United States Patent 7,374,927 (METHODS OF ANALYSIS OF DEGRADED NUCLEIC ACID SAMPLES) - sequence listing, part 7

SEQ ID NO: 240310 - DNA, 25 bp, Homo sapien
acctagcacactaactgcaccagtt

SEQ ID NO: 240311 - DNA, 25 bp, Homo sapien
tgcaccagttaataggccacgcttt

SEQ ID NO: 240312 - DNA, 25 bp, Homo sapien
taataggccacgcttttctccagag

SEQ ID NO: 240313 - DNA, 25 bp, Homo sapien
gagccattggctgaagagttcaaat

SEQ ID NO: 240314 - DNA, 25 bp, Homo sapien
aataggctatccaaaacagtaggct

SEQ ID NO: 240315 - DNA, 25 bp, Homo sapien
gaataaatacagcacccttctctac

SEQ ID NO: 240316 - DNA, 25 bp, Homo sapien
gcacccttctctacccaagttagga

SEQ ID NO: 240317 - DNA, 25 bp, Homo sapien
gatcctctagctttggctttccaaa

SEQ ID NO: 240318 - DNA, 25 bp, Homo sapien
tttggctttccaaagattaccagca

SEQ ID NO: 240319 - DNA, 25 bp, Homo sapien
ggctttccaaagattaccagcatca

SEQ ID NO: 240320 - DNA, 25 bp, Homo sapien
caaagattaccagcatcatccacag

SEQ ID NO: 240321 - DNA, 25 bp, Homo sapien
atcatccacagcatctggcccagag

SEQ ID NO: 240322 - DNA, 25 bp, Homo sapien
cagcatctggcccagagggaatatt

SEQ ID NO: 240323 - DNA, 25 bp, Homo sapien
tattttaaatgctctcctctctctg

SEQ ID NO: 240324 - DNA, 25 bp, Homo sapien
tctggcttaccctcaagctggctta

SEQ ID NO: 240325 - DNA, 25 bp, Homo sapien
tcaagctggcttaacttcagacact

SEQ ID NO: 240326 - DNA, 25 bp, Homo sapien
gctggcttaacttcagacactgaga

SEQ ID NO: 240327 - DNA, 25 bp, Homo sapien
ttcagacactgagaagtgagatcac

SEQ ID NO: 240328 - DNA, 25 bp, Homo sapien
taagaccttataagtctacttttat

SEQ ID NO: 240329 - DNA, 25 bp, Homo sapien
atttccagtggacagcaactactta

SEQ ID NO: 240330 - DNA, 25 bp, Homo sapien
ggacagcaactacttaatcgtctta

SEQ ID NO: 240331 - DNA, 25 bp, Homo sapien
tactttacaatattacctgttggat

SEQ ID NO: 240332 - DNA, 25 bp, Homo sapien
cctgttggatttattatctgtgtac

SEQ ID NO: 240333 - DNA, 25 bp, Homo sapien
acaaatcagttagttgaagggccaa

SEQ ID NO: 240334 - DNA, 25 bp, Homo sapien
atggtcatggagactagctactcta

SEQ ID NO: 240335 - DNA, 25 bp, Homo sapien
ggagactagctactctagaaaattg

SEQ ID NO: 240336 - DNA, 25 bp, Homo sapien
tactgtattaagttactatctggta

SEQ ID NO: 240337 - DNA, 25 bp, Homo sapien
tactatctggtataacttcaattaa

SEQ ID NO: 240338 - DNA, 25 bp, Homo sapien
gtagcagagatctagatatagttta

SEQ ID NO: 240339 - DNA, 25 bp, Homo sapien
gttcgcaagcgctggctgcccaaga

SEQ ID NO: 240340 - DNA, 25 bp, Homo sapien
cgctggctgcccaagatcaagtcca

SEQ ID NO: 240341 - DNA, 25 bp, Homo sapien
agccgggtcctgaacgctgtgaaat

SEQ ID NO: 240342 - DNA, 25 bp, Homo sapien
gcgtggagatgtaccgcacggtcat

SEQ ID NO: 240343 - DNA, 25 bp, Homo sapien
atgtaccgcacggtcatgggctccg

SEQ ID NO: 240344 - DNA, 25 bp, Homo sapien
ggtcctgaacgctgtgaaattgtac

SEQ ID NO: 240345 - DNA, 25 bp, Homo sapien
gccgcggcacaggtgttcgagcaac

SEQ ID NO: 240346 - DNA, 25 bp, Homo sapien
aggtgttcgagcaacgcatctacgc

SEQ ID NO: 240347 - DNA, 25 bp, Homo sapien
gagcaacgcatctacgccgagcggc

SEQ ID NO: 240348 - DNA, 25 bp, Homo sapien
aattgtactgtcagaacttcgcccc

SEQ ID NO: 240349 - DNA, 25 bp, Homo sapien
gagatgaacgtgatcgccgcggaca

SEQ ID NO: 240350 - DNA, 25 bp, Homo sapien
tacagctacaatctttttctgctct

SEQ ID NO: 240351 - DNA, 25 bp, Homo sapien
tgaacagtcgccttccaacacaagc

SEQ ID NO: 240352 - DNA, 25 bp, Homo sapien
tcgccttccaacacaagcaacaata

SEQ ID NO: 240353 - DNA, 25 bp, Homo sapien
taaagtttagtctacggtcctcaga

SEQ ID NO: 240354 - DNA, 25 bp, Homo sapien
tttagtctacggtcctcagagctgc

SEQ ID NO: 240355 - DNA, 25 bp, Homo sapien
tacggtcctcagagctgccggaaga

SEQ ID NO: 240356 - DNA, 25 bp, Homo sapien
tcagagctgccggaagagaagaatc

SEQ ID NO: 240357 - DNA, 25 bp, Homo sapien
gatggaagttcactgtaagctccta

SEQ ID NO: 240358 - DNA, 25 bp, Homo sapien
agttcactgtaagctcctataaccc

SEQ ID NO: 240359 - DNA, 25 bp, Homo sapien
cgtgcacatgggtgaagaagctgtt

SEQ ID NO: 240360 - DNA, 25 bp, Homo sapien
tgttgaaaatacagctacaatcttt

SEQ ID NO: 240361 - DNA, 25 bp, Homo sapien
gagagctgccggagaccctgaaaaa

SEQ ID NO: 240362 - DNA, 25 bp, Homo sapien
gggctgacgaatggaatcacccaag

SEQ ID NO: 240363 - DNA, 25 bp, Homo sapien
gagaggtctctgactctaacaaaac

SEQ ID NO: 240364 - DNA, 25 bp, Homo sapien
tctgactctaacaaaacaccttggg

SEQ ID NO: 240365 - DNA, 25 bp, Homo sapien
gacggagctccttggctgggataca

SEQ ID NO: 240366 - DNA, 25 bp, Homo sapien
gatcttttagtgaattgctgccggc

SEQ ID NO: 240367 - DNA, 25 bp, Homo sapien
ttgctgccggcttctaaggcctgga

SEQ ID NO: 240368 - DNA, 25 bp, Homo sapien
cggagcaaactctggcggatagttg

SEQ ID NO: 240369 - DNA, 25 bp, Homo sapien
atagttgtgagtaatccctggtcct

SEQ ID NO: 240370 - DNA, 25 bp, Homo sapien
gagtaatccctggtccttggaataa

SEQ ID NO: 240371 - DNA, 25 bp, Homo sapien
ccttggaataagtgtcgacctgaga

SEQ ID NO: 240372 - DNA, 25 bp, Homo sapien
ttctgatgaagccactccgatgagc

SEQ ID NO: 240373 - DNA, 25 bp, Homo sapien
actccgatgagcctgtgaggcacat

SEQ ID NO: 240374 - DNA, 25 bp, Homo sapien
tgaggcacattgtcttcacactgtg

SEQ ID NO: 240375 - DNA, 25 bp, Homo sapien
atggcagccggcaatggcctcacag

SEQ ID NO: 240376 - DNA, 25 bp, Homo sapien
gcctcacagtgacaaatgcgtctgc

SEQ ID NO: 240377 - DNA, 25 bp, Homo sapien
atgcgtctgccttttgacccagaat

SEQ ID NO: 240378 - DNA, 25 bp, Homo sapien
agaattctacccctgagagtgcgtc

SEQ ID NO: 240379 - DNA, 25 bp, Homo sapien
gtgcgtcctacagatgcttgcaagt

SEQ ID NO: 240380 - DNA, 25 bp, Homo sapien
gatgcttgcaagtggtatggtaatg

SEQ ID NO: 240381 - DNA, 25 bp, Homo sapien
tgagaactcctgtgtgaattaaatc

SEQ ID NO: 240382 - DNA, 25 bp, Homo sapien
gaattaaatcacgaccttctgatga

SEQ ID NO: 240383 - DNA, 25 bp, Homo sapien
ttccccatctgagcagagcagggag

SEQ ID NO: 240384 - DNA, 25 bp, Homo sapien
cccatctgagcagagcagggaggcc

SEQ ID NO: 240385 - DNA, 25 bp, Homo sapien
gaggcccttttgtaagtccctgaat

SEQ ID NO: 240386 - DNA, 25 bp, Homo sapien
gcccttttgtaagtccctgaattga

SEQ ID NO: 240387 - DNA, 25 bp, Homo sapien
tttgtaagtccctgaattgaagcac

SEQ ID NO: 240388 - DNA, 25 bp, Homo sapien
tgaggagagtcacagcccacagcct

SEQ ID NO: 240389 - DNA, 25 bp, Homo sapien
acagcccacagcctgattctagaag

SEQ ID NO: 240390 - DNA, 25 bp, Homo sapien
gcccacagcctgattctagaagttt

SEQ ID NO: 240391 - DNA, 25 bp, Homo sapien
acagcctgattctagaagtttcctt

SEQ ID NO: 240392 - DNA, 25 bp, Homo sapien
ttcctttgggaggctcttcgggcct

SEQ ID NO: 240393 - DNA, 25 bp, Homo sapien
tgaaagtggcaagaaggtgtttttt

SEQ ID NO: 240394 - DNA, 25 bp, Homo sapien
ttctgcattccatgagaattaaccg

SEQ ID NO: 240395 - DNA, 25 bp, Homo sapien
gcattccatgagaattaaccggtat

SEQ ID NO: 240396 - DNA, 25 bp, Homo sapien
ttccatgagaattaaccggtataga

SEQ ID NO: 240397 - DNA, 25 bp, Homo sapien
attaaccggtatagaagaggaatcg

SEQ ID NO: 240398 - DNA, 25 bp, Homo sapien
gaggaatcgaggtaaactgtgaact

SEQ ID NO: 240399 - DNA, 25 bp, Homo sapien
atcgaggtaaactgtgaactgtgct

SEQ ID NO: 240400 - DNA, 25 bp, Homo sapien
cgaggtaaactgtgaactgtgctta

SEQ ID NO: 240401 - DNA, 25 bp, Homo sapien
aggtaaactgtgaactgtgcttata

SEQ ID NO: 240402 - DNA, 25 bp, Homo sapien
ttctgatttgtcagctaagctaaat

SEQ ID NO: 240403 - DNA, 25 bp, Homo sapien
gtcagctaagctaaatgttatttct

SEQ ID NO: 240404 - DNA, 25 bp, Homo sapien
gactttgtacaagttgataagttaa

SEQ ID NO: 240405 - DNA, 25 bp, Homo sapien
gaaaggagcaatcattttgaactaa

SEQ ID NO: 240406 - DNA, 25 bp, Homo sapien
aatctttctatgttttttgattact

SEQ ID NO: 240407 - DNA, 25 bp, Homo sapien
gattactattcaacttgctattttt

SEQ ID NO: 240408 - DNA, 25 bp, Homo sapien
gcgaagtttcaatagtgttcatctc

SEQ ID NO: 240409 - DNA, 25 bp, Homo sapien
gtgttcatctcaaatcttattgctt

SEQ ID NO: 240410 - DNA, 25 bp, Homo sapien
aatcttattgctttacaaccgtggt

SEQ ID NO: 240411 - DNA, 25 bp, Homo sapien
tacaaccgtggtacacctttcatta

SEQ ID NO: 240412 - DNA, 25 bp, Homo sapien
taaaaagatgaagcagtcaatccag

SEQ ID NO: 240413 - DNA, 25 bp, Homo sapien
cagtgattaatttgacatggctttc

SEQ ID NO: 240414 - DNA, 25 bp, Homo sapien
atttgacatggctttcattgggaaa

SEQ ID NO: 240415 - DNA, 25 bp, Homo sapien
agggctggcaaagagaccaatagac

SEQ ID NO: 240416 - DNA, 25 bp, Homo sapien
aaatcagtgacaaccataactggtt

SEQ ID NO: 240417 - DNA, 25 bp, Homo sapien
taactggtttattatttacaatgct

SEQ ID NO: 240418 - DNA, 25 bp, Homo sapien
aaacacttattctttcaattatagg

SEQ ID NO: 240419 - DNA, 25 bp, Homo sapien
ttctttcaattataggtgaccaaac

SEQ ID NO: 240420 - DNA, 25 bp, Homo sapien
aaatagggtcaacaggcctcctttg

SEQ ID NO: 240421 - DNA, 25 bp, Homo sapien
atagggtcaacaggcctcctttgtc

SEQ ID NO: 240422 - DNA, 25 bp, Homo sapien
tggaagggttcaagggcttccataa

SEQ ID NO: 240423 - DNA, 25 bp, Homo sapien
gaaaactagatctcacattggccgt

SEQ ID NO: 240424 - DNA, 25 bp, Homo sapien
agagtgataaacagctactaacgtt

SEQ ID NO: 240425 - DNA, 25 bp, Homo sapien
tataatgcatgtgataactggtggt

SEQ ID NO: 240426 - DNA, 25 bp, Homo sapien
gtgataactggtggtggttcttgaa

SEQ ID NO: 240427 - DNA, 25 bp, Homo sapien
acgagttctctaagatgcagttaat

SEQ ID NO: 240428 - DNA, 25 bp, Homo sapien
gatgcagttaatcatacctgtctta

SEQ ID NO: 240429 - DNA, 25 bp, Homo sapien
gttaatcatacctgtcttaaacaaa

SEQ ID NO: 240430 - DNA, 25 bp, Homo sapien
attgaactgagtggcaatgaagaca

SEQ ID NO: 240431 - DNA, 25 bp, Homo sapien
aaactgtaattcagttaagcccaca

SEQ ID NO: 240432 - DNA, 25 bp, Homo sapien
ttcagttaagcccacaattagaagg

SEQ ID NO: 240433 - DNA, 25 bp, Homo sapien
agcccacaattagaaggaactttag

SEQ ID NO: 240434 - DNA, 25 bp, Homo sapien
ctttagcttttattggttcaccaca

SEQ ID NO: 240435 - DNA, 25 bp, Homo sapien
agcttttattggttcaccacaattt

SEQ ID NO: 240436 - DNA, 25 bp, Homo sapien
tattggttcaccacaattttttaag

SEQ ID NO: 240437 - DNA, 25 bp, Homo sapien
gaaatcaaccaatgattgttcagtt

SEQ ID NO: 240438 - DNA, 25 bp, Homo sapien
agaacacttctttatttgagggact

SEQ ID NO: 240439 - DNA, 25 bp, Homo sapien
ttgagggactttcccaacaccaggt

SEQ ID NO: 240440 - DNA, 25 bp, Homo sapien
atttcttagagatcaccaaccgact

SEQ ID NO: 240441 - DNA, 25 bp, Homo sapien
accgactccctcactgtgaaattaa

SEQ ID NO: 240442 - DNA, 25 bp, Homo sapien
aacagcgaaccatgtagcttcacct

SEQ ID NO: 240443 - DNA, 25 bp, Homo sapien
tagcttcacctgactcagtgctggg

SEQ ID NO: 240444 - DNA, 25 bp, Homo sapien
tctaccatctactgtgcttgtgtca

SEQ ID NO: 240445 - DNA, 25 bp, Homo sapien
gcttgtgtcatgatgctttttctct

SEQ ID NO: 240446 - DNA, 25 bp, Homo sapien
gatgctttttctctgaagtggtgtg

SEQ ID NO: 240447 - DNA, 25 bp, Homo sapien
aggccctctctacttttaccagcaa

SEQ ID NO: 240448 - DNA, 25 bp, Homo sapien
taccagcaactgatcatgtctttca

SEQ ID NO: 240449 - DNA, 25 bp, Homo sapien
aaggaaggcctttacatgagctaaa

SEQ ID NO: 240450 - DNA, 25 bp, Homo sapien
ggcctttacatgagctaaatgtcct

SEQ ID NO: 240451 - DNA, 25 bp, Homo sapien
atgagctaaatgtcctgcaacttgg

SEQ ID NO: 240452 - DNA, 25 bp, Homo sapien
agctaaatgtcctgcaacttggaat

SEQ ID NO: 240453 - DNA, 25 bp, Homo sapien
tgcaacttggaatggaagctaaagt

SEQ ID NO: 240454 - DNA, 25 bp, Homo sapien
cctatgacatgactgctaaagctta

SEQ ID NO: 240455 - DNA, 25 bp, Homo sapien
gacatgactgctaaagcttatctaa

SEQ ID NO: 240456 - DNA, 25 bp, Homo sapien
aaaaaattagtatgcagtgctttga

SEQ ID NO: 240457 - DNA, 25 bp, Homo sapien
gctttgatttcactgactctaaagg

SEQ ID NO: 240458 - DNA, 25 bp, Homo sapien
tcactgactctaaaggggaacctct

SEQ ID NO: 240459 - DNA, 25 bp, Homo sapien
ggggaacctcttcacattattaact

SEQ ID NO: 240460 - DNA, 25 bp, Homo sapien
atttgagtgcttttaacgtgttgaa

SEQ ID NO: 240461 - DNA, 25 bp, Homo sapien
tctgcccttttaaatatagtggtgc

SEQ ID NO: 240462 - DNA, 25 bp, Homo sapien
gtgctgtctttgtttccaattggaa

SEQ ID NO: 240463 - DNA, 25 bp, Homo sapien
ccaattggaatttcagtgtaatgca

SEQ ID NO: 240464 - DNA, 25 bp, Homo sapien
gtgtaatgcactgttctcacttcag

SEQ ID NO: 240465 - DNA, 25 bp, Homo sapien
taatgcactgttctcacttcagatg

SEQ ID NO: 240466 - DNA, 25 bp, Homo sapien
aatagtgaagttgatatggccctgt

SEQ ID NO: 240467 - DNA, 25 bp, Homo sapien
gttgatatggccctgttcagccaaa

SEQ ID NO: 240468 - DNA, 25 bp, Homo sapien
ttcagccaaatttccgaatcataaa

SEQ ID NO: 240469 - DNA, 25 bp, Homo sapien
tttccgaatcataaagtgacatgct

SEQ ID NO: 240470 - DNA, 25 bp, Homo sapien
ctaataggatatactgtggcatttc

SEQ ID NO: 240471 - DNA, 25 bp, Homo sapien
acactgtctgaattaactagactgc

SEQ ID NO: 240472 - DNA, 25 bp, Homo sapien
actagactgcaataattctttcttt

SEQ ID NO: 240473 - DNA, 25 bp, Homo sapien
ttccattgtcaattagttatactca

SEQ ID NO: 240474 - DNA, 25 bp, Homo sapien
tatactcattttcctgccttgatct

SEQ ID NO: 240475 - DNA, 25 bp, Homo sapien
cctgccttgatctttcattagatat

SEQ ID NO: 240476 - DNA, 25 bp, Homo sapien
gtatctgcttggaatatattatctt

SEQ ID NO: 240477 - DNA, 25 bp, Homo sapien
atcttctttttaactgtgtaattgg

SEQ ID NO: 240478 - DNA, 25 bp, Homo sapien
ttactaaaactctgtaatctccaaa

SEQ ID NO: 240479 - DNA, 25 bp, Homo sapien
attgctatcaaattacacaccatgt

SEQ ID NO: 240480 - DNA, 25 bp, Homo sapien
cacaccatgttttctatcattctca

SEQ ID NO: 240481 - DNA, 25 bp, Homo sapien
atcattctcatagatctgccttata

SEQ ID NO: 240482 - DNA, 25 bp, Homo sapien
aaccatctccttaaagattattttg

SEQ ID NO: 240483 - DNA, 25 bp, Homo sapien
accatctccttaaagattattttga

SEQ ID NO: 240484 - DNA, 25 bp, Homo sapien
aaagataaatctcattcataaaaag

SEQ ID NO: 240485 - DNA, 25 bp, Homo sapien
gataaatctcattcataaaaagaca

SEQ ID NO: 240486 - DNA, 25 bp, Homo sapien
aatctcattcataaaaagacatggt

SEQ ID NO: 240487 - DNA, 25 bp, Homo sapien
atctcattcataaaaagacatggtg

SEQ ID NO: 240488 - DNA, 25 bp, Homo sapien
gtaaattcagactcattttacatga

SEQ ID NO: 240489 - DNA, 25 bp, Homo sapien
taaattcagactcattttacatgat

SEQ ID NO: 240490 - DNA, 25 bp, Homo sapien
cagactcattttacatgatatattt

SEQ ID NO: 240491 - DNA, 25 bp, Homo sapien
tctaaaccctcttattaaaaatatg

SEQ ID NO: 240492 - DNA, 25 bp, Homo sapien
tgttcttcaaaaaagtgtacaaaag

SEQ ID NO: 240493 - DNA, 25 bp, Homo sapien
tcagaagtgacgtttgttggcagat

SEQ ID NO: 240494 - DNA, 25 bp, Homo sapien
gtttgttggcagatggctccctgtc

SEQ ID NO: 240495 - DNA, 25 bp, Homo sapien
ttgttcaccctttcttgcttccgag

SEQ ID NO: 240496 - DNA, 25 bp, Homo sapien
ggcagtcactcatggactggccagt

SEQ ID NO: 240497 - DNA, 25 bp, Homo sapien
tggccagtggacaggccctttctat

SEQ ID NO: 240498 - DNA, 25 bp, Homo sapien
gccctttctataagaacccagccag

SEQ ID NO: 240499 - DNA, 25 bp, Homo sapien
gcttcatccagggagctagaaatag

SEQ ID NO: 240500 - DNA, 25 bp, Homo sapien
ttcttgcttccgaggctgcattcaa

SEQ ID NO: 240501 - DNA, 25 bp, Homo sapien
gaaatagggtttgcactgatgtgtg

SEQ ID NO: 240502 - DNA, 25 bp, Homo sapien
gaggctgcattcaagccccaatgag

SEQ ID NO: 240503 - DNA, 25 bp, Homo sapien
gccccaatgagaacaaaaccatgtg

SEQ ID NO: 240504 - DNA, 25 bp, Homo sapien
gctcaggttgtacctaatatacctc

SEQ ID NO: 240505 - DNA, 25 bp, Homo sapien
aatatacctctaaagaaggccattc

SEQ ID NO: 240506 - DNA, 25 bp, Homo sapien
aaggccattcacatagacttcgatg

SEQ ID NO: 240507 - DNA, 25 bp, Homo sapien
gacttcgatgtgaatggagttcctt

SEQ ID NO: 240508 - DNA, 25 bp, Homo sapien
ggagttccttagacgcagcatgaca

SEQ ID NO: 240509 - DNA, 25 bp, Homo sapien
ttagacgcagcatgacatgcaccat

SEQ ID NO: 240510 - DNA, 25 bp, Homo sapien
tcccagagaagtcggctaagtccca

SEQ ID NO: 240511 - DNA, 25 bp, Homo sapien
cacttagtaccataatctctgcctc

SEQ ID NO: 240512 - DNA, 25 bp, Homo sapien
atctctgcctccagcaaaacatgct

SEQ ID NO: 240513 - DNA, 25 bp, Homo sapien
aaacatgctggctttgtcctgagcc

SEQ ID NO: 240514 - DNA, 25 bp, Homo sapien
aactgaaacttggattccatataaa

SEQ ID NO: 240515 - DNA, 25 bp, Homo sapien
catctcccatttcagtgaataggaa

SEQ ID NO: 240516 - DNA, 25 bp, Homo sapien
ccatttcagtgaataggaacgcccc

SEQ ID NO: 240517 - DNA, 25 bp, Homo sapien
ccccaagccatgaacgtgggcataa

SEQ ID NO: 240518 - DNA, 25 bp, Homo sapien
gtgggcataatccaatgtcgtcctg

SEQ ID NO: 240519 - DNA, 25 bp, Homo sapien
ataatccaatgtcgtcctgcttggc

SEQ ID NO: 240520 - DNA, 25 bp, Homo sapien
aatgtcgtcctgcttggcgagccca

SEQ ID NO: 240521 - DNA, 25 bp, Homo sapien
ttggcgagcccaatcaccaagcttc

SEQ ID NO: 240522 - DNA, 25 bp, Homo sapien
aatcaccaagcttcctgaacagcaa

SEQ ID NO: 240523 - DNA, 25 bp, Homo sapien
agcttcctgaacagcaactaaccac

SEQ ID NO: 240524 - DNA, 25 bp, Homo sapien
tcacctagactcatcatggcactga

SEQ ID NO: 240525 - DNA, 25 bp, Homo sapien
gactcatcatggcactgacagagga

SEQ ID NO: 240526 - DNA, 25 bp, Homo sapien
agggcaggtcgtataatggcatatt

SEQ ID NO: 240527 - DNA, 25 bp, Homo sapien
tagacttaatctagaacccctgtag

SEQ ID NO: 240528 - DNA, 25 bp, Homo sapien
tagaacccctgtagctttttgatgt

SEQ ID NO: 240529 - DNA, 25 bp, Homo sapien
tcttatctctttgaattcctgtttg

SEQ ID NO: 240530 - DNA, 25 bp, Homo sapien
tcctgtttggttacttggcttccaa

SEQ ID NO: 240531 - DNA, 25 bp, Homo sapien
cttggcttccaatggaggtgaactt

SEQ ID NO: 240532 - DNA, 25 bp, Homo sapien
ggtgaacttaacaaccatacttgaa

SEQ ID NO: 240533 - DNA, 25 bp, Homo sapien
atacttgaatattccgtcttgactt

SEQ ID NO: 240534 - DNA, 25 bp, Homo sapien
gtcttgactttgtaaactgtggcta

SEQ ID NO: 240535 - DNA, 25 bp, Homo sapien
gaatggtagatttttgcaatgtctc

SEQ ID NO: 240536 - DNA, 25 bp, Homo sapien
gcaatgtctcaaggcaataggatgt

SEQ ID NO: 240537 - DNA, 25 bp, Homo sapien
tggctttacccaaaccccaccagtg

SEQ ID NO: 240538 - DNA, 25 bp, Homo sapien
cccaccagtgccctactcccgcaat

SEQ ID NO: 240539 - DNA, 25 bp, Homo sapien
ccaccagtgccctactcccgcaatc

SEQ ID NO: 240540 - DNA, 25 bp, Homo sapien
caccagtgccctactcccgcaatcc

SEQ ID NO: 240541 - DNA, 25 bp, Homo sapien
accagtgccctactcccgcaatccc

SEQ ID NO: 240542 - DNA, 25 bp, Homo sapien
ccagtgccctactcccgcaatcccc

SEQ ID NO: 240543 - DNA, 25 bp, Homo sapien
cagcacagctgtaattggggctgag

SEQ ID NO: 240544 - DNA, 25 bp, Homo sapien
gctgagggtaacgaccagcgccaac

SEQ ID NO: 240545 - DNA, 25 bp, Homo sapien
ctgagggtaacgaccagcgccaacc

SEQ ID NO: 240546 - DNA, 25 bp, Homo sapien
tgagggtaacgaccagcgccaaccc

SEQ ID NO: 240547 - DNA, 25 bp, Homo sapien
gcatgtgtgggaaaaagccggaaaa

SEQ ID NO: 240548 - DNA, 25 bp, Homo sapien
gtgctgggtctctagagaagttttt

SEQ ID NO: 240549 - DNA, 25 bp, Homo sapien
tatttgttacaatactgctgctttg

SEQ ID NO: 240550 - DNA, 25 bp, Homo sapien
atactgctgctttgagcaattttgt

SEQ ID NO: 240551 - DNA, 25 bp, Homo sapien
tgtttctcttcattgtctgttaggg

SEQ ID NO: 240552 - DNA, 25 bp, Homo sapien
caccagctttggcatcttaacaaca

SEQ ID NO: 240553 - DNA, 25 bp, Homo sapien
acaacaaacagtggatgggtaattt

SEQ ID NO: 240554 - DNA, 25 bp, Homo sapien
tttctgatacgcatctttagagtca

SEQ ID NO: 240555 - DNA, 25 bp, Homo sapien
aaatatatcttttccctgtactcct

SEQ ID NO: 240556 - DNA, 25 bp, Homo sapien
ttttccctgtactcctcatgtacaa

SEQ ID NO: 240557 - DNA, 25 bp, Homo sapien
gtactcctcatgtacaaccaaagaa

SEQ ID NO: 240558 - DNA, 25 bp, Homo sapien
ctggaaacacaacattttcctctgg

SEQ ID NO: 240559 - DNA, 25 bp, Homo sapien
tagcaaataaggttggcagtcaatt

SEQ ID NO: 240560 - DNA, 25 bp, Homo sapien
cagtcaattgacagaggaagcttaa

SEQ ID NO: 240561 - DNA, 25 bp, Homo sapien
ataatttaatccttttcaggtgtgt

SEQ ID NO: 240562 - DNA, 25 bp, Homo sapien
gtgtgttaatttctttcgtggacca

SEQ ID NO: 240563 - DNA, 25 bp, Homo sapien
tctttcgtggaccaaattaccatgg

SEQ ID NO: 240564 - DNA, 25 bp, Homo sapien
gaccaaattaccatggacctggaat

SEQ ID NO: 240565 - DNA, 25 bp, Homo sapien
atagttgagattttccctaaggtct

SEQ ID NO: 240566 - DNA, 25 bp, Homo sapien
attttccctaaggtctggctgtact

SEQ ID NO: 240567 - DNA, 25 bp, Homo sapien
aggctcaggttcactgcacactaat

SEQ ID NO: 240568 - DNA, 25 bp, Homo sapien
tgcacactaatttgcagcaggaagt

SEQ ID NO: 240569 - DNA, 25 bp, Homo sapien
agcaggaagtgctaggaagcccgat

SEQ ID NO: 240570 - DNA, 25 bp, Homo sapien
atgtatgttttacctccttaaaatg

SEQ ID NO: 240571 - DNA, 25 bp, Homo sapien
tatgttttacctccttaaaatgcct

SEQ ID NO: 240572 - DNA, 25 bp, Homo sapien
tggtttaacctatacacaatgatta

SEQ ID NO: 240573 - DNA, 25 bp, Homo sapien
aatgaaaaccattccttgcccaatg

SEQ ID NO: 240574 - DNA, 25 bp, Homo sapien
gaaaaccattccttgcccaatggat

SEQ ID NO: 240575 - DNA, 25 bp, Homo sapien
cattccttgcccaatggatgtataa

SEQ ID NO: 240576 - DNA, 25 bp, Homo sapien
cttgcccaatggatgtataaatttt

SEQ ID NO: 240577 - DNA, 25 bp, Homo sapien
actattaaaatatcccatgctttga

SEQ ID NO: 240578 - DNA, 25 bp, Homo sapien
aaatatcccatgctttgatcaggtg

SEQ ID NO: 240579 - DNA, 25 bp, Homo sapien
atcccatgctttgatcaggtggtac

SEQ ID NO: 240580 - DNA, 25 bp, Homo sapien
ccatgctttgatcaggtggtacatc

SEQ ID NO: 240581 - DNA, 25 bp, Homo sapien
tcctaacccctgaggtgatggtttt

SEQ ID NO: 240582 - DNA, 25 bp, Homo sapien
ctaacccctgaggtgatggttttag

SEQ ID NO: 240583 - DNA, 25 bp, Homo sapien
taacccctgaggtgatggttttagg

SEQ ID NO: 240584 - DNA, 25 bp, Homo sapien
acccctgaggtgatggttttaggag

SEQ ID NO: 240585 - DNA, 25 bp, Homo sapien
cccctgaggtgatggttttaggagg

SEQ ID NO: 240586 - DNA, 25 bp, Homo sapien
ccctgaggtgatggttttaggaggt

SEQ ID NO: 240587 - DNA, 25 bp, Homo sapien
cctgaggtgatggttttaggaggtg

SEQ ID NO: 240588 - DNA, 25 bp, Homo sapien
ctgaggtgatggttttaggaggtgg

SEQ ID NO: 240589 - DNA, 25 bp, Homo sapien
cctcatcaatgggattagtccctta

SEQ ID NO: 240590 - DNA, 25 bp, Homo sapien
ctcatcaatgggattagtcccttat

SEQ ID NO: 240591 - DNA, 25 bp, Homo sapien
tgaggatttccactccattgctggg

SEQ ID NO: 240592 - DNA, 25 bp, Homo sapien
ggacagtgacttggactctgatgaa

SEQ ID NO: 240593 - DNA, 25 bp, Homo sapien
gactctgatgaatgaggcttccttt

SEQ ID NO: 240594 - DNA, 25 bp, Homo sapien
tgatgaatgaggcttcctttgggcc

SEQ ID NO: 240595 - DNA, 25 bp, Homo sapien
cagtatctgatcctgaaatcatgaa

SEQ ID NO: 240596 - DNA, 25 bp, Homo sapien
tgaaattaactaacaccttagcctt

SEQ ID NO: 240597 - DNA, 25 bp, Homo sapien
taataaatcacctctcctaatcttc

SEQ ID NO: 240598 - DNA, 25 bp, Homo sapien
gggcaatgtcaccctttgatttaaa

SEQ ID NO: 240599 - DNA, 25 bp, Homo sapien
tgggccgagcgtactaagccaggtc

SEQ ID NO: 240600 - DNA, 25 bp, Homo sapien
actaagccaggtccacctgtcagag

SEQ ID NO: 240601 - DNA, 25 bp, Homo sapien
ggacagtgaggatttccactccatt

SEQ ID NO: 240602 - DNA, 25 bp, Homo sapien
tgagtagacgataccatgctgtagg

SEQ ID NO: 240603 - DNA, 25 bp, Homo sapien
ggccctgtgtaggtaccaattttca

SEQ ID NO: 240604 - DNA, 25 bp, Homo sapien
ggtaccaattttcagcttgccagtc

SEQ ID NO: 240605 - DNA, 25 bp, Homo sapien
gcttgccagtcttctgtatgaagaa

SEQ ID NO: 240606 - DNA, 25 bp, Homo sapien
gtatatgtggcactctgctgagaga

SEQ ID NO: 240607 - DNA, 25 bp, Homo sapien
actttatcatcctatcacaatcctc

SEQ ID NO: 240608 - DNA, 25 bp, Homo sapien
ctacttggccagacagccaaatgaa

SEQ ID NO: 240609 - DNA, 25 bp, Homo sapien
tgaatggcacttactcttttcaatt

SEQ ID NO: 240610 - DNA, 25 bp, Homo sapien
gagattaccaaagctctcactgtga

SEQ ID NO: 240611 - DNA, 25 bp, Homo sapien
caaagctctcactgtgaggtctgag

SEQ ID NO: 240612 - DNA, 25 bp, Homo sapien
gtgacttacctcctgagtagacgat

SEQ ID NO: 240613 - DNA, 25 bp, Homo sapien
gctttggtttgttctcactatgcac

SEQ ID NO: 240614 - DNA, 25 bp, Homo sapien
ttggtttgttctcactatgcacttt

SEQ ID NO: 240615 - DNA, 25 bp, Homo sapien
gtttgttctcactatgcactttgga

SEQ ID NO: 240616 - DNA, 25 bp, Homo sapien
gttctcactatgcactttggattta

SEQ ID NO: 240617 - DNA, 25 bp, Homo sapien
gacaatattgactaaatctcctgag

SEQ ID NO: 240618 - DNA, 25 bp, Homo sapien
atattgactaaatctcctgagcata

SEQ ID NO: 240619 - DNA, 25 bp, Homo sapien
gactaaatctcctgagcatattcag

SEQ ID NO: 240620 - DNA, 25 bp, Homo sapien
tgagcatattcaggcagtcaggtct

SEQ ID NO: 240621 - DNA, 25 bp, Homo sapien
catattcaggcagtcaggtctgcac

SEQ ID NO: 240622 - DNA, 25 bp, Homo sapien
ctgcactgtgatagcaacctagaga

SEQ ID NO: 240623 - DNA, 25 bp, Homo sapien
gcaacctagagaaggagaatgcttt

SEQ ID NO: 240624 - DNA, 25 bp, Homo sapien
ttccccatctgagcagagcagggag

SEQ ID NO: 240625 - DNA, 25 bp, Homo sapien
gaggcccttttgtaagtccctgaat

SEQ ID NO: 240626 - DNA, 25 bp, Homo sapien
gcccttttgtaagtccctgaattga

SEQ ID NO: 240627 - DNA, 25 bp, Homo sapien
tttgtaagtccctgaattgaagcac

SEQ ID NO: 240628 - DNA, 25 bp, Homo sapien
cctctgcgtggctttgctgaggaga

SEQ ID NO: 240629 - DNA, 25 bp, Homo sapien
tgaggagagtcacagcccacagcct

SEQ ID NO: 240630 - DNA, 25 bp, Homo sapien
acagcccacagcctgattctagaag

SEQ ID NO: 240631 - DNA, 25 bp, Homo sapien
gcccacagcctgattctagaagttt

SEQ ID NO: 240632 - DNA, 25 bp, Homo sapien
acagcctgattctagaagtttcctt

SEQ ID NO: 240633 - DNA, 25 bp, Homo sapien
tttgggaggctcttcgggcctgcac

SEQ ID NO: 240634 - DNA, 25 bp, Homo sapien
tgaaagtggcaagaaggtgtttttt

SEQ ID NO: 240635 - DNA, 25 bp, Homo sapien
gttgaataaaatttggcccatgttt

SEQ ID NO: 240636 - DNA, 25 bp, Homo sapien
aatttggcccatgttttaattgact

SEQ ID NO: 240637 - DNA, 25 bp, Homo sapien
gttttaattgactctaggcacctct

SEQ ID NO: 240638 - DNA, 25 bp, Homo sapien
attgactctaggcacctctattgaa

SEQ ID NO: 240639 - DNA, 25 bp, Homo sapien
ggcacctctattgaaataagtctga

SEQ ID NO: 240640 - DNA, 25 bp, Homo sapien
aagtctgaggcatagtttgtgaaac

SEQ ID NO: 240641 - DNA, 25 bp, Homo sapien
ggcatagtttgtgaaacatgtttca

SEQ ID NO: 240642 - DNA, 25 bp, Homo sapien
aaatgctagaaatttacagtacaga

SEQ ID NO: 240643 - DNA, 25 bp, Homo sapien
aataaacctgtagattacagctctg

SEQ ID NO: 240644 - DNA, 25 bp, Homo sapien
acagctctgttcctaagaacctcag

SEQ ID NO: 240645 - DNA, 25 bp, Homo sapien
gaacctcagcctttattgtgtctta

SEQ ID NO: 240646 - DNA, 25 bp, Homo sapien
aggcgcgacggcaccttcaactaca

SEQ ID NO: 240647 - DNA, 25 bp, Homo sapien
ccgacgtgtactgctccaagtacaa

SEQ ID NO: 240648 - DNA, 25 bp, Homo sapien
aagtacaacgaagccaccggcgtgt

SEQ ID NO: 240649 - DNA, 25 bp, Homo sapien
gacggcgacgagtgtccctacctgc

SEQ ID NO: 240650 - DNA, 25 bp, Homo sapien
gagtgtccctacctgcaccggacga

SEQ ID NO: 240651 - DNA, 25 bp, Homo sapien
ggacacagaacgcaagtaccacctg

SEQ ID NO: 240652 - DNA, 25 bp, Homo sapien
aacgcaagtaccacctgcgttacta

SEQ ID NO: 240653 - DNA, 25 bp, Homo sapien
tgcgttactacaaaacaggaacctg

SEQ ID NO: 240654 - DNA, 25 bp, Homo sapien
acgagacagacgcacgtggccactg

SEQ ID NO: 240655 - DNA, 25 bp, Homo sapien
cgcacgtggccactgcgtgaagaat

SEQ ID NO: 240656 - DNA, 25 bp, Homo sapien
gaagaatgggctgcactgtgccttc

SEQ ID NO: 240657 - DNA, 25 bp, Homo sapien
agcatgtcgccagcctcttggtgaa

SEQ ID NO: 240658 - DNA, 25 bp, Homo sapien
tgaaacgcctaaagtgtgctgcccc

SEQ ID NO: 240659 - DNA, 25 bp, Homo sapien
ttctcttgaaagtttacaccgaagg

SEQ ID NO: 240660 - DNA, 25 bp, Homo sapien
caccgaagggatgaggttttgccct

SEQ ID NO: 240661 - DNA, 25 bp, Homo sapien
gcacaaagtcggagtcgctgcggct

SEQ ID NO: 240662 - DNA, 25 bp, Homo sapien
gagtcgctgcggctccgaaatagaa

SEQ ID NO: 240663 - DNA, 25 bp, Homo sapien
agaaacggagttgcccatttcgtat

SEQ ID NO: 240664 - DNA, 25 bp, Homo sapien
ttgcccatttcgtatgcttcatcaa

SEQ ID NO: 240665 - DNA, 25 bp, Homo sapien
gcttcatcaacatctgcttgcattt

SEQ ID NO: 240666 - DNA, 25 bp, Homo sapien
tgcattttgaaatcctagtcttaac

SEQ ID NO: 240667 - DNA, 25 bp, Homo sapien
gaaatggctgccctcctagagggaa

SEQ ID NO: 240668 - DNA, 25 bp, Homo sapien
ctgaacctgttcatggtgcatcaga

SEQ ID NO: 240669 - DNA, 25 bp, Homo sapien
tgaacctgttcatggtgcatcagaa

SEQ ID NO: 240670 - DNA, 25 bp, Homo sapien
gaacctgttcatggtgcatcagaac

SEQ ID NO: 240671 - DNA, 25 bp, Homo sapien
aacctgttcatggtgcatcagaaca

SEQ ID NO: 240672 - DNA, 25 bp, Homo sapien
cctgttcatggtgcatcagaacata

SEQ ID NO: 240673 - DNA, 25 bp, Homo sapien
gttcatggtgcatcagaacataatg

SEQ ID NO: 240674 - DNA, 25 bp, Homo sapien
tggtgcatcagaacataatgctgac

SEQ ID NO: 240675 - DNA, 25 bp, Homo sapien
agtgtggcccgagcctgtgtcctcc

SEQ ID NO: 240676 - DNA, 25 bp, Homo sapien
cctcccttggctggcctcacgatgg

SEQ ID NO: 240677 - DNA, 25 bp, Homo sapien
tccaggccccgtagatgggcaagga

SEQ ID NO: 240678 - DNA, 25 bp, Homo sapien
aggccccgtagatgggcaaggactt

SEQ ID NO: 240679 - DNA, 25 bp, Homo sapien
agaaaagcatttctgttgtgttatt

SEQ ID NO: 240680 - DNA, 25 bp, Homo sapien
acaacataatggttattcacctttt

SEQ ID NO: 240681 - DNA, 25 bp, Homo sapien
ttcagttgacgaatcagcatcttgt

SEQ ID NO: 240682 - DNA, 25 bp, Homo sapien
tgacgaatcagcatcttgttcccat

SEQ ID NO: 240683 - DNA, 25 bp, Homo sapien
gaatcagcatcttgttcccatggtg

SEQ ID NO: 240684 - DNA, 25 bp, Homo sapien
cagcatcttgttcccatggtgataa

SEQ ID NO: 240685 - DNA, 25 bp, Homo sapien
cttgttcccatggtgataacactaa

SEQ ID NO: 240686 - DNA, 25 bp, Homo sapien
gaatatatctatgagggcatgtatt

SEQ ID NO: 240687 - DNA, 25 bp, Homo sapien
atctatgagggcatgtattagttaa

SEQ ID NO: 240688 - DNA, 25 bp, Homo sapien
aacactaacaatacatagctgcaat

SEQ ID NO: 240689 - DNA, 25 bp, Homo sapien
tgtacaatggctgatttaattaaat

SEQ ID NO: 240690 - DNA, 25 bp, Homo sapien
agatgagaagtactgaaagaccttt

SEQ ID NO: 240691 - DNA, 25 bp, Homo sapien
tattcaggtttacatgttagctctc

SEQ ID NO: 240692 - DNA, 25 bp, Homo sapien
acatgttagctctctctcataggga

SEQ ID NO: 240693 - DNA, 25 bp, Homo sapien
tagggagctgccatacctcacagtt

SEQ ID NO: 240694 - DNA, 25 bp, Homo sapien
tacctcacagttcaaagtgtattct

SEQ ID NO: 240695 - DNA, 25 bp, Homo sapien
gttcaaagtgtattctatagatcag

SEQ ID NO: 240696 - DNA, 25 bp, Homo sapien
gtgtattctatagatcagtaacatt

SEQ ID NO: 240697 - DNA, 25 bp, Homo sapien
aacattatactgacatgtaattgca

SEQ ID NO: 240698 - DNA, 25 bp, Homo sapien
gtaattgcaatttactatgcagcaa

SEQ ID NO: 240699 - DNA, 25 bp, Homo sapien
tactatgcagcaaaaatgattcaag

SEQ ID NO: 240700 - DNA, 25 bp, Homo sapien
taacctacagtgtctgtataccttt

SEQ ID NO: 240701 - DNA, 25 bp, Homo sapien
ccctgggtagtatactttagaggtg

SEQ ID NO: 240702 - DNA, 25 bp, Homo sapien
tcatgctgagtggtgacccagtgtg

SEQ ID NO: 240703 - DNA, 25 bp, Homo sapien
gacccagtgtggcacatcctaaata

SEQ ID NO: 240704 - DNA, 25 bp, Homo sapien
tgtttcttaactttgctcttcttaa

SEQ ID NO: 240705 - DNA, 25 bp, Homo sapien
aaaaccagccattggtactgaccat

SEQ ID NO: 240706 - DNA, 25 bp, Homo sapien
ttaggaaaagtgatcaggtggccaa

SEQ ID NO: 240707 - DNA, 25 bp, Homo sapien
ttggtactgaccatcatctcttcat

SEQ ID NO: 240708 - DNA, 25 bp, Homo sapien
catcatctcttcatcaatggcatca

SEQ ID NO: 240709 - DNA, 25 bp, Homo sapien
tcaggtggccaaagtgctgtcacta

SEQ ID NO: 240710 - DNA, 25 bp, Homo sapien
tgtcactaaacagggactggctctg

SEQ ID NO: 240711 - DNA, 25 bp, Homo sapien
actggctctgagaattcaaaccttt

SEQ ID NO: 240712 - DNA, 25 bp, Homo sapien
agacagacggttcaaatctttgcta

SEQ ID NO: 240713 - DNA, 25 bp, Homo sapien
aatctttgctacctcccttaagtat

SEQ ID NO: 240714 - DNA, 25 bp, Homo sapien
acctcccttaagtatctccataaat

SEQ ID NO: 240715 - DNA, 25 bp, Homo sapien
gtatctccataaatgctcttccaag

SEQ ID NO: 240716 - DNA, 25 bp, Homo sapien
ataaatgctcttccaagaaatcctc

SEQ ID NO: 240717 - DNA, 25 bp, Homo sapien
tcctccaaaaggcacttagctccat

SEQ ID NO: 240718 - DNA, 25 bp, Homo sapien
ggcacttagctccatacttatgcat

SEQ ID NO: 240719 - DNA, 25 bp, Homo sapien
agctccatacttatgcattgaattg

SEQ ID NO: 240720 - DNA, 25 bp, Homo sapien
gcattgaattgtttcaccttagcaa

SEQ ID NO: 240721 - DNA, 25 bp, Homo sapien
gtttcaccttagcaatcagttttta

SEQ ID NO: 240722 - DNA, 25 bp, Homo sapien
gcaatcagtttttaagactccaagg

SEQ ID NO: 240723 - DNA, 25 bp, Homo sapien
ccaatccaacactagataaagacta

SEQ ID NO: 240724 - DNA, 25 bp, Homo sapien
taaagactatataggcccatttatt

SEQ ID NO: 240725 - DNA, 25 bp, Homo sapien
gaacttcagaggacactaaggttgg

SEQ ID NO: 240726 - DNA, 25 bp, Homo sapien
ggacactaaggttggatgggatttt

SEQ ID NO: 240727 - DNA, 25 bp, Homo sapien
tggaagttgtacaggtcaatgccac

SEQ ID NO: 240728 - DNA, 25 bp, Homo sapien
aggtcaatgccactccatctattgg

SEQ ID NO: 240729 - DNA, 25 bp, Homo sapien
caatgccactccatctattggctga

SEQ ID NO: 240730 - DNA, 25 bp, Homo sapien
ctattggctgagtttcactaggtta

SEQ ID NO: 240731 - DNA, 25 bp, Homo sapien
gctgagtttcactaggttaatacat

SEQ ID NO: 240732 - DNA, 25 bp, Homo sapien
gatcattttattgactatctgccgt

SEQ ID NO: 240733 - DNA, 25 bp, Homo sapien
gactatctgccgtgtctgtgccatt

SEQ ID NO: 240734 - DNA, 25 bp, Homo sapien
atcagaggtcatatgacgacggagc

SEQ ID NO: 240735 - DNA, 25 bp, Homo sapien
atgacgacggagcagagaaacaact

SEQ ID NO: 240736 - DNA, 25 bp, Homo sapien
ttgaaaactaaagtggcatggccac

SEQ ID NO: 240737 - DNA, 25 bp, Homo sapien
atgccagcagtcagcagaaagcaga

SEQ ID NO: 240738 - DNA, 25 bp, Homo sapien
gaggcaagacacagagtctacccta

SEQ ID NO: 240739 - DNA, 25 bp, Homo sapien
agacacagagtctaccctatagcct

SEQ ID NO: 240740 - DNA, 25 bp, Homo sapien
taccctatagcctcctgagaaagct

SEQ ID NO: 240741 - DNA, 25 bp, Homo sapien
aaagctcagtgttgctgacaccttg

SEQ ID NO: 240742 - DNA, 25 bp, Homo sapien
accttgagtttgacccagtgatgct

SEQ ID NO: 240743 - DNA, 25 bp, Homo sapien
ccagtgatgctgatgtctgacttct

SEQ ID NO: 240744 - DNA, 25 bp, Homo sapien
gtgatgctgatgtctgacttctggc

SEQ ID NO: 240745 - DNA, 25 bp, Homo sapien
agatgagaagtactgaaagaccttt

SEQ ID NO: 240746 - DNA, 25 bp, Homo sapien
tacctcacagttcaaagtgtattct

SEQ ID NO: 240747 - DNA, 25 bp, Homo sapien
cctcacagttcaaagtgtattctat

SEQ ID NO: 240748 - DNA, 25 bp, Homo sapien
gttcaaagtgtattctatagatcag

SEQ ID NO: 240749 - DNA, 25 bp, Homo sapien
gtgtattctatagatcagtaacatt

SEQ ID NO: 240750 - DNA, 25 bp, Homo sapien
gtaacattatactgacatgtaattg

SEQ ID NO: 240751 - DNA, 25 bp, Homo sapien
tatactgacatgtaattgcaattta

SEQ ID NO: 240752 - DNA, 25 bp, Homo sapien
gtaattgcaatttactatgcagcaa

SEQ ID NO: 240753 - DNA, 25 bp, Homo sapien
tactatgcagcaaaaatgattcaag

SEQ ID NO: 240754 - DNA, 25 bp, Homo sapien
aataacctacagtgtctgtatacct

SEQ ID NO: 240755 - DNA, 25 bp, Homo sapien
taacctacagtgtctgtataccttt

SEQ ID NO: 240756 - DNA, 25 bp, Homo sapien
aatggttctcggctcagtgaacttt

SEQ ID NO: 240757 - DNA, 25 bp, Homo sapien
agtgcagatttctgagctttcattt

SEQ ID NO: 240758 - DNA, 25 bp, Homo sapien
ttcatttcctgcctgtaacacggtt

SEQ ID NO: 240759 - DNA, 25 bp, Homo sapien
taacacggttcatcccgagttactc

SEQ ID NO: 240760 - DNA, 25 bp, Homo sapien
cgagttactccctgagtcttcaggc

SEQ ID NO: 240761 - DNA, 25 bp, Homo sapien
ggccaagggcttgtgacttctgcaa

SEQ ID NO: 240762 - DNA, 25 bp, Homo sapien
tgacttctgcaagcgacgtgactgg

SEQ ID NO: 240763 - DNA, 25 bp, Homo sapien
acgtgactggaaaccacgcagcact

SEQ ID NO: 240764 - DNA, 25 bp, Homo sapien
tcacagggatcctagtgtgttctct

SEQ ID NO: 240765 - DNA, 25 bp, Homo sapien
agtgtgttctctgctggtgattccc

SEQ ID NO: 240766 - DNA, 25 bp, Homo sapien
gctccttctgcgctgttgccagggc

SEQ ID NO: 240767 - DNA, 25 bp, Homo sapien
tacccctgtccctcagctgtggtct

SEQ ID NO: 240768 - DNA, 25 bp, Homo sapien
gtctgaatgtgtcccttcaaaattc

SEQ ID NO: 240769 - DNA, 25 bp, Homo sapien
tcctaacccctgaggtgatggtttt

SEQ ID NO: 240770 - DNA, 25 bp, Homo sapien
caaagagctgccttgtccctttcac

SEQ ID NO: 240771 - DNA, 25 bp, Homo sapien
gtccctttcactatgtgaggaagca

SEQ ID NO: 240772 - DNA, 25 bp, Homo sapien
aagaaggtgtcattctatgaaccag

SEQ ID NO: 240773 - DNA, 25 bp, Homo sapien
gaagtgggcccctcaccagagacca

SEQ ID NO: 240774 - DNA, 25 bp, Homo sapien
tgtaccagcaccttagtcttgtact

SEQ ID NO: 240775 - DNA, 25 bp, Homo sapien
gtaccagcaccttagtcttgtactt

SEQ ID NO: 240776 - DNA, 25 bp, Homo sapien
taccagcaccttagtcttgtacttc

SEQ ID NO: 240777 - DNA, 25 bp, Homo sapien
accagcaccttagtcttgtacttcc

SEQ ID NO: 240778 - DNA, 25 bp, Homo sapien
tggccctgcttcagcctgacattgt

SEQ ID NO: 240779 - DNA, 25 bp, Homo sapien
tgcttcagcctgacattgtccaagc

SEQ ID NO: 240780 - DNA, 25 bp, Homo sapien
ttcagcctgacattgtccaagcctc

SEQ ID NO: 240781 - DNA, 25 bp, Homo sapien
ccaggtgggctacattttctgctgt

SEQ ID NO: 240782 - DNA, 25 bp, Homo sapien
aggtgggctacattttctgctgtcc

SEQ ID NO: 240783 - DNA, 25 bp, Homo sapien
tgggctacattttctgctgtcccgg

SEQ ID NO: 240784 - DNA, 25 bp, Homo sapien
ggctacattttctgctgtcccggtc

SEQ ID NO: 240785 - DNA, 25 bp, Homo sapien
tttctccttaaatctgatttcactg

SEQ ID NO: 240786 - DNA, 25 bp, Homo sapien
ttaaatctgatttcactgtgagggt

SEQ ID NO: 240787 - DNA, 25 bp, Homo sapien
atctgatttcactgtgagggtggga

SEQ ID NO: 240788 - DNA, 25 bp, Homo sapien
ctcttccccttacttggtaagcaca

SEQ ID NO: 240789 - DNA, 25 bp, Homo sapien
aacaaaaataacctagatcagaagt

SEQ ID NO: 240790 - DNA, 25 bp, Homo sapien
gatcattttattgactatctgccgt

SEQ ID NO: 240791 - DNA, 25 bp, Homo sapien
tcattttattgactatctgccgtgt

SEQ ID NO: 240792 - DNA, 25 bp, Homo sapien
cattttattgactatctgccgtgtc

SEQ ID NO: 240793 - DNA, 25 bp, Homo sapien
attttattgactatctgccgtgtct

SEQ ID NO: 240794 - DNA, 25 bp, Homo sapien
ttttattgactatctgccgtgtctg

SEQ ID NO: 240795 - DNA, 25 bp, Homo sapien
tttattgactatctgccgtgtctgt

SEQ ID NO: 240796 - DNA, 25 bp, Homo sapien
ttattgactatctgccgtgtctgtg

SEQ ID NO: 240797 - DNA, 25 bp, Homo sapien
tattgactatctgccgtgtctgtgc

SEQ ID NO: 240798 - DNA, 25 bp, Homo sapien
tgactatctgccgtgtctgtgccat

SEQ ID NO: 240799 - DNA, 25 bp, Homo sapien
gactatctgccgtgtctgtgccatt

SEQ ID NO: 240800 - DNA, 25 bp, Homo sapien
aggtagaagtgagttcccctcaggt

SEQ ID NO: 240801 - DNA, 25 bp, Homo sapien
ggtagaagtgagttcccctcaggtt

SEQ ID NO: 240802 - DNA, 25 bp, Homo sapien
gtagaagtgagttcccctcaggttt

SEQ ID NO: 240803 - DNA, 25 bp, Homo sapien
tagaagtgagttcccctcaggtttg

SEQ ID NO: 240804 - DNA, 25 bp, Homo sapien
cctcaggtttgattccaccttcaaa

SEQ ID NO: 240805 - DNA, 25 bp, Homo sapien
ctcaggtttgattccaccttcaaat

SEQ ID NO: 240806 - DNA, 25 bp, Homo sapien
tcaggtttgattccaccttcaaatg

SEQ ID NO: 240807 - DNA, 25 bp, Homo sapien
aggtttgattccaccttcaaatgag

SEQ ID NO: 240808 - DNA, 25 bp, Homo sapien
ggtttgattccaccttcaaatgagc

SEQ ID NO: 240809 - DNA, 25 bp, Homo sapien
tttgattccaccttcaaatgagcct

SEQ ID NO: 240810 - DNA, 25 bp, Homo sapien
gaagcttaatggaattataattctc

SEQ ID NO: 240811 - DNA, 25 bp, Homo sapien
tgttcagcatgccatttctgactgg

SEQ ID NO: 240812 - DNA, 25 bp, Homo sapien
agcatgccatttctgactggcacat

SEQ ID NO: 240813 - DNA, 25 bp, Homo sapien
aaggagttggcatcttggatctcag

SEQ ID NO: 240814 - DNA, 25 bp, Homo sapien
gagttggcatcttggatctcagaat

SEQ ID NO: 240815 - DNA, 25 bp, Homo sapien
gcatcttggatctcagaatggcctg

SEQ ID NO: 240816 - DNA, 25 bp, Homo sapien
aaacggatggcctctacgctgttcc

SEQ ID NO: 240817 - DNA, 25 bp, Homo sapien
ggatggcctctacgctgttccatca

SEQ ID NO: 240818 - DNA, 25 bp, Homo sapien
tacgctgttccatcacagtctccaa

SEQ ID NO: 240819 - DNA, 25 bp, Homo sapien
atttcattaaactgttgcataccca

SEQ ID NO: 240820 - DNA, 25 bp, Homo sapien
aaactgttgcatacccagttagcac

SEQ ID NO: 240821 - DNA, 25 bp, Homo sapien
tgttgcatacccagttagcacagta

SEQ ID NO: 240822 - DNA, 25 bp, Homo sapien
ccagttctccaggtgcgttactatt

SEQ ID NO: 240823 - DNA, 25 bp, Homo sapien
ggtgcgttactatttctgggatcat

SEQ ID NO: 240824 - DNA, 25 bp, Homo sapien
gcgttactatttctgggatcatggg

SEQ ID NO: 240825 - DNA, 25 bp, Homo sapien
gggtcagttttaggacacttgaaca

SEQ ID NO: 240826 - DNA, 25 bp, Homo sapien
gttttaggacacttgaacacttctt

SEQ ID NO: 240827 - DNA, 25 bp, Homo sapien
gggcttgtactgaactatctagtga

SEQ ID NO: 240828 - DNA, 25 bp, Homo sapien
gtactgaactatctagtgatcacgt

SEQ ID NO: 240829 - DNA, 25 bp, Homo sapien
gtgatcacgttaacacctaactctc

SEQ ID NO: 240830 - DNA, 25 bp, Homo sapien
atcacgttaacacctaactctcctt

SEQ ID NO: 240831 - DNA, 25 bp, Homo sapien
ttctttttcgccactgtttggcaaa

SEQ ID NO: 240832 - DNA, 25 bp, Homo sapien
tcgccactgtttggcaaagttttct

SEQ ID NO: 240833 - DNA, 25 bp, Homo sapien
aagcaggtgtccaggcaggtaggct

SEQ ID NO: 240834 - DNA, 25 bp, Homo sapien
tggcaccgcaggacctcgtggtact

SEQ ID NO: 240835 - DNA, 25 bp, Homo sapien
aggacctcgtggtactcttgcctta

SEQ ID NO: 240836 - DNA, 25 bp, Homo sapien
acctcgtggtactcttgccttagat

SEQ ID NO: 240837 - DNA, 25 bp, Homo sapien
cgtggtactcttgccttagatttta

SEQ ID NO: 240838 - DNA, 25 bp, Homo sapien
gtactcttgccttagattttacaca

SEQ ID NO: 240839 - DNA, 25 bp, Homo sapien
gccttagattttacacacactccac

SEQ ID NO: 240840 - DNA, 25 bp, Homo sapien
cttagattttacacacactccacag

SEQ ID NO: 240841 - DNA, 25 bp, Homo sapien
ggaagcaaaggcacaggcccacggt

SEQ ID NO: 240842 - DNA, 25 bp, Homo sapien
agcaaaggcacaggcccacggtggc

SEQ ID NO: 240843 - DNA, 25 bp, Homo sapien
gggtaaacactgggaactccagaag

SEQ ID NO: 240844 - DNA, 25 bp, Homo sapien
agtttaaagcccgaaagctgaagca

SEQ ID NO: 240845 - DNA, 25 bp, Homo sapien
gaagcattcagcctctgcaagtgta

SEQ ID NO: 240846 - DNA, 25 bp, Homo sapien
gcaagtgtagactactggactgtag

SEQ ID NO: 240847 - DNA, 25 bp, Homo sapien
acccctgacatccatacttatgttg

SEQ ID NO: 240848 - DNA, 25 bp, Homo sapien
tacttatgttgtctggaagagccat

SEQ ID NO: 240849 - DNA, 25 bp, Homo sapien
agccatggacacatcattattttca

SEQ ID NO: 240850 - DNA, 25 bp, Homo sapien
attattttcagcaaccagctgcagt

SEQ ID NO: 240851 - DNA, 25 bp, Homo sapien
agcaaccagctgcagtgaaactcca

SEQ ID NO: 240852 - DNA, 25 bp, Homo sapien
tccatttacagcaaccccatagtat

SEQ ID NO: 240853 - DNA, 25 bp, Homo sapien
caatgcctcattgtaatgggatatt

SEQ ID NO: 240854 - DNA, 25 bp, Homo sapien
ttcattgaagaattactaggttgcc

SEQ ID NO: 240855 - DNA, 25 bp, Homo sapien
agcctagagatactccaattttttc

SEQ ID NO: 240856 - DNA, 25 bp, Homo sapien
tctgtaaggaactttcttcttgccc

SEQ ID NO: 240857 - DNA, 25 bp, Homo sapien
taaggaactttcttcttgcccaatt

SEQ ID NO: 240858 - DNA, 25 bp, Homo sapien
aactttcttcttgcccaattctggg

SEQ ID NO: 240859 - DNA, 25 bp, Homo sapien
tcttcttgcccaattctgggaggga

SEQ ID NO: 240860 - DNA, 25 bp, Homo sapien
ctgggagggaagtgttcatcttttc

SEQ ID NO: 240861 - DNA, 25 bp, Homo sapien
gatgtggagcattaaggcattttca

SEQ ID NO: 240862 - DNA, 25 bp, Homo sapien
attaaggcattttcagaggcgcccc

SEQ ID NO: 240863 - DNA, 25 bp, Homo sapien
gggcagtggctctaatggatttttg

SEQ ID NO: 240864 - DNA, 25 bp, Homo sapien
gtggctctaatggatttttgcaggt

SEQ ID NO: 240865 - DNA, 25 bp, Homo sapien
tttgcaggttgtgtcggactgggca

SEQ ID NO: 240866 - DNA, 25 bp, Homo sapien
gtaaaggtcagacacattctatgtg

SEQ ID NO: 240867 - DNA, 25 bp, Homo sapien
ggaagccatggaaaagttaaagtct

SEQ ID NO: 240868 - DNA, 25 bp, Homo sapien
gtatagtgaagataaagccaggcaa

SEQ ID NO: 240869 - DNA, 25 bp, Homo sapien
gagggtccatggtgggaccatttca

SEQ ID NO: 240870 - DNA, 25 bp, Homo sapien
gggaccatttcaagaagcagcattt

SEQ ID NO: 240871 - DNA, 25 bp, Homo sapien
aagaagcagcatttgccttgcctgt

SEQ ID NO: 240872 - DNA, 25 bp, Homo sapien
cagcatttgccttgcctgtaagtgg

SEQ ID NO: 240873 - DNA, 25 bp, Homo sapien
ttgcctgtaagtgggatggataagc

SEQ ID NO: 240874 - DNA, 25 bp, Homo sapien
ataagcctgtgtttacagacccacc

SEQ ID NO: 240875 - DNA, 25 bp, Homo sapien
tgtgtttacagacccaccggttaag

SEQ ID NO: 240876 - DNA, 25 bp, Homo sapien
ggatatcatattattatggtcgaag

SEQ ID NO: 240877 - DNA, 25 bp, Homo sapien
gtttctgctacctgacaatcatcgc

SEQ ID NO: 240878 - DNA, 25 bp, Homo sapien
tgctacctgacaatcatcgccttga

SEQ ID NO: 240879 - DNA, 25 bp, Homo sapien
tacctgacaatcatcgccttgagta

SEQ ID NO: 240880 - DNA, 25 bp, Homo sapien
gacaatcatcgccttgagtactggg

SEQ ID NO: 240881 - DNA, 25 bp, Homo sapien
aatcatcgccttgagtactgggaca

SEQ ID NO: 240882 - DNA, 25 bp, Homo sapien
acctttgattactcattatatcctc

SEQ ID NO: 240883 - DNA, 25 bp, Homo sapien
cgccagctggcgtaaatacctaata

SEQ ID NO: 240884 - DNA, 25 bp, Homo sapien
ggcgtaaatacctaataggccctga

SEQ ID NO: 240885 - DNA, 25 bp, Homo sapien
acctaataggccctgaaccgatcgc

SEQ ID NO: 240886 - DNA, 25 bp, Homo sapien
taataggccctgaaccgatcgcctt

SEQ ID NO: 240887 - DNA, 25 bp, Homo sapien
ataggccctgaaccgatcgcctttt

SEQ ID NO: 240888 - DNA, 25 bp, Homo sapien
taaaagagaacttctggtctatctg

SEQ ID NO: 240889 - DNA, 25 bp, Homo sapien
gtctatctggaccagtggtttgtga

SEQ ID NO: 240890 - DNA, 25 bp, Homo sapien
gaaatgtttgctcttcagggattct

SEQ ID NO: 240891 - DNA, 25 bp, Homo sapien
gggattctgcaaacttgaatgtgtt

SEQ ID NO: 240892 - DNA, 25 bp, Homo sapien
taacactccaaagaaccattaccaa

SEQ ID NO: 240893 - DNA, 25 bp, Homo sapien
gaaccctcttgagatgtcatgtaga

SEQ ID NO: 240894 - DNA, 25 bp, Homo sapien
gtagaacacacgcaagaccaccagt

SEQ ID NO: 240895 - DNA, 25 bp, Homo sapien
tgtgctgccagctttgcctgaatgt

SEQ ID NO: 240896 - DNA, 25 bp, Homo sapien
atttctctacattggcatctggccc

SEQ ID NO: 240897 - DNA, 25 bp, Homo sapien
atctggcccaatagtccagtgctat

SEQ ID NO: 240898 - DNA, 25 bp, Homo sapien
agtccagtgctattataagtgtttt

SEQ ID NO: 240899 - DNA, 25 bp, Homo sapien
ttttgtaactgaataatcctccaag

SEQ ID NO: 240900 - DNA, 25 bp, Homo sapien
aataatcctccaagtagccagtgct

SEQ ID NO: 240901 - DNA, 25 bp, Homo sapien
aagtagccagtgctcctactgttta

SEQ ID NO: 240902 - DNA, 25 bp, Homo sapien
agtgctcctactgtttacagtgtcc

SEQ ID NO: 240903 - DNA, 25 bp, Homo sapien
tttacagtgtccctcgtgcccaagt

SEQ ID NO: 240904 - DNA, 25 bp, Homo sapien
aagtctctgtcactttcatcctgtt

SEQ ID NO: 240905 - DNA, 25 bp, Homo sapien
catcccagtagccagctttatgaga

SEQ ID NO: 240906 - DNA, 25 bp, Homo sapien
tttggtatttcttccctacagatta

SEQ ID NO: 240907 - DNA, 25 bp, Homo sapien
catcattatgctaaactaccagttg

SEQ ID NO: 240908 - DNA, 25 bp, Homo sapien
gtgggcttggccctccgatgccaac

SEQ ID NO: 240909 - DNA, 25 bp, Homo sapien
gatgccaaccacagggccccttttg

SEQ ID NO: 240910 - DNA, 25 bp, Homo sapien
ttggcccacgagtaatgtgattatt

SEQ ID NO: 240911 - DNA, 25 bp, Homo sapien
gatgctgttagagaaatttgttgaa

SEQ ID NO: 240912 - DNA, 25 bp, Homo sapien
ttgttgaagaatgcaagttccctcc

SEQ ID NO: 240913 - DNA, 25 bp, Homo sapien
ctccagtgccagatgccatttgttg

SEQ ID NO: 240914 - DNA, 25 bp, Homo sapien
agtgccagatgccatttgttgctat

SEQ ID NO: 240915 - DNA, 25 bp, Homo sapien
ttgttgctatcagaagtgccatgga

SEQ ID NO: 240916 - DNA, 25 bp, Homo sapien
agtgccatggatattctaagatcca

SEQ ID NO: 240917 - DNA, 25 bp, Homo sapien
ggatattctaagatccagatataca

SEQ ID NO: 240918 - DNA, 25 bp, Homo sapien
atccagatatacataactgatccag

SEQ ID NO: 240919 - DNA, 25 bp, Homo sapien
taactgatccagactttaagggttt

SEQ ID NO: 240920 - DNA, 25 bp, Homo sapien
ctttaagggttttatacgcatcagc

SEQ ID NO: 240921 - DNA, 25 bp, Homo sapien
ataattttcaggaccacagactaag

SEQ ID NO: 240922 - DNA, 25 bp, Homo sapien
aggaccacagactaagctgtcgaaa

SEQ ID NO: 240923 - DNA, 25 bp, Homo sapien
cagactaagctgtcgaaattaacgc

SEQ ID NO: 240924 - DNA, 25 bp, Homo sapien
gctgtcgaaattaacgctgattttt

SEQ ID NO: 240925 - DNA, 25 bp, Homo sapien
taacgctgatttttttagggccaga

SEQ ID NO: 240926 - DNA, 25 bp, Homo sapien
caaattatccaatatacatgtcata

SEQ ID NO: 240927 - DNA, 25 bp, Homo sapien
tttttagggccagaataccaaaatg

SEQ ID NO: 240928 - DNA, 25 bp, Homo sapien
gccagaataccaaaatggctcctct

SEQ ID NO: 240929 - DNA, 25 bp, Homo sapien
aaattggacaatttcaaatgcaaaa

SEQ ID NO: 240930 - DNA, 25 bp, Homo sapien
aatatatgagttgcttcctctattt

SEQ ID NO: 240931 - DNA, 25 bp, Homo sapien
agatatgtatgatctatgtgaatcc

SEQ ID NO: 240932 - DNA, 25 bp, Homo sapien
aaaacaaagccattgccctccatcg

SEQ ID NO: 240933 - DNA, 25 bp, Homo sapien
atcgtgaacctccaggcctttcaga

SEQ ID NO: 240934 - DNA, 25 bp, Homo sapien
gaacctccaggcctttcagaggcag

SEQ ID NO: 240935 - DNA, 25 bp, Homo sapien
tgactgtggaagagggctccctgtc

SEQ ID NO: 240936 - DNA, 25 bp, Homo sapien
tgtctccagagaggcttttcaatgc

SEQ ID NO: 240937 - DNA, 25 bp, Homo sapien
gagaggcttttcaatgcagaatttg

SEQ ID NO: 240938 - DNA, 25 bp, Homo sapien
ctgccagcccatctatgagtgtgag

SEQ ID NO: 240939 - DNA, 25 bp, Homo sapien
gcccatctatgagtgtgagcttgcc

SEQ ID NO: 240940 - DNA, 25 bp, Homo sapien
ctatgagtgtgagcttgccagtcag

SEQ ID NO: 240941 - DNA, 25 bp, Homo sapien
gcttgccagtcaggccccagaaaaa

SEQ ID NO: 240942 - DNA, 25 bp, Homo sapien
aacagccagatgtcaggcatcacca

SEQ ID NO: 240943 - DNA, 25 bp, Homo sapien
cctggctaagctgggagcttatctt

SEQ ID NO: 240944 - DNA, 25 bp, Homo sapien
taagctgggagcttatcttccccga

SEQ ID NO: 240945 - DNA, 25 bp, Homo sapien
ctgggagcttatcttccccgagaag

SEQ ID NO: 240946 - DNA, 25 bp, Homo sapien
ttccccgagaagaatctgctgggat

SEQ ID NO: 240947 - DNA, 25 bp, Homo sapien
ggcaattagctgatccaagtgaaaa

SEQ ID NO: 240948 - DNA, 25 bp, Homo sapien
gggcttgggaaacaccgagggcagg

SEQ ID NO: 240949 - DNA, 25 bp, Homo sapien
attagccgtggccttgtgccagcag

SEQ ID NO: 240950 - DNA, 25 bp, Homo sapien
cagggcctgggtgccacaccgggtg

SEQ ID NO: 240951 - DNA, 25 bp, Homo sapien
acaccgggtggcagcgggtggcaga

SEQ ID NO: 240952 - DNA, 25 bp, Homo sapien
ccccgctccggcactgggatttggg

SEQ ID NO: 240953 - DNA, 25 bp, Homo sapien
aaaaggtagagaatgtgctctcaac

SEQ ID NO: 240954 - DNA, 25 bp, Homo sapien
aaacccagactaaaggctacagtga

SEQ ID NO: 240955 - DNA, 25 bp, Homo sapien
aaggctacagtgacgccaagtccag

SEQ ID NO: 240956 - DNA, 25 bp, Homo sapien
tacagtgacgccaagtccagtgaaa

SEQ ID NO: 240957 - DNA, 25 bp, Homo sapien
gacgccaagtccagtgaaaggcaaa

SEQ ID NO: 240958 - DNA, 25 bp, Homo sapien
ggcaccattccaggagaaagattcc

SEQ ID NO: 240959 - DNA, 25 bp, Homo sapien
attccaggagaaagattccggcagc

SEQ ID NO: 240960 - DNA, 25 bp, Homo sapien
gaaagattccggcagcgatgaagat

SEQ ID NO: 240961 - DNA, 25 bp, Homo sapien
ttccggcagcgatgaagatttccta

SEQ ID NO: 240962 - DNA, 25 bp, Homo sapien
gcagcgatgaagatttcctaatgga

SEQ ID NO: 240963 - DNA, 25 bp, Homo sapien
acgatagtgactatggcagttcgaa

SEQ ID NO: 240964 - DNA, 25 bp, Homo sapien
gtgactatggcagttcgaaaaagaa

SEQ ID NO: 240965 - DNA, 25 bp, Homo sapien
agggctatatgccagacctggactc

SEQ ID NO: 240966 - DNA, 25 bp, Homo sapien
gaggaggaggccgatggctctcaga

SEQ ID NO: 240967 - DNA, 25 bp, Homo sapien
tccagttcctcggtgccaggagaga

SEQ ID NO: 240968 - DNA, 25 bp, Homo sapien
cagttcctcggtgccaggagagagc

SEQ ID NO: 240969 - DNA, 25 bp, Homo sapien
ggtggtgtgggtaccacaccagcct

SEQ ID NO: 240970 - DNA, 25 bp, Homo sapien
ccccatgaggaccaccagcaaaggg

SEQ ID NO: 240971 - DNA, 25 bp, Homo sapien
caccagcaaagggagaccaaagaga

SEQ ID NO: 240972 - DNA, 25 bp, Homo sapien
ggagaccaaagagaatgaccccatg

SEQ ID NO: 240973 - DNA, 25 bp, Homo sapien
agagaatgaccccatggacagccat

SEQ ID NO: 240974 - DNA, 25 bp, Homo sapien
aatgaccccatggacagccatcagt

SEQ ID NO: 240975 - DNA, 25 bp, Homo sapien
ccatggacagccatcagtcccagga

SEQ ID NO: 240976 - DNA, 25 bp, Homo sapien
attagcatttcgctcaagtcaagcg

SEQ ID NO: 240977 - DNA, 25 bp, Homo sapien
aagtcaagcgaatcaccttgtcaag

SEQ ID NO: 240978 - DNA, 25 bp, Homo sapien
caccttgtcaagtcatatgcagaga

SEQ ID NO: 240979 - DNA, 25 bp, Homo sapien
tgggatcaaagctagagccatagtc

SEQ ID NO: 240980 - DNA, 25 bp, Homo sapien
aaggcagaacatgacgttggaggaa

SEQ ID NO: 240981 - DNA, 25 bp, Homo sapien
cacagtttaaacacagggcctttgt

SEQ ID NO: 240982 - DNA, 25 bp, Homo sapien
cacagggcctttgtaaagtagtgtt

SEQ ID NO: 240983 - DNA, 25 bp, Homo sapien
gtgttaggatcacttaacgtggttt

SEQ ID NO: 240984 - DNA, 25 bp, Homo sapien
actgagtggcgctaaactgctgatt

SEQ ID NO: 240985 - DNA, 25 bp, Homo sapien
cgctaaactgctgatttgggaggtc

SEQ ID NO: 240986 - DNA, 25 bp, Homo sapien
gttctgggctttattagcatttcgc

SEQ ID NO: 240987 - DNA, 25 bp, Homo sapien
ccaaggcagaagtccttaggcggga

SEQ ID NO: 240988 - DNA, 25 bp, Homo sapien
taggcgggacttccttaccaccacg

SEQ ID NO: 240989 - DNA, 25 bp, Homo sapien
gagttagtaggtcatgcttctacca

SEQ ID NO: 240990 - DNA, 25 bp, Homo sapien
gtcatgcttctaccagtaatctaag

SEQ ID NO: 240991 - DNA, 25 bp, Homo sapien
attttgcagcaaattccagctggtc

SEQ ID NO: 240992 - DNA, 25 bp, Homo sapien
agtaatctaaggactctctccttct

SEQ ID NO: 240993 - DNA, 25 bp, Homo sapien
tctccagatttccaagccttagcta

SEQ ID NO: 240994 - DNA, 25 bp, Homo sapien
gtattgttttcttatggtccagtta

SEQ ID NO: 240995 - DNA, 25 bp, Homo sapien
tccagctggtcagagagtcagtgct

SEQ ID NO: 240996 - DNA, 25 bp, Homo sapien
tggaggctcataacccaacactgga

SEQ ID NO: 240997 - DNA, 25 bp, Homo sapien
tggaacattccctagccaaggcaga

SEQ ID NO: 240998 - DNA, 25 bp, Homo sapien
aaagcctgcaaagttgatagtccaa

SEQ ID NO: 240999 - DNA, 25 bp, Homo sapien
atagtccaactgttacaaccactct

SEQ ID NO: 241000 - DNA, 25 bp, Homo sapien
ggcactttacagacgtcaaggcaaa

SEQ ID NO: 241001 - DNA, 25 bp, Homo sapien
ggcaaatttgaagctgcagaaacgt

SEQ ID NO: 241002 - DNA, 25 bp, Homo sapien
ggtggcagaagtgctcaatgaccct

SEQ ID NO: 241003 - DNA, 25 bp, Homo sapien
gaagtgctcaatgaccctgagaaca

SEQ ID NO: 241004 - DNA, 25 bp, Homo sapien
gaccctgagaacatggagaagcgca

SEQ ID NO: 241005 - DNA, 25 bp, Homo sapien
agcgcaggagccgtgagagcctcaa

SEQ ID NO: 241006 - DNA, 25 bp, Homo sapien
agagcctcaacgtggacgtggtcaa

SEQ ID NO: 241007 - DNA, 25 bp, Homo sapien
tggtcaagtacgagagtggccctga

SEQ ID NO: 241008 - DNA, 25 bp, Homo sapien
caagtacgagagtggccctgacgga

SEQ ID NO: 241009 - DNA, 25 bp, Homo sapien
gtttgtacctgccttgttccaggaa

SEQ ID NO: 241010 - DNA, 25 bp, Homo sapien
acctgccttgttccaggaaggattt

SEQ ID NO: 241011 - DNA, 25 bp, Homo sapien
tgtggtttatattccagtcctttaa

SEQ ID NO: 241012 - DNA, 25 bp, Homo sapien
ccagtcctttaatgctggaagggct

SEQ ID NO: 241013 - DNA, 25 bp, Homo sapien
aagggctgagatgagactgaaagat

SEQ ID NO: 241014 - DNA, 25 bp, Homo sapien
agatgggcaggaagtatatcatcac

SEQ ID NO: 241015 - DNA, 25 bp, Homo sapien
atatcatcacaagctttgtgtttga

SEQ ID NO: 241016 - DNA, 25 bp, Homo sapien
aagctcttagaggagtgatataatc

SEQ ID NO: 241017 - DNA, 25 bp, Homo sapien
catgaatgggaaaggccacagtcta

SEQ ID NO: 241018 - DNA, 25 bp, Homo sapien
ccacagtctagaaatggcagagtgt

SEQ ID NO: 241019 - DNA, 25 bp, Homo sapien
aatggcagagtgtgttcctagtttg

SEQ ID NO: 241020 - DNA, 25 bp, Homo sapien
tctgtaatacagagcaatccgactg

SEQ ID NO: 241021 - DNA, 25 bp, Homo sapien
agagcaatccgactggcacttgtgc

SEQ ID NO: 241022 - DNA, 25 bp, Homo sapien
ctggcacttgtgctatcacgacata

SEQ ID NO: 241023 - DNA, 25 bp, Homo sapien
tatcacgacataagacaagccacaa

SEQ ID NO: 241024 - DNA, 25 bp, Homo sapien
atacgggttggatgtcatggtgcac

SEQ ID NO: 241025 - DNA, 25 bp, Homo sapien
ggttggatgtcatggtgcaccacca

SEQ ID NO: 241026 - DNA, 25 bp, Homo sapien
cacggcttcttaaccttacgaagat

SEQ ID NO: 241027 - DNA, 25 bp, Homo sapien
ttacgaagatcatgcataacactat

SEQ ID NO: 241028 - DNA, 25 bp, Homo sapien
taacactatgtgaacaaatcctatg

SEQ ID NO: 241029 - DNA, 25 bp, Homo sapien
aaatcctatgatacacaccaggagg

SEQ ID NO: 241030 - DNA, 25 bp, Homo sapien
tgatacacaccaggaggctggtacc

SEQ ID NO: 241031 - DNA, 25 bp, Homo sapien
aaccatctccttaaagattattttg

SEQ ID NO: 241032 - DNA, 25 bp, Homo sapien
aaagataaatctcattcataaaaag

SEQ ID NO: 241033 - DNA, 25 bp, Homo sapien
aagataaatctcattcataaaaaga

SEQ ID NO: 241034 - DNA, 25 bp, Homo sapien
agataaatctcattcataaaaagac

SEQ ID NO: 241035 - DNA, 25 bp, Homo sapien
gataaatctcattcataaaaagaca

SEQ ID NO: 241036 - DNA, 25 bp, Homo sapien
ataaatctcattcataaaaagacat

SEQ ID NO: 241037 - DNA, 25 bp, Homo sapien
taaatctcattcataaaaagacatg

SEQ ID NO: 241038 - DNA, 25 bp, Homo sapien
aaatctcattcataaaaagacatgg

SEQ ID NO: 241039 - DNA, 25 bp, Homo sapien
aatctcattcataaaaagacatggt

SEQ ID NO: 241040 - DNA, 25 bp, Homo sapien
atctcattcataaaaagacatggtg

SEQ ID NO: 241041 - DNA, 25 bp, Homo sapien
tgcctgtcagaatcccctgtttgat

SEQ ID NO: 241042 - DNA, 25 bp, Homo sapien
atttccccagtaccaatttcctgag

SEQ ID NO: 241043 - DNA, 25 bp, Homo sapien
ctgagctcctctggtatacctgata

SEQ ID NO: 241044 - DNA, 25 bp, Homo sapien
tcctggctgcagagaagtcatcata

SEQ ID NO: 241045 - DNA, 25 bp, Homo sapien
atccctctggaagctgagcctctga

SEQ ID NO: 241046 - DNA, 25 bp, Homo sapien
gcctctgatgtatgtctctgatgta

SEQ ID NO: 241047 - DNA, 25 bp, Homo sapien
atgtctctgatgtatgtgcatgtag

SEQ ID NO: 241048 - DNA, 25 bp, Homo sapien
tcatcatattgacctgttgctcagt

SEQ ID NO: 241049 - DNA, 25 bp, Homo sapien
tgacctgttgctcagtaatgccctg

SEQ ID NO: 241050 - DNA, 25 bp, Homo sapien
taatgccctgttctgtggtcagctg

SEQ ID NO: 241051 - DNA, 25 bp, Homo sapien
caagtcacctatggcccatggcaga

SEQ ID NO: 241052 - DNA, 25 bp, Homo sapien
ggaagtctgcaaagacgcagcggct

SEQ ID NO: 241053 - DNA, 25 bp, Homo sapien
gcagcggcttgagggacgttttaca

SEQ ID NO: 241054 - DNA, 25 bp, Homo sapien
gggacgttttacatggtcctgctgg

SEQ ID NO: 241055 - DNA, 25 bp, Homo sapien
gggctacctgtaggaggtcatctct

SEQ ID NO: 241056 - DNA, 25 bp, Homo sapien
acctgtaggaggtcatctctcagag

SEQ ID NO: 241057 - DNA, 25 bp, Homo sapien
ggaggtcatctctcagagtaattac

SEQ ID NO: 241058 - DNA, 25 bp, Homo sapien
agagtaattactcattgttctcccc

SEQ ID NO: 241059 - DNA, 25 bp, Homo sapien
tcctctttgttgcttacttaccttg

SEQ ID NO: 241060 - DNA, 25 bp, Homo sapien
tttgttgcttacttaccttgtcagg

SEQ ID NO: 241061 - DNA, 25 bp, Homo sapien
ttgcttacttaccttgtcaggactt

SEQ ID NO: 241062 - DNA, 25 bp, Homo sapien
ttacttaccttgtcaggacttactt

SEQ ID NO: 241063 - DNA, 25 bp, Homo sapien
gggatctatgtttggcttatggcaa

SEQ ID NO: 241064 - DNA, 25 bp, Homo sapien
tggcttatggcaagtggcttcactc

SEQ ID NO: 241065 - DNA, 25 bp, Homo sapien
tatggcaagtggcttcactcccacg

SEQ ID NO: 241066 - DNA, 25 bp, Homo sapien
tggcttcactcccacggctcaggtg

SEQ ID NO: 241067 - DNA, 25 bp, Homo sapien
gaccaccactgcatcatttggaaaa

SEQ ID NO: 241068 - DNA, 25 bp, Homo sapien
tccctgccattctctgatagctgtc

SEQ ID NO: 241069 - DNA, 25 bp, Homo sapien
gccattctctgatagctgtcagtca

SEQ ID NO: 241070 - DNA, 25 bp, Homo sapien
agctgtcagtcaggagctgacctca

SEQ ID NO: 241071 - DNA, 25 bp, Homo sapien
acagacgggcaatttcccctcctat

SEQ ID NO: 241072 - DNA, 25 bp, Homo sapien
tcggcacgagggatggctagggcag

SEQ ID NO: 241073 - DNA, 25 bp, Homo sapien
tagggcaggacacggacagtcatca

SEQ ID NO: 241074 - DNA, 25 bp, Homo sapien
attctggatataacttgggcacctc

SEQ ID NO: 241075 - DNA, 25 bp, Homo sapien
ccctgcacttggagttgaggtgttt

SEQ ID NO: 241076 - DNA, 25 bp, Homo sapien
tgggcacctcctgaagatcattctg

SEQ ID NO: 241077 - DNA, 25 bp, Homo sapien
gcaagacccttctctagaatttcca

SEQ ID NO: 241078 - DNA, 25 bp, Homo sapien
ttctctagaatttccagcctggtgc

SEQ ID NO: 241079 - DNA, 25 bp, Homo sapien
cagcctggtgcgtacattctgtaga

SEQ ID NO: 241080 - DNA, 25 bp, Homo sapien
attttctgttgcatctgtctagcag

SEQ ID NO: 241081 - DNA, 25 bp, Homo sapien
tgtctagcagattcccacccaggac

SEQ ID NO: 241082 - DNA, 25 bp, Homo sapien
tgaaatgctgatccctctgagcagg

SEQ ID NO: 241083 - DNA, 25 bp, Homo sapien
gaggtgtttccatttacttcagcat

SEQ ID NO: 241084 - DNA, 25 bp, Homo sapien
ggtaatttttcacacatgtctttag

SEQ ID NO: 241085 - DNA, 25 bp, Homo sapien
agctgggcactaatgtctgccaccg

SEQ ID NO: 241086 - DNA, 25 bp, Homo sapien
gtctgccaccgactatgttacagtg

SEQ ID NO: 241087 - DNA, 25 bp, Homo sapien
ataaatgattcctctatttgggaga

SEQ ID NO: 241088 - DNA, 25 bp, Homo sapien
ttgggagagatcttccaatccagag

SEQ ID NO: 241089 - DNA, 25 bp, Homo sapien
ctcttggactgcctgggttaaatct

SEQ ID NO: 241090 - DNA, 25 bp, Homo sapien
gcctgggttaaatctgcatagcaga

SEQ ID NO: 241091 - DNA, 25 bp, Homo sapien
agcagaagtggttgatgagttcatc

SEQ ID NO: 241092 - DNA, 25 bp, Homo sapien
tctgaagaaattcaggccccacctc

SEQ ID NO: 241093 - DNA, 25 bp, Homo sapien
tgctcccttttgatggtggcctctg

SEQ ID NO: 241094 - DNA, 25 bp, Homo sapien
gtactcgggcagagtccttgggaca

SEQ ID NO: 241095 - DNA, 25 bp, Homo sapien
gtcgcccaggcctaagtgagtcgtg

SEQ ID NO: 241096 - DNA, 25 bp, Homo sapien
gtgtaaggtgaaagtcctattaggt

SEQ ID NO: 241097 - DNA, 25 bp, Homo sapien
tgtgaacttcacagagtattaaaag

SEQ ID NO: 241098 - DNA, 25 bp, Homo sapien
gaagacccgtgttttgtgctttttg

SEQ ID NO: 241099 - DNA, 25 bp, Homo sapien
gcaaaattatttgggtctacagctt

SEQ ID NO: 241100 - DNA, 25 bp, Homo sapien
ttgggtctacagctttacctattcc

SEQ ID NO: 241101 - DNA, 25 bp, Homo sapien
acagctttacctattcctttcaaga

SEQ ID NO: 241102 - DNA, 25 bp, Homo sapien
tgcttcagcagtttatgttattaag

SEQ ID NO: 241103 - DNA, 25 bp, Homo sapien
cagtttatgttattaagacggaggc

SEQ ID NO: 241104 - DNA, 25 bp, Homo sapien
agacggaggcttgggtcatgttatc

SEQ ID NO: 241105 - DNA, 25 bp, Homo sapien
atgttatctctctccaccaatgtgt

SEQ ID NO: 241106 - DNA, 25 bp, Homo sapien
atctctctccaccaatgtgtaaggt

SEQ ID NO: 241107 - DNA, 25 bp, Homo sapien
cgggcatcaagcgactgtttagctt

SEQ ID NO: 241108 - DNA, 25 bp, Homo sapien
tgtttagcttcttctcccgagataa

SEQ ID NO: 241109 - DNA, 25 bp, Homo sapien
tcccgagataagaagcgcctggcca

SEQ ID NO: 241110 - DNA, 25 bp, Homo sapien
taagaagcgcctggccaacacacag

SEQ ID NO: 241111 - DNA, 25 bp, Homo sapien
agaaacgtgcacatccaggagtcct

SEQ ID NO: 241112 - DNA, 25 bp, Homo sapien
gcacatccaggagtcctttggacag

SEQ ID NO: 241113 - DNA, 25 bp, Homo sapien
gagtcctttggacagtgggcaaaca

SEQ ID NO: 241114 - DNA, 25 bp, Homo sapien
gggcaaacacccaccgcgatgacgg

SEQ ID NO: 241115 - DNA, 25 bp, Homo sapien
ccgcgatgacggttacacagagcaa

SEQ ID NO: 241116 - DNA, 25 bp, Homo sapien
acacagagcaaggacaggaagccct

SEQ ID NO: 241117 - DNA, 25 bp, Homo sapien
gccctgcagcatctgtgaccttggc

SEQ ID NO: 241118 - DNA, 25 bp, Homo sapien
atgtgatctctattgcaacaagtaa

SEQ ID NO: 241119 - DNA, 25 bp, Homo sapien
catttattttagagtagtgctccta

SEQ ID NO: 241120 - DNA, 25 bp, Homo sapien
gagtagtgctcctaacatgtattat

SEQ ID NO: 241121 - DNA, 25 bp, Homo sapien
gtgctcctaacatgtattatcaact

SEQ ID NO: 241122 - DNA, 25 bp, Homo sapien
gtattatcaactttgtggattacat

SEQ ID NO: 241123 - DNA, 25 bp, Homo sapien
caactttgtggattacattggagga

SEQ ID NO: 241124 - DNA, 25 bp, Homo sapien
gaaactaccatgttaaatactgaag

SEQ ID NO: 241125 - DNA, 25 bp, Homo sapien
aacattcatctgattattttaaaca

SEQ ID NO: 241126 - DNA, 25 bp, Homo sapien
gtagataaacatactggaggtgagt

SEQ ID NO: 241127 - DNA, 25 bp, Homo sapien
catgcagtctgaagtcctagttact

SEQ ID NO: 241128 - DNA, 25 bp, Homo sapien
tgcagtctgaagtcctagttactta

SEQ ID NO: 241129 - DNA, 25 bp, Homo sapien
ttctacatcatctacatggccatcc

SEQ ID NO: 241130 - DNA, 25 bp, Homo sapien
ctacatcatctacatggccatcctg

SEQ ID NO: 241131 - DNA, 25 bp, Homo sapien
tgcgccagcaagtacggccgggact

SEQ ID NO: 241132 - DNA, 25 bp, Homo sapien
gcctgctgcctggaatcttctaagg

SEQ ID NO: 241133 - DNA, 25 bp, Homo sapien
ctgcctggaatcttctaagggcacg

SEQ ID NO: 241134 - DNA, 25 bp, Homo sapien
agggcacgccctagggagaagccct

SEQ ID NO: 241135 - DNA, 25 bp, Homo sapien
cacgccctagggagaagccctgtgg

SEQ ID NO: 241136 - DNA, 25 bp, Homo sapien
gctgtcaagagcgtgttctgccagg

SEQ ID NO: 241137 - DNA, 25 bp, Homo sapien
tcaagagcgtgttctgccaggtcca

SEQ ID NO: 241138 - DNA, 25 bp, Homo sapien
tggcatcccagctccaactcgagga

SEQ ID NO: 241139 - DNA, 25 bp, Homo sapien
tccaactcgaggagcctcagtttcc

SEQ ID NO: 241140 - DNA, 25 bp, Homo sapien
tcaagattcaactgctggctttgag

SEQ ID NO: 241141 - DNA, 25 bp, Homo sapien
actgctggctttgagggcctcttta

SEQ ID NO: 241142 - DNA, 25 bp, Homo sapien
gagggcctctttaagaacagtaatg

SEQ ID NO: 241143 - DNA, 25 bp, Homo sapien
aacagtaatgataacctaaggcagt

SEQ ID NO: 241144 - DNA, 25 bp, Homo sapien
ataacctaaggcagtttaacagtat

SEQ ID NO: 241145 - DNA, 25 bp, Homo sapien
cagtatggaatggttaccttttaga

SEQ ID NO: 241146 - DNA, 25 bp, Homo sapien
agctatgggcatggaagttcaatca

SEQ ID NO: 241147 - DNA, 25 bp, Homo sapien
caatcagtgcattgaagtttttcct

SEQ ID NO: 241148 - DNA, 25 bp, Homo sapien
tttcctttatctctcctatggttaa

SEQ ID NO: 241149 - DNA, 25 bp, Homo sapien
aaacgttgcttcagggtgtagagac

SEQ ID NO: 241150 - DNA, 25 bp, Homo sapien
ataggtcatgtttcaacttacagaa

SEQ ID NO: 241151 - DNA, 25 bp, Homo sapien
gggctctcccaaggcggtggagtga

SEQ ID NO: 241152 - DNA, 25 bp, Homo sapien
agtgagaagacaggtgagacaccaa

SEQ ID NO: 241153 - DNA, 25 bp, Homo sapien
agacaccaagcatgaggccgtggcg

SEQ ID NO: 241154 - DNA, 25 bp, Homo sapien
acaccaagcatgaggccgtggcgga

SEQ ID NO: 241155 - DNA, 25 bp, Homo sapien
gggcccaactgctgagcagtagcag

SEQ ID NO: 241156 - DNA, 25 bp, Homo sapien
caactgctgagcagtagcagagaaa

SEQ ID NO: 241157 - DNA, 25 bp, Homo sapien
gcaaacactggacagaagtcaggcc

SEQ ID NO: 241158 - DNA, 25 bp, Homo sapien
aacactggacagaagtcaggccaga

SEQ ID NO: 241159 - DNA, 25 bp, Homo sapien
taagccggagcaaggtccttgtaac

SEQ ID NO: 241160 - DNA, 25 bp, Homo sapien
ggagcaaggtccttgtaacccctgt

SEQ ID NO: 241161 - DNA, 25 bp, Homo sapien
agcaaggtccttgtaacccctgtga

SEQ ID NO: 241162 - DNA, 25 bp, Homo sapien
ggatctgcttgatatgattgaccat

SEQ ID NO: 241163 - DNA, 25 bp, Homo sapien
ttgaccatacaagcatccgaactat

SEQ ID NO: 241164 - DNA, 25 bp, Homo sapien
acaagcatccgaactattgaagaat

SEQ ID NO: 241165 - DNA, 25 bp, Homo sapien
ttgaaaacgaattgaaccacatgtg

SEQ ID NO: 241166 - DNA, 25 bp, Homo sapien
accacatgtgtggtcatagccaaga

SEQ ID NO: 241167 - DNA, 25 bp, Homo sapien
tcatagccaagattcacccttcaaa

SEQ ID NO: 241168 - DNA, 25 bp, Homo sapien
ttcacccttcaaagaggaagcctgg

SEQ ID NO: 241169 - DNA, 25 bp, Homo sapien
tcaaacaggcttttgatgatcataa

SEQ ID NO: 241170 - DNA, 25 bp, Homo sapien
cataatattgttgagactgttctgg

SEQ ID NO: 241171 - DNA, 25 bp, Homo sapien
agactgttctggacttggaagagga

SEQ ID NO: 241172 - DNA, 25 bp, Homo sapien
ggactacaatgtgatgacgtctttt

SEQ ID NO: 241173 - DNA, 25 bp, Homo sapien
cctcgtaattttggactgccacaca

SEQ ID NO: 241174 - DNA, 25 bp, Homo sapien
gactgccacacattggtacctttag

SEQ ID NO: 241175 - DNA, 25 bp, Homo sapien
acattggtacctttagttctctgaa

SEQ ID NO: 241176 - DNA, 25 bp, Homo sapien
tttagttctctgaaggcccacgttt

SEQ ID NO: 241177 - DNA, 25 bp, Homo sapien
gaaggcccacgtttttatcattaag

SEQ ID NO: 241178 - DNA, 25 bp, Homo sapien
agacctatttgttagctagtagagc

SEQ ID NO: 241179 - DNA, 25 bp, Homo sapien
gtagagctttatgttcgctgtccat

SEQ ID NO: 241180 - DNA, 25 bp, Homo sapien
tcgctgtccatgaaaccttctgtaa

SEQ ID NO: 241181 - DNA, 25 bp, Homo sapien
gtaaccacagtgactacaagtagtt

SEQ ID NO: 241182 - DNA, 25 bp, Homo sapien
gctctgatgtgctatgcttagctat

SEQ ID NO: 241183 - DNA, 25 bp, Homo sapien
gctatgcttagctatctgtcagaga

SEQ ID NO: 241184 - DNA, 25 bp, Homo sapien
ggttccattgaataggacagtcttg

SEQ ID NO: 241185 - DNA, 25 bp, Homo sapien
ttatctctgatgcagcaagtcagtt

SEQ ID NO: 241186 - DNA, 25 bp, Homo sapien
aagtcagttgactaggtggaatcag

SEQ ID NO: 241187 - DNA, 25 bp, Homo sapien
gtggaatcaggtctaggttcaaatt

SEQ ID NO: 241188 - DNA, 25 bp, Homo sapien
ttcaaattccagctctttttaatgc

SEQ ID NO: 241189 - DNA, 25 bp, Homo sapien
atgaaactttacacagactgccttt

SEQ ID NO: 241190 - DNA, 25 bp, Homo sapien
agactgccttttcaacctcagtttc

SEQ ID NO: 241191 - DNA, 25 bp, Homo sapien
gactgtgtccaggttgtagggttat

SEQ ID NO: 241192 - DNA, 25 bp, Homo sapien
caggttgtagggttattatgagcat

SEQ ID NO: 241193 - DNA, 25 bp, Homo sapien
tattatgagcattgaacacagtatc

SEQ ID NO: 241194 - DNA, 25 bp, Homo sapien
caatgtaaatgtcaggtccatgtta

SEQ ID NO: 241195 - DNA, 25 bp, Homo sapien
gaaaaacctggccacttattgccgg

SEQ ID NO: 241196 - DNA, 25 bp, Homo sapien
aaacctggccacttattgccggcca

SEQ ID NO: 241197 - DNA, 25 bp, Homo sapien
tggccacttattgccggccagtgaa

SEQ ID NO: 241198 - DNA, 25 bp, Homo sapien
tgccggccagtgaaggccaagcact

SEQ ID NO: 241199 - DNA, 25 bp, Homo sapien
gccagtgaaggccaagcactgtcag

SEQ ID NO: 241200 - DNA, 25 bp, Homo sapien
caagcactgtcaggctggtgcccct

SEQ ID NO: 241201 - DNA, 25 bp, Homo sapien
gatgtggcctgctctgtgcgccgca

SEQ ID NO: 241202 - DNA, 25 bp, Homo sapien
tggcctgctctgtgcgccgcaagaa

SEQ ID NO: 241203 - DNA, 25 bp, Homo sapien
tctgtgcgccgcaagaagccaggcc

SEQ ID NO: 241204 - DNA, 25 bp, Homo sapien
gactgtcgtggctcccctcatcagc

SEQ ID NO: 241205 - DNA, 25 bp, Homo sapien
agctccccacaccagtcaaggcttc

SEQ ID NO: 241206 - DNA, 25 bp, Homo sapien
tttcctttatctctcctatggttaa

SEQ ID NO: 241207 - DNA, 25 bp, Homo sapien
ctttatctctcctatggttaatggt

SEQ ID NO: 241208 - DNA, 25 bp, Homo sapien
atctctcctatggttaatggtttct

SEQ ID NO: 241209 - DNA, 25 bp, Homo sapien
gcagaaaaggaccaattgatttctt

SEQ ID NO: 241210 - DNA, 25 bp, Homo sapien
ttctaaaacgttgcttcagggtgta

SEQ ID NO: 241211 - DNA, 25 bp, Homo sapien
aaacgttgcttcagggtgtagagac

SEQ ID NO: 241212 - DNA, 25 bp, Homo sapien
gttgcttcagggtgtagagaccttt

SEQ ID NO: 241213 - DNA, 25 bp, Homo sapien
tcagggtgtagagacctttataggt

SEQ ID NO: 241214 - DNA, 25 bp, Homo sapien
ctttataggtcatgtttcaacttac

SEQ ID NO: 241215 - DNA, 25 bp, Homo sapien
ataggtcatgtttcaacttacagaa

SEQ ID NO: 241216 - DNA, 25 bp, Homo sapien
ggtcatgtttcaacttacagaaaat

SEQ ID NO: 241217 - DNA, 25 bp, Homo sapien
gcaacatttctgacgcaggtttaat

SEQ ID NO: 241218 - DNA, 25 bp, Homo sapien
gcaggtttaatgctgattagcccta

SEQ ID NO: 241219 - DNA, 25 bp, Homo sapien
taaaacaattctagggcagggctcc

SEQ ID NO: 241220 - DNA, 25 bp, Homo sapien
ggtttgcatataggccagctgcagt

SEQ ID NO: 241221 - DNA, 25 bp, Homo sapien
agttgctgcagctagagtctgtcaa

SEQ ID NO: 241222 - DNA, 25 bp, Homo sapien
tagatttttacatagctgctgcatt

SEQ ID NO: 241223 - DNA, 25 bp, Homo sapien
ggttaaattagcacagcatgaggca

SEQ ID NO: 241224 - DNA, 25 bp, Homo sapien
atagctgctgcatttgtcatccctt

SEQ ID NO: 241225 - DNA, 25 bp, Homo sapien
ttgtcatccctttcctgaagagctt

SEQ ID NO: 241226 - DNA, 25 bp, Homo sapien
tgaagagctttgttgctgtggtctt

SEQ ID NO: 241227 - DNA, 25 bp, Homo sapien
agggctgctttcagcaacatttctg

SEQ ID NO: 241228 - DNA, 25 bp, Homo sapien
aaacacttacttaacatctactctg

SEQ ID NO: 241229 - DNA, 25 bp, Homo sapien
cttaacatctactctgtgccaagca

SEQ ID NO: 241230 - DNA, 25 bp, Homo sapien
acaaggatttttgcctccaaggact

SEQ ID NO: 241231 - DNA, 25 bp, Homo sapien
gatttttgcctccaaggacttgtta

SEQ ID NO: 241232 - DNA, 25 bp, Homo sapien
tccaaggacttgttatcactgtaaa

SEQ ID NO: 241233 - DNA, 25 bp, Homo sapien
ggacttgttatcactgtaaacattt

SEQ ID NO: 241234 - DNA, 25 bp, Homo sapien
cattttgatgtatacaatatggcta

SEQ ID NO: 241235 - DNA, 25 bp, Homo sapien
tatattatgatgtatgctttctttt

SEQ ID NO: 241236 - DNA, 25 bp, Homo sapien
ataaatatttttcctgatcagcttt

SEQ ID NO: 241237 - DNA, 25 bp, Homo sapien
gatcagcttttaatatctgtcaaat

SEQ ID NO: 241238 - DNA, 25 bp, Homo sapien
aagatggtatataagatttcaggaa

SEQ ID NO: 241239 - DNA, 25 bp, Homo sapien
ggaactgtcagatacatactagtag

SEQ ID NO: 241240 - DNA, 25 bp, Homo sapien
agctaattttcctagcctgaaatta

SEQ ID NO: 241241 - DNA, 25 bp, Homo sapien
gcctgaaattatatactgcatctgc

SEQ ID NO: 241242 - DNA, 25 bp, Homo sapien
tgcatctgcactatgtacctactag

SEQ ID NO: 241243 - DNA, 25 bp, Homo sapien
gtacctactagggatctgacctcaa

SEQ ID NO: 241244 - DNA, 25 bp, Homo sapien
gggatctgacctcaagtgttttctg

SEQ ID NO: 241245 - DNA, 25 bp, Homo sapien
aagtgttttctgagcccaggcttcc

SEQ ID NO: 241246 - DNA, 25 bp, Homo sapien
cctggtgtggtgtcttttaccacat

SEQ ID NO: 241247 - DNA, 25 bp, Homo sapien
agctctatgcagtgagtttgtggtt

SEQ ID NO: 241248 - DNA, 25 bp, Homo sapien
aaatgttagcactgctaccactcag

SEQ ID NO: 241249 - DNA, 25 bp, Homo sapien
gctaccactcagcacgtgtaaaatt

SEQ ID NO: 241250 - DNA, 25 bp, Homo sapien
ggtcctatcatgaggatacccaggg

SEQ ID NO: 241251 - DNA, 25 bp, Homo sapien
gggacccacccttagtaatcattag

SEQ ID NO: 241252 - DNA, 25 bp, Homo sapien
tcagaggtgatcagtaacaaaagac

SEQ ID NO: 241253 - DNA, 25 bp, Homo sapien
ctatcacttaagaaattccgatggt

SEQ ID NO: 241254 - DNA, 25 bp, Homo sapien
gatggttttaggaactcaagacaaa

SEQ ID NO: 241255 - DNA, 25 bp, Homo sapien
ataccacactttacttttatcaggg

SEQ ID NO: 241256 - DNA, 25 bp, Homo sapien
tcaaccctctttctgtaggtcagta

SEQ ID NO: 241257 - DNA, 25 bp, Homo sapien
accctctttctgtaggtcagtaggt

SEQ ID NO: 241258 - DNA, 25 bp, Homo sapien
gttccagccctgtaatcacctggtc

SEQ ID NO: 241259 - DNA, 25 bp, Homo sapien
tggtccctctgtagctctgtagact

SEQ ID NO: 241260 - DNA, 25 bp, Homo sapien
gtagctctgtagactggtcctatca

SEQ ID NO: 241261 - DNA, 25 bp, Homo sapien
tgcccttggaaaacctcactccaag

SEQ ID NO: 241262 - DNA, 25 bp, Homo sapien
ctcactccaagtagaggctgtatct

SEQ ID NO: 241263 - DNA, 25 bp, Homo sapien
ggctgtatctggagtgagtgtctac

SEQ ID NO: 241264 - DNA, 25 bp, Homo sapien
gaattggtcagtgcatggcagaact

SEQ ID NO: 241265 - DNA, 25 bp, Homo sapien
tggcagaacttgacatggcagaact

SEQ ID NO: 241266 - DNA, 25 bp, Homo sapien
gtgccttcctacttggtcatcctgt

SEQ ID NO: 241267 - DNA, 25 bp, Homo sapien
gtcatcctgtggctgtaggtgcact

SEQ ID NO: 241268 - DNA, 25 bp, Homo sapien
gtaggtgcactgtcccaactgctca

SEQ ID NO: 241269 - DNA, 25 bp, Homo sapien
cattctcaccacagttacagtcgga

SEQ ID NO: 241270 - DNA, 25 bp, Homo sapien
acaggacaccaagagacatgggcag

SEQ ID NO: 241271 - DNA, 25 bp, Homo sapien
cagggccacgtgtagtctggacaga

SEQ ID NO: 241272 - DNA, 25 bp, Homo sapien
taggcaaatgtggaattcctcacag

SEQ ID NO: 241273 - DNA, 25 bp, Homo sapien
gtggaattcctcacagattaaccag

SEQ ID NO: 241274 - DNA, 25 bp, Homo sapien
ttcctcacagattaaccagtatttt

SEQ ID NO: 241275 - DNA, 25 bp, Homo sapien
attttatggcatgtcttctatttaa

SEQ ID NO: 241276 - DNA, 25 bp, Homo sapien
tggcatgtcttctatttaaaaggaa

SEQ ID NO: 241277 - DNA, 25 bp, Homo sapien
attcttgcatctggccttagaaatg

SEQ ID NO: 241278 - DNA, 25 bp, Homo sapien
gaagttatattctcaagtttatttt

SEQ ID NO: 241279 - DNA, 25 bp, Homo sapien
gtagctaaaatatttttgcaggtaa

SEQ ID NO: 241280 - DNA, 25 bp, Homo sapien
aagctgatagtacatgtgttgttca

SEQ ID NO: 241281 - DNA, 25 bp, Homo sapien
gtacatgtgttgttcaaaccttgtt

SEQ ID NO: 241282 - DNA, 25 bp, Homo sapien
atatctgctgtctttcagaaggcaa

SEQ ID NO: 241283 - DNA, 25 bp, Homo sapien
aagagcgctgcgtgagctgccatgt

SEQ ID NO: 241284 - DNA, 25 bp, Homo sapien
tgagctgccatgtatcgccagccgt

SEQ ID NO: 241285 - DNA, 25 bp, Homo sapien
gccagccgttgctttgttactgaac

SEQ ID NO: 241286 - DNA, 25 bp, Homo sapien
ttgttactgaacgtgccgccgacga

SEQ ID NO: 241287 - DNA, 25 bp, Homo sapien
ggctcatgtgtctgctgcgactcga

SEQ ID NO: 241288 - DNA, 25 bp, Homo sapien
tgctgcgactcgagatggcctgaaa

SEQ ID NO: 241289 - DNA, 25 bp, Homo sapien
gagatggcctgaaacgccactcatt

SEQ ID NO: 241290 - DNA, 25 bp, Homo sapien
cattctcccacttcagttcgttttt

SEQ ID NO: 241291 - DNA, 25 bp, Homo sapien
ggtaacgctatgaattgaattgtct

SEQ ID NO: 241292 - DNA, 25 bp, Homo sapien
attgtctgttctaggactgggcaca

SEQ ID NO: 241293 - DNA, 25 bp, Homo sapien
taggactgggcacagattttcccat

SEQ ID NO: 241294 - DNA, 25 bp, Homo sapien
ggactacactcatgtgacaccatgc

SEQ ID NO: 241295 - DNA, 25 bp, Homo sapien
atgtgacaccatgcccatctttatg

SEQ ID NO: 241296 - DNA, 25 bp, Homo sapien
accatgcccatctttatgttgtgta

SEQ ID NO: 241297 - DNA, 25 bp, Homo sapien
gaatcagctcagtctgaaaatctgt

SEQ ID NO: 241298 - DNA, 25 bp, Homo sapien
ttaaagagactcctgctatgttgca

SEQ ID NO: 241299 - DNA, 25 bp, Homo sapien
tgatttcttggagggttttgtcttt

SEQ ID NO: 241300 - DNA, 25 bp, Homo sapien
agagactcctgctatgttgcacaga

SEQ ID NO: 241301 - DNA, 25 bp, Homo sapien
ttttgtcttttgaatgtgtggtccc

SEQ ID NO: 241302 - DNA, 25 bp, Homo sapien
actcctgctatgttgcacagacttg

SEQ ID NO: 241303 - DNA, 25 bp, Homo sapien
tatgttgcacagacttgtgaattcc

SEQ ID NO: 241304 - DNA, 25 bp, Homo sapien
gtcactcaagtaatgtggactacac

SEQ ID NO: 241305 - DNA, 25 bp, Homo sapien
cataccatttataattgtttcaaag

SEQ ID NO: 241306 - DNA, 25 bp, Homo sapien
gaaaattagattcttctgcataaat

SEQ ID NO: 241307 - DNA, 25 bp, Homo sapien
gattcttctgcataaatctaacaaa

SEQ ID NO: 241308 - DNA, 25 bp, Homo sapien
aatagcaggatttgtgatcagcaca

SEQ ID NO: 241309 - DNA, 25 bp, Homo sapien
aatctgtatactgaaaacatatggg

SEQ ID NO: 241310 - DNA, 25 bp, Homo sapien
aggatttgtgatcagcacacacaca

SEQ ID NO: 241311 - DNA, 25 bp, Homo sapien
gaaagacataccatgttcgtggatc

SEQ ID NO: 241312 - DNA, 25 bp, Homo sapien
gacataccatgttcgtggatcggaa

SEQ ID NO: 241313 - DNA, 25 bp, Homo sapien
catgttcgtggatcggaaaactcaa

SEQ ID NO: 241314 - DNA, 25 bp, Homo sapien
cgtggatcggaaaactcaatatggt

SEQ ID NO: 241315 - DNA, 25 bp, Homo sapien
gaatcaacgcatttctgtataagaa

SEQ ID NO: 241316 - DNA, 25 bp, Homo sapien
cgcgccagcgtgaagttcccgggca

SEQ ID NO: 241317 - DNA, 25 bp, Homo sapien
aagttcccgggcatggtcatgaaag

SEQ ID NO: 241318 - DNA, 25 bp, Homo sapien
ggcatggtcatgaaagcgtggttct

SEQ ID NO: 241319 - DNA, 25 bp, Homo sapien
gaaagcgtggttctgtaagaaatca

SEQ ID NO: 241320 - DNA, 25 bp, Homo sapien
tgtaaacttcaaacttttggcaggt

SEQ ID NO: 241321 - DNA, 25 bp, Homo sapien
gttctctacttgtgatcagcagctg

SEQ ID NO: 241322 - DNA, 25 bp, Homo sapien
cagcagctggtcatagtggttgcct

SEQ ID NO: 241323 - DNA, 25 bp, Homo sapien
gtggttgcctggagtatatgccttt

SEQ ID NO: 241324 - DNA, 25 bp, Homo sapien
atgcctttttgtatcctttgaattt

SEQ ID NO: 241325 - DNA, 25 bp, Homo sapien
gtatcctttgaatttccagccatgt

SEQ ID NO: 241326 - DNA, 25 bp, Homo sapien
gaatttccagccatgtaaatgtatt

SEQ ID NO: 241327 - DNA, 25 bp, Homo sapien
cgttctcctgtgtctactaacaagg

SEQ ID NO: 241328 - DNA, 25 bp, Homo sapien
agagctcagagggtcctcgctgcca

SEQ ID NO: 241329 - DNA, 25 bp, Homo sapien
tagcccgtcatcagccggtggcagc

SEQ ID NO: 241330 - DNA, 25 bp, Homo sapien
agccggtggcagctccatcttccat

SEQ ID NO: 241331 - DNA, 25 bp, Homo sapien
ttcctggttttagggcagaatccat

SEQ ID NO: 241332 - DNA, 25 bp, Homo sapien
gaatccatggagactgcttccagaa

SEQ ID NO: 241333 - DNA, 25 bp, Homo sapien
gaaggcatctggctctgagttataa

SEQ ID NO: 241334 - DNA, 25 bp, Homo sapien
tctgagttataaattacttccctgg

SEQ ID NO: 241335 - DNA, 25 bp, Homo sapien
ttacttccctggtcctgacagtcac

SEQ ID NO: 241336 - DNA, 25 bp, Homo sapien
ctggttccacctttctgaggaggag

SEQ ID NO: 241337 - DNA, 25 bp, Homo sapien
ctttctgaggaggagcctggagtca

SEQ ID NO: 241338 - DNA, 25 bp, Homo sapien
gaaacatttaagatctctttattct

SEQ ID NO: 241339 - DNA, 25 bp, Homo sapien
taagatctctttattcttggtgttc

SEQ ID NO: 241340 - DNA, 25 bp, Homo sapien
gctgggccttcatgggaaatttctt

SEQ ID NO: 241341 - DNA, 25 bp, Homo sapien
ctgggccttcatgggaaatttctta

SEQ ID NO: 241342 - DNA, 25 bp, Homo sapien
ttctggaccacctattatttcaatg

SEQ ID NO: 241343 - DNA, 25 bp, Homo sapien
tctggaccacctattatttcaatgt

SEQ ID NO: 241344 - DNA, 25 bp, Homo sapien
tggaccacctattatttcaatgttg

SEQ ID NO: 241345 - DNA, 25 bp, Homo sapien
gaccacctattatttcaatgttgga

SEQ ID NO: 241346 - DNA, 25 bp, Homo sapien
ccacctattatttcaatgttggacc

SEQ ID NO: 241347 - DNA, 25 bp, Homo sapien
tatcttttctatttttcgtctatgt

SEQ ID NO: 241348 - DNA, 25 bp, Homo sapien
tcttttctatttttcgtctatgttt

SEQ ID NO: 241349 - DNA, 25 bp, Homo sapien
ccaatccaacactagataaagacta

SEQ ID NO: 241350 - DNA, 25 bp, Homo sapien
taaagactatataggcccatttatt

SEQ ID NO: 241351 - DNA, 25 bp, Homo sapien
gaacagacaataagttatggagaac

SEQ ID NO: 241352 - DNA, 25 bp, Homo sapien
gaacttcagaggacactaaggttgg

SEQ ID NO: 241353 - DNA, 25 bp, Homo sapien
acttcagaggacactaaggttggat

SEQ ID NO: 241354 - DNA, 25 bp, Homo sapien
ggacactaaggttggatgggatttt

SEQ ID NO: 241355 - DNA, 25 bp, Homo sapien
cactaaggttggatgggattttgga

SEQ ID NO: 241356 - DNA, 25 bp, Homo sapien
tggaagttgtacaggtcaatgccac

SEQ ID NO: 241357 - DNA, 25 bp, Homo sapien
aggtcaatgccactccatctattgg

SEQ ID NO: 241358 - DNA, 25 bp, Homo sapien
gtcaatgccactccatctattggct

SEQ ID NO: 241359 - DNA, 25 bp, Homo sapien
caatgccactccatctattggctga

SEQ ID NO: 241360 - DNA, 25 bp, Homo sapien
gattctttctctttcacatactagc

SEQ ID NO: 241361 - DNA, 25 bp, Homo sapien
ctttcacatactagctgtactgcct

SEQ ID NO: 241362 - DNA, 25 bp, Homo sapien
gctgtactgcctttcacaaatttct

SEQ ID NO: 241363 - DNA, 25 bp, Homo sapien
tggtatttgagacactgaccccaac

SEQ ID NO: 241364 - DNA, 25 bp, Homo sapien
gacacattgtgtgggctatatatta

SEQ ID NO: 241365 - DNA, 25 bp, Homo sapien
gtgggctatatattaactgctatta

SEQ ID NO: 241366 - DNA, 25 bp, Homo sapien
ttgagacactgaccccaacaattag

SEQ ID NO: 241367 - DNA, 25 bp, Homo sapien
gtatagtattattcttagctaacat

SEQ ID NO: 241368 - DNA, 25 bp, Homo sapien
tgaccccaacaattagatatctata

SEQ ID NO: 241369 - DNA, 25 bp, Homo sapien
agagtatctagaacaaggatgccta

SEQ ID NO: 241370 - DNA, 25 bp, Homo sapien
ggatgcctaggttcagattctttct

SEQ ID NO: 241371 - DNA, 25 bp, Homo sapien
atttgtgatgtgtgtccaaagctct

SEQ ID NO: 241372 - DNA, 25 bp, Homo sapien
tcataggcctcctgatttgtcctgc

SEQ ID NO: 241373 - DNA, 25 bp, Homo sapien
tttgtcctgcctgtctcaagtttaa

SEQ ID NO: 241374 - DNA, 25 bp, Homo sapien
tttaactttgtggtggtggcctaag

SEQ ID NO: 241375 - DNA, 25 bp, Homo sapien
gtggcctaagggaacctgacactga

SEQ ID NO: 241376 - DNA, 25 bp, Homo sapien
ctgacactgactccttctaggtaaa

SEQ ID NO: 241377 - DNA, 25 bp, Homo sapien
gactccttctaggtaaagtccacag

SEQ ID NO: 241378 - DNA, 25 bp, Homo sapien
agtgacggtgagtactgcccagcac

SEQ ID NO: 241379 - DNA, 25 bp, Homo sapien
gtgagtactgcccagcacatccctg

SEQ ID NO: 241380 - DNA, 25 bp, Homo sapien
cattccggctctgtgatacatgtgt

SEQ ID NO: 241381 - DNA, 25 bp, Homo sapien
tgtgatacatgtgttactgacttca

SEQ ID NO: 241382 - DNA, 25 bp, Homo sapien
aggccaggcactctgtagtcttcag

SEQ ID NO: 241383 - DNA, 25 bp, Homo sapien
gccaggcactctgtagtcttcagtg

SEQ ID NO: 241384 - DNA, 25 bp, Homo sapien
aggcactctgtagtcttcagtgcta

SEQ ID NO: 241385 - DNA, 25 bp, Homo sapien
actctgtagtcttcagtgctaccgc

SEQ ID NO: 241386 - DNA, 25 bp, Homo sapien
tgtagtcttcagtgctaccgcatca

SEQ ID NO: 241387 - DNA, 25 bp, Homo sapien
tagtcttcagtgctaccgcatcaac

SEQ ID NO: 241388 - DNA, 25 bp, Homo sapien
agtgctaccgcatcaacctgcagat

SEQ ID NO: 241389 - DNA, 25 bp, Homo sapien
tcccatgcccgctcttgagtatctt

SEQ ID NO: 241390 - DNA, 25 bp, Homo sapien
gagtatcttccccaccctattaaat

SEQ ID NO: 241391 - DNA, 25 bp, Homo sapien
tcttccccaccctattaaattacat

SEQ ID NO: 241392 - DNA, 25 bp, Homo sapien
caccctattaaattacatccggtgc

SEQ ID NO: 241393 - DNA, 25 bp, Homo sapien
gatggctataagtgccgtagtgttc

SEQ ID NO: 241394 - DNA, 25 bp, Homo sapien
taagtgccgtagtgttctgtgggtc

SEQ ID NO: 241395 - DNA, 25 bp, Homo sapien
ggtctctggtgtctgccagtgataa

SEQ ID NO: 241396 - DNA, 25 bp, Homo sapien
cagtgataagtgtggcaccccagga

SEQ ID NO: 241397 - DNA, 25 bp, Homo sapien
ataagtgtggcaccccaggaaggct

SEQ ID NO: 241398 - DNA, 25 bp, Homo sapien
tgtggaccccatcaaggtgctatgt

SEQ ID NO: 241399 - DNA, 25 bp, Homo sapien
aaggtgctatgtgagggccatgctt

SEQ ID NO: 241400 - DNA, 25 bp, Homo sapien
ggtgggcccagtagaccctgcagcc

SEQ ID NO: 241401 - DNA, 25 bp, Homo sapien
actgcccttgtgtactcctgctttg

SEQ ID NO: 241402 - DNA, 25 bp, Homo sapien
tactcctgctttgctacgttatcat

SEQ ID NO: 241403 - DNA, 25 bp, Homo sapien
tgctttgctacgttatcattgatca

SEQ ID NO: 241404 - DNA, 25 bp, Homo sapien
gcctgcattgcactgaaggtatctt

SEQ ID NO: 241405 - DNA, 25 bp, Homo sapien
atctttaactcctgcttctgtacaa

SEQ ID NO: 241406 - DNA, 25 bp, Homo sapien
attgagaccatgagcaaagtgcacc

SEQ ID NO: 241407 - DNA, 25 bp, Homo sapien
aagtgcaccaaaccacacacgaggt

SEQ ID NO: 241408 - DNA, 25 bp, Homo sapien
gaggagtgccacatcatgctagatt

SEQ ID NO: 241409 - DNA, 25 bp, Homo sapien
gagcgcaatggcaggcacacgagaa

SEQ ID NO: 241410 - DNA, 25 bp, Homo sapien
aagaaaatatcccaccttgctgttt

SEQ ID NO: 241411 - DNA, 25 bp, Homo sapien
cttgctgtttagaaccactgtgctg

SEQ ID NO: 241412 - DNA, 25 bp, Homo sapien
aaccactgtgctgtgagcgctgaga

SEQ ID NO: 241413 - DNA, 25 bp, Homo sapien
agaagagaagccatcccacgcagca

SEQ ID NO: 241414 - DNA, 25 bp, Homo sapien
gcagcacttgcaaggcgatccgagc

SEQ ID NO: 241415 - DNA, 25 bp, Homo sapien
acttttaaaggccacatcacctgag

SEQ ID NO: 241416 - DNA, 25 bp, Homo sapien
taaaggccacatcacctgagactag

SEQ ID NO: 241417 - DNA, 25 bp, Homo sapien
tcacctgagactagggtaatcatct

SEQ ID NO: 241418 - DNA, 25 bp, Homo sapien
tagggtaatcatctttacttctggt

SEQ ID NO: 241419 - DNA, 25 bp, Homo sapien
ctttacttctggttcctgaaatcat

SEQ ID NO: 241420 - DNA, 25 bp, Homo sapien
atatttttccagtggaccatcctcc

SEQ ID NO: 241421 - DNA, 25 bp, Homo sapien
ggctgtggttgttgagcatgctttc

SEQ ID NO: 241422 - DNA, 25 bp, Homo sapien
gttgagcatgctttcagaacaccta

SEQ ID NO: 241423 - DNA, 25 bp, Homo sapien
gctttcagaacacctatgtggctta

SEQ ID NO: 241424 - DNA, 25 bp, Homo sapien
acacctatgtggcttaaaacttagt

SEQ ID NO: 241425 - DNA, 25 bp, Homo sapien
gttttgtgttcaacactacgtgtaa

SEQ ID NO: 241426 - DNA, 25 bp, Homo sapien
gtccttgatgtgaccctgtgatatc

SEQ ID NO: 241427 - DNA, 25 bp, Homo sapien
gaccctgtgatatcctgtctcagga

SEQ ID NO: 241428 - DNA, 25 bp, Homo sapien
tgctgccccaagaaacacattgcac

SEQ ID NO: 241429 - DNA, 25 bp, Homo sapien
ccaagaaacacattgcacctgccaa

SEQ ID NO: 241430 - DNA, 25 bp, Homo sapien
acctgccaatagcttgtgggtctgt

SEQ ID NO: 241431 - DNA, 25 bp, Homo sapien
aagactgcggtgtttgagtttctca

SEQ ID NO: 241432 - DNA, 25 bp, Homo sapien
tgtttgagtttctcacacccacctg

SEQ ID NO: 241433 - DNA, 25 bp, Homo sapien
agggctctgtcctctagttttgaga

SEQ ID NO: 241434 - DNA, 25 bp, Homo sapien
tcaacctctgcagaacttcaagaag

SEQ ID NO: 241435 - DNA, 25 bp, Homo sapien
agaaagagaccaagtccctccacgt

SEQ ID NO: 241436 - DNA, 25 bp, Homo sapien
cagcagctgtggtctaagagttgtg

SEQ ID NO: 241437 - DNA, 25 bp, Homo sapien
gtcttctaaagacattttcctagca

SEQ ID NO: 241438 - DNA, 25 bp, Homo sapien
tcttctaaagacattttcctagcat

SEQ ID NO: 241439 - DNA, 25 bp, Homo sapien
ttctaaagacattttcctagcattt

SEQ ID NO: 241440 - DNA, 25 bp, Homo sapien
tctaaagacattttcctagcatttc

SEQ ID NO: 241441 - DNA, 25 bp, Homo sapien
taaagacattttcctagcatttcac

SEQ ID NO: 241442 - DNA, 25 bp, Homo sapien
aaagacattttcctagcatttcact

SEQ ID NO: 241443 - DNA, 25 bp, Homo sapien
aagacattttcctagcatttcactg

SEQ ID NO: 241444 - DNA, 25 bp, Homo sapien
agacattttcctagcatttcactgc

SEQ ID NO: 241445 - DNA, 25 bp, Homo sapien
gacattttcctagcatttcactgcg

SEQ ID NO: 241446 - DNA, 25 bp, Homo sapien
acattttcctagcatttcactgcgg

SEQ ID NO: 241447 - DNA, 25 bp, Homo sapien
atacacatttttttagtcattaata

SEQ ID NO: 241448 - DNA, 25 bp, Homo sapien
gaagcagagctctagtttagccttt

SEQ ID NO: 241449 - DNA, 25 bp, Homo sapien
tagtttagcctttcttgtctcacag

SEQ ID NO: 241450 - DNA, 25 bp, Homo sapien
agcctttcttgtctcacagatgtgc

SEQ ID NO: 241451 - DNA, 25 bp, Homo sapien
agatgtgctgtatcccaggcatact

SEQ ID NO: 241452 - DNA, 25 bp, Homo sapien
tatcccaggcatactataaaacgaa

SEQ ID NO: 241453 - DNA, 25 bp, Homo sapien
ataaaacgaagagtgcccaaccaag

SEQ ID NO: 241454 - DNA, 25 bp, Homo sapien
gtgcccaaccaagctttgaatcgta

SEQ ID NO: 241455 - DNA, 25 bp, Homo sapien
gaatcgtattaacaatgcccacctc

SEQ ID NO: 241456 - DNA, 25 bp, Homo sapien
aatgcccacctctatgctagctgag

SEQ ID NO: 241457 - DNA, 25 bp, Homo sapien
gttgctcatatttaaactgacctaa

SEQ ID NO: 241458 - DNA, 25 bp, Homo sapien
ctgacctaaatatgttttgctgagc

SEQ ID NO: 241459 - DNA, 25 bp, Homo sapien
tgaagcacctgcctttctaaatatg

SEQ ID NO: 241460 - DNA, 25 bp, Homo sapien
gaagagagttacttttggagaggac

SEQ ID NO: 241461 - DNA, 25 bp, Homo sapien
gagaggacttaagcccggaagtgtt

SEQ ID NO: 241462 - DNA, 25 bp, Homo sapien
acttaagcccggaagtgtttgatga

SEQ ID NO: 241463 - DNA, 25 bp, Homo sapien
gtttgatgaatctttgccagcaaat

SEQ ID NO: 241464 - DNA, 25 bp, Homo sapien
aagacttcagtggtctcagttccct

SEQ ID NO: 241465 - DNA, 25 bp, Homo sapien
agttccctgctgcttgagcagtcac

SEQ ID NO: 241466 - DNA, 25 bp, Homo sapien
gcttgagcagtcacctgttcctgag

SEQ ID NO: 241467 - DNA, 25 bp, Homo sapien
gagccattacctcaaccagattttg

SEQ ID NO: 241468 - DNA, 25 bp, Homo sapien
acctcaaccagattttgatgacaag

SEQ ID NO: 241469 - DNA, 25 bp, Homo sapien
gaaaacatagaaccacttcaagtat

SEQ ID NO: 241470 - DNA, 25 bp, Homo sapien
ctgaacctgttcatggtgcatcaga

SEQ ID NO: 241471 - DNA, 25 bp, Homo sapien
gaacctgttcatggtgcatcagaac

SEQ ID NO: 241472 - DNA, 25 bp, Homo sapien
acctgttcatggtgcatcagaacat

SEQ ID NO: 241473 - DNA, 25 bp, Homo sapien
gttcatggtgcatcagaacataatg

SEQ ID NO: 241474 - DNA, 25 bp, Homo sapien
tggtgcatcagaacataatgctgac

SEQ ID NO: 241475 - DNA, 25 bp, Homo sapien
tccacttgctccagctgacaggcac

SEQ ID NO: 241476 - DNA, 25 bp, Homo sapien
tcagtgtggcccgagcctgtgtcct

SEQ ID NO: 241477 - DNA, 25 bp, Homo sapien
cctcccttggctggcctcacgatgg

SEQ ID NO: 241478 - DNA, 25 bp, Homo sapien
ggagctgccttccactgccatcggg

SEQ ID NO: 241479 - DNA, 25 bp, Homo sapien
tccaggccccgtagatgggcaagga

SEQ ID NO: 241480 - DNA, 25 bp, Homo sapien
aggccccgtagatgggcaaggactt

SEQ ID NO: 241481 - DNA, 25 bp, Homo sapien
gactgcatgtcaaggtattttgtac

SEQ ID NO: 241482 - DNA, 25 bp, Homo sapien
tacaatcccagaacttggttccttc

SEQ ID NO: 241483 - DNA, 25 bp, Homo sapien
gttccttccccatgaggactaacaa

SEQ ID NO: 241484 - DNA, 25 bp, Homo sapien
caatcatgatcaagtgtgcactgga

SEQ ID NO: 241485 - DNA, 25 bp, Homo sapien
gcttctcacttcgtgcttcataaat

SEQ ID NO: 241486 - DNA, 25 bp, Homo sapien
aaatgacaatcactgcttgatgcag

SEQ ID NO: 241487 - DNA, 25 bp, Homo sapien
tgcagatgttgcactgtatccactc

SEQ ID NO: 241488 - DNA, 25 bp, Homo sapien
tgttgcactgtatccactcagggat

SEQ ID NO: 241489 - DNA, 25 bp, Homo sapien
tccctttaaagagaatccagtcatg

SEQ ID NO: 241490 - DNA, 25 bp, Homo sapien
taaaaagctgcccttcgaagatctc

SEQ ID NO: 241491 - DNA, 25 bp, Homo sapien
gaagatctcctatgactgcatgtca

SEQ ID NO: 241492 - DNA, 25 bp, Homo sapien
aaggcgaacgggttatttggcactg

SEQ ID NO: 241493 - DNA, 25 bp, Homo sapien
aacgggttatttggcactggcgcta

SEQ ID NO: 241494 - DNA, 25 bp, Homo sapien
gttatttggcactggcgctacccaa

SEQ ID NO: 241495 - DNA, 25 bp, Homo sapien
tggcactggcgctacccaaggactt

SEQ ID NO: 241496 - DNA, 25 bp, Homo sapien
cccagtgtacagtctgtccctcagg

SEQ ID NO: 241497 - DNA, 25 bp, Homo sapien
agtgtacagtctgtccctcaggcct

SEQ ID NO: 241498 - DNA, 25 bp, Homo sapien
agtctgtccctcaggcctcgagcga

SEQ ID NO: 241499 - DNA, 25 bp, Homo sapien
cgcgtgtaacgggctagtcgtcccg

SEQ ID NO: 241500 - DNA, 25 bp, Homo sapien
gtgaaggccgagacaccgggaaaag

SEQ ID NO: 241501 - DNA, 25 bp, Homo sapien
gaaaagaaagaaacgctgctcaaac

SEQ ID NO: 241502 - DNA, 25 bp, Homo sapien
gaaagaaacgctgctcaaacaagca

SEQ ID NO: 241503 - DNA, 25 bp, Homo sapien
gcccgagtggcagcaggatgagttt

SEQ ID NO: 241504 - DNA, 25 bp, Homo sapien
acaatgacagcttctcctacgatga

SEQ ID NO: 241505 - DNA, 25 bp, Homo sapien
tcctacgatgagtctgagaacctgg

SEQ ID NO: 241506 - DNA, 25 bp, Homo sapien
atgagtctgagaacctggaccaaga

SEQ ID NO: 241507 - DNA, 25 bp, Homo sapien
ctggaccaagagactttcttctttg

SEQ ID NO: 241508 - DNA, 25 bp, Homo sapien
ggatgaagatgaggcctatgactga

SEQ ID NO: 241509 - DNA, 25 bp, Homo sapien
gggcagatgcaggaaacacctagag

SEQ ID NO: 241510 - DNA, 25 bp, Homo sapien
aaacacctagagcagccccagagtc

SEQ ID NO: 241511 - DNA, 25 bp, Homo sapien
gggattcccagcgtctgtagtgctt

SEQ ID NO: 241512 - DNA, 25 bp, Homo sapien
ctgtagtgcttcctgtttgctgaat

SEQ ID NO: 241513 - DNA, 25 bp, Homo sapien
ttgctgaataaaggtctctttctca

SEQ ID NO: 241514 - DNA, 25 bp, Homo sapien
gcagctgcccagaaacttcctggga

SEQ ID NO: 241515 - DNA, 25 bp, Homo sapien
gctgcccagaaacttcctgggagaa

SEQ ID NO: 241516 - DNA, 25 bp, Homo sapien
tcctgggagaaagagccctcgggct

SEQ ID NO: 241517 - DNA, 25 bp, Homo sapien
gagaaagagccctcgggctgccttc

SEQ ID NO: 241518 - DNA, 25 bp, Homo sapien
ttcccctctgcgtgtttcgaagtgg

SEQ ID NO: 241519 - DNA, 25 bp, Homo sapien
tctgcgtgtttcgaagtgggatgac

SEQ ID NO: 241520 - DNA, 25 bp, Homo sapien
ttcgaagtgggatgacagtcggcca

SEQ ID NO: 241521 - DNA, 25 bp, Homo sapien
atgacagtcggccacggaaaacaag

SEQ ID NO: 241522 - DNA, 25 bp, Homo sapien
cagtcggccacggaaaacaagagga

SEQ ID NO: 241523 - DNA, 25 bp, Homo sapien
cccgagacctgcacagatgaaggag

SEQ ID NO: 241524 - DNA, 25 bp, Homo sapien
atgaaggagcagaggttctgaccga

SEQ ID NO: 241525 - DNA, 25 bp, Homo sapien
gttgagtgtggcctcaaaccattct

SEQ ID NO: 241526 - DNA, 25 bp, Homo sapien
ttctcctgggtagctcagtcataaa

SEQ ID NO: 241527 - DNA, 25 bp, Homo sapien
ataaaacaccgaatgcctgcctcaa

SEQ ID NO: 241528 - DNA, 25 bp, Homo sapien
atgcctgcctcaaaatagcctctga

SEQ ID NO: 241529 - DNA, 25 bp, Homo sapien
agctgttgacaagtgaagccctcag

SEQ ID NO: 241530 - DNA, 25 bp, Homo sapien
aagccctcaggttgtgtgggattcc

SEQ ID NO: 241531 - DNA, 25 bp, Homo sapien
gtgtgggattccagcaggttattac

SEQ ID NO: 241532 - DNA, 25 bp, Homo sapien
ctcatgtactgttgtcttctaggta

SEQ ID NO: 241533 - DNA, 25 bp, Homo sapien
ttgtcttctaggtaaccaccctgaa

SEQ ID NO: 241534 - DNA, 25 bp, Homo sapien
gaaccaagcagcctttggtccagtg

SEQ ID NO: 241535 - DNA, 25 bp, Homo sapien
agcctttggtccagtgctgctcctt

SEQ ID NO: 241536 - DNA, 25 bp, Homo sapien
tgactgcaggtgtacatgtgtttgc

SEQ ID NO: 241537 - DNA, 25 bp, Homo sapien
gcgtttctacctatattacggactt

SEQ ID NO: 241538 - DNA, 25 bp, Homo sapien
aaataagcacagaacccttgctccc

SEQ ID NO: 241539 - DNA, 25 bp, Homo sapien
ccttgctcccggaggagtcaattta

SEQ ID NO: 241540 - DNA, 25 bp, Homo sapien
gtcaatttagactcacttgcctggt

SEQ ID NO: 241541 - DNA, 25 bp, Homo sapien
acttgcctggtctatcatcaagctc

SEQ ID NO: 241542 - DNA, 25 bp, Homo sapien
tatcatcaagctcctcagctgaggc

SEQ ID NO: 241543 - DNA, 25 bp, Homo sapien
gaggcccacatggtggtgccaatga

SEQ ID NO: 241544 - DNA, 25 bp, Homo sapien
gtgccaatgaggctggaccaacctg

SEQ ID NO: 241545 - DNA, 25 bp, Homo sapien
gtttgagaatgtgtctgtcctttac

SEQ ID NO: 241546 - DNA, 25 bp, Homo sapien
tgtcctttacataccacttctgggc

SEQ ID NO: 241547 - DNA, 25 bp, Homo sapien
gacatgatgcttagtgttgctgcag

SEQ ID NO: 241548 - DNA, 25 bp, Homo sapien
ttgctgcagctatctcatgaccttg

SEQ ID NO: 241549 - DNA, 25 bp, Homo sapien
atgaccttgggcaaaacatcccaac

SEQ ID NO: 241550 - DNA, 25 bp, Homo sapien
catcccaacacacaggagggccaaa

SEQ ID NO: 241551 - DNA, 25 bp, Homo sapien
aggagggccaaacaagcagtcagaa

SEQ ID NO: 241552 - DNA, 25 bp, Homo sapien
aagcctgagtcttgtgggtgttgtt

SEQ ID NO: 241553 - DNA, 25 bp, Homo sapien
tgagcagctgaacaaaccctaggat

SEQ ID NO: 241554 - DNA, 25 bp, Homo sapien
gaacaaaccctaggatggcttcctt

SEQ ID NO: 241555 - DNA, 25 bp, Homo sapien
aggattgcgaacaatgaagctctat

SEQ ID NO: 241556 - DNA, 25 bp, Homo sapien
caggaggtaagcaagggttctgttc

SEQ ID NO: 241557 - DNA, 25 bp, Homo sapien
tgtttctgcctttgaacgtggctgt

SEQ ID NO: 241558 - DNA, 25 bp, Homo sapien
gcaggaaagttcaataggagcgtct

SEQ ID NO: 241559 - DNA, 25 bp, Homo sapien
ataggagcgtcttggctctgtgacc

SEQ ID NO: 241560 - DNA, 25 bp, Homo sapien
ctctgtgacctctgatgagatgatt

SEQ ID NO: 241561 - DNA, 25 bp, Homo sapien
gatgattttattgtgagctttctgt

SEQ ID NO: 241562 - DNA, 25 bp, Homo sapien
tttattgtgagctttctgttcaccc

SEQ ID NO: 241563 - DNA, 25 bp, Homo sapien
tttctctgtgttcatttccggagct

SEQ ID NO: 241564 - DNA, 25 bp, Homo sapien
tgcctgaggtcacattccctgatgg

SEQ ID NO: 241565 - DNA, 25 bp, Homo sapien
ctgaggtcacattccctgatgggaa

SEQ ID NO: 241566 - DNA, 25 bp, Homo sapien
ctgtgttcatttccggagctgtggc

SEQ ID NO: 241567 - DNA, 25 bp, Homo sapien
ttcatttccggagctgtggcaggtg

SEQ ID NO: 241568 - DNA, 25 bp, Homo sapien
gaggacatggaatcttgcttctgct

SEQ ID NO: 241569 - DNA, 25 bp, Homo sapien
aattgtgatggtgattctgctagta

SEQ ID NO: 241570 - DNA, 25 bp, Homo sapien
gacagtgtaacttctgcgtctacaa

SEQ ID NO: 241571 - DNA, 25 bp, Homo sapien
ctacaaaaagaggataggccgtcac

SEQ ID NO: 241572 - DNA, 25 bp, Homo sapien
aaagcccaatggtactgtctctatg

SEQ ID NO: 241573 - DNA, 25 bp, Homo sapien
caatggtactgtctctatggcagag

SEQ ID NO: 241574 - DNA, 25 bp, Homo sapien
gttgtactcaagatgttttcctgga

SEQ ID NO: 241575 - DNA, 25 bp, Homo sapien
tccaactttcctgttcttcctttgg

SEQ ID NO: 241576 - DNA, 25 bp, Homo sapien
aaattcattctgctttctgaccagg

SEQ ID NO: 241577 - DNA, 25 bp, Homo sapien
tctgctttctgaccaggatttccag

SEQ ID NO: 241578 - DNA, 25 bp, Homo sapien
ttccagaaactctgacccttctaag

SEQ ID NO: 241579 - DNA, 25 bp, Homo sapien
cccttctaagaggtctgggtggaat

SEQ ID NO: 241580 - DNA, 25 bp, Homo sapien
gaaaaacctggccacttattgccgg

SEQ ID NO: 241581 - DNA, 25 bp, Homo sapien
tggccacttattgccggccagtgaa

SEQ ID NO: 241582 - DNA, 25 bp, Homo sapien
tgccggccagtgaaggccaagcact

SEQ ID NO: 241583 - DNA, 25 bp, Homo sapien
aaggccaagcactgtcaggctggtg

SEQ ID NO: 241584 - DNA, 25 bp, Homo sapien
agcactgtcaggctggtgcccctgc

SEQ ID NO: 241585 - DNA, 25 bp, Homo sapien
gatgtggcctgctctgtgcgccgca

SEQ ID NO: 241586 - DNA, 25 bp, Homo sapien
tggcctgctctgtgcgccgcaagaa

SEQ ID NO: 241587 - DNA, 25 bp, Homo sapien
tctgtgcgccgcaagaagccaggcc

SEQ ID NO: 241588 - DNA, 25 bp, Homo sapien
cctggcctttgaggagaagtgctct

SEQ ID NO: 241589 - DNA, 25 bp, Homo sapien
tttgaggagaagtgctctacactga

SEQ ID NO: 241590 - DNA, 25 bp, Homo sapien
caaggcttctcagctggagaaccgg

SEQ ID NO: 241591 - DNA, 25 bp, Homo sapien
cagctgagtggatgaagtgtaacaa

SEQ ID NO: 241592 - DNA, 25 bp, Homo sapien
ctgttgcacgctgagaggagtcaga

SEQ ID NO: 241593 - DNA, 25 bp, Homo sapien
agccacagcacctgaagtggcaaag

SEQ ID NO: 241594 - DNA, 25 bp, Homo sapien
agaggagtcagaattagcatttttc

SEQ ID NO: 241595 - DNA, 25 bp, Homo sapien
tttttcatgaaagttccccacgtct

SEQ ID NO: 241596 - DNA, 25 bp, Homo sapien
gaaagttccccacgtctctactaag

SEQ ID NO: 241597 - DNA, 25 bp, Homo sapien
gactaggtaattacacagaggcttg

SEQ ID NO: 241598 - DNA, 25 bp, Homo sapien
cagaggcttgaaatgttacatcacc

SEQ ID NO: 241599 - DNA, 25 bp, Homo sapien
atgttacatcaccagagccaagtcc

SEQ ID NO: 241600 - DNA, 25 bp, Homo sapien
ctcccttcagatcagttactggctg

SEQ ID NO: 241601 - DNA, 25 bp, Homo sapien
gatccatggtctttgtagggtatta

SEQ ID NO: 241602 - DNA, 25 bp, Homo sapien
aagtgttggatctgggctggtccct

SEQ ID NO: 241603 - DNA, 25 bp, Homo sapien
ttaggtccctggttgtatgttccca

SEQ ID NO: 241604 - DNA, 25 bp, Homo sapien
ttgtatgttcccatagcaccccata

SEQ ID NO: 241605 - DNA, 25 bp, Homo sapien
ccatacttcctctctcagaataatc

SEQ ID NO: 241606 - DNA, 25 bp, Homo sapien
atcatttcccttgtaatgctcagca

SEQ ID NO: 241607 - DNA, 25 bp, Homo sapien
tgtaatgctcagcatccgcatcctg

SEQ ID NO: 241608 - DNA, 25 bp, Homo sapien
atcctgcttgactgcaaacttgctg

SEQ ID NO: 241609 - DNA, 25 bp, Homo sapien
aaacttgctgaaggtagggactgtt

SEQ ID NO: 241610 - DNA, 25 bp, Homo sapien
agggactgtttgtcttggacttcgc

SEQ ID NO: 241611 - DNA, 25 bp, Homo sapien
ttcgctgccagtccttagaacagtg

SEQ ID NO: 241612 - DNA, 25 bp, Homo sapien
gtctgggacacagtgtgttctcaaa

SEQ ID NO: 241613 - DNA, 25 bp, Homo sapien
cgctttgccttgcttgggaaatgca

SEQ ID NO: 241614 - DNA, 25 bp, Homo sapien
ctttgccttgcttgggaaatgcagt

SEQ ID NO: 241615 - DNA, 25 bp, Homo sapien
tgccttgcttgggaaatgcagtttc

SEQ ID NO: 241616 - DNA, 25 bp, Homo sapien
ccttgcttgggaaatgcagtttcgt

SEQ ID NO: 241617 - DNA, 25 bp, Homo sapien
tgggaaatgcagtttcgtgtcacct

SEQ ID NO: 241618 - DNA, 25 bp, Homo sapien
agatatgtagttgatcatctagaca

SEQ ID NO: 241619 - DNA, 25 bp, Homo sapien
gttgatcatctagacataattgctg

SEQ ID NO: 241620 - DNA, 25 bp, Homo sapien
agtcacacagcatcattatcagatt

SEQ ID NO: 241621 - DNA, 25 bp, Homo sapien
cacacagcatcattatcagatttat

SEQ ID NO: 241622 - DNA, 25 bp, Homo sapien
atcagatttattacacaacgacttt

SEQ ID NO: 241623 - DNA, 25 bp, Homo sapien
gatttattacacaacgacttttttg

SEQ ID NO: 241624 - DNA, 25 bp, Homo sapien
agaactttcaactctgacctcgtga

SEQ ID NO: 241625 - DNA, 25 bp, Homo sapien
tgacctcgtgaccttttttggaaca

SEQ ID NO: 241626 - DNA, 25 bp, Homo sapien
tgaccttttttggaacagcagcagc

SEQ ID NO: 241627 - DNA, 25 bp, Homo sapien
agcagcactaacttgaccttttcgt

SEQ ID NO: 241628 - DNA, 25 bp, Homo sapien
gggtcattgacagactgtctgagca

SEQ ID NO: 241629 - DNA, 25 bp, Homo sapien
tgtctgagcacatagttgcctccct

SEQ ID NO: 241630 - DNA, 25 bp, Homo sapien
acatagttgcctcccttataacttc

SEQ ID NO: 241631 - DNA, 25 bp, Homo sapien
cttcagttttttcgtttggaatatg

SEQ ID NO: 241632 - DNA, 25 bp, Homo sapien
acttgaatcatgaacgccaacctag

SEQ ID NO: 241633 - DNA, 25 bp, Homo sapien
gaacgccaacctagaaagacaatgt

SEQ ID NO: 241634 - DNA, 25 bp, Homo sapien
gtgaagcaagtacacataccattta

SEQ ID NO: 241635 - DNA, 25 bp, Homo sapien
tcctgtattgctcttaggaatatac

SEQ ID NO: 241636 - DNA, 25 bp, Homo sapien
tattgctcttaggaatatacctcgt

SEQ ID NO: 241637 - DNA, 25 bp, Homo sapien
ggaatatacctcgtaaccttagcaa

SEQ ID NO: 241638 - DNA, 25 bp, Homo sapien
atgttgggaaattctctcaagctac

SEQ ID NO: 241639 - DNA, 25 bp, Homo sapien
gggaaattctctcaagctacagtag

SEQ ID NO: 241640 - DNA, 25 bp, Homo sapien
gctacagtagaactgttccctcttc

SEQ ID NO: 241641 - DNA, 25 bp, Homo sapien
agtagaactgttccctcttctgggc

SEQ ID NO: 241642 - DNA, 25 bp, Homo sapien
tcttctgggccacttgatatcactt

SEQ ID NO: 241643 - DNA, 25 bp, Homo sapien
tctgggccacttgatatcacttatc

SEQ ID NO: 241644 - DNA, 25 bp, Homo sapien
gggccacttgatatcacttatcttt

SEQ ID NO: 241645 - DNA, 25 bp, Homo sapien
atcacttatcttttgggtttttcag

SEQ ID NO: 241646 - DNA, 25 bp, Homo sapien
taacaagtatgtaccattactgaat

SEQ ID NO: 241647 - DNA, 25 bp, Homo sapien
gtaccattactgaatattaaatcct

SEQ ID NO: 241648 - DNA, 25 bp, Homo sapien
aaatccttctttaccatagctacag

SEQ ID NO: 241649 - DNA, 25 bp, Homo sapien
ttctttaccatagctacagttaagt

SEQ ID NO: 241650 - DNA, 25 bp, Homo sapien
cagttaagtaggtgtatctcagaaa

SEQ ID NO: 241651 - DNA, 25 bp, Homo sapien
aatgtagtgaaattgtccacagcaa

SEQ ID NO: 241652 - DNA, 25 bp, Homo sapien
aagctggcccaagtgctcacatttt

SEQ ID NO: 241653 - DNA, 25 bp, Homo sapien
aagtgctcacattttatacccgctc

SEQ ID NO: 241654 - DNA, 25 bp, Homo sapien
attttatacccgctctgtcttagtg

SEQ ID NO: 241655 - DNA, 25 bp, Homo sapien
cgctctgtcttagtgcgttgcaaga

SEQ ID NO: 241656 - DNA, 25 bp, Homo sapien
taaaaagggatatctatggatttcc

SEQ ID NO: 241657 - DNA, 25 bp, Homo sapien
agaacacaaccacccgcttcaggtc

SEQ ID NO: 241658 - DNA, 25 bp, Homo sapien
gaagagcctccaatcacctagactt

SEQ ID NO: 241659 - DNA, 25 bp, Homo sapien
caatcacctagacttccctaattca

SEQ ID NO: 241660 - DNA, 25 bp, Homo sapien
acctagacttccctaattcactgga

SEQ ID NO: 241661 - DNA, 25 bp, Homo sapien
gacttccctaattcactggaacagg

SEQ ID NO: 241662 - DNA, 25 bp, Homo sapien
tccctaattcactggaacaggaaag

SEQ ID NO: 241663 - DNA, 25 bp, Homo sapien
acaaagcacttggtggtgagagtga

SEQ ID NO: 241664 - DNA, 25 bp, Homo sapien
tggtgagagtgagaacacttttggc

SEQ ID NO: 241665 - DNA, 25 bp, Homo sapien
taatccaagccaggggaactcgcgg

SEQ ID NO: 241666 - DNA, 25 bp, Homo sapien
tcaggcgcagccctcgctgggtaat

SEQ ID NO: 241667 - DNA, 25 bp, Homo sapien
cgcagccctcgctgggtaatggaag

SEQ ID NO: 241668 - DNA, 25 bp, Homo sapien
gcaaactaaaaagacgtgggcaata

SEQ ID NO: 241669 - DNA, 25 bp, Homo sapien
caaactaaaaagacgtgggcaatat

SEQ ID NO: 241670 - DNA, 25 bp, Homo sapien
aaaaaattgtacatcttgatcttag

SEQ ID NO: 241671 - DNA, 25 bp, Homo sapien
aaattgtacatcttgatcttagcaa

SEQ ID NO: 241672 - DNA, 25 bp, Homo sapien
ttgtacatcttgatcttagcaaata

SEQ ID NO: 241673 - DNA, 25 bp, Homo sapien
acatcttgatcttagcaaatatcct

SEQ ID NO: 241674 - DNA, 25 bp, Homo sapien
atatccttattgtagagacacttaa

SEQ ID NO: 241675 - DNA, 25 bp, Homo sapien
tggtattttaatatctgcagttctg

SEQ ID NO: 241676 - DNA, 25 bp, Homo sapien
tctgcagttctgaggtagggtgtaa

SEQ ID NO: 241677 - DNA, 25 bp, Homo sapien
tctgaggtagggtgtaacttagttc

SEQ ID NO: 241678 - DNA, 25 bp, Homo sapien
gtaacttagttctacattgtgattt

SEQ ID NO: 241679 - DNA, 25 bp, Homo sapien
tggctttacccaaaccccaccagtg

SEQ ID NO: 241680 - DNA, 25 bp, Homo sapien
ccaccagtgccctactcccgcaatc

SEQ ID NO: 241681 - DNA, 25 bp, Homo sapien
gctgagggtaacgaccagcgccaac

SEQ ID NO: 241682 - DNA, 25 bp, Homo sapien
ctgagggtaacgaccagcgccaacc

SEQ ID NO: 241683 - DNA, 25 bp, Homo sapien
tgagggtaacgaccagcgccaaccc

SEQ ID NO: 241684 - DNA, 25 bp, Homo sapien
gggtaacgaccagcgccaaccccag

SEQ ID NO: 241685 - DNA, 25 bp, Homo sapien
cccagctgcggagggcctggcatgt

SEQ ID NO: 241686 - DNA, 25 bp, Homo sapien
gagggcctggcatgtgtgggaaaaa

SEQ ID NO: 241687 - DNA, 25 bp, Homo sapien
agggcctggcatgtgtgggaaaaag

SEQ ID NO: 241688 - DNA, 25 bp, Homo sapien
gcatgtgtgggaaaaagccggaaaa

SEQ ID NO: 241689 - DNA, 25 bp, Homo sapien
tccttcagggcctgggcttccggca

SEQ ID NO: 241690 - DNA, 25 bp, Homo sapien
tctccttgggtcttaactctcctta

SEQ ID NO: 241691 - DNA, 25 bp, Homo sapien
tgtgagcctgcccaacttttaccaa

SEQ ID NO: 241692 - DNA, 25 bp, Homo sapien
cttaactctccttaactccaaagat

SEQ ID NO: 241693 - DNA, 25 bp, Homo sapien
ccttaactccaaagatgctcacttc

SEQ ID NO: 241694 - DNA, 25 bp, Homo sapien
gctcacttcttttccacaatatgta

SEQ ID NO: 241695 - DNA, 25 bp, Homo sapien
gcctgcccaacttttaccaagttag

SEQ ID NO: 241696 - DNA, 25 bp, Homo sapien
gaagaaaaattctgtcctagacttt

SEQ ID NO: 241697 - DNA, 25 bp, Homo sapien
tcctagactttcaaactccctggag

SEQ ID NO: 241698 - DNA, 25 bp, Homo sapien
gttagtgggatattcaatttcagcc

SEQ ID NO: 241699 - DNA, 25 bp, Homo sapien
atcactgtggctccatatgctacta

SEQ ID NO: 241700 - DNA, 25 bp, Homo sapien
atatgctactactgggtcaagggag

SEQ ID NO: 241701 - DNA, 25 bp, Homo sapien
ctgggtggcttcctatacatcctgg

SEQ ID NO: 241702 - DNA, 25 bp, Homo sapien
cttcctatacatcctggcagaatac

SEQ ID NO: 241703 - DNA, 25 bp, Homo sapien
ccctacccgggacatcttcatggaa

SEQ ID NO: 241704 - DNA, 25 bp, Homo sapien
catggaaaacatcatgttctgtgga

SEQ ID NO: 241705 - DNA, 25 bp, Homo sapien
gcggcttctccgacttctacaagct

SEQ ID NO: 241706 - DNA, 25 bp, Homo sapien
acttctacaagctccggtggctgga

SEQ ID NO: 241707 - DNA, 25 bp, Homo sapien
ggaggccattctcagctggcagaaa

SEQ ID NO: 241708 - DNA, 25 bp, Homo sapien
ttctcagctggcagaaacagcagga

SEQ ID NO: 241709 - DNA, 25 bp, Homo sapien
ctaaagctattcaatatcagcagca

SEQ ID NO: 241710 - DNA, 25 bp, Homo sapien
cagcagcatttttcgaggagagtga

SEQ ID NO: 241711 - DNA, 25 bp, Homo sapien
aaaaacaatttccagatggctgctc

SEQ ID NO: 241712 - DNA, 25 bp, Homo sapien
taattagtgcagtcttatgttataa

SEQ ID NO: 241713 - DNA, 25 bp, Homo sapien
gagttgataaagattacctgtgcag

SEQ ID NO: 241714 - DNA, 25 bp, Homo sapien
attacctgtgcagtgcagagcactt

SEQ ID NO: 241715 - DNA, 25 bp, Homo sapien
gtgcagtgcagagcactttaatgca

SEQ ID NO: 241716 - DNA, 25 bp, Homo sapien
gaaaaagccctatctagtacttgat

SEQ ID NO: 241717 - DNA, 25 bp, Homo sapien
agccctatctagtacttgatgttga

SEQ ID NO: 241718 - DNA, 25 bp, Homo sapien
gccaatgggagaaagactattttac

SEQ ID NO: 241719 - DNA, 25 bp, Homo sapien
gcttttctccttaaacgtaatccag

SEQ ID NO: 241720 - DNA, 25 bp, Homo sapien
acgtaatccagatgactttcctgtt

SEQ ID NO: 241721 - DNA, 25 bp, Homo sapien
cagatgactttcctgttactaaaca

SEQ ID NO: 241722 - DNA, 25 bp, Homo sapien
taaacactgagcagcattacactac

SEQ ID NO: 241723 - DNA, 25 bp, Homo sapien
cctggtagatgggttgacctgaaag

SEQ ID NO: 241724 - DNA, 25 bp, Homo sapien
ccaaggtggcttcccttatgtgtct

SEQ ID NO: 241725 - DNA, 25 bp, Homo sapien
atgggtgggaagctggctcatctgg

SEQ ID NO: 241726 - DNA, 25 bp, Homo sapien
agaatactggcatttgtcctgtcct

SEQ ID NO: 241727 - DNA, 25 bp, Homo sapien
actggcatttgtcctgtcctctggg

SEQ ID NO: 241728 - DNA, 25 bp, Homo sapien
ggtggatttgcccatcaaaacttga

SEQ ID NO: 241729 - DNA, 25 bp, Homo sapien
tagcagggcagggtagatactccta

SEQ ID NO: 241730 - DNA, 25 bp, Homo sapien
tcaggaatttaggtgggactcagct

SEQ ID NO: 241731 - DNA, 25 bp, Homo sapien
gatactcctactatagttccaacta

SEQ ID NO: 241732 - DNA, 25 bp, Homo sapien
tgtcatgtatccaaagctcactctg

SEQ ID NO: 241733 - DNA, 25 bp, Homo sapien
gtatccaaagctcactctgtagtat

SEQ ID NO: 241734 - DNA, 25 bp, Homo sapien
ttgatataatggacagccgctgtac

SEQ ID NO: 241735 - DNA, 25 bp, Homo sapien
agccgctgtactgtgttaaggaaac

SEQ ID NO: 241736 - DNA, 25 bp, Homo sapien
gaagcaccgtttagttcaaccaagg

SEQ ID NO: 241737 - DNA, 25 bp, Homo sapien
tcaaagcctatgttagttgggtctg

SEQ ID NO: 241738 - DNA, 25 bp, Homo sapien
ttgggtctggaacaacttcagtaac

SEQ ID NO: 241739 - DNA, 25 bp, Homo sapien
ataatgagatcatcacttcaagtga

SEQ ID NO: 241740 - DNA, 25 bp, Homo sapien
agtgaagaccatagcaatcgaaatt

SEQ ID NO: 241741 - DNA, 25 bp, Homo sapien
gaaattcagattctgcaggcccatt

SEQ ID NO: 241742 - DNA, 25 bp, Homo sapien
aggcccatttgcagtgcctgaccat

SEQ ID NO: 241743 - DNA, 25 bp, Homo sapien
agtgcctgaccatcttcggcaagat

SEQ ID NO: 241744 - DNA, 25 bp, Homo sapien
gatgtagaagaattcgaagctctct

SEQ ID NO: 241745 - DNA, 25 bp, Homo sapien
gtttcactgcttaataatcctcaat

SEQ ID NO: 241746 - DNA, 25 bp, Homo sapien
aatcctcaatttacactattcataa

SEQ ID NO: 241747 - DNA, 25 bp, Homo sapien
gagaatactactttataccatttgt

SEQ ID NO: 241748 - DNA, 25 bp, Homo sapien
taaaaattgcaccaaagcatcggca

SEQ ID NO: 241749 - DNA, 25 bp, Homo sapien
gcatcggcaaaaacaatactatatt

SEQ ID NO: 241750 - DNA, 25 bp, Homo sapien
aaagtgctcaggtagccaaggccct

SEQ ID NO: 241751 - DNA, 25 bp, Homo sapien
caaggcccttgcttttggtatcaac

SEQ ID NO: 241752 - DNA, 25 bp, Homo sapien
ttgcttttggtatcaaccctcatga

SEQ ID NO: 241753 - DNA, 25 bp, Homo sapien
gtatcaaccctcatgaacccatagg

SEQ ID NO: 241754 - DNA, 25 bp, Homo sapien
gaacccataggagctgaatatttgt

SEQ ID NO: 241755 - DNA, 25 bp, Homo sapien
ggagctgaatatttgtttcactgct

SEQ ID NO: 241756 - DNA, 25 bp, Homo sapien
tgactatctgccgtgtctgtgccat

SEQ ID NO: 241757 - DNA, 25 bp, Homo sapien
gtctgtgccattgcagtgtactagg

SEQ ID NO: 241758 - DNA, 25 bp, Homo sapien
gtgtactaggtgcacttacgagtcc

SEQ ID NO: 241759 - DNA, 25 bp, Homo sapien
taggtgcacttacgagtcctctact

SEQ ID NO: 241760 - DNA, 25 bp, Homo sapien
gagtcctctacttacaaactgcttt

SEQ ID NO: 241761 - DNA, 25 bp, Homo sapien
cctctacttacaaactgcttttcac

SEQ ID NO: 241762 - DNA, 25 bp, Homo sapien
aaggttcagacatacgacgtttgtt

SEQ ID NO: 241763 - DNA, 25 bp, Homo sapien
aatctttctacagccttgtatcctt

SEQ ID NO: 241764 - DNA, 25 bp, Homo sapien
ctacagccttgtatcctttttcctt

SEQ ID NO: 241765 - DNA, 25 bp, Homo sapien
atgtgttatgagttttatcttagac

SEQ ID NO: 241766 - DNA, 25 bp, Homo sapien
gatcattttattgactatctgccgt

SEQ ID NO: 241767 - DNA, 25 bp, Homo sapien
gaatgactaaaaacttgggctccaa

SEQ ID NO: 241768 - DNA, 25 bp, Homo sapien
gaatatctgatactacttgtccaac

SEQ ID NO: 241769 - DNA, 25 bp, Homo sapien
gtccaacatttctacagggcatcaa

SEQ ID NO: 241770 - DNA, 25 bp, Homo sapien
cagggcatcaatgaactagggctga

SEQ ID NO: 241771 - DNA, 25 bp, Homo sapien
gagatagtagctgccttgttagatg

SEQ ID NO: 241772 - DNA, 25 bp, Homo sapien
gttagatgaggcatggctatccagt

SEQ ID NO: 241773 - DNA, 25 bp, Homo sapien
atggctatccagtgcgctacagttt

SEQ ID NO: 241774 - DNA, 25 bp, Homo sapien
gcgctacagtttccacaactgcttg

SEQ ID NO: 241775 - DNA, 25 bp, Homo sapien
catgggccacatctggtctgcagat

SEQ ID NO: 241776 - DNA, 25 bp, Homo sapien
tgcagatgtatatagtttggcccac

SEQ ID NO: 241777 - DNA, 25 bp, Homo sapien
agtttggcccacagaatgactaaaa

SEQ ID NO: 241778 - DNA, 25 bp, Homo sapien
cgctttgccttgcttgggaaatgca

SEQ ID NO: 241779 - DNA, 25 bp, Homo sapien
tgccttgcttgggaaatgcagtttc

SEQ ID NO: 241780 - DNA, 25 bp, Homo sapien
tgggaaatgcagtttcgtgtcacct

SEQ ID NO: 241781 - DNA, 25 bp, Homo sapien
agatatgtagttgatcatctagaca

SEQ ID NO: 241782 - DNA, 25 bp, Homo sapien
gttgatcatctagacataattgctg

SEQ ID NO: 241783 - DNA, 25 bp, Homo sapien
gctgaagatgaacttttggaccaac

SEQ ID NO: 241784 - DNA, 25 bp, Homo sapien
ttggaccaacttctaagtcacacag

SEQ ID NO: 241785 - DNA, 25 bp, Homo sapien
agtcacacagcatcattatcagatt

SEQ ID NO: 241786 - DNA, 25 bp, Homo sapien
cacacagcatcattatcagatttat

SEQ ID NO: 241787 - DNA, 25 bp, Homo sapien
atcagatttattacacaacgacttt

SEQ ID NO: 241788 - DNA, 25 bp, Homo sapien
gatttattacacaacgacttttttg

SEQ ID NO: 241789 - DNA, 25 bp, Homo sapien
gggtaacaggcttagcatcctttgc

SEQ ID NO: 241790 - DNA, 25 bp, Homo sapien
gcatcctttgcatatgagagccttt

SEQ ID NO: 241791 - DNA, 25 bp, Homo sapien
atatgagagcctttctagccgccat

SEQ ID NO: 241792 - DNA, 25 bp, Homo sapien
ttctagccgccatggctggcaggtt

SEQ ID NO: 241793 - DNA, 25 bp, Homo sapien
gtcctgtctgaacttcggtgactct

SEQ ID NO: 241794 - DNA, 25 bp, Homo sapien
ggctgctccctactcctgtttttag

SEQ ID NO: 241795 - DNA, 25 bp, Homo sapien
attacttcattgataacagtcacag

SEQ ID NO: 241796 - DNA, 25 bp, Homo sapien
gaacttcggtgactcttcacaaaat

SEQ ID NO: 241797 - DNA, 25 bp, Homo sapien
ttccatccatttcaggcttttgcag

SEQ ID NO: 241798 - DNA, 25 bp, Homo sapien
tttcaggcttttgcagactttctgc

SEQ ID NO: 241799 - DNA, 25 bp, Homo sapien
gactttctgcattaacagagttagg

SEQ ID NO: 241800 - DNA, 25 bp, Homo sapien
taatgccctgatttttttgtcccgt

SEQ ID NO: 241801 - DNA, 25 bp, Homo sapien
ttttttgtcccgtatctaatgggat

SEQ ID NO: 241802 - DNA, 25 bp, Homo sapien
ataatcctcaaatgtgctacttcga

SEQ ID NO: 241803 - DNA, 25 bp, Homo sapien
aaattatctgggactcatggacaca

SEQ ID NO: 241804 - DNA, 25 bp, Homo sapien
ctgggactcatggacacaagtctct

SEQ ID NO: 241805 - DNA, 25 bp, Homo sapien
gctacttcgaatgcatacacctagt

SEQ ID NO: 241806 - DNA, 25 bp, Homo sapien
ttgagaaaatcctcaaaccatggtg

SEQ ID NO: 241807 - DNA, 25 bp, Homo sapien
tgcatacacctagtgacgctggagg

SEQ ID NO: 241808 - DNA, 25 bp, Homo sapien
ggaggccaggatagcgttcacttaa

SEQ ID NO: 241809 - DNA, 25 bp, Homo sapien
gatagcgttcacttaatgccctgat

SEQ ID NO: 241810 - DNA, 25 bp, Homo sapien
gcgttcacttaatgccctgattttt

SEQ ID NO: 241811 - DNA, 25 bp, Homo sapien
ctccttcctcacacaattaaaatgc

SEQ ID NO: 241812 - DNA, 25 bp, Homo sapien
caattaaaatgctaggtttcctgta

SEQ ID NO: 241813 - DNA, 25 bp, Homo sapien
cttcagggaatttttcactcaagcc

SEQ ID NO: 241814 - DNA, 25 bp, Homo sapien
ggaatttttcactcaagcccagaaa

SEQ ID NO: 241815 - DNA, 25 bp, Homo sapien
tcactcaagcccagaaaataaactc

SEQ ID NO: 241816 - DNA, 25 bp, Homo sapien
tattggttggaaaactgctatctac

SEQ ID NO: 241817 - DNA, 25 bp, Homo sapien
gaaaactgctatctacaggccttcc

SEQ ID NO: 241818 - DNA, 25 bp, Homo sapien
actgctatctacaggccttccacta

SEQ ID NO: 241819 - DNA, 25 bp, Homo sapien
ttccactacctatttcttagtagat

SEQ ID NO: 241820 - DNA, 25 bp, Homo sapien
gacagatactgtgtttgggccttaa

SEQ ID NO: 241821 - DNA, 25 bp, Homo sapien
gatactgtgtttgggccttaaagcc

SEQ ID NO: 241822 - DNA, 25 bp, Homo sapien
gagatacaactggtagtttagcata

SEQ ID NO: 241823 - DNA, 25 bp, Homo sapien
aatctcataaagctggctactggga

SEQ ID NO: 241824 - DNA, 25 bp, Homo sapien
gaaagtgacagagacttgggcacga

SEQ ID NO: 241825 - DNA, 25 bp, Homo sapien
agacttgggcacgagggacactgta

SEQ ID NO: 241826 - DNA, 25 bp, Homo sapien
ggcacgagggacactgtaaacagta

SEQ ID NO: 241827 - DNA, 25 bp, Homo sapien
taaacagtaggagcactggctactt

SEQ ID NO: 241828 - DNA, 25 bp, Homo sapien
gagcactggctacttggaggattat

SEQ ID NO: 241829 - DNA, 25 bp, Homo sapien
tggaggattattcagttacaaaagg

SEQ ID NO: 241830 - DNA, 25 bp, Homo sapien
gttggcatcggagggccaagcccac

SEQ ID NO: 241831 - DNA, 25 bp, Homo sapien
aagcccactcttgcctttactttgt

SEQ ID NO: 241832 - DNA, 25 bp, Homo sapien
actcttgcctttactttgtgatgta

SEQ ID NO: 241833 - DNA, 25 bp, Homo sapien
aggcctaagggcttgatcattggat

SEQ ID NO: 241834 - DNA, 25 bp, Homo sapien
ttggattgaggaggtccagtttttc

SEQ ID NO: 241835 - DNA, 25 bp, Homo sapien
cctgctactcaggatcaatccaatg

SEQ ID NO: 241836 - DNA, 25 bp, Homo sapien
ggatcaatccaatggtctactttct

SEQ ID NO: 241837 - DNA, 25 bp, Homo sapien
aatggtctactttctatgcacttaa

SEQ ID NO: 241838 - DNA, 25 bp, Homo sapien
ggtctactttctatgcacttaaaat

SEQ ID NO: 241839 - DNA, 25 bp, Homo sapien
gaattcgagtggttctagtataaag

SEQ ID NO: 241840 - DNA, 25 bp, Homo sapien
cactttctcctaggcttcatgtttg

SEQ ID NO: 241841 - DNA, 25 bp, Homo sapien
ggcttcatgtttgttttcctatccc

SEQ ID NO: 241842 - DNA, 25 bp, Homo sapien
tgtttgttttcctatcccctgcaca

SEQ ID NO: 241843 - DNA, 25 bp, Homo sapien
tgcacactcaaaattaggcctaagg

SEQ ID NO: 241844 - DNA, 25 bp, Homo sapien
gtggtccaggtcagggtcttctcaa

SEQ ID NO: 241845 - DNA, 25 bp, Homo sapien
agggtcttctcaagtctgaacgtgt

SEQ ID NO: 241846 - DNA, 25 bp, Homo sapien
ttctcaagtctgaacgtgtggcctc

SEQ ID NO: 241847 - DNA, 25 bp, Homo sapien
agtctgaacgtgtggcctcgtggct

SEQ ID NO: 241848 - DNA, 25 bp, Homo sapien
gctgggccaaccaggacacagggct

SEQ ID NO: 241849 - DNA, 25 bp, Homo sapien
ctctctcacattttcatggtgtaaa

SEQ ID NO: 241850 - DNA, 25 bp, Homo sapien
taaaatgtgggaaattcctgcccct

SEQ ID NO: 241851 - DNA, 25 bp, Homo sapien
ttccttccctcttgtgagtagggta

SEQ ID NO: 241852 - DNA, 25 bp, Homo sapien
gtgaacttaatggtacccagaagta

SEQ ID NO: 241853 - DNA, 25 bp, Homo sapien
aaaggtaatctttcaataacatgga

SEQ ID NO: 241854 - DNA, 25 bp, Homo sapien
atggaaatccacttgcaaaaaagac

SEQ ID NO: 241855 - DNA, 25 bp, Homo sapien
atacctttagggtcataatcatcca

SEQ ID NO: 241856 - DNA, 25 bp, Homo sapien
gggtcataatcatccatattacatg

SEQ ID NO: 241857 - DNA, 25 bp, Homo sapien
aaaagaatcttagtcattgtgagga

SEQ ID NO: 241858 - DNA, 25 bp, Homo sapien
gtcattgtgaggaaaagatcagcta

SEQ ID NO: 241859 - DNA, 25 bp, Homo sapien
aggttctttggagaggttcttagag

SEQ ID NO: 241860 - DNA, 25 bp, Homo sapien
gttcttagagacatcagatttcctg

SEQ ID NO: 241861 - DNA, 25 bp, Homo sapien
atcagatctctattatacagaagcc

SEQ ID NO: 241862 - DNA, 25 bp, Homo sapien
atacagaagccatggatgttacttt

SEQ ID NO: 241863 - DNA, 25 bp, Homo sapien
ttttgagtagagagccatgatgtag

SEQ ID NO: 241864 - DNA, 25 bp, Homo sapien
gccatgatgtagaaagccatgtttt

SEQ ID NO: 241865 - DNA, 25 bp, Homo sapien
agaattagtggccaggcttcccttc

SEQ ID NO: 241866 - DNA, 25 bp, Homo sapien
ttaagagccaagttctcactgtctc

SEQ ID NO: 241867 - DNA, 25 bp, Homo sapien
ggactcaagctgcagcctctcgagt

SEQ ID NO: 241868 - DNA, 25 bp, Homo sapien
actcaagctgcagcctctcgagtag

SEQ ID NO: 241869 - DNA, 25 bp, Homo sapien
tgctaccacacccaattatgaattt

SEQ ID NO: 241870 - DNA, 25 bp, Homo sapien
tttcatcattagtttcttagtagag

SEQ ID NO: 241871 - DNA, 25 bp, Homo sapien
tttcttagtagagtccacatgtcct

SEQ ID NO: 241872 - DNA, 25 bp, Homo sapien
agtagagtccacatgtcctcagtag

SEQ ID NO: 241873 - DNA, 25 bp, Homo sapien
agagtccacatgtcctcagtagtaa

SEQ ID NO: 241874 - DNA, 25 bp, Homo sapien
gtccacatgtcctcagtagtaagtt

SEQ ID NO: 241875 - DNA, 25 bp, Homo sapien
tgtcctcagtagtaagttcatcagt

SEQ ID NO: 241876 - DNA, 25 bp, Homo sapien
gtaagttcatcagtgctaaatattt

SEQ ID NO: 241877 - DNA, 25 bp, Homo sapien
gaaattgatgccacctttctgatgt

SEQ ID NO: 241878 - DNA, 25 bp, Homo sapien
tctgatgtgagaaatgactatgcca

SEQ ID NO: 241879 - DNA, 25 bp, Homo sapien
tgactatgccatattgtaaagggac

SEQ ID NO: 241880 - DNA, 25 bp, Homo sapien
agggacatggacacggagatcatta

SEQ ID NO: 241881 - DNA, 25 bp, Homo sapien
tgggttgcccgggtcctagatattg

SEQ ID NO: 241882 - DNA, 25 bp, Homo sapien
gccttataggcatttttggtacctg

SEQ ID NO: 241883 - DNA, 25 bp, Homo sapien
tttttggtacctgtatcccttctat

SEQ ID NO: 241884 - DNA, 25 bp, Homo sapien
cgggtcctagatattgcactgtcac

SEQ ID NO: 241885 - DNA, 25 bp, Homo sapien
aattagatcttatttacctttgtat

SEQ ID NO: 241886 - DNA, 25 bp, Homo sapien
agatattgcactgtcactcctgcca

SEQ ID NO: 241887 - DNA, 25 bp, Homo sapien
tgccacctttgaccctttatcaaaa

SEQ ID NO: 241888 - DNA, 25 bp, Homo sapien
caaagtgaactatttgttcctggaa

SEQ ID NO: 241889 - DNA, 25 bp, Homo sapien
gtgaactatttgttcctggaagtat

SEQ ID NO: 241890 - DNA, 25 bp, Homo sapien
gaactatttgttcctggaagtattt

SEQ ID NO: 241891 - DNA, 25 bp, Homo sapien
tcctttcataatatctcagcaccag

SEQ ID NO: 241892 - DNA, 25 bp, Homo sapien
cataatatctcagcaccagaaacaa

SEQ ID NO: 241893 - DNA, 25 bp, Homo sapien
gaagaagaattaccattctctcttt

SEQ ID NO: 241894 - DNA, 25 bp, Homo sapien
gaattaccattctctctttgtaggc

SEQ ID NO: 241895 - DNA, 25 bp, Homo sapien
aattaccattctctctttgtaggca

SEQ ID NO: 241896 - DNA, 25 bp, Homo sapien
gacacaagggaacagtatttgcatt

SEQ ID NO: 241897 - DNA, 25 bp, Homo sapien
aagggaacagtatttgcatttgtac

SEQ ID NO: 241898 - DNA, 25 bp, Homo sapien
tgcatttgtactgtcttagaatatt

SEQ ID NO: 241899 - DNA, 25 bp, Homo sapien
aacattttttgatgccaagtaccag

SEQ ID NO: 241900 - DNA, 25 bp, Homo sapien
attcaaacttcctgattgtctcgta

SEQ ID NO: 241901 - DNA, 25 bp, Homo sapien
ttcctgattgtctcgtaagtttttt

SEQ ID NO: 241902 - DNA, 25 bp, Homo sapien
taacagttggtttattcgagtcaag

SEQ ID NO: 241903 - DNA, 25 bp, Homo sapien
tattcgagtcaagatccaggcaaga

SEQ ID NO: 241904 - DNA, 25 bp, Homo sapien
gaaactaagttgtttgtcctataga

SEQ ID NO: 241905 - DNA, 25 bp, Homo sapien
gtcctatagaattgtccttcagtgg

SEQ ID NO: 241906 - DNA, 25 bp, Homo sapien
tttactgaatgtatcctaatgggat

SEQ ID NO: 241907 - DNA, 25 bp, Homo sapien
tgggatcatgtacaccttttctgtc

SEQ ID NO: 241908 - DNA, 25 bp, Homo sapien
ttttctgtcccctatatgttctata

SEQ ID NO: 241909 - DNA, 25 bp, Homo sapien
gtcccctatatgttctataaactga

SEQ ID NO: 241910 - DNA, 25 bp, Homo sapien
tctaggttgtgcgttccttattcct

SEQ ID NO: 241911 - DNA, 25 bp, Homo sapien
gaaccactgctttatcagatcttca

SEQ ID NO: 241912 - DNA, 25 bp, Homo sapien
actgctttatcagatcttcagaggg

SEQ ID NO: 241913 - DNA, 25 bp, Homo sapien
ggttgtgcgttccttattccttatg

SEQ ID NO: 241914 - DNA, 25 bp, Homo sapien
aaattcgtataagaatcacagttct

SEQ ID NO: 241915 - DNA, 25 bp, Homo sapien
tgctattttttgctgctaatctcca

SEQ ID NO: 241916 - DNA, 25 bp, Homo sapien
tttttgctgctaatctccagatttt

SEQ ID NO: 241917 - DNA, 25 bp, Homo sapien
gctaatctccagattttgtggatat

SEQ ID NO: 241918 - DNA, 25 bp, Homo sapien
atctaatgcctgatggtgggataat

SEQ ID NO: 241919 - DNA, 25 bp, Homo sapien
gataatttttatcctgaaacgatca

SEQ ID NO: 241920 - DNA, 25 bp, Homo sapien
tttatcctgaaacgatcacctttcc

SEQ ID NO: 241921 - DNA, 25 bp, Homo sapien
tagtattgacaactgcacatgaaag

SEQ ID NO: 241922 - DNA, 25 bp, Homo sapien
gacaactgcacatgaaagttttgca

SEQ ID NO: 241923 - DNA, 25 bp, Homo sapien
ttttgcaaagggaaacaggctaaat

SEQ ID NO: 241924 - DNA, 25 bp, Homo sapien
gggaaacaggctaaatgcaccaaga

SEQ ID NO: 241925 - DNA, 25 bp, Homo sapien
ggctaaatgcaccaagaaagcttct

SEQ ID NO: 241926 - DNA, 25 bp, Homo sapien
gtgaagaatcttaatgcttgtaatt

SEQ ID NO: 241927 - DNA, 25 bp, Homo sapien
gtaatttaaacatttgttcctggag

SEQ ID NO: 241928 - DNA, 25 bp, Homo sapien
ttgttcctggagttttgatttggtg

SEQ ID NO: 241929 - DNA, 25 bp, Homo sapien
gtcagtttggttgggctatagcaca

SEQ ID NO: 241930 - DNA, 25 bp, Homo sapien
ttgggctatagcacacagttattta

SEQ ID NO: 241931 - DNA, 25 bp, Homo sapien
atcaaacagtaatctaggtgtggct

SEQ ID NO: 241932 - DNA, 25 bp, Homo sapien
aattatcatctcctaatcttaccct

SEQ ID NO: 241933 - DNA, 25 bp, Homo sapien
taatcttaccctgacccttttgtca

SEQ ID NO: 241934 - DNA, 25 bp, Homo sapien
gacccttttgtcaaacgttatctag

SEQ ID NO: 241935 - DNA, 25 bp, Homo sapien
ttaaacctcagtataggcaggctgc

SEQ ID NO: 241936 - DNA, 25 bp, Homo sapien
gaaatggacattccagtggcccctg

SEQ ID NO: 241937 - DNA, 25 bp, Homo sapien
gggttccagcctgtagcagcttcat

SEQ ID NO: 241938 - DNA, 25 bp, Homo sapien
agcagcttcatctgtgctttgtgca

SEQ ID NO: 241939 - DNA, 25 bp, Homo sapien
gctttgtgcacttggttctcagtca

SEQ ID NO: 241940 - DNA, 25 bp, Homo sapien
gttctcagtcatctctgcaagggac

SEQ ID NO: 241941 - DNA, 25 bp, Homo sapien
caagggaccctgacgcctgggagat

SEQ ID NO: 241942 - DNA, 25 bp, Homo sapien
gagatcagagccactgaccctttat

SEQ ID NO: 241943 - DNA, 25 bp, Homo sapien
tacagatggcgcctgtggtaaatct

SEQ ID NO: 241944 - DNA, 25 bp, Homo sapien
atctgtgttaacatggtggtagacc

SEQ ID NO: 241945 - DNA, 25 bp, Homo sapien
ggtagatggagcttctagactccaa

SEQ ID NO: 241946 - DNA, 25 bp, Homo sapien
gtgtgagtacactgtcccattaggt

SEQ ID NO: 241947 - DNA, 25 bp, Homo sapien
gtcccattaggttgactgaagtctg

SEQ ID NO: 241948 - DNA, 25 bp, Homo sapien
gaagtctgagtacattttctggcct

SEQ ID NO: 241949 - DNA, 25 bp, Homo sapien
acattttctggcctgcgtgccgtga

SEQ ID NO: 241950 - DNA, 25 bp, Homo sapien
tgccgtgacttatccaacctgtgaa

SEQ ID NO: 241951 - DNA, 25 bp, Homo sapien
acctgtgaactgattgtgatctgct

SEQ ID NO: 241952 - DNA, 25 bp, Homo sapien
gtgatctgcttggtaacttggtttg

SEQ ID NO: 241953 - DNA, 25 bp, Homo sapien
tggtgtaaactgctcttaacccttt

SEQ ID NO: 241954 - DNA, 25 bp, Homo sapien
tactccagactggataacagcaaga

SEQ ID NO: 241955 - DNA, 25 bp, Homo sapien
actccagactggataacagcaagag

SEQ ID NO: 241956 - DNA, 25 bp, Homo sapien
tccagactggataacagcaagagcc

SEQ ID NO: 241957 - DNA, 25 bp, Homo sapien
gactggataacagcaagagcccatc

SEQ ID NO: 241958 - DNA, 25 bp, Homo sapien
catgtcatagccctagagaatgaaa

SEQ ID NO: 241959 - DNA, 25 bp, Homo sapien
aatgaaaaatttgcagtagatagtc

SEQ ID NO: 241960 - DNA, 25 bp, Homo sapien
aaatttgcagtagatagtcaataaa

SEQ ID NO: 241961 - DNA, 25 bp, Homo sapien
gatagtcaataaatgaatcagtagt

SEQ ID NO: 241962 - DNA, 25 bp, Homo sapien
gaatcagtagttaaatattccttaa

SEQ ID NO: 241963 - DNA, 25 bp, Homo sapien
gttaaatattccttaaagtcaactg

SEQ ID NO: 241964 - DNA, 25 bp, Homo sapien
aatattccttaaagtcaactgtatt

SEQ ID NO: 241965 - DNA, 25 bp, Homo sapien
ctgttgccagctatgcctttgagaa

SEQ ID NO: 241966 - DNA, 25 bp, Homo sapien
gcctttgagaacctcgggatcccaa

SEQ ID NO: 241967 - DNA, 25 bp, Homo sapien
gaaagacaatctcggcatgcattat

SEQ ID NO: 241968 - DNA, 25 bp, Homo sapien
acaatctcggcatgcattatttctt

SEQ ID NO: 241969 - DNA, 25 bp, Homo sapien
tgaagattcactcatgttgcatgca

SEQ ID NO: 241970 - DNA, 25 bp, Homo sapien
atgttgcatgcatctgtagcttgtg

SEQ ID NO: 241971 - DNA, 25 bp, Homo sapien
gcatctgtagcttgtgcctttttta

SEQ ID NO: 241972 - DNA, 25 bp, Homo sapien
gtgccttttttattgcctagtagta

SEQ ID NO: 241973 - DNA, 25 bp, Homo sapien
gcctagtagtattctgtcatatgcc

SEQ ID NO: 241974 - DNA, 25 bp, Homo sapien
gtcatatgcctatcttacaatttga

SEQ ID NO: 241975 - DNA, 25 bp, Homo sapien
tacaatttgattatctattcacctg

SEQ ID NO: 241976 - DNA, 25 bp, Homo sapien
gaagcctctggctttgagagtctat

SEQ ID NO: 241977 - DNA, 25 bp, Homo sapien
cttttccctaggagcgtcctagctg

SEQ ID NO: 241978 - DNA, 25 bp, Homo sapien
agcgtcctagctggtgtgctgtgac

SEQ ID NO: 241979 - DNA, 25 bp, Homo sapien
gtgctgtgacacactgggattctga

SEQ ID NO: 241980 - DNA, 25 bp, Homo sapien
tgacacactgggattctgaaaatgg

SEQ ID NO: 241981 - DNA, 25 bp, Homo sapien
aatggattacaaatacgccaaggta

SEQ ID NO: 241982 - DNA, 25 bp, Homo sapien
gccaaggtattggttcttcagccct

SEQ ID NO: 241983 - DNA, 25 bp, Homo sapien
aaggtattggttcttcagccctcag

SEQ ID NO: 241984 - DNA, 25 bp, Homo sapien
tcttctggtagccactgggcctaaa

SEQ ID NO: 241985 - DNA, 25 bp, Homo sapien
tagccactgggcctaaacctgcggg

SEQ ID NO: 241986 - DNA, 25 bp, Homo sapien
taaacctgcgggtgggattgctgca

SEQ ID NO: 241987 - DNA, 25 bp, Homo sapien
actcgacaaagttaagccatgcgcc

SEQ ID NO: 241988 - DNA, 25 bp, Homo sapien
ctcgacaaagttaagccatgcgccc

SEQ ID NO: 241989 - DNA, 25 bp, Homo sapien
cgacaaagttaagccatgcgcccaa

SEQ ID NO: 241990 - DNA, 25 bp, Homo sapien
acaaagttaagccatgcgcccaaaa

SEQ ID NO: 241991 - DNA, 25 bp, Homo sapien
aaagttaagccatgcgcccaaaatt

SEQ ID NO: 241992 - DNA, 25 bp, Homo sapien
aagttaagccatgcgcccaaaattc

SEQ ID NO: 241993 - DNA, 25 bp, Homo sapien
aagccatgcgcccaaaattcaggtt

SEQ ID NO: 241994 - DNA, 25 bp, Homo sapien
gccatgcgcccaaaattcaggttaa

SEQ ID NO: 241995 - DNA, 25 bp, Homo sapien
catgcgcccaaaattcaggttaatt

SEQ ID NO: 241996 - DNA, 25 bp, Homo sapien
gcgcccaaaattcaggttaatttgc

SEQ ID NO: 241997 - DNA, 25 bp, Homo sapien
tcaggttaatttgccaaattcccct

SEQ ID NO: 241998 - DNA, 25 bp, Homo sapien
caaactcttagacaagctggtgaaa

SEQ ID NO: 241999 - DNA, 25 bp, Homo sapien
gctggtgaaagttttaacgactgct

SEQ ID NO: 242000 - DNA, 25 bp, Homo sapien
taacgactgctggaggcaacatgct

SEQ ID NO: 242001 - DNA, 25 bp, Homo sapien
tgctggaggcaacatgcttccacac

SEQ ID NO: 242002 - DNA, 25 bp, Homo sapien
gcttccacactgacagaaatcatct

SEQ ID NO: 242003 - DNA, 25 bp, Homo sapien
ctgcacatatctcaggcttatgaaa

SEQ ID NO: 242004 - DNA, 25 bp, Homo sapien
ggcttatgaaacaaactaattccta

SEQ ID NO: 242005 - DNA, 25 bp, Homo sapien
gaattaaaagcttgcggtgagataa

SEQ ID NO: 242006 - DNA, 25 bp, Homo sapien
gattttggctggatgtgatgactca

SEQ ID NO: 242007 - DNA, 25 bp, Homo sapien
tgatccctacactttaggagggcac

SEQ ID NO: 242008 - DNA, 25 bp, Homo sapien
cctacactttaggagggcacagcag

SEQ ID NO: 242009 - DNA, 25 bp, Homo sapien
tactccagactggataacagcaaga

SEQ ID NO: 242010 - DNA, 25 bp, Homo sapien
actccagactggataacagcaagag

SEQ ID NO: 242011 - DNA, 25 bp, Homo sapien
tccagactggataacagcaagagcc

SEQ ID NO: 242012 - DNA, 25 bp, Homo sapien
cagactggataacagcaagagccca

SEQ ID NO: 242013 - DNA, 25 bp, Homo sapien
gactggataacagcaagagcccatc

SEQ ID NO: 242014 - DNA, 25 bp, Homo sapien
aatgaaaaatttgcagtagatagtc

SEQ ID NO: 242015 - DNA, 25 bp, Homo sapien
aaatttgcagtagatagtcaataaa

SEQ ID NO: 242016 - DNA, 25 bp, Homo sapien
gatagtcaataaatgaatcagtagt

SEQ ID NO: 242017 - DNA, 25 bp, Homo sapien
gaatcagtagttaaatattccttaa

SEQ ID NO: 242018 - DNA, 25 bp, Homo sapien
gttaaatattccttaaagtcaactg

SEQ ID NO: 242019 - DNA, 25 bp, Homo sapien
aatattccttaaagtcaactgtatt

SEQ ID NO: 242020 - DNA, 25 bp, Homo sapien
accggaactgatgactgctatgctt

SEQ ID NO: 242021 - DNA, 25 bp, Homo sapien
tatgcttgacagcagcttcaacagc

SEQ ID NO: 242022 - DNA, 25 bp, Homo sapien
aacctttccattcagttctttccat

SEQ ID NO: 242023 - DNA, 25 bp, Homo sapien
aacagcctcggatacaactcatcat

SEQ ID NO: 242024 - DNA, 25 bp, Homo sapien
aactcatcatgaattagctctggca

SEQ ID NO: 242025 - DNA, 25 bp, Homo sapien
gaatactgttctgtttcctatctct

SEQ ID NO: 242026 - DNA, 25 bp, Homo sapien
gttctgtttcctatctctacatgta

SEQ ID NO: 242027 - DNA, 25 bp, Homo sapien
atttctatgctttggtcttttctca

SEQ ID NO: 242028 - DNA, 25 bp, Homo sapien
gttctttccattccatttttaccag

SEQ ID NO: 242029 - DNA, 25 bp, Homo sapien
ttaccagaattaacgtttcctcatc

SEQ ID NO: 242030 - DNA, 25 bp, Homo sapien
tctgggaagcattttaccggaactg

SEQ ID NO: 242031 - DNA, 25 bp, Homo sapien
tttccctttgcctttcactggactt

SEQ ID NO: 242032 - DNA, 25 bp, Homo sapien
ttgcctttcactggacttggcgtca

SEQ ID NO: 242033 - DNA, 25 bp, Homo sapien
ttcactggacttggcgtcactgtag

SEQ ID NO: 242034 - DNA, 25 bp, Homo sapien
ggacttggcgtcactgtagccttta

SEQ ID NO: 242035 - DNA, 25 bp, Homo sapien
ggcgtcactgtagcctttagtctgg

SEQ ID NO: 242036 - DNA, 25 bp, Homo sapien
actgtagcctttagtctgggtttgg

SEQ ID NO: 242037 - DNA, 25 bp, Homo sapien
tagcctttagtctgggtttgggcat

SEQ ID NO: 242038 - DNA, 25 bp, Homo sapien
ttagtctgggtttgggcatttcctt

SEQ ID NO: 242039 - DNA, 25 bp, Homo sapien
ttgtttttctttttcgaactgccat

SEQ ID NO: 242040 - DNA, 25 bp, Homo sapien
gtttttctttttcgaactgccatag

SEQ ID NO: 242041 - DNA, 25 bp, Homo sapien
ttcgaactgccatagtcactatcgt

SEQ ID NO: 242042 - DNA, 25 bp, Homo sapien
agccagagattagatgcctacatat

SEQ ID NO: 242043 - DNA, 25 bp, Homo sapien
tagatgcctacatatctcttttggc

SEQ ID NO: 242044 - DNA, 25 bp, Homo sapien
atctcttttggcctcagcattctgt

SEQ ID NO: 242045 - DNA, 25 bp, Homo sapien
agcattctgtggtcttctatggaga

SEQ ID NO: 242046 - DNA, 25 bp, Homo sapien
aaggctaattttctgaaggctttga

SEQ ID NO: 242047 - DNA, 25 bp, Homo sapien
tttgaatggaatgaaaactgcctgt

SEQ ID NO: 242048 - DNA, 25 bp, Homo sapien
aactgcctgttcaaatggttctgag

SEQ ID NO: 242049 - DNA, 25 bp, Homo sapien
gttctgaggatactgagagacgctc

SEQ ID NO: 242050 - DNA, 25 bp, Homo sapien
acgctcagtgtgtggtctttttatt

SEQ ID NO: 242051 - DNA, 25 bp, Homo sapien
caggttatgtttacgctgagtgtgt

SEQ ID NO: 242052 - DNA, 25 bp, Homo sapien
cgctggtgagattgtgtagtctaga

SEQ ID NO: 242053 - DNA, 25 bp, Homo sapien
acagagcaggtgcaagccggccttt

SEQ ID NO: 242054 - DNA, 25 bp, Homo sapien
aacgcactctgttcggtgagagcaa

SEQ ID NO: 242055 - DNA, 25 bp, Homo sapien
gagagcaactcagctcgcattgact

SEQ ID NO: 242056 - DNA, 25 bp, Homo sapien
ctgcaggagtgtggccgttcagttc

SEQ ID NO: 242057 - DNA, 25 bp, Homo sapien
gtggccgttcagttctcatttgaac

SEQ ID NO: 242058 - DNA, 25 bp, Homo sapien
gacaacagttgtcttctgagaatca

SEQ ID NO: 242059 - DNA, 25 bp, Homo sapien
gaatcatgagttagagcctcccttt

SEQ ID NO: 242060 - DNA, 25 bp, Homo sapien
taggcttctgactccctcaaaagta

SEQ ID NO: 242061 - DNA, 25 bp, Homo sapien
atttcctcctccgtgaaatgaggga

SEQ ID NO: 242062 - DNA, 25 bp, Homo sapien
ggaatggcccagacattttccagac

SEQ ID NO: 242063 - DNA, 25 bp, Homo sapien
agacctcttctgtcctaagagtgga

SEQ ID NO: 242064 - DNA, 25 bp, Homo sapien
agggtgacattgttccacggcctca

SEQ ID NO: 242065 - DNA, 25 bp, Homo sapien
acggcctcaaagctggccttgggct

SEQ ID NO: 242066 - DNA, 25 bp, Homo sapien
gccttgggctcactcttattagttt

SEQ ID NO: 242067 - DNA, 25 bp, Homo sapien
ctcttattagttttacttcctgcca

SEQ ID NO: 242068 - DNA, 25 bp, Homo sapien
acttttaaggacagagcagatgctc

SEQ ID NO: 242069 - DNA, 25 bp, Homo sapien
cttcctgccatgttcccatgagtaa

SEQ ID NO: 242070 - DNA, 25 bp, Homo sapien
gagtaagtttactgtggctcattcc

SEQ ID NO: 242071 - DNA, 25 bp, Homo sapien
atttctggttttcagtattggtctg

SEQ ID NO: 242072 - DNA, 25 bp, Homo sapien
ggaaactttgagcttggatggaacc

SEQ ID NO: 242073 - DNA, 25 bp, Homo sapien
gctccctggtttggatggcttggaa

SEQ ID NO: 242074 - DNA, 25 bp, Homo sapien
tagtctatcagagttggcaatggag

SEQ ID NO: 242075 - DNA, 25 bp, Homo sapien
gtctaatacctgtattctaatactg

SEQ ID NO: 242076 - DNA, 25 bp, Homo sapien
gtattctaatactgttttcatctga

SEQ ID NO: 242077 - DNA, 25 bp, Homo sapien
actgttttcatctgaatatgtgtag

SEQ ID NO: 242078 - DNA, 25 bp, Homo sapien
actgtgatattttctgtgctgtact

SEQ ID NO: 242079 - DNA, 25 bp, Homo sapien
ctgtgctgtacttttttctggagac

SEQ ID NO: 242080 - DNA, 25 bp, Homo sapien
ttttctggagacgagctggctagca

SEQ ID NO: 242081 - DNA, 25 bp, Homo sapien
agctggctagcagatgtgaaccact

SEQ ID NO: 242082 - DNA, 25 bp, Homo sapien
gtgaaccactggcattggtgtctta

SEQ ID NO: 242083 - DNA, 25 bp, Homo sapien
atatcttgtaatttcctaactttgg

SEQ ID NO: 242084 - DNA, 25 bp, Homo sapien
ttagtattttagtccaaccttctag

SEQ ID NO: 242085 - DNA, 25 bp, Homo sapien
ttttagtccaaccttctagaatggg

SEQ ID NO: 242086 - DNA, 25 bp, Homo sapien
gatcctctagctttggctttccaaa

SEQ ID NO: 242087 - DNA, 25 bp, Homo sapien
tttggctttccaaagattaccagca

SEQ ID NO: 242088 - DNA, 25 bp, Homo sapien
ggctttccaaagattaccagcatca

SEQ ID NO: 242089 - DNA, 25 bp, Homo sapien
caaagattaccagcatcatccacag

SEQ ID NO: 242090 - DNA, 25 bp, Homo sapien
atcatccacagcatctggcccagag

SEQ ID NO: 242091 - DNA, 25 bp, Homo sapien
tctctctggcttaccctcaagctgg

SEQ ID NO: 242092 - DNA, 25 bp, Homo sapien
tctggcttaccctcaagctggctta

SEQ ID NO: 242093 - DNA, 25 bp, Homo sapien
tcaagctggcttaacttcagacact

SEQ ID NO: 242094 - DNA, 25 bp, Homo sapien
aagctggcttaacttcagacactga

SEQ ID NO: 242095 - DNA, 25 bp, Homo sapien
gctggcttaacttcagacactgaga

SEQ ID NO: 242096 - DNA, 25 bp, Homo sapien
tggcttaacttcagacactgagaag

SEQ ID NO: 242097 - DNA, 25 bp, Homo sapien
tattaaaccaggtctatctaaaatt

SEQ ID NO: 242098 - DNA, 25 bp, Homo sapien
aattttaatatcacatgcaagaagc

SEQ ID NO: 242099 - DNA, 25 bp, Homo sapien
cattatcattttgtagcagattttt

SEQ ID NO: 242100 - DNA, 25 bp, Homo sapien
cagattttgaactgatcagcatgag

SEQ ID NO: 242101 - DNA, 25 bp, Homo sapien
gatcagcatgagacagattttcttt

SEQ ID NO: 242102 - DNA, 25 bp, Homo sapien
gttctggacaaaattcaagctggat

SEQ ID NO: 242103 - DNA, 25 bp, Homo sapien
caagctggatattactgattactct

SEQ ID NO: 242104 - DNA, 25 bp, Homo sapien
ggttaagtagttcctaggtgataat

SEQ ID NO: 242105 - DNA, 25 bp, Homo sapien
tagttcctaggtgataattaaatgt

SEQ ID NO: 242106 - DNA, 25 bp, Homo sapien
agtcaaatttgtatagattgcagtc

SEQ ID NO: 242107 - DNA, 25 bp, Homo sapien
atagattgcagtcttttcaaaagtt

SEQ ID NO: 242108 - DNA, 25 bp, Homo sapien
tgaaggattcatagcacagattact

SEQ ID NO: 242109 - DNA, 25 bp, Homo sapien
agattacttgcctaagatcatccag

SEQ ID NO: 242110 - DNA, 25 bp, Homo sapien
gatcatccaggaacgaagacaagaa

SEQ ID NO: 242111 - DNA, 25 bp, Homo sapien
gaattagtccccaaattcagtgttc

SEQ ID NO: 242112 - DNA, 25 bp, Homo sapien
ttcagtgttcttcctagtattaaac

SEQ ID NO: 242113 - DNA, 25 bp, Homo sapien
ttcctagtattaaacattgcccctt

SEQ ID NO: 242114 - DNA, 25 bp, Homo sapien
cattgcccctttcgacaaattttgg

SEQ ID NO: 242115 - DNA, 25 bp, Homo sapien
aaattttggatttcattcttgttat

SEQ ID NO: 242116 - DNA, 25 bp, Homo sapien
ttcttgttatatttcagtactcttg

SEQ ID NO: 242117 - DNA, 25 bp, Homo sapien
atttcagtactcttgctgatttatt

SEQ ID NO: 242118 - DNA, 25 bp, Homo sapien
tgttaggattagtcagtgtcatcgc

SEQ ID NO: 242119 - DNA, 25 bp, Homo sapien
tagtttgcctaatccagtactgtag

SEQ ID NO: 242120 - DNA, 25 bp, Homo sapien
atgggacggtgatttgccagcagtc

SEQ ID NO: 242121 - DNA, 25 bp, Homo sapien
ccagcagtccctactgaatttctta

SEQ ID NO: 242122 - DNA, 25 bp, Homo sapien
tgtcctggtctctaaactggtgtca

SEQ ID NO: 242123 - DNA, 25 bp, Homo sapien
ctggtgtcatgtttcctccttattc

SEQ ID NO: 242124 - DNA, 25 bp, Homo sapien
tattccatcatgtccctgatcatag

SEQ ID NO: 242125 - DNA, 25 bp, Homo sapien
atgtccctgatcatagcctgccaat

SEQ ID NO: 242126 - DNA, 25 bp, Homo sapien
tggatgtagaactctctgctgctct

SEQ ID NO: 242127 - DNA, 25 bp, Homo sapien
gctctcctggaatgatgtctacctg

SEQ ID NO: 242128 - DNA, 25 bp, Homo sapien
tgcctcccaccatgacaataattga

SEQ ID NO: 242129 - DNA, 25 bp, Homo sapien
aattgactgaagctctgaactgtaa

SEQ ID NO: 242130 - DNA, 25 bp, Homo sapien
agttgtcaatgagttgcccctcaga

SEQ ID NO: 242131 - DNA, 25 bp, Homo sapien
gaaaagaggaatttctctcctagaa

SEQ ID NO: 242132 - DNA, 25 bp, Homo sapien
acctcagttttgctattgttgtcat

SEQ ID NO: 242133 - DNA, 25 bp, Homo sapien
tgttgtgttaacttcactccaagaa

SEQ ID NO: 242134 - DNA, 25 bp, Homo sapien
caagaagatcagtgcccatgaacat

SEQ ID NO: 242135 - DNA, 25 bp, Homo sapien
gtgcccatgaacataccttacactg

SEQ ID NO: 242136 - DNA, 25 bp, Homo sapien
acactggaaaaactgacttgctaaa

SEQ ID NO: 242137 - DNA, 25 bp, Homo sapien
aaggcaaggactcttctgacagggc

SEQ ID NO: 242138 - DNA, 25 bp, Homo sapien
gactcttctgacagggcaaggtgga

SEQ ID NO: 242139 - DNA, 25 bp, Homo sapien
aggtgacggtgctattactggcttt

SEQ ID NO: 242140 - DNA, 25 bp, Homo sapien
ggtgctattactggctttcacagat

SEQ ID NO: 242141 - DNA, 25 bp, Homo sapien
gtctttcccacctcattggtccgtg

SEQ ID NO: 242142 - DNA, 25 bp, Homo sapien
cacctcattggtccgtgcttttatt

SEQ ID NO: 242143 - DNA, 25 bp, Homo sapien
tcattggtccgtgcttttattttta

SEQ ID NO: 242144 - DNA, 25 bp, Homo sapien
tcttaaatgccagacagttggaagc

SEQ ID NO: 242145 - DNA, 25 bp, Homo sapien
cagacagttggaagcaaatgccgag

SEQ ID NO: 242146 - DNA, 25 bp, Homo sapien
cagagccatgcttgataggactttg

SEQ ID NO: 242147 - DNA, 25 bp, Homo sapien
gccatgcttgataggactttgaata

SEQ ID NO: 242148 - DNA, 25 bp, Homo sapien
gcttgataggactttgaatattttc

SEQ ID NO: 242149 - DNA, 25 bp, Homo sapien
ttctccttacttaaagtacgttgct

SEQ ID NO: 242150 - DNA, 25 bp, Homo sapien
aagtacgttgcttgtatttagacta

SEQ ID NO: 242151 - DNA, 25 bp, Homo sapien
ttagactataagatgctatggaggt

SEQ ID NO: 242152 - DNA, 25 bp, Homo sapien
tgtacctgtcttgtcacttttccct

SEQ ID NO: 242153 - DNA, 25 bp, Homo sapien
aaagggccttttgctaatctaacag

SEQ ID NO: 242154 - DNA, 25 bp, Homo sapien
aagcaaaggcttctcccctactgat

SEQ ID NO: 242155 - DNA, 25 bp, Homo sapien
ccctactgatctccaagagcttagc

SEQ ID NO: 242156 - DNA, 25 bp, Homo sapien
taaaggcattactaagggaaccaca

SEQ ID NO: 242157 - DNA, 25 bp, Homo sapien
aattcttgtggttctagggcacagc

SEQ ID NO: 242158 - DNA, 25 bp, Homo sapien
gcacagctgtgataaccagggacca

SEQ ID NO: 242159 - DNA, 25 bp, Homo sapien
cagggaccaacacccgcaagtgtgt

SEQ ID NO: 242160 - DNA, 25 bp, Homo sapien
gagtgaatgtcacttcttccattaa

SEQ ID NO: 242161 - DNA, 25 bp, Homo sapien
aagtttcatagtgtttgctgcccgc

SEQ ID NO: 242162 - DNA, 25 bp, Homo sapien
gtttgctgcccgcacatgcttgtac

SEQ ID NO: 242163 - DNA, 25 bp, Homo sapien
taaaagttaccattagctctaaaat

SEQ ID NO: 242164 - DNA, 25 bp, Homo sapien
agattcggatgctttatttatagta

SEQ ID NO: 242165 - DNA, 25 bp, Homo sapien
taattgtagaagtcactgccttctg

SEQ ID NO: 242166 - DNA, 25 bp, Homo sapien
aagtcactgccttctgagttttcaa

SEQ ID NO: 242167 - DNA, 25 bp, Homo sapien
gtcactgccttctgagttttcaaat

SEQ ID NO: 242168 - DNA, 25 bp, Homo sapien
gagttttcaaatagataaccacctt

SEQ ID NO: 242169 - DNA, 25 bp, Homo sapien
gataaccacctttaatattacactg

SEQ ID NO: 242170 - DNA, 25 bp, Homo sapien
ccacctttaatattacactgcttat

SEQ ID NO: 242171 - DNA, 25 bp, Homo sapien
cactgcttataatactaatgtttac

SEQ ID NO: 242172 - DNA, 25 bp, Homo sapien
aaccatataatacattggctttgtc

SEQ ID NO: 242173 - DNA, 25 bp, Homo sapien
cattggctttgtcatattagttttt

SEQ ID NO: 242174 - DNA, 25 bp, Homo sapien
tggcagggtggatttggcccgcaga

SEQ ID NO: 242175 - DNA, 25 bp, Homo sapien
aatttgttgacccttgttccacgag

SEQ ID NO: 242176 - DNA, 25 bp, Homo sapien
gacccttgttccacgagttgaatga

SEQ ID NO: 242177 - DNA, 25 bp, Homo sapien
gaactactaacggaactgatctcct

SEQ ID NO: 242178 - DNA, 25 bp, Homo sapien
actgatctcctatttgaaaactggc

SEQ ID NO: 242179 - DNA, 25 bp, Homo sapien
aaactggcacaatctaattgcctgt

SEQ ID NO: 242180 - DNA, 25 bp, Homo sapien
aattgcctgtaaagttcttccaagc

SEQ ID NO: 242181 - DNA, 25 bp, Homo sapien
gttcttccaagctaaaggagccaat

SEQ ID NO: 242182 - DNA, 25 bp, Homo sapien
aggagccaatatttaactgctatta

SEQ ID NO: 242183 - DNA, 25 bp, Homo sapien
taactgctattatgtatgtgtttaa

SEQ ID NO: 242184 - DNA, 25 bp, Homo sapien
ttgatctttttccaaccgctgaaaa

SEQ ID NO: 242185 - DNA, 25 bp, Homo sapien
tgagatgccaaaggttgctgggtct

SEQ ID NO: 242186 - DNA, 25 bp, Homo sapien
gactgttgtggcctctcagttctct

SEQ ID NO: 242187 - DNA, 25 bp, Homo sapien
ctctcagttctctttgagtctgact

SEQ ID NO: 242188 - DNA, 25 bp, Homo sapien
ttgagtctgactgactgtggccagt

SEQ ID NO: 242189 - DNA, 25 bp, Homo sapien
gtctgactgactgtggccagtccct

SEQ ID NO: 242190 - DNA, 25 bp, Homo sapien
attgtcagctcttaccaaacgtcaa

SEQ ID NO: 242191 - DNA, 25 bp, Homo sapien
ttaccaaacgtcaagacctcttcct

SEQ ID NO: 242192 - DNA, 25 bp, Homo sapien
ttcctgcttgaccactcgcacatgg

SEQ ID NO: 242193 - DNA, 25 bp, Homo sapien
ttgaccactcgcacatggctctagg

SEQ ID NO: 242194 - DNA, 25 bp, Homo sapien
atggctctaggcttctcctgctgag

SEQ ID NO: 242195 - DNA, 25 bp, Homo sapien
ttctcctgctgagtcctggtcttgg

SEQ ID NO: 242196 - DNA, 25 bp, Homo sapien
gcttcctgtagtctgtagaaccata

SEQ ID NO: 242197 - DNA, 25 bp, Homo sapien
gtagtctgtagaaccataagccaaa

SEQ ID NO: 242198 - DNA, 25 bp, Homo sapien
gtctgtagaaccataagccaaataa

SEQ ID NO: 242199 - DNA, 25 bp, Homo sapien
ttacccagtcgcagatatttataga

SEQ ID NO: 242200 - DNA, 25 bp, Homo sapien
gaacagcctaatacaggtgctaaat

SEQ ID NO: 242201 - DNA, 25 bp, Homo sapien
ggtgctaaatacatatctgacaata

SEQ ID NO: 242202 - DNA, 25 bp, Homo sapien
gacaataaatggtagttatctctta

SEQ ID NO: 242203 - DNA, 25 bp, Homo sapien
ggtagttatctcttagaactgttat

SEQ ID NO: 242204 - DNA, 25 bp, Homo sapien
gattaaacgagttacagtgtccatc

SEQ ID NO: 242205 - DNA, 25 bp, Homo sapien
aacgagttacagtgtccatcttaaa

SEQ ID NO: 242206 - DNA, 25 bp, Homo sapien
aaaaaatctcataggttcactttgc

SEQ ID NO: 242207 - DNA, 25 bp, Homo sapien
aatacttgagcatatccctcattta

SEQ ID NO: 242208 - DNA, 25 bp, Homo sapien
gagcatatccctcatttaacttgat

SEQ ID NO: 242209 - DNA, 25 bp, Homo sapien
acttgatttctctcttactttctac

SEQ ID NO: 242210 - DNA, 25 bp, Homo sapien
ttttatgcaaatgagctgtttccca

SEQ ID NO: 242211 - DNA, 25 bp, Homo sapien
gtttcccataggttctgtcttgatc

SEQ ID NO: 242212 - DNA, 25 bp, Homo sapien
ggttctgtcttgatcttaatccttt

SEQ ID NO: 242213 - DNA, 25 bp, Homo sapien
acttgtggttgtgttaatggtcttc

SEQ ID NO: 242214 - DNA, 25 bp, Homo sapien
tgttaatggtcttcatcgctgctgc

SEQ ID NO: 242215 - DNA, 25 bp, Homo sapien
tcttcatcgctgctgcctatttttt

SEQ ID NO: 242216 - DNA, 25 bp, Homo sapien
acaaaaggtactctcaaaaggcata

SEQ ID NO: 242217 - DNA, 25 bp, Homo sapien
tgcacatgattagcaagattcagaa

SEQ ID NO: 242218 - DNA, 25 bp, Homo sapien
gaggagatcagcaggatttttccaa

SEQ ID NO: 242219 - DNA, 25 bp, Homo sapien
aggatttttccaagcacctgtcaaa

SEQ ID NO: 242220 - DNA, 25 bp, Homo sapien
gatcacattttcgtgtgacagtgat

SEQ ID NO: 242221 - DNA, 25 bp, Homo sapien
ccaaaaccagctcggaataggaatt

SEQ ID NO: 242222 - DNA, 25 bp, Homo sapien
atttgcataagatactcccaccagg

SEQ ID NO: 242223 - DNA, 25 bp, Homo sapien
gtttacaaatgatcccacggcaata

SEQ ID NO: 242224 - DNA, 25 bp, Homo sapien
gatcccacggcaataacccaggaat

SEQ ID NO: 242225 - DNA, 25 bp, Homo sapien
acccaggaattatcttatatggttc

SEQ ID NO: 242226 - DNA, 25 bp, Homo sapien
tagaaagataattccgtctctcctt

SEQ ID NO: 242227 - DNA, 25 bp, Homo sapien
cgtctctcctttggcagtaggcatg

SEQ ID NO: 242228 - DNA, 25 bp, Homo sapien
ttggcagtaggcatgtccctgtgag

SEQ ID NO: 242229 - DNA, 25 bp, Homo sapien
ttatgtttaaactcttaggattcaa

SEQ ID NO: 242230 - DNA, 25 bp, Homo sapien
tatgtttaaactcttaggattcaaa

SEQ ID NO: 242231 - DNA, 25 bp, Homo sapien
atgtttaaactcttaggattcaaat

SEQ ID NO: 242232 - DNA, 25 bp, Homo sapien
tgtttaaactcttaggattcaaatg

SEQ ID NO: 242233 - DNA, 25 bp, Homo sapien
gtttaaactcttaggattcaaatga

SEQ ID NO: 242234 - DNA, 25 bp, Homo sapien
taaactcttaggattcaaatgagat

SEQ ID NO: 242235 - DNA, 25 bp, Homo sapien
atctaatggatatttctgatttggg

SEQ ID NO: 242236 - DNA, 25 bp, Homo sapien
ctaatggatatttctgatttgggtc

SEQ ID NO: 242237 - DNA, 25 bp, Homo sapien
taatggatatttctgatttgggtct

SEQ ID NO: 242238 - DNA, 25 bp, Homo sapien
ctgcggagaactggcaatcaaaatc

SEQ ID NO: 242239 - DNA, 25 bp, Homo sapien
tgcggagaactggcaatcaaaatcc

SEQ ID NO: 242240 - DNA, 25 bp, Homo sapien
ggaagcaactttgtatctcaggtct

SEQ ID NO: 242241 - DNA, 25 bp, Homo sapien
gtatctcaggtcttaatgaacacat

SEQ ID NO: 242242 - DNA, 25 bp, Homo sapien
ccctgcatcagggaatgtggaaatg

SEQ ID NO: 242243 - DNA, 25 bp, Homo sapien
ttgctgaattctcaagccttaccaa

SEQ ID NO: 242244 - DNA, 25 bp, Homo sapien
aagccttaccaaacacatcagaaat

SEQ ID NO: 242245 - DNA, 25 bp, Homo sapien
gagaatctgggaatacctttctgaa

SEQ ID NO: 242246 - DNA, 25 bp, Homo sapien
gaatcccacaaaccttaatgtgtgt

SEQ ID NO: 242247 - DNA, 25 bp, Homo sapien
gagaaaccctgcaatttaaatggta

SEQ ID NO: 242248 - DNA, 25 bp, Homo sapien
tggtctggatgatgccccactccat

SEQ ID NO: 242249 - DNA, 25 bp, Homo sapien
cccactccatatttgtaagccctaa

SEQ ID NO: 242250 - DNA, 25 bp, Homo sapien
ccatatttgtaagccctaagtccta

SEQ ID NO: 242251 - DNA, 25 bp, Homo sapien
gggcttagtgatgaaacaaaccttg

SEQ ID NO: 242252 - DNA, 25 bp, Homo sapien
gcaggcgccggtggcttctgtcaca

SEQ ID NO: 242253 - DNA, 25 bp, Homo sapien
caggagggaacagcgctgacattca

SEQ ID NO: 242254 - DNA, 25 bp, Homo sapien
gctgacattcagctggttcgcactg

SEQ ID NO: 242255 - DNA, 25 bp, Homo sapien
gctggttcgcactgatacggctcaa

SEQ ID NO: 242256 - DNA, 25 bp, Homo sapien
gatacggctcaaccagtttgttaaa

SEQ ID NO: 242257 - DNA, 25 bp, Homo sapien
aaaacatgtctgttccagtgtcagt

SEQ ID NO: 242258 - DNA, 25 bp, Homo sapien
gttccagtgtcagtaatatacgagt

SEQ ID NO: 242259 - DNA, 25 bp, Homo sapien
atatacgagtaactgcaatatgcag

SEQ ID NO: 242260 - DNA, 25 bp, Homo sapien
acaaactcagttcaagctaattaag

SEQ ID NO: 242261 - DNA, 25 bp, Homo sapien
ctaattaagagatcgcaacagccgt

SEQ ID NO: 242262 - DNA, 25 bp, Homo sapien
ccactaccacacctgtgttatgggt

SEQ ID NO: 242263 - DNA, 25 bp, Homo sapien
ggtgtcagcctgtgagtccttgaac

SEQ ID NO: 242264 - DNA, 25 bp, Homo sapien
acatctgaacctgtttttctcttca

SEQ ID NO: 242265 - DNA, 25 bp, Homo sapien
tacttaccttgtccaaaaaggtcat

SEQ ID NO: 242266 - DNA, 25 bp, Homo sapien
tcataaagggtagggctttttctgt

SEQ ID NO: 242267 - DNA, 25 bp, Homo sapien
gttccacctctgtactatatttctc

SEQ ID NO: 242268 - DNA, 25 bp, Homo sapien
acctctgtactatatttctccccaa

SEQ ID NO: 242269 - DNA, 25 bp, Homo sapien
tctgtactatatttctccccaacaa

SEQ ID NO: 242270 - DNA, 25 bp, Homo sapien
tgtactatatttctccccaacaaat

SEQ ID NO: 242271 - DNA, 25 bp, Homo sapien
tatttctccccaacaaatatctgcc

SEQ ID NO: 242272 - DNA, 25 bp, Homo sapien
ccaacaaatatctgcccctgaggac

SEQ ID NO: 242273 - DNA, 25 bp, Homo sapien
agtggtacttcattgctgttttagc

SEQ ID NO: 242274 - DNA, 25 bp, Homo sapien
cattgctgttttagccaacgtttta

SEQ ID NO: 242275 - DNA, 25 bp, Homo sapien
gggagtttgactattttggcttacg

SEQ ID NO: 242276 - DNA, 25 bp, Homo sapien
gactattttggcttacgtactcatt

SEQ ID NO: 242277 - DNA, 25 bp, Homo sapien
ttggcttacgtactcatttcctttt

SEQ ID NO: 242278 - DNA, 25 bp, Homo sapien
cttacgtactcatttccttttctct

SEQ ID NO: 242279 - DNA, 25 bp, Homo sapien
tgttttgcttgtgtgcgttcctgat

SEQ ID NO: 242280 - DNA, 25 bp, Homo sapien
tgtgtgcgttcctgatttttgtctt

SEQ ID NO: 242281 - DNA, 25 bp, Homo sapien
ttttgtcttgtataatcttgatctt

SEQ ID NO: 242282 - DNA, 25 bp, Homo sapien
ttgtttcacacatctgcagtaatat

SEQ ID NO: 242283 - DNA, 25 bp, Homo sapien
actaatatttaacaagctctttctt

SEQ ID NO: 242284 - DNA, 25 bp, Homo sapien
agccggtgttggtgtattcctgatt

SEQ ID NO: 242285 - DNA, 25 bp, Homo sapien
tggtgtattcctgatttggacatca

SEQ ID NO: 242286 - DNA, 25 bp, Homo sapien
ttcctgatttggacatcagaaacac

SEQ ID NO: 242287 - DNA, 25 bp, Homo sapien
catgaaaagttgtcacaaatgtgtt

SEQ ID NO: 242288 - DNA, 25 bp, Homo sapien
aagcaacactggttggagatcggac

SEQ ID NO: 242289 - DNA, 25 bp, Homo sapien
aacactggttggagatcggaccacc

SEQ ID NO: 242290 - DNA, 25 bp, Homo sapien
gttggagatcggaccaccggacttg

SEQ ID NO: 242291 - DNA, 25 bp, Homo sapien
atcggaccaccggacttggtggagc

SEQ ID NO: 242292 - DNA, 25 bp, Homo sapien
gaccaccggacttggtggagcgcaa

SEQ ID NO: 242293 - DNA, 25 bp, Homo sapien
ctcccatcacaagaaatactcgaag

SEQ ID NO: 242294 - DNA, 25 bp, Homo sapien
gaaatactcgaagccggtgttggtg

SEQ ID NO: 242295 - DNA, 25 bp, Homo sapien
gaacaagtgactctgctttagacaa

SEQ ID NO: 242296 - DNA, 25 bp, Homo sapien
actctgctttagacaagcccctgga

SEQ ID NO: 242297 - DNA, 25 bp, Homo sapien
cctggccatggagtgaggtagaaaa

SEQ ID NO: 242298 - DNA, 25 bp, Homo sapien
gaattcccatgaatacaaacctatt

SEQ ID NO: 242299 - DNA, 25 bp, Homo sapien
aaaaggcagccccatcagagatcac

SEQ ID NO: 242300 - DNA, 25 bp, Homo sapien
gcagccccatcagagatcacgggag

SEQ ID NO: 242301 - DNA, 25 bp, Homo sapien
atcacgggagcaacagtaagggaca

SEQ ID NO: 242302 - DNA, 25 bp, Homo sapien
gagcaacagtaagggacagagtttt

SEQ ID NO: 242303 - DNA, 25 bp, Homo sapien
gtccacttgtccctcagcatggaag

SEQ ID NO: 242304 - DNA, 25 bp, Homo sapien
cacttgtccctcagcatggaagcca

SEQ ID NO: 242305 - DNA, 25 bp, Homo sapien
accgtggtcctgcatagagtgagtc

SEQ ID NO: 242306 - DNA, 25 bp, Homo sapien
caagaaccggttcaacacgtccacg

SEQ ID NO: 242307 - DNA, 25 bp, Homo sapien
cgagacggccgggaagcacgagagg

SEQ ID NO: 242308 - DNA, 25 bp, Homo sapien
acgaccaccgactcgaaaaccatgt

SEQ ID NO: 242309 - DNA, 25 bp, Homo sapien
cgactcgaaaaccatgttcctcagc

SEQ ID NO: 242310 - DNA, 25 bp, Homo sapien
aaaccatgttcctcagccgtggtgg

SEQ ID NO: 242311 - DNA, 25 bp, Homo sapien
tcgagagtaacacgcttccctgcag

SEQ ID NO: 242312 - DNA, 25 bp, Homo sapien
taacacgcttccctgcagataagag

SEQ ID NO: 242313 - DNA, 25 bp, Homo sapien
acacgcttccctgcagataagagtt

SEQ ID NO: 242314 - DNA, 25 bp, Homo sapien
agccggtctggaaactgctgaacac

SEQ ID NO: 242315 - DNA, 25 bp, Homo sapien
ttacctttccagatgcccagagaga

SEQ ID NO: 242316 - DNA, 25 bp, Homo sapien
tgggacgtgtccaagtccaccacat

SEQ ID NO: 242317 - DNA, 25 bp, Homo sapien
gtatagcctgtgactctccgtgtgt

SEQ ID NO: 242318 - DNA, 25 bp, Homo sapien
tccttccacacctgattagaacatt

SEQ ID NO: 242319 - DNA, 25 bp, Homo sapien
agaacattcataagccacatttaga

SEQ ID NO: 242320 - DNA, 25 bp, Homo sapien
tttgctttcagctgtcacttgcaca

SEQ ID NO: 242321 - DNA, 25 bp, Homo sapien
acttgcacacatactgcctagttgt

SEQ ID NO: 242322 - DNA, 25 bp, Homo sapien
tactgcctagttgtgaaccaaatgt

SEQ ID NO: 242323 - DNA, 25 bp, Homo sapien
tgtgaaaaaacctccttcatcccat

SEQ ID NO: 242324 - DNA, 25 bp, Homo sapien
tgtgtatctgatacctgccgagggc

SEQ ID NO: 242325 - DNA, 25 bp, Homo sapien
agggtgtgtgttgacaacgccgctc

SEQ ID NO: 242326 - DNA, 25 bp, Homo sapien
gaacaagagccgcttccggatggct

SEQ ID NO: 242327 - DNA, 25 bp, Homo sapien
ggagctcaagtgtcgggaactgtct

SEQ ID NO: 242328 - DNA, 25 bp, Homo sapien
gagtcacagccactgatatttaggt

SEQ ID NO: 242329 - DNA, 25 bp, Homo sapien
atatttaggtgatgtctcttaggac

SEQ ID NO: 242330 - DNA, 25 bp, Homo sapien
gatgtctcttaggacttcagtgcct

SEQ ID NO: 242331 - DNA, 25 bp, Homo sapien
taggacttcagtgcctcagctgcct

SEQ ID NO: 242332 - DNA, 25 bp, Homo sapien
ttttgcatgccttaggaagaagcac

SEQ ID NO: 242333 - DNA, 25 bp, Homo sapien
taggtaaaaccagcagtttccagta

SEQ ID NO: 242334 - DNA, 25 bp, Homo sapien
cagcggagagacaagatggagcaca

SEQ ID NO: 242335 - DNA, 25 bp, Homo sapien
acatgtagtctgtgtgcctggtcac

SEQ ID NO: 242336 - DNA, 25 bp, Homo sapien
gcctggtcacacagaggcctgcatg

SEQ ID NO: 242337 - DNA, 25 bp, Homo sapien
cagaggcctgcatgcaagtagcaaa

SEQ ID NO: 242338 - DNA, 25 bp, Homo sapien
agtagcaaagcagctctcaagggct

SEQ ID NO: 242339 - DNA, 25 bp, Homo sapien
atgtactgctcttaggttgttttga

SEQ ID NO: 242340 - DNA, 25 bp, Homo sapien
tactgctcttaggttgttttgataa

SEQ ID NO: 242341 - DNA, 25 bp, Homo sapien
aggaccttcttgaacgacttttctg

SEQ ID NO: 242342 - DNA, 25 bp, Homo sapien
gggaatcaattctctggtattctgg

SEQ ID NO: 242343 - DNA, 25 bp, Homo sapien
aaaaatatttggtgcactgctcaat

SEQ ID NO: 242344 - DNA, 25 bp, Homo sapien
atttggtgcactgctcaattaacaa

SEQ ID NO: 242345 - DNA, 25 bp, Homo sapien
gtgcactgctcaattaacaaaccta

SEQ ID NO: 242346 - DNA, 25 bp, Homo sapien
ttaacaaacctacatggagacctta

SEQ ID NO: 242347 - DNA, 25 bp, Homo sapien
aacctacatggagaccttaattttg

SEQ ID NO: 242348 - DNA, 25 bp, Homo sapien
aatagtttatgtactgctcttaggt

SEQ ID NO: 242349 - DNA, 25 bp, Homo sapien
gtttatgtactgctcttaggttgtt

SEQ ID NO: 242350 - DNA, 25 bp, Homo sapien
agacctgaacttggcctacttcgga

SEQ ID NO: 242351 - DNA, 25 bp, Homo sapien
tacttcggatgccttgtttcccgtg

SEQ ID NO: 242352 - DNA, 25 bp, Homo sapien
tggctcttcctagggcctgtagcta

SEQ ID NO: 242353 - DNA, 25 bp, Homo sapien
gtagctacactgatccactttgaag

SEQ ID NO: 242354 - DNA, 25 bp, Homo sapien
gagatttactcttctgcttcagatc

SEQ ID NO: 242355 - DNA, 25 bp, Homo sapien
ttctcgaataatctgcaacctctgg

SEQ ID NO: 242356 - DNA, 25 bp, Homo sapien
tgtacctgcttctgtcacgtgtagt

SEQ ID NO: 242357 - DNA, 25 bp, Homo sapien
gtcacgtgtagtcttcctagttctc

SEQ ID NO: 242358 - DNA, 25 bp, Homo sapien
aggtaacttttgatcattcttccaa

SEQ ID NO: 242359 - DNA, 25 bp, Homo sapien
ttctgcttcagatctttccatggcc

SEQ ID NO: 242360 - DNA, 25 bp, Homo sapien
aagtctgaaatgatggttatggccc

SEQ ID NO: 242361 - DNA, 25 bp, Homo sapien
gggaagctgactgtgatttaccaaa

SEQ ID NO: 242362 - DNA, 25 bp, Homo sapien
aaccaaaatgtctgcggaatcacca

SEQ ID NO: 242363 - DNA, 25 bp, Homo sapien
gaatcaccagtttgatactctctgt

SEQ ID NO: 242364 - DNA, 25 bp, Homo sapien
gtaatcagaacagtgggcagtgcct

SEQ ID NO: 242365 - DNA, 25 bp, Homo sapien
cagtgcctgggtgaacgtgtctagc

SEQ ID NO: 242366 - DNA, 25 bp, Homo sapien
ggtgaacgtgtctagcagccactgt

SEQ ID NO: 242367 - DNA, 25 bp, Homo sapien
gccactgtgcgggatcgctgtaaca

SEQ ID NO: 242368 - DNA, 25 bp, Homo sapien
tatttacttttctaactgctccaac

SEQ ID NO: 242369 - DNA, 25 bp, Homo sapien
aactgctccaacagccaaatgcctt

SEQ ID NO: 242370 - DNA, 25 bp, Homo sapien
gaccattgtattcagttcattacca

SEQ ID NO: 242371 - DNA, 25 bp, Homo sapien
gcactttgtaatgatgcctttcagt

SEQ ID NO: 242372 - DNA, 25 bp, Homo sapien
ctaacctcgcaaagttgtatttatg

SEQ ID NO: 242373 - DNA, 25 bp, Homo sapien
tttctgtttccaagtggtaattttg

SEQ ID NO: 242374 - DNA, 25 bp, Homo sapien
gttgtatttatgagcctgtgacttt

SEQ ID NO: 242375 - DNA, 25 bp, Homo sapien
ttatgagcctgtgactttcatccac

SEQ ID NO: 242376 - DNA, 25 bp, Homo sapien
cctgtgactttcatccaccaaagaa

SEQ ID NO: 242377 - DNA, 25 bp, Homo sapien
ttcatccaccaaagaaacctgtctt

SEQ ID NO: 242378 - DNA, 25 bp, Homo sapien
aagaaacctgtcttagccatccttt

SEQ ID NO: 242379 - DNA, 25 bp, Homo sapien
tagccatcctttccctttcatagct

SEQ ID NO: 242380 - DNA, 25 bp, Homo sapien
aaatcctctggctttattaccaggt

SEQ ID NO: 242381 - DNA, 25 bp, Homo sapien
ccatatagtcgagggaatcacaaat

SEQ ID NO: 242382 - DNA, 25 bp, Homo sapien
gaatcacaaattttaagtactagct

SEQ ID NO: 242383 - DNA, 25 bp, Homo sapien
gtttctcaaccactttataacgtat

SEQ ID NO: 242384 - DNA, 25 bp, Homo sapien
atgtcttgttttgaagtattgctgc

SEQ ID NO: 242385 - DNA, 25 bp, Homo sapien
agtattgctgctatccttgttatcc

SEQ ID NO: 242386 - DNA, 25 bp, Homo sapien
attgctgctatccttgttatccttc

SEQ ID NO: 242387 - DNA, 25 bp, Homo sapien
tgttatccttcccactgtttttatc

SEQ ID NO: 242388 - DNA, 25 bp, Homo sapien
gaaagttgtacactaatgttctatg

SEQ ID NO: 242389 - DNA, 25 bp, Homo sapien
gtacactaatgttctatgtcaaaat

SEQ ID NO: 242390 - DNA, 25 bp, Homo sapien
actagttctatttaatgtggttatg

SEQ ID NO: 242391 - DNA, 25 bp, Homo sapien
tggttatggaaccagctggaaacac

SEQ ID NO: 242392 - DNA, 25 bp, Homo sapien
agtgattgtacagcaggctgggccc

SEQ ID NO: 242393 - DNA, 25 bp, Homo sapien
cccaggaggtcaggttcattttgtt

SEQ ID NO: 242394 - DNA, 25 bp, Homo sapien
acccttgctaagtaattgacatatg

SEQ ID NO: 242395 - DNA, 25 bp, Homo sapien
atgtaacaataactagcctaaagaa

SEQ ID NO: 242396 - DNA, 25 bp, Homo sapien
aaaaagtatctctcccgagctgaaa

SEQ ID NO: 242397 - DNA, 25 bp, Homo sapien
atctctcccgagctgaaacttaaaa

SEQ ID NO: 242398 - DNA, 25 bp, Homo sapien
tattaaatgcacactgtaccattag

SEQ ID NO: 242399 - DNA, 25 bp, Homo sapien
atgcacactgtaccattagatgaaa

SEQ ID NO: 242400 - DNA, 25 bp, Homo sapien
gaaatcttacttgagaaattgccat

SEQ ID NO: 242401 - DNA, 25 bp, Homo sapien
gaaattgccataagccatattacag

SEQ ID NO: 242402 - DNA, 25 bp, Homo sapien
gccatattacagatcttactttgtt

SEQ ID NO: 242403 - DNA, 25 bp, Homo sapien
ctcatttttacataatatagtcctt

SEQ ID NO: 242404 - DNA, 25 bp, Homo sapien
ttatttaacccttgctaagtaattg

SEQ ID NO: 242405 - DNA, 25 bp, Homo sapien
aaggcacattggtgcatgtgtgttt

SEQ ID NO: 242406 - DNA, 25 bp, Homo sapien
atgtgtgtttgctagctcacttgtc

SEQ ID NO: 242407 - DNA, 25 bp, Homo sapien
gctagctcacttgtccatgaaaata

SEQ ID NO: 242408 - DNA, 25 bp, Homo sapien
aagagaatttatgtggcttctcatt

SEQ ID NO: 242409 - DNA, 25 bp, Homo sapien
tctcatttttaaatcccctcagagg

SEQ ID NO: 242410 - DNA, 25 bp, Homo sapien
aaatcccctcagaggtgtgactagt

SEQ ID NO: 242411 - DNA, 25 bp, Homo sapien
gtgtgactagtctctttatcagcac

SEQ ID NO: 242412 - DNA, 25 bp, Homo sapien
actagtctctttatcagcacacact

SEQ ID NO: 242413 - DNA, 25 bp, Homo sapien
caaacttggagagtatggacaactt

SEQ ID NO: 242414 - DNA, 25 bp, Homo sapien
ggacaactttgatattgcttggcac

SEQ ID NO: 242415 - DNA, 25 bp, Homo sapien
attgcttggcacagatggtattaaa

SEQ ID NO: 242416 - DNA, 25 bp, Homo sapien
ctacatataatcactttgcacacat

SEQ ID NO: 242417 - DNA, 25 bp, Homo sapien
ttttaagttaatcagatgcttccag

SEQ ID NO: 242418 - DNA, 25 bp, Homo sapien
atgcttccagagtcttggatttggt

SEQ ID NO: 242419 - DNA, 25 bp, Homo sapien
cagagtcttggatttggttacccct

SEQ ID NO: 242420 - DNA, 25 bp, Homo sapien
gagacagattctaggttgggacaaa

SEQ ID NO: 242421 - DNA, 25 bp, Homo sapien
ggttgggacaaacatcttaatttat

SEQ ID NO: 242422 - DNA, 25 bp, Homo sapien
gagcaagttctcagagaattcacaa

SEQ ID NO: 242423 - DNA, 25 bp, Homo sapien
ttcacaaaatttctagaatccatga

SEQ ID NO: 242424 - DNA, 25 bp, Homo sapien
gaatccatgaaagatctagagaaca

SEQ ID NO: 242425 - DNA, 25 bp, Homo sapien
aacacttagctgtaagtgctttgac

SEQ ID NO: 242426 - DNA, 25 bp, Homo sapien
ctgtaagtgctttgacctatttttt

SEQ ID NO: 242427 - DNA, 25 bp, Homo sapien
gacaagattcgacccctctggagac

SEQ ID NO: 242428 - DNA, 25 bp, Homo sapien
ctacttccagaacacccaagggttg

SEQ ID NO: 242429 - DNA, 25 bp, Homo sapien
aacacccaagggttgatatttgtgg

SEQ ID NO: 242430 - DNA, 25 bp, Homo sapien
ggttgatatttgtggtcgacagcaa

SEQ ID NO: 242431 - DNA, 25 bp, Homo sapien
tcgacagcaatgatcgggagcgagt

SEQ ID NO: 242432 - DNA, 25 bp, Homo sapien
gctgtactccttgtctttgcaaaca

SEQ ID NO: 242433 - DNA, 25 bp, Homo sapien
aacaggatctgcctaatgctatgaa

SEQ ID NO: 242434 - DNA, 25 bp, Homo sapien
cctaatgctatgaacgctgctgaga

SEQ ID NO: 242435 - DNA, 25 bp, Homo sapien
atgaacgctgctgagatcacagaca

SEQ ID NO: 242436 - DNA, 25 bp, Homo sapien
gacaagctgggcctgcattcccttc

SEQ ID NO: 242437 - DNA, 25 bp, Homo sapien
cttcgtcaccgtaactggtacattc

SEQ ID NO: 242438 - DNA, 25 bp, Homo sapien
gagcattgcaatttcaacgacgtca

SEQ ID NO: 242439 - DNA, 25 bp, Homo sapien
aacgacgtcacaacccgcttgaggg

SEQ ID NO: 242440 - DNA, 25 bp, Homo sapien
gagctaacgtactactgctgcaaga

SEQ ID NO: 242441 - DNA, 25 bp, Homo sapien
gctgcaagaaggacctgtgtaactt

SEQ ID NO: 242442 - DNA, 25 bp, Homo sapien
ggtgggacatccttatcagagaaaa

SEQ ID NO: 242443 - DNA, 25 bp, Homo sapien
agagaaaacagttcttctgctggtg

SEQ ID NO: 242444 - DNA, 25 bp, Homo sapien
tggagccttcatccctaagtcaaca

SEQ ID NO: 242445 - DNA, 25 bp, Homo sapien
taagtcaacaccaggagagcttctc

SEQ ID NO: 242446 - DNA, 25 bp, Homo sapien
tgcgtagtccgctttctcttgctgc

SEQ ID NO: 242447 - DNA, 25 bp, Homo sapien
tcttgctgccacattctaaaggctt

SEQ ID NO: 242448 - DNA, 25 bp, Homo sapien
ggcttgatattttccaaatggatcc

SEQ ID NO: 242449 - DNA, 25 bp, Homo sapien
attgacaaattgctctgccccgcct

SEQ ID NO: 242450 - DNA, 25 bp, Homo sapien
ctcctgcagtctgggatcctgagtg

SEQ ID NO: 242451 - DNA, 25 bp, Homo sapien
atcctgagtgtcctgtgggttcatc

SEQ ID NO: 242452 - DNA, 25 bp, Homo sapien
ttcatctcggatgggcgctgcataa

SEQ ID NO: 242453 - DNA, 25 bp, Homo sapien
atgggcgctgcataaacagcctgca

SEQ ID NO: 242454 - DNA, 25 bp, Homo sapien
aaacagcctgcagggaacgtctggg

SEQ ID NO: 242455 - DNA, 25 bp, Homo sapien
gggagaaccagcttcacaacagata

SEQ ID NO: 242456 - DNA, 25 bp, Homo sapien
aagaattgcgaaagtgtgacacaca

SEQ ID NO: 242457 - DNA, 25 bp, Homo sapien
aagtgggcacatgctcgtgggaaaa

SEQ ID NO: 242458 - DNA, 25 bp, Homo sapien
gttgccaatagacttgcttgactct

SEQ ID NO: 242459 - DNA, 25 bp, Homo sapien
tgcttgactctggagttaccccgaa

SEQ ID NO: 242460 - DNA, 25 bp, Homo sapien
ggctactgtcacatcttgatcacag

SEQ ID NO: 242461 - DNA, 25 bp, Homo sapien
agaaaggcacctggaatgcggctgc

SEQ ID NO: 242462 - DNA, 25 bp, Homo sapien
ggctgcccaagcttgcagggaacaa

SEQ ID NO: 242463 - DNA, 25 bp, Homo sapien
agggaacaatacctgggcaaccttg

SEQ ID NO: 242464 - DNA, 25 bp, Homo sapien
ggcaaccttgtaactgtattctcca

SEQ ID NO: 242465 - DNA, 25 bp, Homo sapien
aactgtattctccaggcagcacatg

SEQ ID NO: 242466 - DNA, 25 bp, Homo sapien
agcacatgcggtggctctgggacat

SEQ ID NO: 242467 - DNA, 25 bp, Homo sapien
taggtttgaacgaccaagtgcatgc

SEQ ID NO: 242468 - DNA, 25 bp, Homo sapien
caagtgcatgctggccactgggagt

SEQ ID NO: 242469 - DNA, 25 bp, Homo sapien
tggatcggtggtgaacctgttgcct

SEQ ID NO: 242470 - DNA, 25 bp, Homo sapien
cctgttgccttcaccaatgggagaa

SEQ ID NO: 242471 - DNA, 25 bp, Homo sapien
taatgggcccagaactgtggtttaa

SEQ ID NO: 242472 - DNA, 25 bp, Homo sapien
atgggcccagaactgtggtttaaat

SEQ ID NO: 242473 - DNA, 25 bp, Homo sapien
gatttgggacctaaaatactcctca

SEQ ID NO: 242474 - DNA, 25 bp, Homo sapien
tgggacctaaaatactcctcaggtt

SEQ ID NO: 242475 - DNA, 25 bp, Homo sapien
gacctaaaatactcctcaggttgat

SEQ ID NO: 242476 - DNA, 25 bp, Homo sapien
tactcctcaggttgatgtattcatg

SEQ ID NO: 242477 - DNA, 25 bp, Homo sapien
cctcaggttgatgtattcatgaagt

SEQ ID NO: 242478 - DNA, 25 bp, Homo sapien
gttaatacacttaatgttgcatgag

SEQ ID NO: 242479 - DNA, 25 bp, Homo sapien
tacacttaatgttgcatgagtgata

SEQ ID NO: 242480 - DNA, 25 bp, Homo sapien
tctgggtttcctcttaagattttag

SEQ ID NO: 242481 - DNA, 25 bp, Homo sapien
tttgtcccacccctccagaaataag

SEQ ID NO: 242482 - DNA, 25 bp, Homo sapien
cccttcttgtttgcacatgccaaga

SEQ ID NO: 242483 - DNA, 25 bp, Homo sapien
tgcacatgccaagataactgctttt

SEQ ID NO: 242484 - DNA, 25 bp, Homo sapien
actgcttttatgcaggctgtacccc

SEQ ID NO: 242485 - DNA, 25 bp, Homo sapien
aaaatcctttctacagtgctgctca

SEQ ID NO: 242486 - DNA, 25 bp, Homo sapien
tcctacctgcattgctgacttgaat

SEQ ID NO: 242487 - DNA, 25 bp, Homo sapien
cttgaattcacagtcgccgagtcta

SEQ ID NO: 242488 - DNA, 25 bp, Homo sapien
cgagtctacctagctttcttggaag

SEQ ID NO: 242489 - DNA, 25 bp, Homo sapien
ggaagcagtctagcaaaatttctat

SEQ ID NO: 242490 - DNA, 25 bp, Homo sapien
aatttctatttgtacgttcactaat

SEQ ID NO: 242491 - DNA, 25 bp, Homo sapien
gtacgttcactaattatctacaagg

SEQ ID NO: 242492 - DNA, 25 bp, Homo sapien
atttacaaaactctacttcagtgtt

SEQ ID NO: 242493 - DNA, 25 bp, Homo sapien
aaagtcacaggtactctgatcctac

SEQ ID NO: 242494 - DNA, 25 bp, Homo sapien
aggtactctgatcctactgtggact

SEQ ID NO: 242495 - DNA, 25 bp, Homo sapien
tactctgatcctactgtggactgtt

SEQ ID NO: 242496 - DNA, 25 bp, Homo sapien
gatcctactgtggactgtttcctat

SEQ ID NO: 242497 - DNA, 25 bp, Homo sapien
caaattaagacgcatgtggtcctaa

SEQ ID NO: 242498 - DNA, 25 bp, Homo sapien
ggactgtttcctatattcgtaattg

SEQ ID NO: 242499 - DNA, 25 bp, Homo sapien
gacgcatgtggtcctaaaattctat

SEQ ID NO: 242500 - DNA, 25 bp, Homo sapien
caagttcaccagacccctggtttag

SEQ ID NO: 242501 - DNA, 25 bp, Homo sapien
cagacccctggtttagaggttgtct

SEQ ID NO: 242502 - DNA, 25 bp, Homo sapien
atatcttgaaaatctacacgtgtaa

SEQ ID NO: 242503 - DNA, 25 bp, Homo sapien
atctacacgtgtaataatctaaatg

SEQ ID NO: 242504 - DNA, 25 bp, Homo sapien
taatgggcccagaactgtggtttaa

SEQ ID NO: 242505 - DNA, 25 bp, Homo sapien
atgggcccagaactgtggtttaaat

SEQ ID NO: 242506 - DNA, 25 bp, Homo sapien
tggatttgggacctaaaatactcct

SEQ ID NO: 242507 - DNA, 25 bp, Homo sapien
atttgggacctaaaatactcctcag

SEQ ID NO: 242508 - DNA, 25 bp, Homo sapien
tgggacctaaaatactcctcaggtt

SEQ ID NO: 242509 - DNA, 25 bp, Homo sapien
gacctaaaatactcctcaggttgat

SEQ ID NO: 242510 - DNA, 25 bp, Homo sapien
tactcctcaggttgatgtattcatg

SEQ ID NO: 242511 - DNA, 25 bp, Homo sapien
tcctcaggttgatgtattcatgaag

SEQ ID NO: 242512 - DNA, 25 bp, Homo sapien
caggttgatgtattcatgaagtttt

SEQ ID NO: 242513 - DNA, 25 bp, Homo sapien
gttaatacacttaatgttgcatgag

SEQ ID NO: 242514 - DNA, 25 bp, Homo sapien
tacacttaatgttgcatgagtgata

SEQ ID NO: 242515 - DNA, 25 bp, Homo sapien
aaggcagacacccacaagaagatga

SEQ ID NO: 242516 - DNA, 25 bp, Homo sapien
gatgactgagttctagagaccccac

SEQ ID NO: 242517 - DNA, 25 bp, Homo sapien
tgagttctagagaccccacaagcac

SEQ ID NO: 242518 - DNA, 25 bp, Homo sapien
agaccccacaagcactatggacgaa

SEQ ID NO: 242519 - DNA, 25 bp, Homo sapien
tatggacgaagcgtgggaccccagc

SEQ ID NO: 242520 - DNA, 25 bp, Homo sapien
tgccctcaggaagaccagtgttgcc

SEQ ID NO: 242521 - DNA, 25 bp, Homo sapien
caggaagaccagtgttgcccgagga

SEQ ID NO: 242522 - DNA, 25 bp, Homo sapien
gggcgtgcggacactgctgagtgga

SEQ ID NO: 242523 - DNA, 25 bp, Homo sapien
ttacttgcccacctgccagtgtctt

SEQ ID NO: 242524 - DNA, 25 bp, Homo sapien
gggcatttccttggcaaggacatta

SEQ ID NO: 242525 - DNA, 25 bp, Homo sapien
tggcaaggacattaaagtgatttca

SEQ ID NO: 242526 - DNA, 25 bp, Homo sapien
cactgtgatggtgttcttaagctca

SEQ ID NO: 242527 - DNA, 25 bp, Homo sapien
gatggtgttcttaagctcatagagt

SEQ ID NO: 242528 - DNA, 25 bp, Homo sapien
aagctcatagagtggcaggttgtct

SEQ ID NO: 242529 - DNA, 25 bp, Homo sapien
aggttgtctgaaatgccaccatcca

SEQ ID NO: 242530 - DNA, 25 bp, Homo sapien
atgaaaccgctgcagacattggcct

SEQ ID NO: 242531 - DNA, 25 bp, Homo sapien
ggcctggatgagctcgtccttggag

SEQ ID NO: 242532 - DNA, 25 bp, Homo sapien
gatataatgacattctcgccgtctg

SEQ ID NO: 242533 - DNA, 25 bp, Homo sapien
attctcgccgtctgacacgcgggtc

SEQ ID NO: 242534 - DNA, 25 bp, Homo sapien
actggcatgctcatggctatcagca

SEQ ID NO: 242535 - DNA, 25 bp, Homo sapien
atggctatcagcaggcaggaccttc

SEQ ID NO: 242536 - DNA, 25 bp, Homo sapien
ctatcagcaggcaggaccttcagca

SEQ ID NO: 242537 - DNA, 25 bp, Homo sapien
aggaccgagggccacagccggacag

SEQ ID NO: 242538 - DNA, 25 bp, Homo sapien
tggattcaggcacacgaccaccaca

SEQ ID NO: 242539 - DNA, 25 bp, Homo sapien
gagcacgtgccacgcatgcctcgtg

SEQ ID NO: 242540 - DNA, 25 bp, Homo sapien
tgccacgcatgcctcgtgtgctcat

SEQ ID NO: 242541 - DNA, 25 bp, Homo sapien
acgcatgcctcgtgtgctcatctca

SEQ ID NO: 242542 - DNA, 25 bp, Homo sapien
atgcctcgtgtgctcatctcacaca

SEQ ID NO: 242543 - DNA, 25 bp, Homo sapien
acacatctcatgccgtacacctgag

SEQ ID NO: 242544 - DNA, 25 bp, Homo sapien
tacacctgaggctgctcacgtctca

SEQ ID NO: 242545 - DNA, 25 bp, Homo sapien
agtgttggtgcacatttgcctctca

SEQ ID NO: 242546 - DNA, 25 bp, Homo sapien
gttggtgcacatttgcctctcacat

SEQ ID NO: 242547 - DNA, 25 bp, Homo sapien
tggtgcacatttgcctctcacatgc

SEQ ID NO: 242548 - DNA, 25 bp, Homo sapien
gagtaattcgtatccaaattggagt

SEQ ID NO: 242549 - DNA, 25 bp, Homo sapien
aaattgcttgcacagttggtccgta

SEQ ID NO: 242550 - DNA, 25 bp, Homo sapien
ttgcacagttggtccgtacacaata

SEQ ID NO: 242551 - DNA, 25 bp, Homo sapien
gtccgtacacaataaacaggctctg

SEQ ID NO: 242552 - DNA, 25 bp, Homo sapien
tctgtatttttagctgacgttgtta

SEQ ID NO: 242553 - DNA, 25 bp, Homo sapien
gctgacgttgttatttgatgatgat

SEQ ID NO: 242554 - DNA, 25 bp, Homo sapien
tgatgtactccattttcactacggc

SEQ ID NO: 242555 - DNA, 25 bp, Homo sapien
tttcactacggcctgaagagactag

SEQ ID NO: 242556 - DNA, 25 bp, Homo sapien
aagagactagtaatcctccttgtag

SEQ ID NO: 242557 - DNA, 25 bp, Homo sapien
tagtaatcctccttgtagtagatgt

SEQ ID NO: 242558 - DNA, 25 bp, Homo sapien
aaatgtctgagcactttaaggaaca

SEQ ID NO: 242559 - DNA, 25 bp, Homo sapien
aggatgcctggattccttgttatct

SEQ ID NO: 242560 - DNA, 25 bp, Homo sapien
ttccttgttatctcaggactctaaa

SEQ ID NO: 242561 - DNA, 25 bp, Homo sapien
cttgcaacttgctattcgtggagat

SEQ ID NO: 242562 - DNA, 25 bp, Homo sapien
ggactctaaatactctaacagctgt

SEQ ID NO: 242563 - DNA, 25 bp, Homo sapien
taaatactctaacagctgtccagtg

SEQ ID NO: 242564 - DNA, 25 bp, Homo sapien
aatactctaacagctgtccagtgtt

SEQ ID NO: 242565 - DNA, 25 bp, Homo sapien
gcaacttgctattcgtggagatgaa

SEQ ID NO: 242566 - DNA, 25 bp, Homo sapien
acttgctattcgtggagatgaagaa

SEQ ID NO: 242567 - DNA, 25 bp, Homo sapien
tgcctttttgtaattctatttgagc

SEQ ID NO: 242568 - DNA, 25 bp, Homo sapien
gtaattctatttgagcaagttggaa

SEQ ID NO: 242569 - DNA, 25 bp, Homo sapien
tgtcattccacacatccacaaatct

SEQ ID NO: 242570 - DNA, 25 bp, Homo sapien
agcgcttccgcagcctgcagcagag

SEQ ID NO: 242571 - DNA, 25 bp, Homo sapien
ttcctgctgactgcgctgtacctgg

SEQ ID NO: 242572 - DNA, 25 bp, Homo sapien
tgctgactgcgctgtacctggagag

SEQ ID NO: 242573 - DNA, 25 bp, Homo sapien
ctgactgcgctgtacctggagagag

SEQ ID NO: 242574 - DNA, 25 bp, Homo sapien
ctgcgctgtacctggagagagacga

SEQ ID NO: 242575 - DNA, 25 bp, Homo sapien
tgtacctggagagagacgagacccg

SEQ ID NO: 242576 - DNA, 25 bp, Homo sapien
agagagacgagacccgggcctggca

SEQ ID NO: 242577 - DNA, 25 bp, Homo sapien
ctggcagcctgtcacagggacccca

SEQ ID NO: 242578 - DNA, 25 bp, Homo sapien
tggcgcctctacagaggagccctga

SEQ ID NO: 242579 - DNA, 25 bp, Homo sapien
gcctctacagaggagccctgaggtc

SEQ ID NO: 242580 - DNA, 25 bp, Homo sapien
tacagaggagccctgaggtccctgc

SEQ ID NO: 242581 - DNA, 25 bp, Homo sapien
agagaggctgtgggaatcttcagaa

SEQ ID NO: 242582 - DNA, 25 bp, Homo sapien
agacagacatgagagacaagcatct

SEQ ID NO: 242583 - DNA, 25 bp, Homo sapien
ttttatttccttcttgtgctgctct

SEQ ID NO: 242584 - DNA, 25 bp, Homo sapien
gtatgagagcctcaggaaaccccat

SEQ ID NO: 242585 - DNA, 25 bp, Homo sapien
ggaaaccccatcaaggaccgagtat

SEQ ID NO: 242586 - DNA, 25 bp, Homo sapien
ggaccgagtatgtgtctggttcctt

SEQ ID NO: 242587 - DNA, 25 bp, Homo sapien
cgagtatgtgtctggttccttgggt

SEQ ID NO: 242588 - DNA, 25 bp, Homo sapien
ttccttgggtgggacgattcctgac

SEQ ID NO: 242589 - DNA, 25 bp, Homo sapien
tgggacgattcctgaccacactgtc

SEQ ID NO: 242590 - DNA, 25 bp, Homo sapien
tgtccagctcttgctctcattaaat

SEQ ID NO: 242591 - DNA, 25 bp, Homo sapien
tccagctcttgctctcattaaatgc

SEQ ID NO: 242592 - DNA, 25 bp, Homo sapien
aaggactctgccacctttcgtagat

SEQ ID NO: 242593 - DNA, 25 bp, Homo sapien
acctttcgtagatggagagtgcaaa

SEQ ID NO: 242594 - DNA, 25 bp, Homo sapien
agtttgtaccatggaactccttctc

SEQ ID NO: 242595 - DNA, 25 bp, Homo sapien
ctcaccacgatgttgaaatcacctg

SEQ ID NO: 242596 - DNA, 25 bp, Homo sapien
ggaactccttctctaacagttactc

SEQ ID NO: 242597 - DNA, 25 bp, Homo sapien
ctaacagttactctgtggcagtgcc

SEQ ID NO: 242598 - DNA, 25 bp, Homo sapien
tgtggcagtgcctatttcaaacctc

SEQ ID NO: 242599 - DNA, 25 bp, Homo sapien
ctcccttaacttctgattgtataga

SEQ ID NO: 242600 - DNA, 25 bp, Homo sapien
gtttcatttgttcatctgtttgttc

SEQ ID NO: 242601 - DNA, 25 bp, Homo sapien
gtttgttcacttagtcagagatgtt

SEQ ID NO: 242602 - DNA, 25 bp, Homo sapien
ccagtcctgtcctttgacaagaagg

SEQ ID NO: 242603 - DNA, 25 bp, Homo sapien
ttcccggtgacccagatgaccacat

SEQ ID NO: 242604 - DNA, 25 bp, Homo sapien
cggtgacccagatgaccacatttaa

SEQ ID NO: 242605 - DNA, 25 bp, Homo sapien
gggagcccaggttgtgctcactgct

SEQ ID NO: 242606 - DNA, 25 bp, Homo sapien
aggttgtgctcactgctctcccgta

SEQ ID NO: 242607 - DNA, 25 bp, Homo sapien
gctcactgctctcccgtatcgtgag

SEQ ID NO: 242608 - DNA, 25 bp, Homo sapien
gtatcgtgagcaccacctctgcttt

SEQ ID NO: 242609 - DNA, 25 bp, Homo sapien
tctgctttccctgcgtagatctagg

SEQ ID NO: 242610 - DNA, 25 bp, Homo sapien
cttgtttttgtggagccgtgtgtgt

SEQ ID NO: 242611 - DNA, 25 bp, Homo sapien
cgtgtgtgttcttctctgagcagct

SEQ ID NO: 242612 - DNA, 25 bp, Homo sapien
ggaccccagcgcagtcccgggagat

SEQ ID NO: 242613 - DNA, 25 bp, Homo sapien
gcgcagtcccgggagatggcggaaa

SEQ ID NO: 242614 - DNA, 25 bp, Homo sapien
acttctcatcttaaacacagatggc

SEQ ID NO: 242615 - DNA, 25 bp, Homo sapien
tcttaaacacagatggcagctcctt

SEQ ID NO: 242616 - DNA, 25 bp, Homo sapien
ggattgtccagccaaattctctgca

SEQ ID NO: 242617 - DNA, 25 bp, Homo sapien
gattgtccagccaaattctctgcag

SEQ ID NO: 242618 - DNA, 25 bp, Homo sapien
ttgtccagccaaattctctgcagac

SEQ ID NO: 242619 - DNA, 25 bp, Homo sapien
aagcttcacccgtcctcttcaggga

SEQ ID NO: 242620 - DNA, 25 bp, Homo sapien
ttcacccgtcctcttcagggaggtg

SEQ ID NO: 242621 - DNA, 25 bp, Homo sapien
acccgtcctcttcagggaggtgatg

SEQ ID NO: 242622 - DNA, 25 bp, Homo sapien
tgatgcaagggcatctgatttcttt

SEQ ID NO: 242623 - DNA, 25 bp, Homo sapien
agagtgggaaccagactctcttttc

SEQ ID NO: 242624 - DNA, 25 bp, Homo sapien
gtgggaaccagactctcttttccaa

SEQ ID NO: 242625 - DNA, 25 bp, Homo sapien
gtggtcctcgctgtggatcggctac

SEQ ID NO: 242626 - DNA, 25 bp, Homo sapien
gatcggctactcttttgtgatgcac

SEQ ID NO: 242627 - DNA, 25 bp, Homo sapien
ttttgtgatgcacaccagcgctggt

SEQ ID NO: 242628 - DNA, 25 bp, Homo sapien
accagcgctggtgcagaaggctctg

SEQ ID NO: 242629 - DNA, 25 bp, Homo sapien
agaagtgcgccattcatcgagtgtc

SEQ ID NO: 242630 - DNA, 25 bp, Homo sapien
attcatcgagtgtcacggccgtggg

SEQ ID NO: 242631 - DNA, 25 bp, Homo sapien
gtgggacctgcaattactacgcaaa

SEQ ID NO: 242632 - DNA, 25 bp, Homo sapien
gcaaacgcttacagcttttggctcg

SEQ ID NO: 242633 - DNA, 25 bp, Homo sapien
ttttggctcgccaccatagagagga

SEQ ID NO: 242634 - DNA, 25 bp, Homo sapien
agatgttcaagaagcctacgccgtc

SEQ ID NO: 242635 - DNA, 25 bp, Homo sapien
tacgccgtccaccttgaaggcaggg

SEQ ID NO: 242636 - DNA, 25 bp, Homo sapien
cgggaaggccctctttggaagcaca

SEQ ID NO: 242637 - DNA, 25 bp, Homo sapien
cacaacaatcatgaccaggagcaat

SEQ ID NO: 242638 - DNA, 25 bp, Homo sapien
gagcaatggtctccaatgtatcaga

SEQ ID NO: 242639 - DNA, 25 bp, Homo sapien
gtatcagaactgaccttccgagtac

SEQ ID NO: 242640 - DNA, 25 bp, Homo sapien
gaccttccgagtacttgtacagtga

SEQ ID NO: 242641 - DNA, 25 bp, Homo sapien
tacagtgacggagggtggaacccaa

SEQ ID NO: 242642 - DNA, 25 bp, Homo sapien
actacatcatcttcagctttgtcct

SEQ ID NO: 242643 - DNA, 25 bp, Homo sapien
cagctttgtcctcttcagcaagcag

SEQ ID NO: 242644 - DNA, 25 bp, Homo sapien
gtaacaacacaatcaccatataagg

SEQ ID NO: 242645 - DNA, 25 bp, Homo sapien
agggagcttgctgtggattaagttt

SEQ ID NO: 242646 - DNA, 25 bp, Homo sapien
agtttcatgacccaggacacgtgcg

SEQ ID NO: 242647 - DNA, 25 bp, Homo sapien
tcactgctctgaaaagacacaacca

SEQ ID NO: 242648 - DNA, 25 bp, Homo sapien
aaagacacaaccagaatggcctggg

SEQ ID NO: 242649 - DNA, 25 bp, Homo sapien
tgggaatgcgttgggactgcccagc

SEQ ID NO: 242650 - DNA, 25 bp, Homo sapien
tgcccagctgagctatcaggtgccc

SEQ ID NO: 242651 - DNA, 25 bp, Homo sapien
agctgagctatcaggtgcccatctt

SEQ ID NO: 242652 - DNA, 25 bp, Homo sapien
ccatcttttctggtcccagcagtgg

SEQ ID NO: 242653 - DNA, 25 bp, Homo sapien
ggtgacatccccagtggtttgtcgc

SEQ ID NO: 242654 - DNA, 25 bp, Homo sapien
atccccagtggtttgtcgccaagac

SEQ ID NO: 242655 - DNA, 25 bp, Homo sapien
ggtttgtcgccaagaccatgtggtg

SEQ ID NO: 242656 - DNA, 25 bp, Homo sapien
ttgtcgccaagaccatgtggtggac

SEQ ID NO: 242657 - DNA, 25 bp, Homo sapien
ccaaactgatgagtccgggagaata

SEQ ID NO: 242658 - DNA, 25 bp, Homo sapien
gaaatcacaattttcctgtggaata

SEQ ID NO: 242659 - DNA, 25 bp, Homo sapien
gatggtccaaaaatagtcaaaaatt

SEQ ID NO: 242660 - DNA, 25 bp, Homo sapien
atagatgtcagcaattaggcagatc

SEQ ID NO: 242661 - DNA, 25 bp, Homo sapien
cagcaattaggcagatcaaggttta

SEQ ID NO: 242662 - DNA, 25 bp, Homo sapien
tcaaggtttagtttaacttccactg

SEQ ID NO: 242663 - DNA, 25 bp, Homo sapien
gaaagactgtgctgtcctttaacat

SEQ ID NO: 242664 - DNA, 25 bp, Homo sapien
gaaacatccgttttcattgttcact

SEQ ID NO: 242665 - DNA, 25 bp, Homo sapien
atccgttttcattgttcacttctaa

SEQ ID NO: 242666 - DNA, 25 bp, Homo sapien
caaaaattatgtgttgccaaaacca

SEQ ID NO: 242667 - DNA, 25 bp, Homo sapien
tgccaaaaccaaacccaggttcatg

SEQ ID NO: 242668 - DNA, 25 bp, Homo sapien
aaacccaggttcatgaatatggtgt

SEQ ID NO: 242669 - DNA, 25 bp, Homo sapien
tgctcttcatgtctctttcaaccat

SEQ ID NO: 242670 - DNA, 25 bp, Homo sapien
gtctctttcaaccatatgatcaatc

SEQ ID NO: 242671 - DNA, 25 bp, Homo sapien
tccctaacttgttgggagttgcgat

SEQ ID NO: 242672 - DNA, 25 bp, Homo sapien
atatctaatcttataggtgcttcta

SEQ ID NO: 242673 - DNA, 25 bp, Homo sapien
tttctttttcttaccatttatcatt

SEQ ID NO: 242674 - DNA, 25 bp, Homo sapien
tataacccagccaacatgtagaagt

SEQ ID NO: 242675 - DNA, 25 bp, Homo sapien
aattttcaactgttcaactgctaaa

SEQ ID NO: 242676 - DNA, 25 bp, Homo sapien
gttgcgattacaagtctatatcctg

SEQ ID NO: 242677 - DNA, 25 bp, Homo sapien
gcacattcagctatccatttgtgta

SEQ ID NO: 242678 - DNA, 25 bp, Homo sapien
atttgtgtacactcccaagtcctag

SEQ ID NO: 242679 - DNA, 25 bp, Homo sapien
cccaagtcctagcttttgctcttca

SEQ ID NO: 242680 - DNA, 25 bp, Homo sapien
cttaagtatattttggctagtctaa

SEQ ID NO: 242681 - DNA, 25 bp, Homo sapien
aatgtctagggtaaatatctcaaat

SEQ ID NO: 242682 - DNA, 25 bp, Homo sapien
agtagattagtgattctaggccaaa

SEQ ID NO: 242683 - DNA, 25 bp, Homo sapien
tttaatcttcaaaatggcagttctg

SEQ ID NO: 242684 - DNA, 25 bp, Homo sapien
agtcagaagctctaccaacacttgg

SEQ ID NO: 242685 - DNA, 25 bp, Homo sapien
gaagctctaccaacacttgggtaca

SEQ ID NO: 242686 - DNA, 25 bp, Homo sapien
aacacttgggtacaccttaccacat

SEQ ID NO: 242687 - DNA, 25 bp, Homo sapien
ggtacaccttaccacatgattaagt

SEQ ID NO: 242688 - DNA, 25 bp, Homo sapien
gcagttctgagagttgacactgcac

SEQ ID NO: 242689 - DNA, 25 bp, Homo sapien
tgcaccttcccctcaaggataagga

SEQ ID NO: 242690 - DNA, 25 bp, Homo sapien
ttcccctcaaggataaggactgtat

SEQ ID NO: 242691 - DNA, 25 bp, Homo sapien
gacactgtcactgcatgacctgtga

SEQ ID NO: 242692 - DNA, 25 bp, Homo sapien
atgacctgtgatgctgcagacacca

SEQ ID NO: 242693 - DNA, 25 bp, Homo sapien
agacaccaccatcctgtgtgcaggt

SEQ ID NO: 242694 - DNA, 25 bp, Homo sapien
gggcatgttccatgtcctgttgcac

SEQ ID NO: 242695 - DNA, 25 bp, Homo sapien
gtgacccatgtactcggttgtagga

SEQ ID NO: 242696 - DNA, 25 bp, Homo sapien
gagaactgagcacaattcactggat

SEQ ID NO: 242697 - DNA, 25 bp, Homo sapien
tgagcacaattcactggattctagt

SEQ ID NO: 242698 - DNA, 25 bp, Homo sapien
attctagtggaatctttctctaagc

SEQ ID NO: 242699 - DNA, 25 bp, Homo sapien
ttctctaagcaattttcccattcct

SEQ ID NO: 242700 - DNA, 25 bp, Homo sapien
cccggaaccacctgtggtgctagtg

SEQ ID NO: 242701 - DNA, 25 bp, Homo sapien
gcgtttaacgctggtgggcagcaat

SEQ ID NO: 242702 - DNA, 25 bp, Homo sapien
agtaccaacgccttggcttgataat

SEQ ID NO: 242703 - DNA, 25 bp, Homo sapien
agcatacagtatttggacgagtgac

SEQ ID NO: 242704 - DNA, 25 bp, Homo sapien
ggaagttgtacagaggatctccaac

SEQ ID NO: 242705 - DNA, 25 bp, Homo sapien
gaggatctccaacgtcaaagtcaat

SEQ ID NO: 242706 - DNA, 25 bp, Homo sapien
ctccaacgtcaaagtcaatcccaaa

SEQ ID NO: 242707 - DNA, 25 bp, Homo sapien
aatcccaaaacagataagccctatg

SEQ ID NO: 242708 - DNA, 25 bp, Homo sapien
aagccctatgaggatgtcagcatca

SEQ ID NO: 242709 - DNA, 25 bp, Homo sapien
gcatcataaatattactgtcaagta

SEQ ID NO: 242710 - DNA, 25 bp, Homo sapien
ttacattaggaagcttaggacttgc

SEQ ID NO: 242711 - DNA, 25 bp, Homo sapien
taggacttgctgaatatacagatca

SEQ ID NO: 242712 - DNA, 25 bp, Homo sapien
tacagatcatgtttcaaagatacag

SEQ ID NO: 242713 - DNA, 25 bp, Homo sapien
agcgggaggcggctgagcccctggt

SEQ ID NO: 242714 - DNA, 25 bp, Homo sapien
ttcctgtgggtgaggcaggcctgcc

SEQ ID NO: 242715 - DNA, 25 bp, Homo sapien
ctggaactttgggcctttgtccaag

SEQ ID NO: 242716 - DNA, 25 bp, Homo sapien
tttgtccaagccccggcgggaactg

SEQ ID NO: 242717 - DNA, 25 bp, Homo sapien
gggaactgcgacgagccagcccggg

SEQ ID NO: 242718 - DNA, 25 bp, Homo sapien
gatgattgatgtccggaaaaacccc

SEQ ID NO: 242719 - DNA, 25 bp, Homo sapien
tgccttggagggagactccgagcct

SEQ ID NO: 242720 - DNA, 25 bp, Homo sapien
agggagactccgagcctgctgaaag

SEQ ID NO: 242721 - DNA, 25 bp, Homo sapien
tctgtgaagggcagtccttaccgca

SEQ ID NO: 242722 - DNA, 25 bp, Homo sapien
gtgaagggcagtccttaccgcacac

SEQ ID NO: 242723 - DNA, 25 bp, Homo sapien
tgtaccctcactgggatcaacaaat

SEQ ID NO: 242724 - DNA, 25 bp, Homo sapien
tcttaaacacagatggcagctcctt

SEQ ID NO: 242725 - DNA, 25 bp, Homo sapien
agggaccctcactagaacaggtctc

SEQ ID NO: 242726 - DNA, 25 bp, Homo sapien
ggattgtccagccaaattctctgca

SEQ ID NO: 242727 - DNA, 25 bp, Homo sapien
ttgtccagccaaattctctgcagac

SEQ ID NO: 242728 - DNA, 25 bp, Homo sapien
gccaaattctctgcagacaccaaag

SEQ ID NO: 242729 - DNA, 25 bp, Homo sapien
acccgtcctcttcagggaggtgatg

SEQ ID NO: 242730 - DNA, 25 bp, Homo sapien
tgatgcaagggcatctgatttcttt

SEQ ID NO: 242731 - DNA, 25 bp, Homo sapien
actagaacaggtctccactatgcat

SEQ ID NO: 242732 - DNA, 25 bp, Homo sapien
agagtgggaaccagactctcttttc

SEQ ID NO: 242733 - DNA, 25 bp, Homo sapien
gtgggaaccagactctcttttccaa

SEQ ID NO: 242734 - DNA, 25 bp, Homo sapien
ttggcttctgctgatatccagccac

SEQ ID NO: 242735 - DNA, 25 bp, Homo sapien
tgattaaagcatccaaacagaagag

SEQ ID NO: 242736 - DNA, 25 bp, Homo sapien
gaggatgaggttaaccttggacttc

SEQ ID NO: 242737 - DNA, 25 bp, Homo sapien
taaccttggacttcatagcagagtt

SEQ ID NO: 242738 - DNA, 25 bp, Homo sapien
gacttcatagcagagttcaatgtca

SEQ ID NO: 242739 - DNA, 25 bp, Homo sapien
ggaaacaagtataataacccagtat

SEQ ID NO: 242740 - DNA, 25 bp, Homo sapien
aacccagtattagttcagccggcag

SEQ ID NO: 242741 - DNA, 25 bp, Homo sapien
agtattagttcagccggcagcttct

SEQ ID NO: 242742 - DNA, 25 bp, Homo sapien
agccggcagcttcttaccccagtat

SEQ ID NO: 242743 - DNA, 25 bp, Homo sapien
cagtatcccaggcagcaacagacac

SEQ ID NO: 242744 - DNA, 25 bp, Homo sapien
caggcagcaacagacaccagcagat

SEQ ID NO: 242745 - DNA, 25 bp, Homo sapien
acccctgcatctgtcttgggaagaa

SEQ ID NO: 242746 - DNA, 25 bp, Homo sapien
ccaaggatgcaaattggatgctatc

SEQ ID NO: 242747 - DNA, 25 bp, Homo sapien
ggatgctatcaaggtattctgtaat

SEQ ID NO: 242748 - DNA, 25 bp, Homo sapien
caaggtattctgtaatatggaaact

SEQ ID NO: 242749 - DNA, 25 bp, Homo sapien
ggaaacatgcataagtgccaatcct

SEQ ID NO: 242750 - DNA, 25 bp, Homo sapien
tgcataagtgccaatcctttgaatg

SEQ ID NO: 242751 - DNA, 25 bp, Homo sapien
gtttagctacggcaatcctgaactt

SEQ ID NO: 242752 - DNA, 25 bp, Homo sapien
tttagctacggcaatcctgaacttc

SEQ ID NO: 242753 - DNA, 25 bp, Homo sapien
cagctggcattccttcgacttctct

SEQ ID NO: 242754 - DNA, 25 bp, Homo sapien
agccgagcttcccagaacatcacat

SEQ ID NO: 242755 - DNA, 25 bp, Homo sapien
gagcttcccagaacatcacatatca

SEQ ID NO: 242756 - DNA, 25 bp, Homo sapien
gaacatcacatatcactgcaaaaat

SEQ ID NO: 242757 - DNA, 25 bp, Homo sapien
aatttctctgaggtgtctttggctc

SEQ ID NO: 242758 - DNA, 25 bp, Homo sapien
gtgtctttggctctgtgtcaccaaa

SEQ ID NO: 242759 - DNA, 25 bp, Homo sapien
tctgcatcccagtggttgctgaaag

SEQ ID NO: 242760 - DNA, 25 bp, Homo sapien
tatattgcgtagtcagatgtcagga

SEQ ID NO: 242761 - DNA, 25 bp, Homo sapien
gatcttaatgagaaaggccctggca

SEQ ID NO: 242762 - DNA, 25 bp, Homo sapien
ggacctagtggtcagcttataccca

SEQ ID NO: 242763 - DNA, 25 bp, Homo sapien
ggtcagcttatacccagactatctc

SEQ ID NO: 242764 - DNA, 25 bp, Homo sapien
tctccactcctccaagagtttgagt

SEQ ID NO: 242765 - DNA, 25 bp, Homo sapien
gagtttgagtcccatagctgatgaa

SEQ ID NO: 242766 - DNA, 25 bp, Homo sapien
gaaagaatttacatatgggctcccc

SEQ ID NO: 242767 - DNA, 25 bp, Homo sapien
aaatctattctcatattttgggaag

SEQ ID NO: 242768 - DNA, 25 bp, Homo sapien
agggcagaatgccagtgtgcttgcc

SEQ ID NO: 242769 - DNA, 25 bp, Homo sapien
agtgtgcttgcctatggacccacag

SEQ ID NO: 242770 - DNA, 25 bp, Homo sapien
gtgcttgcctatggacccacaggag

SEQ ID NO: 242771 - DNA, 25 bp, Homo sapien
gcctatggacccacaggagctggga

SEQ ID NO: 242772 - DNA, 25 bp, Homo sapien
gggaagacgcacacaatgctgggca

SEQ ID NO: 242773 - DNA, 25 bp, Homo sapien
agacgcacacaatgctgggcagccc

SEQ ID NO: 242774 - DNA, 25 bp, Homo sapien
ggtgatcccgcgggctctcatggac

SEQ ID NO: 242775 - DNA, 25 bp, Homo sapien
cgagggccggccatgggccctttct

SEQ ID NO: 242776 - DNA, 25 bp, Homo sapien
atgggccctttctgtcaccatgtct

SEQ ID NO: 242777 - DNA, 25 bp, Homo sapien
gtcaccatgtcttacctagagatct

SEQ ID NO: 242778 - DNA, 25 bp, Homo sapien
atgtcttacctagagatctaccagg

SEQ ID NO: 242779 - DNA, 25 bp, Homo sapien
gagcttctgtctgcatccagtagaa

SEQ ID NO: 242780 - DNA, 25 bp, Homo sapien
gaaaatgcatctgtaggcaccaggt

SEQ ID NO: 242781 - DNA, 25 bp, Homo sapien
taggcaccaggtttaagagcaaaat

SEQ ID NO: 242782 - DNA, 25 bp, Homo sapien
aatcctggagtcttgtctgttagca

SEQ ID NO: 242783 - DNA, 25 bp, Homo sapien
gaatatatttgctccagcacacccg

SEQ ID NO: 242784 - DNA, 25 bp, Homo sapien
agcacacccggatgtaggaaatgtc

SEQ ID NO: 242785 - DNA, 25 bp, Homo sapien
tgtaacttcacttaaatctgctctg

SEQ ID NO: 242786 - DNA, 25 bp, Homo sapien
cttaaatctgctctgagtctctgga

SEQ ID NO: 242787 - DNA, 25 bp, Homo sapien
tctgagtctctggatgcctggcagg

SEQ ID NO: 242788 - DNA, 25 bp, Homo sapien
gcctggcaggtggagaattcaatct

SEQ ID NO: 242789 - DNA, 25 bp, Homo sapien
gaattctgggcttacacactgttgg

SEQ ID NO: 242790 - DNA, 25 bp, Homo sapien
aattgacataatgagcatacctaac

SEQ ID NO: 242791 - DNA, 25 bp, Homo sapien
attgctagcttttactgctacattg

SEQ ID NO: 242792 - DNA, 25 bp, Homo sapien
gagcatacctaacaaatttattcta

SEQ ID NO: 242793 - DNA, 25 bp, Homo sapien
attctagttaatacattctacttat

SEQ ID NO: 242794 - DNA, 25 bp, Homo sapien
gctagcttttactgctacattgaaa

SEQ ID NO: 242795 - DNA, 25 bp, Homo sapien
gatccttaaatatctaatttgcaat

SEQ ID NO: 242796 - DNA, 25 bp, Homo sapien
attactttttagtgttagtctagca

SEQ ID NO: 242797 - DNA, 25 bp, Homo sapien
gtgttagtctagcaggtgtatcaat

SEQ ID NO: 242798 - DNA, 25 bp, Homo sapien
gtctagcaggtgtatcaatgaaaac

SEQ ID NO: 242799 - DNA, 25 bp, Homo sapien
acattgaaataataggtcttggcat

SEQ ID NO: 242800 - DNA, 25 bp, Homo sapien
ataggtcttggcatttgaaatttga

SEQ ID NO: 242801 - DNA, 25 bp, Homo sapien
tcctctggagcatcccctctggagc

SEQ ID NO: 242802 - DNA, 25 bp, Homo sapien
tctgccctgttgtgccgggcgttct

SEQ ID NO: 242803 - DNA, 25 bp, Homo sapien
aggcctcgtggctgtggtcctggac

SEQ ID NO: 242804 - DNA, 25 bp, Homo sapien
cacactggtgggttcctttgtttcg

SEQ ID NO: 242805 - DNA, 25 bp, Homo sapien
tttcgggggttggatcctctagctc

SEQ ID NO: 242806 - DNA, 25 bp, Homo sapien
tctgctgccgtcagagtctgccttt

SEQ ID NO: 242807 - DNA, 25 bp, Homo sapien
ctgccgtcagagtctgcctttgtgt

SEQ ID NO: 242808 - DNA, 25 bp, Homo sapien
gtcagagtctgcctttgtgtcttta

SEQ ID NO: 242809 - DNA, 25 bp, Homo sapien
agagtctgcctttgtgtctttatct

SEQ ID NO: 242810 - DNA, 25 bp, Homo sapien
agtctgcctttgtgtctttatctgc

SEQ ID NO: 242811 - DNA, 25 bp, Homo sapien
cagggctgggagacgcctctccagc

SEQ ID NO: 242812 - DNA, 25 bp, Homo sapien
taacaatacactcccttcaaagact

SEQ ID NO: 242813 - DNA, 25 bp, Homo sapien
acactcccttcaaagacttgcacag

SEQ ID NO: 242814 - DNA, 25 bp, Homo sapien
acttgcacaggccaaattgttggaa

SEQ ID NO: 242815 - DNA, 25 bp, Homo sapien
gccaaattgttggaatgctggtttt

SEQ ID NO: 242816 - DNA, 25 bp, Homo sapien
tggaatgctggttttcttgacaatt

SEQ ID NO: 242817 - DNA, 25 bp, Homo sapien
tgctggttttcttgacaattccaaa

SEQ ID NO: 242818 - DNA, 25 bp, Homo sapien
tgacaattccaaaccccaaaactat

SEQ ID NO: 242819 - DNA, 25 bp, Homo sapien
gcatagtcagatgtttgcttaaaac

SEQ ID NO: 242820 - DNA, 25 bp, Homo sapien
aacctagaaacttaacatgttgctt

SEQ ID NO: 242821 - DNA, 25 bp, Homo sapien
atgttgcttttcatgtgctgtgcca

SEQ ID NO: 242822 - DNA, 25 bp, Homo sapien
gttgcttttcatgtgctgtgccaag

SEQ ID NO: 242823 - DNA, 25 bp, Homo sapien
tggcgcatcctctggagagcacaac

SEQ ID NO: 242824 - DNA, 25 bp, Homo sapien
atcctctggagagcacaacgcatgg

SEQ ID NO: 242825 - DNA, 25 bp, Homo sapien
gcacaacgcatggaaaggtctggaa

SEQ ID NO: 242826 - DNA, 25 bp, Homo sapien
aggtctggaagctctgtgtagccat

SEQ ID NO: 242827 - DNA, 25 bp, Homo sapien
ggaagctctgtgtagccattccttc

SEQ ID NO: 242828 - DNA, 25 bp, Homo sapien
gtgtagccattccttctgcagtcat

SEQ ID NO: 242829 - DNA, 25 bp, Homo sapien
taaccttggctatgttaccaccgtt

SEQ ID NO: 242830 - DNA, 25 bp, Homo sapien
ggctatgttaccaccgttttggtca

SEQ ID NO: 242831 - DNA, 25 bp, Homo sapien
gttttggtcacccaggaggacatct

SEQ ID NO: 242832 - DNA, 25 bp, Homo sapien
tggtcacccaggaggacatcttagc

SEQ ID NO: 242833 - DNA, 25 bp, Homo sapien
gacatcttagcaagggtgcctgcga

SEQ ID NO: 242834 - DNA, 25 bp, Homo sapien
gggccagattaacttctctacccaa

SEQ ID NO: 242835 - DNA, 25 bp, Homo sapien
ctctacccaagagacaggtttttat

SEQ ID NO: 242836 - DNA, 25 bp, Homo sapien
caggtttttatcagctttgtctaag

SEQ ID NO: 242837 - DNA, 25 bp, Homo sapien
gtaatcagcataatcacttcggttc

SEQ ID NO: 242838 - DNA, 25 bp, Homo sapien
gcataatcacttcggttctgtgcaa

SEQ ID NO: 242839 - DNA, 25 bp, Homo sapien
ggttctgtgcaagtgtacctcaact

SEQ ID NO: 242840 - DNA, 25 bp, Homo sapien
caactgaatgatactctggatgcaa

SEQ ID NO: 242841 - DNA, 25 bp, Homo sapien
gatgcaattgaggacggcacacaaa

SEQ ID NO: 242842 - DNA, 25 bp, Homo sapien
gaacaatatctttcacatgtggcga

SEQ ID NO: 242843 - DNA, 25 bp, Homo sapien
ttcacatgtggcgatactacaactt

SEQ ID NO: 242844 - DNA, 25 bp, Homo sapien
gatactacaactttgcccggatgag

SEQ ID NO: 242845 - DNA, 25 bp, Homo sapien
gggccctggcgcaaacatttaatcc

SEQ ID NO: 242846 - DNA, 25 bp, Homo sapien
aacatttaatcctgggctgtgcggg

SEQ ID NO: 242847 - DNA, 25 bp, Homo sapien
ttgcttttccttccgggctctacag

SEQ ID NO: 242848 - DNA, 25 bp, Homo sapien
cgggctctacagtggcatcaatgtg

SEQ ID NO: 242849 - DNA, 25 bp, Homo sapien
tcccgactgggattgttggcctgca

SEQ ID NO: 242850 - DNA, 25 bp, Homo sapien
ggattgttggcctgcagacatccca

SEQ ID NO: 242851 - DNA, 25 bp, Homo sapien
agacatcccacgcataagagcctag

SEQ ID NO: 242852 - DNA, 25 bp, Homo sapien
gcataagagcctaggccagaccgcc

SEQ ID NO: 242853 - DNA, 25 bp, Homo sapien
gcccgctccgttgaagtcttgtgat

SEQ ID NO: 242854 - DNA, 25 bp, Homo sapien
tgattggacaagacacagtgtggag

SEQ ID NO: 242855 - DNA, 25 bp, Homo sapien
gtgtggagaaagacccctaagccta

SEQ ID NO: 242856 - DNA, 25 bp, Homo sapien
atgactatcctatacataagttata

SEQ ID NO: 242857 - DNA, 25 bp, Homo sapien
aaatttcttggatattttgaatgag

SEQ ID NO: 242858 - DNA, 25 bp, Homo sapien
accggtacaagttagaaagtgtgct

SEQ ID NO: 242859 - DNA, 25 bp, Homo sapien
gctaaggactgaatacttgcctcgt

SEQ ID NO: 242860 - DNA, 25 bp, Homo sapien
aggactgaatacttgcctcgtgctt

SEQ ID NO: 242861 - DNA, 25 bp, Homo sapien
tgaatacttgcctcgtgctttttgc

SEQ ID NO: 242862 - DNA, 25 bp, Homo sapien
aatacttgcctcgtgctttttgcca

SEQ ID NO: 242863 - DNA, 25 bp, Homo sapien
ctcgtgctttttgccactggatgat

SEQ ID NO: 242864 - DNA, 25 bp, Homo sapien
gtgctttttgccactggatgatgta

SEQ ID NO: 242865 - DNA, 25 bp, Homo sapien
tttgccactggatgatgtaagttaa

SEQ ID NO: 242866 - DNA, 25 bp, Homo sapien
gaattgttaatcctaagtatatatt

SEQ ID NO: 242867 - DNA, 25 bp, Homo sapien
gaaatgtaacttagccctcggcttc

SEQ ID NO: 242868 - DNA, 25 bp, Homo sapien
ggcttctccttacctttcaggagtt

SEQ ID NO: 242869 - DNA, 25 bp, Homo sapien
tacctttcaggagttctctccttac

SEQ ID NO: 242870 - DNA, 25 bp, Homo sapien
tgcagtcccctggttcagattggtg

SEQ ID NO: 242871 - DNA, 25 bp, Homo sapien
cccctggttcagattggtggtgtct

SEQ ID NO: 242872 - DNA, 25 bp, Homo sapien
attggtggtgtctgtgcctgaaccc

SEQ ID NO: 242873 - DNA, 25 bp, Homo sapien
cacgagcctgaaagcccctcaaagg

SEQ ID NO: 242874 - DNA, 25 bp, Homo sapien
ctgaaagcccctcaaaggccacatg

SEQ ID NO: 242875 - DNA, 25 bp, Homo sapien
ctgcatctccagatggtggcacgag

SEQ ID NO: 242876 - DNA, 25 bp, Homo sapien
atggtggcacgaggcctagcacaca

SEQ ID NO: 242877 - DNA, 25 bp, Homo sapien
ggcctagcacacaaggaatcccaga

SEQ ID NO: 242878 - DNA, 25 bp, Homo sapien
taataccatttctttctggagagag

SEQ ID NO: 242879 - DNA, 25 bp, Homo sapien
gagagaaagctggttcgactgctaa

SEQ ID NO: 242880 - DNA, 25 bp, Homo sapien
agctggttcgactgctaagaataaa

SEQ ID NO: 242881 - DNA, 25 bp, Homo sapien
gatgaggtcaaagcaatgtcttaca

SEQ ID NO: 242882 - DNA, 25 bp, Homo sapien
atgtcttacagctgctctgaaagct

SEQ ID NO: 242883 - DNA, 25 bp, Homo sapien
tgctctgaaagctggccaggaacta

SEQ ID NO: 242884 - DNA, 25 bp, Homo sapien
caggaactaacatggccctcatggg

SEQ ID NO: 242885 - DNA, 25 bp, Homo sapien
agacacaacttccttccggccaaag

SEQ ID NO: 242886 - DNA, 25 bp, Homo sapien
cttccggccaaagcaattcctgaag

SEQ ID NO: 242887 - DNA, 25 bp, Homo sapien
gattaccatttcgatgtagctttct

SEQ ID NO: 242888 - DNA, 25 bp, Homo sapien
tagctttcttcgtcttctctggaaa

SEQ ID NO: 242889 - DNA, 25 bp, Homo sapien
aattcaatctggaatcagaaagcgg

SEQ ID NO: 242890 - DNA, 25 bp, Homo sapien
ttcaatctggaatcagaaagcggtg

SEQ ID NO: 242891 - DNA, 25 bp, Homo sapien
tctggaatcagaaagcggtggattc

SEQ ID NO: 242892 - DNA, 25 bp, Homo sapien
aatcagaaagcggtggattctggca

SEQ ID NO: 242893 - DNA, 25 bp, Homo sapien
atcagaaagcggtggattctggcaa

SEQ ID NO: 242894 - DNA, 25 bp, Homo sapien
cagaaagcggtggattctggcaaat

SEQ ID NO: 242895 - DNA, 25 bp, Homo sapien
agaaagcggtggattctggcaaatg

SEQ ID NO: 242896 - DNA, 25 bp, Homo sapien
aaagcggtggattctggcaaatggt

SEQ ID NO: 242897 - DNA, 25 bp, Homo sapien
gcggtggattctggcaaatggtcct

SEQ ID NO: 242898 - DNA, 25 bp, Homo sapien
ctccccactcatccctggtctggtc

SEQ ID NO: 242899 - DNA, 25 bp, Homo sapien
tcctcaggcatctgggagggccctg

SEQ ID NO: 242900 - DNA, 25 bp, Homo sapien
tgtgcctgcctgacaaaggaagaga

SEQ ID NO: 242901 - DNA, 25 bp, Homo sapien
gagaatctccgaatgtgtatctttg

SEQ ID NO: 242902 - DNA, 25 bp, Homo sapien
ctccgaatgtgtatctttgggccca

SEQ ID NO: 242903 - DNA, 25 bp, Homo sapien
gggtcaccaggctacatggcgacat

SEQ ID NO: 242904 - DNA, 25 bp, Homo sapien
acatggcgacatctaggcagctccg

SEQ ID NO: 242905 - DNA, 25 bp, Homo sapien
agcctccttgccataatcctaatat

SEQ ID NO: 242906 - DNA, 25 bp, Homo sapien
aatatattggtgtcctctgctcaga

SEQ ID NO: 242907 - DNA, 25 bp, Homo sapien
tgtcatcatggtgggaacaggctgt

SEQ ID NO: 242908 - DNA, 25 bp, Homo sapien
agggcctcatctgtacactgtgaaa

SEQ ID NO: 242909 - DNA, 25 bp, Homo sapien
cactgtgaaattaactggcatcctg

SEQ ID NO: 242910 - DNA, 25 bp, Homo sapien
aactggcatcctggtgggcccaagg

SEQ ID NO: 242911 - DNA, 25 bp, Homo sapien
cagtgatactgcctgtcccaggatt

SEQ ID NO: 242912 - DNA, 25 bp, Homo sapien
gatactgcctgtcccaggattacaa

SEQ ID NO: 242913 - DNA, 25 bp, Homo sapien
gtagcataagacatgaaggccacca

SEQ ID NO: 242914 - DNA, 25 bp, Homo sapien
gcataagacatgaaggccaccagaa

SEQ ID NO: 242915 - DNA, 25 bp, Homo sapien
gaaggccaccagaagtgctactatg

SEQ ID NO: 242916 - DNA, 25 bp, Homo sapien
ggccaccagaagtgctactatgatt

SEQ ID NO: 242917 - DNA, 25 bp, Homo sapien
tactatgatttaagattggccgggc

SEQ ID NO: 242918 - DNA, 25 bp, Homo sapien
tatgatttaagattggccgggcagt

SEQ ID NO: 242919 - DNA, 25 bp, Homo sapien
tcaaatgttttattgctggcttgtc

SEQ ID NO: 242920 - DNA, 25 bp, Homo sapien
tgttttattgctggcttgtcttttc

SEQ ID NO: 242921 - DNA, 25 bp, Homo sapien
ttattgctggcttgtcttttctaag

SEQ ID NO: 242922 - DNA, 25 bp, Homo sapien
aattttcttaattcccatcaataat

SEQ ID NO: 242923 - DNA, 25 bp, Homo sapien
cttaattcccatcaataatatagtg

SEQ ID NO: 242924 - DNA, 25 bp, Homo sapien
tattcatcacttttgattctagttt

SEQ ID NO: 242925 - DNA, 25 bp, Homo sapien
aggtaattcagagtagatttcagtc

SEQ ID NO: 242926 - DNA, 25 bp, Homo sapien
gagctaactactaaataatcattga

SEQ ID NO: 242927 - DNA, 25 bp, Homo sapien
atcattgaaaatgtagggcttcctc

SEQ ID NO: 242928 - DNA, 25 bp, Homo sapien
aaatgtagggcttcctcagaaatgt

SEQ ID NO: 242929 - DNA, 25 bp, Homo sapien
agggcttcctcagaaatgtgagtaa

SEQ ID NO: 242930 - DNA, 25 bp, Homo sapien
aatgtgagtaaggatattggaggca

SEQ ID NO: 242931 - DNA, 25 bp, Homo sapien
gatttcagtctgttttcaggtctac

SEQ ID NO: 242932 - DNA, 25 bp, Homo sapien
agtctgttttcaggtctactggaaa

SEQ ID NO: 242933 - DNA, 25 bp, Homo sapien
cagggccctcccagatgcctgagga

SEQ ID NO: 242934 - DNA, 25 bp, Homo sapien
agggccctcccagatgcctgaggag

SEQ ID NO: 242935 - DNA, 25 bp, Homo sapien
gggccctcccagatgcctgaggagg

SEQ ID NO: 242936 - DNA, 25 bp, Homo sapien
ggccctcccagatgcctgaggaggg

SEQ ID NO: 242937 - DNA, 25 bp, Homo sapien
tttggggagagacacaggcaggcga

SEQ ID NO: 242938 - DNA, 25 bp, Homo sapien
ttggggagagacacaggcaggcgag

SEQ ID NO: 242939 - DNA, 25 bp, Homo sapien
gggtggtgctcagggtaaagggcta

SEQ ID NO: 242940 - DNA, 25 bp, Homo sapien
ggtggtgctcagggtaaagggctat

SEQ ID NO: 242941 - DNA, 25 bp, Homo sapien
gcacaaggaccatttgccagaatcc

SEQ ID NO: 242942 - DNA, 25 bp, Homo sapien
agagagcccgcagggaagggtaaag

SEQ ID NO: 242943 - DNA, 25 bp, Homo sapien
gagagcccgcagggaagggtaaagc

SEQ ID NO: 242944 - DNA, 25 bp, Homo sapien
aaactcagccagtctcattctatat

SEQ ID NO: 242945 - DNA, 25 bp, Homo sapien
gtctcattctatatcccaaacgtac

SEQ ID NO: 242946 - DNA, 25 bp, Homo sapien
atgaaactgattttggttccacaag

SEQ ID NO: 242947 - DNA, 25 bp, Homo sapien
gttccacaagcagtgtttgggtgtt

SEQ ID NO: 242948 - DNA, 25 bp, Homo sapien
agtgtttgggtgttgccttcctgaa

SEQ ID NO: 242949 - DNA, 25 bp, Homo sapien
gtgaccaagcttccaaagctcgtcc

SEQ ID NO: 242950 - DNA, 25 bp, Homo sapien
tgtacatttccctgtggttctccgt

SEQ ID NO: 242951 - DNA, 25 bp, Homo sapien
tgggactgaagctttcccgctgttt

SEQ ID NO: 242952 - DNA, 25 bp, Homo sapien
tgtttccctgcctgcaaaagcagcc

SEQ ID NO: 242953 - DNA, 25 bp, Homo sapien
gcattggcttccctcagcaatctgt

SEQ ID NO: 242954 - DNA, 25 bp, Homo sapien
ggcaagagacttcctttgatttcta

SEQ ID NO: 242955 - DNA, 25 bp, Homo sapien
ccggaagagcacagggacacagcca

SEQ ID NO: 242956 - DNA, 25 bp, Homo sapien
agggacacagccagagcccacggag

SEQ ID NO: 242957 - DNA, 25 bp, Homo sapien
acggagggcccttcccgcaaagcag

SEQ ID NO: 242958 - DNA, 25 bp, Homo sapien
ttcccgcaaagcagaagccgccagg

SEQ ID NO: 242959 - DNA, 25 bp, Homo sapien
gctgcctgtggtgaaacccatgggc

SEQ ID NO: 242960 - DNA, 25 bp, Homo sapien
ggctagtgggcttcatgggcaccat

SEQ ID NO: 242961 - DNA, 25 bp, Homo sapien
tggagctcctgagccgtgacagttt

SEQ ID NO: 242962 - DNA, 25 bp, Homo sapien
agctcctgagccgtgacagttttca

SEQ ID NO: 242963 - DNA, 25 bp, Homo sapien
tcctgagccgtgacagttttcaggg

SEQ ID NO: 242964 - DNA, 25 bp, Homo sapien
tcaatcctcagcatgtaccaggcgg

SEQ ID NO: 242965 - DNA, 25 bp, Homo sapien
tcagcatgtaccaggcggcccgggc

SEQ ID NO: 242966 - DNA, 25 bp, Homo sapien
gcacctcagttcctcttacaaaagc

SEQ ID NO: 242967 - DNA, 25 bp, Homo sapien
ttcctcttacaaaagcctccagatg

SEQ ID NO: 242968 - DNA, 25 bp, Homo sapien
cctccagatgatctaaatctagtta

SEQ ID NO: 242969 - DNA, 25 bp, Homo sapien
aatctagttagcaatgtcagcctgt

SEQ ID NO: 242970 - DNA, 25 bp, Homo sapien
agcaatgtcagcctgtggactgcag

SEQ ID NO: 242971 - DNA, 25 bp, Homo sapien
gctgtttgggacattgtattccttt

SEQ ID NO: 242972 - DNA, 25 bp, Homo sapien
tattcctttgtttgtctcttgttgt

SEQ ID NO: 242973 - DNA, 25 bp, Homo sapien
tcctttgtttgtctcttgttgttct

SEQ ID NO: 242974 - DNA, 25 bp, Homo sapien
gtttgtctcttgttgttctgaagga

SEQ ID NO: 242975 - DNA, 25 bp, Homo sapien
gtctcttgttgttctgaaggattgt

SEQ ID NO: 242976 - DNA, 25 bp, Homo sapien
gtattgatcacaaagctatatgcat

SEQ ID NO: 242977 - DNA, 25 bp, Homo sapien
cacagtttaagaaagactggccatc

SEQ ID NO: 242978 - DNA, 25 bp, Homo sapien
ctaacactgcatctggtccatacta

SEQ ID NO: 242979 - DNA, 25 bp, Homo sapien
gcatctggtccatactactttaacc

SEQ ID NO: 242980 - DNA, 25 bp, Homo sapien
cctggaagtggcttcttaaaacagt

SEQ ID NO: 242981 - DNA, 25 bp, Homo sapien
aaacagtcttgtttgttcatcaggg

SEQ ID NO: 242982 - DNA, 25 bp, Homo sapien
tgtttgttcatcagggacccacgga

SEQ ID NO: 242983 - DNA, 25 bp, Homo sapien
atcagggacccacggacaatgtcag

SEQ ID NO: 242984 - DNA, 25 bp, Homo sapien
gacccacggacaatgtcagtgtgtt

SEQ ID NO: 242985 - DNA, 25 bp, Homo sapien
tgttcttcctccctgttttgccgtt

SEQ ID NO: 242986 - DNA, 25 bp, Homo sapien
atcagctgtttctcaatgcatcagt

SEQ ID NO: 242987 - DNA, 25 bp, Homo sapien
atgcatcagtcacttgttcgcagat

SEQ ID NO: 242988 - DNA, 25 bp, Homo sapien
gtgctgagaagaaacacgtttggtt

SEQ ID NO: 242989 - DNA, 25 bp, Homo sapien
gctgagaagaaacacgtttggtttg

SEQ ID NO: 242990 - DNA, 25 bp, Homo sapien
gaagaaacacgtttggtttggagag

SEQ ID NO: 242991 - DNA, 25 bp, Homo sapien
gagagtccatggatggtggttttca

SEQ ID NO: 242992 - DNA, 25 bp, Homo sapien
agagtccatggatggtggttttcag

SEQ ID NO: 242993 - DNA, 25 bp, Homo sapien
gagtccatggatggtggttttcagt

SEQ ID NO: 242994 - DNA, 25 bp, Homo sapien
agtccatggatggtggttttcagtt

SEQ ID NO: 242995 - DNA, 25 bp, Homo sapien
gtccatggatggtggttttcagttt

SEQ ID NO: 242996 - DNA, 25 bp, Homo sapien
gtccttgatgtgcagctggcattcc

SEQ ID NO: 242997 - DNA, 25 bp, Homo sapien
tccttgatgtgcagctggcattcct

SEQ ID NO: 242998 - DNA, 25 bp, Homo sapien
ccttgatgtgcagctggcattcctt

SEQ ID NO: 242999 - DNA, 25 bp, Homo sapien
gattgtgcacgttggatcatttatt

SEQ ID NO: 243000 - DNA, 25 bp, Homo sapien
attgagtttctctcgtacaccaagc

SEQ ID NO: 243001 - DNA, 25 bp, Homo sapien
acaccaagcactggttggatcccat

SEQ ID NO: 243002 - DNA, 25 bp, Homo sapien
ggatcccatgcttgttggtgacaga

SEQ ID NO: 243003 - DNA, 25 bp, Homo sapien
tggtgacagaactgctgtgatgcca

SEQ ID NO: 243004 - DNA, 25 bp, Homo sapien
aggaggagcaccatgaaccagccaa

SEQ ID NO: 243005 - DNA, 25 bp, Homo sapien
gaaccagccaactaacacgtgtcta

SEQ ID NO: 243006 - DNA, 25 bp, Homo sapien
acacgtgtctaatcacataaaggga

SEQ ID NO: 243007 - DNA, 25 bp, Homo sapien
gagccacagtcactttccgaaggtc

SEQ ID NO: 243008 - DNA, 25 bp, Homo sapien
tcactttccgaaggtcacacagcaa

SEQ ID NO: 243009 - DNA, 25 bp, Homo sapien
cagcaagtgcaaatgaggcctcatc

SEQ ID NO: 243010 - DNA, 25 bp, Homo sapien
tgagcccagccgacatttagttatt

SEQ ID NO: 243011 - DNA, 25 bp, Homo sapien
gcccagccgacatttagttattttg

SEQ ID NO: 243012 - DNA, 25 bp, Homo sapien
ttgtaatccgaaaaggtcaattcct

SEQ ID NO: 243013 - DNA, 25 bp, Homo sapien
gtcaattccttgagtgtttctgtct

SEQ ID NO: 243014 - DNA, 25 bp, Homo sapien
aattccttgagtgtttctgtcttga

SEQ ID NO: 243015 - DNA, 25 bp, Homo sapien
ccttgagtgtttctgtcttgaactt

SEQ ID NO: 243016 - DNA, 25 bp, Homo sapien
ttttttctgtaataggcctcccata

SEQ ID NO: 243017 - DNA, 25 bp, Homo sapien
tgtaataggcctcccatactcattg

SEQ ID NO: 243018 - DNA, 25 bp, Homo sapien
tcccatactcattgcccacagtttg

SEQ ID NO: 243019 - DNA, 25 bp, Homo sapien
tcattgcccacagtttgcattcagt

SEQ ID NO: 243020 - DNA, 25 bp, Homo sapien
ttgcccacagtttgcattcagtttt

SEQ ID NO: 243021 - DNA, 25 bp, Homo sapien
ggaggacgacaataatgagaacgca

SEQ ID NO: 243022 - DNA, 25 bp, Homo sapien
aatgacttctctccctctgatgagg

SEQ ID NO: 243023 - DNA, 25 bp, Homo sapien
ttctctccctctgatgaggagctag

SEQ ID NO: 243024 - DNA, 25 bp, Homo sapien
gaggagctagcaaaccttctagagg

SEQ ID NO: 243025 - DNA, 25 bp, Homo sapien
gaggatgaagactctgatgcagatg

SEQ ID NO: 243026 - DNA, 25 bp, Homo sapien
gggacactgacagctctgacaactc

SEQ ID NO: 243027 - DNA, 25 bp, Homo sapien
agctctgacaactctgatttggaag

SEQ ID NO: 243028 - DNA, 25 bp, Homo sapien
atgacatcatcttatctctgaatga

SEQ ID NO: 243029 - DNA, 25 bp, Homo sapien
tctctgaatgagtgaggagccatca

SEQ ID NO: 243030 - DNA, 25 bp, Homo sapien
gagccatcactgcttggaagagatt

SEQ ID NO: 243031 - DNA, 25 bp, Homo sapien
cactgcttggaagagattcttggca

SEQ ID NO: 243032 - DNA, 25 bp, Homo sapien
aaactggacatctctctctctcata

SEQ ID NO: 243033 - DNA, 25 bp, Homo sapien
tctctcatatccttcggcattgggt

SEQ ID NO: 243034 - DNA, 25 bp, Homo sapien
tagaaaacgattccagtcatacagg

SEQ ID NO: 243035 - DNA, 25 bp, Homo sapien
ttccagtcatacaggacacatccca

SEQ ID NO: 243036 - DNA, 25 bp, Homo sapien
atacaggacacatcccactccaaat

SEQ ID NO: 243037 - DNA, 25 bp, Homo sapien
cccactccaaatgatatttccaaaa

SEQ ID NO: 243038 - DNA, 25 bp, Homo sapien
tttccaaaaacatacctctgacagt

SEQ ID NO: 243039 - DNA, 25 bp, Homo sapien
tacctctgacagtaactttgataga

SEQ ID NO: 243040 - DNA, 25 bp, Homo sapien
ttctgggtatccacacctcttggca

SEQ ID NO: 243041 - DNA, 25 bp, Homo sapien
gtatccacacctcttggcaatgaaa

SEQ ID NO: 243042 - DNA, 25 bp, Homo sapien
caatgaaatttgcagctcctccctt

SEQ ID NO: 243043 - DNA, 25 bp, Homo sapien
gggagaacctttgggctcagatgat

SEQ ID NO: 243044 - DNA, 25 bp, Homo sapien
tttgggctcagatgataaagatcct

SEQ ID NO: 243045 - DNA, 25 bp, Homo sapien
tcctgaattagcagagtcctgtgcc

SEQ ID NO: 243046 - DNA, 25 bp, Homo sapien
cctgcctttgggtggaccggactag

SEQ ID NO: 243047 - DNA, 25 bp, Homo sapien
tggccaaggttgaggctcagcctgc

SEQ ID NO: 243048 - DNA, 25 bp, Homo sapien
aggctcagcagccacagttaggcac

SEQ ID NO: 243049 - DNA, 25 bp, Homo sapien
agttaggcacgtttgcacttccaac

SEQ ID NO: 243050 - DNA, 25 bp, Homo sapien
ttgcacttccaaccatcacaggcag

SEQ ID NO: 243051 - DNA, 25 bp, Homo sapien
aaccggcccatggtgtggtgactaa

SEQ ID NO: 243052 - DNA, 25 bp, Homo sapien
gtgtggtgactaacacctcattaat

SEQ ID NO: 243053 - DNA, 25 bp, Homo sapien
acacctcattaatggtcatacccct

SEQ ID NO: 243054 - DNA, 25 bp, Homo sapien
agggacacagccagagcccacggag

SEQ ID NO: 243055 - DNA, 25 bp, Homo sapien
acggagggcccttcccgcaaagcag

SEQ ID NO: 243056 - DNA, 25 bp, Homo sapien
ttcccgcaaagcagaagccgccagg

SEQ ID NO: 243057 - DNA, 25 bp, Homo sapien
cccccgtggctagtgggcttcatgg

SEQ ID NO: 243058 - DNA, 25 bp, Homo sapien
gctgcctgtggtgaaacccatgggc

SEQ ID NO: 243059 - DNA, 25 bp, Homo sapien
gtggagggactgatgcgaggtcccc

SEQ ID NO: 243060 - DNA, 25 bp, Homo sapien
tggagctcctgagccgtgacagttt

SEQ ID NO: 243061 - DNA, 25 bp, Homo sapien
agctcctgagccgtgacagttttca

SEQ ID NO: 243062 - DNA, 25 bp, Homo sapien
tcctgagccgtgacagttttcaggg

SEQ ID NO: 243063 - DNA, 25 bp, Homo sapien
tcctcaatcctcagcatgtaccagg

SEQ ID NO: 243064 - DNA, 25 bp, Homo sapien
tcaatcctcagcatgtaccaggcgg

SEQ ID NO: 243065 - DNA, 25 bp, Homo sapien
gttaatatgctaatgacttaagagt

SEQ ID NO: 243066 - DNA, 25 bp, Homo sapien
cgacaagaactgttttagtcctcat

SEQ ID NO: 243067 - DNA, 25 bp, Homo sapien
aactgttttagtcctcatatgatac

SEQ ID NO: 243068 - DNA, 25 bp, Homo sapien
atatgatactggttgttgagacttt

SEQ ID NO: 243069 - DNA, 25 bp, Homo sapien
tactggttgttgagactttttgagg

SEQ ID NO: 243070 - DNA, 25 bp, Homo sapien
gagactttttgaggaatgttttgag

SEQ ID NO: 243071 - DNA, 25 bp, Homo sapien
gagtagttttcttggttgtgtggat

SEQ ID NO: 243072 - DNA, 25 bp, Homo sapien
cttggttgtgtggattgtttggaat

SEQ ID NO: 243073 - DNA, 25 bp, Homo sapien
gtttggaattatgtggtagcttaga

SEQ ID NO: 243074 - DNA, 25 bp, Homo sapien
gtagcttagaagcatggtaaagatg

SEQ ID NO: 243075 - DNA, 25 bp, Homo sapien
aaagatgcttttaatttgcgtattt

SEQ ID NO: 243076 - DNA, 25 bp, Homo sapien
taagtgtgagagcagatttgagccc

SEQ ID NO: 243077 - DNA, 25 bp, Homo sapien
aaactctcactttacatagctctgc

SEQ ID NO: 243078 - DNA, 25 bp, Homo sapien
atagctctgctgcactgctcagggc

SEQ ID NO: 243079 - DNA, 25 bp, Homo sapien
ctttcccaactcttgatggcaagtt

SEQ ID NO: 243080 - DNA, 25 bp, Homo sapien
ttgatggcaagttacacaaggcccc

SEQ ID NO: 243081 - DNA, 25 bp, Homo sapien
tgaaaaacccagtcctacttacata

SEQ ID NO: 243082 - DNA, 25 bp, Homo sapien
gtcctacttacataaaatctcatca

SEQ ID NO: 243083 - DNA, 25 bp, Homo sapien
aatctcatcactaaccattctggtc

SEQ ID NO: 243084 - DNA, 25 bp, Homo sapien
actactattcctaattctacataag

SEQ ID NO: 243085 - DNA, 25 bp, Homo sapien
gaaagccattctctaaatcccaaat

SEQ ID NO: 243086 - DNA, 25 bp, Homo sapien
caagaccacattgctaagtgtgaga

SEQ ID NO: 243087 - DNA, 25 bp, Homo sapien
tggtgagtcctggacaatgggccct

SEQ ID NO: 243088 - DNA, 25 bp, Homo sapien
tgagtcctggacaatgggccctgga

SEQ ID NO: 243089 - DNA, 25 bp, Homo sapien
gaaagcctaggaaggtgggaactga

SEQ ID NO: 243090 - DNA, 25 bp, Homo sapien
gggagatgaggcacacaggaacact

SEQ ID NO: 243091 - DNA, 25 bp, Homo sapien
cacacaggaacactggatgggaaaa

SEQ ID NO: 243092 - DNA, 25 bp, Homo sapien
acttatcttgggagtctgggcaaat

SEQ ID NO: 243093 - DNA, 25 bp, Homo sapien
atcttgggagtctgggcaaatcact

SEQ ID NO: 243094 - DNA, 25 bp, Homo sapien
gtgtgtgcatttgtgcacgtgtctg

SEQ ID NO: 243095 - DNA, 25 bp, Homo sapien
tgcatttgtgcacgtgtctgtgcat

SEQ ID NO: 243096 - DNA, 25 bp, Homo sapien
acgtgtctgtgcatagctgtgagac

SEQ ID NO: 243097 - DNA, 25 bp, Homo sapien
gtctgtgcatagctgtgagaccaaa

SEQ ID NO: 243098 - DNA, 25 bp, Homo sapien
ggatattccagtgaactatatgaag

SEQ ID NO: 243099 - DNA, 25 bp, Homo sapien
ggagctggaactggtcaccaaggcc

SEQ ID NO: 243100 - DNA, 25 bp, Homo sapien
ggaactggtcaccaaggccggcttc

SEQ ID NO: 243101 - DNA, 25 bp, Homo sapien
cctggtacctgaaccgtatatccta

SEQ ID NO: 243102 - DNA, 25 bp, Homo sapien
tgaaccgtatatcctatggccctga

SEQ ID NO: 243103 - DNA, 25 bp, Homo sapien
cgtatatcctatggccctgactgga

SEQ ID NO: 243104 - DNA, 25 bp, Homo sapien
cctatggccctgactggaaggattt

SEQ ID NO: 243105 - DNA, 25 bp, Homo sapien
gatttctacgtagtggaacccctgg

SEQ ID NO: 243106 - DNA, 25 bp, Homo sapien
gtagtggaacccctggcatttgaag

SEQ ID NO: 243107 - DNA, 25 bp, Homo sapien
ggcatttgaaggtacccctgagcag

SEQ ID NO: 243108 - DNA, 25 bp, Homo sapien
ttgaaggtacccctgagcagaaggc

SEQ ID NO: 243109 - DNA, 25 bp, Homo sapien
gggagaaaggagtgtccttgaggcc

SEQ ID NO: 243110 - DNA, 25 bp, Homo sapien
ttgaggcctaggacgctgcccggcc

SEQ ID NO: 243111 - DNA, 25 bp, Homo sapien
ttcttacctcactcaacttcagcca

SEQ ID NO: 243112 - DNA, 25 bp, Homo sapien
caggaggactgggtggtgcttgcaa

SEQ ID NO: 243113 - DNA, 25 bp, Homo sapien
gaggactgggtggtgcttgcaatgt

SEQ ID NO: 243114 - DNA, 25 bp, Homo sapien
gtggtgcttgcaatgttggaatgac

SEQ ID NO: 243115 - DNA, 25 bp, Homo sapien
gtgcttgcaatgttggaatgaccgg

SEQ ID NO: 243116 - DNA, 25 bp, Homo sapien
gcttgcaatgttggaatgaccggct

SEQ ID NO: 243117 - DNA, 25 bp, Homo sapien
cttgcaatgttggaatgaccggctc

SEQ ID NO: 243118 - DNA, 25 bp, Homo sapien
ttgcaatgttggaatgaccggctca

SEQ ID NO: 243119 - DNA, 25 bp, Homo sapien
tgcaatgttggaatgaccggctcaa

SEQ ID NO: 243120 - DNA, 25 bp, Homo sapien
catatcaagtaagaggcgtcgccac

SEQ ID NO: 243121 - DNA, 25 bp, Homo sapien
aagtaagaggcgtcgccaccaccct

SEQ ID NO: 243122 - DNA, 25 bp, Homo sapien
cgagggcccctctgcggatggagcc

SEQ ID NO: 243123 - DNA, 25 bp, Homo sapien
ccaggtgcaacagggcccatggtca

SEQ ID NO: 243124 - DNA, 25 bp, Homo sapien
gggacagcccgtgtggaaactgcat

SEQ ID NO: 243125 - DNA, 25 bp, Homo sapien
cagcccgtgtggaaactgcatttat

SEQ ID NO: 243126 - DNA, 25 bp, Homo sapien
aactgcatttatcttcttgacctga

SEQ ID NO: 243127 - DNA, 25 bp, Homo sapien
ttatcttcttgacctgatacccatg

SEQ ID NO: 243128 - DNA, 25 bp, Homo sapien
ttcttgacctgatacccatgcagta

SEQ ID NO: 243129 - DNA, 25 bp, Homo sapien
gacctgatacccatgcagtaaatga

SEQ ID NO: 243130 - DNA, 25 bp, Homo sapien
gatacccatgcagtaaatgaatata

SEQ ID NO: 243131 - DNA, 25 bp, Homo sapien
gaggcatgccaaatgttccatatgt

SEQ ID NO: 243132 - DNA, 25 bp, Homo sapien
ttccatatgtgggtgtcagtcaggg

SEQ ID NO: 243133 - DNA, 25 bp, Homo sapien
gtcagtcagggacaacaagatcctt

SEQ ID NO: 243134 - DNA, 25 bp, Homo sapien
acaagatccttaatgcagagctaga

SEQ ID NO: 243135 - DNA, 25 bp, Homo sapien
aagtgttccagatagcagggcatga

SEQ ID NO: 243136 - DNA, 25 bp, Homo sapien
tcgagtttttcctctgtctttaaat

SEQ ID NO: 243137 - DNA, 25 bp, Homo sapien
gggctttgttatcttccactggaaa

SEQ ID NO: 243138 - DNA, 25 bp, Homo sapien
gagtatatgagcatcctctctcaca

SEQ ID NO: 243139 - DNA, 25 bp, Homo sapien
ctctctcacatggaacgctttcata

SEQ ID NO: 243140 - DNA, 25 bp, Homo sapien
tttcataaacttcagggatcccgtg

SEQ ID NO: 243141 - DNA, 25 bp, Homo sapien
ggatcccgtgttgccatggaggcat

SEQ ID NO: 243142 - DNA, 25 bp, Homo sapien
attgttcaagtttatggctccgata

SEQ ID NO: 243143 - DNA, 25 bp, Homo sapien
ggctccgatataaataatgggctat

SEQ ID NO: 243144 - DNA, 25 bp, Homo sapien
atgggctataaacccgtatctggaa

SEQ ID NO: 243145 - DNA, 25 bp, Homo sapien
tggaaaacagttgcgcagtgcgtgc

SEQ ID NO: 243146 - DNA, 25 bp, Homo sapien
tgcgcagtgcgtgcttaatggccag

SEQ ID NO: 243147 - DNA, 25 bp, Homo sapien
atggccagccaatgaaaaccaacgt

SEQ ID NO: 243148 - DNA, 25 bp, Homo sapien
aaaaccaacgtctcattctactccg

SEQ ID NO: 243149 - DNA, 25 bp, Homo sapien
cgtctttcagcacgtcaaggacatc

SEQ ID NO: 243150 - DNA, 25 bp, Homo sapien
tctttttaaagaggccaaccgctgg

SEQ ID NO: 243151 - DNA, 25 bp, Homo sapien
ggacacctggttttggcacctttat

SEQ ID NO: 243152 - DNA, 25 bp, Homo sapien
gggcacgctctgcagttgagctatt

SEQ ID NO: 243153 - DNA, 25 bp, Homo sapien
ggagaccttggtatgagacttactt

SEQ ID NO: 243154 - DNA, 25 bp, Homo sapien
tgagacttactttgcctccagtgag

SEQ ID NO: 243155 - DNA, 25 bp, Homo sapien
ataacctaaatgtcaccaaccacca

SEQ ID NO: 243156 - DNA, 25 bp, Homo sapien
ggtcacttcaccatctttatctaaa

SEQ ID NO: 243157 - DNA, 25 bp, Homo sapien
aaataaaggctttgggctctgatcc

SEQ ID NO: 243158 - DNA, 25 bp, Homo sapien
aaggctttgggctctgatccacaga

SEQ ID NO: 243159 - DNA, 25 bp, Homo sapien
gatccacagagatgggtgagtccta

SEQ ID NO: 243160 - DNA, 25 bp, Homo sapien
gggtgagtcctaatgctctgtgact

SEQ ID NO: 243161 - DNA, 25 bp, Homo sapien
tctgtgactctatgcatctggtatc

SEQ ID NO: 243162 - DNA, 25 bp, Homo sapien
accaaccaccagtcaggaagtttgt

SEQ ID NO: 243163 - DNA, 25 bp, Homo sapien
ggaagtttgtcctggtctatttcac

SEQ ID NO: 243164 - DNA, 25 bp, Homo sapien
ggatctcctgtgaagtgcttcttcc

SEQ ID NO: 243165 - DNA, 25 bp, Homo sapien
gtgcttcttccccagttgaatagga

SEQ ID NO: 243166 - DNA, 25 bp, Homo sapien
aataggagctggtgtttgtctaagc

SEQ ID NO: 243167 - DNA, 25 bp, Homo sapien
gtttgtctaagcctctgcttatgca

SEQ ID NO: 243168 - DNA, 25 bp, Homo sapien
gttatataatgctcttacgcgttag

SEQ ID NO: 243169 - DNA, 25 bp, Homo sapien
ttacgcgttagctatctgaatgata

SEQ ID NO: 243170 - DNA, 25 bp, Homo sapien
gaaaggatgacgactgttatagaga

SEQ ID NO: 243171 - DNA, 25 bp, Homo sapien
ggaacttgggagtatcacttctgta

SEQ ID NO: 243172 - DNA, 25 bp, Homo sapien
acttctgtaatccttatctaacctg

SEQ ID NO: 243173 - DNA, 25 bp, Homo sapien
gtaatccttatctaacctgaatctg

SEQ ID NO: 243174 - DNA, 25 bp, Homo sapien
ctgaatctgttagcaggaaactgaa

SEQ ID NO: 243175 - DNA, 25 bp, Homo sapien
agaagcaggcatgacaagagaggat

SEQ ID NO: 243176 - DNA, 25 bp, Homo sapien
acaagagaggatgcccgtgttacag

SEQ ID NO: 243177 - DNA, 25 bp, Homo sapien
atgagaaaaacagaggccctgggag

SEQ ID NO: 243178 - DNA, 25 bp, Homo sapien
gggaggaagcttgcctaatgccact

SEQ ID NO: 243179 - DNA, 25 bp, Homo sapien
gaagcttgcctaatgccactcagga

SEQ ID NO: 243180 - DNA, 25 bp, Homo sapien
ttgcctaatgccactcaggaggtag

SEQ ID NO: 243181 - DNA, 25 bp, Homo sapien
gcaaagctgggaaaggccctgggtc

SEQ ID NO: 243182 - DNA, 25 bp, Homo sapien
tgcccgggatgccatccgcaggcta

SEQ ID NO: 243183 - DNA, 25 bp, Homo sapien
ggctgggactcctgagtgaaatgaa

SEQ ID NO: 243184 - DNA, 25 bp, Homo sapien
aaatgtgaagtctgccagctagccc

SEQ ID NO: 243185 - DNA, 25 bp, Homo sapien
gaagtctgccagctagccctgagaa

SEQ ID NO: 243186 - DNA, 25 bp, Homo sapien
tgaacatgtatggagacctggtcat

SEQ ID NO: 243187 - DNA, 25 bp, Homo sapien
aacatgtatggagacctggtcatgg

SEQ ID NO: 243188 - DNA, 25 bp, Homo sapien
gtatggagacctggtcatggacaca

SEQ ID NO: 243189 - DNA, 25 bp, Homo sapien
tggagacctggtcatggacacagtc

SEQ ID NO: 243190 - DNA, 25 bp, Homo sapien
ggagacctggtcatggacacagtcc

SEQ ID NO: 243191 - DNA, 25 bp, Homo sapien
gagacctggtcatggacacagtccc

SEQ ID NO: 243192 - DNA, 25 bp, Homo sapien
agacctggtcatggacacagtccct

SEQ ID NO: 243193 - DNA, 25 bp, Homo sapien
acctggtcatggacacagtccctga

SEQ ID NO: 243194 - DNA, 25 bp, Homo sapien
ctggtcatggacacagtccctgaaa

SEQ ID NO: 243195 - DNA, 25 bp, Homo sapien
ggtcatggacacagtccctgaaaag

SEQ ID NO: 243196 - DNA, 25 bp, Homo sapien
tcatggacacagtccctgaaaaggt

SEQ ID NO: 243197 - DNA, 25 bp, Homo sapien
tttgctttctgcttgctacatttgt

SEQ ID NO: 243198 - DNA, 25 bp, Homo sapien
tgctacatttgtctcccttactttt

SEQ ID NO: 243199 - DNA, 25 bp, Homo sapien
taaagacaggctttttccaccggca

SEQ ID NO: 243200 - DNA, 25 bp, Homo sapien
tttccaccggcatcatcactgctat

SEQ ID NO: 243201 - DNA, 25 bp, Homo sapien
ctgctatcatcattaacagcgtaat

SEQ ID NO: 243202 - DNA, 25 bp, Homo sapien
gggtaatacccacaacaactgtagt

SEQ ID NO: 243203 - DNA, 25 bp, Homo sapien
aactgtagtttcttacttggccaag

SEQ ID NO: 243204 - DNA, 25 bp, Homo sapien
acttggccaagagaatgcttattta

SEQ ID NO: 243205 - DNA, 25 bp, Homo sapien
gacttccattctggcaaaatcttgc

SEQ ID NO: 243206 - DNA, 25 bp, Homo sapien
atcttgccttatcagaagacattgg

SEQ ID NO: 243207 - DNA, 25 bp, Homo sapien
gacattggaaagagggattcccttt

SEQ ID NO: 243208 - DNA, 25 bp, Homo sapien
agacacctccgagatccgtcccgcg

SEQ ID NO: 243209 - DNA, 25 bp, Homo sapien
gacacctccgagatccgtcccgcgg

SEQ ID NO: 243210 - DNA, 25 bp, Homo sapien
acacctccgagatccgtcccgcggc

SEQ ID NO: 243211 - DNA, 25 bp, Homo sapien
tccgagatccgtcccgcggctccgg

SEQ ID NO: 243212 - DNA, 25 bp, Homo sapien
gcctcgtaccgtaggtttcggacat

SEQ ID NO: 243213 - DNA, 25 bp, Homo sapien
cctcgtaccgtaggtttcggacatg

SEQ ID NO: 243214 - DNA, 25 bp, Homo sapien
ctcgtaccgtaggtttcggacatgg

SEQ ID NO: 243215 - DNA, 25 bp, Homo sapien
tcgtaccgtaggtttcggacatggc

SEQ ID NO: 243216 - DNA, 25 bp, Homo sapien
aagcccagacacctccgagatccgt

SEQ ID NO: 243217 - DNA, 25 bp, Homo sapien
agcccagacacctccgagatccgtc

SEQ ID NO: 243218 - DNA, 25 bp, Homo sapien
gcccagacacctccgagatccgtcc

SEQ ID NO: 243219 - DNA, 25 bp, Homo sapien
tttgcactttccaacttgccaagtt

SEQ ID NO: 243220 - DNA, 25 bp, Homo sapien
caacttgccaagtttctgaaagaag

SEQ ID NO: 243221 - DNA, 25 bp, Homo sapien
gtaatgccaagaactcccagatgaa

SEQ ID NO: 243222 - DNA, 25 bp, Homo sapien
gaagaggaccttccttagacctata

SEQ ID NO: 243223 - DNA, 25 bp, Homo sapien
ggaccttccttagacctataacaga

SEQ ID NO: 243224 - DNA, 25 bp, Homo sapien
cagattcactacttgacttcagagg

SEQ ID NO: 243225 - DNA, 25 bp, Homo sapien
ggaagtttcagctaattctcaggaa

SEQ ID NO: 243226 - DNA, 25 bp, Homo sapien
ttctcaggaaaaggtcaaaacaggc

SEQ ID NO: 243227 - DNA, 25 bp, Homo sapien
aaaacaggcctgtgactgtcccttg

SEQ ID NO: 243228 - DNA, 25 bp, Homo sapien
ctgtgactgtcccttgaatactgaa

SEQ ID NO: 243229 - DNA, 25 bp, Homo sapien
ggtataaacaagcttctggctcctc

SEQ ID NO: 243230 - DNA, 25 bp, Homo sapien
aaagctgctcagaggtgcagtggca

SEQ ID NO: 243231 - DNA, 25 bp, Homo sapien
tcccaaaccctcataatgcacagag

SEQ ID NO: 243232 - DNA, 25 bp, Homo sapien
caagccttgcttccagagttggtaa

SEQ ID NO: 243233 - DNA, 25 bp, Homo sapien
ggaagaacagggtagcagtctaact

SEQ ID NO: 243234 - DNA, 25 bp, Homo sapien
agggtagcagtctaactttcaaaga

SEQ ID NO: 243235 - DNA, 25 bp, Homo sapien
tttcaaagacagaaaccactggatt

SEQ ID NO: 243236 - DNA, 25 bp, Homo sapien
ggagctgaagactcatccttcaaca

SEQ ID NO: 243237 - DNA, 25 bp, Homo sapien
gcagtggcacaaacaactctaggag

SEQ ID NO: 243238 - DNA, 25 bp, Homo sapien
aactctaggagatcgcctgtgttcc

SEQ ID NO: 243239 - DNA, 25 bp, Homo sapien
ccaagcttatgacgtggctccatgc

SEQ ID NO: 243240 - DNA, 25 bp, Homo sapien
gacgtggctccatgcccaggaactc

SEQ ID NO: 243241 - DNA, 25 bp, Homo sapien
gggcctctgaagtatctttctacaa

SEQ ID NO: 243242 - DNA, 25 bp, Homo sapien
ttctacaaacgcagacaagctccac

SEQ ID NO: 243243 - DNA, 25 bp, Homo sapien
taacctgccaggatgctcaagtcca

SEQ ID NO: 243244 - DNA, 25 bp, Homo sapien
ggatgctcaagtccactgtcacaat

SEQ ID NO: 243245 - DNA, 25 bp, Homo sapien
ctttcagaaaacattagtggccgct

SEQ ID NO: 243246 - DNA, 25 bp, Homo sapien
acagagacggccgaaatgctttcac

SEQ ID NO: 243247 - DNA, 25 bp, Homo sapien
aaatgctttcactccttagctttgc

SEQ ID NO: 243248 - DNA, 25 bp, Homo sapien
tttccagttctaccaaatctgtact

SEQ ID NO: 243249 - DNA, 25 bp, Homo sapien
aaatctgtacttgggagcagcctgc

SEQ ID NO: 243250 - DNA, 25 bp, Homo sapien
gagcagcctgctggatccagaacat

SEQ ID NO: 243251 - DNA, 25 bp, Homo sapien
gagagctgcgtccacagggaacaaa

SEQ ID NO: 243252 - DNA, 25 bp, Homo sapien
cacgctgtgtccatcgcccaggatg

SEQ ID NO: 243253 - DNA, 25 bp, Homo sapien
ctgggagaccgaccctgattttgtg

SEQ ID NO: 243254 - DNA, 25 bp, Homo sapien
gggagaccgaccctgattttgtgaa

SEQ ID NO: 243255 - DNA, 25 bp, Homo sapien
ggagaccgaccctgattttgtgaat

SEQ ID NO: 243256 - DNA, 25 bp, Homo sapien
gagaccgaccctgattttgtgaatg

SEQ ID NO: 243257 - DNA, 25 bp, Homo sapien
agaccgaccctgattttgtgaatga

SEQ ID NO: 243258 - DNA, 25 bp, Homo sapien
gaccgaccctgattttgtgaatgat

SEQ ID NO: 243259 - DNA, 25 bp, Homo sapien
accgaccctgattttgtgaatgatg

SEQ ID NO: 243260 - DNA, 25 bp, Homo sapien
ccgaccctgattttgtgaatgatgt

SEQ ID NO: 243261 - DNA, 25 bp, Homo sapien
gaccctgattttgtgaatgatgtga

SEQ ID NO: 243262 - DNA, 25 bp, Homo sapien
ccctgattttgtgaatgatgtgagt

SEQ ID NO: 243263 - DNA, 25 bp, Homo sapien
gaattacatagtgaaccgtcctcaa

SEQ ID NO: 243264 - DNA, 25 bp, Homo sapien
gaaccgtcctcaaatgaaacccagt

SEQ ID NO: 243265 - DNA, 25 bp, Homo sapien
gaaacccagtggaaagagcttactc

SEQ ID NO: 243266 - DNA, 25 bp, Homo sapien
gagcttactcagtattttggagtca

SEQ ID NO: 243267 - DNA, 25 bp, Homo sapien
atgatagatttgacccgcctgttaa

SEQ ID NO: 243268 - DNA, 25 bp, Homo sapien
aaaaagttgagaagtcaggccttga

SEQ ID NO: 243269 - DNA, 25 bp, Homo sapien
gaggaactcagcaaccagctagcta

SEQ ID NO: 243270 - DNA, 25 bp, Homo sapien
aaccagctagctactcgagagcttg

SEQ ID NO: 243271 - DNA, 25 bp, Homo sapien
gctactcgagagcttggtgtaaaaa

SEQ ID NO: 243272 - DNA, 25 bp, Homo sapien
gcagttgcctgccacaactttgtaa

SEQ ID NO: 243273 - DNA, 25 bp, Homo sapien
gaggttgaaaattcacaggctgccc

SEQ ID NO: 243274 - DNA, 25 bp, Homo sapien
tctgacgaggtctgtagcggccctt

SEQ ID NO: 243275 - DNA, 25 bp, Homo sapien
ttgtgcctggtcttacctgtactcc

SEQ ID NO: 243276 - DNA, 25 bp, Homo sapien
ctgtactccacggacctcggtgaag

SEQ ID NO: 243277 - DNA, 25 bp, Homo sapien
acggacctcggtgaagcaaaagctt

SEQ ID NO: 243278 - DNA, 25 bp, Homo sapien
aatgaggcaacccagtggcagcccc

SEQ ID NO: 243279 - DNA, 25 bp, Homo sapien
gctctcctattggacgtagaggcag

SEQ ID NO: 243280 - DNA, 25 bp, Homo sapien
caaatattctcatcacagaagggat

SEQ ID NO: 243281 - DNA, 25 bp, Homo sapien
atgatccttgctgctctgccgtagg

SEQ ID NO: 243282 - DNA, 25 bp, Homo sapien
tgctctgccgtagggtttttgatgc

SEQ ID NO: 243283 - DNA, 25 bp, Homo sapien
tttgatgctgagctatgctgcacat

SEQ ID NO: 243284 - DNA, 25 bp, Homo sapien
atgctgcacatgacgttaacctaaa

SEQ ID NO: 243285 - DNA, 25 bp, Homo sapien
acaggcatttataactgagggtatg

SEQ ID NO: 243286 - DNA, 25 bp, Homo sapien
actgagggtatgaacttatatccac

SEQ ID NO: 243287 - DNA, 25 bp, Homo sapien
agggtatgaacttatatccaccagg

SEQ ID NO: 243288 - DNA, 25 bp, Homo sapien
atagaggcatttttacatacgtatt

SEQ ID NO: 243289 - DNA, 25 bp, Homo sapien
gaaaatcgtggtttcttaaattgat

SEQ ID NO: 243290 - DNA, 25 bp, Homo sapien
taacctgttttgttgcctcatatgc

SEQ ID NO: 243291 - DNA, 25 bp, Homo sapien
tgttttgttgcctcatatgctgtca

SEQ ID NO: 243292 - DNA, 25 bp, Homo sapien
gttgcctcatatgctgtcaggttaa

SEQ ID NO: 243293 - DNA, 25 bp, Homo sapien
atgctgtcaggttaatttgttttcc

SEQ ID NO: 243294 - DNA, 25 bp, Homo sapien
taatttgttttccttcgtgccagag

SEQ ID NO: 243295 - DNA, 25 bp, Homo sapien
tgttttccttcgtgccagaggtggg

SEQ ID NO: 243296 - DNA, 25 bp, Homo sapien
accatctgggacacggaactgcaca

SEQ ID NO: 243297 - DNA, 25 bp, Homo sapien
ggaactgcacattgcgggcctcaga

SEQ ID NO: 243298 - DNA, 25 bp, Homo sapien
gactatgtgcatccacagctgcgac

SEQ ID NO: 243299 - DNA, 25 bp, Homo sapien
agctgcgacgggtgatgcctgcctt

SEQ ID NO: 243300 - DNA, 25 bp, Homo sapien
gatgcctgccttgatggagatcctg

SEQ ID NO: 243301 - DNA, 25 bp, Homo sapien
ggagatcctgcagtcagactacatc

SEQ ID NO: 243302 - DNA, 25 bp, Homo sapien
gtcagactacatcctggcacaggtg

SEQ ID NO: 243303 - DNA, 25 bp, Homo sapien
tgaccttctctatgacattctcaac

SEQ ID NO: 243304 - DNA, 25 bp, Homo sapien
ttcactccaacttcctaaacctgtt

SEQ ID NO: 243305 - DNA, 25 bp, Homo sapien
gttccagcccacacagtcagggagt

SEQ ID NO: 243306 - DNA, 25 bp, Homo sapien
ggagtctcctgtatgaggtactggt

SEQ ID NO: 243307 - DNA, 25 bp, Homo sapien
aatttgaatgatagatctcttctct

SEQ ID NO: 243308 - DNA, 25 bp, Homo sapien
gccttatttttatactggaactgac

SEQ ID NO: 243309 - DNA, 25 bp, Homo sapien
cttatttttatactggaactgactc

SEQ ID NO: 243310 - DNA, 25 bp, Homo sapien
tatttttatactggaactgactcaa

SEQ ID NO: 243311 - DNA, 25 bp, Homo sapien
atttttatactggaactgactcaaa

SEQ ID NO: 243312 - DNA, 25 bp, Homo sapien
tttatactggaactgactcaaaacc

SEQ ID NO: 243313 - DNA, 25 bp, Homo sapien
tatactggaactgactcaaaacctc

SEQ ID NO: 243314 - DNA, 25 bp, Homo sapien
atactggaactgactcaaaacctct

SEQ ID NO: 243315 - DNA, 25 bp, Homo sapien
tactggaactgactcaaaacctctt

SEQ ID NO: 243316 - DNA, 25 bp, Homo sapien
actggaactgactcaaaacctctta

SEQ ID NO: 243317 - DNA, 25 bp, Homo sapien
ctggaactgactcaaaacctcttaa

SEQ ID NO: 243318 - DNA, 25 bp, Homo sapien
cagtggtttgatcttggccactaca

SEQ ID NO: 243319 - DNA, 25 bp, Homo sapien
tggtttgatcttggccactacaacc

SEQ ID NO: 243320 - DNA, 25 bp, Homo sapien
tgtattttaatcttctctgctcttt

SEQ ID NO: 243321 - DNA, 25 bp, Homo sapien
gtattttaatcttctctgctcttta

SEQ ID NO: 243322 - DNA, 25 bp, Homo sapien
tattttaatcttctctgctctttag

SEQ ID NO: 243323 - DNA, 25 bp, Homo sapien
tttaatcttctctgctctttagatg

SEQ ID NO: 243324 - DNA, 25 bp, Homo sapien
taatcttctctgctctttagatgtt

SEQ ID NO: 243325 - DNA, 25 bp, Homo sapien
aatcttctctgctctttagatgttt

SEQ ID NO: 243326 - DNA, 25 bp, Homo sapien
tcttctctgctctttagatgtttga

SEQ ID NO: 243327 - DNA, 25 bp, Homo sapien
ttctctgctctttagatgtttgaag

SEQ ID NO: 243328 - DNA, 25 bp, Homo sapien
tctgctctttagatgtttgaagtga

SEQ ID NO: 243329 - DNA, 25 bp, Homo sapien
gagaagtaatacctaccttgtaggg

SEQ ID NO: 243330 - DNA, 25 bp, Homo sapien
aatacctaccttgtagggctgttgt

SEQ ID NO: 243331 - DNA, 25 bp, Homo sapien
gaagtaatgcatacagtgcctaaca

SEQ ID NO: 243332 - DNA, 25 bp, Homo sapien
aatgcatacagtgcctaacaaagta

SEQ ID NO: 243333 - DNA, 25 bp, Homo sapien
gtgcctaacaaagtatttaacatca

SEQ ID NO: 243334 - DNA, 25 bp, Homo sapien
gagtggagttgcattctaatctctc

SEQ ID NO: 243335 - DNA, 25 bp, Homo sapien
ggagttgcattctaatctctctgcc

SEQ ID NO: 243336 - DNA, 25 bp, Homo sapien
tctctctgccgcttcaactatgtga

SEQ ID NO: 243337 - DNA, 25 bp, Homo sapien
tgccgcttcaactatgtgacctggg

SEQ ID NO: 243338 - DNA, 25 bp, Homo sapien
ggcaaatgatataaactctatgagc

SEQ ID NO: 243339 - DNA, 25 bp, Homo sapien
tataaactctatgagcctctttcct

SEQ ID NO: 243340 - DNA, 25 bp, Homo sapien
tggagatgtttcctcactcgtggac

SEQ ID NO: 243341 - DNA, 25 bp, Homo sapien
actcgtggactgcacctcaggaaag

SEQ ID NO: 243342 - DNA, 25 bp, Homo sapien
gaggattgcggagtattgcacacat

SEQ ID NO: 243343 - DNA, 25 bp, Homo sapien
attgcacacattcaggtgtcctgca

SEQ ID NO: 243344 - DNA, 25 bp, Homo sapien
ttcaggagcctctgcctggtcatct

SEQ ID NO: 243345 - DNA, 25 bp, Homo sapien
gtcctgcagtggacaccatgacact

SEQ ID NO: 243346 - DNA, 25 bp, Homo sapien
actgactccagcatgcctagaaatc

SEQ ID NO: 243347 - DNA, 25 bp, Homo sapien
gactggatttttgaacagactccca

SEQ ID NO: 243348 - DNA, 25 bp, Homo sapien
ggtcatctcgtcctgcaaataaagt

SEQ ID NO: 243349 - DNA, 25 bp, Homo sapien
aataaagtggccattctgtgggtct

SEQ ID NO: 243350 - DNA, 25 bp, Homo sapien
attctgtgggtctgctcagcctttt

SEQ ID NO: 243351 - DNA, 25 bp, Homo sapien
gacagccccgctcccagatgtaaag

SEQ ID NO: 243352 - DNA, 25 bp, Homo sapien
agccccgctcccagatgtaaagaac

SEQ ID NO: 243353 - DNA, 25 bp, Homo sapien
gctcccagatgtaaagaacgcgact

SEQ ID NO: 243354 - DNA, 25 bp, Homo sapien
tcccagatgtaaagaacgcgacttc

SEQ ID NO: 243355 - DNA, 25 bp, Homo sapien
agatgtaaagaacgcgacttccaca

SEQ ID NO: 243356 - DNA, 25 bp, Homo sapien
tgtaaagaacgcgacttccacaaac

SEQ ID NO: 243357 - DNA, 25 bp, Homo sapien
taaagaacgcgacttccacaaacct

SEQ ID NO: 243358 - DNA, 25 bp, Homo sapien
aaagaacgcgacttccacaaacctg

SEQ ID NO: 243359 - DNA, 25 bp, Homo sapien
aagaacgcgacttccacaaacctgg

SEQ ID NO: 243360 - DNA, 25 bp, Homo sapien
gaacgcgacttccacaaacctggat

SEQ ID NO: 243361 - DNA, 25 bp, Homo sapien
acgcgacttccacaaacctggattt

SEQ ID NO: 243362 - DNA, 25 bp, Homo sapien
ttcacatctgcccagacagggatgg

SEQ ID NO: 243363 - DNA, 25 bp, Homo sapien
gatgctgctgccatggtggcttggg

SEQ ID NO: 243364 - DNA, 25 bp, Homo sapien
gagtgtccttgaggcctaggacgct

SEQ ID NO: 243365 - DNA, 25 bp, Homo sapien
ttgaggcctaggacgctgcccggcc

SEQ ID NO: 243366 - DNA, 25 bp, Homo sapien
ttacctcactcaacttcagccagga

SEQ ID NO: 243367 - DNA, 25 bp, Homo sapien
caggaggactgggtggtgcttgcaa

SEQ ID NO: 243368 - DNA, 25 bp, Homo sapien
gtggtgcttgcaatgttggaatgac

SEQ ID NO: 243369 - DNA, 25 bp, Homo sapien
gtgcttgcaatgttggaatgaccgg

SEQ ID NO: 243370 - DNA, 25 bp, Homo sapien
gcttgcaatgttggaatgaccggct

SEQ ID NO: 243371 - DNA, 25 bp, Homo sapien
ttgcaatgttggaatgaccggctca

SEQ ID NO: 243372 - DNA, 25 bp, Homo sapien
tgcaatgttggaatgaccggctcaa

SEQ ID NO: 243373 - DNA, 25 bp, Homo sapien
gctggcccgcattcatgcgcatcaa

SEQ ID NO: 243374 - DNA, 25 bp, Homo sapien
cactgctggactggacctacagaga

SEQ ID NO: 243375 - DNA, 25 bp, Homo sapien
tggacctacagagacatctgggatt

SEQ ID NO: 243376 - DNA, 25 bp, Homo sapien
atctgggattttctgcgtcagctgt

SEQ ID NO: 243377 - DNA, 25 bp, Homo sapien
ttctgcgtcagctgtttgtcccata

SEQ ID NO: 243378 - DNA, 25 bp, Homo sapien
gtttgtcccatactgtatcctgtat

SEQ ID NO: 243379 - DNA, 25 bp, Homo sapien
atactgtatcctgtatgaccgagga

SEQ ID NO: 243380 - DNA, 25 bp, Homo sapien
atgaccgaggatacacatcactggg

SEQ ID NO: 243381 - DNA, 25 bp, Homo sapien
ggaacccggccctgaagtgcctgag

SEQ ID NO: 243382 - DNA, 25 bp, Homo sapien
ataccgtccagcctatctactggag

SEQ ID NO: 243383 - DNA, 25 bp, Homo sapien
agaggagcggaactcccgcacatga

SEQ ID NO: 243384 - DNA, 25 bp, Homo sapien
tcttttagggccctctgcaagtttt

SEQ ID NO: 243385 - DNA, 25 bp, Homo sapien
aacaactgcttagttgtgtgcagtg

SEQ ID NO: 243386 - DNA, 25 bp, Homo sapien
gttgtgtgcagtgtaggactcttta

SEQ ID NO: 243387 - DNA, 25 bp, Homo sapien
cagtgtaggactctttataggtttt

SEQ ID NO: 243388 - DNA, 25 bp, Homo sapien
tataggtttttgactactcttcttt

SEQ ID NO: 243389 - DNA, 25 bp, Homo sapien
attcaaccattattaatattgctgc

SEQ ID NO: 243390 - DNA, 25 bp, Homo sapien
aactgtttctttgaattctgcctgc

SEQ ID NO: 243391 - DNA, 25 bp, Homo sapien
aattctgcctgcctatccgattggt

SEQ ID NO: 243392 - DNA, 25 bp, Homo sapien
ctgcctatccgattggttttactga

SEQ ID NO: 243393 - DNA, 25 bp, Homo sapien
tatccgattggttttactgaagttt

SEQ ID NO: 243394 - DNA, 25 bp, Homo sapien
gggctgtctgtcatcttttagggcc

SEQ ID NO: 243395 - DNA, 25 bp, Homo sapien
atgcccagctgggagcgttctttca

SEQ ID NO: 243396 - DNA, 25 bp, Homo sapien
ggagcgttctttcagcaaaaagtct

SEQ ID NO: 243397 - DNA, 25 bp, Homo sapien
taattcagagactcaccttccatcc

SEQ ID NO: 243398 - DNA, 25 bp, Homo sapien
ttccatcctggcactaaacaatagt

SEQ ID NO: 243399 - DNA, 25 bp, Homo sapien
ggtaagatctgccaagaatttctct

SEQ ID NO: 243400 - DNA, 25 bp, Homo sapien
gaatttctctcacttaagcaggata

SEQ ID NO: 243401 - DNA, 25 bp, Homo sapien
aagacttatttgagtacttgcctaa

SEQ ID NO: 243402 - DNA, 25 bp, Homo sapien
gagtacttgcctaattgtatttaat

SEQ ID NO: 243403 - DNA, 25 bp, Homo sapien
agaactatgctggatgctgtagaca

SEQ ID NO: 243404 - DNA, 25 bp, Homo sapien
aatactcaacttggtccctatcttc

SEQ ID NO: 243405 - DNA, 25 bp, Homo sapien
atcttccagcaggttagaggccttt

SEQ ID NO: 243406 - DNA, 25 bp, Homo sapien
ggtaccccaggaggatgccttgtaa

SEQ ID NO: 243407 - DNA, 25 bp, Homo sapien
atgccttgtaactgctctttggtca

SEQ ID NO: 243408 - DNA, 25 bp, Homo sapien
ctgctctttggtcatgatagtggta

SEQ ID NO: 243409 - DNA, 25 bp, Homo sapien
aatgcaatatgtctgttagtttggg

SEQ ID NO: 243410 - DNA, 25 bp, Homo sapien
ggcacccgaggctcagtagaggttt

SEQ ID NO: 243411 - DNA, 25 bp, Homo sapien
gaaactaatttctggcacagtgtga

SEQ ID NO: 243412 - DNA, 25 bp, Homo sapien
ttctggcacagtgtgactgcttcaa

SEQ ID NO: 243413 - DNA, 25 bp, Homo sapien
gtgactgcttcaaacctatgttctg

SEQ ID NO: 243414 - DNA, 25 bp, Homo sapien
tcctatagaggagggcagacttttt

SEQ ID NO: 243415 - DNA, 25 bp, Homo sapien
cttagtgcatttgctggtaggtcaa

SEQ ID NO: 243416 - DNA, 25 bp, Homo sapien
ttgaattagtgttcagagtcacaga

SEQ ID NO: 243417 - DNA, 25 bp, Homo sapien
ttccttttcacccatggatgatcat

SEQ ID NO: 243418 - DNA, 25 bp, Homo sapien
acccatggatgatcattgcgagcat

SEQ ID NO: 243419 - DNA, 25 bp, Homo sapien
gaataggttaggcatgctcagtgcc

SEQ ID NO: 243420 - DNA, 25 bp, Homo sapien
tttgccaccacagtcaaatgacatg

SEQ ID NO: 243421 - DNA, 25 bp, Homo sapien
atgcttcactgtggtaccttaatac

SEQ ID NO: 243422 - DNA, 25 bp, Homo sapien
cactgtggtaccttaatacctgaaa

SEQ ID NO: 243423 - DNA, 25 bp, Homo sapien
taatacctgaaatagaaccatggaa

SEQ ID NO: 243424 - DNA, 25 bp, Homo sapien
gaaaattctgatgtcctctctctga

SEQ ID NO: 243425 - DNA, 25 bp, Homo sapien
gatgtcctctctctgaattatgtac

SEQ ID NO: 243426 - DNA, 25 bp, Homo sapien
ctgaattatgtacagactacctggg

SEQ ID NO: 243427 - DNA, 25 bp, Homo sapien
gattaaccgggagcttgaaaatttg

SEQ ID NO: 243428 - DNA, 25 bp, Homo sapien
gaattttaaaatttggccaggtgca

SEQ ID NO: 243429 - DNA, 25 bp, Homo sapien
gcaggaggatcgaggcaagaggtca

SEQ ID NO: 243430 - DNA, 25 bp, Homo sapien
caggaggatcgaggcaagaggtcag

SEQ ID NO: 243431 - DNA, 25 bp, Homo sapien
aggaggatcgaggcaagaggtcagg

SEQ ID NO: 243432 - DNA, 25 bp, Homo sapien
gaggatcgaggcaagaggtcaggag

SEQ ID NO: 243433 - DNA, 25 bp, Homo sapien
aggatcgaggcaagaggtcaggagt

SEQ ID NO: 243434 - DNA, 25 bp, Homo sapien
ggatcgaggcaagaggtcaggagtt

SEQ ID NO: 243435 - DNA, 25 bp, Homo sapien
gatcgaggcaagaggtcaggagttt

SEQ ID NO: 243436 - DNA, 25 bp, Homo sapien
tgtgatggcatgtgtctgtggtccc

SEQ ID NO: 243437 - DNA, 25 bp, Homo sapien
ctgccgtgagctgtgtttatgccac

SEQ ID NO: 243438 - DNA, 25 bp, Homo sapien
gccgtgagctgtgtttatgccactg

SEQ ID NO: 243439 - DNA, 25 bp, Homo sapien
cagggccctcccagatgcctgagga

SEQ ID NO: 243440 - DNA, 25 bp, Homo sapien
agggccctcccagatgcctgaggag

SEQ ID NO: 243441 - DNA, 25 bp, Homo sapien
gggccctcccagatgcctgaggagg

SEQ ID NO: 243442 - DNA, 25 bp, Homo sapien
tttggggagagacacaggcaggcga

SEQ ID NO: 243443 - DNA, 25 bp, Homo sapien
gcgagggggctggtccccagtctgt

SEQ ID NO: 243444 - DNA, 25 bp, Homo sapien
gggtggtgctcagggtaaagggcta

SEQ ID NO: 243445 - DNA, 25 bp, Homo sapien
ggtggtgctcagggtaaagggctat

SEQ ID NO: 243446 - DNA, 25 bp, Homo sapien
caacaggggaccagaccagggatga

SEQ ID NO: 243447 - DNA, 25 bp, Homo sapien
gcacaaggaccatttgccagaatcc

SEQ ID NO: 243448 - DNA, 25 bp, Homo sapien
agagagcccgcagggaagggtaaag

SEQ ID NO: 243449 - DNA, 25 bp, Homo sapien
gagagcccgcagggaagggtaaagc

SEQ ID NO: 243450 - DNA, 25 bp, Homo sapien
cctttgtatccagtactaggagagt

SEQ ID NO: 243451 - DNA, 25 bp, Homo sapien
aggagagtactcactggacagctgt

SEQ ID NO: 243452 - DNA, 25 bp, Homo sapien
gacagctgtgatttgggactgcttt

SEQ ID NO: 243453 - DNA, 25 bp, Homo sapien
atttgggactgctttccagcccttg

SEQ ID NO: 243454 - DNA, 25 bp, Homo sapien
ggctgcccggagtctactggcaaaa

SEQ ID NO: 243455 - DNA, 25 bp, Homo sapien
gtctactggcaaaacggactctctc

SEQ ID NO: 243456 - DNA, 25 bp, Homo sapien
ggagtccagagcaccttggaaccaa

SEQ ID NO: 243457 - DNA, 25 bp, Homo sapien
ggaaccaagtacagcgaagcccact

SEQ ID NO: 243458 - DNA, 25 bp, Homo sapien
agcccactgagttcagttggccggg

SEQ ID NO: 243459 - DNA, 25 bp, Homo sapien
agcagcaagaggcacccgtagaaga

SEQ ID NO: 243460 - DNA, 25 bp, Homo sapien
ggcaggcagaggaacccgacagact

SEQ ID NO: 243461 - DNA, 25 bp, Homo sapien
accggagcacctttgttcggtatat

SEQ ID NO: 243462 - DNA, 25 bp, Homo sapien
cctttgttcggtatatatatgcctt

SEQ ID NO: 243463 - DNA, 25 bp, Homo sapien
atatatgcctttgttacctctgact

SEQ ID NO: 243464 - DNA, 25 bp, Homo sapien
acctctgactcacgtcgcttaaaga

SEQ ID NO: 243465 - DNA, 25 bp, Homo sapien
tcgcttaaagaccagttttgcaaat

SEQ ID NO: 243466 - DNA, 25 bp, Homo sapien
gagaataaaatccttggaggccttg

SEQ ID NO: 243467 - DNA, 25 bp, Homo sapien
ggaggccttgatttgaagctgtgaa

SEQ ID NO: 243468 - DNA, 25 bp, Homo sapien
gaagctgtgaacctgtagcctacca

SEQ ID NO: 243469 - DNA, 25 bp, Homo sapien
gaacctgtagcctaccaaggacagt

SEQ ID NO: 243470 - DNA, 25 bp, Homo sapien
tgcactcctgtgcttgcgacactaa

SEQ ID NO: 243471 - DNA, 25 bp, Homo sapien
tgcgacactaatactgttctctcca

SEQ ID NO: 243472 - DNA, 25 bp, Homo sapien
acacgtgccccgagtgcaagaagag

SEQ ID NO: 243473 - DNA, 25 bp, Homo sapien
ttccgcctgcacatcagcttggtga

SEQ ID NO: 243474 - DNA, 25 bp, Homo sapien
gcacatcagcttggtgatccatcag

SEQ ID NO: 243475 - DNA, 25 bp, Homo sapien
atcagcttggtgatccatcagcgcg

SEQ ID NO: 243476 - DNA, 25 bp, Homo sapien
agcttggtgatccatcagcgcgtgc

SEQ ID NO: 243477 - DNA, 25 bp, Homo sapien
ttggtgatccatcagcgcgtgcacg

SEQ ID NO: 243478 - DNA, 25 bp, Homo sapien
ggtgatccatcagcgcgtgcacgcg

SEQ ID NO: 243479 - DNA, 25 bp, Homo sapien
tgcacgcgggcaagcatgaggtctc

SEQ ID NO: 243480 - DNA, 25 bp, Homo sapien
cacgcgggcaagcatgaggtctcct

SEQ ID NO: 243481 - DNA, 25 bp, Homo sapien
caagcatgaggtctccttcatctgc

SEQ ID NO: 243482 - DNA, 25 bp, Homo sapien
cttcatctgcagcctgtgcggcaag

SEQ ID NO: 243483 - DNA, 25 bp, Homo sapien
ggccacaatacaacactaagcgcat

SEQ ID NO: 243484 - DNA, 25 bp, Homo sapien
ttattaaatagagtttgtgggcctt

SEQ ID NO: 243485 - DNA, 25 bp, Homo sapien
tgtgggccttgttctctactttaaa

SEQ ID NO: 243486 - DNA, 25 bp, Homo sapien
ggccttgttctctactttaaaagca

SEQ ID NO: 243487 - DNA, 25 bp, Homo sapien
gaacatttatgtttccctggtcaat

SEQ ID NO: 243488 - DNA, 25 bp, Homo sapien
tttccctggtcaatgagcctcaata

SEQ ID NO: 243489 - DNA, 25 bp, Homo sapien
aaaaggttttacacgtgacacatga

SEQ ID NO: 243490 - DNA, 25 bp, Homo sapien
tacacgtgacacatgatatcttttc

SEQ ID NO: 243491 - DNA, 25 bp, Homo sapien
cttttcattgctgttaaggacattt

SEQ ID NO: 243492 - DNA, 25 bp, Homo sapien
aagttttctaagtcgctatgctcca

SEQ ID NO: 243493 - DNA, 25 bp, Homo sapien
tctaagtcgctatgctccaatttct

SEQ ID NO: 243494 - DNA, 25 bp, Homo sapien
aaacttttgtgtaagcgcttcacct

SEQ ID NO: 243495 - DNA, 25 bp, Homo sapien
gcgcttcaccttattcctacaataa

SEQ ID NO: 243496 - DNA, 25 bp, Homo sapien
acaatgcagcaagggcttcagtcgc

SEQ ID NO: 243497 - DNA, 25 bp, Homo sapien
ttcagtcgcagctcaggtcttatca

SEQ ID NO: 243498 - DNA, 25 bp, Homo sapien
tcgcagctcaggtcttatcaaacac

SEQ ID NO: 243499 - DNA, 25 bp, Homo sapien
agaaccctcaatgggagaagcctta

SEQ ID NO: 243500 - DNA, 25 bp, Homo sapien
gttagtatcacttctacttattgta

SEQ ID NO: 243501 - DNA, 25 bp, Homo sapien
gctttcattattgcatctactcaca

SEQ ID NO: 243502 - DNA, 25 bp, Homo sapien
atctactcacatttctcactcggtt

SEQ ID NO: 243503 - DNA, 25 bp, Homo sapien
tcactcggtttctggcaccagcaat

SEQ ID NO: 243504 - DNA, 25 bp, Homo sapien
agcaatctcttccatatttataata

SEQ ID NO: 243505 - DNA, 25 bp, Homo sapien
tgaagctccgtgctcaactgattaa

SEQ ID NO: 243506 - DNA, 25 bp, Homo sapien
gctccgtgctcaactgattaaactt

SEQ ID NO: 243507 - DNA, 25 bp, Homo sapien
gattaaactttactgccctatggtg

SEQ ID NO: 243508 - DNA, 25 bp, Homo sapien
aactttactgccctatggtgaccat

SEQ ID NO: 243509 - DNA, 25 bp, Homo sapien
tgccctatggtgaccatctaggaga

SEQ ID NO: 243510 - DNA, 25 bp, Homo sapien
gtgagggtactattctggattgaga

SEQ ID NO: 243511 - DNA, 25 bp, Homo sapien
gagaaaacctatatccattctttat

SEQ ID NO: 243512 - DNA, 25 bp, Homo sapien
caatgtatagttttagtctcctaaa

SEQ ID NO: 243513 - DNA, 25 bp, Homo sapien
gttattttccaaactattctcttgt

SEQ ID NO: 243514 - DNA, 25 bp, Homo sapien
gaaaattttccagtgggcacttaat

SEQ ID NO: 243515 - DNA, 25 bp, Homo sapien
aatggtgcccttgaagaacttccta

SEQ ID NO: 243516 - DNA, 25 bp, Homo sapien
ctgccctccactcttgggaagatgg

SEQ ID NO: 243517 - DNA, 25 bp, Homo sapien
aaacggaaatttggattggcagcta

SEQ ID NO: 243518 - DNA, 25 bp, Homo sapien
gattggcagctagcagttatttcct

SEQ ID NO: 243519 - DNA, 25 bp, Homo sapien
gcagctagcagttatttcctatcag

SEQ ID NO: 243520 - DNA, 25 bp, Homo sapien
tcagatgtactgtgcactttaacct

SEQ ID NO: 243521 - DNA, 25 bp, Homo sapien
gtactgtgcactttaacctaactta

SEQ ID NO: 243522 - DNA, 25 bp, Homo sapien
ttttctgtactgcacaaatacctgt

SEQ ID NO: 243523 - DNA, 25 bp, Homo sapien
gtactgcacaaatacctgttttgtc

SEQ ID NO: 243524 - DNA, 25 bp, Homo sapien
gagtgtatacaatttaagcaacatt

SEQ ID NO: 243525 - DNA, 25 bp, Homo sapien
agtaggagtttagcctgctgcacct

SEQ ID NO: 243526 - DNA, 25 bp, Homo sapien
tgctgcaccttcacgggcattcaga

SEQ ID NO: 243527 - DNA, 25 bp, Homo sapien
tccctctactacacagacactaaat

SEQ ID NO: 243528 - DNA, 25 bp, Homo sapien
aaatgagcactccttggccacttgt

SEQ ID NO: 243529 - DNA, 25 bp, Homo sapien
ttgtgcctccaccactatgtcctgg

SEQ ID NO: 243530 - DNA, 25 bp, Homo sapien
cactatgtcctggtgactactgatt

SEQ ID NO: 243531 - DNA, 25 bp, Homo sapien
gtgactactgattaggtgacctttc

SEQ ID NO: 243532 - DNA, 25 bp, Homo sapien
aggtgacctttcatccatccatggg

SEQ ID NO: 243533 - DNA, 25 bp, Homo sapien
tccccatctgttctcagggttgaat

SEQ ID NO: 243534 - DNA, 25 bp, Homo sapien
cagggttgaatcactacaagagatg

SEQ ID NO: 243535 - DNA, 25 bp, Homo sapien
tgtacaagggtataggtgcctccta

SEQ ID NO: 243536 - DNA, 25 bp, Homo sapien
gggtataggtgcctcctacttccgc

SEQ ID NO: 243537 - DNA, 25 bp, Homo sapien
tcttcttctgggaccagctgcgctc

SEQ ID NO: 243538 - DNA, 25 bp, Homo sapien
ttttctgctcctgtgcagggcagct

SEQ ID NO: 243539 - DNA, 25 bp, Homo sapien
aaggacggtcagtgcttgggcccca

SEQ ID NO: 243540 - DNA, 25 bp, Homo sapien
acggtcagtgcttgggccccagctg

SEQ ID NO: 243541 - DNA, 25 bp, Homo sapien
atgtcccccagcgaagggccagagt

SEQ ID NO: 243542 - DNA, 25 bp, Homo sapien
tgggaacctgtcctcatgcccttcg

SEQ ID NO: 243543 - DNA, 25 bp, Homo sapien
tcctcatgcccttcgtcctgaggag

SEQ ID NO: 243544 - DNA, 25 bp, Homo sapien
tctgccactttagggccttctagag

SEQ ID NO: 243545 - DNA, 25 bp, Homo sapien
agggccttctagaggcagtgtcctt

SEQ ID NO: 243546 - DNA, 25 bp, Homo sapien
agtgtccttaggaagtagctctgag

SEQ ID NO: 243547 - DNA, 25 bp, Homo sapien
agctctgaggcatgggttttctgct

SEQ ID NO: 243548 - DNA, 25 bp, Homo sapien
aggcatgggttttctgctcctgtgc

SEQ ID NO: 243549 - DNA, 25 bp, Homo sapien
agcatttttgcctctagatcctttt

SEQ ID NO: 243550 - DNA, 25 bp, Homo sapien
gatccttttgtctagggtaaattct

SEQ ID NO: 243551 - DNA, 25 bp, Homo sapien
cttagggtgacaagagtatgcggca

SEQ ID NO: 243552 - DNA, 25 bp, Homo sapien
gaaaaggacaaaatctaggcatgaa

SEQ ID NO: 243553 - DNA, 25 bp, Homo sapien
actgcaaatattatgttcttaccca

SEQ ID NO: 243554 - DNA, 25 bp, Homo sapien
attatgttcttacccattcttggaa

SEQ ID NO: 243555 - DNA, 25 bp, Homo sapien
tacccattcttggaaacgtcagctt

SEQ ID NO: 243556 - DNA, 25 bp, Homo sapien
aaacgtcagctttcttgcttcctgt

SEQ ID NO: 243557 - DNA, 25 bp, Homo sapien
gctttcttgcttcctgtgcttccag

SEQ ID NO: 243558 - DNA, 25 bp, Homo sapien
gtgcttccagccgaggtagggcaaa

SEQ ID NO: 243559 - DNA, 25 bp, Homo sapien
gaaaatagccattcagctcaggaag

SEQ ID NO: 243560 - DNA, 25 bp, Homo sapien
tagagacggactgtcactgtcttgc

SEQ ID NO: 243561 - DNA, 25 bp, Homo sapien
actgtcttgccctggactctcaaaa

SEQ ID NO: 243562 - DNA, 25 bp, Homo sapien
tgccctggactctcaaaatcctagg

SEQ ID NO: 243563 - DNA, 25 bp, Homo sapien
aggcatgaagcattgcacccaactg

SEQ ID NO: 243564 - DNA, 25 bp, Homo sapien
aagctggcagaattgtagtgcaatc

SEQ ID NO: 243565 - DNA, 25 bp, Homo sapien
attgtagtgcaatcccgactggtgc

SEQ ID NO: 243566 - DNA, 25 bp, Homo sapien
tgcaatcccgactggtgccgtcaag

SEQ ID NO: 243567 - DNA, 25 bp, Homo sapien
actggtgccgtcaagcttattttac

SEQ ID NO: 243568 - DNA, 25 bp, Homo sapien
gtcaagcttattttaccactttcct

SEQ ID NO: 243569 - DNA, 25 bp, Homo sapien
ctataggaatgtgccaccgcatcag

SEQ ID NO: 243570 - DNA, 25 bp, Homo sapien
aggaatgtgccaccgcatcagctaa

SEQ ID NO: 243571 - DNA, 25 bp, Homo sapien
gggaaagggctctcttacaccgcac

SEQ ID NO: 243572 - DNA, 25 bp, Homo sapien
ttacaccgcactcagggagaccact

SEQ ID NO: 243573 - DNA, 25 bp, Homo sapien
cagggagaccacttctcaggatggg

SEQ ID NO: 243574 - DNA, 25 bp, Homo sapien
tcagatggagagacctctagggaga

SEQ ID NO: 243575 - DNA, 25 bp, Homo sapien
gggagaaagacatccccattgtgtg

SEQ ID NO: 243576 - DNA, 25 bp, Homo sapien
tccccattgtgtgagtggcatttcc

SEQ ID NO: 243577 - DNA, 25 bp, Homo sapien
tggcatttccttaagctggcaggaa

SEQ ID NO: 243578 - DNA, 25 bp, Homo sapien
tggaatagttctggccagaccccgt

SEQ ID NO: 243579 - DNA, 25 bp, Homo sapien
cctctatgaaggaataagttggacc

SEQ ID NO: 243580 - DNA, 25 bp, Homo sapien
caaaacaatgccagggtgtctcccg

SEQ ID NO: 243581 - DNA, 25 bp, Homo sapien
tgtctcccgctttactcttcaggaa

SEQ ID NO: 243582 - DNA, 25 bp, Homo sapien
atagtatggatgtagcagcaggtac

SEQ ID NO: 243583 - DNA, 25 bp, Homo sapien
atctggtgcaaaatcaatgtggact

SEQ ID NO: 243584 - DNA, 25 bp, Homo sapien
aaatcacctgatggaaggacttact

SEQ ID NO: 243585 - DNA, 25 bp, Homo sapien
tggaaggacttactactacaacact

SEQ ID NO: 243586 - DNA, 25 bp, Homo sapien
gaaaccaaacagtctacctgggaga

SEQ ID NO: 243587 - DNA, 25 bp, Homo sapien
gtctacctgggagaaaccagatgat

SEQ ID NO: 243588 - DNA, 25 bp, Homo sapien
aacacctgctgagcaactcttatct

SEQ ID NO: 243589 - DNA, 25 bp, Homo sapien
aactcttatctaaatgcccctggaa

SEQ ID NO: 243590 - DNA, 25 bp, Homo sapien
aatgcccctggaaggaatacaaatc

SEQ ID NO: 243591 - DNA, 25 bp, Homo sapien
ggaaagccttactattataattctc

SEQ ID NO: 243592 - DNA, 25 bp, Homo sapien
gaggatcttgaaggataccagaata

SEQ ID NO: 243593 - DNA, 25 bp, Homo sapien
gaaaatcctggatggctgaccaaga

SEQ ID NO: 243594 - DNA, 25 bp, Homo sapien
gactggcacttgttccagccattag

SEQ ID NO: 243595 - DNA, 25 bp, Homo sapien
cttgttccagccattagtgagttga

SEQ ID NO: 243596 - DNA, 25 bp, Homo sapien
gtgactcactgagtaccatggttct

SEQ ID NO: 243597 - DNA, 25 bp, Homo sapien
taccatggttctgttctcctctgga

SEQ ID NO: 243598 - DNA, 25 bp, Homo sapien
agatcttgcacgtatctgttttcct

SEQ ID NO: 243599 - DNA, 25 bp, Homo sapien
ctagaaaaccacttactcccagaat

SEQ ID NO: 243600 - DNA, 25 bp, Homo sapien
tactcccagaattcaggtcgtgctt

SEQ ID NO: 243601 - DNA, 25 bp, Homo sapien
aggtcgtgcttgttagtactatatc

SEQ ID NO: 243602 - DNA, 25 bp, Homo sapien
gtactatatcaccaagtccattcat

SEQ ID NO: 243603 - DNA, 25 bp, Homo sapien
aactgtaatgttgcactgtattcca

SEQ ID NO: 243604 - DNA, 25 bp, Homo sapien
gagcggaacgccaacttacgccggg

SEQ ID NO: 243605 - DNA, 25 bp, Homo sapien
agccggctggtgtgctccaccttga

SEQ ID NO: 243606 - DNA, 25 bp, Homo sapien
accttgagcgccttcttctggttgg

SEQ ID NO: 243607 - DNA, 25 bp, Homo sapien
agcgccttcttctggttggttgtca

SEQ ID NO: 243608 - DNA, 25 bp, Homo sapien
ttctggttggttgtcatgcagttct

SEQ ID NO: 243609 - DNA, 25 bp, Homo sapien
atgcagttctcacacatgatggcgc

SEQ ID NO: 243610 - DNA, 25 bp, Homo sapien
agttctcacacatgatggcgccgct

SEQ ID NO: 243611 - DNA, 25 bp, Homo sapien
agcggcacgtgaagtccgtcttgca

SEQ ID NO: 243612 - DNA, 25 bp, Homo sapien
tgaagtccgtcttgcactgtgcaca

SEQ ID NO: 243613 - DNA, 25 bp, Homo sapien
ccgtcttgcactgtgcacacatgta

SEQ ID NO: 243614 - DNA, 25 bp, Homo sapien
gggttttatgacctgcttcagcacg

SEQ ID NO: 243615 - DNA, 25 bp, Homo sapien
ccggttatagtttaatgggagcatt

SEQ ID NO: 243616 - DNA, 25 bp, Homo sapien
taatgggagcatttaaacatacttt

SEQ ID NO: 243617 - DNA, 25 bp, Homo sapien
tttcctacaaagcttatcagttagt

SEQ ID NO: 243618 - DNA, 25 bp, Homo sapien
gcttatcagttagttacttaacctt

SEQ ID NO: 243619 - DNA, 25 bp, Homo sapien
ttagttacttaacctttatgaatag

SEQ ID NO: 243620 - DNA, 25 bp, Homo sapien
gatacttggtttcaagttaaatcta

SEQ ID NO: 243621 - DNA, 25 bp, Homo sapien
tcctcttttttatgaccacttgact

SEQ ID NO: 243622 - DNA, 25 bp, Homo sapien
tcttttttatgaccacttgactaag

SEQ ID NO: 243623 - DNA, 25 bp, Homo sapien
cacaaggcagatgtggaaatgtcgc

SEQ ID NO: 243624 - DNA, 25 bp, Homo sapien
ggaaatgtcgctttataaatacaag

SEQ ID NO: 243625 - DNA, 25 bp, Homo sapien
ataaatacaagattcagccagtaaa

SEQ ID NO: 243626 - DNA, 25 bp, Homo sapien
ggctgtctagtagtgattaagagag

SEQ ID NO: 243627 - DNA, 25 bp, Homo sapien
tactgtattaggtgaggaatgccat

SEQ ID NO: 243628 - DNA, 25 bp, Homo sapien
taggtgaggaatgccatatttcttg

SEQ ID NO: 243629 - DNA, 25 bp, Homo sapien
tgccatatttcttgtcagccaacag

SEQ ID NO: 243630 - DNA, 25 bp, Homo sapien
tttcttgtcagccaacagtacttgt

SEQ ID NO: 243631 - DNA, 25 bp, Homo sapien
gtcagccaacagtacttgtctgaga

SEQ ID NO: 243632 - DNA, 25 bp, Homo sapien
gccaacagtacttgtctgagacaga

SEQ ID NO: 243633 - DNA, 25 bp, Homo sapien
attaaaatttctgtgcacttgcttc

SEQ ID NO: 243634 - DNA, 25 bp, Homo sapien
aaaatttctgtgcacttgcttccct

SEQ ID NO: 243635 - DNA, 25 bp, Homo sapien
atttctgtgcacttgcttccctgac

SEQ ID NO: 243636 - DNA, 25 bp, Homo sapien
cttccctgaccatattgattttatt

SEQ ID NO: 243637 - DNA, 25 bp, Homo sapien
ggtaggcccaaccagataggtcagt

SEQ ID NO: 243638 - DNA, 25 bp, Homo sapien
taggtcagtacccagaggaacttct

SEQ ID NO: 243639 - DNA, 25 bp, Homo sapien
gtacccagaggaacttctgcagttt

SEQ ID NO: 243640 - DNA, 25 bp, Homo sapien
agctttttaagctcctttcatctct

SEQ ID NO: 243641 - DNA, 25 bp, Homo sapien
tttcatctctttcattttacacaga

SEQ ID NO: 243642 - DNA, 25 bp, Homo sapien
ttcattttacacagagagggtctct

SEQ ID NO: 243643 - DNA, 25 bp, Homo sapien
ttcaaatccgtaatcttgggctctg

SEQ ID NO: 243644 - DNA, 25 bp, Homo sapien
atccgtaatcttgggctctggattt

SEQ ID NO: 243645 - DNA, 25 bp, Homo sapien
gatttatcagttgttttcctttctg

SEQ ID NO: 243646 - DNA, 25 bp, Homo sapien
cctttctgccagtatttagtgtttt

SEQ ID NO: 243647 - DNA, 25 bp, Homo sapien
tttagtgtttttcgctatggccagc

SEQ ID NO: 243648 - DNA, 25 bp, Homo sapien
ggattttattctcttacatcacagt

SEQ ID NO: 243649 - DNA, 25 bp, Homo sapien
actggtctttaagcgacgtgagtca

SEQ ID NO: 243650 - DNA, 25 bp, Homo sapien
cgtgagtcagaggtaacaaaggcat

SEQ ID NO: 243651 - DNA, 25 bp, Homo sapien
ccgaacaaaggtgctccggtgcagt

SEQ ID NO: 243652 - DNA, 25 bp, Homo sapien
tgcaagccaggaagcatgagtcgct

SEQ ID NO: 243653 - DNA, 25 bp, Homo sapien
catgagtcgctgaattggtgatgga

SEQ ID NO: 243654 - DNA, 25 bp, Homo sapien
tgcttctggagcagtgttcacaacg

SEQ ID NO: 243655 - DNA, 25 bp, Homo sapien
gcagtgttcacaacgggaatgtttt

SEQ ID NO: 243656 - DNA, 25 bp, Homo sapien
gaatgtttttactgtccttggtagg

SEQ ID NO: 243657 - DNA, 25 bp, Homo sapien
ttggtaggctacaggttcacagctt

SEQ ID NO: 243658 - DNA, 25 bp, Homo sapien
acagcttcaaatcaaggcctccaag

SEQ ID NO: 243659 - DNA, 25 bp, Homo sapien
ctttctgtgcacaagacttacccta

SEQ ID NO: 243660 - DNA, 25 bp, Homo sapien
acaagacttaccctaccagcagcag

SEQ ID NO: 243661 - DNA, 25 bp, Homo sapien
ttctctgttgagtggttcattttga

SEQ ID NO: 243662 - DNA, 25 bp, Homo sapien
gagtggttcattttgaagttccaca

SEQ ID NO: 243663 - DNA, 25 bp, Homo sapien
cacagattgaagagaacatgccacc

SEQ ID NO: 243664 - DNA, 25 bp, Homo sapien
aatcacctcacatcttcttggtgga

SEQ ID NO: 243665 - DNA, 25 bp, Homo sapien
cacatcttcttggtggacatgataa

SEQ ID NO: 243666 - DNA, 25 bp, Homo sapien
acttgatttctttactaccttgctg

SEQ ID NO: 243667 - DNA, 25 bp, Homo sapien
tttatccctacctgtgaaccttcaa

SEQ ID NO: 243668 - DNA, 25 bp, Homo sapien
gtgaaccttcaaagactgcattaac

SEQ ID NO: 243669 - DNA, 25 bp, Homo sapien
accaaagattttaatatggccctcg

SEQ ID NO: 243670 - DNA, 25 bp, Homo sapien
acacacccttgtactgcaggacggg

SEQ ID NO: 243671 - DNA, 25 bp, Homo sapien
gggaatggaacctaggtcttcttat

SEQ ID NO: 243672 - DNA, 25 bp, Homo sapien
tggaacctaggtcttcttatttttg

SEQ ID NO: 243673 - DNA, 25 bp, Homo sapien
tcttatttttggttcagtgttaact

SEQ ID NO: 243674 - DNA, 25 bp, Homo sapien
gttattcaaactgccttcccatagg

SEQ ID NO: 243675 - DNA, 25 bp, Homo sapien
ttcccataggtgcttccctgcttct

SEQ ID NO: 243676 - DNA, 25 bp, Homo sapien
gaaggacttacaaacagcttatctt

SEQ ID NO: 243677 - DNA, 25 bp, Homo sapien
cagaggttttgtgcctgatagttat

SEQ ID NO: 243678 - DNA, 25 bp, Homo sapien
gtgcctgatagttatggaatgtgct

SEQ ID NO: 243679 - DNA, 25 bp, Homo sapien
gggaatgctaaaaggctgtctactt

SEQ ID NO: 243680 - DNA, 25 bp, Homo sapien
ggaacttaagttcacacacccttgt

SEQ ID NO: 243681 - DNA, 25 bp, Homo sapien
aaaacggagtgatcggctttggaga

SEQ ID NO: 243682 - DNA, 25 bp, Homo sapien
taaggagacatgacgtgcctgccct

SEQ ID NO: 243683 - DNA, 25 bp, Homo sapien
gggagaaatccctggaaggcacgca

SEQ ID NO: 243684 - DNA, 25 bp, Homo sapien
aaggcacgcaggctggacatcatca

SEQ ID NO: 243685 - DNA, 25 bp, Homo sapien
tggacatcatcatatattctctaca

SEQ ID NO: 243686 - DNA, 25 bp, Homo sapien
tatattctctacagatggagacacc

SEQ ID NO: 243687 - DNA, 25 bp, Homo sapien
atcaggactccctcagaaagcaggc

SEQ ID NO: 243688 - DNA, 25 bp, Homo sapien
acgccttctgtgctgttggaatttc

SEQ ID NO: 243689 - DNA, 25 bp, Homo sapien
gaatcctgtgaccttcatctaaagt

SEQ ID NO: 243690 - DNA, 25 bp, Homo sapien
tcatctaaagtaggtcatgagaccc

SEQ ID NO: 243691 - DNA, 25 bp, Homo sapien
agacccctgagcttaaaacggagtg

SEQ ID NO: 243692 - DNA, 25 bp, Homo sapien
gggaagcgccgtttaaatacacagc

SEQ ID NO: 243693 - DNA, 25 bp, Homo sapien
aatacacagcacgacgtatccttgt

SEQ ID NO: 243694 - DNA, 25 bp, Homo sapien
acgacgtatccttgtaccgacttct

SEQ ID NO: 243695 - DNA, 25 bp, Homo sapien
tcccggttcttgtttgaaaatactg

SEQ ID NO: 243696 - DNA, 25 bp, Homo sapien
gaaaatactgtagttcaggctcttg

SEQ ID NO: 243697 - DNA, 25 bp, Homo sapien
tactgtagttcaggctcttgatcta

SEQ ID NO: 243698 - DNA, 25 bp, Homo sapien
gttcaggctcttgatctagatggca

SEQ ID NO: 243699 - DNA, 25 bp, Homo sapien
aggctcttgatctagatggcagata

SEQ ID NO: 243700 - DNA, 25 bp, Homo sapien
gcagataggaactttcttgtcacaa

SEQ ID NO: 243701 - DNA, 25 bp, Homo sapien
aatagacttttggacacacagctgt

SEQ ID NO: 243702 - DNA, 25 bp, Homo sapien
ggatttataacttaatgtttctgtt

SEQ ID NO: 243703 - DNA, 25 bp, Homo sapien
gagaagatctctcattcagcttaat

SEQ ID NO: 243704 - DNA, 25 bp, Homo sapien
tggatccagcaccttgaggtcctct

SEQ ID NO: 243705 - DNA, 25 bp, Homo sapien
taaagagcctgccagcagtatctga

SEQ ID NO: 243706 - DNA, 25 bp, Homo sapien
cccagctctgtcagaactcgttaga

SEQ ID NO: 243707 - DNA, 25 bp, Homo sapien
agaactcgttagacacatcccgtag

SEQ ID NO: 243708 - DNA, 25 bp, Homo sapien
cccgtagccggtgtcagccatggag

SEQ ID NO: 243709 - DNA, 25 bp, Homo sapien
gtatctcatgagattcccatttcat

SEQ ID NO: 243710 - DNA, 25 bp, Homo sapien
cccatttcatttgaggcctatgtgt

SEQ ID NO: 243711 - DNA, 25 bp, Homo sapien
gcagtatctgagaatggcctctgga

SEQ ID NO: 243712 - DNA, 25 bp, Homo sapien
tggaccccttctcagggtgttaaat

SEQ ID NO: 243713 - DNA, 25 bp, Homo sapien
gctgtgttatagtacatgccgtagt

SEQ ID NO: 243714 - DNA, 25 bp, Homo sapien
atttactaccacaatgtccactaaa

SEQ ID NO: 243715 - DNA, 25 bp, Homo sapien
gtccactaaaactaaactctgttgt

SEQ ID NO: 243716 - DNA, 25 bp, Homo sapien
ctgttgtcagactttgttcttgcct

SEQ ID NO: 243717 - DNA, 25 bp, Homo sapien
taggtttctattactaaaagtcact

SEQ ID NO: 243718 - DNA, 25 bp, Homo sapien
taaaagtcacttttcagaacttagt

SEQ ID NO: 243719 - DNA, 25 bp, Homo sapien
gatgggcatttagtgggattatttc

SEQ ID NO: 243720 - DNA, 25 bp, Homo sapien
ccccatgtcttgtgttttacttcta

SEQ ID NO: 243721 - DNA, 25 bp, Homo sapien
tgtcttgtgttttacttctatatcc

SEQ ID NO: 243722 - DNA, 25 bp, Homo sapien
tatttctaggaataatgaccctgga

SEQ ID NO: 243723 - DNA, 25 bp, Homo sapien
ggaaggcccagtgagatctgttgta

SEQ ID NO: 243724 - DNA, 25 bp, Homo sapien
cagtgagatctgttgtattctgaag

SEQ ID NO: 243725 - DNA, 25 bp, Homo sapien
gaagcactgtgtggccgacagcaac

SEQ ID NO: 243726 - DNA, 25 bp, Homo sapien
caacatcgtgcggtggttctggcaa

SEQ ID NO: 243727 - DNA, 25 bp, Homo sapien
gccaggctcctgcagtttgtgactg

SEQ ID NO: 243728 - DNA, 25 bp, Homo sapien
cagtttgtgactgggtccacgcgag

SEQ ID NO: 243729 - DNA, 25 bp, Homo sapien
gctccaaggcttcaaggctttgcaa

SEQ ID NO: 243730 - DNA, 25 bp, Homo sapien
catccacctgatagacgcgaacaca

SEQ ID NO: 243731 - DNA, 25 bp, Homo sapien
gcgaacacagacaaccttccgaagg

SEQ ID NO: 243732 - DNA, 25 bp, Homo sapien
atacctgctttaaccggatcgacat

SEQ ID NO: 243733 - DNA, 25 bp, Homo sapien
gatcgacattccaccatatgagtcc

SEQ ID NO: 243734 - DNA, 25 bp, Homo sapien
tatgagtcctatgagaagctctacg

SEQ ID NO: 243735 - DNA, 25 bp, Homo sapien
tctacgagaagctgctgacagccgt

SEQ ID NO: 243736 - DNA, 25 bp, Homo sapien
actcctgagctttggcatccatcac

SEQ ID NO: 243737 - DNA, 25 bp, Homo sapien
aggcccttcacctgtatatgtggat

SEQ ID NO: 243738 - DNA, 25 bp, Homo sapien
tcataaaacacgacggtgtccgcct

SEQ ID NO: 243739 - DNA, 25 bp, Homo sapien
gtgtccgcctctacaaggtttatac

SEQ ID NO: 243740 - DNA, 25 bp, Homo sapien
tatacctgtggtacggctgtgagtg

SEQ ID NO: 243741 - DNA, 25 bp, Homo sapien
atggcacaaaaaatccgcctgtctc

SEQ ID NO: 243742 - DNA, 25 bp, Homo sapien
gcctgtctctgttgaaactcctcat

SEQ ID NO: 243743 - DNA, 25 bp, Homo sapien
acctgtatatgtggatgtctttgca

SEQ ID NO: 243744 - DNA, 25 bp, Homo sapien
tgttgaaactcctcatcagttcctg

SEQ ID NO: 243745 - DNA, 25 bp, Homo sapien
tcactgctggcattttcatcgattc

SEQ ID NO: 243746 - DNA, 25 bp, Homo sapien
tgtctttgcatctcccgatcctatc

SEQ ID NO: 243747 - DNA, 25 bp, Homo sapien
cgtcacgtggcagctggagtaccca

SEQ ID NO: 243748 - DNA, 25 bp, Homo sapien
gaaatcctggtgtctgagcgggaca

SEQ ID NO: 243749 - DNA, 25 bp, Homo sapien
tgagcgggacatcagagcccttatc

SEQ ID NO: 243750 - DNA, 25 bp, Homo sapien
gacatcagagcccttatcccactgg

SEQ ID NO: 243751 - DNA, 25 bp, Homo sapien
gtgaatacagcaccactgactggag

SEQ ID NO: 243752 - DNA, 25 bp, Homo sapien
cactgactggagtgccccagcatgt

SEQ ID NO: 243753 - DNA, 25 bp, Homo sapien
ccgtgcgccttgtcactgtggacgg

SEQ ID NO: 243754 - DNA, 25 bp, Homo sapien
tgacagagcatgtcggctgcgagtc

SEQ ID NO: 243755 - DNA, 25 bp, Homo sapien
agcatgtcggctgcgagtctgccaa

SEQ ID NO: 243756 - DNA, 25 bp, Homo sapien
cgagtctgccaacacacaggtcctg

SEQ ID NO: 243757 - DNA, 25 bp, Homo sapien
ctgaggcctgtgatgccgtgttcgt

SEQ ID NO: 243758 - DNA, 25 bp, Homo sapien
ttcccggtgacccagatgaccacat

SEQ ID NO: 243759 - DNA, 25 bp, Homo sapien
ccggtgacccagatgaccacattta

SEQ ID NO: 243760 - DNA, 25 bp, Homo sapien
cggtgacccagatgaccacatttaa

SEQ ID NO: 243761 - DNA, 25 bp, Homo sapien
aggttgtgctcactgctctcccgta

SEQ ID NO: 243762 - DNA, 25 bp, Homo sapien
ttgtgctcactgctctcccgtatcg

SEQ ID NO: 243763 - DNA, 25 bp, Homo sapien
gctcactgctctcccgtatcgtgag

SEQ ID NO: 243764 - DNA, 25 bp, Homo sapien
tcccgtatcgtgagcaccacctctg

SEQ ID NO: 243765 - DNA, 25 bp, Homo sapien
ggaccccagcgcagtcccgggagat

SEQ ID NO: 243766 - DNA, 25 bp, Homo sapien
accccagcgcagtcccgggagatgg

SEQ ID NO: 243767 - DNA, 25 bp, Homo sapien
gcgcagtcccgggagatggcggaaa

SEQ ID NO: 243768 - DNA, 25 bp, Homo sapien
agatggcggaaagaaggcaccaggg

SEQ ID NO: 243769 - DNA, 25 bp, Homo sapien
ttcctttctttatttctgtagaatc

SEQ ID NO: 243770 - DNA, 25 bp, Homo sapien
atctattttatggttggcattttgg

SEQ ID NO: 243771 - DNA, 25 bp, Homo sapien
gaagatttcgatgggttccacattc

SEQ ID NO: 243772 - DNA, 25 bp, Homo sapien
gatgggttccacattcttgctttag

SEQ ID NO: 243773 - DNA, 25 bp, Homo sapien
ggttccacattcttgctttagttgt

SEQ ID NO: 243774 - DNA, 25 bp, Homo sapien
acattcttgctttagttgttgtaga

SEQ ID NO: 243775 - DNA, 25 bp, Homo sapien
gatttgggtgtttctacccaaggca

SEQ ID NO: 243776 - DNA, 25 bp, Homo sapien
ggtgtttctacccaaggcattggtc

SEQ ID NO: 243777 - DNA, 25 bp, Homo sapien
ggcattggtctagcttttcctacaa

SEQ ID NO: 243778 - DNA, 25 bp, Homo sapien
ggtctagcttttcctacaatgaacc

SEQ ID NO: 243779 - DNA, 25 bp, Homo sapien
tcctacaatgaacctatctttggag

SEQ ID NO: 243780 - DNA, 25 bp, Homo sapien
atgtgtgcccatacatgcttatgag

SEQ ID NO: 243781 - DNA, 25 bp, Homo sapien
gtgtgcccatacatgcttatgagga

SEQ ID NO: 243782 - DNA, 25 bp, Homo sapien
gcccatacatgcttatgaggaggtc

SEQ ID NO: 243783 - DNA, 25 bp, Homo sapien
catgcttatgaggaggtcagtgtgt

SEQ ID NO: 243784 - DNA, 25 bp, Homo sapien
aaccttggcttcaaaaatatctctc

SEQ ID NO: 243785 - DNA, 25 bp, Homo sapien
aatatctctcaaatactgtaaacaa

SEQ ID NO: 243786 - DNA, 25 bp, Homo sapien
ctgtaaacaatacctttgatacttt

SEQ ID NO: 243787 - DNA, 25 bp, Homo sapien
ttagaaagagattatggccaggcgt

SEQ ID NO: 243788 - DNA, 25 bp, Homo sapien
gaaagagattatggccaggcgtagt

SEQ ID NO: 243789 - DNA, 25 bp, Homo sapien
gggcagaccacctgaactcaggaat

SEQ ID NO: 243790 - DNA, 25 bp, Homo sapien
gcagaccacctgaactcaggaattt

SEQ ID NO: 243791 - DNA, 25 bp, Homo sapien
ggatgatctgggtcccattctggtc

SEQ ID NO: 243792 - DNA, 25 bp, Homo sapien
atctgggtcccattctggtcttaag

SEQ ID NO: 243793 - DNA, 25 bp, Homo sapien
tgggtcccattctggtcttaagacc

SEQ ID NO: 243794 - DNA, 25 bp, Homo sapien
cattctggtcttaagaccccaaaca

SEQ ID NO: 243795 - DNA, 25 bp, Homo sapien
gatctggagcctctatctggttagt

SEQ ID NO: 243796 - DNA, 25 bp, Homo sapien
gagcctctatctggttagtgtcgta

SEQ ID NO: 243797 - DNA, 25 bp, Homo sapien
gcctctatctggttagtgtcgtaac

SEQ ID NO: 243798 - DNA, 25 bp, Homo sapien
gttagtgtcgtaacctctgtgtgcc

SEQ ID NO: 243799 - DNA, 25 bp, Homo sapien
gaccttagaactgggtctagcaccc

SEQ ID NO: 243800 - DNA, 25 bp, Homo sapien
gaactgggtctagcacccgataaga

SEQ ID NO: 243801 - DNA, 25 bp, Homo sapien
gtctagcacccgataagagctcaat

SEQ ID NO: 243802 - DNA, 25 bp, Homo sapien
gttgaggaacattgatatggtgaaa

SEQ ID NO: 243803 - DNA, 25 bp, Homo sapien
tttttgcatgtgtatgtttctctga

SEQ ID NO: 243804 - DNA, 25 bp, Homo sapien
tttgcatgtgtatgtttctctgagt

SEQ ID NO: 243805 - DNA, 25 bp, Homo sapien
tgcatgtgtatgtttctctgagtgg

SEQ ID NO: 243806 - DNA, 25 bp, Homo sapien
ggagagatagtagtcttgtgtatgt

SEQ ID NO: 243807 - DNA, 25 bp, Homo sapien
agatagtagtcttgtgtatgtgtca

SEQ ID NO: 243808 - DNA, 25 bp, Homo sapien
atagtagtcttgtgtatgtgtcagg

SEQ ID NO: 243809 - DNA, 25 bp, Homo sapien
agtagtcttgtgtatgtgtcaggaa

SEQ ID NO: 243810 - DNA, 25 bp, Homo sapien
gttactagaattccccaagatgaat

SEQ ID NO: 243811 - DNA, 25 bp, Homo sapien
gtcattaaaacattgatatccttca

SEQ ID NO: 243812 - DNA, 25 bp, Homo sapien
taaaacattgatatccttcaaaatt

SEQ ID NO: 243813 - DNA, 25 bp, Homo sapien
cagacctggcggagttgatcgaaaa

SEQ ID NO: 243814 - DNA, 25 bp, Homo sapien
agggtcgtttaaagtcagacctcat

SEQ ID NO: 243815 - DNA, 25 bp, Homo sapien
aagtcagacctcattcttgagctta

SEQ ID NO: 243816 - DNA, 25 bp, Homo sapien
attcttgagcttaacgtcttatgtg

SEQ ID NO: 243817 - DNA, 25 bp, Homo sapien
acgtcttatgtggacagtgttgttt

SEQ ID NO: 243818 - DNA, 25 bp, Homo sapien
agtgttgttttggattgtgtgttgc

SEQ ID NO: 243819 - DNA, 25 bp, Homo sapien
gattgtgtgttgctcctgttgtgac

SEQ ID NO: 243820 - DNA, 25 bp, Homo sapien
gtgttgctcctgttgtgacatttct

SEQ ID NO: 243821 - DNA, 25 bp, Homo sapien
aagagcactgtcaggatgtccaggg

SEQ ID NO: 243822 - DNA, 25 bp, Homo sapien
actgtcaggatgtccagggcgatat

SEQ ID NO: 243823 - DNA, 25 bp, Homo sapien
gccatctccgttggcgtctaagtaa

SEQ ID NO: 243824 - DNA, 25 bp, Homo sapien
gacaaaagaagggagagccatctat

SEQ ID NO: 243825 - DNA, 25 bp, Homo sapien
aaagaagggagagccatctatgata

SEQ ID NO: 243826 - DNA, 25 bp, Homo sapien
gaagggagagccatctatgatatag

SEQ ID NO: 243827 - DNA, 25 bp, Homo sapien
gtgtaagaaaaaagctgtttaacat

SEQ ID NO: 243828 - DNA, 25 bp, Homo sapien
gtatcattttcatatccacttcccc

SEQ ID NO: 243829 - DNA, 25 bp, Homo sapien
tatcattttcatatccacttcccca

SEQ ID NO: 243830 - DNA, 25 bp, Homo sapien
tcatatccacttccccaccactgaa

SEQ ID NO: 243831 - DNA, 25 bp, Homo sapien
gacagtatgtatagtaatagtagct

SEQ ID NO: 243832 - DNA, 25 bp, Homo sapien
gtaatagtagcttgagtgaatatgc

SEQ ID NO: 243833 - DNA, 25 bp, Homo sapien
agtagcttgagtgaatatgcaaaag

SEQ ID NO: 243834 - DNA, 25 bp, Homo sapien
gcttgagtgaatatgcaaaagttta

SEQ ID NO: 243835 - DNA, 25 bp, Homo sapien
tagctgcctggattaatcagtatgg

SEQ ID NO: 243836 - DNA, 25 bp, Homo sapien
atcagtatgggaaacaatcttttgt

SEQ ID NO: 243837 - DNA, 25 bp, Homo sapien
atcttttgtaaatgcaaagctgttt

SEQ ID NO: 243838 - DNA, 25 bp, Homo sapien
agctgttttttgtatatactgttgg

SEQ ID NO: 243839 - DNA, 25 bp, Homo sapien
atactgttgggatttgcttcattgt

SEQ ID NO: 243840 - DNA, 25 bp, Homo sapien
gatttgcttcattgtttgacatcaa

SEQ ID NO: 243841 - DNA, 25 bp, Homo sapien
gttcgaaagagtgaatattttgcca

SEQ ID NO: 243842 - DNA, 25 bp, Homo sapien
ttcagttaaagtgcacagtctgtta

SEQ ID NO: 243843 - DNA, 25 bp, Homo sapien
gcacagtctgttacaggttgacaca

SEQ ID NO: 243844 - DNA, 25 bp, Homo sapien
gttacaggttgacacattgcttgac

SEQ ID NO: 243845 - DNA, 25 bp, Homo sapien
ttgacacattgcttgacctgattta

SEQ ID NO: 243846 - DNA, 25 bp, Homo sapien
tctcttctcatcttggcacttcaga

SEQ ID NO: 243847 - DNA, 25 bp, Homo sapien
agaagtctccccaatcttgacaaag

SEQ ID NO: 243848 - DNA, 25 bp, Homo sapien
ccgggcctcccgttgataagaatat

SEQ ID NO: 243849 - DNA, 25 bp, Homo sapien
atcactgcagataaatggaggtttc

SEQ ID NO: 243850 - DNA, 25 bp, Homo sapien
ggagggcctcctgttgataagatta

SEQ ID NO: 243851 - DNA, 25 bp, Homo sapien
gataagattattgtcactgcaggta

SEQ ID NO: 243852 - DNA, 25 bp, Homo sapien
gtcactgcaggtaaatggaggcttc

SEQ ID NO: 243853 - DNA, 25 bp, Homo sapien
ttgttacacatttgagtttgcaggc

SEQ ID NO: 243854 - DNA, 25 bp, Homo sapien
tgcaggcctaaggttactcccgcta

SEQ ID NO: 243855 - DNA, 25 bp, Homo sapien
ccgctacactatcatctgtaaccat

SEQ ID NO: 243856 - DNA, 25 bp, Homo sapien
gtaaccataacgcactcaacatttt

SEQ ID NO: 243857 - DNA, 25 bp, Homo sapien
atggcatcctgctcgtgtagccttc

SEQ ID NO: 243858 - DNA, 25 bp, Homo sapien
acgcgctgggcagaaaggctaccat

SEQ ID NO: 243859 - DNA, 25 bp, Homo sapien
taccatcaccgcactgagatcaaca

SEQ ID NO: 243860 - DNA, 25 bp, Homo sapien
atcaccgcactgagatcaacaagaa

SEQ ID NO: 243861 - DNA, 25 bp, Homo sapien
gatttataagattggccagggctac

SEQ ID NO: 243862 - DNA, 25 bp, Homo sapien
tggccagggctaccttatcaaggac

SEQ ID NO: 243863 - DNA, 25 bp, Homo sapien
agggctaccttatcaaggacggcaa

SEQ ID NO: 243864 - DNA, 25 bp, Homo sapien
ggacggcaagctgatcaagaacaat

SEQ ID NO: 243865 - DNA, 25 bp, Homo sapien
cctccactgactatgacctatctga

SEQ ID NO: 243866 - DNA, 25 bp, Homo sapien
cactgactatgacctatctgacaag

SEQ ID NO: 243867 - DNA, 25 bp, Homo sapien
gactatgacctatctgacaagagca

SEQ ID NO: 243868 - DNA, 25 bp, Homo sapien
gaatcactttggtgcatgaatggaa

SEQ ID NO: 243869 - DNA, 25 bp, Homo sapien
aaatgctcactccaagtccattcat

SEQ ID NO: 243870 - DNA, 25 bp, Homo sapien
tccaagtccattcatgaggtttact

SEQ ID NO: 243871 - DNA, 25 bp, Homo sapien
tgtgaggctactacgtggccagagt

SEQ ID NO: 243872 - DNA, 25 bp, Homo sapien
gaggtttactctactcttgtgtata

SEQ ID NO: 243873 - DNA, 25 bp, Homo sapien
tactcttgtgtatagcctctttggg

SEQ ID NO: 243874 - DNA, 25 bp, Homo sapien
gtagaactactagagtctttttcta

SEQ ID NO: 243875 - DNA, 25 bp, Homo sapien
gtggccagagtagtacttgaactta

SEQ ID NO: 243876 - DNA, 25 bp, Homo sapien
ttgaacttaagtgggctgtattaca

SEQ ID NO: 243877 - DNA, 25 bp, Homo sapien
gaactcatattcaatacacaatgct

SEQ ID NO: 243878 - DNA, 25 bp, Homo sapien
caatgctgtcattcaaagtggttgc

SEQ ID NO: 243879 - DNA, 25 bp, Homo sapien
cagcaggtacactggcaagcttgcc

SEQ ID NO: 243880 - DNA, 25 bp, Homo sapien
tggcaagcttgccaataccctgggc

SEQ ID NO: 243881 - DNA, 25 bp, Homo sapien
aataccctgggcaatgacgtcttca

SEQ ID NO: 243882 - DNA, 25 bp, Homo sapien
gggcaatgacgtcttcaatgttttt

SEQ ID NO: 243883 - DNA, 25 bp, Homo sapien
tgttttttccattcagctcactgat

SEQ ID NO: 243884 - DNA, 25 bp, Homo sapien
ttcagctcactgataaccttgttga

SEQ ID NO: 243885 - DNA, 25 bp, Homo sapien
ataaccttgttgagccggtcgtcgt

SEQ ID NO: 243886 - DNA, 25 bp, Homo sapien
tgagccggtcgtcgtccgcctcgat

SEQ ID NO: 243887 - DNA, 25 bp, Homo sapien
atacccacgctgtccaagatcttct

SEQ ID NO: 243888 - DNA, 25 bp, Homo sapien
aagatcttcttgatgtccttggcgc

SEQ ID NO: 243889 - DNA, 25 bp, Homo sapien
tcttcttgatgtccttggcgctggg

SEQ ID NO: 243890 - DNA, 25 bp, Homo sapien
ggctggccattaagcacgcactgcg

SEQ ID NO: 243891 - DNA, 25 bp, Homo sapien
attaagcacgcactgcgcaactgtt

SEQ ID NO: 243892 - DNA, 25 bp, Homo sapien
gcactgcgcaactgttttccagata

SEQ ID NO: 243893 - DNA, 25 bp, Homo sapien
gcaactgttttccagatacgggttt

SEQ ID NO: 243894 - DNA, 25 bp, Homo sapien
ccagatacgggtttatagcccatta

SEQ ID NO: 243895 - DNA, 25 bp, Homo sapien
tagcccattatttatatcggagcca

SEQ ID NO: 243896 - DNA, 25 bp, Homo sapien
tatcggagccataaacttgaacaat

SEQ ID NO: 243897 - DNA, 25 bp, Homo sapien
ggaatatcttatttttgcctgttga

SEQ ID NO: 243898 - DNA, 25 bp, Homo sapien
atatcttatttttgcctgttgagaa

SEQ ID NO: 243899 - DNA, 25 bp, Homo sapien
gagaatatctcccatttaacttctt

SEQ ID NO: 243900 - DNA, 25 bp, Homo sapien
tatctcccatttaacttcttttgaa

SEQ ID NO: 243901 - DNA, 25 bp, Homo sapien
gtcatacaaggagttgcacgcatat

SEQ ID NO: 243902 - DNA, 25 bp, Homo sapien
gagttgcacgcatatccaaaacaaa

SEQ ID NO: 243903 - DNA, 25 bp, Homo sapien
aatgatgtccatttatcagcccaga

SEQ ID NO: 243904 - DNA, 25 bp, Homo sapien
aatgtactggatactggtttagttc

SEQ ID NO: 243905 - DNA, 25 bp, Homo sapien
tggtttagttcagcctgtaggtgct

SEQ ID NO: 243906 - DNA, 25 bp, Homo sapien
ttccgacaaatccaagtcagttgca

SEQ ID NO: 243907 - DNA, 25 bp, Homo sapien
aaagatctaagtgttggctctacaa

SEQ ID NO: 243908 - DNA, 25 bp, Homo sapien
aagggaaaactccagacatatcacc

SEQ ID NO: 243909 - DNA, 25 bp, Homo sapien
aagtgttggctctacaagggaagaa

SEQ ID NO: 243910 - DNA, 25 bp, Homo sapien
ttttcctcctacaacaggtctagac

SEQ ID NO: 243911 - DNA, 25 bp, Homo sapien
acaggtctagacaacgtcatacaag

SEQ ID NO: 243912 - DNA, 25 bp, Homo sapien
gcctcgtaccgtaggtttcggacat

SEQ ID NO: 243913 - DNA, 25 bp, Homo sapien
cctcgtaccgtaggtttcggacatg

SEQ ID NO: 243914 - DNA, 25 bp, Homo sapien
tcgtaccgtaggtttcggacatggc

SEQ ID NO: 243915 - DNA, 25 bp, Homo sapien
taccgtaggtttcggacatggccgt

SEQ ID NO: 243916 - DNA, 25 bp, Homo sapien
taggtttcggacatggccgtctgcg

SEQ ID NO: 243917 - DNA, 25 bp, Homo sapien
ggtttcggacatggccgtctgcgac

SEQ ID NO: 243918 - DNA, 25 bp, Homo sapien
atggccgtctgcgacatcttgggag

SEQ ID NO: 243919 - DNA, 25 bp, Homo sapien
tggccgtctgcgacatcttgggagc

SEQ ID NO: 243920 - DNA, 25 bp, Homo sapien
ccgtctgcgacatcttgggagcggc

SEQ ID NO: 243921 - DNA, 25 bp, Homo sapien
cgacatcttgggagcggcgccgcct

SEQ ID NO: 243922 - DNA, 25 bp, Homo sapien
aagcccagacacctccgagatccgt

SEQ ID NO: 243923 - DNA, 25 bp, Homo sapien
atggccgtctgcgacatcttgggag

SEQ ID NO: 243924 - DNA, 25 bp, Homo sapien
tggccgtctgcgacatcttgggagc

SEQ ID NO: 243925 - DNA, 25 bp, Homo sapien
ggccgtctgcgacatcttgggagcg

SEQ ID NO: 243926 - DNA, 25 bp, Homo sapien
gccgtctgcgacatcttgggagcgg

SEQ ID NO: 243927 - DNA, 25 bp, Homo sapien
ccgtctgcgacatcttgggagcggc

SEQ ID NO: 243928 - DNA, 25 bp, Homo sapien
cgtctgcgacatcttgggagcggcg

SEQ ID NO: 243929 - DNA, 25 bp, Homo sapien
gtctgcgacatcttgggagcggcgc

SEQ ID NO: 243930 - DNA, 25 bp, Homo sapien
agcggcgccgcctctcgccgggtca

SEQ ID NO: 243931 - DNA, 25 bp, Homo sapien
actcgcccgcggtccgccggcgcgt

SEQ ID NO: 243932 - DNA, 25 bp, Homo sapien
tccgccggcgcgtctcggtggggaa

SEQ ID NO: 243933 - DNA, 25 bp, Homo sapien
gccggcgcgtctcggtggggaagga

SEQ ID NO: 243934 - DNA, 25 bp, Homo sapien
tggagaatttatctgggaaggcttc

SEQ ID NO: 243935 - DNA, 25 bp, Homo sapien
aaagaagtcagcttggagccagaat

SEQ ID NO: 243936 - DNA, 25 bp, Homo sapien
gtattctgattaatgagggacctgg

SEQ ID NO: 243937 - DNA, 25 bp, Homo sapien
gacctggagcattgtaggcttcgga

SEQ ID NO: 243938 - DNA, 25 bp, Homo sapien
taggcttcggagcacctttttggct

SEQ ID NO: 243939 - DNA, 25 bp, Homo sapien
gaaaggcctgagtctgaggtttaat

SEQ ID NO: 243940 - DNA, 25 bp, Homo sapien
atagatacagttttgttcctccttt

SEQ ID NO: 243941 - DNA, 25 bp, Homo sapien
ttcctcctttccctgtaattacctg

SEQ ID NO: 243942 - DNA, 25 bp, Homo sapien
taattacctggcctgagacactctc

SEQ ID NO: 243943 - DNA, 25 bp, Homo sapien
tcccactgtcacctgaggataggct

SEQ ID NO: 243944 - DNA, 25 bp, Homo sapien
gaggataggctgtatctagattcac

SEQ ID NO: 243945 - DNA, 25 bp, Homo sapien
atacacttactatggtcacattttg

SEQ ID NO: 243946 - DNA, 25 bp, Homo sapien
gaattatgattctcacagggtatat

SEQ ID NO: 243947 - DNA, 25 bp, Homo sapien
atatgtggccaattcttaatgtcat

SEQ ID NO: 243948 - DNA, 25 bp, Homo sapien
gtcattgggaatgctgtttcatttc

SEQ ID NO: 243949 - DNA, 25 bp, Homo sapien
ttcatttcaatcctcaaagttactg

SEQ ID NO: 243950 - DNA, 25 bp, Homo sapien
aatcctcaaagttactgtagcacag

SEQ ID NO: 243951 - DNA, 25 bp, Homo sapien
aaatatcacaatttcctgcagggac

SEQ ID NO: 243952 - DNA, 25 bp, Homo sapien
atttcctgcagggacattatcagta

SEQ ID NO: 243953 - DNA, 25 bp, Homo sapien
gacattatcagtaagttctgcaggg

SEQ ID NO: 243954 - DNA, 25 bp, Homo sapien
aaatcagtactctgcaattgtcact

SEQ ID NO: 243955 - DNA, 25 bp, Homo sapien
agtactctgcaattgtcactgttat

SEQ ID NO: 243956 - DNA, 25 bp, Homo sapien
acaggcggtgtgagcatccatgtgt

SEQ ID NO: 243957 - DNA, 25 bp, Homo sapien
gtgtgagcatccatgtgtggtcttg

SEQ ID NO: 243958 - DNA, 25 bp, Homo sapien
gtgtggtcttggtctaaaccagctc

SEQ ID NO: 243959 - DNA, 25 bp, Homo sapien
ggtctaaaccagctcttgaacaggt

SEQ ID NO: 243960 - DNA, 25 bp, Homo sapien
atgctgagcgttttgatcctagtaa

SEQ ID NO: 243961 - DNA, 25 bp, Homo sapien
tcaaatattgtccttctgcatatgt

SEQ ID NO: 243962 - DNA, 25 bp, Homo sapien
acattattaagctttcttgggtact

SEQ ID NO: 243963 - DNA, 25 bp, Homo sapien
ctttcttgggtactattttgctggg

SEQ ID NO: 243964 - DNA, 25 bp, Homo sapien
gctcttgcgtgaaggtggtacctgt

SEQ ID NO: 243965 - DNA, 25 bp, Homo sapien
ggtacctgtctcatgatccttaaaa

SEQ ID NO: 243966 - DNA, 25 bp, Homo sapien
aagagagaggcttttttcatccaaa

SEQ ID NO: 243967 - DNA, 25 bp, Homo sapien
ggccacagtgtgatcagagaaggac

SEQ ID NO: 243968 - DNA, 25 bp, Homo sapien
gacagccatagggagagggccacct

SEQ ID NO: 243969 - DNA, 25 bp, Homo sapien
gactgtgcccagcacgtagctgtga

SEQ ID NO: 243970 - DNA, 25 bp, Homo sapien
agcacgtagctgtgacctccccggg

SEQ ID NO: 243971 - DNA, 25 bp, Homo sapien
gtgccccggctcaaggtcagcgaga

SEQ ID NO: 243972 - DNA, 25 bp, Homo sapien
tcaaggtcagcgagatgcccatcac

SEQ ID NO: 243973 - DNA, 25 bp, Homo sapien
agctccagcactgagaccttgtcgt

SEQ ID NO: 243974 - DNA, 25 bp, Homo sapien
agcactgagaccttgtcgtccgtca

SEQ ID NO: 243975 - DNA, 25 bp, Homo sapien
agaccttgtcgtccgtcacagccag

SEQ ID NO: 243976 - DNA, 25 bp, Homo sapien
aggatggcaccaggctcctcggctg

SEQ ID NO: 243977 - DNA, 25 bp, Homo sapien
aggctcctcggctgagacggacagt

SEQ ID NO: 243978 - DNA, 25 bp, Homo sapien
tgtgagaccccgaccctctcgagga

SEQ ID NO: 243979 - DNA, 25 bp, Homo sapien
gtgagaccccgaccctctcgaggaa

SEQ ID NO: 243980 - DNA, 25 bp, Homo sapien
tctcgaggaaccctgcctgagacgc

SEQ ID NO: 243981 - DNA, 25 bp, Homo sapien
aaccctgcctgagacgcctccatta

SEQ ID NO: 243982 - DNA, 25 bp, Homo sapien
gcctccattaccactgcgcagtgag

SEQ ID NO: 243983 - DNA, 25 bp, Homo sapien
ctccattaccactgcgcagtgagat

SEQ ID NO: 243984 - DNA, 25 bp, Homo sapien
tccattaccactgcgcagtgagatg

SEQ ID NO: 243985 - DNA, 25 bp, Homo sapien
attaccactgcgcagtgagatgagg

SEQ ID NO: 243986 - DNA, 25 bp, Homo sapien
ttaccactgcgcagtgagatgaggg

SEQ ID NO: 243987 - DNA, 25 bp, Homo sapien
atgaggggactcacagttgccaaga

SEQ ID NO: 243988 - DNA, 25 bp, Homo sapien
gcgcacctgtgccttaatcttccct

SEQ ID NO: 243989 - DNA, 25 bp, Homo sapien
ggtagagatgaggacaagccggagt

SEQ ID NO: 243990 - DNA, 25 bp, Homo sapien
agggtctctgctagaagtcacctga

SEQ ID NO: 243991 - DNA, 25 bp, Homo sapien
gtctctgctagaagtcacctgatcc

SEQ ID NO: 243992 - DNA, 25 bp, Homo sapien
tctgctagaagtcacctgatcctgc

SEQ ID NO: 243993 - DNA, 25 bp, Homo sapien
gctagaagtcacctgatcctgcggg

SEQ ID NO: 243994 - DNA, 25 bp, Homo sapien
ctgcgggctgtcacggtatgacata

SEQ ID NO: 243995 - DNA, 25 bp, Homo sapien
cacggtatgacataggcagatttcc

SEQ ID NO: 243996 - DNA, 25 bp, Homo sapien
ttcccatctgacatggcagctcctg

SEQ ID NO: 243997 - DNA, 25 bp, Homo sapien
tctgggtgacttagctccgggttaa

SEQ ID NO: 243998 - DNA, 25 bp, Homo sapien
agctccgggttaacttccatcaggc

SEQ ID NO: 243999 - DNA, 25 bp, Homo sapien
gggttaacttccatcaggcccagtc

SEQ ID NO: 244000 - DNA, 25 bp, Homo sapien
gccacagctcaagagtattcagaaa

SEQ ID NO: 244001 - DNA, 25 bp, Homo sapien
taaaacacctgtgcagctagattta

SEQ ID NO: 244002 - DNA, 25 bp, Homo sapien
gggacatgttagctgctctggaaaa

SEQ ID NO: 244003 - DNA, 25 bp, Homo sapien
gcaagcaatgaaagcacggcaaatt

SEQ ID NO: 244004 - DNA, 25 bp, Homo sapien
ggcaaattactaacaccagacctct

SEQ ID NO: 244005 - DNA, 25 bp, Homo sapien
accagacctctgtcatatacagtgg

SEQ ID NO: 244006 - DNA, 25 bp, Homo sapien
atatacagtggttactgcagcttct

SEQ ID NO: 244007 - DNA, 25 bp, Homo sapien
gcttcttttcacactaaagactcta

SEQ ID NO: 244008 - DNA, 25 bp, Homo sapien
tttaaccaaaagtcagccctgtttg

SEQ ID NO: 244009 - DNA, 25 bp, Homo sapien
gccctgtttgacatcctttaattct

SEQ ID NO: 244010 - DNA, 25 bp, Homo sapien
taattctgtggacattgcttcttct

SEQ ID NO: 244011 - DNA, 25 bp, Homo sapien
aatggagacacggtgcacagctgct

SEQ ID NO: 244012 - DNA, 25 bp, Homo sapien
gtcatcgtttaagctcctcggtgct

SEQ ID NO: 244013 - DNA, 25 bp, Homo sapien
gcacagctgctccagagagacacat

SEQ ID NO: 244014 - DNA, 25 bp, Homo sapien
agagacacatctgggcagttacagt

SEQ ID NO: 244015 - DNA, 25 bp, Homo sapien
tgggcagttacagtccagcacagca

SEQ ID NO: 244016 - DNA, 25 bp, Homo sapien
ctttcagctcagtgaagggagtcaa

SEQ ID NO: 244017 - DNA, 25 bp, Homo sapien
gttggacagggcagctttggcctct

SEQ ID NO: 244018 - DNA, 25 bp, Homo sapien
gcagctttggcctctgagtcttggg

SEQ ID NO: 244019 - DNA, 25 bp, Homo sapien
tcggtgctcccaatgcatagtcaag

SEQ ID NO: 244020 - DNA, 25 bp, Homo sapien
ttgagagctactggcctggagccgt

SEQ ID NO: 244021 - DNA, 25 bp, Homo sapien
gtgccacctgcgtgttagatgtggt

SEQ ID NO: 244022 - DNA, 25 bp, Homo sapien
ggcggccaacttcactctccattaa

SEQ ID NO: 244023 - DNA, 25 bp, Homo sapien
ccccaacaaagactgtgcattcaat

SEQ ID NO: 244024 - DNA, 25 bp, Homo sapien
gactgtgcattcaataccttaatgg

SEQ ID NO: 244025 - DNA, 25 bp, Homo sapien
ataccttaatggaactcgaggtgga

SEQ ID NO: 244026 - DNA, 25 bp, Homo sapien
tcgaggtggagcttatgaaatttgt

SEQ ID NO: 244027 - DNA, 25 bp, Homo sapien
atttgtgtccaaagtgcggaatctt

SEQ ID NO: 244028 - DNA, 25 bp, Homo sapien
gcggaatcttaaacgtgccatggca

SEQ ID NO: 244029 - DNA, 25 bp, Homo sapien
tgcagatccataccatgtcacgatc

SEQ ID NO: 244030 - DNA, 25 bp, Homo sapien
atccataccatgtcacgatctgtga

SEQ ID NO: 244031 - DNA, 25 bp, Homo sapien
taccatgtcacgatctgtgaaatat

SEQ ID NO: 244032 - DNA, 25 bp, Homo sapien
aatggatttgtgtgtcaggagagaa

SEQ ID NO: 244033 - DNA, 25 bp, Homo sapien
gatcaaagtgtggaagtatccagta

SEQ ID NO: 244034 - DNA, 25 bp, Homo sapien
gtgtggaagtatccagtaatactgg

SEQ ID NO: 244035 - DNA, 25 bp, Homo sapien
agaaacatctaagcaagaaactgta

SEQ ID NO: 244036 - DNA, 25 bp, Homo sapien
aactgtagctgattttactcccaaa

SEQ ID NO: 244037 - DNA, 25 bp, Homo sapien
ctgtagctgattttactcccaaaaa

SEQ ID NO: 244038 - DNA, 25 bp, Homo sapien
aaacatacacttggaatacaaagga

SEQ ID NO: 244039 - DNA, 25 bp, Homo sapien
aagaggcaaagcaagcttttaaaga

SEQ ID NO: 244040 - DNA, 25 bp, Homo sapien
tattgaaagaaaagcgggtaccatc

SEQ ID NO: 244041 - DNA, 25 bp, Homo sapien
aagcgggtaccatcgaatgcttcat

SEQ ID NO: 244042 - DNA, 25 bp, Homo sapien
gggtaccatcgaatgcttcatggga

SEQ ID NO: 244043 - DNA, 25 bp, Homo sapien
catcgaatgcttcatgggagcaggc

SEQ ID NO: 244044 - DNA, 25 bp, Homo sapien
ggcttcctttgtgtgttctctggaa

SEQ ID NO: 244045 - DNA, 25 bp, Homo sapien
tgggatggcgtcgttgctgccccaa

SEQ ID NO: 244046 - DNA, 25 bp, Homo sapien
tttgtagggcagcgctgtgaacaat

SEQ ID NO: 244047 - DNA, 25 bp, Homo sapien
acaatggagccatcaaaaaggcctt

SEQ ID NO: 244048 - DNA, 25 bp, Homo sapien
cacggacattcctggcccaacaaga

SEQ ID NO: 244049 - DNA, 25 bp, Homo sapien
aacaagacctcctggccaggttttg

SEQ ID NO: 244050 - DNA, 25 bp, Homo sapien
tggccaggttttgagccctgcttcc

SEQ ID NO: 244051 - DNA, 25 bp, Homo sapien
acctgcctctactactgcaaatgat

SEQ ID NO: 244052 - DNA, 25 bp, Homo sapien
gcaaatgattggatattcgtctgac

SEQ ID NO: 244053 - DNA, 25 bp, Homo sapien
tggatattcgtctgacttggctctt

SEQ ID NO: 244054 - DNA, 25 bp, Homo sapien
gacttggctcttccctaatgtgtgg

SEQ ID NO: 244055 - DNA, 25 bp, Homo sapien
ctgaaatctgaatcctaatgagaaa

SEQ ID NO: 244056 - DNA, 25 bp, Homo sapien
ttaaattttgttggcacatcacacc

SEQ ID NO: 244057 - DNA, 25 bp, Homo sapien
ttgttggcacatcacaccttgaaag

SEQ ID NO: 244058 - DNA, 25 bp, Homo sapien
gttggcacatcacaccttgaaagta

SEQ ID NO: 244059 - DNA, 25 bp, Homo sapien
ggcacatcacaccttgaaagtattt

SEQ ID NO: 244060 - DNA, 25 bp, Homo sapien
cacaccttgaaagtatttgtattat

SEQ ID NO: 244061 - DNA, 25 bp, Homo sapien
aatgtcttaattgtaatgctctaat

SEQ ID NO: 244062 - DNA, 25 bp, Homo sapien
tagcaaaattagtgtgagttataac

SEQ ID NO: 244063 - DNA, 25 bp, Homo sapien
gtgagttataacatgaagggatttt

SEQ ID NO: 244064 - DNA, 25 bp, Homo sapien
catcttttgctgtatgaaggataat

SEQ ID NO: 244065 - DNA, 25 bp, Homo sapien
aataacagcttttttgcactatgta

SEQ ID NO: 244066 - DNA, 25 bp, Homo sapien
ttggtaaacaagctactgctcctgg

SEQ ID NO: 244067 - DNA, 25 bp, Homo sapien
tactgctcctggaactaatctaggt

SEQ ID NO: 244068 - DNA, 25 bp, Homo sapien
gaactaatctaggtcatcataaccc

SEQ ID NO: 244069 - DNA, 25 bp, Homo sapien
gtcatcataacccaaaatcttttga

SEQ ID NO: 244070 - DNA, 25 bp, Homo sapien
atcttttgaaatatgagagtcccaa

SEQ ID NO: 244071 - DNA, 25 bp, Homo sapien
gagtcccaattaagtctcttaggta

SEQ ID NO: 244072 - DNA, 25 bp, Homo sapien
agtatattttggttgctgtttggcc

SEQ ID NO: 244073 - DNA, 25 bp, Homo sapien
tttggttgctgtttggccatttggt

SEQ ID NO: 244074 - DNA, 25 bp, Homo sapien
ggccatttggtttatttgtaccttg

SEQ ID NO: 244075 - DNA, 25 bp, Homo sapien
gtcagtgggtaatcattgcagcaaa

SEQ ID NO: 244076 - DNA, 25 bp, Homo sapien
ttgctaggaatctcatgtaagtgga

SEQ ID NO: 244077 - DNA, 25 bp, Homo sapien
atggaatttcctggtcacttctcgt

SEQ ID NO: 244078 - DNA, 25 bp, Homo sapien
tggtcacttctcgtcatcattggtc

SEQ ID NO: 244079 - DNA, 25 bp, Homo sapien
cacttctcgtcatcattggtcattt

SEQ ID NO: 244080 - DNA, 25 bp, Homo sapien
attggtcatttcatgccaagtccca

SEQ ID NO: 244081 - DNA, 25 bp, Homo sapien
gtcatttcatgccaagtcccacaca

SEQ ID NO: 244082 - DNA, 25 bp, Homo sapien
cagctctggtcaggtccctggaaaa

SEQ ID NO: 244083 - DNA, 25 bp, Homo sapien
ggtcaggtccctggaaaagaaacag

SEQ ID NO: 244084 - DNA, 25 bp, Homo sapien
ctctgtccctcagctttgagcagag

SEQ ID NO: 244085 - DNA, 25 bp, Homo sapien
tgaccccaccctcaagtttcagaga

SEQ ID NO: 244086 - DNA, 25 bp, Homo sapien
aagtttcagagaccctaatgtccta

SEQ ID NO: 244087 - DNA, 25 bp, Homo sapien
agagaccctaatgtcctagggaatg

SEQ ID NO: 244088 - DNA, 25 bp, Homo sapien
cactgaactgttaagacctggcgag

SEQ ID NO: 244089 - DNA, 25 bp, Homo sapien
aagacctggcgagatcctttttata

SEQ ID NO: 244090 - DNA, 25 bp, Homo sapien
ggcgagatcctttttatagttcttt

SEQ ID NO: 244091 - DNA, 25 bp, Homo sapien
aggactttctgcttatcttcaggaa

SEQ ID NO: 244092 - DNA, 25 bp, Homo sapien
tcttcaggaaggacagtggaccttc

SEQ ID NO: 244093 - DNA, 25 bp, Homo sapien
aaatgtgtgatctgagccaaacgct

SEQ ID NO: 244094 - DNA, 25 bp, Homo sapien
gagccaaacgctcttcagctaactt

SEQ ID NO: 244095 - DNA, 25 bp, Homo sapien
tcttcagctaacttgatctcgcatc

SEQ ID NO: 244096 - DNA, 25 bp, Homo sapien
tgatctcgcatcattttcccagctt

SEQ ID NO: 244097 - DNA, 25 bp, Homo sapien
aattacttgaccaattttcatagca

SEQ ID NO: 244098 - DNA, 25 bp, Homo sapien
gaccaattttcatagcaaactgatt

SEQ ID NO: 244099 - DNA, 25 bp, Homo sapien
ttcacctgcctctactactgcaaat

SEQ ID NO: 244100 - DNA, 25 bp, Homo sapien
acctgcctctactactgcaaatgat

SEQ ID NO: 244101 - DNA, 25 bp, Homo sapien
gcctctactactgcaaatgattgga

SEQ ID NO: 244102 - DNA, 25 bp, Homo sapien
gcaaatgattggatattcgtctgac

SEQ ID NO: 244103 - DNA, 25 bp, Homo sapien
tgattggatattcgtctgacttggc

SEQ ID NO: 244104 - DNA, 25 bp, Homo sapien
attggatattcgtctgacttggctc

SEQ ID NO: 244105 - DNA, 25 bp, Homo sapien
tggatattcgtctgacttggctctt

SEQ ID NO: 244106 - DNA, 25 bp, Homo sapien
ggatattcgtctgacttggctcttc

SEQ ID NO: 244107 - DNA, 25 bp, Homo sapien
atattcgtctgacttggctcttccc

SEQ ID NO: 244108 - DNA, 25 bp, Homo sapien
gtctgacttggctcttccctaatgt

SEQ ID NO: 244109 - DNA, 25 bp, Homo sapien
gacttggctcttccctaatgtgtgg

SEQ ID NO: 244110 - DNA, 25 bp, Homo sapien
tgtgtacccgaggttctttccagtg

SEQ ID NO: 244111 - DNA, 25 bp, Homo sapien
gaaaccaggttagccttcgattcct

SEQ ID NO: 244112 - DNA, 25 bp, Homo sapien
ttttctttcatctgtggttggtcac

SEQ ID NO: 244113 - DNA, 25 bp, Homo sapien
ggttggtcacccttttgagagctct

SEQ ID NO: 244114 - DNA, 25 bp, Homo sapien
tgagagctctgaccccaaaagaagt

SEQ ID NO: 244115 - DNA, 25 bp, Homo sapien
aagtgtttttcagattggcccaagt

SEQ ID NO: 244116 - DNA, 25 bp, Homo sapien
acttctctgaagtggtgctgaaaac

SEQ ID NO: 244117 - DNA, 25 bp, Homo sapien
ggagctgtgggcctcctgattcctt

SEQ ID NO: 244118 - DNA, 25 bp, Homo sapien
tgtgttgatagcacggacctcactg

SEQ ID NO: 244119 - DNA, 25 bp, Homo sapien
gacctcactgagctgttaggagtag

SEQ ID NO: 244120 - DNA, 25 bp, Homo sapien
ggagtagctgtcgacactgtgtacc

SEQ ID NO: 244121 - DNA, 25 bp, Homo sapien
gacgcagacagtgccggcggctcgg

SEQ ID NO: 244122 - DNA, 25 bp, Homo sapien
ctctgagtgcctggacgccatggag

SEQ ID NO: 244123 - DNA, 25 bp, Homo sapien
atggaggagcccgaccatggtgccc

SEQ ID NO: 244124 - DNA, 25 bp, Homo sapien
ggagcccgaccatggtgccctgctg

SEQ ID NO: 244125 - DNA, 25 bp, Homo sapien
ccatggccagtctgtcatcacggtg

SEQ ID NO: 244126 - DNA, 25 bp, Homo sapien
gccagtctgtcatcacggtgatcgg

SEQ ID NO: 244127 - DNA, 25 bp, Homo sapien
cgaggagcactttgaggactacggt

SEQ ID NO: 244128 - DNA, 25 bp, Homo sapien
cactttgaggactacggtgaaggca

SEQ ID NO: 244129 - DNA, 25 bp, Homo sapien
agtgaggcggagctgtccccagaga

SEQ ID NO: 244130 - DNA, 25 bp, Homo sapien
agagaccctatgcaacgggcagctg

SEQ ID NO: 244131 - DNA, 25 bp, Homo sapien
ctcttgccgcaaagctgcacagcat

SEQ ID NO: 244132 - DNA, 25 bp, Homo sapien
gggtctttctcagcagaagttgttt

SEQ ID NO: 244133 - DNA, 25 bp, Homo sapien
gaagttgtttccaggtgtgctcaag

SEQ ID NO: 244134 - DNA, 25 bp, Homo sapien
gctcaagtgccttcctctagcagag

SEQ ID NO: 244135 - DNA, 25 bp, Homo sapien
acagggatgccaagagtagaccaga

SEQ ID NO: 244136 - DNA, 25 bp, Homo sapien
gtagaccagagctgggacccacaga

SEQ ID NO: 244137 - DNA, 25 bp, Homo sapien
gagctgggacccacagacagaacct

SEQ ID NO: 244138 - DNA, 25 bp, Homo sapien
tggtcaccttggattttagccggcc

SEQ ID NO: 244139 - DNA, 25 bp, Homo sapien
ttagccggcctctttctggctataa

SEQ ID NO: 244140 - DNA, 25 bp, Homo sapien
aagtcacttaccctgtctggatcaa

SEQ ID NO: 244141 - DNA, 25 bp, Homo sapien
taccctgtctggatcaacatttctc

SEQ ID NO: 244142 - DNA, 25 bp, Homo sapien
aacatttctcctgctgccaagtgtg

SEQ ID NO: 244143 - DNA, 25 bp, Homo sapien
gaggaggtcaacacccagcctagcc

SEQ ID NO: 244144 - DNA, 25 bp, Homo sapien
tgcctcttgggtcagccctccttga

SEQ ID NO: 244145 - DNA, 25 bp, Homo sapien
attcagggctgttccagagattcga

SEQ ID NO: 244146 - DNA, 25 bp, Homo sapien
gggctgttccagagattcgatcctc

SEQ ID NO: 244147 - DNA, 25 bp, Homo sapien
gagattcgatcctcttaaggcatta

SEQ ID NO: 244148 - DNA, 25 bp, Homo sapien
atcctcttaaggcattatcagtgag

SEQ ID NO: 244149 - DNA, 25 bp, Homo sapien
tggttcacatgccttgtagctaagt

SEQ ID NO: 244150 - DNA, 25 bp, Homo sapien
atgccttgtagctaagtctttctgc

SEQ ID NO: 244151 - DNA, 25 bp, Homo sapien
gctaagtctttctgcaaacaacctc

SEQ ID NO: 244152 - DNA, 25 bp, Homo sapien
ttccccccgtcgagtcatttggtga

SEQ ID NO: 244153 - DNA, 25 bp, Homo sapien
ggatttctggttatgtcaaggctct

SEQ ID NO: 244154 - DNA, 25 bp, Homo sapien
atgctgcccttgtattttcttatct

SEQ ID NO: 244155 - DNA, 25 bp, Homo sapien
tttcttatctgtacccagtgtaact

SEQ ID NO: 244156 - DNA, 25 bp, Homo sapien
tatctgtacccagtgtaactacacg

SEQ ID NO: 244157 - DNA, 25 bp, Homo sapien
gtaactacacgtttactggaactgt

SEQ ID NO: 244158 - DNA, 25 bp, Homo sapien
ctggaactgtgtttttaagactgac

SEQ ID NO: 244159 - DNA, 25 bp, Homo sapien
gactgacagttgtttataatggatt

SEQ ID NO: 244160 - DNA, 25 bp, Homo sapien
gtcgtaagtgccaaaaagtctcagt

SEQ ID NO: 244161 - DNA, 25 bp, Homo sapien
gtgccaaaaagtctcagttgatatt

SEQ ID NO: 244162 - DNA, 25 bp, Homo sapien
caaatgacttgaccttaatgttata

SEQ ID NO: 244163 - DNA, 25 bp, Homo sapien
attggaggcagacttgatatttcag

SEQ ID NO: 244164 - DNA, 25 bp, Homo sapien
gatatttcagagttgcatagtaaaa

SEQ ID NO: 244165 - DNA, 25 bp, Homo sapien
ccccttacacaatatggcgattcca

SEQ ID NO: 244166 - DNA, 25 bp, Homo sapien
tctgccacagccattaaagaaatgg

SEQ ID NO: 244167 - DNA, 25 bp, Homo sapien
tgagttaaaaactacctacagtact

SEQ ID NO: 244168 - DNA, 25 bp, Homo sapien
aaaagagcaggtctgtcagttttac

SEQ ID NO: 244169 - DNA, 25 bp, Homo sapien
tcagttttacaggtgacttctacca

SEQ ID NO: 244170 - DNA, 25 bp, Homo sapien
acaatatggcgattccaggaccctg

SEQ ID NO: 244171 - DNA, 25 bp, Homo sapien
aggtgacttctaccaaatattgcaa

SEQ ID NO: 244172 - DNA, 25 bp, Homo sapien
atatggcgattccaggaccctgttc

SEQ ID NO: 244173 - DNA, 25 bp, Homo sapien
agcacagccatctgcatctattctg

SEQ ID NO: 244174 - DNA, 25 bp, Homo sapien
agccatctgcatctattctgactgg

SEQ ID NO: 244175 - DNA, 25 bp, Homo sapien
ccatctgcatctattctgactggca

SEQ ID NO: 244176 - DNA, 25 bp, Homo sapien
gacgcagacagtgccggcggctcgg

SEQ ID NO: 244177 - DNA, 25 bp, Homo sapien
gcggctcggccgtgccctctgagtg

SEQ ID NO: 244178 - DNA, 25 bp, Homo sapien
cctctgagtgcctggacgccatgga

SEQ ID NO: 244179 - DNA, 25 bp, Homo sapien
ctctgagtgcctggacgccatggag

SEQ ID NO: 244180 - DNA, 25 bp, Homo sapien
atggaggagcccgaccatggtgccc

SEQ ID NO: 244181 - DNA, 25 bp, Homo sapien
tggaggagcccgaccatggtgccct

SEQ ID NO: 244182 - DNA, 25 bp, Homo sapien
ggagcccgaccatggtgccctgctg

SEQ ID NO: 244183 - DNA, 25 bp, Homo sapien
agagaccctatgcaacgggcagctg

SEQ ID NO: 244184 - DNA, 25 bp, Homo sapien
gagaccctatgcaacgggcagctgg

SEQ ID NO: 244185 - DNA, 25 bp, Homo sapien
agaccctatgcaacgggcagctggg

SEQ ID NO: 244186 - DNA, 25 bp, Homo sapien
cctatgcaacgggcagctgggctgc

SEQ ID NO: 244187 - DNA, 25 bp, Homo sapien
ttgctatcttccctatgtattggac

SEQ ID NO: 244188 - DNA, 25 bp, Homo sapien
tatcttccctatgtattggacactg

SEQ ID NO: 244189 - DNA, 25 bp, Homo sapien
tccctatgtattggacactgtatgc

SEQ ID NO: 244190 - DNA, 25 bp, Homo sapien
gtattggacactgtatgcaaacacc

SEQ ID NO: 244191 - DNA, 25 bp, Homo sapien
ggacactgtatgcaaacaccagaag

SEQ ID NO: 244192 - DNA, 25 bp, Homo sapien
atgcaaacaccagaagtacttaaca

SEQ ID NO: 244193 - DNA, 25 bp, Homo sapien
gtacttaacaagtagtggtttcttg

SEQ ID NO: 244194 - DNA, 25 bp, Homo sapien
gatttttagatatgtctgtagcctc

SEQ ID NO: 244195 - DNA, 25 bp, Homo sapien
agatatgtctgtagcctcttagccc

SEQ ID NO: 244196 - DNA, 25 bp, Homo sapien
atgtctgtagcctcttagccctttt

SEQ ID NO: 244197 - DNA, 25 bp, Homo sapien
tctgtagcctcttagcccttttgcc

SEQ ID NO: 244198 - DNA, 25 bp, Homo sapien
aggccaaccaaccagctgctgacag

SEQ ID NO: 244199 - DNA, 25 bp, Homo sapien
atggcggccaagacagaccctgttc

SEQ ID NO: 244200 - DNA, 25 bp, Homo sapien
ggggacctggccattctcaggacaa

SEQ ID NO: 244201 - DNA, 25 bp, Homo sapien
caggacaagagaatgcaggcaggca

SEQ ID NO: 244202 - DNA, 25 bp, Homo sapien
caccctgtcatgtgtgattccaggc

SEQ ID NO: 244203 - DNA, 25 bp, Homo sapien
atgtgtgattccaggcaccagggca

SEQ ID NO: 244204 - DNA, 25 bp, Homo sapien
attccaggcaccagggcaggcccag

SEQ ID NO: 244205 - DNA, 25 bp, Homo sapien
agacagaccctgttccttcgaggaa

SEQ ID NO: 244206 - DNA, 25 bp, Homo sapien
agaccctgttccttcgaggaatggg

SEQ ID NO: 244207 - DNA, 25 bp, Homo sapien
gtgaggatgaggacaactccaccct

SEQ ID NO: 244208 - DNA, 25 bp, Homo sapien
ggatgaggacaactccaccctcctt

SEQ ID NO: 244209 - DNA, 25 bp, Homo sapien
ttctatgttggtgttgtgggcctac

SEQ ID NO: 244210 - DNA, 25 bp, Homo sapien
tgttggtgttgtgggcctacagtaa

SEQ ID NO: 244211 - DNA, 25 bp, Homo sapien
tgtctccagagtcataccgtgcaca

SEQ ID NO: 244212 - DNA, 25 bp, Homo sapien
tacagtaagtagtggaagcgtggtt

SEQ ID NO: 244213 - DNA, 25 bp, Homo sapien
ggaagcgtggttaaccaatcctgaa

SEQ ID NO: 244214 - DNA, 25 bp, Homo sapien
gttaaccaatcctgaagctacacca

SEQ ID NO: 244215 - DNA, 25 bp, Homo sapien
gaagctacaccacagtagcaataat

SEQ ID NO: 244216 - DNA, 25 bp, Homo sapien
gatgcagtagaaaatgttggattcc

SEQ ID NO: 244217 - DNA, 25 bp, Homo sapien
gtcataccgtgcacacttagtctaa

SEQ ID NO: 244218 - DNA, 25 bp, Homo sapien
cacttagtctaactctatgagctga

SEQ ID NO: 244219 - DNA, 25 bp, Homo sapien
ctctatgagctgacccttattacca

SEQ ID NO: 244220 - DNA, 25 bp, Homo sapien
gtatagatacacatttgtccagcct

SEQ ID NO: 244221 - DNA, 25 bp, Homo sapien
tacacatttgtccagccttagtagc

SEQ ID NO: 244222 - DNA, 25 bp, Homo sapien
cagccttagtagctattgccaatta

SEQ ID NO: 244223 - DNA, 25 bp, Homo sapien
tttctagttttaccagtttgcccat

SEQ ID NO: 244224 - DNA, 25 bp, Homo sapien
agtttgcccattcctagcgcatgaa

SEQ ID NO: 244225 - DNA, 25 bp, Homo sapien
attcctagcgcatgaactcccattg

SEQ ID NO: 244226 - DNA, 25 bp, Homo sapien
gaactcccattgctgcatatcatta

SEQ ID NO: 244227 - DNA, 25 bp, Homo sapien
gctgcatatcattatcgatgcttga

SEQ ID NO: 244228 - DNA, 25 bp, Homo sapien
tcgatgcttgacatgtctgttttgt

SEQ ID NO: 244229 - DNA, 25 bp, Homo sapien
ggcagagacactctttgtggttata

SEQ ID NO: 244230 - DNA, 25 bp, Homo sapien
acactctttgtggttataatttgca

SEQ ID NO: 244231 - DNA, 25 bp, Homo sapien
aattaggtccagttgccctgttaat

SEQ ID NO: 244232 - DNA, 25 bp, Homo sapien
ttaggtccagttgccctgttaatgg

SEQ ID NO: 244233 - DNA, 25 bp, Homo sapien
acattttaaatgactcagtttgttt

SEQ ID NO: 244234 - DNA, 25 bp, Homo sapien
tttttcctgggcgagtttgcaatgt

SEQ ID NO: 244235 - DNA, 25 bp, Homo sapien
tttcctgggcgagtttgcaatgtga

SEQ ID NO: 244236 - DNA, 25 bp, Homo sapien
gcaatgtgataatcagattttttaa

SEQ ID NO: 244237 - DNA, 25 bp, Homo sapien
aaagtatgaaccacagttaactagt

SEQ ID NO: 244238 - DNA, 25 bp, Homo sapien
cagttaactagtggtctcaggggta

SEQ ID NO: 244239 - DNA, 25 bp, Homo sapien
gatcagtttggacaagtcttggtat

SEQ ID NO: 244240 - DNA, 25 bp, Homo sapien
accgaattaggtccagttgccctgt

SEQ ID NO: 244241 - DNA, 25 bp, Homo sapien
gaattaggtccagttgccctgttaa

SEQ ID NO: 244242 - DNA, 25 bp, Homo sapien
gggaaggacaccctcactcccacac

SEQ ID NO: 244243 - DNA, 25 bp, Homo sapien
caccccgggaagaacactagaacat

SEQ ID NO: 244244 - DNA, 25 bp, Homo sapien
cccgggaagaacactagaacatcag

SEQ ID NO: 244245 - DNA, 25 bp, Homo sapien
cgggaagaacactagaacatcagca

SEQ ID NO: 244246 - DNA, 25 bp, Homo sapien
ctcaataaggagatgccttgttctt

SEQ ID NO: 244247 - DNA, 25 bp, Homo sapien
ataaggagatgccttgttcttttca

SEQ ID NO: 244248 - DNA, 25 bp, Homo sapien
aataacatgcccagcaaaaacttgc

SEQ ID NO: 244249 - DNA, 25 bp, Homo sapien
aacatgcccagcaaaaacttgcttt

SEQ ID NO: 244250 - DNA, 25 bp, Homo sapien
atgcccagcaaaaacttgctttatg

SEQ ID NO: 244251 - DNA, 25 bp, Homo sapien
cccagcaaaaacttgctttatgggt

SEQ ID NO: 244252 - DNA, 25 bp, Homo sapien
tttatgggtctgcctggagaaaaaa

SEQ ID NO: 244253 - DNA, 25 bp, Homo sapien
gctcagggtcactgaaccactgctt

SEQ ID NO: 244254 - DNA, 25 bp, Homo sapien
tcttttgaaagtagagctagctgcc

SEQ ID NO: 244255 - DNA, 25 bp, Homo sapien
aagtagagctagctgccactttcac

SEQ ID NO: 244256 - DNA, 25 bp, Homo sapien
agagctagctgccactttcacgtgg

SEQ ID NO: 244257 - DNA, 25 bp, Homo sapien
tttcacgtggcctccgcagtgtctc

SEQ ID NO: 244258 - DNA, 25 bp, Homo sapien
ctgccacactgatggctcaagacaa

SEQ ID NO: 244259 - DNA, 25 bp, Homo sapien
tcccagaaacatctctggcccagaa

SEQ ID NO: 244260 - DNA, 25 bp, Homo sapien
ccagaaacatctctggcccagaaag

SEQ ID NO: 244261 - DNA, 25 bp, Homo sapien
gagcaaaagagggtttattttcagt

SEQ ID NO: 244262 - DNA, 25 bp, Homo sapien
cctctctctgggtcagaaccagagg

SEQ ID NO: 244263 - DNA, 25 bp, Homo sapien
tctctgggtcagaaccagagggcat

SEQ ID NO: 244264 - DNA, 25 bp, Homo sapien
agggctcatgttctctactggatta

SEQ ID NO: 244265 - DNA, 25 bp, Homo sapien
ctgaaatctccaccctgatgattgg

SEQ ID NO: 244266 - DNA, 25 bp, Homo sapien
caccctgatgattggaatgaaacgg

SEQ ID NO: 244267 - DNA, 25 bp, Homo sapien
aacggagtgaacatgagcccagctg

SEQ ID NO: 244268 - DNA, 25 bp, Homo sapien
ggagtgaacatgagcccagctgaga

SEQ ID NO: 244269 - DNA, 25 bp, Homo sapien
caggaatgtgtgaaaaacagctgct

SEQ ID NO: 244270 - DNA, 25 bp, Homo sapien
ttgagccctctgtcttgctctctct

SEQ ID NO: 244271 - DNA, 25 bp, Homo sapien
ttctcttaccagagcatctgtttgc

SEQ ID NO: 244272 - DNA, 25 bp, Homo sapien
accagagcatctgtttgcagaggta

SEQ ID NO: 244273 - DNA, 25 bp, Homo sapien
ttgcagaggtaacattaccttcccc

SEQ ID NO: 244274 - DNA, 25 bp, Homo sapien
tccccagccacaggtatgtggaata

SEQ ID NO: 244275 - DNA, 25 bp, Homo sapien
ggctctggccagcaaaagacccaag

SEQ ID NO: 244276 - DNA, 25 bp, Homo sapien
ttgggctccacgaagaagtctgctg

SEQ ID NO: 244277 - DNA, 25 bp, Homo sapien
agacccaagtctgactactcattca

SEQ ID NO: 244278 - DNA, 25 bp, Homo sapien
aagtctgactactcattcagtccct

SEQ ID NO: 244279 - DNA, 25 bp, Homo sapien
gactactcattcagtccctcattat

SEQ ID NO: 244280 - DNA, 25 bp, Homo sapien
tagttaccgaacttctccaaatctc

SEQ ID NO: 244281 - DNA, 25 bp, Homo sapien
gaatgggaacaaatctacctccttc

SEQ ID NO: 244282 - DNA, 25 bp, Homo sapien
ggaacaaatctacctccttccacgt

SEQ ID NO: 244283 - DNA, 25 bp, Homo sapien
tccttccacgtcaacaaacactttt

SEQ ID NO: 244284 - DNA, 25 bp, Homo sapien
ttattttgtgtcttccggcatctgg

SEQ ID NO: 244285 - DNA, 25 bp, Homo sapien
tccggcatctggaatggaataagaa

SEQ ID NO: 244286 - DNA, 25 bp, Homo sapien
tttacagagctgttgcatgacttat

SEQ ID NO: 244287 - DNA, 25 bp, Homo sapien
gagctgttgcatgacttatgttacc

SEQ ID NO: 244288 - DNA, 25 bp, Homo sapien
gcatgacttatgttaccatcctaaa

SEQ ID NO: 244289 - DNA, 25 bp, Homo sapien
attgtctttttatgaattaggcttt

SEQ ID NO: 244290 - DNA, 25 bp, Homo sapien
aggctttttgaacatcctgtgttgg

SEQ ID NO: 244291 - DNA, 25 bp, Homo sapien
tgaacatcctgtgttgggatttttt

SEQ ID NO: 244292 - DNA, 25 bp, Homo sapien
tttcaattggcaacaaaagctctgt

SEQ ID NO: 244293 - DNA, 25 bp, Homo sapien
caaaagctctgtagggctgcagaca

SEQ ID NO: 244294 - DNA, 25 bp, Homo sapien
ggctgcagacatttaaagttcacat

SEQ ID NO: 244295 - DNA, 25 bp, Homo sapien
gttcacataatcatctgtaagacat

SEQ ID NO: 244296 - DNA, 25 bp, Homo sapien
ttttcctgattttgccattatatgg

SEQ ID NO: 244297 - DNA, 25 bp, Homo sapien
tgattcctgatagctcactggcaac

SEQ ID NO: 244298 - DNA, 25 bp, Homo sapien
agctcactggcaactgtaccaaggt

SEQ ID NO: 244299 - DNA, 25 bp, Homo sapien
caaggtggccactgtatcatctact

SEQ ID NO: 244300 - DNA, 25 bp, Homo sapien
tgtatcatctactgatccttctgca

SEQ ID NO: 244301 - DNA, 25 bp, Homo sapien
acctagcactcttggctccagataa

SEQ ID NO: 244302 - DNA, 25 bp, Homo sapien
cttggctccagataacgcacagaaa

SEQ ID NO: 244303 - DNA, 25 bp, Homo sapien
agaaacctattttctcaccagctgt

SEQ ID NO: 244304 - DNA, 25 bp, Homo sapien
tcaccagctgtcatttcttctaggg

SEQ ID NO: 244305 - DNA, 25 bp, Homo sapien
gctgtcatttcttctagggcatgca

SEQ ID NO: 244306 - DNA, 25 bp, Homo sapien
caatatcagttctttacctgtgcat

SEQ ID NO: 244307 - DNA, 25 bp, Homo sapien
aaaaacacagatccaattcgtgtct

SEQ ID NO: 244308 - DNA, 25 bp, Homo sapien
ggtatgatttagtaatatgccagaa

SEQ ID NO: 244309 - DNA, 25 bp, Homo sapien
ttatgcatgttgtttactgagctct

SEQ ID NO: 244310 - DNA, 25 bp, Homo sapien
gtttactgagctctagtcagtcctt

SEQ ID NO: 244311 - DNA, 25 bp, Homo sapien
agctctagtcagtcctttctggcgg

SEQ ID NO: 244312 - DNA, 25 bp, Homo sapien
ttcagttactttttgtcttgtgtcc

SEQ ID NO: 244313 - DNA, 25 bp, Homo sapien
ttgtcttgtgtccatatttgttttg

SEQ ID NO: 244314 - DNA, 25 bp, Homo sapien
attctcaggactcatacaactcact

SEQ ID NO: 244315 - DNA, 25 bp, Homo sapien
tatttgttttgtggtgacccaccta

SEQ ID NO: 244316 - DNA, 25 bp, Homo sapien
tggtgacccacctaaacagattttt

SEQ ID NO: 244317 - DNA, 25 bp, Homo sapien
gactcatacaactcactgtcaatgg

SEQ ID NO: 244318 - DNA, 25 bp, Homo sapien
ataataggtgatccttctcaagctt

SEQ ID NO: 244319 - DNA, 25 bp, Homo sapien
tacttaccttgtccaaaaaggtcat

SEQ ID NO: 244320 - DNA, 25 bp, Homo sapien
taccttgtccaaaaaggtcataaag

SEQ ID NO: 244321 - DNA, 25 bp, Homo sapien
gttccacctctgtactatatttctc

SEQ ID NO: 244322 - DNA, 25 bp, Homo sapien
ttccacctctgtactatatttctcc

SEQ ID NO: 244323 - DNA, 25 bp, Homo sapien
acctctgtactatatttctccccaa

SEQ ID NO: 244324 - DNA, 25 bp, Homo sapien
tctgtactatatttctccccaacaa

SEQ ID NO: 244325 - DNA, 25 bp, Homo sapien
ctgtactatatttctccccaacaaa

SEQ ID NO: 244326 - DNA, 25 bp, Homo sapien
gtactatatttctccccaacaaata

SEQ ID NO: 244327 - DNA, 25 bp, Homo sapien
tatttctccccaacaaatatctgcc

SEQ ID NO: 244328 - DNA, 25 bp, Homo sapien
cccaacaaatatctgcccctgagga

SEQ ID NO: 244329 - DNA, 25 bp, Homo sapien
ccaacaaatatctgcccctgaggac

SEQ ID NO: 244330 - DNA, 25 bp, Homo sapien
tggaagatactagcccagcctagca

SEQ ID NO: 244331 - DNA, 25 bp, Homo sapien
aagatactagcccagcctagcagaa

SEQ ID NO: 244332 - DNA, 25 bp, Homo sapien
gcctagcagaaaagtgcaatatgta

SEQ ID NO: 244333 - DNA, 25 bp, Homo sapien
gcaatatgtatagcatactttgaca

SEQ ID NO: 244334 - DNA, 25 bp, Homo sapien
aacatgatagtccataaccattttg

SEQ ID NO: 244335 - DNA, 25 bp, Homo sapien
tgctgggcaaactacatgaagttat

SEQ ID NO: 244336 - DNA, 25 bp, Homo sapien
aattcacagctaatcaggcattttg

SEQ ID NO: 244337 - DNA, 25 bp, Homo sapien
aatgttgatttttactgtgaaaagg

SEQ ID NO: 244338 - DNA, 25 bp, Homo sapien
taagatatacacaccctagtttaat

SEQ ID NO: 244339 - DNA, 25 bp, Homo sapien
caccctagtttaatgttgtgtcttg

SEQ ID NO: 244340 - DNA, 25 bp, Homo sapien
ggatttacagatttactacaggtat

SEQ ID NO: 244341 - DNA, 25 bp, Homo sapien
ttctgatatcacttttgttaatttg

SEQ ID NO: 244342 - DNA, 25 bp, Homo sapien
gtggtgccaccgcagactaaaagca

SEQ ID NO: 244343 - DNA, 25 bp, Homo sapien
gaaggtgtggatcaccttcctgaat

SEQ ID NO: 244344 - DNA, 25 bp, Homo sapien
ttttgggtacatttctttgcggaag

SEQ ID NO: 244345 - DNA, 25 bp, Homo sapien
atttctttgcggaagattggctgag

SEQ ID NO: 244346 - DNA, 25 bp, Homo sapien
attggctgagatgtggttcacggca

SEQ ID NO: 244347 - DNA, 25 bp, Homo sapien
ttgcggatcacgttgtctgtacact

SEQ ID NO: 244348 - DNA, 25 bp, Homo sapien
gcagatataagtcaagtgctactga

SEQ ID NO: 244349 - DNA, 25 bp, Homo sapien
agtgctactgacttaagtttggcaa

SEQ ID NO: 244350 - DNA, 25 bp, Homo sapien
agtttggcaaaatcactcctcacag

SEQ ID NO: 244351 - DNA, 25 bp, Homo sapien
tcacagcccgctctgttttagaaat

SEQ ID NO: 244352 - DNA, 25 bp, Homo sapien
gagtgtggaaggaggctaggaagtc

SEQ ID NO: 244353 - DNA, 25 bp, Homo sapien
gtgcagtaggtgagcagacctcttg

SEQ ID NO: 244354 - DNA, 25 bp, Homo sapien
agtaggtgagcagacctcttgctgc

SEQ ID NO: 244355 - DNA, 25 bp, Homo sapien
catgcaaatctgatacacctggcgc

SEQ ID NO: 244356 - DNA, 25 bp, Homo sapien
atgcaaatctgatacacctggcgca

SEQ ID NO: 244357 - DNA, 25 bp, Homo sapien
tgcaaatctgatacacctggcgcat

SEQ ID NO: 244358 - DNA, 25 bp, Homo sapien
gcaaatctgatacacctggcgcatc

SEQ ID NO: 244359 - DNA, 25 bp, Homo sapien
caaatctgatacacctggcgcatcc

SEQ ID NO: 244360 - DNA, 25 bp, Homo sapien
aaatctgatacacctggcgcatcct

SEQ ID NO: 244361 - DNA, 25 bp, Homo sapien
aatctgatacacctggcgcatcctc

SEQ ID NO: 244362 - DNA, 25 bp, Homo sapien
atctgatacacctggcgcatcctct

SEQ ID NO: 244363 - DNA, 25 bp, Homo sapien
aacttgtatatccattcatcatttc

SEQ ID NO: 244364 - DNA, 25 bp, Homo sapien
catttcacctgcaaatattttatca

SEQ ID NO: 244365 - DNA, 25 bp, Homo sapien
gcatttgttcctctaaagattataa

SEQ ID NO: 244366 - DNA, 25 bp, Homo sapien
agatgtaatttgtctgctttcccaa

SEQ ID NO: 244367 - DNA, 25 bp, Homo sapien
gtctgctttcccaaggaaaagcatt

SEQ ID NO: 244368 - DNA, 25 bp, Homo sapien
acattaatgatttcttggatctcac

SEQ ID NO: 244369 - DNA, 25 bp, Homo sapien
cttggatctcacactctattgtagt

SEQ ID NO: 244370 - DNA, 25 bp, Homo sapien
tcacactctattgtagtatttctgt

SEQ ID NO: 244371 - DNA, 25 bp, Homo sapien
gtagctaaacaattataacatggtg

SEQ ID NO: 244372 - DNA, 25 bp, Homo sapien
taacatggtggagagtatactataa

SEQ ID NO: 244373 - DNA, 25 bp, Homo sapien
aagttatgtataaagtctcatggga

SEQ ID NO: 244374 - DNA, 25 bp, Homo sapien
gtttgtctggattggctataacatg

SEQ ID NO: 244375 - DNA, 25 bp, Homo sapien
tctggattggctataacatgtcttt

SEQ ID NO: 244376 - DNA, 25 bp, Homo sapien
catgtctttcagcattaggctttta

SEQ ID NO: 244377 - DNA, 25 bp, Homo sapien
gtctttcagcattaggcttttaaga

SEQ ID NO: 244378 - DNA, 25 bp, Homo sapien
tctttactaaagatatcagagctct

SEQ ID NO: 244379 - DNA, 25 bp, Homo sapien
atcagagctcttaatgttgcttaga

SEQ ID NO: 244380 - DNA, 25 bp, Homo sapien
aatgttgcttagatgagggtgactg

SEQ ID NO: 244381 - DNA, 25 bp, Homo sapien
agggtgactgtcaagtacaagcaag

SEQ ID NO: 244382 - DNA, 25 bp, Homo sapien
gactgtcaagtacaagcaagactgg

SEQ ID NO: 244383 - DNA, 25 bp, Homo sapien
agcaagactgggaccttagaaatca

SEQ ID NO: 244384 - DNA, 25 bp, Homo sapien
atcattgtagaaacacagttttgaa

SEQ ID NO: 244385 - DNA, 25 bp, Homo sapien
caagaaccggttcaacacgtccacg

SEQ ID NO: 244386 - DNA, 25 bp, Homo sapien
cgagacggccgggaagcacgagagg

SEQ ID NO: 244387 - DNA, 25 bp, Homo sapien
acgaccaccgactcgaaaaccatgt

SEQ ID NO: 244388 - DNA, 25 bp, Homo sapien
accgactcgaaaaccatgttcctca

SEQ ID NO: 244389 - DNA, 25 bp, Homo sapien
tcgaaaaccatgttcctcagccgtg

SEQ ID NO: 244390 - DNA, 25 bp, Homo sapien
aaaccatgttcctcagccgtggtgg

SEQ ID NO: 244391 - DNA, 25 bp, Homo sapien
tcgagagtaacacgcttccctgcag

SEQ ID NO: 244392 - DNA, 25 bp, Homo sapien
taacacgcttccctgcagataagag

SEQ ID NO: 244393 - DNA, 25 bp, Homo sapien
acacgcttccctgcagataagagtt

SEQ ID NO: 244394 - DNA, 25 bp, Homo sapien
ggcggcctccttacctttccagatg

SEQ ID NO: 244395 - DNA, 25 bp, Homo sapien
ttacctttccagatgcccagagaga

SEQ ID NO: 244396 - DNA, 25 bp, Homo sapien
attttgtatcgattcagagagagga

SEQ ID NO: 244397 - DNA, 25 bp, Homo sapien
ggaaaactgcattcccatagacagg

SEQ ID NO: 244398 - DNA, 25 bp, Homo sapien
catagacagggagacttggtgcatt

SEQ ID NO: 244399 - DNA, 25 bp, Homo sapien
gggagacttggtgcattaatatcca

SEQ ID NO: 244400 - DNA, 25 bp, Homo sapien
aaaagtggctttcatttgtgttctc

SEQ ID NO: 244401 - DNA, 25 bp, Homo sapien
tctctggaagattctcagtagtcct

SEQ ID NO: 244402 - DNA, 25 bp, Homo sapien
agattctcagtagtcctgtgggcat

SEQ ID NO: 244403 - DNA, 25 bp, Homo sapien
cagtagtcctgtgggcatgtgaaca

SEQ ID NO: 244404 - DNA, 25 bp, Homo sapien
cctgtgggcatgtgaacaagagcat

SEQ ID NO: 244405 - DNA, 25 bp, Homo sapien
agagcatgtgtaatcttcataatgt

SEQ ID NO: 244406 - DNA, 25 bp, Homo sapien
ttcataatgtatgtcttgttagcag

SEQ ID NO: 244407 - DNA, 25 bp, Homo sapien
aggcaaaactatgttagccttgcaa

SEQ ID NO: 244408 - DNA, 25 bp, Homo sapien
aactatgttagccttgcaactctgt

SEQ ID NO: 244409 - DNA, 25 bp, Homo sapien
atgttagccttgcaactctgtgaat

SEQ ID NO: 244410 - DNA, 25 bp, Homo sapien
tagccttgcaactctgtgaatcctt

SEQ ID NO: 244411 - DNA, 25 bp, Homo sapien
cttgcaactctgtgaatcctttctt

SEQ ID NO: 244412 - DNA, 25 bp, Homo sapien
ctctgtgaatcctttcttattccac

SEQ ID NO: 244413 - DNA, 25 bp, Homo sapien
gtgaatcctttcttattccacagct

SEQ ID NO: 244414 - DNA, 25 bp, Homo sapien
ctttcttattccacagctccagaat

SEQ ID NO: 244415 - DNA, 25 bp, Homo sapien
tcttattccacagctccagaatggg

SEQ ID NO: 244416 - DNA, 25 bp, Homo sapien
gggatatgtactgtatctgggagtt

SEQ ID NO: 244417 - DNA, 25 bp, Homo sapien
ctgtatctgggagttgattttcata

SEQ ID NO: 244418 - DNA, 25 bp, Homo sapien
accttctcatatatcttgtggctta

SEQ ID NO: 244419 - DNA, 25 bp, Homo sapien
tcatccccacagagttgcttacaca

SEQ ID NO: 244420 - DNA, 25 bp, Homo sapien
gggaatcaactagactgttctcaaa

SEQ ID NO: 244421 - DNA, 25 bp, Homo sapien
gacactaagctactgttcaaattgc

SEQ ID NO: 244422 - DNA, 25 bp, Homo sapien
caaattgctattaactgaagtcact

SEQ ID NO: 244423 - DNA, 25 bp, Homo sapien
ttaaattgtgaccagctttaccact

SEQ ID NO: 244424 - DNA, 25 bp, Homo sapien
ttcttagaacaaacctcccctatat

SEQ ID NO: 244425 - DNA, 25 bp, Homo sapien
aaacctcccctatatctatcaaagt

SEQ ID NO: 244426 - DNA, 25 bp, Homo sapien
atcaaagttgaactgcagcttattt

SEQ ID NO: 244427 - DNA, 25 bp, Homo sapien
aaaatgtaactgtaggctggactca

SEQ ID NO: 244428 - DNA, 25 bp, Homo sapien
ggactcagcaacttacacctgtaat

SEQ ID NO: 244429 - DNA, 25 bp, Homo sapien
gttttcctatcttcaccttattctt

SEQ ID NO: 244430 - DNA, 25 bp, Homo sapien
ccttattcttctactatattctccc

SEQ ID NO: 244431 - DNA, 25 bp, Homo sapien
taaattcacatcattctcccagtac

SEQ ID NO: 244432 - DNA, 25 bp, Homo sapien
agtactaggatttctgctttctgga

SEQ ID NO: 244433 - DNA, 25 bp, Homo sapien
ttttatcctattcaacagactcttg

SEQ ID NO: 244434 - DNA, 25 bp, Homo sapien
cagactcttgaaagcctctgagagt

SEQ ID NO: 244435 - DNA, 25 bp, Homo sapien
gcctctgagagttcttactttctta

SEQ ID NO: 244436 - DNA, 25 bp, Homo sapien
ttatacatctcactcaaagctcttg

SEQ ID NO: 244437 - DNA, 25 bp, Homo sapien
caaagctcttgatctaccagtatgt

SEQ ID NO: 244438 - DNA, 25 bp, Homo sapien
aaaaccttggctttcagtggtgctc

SEQ ID NO: 244439 - DNA, 25 bp, Homo sapien
ctttcagtggtgctctctcttttac

SEQ ID NO: 244440 - DNA, 25 bp, Homo sapien
gctgtgcctgcgaggccaagttgcc

SEQ ID NO: 244441 - DNA, 25 bp, Homo sapien
accctgcggagctaggaggcgcgag

SEQ ID NO: 244442 - DNA, 25 bp, Homo sapien
ggcgcgagcagagaacgtgtgtgtt

SEQ ID NO: 244443 - DNA, 25 bp, Homo sapien
aggagaactcggcttttgaaatgtt

SEQ ID NO: 244444 - DNA, 25 bp, Homo sapien
gaaatgttctttctcgatagtaata

SEQ ID NO: 244445 - DNA, 25 bp, Homo sapien
atagtaataatgtgggctgccagcc

SEQ ID NO: 244446 - DNA, 25 bp, Homo sapien
atcttgcacactttttgggtgtgta

SEQ ID NO: 244447 - DNA, 25 bp, Homo sapien
atatatgtacatagccagagagtca

SEQ ID NO: 244448 - DNA, 25 bp, Homo sapien
acatagccagagagtcatgccacgt

SEQ ID NO: 244449 - DNA, 25 bp, Homo sapien
tagccagagagtcatgccacgtggt

SEQ ID NO: 244450 - DNA, 25 bp, Homo sapien
cgtggtcattaaaccgatgatgatt

SEQ ID NO: 244451 - DNA, 25 bp, Homo sapien
ttccgagtgcagtcctggcgcagca

SEQ ID NO: 244452 - DNA, 25 bp, Homo sapien
caccccgggaagaacactagaacat

SEQ ID NO: 244453 - DNA, 25 bp, Homo sapien
cgggaagaacactagaacatcagca

SEQ ID NO: 244454 - DNA, 25 bp, Homo sapien
ccctatgtgtgtttccctcaataag

SEQ ID NO: 244455 - DNA, 25 bp, Homo sapien
ctcaataaggagatgccttgttctt

SEQ ID NO: 244456 - DNA, 25 bp, Homo sapien
ataaggagatgccttgttcttttca

SEQ ID NO: 244457 - DNA, 25 bp, Homo sapien
agatgccttgttcttttcaccatgc

SEQ ID NO: 244458 - DNA, 25 bp, Homo sapien
ataacatgcccagcaaaaacttgct

SEQ ID NO: 244459 - DNA, 25 bp, Homo sapien
atgcccagcaaaaacttgctttatg

SEQ ID NO: 244460 - DNA, 25 bp, Homo sapien
caaaaacttgctttatgggtctgcc

SEQ ID NO: 244461 - DNA, 25 bp, Homo sapien
gctttatgggtctgcctggagaaaa

SEQ ID NO: 244462 - DNA, 25 bp, Homo sapien
gatgttactttgataccaagtgtat

SEQ ID NO: 244463 - DNA, 25 bp, Homo sapien
gataccaagtgtatgggagtcattg

SEQ ID NO: 244464 - DNA, 25 bp, Homo sapien
gactgggattaagctgatggccacc

SEQ ID NO: 244465 - DNA, 25 bp, Homo sapien
gccacccctttacttgctggaaatt

SEQ ID NO: 244466 - DNA, 25 bp, Homo sapien
gctggaaattaatgccggctatttt

SEQ ID NO: 244467 - DNA, 25 bp, Homo sapien
ttccttaagtcccagtacccagata

SEQ ID NO: 244468 - DNA, 25 bp, Homo sapien
ttaagtcccagtacccagatagaag

SEQ ID NO: 244469 - DNA, 25 bp, Homo sapien
gtcccagtacccagatagaagtgat

SEQ ID NO: 244470 - DNA, 25 bp, Homo sapien
tacccagatagaagtgatttgtgat

SEQ ID NO: 244471 - DNA, 25 bp, Homo sapien
gaaatatcttaagggctcactgagg

SEQ ID NO: 244472 - DNA, 25 bp, Homo sapien
atcttaagggctcactgaggctcag

SEQ ID NO: 244473 - DNA, 25 bp, Homo sapien
aacgcggccaccctgagtctggtga

SEQ ID NO: 244474 - DNA, 25 bp, Homo sapien
accctgagtctggtgagtcgactgc

SEQ ID NO: 244475 - DNA, 25 bp, Homo sapien
gactgcggcggcctgtgtccgaagt

SEQ ID NO: 244476 - DNA, 25 bp, Homo sapien
gcctgcgttcccacgtttggaaacg

SEQ ID NO: 244477 - DNA, 25 bp, Homo sapien
gagcttcgtcgatttgtgtttacat

SEQ ID NO: 244478 - DNA, 25 bp, Homo sapien
gtgtttacatcatcgactatgccag

SEQ ID NO: 244479 - DNA, 25 bp, Homo sapien
atcgactatgccagggagttctcca

SEQ ID NO: 244480 - DNA, 25 bp, Homo sapien
ggagttctccagataagcctggttt

SEQ ID NO: 244481 - DNA, 25 bp, Homo sapien
ttcgtcagtgaaaaggccttaccgt

SEQ ID NO: 244482 - DNA, 25 bp, Homo sapien
ggccttaccgtataactgactttat

SEQ ID NO: 244483 - DNA, 25 bp, Homo sapien
ataactgactttatgcttgccctgc

SEQ ID NO: 244484 - DNA, 25 bp, Homo sapien
gtacatcatcaccactagtaactgt

SEQ ID NO: 244485 - DNA, 25 bp, Homo sapien
taactgtggaccctgcatgtctcaa

SEQ ID NO: 244486 - DNA, 25 bp, Homo sapien
accctgcatgtctcaaaccttggaa

SEQ ID NO: 244487 - DNA, 25 bp, Homo sapien
ctcaaaccttggaaacagtatcatt

SEQ ID NO: 244488 - DNA, 25 bp, Homo sapien
gtactttttatcaaactgctgaaaa

SEQ ID NO: 244489 - DNA, 25 bp, Homo sapien
acccagttttgtaaagatatgttgt

SEQ ID NO: 244490 - DNA, 25 bp, Homo sapien
gtagtttatgtgatgtccaacaggt

SEQ ID NO: 244491 - DNA, 25 bp, Homo sapien
acaggtgttgctatgtttttctcaa

SEQ ID NO: 244492 - DNA, 25 bp, Homo sapien
aatattgtgtggcacccatgttaat

SEQ ID NO: 244493 - DNA, 25 bp, Homo sapien
tgttaatttgctaaggtgccctgct

SEQ ID NO: 244494 - DNA, 25 bp, Homo sapien
atttgctaaggtgccctgctacaca

SEQ ID NO: 244495 - DNA, 25 bp, Homo sapien
tgtgaggtttcctaaactggaactg

SEQ ID NO: 244496 - DNA, 25 bp, Homo sapien
tttcctaaactggaactggacccag

SEQ ID NO: 244497 - DNA, 25 bp, Homo sapien
aactggaactggacccaggatgctt

SEQ ID NO: 244498 - DNA, 25 bp, Homo sapien
gaactggacccaggatgctttgcag

SEQ ID NO: 244499 - DNA, 25 bp, Homo sapien
actggacccaggatgctttgcagca

SEQ ID NO: 244500 - DNA, 25 bp, Homo sapien
tggacccaggatgctttgcagcaac

SEQ ID NO: 244501 - DNA, 25 bp, Homo sapien
gacccaggatgctttgcagcaacgc

SEQ ID NO: 244502 - DNA, 25 bp, Homo sapien
aggatgctttgcagcaacgccctag

SEQ ID NO: 244503 - DNA, 25 bp, Homo sapien
ggatgctttgcagcaacgccctagg

SEQ ID NO: 244504 - DNA, 25 bp, Homo sapien
tttgcagtgaatgtccaaatgcctg

SEQ ID NO: 244505 - DNA, 25 bp, Homo sapien
aaatgcctgtgtcatcttgtcccgt

SEQ ID NO: 244506 - DNA, 25 bp, Homo sapien
caaagatatcaaatgcctacgcgag

SEQ ID NO: 244507 - DNA, 25 bp, Homo sapien
aaatgcctacgcgagaggatctggg

SEQ ID NO: 244508 - DNA, 25 bp, Homo sapien
gggcttccacttcgaatgcatgtac

SEQ ID NO: 244509 - DNA, 25 bp, Homo sapien
tcgaatgcatgtacgctgtcagcca

SEQ ID NO: 244510 - DNA, 25 bp, Homo sapien
tacgctgtcagccatcagtacaata

SEQ ID NO: 244511 - DNA, 25 bp, Homo sapien
aaacatcggtggagctttctttgcc

SEQ ID NO: 244512 - DNA, 25 bp, Homo sapien
taatgatttccctcacagctaggtc

SEQ ID NO: 244513 - DNA, 25 bp, Homo sapien
acagctaggtccagtttatgacaaa

SEQ ID NO: 244514 - DNA, 25 bp, Homo sapien
gttgttttgaagacacccagtacta

SEQ ID NO: 244515 - DNA, 25 bp, Homo sapien
agctttctttgcctttcgatgaaga

SEQ ID NO: 244516 - DNA, 25 bp, Homo sapien
aaattaagccattcagcgacggagg

SEQ ID NO: 244517 - DNA, 25 bp, Homo sapien
atttcattctcctaacatctcaagg

SEQ ID NO: 244518 - DNA, 25 bp, Homo sapien
aatccagataattgacctctccttc

SEQ ID NO: 244519 - DNA, 25 bp, Homo sapien
gacctctccttctattggtatgcaa

SEQ ID NO: 244520 - DNA, 25 bp, Homo sapien
gctagagcaatgatagtcctccggt

SEQ ID NO: 244521 - DNA, 25 bp, Homo sapien
atagtcctccggtagagccttagac

SEQ ID NO: 244522 - DNA, 25 bp, Homo sapien
gagccttagacattgtgtttattgc

SEQ ID NO: 244523 - DNA, 25 bp, Homo sapien
gtttattgcattcctgttccaccca

SEQ ID NO: 244524 - DNA, 25 bp, Homo sapien
actgcattccggatactccaactta

SEQ ID NO: 244525 - DNA, 25 bp, Homo sapien
tccaacttacttccaacacacatat

SEQ ID NO: 244526 - DNA, 25 bp, Homo sapien
caacacacatatgcaggcgtctcta

SEQ ID NO: 244527 - DNA, 25 bp, Homo sapien
tatgcaggcgtctctaaaattccgg

SEQ ID NO: 244528 - DNA, 25 bp, Homo sapien
ttgggtaagccactttagatttttg

SEQ ID NO: 244529 - DNA, 25 bp, Homo sapien
agatttttgggctgcagttttctca

SEQ ID NO: 244530 - DNA, 25 bp, Homo sapien
ggctgcagttttctcaggtaattag

SEQ ID NO: 244531 - DNA, 25 bp, Homo sapien
ggttcacaattctttgagtctcttt

SEQ ID NO: 244532 - DNA, 25 bp, Homo sapien
atatgtgccctcctctcaatcaagg

SEQ ID NO: 244533 - DNA, 25 bp, Homo sapien
aatggtgcagtctttgagctgtatc

SEQ ID NO: 244534 - DNA, 25 bp, Homo sapien
tgcctttcctaaaacgttcatgggt

SEQ ID NO: 244535 - DNA, 25 bp, Homo sapien
ctttgagctgtatccagttggcatt

SEQ ID NO: 244536 - DNA, 25 bp, Homo sapien
gttggcattattctcttggactaaa

SEQ ID NO: 244537 - DNA, 25 bp, Homo sapien
tagtattaacttcctcactttgggt

SEQ ID NO: 244538 - DNA, 25 bp, Homo sapien
taacttcctcactttgggtaagcca

SEQ ID NO: 244539 - DNA, 25 bp, Homo sapien
aagatgccaactggctgcgaatgct

SEQ ID NO: 244540 - DNA, 25 bp, Homo sapien
gatgccaactggctgcgaatgctct

SEQ ID NO: 244541 - DNA, 25 bp, Homo sapien
atgccaactggctgcgaatgctcta

SEQ ID NO: 244542 - DNA, 25 bp, Homo sapien
tgccaactggctgcgaatgctctat

SEQ ID NO: 244543 - DNA, 25 bp, Homo sapien
gccaactggctgcgaatgctctatc

SEQ ID NO: 244544 - DNA, 25 bp, Homo sapien
tccatttctgatagtgcccttgctc

SEQ ID NO: 244545 - DNA, 25 bp, Homo sapien
ccatttctgatagtgcccttgctct

SEQ ID NO: 244546 - DNA, 25 bp, Homo sapien
catttctgatagtgcccttgctctt

SEQ ID NO: 244547 - DNA, 25 bp, Homo sapien
atttctgatagtgcccttgctcttc

SEQ ID NO: 244548 - DNA, 25 bp, Homo sapien
tctgatagtgcccttgctcttctgt

SEQ ID NO: 244549 - DNA, 25 bp, Homo sapien
tgatagtgcccttgctcttctgtct

SEQ ID NO: 244550 - DNA, 25 bp, Homo sapien
cagtgggaggtaatttaatcctcgg

SEQ ID NO: 244551 - DNA, 25 bp, Homo sapien
gcggctacctccgtgctgttctcgt

SEQ ID NO: 244552 - DNA, 25 bp, Homo sapien
gggcttttccctcttgttcggcact

SEQ ID NO: 244553 - DNA, 25 bp, Homo sapien
ttttccctcttgttcggcacttcct

SEQ ID NO: 244554 - DNA, 25 bp, Homo sapien
tcttgttcggcacttcctgctgcca

SEQ ID NO: 244555 - DNA, 25 bp, Homo sapien
gcacttcctgctgccacgtggagaa

SEQ ID NO: 244556 - DNA, 25 bp, Homo sapien
acttcctgctgccacgtggagaagg

SEQ ID NO: 244557 - DNA, 25 bp, Homo sapien
ctgccacgtggagaagggtgtgttt

SEQ ID NO: 244558 - DNA, 25 bp, Homo sapien
acaaatccctagttgatagggtttg

SEQ ID NO: 244559 - DNA, 25 bp, Homo sapien
gaattgttcccgtaatccccacgtg

SEQ ID NO: 244560 - DNA, 25 bp, Homo sapien
tgttcccgtaatccccacgtgacat

SEQ ID NO: 244561 - DNA, 25 bp, Homo sapien
agaccggtgccagtgcgggtcctct

SEQ ID NO: 244562 - DNA, 25 bp, Homo sapien
gtgccagtgcgggtcctctgtatgc

SEQ ID NO: 244563 - DNA, 25 bp, Homo sapien
ccagtgcgggtcctctgtatgctga

SEQ ID NO: 244564 - DNA, 25 bp, Homo sapien
ggtcctctgtatgctgagcgccagt

SEQ ID NO: 244565 - DNA, 25 bp, Homo sapien
tcctctgtatgctgagcgccagtcc

SEQ ID NO: 244566 - DNA, 25 bp, Homo sapien
ccttgaacttacttgtgacacagat

SEQ ID NO: 244567 - DNA, 25 bp, Homo sapien
tgccacattcctcttgctgagatag

SEQ ID NO: 244568 - DNA, 25 bp, Homo sapien
gccacattcctcttgctgagatagt

SEQ ID NO: 244569 - DNA, 25 bp, Homo sapien
cacattcctcttgctgagatagtga

SEQ ID NO: 244570 - DNA, 25 bp, Homo sapien
cattcctcttgctgagatagtgaaa

SEQ ID NO: 244571 - DNA, 25 bp, Homo sapien
tcctcttgctgagatagtgaaaata

SEQ ID NO: 244572 - DNA, 25 bp, Homo sapien
cccaagctctcctgggtcttggagg

SEQ ID NO: 244573 - DNA, 25 bp, Homo sapien
aatgaattggcattgcaggaaagac

SEQ ID NO: 244574 - DNA, 25 bp, Homo sapien
aaagacaggtaaagtgattgctgca

SEQ ID NO: 244575 - DNA, 25 bp, Homo sapien
gattgctgcaatgagaaggagctgt

SEQ ID NO: 244576 - DNA, 25 bp, Homo sapien
aggagctgtgcggaaaaggaataaa

SEQ ID NO: 244577 - DNA, 25 bp, Homo sapien
gccgtggagagaggagcttgccctt

SEQ ID NO: 244578 - DNA, 25 bp, Homo sapien
ggtcctggttcctgaagagctcacc

SEQ ID NO: 244579 - DNA, 25 bp, Homo sapien
tggttcctgaagagctcacccagag

SEQ ID NO: 244580 - DNA, 25 bp, Homo sapien
tcctgaagagctcacccagagaggc

SEQ ID NO: 244581 - DNA, 25 bp, Homo sapien
aaagcagccttttgtcccagctcag

SEQ ID NO: 244582 - DNA, 25 bp, Homo sapien
tttgatctacacctcttgccacctt

SEQ ID NO: 244583 - DNA, 25 bp, Homo sapien
tttcccctagcttggtactagtcct

SEQ ID NO: 244584 - DNA, 25 bp, Homo sapien
tggtactagtccttttatttctgcc

SEQ ID NO: 244585 - DNA, 25 bp, Homo sapien
atttctgcctgtgattatattttaa

SEQ ID NO: 244586 - DNA, 25 bp, Homo sapien
gctgttttcagatatattgccttgt

SEQ ID NO: 244587 - DNA, 25 bp, Homo sapien
taagtggcttgctttgcttactctg

SEQ ID NO: 244588 - DNA, 25 bp, Homo sapien
tgctttgcttactctggttttccat

SEQ ID NO: 244589 - DNA, 25 bp, Homo sapien
gttttccatcctcattcctggatat

SEQ ID NO: 244590 - DNA, 25 bp, Homo sapien
aatcaagattgcagtaggctaacaa

SEQ ID NO: 244591 - DNA, 25 bp, Homo sapien
attgccttgtatcttcgttctttcg

SEQ ID NO: 244592 - DNA, 25 bp, Homo sapien
tctttcgtctcctatcctttttaga

SEQ ID NO: 244593 - DNA, 25 bp, Homo sapien
gtttctctttcagcctgacttacaa

SEQ ID NO: 244594 - DNA, 25 bp, Homo sapien
tggcgtgcaaccaagcctcctgaat

SEQ ID NO: 244595 - DNA, 25 bp, Homo sapien
gaatccaattcacagcgagcacatt

SEQ ID NO: 244596 - DNA, 25 bp, Homo sapien
gagcacattgtcacaagtactcaga

SEQ ID NO: 244597 - DNA, 25 bp, Homo sapien
gactatcagacagtgcagcgctaca

SEQ ID NO: 244598 - DNA, 25 bp, Homo sapien
agtgcagcgctacaggaaataccta

SEQ ID NO: 244599 - DNA, 25 bp, Homo sapien
ggaaatacctacactgcagtctaaa

SEQ ID NO: 244600 - DNA, 25 bp, Homo sapien
aaccctgttgatattgggcttaagt

SEQ ID NO: 244601 - DNA, 25 bp, Homo sapien
aagcctgaaggtcgactgttgtcaa

SEQ ID NO: 244602 - DNA, 25 bp, Homo sapien
ctgttgtcaaattctatctgtgctg

SEQ ID NO: 244603 - DNA, 25 bp, Homo sapien
ctgtgctgaacattaactttttgga

SEQ ID NO: 244604 - DNA, 25 bp, Homo sapien
gggtgtatgtattttgccagatctt

SEQ ID NO: 244605 - DNA, 25 bp, Homo sapien
gattacgggcaagtttttattagag

SEQ ID NO: 244606 - DNA, 25 bp, Homo sapien
ttacgggcaagtttttattagagat

SEQ ID NO: 244607 - DNA, 25 bp, Homo sapien
tacgggcaagtttttattagagatg

SEQ ID NO: 244608 - DNA, 25 bp, Homo sapien
gcccggcctgaactctcagttctaa

SEQ ID NO: 244609 - DNA, 25 bp, Homo sapien
ccggcctgaactctcagttctaacg

SEQ ID NO: 244610 - DNA, 25 bp, Homo sapien
cggcctgaactctcagttctaacgc

SEQ ID NO: 244611 - DNA, 25 bp, Homo sapien
ggcctgaactctcagttctaacgca

SEQ ID NO: 244612 - DNA, 25 bp, Homo sapien
gcctgaactctcagttctaacgcag

SEQ ID NO: 244613 - DNA, 25 bp, Homo sapien
actctcagttctaacgcagggattc

SEQ ID NO: 244614 - DNA, 25 bp, Homo sapien
ctctcagttctaacgcagggattca

SEQ ID NO: 244615 - DNA, 25 bp, Homo sapien
tctcagttctaacgcagggattcag

SEQ ID NO: 244616 - DNA, 25 bp, Homo sapien
gacacctccccaaacatgaatgaca

SEQ ID NO: 244617 - DNA, 25 bp, Homo sapien
atgaatgacaacatcctgttgcctg

SEQ ID NO: 244618 - DNA, 25 bp, Homo sapien
aatgacaacatcctgttgcctgtcc

SEQ ID NO: 244619 - DNA, 25 bp, Homo sapien
acaacatcctgttgcctgtccgcaa

SEQ ID NO: 244620 - DNA, 25 bp, Homo sapien
ttgcctgtccgcaacaatgaccaag

SEQ ID NO: 244621 - DNA, 25 bp, Homo sapien
aggcctgactcagtgcatgctggga

SEQ ID NO: 244622 - DNA, 25 bp, Homo sapien
gcctgactcagtgcatgctgggatg

SEQ ID NO: 244623 - DNA, 25 bp, Homo sapien
tgactcagtgcatgctgggatgtgt

SEQ ID NO: 244624 - DNA, 25 bp, Homo sapien
aagctcatggagaagacaggcattc

SEQ ID NO: 244625 - DNA, 25 bp, Homo sapien
atggagaagacaggcattctgctcc

SEQ ID NO: 244626 - DNA, 25 bp, Homo sapien
gcattctgctcctctgtgctttcgg

SEQ ID NO: 244627 - DNA, 25 bp, Homo sapien
gaaaattgctcatctgcatctaaat

SEQ ID NO: 244628 - DNA, 25 bp, Homo sapien
atctgcatctaaatactgtcttctt

SEQ ID NO: 244629 - DNA, 25 bp, Homo sapien
ctgtcttcttaggattcagaactct

SEQ ID NO: 244630 - DNA, 25 bp, Homo sapien
ttcagaactcttcctcattatgaag

SEQ ID NO: 244631 - DNA, 25 bp, Homo sapien
gaagaaggtagcctgcccatcttaa

SEQ ID NO: 244632 - DNA, 25 bp, Homo sapien
gcctgcccatcttaaacacaacaaa

SEQ ID NO: 244633 - DNA, 25 bp, Homo sapien
acaaaactgcacattgttttaccaa

SEQ ID NO: 244634 - DNA, 25 bp, Homo sapien
ttaccaatggacacaaatttctggg

SEQ ID NO: 244635 - DNA, 25 bp, Homo sapien
aaatttctgggttcttttgcgtgat

SEQ ID NO: 244636 - DNA, 25 bp, Homo sapien
tttgcgtgatggaatcaagacttca

SEQ ID NO: 244637 - DNA, 25 bp, Homo sapien
aagacatcggttctattgcttaata

SEQ ID NO: 244638 - DNA, 25 bp, Homo sapien
tgtcttcgtctacagcccagccttt

SEQ ID NO: 244639 - DNA, 25 bp, Homo sapien
tatggatgtcaaacacctgcacctt

SEQ ID NO: 244640 - DNA, 25 bp, Homo sapien
ggatgtcaaacacctgcaccttgag

SEQ ID NO: 244641 - DNA, 25 bp, Homo sapien
gcaccttgagataatcctacaacca

SEQ ID NO: 244642 - DNA, 25 bp, Homo sapien
tgagataatcctacaaccacatgca

SEQ ID NO: 244643 - DNA, 25 bp, Homo sapien
aaccacatgcagttgtgggaccgca

SEQ ID NO: 244644 - DNA, 25 bp, Homo sapien
acatgcagttgtgggaccgcagttt

SEQ ID NO: 244645 - DNA, 25 bp, Homo sapien
ttgtgggaccgcagtttggtcctgg

SEQ ID NO: 244646 - DNA, 25 bp, Homo sapien
gaaaactctggtaaatgatcactcc

SEQ ID NO: 244647 - DNA, 25 bp, Homo sapien
tggtaaatgatcactccaggatatt

SEQ ID NO: 244648 - DNA, 25 bp, Homo sapien
aaatgatcactccaggatattgaca

SEQ ID NO: 244649 - DNA, 25 bp, Homo sapien
actttggtctttcaaaatagtggca

SEQ ID NO: 244650 - DNA, 25 bp, Homo sapien
atagtggcaatgcttaagatactta

SEQ ID NO: 244651 - DNA, 25 bp, Homo sapien
tacacatacatataagctgaaagca

SEQ ID NO: 244652 - DNA, 25 bp, Homo sapien
agctgaaagcatgtcaagcctattt

SEQ ID NO: 244653 - DNA, 25 bp, Homo sapien
gcttactaaatcaacatctctggag

SEQ ID NO: 244654 - DNA, 25 bp, Homo sapien
aaacagctgctcaagtggttctgtt

SEQ ID NO: 244655 - DNA, 25 bp, Homo sapien
agctgctcaagtggttctgttaaac

SEQ ID NO: 244656 - DNA, 25 bp, Homo sapien
gtggttctgttaaacactcctgcgt

SEQ ID NO: 244657 - DNA, 25 bp, Homo sapien
gttctgttaaacactcctgcgttac

SEQ ID NO: 244658 - DNA, 25 bp, Homo sapien
ttaaacactcctgcgttacaatcac

SEQ ID NO: 244659 - DNA, 25 bp, Homo sapien
acactcctgcgttacaatcacttaa

SEQ ID NO: 244660 - DNA, 25 bp, Homo sapien
acacaagcaagctgactgccttatg

SEQ ID NO: 244661 - DNA, 25 bp, Homo sapien
aagcaagctgactgccttatgacta

SEQ ID NO: 244662 - DNA, 25 bp, Homo sapien
agctgactgccttatgactaatact

SEQ ID NO: 244663 - DNA, 25 bp, Homo sapien
gactgccttatgactaatacttgac

SEQ ID NO: 244664 - DNA, 25 bp, Homo sapien
gactaatacttgacagaacccagca

SEQ ID NO: 244665 - DNA, 25 bp, Homo sapien
taatacttgacagaacccagcaaga

SEQ ID NO: 244666 - DNA, 25 bp, Homo sapien
atatgagattgcagatggatgacct

SEQ ID NO: 244667 - DNA, 25 bp, Homo sapien
gatggatgacctcaatcctgaacag

SEQ ID NO: 244668 - DNA, 25 bp, Homo sapien
gatgacctcaatcctgaacagaaag

SEQ ID NO: 244669 - DNA, 25 bp, Homo sapien
aatcctgaacagaaaggcgtgcatg

SEQ ID NO: 244670 - DNA, 25 bp, Homo sapien
gaacagaaaggcgtgcatgataatg

SEQ ID NO: 244671 - DNA, 25 bp, Homo sapien
tttggcgtataaacttgtgaactgg

SEQ ID NO: 244672 - DNA, 25 bp, Homo sapien
gtaaaaagcattaatccacctgaaa

SEQ ID NO: 244673 - DNA, 25 bp, Homo sapien
aatccacctgaaagtgctgctgtat

SEQ ID NO: 244674 - DNA, 25 bp, Homo sapien
agtgctgctgtataatagtctttca

SEQ ID NO: 244675 - DNA, 25 bp, Homo sapien
tagtctttcaggatgcctaactggt

SEQ ID NO: 244676 - DNA, 25 bp, Homo sapien
caccccaaacccatggcattagaaa

SEQ ID NO: 244677 - DNA, 25 bp, Homo sapien
gggcacaatagcctaatttgaatcg

SEQ ID NO: 244678 - DNA, 25 bp, Homo sapien
cctaatttgaatcgagggcctccaa

SEQ ID NO: 244679 - DNA, 25 bp, Homo sapien
tcgagggcctccaagaacagtctgt

SEQ ID NO: 244680 - DNA, 25 bp, Homo sapien
agaacagtctgtggaaagcgcttca

SEQ ID NO: 244681 - DNA, 25 bp, Homo sapien
cagtctgtggaaagcgcttcagaaa

SEQ ID NO: 244682 - DNA, 25 bp, Homo sapien
atattctgtatcctaggaaggtatt

SEQ ID NO: 244683 - DNA, 25 bp, Homo sapien
gtatcctaggaaggtattactcgta

SEQ ID NO: 244684 - DNA, 25 bp, Homo sapien
attactcgtaatgacacaatgggtg

SEQ ID NO: 244685 - DNA, 25 bp, Homo sapien
taatgacacaatgggtgttcaccct

SEQ ID NO: 244686 - DNA, 25 bp, Homo sapien
gacacaatgggtgttcaccctgtga

SEQ ID NO: 244687 - DNA, 25 bp, Homo sapien
tgggtgttcaccctgtgatatcatt

SEQ ID NO: 244688 - DNA, 25 bp, Homo sapien
gttcaccctgtgatatcattcttat

SEQ ID NO: 244689 - DNA, 25 bp, Homo sapien
caccctgtgatatcattcttatttg

SEQ ID NO: 244690 - DNA, 25 bp, Homo sapien
cattcttatttgaccttgctgcctt

SEQ ID NO: 244691 - DNA, 25 bp, Homo sapien
ttcttatttgaccttgctgcctttt

SEQ ID NO: 244692 - DNA, 25 bp, Homo sapien
tatttgaccttgctgccttttttaa

SEQ ID NO: 244693 - DNA, 25 bp, Homo sapien
gaaattttaaactgctctcaacgta

SEQ ID NO: 244694 - DNA, 25 bp, Homo sapien
aaactgctctcaacgtaggaatctt

SEQ ID NO: 244695 - DNA, 25 bp, Homo sapien
ctcaacgtaggaatcttggtggaaa

SEQ ID NO: 244696 - DNA, 25 bp, Homo sapien
ggaaaagttcctacctgaggtctga

SEQ ID NO: 244697 - DNA, 25 bp, Homo sapien
ctacctgaggtctgatatgattcaa

SEQ ID NO: 244698 - DNA, 25 bp, Homo sapien
tagaatgcaatgagcttggccaagg

SEQ ID NO: 244699 - DNA, 25 bp, Homo sapien
tttgaatccagccaaggaaactttg

SEQ ID NO: 244700 - DNA, 25 bp, Homo sapien
ggaaactttgaatctcgacagctct

SEQ ID NO: 244701 - DNA, 25 bp, Homo sapien
tctcgacagctctgagaatcacatt

SEQ ID NO: 244702 - DNA, 25 bp, Homo sapien
tggataatgttataccccggactat

SEQ ID NO: 244703 - DNA, 25 bp, Homo sapien
ataccccggactatgaaaaaagctg

SEQ ID NO: 244704 - DNA, 25 bp, Homo sapien
ggcatgggcctcttacgtgctgtca

SEQ ID NO: 244705 - DNA, 25 bp, Homo sapien
ggcctcttacgtgctgtcagcttga

SEQ ID NO: 244706 - DNA, 25 bp, Homo sapien
cgtgctgtcagcttgatgtgaagat

SEQ ID NO: 244707 - DNA, 25 bp, Homo sapien
tcagtgctgtgggatttttaggaac

SEQ ID NO: 244708 - DNA, 25 bp, Homo sapien
ggaacaaaaaactgtgacgtctgga

SEQ ID NO: 244709 - DNA, 25 bp, Homo sapien
aaaaactgtgacgtctggatttggg

SEQ ID NO: 244710 - DNA, 25 bp, Homo sapien
tgggattatgggtcaatgttgaaga

SEQ ID NO: 244711 - DNA, 25 bp, Homo sapien
gggaagctcaagtggtgtcgtcttt

SEQ ID NO: 244712 - DNA, 25 bp, Homo sapien
aagctcaagtggtgtcgtcttttgt

SEQ ID NO: 244713 - DNA, 25 bp, Homo sapien
ctcaagtggtgtcgtcttttgtgct

SEQ ID NO: 244714 - DNA, 25 bp, Homo sapien
gtggtgtcgtcttttgtgctgttaa

SEQ ID NO: 244715 - DNA, 25 bp, Homo sapien
tgcatccttcgttttttgtgaccat

SEQ ID NO: 244716 - DNA, 25 bp, Homo sapien
tgtttgtggcgaacacgcagtccaa

SEQ ID NO: 244717 - DNA, 25 bp, Homo sapien
agtccaaccaactctccgaagagtt

SEQ ID NO: 244718 - DNA, 25 bp, Homo sapien
tgttccaaatgctttacccggcaac

SEQ ID NO: 244719 - DNA, 25 bp, Homo sapien
ggaacgacccacagttacggatact

SEQ ID NO: 244720 - DNA, 25 bp, Homo sapien
ttacggatactcgttctggctcata

SEQ ID NO: 244721 - DNA, 25 bp, Homo sapien
gttctggctcatactgctcgtcatt

SEQ ID NO: 244722 - DNA, 25 bp, Homo sapien
atactgctcgtcattcttctaaata

SEQ ID NO: 244723 - DNA, 25 bp, Homo sapien
aaccatcatcattttctaccagaag

SEQ ID NO: 244724 - DNA, 25 bp, Homo sapien
agaaggccagataccagcggaagca

SEQ ID NO: 244725 - DNA, 25 bp, Homo sapien
aatatgctccaagggacggaatttt

SEQ ID NO: 244726 - DNA, 25 bp, Homo sapien
cttagattaagagattcccaggtta

SEQ ID NO: 244727 - DNA, 25 bp, Homo sapien
taagagattcccaggttattagaaa

SEQ ID NO: 244728 - DNA, 25 bp, Homo sapien
atttagatatatacttccaaattgc

SEQ ID NO: 244729 - DNA, 25 bp, Homo sapien
ttccaaattgcctgaccaaaaagtt

SEQ ID NO: 244730 - DNA, 25 bp, Homo sapien
aattgcctgaccaaaaagttatgtc

SEQ ID NO: 244731 - DNA, 25 bp, Homo sapien
gtcaatttaacttctatgaacagta

SEQ ID NO: 244732 - DNA, 25 bp, Homo sapien
gtcataaatattgaaccggttctgt

SEQ ID NO: 244733 - DNA, 25 bp, Homo sapien
gaacagtatacaaacatgacaattt

SEQ ID NO: 244734 - DNA, 25 bp, Homo sapien
catgacaattttccatcacctacac

SEQ ID NO: 244735 - DNA, 25 bp, Homo sapien
gacaattttccatcacctacaccaa

SEQ ID NO: 244736 - DNA, 25 bp, Homo sapien
gaaccggttctgtgttgaacagtat

SEQ ID NO: 244737 - DNA, 25 bp, Homo sapien
ctcccttgtgagctgatgtgtataa

SEQ ID NO: 244738 - DNA, 25 bp, Homo sapien
ataagcagatttaaatccttccctt

SEQ ID NO: 244739 - DNA, 25 bp, Homo sapien
gagatcaccctcagtgcttctttgc

SEQ ID NO: 244740 - DNA, 25 bp, Homo sapien
tcagtgcttctttgctgctcctttt

SEQ ID NO: 244741 - DNA, 25 bp, Homo sapien
ttgctgctccttttctttagacatt

SEQ ID NO: 244742 - DNA, 25 bp, Homo sapien
aactagcactagcatggtcttttaa

SEQ ID NO: 244743 - DNA, 25 bp, Homo sapien
gcactagcatggtcttttaaggatt

SEQ ID NO: 244744 - DNA, 25 bp, Homo sapien
gttcatatcagtcatatatctgtta

SEQ ID NO: 244745 - DNA, 25 bp, Homo sapien
taaagattgtgtttattcccacgat

SEQ ID NO: 244746 - DNA, 25 bp, Homo sapien
gattgtgtttattcccacgatttga

SEQ ID NO: 244747 - DNA, 25 bp, Homo sapien
tcccacgatttgaagaagcctagcc

SEQ ID NO: 244748 - DNA, 25 bp, Homo sapien
acccagtcccaaagcttctaaagca

SEQ ID NO: 244749 - DNA, 25 bp, Homo sapien
ggaatcgagttcctactgtggattt

SEQ ID NO: 244750 - DNA, 25 bp, Homo sapien
agttggagctctttaacctgggcat

SEQ ID NO: 244751 - DNA, 25 bp, Homo sapien
ggcattcttcccaatacttcattag

SEQ ID NO: 244752 - DNA, 25 bp, Homo sapien
cttcattagaaataccgcctgcttc

SEQ ID NO: 244753 - DNA, 25 bp, Homo sapien
gcctgcttcaaaatcacctttgttt

SEQ ID NO: 244754 - DNA, 25 bp, Homo sapien
gtttgcactatctactacagcgtaa

SEQ ID NO: 244755 - DNA, 25 bp, Homo sapien
gcgtaatagacttctggctcagaga

SEQ ID NO: 244756 - DNA, 25 bp, Homo sapien
tgttaactcccttattttacagcta

SEQ ID NO: 244757 - DNA, 25 bp, Homo sapien
tttacagctaatgaagttgacccta

SEQ ID NO: 244758 - DNA, 25 bp, Homo sapien
gaccctagggaggtttgatgactct

SEQ ID NO: 244759 - DNA, 25 bp, Homo sapien
ttaggctcactgacagatcatccca

SEQ ID NO: 244760 - DNA, 25 bp, Homo sapien
gatcatcccaagcaggcttatcagg

SEQ ID NO: 244761 - DNA, 25 bp, Homo sapien
ggcttatcaggttgggtctaatttt

SEQ ID NO: 244762 - DNA, 25 bp, Homo sapien
aaaacagtcattgaggagtcctggc

SEQ ID NO: 244763 - DNA, 25 bp, Homo sapien
ccacccctgcttttgtttgatgctt

SEQ ID NO: 244764 - DNA, 25 bp, Homo sapien
ttgatgcttcacctgtgtttgctgg

SEQ ID NO: 244765 - DNA, 25 bp, Homo sapien
ataatgggatctgttgctggtctct

SEQ ID NO: 244766 - DNA, 25 bp, Homo sapien
agcagatcactgagtcagctccatg

SEQ ID NO: 244767 - DNA, 25 bp, Homo sapien
tcagctccatgactagttacatagg

SEQ ID NO: 244768 - DNA, 25 bp, Homo sapien
aggaagccctggattggcgtgaaat

SEQ ID NO: 244769 - DNA, 25 bp, Homo sapien
tgaaatactggtgcccgaggttcct

SEQ ID NO: 244770 - DNA, 25 bp, Homo sapien
gactgtgtacagctccatggaggtt

SEQ ID NO: 244771 - DNA, 25 bp, Homo sapien
gggagtacccaattgcaaaagctta

SEQ ID NO: 244772 - DNA, 25 bp, Homo sapien
caaaagcttatgtggatgccagagt

SEQ ID NO: 244773 - DNA, 25 bp, Homo sapien
ggatgccagagttcagccaatctat

SEQ ID NO: 244774 - DNA, 25 bp, Homo sapien
gccaatctatggtggtacaaatgaa

SEQ ID NO: 244775 - DNA, 25 bp, Homo sapien
aaggagctgattgcaagagagattg

SEQ ID NO: 244776 - DNA, 25 bp, Homo sapien
tttgacaagtagacatctgcccaca

SEQ ID NO: 244777 - DNA, 25 bp, Homo sapien
ggagtcctattacagctaatctcgt

SEQ ID NO: 244778 - DNA, 25 bp, Homo sapien
agctaatctcgttttaaatctgctc

SEQ ID NO: 244779 - DNA, 25 bp, Homo sapien
tggaaagcgaggaaacactaaacat

SEQ ID NO: 244780 - DNA, 25 bp, Homo sapien
tgtttttacctgctctctctataga

SEQ ID NO: 244781 - DNA, 25 bp, Homo sapien
acaacttctgacttcgctgttaaag

SEQ ID NO: 244782 - DNA, 25 bp, Homo sapien
cttcgctgttaaagaaaattggtct

SEQ ID NO: 244783 - DNA, 25 bp, Homo sapien
atttccttgcattcccattcttact

SEQ ID NO: 244784 - DNA, 25 bp, Homo sapien
ttcccattcttactggctgaaattc

SEQ ID NO: 244785 - DNA, 25 bp, Homo sapien
ttactggctgaaattcaaagctgat

SEQ ID NO: 244786 - DNA, 25 bp, Homo sapien
tttccaaaatctgcacatctccaac

SEQ ID NO: 244787 - DNA, 25 bp, Homo sapien
atgagttgagggtcttacattaaga

SEQ ID NO: 244788 - DNA, 25 bp, Homo sapien
tcttacattaagacttgccagcaag

SEQ ID NO: 244789 - DNA, 25 bp, Homo sapien
gccctgtgattgatgagtgaccagc

SEQ ID NO: 244790 - DNA, 25 bp, Homo sapien
gattgatgagtgaccagccatgtgt

SEQ ID NO: 244791 - DNA, 25 bp, Homo sapien
tgatgagtgaccagccatgtgtgga

SEQ ID NO: 244792 - DNA, 25 bp, Homo sapien
tctggttgttcctccagggtacttt

SEQ ID NO: 244793 - DNA, 25 bp, Homo sapien
aaggttctctgaaaattatttggtg

SEQ ID NO: 244794 - DNA, 25 bp, Homo sapien
attatttggtgggttaaatgcctct

SEQ ID NO: 244795 - DNA, 25 bp, Homo sapien
ttatttggtgggttaaatgcctctg

SEQ ID NO: 244796 - DNA, 25 bp, Homo sapien
tatttggtgggttaaatgcctctga

SEQ ID NO: 244797 - DNA, 25 bp, Homo sapien
atttggtgggttaaatgcctctgat

SEQ ID NO: 244798 - DNA, 25 bp, Homo sapien
tttggtgggttaaatgcctctgatc

SEQ ID NO: 244799 - DNA, 25 bp, Homo sapien
ttggtgggttaaatgcctctgatcc

SEQ ID NO: 244800 - DNA, 25 bp, Homo sapien
tggtgggttaaatgcctctgatcca

SEQ ID NO: 244801 - DNA, 25 bp, Homo sapien
ggtgggttaaatgcctctgatccac

SEQ ID NO: 244802 - DNA, 25 bp, Homo sapien
gtgggttaaatgcctctgatccaca

SEQ ID NO: 244803 - DNA, 25 bp, Homo sapien
atctgcccgggtcctttgggatacg

SEQ ID NO: 244804 - DNA, 25 bp, Homo sapien
ggtcctttgggatacggctgactag

SEQ ID NO: 244805 - DNA, 25 bp, Homo sapien
gcccggtccaaggttacagagccag

SEQ ID NO: 244806 - DNA, 25 bp, Homo sapien
gcaattggcctttgttatgaatctt

SEQ ID NO: 244807 - DNA, 25 bp, Homo sapien
gaatctttttgtggagataaaccca

SEQ ID NO: 244808 - DNA, 25 bp, Homo sapien
agaagtatcacggttctgaccatga

SEQ ID NO: 244809 - DNA, 25 bp, Homo sapien
cggttctgaccatgaaagtgtgttc

SEQ ID NO: 244810 - DNA, 25 bp, Homo sapien
aagtgtgttcaactctaatccagca

SEQ ID NO: 244811 - DNA, 25 bp, Homo sapien
tacagagccagttggactcagaagt

SEQ ID NO: 244812 - DNA, 25 bp, Homo sapien
gatcatttgattctgtgtcgtctaa

SEQ ID NO: 244813 - DNA, 25 bp, Homo sapien
aggtgacttctctgcagtccccttt

SEQ ID NO: 244814 - DNA, 25 bp, Homo sapien
ctggataacaaagggagacccagtt

SEQ ID NO: 244815 - DNA, 25 bp, Homo sapien
tggataacaaagggagacccagttt

SEQ ID NO: 244816 - DNA, 25 bp, Homo sapien
gataacaaagggagacccagtttct

SEQ ID NO: 244817 - DNA, 25 bp, Homo sapien
gggagacccagtttctacaaaatat

SEQ ID NO: 244818 - DNA, 25 bp, Homo sapien
tcctagctattcagggaactgaggt

SEQ ID NO: 244819 - DNA, 25 bp, Homo sapien
cctagctattcagggaactgaggtg

SEQ ID NO: 244820 - DNA, 25 bp, Homo sapien
ctagctattcagggaactgaggtgg

SEQ ID NO: 244821 - DNA, 25 bp, Homo sapien
agctattcagggaactgaggtggga

SEQ ID NO: 244822 - DNA, 25 bp, Homo sapien
tgagcctggaagttcaagacagcag

SEQ ID NO: 244823 - DNA, 25 bp, Homo sapien
gagcctggaagttcaagacagcagt

SEQ ID NO: 244824 - DNA, 25 bp, Homo sapien
gcctggaagttcaagacagcagtga

SEQ ID NO: 244825 - DNA, 25 bp, Homo sapien
tgaagttgggctttccagattcaaa

SEQ ID NO: 244826 - DNA, 25 bp, Homo sapien
ggaaatgtttgatagtttctcctaa

SEQ ID NO: 244827 - DNA, 25 bp, Homo sapien
tctgccccagatgagatttagatgc

SEQ ID NO: 244828 - DNA, 25 bp, Homo sapien
tgagatttagatgcagagggttagt

SEQ ID NO: 244829 - DNA, 25 bp, Homo sapien
ggcgtgatgatttgttcaagattgt

SEQ ID NO: 244830 - DNA, 25 bp, Homo sapien
ttcaagattgtgttatagtagctgc

SEQ ID NO: 244831 - DNA, 25 bp, Homo sapien
tagtagctgccccttttaagccagc

SEQ ID NO: 244832 - DNA, 25 bp, Homo sapien
cccttttaagccagctgtgtgtgtg

SEQ ID NO: 244833 - DNA, 25 bp, Homo sapien
gggtgggcagtgtgtattccacatc

SEQ ID NO: 244834 - DNA, 25 bp, Homo sapien
gtgtattccacatcaacatcctaga

SEQ ID NO: 244835 - DNA, 25 bp, Homo sapien
gagttttatctaaagactgacattg

SEQ ID NO: 244836 - DNA, 25 bp, Homo sapien
tccagtggcatctccaatcaatttg

SEQ ID NO: 244837 - DNA, 25 bp, Homo sapien
ttgaatatacccatgagagctgcct

SEQ ID NO: 244838 - DNA, 25 bp, Homo sapien
tgagagctgccttgagccacagcct

SEQ ID NO: 244839 - DNA, 25 bp, Homo sapien
aggactggaatgagcaccttctaca

SEQ ID NO: 244840 - DNA, 25 bp, Homo sapien
tacaagttcatatagccagttacct

SEQ ID NO: 244841 - DNA, 25 bp, Homo sapien
atagccagttacctaggagagcact

SEQ ID NO: 244842 - DNA, 25 bp, Homo sapien
cctaggagagcacttcttgggagcc

SEQ ID NO: 244843 - DNA, 25 bp, Homo sapien
ttcttgggagcctgacacctaggca

SEQ ID NO: 244844 - DNA, 25 bp, Homo sapien
gagcagaccagtggcagtttctcac

SEQ ID NO: 244845 - DNA, 25 bp, Homo sapien
agtttctcacagctctcaggaaagc

SEQ ID NO: 244846 - DNA, 25 bp, Homo sapien
aagccccagctcacagcagacagga

SEQ ID NO: 244847 - DNA, 25 bp, Homo sapien
agaatgctgtcggtggagcttccca

SEQ ID NO: 244848 - DNA, 25 bp, Homo sapien
gaaatgccataatgagcctgcacag

SEQ ID NO: 244849 - DNA, 25 bp, Homo sapien
gagcctgcacaggagaagatggcat

SEQ ID NO: 244850 - DNA, 25 bp, Homo sapien
tggctgtaagcccttgagctttgcc

SEQ ID NO: 244851 - DNA, 25 bp, Homo sapien
tgagctttgcccctctaatgtcagc

SEQ ID NO: 244852 - DNA, 25 bp, Homo sapien
accccacaccccagtggagagtgtt

SEQ ID NO: 244853 - DNA, 25 bp, Homo sapien
agagtgttccttttggtccctctca

SEQ ID NO: 244854 - DNA, 25 bp, Homo sapien
ttttggtccctctcaaagcctgcat

SEQ ID NO: 244855 - DNA, 25 bp, Homo sapien
gcctgcatctgtcatccatttataa

SEQ ID NO: 244856 - DNA, 25 bp, Homo sapien
ccatttataagtctacagtgtttct

SEQ ID NO: 244857 - DNA, 25 bp, Homo sapien
cagtgtttctgccaagggattgaca

SEQ ID NO: 244858 - DNA, 25 bp, Homo sapien
agagaatatattgggtttgctttat

SEQ ID NO: 244859 - DNA, 25 bp, Homo sapien
tctttgtaaatctgaatgaccataa

SEQ ID NO: 244860 - DNA, 25 bp, Homo sapien
gtgctgctgtgaactaaagtatgtc

SEQ ID NO: 244861 - DNA, 25 bp, Homo sapien
atttcttgtggcaagtaattcacag

SEQ ID NO: 244862 - DNA, 25 bp, Homo sapien
attgatgtacattgatagatgccat

SEQ ID NO: 244863 - DNA, 25 bp, Homo sapien
gatagatgccataaatcagtagcaa

SEQ ID NO: 244864 - DNA, 25 bp, Homo sapien
gtagcaaaaggcacttctaaaggta

SEQ ID NO: 244865 - DNA, 25 bp, Homo sapien
aaagtatgtcatttatgctcaaagt

SEQ ID NO: 244866 - DNA, 25 bp, Homo sapien
gtcatttatgctcaaagtttaattc

SEQ ID NO: 244867 - DNA, 25 bp, Homo sapien
ttaaaaatgctactgagattctgct

SEQ ID NO: 244868 - DNA, 25 bp, Homo sapien
gagattctgctgtaaatatgactag

SEQ ID NO: 244869 - DNA, 25 bp, Homo sapien
gaaagtctgcaaattaggttgtttg

SEQ ID NO: 244870 - DNA, 25 bp, Homo sapien
gtgaggtgtgaaacaggatatgcat

SEQ ID NO: 244871 - DNA, 25 bp, Homo sapien
aaatgtatctttggatttgctgaac

SEQ ID NO: 244872 - DNA, 25 bp, Homo sapien
tttggatttgctgaactgggctcaa

SEQ ID NO: 244873 - DNA, 25 bp, Homo sapien
gaactgggctcaaatgtggtcaaat

SEQ ID NO: 244874 - DNA, 25 bp, Homo sapien
agagagcttatgatgccagttttac

SEQ ID NO: 244875 - DNA, 25 bp, Homo sapien
gatgccagttttactgcattctttt

SEQ ID NO: 244876 - DNA, 25 bp, Homo sapien
gcattctttttagttgtgttcccca

SEQ ID NO: 244877 - DNA, 25 bp, Homo sapien
gccccatgacctttaccagaacaag

SEQ ID NO: 244878 - DNA, 25 bp, Homo sapien
aaacacatgttgacaggaggaccta

SEQ ID NO: 244879 - DNA, 25 bp, Homo sapien
ggacctagaggcattatgagtatta

SEQ ID NO: 244880 - DNA, 25 bp, Homo sapien
gtaaacactaaatttaacagcaaga

SEQ ID NO: 244881 - DNA, 25 bp, Homo sapien
ttcagccattcactattataagtta

SEQ ID NO: 244882 - DNA, 25 bp, Homo sapien
tcttaagatttattagtttggctag

SEQ ID NO: 244883 - DNA, 25 bp, Homo sapien
tagatttctaagtcatcctgttaaa

SEQ ID NO: 244884 - DNA, 25 bp, Homo sapien
tttctaagtcatcctgttaaatagt

SEQ ID NO: 244885 - DNA, 25 bp, Homo sapien
aaatagttagtagagctttgccttt

SEQ ID NO: 244886 - DNA, 25 bp, Homo sapien
agagctttgcctttgatggtattac

SEQ ID NO: 244887 - DNA, 25 bp, Homo sapien
agctttgcctttgatggtattactt

SEQ ID NO: 244888 - DNA, 25 bp, Homo sapien
gttattgacataagaagtgctaaaa

SEQ ID NO: 244889 - DNA, 25 bp, Homo sapien
aaaagaatctttatcctaaggaatg

SEQ ID NO: 244890 - DNA, 25 bp, Homo sapien
tcaaaacttcttcaaagttacctca

SEQ ID NO: 244891 - DNA, 25 bp, Homo sapien
aataggagctcggtgaattcaagga

SEQ ID NO: 244892 - DNA, 25 bp, Homo sapien
ggagctcggtgaattcaaggaccat

SEQ ID NO: 244893 - DNA, 25 bp, Homo sapien
ctcggtgaattcaaggaccatgctt

SEQ ID NO: 244894 - DNA, 25 bp, Homo sapien
attcaaggaccatgcttgcttcgtt

SEQ ID NO: 244895 - DNA, 25 bp, Homo sapien
aaggaccatgcttgcttcgttcatt

SEQ ID NO: 244896 - DNA, 25 bp, Homo sapien
gaccatgcttgcttcgttcattgta

SEQ ID NO: 244897 - DNA, 25 bp, Homo sapien
catgcttgcttcgttcattgtatct

SEQ ID NO: 244898 - DNA, 25 bp, Homo sapien
gcttgcttcgttcattgtatcttca

SEQ ID NO: 244899 - DNA, 25 bp, Homo sapien
ttcgttcattgtatcttcagcacct

SEQ ID NO: 244900 - DNA, 25 bp, Homo sapien
gttcattgtatcttcagcacctagc

SEQ ID NO: 244901 - DNA, 25 bp, Homo sapien
cattgtatcttcagcacctagcaca

SEQ ID NO: 244902 - DNA, 25 bp, Homo sapien
atcgcggaggccacgatgcccgttt

SEQ ID NO: 244903 - DNA, 25 bp, Homo sapien
ggaggccacgatgcccgttttattc

SEQ ID NO: 244904 - DNA, 25 bp, Homo sapien
tttaggataaattccagtgcggcgg

SEQ ID NO: 244905 - DNA, 25 bp, Homo sapien
ttttattccctctccacggcaagga

SEQ ID NO: 244906 - DNA, 25 bp, Homo sapien
attccctctccacggcaaggaaaag

SEQ ID NO: 244907 - DNA, 25 bp, Homo sapien
aaaagcagcgaaatctgaggtcttc

SEQ ID NO: 244908 - DNA, 25 bp, Homo sapien
gaggtcttcagaggttaaccctatc

SEQ ID NO: 244909 - DNA, 25 bp, Homo sapien
gaggttaaccctatctaggagcaga

SEQ ID NO: 244910 - DNA, 25 bp, Homo sapien
atctaggagcagaatgtgacgcatt

SEQ ID NO: 244911 - DNA, 25 bp, Homo sapien
gaatgtgacgcattgtaaacaaata

SEQ ID NO: 244912 - DNA, 25 bp, Homo sapien
gaagccagcccgtatttttctccct

SEQ ID NO: 244913 - DNA, 25 bp, Homo sapien
ggaggtccagccagcgcgttacacc

SEQ ID NO: 244914 - DNA, 25 bp, Homo sapien
ttacacctgccctcgctgtaatgcg

SEQ ID NO: 244915 - DNA, 25 bp, Homo sapien
tgtaatgcgccctactgctcgctgc

SEQ ID NO: 244916 - DNA, 25 bp, Homo sapien
tcgctgcgctgctaccggacgcatg

SEQ ID NO: 244917 - DNA, 25 bp, Homo sapien
ggacgcatggcacctgcgcagaaaa

SEQ ID NO: 244918 - DNA, 25 bp, Homo sapien
tggcacctgcgcagaaaacttctac

SEQ ID NO: 244919 - DNA, 25 bp, Homo sapien
aaacttctaccgtgaccaggtgctg

SEQ ID NO: 244920 - DNA, 25 bp, Homo sapien
agagctccgcggttgcagcgctcct

SEQ ID NO: 244921 - DNA, 25 bp, Homo sapien
taccaccggcgtgcgttcgcaggta

SEQ ID NO: 244922 - DNA, 25 bp, Homo sapien
ttcgcaggtagatcgcggtgccagt

SEQ ID NO: 244923 - DNA, 25 bp, Homo sapien
gtagatcgcggtgccagttgccatg

SEQ ID NO: 244924 - DNA, 25 bp, Homo sapien
cacccctaagcttaacttactcatg

SEQ ID NO: 244925 - DNA, 25 bp, Homo sapien
gcttaacttactcatggttctgcag

SEQ ID NO: 244926 - DNA, 25 bp, Homo sapien
ggttctgcagggtgactgctctcca

SEQ ID NO: 244927 - DNA, 25 bp, Homo sapien
tccatggttctaggtggttctgcat

SEQ ID NO: 244928 - DNA, 25 bp, Homo sapien
gcctctcacatgtgctacagtcaaa

SEQ ID NO: 244929 - DNA, 25 bp, Homo sapien
tgaaactcacttacatggctgacaa

SEQ ID NO: 244930 - DNA, 25 bp, Homo sapien
tggctgacaattgatgttggctgtt

SEQ ID NO: 244931 - DNA, 25 bp, Homo sapien
ctgttgcctggagaagacatatgtg

SEQ ID NO: 244932 - DNA, 25 bp, Homo sapien
ctagattcaagaaagagcttcccag

SEQ ID NO: 244933 - DNA, 25 bp, Homo sapien
aggaaggctaccaagagaccgaagt

SEQ ID NO: 244934 - DNA, 25 bp, Homo sapien
gaccgaagtagaggcttcagtttct

SEQ ID NO: 244935 - DNA, 25 bp, Homo sapien
cctatcaccttacatgtacctattc

SEQ ID NO: 244936 - DNA, 25 bp, Homo sapien
gaaggaagaccttaggctttcaatg

SEQ ID NO: 244937 - DNA, 25 bp, Homo sapien
ggctttcaatgtggtgttctttctt

SEQ ID NO: 244938 - DNA, 25 bp, Homo sapien
tgtggtgttctttcttaagtttaag

SEQ ID NO: 244939 - DNA, 25 bp, Homo sapien
cgagccgcaggcatgtggacagaat

SEQ ID NO: 244940 - DNA, 25 bp, Homo sapien
ttagacactcctcagactactacag

SEQ ID NO: 244941 - DNA, 25 bp, Homo sapien
cagctggtggctctcaaattcatga

SEQ ID NO: 244942 - DNA, 25 bp, Homo sapien
ttcatgagggtccagaagttgttcc

SEQ ID NO: 244943 - DNA, 25 bp, Homo sapien
ggtccagaagttgttcctctggatt

SEQ ID NO: 244944 - DNA, 25 bp, Homo sapien
gggactaatgaggtctgcttccatt

SEQ ID NO: 244945 - DNA, 25 bp, Homo sapien
gcttccattactattattgaaacct

SEQ ID NO: 244946 - DNA, 25 bp, Homo sapien
ggctctgtcatccaactataaacga

SEQ ID NO: 244947 - DNA, 25 bp, Homo sapien
agtccaagctggtctcttgtctaga

SEQ ID NO: 244948 - DNA, 25 bp, Homo sapien
gcaacctagttcaactaccttttct

SEQ ID NO: 244949 - DNA, 25 bp, Homo sapien
aactaccttttcttgcaaatctgat

SEQ ID NO: 244950 - DNA, 25 bp, Homo sapien
ttccaccatggatttatcttgcttt

SEQ ID NO: 244951 - DNA, 25 bp, Homo sapien
gcctgaagtggtctggcttctttac

SEQ ID NO: 244952 - DNA, 25 bp, Homo sapien
ttcagcctcattttgtaacactctc

SEQ ID NO: 244953 - DNA, 25 bp, Homo sapien
gtaacactctcacctcccataatag

SEQ ID NO: 244954 - DNA, 25 bp, Homo sapien
ccataatagccatcttacaagcctc

SEQ ID NO: 244955 - DNA, 25 bp, Homo sapien
agcctcagtaaggactcagttctaa

SEQ ID NO: 244956 - DNA, 25 bp, Homo sapien
ggactcagttctaaaacagggcact

SEQ ID NO: 244957 - DNA, 25 bp, Homo sapien
gatattgcgagagtacagttctacc

SEQ ID NO: 244958 - DNA, 25 bp, Homo sapien
acagttctacctaacggacacagct

SEQ ID NO: 244959 - DNA, 25 bp, Homo sapien
agctccgggtgggtgtgccatattc

SEQ ID NO: 244960 - DNA, 25 bp, Homo sapien
gtgtgccatattccatttcgtacga

SEQ ID NO: 244961 - DNA, 25 bp, Homo sapien
attccatttcgtacgagtctcttag

SEQ ID NO: 244962 - DNA, 25 bp, Homo sapien
aatgctacaattcaacaggctaaag

SEQ ID NO: 244963 - DNA, 25 bp, Homo sapien
aatcacactgaattactatctctaa

SEQ ID NO: 244964 - DNA, 25 bp, Homo sapien
tactatctctaatgactgagttcat

SEQ ID NO: 244965 - DNA, 25 bp, Homo sapien
gactgagttcattaagcgcaataat

SEQ ID NO: 244966 - DNA, 25 bp, Homo sapien
tgcacttaaaggttttgcaacgaaa

SEQ ID NO: 244967 - DNA, 25 bp, Homo sapien
gggccatgagttgaacaattcggac

SEQ ID NO: 244968 - DNA, 25 bp, Homo sapien
tgtgttcggccaaacaagcaggttc

SEQ ID NO: 244969 - DNA, 25 bp, Homo sapien
tcagggctgcgggattccagaagtt

SEQ ID NO: 244970 - DNA, 25 bp, Homo sapien
gcgggattccagaagttgctctgag

SEQ ID NO: 244971 - DNA, 25 bp, Homo sapien
tgagcttgcaatcagacctcaaagc

SEQ ID NO: 244972 - DNA, 25 bp, Homo sapien
gccctcatccttcacaatgtaaatt

SEQ ID NO: 244973 - DNA, 25 bp, Homo sapien
gagaaatgaagtctcgtttcctggg

SEQ ID NO: 244974 - DNA, 25 bp, Homo sapien
aagacccacccatccttatttattg

SEQ ID NO: 244975 - DNA, 25 bp, Homo sapien
cacccatccttatttattgccatat

SEQ ID NO: 244976 - DNA, 25 bp, Homo sapien
tccttatttattgccatatgacttt

SEQ ID NO: 244977 - DNA, 25 bp, Homo sapien
gaagctggtgcgtttgtttgtatat

SEQ ID NO: 244978 - DNA, 25 bp, Homo sapien
tgttggcatgagatgtgtacggtaa

SEQ ID NO: 244979 - DNA, 25 bp, Homo sapien
ggtctttactgctaaacctaaggag

SEQ ID NO: 244980 - DNA, 25 bp, Homo sapien
ctaaacctaaggagatgagagtaaa

SEQ ID NO: 244981 - DNA, 25 bp, Homo sapien
gtaaacagtaagtggccaactcaaa

SEQ ID NO: 244982 - DNA, 25 bp, Homo sapien
tggccaactcaaagaagcatggact

SEQ ID NO: 244983 - DNA, 25 bp, Homo sapien
agaagcatggactatgttgaaacat

SEQ ID NO: 244984 - DNA, 25 bp, Homo sapien
gaaacatggactatagctgcaattt

SEQ ID NO: 244985 - DNA, 25 bp, Homo sapien
tagctgcaatttcccagtggtgcag

SEQ ID NO: 244986 - DNA, 25 bp, Homo sapien
aatttcccagtggtgcagttttcaa

SEQ ID NO: 244987 - DNA, 25 bp, Homo sapien
gatactgttgcccagtgaaaactgc

SEQ ID NO: 244988 - DNA, 25 bp, Homo sapien
gttgcccagtgaaaactgcatgaat

SEQ ID NO: 244989 - DNA, 25 bp, Homo sapien
tgtaatagttttatgcttgtttccc

SEQ ID NO: 244990 - DNA, 25 bp, Homo sapien
gaaagcacagtcctgcatgctgcaa

SEQ ID NO: 244991 - DNA, 25 bp, Homo sapien
gcaagcaagctgaacatgagacaca

SEQ ID NO: 244992 - DNA, 25 bp, Homo sapien
gacacagactccttggattcaacca

SEQ ID NO: 244993 - DNA, 25 bp, Homo sapien
atatcacttagacagccaccattac

SEQ ID NO: 244994 - DNA, 25 bp, Homo sapien
gacagccaccattacttgagaaaat

SEQ ID NO: 244995 - DNA, 25 bp, Homo sapien
gggattttccatcttcaatctattt

SEQ ID NO: 244996 - DNA, 25 bp, Homo sapien
ttcaatctatttattcacctctcct

SEQ ID NO: 244997 - DNA, 25 bp, Homo sapien
gtaattggctgatggtgtcctcgta

SEQ ID NO: 244998 - DNA, 25 bp, Homo sapien
gtcctcgtaggattagaagctgatg

SEQ ID NO: 244999 - DNA, 25 bp, Homo sapien
gagaaggatccttagtgttccatat

SEQ ID NO: 245000 - DNA, 25 bp, Homo sapien
gttccatatacaaagttcagttcca

SEQ ID NO: 245001 - DNA, 25 bp, Homo sapien
gactacgatggcaggacaatgccgt

SEQ ID NO: 245002 - DNA, 25 bp, Homo sapien
gacaatgccgtgagaagcacttcat

SEQ ID NO: 245003 - DNA, 25 bp, Homo sapien
ttcatggtgacagagcccaacccag

SEQ ID NO: 245004 - DNA, 25 bp, Homo sapien
tctggagcattttgtgagcaccgtc

SEQ ID NO: 245005 - DNA, 25 bp, Homo sapien
accgtctcggtggatgggaaagcca

SEQ ID NO: 245006 - DNA, 25 bp, Homo sapien
ggaaagccaaagtctctgcccgtct

SEQ ID NO: 245007 - DNA, 25 bp, Homo sapien
gtctctgcccgtctcttactggagg

SEQ ID NO: 245008 - DNA, 25 bp, Homo sapien
gtgagtctgcccacaaaggaaaaga

SEQ ID NO: 245009 - DNA, 25 bp, Homo sapien
aaaagaggccagagactgtcgtgaa

SEQ ID NO: 245010 - DNA, 25 bp, Homo sapien
gagactgtcgtgaagacatccacta

SEQ ID NO: 245011 - DNA, 25 bp, Homo sapien
gaagacatccactaggtaccagaag

SEQ ID NO: 245012 - DNA, 25 bp, Homo sapien
tagaacagcatctgctgtcctccgg

SEQ ID NO: 245013 - DNA, 25 bp, Homo sapien
acaatatatgatgtacccagggacc

SEQ ID NO: 245014 - DNA, 25 bp, Homo sapien
aagaaaatttctttgcatcttagaa

SEQ ID NO: 245015 - DNA, 25 bp, Homo sapien
cattcattgtgactaaagagcttct

SEQ ID NO: 245016 - DNA, 25 bp, Homo sapien
aagagcttctatgcttccttgtttc

SEQ ID NO: 245017 - DNA, 25 bp, Homo sapien
aacatgctgagcatgctcacaaaga

SEQ ID NO: 245018 - DNA, 25 bp, Homo sapien
gctcacaaagaaggctcgtccattc

SEQ ID NO: 245019 - DNA, 25 bp, Homo sapien
tcgtccattcctcctgtgttttagt

SEQ ID NO: 245020 - DNA, 25 bp, Homo sapien
gaggtttcctaaatggttgccttga

SEQ ID NO: 245021 - DNA, 25 bp, Homo sapien
gttgccttgaaatcactgtggtcca

SEQ ID NO: 245022 - DNA, 25 bp, Homo sapien
actgtggtccaaatgtaattcttac

SEQ ID NO: 245023 - DNA, 25 bp, Homo sapien
ggagtaataggacagcttccttgtc

SEQ ID NO: 245024 - DNA, 25 bp, Homo sapien
ggacagcttccttgtcctgtttttt

SEQ ID NO: 245025 - DNA, 25 bp, Homo sapien
caacccaataatgatgagtgaggct

SEQ ID NO: 245026 - DNA, 25 bp, Homo sapien
acatgataatgggttgttgcaaata

SEQ ID NO: 245027 - DNA, 25 bp, Homo sapien
aggatttttaattctcttattggtg

SEQ ID NO: 245028 - DNA, 25 bp, Homo sapien
attccagccttttgggagtccaggt

SEQ ID NO: 245029 - DNA, 25 bp, Homo sapien
agccttttgggagtccaggtcaggt

SEQ ID NO: 245030 - DNA, 25 bp, Homo sapien
aggtcaggtggattgcttcagctca

SEQ ID NO: 245031 - DNA, 25 bp, Homo sapien
attctcttattggtgtattttccac

SEQ ID NO: 245032 - DNA, 25 bp, Homo sapien
tgtattttccacttgtctatcttta

SEQ ID NO: 245033 - DNA, 25 bp, Homo sapien
cagtgatttttagtggatttcacaa

SEQ ID NO: 245034 - DNA, 25 bp, Homo sapien
gttcaactggactgaagaggacact

SEQ ID NO: 245035 - DNA, 25 bp, Homo sapien
actgatagaacgtgtttccatggac

SEQ ID NO: 245036 - DNA, 25 bp, Homo sapien
catggacacagccttcagggagtcc

SEQ ID NO: 245037 - DNA, 25 bp, Homo sapien
gaaaggccaatcactgctgactaag

SEQ ID NO: 245038 - DNA, 25 bp, Homo sapien
atcactgctgactaagaattcatta

SEQ ID NO: 245039 - DNA, 25 bp, Homo sapien
cattatattggcttagtacacagaa

SEQ ID NO: 245040 - DNA, 25 bp, Homo sapien
ttctgcagatgctattgtacacatg

SEQ ID NO: 245041 - DNA, 25 bp, Homo sapien
tgtacacatgtgacaacctatgaag

SEQ ID NO: 245042 - DNA, 25 bp, Homo sapien
tttatactaaatctcttctccttcc

SEQ ID NO: 245043 - DNA, 25 bp, Homo sapien
agaataaagacttcccttctccatg

SEQ ID NO: 245044 - DNA, 25 bp, Homo sapien
gacttcccttctccatgaagaagtg

SEQ ID NO: 245045 - DNA, 25 bp, Homo sapien
cctcaggctcccaaaattgaatagt

SEQ ID NO: 245046 - DNA, 25 bp, Homo sapien
gtagagatttctctccatccatgac

SEQ ID NO: 245047 - DNA, 25 bp, Homo sapien
atttctctccatccatgacatacaa

SEQ ID NO: 245048 - DNA, 25 bp, Homo sapien
ccatgacatacaattcttccttaag

SEQ ID NO: 245049 - DNA, 25 bp, Homo sapien
cttccttaagaagccagacaactgg

SEQ ID NO: 245050 - DNA, 25 bp, Homo sapien
gacaactggcactcctatatataaa

SEQ ID NO: 245051 - DNA, 25 bp, Homo sapien
aggaatctacttttctatatgccaa

SEQ ID NO: 245052 - DNA, 25 bp, Homo sapien
acttttctatatgccaattgctggg

SEQ ID NO: 245053 - DNA, 25 bp, Homo sapien
atgccaattgctgggatcaaaataa

SEQ ID NO: 245054 - DNA, 25 bp, Homo sapien
gtgaatgttcacgttacaaattctt

SEQ ID NO: 245055 - DNA, 25 bp, Homo sapien
cttttaagaagtgcatacatttatg

SEQ ID NO: 245056 - DNA, 25 bp, Homo sapien
tgtgaggtttcctaaactggaactg

SEQ ID NO: 245057 - DNA, 25 bp, Homo sapien
tgaggtttcctaaactggaactgga

SEQ ID NO: 245058 - DNA, 25 bp, Homo sapien
tttcctaaactggaactggacccag

SEQ ID NO: 245059 - DNA, 25 bp, Homo sapien
aaactggaactggacccaggatgct

SEQ ID NO: 245060 - DNA, 25 bp, Homo sapien
actggaactggacccaggatgcttt

SEQ ID NO: 245061 - DNA, 25 bp, Homo sapien
gaactggacccaggatgctttgcag

SEQ ID NO: 245062 - DNA, 25 bp, Homo sapien
actggacccaggatgctttgcagca

SEQ ID NO: 245063 - DNA, 25 bp, Homo sapien
tggacccaggatgctttgcagcaac

SEQ ID NO: 245064 - DNA, 25 bp, Homo sapien
gacccaggatgctttgcagcaacgc

SEQ ID NO: 245065 - DNA, 25 bp, Homo sapien
aggatgctttgcagcaacgccctag

SEQ ID NO: 245066 - DNA, 25 bp, Homo sapien
ggatgctttgcagcaacgccctagg

SEQ ID NO: 245067 - DNA, 25 bp, Homo sapien
tgcactcacttcaaaacttccaatg

SEQ ID NO: 245068 - DNA, 25 bp, Homo sapien
gttttacttagtcaacagacctcat

SEQ ID NO: 245069 - DNA, 25 bp, Homo sapien
agccagtttacatcagcagtatact

SEQ ID NO: 245070 - DNA, 25 bp, Homo sapien
gtcaacagacctcatattagtttag

SEQ ID NO: 245071 - DNA, 25 bp, Homo sapien
attagtttagtaccctctgcatatc

SEQ ID NO: 245072 - DNA, 25 bp, Homo sapien
gcatatccccttcaaatgaacttgg

SEQ ID NO: 245073 - DNA, 25 bp, Homo sapien
atttctgagtctgaattgggcacaa

SEQ ID NO: 245074 - DNA, 25 bp, Homo sapien
atacttattggtgatgggaattgca

SEQ ID NO: 245075 - DNA, 25 bp, Homo sapien
tgcagtgataccagaggcttagaaa

SEQ ID NO: 245076 - DNA, 25 bp, Homo sapien
aatcgctataaagcaacgtgttgat

SEQ ID NO: 245077 - DNA, 25 bp, Homo sapien
acgtgttgatgatgcactcacttca

SEQ ID NO: 245078 - DNA, 25 bp, Homo sapien
tggacagatggcctgtactacctcg

SEQ ID NO: 245079 - DNA, 25 bp, Homo sapien
gcctgtactacctcgggaagatcaa

SEQ ID NO: 245080 - DNA, 25 bp, Homo sapien
gagggtcagcagctctaagcaaagc

SEQ ID NO: 245081 - DNA, 25 bp, Homo sapien
agctgcctcgtgactttcgaagata

SEQ ID NO: 245082 - DNA, 25 bp, Homo sapien
gataattccaaatactgggtcctat

SEQ ID NO: 245083 - DNA, 25 bp, Homo sapien
aggacatacagcatgccggtgttcc

SEQ ID NO: 245084 - DNA, 25 bp, Homo sapien
aggagaggagcccaagtgcaacatc

SEQ ID NO: 245085 - DNA, 25 bp, Homo sapien
tgcaacatctgcctagggaagacat

SEQ ID NO: 245086 - DNA, 25 bp, Homo sapien
gggccgctgaatgagatcctcatct

SEQ ID NO: 245087 - DNA, 25 bp, Homo sapien
gagatcctcatctgcgggaagtgtg

SEQ ID NO: 245088 - DNA, 25 bp, Homo sapien
gaagtgtggcctgggttaccaccag

SEQ ID NO: 245089 - DNA, 25 bp, Homo sapien
gagaatcaactcttcatcatggatg

SEQ ID NO: 245090 - DNA, 25 bp, Homo sapien
gaatcaactcttcatcatggatggg

SEQ ID NO: 245091 - DNA, 25 bp, Homo sapien
atgggattgtgaaggctgaactata

SEQ ID NO: 245092 - DNA, 25 bp, Homo sapien
tcagcattgacagcatcctcaatta

SEQ ID NO: 245093 - DNA, 25 bp, Homo sapien
gacagcatcctcaattaataattct

SEQ ID NO: 245094 - DNA, 25 bp, Homo sapien
gacagaataatacagctgggctgtt

SEQ ID NO: 245095 - DNA, 25 bp, Homo sapien
aatatatctatgtgccatggcctgg

SEQ ID NO: 245096 - DNA, 25 bp, Homo sapien
tatctatgtgccatggcctgggaag

SEQ ID NO: 245097 - DNA, 25 bp, Homo sapien
gcctgggaagcctgctttctttttt

SEQ ID NO: 245098 - DNA, 25 bp, Homo sapien
gggtttagctcaaaatatctgtggt

SEQ ID NO: 245099 - DNA, 25 bp, Homo sapien
atatctgtggtcctgataaaattgg

SEQ ID NO: 245100 - DNA, 25 bp, Homo sapien
ggaacttcatgtagcagcctaacac

SEQ ID NO: 245101 - DNA, 25 bp, Homo sapien
cttcatgtagcagcctaacaccggg

SEQ ID NO: 245102 - DNA, 25 bp, Homo sapien
gggccgagttgcctttactctattt

SEQ ID NO: 245103 - DNA, 25 bp, Homo sapien
gttgcctttactctattttctatga

SEQ ID NO: 245104 - DNA, 25 bp, Homo sapien
ttttctatgatgaatacttgtggag

SEQ ID NO: 245105 - DNA, 25 bp, Homo sapien
agaaactgtgacaaatccattgatc

SEQ ID NO: 245106 - DNA, 25 bp, Homo sapien
tttattgttggagtcttgttgattc

SEQ ID NO: 245107 - DNA, 25 bp, Homo sapien
ggagtcttgttgattctctatgaat

SEQ ID NO: 245108 - DNA, 25 bp, Homo sapien
ataatttctatttgattgtactgtg

SEQ ID NO: 245109 - DNA, 25 bp, Homo sapien
tactgtgtagagttaatacccacta

SEQ ID NO: 245110 - DNA, 25 bp, Homo sapien
gagttaatacccactagggatatgt

SEQ ID NO: 245111 - DNA, 25 bp, Homo sapien
gccttcagctgaatgtaagaagtcc

SEQ ID NO: 245112 - DNA, 25 bp, Homo sapien
gtaagaagtccagctatcatgaagt

SEQ ID NO: 245113 - DNA, 25 bp, Homo sapien
aagtccagctatcatgaagtctcca

SEQ ID NO: 245114 - DNA, 25 bp, Homo sapien
gctatcatgaagtctccatgtggac

SEQ ID NO: 245115 - DNA, 25 bp, Homo sapien
tgaagtctccatgtggacagacaat

SEQ ID NO: 245116 - DNA, 25 bp, Homo sapien
agtctccatgtggacagacaattca

SEQ ID NO: 245117 - DNA, 25 bp, Homo sapien
agtgccagcacctagatgtttgaat

SEQ ID NO: 245118 - DNA, 25 bp, Homo sapien
gcacctagatgtttgaatcttccca

SEQ ID NO: 245119 - DNA, 25 bp, Homo sapien
tttgaatcttcccagcccagataca

SEQ ID NO: 245120 - DNA, 25 bp, Homo sapien
atcttcccagcccagatacatgatg

SEQ ID NO: 245121 - DNA, 25 bp, Homo sapien
tcccagcccagatacatgatggaaa

SEQ ID NO: 245122 - DNA, 25 bp, Homo sapien
ctccctggccgtgaacaaatgtgac

SEQ ID NO: 245123 - DNA, 25 bp, Homo sapien
tcaaccttgtttctatctcgcagaa

SEQ ID NO: 245124 - DNA, 25 bp, Homo sapien
cagtcccaacttcatcacggatttg

SEQ ID NO: 245125 - DNA, 25 bp, Homo sapien
aacttcatcacggatttgctgtgtg

SEQ ID NO: 245126 - DNA, 25 bp, Homo sapien
gatttgctgtgtggctggacgttct

SEQ ID NO: 245127 - DNA, 25 bp, Homo sapien
tgtggctggacgttctgttctctct

SEQ ID NO: 245128 - DNA, 25 bp, Homo sapien
tgggcctcaatgtccttcttccaaa

SEQ ID NO: 245129 - DNA, 25 bp, Homo sapien
ttctatctcgcagaagctatgcttc

SEQ ID NO: 245130 - DNA, 25 bp, Homo sapien
tgtccttcttccaaaggaggctttt

SEQ ID NO: 245131 - DNA, 25 bp, Homo sapien
aaagccttgcgcctggctgttgttt

SEQ ID NO: 245132 - DNA, 25 bp, Homo sapien
ttgtttcctgcaggcctccatcaaa

SEQ ID NO: 245133 - DNA, 25 bp, Homo sapien
ggcacatagtaagtagtcgataggt

SEQ ID NO: 245134 - DNA, 25 bp, Homo sapien
agtagtcgataggtgttaacaattt

SEQ ID NO: 245135 - DNA, 25 bp, Homo sapien
tattgttattttctggagtccaact

SEQ ID NO: 245136 - DNA, 25 bp, Homo sapien
gagtccaactaacaaatcccacagt

SEQ ID NO: 245137 - DNA, 25 bp, Homo sapien
aaatcccacagtgaatgacatcaca

SEQ ID NO: 245138 - DNA, 25 bp, Homo sapien
aatatgtcaggtttgtacctaccac

SEQ ID NO: 245139 - DNA, 25 bp, Homo sapien
gatgcaaccaacaagatccagaata

SEQ ID NO: 245140 - DNA, 25 bp, Homo sapien
cagaatatggaaacttctactagat

SEQ ID NO: 245141 - DNA, 25 bp, Homo sapien
gtcaggtttgtacctaccacattta

SEQ ID NO: 245142 - DNA, 25 bp, Homo sapien
tagataaacaactccatttcttcag

SEQ ID NO: 245143 - DNA, 25 bp, Homo sapien
gcacttcatgcacagactggcacat

SEQ ID NO: 245144 - DNA, 25 bp, Homo sapien
taatactttcaagcgtttctatggt

SEQ ID NO: 245145 - DNA, 25 bp, Homo sapien
gcgtttctatggtatttgtcagctg

SEQ ID NO: 245146 - DNA, 25 bp, Homo sapien
ggtatttgtcagctgtggagcaaca

SEQ ID NO: 245147 - DNA, 25 bp, Homo sapien
gagcaacagcacacatctgtattaa

SEQ ID NO: 245148 - DNA, 25 bp, Homo sapien
agcacacatctgtattaatagcctg

SEQ ID NO: 245149 - DNA, 25 bp, Homo sapien
atagcctgtgttaagagattactgt

SEQ ID NO: 245150 - DNA, 25 bp, Homo sapien
gaatcctgaaaaacatcctcattgt

SEQ ID NO: 245151 - DNA, 25 bp, Homo sapien
aaacacaggcttttgcacatccaat

SEQ ID NO: 245152 - DNA, 25 bp, Homo sapien
gcacatccaatgtctccttaaagca

SEQ ID NO: 245153 - DNA, 25 bp, Homo sapien
aattccaatacatcagtgcatgtgg

SEQ ID NO: 245154 - DNA, 25 bp, Homo sapien
gagaaggttctaggcttccgaagta

SEQ ID NO: 245155 - DNA, 25 bp, Homo sapien
caatgactaaagatactgcttgcaa

SEQ ID NO: 245156 - DNA, 25 bp, Homo sapien
ctgcttgcaagaaaactggctgaga

SEQ ID NO: 245157 - DNA, 25 bp, Homo sapien
agaggaaaatcttagttgcttggcg

SEQ ID NO: 245158 - DNA, 25 bp, Homo sapien
aaaatcttagttgcttggcgggagg

SEQ ID NO: 245159 - DNA, 25 bp, Homo sapien
aaccaagtagcaaggatctagctga

SEQ ID NO: 245160 - DNA, 25 bp, Homo sapien
gtagcaaggatctagctgagagaat

SEQ ID NO: 245161 - DNA, 25 bp, Homo sapien
atacattaatataggaggacagaca

SEQ ID NO: 245162 - DNA, 25 bp, Homo sapien
gacagacaaagatcctgaaaaggct

SEQ ID NO: 245163 - DNA, 25 bp, Homo sapien
agagcatccaaagcacaggtggaga

SEQ ID NO: 245164 - DNA, 25 bp, Homo sapien
acaaaaaggttagggctgctggcag

SEQ ID NO: 245165 - DNA, 25 bp, Homo sapien
ctggcagctgtggagagaactgtac

SEQ ID NO: 245166 - DNA, 25 bp, Homo sapien
aagaggataaacacacagccatact

SEQ ID NO: 245167 - DNA, 25 bp, Homo sapien
acacagccatactcctgggccagag

SEQ ID NO: 245168 - DNA, 25 bp, Homo sapien
gaacaacattgaaaaagtccaggaa

SEQ ID NO: 245169 - DNA, 25 bp, Homo sapien
agttcctgtgcccaaaggtacgaat

SEQ ID NO: 245170 - DNA, 25 bp, Homo sapien
gtgcccaaaggtacgaatgtgtctt

SEQ ID NO: 245171 - DNA, 25 bp, Homo sapien
aatgtgtcttttcgaattcccttga

SEQ ID NO: 245172 - DNA, 25 bp, Homo sapien
gtgtcttttcgaattcccttgataa

SEQ ID NO: 245173 - DNA, 25 bp, Homo sapien
taaagaagcctcagacaaggaagaa

SEQ ID NO: 245174 - DNA, 25 bp, Homo sapien
ggacacataaataggacacccagca

SEQ ID NO: 245175 - DNA, 25 bp, Homo sapien
taggacacccagcaaaggccagaag

SEQ ID NO: 245176 - DNA, 25 bp, Homo sapien
cttctaggagaagggacatctgtgc

SEQ ID NO: 245177 - DNA, 25 bp, Homo sapien
aagccagcaacccagcccttgaggg

SEQ ID NO: 245178 - DNA, 25 bp, Homo sapien
tctgcagggtgggaccccacactgt

SEQ ID NO: 245179 - DNA, 25 bp, Homo sapien
tgagtctccaggttcactctcagag

SEQ ID NO: 245180 - DNA, 25 bp, Homo sapien
ttcactctcagaggttctggctcag

SEQ ID NO: 245181 - DNA, 25 bp, Homo sapien
tggctccgcccaactgtgagtcaga

SEQ ID NO: 245182 - DNA, 25 bp, Homo sapien
ttatctccaacttccaaagtcaggt

SEQ ID NO: 245183 - DNA, 25 bp, Homo sapien
aacttccaaagtcaggttgtaggat

SEQ ID NO: 245184 - DNA, 25 bp, Homo sapien
gttgtaggatgagaacccgctgata

SEQ ID NO: 245185 - DNA, 25 bp, Homo sapien
tgagaacccgctgataccattctaa

SEQ ID NO: 245186 - DNA, 25 bp, Homo sapien
tgataccattctaagtccgctgcta

SEQ ID NO: 245187 - DNA, 25 bp, Homo sapien
attctaagtccgctgctagagtcct

SEQ ID NO: 245188 - DNA, 25 bp, Homo sapien
agctccgcttgctggcgtcgtctgg

SEQ ID NO: 245189 - DNA, 25 bp, Homo sapien
ggctatgccatagccgcatcttcga

SEQ ID NO: 245190 - DNA, 25 bp, Homo sapien
atgccatagccgcatcttcgatgtc

SEQ ID NO: 245191 - DNA, 25 bp, Homo sapien
tagccgcatcttcgatgtccttctg

SEQ ID NO: 245192 - DNA, 25 bp, Homo sapien
tctgcctcgggactggcagatggcg

SEQ ID NO: 245193 - DNA, 25 bp, Homo sapien
ggcagatggcgccagggagaggact

SEQ ID NO: 245194 - DNA, 25 bp, Homo sapien
accctccagtcatcgtaacgcgtgt

SEQ ID NO: 245195 - DNA, 25 bp, Homo sapien
ctccatgtaggtccacgtttaggtt

SEQ ID NO: 245196 - DNA, 25 bp, Homo sapien
gtccacgtttaggttgggaggatct

SEQ ID NO: 245197 - DNA, 25 bp, Homo sapien
ttaggttgggaggatctaccatgaa

SEQ ID NO: 245198 - DNA, 25 bp, Homo sapien
gaggatctaccatgaagaaggtcaa

SEQ ID NO: 245199 - DNA, 25 bp, Homo sapien
tgtgactttgtaccactaacctgtg

SEQ ID NO: 245200 - DNA, 25 bp, Homo sapien
taacctgtggttcaaacctgggtgt

SEQ ID NO: 245201 - DNA, 25 bp, Homo sapien
gtgtgtttctggcatctccctaacc

SEQ ID NO: 245202 - DNA, 25 bp, Homo sapien
tctccctaacccagatcagcaatgg

SEQ ID NO: 245203 - DNA, 25 bp, Homo sapien
tgctcctctgaggtcagcagaagac

SEQ ID NO: 245204 - DNA, 25 bp, Homo sapien
ggccacactggaatgggaagtcttt

SEQ ID NO: 245205 - DNA, 25 bp, Homo sapien
cccactggatgtgcctgtctggtgg

SEQ ID NO: 245206 - DNA, 25 bp, Homo sapien
tgcctgtctggtgggttttggacct

SEQ ID NO: 245207 - DNA, 25 bp, Homo sapien
atggccattggaagagtctggttca

SEQ ID NO: 245208 - DNA, 25 bp, Homo sapien
tggttcagtttttcccaactctctt

SEQ ID NO: 245209 - DNA, 25 bp, Homo sapien
gggcctctgggttttctgaaggcac

SEQ ID NO: 245210 - DNA, 25 bp, Homo sapien
gaactattgaagtcctcagcacatg

SEQ ID NO: 245211 - DNA, 25 bp, Homo sapien
gcacatgttcttcatggaggtcatc

SEQ ID NO: 245212 - DNA, 25 bp, Homo sapien
atggaggtcatctttccctggactg

SEQ ID NO: 245213 - DNA, 25 bp, Homo sapien
cctggactgcttggctactttagaa

SEQ ID NO: 245214 - DNA, 25 bp, Homo sapien
aagccaatcacaatttcccaacaat

SEQ ID NO: 245215 - DNA, 25 bp, Homo sapien
ttaggatccatcattcaccatttgg

SEQ ID NO: 245216 - DNA, 25 bp, Homo sapien
catttggttggtccctgctgctaag

SEQ ID NO: 245217 - DNA, 25 bp, Homo sapien
ccctgctgctaagaattccaaacta

SEQ ID NO: 245218 - DNA, 25 bp, Homo sapien
ttaaactcagctagatttccctgcc

SEQ ID NO: 245219 - DNA, 25 bp, Homo sapien
caaccccagtggcaacataattctt

SEQ ID NO: 245220 - DNA, 25 bp, Homo sapien
aaacgaaatctatacttgccttgag

SEQ ID NO: 245221 - DNA, 25 bp, Homo sapien
gcatgccccatttataatcgtagcc

SEQ ID NO: 245222 - DNA, 25 bp, Homo sapien
catttataatcgtagcccagcacat

SEQ ID NO: 245223 - DNA, 25 bp, Homo sapien
gtagcccagcacatggaagggaccc

SEQ ID NO: 245224 - DNA, 25 bp, Homo sapien
aagggacccaagagaatgacagcaa

SEQ ID NO: 245225 - DNA, 25 bp, Homo sapien
tgacagcaacgttggctttgccatt

SEQ ID NO: 245226 - DNA, 25 bp, Homo sapien
cgttggctttgccatttcaaccctg

SEQ ID NO: 245227 - DNA, 25 bp, Homo sapien
tactgttctattcatattatctggg

SEQ ID NO: 245228 - DNA, 25 bp, Homo sapien
acattcctttctgttggtgccacca

SEQ ID NO: 245229 - DNA, 25 bp, Homo sapien
atctctgtgcctccgtgtgctgctg

SEQ ID NO: 245230 - DNA, 25 bp, Homo sapien
aagcaatccctgactttatggcact

SEQ ID NO: 245231 - DNA, 25 bp, Homo sapien
gagcccctggcatgcagccagcatg

SEQ ID NO: 245232 - DNA, 25 bp, Homo sapien
gcttacaattgtgaagagcccacag

SEQ ID NO: 245233 - DNA, 25 bp, Homo sapien
gaagagcccacagaaaagttacctt

SEQ ID NO: 245234 - DNA, 25 bp, Homo sapien
gttaccttttcccatcatcgatgat

SEQ ID NO: 245235 - DNA, 25 bp, Homo sapien
cgatgataggaatcgggagcttgcc

SEQ ID NO: 245236 - DNA, 25 bp, Homo sapien
gggagcttgccatcctgttgggcat

SEQ ID NO: 245237 - DNA, 25 bp, Homo sapien
tgccatcctgttgggcatgctggat

SEQ ID NO: 245238 - DNA, 25 bp, Homo sapien
gctggatccagcagagaaggatgaa

SEQ ID NO: 245239 - DNA, 25 bp, Homo sapien
atgcctgtgacagctcgtgtggtgt

SEQ ID NO: 245240 - DNA, 25 bp, Homo sapien
gtgacagctcgtgtggtgtttgttt

SEQ ID NO: 245241 - DNA, 25 bp, Homo sapien
gctgaagctgtctatcctctaccca

SEQ ID NO: 245242 - DNA, 25 bp, Homo sapien
agattctcagggtagtcatctctct

SEQ ID NO: 245243 - DNA, 25 bp, Homo sapien
gattagaatctttgcatgtcccttt

SEQ ID NO: 245244 - DNA, 25 bp, Homo sapien
tttgcatgtccctttctgagttaat

SEQ ID NO: 245245 - DNA, 25 bp, Homo sapien
gtccctttctgagttaatggtagtt

SEQ ID NO: 245246 - DNA, 25 bp, Homo sapien
tctatttttccaagatttacctcta

SEQ ID NO: 245247 - DNA, 25 bp, Homo sapien
agatttacctctaattcttcctctt

SEQ ID NO: 245248 - DNA, 25 bp, Homo sapien
gaaccggaagagtatgaatgtattg

SEQ ID NO: 245249 - DNA, 25 bp, Homo sapien
tgaaacttttcctattagctttaat

SEQ ID NO: 245250 - DNA, 25 bp, Homo sapien
agctttaatactcctagcactttta

SEQ ID NO: 245251 - DNA, 25 bp, Homo sapien
gaatgtattgaaaccaagggaccag

SEQ ID NO: 245252 - DNA, 25 bp, Homo sapien
ccagtgggtttcaaggagagtgtaa

SEQ ID NO: 245253 - DNA, 25 bp, Homo sapien
gagtgtaatcgggaccgtttggatt

SEQ ID NO: 245254 - DNA, 25 bp, Homo sapien
aatgtgaaattcctagagcagctta

SEQ ID NO: 245255 - DNA, 25 bp, Homo sapien
gtgaaattcctagagcagcttaatg

SEQ ID NO: 245256 - DNA, 25 bp, Homo sapien
gagcagcttaatgctagtctctatt

SEQ ID NO: 245257 - DNA, 25 bp, Homo sapien
aatgctagtctctatttggctacct

SEQ ID NO: 245258 - DNA, 25 bp, Homo sapien
gctagtctctatttggctacctttt

SEQ ID NO: 245259 - DNA, 25 bp, Homo sapien
gtctctatttggctacctttttctt

SEQ ID NO: 245260 - DNA, 25 bp, Homo sapien
tctatttggctacctttttctttag

SEQ ID NO: 245261 - DNA, 25 bp, Homo sapien
gaattgcttatatagttagtgtatg

SEQ ID NO: 245262 - DNA, 25 bp, Homo sapien
atattttctctccattatagctcat

SEQ ID NO: 245263 - DNA, 25 bp, Homo sapien
ctctccattatagctcatcatcttt

SEQ ID NO: 245264 - DNA, 25 bp, Homo sapien
ttatagctcatcatcttttagcttt

SEQ ID NO: 245265 - DNA, 25 bp, Homo sapien
aaacttctttgggatagaaatcatt

SEQ ID NO: 245266 - DNA, 25 bp, Homo sapien
gaaaccaagcatactgcactctaat

SEQ ID NO: 245267 - DNA, 25 bp, Homo sapien
actgcactctaatattttactgtaa

SEQ ID NO: 245268 - DNA, 25 bp, Homo sapien
agaattaatgtatttttcaccagtt

SEQ ID NO: 245269 - DNA, 25 bp, Homo sapien
ccagttttccatataccttaggtct

SEQ ID NO: 245270 - DNA, 25 bp, Homo sapien
ataccttaggtcttgatcgtttgtc

SEQ ID NO: 245271 - DNA, 25 bp, Homo sapien
gtcttgatcgtttgtccttaaaaag

SEQ ID NO: 245272 - DNA, 25 bp, Homo sapien
ggatcagcatgagtatagacagtag

SEQ ID NO: 245273 - DNA, 25 bp, Homo sapien
gaaatgtatgggtagtctaaccact

SEQ ID NO: 245274 - DNA, 25 bp, Homo sapien
gggtagtctaaccacttttatcaga

SEQ ID NO: 245275 - DNA, 25 bp, Homo sapien
ctgtggtctcactctagctgagcag

SEQ ID NO: 245276 - DNA, 25 bp, Homo sapien
gcactagtgattgctaagttctctt

SEQ ID NO: 245277 - DNA, 25 bp, Homo sapien
gttctcttacagctaggattccgtt

SEQ ID NO: 245278 - DNA, 25 bp, Homo sapien
gattccgttattctattgtcctgat

SEQ ID NO: 245279 - DNA, 25 bp, Homo sapien
tgatctgaaatctcccagccaaagc

SEQ ID NO: 245280 - DNA, 25 bp, Homo sapien
atctcccagccaaagctttaggaag

SEQ ID NO: 245281 - DNA, 25 bp, Homo sapien
tttaggaagccacctattctccctg

SEQ ID NO: 245282 - DNA, 25 bp, Homo sapien
ctccctgttctcctatgaagtttgt

SEQ ID NO: 245283 - DNA, 25 bp, Homo sapien
tgatctgagtggactcgccagtcta

SEQ ID NO: 245284 - DNA, 25 bp, Homo sapien
gactcgccagtctagctaacatgga

SEQ ID NO: 245285 - DNA, 25 bp, Homo sapien
aacatggagggctagcttcctctca

SEQ ID NO: 245286 - DNA, 25 bp, Homo sapien
cagagtgtgctttgttgtgctttct

SEQ ID NO: 245287 - DNA, 25 bp, Homo sapien
ttgtcattgttgagactgtccgtgg

SEQ ID NO: 245288 - DNA, 25 bp, Homo sapien
tgggctgctggtactgtccattcat

SEQ ID NO: 245289 - DNA, 25 bp, Homo sapien
attcatcctgctctctttgctggag

SEQ ID NO: 245290 - DNA, 25 bp, Homo sapien
gacacatacgtggtgatcttccgcc

SEQ ID NO: 245291 - DNA, 25 bp, Homo sapien
cgcagcttggctgagtgttcaaatc

SEQ ID NO: 245292 - DNA, 25 bp, Homo sapien
acaggctactatgggcagtttcttc

SEQ ID NO: 245293 - DNA, 25 bp, Homo sapien
gtggactcctggtagctatggcaac

SEQ ID NO: 245294 - DNA, 25 bp, Homo sapien
ggcaaccgctgcacttgatcttggc

SEQ ID NO: 245295 - DNA, 25 bp, Homo sapien
tgatcttggcgctgctgcccaagtg

SEQ ID NO: 245296 - DNA, 25 bp, Homo sapien
ccaagtgctctggtctggtgaatcg

SEQ ID NO: 245297 - DNA, 25 bp, Homo sapien
gtctggtgaatcgtcgcaggcagtc

SEQ ID NO: 245298 - DNA, 25 bp, Homo sapien
ggctcaacttccaccccagttacaa

SEQ ID NO: 245299 - DNA, 25 bp, Homo sapien
cccagttacaacatcaacaggccat

SEQ ID NO: 245300 - DNA, 25 bp, Homo sapien
acatcaacaggccatccatctgcga

SEQ ID NO: 245301 - DNA, 25 bp, Homo sapien
gggctggaaactccctctaggagtc

SEQ ID NO: 245302 - DNA, 25 bp, Homo sapien
gaaactccctctaggagtcctctga

SEQ ID NO: 245303 - DNA, 25 bp, Homo sapien
gaaaatattattcgtctgcggagta

SEQ ID NO: 245304 - DNA, 25 bp, Homo sapien
tattattcgtctgcggagtaggaaa

SEQ ID NO: 245305 - DNA, 25 bp, Homo sapien
tcgtctgcggagtaggaaaatatgc

SEQ ID NO: 245306 - DNA, 25 bp, Homo sapien
atgggaaagatgctaatggttgact

SEQ ID NO: 245307 - DNA, 25 bp, Homo sapien
atggttgactttgcattaaaaacgt

SEQ ID NO: 245308 - DNA, 25 bp, Homo sapien
gcattaaaaacgttgtcacatcctg

SEQ ID NO: 245309 - DNA, 25 bp, Homo sapien
acactggaaagggtatccacagcag

SEQ ID NO: 245310 - DNA, 25 bp, Homo sapien
tccacagcaggaagtccccagttca

SEQ ID NO: 245311 - DNA, 25 bp, Homo sapien
agttcacctccatgactacagggca

SEQ ID NO: 245312 - DNA, 25 bp, Homo sapien
tccatgactacagggcagctttgca

SEQ ID NO: 245313 - DNA, 25 bp, Homo sapien
gcagctttgcacagccctctgggcg

SEQ ID NO: 245314 - DNA, 25 bp, Homo sapien
cgcactgtgtgcctctgcccagaag

SEQ ID NO: 245315 - DNA, 25 bp, Homo sapien
ctcctcagttgcatttcttcagtag

SEQ ID NO: 245316 - DNA, 25 bp, Homo sapien
cagtagattcatttccttgatgcaa

SEQ ID NO: 245317 - DNA, 25 bp, Homo sapien
gcaaagcatctgtatttgttggttc

SEQ ID NO: 245318 - DNA, 25 bp, Homo sapien
ggttctgtcatttgagcgatgtctc

SEQ ID NO: 245319 - DNA, 25 bp, Homo sapien
gagcgatgtctctgacttgtttgtt

SEQ ID NO: 245320 - DNA, 25 bp, Homo sapien
gattacgggcaagtttttattagag

SEQ ID NO: 245321 - DNA, 25 bp, Homo sapien
ttacgggcaagtttttattagagat

SEQ ID NO: 245322 - DNA, 25 bp, Homo sapien
cgcgcccggcctgaactctcagttc

SEQ ID NO: 245323 - DNA, 25 bp, Homo sapien
gcgcccggcctgaactctcagttct

SEQ ID NO: 245324 - DNA, 25 bp, Homo sapien
cgcccggcctgaactctcagttcta

SEQ ID NO: 245325 - DNA, 25 bp, Homo sapien
gcccggcctgaactctcagttctaa

SEQ ID NO: 245326 - DNA, 25 bp, Homo sapien
actctcagttctaacgcagggattc

SEQ ID NO: 245327 - DNA, 25 bp, Homo sapien
ctctcagttctaacgcagggattca

SEQ ID NO: 245328 - DNA, 25 bp, Homo sapien
tctcagttctaacgcagggattcag

SEQ ID NO: 245329 - DNA, 25 bp, Homo sapien
gggtggttgttcttcaagcaagttc

SEQ ID NO: 245330 - DNA, 25 bp, Homo sapien
agttctgcttgcacttttgcatttg

SEQ ID NO: 245331 - DNA, 25 bp, Homo sapien
tttgcatttgcctaacagacttttg

SEQ ID NO: 245332 - DNA, 25 bp, Homo sapien
aacagacttttgcagaggcgatggc

SEQ ID NO: 245333 - DNA, 25 bp, Homo sapien
aggcatggtccctggagccgagcct

SEQ ID NO: 245334 - DNA, 25 bp, Homo sapien
actcgtccaagttcggatgcgggaa

SEQ ID NO: 245335 - DNA, 25 bp, Homo sapien
atgcgggaacctggtcccagcttga

SEQ ID NO: 245336 - DNA, 25 bp, Homo sapien
tttcccaccacaaattatcaactgg

SEQ ID NO: 245337 - DNA, 25 bp, Homo sapien
tcaactggttgatgtgtacactaat

SEQ ID NO: 245338 - DNA, 25 bp, Homo sapien
gctatttatgttgtgcctctgcagg

SEQ ID NO: 245339 - DNA, 25 bp, Homo sapien
gcctctgcaggcaaagcccttaata

SEQ ID NO: 245340 - DNA, 25 bp, Homo sapien
tcagctcccacagtgccttttaagg

SEQ ID NO: 245341 - DNA, 25 bp, Homo sapien
tttaagggggacctcacctcctgtg

SEQ ID NO: 245342 - DNA, 25 bp, Homo sapien
gcacagcccaggcatagacgagctg

SEQ ID NO: 245343 - DNA, 25 bp, Homo sapien
catagacgagctggcgttggaccca

SEQ ID NO: 245344 - DNA, 25 bp, Homo sapien
agacgagctggcgttggacccagtt

SEQ ID NO: 245345 - DNA, 25 bp, Homo sapien
gagctggcgttggacccagttcttc

SEQ ID NO: 245346 - DNA, 25 bp, Homo sapien
agctgctgccacaggggccaactag

SEQ ID NO: 245347 - DNA, 25 bp, Homo sapien
tgagaagccaacccctagcccaggg

SEQ ID NO: 245348 - DNA, 25 bp, Homo sapien
gggaactgggatccaatttgtagct

SEQ ID NO: 245349 - DNA, 25 bp, Homo sapien
tgggatccaatttgtagcttcctgc

SEQ ID NO: 245350 - DNA, 25 bp, Homo sapien
agcaaccttctaggcctgctttcca

SEQ ID NO: 245351 - DNA, 25 bp, Homo sapien
attgcagactcggatcagttgcctg

SEQ ID NO: 245352 - DNA, 25 bp, Homo sapien
cagttgcctgggtactcggtggaaa

SEQ ID NO: 245353 - DNA, 25 bp, Homo sapien
tcggtggaaaccaacattctgccca

SEQ ID NO: 245354 - DNA, 25 bp, Homo sapien
aaaccaacattctgcccacaaaaat

SEQ ID NO: 245355 - DNA, 25 bp, Homo sapien
ttatggcaagccacggcctttgtcc

SEQ ID NO: 245356 - DNA, 25 bp, Homo sapien
ttgtccatgcctgctgatgggaact

SEQ ID NO: 245357 - DNA, 25 bp, Homo sapien
ttttgccagacctcgaggtcatggc

SEQ ID NO: 245358 - DNA, 25 bp, Homo sapien
aggatgccctttgccggtatttcag

SEQ ID NO: 245359 - DNA, 25 bp, Homo sapien
tttgccggtatttcagtaacgagcg

SEQ ID NO: 245360 - DNA, 25 bp, Homo sapien
tttcagtaacgagcggattcctccg

SEQ ID NO: 245361 - DNA, 25 bp, Homo sapien
gcggattcctccgatcattgaagag

SEQ ID NO: 245362 - DNA, 25 bp, Homo sapien
gagctttgctgcagaacagggtcct

SEQ ID NO: 245363 - DNA, 25 bp, Homo sapien
gagtctttaatccagctcagacagc

SEQ ID NO: 245364 - DNA, 25 bp, Homo sapien
ctggtggccacgaatgaagtcccaa

SEQ ID NO: 245365 - DNA, 25 bp, Homo sapien
gaagtcccaaccaagtcaggattag

SEQ ID NO: 245366 - DNA, 25 bp, Homo sapien
attagctatggaccctgcttctgga

SEQ ID NO: 245367 - DNA, 25 bp, Homo sapien
attaactcctagaagccagactgcc

SEQ ID NO: 245368 - DNA, 25 bp, Homo sapien
atcagcctggatggttgcgtacccg

SEQ ID NO: 245369 - DNA, 25 bp, Homo sapien
gttgcgtacccgagaatgccaccta

SEQ ID NO: 245370 - DNA, 25 bp, Homo sapien
aattggcatccagagctcagggtag

SEQ ID NO: 245371 - DNA, 25 bp, Homo sapien
ggtagggctcagatgggtccaaaaa

SEQ ID NO: 245372 - DNA, 25 bp, Homo sapien
gaaccaactgttaccagtgctgtgg

SEQ ID NO: 245373 - DNA, 25 bp, Homo sapien
gagatttgatctcatgcgagtcatc

SEQ ID NO: 245374 - DNA, 25 bp, Homo sapien
gatctcatgcgagtcatcaatagga

SEQ ID NO: 245375 - DNA, 25 bp, Homo sapien
ggaggtctgtttgttacataaaaag

SEQ ID NO: 245376 - DNA, 25 bp, Homo sapien
gacctttcggtgtaagaaattgccg

SEQ ID NO: 245377 - DNA, 25 bp, Homo sapien
cctgccctggctggcatgtgagaag

SEQ ID NO: 245378 - DNA, 25 bp, Homo sapien
aagccatggaaggttgtggttgtaa

SEQ ID NO: 245379 - DNA, 25 bp, Homo sapien
gttgtggttgtaaatgagttgtcta

SEQ ID NO: 245380 - DNA, 25 bp, Homo sapien
agaaggtagatttctacagagctga

SEQ ID NO: 245381 - DNA, 25 bp, Homo sapien
tacagagctgagtgttggttccttt

SEQ ID NO: 245382 - DNA, 25 bp, Homo sapien
tcttattggttgaaaattacctggt

SEQ ID NO: 245383 - DNA, 25 bp, Homo sapien
ttacctggtagtgatcagaaaactt

SEQ ID NO: 245384 - DNA, 25 bp, Homo sapien
gtatacaagagtgcattcatgtgcc

SEQ ID NO: 245385 - DNA, 25 bp, Homo sapien
tgcgagaaaaagtaggctcaggctg

SEQ ID NO: 245386 - DNA, 25 bp, Homo sapien
aggatgtcacttgagcacacagctt

SEQ ID NO: 245387 - DNA, 25 bp, Homo sapien
tgtcacttgagcacacagcttcctg

SEQ ID NO: 245388 - DNA, 25 bp, Homo sapien
gcttagaggagcataaagagaccca

SEQ ID NO: 245389 - DNA, 25 bp, Homo sapien
aaagagacccaagaactcttcctct

SEQ ID NO: 245390 - DNA, 25 bp, Homo sapien
ttggctttcccagtaacttctggaa

SEQ ID NO: 245391 - DNA, 25 bp, Homo sapien
gtaacttctggaattacatttggaa

SEQ ID NO: 245392 - DNA, 25 bp, Homo sapien
tacatttggaaagtcacttcacccc

SEQ ID NO: 245393 - DNA, 25 bp, Homo sapien
tgaagccagctctcactgcacctag

SEQ ID NO: 245394 - DNA, 25 bp, Homo sapien
actgcacctagtaggtatacaagag

SEQ ID NO: 245395 - DNA, 25 bp, Homo sapien
acaggtggatgttctgggcaatgct

SEQ ID NO: 245396 - DNA, 25 bp, Homo sapien
gatgttctgggcaatgctgccgcca

SEQ ID NO: 245397 - DNA, 25 bp, Homo sapien
agccgggtcaaagccttcctctgag

SEQ ID NO: 245398 - DNA, 25 bp, Homo sapien
gtcaaagccttcctctgagtcgcag

SEQ ID NO: 245399 - DNA, 25 bp, Homo sapien
atggctgagccgactagtgatttcg

SEQ ID NO: 245400 - DNA, 25 bp, Homo sapien
ccgactagtgatttcgagactccta

SEQ ID NO: 245401 - DNA, 25 bp, Homo sapien
atttcgagactcctatcgggtggca

SEQ ID NO: 245402 - DNA, 25 bp, Homo sapien
gactcctatcgggtggcatgcgtct

SEQ ID NO: 245403 - DNA, 25 bp, Homo sapien
gtggcatgcgtctcccgagctgact

SEQ ID NO: 245404 - DNA, 25 bp, Homo sapien
tgactcccacgttagggcccctgag

SEQ ID NO: 245405 - DNA, 25 bp, Homo sapien
acgttagggcccctgagcgacactg

SEQ ID NO: 245406 - DNA, 25 bp, Homo sapien
gaaggtgtccggcttagaccttgac

SEQ ID NO: 245407 - DNA, 25 bp, Homo sapien
aggtgtccggcttagaccttgacaa

SEQ ID NO: 245408 - DNA, 25 bp, Homo sapien
tccggcttagaccttgacaacagac

SEQ ID NO: 245409 - DNA, 25 bp, Homo sapien
ggcttagaccttgacaacagacact

SEQ ID NO: 245410 - DNA, 25 bp, Homo sapien
gaccttgacaacagacactacccat

SEQ ID NO: 245411 - DNA, 25 bp, Homo sapien
gatgaaaagacattctggccctctg

SEQ ID NO: 245412 - DNA, 25 bp, Homo sapien
tgaaaagacattctggccctctgat

SEQ ID NO: 245413 - DNA, 25 bp, Homo sapien
aaaagacattctggccctctgatcc

SEQ ID NO: 245414 - DNA, 25 bp, Homo sapien
tctgatcctctttcttctccacaaa

SEQ ID NO: 245415 - DNA, 25 bp, Homo sapien
tcttctccacaaaagttttacaaat

SEQ ID NO: 245416 - DNA, 25 bp, Homo sapien
ataaaagatgttcccctaaatacag

SEQ ID NO: 245417 - DNA, 25 bp, Homo sapien
atgggtctgcgcttagtgcccgccg

SEQ ID NO: 245418 - DNA, 25 bp, Homo sapien
gggaacatgaagtgagcgcgactca

SEQ ID NO: 245419 - DNA, 25 bp, Homo sapien
gactcacggcctggagtgcaggaaa

SEQ ID NO: 245420 - DNA, 25 bp, Homo sapien
aaaggcttctcctgcaaggcggtgg

SEQ ID NO: 245421 - DNA, 25 bp, Homo sapien
aaccagaagtctggtagcaccacgt

SEQ ID NO: 245422 - DNA, 25 bp, Homo sapien
ggcgtctctaaactcttggtcgtct

SEQ ID NO: 245423 - DNA, 25 bp, Homo sapien
actcttggtcgtctctgacttttaa

SEQ ID NO: 245424 - DNA, 25 bp, Homo sapien
gtctctgacttttaaacatctaggg

SEQ ID NO: 245425 - DNA, 25 bp, Homo sapien
aagttctaaaacgtgtgtcctggcg

SEQ ID NO: 245426 - DNA, 25 bp, Homo sapien
tgtgtcctggcgtagtagttttggt

SEQ ID NO: 245427 - DNA, 25 bp, Homo sapien
agtagttttggttggcacttggtga

SEQ ID NO: 245428 - DNA, 25 bp, Homo sapien
gcaattcatttcatagttgtcaaga

SEQ ID NO: 245429 - DNA, 25 bp, Homo sapien
gtcaagactatacaaattgtccttt

SEQ ID NO: 245430 - DNA, 25 bp, Homo sapien
ttttaatgttctctcttctgctatc

SEQ ID NO: 245431 - DNA, 25 bp, Homo sapien
tctcttctgctatccctagttggca

SEQ ID NO: 245432 - DNA, 25 bp, Homo sapien
atccctagttggcagtcttcctctt

SEQ ID NO: 245433 - DNA, 25 bp, Homo sapien
tcttcctctttacaacctgctgaaa

SEQ ID NO: 245434 - DNA, 25 bp, Homo sapien
ttcctttaattcctcagcaaaccac

SEQ ID NO: 245435 - DNA, 25 bp, Homo sapien
tcctcagcaaaccaccaactattat

SEQ ID NO: 245436 - DNA, 25 bp, Homo sapien
accaccaactattatatgtcttttt

SEQ ID NO: 245437 - DNA, 25 bp, Homo sapien
aaaattggctgctagggtctgctca

SEQ ID NO: 245438 - DNA, 25 bp, Homo sapien
tagggtctgctcacttccctgtttt

SEQ ID NO: 245439 - DNA, 25 bp, Homo sapien
ttacattcagaagagatccaaacaa

SEQ ID NO: 245440 - DNA, 25 bp, Homo sapien
gatccaaacaactataggccacgaa

SEQ ID NO: 245441 - DNA, 25 bp, Homo sapien
acaactataggccacgaataaacaa

SEQ ID NO: 245442 - DNA, 25 bp, Homo sapien
gatgattagactgactctgagaata

SEQ ID NO: 245443 - DNA, 25 bp, Homo sapien
ctctgagaatattgataagccattt

SEQ ID NO: 245444 - DNA, 25 bp, Homo sapien
tttgtcatataaaacttgaatcagg

SEQ ID NO: 245445 - DNA, 25 bp, Homo sapien
ttgaatcaggattttatgccccaca

SEQ ID NO: 245446 - DNA, 25 bp, Homo sapien
gaatcaggattttatgccccacata

SEQ ID NO: 245447 - DNA, 25 bp, Homo sapien
atcaggattttatgccccacatact

SEQ ID NO: 245448 - DNA, 25 bp, Homo sapien
gccccacatactctggaacttgaag

SEQ ID NO: 245449 - DNA, 25 bp, Homo sapien
aagccagttgggttctaaattgtag

SEQ ID NO: 245450 - DNA, 25 bp, Homo sapien
gtctcatggttgagggtctggtcct

SEQ ID NO: 245451 - DNA, 25 bp, Homo sapien
tggtccttgggaatgcaggtttaga

SEQ ID NO: 245452 - DNA, 25 bp, Homo sapien
aacatctcaatttattcgttggtgg

SEQ ID NO: 245453 - DNA, 25 bp, Homo sapien
gggcaagccttgaaggtgcattcac

SEQ ID NO: 245454 - DNA, 25 bp, Homo sapien
gcatcatgcctagaacagtttcaca

SEQ ID NO: 245455 - DNA, 25 bp, Homo sapien
ggtgcattcacttcggtaaaattta

SEQ ID NO: 245456 - DNA, 25 bp, Homo sapien
gtaaaatttacatatctcacaccaa

SEQ ID NO: 245457 - DNA, 25 bp, Homo sapien
atactgcctgagaaccaaactactt

SEQ ID NO: 245458 - DNA, 25 bp, Homo sapien
taaaacacgtctatctggctctcaa

SEQ ID NO: 245459 - DNA, 25 bp, Homo sapien
tggctctcaaaagggaggcctcact

SEQ ID NO: 245460 - DNA, 25 bp, Homo sapien
aggcctcactgggaggtcagacatt

SEQ ID NO: 245461 - DNA, 25 bp, Homo sapien
cttcctactgactcaaatagtttat

SEQ ID NO: 245462 - DNA, 25 bp, Homo sapien
ggaataactgtctactgtttactag

SEQ ID NO: 245463 - DNA, 25 bp, Homo sapien
acttatataatacatgcagagacaa

SEQ ID NO: 245464 - DNA, 25 bp, Homo sapien
tgcagagacaagatacacaatgatt

SEQ ID NO: 245465 - DNA, 25 bp, Homo sapien
gaactatatttctcattgcactctg

SEQ ID NO: 245466 - DNA, 25 bp, Homo sapien
atttctcattgcactctgtaataaa

SEQ ID NO: 245467 - DNA, 25 bp, Homo sapien
agcagttagttgttacttacctaag

SEQ ID NO: 245468 - DNA, 25 bp, Homo sapien
tacctaagagttaccacttccgtag

SEQ ID NO: 245469 - DNA, 25 bp, Homo sapien
gagttaccacttccgtagcctataa

SEQ ID NO: 245470 - DNA, 25 bp, Homo sapien
acttccgtagcctataacatcaaaa

SEQ ID NO: 245471 - DNA, 25 bp, Homo sapien
attgaactctatcagctatgaagct

SEQ ID NO: 245472 - DNA, 25 bp, Homo sapien
atccaattatggtgactgcttagaa

SEQ ID NO: 245473 - DNA, 25 bp, Homo sapien
tgcttagaaatatcccttttcctcc

SEQ ID NO: 245474 - DNA, 25 bp, Homo sapien
ctttccttctcccataaacataata

SEQ ID NO: 245475 - DNA, 25 bp, Homo sapien
ataataatgtctcctgccagtacta

SEQ ID NO: 245476 - DNA, 25 bp, Homo sapien
cagtactaaggcatggcccatggac

SEQ ID NO: 245477 - DNA, 25 bp, Homo sapien
taacacctatgctcacgttagctct

SEQ ID NO: 245478 - DNA, 25 bp, Homo sapien
tcacgttagctcttgaggccgagtg

SEQ ID NO: 245479 - DNA, 25 bp, Homo sapien
aggccgagtggcttggttctatctg

SEQ ID NO: 245480 - DNA, 25 bp, Homo sapien
ggcttggttctatctggttatcaga

SEQ ID NO: 245481 - DNA, 25 bp, Homo sapien
gcaaacttcatcacagcagggattt

SEQ ID NO: 245482 - DNA, 25 bp, Homo sapien
gtgtggtaccagatggtgtttctga

SEQ ID NO: 245483 - DNA, 25 bp, Homo sapien
cagtttcatcccttagtgattgact

SEQ ID NO: 245484 - DNA, 25 bp, Homo sapien
tagtgattgactccgcatttcacct

SEQ ID NO: 245485 - DNA, 25 bp, Homo sapien
gcatttcacctagctacctaagcta

SEQ ID NO: 245486 - DNA, 25 bp, Homo sapien
gctacctaagctagaaacttggaca

SEQ ID NO: 245487 - DNA, 25 bp, Homo sapien
aacttggacatcattcatggctctt

SEQ ID NO: 245488 - DNA, 25 bp, Homo sapien
atcattcatggctctttttacctca

SEQ ID NO: 245489 - DNA, 25 bp, Homo sapien
atggctctttttacctcacttctca

SEQ ID NO: 245490 - DNA, 25 bp, Homo sapien
gaagttctctaaacaccgtgtccca

SEQ ID NO: 245491 - DNA, 25 bp, Homo sapien
accgtgtcccaaatatctgcattat

SEQ ID NO: 245492 - DNA, 25 bp, Homo sapien
tagtacaagcgactgcaaaacaatt

SEQ ID NO: 245493 - DNA, 25 bp, Homo sapien
accaaagtgggtagatcattagatg

SEQ ID NO: 245494 - DNA, 25 bp, Homo sapien
gggtcctggcggatgcttaggcagt

SEQ ID NO: 245495 - DNA, 25 bp, Homo sapien
ttaagaagacatcacttcccccttg

SEQ ID NO: 245496 - DNA, 25 bp, Homo sapien
gtggctgtcctggattccagggaat

SEQ ID NO: 245497 - DNA, 25 bp, Homo sapien
cagggaatgccccaaacccagtgat

SEQ ID NO: 245498 - DNA, 25 bp, Homo sapien
tccatctgctcattcttcataaggt

SEQ ID NO: 245499 - DNA, 25 bp, Homo sapien
attcttcataaggttggctcacagg

SEQ ID NO: 245500 - DNA, 25 bp, Homo sapien
taaggttggctcacaggtcatctgc

SEQ ID NO: 245501 - DNA, 25 bp, Homo sapien
ggtcatctgctgagaaggtcatctt

SEQ ID NO: 245502 - DNA, 25 bp, Homo sapien
tgagaaggtcatcttctccgtcttc

SEQ ID NO: 245503 - DNA, 25 bp, Homo sapien
tccgtcttcactgggctcactgaat

SEQ ID NO: 245504 - DNA, 25 bp, Homo sapien
gaaactgatgcttcaggtaccttga

SEQ ID NO: 245505 - DNA, 25 bp, Homo sapien
atcctccaagatttaacttccaaga

SEQ ID NO: 245506 - DNA, 25 bp, Homo sapien
tgtggccaatgcacgcggagtgcaa

SEQ ID NO: 245507 - DNA, 25 bp, Homo sapien
aatgcacgcggagtgcaaggccgcc

SEQ ID NO: 245508 - DNA, 25 bp, Homo sapien
aaggccgcctagttgggagccgcaa

SEQ ID NO: 245509 - DNA, 25 bp, Homo sapien
gcctagttgggagccgcaagagcct

SEQ ID NO: 245510 - DNA, 25 bp, Homo sapien
gtggcaggcacacggaacccaatcc

SEQ ID NO: 245511 - DNA, 25 bp, Homo sapien
gaaactgtccggagagtggcacgct

SEQ ID NO: 245512 - DNA, 25 bp, Homo sapien
agcgccggcctcaccagaggaagga

SEQ ID NO: 245513 - DNA, 25 bp, Homo sapien
aactgtccggagagtggcacgctaa

SEQ ID NO: 245514 - DNA, 25 bp, Homo sapien
tgtccggagagtggcacgctaagaa

SEQ ID NO: 245515 - DNA, 25 bp, Homo sapien
ggtgtggacaaatcctccaagattt

SEQ ID NO: 245516 - DNA, 25 bp, Homo sapien
cctgttctgttatccaatccgaaac

SEQ ID NO: 245517 - DNA, 25 bp, Homo sapien
ccgaaacacggaacatgctgcaatt

SEQ ID NO: 245518 - DNA, 25 bp, Homo sapien
gctgcaattcaggagtctggctctc

SEQ ID NO: 245519 - DNA, 25 bp, Homo sapien
ctggctctcttcttaagacctatat

SEQ ID NO: 245520 - DNA, 25 bp, Homo sapien
gaagcacttcagtttatcagtctgt

SEQ ID NO: 245521 - DNA, 25 bp, Homo sapien
gtctgtaacctgcaaatgatgctat

SEQ ID NO: 245522 - DNA, 25 bp, Homo sapien
gatttatgtgttaacctcagtcacg

SEQ ID NO: 245523 - DNA, 25 bp, Homo sapien
atgatgctattagttccctccttat

SEQ ID NO: 245524 - DNA, 25 bp, Homo sapien
tagttccctccttattctggaagaa

SEQ ID NO: 245525 - DNA, 25 bp, Homo sapien
ctcagtcacgaggttgatcagctaa

SEQ ID NO: 245526 - DNA, 25 bp, Homo sapien
tgtgggaccaaaatgtgccctgcct

SEQ ID NO: 245527 - DNA, 25 bp, Homo sapien
aataatacctgtgtctcagaggtgt

SEQ ID NO: 245528 - DNA, 25 bp, Homo sapien
taatggttatgagcagggactctgg

SEQ ID NO: 245529 - DNA, 25 bp, Homo sapien
gtgtctcagaggtgttaaggctcaa

SEQ ID NO: 245530 - DNA, 25 bp, Homo sapien
gtagtatgtaacacaggacgctcac

SEQ ID NO: 245531 - DNA, 25 bp, Homo sapien
ggacgctcacaggaggtgttcagta

SEQ ID NO: 245532 - DNA, 25 bp, Homo sapien
aggtgttcagtatatcggctatcag

SEQ ID NO: 245533 - DNA, 25 bp, Homo sapien
cggctatcagattttacaggaccaa

SEQ ID NO: 245534 - DNA, 25 bp, Homo sapien
gattttacaggaccaaccagacggg

SEQ ID NO: 245535 - DNA, 25 bp, Homo sapien
gggtcataaagctgggctgaatttg

SEQ ID NO: 245536 - DNA, 25 bp, Homo sapien
atttgccaaaaacggaggctgctct

SEQ ID NO: 245537 - DNA, 25 bp, Homo sapien
gagtcctcgattcaagtcctgacat

SEQ ID NO: 245538 - DNA, 25 bp, Homo sapien
agcaggtagggcttgctggcccctc

SEQ ID NO: 245539 - DNA, 25 bp, Homo sapien
tgcaccagcaggcttcacttcttag

SEQ ID NO: 245540 - DNA, 25 bp, Homo sapien
tcacttcttaggctcccaggtcggc

SEQ ID NO: 245541 - DNA, 25 bp, Homo sapien
caggtcggcccctggagactctggt

SEQ ID NO: 245542 - DNA, 25 bp, Homo sapien
atgcacacagctacagaacacacaa

SEQ ID NO: 245543 - DNA, 25 bp, Homo sapien
gaacacacaaccttgcataaagagg

SEQ ID NO: 245544 - DNA, 25 bp, Homo sapien
aagagggtttgtggactcagctgaa

SEQ ID NO: 245545 - DNA, 25 bp, Homo sapien
tatggaattaagcactccttccctc

SEQ ID NO: 245546 - DNA, 25 bp, Homo sapien
ttaagcactccttccctcaaaattt

SEQ ID NO: 245547 - DNA, 25 bp, Homo sapien
tcaaaatttcccctggtggttaatg

SEQ ID NO: 245548 - DNA, 25 bp, Homo sapien
ttcccctggtggttaatgtatcaaa

SEQ ID NO: 245549 - DNA, 25 bp, Homo sapien
agcactttcattaccaatacttctt

SEQ ID NO: 245550 - DNA, 25 bp, Homo sapien
atacttctttcaggctattccattc

SEQ ID NO: 245551 - DNA, 25 bp, Homo sapien
tttcaggctattccattccaagatg

SEQ ID NO: 245552 - DNA, 25 bp, Homo sapien
ttccattccaagatgaccaaatagg

SEQ ID NO: 245553 - DNA, 25 bp, Homo sapien
gatttctgcattttcacagagttat

SEQ ID NO: 245554 - DNA, 25 bp, Homo sapien
cagagttattcctttgtagttgtga

SEQ ID NO: 245555 - DNA, 25 bp, Homo sapien
agttgtgatccagcatggatgtggt

SEQ ID NO: 245556 - DNA, 25 bp, Homo sapien
tggtgtggttgtatcagtgactgca

SEQ ID NO: 245557 - DNA, 25 bp, Homo sapien
gggtttttagcttcaagagccacca

SEQ ID NO: 245558 - DNA, 25 bp, Homo sapien
ttagcttcaagagccaccatgctga

SEQ ID NO: 245559 - DNA, 25 bp, Homo sapien
gccaccatgctgacaagtaagcact

SEQ ID NO: 245560 - DNA, 25 bp, Homo sapien
aagcttctagctgtggcctttctgc

SEQ ID NO: 245561 - DNA, 25 bp, Homo sapien
tctagctgtggcctttctgcctgga

SEQ ID NO: 245562 - DNA, 25 bp, Homo sapien
cttctcagggaaactgagcatctgg

SEQ ID NO: 245563 - DNA, 25 bp, Homo sapien
gagcatctgggcgattccatctctg

SEQ ID NO: 245564 - DNA, 25 bp, Homo sapien
catctgggcgattccatctctgaag

SEQ ID NO: 245565 - DNA, 25 bp, Homo sapien
ctttctgcctggagagttctttcag

SEQ ID NO: 245566 - DNA, 25 bp, Homo sapien
ggagagttctttcaggatcaccgta

SEQ ID NO: 245567 - DNA, 25 bp, Homo sapien
gagttctttcaggatcaccgtatta

SEQ ID NO: 245568 - DNA, 25 bp, Homo sapien
tcaggatcaccgtattataagcagg

SEQ ID NO: 245569 - DNA, 25 bp, Homo sapien
caccgtattataagcaggttactaa

SEQ ID NO: 245570 - DNA, 25 bp, Homo sapien
gacggggttactgcagtaccgaaga

SEQ ID NO: 245571 - DNA, 25 bp, Homo sapien
tgaacttctagactcctctctattt

SEQ ID NO: 245572 - DNA, 25 bp, Homo sapien
gactcctctctatttgtattcaaac

SEQ ID NO: 245573 - DNA, 25 bp, Homo sapien
cattaagactcaagtgttttgggtt

SEQ ID NO: 245574 - DNA, 25 bp, Homo sapien
aaccctagatctatgcaggtcccag

SEQ ID NO: 245575 - DNA, 25 bp, Homo sapien
tatgcaggtcccaggtccctgaaat

SEQ ID NO: 245576 - DNA, 25 bp, Homo sapien
tcccaggtccctgaaatttagagga

SEQ ID NO: 245577 - DNA, 25 bp, Homo sapien
ttcaccagggcaagaaaaacataag

SEQ ID NO: 245578 - DNA, 25 bp, Homo sapien
gggatcctgattgcaaagaaccatt

SEQ ID NO: 245579 - DNA, 25 bp, Homo sapien
tctaaattctaaaaccactctctga

SEQ ID NO: 245580 - DNA, 25 bp, Homo sapien
tgaagcagggaagagtgagacacac

SEQ ID NO: 245581 - DNA, 25 bp, Homo sapien
gagtgagacacaccttgaacttcta

SEQ ID NO: 245582 - DNA, 25 bp, Homo sapien
agcagccaagacacagccttgcaga

SEQ ID NO: 245583 - DNA, 25 bp, Homo sapien
gcagccaagacacagccttgcagag

SEQ ID NO: 245584 - DNA, 25 bp, Homo sapien
acagccttgcagagtcaccgctttc

SEQ ID NO: 245585 - DNA, 25 bp, Homo sapien
agccttgcagagtcaccgctttcct

SEQ ID NO: 245586 - DNA, 25 bp, Homo sapien
cttgcagagtcaccgctttcctgtg

SEQ ID NO: 245587 - DNA, 25 bp, Homo sapien
gcagagtcaccgctttcctgtgcag

SEQ ID NO: 245588 - DNA, 25 bp, Homo sapien
cagagtcaccgctttcctgtgcaga

SEQ ID NO: 245589 - DNA, 25 bp, Homo sapien
agagtcaccgctttcctgtgcagaa

SEQ ID NO: 245590 - DNA, 25 bp, Homo sapien
gagtcaccgctttcctgtgcagaaa

SEQ ID NO: 245591 - DNA, 25 bp, Homo sapien
tgtgcagaaaccttaggggccctcc

SEQ ID NO: 245592 - DNA, 25 bp, Homo sapien
ccttaggggccctccaggaagctgt

SEQ ID NO: 245593 - DNA, 25 bp, Homo sapien
tgttcacgggctggtaagtttcaaa

SEQ ID NO: 245594 - DNA, 25 bp, Homo sapien
cacgggctggtaagtttcaaatcca

SEQ ID NO: 245595 - DNA, 25 bp, Homo sapien
tggtaagtttcaaatccaaggacca

SEQ ID NO: 245596 - DNA, 25 bp, Homo sapien
tttccttcttattgattgttcttgc

SEQ ID NO: 245597 - DNA, 25 bp, Homo sapien
cctcattgcgtccctcagatctgat

SEQ ID NO: 245598 - DNA, 25 bp, Homo sapien
ccttcttattgattgttcttgcttt

SEQ ID NO: 245599 - DNA, 25 bp, Homo sapien
tgttcttgctttttcacacggctcc

SEQ ID NO: 245600 - DNA, 25 bp, Homo sapien
ttgctttttcacacggctccttaag

SEQ ID NO: 245601 - DNA, 25 bp, Homo sapien
ttttcacacggctccttaaggtggt

SEQ ID NO: 245602 - DNA, 25 bp, Homo sapien
cacacggctccttaaggtggtgaat

SEQ ID NO: 245603 - DNA, 25 bp, Homo sapien
cacggctccttaaggtggtgaattt

SEQ ID NO: 245604 - DNA, 25 bp, Homo sapien
gttatatatacttgcaatgtgacat

SEQ ID NO: 245605 - DNA, 25 bp, Homo sapien
atacttgcaatgtgacatggttctg

SEQ ID NO: 245606 - DNA, 25 bp, Homo sapien
caatgtgacatggttctgtagatca

SEQ ID NO: 245607 - DNA, 25 bp, Homo sapien
gtgacatggttctgtagatcatttt

SEQ ID NO: 245608 - DNA, 25 bp, Homo sapien
ggttctgtagatcattttataataa

SEQ ID NO: 245609 - DNA, 25 bp, Homo sapien
tttggcatgtcttcccatcagttca

SEQ ID NO: 245610 - DNA, 25 bp, Homo sapien
ggcatgtcttcccatcagttcaggt

SEQ ID NO: 245611 - DNA, 25 bp, Homo sapien
atgtcttcccatcagttcaggtcaa

SEQ ID NO: 245612 - DNA, 25 bp, Homo sapien
gtcttcccatcagttcaggtcaaaa

SEQ ID NO: 245613 - DNA, 25 bp, Homo sapien
agttcaggtcaaaagtgcattgttg

SEQ ID NO: 245614 - DNA, 25 bp, Homo sapien
caaaagtgcattgttgtgagattta

SEQ ID NO: 245615 - DNA, 25 bp, Homo sapien
tgcagcctccaactaataggctcag

SEQ ID NO: 245616 - DNA, 25 bp, Homo sapien
cctccaactaataggctcaggtgat

SEQ ID NO: 245617 - DNA, 25 bp, Homo sapien
tcccgagtaactcatggcctttaag

SEQ ID NO: 245618 - DNA, 25 bp, Homo sapien
aactcatggcctttaagtgaactgc

SEQ ID NO: 245619 - DNA, 25 bp, Homo sapien
ggcctttaagtgaactgcttccacc

SEQ ID NO: 245620 - DNA, 25 bp, Homo sapien
gaactgcttccaccatccagctgtg

SEQ ID NO: 245621 - DNA, 25 bp, Homo sapien
tgggaacagcagcacatctgtcccc

SEQ ID NO: 245622 - DNA, 25 bp, Homo sapien
tgccacctcttgcatgcacacttga

SEQ ID NO: 245623 - DNA, 25 bp, Homo sapien
cttgcatgcacacttgacctcctga

SEQ ID NO: 245624 - DNA, 25 bp, Homo sapien
gagaaatcgagtcatttggcctcat

SEQ ID NO: 245625 - DNA, 25 bp, Homo sapien
aatcgagtcatttggcctcatcctg

SEQ ID NO: 245626 - DNA, 25 bp, Homo sapien
ttctgtgccaccatcacattgtttt

SEQ ID NO: 245627 - DNA, 25 bp, Homo sapien
gccaccatcacattgttttagttac

SEQ ID NO: 245628 - DNA, 25 bp, Homo sapien
gttactgtagctttatgatattttg

SEQ ID NO: 245629 - DNA, 25 bp, Homo sapien
ttttcttgattgagtactttgccat

SEQ ID NO: 245630 - DNA, 25 bp, Homo sapien
gattgagtactttgccatgaaattt

SEQ ID NO: 245631 - DNA, 25 bp, Homo sapien
tctccactgacttgacatatcattt

SEQ ID NO: 245632 - DNA, 25 bp, Homo sapien
tataaaatgacagtctcacttctcc

SEQ ID NO: 245633 - DNA, 25 bp, Homo sapien
ggctgataagcaagatagagcatat

SEQ ID NO: 245634 - DNA, 25 bp, Homo sapien
gatagagcatatttgaaggccaaaa

SEQ ID NO: 245635 - DNA, 25 bp, Homo sapien
agatatctgtgactttctggactat

SEQ ID NO: 245636 - DNA, 25 bp, Homo sapien
gactttctggactatttgttttcat

SEQ ID NO: 245637 - DNA, 25 bp, Homo sapien
gaatagaattagttccaattaagtt

SEQ ID NO: 245638 - DNA, 25 bp, Homo sapien
ggaagaatgtgagcttttctattta

SEQ ID NO: 245639 - DNA, 25 bp, Homo sapien
gaatgtgagcttttctatttaaaat

SEQ ID NO: 245640 - DNA, 25 bp, Homo sapien
taaaagctaactttgtgggtgctct

SEQ ID NO: 245641 - DNA, 25 bp, Homo sapien
aagctaactttgtgggtgctctgtg

SEQ ID NO: 245642 - DNA, 25 bp, Homo sapien
gggtgctctgtggtatcaccaagca

SEQ ID NO: 245643 - DNA, 25 bp, Homo sapien
tgctctgtggtatcaccaagcaagt

SEQ ID NO: 245644 - DNA, 25 bp, Homo sapien
tctgtggtatcaccaagcaagtgaa

SEQ ID NO: 245645 - DNA, 25 bp, Homo sapien
aatagtatactaatttgtcattcat

SEQ ID NO: 245646 - DNA, 25 bp, Homo sapien
atttgtcattcatttatcatattaa

SEQ ID NO: 245647 - DNA, 25 bp, Homo sapien
taactttcatatttcatacttagga

SEQ ID NO: 245648 - DNA, 25 bp, Homo sapien
agggcctcctggaaaatcatcatcc

SEQ ID NO: 245649 - DNA, 25 bp, Homo sapien
ggcctcctggaaaatcatcatccct

SEQ ID NO: 245650 - DNA, 25 bp, Homo sapien
tcctggaaaatcatcatccctcatc

SEQ ID NO: 245651 - DNA, 25 bp, Homo sapien
atcacccacagtcgcccgattgtga

SEQ ID NO: 245652 - DNA, 25 bp, Homo sapien
acagtcgcccgattgtgacggcaca

SEQ ID NO: 245653 - DNA, 25 bp, Homo sapien
agtcgcccgattgtgacggcacaga

SEQ ID NO: 245654 - DNA, 25 bp, Homo sapien
tcgcccgattgtgacggcacagact

SEQ ID NO: 245655 - DNA, 25 bp, Homo sapien
gattgtgacggcacagactgcgctg

SEQ ID NO: 245656 - DNA, 25 bp, Homo sapien
attgtgacggcacagactgcgctgc

SEQ ID NO: 245657 - DNA, 25 bp, Homo sapien
gggccgtgaagtcctgccatttcac

SEQ ID NO: 245658 - DNA, 25 bp, Homo sapien
gccgtgaagtcctgccatttcacat

SEQ ID NO: 245659 - DNA, 25 bp, Homo sapien
caaaacaaatgcactttgggtgtgt

SEQ ID NO: 245660 - DNA, 25 bp, Homo sapien
acaaatgcactttgggtgtgttttg

SEQ ID NO: 245661 - DNA, 25 bp, Homo sapien
ccctgtagattagttccagaatggg

SEQ ID NO: 245662 - DNA, 25 bp, Homo sapien
attaataggcatgtttgactctcgt

SEQ ID NO: 245663 - DNA, 25 bp, Homo sapien
aataggcatgtttgactctcgtaaa

SEQ ID NO: 245664 - DNA, 25 bp, Homo sapien
ggcatgtttgactctcgtaaaggga

SEQ ID NO: 245665 - DNA, 25 bp, Homo sapien
tgtttgactctcgtaaagggacgtt

SEQ ID NO: 245666 - DNA, 25 bp, Homo sapien
gtaaagggacgttagtagctgctgc

SEQ ID NO: 245667 - DNA, 25 bp, Homo sapien
ggttaaaatagacttgcaggccaat

SEQ ID NO: 245668 - DNA, 25 bp, Homo sapien
aatagacttgcaggccaatcttaaa

SEQ ID NO: 245669 - DNA, 25 bp, Homo sapien
gacttgcaggccaatcttaaatggg

SEQ ID NO: 245670 - DNA, 25 bp, Homo sapien
agctccgcttgctggcgtcgtctgg

SEQ ID NO: 245671 - DNA, 25 bp, Homo sapien
ggctatgccatagccgcatcttcga

SEQ ID NO: 245672 - DNA, 25 bp, Homo sapien
atagccgcatcttcgatgtccttct

SEQ ID NO: 245673 - DNA, 25 bp, Homo sapien
atcttcgatgtccttctgcctcggg

SEQ ID NO: 245674 - DNA, 25 bp, Homo sapien
atggcgccagggagaggactcccca

SEQ ID NO: 245675 - DNA, 25 bp, Homo sapien
aatcttcaagaaaaccctccagtca

SEQ ID NO: 245676 - DNA, 25 bp, Homo sapien
accctccagtcatcgtaacgcgtgt

SEQ ID NO: 245677 - DNA, 25 bp, Homo sapien
ctccatgtaggtccacgtttaggtt

SEQ ID NO: 245678 - DNA, 25 bp, Homo sapien
gtccacgtttaggttgggaggatct

SEQ ID NO: 245679 - DNA, 25 bp, Homo sapien
ttaggttgggaggatctaccatgaa

SEQ ID NO: 245680 - DNA, 25 bp, Homo sapien
gaggatctaccatgaagaaggtcaa

SEQ ID NO: 245681 - DNA, 25 bp, Homo sapien
ttcaagatgggtcaggcgcggtggc

SEQ ID NO: 245682 - DNA, 25 bp, Homo sapien
tcaagatgggtcaggcgcggtggct

SEQ ID NO: 245683 - DNA, 25 bp, Homo sapien
caagatgggtcaggcgcggtggctc

SEQ ID NO: 245684 - DNA, 25 bp, Homo sapien
gtggtggtgtctgcctgtaattcca

SEQ ID NO: 245685 - DNA, 25 bp, Homo sapien
tggtggtgtctgcctgtaattccag

SEQ ID NO: 245686 - DNA, 25 bp, Homo sapien
gccaagatcgcacggttgcacttca

SEQ ID NO: 245687 - DNA, 25 bp, Homo sapien
ccaagatcgcacggttgcacttcag

SEQ ID NO: 245688 - DNA, 25 bp, Homo sapien
gcacttcagcctgggaaatggaatg

SEQ ID NO: 245689 - DNA, 25 bp, Homo sapien
cacttcagcctgggaaatggaatga

SEQ ID NO: 245690 - DNA, 25 bp, Homo sapien
acttcagcctgggaaatggaatgag

SEQ ID NO: 245691 - DNA, 25 bp, Homo sapien
cttcagcctgggaaatggaatgaga

SEQ ID NO: 245692 - DNA, 25 bp, Homo sapien
tcaaaacatttcacagtagtctaaa

SEQ ID NO: 245693 - DNA, 25 bp, Homo sapien
ccaaaatagctgctgtggttctttt

SEQ ID NO: 245694 - DNA, 25 bp, Homo sapien
agctgctgtggttcttttacaaata

SEQ ID NO: 245695 - DNA, 25 bp, Homo sapien
aaggtgcctcatctctaacccagct

SEQ ID NO: 245696 - DNA, 25 bp, Homo sapien
atctctaacccagctttgaagtaat

SEQ ID NO: 245697 - DNA, 25 bp, Homo sapien
gtaatgctatccagaggcagcccta

SEQ ID NO: 245698 - DNA, 25 bp, Homo sapien
cagaggcagccctattgacccgctt

SEQ ID NO: 245699 - DNA, 25 bp, Homo sapien
tgacccgctttccttatggcaaagt

SEQ ID NO: 245700 - DNA, 25 bp, Homo sapien
gcaaagtggactcgcgtcctacctg

SEQ ID NO: 245701 - DNA, 25 bp, Homo sapien
gtcctacctggccagtaatttagca

SEQ ID NO: 245702 - DNA, 25 bp, Homo sapien
gtaatttagcacttagcaactgaca

SEQ ID NO: 245703 - DNA, 25 bp, Homo sapien
agatgtggagccatttgtggtagat

SEQ ID NO: 245704 - DNA, 25 bp, Homo sapien
gatggacgtgtatatcttgcagaag

SEQ ID NO: 245705 - DNA, 25 bp, Homo sapien
gtgtatatcttgcagaagtctccaa

SEQ ID NO: 245706 - DNA, 25 bp, Homo sapien
gcagaagtctccaatggccttaaaa

SEQ ID NO: 245707 - DNA, 25 bp, Homo sapien
gtctccaatggccttaaaaagcatt

SEQ ID NO: 245708 - DNA, 25 bp, Homo sapien
tattattggacatcaacttatggag

SEQ ID NO: 245709 - DNA, 25 bp, Homo sapien
ggacatcaacttatggagaatctta

SEQ ID NO: 245710 - DNA, 25 bp, Homo sapien
ggagaatcttatgaccactcatcta

SEQ ID NO: 245711 - DNA, 25 bp, Homo sapien
atgaccactcatctaatgcaggttt

SEQ ID NO: 245712 - DNA, 25 bp, Homo sapien
tcatctaatgcaggttttgctcttg

SEQ ID NO: 245713 - DNA, 25 bp, Homo sapien
tttgctcttgttccagtaggtcaac

SEQ ID NO: 245714 - DNA, 25 bp, Homo sapien
ttttctagtttcctacaatcagcat

SEQ ID NO: 245715 - DNA, 25 bp, Homo sapien
tagtttcctacaatcagcatgtgtt

SEQ ID NO: 245716 - DNA, 25 bp, Homo sapien
gaaggaaacactggcttatcattaa

SEQ ID NO: 245717 - DNA, 25 bp, Homo sapien
cactggcttatcattaaaggacatt

SEQ ID NO: 245718 - DNA, 25 bp, Homo sapien
aagctcattgtggtggaagtgtcat

SEQ ID NO: 245719 - DNA, 25 bp, Homo sapien
gtggaagtgtcattaccaggattgt

SEQ ID NO: 245720 - DNA, 25 bp, Homo sapien
aagaagtgtgctgttcagagtggtt

SEQ ID NO: 245721 - DNA, 25 bp, Homo sapien
cagagtggttatttctacgacctga

SEQ ID NO: 245722 - DNA, 25 bp, Homo sapien
ggttatttctacgacctgaagtata

SEQ ID NO: 245723 - DNA, 25 bp, Homo sapien
tacgacctgaagtatagatgacttt

SEQ ID NO: 245724 - DNA, 25 bp, Homo sapien
gacttttagtcttttctctgcactt

SEQ ID NO: 245725 - DNA, 25 bp, Homo sapien
tccacagtagcccagtcgtggtagg

SEQ ID NO: 245726 - DNA, 25 bp, Homo sapien
acagtagcccagtcgtggtaggata

SEQ ID NO: 245727 - DNA, 25 bp, Homo sapien
tagcccagtcgtggtaggataaatt

SEQ ID NO: 245728 - DNA, 25 bp, Homo sapien
ggataaattacggatatagtcattc

SEQ ID NO: 245729 - DNA, 25 bp, Homo sapien
aattacggatatagtcattctaggg

SEQ ID NO: 245730 - DNA, 25 bp, Homo sapien
tcattctaggggtttcagtcttttc

SEQ ID NO: 245731 - DNA, 25 bp, Homo sapien
gaactgcctgaagttcgcacattca

SEQ ID NO: 245732 - DNA, 25 bp, Homo sapien
actgcctgaagttcgcacattcaga

SEQ ID NO: 245733 - DNA, 25 bp, Homo sapien
gaagttcgcacattcagattgttgt

SEQ ID NO: 245734 - DNA, 25 bp, Homo sapien
tcgcacattcagattgttgtgtcca

SEQ ID NO: 245735 - DNA, 25 bp, Homo sapien
gggatggcctttccggtcttcgcac

SEQ ID NO: 245736 - DNA, 25 bp, Homo sapien
aattagataacagaaatgccacact

SEQ ID NO: 245737 - DNA, 25 bp, Homo sapien
ctgtcaacaccgaccgggaggaaag

SEQ ID NO: 245738 - DNA, 25 bp, Homo sapien
gaaagcctcgctggcggagaccgct

SEQ ID NO: 245739 - DNA, 25 bp, Homo sapien
ggagaccgctcaagggagccctccg

SEQ ID NO: 245740 - DNA, 25 bp, Homo sapien
tcccagcccgggtcgcaggtggagg

SEQ ID NO: 245741 - DNA, 25 bp, Homo sapien
agtgcctcctgcagggacggttctc

SEQ ID NO: 245742 - DNA, 25 bp, Homo sapien
tgcagggacggttctcccgcagaca

SEQ ID NO: 245743 - DNA, 25 bp, Homo sapien
agacactcaaactccgggatgtaaa

SEQ ID NO: 245744 - DNA, 25 bp, Homo sapien
gatgtaaaacccctgttaataattg

SEQ ID NO: 245745 - DNA, 25 bp, Homo sapien
gggtctgttaattgccaaatacagt

SEQ ID NO: 245746 - DNA, 25 bp, Homo sapien
gaaagttgtatgcactaggtaaaat

SEQ ID NO: 245747 - DNA, 25 bp, Homo sapien
gtataataagtacccccatttgatt

SEQ ID NO: 245748 - DNA, 25 bp, Homo sapien
atttgatttttagatggactctgag

SEQ ID NO: 245749 - DNA, 25 bp, Homo sapien
ggactctgagataatgtactacatg

SEQ ID NO: 245750 - DNA, 25 bp, Homo sapien
ttaataccatctctgctatctactc

SEQ ID NO: 245751 - DNA, 25 bp, Homo sapien
tacatgccaggcaccttgtggtact

SEQ ID NO: 245752 - DNA, 25 bp, Homo sapien
aggcaccttgtggtactcaaataaa

SEQ ID NO: 245753 - DNA, 25 bp, Homo sapien
catctctgctatctactccaagtat

SEQ ID NO: 245754 - DNA, 25 bp, Homo sapien
aactggtacaagtagttctcatgta

SEQ ID NO: 245755 - DNA, 25 bp, Homo sapien
caagtagttctcatgtagttataaa

SEQ ID NO: 245756 - DNA, 25 bp, Homo sapien
gaatacattgaaggaactccctatt

SEQ ID NO: 245757 - DNA, 25 bp, Homo sapien
tatgggaatttaggcaccttccctt

SEQ ID NO: 245758 - DNA, 25 bp, Homo sapien
cagtgtcctttccaaatattataaa

SEQ ID NO: 245759 - DNA, 25 bp, Homo sapien
tataaaactttgtgttcattctgga

SEQ ID NO: 245760 - DNA, 25 bp, Homo sapien
aatcacaatgatttcctgctttgga

SEQ ID NO: 245761 - DNA, 25 bp, Homo sapien
ttcctgctttggagcaatgagaaat

SEQ ID NO: 245762 - DNA, 25 bp, Homo sapien
aaacttcaccttttcatagcttttg

SEQ ID NO: 245763 - DNA, 25 bp, Homo sapien
tcaccttttcatagcttttgatgtt

SEQ ID NO: 245764 - DNA, 25 bp, Homo sapien
gtttgcaccatgtgaattacccacc

SEQ ID NO: 245765 - DNA, 25 bp, Homo sapien
gaaaaagtgtttacctctgagaaga

SEQ ID NO: 245766 - DNA, 25 bp, Homo sapien
aagaatgaggagctgtagattttta

SEQ ID NO: 245767 - DNA, 25 bp, Homo sapien
tttttaacgattctgatgtatttgc

SEQ ID NO: 245768 - DNA, 25 bp, Homo sapien
tttttcccaatgttcatgaataaat

SEQ ID NO: 245769 - DNA, 25 bp, Homo sapien
taataggtttaggtgtttataagca

SEQ ID NO: 245770 - DNA, 25 bp, Homo sapien
ataggtttaggtgtttataagcaat

SEQ ID NO: 245771 - DNA, 25 bp, Homo sapien
taggtgtttataagcaatagttctc

SEQ ID NO: 245772 - DNA, 25 bp, Homo sapien
aggtgtttataagcaatagttctct

SEQ ID NO: 245773 - DNA, 25 bp, Homo sapien
ggtgtttataagcaatagttctcta

SEQ ID NO: 245774 - DNA, 25 bp, Homo sapien
gtgtttataagcaatagttctctat

SEQ ID NO: 245775 - DNA, 25 bp, Homo sapien
tgtttataagcaatagttctctatt

SEQ ID NO: 245776 - DNA, 25 bp, Homo sapien
tataagcaatagttctctattttct

SEQ ID NO: 245777 - DNA, 25 bp, Homo sapien
gttctctattttctagttgatataa

SEQ ID NO: 245778 - DNA, 25 bp, Homo sapien
ttttcccataattgtatatcagaga

SEQ ID NO: 245779 - DNA, 25 bp, Homo sapien
tcccataattgtatatcagagaaat

SEQ ID NO: 245780 - DNA, 25 bp, Homo sapien
tgggtcaggcacctaggcagcttta

SEQ ID NO: 245781 - DNA, 25 bp, Homo sapien
aggcacctaggcagctttatggcag

SEQ ID NO: 245782 - DNA, 25 bp, Homo sapien
cctaggcagctttatggcaggcgga

SEQ ID NO: 245783 - DNA, 25 bp, Homo sapien
atggcaggcggagatgcaccaccca

SEQ ID NO: 245784 - DNA, 25 bp, Homo sapien
cagatccagggaagacacagtcact

SEQ ID NO: 245785 - DNA, 25 bp, Homo sapien
acatcctctttccaggcagggcttg

SEQ ID NO: 245786 - DNA, 25 bp, Homo sapien
gccctggctgtagcgagtgcggcag

SEQ ID NO: 245787 - DNA, 25 bp, Homo sapien
cagctatcagcaacttcagagagct

SEQ ID NO: 245788 - DNA, 25 bp, Homo sapien
gagagctgccttgcctgaggtcccg

SEQ ID NO: 245789 - DNA, 25 bp, Homo sapien
agtcactaacccctggctcatctgg

SEQ ID NO: 245790 - DNA, 25 bp, Homo sapien
aacccctggctcatctggcaggtgt

SEQ ID NO: 245791 - DNA, 25 bp, Homo sapien
atatcatttataactaacctttagc

SEQ ID NO: 245792 - DNA, 25 bp, Homo sapien
taacctttagcctttagccactcaa

SEQ ID NO: 245793 - DNA, 25 bp, Homo sapien
ctttagcctttagccactcaaaaat

SEQ ID NO: 245794 - DNA, 25 bp, Homo sapien
tatttcctaatagcctaagggttct

SEQ ID NO: 245795 - DNA, 25 bp, Homo sapien
agcctaagggttcttggcaggtctt

SEQ ID NO: 245796 - DNA, 25 bp, Homo sapien
ttccccacatcagcaagaaatcttg

SEQ ID NO: 245797 - DNA, 25 bp, Homo sapien
tgggaagagtcagaccttgttccct

SEQ ID NO: 245798 - DNA, 25 bp, Homo sapien
ttgttccctgaacaagctttctgct

SEQ ID NO: 245799 - DNA, 25 bp, Homo sapien
tctgccccggagattcctgtgtgtc

SEQ ID NO: 245800 - DNA, 25 bp, Homo sapien
agattcctgtgtgtcccagtctcta

SEQ ID NO: 245801 - DNA, 25 bp, Homo sapien
tcccagtctctagggagggaggctt

SEQ ID NO: 245802 - DNA, 25 bp, Homo sapien
aatgccacagaggatcacccagaaa

SEQ ID NO: 245803 - DNA, 25 bp, Homo sapien
gatcacccagaaaccaatgccgtag

SEQ ID NO: 245804 - DNA, 25 bp, Homo sapien
gaaaccaatgccgtagatgaaccct

SEQ ID NO: 245805 - DNA, 25 bp, Homo sapien
gatgaaccctacaaaatccatggcc

SEQ ID NO: 245806 - DNA, 25 bp, Homo sapien
gaccgagcccctatgaaaagaccag

SEQ ID NO: 245807 - DNA, 25 bp, Homo sapien
aaagaatccaagagctcattgatga

SEQ ID NO: 245808 - DNA, 25 bp, Homo sapien
gagatgctcggaaagttctaataaa

SEQ ID NO: 245809 - DNA, 25 bp, Homo sapien
cttgcttatagagatattccatggg

SEQ ID NO: 245810 - DNA, 25 bp, Homo sapien
tattccatgggatagcaaatcctgt

SEQ ID NO: 245811 - DNA, 25 bp, Homo sapien
gatagcaaatcctgtgtcatggaga

SEQ ID NO: 245812 - DNA, 25 bp, Homo sapien
gatgaagtcaaaattcctgattcca

SEQ ID NO: 245813 - DNA, 25 bp, Homo sapien
atctgccaaacctattcattcatct

SEQ ID NO: 245814 - DNA, 25 bp, Homo sapien
gttaaagattcacagtctccgccaa

SEQ ID NO: 245815 - DNA, 25 bp, Homo sapien
tcgttcattcaattcttctcctaag

SEQ ID NO: 245816 - DNA, 25 bp, Homo sapien
agtctccgccaatagaaacaacagg

SEQ ID NO: 245817 - DNA, 25 bp, Homo sapien
caggaagcttcagaacagactagaa

SEQ ID NO: 245818 - DNA, 25 bp, Homo sapien
gaaagcttgcaaactctggtagaag

SEQ ID NO: 245819 - DNA, 25 bp, Homo sapien
gaaccaagcaatgtcttcaatgatc

SEQ ID NO: 245820 - DNA, 25 bp, Homo sapien
ttctcctaagaagtctccagtgcac

SEQ ID NO: 245821 - DNA, 25 bp, Homo sapien
taagaagtctccagtgcactcactc

SEQ ID NO: 245822 - DNA, 25 bp, Homo sapien
gcactcactcctaactagttcagtt

SEQ ID NO: 245823 - DNA, 25 bp, Homo sapien
ggttcaataggttccacatcacagt

SEQ ID NO: 245824 - DNA, 25 bp, Homo sapien
tgctgttaataacccttccattctt

SEQ ID NO: 245825 - DNA, 25 bp, Homo sapien
tcttttttactttccctcagaccat

SEQ ID NO: 245826 - DNA, 25 bp, Homo sapien
ttccctcagaccatatattgtgatt

SEQ ID NO: 245827 - DNA, 25 bp, Homo sapien
tgattatagtttctgctgaggagga

SEQ ID NO: 245828 - DNA, 25 bp, Homo sapien
aggaggatggaaactcaactccctt

SEQ ID NO: 245829 - DNA, 25 bp, Homo sapien
attctacttgatgttcagaaccgga

SEQ ID NO: 245830 - DNA, 25 bp, Homo sapien
gttcagaaccggattgcaagagagt

SEQ ID NO: 245831 - DNA, 25 bp, Homo sapien
caagagagtttaaagtgcccaacac

SEQ ID NO: 245832 - DNA, 25 bp, Homo sapien
gtatcttaagtgcatggaactactg

SEQ ID NO: 245833 - DNA, 25 bp, Homo sapien
aagaatctgttcacctatttatgta

SEQ ID NO: 245834 - DNA, 25 bp, Homo sapien
tagtcctgctgttaataacccttcc

SEQ ID NO: 245835 - DNA, 25 bp, Homo sapien
ttgcattcttaacatcacctacaag

SEQ ID NO: 245836 - DNA, 25 bp, Homo sapien
acatcacctacaagagtggacttta

SEQ ID NO: 245837 - DNA, 25 bp, Homo sapien
gtggactttaggtccatgctgtcca

SEQ ID NO: 245838 - DNA, 25 bp, Homo sapien
ctttaggtccatgctgtccacagca

SEQ ID NO: 245839 - DNA, 25 bp, Homo sapien
acccagccatgtgtggctactgaga

SEQ ID NO: 245840 - DNA, 25 bp, Homo sapien
gccatgtgtggctactgagatgtag

SEQ ID NO: 245841 - DNA, 25 bp, Homo sapien
tgtagccaaaccaagtgtgtcatga

SEQ ID NO: 245842 - DNA, 25 bp, Homo sapien
aaaccaagtgtgtcatgactctgaa

SEQ ID NO: 245843 - DNA, 25 bp, Homo sapien
gtcatgactctgaaacaccaggtat

SEQ ID NO: 245844 - DNA, 25 bp, Homo sapien
gaaacaccaggtatgaagcatggaa

SEQ ID NO: 245845 - DNA, 25 bp, Homo sapien
tgaagcatggaagaggacaacaact

SEQ ID NO: 245846 - DNA, 25 bp, Homo sapien
atccaggtgaaacagaacctactgg

SEQ ID NO: 245847 - DNA, 25 bp, Homo sapien
tactggaatgaagctggcctcccat

SEQ ID NO: 245848 - DNA, 25 bp, Homo sapien
aatgaagctggcctcccatggaatg

SEQ ID NO: 245849 - DNA, 25 bp, Homo sapien
ctcccgtctccttgatttgaagcag

SEQ ID NO: 245850 - DNA, 25 bp, Homo sapien
cgtctccttgatttgaagcagcttc

SEQ ID NO: 245851 - DNA, 25 bp, Homo sapien
cacgttggttattatgccatttttc

SEQ ID NO: 245852 - DNA, 25 bp, Homo sapien
ttttctttctcttttgcttgacttc

SEQ ID NO: 245853 - DNA, 25 bp, Homo sapien
ctcttttgcttgacttctcagaggt

SEQ ID NO: 245854 - DNA, 25 bp, Homo sapien
tgcctcctgctaagccaatttatac

SEQ ID NO: 245855 - DNA, 25 bp, Homo sapien
cctgctaagccaatttatacattcc

SEQ ID NO: 245856 - DNA, 25 bp, Homo sapien
aaaatcttccatttcatccaggtga

SEQ ID NO: 245857 - DNA, 25 bp, Homo sapien
ccagttacttgtggggctgaggtgg

SEQ ID NO: 245858 - DNA, 25 bp, Homo sapien
acttcagcccaggtggttgaggctg

SEQ ID NO: 245859 - DNA, 25 bp, Homo sapien
cttcagcccaggtggttgaggctgc

SEQ ID NO: 245860 - DNA, 25 bp, Homo sapien
gtactacagcctgggggacagagca

SEQ ID NO: 245861 - DNA, 25 bp, Homo sapien
caagaccctctctcaataaataaat

SEQ ID NO: 245862 - DNA, 25 bp, Homo sapien
taaataattaacacacaattcatgg

SEQ ID NO: 245863 - DNA, 25 bp, Homo sapien
aaataattaacacacaattcatgga

SEQ ID NO: 245864 - DNA, 25 bp, Homo sapien
aataattaacacacaattcatggaa

SEQ ID NO: 245865 - DNA, 25 bp, Homo sapien
ataattaacacacaattcatggaag

SEQ ID NO: 245866 - DNA, 25 bp, Homo sapien
taattaacacacaattcatggaaga

SEQ ID NO: 245867 - DNA, 25 bp, Homo sapien
aattaacacacaattcatggaagag

SEQ ID NO: 245868 - DNA, 25 bp, Homo sapien
tagcatctgatcctcgtcatgggac

SEQ ID NO: 245869 - DNA, 25 bp, Homo sapien
cagcctgtcttactacaattgccag

SEQ ID NO: 245870 - DNA, 25 bp, Homo sapien
aatcttactctgagggttactgtag

SEQ ID NO: 245871 - DNA, 25 bp, Homo sapien
gtcttactacaattgccagctggag

SEQ ID NO: 245872 - DNA, 25 bp, Homo sapien
acaattgccagctggagacagaaca

SEQ ID NO: 245873 - DNA, 25 bp, Homo sapien
taagggcaaaggcagaatggcatat

SEQ ID NO: 245874 - DNA, 25 bp, Homo sapien
gaaccaaaggtcagtcacagaacag

SEQ ID NO: 245875 - DNA, 25 bp, Homo sapien
cagctgtgtcacaggtgagatctaa

SEQ ID NO: 245876 - DNA, 25 bp, Homo sapien
gttgtttgtctctacagtaaatgat

SEQ ID NO: 245877 - DNA, 25 bp, Homo sapien
attccagtccctttaaccatgtgaa

SEQ ID NO: 245878 - DNA, 25 bp, Homo sapien
ggagacaggaacactagcatctgat

SEQ ID NO: 245879 - DNA, 25 bp, Homo sapien
ttcagatgcctgaagggagtgcttt

SEQ ID NO: 245880 - DNA, 25 bp, Homo sapien
tgtggaccttggctccctccgtgga

SEQ ID NO: 245881 - DNA, 25 bp, Homo sapien
tggctccctccgtggacctgggctt

SEQ ID NO: 245882 - DNA, 25 bp, Homo sapien
ggcttcgtggtgagcactgcagcct

SEQ ID NO: 245883 - DNA, 25 bp, Homo sapien
gcaccactgcaacatatagacctga

SEQ ID NO: 245884 - DNA, 25 bp, Homo sapien
tagacctgagtgctattgtattttg

SEQ ID NO: 245885 - DNA, 25 bp, Homo sapien
gagtgctattgtattttggcttggt

SEQ ID NO: 245886 - DNA, 25 bp, Homo sapien
ttttggcttggtgtgtatgctcttc

SEQ ID NO: 245887 - DNA, 25 bp, Homo sapien
cttggtgtgtatgctcttcattgtg

SEQ ID NO: 245888 - DNA, 25 bp, Homo sapien
attgctgttcttttgacaatttaag

SEQ ID NO: 245889 - DNA, 25 bp, Homo sapien
gtgattgttttgtttactgtaagtt

SEQ ID NO: 245890 - DNA, 25 bp, Homo sapien
gcccaaatgtaagttgtattccaag

SEQ ID NO: 245891 - DNA, 25 bp, Homo sapien
caaatgtaagttgtattccaaggtt

SEQ ID NO: 245892 - DNA, 25 bp, Homo sapien
tgtaagttgtattccaaggtttggt

SEQ ID NO: 245893 - DNA, 25 bp, Homo sapien
ctcttttactggttaactttgagca

SEQ ID NO: 245894 - DNA, 25 bp, Homo sapien
tttactggttaactttgagcaggtc

SEQ ID NO: 245895 - DNA, 25 bp, Homo sapien
tactggttaactttgagcaggtcac

SEQ ID NO: 245896 - DNA, 25 bp, Homo sapien
ctggttaactttgagcaggtcactt

SEQ ID NO: 245897 - DNA, 25 bp, Homo sapien
ggttaactttgagcaggtcacttat

SEQ ID NO: 245898 - DNA, 25 bp, Homo sapien
gttaactttgagcaggtcacttata

SEQ ID NO: 245899 - DNA, 25 bp, Homo sapien
ttaactttgagcaggtcacttatat

SEQ ID NO: 245900 - DNA, 25 bp, Homo sapien
aactttgagcaggtcacttatattt

SEQ ID NO: 245901 - DNA, 25 bp, Homo sapien
ccacccacctattgttgtcacttgg

SEQ ID NO: 245902 - DNA, 25 bp, Homo sapien
cacctattgttgtcacttgggaaga

SEQ ID NO: 245903 - DNA, 25 bp, Homo sapien
aagaaaacagacaccttcaaggaga

SEQ ID NO: 245904 - DNA, 25 bp, Homo sapien
cagacaccttcaaggagagggctcc

SEQ ID NO: 245905 - DNA, 25 bp, Homo sapien
aagacagagctggatgcccctcgct

SEQ ID NO: 245906 - DNA, 25 bp, Homo sapien
atgcccctcgcttccgtagggaaag

SEQ ID NO: 245907 - DNA, 25 bp, Homo sapien
ccgtagggaaagcacttctcctgca

SEQ ID NO: 245908 - DNA, 25 bp, Homo sapien
ctgcaggatggcattgctctctccc

SEQ ID NO: 245909 - DNA, 25 bp, Homo sapien
tctccccttccatggcacgtagtat

SEQ ID NO: 245910 - DNA, 25 bp, Homo sapien
ttccatggcacgtagtatgtgctca

SEQ ID NO: 245911 - DNA, 25 bp, Homo sapien
agacctgcttgctgccaagcgtttg

SEQ ID NO: 245912 - DNA, 25 bp, Homo sapien
tgacttcatcagattccctacagag

SEQ ID NO: 245913 - DNA, 25 bp, Homo sapien
gtttctgttgtaacacttaacatgc

SEQ ID NO: 245914 - DNA, 25 bp, Homo sapien
acatgctgtattataatgtgcttat

SEQ ID NO: 245915 - DNA, 25 bp, Homo sapien
aagtttgttacattgtacgtgctcg

SEQ ID NO: 245916 - DNA, 25 bp, Homo sapien
gttacattgtacgtgctcgaggaca

SEQ ID NO: 245917 - DNA, 25 bp, Homo sapien
ctcgaggacaagcagccggtagtat

SEQ ID NO: 245918 - DNA, 25 bp, Homo sapien
agccggtagtattcacctctgtcat

SEQ ID NO: 245919 - DNA, 25 bp, Homo sapien
acatgagggcactgatgtgtttgct

SEQ ID NO: 245920 - DNA, 25 bp, Homo sapien
gtgtttgctgagtgactgggacaat

SEQ ID NO: 245921 - DNA, 25 bp, Homo sapien
acgtgagccccgaaactttcagtgg

SEQ ID NO: 245922 - DNA, 25 bp, Homo sapien
cagtgggctctgaaagttaagaaaa

SEQ ID NO: 245923 - DNA, 25 bp, Homo sapien
tagctatggcagtctttcagggtca

SEQ ID NO: 245924 - DNA, 25 bp, Homo sapien
gaagaaactcccatcaagactgaag

SEQ ID NO: 245925 - DNA, 25 bp, Homo sapien
gactgaagcagacgttttggcagaa

SEQ ID NO: 245926 - DNA, 25 bp, Homo sapien
aaccaggttcttgatagcagtgctc

SEQ ID NO: 245927 - DNA, 25 bp, Homo sapien
gatagcagtgctcctaagagtccaa

SEQ ID NO: 245928 - DNA, 25 bp, Homo sapien
tgctcctaagagtccaagtcaagat

SEQ ID NO: 245929 - DNA, 25 bp, Homo sapien
cagaagccaagagtgagaaccgaaa

SEQ ID NO: 245930 - DNA, 25 bp, Homo sapien
gattatcacaactatcaaacgttat

SEQ ID NO: 245931 - DNA, 25 bp, Homo sapien
gttattcgaaccaagaacacaccat

SEQ ID NO: 245932 - DNA, 25 bp, Homo sapien
aacacaccatccatatctcttggaa

SEQ ID NO: 245933 - DNA, 25 bp, Homo sapien
tatctcttggaaatgcttctagctc

SEQ ID NO: 245934 - DNA, 25 bp, Homo sapien
agtgaattgttgacagggctttaaa

SEQ ID NO: 245935 - DNA, 25 bp, Homo sapien
gggctcctcgagaagtaagaccgta

SEQ ID NO: 245936 - DNA, 25 bp, Homo sapien
gaagtaagaccgtatctgccagcgt

SEQ ID NO: 245937 - DNA, 25 bp, Homo sapien
taagaccgtatctgccagcgtttct

SEQ ID NO: 245938 - DNA, 25 bp, Homo sapien
gaccgtatctgccagcgtttctcac

SEQ ID NO: 245939 - DNA, 25 bp, Homo sapien
actggagagcagctgctctggagca

SEQ ID NO: 245940 - DNA, 25 bp, Homo sapien
aaaaaggtgtcaggcttgctatgtt

SEQ ID NO: 245941 - DNA, 25 bp, Homo sapien
aaggtgtcaggcttgctatgttgag

SEQ ID NO: 245942 - DNA, 25 bp, Homo sapien
gtcaggcttgctatgttgaggttgt

SEQ ID NO: 245943 - DNA, 25 bp, Homo sapien
gaggttgtttttagagttacagaga

SEQ ID NO: 245944 - DNA, 25 bp, Homo sapien
aataaaaacactcataatttcctga

SEQ ID NO: 245945 - DNA, 25 bp, Homo sapien
aggttctgggacgacctgtgtctca

SEQ ID NO: 245946 - DNA, 25 bp, Homo sapien
gggagctggtctcctgaatccgatc

SEQ ID NO: 245947 - DNA, 25 bp, Homo sapien
ggatgaggacctgagacgccttctc

SEQ ID NO: 245948 - DNA, 25 bp, Homo sapien
ctctgcgcattgcacagaagagcgg

SEQ ID NO: 245949 - DNA, 25 bp, Homo sapien
ttgcacagaagagcggctgctggta

SEQ ID NO: 245950 - DNA, 25 bp, Homo sapien
ctgctggtaaagttctgggagttct

SEQ ID NO: 245951 - DNA, 25 bp, Homo sapien
agttctgggagttctgacacatgca

SEQ ID NO: 245952 - DNA, 25 bp, Homo sapien
ggagttctgacacatgcacgccaca

SEQ ID NO: 245953 - DNA, 25 bp, Homo sapien
ctgacacatgcacgccacagaaaca

SEQ ID NO: 245954 - DNA, 25 bp, Homo sapien
ttctggccaagtggcaatgatgagt

SEQ ID NO: 245955 - DNA, 25 bp, Homo sapien
gcaatgatgagttttcagagaggat

SEQ ID NO: 245956 - DNA, 25 bp, Homo sapien
gggaaaaaagacaccttgtggcatt

SEQ ID NO: 245957 - DNA, 25 bp, Homo sapien
accttgtggcattaagtcttgcttt

SEQ ID NO: 245958 - DNA, 25 bp, Homo sapien
gtcttgctttggttaaagccttatt

SEQ ID NO: 245959 - DNA, 25 bp, Homo sapien
aagccttatttcacataattgctaa

SEQ ID NO: 245960 - DNA, 25 bp, Homo sapien
ctacctatagtttaattatcggcac

SEQ ID NO: 245961 - DNA, 25 bp, Homo sapien
ttatcggcacttgtattttgtaact

SEQ ID NO: 245962 - DNA, 25 bp, Homo sapien
aacttgatatcttacctaggattgg

SEQ ID NO: 245963 - DNA, 25 bp, Homo sapien
acctaggattgggaatttgggacat

SEQ ID NO: 245964 - DNA, 25 bp, Homo sapien
gaatttgggacatgacacgtactat

SEQ ID NO: 245965 - DNA, 25 bp, Homo sapien
gtcagtctatgtacatactgcttat

SEQ ID NO: 245966 - DNA, 25 bp, Homo sapien
tactgcttattgatgtgctgtgata

SEQ ID NO: 245967 - DNA, 25 bp, Homo sapien
ctgacaacccctacttttgcaagac

SEQ ID NO: 245968 - DNA, 25 bp, Homo sapien
caacccctacttttgcaagaccaag

SEQ ID NO: 245969 - DNA, 25 bp, Homo sapien
cctacttttgcaagaccaagaaggg

SEQ ID NO: 245970 - DNA, 25 bp, Homo sapien
cccttggacgggactatgtgtgcac

SEQ ID NO: 245971 - DNA, 25 bp, Homo sapien
ttggacgggactatgtgtgcacctg

SEQ ID NO: 245972 - DNA, 25 bp, Homo sapien
acgggactatgtgtgcacctggcaa

SEQ ID NO: 245973 - DNA, 25 bp, Homo sapien
tgtgcacctggcaagttcaggccgg

SEQ ID NO: 245974 - DNA, 25 bp, Homo sapien
tgcacctggcaagttcaggccgggc

SEQ ID NO: 245975 - DNA, 25 bp, Homo sapien
aagacaagtctggttaacatggcaa

SEQ ID NO: 245976 - DNA, 25 bp, Homo sapien
aaggcatgaaaatcgtttgacccag

SEQ ID NO: 245977 - DNA, 25 bp, Homo sapien
atgaaaatcgtttgacccaggaggc

SEQ ID NO: 245978 - DNA, 25 bp, Homo sapien
atgaaatatttacagcttactcagt

SEQ ID NO: 245979 - DNA, 25 bp, Homo sapien
atttttcactcccaacagctgtttt

SEQ ID NO: 245980 - DNA, 25 bp, Homo sapien
tacctctttggcctaaagttttcat

SEQ ID NO: 245981 - DNA, 25 bp, Homo sapien
agtgtcctttatttcatgagtcaca

SEQ ID NO: 245982 - DNA, 25 bp, Homo sapien
tcatgagtcacacactttgttttca

SEQ ID NO: 245983 - DNA, 25 bp, Homo sapien
tcaggatgccagaatcccatattaa

SEQ ID NO: 245984 - DNA, 25 bp, Homo sapien
attaaggacctagctaacttgccta

SEQ ID NO: 245985 - DNA, 25 bp, Homo sapien
agctaacttgcctaggcttcagaag

SEQ ID NO: 245986 - DNA, 25 bp, Homo sapien
tgcttgaggcaaggacaatcttttt

SEQ ID NO: 245987 - DNA, 25 bp, Homo sapien
ggacaatctttttctgatcatctca

SEQ ID NO: 245988 - DNA, 25 bp, Homo sapien
atctcactttcagttctatttggta

SEQ ID NO: 245989 - DNA, 25 bp, Homo sapien
tttttaaactagatcccttcattat

SEQ ID NO: 245990 - DNA, 25 bp, Homo sapien
tagatcccttcattattctttatgc

SEQ ID NO: 245991 - DNA, 25 bp, Homo sapien
ttctttatgccccagagtaaatccc

SEQ ID NO: 245992 - DNA, 25 bp, Homo sapien
tatgccccagagtaaatcccagatg

SEQ ID NO: 245993 - DNA, 25 bp, Homo sapien
gccccagagtaaatcccagatggat

SEQ ID NO: 245994 - DNA, 25 bp, Homo sapien
atatgaatgctttgatgatcttgga

SEQ ID NO: 245995 - DNA, 25 bp, Homo sapien
caatttttgcagcatatggtggaca

SEQ ID NO: 245996 - DNA, 25 bp, Homo sapien
atggtggacaaaggagataatttct

SEQ ID NO: 245997 - DNA, 25 bp, Homo sapien
ttctttaatgtatcaatagctcttg

SEQ ID NO: 245998 - DNA, 25 bp, Homo sapien
tgtatcaatagctcttgcaaagcaa

SEQ ID NO: 245999 - DNA, 25 bp, Homo sapien
aatagctcttgcaaagcaaacagga

SEQ ID NO: 246000 - DNA, 25 bp, Homo sapien
ggagtaataggacagcttccttgtc

SEQ ID NO: 246001 - DNA, 25 bp, Homo sapien
agtaataggacagcttccttgtcct

SEQ ID NO: 246002 - DNA, 25 bp, Homo sapien
aaaactacaacccaataatgatgag

SEQ ID NO: 246003 - DNA, 25 bp, Homo sapien
cccaataatgatgagtgaggctgtt

SEQ ID NO: 246004 - DNA, 25 bp, Homo sapien
acatgataatgggttgttgcaaata

SEQ ID NO: 246005 - DNA, 25 bp, Homo sapien
aggatttttaattctcttattggtg

SEQ ID NO: 246006 - DNA, 25 bp, Homo sapien
attccagccttttgggagtccaggt

SEQ ID NO: 246007 - DNA, 25 bp, Homo sapien
agccttttgggagtccaggtcaggt

SEQ ID NO: 246008 - DNA, 25 bp, Homo sapien
attctcttattggtgtattttccac

SEQ ID NO: 246009 - DNA, 25 bp, Homo sapien
cagtgatttttagtggatttcacaa

SEQ ID NO: 246010 - DNA, 25 bp, Homo sapien
tagtggatttcacaaaggagtaata

SEQ ID NO: 246011 - DNA, 25 bp, Homo sapien
ctgacaacccctacttttgcaagac

SEQ ID NO: 246012 - DNA, 25 bp, Homo sapien
tgacaacccctacttttgcaagacc

SEQ ID NO: 246013 - DNA, 25 bp, Homo sapien
gacaacccctacttttgcaagacca

SEQ ID NO: 246014 - DNA, 25 bp, Homo sapien
caacccctacttttgcaagaccaag

SEQ ID NO: 246015 - DNA, 25 bp, Homo sapien
cccctacttttgcaagaccaagaag

SEQ ID NO: 246016 - DNA, 25 bp, Homo sapien
cctacttttgcaagaccaagaaggg

SEQ ID NO: 246017 - DNA, 25 bp, Homo sapien
cccttggacgggactatgtgtgcac

SEQ ID NO: 246018 - DNA, 25 bp, Homo sapien
cttggacgggactatgtgtgcacct

SEQ ID NO: 246019 - DNA, 25 bp, Homo sapien
ttggacgggactatgtgtgcacctg

SEQ ID NO: 246020 - DNA, 25 bp, Homo sapien
acgggactatgtgtgcacctggcaa

SEQ ID NO: 246021 - DNA, 25 bp, Homo sapien
cgggactatgtgtgcacctggcaag

SEQ ID NO: 246022 - DNA, 25 bp, Homo sapien
tttttaccacaacctattttgtgat

SEQ ID NO: 246023 - DNA, 25 bp, Homo sapien
ctattttgtgatccctacgtgtcat

SEQ ID NO: 246024 - DNA, 25 bp, Homo sapien
ttgtgatccctacgtgtcatttctt

SEQ ID NO: 246025 - DNA, 25 bp, Homo sapien
tgatccctacgtgtcatttcttcag

SEQ ID NO: 246026 - DNA, 25 bp, Homo sapien
taaaatatacgaacatggtgagatt

SEQ ID NO: 246027 - DNA, 25 bp, Homo sapien
tgaaaagtctccctcatgccctcaa

SEQ ID NO: 246028 - DNA, 25 bp, Homo sapien
aatttcccagccactgttccttctg

SEQ ID NO: 246029 - DNA, 25 bp, Homo sapien
ttccttctggactcttctacaaata

SEQ ID NO: 246030 - DNA, 25 bp, Homo sapien
tctacaaatagtccctgtttctaca

SEQ ID NO: 246031 - DNA, 25 bp, Homo sapien
aaatagtccctgtttctacaaatgt

SEQ ID NO: 246032 - DNA, 25 bp, Homo sapien
gggaggctattttgatttctaccct

SEQ ID NO: 246033 - DNA, 25 bp, Homo sapien
aacttaacttgccaacaatctgcta

SEQ ID NO: 246034 - DNA, 25 bp, Homo sapien
caatctgctaaattaccttccgtat

SEQ ID NO: 246035 - DNA, 25 bp, Homo sapien
ttaccttccgtatttcctccacgtg

SEQ ID NO: 246036 - DNA, 25 bp, Homo sapien
gtgcccattgttcatgggcaataaa

SEQ ID NO: 246037 - DNA, 25 bp, Homo sapien
tttattggaaggacacagaagagct

SEQ ID NO: 246038 - DNA, 25 bp, Homo sapien
gaagagcttcagaatcacaggaaga

SEQ ID NO: 246039 - DNA, 25 bp, Homo sapien
aaaatacaggacacaggagagaggc

SEQ ID NO: 246040 - DNA, 25 bp, Homo sapien
aggctggctaacctcagggtacatg

SEQ ID NO: 246041 - DNA, 25 bp, Homo sapien
agggtacatgtatacgccatagtga

SEQ ID NO: 246042 - DNA, 25 bp, Homo sapien
ttagttgcaacaatagaaaccactt

SEQ ID NO: 246043 - DNA, 25 bp, Homo sapien
gaaaccacttatcttgctaacttaa

SEQ ID NO: 246044 - DNA, 25 bp, Homo sapien
ttccctgctgccatatttggttttc

SEQ ID NO: 246045 - DNA, 25 bp, Homo sapien
attgtttcctccattctgagggttt

SEQ ID NO: 246046 - DNA, 25 bp, Homo sapien
ctgagggtttcatcatcaggtggga

SEQ ID NO: 246047 - DNA, 25 bp, Homo sapien
tcaggtgggaagtataaaccttctc

SEQ ID NO: 246048 - DNA, 25 bp, Homo sapien
aacaggcattggagggtacctcggt

SEQ ID NO: 246049 - DNA, 25 bp, Homo sapien
acaggcattggagggtacctcggtt

SEQ ID NO: 246050 - DNA, 25 bp, Homo sapien
aggcattggagggtacctcggttca

SEQ ID NO: 246051 - DNA, 25 bp, Homo sapien
gcattggagggtacctcggttcaga

SEQ ID NO: 246052 - DNA, 25 bp, Homo sapien
cattggagggtacctcggttcagat

SEQ ID NO: 246053 - DNA, 25 bp, Homo sapien
gggtacctcggttcagatgtgtcat

SEQ ID NO: 246054 - DNA, 25 bp, Homo sapien
cccgagaaagggtgcagtggcctca

SEQ ID NO: 246055 - DNA, 25 bp, Homo sapien
tgagacctcaaacctgtgttcccaa

SEQ ID NO: 246056 - DNA, 25 bp, Homo sapien
tgttcccaaggaggcgagctgctgt

SEQ ID NO: 246057 - DNA, 25 bp, Homo sapien
gcgagctgctgttcccaggtgatga

SEQ ID NO: 246058 - DNA, 25 bp, Homo sapien
taagtggctgccagacatggctgag

SEQ ID NO: 246059 - DNA, 25 bp, Homo sapien
catggctgagagctgttgtcactgc

SEQ ID NO: 246060 - DNA, 25 bp, Homo sapien
gttgtcactgccgtcaagtgcatgt

SEQ ID NO: 246061 - DNA, 25 bp, Homo sapien
aagtgcatgtctccaagccatatca

SEQ ID NO: 246062 - DNA, 25 bp, Homo sapien
gagacctccaggtggtccttctggg

SEQ ID NO: 246063 - DNA, 25 bp, Homo sapien
ggcgtccctcgatgtgaggccacat

SEQ ID NO: 246064 - DNA, 25 bp, Homo sapien
cacatggcaagtgggccgtggatct

SEQ ID NO: 246065 - DNA, 25 bp, Homo sapien
tgcatttttcccctatccctgggaa

SEQ ID NO: 246066 - DNA, 25 bp, Homo sapien
tccagccagtcccattcgggaaaga

SEQ ID NO: 246067 - DNA, 25 bp, Homo sapien
agatgaaaccggaggccgggctcac

SEQ ID NO: 246068 - DNA, 25 bp, Homo sapien
gttcttggatgactcagccctggga

SEQ ID NO: 246069 - DNA, 25 bp, Homo sapien
atgactcagccctgggacctgcaca

SEQ ID NO: 246070 - DNA, 25 bp, Homo sapien
acagggacctgtgacttgtgttcat

SEQ ID NO: 246071 - DNA, 25 bp, Homo sapien
ggacctgtgacttgtgttcatcggg

SEQ ID NO: 246072 - DNA, 25 bp, Homo sapien
gggccggtgtcacttccagttttga

SEQ ID NO: 246073 - DNA, 25 bp, Homo sapien
gtcacttccagttttgatccaggct

SEQ ID NO: 246074 - DNA, 25 bp, Homo sapien
gatccaggctctttcactgtaaaat

SEQ ID NO: 246075 - DNA, 25 bp, Homo sapien
taggaaaatgccttgccattctagt

SEQ ID NO: 246076 - DNA, 25 bp, Homo sapien
tgtaaagcagcttggcccctccagc

SEQ ID NO: 246077 - DNA, 25 bp, Homo sapien
gagccttagaacagtgtactcccaa

SEQ ID NO: 246078 - DNA, 25 bp, Homo sapien
acagtgtactcccaattcttgcctt

SEQ ID NO: 246079 - DNA, 25 bp, Homo sapien
tgccttccattctttgtgctgttat

SEQ ID NO: 246080 - DNA, 25 bp, Homo sapien
attttctctttaagccccactaatg

SEQ ID NO: 246081 - DNA, 25 bp, Homo sapien
taagccccactaatgtttatacttt

SEQ ID NO: 246082 - DNA, 25 bp, Homo sapien
atactttaaatgattctgtaaccac

SEQ ID NO: 246083 - DNA, 25 bp, Homo sapien
tgtaaccaccctcactgttaagatt

SEQ ID NO: 246084 - DNA, 25 bp, Homo sapien
atttttctaggtttgtgacagtaag

SEQ ID NO: 246085 - DNA, 25 bp, Homo sapien
gttaccttaggtttacaatctgcat

SEQ ID NO: 246086 - DNA, 25 bp, Homo sapien
aggtttacaatctgcatctttaatt

SEQ ID NO: 246087 - DNA, 25 bp, Homo sapien
atctttaattaacatgtctgcattc

SEQ ID NO: 246088 - DNA, 25 bp, Homo sapien
gaaaatcggcaaatggctgggacta

SEQ ID NO: 246089 - DNA, 25 bp, Homo sapien
ggactacaaccctggtctcttgaat

SEQ ID NO: 246090 - DNA, 25 bp, Homo sapien
accctggtctcttgaatcctgtttg

SEQ ID NO: 246091 - DNA, 25 bp, Homo sapien
ctgtttggaaatctgtgcgttagga

SEQ ID NO: 246092 - DNA, 25 bp, Homo sapien
atctgtgcgttaggagggaaatttc

SEQ ID NO: 246093 - DNA, 25 bp, Homo sapien
gaaatttccattcctacagcttcat

SEQ ID NO: 246094 - DNA, 25 bp, Homo sapien
ggaaaaggtctactccatttcagga

SEQ ID NO: 246095 - DNA, 25 bp, Homo sapien
ggaggtaacagtcctggcatgcaca

SEQ ID NO: 246096 - DNA, 25 bp, Homo sapien
cagtcctggcatgcacaattcaagc

SEQ ID NO: 246097 - DNA, 25 bp, Homo sapien
gttcctcactcctcactaggagaag

SEQ ID NO: 246098 - DNA, 25 bp, Homo sapien
tgaagagacctgatgctcataatca

SEQ ID NO: 246099 - DNA, 25 bp, Homo sapien
accccgaggcacattaactggcgtg

SEQ ID NO: 246100 - DNA, 25 bp, Homo sapien
aactggcgtgactttcaggacggcg

SEQ ID NO: 246101 - DNA, 25 bp, Homo sapien
aacccctagcctcttgaattactca

SEQ ID NO: 246102 - DNA, 25 bp, Homo sapien
ttgaattactcaagtccctcagctc

SEQ ID NO: 246103 - DNA, 25 bp, Homo sapien
cctcagctctgttggcacaaatacg

SEQ ID NO: 246104 - DNA, 25 bp, Homo sapien
cacaaatacgtgctggatgatagaa

SEQ ID NO: 246105 - DNA, 25 bp, Homo sapien
gaattcttacaaggcctgacttctg

SEQ ID NO: 246106 - DNA, 25 bp, Homo sapien
aaggcctgacttctggatctggaga

SEQ ID NO: 246107 - DNA, 25 bp, Homo sapien
acttctttgtgtcccatcttcaaaa

SEQ ID NO: 246108 - DNA, 25 bp, Homo sapien
aaaatgcctcctccacttgttgcag

SEQ ID NO: 246109 - DNA, 25 bp, Homo sapien
cctccacttgttgcagaagcctaaa

SEQ ID NO: 246110 - DNA, 25 bp, Homo sapien
atccatgtagttatgaatttcagat

SEQ ID NO: 246111 - DNA, 25 bp, Homo sapien
ttcagatgtatgtctgtagatgaac

SEQ ID NO: 246112 - DNA, 25 bp, Homo sapien
aacgcagtagttgccctcttaataa

SEQ ID NO: 246113 - DNA, 25 bp, Homo sapien
tgacaagtaattataatctctctct

SEQ ID NO: 246114 - DNA, 25 bp, Homo sapien
gtagttgccctcttaataatgactt

SEQ ID NO: 246115 - DNA, 25 bp, Homo sapien
tctctggccatcattggcgagtgca

SEQ ID NO: 246116 - DNA, 25 bp, Homo sapien
attggcgagtgcagtgttgagctaa

SEQ ID NO: 246117 - DNA, 25 bp, Homo sapien
gttgagctaaaagtgacccagagga

SEQ ID NO: 246118 - DNA, 25 bp, Homo sapien
ggaggtgaactataatttacttgag

SEQ ID NO: 246119 - DNA, 25 bp, Homo sapien
ttaataatgacttgtgcttgcccct

SEQ ID NO: 246120 - DNA, 25 bp, Homo sapien
taaatctatttccaattgatgtata

SEQ ID NO: 246121 - DNA, 25 bp, Homo sapien
tctctgatctctcttccagagcaga

SEQ ID NO: 246122 - DNA, 25 bp, Homo sapien
tctgatctctcttccagagcagagc

SEQ ID NO: 246123 - DNA, 25 bp, Homo sapien
ctgatctctcttccagagcagagcc

SEQ ID NO: 246124 - DNA, 25 bp, Homo sapien
ctcgttccttggactgttcctgttc

SEQ ID NO: 246125 - DNA, 25 bp, Homo sapien
gactgttcctgttccctgcactgtg

SEQ ID NO: 246126 - DNA, 25 bp, Homo sapien
actgttcctgttccctgcactgtgg

SEQ ID NO: 246127 - DNA, 25 bp, Homo sapien
gggacaggccagtgctctgggacgt

SEQ ID NO: 246128 - DNA, 25 bp, Homo sapien
acaggccagtgctctgggacgtggg

SEQ ID NO: 246129 - DNA, 25 bp, Homo sapien
ctcggtttctcctctcggtgtctct

SEQ ID NO: 246130 - DNA, 25 bp, Homo sapien
tcggtgtctctccttgcctctctga

SEQ ID NO: 246131 - DNA, 25 bp, Homo sapien
tgcctctctgatctctcttccagag

SEQ ID NO: 246132 - DNA, 25 bp, Homo sapien
tgataaaaatattctcatgcagtat

SEQ ID NO: 246133 - DNA, 25 bp, Homo sapien
gaagcaaatttcagcgacatgtcat

SEQ ID NO: 246134 - DNA, 25 bp, Homo sapien
cagcgacatgtcattgagtttttat

SEQ ID NO: 246135 - DNA, 25 bp, Homo sapien
ggtaaagctataattgtgcagtgta

SEQ ID NO: 246136 - DNA, 25 bp, Homo sapien
aagatagtttattctgtcagggtat

SEQ ID NO: 246137 - DNA, 25 bp, Homo sapien
atatgaagttagtatacagccagaa

SEQ ID NO: 246138 - DNA, 25 bp, Homo sapien
gtatacagccagaacagccaagcct

SEQ ID NO: 246139 - DNA, 25 bp, Homo sapien
gaacagccaagcctcaattcttgta

SEQ ID NO: 246140 - DNA, 25 bp, Homo sapien
agcctcaattcttgtaccttgtgtc

SEQ ID NO: 246141 - DNA, 25 bp, Homo sapien
tgaacttctcagagaggcatctggg

SEQ ID NO: 246142 - DNA, 25 bp, Homo sapien
gggtcctggaacttcatgttgatga

SEQ ID NO: 246143 - DNA, 25 bp, Homo sapien
tgtggaacctactcagcagcttggt

SEQ ID NO: 246144 - DNA, 25 bp, Homo sapien
ggaacctactcagcagcttggtttc

SEQ ID NO: 246145 - DNA, 25 bp, Homo sapien
gggcatatttatttcttaaagccaa

SEQ ID NO: 246146 - DNA, 25 bp, Homo sapien
ttaaagccaaacctctccttcattg

SEQ ID NO: 246147 - DNA, 25 bp, Homo sapien
cctctccttcattggtttagtgtac

SEQ ID NO: 246148 - DNA, 25 bp, Homo sapien
atacacttatcccactttaatctcc

SEQ ID NO: 246149 - DNA, 25 bp, Homo sapien
ctcctgtaccctctgttgctgaagt

SEQ ID NO: 246150 - DNA, 25 bp, Homo sapien
ctgggccctggaaaagccgatggaa

SEQ ID NO: 246151 - DNA, 25 bp, Homo sapien
ggaaaaagtctgttcctgcagccaa

SEQ ID NO: 246152 - DNA, 25 bp, Homo sapien
cctgggtcccaggtgactaggagta

SEQ ID NO: 246153 - DNA, 25 bp, Homo sapien
cccaggtgactaggagtagccatag

SEQ ID NO: 246154 - DNA, 25 bp, Homo sapien
tgacctcttggcgagaatgcaaaga

SEQ ID NO: 246155 - DNA, 25 bp, Homo sapien
gacctcttggcgagaatgcaaagaa

SEQ ID NO: 246156 - DNA, 25 bp, Homo sapien
acctcttggcgagaatgcaaagaag

SEQ ID NO: 246157 - DNA, 25 bp, Homo sapien
cctcttggcgagaatgcaaagaagg

SEQ ID NO: 246158 - DNA, 25 bp, Homo sapien
ctcttggcgagaatgcaaagaaggg

SEQ ID NO: 246159 - DNA, 25 bp, Homo sapien
cgagaatgcaaagaagggaacgctt

SEQ ID NO: 246160 - DNA, 25 bp, Homo sapien
gagaatgcaaagaagggaacgcttg

SEQ ID NO: 246161 - DNA, 25 bp, Homo sapien
gaatgcaaagaagggaacgcttgct

SEQ ID NO: 246162 - DNA, 25 bp, Homo sapien
atgcaaagaagggaacgcttgctta

SEQ ID NO: 246163 - DNA, 25 bp, Homo sapien
tgcaaagaagggaacgcttgcttat

SEQ ID NO: 246164 - DNA, 25 bp, Homo sapien
gcaaagaagggaacgcttgcttata

SEQ ID NO: 246165 - DNA, 25 bp, Homo sapien
ataggagtgaactccggcacctgtt

SEQ ID NO: 246166 - DNA, 25 bp, Homo sapien
gcacctgttgtcttctgcgggtgac

SEQ ID NO: 246167 - DNA, 25 bp, Homo sapien
tgcgggtgacgcacactttaaatgg

SEQ ID NO: 246168 - DNA, 25 bp, Homo sapien
gaggttgtggctataacttgtggct

SEQ ID NO: 246169 - DNA, 25 bp, Homo sapien
ggctataacttgtggctgggaataa

SEQ ID NO: 246170 - DNA, 25 bp, Homo sapien
ataaagatggcaccgccaaggagcc

SEQ ID NO: 246171 - DNA, 25 bp, Homo sapien
tgtgatgggtgcgaatcagcgtata

SEQ ID NO: 246172 - DNA, 25 bp, Homo sapien
gaatcagcgtatagcacttgagaac

SEQ ID NO: 246173 - DNA, 25 bp, Homo sapien
aaggcagaccttggagcagaatggt

SEQ ID NO: 246174 - DNA, 25 bp, Homo sapien
gcagaatggttatgtgaaggatcac

SEQ ID NO: 246175 - DNA, 25 bp, Homo sapien
aggatcacatcacccatgggtaggg

SEQ ID NO: 246176 - DNA, 25 bp, Homo sapien
gaggcggaaatctctcagggagaat

SEQ ID NO: 246177 - DNA, 25 bp, Homo sapien
tctcagggagaattatttcctttct

SEQ ID NO: 246178 - DNA, 25 bp, Homo sapien
gggaattctgtgacagctgattgaa

SEQ ID NO: 246179 - DNA, 25 bp, Homo sapien
gatgaagaacctctgcattctagtt

SEQ ID NO: 246180 - DNA, 25 bp, Homo sapien
tgcattctagttaccctttgcttcc

SEQ ID NO: 246181 - DNA, 25 bp, Homo sapien
tttgcttcccttcacctcttgtaaa

SEQ ID NO: 246182 - DNA, 25 bp, Homo sapien
tttggcttggcaacaatgacattgt

SEQ ID NO: 246183 - DNA, 25 bp, Homo sapien
gacattgtcatgcttattgtcccaa

SEQ ID NO: 246184 - DNA, 25 bp, Homo sapien
atatccatcctgtcgtagatcttaa

SEQ ID NO: 246185 - DNA, 25 bp, Homo sapien
tcttaatgtttttgatcgttgcgtt

SEQ ID NO: 246186 - DNA, 25 bp, Homo sapien
gcgttaaagtggaagtgccacccac

SEQ ID NO: 246187 - DNA, 25 bp, Homo sapien
gatgtgcaaatatcactggattgga

SEQ ID NO: 246188 - DNA, 25 bp, Homo sapien
aaatatcactggattggaggagctc

SEQ ID NO: 246189 - DNA, 25 bp, Homo sapien
ttggaggagctcacttggaaagcca

SEQ ID NO: 246190 - DNA, 25 bp, Homo sapien
gagctcacttggaaagccagtattc

SEQ ID NO: 246191 - DNA, 25 bp, Homo sapien
acttggaaagccagtattcctcctg

SEQ ID NO: 246192 - DNA, 25 bp, Homo sapien
aagaaaggctgtcgtcttatgccaa

SEQ ID NO: 246193 - DNA, 25 bp, Homo sapien
aaggctgtcgtcttatgccaaaagc

SEQ ID NO: 246194 - DNA, 25 bp, Homo sapien
ggctgtcgtcttatgccaaaagcaa

SEQ ID NO: 246195 - DNA, 25 bp, Homo sapien
gtcgtcttatgccaaaagcaatacc

SEQ ID NO: 246196 - DNA, 25 bp, Homo sapien
aagcaataccaaccttgttcacggg

SEQ ID NO: 246197 - DNA, 25 bp, Homo sapien
caataccaaccttgttcacgggctg

SEQ ID NO: 246198 - DNA, 25 bp, Homo sapien
ctactttttcatggctgttgaccta

SEQ ID NO: 246199 - DNA, 25 bp, Homo sapien
atggctgttgacctactggaacaag

SEQ ID NO: 246200 - DNA, 25 bp, Homo sapien
gcaaaacctgcattagatgagtggt

SEQ ID NO: 246201 - DNA, 25 bp, Homo sapien
gatgagtggtcataagattctccat

SEQ ID NO: 246202 - DNA, 25 bp, Homo sapien
gattctccataagttgatgtccaat

SEQ ID NO: 246203 - DNA, 25 bp, Homo sapien
taaggccattggagacttctgcaag

SEQ ID NO: 246204 - DNA, 25 bp, Homo sapien
acttctgcaagatatacacgtccat

SEQ ID NO: 246205 - DNA, 25 bp, Homo sapien
atatacacgtccatctaccacaaat

SEQ ID NO: 246206 - DNA, 25 bp, Homo sapien
taccacaaatggctccacatctgta

SEQ ID NO: 246207 - DNA, 25 bp, Homo sapien
ggctccacatctgtattgtctggtt

SEQ ID NO: 246208 - DNA, 25 bp, Homo sapien
gtctggttttagacaacccatttga

SEQ ID NO: 246209 - DNA, 25 bp, Homo sapien
cctctggcaatcacagctctgcagc

SEQ ID NO: 246210 - DNA, 25 bp, Homo sapien
ccaaccctctccatggccgatggga

SEQ ID NO: 246211 - DNA, 25 bp, Homo sapien
gagcacacacactcggagggctgag

SEQ ID NO: 246212 - DNA, 25 bp, Homo sapien
cacacactcggagggctgagcagca

SEQ ID NO: 246213 - DNA, 25 bp, Homo sapien
gagcagcacgctggaaactgtgact

SEQ ID NO: 246214 - DNA, 25 bp, Homo sapien
acgctggaaactgtgacttggtgat

SEQ ID NO: 246215 - DNA, 25 bp, Homo sapien
aaactgtgacttggtgatgcccagc

SEQ ID NO: 246216 - DNA, 25 bp, Homo sapien
cccagctgcacacgaaattacacat

SEQ ID NO: 246217 - DNA, 25 bp, Homo sapien
acgaaattacacatgactcacctta

SEQ ID NO: 246218 - DNA, 25 bp, Homo sapien
tacacatgactcaccttattaaggg

SEQ ID NO: 246219 - DNA, 25 bp, Homo sapien
cttattaagggctattgcactgaaa

SEQ ID NO: 246220 - DNA, 25 bp, Homo sapien
tctctgatctctcttccagagcaga

SEQ ID NO: 246221 - DNA, 25 bp, Homo sapien
ctgatctctcttccagagcagagcc

SEQ ID NO: 246222 - DNA, 25 bp, Homo sapien
ttgggctgagatggctgtgccccaa

SEQ ID NO: 246223 - DNA, 25 bp, Homo sapien
ggctgagatggctgtgccccaactc

SEQ ID NO: 246224 - DNA, 25 bp, Homo sapien
ctcgttccttggactgttcctgttc

SEQ ID NO: 246225 - DNA, 25 bp, Homo sapien
actgttcctgttccctgcactgtgg

SEQ ID NO: 246226 - DNA, 25 bp, Homo sapien
gttccctgcactgtgggacaggcca

SEQ ID NO: 246227 - DNA, 25 bp, Homo sapien
ggacaggccagtgctctgggacgtg

SEQ ID NO: 246228 - DNA, 25 bp, Homo sapien
tgggacgtgggcagccccaccctgt

SEQ ID NO: 246229 - DNA, 25 bp, Homo sapien
ctcggtttctcctctcggtgtctct

SEQ ID NO: 246230 - DNA, 25 bp, Homo sapien
cggtgtctctccttgcctctctgat

SEQ ID NO: 246231 - DNA, 25 bp, Homo sapien
gaagttggtggaacagctcactgaa

SEQ ID NO: 246232 - DNA, 25 bp, Homo sapien
gatgaattatttaagctggctccgg

SEQ ID NO: 246233 - DNA, 25 bp, Homo sapien
tggctccggagaaagtgaacgcagt

SEQ ID NO: 246234 - DNA, 25 bp, Homo sapien
gaggccatcgtgaactttgtcaacc

SEQ ID NO: 246235 - DNA, 25 bp, Homo sapien
ttgtcaaccagaagctggaccgcct

SEQ ID NO: 246236 - DNA, 25 bp, Homo sapien
accgcctgggcctgtctgtgcagaa

SEQ ID NO: 246237 - DNA, 25 bp, Homo sapien
gggcctgtctgtgcagaatctggac

SEQ ID NO: 246238 - DNA, 25 bp, Homo sapien
agaatctggacacccagtttgcaga

SEQ ID NO: 246239 - DNA, 25 bp, Homo sapien
gggtcatcttactcttgctgattgg

SEQ ID NO: 246240 - DNA, 25 bp, Homo sapien
ttactcttgctgattggacaacttg

SEQ ID NO: 246241 - DNA, 25 bp, Homo sapien
ggacaacttgaaggcttcttcctgc

SEQ ID NO: 246242 - DNA, 25 bp, Homo sapien
gtgtagctgctgtaagaattctaat

SEQ ID NO: 246243 - DNA, 25 bp, Homo sapien
gtagctgctgtaagaattctaatcc

SEQ ID NO: 246244 - DNA, 25 bp, Homo sapien
gctgctgtaagaattctaatcccta

SEQ ID NO: 246245 - DNA, 25 bp, Homo sapien
tgtaagaattctaatccctagccgg

SEQ ID NO: 246246 - DNA, 25 bp, Homo sapien
gtaagaattctaatccctagccggg

SEQ ID NO: 246247 - DNA, 25 bp, Homo sapien
taagaattctaatccctagccgggt

SEQ ID NO: 246248 - DNA, 25 bp, Homo sapien
aagaattctaatccctagccgggtg

SEQ ID NO: 246249 - DNA, 25 bp, Homo sapien
gaattctaatccctagccgggtgca

SEQ ID NO: 246250 - DNA, 25 bp, Homo sapien
aattctaatccctagccgggtgcag

SEQ ID NO: 246251 - DNA, 25 bp, Homo sapien
attctaatccctagccgggtgcagt

SEQ ID NO: 246252 - DNA, 25 bp, Homo sapien
ttctaatccctagccgggtgcagtg

SEQ ID NO: 246253 - DNA, 25 bp, Homo sapien
gagaccctggagacgcagcccggag

SEQ ID NO: 246254 - DNA, 25 bp, Homo sapien
tcctcgcggcccacggagaaggcgt

SEQ ID NO: 246255 - DNA, 25 bp, Homo sapien
tcgcggcccacggagaaggcgttca

SEQ ID NO: 246256 - DNA, 25 bp, Homo sapien
acggagaaggcgttcacggtgccca

SEQ ID NO: 246257 - DNA, 25 bp, Homo sapien
gagaaggcgttcacggtgcccatca

SEQ ID NO: 246258 - DNA, 25 bp, Homo sapien
aaggcgttcacggtgcccatcacgg

SEQ ID NO: 246259 - DNA, 25 bp, Homo sapien
gttcacggtgcccatcacggatgtg

SEQ ID NO: 246260 - DNA, 25 bp, Homo sapien
gggcagtggcggctacacctacttc

SEQ ID NO: 246261 - DNA, 25 bp, Homo sapien
gcagtggcggctacacctacttcac

SEQ ID NO: 246262 - DNA, 25 bp, Homo sapien
acctacttcaccacggtgaccgtgg

SEQ ID NO: 246263 - DNA, 25 bp, Homo sapien
tcaccacggtgaccgtggagaccct

SEQ ID NO: 246264 - DNA, 25 bp, Homo sapien
cgacgaggagctaaataagcttcta

SEQ ID NO: 246265 - DNA, 25 bp, Homo sapien
gctaaataagcttctaggtcgcgtg

SEQ ID NO: 246266 - DNA, 25 bp, Homo sapien
aataagcttctaggtcgcgtgacca

SEQ ID NO: 246267 - DNA, 25 bp, Homo sapien
aagcttctaggtcgcgtgaccatcg

SEQ ID NO: 246268 - DNA, 25 bp, Homo sapien
aatgattactagtcaaatccgtcag

SEQ ID NO: 246269 - DNA, 25 bp, Homo sapien
tagtcaaatccgtcagtgatcccga

SEQ ID NO: 246270 - DNA, 25 bp, Homo sapien
tcaaatccgtcagtgatcccgagtc

SEQ ID NO: 246271 - DNA, 25 bp, Homo sapien
gtcagtgatcccgagtcccagaaac

SEQ ID NO: 246272 - DNA, 25 bp, Homo sapien
gtgatcccgagtcccagaaaccaaa

SEQ ID NO: 246273 - DNA, 25 bp, Homo sapien
gtgctggaatacacatacgatgcct

SEQ ID NO: 246274 - DNA, 25 bp, Homo sapien
ctggaatacacatacgatgcctgaa

SEQ ID NO: 246275 - DNA, 25 bp, Homo sapien
ttttttctctccgatccttggacac

SEQ ID NO: 246276 - DNA, 25 bp, Homo sapien
gatccttggacacctcctctgtctg

SEQ ID NO: 246277 - DNA, 25 bp, Homo sapien
acctcctctgtctgccatttattag

SEQ ID NO: 246278 - DNA, 25 bp, Homo sapien
attagccatgtgaacttggccacat

SEQ ID NO: 246279 - DNA, 25 bp, Homo sapien
tgtgaacttggccacatcacttcac

SEQ ID NO: 246280 - DNA, 25 bp, Homo sapien
gggtttataaacacctacctcgcag

SEQ ID NO: 246281 - DNA, 25 bp, Homo sapien
ttataaacacctacctcgcagggtt

SEQ ID NO: 246282 - DNA, 25 bp, Homo sapien
taaacacctacctcgcagggttgtt

SEQ ID NO: 246283 - DNA, 25 bp, Homo sapien
aatgtatgtaaagcgccttgcacac

SEQ ID NO: 246284 - DNA, 25 bp, Homo sapien
tatgtaaagcgccttgcacactgcc

SEQ ID NO: 246285 - DNA, 25 bp, Homo sapien
aaagcgccttgcacactgcctggca

SEQ ID NO: 246286 - DNA, 25 bp, Homo sapien
gagtaaacctcgagaccaatccaga

SEQ ID NO: 246287 - DNA, 25 bp, Homo sapien
ataatgatctctatacctccttctc

SEQ ID NO: 246288 - DNA, 25 bp, Homo sapien
aacctcgagaccaatccagaaataa

SEQ ID NO: 246289 - DNA, 25 bp, Homo sapien
acctccttctcgaactgtggtttga

SEQ ID NO: 246290 - DNA, 25 bp, Homo sapien
tgtggtttgaaggacagtatcatca

SEQ ID NO: 246291 - DNA, 25 bp, Homo sapien
gaaggacagtatcatcagcattact

SEQ ID NO: 246292 - DNA, 25 bp, Homo sapien
gcattacttggagcttgtgagaaat

SEQ ID NO: 246293 - DNA, 25 bp, Homo sapien
gaaataaattgccaagcttctatca

SEQ ID NO: 246294 - DNA, 25 bp, Homo sapien
gccaagcttctatcaaataattcaa

SEQ ID NO: 246295 - DNA, 25 bp, Homo sapien
caggactcttgatgatacacttgaa

SEQ ID NO: 246296 - DNA, 25 bp, Homo sapien
gatgatacacttgaagtcactaaat

SEQ ID NO: 246297 - DNA, 25 bp, Homo sapien
atcctctgagctgcctcagggaaat

SEQ ID NO: 246298 - DNA, 25 bp, Homo sapien
cagggaaatctccttaaaacttcag

SEQ ID NO: 246299 - DNA, 25 bp, Homo sapien
aaacttcagattgggtcaccttcct

SEQ ID NO: 246300 - DNA, 25 bp, Homo sapien
tgaatacaccttcccagtgtctgca

SEQ ID NO: 246301 - DNA, 25 bp, Homo sapien
tgcttaacaagcttcagtctccatc

SEQ ID NO: 246302 - DNA, 25 bp, Homo sapien
cccatgcccaggtggtcagggtcag

SEQ ID NO: 246303 - DNA, 25 bp, Homo sapien
cagctggacgtttcaactgctcaga

SEQ ID NO: 246304 - DNA, 25 bp, Homo sapien
ttcaactgctcagaccgagggtcag

SEQ ID NO: 246305 - DNA, 25 bp, Homo sapien
acagttcctgcctcgggtcagtgtt

SEQ ID NO: 246306 - DNA, 25 bp, Homo sapien
tgttctgggtggtttctctggaatc

SEQ ID NO: 246307 - DNA, 25 bp, Homo sapien
ggtttctctggaatcatccaaccct

SEQ ID NO: 246308 - DNA, 25 bp, Homo sapien
aagctagatgggacgtacctgccct

SEQ ID NO: 246309 - DNA, 25 bp, Homo sapien
tgcccttgccggtggacaagatcat

SEQ ID NO: 246310 - DNA, 25 bp, Homo sapien
gacaagatcatccagcgtacaaaaa

SEQ ID NO: 246311 - DNA, 25 bp, Homo sapien
gtcaacaagatcgtgcagtacagcc

SEQ ID NO: 246312 - DNA, 25 bp, Homo sapien
gagcactttgtcaatggcctcagat

SEQ ID NO: 246313 - DNA, 25 bp, Homo sapien
aatggcctcagatatggcgtacccc

SEQ ID NO: 246314 - DNA, 25 bp, Homo sapien
tggcgtaccccggagccagcaggta

SEQ ID NO: 246315 - DNA, 25 bp, Homo sapien
cagtctttggtctccaggtgaggag

SEQ ID NO: 246316 - DNA, 25 bp, Homo sapien
aggtgggcagcattacttccatctt

SEQ ID NO: 246317 - DNA, 25 bp, Homo sapien
ttccatctttagcaatcgggccgtg

SEQ ID NO: 246318 - DNA, 25 bp, Homo sapien
gggccgtggtgaaatacagtcgtct

SEQ ID NO: 246319 - DNA, 25 bp, Homo sapien
ggcactattgtatgtactttatata

SEQ ID NO: 246320 - DNA, 25 bp, Homo sapien
tcacatttaatcctcctgtcaatgc

SEQ ID NO: 246321 - DNA, 25 bp, Homo sapien
cctgtcaatgctttgaggtaggtat

SEQ ID NO: 246322 - DNA, 25 bp, Homo sapien
tttgaggtaggtatgattcccattt

SEQ ID NO: 246323 - DNA, 25 bp, Homo sapien
gctcaaggagtttaatcatttatca

SEQ ID NO: 246324 - DNA, 25 bp, Homo sapien
catttatcaagggtttcttctgcga

SEQ ID NO: 246325 - DNA, 25 bp, Homo sapien
gtttcttctgcgaatgatagagcca

SEQ ID NO: 246326 - DNA, 25 bp, Homo sapien
aatgatagagccaggctgcgccgtc

SEQ ID NO: 246327 - DNA, 25 bp, Homo sapien
atagagccaggctgcgccgtcggct

SEQ ID NO: 246328 - DNA, 25 bp, Homo sapien
ggctcctctagcctaacgttggttt

SEQ ID NO: 246329 - DNA, 25 bp, Homo sapien
gcctaacgttggtttacagtattca

SEQ ID NO: 246330 - DNA, 25 bp, Homo sapien
ataattttcttctctgtaatctaag

SEQ ID NO: 246331 - DNA, 25 bp, Homo sapien
taataggtttaggtgtttataagca

SEQ ID NO: 246332 - DNA, 25 bp, Homo sapien
ataggtttaggtgtttataagcaat

SEQ ID NO: 246333 - DNA, 25 bp, Homo sapien
taggtgtttataagcaatagttctc

SEQ ID NO: 246334 - DNA, 25 bp, Homo sapien
ggtgtttataagcaatagttctcta

SEQ ID NO: 246335 - DNA, 25 bp, Homo sapien
gtgtttataagcaatagttctctat

SEQ ID NO: 246336 - DNA, 25 bp, Homo sapien
tataagcaatagttctctattttct

SEQ ID NO: 246337 - DNA, 25 bp, Homo sapien
gttctctattttctagttgatataa

SEQ ID NO: 246338 - DNA, 25 bp, Homo sapien
agaaaagctaggtgaggttgagtta

SEQ ID NO: 246339 - DNA, 25 bp, Homo sapien
ttttcccataattgtatatcagaga

SEQ ID NO: 246340 - DNA, 25 bp, Homo sapien
tcccataattgtatatcagagaaat

SEQ ID NO: 246341 - DNA, 25 bp, Homo sapien
atctctgaggttagaatgttgattc

SEQ ID NO: 246342 - DNA, 25 bp, Homo sapien
agaatgttgattcatgcatattcca

SEQ ID NO: 246343 - DNA, 25 bp, Homo sapien
tcatgcatattccagctggctttcc

SEQ ID NO: 246344 - DNA, 25 bp, Homo sapien
agctggctttccctatgagtataaa

SEQ ID NO: 246345 - DNA, 25 bp, Homo sapien
ggtccaaagaccagagaatccctaa

SEQ ID NO: 246346 - DNA, 25 bp, Homo sapien
gaatccctaagtaggaagacagttt

SEQ ID NO: 246347 - DNA, 25 bp, Homo sapien
atcaactttcatgaacacagtcgtt

SEQ ID NO: 246348 - DNA, 25 bp, Homo sapien
gaacacagtcgttcagctgaaccaa

SEQ ID NO: 246349 - DNA, 25 bp, Homo sapien
tcgttcagctgaaccaagtatcagt

SEQ ID NO: 246350 - DNA, 25 bp, Homo sapien
aagtatcagtgataacttctgtttt

SEQ ID NO: 246351 - DNA, 25 bp, Homo sapien
tttagaaatatatctctgaggttag

SEQ ID NO: 246352 - DNA, 25 bp, Homo sapien
tggttcttaagatatcctttgtttt

SEQ ID NO: 246353 - DNA, 25 bp, Homo sapien
aaagttgacagattgtccctgccgc

SEQ ID NO: 246354 - DNA, 25 bp, Homo sapien
tgccgcagtgtccagggtcacctct

SEQ ID NO: 246355 - DNA, 25 bp, Homo sapien
agctgctcctggcttggacgtattt

SEQ ID NO: 246356 - DNA, 25 bp, Homo sapien
gcttggacgtatttctcatgaggca

SEQ ID NO: 246357 - DNA, 25 bp, Homo sapien
ttctcatgaggcagacttttgccag

SEQ ID NO: 246358 - DNA, 25 bp, Homo sapien
tctgtgtaactctgacttcctaaat

SEQ ID NO: 246359 - DNA, 25 bp, Homo sapien
ctctgacttcctaaatggtgaccga

SEQ ID NO: 246360 - DNA, 25 bp, Homo sapien
gagattttcaaaacctcaggctttt

SEQ ID NO: 246361 - DNA, 25 bp, Homo sapien
aaacctcaggcttttcatatgttta

SEQ ID NO: 246362 - DNA, 25 bp, Homo sapien
gtcatgggtcttagaggcttttgaa

SEQ ID NO: 246363 - DNA, 25 bp, Homo sapien
cacagtagcccagtcgtggtaggat

SEQ ID NO: 246364 - DNA, 25 bp, Homo sapien
tagcccagtcgtggtaggataaatt

SEQ ID NO: 246365 - DNA, 25 bp, Homo sapien
aattacggatatagtcattctaggg

SEQ ID NO: 246366 - DNA, 25 bp, Homo sapien
ttcagtcttttccatctcaaggcat

SEQ ID NO: 246367 - DNA, 25 bp, Homo sapien
ggcattgtgtgttttgttccgggac

SEQ ID NO: 246368 - DNA, 25 bp, Homo sapien
gaactgcctgaagttcgcacattca

SEQ ID NO: 246369 - DNA, 25 bp, Homo sapien
gaagttcgcacattcagattgttgt

SEQ ID NO: 246370 - DNA, 25 bp, Homo sapien
tcgcacattcagattgttgtgtcca

SEQ ID NO: 246371 - DNA, 25 bp, Homo sapien
gggatggcctttccggtcttcgcac

SEQ ID NO: 246372 - DNA, 25 bp, Homo sapien
tcccctgcacttctggatgacacag

SEQ ID NO: 246373 - DNA, 25 bp, Homo sapien
ggatgacacagggtgctgctgcctc

SEQ ID NO: 246374 - DNA, 25 bp, Homo sapien
gaatggaaagaagccctgcctggat

SEQ ID NO: 246375 - DNA, 25 bp, Homo sapien
gccctgcctggatgcatggagcaga

SEQ ID NO: 246376 - DNA, 25 bp, Homo sapien
ggagcagatggatactgacaccaag

SEQ ID NO: 246377 - DNA, 25 bp, Homo sapien
gacaccaaggacattcagattttct

SEQ ID NO: 246378 - DNA, 25 bp, Homo sapien
gaaacacccaatgttcagaccttac

SEQ ID NO: 246379 - DNA, 25 bp, Homo sapien
aaacgacttctgctattcttactta

SEQ ID NO: 246380 - DNA, 25 bp, Homo sapien
agtgatagcacctcatgtcttcaga

SEQ ID NO: 246381 - DNA, 25 bp, Homo sapien
accttacctcagtctaagagctggc

SEQ ID NO: 246382 - DNA, 25 bp, Homo sapien
agagctggctccacagttggtagca

SEQ ID NO: 246383 - DNA, 25 bp, Homo sapien
gttggtagcaatggccctgttaggc

SEQ ID NO: 246384 - DNA, 25 bp, Homo sapien
aatggccctgttaggcagactgtcc

SEQ ID NO: 246385 - DNA, 25 bp, Homo sapien
acatttttaagagcgtgatacagga

SEQ ID NO: 246386 - DNA, 25 bp, Homo sapien
gagcgtgatacaggattgttaacaa

SEQ ID NO: 246387 - DNA, 25 bp, Homo sapien
gacttttctactacaagaaggtggc

SEQ ID NO: 246388 - DNA, 25 bp, Homo sapien
agaaggtggcttcctcaaggcatat

SEQ ID NO: 246389 - DNA, 25 bp, Homo sapien
ggtggcttcctcaaggcatatgatt

SEQ ID NO: 246390 - DNA, 25 bp, Homo sapien
gcttcctcaaggcatatgattgcaa

SEQ ID NO: 246391 - DNA, 25 bp, Homo sapien
atgattgcaatccaagcgatgctat

SEQ ID NO: 246392 - DNA, 25 bp, Homo sapien
agattgtttgcggagggctgcagct

SEQ ID NO: 246393 - DNA, 25 bp, Homo sapien
gcaaaagaacactgaccataagatc

SEQ ID NO: 246394 - DNA, 25 bp, Homo sapien
ataagatctgccctcaacacatttt

SEQ ID NO: 246395 - DNA, 25 bp, Homo sapien
agatctgccctcaacacatttttaa

SEQ ID NO: 246396 - DNA, 25 bp, Homo sapien
gacagatgatgagcgagaacgctat

SEQ ID NO: 246397 - DNA, 25 bp, Homo sapien
acgctataaagctgtgttccaagac

SEQ ID NO: 246398 - DNA, 25 bp, Homo sapien
gctgtgttccaagaccagttttcag

SEQ ID NO: 246399 - DNA, 25 bp, Homo sapien
gttttcagagtacaaagagctgtct

SEQ ID NO: 246400 - DNA, 25 bp, Homo sapien
ctgtcctgaggaagtttgatgagct

SEQ ID NO: 246401 - DNA, 25 bp, Homo sapien
gatgcagtgatgagcagattgccac

SEQ ID NO: 246402 - DNA, 25 bp, Homo sapien
gagcagattgccacatcattcggaa

SEQ ID NO: 246403 - DNA, 25 bp, Homo sapien
attgccacatcattcggaaagccga

SEQ ID NO: 246404 - DNA, 25 bp, Homo sapien
gaaagccgacaggaacatgagagaa

SEQ ID NO: 246405 - DNA, 25 bp, Homo sapien
gaatgatcctacatttctggaaaaa

SEQ ID NO: 246406 - DNA, 25 bp, Homo sapien
aagaacgctgtgattacctaaagaa

SEQ ID NO: 246407 - DNA, 25 bp, Homo sapien
tgcatatagctgtatcatagtttat

SEQ ID NO: 246408 - DNA, 25 bp, Homo sapien
gtttatacatagatgctttgtaaca

SEQ ID NO: 246409 - DNA, 25 bp, Homo sapien
taatgctatgaatgctatggtgaat

SEQ ID NO: 246410 - DNA, 25 bp, Homo sapien
tcaacttatgtttccaccagcagtt

SEQ ID NO: 246411 - DNA, 25 bp, Homo sapien
gtttccaccagcagtttcagagagt

SEQ ID NO: 246412 - DNA, 25 bp, Homo sapien
accagcagtttcagagagtgcctgt

SEQ ID NO: 246413 - DNA, 25 bp, Homo sapien
agagagtgcctgtctcatcccatcc

SEQ ID NO: 246414 - DNA, 25 bp, Homo sapien
atcctccccagtattgcatattctt

SEQ ID NO: 246415 - DNA, 25 bp, Homo sapien
gtattgcatattcttgagtctttta

SEQ ID NO: 246416 - DNA, 25 bp, Homo sapien
gagtcttttattctttgataatgac

SEQ ID NO: 246417 - DNA, 25 bp, Homo sapien
gatgaatcattgatagtttttcttc

SEQ ID NO: 246418 - DNA, 25 bp, Homo sapien
atctctaaaagagtacacggtccta

SEQ ID NO: 246419 - DNA, 25 bp, Homo sapien
tctctaaaagagtacacggtcctag

SEQ ID NO: 246420 - DNA, 25 bp, Homo sapien
ctaaaagagtacacggtcctagagc

SEQ ID NO: 246421 - DNA, 25 bp, Homo sapien
taaaagagtacacggtcctagagca

SEQ ID NO: 246422 - DNA, 25 bp, Homo sapien
aaagagtacacggtcctagagcagt

SEQ ID NO: 246423 - DNA, 25 bp, Homo sapien
aagagtacacggtcctagagcagtg

SEQ ID NO: 246424 - DNA, 25 bp, Homo sapien
agtacacggtcctagagcagtggtg

SEQ ID NO: 246425 - DNA, 25 bp, Homo sapien
gtacacggtcctagagcagtggtgt

SEQ ID NO: 246426 - DNA, 25 bp, Homo sapien
tacacggtcctagagcagtggtgtg

SEQ ID NO: 246427 - DNA, 25 bp, Homo sapien
gaatctctcaggcatactgaaatgt

SEQ ID NO: 246428 - DNA, 25 bp, Homo sapien
aatctctcaggcatactgaaatgtt

SEQ ID NO: 246429 - DNA, 25 bp, Homo sapien
gtcaagcccactctaccacttttta

SEQ ID NO: 246430 - DNA, 25 bp, Homo sapien
agtgttcttcagagattgacatacc

SEQ ID NO: 246431 - DNA, 25 bp, Homo sapien
ttacttatctggttaataatccgaa

SEQ ID NO: 246432 - DNA, 25 bp, Homo sapien
tctggttaataatccgaaatgttac

SEQ ID NO: 246433 - DNA, 25 bp, Homo sapien
ttcctgttgtggatgtaacttacct

SEQ ID NO: 246434 - DNA, 25 bp, Homo sapien
tggatgtaacttacctttctaaact

SEQ ID NO: 246435 - DNA, 25 bp, Homo sapien
ctcctttagagttaacgacttctat

SEQ ID NO: 246436 - DNA, 25 bp, Homo sapien
gagttaacgacttctatttagtatt

SEQ ID NO: 246437 - DNA, 25 bp, Homo sapien
tatttagtattgttggtatctccag

SEQ ID NO: 246438 - DNA, 25 bp, Homo sapien
atacacaaagttctcatcctaaatg

SEQ ID NO: 246439 - DNA, 25 bp, Homo sapien
tgaactatttcagtcaagcccactc

SEQ ID NO: 246440 - DNA, 25 bp, Homo sapien
gagtgagtccggtctcccggcgaaa

SEQ ID NO: 246441 - DNA, 25 bp, Homo sapien
tctcccggcgaaagtgagcgaggtt

SEQ ID NO: 246442 - DNA, 25 bp, Homo sapien
aagaaggctgagaaccgccgagaac

SEQ ID NO: 246443 - DNA, 25 bp, Homo sapien
ctgagaaccgccgagaacgtgaaaa

SEQ ID NO: 246444 - DNA, 25 bp, Homo sapien
gagcatcaagaagcactatagattt

SEQ ID NO: 246445 - DNA, 25 bp, Homo sapien
agatttagctaaacatccatgtaat

SEQ ID NO: 246446 - DNA, 25 bp, Homo sapien
gtaatgcctcaatggtatcagcttt

SEQ ID NO: 246447 - DNA, 25 bp, Homo sapien
atgcctcaatggtatcagctttttt

SEQ ID NO: 246448 - DNA, 25 bp, Homo sapien
ttttgatatcagttggtagttggaa

SEQ ID NO: 246449 - DNA, 25 bp, Homo sapien
tattttatctgacgtatacctgaat

SEQ ID NO: 246450 - DNA, 25 bp, Homo sapien
tatctgacgtatacctgaataaaat

SEQ ID NO: 246451 - DNA, 25 bp, Homo sapien
tgaagcctgaggttactgcattaaa

SEQ ID NO: 246452 - DNA, 25 bp, Homo sapien
actgcattaaaagtgcctgagtaaa

SEQ ID NO: 246453 - DNA, 25 bp, Homo sapien
taattattctccagtagctgagcaa

SEQ ID NO: 246454 - DNA, 25 bp, Homo sapien
gtagctgagcaatgcttgtgaatct

SEQ ID NO: 246455 - DNA, 25 bp, Homo sapien
gtgaatcttttcttaagaaatccca

SEQ ID NO: 246456 - DNA, 25 bp, Homo sapien
gaaatcccaaaaagccaatattagt

SEQ ID NO: 246457 - DNA, 25 bp, Homo sapien
gtttaatttggttatcttgctttat

SEQ ID NO: 246458 - DNA, 25 bp, Homo sapien
tatgcctctaaacaatcaaatctat

SEQ ID NO: 246459 - DNA, 25 bp, Homo sapien
gatgtcaagaaatatacctactgct

SEQ ID NO: 246460 - DNA, 25 bp, Homo sapien
atacctactgctatccgtatgtggt

SEQ ID NO: 246461 - DNA, 25 bp, Homo sapien
actgctatccgtatgtggtggatta

SEQ ID NO: 246462 - DNA, 25 bp, Homo sapien
tgtcttcgtctacagcccagccttt

SEQ ID NO: 246463 - DNA, 25 bp, Homo sapien
tatggatgtcaaacacctgcacctt

SEQ ID NO: 246464 - DNA, 25 bp, Homo sapien
ggatgtcaaacacctgcaccttgag

SEQ ID NO: 246465 - DNA, 25 bp, Homo sapien
gcaccttgagataatcctacaacca

SEQ ID NO: 246466 - DNA, 25 bp, Homo sapien
tgagataatcctacaaccacatgca

SEQ ID NO: 246467 - DNA, 25 bp, Homo sapien
aaccacatgcagttgtgggaccgca

SEQ ID NO: 246468 - DNA, 25 bp, Homo sapien
acatgcagttgtgggaccgcagttt

SEQ ID NO: 246469 - DNA, 25 bp, Homo sapien
acacccagcttgtgcctgtggttaa

SEQ ID NO: 246470 - DNA, 25 bp, Homo sapien
gcctgtggttaacatctcagaaaac

SEQ ID NO: 246471 - DNA, 25 bp, Homo sapien
gaaaactctggtaaatgatcactcc

SEQ ID NO: 246472 - DNA, 25 bp, Homo sapien
aaatgatcactccaggatattgaca

SEQ ID NO: 246473 - DNA, 25 bp, Homo sapien
aatttgtattctcccaatttgctta

SEQ ID NO: 246474 - DNA, 25 bp, Homo sapien
tgtattctcccaatttgcttataat

SEQ ID NO: 246475 - DNA, 25 bp, Homo sapien
gaaaacccatccttgaacaaggtat

SEQ ID NO: 246476 - DNA, 25 bp, Homo sapien
gatttaaagattgcatctctttcac

SEQ ID NO: 246477 - DNA, 25 bp, Homo sapien
aaagattgcatctctttcacaatat

SEQ ID NO: 246478 - DNA, 25 bp, Homo sapien
gattgcatctctttcacaatatttt

SEQ ID NO: 246479 - DNA, 25 bp, Homo sapien
aacccatccttgaacaaggtataga

SEQ ID NO: 246480 - DNA, 25 bp, Homo sapien
gggcaacaatttattagtggactgg

SEQ ID NO: 246481 - DNA, 25 bp, Homo sapien
gcaacaatttattagtggactggaa

SEQ ID NO: 246482 - DNA, 25 bp, Homo sapien
ttagtggactggaaatgaacagatt

SEQ ID NO: 246483 - DNA, 25 bp, Homo sapien
tacctgtattttatccccaagtgga

SEQ ID NO: 246484 - DNA, 25 bp, Homo sapien
gaagtgtacaaggaagtggccatcc

SEQ ID NO: 246485 - DNA, 25 bp, Homo sapien
gaagtggccatccttgttcaagtta

SEQ ID NO: 246486 - DNA, 25 bp, Homo sapien
tccttgttcaagttacgtatctagt

SEQ ID NO: 246487 - DNA, 25 bp, Homo sapien
agttagaacaacttcccagtccatt

SEQ ID NO: 246488 - DNA, 25 bp, Homo sapien
aacttcccagtccattggagttctt

SEQ ID NO: 246489 - DNA, 25 bp, Homo sapien
cattggagttctttgagaagcctca

SEQ ID NO: 246490 - DNA, 25 bp, Homo sapien
ctcagggaagtagctctgggtcctt

SEQ ID NO: 246491 - DNA, 25 bp, Homo sapien
agctctgggtccttctaatcaacct

SEQ ID NO: 246492 - DNA, 25 bp, Homo sapien
ttctaatcaacctcccattactgcg

SEQ ID NO: 246493 - DNA, 25 bp, Homo sapien
tactgcgccagtaagtttctgtttc

SEQ ID NO: 246494 - DNA, 25 bp, Homo sapien
atgcatattgtatcctgactgtgtg

SEQ ID NO: 246495 - DNA, 25 bp, Homo sapien
tttttccttcactttgttctggaat

SEQ ID NO: 246496 - DNA, 25 bp, Homo sapien
tccttcactttgttctggaatttaa

SEQ ID NO: 246497 - DNA, 25 bp, Homo sapien
ttaaaaagtgtctagagcccattac

SEQ ID NO: 246498 - DNA, 25 bp, Homo sapien
gtgtctagagcccattactttagcc

SEQ ID NO: 246499 - DNA, 25 bp, Homo sapien
agagcccattactttagccttagct

SEQ ID NO: 246500 - DNA, 25 bp, Homo sapien
agccttagctttttggacagcgtta

SEQ ID NO: 246501 - DNA, 25 bp, Homo sapien
ataactttccttgaagtgagctgct

SEQ ID NO: 246502 - DNA, 25 bp, Homo sapien
tttccttgaagtgagctgctaagca

SEQ ID NO: 246503 - DNA, 25 bp, Homo sapien
gctgctaagcagaagaaaacttgtt

SEQ ID NO: 246504 - DNA, 25 bp, Homo sapien
ttttaacctttaccacaattctgtg

SEQ ID NO: 246505 - DNA, 25 bp, Homo sapien
ccacaattctgtgggccaaagggat

SEQ ID NO: 246506 - DNA, 25 bp, Homo sapien
attgctgttcagtcacaaatccgaa

SEQ ID NO: 246507 - DNA, 25 bp, Homo sapien
gtaagcttttgtttctaaccattgt

SEQ ID NO: 246508 - DNA, 25 bp, Homo sapien
caggctgtgctgacccaggattagt

SEQ ID NO: 246509 - DNA, 25 bp, Homo sapien
atatttgtgtgcatgcgtctccaag

SEQ ID NO: 246510 - DNA, 25 bp, Homo sapien
gcatgcgtctccaagtcagttgtaa

SEQ ID NO: 246511 - DNA, 25 bp, Homo sapien
tgctgacccaggattagtaatttgt

SEQ ID NO: 246512 - DNA, 25 bp, Homo sapien
tagtaatttgttatgtctgttttcc

SEQ ID NO: 246513 - DNA, 25 bp, Homo sapien
gttttcccttagatgtttgggcact

SEQ ID NO: 246514 - DNA, 25 bp, Homo sapien
gtttgggcactcagatgctatcttg

SEQ ID NO: 246515 - DNA, 25 bp, Homo sapien
gatgctatcttggtgcacacacaca

SEQ ID NO: 246516 - DNA, 25 bp, Homo sapien
ggtgcacacacacaacattgctgtt

SEQ ID NO: 246517 - DNA, 25 bp, Homo sapien
gagtgagtccggtctcccggcgaaa

SEQ ID NO: 246518 - DNA, 25 bp, Homo sapien
tctcccggcgaaagtgagcgaggtt

SEQ ID NO: 246519 - DNA, 25 bp, Homo sapien
aaagtgagcgaggtttgcccggagc

SEQ ID NO: 246520 - DNA, 25 bp, Homo sapien
aggtttgcccggagcgcgcacgagg

SEQ ID NO: 246521 - DNA, 25 bp, Homo sapien
aaaaaagactggtgcgaggaagaag

SEQ ID NO: 246522 - DNA, 25 bp, Homo sapien
aagaaggctgagaaccgccgagaac

SEQ ID NO: 246523 - DNA, 25 bp, Homo sapien
ctgagaaccgccgagaacgtgaaaa

SEQ ID NO: 246524 - DNA, 25 bp, Homo sapien
gccgagaacgtgaaaaacaactaag

SEQ ID NO: 246525 - DNA, 25 bp, Homo sapien
aaacaactaagagcatcaagaagca

SEQ ID NO: 246526 - DNA, 25 bp, Homo sapien
gaagcactatagatttagctaaaca

SEQ ID NO: 246527 - DNA, 25 bp, Homo sapien
agatttagctaaacatccatgtaat

SEQ ID NO: 246528 - DNA, 25 bp, Homo sapien
gccattttctggaactacctctgta

SEQ ID NO: 246529 - DNA, 25 bp, Homo sapien
ggaactacctctgtattagataccc

SEQ ID NO: 246530 - DNA, 25 bp, Homo sapien
ttagataccccagactataaggaag

SEQ ID NO: 246531 - DNA, 25 bp, Homo sapien
aaggaagacacctccacaactgaaa

SEQ ID NO: 246532 - DNA, 25 bp, Homo sapien
caatagctacaaacctagtggaaga

SEQ ID NO: 246533 - DNA, 25 bp, Homo sapien
gaaacggatatctttgaactactga

SEQ ID NO: 246534 - DNA, 25 bp, Homo sapien
gaagaacccgatgagttcatgattt

SEQ ID NO: 246535 - DNA, 25 bp, Homo sapien
aattgtgcaatagtctagccagcta

SEQ ID NO: 246536 - DNA, 25 bp, Homo sapien
tagccagctagccttaacatctaag

SEQ ID NO: 246537 - DNA, 25 bp, Homo sapien
gagactgtacctaagatcactgagc

SEQ ID NO: 246538 - DNA, 25 bp, Homo sapien
taagatcactgagccattttctgga

SEQ ID NO: 246539 - DNA, 25 bp, Homo sapien
tgcctgccatatgcctgtccccttt

SEQ ID NO: 246540 - DNA, 25 bp, Homo sapien
agtccaggcagtcgagctccacctg

SEQ ID NO: 246541 - DNA, 25 bp, Homo sapien
tgcttcctctcggtgatattttttc

SEQ ID NO: 246542 - DNA, 25 bp, Homo sapien
cttcctctcggtgatattttttcta

SEQ ID NO: 246543 - DNA, 25 bp, Homo sapien
ttcctctcggtgatattttttctac

SEQ ID NO: 246544 - DNA, 25 bp, Homo sapien
ctctcggtgatattttttctacgcc

SEQ ID NO: 246545 - DNA, 25 bp, Homo sapien
ctcggtgatattttttctacgccaa

SEQ ID NO: 246546 - DNA, 25 bp, Homo sapien
tcggtgatattttttctacgccaaa

SEQ ID NO: 246547 - DNA, 25 bp, Homo sapien
gtgatattttttctacgccaaaaca

SEQ ID NO: 246548 - DNA, 25 bp, Homo sapien
gatattttttctacgccaaaacaga

SEQ ID NO: 246549 - DNA, 25 bp, Homo sapien
ttctacgccaaaacagacgggaaag

SEQ ID NO: 246550 - DNA, 25 bp, Homo sapien
cagtccacgtgtcggtccgtgcgga

SEQ ID NO: 246551 - DNA, 25 bp, Homo sapien
ggaggagcccgttcgctcctcgctg

SEQ ID NO: 246552 - DNA, 25 bp, Homo sapien
ttcgctcctcgctggccgagggctg

SEQ ID NO: 246553 - DNA, 25 bp, Homo sapien
gggaccgcagcgtctcctcaccaga

SEQ ID NO: 246554 - DNA, 25 bp, Homo sapien
agactccctgtctgcacacgatgtc

SEQ ID NO: 246555 - DNA, 25 bp, Homo sapien
tgcattctcagatagcccctattct

SEQ ID NO: 246556 - DNA, 25 bp, Homo sapien
tcagatagcccctattctcagatgg

SEQ ID NO: 246557 - DNA, 25 bp, Homo sapien
gatagcccctattctcagatggcct

SEQ ID NO: 246558 - DNA, 25 bp, Homo sapien
ccctattctcagatggcctcaatga

SEQ ID NO: 246559 - DNA, 25 bp, Homo sapien
ttctcagatggcctcaatgaggaca

SEQ ID NO: 246560 - DNA, 25 bp, Homo sapien
gcgtgggacctgctactcggagagt

SEQ ID NO: 246561 - DNA, 25 bp, Homo sapien
cggcagggtggatgagttctaataa

SEQ ID NO: 246562 - DNA, 25 bp, Homo sapien
ctaataagggtagtttcctgtgaca

SEQ ID NO: 246563 - DNA, 25 bp, Homo sapien
tcctgtgacagtccggaatctggaa

SEQ ID NO: 246564 - DNA, 25 bp, Homo sapien
gaatctggaactaggcatcagccca

SEQ ID NO: 246565 - DNA, 25 bp, Homo sapien
taggcatcagcccaaatggctcctg

SEQ ID NO: 246566 - DNA, 25 bp, Homo sapien
atggctcctgcatgaaaagctgcgg

SEQ ID NO: 246567 - DNA, 25 bp, Homo sapien
aaagctgcggtggatctaagtggca

SEQ ID NO: 246568 - DNA, 25 bp, Homo sapien
gtggcagctaggagtcaaggcaact

SEQ ID NO: 246569 - DNA, 25 bp, Homo sapien
tcaaggcaactagcttcctccgaag

SEQ ID NO: 246570 - DNA, 25 bp, Homo sapien
gcttcctccgaagcgaggcaagaca

SEQ ID NO: 246571 - DNA, 25 bp, Homo sapien
aggaacggagactcggccgagcctc

SEQ ID NO: 246572 - DNA, 25 bp, Homo sapien
ggcgccatgtgttttaagttgcagc

SEQ ID NO: 246573 - DNA, 25 bp, Homo sapien
aagttgcagcgtcaaaaacatgaag

SEQ ID NO: 246574 - DNA, 25 bp, Homo sapien
attgctttagcaaatatttacccag

SEQ ID NO: 246575 - DNA, 25 bp, Homo sapien
aaatatttacccagtcctgactctg

SEQ ID NO: 246576 - DNA, 25 bp, Homo sapien
tgactctgcacatggcatcgttcta

SEQ ID NO: 246577 - DNA, 25 bp, Homo sapien
ggcatcgttctaggagcccaaagat

SEQ ID NO: 246578 - DNA, 25 bp, Homo sapien
gtttaataatcaagccctgtgaagg

SEQ ID NO: 246579 - DNA, 25 bp, Homo sapien
aggagtttatagcatctgtggattt

SEQ ID NO: 246580 - DNA, 25 bp, Homo sapien
attttggtacccacggaggtgctgg

SEQ ID NO: 246581 - DNA, 25 bp, Homo sapien
ggtacccacggaggtgctggaacca

SEQ ID NO: 246582 - DNA, 25 bp, Homo sapien
gcacgccaagatggctgtgtccaca

SEQ ID NO: 246583 - DNA, 25 bp, Homo sapien
gggcctaatctacattttgctccgg

SEQ ID NO: 246584 - DNA, 25 bp, Homo sapien
ggcctaatctacattttgctccgga

SEQ ID NO: 246585 - DNA, 25 bp, Homo sapien
attttgctccggatccaatgattta

SEQ ID NO: 246586 - DNA, 25 bp, Homo sapien
gctccggatccaatgatttaatttt

SEQ ID NO: 246587 - DNA, 25 bp, Homo sapien
aatccagtgattaaagtcatgcaag

SEQ ID NO: 246588 - DNA, 25 bp, Homo sapien
gtgattaaagtcatgcaaggagatg

SEQ ID NO: 246589 - DNA, 25 bp, Homo sapien
gggcttgctaaaagtcaggttgcag

SEQ ID NO: 246590 - DNA, 25 bp, Homo sapien
aaaagtcaggttgcagtttccattg

SEQ ID NO: 246591 - DNA, 25 bp, Homo sapien
gtcaggttgcagtttccattgcatt

SEQ ID NO: 246592 - DNA, 25 bp, Homo sapien
ggttgcagtttccattgcattcaag

SEQ ID NO: 246593 - DNA, 25 bp, Homo sapien
gcagtttccattgcattcaagaaaa

SEQ ID NO: 246594 - DNA, 25 bp, Homo sapien
tgtccaggccacttgctgtacctgg

SEQ ID NO: 246595 - DNA, 25 bp, Homo sapien
tgagtcctgcttgctgtgcccggct

SEQ ID NO: 246596 - DNA, 25 bp, Homo sapien
gagactgcagtgcttgtccattcac

SEQ ID NO: 246597 - DNA, 25 bp, Homo sapien
tgcagtgcttgtccattcaccatga

SEQ ID NO: 246598 - DNA, 25 bp, Homo sapien
gattaatccaaatgttccaactgtc

SEQ ID NO: 246599 - DNA, 25 bp, Homo sapien
gttccaactgtctaatgggagttcc

SEQ ID NO: 246600 - DNA, 25 bp, Homo sapien
actgtctaatgggagttccaacaag

SEQ ID NO: 246601 - DNA, 25 bp, Homo sapien
gagttccaacaagaagatatccagg

SEQ ID NO: 246602 - DNA, 25 bp, Homo sapien
aagatatccagggaggaaattcaca

SEQ ID NO: 246603 - DNA, 25 bp, Homo sapien
ccaaaggtcatgagttttcaggttg

SEQ ID NO: 246604 - DNA, 25 bp, Homo sapien
ggttgaaagaacacccaaccaagag

SEQ ID NO: 246605 - DNA, 25 bp, Homo sapien
atgctcattaaatatctgtggactg

SEQ ID NO: 246606 - DNA, 25 bp, Homo sapien
tctgtggactgacttattgattgac

SEQ ID NO: 246607 - DNA, 25 bp, Homo sapien
cttattgattgaccagccaagctgc

SEQ ID NO: 246608 - DNA, 25 bp, Homo sapien
ccatccatcctcatctataaggcta

SEQ ID NO: 246609 - DNA, 25 bp, Homo sapien
gttgggtatcatcaggtaagacatt

SEQ ID NO: 246610 - DNA, 25 bp, Homo sapien
aacatcatacagaaccagcccggag

SEQ ID NO: 246611 - DNA, 25 bp, Homo sapien
tatgggtctattgtcttcctaccac

SEQ ID NO: 246612 - DNA, 25 bp, Homo sapien
tttgcatcctctatggtcatcaaca

SEQ ID NO: 246613 - DNA, 25 bp, Homo sapien
tggtcatcaacattgtacttcacaa

SEQ ID NO: 246614 - DNA, 25 bp, Homo sapien
caccccgagtacaaagaatcttctt

SEQ ID NO: 246615 - DNA, 25 bp, Homo sapien
gaatcttctttaggtcatagactat

SEQ ID NO: 246616 - DNA, 25 bp, Homo sapien
taagatgctgcttaaccaatgttat

SEQ ID NO: 246617 - DNA, 25 bp, Homo sapien
aatgccatagcatcatatctccaaa

SEQ ID NO: 246618 - DNA, 25 bp, Homo sapien
atagcatcatatctccaaatacaag

SEQ ID NO: 246619 - DNA, 25 bp, Homo sapien
aaaacagagtatactgagctgttct

SEQ ID NO: 246620 - DNA, 25 bp, Homo sapien
attgcacagatgagcctgacagtcc

SEQ ID NO: 246621 - DNA, 25 bp, Homo sapien
gagcctgacagtccttcaatgtata

SEQ ID NO: 246622 - DNA, 25 bp, Homo sapien
cagtccttcaatgtataattttccc

SEQ ID NO: 246623 - DNA, 25 bp, Homo sapien
taattttcccccagcatctagtaat

SEQ ID NO: 246624 - DNA, 25 bp, Homo sapien
atttgcatttgtacatcacagggta

SEQ ID NO: 246625 - DNA, 25 bp, Homo sapien
ccattctgaggaagagtgttctgtt

SEQ ID NO: 246626 - DNA, 25 bp, Homo sapien
ctgttctctaagatgctgcttaacc

SEQ ID NO: 246627 - DNA, 25 bp, Homo sapien
tggcccctttccctgactgtcaagg

SEQ ID NO: 246628 - DNA, 25 bp, Homo sapien
ggcccctttccctgactgtcaagga

SEQ ID NO: 246629 - DNA, 25 bp, Homo sapien
ccctttccctgactgtcaaggacaa

SEQ ID NO: 246630 - DNA, 25 bp, Homo sapien
cctttccctgactgtcaaggacaac

SEQ ID NO: 246631 - DNA, 25 bp, Homo sapien
ctttccctgactgtcaaggacaact

SEQ ID NO: 246632 - DNA, 25 bp, Homo sapien
tttccctgactgtcaaggacaactg

SEQ ID NO: 246633 - DNA, 25 bp, Homo sapien
ttccctgactgtcaaggacaactga

SEQ ID NO: 246634 - DNA, 25 bp, Homo sapien
tccctgactgtcaaggacaactgac

SEQ ID NO: 246635 - DNA, 25 bp, Homo sapien
ccctgactgtcaaggacaactgact

SEQ ID NO: 246636 - DNA, 25 bp, Homo sapien
ctgactgtcaaggacaactgactcc

SEQ ID NO: 246637 - DNA, 25 bp, Homo sapien
tgactgtcaaggacaactgactccc

SEQ ID NO: 246638 - DNA, 25 bp, Homo sapien
aacagacccctgacaattattaaca

SEQ ID NO: 246639 - DNA, 25 bp, Homo sapien
tcaatctaatgtctgtctttcacat

SEQ ID NO: 246640 - DNA, 25 bp, Homo sapien
acatcccggagtttgagtgtctgcg

SEQ ID NO: 246641 - DNA, 25 bp, Homo sapien
agtgtctgcgggagaaccgtccctg

SEQ ID NO: 246642 - DNA, 25 bp, Homo sapien
agcggtctccgccagcgaggctttc

SEQ ID NO: 246643 - DNA, 25 bp, Homo sapien
ctgtctttcacatacttccaaacat

SEQ ID NO: 246644 - DNA, 25 bp, Homo sapien
tttcctcccggtcggtgttgacagt

SEQ ID NO: 246645 - DNA, 25 bp, Homo sapien
gtcggtgttgacagtgtggcatttc

SEQ ID NO: 246646 - DNA, 25 bp, Homo sapien
gacagtgtggcatttctgttatcta

SEQ ID NO: 246647 - DNA, 25 bp, Homo sapien
aattattttacctagtgcatacaac

SEQ ID NO: 246648 - DNA, 25 bp, Homo sapien
agtgcatacaactttcaaaaactgt

SEQ ID NO: 246649 - DNA, 25 bp, Homo sapien
tgagggccgcctcattttcgttggt

SEQ ID NO: 246650 - DNA, 25 bp, Homo sapien
tcattttcgttggtccaggccagga

SEQ ID NO: 246651 - DNA, 25 bp, Homo sapien
ccaggaggaactggcactttttccg

SEQ ID NO: 246652 - DNA, 25 bp, Homo sapien
ttccgggcccggtaaagatgatctc

SEQ ID NO: 246653 - DNA, 25 bp, Homo sapien
ccggtaaagatgatctcgctcttct

SEQ ID NO: 246654 - DNA, 25 bp, Homo sapien
tctagccacggcctgtttccgggca

SEQ ID NO: 246655 - DNA, 25 bp, Homo sapien
agtgctgccagcgtgtagcctttct

SEQ ID NO: 246656 - DNA, 25 bp, Homo sapien
agcgtgtagcctttctggttggtcg

SEQ ID NO: 246657 - DNA, 25 bp, Homo sapien
tagcctttctggttggtcgggccct

SEQ ID NO: 246658 - DNA, 25 bp, Homo sapien
caggatgcgggcgacctcgtgcata

SEQ ID NO: 246659 - DNA, 25 bp, Homo sapien
tgcatagcccctcgtgtgcccaggg

SEQ ID NO: 246660 - DNA, 25 bp, Homo sapien
gagtttgaattctcacagttgcccc

SEQ ID NO: 246661 - DNA, 25 bp, Homo sapien
acagttgcccctcaaagtggagttc

SEQ ID NO: 246662 - DNA, 25 bp, Homo sapien
ggctctgctgacatccaggacttgg

SEQ ID NO: 246663 - DNA, 25 bp, Homo sapien
gctgacatccaggacttggagaaat

SEQ ID NO: 246664 - DNA, 25 bp, Homo sapien
tggagaaatggctggctaaaattgc

SEQ ID NO: 246665 - DNA, 25 bp, Homo sapien
gctggctaaaattgcctgagaggca

SEQ ID NO: 246666 - DNA, 25 bp, Homo sapien
gagaggcagctctaaagcacaagac

SEQ ID NO: 246667 - DNA, 25 bp, Homo sapien
acaagacctggatgtgtgacacaca

SEQ ID NO: 246668 - DNA, 25 bp, Homo sapien
gtgtgacacacagttttggaaaaag

SEQ ID NO: 246669 - DNA, 25 bp, Homo sapien
aaaaggtctgtggtagtctggagtt

SEQ ID NO: 246670 - DNA, 25 bp, Homo sapien
gaaacatttctttgttctggaaaca

SEQ ID NO: 246671 - DNA, 25 bp, Homo sapien
tttgggaggtcctgtacagtgatgt

SEQ ID NO: 246672 - DNA, 25 bp, Homo sapien
gggcctgcttacagaagcattctgg

SEQ ID NO: 246673 - DNA, 25 bp, Homo sapien
aagcattctggccatgatttggtaa

SEQ ID NO: 246674 - DNA, 25 bp, Homo sapien
aagcagctagctgtgctgtgggatc

SEQ ID NO: 246675 - DNA, 25 bp, Homo sapien
tcttctgccccttgtcggtttatac

SEQ ID NO: 246676 - DNA, 25 bp, Homo sapien
tgtcggtttatactctccaaagccc

SEQ ID NO: 246677 - DNA, 25 bp, Homo sapien
aaagccctcaggctggaatgactaa

SEQ ID NO: 246678 - DNA, 25 bp, Homo sapien
gaatgactaagttgcctgaacagga

SEQ ID NO: 246679 - DNA, 25 bp, Homo sapien
aaagatggcggcctgccccatctat

SEQ ID NO: 246680 - DNA, 25 bp, Homo sapien
gccccatctattctctcagagttca

SEQ ID NO: 246681 - DNA, 25 bp, Homo sapien
gagttcatcttgtttgatggagctt

SEQ ID NO: 246682 - DNA, 25 bp, Homo sapien
gaaaacatgcacttcgagatctgcc

SEQ ID NO: 246683 - DNA, 25 bp, Homo sapien
agctacctcactggtgcctggaagc

SEQ ID NO: 246684 - DNA, 25 bp, Homo sapien
aagccggacacggagcatgcagtca

SEQ ID NO: 246685 - DNA, 25 bp, Homo sapien
gcatgcagtcattcggctcaaaaat

SEQ ID NO: 246686 - DNA, 25 bp, Homo sapien
aaatgaccaggctaactactcgctc

SEQ ID NO: 246687 - DNA, 25 bp, Homo sapien
acagatgacccgctcatcttcaagt

SEQ ID NO: 246688 - DNA, 25 bp, Homo sapien
tggacactgattaccagatgaccaa

SEQ ID NO: 246689 - DNA, 25 bp, Homo sapien
gaccaaacgggacatgggctttact

SEQ ID NO: 246690 - DNA, 25 bp, Homo sapien
atcaatgcggccaaatctagtttcc

SEQ ID NO: 246691 - DNA, 25 bp, Homo sapien
aaaagagggagcttctcgacctgct

SEQ ID NO: 246692 - DNA, 25 bp, Homo sapien
ctcgacctgctctataaagcctatg

SEQ ID NO: 246693 - DNA, 25 bp, Homo sapien
gaaggcctacctttccttagaagtg

SEQ ID NO: 246694 - DNA, 25 bp, Homo sapien
acggaagtgcggaacacctgctttc

SEQ ID NO: 246695 - DNA, 25 bp, Homo sapien
acggaccgcctataaaggagctcaa

SEQ ID NO: 246696 - DNA, 25 bp, Homo sapien
gctcaacctggcaggcaatcggatt

SEQ ID NO: 246697 - DNA, 25 bp, Homo sapien
aatcggattggcaccctggagttgg

SEQ ID NO: 246698 - DNA, 25 bp, Homo sapien
gagcatttgatggtctgtcacggtc

SEQ ID NO: 246699 - DNA, 25 bp, Homo sapien
gatggtctgtcacggtcgctgctaa

SEQ ID NO: 246700 - DNA, 25 bp, Homo sapien
ctgctaactcttcgcctgagcaaaa

SEQ ID NO: 246701 - DNA, 25 bp, Homo sapien
acccagcttcctgtaagagcattca

SEQ ID NO: 246702 - DNA, 25 bp, Homo sapien
agagcattcaagctacccaggctga

SEQ ID NO: 246703 - DNA, 25 bp, Homo sapien
tgacacaactggacctcaatcggaa

SEQ ID NO: 246704 - DNA, 25 bp, Homo sapien
acagggatatagatttcagctcaag

SEQ ID NO: 246705 - DNA, 25 bp, Homo sapien
tgaaaaattttccaggcaccgaagt

SEQ ID NO: 246706 - DNA, 25 bp, Homo sapien
ggcaccgaagttgtccacatgctaa

SEQ ID NO: 246707 - DNA, 25 bp, Homo sapien
tgtgggtttctagtccctgaaagtg

SEQ ID NO: 246708 - DNA, 25 bp, Homo sapien
ttctagtccctgaaagtgacactgg

SEQ ID NO: 246709 - DNA, 25 bp, Homo sapien
agtgacactgggtatgagcattggc

SEQ ID NO: 246710 - DNA, 25 bp, Homo sapien
gagcattggcagaacacatattcaa

SEQ ID NO: 246711 - DNA, 25 bp, Homo sapien
ttggcagaacacatattcaagcctc

SEQ ID NO: 246712 - DNA, 25 bp, Homo sapien
tattcaagcctcaaaaatcaatgtt

SEQ ID NO: 246713 - DNA, 25 bp, Homo sapien
agagctactgtaggaaagcagaatt

SEQ ID NO: 246714 - DNA, 25 bp, Homo sapien
ttagagtttttctgtatggctcaaa

SEQ ID NO: 246715 - DNA, 25 bp, Homo sapien
ggtggctgacgctcaggactatgac

SEQ ID NO: 246716 - DNA, 25 bp, Homo sapien
gacgctcaggactatgaccgcaggg

SEQ ID NO: 246717 - DNA, 25 bp, Homo sapien
cgcagggcagataagccgtggaccc

SEQ ID NO: 246718 - DNA, 25 bp, Homo sapien
gcagataagccgtggacccgcctca

SEQ ID NO: 246719 - DNA, 25 bp, Homo sapien
ctgcagacaaagctgccatccgaaa

SEQ ID NO: 246720 - DNA, 25 bp, Homo sapien
agacaaagctgccatccgaaaggag

SEQ ID NO: 246721 - DNA, 25 bp, Homo sapien
gctgccatccgaaaggagctcaatg

SEQ ID NO: 246722 - DNA, 25 bp, Homo sapien
ggagctcaatgaattcaaaagcact

SEQ ID NO: 246723 - DNA, 25 bp, Homo sapien
agcactgagatggaagttcatgaat

SEQ ID NO: 246724 - DNA, 25 bp, Homo sapien
agttcatgaattgagtagacactta

SEQ ID NO: 246725 - DNA, 25 bp, Homo sapien
tagacacttaacaaggtttcaccga

SEQ ID NO: 246726 - DNA, 25 bp, Homo sapien
tgtacagattgtgtctccttatgtt

SEQ ID NO: 246727 - DNA, 25 bp, Homo sapien
tccatcttagcttcccaaattgttg

SEQ ID NO: 246728 - DNA, 25 bp, Homo sapien
gagccagtgtgcttggcctgatttt

SEQ ID NO: 246729 - DNA, 25 bp, Homo sapien
gtttcattgtaagacgaggacttgc

SEQ ID NO: 246730 - DNA, 25 bp, Homo sapien
tcattgtaagacgaggacttgctat

SEQ ID NO: 246731 - DNA, 25 bp, Homo sapien
ttgtaagacgaggacttgctatgtt

SEQ ID NO: 246732 - DNA, 25 bp, Homo sapien
cagtttggtcttgaactcggtctca

SEQ ID NO: 246733 - DNA, 25 bp, Homo sapien
tgaactcggtctcaagtgattctcc

SEQ ID NO: 246734 - DNA, 25 bp, Homo sapien
ttcccaaagcgtttgggccggcaga

SEQ ID NO: 246735 - DNA, 25 bp, Homo sapien
cccaaagcgtttgggccggcagatg

SEQ ID NO: 246736 - DNA, 25 bp, Homo sapien
caaagcgtttgggccggcagatgtc

SEQ ID NO: 246737 - DNA, 25 bp, Homo sapien
ggaacaactgaagctaacacctgag

SEQ ID NO: 246738 - DNA, 25 bp, Homo sapien
aagttcgcctacgagtctctaaacg

SEQ ID NO: 246739 - DNA, 25 bp, Homo sapien
aagagttaggtacggctgatgacac

SEQ ID NO: 246740 - DNA, 25 bp, Homo sapien
gtcataaacgcacccaagttgagca

SEQ ID NO: 246741 - DNA, 25 bp, Homo sapien
gagcaagaactgtgttggcccgtgt

SEQ ID NO: 246742 - DNA, 25 bp, Homo sapien
gtgttggcccgtgtgtgagaaaaaa

SEQ ID NO: 246743 - DNA, 25 bp, Homo sapien
aaatagccacgtccagactgggaga

SEQ ID NO: 246744 - DNA, 25 bp, Homo sapien
ggagaatttactacttccaaagaca

SEQ ID NO: 246745 - DNA, 25 bp, Homo sapien
ggtctttctgactccgaaactaaca

SEQ ID NO: 246746 - DNA, 25 bp, Homo sapien
ctaacagatcttgactccagaaaag

SEQ ID NO: 246747 - DNA, 25 bp, Homo sapien
cagaaaagcgtcctgcctgtcattt

SEQ ID NO: 246748 - DNA, 25 bp, Homo sapien
caggctgacgacgagggtgattact

SEQ ID NO: 246749 - DNA, 25 bp, Homo sapien
ggctgacgacgagggtgattactac

SEQ ID NO: 246750 - DNA, 25 bp, Homo sapien
ctgacgacgagggtgattactactg

SEQ ID NO: 246751 - DNA, 25 bp, Homo sapien
gacgacgagggtgattactactgca

SEQ ID NO: 246752 - DNA, 25 bp, Homo sapien
gggtgattactactgcatctcatat

SEQ ID NO: 246753 - DNA, 25 bp, Homo sapien
gtgattactactgcatctcatatac

SEQ ID NO: 246754 - DNA, 25 bp, Homo sapien
gcatctcatatacaagtagcaaccc

SEQ ID NO: 246755 - DNA, 25 bp, Homo sapien
catatacaagtagcaaccctctcgt

SEQ ID NO: 246756 - DNA, 25 bp, Homo sapien
atatacaagtagcaaccctctcgtg

SEQ ID NO: 246757 - DNA, 25 bp, Homo sapien
tatacaagtagcaaccctctcgtgg

SEQ ID NO: 246758 - DNA, 25 bp, Homo sapien
tacaagtagcaaccctctcgtggtt

SEQ ID NO: 246759 - DNA, 25 bp, Homo sapien
atgaggcgccgttggctgatctata

SEQ ID NO: 246760 - DNA, 25 bp, Homo sapien
atgcgagcagatccacacattcatt

SEQ ID NO: 246761 - DNA, 25 bp, Homo sapien
attcattcatagaatctgaccacca

SEQ ID NO: 246762 - DNA, 25 bp, Homo sapien
ctgaccaccatagcagatttctgca

SEQ ID NO: 246763 - DNA, 25 bp, Homo sapien
gcagctgccacaacagtactcatga

SEQ ID NO: 246764 - DNA, 25 bp, Homo sapien
gtcaatgtcactgactgctttgcca

SEQ ID NO: 246765 - DNA, 25 bp, Homo sapien
tgactgctttgccagcacagggacc

SEQ ID NO: 246766 - DNA, 25 bp, Homo sapien
tgcccttctcaacacgacatataga

SEQ ID NO: 246767 - DNA, 25 bp, Homo sapien
ccaggtcgtgggtccctagaggaca

SEQ ID NO: 246768 - DNA, 25 bp, Homo sapien
tagaggacaccaccgatactgtgat

SEQ ID NO: 246769 - DNA, 25 bp, Homo sapien
tactgtgatgtgatgatgaggcgcc

SEQ ID NO: 246770 - DNA, 25 bp, Homo sapien
gtcaggccgcacaatggccgagtag

SEQ ID NO: 246771 - DNA, 25 bp, Homo sapien
agtgcggcatctatactccaagcga

SEQ ID NO: 246772 - DNA, 25 bp, Homo sapien
cggcatctatactccaagcgactag

SEQ ID NO: 246773 - DNA, 25 bp, Homo sapien
tctatactccaagcgactagaccgg

SEQ ID NO: 246774 - DNA, 25 bp, Homo sapien
caagcgactagaccggagtgtctcc

SEQ ID NO: 246775 - DNA, 25 bp, Homo sapien
actagaccggagtgtctcctaccag

SEQ ID NO: 246776 - DNA, 25 bp, Homo sapien
ggagtgtctcctaccagctgagccc

SEQ ID NO: 246777 - DNA, 25 bp, Homo sapien
tggctgacctgaagcgccagcgagc

SEQ ID NO: 246778 - DNA, 25 bp, Homo sapien
gaagcgccagcgagctgctgccaag

SEQ ID NO: 246779 - DNA, 25 bp, Homo sapien
gcccgagagccctgagacagctgag

SEQ ID NO: 246780 - DNA, 25 bp, Homo sapien
gagccctgagacagctgagcctggc

SEQ ID NO: 246781 - DNA, 25 bp, Homo sapien
ggtctctaagcacaaacgaacattc

SEQ ID NO: 246782 - DNA, 25 bp, Homo sapien
taatgaaatgagtggcaggcagcgt

SEQ ID NO: 246783 - DNA, 25 bp, Homo sapien
ggcagcgtgtgcagagcaccagcaa

SEQ ID NO: 246784 - DNA, 25 bp, Homo sapien
gcaaaggctcagagggatgcccaca

SEQ ID NO: 246785 - DNA, 25 bp, Homo sapien
caccgcaaccgtgcacagaggagga

SEQ ID NO: 246786 - DNA, 25 bp, Homo sapien
ggaggagaatgctccctacaggtga

SEQ ID NO: 246787 - DNA, 25 bp, Homo sapien
gaatgctccctacaggtgaaaacta

SEQ ID NO: 246788 - DNA, 25 bp, Homo sapien
catctgaggtggaatgactgtggct

SEQ ID NO: 246789 - DNA, 25 bp, Homo sapien
gaatgactgtggctctgtgccatct

SEQ ID NO: 246790 - DNA, 25 bp, Homo sapien
ctctgtgccatctcgaaatctactg

SEQ ID NO: 246791 - DNA, 25 bp, Homo sapien
gaaatctactggtctctaagcacaa

SEQ ID NO: 246792 - DNA, 25 bp, Homo sapien
gtcttcattgtagcagcaatgccat

SEQ ID NO: 246793 - DNA, 25 bp, Homo sapien
gcaatgccattagatttgttcctga

SEQ ID NO: 246794 - DNA, 25 bp, Homo sapien
gatttgttcctgatcttgaagatat

SEQ ID NO: 246795 - DNA, 25 bp, Homo sapien
gcagcaaggcatttggattcagtcc

SEQ ID NO: 246796 - DNA, 25 bp, Homo sapien
tggattcagtcctcagtgatcacac

SEQ ID NO: 246797 - DNA, 25 bp, Homo sapien
atgcttgtagacgtttttgctccag

SEQ ID NO: 246798 - DNA, 25 bp, Homo sapien
tttgctccagaatttcgaaggccaa

SEQ ID NO: 246799 - DNA, 25 bp, Homo sapien
gaatatacatctccgaaatttctat

SEQ ID NO: 246800 - DNA, 25 bp, Homo sapien
tttctatataattgttccccctctg

SEQ ID NO: 246801 - DNA, 25 bp, Homo sapien
ccctctgaccctcaactttgtagag

SEQ ID NO: 246802 - DNA, 25 bp, Homo sapien
gtagagcattccattagttgcaagg

SEQ ID NO: 246803 - DNA, 25 bp, Homo sapien
agacctcccaagaacagacctgcag

SEQ ID NO: 246804 - DNA, 25 bp, Homo sapien
agacctgcaggcagagcaggctcca

SEQ ID NO: 246805 - DNA, 25 bp, Homo sapien
agagcaggctccagggcccaccatg

SEQ ID NO: 246806 - DNA, 25 bp, Homo sapien
tcggccctgcctgagagaaacagca

SEQ ID NO: 246807 - DNA, 25 bp, Homo sapien
acagcacaaactatttcgtccaacc

SEQ ID NO: 246808 - DNA, 25 bp, Homo sapien
aaactatttcgtccaaccctgctgc

SEQ ID NO: 246809 - DNA, 25 bp, Homo sapien
tcttctgactccctggagacagcta

SEQ ID NO: 246810 - DNA, 25 bp, Homo sapien
actccctggagacagctacttttta

SEQ ID NO: 246811 - DNA, 25 bp, Homo sapien
gacagctactttttaggagtttcat

SEQ ID NO: 246812 - DNA, 25 bp, Homo sapien
ttcttcaagagagctttcttccact

SEQ ID NO: 246813 - DNA, 25 bp, Homo sapien
tttcttccactgacataaaatgcca

SEQ ID NO: 246814 - DNA, 25 bp, Homo sapien
gtgtggtgattgttcaggtcgaatc

SEQ ID NO: 246815 - DNA, 25 bp, Homo sapien
tgttcaggtcgaatctgttgtatcc

SEQ ID NO: 246816 - DNA, 25 bp, Homo sapien
atccagtacagctttaggtcttcag

SEQ ID NO: 246817 - DNA, 25 bp, Homo sapien
tcagctgcccttctggcgagtacat

SEQ ID NO: 246818 - DNA, 25 bp, Homo sapien
tggcgagtacatgcacaggattgta

SEQ ID NO: 246819 - DNA, 25 bp, Homo sapien
atgcagtcatatttccagtctgcct

SEQ ID NO: 246820 - DNA, 25 bp, Homo sapien
tccagtctgcctctatgatgatgtt

SEQ ID NO: 246821 - DNA, 25 bp, Homo sapien
taaattattgctgtttagctgtgaa

SEQ ID NO: 246822 - DNA, 25 bp, Homo sapien
gaacaagggatgtaccactggagga

SEQ ID NO: 246823 - DNA, 25 bp, Homo sapien
gagtatccttttgtacacattttga

SEQ ID NO: 246824 - DNA, 25 bp, Homo sapien
tgcttcttctgtagtgatagaacaa

SEQ ID NO: 246825 - DNA, 25 bp, Homo sapien
agctttgctgtgcacacccgcagag

SEQ ID NO: 246826 - DNA, 25 bp, Homo sapien
gctttgctgtgcacacccgcagaga

SEQ ID NO: 246827 - DNA, 25 bp, Homo sapien
ctttgctgtgcacacccgcagagag

SEQ ID NO: 246828 - DNA, 25 bp, Homo sapien
tttgctgtgcacacccgcagagaga

SEQ ID NO: 246829 - DNA, 25 bp, Homo sapien
ttgctgtgcacacccgcagagagaa

SEQ ID NO: 246830 - DNA, 25 bp, Homo sapien
tgtgcacacccgcagagagaaccct

SEQ ID NO: 246831 - DNA, 25 bp, Homo sapien
gtgcacacccgcagagagaaccctg

SEQ ID NO: 246832 - DNA, 25 bp, Homo sapien
agagagaaccctgccgagccaggcg

SEQ ID NO: 246833 - DNA, 25 bp, Homo sapien
agaaccctgccgagccaggcgcggt

SEQ ID NO: 246834 - DNA, 25 bp, Homo sapien
aggccggggatccatctctgctgag

SEQ ID NO: 246835 - DNA, 25 bp, Homo sapien
gatcatctgcctggcctctcaccac

SEQ ID NO: 246836 - DNA, 25 bp, Homo sapien
agaattatcctcaacatagcctttt

SEQ ID NO: 246837 - DNA, 25 bp, Homo sapien
tcaacatagccttttgacgctgtaa

SEQ ID NO: 246838 - DNA, 25 bp, Homo sapien
agccttttgacgctgtaaatcttga

SEQ ID NO: 246839 - DNA, 25 bp, Homo sapien
gacgctgtaaatcttgagtattcat

SEQ ID NO: 246840 - DNA, 25 bp, Homo sapien
tacccttttctgatctcctggaaac

SEQ ID NO: 246841 - DNA, 25 bp, Homo sapien
attgcacttctcttcccgaggagtg

SEQ ID NO: 246842 - DNA, 25 bp, Homo sapien
gggactgggagaccaaaaatttctg

SEQ ID NO: 246843 - DNA, 25 bp, Homo sapien
aaaatttctgatcccatttctgatg

SEQ ID NO: 246844 - DNA, 25 bp, Homo sapien
catttctgatggatgtgtcacacct

SEQ ID NO: 246845 - DNA, 25 bp, Homo sapien
atgtgtcacaccttttctgtcaaaa

SEQ ID NO: 246846 - DNA, 25 bp, Homo sapien
gtcacaccttttctgtcaaaataaa

SEQ ID NO: 246847 - DNA, 25 bp, Homo sapien
gagcttccagattgcatagccattt

SEQ ID NO: 246848 - DNA, 25 bp, Homo sapien
ccagattgcatagccatttccttga

SEQ ID NO: 246849 - DNA, 25 bp, Homo sapien
gccatttccttgactactgagtaaa

SEQ ID NO: 246850 - DNA, 25 bp, Homo sapien
gactactgagtaaaggccaaggcta

SEQ ID NO: 246851 - DNA, 25 bp, Homo sapien
taaaggccaaggctaagatttagta

SEQ ID NO: 246852 - DNA, 25 bp, Homo sapien
aagatttagtaagcctagccctgaa

SEQ ID NO: 246853 - DNA, 25 bp, Homo sapien
gtaagcctagccctgaagcaagcaa

SEQ ID NO: 246854 - DNA, 25 bp, Homo sapien
tatggcagtgtaatgcaggtcattt

SEQ ID NO: 246855 - DNA, 25 bp, Homo sapien
gttgggcacaaagaaaatttagatc

SEQ ID NO: 246856 - DNA, 25 bp, Homo sapien
catgtcaaacacaggttagagagac

SEQ ID NO: 246857 - DNA, 25 bp, Homo sapien
gttagagagactgagcttccagatt

SEQ ID NO: 246858 - DNA, 25 bp, Homo sapien
ttgggtacactccttgcccagggtt

SEQ ID NO: 246859 - DNA, 25 bp, Homo sapien
gttccacagccccttaaaggcaggg

SEQ ID NO: 246860 - DNA, 25 bp, Homo sapien
gtggctgcagggtctgcaagatcat

SEQ ID NO: 246861 - DNA, 25 bp, Homo sapien
gccccttaaaggcagggtctttctg

SEQ ID NO: 246862 - DNA, 25 bp, Homo sapien
gtgtgggaacagagcacaggccctc

SEQ ID NO: 246863 - DNA, 25 bp, Homo sapien
gggtctgcaagatcatcagggcccc

SEQ ID NO: 246864 - DNA, 25 bp, Homo sapien
agagcccacgagatctcactttctc

SEQ ID NO: 246865 - DNA, 25 bp, Homo sapien
atgtgacacttgcagaggggacccc

SEQ ID NO: 246866 - DNA, 25 bp, Homo sapien
gggccacgctggttacttgggtaca

SEQ ID NO: 246867 - DNA, 25 bp, Homo sapien
acgctggttacttgggtacactcct

SEQ ID NO: 246868 - DNA, 25 bp, Homo sapien
tggttacttgggtacactccttgcc

SEQ ID NO: 246869 - DNA, 25 bp, Homo sapien
accaggtttttccagaattagtctg

SEQ ID NO: 246870 - DNA, 25 bp, Homo sapien
cagaattagtctggatcagtgccta

SEQ ID NO: 246871 - DNA, 25 bp, Homo sapien
agctgttattaattctccacacatg

SEQ ID NO: 246872 - DNA, 25 bp, Homo sapien
cacacatgagtctggctaactgggc

SEQ ID NO: 246873 - DNA, 25 bp, Homo sapien
taactgggccagctctcatgtttta

SEQ ID NO: 246874 - DNA, 25 bp, Homo sapien
agctctcatgttttactcctgtctg

SEQ ID NO: 246875 - DNA, 25 bp, Homo sapien
gttttactcctgtctggctacaaat

SEQ ID NO: 246876 - DNA, 25 bp, Homo sapien
gtctggctacaaatagcactgtgca

SEQ ID NO: 246877 - DNA, 25 bp, Homo sapien
agcactgtgcatagtagccctgttt

SEQ ID NO: 246878 - DNA, 25 bp, Homo sapien
agtagccctgtttccccatggtgtt

SEQ ID NO: 246879 - DNA, 25 bp, Homo sapien
actggaattctaataatcctgttgt

SEQ ID NO: 246880 - DNA, 25 bp, Homo sapien
tcctttaaaaggcatccgtaggctg

SEQ ID NO: 246881 - DNA, 25 bp, Homo sapien
cctttaaaaggcatccgtaggctgc

SEQ ID NO: 246882 - DNA, 25 bp, Homo sapien
ctttaaaaggcatccgtaggctgcg

SEQ ID NO: 246883 - DNA, 25 bp, Homo sapien
tttaaaaggcatccgtaggctgcgt

SEQ ID NO: 246884 - DNA, 25 bp, Homo sapien
taaaaggcatccgtaggctgcgtgc

SEQ ID NO: 246885 - DNA, 25 bp, Homo sapien
aaaaggcatccgtaggctgcgtgca

SEQ ID NO: 246886 - DNA, 25 bp, Homo sapien
aaaggcatccgtaggctgcgtgcag

SEQ ID NO: 246887 - DNA, 25 bp, Homo sapien
aaggcatccgtaggctgcgtgcagt

SEQ ID NO: 246888 - DNA, 25 bp, Homo sapien
ggcatccgtaggctgcgtgcagtgg

SEQ ID NO: 246889 - DNA, 25 bp, Homo sapien
catccgtaggctgcgtgcagtggct

SEQ ID NO: 246890 - DNA, 25 bp, Homo sapien
gacattttcttagggggtctataag

SEQ ID NO: 246891 - DNA, 25 bp, Homo sapien
aaggccattgagtgggtgttccaaa

SEQ ID NO: 246892 - DNA, 25 bp, Homo sapien
tgggtgttccaaagggcagcacaga

SEQ ID NO: 246893 - DNA, 25 bp, Homo sapien
gggcagcacagaatggagtttagtt

SEQ ID NO: 246894 - DNA, 25 bp, Homo sapien
gggacacactacctgggctcaagtc

SEQ ID NO: 246895 - DNA, 25 bp, Homo sapien
aaatgctttatacatgagactgatc

SEQ ID NO: 246896 - DNA, 25 bp, Homo sapien
agctgtgccacttgagcaagttgct

SEQ ID NO: 246897 - DNA, 25 bp, Homo sapien
gagactgatcttaccatcttcaata

SEQ ID NO: 246898 - DNA, 25 bp, Homo sapien
accatcttcaatatcctgtctggaa

SEQ ID NO: 246899 - DNA, 25 bp, Homo sapien
gaaagccttcatttgtgagtgctgt

SEQ ID NO: 246900 - DNA, 25 bp, Homo sapien
gagtgctgttgagatcacatgtcct

SEQ ID NO: 246901 - DNA, 25 bp, Homo sapien
agatcacatgtcctcccaagtagga

SEQ ID NO: 246902 - DNA, 25 bp, Homo sapien
gacagaatcatagccttcagggaag

SEQ ID NO: 246903 - DNA, 25 bp, Homo sapien
gccttcagggaagaggtatatgcaa

SEQ ID NO: 246904 - DNA, 25 bp, Homo sapien
gtatatgcaatgttctctccttcca

SEQ ID NO: 246905 - DNA, 25 bp, Homo sapien
ttctctccttccaaagattacctag

SEQ ID NO: 246906 - DNA, 25 bp, Homo sapien
ttacctagatagagaactgttcata

SEQ ID NO: 246907 - DNA, 25 bp, Homo sapien
gaaatatcttggtactgtctacatt

SEQ ID NO: 246908 - DNA, 25 bp, Homo sapien
ggtactgtctacattactcttgaga

SEQ ID NO: 246909 - DNA, 25 bp, Homo sapien
atttcttacgtctgaaatgagtcag

SEQ ID NO: 246910 - DNA, 25 bp, Homo sapien
gtctgaaatgagtcagttgtttcta

SEQ ID NO: 246911 - DNA, 25 bp, Homo sapien
agtatatactgaacatccactgtat

SEQ ID NO: 246912 - DNA, 25 bp, Homo sapien
gatcgagacagaatcatagccttca

SEQ ID NO: 246913 - DNA, 25 bp, Homo sapien
tggcagaaatactccaggctcctac

SEQ ID NO: 246914 - DNA, 25 bp, Homo sapien
taccccaaagcacatgtcagccttg

SEQ ID NO: 246915 - DNA, 25 bp, Homo sapien
gtcagccttgctgctggagcacgaa

SEQ ID NO: 246916 - DNA, 25 bp, Homo sapien
gctgctggagcacgaagacaatgta

SEQ ID NO: 246917 - DNA, 25 bp, Homo sapien
ggaggagttgtgagaccctgaccct

SEQ ID NO: 246918 - DNA, 25 bp, Homo sapien
tgaccctgagtccttacttgaaagc

SEQ ID NO: 246919 - DNA, 25 bp, Homo sapien
gtccttacttgaaagctgctgctgg

SEQ ID NO: 246920 - DNA, 25 bp, Homo sapien
tcttttggactcttatttcttgccc

SEQ ID NO: 246921 - DNA, 25 bp, Homo sapien
gcccttttccttattaggcaagcag

SEQ ID NO: 246922 - DNA, 25 bp, Homo sapien
atgtcatcatagtaggagctcatgg

SEQ ID NO: 246923 - DNA, 25 bp, Homo sapien
aagtcagtggcttgatgcttctgtt

SEQ ID NO: 246924 - DNA, 25 bp, Homo sapien
ggtttatgtaagtctctaggattga

SEQ ID NO: 246925 - DNA, 25 bp, Homo sapien
agggctttagccttcacaaacttct

SEQ ID NO: 246926 - DNA, 25 bp, Homo sapien
ccttcacaaacttctcactgttgat

SEQ ID NO: 246927 - DNA, 25 bp, Homo sapien
aacttctcactgttgatgtcaatac

SEQ ID NO: 246928 - DNA, 25 bp, Homo sapien
gtcaatacctatgattctggaagct

SEQ ID NO: 246929 - DNA, 25 bp, Homo sapien
ctatgattctggaagctcctgctgc

SEQ ID NO: 246930 - DNA, 25 bp, Homo sapien
gctttacaacccattacagcagaaa

SEQ ID NO: 246931 - DNA, 25 bp, Homo sapien
ggtgaccttggcattgttgattgca

SEQ ID NO: 246932 - DNA, 25 bp, Homo sapien
tggcattgttgattgcagccccata

SEQ ID NO: 246933 - DNA, 25 bp, Homo sapien
tgattgcagccccatagccagttga

SEQ ID NO: 246934 - DNA, 25 bp, Homo sapien
gattgatatctgacaccacagtgta

SEQ ID NO: 246935 - DNA, 25 bp, Homo sapien
gaatttcactcccaccttgttgctg

SEQ ID NO: 246936 - DNA, 25 bp, Homo sapien
gggtaccttcttcagggtacatcta

SEQ ID NO: 246937 - DNA, 25 bp, Homo sapien
tcagggtacatctaaacacagtggc

SEQ ID NO: 246938 - DNA, 25 bp, Homo sapien
aacacagtggccttatacagaaatg

SEQ ID NO: 246939 - DNA, 25 bp, Homo sapien
attatctccagctgtaatgtcctac

SEQ ID NO: 246940 - DNA, 25 bp, Homo sapien
aatgttgttcaacccacacagtgct

SEQ ID NO: 246941 - DNA, 25 bp, Homo sapien
taaaattcagacttcttgtttccct

SEQ ID NO: 246942 - DNA, 25 bp, Homo sapien
gtaatgtcctaccatataatccaga

SEQ ID NO: 246943 - DNA, 25 bp, Homo sapien
ataatccagaggttgcatagaagca

SEQ ID NO: 246944 - DNA, 25 bp, Homo sapien
catagaagcagagttgtcacagtct

SEQ ID NO: 246945 - DNA, 25 bp, Homo sapien
gtcacagtctctgtagcacgtttgt

SEQ ID NO: 246946 - DNA, 25 bp, Homo sapien
attaagatggccacgctgaacctct

SEQ ID NO: 246947 - DNA, 25 bp, Homo sapien
tgaacctcttccagatcgtgagcaa

SEQ ID NO: 246948 - DNA, 25 bp, Homo sapien
agatcgtgagcaagcacctgaagga

SEQ ID NO: 246949 - DNA, 25 bp, Homo sapien
tggaggacacccacaagcagctgga

SEQ ID NO: 246950 - DNA, 25 bp, Homo sapien
atccagcaatttatccaagaccggt

SEQ ID NO: 246951 - DNA, 25 bp, Homo sapien
aagaccggtcggacatctgggcaga

SEQ ID NO: 246952 - DNA, 25 bp, Homo sapien
gaacaacagcgagtccggatttaag

SEQ ID NO: 246953 - DNA, 25 bp, Homo sapien
gaggcagccttgttccagaatgtcc

SEQ ID NO: 246954 - DNA, 25 bp, Homo sapien
gaactccgaggaatctcgctgggcg

SEQ ID NO: 246955 - DNA, 25 bp, Homo sapien
tgggcgcacatccagaacaccgcag

SEQ ID NO: 246956 - DNA, 25 bp, Homo sapien
gcagccaagaagaccctcctgcttg

SEQ ID NO: 246957 - DNA, 25 bp, Homo sapien
tagaccttcttccttatctacactt

SEQ ID NO: 246958 - DNA, 25 bp, Homo sapien
acttcctctccaacatgaatcttga

SEQ ID NO: 246959 - DNA, 25 bp, Homo sapien
catgaatcttgatggctctgcacaa

SEQ ID NO: 246960 - DNA, 25 bp, Homo sapien
acagctgttgtccatgatagagaag

SEQ ID NO: 246961 - DNA, 25 bp, Homo sapien
gaagtggtcattttctaccacaagg

SEQ ID NO: 246962 - DNA, 25 bp, Homo sapien
accacaagggagaatatcatgctat

SEQ ID NO: 246963 - DNA, 25 bp, Homo sapien
catgctatggatattcgctgttacc

SEQ ID NO: 246964 - DNA, 25 bp, Homo sapien
atattcgctgttaccactcaggagg

SEQ ID NO: 246965 - DNA, 25 bp, Homo sapien
gttaccactcaggaggacctttaca

SEQ ID NO: 246966 - DNA, 25 bp, Homo sapien
ggaggacctttacatttgggagata

SEQ ID NO: 246967 - DNA, 25 bp, Homo sapien
ggaattgtcttagaccttcttcctt

SEQ ID NO: 246968 - DNA, 25 bp, Homo sapien
cgttttcttccggagcacacaaatc

SEQ ID NO: 246969 - DNA, 25 bp, Homo sapien
ttgggcgtcccctgttctcaggctg

SEQ ID NO: 246970 - DNA, 25 bp, Homo sapien
gttctcaggctgccatcgtgaggaa

SEQ ID NO: 246971 - DNA, 25 bp, Homo sapien
aaggatgaagagatgccctccagaa

SEQ ID NO: 246972 - DNA, 25 bp, Homo sapien
tgccctccagaaggtgcatactttt

SEQ ID NO: 246973 - DNA, 25 bp, Homo sapien
gaggaccccctagagagagcaatgt

SEQ ID NO: 246974 - DNA, 25 bp, Homo sapien
tttaaaggaacccatctgatacagt

SEQ ID NO: 246975 - DNA, 25 bp, Homo sapien
ggaacccatctgatacagtagaatt

SEQ ID NO: 246976 - DNA, 25 bp, Homo sapien
gggacagaccataagactgtgcaac

SEQ ID NO: 246977 - DNA, 25 bp, Homo sapien
agactgtgcaacatttctccttttc

SEQ ID NO: 246978 - DNA, 25 bp, Homo sapien
tgccttttcgccctctttcagaggc

SEQ ID NO: 246979 - DNA, 25 bp, Homo sapien
atcttggccccaatcttggcaggga

SEQ ID NO: 246980 - DNA, 25 bp, Homo sapien
cttggccccaatcttggcagggaga

SEQ ID NO: 246981 - DNA, 25 bp, Homo sapien
ttggccccaatcttggcagggagag

SEQ ID NO: 246982 - DNA, 25 bp, Homo sapien
aacgttctcaactgtatttgatttc

SEQ ID NO: 246983 - DNA, 25 bp, Homo sapien
gttctcaactgtatttgatttctcc

SEQ ID NO: 246984 - DNA, 25 bp, Homo sapien
ctcaactgtatttgatttctcctca

SEQ ID NO: 246985 - DNA, 25 bp, Homo sapien
gatttctcctcagccagagggggta

SEQ ID NO: 246986 - DNA, 25 bp, Homo sapien
gggtaaggtggccttcccagaagca

SEQ ID NO: 246987 - DNA, 25 bp, Homo sapien
tcccagaagcacaggtgggccgcgt

SEQ ID NO: 246988 - DNA, 25 bp, Homo sapien
agaagcacaggtgggccgcgtgtca

SEQ ID NO: 246989 - DNA, 25 bp, Homo sapien
tgggccgcgtgtcagaggccctgga

SEQ ID NO: 246990 - DNA, 25 bp, Homo sapien
cttatggcccatcttctaatccata

SEQ ID NO: 246991 - DNA, 25 bp, Homo sapien
gcccatcttctaatccatactggag

SEQ ID NO: 246992 - DNA, 25 bp, Homo sapien
attatacctaaccaaccatcagaga

SEQ ID NO: 246993 - DNA, 25 bp, Homo sapien
ggcaaggtcttcaatcaaaatccac

SEQ ID NO: 246994 - DNA, 25 bp, Homo sapien
ttcaatcaaaatccacacctttcac

SEQ ID NO: 246995 - DNA, 25 bp, Homo sapien
ccacacctttcacgacatcggaaaa

SEQ ID NO: 246996 - DNA, 25 bp, Homo sapien
gctggagagaattcactgcgtacct

SEQ ID NO: 246997 - DNA, 25 bp, Homo sapien
gaattcactgcgtaccttacagatg

SEQ ID NO: 246998 - DNA, 25 bp, Homo sapien
tgcgtaccttacagatggaatgaat

SEQ ID NO: 246999 - DNA, 25 bp, Homo sapien
tagaattcacacctagcacaacatt

SEQ ID NO: 247000 - DNA, 25 bp, Homo sapien
gcacaacattggaggactcaggaga

SEQ ID NO: 247001 - DNA, 25 bp, Homo sapien
tgttgcccaggcttaggagcaggat

SEQ ID NO: 247002 - DNA, 25 bp, Homo sapien
gagtatacatcgtgttgctccagat

SEQ ID NO: 247003 - DNA, 25 bp, Homo sapien
atacatcgtgttgctccagatggta

SEQ ID NO: 247004 - DNA, 25 bp, Homo sapien
atcgtgttgctccagatggtaaaac

SEQ ID NO: 247005 - DNA, 25 bp, Homo sapien
ttactaaaataaagtttcagcacgt

SEQ ID NO: 247006 - DNA, 25 bp, Homo sapien
gtttcagcacgtaaagtaaagcact

SEQ ID NO: 247007 - DNA, 25 bp, Homo sapien
cttggccattttagacactaaccat

SEQ ID NO: 247008 - DNA, 25 bp, Homo sapien
ttttagacactaaccatctggagca

SEQ ID NO: 247009 - DNA, 25 bp, Homo sapien
gacactaaccatctggagcaaccat

SEQ ID NO: 247010 - DNA, 25 bp, Homo sapien
atctggagcaaccatgtaactcttg

SEQ ID NO: 247011 - DNA, 25 bp, Homo sapien
tgctcttttttccagaagtgtaaaa

SEQ ID NO: 247012 - DNA, 25 bp, Homo sapien
tgaccgtggagttggcgtactgcag

SEQ ID NO: 247013 - DNA, 25 bp, Homo sapien
gtactgcaggaagccgaactcgtct

SEQ ID NO: 247014 - DNA, 25 bp, Homo sapien
aggaagccgaactcgtctcgctggc

SEQ ID NO: 247015 - DNA, 25 bp, Homo sapien
ggccgtccgggcacagcgattgcat

SEQ ID NO: 247016 - DNA, 25 bp, Homo sapien
acagcgattgcatgacaggcaggat

SEQ ID NO: 247017 - DNA, 25 bp, Homo sapien
acttccttcacggagatggtgggct

SEQ ID NO: 247018 - DNA, 25 bp, Homo sapien
agatggtgggcttcttctgtcgcag

SEQ ID NO: 247019 - DNA, 25 bp, Homo sapien
tgtcgcagccccagcaggataaaga

SEQ ID NO: 247020 - DNA, 25 bp, Homo sapien
acgggctccggcgtttgagcgtcac

SEQ ID NO: 247021 - DNA, 25 bp, Homo sapien
gtttgagcgtcacgttcttccagag

SEQ ID NO: 247022 - DNA, 25 bp, Homo sapien
gcgtcacgttcttccagagcagcag

SEQ ID NO: 247023 - DNA, 25 bp, Homo sapien
caaggcacccgtcactcagcgagaa

SEQ ID NO: 247024 - DNA, 25 bp, Homo sapien
gaaaggtgccaattcagatggctga

SEQ ID NO: 247025 - DNA, 25 bp, Homo sapien
agatggctgagctacttcgcctggg

SEQ ID NO: 247026 - DNA, 25 bp, Homo sapien
gacctgtatcaccacagggtcacag

SEQ ID NO: 247027 - DNA, 25 bp, Homo sapien
acagaaatggaaccttctccgtcac

SEQ ID NO: 247028 - DNA, 25 bp, Homo sapien
acacctcctgatggcagtcagctgt

SEQ ID NO: 247029 - DNA, 25 bp, Homo sapien
tggcagtcagctgtgacccgctgaa

SEQ ID NO: 247030 - DNA, 25 bp, Homo sapien
gacccgctgaatccaggacatcatg

SEQ ID NO: 247031 - DNA, 25 bp, Homo sapien
ggacatcatgcattccagtttcatt

SEQ ID NO: 247032 - DNA, 25 bp, Homo sapien
tgcattccagtttcatttgcgagaa

SEQ ID NO: 247033 - DNA, 25 bp, Homo sapien
catttgcgagaacatttccaggtcc

SEQ ID NO: 247034 - DNA, 25 bp, Homo sapien
tttagaacactggaaagcaagtata

SEQ ID NO: 247035 - DNA, 25 bp, Homo sapien
atagggcatcaaattttacaaagac

SEQ ID NO: 247036 - DNA, 25 bp, Homo sapien
ttttacaaagactcctaaggctata

SEQ ID NO: 247037 - DNA, 25 bp, Homo sapien
agtcttgtatattcatgtagctcat

SEQ ID NO: 247038 - DNA, 25 bp, Homo sapien
gaaacgaacaaatcgctggttagaa

SEQ ID NO: 247039 - DNA, 25 bp, Homo sapien
gggatttgagtacatatgggcttaa

SEQ ID NO: 247040 - DNA, 25 bp, Homo sapien
atatgggcttaagagtgttctgtca

SEQ ID NO: 247041 - DNA, 25 bp, Homo sapien
ggcttaagagtgttctgtcatgatt

SEQ ID NO: 247042 - DNA, 25 bp, Homo sapien
ctgtcatgattgtagtggtgaaaac

SEQ ID NO: 247043 - DNA, 25 bp, Homo sapien
cctatattgggcattgtcaagactt

SEQ ID NO: 247044 - DNA, 25 bp, Homo sapien
gtcaagacttaaatttagaacactg

SEQ ID NO: 247045 - DNA, 25 bp, Homo sapien
tcagtataatatgtgtccagaccct

SEQ ID NO: 247046 - DNA, 25 bp, Homo sapien
tccagaccctgttagccttagtaaa

SEQ ID NO: 247047 - DNA, 25 bp, Homo sapien
tgttagccttagtaaacctagtgtt

SEQ ID NO: 247048 - DNA, 25 bp, Homo sapien
aacaagacacggaagctttcacttt

SEQ ID NO: 247049 - DNA, 25 bp, Homo sapien
ggaagctttcactttagaacatttt

SEQ ID NO: 247050 - DNA, 25 bp, Homo sapien
agacctgttcttggttggattccta

SEQ ID NO: 247051 - DNA, 25 bp, Homo sapien
tggagtgaccaaacctcagaccaac

SEQ ID NO: 247052 - DNA, 25 bp, Homo sapien
aacctgctggagcttaagaactctt

SEQ ID NO: 247053 - DNA, 25 bp, Homo sapien
aactggtgcacaaaagcgtttccat

SEQ ID NO: 247054 - DNA, 25 bp, Homo sapien
aagcgtttccataaatcaattctag

SEQ ID NO: 247055 - DNA, 25 bp, Homo sapien
agaagaccataaagacctcagggat

SEQ ID NO: 247056 - DNA, 25 bp, Homo sapien
tactccaggccaccagctggtgtca

SEQ ID NO: 247057 - DNA, 25 bp, Homo sapien
tccaggccaccagctggtgtcagat

SEQ ID NO: 247058 - DNA, 25 bp, Homo sapien
ccaggccaccagctggtgtcagatt

SEQ ID NO: 247059 - DNA, 25 bp, Homo sapien
tcagattgggccaccgggagagaac

SEQ ID NO: 247060 - DNA, 25 bp, Homo sapien
ccaccgggagagaacaggcctagga

SEQ ID NO: 247061 - DNA, 25 bp, Homo sapien
ctccccagaggtctccaggaggaac

SEQ ID NO: 247062 - DNA, 25 bp, Homo sapien
ccccagaggtctccaggaggaacct

SEQ ID NO: 247063 - DNA, 25 bp, Homo sapien
gaggtctccaggaggaacctggctc

SEQ ID NO: 247064 - DNA, 25 bp, Homo sapien
ggtctccaggaggaacctggctcaa

SEQ ID NO: 247065 - DNA, 25 bp, Homo sapien
tctccaggaggaacctggctcaact

SEQ ID NO: 247066 - DNA, 25 bp, Homo sapien
ccaggaggaacctggctcaactggg

SEQ ID NO: 247067 - DNA, 25 bp, Homo sapien
gaatcagtgaccagtatagcactta

SEQ ID NO: 247068 - DNA, 25 bp, Homo sapien
atagcacttagatcccttctaactc

SEQ ID NO: 247069 - DNA, 25 bp, Homo sapien
gatcccttctaactcatataatttt

SEQ ID NO: 247070 - DNA, 25 bp, Homo sapien
tttttctcagccaatccattcacaa

SEQ ID NO: 247071 - DNA, 25 bp, Homo sapien
caagcttggcattgacatgtgctgc

SEQ ID NO: 247072 - DNA, 25 bp, Homo sapien
gacatgtgctgctagtttataaact

SEQ ID NO: 247073 - DNA, 25 bp, Homo sapien
actggcattgacgaaaatcatttga

SEQ ID NO: 247074 - DNA, 25 bp, Homo sapien
tttgaatctcttctggctgagataa

SEQ ID NO: 247075 - DNA, 25 bp, Homo sapien
ggctgagataatttgccaatgcaaa

SEQ ID NO: 247076 - DNA, 25 bp, Homo sapien
tgccaatgcaaaatacagttgtcat

SEQ ID NO: 247077 - DNA, 25 bp, Homo sapien
agttgtcattaatcctgcacattag

SEQ ID NO: 247078 - DNA, 25 bp, Homo sapien
aagataactgcgaggtataaagaac

SEQ ID NO: 247079 - DNA, 25 bp, Homo sapien
agattctactcctcaggcctcaaat

SEQ ID NO: 247080 - DNA, 25 bp, Homo sapien
attctactcctcaggcctcaaatgt

SEQ ID NO: 247081 - DNA, 25 bp, Homo sapien
tactcctcaggcctcaaatgtgagc

SEQ ID NO: 247082 - DNA, 25 bp, Homo sapien
ctcctcaggcctcaaatgtgagcgc

SEQ ID NO: 247083 - DNA, 25 bp, Homo sapien
gaagaggccagcgacagcgctgcac

SEQ ID NO: 247084 - DNA, 25 bp, Homo sapien
gaggccagcgacagcgctgcacgaa

SEQ ID NO: 247085 - DNA, 25 bp, Homo sapien
agcgacagcgctgcacgaagcgagt

SEQ ID NO: 247086 - DNA, 25 bp, Homo sapien
gcacgaagcgagtgggcgggcgctc

SEQ ID NO: 247087 - DNA, 25 bp, Homo sapien
gctcgtgcccggctaaaagatggct

SEQ ID NO: 247088 - DNA, 25 bp, Homo sapien
gccaccgcctgggaggttactgtaa

SEQ ID NO: 247089 - DNA, 25 bp, Homo sapien
acaaaagctgttgaccaaggtatca

SEQ ID NO: 247090 - DNA, 25 bp, Homo sapien
ggtatcagcaacacaagccttctaa

SEQ ID NO: 247091 - DNA, 25 bp, Homo sapien
gcaacacaagccttctaaactcaag

SEQ ID NO: 247092 - DNA, 25 bp, Homo sapien
tattcttagaaactgatttggactg

SEQ ID NO: 247093 - DNA, 25 bp, Homo sapien
actgatttggactgttaaaggctaa

SEQ ID NO: 247094 - DNA, 25 bp, Homo sapien
agactcttcttgacacattttgcct

SEQ ID NO: 247095 - DNA, 25 bp, Homo sapien
gacacattttgcctacacttgctat

SEQ ID NO: 247096 - DNA, 25 bp, Homo sapien
ttgcctacacttgctatgtaaatat

SEQ ID NO: 247097 - DNA, 25 bp, Homo sapien
atgtatgcctgtcatttttgtttcc

SEQ ID NO: 247098 - DNA, 25 bp, Homo sapien
tgttcctttttacgtttatactctg

SEQ ID NO: 247099 - DNA, 25 bp, Homo sapien
tatactctgttcttctgtacataga

SEQ ID NO: 247100 - DNA, 25 bp, Homo sapien
aaccagctttcagagtagcctcatc

SEQ ID NO: 247101 - DNA, 25 bp, Homo sapien
atcagtgcccttgcagtctgactgt

SEQ ID NO: 247102 - DNA, 25 bp, Homo sapien
gactgtgtacacttggttcagctaa

SEQ ID NO: 247103 - DNA, 25 bp, Homo sapien
agctaatgtctgagagtcctgcact

SEQ ID NO: 247104 - DNA, 25 bp, Homo sapien
gtcctgcactgggttactttatact

SEQ ID NO: 247105 - DNA, 25 bp, Homo sapien
agtgaggacgttaaccagccatatt

SEQ ID NO: 247106 - DNA, 25 bp, Homo sapien
tattggctcaataaatagcttcggt

SEQ ID NO: 247107 - DNA, 25 bp, Homo sapien
ttccttctagaaatcagtgcctatt

SEQ ID NO: 247108 - DNA, 25 bp, Homo sapien
agtccaattccatctgaagccaagc

SEQ ID NO: 247109 - DNA, 25 bp, Homo sapien
catctgaagccaagctgttgtcatt

SEQ ID NO: 247110 - DNA, 25 bp, Homo sapien
attttcattcggtgacattctctcc

SEQ ID NO: 247111 - DNA, 25 bp, Homo sapien
aagccagctccctccgagaagtcat

SEQ ID NO: 247112 - DNA, 25 bp, Homo sapien
attaccgcctgacttgcgtttgata

SEQ ID NO: 247113 - DNA, 25 bp, Homo sapien
agccttcagaaattgccggtctggg

SEQ ID NO: 247114 - DNA, 25 bp, Homo sapien
gcgtttgatatttagacaccttggt

SEQ ID NO: 247115 - DNA, 25 bp, Homo sapien
acaccttggtcacaacatcttgcat

SEQ ID NO: 247116 - DNA, 25 bp, Homo sapien
atcttgcattctctcgggatgctga

SEQ ID NO: 247117 - DNA, 25 bp, Homo sapien
taactgctctttggcctttcctgca

SEQ ID NO: 247118 - DNA, 25 bp, Homo sapien
ctgcattggtcctcctcaggcaggg

SEQ ID NO: 247119 - DNA, 25 bp, Homo sapien
gctcttctatattaatgctggctcc

SEQ ID NO: 247120 - DNA, 25 bp, Homo sapien
ggagaagatcctgaattagaccttt

SEQ ID NO: 247121 - DNA, 25 bp, Homo sapien
gcacagttttgtcttcagtttcctc

SEQ ID NO: 247122 - DNA, 25 bp, Homo sapien
gaatcatgtgtttggctgtcagggt

SEQ ID NO: 247123 - DNA, 25 bp, Homo sapien
ctgaatacaggccaggattccatct

SEQ ID NO: 247124 - DNA, 25 bp, Homo sapien
ccatctcttgcattggctgtagaat

SEQ ID NO: 247125 - DNA, 25 bp, Homo sapien
ctgtagaatcagagacttgggtcca

SEQ ID NO: 247126 - DNA, 25 bp, Homo sapien
gacttgggtccatgataagccattt

SEQ ID NO: 247127 - DNA, 25 bp, Homo sapien
ccatttgttaaagctcattgagatc

SEQ ID NO: 247128 - DNA, 25 bp, Homo sapien
tgagatcctgaaaaccaagcccatc

SEQ ID NO: 247129 - DNA, 25 bp, Homo sapien
gaagcagagagttttgtcatggtat

SEQ ID NO: 247130 - DNA, 25 bp, Homo sapien
tctgctctgccttacagagttcatg

SEQ ID NO: 247131 - DNA, 25 bp, Homo sapien
agaaggaaggatctgctcctgtgac

SEQ ID NO: 247132 - DNA, 25 bp, Homo sapien
gaaaaatcgtcttctgaatcatgtg

SEQ ID NO: 247133 - DNA, 25 bp, Homo sapien
gaatggcctgagccgaagccagctc

SEQ ID NO: 247134 - DNA, 25 bp, Homo sapien
aagccagctccctccgagaagtcat

SEQ ID NO: 247135 - DNA, 25 bp, Homo sapien
gacttgcgtttgatatttagacacc

SEQ ID NO: 247136 - DNA, 25 bp, Homo sapien
gcgtttgatatttagacaccttggt

SEQ ID NO: 247137 - DNA, 25 bp, Homo sapien
gatatttagacaccttggtcacaac

SEQ ID NO: 247138 - DNA, 25 bp, Homo sapien
gacaccttggtcacaacatcttgca

SEQ ID NO: 247139 - DNA, 25 bp, Homo sapien
cttggtcacaacatcttgcattctc

SEQ ID NO: 247140 - DNA, 25 bp, Homo sapien
atcttgcattctctcgggatgctga

SEQ ID NO: 247141 - DNA, 25 bp, Homo sapien
taactgctctttggcctttcctgca

SEQ ID NO: 247142 - DNA, 25 bp, Homo sapien
gctctttggcctttcctgcattggt

SEQ ID NO: 247143 - DNA, 25 bp, Homo sapien
tcctgcattggtcctcctcaggcag

SEQ ID NO: 247144 - DNA, 25 bp, Homo sapien
cactcactcatacatgtcctcagga

SEQ ID NO: 247145 - DNA, 25 bp, Homo sapien
gtcctcaggacgtgaagacatttca

SEQ ID NO: 247146 - DNA, 25 bp, Homo sapien
gacatttcagcagaccaaagtttcc

SEQ ID NO: 247147 - DNA, 25 bp, Homo sapien
gcagaccaaagtttccttcgaattt

SEQ ID NO: 247148 - DNA, 25 bp, Homo sapien
cgaattttcttcgaatcgtccagat

SEQ ID NO: 247149 - DNA, 25 bp, Homo sapien
ttcttcgaatcgtccagatacttgg

SEQ ID NO: 247150 - DNA, 25 bp, Homo sapien
agatacttggagacatctcctcctc

SEQ ID NO: 247151 - DNA, 25 bp, Homo sapien
cccttggagcacacagtggtgaaga

SEQ ID NO: 247152 - DNA, 25 bp, Homo sapien
cacagtggtgaagacattcctgaat

SEQ ID NO: 247153 - DNA, 25 bp, Homo sapien
gacattcctgaatatgtctcaggct

SEQ ID NO: 247154 - DNA, 25 bp, Homo sapien
gtctcaggctgtagaaatcttattt

SEQ ID NO: 247155 - DNA, 25 bp, Homo sapien
ttcccagttgggatgtcttactaaa

SEQ ID NO: 247156 - DNA, 25 bp, Homo sapien
tgggtgctgtgtctcaccaaccaga

SEQ ID NO: 247157 - DNA, 25 bp, Homo sapien
ctcaccaaccagatttttacttctc

SEQ ID NO: 247158 - DNA, 25 bp, Homo sapien
cacgtgtgagccgttttctgggaat

SEQ ID NO: 247159 - DNA, 25 bp, Homo sapien
tgggaatttccctgagataaaaagt

SEQ ID NO: 247160 - DNA, 25 bp, Homo sapien
gataaaaagtaccacctccttcaag

SEQ ID NO: 247161 - DNA, 25 bp, Homo sapien
gtatgttttctctctaacctttctg

SEQ ID NO: 247162 - DNA, 25 bp, Homo sapien
ttcaagtttcagacgcctgctcagt

SEQ ID NO: 247163 - DNA, 25 bp, Homo sapien
agacgcctgctcagtggtcacatat

SEQ ID NO: 247164 - DNA, 25 bp, Homo sapien
ttctctctaacctttctgttgtaaa

SEQ ID NO: 247165 - DNA, 25 bp, Homo sapien
tggagaagatgttcccagttgggat

SEQ ID NO: 247166 - DNA, 25 bp, Homo sapien
gcacccggccgggaatttatcaaag

SEQ ID NO: 247167 - DNA, 25 bp, Homo sapien
ttcaaacctgagtctagcacaatgc

SEQ ID NO: 247168 - DNA, 25 bp, Homo sapien
tcaaacctgagtctagcacaatgca

SEQ ID NO: 247169 - DNA, 25 bp, Homo sapien
tctgactccttccagggaagtatca

SEQ ID NO: 247170 - DNA, 25 bp, Homo sapien
ctgactccttccagggaagtatcag

SEQ ID NO: 247171 - DNA, 25 bp, Homo sapien
tgactccttccagggaagtatcagc

SEQ ID NO: 247172 - DNA, 25 bp, Homo sapien
actccttccagggaagtatcagctt

SEQ ID NO: 247173 - DNA, 25 bp, Homo sapien
ctccttccagggaagtatcagctta

SEQ ID NO: 247174 - DNA, 25 bp, Homo sapien
tccttccagggaagtatcagcttaa

SEQ ID NO: 247175 - DNA, 25 bp, Homo sapien
ccttccagggaagtatcagcttaag

SEQ ID NO: 247176 - DNA, 25 bp, Homo sapien
atccctgccctccacactgcaagct

SEQ ID NO: 247177 - DNA, 25 bp, Homo sapien
tttaaaacagtgtctggtgtgtagc

SEQ ID NO: 247178 - DNA, 25 bp, Homo sapien
gtgtctggtgtgtagcaagcaaata

SEQ ID NO: 247179 - DNA, 25 bp, Homo sapien
caaatatgagtattagtcttttcct

SEQ ID NO: 247180 - DNA, 25 bp, Homo sapien
gtcttttccttgttaaaatgtgtgc

SEQ ID NO: 247181 - DNA, 25 bp, Homo sapien
aatagtgtttcttgaccacatgctt

SEQ ID NO: 247182 - DNA, 25 bp, Homo sapien
agtgtttcttgaccacatgctttta

SEQ ID NO: 247183 - DNA, 25 bp, Homo sapien
gtttcctcctaggaaacatggaggt

SEQ ID NO: 247184 - DNA, 25 bp, Homo sapien
ggcggtgcacgctacaggatttctg

SEQ ID NO: 247185 - DNA, 25 bp, Homo sapien
gcacgctacaggatttctgtaagaa

SEQ ID NO: 247186 - DNA, 25 bp, Homo sapien
gaacagatgagttaacgtgtgcaaa

SEQ ID NO: 247187 - DNA, 25 bp, Homo sapien
gagttaacgtgtgcaaaacatttaa

SEQ ID NO: 247188 - DNA, 25 bp, Homo sapien
tttccgttttcctagccaacttgtg

SEQ ID NO: 247189 - DNA, 25 bp, Homo sapien
agccaacttgtgttctgggtttgaa

SEQ ID NO: 247190 - DNA, 25 bp, Homo sapien
gacccaccacaaatgctttttctat

SEQ ID NO: 247191 - DNA, 25 bp, Homo sapien
aaatgctgcttgtgtggtgctctgc

SEQ ID NO: 247192 - DNA, 25 bp, Homo sapien
ctctgcttcctgaggatttggctgg

SEQ ID NO: 247193 - DNA, 25 bp, Homo sapien
ggattctccgctggcacatgggaga

SEQ ID NO: 247194 - DNA, 25 bp, Homo sapien
aaggccatcttctgtgtcggtgctg

SEQ ID NO: 247195 - DNA, 25 bp, Homo sapien
ctgtgtcggtgctgtgatctgcctt

SEQ ID NO: 247196 - DNA, 25 bp, Homo sapien
gccttgttctcacttgctgaggata

SEQ ID NO: 247197 - DNA, 25 bp, Homo sapien
ggataagggcatacacgctgctcct

SEQ ID NO: 247198 - DNA, 25 bp, Homo sapien
ttgttgcccgacttcgtactaagca

SEQ ID NO: 247199 - DNA, 25 bp, Homo sapien
aagctgcattttcatgcactaccct

SEQ ID NO: 247200 - DNA, 25 bp, Homo sapien
gcactacccttgttatgcaaccagt

SEQ ID NO: 247201 - DNA, 25 bp, Homo sapien
ccttgttatgcaaccagtagtgata

SEQ ID NO: 247202 - DNA, 25 bp, Homo sapien
ttgcttttggtgtaagtctcatgtt

SEQ ID NO: 247203 - DNA, 25 bp, Homo sapien
gaaacttgatttttagtctgaccaa

SEQ ID NO: 247204 - DNA, 25 bp, Homo sapien
tttagtctgaccaatgatgtatttg

SEQ ID NO: 247205 - DNA, 25 bp, Homo sapien
gacaattgactaatggtggaggttc

SEQ ID NO: 247206 - DNA, 25 bp, Homo sapien
aatggtggaggttcacctttgagca

SEQ ID NO: 247207 - DNA, 25 bp, Homo sapien
gagcaccttattgatcactttaaag

SEQ ID NO: 247208 - DNA, 25 bp, Homo sapien
tttcttttccctttgtatgagatgt

SEQ ID NO: 247209 - DNA, 25 bp, Homo sapien
cagattcctgtatccaataacatta

SEQ ID NO: 247210 - DNA, 25 bp, Homo sapien
tgctgtcgccctcacaggatgtcac

SEQ ID NO: 247211 - DNA, 25 bp, Homo sapien
aggatgtcaccttcagcgtctgaaa

SEQ ID NO: 247212 - DNA, 25 bp, Homo sapien
tctgaaagctgggtttgatgcgtct

SEQ ID NO: 247213 - DNA, 25 bp, Homo sapien
ttgatgcgtctggaaaggcgtccct

SEQ ID NO: 247214 - DNA, 25 bp, Homo sapien
aaaggcgtccctgacaggcgtcgtt

SEQ ID NO: 247215 - DNA, 25 bp, Homo sapien
gcgtcgttgccaggagcccctagtg

SEQ ID NO: 247216 - DNA, 25 bp, Homo sapien
ttctctcgttgcacccggaacatgg

SEQ ID NO: 247217 - DNA, 25 bp, Homo sapien
aaagggtctacccagcatggtgcgt

SEQ ID NO: 247218 - DNA, 25 bp, Homo sapien
acccagcatggtgcgtggagcctaa

SEQ ID NO: 247219 - DNA, 25 bp, Homo sapien
gtggagcctaagcagtcagtacttc

SEQ ID NO: 247220 - DNA, 25 bp, Homo sapien
gtcagtacttcaggacttcacccgg

SEQ ID NO: 247221 - DNA, 25 bp, Homo sapien
cttggcctcaactaattaggccaaa

SEQ ID NO: 247222 - DNA, 25 bp, Homo sapien
gcctcaactaattaggccaaacaga

SEQ ID NO: 247223 - DNA, 25 bp, Homo sapien
cctcaactaattaggccaaacagat

SEQ ID NO: 247224 - DNA, 25 bp, Homo sapien
ctcaactaattaggccaaacagatg

SEQ ID NO: 247225 - DNA, 25 bp, Homo sapien
aactaattaggccaaacagatgtac

SEQ ID NO: 247226 - DNA, 25 bp, Homo sapien
actaattaggccaaacagatgtact

SEQ ID NO: 247227 - DNA, 25 bp, Homo sapien
ctaattaggccaaacagatgtactt

SEQ ID NO: 247228 - DNA, 25 bp, Homo sapien
taattaggccaaacagatgtacttc

SEQ ID NO: 247229 - DNA, 25 bp, Homo sapien
aattaggccaaacagatgtacttca

SEQ ID NO: 247230 - DNA, 25 bp, Homo sapien
attaggccaaacagatgtacttcac

SEQ ID NO: 247231 - DNA, 25 bp, Homo sapien
ttaggccaaacagatgtacttcact

SEQ ID NO: 247232 - DNA, 25 bp, Homo sapien
tatggagatccagaagccccgtttc

SEQ ID NO: 247233 - DNA, 25 bp, Homo sapien
gaagccccgtttcgagctacgaagt

SEQ ID NO: 247234 - DNA, 25 bp, Homo sapien
gaagtctctcttctactgcagtctt

SEQ ID NO: 247235 - DNA, 25 bp, Homo sapien
aaaacagagccactttggtgcctac

SEQ ID NO: 247236 - DNA, 25 bp, Homo sapien
attccctgtgaatccactctagttg

SEQ ID NO: 247237 - DNA, 25 bp, Homo sapien
actctagttgggatatagcctctct

SEQ ID NO: 247238 - DNA, 25 bp, Homo sapien
atatagcctctctacagctcagtga

SEQ ID NO: 247239 - DNA, 25 bp, Homo sapien
agctcagtgacgtagcgcgccaaaa

SEQ ID NO: 247240 - DNA, 25 bp, Homo sapien
tccacaagtaggtaggcacatccag

SEQ ID NO: 247241 - DNA, 25 bp, Homo sapien
gcacatccaggtagctctgtcagaa

SEQ ID NO: 247242 - DNA, 25 bp, Homo sapien
gtcagaagatgggacctggcgcctt

SEQ ID NO: 247243 - DNA, 25 bp, Homo sapien
caggctgagagctcctcgaggaagc

SEQ ID NO: 247244 - DNA, 25 bp, Homo sapien
cctcgaggaagcgaggctgagtcct

SEQ ID NO: 247245 - DNA, 25 bp, Homo sapien
agtcctgcaggaattctcaagtact

SEQ ID NO: 247246 - DNA, 25 bp, Homo sapien
ctgtattgatatttctgtagtaagc

SEQ ID NO: 247247 - DNA, 25 bp, Homo sapien
taatacaagcacagtccgtatcgcg

SEQ ID NO: 247248 - DNA, 25 bp, Homo sapien
gggttaccgtcttccaatggagtct

SEQ ID NO: 247249 - DNA, 25 bp, Homo sapien
caatggagtctggttacacgtttat

SEQ ID NO: 247250 - DNA, 25 bp, Homo sapien
acacgtttatgagacttggagccaa

SEQ ID NO: 247251 - DNA, 25 bp, Homo sapien
aaatactactcgcttgtcgagggct

SEQ ID NO: 247252 - DNA, 25 bp, Homo sapien
ctcgcttgtcgagggctactgagaa

SEQ ID NO: 247253 - DNA, 25 bp, Homo sapien
ggtcataaatgatacatgatgcctt

SEQ ID NO: 247254 - DNA, 25 bp, Homo sapien
gaaacttcaagggtaagctacacta

SEQ ID NO: 247255 - DNA, 25 bp, Homo sapien
tcaagggtaagctacactaatgtaa

SEQ ID NO: 247256 - DNA, 25 bp, Homo sapien
ttctcagatgtgttgtttatgttac

SEQ ID NO: 247257 - DNA, 25 bp, Homo sapien
tgtgttgtttatgttacagctttgt

SEQ ID NO: 247258 - DNA, 25 bp, Homo sapien
agctttgtgttcaagttctcttgaa

SEQ ID NO: 247259 - DNA, 25 bp, Homo sapien
caagttctcttgaagtaattgtgca

SEQ ID NO: 247260 - DNA, 25 bp, Homo sapien
gtaattgtgcagaatgggctatata

SEQ ID NO: 247261 - DNA, 25 bp, Homo sapien
gtttattgatgctgctaatgtttct

SEQ ID NO: 247262 - DNA, 25 bp, Homo sapien
atatgctcattttcacttttagcct

SEQ ID NO: 247263 - DNA, 25 bp, Homo sapien
ttttcacttttagcctatcatgagc

SEQ ID NO: 247264 - DNA, 25 bp, Homo sapien
ttagcctatcatgagctcttttgaa

SEQ ID NO: 247265 - DNA, 25 bp, Homo sapien
cgggcccggcagctacgtctatttt

SEQ ID NO: 247266 - DNA, 25 bp, Homo sapien
gggcccggcagctacgtctattttc

SEQ ID NO: 247267 - DNA, 25 bp, Homo sapien
tctgtagaaggtgccacagtgagac

SEQ ID NO: 247268 - DNA, 25 bp, Homo sapien
gccacagtgagacctggagccaccc

SEQ ID NO: 247269 - DNA, 25 bp, Homo sapien
ccacagtgagacctggagccacccc

SEQ ID NO: 247270 - DNA, 25 bp, Homo sapien
cctgccctggcgccgtttagagctg

SEQ ID NO: 247271 - DNA, 25 bp, Homo sapien
tgccctggcgccgtttagagctggg

SEQ ID NO: 247272 - DNA, 25 bp, Homo sapien
attcaaccactctgacgtggggaga

SEQ ID NO: 247273 - DNA, 25 bp, Homo sapien
aggagtaacaaacaagattgtgata

SEQ ID NO: 247274 - DNA, 25 bp, Homo sapien
gtaacaaacaagattgtgatagtgt

SEQ ID NO: 247275 - DNA, 25 bp, Homo sapien
actttgagctagataaataaaggcc

SEQ ID NO: 247276 - DNA, 25 bp, Homo sapien
tggcagctgttagggtccacaggtt

SEQ ID NO: 247277 - DNA, 25 bp, Homo sapien
gttagggtccacaggttaatgatct

SEQ ID NO: 247278 - DNA, 25 bp, Homo sapien
gggtccacaggttaatgatctccaa

SEQ ID NO: 247279 - DNA, 25 bp, Homo sapien
ggttaatgatctccaacgtcacaca

SEQ ID NO: 247280 - DNA, 25 bp, Homo sapien
atgatctccaacgtcacacagaaga

SEQ ID NO: 247281 - DNA, 25 bp, Homo sapien
tccaacgtcacacagaagagaatgt

SEQ ID NO: 247282 - DNA, 25 bp, Homo sapien
gaatgtgctgaggtgtgacctccct

SEQ ID NO: 247283 - DNA, 25 bp, Homo sapien
tgaagtctgaagatcagcccagtct

SEQ ID NO: 247284 - DNA, 25 bp, Homo sapien
gtctgaagatcagcccagtcttcct

SEQ ID NO: 247285 - DNA, 25 bp, Homo sapien
gccgtgggagtgctggccaacgtgc

SEQ ID NO: 247286 - DNA, 25 bp, Homo sapien
caggcagggaggacctgaattcctg

SEQ ID NO: 247287 - DNA, 25 bp, Homo sapien
taaacacccaagaaccgtttcagat

SEQ ID NO: 247288 - DNA, 25 bp, Homo sapien
ccaagaaccgtttcagatcttctct

SEQ ID NO: 247289 - DNA, 25 bp, Homo sapien
gctgatgcaggtagttttaaatttt

SEQ ID NO: 247290 - DNA, 25 bp, Homo sapien
aaatttttctcagttccagtgatag

SEQ ID NO: 247291 - DNA, 25 bp, Homo sapien
gttccagtgatagaaaacccacaca

SEQ ID NO: 247292 - DNA, 25 bp, Homo sapien
tacatcctctgccagtcttaataga

SEQ ID NO: 247293 - DNA, 25 bp, Homo sapien
ctgctttcctgctccgtatctcagt

SEQ ID NO: 247294 - DNA, 25 bp, Homo sapien
agagaagctctgacgcagtgctgct

SEQ ID NO: 247295 - DNA, 25 bp, Homo sapien
ccgggtcagcctgccatttagggaa

SEQ ID NO: 247296 - DNA, 25 bp, Homo sapien
ctgctccgtatctcagtctgcactg

SEQ ID NO: 247297 - DNA, 25 bp, Homo sapien
tgacatcaagatgggagcccagccc

SEQ ID NO: 247298 - DNA, 25 bp, Homo sapien
gccccgtggttcctatggatgctgt

SEQ ID NO: 247299 - DNA, 25 bp, Homo sapien
ggttcctatggatgctgtttcccct

SEQ ID NO: 247300 - DNA, 25 bp, Homo sapien
agcacccaactggattgatgtctgc

SEQ ID NO: 247301 - DNA, 25 bp, Homo sapien
actggattgatgtctgccgcctgaa

SEQ ID NO: 247302 - DNA, 25 bp, Homo sapien
gtctgccgcctgaaatacacttgat

SEQ ID NO: 247303 - DNA, 25 bp, Homo sapien
aaatacacttgatctgcgtttccga

SEQ ID NO: 247304 - DNA, 25 bp, Homo sapien
ttgatctgcgtttccgaagccaagc

SEQ ID NO: 247305 - DNA, 25 bp, Homo sapien
atgggcgggataaagaagcaatcac

SEQ ID NO: 247306 - DNA, 25 bp, Homo sapien
aaaagcagtcggacctagtcaagcc

SEQ ID NO: 247307 - DNA, 25 bp, Homo sapien
agtcggacctagtcaagccggagca

SEQ ID NO: 247308 - DNA, 25 bp, Homo sapien
agccctctagcgtcccaaacgaggg

SEQ ID NO: 247309 - DNA, 25 bp, Homo sapien
agaatagatcttgggaatcttcccc

SEQ ID NO: 247310 - DNA, 25 bp, Homo sapien
atcttccccattttctagtccagaa

SEQ ID NO: 247311 - DNA, 25 bp, Homo sapien
gaaacttcaagggtaagctacacta

SEQ ID NO: 247312 - DNA, 25 bp, Homo sapien
ttctcagatgtgttgtttatgttac

SEQ ID NO: 247313 - DNA, 25 bp, Homo sapien
agctttgtgttcaagttctcttgaa

SEQ ID NO: 247314 - DNA, 25 bp, Homo sapien
caagttctcttgaagtaattgtgca

SEQ ID NO: 247315 - DNA, 25 bp, Homo sapien
gtaattgtgcagaatgggctatata

SEQ ID NO: 247316 - DNA, 25 bp, Homo sapien
gtttattgatgctgctaatgtttct

SEQ ID NO: 247317 - DNA, 25 bp, Homo sapien
atatgctcattttcacttttagcct

SEQ ID NO: 247318 - DNA, 25 bp, Homo sapien
ttttcacttttagcctatcatgagc

SEQ ID NO: 247319 - DNA, 25 bp, Homo sapien
ttagcctatcatgagctcttttgaa

SEQ ID NO: 247320 - DNA, 25 bp, Homo sapien
agaatagatcttgggaatcttcccc

SEQ ID NO: 247321 - DNA, 25 bp, Homo sapien
atagatcttgggaatcttccccatt

SEQ ID NO: 247322 - DNA, 25 bp, Homo sapien
agatcttgggaatcttccccatttt

SEQ ID NO: 247323 - DNA, 25 bp, Homo sapien
atcttgggaatcttccccattttct

SEQ ID NO: 247324 - DNA, 25 bp, Homo sapien
cttgggaatcttccccattttctag

SEQ ID NO: 247325 - DNA, 25 bp, Homo sapien
ggaatcttccccattttctagtcca

SEQ ID NO: 247326 - DNA, 25 bp, Homo sapien
aatcttccccattttctagtccaga

SEQ ID NO: 247327 - DNA, 25 bp, Homo sapien
atcttccccattttctagtccagaa

SEQ ID NO: 247328 - DNA, 25 bp, Homo sapien
tcttccccattttctagtccagaaa

SEQ ID NO: 247329 - DNA, 25 bp, Homo sapien
ttccccattttctagtccagaaact

SEQ ID NO: 247330 - DNA, 25 bp, Homo sapien
attttctagtccagaaacttcaagg

SEQ ID NO: 247331 - DNA, 25 bp, Homo sapien
aatgcatcaatcaatctcgagagta

SEQ ID NO: 247332 - DNA, 25 bp, Homo sapien
gagagtatgatcatgcttcctgctt

SEQ ID NO: 247333 - DNA, 25 bp, Homo sapien
ggatctgaagttaactgcaactcca

SEQ ID NO: 247334 - DNA, 25 bp, Homo sapien
tacaagacttctttgggacccatgg

SEQ ID NO: 247335 - DNA, 25 bp, Homo sapien
tgggacccatggaagcatctctaca

SEQ ID NO: 247336 - DNA, 25 bp, Homo sapien
acatgctcatgtttgccagattcag

SEQ ID NO: 247337 - DNA, 25 bp, Homo sapien
agattcagtggcctcctgaaacctg

SEQ ID NO: 247338 - DNA, 25 bp, Homo sapien
gaaacctggccctagctaataagtt

SEQ ID NO: 247339 - DNA, 25 bp, Homo sapien
acttgtaatacgctgaatgctgcat

SEQ ID NO: 247340 - DNA, 25 bp, Homo sapien
ggttttgaaactacttacctgctgt

SEQ ID NO: 247341 - DNA, 25 bp, Homo sapien
ttacctgctgtggaacacctgtata

SEQ ID NO: 247342 - DNA, 25 bp, Homo sapien
ttatcctagtaatattacttcctgg

SEQ ID NO: 247343 - DNA, 25 bp, Homo sapien
ccattattcatgaagtcaacctaga

SEQ ID NO: 247344 - DNA, 25 bp, Homo sapien
gatcagcaatgaggaataattaaac

SEQ ID NO: 247345 - DNA, 25 bp, Homo sapien
ttttcaagcatggagaaatgctcat

SEQ ID NO: 247346 - DNA, 25 bp, Homo sapien
gtcaacctagaagggcagactggta

SEQ ID NO: 247347 - DNA, 25 bp, Homo sapien
ggagaaatgctcatgcgagaatact

SEQ ID NO: 247348 - DNA, 25 bp, Homo sapien
atgctcatgcgagaatactaagtaa

SEQ ID NO: 247349 - DNA, 25 bp, Homo sapien
gggcagactggtaataacatgagtt

SEQ ID NO: 247350 - DNA, 25 bp, Homo sapien
acatgagttggtacattcttcctgg

SEQ ID NO: 247351 - DNA, 25 bp, Homo sapien
tacattcttcctggcaatacataaa

SEQ ID NO: 247352 - DNA, 25 bp, Homo sapien
ttcctggcaatacataaagaccttt

SEQ ID NO: 247353 - DNA, 25 bp, Homo sapien
gatggccttaccatccagggacttg

SEQ ID NO: 247354 - DNA, 25 bp, Homo sapien
cagggacttgccgttcatgtctctg

SEQ ID NO: 247355 - DNA, 25 bp, Homo sapien
caaaggtgacgaacgcgaagcccct

SEQ ID NO: 247356 - DNA, 25 bp, Homo sapien
gaagcccctcgacttgttggtttct

SEQ ID NO: 247357 - DNA, 25 bp, Homo sapien
ttggtttctcggtctttcatcagga

SEQ ID NO: 247358 - DNA, 25 bp, Homo sapien
tttcatcaggagcacctcgacgatg

SEQ ID NO: 247359 - DNA, 25 bp, Homo sapien
cgacgatgcggccatacttgccaaa

SEQ ID NO: 247360 - DNA, 25 bp, Homo sapien
atacttgccaaactcggcttcgagg

SEQ ID NO: 247361 - DNA, 25 bp, Homo sapien
tcgagggctttctcgtcggtttcga

SEQ ID NO: 247362 - DNA, 25 bp, Homo sapien
gcttcaaccatgtttgccggtcgaa

SEQ ID NO: 247363 - DNA, 25 bp, Homo sapien
tcagtttgccggtcgaacggtcggt

SEQ ID NO: 247364 - DNA, 25 bp, Homo sapien
aaacacttccacaaccagtagaatg

SEQ ID NO: 247365 - DNA, 25 bp, Homo sapien
acttccacaaccagtagaatgcaaa

SEQ ID NO: 247366 - DNA, 25 bp, Homo sapien
gaatgcaaaaagtgctttccaagag

SEQ ID NO: 247367 - DNA, 25 bp, Homo sapien
ctttccaagagttcactgaatcctg

SEQ ID NO: 247368 - DNA, 25 bp, Homo sapien
gagttcactgaatcctgaagcacgg

SEQ ID NO: 247369 - DNA, 25 bp, Homo sapien
tacttttgcatcagcctaatatgag

SEQ ID NO: 247370 - DNA, 25 bp, Homo sapien
ttttgcatcagcctaatatgaggaa

SEQ ID NO: 247371 - DNA, 25 bp, Homo sapien
gcatcagcctaatatgaggaagtaa

SEQ ID NO: 247372 - DNA, 25 bp, Homo sapien
acagaataattctttcctggaagtc

SEQ ID NO: 247373 - DNA, 25 bp, Homo sapien
gaataattctttcctggaagtctgg

SEQ ID NO: 247374 - DNA, 25 bp, Homo sapien
tcctggaagtctggcattttgcctg

SEQ ID NO: 247375 - DNA, 25 bp, Homo sapien
gtgaggctgagaatctgccattggt

SEQ ID NO: 247376 - DNA, 25 bp, Homo sapien
caagtctccttctgatgtctgatga

SEQ ID NO: 247377 - DNA, 25 bp, Homo sapien
ctgccattggtgaatgtaatgtcct

SEQ ID NO: 247378 - DNA, 25 bp, Homo sapien
gtgaatgtaatgtcctttcccagtt

SEQ ID NO: 247379 - DNA, 25 bp, Homo sapien
tgtttcctcctttccacaaccaaat

SEQ ID NO: 247380 - DNA, 25 bp, Homo sapien
ctcctttccacaaccaaatcttata

SEQ ID NO: 247381 - DNA, 25 bp, Homo sapien
caaatcttatagcagctggttggaa

SEQ ID NO: 247382 - DNA, 25 bp, Homo sapien
gaggtgatgttaaagaagacccaat

SEQ ID NO: 247383 - DNA, 25 bp, Homo sapien
agaagacccaattctgtgtctcctc

SEQ ID NO: 247384 - DNA, 25 bp, Homo sapien
caattctgtgtctcctcaaaaccta

SEQ ID NO: 247385 - DNA, 25 bp, Homo sapien
gtctcctcaaaacctagagttcagg

SEQ ID NO: 247386 - DNA, 25 bp, Homo sapien
aagcaaattggctacttgtcccttc

SEQ ID NO: 247387 - DNA, 25 bp, Homo sapien
accaggttcctcgagctgaaattag

SEQ ID NO: 247388 - DNA, 25 bp, Homo sapien
attagtcatcatatctcaagctgtg

SEQ ID NO: 247389 - DNA, 25 bp, Homo sapien
tgttgtcaaccaaaccaggagcctt

SEQ ID NO: 247390 - DNA, 25 bp, Homo sapien
ggagccttagacaagagactctggc

SEQ ID NO: 247391 - DNA, 25 bp, Homo sapien
agactctggctgagagcacttggca

SEQ ID NO: 247392 - DNA, 25 bp, Homo sapien
agtgccctccttgcgatgaagactg

SEQ ID NO: 247393 - DNA, 25 bp, Homo sapien
aaagatttgtgggagcagaccagca

SEQ ID NO: 247394 - DNA, 25 bp, Homo sapien
gggcacaactcactactctgacaac

SEQ ID NO: 247395 - DNA, 25 bp, Homo sapien
tactctgacaacaacagccctgcga

SEQ ID NO: 247396 - DNA, 25 bp, Homo sapien
agccctgcgagcaacatagttacag

SEQ ID NO: 247397 - DNA, 25 bp, Homo sapien
gcttgctataatacttggaacctgt

SEQ ID NO: 247398 - DNA, 25 bp, Homo sapien
acttggaacctgttgctttctcttc

SEQ ID NO: 247399 - DNA, 25 bp, Homo sapien
tcttcctcactctttaaatgtcata

SEQ ID NO: 247400 - DNA, 25 bp, Homo sapien
aaggtcacacagttcttggaatcag

SEQ ID NO: 247401 - DNA, 25 bp, Homo sapien
gttatcaatgccatttccatttgga

SEQ ID NO: 247402 - DNA, 25 bp, Homo sapien
catgattctgcctggctttctgagt

SEQ ID NO: 247403 - DNA, 25 bp, Homo sapien
gacgcagacgagagcaacatacgtt

SEQ ID NO: 247404 - DNA, 25 bp, Homo sapien
ggaagtatctaaataaccacaatgt

SEQ ID NO: 247405 - DNA, 25 bp, Homo sapien
gtgatcacagcttctccacgagcct

SEQ ID NO: 247406 - DNA, 25 bp, Homo sapien
ttctccacgagccttcctgaagtaa

SEQ ID NO: 247407 - DNA, 25 bp, Homo sapien
gccttcctgaagtaaagctggtatg

SEQ ID NO: 247408 - DNA, 25 bp, Homo sapien
gaacaggactgccttatgaggaaac

SEQ ID NO: 247409 - DNA, 25 bp, Homo sapien
caagttcacacagcaattaagtgat

SEQ ID NO: 247410 - DNA, 25 bp, Homo sapien
attaagtgatcaagtccaagagcaa

SEQ ID NO: 247411 - DNA, 25 bp, Homo sapien
agagcaaaaccaggcaggctggctc

SEQ ID NO: 247412 - DNA, 25 bp, Homo sapien
tggctccagagctcacgatagtcca

SEQ ID NO: 247413 - DNA, 25 bp, Homo sapien
agctcacgatagtccaccactgctt

SEQ ID NO: 247414 - DNA, 25 bp, Homo sapien
actgctttccaccatcactacggaa

SEQ ID NO: 247415 - DNA, 25 bp, Homo sapien
atcactacggaatcaagtccatgag

SEQ ID NO: 247416 - DNA, 25 bp, Homo sapien
aagtccatgaggatactcaccttat

SEQ ID NO: 247417 - DNA, 25 bp, Homo sapien
atactcaccttatgtcagttgccta

SEQ ID NO: 247418 - DNA, 25 bp, Homo sapien
cttatgtcagttgcctaagttggaa

SEQ ID NO: 247419 - DNA, 25 bp, Homo sapien
ccttcggtatgagacaagtatgttt

SEQ ID NO: 247420 - DNA, 25 bp, Homo sapien
aagtatgttttttgctgctctgcct

SEQ ID NO: 247421 - DNA, 25 bp, Homo sapien
tgctctgcctaagccactgaaaagg

SEQ ID NO: 247422 - DNA, 25 bp, Homo sapien
gtgagtatgtgtgtactgttcatgt

SEQ ID NO: 247423 - DNA, 25 bp, Homo sapien
gtactgttcatgtaggcacatctaa

SEQ ID NO: 247424 - DNA, 25 bp, Homo sapien
tgtaggcacatctaaaaactgctgt

SEQ ID NO: 247425 - DNA, 25 bp, Homo sapien
aaaactgctgtgcactatggctgat

SEQ ID NO: 247426 - DNA, 25 bp, Homo sapien
gctgtgcactatggctgatgaccaa

SEQ ID NO: 247427 - DNA, 25 bp, Homo sapien
ggctgatgaccaacaagagacctaa

SEQ ID NO: 247428 - DNA, 25 bp, Homo sapien
tttctccactcacctattttcaaga

SEQ ID NO: 247429 - DNA, 25 bp, Homo sapien
aaaacaccaagctctttaccatatg

SEQ ID NO: 247430 - DNA, 25 bp, Homo sapien
acaaggattccagttctgctgctat

SEQ ID NO: 247431 - DNA, 25 bp, Homo sapien
gttctgctgctatataaaccagcct

SEQ ID NO: 247432 - DNA, 25 bp, Homo sapien
taaaccagcctcaaatagtctgagt

SEQ ID NO: 247433 - DNA, 25 bp, Homo sapien
tcaaatagtctgagtctgtgatatc

SEQ ID NO: 247434 - DNA, 25 bp, Homo sapien
gtctgtgatatcactgggtcacccc

SEQ ID NO: 247435 - DNA, 25 bp, Homo sapien
tgaaatggatggcatctgatcctgc

SEQ ID NO: 247436 - DNA, 25 bp, Homo sapien
tcacccccatcacttcagtagaagg

SEQ ID NO: 247437 - DNA, 25 bp, Homo sapien
aaggcctgccactgcctgacatgtg

SEQ ID NO: 247438 - DNA, 25 bp, Homo sapien
tgccactgcctgacatgtgaaagag

SEQ ID NO: 247439 - DNA, 25 bp, Homo sapien
catctgatcctgcttcatgtgattc

SEQ ID NO: 247440 - DNA, 25 bp, Homo sapien
gatcctgcttcatgtgattcttcat

SEQ ID NO: 247441 - DNA, 25 bp, Homo sapien
aactctcagccaaaccaaacagaag

SEQ ID NO: 247442 - DNA, 25 bp, Homo sapien
atattgagatttccgatgagttcct

SEQ ID NO: 247443 - DNA, 25 bp, Homo sapien
atttccgatgagttcctggtacagt

SEQ ID NO: 247444 - DNA, 25 bp, Homo sapien
tggtacagttcagacaggacaaagt

SEQ ID NO: 247445 - DNA, 25 bp, Homo sapien
gggagtgtcccaacatgtaaacgaa

SEQ ID NO: 247446 - DNA, 25 bp, Homo sapien
aacaaccgtctccttgaagttgctg

SEQ ID NO: 247447 - DNA, 25 bp, Homo sapien
tgaagttgctgtcccttaactggcg

SEQ ID NO: 247448 - DNA, 25 bp, Homo sapien
ctctctactttcatggacttgttcc

SEQ ID NO: 247449 - DNA, 25 bp, Homo sapien
ggacttgttcctttgtaatagtgca

SEQ ID NO: 247450 - DNA, 25 bp, Homo sapien
gttcattgtatgtttgggaatcacc

SEQ ID NO: 247451 - DNA, 25 bp, Homo sapien
gggaatcaccaaaggcttttagagt

SEQ ID NO: 247452 - DNA, 25 bp, Homo sapien
ccccaaatgagcaggtccaagacac

SEQ ID NO: 247453 - DNA, 25 bp, Homo sapien
gagcaggtccaagacacttattcat

SEQ ID NO: 247454 - DNA, 25 bp, Homo sapien
caagacacttattcatacatcagga

SEQ ID NO: 247455 - DNA, 25 bp, Homo sapien
atcaggaaaaccagggtccagagat

SEQ ID NO: 247456 - DNA, 25 bp, Homo sapien
agaaatccaaggcttggagccactt

SEQ ID NO: 247457 - DNA, 25 bp, Homo sapien
tggatggtcacccagggccatcagc

SEQ ID NO: 247458 - DNA, 25 bp, Homo sapien
catcagcatctactagccaggagga

SEQ ID NO: 247459 - DNA, 25 bp, Homo sapien
gaggctgggacattcgggaggcaat

SEQ ID NO: 247460 - DNA, 25 bp, Homo sapien
atgggaacctctcctcaaggactgc

SEQ ID NO: 247461 - DNA, 25 bp, Homo sapien
aacctctcctcaaggactgctaagt

SEQ ID NO: 247462 - DNA, 25 bp, Homo sapien
tcctcaaggactgctaagtcaggaa

SEQ ID NO: 247463 - DNA, 25 bp, Homo sapien
tgagccccaacatctgctagtgttg

SEQ ID NO: 247464 - DNA, 25 bp, Homo sapien
atccatctctgcattctgatgctgg

SEQ ID NO: 247465 - DNA, 25 bp, Homo sapien
tctctgcattctgatgctgggagac

SEQ ID NO: 247466 - DNA, 25 bp, Homo sapien
gctgggagactatttccttgaaatg

SEQ ID NO: 247467 - DNA, 25 bp, Homo sapien
gcaattgattttgcctctgctaaga

SEQ ID NO: 247468 - DNA, 25 bp, Homo sapien
tctgctaagaggctctgctggctac

SEQ ID NO: 247469 - DNA, 25 bp, Homo sapien
agaggctctgctggctacccatgta

SEQ ID NO: 247470 - DNA, 25 bp, Homo sapien
tacccatgtactagccagtgtcctg

SEQ ID NO: 247471 - DNA, 25 bp, Homo sapien
aattcaagtttttgtggctgcccct

SEQ ID NO: 247472 - DNA, 25 bp, Homo sapien
gtactagccagtgtcctgcatgggt

SEQ ID NO: 247473 - DNA, 25 bp, Homo sapien
ctgcccctcagggagaattaggcta

SEQ ID NO: 247474 - DNA, 25 bp, Homo sapien
gtgagtgatccaccaccaaaggcag

SEQ ID NO: 247475 - DNA, 25 bp, Homo sapien
ggcagctttggtaatcctagccaca

SEQ ID NO: 247476 - DNA, 25 bp, Homo sapien
ctctcagtgtagcttgccataccaa

SEQ ID NO: 247477 - DNA, 25 bp, Homo sapien
tagccacacatcaagcctcttaata

SEQ ID NO: 247478 - DNA, 25 bp, Homo sapien
tactcatattccttcgaacctctaa

SEQ ID NO: 247479 - DNA, 25 bp, Homo sapien
cagttacttgggttaaggcaggcac

SEQ ID NO: 247480 - DNA, 25 bp, Homo sapien
aaggcaggcactagtctccctggaa

SEQ ID NO: 247481 - DNA, 25 bp, Homo sapien
tggaacgcctgacctcttaaggagc

SEQ ID NO: 247482 - DNA, 25 bp, Homo sapien
gacctcttaaggagccatggcagaa

SEQ ID NO: 247483 - DNA, 25 bp, Homo sapien
taccaagatgttcctagagttcttt

SEQ ID NO: 247484 - DNA, 25 bp, Homo sapien
atcccagcaccatcactgggtgagt

SEQ ID NO: 247485 - DNA, 25 bp, Homo sapien
actaacagcagaatctacctcccaa

SEQ ID NO: 247486 - DNA, 25 bp, Homo sapien
tacctcccaactgccatgtgattaa

SEQ ID NO: 247487 - DNA, 25 bp, Homo sapien
ctcccaactgccatgtgattaagaa

SEQ ID NO: 247488 - DNA, 25 bp, Homo sapien
ttaagaaatgggtcttgagtcctgt

SEQ ID NO: 247489 - DNA, 25 bp, Homo sapien
gtcctgtgctgttggcaaagtgcca

SEQ ID NO: 247490 - DNA, 25 bp, Homo sapien
gctgttggcaaagtgccaggcacag

SEQ ID NO: 247491 - DNA, 25 bp, Homo sapien
gggtccttaacaagcgtgactttgc

SEQ ID NO: 247492 - DNA, 25 bp, Homo sapien
aagcgtgactttgctcattctgtca

SEQ ID NO: 247493 - DNA, 25 bp, Homo sapien
actttgctcattctgtcatcactaa

SEQ ID NO: 247494 - DNA, 25 bp, Homo sapien
gctcattctgtcatcactaaggcaa

SEQ ID NO: 247495 - DNA, 25 bp, Homo sapien
taaggcaataaacctttgccaggtg

SEQ ID NO: 247496 - DNA, 25 bp, Homo sapien
ctaaaagccattcagatagcagtaa

SEQ ID NO: 247497 - DNA, 25 bp, Homo sapien
gccattcagatagcagtaaaacatt

SEQ ID NO: 247498 - DNA, 25 bp, Homo sapien
cagtaaaacattctgtatgatgtgc

SEQ ID NO: 247499 - DNA, 25 bp, Homo sapien
gtgcaataaaacatccaagatcttt

SEQ ID NO: 247500 - DNA, 25 bp, Homo sapien
aaaggtgattggtacagggtgccta

SEQ ID NO: 247501 - DNA, 25 bp, Homo sapien
ggtacagggtgcctattttagtcat

SEQ ID NO: 247502 - DNA, 25 bp, Homo sapien
gggtgcctattttagtcatggatca

SEQ ID NO: 247503 - DNA, 25 bp, Homo sapien
tttagtcatggatcaaaatttgtgt

SEQ ID NO: 247504 - DNA, 25 bp, Homo sapien
aatttgtgtaacttgcagggctttc

SEQ ID NO: 247505 - DNA, 25 bp, Homo sapien
gtgtaacttgcagggctttctttct

SEQ ID NO: 247506 - DNA, 25 bp, Homo sapien
tttcttcaaatttacaagggttcat

SEQ ID NO: 247507 - DNA, 25 bp, Homo sapien
aagaagtcatgaatgctgaggaagc

SEQ ID NO: 247508 - DNA, 25 bp, Homo sapien
ccaatcccactgttcatttatcttt

SEQ ID NO: 247509 - DNA, 25 bp, Homo sapien
atttatctttatttgcatcagttag

SEQ ID NO: 247510 - DNA, 25 bp, Homo sapien
gcatcagttagactggttgtttaca

SEQ ID NO: 247511 - DNA, 25 bp, Homo sapien
gttgtttacaaagctaataccacca

SEQ ID NO: 247512 - DNA, 25 bp, Homo sapien
ataccaccataccactagtcaaaag

SEQ ID NO: 247513 - DNA, 25 bp, Homo sapien
ctagtcaaaagagagttccatacct

SEQ ID NO: 247514 - DNA, 25 bp, Homo sapien
gttccatacctttgctgacctagtg

SEQ ID NO: 247515 - DNA, 25 bp, Homo sapien
acctttgctgacctagtggtagacc

SEQ ID NO: 247516 - DNA, 25 bp, Homo sapien
gtggtagaccattcttctcaggcaa

SEQ ID NO: 247517 - DNA, 25 bp, Homo sapien
ctcaggcaaggttggctttttcaaa

SEQ ID NO: 247518 - DNA, 25 bp, Homo sapien
tgtcgtcttgggagtggaggaacct

SEQ ID NO: 247519 - DNA, 25 bp, Homo sapien
gagggaaaagcccagggacgagtca

SEQ ID NO: 247520 - DNA, 25 bp, Homo sapien
tctgccctggtgctcttgcacgtat

SEQ ID NO: 247521 - DNA, 25 bp, Homo sapien
gccctggtgctcttgcacgtatcca

SEQ ID NO: 247522 - DNA, 25 bp, Homo sapien
ttttcttaagcttatgagtgactta

SEQ ID NO: 247523 - DNA, 25 bp, Homo sapien
gcacgtatccacatgggccacagct

SEQ ID NO: 247524 - DNA, 25 bp, Homo sapien
cacgtatccacatgggccacagctg

SEQ ID NO: 247525 - DNA, 25 bp, Homo sapien
caggctccgctgaggtcaccttggg

SEQ ID NO: 247526 - DNA, 25 bp, Homo sapien
ccagagtccctgatggtgtcgtctt

SEQ ID NO: 247527 - DNA, 25 bp, Homo sapien
agagtccctgatggtgtcgtcttgg

SEQ ID NO: 247528 - DNA, 25 bp, Homo sapien
tccctgatggtgtcgtcttgggagt

SEQ ID NO: 247529 - DNA, 25 bp, Homo sapien
aagggtgtgagttactttgacttca

SEQ ID NO: 247530 - DNA, 25 bp, Homo sapien
tttgacttcaagacgtctcagtggc

SEQ ID NO: 247531 - DNA, 25 bp, Homo sapien
aagacgtctcagtggcggctggttc

SEQ ID NO: 247532 - DNA, 25 bp, Homo sapien
gaggctttatgctggagcacttcca

SEQ ID NO: 247533 - DNA, 25 bp, Homo sapien
ggagcacttccagcaaagttcggct

SEQ ID NO: 247534 - DNA, 25 bp, Homo sapien
ttaactcactggctggtcacccttg

SEQ ID NO: 247535 - DNA, 25 bp, Homo sapien
aagcctaaggcctcagttttcaacg

SEQ ID NO: 247536 - DNA, 25 bp, Homo sapien
aggcctcagttttcaacgctgtaaa

SEQ ID NO: 247537 - DNA, 25 bp, Homo sapien
acagcccgtgtgacaagtgcagcaa

SEQ ID NO: 247538 - DNA, 25 bp, Homo sapien
aagcaatgcaacttccttgggacct

SEQ ID NO: 247539 - DNA, 25 bp, Homo sapien
ttgtggtcccttgctttaaaagtat

SEQ ID NO: 247540 - DNA, 25 bp, Homo sapien
ctcagaacttactacaggagctggg

SEQ ID NO: 247541 - DNA, 25 bp, Homo sapien
caaaatcaagctgtgactccaagaa

SEQ ID NO: 247542 - DNA, 25 bp, Homo sapien
atcaagctgtgactccaagaagaag

SEQ ID NO: 247543 - DNA, 25 bp, Homo sapien
aagaagagggcatggccgttcgtta

SEQ ID NO: 247544 - DNA, 25 bp, Homo sapien
gcatggccgttcgttaggcaccaaa

SEQ ID NO: 247545 - DNA, 25 bp, Homo sapien
ttaggcaccaaataagctctcccag

SEQ ID NO: 247546 - DNA, 25 bp, Homo sapien
aaaagatttgcatcacatgctgatg

SEQ ID NO: 247547 - DNA, 25 bp, Homo sapien
atgctgatgcttacagcagccacag

SEQ ID NO: 247548 - DNA, 25 bp, Homo sapien
gactgccaagaccagtttggaccac

SEQ ID NO: 247549 - DNA, 25 bp, Homo sapien
gaccagtttggaccactcagaactt

SEQ ID NO: 247550 - DNA, 25 bp, Homo sapien
ggaccactcagaacttactacagga

SEQ ID NO: 247551 - DNA, 25 bp, Homo sapien
gtcctcagagcagcctcgcctgctg

SEQ ID NO: 247552 - DNA, 25 bp, Homo sapien
ccccactgggagaggcgccgtgcct

SEQ ID NO: 247553 - DNA, 25 bp, Homo sapien
tgtctgaacctcctcgcagggccaa

SEQ ID NO: 247554 - DNA, 25 bp, Homo sapien
tctgaacctcctcgcagggccaaag

SEQ ID NO: 247555 - DNA, 25 bp, Homo sapien
tgaacctcctcgcagggccaaaggc

SEQ ID NO: 247556 - DNA, 25 bp, Homo sapien
gaacctcctcgcagggccaaaggct

SEQ ID NO: 247557 - DNA, 25 bp, Homo sapien
gctgtgttgggcccattgtcccccg

SEQ ID NO: 247558 - DNA, 25 bp, Homo sapien
tgttccccagtgaagcccttgtggg

SEQ ID NO: 247559 - DNA, 25 bp, Homo sapien
ttccccagtgaagcccttgtgggaa

SEQ ID NO: 247560 - DNA, 25 bp, Homo sapien
ccagtgaagcccttgtgggaaggtt

SEQ ID NO: 247561 - DNA, 25 bp, Homo sapien
cagtgaagcccttgtgggaaggttc

SEQ ID NO: 247562 - DNA, 25 bp, Homo sapien
gggaaccatcttctaactggcagct

SEQ ID NO: 247563 - DNA, 25 bp, Homo sapien
ggcagctctgacaaaacggctagaa

SEQ ID NO: 247564 - DNA, 25 bp, Homo sapien
gaatctgggatgctcagactggcca

SEQ ID NO: 247565 - DNA, 25 bp, Homo sapien
tggccagtgcctccaggttcttgag

SEQ ID NO: 247566 - DNA, 25 bp, Homo sapien
catagtcattacaggcagcaaggat

SEQ ID NO: 247567 - DNA, 25 bp, Homo sapien
cctgtaggatatggcgttgactgaa

SEQ ID NO: 247568 - DNA, 25 bp, Homo sapien
aagctggtcagtgagcaaccttgct

SEQ ID NO: 247569 - DNA, 25 bp, Homo sapien
gagcaaccttgctagcaatggtaat

SEQ ID NO: 247570 - DNA, 25 bp, Homo sapien
ggtaatcaagaactggaacttcaca

SEQ ID NO: 247571 - DNA, 25 bp, Homo sapien
aacttcacagacagcagctctctta

SEQ ID NO: 247572 - DNA, 25 bp, Homo sapien
caaagatttctttcaaccctcaagg

SEQ ID NO: 247573 - DNA, 25 bp, Homo sapien
tataccagtaccaaactatgttaat

SEQ ID NO: 247574 - DNA, 25 bp, Homo sapien
taagtcctgtaacttattctcccaa

SEQ ID NO: 247575 - DNA, 25 bp, Homo sapien
tttggcttattctacggcctttgta

SEQ ID NO: 247576 - DNA, 25 bp, Homo sapien
tattctacggcctttgtatttctag

SEQ ID NO: 247577 - DNA, 25 bp, Homo sapien
ctacggcctttgtatttctaggtga

SEQ ID NO: 247578 - DNA, 25 bp, Homo sapien
cggcctttgtatttctaggtgaatt

SEQ ID NO: 247579 - DNA, 25 bp, Homo sapien
tagtatcttaacaacaagtccttca

SEQ ID NO: 247580 - DNA, 25 bp, Homo sapien
aacaacaagtccttcaatccatgaa

SEQ ID NO: 247581 - DNA, 25 bp, Homo sapien
caatccatgaatatcattcttcccc

SEQ ID NO: 247582 - DNA, 25 bp, Homo sapien
taagcggtctttaatttctcctggc

SEQ ID NO: 247583 - DNA, 25 bp, Homo sapien
cggtctttaatttctcctggcaata

SEQ ID NO: 247584 - DNA, 25 bp, Homo sapien
ctagaatcagggtacgtgggtgaat

SEQ ID NO: 247585 - DNA, 25 bp, Homo sapien
ctcctattcaacagattggcaagtc

SEQ ID NO: 247586 - DNA, 25 bp, Homo sapien
aataggtagttatgtccctcggctg

SEQ ID NO: 247587 - DNA, 25 bp, Homo sapien
gctgctccactgacatttcattttt

SEQ ID NO: 247588 - DNA, 25 bp, Homo sapien
agggagcactgggaaggccccatac

SEQ ID NO: 247589 - DNA, 25 bp, Homo sapien
gccccatacttcctatatgactgga

SEQ ID NO: 247590 - DNA, 25 bp, Homo sapien
atgactggagcacggaattctgcct

SEQ ID NO: 247591 - DNA, 25 bp, Homo sapien
gagcacggaattctgcctcccaggg

SEQ ID NO: 247592 - DNA, 25 bp, Homo sapien
ggacttctagatagacgcactctta

SEQ ID NO: 247593 - DNA, 25 bp, Homo sapien
gatagacgcactcttataatataag

SEQ ID NO: 247594 - DNA, 25 bp, Homo sapien
gttataacagacaagggctagaatc

SEQ ID NO: 247595 - DNA, 25 bp, Homo sapien
gtcctcagagcagcctcgcctgctg

SEQ ID NO: 247596 - DNA, 25 bp, Homo sapien
tgctgaccccactgggagaggcgcc

SEQ ID NO: 247597 - DNA, 25 bp, Homo sapien
cctggtgggagctccgctggctcct

SEQ ID NO: 247598 - DNA, 25 bp, Homo sapien
tgtctgaacctcctcgcagggccaa

SEQ ID NO: 247599 - DNA, 25 bp, Homo sapien
tgaacctcctcgcagggccaaaggc

SEQ ID NO: 247600 - DNA, 25 bp, Homo sapien
gaacctcctcgcagggccaaaggct

SEQ ID NO: 247601 - DNA, 25 bp, Homo sapien
tggcttggcctgtgtttcccctggc

SEQ ID NO: 247602 - DNA, 25 bp, Homo sapien
tgttccccagtgaagcccttgtggg

SEQ ID NO: 247603 - DNA, 25 bp, Homo sapien
ttccccagtgaagcccttgtgggaa

SEQ ID NO: 247604 - DNA, 25 bp, Homo sapien
ccagtgaagcccttgtgggaaggtt

SEQ ID NO: 247605 - DNA, 25 bp, Homo sapien
cagtgaagcccttgtgggaaggttc

SEQ ID NO: 247606 - DNA, 25 bp, Homo sapien
tctttctggttcactagcaatttga

SEQ ID NO: 247607 - DNA, 25 bp, Homo sapien
gttcactagcaatttgatttgccta

SEQ ID NO: 247608 - DNA, 25 bp, Homo sapien
gtgcaactttaggatcaagaagaag

SEQ ID NO: 247609 - DNA, 25 bp, Homo sapien
aatttcaatttgatgctataggcaa

SEQ ID NO: 247610 - DNA, 25 bp, Homo sapien
ctataggcaatagggagtcatggaa

SEQ ID NO: 247611 - DNA, 25 bp, Homo sapien
gagtcatggaaggttttagaccagt

SEQ ID NO: 247612 - DNA, 25 bp, Homo sapien
agaccagtgaagacataaccacaat

SEQ ID NO: 247613 - DNA, 25 bp, Homo sapien
ggatttgaacctttgcagtccgatc

SEQ ID NO: 247614 - DNA, 25 bp, Homo sapien
tttgcagtccgatctcagagtccat

SEQ ID NO: 247615 - DNA, 25 bp, Homo sapien
ccgatctcagagtccatgcacataa

SEQ ID NO: 247616 - DNA, 25 bp, Homo sapien
gagtccatgcacataaacactacat

SEQ ID NO: 247617 - DNA, 25 bp, Homo sapien
gcactgcctgctacttgagggccag

SEQ ID NO: 247618 - DNA, 25 bp, Homo sapien
tgtgtgcagggctgcatcccgcaga

SEQ ID NO: 247619 - DNA, 25 bp, Homo sapien
gcatcccgcagatggctggaatatt

SEQ ID NO: 247620 - DNA, 25 bp, Homo sapien
aaaattcttctatattggctggtaa

SEQ ID NO: 247621 - DNA, 25 bp, Homo sapien
ggctggtaaattgccatggccctga

SEQ ID NO: 247622 - DNA, 25 bp, Homo sapien
ggccctgagccactgagtatgttca

SEQ ID NO: 247623 - DNA, 25 bp, Homo sapien
gagtatgttcattgccacccctgtc

SEQ ID NO: 247624 - DNA, 25 bp, Homo sapien
cactttccctgatcctgcaattaaa

SEQ ID NO: 247625 - DNA, 25 bp, Homo sapien
atatggaagggactcccaggaccct

SEQ ID NO: 247626 - DNA, 25 bp, Homo sapien
tgcccagcttccatgctgactgatg

SEQ ID NO: 247627 - DNA, 25 bp, Homo sapien
gcttccatgctgactgatggttaaa

SEQ ID NO: 247628 - DNA, 25 bp, Homo sapien
tcgaacacatggcacgggaattatg

SEQ ID NO: 247629 - DNA, 25 bp, Homo sapien
cacatggcacgggaattatgaatac

SEQ ID NO: 247630 - DNA, 25 bp, Homo sapien
tggcacgggaattatgaatacaact

SEQ ID NO: 247631 - DNA, 25 bp, Homo sapien
ttatgaatacaactaaatgggcatt

SEQ ID NO: 247632 - DNA, 25 bp, Homo sapien
atacaactaaatgggcattcaccgc

SEQ ID NO: 247633 - DNA, 25 bp, Homo sapien
aactaaatgggcattcaccgcttgg

SEQ ID NO: 247634 - DNA, 25 bp, Homo sapien
actaaatgggcattcaccgcttggc

SEQ ID NO: 247635 - DNA, 25 bp, Homo sapien
ctaaatgggcattcaccgcttggcg

SEQ ID NO: 247636 - DNA, 25 bp, Homo sapien
taaatgggcattcaccgcttggcgt

SEQ ID NO: 247637 - DNA, 25 bp, Homo sapien
aaatgggcattcaccgcttggcgtg

SEQ ID NO: 247638 - DNA, 25 bp, Homo sapien
ggcattcaccgcttggcgtggtggc

SEQ ID NO: 247639 - DNA, 25 bp, Homo sapien
acaccaccatttccaatttcacaaa

SEQ ID NO: 247640 - DNA, 25 bp, Homo sapien
acttgctcaaggacacttatctcaa

SEQ ID NO: 247641 - DNA, 25 bp, Homo sapien
ggacacttatctcaataattggtaa

SEQ ID NO: 247642 - DNA, 25 bp, Homo sapien
tactactttttaagtgtgaagacac

SEQ ID NO: 247643 - DNA, 25 bp, Homo sapien
gacactgatattgccttcattttgg

SEQ ID NO: 247644 - DNA, 25 bp, Homo sapien
tcattttggcaaaacaaccatgtag

SEQ ID NO: 247645 - DNA, 25 bp, Homo sapien
atactagaagtcatcaacttaactg

SEQ ID NO: 247646 - DNA, 25 bp, Homo sapien
aacttaactgattttatttctcact

SEQ ID NO: 247647 - DNA, 25 bp, Homo sapien
tgctaatcttccaggttctgaagtg

SEQ ID NO: 247648 - DNA, 25 bp, Homo sapien
ccaggttctgaagtgtattaggcca

SEQ ID NO: 247649 - DNA, 25 bp, Homo sapien
ctgaagtgtattaggccatttttgc

SEQ ID NO: 247650 - DNA, 25 bp, Homo sapien
gatttttcttgataacattaacatt

SEQ ID NO: 247651 - DNA, 25 bp, Homo sapien
ttattttttcagacatactgtaatt

SEQ ID NO: 247652 - DNA, 25 bp, Homo sapien
taatgtgagcgtttgttttaagttc

SEQ ID NO: 247653 - DNA, 25 bp, Homo sapien
gagcgtttgttttaagttcacagaa

SEQ ID NO: 247654 - DNA, 25 bp, Homo sapien
acttaataattcaaattctcaggaa

SEQ ID NO: 247655 - DNA, 25 bp, Homo sapien
ttctcaggaattaaggactcaccat

SEQ ID NO: 247656 - DNA, 25 bp, Homo sapien
aggaattaaggactcaccataacat

SEQ ID NO: 247657 - DNA, 25 bp, Homo sapien
actcaccataacattgtcagttcta

SEQ ID NO: 247658 - DNA, 25 bp, Homo sapien
ttgtcagttctaatgaaattttgta

SEQ ID NO: 247659 - DNA, 25 bp, Homo sapien
gatggcaagtttgttacctcacttg

SEQ ID NO: 247660 - DNA, 25 bp, Homo sapien
aagtttgttacctcacttgagtggg

SEQ ID NO: 247661 - DNA, 25 bp, Homo sapien
caggtcttcaagtgtcggttttcca

SEQ ID NO: 247662 - DNA, 25 bp, Homo sapien
tcaagtgtcggttttccacgtactg

SEQ ID NO: 247663 - DNA, 25 bp, Homo sapien
cacgtactgtgaactttccaccttt

SEQ ID NO: 247664 - DNA, 25 bp, Homo sapien
gatagtcacttgaattccagttttt

SEQ ID NO: 247665 - DNA, 25 bp, Homo sapien
ttatacacactccttgctcctggca

SEQ ID NO: 247666 - DNA, 25 bp, Homo sapien
gctcctggcaaagcacttggctaca

SEQ ID NO: 247667 - DNA, 25 bp, Homo sapien
acttggctacacattttggctgcta

SEQ ID NO: 247668 - DNA, 25 bp, Homo sapien
ttggctgctagtgtgacgttgatta

SEQ ID NO: 247669 - DNA, 25 bp, Homo sapien
ggattcagtatagtctccatgtaat

SEQ ID NO: 247670 - DNA, 25 bp, Homo sapien
gcaagcaagatttcatacttcgcat

SEQ ID NO: 247671 - DNA, 25 bp, Homo sapien
ttcgcattatactgagggttcccca

SEQ ID NO: 247672 - DNA, 25 bp, Homo sapien
tcgaacacatggcacgggaattatg

SEQ ID NO: 247673 - DNA, 25 bp, Homo sapien
cgaacacatggcacgggaattatga

SEQ ID NO: 247674 - DNA, 25 bp, Homo sapien
gaacacatggcacgggaattatgaa

SEQ ID NO: 247675 - DNA, 25 bp, Homo sapien
aacacatggcacgggaattatgaat

SEQ ID NO: 247676 - DNA, 25 bp, Homo sapien
acacatggcacgggaattatgaata

SEQ ID NO: 247677 - DNA, 25 bp, Homo sapien
cacatggcacgggaattatgaatac

SEQ ID NO: 247678 - DNA, 25 bp, Homo sapien
acatggcacgggaattatgaataca

SEQ ID NO: 247679 - DNA, 25 bp, Homo sapien
catggcacgggaattatgaatacaa

SEQ ID NO: 247680 - DNA, 25 bp, Homo sapien
atggcacgggaattatgaatacaac

SEQ ID NO: 247681 - DNA, 25 bp, Homo sapien
tggcacgggaattatgaatacaact

SEQ ID NO: 247682 - DNA, 25 bp, Homo sapien
gtgtcagatttagacctgtggtttc

SEQ ID NO: 247683 - DNA, 25 bp, Homo sapien
tcagatttagacctgtggtttcaga

SEQ ID NO: 247684 - DNA, 25 bp, Homo sapien
aaacatgtttggcactataggtaaa

SEQ ID NO: 247685 - DNA, 25 bp, Homo sapien
caatgtttgagtgtgcttttggtaa

SEQ ID NO: 247686 - DNA, 25 bp, Homo sapien
taatgctgagctttctttaaatggc

SEQ ID NO: 247687 - DNA, 25 bp, Homo sapien
aaatggcttgtggagtcgtgaactt

SEQ ID NO: 247688 - DNA, 25 bp, Homo sapien
tgtggagtcgtgaacttttgctaat

SEQ ID NO: 247689 - DNA, 25 bp, Homo sapien
gtgaacttttgctaatgatgtggct

SEQ ID NO: 247690 - DNA, 25 bp, Homo sapien
gatgtggctccaaaaggtaatacat

SEQ ID NO: 247691 - DNA, 25 bp, Homo sapien
taacattagactttaactttctgta

SEQ ID NO: 247692 - DNA, 25 bp, Homo sapien
aaagtggacactgtaacacgtgtgg

SEQ ID NO: 247693 - DNA, 25 bp, Homo sapien
atttaattcctacgtacatgcgccc

SEQ ID NO: 247694 - DNA, 25 bp, Homo sapien
ggtgcctcagagaaatgcgctgaca

SEQ ID NO: 247695 - DNA, 25 bp, Homo sapien
ctctgtagagtgagctcaacgagct

SEQ ID NO: 247696 - DNA, 25 bp, Homo sapien
atgcgctgacaaatcttaaaggtgg

SEQ ID NO: 247697 - DNA, 25 bp, Homo sapien
catgacaaaagtccgcccgttattg

SEQ ID NO: 247698 - DNA, 25 bp, Homo sapien
ttattgctgctcaacagacccatca

SEQ ID NO: 247699 - DNA, 25 bp, Homo sapien
agacccatcaagtcacgctgttgga

SEQ ID NO: 247700 - DNA, 25 bp, Homo sapien
aagtcacgctgttggacaggcctcg

SEQ ID NO: 247701 - DNA, 25 bp, Homo sapien
aacgagctcaatgtgattccagtta

SEQ ID NO: 247702 - DNA, 25 bp, Homo sapien
tgggccttaagccaaatgcgcctaa

SEQ ID NO: 247703 - DNA, 25 bp, Homo sapien
cgcaacttgcctctctattatttat

SEQ ID NO: 247704 - DNA, 25 bp, Homo sapien
tcctttaaaaggcatccgtaggctg

SEQ ID NO: 247705 - DNA, 25 bp, Homo sapien
cctttaaaaggcatccgtaggctgc

SEQ ID NO: 247706 - DNA, 25 bp, Homo sapien
ctttaaaaggcatccgtaggctgcg

SEQ ID NO: 247707 - DNA, 25 bp, Homo sapien
tttaaaaggcatccgtaggctgcgt

SEQ ID NO: 247708 - DNA, 25 bp, Homo sapien
taaaaggcatccgtaggctgcgtgc

SEQ ID NO: 247709 - DNA, 25 bp, Homo sapien
aaaaggcatccgtaggctgcgtgca

SEQ ID NO: 247710 - DNA, 25 bp, Homo sapien
aaaggcatccgtaggctgcgtgcag

SEQ ID NO: 247711 - DNA, 25 bp, Homo sapien
aaggcatccgtaggctgcgtgcagt

SEQ ID NO: 247712 - DNA, 25 bp, Homo sapien
ggcatccgtaggctgcgtgcagtgg

SEQ ID NO: 247713 - DNA, 25 bp, Homo sapien
gcatccgtaggctgcgtgcagtggc

SEQ ID NO: 247714 - DNA, 25 bp, Homo sapien
catccgtaggctgcgtgcagtggct

SEQ ID NO: 247715 - DNA, 25 bp, Homo sapien
gcacagccagttctattcctttcaa

SEQ ID NO: 247716 - DNA, 25 bp, Homo sapien
gattgcttcgaggtatttttccagt

SEQ ID NO: 247717 - DNA, 25 bp, Homo sapien
gtggaggtccagaaagtacacactt

SEQ ID NO: 247718 - DNA, 25 bp, Homo sapien
gaaagtacacactttggaagcccgg

SEQ ID NO: 247719 - DNA, 25 bp, Homo sapien
gtaagaatcattccacttaagcccc

SEQ ID NO: 247720 - DNA, 25 bp, Homo sapien
ccccaacattagaccagtgcattcg

SEQ ID NO: 247721 - DNA, 25 bp, Homo sapien
agaccagtgcattcgtgtcaggaat

SEQ ID NO: 247722 - DNA, 25 bp, Homo sapien
tgttgtccaggcgagcaacctttaa

SEQ ID NO: 247723 - DNA, 25 bp, Homo sapien
aacctttaacttgtgctcctgcatg

SEQ ID NO: 247724 - DNA, 25 bp, Homo sapien
gaacgccttctccacagttgaagag

SEQ ID NO: 247725 - DNA, 25 bp, Homo sapien
cacagttgaagagataccggttgaa

SEQ ID NO: 247726 - DNA, 25 bp, Homo sapien
agcctatgccacacgtatttcttat

SEQ ID NO: 247727 - DNA, 25 bp, Homo sapien
tatgccacacgtatttcttatcacc

SEQ ID NO: 247728 - DNA, 25 bp, Homo sapien
tatttcttatcaccctcctttaagt

SEQ ID NO: 247729 - DNA, 25 bp, Homo sapien
tgctgcctgtggagtgtttagtttt

SEQ ID NO: 247730 - DNA, 25 bp, Homo sapien
gtttagttttaggtattatcgctga

SEQ ID NO: 247731 - DNA, 25 bp, Homo sapien
aggtattatcgctgaattttccact

SEQ ID NO: 247732 - DNA, 25 bp, Homo sapien
tatcgctgaattttccactttagaa

SEQ ID NO: 247733 - DNA, 25 bp, Homo sapien
tccactttagaaaatgatcgcttag

SEQ ID NO: 247734 - DNA, 25 bp, Homo sapien
gaaaatgatcgcttagctctctttt

SEQ ID NO: 247735 - DNA, 25 bp, Homo sapien
aaatgatcgcttagctctcttttcc

SEQ ID NO: 247736 - DNA, 25 bp, Homo sapien
atgatcgcttagctctcttttcctc

SEQ ID NO: 247737 - DNA, 25 bp, Homo sapien
cggcccacaaatctcagatcgttga

SEQ ID NO: 247738 - DNA, 25 bp, Homo sapien
ctcagatcgttgaaccttgctactt

SEQ ID NO: 247739 - DNA, 25 bp, Homo sapien
gctacttggtttttcataacagcag

SEQ ID NO: 247740 - DNA, 25 bp, Homo sapien
agcagaggcattccggagctcagca

SEQ ID NO: 247741 - DNA, 25 bp, Homo sapien
gaataattttcatcgttacccgcca

SEQ ID NO: 247742 - DNA, 25 bp, Homo sapien
atgacagtaaccacagtcccatctg

SEQ ID NO: 247743 - DNA, 25 bp, Homo sapien
tctccgagggctaccaccttgaagg

SEQ ID NO: 247744 - DNA, 25 bp, Homo sapien
accttgaaggccacgggcagggtct

SEQ ID NO: 247745 - DNA, 25 bp, Homo sapien
cagggtcttgttgcagcgccagtgc

SEQ ID NO: 247746 - DNA, 25 bp, Homo sapien
agggcagcaccgagcacaggaagtt

SEQ ID NO: 247747 - DNA, 25 bp, Homo sapien
gtcaaggtgaaactcttgcctcgtc

SEQ ID NO: 247748 - DNA, 25 bp, Homo sapien
gaagcaagtcccagagctgaggttc

SEQ ID NO: 247749 - DNA, 25 bp, Homo sapien
cagagctgaggttctatggaattag

SEQ ID NO: 247750 - DNA, 25 bp, Homo sapien
ggaaaaggccacattaagccctcct

SEQ ID NO: 247751 - DNA, 25 bp, Homo sapien
attaagccctcctttggctttcagc

SEQ ID NO: 247752 - DNA, 25 bp, Homo sapien
ccccatttcagatagaccgacaggc

SEQ ID NO: 247753 - DNA, 25 bp, Homo sapien
gatagaccgacaggcagacatgtgt

SEQ ID NO: 247754 - DNA, 25 bp, Homo sapien
aggcagacatgtgtcccctgctgtc

SEQ ID NO: 247755 - DNA, 25 bp, Homo sapien
gtccacatcaggcagggctggtcca

SEQ ID NO: 247756 - DNA, 25 bp, Homo sapien
cacttcctcttcagggtgacacctt

SEQ ID NO: 247757 - DNA, 25 bp, Homo sapien
tctcaggacctaagacgcaagggtc

SEQ ID NO: 247758 - DNA, 25 bp, Homo sapien
gacgcaagggtcctttctgaaagtt

SEQ ID NO: 247759 - DNA, 25 bp, Homo sapien
catatcatctttagagatagtgtat

SEQ ID NO: 247760 - DNA, 25 bp, Homo sapien
atatcatctttagagatagtgtata

SEQ ID NO: 247761 - DNA, 25 bp, Homo sapien
tatcatctttagagatagtgtataa

SEQ ID NO: 247762 - DNA, 25 bp, Homo sapien
atcatctttagagatagtgtataat

SEQ ID NO: 247763 - DNA, 25 bp, Homo sapien
catctttagagatagtgtataatta

SEQ ID NO: 247764 - DNA, 25 bp, Homo sapien
agagatagtgtataattagttctgt

SEQ ID NO: 247765 - DNA, 25 bp, Homo sapien
gagatagtgtataattagttctgtg

SEQ ID NO: 247766 - DNA, 25 bp, Homo sapien
agatagtgtataattagttctgtga

SEQ ID NO: 247767 - DNA, 25 bp, Homo sapien
gatagtgtataattagttctgtgaa

SEQ ID NO: 247768 - DNA, 25 bp, Homo sapien
atagtgtataattagttctgtgaag

SEQ ID NO: 247769 - DNA, 25 bp, Homo sapien
tagtgtataattagttctgtgaagt

SEQ ID NO: 247770 - DNA, 25 bp, Homo sapien
actaatattggttcatgtgcttgtg

SEQ ID NO: 247771 - DNA, 25 bp, Homo sapien
tattggttcatgtgcttgtgtatat

SEQ ID NO: 247772 - DNA, 25 bp, Homo sapien
aaatagaccctactgtactgtgctt

SEQ ID NO: 247773 - DNA, 25 bp, Homo sapien
agaccctactgtactgtgctttgga

SEQ ID NO: 247774 - DNA, 25 bp, Homo sapien
cctactgtactgtgctttggacatt

SEQ ID NO: 247775 - DNA, 25 bp, Homo sapien
gtactgtgctttggacatttgaatt

SEQ ID NO: 247776 - DNA, 25 bp, Homo sapien
aaatatatgtaatctgtgacttgat

SEQ ID NO: 247777 - DNA, 25 bp, Homo sapien
atctgtgacttgatattttgtttta

SEQ ID NO: 247778 - DNA, 25 bp, Homo sapien
aatctaaaatgtcttatgttatcag

SEQ ID NO: 247779 - DNA, 25 bp, Homo sapien
atgttatcagattatgctattttgt

SEQ ID NO: 247780 - DNA, 25 bp, Homo sapien
tcactggaccgacgttttaacaacg

SEQ ID NO: 247781 - DNA, 25 bp, Homo sapien
tagactgttgacgtcccctgggaag

SEQ ID NO: 247782 - DNA, 25 bp, Homo sapien
gaattggctgtgaaggatcctccct

SEQ ID NO: 247783 - DNA, 25 bp, Homo sapien
aggatcctccctgagactggcaagg

SEQ ID NO: 247784 - DNA, 25 bp, Homo sapien
tgagaacatggaaccggactccaag

SEQ ID NO: 247785 - DNA, 25 bp, Homo sapien
cggactccaagatgacgatctaaag

SEQ ID NO: 247786 - DNA, 25 bp, Homo sapien
gatgacgatctaaagacccgggagc

SEQ ID NO: 247787 - DNA, 25 bp, Homo sapien
gacgatctaaagacccgggagcgag

SEQ ID NO: 247788 - DNA, 25 bp, Homo sapien
taaagacccgggagcgagaagccaa

SEQ ID NO: 247789 - DNA, 25 bp, Homo sapien
gtgtagggcccagagaagcagaaca

SEQ ID NO: 247790 - DNA, 25 bp, Homo sapien
gcccagagaagcagaacagcccaga

SEQ ID NO: 247791 - DNA, 25 bp, Homo sapien
cctggcctagacctctggaattgag

SEQ ID NO: 247792 - DNA, 25 bp, Homo sapien
gtcacctggtttgacgttggtcact

SEQ ID NO: 247793 - DNA, 25 bp, Homo sapien
ttggtcactcctggcccaatacttt

SEQ ID NO: 247794 - DNA, 25 bp, Homo sapien
ccaatactttccacaatacctgcag

SEQ ID NO: 247795 - DNA, 25 bp, Homo sapien
atacctgcagcctcatggccaacga

SEQ ID NO: 247796 - DNA, 25 bp, Homo sapien
atggccaacgatcactgggaaagct

SEQ ID NO: 247797 - DNA, 25 bp, Homo sapien
aggccctcaaatttagaatcgataa

SEQ ID NO: 247798 - DNA, 25 bp, Homo sapien
gaatcgataacagtggcatcagtat

SEQ ID NO: 247799 - DNA, 25 bp, Homo sapien
aacctgctggttttgtcttccatta

SEQ ID NO: 247800 - DNA, 25 bp, Homo sapien
ggttttgtcttccattagttgttga

SEQ ID NO: 247801 - DNA, 25 bp, Homo sapien
gttgttgatcactagcaggactttt

SEQ ID NO: 247802 - DNA, 25 bp, Homo sapien
gattactgattttcccacacaaatt

SEQ ID NO: 247803 - DNA, 25 bp, Homo sapien
tcccttgaacttcccaacaccctca

SEQ ID NO: 247804 - DNA, 25 bp, Homo sapien
cttgaacttcccaacaccctcagcc

SEQ ID NO: 247805 - DNA, 25 bp, Homo sapien
ctcactcagcctccccaacctgaat

SEQ ID NO: 247806 - DNA, 25 bp, Homo sapien
cccaacctgaatctccagaattcga

SEQ ID NO: 247807 - DNA, 25 bp, Homo sapien
ccaacctgaatctccagaattcgat

SEQ ID NO: 247808 - DNA, 25 bp, Homo sapien
caacctgaatctccagaattcgatt

SEQ ID NO: 247809 - DNA, 25 bp, Homo sapien
aacctgaatctccagaattcgattt

SEQ ID NO: 247810 - DNA, 25 bp, Homo sapien
acctgaatctccagaattcgatttt

SEQ ID NO: 247811 - DNA, 25 bp, Homo sapien
cctgaatctccagaattcgattttt

SEQ ID NO: 247812 - DNA, 25 bp, Homo sapien
ctgaatctccagaattcgatttttt

SEQ ID NO: 247813 - DNA, 25 bp, Homo sapien
tgaatctccagaattcgatttttta

SEQ ID NO: 247814 - DNA, 25 bp, Homo sapien
gatgctggagaagttatcactcaga

SEQ ID NO: 247815 - DNA, 25 bp, Homo sapien
agaagttatcactcagagagagctg

SEQ ID NO: 247816 - DNA, 25 bp, Homo sapien
ggtgagcaacgaccttacggagcaa

SEQ ID NO: 247817 - DNA, 25 bp, Homo sapien
gagcaacgaccttacggagcaagca

SEQ ID NO: 247818 - DNA, 25 bp, Homo sapien
gaccttacggagcaagcagccacat

SEQ ID NO: 247819 - DNA, 25 bp, Homo sapien
tacggagcaagcagccacatttggg

SEQ ID NO: 247820 - DNA, 25 bp, Homo sapien
gtccttgacatatctgacctttgga

SEQ ID NO: 247821 - DNA, 25 bp, Homo sapien
ttgacatatctgacctttggaaagg

SEQ ID NO: 247822 - DNA, 25 bp, Homo sapien
atatctgacctttggaaaggagttc

SEQ ID NO: 247823 - DNA, 25 bp, Homo sapien
aaaaggcagccgtgatctctgctga

SEQ ID NO: 247824 - DNA, 25 bp, Homo sapien
aaggcagccgtgatctctgctgagg

SEQ ID NO: 247825 - DNA, 25 bp, Homo sapien
taagaagtatcaatgcatatcgagc

SEQ ID NO: 247826 - DNA, 25 bp, Homo sapien
gtatcaatgcatatcgagcaacatt

SEQ ID NO: 247827 - DNA, 25 bp, Homo sapien
aatgcatatcgagcaacattgggct

SEQ ID NO: 247828 - DNA, 25 bp, Homo sapien
gcatatcgagcaacattgggctcag

SEQ ID NO: 247829 - DNA, 25 bp, Homo sapien
tatcgagcaacattgggctcagagg

SEQ ID NO: 247830 - DNA, 25 bp, Homo sapien
gcaacattgggctcagaggattttg

SEQ ID NO: 247831 - DNA, 25 bp, Homo sapien
ttgggctcagaggattttgaaacac

SEQ ID NO: 247832 - DNA, 25 bp, Homo sapien
gggctcagaggattttgaaacactg

SEQ ID NO: 247833 - DNA, 25 bp, Homo sapien
aattttgcaaatggcttgtccaaaa

SEQ ID NO: 247834 - DNA, 25 bp, Homo sapien
gcaaatggcttgtccaaaatggaga

SEQ ID NO: 247835 - DNA, 25 bp, Homo sapien
aatggcttgtccaaaatggagaaaa

SEQ ID NO: 247836 - DNA, 25 bp, Homo sapien
tgaactgccatagatgctggaaaaa

SEQ ID NO: 247837 - DNA, 25 bp, Homo sapien
gaactgccatagatgctggaaaaaa

SEQ ID NO: 247838 - DNA, 25 bp, Homo sapien
gatgctggaaaaaaggaactgatgt

SEQ ID NO: 247839 - DNA, 25 bp, Homo sapien
tagtattcaacttttttcaggtaat

SEQ ID NO: 247840 - DNA, 25 bp, Homo sapien
gtattcaacttttttcaggtaatag

SEQ ID NO: 247841 - DNA, 25 bp, Homo sapien
ttcaacttttttcaggtaatagaag

SEQ ID NO: 247842 - DNA, 25 bp, Homo sapien
ttaccatgttaaattatagtgagat

SEQ ID NO: 247843 - DNA, 25 bp, Homo sapien
actgtgatgctatgtttgtttcact

SEQ ID NO: 247844 - DNA, 25 bp, Homo sapien
gatgctatgtttgtttcactaaact

SEQ ID NO: 247845 - DNA, 25 bp, Homo sapien
gctatgtttgtttcactaaactttc

SEQ ID NO: 247846 - DNA, 25 bp, Homo sapien
tatgtttgtttcactaaactttcta

SEQ ID NO: 247847 - DNA, 25 bp, Homo sapien
atgtgctggccgagatcccggagca

SEQ ID NO: 247848 - DNA, 25 bp, Homo sapien
tgctggccgagatcccggagcagct

SEQ ID NO: 247849 - DNA, 25 bp, Homo sapien
tatatgcgcaccagagacatccagc

SEQ ID NO: 247850 - DNA, 25 bp, Homo sapien
cagctccagagcagccctgaggatt

SEQ ID NO: 247851 - DNA, 25 bp, Homo sapien
agagcagccctgaggattccacata

SEQ ID NO: 247852 - DNA, 25 bp, Homo sapien
agcagccctgaggattccacatatc

SEQ ID NO: 247853 - DNA, 25 bp, Homo sapien
gccctgaggattccacatatccaat

SEQ ID NO: 247854 - DNA, 25 bp, Homo sapien
aggattccacatatccaatgcctca

SEQ ID NO: 247855 - DNA, 25 bp, Homo sapien
attccacatatccaatgcctcacag

SEQ ID NO: 247856 - DNA, 25 bp, Homo sapien
atatccaatgcctcacagtctgcaa

SEQ ID NO: 247857 - DNA, 25 bp, Homo sapien
atccaatgcctcacagtctgcaagc

SEQ ID NO: 247858 - DNA, 25 bp, Homo sapien
atagtcttggtgaggaattccccag

SEQ ID NO: 247859 - DNA, 25 bp, Homo sapien
gaattccccaggatataaatggcta

SEQ ID NO: 247860 - DNA, 25 bp, Homo sapien
aataattgacaagatgcagtgcctg

SEQ ID NO: 247861 - DNA, 25 bp, Homo sapien
agtgcctgccagtttatgacattaa

SEQ ID NO: 247862 - DNA, 25 bp, Homo sapien
atgacattaacttggtttgaaacta

SEQ ID NO: 247863 - DNA, 25 bp, Homo sapien
acatatgacatagtaccagtgcagt

SEQ ID NO: 247864 - DNA, 25 bp, Homo sapien
gtaccagtgcagtcagagctgccct

SEQ ID NO: 247865 - DNA, 25 bp, Homo sapien
gagctgcccttaggcatgatgaaca

SEQ ID NO: 247866 - DNA, 25 bp, Homo sapien
aacatgtggcccgtttttgcctggt

SEQ ID NO: 247867 - DNA, 25 bp, Homo sapien
tttttgcctggtgttttggcagcaa

SEQ ID NO: 247868 - DNA, 25 bp, Homo sapien
aagcaggaagcaattttgtgtgggt

SEQ ID NO: 247869 - DNA, 25 bp, Homo sapien
gtccctcatgcttgacttttggtgc

SEQ ID NO: 247870 - DNA, 25 bp, Homo sapien
catgcttgacttttggtgcctaggg

SEQ ID NO: 247871 - DNA, 25 bp, Homo sapien
gacttttggtgcctagggtcctgtt

SEQ ID NO: 247872 - DNA, 25 bp, Homo sapien
tagggtcctgttctcctggttagag

SEQ ID NO: 247873 - DNA, 25 bp, Homo sapien
ctcctggttagagggaacttggtgt

SEQ ID NO: 247874 - DNA, 25 bp, Homo sapien
agagggaacttggtgtgctcacact

SEQ ID NO: 247875 - DNA, 25 bp, Homo sapien
gtgctcacactgagggaaagtgaag

SEQ ID NO: 247876 - DNA, 25 bp, Homo sapien
tggccttcctgccttggtgcctgcg

SEQ ID NO: 247877 - DNA, 25 bp, Homo sapien
ggtgggtcccagacctgagagcaaa

SEQ ID NO: 247878 - DNA, 25 bp, Homo sapien
gagcaaagcgctgttctctgaagtg

SEQ ID NO: 247879 - DNA, 25 bp, Homo sapien
tgttctctgaagtgctttgtagctg

SEQ ID NO: 247880 - DNA, 25 bp, Homo sapien
ttgccattcacctgagacactaact

SEQ ID NO: 247881 - DNA, 25 bp, Homo sapien
tgagttgtgacagcctgtctctcta

SEQ ID NO: 247882 - DNA, 25 bp, Homo sapien
tacccaggtggtaatgcttagtgcc

SEQ ID NO: 247883 - DNA, 25 bp, Homo sapien
gcttagtgccattcccaatgtacat

SEQ ID NO: 247884 - DNA, 25 bp, Homo sapien
atgtctctgttgtggtatcttaata

SEQ ID NO: 247885 - DNA, 25 bp, Homo sapien
taatagatcctgtagttcccacatg

SEQ ID NO: 247886 - DNA, 25 bp, Homo sapien
gttcccacatgttttggtaactgtt

SEQ ID NO: 247887 - DNA, 25 bp, Homo sapien
gatgctggtgaatgctcaatccctt

SEQ ID NO: 247888 - DNA, 25 bp, Homo sapien
gctcaatcccttttcctggagagaa

SEQ ID NO: 247889 - DNA, 25 bp, Homo sapien
gagaagccattaagcctgctctgct

SEQ ID NO: 247890 - DNA, 25 bp, Homo sapien
gctgagctccatgagatcacatgtt

SEQ ID NO: 247891 - DNA, 25 bp, Homo sapien
cggactccaagatgacgatctaaag

SEQ ID NO: 247892 - DNA, 25 bp, Homo sapien
ggactccaagatgacgatctaaaga

SEQ ID NO: 247893 - DNA, 25 bp, Homo sapien
gactccaagatgacgatctaaagac

SEQ ID NO: 247894 - DNA, 25 bp, Homo sapien
tccaagatgacgatctaaagacccg

SEQ ID NO: 247895 - DNA, 25 bp, Homo sapien
caagatgacgatctaaagacccggg

SEQ ID NO: 247896 - DNA, 25 bp, Homo sapien
aagatgacgatctaaagacccggga

SEQ ID NO: 247897 - DNA, 25 bp, Homo sapien
agatgacgatctaaagacccgggag

SEQ ID NO: 247898 - DNA, 25 bp, Homo sapien
gatgacgatctaaagacccgggagc

SEQ ID NO: 247899 - DNA, 25 bp, Homo sapien
gacgatctaaagacccgggagcgag

SEQ ID NO: 247900 - DNA, 25 bp, Homo sapien
acgatctaaagacccgggagcgaga

SEQ ID NO: 247901 - DNA, 25 bp, Homo sapien
cgatctaaagacccgggagcgagaa

SEQ ID NO: 247902 - DNA, 25 bp, Homo sapien
ttatgaatacaactaaatgggcatt

SEQ ID NO: 247903 - DNA, 25 bp, Homo sapien
gaatacaactaaatgggcattcacc

SEQ ID NO: 247904 - DNA, 25 bp, Homo sapien
aatacaactaaatgggcattcaccg

SEQ ID NO: 247905 - DNA, 25 bp, Homo sapien
atacaactaaatgggcattcaccgc

SEQ ID NO: 247906 - DNA, 25 bp, Homo sapien
aactaaatgggcattcaccgcttgg

SEQ ID NO: 247907 - DNA, 25 bp, Homo sapien
actaaatgggcattcaccgcttggc

SEQ ID NO: 247908 - DNA, 25 bp, Homo sapien
ctaaatgggcattcaccgcttggcg

SEQ ID NO: 247909 - DNA, 25 bp, Homo sapien
taaatgggcattcaccgcttggcgt

SEQ ID NO: 247910 - DNA, 25 bp, Homo sapien
aaatgggcattcaccgcttggcgtg

SEQ ID NO: 247911 - DNA, 25 bp, Homo sapien
aatgggcattcaccgcttggcgtgg

SEQ ID NO: 247912 - DNA, 25 bp, Homo sapien
ggcattcaccgcttggcgtggtggc

SEQ ID NO: 247913 - DNA, 25 bp, Homo sapien
tgagatgtaggctccaccttaactg

SEQ ID NO: 247914 - DNA, 25 bp, Homo sapien
ccaccttaactgtgctcagatacac

SEQ ID NO: 247915 - DNA, 25 bp, Homo sapien
tgagggctttttaacttgattatgc

SEQ ID NO: 247916 - DNA, 25 bp, Homo sapien
attcatctgcaatttggcttcccta

SEQ ID NO: 247917 - DNA, 25 bp, Homo sapien
ggcttccctaacttaacattgcatc

SEQ ID NO: 247918 - DNA, 25 bp, Homo sapien
gaaactctttggaacaacagctatc

SEQ ID NO: 247919 - DNA, 25 bp, Homo sapien
gctatctagatagctgactcattct

SEQ ID NO: 247920 - DNA, 25 bp, Homo sapien
gactcattcttttggattgctacgt

SEQ ID NO: 247921 - DNA, 25 bp, Homo sapien
ggattgctacgtaatctcacttaat

SEQ ID NO: 247922 - DNA, 25 bp, Homo sapien
gaatcattgccttgttgatgggcct

SEQ ID NO: 247923 - DNA, 25 bp, Homo sapien
tgccttgttgatgggccttcagatt

SEQ ID NO: 247924 - DNA, 25 bp, Homo sapien
cggcacgaggcttcagcgctggcct

SEQ ID NO: 247925 - DNA, 25 bp, Homo sapien
gcctgggcttggctcttgaaccctt

SEQ ID NO: 247926 - DNA, 25 bp, Homo sapien
ctgggcttggctcttgaacccttcc

SEQ ID NO: 247927 - DNA, 25 bp, Homo sapien
ttggctcttgaacccttcccttgaa

SEQ ID NO: 247928 - DNA, 25 bp, Homo sapien
cccaacctgaatctccagaattcga

SEQ ID NO: 247929 - DNA, 25 bp, Homo sapien
caacctgaatctccagaattcgatt

SEQ ID NO: 247930 - DNA, 25 bp, Homo sapien
acctgaatctccagaattcgatttt

SEQ ID NO: 247931 - DNA, 25 bp, Homo sapien
tgaatctccagaattcgatttttta

SEQ ID NO: 247932 - DNA, 25 bp, Homo sapien
ccagaattcgattttttaaccatga

SEQ ID NO: 247933 - DNA, 25 bp, Homo sapien
ttttaaccatgaaccagaagatgct

SEQ ID NO: 247934 - DNA, 25 bp, Homo sapien
gaagatgctgaagccacacagaaca

SEQ ID NO: 247935 - DNA, 25 bp, Homo sapien
aaatcacctcctgacttaatccttt

SEQ ID NO: 247936 - DNA, 25 bp, Homo sapien
aggaaccggtattgcctagagcctc

SEQ ID NO: 247937 - DNA, 25 bp, Homo sapien
gaagcaaagtgcctatcagcagcgt

SEQ ID NO: 247938 - DNA, 25 bp, Homo sapien
aaagtgcctatcagcagcgttgcgt

SEQ ID NO: 247939 - DNA, 25 bp, Homo sapien
tatcagcagcgttgcgtcctctggg

SEQ ID NO: 247940 - DNA, 25 bp, Homo sapien
gggtgtgggctaaccttggccacca

SEQ ID NO: 247941 - DNA, 25 bp, Homo sapien
accaccacaaaaggaatgtgccaga

SEQ ID NO: 247942 - DNA, 25 bp, Homo sapien
atgtgccagaatgctgaaccttctt

SEQ ID NO: 247943 - DNA, 25 bp, Homo sapien
atgctgaaccttcttgttaatgcta

SEQ ID NO: 247944 - DNA, 25 bp, Homo sapien
gttaatgctatgaccgtgccttgaa

SEQ ID NO: 247945 - DNA, 25 bp, Homo sapien
tgctatgaccgtgccttgaataaac

SEQ ID NO: 247946 - DNA, 25 bp, Homo sapien
gttgtgtggtttgtagtcctgcgac

SEQ ID NO: 247947 - DNA, 25 bp, Homo sapien
gaaagcattgttacttacttgtgga

SEQ ID NO: 247948 - DNA, 25 bp, Homo sapien
attttcacatcccagagcatcatag

SEQ ID NO: 247949 - DNA, 25 bp, Homo sapien
gagcatcatagatagttccattaag

SEQ ID NO: 247950 - DNA, 25 bp, Homo sapien
tagtcctgcgacttttagtcctgat

SEQ ID NO: 247951 - DNA, 25 bp, Homo sapien
aatggttaacatggcatttctaaga

SEQ ID NO: 247952 - DNA, 25 bp, Homo sapien
cgacttttagtcctgatgttaatgt

SEQ ID NO: 247953 - DNA, 25 bp, Homo sapien
gttaatgtaacttgtcagacctgcg

SEQ ID NO: 247954 - DNA, 25 bp, Homo sapien
taacttgtcagacctgcgtttccgt

SEQ ID NO: 247955 - DNA, 25 bp, Homo sapien
tttccgtccttacctatggagctaa

SEQ ID NO: 247956 - DNA, 25 bp, Homo sapien
ggagctaaatcttgcccacaaactt

SEQ ID NO: 247957 - DNA, 25 bp, Homo sapien
tgaaacaccccattccagctattgt

SEQ ID NO: 247958 - DNA, 25 bp, Homo sapien
accccattccagctattgttatctg

SEQ ID NO: 247959 - DNA, 25 bp, Homo sapien
attagatggtgatttgacgtctggg

SEQ ID NO: 247960 - DNA, 25 bp, Homo sapien
gggaagttgcagatatagttttaat

SEQ ID NO: 247961 - DNA, 25 bp, Homo sapien
ttaatttactgtaggactagtggca

SEQ ID NO: 247962 - DNA, 25 bp, Homo sapien
ggactagtggcagtgagtctcatat

SEQ ID NO: 247963 - DNA, 25 bp, Homo sapien
agtgagtctcatattgctgtcatat

SEQ ID NO: 247964 - DNA, 25 bp, Homo sapien
ttcagtagcctaaagaccacgcttt

SEQ ID NO: 247965 - DNA, 25 bp, Homo sapien
agaccacgctttgagaaactcgtaa

SEQ ID NO: 247966 - DNA, 25 bp, Homo sapien
gaaactcgtaaaggtttgtcataga

SEQ ID NO: 247967 - DNA, 25 bp, Homo sapien
taattttaagctttagttgcctact

SEQ ID NO: 247968 - DNA, 25 bp, Homo sapien
gcgcccggcctagttgaggagtaaa

SEQ ID NO: 247969 - DNA, 25 bp, Homo sapien
tcaggttcttactaaacctcttcaa

SEQ ID NO: 247970 - DNA, 25 bp, Homo sapien
cctcttcaaagaaatggcagcatga

SEQ ID NO: 247971 - DNA, 25 bp, Homo sapien
ggcagcatgatgagctttgaaaatg

SEQ ID NO: 247972 - DNA, 25 bp, Homo sapien
agcagagaaggagggccccatgcac

SEQ ID NO: 247973 - DNA, 25 bp, Homo sapien
cacacacacccgaagaagaattgtg

SEQ ID NO: 247974 - DNA, 25 bp, Homo sapien
agaagaattgtgtttcgtggtaaca

SEQ ID NO: 247975 - DNA, 25 bp, Homo sapien
tgtttcgtggtaacacactaccctc

SEQ ID NO: 247976 - DNA, 25 bp, Homo sapien
gtggtaacacactaccctcaggttc

SEQ ID NO: 247977 - DNA, 25 bp, Homo sapien
taacacactaccctcaggttcagac

SEQ ID NO: 247978 - DNA, 25 bp, Homo sapien
aggttcagaccacactcaacctgtt

SEQ ID NO: 247979 - DNA, 25 bp, Homo sapien
tgataagtgacagtgccggtgcccc

SEQ ID NO: 247980 - DNA, 25 bp, Homo sapien
agcgcccttttacctgatggctcac

SEQ ID NO: 247981 - DNA, 25 bp, Homo sapien
gcccttccctttgaatcgtcttggg

SEQ ID NO: 247982 - DNA, 25 bp, Homo sapien
ttgaatcgtcttgggtaacgggtgc

SEQ ID NO: 247983 - DNA, 25 bp, Homo sapien
atgcctggaaggtcatgtcctttgt

SEQ ID NO: 247984 - DNA, 25 bp, Homo sapien
atggcttccagctgtggttgactga

SEQ ID NO: 247985 - DNA, 25 bp, Homo sapien
gaaattgtgatcaaccagaatccag

SEQ ID NO: 247986 - DNA, 25 bp, Homo sapien
agaaggccagacacaacttgcctca

SEQ ID NO: 247987 - DNA, 25 bp, Homo sapien
agaatccagaacacgctgtgcttaa

SEQ ID NO: 247988 - DNA, 25 bp, Homo sapien
aacacgctgtgcttaatggagtgaa

SEQ ID NO: 247989 - DNA, 25 bp, Homo sapien
atggagtgaactgcctgtgaagcgc

SEQ ID NO: 247990 - DNA, 25 bp, Homo sapien
agaaattgccccacaggaggtcact

SEQ ID NO: 247991 - DNA, 25 bp, Homo sapien
ggaccagagctgcagtacctacagg

SEQ ID NO: 247992 - DNA, 25 bp, Homo sapien
gttctcagagtctccggaatggcct

SEQ ID NO: 247993 - DNA, 25 bp, Homo sapien
aaccatatcaggactgaagtcacac

SEQ ID NO: 247994 - DNA, 25 bp, Homo sapien
actgtgtctctaaacgggctctgga

SEQ ID NO: 247995 - DNA, 25 bp, Homo sapien
tctggagtcagtgagccttggttta

SEQ ID NO: 247996 - DNA, 25 bp, Homo sapien
gtgagccttggtttaaatcccctat

SEQ ID NO: 247997 - DNA, 25 bp, Homo sapien
cttggtttaaatcccctatgcactc

SEQ ID NO: 247998 - DNA, 25 bp, Homo sapien
gaagtcacacttgtccagtttgcaa

SEQ ID NO: 247999 - DNA, 25 bp, Homo sapien
tatttcttgttttcacaaagctgag

SEQ ID NO: 248000 - DNA, 25 bp, Homo sapien
aaagctgagccttccacatgaggaa

SEQ ID NO: 248001 - DNA, 25 bp, Homo sapien
aacagaaatctgaacttatacaagt

SEQ ID NO: 248002 - DNA, 25 bp, Homo sapien
gcattttctgtcttgctactatctg

SEQ ID NO: 248003 - DNA, 25 bp, Homo sapien
gtcttgctactatctgcgtatatgt

SEQ ID NO: 248004 - DNA, 25 bp, Homo sapien
atctgcgtatatgtaacagcttttc

SEQ ID NO: 248005 - DNA, 25 bp, Homo sapien
catggattaaattttctttccacta

SEQ ID NO: 248006 - DNA, 25 bp, Homo sapien
aacagcttttctcaaggcttcaaga

SEQ ID NO: 248007 - DNA, 25 bp, Homo sapien
tttctcaaggcttcaagataggaat

SEQ ID NO: 248008 - DNA, 25 bp, Homo sapien
gataggaattgttttatgcctttgt

SEQ ID NO: 248009 - DNA, 25 bp, Homo sapien
tatgcctttgtatcacagacctaag

SEQ ID NO: 248010 - DNA, 25 bp, Homo sapien
gtatcacagacctaagagaccaaaa

SEQ ID NO: 248011 - DNA, 25 bp, Homo sapien
tctttccactaagtattaactatag

SEQ ID NO: 248012 - DNA, 25 bp, Homo sapien
gggacggtgccacttccagacaaga

SEQ ID NO: 248013 - DNA, 25 bp, Homo sapien
tgacgttggagagccagccagactc

SEQ ID NO: 248014 - DNA, 25 bp, Homo sapien
ttccagacaagacccacaaatctca

SEQ ID NO: 248015 - DNA, 25 bp, Homo sapien
acaaatctcaggtggagactctgcc

SEQ ID NO: 248016 - DNA, 25 bp, Homo sapien
tgccaccaagtctggaagaatcgtc

SEQ ID NO: 248017 - DNA, 25 bp, Homo sapien
aagaatcgtccacgtccacgagcga

SEQ ID NO: 248018 - DNA, 25 bp, Homo sapien
agagccagccagactcctcggagga

SEQ ID NO: 248019 - DNA, 25 bp, Homo sapien
cccgcggagaagcagtcatcatcat

SEQ ID NO: 248020 - DNA, 25 bp, Homo sapien
atcatcatccatggagtggctgctg

SEQ ID NO: 248021 - DNA, 25 bp, Homo sapien
gagaagtcagcatttttgaagccct

SEQ ID NO: 248022 - DNA, 25 bp, Homo sapien
gagctggcaaaaggagcctcacacc

SEQ ID NO: 248023 - DNA, 25 bp, Homo sapien
atcttggccccaatcttggcaggga

SEQ ID NO: 248024 - DNA, 25 bp, Homo sapien
ttggccccaatcttggcagggagag

SEQ ID NO: 248025 - DNA, 25 bp, Homo sapien
cgggcagggtcctcccgtctcagga

SEQ ID NO: 248026 - DNA, 25 bp, Homo sapien
aacgttctcaactgtatttgatttc

SEQ ID NO: 248027 - DNA, 25 bp, Homo sapien
ctcaactgtatttgatttctcctca

SEQ ID NO: 248028 - DNA, 25 bp, Homo sapien
gatttctcctcagccagagggggta

SEQ ID NO: 248029 - DNA, 25 bp, Homo sapien
ggtaaggtggccttcccagaagcac

SEQ ID NO: 248030 - DNA, 25 bp, Homo sapien
aggtggccttcccagaagcacaggt

SEQ ID NO: 248031 - DNA, 25 bp, Homo sapien
tcccagaagcacaggtgggccgcgt

SEQ ID NO: 248032 - DNA, 25 bp, Homo sapien
agaagcacaggtgggccgcgtgtca

SEQ ID NO: 248033 - DNA, 25 bp, Homo sapien
tgggccgcgtgtcagaggccctgga

SEQ ID NO: 248034 - DNA, 25 bp, Homo sapien
ggcaggtcatcgaccagtacagcat

SEQ ID NO: 248035 - DNA, 25 bp, Homo sapien
cacagctttcagttcccatgaaggt

SEQ ID NO: 248036 - DNA, 25 bp, Homo sapien
aaggtaggacagctctccaccagca

SEQ ID NO: 248037 - DNA, 25 bp, Homo sapien
accagcacacagtccggtgaggaaa

SEQ ID NO: 248038 - DNA, 25 bp, Homo sapien
acaccatctgttggtttgagataaa

SEQ ID NO: 248039 - DNA, 25 bp, Homo sapien
aacactactatttgttctctgccaa

SEQ ID NO: 248040 - DNA, 25 bp, Homo sapien
ggtttacctgatgagtacgcctttg

SEQ ID NO: 248041 - DNA, 25 bp, Homo sapien
tctgccaaatccaaatccccttgtt

SEQ ID NO: 248042 - DNA, 25 bp, Homo sapien
atgagtacgcctttgtcacaacctt

SEQ ID NO: 248043 - DNA, 25 bp, Homo sapien
aacctctcggaaggaagactggtat

SEQ ID NO: 248044 - DNA, 25 bp, Homo sapien
agactggtatatctggcaggtcatc

SEQ ID NO: 248045 - DNA, 25 bp, Homo sapien
gcaggcgttcggctttgaccagacc

SEQ ID NO: 248046 - DNA, 25 bp, Homo sapien
ttcggctttgaccagacctttcagt

SEQ ID NO: 248047 - DNA, 25 bp, Homo sapien
agacctttcagtcctatcggaagga

SEQ ID NO: 248048 - DNA, 25 bp, Homo sapien
ggatgatttcgttatggcttttttc

SEQ ID NO: 248049 - DNA, 25 bp, Homo sapien
atggcttttttcaaagacccaaatg

SEQ ID NO: 248050 - DNA, 25 bp, Homo sapien
caaagacccaaatgttattcccaat

SEQ ID NO: 248051 - DNA, 25 bp, Homo sapien
attcccaatttgaagttactttcag

SEQ ID NO: 248052 - DNA, 25 bp, Homo sapien
tcttctggacaatggatcatattag

SEQ ID NO: 248053 - DNA, 25 bp, Homo sapien
gaaatattcagccaaccagatagag

SEQ ID NO: 248054 - DNA, 25 bp, Homo sapien
cttccagtctctgagctctaaggag

SEQ ID NO: 248055 - DNA, 25 bp, Homo sapien
tgggcagaatcaaggcgcaggcgtt

SEQ ID NO: 248056 - DNA, 25 bp, Homo sapien
gcacccggccgggaatttatcaaag

SEQ ID NO: 248057 - DNA, 25 bp, Homo sapien
ttcaaacctgagtctagcacaatgc

SEQ ID NO: 248058 - DNA, 25 bp, Homo sapien
tcaaacctgagtctagcacaatgca

SEQ ID NO: 248059 - DNA, 25 bp, Homo sapien
tactcctacaaacccaagttctgac

SEQ ID NO: 248060 - DNA, 25 bp, Homo sapien
tacaaacccaagttctgactccttc

SEQ ID NO: 248061 - DNA, 25 bp, Homo sapien
tctgactccttccagggaagtatca

SEQ ID NO: 248062 - DNA, 25 bp, Homo sapien
tgactccttccagggaagtatcagc

SEQ ID NO: 248063 - DNA, 25 bp, Homo sapien
actccttccagggaagtatcagctt

SEQ ID NO: 248064 - DNA, 25 bp, Homo sapien
tccttccagggaagtatcagcttaa

SEQ ID NO: 248065 - DNA, 25 bp, Homo sapien
ccttccagggaagtatcagcttaag

SEQ ID NO: 248066 - DNA, 25 bp, Homo sapien
aacttgatcaggaaagtgacactgg

SEQ ID NO: 248067 - DNA, 25 bp, Homo sapien
gcacatctgaaaccatatgaagaaa

SEQ ID NO: 248068 - DNA, 25 bp, Homo sapien
ggagttagctccacaaaaacttctg

SEQ ID NO: 248069 - DNA, 25 bp, Homo sapien
caaaaacttctgctccgtctccaaa

SEQ ID NO: 248070 - DNA, 25 bp, Homo sapien
aggtcactgaatttggctgtggcac

SEQ ID NO: 248071 - DNA, 25 bp, Homo sapien
gagctgctgccaaaatatcccgatt

SEQ ID NO: 248072 - DNA, 25 bp, Homo sapien
ctgcccttggaaggcccctgagaga

SEQ ID NO: 248073 - DNA, 25 bp, Homo sapien
gaaggcccctgagagaggaccccaa

SEQ ID NO: 248074 - DNA, 25 bp, Homo sapien
gagagaggaccccaaaactccgctg

SEQ ID NO: 248075 - DNA, 25 bp, Homo sapien
aaaactccgctgacatgtggctgtg

SEQ ID NO: 248076 - DNA, 25 bp, Homo sapien
gctgtggcacgagatacactgtcat

SEQ ID NO: 248077 - DNA, 25 bp, Homo sapien
tgtcatggccaaaaactgctacaag

SEQ ID NO: 248078 - DNA, 25 bp, Homo sapien
accatactgggatttgggaacttct

SEQ ID NO: 248079 - DNA, 25 bp, Homo sapien
ccatactgggatttgggaacttctt

SEQ ID NO: 248080 - DNA, 25 bp, Homo sapien
catactgggatttgggaacttcttt

SEQ ID NO: 248081 - DNA, 25 bp, Homo sapien
gagttaaatatcattgatagtcttg

SEQ ID NO: 248082 - DNA, 25 bp, Homo sapien
gttaaatatcattgatagtcttgtg

SEQ ID NO: 248083 - DNA, 25 bp, Homo sapien
aaatatcattgatagtcttgtgtgt

SEQ ID NO: 248084 - DNA, 25 bp, Homo sapien
aatatcattgatagtcttgtgtgtc

SEQ ID NO: 248085 - DNA, 25 bp, Homo sapien
atatcattgatagtcttgtgtgtct

SEQ ID NO: 248086 - DNA, 25 bp, Homo sapien
tatcattgatagtcttgtgtgtctc

SEQ ID NO: 248087 - DNA, 25 bp, Homo sapien
atcattgatagtcttgtgtgtctca

SEQ ID NO: 248088 - DNA, 25 bp, Homo sapien
atttgcttttatctgagaatttctc

SEQ ID NO: 248089 - DNA, 25 bp, Homo sapien
aatcagctaattacgttaaaccatg

SEQ ID NO: 248090 - DNA, 25 bp, Homo sapien
gttaaaccatggtatctccctttat

SEQ ID NO: 248091 - DNA, 25 bp, Homo sapien
catggtatctccctttattgtgtta

SEQ ID NO: 248092 - DNA, 25 bp, Homo sapien
ctccctttattgtgttagactgaat

SEQ ID NO: 248093 - DNA, 25 bp, Homo sapien
aaagcattttattagcgctaggtgt

SEQ ID NO: 248094 - DNA, 25 bp, Homo sapien
tagcgctaggtgtgaacccgagcct

SEQ ID NO: 248095 - DNA, 25 bp, Homo sapien
acccgagccttttgctaaataccag

SEQ ID NO: 248096 - DNA, 25 bp, Homo sapien
ttcctagttctgtaaaaatcgctat

SEQ ID NO: 248097 - DNA, 25 bp, Homo sapien
aaatcgctatattgagtgttctcta

SEQ ID NO: 248098 - DNA, 25 bp, Homo sapien
ttgagtgttctctatcacttaataa

SEQ ID NO: 248099 - DNA, 25 bp, Homo sapien
gtggacttaaagatatgcagtgtat

SEQ ID NO: 248100 - DNA, 25 bp, Homo sapien
tggtcaggccgcacaatggccgagt

SEQ ID NO: 248101 - DNA, 25 bp, Homo sapien
tcaggccgcacaatggccgagtagg

SEQ ID NO: 248102 - DNA, 25 bp, Homo sapien
agtgcggcatctatactccaagcga

SEQ ID NO: 248103 - DNA, 25 bp, Homo sapien
gcggcatctatactccaagcgacta

SEQ ID NO: 248104 - DNA, 25 bp, Homo sapien
ggcatctatactccaagcgactaga

SEQ ID NO: 248105 - DNA, 25 bp, Homo sapien
tctatactccaagcgactagaccgg

SEQ ID NO: 248106 - DNA, 25 bp, Homo sapien
caagcgactagaccggagtgtctcc

SEQ ID NO: 248107 - DNA, 25 bp, Homo sapien
gactagaccggagtgtctcctacca

SEQ ID NO: 248108 - DNA, 25 bp, Homo sapien
gaccggagtgtctcctaccagctga

SEQ ID NO: 248109 - DNA, 25 bp, Homo sapien
ggagtgtctcctaccagctgagccc

SEQ ID NO: 248110 - DNA, 25 bp, Homo sapien
tggctgacctgaagcgccagcgagc

SEQ ID NO: 248111 - DNA, 25 bp, Homo sapien
tctgcttcatgggataggaccgtct

SEQ ID NO: 248112 - DNA, 25 bp, Homo sapien
tcatgggataggaccgtctctgtct

SEQ ID NO: 248113 - DNA, 25 bp, Homo sapien
ataggaccgtctctgtctgatcctg

SEQ ID NO: 248114 - DNA, 25 bp, Homo sapien
tctctgtctgatcctgtccattcgg

SEQ ID NO: 248115 - DNA, 25 bp, Homo sapien
ggaatcccacaacatcagctctgtg

SEQ ID NO: 248116 - DNA, 25 bp, Homo sapien
caagagggctcctcactatctaggg

SEQ ID NO: 248117 - DNA, 25 bp, Homo sapien
tcctcactatctagggagccctggg

SEQ ID NO: 248118 - DNA, 25 bp, Homo sapien
acaccccacgggaggagtggcatct

SEQ ID NO: 248119 - DNA, 25 bp, Homo sapien
acctggagcctgttacccgttagag

SEQ ID NO: 248120 - DNA, 25 bp, Homo sapien
tggagcctgttacccgttagagagc

SEQ ID NO: 248121 - DNA, 25 bp, Homo sapien
cctgttacccgttagagagctgaga

SEQ ID NO: 248122 - DNA, 25 bp, Homo sapien
ccattcaggtgtccgtgaattcacc

SEQ ID NO: 248123 - DNA, 25 bp, Homo sapien
gtgtccgtgaattcacctgcgagac

SEQ ID NO: 248124 - DNA, 25 bp, Homo sapien
cttcaagaggaagaaccacctggag

SEQ ID NO: 248125 - DNA, 25 bp, Homo sapien
gtgcgagatctgtggctaccagtgc

SEQ ID NO: 248126 - DNA, 25 bp, Homo sapien
atctgtggctaccagtgccggcagc

SEQ ID NO: 248127 - DNA, 25 bp, Homo sapien
agcgcgcgtcgctcaactggcacat

SEQ ID NO: 248128 - DNA, 25 bp, Homo sapien
atgaagaagcacactgcggaggtgc

SEQ ID NO: 248129 - DNA, 25 bp, Homo sapien
gcggaggtgcagtacaacttcacgt

SEQ ID NO: 248130 - DNA, 25 bp, Homo sapien
agtacaacttcacgtgcgatcgctg

SEQ ID NO: 248131 - DNA, 25 bp, Homo sapien
acttcacgtgcgatcgctgcgggaa

SEQ ID NO: 248132 - DNA, 25 bp, Homo sapien
agaagctggacagcgtcaagttcca

SEQ ID NO: 248133 - DNA, 25 bp, Homo sapien
gctcacatcctgtgcgcagcatctt

SEQ ID NO: 248134 - DNA, 25 bp, Homo sapien
gacatgtgcgtgcacttctttgatg

SEQ ID NO: 248135 - DNA, 25 bp, Homo sapien
tgcacttctttgatgtggagcgggc

SEQ ID NO: 248136 - DNA, 25 bp, Homo sapien
tgtcaacaagctgcagggccacagt

SEQ ID NO: 248137 - DNA, 25 bp, Homo sapien
acagtgcacctgtgcttgatgtcag

SEQ ID NO: 248138 - DNA, 25 bp, Homo sapien
gcttgatgtcagcttcaactgcgac

SEQ ID NO: 248139 - DNA, 25 bp, Homo sapien
ttcaactgcgacgagagcctactgg

SEQ ID NO: 248140 - DNA, 25 bp, Homo sapien
cgacgagagcctactggcctccagt

SEQ ID NO: 248141 - DNA, 25 bp, Homo sapien
acgccagcggcatggtcatcgtctg

SEQ ID NO: 248142 - DNA, 25 bp, Homo sapien
agcagaagtagggtcctgtcggccc

SEQ ID NO: 248143 - DNA, 25 bp, Homo sapien
aagtagggtcctgtcggccctgctg

SEQ ID NO: 248144 - DNA, 25 bp, Homo sapien
ggaaaagaaagctcccacatttcta

SEQ ID NO: 248145 - DNA, 25 bp, Homo sapien
gaaaagaaagctcccacatttctat

SEQ ID NO: 248146 - DNA, 25 bp, Homo sapien
aagaaagctcccacatttctattta

SEQ ID NO: 248147 - DNA, 25 bp, Homo sapien
gaaagctcccacatttctatttatg

SEQ ID NO: 248148 - DNA, 25 bp, Homo sapien
aaagctcccacatttctatttatgc

SEQ ID NO: 248149 - DNA, 25 bp, Homo sapien
aagctcccacatttctatttatgct

SEQ ID NO: 248150 - DNA, 25 bp, Homo sapien
ttctatttatgctaacttcaagtgg

SEQ ID NO: 248151 - DNA, 25 bp, Homo sapien
ctatttatgctaacttcaagtggaa

SEQ ID NO: 248152 - DNA, 25 bp, Homo sapien
atttatgctaacttcaagtggaatt

SEQ ID NO: 248153 - DNA, 25 bp, Homo sapien
agtcaggaagactaagtagcatatt

SEQ ID NO: 248154 - DNA, 25 bp, Homo sapien
acagccacccagaccggagactcgg

SEQ ID NO: 248155 - DNA, 25 bp, Homo sapien
tccgccgaaaaccacgagagggttg

SEQ ID NO: 248156 - DNA, 25 bp, Homo sapien
gaaaaccacgagagggttgctactt

SEQ ID NO: 248157 - DNA, 25 bp, Homo sapien
ccacgagagggttgctacttgtata

SEQ ID NO: 248158 - DNA, 25 bp, Homo sapien
acgagagggttgctacttgtatatg

SEQ ID NO: 248159 - DNA, 25 bp, Homo sapien
atgagatgcagtagtaatcaccctc

SEQ ID NO: 248160 - DNA, 25 bp, Homo sapien
gagatgcagtagtaatcaccctcgt

SEQ ID NO: 248161 - DNA, 25 bp, Homo sapien
gatgcagtagtaatcaccctcgtcg

SEQ ID NO: 248162 - DNA, 25 bp, Homo sapien
atgcagtagtaatcaccctcgtcgt

SEQ ID NO: 248163 - DNA, 25 bp, Homo sapien
cagtagtaatcaccctcgtcgtcag

SEQ ID NO: 248164 - DNA, 25 bp, Homo sapien
tagtaatcaccctcgtcgtcagcct

SEQ ID NO: 248165 - DNA, 25 bp, Homo sapien
aatcaccctcgtcgtcagcctggag

SEQ ID NO: 248166 - DNA, 25 bp, Homo sapien
gctgtttttaggagacttttagcag

SEQ ID NO: 248167 - DNA, 25 bp, Homo sapien
ttaggagacttttagcaggacagga

SEQ ID NO: 248168 - DNA, 25 bp, Homo sapien
agcaggacaggagcttacctctcat

SEQ ID NO: 248169 - DNA, 25 bp, Homo sapien
aggacaggagcttacctctcatcta

SEQ ID NO: 248170 - DNA, 25 bp, Homo sapien
ttacctctcatctacctctgcttgg

SEQ ID NO: 248171 - DNA, 25 bp, Homo sapien
cctctgcttggacaaaccagtgatg

SEQ ID NO: 248172 - DNA, 25 bp, Homo sapien
gcttggacaaaccagtgatgtgatt

SEQ ID NO: 248173 - DNA, 25 bp, Homo sapien
gtgatttgcaaataggctgtaactt

SEQ ID NO: 248174 - DNA, 25 bp, Homo sapien
actttcagagaatttgacctaactt

SEQ ID NO: 248175 - DNA, 25 bp, Homo sapien
cagagaatttgacctaacttagaat

SEQ ID NO: 248176 - DNA, 25 bp, Homo sapien
gtaaaagagaaaagcattgtcctta

SEQ ID NO: 248177 - DNA, 25 bp, Homo sapien
gcattacataaatcactctgataac

SEQ ID NO: 248178 - DNA, 25 bp, Homo sapien
actctgataacataagtgcacagta

SEQ ID NO: 248179 - DNA, 25 bp, Homo sapien
gtgcacagtaatatgcctgatctct

SEQ ID NO: 248180 - DNA, 25 bp, Homo sapien
agtaatatgcctgatctcttccttt

SEQ ID NO: 248181 - DNA, 25 bp, Homo sapien
aatatgcctgatctcttccttttta

SEQ ID NO: 248182 - DNA, 25 bp, Homo sapien
ttaaaagccaacttgagttcagtac

SEQ ID NO: 248183 - DNA, 25 bp, Homo sapien
gagttcagtaccatctgaatacaca

SEQ ID NO: 248184 - DNA, 25 bp, Homo sapien
cagactcaacagattcaagtactct

SEQ ID NO: 248185 - DNA, 25 bp, Homo sapien
gattcaagtactctgcttactctaa

SEQ ID NO: 248186 - DNA, 25 bp, Homo sapien
gcttactctaattgactagactcta

SEQ ID NO: 248187 - DNA, 25 bp, Homo sapien
aattgactagactctaggttttatt

SEQ ID NO: 248188 - DNA, 25 bp, Homo sapien
agataaagttggctcagattgatta

SEQ ID NO: 248189 - DNA, 25 bp, Homo sapien
ggctcagattgattatcatccttat

SEQ ID NO: 248190 - DNA, 25 bp, Homo sapien
gattgattatcatccttattatctc

SEQ ID NO: 248191 - DNA, 25 bp, Homo sapien
ttatctctataatctgtgtttcatt

SEQ ID NO: 248192 - DNA, 25 bp, Homo sapien
gtgtttcatttcacaagggctagat

SEQ ID NO: 248193 - DNA, 25 bp, Homo sapien
gggaaatcggtgaaagactagacta

SEQ ID NO: 248194 - DNA, 25 bp, Homo sapien
tcagtaatatctagttttgcagtta

SEQ ID NO: 248195 - DNA, 25 bp, Homo sapien
gcatttaaaagattcctcatgtaga

SEQ ID NO: 248196 - DNA, 25 bp, Homo sapien
gattcctcatgtagagtgatatcct

SEQ ID NO: 248197 - DNA, 25 bp, Homo sapien
gagtgatatcctaatatccttgcat

SEQ ID NO: 248198 - DNA, 25 bp, Homo sapien
gcattgttttctgagatgccggttt

SEQ ID NO: 248199 - DNA, 25 bp, Homo sapien
gttagaataatttcagacccaataa

SEQ ID NO: 248200 - DNA, 25 bp, Homo sapien
cagacccaataaggaatttcgatta

SEQ ID NO: 248201 - DNA, 25 bp, Homo sapien
atcataattacctagatgcctctta

SEQ ID NO: 248202 - DNA, 25 bp, Homo sapien
gaaatttcacaaaactgcctggcac

SEQ ID NO: 248203 - DNA, 25 bp, Homo sapien
aaactgcctggcacacaagcacaca

SEQ ID NO: 248204 - DNA, 25 bp, Homo sapien
aatctcttgatattagaagttgcat

SEQ ID NO: 248205 - DNA, 25 bp, Homo sapien
gaagatttcagagacccattctaaa

SEQ ID NO: 248206 - DNA, 25 bp, Homo sapien
taaacaagggcattcactctctgga

SEQ ID NO: 248207 - DNA, 25 bp, Homo sapien
aagggcattcactctctggaagtag

SEQ ID NO: 248208 - DNA, 25 bp, Homo sapien
ctctctggaagtagcatggccttgt

SEQ ID NO: 248209 - DNA, 25 bp, Homo sapien
tggaagtagcatggccttgtgaact

SEQ ID NO: 248210 - DNA, 25 bp, Homo sapien
aacttacttgagtaggtatctttca

SEQ ID NO: 248211 - DNA, 25 bp, Homo sapien
ggtatctttcagacaaagctgcatg

SEQ ID NO: 248212 - DNA, 25 bp, Homo sapien
aaagctgcatggcttcatgtacaat

SEQ ID NO: 248213 - DNA, 25 bp, Homo sapien
ggcttcatgtacaatagtccccaga

SEQ ID NO: 248214 - DNA, 25 bp, Homo sapien
atgtacaatagtccccagatcacct

SEQ ID NO: 248215 - DNA, 25 bp, Homo sapien
agatcacctcgcactgtagtttgct

SEQ ID NO: 248216 - DNA, 25 bp, Homo sapien
acctcgcactgtagtttgctcaaga

SEQ ID NO: 248217 - DNA, 25 bp, Homo sapien
agtttgctcaagaaggagcctacag

SEQ ID NO: 248218 - DNA, 25 bp, Homo sapien
ttaacaggtctgtctgtaagagcat

SEQ ID NO: 248219 - DNA, 25 bp, Homo sapien
atgccactggaaacacccatccaat

SEQ ID NO: 248220 - DNA, 25 bp, Homo sapien
catccaatttgggacccctggaaga

SEQ ID NO: 248221 - DNA, 25 bp, Homo sapien
ttggaaaaggcgcaggtgcccttct

SEQ ID NO: 248222 - DNA, 25 bp, Homo sapien
caggtgcccttcttgtttattgttg

SEQ ID NO: 248223 - DNA, 25 bp, Homo sapien
gttggcatggatgatcaaagctgga

SEQ ID NO: 248224 - DNA, 25 bp, Homo sapien
gaattctatgctcagatagcctctg

SEQ ID NO: 248225 - DNA, 25 bp, Homo sapien
gttacccagaaactggtcactgtat

SEQ ID NO: 248226 - DNA, 25 bp, Homo sapien
tcactgtattgacccaccttatttt

SEQ ID NO: 248227 - DNA, 25 bp, Homo sapien
ttattttcctccttctagagcttct

SEQ ID NO: 248228 - DNA, 25 bp, Homo sapien
tctagagcttctgtgcacgctgttt

SEQ ID NO: 248229 - DNA, 25 bp, Homo sapien
tttctcacttttatggacacttgga

SEQ ID NO: 248230 - DNA, 25 bp, Homo sapien
ggacacttggagcaatccactggag

SEQ ID NO: 248231 - DNA, 25 bp, Homo sapien
gcaatccactggaggaacacaatca

SEQ ID NO: 248232 - DNA, 25 bp, Homo sapien
gtggatcgaatcctgtcccagacag

SEQ ID NO: 248233 - DNA, 25 bp, Homo sapien
agccaatgatctgcgcaagcagtgt

SEQ ID NO: 248234 - DNA, 25 bp, Homo sapien
gtgatgtggtggacacggcattcaa

SEQ ID NO: 248235 - DNA, 25 bp, Homo sapien
ccagggacaagctggctgatcatct

SEQ ID NO: 248236 - DNA, 25 bp, Homo sapien
ggctgatcatctggccaaggtcatg

SEQ ID NO: 248237 - DNA, 25 bp, Homo sapien
gaagagattgcttcccaggagaaaa

SEQ ID NO: 248238 - DNA, 25 bp, Homo sapien
acagctcttgaaaaggccatccttg

SEQ ID NO: 248239 - DNA, 25 bp, Homo sapien
gccatccttgaccaagaagggccag

SEQ ID NO: 248240 - DNA, 25 bp, Homo sapien
aaggtggctcatacgcgcttggaga

SEQ ID NO: 248241 - DNA, 25 bp, Homo sapien
ttggagaccaggacacaccggccga

SEQ ID NO: 248242 - DNA, 25 bp, Homo sapien
caccggccgaacgtggagctgtgtc

SEQ ID NO: 248243 - DNA, 25 bp, Homo sapien
gcaggaaaagaaagctcccacattt

SEQ ID NO: 248244 - DNA, 25 bp, Homo sapien
gaaagctcccacatttctatttatg

SEQ ID NO: 248245 - DNA, 25 bp, Homo sapien
tctatttatgctaacttcaagtgga

SEQ ID NO: 248246 - DNA, 25 bp, Homo sapien
agtcaggaagactaagtagcatatt

SEQ ID NO: 248247 - DNA, 25 bp, Homo sapien
taactgtaagagcaaccacatgtag

SEQ ID NO: 248248 - DNA, 25 bp, Homo sapien
aactgtaagagcaaccacatgtagc

SEQ ID NO: 248249 - DNA, 25 bp, Homo sapien
actgtaagagcaaccacatgtagct

SEQ ID NO: 248250 - DNA, 25 bp, Homo sapien
gcaaccacatgtagctagagactat

SEQ ID NO: 248251 - DNA, 25 bp, Homo sapien
acatgtagctagagactattatacc

SEQ ID NO: 248252 - DNA, 25 bp, Homo sapien
gactattataccagacagagcagcc

SEQ ID NO: 248253 - DNA, 25 bp, Homo sapien
agacagagcagcctagatcttctcc

SEQ ID NO: 248254 - DNA, 25 bp, Homo sapien
aaacattcacatttcacttcacaca

SEQ ID NO: 248255 - DNA, 25 bp, Homo sapien
ttgaccacttgcttgccctttgctg

SEQ ID NO: 248256 - DNA, 25 bp, Homo sapien
tttctcttcctatttaagcacatac

SEQ ID NO: 248257 - DNA, 25 bp, Homo sapien
tatttaagcacatacatccaaccac

SEQ ID NO: 248258 - DNA, 25 bp, Homo sapien
tacatccaaccacactcaatcaaat

SEQ ID NO: 248259 - DNA, 25 bp, Homo sapien
tcaaatccctgactgctccatgtga

SEQ ID NO: 248260 - DNA, 25 bp, Homo sapien
gagagttctgcttccagcatgacgt

SEQ ID NO: 248261 - DNA, 25 bp, Homo sapien
gcttccagcatgacgtggtctgaaa

SEQ ID NO: 248262 - DNA, 25 bp, Homo sapien
ttcatctgaagacagctgctcactc

SEQ ID NO: 248263 - DNA, 25 bp, Homo sapien
tcaaccactgtcttcaacagcggag

SEQ ID NO: 248264 - DNA, 25 bp, Homo sapien
aacagcggagggtcccagatgctgc

SEQ ID NO: 248265 - DNA, 25 bp, Homo sapien
gggattaacagcttcttgggaagtc

SEQ ID NO: 248266 - DNA, 25 bp, Homo sapien
gaataagctctatgagacctgcaag

SEQ ID NO: 248267 - DNA, 25 bp, Homo sapien
gggatcagaactgctcccagtggaa

SEQ ID NO: 248268 - DNA, 25 bp, Homo sapien
tgctcccagtggaaagtagatgcca

SEQ ID NO: 248269 - DNA, 25 bp, Homo sapien
gatgccacagtgatgtagctctgaa

SEQ ID NO: 248270 - DNA, 25 bp, Homo sapien
gaaagagagtgcaccaggacaagga

SEQ ID NO: 248271 - DNA, 25 bp, Homo sapien
caggacaaggagaagttcctctttt

SEQ ID NO: 248272 - DNA, 25 bp, Homo sapien
atgagacctgcaagttactggacac

SEQ ID NO: 248273 - DNA, 25 bp, Homo sapien
aactagacataacacatgctggttg

SEQ ID NO: 248274 - DNA, 25 bp, Homo sapien
cacattttgaatgccttccaagaag

SEQ ID NO: 248275 - DNA, 25 bp, Homo sapien
gccttccaagaagaacggtccagta

SEQ ID NO: 248276 - DNA, 25 bp, Homo sapien
agcagtatttacaacagagggtaca

SEQ ID NO: 248277 - DNA, 25 bp, Homo sapien
tacaacagagggtacaagttctatc

SEQ ID NO: 248278 - DNA, 25 bp, Homo sapien
aaaaggagggactatggcatcaaac

SEQ ID NO: 248279 - DNA, 25 bp, Homo sapien
atggcatcaaacagcctcttcagca

SEQ ID NO: 248280 - DNA, 25 bp, Homo sapien
atcaaacagcctcttcagcacagtg

SEQ ID NO: 248281 - DNA, 25 bp, Homo sapien
agcacagtgacaccatgtcagcaaa

SEQ ID NO: 248282 - DNA, 25 bp, Homo sapien
gacaccatgtcagcaaaacttcttt

SEQ ID NO: 248283 - DNA, 25 bp, Homo sapien
ccatgtcagcaaaacttcttttggg

SEQ ID NO: 248284 - DNA, 25 bp, Homo sapien
caagaagtctctggtttttaaatgg

SEQ ID NO: 248285 - DNA, 25 bp, Homo sapien
taccagccaccgagaccaacagagt

SEQ ID NO: 248286 - DNA, 25 bp, Homo sapien
gccaccgagaccaacagagtcattt

SEQ ID NO: 248287 - DNA, 25 bp, Homo sapien
tatccaaacgcgcattcttcaccaa

SEQ ID NO: 248288 - DNA, 25 bp, Homo sapien
ttcttcaccaagacctgaggcacag

SEQ ID NO: 248289 - DNA, 25 bp, Homo sapien
aagacctgaggcacagacacctggt

SEQ ID NO: 248290 - DNA, 25 bp, Homo sapien
agacacctggtgagtgaggcttcaa

SEQ ID NO: 248291 - DNA, 25 bp, Homo sapien
caagggagatgctctttgtcctggg

SEQ ID NO: 248292 - DNA, 25 bp, Homo sapien
gaaaccgtacctgcagcaaggcata

SEQ ID NO: 248293 - DNA, 25 bp, Homo sapien
actcctggtgaaaagaacatgcctc

SEQ ID NO: 248294 - DNA, 25 bp, Homo sapien
gaacatgcctcaaaactactctttt

SEQ ID NO: 248295 - DNA, 25 bp, Homo sapien
actcttttgccactcgttaaccact

SEQ ID NO: 248296 - DNA, 25 bp, Homo sapien
cactcgttaaccacttccgtttgtg

SEQ ID NO: 248297 - DNA, 25 bp, Homo sapien
cttgaaccctgtgcccatcaaaaaa

SEQ ID NO: 248298 - DNA, 25 bp, Homo sapien
gggagcagaagagggaacactcttt

SEQ ID NO: 248299 - DNA, 25 bp, Homo sapien
gagggaacactctttgtacccattt

SEQ ID NO: 248300 - DNA, 25 bp, Homo sapien
gggaacactctttgtacccatttct

SEQ ID NO: 248301 - DNA, 25 bp, Homo sapien
gaacactctttgtacccatttctag

SEQ ID NO: 248302 - DNA, 25 bp, Homo sapien
acactctttgtacccatttctagcg

SEQ ID NO: 248303 - DNA, 25 bp, Homo sapien
tctttgtacccatttctagcgccag

SEQ ID NO: 248304 - DNA, 25 bp, Homo sapien
tttgtacccatttctagcgccaggc

SEQ ID NO: 248305 - DNA, 25 bp, Homo sapien
tgtacccatttctagcgccaggctg

SEQ ID NO: 248306 - DNA, 25 bp, Homo sapien
tacccatttctagcgccaggctgtt

SEQ ID NO: 248307 - DNA, 25 bp, Homo sapien
atttctagcgccaggctgttggccc

SEQ ID NO: 248308 - DNA, 25 bp, Homo sapien
tctagcgccaggctgttggcccact

SEQ ID NO: 248309 - DNA, 25 bp, Homo sapien
aagataactgcgaggtataaagaac

SEQ ID NO: 248310 - DNA, 25 bp, Homo sapien
agattctactcctcaggcctcaaat

SEQ ID NO: 248311 - DNA, 25 bp, Homo sapien
attctactcctcaggcctcaaatgt

SEQ ID NO: 248312 - DNA, 25 bp, Homo sapien
ttctactcctcaggcctcaaatgtg

SEQ ID NO: 248313 - DNA, 25 bp, Homo sapien
tactcctcaggcctcaaatgtgagc

SEQ ID NO: 248314 - DNA, 25 bp, Homo sapien
actcctcaggcctcaaatgtgagcg

SEQ ID NO: 248315 - DNA, 25 bp, Homo sapien
ctcctcaggcctcaaatgtgagcgc

SEQ ID NO: 248316 - DNA, 25 bp, Homo sapien
gaagaggccagcgacagcgctgcac

SEQ ID NO: 248317 - DNA, 25 bp, Homo sapien
gaggccagcgacagcgctgcacgaa

SEQ ID NO: 248318 - DNA, 25 bp, Homo sapien
agcgacagcgctgcacgaagcgagt

SEQ ID NO: 248319 - DNA, 25 bp, Homo sapien
gcacgaagcgagtgggcgggcgctc

SEQ ID NO: 248320 - DNA, 25 bp, Homo sapien
ctcccagttattgctttgtgacctt

SEQ ID NO: 248321 - DNA, 25 bp, Homo sapien
tgctttgtgaccttatcctacattt

SEQ ID NO: 248322 - DNA, 25 bp, Homo sapien
gctttgtgaccttatcctacatttt

SEQ ID NO: 248323 - DNA, 25 bp, Homo sapien
tttgtgaccttatcctacattttaa

SEQ ID NO: 248324 - DNA, 25 bp, Homo sapien
gtgaccttatcctacattttaatca

SEQ ID NO: 248325 - DNA, 25 bp, Homo sapien
gaccttatcctacattttaatcatc

SEQ ID NO: 248326 - DNA, 25 bp, Homo sapien
ttatcctacattttaatcatcccat

SEQ ID NO: 248327 - DNA, 25 bp, Homo sapien
atcctacattttaatcatcccatca

SEQ ID NO: 248328 - DNA, 25 bp, Homo sapien
cctacattttaatcatcccatcaag

SEQ ID NO: 248329 - DNA, 25 bp, Homo sapien
cattttaatcatcccatcaagactg

SEQ ID NO: 248330 - DNA, 25 bp, Homo sapien
cagaagcagaaagaaacaaccccct

SEQ ID NO: 248331 - DNA, 25 bp, Homo sapien
cttcagctcagttatgtctatttct

SEQ ID NO: 248332 - DNA, 25 bp, Homo sapien
gctcagttatgtctatttctttttt

SEQ ID NO: 248333 - DNA, 25 bp, Homo sapien
atggagacagactgacgggttgcct

SEQ ID NO: 248334 - DNA, 25 bp, Homo sapien
acagactgacgggttgcctggctga

SEQ ID NO: 248335 - DNA, 25 bp, Homo sapien
gcttgttttagggtgtggagcaacc

SEQ ID NO: 248336 - DNA, 25 bp, Homo sapien
ccaactgaactgtctgggcttcggg

SEQ ID NO: 248337 - DNA, 25 bp, Homo sapien
gaagaacccagtcagtcctagagcc

SEQ ID NO: 248338 - DNA, 25 bp, Homo sapien
ccagtcagtcctagagcccacagaa

SEQ ID NO: 248339 - DNA, 25 bp, Homo sapien
atgaggctgtctgggccctttatgg

SEQ ID NO: 248340 - DNA, 25 bp, Homo sapien
gtctgggccctttatggaattactt

SEQ ID NO: 248341 - DNA, 25 bp, Homo sapien
ggaattacttcagctcagttatgtc

SEQ ID NO: 248342 - DNA, 25 bp, Homo sapien
atttgagactttattctgtaccagc

SEQ ID NO: 248343 - DNA, 25 bp, Homo sapien
gagactttattctgtaccagccctg

SEQ ID NO: 248344 - DNA, 25 bp, Homo sapien
gactttattctgtaccagccctgta

SEQ ID NO: 248345 - DNA, 25 bp, Homo sapien
tttattctgtaccagccctgtataa

SEQ ID NO: 248346 - DNA, 25 bp, Homo sapien
tattctgtaccagccctgtataata

SEQ ID NO: 248347 - DNA, 25 bp, Homo sapien
tctgtaccagccctgtataataaca

SEQ ID NO: 248348 - DNA, 25 bp, Homo sapien
taggaccttcctctgaggtaggtct

SEQ ID NO: 248349 - DNA, 25 bp, Homo sapien
ccttcctctgaggtaggtctaaata

SEQ ID NO: 248350 - DNA, 25 bp, Homo sapien
ctgaggtaggtctaaatactgatct

SEQ ID NO: 248351 - DNA, 25 bp, Homo sapien
gaactaacgttttggggactcagca

SEQ ID NO: 248352 - DNA, 25 bp, Homo sapien
tttggggactcagcatctctgccag

SEQ ID NO: 248353 - DNA, 25 bp, Homo sapien
cataagttaaagacctttctctctc

SEQ ID NO: 248354 - DNA, 25 bp, Homo sapien
gtagtttacttaggtgatagcagcc

SEQ ID NO: 248355 - DNA, 25 bp, Homo sapien
gatagcagcctgaatctcaagagtt

SEQ ID NO: 248356 - DNA, 25 bp, Homo sapien
aatctgggcctcttggaagtacttt

SEQ ID NO: 248357 - DNA, 25 bp, Homo sapien
ttggaagtacttttgcctcctgagc

SEQ ID NO: 248358 - DNA, 25 bp, Homo sapien
tttgcctcctgagcaaggtaccatg

SEQ ID NO: 248359 - DNA, 25 bp, Homo sapien
aaggtaccatggctgccagacttca

SEQ ID NO: 248360 - DNA, 25 bp, Homo sapien
gctgccagacttcaggtgaactcaa

SEQ ID NO: 248361 - DNA, 25 bp, Homo sapien
ttcaggtgaactcaaaggtctgcca

SEQ ID NO: 248362 - DNA, 25 bp, Homo sapien
gaaggagcactcttatggaaacaag

SEQ ID NO: 248363 - DNA, 25 bp, Homo sapien
tcagagccattgactttgatcataa

SEQ ID NO: 248364 - DNA, 25 bp, Homo sapien
acgggccgaagctttgctgtgcaca

SEQ ID NO: 248365 - DNA, 25 bp, Homo sapien
agctttgctgtgcacacccgcagag

SEQ ID NO: 248366 - DNA, 25 bp, Homo sapien
tttgctgtgcacacccgcagagaga

SEQ ID NO: 248367 - DNA, 25 bp, Homo sapien
ttgctgtgcacacccgcagagagaa

SEQ ID NO: 248368 - DNA, 25 bp, Homo sapien
tgtgcacacccgcagagagaaccct

SEQ ID NO: 248369 - DNA, 25 bp, Homo sapien
gtgcacacccgcagagagaaccctg

SEQ ID NO: 248370 - DNA, 25 bp, Homo sapien
agagagaaccctgccgagccaggcg

SEQ ID NO: 248371 - DNA, 25 bp, Homo sapien
agaaccctgccgagccaggcgcggt

SEQ ID NO: 248372 - DNA, 25 bp, Homo sapien
gggatccatctctgctgagaagcct

SEQ ID NO: 248373 - DNA, 25 bp, Homo sapien
agggtctcccttctgactcagtaaa

SEQ ID NO: 248374 - DNA, 25 bp, Homo sapien
gactcagtaaagatcaccgctgcct

SEQ ID NO: 248375 - DNA, 25 bp, Homo sapien
acacatttttgactgtacacactat

SEQ ID NO: 248376 - DNA, 25 bp, Homo sapien
gactgtacacactataaatggcatc

SEQ ID NO: 248377 - DNA, 25 bp, Homo sapien
caaagtaatgtgagtcctgccagta

SEQ ID NO: 248378 - DNA, 25 bp, Homo sapien
aatgtgagtcctgccagtattctgg

SEQ ID NO: 248379 - DNA, 25 bp, Homo sapien
ccagtattctggtggataaggtctt

SEQ ID NO: 248380 - DNA, 25 bp, Homo sapien
gagtatttggttgcttgtcacaaca

SEQ ID NO: 248381 - DNA, 25 bp, Homo sapien
gttgcttgtcacaacattctccaag

SEQ ID NO: 248382 - DNA, 25 bp, Homo sapien
ttctccaagcagtgatatttctaaa

SEQ ID NO: 248383 - DNA, 25 bp, Homo sapien
ggagatacatgttgaaaacggtttt

SEQ ID NO: 248384 - DNA, 25 bp, Homo sapien
aatttacacttccatttcctgatta

SEQ ID NO: 248385 - DNA, 25 bp, Homo sapien
tggaaatactttgtgtaaaccatcc

SEQ ID NO: 248386 - DNA, 25 bp, Homo sapien
gcatggaaactctttgccactttca

SEQ ID NO: 248387 - DNA, 25 bp, Homo sapien
ctttgccactttcatctgactattg

SEQ ID NO: 248388 - DNA, 25 bp, Homo sapien
tcatgcctacataacacagctttca

SEQ ID NO: 248389 - DNA, 25 bp, Homo sapien
gaaaaactgatggatcctgcagatt

SEQ ID NO: 248390 - DNA, 25 bp, Homo sapien
tgcagattaactatggacagccaaa

SEQ ID NO: 248391 - DNA, 25 bp, Homo sapien
agtaaagtgatgtctacaacagcat

SEQ ID NO: 248392 - DNA, 25 bp, Homo sapien
cagctatgcctgatatggtgttaat

SEQ ID NO: 248393 - DNA, 25 bp, Homo sapien
gctttcataagaacccaataggaca

SEQ ID NO: 248394 - DNA, 25 bp, Homo sapien
caataggacagggttcaaggaccct

SEQ ID NO: 248395 - DNA, 25 bp, Homo sapien
ccctttaaagaatgccacacctata

SEQ ID NO: 248396 - DNA, 25 bp, Homo sapien
gccacacctatagaggcatggaaac

SEQ ID NO: 248397 - DNA, 25 bp, Homo sapien
ccatcagatctgtgcttcacataga

SEQ ID NO: 248398 - DNA, 25 bp, Homo sapien
cagatctgtgcttcacatagagaag

SEQ ID NO: 248399 - DNA, 25 bp, Homo sapien
gtgcttcacatagagaagtccggct

SEQ ID NO: 248400 - DNA, 25 bp, Homo sapien
ttcacatagagaagtccggcttcga

SEQ ID NO: 248401 - DNA, 25 bp, Homo sapien
acatagagaagtccggcttcgagat

SEQ ID NO: 248402 - DNA, 25 bp, Homo sapien
aagtccggcttcgagatggagtcac

SEQ ID NO: 248403 - DNA, 25 bp, Homo sapien
gtccggcttcgagatggagtcaccg

SEQ ID NO: 248404 - DNA, 25 bp, Homo sapien
cttcgagatggagtcaccggagcat

SEQ ID NO: 248405 - DNA, 25 bp, Homo sapien
ttcgagatggagtcaccggagcatg

SEQ ID NO: 248406 - DNA, 25 bp, Homo sapien
accggagcatggtgtgcgggcactc

SEQ ID NO: 248407 - DNA, 25 bp, Homo sapien
gcatggtgtgcgggcactcagtaaa

SEQ ID NO: 248408 - DNA, 25 bp, Homo sapien
ggacctgacacctagcaggaagggc

SEQ ID NO: 248409 - DNA, 25 bp, Homo sapien
gacacctagcaggaagggcttatgc

SEQ ID NO: 248410 - DNA, 25 bp, Homo sapien
gtcccaggttgggaggactcactct

SEQ ID NO: 248411 - DNA, 25 bp, Homo sapien
tcccaggttgggaggactcactctg

SEQ ID NO: 248412 - DNA, 25 bp, Homo sapien
cccaggttgggaggactcactctgt

SEQ ID NO: 248413 - DNA, 25 bp, Homo sapien
ccaggttgggaggactcactctgtg

SEQ ID NO: 248414 - DNA, 25 bp, Homo sapien
caggttgggaggactcactctgtgc

SEQ ID NO: 248415 - DNA, 25 bp, Homo sapien
aggttgggaggactcactctgtgct

SEQ ID NO: 248416 - DNA, 25 bp, Homo sapien
tgggaggactcactctgtgctcccc

SEQ ID NO: 248417 - DNA, 25 bp, Homo sapien
ggaggactcactctgtgctccccga

SEQ ID NO: 248418 - DNA, 25 bp, Homo sapien
agcccttgtgtctgtgaactttcaa

SEQ ID NO: 248419 - DNA, 25 bp, Homo sapien
ggcagtgtgagcgtgaaaataaaca

SEQ ID NO: 248420 - DNA, 25 bp, Homo sapien
gcgtgaaaataaacaggctgggcgc

SEQ ID NO: 248421 - DNA, 25 bp, Homo sapien
aaacaagaaaagtcagccgtgcgtg

SEQ ID NO: 248422 - DNA, 25 bp, Homo sapien
acaagaaaagtcagccgtgcgtggt

SEQ ID NO: 248423 - DNA, 25 bp, Homo sapien
gaaaagtcagccgtgcgtggtgtca

SEQ ID NO: 248424 - DNA, 25 bp, Homo sapien
aaaagtcagccgtgcgtggtgtcac

SEQ ID NO: 248425 - DNA, 25 bp, Homo sapien
aaagtcagccgtgcgtggtgtcacc

SEQ ID NO: 248426 - DNA, 25 bp, Homo sapien
agtcagccgtgcgtggtgtcacccg

SEQ ID NO: 248427 - DNA, 25 bp, Homo sapien
tcacttgagccagaggttaagtctg

SEQ ID NO: 248428 - DNA, 25 bp, Homo sapien
acttgagccagaggttaagtctgca

SEQ ID NO: 248429 - DNA, 25 bp, Homo sapien
tgagccagaggttaagtctgcagtg

SEQ ID NO: 248430 - DNA, 25 bp, Homo sapien
gtttaatacatccaatatgtcaagt

SEQ ID NO: 248431 - DNA, 25 bp, Homo sapien
tttaatacatccaatatgtcaagtt

SEQ ID NO: 248432 - DNA, 25 bp, Homo sapien
tatgtcaagttaaaccattctggga

SEQ ID NO: 248433 - DNA, 25 bp, Homo sapien
atgtcaagttaaaccattctgggat

SEQ ID NO: 248434 - DNA, 25 bp, Homo sapien
gtcaagttaaaccattctgggattt

SEQ ID NO: 248435 - DNA, 25 bp, Homo sapien
caagttaaaccattctgggatttgc

SEQ ID NO: 248436 - DNA, 25 bp, Homo sapien
aagttaaaccattctgggatttgca

SEQ ID NO: 248437 - DNA, 25 bp, Homo sapien
gttaaaccattctgggatttgcaaa

SEQ ID NO: 248438 - DNA, 25 bp, Homo sapien
aaaccattctgggatttgcaaagtt

SEQ ID NO: 248439 - DNA, 25 bp, Homo sapien
accattctgggatttgcaaagttta

SEQ ID NO: 248440 - DNA, 25 bp, Homo sapien
tgcaaagtttaatacatccaatatg

SEQ ID NO: 248441 - DNA, 25 bp, Homo sapien
tcaactctgcctgttttaactatag

SEQ ID NO: 248442 - DNA, 25 bp, Homo sapien
gacttgttatcatgaatttatccta

SEQ ID NO: 248443 - DNA, 25 bp, Homo sapien
aaatgaataagctcttcctgtgact

SEQ ID NO: 248444 - DNA, 25 bp, Homo sapien
cacccccatttgtcctatattaaat

SEQ ID NO: 248445 - DNA, 25 bp, Homo sapien
taaataacacgggttccaatcttct

SEQ ID NO: 248446 - DNA, 25 bp, Homo sapien
gttccaatcttctttaaattttcat

SEQ ID NO: 248447 - DNA, 25 bp, Homo sapien
aaattttcatgatctggcttcataa

SEQ ID NO: 248448 - DNA, 25 bp, Homo sapien
atgatctggcttcataataaagctt

SEQ ID NO: 248449 - DNA, 25 bp, Homo sapien
aagctttatagttggttcttaccag

SEQ ID NO: 248450 - DNA, 25 bp, Homo sapien
ggttcttaccagttgtatcaccctg

SEQ ID NO: 248451 - DNA, 25 bp, Homo sapien
gaattggatgttcattttgcacatt

SEQ ID NO: 248452 - DNA, 25 bp, Homo sapien
taagaaatacgtgtggcataggctg

SEQ ID NO: 248453 - DNA, 25 bp, Homo sapien
aagaaatacgtgtggcataggctgg

SEQ ID NO: 248454 - DNA, 25 bp, Homo sapien
aaaagagagctaagcgatcattttc

SEQ ID NO: 248455 - DNA, 25 bp, Homo sapien
agagagctaagcgatcattttctaa

SEQ ID NO: 248456 - DNA, 25 bp, Homo sapien
gagagctaagcgatcattttctaaa

SEQ ID NO: 248457 - DNA, 25 bp, Homo sapien
gagctaagcgatcattttctaaagt

SEQ ID NO: 248458 - DNA, 25 bp, Homo sapien
agctaagcgatcattttctaaagtg

SEQ ID NO: 248459 - DNA, 25 bp, Homo sapien
gctaagcgatcattttctaaagtgg

SEQ ID NO: 248460 - DNA, 25 bp, Homo sapien
ctaagcgatcattttctaaagtgga

SEQ ID NO: 248461 - DNA, 25 bp, Homo sapien
aagcgatcattttctaaagtggaaa

SEQ ID NO: 248462 - DNA, 25 bp, Homo sapien
gtggaaaattcagcgataataccta

SEQ ID NO: 248463 - DNA, 25 bp, Homo sapien
ttcgggatgaaattgtcagtgtaaa

SEQ ID NO: 248464 - DNA, 25 bp, Homo sapien
gaaattgtcagtgtaaaaccagaaa

SEQ ID NO: 248465 - DNA, 25 bp, Homo sapien
aaaccagaaaaaatgcatctcttct

SEQ ID NO: 248466 - DNA, 25 bp, Homo sapien
gaaaaaatgcatctcttctagaatt

SEQ ID NO: 248467 - DNA, 25 bp, Homo sapien
aatgcatctcttctagaattgttta

SEQ ID NO: 248468 - DNA, 25 bp, Homo sapien
tctcttctagaattgtttaaaccct

SEQ ID NO: 248469 - DNA, 25 bp, Homo sapien
gggtgttaccaactgagatcgatca

SEQ ID NO: 248470 - DNA, 25 bp, Homo sapien
ggtgttaccaactgagatcgatcag

SEQ ID NO: 248471 - DNA, 25 bp, Homo sapien
atccaatcacagatcatgaaacagt

SEQ ID NO: 248472 - DNA, 25 bp, Homo sapien
caatcacagatcatgaaacagtagt

SEQ ID NO: 248473 - DNA, 25 bp, Homo sapien
gtgtttgtgtttcaagcagaaaaac

SEQ ID NO: 248474 - DNA, 25 bp, Homo sapien
atatgttggaaatactcagtaaagc

SEQ ID NO: 248475 - DNA, 25 bp, Homo sapien
gcagaagctccagaaacactgtggg

SEQ ID NO: 248476 - DNA, 25 bp, Homo sapien
ctcctacatattcagagattgttac

SEQ ID NO: 248477 - DNA, 25 bp, Homo sapien
cagagattgttactgcacctccatt

SEQ ID NO: 248478 - DNA, 25 bp, Homo sapien
gattgttactgcacctccattccct

SEQ ID NO: 248479 - DNA, 25 bp, Homo sapien
aatcctctgtgatctggtagcaaaa

SEQ ID NO: 248480 - DNA, 25 bp, Homo sapien
ggtagcaaaaggcagctgataattt

SEQ ID NO: 248481 - DNA, 25 bp, Homo sapien
aatttatacacacaccacgcctgtg

SEQ ID NO: 248482 - DNA, 25 bp, Homo sapien
ttatacacacaccacgcctgtgtgt

SEQ ID NO: 248483 - DNA, 25 bp, Homo sapien
agagctggtctccactcgagagctg

SEQ ID NO: 248484 - DNA, 25 bp, Homo sapien
agctggtctccactcgagagctgtt

SEQ ID NO: 248485 - DNA, 25 bp, Homo sapien
tggctgacctgtctaccctctcgaa

SEQ ID NO: 248486 - DNA, 25 bp, Homo sapien
aggctcatgaccctgtttatgcggt

SEQ ID NO: 248487 - DNA, 25 bp, Homo sapien
atgaccctgtttatgcggtaccgga

SEQ ID NO: 248488 - DNA, 25 bp, Homo sapien
gaccctgtttatgcggtaccggagt

SEQ ID NO: 248489 - DNA, 25 bp, Homo sapien
tgcggtaccggagtagcagtgtcct

SEQ ID NO: 248490 - DNA, 25 bp, Homo sapien
gtaccggagtagcagtgtcctctct

SEQ ID NO: 248491 - DNA, 25 bp, Homo sapien
ggagtagcagtgtcctctctcatga

SEQ ID NO: 248492 - DNA, 25 bp, Homo sapien
tagcagtgtcctctctcatgaagag

SEQ ID NO: 248493 - DNA, 25 bp, Homo sapien
ctcatgaagaggtgggtgatgttct

SEQ ID NO: 248494 - DNA, 25 bp, Homo sapien
atgttctgcaaggtgtggctttggc

SEQ ID NO: 248495 - DNA, 25 bp, Homo sapien
gtgtggctttggctgacctgtctac

SEQ ID NO: 248496 - DNA, 25 bp, Homo sapien
tccaaagtctactcttcaagaacat

SEQ ID NO: 248497 - DNA, 25 bp, Homo sapien
gaaacaactattcaatcatcggcta

SEQ ID NO: 248498 - DNA, 25 bp, Homo sapien
tcaatcatcggctaaaacacaaaat

SEQ ID NO: 248499 - DNA, 25 bp, Homo sapien
tacaccaacatttgaaataccattc

SEQ ID NO: 248500 - DNA, 25 bp, Homo sapien
aaatgtctttcaatttatactcaaa

SEQ ID NO: 248501 - DNA, 25 bp, Homo sapien
tagttaaatcatttgggcactccca

SEQ ID NO: 248502 - DNA, 25 bp, Homo sapien
ggcactcccaaactccttttaagtg

SEQ ID NO: 248503 - DNA, 25 bp, Homo sapien
aaactccttttaagtgcccagagat

SEQ ID NO: 248504 - DNA, 25 bp, Homo sapien
gcccagagattgacagagcagttca

SEQ ID NO: 248505 - DNA, 25 bp, Homo sapien
gagcagttcagctactgcatagcca

SEQ ID NO: 248506 - DNA, 25 bp, Homo sapien
tactgcatagccatggattagctat

SEQ ID NO: 248507 - DNA, 25 bp, Homo sapien
aaggtgtcaccctgaagaggaagtg

SEQ ID NO: 248508 - DNA, 25 bp, Homo sapien
gaggaagtggtggaccagccctgcc

SEQ ID NO: 248509 - DNA, 25 bp, Homo sapien
atgtctgcctgtcggtctatctgaa

SEQ ID NO: 248510 - DNA, 25 bp, Homo sapien
tgcctgtcggtctatctgaaatggg

SEQ ID NO: 248511 - DNA, 25 bp, Homo sapien
ccaaaggagggcttaatgtggcctt

SEQ ID NO: 248512 - DNA, 25 bp, Homo sapien
gagggcttaatgtggccttttccac

SEQ ID NO: 248513 - DNA, 25 bp, Homo sapien
cttttccaccttctaattccataga

SEQ ID NO: 248514 - DNA, 25 bp, Homo sapien
ctaattccatagaacctcagctctg

SEQ ID NO: 248515 - DNA, 25 bp, Homo sapien
aattccatagaacctcagctctggg

SEQ ID NO: 248516 - DNA, 25 bp, Homo sapien
tcagctctgggacttgcttcctgac

SEQ ID NO: 248517 - DNA, 25 bp, Homo sapien
gctctgggacttgcttcctgaccta

SEQ ID NO: 248518 - DNA, 25 bp, Homo sapien
agccactgttttcctcgttttcaag

SEQ ID NO: 248519 - DNA, 25 bp, Homo sapien
ttttcctcgttttcaaggctctcct

SEQ ID NO: 248520 - DNA, 25 bp, Homo sapien
gcagttcctgaaccaaatgtgttgt

SEQ ID NO: 248521 - DNA, 25 bp, Homo sapien
gtctccactgctttatgacccattt

SEQ ID NO: 248522 - DNA, 25 bp, Homo sapien
gctttatgacccattttgacctcaa

SEQ ID NO: 248523 - DNA, 25 bp, Homo sapien
atgacccattttgacctcaaataag

SEQ ID NO: 248524 - DNA, 25 bp, Homo sapien
gaaagactctagaatgctcaacgct

SEQ ID NO: 248525 - DNA, 25 bp, Homo sapien
gaatgctcaacgctgagttccttgg

SEQ ID NO: 248526 - DNA, 25 bp, Homo sapien
cttggcaacttctcacgcagttgta

SEQ ID NO: 248527 - DNA, 25 bp, Homo sapien
gcttccatggttgctctcagttggt

SEQ ID NO: 248528 - DNA, 25 bp, Homo sapien
catggttgctctcagttggtcattg

SEQ ID NO: 248529 - DNA, 25 bp, Homo sapien
ttctccactctgtgataggccccag

SEQ ID NO: 248530 - DNA, 25 bp, Homo sapien
tcttgttcttttttacgtctgcaag

SEQ ID NO: 248531 - DNA, 25 bp, Homo sapien
tgttcttttttacgtctgcaaggtt

SEQ ID NO: 248532 - DNA, 25 bp, Homo sapien
ttttttacgtctgcaaggttctctg

SEQ ID NO: 248533 - DNA, 25 bp, Homo sapien
ttttacgtctgcaaggttctctgct

SEQ ID NO: 248534 - DNA, 25 bp, Homo sapien
ttacgtctgcaaggttctctgctta

SEQ ID NO: 248535 - DNA, 25 bp, Homo sapien
tccaggtattaagcctgctacccat

SEQ ID NO: 248536 - DNA, 25 bp, Homo sapien
gtattaagcctgctacccatttgtt

SEQ ID NO: 248537 - DNA, 25 bp, Homo sapien
attaagcctgctacccatttgtttt

SEQ ID NO: 248538 - DNA, 25 bp, Homo sapien
ttaagcctgctacccatttgttttt

SEQ ID NO: 248539 - DNA, 25 bp, Homo sapien
tcccattctccactctgtgataggc

SEQ ID NO: 248540 - DNA, 25 bp, Homo sapien
cgactccactgcatgtattacgtgc

SEQ ID NO: 248541 - DNA, 25 bp, Homo sapien
tattacgtgcatgtgtaccttggaa

SEQ ID NO: 248542 - DNA, 25 bp, Homo sapien
taagccctgagacaactctgcactg

SEQ ID NO: 248543 - DNA, 25 bp, Homo sapien
aactctgcactgtatcctgctattc

SEQ ID NO: 248544 - DNA, 25 bp, Homo sapien
aactgcaggacctcatggagcgaga

SEQ ID NO: 248545 - DNA, 25 bp, Homo sapien
gagcgagagatccaaacctttctga

SEQ ID NO: 248546 - DNA, 25 bp, Homo sapien
tactttaccttctacctttttcatg

SEQ ID NO: 248547 - DNA, 25 bp, Homo sapien
cctttttcatgctactcaggattga

SEQ ID NO: 248548 - DNA, 25 bp, Homo sapien
ggttatcttctgacgagtgctggca

SEQ ID NO: 248549 - DNA, 25 bp, Homo sapien
gagtgctggcattatcacttgttgc

SEQ ID NO: 248550 - DNA, 25 bp, Homo sapien
aggcttgttctgaggttcacccgac

SEQ ID NO: 248551 - DNA, 25 bp, Homo sapien
agtcacagctgggagatggcttgaa

SEQ ID NO: 248552 - DNA, 25 bp, Homo sapien
gtaatgacctctgccatcagggaga

SEQ ID NO: 248553 - DNA, 25 bp, Homo sapien
ggacggtggttcatcgtattctcat

SEQ ID NO: 248554 - DNA, 25 bp, Homo sapien
atcgtattctcatgcccagttgtgt

SEQ ID NO: 248555 - DNA, 25 bp, Homo sapien
gcccagttgtgtcatctaggattcc

SEQ ID NO: 248556 - DNA, 25 bp, Homo sapien
aaccatttttagtgacttgactgct

SEQ ID NO: 248557 - DNA, 25 bp, Homo sapien
agtatgattctcaattatatggcca

SEQ ID NO: 248558 - DNA, 25 bp, Homo sapien
ttatatggccatactccatgtttgc

SEQ ID NO: 248559 - DNA, 25 bp, Homo sapien
gaaccattaactaactactcccatc

SEQ ID NO: 248560 - DNA, 25 bp, Homo sapien
atctccttaaagcactacctacact

SEQ ID NO: 248561 - DNA, 25 bp, Homo sapien
tacagtgcagcaagcccagagtcac

SEQ ID NO: 248562 - DNA, 25 bp, Homo sapien
attggctcaaggtgttgccgctagt

SEQ ID NO: 248563 - DNA, 25 bp, Homo sapien
gtgttgccgctagtcagtgccagag

SEQ ID NO: 248564 - DNA, 25 bp, Homo sapien
agtgccagagccaggactccacaca

SEQ ID NO: 248565 - DNA, 25 bp, Homo sapien
acatcatgagacctcattcagccct

SEQ ID NO: 248566 - DNA, 25 bp, Homo sapien
ccacatctttcacttgtacagcaga

SEQ ID NO: 248567 - DNA, 25 bp, Homo sapien
acagcagattgccaaactcatgttg

SEQ ID NO: 248568 - DNA, 25 bp, Homo sapien
gggctctggtgctctcaagtacaga

SEQ ID NO: 248569 - DNA, 25 bp, Homo sapien
ccatgtcactgggttgctgccaagt

SEQ ID NO: 248570 - DNA, 25 bp, Homo sapien
ttccaagaatcctctgaagggttct

SEQ ID NO: 248571 - DNA, 25 bp, Homo sapien
gaagggttctgattttacagacaaa

SEQ ID NO: 248572 - DNA, 25 bp, Homo sapien
tggcatggataagtgattggctcaa

SEQ ID NO: 248573 - DNA, 25 bp, Homo sapien
acctgatttgatgaaccaaggaaag

SEQ ID NO: 248574 - DNA, 25 bp, Homo sapien
gaaccaaggaaagccatgcgtttaa

SEQ ID NO: 248575 - DNA, 25 bp, Homo sapien
gaaagccatgcgtttaaacaaatat

SEQ ID NO: 248576 - DNA, 25 bp, Homo sapien
atatatgaatattccctatgttaaa

SEQ ID NO: 248577 - DNA, 25 bp, Homo sapien
catatcatctttagagatagtgtat

SEQ ID NO: 248578 - DNA, 25 bp, Homo sapien
gatagtgtataattagttctgtgaa

SEQ ID NO: 248579 - DNA, 25 bp, Homo sapien
tatggagtttcattatacttttctc

SEQ ID NO: 248580 - DNA, 25 bp, Homo sapien
acttttctctctactcttgtctatg

SEQ ID NO: 248581 - DNA, 25 bp, Homo sapien
ttttctctctactcttgtctatgtt

SEQ ID NO: 248582 - DNA, 25 bp, Homo sapien
ttctctctactcttgtctatgttga

SEQ ID NO: 248583 - DNA, 25 bp, Homo sapien
tctctctactcttgtctatgttgaa

SEQ ID NO: 248584 - DNA, 25 bp, Homo sapien
catcacttctttgtcccagattcat

SEQ ID NO: 248585 - DNA, 25 bp, Homo sapien
gaaattgtgctgatgtccattttat

SEQ ID NO: 248586 - DNA, 25 bp, Homo sapien
tattacaaactccaagacatttctt

SEQ ID NO: 248587 - DNA, 25 bp, Homo sapien
ttagaattgtctacagatttcgtgt

SEQ ID NO: 248588 - DNA, 25 bp, Homo sapien
gatttcgtgtagctacttattggta

SEQ ID NO: 248589 - DNA, 25 bp, Homo sapien
ggtagcttcttaatttcatacttgt

SEQ ID NO: 248590 - DNA, 25 bp, Homo sapien
atttcatacttgtccagaccattag

SEQ ID NO: 248591 - DNA, 25 bp, Homo sapien
attattacatgctctgtcttgggcc

SEQ ID NO: 248592 - DNA, 25 bp, Homo sapien
ctgtcttgggcctatcattaacatt

SEQ ID NO: 248593 - DNA, 25 bp, Homo sapien
ttaacattagcttagggattctgat

SEQ ID NO: 248594 - DNA, 25 bp, Homo sapien
gaattggcaaaactcttcttacaga

SEQ ID NO: 248595 - DNA, 25 bp, Homo sapien
tagggtgttatgaaaaatgcaattt

SEQ ID NO: 248596 - DNA, 25 bp, Homo sapien
aactggttaccaagcatcaagaaaa

SEQ ID NO: 248597 - DNA, 25 bp, Homo sapien
actggttaccaagcatcaagaaaaa

SEQ ID NO: 248598 - DNA, 25 bp, Homo sapien
ggttaccaagcatcaagaaaaactt

SEQ ID NO: 248599 - DNA, 25 bp, Homo sapien
gtattttatcttcattctattatta

SEQ ID NO: 248600 - DNA, 25 bp, Homo sapien
attttatcttcattctattattagc

SEQ ID NO: 248601 - DNA, 25 bp, Homo sapien
ttatcttcattctattattagcaga

SEQ ID NO: 248602 - DNA, 25 bp, Homo sapien
tcttcattctattattagcagataa

SEQ ID NO: 248603 - DNA, 25 bp, Homo sapien
attctattattagcagataacctta

SEQ ID NO: 248604 - DNA, 25 bp, Homo sapien
gataaccttaataaaaatgagctgt

SEQ ID NO: 248605 - DNA, 25 bp, Homo sapien
aaaaatgagctgttatttacagcaa

SEQ ID NO: 248606 - DNA, 25 bp, Homo sapien
gtttcattgtaagacgaggacttgc

SEQ ID NO: 248607 - DNA, 25 bp, Homo sapien
tttcattgtaagacgaggacttgct

SEQ ID NO: 248608 - DNA, 25 bp, Homo sapien
ttcattgtaagacgaggacttgcta

SEQ ID NO: 248609 - DNA, 25 bp, Homo sapien
tcattgtaagacgaggacttgctat

SEQ ID NO: 248610 - DNA, 25 bp, Homo sapien
attgtaagacgaggacttgctatgt

SEQ ID NO: 248611 - DNA, 25 bp, Homo sapien
ttgtaagacgaggacttgctatgtt

SEQ ID NO: 248612 - DNA, 25 bp, Homo sapien
gttcccaaagcgtttgggccggcag

SEQ ID NO: 248613 - DNA, 25 bp, Homo sapien
ttcccaaagcgtttgggccggcaga

SEQ ID NO: 248614 - DNA, 25 bp, Homo sapien
tcccaaagcgtttgggccggcagat

SEQ ID NO: 248615 - DNA, 25 bp, Homo sapien
cccaaagcgtttgggccggcagatg

SEQ ID NO: 248616 - DNA, 25 bp, Homo sapien
caaagcgtttgggccggcagatgtc

SEQ ID NO: 248617 - DNA, 25 bp, Homo sapien
accatactgggatttgggaacttct

SEQ ID NO: 248618 - DNA, 25 bp, Homo sapien
catactgggatttgggaacttcttt

SEQ ID NO: 248619 - DNA, 25 bp, Homo sapien
aggtcatcttgatggaattgtgttt

SEQ ID NO: 248620 - DNA, 25 bp, Homo sapien
aatatcattgatagtcttgtgtgtc

SEQ ID NO: 248621 - DNA, 25 bp, Homo sapien
tatcattgatagtcttgtgtgtctc

SEQ ID NO: 248622 - DNA, 25 bp, Homo sapien
atcattgatagtcttgtgtgtctca

SEQ ID NO: 248623 - DNA, 25 bp, Homo sapien
ttgatagtcttgtgtgtctcacata

SEQ ID NO: 248624 - DNA, 25 bp, Homo sapien
atttgcttttatctgagaatttctc

SEQ ID NO: 248625 - DNA, 25 bp, Homo sapien
atgtcaagttaaaccattctgggat

SEQ ID NO: 248626 - DNA, 25 bp, Homo sapien
accattctgggatttgcaaagttta

SEQ ID NO: 248627 - DNA, 25 bp, Homo sapien
gcaaagtttaatacatccaatatgt

SEQ ID NO: 248628 - DNA, 25 bp, Homo sapien
ggaggtcaatgcaggccaagatgtt

SEQ ID NO: 248629 - DNA, 25 bp, Homo sapien
agatgttggagcaaagacggcgcct

SEQ ID NO: 248630 - DNA, 25 bp, Homo sapien
tagaaagacagccataagattcagt

SEQ ID NO: 248631 - DNA, 25 bp, Homo sapien
aaagacggcgcctggcactaagact

SEQ ID NO: 248632 - DNA, 25 bp, Homo sapien
gcctggcactaagactctatacctg

SEQ ID NO: 248633 - DNA, 25 bp, Homo sapien
tctatacctgccaggagtgggcggt

SEQ ID NO: 248634 - DNA, 25 bp, Homo sapien
acaggttcgaatgtggcaggcccgc

SEQ ID NO: 248635 - DNA, 25 bp, Homo sapien
aagcggcctgcatcatccagtctca

SEQ ID NO: 248636 - DNA, 25 bp, Homo sapien
tggaaacatggtgcgccggacgtta

SEQ ID NO: 248637 - DNA, 25 bp, Homo sapien
ggacgttactgcaggcagcactcag

SEQ ID NO: 248638 - DNA, 25 bp, Homo sapien
agagcctgggtcatccagtgctggt

SEQ ID NO: 248639 - DNA, 25 bp, Homo sapien
atgggcattgatgggcattgtgact

SEQ ID NO: 248640 - DNA, 25 bp, Homo sapien
ggcattgtgactgcagtcctgcact

SEQ ID NO: 248641 - DNA, 25 bp, Homo sapien
gcagtcctgcactgtggatctggct

SEQ ID NO: 248642 - DNA, 25 bp, Homo sapien
aaacctgcactctagaagcaccact

SEQ ID NO: 248643 - DNA, 25 bp, Homo sapien
gtggatctggctgggcaaacataga

SEQ ID NO: 248644 - DNA, 25 bp, Homo sapien
ctggctgggcaaacatagataggat

SEQ ID NO: 248645 - DNA, 25 bp, Homo sapien
gtgaactgtcacctgcagagcagag

SEQ ID NO: 248646 - DNA, 25 bp, Homo sapien
gaagcaccactatagagcgtttccc

SEQ ID NO: 248647 - DNA, 25 bp, Homo sapien
tatagagcgtttccccttctaggaa

SEQ ID NO: 248648 - DNA, 25 bp, Homo sapien
gagcgtttccccttctaggaaggag

SEQ ID NO: 248649 - DNA, 25 bp, Homo sapien
taggaaggagatgggtcctccctga

SEQ ID NO: 248650 - DNA, 25 bp, Homo sapien
tggccccagataggaccgggaacta

SEQ ID NO: 248651 - DNA, 25 bp, Homo sapien
gatcaaacctacctggattcttgtg

SEQ ID NO: 248652 - DNA, 25 bp, Homo sapien
ggattcttgtgaaccattcatgtga

SEQ ID NO: 248653 - DNA, 25 bp, Homo sapien
aactggaatttcacacagacccggg

SEQ ID NO: 248654 - DNA, 25 bp, Homo sapien
atttctcaaagttcaagacgggtca

SEQ ID NO: 248655 - DNA, 25 bp, Homo sapien
agacgggtcatattccgtggaatac

SEQ ID NO: 248656 - DNA, 25 bp, Homo sapien
ggagtgatttcacttttctgatcaa

SEQ ID NO: 248657 - DNA, 25 bp, Homo sapien
attaaaactcagctccgcaatatat

SEQ ID NO: 248658 - DNA, 25 bp, Homo sapien
aaatgatcacttcgttttctgttac

SEQ ID NO: 248659 - DNA, 25 bp, Homo sapien
tttctgttacggctacttttatatt

SEQ ID NO: 248660 - DNA, 25 bp, Homo sapien
tatttttcaacattactgctggtct

SEQ ID NO: 248661 - DNA, 25 bp, Homo sapien
agcacacagctcaaagtcagccaat

SEQ ID NO: 248662 - DNA, 25 bp, Homo sapien
gtcagccaataagtcttttcctatt

SEQ ID NO: 248663 - DNA, 25 bp, Homo sapien
tcttttcctatttgtgacttttact

SEQ ID NO: 248664 - DNA, 25 bp, Homo sapien
gaaagtctgtctttgaccggcatgt

SEQ ID NO: 248665 - DNA, 25 bp, Homo sapien
accggcatgttgtcctcagctaatt

SEQ ID NO: 248666 - DNA, 25 bp, Homo sapien
tgtcctcagctaattgggaattgaa

SEQ ID NO: 248667 - DNA, 25 bp, Homo sapien
acaactggaaagaactgactgggtt

SEQ ID NO: 248668 - DNA, 25 bp, Homo sapien
actgactgggttttgctgggtttca

SEQ ID NO: 248669 - DNA, 25 bp, Homo sapien
ggtttcattttaataccttgttgat

SEQ ID NO: 248670 - DNA, 25 bp, Homo sapien
tgttgatttcaccaactgttgctgg

SEQ ID NO: 248671 - DNA, 25 bp, Homo sapien
caccaactgttgctggaagattcaa

SEQ ID NO: 248672 - DNA, 25 bp, Homo sapien
gcaacatggcattgaaggtacccgt

SEQ ID NO: 248673 - DNA, 25 bp, Homo sapien
aggtacccgttgacagtgacgtgca

SEQ ID NO: 248674 - DNA, 25 bp, Homo sapien
gacagtgacgtgcatcacagcatta

SEQ ID NO: 248675 - DNA, 25 bp, Homo sapien
gaaagggaccaccacatccatggag

SEQ ID NO: 248676 - DNA, 25 bp, Homo sapien
acatccatggagtgcaccgcgtgag

SEQ ID NO: 248677 - DNA, 25 bp, Homo sapien
agtgcaccgcgtgagagaaatgctc

SEQ ID NO: 248678 - DNA, 25 bp, Homo sapien
gctcaggaagggaattgaccagatt

SEQ ID NO: 248679 - DNA, 25 bp, Homo sapien
aggcagagctgagcaaccaggcttt

SEQ ID NO: 248680 - DNA, 25 bp, Homo sapien
tgagcaaccaggctttcactgctga

SEQ ID NO: 248681 - DNA, 25 bp, Homo sapien
tgagccagctccatcgtacaacagg

SEQ ID NO: 248682 - DNA, 25 bp, Homo sapien
gagtgagggaagtacctgcttcaca

SEQ ID NO: 248683 - DNA, 25 bp, Homo sapien
agtgatggataatctgctggaggcc

SEQ ID NO: 248684 - DNA, 25 bp, Homo sapien
gctgccttccgcgacagaagaaaaa

SEQ ID NO: 248685 - DNA, 25 bp, Homo sapien
aaggacaccgatgccaaaagatgtt

SEQ ID NO: 248686 - DNA, 25 bp, Homo sapien
aagatgttcggcagagtctcagtcc

SEQ ID NO: 248687 - DNA, 25 bp, Homo sapien
cagagtctcagtccaatgtctcaga

SEQ ID NO: 248688 - DNA, 25 bp, Homo sapien
agtccaatgtctcagaggcctgttc

SEQ ID NO: 248689 - DNA, 25 bp, Homo sapien
ttgtaaccatggtaataaaccgtat

SEQ ID NO: 248690 - DNA, 25 bp, Homo sapien
attcttcttatctacttttatccta

SEQ ID NO: 248691 - DNA, 25 bp, Homo sapien
cttttatcctattgatctgtgattt

SEQ ID NO: 248692 - DNA, 25 bp, Homo sapien
ctgtgattttagtagactgctgtga

SEQ ID NO: 248693 - DNA, 25 bp, Homo sapien
gactgctgtgaaattctcaagttcc

SEQ ID NO: 248694 - DNA, 25 bp, Homo sapien
aaaaagcctctcgagctccaaaggg

SEQ ID NO: 248695 - DNA, 25 bp, Homo sapien
gggatgcatcaggacgataatttca

SEQ ID NO: 248696 - DNA, 25 bp, Homo sapien
caggacgataatttcaagagttcaa

SEQ ID NO: 248697 - DNA, 25 bp, Homo sapien
agagttcaatggtgaatttccttgg

SEQ ID NO: 248698 - DNA, 25 bp, Homo sapien
aatttccttggcttccactgagcta

SEQ ID NO: 248699 - DNA, 25 bp, Homo sapien
cactgagctacctgttaacttcaac

SEQ ID NO: 248700 - DNA, 25 bp, Homo sapien
cacactggcctggagactacatgat

SEQ ID NO: 248701 - DNA, 25 bp, Homo sapien
ggtgtctcagtaatggatttacaac

SEQ ID NO: 248702 - DNA, 25 bp, Homo sapien
gcaaacatctcaagcagcagtgcca

SEQ ID NO: 248703 - DNA, 25 bp, Homo sapien
cagcctctagaactaatatgtgaaa

SEQ ID NO: 248704 - DNA, 25 bp, Homo sapien
aatgacaggatgatttgcaagacac

SEQ ID NO: 248705 - DNA, 25 bp, Homo sapien
cccggtgactgaagagatgctacag

SEQ ID NO: 248706 - DNA, 25 bp, Homo sapien
tgaagagatgctacagcggtgcaag

SEQ ID NO: 248707 - DNA, 25 bp, Homo sapien
gggtggactgcgcttcttctcaaca

SEQ ID NO: 248708 - DNA, 25 bp, Homo sapien
tggactgcgcttcttctcaacacaa

SEQ ID NO: 248709 - DNA, 25 bp, Homo sapien
tgcgcttcttctcaacacaatacaa

SEQ ID NO: 248710 - DNA, 25 bp, Homo sapien
gcttcttctcaacacaatacaagga

SEQ ID NO: 248711 - DNA, 25 bp, Homo sapien
tctcaacacaatacaaggacgagtt

SEQ ID NO: 248712 - DNA, 25 bp, Homo sapien
ggacgagtttcctttcaagtaccag

SEQ ID NO: 248713 - DNA, 25 bp, Homo sapien
gacgagtttcctttcaagtaccagg

SEQ ID NO: 248714 - DNA, 25 bp, Homo sapien
gactgaaaaatcctcaggagggctt

SEQ ID NO: 248715 - DNA, 25 bp, Homo sapien
ctgaagccacacagaacacctccgg

SEQ ID NO: 248716 - DNA, 25 bp, Homo sapien
gtacagattgtgtctccttatgttg

SEQ ID NO: 248717 - DNA, 25 bp, Homo sapien
aagcgatctttccatcttagcttcc

SEQ ID NO: 248718 - DNA, 25 bp, Homo sapien
gatctttccatcttagcttcccaaa

SEQ ID NO: 248719 - DNA, 25 bp, Homo sapien
tctttccatcttagcttcccaaatt

SEQ ID NO: 248720 - DNA, 25 bp, Homo sapien
tttccatcttagcttcccaaattgt

SEQ ID NO: 248721 - DNA, 25 bp, Homo sapien
tccatcttagcttcccaaattgttg

SEQ ID NO: 248722 - DNA, 25 bp, Homo sapien
ccatcttagcttcccaaattgttgg

SEQ ID NO: 248723 - DNA, 25 bp, Homo sapien
gttggaattatggacatgagccagt

SEQ ID NO: 248724 - DNA, 25 bp, Homo sapien
tggacatgagccagtgtgcttggcc

SEQ ID NO: 248725 - DNA, 25 bp, Homo sapien
gagccagtgtgcttggcctgatttt

SEQ ID NO: 248726 - DNA, 25 bp, Homo sapien
gccagtgtgcttggcctgatttttt

SEQ ID NO: 248727 - DNA, 25 bp, Homo sapien
ttgtgcctcttctcgtgttgatacg

SEQ ID NO: 248728 - DNA, 25 bp, Homo sapien
gcctcttctcgtgttgatacgtgta

SEQ ID NO: 248729 - DNA, 25 bp, Homo sapien
tcttctcgtgttgatacgtgtattt

SEQ ID NO: 248730 - DNA, 25 bp, Homo sapien
gttgatacgtgtatttgggtcaaaa

SEQ ID NO: 248731 - DNA, 25 bp, Homo sapien
ttcccaggggaagctagcaatagtt

SEQ ID NO: 248732 - DNA, 25 bp, Homo sapien
ctagcaatagttttaaaagcacaaa

SEQ ID NO: 248733 - DNA, 25 bp, Homo sapien
caggatctttttgtagtaagtatat

SEQ ID NO: 248734 - DNA, 25 bp, Homo sapien
gtaatttgtgtgtttatgatatgta

SEQ ID NO: 248735 - DNA, 25 bp, Homo sapien
ttagatgttattgtgcctcttctcg

SEQ ID NO: 248736 - DNA, 25 bp, Homo sapien
atgttattgtgcctcttctcgtgtt

SEQ ID NO: 248737 - DNA, 25 bp, Homo sapien
tattgtgcctcttctcgtgttgata

SEQ ID NO: 248738 - DNA, 25 bp, Homo sapien
gactgggataagtagccgtttcaca

SEQ ID NO: 248739 - DNA, 25 bp, Homo sapien
agtagccgtttcacattcaattaga

SEQ ID NO: 248740 - DNA, 25 bp, Homo sapien
ttctgtggctggaataagatcaggg

SEQ ID NO: 248741 - DNA, 25 bp, Homo sapien
aattcatagcttgttgtgttagaga

SEQ ID NO: 248742 - DNA, 25 bp, Homo sapien
gagattaattaggattctgctgttg

SEQ ID NO: 248743 - DNA, 25 bp, Homo sapien
ttctgctgttgaatcttagtacaaa

SEQ ID NO: 248744 - DNA, 25 bp, Homo sapien
gatggtacttctgttatgttgccta

SEQ ID NO: 248745 - DNA, 25 bp, Homo sapien
ttgcctaagcagacaggaagctaca

SEQ ID NO: 248746 - DNA, 25 bp, Homo sapien
ggaagctacaagaaacaccagtctg

SEQ ID NO: 248747 - DNA, 25 bp, Homo sapien
agtgcctcaggatctcagatgattt

SEQ ID NO: 248748 - DNA, 25 bp, Homo sapien
tctcagatgatttaggaagtgtgct

SEQ ID NO: 248749 - DNA, 25 bp, Homo sapien
tctcccctcgctgctgcaccctggc

SEQ ID NO: 248750 - DNA, 25 bp, Homo sapien
gtcccaggttgggaggactcactct

SEQ ID NO: 248751 - DNA, 25 bp, Homo sapien
tcccaggttgggaggactcactctg

SEQ ID NO: 248752 - DNA, 25 bp, Homo sapien
cccaggttgggaggactcactctgt

SEQ ID NO: 248753 - DNA, 25 bp, Homo sapien
ccaggttgggaggactcactctgtg

SEQ ID NO: 248754 - DNA, 25 bp, Homo sapien
caggttgggaggactcactctgtgc

SEQ ID NO: 248755 - DNA, 25 bp, Homo sapien
aggttgggaggactcactctgtgct

SEQ ID NO: 248756 - DNA, 25 bp, Homo sapien
tgggaggactcactctgtgctcccc

SEQ ID NO: 248757 - DNA, 25 bp, Homo sapien
gggaggactcactctgtgctccccg

SEQ ID NO: 248758 - DNA, 25 bp, Homo sapien
ggaggactcactctgtgctccccga

SEQ ID NO: 248759 - DNA, 25 bp, Homo sapien
gaggactcactctgtgctccccgac

SEQ ID NO: 248760 - DNA, 25 bp, Homo sapien
agggccgattactgacctcataaat

SEQ ID NO: 248761 - DNA, 25 bp, Homo sapien
atggtgatcgactgtccaggcgacc

SEQ ID NO: 248762 - DNA, 25 bp, Homo sapien
tccgccgaaaaccacgagagggttg

SEQ ID NO: 248763 - DNA, 25 bp, Homo sapien
gaaaaccacgagagggttgctactt

SEQ ID NO: 248764 - DNA, 25 bp, Homo sapien
ccacgagagggttgctacttgtata

SEQ ID NO: 248765 - DNA, 25 bp, Homo sapien
acgagagggttgctacttgtatatg

SEQ ID NO: 248766 - DNA, 25 bp, Homo sapien
atgagatgcagtagtaatcaccctc

SEQ ID NO: 248767 - DNA, 25 bp, Homo sapien
agatgcagtagtaatcaccctcgtc

SEQ ID NO: 248768 - DNA, 25 bp, Homo sapien
atgcagtagtaatcaccctcgtcgt

SEQ ID NO: 248769 - DNA, 25 bp, Homo sapien
cagtagtaatcaccctcgtcgtcag

SEQ ID NO: 248770 - DNA, 25 bp, Homo sapien
aatcaccctcgtcgtcagcctggag

SEQ ID NO: 248771 - DNA, 25 bp, Homo sapien
tggaccccaaacaataccttttgtg

SEQ ID NO: 248772 - DNA, 25 bp, Homo sapien
gaggttgatagtcatcttttagcaa

SEQ ID NO: 248773 - DNA, 25 bp, Homo sapien
tgattgtactctaagcatttgcatt

SEQ ID NO: 248774 - DNA, 25 bp, Homo sapien
gaacgagcacacatattctgagcat

SEQ ID NO: 248775 - DNA, 25 bp, Homo sapien
ttctgagcatttattggcaccaagc

SEQ ID NO: 248776 - DNA, 25 bp, Homo sapien
gcacttttccaggtagctttacaaa

SEQ ID NO: 248777 - DNA, 25 bp, Homo sapien
acaaattctgtcactgaagcccttg

SEQ ID NO: 248778 - DNA, 25 bp, Homo sapien
agcccttgccatagactactttgaa

SEQ ID NO: 248779 - DNA, 25 bp, Homo sapien
aaatagttacttgtgttctcgccag

SEQ ID NO: 248780 - DNA, 25 bp, Homo sapien
ttctcgccagtgttattcacctttt

SEQ ID NO: 248781 - DNA, 25 bp, Homo sapien
ttcctcccaacatttggcacagtgc

SEQ ID NO: 248782 - DNA, 25 bp, Homo sapien
gaacaagacctgcttggagggattc

SEQ ID NO: 248783 - DNA, 25 bp, Homo sapien
gagggattccactgagtgaaaccca

SEQ ID NO: 248784 - DNA, 25 bp, Homo sapien
gagtgaaacccactcacaggcttgt

SEQ ID NO: 248785 - DNA, 25 bp, Homo sapien
actcacaggcttgtccatgtgctgc

SEQ ID NO: 248786 - DNA, 25 bp, Homo sapien
acattccgtggacatcagcactact

SEQ ID NO: 248787 - DNA, 25 bp, Homo sapien
gacatcagcactactctcctgagga

SEQ ID NO: 248788 - DNA, 25 bp, Homo sapien
ctgaggactcttcagtggctgagca

SEQ ID NO: 248789 - DNA, 25 bp, Homo sapien
gctgagcagctttggacttgtttgt

SEQ ID NO: 248790 - DNA, 25 bp, Homo sapien
gtttgttatcctattttgcatgtgt

SEQ ID NO: 248791 - DNA, 25 bp, Homo sapien
gaaaatccacacatcttgagcctaa

SEQ ID NO: 248792 - DNA, 25 bp, Homo sapien
gagcctaatcatgtagtgtagatca

SEQ ID NO: 248793 - DNA, 25 bp, Homo sapien
gatgtttgtatccaactccgggcaa

SEQ ID NO: 248794 - DNA, 25 bp, Homo sapien
atgtttgtatccaactccgggcaat

SEQ ID NO: 248795 - DNA, 25 bp, Homo sapien
gtttgtatccaactccgggcaatgt

SEQ ID NO: 248796 - DNA, 25 bp, Homo sapien
ttgtatccaactccgggcaatgtgg

SEQ ID NO: 248797 - DNA, 25 bp, Homo sapien
aactccgggcaatgtggggctacaa

SEQ ID NO: 248798 - DNA, 25 bp, Homo sapien
gctacaaaggcccctggcttccata

SEQ ID NO: 248799 - DNA, 25 bp, Homo sapien
ctggcttccataccctggggaccgg

SEQ ID NO: 248800 - DNA, 25 bp, Homo sapien
gagggctggtgctcccgcggtgggt

SEQ ID NO: 248801 - DNA, 25 bp, Homo sapien
aggcaagcaggcatcagctccggcg

SEQ ID NO: 248802 - DNA, 25 bp, Homo sapien
aagcaggcatcagctccggcgctgg

SEQ ID NO: 248803 - DNA, 25 bp, Homo sapien
caggcatcagctccggcgctggtct

SEQ ID NO: 248804 - DNA, 25 bp, Homo sapien
ttggggtatgagtccttcctcgcgg

SEQ ID NO: 248805 - DNA, 25 bp, Homo sapien
gctcggtgggtcctgagtattcttt

SEQ ID NO: 248806 - DNA, 25 bp, Homo sapien
cctgagtattctttggccggatttg

SEQ ID NO: 248807 - DNA, 25 bp, Homo sapien
attctttggccggatttgctgatcc

SEQ ID NO: 248808 - DNA, 25 bp, Homo sapien
ggatttgctgatccgtctgctccag

SEQ ID NO: 248809 - DNA, 25 bp, Homo sapien
gggatgtggcccaggcaatctttta

SEQ ID NO: 248810 - DNA, 25 bp, Homo sapien
agacctccaggtgattataatgcaa

SEQ ID NO: 248811 - DNA, 25 bp, Homo sapien
aggaaggattccctatcttggacct

SEQ ID NO: 248812 - DNA, 25 bp, Homo sapien
aaggattccctatcttggacctgag

SEQ ID NO: 248813 - DNA, 25 bp, Homo sapien
gattccctatcttggacctgaggct

SEQ ID NO: 248814 - DNA, 25 bp, Homo sapien
ttccctatcttggacctgaggctgc

SEQ ID NO: 248815 - DNA, 25 bp, Homo sapien
ctgttactgtagatgattagggcct

SEQ ID NO: 248816 - DNA, 25 bp, Homo sapien
atgattagggcctaactgtaaatac

SEQ ID NO: 248817 - DNA, 25 bp, Homo sapien
tgtaaatacagatggctctgactat

SEQ ID NO: 248818 - DNA, 25 bp, Homo sapien
tttgtgatgagaacactgcagcact

SEQ ID NO: 248819 - DNA, 25 bp, Homo sapien
gaacactgcagcactgtggtttctc

SEQ ID NO: 248820 - DNA, 25 bp, Homo sapien
actgcagcactgtggtttctctaag

SEQ ID NO: 248821 - DNA, 25 bp, Homo sapien
ctgtggtttctctaagtggttattt

SEQ ID NO: 248822 - DNA, 25 bp, Homo sapien
tttgaacactcctggtaacgaccta

SEQ ID NO: 248823 - DNA, 25 bp, Homo sapien
gaacactcctggtaacgacctatac

SEQ ID NO: 248824 - DNA, 25 bp, Homo sapien
ggtaacgacctataccacttagaat

SEQ ID NO: 248825 - DNA, 25 bp, Homo sapien
gacctataccacttagaatagttgg

SEQ ID NO: 248826 - DNA, 25 bp, Homo sapien
gtgccataattcatatttgtcgcca

SEQ ID NO: 248827 - DNA, 25 bp, Homo sapien
agcatcttctcaggctgacactgtg

SEQ ID NO: 248828 - DNA, 25 bp, Homo sapien
gacactgtgccaaacaagggattat

SEQ ID NO: 248829 - DNA, 25 bp, Homo sapien
gatgcagcttccatccctgaaagct

SEQ ID NO: 248830 - DNA, 25 bp, Homo sapien
atccctgaaagctcacagtccattc

SEQ ID NO: 248831 - DNA, 25 bp, Homo sapien
ttgagtcatcacctgacactggaca

SEQ ID NO: 248832 - DNA, 25 bp, Homo sapien
atcacaatcatccatccagatcatg

SEQ ID NO: 248833 - DNA, 25 bp, Homo sapien
agatcatggaagtccctttactccc

SEQ ID NO: 248834 - DNA, 25 bp, Homo sapien
gacactggacactttgtttatccaa

SEQ ID NO: 248835 - DNA, 25 bp, Homo sapien
tcaggattttctgttagcaagcaaa

SEQ ID NO: 248836 - DNA, 25 bp, Homo sapien
caaaggaactgctcatgggtaagaa

SEQ ID NO: 248837 - DNA, 25 bp, Homo sapien
attgcctgccaggttgagctccttt

SEQ ID NO: 248838 - DNA, 25 bp, Homo sapien
gagctcctttataggcggtccgtgt

SEQ ID NO: 248839 - DNA, 25 bp, Homo sapien
gaaagcaggtgttccgcacttccgt

SEQ ID NO: 248840 - DNA, 25 bp, Homo sapien
gcacttccgtgatgttgttcaaact

SEQ ID NO: 248841 - DNA, 25 bp, Homo sapien
gaaaggtaggccttcagctggctcc

SEQ ID NO: 248842 - DNA, 25 bp, Homo sapien
acgctgcgaatcttgttgtgctgca

SEQ ID NO: 248843 - DNA, 25 bp, Homo sapien
acgacatgtgatgaagcagcgccca

SEQ ID NO: 248844 - DNA, 25 bp, Homo sapien
gtgatcctgtttttgctcaggcgaa

SEQ ID NO: 248845 - DNA, 25 bp, Homo sapien
cgaagagttagcagcgaccgtgaca

SEQ ID NO: 248846 - DNA, 25 bp, Homo sapien
gaccgtgacagaccatcaaatgctc

SEQ ID NO: 248847 - DNA, 25 bp, Homo sapien
caactccagggtgccaatccgattg

SEQ ID NO: 248848 - DNA, 25 bp, Homo sapien
ggctgattggcgctggtttccatct

SEQ ID NO: 248849 - DNA, 25 bp, Homo sapien
ctggtttccatctgtcagattggac

SEQ ID NO: 248850 - DNA, 25 bp, Homo sapien
catctgtcagattggacagcagtac

SEQ ID NO: 248851 - DNA, 25 bp, Homo sapien
gggctcacgaccagatagagtcttg

SEQ ID NO: 248852 - DNA, 25 bp, Homo sapien
agatagagtcttgtctgggaaccac

SEQ ID NO: 248853 - DNA, 25 bp, Homo sapien
gaaccacaagtgagtgttgttacca

SEQ ID NO: 248854 - DNA, 25 bp, Homo sapien
agtgagtgttgttaccacagctctg

SEQ ID NO: 248855 - DNA, 25 bp, Homo sapien
gagtgttgttaccacagctctgcag

SEQ ID NO: 248856 - DNA, 25 bp, Homo sapien
agcagtgagggcacctctcaatcca

SEQ ID NO: 248857 - DNA, 25 bp, Homo sapien
agggcacctctcaatccacgtgcag

SEQ ID NO: 248858 - DNA, 25 bp, Homo sapien
tcttcaggggatacggtccaacacc

SEQ ID NO: 248859 - DNA, 25 bp, Homo sapien
actttacaaacccacagttctgctg

SEQ ID NO: 248860 - DNA, 25 bp, Homo sapien
ccacagttctgctgtttcacagtga

SEQ ID NO: 248861 - DNA, 25 bp, Homo sapien
agttctgctgtttcacagtgagatt

SEQ ID NO: 248862 - DNA, 25 bp, Homo sapien
gtttcacagtgagattcgagtctaa

SEQ ID NO: 248863 - DNA, 25 bp, Homo sapien
gtgagattcgagtctaaataagtac

SEQ ID NO: 248864 - DNA, 25 bp, Homo sapien
tgttaaattagttgtagcctaaagc

SEQ ID NO: 248865 - DNA, 25 bp, Homo sapien
ctaaagcttccctcttatgtttaat

SEQ ID NO: 248866 - DNA, 25 bp, Homo sapien
cttatgtttaattttggctaatagg

SEQ ID NO: 248867 - DNA, 25 bp, Homo sapien
gtaaacttaatgttcaaatgggaca

SEQ ID NO: 248868 - DNA, 25 bp, Homo sapien
atgggacatatcttaagctgtaata

SEQ ID NO: 248869 - DNA, 25 bp, Homo sapien
tatcttaagctgtaataaatctggc

SEQ ID NO: 248870 - DNA, 25 bp, Homo sapien
tcagcactggccgaagacatccggt

SEQ ID NO: 248871 - DNA, 25 bp, Homo sapien
agcactggccgaagacatccggtgc

SEQ ID NO: 248872 - DNA, 25 bp, Homo sapien
ggccgaagacatccggtgcctctag

SEQ ID NO: 248873 - DNA, 25 bp, Homo sapien
gaagacatccggtgcctctagccac

SEQ ID NO: 248874 - DNA, 25 bp, Homo sapien
actgtccaaggcactgtcttctttg

SEQ ID NO: 248875 - DNA, 25 bp, Homo sapien
gtccaaggcactgtcttctttggga

SEQ ID NO: 248876 - DNA, 25 bp, Homo sapien
caaggcactgtcttctttgggaagg

SEQ ID NO: 248877 - DNA, 25 bp, Homo sapien
ggcactgtcttctttgggaaggtat

SEQ ID NO: 248878 - DNA, 25 bp, Homo sapien
actgtcttctttgggaaggtatctg

SEQ ID NO: 248879 - DNA, 25 bp, Homo sapien
tctttgggaaggtatctgatttggt

SEQ ID NO: 248880 - DNA, 25 bp, Homo sapien
tgggaaggtatctgatttggtcagt

SEQ ID NO: 248881 - DNA, 25 bp, Homo sapien
ccagccaggataattgggttcctta

SEQ ID NO: 248882 - DNA, 25 bp, Homo sapien
taacctgatatgcatccctgaggca

SEQ ID NO: 248883 - DNA, 25 bp, Homo sapien
gaggcattatcctgagcagccacta

SEQ ID NO: 248884 - DNA, 25 bp, Homo sapien
gagcagccactagatgtccataatg

SEQ ID NO: 248885 - DNA, 25 bp, Homo sapien
taatgcctcatagggtgttccagga

SEQ ID NO: 248886 - DNA, 25 bp, Homo sapien
agtgagctgggtatcgttttgccac

SEQ ID NO: 248887 - DNA, 25 bp, Homo sapien
gttttgccaccaaataggctttgcg

SEQ ID NO: 248888 - DNA, 25 bp, Homo sapien
taggctttgcggactcttttaaggg

SEQ ID NO: 248889 - DNA, 25 bp, Homo sapien
tttaagggtaggtccatcagtggca

SEQ ID NO: 248890 - DNA, 25 bp, Homo sapien
cctagtgactttgggtcgccaatag

SEQ ID NO: 248891 - DNA, 25 bp, Homo sapien
gtcatctagaggacccaggactctc

SEQ ID NO: 248892 - DNA, 25 bp, Homo sapien
gttacttgcctgattaggtgctgga

SEQ ID NO: 248893 - DNA, 25 bp, Homo sapien
ggctccctgttttggtgtggactca

SEQ ID NO: 248894 - DNA, 25 bp, Homo sapien
tggactcatggcaagctggtgttta

SEQ ID NO: 248895 - DNA, 25 bp, Homo sapien
tcaggaggcctgctgatctttcaaa

SEQ ID NO: 248896 - DNA, 25 bp, Homo sapien
tgctgatctttcaaaggacacccat

SEQ ID NO: 248897 - DNA, 25 bp, Homo sapien
tgatgtctactcatagaaagggcaa

SEQ ID NO: 248898 - DNA, 25 bp, Homo sapien
gcaagtaacgtgttcattttggtct

SEQ ID NO: 248899 - DNA, 25 bp, Homo sapien
ttgaatgtccaaactcaagggttgg

SEQ ID NO: 248900 - DNA, 25 bp, Homo sapien
aatcagacatatgcgatcttgggtt

SEQ ID NO: 248901 - DNA, 25 bp, Homo sapien
gcgatcttgggtttttgcatggaaa

SEQ ID NO: 248902 - DNA, 25 bp, Homo sapien
gaaaacatttcaaccatctaagtca

SEQ ID NO: 248903 - DNA, 25 bp, Homo sapien
cagtggcttaatatatgtatgggaa

SEQ ID NO: 248904 - DNA, 25 bp, Homo sapien
gaagttggcacttttctaccctctg

SEQ ID NO: 248905 - DNA, 25 bp, Homo sapien
acttttctaccctctgagcttggtt

SEQ ID NO: 248906 - DNA, 25 bp, Homo sapien
ctaccctctgagcttggttcttaat

SEQ ID NO: 248907 - DNA, 25 bp, Homo sapien
ccctctgagcttggttcttaataag

SEQ ID NO: 248908 - DNA, 25 bp, Homo sapien
gagcttggttcttaataagcataat

SEQ ID NO: 248909 - DNA, 25 bp, Homo sapien
gaatatgtagtatctcctaattatg

SEQ ID NO: 248910 - DNA, 25 bp, Homo sapien
gtatctcctaattatgagcactgca

SEQ ID NO: 248911 - DNA, 25 bp, Homo sapien
aattatgagcactgcatgagaatta

SEQ ID NO: 248912 - DNA, 25 bp, Homo sapien
gaaaaatcagtatgttctctgtttt

SEQ ID NO: 248913 - DNA, 25 bp, Homo sapien
atgtcaaagtttatgtcagggttaa

SEQ ID NO: 248914 - DNA, 25 bp, Homo sapien
aatactgactttgagtaacggcctt

SEQ ID NO: 248915 - DNA, 25 bp, Homo sapien
gagtaacggccttgaggtgtccctc

SEQ ID NO: 248916 - DNA, 25 bp, Homo sapien
tgaggtgtccctcgcccttttggtt

SEQ ID NO: 248917 - DNA, 25 bp, Homo sapien
tggtttgttcaaggagctgctgctt

SEQ ID NO: 248918 - DNA, 25 bp, Homo sapien
gctgctgctttgcatagctgctcta

SEQ ID NO: 248919 - DNA, 25 bp, Homo sapien
atagctgctctagtgtctggtatca

SEQ ID NO: 248920 - DNA, 25 bp, Homo sapien
gtctggtatcatcggatctggtttt

SEQ ID NO: 248921 - DNA, 25 bp, Homo sapien
ttttgaataattcccaggagtcctg

SEQ ID NO: 248922 - DNA, 25 bp, Homo sapien
aatgtgaacgcatgccacggtggtc

SEQ ID NO: 248923 - DNA, 25 bp, Homo sapien
atgccacggtggtctgaccctcaca

SEQ ID NO: 248924 - DNA, 25 bp, Homo sapien
gtgatttttcttctgatcagtttca

SEQ ID NO: 248925 - DNA, 25 bp, Homo sapien
ttaccttgctcgattgccttgctga

SEQ ID NO: 248926 - DNA, 25 bp, Homo sapien
attgccttgctgactacatcatgga

SEQ ID NO: 248927 - DNA, 25 bp, Homo sapien
ggcagtatgcgcaacacttcacaag

SEQ ID NO: 248928 - DNA, 25 bp, Homo sapien
gaagtggacaacaaccgtgagcccc

SEQ ID NO: 248929 - DNA, 25 bp, Homo sapien
agccccacagcgctgagagtgatgt

SEQ ID NO: 248930 - DNA, 25 bp, Homo sapien
gatgtgactcgctttttgtttgatg

SEQ ID NO: 248931 - DNA, 25 bp, Homo sapien
gatgagatgcccaaatccaggaaga

SEQ ID NO: 248932 - DNA, 25 bp, Homo sapien
ctgggtcccagagccttgaagggaa

SEQ ID NO: 248933 - DNA, 25 bp, Homo sapien
gaagggaacctcacaggcttagcca

SEQ ID NO: 248934 - DNA, 25 bp, Homo sapien
cttagccagggcaaaaatgtgtcac

SEQ ID NO: 248935 - DNA, 25 bp, Homo sapien
gctgaggaatatctgctgttgtcat

SEQ ID NO: 248936 - DNA, 25 bp, Homo sapien
aaatagacatattccctccaccctt

SEQ ID NO: 248937 - DNA, 25 bp, Homo sapien
ccacccttctcatgttagtaaatgt

SEQ ID NO: 248938 - DNA, 25 bp, Homo sapien
acgaatatgggcttatgatttcaca

SEQ ID NO: 248939 - DNA, 25 bp, Homo sapien
catgttagtaaatgtttcctgcttg

SEQ ID NO: 248940 - DNA, 25 bp, Homo sapien
gaatatgggcttatgatttcacagg

SEQ ID NO: 248941 - DNA, 25 bp, Homo sapien
acagctgacaccacaaataatttta

SEQ ID NO: 248942 - DNA, 25 bp, Homo sapien
ccaggcctttaaaacatagtagcaa

SEQ ID NO: 248943 - DNA, 25 bp, Homo sapien
ggtcatctctatttcactagtaatc

SEQ ID NO: 248944 - DNA, 25 bp, Homo sapien
tctctatttcactagtaatctgata

SEQ ID NO: 248945 - DNA, 25 bp, Homo sapien
ctgtgaggcgaaggtaggtctttaa

SEQ ID NO: 248946 - DNA, 25 bp, Homo sapien
ggcgaaggtaggtctttaatgaaat

SEQ ID NO: 248947 - DNA, 25 bp, Homo sapien
gatgatgaagtcttcttcggaccct

SEQ ID NO: 248948 - DNA, 25 bp, Homo sapien
tgaagtcttcttcggaccctttgga

SEQ ID NO: 248949 - DNA, 25 bp, Homo sapien
agaaagatgtattgctgccagcttg

SEQ ID NO: 248950 - DNA, 25 bp, Homo sapien
gccagcttggaattaaataatccgg

SEQ ID NO: 248951 - DNA, 25 bp, Homo sapien
gttgcccacatctgagagtcccttt

SEQ ID NO: 248952 - DNA, 25 bp, Homo sapien
agtccctttgcctggagccctctgg

SEQ ID NO: 248953 - DNA, 25 bp, Homo sapien
agaagttcgtggaggtgtacaaaga

SEQ ID NO: 248954 - DNA, 25 bp, Homo sapien
ggtgtacaaagaagctcacttactg

SEQ ID NO: 248955 - DNA, 25 bp, Homo sapien
agctcacttactggctttacacatt

SEQ ID NO: 248956 - DNA, 25 bp, Homo sapien
tttacacattgagagcagcagccgg

SEQ ID NO: 248957 - DNA, 25 bp, Homo sapien
gccagggcgtggaaagattcataca

SEQ ID NO: 248958 - DNA, 25 bp, Homo sapien
ggccaaactgattgccatcaggtca

SEQ ID NO: 248959 - DNA, 25 bp, Homo sapien
tcaggtcagacaaaactgcctttta

SEQ ID NO: 248960 - DNA, 25 bp, Homo sapien
tttatggtgtagtctgccagcttca

SEQ ID NO: 248961 - DNA, 25 bp, Homo sapien
atgctgtattgttgttattggctag

SEQ ID NO: 248962 - DNA, 25 bp, Homo sapien
gactattgttggactattttttatc

SEQ ID NO: 248963 - DNA, 25 bp, Homo sapien
ttatcaaatgctttaccccacgcct

SEQ ID NO: 248964 - DNA, 25 bp, Homo sapien
cacgcctgtttgtattgggagctct

SEQ ID NO: 248965 - DNA, 25 bp, Homo sapien
ggaccaatagtgtctctcctagtga

SEQ ID NO: 248966 - DNA, 25 bp, Homo sapien
gtctctcctagtgacagaaatatga

SEQ ID NO: 248967 - DNA, 25 bp, Homo sapien
tgtggattacacagcctcatccctc

SEQ ID NO: 248968 - DNA, 25 bp, Homo sapien
tccagcccatccaaaatgctatatt

SEQ ID NO: 248969 - DNA, 25 bp, Homo sapien
ggttcctcgtgggtatcgtcctcat

SEQ ID NO: 248970 - DNA, 25 bp, Homo sapien
gttcctcgtgggtatcgtcctcatc

SEQ ID NO: 248971 - DNA, 25 bp, Homo sapien
atggagaccctagtttgtgccctag

SEQ ID NO: 248972 - DNA, 25 bp, Homo sapien
tggagaccctagtttgtgccctagg

SEQ ID NO: 248973 - DNA, 25 bp, Homo sapien
ggagaccctagtttgtgccctaggc

SEQ ID NO: 248974 - DNA, 25 bp, Homo sapien
gagaccctagtttgtgccctaggcc

SEQ ID NO: 248975 - DNA, 25 bp, Homo sapien
gaccctagtttgtgccctaggccta

SEQ ID NO: 248976 - DNA, 25 bp, Homo sapien
accctagtttgtgccctaggcctag

SEQ ID NO: 248977 - DNA, 25 bp, Homo sapien
tgtgccctaggcctagacattggcc

SEQ ID NO: 248978 - DNA, 25 bp, Homo sapien
ccctaggcctagacattggcctggt

SEQ ID NO: 248979 - DNA, 25 bp, Homo sapien
acattggcctggtggggttcctcgt

SEQ ID NO: 248980 - DNA, 25 bp, Homo sapien
gcactcctctttgccctagagataa

SEQ ID NO: 248981 - DNA, 25 bp, Homo sapien
gccctagagataagggacctgactt

SEQ ID NO: 248982 - DNA, 25 bp, Homo sapien
atcctgaacatttgtacccctggag

SEQ ID NO: 248983 - DNA, 25 bp, Homo sapien
gtacccctggagaagttccttagca

SEQ ID NO: 248984 - DNA, 25 bp, Homo sapien
gaatcacaaggaacctctggctagg

SEQ ID NO: 248985 - DNA, 25 bp, Homo sapien
tggctaggtgatcctgatgtttcct

SEQ ID NO: 248986 - DNA, 25 bp, Homo sapien
gatgtttcctactgagtttttctgg

SEQ ID NO: 248987 - DNA, 25 bp, Homo sapien
cctactgagtttttctggtatccag

SEQ ID NO: 248988 - DNA, 25 bp, Homo sapien
ccagatttctggaaaccgagtaatc

SEQ ID NO: 248989 - DNA, 25 bp, Homo sapien
tgggtggttcatctgcttccatccc

SEQ ID NO: 248990 - DNA, 25 bp, Homo sapien
ttcatctgcttccatcccagtgaaa

SEQ ID NO: 248991 - DNA, 25 bp, Homo sapien
gtgcgctctcgcgaggaggcggcag

SEQ ID NO: 248992 - DNA, 25 bp, Homo sapien
tgtccgagttggagagtgctctgca

SEQ ID NO: 248993 - DNA, 25 bp, Homo sapien
ccgagttggagagtgctctgcagat

SEQ ID NO: 248994 - DNA, 25 bp, Homo sapien
tatattctgctgagaagccaaagct

SEQ ID NO: 248995 - DNA, 25 bp, Homo sapien
ttctgctgagaagccaaagctggaa

SEQ ID NO: 248996 - DNA, 25 bp, Homo sapien
aagatgagcatctcgttttcttctg

SEQ ID NO: 248997 - DNA, 25 bp, Homo sapien
atgagcatctcgttttcttctgtca

SEQ ID NO: 248998 - DNA, 25 bp, Homo sapien
agcatctcgttttcttctgtcagat

SEQ ID NO: 248999 - DNA, 25 bp, Homo sapien
ttcttctgtcagatgggcaagcggg

SEQ ID NO: 249000 - DNA, 25 bp, Homo sapien
acggtctcgcttcctgaactccgtt

SEQ ID NO: 249001 - DNA, 25 bp, Homo sapien
cgttcactcctagcctccggacggg

SEQ ID NO: 249002 - DNA, 25 bp, Homo sapien
ccaaggctttggatgtatcactagt

SEQ ID NO: 249003 - DNA, 25 bp, Homo sapien
gatgtatcactagtttgttcctttt

SEQ ID NO: 249004 - DNA, 25 bp, Homo sapien
gatatatcacttagttttaacagct

SEQ ID NO: 249005 - DNA, 25 bp, Homo sapien
gttttaacagctaaggtatctattt

SEQ ID NO: 249006 - DNA, 25 bp, Homo sapien
gttacacaaattcatgcaactttca

SEQ ID NO: 249007 - DNA, 25 bp, Homo sapien
gcaactttcatataagcattaaacc

SEQ ID NO: 249008 - DNA, 25 bp, Homo sapien
taaaccatacagctgcatctacgta

SEQ ID NO: 249009 - DNA, 25 bp, Homo sapien
acagctgcatctacgtaagtataat

SEQ ID NO: 249010 - DNA, 25 bp, Homo sapien
aaatcactgaacatgccacttcctg

SEQ ID NO: 249011 - DNA, 25 bp, Homo sapien
ctccgtctgcggtgttgacatatga

SEQ ID NO: 249012 - DNA, 25 bp, Homo sapien
atatgaggtacagcaatccgagagt

SEQ ID NO: 249013 - DNA, 25 bp, Homo sapien
aaactttgtaagagtggtctacgca

SEQ ID NO: 249014 - DNA, 25 bp, Homo sapien
tggtctacgcacacaggatcttgtc

SEQ ID NO: 249015 - DNA, 25 bp, Homo sapien
aggatcttgtcctccctaggcgtgg

SEQ ID NO: 249016 - DNA, 25 bp, Homo sapien
tccctaggcgtggatagagagatgc

SEQ ID NO: 249017 - DNA, 25 bp, Homo sapien
gagagatgccataatctgccagcat

SEQ ID NO: 249018 - DNA, 25 bp, Homo sapien
ttgaggcgttgatacatagtgcagt

SEQ ID NO: 249019 - DNA, 25 bp, Homo sapien
agtgcagtgagccaatttccttttc

SEQ ID NO: 249020 - DNA, 25 bp, Homo sapien
tgagccaatttccttttcagttgtc

SEQ ID NO: 249021 - DNA, 25 bp, Homo sapien
cactcagcaccataacatcacgaag

SEQ ID NO: 249022 - DNA, 25 bp, Homo sapien
tgcaaacctctcactaagccttcag

SEQ ID NO: 249023 - DNA, 25 bp, Homo sapien
tctcactaagccttcagaccaaagt

SEQ ID NO: 249024 - DNA, 25 bp, Homo sapien
tttaatagtatattcagtggctgaa

SEQ ID NO: 249025 - DNA, 25 bp, Homo sapien
ggagtattaatcattatttcttcag

SEQ ID NO: 249026 - DNA, 25 bp, Homo sapien
gatatacctgggaaatattcttgga

SEQ ID NO: 249027 - DNA, 25 bp, Homo sapien
aatattcttggatccttcacacatc

SEQ ID NO: 249028 - DNA, 25 bp, Homo sapien
gatccttcacacatccacttaattt

SEQ ID NO: 249029 - DNA, 25 bp, Homo sapien
atttcagaaattgtgggctcattcc

SEQ ID NO: 249030 - DNA, 25 bp, Homo sapien
gaaattgtgggctcattccctccct

SEQ ID NO: 249031 - DNA, 25 bp, Homo sapien
cattccctccctctagtttatttat

SEQ ID NO: 249032 - DNA, 25 bp, Homo sapien
ttatttgctcatctttatcacctaa

SEQ ID NO: 249033 - DNA, 25 bp, Homo sapien
ttgctcatctttatcacctaatggt

SEQ ID NO: 249034 - DNA, 25 bp, Homo sapien
ctttatcacctaatggtagtttgtt

SEQ ID NO: 249035 - DNA, 25 bp, Homo sapien
gttcatttacttgccaggaccctgg

SEQ ID NO: 249036 - DNA, 25 bp, Homo sapien
aggaccctggctctacttttagagt

SEQ ID NO: 249037 - DNA, 25 bp, Homo sapien
aagaaactctaacttgcatcaaggt

SEQ ID NO: 249038 - DNA, 25 bp, Homo sapien
taaaggttccgatctttctccttgg

SEQ ID NO: 249039 - DNA, 25 bp, Homo sapien
gtggagtgatctcattctcaggaca

SEQ ID NO: 249040 - DNA, 25 bp, Homo sapien
cgtttacttacctgattcctcggag

SEQ ID NO: 249041 - DNA, 25 bp, Homo sapien
ttcctcggagcattatcaacttctg

SEQ ID NO: 249042 - DNA, 25 bp, Homo sapien
aacttctgctctgttgtcctgacca

SEQ ID NO: 249043 - DNA, 25 bp, Homo sapien
tgtcctgaccatacatatgtcctag

SEQ ID NO: 249044 - DNA, 25 bp, Homo sapien
acatatgtcctagaactacagttaa

SEQ ID NO: 249045 - DNA, 25 bp, Homo sapien
gaatcctgtataaaagaactccaag

SEQ ID NO: 249046 - DNA, 25 bp, Homo sapien
atcgtctcagctcatttatcaagta

SEQ ID NO: 249047 - DNA, 25 bp, Homo sapien
aatgagccttttgtgtacacacaga

SEQ ID NO: 249048 - DNA, 25 bp, Homo sapien
gtgtacacacagaggcacatgtgca

SEQ ID NO: 249049 - DNA, 25 bp, Homo sapien
caacttgtgaacacacatttctgtt

SEQ ID NO: 249050 - DNA, 25 bp, Homo sapien
aaattcctttctgaagtgtctcttc

SEQ ID NO: 249051 - DNA, 25 bp, Homo sapien
tctgaagtgtctcttctgtgaaagg

SEQ ID NO: 249052 - DNA, 25 bp, Homo sapien
ggttcagagcagattttgcttacta

SEQ ID NO: 249053 - DNA, 25 bp, Homo sapien
gcttactatgtagtgttgcccttaa

SEQ ID NO: 249054 - DNA, 25 bp, Homo sapien
gttgcccttaagtacagtggtgtaa

SEQ ID NO: 249055 - DNA, 25 bp, Homo sapien
cagtggtgtaattttattcaagatt

SEQ ID NO: 249056 - DNA, 25 bp, Homo sapien
attcaagattgtgctcttctatcaa

SEQ ID NO: 249057 - DNA, 25 bp, Homo sapien
tttgctgtgaccaacagggaggaca

SEQ ID NO: 249058 - DNA, 25 bp, Homo sapien
gacagggcctgggactgttctccca

SEQ ID NO: 249059 - DNA, 25 bp, Homo sapien
tgggactgttctcccagatccgcca

SEQ ID NO: 249060 - DNA, 25 bp, Homo sapien
tgcaccggccgcctgtgtaacagag

SEQ ID NO: 249061 - DNA, 25 bp, Homo sapien
aaatggccagagaggccctggacaa

SEQ ID NO: 249062 - DNA, 25 bp, Homo sapien
tggacaacctcttgcggccctggct

SEQ ID NO: 249063 - DNA, 25 bp, Homo sapien
tcccttctaaggctgtccaccagga

SEQ ID NO: 249064 - DNA, 25 bp, Homo sapien
taaggctgtccaccaggagcccggt

SEQ ID NO: 249065 - DNA, 25 bp, Homo sapien
tgtccaccaggagcccggtgctagg

SEQ ID NO: 249066 - DNA, 25 bp, Homo sapien
cagagccccgagcagccagacagtg

SEQ ID NO: 249067 - DNA, 25 bp, Homo sapien
actggggctgggtatgctgcttcct

SEQ ID NO: 249068 - DNA, 25 bp, Homo sapien
caggtttgcgcctgcgcaggtcgca

SEQ ID NO: 249069 - DNA, 25 bp, Homo sapien
gccggcttccgttcgcggactttgg

SEQ ID NO: 249070 - DNA, 25 bp, Homo sapien
ttccgttcgcggactttggcccagg

SEQ ID NO: 249071 - DNA, 25 bp, Homo sapien
ttcgcggactttggcccaggcgcgt

SEQ ID NO: 249072 - DNA, 25 bp, Homo sapien
gaaccggttcctggacttgagcgga

SEQ ID NO: 249073 - DNA, 25 bp, Homo sapien
aaccggttcctggacttgagcggag

SEQ ID NO: 249074 - DNA, 25 bp, Homo sapien
gccgcctgcacgactggactggagc

SEQ ID NO: 249075 - DNA, 25 bp, Homo sapien
gactggactggagcggccgggtgcc

SEQ ID NO: 249076 - DNA, 25 bp, Homo sapien
cctggaggcccctgggaattgcagt

SEQ ID NO: 249077 - DNA, 25 bp, Homo sapien
gaattgcagtccttgcgcaggtgga

SEQ ID NO: 249078 - DNA, 25 bp, Homo sapien
attgcagtccttgcgcaggtggaga

SEQ ID NO: 249079 - DNA, 25 bp, Homo sapien
agatggtggtattcatttataatca

SEQ ID NO: 249080 - DNA, 25 bp, Homo sapien
taaaacaaaatcatggccaggcctg

SEQ ID NO: 249081 - DNA, 25 bp, Homo sapien
aaaacaaaatcatggccaggcctgt

SEQ ID NO: 249082 - DNA, 25 bp, Homo sapien
aaacaaaatcatggccaggcctgtg

SEQ ID NO: 249083 - DNA, 25 bp, Homo sapien
tcatggccaggcctgtgactcacac

SEQ ID NO: 249084 - DNA, 25 bp, Homo sapien
cctggcactttaggaggcttaggaa

SEQ ID NO: 249085 - DNA, 25 bp, Homo sapien
ggattgtttgaaaccaggagctcaa

SEQ ID NO: 249086 - DNA, 25 bp, Homo sapien
aatttcttcctaatcagattaccaa

SEQ ID NO: 249087 - DNA, 25 bp, Homo sapien
aaattgataacttgcttttggctat

SEQ ID NO: 249088 - DNA, 25 bp, Homo sapien
attgataacttgcttttggctatgt

SEQ ID NO: 249089 - DNA, 25 bp, Homo sapien
gataacttgcttttggctatgttaa

SEQ ID NO: 249090 - DNA, 25 bp, Homo sapien
gtagtaactcacaatgcttcctggg

SEQ ID NO: 249091 - DNA, 25 bp, Homo sapien
gggtatttaaattctactctctcat

SEQ ID NO: 249092 - DNA, 25 bp, Homo sapien
gaggcatttctgattagcccttccc

SEQ ID NO: 249093 - DNA, 25 bp, Homo sapien
aattctactctctcatcagcactga

SEQ ID NO: 249094 - DNA, 25 bp, Homo sapien
actgagcacctactttgggcccttt

SEQ ID NO: 249095 - DNA, 25 bp, Homo sapien
ccctttcccgtgctagccatttggg

SEQ ID NO: 249096 - DNA, 25 bp, Homo sapien
gaacctttaggatttcacagccatg

SEQ ID NO: 249097 - DNA, 25 bp, Homo sapien
cacagccatgctggatgggataaaa

SEQ ID NO: 249098 - DNA, 25 bp, Homo sapien
aaaccagctcacatggagaatcaga

SEQ ID NO: 249099 - DNA, 25 bp, Homo sapien
ctattttcctagtatcactctttaa

SEQ ID NO: 249100 - DNA, 25 bp, Homo sapien
atttcatggcctccgtagtaactca

SEQ ID NO: 249101 - DNA, 25 bp, Homo sapien
tagccactgtgttcctatgtgttgc

SEQ ID NO: 249102 - DNA, 25 bp, Homo sapien
actgtgttcctatgtgttgcaacca

SEQ ID NO: 249103 - DNA, 25 bp, Homo sapien
ctatgtgttgcaaccaggagtcagt

SEQ ID NO: 249104 - DNA, 25 bp, Homo sapien
acctcaaagttgcaagcgctcgatg

SEQ ID NO: 249105 - DNA, 25 bp, Homo sapien
aagttgcaagcgctcgatgcagtca

SEQ ID NO: 249106 - DNA, 25 bp, Homo sapien
aagcgctcgatgcagtcacaatgtc

SEQ ID NO: 249107 - DNA, 25 bp, Homo sapien
gatgcagtcacaatgtccatcacca

SEQ ID NO: 249108 - DNA, 25 bp, Homo sapien
agtggtgtgtatatttcttaggaac

SEQ ID NO: 249109 - DNA, 25 bp, Homo sapien
tatttcttaggaacacttagtattt

SEQ ID NO: 249110 - DNA, 25 bp, Homo sapien
aaaggccaactgcaagtaacaccct

SEQ ID NO: 249111 - DNA, 25 bp, Homo sapien
aagtaacaccctgcgaggctctgta

SEQ ID NO: 249112 - DNA, 25 bp, Homo sapien
cccagacgccttggcggccagtgct

SEQ ID NO: 249113 - DNA, 25 bp, Homo sapien
gctccagcaggtgcgcggagcctcc

SEQ ID NO: 249114 - DNA, 25 bp, Homo sapien
agcaggtgcgcggagcctcccaccc

SEQ ID NO: 249115 - DNA, 25 bp, Homo sapien
tagctcctccgtccagtcagccgag

SEQ ID NO: 249116 - DNA, 25 bp, Homo sapien
tccgtccagtcagccgagcggctca

SEQ ID NO: 249117 - DNA, 25 bp, Homo sapien
tgaacacgttctggaagccatccgc

SEQ ID NO: 249118 - DNA, 25 bp, Homo sapien
gaacacgttctggaagccatccgca

SEQ ID NO: 249119 - DNA, 25 bp, Homo sapien
aacacgttctggaagccatccgcag

SEQ ID NO: 249120 - DNA, 25 bp, Homo sapien
acacgttctggaagccatccgcagc

SEQ ID NO: 249121 - DNA, 25 bp, Homo sapien
gttctggaagccatccgcagccgcg

SEQ ID NO: 249122 - DNA, 25 bp, Homo sapien
ttctggaagccatccgcagccgcgg

SEQ ID NO: 249123 - DNA, 25 bp, Homo sapien
gggataattcccaaacagcagcacc

SEQ ID NO: 249124 - DNA, 25 bp, Homo sapien
ataattcccaaacagcagcacccag

SEQ ID NO: 249125 - DNA, 25 bp, Homo sapien
agagcttcccgaattctcacagcag

SEQ ID NO: 249126 - DNA, 25 bp, Homo sapien
attctcacagcagccagatgatcct

SEQ ID NO: 249127 - DNA, 25 bp, Homo sapien
agcagccagatgatcctgtgttgca

SEQ ID NO: 249128 - DNA, 25 bp, Homo sapien
agccagatgatcctgtgttgcagtt

SEQ ID NO: 249129 - DNA, 25 bp, Homo sapien
gggccgctgaatccagcgtctcagg

SEQ ID NO: 249130 - DNA, 25 bp, Homo sapien
gggcagtgcattctggagttgagct

SEQ ID NO: 249131 - DNA, 25 bp, Homo sapien
tcttcatggtcacagcaacgcagga

SEQ ID NO: 249132 - DNA, 25 bp, Homo sapien
acagcaacgcaggacttcgggactt

SEQ ID NO: 249133 - DNA, 25 bp, Homo sapien
caacgcaggacttcgggacttcatg

SEQ ID NO: 249134 - DNA, 25 bp, Homo sapien
gtattagacagttttaaggcattca

SEQ ID NO: 249135 - DNA, 25 bp, Homo sapien
aaggcattcaactgagaaaacttta

SEQ ID NO: 249136 - DNA, 25 bp, Homo sapien
gaaaactttatttgtcaaggtcaga

SEQ ID NO: 249137 - DNA, 25 bp, Homo sapien
gaagttggtggattgctgtgttttt

SEQ ID NO: 249138 - DNA, 25 bp, Homo sapien
gctgtgtttttgcatgattagcatg

SEQ ID NO: 249139 - DNA, 25 bp, Homo sapien
ggagcaagaggaacatgcttgtttt

SEQ ID NO: 249140 - DNA, 25 bp, Homo sapien
gtggtacatgcagtgtgttctctct

SEQ ID NO: 249141 - DNA, 25 bp, Homo sapien
gtgttctctctttattggcttctaa

SEQ ID NO: 249142 - DNA, 25 bp, Homo sapien
ctctttattggcttctaaaccagtt

SEQ ID NO: 249143 - DNA, 25 bp, Homo sapien
agttttgtcctttaatgcatgtcaa

SEQ ID NO: 249144 - DNA, 25 bp, Homo sapien
ttaatgcatgtcaaatatttctccc

SEQ ID NO: 249145 - DNA, 25 bp, Homo sapien
tatttaccccacattacccaatcag

SEQ ID NO: 249146 - DNA, 25 bp, Homo sapien
tttaccccacattacccaatcagta

SEQ ID NO: 249147 - DNA, 25 bp, Homo sapien
taggtgtttgctaatatacacaatc

SEQ ID NO: 249148 - DNA, 25 bp, Homo sapien
atacacaatcattactataacctaa

SEQ ID NO: 249149 - DNA, 25 bp, Homo sapien
atcattactataacctaattaaggg

SEQ ID NO: 249150 - DNA, 25 bp, Homo sapien
gtaacaaatgcattcggttcttgac

SEQ ID NO: 249151 - DNA, 25 bp, Homo sapien
aaatgcattcggttcttgacagctg

SEQ ID NO: 249152 - DNA, 25 bp, Homo sapien
atgcattcggttcttgacagctgaa

SEQ ID NO: 249153 - DNA, 25 bp, Homo sapien
gcattcggttcttgacagctgaaaa

SEQ ID NO: 249154 - DNA, 25 bp, Homo sapien
tcggttcttgacagctgaaaacaaa

SEQ ID NO: 249155 - DNA, 25 bp, Homo sapien
ttgtttatggatttacttctttgag

SEQ ID NO: 249156 - DNA, 25 bp, Homo sapien
gccattgaagctaccgtcttcagca

SEQ ID NO: 249157 - DNA, 25 bp, Homo sapien
tattcagccatctcctcatgaagcc

SEQ ID NO: 249158 - DNA, 25 bp, Homo sapien
gaagcctgggatgtgattcttgtgc

SEQ ID NO: 249159 - DNA, 25 bp, Homo sapien
agctctttcctgaggggcactggta

SEQ ID NO: 249160 - DNA, 25 bp, Homo sapien
aatggtgcagtccaggtacagcatg

SEQ ID NO: 249161 - DNA, 25 bp, Homo sapien
ggtgcagtccaggtacagcatggac

SEQ ID NO: 249162 - DNA, 25 bp, Homo sapien
ctgacctgaacttcagccttcagaa

SEQ ID NO: 249163 - DNA, 25 bp, Homo sapien
gaacttcagccttcagaaccaagag

SEQ ID NO: 249164 - DNA, 25 bp, Homo sapien
ttcagccttcagaaccaagagacaa

SEQ ID NO: 249165 - DNA, 25 bp, Homo sapien
tgaatgcctgccattgaagctaccg

SEQ ID NO: 249166 - DNA, 25 bp, Homo sapien
atgcctgccattgaagctaccgtct

SEQ ID NO: 249167 - DNA, 25 bp, Homo sapien
gtgtgcctgcctactggttgacggt

SEQ ID NO: 249168 - DNA, 25 bp, Homo sapien
gtgcctgcctactggttgacggtca

SEQ ID NO: 249169 - DNA, 25 bp, Homo sapien
ctgcctactggttgacggtcaggtg

SEQ ID NO: 249170 - DNA, 25 bp, Homo sapien
gtcaggtgggctgattggttctccc

SEQ ID NO: 249171 - DNA, 25 bp, Homo sapien
aggtgggctgattggttctccctgc

SEQ ID NO: 249172 - DNA, 25 bp, Homo sapien
gtgggctgattggttctccctgcta

SEQ ID NO: 249173 - DNA, 25 bp, Homo sapien
ggctgattggttctccctgctacag

SEQ ID NO: 249174 - DNA, 25 bp, Homo sapien
ctgattggttctccctgctacagtg

SEQ ID NO: 249175 - DNA, 25 bp, Homo sapien
attggttctccctgctacagtggta

SEQ ID NO: 249176 - DNA, 25 bp, Homo sapien
tggttctccctgctacagtggtaga

SEQ ID NO: 249177 - DNA, 25 bp, Homo sapien
ggttctccctgctacagtggtagaa

SEQ ID NO: 249178 - DNA, 25 bp, Homo sapien
aaatctgtttgctgggaattcctga

SEQ ID NO: 249179 - DNA, 25 bp, Homo sapien
aatctgtttgctgggaattcctgat

SEQ ID NO: 249180 - DNA, 25 bp, Homo sapien
tctgtttgctgggaattcctgattc

SEQ ID NO: 249181 - DNA, 25 bp, Homo sapien
ctgtttgctgggaattcctgattct

SEQ ID NO: 249182 - DNA, 25 bp, Homo sapien
gtttgctgggaattcctgattcttg

SEQ ID NO: 249183 - DNA, 25 bp, Homo sapien
gtacgtatgtttggctcattactgg

SEQ ID NO: 249184 - DNA, 25 bp, Homo sapien
acgtatgtttggctcattactggtt

SEQ ID NO: 249185 - DNA, 25 bp, Homo sapien
accccttgagtgaatgcctgtttat

SEQ ID NO: 249186 - DNA, 25 bp, Homo sapien
ccccttgagtgaatgcctgtttatg

SEQ ID NO: 249187 - DNA, 25 bp, Homo sapien
ccttgagtgaatgcctgtttatgat

SEQ ID NO: 249188 - DNA, 25 bp, Homo sapien
ttgagtgaatgcctgtttatgatga

SEQ ID NO: 249189 - DNA, 25 bp, Homo sapien
actcaagcttgcctgttgcttctca

SEQ ID NO: 249190 - DNA, 25 bp, Homo sapien
agggtctagtgccttctgtgctgca

SEQ ID NO: 249191 - DNA, 25 bp, Homo sapien
gctgcacagctacctgaggaaccaa

SEQ ID NO: 249192 - DNA, 25 bp, Homo sapien
gagcacacaaagaaacagaccacat

SEQ ID NO: 249193 - DNA, 25 bp, Homo sapien
agtgactacgacaaaacctacccag

SEQ ID NO: 249194 - DNA, 25 bp, Homo sapien
aacctccagacactgaattccgaag

SEQ ID NO: 249195 - DNA, 25 bp, Homo sapien
acctacccagatttcttaatgcttt

SEQ ID NO: 249196 - DNA, 25 bp, Homo sapien
aagtcaaagagtaccttcagagtct

SEQ ID NO: 249197 - DNA, 25 bp, Homo sapien
accttcagagtctttcctacaaaga

SEQ ID NO: 249198 - DNA, 25 bp, Homo sapien
gctaaaattcctgagcttcaagatt

SEQ ID NO: 249199 - DNA, 25 bp, Homo sapien
atggatgctactcaagcttgcctgt

SEQ ID NO: 249200 - DNA, 25 bp, Homo sapien
tattaattttaaccatactccaact

SEQ ID NO: 249201 - DNA, 25 bp, Homo sapien
acgggcagcagacattggtccctga

SEQ ID NO: 249202 - DNA, 25 bp, Homo sapien
attggtccctgatcctccattataa

SEQ ID NO: 249203 - DNA, 25 bp, Homo sapien
gatcctccattataaccaatttttt

SEQ ID NO: 249204 - DNA, 25 bp, Homo sapien
accaattttttgcaaacgtatgttg

SEQ ID NO: 249205 - DNA, 25 bp, Homo sapien
gagaataattagctttgactctaaa

SEQ ID NO: 249206 - DNA, 25 bp, Homo sapien
aaaatgctgtcttccctgaaggaga

SEQ ID NO: 249207 - DNA, 25 bp, Homo sapien
ttccctgaaggagacctaggatttt

SEQ ID NO: 249208 - DNA, 25 bp, Homo sapien
tccaacttcccttaagaggccaagt

SEQ ID NO: 249209 - DNA, 25 bp, Homo sapien
gccaagttttaaagtccagtcatga

SEQ ID NO: 249210 - DNA, 25 bp, Homo sapien
taaagtccagtcatgagaattgatt

SEQ ID NO: 249211 - DNA, 25 bp, Homo sapien
gagatgcgtgggaccatagagccaa

SEQ ID NO: 249212 - DNA, 25 bp, Homo sapien
tgcgtgggaccatagagccaaggat

SEQ ID NO: 249213 - DNA, 25 bp, Homo sapien
ggaccatagagccaaggatgataat

SEQ ID NO: 249214 - DNA, 25 bp, Homo sapien
gatgataattccgtgacttgccctt

SEQ ID NO: 249215 - DNA, 25 bp, Homo sapien
tgataattccgtgacttgcccttgc

SEQ ID NO: 249216 - DNA, 25 bp, Homo sapien
ataattccgtgacttgcccttgccc

SEQ ID NO: 249217 - DNA, 25 bp, Homo sapien
tctcctcgatacccaggtggagcct

SEQ ID NO: 249218 - DNA, 25 bp, Homo sapien
cgtcctaggcaatacgcacgtggta

SEQ ID NO: 249219 - DNA, 25 bp, Homo sapien
atacgcacgtggtagagtcccagtc

SEQ ID NO: 249220 - DNA, 25 bp, Homo sapien
cacgtggtagagtcccagtctggaa

SEQ ID NO: 249221 - DNA, 25 bp, Homo sapien
tggtagagtcccagtctggaagctg

SEQ ID NO: 249222 - DNA, 25 bp, Homo sapien
caatatgtcccccttctttgatttg

SEQ ID NO: 249223 - DNA, 25 bp, Homo sapien
agcaaacgcagcttcgtcacggtga

SEQ ID NO: 249224 - DNA, 25 bp, Homo sapien
gcaaacgcagcttcgtcacggtgag

SEQ ID NO: 249225 - DNA, 25 bp, Homo sapien
caaacgcagcttcgtcacggtgagc

SEQ ID NO: 249226 - DNA, 25 bp, Homo sapien
aaacgcagcttcgtcacggtgagct

SEQ ID NO: 249227 - DNA, 25 bp, Homo sapien
aacgcagcttcgtcacggtgagcta

SEQ ID NO: 249228 - DNA, 25 bp, Homo sapien
acgcagcttcgtcacggtgagctac

SEQ ID NO: 249229 - DNA, 25 bp, Homo sapien
acagaagggtcatgggtgcctatgc

SEQ ID NO: 249230 - DNA, 25 bp, Homo sapien
cagaagggtcatgggtgcctatgcc

SEQ ID NO: 249231 - DNA, 25 bp, Homo sapien
aagggtcatgggtgcctatgcctgg

SEQ ID NO: 249232 - DNA, 25 bp, Homo sapien
agggtcatgggtgcctatgcctggg

SEQ ID NO: 249233 - DNA, 25 bp, Homo sapien
agtgagaccaaagggatatctgttc

SEQ ID NO: 249234 - DNA, 25 bp, Homo sapien
agggatatctgttccctgttacctt

SEQ ID NO: 249235 - DNA, 25 bp, Homo sapien
cctgttacctttttggagaattcat

SEQ ID NO: 249236 - DNA, 25 bp, Homo sapien
atggcttttcaattctgtggacttt

SEQ ID NO: 249237 - DNA, 25 bp, Homo sapien
gtggactttgtaccatttggcttca

SEQ ID NO: 249238 - DNA, 25 bp, Homo sapien
atttggcttcaccttgtactgcaag

SEQ ID NO: 249239 - DNA, 25 bp, Homo sapien
tggcttcaccttgtactgcaagatg

SEQ ID NO: 249240 - DNA, 25 bp, Homo sapien
caaaacaaaattggactgtctggaa

SEQ ID NO: 249241 - DNA, 25 bp, Homo sapien
gactgtctggaaagctaaagttctg

SEQ ID NO: 249242 - DNA, 25 bp, Homo sapien
ggaatgtactgcctctaatttttct

SEQ ID NO: 249243 - DNA, 25 bp, Homo sapien
tctcccaggtttcttaagaataatg

SEQ ID NO: 249244 - DNA, 25 bp, Homo sapien
tctccatttagattgatacccatta

SEQ ID NO: 249245 - DNA, 25 bp, Homo sapien
atacccattaaatagcatagtgctc

SEQ ID NO: 249246 - DNA, 25 bp, Homo sapien
atagtgctcccattaaactagcgac

SEQ ID NO: 249247 - DNA, 25 bp, Homo sapien
tatctagtacttatgctccatcctg

SEQ ID NO: 249248 - DNA, 25 bp, Homo sapien
acttatgctccatcctgtttatagg

SEQ ID NO: 249249 - DNA, 25 bp, Homo sapien
gctttgatgtgatcttcattcctct

SEQ ID NO: 249250 - DNA, 25 bp, Homo sapien
gatcttcattcctctgtatagtggg

SEQ ID NO: 249251 - DNA, 25 bp, Homo sapien
agtgggaaaccatgagacgtgctta

SEQ ID NO: 249252 - DNA, 25 bp, Homo sapien
acgtgcttagtcttcataaatcgat

SEQ ID NO: 249253 - DNA, 25 bp, Homo sapien
agtcttcataaatcgatgctgcctc

SEQ ID NO: 249254 - DNA, 25 bp, Homo sapien
tagtggccattgctttcttttctac

SEQ ID NO: 249255 - DNA, 25 bp, Homo sapien
tgcggagcggcctcggtcaaactcg

SEQ ID NO: 249256 - DNA, 25 bp, Homo sapien
ggcctcggtcaaactcgtcttaaag

SEQ ID NO: 249257 - DNA, 25 bp, Homo sapien
gtcaaactcgtcttaaaggacgcgg

SEQ ID NO: 249258 - DNA, 25 bp, Homo sapien
aaaggacgcggaaagcgccgcaccg

SEQ ID NO: 249259 - DNA, 25 bp, Homo sapien
gaaagcgccgcaccgaccagcagga

SEQ ID NO: 249260 - DNA, 25 bp, Homo sapien
tttaacccgctttgcgcggagccct

SEQ ID NO: 249261 - DNA, 25 bp, Homo sapien
gacggccgcgcaggcgcattatcct

SEQ ID NO: 249262 - DNA, 25 bp, Homo sapien
attatcctagccctcggcgcgtggg

SEQ ID NO: 249263 - DNA, 25 bp, Homo sapien
gaaagggtactaggcggctccgcta

SEQ ID NO: 249264 - DNA, 25 bp, Homo sapien
tactaggcggctccgctaggttcat

SEQ ID NO: 249265 - DNA, 25 bp, Homo sapien
tccgctaggttcatggagctgagct

SEQ ID NO: 249266 - DNA, 25 bp, Homo sapien
gcatccaaggaaagactgacagctt

SEQ ID NO: 249267 - DNA, 25 bp, Homo sapien
agactgacagctttgaaagagacct

SEQ ID NO: 249268 - DNA, 25 bp, Homo sapien
atggatgttttggaaatctgttcat

SEQ ID NO: 249269 - DNA, 25 bp, Homo sapien
aagagacctgataatgatgcaagta

SEQ ID NO: 249270 - DNA, 25 bp, Homo sapien
gttttggaaatctgttcattgttga

SEQ ID NO: 249271 - DNA, 25 bp, Homo sapien
ttcattgttgatagggctgacggcc

SEQ ID NO: 249272 - DNA, 25 bp, Homo sapien
gggctgacggcctataaggaattat

SEQ ID NO: 249273 - DNA, 25 bp, Homo sapien
taaggaattatcactccctaaaagg

SEQ ID NO: 249274 - DNA, 25 bp, Homo sapien
gaaacttgcagagcaattcagcatc

SEQ ID NO: 249275 - DNA, 25 bp, Homo sapien
tgcagagcaattcagcatccaagga

SEQ ID NO: 249276 - DNA, 25 bp, Homo sapien
gagcaattcagcatccaaggaaaga

SEQ ID NO: 249277 - DNA, 25 bp, Homo sapien
tggtacaggctggttttggcccaat

SEQ ID NO: 249278 - DNA, 25 bp, Homo sapien
tggaagcccctgaagacctaaactg

SEQ ID NO: 249279 - DNA, 25 bp, Homo sapien
cctgaagacctaaactgcctggatg

SEQ ID NO: 249280 - DNA, 25 bp, Homo sapien
gatggactgggatgcccttaactga

SEQ ID NO: 249281 - DNA, 25 bp, Homo sapien
atgagtctgtaatttgggaacctta

SEQ ID NO: 249282 - DNA, 25 bp, Homo sapien
ggaaccttaatgtgagacaccactt

SEQ ID NO: 249283 - DNA, 25 bp, Homo sapien
taaggagaggaacttggcccagcaa

SEQ ID NO: 249284 - DNA, 25 bp, Homo sapien
ttggcccagcaagtgatcactctag

SEQ ID NO: 249285 - DNA, 25 bp, Homo sapien
cttaactgaggtctgctgtctggaa

SEQ ID NO: 249286 - DNA, 25 bp, Homo sapien
gtctggaaaggacaccacaggccca

SEQ ID NO: 249287 - DNA, 25 bp, Homo sapien
tctggaccaatgacctagattcaac

SEQ ID NO: 249288 - DNA, 25 bp, Homo sapien
agtggttccagtttgatatctacaa

SEQ ID NO: 249289 - DNA, 25 bp, Homo sapien
gatatctacaagaagagcctcacta

SEQ ID NO: 249290 - DNA, 25 bp, Homo sapien
atctacaagaagagcctcactaggg

SEQ ID NO: 249291 - DNA, 25 bp, Homo sapien
ggcttggcttcctcccgagctactt

SEQ ID NO: 249292 - DNA, 25 bp, Homo sapien
tcccgagctacttctgtggcagtac

SEQ ID NO: 249293 - DNA, 25 bp, Homo sapien
gagctacttctgtggcagtactttt

SEQ ID NO: 249294 - DNA, 25 bp, Homo sapien
tacttctgtggcagtacttttggag

SEQ ID NO: 249295 - DNA, 25 bp, Homo sapien
agaaagtagaatcgctttcctctgg

SEQ ID NO: 249296 - DNA, 25 bp, Homo sapien
tccctacagccacgtgtgcttctgg

SEQ ID NO: 249297 - DNA, 25 bp, Homo sapien
tgaggcacacgggaaggaggagaac

SEQ ID NO: 249298 - DNA, 25 bp, Homo sapien
gtatcgcagaagtcgatgagaggaa

SEQ ID NO: 249299 - DNA, 25 bp, Homo sapien
caatcacggccctcttttagggagt

SEQ ID NO: 249300 - DNA, 25 bp, Homo sapien
agtacccgaccccaaagagactcat

SEQ ID NO: 249301 - DNA, 25 bp, Homo sapien
gaagcacagccagaatagacacagt

SEQ ID NO: 249302 - DNA, 25 bp, Homo sapien
gaatagacacagtcaccgtaatggt

SEQ ID NO: 249303 - DNA, 25 bp, Homo sapien
accgtaatggtgactctgagaacag

SEQ ID NO: 249304 - DNA, 25 bp, Homo sapien
gtgacagcagttacttctgcagtca

SEQ ID NO: 249305 - DNA, 25 bp, Homo sapien
gaggtcttgttgattcaccattctg

SEQ ID NO: 249306 - DNA, 25 bp, Homo sapien
gattcaccattctgctcttagctta

SEQ ID NO: 249307 - DNA, 25 bp, Homo sapien
aaagagactcattttccaggccaga

SEQ ID NO: 249308 - DNA, 25 bp, Homo sapien
ttttccaggccagagggcggcctaa

SEQ ID NO: 249309 - DNA, 25 bp, Homo sapien
ggaatgaaagtgtaccctagcagtg

SEQ ID NO: 249310 - DNA, 25 bp, Homo sapien
gcctatccttcaatgcctaattcta

SEQ ID NO: 249311 - DNA, 25 bp, Homo sapien
caggtgggctttatatcctgaacct

SEQ ID NO: 249312 - DNA, 25 bp, Homo sapien
gttgtacttaacttactcctgcatc

SEQ ID NO: 249313 - DNA, 25 bp, Homo sapien
acttaacttactcctgcatctcaca

SEQ ID NO: 249314 - DNA, 25 bp, Homo sapien
atctcacactagtcatggtattagc

SEQ ID NO: 249315 - DNA, 25 bp, Homo sapien
ggtattagcatttattgtgtccagt

SEQ ID NO: 249316 - DNA, 25 bp, Homo sapien
tagcatttattgtgtccagtgttta

SEQ ID NO: 249317 - DNA, 25 bp, Homo sapien
actgtctcttctgtactcaagctgt

SEQ ID NO: 249318 - DNA, 25 bp, Homo sapien
ttctgtactcaagctgtaagccttt

SEQ ID NO: 249319 - DNA, 25 bp, Homo sapien
tgtaagcctttatcagtgaatctga

SEQ ID NO: 249320 - DNA, 25 bp, Homo sapien
aaactggtattttggagcatccttt

SEQ ID NO: 249321 - DNA, 25 bp, Homo sapien
ggcctggcctgagatgtgtcccgat

SEQ ID NO: 249322 - DNA, 25 bp, Homo sapien
ctggcctgagatgtgtcccgatgga

SEQ ID NO: 249323 - DNA, 25 bp, Homo sapien
tggcctgagatgtgtcccgatggat

SEQ ID NO: 249324 - DNA, 25 bp, Homo sapien
ggcctgagatgtgtcccgatggatt

SEQ ID NO: 249325 - DNA, 25 bp, Homo sapien
cctgagatgtgtcccgatggattct

SEQ ID NO: 249326 - DNA, 25 bp, Homo sapien
gagatgtgtcccgatggattcttcg

SEQ ID NO: 249327 - DNA, 25 bp, Homo sapien
caaggcattcctggcgacgacactg

SEQ ID NO: 249328 - DNA, 25 bp, Homo sapien
tgaatgggatcaggctgcactgcgc

SEQ ID NO: 249329 - DNA, 25 bp, Homo sapien
gatcaggctgcactgcgcgcgcggg

SEQ ID NO: 249330 - DNA, 25 bp, Homo sapien
gctttctcgcttcgcgtggaggcac

SEQ ID NO: 249331 - DNA, 25 bp, Homo sapien
tggaggcacccacgaccctcggtga

SEQ ID NO: 249332 - DNA, 25 bp, Homo sapien
accagtgtgactctagagccagtac

SEQ ID NO: 249333 - DNA, 25 bp, Homo sapien
gtgtgactctagagccagtactatt

SEQ ID NO: 249334 - DNA, 25 bp, Homo sapien
gagccagtactattgatcattatat

SEQ ID NO: 249335 - DNA, 25 bp, Homo sapien
acaacctaaatgtttcacagtgatt

SEQ ID NO: 249336 - DNA, 25 bp, Homo sapien
cacagtgattgttagggtccatccc

SEQ ID NO: 249337 - DNA, 25 bp, Homo sapien
gattgttagggtccatccctacagt

SEQ ID NO: 249338 - DNA, 25 bp, Homo sapien
tgccttctcagccatgaaaatgatg

SEQ ID NO: 249339 - DNA, 25 bp, Homo sapien
gaaaggatgtcttggtatatgtaag

SEQ ID NO: 249340 - DNA, 25 bp, Homo sapien
tattatgtctggaaggatatgtgcc

SEQ ID NO: 249341 - DNA, 25 bp, Homo sapien
gtctggaaggatatgtgccaaattg

SEQ ID NO: 249342 - DNA, 25 bp, Homo sapien
atttctgagtgtagttttacaggtg

SEQ ID NO: 249343 - DNA, 25 bp, Homo sapien
cctgcctggcctgacagctggtggt

SEQ ID NO: 249344 - DNA, 25 bp, Homo sapien
tggttctgaagctccacaactttgg

SEQ ID NO: 249345 - DNA, 25 bp, Homo sapien
tgaagctccacaactttggcctaat

SEQ ID NO: 249346 - DNA, 25 bp, Homo sapien
acaactttggcctaatcatctctct

SEQ ID NO: 249347 - DNA, 25 bp, Homo sapien
actttggcctaatcatctctctcag

SEQ ID NO: 249348 - DNA, 25 bp, Homo sapien
aatctaaatatcttgcttgatgctc

SEQ ID NO: 249349 - DNA, 25 bp, Homo sapien
ggaaacaagacaagtcaaccccagt

SEQ ID NO: 249350 - DNA, 25 bp, Homo sapien
caagacaagtcaaccccagtgtgaa

SEQ ID NO: 249351 - DNA, 25 bp, Homo sapien
tgatgctctgagcagtccagtccac

SEQ ID NO: 249352 - DNA, 25 bp, Homo sapien
tgagcagtccagtccacaccttcag

SEQ ID NO: 249353 - DNA, 25 bp, Homo sapien
gggtcagcaaatgcctgcctggcct

SEQ ID NO: 249354 - DNA, 25 bp, Homo sapien
tgctggccccatcataatctttttt

SEQ ID NO: 249355 - DNA, 25 bp, Homo sapien
ggaaacgaatactggtacacttaca

SEQ ID NO: 249356 - DNA, 25 bp, Homo sapien
ggtacacttacatttcttggaagag

SEQ ID NO: 249357 - DNA, 25 bp, Homo sapien
gcagcagaaaccttgggatatcctt

SEQ ID NO: 249358 - DNA, 25 bp, Homo sapien
cttgtgggtcaaggaggcaactctc

SEQ ID NO: 249359 - DNA, 25 bp, Homo sapien
aaggaggcaactctcctcacggatt

SEQ ID NO: 249360 - DNA, 25 bp, Homo sapien
ctcacggattccctgatttgataac

SEQ ID NO: 249361 - DNA, 25 bp, Homo sapien
aatccaagttttcacaagtttctct

SEQ ID NO: 249362 - DNA, 25 bp, Homo sapien
ttaacttaagacttcctagaccaag

SEQ ID NO: 249363 - DNA, 25 bp, Homo sapien
gacttcctagaccaagaattcctac

SEQ ID NO: 249364 - DNA, 25 bp, Homo sapien
aaggctatgagttgctgctggcccc

SEQ ID NO: 249365 - DNA, 25 bp, Homo sapien
ccaggaaaaacatgcatgcgggaaa

SEQ ID NO: 249366 - DNA, 25 bp, Homo sapien
gagctgaagatctgctctttgcgta

SEQ ID NO: 249367 - DNA, 25 bp, Homo sapien
tgctctttgcgtaccaccagcttca

SEQ ID NO: 249368 - DNA, 25 bp, Homo sapien
cccactttattctcgtgaatggatg

SEQ ID NO: 249369 - DNA, 25 bp, Homo sapien
ttctcgtgaatggatgtctattacc

SEQ ID NO: 249370 - DNA, 25 bp, Homo sapien
atggatgtctattaccgaggattta

SEQ ID NO: 249371 - DNA, 25 bp, Homo sapien
tgtaaagagggccagcttcgtgctt

SEQ ID NO: 249372 - DNA, 25 bp, Homo sapien
agagggccagcttcgtgctttaaat

SEQ ID NO: 249373 - DNA, 25 bp, Homo sapien
gccagcttcgtgctttaaatgaata

SEQ ID NO: 249374 - DNA, 25 bp, Homo sapien
gattttgttgtgttcattattggag

SEQ ID NO: 249375 - DNA, 25 bp, Homo sapien
gaggaagtacttgcaatggattgta

SEQ ID NO: 249376 - DNA, 25 bp, Homo sapien
caaccacgttgggtataccaggcta

SEQ ID NO: 249377 - DNA, 25 bp, Homo sapien
accaggctacaaacacatgcttgtt

SEQ ID NO: 249378 - DNA, 25 bp, Homo sapien
caccatctctgaggatttttaggaa

SEQ ID NO: 249379 - DNA, 25 bp, Homo sapien
gggtaaatatcctcaacttccacag

SEQ ID NO: 249380 - DNA, 25 bp, Homo sapien
ggcagtaccctgaaatcttgggaat

SEQ ID NO: 249381 - DNA, 25 bp, Homo sapien
gagaaaccattctagatcagctcct

SEQ ID NO: 249382 - DNA, 25 bp, Homo sapien
gatcagctcctagatactcctaaga

SEQ ID NO: 249383 - DNA, 25 bp, Homo sapien
ttaggaaagctccaaattgcccttg

SEQ ID NO: 249384 - DNA, 25 bp, Homo sapien
caaattgcccttggttctaatgagc

SEQ ID NO: 249385 - DNA, 25 bp, Homo sapien
aaagggtcttctctgtataagctct

SEQ ID NO: 249386 - DNA, 25 bp, Homo sapien
taagctctggtatcctctattttaa

SEQ ID NO: 249387 - DNA, 25 bp, Homo sapien
aaaaaactgtagcatgtagaggaaa

SEQ ID NO: 249388 - DNA, 25 bp, Homo sapien
aaaaactgtagcatgtagaggaaag

SEQ ID NO: 249389 - DNA, 25 bp, Homo sapien
aaaactgtagcatgtagaggaaagt

SEQ ID NO: 249390 - DNA, 25 bp, Homo sapien
aactgtagcatgtagaggaaagtgc

SEQ ID NO: 249391 - DNA, 25 bp, Homo sapien
ctgtagcatgtagaggaaagtgcac

SEQ ID NO: 249392 - DNA, 25 bp, Homo sapien
tgtagcatgtagaggaaagtgcact

SEQ ID NO: 249393 - DNA, 25 bp, Homo sapien
tagcatgtagaggaaagtgcactgg

SEQ ID NO: 249394 - DNA, 25 bp, Homo sapien
catgtagaggaaagtgcactgggat

SEQ ID NO: 249395 - DNA, 25 bp, Homo sapien
atgtagaggaaagtgcactgggata

SEQ ID NO: 249396 - DNA, 25 bp, Homo sapien
tgtagaggaaagtgcactgggataa

SEQ ID NO: 249397 - DNA, 25 bp, Homo sapien
gtagaggaaagtgcactgggataat

SEQ ID NO: 249398 - DNA, 25 bp, Homo sapien
gtggattaactcagttcaactgata

SEQ ID NO: 249399 - DNA, 25 bp, Homo sapien
ccaaacagtaggcagagactgtctc

SEQ ID NO: 249400 - DNA, 25 bp, Homo sapien
cagtaggcgctgaatgtttggtgaa

SEQ ID NO: 249401 - DNA, 25 bp, Homo sapien
cagttcaactgataactactcctcc

SEQ ID NO: 249402 - DNA, 25 bp, Homo sapien
tgaagggaaagctgaggcaccaacc

SEQ ID NO: 249403 - DNA, 25 bp, Homo sapien
aagggaaagctgaggcaccaaccct

SEQ ID NO: 249404 - DNA, 25 bp, Homo sapien
agggaaagctgaggcaccaaccctc

SEQ ID NO: 249405 - DNA, 25 bp, Homo sapien
ggaaagctgaggcaccaaccctcag

SEQ ID NO: 249406 - DNA, 25 bp, Homo sapien
gttcaactgataactactcctccag

SEQ ID NO: 249407 - DNA, 25 bp, Homo sapien
ttcaactgataactactcctccaga

SEQ ID NO: 249408 - DNA, 25 bp, Homo sapien
tcaactgataactactcctccagac

SEQ ID NO: 249409 - DNA, 25 bp, Homo sapien
tcacaggtggaaatgaccatctggt

SEQ ID NO: 249410 - DNA, 25 bp, Homo sapien
gaccatctggtcaaagtttgggatt

SEQ ID NO: 249411 - DNA, 25 bp, Homo sapien
gacacagtggcaacatcacacgcat

SEQ ID NO: 249412 - DNA, 25 bp, Homo sapien
acacgcatccgcataagtccaggaa

SEQ ID NO: 249413 - DNA, 25 bp, Homo sapien
gtgtaagtgccgatggagccatttt

SEQ ID NO: 249414 - DNA, 25 bp, Homo sapien
agccattttgcgatggaagtaccca

SEQ ID NO: 249415 - DNA, 25 bp, Homo sapien
gaagtacccatatacctcctgaagc

SEQ ID NO: 249416 - DNA, 25 bp, Homo sapien
ctcctgaagctgatgagatgtctct

SEQ ID NO: 249417 - DNA, 25 bp, Homo sapien
gaaggttccctgtctgggtcgataa

SEQ ID NO: 249418 - DNA, 25 bp, Homo sapien
ccctgtctgggtcgataaatggcat

SEQ ID NO: 249419 - DNA, 25 bp, Homo sapien
gataaatggcatggatatcacacag

SEQ ID NO: 249420 - DNA, 25 bp, Homo sapien
ttgtttgtatttcatgtggttttat

SEQ ID NO: 249421 - DNA, 25 bp, Homo sapien
ttttcacccttttttgtgatttgca

SEQ ID NO: 249422 - DNA, 25 bp, Homo sapien
cacccttttttgtgatttgcaatga

SEQ ID NO: 249423 - DNA, 25 bp, Homo sapien
tttgcaatgatgtgcttgcccagct

SEQ ID NO: 249424 - DNA, 25 bp, Homo sapien
aatgatgtgcttgcccagctaactt

SEQ ID NO: 249425 - DNA, 25 bp, Homo sapien
gctaacttttgaattgcacttttta

SEQ ID NO: 249426 - DNA, 25 bp, Homo sapien
cagagccagaactcggtggtggagg

SEQ ID NO: 249427 - DNA, 25 bp, Homo sapien
accaccttcttttgcacttggaaag

SEQ ID NO: 249428 - DNA, 25 bp, Homo sapien
aacatctggatagagttctagcttt

SEQ ID NO: 249429 - DNA, 25 bp, Homo sapien
tagagttctagctttgacttctcat

SEQ ID NO: 249430 - DNA, 25 bp, Homo sapien
ggtgcattcctcagcacactttttt

SEQ ID NO: 249431 - DNA, 25 bp, Homo sapien
tcctaaactctaataaagtcatgct

SEQ ID NO: 249432 - DNA, 25 bp, Homo sapien
tgacttcagtatttctgacctccta

SEQ ID NO: 249433 - DNA, 25 bp, Homo sapien
gacttcagtatttctgacctcctaa

SEQ ID NO: 249434 - DNA, 25 bp, Homo sapien
acttcagtatttctgacctcctaaa

SEQ ID NO: 249435 - DNA, 25 bp, Homo sapien
tcagtatttctgacctcctaaactc

SEQ ID NO: 249436 - DNA, 25 bp, Homo sapien
agtatttctgacctcctaaactcta

SEQ ID NO: 249437 - DNA, 25 bp, Homo sapien
gtatttctgacctcctaaactctaa

SEQ ID NO: 249438 - DNA, 25 bp, Homo sapien
atttctgacctcctaaactctaata

SEQ ID NO: 249439 - DNA, 25 bp, Homo sapien
tttctgacctcctaaactctaataa

SEQ ID NO: 249440 - DNA, 25 bp, Homo sapien
tctgacctcctaaactctaataaag

SEQ ID NO: 249441 - DNA, 25 bp, Homo sapien
gacctcctaaactctaataaagtca

SEQ ID NO: 249442 - DNA, 25 bp, Homo sapien
taagggacacaggtcaacaagcagt

SEQ ID NO: 249443 - DNA, 25 bp, Homo sapien
acaggtcaacaagcagtaggtcttt

SEQ ID NO: 249444 - DNA, 25 bp, Homo sapien
agtaggtctttggaagctcgctctc

SEQ ID NO: 249445 - DNA, 25 bp, Homo sapien
aggtctttggaagctcgctctctca

SEQ ID NO: 249446 - DNA, 25 bp, Homo sapien
aagctcgctctctcacatggtataa

SEQ ID NO: 249447 - DNA, 25 bp, Homo sapien
ctcgctctctcacatggtataaggt

SEQ ID NO: 249448 - DNA, 25 bp, Homo sapien
cgctctctcacatggtataaggtga

SEQ ID NO: 249449 - DNA, 25 bp, Homo sapien
gggacacatggaatgtaaacctcca

SEQ ID NO: 249450 - DNA, 25 bp, Homo sapien
gaatgtaaacctccaaactaattat

SEQ ID NO: 249451 - DNA, 25 bp, Homo sapien
gcaaaacaaaaacacctggttcaat

SEQ ID NO: 249452 - DNA, 25 bp, Homo sapien
gaatggaggaactaattccaaatat

SEQ ID NO: 249453 - DNA, 25 bp, Homo sapien
aaatctttgctattgtgtggagaga

SEQ ID NO: 249454 - DNA, 25 bp, Homo sapien
atttctgtttcttaagtgatggtac

SEQ ID NO: 249455 - DNA, 25 bp, Homo sapien
gatggtacatttgtccatgtaacag

SEQ ID NO: 249456 - DNA, 25 bp, Homo sapien
tttttactggtatcaccttacatgg

SEQ ID NO: 249457 - DNA, 25 bp, Homo sapien
tcaccttacatggtatcactgggaa

SEQ ID NO: 249458 - DNA, 25 bp, Homo sapien
tggtatcactgggaacatttatgga

SEQ ID NO: 249459 - DNA, 25 bp, Homo sapien
ggaatcaacacttctgtagctcagt

SEQ ID NO: 249460 - DNA, 25 bp, Homo sapien
ctcagtgacaggtggtggttgttta

SEQ ID NO: 249461 - DNA, 25 bp, Homo sapien
gtgactagtacatgtatttctccat

SEQ ID NO: 249462 - DNA, 25 bp, Homo sapien
atttctccataagcagagttgccga

SEQ ID NO: 249463 - DNA, 25 bp, Homo sapien
agagttgccgaatcaataaacatgc

SEQ ID NO: 249464 - DNA, 25 bp, Homo sapien
aaatatatttatcctgttgcccaac

SEQ ID NO: 249465 - DNA, 25 bp, Homo sapien
tatatttatcctgttgcccaacgat

SEQ ID NO: 249466 - DNA, 25 bp, Homo sapien
tatcctgttgcccaacgattctaat

SEQ ID NO: 249467 - DNA, 25 bp, Homo sapien
gttgcccaacgattctaatcctgag

SEQ ID NO: 249468 - DNA, 25 bp, Homo sapien
gcccaacgattctaatcctgagaag

SEQ ID NO: 249469 - DNA, 25 bp, Homo sapien
aaaaataccagttcataacaacata

SEQ ID NO: 249470 - DNA, 25 bp, Homo sapien
gaatattttctactgacataattta

SEQ ID NO: 249471 - DNA, 25 bp, Homo sapien
gacataatttatagtagccaagaac

SEQ ID NO: 249472 - DNA, 25 bp, Homo sapien
gaaataaagtaatgcccacctatag

SEQ ID NO: 249473 - DNA, 25 bp, Homo sapien
aagtaatgcccacctatagaagaat

SEQ ID NO: 249474 - DNA, 25 bp, Homo sapien
aatgcccacctatagaagaataaat

SEQ ID NO: 249475 - DNA, 25 bp, Homo sapien
ggcttgtcccggtgtatccgcagcg

SEQ ID NO: 249476 - DNA, 25 bp, Homo sapien
cttgtcccggtgtatccgcagcgcg

SEQ ID NO: 249477 - DNA, 25 bp, Homo sapien
tgtcccggtgtatccgcagcgcgcc

SEQ ID NO: 249478 - DNA, 25 bp, Homo sapien
cctggtggccggaggccgtaactgt

SEQ ID NO: 249479 - DNA, 25 bp, Homo sapien
tggccggaggccgtaactgtcgcgg

SEQ ID NO: 249480 - DNA, 25 bp, Homo sapien
aactgtcgcggctgagggggcgtcc

SEQ ID NO: 249481 - DNA, 25 bp, Homo sapien
agcgcgccctgtcccgccatataca

SEQ ID NO: 249482 - DNA, 25 bp, Homo sapien
cctggtgccggaggccgtaattgtc

SEQ ID NO: 249483 - DNA, 25 bp, Homo sapien
gtgccggaggccgtaattgtcgcgg

SEQ ID NO: 249484 - DNA, 25 bp, Homo sapien
attgtcgcggctgaaggggcttgtc

SEQ ID NO: 249485 - DNA, 25 bp, Homo sapien
gggcttgtcccggtgtatccgcagc

SEQ ID NO: 249486 - DNA, 25 bp, Homo sapien
attccaggagttccagtgcagccag

SEQ ID NO: 249487 - DNA, 25 bp, Homo sapien
tacattcattcagctttgtatgctt

SEQ ID NO: 249488 - DNA, 25 bp, Homo sapien
cagctttgtatgcttactttctgcc

SEQ ID NO: 249489 - DNA, 25 bp, Homo sapien
ttctgccagctcttcacaaaggtag

SEQ ID NO: 249490 - DNA, 25 bp, Homo sapien
gccagctcttcacaaaggtagaagt

SEQ ID NO: 249491 - DNA, 25 bp, Homo sapien
ataaagcgaacaacatcaggaggag

SEQ ID NO: 249492 - DNA, 25 bp, Homo sapien
gaacaacatcaggaggagaatggcc

SEQ ID NO: 249493 - DNA, 25 bp, Homo sapien
ggagaatggccccagatactagttt

SEQ ID NO: 249494 - DNA, 25 bp, Homo sapien
gaatggccccagatactagttttcc

SEQ ID NO: 249495 - DNA, 25 bp, Homo sapien
ccccagatactagttttcccagaag

SEQ ID NO: 249496 - DNA, 25 bp, Homo sapien
tactagttttcccagaaggtacttg

SEQ ID NO: 249497 - DNA, 25 bp, Homo sapien
ggagagctgtaagtgttcaccttta

SEQ ID NO: 249498 - DNA, 25 bp, Homo sapien
gaagttgccctacgaattttagaca

SEQ ID NO: 249499 - DNA, 25 bp, Homo sapien
gttcacctttactcttgaagacagg

SEQ ID NO: 249500 - DNA, 25 bp, Homo sapien
cctttctcatttcaaatgactgcat

SEQ ID NO: 249501 - DNA, 25 bp, Homo sapien
atgactgcatttcattccaatgagc

SEQ ID NO: 249502 - DNA, 25 bp, Homo sapien
tcattccaatgagcagagattcttc

SEQ ID NO: 249503 - DNA, 25 bp, Homo sapien
gagcagagattcttcataaacctgt

SEQ ID NO: 249504 - DNA, 25 bp, Homo sapien
ctgtgattttaatgtcttctaccta

SEQ ID NO: 249505 - DNA, 25 bp, Homo sapien
aaaatgtggctttattcttctcagt

SEQ ID NO: 249506 - DNA, 25 bp, Homo sapien
gtggctttattcttctcagtttgga

SEQ ID NO: 249507 - DNA, 25 bp, Homo sapien
cttctcagtttggaatgatcaacat

SEQ ID NO: 249508 - DNA, 25 bp, Homo sapien
atagtagtgtgggatattcgtatag

SEQ ID NO: 249509 - DNA, 25 bp, Homo sapien
gtgtgggatattcgtatagttttct

SEQ ID NO: 249510 - DNA, 25 bp, Homo sapien
tcgtatagttttcttggaagaggta

SEQ ID NO: 249511 - DNA, 25 bp, Homo sapien
gaagaggtaatatttgagtaggatc

SEQ ID NO: 249512 - DNA, 25 bp, Homo sapien
gtaatatttgagtaggatcttgaaa

SEQ ID NO: 249513 - DNA, 25 bp, Homo sapien
atgagtagacgtgtaaatgccgcaa

SEQ ID NO: 249514 - DNA, 25 bp, Homo sapien
gtagacgtgtaaatgccgcaagtaa

SEQ ID NO: 249515 - DNA, 25 bp, Homo sapien
aaatgccgcaagtaaaggcaaagat

SEQ ID NO: 249516 - DNA, 25 bp, Homo sapien
ggcaaagatatatacatcattgtcg

SEQ ID NO: 249517 - DNA, 25 bp, Homo sapien
atacatcattgtcggaataggaaag

SEQ ID NO: 249518 - DNA, 25 bp, Homo sapien
agagtgtggcacatctgggaatgat

SEQ ID NO: 249519 - DNA, 25 bp, Homo sapien
taatcttgtctgtttgttgcaccat

SEQ ID NO: 249520 - DNA, 25 bp, Homo sapien
ctgtttgttgcaccatggaaatcac

SEQ ID NO: 249521 - DNA, 25 bp, Homo sapien
atgcacacaagcagagtgcctttgc

SEQ ID NO: 249522 - DNA, 25 bp, Homo sapien
aatgttgattccaggtttgtttaat

SEQ ID NO: 249523 - DNA, 25 bp, Homo sapien
aaaaaactgtagcatgtagaggaaa

SEQ ID NO: 249524 - DNA, 25 bp, Homo sapien
aaaactgtagcatgtagaggaaagt

SEQ ID NO: 249525 - DNA, 25 bp, Homo sapien
ctgtagcatgtagaggaaagtgcac

SEQ ID NO: 249526 - DNA, 25 bp, Homo sapien
tagcatgtagaggaaagtgcactgg

SEQ ID NO: 249527 - DNA, 25 bp, Homo sapien
catgtagaggaaagtgcactgggat

SEQ ID NO: 249528 - DNA, 25 bp, Homo sapien
atgtagaggaaagtgcactgggata

SEQ ID NO: 249529 - DNA, 25 bp, Homo sapien
gtagaggaaagtgcactgggataat

SEQ ID NO: 249530 - DNA, 25 bp, Homo sapien
tttgcagagttattacgtttgaagt

SEQ ID NO: 249531 - DNA, 25 bp, Homo sapien
gcagagttattacgtttgaagtata

SEQ ID NO: 249532 - DNA, 25 bp, Homo sapien
gagttattacgtttgaagtatactt

SEQ ID NO: 249533 - DNA, 25 bp, Homo sapien
gatcagttattgctgcattaaaaac

SEQ ID NO: 249534 - DNA, 25 bp, Homo sapien
gttattgctgcattaaaaacatgag

SEQ ID NO: 249535 - DNA, 25 bp, Homo sapien
ttgctgcattaaaaacatgagtctt

SEQ ID NO: 249536 - DNA, 25 bp, Homo sapien
gctgcattaaaaacatgagtctttt

SEQ ID NO: 249537 - DNA, 25 bp, Homo sapien
aaacatgagtcttttttattaggtg

SEQ ID NO: 249538 - DNA, 25 bp, Homo sapien
gaaaaattaagtgaagaggctcttt

SEQ ID NO: 249539 - DNA, 25 bp, Homo sapien
gaagaggctctttatggttaattta

SEQ ID NO: 249540 - DNA, 25 bp, Homo sapien
tttttgcagagttattacgtttgaa

SEQ ID NO: 249541 - DNA, 25 bp, Homo sapien
gatccctcccctgatcatttataga

SEQ ID NO: 249542 - DNA, 25 bp, Homo sapien
atttatagacacttgccatctcccg

SEQ ID NO: 249543 - DNA, 25 bp, Homo sapien
aatgcttatcttgaatttacacctg

SEQ ID NO: 249544 - DNA, 25 bp, Homo sapien
acacctgttgtaaattgccccattc

SEQ ID NO: 249545 - DNA, 25 bp, Homo sapien
attgccccattcatgaattaggcta

SEQ ID NO: 249546 - DNA, 25 bp, Homo sapien
ttaggctaatgattgtctttctttg

SEQ ID NO: 249547 - DNA, 25 bp, Homo sapien
tttgttcaattgcttcatgccgaag

SEQ ID NO: 249548 - DNA, 25 bp, Homo sapien
atgccgaaggagtcacctctctggg

SEQ ID NO: 249549 - DNA, 25 bp, Homo sapien
tctctgggttctcacatgctgtaaa

SEQ ID NO: 249550 - DNA, 25 bp, Homo sapien
ttctctaatcacctgcctagattca

SEQ ID NO: 249551 - DNA, 25 bp, Homo sapien
aagaaatctgctattctccccagat

SEQ ID NO: 249552 - DNA, 25 bp, Homo sapien
gctataccatgaattgggtccgcca

SEQ ID NO: 249553 - DNA, 25 bp, Homo sapien
ggagtgggtctcagtcattactggt

SEQ ID NO: 249554 - DNA, 25 bp, Homo sapien
attactggtagtagtagtaccacaa

SEQ ID NO: 249555 - DNA, 25 bp, Homo sapien
gtagtaccacaaactacgcacactc

SEQ ID NO: 249556 - DNA, 25 bp, Homo sapien
ggccgtatattactgcgcgaaggac

SEQ ID NO: 249557 - DNA, 25 bp, Homo sapien
ccgtatattactgcgcgaaggacct

SEQ ID NO: 249558 - DNA, 25 bp, Homo sapien
tattactgcgcgaaggacctggaat

SEQ ID NO: 249559 - DNA, 25 bp, Homo sapien
actgcgcgaaggacctggaatagtt

SEQ ID NO: 249560 - DNA, 25 bp, Homo sapien
tctggtttcacctttagcggctata

SEQ ID NO: 249561 - DNA, 25 bp, Homo sapien
gtttcacctttagcggctataccat

SEQ ID NO: 249562 - DNA, 25 bp, Homo sapien
cctttagcggctataccatgaattg

SEQ ID NO: 249563 - DNA, 25 bp, Homo sapien
cctggccccctcaaaatggaagagt

SEQ ID NO: 249564 - DNA, 25 bp, Homo sapien
agtgatgactatttgtcttcgtaac

SEQ ID NO: 249565 - DNA, 25 bp, Homo sapien
gactatttgtcttcgtaacactgtg

SEQ ID NO: 249566 - DNA, 25 bp, Homo sapien
ctatttgtcttcgtaacactgtggg

SEQ ID NO: 249567 - DNA, 25 bp, Homo sapien
gagccttaaatggaagagtgtcaaa

SEQ ID NO: 249568 - DNA, 25 bp, Homo sapien
aatggaagagtgtcaaaagcaacat

SEQ ID NO: 249569 - DNA, 25 bp, Homo sapien
catgatgtatgaaacactgttggcc

SEQ ID NO: 249570 - DNA, 25 bp, Homo sapien
tgtatgaaacactgttggccaaagt

SEQ ID NO: 249571 - DNA, 25 bp, Homo sapien
tgttggccaaagtgcacaattagta

SEQ ID NO: 249572 - DNA, 25 bp, Homo sapien
ggccaaagtgcacaattagtaatac

SEQ ID NO: 249573 - DNA, 25 bp, Homo sapien
gattctgtttccaaggtactttgta

SEQ ID NO: 249574 - DNA, 25 bp, Homo sapien
tcttcagtaactgctgctctgttaa

SEQ ID NO: 249575 - DNA, 25 bp, Homo sapien
aactgttctattctgatactacgcg

SEQ ID NO: 249576 - DNA, 25 bp, Homo sapien
gatactacgcgtgttgttttttaca

SEQ ID NO: 249577 - DNA, 25 bp, Homo sapien
acatgggtcatttaaagtcctgtat

SEQ ID NO: 249578 - DNA, 25 bp, Homo sapien
gtcctgtatgaaccataacctgctg

SEQ ID NO: 249579 - DNA, 25 bp, Homo sapien
taacctgctgtggtacctttgtaca

SEQ ID NO: 249580 - DNA, 25 bp, Homo sapien
gtacctttgtacatgtttgattctg

SEQ ID NO: 249581 - DNA, 25 bp, Homo sapien
ttattccagtgtggcatatgtgccc

SEQ ID NO: 249582 - DNA, 25 bp, Homo sapien
tgtgcccctctgtatcttttgagaa

SEQ ID NO: 249583 - DNA, 25 bp, Homo sapien
gtgcggaataggttgcttctaccac

SEQ ID NO: 249584 - DNA, 25 bp, Homo sapien
gcttctaccacctgttcttaatgta

SEQ ID NO: 249585 - DNA, 25 bp, Homo sapien
aattgggtgtcctgatgcagactga

SEQ ID NO: 249586 - DNA, 25 bp, Homo sapien
gcagtttctctcaattgtagcctca

SEQ ID NO: 249587 - DNA, 25 bp, Homo sapien
gtagcctcatactcataaggtgctt

SEQ ID NO: 249588 - DNA, 25 bp, Homo sapien
gtgcttaccagctagaacattgagc

SEQ ID NO: 249589 - DNA, 25 bp, Homo sapien
tttttctctgatggcattaactttg

SEQ ID NO: 249590 - DNA, 25 bp, Homo sapien
atgatggatgcagaccctgttcttg

SEQ ID NO: 249591 - DNA, 25 bp, Homo sapien
ggaagtccttagtggctgcatcctt

SEQ ID NO: 249592 - DNA, 25 bp, Homo sapien
tgcatccttggtgcactgtgatgga

SEQ ID NO: 249593 - DNA, 25 bp, Homo sapien
atgtgttctttgtgagctttcgttc

SEQ ID NO: 249594 - DNA, 25 bp, Homo sapien
gagctttcgttctatgattgtcaaa

SEQ ID NO: 249595 - DNA, 25 bp, Homo sapien
ttgtcaaaagtacgatgtggttcct

SEQ ID NO: 249596 - DNA, 25 bp, Homo sapien
gaaattaacaagagaccaccagtca

SEQ ID NO: 249597 - DNA, 25 bp, Homo sapien
agtcaccaagtgacagggactgctt

SEQ ID NO: 249598 - DNA, 25 bp, Homo sapien
gacagggactgctttaaggctctca

SEQ ID NO: 249599 - DNA, 25 bp, Homo sapien
gctttaaggctctcatttgtgttac

SEQ ID NO: 249600 - DNA, 25 bp, Homo sapien
tcatttgtgttacctcttccagttc

SEQ ID NO: 249601 - DNA, 25 bp, Homo sapien
ttccagttcccaaaacgattccatt

SEQ ID NO: 249602 - DNA, 25 bp, Homo sapien
aaacgattccattaggatggcccta

SEQ ID NO: 249603 - DNA, 25 bp, Homo sapien
taggatggccctaaagtccccattt

SEQ ID NO: 249604 - DNA, 25 bp, Homo sapien
aacaccccaacgttatatcgcgaag

SEQ ID NO: 249605 - DNA, 25 bp, Homo sapien
atcgcgaagaagtggccacgcgcgt

SEQ ID NO: 249606 - DNA, 25 bp, Homo sapien
gtcagaaggcttccgggatcatcca

SEQ ID NO: 249607 - DNA, 25 bp, Homo sapien
aaagtacagtggaagcagactacga

SEQ ID NO: 249608 - DNA, 25 bp, Homo sapien
agtacagtggaagcagactacgaga

SEQ ID NO: 249609 - DNA, 25 bp, Homo sapien
agagtgtagagggagaaggtgcccc

SEQ ID NO: 249610 - DNA, 25 bp, Homo sapien
tcccatccttttgggctcggaccct

SEQ ID NO: 249611 - DNA, 25 bp, Homo sapien
tttttccacagggaactatccctat

SEQ ID NO: 249612 - DNA, 25 bp, Homo sapien
tttccacagggaactatccctattg

SEQ ID NO: 249613 - DNA, 25 bp, Homo sapien
cacagggaactatccctattgggtc

SEQ ID NO: 249614 - DNA, 25 bp, Homo sapien
ggaactatccctattgggtcctcca

SEQ ID NO: 249615 - DNA, 25 bp, Homo sapien
aactatccctattgggtcctccaga

SEQ ID NO: 249616 - DNA, 25 bp, Homo sapien
atccctattgggtcctccagatcat

SEQ ID NO: 249617 - DNA, 25 bp, Homo sapien
ccctattgggtcctccagatcatct

SEQ ID NO: 249618 - DNA, 25 bp, Homo sapien
gtacactcacacttcatgattgaca

SEQ ID NO: 249619 - DNA, 25 bp, Homo sapien
atttccatttggttatgcttatttt

SEQ ID NO: 249620 - DNA, 25 bp, Homo sapien
gaaattttctactaacagccagcta

SEQ ID NO: 249621 - DNA, 25 bp, Homo sapien
gttagctctatctgtttcacttgga

SEQ ID NO: 249622 - DNA, 25 bp, Homo sapien
tatctgtttcacttggacgtttcat

SEQ ID NO: 249623 - DNA, 25 bp, Homo sapien
gtttcacttggacgtttcattttga

SEQ ID NO: 249624 - DNA, 25 bp, Homo sapien
gttttatacaaagtagccagtccca

SEQ ID NO: 249625 - DNA, 25 bp, Homo sapien
aaagtagccagtcccataatgaaat

SEQ ID NO: 249626 - DNA, 25 bp, Homo sapien
gccagtcccataatgaaatgctgta

SEQ ID NO: 249627 - DNA, 25 bp, Homo sapien
aaatgctgtattgccatagtggtca

SEQ ID NO: 249628 - DNA, 25 bp, Homo sapien
tattgccatagtggtcacacccaag

SEQ ID NO: 249629 - DNA, 25 bp, Homo sapien
attaggtataacacttttgcctgca

SEQ ID NO: 249630 - DNA, 25 bp, Homo sapien
taggtataacacttttgcctgcaaa

SEQ ID NO: 249631 - DNA, 25 bp, Homo sapien
ggtataacacttttgcctgcaaatc

SEQ ID NO: 249632 - DNA, 25 bp, Homo sapien
gtataacacttttgcctgcaaatct

SEQ ID NO: 249633 - DNA, 25 bp, Homo sapien
tgcctgcaaatctatcagcaacctc

SEQ ID NO: 249634 - DNA, 25 bp, Homo sapien
cctgcaaatctatcagcaacctcta

SEQ ID NO: 249635 - DNA, 25 bp, Homo sapien
tgcaaatctatcagcaacctctatt

SEQ ID NO: 249636 - DNA, 25 bp, Homo sapien
gcaaatctatcagcaacctctatta

SEQ ID NO: 249637 - DNA, 25 bp, Homo sapien
aaatctatcagcaacctctattacc

SEQ ID NO: 249638 - DNA, 25 bp, Homo sapien
atctatcagcaacctctattaccca

SEQ ID NO: 249639 - DNA, 25 bp, Homo sapien
agcaacctctattacccaccacatt

SEQ ID NO: 249640 - DNA, 25 bp, Homo sapien
acagcaccaacaccaagttaacagg

SEQ ID NO: 249641 - DNA, 25 bp, Homo sapien
aacaccaagttaacaggatgcaaca

SEQ ID NO: 249642 - DNA, 25 bp, Homo sapien
ggatgcaacatgtgtatgactctaa

SEQ ID NO: 249643 - DNA, 25 bp, Homo sapien
gactctaaaagccctaagtagttgg

SEQ ID NO: 249644 - DNA, 25 bp, Homo sapien
tcctgggccttcaatcatagcaatt

SEQ ID NO: 249645 - DNA, 25 bp, Homo sapien
tgggccttcaatcatagcaatttga

SEQ ID NO: 249646 - DNA, 25 bp, Homo sapien
atttgttgggtaatcaagacattcc

SEQ ID NO: 249647 - DNA, 25 bp, Homo sapien
ggtaatcaagacattcccgtatatg

SEQ ID NO: 249648 - DNA, 25 bp, Homo sapien
cattcccgtatatgtctgatttcat

SEQ ID NO: 249649 - DNA, 25 bp, Homo sapien
gtctgatttcatggaactgctctat

SEQ ID NO: 249650 - DNA, 25 bp, Homo sapien
atgtgtgtgtctgtagcttcagttt

SEQ ID NO: 249651 - DNA, 25 bp, Homo sapien
tctcccattagctcagccgtggcat

SEQ ID NO: 249652 - DNA, 25 bp, Homo sapien
catcggacttgcagcttcattttgg

SEQ ID NO: 249653 - DNA, 25 bp, Homo sapien
tcattttgggctgccttagccatga

SEQ ID NO: 249654 - DNA, 25 bp, Homo sapien
atgaagctccttttgctgactttga

SEQ ID NO: 249655 - DNA, 25 bp, Homo sapien
cttttgctgactttgactgtgctgc

SEQ ID NO: 249656 - DNA, 25 bp, Homo sapien
agctgactccaggtggcacccaaag

SEQ ID NO: 249657 - DNA, 25 bp, Homo sapien
gtggcacccaaagatgctggaatct

SEQ ID NO: 249658 - DNA, 25 bp, Homo sapien
agatgctggaatctttatggcaaat

SEQ ID NO: 249659 - DNA, 25 bp, Homo sapien
aaatgccgttacagatgctccaaga

SEQ ID NO: 249660 - DNA, 25 bp, Homo sapien
gaaagagtctatgtttactgcataa

SEQ ID NO: 249661 - DNA, 25 bp, Homo sapien
cagtcagagtgtgagggctgtaccc

SEQ ID NO: 249662 - DNA, 25 bp, Homo sapien
atgcgaaccagtcgtatttcctttg

SEQ ID NO: 249663 - DNA, 25 bp, Homo sapien
taaagacgtgcactggccatctagg

SEQ ID NO: 249664 - DNA, 25 bp, Homo sapien
ctagggaggagcttttacttcaact

SEQ ID NO: 249665 - DNA, 25 bp, Homo sapien
ttgggtccgggaattcagagaatct

SEQ ID NO: 249666 - DNA, 25 bp, Homo sapien
taggactggagctgactggtgacct

SEQ ID NO: 249667 - DNA, 25 bp, Homo sapien
gacctggcgctcgatggacggaaac

SEQ ID NO: 249668 - DNA, 25 bp, Homo sapien
ggacggaaacgctgttcttgccgct

SEQ ID NO: 249669 - DNA, 25 bp, Homo sapien
ttcggcagctcccatactggtggga

SEQ ID NO: 249670 - DNA, 25 bp, Homo sapien
agaggcaaacttgcagtctgctcat

SEQ ID NO: 249671 - DNA, 25 bp, Homo sapien
agagaatctcgttgtccagggccag

SEQ ID NO: 249672 - DNA, 25 bp, Homo sapien
gccaacccttgatagatgcgaacca

SEQ ID NO: 249673 - DNA, 25 bp, Homo sapien
gggaaaagcaatttaatgtaccacg

SEQ ID NO: 249674 - DNA, 25 bp, Homo sapien
gaaaagcaatttaatgtaccacgat

SEQ ID NO: 249675 - DNA, 25 bp, Homo sapien
aaagcaatttaatgtaccacgatga

SEQ ID NO: 249676 - DNA, 25 bp, Homo sapien
agcaatttaatgtaccacgatgaat

SEQ ID NO: 249677 - DNA, 25 bp, Homo sapien
atttaatgtaccacgatgaatagct

SEQ ID NO: 249678 - DNA, 25 bp, Homo sapien
taatgtaccacgatgaatagctaac

SEQ ID NO: 249679 - DNA, 25 bp, Homo sapien
atgtaccacgatgaatagctaactg

SEQ ID NO: 249680 - DNA, 25 bp, Homo sapien
gtaccacgatgaatagctaactgtt

SEQ ID NO: 249681 - DNA, 25 bp, Homo sapien
accacgatgaatagctaactgttcc

SEQ ID NO: 249682 - DNA, 25 bp, Homo sapien
acgatgaatagctaactgttcccaa

SEQ ID NO: 249683 - DNA, 25 bp, Homo sapien
cgatgaatagctaactgttcccaag

SEQ ID NO: 249684 - DNA, 25 bp, Homo sapien
aattaccatgtatcaaatgggtgac

SEQ ID NO: 249685 - DNA, 25 bp, Homo sapien
ttaccatgtatcaaatgggtgacga

SEQ ID NO: 249686 - DNA, 25 bp, Homo sapien
accatgtatcaaatgggtgacgaat

SEQ ID NO: 249687 - DNA, 25 bp, Homo sapien
catgtatcaaatgggtgacgaatta

SEQ ID NO: 249688 - DNA, 25 bp, Homo sapien
atcaaatgggtgacgaattaatact

SEQ ID NO: 249689 - DNA, 25 bp, Homo sapien
caaatgggtgacgaattaatactag

SEQ ID NO: 249690 - DNA, 25 bp, Homo sapien
aatgggtgacgaattaatactagat

SEQ ID NO: 249691 - DNA, 25 bp, Homo sapien
atgggtgacgaattaatactagata

SEQ ID NO: 249692 - DNA, 25 bp, Homo sapien
gggtgacgaattaatactagatata

SEQ ID NO: 249693 - DNA, 25 bp, Homo sapien
gtgacgaattaatactagatatatc

SEQ ID NO: 249694 - DNA, 25 bp, Homo sapien
gacgaattaatactagatatatcta

SEQ ID NO: 249695 - DNA, 25 bp, Homo sapien
aagaagaacaactatttcgctccag

SEQ ID NO: 249696 - DNA, 25 bp, Homo sapien
agaagaacaactatttcgctccaga

SEQ ID NO: 249697 - DNA, 25 bp, Homo sapien
gaagaacaactatttcgctccagaa

SEQ ID NO: 249698 - DNA, 25 bp, Homo sapien
aagaacaactatttcgctccagaaa

SEQ ID NO: 249699 - DNA, 25 bp, Homo sapien
cagaaacttgggagaactgggtatt

SEQ ID NO: 249700 - DNA, 25 bp, Homo sapien
tgggagaactgggtatttagaacaa

SEQ ID NO: 249701 - DNA, 25 bp, Homo sapien
gaactgggtatttagaacaagtgat

SEQ ID NO: 249702 - DNA, 25 bp, Homo sapien
ctgggtatttagaacaagtgataat

SEQ ID NO: 249703 - DNA, 25 bp, Homo sapien
cagactgtagcattgaaattagatg

SEQ ID NO: 249704 - DNA, 25 bp, Homo sapien
aattagatgcgagaatcagagattc

SEQ ID NO: 249705 - DNA, 25 bp, Homo sapien
tagatgcgagaatcagagattcttc

SEQ ID NO: 249706 - DNA, 25 bp, Homo sapien
aaaggtgagcttatatattgtttat

SEQ ID NO: 249707 - DNA, 25 bp, Homo sapien
cctggaaatagacaatttggctctc

SEQ ID NO: 249708 - DNA, 25 bp, Homo sapien
tagacaatttggctctcataccata

SEQ ID NO: 249709 - DNA, 25 bp, Homo sapien
aatttggctctcataccataagcat

SEQ ID NO: 249710 - DNA, 25 bp, Homo sapien
gatttctttatatggtggtgtgttt

SEQ ID NO: 249711 - DNA, 25 bp, Homo sapien
ttctgaattttccatgtgctttaat

SEQ ID NO: 249712 - DNA, 25 bp, Homo sapien
tatatctgttcaatttttatcattc

SEQ ID NO: 249713 - DNA, 25 bp, Homo sapien
tttatcattccccttatcattagaa

SEQ ID NO: 249714 - DNA, 25 bp, Homo sapien
attccccttatcattagaaagtttg

SEQ ID NO: 249715 - DNA, 25 bp, Homo sapien
aaatacttgaatcttggacctctaa

SEQ ID NO: 249716 - DNA, 25 bp, Homo sapien
aatcttggacctctaaatatacttt

SEQ ID NO: 249717 - DNA, 25 bp, Homo sapien
ttcatccaatccgagcatcggctga

SEQ ID NO: 249718 - DNA, 25 bp, Homo sapien
gagcatcggctgacaagtttattta

SEQ ID NO: 249719 - DNA, 25 bp, Homo sapien
tctgagacaggttgggagccagccc

SEQ ID NO: 249720 - DNA, 25 bp, Homo sapien
tttaatccctgaacctggatccaag

SEQ ID NO: 249721 - DNA, 25 bp, Homo sapien
tggatccaaggcatctccctgtaga

SEQ ID NO: 249722 - DNA, 25 bp, Homo sapien
aggcatctccctgtagaaaacatca

SEQ ID NO: 249723 - DNA, 25 bp, Homo sapien
tccctgtagaaaacatcagaccggg

SEQ ID NO: 249724 - DNA, 25 bp, Homo sapien
gcagcagctgccaacggccgctgtg

SEQ ID NO: 249725 - DNA, 25 bp, Homo sapien
gggtccaggcacaggaacagccaaa

SEQ ID NO: 249726 - DNA, 25 bp, Homo sapien
aggaacagccaaacgcccgaaccag

SEQ ID NO: 249727 - DNA, 25 bp, Homo sapien
ggttacctttgccacttcatccaat

SEQ ID NO: 249728 - DNA, 25 bp, Homo sapien
ttgcaactgatttcctccagataca

SEQ ID NO: 249729 - DNA, 25 bp, Homo sapien
tttcctccagatacaaacagggcag

SEQ ID NO: 249730 - DNA, 25 bp, Homo sapien
agttcccagccagcttccttggatg

SEQ ID NO: 249731 - DNA, 25 bp, Homo sapien
agcttccttggatggccacacagga

SEQ ID NO: 249732 - DNA, 25 bp, Homo sapien
ggatggccacacaggaatcactcca

SEQ ID NO: 249733 - DNA, 25 bp, Homo sapien
agcagaaccacagggaaacctcttg

SEQ ID NO: 249734 - DNA, 25 bp, Homo sapien
tcttgtccctctggaaactcagtta

SEQ ID NO: 249735 - DNA, 25 bp, Homo sapien
actcagttacaatcagttcagcact

SEQ ID NO: 249736 - DNA, 25 bp, Homo sapien
gttcagcacttgaaggaaggatctc

SEQ ID NO: 249737 - DNA, 25 bp, Homo sapien
tgagacccacacttatgctctgatg

SEQ ID NO: 249738 - DNA, 25 bp, Homo sapien
tgctctgatgccttgcaactgattt

SEQ ID NO: 249739 - DNA, 25 bp, Homo sapien
tttgggccatgatttggagggttcc

SEQ ID NO: 249740 - DNA, 25 bp, Homo sapien
gattaataacttaagtacctactat

SEQ ID NO: 249741 - DNA, 25 bp, Homo sapien
ttaagtacctactattcaaaagagg

SEQ ID NO: 249742 - DNA, 25 bp, Homo sapien
gggcttctaggacccttgagtgaac

SEQ ID NO: 249743 - DNA, 25 bp, Homo sapien
gcttctaggacccttgagtgaacag

SEQ ID NO: 249744 - DNA, 25 bp, Homo sapien
ttctaggacccttgagtgaacagtg

SEQ ID NO: 249745 - DNA, 25 bp, Homo sapien
ctaggacccttgagtgaacagtgag

SEQ ID NO: 249746 - DNA, 25 bp, Homo sapien
gaacagtgagagctcttgggacttc

SEQ ID NO: 249747 - DNA, 25 bp, Homo sapien
acagtgagagctcttgggacttctt

SEQ ID NO: 249748 - DNA, 25 bp, Homo sapien
agtgagagctcttgggacttcttga

SEQ ID NO: 249749 - DNA, 25 bp, Homo sapien
agagctcttgggacttcttgagccc

SEQ ID NO: 249750 - DNA, 25 bp, Homo sapien
ggttcctcgtgggtatcgtcctcat

SEQ ID NO: 249751 - DNA, 25 bp, Homo sapien
tcgtcctcatcatcatgggcacata

SEQ ID NO: 249752 - DNA, 25 bp, Homo sapien
atatgtgtccagtgtccctaggtaa

SEQ ID NO: 249753 - DNA, 25 bp, Homo sapien
actcctcaggcattgggagctccaa

SEQ ID NO: 249754 - DNA, 25 bp, Homo sapien
ttgggagctccaagtgcctattcca

SEQ ID NO: 249755 - DNA, 25 bp, Homo sapien
atggagaccctagtttgtgccctag

SEQ ID NO: 249756 - DNA, 25 bp, Homo sapien
ggagaccctagtttgtgccctaggc

SEQ ID NO: 249757 - DNA, 25 bp, Homo sapien
accctagtttgtgccctaggcctag

SEQ ID NO: 249758 - DNA, 25 bp, Homo sapien
tgtgccctaggcctagacattggcc

SEQ ID NO: 249759 - DNA, 25 bp, Homo sapien
ccctaggcctagacattggcctggt

SEQ ID NO: 249760 - DNA, 25 bp, Homo sapien
acattggcctggtggggttcctcgt

SEQ ID NO: 249761 - DNA, 25 bp, Homo sapien
ttgaatgttgactcaggctgtgggt

SEQ ID NO: 249762 - DNA, 25 bp, Homo sapien
tgtgggtgggacaaacctcaggcac

SEQ ID NO: 249763 - DNA, 25 bp, Homo sapien
tgggacaaacctcaggcaccttgga

SEQ ID NO: 249764 - DNA, 25 bp, Homo sapien
taagcaactttggttaacacatatt

SEQ ID NO: 249765 - DNA, 25 bp, Homo sapien
gaagggcacgactcctggactaaat

SEQ ID NO: 249766 - DNA, 25 bp, Homo sapien
tttgttttgaccatcgaagataaaa

SEQ ID NO: 249767 - DNA, 25 bp, Homo sapien
aaaactctttatttaattgcttatg

SEQ ID NO: 249768 - DNA, 25 bp, Homo sapien
acctaaaacagggagcatcatctaa

SEQ ID NO: 249769 - DNA, 25 bp, Homo sapien
ggactaaatcagatccctgatcaga

SEQ ID NO: 249770 - DNA, 25 bp, Homo sapien
ccctgatcagagaatgtttcaccct

SEQ ID NO: 249771 - DNA, 25 bp, Homo sapien
accctgaagtcagcctgttcttagg

SEQ ID NO: 249772 - DNA, 25 bp, Homo sapien
ggcgccaccaagtttttaatgttct

SEQ ID NO: 249773 - DNA, 25 bp, Homo sapien
gccaccaagtttttaatgttctctt

SEQ ID NO: 249774 - DNA, 25 bp, Homo sapien
gcattattgagaaactgaacatgtg

SEQ ID NO: 249775 - DNA, 25 bp, Homo sapien
tgaacatgtgtttcagttattacat

SEQ ID NO: 249776 - DNA, 25 bp, Homo sapien
gtgtttcagttattacatggcttct

SEQ ID NO: 249777 - DNA, 25 bp, Homo sapien
cagttattacatggcttctgattaa

SEQ ID NO: 249778 - DNA, 25 bp, Homo sapien
catttgggttgtgtgagtttttctc

SEQ ID NO: 249779 - DNA, 25 bp, Homo sapien
ctgcaaaatatagtgccttcgaatg

SEQ ID NO: 249780 - DNA, 25 bp, Homo sapien
tatagtgccttcgaatgagaggtga

SEQ ID NO: 249781 - DNA, 25 bp, Homo sapien
ggtagttaattcaaaatgagtctca

SEQ ID NO: 249782 - DNA, 25 bp, Homo sapien
gggaccagtgattcaatggttttaa

SEQ ID NO: 249783 - DNA, 25 bp, Homo sapien
ccaaagtccaacagccatgcagcca

SEQ ID NO: 249784 - DNA, 25 bp, Homo sapien
agaagcagcggctgacacctcggcc

SEQ ID NO: 249785 - DNA, 25 bp, Homo sapien
atgatcgaaagcacccccatgtcca

SEQ ID NO: 249786 - DNA, 25 bp, Homo sapien
gccaccccactcctggacgagatgg

SEQ ID NO: 249787 - DNA, 25 bp, Homo sapien
tgctcctcggactctggttacctct

SEQ ID NO: 249788 - DNA, 25 bp, Homo sapien
tcctcggactctggttacctctgag

SEQ ID NO: 249789 - DNA, 25 bp, Homo sapien
tcggactctggttacctctgaggct

SEQ ID NO: 249790 - DNA, 25 bp, Homo sapien
cggactctggttacctctgaggctg

SEQ ID NO: 249791 - DNA, 25 bp, Homo sapien
gactctggttacctctgaggctggg

SEQ ID NO: 249792 - DNA, 25 bp, Homo sapien
cctccttttatgtccataaagtggc

SEQ ID NO: 249793 - DNA, 25 bp, Homo sapien
tttatgtccataaagtggcgtgaag

SEQ ID NO: 249794 - DNA, 25 bp, Homo sapien
tcccgccatatacattccgtgcttt

SEQ ID NO: 249795 - DNA, 25 bp, Homo sapien
gccatatacattccgtgcttttcaa

SEQ ID NO: 249796 - DNA, 25 bp, Homo sapien
tatacattccgtgcttttcaaacac

SEQ ID NO: 249797 - DNA, 25 bp, Homo sapien
cgtgggctaagcatgggacccacgt

SEQ ID NO: 249798 - DNA, 25 bp, Homo sapien
gggacacacggcgataaagagccag

SEQ ID NO: 249799 - DNA, 25 bp, Homo sapien
acggcgataaagagccaggccctcg

SEQ ID NO: 249800 - DNA, 25 bp, Homo sapien
cgataaagagccaggccctcgctgc

SEQ ID NO: 249801 - DNA, 25 bp, Homo sapien
aggccctcgctgccaaggagctttc

SEQ ID NO: 249802 - DNA, 25 bp, Homo sapien
aggagctttcccgtaacaccgatgc

SEQ ID NO: 249803 - DNA, 25 bp, Homo sapien
gagctttcccgtaacaccgatgcat

SEQ ID NO: 249804 - DNA, 25 bp, Homo sapien
gctttcccgtaacaccgatgcatca

SEQ ID NO: 249805 - DNA, 25 bp, Homo sapien
ttcccagccccgatatctggaatgt

SEQ ID NO: 249806 - DNA, 25 bp, Homo sapien
cagccccgatatctggaatgtcgat

SEQ ID NO: 249807 - DNA, 25 bp, Homo sapien
gatatctggaatgtcgatggcgcta

SEQ ID NO: 249808 - DNA, 25 bp, Homo sapien
atctggaatgtcgatggcgctaatt

SEQ ID NO: 249809 - DNA, 25 bp, Homo sapien
ctggaatgtcgatggcgctaattgc

SEQ ID NO: 249810 - DNA, 25 bp, Homo sapien
cgctaattgccagcatgtgtttgtc

SEQ ID NO: 249811 - DNA, 25 bp, Homo sapien
taattgccagcatgtgtttgtcctt

SEQ ID NO: 249812 - DNA, 25 bp, Homo sapien
attgccagcatgtgtttgtccttaa

SEQ ID NO: 249813 - DNA, 25 bp, Homo sapien
tgccagcatgtgtttgtccttaaga

SEQ ID NO: 249814 - DNA, 25 bp, Homo sapien
ccagcatgtgtttgtccttaagact

SEQ ID NO: 249815 - DNA, 25 bp, Homo sapien
gcatgtgtttgtccttaagactttt

SEQ ID NO: 249816 - DNA, 25 bp, Homo sapien
gatcattttgagtaattccatgtca

SEQ ID NO: 249817 - DNA, 25 bp, Homo sapien
tgagtaattccatgtcatccacaca

SEQ ID NO: 249818 - DNA, 25 bp, Homo sapien
attggcctcccagtgttacaggaaa

SEQ ID NO: 249819 - DNA, 25 bp, Homo sapien
gtgttacaggaaagaggtcccgatc

SEQ ID NO: 249820 - DNA, 25 bp, Homo sapien
tcagtcaccgccagttaggctcctt

SEQ ID NO: 249821 - DNA, 25 bp, Homo sapien
gaatgactattccataggcagagct

SEQ ID NO: 249822 - DNA, 25 bp, Homo sapien
gactattccataggcagagctggtg

SEQ ID NO: 249823 - DNA, 25 bp, Homo sapien
cgccagttaggctccttcagacaac

SEQ ID NO: 249824 - DNA, 25 bp, Homo sapien
tcagacaaccctgtggcttgcttta

SEQ ID NO: 249825 - DNA, 25 bp, Homo sapien
gcttgctttataaggtatgtcgaaa

SEQ ID NO: 249826 - DNA, 25 bp, Homo sapien
atgtcgaaacaaatgaacctagatc

SEQ ID NO: 249827 - DNA, 25 bp, Homo sapien
gggaccaaactctcggtcataccaa

SEQ ID NO: 249828 - DNA, 25 bp, Homo sapien
ggaccaaactctcggtcataccaaa

SEQ ID NO: 249829 - DNA, 25 bp, Homo sapien
gggctgggagttaccaactcacttt

SEQ ID NO: 249830 - DNA, 25 bp, Homo sapien
ggctgggagttaccaactcactttc

SEQ ID NO: 249831 - DNA, 25 bp, Homo sapien
gctgggagttaccaactcactttcg

SEQ ID NO: 249832 - DNA, 25 bp, Homo sapien
ctgggagttaccaactcactttcgg

SEQ ID NO: 249833 - DNA, 25 bp, Homo sapien
tgggagttaccaactcactttcggg

SEQ ID NO: 249834 - DNA, 25 bp, Homo sapien
gagttaccaactcactttcgggaag

SEQ ID NO: 249835 - DNA, 25 bp, Homo sapien
atggctttcccagtccttgcatcaa

SEQ ID NO: 249836 - DNA, 25 bp, Homo sapien
tggctttcccagtccttgcatcaac

SEQ ID NO: 249837 - DNA, 25 bp, Homo sapien
gctttcccagtccttgcatcaacgg

SEQ ID NO: 249838 - DNA, 25 bp, Homo sapien
tttcccagtccttgcatcaacggga

SEQ ID NO: 249839 - DNA, 25 bp, Homo sapien
ttcccagtccttgcatcaacgggat

SEQ ID NO: 249840 - DNA, 25 bp, Homo sapien
tcccagtccttgcatcaacgggatg

SEQ ID NO: 249841 - DNA, 25 bp, Homo sapien
cagtccttgcatcaacgggatgcca

SEQ ID NO: 249842 - DNA, 25 bp, Homo sapien
gtccttgcatcaacgggatgccaca

SEQ ID NO: 249843 - DNA, 25 bp, Homo sapien
ttgcatcaacgggatgccacatttc

SEQ ID NO: 249844 - DNA, 25 bp, Homo sapien
catcaacgggatgccacatttcata

SEQ ID NO: 249845 - DNA, 25 bp, Homo sapien
tcaacgggatgccacatttcataac

SEQ ID NO: 249846 - DNA, 25 bp, Homo sapien
cccttccaaaacacagaggagccat

SEQ ID NO: 249847 - DNA, 25 bp, Homo sapien
cacagaggagccatatgagaatatc

SEQ ID NO: 249848 - DNA, 25 bp, Homo sapien
ggacaaaatacagatcccaagctaa

SEQ ID NO: 249849 - DNA, 25 bp, Homo sapien
gatcccaagctaaatcccaaggatg

SEQ ID NO: 249850 - DNA, 25 bp, Homo sapien
aatcccaaggatgacggcatcgtct

SEQ ID NO: 249851 - DNA, 25 bp, Homo sapien
aggatgacggcatcgtctatgcttc

SEQ ID NO: 249852 - DNA, 25 bp, Homo sapien
gacggcatcgtctatgcttcccttg

SEQ ID NO: 249853 - DNA, 25 bp, Homo sapien
agaacgagaccctgtactctgtctt

SEQ ID NO: 249854 - DNA, 25 bp, Homo sapien
gaccctgtactctgtcttaaaggcc

SEQ ID NO: 249855 - DNA, 25 bp, Homo sapien
cttaaaggcctaaccaatggacagc

SEQ ID NO: 249856 - DNA, 25 bp, Homo sapien
actgaatggtgaggccaggtacagt

SEQ ID NO: 249857 - DNA, 25 bp, Homo sapien
aaatctaatatttggctgtggcatt

SEQ ID NO: 249858 - DNA, 25 bp, Homo sapien
taatatttggctgtggcattatcca

SEQ ID NO: 249859 - DNA, 25 bp, Homo sapien
tgtggcattatccagaagtatggag

SEQ ID NO: 249860 - DNA, 25 bp, Homo sapien
ggagtttattatagctatgttcaag

SEQ ID NO: 249861 - DNA, 25 bp, Homo sapien
tatagtaaggagattcccatgttac

SEQ ID NO: 249862 - DNA, 25 bp, Homo sapien
atttgtggatgttttcctgcatcat

SEQ ID NO: 249863 - DNA, 25 bp, Homo sapien
ggatgttttcctgcatcatatgcaa

SEQ ID NO: 249864 - DNA, 25 bp, Homo sapien
taaagagagttataggcctcttggg

SEQ ID NO: 249865 - DNA, 25 bp, Homo sapien
tcttggggcccagaactcagagttc

SEQ ID NO: 249866 - DNA, 25 bp, Homo sapien
ctcagagttcaaaatgacccttctt

SEQ ID NO: 249867 - DNA, 25 bp, Homo sapien
aatgacccttctttgattggatcaa

SEQ ID NO: 249868 - DNA, 25 bp, Homo sapien
ttcagtacaggtgggataaatgctc

SEQ ID NO: 249869 - DNA, 25 bp, Homo sapien
taaatgctctgaaaggctgtgccca

SEQ ID NO: 249870 - DNA, 25 bp, Homo sapien
aaatgctctgaaaggctgtgcccag

SEQ ID NO: 249871 - DNA, 25 bp, Homo sapien
cccagaggaatgagcaaataggcaa

SEQ ID NO: 249872 - DNA, 25 bp, Homo sapien
gagcaaataggcaagtgtttccaaa

SEQ ID NO: 249873 - DNA, 25 bp, Homo sapien
caagtgtttccaaactacttggagg

SEQ ID NO: 249874 - DNA, 25 bp, Homo sapien
tcacaaaatcacatcagacagaagt

SEQ ID NO: 249875 - DNA, 25 bp, Homo sapien
agacagaagttgttttcttcaggag

SEQ ID NO: 249876 - DNA, 25 bp, Homo sapien
tcttcaggagggaaatgaaccactt

SEQ ID NO: 249877 - DNA, 25 bp, Homo sapien
tgaaccacttaatatacccatacta

SEQ ID NO: 249878 - DNA, 25 bp, Homo sapien
tatacccatactaccttgaacaatg

SEQ ID NO: 249879 - DNA, 25 bp, Homo sapien
ctgttgaaatggagtgataggtgca

SEQ ID NO: 249880 - DNA, 25 bp, Homo sapien
gtctatgttagagatttttcctaaa

SEQ ID NO: 249881 - DNA, 25 bp, Homo sapien
gtgataggtgcatggacacttctta

SEQ ID NO: 249882 - DNA, 25 bp, Homo sapien
aggtgcatggacacttcttatacca

SEQ ID NO: 249883 - DNA, 25 bp, Homo sapien
atggacacttcttataccattctct

SEQ ID NO: 249884 - DNA, 25 bp, Homo sapien
aaaggtattaattccctcattcctg

SEQ ID NO: 249885 - DNA, 25 bp, Homo sapien
gtattaattccctcattcctgtctc

SEQ ID NO: 249886 - DNA, 25 bp, Homo sapien
ttcctgtctccccaagtgaagcttt

SEQ ID NO: 249887 - DNA, 25 bp, Homo sapien
ctgtctccccaagtgaagctttgag

SEQ ID NO: 249888 - DNA, 25 bp, Homo sapien
tctccccaagtgaagctttgagcta

SEQ ID NO: 249889 - DNA, 25 bp, Homo sapien
gaagctttgagctaaaaaggtcaag

SEQ ID NO: 249890 - DNA, 25 bp, Homo sapien
tttccccagtgctttgagtcttcct

SEQ ID NO: 249891 - DNA, 25 bp, Homo sapien
acacaaagtactctgttgccctatt

SEQ ID NO: 249892 - DNA, 25 bp, Homo sapien
cttaatagtcatatttccgtggtgg

SEQ ID NO: 249893 - DNA, 25 bp, Homo sapien
atttccgtggtggaagatctcccta

SEQ ID NO: 249894 - DNA, 25 bp, Homo sapien
agatctccctatttctctgatgtga

SEQ ID NO: 249895 - DNA, 25 bp, Homo sapien
atttctctgatgtgacaggttacag

SEQ ID NO: 249896 - DNA, 25 bp, Homo sapien
tgttgccctattatagtcctgcgat

SEQ ID NO: 249897 - DNA, 25 bp, Homo sapien
atagtcctgcgatagttctggctag

SEQ ID NO: 249898 - DNA, 25 bp, Homo sapien
tctggctaggattaggttgacggtc

SEQ ID NO: 249899 - DNA, 25 bp, Homo sapien
gttgacggtctaagccccaagaaag

SEQ ID NO: 249900 - DNA, 25 bp, Homo sapien
tggcattttcatagcaggctttccc

SEQ ID NO: 249901 - DNA, 25 bp, Homo sapien
ggagactcctgaccctcagaatgag

SEQ ID NO: 249902 - DNA, 25 bp, Homo sapien
aagcagcacaccaaactgtcaaagt

SEQ ID NO: 249903 - DNA, 25 bp, Homo sapien
aagtggtgatccctcttcatttgac

SEQ ID NO: 249904 - DNA, 25 bp, Homo sapien
gaaagcaagctaacccagaaacagt

SEQ ID NO: 249905 - DNA, 25 bp, Homo sapien
gaaacagtgaggtgacagtgcgcct

SEQ ID NO: 249906 - DNA, 25 bp, Homo sapien
gacagtgcgcctcaaacacaggaaa

SEQ ID NO: 249907 - DNA, 25 bp, Homo sapien
ataactatactgattggatgctgct

SEQ ID NO: 249908 - DNA, 25 bp, Homo sapien
ggatgctgctcaaaatcagcctaca

SEQ ID NO: 249909 - DNA, 25 bp, Homo sapien
aaatcagcctacatgccatctttgg

SEQ ID NO: 249910 - DNA, 25 bp, Homo sapien
tgccatctttggtacgtgtgaacaa

SEQ ID NO: 249911 - DNA, 25 bp, Homo sapien
ttaccaattcctattctaactatga

SEQ ID NO: 249912 - DNA, 25 bp, Homo sapien
atgcagcctgacatcccgtttcccc

SEQ ID NO: 249913 - DNA, 25 bp, Homo sapien
tttccccaggccagaggtaggtttg

SEQ ID NO: 249914 - DNA, 25 bp, Homo sapien
ttccccaggccagaggtaggtttga

SEQ ID NO: 249915 - DNA, 25 bp, Homo sapien
tccccaggccagaggtaggtttgaa

SEQ ID NO: 249916 - DNA, 25 bp, Homo sapien
cccaggccagaggtaggtttgaagt

SEQ ID NO: 249917 - DNA, 25 bp, Homo sapien
gaggtaggtttgaagtgaggtctgt

SEQ ID NO: 249918 - DNA, 25 bp, Homo sapien
gaggtctgtgtcactgtggtattat

SEQ ID NO: 249919 - DNA, 25 bp, Homo sapien
gtctgtgtcactgtggtattatgat

SEQ ID NO: 249920 - DNA, 25 bp, Homo sapien
gtgtcactgtggtattatgattacg

SEQ ID NO: 249921 - DNA, 25 bp, Homo sapien
gtcactgtggtattatgattacgtt

SEQ ID NO: 249922 - DNA, 25 bp, Homo sapien
ctgtggtattatgattacgtttggg

SEQ ID NO: 249923 - DNA, 25 bp, Homo sapien
cagaggatgacagggctctacaatc

SEQ ID NO: 249924 - DNA, 25 bp, Homo sapien
ggccaggagagggtacaccccagct

SEQ ID NO: 249925 - DNA, 25 bp, Homo sapien
agagcaaagcagatggatccagttt

SEQ ID NO: 249926 - DNA, 25 bp, Homo sapien
gatggatccagttttctgtgtgttc

SEQ ID NO: 249927 - DNA, 25 bp, Homo sapien
tctgtacttcctcgtagctctgctg

SEQ ID NO: 249928 - DNA, 25 bp, Homo sapien
tcctcgtagctctgctgacaaagca

SEQ ID NO: 249929 - DNA, 25 bp, Homo sapien
tgacaaagcaagcaggcctcccgtg

SEQ ID NO: 249930 - DNA, 25 bp, Homo sapien
acttgtgtacacctaggctggcaaa

SEQ ID NO: 249931 - DNA, 25 bp, Homo sapien
ggctggcaaatcttggagcctctgg

SEQ ID NO: 249932 - DNA, 25 bp, Homo sapien
cctctgggctctgaaaactagacaa

SEQ ID NO: 249933 - DNA, 25 bp, Homo sapien
gatcattaaacctggcttgagtctc

SEQ ID NO: 249934 - DNA, 25 bp, Homo sapien
gagttattacgtttgaagtatactt

SEQ ID NO: 249935 - DNA, 25 bp, Homo sapien
tcaactctcaaaatatttcctactg

SEQ ID NO: 249936 - DNA, 25 bp, Homo sapien
tatttcctactgtttctttattcca

SEQ ID NO: 249937 - DNA, 25 bp, Homo sapien
tctttattccagttgtattcacatg

SEQ ID NO: 249938 - DNA, 25 bp, Homo sapien
gatcagttattgctgcattaaaaac

SEQ ID NO: 249939 - DNA, 25 bp, Homo sapien
gctgcattaaaaacatgagtctttt

SEQ ID NO: 249940 - DNA, 25 bp, Homo sapien
aaacatgagtcttttttattaggtg

SEQ ID NO: 249941 - DNA, 25 bp, Homo sapien
tattaggtggccattatttatgatc

SEQ ID NO: 249942 - DNA, 25 bp, Homo sapien
gaaaaattaagtgaagaggctcttt

SEQ ID NO: 249943 - DNA, 25 bp, Homo sapien
gaagaggctctttatggttaattta

SEQ ID NO: 249944 - DNA, 25 bp, Homo sapien
tttttgcagagttattacgtttgaa

SEQ ID NO: 249945 - DNA, 25 bp, Homo sapien
agctactgctgtctggctccccgga

SEQ ID NO: 249946 - DNA, 25 bp, Homo sapien
ggtgagtcccctgagacgctggatt

SEQ ID NO: 249947 - DNA, 25 bp, Homo sapien
agacgctggattcagcggccccaga

SEQ ID NO: 249948 - DNA, 25 bp, Homo sapien
agcggccccagaactgcaacacagg

SEQ ID NO: 249949 - DNA, 25 bp, Homo sapien
gcaacacaggatcatctggctgctg

SEQ ID NO: 249950 - DNA, 25 bp, Homo sapien
ctgctgtgagaattcgggaagctct

SEQ ID NO: 249951 - DNA, 25 bp, Homo sapien
tctgggtgctgctgtttgggaatta

SEQ ID NO: 249952 - DNA, 25 bp, Homo sapien
ggtgctgctgtttgggaattatccc

SEQ ID NO: 249953 - DNA, 25 bp, Homo sapien
gaattatccccatgaagtcccgaag

SEQ ID NO: 249954 - DNA, 25 bp, Homo sapien
atgaagtcccgaagtcctgcgttgc

SEQ ID NO: 249955 - DNA, 25 bp, Homo sapien
tcctgcgttgctgtgaccatgaaga

SEQ ID NO: 249956 - DNA, 25 bp, Homo sapien
gagagaggcttgtcaaaatcttttt

SEQ ID NO: 249957 - DNA, 25 bp, Homo sapien
gcttgtcaaaatctttttagtgcac

SEQ ID NO: 249958 - DNA, 25 bp, Homo sapien
attttgttcatcttggatttggtga

SEQ ID NO: 249959 - DNA, 25 bp, Homo sapien
atcttggatttggtgagctgggtaa

SEQ ID NO: 249960 - DNA, 25 bp, Homo sapien
agctgggtaatattctgtgcacggc

SEQ ID NO: 249961 - DNA, 25 bp, Homo sapien
tgggtaatattctgtgcacggctcc

SEQ ID NO: 249962 - DNA, 25 bp, Homo sapien
taatattctgtgcacggctcctaaa

SEQ ID NO: 249963 - DNA, 25 bp, Homo sapien
ttctgtgcacggctcctaaatgaat

SEQ ID NO: 249964 - DNA, 25 bp, Homo sapien
gtgcacggctcctaaatgaattatt

SEQ ID NO: 249965 - DNA, 25 bp, Homo sapien
ttattaaatgtcaactcaagatggc

SEQ ID NO: 249966 - DNA, 25 bp, Homo sapien
gatggcttaactaaaatactcaatt

SEQ ID NO: 249967 - DNA, 25 bp, Homo sapien
attaagaacaaaatgggcctggcgc

SEQ ID NO: 249968 - DNA, 25 bp, Homo sapien
ttaagaacaaaatgggcctggcgcg

SEQ ID NO: 249969 - DNA, 25 bp, Homo sapien
taagaacaaaatgggcctggcgcgg

SEQ ID NO: 249970 - DNA, 25 bp, Homo sapien
aagaacaaaatgggcctggcgcggt

SEQ ID NO: 249971 - DNA, 25 bp, Homo sapien
agaacaaaatgggcctggcgcggtg

SEQ ID NO: 249972 - DNA, 25 bp, Homo sapien
gaacaaaatgggcctggcgcggtgg

SEQ ID NO: 249973 - DNA, 25 bp, Homo sapien
aacaaaatgggcctggcgcggtggc

SEQ ID NO: 249974 - DNA, 25 bp, Homo sapien
caaaatgggcctggcgcggtggctt

SEQ ID NO: 249975 - DNA, 25 bp, Homo sapien
agtgagcggagatctgccattgcac

SEQ ID NO: 249976 - DNA, 25 bp, Homo sapien
gtgagcggagatctgccattgcact

SEQ ID NO: 249977 - DNA, 25 bp, Homo sapien
gagcggagatctgccattgcactcc

SEQ ID NO: 249978 - DNA, 25 bp, Homo sapien
cttgtcccggtgtatccgcagcgcg

SEQ ID NO: 249979 - DNA, 25 bp, Homo sapien
tggccggaggccgtaactgtcgcgg

SEQ ID NO: 249980 - DNA, 25 bp, Homo sapien
aggccgtaactgtcgcggctgaggg

SEQ ID NO: 249981 - DNA, 25 bp, Homo sapien
ggcgtcccggtgtatccgcagcgcg

SEQ ID NO: 249982 - DNA, 25 bp, Homo sapien
gccatatacattccgtgcttttcaa

SEQ ID NO: 249983 - DNA, 25 bp, Homo sapien
gtgcttttcaaacacccgccgtggg

SEQ ID NO: 249984 - DNA, 25 bp, Homo sapien
cgccgtgggctaagcatgggaccca

SEQ ID NO: 249985 - DNA, 25 bp, Homo sapien
gagctttcccgtaacaccgatgcat

SEQ ID NO: 249986 - DNA, 25 bp, Homo sapien
cctggtgccggaggccgtaattgtc

SEQ ID NO: 249987 - DNA, 25 bp, Homo sapien
ggaggccgtaattgtcgcggctgaa

SEQ ID NO: 249988 - DNA, 25 bp, Homo sapien
gggcttgtcccggtgtatccgcagc

SEQ ID NO: 249989 - DNA, 25 bp, Homo sapien
atggtccctgagcaaaggagatatt

SEQ ID NO: 249990 - DNA, 25 bp, Homo sapien
gaagtttatgaggatgtgcaagata

SEQ ID NO: 249991 - DNA, 25 bp, Homo sapien
tttgcattttattttgggctatctc

SEQ ID NO: 249992 - DNA, 25 bp, Homo sapien
taatgacgactgtgatattggctac

SEQ ID NO: 249993 - DNA, 25 bp, Homo sapien
gcattttattttgggctatctcagc

SEQ ID NO: 249994 - DNA, 25 bp, Homo sapien
attttgggctatctcagcttctttt

SEQ ID NO: 249995 - DNA, 25 bp, Homo sapien
tcttttactagaagctcatgcctat

SEQ ID NO: 249996 - DNA, 25 bp, Homo sapien
gacgactgtgatattggctacataa

SEQ ID NO: 249997 - DNA, 25 bp, Homo sapien
gggatcacagatgtggactggctta

SEQ ID NO: 249998 - DNA, 25 bp, Homo sapien
gactggcttaggtagaatggtccct

SEQ ID NO: 249999 - DNA, 25 bp, Homo sapien
ttaggtagaatggtccctgagcaaa

SEQ ID NO: 250000 - DNA, 25 bp, Homo sapien
tcctgaatcatatatttagttactt

SEQ ID NO: 250001 - DNA, 25 bp, Homo sapien
atttagttactttctatagtgattg

SEQ ID NO: 250002 - DNA, 25 bp, Homo sapien
ttctatagtgattgtatggatttaa

SEQ ID NO: 250003 - DNA, 25 bp, Homo sapien
tttcatttttgttagtatacctata

SEQ ID NO: 250004 - DNA, 25 bp, Homo sapien
atacataatcacattgacaaaccaa

SEQ ID NO: 250005 - DNA, 25 bp, Homo sapien
gtttttctgatgaatggcttgattt

SEQ ID NO: 250006 - DNA, 25 bp, Homo sapien
ttttctccttgacatgttttgactg

SEQ ID NO: 250007 - DNA, 25 bp, Homo sapien
ctccttgacatgttttgactgttca

SEQ ID NO: 250008 - DNA, 25 bp, Homo sapien
gacatgttttgactgttcattctaa

SEQ ID NO: 250009 - DNA, 25 bp, Homo sapien
tgttttgactgttcattctaactga

SEQ ID NO: 250010 - DNA, 25 bp, Homo sapien
gactgttcattctaactgaaaacat

SEQ ID NO: 250011 - DNA, 25 bp, Homo sapien
cccgccccgaagtctgaaagttatg

SEQ ID NO: 250012 - DNA, 25 bp, Homo sapien
aaagttatgccctggagacctgcga

SEQ ID NO: 250013 - DNA, 25 bp, Homo sapien
tggagacctgcgagctgcggagtgc

SEQ ID NO: 250014 - DNA, 25 bp, Homo sapien
aggaggcctccagaataactcccgg

SEQ ID NO: 250015 - DNA, 25 bp, Homo sapien
ataactcccggagtcggaacagcgc

SEQ ID NO: 250016 - DNA, 25 bp, Homo sapien
gtcggaacagcgctgggctgctgaa

SEQ ID NO: 250017 - DNA, 25 bp, Homo sapien
gaagtttgcagcctccggatccgcg

SEQ ID NO: 250018 - DNA, 25 bp, Homo sapien
tcctggcttcaaattcaacccaatc

SEQ ID NO: 250019 - DNA, 25 bp, Homo sapien
aacccaatcagctctgccgatggtt

SEQ ID NO: 250020 - DNA, 25 bp, Homo sapien
tcagctctgccgatggtttgaaact

SEQ ID NO: 250021 - DNA, 25 bp, Homo sapien
tggtttgaaactgcacacgccgacc

SEQ ID NO: 250022 - DNA, 25 bp, Homo sapien
gaggtatatgggtacttccatcgca

SEQ ID NO: 250023 - DNA, 25 bp, Homo sapien
gtacttccatcgcaaaatggctcca

SEQ ID NO: 250024 - DNA, 25 bp, Homo sapien
aaatggctccatcggcacttacact

SEQ ID NO: 250025 - DNA, 25 bp, Homo sapien
atttcctggacttatgcggatgcgt

SEQ ID NO: 250026 - DNA, 25 bp, Homo sapien
cggatgcgtgtgatgttgccactgt

SEQ ID NO: 250027 - DNA, 25 bp, Homo sapien
gtgagtcacttcaccctcattataa

SEQ ID NO: 250028 - DNA, 25 bp, Homo sapien
tcaccctcattataatcccaaactt

SEQ ID NO: 250029 - DNA, 25 bp, Homo sapien
aatcccaaactttgaccagatggtc

SEQ ID NO: 250030 - DNA, 25 bp, Homo sapien
aaacacgtatatggcattgctgcaa

SEQ ID NO: 250031 - DNA, 25 bp, Homo sapien
gatcattttcaacatggtccccatg

SEQ ID NO: 250032 - DNA, 25 bp, Homo sapien
cagagacatctcatcagcttcagga

SEQ ID NO: 250033 - DNA, 25 bp, Homo sapien
ctcggtcataccaaaggcctgagtc

SEQ ID NO: 250034 - DNA, 25 bp, Homo sapien
tcggtcataccaaaggcctgagtca

SEQ ID NO: 250035 - DNA, 25 bp, Homo sapien
gtatctcttctggaaaccctcagtc

SEQ ID NO: 250036 - DNA, 25 bp, Homo sapien
tatctcttctggaaaccctcagtcc

SEQ ID NO: 250037 - DNA, 25 bp, Homo sapien
cttctggaaaccctcagtccatata

SEQ ID NO: 250038 - DNA, 25 bp, Homo sapien
tctggaaaccctcagtccatataag

SEQ ID NO: 250039 - DNA, 25 bp, Homo sapien
tggaaaccctcagtccatataagcg

SEQ ID NO: 250040 - DNA, 25 bp, Homo sapien
aaaccctcagtccatataagcgaca

SEQ ID NO: 250041 - DNA, 25 bp, Homo sapien
tcagtccatataagcgacacggctg

SEQ ID NO: 250042 - DNA, 25 bp, Homo sapien
tccatataagcgacacggctgagta

SEQ ID NO: 250043 - DNA, 25 bp, Homo sapien
ctgtggtgctctctggggctgggag

SEQ ID NO: 250044 - DNA, 25 bp, Homo sapien
atgagtacattcttattaagtgatg

SEQ ID NO: 250045 - DNA, 25 bp, Homo sapien
ttttttcaagcagcttcattttatt

SEQ ID NO: 250046 - DNA, 25 bp, Homo sapien
atacatactcatttgttgtaaacag

SEQ ID NO: 250047 - DNA, 25 bp, Homo sapien
tctgaatgtactcaaaactcccaac

SEQ ID NO: 250048 - DNA, 25 bp, Homo sapien
gtactcaaaactcccaacaacaatt

SEQ ID NO: 250049 - DNA, 25 bp, Homo sapien
aaactcccaacaacaattgaacagg

SEQ ID NO: 250050 - DNA, 25 bp, Homo sapien
gaacaggatgtttgctaatagaaaa

SEQ ID NO: 250051 - DNA, 25 bp, Homo sapien
caggaatatgtgtatatggcatgaa

SEQ ID NO: 250052 - DNA, 25 bp, Homo sapien
agtcattgactttaagcttcttatc

SEQ ID NO: 250053 - DNA, 25 bp, Homo sapien
tttaagcttcttatccatacaagga

SEQ ID NO: 250054 - DNA, 25 bp, Homo sapien
gcttcttatccatacaaggaactaa

SEQ ID NO: 250055 - DNA, 25 bp, Homo sapien
tctcatttccagatgatctccagtg

SEQ ID NO: 250056 - DNA, 25 bp, Homo sapien
tggacctcaaaatcctgcctaatga

SEQ ID NO: 250057 - DNA, 25 bp, Homo sapien
aatcctgcctaatgatgagtgcaaa

SEQ ID NO: 250058 - DNA, 25 bp, Homo sapien
gagtgcaaaaaagcccacgtccaga

SEQ ID NO: 250059 - DNA, 25 bp, Homo sapien
aaaagcccacgtccagaaggtgaca

SEQ ID NO: 250060 - DNA, 25 bp, Homo sapien
aggtgacagacttcatgctgtgtgt

SEQ ID NO: 250061 - DNA, 25 bp, Homo sapien
agacttcatgctgtgtgtcggacac

SEQ ID NO: 250062 - DNA, 25 bp, Homo sapien
catgctgtgtgtcggacacctggaa

SEQ ID NO: 250063 - DNA, 25 bp, Homo sapien
tgtcggacacctggaaggtggcaaa

SEQ ID NO: 250064 - DNA, 25 bp, Homo sapien
taagccttctgtcgccgtcagagtg

SEQ ID NO: 250065 - DNA, 25 bp, Homo sapien
gccgtcagagtgctgtcttatgtga

SEQ ID NO: 250066 - DNA, 25 bp, Homo sapien
tgatggtgctttatgcagcttccac

SEQ ID NO: 250067 - DNA, 25 bp, Homo sapien
tatgcagcttccaccatttacaaga

SEQ ID NO: 250068 - DNA, 25 bp, Homo sapien
gattttcctgtggtgtggaacctct

SEQ ID NO: 250069 - DNA, 25 bp, Homo sapien
gtgtggaacctctcatgataaagca

SEQ ID NO: 250070 - DNA, 25 bp, Homo sapien
gaactagaagcttattccagtcaag

SEQ ID NO: 250071 - DNA, 25 bp, Homo sapien
ttctgatttatcttgtggtaagcat

SEQ ID NO: 250072 - DNA, 25 bp, Homo sapien
gaaggacatatctgcacatgacctg

SEQ ID NO: 250073 - DNA, 25 bp, Homo sapien
gcacatgacctgagactaagtacta

SEQ ID NO: 250074 - DNA, 25 bp, Homo sapien
gaaaattgctcttaggaagcttaca

SEQ ID NO: 250075 - DNA, 25 bp, Homo sapien
tagattctcggtgctgctaaacagg

SEQ ID NO: 250076 - DNA, 25 bp, Homo sapien
taaacaggacacacaaggacaccat

SEQ ID NO: 250077 - DNA, 25 bp, Homo sapien
gactcaggcctttggtatgaccgag

SEQ ID NO: 250078 - DNA, 25 bp, Homo sapien
cagagagcaccacagcacagaagta

SEQ ID NO: 250079 - DNA, 25 bp, Homo sapien
tactcagccgtgtcgcttatatgga

SEQ ID NO: 250080 - DNA, 25 bp, Homo sapien
cagccgtgtcgcttatatggactga

SEQ ID NO: 250081 - DNA, 25 bp, Homo sapien
tcgcttatatggactgagggtttcc

SEQ ID NO: 250082 - DNA, 25 bp, Homo sapien
gactgagggtttccagaagagatac

SEQ ID NO: 250083 - DNA, 25 bp, Homo sapien
cctgcattggtgttacacagtcttt

SEQ ID NO: 250084 - DNA, 25 bp, Homo sapien
ggtgttacacagtctttagtgctat

SEQ ID NO: 250085 - DNA, 25 bp, Homo sapien
ttacacagtctttagtgctattgca

SEQ ID NO: 250086 - DNA, 25 bp, Homo sapien
tgctattgcaataaccttgactcag

SEQ ID NO: 250087 - DNA, 25 bp, Homo sapien
ataaccttgactcaggcctttggta

SEQ ID NO: 250088 - DNA, 25 bp, Homo sapien
atatttacttcatgtccacatcatg

SEQ ID NO: 250089 - DNA, 25 bp, Homo sapien
ttacttcatgtccacatcatgaaaa

SEQ ID NO: 250090 - DNA, 25 bp, Homo sapien
aattaccatgtatcaaatgggtgac

SEQ ID NO: 250091 - DNA, 25 bp, Homo sapien
taccatgtatcaaatgggtgacgaa

SEQ ID NO: 250092 - DNA, 25 bp, Homo sapien
catgtatcaaatgggtgacgaatta

SEQ ID NO: 250093 - DNA, 25 bp, Homo sapien
atcaaatgggtgacgaattaatact

SEQ ID NO: 250094 - DNA, 25 bp, Homo sapien
caaatgggtgacgaattaatactag

SEQ ID NO: 250095 - DNA, 25 bp, Homo sapien
aatgggtgacgaattaatactagat

SEQ ID NO: 250096 - DNA, 25 bp, Homo sapien
tgggtgacgaattaatactagatat

SEQ ID NO: 250097 - DNA, 25 bp, Homo sapien
ggtgacgaattaatactagatatat

SEQ ID NO: 250098 - DNA, 25 bp, Homo sapien
gacgaattaatactagatatatcta

SEQ ID NO: 250099 - DNA, 25 bp, Homo sapien
tgagccaccccgaggtccagagacg

SEQ ID NO: 250100 - DNA, 25 bp, Homo sapien
gagccaccccgaggtccagagacga

SEQ ID NO: 250101 - DNA, 25 bp, Homo sapien
agccaccccgaggtccagagacgac

SEQ ID NO: 250102 - DNA, 25 bp, Homo sapien
gccaccccgaggtccagagacgact

SEQ ID NO: 250103 - DNA, 25 bp, Homo sapien
ccaccccgaggtccagagacgactg

SEQ ID NO: 250104 - DNA, 25 bp, Homo sapien
caccccgaggtccagagacgactgg

SEQ ID NO: 250105 - DNA, 25 bp, Homo sapien
accccgaggtccagagacgactgga

SEQ ID NO: 250106 - DNA, 25 bp, Homo sapien
ccccgaggtccagagacgactggac

SEQ ID NO: 250107 - DNA, 25 bp, Homo sapien
ccccagcctacgcatgggatttcaa

SEQ ID NO: 250108 - DNA, 25 bp, Homo sapien
cccagcctacgcatgggatttcaag

SEQ ID NO: 250109 - DNA, 25 bp, Homo sapien
ccagcctacgcatgggatttcaaga

SEQ ID NO: 250110 - DNA, 25 bp, Homo sapien
gaggaaccccaccaggccaatgtct

SEQ ID NO: 250111 - DNA, 25 bp, Homo sapien
aatgtctaggcctagggcacaaact

SEQ ID NO: 250112 - DNA, 25 bp, Homo sapien
tgcagggtgtctcccacaagtcatt

SEQ ID NO: 250113 - DNA, 25 bp, Homo sapien
gcacaaactagggtctccatggcat

SEQ ID NO: 250114 - DNA, 25 bp, Homo sapien
tctccatggcatctggtggtggaat

SEQ ID NO: 250115 - DNA, 25 bp, Homo sapien
tggaataggcacttggagctcccaa

SEQ ID NO: 250116 - DNA, 25 bp, Homo sapien
ttggagctcccaatgcctgaggagt

SEQ ID NO: 250117 - DNA, 25 bp, Homo sapien
tcccacaagtcatttctctcagaag

SEQ ID NO: 250118 - DNA, 25 bp, Homo sapien
ttacctagggacactggacacatat

SEQ ID NO: 250119 - DNA, 25 bp, Homo sapien
ggacacatatgtgcccatgatgatg

SEQ ID NO: 250120 - DNA, 25 bp, Homo sapien
gatgaggacgatacccacgaggaac

SEQ ID NO: 250121 - DNA, 25 bp, Homo sapien
aagtaagaccttcctaatgtctaat

SEQ ID NO: 250122 - DNA, 25 bp, Homo sapien
aagaccttcctaatgtctaatacaa

SEQ ID NO: 250123 - DNA, 25 bp, Homo sapien
gtctaatacaaactgggctccagca

SEQ ID NO: 250124 - DNA, 25 bp, Homo sapien
ctaatacaaactgggctccagcaag

SEQ ID NO: 250125 - DNA, 25 bp, Homo sapien
aaatgtatagtagagtggtgtctgt

SEQ ID NO: 250126 - DNA, 25 bp, Homo sapien
gagtggtgtctgtataagtgttacc

SEQ ID NO: 250127 - DNA, 25 bp, Homo sapien
gtgtctgtataagtgttacctgtag

SEQ ID NO: 250128 - DNA, 25 bp, Homo sapien
gggttttgtccagcaagcctgaaat

SEQ ID NO: 250129 - DNA, 25 bp, Homo sapien
gttttgtccagcaagcctgaaattt

SEQ ID NO: 250130 - DNA, 25 bp, Homo sapien
tttgtccagcaagcctgaaatttat

SEQ ID NO: 250131 - DNA, 25 bp, Homo sapien
gtccagcaagcctgaaatttatact

SEQ ID NO: 250132 - DNA, 25 bp, Homo sapien
gcttaagaacattcatgccagcttt

SEQ ID NO: 250133 - DNA, 25 bp, Homo sapien
ttcatgccagctttgtttatataac

SEQ ID NO: 250134 - DNA, 25 bp, Homo sapien
ggacaataatttggcatcctctagt

SEQ ID NO: 250135 - DNA, 25 bp, Homo sapien
aataacccaaatgtctgaggatggg

SEQ ID NO: 250136 - DNA, 25 bp, Homo sapien
aatgaatacacaacagctacaagca

SEQ ID NO: 250137 - DNA, 25 bp, Homo sapien
aacagctacaagcatctactggaat

SEQ ID NO: 250138 - DNA, 25 bp, Homo sapien
gcatctactggaatgaatctcacat

SEQ ID NO: 250139 - DNA, 25 bp, Homo sapien
tttggcatcctctagtgaagttgaa

SEQ ID NO: 250140 - DNA, 25 bp, Homo sapien
aatctcacatgcattgtgttgtaga

SEQ ID NO: 250141 - DNA, 25 bp, Homo sapien
tgtgtgtgcttgagactcagcaatt

SEQ ID NO: 250142 - DNA, 25 bp, Homo sapien
gactcagcaattcccctttgtgaca

SEQ ID NO: 250143 - DNA, 25 bp, Homo sapien
aaatcagagcacaagaagtaccagt

SEQ ID NO: 250144 - DNA, 25 bp, Homo sapien
tcagagcacaagaagtaccagtcca

SEQ ID NO: 250145 - DNA, 25 bp, Homo sapien
gagcacaagaagtaccagtccacca

SEQ ID NO: 250146 - DNA, 25 bp, Homo sapien
agcacaagaagtaccagtccaccaa

SEQ ID NO: 250147 - DNA, 25 bp, Homo sapien
gcacaagaagtaccagtccaccaac

SEQ ID NO: 250148 - DNA, 25 bp, Homo sapien
acaagaagtaccagtccaccaactc

SEQ ID NO: 250149 - DNA, 25 bp, Homo sapien
aagaagtaccagtccaccaactcac

SEQ ID NO: 250150 - DNA, 25 bp, Homo sapien
gaagtaccagtccaccaactcacat

SEQ ID NO: 250151 - DNA, 25 bp, Homo sapien
gtaccagtccaccaactcacatttt

SEQ ID NO: 250152 - DNA, 25 bp, Homo sapien
cagtccaccaactcacattttctat

SEQ ID NO: 250153 - DNA, 25 bp, Homo sapien
aaaagaagttccatattcgacagca

SEQ ID NO: 250154 - DNA, 25 bp, Homo sapien
gagatgcgtgggaccatagagccaa

SEQ ID NO: 250155 - DNA, 25 bp, Homo sapien
ggaccatagagccaaggatgataat

SEQ ID NO: 250156 - DNA, 25 bp, Homo sapien
gatgataattccgtgacttgccctt

SEQ ID NO: 250157 - DNA, 25 bp, Homo sapien
gataattccgtgacttgcccttgcc

SEQ ID NO: 250158 - DNA, 25 bp, Homo sapien
caaggcattcctggcgacgacactg

SEQ ID NO: 250159 - DNA, 25 bp, Homo sapien
tgaatgggatcaggctgcactgcgc

SEQ ID NO: 250160 - DNA, 25 bp, Homo sapien
cgtcctaggcaatacgcacgtggta

SEQ ID NO: 250161 - DNA, 25 bp, Homo sapien
atacgcacgtggtagagtcccagtc

SEQ ID NO: 250162 - DNA, 25 bp, Homo sapien
cacgtggtagagtcccagtctggaa

SEQ ID NO: 250163 - DNA, 25 bp, Homo sapien
tggtagagtcccagtctggaagctg

SEQ ID NO: 250164 - DNA, 25 bp, Homo sapien
gctttctcgcttcgcgtggaggcac

SEQ ID NO: 250165 - DNA, 25 bp, Homo sapien
aatctttattgggagaagccgtcaa

SEQ ID NO: 250166 - DNA, 25 bp, Homo sapien
gaagccgtcaaggacagttctgtga

SEQ ID NO: 250167 - DNA, 25 bp, Homo sapien
gaaaggatctctggatcaccacaaa

SEQ ID NO: 250168 - DNA, 25 bp, Homo sapien
ctggatcaccacaaagtctggctca

SEQ ID NO: 250169 - DNA, 25 bp, Homo sapien
ggctttgcaaacactaaacattcct

SEQ ID NO: 250170 - DNA, 25 bp, Homo sapien
taaacattcctgtctcaagtcctgt

SEQ ID NO: 250171 - DNA, 25 bp, Homo sapien
ctgtctcaagtcctgtagatggctt

SEQ ID NO: 250172 - DNA, 25 bp, Homo sapien
agtcctgtagatggcttgaaatagt

SEQ ID NO: 250173 - DNA, 25 bp, Homo sapien
aagcatgccttataaacatcttcag

SEQ ID NO: 250174 - DNA, 25 bp, Homo sapien
ttcagtctttatcaactctttggag

SEQ ID NO: 250175 - DNA, 25 bp, Homo sapien
ggccgatggcagaagaaattttgtc

SEQ ID NO: 250176 - DNA, 25 bp, Homo sapien
taagagggaagctttaggctacaac

SEQ ID NO: 250177 - DNA, 25 bp, Homo sapien
gagggaagctttaggctacaactaa

SEQ ID NO: 250178 - DNA, 25 bp, Homo sapien
gaagctttaggctacaactaattta

SEQ ID NO: 250179 - DNA, 25 bp, Homo sapien
ggctacaactaatttaacaatttct

SEQ ID NO: 250180 - DNA, 25 bp, Homo sapien
cattaatatcactttgtcaccatca

SEQ ID NO: 250181 - DNA, 25 bp, Homo sapien
aatatcactttgtcaccatcaaaaa

SEQ ID NO: 250182 - DNA, 25 bp, Homo sapien
aatgtacttatttagactcgaatct

SEQ ID NO: 250183 - DNA, 25 bp, Homo sapien
ttatttagactcgaatctcactgtg

SEQ ID NO: 250184 - DNA, 25 bp, Homo sapien
atttagactcgaatctcactgtgaa

SEQ ID NO: 250185 - DNA, 25 bp, Homo sapien
tagactcgaatctcactgtgaaaca

SEQ ID NO: 250186 - DNA, 25 bp, Homo sapien
cagcagaactgtgggtttgtaaagt

SEQ ID NO: 250187 - DNA, 25 bp, Homo sapien
gggaaaagcaatttaatgtaccacg

SEQ ID NO: 250188 - DNA, 25 bp, Homo sapien
gaaaagcaatttaatgtaccacgat

SEQ ID NO: 250189 - DNA, 25 bp, Homo sapien
aaagcaatttaatgtaccacgatga

SEQ ID NO: 250190 - DNA, 25 bp, Homo sapien
agcaatttaatgtaccacgatgaat

SEQ ID NO: 250191 - DNA, 25 bp, Homo sapien
atttaatgtaccacgatgaatagct

SEQ ID NO: 250192 - DNA, 25 bp, Homo sapien
taatgtaccacgatgaatagctaac

SEQ ID NO: 250193 - DNA, 25 bp, Homo sapien
atgtaccacgatgaatagctaactg

SEQ ID NO: 250194 - DNA, 25 bp, Homo sapien
gtaccacgatgaatagctaactgtt

SEQ ID NO: 250195 - DNA, 25 bp, Homo sapien
cacgatgaatagctaactgttccca

SEQ ID NO: 250196 - DNA, 25 bp, Homo sapien
cgatgaatagctaactgttcccaag

SEQ ID NO: 250197 - DNA, 25 bp, Homo sapien
gaatagctaactgttcccaagtgtt

SEQ ID NO: 250198 - DNA, 25 bp, Homo sapien
ggcccttgactagatggatgcagta

SEQ ID NO: 250199 - DNA, 25 bp, Homo sapien
atggatgcagtatctccgagaggga

SEQ ID NO: 250200 - DNA, 25 bp, Homo sapien
acggtgtgtgtggattgtcagcctc

SEQ ID NO: 250201 - DNA, 25 bp, Homo sapien
ggattgtcagcctccagctatgaac

SEQ ID NO: 250202 - DNA, 25 bp, Homo sapien
agctatgaactctgtgagccttcgt

SEQ ID NO: 250203 - DNA, 25 bp, Homo sapien
tgtgagccttcgttgttctggagat

SEQ ID NO: 250204 - DNA, 25 bp, Homo sapien
gagatggcctggactccgatggaaa

SEQ ID NO: 250205 - DNA, 25 bp, Homo sapien
gaaatcagactctccattggcaagc

SEQ ID NO: 250206 - DNA, 25 bp, Homo sapien
agcaattggtaatcctcggtgtcaa

SEQ ID NO: 250207 - DNA, 25 bp, Homo sapien
gttcggcgagtagaccagtgttctt

SEQ ID NO: 250208 - DNA, 25 bp, Homo sapien
agtgttcttgtccagctgttcacag

SEQ ID NO: 250209 - DNA, 25 bp, Homo sapien
gaagaggctcgtacattgacatcgg

SEQ ID NO: 250210 - DNA, 25 bp, Homo sapien
gctcgtacattgacatcggcgatgt

SEQ ID NO: 250211 - DNA, 25 bp, Homo sapien
gacatcggcgatgtaaatgaattcg

SEQ ID NO: 250212 - DNA, 25 bp, Homo sapien
aatgaattcggaaagtcaaggctgt

SEQ ID NO: 250213 - DNA, 25 bp, Homo sapien
aaagtcaaggctgtgtggttgcagt

SEQ ID NO: 250214 - DNA, 25 bp, Homo sapien
gaagatgtgccttcatgccacattc

SEQ ID NO: 250215 - DNA, 25 bp, Homo sapien
gtgccttcatgccacattcagcagt

SEQ ID NO: 250216 - DNA, 25 bp, Homo sapien
agggctctccagaagtacctgcgca

SEQ ID NO: 250217 - DNA, 25 bp, Homo sapien
gaagtacctgcgcatcacccggcag

SEQ ID NO: 250218 - DNA, 25 bp, Homo sapien
cggcagcagaactaccacagcatgg

SEQ ID NO: 250219 - DNA, 25 bp, Homo sapien
gccttctgcatcaccaacggcatga

SEQ ID NO: 250220 - DNA, 25 bp, Homo sapien
ttttcaggacaaagtatcaacaagg

SEQ ID NO: 250221 - DNA, 25 bp, Homo sapien
cccattgtgtacattgcggaacact

SEQ ID NO: 250222 - DNA, 25 bp, Homo sapien
caaaattagcgtgagattgggaaat

SEQ ID NO: 250223 - DNA, 25 bp, Homo sapien
ggaaatatctaatttccatccagcc

SEQ ID NO: 250224 - DNA, 25 bp, Homo sapien
tccatccagccacagtggagagtcc

SEQ ID NO: 250225 - DNA, 25 bp, Homo sapien
ccacagtggagagtcctgactgaaa

SEQ ID NO: 250226 - DNA, 25 bp, Homo sapien
ctgactgaaaaccaggcattcgcta

SEQ ID NO: 250227 - DNA, 25 bp, Homo sapien
accaggcattcgctaaagatcccag

SEQ ID NO: 250228 - DNA, 25 bp, Homo sapien
ggcattcgctaaagatcccagaaag

SEQ ID NO: 250229 - DNA, 25 bp, Homo sapien
ggagttgatactgagatagcttgaa

SEQ ID NO: 250230 - DNA, 25 bp, Homo sapien
tgagatagcttgaattttcaggaca

SEQ ID NO: 250231 - DNA, 25 bp, Homo sapien
agagatgagtcaaccactggccctg

SEQ ID NO: 250232 - DNA, 25 bp, Homo sapien
gagtcaaccactggccctgcaagat

SEQ ID NO: 250233 - DNA, 25 bp, Homo sapien
gacagtagcttatcactttcaattt

SEQ ID NO: 250234 - DNA, 25 bp, Homo sapien
ggaatggagaacagcctttccaaac

SEQ ID NO: 250235 - DNA, 25 bp, Homo sapien
cagcctttccaaacataacctgtga

SEQ ID NO: 250236 - DNA, 25 bp, Homo sapien
taacctgtgagaggagtttctgtaa

SEQ ID NO: 250237 - DNA, 25 bp, Homo sapien
tgtatccgagaagcctttcctatca

SEQ ID NO: 250238 - DNA, 25 bp, Homo sapien
atcaccttagtatgatagttctctg

SEQ ID NO: 250239 - DNA, 25 bp, Homo sapien
gagagctgtgaggaaatctttcttt

SEQ ID NO: 250240 - DNA, 25 bp, Homo sapien
ctttcttttaaagtggcggtcatct

SEQ ID NO: 250241 - DNA, 25 bp, Homo sapien
aagtggcggtcatctttgaaaccaa

SEQ ID NO: 250242 - DNA, 25 bp, Homo sapien
tgtcaatttttctaggttggcaagg

SEQ ID NO: 250243 - DNA, 25 bp, Homo sapien
atttttctaggttggcaaggaggca

SEQ ID NO: 250244 - DNA, 25 bp, Homo sapien
ggaggcagaaaaccttcattgtttc

SEQ ID NO: 250245 - DNA, 25 bp, Homo sapien
ggcagaaaaccttcattgtttcata

SEQ ID NO: 250246 - DNA, 25 bp, Homo sapien
gaatttccaaaatcattatctattt

SEQ ID NO: 250247 - DNA, 25 bp, Homo sapien
agtcccttgttcaatttaacttatg

SEQ ID NO: 250248 - DNA, 25 bp, Homo sapien
tttaacttatgttcctaagagaggt

SEQ ID NO: 250249 - DNA, 25 bp, Homo sapien
gtttcagtgtgattcagtcctcaga

SEQ ID NO: 250250 - DNA, 25 bp, Homo sapien
gtgtgattcagtcctcagacctaat

SEQ ID NO: 250251 - DNA, 25 bp, Homo sapien
ttcagtcctcagacctaattgggtt

SEQ ID NO: 250252 - DNA, 25 bp, Homo sapien
gtcctcagacctaattgggttgaat

SEQ ID NO: 250253 - DNA, 25 bp, Homo sapien
aatttcttccaacacaatcttcctg

SEQ ID NO: 250254 - DNA, 25 bp, Homo sapien
aatcttcctgctcgcagtggagcac

SEQ ID NO: 250255 - DNA, 25 bp, Homo sapien
ggagcactggatgggccacgcttaa

SEQ ID NO: 250256 - DNA, 25 bp, Homo sapien
gggccacgcttaaatattagtatga

SEQ ID NO: 250257 - DNA, 25 bp, Homo sapien
ttagtatgaactgaccaaactcttc

SEQ ID NO: 250258 - DNA, 25 bp, Homo sapien
tgaccaaactcttcacaaatgccct

SEQ ID NO: 250259 - DNA, 25 bp, Homo sapien
acaaatgcccttctagtgtctagga

SEQ ID NO: 250260 - DNA, 25 bp, Homo sapien
tctaggatggtgtctgccagccaca

SEQ ID NO: 250261 - DNA, 25 bp, Homo sapien
cagggccactgctgactcaaagtga

SEQ ID NO: 250262 - DNA, 25 bp, Homo sapien
gctgactcaaagtgacctaaactta

SEQ ID NO: 250263 - DNA, 25 bp, Homo sapien
catatcccacaacctttagttcgat

SEQ ID NO: 250264 - DNA, 25 bp, Homo sapien
gaaaagatggtggtattcatttata

SEQ ID NO: 250265 - DNA, 25 bp, Homo sapien
agatggtggtattcatttataatca

SEQ ID NO: 250266 - DNA, 25 bp, Homo sapien
taaaacaaaatcatggccaggcctg

SEQ ID NO: 250267 - DNA, 25 bp, Homo sapien
aaaacaaaatcatggccaggcctgt

SEQ ID NO: 250268 - DNA, 25 bp, Homo sapien
aaacaaaatcatggccaggcctgtg

SEQ ID NO: 250269 - DNA, 25 bp, Homo sapien
ggaaaattgataacttgcttttggc

SEQ ID NO: 250270 - DNA, 25 bp, Homo sapien
aaattgataacttgcttttggctat

SEQ ID NO: 250271 - DNA, 25 bp, Homo sapien
aattgataacttgcttttggctatg

SEQ ID NO: 250272 - DNA, 25 bp, Homo sapien
attgataacttgcttttggctatgt

SEQ ID NO: 250273 - DNA, 25 bp, Homo sapien
ttgataacttgcttttggctatgtt

SEQ ID NO: 250274 - DNA, 25 bp, Homo sapien
gataacttgcttttggctatgttaa

SEQ ID NO: 250275 - DNA, 25 bp, Homo sapien
aaattgcatctgcttaccctggccc

SEQ ID NO: 250276 - DNA, 25 bp, Homo sapien
cctggccccctcaaaatggaagagt

SEQ ID NO: 250277 - DNA, 25 bp, Homo sapien
agtgatgactatttgtcttcgtaac

SEQ ID NO: 250278 - DNA, 25 bp, Homo sapien
ctatttgtcttcgtaacactgtggg

SEQ ID NO: 250279 - DNA, 25 bp, Homo sapien
gagccttaaatggaagagtgtcaaa

SEQ ID NO: 250280 - DNA, 25 bp, Homo sapien
ggctgtcacttccaattttcaagcg

SEQ ID NO: 250281 - DNA, 25 bp, Homo sapien
gatgtatgaaacactgttggccaaa

SEQ ID NO: 250282 - DNA, 25 bp, Homo sapien
tgttggccaaagtgcacaattagta

SEQ ID NO: 250283 - DNA, 25 bp, Homo sapien
ggccaaagtgcacaattagtaatac

SEQ ID NO: 250284 - DNA, 25 bp, Homo sapien
gattctgtttccaaggtactttgta

SEQ ID NO: 250285 - DNA, 25 bp, Homo sapien
gtattctcaaattgcatctgcttac

SEQ ID NO: 250286 - DNA, 25 bp, Homo sapien
tatattgccataagactcgactaaa

SEQ ID NO: 250287 - DNA, 25 bp, Homo sapien
aggaatcacgtcagagacacctgga

SEQ ID NO: 250288 - DNA, 25 bp, Homo sapien
gagacacctggagaattttcgcatt

SEQ ID NO: 250289 - DNA, 25 bp, Homo sapien
aagccacatggaaatgctacaaagc

SEQ ID NO: 250290 - DNA, 25 bp, Homo sapien
tttcgcattcgagccaagcatctgg

SEQ ID NO: 250291 - DNA, 25 bp, Homo sapien
atctggcagccaactggaatcgcat

SEQ ID NO: 250292 - DNA, 25 bp, Homo sapien
ggaatcgcatcaggacctccaggag

SEQ ID NO: 250293 - DNA, 25 bp, Homo sapien
aattcttcctcttttatcgccagca

SEQ ID NO: 250294 - DNA, 25 bp, Homo sapien
ttttatcgccagcagaagtgggcat

SEQ ID NO: 250295 - DNA, 25 bp, Homo sapien
gcatcaggtgtgattgccattgctt

SEQ ID NO: 250296 - DNA, 25 bp, Homo sapien
gccattgcttggctgttatattgcc

SEQ ID NO: 250297 - DNA, 25 bp, Homo sapien
tgaaatcttgtaaaccatgccttcc

SEQ ID NO: 250298 - DNA, 25 bp, Homo sapien
atatggcaccataaaaaagtcatgt

SEQ ID NO: 250299 - DNA, 25 bp, Homo sapien
agagcatatgcttttttagaaccag

SEQ ID NO: 250300 - DNA, 25 bp, Homo sapien
catatgcttttttagaaccaggtta

SEQ ID NO: 250301 - DNA, 25 bp, Homo sapien
aaagctgtttgttatctaatagagt

SEQ ID NO: 250302 - DNA, 25 bp, Homo sapien
gtaaaagttactgaggtcaacagat

SEQ ID NO: 250303 - DNA, 25 bp, Homo sapien
gtcaacagatagacaggtctggcat

SEQ ID NO: 250304 - DNA, 25 bp, Homo sapien
acaggtctggcataatatatgccca

SEQ ID NO: 250305 - DNA, 25 bp, Homo sapien
atgcccagtcataatagtctaatta

SEQ ID NO: 250306 - DNA, 25 bp, Homo sapien
cagaggttaattgaattcctgggtt

SEQ ID NO: 250307 - DNA, 25 bp, Homo sapien
gttttccaaaattagctgaaatctt

SEQ ID NO: 250308 - DNA, 25 bp, Homo sapien
gctgccgcgaatcgcgccacttaca

SEQ ID NO: 250309 - DNA, 25 bp, Homo sapien
gccggcttccgttcgcggactttgg

SEQ ID NO: 250310 - DNA, 25 bp, Homo sapien
ttccgttcgcggactttggcccagg

SEQ ID NO: 250311 - DNA, 25 bp, Homo sapien
ttcgcggactttggcccaggcgcgt

SEQ ID NO: 250312 - DNA, 25 bp, Homo sapien
ggcgctgccgagaggctgggagccc

SEQ ID NO: 250313 - DNA, 25 bp, Homo sapien
gaaccggttcctggacttgagcgga

SEQ ID NO: 250314 - DNA, 25 bp, Homo sapien
aaccggttcctggacttgagcggag

SEQ ID NO: 250315 - DNA, 25 bp, Homo sapien
gccgcctgcacgactggactggagc

SEQ ID NO: 250316 - DNA, 25 bp, Homo sapien
gactggactggagcggccgggtgcc

SEQ ID NO: 250317 - DNA, 25 bp, Homo sapien
gaattgcagtccttgcgcaggtgga

SEQ ID NO: 250318 - DNA, 25 bp, Homo sapien
attgcagtccttgcgcaggtggaga

SEQ ID NO: 250319 - DNA, 25 bp, Homo sapien
gttgagaaaggcgagacacgttttt

SEQ ID NO: 250320 - DNA, 25 bp, Homo sapien
gcgagacacgtttttgtcttcccta

SEQ ID NO: 250321 - DNA, 25 bp, Homo sapien
acgtttttgtcttccctacaggatg

SEQ ID NO: 250322 - DNA, 25 bp, Homo sapien
gtcttccctacaggatggatgtgga

SEQ ID NO: 250323 - DNA, 25 bp, Homo sapien
caagattgaagacacaggaggcagt

SEQ ID NO: 250324 - DNA, 25 bp, Homo sapien
cagtggcggctcctattccatcaaa

SEQ ID NO: 250325 - DNA, 25 bp, Homo sapien
atcaaaacccagtttaactctgagg

SEQ ID NO: 250326 - DNA, 25 bp, Homo sapien
tttaactctgaggagcagtggacaa

SEQ ID NO: 250327 - DNA, 25 bp, Homo sapien
gttcatgctgacgaatcttaagtgg

SEQ ID NO: 250328 - DNA, 25 bp, Homo sapien
ttgcttgggtgtcctcacaatttta

SEQ ID NO: 250329 - DNA, 25 bp, Homo sapien
gggtgtcctcacaattttataacaa

SEQ ID NO: 250330 - DNA, 25 bp, Homo sapien
tgctggactcacctggaatctctcc

SEQ ID NO: 250331 - DNA, 25 bp, Homo sapien
atcactatcattgagacctgcacat

SEQ ID NO: 250332 - DNA, 25 bp, Homo sapien
gagacctgcacatcttaatagaaat

SEQ ID NO: 250333 - DNA, 25 bp, Homo sapien
atgacttacctagaagttcgcttgt

SEQ ID NO: 250334 - DNA, 25 bp, Homo sapien
gaagttcgcttgtaactaatgaaat

SEQ ID NO: 250335 - DNA, 25 bp, Homo sapien
gtcatgtgtttctctcctgtgacat

SEQ ID NO: 250336 - DNA, 25 bp, Homo sapien
gtttctctcctgtgacatttcaaaa

SEQ ID NO: 250337 - DNA, 25 bp, Homo sapien
gtgtttcatcttgaatagctgaact

SEQ ID NO: 250338 - DNA, 25 bp, Homo sapien
gaatagctgaactaattgctttgga

SEQ ID NO: 250339 - DNA, 25 bp, Homo sapien
aattgctttggaaacagagtcctag

SEQ ID NO: 250340 - DNA, 25 bp, Homo sapien
gtgacttcaacagaattgttactaa

SEQ ID NO: 250341 - DNA, 25 bp, Homo sapien
acatcacccaaccacttgtatgtgt

SEQ ID NO: 250342 - DNA, 25 bp, Homo sapien
taatatgcatatatagttaccgtgc

SEQ ID NO: 250343 - DNA, 25 bp, Homo sapien
gttaccgtgctaaaatggttaccag

SEQ ID NO: 250344 - DNA, 25 bp, Homo sapien
aatggttaccagcaggttttgagag

SEQ ID NO: 250345 - DNA, 25 bp, Homo sapien
gagaatgctgcatcagaaaagtgtc

SEQ ID NO: 250346 - DNA, 25 bp, Homo sapien
gaaaagtgtcagttgccacctcatt

SEQ ID NO: 250347 - DNA, 25 bp, Homo sapien
acctcattctccctgatttaggttc

SEQ ID NO: 250348 - DNA, 25 bp, Homo sapien
attctccctgatttaggttcctgac

SEQ ID NO: 250349 - DNA, 25 bp, Homo sapien
ctgatttaggttcctgacactgatt

SEQ ID NO: 250350 - DNA, 25 bp, Homo sapien
tgacactgattcctttctctctcgt

SEQ ID NO: 250351 - DNA, 25 bp, Homo sapien
cccccattgggtgtatcttgtctat

SEQ ID NO: 250352 - DNA, 25 bp, Homo sapien
ctcccacgtctggagggtcccaggt

SEQ ID NO: 250353 - DNA, 25 bp, Homo sapien
tattgttggcactaggtacagcgct

SEQ ID NO: 250354 - DNA, 25 bp, Homo sapien
gttggcactaggtacagcgctgaat

SEQ ID NO: 250355 - DNA, 25 bp, Homo sapien
ggcactaggtacagcgctgaattct

SEQ ID NO: 250356 - DNA, 25 bp, Homo sapien
ggtacagcgctgaattctaccactg

SEQ ID NO: 250357 - DNA, 25 bp, Homo sapien
cagcgctgaattctaccactgtagc

SEQ ID NO: 250358 - DNA, 25 bp, Homo sapien
gcgctgaattctaccactgtagcag

SEQ ID NO: 250359 - DNA, 25 bp, Homo sapien
gaattctaccactgtagcagggaga

SEQ ID NO: 250360 - DNA, 25 bp, Homo sapien
taccactgtagcagggagaaccaat

SEQ ID NO: 250361 - DNA, 25 bp, Homo sapien
agggagaaccaatcagcccacctga

SEQ ID NO: 250362 - DNA, 25 bp, Homo sapien
cacctgaccgtcaaccagtaggcag

SEQ ID NO: 250363 - DNA, 25 bp, Homo sapien
tcttctgtggctgaaactacttctc

SEQ ID NO: 250364 - DNA, 25 bp, Homo sapien
ttctcaggccactgcttcagaagta

SEQ ID NO: 250365 - DNA, 25 bp, Homo sapien
gcttcagaagtacagaccaacagag

SEQ ID NO: 250366 - DNA, 25 bp, Homo sapien
atgctgacagctgccgggagactca

SEQ ID NO: 250367 - DNA, 25 bp, Homo sapien
ggagactcacgccttagtgacagtc

SEQ ID NO: 250368 - DNA, 25 bp, Homo sapien
gccttagtgacagtctccaggagaa

SEQ ID NO: 250369 - DNA, 25 bp, Homo sapien
ggagaagactgtgaggccaccattt

SEQ ID NO: 250370 - DNA, 25 bp, Homo sapien
gaggccaccatttgggccacactga

SEQ ID NO: 250371 - DNA, 25 bp, Homo sapien
gggccacactgagaaattgtttttc

SEQ ID NO: 250372 - DNA, 25 bp, Homo sapien
ggttctataatgcatcttggcagaa

SEQ ID NO: 250373 - DNA, 25 bp, Homo sapien
agacgtgttcgtttcttctgtggct

SEQ ID NO: 250374 - DNA, 25 bp, Homo sapien
agtggttccagtttgatatctacaa

SEQ ID NO: 250375 - DNA, 25 bp, Homo sapien
gatatctacaagaagagcctcacta

SEQ ID NO: 250376 - DNA, 25 bp, Homo sapien
ggcttggcttcctcccgagctactt

SEQ ID NO: 250377 - DNA, 25 bp, Homo sapien
tcccgagctacttctgtggcagtac

SEQ ID NO: 250378 - DNA, 25 bp, Homo sapien
gagctacttctgtggcagtactttt

SEQ ID NO: 250379 - DNA, 25 bp, Homo sapien
tacttctgtggcagtacttttggag

SEQ ID NO: 250380 - DNA, 25 bp, Homo sapien
gagaaagtagaatcgctttcctctg

SEQ ID NO: 250381 - DNA, 25 bp, Homo sapien
gtagaatcgctttcctctggagaaa

SEQ ID NO: 250382 - DNA, 25 bp, Homo sapien
tccctacagccacgtgtgcttctgg

SEQ ID NO: 250383 - DNA, 25 bp, Homo sapien
gtatcgcagaagtcgatgagaggaa

SEQ ID NO: 250384 - DNA, 25 bp, Homo sapien
ctggcttgcagcatctggagtgacc

SEQ ID NO: 250385 - DNA, 25 bp, Homo sapien
tgacacttccgtcaccaataatcgg

SEQ ID NO: 250386 - DNA, 25 bp, Homo sapien
caccaataatcggactgagttacag

SEQ ID NO: 250387 - DNA, 25 bp, Homo sapien
gtgtagagtgtgcatacctgtatac

SEQ ID NO: 250388 - DNA, 25 bp, Homo sapien
acatgtattctgtgtctcacgggcc

SEQ ID NO: 250389 - DNA, 25 bp, Homo sapien
gtctcacgggccacctgctgaatga

SEQ ID NO: 250390 - DNA, 25 bp, Homo sapien
gagaggactccagttgaaaggtcaa

SEQ ID NO: 250391 - DNA, 25 bp, Homo sapien
acaagagctttttgagtgggtcttc

SEQ ID NO: 250392 - DNA, 25 bp, Homo sapien
tgagtgggtcttcaacttagttaaa

SEQ ID NO: 250393 - DNA, 25 bp, Homo sapien
aaataaaggacctgtgttccttgag

SEQ ID NO: 250394 - DNA, 25 bp, Homo sapien
gcaaggttcaaaacatagatcccct

SEQ ID NO: 250395 - DNA, 25 bp, Homo sapien
tagatccccttaaatgacacttccg

SEQ ID NO: 250396 - DNA, 25 bp, Homo sapien
gaataccttcacaatctgaactttc

SEQ ID NO: 250397 - DNA, 25 bp, Homo sapien
tgaactttctctagatgggcacaga

SEQ ID NO: 250398 - DNA, 25 bp, Homo sapien
tgggcacagatcatgaataactcag

SEQ ID NO: 250399 - DNA, 25 bp, Homo sapien
gaaaccattagcatattgtgtgctt

SEQ ID NO: 250400 - DNA, 25 bp, Homo sapien
agtgctgaggctttttgcaggcgca

SEQ ID NO: 250401 - DNA, 25 bp, Homo sapien
tgcaggcgcagttagcaggcgaact

SEQ ID NO: 250402 - DNA, 25 bp, Homo sapien
caggcgaactggtcagcagggtttc

SEQ ID NO: 250403 - DNA, 25 bp, Homo sapien
gggccctgtgttgctaaggaattaa

SEQ ID NO: 250404 - DNA, 25 bp, Homo sapien
ggaaaaatcatcttatactaaacgt

SEQ ID NO: 250405 - DNA, 25 bp, Homo sapien
tactaaacgtctttattgccaaact

SEQ ID NO: 250406 - DNA, 25 bp, Homo sapien
tattgccaaactagaataccttcac

SEQ ID NO: 250407 - DNA, 25 bp, Homo sapien
gcgccggcggaaggagacgcgctgc

SEQ ID NO: 250408 - DNA, 25 bp, Homo sapien
tcttcgacggccgcgttgggttttg

SEQ ID NO: 250409 - DNA, 25 bp, Homo sapien
ttcagttttcttgtgtggcgctgca

SEQ ID NO: 250410 - DNA, 25 bp, Homo sapien
agttttcttgtgtggcgctgcagca

SEQ ID NO: 250411 - DNA, 25 bp, Homo sapien
ttgtgtggcgctgcagcacaaggct

SEQ ID NO: 250412 - DNA, 25 bp, Homo sapien
tggcgctgcagcacaaggctgcgaa

SEQ ID NO: 250413 - DNA, 25 bp, Homo sapien
gatctggacggacccagtggccgct

SEQ ID NO: 250414 - DNA, 25 bp, Homo sapien
agggccgggcactactttccgtctg

SEQ ID NO: 250415 - DNA, 25 bp, Homo sapien
gcactactttccgtctgcggtggtt

SEQ ID NO: 250416 - DNA, 25 bp, Homo sapien
tactttccgtctgcggtggttccgc

SEQ ID NO: 250417 - DNA, 25 bp, Homo sapien
tttccgtctgcggtggttccgccga

SEQ ID NO: 250418 - DNA, 25 bp, Homo sapien
tgagcccagggagttatcaaacacc

SEQ ID NO: 250419 - DNA, 25 bp, Homo sapien
cagggagttatcaaacacccacgaa

SEQ ID NO: 250420 - DNA, 25 bp, Homo sapien
tttgggccatgatttggagggttcc

SEQ ID NO: 250421 - DNA, 25 bp, Homo sapien
gattaataacttaagtacctactat

SEQ ID NO: 250422 - DNA, 25 bp, Homo sapien
ttaagtacctactattcaaaagagg

SEQ ID NO: 250423 - DNA, 25 bp, Homo sapien
ctattcaaaagaggtctctctcttg

SEQ ID NO: 250424 - DNA, 25 bp, Homo sapien
gggcttctaggacccttgagtgaac

SEQ ID NO: 250425 - DNA, 25 bp, Homo sapien
ctaggacccttgagtgaacagtgag

SEQ ID NO: 250426 - DNA, 25 bp, Homo sapien
gaacagtgagagctcttgggacttc

SEQ ID NO: 250427 - DNA, 25 bp, Homo sapien
agtgagagctcttgggacttcttga

SEQ ID NO: 250428 - DNA, 25 bp, Homo sapien
agagctcttgggacttcttgagccc

SEQ ID NO: 250429 - DNA, 25 bp, Homo sapien
gttgtgtaccactatagcatgacta

SEQ ID NO: 250430 - DNA, 25 bp, Homo sapien
tgtgtaccactatagcatgactata

SEQ ID NO: 250431 - DNA, 25 bp, Homo sapien
tgcttgttaccctgagctgataact

SEQ ID NO: 250432 - DNA, 25 bp, Homo sapien
gttaccctgagctgataactgtaca

SEQ ID NO: 250433 - DNA, 25 bp, Homo sapien
accctgagctgataactgtacattc

SEQ ID NO: 250434 - DNA, 25 bp, Homo sapien
tgagctgataactgtacattctttg

SEQ ID NO: 250435 - DNA, 25 bp, Homo sapien
gataactgtacattctttgtatcaa

SEQ ID NO: 250436 - DNA, 25 bp, Homo sapien
aactgtacattctttgtatcaaagt

SEQ ID NO: 250437 - DNA, 25 bp, Homo sapien
gtatcaaagtattctaccccacgaa

SEQ ID NO: 250438 - DNA, 25 bp, Homo sapien
agtattctaccccacgaatatgtag

SEQ ID NO: 250439 - DNA, 25 bp, Homo sapien
ctaccccacgaatatgtagaattat

SEQ ID NO: 250440 - DNA, 25 bp, Homo sapien
tgcttcggcagcacgaggccacgcg

SEQ ID NO: 250441 - DNA, 25 bp, Homo sapien
agcacgaggccacgcgggagctgga

SEQ ID NO: 250442 - DNA, 25 bp, Homo sapien
ccgcctgcagcaccagacggagctg

SEQ ID NO: 250443 - DNA, 25 bp, Homo sapien
ccagctggagtacaacaagcggcgt

SEQ ID NO: 250444 - DNA, 25 bp, Homo sapien
ctggagtacaacaagcggcgtgagc

SEQ ID NO: 250445 - DNA, 25 bp, Homo sapien
ggagtacaacaagcggcgtgagcaa

SEQ ID NO: 250446 - DNA, 25 bp, Homo sapien
aacaagcggcgtgagcaagagttgc

SEQ ID NO: 250447 - DNA, 25 bp, Homo sapien
tgagcaagagttgcggcagaagcat

SEQ ID NO: 250448 - DNA, 25 bp, Homo sapien
agttgcggcagaagcatgcggccca

SEQ ID NO: 250449 - DNA, 25 bp, Homo sapien
cggcagaagcatgcggcccaggttc

SEQ ID NO: 250450 - DNA, 25 bp, Homo sapien
agcatgcggcccaggttcgccagca

SEQ ID NO: 250451 - DNA, 25 bp, Homo sapien
tctttgttacataatcaggattaat

SEQ ID NO: 250452 - DNA, 25 bp, Homo sapien
attaatttaagcagcctaggccatc

SEQ ID NO: 250453 - DNA, 25 bp, Homo sapien
ttaagcagcctaggccatccattta

SEQ ID NO: 250454 - DNA, 25 bp, Homo sapien
accaggtgcgagtccccttgctctt

SEQ ID NO: 250455 - DNA, 25 bp, Homo sapien
aagggctgctcaggtggtcctgcca

SEQ ID NO: 250456 - DNA, 25 bp, Homo sapien
ggctgctcaggtggtcctgccacat

SEQ ID NO: 250457 - DNA, 25 bp, Homo sapien
cctctgtgccagtgtaaactgataa

SEQ ID NO: 250458 - DNA, 25 bp, Homo sapien
tgataatagtgatttccctgcccca

SEQ ID NO: 250459 - DNA, 25 bp, Homo sapien
taatagtgatttccctgccccacct

SEQ ID NO: 250460 - DNA, 25 bp, Homo sapien
cctctctgccagctatctaagtttt

SEQ ID NO: 250461 - DNA, 25 bp, Homo sapien
ctctgccagctatctaagttttctt

SEQ ID NO: 250462 - DNA, 25 bp, Homo sapien
tgaagtatccccagttgttttcctt

SEQ ID NO: 250463 - DNA, 25 bp, Homo sapien
tccttcagtgttgagtttttgtcct

SEQ ID NO: 250464 - DNA, 25 bp, Homo sapien
tattatattttgctctccctaacat

SEQ ID NO: 250465 - DNA, 25 bp, Homo sapien
tgctctccctaacatttgactgttt

SEQ ID NO: 250466 - DNA, 25 bp, Homo sapien
ataaataataccctcgatgccactg

SEQ ID NO: 250467 - DNA, 25 bp, Homo sapien
gatgccactggatactcacaagcag

SEQ ID NO: 250468 - DNA, 25 bp, Homo sapien
tggatactcacaagcagggttatgc

SEQ ID NO: 250469 - DNA, 25 bp, Homo sapien
agggttatgctccttcatcttgggc

SEQ ID NO: 250470 - DNA, 25 bp, Homo sapien
tttattttgtacctcctatgcgtgg

SEQ ID NO: 250471 - DNA, 25 bp, Homo sapien
acctcctatgcgtgggatagtccag

SEQ ID NO: 250472 - DNA, 25 bp, Homo sapien
aattgcacctgctatacttaaatgt

SEQ ID NO: 250473 - DNA, 25 bp, Homo sapien
ttaaaactatacctaaattcttgca

SEQ ID NO: 250474 - DNA, 25 bp, Homo sapien
acttttatgggcttggacattgttg

SEQ ID NO: 250475 - DNA, 25 bp, Homo sapien
tatgggcttggacattgttgaaatg

SEQ ID NO: 250476 - DNA, 25 bp, Homo sapien
tataatatagcttcctggcaggtta

SEQ ID NO: 250477 - DNA, 25 bp, Homo sapien
gcaggttaaaagtcaacacttgatt

SEQ ID NO: 250478 - DNA, 25 bp, Homo sapien
cttgattttgctattcttctgactt

SEQ ID NO: 250479 - DNA, 25 bp, Homo sapien
gctattcttctgactttttgaaacc

SEQ ID NO: 250480 - DNA, 25 bp, Homo sapien
tttgaaaccctgaagttctgaattt

SEQ ID NO: 250481 - DNA, 25 bp, Homo sapien
agcttttcagcaatggttgtttgtt

SEQ ID NO: 250482 - DNA, 25 bp, Homo sapien
ttgtttatggttcaaacatctgaaa

SEQ ID NO: 250483 - DNA, 25 bp, Homo sapien
aacatctgaaataactacctgcatt

SEQ ID NO: 250484 - DNA, 25 bp, Homo sapien
cttctaatgattaggattacccatg

SEQ ID NO: 250485 - DNA, 25 bp, Homo sapien
ggattacccatgatttaggccacta

SEQ ID NO: 250486 - DNA, 25 bp, Homo sapien
agtctagtcgtctcaaatcctattt

SEQ ID NO: 250487 - DNA, 25 bp, Homo sapien
gtcgtctcaaatcctatttggaaca

SEQ ID NO: 250488 - DNA, 25 bp, Homo sapien
tggtatcttctttccttaaataagg

SEQ ID NO: 250489 - DNA, 25 bp, Homo sapien
gggtttcccctctacatatgttata

SEQ ID NO: 250490 - DNA, 25 bp, Homo sapien
actattctataattcctgttacatc

SEQ ID NO: 250491 - DNA, 25 bp, Homo sapien
aattcctgttacatcatgtgttaac

SEQ ID NO: 250492 - DNA, 25 bp, Homo sapien
gtgttaacttgctgtgatttcatgt

SEQ ID NO: 250493 - DNA, 25 bp, Homo sapien
tcatgggaggtaagttttgtcagct

SEQ ID NO: 250494 - DNA, 25 bp, Homo sapien
taagttttgtcagcttactgtttat

SEQ ID NO: 250495 - DNA, 25 bp, Homo sapien
aatgctgcgggctgaggcccacgct

SEQ ID NO: 250496 - DNA, 25 bp, Homo sapien
tgaggcccacgctggaggaacaccg

SEQ ID NO: 250497 - DNA, 25 bp, Homo sapien
ggaacaccggccagtgggcagcttt

SEQ ID NO: 250498 - DNA, 25 bp, Homo sapien
aacacagcacactcctaagtgagtc

SEQ ID NO: 250499 - DNA, 25 bp, Homo sapien
caccatggtgacttttggattccca

SEQ ID NO: 250500 - DNA, 25 bp, Homo sapien
tgacttttggattcccactgccagt

SEQ ID NO: 250501 - DNA, 25 bp, Homo sapien
attcccactgccagttcctgtggag

SEQ ID NO: 250502 - DNA, 25 bp, Homo sapien
gtggagtcagagagatcttagctca

SEQ ID NO: 250503 - DNA, 25 bp, Homo sapien
gagatcttagctcagaagtgctgac

SEQ ID NO: 250504 - DNA, 25 bp, Homo sapien
aataccagtggaatccggataggac

SEQ ID NO: 250505 - DNA, 25 bp, Homo sapien
aatccggataggacggtgtgaccca

SEQ ID NO: 250506 - DNA, 25 bp, Homo sapien
acagggttcctcaaggcatgctgca

SEQ ID NO: 250507 - DNA, 25 bp, Homo sapien
aaggcatgctgcagcctataccact

SEQ ID NO: 250508 - DNA, 25 bp, Homo sapien
tgctcagtaccaacaccagtttgcc

SEQ ID NO: 250509 - DNA, 25 bp, Homo sapien
agtttgccacccaatcctacattgg

SEQ ID NO: 250510 - DNA, 25 bp, Homo sapien
tacattgggtcttcccgaggctcaa

SEQ ID NO: 250511 - DNA, 25 bp, Homo sapien
ttcccgaggctcaacaatttacact

SEQ ID NO: 250512 - DNA, 25 bp, Homo sapien
aatttacactggatacccgctgagt

SEQ ID NO: 250513 - DNA, 25 bp, Homo sapien
gagtcctaccaagatcagccagtat

SEQ ID NO: 250514 - DNA, 25 bp, Homo sapien
gatcagccagtattcctacttatag

SEQ ID NO: 250515 - DNA, 25 bp, Homo sapien
gaggaggaatcatggctaccttctc

SEQ ID NO: 250516 - DNA, 25 bp, Homo sapien
cctggccctgcgttcttaatattgg

SEQ ID NO: 250517 - DNA, 25 bp, Homo sapien
gttacttttactcaatatcaacagt

SEQ ID NO: 250518 - DNA, 25 bp, Homo sapien
caatatcaacagtacttcaatagat

SEQ ID NO: 250519 - DNA, 25 bp, Homo sapien
gatatttattagttatgttcaatct

SEQ ID NO: 250520 - DNA, 25 bp, Homo sapien
ggaaaatcaactccagtccacacat

SEQ ID NO: 250521 - DNA, 25 bp, Homo sapien
tccagtccacacatacagtcatgtt

SEQ ID NO: 250522 - DNA, 25 bp, Homo sapien
taagatgtcatgttgtatgtcacac

SEQ ID NO: 250523 - DNA, 25 bp, Homo sapien
gtcatgttgtatgtcacacagtttc

SEQ ID NO: 250524 - DNA, 25 bp, Homo sapien
gtatgtcacacagtttctagattga

SEQ ID NO: 250525 - DNA, 25 bp, Homo sapien
gtttctagattgatttctcttgtgt

SEQ ID NO: 250526 - DNA, 25 bp, Homo sapien
tttctcttgtgtataagttataaca

SEQ ID NO: 250527 - DNA, 25 bp, Homo sapien
taacatcaaaaatgccaaagggtat

SEQ ID NO: 250528 - DNA, 25 bp, Homo sapien
gtagttttgactatttctaaaagca

SEQ ID NO: 250529 - DNA, 25 bp, Homo sapien
tgactatttctaaaagcagaggaga

SEQ ID NO: 250530 - DNA, 25 bp, Homo sapien
aaatatcctggaatctgtatggagg

SEQ ID NO: 250531 - DNA, 25 bp, Homo sapien
tgttaatttttcagttacgttatct

SEQ ID NO: 250532 - DNA, 25 bp, Homo sapien
gttacgttatctataaacatgatgg

SEQ ID NO: 250533 - DNA, 25 bp, Homo sapien
acatgatggaagtaaaggtttggca

SEQ ID NO: 250534 - DNA, 25 bp, Homo sapien
gtttggcagaatttcaccttgacta

SEQ ID NO: 250535 - DNA, 25 bp, Homo sapien
gcagaatttcaccttgactatttga

SEQ ID NO: 250536 - DNA, 25 bp, Homo sapien
gactatttgaaaattacagacccaa

SEQ ID NO: 250537 - DNA, 25 bp, Homo sapien
tacagacccaattaattccattcaa

SEQ ID NO: 250538 - DNA, 25 bp, Homo sapien
taattccattcaaaagtggttttcg

SEQ ID NO: 250539 - DNA, 25 bp, Homo sapien
attagaaccacgctgtatttacatt

SEQ ID NO: 250540 - DNA, 25 bp, Homo sapien
acgctgtatttacatttaccttggt

SEQ ID NO: 250541 - DNA, 25 bp, Homo sapien
ttaccttggtagtttatttgtggat

SEQ ID NO: 250542 - DNA, 25 bp, Homo sapien
ttgtggatggcagttttctgtagtt

SEQ ID NO: 250543 - DNA, 25 bp, Homo sapien
gactgtggtagctcttggattgttt

SEQ ID NO: 250544 - DNA, 25 bp, Homo sapien
gtagctcttggattgttttgcaaat

SEQ ID NO: 250545 - DNA, 25 bp, Homo sapien
attacagctgaaatctgtgtcatgg

SEQ ID NO: 250546 - DNA, 25 bp, Homo sapien
tctgtgtcatggattaaactggctt

SEQ ID NO: 250547 - DNA, 25 bp, Homo sapien
catggattaaactggcttatgtggc

SEQ ID NO: 250548 - DNA, 25 bp, Homo sapien
tgtttactaattttatactcccatt

SEQ ID NO: 250549 - DNA, 25 bp, Homo sapien
ttatactcccattaaaaatctctaa

SEQ ID NO: 250550 - DNA, 25 bp, Homo sapien
gatctgtgtttatcattagccttgt

SEQ ID NO: 250551 - DNA, 25 bp, Homo sapien
tgtgtttatcattagccttgtacaa

SEQ ID NO: 250552 - DNA, 25 bp, Homo sapien
attactaatagtgatgttcttttgc

SEQ ID NO: 250553 - DNA, 25 bp, Homo sapien
cttttgcaaggcatagaacatttgt

SEQ ID NO: 250554 - DNA, 25 bp, Homo sapien
aatactggaaaaccatatatctttt

SEQ ID NO: 250555 - DNA, 25 bp, Homo sapien
atttatgtactcacagtctttccct

SEQ ID NO: 250556 - DNA, 25 bp, Homo sapien
gtactcacagtctttccctgaagag

SEQ ID NO: 250557 - DNA, 25 bp, Homo sapien
ctcacagtctttccctgaagagaag

SEQ ID NO: 250558 - DNA, 25 bp, Homo sapien
aagtctactgttcataaaccatgct

SEQ ID NO: 250559 - DNA, 25 bp, Homo sapien
gttcataaaccatgctaaacatttt

SEQ ID NO: 250560 - DNA, 25 bp, Homo sapien
gctagtgttaggaagtgaacctaaa

SEQ ID NO: 250561 - DNA, 25 bp, Homo sapien
ggcccgagcctgcttcctattttga

SEQ ID NO: 250562 - DNA, 25 bp, Homo sapien
gatagatggtgcagcatgtctacat

SEQ ID NO: 250563 - DNA, 25 bp, Homo sapien
gcatgtctacatggttgtttgttgc

SEQ ID NO: 250564 - DNA, 25 bp, Homo sapien
tggttgtttgttgctaaactttata

SEQ ID NO: 250565 - DNA, 25 bp, Homo sapien
taatgtgtggtttcaattcagcttg

SEQ ID NO: 250566 - DNA, 25 bp, Homo sapien
aaaataatctcactacatgtagcag

SEQ ID NO: 250567 - DNA, 25 bp, Homo sapien
tgtaatgttagtatttctgctttga

SEQ ID NO: 250568 - DNA, 25 bp, Homo sapien
ttctgctttgaatccttgatattgc

SEQ ID NO: 250569 - DNA, 25 bp, Homo sapien
gatattgcaatggaattcctacttt

SEQ ID NO: 250570 - DNA, 25 bp, Homo sapien
gatatgctagttattgtgtgcgatt

SEQ ID NO: 250571 - DNA, 25 bp, Homo sapien
tattgtgtgcgatttaaactttttt

SEQ ID NO: 250572 - DNA, 25 bp, Homo sapien
taatatgcatatatagttaccgtgc

SEQ ID NO: 250573 - DNA, 25 bp, Homo sapien
gttaccgtgctaaaatggttaccag

SEQ ID NO: 250574 - DNA, 25 bp, Homo sapien
aatggttaccagcaggttttgagag

SEQ ID NO: 250575 - DNA, 25 bp, Homo sapien
gagaatgctgcatcagaaaagtgtc

SEQ ID NO: 250576 - DNA, 25 bp, Homo sapien
gaaaagtgtcagttgccacctcatt

SEQ ID NO: 250577 - DNA, 25 bp, Homo sapien
aaagtgtcagttgccacctcattct

SEQ ID NO: 250578 - DNA, 25 bp, Homo sapien
acctcattctccctgatttaggttc

SEQ ID NO: 250579 - DNA, 25 bp, Homo sapien
attctccctgatttaggttcctgac

SEQ ID NO: 250580 - DNA, 25 bp, Homo sapien
ctgatttaggttcctgacactgatt

SEQ ID NO: 250581 - DNA, 25 bp, Homo sapien
cccccattgggtgtatcttgtctat

SEQ ID NO: 250582 - DNA, 25 bp, Homo sapien
gtatcttgtctatgtacagatattt

SEQ ID NO: 250583 - DNA, 25 bp, Homo sapien
aaatatcttagggtattctggaagt

SEQ ID NO: 250584 - DNA, 25 bp, Homo sapien
gattgattatattgctcaaccctgt

SEQ ID NO: 250585 - DNA, 25 bp, Homo sapien
gctcaaccctgtttattatacgcag

SEQ ID NO: 250586 - DNA, 25 bp, Homo sapien
attatacgcagattcctttggacga

SEQ ID NO: 250587 - DNA, 25 bp, Homo sapien
gattcctttggacgaggtgttctaa

SEQ ID NO: 250588 - DNA, 25 bp, Homo sapien
ggacgaggtgttctaacagtcttag

SEQ ID NO: 250589 - DNA, 25 bp, Homo sapien
cttagaacatctgatatatgggatc

SEQ ID NO: 250590 - DNA, 25 bp, Homo sapien
atgacttctagtgtatacctttaac

SEQ ID NO: 250591 - DNA, 25 bp, Homo sapien
agtgtatacctttaacagcctcctt

SEQ ID NO: 250592 - DNA, 25 bp, Homo sapien
ctttaacagcctcctttttgtgaat

SEQ ID NO: 250593 - DNA, 25 bp, Homo sapien
gtgaattttcactgttcttaccaag

SEQ ID NO: 250594 - DNA, 25 bp, Homo sapien
aaacctatggcctttttattgagca

SEQ ID NO: 250595 - DNA, 25 bp, Homo sapien
ctatggcctttttattgagcacact

SEQ ID NO: 250596 - DNA, 25 bp, Homo sapien
gagcacactcttaaatcattatttg

SEQ ID NO: 250597 - DNA, 25 bp, Homo sapien
atttggcttgtaaacattcatctga

SEQ ID NO: 250598 - DNA, 25 bp, Homo sapien
ctgaattgtggctacaatcctcttt

SEQ ID NO: 250599 - DNA, 25 bp, Homo sapien
ggctacaatcctctttaaataatct

SEQ ID NO: 250600 - DNA, 25 bp, Homo sapien
aagcttacattttcacagttttggc

SEQ ID NO: 250601 - DNA, 25 bp, Homo sapien
cattttcacagttttggctcttaaa

SEQ ID NO: 250602 - DNA, 25 bp, Homo sapien
ggctcttaaacacattccacaaatg

SEQ ID NO: 250603 - DNA, 25 bp, Homo sapien
aaacacattccacaaatgccattaa

SEQ ID NO: 250604 - DNA, 25 bp, Homo sapien
tattttgttttaggccagtcatggt

SEQ ID NO: 250605 - DNA, 25 bp, Homo sapien
aaatgttccttctgttcaaatcgaa

SEQ ID NO: 250606 - DNA, 25 bp, Homo sapien
aatcgaaatacctcatctctatggc

SEQ ID NO: 250607 - DNA, 25 bp, Homo sapien
atggctgtacattaggacctagaac

SEQ ID NO: 250608 - DNA, 25 bp, Homo sapien
aggacctagaacagtggcccattgc

SEQ ID NO: 250609 - DNA, 25 bp, Homo sapien
gtggcccattgctcttagactggaa

SEQ ID NO: 250610 - DNA, 25 bp, Homo sapien
tagactggaaccatgtccactaaaa

SEQ ID NO: 250611 - DNA, 25 bp, Homo sapien
taagcagatgttgtagacctagccc

SEQ ID NO: 250612 - DNA, 25 bp, Homo sapien
atgttgtagacctagccccacagga

SEQ ID NO: 250613 - DNA, 25 bp, Homo sapien
acaggactgcatttagctgcttcag

SEQ ID NO: 250614 - DNA, 25 bp, Homo sapien
gataaaatatatcaattcccagaga

SEQ ID NO: 250615 - DNA, 25 bp, Homo sapien
attcccagagaaaactcttgactta

SEQ ID NO: 250616 - DNA, 25 bp, Homo sapien
cctcatgcgtcccttttatgggaga

SEQ ID NO: 250617 - DNA, 25 bp, Homo sapien
gttattttgctttccggtacaggat

SEQ ID NO: 250618 - DNA, 25 bp, Homo sapien
acaggatacagctgtgcttctccta

SEQ ID NO: 250619 - DNA, 25 bp, Homo sapien
cagctgtgcttctcctactttgtat

SEQ ID NO: 250620 - DNA, 25 bp, Homo sapien
tactttgtatttgccatatacggat

SEQ ID NO: 250621 - DNA, 25 bp, Homo sapien
aacctcatgactgatttttccctat

SEQ ID NO: 250622 - DNA, 25 bp, Homo sapien
tgagtggctctgtataccattttca

SEQ ID NO: 250623 - DNA, 25 bp, Homo sapien
gtttgaggaggagatctaccaacta

SEQ ID NO: 250624 - DNA, 25 bp, Homo sapien
ggagatctaccaactaatcagcagt

SEQ ID NO: 250625 - DNA, 25 bp, Homo sapien
tcagcagttctgagatgaatcgcat

SEQ ID NO: 250626 - DNA, 25 bp, Homo sapien
gagatgaatcgcatagggcctcatg

SEQ ID NO: 250627 - DNA, 25 bp, Homo sapien
tgactcttcaagctcctggtggcta

SEQ ID NO: 250628 - DNA, 25 bp, Homo sapien
gtggctaccagcatctctgggcttg

SEQ ID NO: 250629 - DNA, 25 bp, Homo sapien
ctcccacattttggaggctaaatgt

SEQ ID NO: 250630 - DNA, 25 bp, Homo sapien
aatatctaccttcacagtcactttg

SEQ ID NO: 250631 - DNA, 25 bp, Homo sapien
gtctctcttataagggcgcttgtca

SEQ ID NO: 250632 - DNA, 25 bp, Homo sapien
ataagggcgcttgtcatgagattta

SEQ ID NO: 250633 - DNA, 25 bp, Homo sapien
tgtcatgagatttaggacccaccta

SEQ ID NO: 250634 - DNA, 25 bp, Homo sapien
gacccacctagataatccgcgatta

SEQ ID NO: 250635 - DNA, 25 bp, Homo sapien
gcgattatgtaatctcaagatcctt

SEQ ID NO: 250636 - DNA, 25 bp, Homo sapien
gaaagggtcacgttccctctggagg

SEQ ID NO: 250637 - DNA, 25 bp, Homo sapien
gggaaagctgtatcttgactcttca

SEQ ID NO: 250638 - DNA, 25 bp, Homo sapien
cctgcctggatccagctctgggagc

SEQ ID NO: 250639 - DNA, 25 bp, Homo sapien
tccagctctgggagccctgccgagg

SEQ ID NO: 250640 - DNA, 25 bp, Homo sapien
cagggttttagagagcagtggcaga

SEQ ID NO: 250641 - DNA, 25 bp, Homo sapien
agtggcagaggtagccccctaaatg

SEQ ID NO: 250642 - DNA, 25 bp, Homo sapien
atccccgtctgaccaagggctgact

SEQ ID NO: 250643 - DNA, 25 bp, Homo sapien
tgaccaagggctgacttctccagga

SEQ ID NO: 250644 - DNA, 25 bp, Homo sapien
aagggctgacttctccaggacctag

SEQ ID NO: 250645 - DNA, 25 bp, Homo sapien
ctgacttctccaggacctagtcggg

SEQ ID NO: 250646 - DNA, 25 bp, Homo sapien
gggcaaggagaaagcaccgacaatc

SEQ ID NO: 250647 - DNA, 25 bp, Homo sapien
gagaaagcaccgacaatctttgatt

SEQ ID NO: 250648 - DNA, 25 bp, Homo sapien
gcaccgacaatctttgattactgaa

SEQ ID NO: 250649 - DNA, 25 bp, Homo sapien
tattagtattacagaggctcttgcc

SEQ ID NO: 250650 - DNA, 25 bp, Homo sapien
tattacagaggctcttgcccagcca

SEQ ID NO: 250651 - DNA, 25 bp, Homo sapien
tgatttttatggctactcttcccag

SEQ ID NO: 250652 - DNA, 25 bp, Homo sapien
ttatggctactcttcccagttacat

SEQ ID NO: 250653 - DNA, 25 bp, Homo sapien
gctactcttcccagttacattttat

SEQ ID NO: 250654 - DNA, 25 bp, Homo sapien
ttatgcatctgtaagctttccttcc

SEQ ID NO: 250655 - DNA, 25 bp, Homo sapien
gtaagctttccttccttagcaaaat

SEQ ID NO: 250656 - DNA, 25 bp, Homo sapien
gctttccttccttagcaaaattgca

SEQ ID NO: 250657 - DNA, 25 bp, Homo sapien
aaaattacctgacacataccacgct

SEQ ID NO: 250658 - DNA, 25 bp, Homo sapien
ttacctgacacataccacgcttaaa

SEQ ID NO: 250659 - DNA, 25 bp, Homo sapien
tgacacataccacgcttaaaccaac

SEQ ID NO: 250660 - DNA, 25 bp, Homo sapien
gtcaagcctcagctgtgactctaat

SEQ ID NO: 250661 - DNA, 25 bp, Homo sapien
agctgtgactctaatcctgccaagt

SEQ ID NO: 250662 - DNA, 25 bp, Homo sapien
ctgagagccgactcattcatccaaa

SEQ ID NO: 250663 - DNA, 25 bp, Homo sapien
agagaacggtttggatggagctcaa

SEQ ID NO: 250664 - DNA, 25 bp, Homo sapien
gctcaaggtgcctggctcgctggca

SEQ ID NO: 250665 - DNA, 25 bp, Homo sapien
gaaggtctgtcactactcagttggg

SEQ ID NO: 250666 - DNA, 25 bp, Homo sapien
tgagaagttcaagtccactgcctcg

SEQ ID NO: 250667 - DNA, 25 bp, Homo sapien
aactcaaatgagtcagcctcaccaa

SEQ ID NO: 250668 - DNA, 25 bp, Homo sapien
agcctcaccaaccaagaatcgcgtt

SEQ ID NO: 250669 - DNA, 25 bp, Homo sapien
gaatcgcgttcataaacagactcag

SEQ ID NO: 250670 - DNA, 25 bp, Homo sapien
aacagactcagagcctgcgtgccgt

SEQ ID NO: 250671 - DNA, 25 bp, Homo sapien
tgacctgacccactcctagagaaag

SEQ ID NO: 250672 - DNA, 25 bp, Homo sapien
gaaaaactcagagcttgcctgccag

SEQ ID NO: 250673 - DNA, 25 bp, Homo sapien
gagcttgcctgccaggtaacatttc

SEQ ID NO: 250674 - DNA, 25 bp, Homo sapien
tgccaggtaacatttctgcctcctc

SEQ ID NO: 250675 - DNA, 25 bp, Homo sapien
tccagtctgctctgagagccagcga

SEQ ID NO: 250676 - DNA, 25 bp, Homo sapien
gagccagcgaagtctctctcaccag

SEQ ID NO: 250677 - DNA, 25 bp, Homo sapien
tctcaccagcctatcatttgtctga

SEQ ID NO: 250678 - DNA, 25 bp, Homo sapien
atcatttgtctgactcaggcttttg

SEQ ID NO: 250679 - DNA, 25 bp, Homo sapien
gactcaggcttttgtctgggctgaa

SEQ ID NO: 250680 - DNA, 25 bp, Homo sapien
gtctgggctgaaggctattacattt

SEQ ID NO: 250681 - DNA, 25 bp, Homo sapien
gctgaaggctattacattttgagga

SEQ ID NO: 250682 - DNA, 25 bp, Homo sapien
tctttcctgtaacactgggaggcca

SEQ ID NO: 250683 - DNA, 25 bp, Homo sapien
gtgtggatgacatggaattactcaa

SEQ ID NO: 250684 - DNA, 25 bp, Homo sapien
gacatggaattactcaaaatgatct

SEQ ID NO: 250685 - DNA, 25 bp, Homo sapien
gatctaggttcatttgtttcgacat

SEQ ID NO: 250686 - DNA, 25 bp, Homo sapien
tctaggttcatttgtttcgacatac

SEQ ID NO: 250687 - DNA, 25 bp, Homo sapien
gacaggtacgacctctgttcattct

SEQ ID NO: 250688 - DNA, 25 bp, Homo sapien
gttcatttgtttcgacataccttat

SEQ ID NO: 250689 - DNA, 25 bp, Homo sapien
tttgtttcgacataccttataaagc

SEQ ID NO: 250690 - DNA, 25 bp, Homo sapien
aaagcaagccacagggttgtctgaa

SEQ ID NO: 250691 - DNA, 25 bp, Homo sapien
gcaagccacagggttgtctgaagga

SEQ ID NO: 250692 - DNA, 25 bp, Homo sapien
aggtacgacctctgttcattctcac

SEQ ID NO: 250693 - DNA, 25 bp, Homo sapien
agagagtgcaggaggccgctccctc

SEQ ID NO: 250694 - DNA, 25 bp, Homo sapien
cctctgtgtgtggtcagctggcctg

SEQ ID NO: 250695 - DNA, 25 bp, Homo sapien
tgtgacctcaccagtggcccagagc

SEQ ID NO: 250696 - DNA, 25 bp, Homo sapien
tgacctcaccagtggcccagagcag

SEQ ID NO: 250697 - DNA, 25 bp, Homo sapien
gtgaacctgacaggtctcaccagcg

SEQ ID NO: 250698 - DNA, 25 bp, Homo sapien
ctgacaggtctcaccagcgccggta

SEQ ID NO: 250699 - DNA, 25 bp, Homo sapien
acaggtctcaccagcgccggtactg

SEQ ID NO: 250700 - DNA, 25 bp, Homo sapien
tgctcctcctgcaggcgcgactggt

SEQ ID NO: 250701 - DNA, 25 bp, Homo sapien
tgcaggcgcgactggtaactcccat

SEQ ID NO: 250702 - DNA, 25 bp, Homo sapien
aggcgcgactggtaactcccatgag

SEQ ID NO: 250703 - DNA, 25 bp, Homo sapien
cgactggtaactcccatgagcccgg

SEQ ID NO: 250704 - DNA, 25 bp, Homo sapien
aactcaagtttcatgtttcaatgcc

SEQ ID NO: 250705 - DNA, 25 bp, Homo sapien
agtttcatgtttcaatgccaagttc

SEQ ID NO: 250706 - DNA, 25 bp, Homo sapien
tttgccttatcataaacaggaaatg

SEQ ID NO: 250707 - DNA, 25 bp, Homo sapien
aagggctgtcaggatgggataattt

SEQ ID NO: 250708 - DNA, 25 bp, Homo sapien
aatttgggaggcttctcattctggc

SEQ ID NO: 250709 - DNA, 25 bp, Homo sapien
tcattctggcttctatttctatgtg

SEQ ID NO: 250710 - DNA, 25 bp, Homo sapien
ggcttctatttctatgtgagtacca

SEQ ID NO: 250711 - DNA, 25 bp, Homo sapien
gtgagtaccagcatatagagtgttt

SEQ ID NO: 250712 - DNA, 25 bp, Homo sapien
gtcatataatttatctgcacagact

SEQ ID NO: 250713 - DNA, 25 bp, Homo sapien
tgcacagacttagaccttcaggaaa

SEQ ID NO: 250714 - DNA, 25 bp, Homo sapien
gtaaacatacttcagcatcttggag

SEQ ID NO: 250715 - DNA, 25 bp, Homo sapien
gttgactactaatgactaatgagaa

SEQ ID NO: 250716 - DNA, 25 bp, Homo sapien
atgtggtgtggttttgcacttaaaa

SEQ ID NO: 250717 - DNA, 25 bp, Homo sapien
aggtattcatatgctctagttgtaa

SEQ ID NO: 250718 - DNA, 25 bp, Homo sapien
aaaatccacttctctactagtcgaa

SEQ ID NO: 250719 - DNA, 25 bp, Homo sapien
acttctctactagtcgaactgcttt

SEQ ID NO: 250720 - DNA, 25 bp, Homo sapien
tcgaactgcttttagtgtctcacca

SEQ ID NO: 250721 - DNA, 25 bp, Homo sapien
actgcttttagtgtctcaccagtgg

SEQ ID NO: 250722 - DNA, 25 bp, Homo sapien
cagtggttttacatctgcagagttt

SEQ ID NO: 250723 - DNA, 25 bp, Homo sapien
tgctgacctttgagaggatttgaaa

SEQ ID NO: 250724 - DNA, 25 bp, Homo sapien
gcttcatattgtgatcctaaatttt

SEQ ID NO: 250725 - DNA, 25 bp, Homo sapien
tatattcactatattccctaaagta

SEQ ID NO: 250726 - DNA, 25 bp, Homo sapien
tctctctccttctccgattagaaaa

SEQ ID NO: 250727 - DNA, 25 bp, Homo sapien
aaatctgagatagcagccggccctg

SEQ ID NO: 250728 - DNA, 25 bp, Homo sapien
ggccctgcgagaatctccatgatta

SEQ ID NO: 250729 - DNA, 25 bp, Homo sapien
ctccatgattagtccacctcaagat

SEQ ID NO: 250730 - DNA, 25 bp, Homo sapien
acctcaagatggacgaatgggcagc

SEQ ID NO: 250731 - DNA, 25 bp, Homo sapien
ggacgaatgggcagcgtctcctccc

SEQ ID NO: 250732 - DNA, 25 bp, Homo sapien
gcctgacaacgagtcagaggagcgt

SEQ ID NO: 250733 - DNA, 25 bp, Homo sapien
gagcgtgggaaagcctctcaggatt

SEQ ID NO: 250734 - DNA, 25 bp, Homo sapien
tctcaggattccacctctgcaaatt

SEQ ID NO: 250735 - DNA, 25 bp, Homo sapien
tctgcaaattccctacaagggaccc

SEQ ID NO: 250736 - DNA, 25 bp, Homo sapien
gccaacaccacagttaccagggaga

SEQ ID NO: 250737 - DNA, 25 bp, Homo sapien
ggaagaagaggacaccgagaaccct

SEQ ID NO: 250738 - DNA, 25 bp, Homo sapien
aggacaccgagaaccctctgaaagt

SEQ ID NO: 250739 - DNA, 25 bp, Homo sapien
aaatgacacgaaagagtcagcaaga

SEQ ID NO: 250740 - DNA, 25 bp, Homo sapien
gcaagagagaccagtccccagaaga

SEQ ID NO: 250741 - DNA, 25 bp, Homo sapien
agagagaccagtccccagaagatcc

SEQ ID NO: 250742 - DNA, 25 bp, Homo sapien
atcctcagaccaggacagtaaactg

SEQ ID NO: 250743 - DNA, 25 bp, Homo sapien
gaccaggacagtaaactgccagctg

SEQ ID NO: 250744 - DNA, 25 bp, Homo sapien
ggacagtaaactgccagctgaggaa

SEQ ID NO: 250745 - DNA, 25 bp, Homo sapien
aggagcacacgcctcatcaatgcat

SEQ ID NO: 250746 - DNA, 25 bp, Homo sapien
gcacacgcctcatcaatgcatggaa

SEQ ID NO: 250747 - DNA, 25 bp, Homo sapien
acacgcctcatcaatgcatggaaga

SEQ ID NO: 250748 - DNA, 25 bp, Homo sapien
atcaatcatgattctcctctacaat

SEQ ID NO: 250749 - DNA, 25 bp, Homo sapien
atgattctcctctacaatcccaatg

SEQ ID NO: 250750 - DNA, 25 bp, Homo sapien
tagtataaccgagccagtcactaaa

SEQ ID NO: 250751 - DNA, 25 bp, Homo sapien
aaccgagccagtcactaaagctgcc

SEQ ID NO: 250752 - DNA, 25 bp, Homo sapien
tcctactgttccctatgtttcatat

SEQ ID NO: 250753 - DNA, 25 bp, Homo sapien
gttccctatgtttcatattcctttt

SEQ ID NO: 250754 - DNA, 25 bp, Homo sapien
ttcctttttctgaggctctacctgt

SEQ ID NO: 250755 - DNA, 25 bp, Homo sapien
ttttctgaggctctacctgtagaca

SEQ ID NO: 250756 - DNA, 25 bp, Homo sapien
ctacctgtagacatcttcaagaccc

SEQ ID NO: 250757 - DNA, 25 bp, Homo sapien
aaacctttcaggtgctccccaactg

SEQ ID NO: 250758 - DNA, 25 bp, Homo sapien
ggtgctccccaactgttcatcaaaa

SEQ ID NO: 250759 - DNA, 25 bp, Homo sapien
ccaccttggtgtacatgctcacaga

SEQ ID NO: 250760 - DNA, 25 bp, Homo sapien
tcacagaggctctgttcatggagca

SEQ ID NO: 250761 - DNA, 25 bp, Homo sapien
gatccacaactagatggaaggcact

SEQ ID NO: 250762 - DNA, 25 bp, Homo sapien
gatggaaggcactctagtctttgca

SEQ ID NO: 250763 - DNA, 25 bp, Homo sapien
aaggcactctagtctttgcagaaaa

SEQ ID NO: 250764 - DNA, 25 bp, Homo sapien
gtacctgaatgtacattgcacaatg

SEQ ID NO: 250765 - DNA, 25 bp, Homo sapien
tgaatgtacattgcacaatgcctgg

SEQ ID NO: 250766 - DNA, 25 bp, Homo sapien
ataaatgatagttcgactcgtctgt

SEQ ID NO: 250767 - DNA, 25 bp, Homo sapien
gatagttcgactcgtctgtggaaga

SEQ ID NO: 250768 - DNA, 25 bp, Homo sapien
tcgactcgtctgtggaagaacttac

SEQ ID NO: 250769 - DNA, 25 bp, Homo sapien
gtctgtggaagaacttacaatcatg

SEQ ID NO: 250770 - DNA, 25 bp, Homo sapien
gagagccttctagctattttggcat

SEQ ID NO: 250771 - DNA, 25 bp, Homo sapien
ggctttttataccagtgtgtccagt

SEQ ID NO: 250772 - DNA, 25 bp, Homo sapien
gtgtccagttagatttactaggctt

SEQ ID NO: 250773 - DNA, 25 bp, Homo sapien
ctaggcttactgacatgctattggt

SEQ ID NO: 250774 - DNA, 25 bp, Homo sapien
ggtaaatcgcattaaagttcatctg

SEQ ID NO: 250775 - DNA, 25 bp, Homo sapien
tgtctgttgacttcttagtcctcag

SEQ ID NO: 250776 - DNA, 25 bp, Homo sapien
tagtcctcagacatgggcctttgtg

SEQ ID NO: 250777 - DNA, 25 bp, Homo sapien
agacatgggcctttgtgttttagaa

SEQ ID NO: 250778 - DNA, 25 bp, Homo sapien
ttgaatttgagttattgggccccac

SEQ ID NO: 250779 - DNA, 25 bp, Homo sapien
agaacgtgagcctgggatactttca

SEQ ID NO: 250780 - DNA, 25 bp, Homo sapien
agttggtttcccatcaaatatgaat

SEQ ID NO: 250781 - DNA, 25 bp, Homo sapien
taaaaatgtggccaaaccttcaccg

SEQ ID NO: 250782 - DNA, 25 bp, Homo sapien
aaatgtggccaaaccttcaccggtg

SEQ ID NO: 250783 - DNA, 25 bp, Homo sapien
atgtggccaaaccttcaccggtggt

SEQ ID NO: 250784 - DNA, 25 bp, Homo sapien
gtggccaaaccttcaccggtggtgg

SEQ ID NO: 250785 - DNA, 25 bp, Homo sapien
aaccttcaccggtggtgggacagct

SEQ ID NO: 250786 - DNA, 25 bp, Homo sapien
tggtgggacagctcatagacctgag

SEQ ID NO: 250787 - DNA, 25 bp, Homo sapien
gggacagctcatagacctgagctcc

SEQ ID NO: 250788 - DNA, 25 bp, Homo sapien
tgagctcccctctgatccagctgag

SEQ ID NO: 250789 - DNA, 25 bp, Homo sapien
ccctctgatccagctgagccctgag

SEQ ID NO: 250790 - DNA, 25 bp, Homo sapien
aggagaacgtggattccccactcct

SEQ ID NO: 250791 - DNA, 25 bp, Homo sapien
gagctcaaggagatgcaggctgcag

SEQ ID NO: 250792 - DNA, 25 bp, Homo sapien
ttaggccaaagttgtggagcttcag

SEQ ID NO: 250793 - DNA, 25 bp, Homo sapien
accaccagctgtcaggccaggcagg

SEQ ID NO: 250794 - DNA, 25 bp, Homo sapien
caggcaggcatttgctgaccccagc

SEQ ID NO: 250795 - DNA, 25 bp, Homo sapien
ctgaaggtgtggactggactgctca

SEQ ID NO: 250796 - DNA, 25 bp, Homo sapien
tgtggactggactgctcagagcatc

SEQ ID NO: 250797 - DNA, 25 bp, Homo sapien
gactggactgctcagagcatcaagc

SEQ ID NO: 250798 - DNA, 25 bp, Homo sapien
gcatcaagcaagatatttagattct

SEQ ID NO: 250799 - DNA, 25 bp, Homo sapien
gaaacttgacattgttcacactggg

SEQ ID NO: 250800 - DNA, 25 bp, Homo sapien
ttgacttgtcttgtttcctccccaa

SEQ ID NO: 250801 - DNA, 25 bp, Homo sapien
ttgtcttgtttcctccccaaggaca

SEQ ID NO: 250802 - DNA, 25 bp, Homo sapien
aggagaacccctgagagagatgatt

SEQ ID NO: 250803 - DNA, 25 bp, Homo sapien
tttagttcaattgttcatccatttt

SEQ ID NO: 250804 - DNA, 25 bp, Homo sapien
agttcaattgttcatccatttttta

SEQ ID NO: 250805 - DNA, 25 bp, Homo sapien
attgttcatccattttttatttgct

SEQ ID NO: 250806 - DNA, 25 bp, Homo sapien
tttgcttttataattgcctccttgt

SEQ ID NO: 250807 - DNA, 25 bp, Homo sapien
ttgcctccttgttttggtatattgt

SEQ ID NO: 250808 - DNA, 25 bp, Homo sapien
gcctccttgttttggtatattgtaa

SEQ ID NO: 250809 - DNA, 25 bp, Homo sapien
tgtgtgtttctgtatatgcacacac

SEQ ID NO: 250810 - DNA, 25 bp, Homo sapien
cataaacggctttgcctagccaagg

SEQ ID NO: 250811 - DNA, 25 bp, Homo sapien
aaacggctttgcctagccaaggatt

SEQ ID NO: 250812 - DNA, 25 bp, Homo sapien
aacggctttgcctagccaaggattt

SEQ ID NO: 250813 - DNA, 25 bp, Homo sapien
cggctttgcctagccaaggattttt

SEQ ID NO: 250814 - DNA, 25 bp, Homo sapien
gtctatgttagagatttttcctaaa

SEQ ID NO: 250815 - DNA, 25 bp, Homo sapien
gtgataggtgcatggacacttctta

SEQ ID NO: 250816 - DNA, 25 bp, Homo sapien
aggtgcatggacacttcttatacca

SEQ ID NO: 250817 - DNA, 25 bp, Homo sapien
atggacacttcttataccattctct

SEQ ID NO: 250818 - DNA, 25 bp, Homo sapien
taccattctctctgctttgtgtgtg

SEQ ID NO: 250819 - DNA, 25 bp, Homo sapien
gctttgtgtgtgtttgacattttcc

SEQ ID NO: 250820 - DNA, 25 bp, Homo sapien
aaaggtattaattccctcattcctg

SEQ ID NO: 250821 - DNA, 25 bp, Homo sapien
gtattaattccctcattcctgtctc

SEQ ID NO: 250822 - DNA, 25 bp, Homo sapien
ttcctgtctccccaagtgaagcttt

SEQ ID NO: 250823 - DNA, 25 bp, Homo sapien
tctccccaagtgaagctttgagcta

SEQ ID NO: 250824 - DNA, 25 bp, Homo sapien
gaagctttgagctaaaaaggtcaag

SEQ ID NO: 250825 - DNA, 25 bp, Homo sapien
tcatctccagctacatcagtcattc

SEQ ID NO: 250826 - DNA, 25 bp, Homo sapien
cagctacatcagtcattctctgcag

SEQ ID NO: 250827 - DNA, 25 bp, Homo sapien
gtcattctctgcagggcaaaatctc

SEQ ID NO: 250828 - DNA, 25 bp, Homo sapien
gcccctggctgtgttggcaggactt

SEQ ID NO: 250829 - DNA, 25 bp, Homo sapien
tgtgttggcaggacttcggtgtcca

SEQ ID NO: 250830 - DNA, 25 bp, Homo sapien
acttcggtgtccagggtagatctcc

SEQ ID NO: 250831 - DNA, 25 bp, Homo sapien
agatctcccctccactgaggagtga

SEQ ID NO: 250832 - DNA, 25 bp, Homo sapien
gagtgaggtcccagaatcctgttgg

SEQ ID NO: 250833 - DNA, 25 bp, Homo sapien
aatcctgttgggtcccaggcctcag

SEQ ID NO: 250834 - DNA, 25 bp, Homo sapien
cagcatcccttcttgggtggatgga

SEQ ID NO: 250835 - DNA, 25 bp, Homo sapien
tgggtggatggagcctcgtcctcat

SEQ ID NO: 250836 - DNA, 25 bp, Homo sapien
gggagcaagatttcatgtcagacct

SEQ ID NO: 250837 - DNA, 25 bp, Homo sapien
atgtcagacctcatgaaagctttgc

SEQ ID NO: 250838 - DNA, 25 bp, Homo sapien
gacctcatgaaagctttgcaaaaga

SEQ ID NO: 250839 - DNA, 25 bp, Homo sapien
aagagaggcaacgtgtcctagggac

SEQ ID NO: 250840 - DNA, 25 bp, Homo sapien
caacgtgtcctagggacgggcatga

SEQ ID NO: 250841 - DNA, 25 bp, Homo sapien
ttccagagggagaagcatcgctgac

SEQ ID NO: 250842 - DNA, 25 bp, Homo sapien
gagaagcatcgctgaccccgagcgc

SEQ ID NO: 250843 - DNA, 25 bp, Homo sapien
tgaccccgagcgcaggttttgctag

SEQ ID NO: 250844 - DNA, 25 bp, Homo sapien
gttttgctagcagattgccctgaca

SEQ ID NO: 250845 - DNA, 25 bp, Homo sapien
tgccctgacatcttgttcatttcag

SEQ ID NO: 250846 - DNA, 25 bp, Homo sapien
gaggcaagagaacccagggcacccc

SEQ ID NO: 250847 - DNA, 25 bp, Homo sapien
cataaacggctttgcctagccaagg

SEQ ID NO: 250848 - DNA, 25 bp, Homo sapien
ataaacggctttgcctagccaagga

SEQ ID NO: 250849 - DNA, 25 bp, Homo sapien
taaacggctttgcctagccaaggat

SEQ ID NO: 250850 - DNA, 25 bp, Homo sapien
aaacggctttgcctagccaaggatt

SEQ ID NO: 250851 - DNA, 25 bp, Homo sapien
aacggctttgcctagccaaggattt

SEQ ID NO: 250852 - DNA, 25 bp, Homo sapien
acggctttgcctagccaaggatttt

SEQ ID NO: 250853 - DNA, 25 bp, Homo sapien
cggctttgcctagccaaggattttt

SEQ ID NO: 250854 - DNA, 25 bp, Homo sapien
ggctttgcctagccaaggatttttt

SEQ ID NO: 250855 - DNA, 25 bp, Homo sapien
gctttgcctagccaaggattttttt

SEQ ID NO: 250856 - DNA, 25 bp, Homo sapien
ttatctgtataaaactttttgtata

SEQ ID NO: 250857 - DNA, 25 bp, Homo sapien
gacgatttacataaagtagctggca

SEQ ID NO: 250858 - DNA, 25 bp, Homo sapien
gtagctggcagatgataggtactca

SEQ ID NO: 250859 - DNA, 25 bp, Homo sapien
gctggcagatgataggtactcaata

SEQ ID NO: 250860 - DNA, 25 bp, Homo sapien
gccatcagatgccactcttattcag

SEQ ID NO: 250861 - DNA, 25 bp, Homo sapien
ttcattactaaatagtccccttctt

SEQ ID NO: 250862 - DNA, 25 bp, Homo sapien
cagatgccactcttattcagcctat

SEQ ID NO: 250863 - DNA, 25 bp, Homo sapien
tttctattaactaacaacagtgagt

SEQ ID NO: 250864 - DNA, 25 bp, Homo sapien
ctaacaacagtgagttcgttgggta

SEQ ID NO: 250865 - DNA, 25 bp, Homo sapien
gcctatcttgaccttcagtttcttt

SEQ ID NO: 250866 - DNA, 25 bp, Homo sapien
ctatcttgaccttcagtttctttat

SEQ ID NO: 250867 - DNA, 25 bp, Homo sapien
gtaaggcttaagtagagacgattta

SEQ ID NO: 250868 - DNA, 25 bp, Homo sapien
ttttttgatggtaatgagtgatttc

SEQ ID NO: 250869 - DNA, 25 bp, Homo sapien
gatttcaaaaatacgtttaggctgg

SEQ ID NO: 250870 - DNA, 25 bp, Homo sapien
agttcatgaccgtcctggtcaacag

SEQ ID NO: 250871 - DNA, 25 bp, Homo sapien
tcatgaccgtcctggtcaacagagt

SEQ ID NO: 250872 - DNA, 25 bp, Homo sapien
gaccgtcctggtcaacagagtaaga

SEQ ID NO: 250873 - DNA, 25 bp, Homo sapien
gtcattgctggtcaatgaagcatac

SEQ ID NO: 250874 - DNA, 25 bp, Homo sapien
tgaagcatactaacagaccaatctg

SEQ ID NO: 250875 - DNA, 25 bp, Homo sapien
gaccaatctgagcagtaattgtcct

SEQ ID NO: 250876 - DNA, 25 bp, Homo sapien
atctgagcagtaattgtccttgcat

SEQ ID NO: 250877 - DNA, 25 bp, Homo sapien
gcagtaattgtccttgcataagcaa

SEQ ID NO: 250878 - DNA, 25 bp, Homo sapien
gtaattgtccttgcataagcaagat

SEQ ID NO: 250879 - DNA, 25 bp, Homo sapien
gtatttgtagaagggtcaacgccac

SEQ ID NO: 250880 - DNA, 25 bp, Homo sapien
tttgtagaagggtcaacgccaccgc

SEQ ID NO: 250881 - DNA, 25 bp, Homo sapien
gtagaagggtcaacgccaccgcctc

SEQ ID NO: 250882 - DNA, 25 bp, Homo sapien
tggccatcatcccaggtagagctgc

SEQ ID NO: 250883 - DNA, 25 bp, Homo sapien
atcatcccaggtagagctgccctct

SEQ ID NO: 250884 - DNA, 25 bp, Homo sapien
cttttctcatcctgcaaagcaaggg

SEQ ID NO: 250885 - DNA, 25 bp, Homo sapien
tctcatcctgcaaagcaagggtgtt

SEQ ID NO: 250886 - DNA, 25 bp, Homo sapien
tcctgcaaagcaagggtgttggagc

SEQ ID NO: 250887 - DNA, 25 bp, Homo sapien
caagggtgttggagcgggccggaga

SEQ ID NO: 250888 - DNA, 25 bp, Homo sapien
ggaaacaggcctttcggaggctcct

SEQ ID NO: 250889 - DNA, 25 bp, Homo sapien
aaacaggcctttcggaggctcctca

SEQ ID NO: 250890 - DNA, 25 bp, Homo sapien
gcgctcgcccagtgatgtgtagcac

SEQ ID NO: 250891 - DNA, 25 bp, Homo sapien
tgatgtgtagcacccttgcacccag

SEQ ID NO: 250892 - DNA, 25 bp, Homo sapien
ttgcacccaggaggactctgcattt

SEQ ID NO: 250893 - DNA, 25 bp, Homo sapien
ggactctgcatttaccaagcacttc

SEQ ID NO: 250894 - DNA, 25 bp, Homo sapien
gacgtttgctgcttgctggatgcct

SEQ ID NO: 250895 - DNA, 25 bp, Homo sapien
tcaccctctattccttgatagcgga

SEQ ID NO: 250896 - DNA, 25 bp, Homo sapien
ttgatagcggattacacctacccct

SEQ ID NO: 250897 - DNA, 25 bp, Homo sapien
aattccatcatcaaccctgtcatat

SEQ ID NO: 250898 - DNA, 25 bp, Homo sapien
aaccctgtcatatatgctttcagaa

SEQ ID NO: 250899 - DNA, 25 bp, Homo sapien
gagatccagaaagcgctctgtctca

SEQ ID NO: 250900 - DNA, 25 bp, Homo sapien
tctgtctcatttgctgcggctgcat

SEQ ID NO: 250901 - DNA, 25 bp, Homo sapien
gacaaactacaataaagccatgccc

SEQ ID NO: 250902 - DNA, 25 bp, Homo sapien
taaagccatgccctgactggatgtg

SEQ ID NO: 250903 - DNA, 25 bp, Homo sapien
aagccatgccctgactggatgtgcc

SEQ ID NO: 250904 - DNA, 25 bp, Homo sapien
atgccctgactggatgtgcctaaca

SEQ ID NO: 250905 - DNA, 25 bp, Homo sapien
gccctgactggatgtgcctaacatt

SEQ ID NO: 250906 - DNA, 25 bp, Homo sapien
gactggatgtgcctaacatttgtct

SEQ ID NO: 250907 - DNA, 25 bp, Homo sapien
ggatgtgcctaacatttgtctggtg

SEQ ID NO: 250908 - DNA, 25 bp, Homo sapien
tgtgcctaacatttgtctggtgctt

SEQ ID NO: 250909 - DNA, 25 bp, Homo sapien
gcctaacatttgtctggtgcttaaa

SEQ ID NO: 250910 - DNA, 25 bp, Homo sapien
acatttgtctggtgcttaaaggagt

SEQ ID NO: 250911 - DNA, 25 bp, Homo sapien
tggtgcttaaaggagttggctgcat

SEQ ID NO: 250912 - DNA, 25 bp, Homo sapien
aatgtgtaatctattgtgcctggct

SEQ ID NO: 250913 - DNA, 25 bp, Homo sapien
ctggcttctttcacgtagcattttg

SEQ ID NO: 250914 - DNA, 25 bp, Homo sapien
gattgttgacaaatatttatccact

SEQ ID NO: 250915 - DNA, 25 bp, Homo sapien
tgattctttgacaagcttgccaatt

SEQ ID NO: 250916 - DNA, 25 bp, Homo sapien
gcttgccaatttactgattttgtca

SEQ ID NO: 250917 - DNA, 25 bp, Homo sapien
aagtttgttcatcctttgagtgtgt

SEQ ID NO: 250918 - DNA, 25 bp, Homo sapien
ttgttcatcctttgagtgtgtgagt

SEQ ID NO: 250919 - DNA, 25 bp, Homo sapien
gtgtgagtatagtatcagaggctta

SEQ ID NO: 250920 - DNA, 25 bp, Homo sapien
gtatcagaggcttaattttgtattt

SEQ ID NO: 250921 - DNA, 25 bp, Homo sapien
tttatggagctattctaacttgtta

SEQ ID NO: 250922 - DNA, 25 bp, Homo sapien
ggtattaaacttgaagcaaacttct

SEQ ID NO: 250923 - DNA, 25 bp, Homo sapien
tgacctcaaccactgaacttcaaac

SEQ ID NO: 250924 - DNA, 25 bp, Homo sapien
acctaagggttcgacagacactttg

SEQ ID NO: 250925 - DNA, 25 bp, Homo sapien
ttgggctgtggcaagctacactctg

SEQ ID NO: 250926 - DNA, 25 bp, Homo sapien
accctgctagcctttgaacttggaa

SEQ ID NO: 250927 - DNA, 25 bp, Homo sapien
tgaacttggaagcatcgcccacaaa

SEQ ID NO: 250928 - DNA, 25 bp, Homo sapien
agtgccaccctctagccttgaggga

SEQ ID NO: 250929 - DNA, 25 bp, Homo sapien
gccttgagggaccatatatgtctct

SEQ ID NO: 250930 - DNA, 25 bp, Homo sapien
catatatgtctctgtgaatctccgt

SEQ ID NO: 250931 - DNA, 25 bp, Homo sapien
caagaacttggactgtagtcttccc

SEQ ID NO: 250932 - DNA, 25 bp, Homo sapien
gtgacatcacaccttatcagatcct

SEQ ID NO: 250933 - DNA, 25 bp, Homo sapien
gatcctacgagtgagctactgacct

SEQ ID NO: 250934 - DNA, 25 bp, Homo sapien
ggtatttaagaatgagcatccgctt

SEQ ID NO: 250935 - DNA, 25 bp, Homo sapien
tgagcatccgcttcaatgtcatctg

SEQ ID NO: 250936 - DNA, 25 bp, Homo sapien
aatgtcatctgcctccacattgtat

SEQ ID NO: 250937 - DNA, 25 bp, Homo sapien
atctgcctccacattgtatttaata

SEQ ID NO: 250938 - DNA, 25 bp, Homo sapien
aattgtttgggaatcctggtattga

SEQ ID NO: 250939 - DNA, 25 bp, Homo sapien
ggaatcctggtattgatgtattact

SEQ ID NO: 250940 - DNA, 25 bp, Homo sapien
ttaaagcccaagattcccttcatac

SEQ ID NO: 250941 - DNA, 25 bp, Homo sapien
aagattcccttcatacctgtgtgac

SEQ ID NO: 250942 - DNA, 25 bp, Homo sapien
cctgtgtgaccaaatccatgtttct

SEQ ID NO: 250943 - DNA, 25 bp, Homo sapien
tcgaaagaatcttcctagaaaagct

SEQ ID NO: 250944 - DNA, 25 bp, Homo sapien
tcaattcatcatgtattttgttcat

SEQ ID NO: 250945 - DNA, 25 bp, Homo sapien
aatacaacagaatgtggccaccact

SEQ ID NO: 250946 - DNA, 25 bp, Homo sapien
tgtggccaccactgatggataatgg

SEQ ID NO: 250947 - DNA, 25 bp, Homo sapien
ggccaccactgatggataatggata

SEQ ID NO: 250948 - DNA, 25 bp, Homo sapien
atatgcacatgtatgcactgtgtct

SEQ ID NO: 250949 - DNA, 25 bp, Homo sapien
gcacatgtatgcactgtgtctacag

SEQ ID NO: 250950 - DNA, 25 bp, Homo sapien
acatgtatgcactgtgtctacagca

SEQ ID NO: 250951 - DNA, 25 bp, Homo sapien
aaggaatgagtgaggccacgtgcaa

SEQ ID NO: 250952 - DNA, 25 bp, Homo sapien
acgtgcaacaaccttgactcttggg

SEQ ID NO: 250953 - DNA, 25 bp, Homo sapien
tgcaacaaccttgactcttgggagc

SEQ ID NO: 250954 - DNA, 25 bp, Homo sapien
tgactcttgggagcttggagttgaa

SEQ ID NO: 250955 - DNA, 25 bp, Homo sapien
ctcttgggagcttggagttgaagtt

SEQ ID NO: 250956 - DNA, 25 bp, Homo sapien
ccagtagtcatagtagtccggccga

SEQ ID NO: 250957 - DNA, 25 bp, Homo sapien
ggcccttcacggagtgtgcgtagtt

SEQ ID NO: 250958 - DNA, 25 bp, Homo sapien
ggtactactactaccagtaatgact

SEQ ID NO: 250959 - DNA, 25 bp, Homo sapien
cagtaatgactgagacccactccag

SEQ ID NO: 250960 - DNA, 25 bp, Homo sapien
gcctggcggacccaattcatggtat

SEQ ID NO: 250961 - DNA, 25 bp, Homo sapien
gacccaattcatggtatagccgcta

SEQ ID NO: 250962 - DNA, 25 bp, Homo sapien
gtatagccgctaaaggtgaaaccag

SEQ ID NO: 250963 - DNA, 25 bp, Homo sapien
agtagtccggccgacgatcaactat

SEQ ID NO: 250964 - DNA, 25 bp, Homo sapien
ggccgacgatcaactattccaggtc

SEQ ID NO: 250965 - DNA, 25 bp, Homo sapien
attccaggtccttcgcgcagtaata

SEQ ID NO: 250966 - DNA, 25 bp, Homo sapien
gtccttcgcgcagtaatatacggcc

SEQ ID NO: 250967 - DNA, 25 bp, Homo sapien
agggccctcactgtgtggtctctgg

SEQ ID NO: 250968 - DNA, 25 bp, Homo sapien
ggccctcactgtgtggtctctggag

SEQ ID NO: 250969 - DNA, 25 bp, Homo sapien
ggagctgaccaccagttggtcccag

SEQ ID NO: 250970 - DNA, 25 bp, Homo sapien
tgaccttggcccagaatccaccagg

SEQ ID NO: 250971 - DNA, 25 bp, Homo sapien
ttggcccagaatccaccagggcagg

SEQ ID NO: 250972 - DNA, 25 bp, Homo sapien
gggtgtgagggcctacctctcacct

SEQ ID NO: 250973 - DNA, 25 bp, Homo sapien
tgtgagggcctacctctcacctggg

SEQ ID NO: 250974 - DNA, 25 bp, Homo sapien
tggatgcctccccttcagcactggg

SEQ ID NO: 250975 - DNA, 25 bp, Homo sapien
cacagaggctagagggtgtcacaga

SEQ ID NO: 250976 - DNA, 25 bp, Homo sapien
gagctgcaaaggaacagccagcctg

SEQ ID NO: 250977 - DNA, 25 bp, Homo sapien
tgcaaaggaacagccagcctgtgtg

SEQ ID NO: 250978 - DNA, 25 bp, Homo sapien
aacaacttctgcttcccacattcaa

SEQ ID NO: 250979 - DNA, 25 bp, Homo sapien
acaacttctgcttcccacattcaag

SEQ ID NO: 250980 - DNA, 25 bp, Homo sapien
ttctgcttcccacattcaagcgatc

SEQ ID NO: 250981 - DNA, 25 bp, Homo sapien
atgcatgggatggagaaggattcaa

SEQ ID NO: 250982 - DNA, 25 bp, Homo sapien
gagaaggattcaacatttaatggca

SEQ ID NO: 250983 - DNA, 25 bp, Homo sapien
ggattcaacatttaatggcagttag

SEQ ID NO: 250984 - DNA, 25 bp, Homo sapien
tcaacatttaatggcagttagaatc

SEQ ID NO: 250985 - DNA, 25 bp, Homo sapien
atggcagttagaatcaaatttttaa

SEQ ID NO: 250986 - DNA, 25 bp, Homo sapien
gttagaatcaaatttttaactcaag

SEQ ID NO: 250987 - DNA, 25 bp, Homo sapien
tccagtggccaatagaatggagtgt

SEQ ID NO: 250988 - DNA, 25 bp, Homo sapien
agtggccaatagaatggagtgtagt

SEQ ID NO: 250989 - DNA, 25 bp, Homo sapien
aagacaaagtgctcagcgtccacac

SEQ ID NO: 250990 - DNA, 25 bp, Homo sapien
acaaagtgctcagcgtccacacaga

SEQ ID NO: 250991 - DNA, 25 bp, Homo sapien
agaccctgtccacctctataagaac

SEQ ID NO: 250992 - DNA, 25 bp, Homo sapien
acctctataagaactggatcaacca

SEQ ID NO: 250993 - DNA, 25 bp, Homo sapien
agcgcagccatctcccatatgatgt

SEQ ID NO: 250994 - DNA, 25 bp, Homo sapien
agagacgactggacatcgccctacg

SEQ ID NO: 250995 - DNA, 25 bp, Homo sapien
gacgactggacatcgccctacgcaa

SEQ ID NO: 250996 - DNA, 25 bp, Homo sapien
tcctcgccatgactgataagttcct

SEQ ID NO: 250997 - DNA, 25 bp, Homo sapien
gataagttccttttagccatcacct

SEQ ID NO: 250998 - DNA, 25 bp, Homo sapien
ttttagccatcacctcatctgtgga

SEQ ID NO: 250999 - DNA, 25 bp, Homo sapien
tcatctgtggaccaaattccgtatg

SEQ ID NO: 251000 - DNA, 25 bp, Homo sapien
tttcaaatcacactgaaggttcagc

SEQ ID NO: 251001 - DNA, 25 bp, Homo sapien
actgaaggttcagccgtactccttt

SEQ ID NO: 251002 - DNA, 25 bp, Homo sapien
gaaggttcagccgtactcctttcat

SEQ ID NO: 251003 - DNA, 25 bp, Homo sapien
ttcagccgtactcctttcatgtttg

SEQ ID NO: 251004 - DNA, 25 bp, Homo sapien
agccgtactcctttcatgtttggtt

SEQ ID NO: 251005 - DNA, 25 bp, Homo sapien
gtactcctttcatgtttggtttaat

SEQ ID NO: 251006 - DNA, 25 bp, Homo sapien
ttcatgtttggtttaatactgttgt

SEQ ID NO: 251007 - DNA, 25 bp, Homo sapien
ttggtactgtaaaacaccttttcag

SEQ ID NO: 251008 - DNA, 25 bp, Homo sapien
ctgtaaaacaccttttcagaatgag

SEQ ID NO: 251009 - DNA, 25 bp, Homo sapien
aatttatatcattggtggtttcaaa

SEQ ID NO: 251010 - DNA, 25 bp, Homo sapien
ggctaaagcccaaagtaccagtgtc

SEQ ID NO: 251011 - DNA, 25 bp, Homo sapien
gccatctgtactggagcctggacaa

SEQ ID NO: 251012 - DNA, 25 bp, Homo sapien
tggagcctggacaaaccactggtct

SEQ ID NO: 251013 - DNA, 25 bp, Homo sapien
agcctcacatttccctggcaaggag

SEQ ID NO: 251014 - DNA, 25 bp, Homo sapien
ggcttggcctgggaccttgtaactt

SEQ ID NO: 251015 - DNA, 25 bp, Homo sapien
agagagaggtttagccatgtcctgg

SEQ ID NO: 251016 - DNA, 25 bp, Homo sapien
atgtcctgggtctaggattacagcc

SEQ ID NO: 251017 - DNA, 25 bp, Homo sapien
gggcacttaagaagacctggtcatt

SEQ ID NO: 251018 - DNA, 25 bp, Homo sapien
ggtcattggtccagacttgggccaa

SEQ ID NO: 251019 - DNA, 25 bp, Homo sapien
ggaccttgtaacttccttgcaagtt

SEQ ID NO: 251020 - DNA, 25 bp, Homo sapien
gagctatcctgtcacggttttatgt

SEQ ID NO: 251021 - DNA, 25 bp, Homo sapien
aagctgggactctgttttacagcca

SEQ ID NO: 251022 - DNA, 25 bp, Homo sapien
gagcaataagtttctctcactcaaa

SEQ ID NO: 251023 - DNA, 25 bp, Homo sapien
aataagtttctctcactcaaatgtg

SEQ ID NO: 251024 - DNA, 25 bp, Homo sapien
tttctctcactcaaatgtgggcggg

SEQ ID NO: 251025 - DNA, 25 bp, Homo sapien
ggcgggcctagcctgtcgctggtgg

SEQ ID NO: 251026 - DNA, 25 bp, Homo sapien
gggaggtctgcaaatcgtccaactc

SEQ ID NO: 251027 - DNA, 25 bp, Homo sapien
aggtctgcaaatcgtccaactctgg

SEQ ID NO: 251028 - DNA, 25 bp, Homo sapien
gcaaatcgtccaactctggtgctaa

SEQ ID NO: 251029 - DNA, 25 bp, Homo sapien
atcgtccaactctggtgctaatggc

SEQ ID NO: 251030 - DNA, 25 bp, Homo sapien
aactctggtgctaatggcgggtctt

SEQ ID NO: 251031 - DNA, 25 bp, Homo sapien
tctggtgctaatggcgggtcttctc

SEQ ID NO: 251032 - DNA, 25 bp, Homo sapien
tgctaatggcgggtcttctcagccc

SEQ ID NO: 251033 - DNA, 25 bp, Homo sapien
tgccgacctaattttcactgacagc

SEQ ID NO: 251034 - DNA, 25 bp, Homo sapien
gacagcaaactttatattcctttgg

SEQ ID NO: 251035 - DNA, 25 bp, Homo sapien
tggagtatcgttctatttctctagc

SEQ ID NO: 251036 - DNA, 25 bp, Homo sapien
gtatttgtagaagggtcaacgccac

SEQ ID NO: 251037 - DNA, 25 bp, Homo sapien
tgtagaagggtcaacgccaccgcct

SEQ ID NO: 251038 - DNA, 25 bp, Homo sapien
tggccatcatcccaggtagagctgc

SEQ ID NO: 251039 - DNA, 25 bp, Homo sapien
atcatcccaggtagagctgccctct

SEQ ID NO: 251040 - DNA, 25 bp, Homo sapien
ttttctcatcctgcaaagcaagggt

SEQ ID NO: 251041 - DNA, 25 bp, Homo sapien
tcctgcaaagcaagggtgttggagc

SEQ ID NO: 251042 - DNA, 25 bp, Homo sapien
ggaaacaggcctttcggaggctcct

SEQ ID NO: 251043 - DNA, 25 bp, Homo sapien
ggaggctcctcatccctcggaggtc

SEQ ID NO: 251044 - DNA, 25 bp, Homo sapien
accctgcactcccaaagattttgtg

SEQ ID NO: 251045 - DNA, 25 bp, Homo sapien
agattttgtgcagatgggtagttcc

SEQ ID NO: 251046 - DNA, 25 bp, Homo sapien
gtgcagatatggaaaattgtgactt

SEQ ID NO: 251047 - DNA, 25 bp, Homo sapien
aaattgtgacttacttcatgaccag

SEQ ID NO: 251048 - DNA, 25 bp, Homo sapien
ttgtgacttacttcatgaccagaac

SEQ ID NO: 251049 - DNA, 25 bp, Homo sapien
gtgacttacttcatgaccagaacta

SEQ ID NO: 251050 - DNA, 25 bp, Homo sapien
tacttcatgaccagaactatctaga

SEQ ID NO: 251051 - DNA, 25 bp, Homo sapien
cagaactatctagaatatgtgtggg

SEQ ID NO: 251052 - DNA, 25 bp, Homo sapien
gggtataaacatcttgcttaaccaa

SEQ ID NO: 251053 - DNA, 25 bp, Homo sapien
atcttgcttaaccaaatatctatgt

SEQ ID NO: 251054 - DNA, 25 bp, Homo sapien
aatatctatgtaggcagaggtaacc

SEQ ID NO: 251055 - DNA, 25 bp, Homo sapien
aagatcgaatttcacattgtagaga

SEQ ID NO: 251056 - DNA, 25 bp, Homo sapien
tgtagagatgtatagctgtgattaa

SEQ ID NO: 251057 - DNA, 25 bp, Homo sapien
ctgtgattaagctgcatatgtatgc

SEQ ID NO: 251058 - DNA, 25 bp, Homo sapien
atgtatgctgggaaacggcttgagt

SEQ ID NO: 251059 - DNA, 25 bp, Homo sapien
acacctctcatctgcttgaaatatg

SEQ ID NO: 251060 - DNA, 25 bp, Homo sapien
gcttgaaatatggaccagtattcta

SEQ ID NO: 251061 - DNA, 25 bp, Homo sapien
gtattctaaaatatcagctactggg

SEQ ID NO: 251062 - DNA, 25 bp, Homo sapien
gggtctcattcactacaagataaat

SEQ ID NO: 251063 - DNA, 25 bp, Homo sapien
gggactgtgtctgcaaactctcttg

SEQ ID NO: 251064 - DNA, 25 bp, Homo sapien
tgcaaactctcttgtcttcacagac

SEQ ID NO: 251065 - DNA, 25 bp, Homo sapien
ctctcttgtcttcacagacgcctaa

SEQ ID NO: 251066 - DNA, 25 bp, Homo sapien
gtcgaaacacgataaattgccaata

SEQ ID NO: 251067 - DNA, 25 bp, Homo sapien
gcaaattgcaggtcgttaacgcttt

SEQ ID NO: 251068 - DNA, 25 bp, Homo sapien
gttaacgctttagaacgacacattt

SEQ ID NO: 251069 - DNA, 25 bp, Homo sapien
agaacgacacatttctgtatcgccc

SEQ ID NO: 251070 - DNA, 25 bp, Homo sapien
tgtatcgccccgtgaagagctctac

SEQ ID NO: 251071 - DNA, 25 bp, Homo sapien
gagctctacgcacatgaatgttccc

SEQ ID NO: 251072 - DNA, 25 bp, Homo sapien
gaatgttccccgtctgtttaactgt

SEQ ID NO: 251073 - DNA, 25 bp, Homo sapien
gtttaactgttacggccgcagtgtg

SEQ ID NO: 251074 - DNA, 25 bp, Homo sapien
gccgacaattaacaatgactcaccg

SEQ ID NO: 251075 - DNA, 25 bp, Homo sapien
tgactcaccgagcagcagattcttt

SEQ ID NO: 251076 - DNA, 25 bp, Homo sapien
gcagattctttgcacacatccataa

SEQ ID NO: 251077 - DNA, 25 bp, Homo sapien
ataaaaagatgggagtctcacctgt

SEQ ID NO: 251078 - DNA, 25 bp, Homo sapien
gggagtctcacctgtgttgcttagg

SEQ ID NO: 251079 - DNA, 25 bp, Homo sapien
tggcctccagtgatgttcctgcctt

SEQ ID NO: 251080 - DNA, 25 bp, Homo sapien
gcctccagtgatgttcctgccttgg

SEQ ID NO: 251081 - DNA, 25 bp, Homo sapien
acacccagccagtaatctttagctt

SEQ ID NO: 251082 - DNA, 25 bp, Homo sapien
gcaattaggtttagaggagctcact

SEQ ID NO: 251083 - DNA, 25 bp, Homo sapien
ggtttagaggagctcacttgctttt

SEQ ID NO: 251084 - DNA, 25 bp, Homo sapien
ttagaggagctcacttgctttttca

SEQ ID NO: 251085 - DNA, 25 bp, Homo sapien
cttgctttttcaaatatgggttgga

SEQ ID NO: 251086 - DNA, 25 bp, Homo sapien
aaagagttttgcctctacaatgaaa

SEQ ID NO: 251087 - DNA, 25 bp, Homo sapien
aaatgatttttaccagattatggaa

SEQ ID NO: 251088 - DNA, 25 bp, Homo sapien
ctttggctcagaaaactcatttggg

SEQ ID NO: 251089 - DNA, 25 bp, Homo sapien
ggaaattctcttttgtgttcagttt

SEQ ID NO: 251090 - DNA, 25 bp, Homo sapien
tcagtttaacctagaaaggtcctct

SEQ ID NO: 251091 - DNA, 25 bp, Homo sapien
taagccaggctttgacgtgaattat

SEQ ID NO: 251092 - DNA, 25 bp, Homo sapien
gacgtgaattatcacttttctttat

SEQ ID NO: 251093 - DNA, 25 bp, Homo sapien
gtttatagctatttctggttcagtt

SEQ ID NO: 251094 - DNA, 25 bp, Homo sapien
ggttcagttctgaacttcagcactt

SEQ ID NO: 251095 - DNA, 25 bp, Homo sapien
gaacttcagcacttaatcatcctta

SEQ ID NO: 251096 - DNA, 25 bp, Homo sapien
gcacttaatcatccttatcaaccag

SEQ ID NO: 251097 - DNA, 25 bp, Homo sapien
atcatccttatcaaccaggcttttg

SEQ ID NO: 251098 - DNA, 25 bp, Homo sapien
tcaaccaggcttttggtagcctaaa

SEQ ID NO: 251099 - DNA, 25 bp, Homo sapien
gttcttaaaacttctctgagccttg

SEQ ID NO: 251100 - DNA, 25 bp, Homo sapien
gattttctcatctgcatgatggatt

SEQ ID NO: 251101 - DNA, 25 bp, Homo sapien
ttttataggttgaccactcgtcctg

SEQ ID NO: 251102 - DNA, 25 bp, Homo sapien
tcgtcctggtttgcctgagactgaa

SEQ ID NO: 251103 - DNA, 25 bp, Homo sapien
gggacacagaacttccagtgctaaa

SEQ ID NO: 251104 - DNA, 25 bp, Homo sapien
acaacatgatggacagagcacggat

SEQ ID NO: 251105 - DNA, 25 bp, Homo sapien
gaaaatcccaggcatatcaagatga

SEQ ID NO: 251106 - DNA, 25 bp, Homo sapien
gagcacggattttctgagggataca

SEQ ID NO: 251107 - DNA, 25 bp, Homo sapien
tctgagggatacagccaggtcccac

SEQ ID NO: 251108 - DNA, 25 bp, Homo sapien
tcccacccctaattagcttcttgag

SEQ ID NO: 251109 - DNA, 25 bp, Homo sapien
gcttcttgagctcagctaagttctt

SEQ ID NO: 251110 - DNA, 25 bp, Homo sapien
gaaaacggctggagagtttgcccaa

SEQ ID NO: 251111 - DNA, 25 bp, Homo sapien
ggagagtttgcccaaagccctgtac

SEQ ID NO: 251112 - DNA, 25 bp, Homo sapien
agctcctcgtgttgggactgcgctg

SEQ ID NO: 251113 - DNA, 25 bp, Homo sapien
tgtccacccagaagacacagggcta

SEQ ID NO: 251114 - DNA, 25 bp, Homo sapien
agacacagggctacctttctgagga

SEQ ID NO: 251115 - DNA, 25 bp, Homo sapien
tttctgaggacacctccatgaacag

SEQ ID NO: 251116 - DNA, 25 bp, Homo sapien
agcctgcccttctgttcatggaaga

SEQ ID NO: 251117 - DNA, 25 bp, Homo sapien
tctgttcatggaagaaggccgctgc

SEQ ID NO: 251118 - DNA, 25 bp, Homo sapien
aggacacaacgctccgctactggga

SEQ ID NO: 251119 - DNA, 25 bp, Homo sapien
agcgcagacgctcagtccaacagag

SEQ ID NO: 251120 - DNA, 25 bp, Homo sapien
aacagagcgtcattgtgaaccagaa

SEQ ID NO: 251121 - DNA, 25 bp, Homo sapien
gaggcagacaaacaggccaatccgg

SEQ ID NO: 251122 - DNA, 25 bp, Homo sapien
gaaagctctacaatgaggcagattt

SEQ ID NO: 251123 - DNA, 25 bp, Homo sapien
gcagattttttaatacccactcctt

SEQ ID NO: 251124 - DNA, 25 bp, Homo sapien
caagtccttcagctcaagctgcagc

SEQ ID NO: 251125 - DNA, 25 bp, Homo sapien
caaatatttgcataaagagctggta

SEQ ID NO: 251126 - DNA, 25 bp, Homo sapien
agcttcctggttcatgacattacag

SEQ ID NO: 251127 - DNA, 25 bp, Homo sapien
cattacagcatggatcgttttcaaa

SEQ ID NO: 251128 - DNA, 25 bp, Homo sapien
cagcatggatcgttttcaaaattaa

SEQ ID NO: 251129 - DNA, 25 bp, Homo sapien
gtgaacccatgactagaaagataat

SEQ ID NO: 251130 - DNA, 25 bp, Homo sapien
ggatattgtaaacacacctcaggga

SEQ ID NO: 251131 - DNA, 25 bp, Homo sapien
acacacctcagggagataacatggg

SEQ ID NO: 251132 - DNA, 25 bp, Homo sapien
tggcctccagtgatgttcctgcctt

SEQ ID NO: 251133 - DNA, 25 bp, Homo sapien
gcctccagtgatgttcctgccttgg

SEQ ID NO: 251134 - DNA, 25 bp, Homo sapien
acacccagccagtaatctttagctt

SEQ ID NO: 251135 - DNA, 25 bp, Homo sapien
gcaattaggtttagaggagctcact

SEQ ID NO: 251136 - DNA, 25 bp, Homo sapien
ggtttagaggagctcacttgctttt

SEQ ID NO: 251137 - DNA, 25 bp, Homo sapien
ttagaggagctcacttgctttttca

SEQ ID NO: 251138 - DNA, 25 bp, Homo sapien
cacttgctttttcaaatatgggttg

SEQ ID NO: 251139 - DNA, 25 bp, Homo sapien
ttgctttttcaaatatgggttggat

SEQ ID NO: 251140 - DNA, 25 bp, Homo sapien
aaaaagagttttgcctctacaatga

SEQ ID NO: 251141 - DNA, 25 bp, Homo sapien
aaagagttttgcctctacaatgaaa

SEQ ID NO: 251142 - DNA, 25 bp, Homo sapien
aaatgatttttaccagattatggaa

SEQ ID NO: 251143 - DNA, 25 bp, Homo sapien
tcccagaccaggagcttcaggtctg

SEQ ID NO: 251144 - DNA, 25 bp, Homo sapien
aggtctgcaggccttcaatcaccaa

SEQ ID NO: 251145 - DNA, 25 bp, Homo sapien
aatcaccaaactccccacgatgttt

SEQ ID NO: 251146 - DNA, 25 bp, Homo sapien
tcgggcaccaaaacaggtcactacc

SEQ ID NO: 251147 - DNA, 25 bp, Homo sapien
aaaacaggtcactacctccctgaag

SEQ ID NO: 251148 - DNA, 25 bp, Homo sapien
aaagaggccagtttctctggagctc

SEQ ID NO: 251149 - DNA, 25 bp, Homo sapien
gagctcattctccaaaagtcatcag

SEQ ID NO: 251150 - DNA, 25 bp, Homo sapien
ccaaaagtcatcagtctagttccag

SEQ ID NO: 251151 - DNA, 25 bp, Homo sapien
aggcctcagggcaaggctactcagg

SEQ ID NO: 251152 - DNA, 25 bp, Homo sapien
aggcctgtgggcatcaattgccagc

SEQ ID NO: 251153 - DNA, 25 bp, Homo sapien
tgggcatcaattgccagcatctcag

SEQ ID NO: 251154 - DNA, 25 bp, Homo sapien
gaaacccagaggcaaaccaaatcta

SEQ ID NO: 251155 - DNA, 25 bp, Homo sapien
cccagaggcaaaccaaatctataaa

SEQ ID NO: 251156 - DNA, 25 bp, Homo sapien
ccaaagagaacttttgtccaaaatg

SEQ ID NO: 251157 - DNA, 25 bp, Homo sapien
tcacccttccaccacttagaaacta

SEQ ID NO: 251158 - DNA, 25 bp, Homo sapien
tttcaaagttgttaatagccaaata

SEQ ID NO: 251159 - DNA, 25 bp, Homo sapien
aatcaccagctatttagaaagtaat

SEQ ID NO: 251160 - DNA, 25 bp, Homo sapien
tattgaattttgttccctagaaaca

SEQ ID NO: 251161 - DNA, 25 bp, Homo sapien
tccctagaaacaaagaatacgcctt

SEQ ID NO: 251162 - DNA, 25 bp, Homo sapien
gaaacaaagaatacgcctttctaat

SEQ ID NO: 251163 - DNA, 25 bp, Homo sapien
agaatacgcctttctaatgtatatt

SEQ ID NO: 251164 - DNA, 25 bp, Homo sapien
tattttgaaacccagaggcaaacca

SEQ ID NO: 251165 - DNA, 25 bp, Homo sapien
tggccttggcgctgggtttccgccc

SEQ ID NO: 251166 - DNA, 25 bp, Homo sapien
agtgtctttgctggtcttccggctg

SEQ ID NO: 251167 - DNA, 25 bp, Homo sapien
ctttgctggtcttccggctgcggcg

SEQ ID NO: 251168 - DNA, 25 bp, Homo sapien
ttggcacttggcaccagaagggccg

SEQ ID NO: 251169 - DNA, 25 bp, Homo sapien
gggacggctcagcacactgtatctt

SEQ ID NO: 251170 - DNA, 25 bp, Homo sapien
ggctcagcacactgtatcttatagt

SEQ ID NO: 251171 - DNA, 25 bp, Homo sapien
agcacactgtatcttatagtcaggg

SEQ ID NO: 251172 - DNA, 25 bp, Homo sapien
gtgtctccgtcgtcaaactccacgg

SEQ ID NO: 251173 - DNA, 25 bp, Homo sapien
gtcgtcaaactccacggtgatcaag

SEQ ID NO: 251174 - DNA, 25 bp, Homo sapien
aactccacggtgatcaagtccccat

SEQ ID NO: 251175 - DNA, 25 bp, Homo sapien
acggtgatcaagtccccatcgtcct

SEQ ID NO: 251176 - DNA, 25 bp, Homo sapien
taatactttgagaaggcttatggta

SEQ ID NO: 251177 - DNA, 25 bp, Homo sapien
taaaacatgttatacccttgaatgg

SEQ ID NO: 251178 - DNA, 25 bp, Homo sapien
tgacattttcaaacagacattccaa

SEQ ID NO: 251179 - DNA, 25 bp, Homo sapien
atcatttccaagtacagtcatccct

SEQ ID NO: 251180 - DNA, 25 bp, Homo sapien
atccctctgtatcagcccggagatt

SEQ ID NO: 251181 - DNA, 25 bp, Homo sapien
gtatcagcccggagattggttctag

SEQ ID NO: 251182 - DNA, 25 bp, Homo sapien
ggagattggttctagtatccccttg

SEQ ID NO: 251183 - DNA, 25 bp, Homo sapien
attggttctagtatccccttggata

SEQ ID NO: 251184 - DNA, 25 bp, Homo sapien
ttggataccaaaattcacacatact

SEQ ID NO: 251185 - DNA, 25 bp, Homo sapien
tcacacatactatttttcctctgct

SEQ ID NO: 251186 - DNA, 25 bp, Homo sapien
ttcctctgcttttaagaattgaagt

SEQ ID NO: 251187 - DNA, 25 bp, Homo sapien
taaaaaagcacctactttaagccat

SEQ ID NO: 251188 - DNA, 25 bp, Homo sapien
ttttttcagcaaggagtcattctgc

SEQ ID NO: 251189 - DNA, 25 bp, Homo sapien
tttttcagcaaggagtcattctgcc

SEQ ID NO: 251190 - DNA, 25 bp, Homo sapien
tattcactattctagactaatagca

SEQ ID NO: 251191 - DNA, 25 bp, Homo sapien
attcactattctagactaatagcaa

SEQ ID NO: 251192 - DNA, 25 bp, Homo sapien
ttcactattctagactaatagcaag

SEQ ID NO: 251193 - DNA, 25 bp, Homo sapien
tcactattctagactaatagcaaga

SEQ ID NO: 251194 - DNA, 25 bp, Homo sapien
tattctagactaatagcaagaccgg

SEQ ID NO: 251195 - DNA, 25 bp, Homo sapien
attctagactaatagcaagaccggg

SEQ ID NO: 251196 - DNA, 25 bp, Homo sapien
tagactaatagcaagaccggggatc

SEQ ID NO: 251197 - DNA, 25 bp, Homo sapien
gactaatagcaagaccggggatctt

SEQ ID NO: 251198 - DNA, 25 bp, Homo sapien
ctcctgaataaacatcattttcttt

SEQ ID NO: 251199 - DNA, 25 bp, Homo sapien
tctctgttatttaggctgacaagga

SEQ ID NO: 251200 - DNA, 25 bp, Homo sapien
gctgacaaggatatgccaagaagta

SEQ ID NO: 251201 - DNA, 25 bp, Homo sapien
gtagcttggatatagcagttaactc

SEQ ID NO: 251202 - DNA, 25 bp, Homo sapien
atagcagttaactctgcctttagga

SEQ ID NO: 251203 - DNA, 25 bp, Homo sapien
gttaactctgcctttaggatatgtg

SEQ ID NO: 251204 - DNA, 25 bp, Homo sapien
gagttaactaaaagctgacctttga

SEQ ID NO: 251205 - DNA, 25 bp, Homo sapien
aaataatgatcctgagctaggagag

SEQ ID NO: 251206 - DNA, 25 bp, Homo sapien
ggagagtacattttgcagacctttg

SEQ ID NO: 251207 - DNA, 25 bp, Homo sapien
tgcagacctttggtttccatattaa

SEQ ID NO: 251208 - DNA, 25 bp, Homo sapien
cagacctttggtttccatattaaga

SEQ ID NO: 251209 - DNA, 25 bp, Homo sapien
aaacaaacaacaatgtgtacttgaa

SEQ ID NO: 251210 - DNA, 25 bp, Homo sapien
atgtgtacttgaaaattgcgaagag

SEQ ID NO: 251211 - DNA, 25 bp, Homo sapien
agagagattttaagtgttttcacaa

SEQ ID NO: 251212 - DNA, 25 bp, Homo sapien
tcacaagtatgtgaggtcatgcata

SEQ ID NO: 251213 - DNA, 25 bp, Homo sapien
gtgaggtcatgcatatgttaatcaa

SEQ ID NO: 251214 - DNA, 25 bp, Homo sapien
ggtcatgcatatgttaatcaacttg

SEQ ID NO: 251215 - DNA, 25 bp, Homo sapien
catgcatatgttaatcaacttgatt

SEQ ID NO: 251216 - DNA, 25 bp, Homo sapien
ttttgaacagtatgttgtacgccat

SEQ ID NO: 251217 - DNA, 25 bp, Homo sapien
gaacagtatgttgtacgccataaat

SEQ ID NO: 251218 - DNA, 25 bp, Homo sapien
cagtatgttgtacgccataaatata

SEQ ID NO: 251219 - DNA, 25 bp, Homo sapien
agtgacccctggtcgcaccactgca

SEQ ID NO: 251220 - DNA, 25 bp, Homo sapien
gaaaacatttttacctcagcaaaag

SEQ ID NO: 251221 - DNA, 25 bp, Homo sapien
gaagcagatgactaccatcttagaa

SEQ ID NO: 251222 - DNA, 25 bp, Homo sapien
aaaaccatctttcttcgtacttcat

SEQ ID NO: 251223 - DNA, 25 bp, Homo sapien
ttcgtacttcatcacaatgtttgga

SEQ ID NO: 251224 - DNA, 25 bp, Homo sapien
gaacaggtagataatttcctagatt

SEQ ID NO: 251225 - DNA, 25 bp, Homo sapien
gacatggatgaagagattaaacccc

SEQ ID NO: 251226 - DNA, 25 bp, Homo sapien
gattaaaccccaaatgagtgaggat

SEQ ID NO: 251227 - DNA, 25 bp, Homo sapien
gagcaggatgtaagcaccagcattc

SEQ ID NO: 251228 - DNA, 25 bp, Homo sapien
ggatgtaagcaccagcattccttcc

SEQ ID NO: 251229 - DNA, 25 bp, Homo sapien
ctgtatcccttttgtggcccagcct

SEQ ID NO: 251230 - DNA, 25 bp, Homo sapien
agcctcctacctgtgaagtgaagcc

SEQ ID NO: 251231 - DNA, 25 bp, Homo sapien
attctctgcaatccaaatgtatcca

SEQ ID NO: 251232 - DNA, 25 bp, Homo sapien
atgtatccattctggctgaagccca

SEQ ID NO: 251233 - DNA, 25 bp, Homo sapien
tgaagcccagccagaatcccgagtg

SEQ ID NO: 251234 - DNA, 25 bp, Homo sapien
agccagaatcccgagtggaagaaac

SEQ ID NO: 251235 - DNA, 25 bp, Homo sapien
tccttctgtttaaacttcaattcca

SEQ ID NO: 251236 - DNA, 25 bp, Homo sapien
aaacttcaattccaaaggtgcacag

SEQ ID NO: 251237 - DNA, 25 bp, Homo sapien
caattccaaaggtgcacagatgtat

SEQ ID NO: 251238 - DNA, 25 bp, Homo sapien
ccaaaggtgcacagatgtattcata

SEQ ID NO: 251239 - DNA, 25 bp, Homo sapien
ctgtggacccatctcagtggagaat

SEQ ID NO: 251240 - DNA, 25 bp, Homo sapien
gagaattcgttttggacccgtggct

SEQ ID NO: 251241 - DNA, 25 bp, Homo sapien
gtgcagctgtggactcgagtgccat

SEQ ID NO: 251242 - DNA, 25 bp, Homo sapien
gtgtcaagggactatgtatacatga

SEQ ID NO: 251243 - DNA, 25 bp, Homo sapien
atagctgaatctttggtgtattgaa

SEQ ID NO: 251244 - DNA, 25 bp, Homo sapien
aataggcagcactctgaaagacaga

SEQ ID NO: 251245 - DNA, 25 bp, Homo sapien
acagaagcttcgtccagccactctt

SEQ ID NO: 251246 - DNA, 25 bp, Homo sapien
actcttcagcacattcctttactaa

SEQ ID NO: 251247 - DNA, 25 bp, Homo sapien
agcacattcctttactaagcagttt

SEQ ID NO: 251248 - DNA, 25 bp, Homo sapien
taagcagtttaaagccgtcctagtg

SEQ ID NO: 251249 - DNA, 25 bp, Homo sapien
gtggagcaagccctaaagcagattt

SEQ ID NO: 251250 - DNA, 25 bp, Homo sapien
ttgccattttccaagaatgacggtg

SEQ ID NO: 251251 - DNA, 25 bp, Homo sapien
gacggtggtggcttttagtcagaaa

SEQ ID NO: 251252 - DNA, 25 bp, Homo sapien
tagtcagaaaatggccttctgtgct

SEQ ID NO: 251253 - DNA, 25 bp, Homo sapien
tctgtgtttggcaagtttctgctca

SEQ ID NO: 251254 - DNA, 25 bp, Homo sapien
agcctccaaagccttaaccaagtgt

SEQ ID NO: 251255 - DNA, 25 bp, Homo sapien
tgtcaccttttctctgcagcatttt

SEQ ID NO: 251256 - DNA, 25 bp, Homo sapien
gaaccagggatcttttacttgggat

SEQ ID NO: 251257 - DNA, 25 bp, Homo sapien
agaagcactgtggacatattgccat

SEQ ID NO: 251258 - DNA, 25 bp, Homo sapien
atggcaaggtttgcactgtcttgga

SEQ ID NO: 251259 - DNA, 25 bp, Homo sapien
aggaaggaagccatattcatccctg

SEQ ID NO: 251260 - DNA, 25 bp, Homo sapien
ccaagggcacgaggcagtacctttg

SEQ ID NO: 251261 - DNA, 25 bp, Homo sapien
agtacctttgctccatgcctttgct

SEQ ID NO: 251262 - DNA, 25 bp, Homo sapien
ttgcttggactagtcctaccaccag

SEQ ID NO: 251263 - DNA, 25 bp, Homo sapien
agcaattcctgcatttctgtgtttg

SEQ ID NO: 251264 - DNA, 25 bp, Homo sapien
attgagttgcttttgttctcttgat

SEQ ID NO: 251265 - DNA, 25 bp, Homo sapien
ttctcttgatttggtctctcttcaa

SEQ ID NO: 251266 - DNA, 25 bp, Homo sapien
tcttcaagttgatgtgggcaataaa

SEQ ID NO: 251267 - DNA, 25 bp, Homo sapien
gagccttgaccaactaaagtccatt

SEQ ID NO: 251268 - DNA, 25 bp, Homo sapien
caactaaagtccatttcagctgagg

SEQ ID NO: 251269 - DNA, 25 bp, Homo sapien
tcagctgaggagatcttgactctct

SEQ ID NO: 251270 - DNA, 25 bp, Homo sapien
ggagatcttgactctcttttgtggg

SEQ ID NO: 251271 - DNA, 25 bp, Homo sapien
caccacctgttacacctattattgt

SEQ ID NO: 251272 - DNA, 25 bp, Homo sapien
tttttcatgatgtgtgtggcagaga

SEQ ID NO: 251273 - DNA, 25 bp, Homo sapien
gtatatgatattccattgagttgct

SEQ ID NO: 251274 - DNA, 25 bp, Homo sapien
tattccattgagttgcttttgttct

SEQ ID NO: 251275 - DNA, 25 bp, Homo sapien
tcgctgtcctcttcagttgcctttg

SEQ ID NO: 251276 - DNA, 25 bp, Homo sapien
ttgcctttgctagggaccggcctgt

SEQ ID NO: 251277 - DNA, 25 bp, Homo sapien
tgtccctttactacctaagtcatcg

SEQ ID NO: 251278 - DNA, 25 bp, Homo sapien
actacctaagtcatcgtcagttcgc

SEQ ID NO: 251279 - DNA, 25 bp, Homo sapien
aagtcatcgtcagttcgcccaactt

SEQ ID NO: 251280 - DNA, 25 bp, Homo sapien
aaatctgcccctcacggtacgcagg

SEQ ID NO: 251281 - DNA, 25 bp, Homo sapien
ctcacggtacgcagggatcgccctt

SEQ ID NO: 251282 - DNA, 25 bp, Homo sapien
tgcctttggactggtccaggtcctc

SEQ ID NO: 251283 - DNA, 25 bp, Homo sapien
ccagtcctggacctactgctactgt

SEQ ID NO: 251284 - DNA, 25 bp, Homo sapien
tactgctactgtccttttatccggt

SEQ ID NO: 251285 - DNA, 25 bp, Homo sapien
tgctactgtccttttatccggtcct

SEQ ID NO: 251286 - DNA, 25 bp, Homo sapien
tatagtaatttgtttcagcagcaac

SEQ ID NO: 251287 - DNA, 25 bp, Homo sapien
gtattgttatctccttccctgagtt

SEQ ID NO: 251288 - DNA, 25 bp, Homo sapien
tatctccttccctgagttttggcag

SEQ ID NO: 251289 - DNA, 25 bp, Homo sapien
gaacctgtctcagagatctattcct

SEQ ID NO: 251290 - DNA, 25 bp, Homo sapien
atctattcctgttctcactgtggtc

SEQ ID NO: 251291 - DNA, 25 bp, Homo sapien
actccttcccctctaatattctatt

SEQ ID NO: 251292 - DNA, 25 bp, Homo sapien
aatattctattcctctacatctgct

SEQ ID NO: 251293 - DNA, 25 bp, Homo sapien
tcctctacatctgcttgggaaagta

SEQ ID NO: 251294 - DNA, 25 bp, Homo sapien
attttagcccagtgacacccttgta

SEQ ID NO: 251295 - DNA, 25 bp, Homo sapien
gacacccttgtaggactttggacct

SEQ ID NO: 251296 - DNA, 25 bp, Homo sapien
ggactttggacctccagatctgtaa

SEQ ID NO: 251297 - DNA, 25 bp, Homo sapien
gatgtcttccagatgggacccagag

SEQ ID NO: 251298 - DNA, 25 bp, Homo sapien
gatgggacccagagtctaaccacaa

SEQ ID NO: 251299 - DNA, 25 bp, Homo sapien
taaccacaaaattcacttgtttcat

SEQ ID NO: 251300 - DNA, 25 bp, Homo sapien
agtatttgtatgttgaatttttcac

SEQ ID NO: 251301 - DNA, 25 bp, Homo sapien
gcatcattatactcaaaaagtttgg

SEQ ID NO: 251302 - DNA, 25 bp, Homo sapien
gggattaggaatgctcaacctatat

SEQ ID NO: 251303 - DNA, 25 bp, Homo sapien
ggaatgctcaacctatatttcattt

SEQ ID NO: 251304 - DNA, 25 bp, Homo sapien
tttttccatggccaaatattccccg

SEQ ID NO: 251305 - DNA, 25 bp, Homo sapien
aaatattccccgtttatccatgtgt

SEQ ID NO: 251306 - DNA, 25 bp, Homo sapien
attccccgtttatccatgtgtccat

SEQ ID NO: 251307 - DNA, 25 bp, Homo sapien
atgtgtccattgacggccatctatg

SEQ ID NO: 251308 - DNA, 25 bp, Homo sapien
gaagagccttgaccaactaaagtcc

SEQ ID NO: 251309 - DNA, 25 bp, Homo sapien
gagccttgaccaactaaagtccatt

SEQ ID NO: 251310 - DNA, 25 bp, Homo sapien
gaccaactaaagtccatttcagctg

SEQ ID NO: 251311 - DNA, 25 bp, Homo sapien
caactaaagtccatttcagctgagg

SEQ ID NO: 251312 - DNA, 25 bp, Homo sapien
aaagtccatttcagctgaggagatc

SEQ ID NO: 251313 - DNA, 25 bp, Homo sapien
gtccatttcagctgaggagatcttg

SEQ ID NO: 251314 - DNA, 25 bp, Homo sapien
tttcagctgaggagatcttgactct

SEQ ID NO: 251315 - DNA, 25 bp, Homo sapien
agctgaggagatcttgactctcttt

SEQ ID NO: 251316 - DNA, 25 bp, Homo sapien
gggcaccacctgttacacctattat

SEQ ID NO: 251317 - DNA, 25 bp, Homo sapien
caccacctgttacacctattattgt

SEQ ID NO: 251318 - DNA, 25 bp, Homo sapien
ccacctgttacacctattattgttt

SEQ ID NO: 251319 - DNA, 25 bp, Homo sapien
gtatcactagtttgaagtaaaccca

SEQ ID NO: 251320 - DNA, 25 bp, Homo sapien
gtaaacccatctggaattactgatt

SEQ ID NO: 251321 - DNA, 25 bp, Homo sapien
acccatctggaattactgattttaa

SEQ ID NO: 251322 - DNA, 25 bp, Homo sapien
gaatttcaagcacctttctatgcaa

SEQ ID NO: 251323 - DNA, 25 bp, Homo sapien
gcacctttctatgcaaatgacttgt

SEQ ID NO: 251324 - DNA, 25 bp, Homo sapien
atagagtatagtatgccgttaacaa

SEQ ID NO: 251325 - DNA, 25 bp, Homo sapien
gtatgccgttaacaaacagcccagc

SEQ ID NO: 251326 - DNA, 25 bp, Homo sapien
agagaagttctctactttgggctgc

SEQ ID NO: 251327 - DNA, 25 bp, Homo sapien
aagttctctactttgggctgcggtt

SEQ ID NO: 251328 - DNA, 25 bp, Homo sapien
tctactttgggctgcggtttcaggc

SEQ ID NO: 251329 - DNA, 25 bp, Homo sapien
gctgcggtttcaggctttttggctt

SEQ ID NO: 251330 - DNA, 25 bp, Homo sapien
gaaaatctatgactgtattaccaag

SEQ ID NO: 251331 - DNA, 25 bp, Homo sapien
aaaatctatgactgtattaccaagc

SEQ ID NO: 251332 - DNA, 25 bp, Homo sapien
aaatctatgactgtattaccaagct

SEQ ID NO: 251333 - DNA, 25 bp, Homo sapien
aatctatgactgtattaccaagctt

SEQ ID NO: 251334 - DNA, 25 bp, Homo sapien
atctatgactgtattaccaagctta

SEQ ID NO: 251335 - DNA, 25 bp, Homo sapien
ctatgactgtattaccaagcttaag

SEQ ID NO: 251336 - DNA, 25 bp, Homo sapien
tatgactgtattaccaagcttaaga

SEQ ID NO: 251337 - DNA, 25 bp, Homo sapien
atgactgtattaccaagcttaagaa

SEQ ID NO: 251338 - DNA, 25 bp, Homo sapien
tgactgtattaccaagcttaagaaa

SEQ ID NO: 251339 - DNA, 25 bp, Homo sapien
gactgtattaccaagcttaagaaat

SEQ ID NO: 251340 - DNA, 25 bp, Homo sapien
aataaaacagttgagtgatctctca

SEQ ID NO: 251341 - DNA, 25 bp, Homo sapien
accagcgtggctttgaaggatgtat

SEQ ID NO: 251342 - DNA, 25 bp, Homo sapien
attctgttactctttgttggaccca

SEQ ID NO: 251343 - DNA, 25 bp, Homo sapien
gttactctttgttggacccacacaa

SEQ ID NO: 251344 - DNA, 25 bp, Homo sapien
acccacacaactcagcagttgaaat

SEQ ID NO: 251345 - DNA, 25 bp, Homo sapien
ttttctcctgcgttttcatctccta

SEQ ID NO: 251346 - DNA, 25 bp, Homo sapien
gttttcatctcctaatttgggctcc

SEQ ID NO: 251347 - DNA, 25 bp, Homo sapien
atttgggctccccttcatatagagc

SEQ ID NO: 251348 - DNA, 25 bp, Homo sapien
tccccttcatatagagcttttggaa

SEQ ID NO: 251349 - DNA, 25 bp, Homo sapien
gaattcaagttcatcaggcacattt

SEQ ID NO: 251350 - DNA, 25 bp, Homo sapien
aaatggaggtcagcttaggccagtt

SEQ ID NO: 251351 - DNA, 25 bp, Homo sapien
agcttaggccagttggttcacatgg

SEQ ID NO: 251352 - DNA, 25 bp, Homo sapien
tacctcctgtcttgctggatgaggt

SEQ ID NO: 251353 - DNA, 25 bp, Homo sapien
gtcttgctggatgaggtctctcctg

SEQ ID NO: 251354 - DNA, 25 bp, Homo sapien
ctctcctgtggctctacttttatat

SEQ ID NO: 251355 - DNA, 25 bp, Homo sapien
gtggctctacttttatatcatattc

SEQ ID NO: 251356 - DNA, 25 bp, Homo sapien
tatatcatattcttccttggattat

SEQ ID NO: 251357 - DNA, 25 bp, Homo sapien
gttatttgcataccttacgcatttg

SEQ ID NO: 251358 - DNA, 25 bp, Homo sapien
acgcatttgtatctactcaactgag

SEQ ID NO: 251359 - DNA, 25 bp, Homo sapien
ctcaactgagtgtgtttaatgtcca

SEQ ID NO: 251360 - DNA, 25 bp, Homo sapien
ttaatgtccagaaatcagatgccta

SEQ ID NO: 251361 - DNA, 25 bp, Homo sapien
taggtggaagttcagcccttcatct

SEQ ID NO: 251362 - DNA, 25 bp, Homo sapien
ttcagcccttcatctctcatttcat

SEQ ID NO: 251363 - DNA, 25 bp, Homo sapien
tccaggtatagagaaccatccagat

SEQ ID NO: 251364 - DNA, 25 bp, Homo sapien
atatctaatgatgcaaagttttatt

SEQ ID NO: 251365 - DNA, 25 bp, Homo sapien
tcttgaacttggacactgatgccat

SEQ ID NO: 251366 - DNA, 25 bp, Homo sapien
aacttggacactgatgccatcaaac

SEQ ID NO: 251367 - DNA, 25 bp, Homo sapien
gatttaatgcagatgaacatatttc

SEQ ID NO: 251368 - DNA, 25 bp, Homo sapien
ttctattttaagtaacgggaatctg

SEQ ID NO: 251369 - DNA, 25 bp, Homo sapien
aacgggaatctgtaagaatgtttgc

SEQ ID NO: 251370 - DNA, 25 bp, Homo sapien
gaatgtttgcttgagatatggttaa

SEQ ID NO: 251371 - DNA, 25 bp, Homo sapien
gcttgagatatggttaacttttttc

SEQ ID NO: 251372 - DNA, 25 bp, Homo sapien
cttttgttggttttgacttagatgg

SEQ ID NO: 251373 - DNA, 25 bp, Homo sapien
gatggacaccatgagatgttaatat

SEQ ID NO: 251374 - DNA, 25 bp, Homo sapien
acagttcaagttagcctaccagttg

SEQ ID NO: 251375 - DNA, 25 bp, Homo sapien
cagttggaatgtggatcagtgtttt

SEQ ID NO: 251376 - DNA, 25 bp, Homo sapien
aatgcactcatttacctttacatgg

SEQ ID NO: 251377 - DNA, 25 bp, Homo sapien
ggtgaaagttctctcttgatcctac

SEQ ID NO: 251378 - DNA, 25 bp, Homo sapien
agttctctcttgatcctacaaacag

SEQ ID NO: 251379 - DNA, 25 bp, Homo sapien
aacagacattttccactcgtgtttc

SEQ ID NO: 251380 - DNA, 25 bp, Homo sapien
ttccactcgtgtttccatagttgtt

SEQ ID NO: 251381 - DNA, 25 bp, Homo sapien
gtttccatagttgttaagtgtatca

SEQ ID NO: 251382 - DNA, 25 bp, Homo sapien
gatgtgttgggcatgtgaatctcca

SEQ ID NO: 251383 - DNA, 25 bp, Homo sapien
atgtgaatctccaagtgcctgtgta

SEQ ID NO: 251384 - DNA, 25 bp, Homo sapien
gaatctccaagtgcctgtgtaataa

SEQ ID NO: 251385 - DNA, 25 bp, Homo sapien
ggtggtccgcgctctaggaaaagat

SEQ ID NO: 251386 - DNA, 25 bp, Homo sapien
tggtccgcgctctaggaaaagatat

SEQ ID NO: 251387 - DNA, 25 bp, Homo sapien
gtccgcgctctaggaaaagatatga

SEQ ID NO: 251388 - DNA, 25 bp, Homo sapien
aaaagatatgaatggcctgggtggc

SEQ ID NO: 251389 - DNA, 25 bp, Homo sapien
gccggcgtgcggcaggcgggacact

SEQ ID NO: 251390 - DNA, 25 bp, Homo sapien
caggcgggacactcgggctcgctct

SEQ ID NO: 251391 - DNA, 25 bp, Homo sapien
actcgggctcgctcttgccgcagat

SEQ ID NO: 251392 - DNA, 25 bp, Homo sapien
tcttgccgcagatgcggacggcgca

SEQ ID NO: 251393 - DNA, 25 bp, Homo sapien
tgcggacggcgcagtccatgcagaa

SEQ ID NO: 251394 - DNA, 25 bp, Homo sapien
cggacggcgcagtccatgcagaaga

SEQ ID NO: 251395 - DNA, 25 bp, Homo sapien
gatggccccggccacgtggtggtcc

SEQ ID NO: 251396 - DNA, 25 bp, Homo sapien
gatagtctaaggaactcatttgatt

SEQ ID NO: 251397 - DNA, 25 bp, Homo sapien
gagtagaacgcacaagtgtctgtta

SEQ ID NO: 251398 - DNA, 25 bp, Homo sapien
tacttgagagtcctatatgcactgt

SEQ ID NO: 251399 - DNA, 25 bp, Homo sapien
gtcctatatgcactgttatccacaa

SEQ ID NO: 251400 - DNA, 25 bp, Homo sapien
gttatccacaaccatttaagcactt

SEQ ID NO: 251401 - DNA, 25 bp, Homo sapien
tttaagcacttatccactaatccct

SEQ ID NO: 251402 - DNA, 25 bp, Homo sapien
gcacttatccactaatccctaataa

SEQ ID NO: 251403 - DNA, 25 bp, Homo sapien
accagttattcaagctacatcctcc

SEQ ID NO: 251404 - DNA, 25 bp, Homo sapien
gctacatcctcccaagattggactt

SEQ ID NO: 251405 - DNA, 25 bp, Homo sapien
gattggactttgtttctactttggt

SEQ ID NO: 251406 - DNA, 25 bp, Homo sapien
tctactttggtagggacataaataa

SEQ ID NO: 251407 - DNA, 25 bp, Homo sapien
atcttgtttaggaagaagcagtccc

SEQ ID NO: 251408 - DNA, 25 bp, Homo sapien
aagaagcagtccctgttctccagaa

SEQ ID NO: 251409 - DNA, 25 bp, Homo sapien
agaagcagtccctgttctccagaat

SEQ ID NO: 251410 - DNA, 25 bp, Homo sapien
ttcagcaaggagtcattctgccaga

SEQ ID NO: 251411 - DNA, 25 bp, Homo sapien
atgtagtacacaaatacaggataat

SEQ ID NO: 251412 - DNA, 25 bp, Homo sapien
agaaaatcattcacatattggttca

SEQ ID NO: 251413 - DNA, 25 bp, Homo sapien
gtaaaatttctcatttctagtgaat

SEQ ID NO: 251414 - DNA, 25 bp, Homo sapien
aatcattcacatattggttcactca

SEQ ID NO: 251415 - DNA, 25 bp, Homo sapien
gtaattttacatctcacctcattct

SEQ ID NO: 251416 - DNA, 25 bp, Homo sapien
cacatattggttcactcaacaagca

SEQ ID NO: 251417 - DNA, 25 bp, Homo sapien
attctagactaatagcaagaccggg

SEQ ID NO: 251418 - DNA, 25 bp, Homo sapien
taatttcagctgttgtataatttaa

SEQ ID NO: 251419 - DNA, 25 bp, Homo sapien
aatgacttaaatgtttatatcctac

SEQ ID NO: 251420 - DNA, 25 bp, Homo sapien
gtttatatcctacttgtgcagatag

SEQ ID NO: 251421 - DNA, 25 bp, Homo sapien
tcctacttgtgcagatagtatttct

SEQ ID NO: 251422 - DNA, 25 bp, Homo sapien
gtatttctgattgatgtcatctatc

SEQ ID NO: 251423 - DNA, 25 bp, Homo sapien
gatgtcatctatcaagaatttcaag

SEQ ID NO: 251424 - DNA, 25 bp, Homo sapien
tttttgtcttgaatcgtgggtagtc

SEQ ID NO: 251425 - DNA, 25 bp, Homo sapien
gtcttgaatcgtgggtagtcattta

SEQ ID NO: 251426 - DNA, 25 bp, Homo sapien
aatcgtgggtagtcatttaagtata

SEQ ID NO: 251427 - DNA, 25 bp, Homo sapien
atttcaaaaaagttatggctacaga

SEQ ID NO: 251428 - DNA, 25 bp, Homo sapien
ggatttttaatagtacattcatcaa

SEQ ID NO: 251429 - DNA, 25 bp, Homo sapien
ggtattgtagaaacgctgcgctgcc

SEQ ID NO: 251430 - DNA, 25 bp, Homo sapien
agaaacgctgcgctgcctatcacag

SEQ ID NO: 251431 - DNA, 25 bp, Homo sapien
acagcttgtgatgtgacacgttcat

SEQ ID NO: 251432 - DNA, 25 bp, Homo sapien
gtgacacgttcattctgcaagttta

SEQ ID NO: 251433 - DNA, 25 bp, Homo sapien
taaacttcgcctagatcggttcttg

SEQ ID NO: 251434 - DNA, 25 bp, Homo sapien
agaacttcgcctgcatatgatggaa

SEQ ID NO: 251435 - DNA, 25 bp, Homo sapien
gtcattggtggctttgttttacaaa

SEQ ID NO: 251436 - DNA, 25 bp, Homo sapien
tacaaagtcttcacctttctgctga

SEQ ID NO: 251437 - DNA, 25 bp, Homo sapien
acctttctgctgagtcacgggacta

SEQ ID NO: 251438 - DNA, 25 bp, Homo sapien
gagtcacgggactaagttcaacaca

SEQ ID NO: 251439 - DNA, 25 bp, Homo sapien
gttcaacacaatttctactttccgc

SEQ ID NO: 251440 - DNA, 25 bp, Homo sapien
ttaattcttacagggtagaccaaat

SEQ ID NO: 251441 - DNA, 25 bp, Homo sapien
ggacaatgagtctcaccgagataga

SEQ ID NO: 251442 - DNA, 25 bp, Homo sapien
tcaccgagatagagaagcctgggaa

SEQ ID NO: 251443 - DNA, 25 bp, Homo sapien
gggaaatatcctgagctttcagcag

SEQ ID NO: 251444 - DNA, 25 bp, Homo sapien
gagctttcagcagatcagcatacca

SEQ ID NO: 251445 - DNA, 25 bp, Homo sapien
cagcagatcagcataccaaaggtta

SEQ ID NO: 251446 - DNA, 25 bp, Homo sapien
aatccaaacctatacaagttcaagg

SEQ ID NO: 251447 - DNA, 25 bp, Homo sapien
ctagaataaaaatcactgctcctca

SEQ ID NO: 251448 - DNA, 25 bp, Homo sapien
atttgcaatatatcccatgttgaac

SEQ ID NO: 251449 - DNA, 25 bp, Homo sapien
attaccagacatgcaaagaatcagg

SEQ ID NO: 251450 - DNA, 25 bp, Homo sapien
caggaacatatgatctatagagcag

SEQ ID NO: 251451 - DNA, 25 bp, Homo sapien
atcaaggcagtgaaatgaagtgtaa

SEQ ID NO: 251452 - DNA, 25 bp, Homo sapien
taatggctgagtttggagtcacatc

SEQ ID NO: 251453 - DNA, 25 bp, Homo sapien
gagtttggagtcacatcactgccac

SEQ ID NO: 251454 - DNA, 25 bp, Homo sapien
atcactgccacttgctagcctgtgt

SEQ ID NO: 251455 - DNA, 25 bp, Homo sapien
actgccacttgctagcctgtgtgac

SEQ ID NO: 251456 - DNA, 25 bp, Homo sapien
ttgctagcctgtgtgaccttaaaca

SEQ ID NO: 251457 - DNA, 25 bp, Homo sapien
tcttgacctttagtgtttttctctg

SEQ ID NO: 251458 - DNA, 25 bp, Homo sapien
gtaaaatgggttatcttttctcatt

SEQ ID NO: 251459 - DNA, 25 bp, Homo sapien
tttctcatttgattatcagatagga

SEQ ID NO: 251460 - DNA, 25 bp, Homo sapien
gatagtatactttctatgtgccgcc

SEQ ID NO: 251461 - DNA, 25 bp, Homo sapien
aattcagaagatgttataccttaaa

SEQ ID NO: 251462 - DNA, 25 bp, Homo sapien
gtcagataaagcaaacccatgccct

SEQ ID NO: 251463 - DNA, 25 bp, Homo sapien
ataaagcaaacccatgccctcaaga

SEQ ID NO: 251464 - DNA, 25 bp, Homo sapien
aagaccccgcaggaatgccattagg

SEQ ID NO: 251465 - DNA, 25 bp, Homo sapien
gaatttggctgtaggaatttagaga

SEQ ID NO: 251466 - DNA, 25 bp, Homo sapien
gaatttggaggttctcttccattca

SEQ ID NO: 251467 - DNA, 25 bp, Homo sapien
tggaggttctcttccattcaaattt

SEQ ID NO: 251468 - DNA, 25 bp, Homo sapien
ttcctccaagtggtatatactttac

SEQ ID NO: 251469 - DNA, 25 bp, Homo sapien
ttttcatcataagccaaaagtctga

SEQ ID NO: 251470 - DNA, 25 bp, Homo sapien
aaaagtctgacattagcctgaagga

SEQ ID NO: 251471 - DNA, 25 bp, Homo sapien
cattagcctgaaggactgtgtgacc

SEQ ID NO: 251472 - DNA, 25 bp, Homo sapien
ggactgtgtgaccattaaagttagt

SEQ ID NO: 251473 - DNA, 25 bp, Homo sapien
ttgaaatcatttctctcccaactga

SEQ ID NO: 251474 - DNA, 25 bp, Homo sapien
catttctctcccaactgactagaaa

SEQ ID NO: 251475 - DNA, 25 bp, Homo sapien
gactagaaatacctccttaatatcg

SEQ ID NO: 251476 - DNA, 25 bp, Homo sapien
gaaatacctccttaatatcgtaaat

SEQ ID NO: 251477 - DNA, 25 bp, Homo sapien
aatatcgtaaattctcaagtgtaca

SEQ ID NO: 251478 - DNA, 25 bp, Homo sapien
atctgctttgatattacgttttcta

SEQ ID NO: 251479 - DNA, 25 bp, Homo sapien
tagtaattcataggacaagtccctc

SEQ ID NO: 251480 - DNA, 25 bp, Homo sapien
cataggacaagtccctcttcatttt

SEQ ID NO: 251481 - DNA, 25 bp, Homo sapien
gaatataattgcattatctttgaga

SEQ ID NO: 251482 - DNA, 25 bp, Homo sapien
acataaactgttcatgcttcattaa

SEQ ID NO: 251483 - DNA, 25 bp, Homo sapien
gttcatgcttcattaaaatactctt

SEQ ID NO: 251484 - DNA, 25 bp, Homo sapien
gaaaatctatgactgtattaccaag

SEQ ID NO: 251485 - DNA, 25 bp, Homo sapien
aaaatctatgactgtattaccaagc

SEQ ID NO: 251486 - DNA, 25 bp, Homo sapien
aaatctatgactgtattaccaagct

SEQ ID NO: 251487 - DNA, 25 bp, Homo sapien
aatctatgactgtattaccaagctt

SEQ ID NO: 251488 - DNA, 25 bp, Homo sapien
atctatgactgtattaccaagctta

SEQ ID NO: 251489 - DNA, 25 bp, Homo sapien
tctatgactgtattaccaagcttaa

SEQ ID NO: 251490 - DNA, 25 bp, Homo sapien
ctatgactgtattaccaagcttaag

SEQ ID NO: 251491 - DNA, 25 bp, Homo sapien
tatgactgtattaccaagcttaaga

SEQ ID NO: 251492 - DNA, 25 bp, Homo sapien
atgactgtattaccaagcttaagaa

SEQ ID NO: 251493 - DNA, 25 bp, Homo sapien
tgactgtattaccaagcttaagaaa

SEQ ID NO: 251494 - DNA, 25 bp, Homo sapien
gactgtattaccaagcttaagaaat

SEQ ID NO: 251495 - DNA, 25 bp, Homo sapien
gaatattagatttagaacccgggcg

SEQ ID NO: 251496 - DNA, 25 bp, Homo sapien
aacccgggcgtatgaatcttagcat

SEQ ID NO: 251497 - DNA, 25 bp, Homo sapien
gatgctcaaaaccttttatcaattg

SEQ ID NO: 251498 - DNA, 25 bp, Homo sapien
aattgattccatttctgccgttaca

SEQ ID NO: 251499 - DNA, 25 bp, Homo sapien
gattccatttctgccgttacaaaca

SEQ ID NO: 251500 - DNA, 25 bp, Homo sapien
tctgccgttacaaacacacacgaag

SEQ ID NO: 251501 - DNA, 25 bp, Homo sapien
acacacgaagttcctagttcactgg

SEQ ID NO: 251502 - DNA, 25 bp, Homo sapien
ttcctagttcactgggacttcctga

SEQ ID NO: 251503 - DNA, 25 bp, Homo sapien
agttcactgggacttcctgatttgt

SEQ ID NO: 251504 - DNA, 25 bp, Homo sapien
ttctcacctagaagctctgtttatt

SEQ ID NO: 251505 - DNA, 25 bp, Homo sapien
tagaagctctgtttatttctgagca

SEQ ID NO: 251506 - DNA, 25 bp, Homo sapien
tacatccagggggtttcttcctaat

SEQ ID NO: 251507 - DNA, 25 bp, Homo sapien
ataattgaagtgcatgacgagcccc

SEQ ID NO: 251508 - DNA, 25 bp, Homo sapien
agtgcatgacgagcccccaaataag

SEQ ID NO: 251509 - DNA, 25 bp, Homo sapien
taaaaagttcaatatgtgccagtat

SEQ ID NO: 251510 - DNA, 25 bp, Homo sapien
tatgtgccagtatttacaaccagta

SEQ ID NO: 251511 - DNA, 25 bp, Homo sapien
gtgccagtatttacaaccagtatat

SEQ ID NO: 251512 - DNA, 25 bp, Homo sapien
gtacttaatagagctcatacagttt

SEQ ID NO: 251513 - DNA, 25 bp, Homo sapien
agagctcatacagtttggagaggaa

SEQ ID NO: 251514 - DNA, 25 bp, Homo sapien
ggttaaataaggagtgtcacacact

SEQ ID NO: 251515 - DNA, 25 bp, Homo sapien
tcacacacttgatgtgctgatgtgt

SEQ ID NO: 251516 - DNA, 25 bp, Homo sapien
acttgatgtgctgatgtgtacatcc

SEQ ID NO: 251517 - DNA, 25 bp, Homo sapien
cccagttattatgaagccttcctga

SEQ ID NO: 251518 - DNA, 25 bp, Homo sapien
gaactttaaatatcggccaccactt

SEQ ID NO: 251519 - DNA, 25 bp, Homo sapien
taaatatcggccaccactttcatga

SEQ ID NO: 251520 - DNA, 25 bp, Homo sapien
tcggccaccactttcatgaggctga

SEQ ID NO: 251521 - DNA, 25 bp, Homo sapien
atgggattcagcaattaggagcgtt

SEQ ID NO: 251522 - DNA, 25 bp, Homo sapien
cagcaattaggagcgttgcagggaa

SEQ ID NO: 251523 - DNA, 25 bp, Homo sapien
ggtcccttggttaggtgacaattag

SEQ ID NO: 251524 - DNA, 25 bp, Homo sapien
cccttggttaggtgacaattagtct

SEQ ID NO: 251525 - DNA, 25 bp, Homo sapien
gtctataaaacacagctgtgtgtgt

SEQ ID NO: 251526 - DNA, 25 bp, Homo sapien
taaaaagctctgtgcccaataggaa

SEQ ID NO: 251527 - DNA, 25 bp, Homo sapien
gctctgtgcccaataggaacattaa

SEQ ID NO: 251528 - DNA, 25 bp, Homo sapien
taaaaccagagccagattctttctg

SEQ ID NO: 251529 - DNA, 25 bp, Homo sapien
tatctctttttattcacaacactat

SEQ ID NO: 251530 - DNA, 25 bp, Homo sapien
ttctgaccttcagcctaataatact

SEQ ID NO: 251531 - DNA, 25 bp, Homo sapien
atactttacttactataacctggag

SEQ ID NO: 251532 - DNA, 25 bp, Homo sapien
taacctggagattcccattttgtaa

SEQ ID NO: 251533 - DNA, 25 bp, Homo sapien
cattttgtaatgtcccctctatgag

SEQ ID NO: 251534 - DNA, 25 bp, Homo sapien
ccctctatgaggcttgtcttaacag

SEQ ID NO: 251535 - DNA, 25 bp, Homo sapien
tgaagacacccacaatgccagctat

SEQ ID NO: 251536 - DNA, 25 bp, Homo sapien
ccagctattgttttctatggcaaca

SEQ ID NO: 251537 - DNA, 25 bp, Homo sapien
gtgcttagaatgaggcctgacagac

SEQ ID NO: 251538 - DNA, 25 bp, Homo sapien
gaggcctgacagactctcaatgagt

SEQ ID NO: 251539 - DNA, 25 bp, Homo sapien
tgagcgggtgctggtcactaagctg

SEQ ID NO: 251540 - DNA, 25 bp, Homo sapien
agttgaccagggtcgtcaggttgat

SEQ ID NO: 251541 - DNA, 25 bp, Homo sapien
caggttgatgaaatgggccacagac

SEQ ID NO: 251542 - DNA, 25 bp, Homo sapien
tggatctggacgtcattttggcggt

SEQ ID NO: 251543 - DNA, 25 bp, Homo sapien
tggacgtcattttggcggttgtgca

SEQ ID NO: 251544 - DNA, 25 bp, Homo sapien
gtcattttggcggttgtgcaacatg

SEQ ID NO: 251545 - DNA, 25 bp, Homo sapien
tgtgcaacatggcagagccgctgac

SEQ ID NO: 251546 - DNA, 25 bp, Homo sapien
atggcagagccgctgacggtatcaa

SEQ ID NO: 251547 - DNA, 25 bp, Homo sapien
acggtatcaaaggtcacggtcagga

SEQ ID NO: 251548 - DNA, 25 bp, Homo sapien
cacggtcaggattgagttgtccagc

SEQ ID NO: 251549 - DNA, 25 bp, Homo sapien
gttgtccagctgtaactggcgttca

SEQ ID NO: 251550 - DNA, 25 bp, Homo sapien
aaagagagaagcatgcagtgagcat

SEQ ID NO: 251551 - DNA, 25 bp, Homo sapien
agtgagcatctggaagttcttgtaa

SEQ ID NO: 251552 - DNA, 25 bp, Homo sapien
attgccaattcctaagctttttctt

SEQ ID NO: 251553 - DNA, 25 bp, Homo sapien
ctgatttgcagaccgattttatttt

SEQ ID NO: 251554 - DNA, 25 bp, Homo sapien
atttgcagaccgattttatttttag

SEQ ID NO: 251555 - DNA, 25 bp, Homo sapien
gtggcttttgaactaaagcgctttt

SEQ ID NO: 251556 - DNA, 25 bp, Homo sapien
attaaggagttataacagcatgtta

SEQ ID NO: 251557 - DNA, 25 bp, Homo sapien
gcatgttattttgagtagctgttac

SEQ ID NO: 251558 - DNA, 25 bp, Homo sapien
tagctgttactaaaatctgttgtga

SEQ ID NO: 251559 - DNA, 25 bp, Homo sapien
tgatggaacaatttggagtgagcat

SEQ ID NO: 251560 - DNA, 25 bp, Homo sapien
tggagtgagcatctgatatcagaga

SEQ ID NO: 251561 - DNA, 25 bp, Homo sapien
tacatacaaatttaagtctcctgat

SEQ ID NO: 251562 - DNA, 25 bp, Homo sapien
gtctcctgatcatctaccagattta

SEQ ID NO: 251563 - DNA, 25 bp, Homo sapien
tatgcagacatgatcgagagccttc

SEQ ID NO: 251564 - DNA, 25 bp, Homo sapien
gagagccttcgtttaatgaaacttt

SEQ ID NO: 251565 - DNA, 25 bp, Homo sapien
gaaacttttcgattcagtctaagtc

SEQ ID NO: 251566 - DNA, 25 bp, Homo sapien
gattcagtctaagtcctgcaggaca

SEQ ID NO: 251567 - DNA, 25 bp, Homo sapien
gtcctgcaggacattctcttcagat

SEQ ID NO: 251568 - DNA, 25 bp, Homo sapien
aaagaccttgattggtgaagcctgt

SEQ ID NO: 251569 - DNA, 25 bp, Homo sapien
gtgaagcctgtatctggcttgacaa

SEQ ID NO: 251570 - DNA, 25 bp, Homo sapien
atctggcttgacaaagtggatctca

SEQ ID NO: 251571 - DNA, 25 bp, Homo sapien
gaaaaagaatagtcaactggcacaa

SEQ ID NO: 251572 - DNA, 25 bp, Homo sapien
aaatgtatatatatcctagtcccct

SEQ ID NO: 251573 - DNA, 25 bp, Homo sapien
ccctaaccaaatcctgacctattgg

SEQ ID NO: 251574 - DNA, 25 bp, Homo sapien
taaccaaatcctgacctattgggat

SEQ ID NO: 251575 - DNA, 25 bp, Homo sapien
ccaaatcctgacctattgggatact

SEQ ID NO: 251576 - DNA, 25 bp, Homo sapien
aatcctgacctattgggatacttat

SEQ ID NO: 251577 - DNA, 25 bp, Homo sapien
ctgacctattgggatacttataaaa

SEQ ID NO: 251578 - DNA, 25 bp, Homo sapien
taagtaagtgggatacacaaagaat

SEQ ID NO: 251579 - DNA, 25 bp, Homo sapien
ttttcattattagcaaaaacctaag

SEQ ID NO: 251580 - DNA, 25 bp, Homo sapien
ggatttaaactaattgaaactgtat

SEQ ID NO: 251581 - DNA, 25 bp, Homo sapien
gaaactgtatttgattggacttaat

SEQ ID NO: 251582 - DNA, 25 bp, Homo sapien
ggagacttacttttatgacattcta

SEQ ID NO: 251583 - DNA, 25 bp, Homo sapien
ttaagattagatgttagctgctgaa

SEQ ID NO: 251584 - DNA, 25 bp, Homo sapien
ctgaagtttgtggaggtcggacata

SEQ ID NO: 251585 - DNA, 25 bp, Homo sapien
gaggtcggacataaagcttccaaca

SEQ ID NO: 251586 - DNA, 25 bp, Homo sapien
aaagcttccaacatcagtaatgcaa

SEQ ID NO: 251587 - DNA, 25 bp, Homo sapien
aaaattgtcttgaacctgcgataaa

SEQ ID NO: 251588 - DNA, 25 bp, Homo sapien
acctgcgataaaattttgttggact

SEQ ID NO: 251589 - DNA, 25 bp, Homo sapien
aaaagggccatgtagcatgcctcaa

SEQ ID NO: 251590 - DNA, 25 bp, Homo sapien
atgtagcatgcctcaaagccaggtt

SEQ ID NO: 251591 - DNA, 25 bp, Homo sapien
atgcctcaaagccaggttactcagc

SEQ ID NO: 251592 - DNA, 25 bp, Homo sapien
gttactcagcctagtccttgtttaa

SEQ ID NO: 251593 - DNA, 25 bp, Homo sapien
gcctagtccttgtttaagcagtttt

SEQ ID NO: 251594 - DNA, 25 bp, Homo sapien
actaatagtcgtatatctctaaaag

SEQ ID NO: 251595 - DNA, 25 bp, Homo sapien
aaagattttcagaggagttgataac

SEQ ID NO: 251596 - DNA, 25 bp, Homo sapien
ggagttgataacaggaatgtcagaa

SEQ ID NO: 251597 - DNA, 25 bp, Homo sapien
tattcctcggactctacctgaaata

SEQ ID NO: 251598 - DNA, 25 bp, Homo sapien
agtatattactgtcaagtgtaggaa

SEQ ID NO: 251599 - DNA, 25 bp, Homo sapien
ggaaaatagctttttgtcaattcct

SEQ ID NO: 251600 - DNA, 25 bp, Homo sapien
tcctcggactctacctgaaatatca

SEQ ID NO: 251601 - DNA, 25 bp, Homo sapien
cggactctacctgaaatatcaaaat

SEQ ID NO: 251602 - DNA, 25 bp, Homo sapien
taagaataaggtatttggcagggtt

SEQ ID NO: 251603 - DNA, 25 bp, Homo sapien
gcagggttttcatattgacatttca

SEQ ID NO: 251604 - DNA, 25 bp, Homo sapien
attgacatttcagtctcagtttttt

SEQ ID NO: 251605 - DNA, 25 bp, Homo sapien
aaggcaacaagcaggatacatccag

SEQ ID NO: 251606 - DNA, 25 bp, Homo sapien
caagcaggatacatccagctgtgct

SEQ ID NO: 251607 - DNA, 25 bp, Homo sapien
gctgtgctacctgggaggagtcctc

SEQ ID NO: 251608 - DNA, 25 bp, Homo sapien
aggagtcctctcttctataatcaaa

SEQ ID NO: 251609 - DNA, 25 bp, Homo sapien
gtcctctcttctataatcaaactca

SEQ ID NO: 251610 - DNA, 25 bp, Homo sapien
actcaacagaaacaggcccttgctt

SEQ ID NO: 251611 - DNA, 25 bp, Homo sapien
gaaacaggcccttgcttctgggaca

SEQ ID NO: 251612 - DNA, 25 bp, Homo sapien
ttctgggacatcaaacatgaagagg

SEQ ID NO: 251613 - DNA, 25 bp, Homo sapien
atgaagaggctcctgttctgcagaa

SEQ ID NO: 251614 - DNA, 25 bp, Homo sapien
gaagaggctcctgttctgcagaaaa

SEQ ID NO: 251615 - DNA, 25 bp, Homo sapien
gaggctcctgttctgcagaaaataa

SEQ ID NO: 251616 - DNA, 25 bp, Homo sapien
tgcctgtgtgtgacctctaactatg

SEQ ID NO: 251617 - DNA, 25 bp, Homo sapien
gtgacctctaactatgtgcctggaa

SEQ ID NO: 251618 - DNA, 25 bp, Homo sapien
gtgcctggaaactgaattacatgta

SEQ ID NO: 251619 - DNA, 25 bp, Homo sapien
aacaggattttcttattgcctaagc

SEQ ID NO: 251620 - DNA, 25 bp, Homo sapien
ttgcctaagcatgaacttggtatga

SEQ ID NO: 251621 - DNA, 25 bp, Homo sapien
gtaacttggattcttataacctgga

SEQ ID NO: 251622 - DNA, 25 bp, Homo sapien
tataacctggactgtaagtttgttt

SEQ ID NO: 251623 - DNA, 25 bp, Homo sapien
aagtttgttttagctccagtgggag

SEQ ID NO: 251624 - DNA, 25 bp, Homo sapien
atgaaaccatcctcatcttttctac

SEQ ID NO: 251625 - DNA, 25 bp, Homo sapien
ttttctacccctggactaatcattt

SEQ ID NO: 251626 - DNA, 25 bp, Homo sapien
actgctgagtttatcttgtgttaag

SEQ ID NO: 251627 - DNA, 25 bp, Homo sapien
tgtccaagtcttataacatttttca

SEQ ID NO: 251628 - DNA, 25 bp, Homo sapien
aaaaatcaaagcactgtacactaaa

SEQ ID NO: 251629 - DNA, 25 bp, Homo sapien
gaaatcaaatcctggctcacttgaa

SEQ ID NO: 251630 - DNA, 25 bp, Homo sapien
aataacagtctgtgggcaactggtt

SEQ ID NO: 251631 - DNA, 25 bp, Homo sapien
gcaactggttgtttctcaggtcacc

SEQ ID NO: 251632 - DNA, 25 bp, Homo sapien
gacagatggtccctaaggtgcaaaa

SEQ ID NO: 251633 - DNA, 25 bp, Homo sapien
gatggcagactgctctttgacaatg

SEQ ID NO: 251634 - DNA, 25 bp, Homo sapien
ggcagactgctctttgacaatgaag

SEQ ID NO: 251635 - DNA, 25 bp, Homo sapien
ttactttggtaaactgactttggct

SEQ ID NO: 251636 - DNA, 25 bp, Homo sapien
aactgactttggctatcaacagact

SEQ ID NO: 251637 - DNA, 25 bp, Homo sapien
ctatcaacagacttaatgtccaagt

SEQ ID NO: 251638 - DNA, 25 bp, Homo sapien
agtaaatttagtcctctagtgccta

SEQ ID NO: 251639 - DNA, 25 bp, Homo sapien
aaatttagtcctctagtgcctacct

SEQ ID NO: 251640 - DNA, 25 bp, Homo sapien
tctagtgcctacctctatggtgaaa

SEQ ID NO: 251641 - DNA, 25 bp, Homo sapien
gtgcctacctctatggtgaaatcag

SEQ ID NO: 251642 - DNA, 25 bp, Homo sapien
ggtgaaatcagaccattggcatagt

SEQ ID NO: 251643 - DNA, 25 bp, Homo sapien
cagaccattggcatagtttgaagtc

SEQ ID NO: 251644 - DNA, 25 bp, Homo sapien
ttgaagtcttccaagaagcctggtt

SEQ ID NO: 251645 - DNA, 25 bp, Homo sapien
atgtgttacttatactatggtgagt

SEQ ID NO: 251646 - DNA, 25 bp, Homo sapien
tatactatggtgagttgtctatctg

SEQ ID NO: 251647 - DNA, 25 bp, Homo sapien
ttctaaaattgtcatctgtcaaggt

SEQ ID NO: 251648 - DNA, 25 bp, Homo sapien
ttgtcatctgtcaaggtagagaatt

SEQ ID NO: 251649 - DNA, 25 bp, Homo sapien
ttttaacaagtcctctggttcgctc

SEQ ID NO: 251650 - DNA, 25 bp, Homo sapien
tttaacaagtcctctggttcgctcc

SEQ ID NO: 251651 - DNA, 25 bp, Homo sapien
ttaacaagtcctctggttcgctcca

SEQ ID NO: 251652 - DNA, 25 bp, Homo sapien
taacggctcctctcagttcccgtgg

SEQ ID NO: 251653 - DNA, 25 bp, Homo sapien
aacggctcctctcagttcccgtggt

SEQ ID NO: 251654 - DNA, 25 bp, Homo sapien
tctcagttcccgtggtcccaaaagc

SEQ ID NO: 251655 - DNA, 25 bp, Homo sapien
ttcccgtggtcccaaaagccctctg

SEQ ID NO: 251656 - DNA, 25 bp, Homo sapien
aaagccctctgtcccgtgcagggct

SEQ ID NO: 251657 - DNA, 25 bp, Homo sapien
cttccacatcctcctgatagcagag

SEQ ID NO: 251658 - DNA, 25 bp, Homo sapien
ttccacatcctcctgatagcagagg

SEQ ID NO: 251659 - DNA, 25 bp, Homo sapien
tccacatcctcctgatagcagaggc

SEQ ID NO: 251660 - DNA, 25 bp, Homo sapien
aatgaggaacccaagcaactgttgc

SEQ ID NO: 251661 - DNA, 25 bp, Homo sapien
aagcaactgttgctttcacataact

SEQ ID NO: 251662 - DNA, 25 bp, Homo sapien
gctttcacataacttggaggtttct

SEQ ID NO: 251663 - DNA, 25 bp, Homo sapien
tggaggtttctaaggcagtgtttct

SEQ ID NO: 251664 - DNA, 25 bp, Homo sapien
caatgtcaagatgtcacgtttcaaa

SEQ ID NO: 251665 - DNA, 25 bp, Homo sapien
agattcagactctttgtgctctcct

SEQ ID NO: 251666 - DNA, 25 bp, Homo sapien
gtcacgtttcaaaagacaacctgaa

SEQ ID NO: 251667 - DNA, 25 bp, Homo sapien
gaattctcagatgatttcaatgcaa

SEQ ID NO: 251668 - DNA, 25 bp, Homo sapien
gattaattttcacttgcctccattt

SEQ ID NO: 251669 - DNA, 25 bp, Homo sapien
ctccttcagcaaggcacaggttgaa

SEQ ID NO: 251670 - DNA, 25 bp, Homo sapien
gcaaggcacaggttgaactcaggaa

SEQ ID NO: 251671 - DNA, 25 bp, Homo sapien
tctgcaagcgcttccagcgggcgtc

SEQ ID NO: 251672 - DNA, 25 bp, Homo sapien
gggtggtactttcattcggtcatcc

SEQ ID NO: 251673 - DNA, 25 bp, Homo sapien
attcggtcatcctgtgagtgttcca

SEQ ID NO: 251674 - DNA, 25 bp, Homo sapien
tgagtgttccacttcccgacggagg

SEQ ID NO: 251675 - DNA, 25 bp, Homo sapien
gaggtacccgtcaccgcagaaccgg

SEQ ID NO: 251676 - DNA, 25 bp, Homo sapien
agaaccgggtggctggctctcctcc

SEQ ID NO: 251677 - DNA, 25 bp, Homo sapien
gaaagcctgtcacttattcctcaac

SEQ ID NO: 251678 - DNA, 25 bp, Homo sapien
ctgtcacttattcctcaacactgtt

SEQ ID NO: 251679 - DNA, 25 bp, Homo sapien
gaagttacctagaaaagtacagaca

SEQ ID NO: 251680 - DNA, 25 bp, Homo sapien
gacagaagacctaggcttgcgtttt

SEQ ID NO: 251681 - DNA, 25 bp, Homo sapien
acctaggcttgcgttttagaatcgt

SEQ ID NO: 251682 - DNA, 25 bp, Homo sapien
aaatcacagatcttattttgagatt

SEQ ID NO: 251683 - DNA, 25 bp, Homo sapien
aaaaatacttctagctttagccagg

SEQ ID NO: 251684 - DNA, 25 bp, Homo sapien
acttctagctttagccaggtgtgca

SEQ ID NO: 251685 - DNA, 25 bp, Homo sapien
tgcatgttgctgccattttgcattt

SEQ ID NO: 251686 - DNA, 25 bp, Homo sapien
tggattctggaaggacatagttctt

SEQ ID NO: 251687 - DNA, 25 bp, Homo sapien
gttactcagaattgtcatagatttt

SEQ ID NO: 251688 - DNA, 25 bp, Homo sapien
catagttcttctaaaatttcctgtt

SEQ ID NO: 251689 - DNA, 25 bp, Homo sapien
tttcctgttaattggcatgtacgtc

SEQ ID NO: 251690 - DNA, 25 bp, Homo sapien
gttaattggcatgtacgtctcattt

SEQ ID NO: 251691 - DNA, 25 bp, Homo sapien
ggcatgtacgtctcatttaaagcaa

SEQ ID NO: 251692 - DNA, 25 bp, Homo sapien
gcaaattaagtaggacaagcaagtc

SEQ ID NO: 251693 - DNA, 25 bp, Homo sapien
caaatttcctgactcctcagaacag

SEQ ID NO: 251694 - DNA, 25 bp, Homo sapien
aacagctcagctcagctgggagtct

SEQ ID NO: 251695 - DNA, 25 bp, Homo sapien
cgagacatcagcagagtacctggaa

SEQ ID NO: 251696 - DNA, 25 bp, Homo sapien
aatggaactccaagcaagtcgaagc

SEQ ID NO: 251697 - DNA, 25 bp, Homo sapien
gtcgaagcttgggagccagtgtcct

SEQ ID NO: 251698 - DNA, 25 bp, Homo sapien
gccagtgtccttgcagtctgaatat

SEQ ID NO: 251699 - DNA, 25 bp, Homo sapien
gaggtaactctgttatgctcaccgc

SEQ ID NO: 251700 - DNA, 25 bp, Homo sapien
agcaagaattcctttgccaccattt

SEQ ID NO: 251701 - DNA, 25 bp, Homo sapien
accatttctctagtcaggcggagct

SEQ ID NO: 251702 - DNA, 25 bp, Homo sapien
tgtccagggttcaggtggctttcca

SEQ ID NO: 251703 - DNA, 25 bp, Homo sapien
gacatgcttcaacttgcctggagat

SEQ ID NO: 251704 - DNA, 25 bp, Homo sapien
ggaactgtctgtgtttgggtcaaga

SEQ ID NO: 251705 - DNA, 25 bp, Homo sapien
gaactgtctgtgtttgggtcaagaa

SEQ ID NO: 251706 - DNA, 25 bp, Homo sapien
aactgtctgtgtttgggtcaagaat

SEQ ID NO: 251707 - DNA, 25 bp, Homo sapien
ctgtctgtgtttgggtcaagaatat

SEQ ID NO: 251708 - DNA, 25 bp, Homo sapien
gtctgtgtttgggtcaagaatatgc

SEQ ID NO: 251709 - DNA, 25 bp, Homo sapien
gtcaagaatatgcaactggctgggc

SEQ ID NO: 251710 - DNA, 25 bp, Homo sapien
caagaatatgcaactggctgggcac

SEQ ID NO: 251711 - DNA, 25 bp, Homo sapien
aagaatatgcaactggctgggcaca

SEQ ID NO: 251712 - DNA, 25 bp, Homo sapien
agaatatgcaactggctgggcacat

SEQ ID NO: 251713 - DNA, 25 bp, Homo sapien
gaatatgcaactggctgggcacatt

SEQ ID NO: 251714 - DNA, 25 bp, Homo sapien
aatatgcaactggctgggcacattg

SEQ ID NO: 251715 - DNA, 25 bp, Homo sapien
aaatcctatttagtacaaggtacat

SEQ ID NO: 251716 - DNA, 25 bp, Homo sapien
gtacaaggtacattatttaggtaat

SEQ ID NO: 251717 - DNA, 25 bp, Homo sapien
taatgagtccattaaaagccaacac

SEQ ID NO: 251718 - DNA, 25 bp, Homo sapien
gagtccattaaaagccaacactttc

SEQ ID NO: 251719 - DNA, 25 bp, Homo sapien
aacactttccccactacactatatg

SEQ ID NO: 251720 - DNA, 25 bp, Homo sapien
actttccccactacactatatgtgt

SEQ ID NO: 251721 - DNA, 25 bp, Homo sapien
tccccactacactatatgtgtatgt

SEQ ID NO: 251722 - DNA, 25 bp, Homo sapien
gtgtatgtaacacaactgcccttgt

SEQ ID NO: 251723 - DNA, 25 bp, Homo sapien
gtatgtaacacaactgcccttgtaa

SEQ ID NO: 251724 - DNA, 25 bp, Homo sapien
tgtaacacaactgcccttgtaactt

SEQ ID NO: 251725 - DNA, 25 bp, Homo sapien
tgcccttgtaacttcctaaacctat

SEQ ID NO: 251726 - DNA, 25 bp, Homo sapien
gtcaaaatgtcaagtaatcacccaa

SEQ ID NO: 251727 - DNA, 25 bp, Homo sapien
gtaatcacccaaagttgcatttaat

SEQ ID NO: 251728 - DNA, 25 bp, Homo sapien
aaaggcactacatactgtaccaagt

SEQ ID NO: 251729 - DNA, 25 bp, Homo sapien
tactgtaccaagtttatcttcaata

SEQ ID NO: 251730 - DNA, 25 bp, Homo sapien
atcttcaatatttgtgccttactta

SEQ ID NO: 251731 - DNA, 25 bp, Homo sapien
atttgtgccttacttactttgacta

SEQ ID NO: 251732 - DNA, 25 bp, Homo sapien
gtgccttacttactttgactataac

SEQ ID NO: 251733 - DNA, 25 bp, Homo sapien
ctataacaaattccaatgagtcaga

SEQ ID NO: 251734 - DNA, 25 bp, Homo sapien
ttcatcaaggtccagttccgacagc

SEQ ID NO: 251735 - DNA, 25 bp, Homo sapien
aggtccagttccgacagcattcctg

SEQ ID NO: 251736 - DNA, 25 bp, Homo sapien
aaggcttaatgccaacattttcata

SEQ ID NO: 251737 - DNA, 25 bp, Homo sapien
agctaaattatcttttgcttattac

SEQ ID NO: 251738 - DNA, 25 bp, Homo sapien
gtctgtggtagttggtctgctctgc

SEQ ID NO: 251739 - DNA, 25 bp, Homo sapien
cttttgcttattacatagagtgcta

SEQ ID NO: 251740 - DNA, 25 bp, Homo sapien
tagagtgctagaagtatgctgtcat

SEQ ID NO: 251741 - DNA, 25 bp, Homo sapien
ctgtcatggcatatgtcctagtttc

SEQ ID NO: 251742 - DNA, 25 bp, Homo sapien
atggcatatgtcctagtttctcatc

SEQ ID NO: 251743 - DNA, 25 bp, Homo sapien
ggtagttggtctgctctgctctttg

SEQ ID NO: 251744 - DNA, 25 bp, Homo sapien
tggaccaaagtcagtgattttattt

SEQ ID NO: 251745 - DNA, 25 bp, Homo sapien
gtaaccatattgtaccactgtttga

SEQ ID NO: 251746 - DNA, 25 bp, Homo sapien
tgatcgtgatcaattaagcagaaag

SEQ ID NO: 251747 - DNA, 25 bp, Homo sapien
gtcaggtaacctgtctatattagct

SEQ ID NO: 251748 - DNA, 25 bp, Homo sapien
agctgtgagctgtggtgactgttat

SEQ ID NO: 251749 - DNA, 25 bp, Homo sapien
ggtgactgttatttttcctagtgat

SEQ ID NO: 251750 - DNA, 25 bp, Homo sapien
tattcattctgttcactgtggccag

SEQ ID NO: 251751 - DNA, 25 bp, Homo sapien
cctagtgatagttttcagtgacagc

SEQ ID NO: 251752 - DNA, 25 bp, Homo sapien
gacagcatagattctggtatcatat

SEQ ID NO: 251753 - DNA, 25 bp, Homo sapien
tggcatatgcagacttttcacaaag

SEQ ID NO: 251754 - DNA, 25 bp, Homo sapien
aaagtgattgttttcttgagctctg

SEQ ID NO: 251755 - DNA, 25 bp, Homo sapien
ttgagctctggactacttggtaaca

SEQ ID NO: 251756 - DNA, 25 bp, Homo sapien
agtactggccacaccagtggccaaa

SEQ ID NO: 251757 - DNA, 25 bp, Homo sapien
agaactgcattcatcatgtggctgt

SEQ ID NO: 251758 - DNA, 25 bp, Homo sapien
atgtggctgttctatagctgtgagc

SEQ ID NO: 251759 - DNA, 25 bp, Homo sapien
tgtagttaaattgtcatgctgtttg

SEQ ID NO: 251760 - DNA, 25 bp, Homo sapien
catgctgtttgaaataattgatact

SEQ ID NO: 251761 - DNA, 25 bp, Homo sapien
aattgatacttgtctacgtaataca

SEQ ID NO: 251762 - DNA, 25 bp, Homo sapien
gatacttgtctacgtaatacatttt

SEQ ID NO: 251763 - DNA, 25 bp, Homo sapien
ttactgtatgttttgaagatggtta

SEQ ID NO: 251764 - DNA, 25 bp, Homo sapien
gaagatggttataatttcactttca

SEQ ID NO: 251765 - DNA, 25 bp, Homo sapien
taaaaacatatagcttagggatttt

SEQ ID NO: 251766 - DNA, 25 bp, Homo sapien
tttaaaagcccctgagttctaggag

SEQ ID NO: 251767 - DNA, 25 bp, Homo sapien
aaaagcccctgagttctaggagagg

SEQ ID NO: 251768 - DNA, 25 bp, Homo sapien
cctgagttctaggagagggcttatt

SEQ ID NO: 251769 - DNA, 25 bp, Homo sapien
ggagagggcttattgaattgctata

SEQ ID NO: 251770 - DNA, 25 bp, Homo sapien
gtcctggacagcaggaggctctact

SEQ ID NO: 251771 - DNA, 25 bp, Homo sapien
aggctctactcctgcaaatgggtac

SEQ ID NO: 251772 - DNA, 25 bp, Homo sapien
gcaaatgggtacagtctcaggacaa

SEQ ID NO: 251773 - DNA, 25 bp, Homo sapien
agtctcaggacaacttagcctccag

SEQ ID NO: 251774 - DNA, 25 bp, Homo sapien
gacaacttagcctccaggacgcact

SEQ ID NO: 251775 - DNA, 25 bp, Homo sapien
ggcccgctcctgagagcctgtggca

SEQ ID NO: 251776 - DNA, 25 bp, Homo sapien
gagagcctgtggcatgcccttgacc

SEQ ID NO: 251777 - DNA, 25 bp, Homo sapien
ttgaccctgcttggcctggctttct

SEQ ID NO: 251778 - DNA, 25 bp, Homo sapien
tctgcctccatccttgggcctgaga

SEQ ID NO: 251779 - DNA, 25 bp, Homo sapien
cccacaactcagtgtccttcaaata

SEQ ID NO: 251780 - DNA, 25 bp, Homo sapien
tcaaatatacaatgaccacccttct

SEQ ID NO: 251781 - DNA, 25 bp, Homo sapien
gagaatgcccaaaaagtgccagaag

SEQ ID NO: 251782 - DNA, 25 bp, Homo sapien
agtgccagaagcatcgtggcatttc

SEQ ID NO: 251783 - DNA, 25 bp, Homo sapien
gaaccatggattctgcctttggacc

SEQ ID NO: 251784 - DNA, 25 bp, Homo sapien
ctttggacccctctctattaatatt

SEQ ID NO: 251785 - DNA, 25 bp, Homo sapien
cttcagatgtcaccctaatccactg

SEQ ID NO: 251786 - DNA, 25 bp, Homo sapien
taatccactgccctaagacagaatt

SEQ ID NO: 251787 - DNA, 25 bp, Homo sapien
tcattccttcaacaagtcaagtcat

SEQ ID NO: 251788 - DNA, 25 bp, Homo sapien
aagtcaagtcatacttggcctctcc

SEQ ID NO: 251789 - DNA, 25 bp, Homo sapien
tggcctctccctgagaatctgagca

SEQ ID NO: 251790 - DNA, 25 bp, Homo sapien
gaatctgagcaggagccttataacc

SEQ ID NO: 251791 - DNA, 25 bp, Homo sapien
gagccttataacctgtggtcattat

SEQ ID NO: 251792 - DNA, 25 bp, Homo sapien
atctggtacattgcttcagtaggta

SEQ ID NO: 251793 - DNA, 25 bp, Homo sapien
gtacattgcttcagtaggtaagtca

SEQ ID NO: 251794 - DNA, 25 bp, Homo sapien
tgcttcagtaggtaagtcagtatga

SEQ ID NO: 251795 - DNA, 25 bp, Homo sapien
gtcagtatgaacttctaagaatttt

SEQ ID NO: 251796 - DNA, 25 bp, Homo sapien
attgggtctattgtgggtatgtcca

SEQ ID NO: 251797 - DNA, 25 bp, Homo sapien
ggtctattgtgggtatgtccaacgt

SEQ ID NO: 251798 - DNA, 25 bp, Homo sapien
attgtgggtatgtccaacgtgacag

SEQ ID NO: 251799 - DNA, 25 bp, Homo sapien
gactgaaatggctttcatcatcttt

SEQ ID NO: 251800 - DNA, 25 bp, Homo sapien
ttcatcatctttaagtcaaagtgag

SEQ ID NO: 251801 - DNA, 25 bp, Homo sapien
gtatgtacttgtgtctctgtatgta

SEQ ID NO: 251802 - DNA, 25 bp, Homo sapien
acttgtgtctctgtatgtatgtaaa

SEQ ID NO: 251803 - DNA, 25 bp, Homo sapien
gaacacatgttcctggtccgttaca

SEQ ID NO: 251804 - DNA, 25 bp, Homo sapien
gtccgttacacaacaccaaatctgg

SEQ ID NO: 251805 - DNA, 25 bp, Homo sapien
aaatctggcttcaccctgtgaatta

SEQ ID NO: 251806 - DNA, 25 bp, Homo sapien
gagggccaggactgctgaacctccc

SEQ ID NO: 251807 - DNA, 25 bp, Homo sapien
cccggcttcttggaattcggtgaat

SEQ ID NO: 251808 - DNA, 25 bp, Homo sapien
aacgtttctacacggcagatgcttt

SEQ ID NO: 251809 - DNA, 25 bp, Homo sapien
gtatacatgttactagggtctctat

SEQ ID NO: 251810 - DNA, 25 bp, Homo sapien
tagggtctctatcagctcgatctag

SEQ ID NO: 251811 - DNA, 25 bp, Homo sapien
ggcagatgctttcaacgtagacaat

SEQ ID NO: 251812 - DNA, 25 bp, Homo sapien
atgatcactttctttattcctagta

SEQ ID NO: 251813 - DNA, 25 bp, Homo sapien
agaagggcagatacacagataggaa

SEQ ID NO: 251814 - DNA, 25 bp, Homo sapien
tgaggtgacacataactaaaatttc

SEQ ID NO: 251815 - DNA, 25 bp, Homo sapien
ataactgtgactgagatacaagtac

SEQ ID NO: 251816 - DNA, 25 bp, Homo sapien
gatacaagtacaaaccaaagcctgg

SEQ ID NO: 251817 - DNA, 25 bp, Homo sapien
gaaatgtttctcttcgcaaaggact

SEQ ID NO: 251818 - DNA, 25 bp, Homo sapien
ttctaagctctcattttattactgg

SEQ ID NO: 251819 - DNA, 25 bp, Homo sapien
ttcgcaaaggactcttataccctcc

SEQ ID NO: 251820 - DNA, 25 bp, Homo sapien
ccctaaagaaatcaccatgccggtc

SEQ ID NO: 251821 - DNA, 25 bp, Homo sapien
ctcattttattactggagtcacaat

SEQ ID NO: 251822 - DNA, 25 bp, Homo sapien
tgtgtgtaggtgttgccgacaaaaa

SEQ ID NO: 251823 - DNA, 25 bp, Homo sapien
tgataattaactttcccttgaggtg

SEQ ID NO: 251824 - DNA, 25 bp, Homo sapien
taactttcccttgaggtgacacata

SEQ ID NO: 251825 - DNA, 25 bp, Homo sapien
gttgaatgacaaatcactccaaaca

SEQ ID NO: 251826 - DNA, 25 bp, Homo sapien
cagagaatcagctaggagaccagtt

SEQ ID NO: 251827 - DNA, 25 bp, Homo sapien
gagaccagttattcagggtccattt

SEQ ID NO: 251828 - DNA, 25 bp, Homo sapien
gtcctgggtaaaatgtggctgtaac

SEQ ID NO: 251829 - DNA, 25 bp, Homo sapien
gtggctgtaacctaaaccaactagt

SEQ ID NO: 251830 - DNA, 25 bp, Homo sapien
caactagtccttgtgatttgtttct

SEQ ID NO: 251831 - DNA, 25 bp, Homo sapien
ttctgccctctgtgtttcctgttgt

SEQ ID NO: 251832 - DNA, 25 bp, Homo sapien
gtgtttcctgttgtcaaatgctaag

SEQ ID NO: 251833 - DNA, 25 bp, Homo sapien
gctaagtgtgtgttttgcagtcatg

SEQ ID NO: 251834 - DNA, 25 bp, Homo sapien
cattgtagtcatatgtctggtgtga

SEQ ID NO: 251835 - DNA, 25 bp, Homo sapien
ctggtgtgacactttggagcaaaaa

SEQ ID NO: 251836 - DNA, 25 bp, Homo sapien
aaatcatatggctggacttcattaa

SEQ ID NO: 251837 - DNA, 25 bp, Homo sapien
gacttcattaatgttgtatggccaa

SEQ ID NO: 251838 - DNA, 25 bp, Homo sapien
tctaattatggcctgtgaacctccc

SEQ ID NO: 251839 - DNA, 25 bp, Homo sapien
tgtgaacctccctggatctcgatca

SEQ ID NO: 251840 - DNA, 25 bp, Homo sapien
gatctcgatcacctgcatatttggg

SEQ ID NO: 251841 - DNA, 25 bp, Homo sapien
gaatatgcaggttccagggtcccac

SEQ ID NO: 251842 - DNA, 25 bp, Homo sapien
agggtcccacctgaaactacagaat

SEQ ID NO: 251843 - DNA, 25 bp, Homo sapien
cagaatcagtattgagatcccaggt

SEQ ID NO: 251844 - DNA, 25 bp, Homo sapien
agatcccaggtgattctcatgtaca

SEQ ID NO: 251845 - DNA, 25 bp, Homo sapien
gtgattctcatgtacactcaagtgt

SEQ ID NO: 251846 - DNA, 25 bp, Homo sapien
acatggctaattctagggtgaacga

SEQ ID NO: 251847 - DNA, 25 bp, Homo sapien
gggattacagggacattttagccat

SEQ ID NO: 251848 - DNA, 25 bp, Homo sapien
cagggacattttagccataccaaga

SEQ ID NO: 251849 - DNA, 25 bp, Homo sapien
ttttagccataccaagaatcattag

SEQ ID NO: 251850 - DNA, 25 bp, Homo sapien
gaatcattagaagatgcaagctgga

SEQ ID NO: 251851 - DNA, 25 bp, Homo sapien
ggttttgaacccttcatgttgcagc

SEQ ID NO: 251852 - DNA, 25 bp, Homo sapien
gaacccttcatgttgcagcaaatgt

SEQ ID NO: 251853 - DNA, 25 bp, Homo sapien
gttgcagcaaatgtgaatctcctac

SEQ ID NO: 251854 - DNA, 25 bp, Homo sapien
gcagcaaatgtgaatctcctacaga

SEQ ID NO: 251855 - DNA, 25 bp, Homo sapien
ttggggacttacctgttcaaatagc

SEQ ID NO: 251856 - DNA, 25 bp, Homo sapien
tgttcaaatagcagcccggtgtcct

SEQ ID NO: 251857 - DNA, 25 bp, Homo sapien
atagcagcccggtgtcctctgtggg

SEQ ID NO: 251858 - DNA, 25 bp, Homo sapien
taggagtttgtgactagatgggcaa

SEQ ID NO: 251859 - DNA, 25 bp, Homo sapien
gagtttgtgactagatgggcaatat

SEQ ID NO: 251860 - DNA, 25 bp, Homo sapien
agtttgtgactagatgggcaatata

SEQ ID NO: 251861 - DNA, 25 bp, Homo sapien
gtttgtgactagatgggcaatatag

SEQ ID NO: 251862 - DNA, 25 bp, Homo sapien
tttgtgactagatgggcaatatagt

SEQ ID NO: 251863 - DNA, 25 bp, Homo sapien
ttgtgactagatgggcaatatagta

SEQ ID NO: 251864 - DNA, 25 bp, Homo sapien
tgtgactagatgggcaatatagtaa

SEQ ID NO: 251865 - DNA, 25 bp, Homo sapien
ggcaatatagtaagatgtcatcttt

SEQ ID NO: 251866 - DNA, 25 bp, Homo sapien
gcaatatagtaagatgtcatctttt

SEQ ID NO: 251867 - DNA, 25 bp, Homo sapien
attagctggccactgtggcacacgc

SEQ ID NO: 251868 - DNA, 25 bp, Homo sapien
tgagaaaatctatttaactcaatat

SEQ ID NO: 251869 - DNA, 25 bp, Homo sapien
ggccaaagtcatgggcctcattcca

SEQ ID NO: 251870 - DNA, 25 bp, Homo sapien
gcacttggcatggtgcatggagcac

SEQ ID NO: 251871 - DNA, 25 bp, Homo sapien
gggtcgggtccttccaggccacctg

SEQ ID NO: 251872 - DNA, 25 bp, Homo sapien
ggccacctgccgagagctaaaacat

SEQ ID NO: 251873 - DNA, 25 bp, Homo sapien
aaacatgtgctttgaacgactgcca

SEQ ID NO: 251874 - DNA, 25 bp, Homo sapien
gactgccagcaggatgcggtagcac

SEQ ID NO: 251875 - DNA, 25 bp, Homo sapien
ggatgcggtagcacgcacctgcaat

SEQ ID NO: 251876 - DNA, 25 bp, Homo sapien
gctgcactgaccaccctgggtgtga

SEQ ID NO: 251877 - DNA, 25 bp, Homo sapien
ggtgtgaaggccactcgcatataga

SEQ ID NO: 251878 - DNA, 25 bp, Homo sapien
catatagaggtgacaggcgacccct

SEQ ID NO: 251879 - DNA, 25 bp, Homo sapien
gaggtgacaggcgacccctctgttg

SEQ ID NO: 251880 - DNA, 25 bp, Homo sapien
ctggcttattattaatcgaattagc

SEQ ID NO: 251881 - DNA, 25 bp, Homo sapien
ttaatcgaattagcagtttctgttt

SEQ ID NO: 251882 - DNA, 25 bp, Homo sapien
atttcacctgctactcagccgtaaa

SEQ ID NO: 251883 - DNA, 25 bp, Homo sapien
acctgctactcagccgtaaaagttt

SEQ ID NO: 251884 - DNA, 25 bp, Homo sapien
gctactcagccgtaaaagtttattt

SEQ ID NO: 251885 - DNA, 25 bp, Homo sapien
gattcaaatgcagagattgagtttt

SEQ ID NO: 251886 - DNA, 25 bp, Homo sapien
gaggtcatattgagagtttgtcatc

SEQ ID NO: 251887 - DNA, 25 bp, Homo sapien
attgagagtttgtcatctcgtagaa

SEQ ID NO: 251888 - DNA, 25 bp, Homo sapien
gtttgtcatctcgtagaataatcag

SEQ ID NO: 251889 - DNA, 25 bp, Homo sapien
gtcatctcgtagaataatcagtatg

SEQ ID NO: 251890 - DNA, 25 bp, Homo sapien
agaggttttttggattagaggcagt

SEQ ID NO: 251891 - DNA, 25 bp, Homo sapien
gggaagtcccttatttggaagagag

SEQ ID NO: 251892 - DNA, 25 bp, Homo sapien
tgtagcacacactcatcatggattg

SEQ ID NO: 251893 - DNA, 25 bp, Homo sapien
catcatggattgctcagagttcctt

SEQ ID NO: 251894 - DNA, 25 bp, Homo sapien
cagagttcctttagggcagagctga

SEQ ID NO: 251895 - DNA, 25 bp, Homo sapien
ctgagggcctgggatccaggaacca

SEQ ID NO: 251896 - DNA, 25 bp, Homo sapien
gcaagacttgcatccaggtagccta

SEQ ID NO: 251897 - DNA, 25 bp, Homo sapien
ttgcatccaggtagcctaaggactc

SEQ ID NO: 251898 - DNA, 25 bp, Homo sapien
gtagcctaaggactcctggtcactg

SEQ ID NO: 251899 - DNA, 25 bp, Homo sapien
gggaaggctccaggcctaacttgga

SEQ ID NO: 251900 - DNA, 25 bp, Homo sapien
aggcctaacttggagcatgtcactg

SEQ ID NO: 251901 - DNA, 25 bp, Homo sapien
taacttggagcatgtcactggccat

SEQ ID NO: 251902 - DNA, 25 bp, Homo sapien
gttttttcagcaagctagccataca

SEQ ID NO: 251903 - DNA, 25 bp, Homo sapien
gcaagctagccatacaaccattgta

SEQ ID NO: 251904 - DNA, 25 bp, Homo sapien
ggtttagagcccagatcagttagta

SEQ ID NO: 251905 - DNA, 25 bp, Homo sapien
cagttagtaggctttcgttgtcttc

SEQ ID NO: 251906 - DNA, 25 bp, Homo sapien
taggctttcgttgtcttctctttca

SEQ ID NO: 251907 - DNA, 25 bp, Homo sapien
acatgtacatctttactgtttgaaa

SEQ ID NO: 251908 - DNA, 25 bp, Homo sapien
gttacagctgtcaaagaatcttcat

SEQ ID NO: 251909 - DNA, 25 bp, Homo sapien
gcaagtgtactgtcattcatagtgt

SEQ ID NO: 251910 - DNA, 25 bp, Homo sapien
gaatcttcacttttgctaccttgat

SEQ ID NO: 251911 - DNA, 25 bp, Homo sapien
gctaccttgatatagcattgggcta

SEQ ID NO: 251912 - DNA, 25 bp, Homo sapien
gcattgggctatcatgttacaacat

SEQ ID NO: 251913 - DNA, 25 bp, Homo sapien
ttacattaaggtcatttgtcagaat

SEQ ID NO: 251914 - DNA, 25 bp, Homo sapien
gtttgtttagagttggctgacctcc

SEQ ID NO: 251915 - DNA, 25 bp, Homo sapien
ttgtttagagttggctgacctccaa

SEQ ID NO: 251916 - DNA, 25 bp, Homo sapien
gggtcaaggaatcctactgccttag

SEQ ID NO: 251917 - DNA, 25 bp, Homo sapien
gtcaaggaatcctactgccttagct

SEQ ID NO: 251918 - DNA, 25 bp, Homo sapien
tataggcatgcacccggccatgtgt

SEQ ID NO: 251919 - DNA, 25 bp, Homo sapien
atttatagctcttaaagcccagatg

SEQ ID NO: 251920 - DNA, 25 bp, Homo sapien
aaagcccagatgaagaaatcacatt

SEQ ID NO: 251921 - DNA, 25 bp, Homo sapien
tagtgaagaaacatttggccattga

SEQ ID NO: 251922 - DNA, 25 bp, Homo sapien
gctgaagatgtgtccaaagagatcc

SEQ ID NO: 251923 - DNA, 25 bp, Homo sapien
gtgtccaaagagatccttacattaa

SEQ ID NO: 251924 - DNA, 25 bp, Homo sapien
tctctgttatttaggctgacaagga

SEQ ID NO: 251925 - DNA, 25 bp, Homo sapien
gttatttaggctgacaaggatatgc

SEQ ID NO: 251926 - DNA, 25 bp, Homo sapien
gctgacaaggatatgccaagaagta

SEQ ID NO: 251927 - DNA, 25 bp, Homo sapien
gtagcttggatatagcagttaactc

SEQ ID NO: 251928 - DNA, 25 bp, Homo sapien
ggatatagcagttaactctgccttt

SEQ ID NO: 251929 - DNA, 25 bp, Homo sapien
agcagttaactctgcctttaggata

SEQ ID NO: 251930 - DNA, 25 bp, Homo sapien
gttaactctgcctttaggatatgtg

SEQ ID NO: 251931 - DNA, 25 bp, Homo sapien
gagttaactaaaagctgacctttga

SEQ ID NO: 251932 - DNA, 25 bp, Homo sapien
tgcagacctttggtttccatattaa

SEQ ID NO: 251933 - DNA, 25 bp, Homo sapien
cagacctttggtttccatattaaga

SEQ ID NO: 251934 - DNA, 25 bp, Homo sapien
ggtttccatattaagaaattcagat

SEQ ID NO: 251935 - DNA, 25 bp, Homo sapien
acatttattgcgtacctcctatatt

SEQ ID NO: 251936 - DNA, 25 bp, Homo sapien
gcgtacctcctatattctgcaaatt

SEQ ID NO: 251937 - DNA, 25 bp, Homo sapien
gggtttctgtgatgattctgagaat

SEQ ID NO: 251938 - DNA, 25 bp, Homo sapien
tattctgcaaattttccccaaatag

SEQ ID NO: 251939 - DNA, 25 bp, Homo sapien
ttttccccaaatagaagccagttca

SEQ ID NO: 251940 - DNA, 25 bp, Homo sapien
tccacaccatctcttctttgagttg

SEQ ID NO: 251941 - DNA, 25 bp, Homo sapien
ttgagttgtttatggcctcccttaa

SEQ ID NO: 251942 - DNA, 25 bp, Homo sapien
atggcctcccttaaggcattttaca

SEQ ID NO: 251943 - DNA, 25 bp, Homo sapien
ttacaaacccataagcctacaatag

SEQ ID NO: 251944 - DNA, 25 bp, Homo sapien
gtgtcataatagcatcaatgtgcac

SEQ ID NO: 251945 - DNA, 25 bp, Homo sapien
agcagaaatagggttttctcatctt

SEQ ID NO: 251946 - DNA, 25 bp, Homo sapien
atttccagaaccgtgccagagagat

SEQ ID NO: 251947 - DNA, 25 bp, Homo sapien
gagtctggttgagtcctgatcacca

SEQ ID NO: 251948 - DNA, 25 bp, Homo sapien
tgatcaccagtatcttttttctgaa

SEQ ID NO: 251949 - DNA, 25 bp, Homo sapien
tttctgaaggcaggtctaggctcac

SEQ ID NO: 251950 - DNA, 25 bp, Homo sapien
ggtctaggctcaccaagagttgcaa

SEQ ID NO: 251951 - DNA, 25 bp, Homo sapien
gagttgcaaaccacatcttatctag

SEQ ID NO: 251952 - DNA, 25 bp, Homo sapien
gattgagaactctcatgtctgcagg

SEQ ID NO: 251953 - DNA, 25 bp, Homo sapien
taagaatgtttgcaccacctgttgg

SEQ ID NO: 251954 - DNA, 25 bp, Homo sapien
gcaccacctgttggcagtcagatta

SEQ ID NO: 251955 - DNA, 25 bp, Homo sapien
aaaacggtgccagccaaatagttga

SEQ ID NO: 251956 - DNA, 25 bp, Homo sapien
atagttgaccaatggcccacaagac

SEQ ID NO: 251957 - DNA, 25 bp, Homo sapien
ggttctgtaagtgttttctccattg

SEQ ID NO: 251958 - DNA, 25 bp, Homo sapien
ctgtaagtgttttctccattgcctc

SEQ ID NO: 251959 - DNA, 25 bp, Homo sapien
attgcctcttgccagggagggtaat

SEQ ID NO: 251960 - DNA, 25 bp, Homo sapien
ccagggagggtaatggcttcctaga

SEQ ID NO: 251961 - DNA, 25 bp, Homo sapien
gggtaatggcttcctagagccagat

SEQ ID NO: 251962 - DNA, 25 bp, Homo sapien
cctgccaggtctctgtctgacagtg

SEQ ID NO: 251963 - DNA, 25 bp, Homo sapien
taaccctgcctacactttcaagaat

SEQ ID NO: 251964 - DNA, 25 bp, Homo sapien
aagaattgaaactctttgcagcctc

SEQ ID NO: 251965 - DNA, 25 bp, Homo sapien
gtactatcgatttcctaaaggaccg

SEQ ID NO: 251966 - DNA, 25 bp, Homo sapien
cctaaaggaccgtgagtgatataca

SEQ ID NO: 251967 - DNA, 25 bp, Homo sapien
gtgacagtgttcacttggttctgta

SEQ ID NO: 251968 - DNA, 25 bp, Homo sapien
ctctaacaacaaaatatggaggctt

SEQ ID NO: 251969 - DNA, 25 bp, Homo sapien
tggaggcttttatatcaacactggc

SEQ ID NO: 251970 - DNA, 25 bp, Homo sapien
ggcttttatatcaacactggcactc

SEQ ID NO: 251971 - DNA, 25 bp, Homo sapien
tttatatcaacactggcactctaca

SEQ ID NO: 251972 - DNA, 25 bp, Homo sapien
atcaacactggcactctacagtttc

SEQ ID NO: 251973 - DNA, 25 bp, Homo sapien
actggcactctacagtttcgccaag

SEQ ID NO: 251974 - DNA, 25 bp, Homo sapien
tggcactctacagtttcgccaagct

SEQ ID NO: 251975 - DNA, 25 bp, Homo sapien
gtttcgccaagcttcagatactgaa

SEQ ID NO: 251976 - DNA, 25 bp, Homo sapien
gaagatgatattacagacaaccaaa

SEQ ID NO: 251977 - DNA, 25 bp, Homo sapien
acagacaaccaaaagcacaagccac

SEQ ID NO: 251978 - DNA, 25 bp, Homo sapien
gatattgagatgaagaagcggaagc

SEQ ID NO: 251979 - DNA, 25 bp, Homo sapien
agcttgcaacaaggctttgttttct

SEQ ID NO: 251980 - DNA, 25 bp, Homo sapien
agatctgttccatttcacttactgt

SEQ ID NO: 251981 - DNA, 25 bp, Homo sapien
tttcacttactgttctgaggagggt

SEQ ID NO: 251982 - DNA, 25 bp, Homo sapien
tctgaggagggtttcaaggttctgt

SEQ ID NO: 251983 - DNA, 25 bp, Homo sapien
tttcaaggttctgtgtttaaagtca

SEQ ID NO: 251984 - DNA, 25 bp, Homo sapien
aggatttacctgtctgtagaacata

SEQ ID NO: 251985 - DNA, 25 bp, Homo sapien
tagagtaagctagccttttgcacat

SEQ ID NO: 251986 - DNA, 25 bp, Homo sapien
agccttttgcacatttacattgaca

SEQ ID NO: 251987 - DNA, 25 bp, Homo sapien
tacattgacatgtttcttcttgaat

SEQ ID NO: 251988 - DNA, 25 bp, Homo sapien
tcttgaatttggactgttgcagcat

SEQ ID NO: 251989 - DNA, 25 bp, Homo sapien
atttggactgttgcagcatatctat

SEQ ID NO: 251990 - DNA, 25 bp, Homo sapien
tggcaaatcagatttcatgaggaaa

SEQ ID NO: 251991 - DNA, 25 bp, Homo sapien
ggcaaatcagatttcatgaggaaaa

SEQ ID NO: 251992 - DNA, 25 bp, Homo sapien
gcaaatcagatttcatgaggaaaat

SEQ ID NO: 251993 - DNA, 25 bp, Homo sapien
atcagatttcatgaggaaaatggca

SEQ ID NO: 251994 - DNA, 25 bp, Homo sapien
tcagatttcatgaggaaaatggcat

SEQ ID NO: 251995 - DNA, 25 bp, Homo sapien
gatttcatgaggaaaatggcatggt

SEQ ID NO: 251996 - DNA, 25 bp, Homo sapien
atttcatgaggaaaatggcatggtt

SEQ ID NO: 251997 - DNA, 25 bp, Homo sapien
tttcatgaggaaaatggcatggttg

SEQ ID NO: 251998 - DNA, 25 bp, Homo sapien
tcatgaggaaaatggcatggttgaa

SEQ ID NO: 251999 - DNA, 25 bp, Homo sapien
atggaagtgggagacaattccacac

SEQ ID NO: 252000 - DNA, 25 bp, Homo sapien
tggaagtgggagacaattccacaca

SEQ ID NO: 252001 - DNA, 25 bp, Homo sapien
tcgagctgccccacggagaccaggg

SEQ ID NO: 252002 - DNA, 25 bp, Homo sapien
tgagctgtcccgaggcaccgctttc

SEQ ID NO: 252003 - DNA, 25 bp, Homo sapien
gaccaagtctgagttcttgttctca

SEQ ID NO: 252004 - DNA, 25 bp, Homo sapien
tcagtggcctcacctctggagggct

SEQ ID NO: 252005 - DNA, 25 bp, Homo sapien
ttgttctcactctgatcactgtgct

SEQ ID NO: 252006 - DNA, 25 bp, Homo sapien
gtggcatctcagagagtcatccctg

SEQ ID NO: 252007 - DNA, 25 bp, Homo sapien
agtcatccctgacgaaggaggcgcc

SEQ ID NO: 252008 - DNA, 25 bp, Homo sapien
aggcgccgcaggtctcacagcggaa

SEQ ID NO: 252009 - DNA, 25 bp, Homo sapien
acagcactggtcagaagttccgaca

SEQ ID NO: 252010 - DNA, 25 bp, Homo sapien
agaagttccgacagctgaccaccct

SEQ ID NO: 252011 - DNA, 25 bp, Homo sapien
cttcggctgagctagaggtcttggc

SEQ ID NO: 252012 - DNA, 25 bp, Homo sapien
cccagctactccagctactcggaag

SEQ ID NO: 252013 - DNA, 25 bp, Homo sapien
ccagctactccagctactcggaagg

SEQ ID NO: 252014 - DNA, 25 bp, Homo sapien
cagctactccagctactcggaaggc

SEQ ID NO: 252015 - DNA, 25 bp, Homo sapien
agctactccagctactcggaaggct

SEQ ID NO: 252016 - DNA, 25 bp, Homo sapien
gctactccagctactcggaaggctg

SEQ ID NO: 252017 - DNA, 25 bp, Homo sapien
ctactccagctactcggaaggctga

SEQ ID NO: 252018 - DNA, 25 bp, Homo sapien
agagcttgcagctagctgagattgt

SEQ ID NO: 252019 - DNA, 25 bp, Homo sapien
agcttgcagctagctgagattgtgc

SEQ ID NO: 252020 - DNA, 25 bp, Homo sapien
gcttgcagctagctgagattgtgcc

SEQ ID NO: 252021 - DNA, 25 bp, Homo sapien
gagacgtaggtagccgtagttggac

SEQ ID NO: 252022 - DNA, 25 bp, Homo sapien
gtagttggacggacgggcagggccg

SEQ ID NO: 252023 - DNA, 25 bp, Homo sapien
ttcccccagctgtaagacagggacg

SEQ ID NO: 252024 - DNA, 25 bp, Homo sapien
gggcggcccagtggctgagaggagc

SEQ ID NO: 252025 - DNA, 25 bp, Homo sapien
gcccagtggctgagaggagccggct

SEQ ID NO: 252026 - DNA, 25 bp, Homo sapien
agaggagccggctgtggagccccgc

SEQ ID NO: 252027 - DNA, 25 bp, Homo sapien
cgtccgaggaggatcgttttctaag

SEQ ID NO: 252028 - DNA, 25 bp, Homo sapien
gtccgaggaggatcgttttctaagt

SEQ ID NO: 252029 - DNA, 25 bp, Homo sapien
cgaggaggatcgttttctaagtgca

SEQ ID NO: 252030 - DNA, 25 bp, Homo sapien
aggaggatcgttttctaagtgcaat

SEQ ID NO: 252031 - DNA, 25 bp, Homo sapien
gaggatcgttttctaagtgcaatac

SEQ ID NO: 252032 - DNA, 25 bp, Homo sapien
tttcctccctggtagagccacagcg

SEQ ID NO: 252033 - DNA, 25 bp, Homo sapien
ttcctccctggtagagccacagcgg

SEQ ID NO: 252034 - DNA, 25 bp, Homo sapien
tggtagagccacagcggggtatcca

SEQ ID NO: 252035 - DNA, 25 bp, Homo sapien
tattattggcgagaaggaccatggc

SEQ ID NO: 252036 - DNA, 25 bp, Homo sapien
tattggcgagaaggaccatggcacc

SEQ ID NO: 252037 - DNA, 25 bp, Homo sapien
ttggcgagaaggaccatggcaccgc

SEQ ID NO: 252038 - DNA, 25 bp, Homo sapien
gagaaggaccatggcaccgcaccaa

SEQ ID NO: 252039 - DNA, 25 bp, Homo sapien
tggagcaccaggcaggtttccaaag

SEQ ID NO: 252040 - DNA, 25 bp, Homo sapien
ggagcaccaggcaggtttccaaagc

SEQ ID NO: 252041 - DNA, 25 bp, Homo sapien
gagcaccaggcaggtttccaaagca

SEQ ID NO: 252042 - DNA, 25 bp, Homo sapien
gcaccaggcaggtttccaaagcacc

SEQ ID NO: 252043 - DNA, 25 bp, Homo sapien
aactgtccatggcatgaaagacttg

SEQ ID NO: 252044 - DNA, 25 bp, Homo sapien
gaaagacttggaccgccatctcaga

SEQ ID NO: 252045 - DNA, 25 bp, Homo sapien
ttctgtgacaagtgcttcagccgga

SEQ ID NO: 252046 - DNA, 25 bp, Homo sapien
gaaggacaacctgaccatgcacatg

SEQ ID NO: 252047 - DNA, 25 bp, Homo sapien
atgcggtgccacaccagtgtgaagc

SEQ ID NO: 252048 - DNA, 25 bp, Homo sapien
aagtgtcacctgtgtgactacgctg

SEQ ID NO: 252049 - DNA, 25 bp, Homo sapien
tgtgactacgctgccgtggacagca

SEQ ID NO: 252050 - DNA, 25 bp, Homo sapien
gccgtggacagcagtagcctcaaga

SEQ ID NO: 252051 - DNA, 25 bp, Homo sapien
gtagcctcaagaagcacctgcggat

SEQ ID NO: 252052 - DNA, 25 bp, Homo sapien
ggatccactctgatgagcggccgta

SEQ ID NO: 252053 - DNA, 25 bp, Homo sapien
atgagcggccgtacaaatgccagct

SEQ ID NO: 252054 - DNA, 25 bp, Homo sapien
acaaggagctactacccaagggaag

SEQ ID NO: 252055 - DNA, 25 bp, Homo sapien
gaagattaattggtgacctttcgcc

SEQ ID NO: 252056 - DNA, 25 bp, Homo sapien
gttgctggtcaaggcagaaacgcta

SEQ ID NO: 252057 - DNA, 25 bp, Homo sapien
gaaacgctaacttccaactgtggtc

SEQ ID NO: 252058 - DNA, 25 bp, Homo sapien
acttccaactgtggtctgttaagag

SEQ ID NO: 252059 - DNA, 25 bp, Homo sapien
gttaagagatctgctgggaaccttc

SEQ ID NO: 252060 - DNA, 25 bp, Homo sapien
ttcagaagcactgccttccaaggcg

SEQ ID NO: 252061 - DNA, 25 bp, Homo sapien
gacgggtggagcttgttcaacccaa

SEQ ID NO: 252062 - DNA, 25 bp, Homo sapien
caacccaaagatgtgtgcgatgaac

SEQ ID NO: 252063 - DNA, 25 bp, Homo sapien
gatgaacggatctacacactggaaa

SEQ ID NO: 252064 - DNA, 25 bp, Homo sapien
atacgtatcaaaactgcaacagcaa

SEQ ID NO: 252065 - DNA, 25 bp, Homo sapien
atagtttttactagtatcaccaaat

SEQ ID NO: 252066 - DNA, 25 bp, Homo sapien
tttactagtatcaccaaattgagtg

SEQ ID NO: 252067 - DNA, 25 bp, Homo sapien
aattacattctttattttctattag

SEQ ID NO: 252068 - DNA, 25 bp, Homo sapien
ttttctattagctgtattcatactt

SEQ ID NO: 252069 - DNA, 25 bp, Homo sapien
attagctgtattcatactttggttg

SEQ ID NO: 252070 - DNA, 25 bp, Homo sapien
ggttgcttcagactttatatattgt

SEQ ID NO: 252071 - DNA, 25 bp, Homo sapien
gcttcagactttatatattgttctt

SEQ ID NO: 252072 - DNA, 25 bp, Homo sapien
aaattgtcacttctattctttacag

SEQ ID NO: 252073 - DNA, 25 bp, Homo sapien
gtcacttctattctttacagaacct

SEQ ID NO: 252074 - DNA, 25 bp, Homo sapien
tctttacagaaccttgtagtgccaa

SEQ ID NO: 252075 - DNA, 25 bp, Homo sapien
cagaaccttgtagtgccaaaaactt

SEQ ID NO: 252076 - DNA, 25 bp, Homo sapien
agtctcaacaccctcagccactagg

SEQ ID NO: 252077 - DNA, 25 bp, Homo sapien
agccactagggcacatccagaattt

SEQ ID NO: 252078 - DNA, 25 bp, Homo sapien
cactagggcacatccagaattttag

SEQ ID NO: 252079 - DNA, 25 bp, Homo sapien
gggcacatccagaattttagagaca

SEQ ID NO: 252080 - DNA, 25 bp, Homo sapien
agaattttagagacatctccaggta

SEQ ID NO: 252081 - DNA, 25 bp, Homo sapien
gaccaatgatgttttcccatctctg

SEQ ID NO: 252082 - DNA, 25 bp, Homo sapien
gcagcaccaatgtgggcaggcctgt

SEQ ID NO: 252083 - DNA, 25 bp, Homo sapien
ggcaggcctgtctggactcaagcta

SEQ ID NO: 252084 - DNA, 25 bp, Homo sapien
atgttttcccatctctgaatgctag

SEQ ID NO: 252085 - DNA, 25 bp, Homo sapien
gttttcccatctctgaatgctaggg

SEQ ID NO: 252086 - DNA, 25 bp, Homo sapien
tacccctggggcatcttcactgata

SEQ ID NO: 252087 - DNA, 25 bp, Homo sapien
tgaaccagggtttgtttaccttctg

SEQ ID NO: 252088 - DNA, 25 bp, Homo sapien
ggtttgtttaccttctgagctgcag

SEQ ID NO: 252089 - DNA, 25 bp, Homo sapien
ttgtttaccttctgagctgcagaga

SEQ ID NO: 252090 - DNA, 25 bp, Homo sapien
gggcttctggaatttaaggtaacag

SEQ ID NO: 252091 - DNA, 25 bp, Homo sapien
gcaggggtatcttgatcatccggat

SEQ ID NO: 252092 - DNA, 25 bp, Homo sapien
atggtggtacccacccctatggagg

SEQ ID NO: 252093 - DNA, 25 bp, Homo sapien
accctgacacggagacactggcaga

SEQ ID NO: 252094 - DNA, 25 bp, Homo sapien
tgacacggagacactggcagaatag

SEQ ID NO: 252095 - DNA, 25 bp, Homo sapien
gagctgattgcaccactgatgcctc

SEQ ID NO: 252096 - DNA, 25 bp, Homo sapien
tgattgcaccactgatgcctcccaa

SEQ ID NO: 252097 - DNA, 25 bp, Homo sapien
tgggagaccaatgcctgaaccaggg

SEQ ID NO: 252098 - DNA, 25 bp, Homo sapien
tgccacagcagctgtactcacagca

SEQ ID NO: 252099 - DNA, 25 bp, Homo sapien
agcacccacgtgcttggcactgcag

SEQ ID NO: 252100 - DNA, 25 bp, Homo sapien
tcttctgcccagaacaattttacag

SEQ ID NO: 252101 - DNA, 25 bp, Homo sapien
gaaaaacaaagcattgccttgggaa

SEQ ID NO: 252102 - DNA, 25 bp, Homo sapien
gccttgggaatatttcagtgttatt

SEQ ID NO: 252103 - DNA, 25 bp, Homo sapien
tgaggtttctaggaacactggactt

SEQ ID NO: 252104 - DNA, 25 bp, Homo sapien
ggaacactggacttgtaagtactat

SEQ ID NO: 252105 - DNA, 25 bp, Homo sapien
gtactataaagctcacatgcctgtt

SEQ ID NO: 252106 - DNA, 25 bp, Homo sapien
aagctcacatgcctgttacttctgt

SEQ ID NO: 252107 - DNA, 25 bp, Homo sapien
gcctgttacttctgtgcaaatggag

SEQ ID NO: 252108 - DNA, 25 bp, Homo sapien
gccacctgaaagatggtcacaatgg

SEQ ID NO: 252109 - DNA, 25 bp, Homo sapien
aaattgagcctttagtgaacttgaa

SEQ ID NO: 252110 - DNA, 25 bp, Homo sapien
ttgaataccctgttccccaatcact

SEQ ID NO: 252111 - DNA, 25 bp, Homo sapien
gcagtttctgagcagccaacatgtc

SEQ ID NO: 252112 - DNA, 25 bp, Homo sapien
gcagccaacatgtcagaggcaggaa

SEQ ID NO: 252113 - DNA, 25 bp, Homo sapien
acttcatgttcagaattgtctccaa

SEQ ID NO: 252114 - DNA, 25 bp, Homo sapien
aagacacctgcctttacacgtgtat

SEQ ID NO: 252115 - DNA, 25 bp, Homo sapien
gcctttacacgtgtattttaagcta

SEQ ID NO: 252116 - DNA, 25 bp, Homo sapien
gggaacattcaatatgggtgtcttt

SEQ ID NO: 252117 - DNA, 25 bp, Homo sapien
tcaatatgggtgtctttgctgtgct

SEQ ID NO: 252118 - DNA, 25 bp, Homo sapien
tgctgtgcttgcagtcttaattctg

SEQ ID NO: 252119 - DNA, 25 bp, Homo sapien
tgcagtcttaattctgtggacactg

SEQ ID NO: 252120 - DNA, 25 bp, Homo sapien
agtctcaacaccctcagccactagg

SEQ ID NO: 252121 - DNA, 25 bp, Homo sapien
agccactagggcacatccagaattt

SEQ ID NO: 252122 - DNA, 25 bp, Homo sapien
aaagaccaatgatgttttcccatct

SEQ ID NO: 252123 - DNA, 25 bp, Homo sapien
cactagggcacatccagaattttag

SEQ ID NO: 252124 - DNA, 25 bp, Homo sapien
gggcacatccagaattttagagaca

SEQ ID NO: 252125 - DNA, 25 bp, Homo sapien
agaattttagagacatctccaggta

SEQ ID NO: 252126 - DNA, 25 bp, Homo sapien
gaccaatgatgttttcccatctctg

SEQ ID NO: 252127 - DNA, 25 bp, Homo sapien
atgatgttttcccatctctgaatgc

SEQ ID NO: 252128 - DNA, 25 bp, Homo sapien
atgttttcccatctctgaatgctag

SEQ ID NO: 252129 - DNA, 25 bp, Homo sapien
gttttcccatctctgaatgctaggg

SEQ ID NO: 252130 - DNA, 25 bp, Homo sapien
tacccctggggcatcttcactgata

SEQ ID NO: 252131 - DNA, 25 bp, Homo sapien
tgaacccaaccagacggagaatgat

SEQ ID NO: 252132 - DNA, 25 bp, Homo sapien
gagaatgatgccctggaacctgaag

SEQ ID NO: 252133 - DNA, 25 bp, Homo sapien
gaacctgaagatctgtcccaggctg

SEQ ID NO: 252134 - DNA, 25 bp, Homo sapien
gaggcttgagctgcagagatctgct

SEQ ID NO: 252135 - DNA, 25 bp, Homo sapien
agatctgctaactcaaacccggcta

SEQ ID NO: 252136 - DNA, 25 bp, Homo sapien
tatggcaccccgagaacgcaaagct

SEQ ID NO: 252137 - DNA, 25 bp, Homo sapien
gaagactttcacatcctgttagctt

SEQ ID NO: 252138 - DNA, 25 bp, Homo sapien
agctttcttaactagtattgtccat

SEQ ID NO: 252139 - DNA, 25 bp, Homo sapien
gtattgtccatatcagacctctgat

SEQ ID NO: 252140 - DNA, 25 bp, Homo sapien
aagtcttcagcgagacccttgcatt

SEQ ID NO: 252141 - DNA, 25 bp, Homo sapien
gagacccttgcattagaaactgaaa

SEQ ID NO: 252142 - DNA, 25 bp, Homo sapien
ggaagtcgctgagtgatagctgatc

SEQ ID NO: 252143 - DNA, 25 bp, Homo sapien
ccaggcactcatcttcttaaacata

SEQ ID NO: 252144 - DNA, 25 bp, Homo sapien
aattacaatttagcccattcttgat

SEQ ID NO: 252145 - DNA, 25 bp, Homo sapien
attcttgatggctcattgtcatttc

SEQ ID NO: 252146 - DNA, 25 bp, Homo sapien
ttgtcatttctgtgagcttctcttt

SEQ ID NO: 252147 - DNA, 25 bp, Homo sapien
gcttctcttttcataatggcctgta

SEQ ID NO: 252148 - DNA, 25 bp, Homo sapien
tcatagggccaagggattttaacat

SEQ ID NO: 252149 - DNA, 25 bp, Homo sapien
taactttttgtcctaggttagcttg

SEQ ID NO: 252150 - DNA, 25 bp, Homo sapien
ctaggttagcttgtatctctcccac

SEQ ID NO: 252151 - DNA, 25 bp, Homo sapien
ataactgctgctgagacatctatgt

SEQ ID NO: 252152 - DNA, 25 bp, Homo sapien
tgatatcatttgacgtcaacctccc

SEQ ID NO: 252153 - DNA, 25 bp, Homo sapien
tacaagtacagcattcttggaaaga

SEQ ID NO: 252154 - DNA, 25 bp, Homo sapien
aaatctcaaggttggaaatacagcc

SEQ ID NO: 252155 - DNA, 25 bp, Homo sapien
cttactctctctagagctggaggac

SEQ ID NO: 252156 - DNA, 25 bp, Homo sapien
acaggtttgtggttgaggacttctc

SEQ ID NO: 252157 - DNA, 25 bp, Homo sapien
aggacttctctgtccgatgtctaca

SEQ ID NO: 252158 - DNA, 25 bp, Homo sapien
gtccgatgtctacattcaggttctg

SEQ ID NO: 252159 - DNA, 25 bp, Homo sapien
gtctacattcaggttctgacttcat

SEQ ID NO: 252160 - DNA, 25 bp, Homo sapien
aggatttcctccctgtctttttcag

SEQ ID NO: 252161 - DNA, 25 bp, Homo sapien
tccctgtctttttcagtgtctcata

SEQ ID NO: 252162 - DNA, 25 bp, Homo sapien
gtgtctcataaacgctactctggat

SEQ ID NO: 252163 - DNA, 25 bp, Homo sapien
aacgctactctggattgttgtaaat

SEQ ID NO: 252164 - DNA, 25 bp, Homo sapien
cactcggacgggacgcgcacttgcg

SEQ ID NO: 252165 - DNA, 25 bp, Homo sapien
gcacttgcgccaagctctatgacaa

SEQ ID NO: 252166 - DNA, 25 bp, Homo sapien
tctatgacaagagcgacccctacta

SEQ ID NO: 252167 - DNA, 25 bp, Homo sapien
agagcgacccctactatgagaactg

SEQ ID NO: 252168 - DNA, 25 bp, Homo sapien
gacccctactatgagaactgctgcg

SEQ ID NO: 252169 - DNA, 25 bp, Homo sapien
gggcgccgagctgtcgctggagtcg

SEQ ID NO: 252170 - DNA, 25 bp, Homo sapien
ggagtcgggcgcagacctgccctac

SEQ ID NO: 252171 - DNA, 25 bp, Homo sapien
aacaccgcctcctcacttgtggtgg

SEQ ID NO: 252172 - DNA, 25 bp, Homo sapien
cgcgctgcgagctcaccgtgtggtc

SEQ ID NO: 252173 - DNA, 25 bp, Homo sapien
tcaccgtgtggtcccggcaaggcaa

SEQ ID NO: 252174 - DNA, 25 bp, Homo sapien
gacctcaagcactcggacgggacgc

SEQ ID NO: 252175 - DNA, 25 bp, Homo sapien
ttgggttttcaacagctggagaaat

SEQ ID NO: 252176 - DNA, 25 bp, Homo sapien
tttactttggaatccccgcagcctc

SEQ ID NO: 252177 - DNA, 25 bp, Homo sapien
gaatctgaatatcaccatctggaag

SEQ ID NO: 252178 - DNA, 25 bp, Homo sapien
tatcaccatctggaagttgtgccat

SEQ ID NO: 252179 - DNA, 25 bp, Homo sapien
aggattcgagctgggattctcttct

SEQ ID NO: 252180 - DNA, 25 bp, Homo sapien
attctcttcttcctctagcagtgta

SEQ ID NO: 252181 - DNA, 25 bp, Homo sapien
cttcctctagcagtgtatttcttct

SEQ ID NO: 252182 - DNA, 25 bp, Homo sapien
attccctaatggaccaactcagacc

SEQ ID NO: 252183 - DNA, 25 bp, Homo sapien
gctgaggcaggtccttccgtaaaat

SEQ ID NO: 252184 - DNA, 25 bp, Homo sapien
gaatgagcggcgcttaatccatccg

SEQ ID NO: 252185 - DNA, 25 bp, Homo sapien
taatccatccgccaaaggccagtct

SEQ ID NO: 252186 - DNA, 25 bp, Homo sapien
gacactgacgccacactgagcagga

SEQ ID NO: 252187 - DNA, 25 bp, Homo sapien
tgacgccacactgagcaggatgcac

SEQ ID NO: 252188 - DNA, 25 bp, Homo sapien
acactgagcaggatgcacggcccgg

SEQ ID NO: 252189 - DNA, 25 bp, Homo sapien
tggtggcccgagacaccgagagctt

SEQ ID NO: 252190 - DNA, 25 bp, Homo sapien
acaccgagagcttggttctgggact

SEQ ID NO: 252191 - DNA, 25 bp, Homo sapien
gttctgggactgtggctcagctgac

SEQ ID NO: 252192 - DNA, 25 bp, Homo sapien
aacacatgaggttcagctcgtgccg

SEQ ID NO: 252193 - DNA, 25 bp, Homo sapien
atgaggttcagctcgtgccgggcac

SEQ ID NO: 252194 - DNA, 25 bp, Homo sapien
tgccgggcactgtacattcactgaa

SEQ ID NO: 252195 - DNA, 25 bp, Homo sapien
cgggcactgtacattcactgaagca

SEQ ID NO: 252196 - DNA, 25 bp, Homo sapien
ctgtacattcactgaagcagctcaa

SEQ ID NO: 252197 - DNA, 25 bp, Homo sapien
gtgacagccctgtacacagcactgt

SEQ ID NO: 252198 - DNA, 25 bp, Homo sapien
tacacagcactgtgacctcctacag

SEQ ID NO: 252199 - DNA, 25 bp, Homo sapien
tacagctccgtgcagtacccactgg

SEQ ID NO: 252200 - DNA, 25 bp, Homo sapien
tgggcatgcggttgccctgcctttg

SEQ ID NO: 252201 - DNA, 25 bp, Homo sapien
cctcctacgatgaagctgtcaagat

SEQ ID NO: 252202 - DNA, 25 bp, Homo sapien
aagctgtcaagatggccaagcccag

SEQ ID NO: 252203 - DNA, 25 bp, Homo sapien
caagatggccaagcccagagaggaa

SEQ ID NO: 252204 - DNA, 25 bp, Homo sapien
ggaaggaccagcactctcccagaaa

SEQ ID NO: 252205 - DNA, 25 bp, Homo sapien
tcgggcctagagaccactccagtgc

SEQ ID NO: 252206 - DNA, 25 bp, Homo sapien
ggagtcgggccccaatactcaacta

SEQ ID NO: 252207 - DNA, 25 bp, Homo sapien
aatactcaactaccaccttgtagcc

SEQ ID NO: 252208 - DNA, 25 bp, Homo sapien
ccttggaaacagttgaactctgaaa

SEQ ID NO: 252209 - DNA, 25 bp, Homo sapien
agttgaactctgaaaagctgatggc

SEQ ID NO: 252210 - DNA, 25 bp, Homo sapien
ggcaaatcagatttcatgaggaaaa

SEQ ID NO: 252211 - DNA, 25 bp, Homo sapien
gcaaatcagatttcatgaggaaaat

SEQ ID NO: 252212 - DNA, 25 bp, Homo sapien
tcagatttcatgaggaaaatggcat

SEQ ID NO: 252213 - DNA, 25 bp, Homo sapien
atttcatgaggaaaatggcatggtt

SEQ ID NO: 252214 - DNA, 25 bp, Homo sapien
aaatggcatggttgaaaatagtaat

SEQ ID NO: 252215 - DNA, 25 bp, Homo sapien
aataagactgaagttttaaatgact

SEQ ID NO: 252216 - DNA, 25 bp, Homo sapien
atggaagtgggagacaattccacac

SEQ ID NO: 252217 - DNA, 25 bp, Homo sapien
tggaagtgggagacaattccacaca

SEQ ID NO: 252218 - DNA, 25 bp, Homo sapien
gtgggagacaattccacacacaggg

SEQ ID NO: 252219 - DNA, 25 bp, Homo sapien
gacagcactttaaaactttaacagc

SEQ ID NO: 252220 - DNA, 25 bp, Homo sapien
aacttgtactacatacttgatctga

SEQ ID NO: 252221 - DNA, 25 bp, Homo sapien
tgcttgcttaatgattcccaggaaa

SEQ ID NO: 252222 - DNA, 25 bp, Homo sapien
gattcccaggaaacttcgttgtagg

SEQ ID NO: 252223 - DNA, 25 bp, Homo sapien
gaaacttcgttgtaggcatatattt

SEQ ID NO: 252224 - DNA, 25 bp, Homo sapien
atacagtgttaactatgcaagtaag

SEQ ID NO: 252225 - DNA, 25 bp, Homo sapien
aatgttttagtccaattactgtgat

SEQ ID NO: 252226 - DNA, 25 bp, Homo sapien
actgtgatttattcaactctgttct

SEQ ID NO: 252227 - DNA, 25 bp, Homo sapien
actctgttctaaagttatctggaat

SEQ ID NO: 252228 - DNA, 25 bp, Homo sapien
tatctggaattgtcatgctgcctca

SEQ ID NO: 252229 - DNA, 25 bp, Homo sapien
tgtcatgctgcctcaatttacagaa

SEQ ID NO: 252230 - DNA, 25 bp, Homo sapien
gtactcttggtttcagaatcgtaac

SEQ ID NO: 252231 - DNA, 25 bp, Homo sapien
tcgtaactaagaggtaaggcattgg

SEQ ID NO: 252232 - DNA, 25 bp, Homo sapien
gaggctttcaaaatcagtatctggg

SEQ ID NO: 252233 - DNA, 25 bp, Homo sapien
gacactgaagaaacactcatccaca

SEQ ID NO: 252234 - DNA, 25 bp, Homo sapien
ggaaaggatgtctgtccatctaaca

SEQ ID NO: 252235 - DNA, 25 bp, Homo sapien
gtctgtccatctaacaagctcaggg

SEQ ID NO: 252236 - DNA, 25 bp, Homo sapien
gggtttctgagtctcagaatgacat

SEQ ID NO: 252237 - DNA, 25 bp, Homo sapien
tcagaatgacatcccatttcaaaaa

SEQ ID NO: 252238 - DNA, 25 bp, Homo sapien
gatattgaaatcattctgcctgttt

SEQ ID NO: 252239 - DNA, 25 bp, Homo sapien
ctgcctgtttgagagatgactggtt

SEQ ID NO: 252240 - DNA, 25 bp, Homo sapien
gatgactggttatttacagcacaaa

SEQ ID NO: 252241 - DNA, 25 bp, Homo sapien
ctgggtcatccaccccaatgatgtc

SEQ ID NO: 252242 - DNA, 25 bp, Homo sapien
accccaatgatgtcctcaagattct

SEQ ID NO: 252243 - DNA, 25 bp, Homo sapien
tcaagattctggaggccttcttcat

SEQ ID NO: 252244 - DNA, 25 bp, Homo sapien
tggaggccttcttcatgggtctgaa

SEQ ID NO: 252245 - DNA, 25 bp, Homo sapien
gtacagaagaatgtgcgtgacaact

SEQ ID NO: 252246 - DNA, 25 bp, Homo sapien
tgtgcgtgacaactccaaggactcg

SEQ ID NO: 252247 - DNA, 25 bp, Homo sapien
aaggactcggagtactggcaggccc

SEQ ID NO: 252248 - DNA, 25 bp, Homo sapien
tggcaggccctgaccacagtgatcc

SEQ ID NO: 252249 - DNA, 25 bp, Homo sapien
tacacagccttggagaagtaccacc

SEQ ID NO: 252250 - DNA, 25 bp, Homo sapien
tggagaagtaccaccttgtcctgac

SEQ ID NO: 252251 - DNA, 25 bp, Homo sapien
ttgtcctgacccagagggccaagct

SEQ ID NO: 252252 - DNA, 25 bp, Homo sapien
ctggtaagcttggtgatgttctcta

SEQ ID NO: 252253 - DNA, 25 bp, Homo sapien
atgttctctagccaaattcgaaggt

SEQ ID NO: 252254 - DNA, 25 bp, Homo sapien
agcagtttcgcttatttgattattc

SEQ ID NO: 252255 - DNA, 25 bp, Homo sapien
aaatctttattaacacgcattacgt

SEQ ID NO: 252256 - DNA, 25 bp, Homo sapien
acgcattacgtgtaccagaaactgt

SEQ ID NO: 252257 - DNA, 25 bp, Homo sapien
gaaactgtggtacacttaactgtgg

SEQ ID NO: 252258 - DNA, 25 bp, Homo sapien
gtggtacacttaactgtggagctgg

SEQ ID NO: 252259 - DNA, 25 bp, Homo sapien
gaagcaaaagtgaacatgccgcctt

SEQ ID NO: 252260 - DNA, 25 bp, Homo sapien
acatgccgccttaagtgagttcaga

SEQ ID NO: 252261 - DNA, 25 bp, Homo sapien
taagtgagttcagatggcttatctt

SEQ ID NO: 252262 - DNA, 25 bp, Homo sapien
gatataagcaaaagtagcacactga

SEQ ID NO: 252263 - DNA, 25 bp, Homo sapien
gaaaatccaagtagcaaatgaccat

SEQ ID NO: 252264 - DNA, 25 bp, Homo sapien
tgaccattatgtgtaagacttactc

SEQ ID NO: 252265 - DNA, 25 bp, Homo sapien
gtaagacttactctaaaaagaccat

SEQ ID NO: 252266 - DNA, 25 bp, Homo sapien
gaccattttaaatagctcatatatt

SEQ ID NO: 252267 - DNA, 25 bp, Homo sapien
aaacctgctattttccaaaactgca

SEQ ID NO: 252268 - DNA, 25 bp, Homo sapien
tccaaaactgcaaaactagagctat

SEQ ID NO: 252269 - DNA, 25 bp, Homo sapien
aaatcagcttatcctcattggtata

SEQ ID NO: 252270 - DNA, 25 bp, Homo sapien
gcttatcctcattggtatagtggta

SEQ ID NO: 252271 - DNA, 25 bp, Homo sapien
ttgaaagatgtctcatgcatacatt

SEQ ID NO: 252272 - DNA, 25 bp, Homo sapien
ctcatgcatacattggcgtgtacat

SEQ ID NO: 252273 - DNA, 25 bp, Homo sapien
attggcgtgtacataaacgtttgtg

SEQ ID NO: 252274 - DNA, 25 bp, Homo sapien
tgctggaaaaagtacctgtcataga

SEQ ID NO: 252275 - DNA, 25 bp, Homo sapien
atctcaagtgtaaaaacagttctgt

SEQ ID NO: 252276 - DNA, 25 bp, Homo sapien
aacagttctgtagatagatggtagt

SEQ ID NO: 252277 - DNA, 25 bp, Homo sapien
tagatggtagtgatggtagcacatc

SEQ ID NO: 252278 - DNA, 25 bp, Homo sapien
agtgatggtagcacatcaatgtgaa

SEQ ID NO: 252279 - DNA, 25 bp, Homo sapien
atcaatgtgaaggtatttaatgcca

SEQ ID NO: 252280 - DNA, 25 bp, Homo sapien
tgaactgtacacttataacgaatta

SEQ ID NO: 252281 - DNA, 25 bp, Homo sapien
ctgtacacttataacgaattaggat

SEQ ID NO: 252282 - DNA, 25 bp, Homo sapien
atatgtagtttaacaggtgtggtca

SEQ ID NO: 252283 - DNA, 25 bp, Homo sapien
aggtgtggtcaatatcaaaacttag

SEQ ID NO: 252284 - DNA, 25 bp, Homo sapien
gtggtcaatatcaaaacttaggtat

SEQ ID NO: 252285 - DNA, 25 bp, Homo sapien
gcgttgttttaaggccgcagggctt

SEQ ID NO: 252286 - DNA, 25 bp, Homo sapien
tttaaggccgcagggcttgggaggc

SEQ ID NO: 252287 - DNA, 25 bp, Homo sapien
gcttgggaggcttgtgttgagttaa

SEQ ID NO: 252288 - DNA, 25 bp, Homo sapien
tgtccccggaatcccgcgttccagg

SEQ ID NO: 252289 - DNA, 25 bp, Homo sapien
cgttccagggaggaagcgcctttga

SEQ ID NO: 252290 - DNA, 25 bp, Homo sapien
tccagggaggaagcgcctttgacag

SEQ ID NO: 252291 - DNA, 25 bp, Homo sapien
agcgcctttgacagcgcgcgccggt

SEQ ID NO: 252292 - DNA, 25 bp, Homo sapien
ccgcgtccctgctcaggcggaggga

SEQ ID NO: 252293 - DNA, 25 bp, Homo sapien
agggtctcgagtccgggtccaggca

SEQ ID NO: 252294 - DNA, 25 bp, Homo sapien
gagtccgggtccaggcaggcgtgga

SEQ ID NO: 252295 - DNA, 25 bp, Homo sapien
tggaggtggcgggaacggcgcaccg

SEQ ID NO: 252296 - DNA, 25 bp, Homo sapien
tacagcaacagctctgggtgagagt

SEQ ID NO: 252297 - DNA, 25 bp, Homo sapien
gggataatttgtcaagccatagaaa

SEQ ID NO: 252298 - DNA, 25 bp, Homo sapien
aatctagtaagtgtatgacctctca

SEQ ID NO: 252299 - DNA, 25 bp, Homo sapien
gtgtatgacctctcaccattttaag

SEQ ID NO: 252300 - DNA, 25 bp, Homo sapien
gaggtatcagattcatttgcactat

SEQ ID NO: 252301 - DNA, 25 bp, Homo sapien
aggaatgctagttttgtgcaaaaat

SEQ ID NO: 252302 - DNA, 25 bp, Homo sapien
tccccacatttaggttgaaaagctt

SEQ ID NO: 252303 - DNA, 25 bp, Homo sapien
agctttcaaatgttccaagttatgc

SEQ ID NO: 252304 - DNA, 25 bp, Homo sapien
aaaaccttttgctggatacaggaga

SEQ ID NO: 252305 - DNA, 25 bp, Homo sapien
gaaggttggactttatctacagtta

SEQ ID NO: 252306 - DNA, 25 bp, Homo sapien
gttatcttttgattacagcaacagc

SEQ ID NO: 252307 - DNA, 25 bp, Homo sapien
agcaggtgcagccagctctagacag

SEQ ID NO: 252308 - DNA, 25 bp, Homo sapien
gtgcagccagctctagacagcatat

SEQ ID NO: 252309 - DNA, 25 bp, Homo sapien
gctctagacagcatataggccacat

SEQ ID NO: 252310 - DNA, 25 bp, Homo sapien
agacagcatataggccacatcctca

SEQ ID NO: 252311 - DNA, 25 bp, Homo sapien
acatcctcactcctgttataacaaa

SEQ ID NO: 252312 - DNA, 25 bp, Homo sapien
ttccacttcagccttttgtttcatc

SEQ ID NO: 252313 - DNA, 25 bp, Homo sapien
tttcatcctgggtaagtccttcata

SEQ ID NO: 252314 - DNA, 25 bp, Homo sapien
gtaagtccttcatagggtgtaacca

SEQ ID NO: 252315 - DNA, 25 bp, Homo sapien
tagcttaaaaccctaaagaacattg

SEQ ID NO: 252316 - DNA, 25 bp, Homo sapien
gaacattgtaatcagcgctcttgag

SEQ ID NO: 252317 - DNA, 25 bp, Homo sapien
tgtaatcagcgctcttgagcccttt

SEQ ID NO: 252318 - DNA, 25 bp, Homo sapien
aaaatttctttttgttggtcatgat

SEQ ID NO: 252319 - DNA, 25 bp, Homo sapien
taggagtttgtgactagatgggcaa

SEQ ID NO: 252320 - DNA, 25 bp, Homo sapien
gagtttgtgactagatgggcaatat

SEQ ID NO: 252321 - DNA, 25 bp, Homo sapien
agtttgtgactagatgggcaatata

SEQ ID NO: 252322 - DNA, 25 bp, Homo sapien
gtttgtgactagatgggcaatatag

SEQ ID NO: 252323 - DNA, 25 bp, Homo sapien
ttgtgactagatgggcaatatagta

SEQ ID NO: 252324 - DNA, 25 bp, Homo sapien
ggcaatatagtaagatgtcatcttt

SEQ ID NO: 252325 - DNA, 25 bp, Homo sapien
attagctggccactgtggcacacgc

SEQ ID NO: 252326 - DNA, 25 bp, Homo sapien
gagaaaatctatttaactcaatata

SEQ ID NO: 252327 - DNA, 25 bp, Homo sapien
attcaaaatatttcatcatgcaatc

SEQ ID NO: 252328 - DNA, 25 bp, Homo sapien
aaaatatttcatcatgcaatcaata

SEQ ID NO: 252329 - DNA, 25 bp, Homo sapien
ttaaaaggtgggggcattatgctaa

SEQ ID NO: 252330 - DNA, 25 bp, Homo sapien
aaagatcacaagaatttagtgtggt

SEQ ID NO: 252331 - DNA, 25 bp, Homo sapien
aagatcacaagaatttagtgtggta

SEQ ID NO: 252332 - DNA, 25 bp, Homo sapien
gatcacaagaatttagtgtggtagg

SEQ ID NO: 252333 - DNA, 25 bp, Homo sapien
atcacaagaatttagtgtggtaggt

SEQ ID NO: 252334 - DNA, 25 bp, Homo sapien
tcacaagaatttagtgtggtaggtg

SEQ ID NO: 252335 - DNA, 25 bp, Homo sapien
caagaatttagtgtggtaggtggga

SEQ ID NO: 252336 - DNA, 25 bp, Homo sapien
gaatttagtgtggtaggtgggaaca

SEQ ID NO: 252337 - DNA, 25 bp, Homo sapien
aatttagtgtggtaggtgggaacag

SEQ ID NO: 252338 - DNA, 25 bp, Homo sapien
tttagtgtggtaggtgggaacagaa

SEQ ID NO: 252339 - DNA, 25 bp, Homo sapien
tagtgtggtaggtgggaacagaaaa

SEQ ID NO: 252340 - DNA, 25 bp, Homo sapien
ggctgtataaagagttgttccatga

SEQ ID NO: 252341 - DNA, 25 bp, Homo sapien
ttccatgatggacgtaactcttttg

SEQ ID NO: 252342 - DNA, 25 bp, Homo sapien
ggacgtaactcttttggatgaacat

SEQ ID NO: 252343 - DNA, 25 bp, Homo sapien
tgaacatgggaaacccttttggtgt

SEQ ID NO: 252344 - DNA, 25 bp, Homo sapien
ccggtgtgcctgagatcgcctgcca

SEQ ID NO: 252345 - DNA, 25 bp, Homo sapien
acagctctagcttcttgggacagac

SEQ ID NO: 252346 - DNA, 25 bp, Homo sapien
gggacagacatacaacgtggactac

SEQ ID NO: 252347 - DNA, 25 bp, Homo sapien
gtgtggatcagagagaccgaagaat

SEQ ID NO: 252348 - DNA, 25 bp, Homo sapien
gagaacacctacctcttattggaaa

SEQ ID NO: 252349 - DNA, 25 bp, Homo sapien
attggaaaagttggcctctcgtgga

SEQ ID NO: 252350 - DNA, 25 bp, Homo sapien
tggcctctcgtggaaaactgatatt

SEQ ID NO: 252351 - DNA, 25 bp, Homo sapien
ggacaaacttgtcattacatttgta

SEQ ID NO: 252352 - DNA, 25 bp, Homo sapien
tacatttgtaaccttgtacagagga

SEQ ID NO: 252353 - DNA, 25 bp, Homo sapien
gtaaccttgtacagaggatttttca

SEQ ID NO: 252354 - DNA, 25 bp, Homo sapien
ggatttttcactatgtgcctagctt

SEQ ID NO: 252355 - DNA, 25 bp, Homo sapien
actatgtgcctagcttggtgtccat

SEQ ID NO: 252356 - DNA, 25 bp, Homo sapien
atgtgcctagcttggtgtccattca

SEQ ID NO: 252357 - DNA, 25 bp, Homo sapien
tagcttggtgtccattcagctaaaa

SEQ ID NO: 252358 - DNA, 25 bp, Homo sapien
gactattttatattacatgacccaa

SEQ ID NO: 252359 - DNA, 25 bp, Homo sapien
acatgacccaatcctgtatttattt

SEQ ID NO: 252360 - DNA, 25 bp, Homo sapien
tttagtagaattgtgcctttttgtc

SEQ ID NO: 252361 - DNA, 25 bp, Homo sapien
gtgaataaatgctgtacattttgca

SEQ ID NO: 252362 - DNA, 25 bp, Homo sapien
aatatatctgggaataggaatcgag

SEQ ID NO: 252363 - DNA, 25 bp, Homo sapien
ataggaatcgagaaagcaaccaaga

SEQ ID NO: 252364 - DNA, 25 bp, Homo sapien
gcaacactttctcatggtcacgggt

SEQ ID NO: 252365 - DNA, 25 bp, Homo sapien
agcaaccaagagagcagaactgagt

SEQ ID NO: 252366 - DNA, 25 bp, Homo sapien
tgtcagaccacatctgcagctctga

SEQ ID NO: 252367 - DNA, 25 bp, Homo sapien
accacatctgcagctctgattagtc

SEQ ID NO: 252368 - DNA, 25 bp, Homo sapien
tgattagtcaaatccgaaatgtgcc

SEQ ID NO: 252369 - DNA, 25 bp, Homo sapien
tttctcatggtcacgggtgagcacg

SEQ ID NO: 252370 - DNA, 25 bp, Homo sapien
tccgtggaaatactggaatcaccag

SEQ ID NO: 252371 - DNA, 25 bp, Homo sapien
tactggaatcaccagctcaataata

SEQ ID NO: 252372 - DNA, 25 bp, Homo sapien
acatctctccaaatatgggttggga

SEQ ID NO: 252373 - DNA, 25 bp, Homo sapien
tgtctaccctatggccacagcagga

SEQ ID NO: 252374 - DNA, 25 bp, Homo sapien
ccctatggccacagcaggaggtcag

SEQ ID NO: 252375 - DNA, 25 bp, Homo sapien
tcagcccagggccaggagacacatg

SEQ ID NO: 252376 - DNA, 25 bp, Homo sapien
gagaccccgactttctctaacccag

SEQ ID NO: 252377 - DNA, 25 bp, Homo sapien
taacccagtggctgtgcggtgcagg

SEQ ID NO: 252378 - DNA, 25 bp, Homo sapien
gcatgacatgttaactgtgtgccca

SEQ ID NO: 252379 - DNA, 25 bp, Homo sapien
tgacatgttaactgtgtgcccagga

SEQ ID NO: 252380 - DNA, 25 bp, Homo sapien
gaccgggtatgccaactggaatgat

SEQ ID NO: 252381 - DNA, 25 bp, Homo sapien
gggtatgccaactggaatgattcta

SEQ ID NO: 252382 - DNA, 25 bp, Homo sapien
gccaactggaatgattctagaacca

SEQ ID NO: 252383 - DNA, 25 bp, Homo sapien
agggagccctgctcggccctgaatc

SEQ ID NO: 252384 - DNA, 25 bp, Homo sapien
tgggttacagtgttgttcatccttt

SEQ ID NO: 252385 - DNA, 25 bp, Homo sapien
gttcatcctttctttgccgaaagaa

SEQ ID NO: 252386 - DNA, 25 bp, Homo sapien
tttgccgaaagaatgaatcccagtg

SEQ ID NO: 252387 - DNA, 25 bp, Homo sapien
gaaagaatgaatcccagtgcttcac

SEQ ID NO: 252388 - DNA, 25 bp, Homo sapien
gttaaaggaaagatctgctggtagt

SEQ ID NO: 252389 - DNA, 25 bp, Homo sapien
gatctgctggtagtgtttagtcttt

SEQ ID NO: 252390 - DNA, 25 bp, Homo sapien
gtttagtctttgttctgagctgata

SEQ ID NO: 252391 - DNA, 25 bp, Homo sapien
ctgatatgtgttagtagctttttgt

SEQ ID NO: 252392 - DNA, 25 bp, Homo sapien
cagtgaaccagaagctctttttttc

SEQ ID NO: 252393 - DNA, 25 bp, Homo sapien
ttctgttgtgaaatgctagctttaa

SEQ ID NO: 252394 - DNA, 25 bp, Homo sapien
gtatacagagaggttcacaatttta

SEQ ID NO: 252395 - DNA, 25 bp, Homo sapien
acatgtttaggtaggataattgtaa

SEQ ID NO: 252396 - DNA, 25 bp, Homo sapien
aaagagcaaggcactagtgagaaaa

SEQ ID NO: 252397 - DNA, 25 bp, Homo sapien
gagaatagatacaaggagacctaca

SEQ ID NO: 252398 - DNA, 25 bp, Homo sapien
agatacaaggagacctacaggttta

SEQ ID NO: 252399 - DNA, 25 bp, Homo sapien
gagacctacaggtttacaacattaa

SEQ ID NO: 252400 - DNA, 25 bp, Homo sapien
ggtttacaacattaatattggccaa

SEQ ID NO: 252401 - DNA, 25 bp, Homo sapien
aatattggccaatacttgattggac

SEQ ID NO: 252402 - DNA, 25 bp, Homo sapien
ggccaatacttgattggacagttta

SEQ ID NO: 252403 - DNA, 25 bp, Homo sapien
ttttcaacctgaaaggcctttgtgc

SEQ ID NO: 252404 - DNA, 25 bp, Homo sapien
ttcaacctgaaaggcctttgtgccc

SEQ ID NO: 252405 - DNA, 25 bp, Homo sapien
ttgtgccccaaagtttggtaaggag

SEQ ID NO: 252406 - DNA, 25 bp, Homo sapien
gcccgaggaccaagcttcagaagaa

SEQ ID NO: 252407 - DNA, 25 bp, Homo sapien
tcagaagaactgcacatgggaggaa

SEQ ID NO: 252408 - DNA, 25 bp, Homo sapien
aataccaaccgcttaacttcttcag

SEQ ID NO: 252409 - DNA, 25 bp, Homo sapien
caaccgcttaacttcttcagagaca

SEQ ID NO: 252410 - DNA, 25 bp, Homo sapien
ttcagagacaacctctaacccggct

SEQ ID NO: 252411 - DNA, 25 bp, Homo sapien
ggctcaccaccacgctagctaaaaa

SEQ ID NO: 252412 - DNA, 25 bp, Homo sapien
cacgctagctaaaaaagggccctct

SEQ ID NO: 252413 - DNA, 25 bp, Homo sapien
gggcttgtcttcacattttccgtgt

SEQ ID NO: 252414 - DNA, 25 bp, Homo sapien
tcacattttccgtgttgtcacttgc

SEQ ID NO: 252415 - DNA, 25 bp, Homo sapien
tttggaagccgtccctagatgtaca

SEQ ID NO: 252416 - DNA, 25 bp, Homo sapien
tagatgtacactgtcttgccgggac

SEQ ID NO: 252417 - DNA, 25 bp, Homo sapien
tatgaaagaacgttagtacccaggt

SEQ ID NO: 252418 - DNA, 25 bp, Homo sapien
ccaggttttccatgagattctctac

SEQ ID NO: 252419 - DNA, 25 bp, Homo sapien
tctacacaggcaagaagctccatag

SEQ ID NO: 252420 - DNA, 25 bp, Homo sapien
gaagctccatagaagtggcatttga

SEQ ID NO: 252421 - DNA, 25 bp, Homo sapien
gtgtttatcacactggttccatttc

SEQ ID NO: 252422 - DNA, 25 bp, Homo sapien
actggttccatttccttgcaaataa

SEQ ID NO: 252423 - DNA, 25 bp, Homo sapien
agtctatttcccagtaacccttgca

SEQ ID NO: 252424 - DNA, 25 bp, Homo sapien
aacccttgcagttaagagtgtgccc

SEQ ID NO: 252425 - DNA, 25 bp, Homo sapien
gagtgtgcccatgtgattgagttct

SEQ ID NO: 252426 - DNA, 25 bp, Homo sapien
gtccccagtagaaaaatactctctg

SEQ ID NO: 252427 - DNA, 25 bp, Homo sapien
gaaacccatgctcttactatgaaag

SEQ ID NO: 252428 - DNA, 25 bp, Homo sapien
ttgccacttccaaggacaagttttt

SEQ ID NO: 252429 - DNA, 25 bp, Homo sapien
gacaacgaggtagtgacccgcgcat

SEQ ID NO: 252430 - DNA, 25 bp, Homo sapien
atcactcaagatccgttcccagaaa

SEQ ID NO: 252431 - DNA, 25 bp, Homo sapien
aggagatgctgtgccacatcgctaa

SEQ ID NO: 252432 - DNA, 25 bp, Homo sapien
gatccgttcccagaaattaatcgaa

SEQ ID NO: 252433 - DNA, 25 bp, Homo sapien
gaaagtcacaagaagcaccgtcgct

SEQ ID NO: 252434 - DNA, 25 bp, Homo sapien
aagaagcaccgtcgctctcggaggt

SEQ ID NO: 252435 - DNA, 25 bp, Homo sapien
ggaggtcctagactcgtcctgacac

SEQ ID NO: 252436 - DNA, 25 bp, Homo sapien
tgtgccacatcgctaaccgcgagtt

SEQ ID NO: 252437 - DNA, 25 bp, Homo sapien
gagttcctcgccagcttagagggaa

SEQ ID NO: 252438 - DNA, 25 bp, Homo sapien
gaaggctgcccgaatacaacacccg

SEQ ID NO: 252439 - DNA, 25 bp, Homo sapien
gctcatcaaatccttgatgtcttca

SEQ ID NO: 252440 - DNA, 25 bp, Homo sapien
cttcaaatagacttttctccctctc

SEQ ID NO: 252441 - DNA, 25 bp, Homo sapien
gtgagaggttggtctgataaaagta

SEQ ID NO: 252442 - DNA, 25 bp, Homo sapien
gataaaagtaatctaccctggctag

SEQ ID NO: 252443 - DNA, 25 bp, Homo sapien
agtaatctaccctggctagacatct

SEQ ID NO: 252444 - DNA, 25 bp, Homo sapien
aatctaccctggctagacatctgct

SEQ ID NO: 252445 - DNA, 25 bp, Homo sapien
taccctggctagacatctgctgcta

SEQ ID NO: 252446 - DNA, 25 bp, Homo sapien
tttaccttagaatttatcccatgag

SEQ ID NO: 252447 - DNA, 25 bp, Homo sapien
accttagaatttatcccatgagaaa

SEQ ID NO: 252448 - DNA, 25 bp, Homo sapien
gaatttatcccatgagaaatgtaga

SEQ ID NO: 252449 - DNA, 25 bp, Homo sapien
gagaaatgtagaatcaggttactat

SEQ ID NO: 252450 - DNA, 25 bp, Homo sapien
atatccttaaagtgcctctgaggcc

SEQ ID NO: 252451 - DNA, 25 bp, Homo sapien
caaagcctttgtggcaattgtcaaa

SEQ ID NO: 252452 - DNA, 25 bp, Homo sapien
tgtcaaatgagtccatatgcagtga

SEQ ID NO: 252453 - DNA, 25 bp, Homo sapien
gtccatatgcagtgagtaccgtgtt

SEQ ID NO: 252454 - DNA, 25 bp, Homo sapien
atatgcagtgagtaccgtgttgagg

SEQ ID NO: 252455 - DNA, 25 bp, Homo sapien
ttctacatgggagcaagacagctgc

SEQ ID NO: 252456 - DNA, 25 bp, Homo sapien
gaagcctgggtgtgtatcctggttc

SEQ ID NO: 252457 - DNA, 25 bp, Homo sapien
ggtgtgtatcctggttctgctagga

SEQ ID NO: 252458 - DNA, 25 bp, Homo sapien
tgggtgactctctggctccccaagc

SEQ ID NO: 252459 - DNA, 25 bp, Homo sapien
aagcctccctttcctactgttatat

SEQ ID NO: 252460 - DNA, 25 bp, Homo sapien
tccctttcctactgttatatcctta

SEQ ID NO: 252461 - DNA, 25 bp, Homo sapien
gggatctgtaggttatagttttcac

SEQ ID NO: 252462 - DNA, 25 bp, Homo sapien
gaaatttttgacattacttcttcag

SEQ ID NO: 252463 - DNA, 25 bp, Homo sapien
atcattctgggatttgaattacatg

SEQ ID NO: 252464 - DNA, 25 bp, Homo sapien
tggttcccttactatccggtgaagt

SEQ ID NO: 252465 - DNA, 25 bp, Homo sapien
tactatccggtgaagtagcagaacc

SEQ ID NO: 252466 - DNA, 25 bp, Homo sapien
gcagaaccaccttttgtaggaatca

SEQ ID NO: 252467 - DNA, 25 bp, Homo sapien
ggaatcagttatcaggccctttact

SEQ ID NO: 252468 - DNA, 25 bp, Homo sapien
tttactttcccttgaactctaggct

SEQ ID NO: 252469 - DNA, 25 bp, Homo sapien
aactctaggctagttccagaacctt

SEQ ID NO: 252470 - DNA, 25 bp, Homo sapien
tagttccagaacctttggtggactg

SEQ ID NO: 252471 - DNA, 25 bp, Homo sapien
aagaggaaatagttatgccacaatt

SEQ ID NO: 252472 - DNA, 25 bp, Homo sapien
cctccactgcacaggtctgagaaga

SEQ ID NO: 252473 - DNA, 25 bp, Homo sapien
gagagtattatgaccacttctgggc

SEQ ID NO: 252474 - DNA, 25 bp, Homo sapien
acttctgggccacctttgtatccag

SEQ ID NO: 252475 - DNA, 25 bp, Homo sapien
tgtatccaggaaagacccttaccct

SEQ ID NO: 252476 - DNA, 25 bp, Homo sapien
taggatgcaggctgtcataggaagt

SEQ ID NO: 252477 - DNA, 25 bp, Homo sapien
ttgagatcactcagcctcaggagtc

SEQ ID NO: 252478 - DNA, 25 bp, Homo sapien
cagttctcacctcccatgaaagtgg

SEQ ID NO: 252479 - DNA, 25 bp, Homo sapien
tccagaccccagattctaacatgct

SEQ ID NO: 252480 - DNA, 25 bp, Homo sapien
tctaacatgctcaccttgaagatcc

SEQ ID NO: 252481 - DNA, 25 bp, Homo sapien
ttgaagatcccaagagcccatacct

SEQ ID NO: 252482 - DNA, 25 bp, Homo sapien
agcccatacctattcagatgctcct

SEQ ID NO: 252483 - DNA, 25 bp, Homo sapien
ggagaagaaattttcctaggtcagt

SEQ ID NO: 252484 - DNA, 25 bp, Homo sapien
gaaattttcctaggtcagtttatat

SEQ ID NO: 252485 - DNA, 25 bp, Homo sapien
attttcctaggtcagtttatatata

SEQ ID NO: 252486 - DNA, 25 bp, Homo sapien
tcctaggtcagtttatatataacaa

SEQ ID NO: 252487 - DNA, 25 bp, Homo sapien
aaacatttgaactccagcatgcagt

SEQ ID NO: 252488 - DNA, 25 bp, Homo sapien
gtgaaacttaatatctttagcaact

SEQ ID NO: 252489 - DNA, 25 bp, Homo sapien
tatctttagcaactggggacacccg

SEQ ID NO: 252490 - DNA, 25 bp, Homo sapien
ggacacccgaagtatacttgtttat

SEQ ID NO: 252491 - DNA, 25 bp, Homo sapien
ggcacaccaggcaagcacatctaga

SEQ ID NO: 252492 - DNA, 25 bp, Homo sapien
ccaggcaagcacatctagaagagtt

SEQ ID NO: 252493 - DNA, 25 bp, Homo sapien
caagcacatctagaagagttggtac

SEQ ID NO: 252494 - DNA, 25 bp, Homo sapien
cactcatctggctttccttgctata

SEQ ID NO: 252495 - DNA, 25 bp, Homo sapien
ctttccttgctatagacatgctttg

SEQ ID NO: 252496 - DNA, 25 bp, Homo sapien
atgctttgcatacccagcttctagc

SEQ ID NO: 252497 - DNA, 25 bp, Homo sapien
ttctagccacatcttccctaagaaa

SEQ ID NO: 252498 - DNA, 25 bp, Homo sapien
tagagtatggatctgcatgttgtca

SEQ ID NO: 252499 - DNA, 25 bp, Homo sapien
ggatctgcatgttgtcagctaccta

SEQ ID NO: 252500 - DNA, 25 bp, Homo sapien
gttgtcagctacctaaagcagcaaa

SEQ ID NO: 252501 - DNA, 25 bp, Homo sapien
taaaatcagggaaccttgcagttta

SEQ ID NO: 252502 - DNA, 25 bp, Homo sapien
agggaaccttgcagtttaaggcaca

SEQ ID NO: 252503 - DNA, 25 bp, Homo sapien
aactagatttttgaccctcactcat

SEQ ID NO: 252504 - DNA, 25 bp, Homo sapien
agatttttgaccctcactcatctgg

SEQ ID NO: 252505 - DNA, 25 bp, Homo sapien
gaaggatcacgagccacacacggag

SEQ ID NO: 252506 - DNA, 25 bp, Homo sapien
gagcaactcagtccaggctgcacaa

SEQ ID NO: 252507 - DNA, 25 bp, Homo sapien
acggagccttactctccaaataggc

SEQ ID NO: 252508 - DNA, 25 bp, Homo sapien
agtcgtcccttagcctaagaactca

SEQ ID NO: 252509 - DNA, 25 bp, Homo sapien
cagaggttgagctgcagtgtgtcca

SEQ ID NO: 252510 - DNA, 25 bp, Homo sapien
cagtgtgtccagtatttaaaagtat

SEQ ID NO: 252511 - DNA, 25 bp, Homo sapien
ggctgcacaaattgagtagcactgc

SEQ ID NO: 252512 - DNA, 25 bp, Homo sapien
gagtagcactgctctgcagctcgct

SEQ ID NO: 252513 - DNA, 25 bp, Homo sapien
gcagctcgctgcactaaaagtggaa

SEQ ID NO: 252514 - DNA, 25 bp, Homo sapien
gatattttccattacagcaagtgct

SEQ ID NO: 252515 - DNA, 25 bp, Homo sapien
agcaagtgctcccacagaaggatca

SEQ ID NO: 252516 - DNA, 25 bp, Homo sapien
tagcagccactgatgaagggtgttt

SEQ ID NO: 252517 - DNA, 25 bp, Homo sapien
gatgaagggtgtttagagactaagc

SEQ ID NO: 252518 - DNA, 25 bp, Homo sapien
gactaagcaggataatctaccagat

SEQ ID NO: 252519 - DNA, 25 bp, Homo sapien
ctaccagatatagaagtcaggctta

SEQ ID NO: 252520 - DNA, 25 bp, Homo sapien
gtcaggcttatcatgagaagatcat

SEQ ID NO: 252521 - DNA, 25 bp, Homo sapien
gaagatcatgcagtattccctctat

SEQ ID NO: 252522 - DNA, 25 bp, Homo sapien
atgcagtattccctctatcaaacct

SEQ ID NO: 252523 - DNA, 25 bp, Homo sapien
tatcaaacctccatcaacagctaat

SEQ ID NO: 252524 - DNA, 25 bp, Homo sapien
tccatcaacagctaattaatccaaa

SEQ ID NO: 252525 - DNA, 25 bp, Homo sapien
aaggtgggccataccaactccctct

SEQ ID NO: 252526 - DNA, 25 bp, Homo sapien
tttgatcttcatttagcagccactg

SEQ ID NO: 252527 - DNA, 25 bp, Homo sapien
cccctttggacataactttctgttg

SEQ ID NO: 252528 - DNA, 25 bp, Homo sapien
ctttctgttgaagctgttctttggc

SEQ ID NO: 252529 - DNA, 25 bp, Homo sapien
aagctgttctttggctggttggttt

SEQ ID NO: 252530 - DNA, 25 bp, Homo sapien
ctttggctggttggttttagtactg

SEQ ID NO: 252531 - DNA, 25 bp, Homo sapien
ttagtactgtaaactgcttctgagc

SEQ ID NO: 252532 - DNA, 25 bp, Homo sapien
ctgcttctgagcaaacacggaaatt

SEQ ID NO: 252533 - DNA, 25 bp, Homo sapien
gatcctgaagttttagaatggcaaa

SEQ ID NO: 252534 - DNA, 25 bp, Homo sapien
atatgtcagtatagaggctctactt

SEQ ID NO: 252535 - DNA, 25 bp, Homo sapien
gaggctctactttatgtagacttaa

SEQ ID NO: 252536 - DNA, 25 bp, Homo sapien
gagatatgtaccttcatattcagaa

SEQ ID NO: 252537 - DNA, 25 bp, Homo sapien
gaaatctggatgtttccttcataca

SEQ ID NO: 252538 - DNA, 25 bp, Homo sapien
gcaagtggccaactcttcaaataca

SEQ ID NO: 252539 - DNA, 25 bp, Homo sapien
agggtagctacctatttcacgtgaa

SEQ ID NO: 252540 - DNA, 25 bp, Homo sapien
tttcacgtgaaaggcctcagtattc

SEQ ID NO: 252541 - DNA, 25 bp, Homo sapien
ccttttgtctctaaattctactctt

SEQ ID NO: 252542 - DNA, 25 bp, Homo sapien
gtattctgctcacttgaactacgga

SEQ ID NO: 252543 - DNA, 25 bp, Homo sapien
aataggccacaatacttggttacaa

SEQ ID NO: 252544 - DNA, 25 bp, Homo sapien
tggaactctgaacctatgtggagga

SEQ ID NO: 252545 - DNA, 25 bp, Homo sapien
gaacgagataccagctgggctcttt

SEQ ID NO: 252546 - DNA, 25 bp, Homo sapien
tctttccacattcagggctcagcag

SEQ ID NO: 252547 - DNA, 25 bp, Homo sapien
gaagtgggctccttactattctgac

SEQ ID NO: 252548 - DNA, 25 bp, Homo sapien
ttactattctgaccactagcaagtg

SEQ ID NO: 252549 - DNA, 25 bp, Homo sapien
gatgcttcatctatattgacagctg

SEQ ID NO: 252550 - DNA, 25 bp, Homo sapien
tctatattgacagctgcaagaacag

SEQ ID NO: 252551 - DNA, 25 bp, Homo sapien
gagaacagtttctcccatagtgttt

SEQ ID NO: 252552 - DNA, 25 bp, Homo sapien
agtttctcccatagtgtttcctgtg

SEQ ID NO: 252553 - DNA, 25 bp, Homo sapien
ctcccatagtgtttcctgtggaatg

SEQ ID NO: 252554 - DNA, 25 bp, Homo sapien
tgtttcctgtggaatgctagtgtct

SEQ ID NO: 252555 - DNA, 25 bp, Homo sapien
gctagtgtctcataaagtcttctaa

SEQ ID NO: 252556 - DNA, 25 bp, Homo sapien
tttggaagccattttgtgttactgt

SEQ ID NO: 252557 - DNA, 25 bp, Homo sapien
gtgttactgtgtgactttcttttac

SEQ ID NO: 252558 - DNA, 25 bp, Homo sapien
gttactgtgtgactttcttttactc

SEQ ID NO: 252559 - DNA, 25 bp, Homo sapien
aacagcaccataaaatttctgacaa

SEQ ID NO: 252560 - DNA, 25 bp, Homo sapien
gctggcgcttctgacttcaggagcg

SEQ ID NO: 252561 - DNA, 25 bp, Homo sapien
ggcgcttctgacttcaggagcgaaa

SEQ ID NO: 252562 - DNA, 25 bp, Homo sapien
ttctgacttcaggagcgaaaggagg

SEQ ID NO: 252563 - DNA, 25 bp, Homo sapien
gaggcctagtttgggccgatgtatt

SEQ ID NO: 252564 - DNA, 25 bp, Homo sapien
aaagcagagtggacagcagagagtc

SEQ ID NO: 252565 - DNA, 25 bp, Homo sapien
gtcaatttccctttcgttgggagtg

SEQ ID NO: 252566 - DNA, 25 bp, Homo sapien
tggctaattgtcttcggccaaccag

SEQ ID NO: 252567 - DNA, 25 bp, Homo sapien
gctaattgtcttcggccaaccaggg

SEQ ID NO: 252568 - DNA, 25 bp, Homo sapien
tgccacggtgggagtcagccaagat

SEQ ID NO: 252569 - DNA, 25 bp, Homo sapien
gatgccagcgattgctcttttcaaa

SEQ ID NO: 252570 - DNA, 25 bp, Homo sapien
ttttcaaaacctaccagtcccactg

SEQ ID NO: 252571 - DNA, 25 bp, Homo sapien
atctggtacattgcttcagtaggta

SEQ ID NO: 252572 - DNA, 25 bp, Homo sapien
gtacattgcttcagtaggtaagtca

SEQ ID NO: 252573 - DNA, 25 bp, Homo sapien
tgcttcagtaggtaagtcagtatga

SEQ ID NO: 252574 - DNA, 25 bp, Homo sapien
gtcagtatgaacttctaagaatttt

SEQ ID NO: 252575 - DNA, 25 bp, Homo sapien
gttttcttctgtattgggtctattg

SEQ ID NO: 252576 - DNA, 25 bp, Homo sapien
tgggtctattgtgggtatgtccaac

SEQ ID NO: 252577 - DNA, 25 bp, Homo sapien
attgtgggtatgtccaacgtgacag

SEQ ID NO: 252578 - DNA, 25 bp, Homo sapien
gactgaaatggctttcatcatcttt

SEQ ID NO: 252579 - DNA, 25 bp, Homo sapien
tggctttcatcatctttaagtcaaa

SEQ ID NO: 252580 - DNA, 25 bp, Homo sapien
gtatgtacttgtgtctctgtatgta

SEQ ID NO: 252581 - DNA, 25 bp, Homo sapien
acttgtgtctctgtatgtatgtaaa

SEQ ID NO: 252582 - DNA, 25 bp, Homo sapien
tgcttcctgttctggcttcgttatg

SEQ ID NO: 252583 - DNA, 25 bp, Homo sapien
tctggcttcgttatgttctattctc

SEQ ID NO: 252584 - DNA, 25 bp, Homo sapien
gttatgttctattctcagcagatga

SEQ ID NO: 252585 - DNA, 25 bp, Homo sapien
gcagatgaattgcatgccttccata

SEQ ID NO: 252586 - DNA, 25 bp, Homo sapien
gcatgccttccatatcaggatgtaa

SEQ ID NO: 252587 - DNA, 25 bp, Homo sapien
gatgtaatttattcaggtttgcact

SEQ ID NO: 252588 - DNA, 25 bp, Homo sapien
ggtttgcactattataagttgacat

SEQ ID NO: 252589 - DNA, 25 bp, Homo sapien
gacatcataatatctagtgtgctta

SEQ ID NO: 252590 - DNA, 25 bp, Homo sapien
gtgtgcttaactgtattttcccgga

SEQ ID NO: 252591 - DNA, 25 bp, Homo sapien
tattttcccggaatgcaagtccctt

SEQ ID NO: 252592 - DNA, 25 bp, Homo sapien
gcaagtcccttggtccatattaaag

SEQ ID NO: 252593 - DNA, 25 bp, Homo sapien
atatgagctactacattattacatg

SEQ ID NO: 252594 - DNA, 25 bp, Homo sapien
ttattacatgtatagcctcaaaggt

SEQ ID NO: 252595 - DNA, 25 bp, Homo sapien
ttgctgactcagcatgacacacaca

SEQ ID NO: 252596 - DNA, 25 bp, Homo sapien
gatcttgtattctcatttatgcaga

SEQ ID NO: 252597 - DNA, 25 bp, Homo sapien
tgagaatgacttgtcccctgttgac

SEQ ID NO: 252598 - DNA, 25 bp, Homo sapien
tgttgaccttccataccactgaaag

SEQ ID NO: 252599 - DNA, 25 bp, Homo sapien
accttccataccactgaaagaccag

SEQ ID NO: 252600 - DNA, 25 bp, Homo sapien
agcacggagctgctaatagctctcc

SEQ ID NO: 252601 - DNA, 25 bp, Homo sapien
tgacacacacagtccatgaggtaca

SEQ ID NO: 252602 - DNA, 25 bp, Homo sapien
agtccatgaggtacaaggtccttaa

SEQ ID NO: 252603 - DNA, 25 bp, Homo sapien
ccatttaggttttggtgcttatgta

SEQ ID NO: 252604 - DNA, 25 bp, Homo sapien
gtgtggtggtgtgccgatacctcct

SEQ ID NO: 252605 - DNA, 25 bp, Homo sapien
cttcaggatgtgttccctcttccag

SEQ ID NO: 252606 - DNA, 25 bp, Homo sapien
gtgggaccgctgtcccttatttcaa

SEQ ID NO: 252607 - DNA, 25 bp, Homo sapien
tgtcccttatttcaacccgttagca

SEQ ID NO: 252608 - DNA, 25 bp, Homo sapien
tttcaacccgttagcaacaatggat

SEQ ID NO: 252609 - DNA, 25 bp, Homo sapien
gaacacagtggctattaatgaagag

SEQ ID NO: 252610 - DNA, 25 bp, Homo sapien
aatgaagaggcccatgctggagact

SEQ ID NO: 252611 - DNA, 25 bp, Homo sapien
tgctggagactggaagggttccctt

SEQ ID NO: 252612 - DNA, 25 bp, Homo sapien
gggttcccttgtcctagacattgag

SEQ ID NO: 252613 - DNA, 25 bp, Homo sapien
gggcccagataagaccaaaaccaag

SEQ ID NO: 252614 - DNA, 25 bp, Homo sapien
agaaactgtctcagatctcacggcc

SEQ ID NO: 252615 - DNA, 25 bp, Homo sapien
gtttggatgggttcatttcaactca

SEQ ID NO: 252616 - DNA, 25 bp, Homo sapien
attcagttccacgactagtttccag

SEQ ID NO: 252617 - DNA, 25 bp, Homo sapien
tagtttccagcgcacaggtacacat

SEQ ID NO: 252618 - DNA, 25 bp, Homo sapien
caggtacacatggtagacgtcaagt

SEQ ID NO: 252619 - DNA, 25 bp, Homo sapien
gacgtcaagtgtatgccgtatgcat

SEQ ID NO: 252620 - DNA, 25 bp, Homo sapien
gtatgcatatgcacagagacgctat

SEQ ID NO: 252621 - DNA, 25 bp, Homo sapien
gagacgctatttgaaggcaactctt

SEQ ID NO: 252622 - DNA, 25 bp, Homo sapien
gagataaaattcactctcctggagt

SEQ ID NO: 252623 - DNA, 25 bp, Homo sapien
ctctcctggagttacattcgcaata

SEQ ID NO: 252624 - DNA, 25 bp, Homo sapien
gttttactttactgcttttcttgct

SEQ ID NO: 252625 - DNA, 25 bp, Homo sapien
gaagcctcaaagagcgcagacctgg

SEQ ID NO: 252626 - DNA, 25 bp, Homo sapien
gccttggttattactttcaattgaa

SEQ ID NO: 252627 - DNA, 25 bp, Homo sapien
tcaattgaaagttctatgggatcta

SEQ ID NO: 252628 - DNA, 25 bp, Homo sapien
atgggatctagaaatgagacatact

SEQ ID NO: 252629 - DNA, 25 bp, Homo sapien
aatgagacatactggcatggagagt

SEQ ID NO: 252630 - DNA, 25 bp, Homo sapien
aagagctacaggagcatttaggcca

SEQ ID NO: 252631 - DNA, 25 bp, Homo sapien
ttaggccatttctatgccaagctta

SEQ ID NO: 252632 - DNA, 25 bp, Homo sapien
gccaagcttattctacatgcacaaa

SEQ ID NO: 252633 - DNA, 25 bp, Homo sapien
gatttctagaagtgtggtgtattac

SEQ ID NO: 252634 - DNA, 25 bp, Homo sapien
aagtgtggtgtattactcatggaaa

SEQ ID NO: 252635 - DNA, 25 bp, Homo sapien
tcatggaaagtgagttgccttggtt

SEQ ID NO: 252636 - DNA, 25 bp, Homo sapien
gagttgccttggttattactttcaa

SEQ ID NO: 252637 - DNA, 25 bp, Homo sapien
atacttcaccccagcagaggttcat

SEQ ID NO: 252638 - DNA, 25 bp, Homo sapien
cagcagaggttcatgggacacagtt

SEQ ID NO: 252639 - DNA, 25 bp, Homo sapien
gttcatgggacacagttggaaagcc

SEQ ID NO: 252640 - DNA, 25 bp, Homo sapien
agttggaaagccactgggaggaaat

SEQ ID NO: 252641 - DNA, 25 bp, Homo sapien
tgtagcaagcccagccggtaatcct

SEQ ID NO: 252642 - DNA, 25 bp, Homo sapien
gtaatcctcctaatgaacccacaag

SEQ ID NO: 252643 - DNA, 25 bp, Homo sapien
aacccacaaggtcaattcacaactg

SEQ ID NO: 252644 - DNA, 25 bp, Homo sapien
ggtcaattcacaactgatatcttag

SEQ ID NO: 252645 - DNA, 25 bp, Homo sapien
tcacaactgatatcttagctattaa

SEQ ID NO: 252646 - DNA, 25 bp, Homo sapien
agtactgactttaccaaaagaatca

SEQ ID NO: 252647 - DNA, 25 bp, Homo sapien
aagaatcatcaagaaagctatttat

SEQ ID NO: 252648 - DNA, 25 bp, Homo sapien
gacagaaagacacttctctggcttt

SEQ ID NO: 252649 - DNA, 25 bp, Homo sapien
ttctctggctttttactggcttgaa

SEQ ID NO: 252650 - DNA, 25 bp, Homo sapien
tttactggcttgaacccaatgggac

SEQ ID NO: 252651 - DNA, 25 bp, Homo sapien
aacccaatgggacagagactctcta

SEQ ID NO: 252652 - DNA, 25 bp, Homo sapien
tagaaagtttcagggctcacattca

SEQ ID NO: 252653 - DNA, 25 bp, Homo sapien
gctcacattcacttgtttgtccaaa

SEQ ID NO: 252654 - DNA, 25 bp, Homo sapien
ttttgagtgtctcccaagtgccaaa

SEQ ID NO: 252655 - DNA, 25 bp, Homo sapien
gcctgagcccatgagcggtagtctg

SEQ ID NO: 252656 - DNA, 25 bp, Homo sapien
gttctgagttggctaggaagacaca

SEQ ID NO: 252657 - DNA, 25 bp, Homo sapien
aggaagacacaaggcacaatggaca

SEQ ID NO: 252658 - DNA, 25 bp, Homo sapien
gggcaaagtccacttgctggacatt

SEQ ID NO: 252659 - DNA, 25 bp, Homo sapien
aggagcctcttgagcaggtcctggc

SEQ ID NO: 252660 - DNA, 25 bp, Homo sapien
gagcctcttgagcaggtcctggcaa

SEQ ID NO: 252661 - DNA, 25 bp, Homo sapien
agcctcttgagcaggtcctggcaat

SEQ ID NO: 252662 - DNA, 25 bp, Homo sapien
tcttgagcaggtcctggcaatcggc

SEQ ID NO: 252663 - DNA, 25 bp, Homo sapien
tgagcaggtcctggcaatcggccga

SEQ ID NO: 252664 - DNA, 25 bp, Homo sapien
gcaggtcctggcaatcggccgagat

SEQ ID NO: 252665 - DNA, 25 bp, Homo sapien
aggtcctggcaatcggccgagatgc

SEQ ID NO: 252666 - DNA, 25 bp, Homo sapien
tggcaatcggccgagatgctcagat

SEQ ID NO: 252667 - DNA, 25 bp, Homo sapien
gcaatcggccgagatgctcagatga

SEQ ID NO: 252668 - DNA, 25 bp, Homo sapien
atcggccgagatgctcagatgagtg

SEQ ID NO: 252669 - DNA, 25 bp, Homo sapien
ttctgctgctgccacagcatcttgg

SEQ ID NO: 252670 - DNA, 25 bp, Homo sapien
acacactcacgcatgagcaaacgtg

SEQ ID NO: 252671 - DNA, 25 bp, Homo sapien
atgagcaaacgtgtacagactggca

SEQ ID NO: 252672 - DNA, 25 bp, Homo sapien
aaacgtgtacagactggcacatgcc

SEQ ID NO: 252673 - DNA, 25 bp, Homo sapien
ggcacatgcctccacatgcgaacac

SEQ ID NO: 252674 - DNA, 25 bp, Homo sapien
actcacactggcacacatgctgtct

SEQ ID NO: 252675 - DNA, 25 bp, Homo sapien
acacatgctgtctacccgtgcacag

SEQ ID NO: 252676 - DNA, 25 bp, Homo sapien
tgtctacccgtgcacaggcacacgt

SEQ ID NO: 252677 - DNA, 25 bp, Homo sapien
aggcacacgtgctggtctgcacaca

SEQ ID NO: 252678 - DNA, 25 bp, Homo sapien
actcgctatgccaggcctcctgggt

SEQ ID NO: 252679 - DNA, 25 bp, Homo sapien
gcctcctgggtctgcagtgagtctg

SEQ ID NO: 252680 - DNA, 25 bp, Homo sapien
ttgggagccgctgtgggccacatct

SEQ ID NO: 252681 - DNA, 25 bp, Homo sapien
ggctccgcctggaccggagcgttct

SEQ ID NO: 252682 - DNA, 25 bp, Homo sapien
cagggctccggcagctgcttctagc

SEQ ID NO: 252683 - DNA, 25 bp, Homo sapien
tgcttctagcctgggaccggtctca

SEQ ID NO: 252684 - DNA, 25 bp, Homo sapien
tctagcctgggaccggtctcaaccg

SEQ ID NO: 252685 - DNA, 25 bp, Homo sapien
tgggaccggtctcaaccgccgggag

SEQ ID NO: 252686 - DNA, 25 bp, Homo sapien
gcttggacatgagcgcccaggagcc

SEQ ID NO: 252687 - DNA, 25 bp, Homo sapien
cgcagggtcggagattccccattga

SEQ ID NO: 252688 - DNA, 25 bp, Homo sapien
agggtcggagattccccattgaggc

SEQ ID NO: 252689 - DNA, 25 bp, Homo sapien
ggagattccccattgaggccggaga

SEQ ID NO: 252690 - DNA, 25 bp, Homo sapien
gattccccattgaggccggagactc

SEQ ID NO: 252691 - DNA, 25 bp, Homo sapien
attgaggccggagactcccgtggcc

SEQ ID NO: 252692 - DNA, 25 bp, Homo sapien
attatagaattccacagctcctacc

SEQ ID NO: 252693 - DNA, 25 bp, Homo sapien
agctcctaccaagaccatgaggata

SEQ ID NO: 252694 - DNA, 25 bp, Homo sapien
atatctaacacttttcagttgctga

SEQ ID NO: 252695 - DNA, 25 bp, Homo sapien
accacaataggagtatcagggccaa

SEQ ID NO: 252696 - DNA, 25 bp, Homo sapien
gtatcagggccaaatacctatgtaa

SEQ ID NO: 252697 - DNA, 25 bp, Homo sapien
tgaggtcatttctgctttaggaaaa

SEQ ID NO: 252698 - DNA, 25 bp, Homo sapien
tctgctttaggaaaagtactttcgg

SEQ ID NO: 252699 - DNA, 25 bp, Homo sapien
tcggtaaattctttggccctgacca

SEQ ID NO: 252700 - DNA, 25 bp, Homo sapien
tggccctgaccagtattcattattt

SEQ ID NO: 252701 - DNA, 25 bp, Homo sapien
gaccagtattcattatttcagataa

SEQ ID NO: 252702 - DNA, 25 bp, Homo sapien
agataattccctgtgataggacaac

SEQ ID NO: 252703 - DNA, 25 bp, Homo sapien
cagacctgcagcacaagtgcgcggg

SEQ ID NO: 252704 - DNA, 25 bp, Homo sapien
tgcagcacaagtgcgcgggcctgtc

SEQ ID NO: 252705 - DNA, 25 bp, Homo sapien
tgggcgactccatatgcaatcagta

SEQ ID NO: 252706 - DNA, 25 bp, Homo sapien
gcgactccatatgcaatcagtagcg

SEQ ID NO: 252707 - DNA, 25 bp, Homo sapien
tatgcaatcagtagcgagcagccgg

SEQ ID NO: 252708 - DNA, 25 bp, Homo sapien
atcagtagcgagcagccgggcccca

SEQ ID NO: 252709 - DNA, 25 bp, Homo sapien
agaccctcatgcactctcttacgtg

SEQ ID NO: 252710 - DNA, 25 bp, Homo sapien
atgcactctcttacgtgccattctc

SEQ ID NO: 252711 - DNA, 25 bp, Homo sapien
gaaagatccaaactaatattgctgt

SEQ ID NO: 252712 - DNA, 25 bp, Homo sapien
aaggtttctgtatattgtatagagc

SEQ ID NO: 252713 - DNA, 25 bp, Homo sapien
ttgtatagagctgtgtataaactgg

SEQ ID NO: 252714 - DNA, 25 bp, Homo sapien
tttgcctaaagtacaatttatcggg

SEQ ID NO: 252715 - DNA, 25 bp, Homo sapien
cttttaagtctttcatgggacctat

SEQ ID NO: 252716 - DNA, 25 bp, Homo sapien
ggcaatctaaaaaggtgttctctgt

SEQ ID NO: 252717 - DNA, 25 bp, Homo sapien
aggtgttctctgtgttatgtaaagt

SEQ ID NO: 252718 - DNA, 25 bp, Homo sapien
tggaggcttccttatattttaacct

SEQ ID NO: 252719 - DNA, 25 bp, Homo sapien
gcaatgaggagggattcctgtcatt

SEQ ID NO: 252720 - DNA, 25 bp, Homo sapien
tcctgtcattaagcacaagggcgct

SEQ ID NO: 252721 - DNA, 25 bp, Homo sapien
acaagggcgctggatcctcaagtgc

SEQ ID NO: 252722 - DNA, 25 bp, Homo sapien
tggatcctcaagtgcccatcttcgt

SEQ ID NO: 252723 - DNA, 25 bp, Homo sapien
gtgcccatcttcgtgagagaaaaag

SEQ ID NO: 252724 - DNA, 25 bp, Homo sapien
ccatttctggtgctttctgctcaca

SEQ ID NO: 252725 - DNA, 25 bp, Homo sapien
gactccttccgctgggccacagtgg

SEQ ID NO: 252726 - DNA, 25 bp, Homo sapien
cacagtgggagcaccaggccttcac

SEQ ID NO: 252727 - DNA, 25 bp, Homo sapien
ttgcctttgggcagctgacaaccac

SEQ ID NO: 252728 - DNA, 25 bp, Homo sapien
acaaccacgggtttggcaactgcgt

SEQ ID NO: 252729 - DNA, 25 bp, Homo sapien
tgcaggcttcagctgccttcaactg

SEQ ID NO: 252730 - DNA, 25 bp, Homo sapien
agctgccttcaactggaacgaccag

SEQ ID NO: 252731 - DNA, 25 bp, Homo sapien
gaacgaccagcgctgcaaaacccga

SEQ ID NO: 252732 - DNA, 25 bp, Homo sapien
gaaaccgttacatctgccagtttgc

SEQ ID NO: 252733 - DNA, 25 bp, Homo sapien
gttacatctgccagtttgcccagga

SEQ ID NO: 252734 - DNA, 25 bp, Homo sapien
tgggagcaccggctctgcttacctg

SEQ ID NO: 252735 - DNA, 25 bp, Homo sapien
tacctgtctgcccacctgtctggaa

SEQ ID NO: 252736 - DNA, 25 bp, Homo sapien
taattcacttgtcccaaaagccacc

SEQ ID NO: 252737 - DNA, 25 bp, Homo sapien
gcctgacgccacagtcattggcaga

SEQ ID NO: 252738 - DNA, 25 bp, Homo sapien
cagtcattggcagaggtctgggcat

SEQ ID NO: 252739 - DNA, 25 bp, Homo sapien
agaggtctgggcattattaatttat

SEQ ID NO: 252740 - DNA, 25 bp, Homo sapien
aaaatccatgctttacacctggaca

SEQ ID NO: 252741 - DNA, 25 bp, Homo sapien
acacctggacagtagacagggactt

SEQ ID NO: 252742 - DNA, 25 bp, Homo sapien
cagggacttcagagattgcacgttt

SEQ ID NO: 252743 - DNA, 25 bp, Homo sapien
ttgcacgtttgaatacattctccca

SEQ ID NO: 252744 - DNA, 25 bp, Homo sapien
ttctcccaagactgaggttgttcgg

SEQ ID NO: 252745 - DNA, 25 bp, Homo sapien
taattcctgtagtccaatcacacaa

SEQ ID NO: 252746 - DNA, 25 bp, Homo sapien
agatgtgactcacctttctgctgcc

SEQ ID NO: 252747 - DNA, 25 bp, Homo sapien
gtcagataaagcaaacccatgccct

SEQ ID NO: 252748 - DNA, 25 bp, Homo sapien
ataaagcaaacccatgccctcaaga

SEQ ID NO: 252749 - DNA, 25 bp, Homo sapien
tcaagaccccgcaggaatgccatta

SEQ ID NO: 252750 - DNA, 25 bp, Homo sapien
agaccccgcaggaatgccattaggg

SEQ ID NO: 252751 - DNA, 25 bp, Homo sapien
gaatttggctgtaggaatttagaga

SEQ ID NO: 252752 - DNA, 25 bp, Homo sapien
ttcctccaagtggtatatactttac

SEQ ID NO: 252753 - DNA, 25 bp, Homo sapien
ttttcatcataagccaaaagtctga

SEQ ID NO: 252754 - DNA, 25 bp, Homo sapien
aaaagtctgacattagcctgaagga

SEQ ID NO: 252755 - DNA, 25 bp, Homo sapien
cattagcctgaaggactgtgtgacc

SEQ ID NO: 252756 - DNA, 25 bp, Homo sapien
gaaggactgtgtgaccattaaagtt

SEQ ID NO: 252757 - DNA, 25 bp, Homo sapien
gactgtgtgaccattaaagttagta

SEQ ID NO: 252758 - DNA, 25 bp, Homo sapien
catttttacagggttcccatttgca

SEQ ID NO: 252759 - DNA, 25 bp, Homo sapien
tttttacagggttcccatttgcact

SEQ ID NO: 252760 - DNA, 25 bp, Homo sapien
ttttacagggttcccatttgcactt

SEQ ID NO: 252761 - DNA, 25 bp, Homo sapien
ttacagggttcccatttgcacttca

SEQ ID NO: 252762 - DNA, 25 bp, Homo sapien
tacagggttcccatttgcacttcat

SEQ ID NO: 252763 - DNA, 25 bp, Homo sapien
cagggttcccatttgcacttcatct

SEQ ID NO: 252764 - DNA, 25 bp, Homo sapien
cacttcatctttcagtaaagtcttg

SEQ ID NO: 252765 - DNA, 25 bp, Homo sapien
tcatctttcagtaaagtcttgtcag

SEQ ID NO: 252766 - DNA, 25 bp, Homo sapien
atctttcagtaaagtcttgtcagaa

SEQ ID NO: 252767 - DNA, 25 bp, Homo sapien
gaattttagttatctgttggacatt

SEQ ID NO: 252768 - DNA, 25 bp, Homo sapien
tacctttttttaacttcatcattat

SEQ ID NO: 252769 - DNA, 25 bp, Homo sapien
caggaccctgcttttttaggcagaa

SEQ ID NO: 252770 - DNA, 25 bp, Homo sapien
tatggatgggccactccaaagagaa

SEQ ID NO: 252771 - DNA, 25 bp, Homo sapien
gccgtgggatggtgtgaacactcca

SEQ ID NO: 252772 - DNA, 25 bp, Homo sapien
ggtgtgaacactccatgtttattca

SEQ ID NO: 252773 - DNA, 25 bp, Homo sapien
catgtttattcacatcttggacccc

SEQ ID NO: 252774 - DNA, 25 bp, Homo sapien
ccttgtctttgcaagaaggcttctg

SEQ ID NO: 252775 - DNA, 25 bp, Homo sapien
agtccttagaggtgaagctgtgtcc

SEQ ID NO: 252776 - DNA, 25 bp, Homo sapien
actgatacccaagccaacaaggaga

SEQ ID NO: 252777 - DNA, 25 bp, Homo sapien
aagccaacaaggagatgccctgacc

SEQ ID NO: 252778 - DNA, 25 bp, Homo sapien
aggagatgccctgacccactcatgg

SEQ ID NO: 252779 - DNA, 25 bp, Homo sapien
aaggacactcatggaaaaggccttc

SEQ ID NO: 252780 - DNA, 25 bp, Homo sapien
aaagtttgatccgatgtcttctact

SEQ ID NO: 252781 - DNA, 25 bp, Homo sapien
gtttgatccgatgtcttctactttt

SEQ ID NO: 252782 - DNA, 25 bp, Homo sapien
ttaagcctgccatctacgaagacag

SEQ ID NO: 252783 - DNA, 25 bp, Homo sapien
agcctgccatctacgaagacagtgt

SEQ ID NO: 252784 - DNA, 25 bp, Homo sapien
tgccatctacgaagacagtgtaagt

SEQ ID NO: 252785 - DNA, 25 bp, Homo sapien
gtgtaagtctaacaacaaaaccatg

SEQ ID NO: 252786 - DNA, 25 bp, Homo sapien
aaaaccatgtgttcaattcactaag

SEQ ID NO: 252787 - DNA, 25 bp, Homo sapien
atgtgttcaattcactaagtcagtg

SEQ ID NO: 252788 - DNA, 25 bp, Homo sapien
tatagggaatcagcaatggttgaac

SEQ ID NO: 252789 - DNA, 25 bp, Homo sapien
attaggaaaagcactgaacagtgcc

SEQ ID NO: 252790 - DNA, 25 bp, Homo sapien
gagtgtgaacagaatgacatttgat

SEQ ID NO: 252791 - DNA, 25 bp, Homo sapien
gatcttccgtgtgagattcatccag

SEQ ID NO: 252792 - DNA, 25 bp, Homo sapien
gattcatccagatcatcatagctct

SEQ ID NO: 252793 - DNA, 25 bp, Homo sapien
tcatcatagctctcagtgtcctctg

SEQ ID NO: 252794 - DNA, 25 bp, Homo sapien
gctatactgttgttagagctgatac

SEQ ID NO: 252795 - DNA, 25 bp, Homo sapien
gatactagcggagatctgagcagga

SEQ ID NO: 252796 - DNA, 25 bp, Homo sapien
aacgctagttatctggaagccactt

SEQ ID NO: 252797 - DNA, 25 bp, Homo sapien
ctcttctgaggagctgcgttcgggc

SEQ ID NO: 252798 - DNA, 25 bp, Homo sapien
tttttcatttgagttccgcctggcg

SEQ ID NO: 252799 - DNA, 25 bp, Homo sapien
agctgagcctgcgaaaggaggttca

SEQ ID NO: 252800 - DNA, 25 bp, Homo sapien
tcccctaagtcagtagccctggaaa

SEQ ID NO: 252801 - DNA, 25 bp, Homo sapien
aagtgacacatcaaggatctccgaa

SEQ ID NO: 252802 - DNA, 25 bp, Homo sapien
acctgtccgtaatgttgggcgccta

SEQ ID NO: 252803 - DNA, 25 bp, Homo sapien
ctgtccgtaatgttgggcgcctaag

SEQ ID NO: 252804 - DNA, 25 bp, Homo sapien
gtccgtaatgttgggcgcctaagtt

SEQ ID NO: 252805 - DNA, 25 bp, Homo sapien
aatgttgggcgcctaagttcttcct

SEQ ID NO: 252806 - DNA, 25 bp, Homo sapien
agttcttcctgttgggcactgtcag

SEQ ID NO: 252807 - DNA, 25 bp, Homo sapien
ttcctgttgggcactgtcagggcag

SEQ ID NO: 252808 - DNA, 25 bp, Homo sapien
actgtcagggcagtgcgcctcaggc

SEQ ID NO: 252809 - DNA, 25 bp, Homo sapien
tgcgcctcaggctgtgcttgtctct

SEQ ID NO: 252810 - DNA, 25 bp, Homo sapien
ttgtctctgcaaaaatgtcctggcc

SEQ ID NO: 252811 - DNA, 25 bp, Homo sapien
tgtctctgcaaaaatgtcctggccc

SEQ ID NO: 252812 - DNA, 25 bp, Homo sapien
gtctctgcaaaaatgtcctggcccc

SEQ ID NO: 252813 - DNA, 25 bp, Homo sapien
catgtataagtaccgcaatcgtgat

SEQ ID NO: 252814 - DNA, 25 bp, Homo sapien
taccgcaatcgtgatgagggctcct

SEQ ID NO: 252815 - DNA, 25 bp, Homo sapien
gcaatcgtgatgagggctcctacca

SEQ ID NO: 252816 - DNA, 25 bp, Homo sapien
gatgagggctcctaccaggtggacc

SEQ ID NO: 252817 - DNA, 25 bp, Homo sapien
agggctcctaccaggtggaccagag

SEQ ID NO: 252818 - DNA, 25 bp, Homo sapien
cctaccaggtggaccagagccgaaa

SEQ ID NO: 252819 - DNA, 25 bp, Homo sapien
ccaggtggaccagagccgaaactac

SEQ ID NO: 252820 - DNA, 25 bp, Homo sapien
atcagtaactcggcccagagcaatg

SEQ ID NO: 252821 - DNA, 25 bp, Homo sapien
tggtgaaagagaaggccccggctgc

SEQ ID NO: 252822 - DNA, 25 bp, Homo sapien
acaaggagtattatgtctgagcccc

SEQ ID NO: 252823 - DNA, 25 bp, Homo sapien
gagtattatgtctgagcccccggca

SEQ ID NO: 252824 - DNA, 25 bp, Homo sapien
agaggtgagcagtagctttcccaaa

SEQ ID NO: 252825 - DNA, 25 bp, Homo sapien
agtagctttcccaaaggcccagagc

SEQ ID NO: 252826 - DNA, 25 bp, Homo sapien
ggaagatcaagcaagccctgcgcct

SEQ ID NO: 252827 - DNA, 25 bp, Homo sapien
ctatctgcagcttgatctctctgta

SEQ ID NO: 252828 - DNA, 25 bp, Homo sapien
tgatctctctgtactgagccatgga

SEQ ID NO: 252829 - DNA, 25 bp, Homo sapien
tactgagccatggagctccttcttg

SEQ ID NO: 252830 - DNA, 25 bp, Homo sapien
gagctccttcttggaggcgtgaaat

SEQ ID NO: 252831 - DNA, 25 bp, Homo sapien
ttggaggcgtgaaatgctccccatc

SEQ ID NO: 252832 - DNA, 25 bp, Homo sapien
actccttgtccagtcagcaatgctg

SEQ ID NO: 252833 - DNA, 25 bp, Homo sapien
gtcagcaatgctggaatacctctgc

SEQ ID NO: 252834 - DNA, 25 bp, Homo sapien
gaatacctctgcagctcacagtcca

SEQ ID NO: 252835 - DNA, 25 bp, Homo sapien
gaaatcactgtagatggcaacacct

SEQ ID NO: 252836 - DNA, 25 bp, Homo sapien
ggcaacacctgacttgtctggagtt

SEQ ID NO: 252837 - DNA, 25 bp, Homo sapien
aacttagagttgtagagcggcctta

SEQ ID NO: 252838 - DNA, 25 bp, Homo sapien
gtagagcggccttagctcattgaaa

SEQ ID NO: 252839 - DNA, 25 bp, Homo sapien
atttgttgtcgttaactgggcattt

SEQ ID NO: 252840 - DNA, 25 bp, Homo sapien
gaagctaaatcatcctcagcagcca

SEQ ID NO: 252841 - DNA, 25 bp, Homo sapien
aaatcgacggcaaacaatgtatggt

SEQ ID NO: 252842 - DNA, 25 bp, Homo sapien
tggtatttcttataggagggcctct

SEQ ID NO: 252843 - DNA, 25 bp, Homo sapien
gggcattttgacaaccgttccattc

SEQ ID NO: 252844 - DNA, 25 bp, Homo sapien
cattccccagtgtctttttacacgt

SEQ ID NO: 252845 - DNA, 25 bp, Homo sapien
tgagtggcggagtcagatccagcta

SEQ ID NO: 252846 - DNA, 25 bp, Homo sapien
tgaagcccagccagaatcccgagtg

SEQ ID NO: 252847 - DNA, 25 bp, Homo sapien
tccttctgtttaaacttcaattcca

SEQ ID NO: 252848 - DNA, 25 bp, Homo sapien
ttaaacttcaattccaaaggtgcac

SEQ ID NO: 252849 - DNA, 25 bp, Homo sapien
aaacttcaattccaaaggtgcacag

SEQ ID NO: 252850 - DNA, 25 bp, Homo sapien
aacttcaattccaaaggtgcacaga

SEQ ID NO: 252851 - DNA, 25 bp, Homo sapien
cttcaattccaaaggtgcacagatg

SEQ ID NO: 252852 - DNA, 25 bp, Homo sapien
tcaattccaaaggtgcacagatgta

SEQ ID NO: 252853 - DNA, 25 bp, Homo sapien
caattccaaaggtgcacagatgtat

SEQ ID NO: 252854 - DNA, 25 bp, Homo sapien
attccaaaggtgcacagatgtattc

SEQ ID NO: 252855 - DNA, 25 bp, Homo sapien
tccaaaggtgcacagatgtattcat

SEQ ID NO: 252856 - DNA, 25 bp, Homo sapien
ccaaaggtgcacagatgtattcata

SEQ ID NO: 252857 - DNA, 25 bp, Homo sapien
cagggttgccatggcagaagatgct

SEQ ID NO: 252858 - DNA, 25 bp, Homo sapien
ttttccttgagagaactgtactcaa

SEQ ID NO: 252859 - DNA, 25 bp, Homo sapien
gtactcaagatgatgtaaatgtcac

SEQ ID NO: 252860 - DNA, 25 bp, Homo sapien
atgtcaccccgggtgccacttgggt

SEQ ID NO: 252861 - DNA, 25 bp, Homo sapien
tgccacttgggtgctttggagaagc

SEQ ID NO: 252862 - DNA, 25 bp, Homo sapien
cttgggtgctttggagaagcgctca

SEQ ID NO: 252863 - DNA, 25 bp, Homo sapien
gacctgtcctctggcgtgcggttca

SEQ ID NO: 252864 - DNA, 25 bp, Homo sapien
cgtgcggttcacgggctgtgtttat

SEQ ID NO: 252865 - DNA, 25 bp, Homo sapien
ggttccttcacagccaccttgggaa

SEQ ID NO: 252866 - DNA, 25 bp, Homo sapien
ttgcctctgaatcacgccaggcagg

SEQ ID NO: 252867 - DNA, 25 bp, Homo sapien
tggaaatcagggtgacactccgcta

SEQ ID NO: 252868 - DNA, 25 bp, Homo sapien
aggtcttggagagcttggccgcctt

SEQ ID NO: 252869 - DNA, 25 bp, Homo sapien
ttggccgccttggagagcatctgca

SEQ ID NO: 252870 - DNA, 25 bp, Homo sapien
agagcatctgcatccgagtgcctag

SEQ ID NO: 252871 - DNA, 25 bp, Homo sapien
atccgagtgcctagcaagttcttgc

SEQ ID NO: 252872 - DNA, 25 bp, Homo sapien
aagttcttgccgatggctttgttct

SEQ ID NO: 252873 - DNA, 25 bp, Homo sapien
tttgttctcgtaccaggtcacatcg

SEQ ID NO: 252874 - DNA, 25 bp, Homo sapien
ggccgctggaagaacgccttgcaga

SEQ ID NO: 252875 - DNA, 25 bp, Homo sapien
cgccttgcagagagggttgcgtttc

SEQ ID NO: 252876 - DNA, 25 bp, Homo sapien
ggttgcgtttcgacaggtacttgac

SEQ ID NO: 252877 - DNA, 25 bp, Homo sapien
ggcgagcccagcttggtgccaatgc

SEQ ID NO: 252878 - DNA, 25 bp, Homo sapien
aatgcccgcgatgctgttgagcgtg

SEQ ID NO: 252879 - DNA, 25 bp, Homo sapien
ctttcaagtcttttatcaccctagc

SEQ ID NO: 252880 - DNA, 25 bp, Homo sapien
tcaagtcttttatcaccctagcata

SEQ ID NO: 252881 - DNA, 25 bp, Homo sapien
caagtcttttatcaccctagcatat

SEQ ID NO: 252882 - DNA, 25 bp, Homo sapien
aagtcttttatcaccctagcatata

SEQ ID NO: 252883 - DNA, 25 bp, Homo sapien
agtcttttatcaccctagcatataa

SEQ ID NO: 252884 - DNA, 25 bp, Homo sapien
ttatcaccctagcatataaaaatat

SEQ ID NO: 252885 - DNA, 25 bp, Homo sapien
tttatttaacttctaggcattaaca

SEQ ID NO: 252886 - DNA, 25 bp, Homo sapien
aacttctaggcattaacatttttgg

SEQ ID NO: 252887 - DNA, 25 bp, Homo sapien
ctaggcattaacatttttggtttga

SEQ ID NO: 252888 - DNA, 25 bp, Homo sapien
tttggtttgaactgttacaactgca

SEQ ID NO: 252889 - DNA, 25 bp, Homo sapien
gttacaactgcaattattagtaatg

SEQ ID NO: 252890 - DNA, 25 bp, Homo sapien
tatgtatcataggtgacttacacag

SEQ ID NO: 252891 - DNA, 25 bp, Homo sapien
ggtgacttacacagtgtccttggta

SEQ ID NO: 252892 - DNA, 25 bp, Homo sapien
acacagtgtccttggtaaggagaat

SEQ ID NO: 252893 - DNA, 25 bp, Homo sapien
atttagagtgagagtctgttcccca

SEQ ID NO: 252894 - DNA, 25 bp, Homo sapien
agtctgttccccactgaggtttgat

SEQ ID NO: 252895 - DNA, 25 bp, Homo sapien
gttccccactgaggtttgatttaag

SEQ ID NO: 252896 - DNA, 25 bp, Homo sapien
aaatgacatcatcagccactcagca

SEQ ID NO: 252897 - DNA, 25 bp, Homo sapien
tcatcagccactcagcagcttgatt

SEQ ID NO: 252898 - DNA, 25 bp, Homo sapien
tcagcagcttgattctctccttggg

SEQ ID NO: 252899 - DNA, 25 bp, Homo sapien
aaaatcacttaattgccaagcaaca

SEQ ID NO: 252900 - DNA, 25 bp, Homo sapien
ttgccaagcaacatggacttacagg

SEQ ID NO: 252901 - DNA, 25 bp, Homo sapien
gagattaaaccagaattgggatact

SEQ ID NO: 252902 - DNA, 25 bp, Homo sapien
aattgggatactgggcttgtgcttc

SEQ ID NO: 252903 - DNA, 25 bp, Homo sapien
tgtgcttctgcttctgaagagcaga

SEQ ID NO: 252904 - DNA, 25 bp, Homo sapien
aaaagtgtcagatctaaatccactc

SEQ ID NO: 252905 - DNA, 25 bp, Homo sapien
tccccaccagatatgacatcagcaa

SEQ ID NO: 252906 - DNA, 25 bp, Homo sapien
agatatgacatcagcaagccaggca

SEQ ID NO: 252907 - DNA, 25 bp, Homo sapien
aagccaggcagagaatccccttgcg

SEQ ID NO: 252908 - DNA, 25 bp, Homo sapien
ccaggcagagaatccccttgcggag

SEQ ID NO: 252909 - DNA, 25 bp, Homo sapien
cagagaatccccttgcggagggata

SEQ ID NO: 252910 - DNA, 25 bp, Homo sapien
tccccttgcggagggataacctaga

SEQ ID NO: 252911 - DNA, 25 bp, Homo sapien
gagggataacctagaacgtcaaacg

SEQ ID NO: 252912 - DNA, 25 bp, Homo sapien
gaaaagcctagtcttgtctctcaag

SEQ ID NO: 252913 - DNA, 25 bp, Homo sapien
gtcttgtctctcaagagcatctcgg

SEQ ID NO: 252914 - DNA, 25 bp, Homo sapien
aagagcatctcggacccagaacatt

SEQ ID NO: 252915 - DNA, 25 bp, Homo sapien
aacattctccagtagtgcattcagt

SEQ ID NO: 252916 - DNA, 25 bp, Homo sapien
gtgcattcagttcaacacagcaagt

SEQ ID NO: 252917 - DNA, 25 bp, Homo sapien
acagcaagtgcttcattgcatggaa

SEQ ID NO: 252918 - DNA, 25 bp, Homo sapien
gtagccttcctgatatttacagtaa

SEQ ID NO: 252919 - DNA, 25 bp, Homo sapien
ccattaactgttttatcgatagcaa

SEQ ID NO: 252920 - DNA, 25 bp, Homo sapien
attagatgttctatagtgctacaag

SEQ ID NO: 252921 - DNA, 25 bp, Homo sapien
gtgctacaaggaattgccttccgaa

SEQ ID NO: 252922 - DNA, 25 bp, Homo sapien
gccttccgaatggaggttcatgtat

SEQ ID NO: 252923 - DNA, 25 bp, Homo sapien
ttcgagatttcgttcctttggctcc

SEQ ID NO: 252924 - DNA, 25 bp, Homo sapien
cgttcctttggctccctgggaagtg

SEQ ID NO: 252925 - DNA, 25 bp, Homo sapien
ttctgcatgtcctacggtagtgatg

SEQ ID NO: 252926 - DNA, 25 bp, Homo sapien
tagtgatgggacaggcagcttcaag

SEQ ID NO: 252927 - DNA, 25 bp, Homo sapien
agcttcaagtccatgtcgacttcca

SEQ ID NO: 252928 - DNA, 25 bp, Homo sapien
gtccatgtcgacttccactgaaata

SEQ ID NO: 252929 - DNA, 25 bp, Homo sapien
gtcgacttccactgaaatagttgat

SEQ ID NO: 252930 - DNA, 25 bp, Homo sapien
tcaccaccaagagaatcattgagaa

SEQ ID NO: 252931 - DNA, 25 bp, Homo sapien
ttgtcggacgcgtagaaacgcgata

SEQ ID NO: 252932 - DNA, 25 bp, Homo sapien
acgcgatatctatgaccgctatggc

SEQ ID NO: 252933 - DNA, 25 bp, Homo sapien
atctatgaccgctatggcgaggcga

SEQ ID NO: 252934 - DNA, 25 bp, Homo sapien
ccttcaactggaataatttcacttc

SEQ ID NO: 252935 - DNA, 25 bp, Homo sapien
taaaagttgagtgtgttactaacca

SEQ ID NO: 252936 - DNA, 25 bp, Homo sapien
aagaaagtctatcacgtccaaaaat

SEQ ID NO: 252937 - DNA, 25 bp, Homo sapien
gtctatcacgtccaaaaatgacaat

SEQ ID NO: 252938 - DNA, 25 bp, Homo sapien
aaatgacaatatatgctgcacagcg

SEQ ID NO: 252939 - DNA, 25 bp, Homo sapien
gctgcacagcgtcataaaagcatat

SEQ ID NO: 252940 - DNA, 25 bp, Homo sapien
taaacagctatagaaacctctactg

SEQ ID NO: 252941 - DNA, 25 bp, Homo sapien
gaaacctctactgtcataatgatgg

SEQ ID NO: 252942 - DNA, 25 bp, Homo sapien
tctactgtcataatgatggtgcaca

SEQ ID NO: 252943 - DNA, 25 bp, Homo sapien
gatggtgcacaaaactttcacgtta

SEQ ID NO: 252944 - DNA, 25 bp, Homo sapien
aaacagaaggaatcatgctaaacaa

SEQ ID NO: 252945 - DNA, 25 bp, Homo sapien
ggagaagggccctcaagtccccacg

SEQ ID NO: 252946 - DNA, 25 bp, Homo sapien
aagtccccacgtggccttggcaagt

SEQ ID NO: 252947 - DNA, 25 bp, Homo sapien
aagtcactctgcttgctaaacgatg

SEQ ID NO: 252948 - DNA, 25 bp, Homo sapien
taaacgatgttgacctcgcctggaa

SEQ ID NO: 252949 - DNA, 25 bp, Homo sapien
tgttgacctcgcctggaaaatggga

SEQ ID NO: 252950 - DNA, 25 bp, Homo sapien
aatgggaggacccactcctaggaga

SEQ ID NO: 252951 - DNA, 25 bp, Homo sapien
cactcctaggagagtatgggtctca

SEQ ID NO: 252952 - DNA, 25 bp, Homo sapien
gtatgggtctcaaggcatttttaca

SEQ ID NO: 252953 - DNA, 25 bp, Homo sapien
gcatttttacaagcacagcctgagt

SEQ ID NO: 252954 - DNA, 25 bp, Homo sapien
cagtctctctccgtttggagtgaga

SEQ ID NO: 252955 - DNA, 25 bp, Homo sapien
gggcatctcattgagaagcgcgaga

SEQ ID NO: 252956 - DNA, 25 bp, Homo sapien
cagtagacattgttgtaccttttac

SEQ ID NO: 252957 - DNA, 25 bp, Homo sapien
ttactcacattcactaatatgcatt

SEQ ID NO: 252958 - DNA, 25 bp, Homo sapien
catttacgtagtgcaggtcctttgt

SEQ ID NO: 252959 - DNA, 25 bp, Homo sapien
agtgcaggtcctttgtttcacagtt

SEQ ID NO: 252960 - DNA, 25 bp, Homo sapien
ggtcctttgtttcacagttactaat

SEQ ID NO: 252961 - DNA, 25 bp, Homo sapien
gtttcacagttactaataaggcaga

SEQ ID NO: 252962 - DNA, 25 bp, Homo sapien
aatatttgcctagacggtttatcat

SEQ ID NO: 252963 - DNA, 25 bp, Homo sapien
gcctagacggtttatcattatttgc

SEQ ID NO: 252964 - DNA, 25 bp, Homo sapien
tatcattatttgctcatcccagtag

SEQ ID NO: 252965 - DNA, 25 bp, Homo sapien
atttgctcatcccagtagacattgt

SEQ ID NO: 252966 - DNA, 25 bp, Homo sapien
gctcatcccagtagacattgttgta

SEQ ID NO: 252967 - DNA, 25 bp, Homo sapien
actgtgcaatgcgaagccatacttc

SEQ ID NO: 252968 - DNA, 25 bp, Homo sapien
gcaatgcgaagccatacttcttcag

SEQ ID NO: 252969 - DNA, 25 bp, Homo sapien
aagccatacttcttcagtgcacaaa

SEQ ID NO: 252970 - DNA, 25 bp, Homo sapien
tcttcagtgcacaaagtcatgttta

SEQ ID NO: 252971 - DNA, 25 bp, Homo sapien
atgctacagtagtttcaaagttcag

SEQ ID NO: 252972 - DNA, 25 bp, Homo sapien
aaagttcagtgttgtggacccagga

SEQ ID NO: 252973 - DNA, 25 bp, Homo sapien
gttcagtgttgtggacccaggaaat

SEQ ID NO: 252974 - DNA, 25 bp, Homo sapien
gttgtggacccaggaaattttccat

SEQ ID NO: 252975 - DNA, 25 bp, Homo sapien
ggaaattttccataagtcttgcttg

SEQ ID NO: 252976 - DNA, 25 bp, Homo sapien
tttccataagtcttgcttgataaca

SEQ ID NO: 252977 - DNA, 25 bp, Homo sapien
gtcttgcttgataacaatgtgattg

SEQ ID NO: 252978 - DNA, 25 bp, Homo sapien
cagaatagcatgtactgcagggaat

SEQ ID NO: 252979 - DNA, 25 bp, Homo sapien
gcagggaatttgcagatagttgatt

SEQ ID NO: 252980 - DNA, 25 bp, Homo sapien
atatccagctaatcaatttgccaga

SEQ ID NO: 252981 - DNA, 25 bp, Homo sapien
tgctggtagatgctgtctcatttgg

SEQ ID NO: 252982 - DNA, 25 bp, Homo sapien
gctgtctcatttggttgactgtgag

SEQ ID NO: 252983 - DNA, 25 bp, Homo sapien
tgactgtgagacttgaatctgctac

SEQ ID NO: 252984 - DNA, 25 bp, Homo sapien
gaatctgctacacatcactctatag

SEQ ID NO: 252985 - DNA, 25 bp, Homo sapien
acatcactctatagattttgaacag

SEQ ID NO: 252986 - DNA, 25 bp, Homo sapien
gcagtcgggaaattgtagctattct

SEQ ID NO: 252987 - DNA, 25 bp, Homo sapien
gtagctattctctgtagcagggtat

SEQ ID NO: 252988 - DNA, 25 bp, Homo sapien
gcagggtatgtatgacacattttca

SEQ ID NO: 252989 - DNA, 25 bp, Homo sapien
gcacagagttatttagacttttcct

SEQ ID NO: 252990 - DNA, 25 bp, Homo sapien
tcatttaacctctccagcttttgtt

SEQ ID NO: 252991 - DNA, 25 bp, Homo sapien
gacttttcctattgatacccacgat

SEQ ID NO: 252992 - DNA, 25 bp, Homo sapien
acgatgttcataagcaacccactcc

SEQ ID NO: 252993 - DNA, 25 bp, Homo sapien
aacccactcccatagtatcactgga

SEQ ID NO: 252994 - DNA, 25 bp, Homo sapien
gtatcactggagtcatgtagcaaga

SEQ ID NO: 252995 - DNA, 25 bp, Homo sapien
gtagcaagacaattccctgcaggct

SEQ ID NO: 252996 - DNA, 25 bp, Homo sapien
gcaggctagtactctccagcacatc

SEQ ID NO: 252997 - DNA, 25 bp, Homo sapien
tccagcttttgttgcctagtcataa

SEQ ID NO: 252998 - DNA, 25 bp, Homo sapien
gggccagctatatctattttatagg

SEQ ID NO: 252999 - DNA, 25 bp, Homo sapien
ggcttttataagcatccactgagat

SEQ ID NO: 253000 - DNA, 25 bp, Homo sapien
agctggcaggagtgcgacgaggcgc

SEQ ID NO: 253001 - DNA, 25 bp, Homo sapien
aggagtgcgacgaggcgccaagcct

SEQ ID NO: 253002 - DNA, 25 bp, Homo sapien
caagcctgaggtgcctcggattgtg

SEQ ID NO: 253003 - DNA, 25 bp, Homo sapien
gtgcctcggattgtggtgcagcccc

SEQ ID NO: 253004 - DNA, 25 bp, Homo sapien
ggagcccagaccaccgcggcggaaa

SEQ ID NO: 253005 - DNA, 25 bp, Homo sapien
gcggaaaccccagacccgcggcaag

SEQ ID NO: 253006 - DNA, 25 bp, Homo sapien
cggcaagactttccatgggctcctg

SEQ ID NO: 253007 - DNA, 25 bp, Homo sapien
ggacacccgcttctgagaggaccat

SEQ ID NO: 253008 - DNA, 25 bp, Homo sapien
agaggaccatggacttagtgtcccc

SEQ ID NO: 253009 - DNA, 25 bp, Homo sapien
atggacttagtgtcccccagtctca

SEQ ID NO: 253010 - DNA, 25 bp, Homo sapien
gtcccccagtctcaattgcctgatg

SEQ ID NO: 253011 - DNA, 25 bp, Homo sapien
actgccatatccctgctctttcttt

SEQ ID NO: 253012 - DNA, 25 bp, Homo sapien
cagttttatactgggtctatttcag

SEQ ID NO: 253013 - DNA, 25 bp, Homo sapien
tctatttcagagacctaatggtggt

SEQ ID NO: 253014 - DNA, 25 bp, Homo sapien
tgtattccgtaaactaaaccataga

SEQ ID NO: 253015 - DNA, 25 bp, Homo sapien
gtgttacagctcatggttttccttc

SEQ ID NO: 253016 - DNA, 25 bp, Homo sapien
aggatctattgaagggcgaagttac

SEQ ID NO: 253017 - DNA, 25 bp, Homo sapien
aagggcgaagttactgttaagatct

SEQ ID NO: 253018 - DNA, 25 bp, Homo sapien
gttaagatctactgtgctgtgtcaa

SEQ ID NO: 253019 - DNA, 25 bp, Homo sapien
tagcatcagatgctgtttgaatctg

SEQ ID NO: 253020 - DNA, 25 bp, Homo sapien
gtgtgtcatctcaacatgcaactag

SEQ ID NO: 253021 - DNA, 25 bp, Homo sapien
actagatagtagattcactgccata

SEQ ID NO: 253022 - DNA, 25 bp, Homo sapien
atgtaatatgtagtctggagaaaac

SEQ ID NO: 253023 - DNA, 25 bp, Homo sapien
gagaaaacatctcccaagttctgtt

SEQ ID NO: 253024 - DNA, 25 bp, Homo sapien
aacatctcccaagttctgttgggcc

SEQ ID NO: 253025 - DNA, 25 bp, Homo sapien
tgttgggccattctccctattggaa

SEQ ID NO: 253026 - DNA, 25 bp, Homo sapien
gggccattctccctattggaagtat

SEQ ID NO: 253027 - DNA, 25 bp, Homo sapien
gccattctccctattggaagtatac

SEQ ID NO: 253028 - DNA, 25 bp, Homo sapien
tctccctattggaagtatactaata

SEQ ID NO: 253029 - DNA, 25 bp, Homo sapien
atactaatagtatctgctcactgga

SEQ ID NO: 253030 - DNA, 25 bp, Homo sapien
agtatctgctcactggaacatgcca

SEQ ID NO: 253031 - DNA, 25 bp, Homo sapien
tctgctcactggaacatgccatata

SEQ ID NO: 253032 - DNA, 25 bp, Homo sapien
tcactggaacatgccatatatgtca

SEQ ID NO: 253033 - DNA, 25 bp, Homo sapien
ctatgaggctgctgttagttttaca

SEQ ID NO: 253034 - DNA, 25 bp, Homo sapien
taaggaaactcatcctcagagaggt

SEQ ID NO: 253035 - DNA, 25 bp, Homo sapien
gagaggttcagttacttacccagga

SEQ ID NO: 253036 - DNA, 25 bp, Homo sapien
gttcagttacttacccaggatcaca

SEQ ID NO: 253037 - DNA, 25 bp, Homo sapien
acccaggatcacaaagccagtaggt

SEQ ID NO: 253038 - DNA, 25 bp, Homo sapien
gagctaaaacttgaacccagactta

SEQ ID NO: 253039 - DNA, 25 bp, Homo sapien
tgaacccagacttatgtaactacat

SEQ ID NO: 253040 - DNA, 25 bp, Homo sapien
aactacatcacaacacttctaagcc

SEQ ID NO: 253041 - DNA, 25 bp, Homo sapien
cactcttgccctaaggtggaagccg

SEQ ID NO: 253042 - DNA, 25 bp, Homo sapien
ttgccctaaggtggaagccgcctaa

SEQ ID NO: 253043 - DNA, 25 bp, Homo sapien
agccgcctaatgtcttttgttcaaa

SEQ ID NO: 253044 - DNA, 25 bp, Homo sapien
catccttcaggcgaattattgaaaa

SEQ ID NO: 253045 - DNA, 25 bp, Homo sapien
taaggacatggacccccggctgatt

SEQ ID NO: 253046 - DNA, 25 bp, Homo sapien
ggcttgtttggatacaacacaggaa

SEQ ID NO: 253047 - DNA, 25 bp, Homo sapien
acaggaactgtggatttatcagcga

SEQ ID NO: 253048 - DNA, 25 bp, Homo sapien
tgtggatttatcagcgagagtggca

SEQ ID NO: 253049 - DNA, 25 bp, Homo sapien
agtggcagcgctttggtgtccgcat

SEQ ID NO: 253050 - DNA, 25 bp, Homo sapien
agcgctttggtgtccgcatgttacg

SEQ ID NO: 253051 - DNA, 25 bp, Homo sapien
catgttacgagagcgggctgcgttt

SEQ ID NO: 253052 - DNA, 25 bp, Homo sapien
agcgggctgcgtttgtgtggtgaat

SEQ ID NO: 253053 - DNA, 25 bp, Homo sapien
ggaaatgtcactgccgaagaccaaa

SEQ ID NO: 253054 - DNA, 25 bp, Homo sapien
aagcttcttggtataaaagactctt

SEQ ID NO: 253055 - DNA, 25 bp, Homo sapien
atcgctgtatggtctgggttctctt

SEQ ID NO: 253056 - DNA, 25 bp, Homo sapien
tgtatggtctgggttctcttctctg

SEQ ID NO: 253057 - DNA, 25 bp, Homo sapien
ggttctcttctctgcccagtgtttg

SEQ ID NO: 253058 - DNA, 25 bp, Homo sapien
tatgtacccctgctttcctcacttt

SEQ ID NO: 253059 - DNA, 25 bp, Homo sapien
tttcaggcttccatgcttctctgtg

SEQ ID NO: 253060 - DNA, 25 bp, Homo sapien
tgtgacatcccccaaaaacaggcag

SEQ ID NO: 253061 - DNA, 25 bp, Homo sapien
aagatgtgcatgtacccactcaagc

SEQ ID NO: 253062 - DNA, 25 bp, Homo sapien
tcaagcctcaagcttgtatctgtat

SEQ ID NO: 253063 - DNA, 25 bp, Homo sapien
gtatctgtatccatatccagggaca

SEQ ID NO: 253064 - DNA, 25 bp, Homo sapien
aatcttgggaaatggacaggaactc

SEQ ID NO: 253065 - DNA, 25 bp, Homo sapien
acaggaactcccaggcagacacata

SEQ ID NO: 253066 - DNA, 25 bp, Homo sapien
attgccctgactgagatggacacca

SEQ ID NO: 253067 - DNA, 25 bp, Homo sapien
gccctgactgagatggacaccaaca

SEQ ID NO: 253068 - DNA, 25 bp, Homo sapien
accaacaaccactcctatgtctttg

SEQ ID NO: 253069 - DNA, 25 bp, Homo sapien
acagtagaactctgcgaccaaggga

SEQ ID NO: 253070 - DNA, 25 bp, Homo sapien
aactctgcgaccaagggaggctgag

SEQ ID NO: 253071 - DNA, 25 bp, Homo sapien
agggaatgtccaagaaccacctcct

SEQ ID NO: 253072 - DNA, 25 bp, Homo sapien
caagaaccacctcctaattcttatt

SEQ ID NO: 253073 - DNA, 25 bp, Homo sapien
aaggtcatttgggaagtgctgaatt

SEQ ID NO: 253074 - DNA, 25 bp, Homo sapien
catttgggaagtgctgaattcgata

SEQ ID NO: 253075 - DNA, 25 bp, Homo sapien
ggagcccttcatttatgggaagccc

SEQ ID NO: 253076 - DNA, 25 bp, Homo sapien
ttcatttatgggaagcccagggagc

SEQ ID NO: 253077 - DNA, 25 bp, Homo sapien
gaaatgcatccctaacttcaacata

SEQ ID NO: 253078 - DNA, 25 bp, Homo sapien
gaaaccattctttgtacccacccat

SEQ ID NO: 253079 - DNA, 25 bp, Homo sapien
ataaaaatcccctcatttctcatca

SEQ ID NO: 253080 - DNA, 25 bp, Homo sapien
ctcatcagatgtttactgggttgct

SEQ ID NO: 253081 - DNA, 25 bp, Homo sapien
aatagaatcctgcaagaggctcaac

SEQ ID NO: 253082 - DNA, 25 bp, Homo sapien
caagaggctcaacagggaagtccaa

SEQ ID NO: 253083 - DNA, 25 bp, Homo sapien
gggaagtccaaagagtcaatcaaga

SEQ ID NO: 253084 - DNA, 25 bp, Homo sapien
actgtaggtcaatgctccacgaggt

SEQ ID NO: 253085 - DNA, 25 bp, Homo sapien
tccacgaggttcttcttttgttgca

SEQ ID NO: 253086 - DNA, 25 bp, Homo sapien
gttgcaccaatatagctgcactgtt

SEQ ID NO: 253087 - DNA, 25 bp, Homo sapien
gctgcactgttatacccatatggtt

SEQ ID NO: 253088 - DNA, 25 bp, Homo sapien
gattcaagctcagcttacacttggc

SEQ ID NO: 253089 - DNA, 25 bp, Homo sapien
agctcagcttacacttggcaatctt

SEQ ID NO: 253090 - DNA, 25 bp, Homo sapien
gcttacacttggcaatcttctaggg

SEQ ID NO: 253091 - DNA, 25 bp, Homo sapien
cttggcaatcttctagggaggactt

SEQ ID NO: 253092 - DNA, 25 bp, Homo sapien
atcttctagggaggactttggctga

SEQ ID NO: 253093 - DNA, 25 bp, Homo sapien
ctagggaggactttggctgaaccca

SEQ ID NO: 253094 - DNA, 25 bp, Homo sapien
gaaaagaatcacaaacatctggagt

SEQ ID NO: 253095 - DNA, 25 bp, Homo sapien
acatctggagtttgttgactagaaa

SEQ ID NO: 253096 - DNA, 25 bp, Homo sapien
gttgactagaaaaattccttgtggt

SEQ ID NO: 253097 - DNA, 25 bp, Homo sapien
aattccttgtggtctgacagattac

SEQ ID NO: 253098 - DNA, 25 bp, Homo sapien
gtctgacagattaccatttcctacc

SEQ ID NO: 253099 - DNA, 25 bp, Homo sapien
gctggcgcttctgacttcaggagcg

SEQ ID NO: 253100 - DNA, 25 bp, Homo sapien
ctggcgcttctgacttcaggagcga

SEQ ID NO: 253101 - DNA, 25 bp, Homo sapien
tggcgcttctgacttcaggagcgaa

SEQ ID NO: 253102 - DNA, 25 bp, Homo sapien
ggcgcttctgacttcaggagcgaaa

SEQ ID NO: 253103 - DNA, 25 bp, Homo sapien
ttctgacttcaggagcgaaaggagg

SEQ ID NO: 253104 - DNA, 25 bp, Homo sapien
tctgacttcaggagcgaaaggagga

SEQ ID NO: 253105 - DNA, 25 bp, Homo sapien
ttcaggagcgaaaggaggaggccta

SEQ ID NO: 253106 - DNA, 25 bp, Homo sapien
gagcgaaaggaggaggcctagtttg

SEQ ID NO: 253107 - DNA, 25 bp, Homo sapien
tggctaattgtcttcggccaaccag

SEQ ID NO: 253108 - DNA, 25 bp, Homo sapien
ggctaattgtcttcggccaaccagg

SEQ ID NO: 253109 - DNA, 25 bp, Homo sapien
gctaattgtcttcggccaaccaggg

SEQ ID NO: 253110 - DNA, 25 bp, Homo sapien
agccgtgagaggactgctcaacaat

SEQ ID NO: 253111 - DNA, 25 bp, Homo sapien
gggcccaagggttatggctttcatg

SEQ ID NO: 253112 - DNA, 25 bp, Homo sapien
cccaagggttatggctttcatgtct

SEQ ID NO: 253113 - DNA, 25 bp, Homo sapien
aattcaatgtttcattccgctgcct

SEQ ID NO: 253114 - DNA, 25 bp, Homo sapien
gaatctggagtaattaatgccaccc

SEQ ID NO: 253115 - DNA, 25 bp, Homo sapien
ggagtaattaatgccacccaaagaa

SEQ ID NO: 253116 - DNA, 25 bp, Homo sapien
taatgccacccaaagaaaaggccct

SEQ ID NO: 253117 - DNA, 25 bp, Homo sapien
ccgctgcctccatcatgtaatagaa

SEQ ID NO: 253118 - DNA, 25 bp, Homo sapien
gtaatagaatcgctttccagaaagg

SEQ ID NO: 253119 - DNA, 25 bp, Homo sapien
aaggcagttaactggaagcagcaga

SEQ ID NO: 253120 - DNA, 25 bp, Homo sapien
aggctcccagccgtgagaggactgc

SEQ ID NO: 253121 - DNA, 25 bp, Homo sapien
gaacttttcaaatgtagaggagcct

SEQ ID NO: 253122 - DNA, 25 bp, Homo sapien
agaggagcctttagaaggaagcctt

SEQ ID NO: 253123 - DNA, 25 bp, Homo sapien
gaaggaagccttgagcatgaggaca

SEQ ID NO: 253124 - DNA, 25 bp, Homo sapien
cctgactctgtgtgaacctggaact

SEQ ID NO: 253125 - DNA, 25 bp, Homo sapien
actctgtgtgaacctggaactgtta

SEQ ID NO: 253126 - DNA, 25 bp, Homo sapien
ggaactgttagaatgtctgtgctgt

SEQ ID NO: 253127 - DNA, 25 bp, Homo sapien
gttagaatgtctgtgctgtgataaa

SEQ ID NO: 253128 - DNA, 25 bp, Homo sapien
aaggtcatctccctacaatgttatg

SEQ ID NO: 253129 - DNA, 25 bp, Homo sapien
ggtcatctccctacaatgttatgat

SEQ ID NO: 253130 - DNA, 25 bp, Homo sapien
atctccctacaatgttatgatacag

SEQ ID NO: 253131 - DNA, 25 bp, Homo sapien
tgttatgatacagacctcaaaccta

SEQ ID NO: 253132 - DNA, 25 bp, Homo sapien
tgtctaccctatggccacagcagga

SEQ ID NO: 253133 - DNA, 25 bp, Homo sapien
ccctatggccacagcaggaggtcag

SEQ ID NO: 253134 - DNA, 25 bp, Homo sapien
tcagcccagggccaggagacacatg

SEQ ID NO: 253135 - DNA, 25 bp, Homo sapien
tttgcagcctgggagaccccgactt

SEQ ID NO: 253136 - DNA, 25 bp, Homo sapien
ccgactttctctaacccagtggctg

SEQ ID NO: 253137 - DNA, 25 bp, Homo sapien
taacccagtggctgtgcggtgcagg

SEQ ID NO: 253138 - DNA, 25 bp, Homo sapien
gcatgacatgttaactgtgtgccca

SEQ ID NO: 253139 - DNA, 25 bp, Homo sapien
tgacatgttaactgtgtgcccagga

SEQ ID NO: 253140 - DNA, 25 bp, Homo sapien
gaccgggtatgccaactggaatgat

SEQ ID NO: 253141 - DNA, 25 bp, Homo sapien
gccaactggaatgattctagaacca

SEQ ID NO: 253142 - DNA, 25 bp, Homo sapien
agggagccctgctcggccctgaatc

SEQ ID NO: 253143 - DNA, 25 bp, Homo sapien
attgtgccacctttttatacttcat

SEQ ID NO: 253144 - DNA, 25 bp, Homo sapien
gtgccacctttttatacttcatttt

SEQ ID NO: 253145 - DNA, 25 bp, Homo sapien
gtatggatgcatatatacttaatga

SEQ ID NO: 253146 - DNA, 25 bp, Homo sapien
ttgaggttcagagtatgacaaatct

SEQ ID NO: 253147 - DNA, 25 bp, Homo sapien
tactgcctatttaggcaatagctaa

SEQ ID NO: 253148 - DNA, 25 bp, Homo sapien
ggcaatagctaatagagtagtttgt

SEQ ID NO: 253149 - DNA, 25 bp, Homo sapien
gagtggagtatgtacttaatgtata

SEQ ID NO: 253150 - DNA, 25 bp, Homo sapien
taaacttgctactacattgtattac

SEQ ID NO: 253151 - DNA, 25 bp, Homo sapien
ccttctcatggatgtgaaagtacca

SEQ ID NO: 253152 - DNA, 25 bp, Homo sapien
ggatgtgaaagtaccaatgaaatgt

SEQ ID NO: 253153 - DNA, 25 bp, Homo sapien
gtggagatctcgatgtataacagtc

SEQ ID NO: 253154 - DNA, 25 bp, Homo sapien
cacaactcccagttgtttgggaact

SEQ ID NO: 253155 - DNA, 25 bp, Homo sapien
ttcatctcaatatcatcttctttta

SEQ ID NO: 253156 - DNA, 25 bp, Homo sapien
accttgggtggcttgtgcttttggt

SEQ ID NO: 253157 - DNA, 25 bp, Homo sapien
cttgtgcttttggttgtctgtaata

SEQ ID NO: 253158 - DNA, 25 bp, Homo sapien
gtaatatcatcttcttcagtatctg

SEQ ID NO: 253159 - DNA, 25 bp, Homo sapien
ttcagtatctgaagcttggcgaaac

SEQ ID NO: 253160 - DNA, 25 bp, Homo sapien
gaagcttggcgaaactgtagagtgc

SEQ ID NO: 253161 - DNA, 25 bp, Homo sapien
tgtagagtgccagtgttgatataaa

SEQ ID NO: 253162 - DNA, 25 bp, Homo sapien
aaaagcctccatattttgttgttag

SEQ ID NO: 253163 - DNA, 25 bp, Homo sapien
gagaagcgggaactaattcatcata

SEQ ID NO: 253164 - DNA, 25 bp, Homo sapien
atttagagccacaactcccagttgt

SEQ ID NO: 253165 - DNA, 25 bp, Homo sapien
acagacctgccctctgaagttctct

SEQ ID NO: 253166 - DNA, 25 bp, Homo sapien
tgaagttctctccacgccctttgga

SEQ ID NO: 253167 - DNA, 25 bp, Homo sapien
acgccctttggacaggcacttcggc

SEQ ID NO: 253168 - DNA, 25 bp, Homo sapien
gtgggcagacccaacggccagagct

SEQ ID NO: 253169 - DNA, 25 bp, Homo sapien
acggccagagctaacaggactgcct

SEQ ID NO: 253170 - DNA, 25 bp, Homo sapien
ccagagctaacaggactgcctggga

SEQ ID NO: 253171 - DNA, 25 bp, Homo sapien
ccctaccagatttctattttataat

SEQ ID NO: 253172 - DNA, 25 bp, Homo sapien
tttacatcagagctaacaaccaggg

SEQ ID NO: 253173 - DNA, 25 bp, Homo sapien
aaggagaccgtcaggccgcatgtag

SEQ ID NO: 253174 - DNA, 25 bp, Homo sapien
accgtcaggccgcatgtagacaatg

SEQ ID NO: 253175 - DNA, 25 bp, Homo sapien
ggccgcatgtagacaatgctgctaa

SEQ ID NO: 253176 - DNA, 25 bp, Homo sapien
cctaggacgcggctaaactcttggc

SEQ ID NO: 253177 - DNA, 25 bp, Homo sapien
ctaggacgcggctaaactcttggcc

SEQ ID NO: 253178 - DNA, 25 bp, Homo sapien
tttgtctttgaccatataagcttgt

SEQ ID NO: 253179 - DNA, 25 bp, Homo sapien
gaccatataagcttgtaactctgac

SEQ ID NO: 253180 - DNA, 25 bp, Homo sapien
ataagcttgtaactctgactgcgga

SEQ ID NO: 253181 - DNA, 25 bp, Homo sapien
aagcttgtaactctgactgcggaga

SEQ ID NO: 253182 - DNA, 25 bp, Homo sapien
gcttgtaactctgactgcggagagt

SEQ ID NO: 253183 - DNA, 25 bp, Homo sapien
gtaactctgactgcggagagtgagt

SEQ ID NO: 253184 - DNA, 25 bp, Homo sapien
gagaggcaacgaagtccttagcact

SEQ ID NO: 253185 - DNA, 25 bp, Homo sapien
ggcaacgaagtccttagcactggca

SEQ ID NO: 253186 - DNA, 25 bp, Homo sapien
aacgaagtccttagcactggcagct

SEQ ID NO: 253187 - DNA, 25 bp, Homo sapien
gcttttcttttctccatgctagtgt

SEQ ID NO: 253188 - DNA, 25 bp, Homo sapien
tttcttttctccatgctagtgttat

SEQ ID NO: 253189 - DNA, 25 bp, Homo sapien
ttttctccatgctagtgttatcagg

SEQ ID NO: 253190 - DNA, 25 bp, Homo sapien
ctccatgctagtgttatcaggtttt

SEQ ID NO: 253191 - DNA, 25 bp, Homo sapien
gctagtgttatcaggttttggtatt

SEQ ID NO: 253192 - DNA, 25 bp, Homo sapien
gtgttatcaggttttggtatttatt

SEQ ID NO: 253193 - DNA, 25 bp, Homo sapien
ggtatttatttacttacagcatatg

SEQ ID NO: 253194 - DNA, 25 bp, Homo sapien
gcatatgttatgaagctggtttgaa

SEQ ID NO: 253195 - DNA, 25 bp, Homo sapien
gaaaattggttttagatatatctgc

SEQ ID NO: 253196 - DNA, 25 bp, Homo sapien
agatatatctgcaagtttactactt

SEQ ID NO: 253197 - DNA, 25 bp, Homo sapien
atctgcaagtttactactttgactg

SEQ ID NO: 253198 - DNA, 25 bp, Homo sapien
caggctgtatatggaggctctcctc

SEQ ID NO: 253199 - DNA, 25 bp, Homo sapien
ttctaaccctgctgctgatttggaa

SEQ ID NO: 253200 - DNA, 25 bp, Homo sapien
ttggaattaccttgccaagcccctt

SEQ ID NO: 253201 - DNA, 25 bp, Homo sapien
aaatgtctctgtcttctatgtgata

SEQ ID NO: 253202 - DNA, 25 bp, Homo sapien
aagcccctttgtgccttatagtgaa

SEQ ID NO: 253203 - DNA, 25 bp, Homo sapien
gtgccttatagtgaactttctctaa

SEQ ID NO: 253204 - DNA, 25 bp, Homo sapien
gtgaactttctctaagggacctgtc

SEQ ID NO: 253205 - DNA, 25 bp, Homo sapien
aagggacctgtcatctcttatcatt

SEQ ID NO: 253206 - DNA, 25 bp, Homo sapien
gtcatctcttatcattgtttatcca

SEQ ID NO: 253207 - DNA, 25 bp, Homo sapien
ctatgtgatacattctgctgttttt

SEQ ID NO: 253208 - DNA, 25 bp, Homo sapien
ggtaccaaccaccaggctgtatatg

SEQ ID NO: 253209 - DNA, 25 bp, Homo sapien
catatttctgtctgtcccagcacct

SEQ ID NO: 253210 - DNA, 25 bp, Homo sapien
agcacctcaggagcattctcattgt

SEQ ID NO: 253211 - DNA, 25 bp, Homo sapien
acctcaggagcattctcattgtggc

SEQ ID NO: 253212 - DNA, 25 bp, Homo sapien
aatgagtcacgtacttgtattgcac

SEQ ID NO: 253213 - DNA, 25 bp, Homo sapien
gtcacgtacttgtattgcacagtgg

SEQ ID NO: 253214 - DNA, 25 bp, Homo sapien
gtattgcacagtggacacctctaga

SEQ ID NO: 253215 - DNA, 25 bp, Homo sapien
cacctctagaggtccattggtttaa

SEQ ID NO: 253216 - DNA, 25 bp, Homo sapien
cccctcccagaagtaaatctagtat

SEQ ID NO: 253217 - DNA, 25 bp, Homo sapien
gtaaatctagtatctgagttttctt

SEQ ID NO: 253218 - DNA, 25 bp, Homo sapien
ccttgagtcaaactaataactgtct

SEQ ID NO: 253219 - DNA, 25 bp, Homo sapien
ctaataactgtctagtacggaggtg

SEQ ID NO: 253220 - DNA, 25 bp, Homo sapien
atacttttatgttatccctaatcgt

SEQ ID NO: 253221 - DNA, 25 bp, Homo sapien
tttatgttatccctaatcgtcccac

SEQ ID NO: 253222 - DNA, 25 bp, Homo sapien
tatccctaatcgtcccactaaatgg

SEQ ID NO: 253223 - DNA, 25 bp, Homo sapien
atcgtcccactaaatggaatgccta

SEQ ID NO: 253224 - DNA, 25 bp, Homo sapien
ggaatgcctatgattagcttcatta

SEQ ID NO: 253225 - DNA, 25 bp, Homo sapien
gctaatatccattttatgcacatta

SEQ ID NO: 253226 - DNA, 25 bp, Homo sapien
gcacattaaagctcagtatgcattt

SEQ ID NO: 253227 - DNA, 25 bp, Homo sapien
taaagctcagtatgcattttctttg

SEQ ID NO: 253228 - DNA, 25 bp, Homo sapien
ttttctttgatgcatgcagtttcta

SEQ ID NO: 253229 - DNA, 25 bp, Homo sapien
gatgcatgcagtttctatcaattaa

SEQ ID NO: 253230 - DNA, 25 bp, Homo sapien
gcatgcagtttctatcaattaaata

SEQ ID NO: 253231 - DNA, 25 bp, Homo sapien
ttcttctcgctctctgtgggtcatg

SEQ ID NO: 253232 - DNA, 25 bp, Homo sapien
gctctctgtgggtcatgccgaccat

SEQ ID NO: 253233 - DNA, 25 bp, Homo sapien
gggtcatgccgaccatctagtcagt

SEQ ID NO: 253234 - DNA, 25 bp, Homo sapien
cgaccatctagtcagtcccagtgag

SEQ ID NO: 253235 - DNA, 25 bp, Homo sapien
aactgggtatctcagttggagatgc

SEQ ID NO: 253236 - DNA, 25 bp, Homo sapien
gcagaaatcacccacattcctcgtt

SEQ ID NO: 253237 - DNA, 25 bp, Homo sapien
cgttcctctcgctggcagctgcaga

SEQ ID NO: 253238 - DNA, 25 bp, Homo sapien
tgcagaccagagctgcttctagtcg

SEQ ID NO: 253239 - DNA, 25 bp, Homo sapien
ttctagtcggcagtcttggcccctc

SEQ ID NO: 253240 - DNA, 25 bp, Homo sapien
ccttgccataatgatcagtgatgat

SEQ ID NO: 253241 - DNA, 25 bp, Homo sapien
agtgatgatctgtcttttaataagt

SEQ ID NO: 253242 - DNA, 25 bp, Homo sapien
ctgtggacccatctcagtggagaat

SEQ ID NO: 253243 - DNA, 25 bp, Homo sapien
tcagtggagaattcgttttggaccc

SEQ ID NO: 253244 - DNA, 25 bp, Homo sapien
gtggagaattcgttttggacccgtg

SEQ ID NO: 253245 - DNA, 25 bp, Homo sapien
gagaattcgttttggacccgtggct

SEQ ID NO: 253246 - DNA, 25 bp, Homo sapien
gttttggacccgtggctccgtgcag

SEQ ID NO: 253247 - DNA, 25 bp, Homo sapien
tggctccgtgcagctgtggactcga

SEQ ID NO: 253248 - DNA, 25 bp, Homo sapien
gtgcagctgtggactcgagtgccat

SEQ ID NO: 253249 - DNA, 25 bp, Homo sapien
cagctgtggactcgagtgccatcca

SEQ ID NO: 253250 - DNA, 25 bp, Homo sapien
tgtggactcgagtgccatccactgg

SEQ ID NO: 253251 - DNA, 25 bp, Homo sapien
actcgagtgccatccactggtgtga

SEQ ID NO: 253252 - DNA, 25 bp, Homo sapien
cgagtgccatccactggtgtgagtc

SEQ ID NO: 253253 - DNA, 25 bp, Homo sapien
tttggattgtaattgggagctctgc

SEQ ID NO: 253254 - DNA, 25 bp, Homo sapien
tacgccagggcggttccaaactcta

SEQ ID NO: 253255 - DNA, 25 bp, Homo sapien
accgtcagggagacctacagtttcg

SEQ ID NO: 253256 - DNA, 25 bp, Homo sapien
tgcctcccaaaatggagccaggctt

SEQ ID NO: 253257 - DNA, 25 bp, Homo sapien
tgggctggccttgtatataggaaat

SEQ ID NO: 253258 - DNA, 25 bp, Homo sapien
gagatttgaaacagtgctcgggttt

SEQ ID NO: 253259 - DNA, 25 bp, Homo sapien
aacagtgctcgggttttcgctagga

SEQ ID NO: 253260 - DNA, 25 bp, Homo sapien
agtgctcgggttttcgctaggaccg

SEQ ID NO: 253261 - DNA, 25 bp, Homo sapien
aacttccgctgccttcggacatagg

SEQ ID NO: 253262 - DNA, 25 bp, Homo sapien
tgccttcggacatagggacccagtt

SEQ ID NO: 253263 - DNA, 25 bp, Homo sapien
atagggacccagttcccaggagcgg

SEQ ID NO: 253264 - DNA, 25 bp, Homo sapien
cttgttaatgccatttgatgggaaa

SEQ ID NO: 253265 - DNA, 25 bp, Homo sapien
gttaatgccatttgatgggaaagaa

SEQ ID NO: 253266 - DNA, 25 bp, Homo sapien
caaatgtgtctcagagtcaagggct

SEQ ID NO: 253267 - DNA, 25 bp, Homo sapien
aatgtgtctcagagtcaagggctgg

SEQ ID NO: 253268 - DNA, 25 bp, Homo sapien
gtcaagggctgggccttcaaatgct

SEQ ID NO: 253269 - DNA, 25 bp, Homo sapien
ttcaaatgctgatagctctcagtct

SEQ ID NO: 253270 - DNA, 25 bp, Homo sapien
aaatgctgatagctctcagtctgtc

SEQ ID NO: 253271 - DNA, 25 bp, Homo sapien
tctcagtctgtctgtctacacaccc

SEQ ID NO: 253272 - DNA, 25 bp, Homo sapien
tcaagcatcttcactatgcttttaa

SEQ ID NO: 253273 - DNA, 25 bp, Homo sapien
gcatcttcactatgcttttaagcta

SEQ ID NO: 253274 - DNA, 25 bp, Homo sapien
atcttcactatgcttttaagctaaa

SEQ ID NO: 253275 - DNA, 25 bp, Homo sapien
cctgaggctgtgtgtaacaaaatga

SEQ ID NO: 253276 - DNA, 25 bp, Homo sapien
aaaatgacaggacaatcttgcagta

SEQ ID NO: 253277 - DNA, 25 bp, Homo sapien
gcagtaacctttccccttgaagaga

SEQ ID NO: 253278 - DNA, 25 bp, Homo sapien
ggagcagttggctacttgattacaa

SEQ ID NO: 253279 - DNA, 25 bp, Homo sapien
ttggctacttgattacaacagagta

SEQ ID NO: 253280 - DNA, 25 bp, Homo sapien
gaagtactggatttgggaaaacctg

SEQ ID NO: 253281 - DNA, 25 bp, Homo sapien
gaatgaaagccctacaccctagcat

SEQ ID NO: 253282 - DNA, 25 bp, Homo sapien
tgaaagccctacaccctagcattgc

SEQ ID NO: 253283 - DNA, 25 bp, Homo sapien
tacaccctagcattgccctacttag

SEQ ID NO: 253284 - DNA, 25 bp, Homo sapien
cccctgaattaacagagccccaatt

SEQ ID NO: 253285 - DNA, 25 bp, Homo sapien
aacagagccccaattgagacaaacc

SEQ ID NO: 253286 - DNA, 25 bp, Homo sapien
gtcaagtgcaggagttggtggagct

SEQ ID NO: 253287 - DNA, 25 bp, Homo sapien
agagaaaatggtgcagtgcaacgaa

SEQ ID NO: 253288 - DNA, 25 bp, Homo sapien
gcagtgcaacgaaggggcttacttt

SEQ ID NO: 253289 - DNA, 25 bp, Homo sapien
ggcttacttttctgatgacatatac

SEQ ID NO: 253290 - DNA, 25 bp, Homo sapien
ttctgatgacatatacaaggacaca

SEQ ID NO: 253291 - DNA, 25 bp, Homo sapien
tgatgacatatacaaggacacagag

SEQ ID NO: 253292 - DNA, 25 bp, Homo sapien
caaggacacagaggaaaggctgaaa

SEQ ID NO: 253293 - DNA, 25 bp, Homo sapien
tgaggaaaatctacactgaccaatt

SEQ ID NO: 253294 - DNA, 25 bp, Homo sapien
gaggaaaatctacactgaccaatta

SEQ ID NO: 253295 - DNA, 25 bp, Homo sapien
gaaaatctacactgaccaattaaat

SEQ ID NO: 253296 - DNA, 25 bp, Homo sapien
aaactagtagaagaggataagcata

SEQ ID NO: 253297 - DNA, 25 bp, Homo sapien
ttgtgtctgctccaagtgcgaaccc

SEQ ID NO: 253298 - DNA, 25 bp, Homo sapien
tgctcaaagctagagttttcgtgac

SEQ ID NO: 253299 - DNA, 25 bp, Homo sapien
aggagcactacctgagctttctctt

SEQ ID NO: 253300 - DNA, 25 bp, Homo sapien
gagctttctcttccgggtctaaagg

SEQ ID NO: 253301 - DNA, 25 bp, Homo sapien
aaaggtggaaacttctttgcagcac

SEQ ID NO: 253302 - DNA, 25 bp, Homo sapien
gcatttcactgtactgattcctttt

SEQ ID NO: 253303 - DNA, 25 bp, Homo sapien
tttggatcaccacctcctgcgttta

SEQ ID NO: 253304 - DNA, 25 bp, Homo sapien
ggctcactcagctatacactgcttg

SEQ ID NO: 253305 - DNA, 25 bp, Homo sapien
tttcgtgacagctctttcaagggtg

SEQ ID NO: 253306 - DNA, 25 bp, Homo sapien
ttcaagggtgcccacttggagcctt

SEQ ID NO: 253307 - DNA, 25 bp, Homo sapien
atggatgtcttcacggtgagccttg

SEQ ID NO: 253308 - DNA, 25 bp, Homo sapien
gagaaacaacctgacgtgcaccaat

SEQ ID NO: 253309 - DNA, 25 bp, Homo sapien
gacgtgcaccaatcagtctgcacat

SEQ ID NO: 253310 - DNA, 25 bp, Homo sapien
catcccaacccttcacattttataa

SEQ ID NO: 253311 - DNA, 25 bp, Homo sapien
taggagcacttttatgagagacatt

SEQ ID NO: 253312 - DNA, 25 bp, Homo sapien
gagagacattttccatgactaaata

SEQ ID NO: 253313 - DNA, 25 bp, Homo sapien
agcattagtcagtaaatcctttaga

SEQ ID NO: 253314 - DNA, 25 bp, Homo sapien
tcctttagaactgggttttgaaatg

SEQ ID NO: 253315 - DNA, 25 bp, Homo sapien
catttcttgtagtcttacatttttt

SEQ ID NO: 253316 - DNA, 25 bp, Homo sapien
gttgttgttctggaatctacctgta

SEQ ID NO: 253317 - DNA, 25 bp, Homo sapien
gtagacctggattcatgtgggctct

SEQ ID NO: 253318 - DNA, 25 bp, Homo sapien
acctggattcatgtgggctcttcca

SEQ ID NO: 253319 - DNA, 25 bp, Homo sapien
gtttgggaccaaccgagatcacaca

SEQ ID NO: 253320 - DNA, 25 bp, Homo sapien
ggaccaaccgagatcacacagctga

SEQ ID NO: 253321 - DNA, 25 bp, Homo sapien
aggtcaagctgaaagtcggccgcca

SEQ ID NO: 253322 - DNA, 25 bp, Homo sapien
aagtgcacgcagaataaggtctacg

SEQ ID NO: 253323 - DNA, 25 bp, Homo sapien
agcgtggatcccaggacaccgtgaa

SEQ ID NO: 253324 - DNA, 25 bp, Homo sapien
gatcccaggacaccgtgaacggact

SEQ ID NO: 253325 - DNA, 25 bp, Homo sapien
ttgactttcgcgtttttaaggagtg

SEQ ID NO: 253326 - DNA, 25 bp, Homo sapien
gggtgcagggaaacaatcctccgcc

SEQ ID NO: 253327 - DNA, 25 bp, Homo sapien
ggtctacgtgattaagcaccgcctg

SEQ ID NO: 253328 - DNA, 25 bp, Homo sapien
gctgcacagatgaaagggaggctca

SEQ ID NO: 253329 - DNA, 25 bp, Homo sapien
aggctcagagacgtttgggaccaac

SEQ ID NO: 253330 - DNA, 25 bp, Homo sapien
aataagcgtatctggatttttcttt

SEQ ID NO: 253331 - DNA, 25 bp, Homo sapien
cttttgaattcttgactgataagtt

SEQ ID NO: 253332 - DNA, 25 bp, Homo sapien
gaattcttgactgataagtttgaga

SEQ ID NO: 253333 - DNA, 25 bp, Homo sapien
ttgagaatgtatgtttttggaattt

SEQ ID NO: 253334 - DNA, 25 bp, Homo sapien
ttttacagttgactcaagtgtgaaa

SEQ ID NO: 253335 - DNA, 25 bp, Homo sapien
acagttgactcaagtgtgaaagtat

SEQ ID NO: 253336 - DNA, 25 bp, Homo sapien
gttgactcaagtgtgaaagtataca

SEQ ID NO: 253337 - DNA, 25 bp, Homo sapien
gaaagtatacacaagtaatttttct

SEQ ID NO: 253338 - DNA, 25 bp, Homo sapien
ttttcttttctagctatgtgaatgt

SEQ ID NO: 253339 - DNA, 25 bp, Homo sapien
ttcttttctagctatgtgaatgtaa

SEQ ID NO: 253340 - DNA, 25 bp, Homo sapien
ctagctatgtgaatgtaaaatactt

SEQ ID NO: 253341 - DNA, 25 bp, Homo sapien
ggtactttggtagcctgagtggtct

SEQ ID NO: 253342 - DNA, 25 bp, Homo sapien
actttggtagcctgagtggtctttt

SEQ ID NO: 253343 - DNA, 25 bp, Homo sapien
tttttcatctctttcgcgtccatta

SEQ ID NO: 253344 - DNA, 25 bp, Homo sapien
tctttcgcgtccattactcaaggag

SEQ ID NO: 253345 - DNA, 25 bp, Homo sapien
tactcaaggagacagcataacagat

SEQ ID NO: 253346 - DNA, 25 bp, Homo sapien
acagatgcagaacaagtcatatttg

SEQ ID NO: 253347 - DNA, 25 bp, Homo sapien
aaaagggcgtgagctcacacagtga

SEQ ID NO: 253348 - DNA, 25 bp, Homo sapien
aaatatggtgagaagctcgctcctt

SEQ ID NO: 253349 - DNA, 25 bp, Homo sapien
ctcgctcctttcaacttgtttggta

SEQ ID NO: 253350 - DNA, 25 bp, Homo sapien
acttgtttggtactgacagctgata

SEQ ID NO: 253351 - DNA, 25 bp, Homo sapien
gacagctgatagaagctattttcta

SEQ ID NO: 253352 - DNA, 25 bp, Homo sapien
cctgaggctgtgtgtaacaaaatga

SEQ ID NO: 253353 - DNA, 25 bp, Homo sapien
tgaggctgtgtgtaacaaaatgaca

SEQ ID NO: 253354 - DNA, 25 bp, Homo sapien
caaaatgacaggacaatcttgcagt

SEQ ID NO: 253355 - DNA, 25 bp, Homo sapien
aaaatgacaggacaatcttgcagta

SEQ ID NO: 253356 - DNA, 25 bp, Homo sapien
gattgtgatatatactagtatctag

SEQ ID NO: 253357 - DNA, 25 bp, Homo sapien
ctagtatctaggaatgaacagtaaa

SEQ ID NO: 253358 - DNA, 25 bp, Homo sapien
gagcagttggctacttgattacaac

SEQ ID NO: 253359 - DNA, 25 bp, Homo sapien
gcagttggctacttgattacaacag

SEQ ID NO: 253360 - DNA, 25 bp, Homo sapien
gttggctacttgattacaacagagt

SEQ ID NO: 253361 - DNA, 25 bp, Homo sapien
ggctacttgattacaacagagtaaa

SEQ ID NO: 253362 - DNA, 25 bp, Homo sapien
gaagtactggatttgggaaaacctg

SEQ ID NO: 253363 - DNA, 25 bp, Homo sapien
aatgatttcaaattatcctagagta

SEQ ID NO: 253364 - DNA, 25 bp, Homo sapien
tatcctagagtataacatttttatc

SEQ ID NO: 253365 - DNA, 25 bp, Homo sapien
attactgttctaatgctgaagtgac

SEQ ID NO: 253366 - DNA, 25 bp, Homo sapien
actgttctaatgctgaagtgacttt

SEQ ID NO: 253367 - DNA, 25 bp, Homo sapien
acttttgccagtgccatgtccaggg

SEQ ID NO: 253368 - DNA, 25 bp, Homo sapien
gggaggtataagttacttgctctta

SEQ ID NO: 253369 - DNA, 25 bp, Homo sapien
gacacctttgggagtattcccaaag

SEQ ID NO: 253370 - DNA, 25 bp, Homo sapien
gggagtattcccaaagcatgtctca

SEQ ID NO: 253371 - DNA, 25 bp, Homo sapien
gagtattcccaaagcatgtctcaag

SEQ ID NO: 253372 - DNA, 25 bp, Homo sapien
cccgagagcatggtttaaaagcttg

SEQ ID NO: 253373 - DNA, 25 bp, Homo sapien
gcatggtttaaaagcttggacccct

SEQ ID NO: 253374 - DNA, 25 bp, Homo sapien
gtctggaagaggaccatctgggatt

SEQ ID NO: 253375 - DNA, 25 bp, Homo sapien
ggaagaggaccatctgggatttcta

SEQ ID NO: 253376 - DNA, 25 bp, Homo sapien
atctgggatttctacagcctgggta

SEQ ID NO: 253377 - DNA, 25 bp, Homo sapien
ctgggatttctacagcctgggtacc

SEQ ID NO: 253378 - DNA, 25 bp, Homo sapien
ggtacccatagccacaccaaggctt

SEQ ID NO: 253379 - DNA, 25 bp, Homo sapien
gccacaccaaggcttctgggagatt

SEQ ID NO: 253380 - DNA, 25 bp, Homo sapien
cacaccaaggcttctgggagattct

SEQ ID NO: 253381 - DNA, 25 bp, Homo sapien
aggctgttcccaaatagctccctgc

SEQ ID NO: 253382 - DNA, 25 bp, Homo sapien
agcagaagagccattcatctcataa

SEQ ID NO: 253383 - DNA, 25 bp, Homo sapien
tgcaaggttatttgcaggcagggat

SEQ ID NO: 253384 - DNA, 25 bp, Homo sapien
gatgggcttgtacctgacagcaccc

SEQ ID NO: 253385 - DNA, 25 bp, Homo sapien
gtgactgcaggccaagggaacccca

SEQ ID NO: 253386 - DNA, 25 bp, Homo sapien
cccagccagcatgtgcaagctatta

SEQ ID NO: 253387 - DNA, 25 bp, Homo sapien
aggaagatgtcccatcttgcccata

SEQ ID NO: 253388 - DNA, 25 bp, Homo sapien
ggctcttcaccttcagagtgaccac

SEQ ID NO: 253389 - DNA, 25 bp, Homo sapien
tgaccacttcccagactctggaagt

SEQ ID NO: 253390 - DNA, 25 bp, Homo sapien
gaagtgggaagaccctctttgacgc

SEQ ID NO: 253391 - DNA, 25 bp, Homo sapien
gaccctctttgacgctttattacag

SEQ ID NO: 253392 - DNA, 25 bp, Homo sapien
gtaatttgagctcctatcgacttgg

SEQ ID NO: 253393 - DNA, 25 bp, Homo sapien
gcgaatgaatttctcttttgtggtt

SEQ ID NO: 253394 - DNA, 25 bp, Homo sapien
gagccacttcacagcactcagggat

SEQ ID NO: 253395 - DNA, 25 bp, Homo sapien
ctgctgtccagtgaccaggtggaca

SEQ ID NO: 253396 - DNA, 25 bp, Homo sapien
ttctagctggaagggaagggcaaaa

SEQ ID NO: 253397 - DNA, 25 bp, Homo sapien
acaccacaatactctgggaattgaa

SEQ ID NO: 253398 - DNA, 25 bp, Homo sapien
gaattgaacgttttctaaatccctg

SEQ ID NO: 253399 - DNA, 25 bp, Homo sapien
aaatccctgattgtaatgctgatga

SEQ ID NO: 253400 - DNA, 25 bp, Homo sapien
gagtagaaactgactctgtttgtca

SEQ ID NO: 253401 - DNA, 25 bp, Homo sapien
ctctgtttgtcatgtttagttttca

SEQ ID NO: 253402 - DNA, 25 bp, Homo sapien
aaatgataacaacgcctaacacaat

SEQ ID NO: 253403 - DNA, 25 bp, Homo sapien
gaccctcaacactgttattctctag

SEQ ID NO: 253404 - DNA, 25 bp, Homo sapien
ctcaacactgttattctctagctta

SEQ ID NO: 253405 - DNA, 25 bp, Homo sapien
tatcttcttggtcagagtctacttt

SEQ ID NO: 253406 - DNA, 25 bp, Homo sapien
cttggtcagagtctactttcttctt

SEQ ID NO: 253407 - DNA, 25 bp, Homo sapien
ctgcagcaagtctatgcctgggtaa

SEQ ID NO: 253408 - DNA, 25 bp, Homo sapien
gtctatgcctgggtaacaaccaacc

SEQ ID NO: 253409 - DNA, 25 bp, Homo sapien
tcccgcctctgtgaggcttgaggag

SEQ ID NO: 253410 - DNA, 25 bp, Homo sapien
agcagtatgtatctgggccagcctg

SEQ ID NO: 253411 - DNA, 25 bp, Homo sapien
cctggtcctcagagtgtggaattaa

SEQ ID NO: 253412 - DNA, 25 bp, Homo sapien
ggaattaacacctttcctctagcaa

SEQ ID NO: 253413 - DNA, 25 bp, Homo sapien
ctctagcaactgtttgtgctgctga

SEQ ID NO: 253414 - DNA, 25 bp, Homo sapien
gagaacagcacagactctctggcag

SEQ ID NO: 253415 - DNA, 25 bp, Homo sapien
gttctctccagagggaagcctgtga

SEQ ID NO: 253416 - DNA, 25 bp, Homo sapien
acatatggcatctgcactcagggcg

SEQ ID NO: 253417 - DNA, 25 bp, Homo sapien
tccggccttgctataaaatgacttt

SEQ ID NO: 253418 - DNA, 25 bp, Homo sapien
cctcatatggtttttggccaagtga

SEQ ID NO: 253419 - DNA, 25 bp, Homo sapien
ttttggccaagtgactaaaacagtt

SEQ ID NO: 253420 - DNA, 25 bp, Homo sapien
tggtaagccccacctcaaacttgtt

SEQ ID NO: 253421 - DNA, 25 bp, Homo sapien
ttctgtgggtgaccttttccgggat

SEQ ID NO: 253422 - DNA, 25 bp, Homo sapien
ttccgggatttcttgttcttatcaa

SEQ ID NO: 253423 - DNA, 25 bp, Homo sapien
gcacatgctaaacgtcttccatttg

SEQ ID NO: 253424 - DNA, 25 bp, Homo sapien
aaacgtcttccatttgacttctcta

SEQ ID NO: 253425 - DNA, 25 bp, Homo sapien
tgacttctctactcggtgtctcaga

SEQ ID NO: 253426 - DNA, 25 bp, Homo sapien
gtctcagacagtgtcttcccagaaa

SEQ ID NO: 253427 - DNA, 25 bp, Homo sapien
accctctacccaaagatgaaacatg

SEQ ID NO: 253428 - DNA, 25 bp, Homo sapien
ttttctcatggtcacatttaacagt

SEQ ID NO: 253429 - DNA, 25 bp, Homo sapien
aatccgtggagttggacttgtgaga

SEQ ID NO: 253430 - DNA, 25 bp, Homo sapien
gttggacttgtgagaggccttgccc

SEQ ID NO: 253431 - DNA, 25 bp, Homo sapien
ggacttgtgagaggccttgccctga

SEQ ID NO: 253432 - DNA, 25 bp, Homo sapien
atgccttgatggctgtgtctcccgt

SEQ ID NO: 253433 - DNA, 25 bp, Homo sapien
ttgatggctgtgtctcccgtgctcc

SEQ ID NO: 253434 - DNA, 25 bp, Homo sapien
aggtcctcatcctcaggactgtgag

SEQ ID NO: 253435 - DNA, 25 bp, Homo sapien
tcaggactgtgagacgccgttggac

SEQ ID NO: 253436 - DNA, 25 bp, Homo sapien
cgccgttggacgtggaggagcctga

SEQ ID NO: 253437 - DNA, 25 bp, Homo sapien
tggcatttgccagttgaaacctgaa

SEQ ID NO: 253438 - DNA, 25 bp, Homo sapien
ttgccagttgaaacctgaaggattg

SEQ ID NO: 253439 - DNA, 25 bp, Homo sapien
aagcccattgcatataagcagcaca

SEQ ID NO: 253440 - DNA, 25 bp, Homo sapien
tgcttgcacctcctatccggaggta

SEQ ID NO: 253441 - DNA, 25 bp, Homo sapien
gggctcttgcttgaggcctgcacag

SEQ ID NO: 253442 - DNA, 25 bp, Homo sapien
aggaagcaagtatagccccggtgcc

SEQ ID NO: 253443 - DNA, 25 bp, Homo sapien
agtatagccccggtgccccagagtg

SEQ ID NO: 253444 - DNA, 25 bp, Homo sapien
agtgggttccacttagccctggcga

SEQ ID NO: 253445 - DNA, 25 bp, Homo sapien
ggcgagatggcctgtcctgagatct

SEQ ID NO: 253446 - DNA, 25 bp, Homo sapien
tgtcctgagatctctgctcccagac

SEQ ID NO: 253447 - DNA, 25 bp, Homo sapien
acagtccttaggctgcctggtccag

SEQ ID NO: 253448 - DNA, 25 bp, Homo sapien
tgcggctctgtcaggaaacctggac

SEQ ID NO: 253449 - DNA, 25 bp, Homo sapien
aggaaacctggactctcaaggccca

SEQ ID NO: 253450 - DNA, 25 bp, Homo sapien
accagcctctccgtgagtgttagaa

SEQ ID NO: 253451 - DNA, 25 bp, Homo sapien
ctggatgactgcacagcggtgccct

SEQ ID NO: 253452 - DNA, 25 bp, Homo sapien
cagcggtgccctggtatagcagaaa

SEQ ID NO: 253453 - DNA, 25 bp, Homo sapien
tggaaggttagagaccgggcctctt

SEQ ID NO: 253454 - DNA, 25 bp, Homo sapien
gggcctcttaccctggaactctgca

SEQ ID NO: 253455 - DNA, 25 bp, Homo sapien
ccttgtctgtacagccaggtatgaa

SEQ ID NO: 253456 - DNA, 25 bp, Homo sapien
gccaggtatgaagctcagtgatttc

SEQ ID NO: 253457 - DNA, 25 bp, Homo sapien
ttctaagattctttctggtccttca

SEQ ID NO: 253458 - DNA, 25 bp, Homo sapien
aaagttgatcatgtatttttgtctg

SEQ ID NO: 253459 - DNA, 25 bp, Homo sapien
tttttgtctgatccctgattcatgg

SEQ ID NO: 253460 - DNA, 25 bp, Homo sapien
gattcatggtttctttcaggtcgga

SEQ ID NO: 253461 - DNA, 25 bp, Homo sapien
gactgttacagagttttctataaga

SEQ ID NO: 253462 - DNA, 25 bp, Homo sapien
gaggatttcctatccccaggacctg

SEQ ID NO: 253463 - DNA, 25 bp, Homo sapien
aagggcaggtgtggtctcacccaga

SEQ ID NO: 253464 - DNA, 25 bp, Homo sapien
aggtgtggtctcacccagaatggtt

SEQ ID NO: 253465 - DNA, 25 bp, Homo sapien
agaatggttcctgctgcttccgcgg

SEQ ID NO: 253466 - DNA, 25 bp, Homo sapien
ttttctcacggcctctgctgggttc

SEQ ID NO: 253467 - DNA, 25 bp, Homo sapien
tctgctgggttctcccctgggtgct

SEQ ID NO: 253468 - DNA, 25 bp, Homo sapien
cctgggtgctgtggatgcatcctgc

SEQ ID NO: 253469 - DNA, 25 bp, Homo sapien
gatgcatcctgcctgctggaaattc

SEQ ID NO: 253470 - DNA, 25 bp, Homo sapien
cctgcctgctggaaattctgtgctc

SEQ ID NO: 253471 - DNA, 25 bp, Homo sapien
tgtttccatccctttgtcgtggtaa

SEQ ID NO: 253472 - DNA, 25 bp, Homo sapien
ccctttgtcgtggtaatgaccgtat

SEQ ID NO: 253473 - DNA, 25 bp, Homo sapien
aagtcctgagacctgaagattgtaa

SEQ ID NO: 253474 - DNA, 25 bp, Homo sapien
aagattgtaatattcatgtctgtga

SEQ ID NO: 253475 - DNA, 25 bp, Homo sapien
gaagcttttaaacattacacttgag

SEQ ID NO: 253476 - DNA, 25 bp, Homo sapien
ttacacttgagatcagtcatgactt

SEQ ID NO: 253477 - DNA, 25 bp, Homo sapien
cagtcatgacttgatattcaggtaa

SEQ ID NO: 253478 - DNA, 25 bp, Homo sapien
gcactaattgcattacattggtaac

SEQ ID NO: 253479 - DNA, 25 bp, Homo sapien
ggtaactgcaatataaaatagccat

SEQ ID NO: 253480 - DNA, 25 bp, Homo sapien
aatagccattattgttttgtgaagc

SEQ ID NO: 253481 - DNA, 25 bp, Homo sapien
attgttttgtgaagcatggttgaaa

SEQ ID NO: 253482 - DNA, 25 bp, Homo sapien
gttgaaattagctagtggtcccttt

SEQ ID NO: 253483 - DNA, 25 bp, Homo sapien
ctagtggtcccttttgaatttcatg

SEQ ID NO: 253484 - DNA, 25 bp, Homo sapien
gatgcttccggctcctctaggaaga

SEQ ID NO: 253485 - DNA, 25 bp, Homo sapien
cggctcctctaggaagaggctctgg

SEQ ID NO: 253486 - DNA, 25 bp, Homo sapien
tttgagggcgcagtaggctcccgtc

SEQ ID NO: 253487 - DNA, 25 bp, Homo sapien
agtaggctcccgtcctagcgggtcg

SEQ ID NO: 253488 - DNA, 25 bp, Homo sapien
cgggtcgcagctccttacaagattt

SEQ ID NO: 253489 - DNA, 25 bp, Homo sapien
ggttggattaatcttctagaagggt

SEQ ID NO: 253490 - DNA, 25 bp, Homo sapien
tagaagggtgctaggtctccccgtt

SEQ ID NO: 253491 - DNA, 25 bp, Homo sapien
cccgccaccaactttagagttgtgg

SEQ ID NO: 253492 - DNA, 25 bp, Homo sapien
agagttgtggtgtacaagcgctatc

SEQ ID NO: 253493 - DNA, 25 bp, Homo sapien
gtacaagcgctatcttttctgatgt

SEQ ID NO: 253494 - DNA, 25 bp, Homo sapien
ttttctgatgttatatcccatagga

SEQ ID NO: 253495 - DNA, 25 bp, Homo sapien
agttgaataagaatggacgcccaca

SEQ ID NO: 253496 - DNA, 25 bp, Homo sapien
gaatggacgcccacagtgattctca

SEQ ID NO: 253497 - DNA, 25 bp, Homo sapien
ggacgcccacagtgattctcaacca

SEQ ID NO: 253498 - DNA, 25 bp, Homo sapien
attacaaattttcacagaacacagt

SEQ ID NO: 253499 - DNA, 25 bp, Homo sapien
gggtaactatgagagtcaatacaag

SEQ ID NO: 253500 - DNA, 25 bp, Homo sapien
gggtgtttcgtttcataacagatct

SEQ ID NO: 253501 - DNA, 25 bp, Homo sapien
gtttcataacagatctcttaccatc

SEQ ID NO: 253502 - DNA, 25 bp, Homo sapien
agatctcttaccatcactggaagtg

SEQ ID NO: 253503 - DNA, 25 bp, Homo sapien
aaaacagaggtattccgagtggaca

SEQ ID NO: 253504 - DNA, 25 bp, Homo sapien
gtattccgagtggacagatttccat

SEQ ID NO: 253505 - DNA, 25 bp, Homo sapien
tccgagtggacagatttccatgtgt

SEQ ID NO: 253506 - DNA, 25 bp, Homo sapien
gtcttctggatcagactgttgttgg

SEQ ID NO: 253507 - DNA, 25 bp, Homo sapien
actgttgttggttatctggtgtgga

SEQ ID NO: 253508 - DNA, 25 bp, Homo sapien
gtgcacttagcatgctgacttgctc

SEQ ID NO: 253509 - DNA, 25 bp, Homo sapien
gacttgctcatcagttttgcacagt

SEQ ID NO: 253510 - DNA, 25 bp, Homo sapien
cagaaactccattggaaccccgagg

SEQ ID NO: 253511 - DNA, 25 bp, Homo sapien
aggacaaaggttatgtgcttcacat

SEQ ID NO: 253512 - DNA, 25 bp, Homo sapien
cttcacatgatcactactgcagcag

SEQ ID NO: 253513 - DNA, 25 bp, Homo sapien
actgcagcagaatggtctatgtcat

SEQ ID NO: 253514 - DNA, 25 bp, Homo sapien
ttttttcctgacttacattcgtgat

SEQ ID NO: 253515 - DNA, 25 bp, Homo sapien
gaagccaatttacatggattaaccc

SEQ ID NO: 253516 - DNA, 25 bp, Homo sapien
ggattaaccctctatgacactgcac

SEQ ID NO: 253517 - DNA, 25 bp, Homo sapien
gtgttgtttccccaaagtctcaatc

SEQ ID NO: 253518 - DNA, 25 bp, Homo sapien
gtttccccaaagtctcaatcagatg

SEQ ID NO: 253519 - DNA, 25 bp, Homo sapien
aagctgggcgaccttacccttcacg

SEQ ID NO: 253520 - DNA, 25 bp, Homo sapien
tcacgtcattccagccccagaggag

SEQ ID NO: 253521 - DNA, 25 bp, Homo sapien
gagtctaacctagagatacctccaa

SEQ ID NO: 253522 - DNA, 25 bp, Homo sapien
tagagatacctccaagcgcggccgg

SEQ ID NO: 253523 - DNA, 25 bp, Homo sapien
aaatcactgcatctcataattattg

SEQ ID NO: 253524 - DNA, 25 bp, Homo sapien
gagatctttgtgttgtaattttcaa

SEQ ID NO: 253525 - DNA, 25 bp, Homo sapien
caagctgtttttagagggaatatat

SEQ ID NO: 253526 - DNA, 25 bp, Homo sapien
atatatgtcctggtttgctgctgtg

SEQ ID NO: 253527 - DNA, 25 bp, Homo sapien
ctggtttgctgctgtgttgtttccc

SEQ ID NO: 253528 - DNA, 25 bp, Homo sapien
gtattagtttttgatgcagacataa

SEQ ID NO: 253529 - DNA, 25 bp, Homo sapien
acttatgggtaataaaggctagtca

SEQ ID NO: 253530 - DNA, 25 bp, Homo sapien
aaggctagtcagaaccctataccat

SEQ ID NO: 253531 - DNA, 25 bp, Homo sapien
ggctagtcagaaccctataccataa

SEQ ID NO: 253532 - DNA, 25 bp, Homo sapien
gtcagaaccctataccataaagtgt

SEQ ID NO: 253533 - DNA, 25 bp, Homo sapien
ataccataaagtgtagttaccatac

SEQ ID NO: 253534 - DNA, 25 bp, Homo sapien
agtgtagttaccatacagattaata

SEQ ID NO: 253535 - DNA, 25 bp, Homo sapien
aaatgtatgcttgatatttctcaac

SEQ ID NO: 253536 - DNA, 25 bp, Homo sapien
tgtatgcttgatatttctcaactgt

SEQ ID NO: 253537 - DNA, 25 bp, Homo sapien
tttttctgctgtattccagctgacc

SEQ ID NO: 253538 - DNA, 25 bp, Homo sapien
tctgctgtattccagctgaccaaaa

SEQ ID NO: 253539 - DNA, 25 bp, Homo sapien
atgtatacatccctaaacaaaatat

SEQ ID NO: 253540 - DNA, 25 bp, Homo sapien
aataatcttgcctgtttgggaacta

SEQ ID NO: 253541 - DNA, 25 bp, Homo sapien
atcttgcctgtttgggaactataaa

SEQ ID NO: 253542 - DNA, 25 bp, Homo sapien
aaacagaaacgtatgttacatatcc

SEQ ID NO: 253543 - DNA, 25 bp, Homo sapien
gttacatatccttttgtctgattct

SEQ ID NO: 253544 - DNA, 25 bp, Homo sapien
tatccttttgtctgattctttaatg

SEQ ID NO: 253545 - DNA, 25 bp, Homo sapien
gaatatactgctgtcaacttgtcta

SEQ ID NO: 253546 - DNA, 25 bp, Homo sapien
tactgctgtcaacttgtctatttat

SEQ ID NO: 253547 - DNA, 25 bp, Homo sapien
aactttgtgggcaatgatgtctttg

SEQ ID NO: 253548 - DNA, 25 bp, Homo sapien
caatgatgtctttgctttgctttat

SEQ ID NO: 253549 - DNA, 25 bp, Homo sapien
tctttgctttgctttatactttaac

SEQ ID NO: 253550 - DNA, 25 bp, Homo sapien
gaacccatatatgagagcctgttga

SEQ ID NO: 253551 - DNA, 25 bp, Homo sapien
tgagagcctgttgagggcttcaatt

SEQ ID NO: 253552 - DNA, 25 bp, Homo sapien
gggcttcaattgagaactccactcc

SEQ ID NO: 253553 - DNA, 25 bp, Homo sapien
gaagacttcatgctgttggcagtag

SEQ ID NO: 253554 - DNA, 25 bp, Homo sapien
cagtaggaatcattgcagcaagtgc

SEQ ID NO: 253555 - DNA, 25 bp, Homo sapien
cagcaagtgctttcatccaaaacca

SEQ ID NO: 253556 - DNA, 25 bp, Homo sapien
aaaaccatgagtgttggagccaggt

SEQ ID NO: 253557 - DNA, 25 bp, Homo sapien
ggatacaatggctgtttggttccag

SEQ ID NO: 253558 - DNA, 25 bp, Homo sapien
atgaggctgcatgcaacctgcctga

SEQ ID NO: 253559 - DNA, 25 bp, Homo sapien
gacactgctcgacctggtctatctt

SEQ ID NO: 253560 - DNA, 25 bp, Homo sapien
gtctatcttctgcatgaacccatat

SEQ ID NO: 253561 - DNA, 25 bp, Homo sapien
cttttcagcataaggactcaatcct

SEQ ID NO: 253562 - DNA, 25 bp, Homo sapien
agcataaggactcaatcctaggctc

SEQ ID NO: 253563 - DNA, 25 bp, Homo sapien
cctaggctcctaccccagacgggtg

SEQ ID NO: 253564 - DNA, 25 bp, Homo sapien
agacgggtgccttccaacgttcctg

SEQ ID NO: 253565 - DNA, 25 bp, Homo sapien
gggtgccttccaacgttcctggtgc

SEQ ID NO: 253566 - DNA, 25 bp, Homo sapien
ccttccaacgttcctggtgccagtg

SEQ ID NO: 253567 - DNA, 25 bp, Homo sapien
agggccccatccttcagtgcattgc

SEQ ID NO: 253568 - DNA, 25 bp, Homo sapien
agtgcattgcacactttgcatgctg

SEQ ID NO: 253569 - DNA, 25 bp, Homo sapien
cactttgcatgctgggtcagggaag

SEQ ID NO: 253570 - DNA, 25 bp, Homo sapien
agagaggacagtgcacctggtttcc

SEQ ID NO: 253571 - DNA, 25 bp, Homo sapien
agaggacagtgcacctggtttcccc

SEQ ID NO: 253572 - DNA, 25 bp, Homo sapien
tgtccggggacctgtgcaaatgacc

SEQ ID NO: 253573 - DNA, 25 bp, Homo sapien
aatgaccctggagttggtttcgctt

SEQ ID NO: 253574 - DNA, 25 bp, Homo sapien
tggagttggtttcgctttctcccct

SEQ ID NO: 253575 - DNA, 25 bp, Homo sapien
ctttctccccttgcggcggtgtgaa

SEQ ID NO: 253576 - DNA, 25 bp, Homo sapien
tgtgaacgtgtgtccgcagcgtgat

SEQ ID NO: 253577 - DNA, 25 bp, Homo sapien
gagaaattgacccacctaagttaca

SEQ ID NO: 253578 - DNA, 25 bp, Homo sapien
tgacccacctaagttacaaggaagt

SEQ ID NO: 253579 - DNA, 25 bp, Homo sapien
cgcattggggtctcctacattttct

SEQ ID NO: 253580 - DNA, 25 bp, Homo sapien
tacattttctccaatgacgatgagg

SEQ ID NO: 253581 - DNA, 25 bp, Homo sapien
ttctccaatgacgatgaggacgtgg

SEQ ID NO: 253582 - DNA, 25 bp, Homo sapien
agatggcggcggcttgcccgacggt

SEQ ID NO: 253583 - DNA, 25 bp, Homo sapien
gacatatttaaagccttgtgaacat

SEQ ID NO: 253584 - DNA, 25 bp, Homo sapien
atatggctacttttattgttttcct

SEQ ID NO: 253585 - DNA, 25 bp, Homo sapien
tgtgtgttgccaaatcactctcctg

SEQ ID NO: 253586 - DNA, 25 bp, Homo sapien
ttgccaaatcactctcctgaatgtt

SEQ ID NO: 253587 - DNA, 25 bp, Homo sapien
aatcactctcctgaatgttagaaaa

SEQ ID NO: 253588 - DNA, 25 bp, Homo sapien
gttagaaaatcaggtttcattcctt

SEQ ID NO: 253589 - DNA, 25 bp, Homo sapien
gtttcattccttgtttacataacgt

SEQ ID NO: 253590 - DNA, 25 bp, Homo sapien
aacatttgcagttgattttcagtca

SEQ ID NO: 253591 - DNA, 25 bp, Homo sapien
gattttcagtcaacaaattgctttt

SEQ ID NO: 253592 - DNA, 25 bp, Homo sapien
gaaataagaccattccagtatcctt

SEQ ID NO: 253593 - DNA, 25 bp, Homo sapien
cattccagtatccttaccttacaga

SEQ ID NO: 253594 - DNA, 25 bp, Homo sapien
caacgctgcagatttatctgcacaa

SEQ ID NO: 253595 - DNA, 25 bp, Homo sapien
atctgcacaaacatctccacttttg

SEQ ID NO: 253596 - DNA, 25 bp, Homo sapien
aggtgggtagattccagttccctgg

SEQ ID NO: 253597 - DNA, 25 bp, Homo sapien
agttccctggactaccttcaggagg

SEQ ID NO: 253598 - DNA, 25 bp, Homo sapien
gaagaggcaaagctacaggtttact

SEQ ID NO: 253599 - DNA, 25 bp, Homo sapien
ctacaggtttacttgggagccagct

SEQ ID NO: 253600 - DNA, 25 bp, Homo sapien
agactcacaggtgctggtgcttgga

SEQ ID NO: 253601 - DNA, 25 bp, Homo sapien
ggtgcttggatttagccaggctcct

SEQ ID NO: 253602 - DNA, 25 bp, Homo sapien
tgcagtgccagcacgcaaatccctt

SEQ ID NO: 253603 - DNA, 25 bp, Homo sapien
gcaaatcccttcaccacagggtttc

SEQ ID NO: 253604 - DNA, 25 bp, Homo sapien
acagggtttcgttttgctggcttga

SEQ ID NO: 253605 - DNA, 25 bp, Homo sapien
gatcaggtggcaaaaacgctaattt

SEQ ID NO: 253606 - DNA, 25 bp, Homo sapien
tcaatagcatctttttctctagaag

SEQ ID NO: 253607 - DNA, 25 bp, Homo sapien
tgaagcaatcttccctggacaaggt

SEQ ID NO: 253608 - DNA, 25 bp, Homo sapien
gaagaggcaacatagctcactaaat

SEQ ID NO: 253609 - DNA, 25 bp, Homo sapien
agattattcatgctctgcacctgag

SEQ ID NO: 253610 - DNA, 25 bp, Homo sapien
gagagaaccgcagccgacgcgctgt

SEQ ID NO: 253611 - DNA, 25 bp, Homo sapien
gaatactgccagtctgctcgttcag

SEQ ID NO: 253612 - DNA, 25 bp, Homo sapien
ctgctcgttcagacagatgtaaagt

SEQ ID NO: 253613 - DNA, 25 bp, Homo sapien
gatgtaaagtccaacggcttccgct

SEQ ID NO: 253614 - DNA, 25 bp, Homo sapien
ttccgctttcatcacacatcagtgt

SEQ ID NO: 253615 - DNA, 25 bp, Homo sapien
cacatcagtgtgtaagttggatcag

SEQ ID NO: 253616 - DNA, 25 bp, Homo sapien
aactttctttccctagtgtcttgca

SEQ ID NO: 253617 - DNA, 25 bp, Homo sapien
cactccctggtatctagcacataga

SEQ ID NO: 253618 - DNA, 25 bp, Homo sapien
aaccatgcctctttataacatttag

SEQ ID NO: 253619 - DNA, 25 bp, Homo sapien
atggaacccattgactggtctgccc

SEQ ID NO: 253620 - DNA, 25 bp, Homo sapien
tcatctccgatccttggctgaaaag

SEQ ID NO: 253621 - DNA, 25 bp, Homo sapien
gaaaagcctaacaagccattatctg

SEQ ID NO: 253622 - DNA, 25 bp, Homo sapien
aagccattatctgtccgtactgaaa

SEQ ID NO: 253623 - DNA, 25 bp, Homo sapien
gtactgaaacactcctcctgatgtc

SEQ ID NO: 253624 - DNA, 25 bp, Homo sapien
ttagatcaccgtccttataatgcgc

SEQ ID NO: 253625 - DNA, 25 bp, Homo sapien
tataatgcgcctttctgtctctttt

SEQ ID NO: 253626 - DNA, 25 bp, Homo sapien
tctttttaaaccttgagcaccttga

SEQ ID NO: 253627 - DNA, 25 bp, Homo sapien
ctcctccattggacatgactcaaac

SEQ ID NO: 253628 - DNA, 25 bp, Homo sapien
agcaggaatcacttgtatcagccaa

SEQ ID NO: 253629 - DNA, 25 bp, Homo sapien
tgtatcagccaagcactcaagagat

SEQ ID NO: 253630 - DNA, 25 bp, Homo sapien
agcactcaagagatgccggtaaaca

SEQ ID NO: 253631 - DNA, 25 bp, Homo sapien
aagggtgctcagtaggtgactcttc

SEQ ID NO: 253632 - DNA, 25 bp, Homo sapien
gactcttcactgatgtcctcctctt

SEQ ID NO: 253633 - DNA, 25 bp, Homo sapien
ttcttctgctgagaaaccagtgcaa

SEQ ID NO: 253634 - DNA, 25 bp, Homo sapien
accagtgcaagtatctatgaagtca

SEQ ID NO: 253635 - DNA, 25 bp, Homo sapien
gagaaggttttccataggacttgtt

SEQ ID NO: 253636 - DNA, 25 bp, Homo sapien
taggacttgtttccaccttgatagt

SEQ ID NO: 253637 - DNA, 25 bp, Homo sapien
gtggttaatccacctgcagtaaaac

SEQ ID NO: 253638 - DNA, 25 bp, Homo sapien
atgtgggcctctccagtgcaaacca

SEQ ID NO: 253639 - DNA, 25 bp, Homo sapien
tctccagtgcaaaccaccgagcatt

SEQ ID NO: 253640 - DNA, 25 bp, Homo sapien
gagcattccaccatgaccggtcaca

SEQ ID NO: 253641 - DNA, 25 bp, Homo sapien
gaccggtcacagctacaaatccaga

SEQ ID NO: 253642 - DNA, 25 bp, Homo sapien
gagaccatcaatcctgctagagtgc

SEQ ID NO: 253643 - DNA, 25 bp, Homo sapien
gcacccaagggtggctgaccaagac

SEQ ID NO: 253644 - DNA, 25 bp, Homo sapien
tgaccaagactgcagagtctcctcc

SEQ ID NO: 253645 - DNA, 25 bp, Homo sapien
ggtccattcagcctcctggcattta

SEQ ID NO: 253646 - DNA, 25 bp, Homo sapien
ggcatttaactaccagcatccagtg

SEQ ID NO: 253647 - DNA, 25 bp, Homo sapien
agcatccagtggtccccaaggaatc

SEQ ID NO: 253648 - DNA, 25 bp, Homo sapien
gcctcctgacatgagtctgctggaa

SEQ ID NO: 253649 - DNA, 25 bp, Homo sapien
gagcgtgggagagtgccctaaactt

SEQ ID NO: 253650 - DNA, 25 bp, Homo sapien
gggcggagcaacctgttatcaatac

SEQ ID NO: 253651 - DNA, 25 bp, Homo sapien
atacactttcttgagcagagtctga

SEQ ID NO: 253652 - DNA, 25 bp, Homo sapien
aaacgaacacagtcacatagtccaa

SEQ ID NO: 253653 - DNA, 25 bp, Homo sapien
aaatcatttgagacggtgccctgta

SEQ ID NO: 253654 - DNA, 25 bp, Homo sapien
ggtgccctgtatgttcatctcaagg

SEQ ID NO: 253655 - DNA, 25 bp, Homo sapien
tcatctcaaggcatctagctcttac

SEQ ID NO: 253656 - DNA, 25 bp, Homo sapien
tagctcttacccacagagaaccgtg

SEQ ID NO: 253657 - DNA, 25 bp, Homo sapien
agagaaccgtgactctgggcttccc

SEQ ID NO: 253658 - DNA, 25 bp, Homo sapien
gggtcctgattgtcagattgaagct

SEQ ID NO: 253659 - DNA, 25 bp, Homo sapien
tgggcttccctcactaaatatgtct

SEQ ID NO: 253660 - DNA, 25 bp, Homo sapien
attaacacttgaatcccctaactgg

SEQ ID NO: 253661 - DNA, 25 bp, Homo sapien
gaatcccctaactggaagttaatat

SEQ ID NO: 253662 - DNA, 25 bp, Homo sapien
gagagtattacagtgttctagtcct

SEQ ID NO: 253663 - DNA, 25 bp, Homo sapien
gttctagtcctgtgagcccatagta

SEQ ID NO: 253664 - DNA, 25 bp, Homo sapien
gagcccatagtatttttcaaaggta

SEQ ID NO: 253665 - DNA, 25 bp, Homo sapien
atatgcatatgcctgtttgctttca

SEQ ID NO: 253666 - DNA, 25 bp, Homo sapien
gtttgctttcataatctgagttgtt

SEQ ID NO: 253667 - DNA, 25 bp, Homo sapien
gaacctattgattacctctgagatg

SEQ ID NO: 253668 - DNA, 25 bp, Homo sapien
aggactgtgagacattggtttgtaa

SEQ ID NO: 253669 - DNA, 25 bp, Homo sapien
tgtaatggaggacttttacttttca

SEQ ID NO: 253670 - DNA, 25 bp, Homo sapien
cacctatgctattcagtactgttgg

SEQ ID NO: 253671 - DNA, 25 bp, Homo sapien
agatattgtgcattttcctcagaaa

SEQ ID NO: 253672 - DNA, 25 bp, Homo sapien
aattcctttgtctcctgctagttta

SEQ ID NO: 253673 - DNA, 25 bp, Homo sapien
tgtctcctgctagtttaaaccaaat

SEQ ID NO: 253674 - DNA, 25 bp, Homo sapien
accaaatattgtttgccacctctac

SEQ ID NO: 253675 - DNA, 25 bp, Homo sapien
tgtttgccacctctacaaacctttt

SEQ ID NO: 253676 - DNA, 25 bp, Homo sapien
gggaaatatcaccaactaatactaa

SEQ ID NO: 253677 - DNA, 25 bp, Homo sapien
ggaaacagaacttgcctagagatga

SEQ ID NO: 253678 - DNA, 25 bp, Homo sapien
gctggactctgatggatcgcctagg

SEQ ID NO: 253679 - DNA, 25 bp, Homo sapien
gatggatcgcctaggatatccaaag

SEQ ID NO: 253680 - DNA, 25 bp, Homo sapien
gtttatggactaaatgctgcaggtc

SEQ ID NO: 253681 - DNA, 25 bp, Homo sapien
gcaggtcagcagaaatttgcactaa

SEQ ID NO: 253682 - DNA, 25 bp, Homo sapien
gagcaaactgcggttcagcaccatt

SEQ ID NO: 253683 - DNA, 25 bp, Homo sapien
gcggttcagcaccattgaagagttt

SEQ ID NO: 253684 - DNA, 25 bp, Homo sapien
gaagagttttcctacattcggaggc

SEQ ID NO: 253685 - DNA, 25 bp, Homo sapien
agttttcctacattcggaggctgcc

SEQ ID NO: 253686 - DNA, 25 bp, Homo sapien
ggaggctgccctctgacgtcgtcac

SEQ ID NO: 253687 - DNA, 25 bp, Homo sapien
tctgacgtcgtcaccggctacctgg

SEQ ID NO: 253688 - DNA, 25 bp, Homo sapien
cctgaggaaggccacgagcatcgtt

SEQ ID NO: 253689 - DNA, 25 bp, Homo sapien
gaaggccacgagcatcgttccctga

SEQ ID NO: 253690 - DNA, 25 bp, Homo sapien
aaacagactctggactcatgatttt

SEQ ID NO: 253691 - DNA, 25 bp, Homo sapien
ggactcatgattttgtttcacggaa

SEQ ID NO: 253692 - DNA, 25 bp, Homo sapien
tttcaggtctgcttgccaactacac

SEQ ID NO: 253693 - DNA, 25 bp, Homo sapien
gaagatattgtgcattttcctcaga

SEQ ID NO: 253694 - DNA, 25 bp, Homo sapien
agatattgtgcattttcctcagaaa

SEQ ID NO: 253695 - DNA, 25 bp, Homo sapien
ggaattcctttgtctcctgctagtt

SEQ ID NO: 253696 - DNA, 25 bp, Homo sapien
attcctttgtctcctgctagtttaa

SEQ ID NO: 253697 - DNA, 25 bp, Homo sapien
tcctttgtctcctgctagtttaaac

SEQ ID NO: 253698 - DNA, 25 bp, Homo sapien
ctttgtctcctgctagtttaaacca

SEQ ID NO: 253699 - DNA, 25 bp, Homo sapien
tgtctcctgctagtttaaaccaaat

SEQ ID NO: 253700 - DNA, 25 bp, Homo sapien
accaaatattgtttgccacctctac

SEQ ID NO: 253701 - DNA, 25 bp, Homo sapien
gggaaatatcaccaactaatactaa

SEQ ID NO: 253702 - DNA, 25 bp, Homo sapien
tatcaccaactaatactaatgtttg

SEQ ID NO: 253703 - DNA, 25 bp, Homo sapien
actaatgtttggaaacagaacttgc

SEQ ID NO: 253704 - DNA, 25 bp, Homo sapien
gaatagtgtctagcatgtaagcctt

SEQ ID NO: 253705 - DNA, 25 bp, Homo sapien
tctagcatgtaagccttgtggacat

SEQ ID NO: 253706 - DNA, 25 bp, Homo sapien
gtaagccttgtggacatatagaaag

SEQ ID NO: 253707 - DNA, 25 bp, Homo sapien
tgttttgcacagtaatctattttct

SEQ ID NO: 253708 - DNA, 25 bp, Homo sapien
atcatgtattggaacgatgtgtgca

SEQ ID NO: 253709 - DNA, 25 bp, Homo sapien
gatgtgtgcaagtcaccattctgcc

SEQ ID NO: 253710 - DNA, 25 bp, Homo sapien
aagtcaccattctgccttcctaagg

SEQ ID NO: 253711 - DNA, 25 bp, Homo sapien
ccttcctaaggcaggagacctgatg

SEQ ID NO: 253712 - DNA, 25 bp, Homo sapien
aatgggatagtagtggcaatctcac

SEQ ID NO: 253713 - DNA, 25 bp, Homo sapien
gtagtggcaatctcacagggtgatt

SEQ ID NO: 253714 - DNA, 25 bp, Homo sapien
gggtggtcaatgaagtaatgcatgt

SEQ ID NO: 253715 - DNA, 25 bp, Homo sapien
aatcacgaagtaaatcatagagcct

SEQ ID NO: 253716 - DNA, 25 bp, Homo sapien
catagagccttgacttgaactcagg

SEQ ID NO: 253717 - DNA, 25 bp, Homo sapien
caggaagttaacacaattctgggaa

SEQ ID NO: 253718 - DNA, 25 bp, Homo sapien
attctgggaatatagcaggctgcca

SEQ ID NO: 253719 - DNA, 25 bp, Homo sapien
gctgccaagaaagggagctccgaag

SEQ ID NO: 253720 - DNA, 25 bp, Homo sapien
gagctccgaaggacaatgaccaaat

SEQ ID NO: 253721 - DNA, 25 bp, Homo sapien
gttcaattagaccaacctccaacat

SEQ ID NO: 253722 - DNA, 25 bp, Homo sapien
gaccaacctccaacatagaacacag

SEQ ID NO: 253723 - DNA, 25 bp, Homo sapien
atagaacacagacttcctctgcaac

SEQ ID NO: 253724 - DNA, 25 bp, Homo sapien
tgcaacctctccaacagatggccat

SEQ ID NO: 253725 - DNA, 25 bp, Homo sapien
gctgccacctaaacaagtccaatga

SEQ ID NO: 253726 - DNA, 25 bp, Homo sapien
tgcttacctgggtggcataagaagt

SEQ ID NO: 253727 - DNA, 25 bp, Homo sapien
gcttacctgggtggcataagaagtg

SEQ ID NO: 253728 - DNA, 25 bp, Homo sapien
tacctgggtggcataagaagtgtga

SEQ ID NO: 253729 - DNA, 25 bp, Homo sapien
acctgggtggcataagaagtgtgat

SEQ ID NO: 253730 - DNA, 25 bp, Homo sapien
cctgggtggcataagaagtgtgata

SEQ ID NO: 253731 - DNA, 25 bp, Homo sapien
aagaagtgtgatagaggccgggcgc

SEQ ID NO: 253732 - DNA, 25 bp, Homo sapien
agaagtgtgatagaggccgggcgca

SEQ ID NO: 253733 - DNA, 25 bp, Homo sapien
acacacctgttaattgcagctactt

SEQ ID NO: 253734 - DNA, 25 bp, Homo sapien
cacacctgttaattgcagctacttg

SEQ ID NO: 253735 - DNA, 25 bp, Homo sapien
acacctgttaattgcagctacttga

SEQ ID NO: 253736 - DNA, 25 bp, Homo sapien
acctgttaattgcagctacttgaga

SEQ ID NO: 253737 - DNA, 25 bp, Homo sapien
ttgtcatttctccaccgtctaatac

SEQ ID NO: 253738 - DNA, 25 bp, Homo sapien
tctccaccgtctaatacttccttta

SEQ ID NO: 253739 - DNA, 25 bp, Homo sapien
ttcctttaagttggtgcccctctca

SEQ ID NO: 253740 - DNA, 25 bp, Homo sapien
gccattcctggctccgtggtagcag

SEQ ID NO: 253741 - DNA, 25 bp, Homo sapien
gacactggaatgaacgctgaactaa

SEQ ID NO: 253742 - DNA, 25 bp, Homo sapien
taaaggcttattccggattgatcca

SEQ ID NO: 253743 - DNA, 25 bp, Homo sapien
ggattgatccagtaacaggtaacat

SEQ ID NO: 253744 - DNA, 25 bp, Homo sapien
aaaccagcacctactgatgtgggat

SEQ ID NO: 253745 - DNA, 25 bp, Homo sapien
gattgcatcgtttggtggtcaacat

SEQ ID NO: 253746 - DNA, 25 bp, Homo sapien
ccctaagtctttgcacacgcttgtg

SEQ ID NO: 253747 - DNA, 25 bp, Homo sapien
cacgcttgtgcttgtattcctttat

SEQ ID NO: 253748 - DNA, 25 bp, Homo sapien
gtataccttaaagacttgctcacat

SEQ ID NO: 253749 - DNA, 25 bp, Homo sapien
gacttgctcacattacttaaaattg

SEQ ID NO: 253750 - DNA, 25 bp, Homo sapien
taggttaggcatctatccaatctcc

SEQ ID NO: 253751 - DNA, 25 bp, Homo sapien
tatccaatctcccatgccagtaatt

SEQ ID NO: 253752 - DNA, 25 bp, Homo sapien
tctcccatgccagtaattctacaga

SEQ ID NO: 253753 - DNA, 25 bp, Homo sapien
gacagaggccagattgctatgctta

SEQ ID NO: 253754 - DNA, 25 bp, Homo sapien
tatgctgtatccttctaatcaccac

SEQ ID NO: 253755 - DNA, 25 bp, Homo sapien
ctaatcaccactttctcatcaaaat

SEQ ID NO: 253756 - DNA, 25 bp, Homo sapien
gctatgcttagatacaatttcaacc

SEQ ID NO: 253757 - DNA, 25 bp, Homo sapien
aatttcaaccacctacaaatccatc

SEQ ID NO: 253758 - DNA, 25 bp, Homo sapien
atccatctaattacctacatgacca

SEQ ID NO: 253759 - DNA, 25 bp, Homo sapien
gccgatgacccccaggatgtcaaat

SEQ ID NO: 253760 - DNA, 25 bp, Homo sapien
taggaaataaattcatgggactata

SEQ ID NO: 253761 - DNA, 25 bp, Homo sapien
gagaatgatttaatgtcctgagagg

SEQ ID NO: 253762 - DNA, 25 bp, Homo sapien
gaacagacctagagggtttccgcac

SEQ ID NO: 253763 - DNA, 25 bp, Homo sapien
gacctagagggtttccgcacagggc

SEQ ID NO: 253764 - DNA, 25 bp, Homo sapien
gggtttccgcacagggctcatggat

SEQ ID NO: 253765 - DNA, 25 bp, Homo sapien
cacagggctcatggattcgtttcaa

SEQ ID NO: 253766 - DNA, 25 bp, Homo sapien
agggctcatggattcgtttcaagaa

SEQ ID NO: 253767 - DNA, 25 bp, Homo sapien
ggattcgtttcaagaattgacaaca

SEQ ID NO: 253768 - DNA, 25 bp, Homo sapien
aacatagtttgcaatctccttcctg

SEQ ID NO: 253769 - DNA, 25 bp, Homo sapien
ccacctttattctcctagtggagag

SEQ ID NO: 253770 - DNA, 25 bp, Homo sapien
cagatgatactttcaatcctttgga

SEQ ID NO: 253771 - DNA, 25 bp, Homo sapien
aatcctttggaaagttatcaccatg

SEQ ID NO: 253772 - DNA, 25 bp, Homo sapien
agtaggctgatatcggaggagtcat

SEQ ID NO: 253773 - DNA, 25 bp, Homo sapien
ttatttaatacccattggaaccctg

SEQ ID NO: 253774 - DNA, 25 bp, Homo sapien
gtcaaagtctgaatatccgcctcaa

SEQ ID NO: 253775 - DNA, 25 bp, Homo sapien
ctgaatatccgcctcaagtaagcac

SEQ ID NO: 253776 - DNA, 25 bp, Homo sapien
caaagtagggtgtttaccactatat

SEQ ID NO: 253777 - DNA, 25 bp, Homo sapien
taccactatataacaggctgagcaa

SEQ ID NO: 253778 - DNA, 25 bp, Homo sapien
aacaggctgagcaaattaccaagac

SEQ ID NO: 253779 - DNA, 25 bp, Homo sapien
acacagctacttgacacctgtcgag

SEQ ID NO: 253780 - DNA, 25 bp, Homo sapien
gacacctgtcgagtttgtcggtttt

SEQ ID NO: 253781 - DNA, 25 bp, Homo sapien
gaactaggcccttggatgaagtgaa

SEQ ID NO: 253782 - DNA, 25 bp, Homo sapien
gaagtgaaccagtttccagccaatg

SEQ ID NO: 253783 - DNA, 25 bp, Homo sapien
gaaccagtttccagccaatgcaatg

SEQ ID NO: 253784 - DNA, 25 bp, Homo sapien
cagccaatgcaatgaagccgggttg

SEQ ID NO: 253785 - DNA, 25 bp, Homo sapien
cagagattaggttgtggccagagct

SEQ ID NO: 253786 - DNA, 25 bp, Homo sapien
gagtgattccttaagcttgttttaa

SEQ ID NO: 253787 - DNA, 25 bp, Homo sapien
gcttgttttaaaatctgctccagcc

SEQ ID NO: 253788 - DNA, 25 bp, Homo sapien
tttaaaatctgctccagcctaaaga

SEQ ID NO: 253789 - DNA, 25 bp, Homo sapien
atctgctccagcctaaagagttaag

SEQ ID NO: 253790 - DNA, 25 bp, Homo sapien
agggaaaacccttggctctgagtct

SEQ ID NO: 253791 - DNA, 25 bp, Homo sapien
aaaacccttggctctgagtcttgtt

SEQ ID NO: 253792 - DNA, 25 bp, Homo sapien
ttcccaggcaggattaaggcccgtg

SEQ ID NO: 253793 - DNA, 25 bp, Homo sapien
ggattaaggcccgtggtcagtgccc

SEQ ID NO: 253794 - DNA, 25 bp, Homo sapien
tggtcagtgcccctgctttgctgct

SEQ ID NO: 253795 - DNA, 25 bp, Homo sapien
tccttgtgctgaatgttgctcacag

SEQ ID NO: 253796 - DNA, 25 bp, Homo sapien
gaatgttgctcacagcttttgctgt

SEQ ID NO: 253797 - DNA, 25 bp, Homo sapien
gttttgaaaaatgtaactccagcaa

SEQ ID NO: 253798 - DNA, 25 bp, Homo sapien
gtaactccagcaagaatgcgttttt

SEQ ID NO: 253799 - DNA, 25 bp, Homo sapien
gcaagaatgcgttttttgaaatcag

SEQ ID NO: 253800 - DNA, 25 bp, Homo sapien
tgcttttaatagtccctttcagatt

SEQ ID NO: 253801 - DNA, 25 bp, Homo sapien
ttaatagtccctttcagattcttaa

SEQ ID NO: 253802 - DNA, 25 bp, Homo sapien
gacaggactagtaaggcccctttct

SEQ ID NO: 253803 - DNA, 25 bp, Homo sapien
ggtgctggtgcatcacataaatcac

SEQ ID NO: 253804 - DNA, 25 bp, Homo sapien
aaacaagcctgtttcctactcaagg

SEQ ID NO: 253805 - DNA, 25 bp, Homo sapien
gtttcctactcaaggtgtgtctgta

SEQ ID NO: 253806 - DNA, 25 bp, Homo sapien
tgtgtctgtagagtcctgactgcgt

SEQ ID NO: 253807 - DNA, 25 bp, Homo sapien
tctgtctggcacatttctgaacttt

SEQ ID NO: 253808 - DNA, 25 bp, Homo sapien
aagagaacaccatcaaacgcgtccg

SEQ ID NO: 253809 - DNA, 25 bp, Homo sapien
gcgtccggcatacagcgtaaacatc

SEQ ID NO: 253810 - DNA, 25 bp, Homo sapien
agaccgtgattctgcgccatcaaac

SEQ ID NO: 253811 - DNA, 25 bp, Homo sapien
aacgctctccagctaatttcatttg

SEQ ID NO: 253812 - DNA, 25 bp, Homo sapien
tcatttggtgattactctgctagaa

SEQ ID NO: 253813 - DNA, 25 bp, Homo sapien
aaaaaacacgttggccttggtgctg

SEQ ID NO: 253814 - DNA, 25 bp, Homo sapien
tgctctttagcccagatacacatac

SEQ ID NO: 253815 - DNA, 25 bp, Homo sapien
tttgtctttgtgcaataatcagtgt

SEQ ID NO: 253816 - DNA, 25 bp, Homo sapien
taatcagtgttcctggcagagcctg

SEQ ID NO: 253817 - DNA, 25 bp, Homo sapien
caagctgcagcctactgaggaggca

SEQ ID NO: 253818 - DNA, 25 bp, Homo sapien
tagcactctcagtcgctgtacagtt

SEQ ID NO: 253819 - DNA, 25 bp, Homo sapien
gtcgctgtacagtttctatggtgtg

SEQ ID NO: 253820 - DNA, 25 bp, Homo sapien
atggtgtgaatgaacttccctccta

SEQ ID NO: 253821 - DNA, 25 bp, Homo sapien
atgaacttccctcctagttgctgat

SEQ ID NO: 253822 - DNA, 25 bp, Homo sapien
ctagttgctgatggcgctggtacct

SEQ ID NO: 253823 - DNA, 25 bp, Homo sapien
ccatggcccgggtgtagagaaacca

SEQ ID NO: 253824 - DNA, 25 bp, Homo sapien
tagagaaaccaagcggcagccacca

SEQ ID NO: 253825 - DNA, 25 bp, Homo sapien
aatatgtttagagatgccgccagaa

SEQ ID NO: 253826 - DNA, 25 bp, Homo sapien
atgtttagagatgccgccagaacat

SEQ ID NO: 253827 - DNA, 25 bp, Homo sapien
agatagcatgttctccatttgcagt

SEQ ID NO: 253828 - DNA, 25 bp, Homo sapien
catgttctccatttgcagtctacaa

SEQ ID NO: 253829 - DNA, 25 bp, Homo sapien
gttctccatttgcagtctacaaagg

SEQ ID NO: 253830 - DNA, 25 bp, Homo sapien
cctgtgcaagagacttttatatcta

SEQ ID NO: 253831 - DNA, 25 bp, Homo sapien
ggatgtacgtttttcatattttaga

SEQ ID NO: 253832 - DNA, 25 bp, Homo sapien
gtttttcatattttagagttcattg

SEQ ID NO: 253833 - DNA, 25 bp, Homo sapien
tggaaaaataccatcaaagttgacc

SEQ ID NO: 253834 - DNA, 25 bp, Homo sapien
gaaaatccttaccagttgtttgtca

SEQ ID NO: 253835 - DNA, 25 bp, Homo sapien
aatccttaccagttgtttgtcatat

SEQ ID NO: 253836 - DNA, 25 bp, Homo sapien
attgcatctgaacaacaagttgtat

SEQ ID NO: 253837 - DNA, 25 bp, Homo sapien
aactgagaaagcaaggctagtctga

SEQ ID NO: 253838 - DNA, 25 bp, Homo sapien
aagcaaggctagtctgaggaaaatt

SEQ ID NO: 253839 - DNA, 25 bp, Homo sapien
gaggaaaatttataccgctcacatt

SEQ ID NO: 253840 - DNA, 25 bp, Homo sapien
aaatttataccgctcacatttccct

SEQ ID NO: 253841 - DNA, 25 bp, Homo sapien
tataccgctcacatttcccttctga

SEQ ID NO: 253842 - DNA, 25 bp, Homo sapien
tttcccttctgaattggagaataga

SEQ ID NO: 253843 - DNA, 25 bp, Homo sapien
aattgtaacctacctttcaaagatg

SEQ ID NO: 253844 - DNA, 25 bp, Homo sapien
gtaacctacctttcaaagatgcatt

SEQ ID NO: 253845 - DNA, 25 bp, Homo sapien
ttcttatttttctattgccctattt

SEQ ID NO: 253846 - DNA, 25 bp, Homo sapien
taaatgtatatgtctctgtttatat

SEQ ID NO: 253847 - DNA, 25 bp, Homo sapien
gtattttttgtgtgcaaagtcttag

SEQ ID NO: 253848 - DNA, 25 bp, Homo sapien
ttttgtgtgcaaagtcttagaattg

SEQ ID NO: 253849 - DNA, 25 bp, Homo sapien
gtgtgcaaagtcttagaattggatt

SEQ ID NO: 253850 - DNA, 25 bp, Homo sapien
gtgcaaagtcttagaattggattta

SEQ ID NO: 253851 - DNA, 25 bp, Homo sapien
gtcttagaattggatttataacatt

SEQ ID NO: 253852 - DNA, 25 bp, Homo sapien
gaatatgatcatttctccatcataa

SEQ ID NO: 253853 - DNA, 25 bp, Homo sapien
atgatcatttctccatcataaagga

SEQ ID NO: 253854 - DNA, 25 bp, Homo sapien
gatcatttctccatcataaaggaaa

SEQ ID NO: 253855 - DNA, 25 bp, Homo sapien
atcatttctccatcataaaggaaag

SEQ ID NO: 253856 - DNA, 25 bp, Homo sapien
atttctccatcataaaggaaagaag

SEQ ID NO: 253857 - DNA, 25 bp, Homo sapien
aagaagagacttcattgtgtgtgtg

SEQ ID NO: 253858 - DNA, 25 bp, Homo sapien
cagaaaagggcaagctcatggccca

SEQ ID NO: 253859 - DNA, 25 bp, Homo sapien
ttcctaacaacattcgccacaagtt

SEQ ID NO: 253860 - DNA, 25 bp, Homo sapien
cctccgtcttctcagactactatga

SEQ ID NO: 253861 - DNA, 25 bp, Homo sapien
agactactatgacctcggctacaac

SEQ ID NO: 253862 - DNA, 25 bp, Homo sapien
tcggctacaacatgcggtcaaactt

SEQ ID NO: 253863 - DNA, 25 bp, Homo sapien
catgcggtcaaacttgtttcgaggg

SEQ ID NO: 253864 - DNA, 25 bp, Homo sapien
gacaaagagcctcatgaaggcttct

SEQ ID NO: 253865 - DNA, 25 bp, Homo sapien
gaaggcttcttacacaccagaggtc

SEQ ID NO: 253866 - DNA, 25 bp, Homo sapien
cacaccagaggtcattgagaaatca

SEQ ID NO: 253867 - DNA, 25 bp, Homo sapien
gtgagggacttagaacactggcatg

SEQ ID NO: 253868 - DNA, 25 bp, Homo sapien
tgatgaagtcttcgagggccagaaa

SEQ ID NO: 253869 - DNA, 25 bp, Homo sapien
tatcaagtaccatgttttccaacca

SEQ ID NO: 253870 - DNA, 25 bp, Homo sapien
tttccaaccaaccagttattcgtgg

SEQ ID NO: 253871 - DNA, 25 bp, Homo sapien
atgttactgtaatcctgctccatta

SEQ ID NO: 253872 - DNA, 25 bp, Homo sapien
ctgtaatcctgctccattaaatgca

SEQ ID NO: 253873 - DNA, 25 bp, Homo sapien
tgcagcattgttgtcaggtgctgcc

SEQ ID NO: 253874 - DNA, 25 bp, Homo sapien
tcttgcttgggaacagcattgggct

SEQ ID NO: 253875 - DNA, 25 bp, Homo sapien
agcattgggcttttaaatgtctgca

SEQ ID NO: 253876 - DNA, 25 bp, Homo sapien
atgtctgcagaatctctgcgttcga

SEQ ID NO: 253877 - DNA, 25 bp, Homo sapien
gaatctctgcgttcgaagggaattg

SEQ ID NO: 253878 - DNA, 25 bp, Homo sapien
gagaatgaacttcctggtactgtaa

SEQ ID NO: 253879 - DNA, 25 bp, Homo sapien
aacttcctggtactgtaatgaaaat

SEQ ID NO: 253880 - DNA, 25 bp, Homo sapien
gagccaccctgattaagttcttgtt

SEQ ID NO: 253881 - DNA, 25 bp, Homo sapien
ggtgcaccagacatttacataggct

SEQ ID NO: 253882 - DNA, 25 bp, Homo sapien
aatcaatgttgatggcagccgtgtt

SEQ ID NO: 253883 - DNA, 25 bp, Homo sapien
gatggcagccgtgtttttaatccat

SEQ ID NO: 253884 - DNA, 25 bp, Homo sapien
taatccatgggcctaaaacagtgtc

SEQ ID NO: 253885 - DNA, 25 bp, Homo sapien
aaaacagtgtccctcatacctgtct

SEQ ID NO: 253886 - DNA, 25 bp, Homo sapien
tcatacctgtctcttgctgaggccc

SEQ ID NO: 253887 - DNA, 25 bp, Homo sapien
tgtcgcaggtgagccatgtctgact

SEQ ID NO: 253888 - DNA, 25 bp, Homo sapien
tcagtccacgtcttcagccctattt

SEQ ID NO: 253889 - DNA, 25 bp, Homo sapien
atttcccaagcttacctagtgagtc

SEQ ID NO: 253890 - DNA, 25 bp, Homo sapien
agcttacctagtgagtcctccttga

SEQ ID NO: 253891 - DNA, 25 bp, Homo sapien
acctgtgatacagtttcagaaaacc

SEQ ID NO: 253892 - DNA, 25 bp, Homo sapien
attcatattaacatggccactgtca

SEQ ID NO: 253893 - DNA, 25 bp, Homo sapien
atggccactgtcacatgtgctgaaa

SEQ ID NO: 253894 - DNA, 25 bp, Homo sapien
gctgaaaattggttgagagaccgta

SEQ ID NO: 253895 - DNA, 25 bp, Homo sapien
taaaatgaactgttattctgcaaaa

SEQ ID NO: 253896 - DNA, 25 bp, Homo sapien
tccaaaattgaagactgaaccacag

SEQ ID NO: 253897 - DNA, 25 bp, Homo sapien
gaaccacagcagtcaaacttatcaa

SEQ ID NO: 253898 - DNA, 25 bp, Homo sapien
agcagtcaaacttatcaaccttttg

SEQ ID NO: 253899 - DNA, 25 bp, Homo sapien
atcaaccttttgatcaaaaccggtg

SEQ ID NO: 253900 - DNA, 25 bp, Homo sapien
tgatcaaaaccggtgactaaaagga

SEQ ID NO: 253901 - DNA, 25 bp, Homo sapien
aggaatatgaaacctgtgatacagt

SEQ ID NO: 253902 - DNA, 25 bp, Homo sapien
gactagtgtctgaagaactttacaa

SEQ ID NO: 253903 - DNA, 25 bp, Homo sapien
tacaaacaatacttgaaccctttct

SEQ ID NO: 253904 - DNA, 25 bp, Homo sapien
ctttctttaaagttatcccatcatg

SEQ ID NO: 253905 - DNA, 25 bp, Homo sapien
gttatcccatcatgttttatagtca

SEQ ID NO: 253906 - DNA, 25 bp, Homo sapien
tagtcattgttgcttccattgttag

SEQ ID NO: 253907 - DNA, 25 bp, Homo sapien
agtttccattttcaagtgctttgta

SEQ ID NO: 253908 - DNA, 25 bp, Homo sapien
taagtgcactacctgaaattttgtt

SEQ ID NO: 253909 - DNA, 25 bp, Homo sapien
attcattcgtatcttgttggctgcc

SEQ ID NO: 253910 - DNA, 25 bp, Homo sapien
ttcgtatcttgttggctgcctatga

SEQ ID NO: 253911 - DNA, 25 bp, Homo sapien
ggagattcagtagtcattgtatgca

SEQ ID NO: 253912 - DNA, 25 bp, Homo sapien
gtcattgtatgcatctttaagtcaa

SEQ ID NO: 253913 - DNA, 25 bp, Homo sapien
agccagggcaagctcagggtggaga

SEQ ID NO: 253914 - DNA, 25 bp, Homo sapien
gtacagatgtgtggcttggtgctta

SEQ ID NO: 253915 - DNA, 25 bp, Homo sapien
tggcttggtgcttaaggccaccagt

SEQ ID NO: 253916 - DNA, 25 bp, Homo sapien
gtgcttaaggccaccagtggtcagc

SEQ ID NO: 253917 - DNA, 25 bp, Homo sapien
ggccaccagtggtcagcctggtgaa

SEQ ID NO: 253918 - DNA, 25 bp, Homo sapien
cagcctttcttacctcattggccat

SEQ ID NO: 253919 - DNA, 25 bp, Homo sapien
tttcttacctcattggccatcccta

SEQ ID NO: 253920 - DNA, 25 bp, Homo sapien
ggattttgatgagtgaagcgtatga

SEQ ID NO: 253921 - DNA, 25 bp, Homo sapien
aagcgtatgatgatcttgtccacac

SEQ ID NO: 253922 - DNA, 25 bp, Homo sapien
gatgatcttgtccacactgaaacag

SEQ ID NO: 253923 - DNA, 25 bp, Homo sapien
agtcctacaggctcagatgcaggct

SEQ ID NO: 253924 - DNA, 25 bp, Homo sapien
ttttctcttgccactaataaggaaa

SEQ ID NO: 253925 - DNA, 25 bp, Homo sapien
actatatccatctgccctcaacggg

SEQ ID NO: 253926 - DNA, 25 bp, Homo sapien
ttttgtgattgtactgtgcacagtc

SEQ ID NO: 253927 - DNA, 25 bp, Homo sapien
tactgtgcacagtcatactataaaa

SEQ ID NO: 253928 - DNA, 25 bp, Homo sapien
taaaagccctaaagttgcccagact

SEQ ID NO: 253929 - DNA, 25 bp, Homo sapien
ccagactttcctatctacttttctt

SEQ ID NO: 253930 - DNA, 25 bp, Homo sapien
gtttaattttggatgacctagtcag

SEQ ID NO: 253931 - DNA, 25 bp, Homo sapien
gacctagtcagagtagtgcccagtt

SEQ ID NO: 253932 - DNA, 25 bp, Homo sapien
cagagtagtgcccagtttctctact

SEQ ID NO: 253933 - DNA, 25 bp, Homo sapien
ttctctactgtgtgggttatcagtt

SEQ ID NO: 253934 - DNA, 25 bp, Homo sapien
gggttatcagtttttctcttgccac

SEQ ID NO: 253935 - DNA, 25 bp, Homo sapien
gctggactcaggcacgtttacagtg

SEQ ID NO: 253936 - DNA, 25 bp, Homo sapien
gactcaggcacgtttacagtgatgt

SEQ ID NO: 253937 - DNA, 25 bp, Homo sapien
acagtgatgtgtatgcagggtatgc

SEQ ID NO: 253938 - DNA, 25 bp, Homo sapien
tggtttcctggaagggcattttcca

SEQ ID NO: 253939 - DNA, 25 bp, Homo sapien
gaagggcattttccacattgtgcgt

SEQ ID NO: 253940 - DNA, 25 bp, Homo sapien
gggcattttccacattgtgcgttat

SEQ ID NO: 253941 - DNA, 25 bp, Homo sapien
cattgtgcgttatggatgatcatcc

SEQ ID NO: 253942 - DNA, 25 bp, Homo sapien
tatggatgatcatcccaggcatcag

SEQ ID NO: 253943 - DNA, 25 bp, Homo sapien
atcccaggcatcaggtgtgaagccc

SEQ ID NO: 253944 - DNA, 25 bp, Homo sapien
ggcatcaggtgtgaagccctgcatc

SEQ ID NO: 253945 - DNA, 25 bp, Homo sapien
atccaggggctatcaaatctctctg

SEQ ID NO: 253946 - DNA, 25 bp, Homo sapien
ggaccagaaacctgggagagacttg

SEQ ID NO: 253947 - DNA, 25 bp, Homo sapien
atgaggagtggttgggctgtgcctg

SEQ ID NO: 253948 - DNA, 25 bp, Homo sapien
tgtgcctgggcctagcacggacatg

SEQ ID NO: 253949 - DNA, 25 bp, Homo sapien
gggcctagcacggacatggtctgtc

SEQ ID NO: 253950 - DNA, 25 bp, Homo sapien
agcacggacatggtctgtcctgaca

SEQ ID NO: 253951 - DNA, 25 bp, Homo sapien
gacatggtctgtcctgacagcactc

SEQ ID NO: 253952 - DNA, 25 bp, Homo sapien
ggcatggctggtgcctgaagacccc

SEQ ID NO: 253953 - DNA, 25 bp, Homo sapien
ttttctttgagagttcgtgaagagg

SEQ ID NO: 253954 - DNA, 25 bp, Homo sapien
accagccactggaggggtcatcctt

SEQ ID NO: 253955 - DNA, 25 bp, Homo sapien
tcatccttgcccatcgggaccagaa

SEQ ID NO: 253956 - DNA, 25 bp, Homo sapien
ttgcccatcgggaccagaaacctgg

SEQ ID NO: 253957 - DNA, 25 bp, Homo sapien
atgttctatgaacccaatctctgcc

SEQ ID NO: 253958 - DNA, 25 bp, Homo sapien
gaacccaatctctgccacatgtcaa

SEQ ID NO: 253959 - DNA, 25 bp, Homo sapien
acatgtcaatacctgctcttcaaag

SEQ ID NO: 253960 - DNA, 25 bp, Homo sapien
tcaaagccccttttgaaactcagtt

SEQ ID NO: 253961 - DNA, 25 bp, Homo sapien
tttgtgccaagtcctctggatctaa

SEQ ID NO: 253962 - DNA, 25 bp, Homo sapien
ggatctaattaccttaaacaagcag

SEQ ID NO: 253963 - DNA, 25 bp, Homo sapien
taaacagacattcccagtcatcctg

SEQ ID NO: 253964 - DNA, 25 bp, Homo sapien
agtcatcctggtgcttgtacttctc

SEQ ID NO: 253965 - DNA, 25 bp, Homo sapien
cttgtacttctcctacatgtcatga

SEQ ID NO: 253966 - DNA, 25 bp, Homo sapien
aaggaccttggatttactgagaact

SEQ ID NO: 253967 - DNA, 25 bp, Homo sapien
atccagagcctcagttctgtacttg

SEQ ID NO: 253968 - DNA, 25 bp, Homo sapien
aagccgtggaaacacacccggattg

SEQ ID NO: 253969 - DNA, 25 bp, Homo sapien
aacacacccggattgaaatgcccct

SEQ ID NO: 253970 - DNA, 25 bp, Homo sapien
acacccggattgaaatgcccctggc

SEQ ID NO: 253971 - DNA, 25 bp, Homo sapien
cctgacccgaccctaggagaagcag

SEQ ID NO: 253972 - DNA, 25 bp, Homo sapien
ggagaagcagccgagttacccgaca

SEQ ID NO: 253973 - DNA, 25 bp, Homo sapien
gagttacccgacatcgtggtcagca

SEQ ID NO: 253974 - DNA, 25 bp, Homo sapien
tacccgacatcgtggtcagcaggag

SEQ ID NO: 253975 - DNA, 25 bp, Homo sapien
agctgggtcggtggctggatgctgc

SEQ ID NO: 253976 - DNA, 25 bp, Homo sapien
tgcagcagcagggactcagcgcctg

SEQ ID NO: 253977 - DNA, 25 bp, Homo sapien
ttttaaaatttcacaaagcatccgg

SEQ ID NO: 253978 - DNA, 25 bp, Homo sapien
gaggccgcccttcggaaaagccgtg

SEQ ID NO: 253979 - DNA, 25 bp, Homo sapien
gacagcagagcctttccagctgtac

SEQ ID NO: 253980 - DNA, 25 bp, Homo sapien
agcagagcctttccagctgtacata

SEQ ID NO: 253981 - DNA, 25 bp, Homo sapien
gcagagcctttccagctgtacataa

SEQ ID NO: 253982 - DNA, 25 bp, Homo sapien
agagcctttccagctgtacataacc

SEQ ID NO: 253983 - DNA, 25 bp, Homo sapien
gagcctttccagctgtacataacca

SEQ ID NO: 253984 - DNA, 25 bp, Homo sapien
agcctttccagctgtacataaccac

SEQ ID NO: 253985 - DNA, 25 bp, Homo sapien
taataggaaacggaagagacttggt

SEQ ID NO: 253986 - DNA, 25 bp, Homo sapien
gaaacggaagagacttggtagacga

SEQ ID NO: 253987 - DNA, 25 bp, Homo sapien
ggaagagacttggtagacgagataa

SEQ ID NO: 253988 - DNA, 25 bp, Homo sapien
acttggtagacgagataaggaggac

SEQ ID NO: 253989 - DNA, 25 bp, Homo sapien
agacgagataaggaggacaagagaa

SEQ ID NO: 253990 - DNA, 25 bp, Homo sapien
tgtgtcccctcgtccaggattcaga

SEQ ID NO: 253991 - DNA, 25 bp, Homo sapien
gtccaggattcagactcttactgta

SEQ ID NO: 253992 - DNA, 25 bp, Homo sapien
ggattcagactcttactgtaggaga

SEQ ID NO: 253993 - DNA, 25 bp, Homo sapien
gactcttactgtaggagagaccaag

SEQ ID NO: 253994 - DNA, 25 bp, Homo sapien
cctgggctccagatgagtagaacgt

SEQ ID NO: 253995 - DNA, 25 bp, Homo sapien
gatgagtagaacgtgggccacgcca

SEQ ID NO: 253996 - DNA, 25 bp, Homo sapien
cagtgggcaccaggaagagttgtct

SEQ ID NO: 253997 - DNA, 25 bp, Homo sapien
gaagagttgtctgcaggaggccagc

SEQ ID NO: 253998 - DNA, 25 bp, Homo sapien
aggaggccagcagcccgaaggcagg

SEQ ID NO: 253999 - DNA, 25 bp, Homo sapien
gcccaggtgtgtacagccagtggct

SEQ ID NO: 254000 - DNA, 25 bp, Homo sapien
agcagggtccggaagtcccatgtgt

SEQ ID NO: 254001 - DNA, 25 bp, Homo sapien
aggaccaggtccgtgtggatgctcc

SEQ ID NO: 254002 - DNA, 25 bp, Homo sapien
aggtccgtgtggatgctcctagtgc

SEQ ID NO: 254003 - DNA, 25 bp, Homo sapien
tgtggatgctcctagtgcgttcaaa

SEQ ID NO: 254004 - DNA, 25 bp, Homo sapien
ggatgctcctagtgcgttcaaataa

SEQ ID NO: 254005 - DNA, 25 bp, Homo sapien
ctcagctcacccatggaactagaaa

SEQ ID NO: 254006 - DNA, 25 bp, Homo sapien
gctcacccatggaactagaaattca

SEQ ID NO: 254007 - DNA, 25 bp, Homo sapien
tcacaaacctgaagctgaaccacag

SEQ ID NO: 254008 - DNA, 25 bp, Homo sapien
tgaaccacaggacaagaaattaaac

SEQ ID NO: 254009 - DNA, 25 bp, Homo sapien
cttttttcacaggttttgcattgaa

SEQ ID NO: 254010 - DNA, 25 bp, Homo sapien
caggttttgcattgaatgttttaga

SEQ ID NO: 254011 - DNA, 25 bp, Homo sapien
tcacccatgtataccaaaactggtt

SEQ ID NO: 254012 - DNA, 25 bp, Homo sapien
catgggactgtctagaggttccatt

SEQ ID NO: 254013 - DNA, 25 bp, Homo sapien
agaggttccatttcccaatagggtg

SEQ ID NO: 254014 - DNA, 25 bp, Homo sapien
ggttgcctttccttgtcttaattag

SEQ ID NO: 254015 - DNA, 25 bp, Homo sapien
taattaggcctaactgttccagagc

SEQ ID NO: 254016 - DNA, 25 bp, Homo sapien
gcctgtgtactatcaatgccacttg

SEQ ID NO: 254017 - DNA, 25 bp, Homo sapien
gaacccaagcattcactttaatact

SEQ ID NO: 254018 - DNA, 25 bp, Homo sapien
tctgccctggttaatttagccctaa

SEQ ID NO: 254019 - DNA, 25 bp, Homo sapien
aatacttactgagcatctcccatgt

SEQ ID NO: 254020 - DNA, 25 bp, Homo sapien
tagccctaactctcatctgctggag

SEQ ID NO: 254021 - DNA, 25 bp, Homo sapien
tggagagtcagctcccaaactgttc

SEQ ID NO: 254022 - DNA, 25 bp, Homo sapien
aactgttctttcttgtaggcagagg

SEQ ID NO: 254023 - DNA, 25 bp, Homo sapien
taggtattttttgccaagataacaa

SEQ ID NO: 254024 - DNA, 25 bp, Homo sapien
ccttatctgttttggacaagtccaa

SEQ ID NO: 254025 - DNA, 25 bp, Homo sapien
aggaatggttaagaattatcagcac

SEQ ID NO: 254026 - DNA, 25 bp, Homo sapien
agaattatcagcaccttaattggtg

SEQ ID NO: 254027 - DNA, 25 bp, Homo sapien
gaattatcagcaccttaattggtgg

SEQ ID NO: 254028 - DNA, 25 bp, Homo sapien
aattatcagcaccttaattggtggt

SEQ ID NO: 254029 - DNA, 25 bp, Homo sapien
ttatcagcaccttaattggtggtaa

SEQ ID NO: 254030 - DNA, 25 bp, Homo sapien
atcagcaccttaattggtggtaaga

SEQ ID NO: 254031 - DNA, 25 bp, Homo sapien
agcaccttaattggtggtaagagct

SEQ ID NO: 254032 - DNA, 25 bp, Homo sapien
gcaccttaattggtggtaagagcta

SEQ ID NO: 254033 - DNA, 25 bp, Homo sapien
caccttaattggtggtaagagctag

SEQ ID NO: 254034 - DNA, 25 bp, Homo sapien
ggtgaataagctggctgtccttcct

SEQ ID NO: 254035 - DNA, 25 bp, Homo sapien
tccgtagcctgacactccatgggaa

SEQ ID NO: 254036 - DNA, 25 bp, Homo sapien
tataggcaatatgtgctgtgcaccc

SEQ ID NO: 254037 - DNA, 25 bp, Homo sapien
gtatcaccacgttcgacttcagtgg

SEQ ID NO: 254038 - DNA, 25 bp, Homo sapien
ccacagctgaagtctggaaacgcat

SEQ ID NO: 254039 - DNA, 25 bp, Homo sapien
gaaacgcatgaacatcaagcccaag

SEQ ID NO: 254040 - DNA, 25 bp, Homo sapien
caagaaggcctggaccaagcagaat

SEQ ID NO: 254041 - DNA, 25 bp, Homo sapien
gcagaatacactttgaggctcccac

SEQ ID NO: 254042 - DNA, 25 bp, Homo sapien
ttgaggctcccacgaccctagtagt

SEQ ID NO: 254043 - DNA, 25 bp, Homo sapien
ctagtagtcctaaaggcctaagcat

SEQ ID NO: 254044 - DNA, 25 bp, Homo sapien
ggcctaagcatagacagcatggttt

SEQ ID NO: 254045 - DNA, 25 bp, Homo sapien
ttggaaatcgtgtcagttgtaccct

SEQ ID NO: 254046 - DNA, 25 bp, Homo sapien
tcgtgtcagttgtaccctgaccata

SEQ ID NO: 254047 - DNA, 25 bp, Homo sapien
agttgtaccctgaccataaaatatg

SEQ ID NO: 254048 - DNA, 25 bp, Homo sapien
ttcacatggcatttccaataatctg

SEQ ID NO: 254049 - DNA, 25 bp, Homo sapien
ggcatttccaataatctggattgaa

SEQ ID NO: 254050 - DNA, 25 bp, Homo sapien
tagataaattaataggccacgttca

SEQ ID NO: 254051 - DNA, 25 bp, Homo sapien
gttattagtgcaaatttcctagaga

SEQ ID NO: 254052 - DNA, 25 bp, Homo sapien
accatttctctttcaaattttccag

SEQ ID NO: 254053 - DNA, 25 bp, Homo sapien
ttgaattttatgttcgcttttgctt

SEQ ID NO: 254054 - DNA, 25 bp, Homo sapien
ttcgcttttgcttcttaggttctat

SEQ ID NO: 254055 - DNA, 25 bp, Homo sapien
tgcttcttaggttctatcacttaat

SEQ ID NO: 254056 - DNA, 25 bp, Homo sapien
ccattgacagctctgcggaacagaa

SEQ ID NO: 254057 - DNA, 25 bp, Homo sapien
gaacagaaacttggtccacccaact

SEQ ID NO: 254058 - DNA, 25 bp, Homo sapien
tcagttaacctcaccaaggtttcag

SEQ ID NO: 254059 - DNA, 25 bp, Homo sapien
caaggtttcagtgtggctatgtgtt

SEQ ID NO: 254060 - DNA, 25 bp, Homo sapien
tgtggctatgtgttattgcacctgt

SEQ ID NO: 254061 - DNA, 25 bp, Homo sapien
ctgttcaatcggatgaggccccatg

SEQ ID NO: 254062 - DNA, 25 bp, Homo sapien
gaggccccatgaagacttatcagaa

SEQ ID NO: 254063 - DNA, 25 bp, Homo sapien
gatgagagtgacttcagtgtgacaa

SEQ ID NO: 254064 - DNA, 25 bp, Homo sapien
tgatgcagtgtggaccaccctgcac

SEQ ID NO: 254065 - DNA, 25 bp, Homo sapien
accaccctgcacattttgcaatgta

SEQ ID NO: 254066 - DNA, 25 bp, Homo sapien
atggcaaaaccatagcacttctaaa

SEQ ID NO: 254067 - DNA, 25 bp, Homo sapien
gagtcaaggccagactagatcagcc

SEQ ID NO: 254068 - DNA, 25 bp, Homo sapien
gtcaaggccagactagatcagccta

SEQ ID NO: 254069 - DNA, 25 bp, Homo sapien
caaggccagactagatcagcctaag

SEQ ID NO: 254070 - DNA, 25 bp, Homo sapien
ccagactagatcagcctaagcccag

SEQ ID NO: 254071 - DNA, 25 bp, Homo sapien
aaaggggcgtgtcatgtgcctcatc

SEQ ID NO: 254072 - DNA, 25 bp, Homo sapien
tcagttggtaaatgattattgacaa

SEQ ID NO: 254073 - DNA, 25 bp, Homo sapien
atttgagtagatttggcctctattc

SEQ ID NO: 254074 - DNA, 25 bp, Homo sapien
ttggcctctattctcatggagcttc

SEQ ID NO: 254075 - DNA, 25 bp, Homo sapien
gcctctattctcatggagcttcctt

SEQ ID NO: 254076 - DNA, 25 bp, Homo sapien
ctattctcatggagcttcctttcta

SEQ ID NO: 254077 - DNA, 25 bp, Homo sapien
attctcatggagcttcctttctaga

SEQ ID NO: 254078 - DNA, 25 bp, Homo sapien
gggaacgcaatattccacgagtaat

SEQ ID NO: 254079 - DNA, 25 bp, Homo sapien
atattccacgagtaatgagccctga

SEQ ID NO: 254080 - DNA, 25 bp, Homo sapien
gtaatgagccctgaaaactttccta

SEQ ID NO: 254081 - DNA, 25 bp, Homo sapien
tgagccctgaaaactttcctactgc

SEQ ID NO: 254082 - DNA, 25 bp, Homo sapien
gaaaactttcctactgcttcagttg

SEQ ID NO: 254083 - DNA, 25 bp, Homo sapien
ctttcctactgcttcagttgaagga

SEQ ID NO: 254084 - DNA, 25 bp, Homo sapien
gaaatccaagccaaaggacaaagac

SEQ ID NO: 254085 - DNA, 25 bp, Homo sapien
ggcaaactcattattacattgggta

SEQ ID NO: 254086 - DNA, 25 bp, Homo sapien
aatatctgatgcagaacagatgcca

SEQ ID NO: 254087 - DNA, 25 bp, Homo sapien
gaacagatgccacagcatacattaa

SEQ ID NO: 254088 - DNA, 25 bp, Homo sapien
gccacagcatacattaaaagatcaa

SEQ ID NO: 254089 - DNA, 25 bp, Homo sapien
ctgcagagactgacccaggtcgtgg

SEQ ID NO: 254090 - DNA, 25 bp, Homo sapien
agagactgacccaggtcgtggaaca

SEQ ID NO: 254091 - DNA, 25 bp, Homo sapien
ctgacccaggtcgtggaacaggagc

SEQ ID NO: 254092 - DNA, 25 bp, Homo sapien
aggagcggcaggagcgccaagccct

SEQ ID NO: 254093 - DNA, 25 bp, Homo sapien
agagatggcctggaccaccagcatg

SEQ ID NO: 254094 - DNA, 25 bp, Homo sapien
atggcctggaccaccagcatgcctg

SEQ ID NO: 254095 - DNA, 25 bp, Homo sapien
ccatggtccatgtgtggccccaaca

SEQ ID NO: 254096 - DNA, 25 bp, Homo sapien
tggccccaacaccacctgtaagggt

SEQ ID NO: 254097 - DNA, 25 bp, Homo sapien
acaccacctgtaagggtcatggctt

SEQ ID NO: 254098 - DNA, 25 bp, Homo sapien
aagggtcatggcttgtgagccacct

SEQ ID NO: 254099 - DNA, 25 bp, Homo sapien
ggtcatggcttgtgagccacctgcc

SEQ ID NO: 254100 - DNA, 25 bp, Homo sapien
aactacagcaatgttgcttctgcct

SEQ ID NO: 254101 - DNA, 25 bp, Homo sapien
ttctgcctgggtctgcgctccacga

SEQ ID NO: 254102 - DNA, 25 bp, Homo sapien
acaaaattgctcctacctggtttgg

SEQ ID NO: 254103 - DNA, 25 bp, Homo sapien
aaattgctcctacctggtttggcag

SEQ ID NO: 254104 - DNA, 25 bp, Homo sapien
gcttcctggacttccagctcaatga

SEQ ID NO: 254105 - DNA, 25 bp, Homo sapien
attgctcctacctggtttggcagct

SEQ ID NO: 254106 - DNA, 25 bp, Homo sapien
tcctacctggtttggcagctccacg

SEQ ID NO: 254107 - DNA, 25 bp, Homo sapien
aacaccctcagatctgagcagcggc

SEQ ID NO: 254108 - DNA, 25 bp, Homo sapien
gctcctttctgggtcttctgtttca

SEQ ID NO: 254109 - DNA, 25 bp, Homo sapien
ctgggtcttctgtttcacgatcctt

SEQ ID NO: 254110 - DNA, 25 bp, Homo sapien
gaccctcgaactacagcaatgttgc

SEQ ID NO: 254111 - DNA, 25 bp, Homo sapien
gagtattatccaccagtggcagata

SEQ ID NO: 254112 - DNA, 25 bp, Homo sapien
gataggctgggcatctgggcagaat

SEQ ID NO: 254113 - DNA, 25 bp, Homo sapien
gataagagctgtggccctgcagcca

SEQ ID NO: 254114 - DNA, 25 bp, Homo sapien
agtccctgcatttgcaccctgagtt

SEQ ID NO: 254115 - DNA, 25 bp, Homo sapien
tgagtttgccatgagctgtgtgacc

SEQ ID NO: 254116 - DNA, 25 bp, Homo sapien
gtgaccttagtcaagtttctcaacc

SEQ ID NO: 254117 - DNA, 25 bp, Homo sapien
atttgcggacagattaaggacttca

SEQ ID NO: 254118 - DNA, 25 bp, Homo sapien
ggatcgtgttttgcacacagcccga

SEQ ID NO: 254119 - DNA, 25 bp, Homo sapien
cagacctaggtcttgcagatgcaaa

SEQ ID NO: 254120 - DNA, 25 bp, Homo sapien
gcagatgcaaactcctgtcaagtgt

SEQ ID NO: 254121 - DNA, 25 bp, Homo sapien
gcaaactcctgtcaagtgtgagagg

SEQ ID NO: 254122 - DNA, 25 bp, Homo sapien
tgcatcaagtctaaatagccgctcg

SEQ ID NO: 254123 - DNA, 25 bp, Homo sapien
caagtctaaatagccgctcgcagga

SEQ ID NO: 254124 - DNA, 25 bp, Homo sapien
taaatagccgctcgcaggatctggg

SEQ ID NO: 254125 - DNA, 25 bp, Homo sapien
acctgatctgatctttataaaaagt

SEQ ID NO: 254126 - DNA, 25 bp, Homo sapien
ttataaaaagtgctcccccactcag

SEQ ID NO: 254127 - DNA, 25 bp, Homo sapien
cctccacactgaagagtgtgctcca

SEQ ID NO: 254128 - DNA, 25 bp, Homo sapien
agcgctgtctggctcggcaaggagg

SEQ ID NO: 254129 - DNA, 25 bp, Homo sapien
gctgaaactggagagcccctgggaa

SEQ ID NO: 254130 - DNA, 25 bp, Homo sapien
ctggagagcccctgggaaggctctt

SEQ ID NO: 254131 - DNA, 25 bp, Homo sapien
gaaggctcttgtgggccaggtggca

SEQ ID NO: 254132 - DNA, 25 bp, Homo sapien
atacctgtgaaatggtggagtgtgc

SEQ ID NO: 254133 - DNA, 25 bp, Homo sapien
cttaccctgtctgtgatcttgtctg

SEQ ID NO: 254134 - DNA, 25 bp, Homo sapien
ttaccctgtctgtgatcttgtctgt

SEQ ID NO: 254135 - DNA, 25 bp, Homo sapien
accctgtctgtgatcttgtctgtga

SEQ ID NO: 254136 - DNA, 25 bp, Homo sapien
cctgtctgtgatcttgtctgtgatg

SEQ ID NO: 254137 - DNA, 25 bp, Homo sapien
tgtctgtgatcttgtctgtgatgca

SEQ ID NO: 254138 - DNA, 25 bp, Homo sapien
tctgtgatcttgtctgtgatgcagt

SEQ ID NO: 254139 - DNA, 25 bp, Homo sapien
gtgatcttgtctgtgatgcagtaat

SEQ ID NO: 254140 - DNA, 25 bp, Homo sapien
gatcttgtctgtgatgcagtaatga

SEQ ID NO: 254141 - DNA, 25 bp, Homo sapien
tctgtgatgcagtaatgatattcca

SEQ ID NO: 254142 - DNA, 25 bp, Homo sapien
gcagtaatgatattccactctaggt

SEQ ID NO: 254143 - DNA, 25 bp, Homo sapien
taatgatattccactctaggttccc

SEQ ID NO: 254144 - DNA, 25 bp, Homo sapien
gactactcatactaatttcgcggcc

SEQ ID NO: 254145 - DNA, 25 bp, Homo sapien
gatttgccccatcatatccgagtct

SEQ ID NO: 254146 - DNA, 25 bp, Homo sapien
cccatcatatccgagtctttactaa

SEQ ID NO: 254147 - DNA, 25 bp, Homo sapien
aaatgaggctgcttaagtacccaag

SEQ ID NO: 254148 - DNA, 25 bp, Homo sapien
ggctgcttaagtacccaagtggagc

SEQ ID NO: 254149 - DNA, 25 bp, Homo sapien
acagttactgtaagtctgagttaga

SEQ ID NO: 254150 - DNA, 25 bp, Homo sapien
tacagagcatctagttattgagcaa

SEQ ID NO: 254151 - DNA, 25 bp, Homo sapien
gagcatctagttattgagcaaagcc

SEQ ID NO: 254152 - DNA, 25 bp, Homo sapien
tttacctgttcgcttattcaaagag

SEQ ID NO: 254153 - DNA, 25 bp, Homo sapien
caatagaatttgcttctcagtacat

SEQ ID NO: 254154 - DNA, 25 bp, Homo sapien
aaaagctgggacgcctgccaggaac

SEQ ID NO: 254155 - DNA, 25 bp, Homo sapien
gagaaagatgattggcctcttaggg

SEQ ID NO: 254156 - DNA, 25 bp, Homo sapien
gtaactcatggccagggaatggctt

SEQ ID NO: 254157 - DNA, 25 bp, Homo sapien
ggcacttccttgattccgctgtact

SEQ ID NO: 254158 - DNA, 25 bp, Homo sapien
ctgtactcctcagcgggaccggaga

SEQ ID NO: 254159 - DNA, 25 bp, Homo sapien
gttccaggagggagccttccagagt

SEQ ID NO: 254160 - DNA, 25 bp, Homo sapien
cttccagagtcggtgcagggttgac

SEQ ID NO: 254161 - DNA, 25 bp, Homo sapien
cagggttgacaggagacgtttgttt

SEQ ID NO: 254162 - DNA, 25 bp, Homo sapien
gacaggagacgtttgttttgctttt

SEQ ID NO: 254163 - DNA, 25 bp, Homo sapien
ggaatggcttagttatctgagggaa

SEQ ID NO: 254164 - DNA, 25 bp, Homo sapien
atctgagggaatcttgtctgtgaaa

SEQ ID NO: 254165 - DNA, 25 bp, Homo sapien
gcaaatgggaattcagacaggtcag

SEQ ID NO: 254166 - DNA, 25 bp, Homo sapien
gatgctgtattatatccgctcccgc

SEQ ID NO: 254167 - DNA, 25 bp, Homo sapien
tgctgtattatatccgctcccgctg

SEQ ID NO: 254168 - DNA, 25 bp, Homo sapien
gtattatatccgctcccgctgtact

SEQ ID NO: 254169 - DNA, 25 bp, Homo sapien
attatatccgctcccgctgtactgc

SEQ ID NO: 254170 - DNA, 25 bp, Homo sapien
ctggtggggaactgtaagcaatttg

SEQ ID NO: 254171 - DNA, 25 bp, Homo sapien
agcaatttgattgcttcccttctat

SEQ ID NO: 254172 - DNA, 25 bp, Homo sapien
acaaatcgtaattagaagtgctctc

SEQ ID NO: 254173 - DNA, 25 bp, Homo sapien
aatcgtaattagaagtgctctctat

SEQ ID NO: 254174 - DNA, 25 bp, Homo sapien
gtaattagaagtgctctctattttt

SEQ ID NO: 254175 - DNA, 25 bp, Homo sapien
taagacaaggtaacggtgaaagctc

SEQ ID NO: 254176 - DNA, 25 bp, Homo sapien
caaggtaacggtgaaagctcctcaa

SEQ ID NO: 254177 - DNA, 25 bp, Homo sapien
tcaaggactttaacctgggccggat

SEQ ID NO: 254178 - DNA, 25 bp, Homo sapien
taacctgggccggatctggtttgga

SEQ ID NO: 254179 - DNA, 25 bp, Homo sapien
catgaccttctttagagccactaag

SEQ ID NO: 254180 - DNA, 25 bp, Homo sapien
accaggctggcctagacccagggat

SEQ ID NO: 254181 - DNA, 25 bp, Homo sapien
gatgagaatgcaccctaaaataaat

SEQ ID NO: 254182 - DNA, 25 bp, Homo sapien
gcagcagagggcttccctgtctagt

SEQ ID NO: 254183 - DNA, 25 bp, Homo sapien
ttccctgtctagtgtgtgatcctaa

SEQ ID NO: 254184 - DNA, 25 bp, Homo sapien
gatcctaactaaaggcagctctctt

SEQ ID NO: 254185 - DNA, 25 bp, Homo sapien
agccttcccctggattaggtcacat

SEQ ID NO: 254186 - DNA, 25 bp, Homo sapien
attaggtcacatacacctggtggcc

SEQ ID NO: 254187 - DNA, 25 bp, Homo sapien
ccaagcctctgctgggtcccaaata

SEQ ID NO: 254188 - DNA, 25 bp, Homo sapien
aaatgaatgactgccaccaagttcc

SEQ ID NO: 254189 - DNA, 25 bp, Homo sapien
aaggccagccatgtactcatttctg

SEQ ID NO: 254190 - DNA, 25 bp, Homo sapien
atttctgctcatcaagccttagcct

SEQ ID NO: 254191 - DNA, 25 bp, Homo sapien
gccttagcctgggtttatcgctagg

SEQ ID NO: 254192 - DNA, 25 bp, Homo sapien
ttatcgctaggtgatgggtctgaac

SEQ ID NO: 254193 - DNA, 25 bp, Homo sapien
gactgccaccaagttccactttgaa

SEQ ID NO: 254194 - DNA, 25 bp, Homo sapien
ggtctgaaccctaggtgcggcccgg

SEQ ID NO: 254195 - DNA, 25 bp, Homo sapien
tccactttgaaaagccctgcccagg

SEQ ID NO: 254196 - DNA, 25 bp, Homo sapien
gaaccccatttgtataaggcaaaat

SEQ ID NO: 254197 - DNA, 25 bp, Homo sapien
atacaaagacaccaagaattcctca

SEQ ID NO: 254198 - DNA, 25 bp, Homo sapien
gaattcctcaataccctaagattaa

SEQ ID NO: 254199 - DNA, 25 bp, Homo sapien
aactacagcaatgttgcttctgcct

SEQ ID NO: 254200 - DNA, 25 bp, Homo sapien
ttctgcctgggtctgcgctccacga

SEQ ID NO: 254201 - DNA, 25 bp, Homo sapien
acaaaattgctcctacctggtttgg

SEQ ID NO: 254202 - DNA, 25 bp, Homo sapien
aaaattgctcctacctggtttggca

SEQ ID NO: 254203 - DNA, 25 bp, Homo sapien
aaattgctcctacctggtttggcag

SEQ ID NO: 254204 - DNA, 25 bp, Homo sapien
attgctcctacctggtttggcagct

SEQ ID NO: 254205 - DNA, 25 bp, Homo sapien
tcctacctggtttggcagctccacg

SEQ ID NO: 254206 - DNA, 25 bp, Homo sapien
aacaccctcagatctgagcagcggc

SEQ ID NO: 254207 - DNA, 25 bp, Homo sapien
cagctcctttctgggtcttctgttt

SEQ ID NO: 254208 - DNA, 25 bp, Homo sapien
gctcctttctgggtcttctgtttca

SEQ ID NO: 254209 - DNA, 25 bp, Homo sapien
gaccctcgaactacagcaatgttgc

SEQ ID NO: 254210 - DNA, 25 bp, Homo sapien
gggtggccgcggcacacggactcgc

SEQ ID NO: 254211 - DNA, 25 bp, Homo sapien
ggcacacggactcgccctcgagact

SEQ ID NO: 254212 - DNA, 25 bp, Homo sapien
agccccggcggatctgagcgtcatg

SEQ ID NO: 254213 - DNA, 25 bp, Homo sapien
ggctcggtcataaagccgggccgca

SEQ ID NO: 254214 - DNA, 25 bp, Homo sapien
gctcggtcataaagccgggccgcag

SEQ ID NO: 254215 - DNA, 25 bp, Homo sapien
aaagccgggccgcagcgtgggagct

SEQ ID NO: 254216 - DNA, 25 bp, Homo sapien
cgcagcgtgggagctgcacctcggg

SEQ ID NO: 254217 - DNA, 25 bp, Homo sapien
gatccctgagcgacttggggcactg

SEQ ID NO: 254218 - DNA, 25 bp, Homo sapien
ggcactggggctgcaatacagaaga

SEQ ID NO: 254219 - DNA, 25 bp, Homo sapien
gggctgcaatacagaagaggaagcc

SEQ ID NO: 254220 - DNA, 25 bp, Homo sapien
cacgttgcgcgcacccgcccggtga

SEQ ID NO: 254221 - DNA, 25 bp, Homo sapien
cagtttgaaggctcaaggcaagagg

SEQ ID NO: 254222 - DNA, 25 bp, Homo sapien
tagtactctatctgggatgtacctt

SEQ ID NO: 254223 - DNA, 25 bp, Homo sapien
actctatctgggatgtaccttactt

SEQ ID NO: 254224 - DNA, 25 bp, Homo sapien
tatctgggatgtaccttacttcact

SEQ ID NO: 254225 - DNA, 25 bp, Homo sapien
ctgggatgtaccttacttcacttac

SEQ ID NO: 254226 - DNA, 25 bp, Homo sapien
ggatgtaccttacttcacttacaaa

SEQ ID NO: 254227 - DNA, 25 bp, Homo sapien
gtaccttacttcacttacaaataag

SEQ ID NO: 254228 - DNA, 25 bp, Homo sapien
cttacaaataagcacagatcatatt

SEQ ID NO: 254229 - DNA, 25 bp, Homo sapien
ttttgtatctacataactaggcaag

SEQ ID NO: 254230 - DNA, 25 bp, Homo sapien
ataactaggcaagaaccatcctgaa

SEQ ID NO: 254231 - DNA, 25 bp, Homo sapien
gaaccatcctgaaagggtaacaaat

SEQ ID NO: 254232 - DNA, 25 bp, Homo sapien
cagtgaagcctgtgtaataccatac

SEQ ID NO: 254233 - DNA, 25 bp, Homo sapien
ggatgaaagactattctgagcaaaa

SEQ ID NO: 254234 - DNA, 25 bp, Homo sapien
aatgggatgtcagaatctttgaaaa

SEQ ID NO: 254235 - DNA, 25 bp, Homo sapien
gaaggattttccattcaataaggat

SEQ ID NO: 254236 - DNA, 25 bp, Homo sapien
caataaggataatctctcttcctat

SEQ ID NO: 254237 - DNA, 25 bp, Homo sapien
ctctcttcctatcattctgtcaaaa

SEQ ID NO: 254238 - DNA, 25 bp, Homo sapien
ttctgtcaaaatggcagtttctttt

SEQ ID NO: 254239 - DNA, 25 bp, Homo sapien
ggcagtttcttttggtaattatcca

SEQ ID NO: 254240 - DNA, 25 bp, Homo sapien
ggattctttgcctagcagtggccgt

SEQ ID NO: 254241 - DNA, 25 bp, Homo sapien
agtggccgtcaaactgatgtagcat

SEQ ID NO: 254242 - DNA, 25 bp, Homo sapien
aaactgatgtagcattgtacttctc

SEQ ID NO: 254243 - DNA, 25 bp, Homo sapien
tagtgccaccacagcttatggcatc

SEQ ID NO: 254244 - DNA, 25 bp, Homo sapien
cagcttatggcatctcattgaggac

SEQ ID NO: 254245 - DNA, 25 bp, Homo sapien
tgcacaataaaaccaagcctctgga

SEQ ID NO: 254246 - DNA, 25 bp, Homo sapien
tggaatctgtcctcgtgtccacctg

SEQ ID NO: 254247 - DNA, 25 bp, Homo sapien
gtgaggctggggaacgccacctctt

SEQ ID NO: 254248 - DNA, 25 bp, Homo sapien
tgacttctccccaaccacttagtag

SEQ ID NO: 254249 - DNA, 25 bp, Homo sapien
acttagtagcaacgctaccccaggg

SEQ ID NO: 254250 - DNA, 25 bp, Homo sapien
gggctaatgactgcacactgggctt

SEQ ID NO: 254251 - DNA, 25 bp, Homo sapien
atgactgcacactgggcttcttttc

SEQ ID NO: 254252 - DNA, 25 bp, Homo sapien
ttttcagaatgaccctaacgagaca

SEQ ID NO: 254253 - DNA, 25 bp, Homo sapien
accctaacgagacacatttgcccaa

SEQ ID NO: 254254 - DNA, 25 bp, Homo sapien
tggagttttcattgtctcgtgcaat

SEQ ID NO: 254255 - DNA, 25 bp, Homo sapien
gttttcattgtctcgtgcaatgcca

SEQ ID NO: 254256 - DNA, 25 bp, Homo sapien
ttcattgtctcgtgcaatgccatcg

SEQ ID NO: 254257 - DNA, 25 bp, Homo sapien
cattgtctcgtgcaatgccatcgac

SEQ ID NO: 254258 - DNA, 25 bp, Homo sapien
gcaatgccatcgaccttgaatttca

SEQ ID NO: 254259 - DNA, 25 bp, Homo sapien
aatgccatcgaccttgaatttcagc

SEQ ID NO: 254260 - DNA, 25 bp, Homo sapien
gccatcgaccttgaatttcagcata

SEQ ID NO: 254261 - DNA, 25 bp, Homo sapien
atcgaccttgaatttcagcatagga

SEQ ID NO: 254262 - DNA, 25 bp, Homo sapien
cttgaatttcagcataggacccata

SEQ ID NO: 254263 - DNA, 25 bp, Homo sapien
atttcagcataggacccatatgaag

SEQ ID NO: 254264 - DNA, 25 bp, Homo sapien
ttcagcataggacccatatgaagtg

SEQ ID NO: 254265 - DNA, 25 bp, Homo sapien
gaattttggatgatcttgcctgcgt

SEQ ID NO: 254266 - DNA, 25 bp, Homo sapien
gatgatcttgcctgcgtctgagtac

SEQ ID NO: 254267 - DNA, 25 bp, Homo sapien
ttgcctgcgtctgagtactgactcc

SEQ ID NO: 254268 - DNA, 25 bp, Homo sapien
agtactgactcctccactcactgaa

SEQ ID NO: 254269 - DNA, 25 bp, Homo sapien
cactgaaagtcactttggccaagtg

SEQ ID NO: 254270 - DNA, 25 bp, Homo sapien
actttggccaagtgacttcgtgttt

SEQ ID NO: 254271 - DNA, 25 bp, Homo sapien
ggccaagtgacttcgtgtttttgtg

SEQ ID NO: 254272 - DNA, 25 bp, Homo sapien
acttcgtgtttttgtgtctctgctc

SEQ ID NO: 254273 - DNA, 25 bp, Homo sapien
ctctgctcccacaccagtaaaatgg

SEQ ID NO: 254274 - DNA, 25 bp, Homo sapien
agatatcttgatggactgttgtgat

SEQ ID NO: 254275 - DNA, 25 bp, Homo sapien
gagccgtgattgagtcaccacactg

SEQ ID NO: 254276 - DNA, 25 bp, Homo sapien
ttctccccaaccacttagtagcaac

SEQ ID NO: 254277 - DNA, 25 bp, Homo sapien
cccaaccacttagtagcaacgctac

SEQ ID NO: 254278 - DNA, 25 bp, Homo sapien
tcttttcagaatgaccctaacgaga

SEQ ID NO: 254279 - DNA, 25 bp, Homo sapien
ttttcagaatgaccctaacgagaca

SEQ ID NO: 254280 - DNA, 25 bp, Homo sapien
ttcagaatgaccctaacgagacaca

SEQ ID NO: 254281 - DNA, 25 bp, Homo sapien
tcagaatgaccctaacgagacacat

SEQ ID NO: 254282 - DNA, 25 bp, Homo sapien
cagaatgaccctaacgagacacatt

SEQ ID NO: 254283 - DNA, 25 bp, Homo sapien
gaatgaccctaacgagacacatttg

SEQ ID NO: 254284 - DNA, 25 bp, Homo sapien
atgaccctaacgagacacatttgcc

SEQ ID NO: 254285 - DNA, 25 bp, Homo sapien
gaccctaacgagacacatttgccca

SEQ ID NO: 254286 - DNA, 25 bp, Homo sapien
accctaacgagacacatttgcccaa

SEQ ID NO: 254287 - DNA, 25 bp, Homo sapien
ccttatctgttttggacaagtccaa

SEQ ID NO: 254288 - DNA, 25 bp, Homo sapien
agaattatcagcaccttaattggtg

SEQ ID NO: 254289 - DNA, 25 bp, Homo sapien
gaattatcagcaccttaattggtgg

SEQ ID NO: 254290 - DNA, 25 bp, Homo sapien
aattatcagcaccttaattggtggt

SEQ ID NO: 254291 - DNA, 25 bp, Homo sapien
attatcagcaccttaattggtggta

SEQ ID NO: 254292 - DNA, 25 bp, Homo sapien
ttatcagcaccttaattggtggtaa

SEQ ID NO: 254293 - DNA, 25 bp, Homo sapien
tatcagcaccttaattggtggtaag

SEQ ID NO: 254294 - DNA, 25 bp, Homo sapien
atcagcaccttaattggtggtaaga

SEQ ID NO: 254295 - DNA, 25 bp, Homo sapien
agcaccttaattggtggtaagagct

SEQ ID NO: 254296 - DNA, 25 bp, Homo sapien
gcaccttaattggtggtaagagcta

SEQ ID NO: 254297 - DNA, 25 bp, Homo sapien
caccttaattggtggtaagagctag

SEQ ID NO: 254298 - DNA, 25 bp, Homo sapien
aagctcccaagaggctcctgaggaa

SEQ ID NO: 254299 - DNA, 25 bp, Homo sapien
ttgtgagtgtgttgcccgtgtgtct

SEQ ID NO: 254300 - DNA, 25 bp, Homo sapien
tgtgttgcccgtgtgtctgtgtgta

SEQ ID NO: 254301 - DNA, 25 bp, Homo sapien
gacgctgggacccttgccttagatt

SEQ ID NO: 254302 - DNA, 25 bp, Homo sapien
tgggacccttgccttagatttctga

SEQ ID NO: 254303 - DNA, 25 bp, Homo sapien
acccttgccttagatttctgactgg

SEQ ID NO: 254304 - DNA, 25 bp, Homo sapien
cttgccttagatttctgactggtag

SEQ ID NO: 254305 - DNA, 25 bp, Homo sapien
ttagatttctgactggtagggtttc

SEQ ID NO: 254306 - DNA, 25 bp, Homo sapien
atttctgactggtagggtttctcca

SEQ ID NO: 254307 - DNA, 25 bp, Homo sapien
tcactccctgccaaggtcccatggg

SEQ ID NO: 254308 - DNA, 25 bp, Homo sapien
acctcctgcatgtctccgcggaggg

SEQ ID NO: 254309 - DNA, 25 bp, Homo sapien
ttattgagtgattgatactgtgtcc

SEQ ID NO: 254310 - DNA, 25 bp, Homo sapien
gggcacataaacaattcacatgtaa

SEQ ID NO: 254311 - DNA, 25 bp, Homo sapien
acaattcacatgtaatttttctgta

SEQ ID NO: 254312 - DNA, 25 bp, Homo sapien
gtaatttttctgtattacattgaca

SEQ ID NO: 254313 - DNA, 25 bp, Homo sapien
atgatctctgcatctaaaattcaag

SEQ ID NO: 254314 - DNA, 25 bp, Homo sapien
aagcagtccagcctggaatactatc

SEQ ID NO: 254315 - DNA, 25 bp, Homo sapien
gttgtgaacaactctgaaaacatac

SEQ ID NO: 254316 - DNA, 25 bp, Homo sapien
aacatactggtcgatgaggtttata

SEQ ID NO: 254317 - DNA, 25 bp, Homo sapien
gtcgatgaggtttatagctagagtc

SEQ ID NO: 254318 - DNA, 25 bp, Homo sapien
tagctagagtctaaaatgccacatt

SEQ ID NO: 254319 - DNA, 25 bp, Homo sapien
atgccacatttatatgggtgaaaca

SEQ ID NO: 254320 - DNA, 25 bp, Homo sapien
tctgcattcccagtttccgcaggag

SEQ ID NO: 254321 - DNA, 25 bp, Homo sapien
tcccagtttccgcaggagccttgat

SEQ ID NO: 254322 - DNA, 25 bp, Homo sapien
gagccttgatccatggggaagcctg

SEQ ID NO: 254323 - DNA, 25 bp, Homo sapien
gaagagcctgaagacattgggaaag

SEQ ID NO: 254324 - DNA, 25 bp, Homo sapien
gtggagcaggaatagttccactgta

SEQ ID NO: 254325 - DNA, 25 bp, Homo sapien
gtattgtcacagtgtgtttgcactt

SEQ ID NO: 254326 - DNA, 25 bp, Homo sapien
tgtgtttgcactttctgaggttcta

SEQ ID NO: 254327 - DNA, 25 bp, Homo sapien
tgtttgcactttctgaggttctagc

SEQ ID NO: 254328 - DNA, 25 bp, Homo sapien
tgaggttctagctagtacagattgt

SEQ ID NO: 254329 - DNA, 25 bp, Homo sapien
ggttctagctagtacagattgtata

SEQ ID NO: 254330 - DNA, 25 bp, Homo sapien
gtatattgatagtacatattgcttt

SEQ ID NO: 254331 - DNA, 25 bp, Homo sapien
agtccaatttccatgtgtcgtgcag

SEQ ID NO: 254332 - DNA, 25 bp, Homo sapien
gtgtcgtgcaggtaattgtatcatt

SEQ ID NO: 254333 - DNA, 25 bp, Homo sapien
cattcaaaaactgctgtgtcccgat

SEQ ID NO: 254334 - DNA, 25 bp, Homo sapien
aaaactgctgtgtcccgatagaggg

SEQ ID NO: 254335 - DNA, 25 bp, Homo sapien
tagagggaattgtttccagctgatg

SEQ ID NO: 254336 - DNA, 25 bp, Homo sapien
cagctgatggcttataaacacgaag

SEQ ID NO: 254337 - DNA, 25 bp, Homo sapien
agcacagacaggaagctccgggctc

SEQ ID NO: 254338 - DNA, 25 bp, Homo sapien
cattttccttcctcagtgcacttgg

SEQ ID NO: 254339 - DNA, 25 bp, Homo sapien
gtgcacttggcagaatcagcgccat

SEQ ID NO: 254340 - DNA, 25 bp, Homo sapien
gcgccattcagataaaacccagtgt

SEQ ID NO: 254341 - DNA, 25 bp, Homo sapien
aaactgatcgtgttgggatattcaa

SEQ ID NO: 254342 - DNA, 25 bp, Homo sapien
atggaaaaactcaacgacctggaag

SEQ ID NO: 254343 - DNA, 25 bp, Homo sapien
aactcaacgacctggaagtgaaaga

SEQ ID NO: 254344 - DNA, 25 bp, Homo sapien
gttacttgtaataaaactcaccaat

SEQ ID NO: 254345 - DNA, 25 bp, Homo sapien
caccaattttaaatctacgatgtaa

SEQ ID NO: 254346 - DNA, 25 bp, Homo sapien
atctacgatgtaaccatttaaggag

SEQ ID NO: 254347 - DNA, 25 bp, Homo sapien
aaggaggtttgtagaattgtgcagt

SEQ ID NO: 254348 - DNA, 25 bp, Homo sapien
catcagcagagtcacgttttagaat

SEQ ID NO: 254349 - DNA, 25 bp, Homo sapien
gcagagtcacgttttagaatatttt

SEQ ID NO: 254350 - DNA, 25 bp, Homo sapien
tgtcatttccccaaataccctaaag

SEQ ID NO: 254351 - DNA, 25 bp, Homo sapien
aaataccctaaagcctctgcacagt

SEQ ID NO: 254352 - DNA, 25 bp, Homo sapien
ctaaagcctctgcacagtcatttcc

SEQ ID NO: 254353 - DNA, 25 bp, Homo sapien
tatttgtggccccatcttgcagggc

SEQ ID NO: 254354 - DNA, 25 bp, Homo sapien
taattcatgttttcagctctgagct

SEQ ID NO: 254355 - DNA, 25 bp, Homo sapien
ggcctctcatgcttgaaacctgtga

SEQ ID NO: 254356 - DNA, 25 bp, Homo sapien
aaacctgtgaccatcttctattctt

SEQ ID NO: 254357 - DNA, 25 bp, Homo sapien
cttttgtccggtaatctgtctagca

SEQ ID NO: 254358 - DNA, 25 bp, Homo sapien
tgtctagcagcagccattgactctg

SEQ ID NO: 254359 - DNA, 25 bp, Homo sapien
tggccaaagcatcttgatctcacct

SEQ ID NO: 254360 - DNA, 25 bp, Homo sapien
gagctcaggatctgtaattcagaca

SEQ ID NO: 254361 - DNA, 25 bp, Homo sapien
aattcagacacctgcttgatttctc

SEQ ID NO: 254362 - DNA, 25 bp, Homo sapien
cttgatttctccagacgcatgtcta

SEQ ID NO: 254363 - DNA, 25 bp, Homo sapien
taatagtcacgtcaaacttgccctg

SEQ ID NO: 254364 - DNA, 25 bp, Homo sapien
ttatttacccgcctcagaagtcacc

SEQ ID NO: 254365 - DNA, 25 bp, Homo sapien
agaagtcacccaagagctcgtgaaa

SEQ ID NO: 254366 - DNA, 25 bp, Homo sapien
gtcacccaagagctcgtgaaattgg

SEQ ID NO: 254367 - DNA, 25 bp, Homo sapien
aattgggcagggactgtggtaacat

SEQ ID NO: 254368 - DNA, 25 bp, Homo sapien
gggactgtggtaacataaagtttca

SEQ ID NO: 254369 - DNA, 25 bp, Homo sapien
gttcaaagtttatgtgtccttcctt

SEQ ID NO: 254370 - DNA, 25 bp, Homo sapien
ttatgtgtccttccttactcccggt

SEQ ID NO: 254371 - DNA, 25 bp, Homo sapien
tactcccggtggagtgggctcatga

SEQ ID NO: 254372 - DNA, 25 bp, Homo sapien
gggctcatgagaatatccaagtgtt

SEQ ID NO: 254373 - DNA, 25 bp, Homo sapien
tccagcgctgcgaaggcatgggcac

SEQ ID NO: 254374 - DNA, 25 bp, Homo sapien
aggcccacatcctcttggagaagag

SEQ ID NO: 254375 - DNA, 25 bp, Homo sapien
gtgatcttggactgtcaattcccct

SEQ ID NO: 254376 - DNA, 25 bp, Homo sapien
atccattttactgcaaacataaggg

SEQ ID NO: 254377 - DNA, 25 bp, Homo sapien
tgcagtaaagggttgtctcacgtct

SEQ ID NO: 254378 - DNA, 25 bp, Homo sapien
gtctcacgtcttctgctttaaaagc

SEQ ID NO: 254379 - DNA, 25 bp, Homo sapien
tatgacctgaaaactccagttacat

SEQ ID NO: 254380 - DNA, 25 bp, Homo sapien
gatctgcagctatctaaggcttggt

SEQ ID NO: 254381 - DNA, 25 bp, Homo sapien
gctatctaaggcttggttttcttac

SEQ ID NO: 254382 - DNA, 25 bp, Homo sapien
actgtcatatgatacctgggtctaa

SEQ ID NO: 254383 - DNA, 25 bp, Homo sapien
acctgggtctaatgaactctgctga

SEQ ID NO: 254384 - DNA, 25 bp, Homo sapien
tgagatcacctcaagtttctgcggt

SEQ ID NO: 254385 - DNA, 25 bp, Homo sapien
cacctcaagtttctgcggttggtaa

SEQ ID NO: 254386 - DNA, 25 bp, Homo sapien
gaaggacaggccatcagctccgaaa

SEQ ID NO: 254387 - DNA, 25 bp, Homo sapien
aggccatcagctccgaaacactgta

SEQ ID NO: 254388 - DNA, 25 bp, Homo sapien
catcagctccgaaacactgtatgta

SEQ ID NO: 254389 - DNA, 25 bp, Homo sapien
gtatgtattttccagtatatactgc

SEQ ID NO: 254390 - DNA, 25 bp, Homo sapien
ccagtatatactgctagctgtgtga

SEQ ID NO: 254391 - DNA, 25 bp, Homo sapien
tatactgctagctgtgtgatgttgg

SEQ ID NO: 254392 - DNA, 25 bp, Homo sapien
ctatctcataggtggcaactacaag

SEQ ID NO: 254393 - DNA, 25 bp, Homo sapien
ggcagcacactcagggaattaagga

SEQ ID NO: 254394 - DNA, 25 bp, Homo sapien
tttctcttggctttcctggataagg

SEQ ID NO: 254395 - DNA, 25 bp, Homo sapien
ggctttcctggataaggactgcatc

SEQ ID NO: 254396 - DNA, 25 bp, Homo sapien
aggactgcatcattcctgtggaagg

SEQ ID NO: 254397 - DNA, 25 bp, Homo sapien
tgctcagggttgtgagtgtgttgcc

SEQ ID NO: 254398 - DNA, 25 bp, Homo sapien
gacgctgggacccttgccttagatt

SEQ ID NO: 254399 - DNA, 25 bp, Homo sapien
tgggacccttgccttagatttctga

SEQ ID NO: 254400 - DNA, 25 bp, Homo sapien
ggacccttgccttagatttctgact

SEQ ID NO: 254401 - DNA, 25 bp, Homo sapien
acccttgccttagatttctgactgg

SEQ ID NO: 254402 - DNA, 25 bp, Homo sapien
ccttgccttagatttctgactggta

SEQ ID NO: 254403 - DNA, 25 bp, Homo sapien
gccttagatttctgactggtagggt

SEQ ID NO: 254404 - DNA, 25 bp, Homo sapien
tagatttctgactggtagggtttct

SEQ ID NO: 254405 - DNA, 25 bp, Homo sapien
tcactccctgccaaggtcccatggg

SEQ ID NO: 254406 - DNA, 25 bp, Homo sapien
cacctcctgcatgtctccgcggagg

SEQ ID NO: 254407 - DNA, 25 bp, Homo sapien
gcggaggggctaccttccttcccat

SEQ ID NO: 254408 - DNA, 25 bp, Homo sapien
gtaaggctgggctgctgcgacacag

SEQ ID NO: 254409 - DNA, 25 bp, Homo sapien
attgggcagtggaagctattttttg

SEQ ID NO: 254410 - DNA, 25 bp, Homo sapien
tattttttgccttccctgtgtaaca

SEQ ID NO: 254411 - DNA, 25 bp, Homo sapien
ttgtttaatgttgggcctgaggtta

SEQ ID NO: 254412 - DNA, 25 bp, Homo sapien
tgggcctgaggttaactgtgaccat

SEQ ID NO: 254413 - DNA, 25 bp, Homo sapien
gaggttaactgtgaccatggtccag

SEQ ID NO: 254414 - DNA, 25 bp, Homo sapien
tgaccatggtccagcttgagtggct

SEQ ID NO: 254415 - DNA, 25 bp, Homo sapien
gtccagcttgagtggcttctggagc

SEQ ID NO: 254416 - DNA, 25 bp, Homo sapien
gcttctggagcagccacattttcaa

SEQ ID NO: 254417 - DNA, 25 bp, Homo sapien
tctggagcagccacattttcaagga

SEQ ID NO: 254418 - DNA, 25 bp, Homo sapien
agccagccagttcagggctcaggcc

SEQ ID NO: 254419 - DNA, 25 bp, Homo sapien
cttataccccaaacagagagcaaat

SEQ ID NO: 254420 - DNA, 25 bp, Homo sapien
gagagcaaataagtatccccatttt

SEQ ID NO: 254421 - DNA, 25 bp, Homo sapien
atccccattttttagtcacatagag

SEQ ID NO: 254422 - DNA, 25 bp, Homo sapien
gtcacatagagttccagagttgcca

SEQ ID NO: 254423 - DNA, 25 bp, Homo sapien
tccagagttgccacagttacatcgc

SEQ ID NO: 254424 - DNA, 25 bp, Homo sapien
gccacagttacatcgcaaagtcagg

SEQ ID NO: 254425 - DNA, 25 bp, Homo sapien
ggatttgaatccagtgcagaccgaa

SEQ ID NO: 254426 - DNA, 25 bp, Homo sapien
cagaccgaaacaccatggttttctc

SEQ ID NO: 254427 - DNA, 25 bp, Homo sapien
tggttttctctccaaagcagagcag

SEQ ID NO: 254428 - DNA, 25 bp, Homo sapien
gggtcttgtcagtcagagtcctaaa

SEQ ID NO: 254429 - DNA, 25 bp, Homo sapien
ttcaattaactatccctctaatccc

SEQ ID NO: 254430 - DNA, 25 bp, Homo sapien
gcaaagcccataagcaagttcagaa

SEQ ID NO: 254431 - DNA, 25 bp, Homo sapien
ttctacttgtccaaagcaacatgga

SEQ ID NO: 254432 - DNA, 25 bp, Homo sapien
tttctatcctaaaatctacctcctg

SEQ ID NO: 254433 - DNA, 25 bp, Homo sapien
aaatatgctccagccaaaggtgacc

SEQ ID NO: 254434 - DNA, 25 bp, Homo sapien
gccaaaggtgaccatggaaacctat

SEQ ID NO: 254435 - DNA, 25 bp, Homo sapien
ggaaacctattgataaggctctggg

SEQ ID NO: 254436 - DNA, 25 bp, Homo sapien
atctctgttcagacaactctagcgg

SEQ ID NO: 254437 - DNA, 25 bp, Homo sapien
actctagcggtgtgactctgagcaa

SEQ ID NO: 254438 - DNA, 25 bp, Homo sapien
ctgagcaagtgttttttaacctaag

SEQ ID NO: 254439 - DNA, 25 bp, Homo sapien
gagtaagacttgaactagtttgcaa

SEQ ID NO: 254440 - DNA, 25 bp, Homo sapien
gtttgcaaatatctgtgatcttcac

SEQ ID NO: 254441 - DNA, 25 bp, Homo sapien
ttatttcttttttgcaatgctagat

SEQ ID NO: 254442 - DNA, 25 bp, Homo sapien
atttgtctaaggtggagattaccag

SEQ ID NO: 254443 - DNA, 25 bp, Homo sapien
tactgttgcaacatagattgcttat

SEQ ID NO: 254444 - DNA, 25 bp, Homo sapien
agattaccagggtagactcgctctg

SEQ ID NO: 254445 - DNA, 25 bp, Homo sapien
tatgtaatgatgtctgtggctacat

SEQ ID NO: 254446 - DNA, 25 bp, Homo sapien
gtggctacataacctgccaacactt

SEQ ID NO: 254447 - DNA, 25 bp, Homo sapien
aacctgccaacacttagtcttatca

SEQ ID NO: 254448 - DNA, 25 bp, Homo sapien
tagtcttatcacacattttatttta

SEQ ID NO: 254449 - DNA, 25 bp, Homo sapien
tcttctaattactaacaatgctggt

SEQ ID NO: 254450 - DNA, 25 bp, Homo sapien
gaaattgttgtgtatatctctggta

SEQ ID NO: 254451 - DNA, 25 bp, Homo sapien
atctctggtagatatgtgttatttc

SEQ ID NO: 254452 - DNA, 25 bp, Homo sapien
gttgtggtcactgaatgcactccct

SEQ ID NO: 254453 - DNA, 25 bp, Homo sapien
actgaatgcactccctggtttttat

SEQ ID NO: 254454 - DNA, 25 bp, Homo sapien
cctggtttttatttgtcagtgaaat

SEQ ID NO: 254455 - DNA, 25 bp, Homo sapien
gtcagtgaaatctttatgcattcat

SEQ ID NO: 254456 - DNA, 25 bp, Homo sapien
aattccatggctttgtaggctgtgc

SEQ ID NO: 254457 - DNA, 25 bp, Homo sapien
ctttgtaggctgtgctgtgtctgaa

SEQ ID NO: 254458 - DNA, 25 bp, Homo sapien
cctagggaaacatgaggccccttat

SEQ ID NO: 254459 - DNA, 25 bp, Homo sapien
ggaacaacttcactttctcttttat

SEQ ID NO: 254460 - DNA, 25 bp, Homo sapien
tcttttatgtattgagccctgtgtt

SEQ ID NO: 254461 - DNA, 25 bp, Homo sapien
attgagccctgtgttaacatttcac

SEQ ID NO: 254462 - DNA, 25 bp, Homo sapien
tcacttaagaagagcaccagtgctt

SEQ ID NO: 254463 - DNA, 25 bp, Homo sapien
tcatttcatctaacatcatctcata

SEQ ID NO: 254464 - DNA, 25 bp, Homo sapien
taacatcatctcatattgctcctct

SEQ ID NO: 254465 - DNA, 25 bp, Homo sapien
ctcatattgctcctctgtcaagaga

SEQ ID NO: 254466 - DNA, 25 bp, Homo sapien
gaagaaagtgatcctccaatgctat

SEQ ID NO: 254467 - DNA, 25 bp, Homo sapien
gatcctccaatgctatttgtttctg

SEQ ID NO: 254468 - DNA, 25 bp, Homo sapien
ggaatgaatcctgcactggaggcaa

SEQ ID NO: 254469 - DNA, 25 bp, Homo sapien
aaagctgacaaggaaagagccatta

SEQ ID NO: 254470 - DNA, 25 bp, Homo sapien
aagtcaactgattgtgatcattaat

SEQ ID NO: 254471 - DNA, 25 bp, Homo sapien
caaaacctaattatcacagcctagg

SEQ ID NO: 254472 - DNA, 25 bp, Homo sapien
ttatcacagcctaggtaagagccat

SEQ ID NO: 254473 - DNA, 25 bp, Homo sapien
gcctaggtaagagccatcagtatta

SEQ ID NO: 254474 - DNA, 25 bp, Homo sapien
atactgtgcaatccgggctgccttc

SEQ ID NO: 254475 - DNA, 25 bp, Homo sapien
ggtgtttggttgctgttccaagaac

SEQ ID NO: 254476 - DNA, 25 bp, Homo sapien
gggctctggcatccctattcgcctt

SEQ ID NO: 254477 - DNA, 25 bp, Homo sapien
atccctattcgccttcctggtgctt

SEQ ID NO: 254478 - DNA, 25 bp, Homo sapien
gaggccccattaatttcttttccat

SEQ ID NO: 254479 - DNA, 25 bp, Homo sapien
aatttcttttccatcacccgatgca

SEQ ID NO: 254480 - DNA, 25 bp, Homo sapien
ttccatcacccgatgcagatctcag

SEQ ID NO: 254481 - DNA, 25 bp, Homo sapien
cctctggctaaacgcttattagcag

SEQ ID NO: 254482 - DNA, 25 bp, Homo sapien
ctaaacgcttattagcagtttccca

SEQ ID NO: 254483 - DNA, 25 bp, Homo sapien
gcaggcgatactgtgcaatccgggc

SEQ ID NO: 254484 - DNA, 25 bp, Homo sapien
aggcgatactgtgcaatccgggctg

SEQ ID NO: 254485 - DNA, 25 bp, Homo sapien
ggcatttttgatgatactactctac

SEQ ID NO: 254486 - DNA, 25 bp, Homo sapien
gatactactctacacagatcagact

SEQ ID NO: 254487 - DNA, 25 bp, Homo sapien
gatcagactcatgtgcagaatcgtg

SEQ ID NO: 254488 - DNA, 25 bp, Homo sapien
atgtgcagaatcgtgcctggagaga

SEQ ID NO: 254489 - DNA, 25 bp, Homo sapien
gaggtttggttaagacagagatttc

SEQ ID NO: 254490 - DNA, 25 bp, Homo sapien
gatttctggaaacattcaaattgca

SEQ ID NO: 254491 - DNA, 25 bp, Homo sapien
gaaacccacaatctaatgaggaatg

SEQ ID NO: 254492 - DNA, 25 bp, Homo sapien
gtactagattgaacacatggaatgc

SEQ ID NO: 254493 - DNA, 25 bp, Homo sapien
gaatgcaatgcaatgagactttctg

SEQ ID NO: 254494 - DNA, 25 bp, Homo sapien
gagactttctgcactaaaacttatc

SEQ ID NO: 254495 - DNA, 25 bp, Homo sapien
aaacttatcctcatatgtacaacaa

SEQ ID NO: 254496 - DNA, 25 bp, Homo sapien
gtcatctatcctgccagtgttttat

SEQ ID NO: 254497 - DNA, 25 bp, Homo sapien
gtgttttatgttgtagctgtttttc

SEQ ID NO: 254498 - DNA, 25 bp, Homo sapien
tttctttgacaggtgagttccagct

SEQ ID NO: 254499 - DNA, 25 bp, Homo sapien
gagttccagctatgttgttagtcat

SEQ ID NO: 254500 - DNA, 25 bp, Homo sapien
gttagtcatgatcctgccattattt

SEQ ID NO: 254501 - DNA, 25 bp, Homo sapien
gttctgtaggatgtctccaggctac

SEQ ID NO: 254502 - DNA, 25 bp, Homo sapien
gtctccaggctacttaaacatattt

SEQ ID NO: 254503 - DNA, 25 bp, Homo sapien
agtgacttcttagtaagcccctaca

SEQ ID NO: 254504 - DNA, 25 bp, Homo sapien
agcccctacattatatgcatacttg

SEQ ID NO: 254505 - DNA, 25 bp, Homo sapien
cacttctacctaacagggacctcaa

SEQ ID NO: 254506 - DNA, 25 bp, Homo sapien
gggacctcaacttaagtctcttcag

SEQ ID NO: 254507 - DNA, 25 bp, Homo sapien
gtcctgtgggatgagtcagggttct

SEQ ID NO: 254508 - DNA, 25 bp, Homo sapien
ggctgcaccccctggacaggatgat

SEQ ID NO: 254509 - DNA, 25 bp, Homo sapien
gctgcaccccctggacaggatgatc

SEQ ID NO: 254510 - DNA, 25 bp, Homo sapien
ctgcaccccctggacaggatgatcg

SEQ ID NO: 254511 - DNA, 25 bp, Homo sapien
tgcaccccctggacaggatgatcgg

SEQ ID NO: 254512 - DNA, 25 bp, Homo sapien
gcaccccctggacaggatgatcggc

SEQ ID NO: 254513 - DNA, 25 bp, Homo sapien
caccccctggacaggatgatcggct

SEQ ID NO: 254514 - DNA, 25 bp, Homo sapien
accccctggacaggatgatcggctg

SEQ ID NO: 254515 - DNA, 25 bp, Homo sapien
ccccctggacaggatgatcggctga

SEQ ID NO: 254516 - DNA, 25 bp, Homo sapien
cccctggacaggatgatcggctgaa

SEQ ID NO: 254517 - DNA, 25 bp, Homo sapien
ccctggacaggatgatcggctgaat

SEQ ID NO: 254518 - DNA, 25 bp, Homo sapien
ttctcctggagacgcaactcaagtt

SEQ ID NO: 254519 - DNA, 25 bp, Homo sapien
tggagacgcaactcaagttctcatg

SEQ ID NO: 254520 - DNA, 25 bp, Homo sapien
tggagttttcattgtctcgtgcaat

SEQ ID NO: 254521 - DNA, 25 bp, Homo sapien
gttttcattgtctcgtgcaatgcca

SEQ ID NO: 254522 - DNA, 25 bp, Homo sapien
tcattgtctcgtgcaatgccatcga

SEQ ID NO: 254523 - DNA, 25 bp, Homo sapien
gcaatgccatcgaccttgaatttca

SEQ ID NO: 254524 - DNA, 25 bp, Homo sapien
aatgccatcgaccttgaatttcagc

SEQ ID NO: 254525 - DNA, 25 bp, Homo sapien
gccatcgaccttgaatttcagcata

SEQ ID NO: 254526 - DNA, 25 bp, Homo sapien
cttgaatttcagcataggacccata

SEQ ID NO: 254527 - DNA, 25 bp, Homo sapien
ttcagcataggacccatatgaagtg

SEQ ID NO: 254528 - DNA, 25 bp, Homo sapien
agatctggctgtggcccgcgaagcc

SEQ ID NO: 254529 - DNA, 25 bp, Homo sapien
gtgccttcaagtccttcgatgatgt

SEQ ID NO: 254530 - DNA, 25 bp, Homo sapien
tccttcgatgatgtctggaggctct

SEQ ID NO: 254531 - DNA, 25 bp, Homo sapien
aggctctgggaggttctgctgacgg

SEQ ID NO: 254532 - DNA, 25 bp, Homo sapien
ctggaccccgtgtttgctgagcacc

SEQ ID NO: 254533 - DNA, 25 bp, Homo sapien
tggtggcctacagcatgctgcagat

SEQ ID NO: 254534 - DNA, 25 bp, Homo sapien
ctacagcatgctgcagatggtgcgg

SEQ ID NO: 254535 - DNA, 25 bp, Homo sapien
gtttgctgagcacctaaaagggaag

SEQ ID NO: 254536 - DNA, 25 bp, Homo sapien
tgcaacaacctcatcgaccttgatg

SEQ ID NO: 254537 - DNA, 25 bp, Homo sapien
aacctcatcgaccttgatgctgatg

SEQ ID NO: 254538 - DNA, 25 bp, Homo sapien
ctgatgagctgatctctgccgcctg

SEQ ID NO: 254539 - DNA, 25 bp, Homo sapien
gcttctgcttccagcgtgccttcaa

SEQ ID NO: 254540 - DNA, 25 bp, Homo sapien
aatcaggcacaaattgaccaattct

SEQ ID NO: 254541 - DNA, 25 bp, Homo sapien
aattctcatgccatttgcaaagcaa

SEQ ID NO: 254542 - DNA, 25 bp, Homo sapien
ggatgatgaaacctggctaactaaa

SEQ ID NO: 254543 - DNA, 25 bp, Homo sapien
gaaacctggctaactaaattaatgg

SEQ ID NO: 254544 - DNA, 25 bp, Homo sapien
aatggatcatttcactaaatcagat

SEQ ID NO: 254545 - DNA, 25 bp, Homo sapien
tattaacttgtctccctagaagctg

SEQ ID NO: 254546 - DNA, 25 bp, Homo sapien
gagtttttaagtcctgatctgttct

SEQ ID NO: 254547 - DNA, 25 bp, Homo sapien
agaagctgagatttttcgccttaaa

SEQ ID NO: 254548 - DNA, 25 bp, Homo sapien
tttttcgccttaaatgacatggttg

SEQ ID NO: 254549 - DNA, 25 bp, Homo sapien
gtcctgatctgttctaaggtgcctt

SEQ ID NO: 254550 - DNA, 25 bp, Homo sapien
gtgattctgaagttcttaatttgca

SEQ ID NO: 254551 - DNA, 25 bp, Homo sapien
gtgcctggtcccatgtacttgaagt

SEQ ID NO: 254552 - DNA, 25 bp, Homo sapien
tgcctggtcccatgtacttgaagtc

SEQ ID NO: 254553 - DNA, 25 bp, Homo sapien
gcctggtcccatgtacttgaagtca

SEQ ID NO: 254554 - DNA, 25 bp, Homo sapien
gatattgtataatggcaacagttgt

SEQ ID NO: 254555 - DNA, 25 bp, Homo sapien
attgtataatggcaacagttgttat

SEQ ID NO: 254556 - DNA, 25 bp, Homo sapien
taatggcaacagttgttatactgta

SEQ ID NO: 254557 - DNA, 25 bp, Homo sapien
ttcttcaaatattcagcctcatcta

SEQ ID NO: 254558 - DNA, 25 bp, Homo sapien
tcttcaaatattcagcctcatctag

SEQ ID NO: 254559 - DNA, 25 bp, Homo sapien
cttcaaatattcagcctcatctagt

SEQ ID NO: 254560 - DNA, 25 bp, Homo sapien
ttcaaatattcagcctcatctagtt

SEQ ID NO: 254561 - DNA, 25 bp, Homo sapien
tcaaatattcagcctcatctagttg

SEQ ID NO: 254562 - DNA, 25 bp, Homo sapien
gtacagcggaatcaaggaagtgccc

SEQ ID NO: 254563 - DNA, 25 bp, Homo sapien
aagtgccccaggagccacgtccaag

SEQ ID NO: 254564 - DNA, 25 bp, Homo sapien
ggagccacgtccaagtgtgttcttc

SEQ ID NO: 254565 - DNA, 25 bp, Homo sapien
tcctgacctgtctgaattcccattt

SEQ ID NO: 254566 - DNA, 25 bp, Homo sapien
aattcccatttgcaccagtttccct

SEQ ID NO: 254567 - DNA, 25 bp, Homo sapien
taagccattccctggccatgagtta

SEQ ID NO: 254568 - DNA, 25 bp, Homo sapien
ccatgagttactacagtttcggtca

SEQ ID NO: 254569 - DNA, 25 bp, Homo sapien
gttactacagtttcggtcattcatt

SEQ ID NO: 254570 - DNA, 25 bp, Homo sapien
cagtttcggtcattcattcagtgga

SEQ ID NO: 254571 - DNA, 25 bp, Homo sapien
cagtggaaaagcgaccagggacaga

SEQ ID NO: 254572 - DNA, 25 bp, Homo sapien
cgccataaaggtcacctggcccgag

SEQ ID NO: 254573 - DNA, 25 bp, Homo sapien
gtgactttaaaatcattccatacaa

SEQ ID NO: 254574 - DNA, 25 bp, Homo sapien
aatcattccatacaaatccctcttt

SEQ ID NO: 254575 - DNA, 25 bp, Homo sapien
ttccatacaaatccctctttttcag

SEQ ID NO: 254576 - DNA, 25 bp, Homo sapien
gttatgatcatgtattggtaggagc

SEQ ID NO: 254577 - DNA, 25 bp, Homo sapien
ggagcatgattagaaaccaagtttc

SEQ ID NO: 254578 - DNA, 25 bp, Homo sapien
tttcttgggccgcagtttcatattc

SEQ ID NO: 254579 - DNA, 25 bp, Homo sapien
cttgggccgcagtttcatattcttg

SEQ ID NO: 254580 - DNA, 25 bp, Homo sapien
ttgatgctcaactaacctatgaaat

SEQ ID NO: 254581 - DNA, 25 bp, Homo sapien
atgtgatactgaaggtcaactggca

SEQ ID NO: 254582 - DNA, 25 bp, Homo sapien
gtcaactggcaggttttgccacagt

SEQ ID NO: 254583 - DNA, 25 bp, Homo sapien
ctggcaggttttgccacagtgtaaa

SEQ ID NO: 254584 - DNA, 25 bp, Homo sapien
gggcaggtggacgtacatctgttcc

SEQ ID NO: 254585 - DNA, 25 bp, Homo sapien
aggtggacgtacatctgttcctgga

SEQ ID NO: 254586 - DNA, 25 bp, Homo sapien
tggacgtacatctgttcctggaact

SEQ ID NO: 254587 - DNA, 25 bp, Homo sapien
aactgcaggcccgagaacacggtgt

SEQ ID NO: 254588 - DNA, 25 bp, Homo sapien
ctgcaggcccgagaacacggtgtga

SEQ ID NO: 254589 - DNA, 25 bp, Homo sapien
ccgagaacacggtgtgaggatcgct

SEQ ID NO: 254590 - DNA, 25 bp, Homo sapien
acatcttggcgaggtttctctaggg

SEQ ID NO: 254591 - DNA, 25 bp, Homo sapien
cttggcgaggtttctctagggtgca

SEQ ID NO: 254592 - DNA, 25 bp, Homo sapien
gcgaggtttctctagggtgcatgcc

SEQ ID NO: 254593 - DNA, 25 bp, Homo sapien
gaggtttctctagggtgcatgccca

SEQ ID NO: 254594 - DNA, 25 bp, Homo sapien
gtttctctagggtgcatgcccagga

SEQ ID NO: 254595 - DNA, 25 bp, Homo sapien
ctggaatctgtcctcgtgtccacct

SEQ ID NO: 254596 - DNA, 25 bp, Homo sapien
tggaatctgtcctcgtgtccacctg

SEQ ID NO: 254597 - DNA, 25 bp, Homo sapien
ggaatctgtcctcgtgtccacctgg

SEQ ID NO: 254598 - DNA, 25 bp, Homo sapien
gaatctgtcctcgtgtccacctggc

SEQ ID NO: 254599 - DNA, 25 bp, Homo sapien
tctgtcctcgtgtccacctggcctt

SEQ ID NO: 254600 - DNA, 25 bp, Homo sapien
tcgtgtccacctggccttcgctcct

SEQ ID NO: 254601 - DNA, 25 bp, Homo sapien
ttcgctggggtctccacgggtgagg

SEQ ID NO: 254602 - DNA, 25 bp, Homo sapien
gctggggtctccacgggtgaggctg

SEQ ID NO: 254603 - DNA, 25 bp, Homo sapien
gtgaggctggggaacgccacctctt

SEQ ID NO: 254604 - DNA, 25 bp, Homo sapien
gaggctggggaacgccacctcttcc

SEQ ID NO: 254605 - DNA, 25 bp, Homo sapien
aggggctaatgactgcacactgggc

SEQ ID NO: 254606 - DNA, 25 bp, Homo sapien
tgagtggctctctgcgcacagtgtt

SEQ ID NO: 254607 - DNA, 25 bp, Homo sapien
tctctgcgcacagtgttcgggacta

SEQ ID NO: 254608 - DNA, 25 bp, Homo sapien
tgcgcacagtgttcgggactacccc

SEQ ID NO: 254609 - DNA, 25 bp, Homo sapien
cagcgctgagtgagagccagcccaa

SEQ ID NO: 254610 - DNA, 25 bp, Homo sapien
tgagtgagagccagcccaagttcgg

SEQ ID NO: 254611 - DNA, 25 bp, Homo sapien
aagttcggccacttcctcgagttca

SEQ ID NO: 254612 - DNA, 25 bp, Homo sapien
gccacttcctcgagttcatggatga

SEQ ID NO: 254613 - DNA, 25 bp, Homo sapien
catggatgagttctgccaggagccc

SEQ ID NO: 254614 - DNA, 25 bp, Homo sapien
ccacagccagtgactcacaaggcta

SEQ ID NO: 254615 - DNA, 25 bp, Homo sapien
gactcacaaggctagagctgtgcat

SEQ ID NO: 254616 - DNA, 25 bp, Homo sapien
ttaccggcagctggtgagtggctct

SEQ ID NO: 254617 - DNA, 25 bp, Homo sapien
tttctttttacccttagatattgca

SEQ ID NO: 254618 - DNA, 25 bp, Homo sapien
tttttacccttagatattgcatccg

SEQ ID NO: 254619 - DNA, 25 bp, Homo sapien
ttacccttagatattgcatccgtgg

SEQ ID NO: 254620 - DNA, 25 bp, Homo sapien
acccttagatattgcatccgtggta

SEQ ID NO: 254621 - DNA, 25 bp, Homo sapien
ccttagatattgcatccgtggtatt

SEQ ID NO: 254622 - DNA, 25 bp, Homo sapien
tagatattgcatccgtggtatttca

SEQ ID NO: 254623 - DNA, 25 bp, Homo sapien
gatattgcatccgtggtatttcagg

SEQ ID NO: 254624 - DNA, 25 bp, Homo sapien
atattgcatccgtggtatttcaggg

SEQ ID NO: 254625 - DNA, 25 bp, Homo sapien
gcatccgtggtatttcaggggtata

SEQ ID NO: 254626 - DNA, 25 bp, Homo sapien
aatattggaatttaggagctatttt

SEQ ID NO: 254627 - DNA, 25 bp, Homo sapien
aaatattactaagtggtatcttttg

SEQ ID NO: 254628 - DNA, 25 bp, Homo sapien
atcaagtctaaatagccgctcgcag

SEQ ID NO: 254629 - DNA, 25 bp, Homo sapien
taaatagccgctcgcaggatctggg

SEQ ID NO: 254630 - DNA, 25 bp, Homo sapien
gttttcagaaacctgatctgatctt

SEQ ID NO: 254631 - DNA, 25 bp, Homo sapien
ctgatctttataaaaagtgctcccc

SEQ ID NO: 254632 - DNA, 25 bp, Homo sapien
agcgctgtctggctcggcaaggagg

SEQ ID NO: 254633 - DNA, 25 bp, Homo sapien
gctgaaactggagagcccctgggaa

SEQ ID NO: 254634 - DNA, 25 bp, Homo sapien
ctggagagcccctgggaaggctctt

SEQ ID NO: 254635 - DNA, 25 bp, Homo sapien
cactgaagagtgtgctccagctggg

SEQ ID NO: 254636 - DNA, 25 bp, Homo sapien
gaaggctcttgtgggccaggtggca

SEQ ID NO: 254637 - DNA, 25 bp, Homo sapien
gaatggatacctgtgaaatggtgga

SEQ ID NO: 254638 - DNA, 25 bp, Homo sapien
tggtggagtgtgcatcaagtctaaa

SEQ ID NO: 254639 - DNA, 25 bp, Homo sapien
tgcttacctgggtggcataagaagt

SEQ ID NO: 254640 - DNA, 25 bp, Homo sapien
gcttacctgggtggcataagaagtg

SEQ ID NO: 254641 - DNA, 25 bp, Homo sapien
cttacctgggtggcataagaagtgt

SEQ ID NO: 254642 - DNA, 25 bp, Homo sapien
ttacctgggtggcataagaagtgtg

SEQ ID NO: 254643 - DNA, 25 bp, Homo sapien
tacctgggtggcataagaagtgtga

SEQ ID NO: 254644 - DNA, 25 bp, Homo sapien
acctgggtggcataagaagtgtgat

SEQ ID NO: 254645 - DNA, 25 bp, Homo sapien
cctgggtggcataagaagtgtgata

SEQ ID NO: 254646 - DNA, 25 bp, Homo sapien
ctgggtggcataagaagtgtgatag

SEQ ID NO: 254647 - DNA, 25 bp, Homo sapien
aagaagtgtgatagaggccgggcgc

SEQ ID NO: 254648 - DNA, 25 bp, Homo sapien
agaagtgtgatagaggccgggcgca

SEQ ID NO: 254649 - DNA, 25 bp, Homo sapien
acacacctgttaattgcagctactt

SEQ ID NO: 254650 - DNA, 25 bp, Homo sapien
agatttgtggcaacttttcatcgag

SEQ ID NO: 254651 - DNA, 25 bp, Homo sapien
ggcaacttttcatcgagtgagtcta

SEQ ID NO: 254652 - DNA, 25 bp, Homo sapien
gagtgagtctattggcatcattttt

SEQ ID NO: 254653 - DNA, 25 bp, Homo sapien
tgcaagagcatatgctcacttcctg

SEQ ID NO: 254654 - DNA, 25 bp, Homo sapien
attgcacactcctatctttctgaac

SEQ ID NO: 254655 - DNA, 25 bp, Homo sapien
cctgcctctgtgacagcatttttta

SEQ ID NO: 254656 - DNA, 25 bp, Homo sapien
tgctattgcacacttgactaaaatg

SEQ ID NO: 254657 - DNA, 25 bp, Homo sapien
cacacaccatacacacttgtttcat

SEQ ID NO: 254658 - DNA, 25 bp, Homo sapien
acacttgtttcattgcgcttcattt

SEQ ID NO: 254659 - DNA, 25 bp, Homo sapien
cgcttcattttattgcacttctcga

SEQ ID NO: 254660 - DNA, 25 bp, Homo sapien
tattgcacttctcgaagaatgtgtt

SEQ ID NO: 254661 - DNA, 25 bp, Homo sapien
ctctctctgactttcgcaatatggg

SEQ ID NO: 254662 - DNA, 25 bp, Homo sapien
actttcgcaatatgggtcactgtgt

SEQ ID NO: 254663 - DNA, 25 bp, Homo sapien
gtcactgtgtagacgactcacccag

SEQ ID NO: 254664 - DNA, 25 bp, Homo sapien
tcacccagtctgcatgtggttcaag

SEQ ID NO: 254665 - DNA, 25 bp, Homo sapien
tgcatgtggttcaaggccccagagt

SEQ ID NO: 254666 - DNA, 25 bp, Homo sapien
aaggccccagagttctctcagtgat

SEQ ID NO: 254667 - DNA, 25 bp, Homo sapien
agagttctctcagtgatgctaatgg

SEQ ID NO: 254668 - DNA, 25 bp, Homo sapien
atgctaatgggtgatccgtgctgga

SEQ ID NO: 254669 - DNA, 25 bp, Homo sapien
ggtgatccgtgctggagtttgtaat

SEQ ID NO: 254670 - DNA, 25 bp, Homo sapien
gagtttgtaattggcacctctcacc

SEQ ID NO: 254671 - DNA, 25 bp, Homo sapien
aacattgccagattaagcactagtg

SEQ ID NO: 254672 - DNA, 25 bp, Homo sapien
tcctacttttacttgacttttgact

SEQ ID NO: 254673 - DNA, 25 bp, Homo sapien
aggtgcagtccaatgaatcaatctt

SEQ ID NO: 254674 - DNA, 25 bp, Homo sapien
aatcttcttctttattgtagccctt

SEQ ID NO: 254675 - DNA, 25 bp, Homo sapien
tattgtagcccttttgatgtttaaa

SEQ ID NO: 254676 - DNA, 25 bp, Homo sapien
aatgatctcagtatcctctttcttg

SEQ ID NO: 254677 - DNA, 25 bp, Homo sapien
gcagtgttcaatatagtaccagtaa

SEQ ID NO: 254678 - DNA, 25 bp, Homo sapien
gtaccagtaactacaggtggctact

SEQ ID NO: 254679 - DNA, 25 bp, Homo sapien
cagtatcctctttcttgtatttttc

SEQ ID NO: 254680 - DNA, 25 bp, Homo sapien
tttcttaattcaggatctgggcctt

SEQ ID NO: 254681 - DNA, 25 bp, Homo sapien
atctgggccttttgggttctgcagc

SEQ ID NO: 254682 - DNA, 25 bp, Homo sapien
ggttctgcagccgtatgttgcaaat

SEQ ID NO: 254683 - DNA, 25 bp, Homo sapien
ataagtctaatttgagcattctgca

SEQ ID NO: 254684 - DNA, 25 bp, Homo sapien
agtctaatttgagcattctgcaata

SEQ ID NO: 254685 - DNA, 25 bp, Homo sapien
ttcctatcaggaaaactaatgcaga

SEQ ID NO: 254686 - DNA, 25 bp, Homo sapien
tacatgtataattcaaaactcaact

SEQ ID NO: 254687 - DNA, 25 bp, Homo sapien
caactttgtatgtataggagtctgc

SEQ ID NO: 254688 - DNA, 25 bp, Homo sapien
gtatgtataggagtctgctggttgt

SEQ ID NO: 254689 - DNA, 25 bp, Homo sapien
tgtataggagtctgctggttgtttg

SEQ ID NO: 254690 - DNA, 25 bp, Homo sapien
gagcacataataaaagtccgtcatt

SEQ ID NO: 254691 - DNA, 25 bp, Homo sapien
cataataaaagtccgtcattcccca

SEQ ID NO: 254692 - DNA, 25 bp, Homo sapien
ctacacacacagcttattttgggaa

SEQ ID NO: 254693 - DNA, 25 bp, Homo sapien
tacacacacagcttattttgggaaa

SEQ ID NO: 254694 - DNA, 25 bp, Homo sapien
aggccttcccagaagtagaccatac

SEQ ID NO: 254695 - DNA, 25 bp, Homo sapien
gtagaccatactgccttgaacttgt

SEQ ID NO: 254696 - DNA, 25 bp, Homo sapien
gctttctccatacatttttaatgca

SEQ ID NO: 254697 - DNA, 25 bp, Homo sapien
aattgagttcagaagcctccaagaa

SEQ ID NO: 254698 - DNA, 25 bp, Homo sapien
aacagaaaggatcccctttctccag

SEQ ID NO: 254699 - DNA, 25 bp, Homo sapien
tggtctatcagtacctcttcctgaa

SEQ ID NO: 254700 - DNA, 25 bp, Homo sapien
tcttcctgaatctggtacccatctg

SEQ ID NO: 254701 - DNA, 25 bp, Homo sapien
tgccttctccagttcattctaaaca

SEQ ID NO: 254702 - DNA, 25 bp, Homo sapien
ttcattctaaacactgctgggacta

SEQ ID NO: 254703 - DNA, 25 bp, Homo sapien
gactagggtttttccatcaggagca

SEQ ID NO: 254704 - DNA, 25 bp, Homo sapien
gcaaatggaatccaggccttcccag

SEQ ID NO: 254705 - DNA, 25 bp, Homo sapien
atctgggcatcccttggttcactca

SEQ ID NO: 254706 - DNA, 25 bp, Homo sapien
gcatcccttggttcactcaagttga

SEQ ID NO: 254707 - DNA, 25 bp, Homo sapien
cttggttcactcaagttgacacaaa

SEQ ID NO: 254708 - DNA, 25 bp, Homo sapien
gagactggccttactctgaaattag

SEQ ID NO: 254709 - DNA, 25 bp, Homo sapien
aatggagactaggtagagacaacta

SEQ ID NO: 254710 - DNA, 25 bp, Homo sapien
agacaactagttctctaccaaacat

SEQ ID NO: 254711 - DNA, 25 bp, Homo sapien
actagttctctaccaaacatgtaca

SEQ ID NO: 254712 - DNA, 25 bp, Homo sapien
acatgtacagttattcgttggtatc

SEQ ID NO: 254713 - DNA, 25 bp, Homo sapien
cagttattcgttggtatctgaaggg

SEQ ID NO: 254714 - DNA, 25 bp, Homo sapien
tctgcaggtgctcaagtcatttata

SEQ ID NO: 254715 - DNA, 25 bp, Homo sapien
acctttgcacatcttccatatactt

SEQ ID NO: 254716 - DNA, 25 bp, Homo sapien
tttctgcgttccttatgctgcagtc

SEQ ID NO: 254717 - DNA, 25 bp, Homo sapien
atgctgcagtctacttagcttcttc

SEQ ID NO: 254718 - DNA, 25 bp, Homo sapien
cttcttccgtccctgctatttttgg

SEQ ID NO: 254719 - DNA, 25 bp, Homo sapien
ttcttagccacattctaatttctag

SEQ ID NO: 254720 - DNA, 25 bp, Homo sapien
aaatcacctaataagctgacagaga

SEQ ID NO: 254721 - DNA, 25 bp, Homo sapien
gagaaacccgttaatctggtacata

SEQ ID NO: 254722 - DNA, 25 bp, Homo sapien
ggtacataaacatctagtttctgct

SEQ ID NO: 254723 - DNA, 25 bp, Homo sapien
actaaatatccagttccatttttgg

SEQ ID NO: 254724 - DNA, 25 bp, Homo sapien
ttccatttttggtcatctcttgcta

SEQ ID NO: 254725 - DNA, 25 bp, Homo sapien
tggtcatctcttgctatcatagttc

SEQ ID NO: 254726 - DNA, 25 bp, Homo sapien
cttgctatcatagttcttccaataa

SEQ ID NO: 254727 - DNA, 25 bp, Homo sapien
ttaagagttggtcatctggaaagaa

SEQ ID NO: 254728 - DNA, 25 bp, Homo sapien
agaagaaaactcagtaggcaccttc

SEQ ID NO: 254729 - DNA, 25 bp, Homo sapien
ttgttttttcttgtggtgtccggat

SEQ ID NO: 254730 - DNA, 25 bp, Homo sapien
ttttcttgtggtgtccggatcagca

SEQ ID NO: 254731 - DNA, 25 bp, Homo sapien
gtccggatcagcatcctgcatgtga

SEQ ID NO: 254732 - DNA, 25 bp, Homo sapien
ctgcatgtgagattcatccacgttg

SEQ ID NO: 254733 - DNA, 25 bp, Homo sapien
gttcagttctcttcatggttatgtc

SEQ ID NO: 254734 - DNA, 25 bp, Homo sapien
ggttatgtctggtttcattctatga

SEQ ID NO: 254735 - DNA, 25 bp, Homo sapien
aatttatctattctacacttgggtg

SEQ ID NO: 254736 - DNA, 25 bp, Homo sapien
tgggtggcagctgcttcagattttt

SEQ ID NO: 254737 - DNA, 25 bp, Homo sapien
aaagtgaactacaggcagggcatga

SEQ ID NO: 254738 - DNA, 25 bp, Homo sapien
ctccccaaactctgcagtaacagag

SEQ ID NO: 254739 - DNA, 25 bp, Homo sapien
ctgcagtaacagagtcaacaagaca

SEQ ID NO: 254740 - DNA, 25 bp, Homo sapien
gtcaacaagacaatggcttaaagat

SEQ ID NO: 254741 - DNA, 25 bp, Homo sapien
agagaccagttgatcggtcacacaa

SEQ ID NO: 254742 - DNA, 25 bp, Homo sapien
cagttgatcggtcacacaagctgtt

SEQ ID NO: 254743 - DNA, 25 bp, Homo sapien
acacttcagagggctctggcagggt

SEQ ID NO: 254744 - DNA, 25 bp, Homo sapien
gccacagagagtaaaggtctagcac

SEQ ID NO: 254745 - DNA, 25 bp, Homo sapien
gagagtaaaggtctagcacacccat

SEQ ID NO: 254746 - DNA, 25 bp, Homo sapien
gtaaaggtctagcacacccattgtg

SEQ ID NO: 254747 - DNA, 25 bp, Homo sapien
aggtctagcacacccattgtggaga

SEQ ID NO: 254748 - DNA, 25 bp, Homo sapien
ctagcacacccattgtggagatatt

SEQ ID NO: 254749 - DNA, 25 bp, Homo sapien
catggaaccaacagtcagcatcttg

SEQ ID NO: 254750 - DNA, 25 bp, Homo sapien
cagcatcttggtttcggacacgtga

SEQ ID NO: 254751 - DNA, 25 bp, Homo sapien
ggacacgtgaagaaattcatctcag

SEQ ID NO: 254752 - DNA, 25 bp, Homo sapien
aattcatctcagactgtgtatccta

SEQ ID NO: 254753 - DNA, 25 bp, Homo sapien
tgtgtatcctaaatcaggcacttgc

SEQ ID NO: 254754 - DNA, 25 bp, Homo sapien
aggcacttgctgaatctaactacat

SEQ ID NO: 254755 - DNA, 25 bp, Homo sapien
ctacatgagtgagaccagttgacaa

SEQ ID NO: 254756 - DNA, 25 bp, Homo sapien
cagttgacaacacatggagcagaca

SEQ ID NO: 254757 - DNA, 25 bp, Homo sapien
ggagcagacatgagctgttctcagt

SEQ ID NO: 254758 - DNA, 25 bp, Homo sapien
agtgagtcctacacaaattcctgac

SEQ ID NO: 254759 - DNA, 25 bp, Homo sapien
gcagtgatttcttacataggaatag

SEQ ID NO: 254760 - DNA, 25 bp, Homo sapien
taaatggcaaccaaaaactggcttt

SEQ ID NO: 254761 - DNA, 25 bp, Homo sapien
atttatccagaacatccatagccca

SEQ ID NO: 254762 - DNA, 25 bp, Homo sapien
tccagaacatccatagcccaataag

SEQ ID NO: 254763 - DNA, 25 bp, Homo sapien
agcccaataagcttttgtctaagtt

SEQ ID NO: 254764 - DNA, 25 bp, Homo sapien
aagttgtcatcttacttactcacaa

SEQ ID NO: 254765 - DNA, 25 bp, Homo sapien
gtcatcttacttactcacaaaggag

SEQ ID NO: 254766 - DNA, 25 bp, Homo sapien
gtagattgtaacagcctccttggac

SEQ ID NO: 254767 - DNA, 25 bp, Homo sapien
aacagcctccttggacaacattgtg

SEQ ID NO: 254768 - DNA, 25 bp, Homo sapien
caacattgtgagtctgttttaacat

SEQ ID NO: 254769 - DNA, 25 bp, Homo sapien
ttaatatactcttacaacctaggaa

SEQ ID NO: 254770 - DNA, 25 bp, Homo sapien
actcttacaacctaggaatctcctg

SEQ ID NO: 254771 - DNA, 25 bp, Homo sapien
gtgcctggtcccatgtacttgaagt

SEQ ID NO: 254772 - DNA, 25 bp, Homo sapien
gcctggtcccatgtacttgaagtca

SEQ ID NO: 254773 - DNA, 25 bp, Homo sapien
gtacttgaagtcatcactaacaaaa

SEQ ID NO: 254774 - DNA, 25 bp, Homo sapien
gatattgtataatggcaacagttgt

SEQ ID NO: 254775 - DNA, 25 bp, Homo sapien
taatggcaacagttgttatactgta

SEQ ID NO: 254776 - DNA, 25 bp, Homo sapien
tatactgtactttctatttgtattt

SEQ ID NO: 254777 - DNA, 25 bp, Homo sapien
ttcttcaaatattcagcctcatcta

SEQ ID NO: 254778 - DNA, 25 bp, Homo sapien
ttcaaatattcagcctcatctagtt

SEQ ID NO: 254779 - DNA, 25 bp, Homo sapien
cagcctcatctagttgaatctgaag

SEQ ID NO: 254780 - DNA, 25 bp, Homo sapien
aagatgtggacctgctgatgaagag

SEQ ID NO: 254781 - DNA, 25 bp, Homo sapien
gaagagggctgattgtatctaactt

SEQ ID NO: 254782 - DNA, 25 bp, Homo sapien
agcacaattgactatcatatgggat

SEQ ID NO: 254783 - DNA, 25 bp, Homo sapien
aatgaatttgaatccttaggttact

SEQ ID NO: 254784 - DNA, 25 bp, Homo sapien
gaatccttaggttactccatgtatg

SEQ ID NO: 254785 - DNA, 25 bp, Homo sapien
ggttactccatgtatgaaattcccc

SEQ ID NO: 254786 - DNA, 25 bp, Homo sapien
aattcaaggcttaggtgtaaaaatg

SEQ ID NO: 254787 - DNA, 25 bp, Homo sapien
aaaatctgggctactatatataaaa

SEQ ID NO: 254788 - DNA, 25 bp, Homo sapien
aaatgtatggattggcaggagcttc

SEQ ID NO: 254789 - DNA, 25 bp, Homo sapien
ggcaggagcttcttaagcaaatcta

SEQ ID NO: 254790 - DNA, 25 bp, Homo sapien
taagcaaatctagagacccagaaat

SEQ ID NO: 254791 - DNA, 25 bp, Homo sapien
aaatttcactgtttgctgagaaggg

SEQ ID NO: 254792 - DNA, 25 bp, Homo sapien
tagcacaagcacaattgactatcat

SEQ ID NO: 254793 - DNA, 25 bp, Homo sapien
gtgcttcctgaataactagactctt

SEQ ID NO: 254794 - DNA, 25 bp, Homo sapien
gaataactagactcttgtgcaagct

SEQ ID NO: 254795 - DNA, 25 bp, Homo sapien
tatttgaatttagtgggacctcttg

SEQ ID NO: 254796 - DNA, 25 bp, Homo sapien
gacctcttggaagtagtctgtcctt

SEQ ID NO: 254797 - DNA, 25 bp, Homo sapien
cttggaagtagtctgtccttgtgtg

SEQ ID NO: 254798 - DNA, 25 bp, Homo sapien
accatcaccatggatgagagctgat

SEQ ID NO: 254799 - DNA, 25 bp, Homo sapien
ggataactgagtccaaagaactgtg

SEQ ID NO: 254800 - DNA, 25 bp, Homo sapien
agaactgtggaacttccctcagggc

SEQ ID NO: 254801 - DNA, 25 bp, Homo sapien
tcagggctggaaggtccctgctcct

SEQ ID NO: 254802 - DNA, 25 bp, Homo sapien
atgtctccctacacttagtgaatgg

SEQ ID NO: 254803 - DNA, 25 bp, Homo sapien
tgaatggttgacagtcccaacaccc

SEQ ID NO: 254804 - DNA, 25 bp, Homo sapien
agccaaatgctatggaaccaaagaa

SEQ ID NO: 254805 - DNA, 25 bp, Homo sapien
gatgactcacatctgtttaacttga

SEQ ID NO: 254806 - DNA, 25 bp, Homo sapien
acatctgtttaacttgaactcttat

SEQ ID NO: 254807 - DNA, 25 bp, Homo sapien
gaactcttatgcaaaaatcctaatc

SEQ ID NO: 254808 - DNA, 25 bp, Homo sapien
aggcatataggagtgatggttcccc

SEQ ID NO: 254809 - DNA, 25 bp, Homo sapien
aaaaatcctaatcgtgtcgcaacac

SEQ ID NO: 254810 - DNA, 25 bp, Homo sapien
gtcgcaacacgggaccagttactgt

SEQ ID NO: 254811 - DNA, 25 bp, Homo sapien
ccagttactgtgtctatcgggtcat

SEQ ID NO: 254812 - DNA, 25 bp, Homo sapien
gtgtctatcgggtcatttgggaatg

SEQ ID NO: 254813 - DNA, 25 bp, Homo sapien
cttgcagccattgacatttctttct

SEQ ID NO: 254814 - DNA, 25 bp, Homo sapien
ttccactatttggtgttgggcactg

SEQ ID NO: 254815 - DNA, 25 bp, Homo sapien
atatttaatccaaattagggctatg

SEQ ID NO: 254816 - DNA, 25 bp, Homo sapien
taatccaaattagggctatgtaaat

SEQ ID NO: 254817 - DNA, 25 bp, Homo sapien
aatatataaggaactgacactgcag

SEQ ID NO: 254818 - DNA, 25 bp, Homo sapien
ggaactgacactgcagatatactaa

SEQ ID NO: 254819 - DNA, 25 bp, Homo sapien
gacactgcagatatactaagtcaag

SEQ ID NO: 254820 - DNA, 25 bp, Homo sapien
gatatactaagtcaagagttctgag

SEQ ID NO: 254821 - DNA, 25 bp, Homo sapien
ctaagtcaagagttctgagtataga

SEQ ID NO: 254822 - DNA, 25 bp, Homo sapien
tacagactttgaaagcaaatgatgt

SEQ ID NO: 254823 - DNA, 25 bp, Homo sapien
gatgtaattcaacactcattttctg

SEQ ID NO: 254824 - DNA, 25 bp, Homo sapien
gtaattcaacactcattttctggtg

SEQ ID NO: 254825 - DNA, 25 bp, Homo sapien
cactcattttctggtgtttcttcat

SEQ ID NO: 254826 - DNA, 25 bp, Homo sapien
gcgcgcgcactgattgccgcagcta

SEQ ID NO: 254827 - DNA, 25 bp, Homo sapien
tcgccgcccgggaccgggtgacatt

SEQ ID NO: 254828 - DNA, 25 bp, Homo sapien
acattgaggttttcgtctatcgccg

SEQ ID NO: 254829 - DNA, 25 bp, Homo sapien
aggttttcgtctatcgccgctgggc

SEQ ID NO: 254830 - DNA, 25 bp, Homo sapien
gccgctgggccgatagggcttcttt

SEQ ID NO: 254831 - DNA, 25 bp, Homo sapien
ggccgatagggcttctttttaagat

SEQ ID NO: 254832 - DNA, 25 bp, Homo sapien
ttggctttccaagtaagatttttgt

SEQ ID NO: 254833 - DNA, 25 bp, Homo sapien
gcctgcttttctcctggaatttttt

SEQ ID NO: 254834 - DNA, 25 bp, Homo sapien
tttttgtttttggtcgaagaagcag

SEQ ID NO: 254835 - DNA, 25 bp, Homo sapien
gaattagccctgagatgtcagccct

SEQ ID NO: 254836 - DNA, 25 bp, Homo sapien
tagccctgagatgtcagccctgtgc

SEQ ID NO: 254837 - DNA, 25 bp, Homo sapien
tcatggtttttaccccatctggctg

SEQ ID NO: 254838 - DNA, 25 bp, Homo sapien
taccccatctggctgaatctacagg

SEQ ID NO: 254839 - DNA, 25 bp, Homo sapien
aatctacaggcccatctcaagtaga

SEQ ID NO: 254840 - DNA, 25 bp, Homo sapien
acaggcccatctcaagtagagaggc

SEQ ID NO: 254841 - DNA, 25 bp, Homo sapien
gtagagaggccagactataaaagat

SEQ ID NO: 254842 - DNA, 25 bp, Homo sapien
tataaaagatagttggtttccacag

SEQ ID NO: 254843 - DNA, 25 bp, Homo sapien
aagacagccagggaagtgactctca

SEQ ID NO: 254844 - DNA, 25 bp, Homo sapien
gaagtgactctcagaaacccaggaa

SEQ ID NO: 254845 - DNA, 25 bp, Homo sapien
gactctcagaaacccaggaacctta

SEQ ID NO: 254846 - DNA, 25 bp, Homo sapien
caggaaccttataagctaagctgct

SEQ ID NO: 254847 - DNA, 25 bp, Homo sapien
ataagctaagctgcttctcattctt

SEQ ID NO: 254848 - DNA, 25 bp, Homo sapien
ccaggaatctggttagctttgctta

SEQ ID NO: 254849 - DNA, 25 bp, Homo sapien
tctggttagctttgcttaacacatt

SEQ ID NO: 254850 - DNA, 25 bp, Homo sapien
aaacttgtttgaatgcatgagtaca

SEQ ID NO: 254851 - DNA, 25 bp, Homo sapien
gcatgagtacagtcactagtagcat

SEQ ID NO: 254852 - DNA, 25 bp, Homo sapien
agggataggacttgagtctaatcct

SEQ ID NO: 254853 - DNA, 25 bp, Homo sapien
gagtctaatcctaactcttagcagt

SEQ ID NO: 254854 - DNA, 25 bp, Homo sapien
aactcttagcagttacactggatga

SEQ ID NO: 254855 - DNA, 25 bp, Homo sapien
gttacactggatgacattagagcaa

SEQ ID NO: 254856 - DNA, 25 bp, Homo sapien
gagcaaatggttctttacgtctaca

SEQ ID NO: 254857 - DNA, 25 bp, Homo sapien
gatgtaataatttccatatcaacta

SEQ ID NO: 254858 - DNA, 25 bp, Homo sapien
gatgtacagtgctaattccaatgaa

SEQ ID NO: 254859 - DNA, 25 bp, Homo sapien
attttatgtccagacatcacccctg

SEQ ID NO: 254860 - DNA, 25 bp, Homo sapien
atcacccctgaaacactgtactgta

SEQ ID NO: 254861 - DNA, 25 bp, Homo sapien
ctgtactgtactatcttgctctgag

SEQ ID NO: 254862 - DNA, 25 bp, Homo sapien
tcttgctctgagtagtatcaactgg

SEQ ID NO: 254863 - DNA, 25 bp, Homo sapien
gtagtatcaactggatcgtctcata

SEQ ID NO: 254864 - DNA, 25 bp, Homo sapien
tggatcgtctcatatttgcctcatt

SEQ ID NO: 254865 - DNA, 25 bp, Homo sapien
gatgttgtaatctaaacaagtgcct

SEQ ID NO: 254866 - DNA, 25 bp, Homo sapien
acaagtgccttatgtttattgctaa

SEQ ID NO: 254867 - DNA, 25 bp, Homo sapien
ttattgctaagaactggtgttacca

SEQ ID NO: 254868 - DNA, 25 bp, Homo sapien
tggtgttaccaacccttttgagaag

SEQ ID NO: 254869 - DNA, 25 bp, Homo sapien
ggtctcttgacctgtattaacatag

SEQ ID NO: 254870 - DNA, 25 bp, Homo sapien
gggctgtgccccacgattccaggag

SEQ ID NO: 254871 - DNA, 25 bp, Homo sapien
gattccaggagttccgccgtgccta

SEQ ID NO: 254872 - DNA, 25 bp, Homo sapien
gagttccgccgtgcctacgaggctg

SEQ ID NO: 254873 - DNA, 25 bp, Homo sapien
acccctgcgaggtggcgctgcactg

SEQ ID NO: 254874 - DNA, 25 bp, Homo sapien
actgctttggaggtgatgggactat

SEQ ID NO: 254875 - DNA, 25 bp, Homo sapien
tgggactatcaataagaactctgtt

SEQ ID NO: 254876 - DNA, 25 bp, Homo sapien
attcgtaccccactgcgctgtggcg

SEQ ID NO: 254877 - DNA, 25 bp, Homo sapien
ttcgtaccccactgcgctgtggcgt

SEQ ID NO: 254878 - DNA, 25 bp, Homo sapien
caccttcctcttcatgggctggagc

SEQ ID NO: 254879 - DNA, 25 bp, Homo sapien
accttcctcttcatgggctggagcc

SEQ ID NO: 254880 - DNA, 25 bp, Homo sapien
tcttcatgggctggagccgctttgg

SEQ ID NO: 254881 - DNA, 25 bp, Homo sapien
actgttgcttcagacgctgataaga

SEQ ID NO: 254882 - DNA, 25 bp, Homo sapien
cttcagacgctgataagattgtaga

SEQ ID NO: 254883 - DNA, 25 bp, Homo sapien
gacgctgataagattgtagaagata

SEQ ID NO: 254884 - DNA, 25 bp, Homo sapien
gaagatagggaagctgtagtttact

SEQ ID NO: 254885 - DNA, 25 bp, Homo sapien
gaagctgtagtttactatctagttt

SEQ ID NO: 254886 - DNA, 25 bp, Homo sapien
tatctagttttttaatgcacatgaa

SEQ ID NO: 254887 - DNA, 25 bp, Homo sapien
gtatttcttaactgggcaaaatgga

SEQ ID NO: 254888 - DNA, 25 bp, Homo sapien
atggaaactttgtaactgaagccag

SEQ ID NO: 254889 - DNA, 25 bp, Homo sapien
aactgaagccagtcaaggtgaatac

SEQ ID NO: 254890 - DNA, 25 bp, Homo sapien
aaggtgaatacacagaaaatcattt

SEQ ID NO: 254891 - DNA, 25 bp, Homo sapien
gataaaccgttttaagagagttgag

SEQ ID NO: 254892 - DNA, 25 bp, Homo sapien
agaagccagtcccaagagtggcatt

SEQ ID NO: 254893 - DNA, 25 bp, Homo sapien
agtggcattggttagcatatctcaa

SEQ ID NO: 254894 - DNA, 25 bp, Homo sapien
tacagtgggagaagcctcttagctc

SEQ ID NO: 254895 - DNA, 25 bp, Homo sapien
gagaagcctcttagctcagctccag

SEQ ID NO: 254896 - DNA, 25 bp, Homo sapien
ttagctcagctccagttatttctct

SEQ ID NO: 254897 - DNA, 25 bp, Homo sapien
agctccagttatttctctattgtag

SEQ ID NO: 254898 - DNA, 25 bp, Homo sapien
gaaaacatactccacatggactcaa

SEQ ID NO: 254899 - DNA, 25 bp, Homo sapien
catggactcaataaatcttgggtga

SEQ ID NO: 254900 - DNA, 25 bp, Homo sapien
gaattcagctaggatccagaagtga

SEQ ID NO: 254901 - DNA, 25 bp, Homo sapien
agaagtgatgctgttacgtgacgtc

SEQ ID NO: 254902 - DNA, 25 bp, Homo sapien
tgctgttacgtgacgtcttcaacct

SEQ ID NO: 254903 - DNA, 25 bp, Homo sapien
tggaatttgggatcctcttctgtct

SEQ ID NO: 254904 - DNA, 25 bp, Homo sapien
gaatttgggatcctcttctgtctct

SEQ ID NO: 254905 - DNA, 25 bp, Homo sapien
ttctgtctcttgagttgaaatcaga

SEQ ID NO: 254906 - DNA, 25 bp, Homo sapien
cttgagttgaaatcagaggctgctt

SEQ ID NO: 254907 - DNA, 25 bp, Homo sapien
gagttgaaatcagaggctgcttgcc

SEQ ID NO: 254908 - DNA, 25 bp, Homo sapien
gttgaaatcagaggctgcttgccgg

SEQ ID NO: 254909 - DNA, 25 bp, Homo sapien
cagacagatcaccagatgtcgggag

SEQ ID NO: 254910 - DNA, 25 bp, Homo sapien
acagatcaccagatgtcgggagtta

SEQ ID NO: 254911 - DNA, 25 bp, Homo sapien
gatcaccagatgtcgggagttagaa

SEQ ID NO: 254912 - DNA, 25 bp, Homo sapien
accagatgtcgggagttagaaacca

SEQ ID NO: 254913 - DNA, 25 bp, Homo sapien
ccagatgtcgggagttagaaaccag

SEQ ID NO: 254914 - DNA, 25 bp, Homo sapien
aaggctttgtaggtgaggtttccat

SEQ ID NO: 254915 - DNA, 25 bp, Homo sapien
gaggtttccatggaccttcaaaggt

SEQ ID NO: 254916 - DNA, 25 bp, Homo sapien
catggaccttcaaaggtgccagcag

SEQ ID NO: 254917 - DNA, 25 bp, Homo sapien
aactccctccttgcaaggaaaggag

SEQ ID NO: 254918 - DNA, 25 bp, Homo sapien
gagatgtccagccaatgatgcccgg

SEQ ID NO: 254919 - DNA, 25 bp, Homo sapien
aatgatgcccggcttctgaggccca

SEQ ID NO: 254920 - DNA, 25 bp, Homo sapien
gctggtgtcccgaagatgaaatgaa

SEQ ID NO: 254921 - DNA, 25 bp, Homo sapien
ctgcctatctcagttggcgggaggt

SEQ ID NO: 254922 - DNA, 25 bp, Homo sapien
tggatgtgcaagaccagccactgga

SEQ ID NO: 254923 - DNA, 25 bp, Homo sapien
agccactggaggtagctctctggag

SEQ ID NO: 254924 - DNA, 25 bp, Homo sapien
tggagtcaaagagaggcctgctttt

SEQ ID NO: 254925 - DNA, 25 bp, Homo sapien
gggcactaaaaggaagccggccaga

SEQ ID NO: 254926 - DNA, 25 bp, Homo sapien
cactaaaaggaagccggccagaggt

SEQ ID NO: 254927 - DNA, 25 bp, Homo sapien
gggccaagagcccttacagccttct

SEQ ID NO: 254928 - DNA, 25 bp, Homo sapien
gtcctcccggaactgggccggagcg

SEQ ID NO: 254929 - DNA, 25 bp, Homo sapien
ggagcgcagagaacgcagtgtgaga

SEQ ID NO: 254930 - DNA, 25 bp, Homo sapien
tctcgcaccctgtgaacactttgaa

SEQ ID NO: 254931 - DNA, 25 bp, Homo sapien
gaagcaacgggctaagcgctgctat

SEQ ID NO: 254932 - DNA, 25 bp, Homo sapien
agcaacgggctaagcgctgctattt

SEQ ID NO: 254933 - DNA, 25 bp, Homo sapien
gcaacgggctaagcgctgctatttg

SEQ ID NO: 254934 - DNA, 25 bp, Homo sapien
aacgggctaagcgctgctatttggg

SEQ ID NO: 254935 - DNA, 25 bp, Homo sapien
aagcgctgctatttggggcactaaa

SEQ ID NO: 254936 - DNA, 25 bp, Homo sapien
tgacctccattcgtaccccactgcg

SEQ ID NO: 254937 - DNA, 25 bp, Homo sapien
attcgtaccccactgcgctgtggcg

SEQ ID NO: 254938 - DNA, 25 bp, Homo sapien
ttcgtaccccactgcgctgtggcgt

SEQ ID NO: 254939 - DNA, 25 bp, Homo sapien
tcgtaccccactgcgctgtggcgtc

SEQ ID NO: 254940 - DNA, 25 bp, Homo sapien
cgtaccccactgcgctgtggcgtcc

SEQ ID NO: 254941 - DNA, 25 bp, Homo sapien
gtaccccactgcgctgtggcgtcca

SEQ ID NO: 254942 - DNA, 25 bp, Homo sapien
taccccactgcgctgtggcgtccac

SEQ ID NO: 254943 - DNA, 25 bp, Homo sapien
accccactgcgctgtggcgtccacc

SEQ ID NO: 254944 - DNA, 25 bp, Homo sapien
ccccactgcgctgtggcgtccaccc

SEQ ID NO: 254945 - DNA, 25 bp, Homo sapien
cccactgcgctgtggcgtccacccg

SEQ ID NO: 254946 - DNA, 25 bp, Homo sapien
tccacccgggcccaggcaccttcct

SEQ ID NO: 254947 - DNA, 25 bp, Homo sapien
ggaacccagaactagttgcccggct

SEQ ID NO: 254948 - DNA, 25 bp, Homo sapien
gatacagctggccaatgaggaatat

SEQ ID NO: 254949 - DNA, 25 bp, Homo sapien
tataaacggatcacccgcaacgtca

SEQ ID NO: 254950 - DNA, 25 bp, Homo sapien
ccgcaacgtcacttgtcaggataca

SEQ ID NO: 254951 - DNA, 25 bp, Homo sapien
aagacatggtgggactctcagcgac

SEQ ID NO: 254952 - DNA, 25 bp, Homo sapien
gactctcagcgacctgggaaagcaa

SEQ ID NO: 254953 - DNA, 25 bp, Homo sapien
tcattgaaggctctggtcatcacca

SEQ ID NO: 254954 - DNA, 25 bp, Homo sapien
atttcattgtcacggtggttgctgc

SEQ ID NO: 254955 - DNA, 25 bp, Homo sapien
gtctgcacttaccttggaagccaat

SEQ ID NO: 254956 - DNA, 25 bp, Homo sapien
acagaaatggcctcgcgggtgctag

SEQ ID NO: 254957 - DNA, 25 bp, Homo sapien
gtgctagctgcattgatcgtcgcct

SEQ ID NO: 254958 - DNA, 25 bp, Homo sapien
ggctctttaaatggggtatctcctc

SEQ ID NO: 254959 - DNA, 25 bp, Homo sapien
aacccatcttgggatccccaagaag

SEQ ID NO: 254960 - DNA, 25 bp, Homo sapien
cgcgagggcctggactaactcagat

SEQ ID NO: 254961 - DNA, 25 bp, Homo sapien
ggactaactcagatggtgctcggct

SEQ ID NO: 254962 - DNA, 25 bp, Homo sapien
actcagatggtgctcggctggacaa

SEQ ID NO: 254963 - DNA, 25 bp, Homo sapien
gaggatgattcctaactcttctgtt

SEQ ID NO: 254964 - DNA, 25 bp, Homo sapien
gatgattcctaactcttctgtttgg

SEQ ID NO: 254965 - DNA, 25 bp, Homo sapien
attcctaactcttctgtttggtggg

SEQ ID NO: 254966 - DNA, 25 bp, Homo sapien
tttggtggggctctttttatagcac

SEQ ID NO: 254967 - DNA, 25 bp, Homo sapien
ttccttgacctagatccaggaggct

SEQ ID NO: 254968 - DNA, 25 bp, Homo sapien
tgacctagatccaggaggctcaggg

SEQ ID NO: 254969 - DNA, 25 bp, Homo sapien
gtattttttgtgtgcaaagtcttag

SEQ ID NO: 254970 - DNA, 25 bp, Homo sapien
ttttgtgtgcaaagtcttagaattg

SEQ ID NO: 254971 - DNA, 25 bp, Homo sapien
gtgtgcaaagtcttagaattggatt

SEQ ID NO: 254972 - DNA, 25 bp, Homo sapien
gtcttagaattggatttataacatt

SEQ ID NO: 254973 - DNA, 25 bp, Homo sapien
gaatatgatcatttctccatcataa

SEQ ID NO: 254974 - DNA, 25 bp, Homo sapien
atgatcatttctccatcataaagga

SEQ ID NO: 254975 - DNA, 25 bp, Homo sapien
gatcatttctccatcataaaggaaa

SEQ ID NO: 254976 - DNA, 25 bp, Homo sapien
catttctccatcataaaggaaagaa

SEQ ID NO: 254977 - DNA, 25 bp, Homo sapien
aagaagagacttcattgtgtgtgtg

SEQ ID NO: 254978 - DNA, 25 bp, Homo sapien
cgagatagagtttcactgttgtcac

SEQ ID NO: 254979 - DNA, 25 bp, Homo sapien
gtcacccagggctggtctcagctca

SEQ ID NO: 254980 - DNA, 25 bp, Homo sapien
atcgaactttctttgttgctgctag

SEQ ID NO: 254981 - DNA, 25 bp, Homo sapien
gttgctgctagttaaaacttgttgc

SEQ ID NO: 254982 - DNA, 25 bp, Homo sapien
tctcttgtgtccaggtatgcagcaa

SEQ ID NO: 254983 - DNA, 25 bp, Homo sapien
gcaatttcaccttaaagatactgtt

SEQ ID NO: 254984 - DNA, 25 bp, Homo sapien
ctgttggttttacagatgctctcca

SEQ ID NO: 254985 - DNA, 25 bp, Homo sapien
atgctctccaacctattttctataa

SEQ ID NO: 254986 - DNA, 25 bp, Homo sapien
gtggtgaactcagataacaaacttc

SEQ ID NO: 254987 - DNA, 25 bp, Homo sapien
tctaaactggttctgcttctaagac

SEQ ID NO: 254988 - DNA, 25 bp, Homo sapien
ctctcgcacgcagtctagagatgga

SEQ ID NO: 254989 - DNA, 25 bp, Homo sapien
tagagatggactgagccttgcttct

SEQ ID NO: 254990 - DNA, 25 bp, Homo sapien
tggactgagccttgcttctcactgg

SEQ ID NO: 254991 - DNA, 25 bp, Homo sapien
taagggcgcttcttgctctctgaaa

SEQ ID NO: 254992 - DNA, 25 bp, Homo sapien
ttgctctctgaaatgccctgctaaa

SEQ ID NO: 254993 - DNA, 25 bp, Homo sapien
tgaaatgccctgctaaatgcttctc

SEQ ID NO: 254994 - DNA, 25 bp, Homo sapien
aaatgcttctcttaattatttgaat

SEQ ID NO: 254995 - DNA, 25 bp, Homo sapien
aaatgaagtcgaatctgccctcaca

SEQ ID NO: 254996 - DNA, 25 bp, Homo sapien
gaatctgccctcacagagacacaag

SEQ ID NO: 254997 - DNA, 25 bp, Homo sapien
aattcatacactattgcatttttaa

SEQ ID NO: 254998 - DNA, 25 bp, Homo sapien
gattgtattgtgtattttcggttaa

SEQ ID NO: 254999 - DNA, 25 bp, Homo sapien
tgcagcaccatattttataacccag

SEQ ID NO: 255000 - DNA, 25 bp, Homo sapien
attttataacccagctttagcattt

SEQ ID NO: 255001 - DNA, 25 bp, Homo sapien
ctccttcttttaagggcgcttcttg

SEQ ID NO: 255002 - DNA, 25 bp, Homo sapien
aagcaagtatttatataacctaggg

SEQ ID NO: 255003 - DNA, 25 bp, Homo sapien
gataagaagatggatttggcaataa

SEQ ID NO: 255004 - DNA, 25 bp, Homo sapien
aagttatatatccatgtcataccac

SEQ ID NO: 255005 - DNA, 25 bp, Homo sapien
gaggtggcaaaaacactaagcagta

SEQ ID NO: 255006 - DNA, 25 bp, Homo sapien
tatatccatgtcataccacatgcaa

SEQ ID NO: 255007 - DNA, 25 bp, Homo sapien
aatacatttgcaacatactttctct

SEQ ID NO: 255008 - DNA, 25 bp, Homo sapien
tttgcaacatactttctctttaatt

SEQ ID NO: 255009 - DNA, 25 bp, Homo sapien
tttctctttaatttgaagggctaat

SEQ ID NO: 255010 - DNA, 25 bp, Homo sapien
tgaagggctaattttctcaatataa

SEQ ID NO: 255011 - DNA, 25 bp, Homo sapien
gtcataccacatgcaaaacacagct

SEQ ID NO: 255012 - DNA, 25 bp, Homo sapien
accacatgcaaaacacagctgccag

SEQ ID NO: 255013 - DNA, 25 bp, Homo sapien
ccttctgatccctgggcgccaatat

SEQ ID NO: 255014 - DNA, 25 bp, Homo sapien
actttcccatgaagcctaactgcgt

SEQ ID NO: 255015 - DNA, 25 bp, Homo sapien
atgaagcctaactgcgtgaacaccc

SEQ ID NO: 255016 - DNA, 25 bp, Homo sapien
ttagcagtgattttgcccttccccg

SEQ ID NO: 255017 - DNA, 25 bp, Homo sapien
gtaatgctgtcccacttataactgt

SEQ ID NO: 255018 - DNA, 25 bp, Homo sapien
cacttataactgtgctctacttagc

SEQ ID NO: 255019 - DNA, 25 bp, Homo sapien
gctctacttagcattctcagggatc

SEQ ID NO: 255020 - DNA, 25 bp, Homo sapien
gggatcataccttaatgttttcagt

SEQ ID NO: 255021 - DNA, 25 bp, Homo sapien
agcacacacctcttcttatcaggct

SEQ ID NO: 255022 - DNA, 25 bp, Homo sapien
ttatcaggcttcctccacttagcaa

SEQ ID NO: 255023 - DNA, 25 bp, Homo sapien
tagcaacttgctaacggccacctct

SEQ ID NO: 255024 - DNA, 25 bp, Homo sapien
gaagtgctctgctctaggctgggtc

SEQ ID NO: 255025 - DNA, 25 bp, Homo sapien
gcctgttctctggttggcttttgca

SEQ ID NO: 255026 - DNA, 25 bp, Homo sapien
tggcttttgcaggagggcagcttac

SEQ ID NO: 255027 - DNA, 25 bp, Homo sapien
ggcagcttacgtgtttgtcaaccag

SEQ ID NO: 255028 - DNA, 25 bp, Homo sapien
aaccagttagaaagccagttcctgt

SEQ ID NO: 255029 - DNA, 25 bp, Homo sapien
ttcctgtgggtcgagtttaggcctt

SEQ ID NO: 255030 - DNA, 25 bp, Homo sapien
gcctttttggccatagttgagaatt

SEQ ID NO: 255031 - DNA, 25 bp, Homo sapien
ttttgacttgggatactgggttgtt

SEQ ID NO: 255032 - DNA, 25 bp, Homo sapien
cgcctggctcggttatgggaatagc

SEQ ID NO: 255033 - DNA, 25 bp, Homo sapien
ggaatagccgtcagtgcatccatgt

SEQ ID NO: 255034 - DNA, 25 bp, Homo sapien
atgtctgtgaccaacacccagccag

SEQ ID NO: 255035 - DNA, 25 bp, Homo sapien
gatgatcggctgaatgtaacagagg

SEQ ID NO: 255036 - DNA, 25 bp, Homo sapien
gtaacagaggaactaacgtccaacg

SEQ ID NO: 255037 - DNA, 25 bp, Homo sapien
gaggaactaacgtccaacgacaaga

SEQ ID NO: 255038 - DNA, 25 bp, Homo sapien
gtccaacgacaagacgaggattctc

SEQ ID NO: 255039 - DNA, 25 bp, Homo sapien
gaggattctcaacgtccagtccagg

SEQ ID NO: 255040 - DNA, 25 bp, Homo sapien
tcaacgtccagtccaggctcacaga

SEQ ID NO: 255041 - DNA, 25 bp, Homo sapien
gctcacagacgccaaacgcattaac

SEQ ID NO: 255042 - DNA, 25 bp, Homo sapien
aacgcattaactggcgaacagtgct

SEQ ID NO: 255043 - DNA, 25 bp, Homo sapien
taactggcgaacagtgctgagtggc

SEQ ID NO: 255044 - DNA, 25 bp, Homo sapien
gttctcctggagttcgctgaggagc

SEQ ID NO: 255045 - DNA, 25 bp, Homo sapien
gagcagctgcgagccgaccatgtct

SEQ ID NO: 255046 - DNA, 25 bp, Homo sapien
aatccttaggatgggctttggttga

SEQ ID NO: 255047 - DNA, 25 bp, Homo sapien
gattcaccctagtccctgcttgttc

SEQ ID NO: 255048 - DNA, 25 bp, Homo sapien
gtggccatccaaaagtcataaccgc

SEQ ID NO: 255049 - DNA, 25 bp, Homo sapien
aagtcataaccgctaccattggcag

SEQ ID NO: 255050 - DNA, 25 bp, Homo sapien
agcccataacccaaaactactgatc

SEQ ID NO: 255051 - DNA, 25 bp, Homo sapien
aggacaattctgttgggccatctca

SEQ ID NO: 255052 - DNA, 25 bp, Homo sapien
caaagcttactgtgaggtggctgaa

SEQ ID NO: 255053 - DNA, 25 bp, Homo sapien
gtggctgaaagcttcactgggactg

SEQ ID NO: 255054 - DNA, 25 bp, Homo sapien
gcttgttccagaattgtctttcaaa

SEQ ID NO: 255055 - DNA, 25 bp, Homo sapien
tggaagatttatcccttagctactg

SEQ ID NO: 255056 - DNA, 25 bp, Homo sapien
cttagctactgggagtgttgttaga

SEQ ID NO: 255057 - DNA, 25 bp, Homo sapien
ttcttatgctcttataaaacatgtg

SEQ ID NO: 255058 - DNA, 25 bp, Homo sapien
aaaacatgtgttctggactcacgtt

SEQ ID NO: 255059 - DNA, 25 bp, Homo sapien
atgtgttctggactcacgttggctt

SEQ ID NO: 255060 - DNA, 25 bp, Homo sapien
gactcacgttggcttccatttcttc

SEQ ID NO: 255061 - DNA, 25 bp, Homo sapien
agatggaagaggtggctgctgtatt

SEQ ID NO: 255062 - DNA, 25 bp, Homo sapien
ttggatcaaggatatgagcagagat

SEQ ID NO: 255063 - DNA, 25 bp, Homo sapien
tgaggcagcggctgtaatggatcaa

SEQ ID NO: 255064 - DNA, 25 bp, Homo sapien
aatggatcaaggctatgaacatctt

SEQ ID NO: 255065 - DNA, 25 bp, Homo sapien
aaggctatgaacatcttgtgaagta

SEQ ID NO: 255066 - DNA, 25 bp, Homo sapien
gaagtaggatgttaagtctgcaaat

SEQ ID NO: 255067 - DNA, 25 bp, Homo sapien
cacatctattacaaacttcatttta

SEQ ID NO: 255068 - DNA, 25 bp, Homo sapien
tagcatgaaagccaccttcacttca

SEQ ID NO: 255069 - DNA, 25 bp, Homo sapien
ttcacttcagccaccacttggacag

SEQ ID NO: 255070 - DNA, 25 bp, Homo sapien
ctgttgtgagcgctaatgcaccttc

SEQ ID NO: 255071 - DNA, 25 bp, Homo sapien
gagcgctaatgcaccttctgaaaag

SEQ ID NO: 255072 - DNA, 25 bp, Homo sapien
tttcttccaataggtcactgctgtc

SEQ ID NO: 255073 - DNA, 25 bp, Homo sapien
cttctcacacttgcttgaggtgcat

SEQ ID NO: 255074 - DNA, 25 bp, Homo sapien
ttgcttgaggtgcattttactttgt

SEQ ID NO: 255075 - DNA, 25 bp, Homo sapien
tttcccctgttactaaaagccacat

SEQ ID NO: 255076 - DNA, 25 bp, Homo sapien
tcactgctgtctgttctgacttatt

SEQ ID NO: 255077 - DNA, 25 bp, Homo sapien
gtctgttctgacttattgctaattc

SEQ ID NO: 255078 - DNA, 25 bp, Homo sapien
ttttctgacctctctagagcctaga

SEQ ID NO: 255079 - DNA, 25 bp, Homo sapien
ggaaacagaacttgcatagagtaca

SEQ ID NO: 255080 - DNA, 25 bp, Homo sapien
gattctaacattctctgaaacactt

SEQ ID NO: 255081 - DNA, 25 bp, Homo sapien
gagatgtttgagctaccatttatat

SEQ ID NO: 255082 - DNA, 25 bp, Homo sapien
gattctgttttcatggatagattca

SEQ ID NO: 255083 - DNA, 25 bp, Homo sapien
gatagattcaactaagtcttccaag

SEQ ID NO: 255084 - DNA, 25 bp, Homo sapien
tgttcgtcgtcgtttttccttcata

SEQ ID NO: 255085 - DNA, 25 bp, Homo sapien
gtttttccttcatacgttatctagt

SEQ ID NO: 255086 - DNA, 25 bp, Homo sapien
tacgttatctagttatgcagcactg

SEQ ID NO: 255087 - DNA, 25 bp, Homo sapien
tatgcagcactggaaacagactgaa

SEQ ID NO: 255088 - DNA, 25 bp, Homo sapien
aaaccagttttatcagacctatgtg

SEQ ID NO: 255089 - DNA, 25 bp, Homo sapien
atcagacctatgtgtaataagactc

SEQ ID NO: 255090 - DNA, 25 bp, Homo sapien
gtgctttcacacaatccaacttggc

SEQ ID NO: 255091 - DNA, 25 bp, Homo sapien
ctgcaactgtgtgtgagatgagctg

SEQ ID NO: 255092 - DNA, 25 bp, Homo sapien
tgtgtgtgagatgagctgaccacca

SEQ ID NO: 255093 - DNA, 25 bp, Homo sapien
ctggaacagaatatggcagctggaa

SEQ ID NO: 255094 - DNA, 25 bp, Homo sapien
gctgctgtggtaatcagaagctaca

SEQ ID NO: 255095 - DNA, 25 bp, Homo sapien
gaagctacaatatgtgacacgactg

SEQ ID NO: 255096 - DNA, 25 bp, Homo sapien
gtgacacgactgtgaggctgacctg

SEQ ID NO: 255097 - DNA, 25 bp, Homo sapien
aggctgacctgtaactgggcctcaa

SEQ ID NO: 255098 - DNA, 25 bp, Homo sapien
cattcatgcaacctggaagggcatc

SEQ ID NO: 255099 - DNA, 25 bp, Homo sapien
acctggaagggcatcaagactcttg

SEQ ID NO: 255100 - DNA, 25 bp, Homo sapien
caagactcttggtcagggcctgaag

SEQ ID NO: 255101 - DNA, 25 bp, Homo sapien
acctgagtaggccactataaactga

SEQ ID NO: 255102 - DNA, 25 bp, Homo sapien
aactgaaaactctggtttctgtcca

SEQ ID NO: 255103 - DNA, 25 bp, Homo sapien
ctctggtttctgtccatatttgcag

SEQ ID NO: 255104 - DNA, 25 bp, Homo sapien
gagtaaatgttgaaatgcccaatct

SEQ ID NO: 255105 - DNA, 25 bp, Homo sapien
aaatgcccaatctgatggttccttg

SEQ ID NO: 255106 - DNA, 25 bp, Homo sapien
aaaagggagcctgacatgccaggtg

SEQ ID NO: 255107 - DNA, 25 bp, Homo sapien
gattgttggagtcagatctccctgc

SEQ ID NO: 255108 - DNA, 25 bp, Homo sapien
agatctccctgcaggaaagcccggg

SEQ ID NO: 255109 - DNA, 25 bp, Homo sapien
ggaaccacagatacacccacaaggt

SEQ ID NO: 255110 - DNA, 25 bp, Homo sapien
tacacccacaaggtgagctgcagga

SEQ ID NO: 255111 - DNA, 25 bp, Homo sapien
gagctgcaggatggatgctgcccac

SEQ ID NO: 255112 - DNA, 25 bp, Homo sapien
aagctggacggagaatggccttgat

SEQ ID NO: 255113 - DNA, 25 bp, Homo sapien
gctggacggagaatggccttgatga

SEQ ID NO: 255114 - DNA, 25 bp, Homo sapien
agaaggcctcagaagatcaaactat

SEQ ID NO: 255115 - DNA, 25 bp, Homo sapien
agaagatcaaactattccgagctaa

SEQ ID NO: 255116 - DNA, 25 bp, Homo sapien
gaagatcaaactattccgagctaaa

SEQ ID NO: 255117 - DNA, 25 bp, Homo sapien
ggtttgaaccgatggcaaagaagtt

SEQ ID NO: 255118 - DNA, 25 bp, Homo sapien
gaaagagtatcagcgatggaagcca

SEQ ID NO: 255119 - DNA, 25 bp, Homo sapien
aagagtatcagcgatggaagccaaa

SEQ ID NO: 255120 - DNA, 25 bp, Homo sapien
gagtatcagcgatggaagccaaagt

SEQ ID NO: 255121 - DNA, 25 bp, Homo sapien
tatcagcgatggaagccaaagtgaa

SEQ ID NO: 255122 - DNA, 25 bp, Homo sapien
cgatggaagccaaagtgaatgaaat

SEQ ID NO: 255123 - DNA, 25 bp, Homo sapien
gaggaatagatgactttctttcttt

SEQ ID NO: 255124 - DNA, 25 bp, Homo sapien
agaaatcacttctgagtaggatgta

SEQ ID NO: 255125 - DNA, 25 bp, Homo sapien
gtaggatgtatattttcgttggatt

SEQ ID NO: 255126 - DNA, 25 bp, Homo sapien
gttatttctttagaaccctccacag

SEQ ID NO: 255127 - DNA, 25 bp, Homo sapien
atttctttagaaccctccacagcaa

SEQ ID NO: 255128 - DNA, 25 bp, Homo sapien
agaaccctccacagcaacatgcaag

SEQ ID NO: 255129 - DNA, 25 bp, Homo sapien
gcaacatgcaagaccatggagttaa

SEQ ID NO: 255130 - DNA, 25 bp, Homo sapien
aagaaacccagagacctttatcaat

SEQ ID NO: 255131 - DNA, 25 bp, Homo sapien
acccagagacctttatcaattaatt

SEQ ID NO: 255132 - DNA, 25 bp, Homo sapien
tcaattaattgtactgtttgtgaat

SEQ ID NO: 255133 - DNA, 25 bp, Homo sapien
gatcctcttaaaacgtttatattct

SEQ ID NO: 255134 - DNA, 25 bp, Homo sapien
ctctgggagcctaaaccaggctgca

SEQ ID NO: 255135 - DNA, 25 bp, Homo sapien
taaaccaggctgcatcggaggccag

SEQ ID NO: 255136 - DNA, 25 bp, Homo sapien
atcggaggccaggacccggatcatt

SEQ ID NO: 255137 - DNA, 25 bp, Homo sapien
aggacccggatcattcactgtgata

SEQ ID NO: 255138 - DNA, 25 bp, Homo sapien
ggatcattcactgtgataccctgcc

SEQ ID NO: 255139 - DNA, 25 bp, Homo sapien
gtgcgctcagagacacgggcaagca

SEQ ID NO: 255140 - DNA, 25 bp, Homo sapien
agagacacgggcaagcatgcctctt

SEQ ID NO: 255141 - DNA, 25 bp, Homo sapien
accagacctttgctgggcctaaagg

SEQ ID NO: 255142 - DNA, 25 bp, Homo sapien
ctcagtctagggatctggccacaga

SEQ ID NO: 255143 - DNA, 25 bp, Homo sapien
tgtgaaccaacacagacacccaagc

SEQ ID NO: 255144 - DNA, 25 bp, Homo sapien
gacacccaagcagagcaatcagtta

SEQ ID NO: 255145 - DNA, 25 bp, Homo sapien
aactttcacaaagtatctcctgaaa

SEQ ID NO: 255146 - DNA, 25 bp, Homo sapien
gtatctcctgaaaactcctgtcttt

SEQ ID NO: 255147 - DNA, 25 bp, Homo sapien
aactcctgtctttgtacaaaattca

SEQ ID NO: 255148 - DNA, 25 bp, Homo sapien
ggttgtattcggattggtgtcttca

SEQ ID NO: 255149 - DNA, 25 bp, Homo sapien
attggatataataattctgcctaga

SEQ ID NO: 255150 - DNA, 25 bp, Homo sapien
gattggtgtcttcaagggtcccttt

SEQ ID NO: 255151 - DNA, 25 bp, Homo sapien
tcaagggtccctttcagttcgcagt

SEQ ID NO: 255152 - DNA, 25 bp, Homo sapien
tttcagttcgcagtccaaggtgcca

SEQ ID NO: 255153 - DNA, 25 bp, Homo sapien
agttcgcagtccaaggtgccaggga

SEQ ID NO: 255154 - DNA, 25 bp, Homo sapien
aattctgcctagatttttaactgag

SEQ ID NO: 255155 - DNA, 25 bp, Homo sapien
gggacaaaatgtaatgtgttttcaa

SEQ ID NO: 255156 - DNA, 25 bp, Homo sapien
tagagacgttctccagccagaagag

SEQ ID NO: 255157 - DNA, 25 bp, Homo sapien
gagatattcagtcaccacagttccc

SEQ ID NO: 255158 - DNA, 25 bp, Homo sapien
cacagttcccaaatggcctaggaat

SEQ ID NO: 255159 - DNA, 25 bp, Homo sapien
atatcaccattactccccaatggga

SEQ ID NO: 255160 - DNA, 25 bp, Homo sapien
ccccgacagtctcagcatggtgtga

SEQ ID NO: 255161 - DNA, 25 bp, Homo sapien
tggcaggtaccaatcactcatcccg

SEQ ID NO: 255162 - DNA, 25 bp, Homo sapien
ctcatcccgctcagtgaagacacag

SEQ ID NO: 255163 - DNA, 25 bp, Homo sapien
gacacagtgttcagctacggaagcc

SEQ ID NO: 255164 - DNA, 25 bp, Homo sapien
aagccataaggcaggccgagcttct

SEQ ID NO: 255165 - DNA, 25 bp, Homo sapien
gagcttctgcccatccggaggaaat

SEQ ID NO: 255166 - DNA, 25 bp, Homo sapien
gaaatctcagctatccaacggcggt

SEQ ID NO: 255167 - DNA, 25 bp, Homo sapien
tggtagcctcaccactgagatacta

SEQ ID NO: 255168 - DNA, 25 bp, Homo sapien
gcctcaccactgagatactaactag

SEQ ID NO: 255169 - DNA, 25 bp, Homo sapien
actgagatactaactagacctagac

SEQ ID NO: 255170 - DNA, 25 bp, Homo sapien
gacctagactaggagctttatcagg

SEQ ID NO: 255171 - DNA, 25 bp, Homo sapien
agactaggagctttatcaggttcta

SEQ ID NO: 255172 - DNA, 25 bp, Homo sapien
acacatggaaatctgtccactcgga

SEQ ID NO: 255173 - DNA, 25 bp, Homo sapien
ggaaatctgtccactcggaatacct

SEQ ID NO: 255174 - DNA, 25 bp, Homo sapien
aaatctgtccactcggaatacctct

SEQ ID NO: 255175 - DNA, 25 bp, Homo sapien
tgtccactcggaatacctctgtttt

SEQ ID NO: 255176 - DNA, 25 bp, Homo sapien
cacttccagtgatggtaagagatct

SEQ ID NO: 255177 - DNA, 25 bp, Homo sapien
gatctgttatgaaacgaaacacccc

SEQ ID NO: 255178 - DNA, 25 bp, Homo sapien
gcttcaagtgcttcctgttttttgc

SEQ ID NO: 255179 - DNA, 25 bp, Homo sapien
ggtagcagtcatttcaagctgaaca

SEQ ID NO: 255180 - DNA, 25 bp, Homo sapien
ggtaatcgagcacttggtttttgta

SEQ ID NO: 255181 - DNA, 25 bp, Homo sapien
gtttttgtagtacctcctgtggcca

SEQ ID NO: 255182 - DNA, 25 bp, Homo sapien
tggccatctccacagtgtcatattt

SEQ ID NO: 255183 - DNA, 25 bp, Homo sapien
aaatcttgtgtaagcattggtctaa

SEQ ID NO: 255184 - DNA, 25 bp, Homo sapien
attggtctaagggtcactgactgtg

SEQ ID NO: 255185 - DNA, 25 bp, Homo sapien
gcggtgacagcatggccatcttaga

SEQ ID NO: 255186 - DNA, 25 bp, Homo sapien
gagttccctctatttactttcacaa

SEQ ID NO: 255187 - DNA, 25 bp, Homo sapien
tatttactttcacaaggactcttgg

SEQ ID NO: 255188 - DNA, 25 bp, Homo sapien
aagatatttgtatacctgggtgtgt

SEQ ID NO: 255189 - DNA, 25 bp, Homo sapien
gctatgtgcgtcttcagtagttcca

SEQ ID NO: 255190 - DNA, 25 bp, Homo sapien
gctaaagcaatttggcattctccca

SEQ ID NO: 255191 - DNA, 25 bp, Homo sapien
gcattctcccactgtgatttgtgac

SEQ ID NO: 255192 - DNA, 25 bp, Homo sapien
aaattgaaacggatgccacccttga

SEQ ID NO: 255193 - DNA, 25 bp, Homo sapien
cggatgccacccttgaagatttact

SEQ ID NO: 255194 - DNA, 25 bp, Homo sapien
atttactggcgggaatgctcactct

SEQ ID NO: 255195 - DNA, 25 bp, Homo sapien
tcactcttgtcgttttcctcagtat

SEQ ID NO: 255196 - DNA, 25 bp, Homo sapien
ttcctcagtatcgttcatgtctttg

SEQ ID NO: 255197 - DNA, 25 bp, Homo sapien
gtatcgttcatgtctttggcaacaa

SEQ ID NO: 255198 - DNA, 25 bp, Homo sapien
gaacacctgatgaaagcaagcaatg

SEQ ID NO: 255199 - DNA, 25 bp, Homo sapien
gcaagcaatgctcagttcccatcaa

SEQ ID NO: 255200 - DNA, 25 bp, Homo sapien
cagatgaggaaatccgtaggcagga

SEQ ID NO: 255201 - DNA, 25 bp, Homo sapien
gcaggagcggttgagtgattttcct

SEQ ID NO: 255202 - DNA, 25 bp, Homo sapien
gagcggttgagtgattttcctaagg

SEQ ID NO: 255203 - DNA, 25 bp, Homo sapien
tttgtcatctggtagcaggtttcca

SEQ ID NO: 255204 - DNA, 25 bp, Homo sapien
gtcatctggtagcaggtttccatta

SEQ ID NO: 255205 - DNA, 25 bp, Homo sapien
ggtagcaggtttccattaccatgcc

SEQ ID NO: 255206 - DNA, 25 bp, Homo sapien
tagcaggtttccattaccatgccat

SEQ ID NO: 255207 - DNA, 25 bp, Homo sapien
catcagagcagacctcagccagggc

SEQ ID NO: 255208 - DNA, 25 bp, Homo sapien
tcagagcagacctcagccagggcca

SEQ ID NO: 255209 - DNA, 25 bp, Homo sapien
cagccacaggttccccatgggccag

SEQ ID NO: 255210 - DNA, 25 bp, Homo sapien
gggccagctttacgcctcctgatcc

SEQ ID NO: 255211 - DNA, 25 bp, Homo sapien
caatgaaactaaaccctgtgattct

SEQ ID NO: 255212 - DNA, 25 bp, Homo sapien
aaccctgtgattctgtccttagaat

SEQ ID NO: 255213 - DNA, 25 bp, Homo sapien
ctgtccttagaatgcagaagtccgt

SEQ ID NO: 255214 - DNA, 25 bp, Homo sapien
tgcagaagtccgtggtcataacctt

SEQ ID NO: 255215 - DNA, 25 bp, Homo sapien
gtggtcataaccttgtctctggctg

SEQ ID NO: 255216 - DNA, 25 bp, Homo sapien
tctctggctgcatccaattgttgct

SEQ ID NO: 255217 - DNA, 25 bp, Homo sapien
aattgttgctttgaccctctcctat

SEQ ID NO: 255218 - DNA, 25 bp, Homo sapien
accctctcctatatttcttttctgg

SEQ ID NO: 255219 - DNA, 25 bp, Homo sapien
aaagcattctttgtccagcgtgact

SEQ ID NO: 255220 - DNA, 25 bp, Homo sapien
gtccagcgtgacttatgtacccaga

SEQ ID NO: 255221 - DNA, 25 bp, Homo sapien
tatgtacccagaaagaaggcctctt

SEQ ID NO: 255222 - DNA, 25 bp, Homo sapien
atgcctcatggagaggtgacatcat

SEQ ID NO: 255223 - DNA, 25 bp, Homo sapien
tcatggagaggtgacatcatacatt

SEQ ID NO: 255224 - DNA, 25 bp, Homo sapien
tacattcacatgcttctcacctaag

SEQ ID NO: 255225 - DNA, 25 bp, Homo sapien
tgcttctcacctaagtccccagggt

SEQ ID NO: 255226 - DNA, 25 bp, Homo sapien
gacccccttctcttgcagagtgtgg

SEQ ID NO: 255227 - DNA, 25 bp, Homo sapien
caccagactttttctgcccttaggg

SEQ ID NO: 255228 - DNA, 25 bp, Homo sapien
cagactttttctgcccttagggtag

SEQ ID NO: 255229 - DNA, 25 bp, Homo sapien
cccttagggtagtacagctggcatt

SEQ ID NO: 255230 - DNA, 25 bp, Homo sapien
tagggtagtacagctggcatttgtt

SEQ ID NO: 255231 - DNA, 25 bp, Homo sapien
gggagtgtttcaatctgttatatgt

SEQ ID NO: 255232 - DNA, 25 bp, Homo sapien
tgtttcaatctgttatatgttctgt

SEQ ID NO: 255233 - DNA, 25 bp, Homo sapien
tccaggcaggcgatgagcaaagcaa

SEQ ID NO: 255234 - DNA, 25 bp, Homo sapien
aaggacactcgatcacactgacttg

SEQ ID NO: 255235 - DNA, 25 bp, Homo sapien
gacactcgatcacactgacttggta

SEQ ID NO: 255236 - DNA, 25 bp, Homo sapien
gatcacactgacttggtatcatcac

SEQ ID NO: 255237 - DNA, 25 bp, Homo sapien
tgacttggtatcatcaccctcagct

SEQ ID NO: 255238 - DNA, 25 bp, Homo sapien
gagtcatggcttaggcaggatgcca

SEQ ID NO: 255239 - DNA, 25 bp, Homo sapien
ggcaggatgccagagatatcctaaa

SEQ ID NO: 255240 - DNA, 25 bp, Homo sapien
gatgccagagatatcctaaatcaag

SEQ ID NO: 255241 - DNA, 25 bp, Homo sapien
gatatcctaaatcaaggtgaccgtg

SEQ ID NO: 255242 - DNA, 25 bp, Homo sapien
gatgagcaaagcaacccaacccagg

SEQ ID NO: 255243 - DNA, 25 bp, Homo sapien
agtgcctagttctgctccgagagcc

SEQ ID NO: 255244 - DNA, 25 bp, Homo sapien
aaatttgagggactcatctttgccc

SEQ ID NO: 255245 - DNA, 25 bp, Homo sapien
cttgttaatgccatttgatgggaaa

SEQ ID NO: 255246 - DNA, 25 bp, Homo sapien
caaatgtgtctcagagtcaagggct

SEQ ID NO: 255247 - DNA, 25 bp, Homo sapien
aatgtgtctcagagtcaagggctgg

SEQ ID NO: 255248 - DNA, 25 bp, Homo sapien
gtctcagagtcaagggctgggcctt

SEQ ID NO: 255249 - DNA, 25 bp, Homo sapien
gagtcaagggctgggccttcaaatg

SEQ ID NO: 255250 - DNA, 25 bp, Homo sapien
ttcaaatgctgatagctctcagtct

SEQ ID NO: 255251 - DNA, 25 bp, Homo sapien
aaatgctgatagctctcagtctgtc

SEQ ID NO: 255252 - DNA, 25 bp, Homo sapien
tctcagtctgtctgtctacacaccc

SEQ ID NO: 255253 - DNA, 25 bp, Homo sapien
aagtcttcctcaagcatcttcacta

SEQ ID NO: 255254 - DNA, 25 bp, Homo sapien
gcatcttcactatgcttttaagcta

SEQ ID NO: 255255 - DNA, 25 bp, Homo sapien
taccatactcaattgtcagtttacg

SEQ ID NO: 255256 - DNA, 25 bp, Homo sapien
tactcaattgtcagtttacgtggtt

SEQ ID NO: 255257 - DNA, 25 bp, Homo sapien
ttacgtggttttgtgaatactggca

SEQ ID NO: 255258 - DNA, 25 bp, Homo sapien
atactggcaaaagcaattgttttta

SEQ ID NO: 255259 - DNA, 25 bp, Homo sapien
aaggcattcattattgacttacatg

SEQ ID NO: 255260 - DNA, 25 bp, Homo sapien
gacttacatgtcagtaaggtctgct

SEQ ID NO: 255261 - DNA, 25 bp, Homo sapien
ttctatgtactcctgtttgccaagc

SEQ ID NO: 255262 - DNA, 25 bp, Homo sapien
gtactcctgtttgccaagctcaata

SEQ ID NO: 255263 - DNA, 25 bp, Homo sapien
gtttgccaagctcaataatggacaa

SEQ ID NO: 255264 - DNA, 25 bp, Homo sapien
tatgtaaactactattgctctcttt

SEQ ID NO: 255265 - DNA, 25 bp, Homo sapien
aaactactattgctctctttataat

SEQ ID NO: 255266 - DNA, 25 bp, Homo sapien
tcctataggtatgtgatgacttgtt

SEQ ID NO: 255267 - DNA, 25 bp, Homo sapien
aaaggtatttggaacatcaatctgt

SEQ ID NO: 255268 - DNA, 25 bp, Homo sapien
ggaacatcaatctgtaattatccat

SEQ ID NO: 255269 - DNA, 25 bp, Homo sapien
aattatccattttccattcatgcat

SEQ ID NO: 255270 - DNA, 25 bp, Homo sapien
tttccattcatgcattcactaattc

SEQ ID NO: 255271 - DNA, 25 bp, Homo sapien
atatgtgtctgggagtgctgggaat

SEQ ID NO: 255272 - DNA, 25 bp, Homo sapien
aaaccctaagataatcattcaccag

SEQ ID NO: 255273 - DNA, 25 bp, Homo sapien
cattcaccagaagctcatagatata

SEQ ID NO: 255274 - DNA, 25 bp, Homo sapien
tatatagctaaatgcaaccagttgt

SEQ ID NO: 255275 - DNA, 25 bp, Homo sapien
gcaaccagttgtttttccaaatgta

SEQ ID NO: 255276 - DNA, 25 bp, Homo sapien
tttccaaatgtactcatcatctgta

SEQ ID NO: 255277 - DNA, 25 bp, Homo sapien
tttcatccttgcaacagctctgcag

SEQ ID NO: 255278 - DNA, 25 bp, Homo sapien
gcagggccccgcagatgaggaaatc

SEQ ID NO: 255279 - DNA, 25 bp, Homo sapien
cagatgaggaaatccgtaggcagga

SEQ ID NO: 255280 - DNA, 25 bp, Homo sapien
gcaggagcggttgagtgattttcct

SEQ ID NO: 255281 - DNA, 25 bp, Homo sapien
gagcggttgagtgattttcctaagg

SEQ ID NO: 255282 - DNA, 25 bp, Homo sapien
aggtcacccagctgtttggtaatag

SEQ ID NO: 255283 - DNA, 25 bp, Homo sapien
tttgtcatctggtagcaggtttcca

SEQ ID NO: 255284 - DNA, 25 bp, Homo sapien
gtcatctggtagcaggtttccatta

SEQ ID NO: 255285 - DNA, 25 bp, Homo sapien
tagcaggtttccattaccatgccat

SEQ ID NO: 255286 - DNA, 25 bp, Homo sapien
atcagagcagacctcagccagggcc

SEQ ID NO: 255287 - DNA, 25 bp, Homo sapien
atgggccagctttacgcctcctgat

SEQ ID NO: 255288 - DNA, 25 bp, Homo sapien
tgggtgttttgccaagtctttctca

SEQ ID NO: 255289 - DNA, 25 bp, Homo sapien
gggtgttttgccaagtctttctcaa

SEQ ID NO: 255290 - DNA, 25 bp, Homo sapien
ggtgttttgccaagtctttctcaat

SEQ ID NO: 255291 - DNA, 25 bp, Homo sapien
gtgttttgccaagtctttctcaatc

SEQ ID NO: 255292 - DNA, 25 bp, Homo sapien
agtctttctcaatctcatctcagct

SEQ ID NO: 255293 - DNA, 25 bp, Homo sapien
gtctttctcaatctcatctcagctt

SEQ ID NO: 255294 - DNA, 25 bp, Homo sapien
ggaatttatgggaggcaatgtgtgc

SEQ ID NO: 255295 - DNA, 25 bp, Homo sapien
atgggaggcaatgtgtgcggctttt

SEQ ID NO: 255296 - DNA, 25 bp, Homo sapien
cttatagagctgtgtagaaggtctg

SEQ ID NO: 255297 - DNA, 25 bp, Homo sapien
tagagctgtgtagaaggtctggaat

SEQ ID NO: 255298 - DNA, 25 bp, Homo sapien
gctgtgtagaaggtctggaatgatc

SEQ ID NO: 255299 - DNA, 25 bp, Homo sapien
ggagtcgcaggttctgtaagccttc

SEQ ID NO: 255300 - DNA, 25 bp, Homo sapien
gtaagccttctgcagaatgttacgt

SEQ ID NO: 255301 - DNA, 25 bp, Homo sapien
tgcagaatgttacgttgtccaccca

SEQ ID NO: 255302 - DNA, 25 bp, Homo sapien
cacccagcccatttcaagtttggat

SEQ ID NO: 255303 - DNA, 25 bp, Homo sapien
ttcaagtttggattggagtccagat

SEQ ID NO: 255304 - DNA, 25 bp, Homo sapien
gggtctctgcgtctgtagttcattt

SEQ ID NO: 255305 - DNA, 25 bp, Homo sapien
gtagttcatttgaccaaacggtgag

SEQ ID NO: 255306 - DNA, 25 bp, Homo sapien
tgaccaaacggtgagagtactgatc

SEQ ID NO: 255307 - DNA, 25 bp, Homo sapien
gagtactgatcgttacaaagctcaa

SEQ ID NO: 255308 - DNA, 25 bp, Homo sapien
tcacctctggaagtatgaataccct

SEQ ID NO: 255309 - DNA, 25 bp, Homo sapien
gaataccctattcagcggtcaaaga

SEQ ID NO: 255310 - DNA, 25 bp, Homo sapien
aggattgccgtaaggacctggattc

SEQ ID NO: 255311 - DNA, 25 bp, Homo sapien
gccgtaaggacctggattcatccaa

SEQ ID NO: 255312 - DNA, 25 bp, Homo sapien
aattgctttgtaaggtgggagacac

SEQ ID NO: 255313 - DNA, 25 bp, Homo sapien
gacaccgagtacaggcgagggactt

SEQ ID NO: 255314 - DNA, 25 bp, Homo sapien
gtacaggcgagggactttattaggt

SEQ ID NO: 255315 - DNA, 25 bp, Homo sapien
gtcagggatttaatcaggcatctgt

SEQ ID NO: 255316 - DNA, 25 bp, Homo sapien
cagatttctttattcctgttccctc

SEQ ID NO: 255317 - DNA, 25 bp, Homo sapien
acaacttgacacagcttagagacta

SEQ ID NO: 255318 - DNA, 25 bp, Homo sapien
tagagactaaaaatcatccttcaat

SEQ ID NO: 255319 - DNA, 25 bp, Homo sapien
gcagcagaagttgcaaagtttccta

SEQ ID NO: 255320 - DNA, 25 bp, Homo sapien
aagttgcaaagtttcctatgatgct

SEQ ID NO: 255321 - DNA, 25 bp, Homo sapien
agagcacatctctttgtagataaac

SEQ ID NO: 255322 - DNA, 25 bp, Homo sapien
ctttgtagataaaccatagtcagga

SEQ ID NO: 255323 - DNA, 25 bp, Homo sapien
aaccatagtcaggaaagagtatttt

SEQ ID NO: 255324 - DNA, 25 bp, Homo sapien
ttcagtatggttgataattccaagt

SEQ ID NO: 255325 - DNA, 25 bp, Homo sapien
ccaagtaatgtgttagtgcctcatg

SEQ ID NO: 255326 - DNA, 25 bp, Homo sapien
tagtgcctcatgttttccagacaga

SEQ ID NO: 255327 - DNA, 25 bp, Homo sapien
catgttttccagacagacttccaaa

SEQ ID NO: 255328 - DNA, 25 bp, Homo sapien
gttttccagacagacttccaaaaga

SEQ ID NO: 255329 - DNA, 25 bp, Homo sapien
ttccaaaagaggtcatgagtaaagt

SEQ ID NO: 255330 - DNA, 25 bp, Homo sapien
aagaatttttacctgacacattgaa

SEQ ID NO: 255331 - DNA, 25 bp, Homo sapien
gtgtgaaagctcatttcacaccaat

SEQ ID NO: 255332 - DNA, 25 bp, Homo sapien
ccagcagcatcattctgttcttctg

SEQ ID NO: 255333 - DNA, 25 bp, Homo sapien
attctgttcttctgcctgagggcat

SEQ ID NO: 255334 - DNA, 25 bp, Homo sapien
ctttcttatctggagacattgtttc

SEQ ID NO: 255335 - DNA, 25 bp, Homo sapien
gacattgtttcttagctactttcat

SEQ ID NO: 255336 - DNA, 25 bp, Homo sapien
actttcattcttatcttctctctta

SEQ ID NO: 255337 - DNA, 25 bp, Homo sapien
ttctctcttatacttagtgcctagg

SEQ ID NO: 255338 - DNA, 25 bp, Homo sapien
agtgcctaggtagttggctccgatt

SEQ ID NO: 255339 - DNA, 25 bp, Homo sapien
tagttggctccgattaatttttctt

SEQ ID NO: 255340 - DNA, 25 bp, Homo sapien
ttctttatgacctttatgcttccaa

SEQ ID NO: 255341 - DNA, 25 bp, Homo sapien
agctgttctggttgatagcaacatc

SEQ ID NO: 255342 - DNA, 25 bp, Homo sapien
gatagcaacatctagtgggcaacac

SEQ ID NO: 255343 - DNA, 25 bp, Homo sapien
taaaggccaaatctgtcctctttcc

SEQ ID NO: 255344 - DNA, 25 bp, Homo sapien
atttatattacaagccattcaggga

SEQ ID NO: 255345 - DNA, 25 bp, Homo sapien
agaaaccttgactaccccactgtct

SEQ ID NO: 255346 - DNA, 25 bp, Homo sapien
ctaccccactgtctactaagaacaa

SEQ ID NO: 255347 - DNA, 25 bp, Homo sapien
gcaaaattcactttgaaagcaccag

SEQ ID NO: 255348 - DNA, 25 bp, Homo sapien
gaaagcaccagtggttccattacat

SEQ ID NO: 255349 - DNA, 25 bp, Homo sapien
cagtggttccattacattgacaact

SEQ ID NO: 255350 - DNA, 25 bp, Homo sapien
attgacaactactaccaagatttag

SEQ ID NO: 255351 - DNA, 25 bp, Homo sapien
gtgctcgacaactaatccagattac

SEQ ID NO: 255352 - DNA, 25 bp, Homo sapien
gatttagctcatcataattcagatt

SEQ ID NO: 255353 - DNA, 25 bp, Homo sapien
atttttaatcaatcatcttagccaa

SEQ ID NO: 255354 - DNA, 25 bp, Homo sapien
cagtggtctctacccgcaaaggcaa

SEQ ID NO: 255355 - DNA, 25 bp, Homo sapien
tctctacccgcaaaggcaagtgccg

SEQ ID NO: 255356 - DNA, 25 bp, Homo sapien
gcgtgcggcgcatggtggtgaagat

SEQ ID NO: 255357 - DNA, 25 bp, Homo sapien
aagatggccaagatccccgtatcgc

SEQ ID NO: 255358 - DNA, 25 bp, Homo sapien
gggcggcggaacaagaccacataca

SEQ ID NO: 255359 - DNA, 25 bp, Homo sapien
gaccacatacaaagtgtcttccttg

SEQ ID NO: 255360 - DNA, 25 bp, Homo sapien
tacaaagtgtcttccttgagcagca

SEQ ID NO: 255361 - DNA, 25 bp, Homo sapien
gcccggtctcagtcccagagttgaa

SEQ ID NO: 255362 - DNA, 25 bp, Homo sapien
gtcccagagttgaagccggaatctt

SEQ ID NO: 255363 - DNA, 25 bp, Homo sapien
agttgaagccggaatcttcccagac

SEQ ID NO: 255364 - DNA, 25 bp, Homo sapien
cggaatcttcccagaccccagtggt

SEQ ID NO: 255365 - DNA, 25 bp, Homo sapien
caacctattctccataatagggagt

SEQ ID NO: 255366 - DNA, 25 bp, Homo sapien
tagggagtctaatcctattccttcc

SEQ ID NO: 255367 - DNA, 25 bp, Homo sapien
tattccttccctgcctgatgaggat

SEQ ID NO: 255368 - DNA, 25 bp, Homo sapien
aggacggcatctcatttggggcttt

SEQ ID NO: 255369 - DNA, 25 bp, Homo sapien
gggctttttggcagtgggcctcatt

SEQ ID NO: 255370 - DNA, 25 bp, Homo sapien
ctttttggcagtgggcctcatttta

SEQ ID NO: 255371 - DNA, 25 bp, Homo sapien
agtggatctatccagctgcttcctt

SEQ ID NO: 255372 - DNA, 25 bp, Homo sapien
gatctatccagctgcttccttgtag

SEQ ID NO: 255373 - DNA, 25 bp, Homo sapien
atccagctgcttccttgtagccaag

SEQ ID NO: 255374 - DNA, 25 bp, Homo sapien
attgtgattcactgattttattgat

SEQ ID NO: 255375 - DNA, 25 bp, Homo sapien
agactggtatttttgaagctgctat

SEQ ID NO: 255376 - DNA, 25 bp, Homo sapien
gctgcttcttccagatgaatcagag

SEQ ID NO: 255377 - DNA, 25 bp, Homo sapien
atgaatcagagtgccagccacgtgt

SEQ ID NO: 255378 - DNA, 25 bp, Homo sapien
cagccacgtgtaccatttgtaccaa

SEQ ID NO: 255379 - DNA, 25 bp, Homo sapien
tgtaccaagtccattaaagatcgat

SEQ ID NO: 255380 - DNA, 25 bp, Homo sapien
gagcttgttcttcatctgtaaggac

SEQ ID NO: 255381 - DNA, 25 bp, Homo sapien
tgtaaggacagactatcctcaccct

SEQ ID NO: 255382 - DNA, 25 bp, Homo sapien
ctatcctcacccttctaatgatttt

SEQ ID NO: 255383 - DNA, 25 bp, Homo sapien
attttaacagccacaacatctccaa

SEQ ID NO: 255384 - DNA, 25 bp, Homo sapien
tctccaacaaataacgcacctcttt

SEQ ID NO: 255385 - DNA, 25 bp, Homo sapien
ggagatctaccttttaacagtacag

SEQ ID NO: 255386 - DNA, 25 bp, Homo sapien
tgagaatcactacagcctcatggcc

SEQ ID NO: 255387 - DNA, 25 bp, Homo sapien
tcttttcaagatatcgtcatcattc

SEQ ID NO: 255388 - DNA, 25 bp, Homo sapien
gatatcgtcatcattcttaaacaac

SEQ ID NO: 255389 - DNA, 25 bp, Homo sapien
gtcatcattcttaaacaacattctt

SEQ ID NO: 255390 - DNA, 25 bp, Homo sapien
taaacaacattcttaacccccagct

SEQ ID NO: 255391 - DNA, 25 bp, Homo sapien
gtccccattttaatagatgtcattg

SEQ ID NO: 255392 - DNA, 25 bp, Homo sapien
gatgtcattgcttcaagtctaacgg

SEQ ID NO: 255393 - DNA, 25 bp, Homo sapien
attgcttcaagtctaacggcgccgg

SEQ ID NO: 255394 - DNA, 25 bp, Homo sapien
gcttcaagtctaacggcgccgggag

SEQ ID NO: 255395 - DNA, 25 bp, Homo sapien
gaggcctgtttgagggaaaacatta

SEQ ID NO: 255396 - DNA, 25 bp, Homo sapien
gttgctacaggtccctgagatgcaa

SEQ ID NO: 255397 - DNA, 25 bp, Homo sapien
caggtccctgagatgcaatcagatt

SEQ ID NO: 255398 - DNA, 25 bp, Homo sapien
gtagggacagtctcattgctgtctt

SEQ ID NO: 255399 - DNA, 25 bp, Homo sapien
attgctgtcttctagcagacagaag

SEQ ID NO: 255400 - DNA, 25 bp, Homo sapien
cagacagaagagttaggtgccagaa

SEQ ID NO: 255401 - DNA, 25 bp, Homo sapien
gttaggtgccagaaaggacaatctt

SEQ ID NO: 255402 - DNA, 25 bp, Homo sapien
ggacaatcttgatggtgggtcccct

SEQ ID NO: 255403 - DNA, 25 bp, Homo sapien
ggcccttgattaggtcagtggtccc

SEQ ID NO: 255404 - DNA, 25 bp, Homo sapien
gagccatcggcgagaggcctccagc

SEQ ID NO: 255405 - DNA, 25 bp, Homo sapien
gacagtctgggctctcgggtactaa

SEQ ID NO: 255406 - DNA, 25 bp, Homo sapien
gctctcgggtactaatctttctaat

SEQ ID NO: 255407 - DNA, 25 bp, Homo sapien
atctttctaatatggcagtggttgt

SEQ ID NO: 255408 - DNA, 25 bp, Homo sapien
ggttgtggcacttctgacttgaatt

SEQ ID NO: 255409 - DNA, 25 bp, Homo sapien
cattgtacacaagagaggccagcca

SEQ ID NO: 255410 - DNA, 25 bp, Homo sapien
gagaggccagccattaagaattgtt

SEQ ID NO: 255411 - DNA, 25 bp, Homo sapien
gaatacttggccagagatcctctag

SEQ ID NO: 255412 - DNA, 25 bp, Homo sapien
acttggccagagatcctctagataa

SEQ ID NO: 255413 - DNA, 25 bp, Homo sapien
gccagagatcctctagataagtagc

SEQ ID NO: 255414 - DNA, 25 bp, Homo sapien
agaggatttctttgagactctaaat

SEQ ID NO: 255415 - DNA, 25 bp, Homo sapien
ggaagaagcaaatacacaaacgttt

SEQ ID NO: 255416 - DNA, 25 bp, Homo sapien
agcaaatacacaaacgttttatggg

SEQ ID NO: 255417 - DNA, 25 bp, Homo sapien
taaagacatctctgaacaaatgata

SEQ ID NO: 255418 - DNA, 25 bp, Homo sapien
gactctaaatatgctttgttcagga

SEQ ID NO: 255419 - DNA, 25 bp, Homo sapien
aatattggctcattgtacacaagag

SEQ ID NO: 255420 - DNA, 25 bp, Homo sapien
cagtggtgggctgagtctttctcct

SEQ ID NO: 255421 - DNA, 25 bp, Homo sapien
agtctttctcctggtatcatctctt

SEQ ID NO: 255422 - DNA, 25 bp, Homo sapien
aggacctctgtgattatattgggca

SEQ ID NO: 255423 - DNA, 25 bp, Homo sapien
tatattgggcacctggatattgcag

SEQ ID NO: 255424 - DNA, 25 bp, Homo sapien
ggatattgcaggatacgctctctat

SEQ ID NO: 255425 - DNA, 25 bp, Homo sapien
tgcaggatacgctctctattttaag

SEQ ID NO: 255426 - DNA, 25 bp, Homo sapien
ggatacgctctctattttaaggcta

SEQ ID NO: 255427 - DNA, 25 bp, Homo sapien
tctattttaaggctatgctccgtaa

SEQ ID NO: 255428 - DNA, 25 bp, Homo sapien
tatgctccgtaaagagagtgcctcc

SEQ ID NO: 255429 - DNA, 25 bp, Homo sapien
ctgccagaggaatacagcttctaga

SEQ ID NO: 255430 - DNA, 25 bp, Homo sapien
aatacagcttctagaggctacccac

SEQ ID NO: 255431 - DNA, 25 bp, Homo sapien
accagctggaaatggcggtgccact

SEQ ID NO: 255432 - DNA, 25 bp, Homo sapien
gaacagcccttctgaatggtgggag

SEQ ID NO: 255433 - DNA, 25 bp, Homo sapien
cctgccccggaaccaaagatggtga

SEQ ID NO: 255434 - DNA, 25 bp, Homo sapien
aagtgggcgatgttttcactgagcc

SEQ ID NO: 255435 - DNA, 25 bp, Homo sapien
atgttttcactgagccagcgcaggg

SEQ ID NO: 255436 - DNA, 25 bp, Homo sapien
cagcgcagggcctggatctggtcca

SEQ ID NO: 255437 - DNA, 25 bp, Homo sapien
aggagcccatagttgccttttgcag

SEQ ID NO: 255438 - DNA, 25 bp, Homo sapien
gcctggtccccggtgctgagaaaac

SEQ ID NO: 255439 - DNA, 25 bp, Homo sapien
tgagaaaaccgagcaccccaagacg

SEQ ID NO: 255440 - DNA, 25 bp, Homo sapien
gacggtagttgagcgtggctacaat

SEQ ID NO: 255441 - DNA, 25 bp, Homo sapien
ggctacaatgacgttgccataggca

SEQ ID NO: 255442 - DNA, 25 bp, Homo sapien
gggccaggtatgtagcaaagagaca

SEQ ID NO: 255443 - DNA, 25 bp, Homo sapien
aatgaagagttaaccgctccctgat

SEQ ID NO: 255444 - DNA, 25 bp, Homo sapien
gagacagcaagaggagccttccgca

SEQ ID NO: 255445 - DNA, 25 bp, Homo sapien
gagccttccgcagtactttaagtaa

SEQ ID NO: 255446 - DNA, 25 bp, Homo sapien
atgagcccatctgtgcatatctctg

SEQ ID NO: 255447 - DNA, 25 bp, Homo sapien
taaccgctccctgatgtttgaatgg

SEQ ID NO: 255448 - DNA, 25 bp, Homo sapien
attcctccctgtatgcccatggatg

SEQ ID NO: 255449 - DNA, 25 bp, Homo sapien
gtatgcccatggatgctagagctga

SEQ ID NO: 255450 - DNA, 25 bp, Homo sapien
tgctagagctgacccttttctacag

SEQ ID NO: 255451 - DNA, 25 bp, Homo sapien
aaaaattcctatttcacgtcatgaa

SEQ ID NO: 255452 - DNA, 25 bp, Homo sapien
gagaaggcctaatggtaatgtttac

SEQ ID NO: 255453 - DNA, 25 bp, Homo sapien
tggatattaccttttaactactagt

SEQ ID NO: 255454 - DNA, 25 bp, Homo sapien
aactactagttaacatcatgcttga

SEQ ID NO: 255455 - DNA, 25 bp, Homo sapien
gttaacatcatgcttgatcaacatt

SEQ ID NO: 255456 - DNA, 25 bp, Homo sapien
atgcttgatcaacatttgctcctag

SEQ ID NO: 255457 - DNA, 25 bp, Homo sapien
gcttgatcaacatttgctcctagtt

SEQ ID NO: 255458 - DNA, 25 bp, Homo sapien
gatcaacatttgctcctagttatca

SEQ ID NO: 255459 - DNA, 25 bp, Homo sapien
caacatttgctcctagttatcacca

SEQ ID NO: 255460 - DNA, 25 bp, Homo sapien
catttgctcctagttatcaccatta

SEQ ID NO: 255461 - DNA, 25 bp, Homo sapien
tttgctcctagttatcaccattaaa

SEQ ID NO: 255462 - DNA, 25 bp, Homo sapien
gctcctagttatcaccattaaatta

SEQ ID NO: 255463 - DNA, 25 bp, Homo sapien
atggatgtcttcacattaggggtgg

SEQ ID NO: 255464 - DNA, 25 bp, Homo sapien
aatggcctgctcttcaatgtagctt

SEQ ID NO: 255465 - DNA, 25 bp, Homo sapien
agtttagttcaattgtcctgcccac

SEQ ID NO: 255466 - DNA, 25 bp, Homo sapien
cccaagctgagaaccgggagccgga

SEQ ID NO: 255467 - DNA, 25 bp, Homo sapien
aaagaacagcttctttcctctcttc

SEQ ID NO: 255468 - DNA, 25 bp, Homo sapien
ttctccttgggacagcaacagcaca

SEQ ID NO: 255469 - DNA, 25 bp, Homo sapien
aacagcacagagagtgggccgccat

SEQ ID NO: 255470 - DNA, 25 bp, Homo sapien
gggactgattctttcagctctacat

SEQ ID NO: 255471 - DNA, 25 bp, Homo sapien
gccggaggaaatcatagcgaaatct

SEQ ID NO: 255472 - DNA, 25 bp, Homo sapien
gcgaaatctcaacctgatgtagccc

SEQ ID NO: 255473 - DNA, 25 bp, Homo sapien
gatgtagccccatcagcatcacaca

SEQ ID NO: 255474 - DNA, 25 bp, Homo sapien
acacactcagagcaaaatggcctgc

SEQ ID NO: 255475 - DNA, 25 bp, Homo sapien
ttttttccgtagacatgaccacttt

SEQ ID NO: 255476 - DNA, 25 bp, Homo sapien
gtagacatgaccactttattaactg

SEQ ID NO: 255477 - DNA, 25 bp, Homo sapien
tattaactggtggtgggatgctgtt

SEQ ID NO: 255478 - DNA, 25 bp, Homo sapien
tgacaaggaaaaagttgcttaccca

SEQ ID NO: 255479 - DNA, 25 bp, Homo sapien
tctgttgtatttgaagtatcatctg

SEQ ID NO: 255480 - DNA, 25 bp, Homo sapien
gtatcatctggttttgccttaactc

SEQ ID NO: 255481 - DNA, 25 bp, Homo sapien
gttgcttacccaaaatctaagtgct

SEQ ID NO: 255482 - DNA, 25 bp, Homo sapien
aaaatctaagtgctcaatccctgag

SEQ ID NO: 255483 - DNA, 25 bp, Homo sapien
gctcaatccctgagcctcagcaaaa

SEQ ID NO: 255484 - DNA, 25 bp, Homo sapien
gctcccctccgagggaaatcttata

SEQ ID NO: 255485 - DNA, 25 bp, Homo sapien
gagggaaatcttatactttattgct

SEQ ID NO: 255486 - DNA, 25 bp, Homo sapien
aggagacatggattctgtcactacc

SEQ ID NO: 255487 - DNA, 25 bp, Homo sapien
aaacccatcgcaaagtgaagggata

SEQ ID NO: 255488 - DNA, 25 bp, Homo sapien
gaacccaatagtatgtcattgaaac

SEQ ID NO: 255489 - DNA, 25 bp, Homo sapien
accctgtctacaaaagaagactcat

SEQ ID NO: 255490 - DNA, 25 bp, Homo sapien
aagtcaacaataactcgggtttcat

SEQ ID NO: 255491 - DNA, 25 bp, Homo sapien
agaggaggaaaatcaacccattcaa

SEQ ID NO: 255492 - DNA, 25 bp, Homo sapien
acccattcaaatacaggagcatctg

SEQ ID NO: 255493 - DNA, 25 bp, Homo sapien
ggatagctgattgtcatcccatttt

SEQ ID NO: 255494 - DNA, 25 bp, Homo sapien
tcatcccatttttgagacctcagtc

SEQ ID NO: 255495 - DNA, 25 bp, Homo sapien
ttctgcgtgcatcaccacaactaag

SEQ ID NO: 255496 - DNA, 25 bp, Homo sapien
gtgcatcaccacaactaagaggaag

SEQ ID NO: 255497 - DNA, 25 bp, Homo sapien
aaatgccttgcctggagaagttaga

SEQ ID NO: 255498 - DNA, 25 bp, Homo sapien
agttagatcttgcaagtctcaggag

SEQ ID NO: 255499 - DNA, 25 bp, Homo sapien
gccgagatggtttgtcttatgccta

SEQ ID NO: 255500 - DNA, 25 bp, Homo sapien
atgcctatagctgtttatgtcccac

SEQ ID NO: 255501 - DNA, 25 bp, Homo sapien
tgtcccaccagtgggtgtttgtttc

SEQ ID NO: 255502 - DNA, 25 bp, Homo sapien
ttgtttcattaggtgccgtttccag

SEQ ID NO: 255503 - DNA, 25 bp, Homo sapien
ccgtttccagccaaatgttctcatt

SEQ ID NO: 255504 - DNA, 25 bp, Homo sapien
tgttctcattcttcacatcttcaat

SEQ ID NO: 255505 - DNA, 25 bp, Homo sapien
taacctaaaatggtgccctgtggct

SEQ ID NO: 255506 - DNA, 25 bp, Homo sapien
tgtggctgccattctctaactcttg

SEQ ID NO: 255507 - DNA, 25 bp, Homo sapien
ccattctctaactcttgcatactta

SEQ ID NO: 255508 - DNA, 25 bp, Homo sapien
taagaagcaagcacaccgtcaggct

SEQ ID NO: 255509 - DNA, 25 bp, Homo sapien
gcaagcacaccgtcaggctgagaaa

SEQ ID NO: 255510 - DNA, 25 bp, Homo sapien
gaaaacactggatactgaatggaaa

SEQ ID NO: 255511 - DNA, 25 bp, Homo sapien
gggtctaggatccttcaaccagcag

SEQ ID NO: 255512 - DNA, 25 bp, Homo sapien
accagcagctggctaatgagcaaaa

SEQ ID NO: 255513 - DNA, 25 bp, Homo sapien
aaaagcccagcaggattacctgaat

SEQ ID NO: 255514 - DNA, 25 bp, Homo sapien
agcaggattacctgaattcagtaat

SEQ ID NO: 255515 - DNA, 25 bp, Homo sapien
accgagtcctgcctattgctggaag

SEQ ID NO: 255516 - DNA, 25 bp, Homo sapien
gtcctgcctattgctggaagggcat

SEQ ID NO: 255517 - DNA, 25 bp, Homo sapien
gcagcaagctgccatcaggaaagag

SEQ ID NO: 255518 - DNA, 25 bp, Homo sapien
gcaggaagtacaacgctctaagaag

SEQ ID NO: 255519 - DNA, 25 bp, Homo sapien
gggacagcgccctctggagctcgct

SEQ ID NO: 255520 - DNA, 25 bp, Homo sapien
tctggagctcgctgggagcatcacc

SEQ ID NO: 255521 - DNA, 25 bp, Homo sapien
tgtggcccggcagggaagatcgcct

SEQ ID NO: 255522 - DNA, 25 bp, Homo sapien
acggctcgccggtccagagccatga

SEQ ID NO: 255523 - DNA, 25 bp, Homo sapien
ccggtccagagccatgagccaagag

SEQ ID NO: 255524 - DNA, 25 bp, Homo sapien
ggtccagagccatgagccaagagcc

SEQ ID NO: 255525 - DNA, 25 bp, Homo sapien
aagatcgcctggacgtggagccagc

SEQ ID NO: 255526 - DNA, 25 bp, Homo sapien
atcgcctggacgtggagccagcatc

SEQ ID NO: 255527 - DNA, 25 bp, Homo sapien
ggacgtggagccagcatcgccccgt

SEQ ID NO: 255528 - DNA, 25 bp, Homo sapien
gtgccctcggcgtttgcatttgtaa

SEQ ID NO: 255529 - DNA, 25 bp, Homo sapien
gccctcggcgtttgcatttgtaaac

SEQ ID NO: 255530 - DNA, 25 bp, Homo sapien
gtgaccccaaagatagccacaacta

SEQ ID NO: 255531 - DNA, 25 bp, Homo sapien
aactatgaatatgaacactgtgaca

SEQ ID NO: 255532 - DNA, 25 bp, Homo sapien
tggtagcaccatactcaatccaatg

SEQ ID NO: 255533 - DNA, 25 bp, Homo sapien
aatccaatggacaacatttattttc

SEQ ID NO: 255534 - DNA, 25 bp, Homo sapien
tgctgttttgtgtatacttgcactc

SEQ ID NO: 255535 - DNA, 25 bp, Homo sapien
gtgtatacttgcactcaggctgaag

SEQ ID NO: 255536 - DNA, 25 bp, Homo sapien
tgaagtgaacttcaactgcctgcat

SEQ ID NO: 255537 - DNA, 25 bp, Homo sapien
tcaactgcctgcattcttatctcag

SEQ ID NO: 255538 - DNA, 25 bp, Homo sapien
gcctgcattcttatctcagtttctt

SEQ ID NO: 255539 - DNA, 25 bp, Homo sapien
cttatctcagtttcttattattgct

SEQ ID NO: 255540 - DNA, 25 bp, Homo sapien
gctgaatgacaagcatgctaggaaa

SEQ ID NO: 255541 - DNA, 25 bp, Homo sapien
aggcccgagcggtcaaagtcctcac

SEQ ID NO: 255542 - DNA, 25 bp, Homo sapien
gagcggtcaaagtcctcactgagag

SEQ ID NO: 255543 - DNA, 25 bp, Homo sapien
ggtcaaagtcctcactgagagcccc

SEQ ID NO: 255544 - DNA, 25 bp, Homo sapien
cagacaggagctgcctgctggcaca

SEQ ID NO: 255545 - DNA, 25 bp, Homo sapien
ggagctgcctgctggcacacgtcca

SEQ ID NO: 255546 - DNA, 25 bp, Homo sapien
acgagggcaggttcagagaagcagc

SEQ ID NO: 255547 - DNA, 25 bp, Homo sapien
tgcagtcggagcttggcgttgaaaa

SEQ ID NO: 255548 - DNA, 25 bp, Homo sapien
tcggagcttggcgttgaaaagatga

SEQ ID NO: 255549 - DNA, 25 bp, Homo sapien
aaaagatgagcatcccactgctcct

SEQ ID NO: 255550 - DNA, 25 bp, Homo sapien
acaaggtggccctcgtggagcgcta

SEQ ID NO: 255551 - DNA, 25 bp, Homo sapien
ggagcgctatgtggccggcttcccg

SEQ ID NO: 255552 - DNA, 25 bp, Homo sapien
tgaatttgctgagttttgccacgtg

SEQ ID NO: 255553 - DNA, 25 bp, Homo sapien
gcctatgtgattaaccaccaataaa

SEQ ID NO: 255554 - DNA, 25 bp, Homo sapien
ccaccaataaaaacctgggacatca

SEQ ID NO: 255555 - DNA, 25 bp, Homo sapien
caccaataaaaacctgggacatcaa

SEQ ID NO: 255556 - DNA, 25 bp, Homo sapien
taagctgctttaattgccaagaatt

SEQ ID NO: 255557 - DNA, 25 bp, Homo sapien
aagctgctttaattgccaagaattc

SEQ ID NO: 255558 - DNA, 25 bp, Homo sapien
agctgctttaattgccaagaattca

SEQ ID NO: 255559 - DNA, 25 bp, Homo sapien
gctgctttaattgccaagaattcac

SEQ ID NO: 255560 - DNA, 25 bp, Homo sapien
gctttaattgccaagaattcacatg

SEQ ID NO: 255561 - DNA, 25 bp, Homo sapien
tttaattgccaagaattcacatgtg

SEQ ID NO: 255562 - DNA, 25 bp, Homo sapien
ttaattgccaagaattcacatgtgg

SEQ ID NO: 255563 - DNA, 25 bp, Homo sapien
attttccagtgatagaaattaccaa

SEQ ID NO: 255564 - DNA, 25 bp, Homo sapien
aaattaccaaaatttgtgtgtgtca

SEQ ID NO: 255565 - DNA, 25 bp, Homo sapien
taggtagctaggtgaatggcagcat

SEQ ID NO: 255566 - DNA, 25 bp, Homo sapien
gtgaatggcagcataaattttctct

SEQ ID NO: 255567 - DNA, 25 bp, Homo sapien
gttcaaaactacttggctaatgagt

SEQ ID NO: 255568 - DNA, 25 bp, Homo sapien
atgagtatttttgctctagcatgga

SEQ ID NO: 255569 - DNA, 25 bp, Homo sapien
tgctctagcatggaattctggagga

SEQ ID NO: 255570 - DNA, 25 bp, Homo sapien
gaaatatgatgctacttgggttcac

SEQ ID NO: 255571 - DNA, 25 bp, Homo sapien
gatgctacttgggttcactttagag

SEQ ID NO: 255572 - DNA, 25 bp, Homo sapien
ttgggttcactttagagcttgcatt

SEQ ID NO: 255573 - DNA, 25 bp, Homo sapien
ttagagcttgcatttatttatgtat

SEQ ID NO: 255574 - DNA, 25 bp, Homo sapien
atggcgtggcacttctgaaggtctg

SEQ ID NO: 255575 - DNA, 25 bp, Homo sapien
gccagagtgggtttactgggttcct

SEQ ID NO: 255576 - DNA, 25 bp, Homo sapien
cagagtgggtttactgggttccttg

SEQ ID NO: 255577 - DNA, 25 bp, Homo sapien
actgggttccttgtctccatgctgg

SEQ ID NO: 255578 - DNA, 25 bp, Homo sapien
gttccttgtctccatgctggttgtc

SEQ ID NO: 255579 - DNA, 25 bp, Homo sapien
ttgtctccatgctggttgtcttcct

SEQ ID NO: 255580 - DNA, 25 bp, Homo sapien
tccatgctggttgtcttccttgtgt

SEQ ID NO: 255581 - DNA, 25 bp, Homo sapien
gtcttccttgtgtctacacgcaaga

SEQ ID NO: 255582 - DNA, 25 bp, Homo sapien
tgtgtctacacgcaagatccatacc

SEQ ID NO: 255583 - DNA, 25 bp, Homo sapien
tgtctacacgcaagatccataccac

SEQ ID NO: 255584 - DNA, 25 bp, Homo sapien
acgcaagatccataccaccatgagt

SEQ ID NO: 255585 - DNA, 25 bp, Homo sapien
gcctgaacatcatctgcagcttgga

SEQ ID NO: 255586 - DNA, 25 bp, Homo sapien
tgcagcttggacacctctctacggg

SEQ ID NO: 255587 - DNA, 25 bp, Homo sapien
tggacacctctctacgggccaggaa

SEQ ID NO: 255588 - DNA, 25 bp, Homo sapien
gaagatctaggtgtgtgacgtctaa

SEQ ID NO: 255589 - DNA, 25 bp, Homo sapien
gtgtgtgacgtctaattcattagcc

SEQ ID NO: 255590 - DNA, 25 bp, Homo sapien
gtctaattcattagccaaggacggc

SEQ ID NO: 255591 - DNA, 25 bp, Homo sapien
aaggacggctactgagccttggaaa

SEQ ID NO: 255592 - DNA, 25 bp, Homo sapien
aaggctagtgcagacaggtgtgcaa

SEQ ID NO: 255593 - DNA, 25 bp, Homo sapien
aggtgtgcaatacacgctgcgtctc

SEQ ID NO: 255594 - DNA, 25 bp, Homo sapien
cgtctcagcggctccgtaggaaaga

SEQ ID NO: 255595 - DNA, 25 bp, Homo sapien
atctcagctctgataacacggtatc

SEQ ID NO: 255596 - DNA, 25 bp, Homo sapien
gaacttgaccgagagctttacttcg

SEQ ID NO: 255597 - DNA, 25 bp, Homo sapien
gaccgagagctttacttcgatctac

SEQ ID NO: 255598 - DNA, 25 bp, Homo sapien
gagagctttacttcgatctacagtg

SEQ ID NO: 255599 - DNA, 25 bp, Homo sapien
gagctttacttcgatctacagtggg

SEQ ID NO: 255600 - DNA, 25 bp, Homo sapien
gggcacagtcctctaatccttctgg

SEQ ID NO: 255601 - DNA, 25 bp, Homo sapien
agtcctctaatccttctggtcctca

SEQ ID NO: 255602 - DNA, 25 bp, Homo sapien
tcccaaggacccctgggagtctcat

SEQ ID NO: 255603 - DNA, 25 bp, Homo sapien
gggaagcccctagtctacttcagca

SEQ ID NO: 255604 - DNA, 25 bp, Homo sapien
gaagcccctagtctacttcagcaag

SEQ ID NO: 255605 - DNA, 25 bp, Homo sapien
ttggtgaccacagcaatttttgact

SEQ ID NO: 255606 - DNA, 25 bp, Homo sapien
tggtgaccacagcaatttttgactc

SEQ ID NO: 255607 - DNA, 25 bp, Homo sapien
tgtctctgcccctcaaaggcgtgtg

SEQ ID NO: 255608 - DNA, 25 bp, Homo sapien
ctcaaaggcgtgtgcgtcagagaca

SEQ ID NO: 255609 - DNA, 25 bp, Homo sapien
tgtgcgtcagagacacggacgtgtt

SEQ ID NO: 255610 - DNA, 25 bp, Homo sapien
gacacggacgtgttctgcacggaaa

SEQ ID NO: 255611 - DNA, 25 bp, Homo sapien
gttctgcacggaaaactatctgaag

SEQ ID NO: 255612 - DNA, 25 bp, Homo sapien
gattgggaatgacaccattgtcttc

SEQ ID NO: 255613 - DNA, 25 bp, Homo sapien
tgacaccattgtcttcaccttgtat

SEQ ID NO: 255614 - DNA, 25 bp, Homo sapien
ccatgtgggagaccctttctgtgac

SEQ ID NO: 255615 - DNA, 25 bp, Homo sapien
taccggaatgcctcttcaggttagc

SEQ ID NO: 255616 - DNA, 25 bp, Homo sapien
tgcctcttcaggttagcgattacag

SEQ ID NO: 255617 - DNA, 25 bp, Homo sapien
ttagcgattacagctggcagcagac

SEQ ID NO: 255618 - DNA, 25 bp, Homo sapien
gaccccagaacgaaggaggcatcag

SEQ ID NO: 255619 - DNA, 25 bp, Homo sapien
gaggcatcagaagctgagccacccg

SEQ ID NO: 255620 - DNA, 25 bp, Homo sapien
acccgtggccgacaagaaacctgag

SEQ ID NO: 255621 - DNA, 25 bp, Homo sapien
tgtgatcgacccaggcttgcgagtt

SEQ ID NO: 255622 - DNA, 25 bp, Homo sapien
gcttgcgagttgttttggcaacaca

SEQ ID NO: 255623 - DNA, 25 bp, Homo sapien
gttttcacatatgtggcaccaggca

SEQ ID NO: 255624 - DNA, 25 bp, Homo sapien
aagagccgaccaatatgtcattgat

SEQ ID NO: 255625 - DNA, 25 bp, Homo sapien
gcagcccagggatgccggtgaaatc

SEQ ID NO: 255626 - DNA, 25 bp, Homo sapien
atgccggtgaaatctctgggagaac

SEQ ID NO: 255627 - DNA, 25 bp, Homo sapien
atctctgggagaacggcatgttcca

SEQ ID NO: 255628 - DNA, 25 bp, Homo sapien
gcatgttccagagagccacagcttg

SEQ ID NO: 255629 - DNA, 25 bp, Homo sapien
atgcttgatcaacatttgctcctag

SEQ ID NO: 255630 - DNA, 25 bp, Homo sapien
atttgctcctagttatcaccattaa

SEQ ID NO: 255631 - DNA, 25 bp, Homo sapien
ttgggctccccttgggatttagtag

SEQ ID NO: 255632 - DNA, 25 bp, Homo sapien
attaagaccttaatggtaaactgag

SEQ ID NO: 255633 - DNA, 25 bp, Homo sapien
tgggctccccttgggatttagtagt

SEQ ID NO: 255634 - DNA, 25 bp, Homo sapien
tggtaaactgaggttactgatgcat

SEQ ID NO: 255635 - DNA, 25 bp, Homo sapien
ggctccccttgggatttagtagtag

SEQ ID NO: 255636 - DNA, 25 bp, Homo sapien
ctgatgcatcatcacatttaagtaa

SEQ ID NO: 255637 - DNA, 25 bp, Homo sapien
gatgcatcatcacatttaagtaaaa

SEQ ID NO: 255638 - DNA, 25 bp, Homo sapien
gctccccttgggatttagtagtaga

SEQ ID NO: 255639 - DNA, 25 bp, Homo sapien
attaagcctcccaatcttaggatcc

SEQ ID NO: 255640 - DNA, 25 bp, Homo sapien
aattagatgatctgcacactctgta

SEQ ID NO: 255641 - DNA, 25 bp, Homo sapien
gatgatctgcacactctgtatcata

SEQ ID NO: 255642 - DNA, 25 bp, Homo sapien
gatctgcacactctgtatcataaaa

SEQ ID NO: 255643 - DNA, 25 bp, Homo sapien
taaattgaccatatctccagacaag

SEQ ID NO: 255644 - DNA, 25 bp, Homo sapien
gaccatatctccagacaagattgtt

SEQ ID NO: 255645 - DNA, 25 bp, Homo sapien
gaggctgtgtgttgcctataatgaa

SEQ ID NO: 255646 - DNA, 25 bp, Homo sapien
gtacctcagggcttcatgtgaacaa

SEQ ID NO: 255647 - DNA, 25 bp, Homo sapien
acaccctgttttctgtggtagacca

SEQ ID NO: 255648 - DNA, 25 bp, Homo sapien
ggtagaccataattagctattgcat

SEQ ID NO: 255649 - DNA, 25 bp, Homo sapien
tgattttcttgaactggtaagcgcc

SEQ ID NO: 255650 - DNA, 25 bp, Homo sapien
ctggtaagcgccaaagcatgtgttt

SEQ ID NO: 255651 - DNA, 25 bp, Homo sapien
ttgggctccccttgggatttagtag

SEQ ID NO: 255652 - DNA, 25 bp, Homo sapien
attaagaccttaatggtaaactgag

SEQ ID NO: 255653 - DNA, 25 bp, Homo sapien
tgggctccccttgggatttagtagt

SEQ ID NO: 255654 - DNA, 25 bp, Homo sapien
ccttaatggtaaactgaggttactg

SEQ ID NO: 255655 - DNA, 25 bp, Homo sapien
aatggtaaactgaggttactgatgc

SEQ ID NO: 255656 - DNA, 25 bp, Homo sapien
tggtaaactgaggttactgatgcat

SEQ ID NO: 255657 - DNA, 25 bp, Homo sapien
ggctccccttgggatttagtagtag

SEQ ID NO: 255658 - DNA, 25 bp, Homo sapien
ctgatgcatcatcacatttaagtaa

SEQ ID NO: 255659 - DNA, 25 bp, Homo sapien
gatgcatcatcacatttaagtaaaa

SEQ ID NO: 255660 - DNA, 25 bp, Homo sapien
gctccccttgggatttagtagtaga

SEQ ID NO: 255661 - DNA, 25 bp, Homo sapien
tgcatcatcacatttaagtaaaaat

SEQ ID NO: 255662 - DNA, 25 bp, Homo sapien
agccggcaagagaaagaggcccact

SEQ ID NO: 255663 - DNA, 25 bp, Homo sapien
gaggcccactgcaatatgctgtgaa

SEQ ID NO: 255664 - DNA, 25 bp, Homo sapien
gaagtcaaactgttgacctcttttc

SEQ ID NO: 255665 - DNA, 25 bp, Homo sapien
caaactgttgacctcttttccccag

SEQ ID NO: 255666 - DNA, 25 bp, Homo sapien
gttccaaaactacatccctgaggag

SEQ ID NO: 255667 - DNA, 25 bp, Homo sapien
tccctgaggagttgtgcacctctac

SEQ ID NO: 255668 - DNA, 25 bp, Homo sapien
gttgtgcacctctacggaaagttca

SEQ ID NO: 255669 - DNA, 25 bp, Homo sapien
gcacctctacggaaagttcagatga

SEQ ID NO: 255670 - DNA, 25 bp, Homo sapien
gatgaaagagctaattccccttgat

SEQ ID NO: 255671 - DNA, 25 bp, Homo sapien
taattccccttgatctctcttcttg

SEQ ID NO: 255672 - DNA, 25 bp, Homo sapien
tctcttcttgttcagagtggaggaa

SEQ ID NO: 255673 - DNA, 25 bp, Homo sapien
tctgagacggcagctgagttgcact

SEQ ID NO: 255674 - DNA, 25 bp, Homo sapien
gagttgcactgtgcgacgcgacaga

SEQ ID NO: 255675 - DNA, 25 bp, Homo sapien
gtgaagtcccatactacacaatatt

SEQ ID NO: 255676 - DNA, 25 bp, Homo sapien
tacatttcccagcattccagcggcg

SEQ ID NO: 255677 - DNA, 25 bp, Homo sapien
cagatcccagcgcaccacaaagagg

SEQ ID NO: 255678 - DNA, 25 bp, Homo sapien
gcactcggttcctctgtaacttaga

SEQ ID NO: 255679 - DNA, 25 bp, Homo sapien
tctgtaacttagactccagtgtgcc

SEQ ID NO: 255680 - DNA, 25 bp, Homo sapien
tattcatctggtgttgttgcctaga

SEQ ID NO: 255681 - DNA, 25 bp, Homo sapien
gttgcctagagtttgtcccagcgga

SEQ ID NO: 255682 - DNA, 25 bp, Homo sapien
tttgtcccagcggagggttggcttc

SEQ ID NO: 255683 - DNA, 25 bp, Homo sapien
tggcttcggatctgcagaggcttta

SEQ ID NO: 255684 - DNA, 25 bp, Homo sapien
acgtgggcgtggtgcacttcactcc

SEQ ID NO: 255685 - DNA, 25 bp, Homo sapien
tggtgcacttcactcccttgataca

SEQ ID NO: 255686 - DNA, 25 bp, Homo sapien
actcccttgatacagcccaagatag

SEQ ID NO: 255687 - DNA, 25 bp, Homo sapien
gttccgaaggaaatactgccatcga

SEQ ID NO: 255688 - DNA, 25 bp, Homo sapien
catcgagggctcagaatgttattcc

SEQ ID NO: 255689 - DNA, 25 bp, Homo sapien
gttattccctgaagcgcagcgcttg

SEQ ID NO: 255690 - DNA, 25 bp, Homo sapien
aaagcacgggcaggctgttagagtt

SEQ ID NO: 255691 - DNA, 25 bp, Homo sapien
agttggcagacatagaccctactct

SEQ ID NO: 255692 - DNA, 25 bp, Homo sapien
agctctccatctcacactttaagag

SEQ ID NO: 255693 - DNA, 25 bp, Homo sapien
catctcacactttaagagcctctgt

SEQ ID NO: 255694 - DNA, 25 bp, Homo sapien
tttaagagcctctgtgatgtataca

SEQ ID NO: 255695 - DNA, 25 bp, Homo sapien
tagtagcctgacatcgactctctca

SEQ ID NO: 255696 - DNA, 25 bp, Homo sapien
atttccctgttcttgcttctgacaa

SEQ ID NO: 255697 - DNA, 25 bp, Homo sapien
gcttctgacaaagtgaggcccaata

SEQ ID NO: 255698 - DNA, 25 bp, Homo sapien
tagggctcagactggttgctcagtt

SEQ ID NO: 255699 - DNA, 25 bp, Homo sapien
ggttgctcagttctggaaagatcag

SEQ ID NO: 255700 - DNA, 25 bp, Homo sapien
gatcagggatgctgccagcatggct

SEQ ID NO: 255701 - DNA, 25 bp, Homo sapien
agcatggctgtctcaacccactgag

SEQ ID NO: 255702 - DNA, 25 bp, Homo sapien
tcaacccactgagttctgtctaaac

SEQ ID NO: 255703 - DNA, 25 bp, Homo sapien
agcagattcctgcatgattcctgcc

SEQ ID NO: 255704 - DNA, 25 bp, Homo sapien
tgattcctgcccctggatcaggagt

SEQ ID NO: 255705 - DNA, 25 bp, Homo sapien
gatcaggagtctgctctacttgacc

SEQ ID NO: 255706 - DNA, 25 bp, Homo sapien
gtgtctgtgtttaatattaccaact

SEQ ID NO: 255707 - DNA, 25 bp, Homo sapien
tattaccaactacattggaagcctg

SEQ ID NO: 255708 - DNA, 25 bp, Homo sapien
aagcctgagcagggcgaggaccaat

SEQ ID NO: 255709 - DNA, 25 bp, Homo sapien
tttcctgtattgctttagtatgctg

SEQ ID NO: 255710 - DNA, 25 bp, Homo sapien
attgctttagtatgctggcttgtac

SEQ ID NO: 255711 - DNA, 25 bp, Homo sapien
atgctggcttgtacatagtaggcac

SEQ ID NO: 255712 - DNA, 25 bp, Homo sapien
catgtttgttggttgattgtttaag

SEQ ID NO: 255713 - DNA, 25 bp, Homo sapien
gattgtttaagccagagtgtattac

SEQ ID NO: 255714 - DNA, 25 bp, Homo sapien
gagtgtattacaacaatctggagat

SEQ ID NO: 255715 - DNA, 25 bp, Homo sapien
gggttctcaggttcactcattgaca

SEQ ID NO: 255716 - DNA, 25 bp, Homo sapien
acgttttgtgtatatttgcttcaac

SEQ ID NO: 255717 - DNA, 25 bp, Homo sapien
aatgaccccaagactgagcccaaga

SEQ ID NO: 255718 - DNA, 25 bp, Homo sapien
tgagcccaagaactgcgatcccaag

SEQ ID NO: 255719 - DNA, 25 bp, Homo sapien
gaactgcgatcccaagtgtgaacaa

SEQ ID NO: 255720 - DNA, 25 bp, Homo sapien
aagtgtgagtccaaatgccagccca

SEQ ID NO: 255721 - DNA, 25 bp, Homo sapien
gtgagtccaaatgccagcccagctg

SEQ ID NO: 255722 - DNA, 25 bp, Homo sapien
gccagcccagctgtttaaagaagct

SEQ ID NO: 255723 - DNA, 25 bp, Homo sapien
agtgcccatgggaaaagtgtccagc

SEQ ID NO: 255724 - DNA, 25 bp, Homo sapien
aaaagtgtccagcaccacccaagtg

SEQ ID NO: 255725 - DNA, 25 bp, Homo sapien
ctcactcaactgcttgtcaagttca

SEQ ID NO: 255726 - DNA, 25 bp, Homo sapien
tcaagttcaccaccaacacagaggg

SEQ ID NO: 255727 - DNA, 25 bp, Homo sapien
gaaacaatgtcgagtgatgataaaa

SEQ ID NO: 255728 - DNA, 25 bp, Homo sapien
gaatgataatatgtttgcttacaac

SEQ ID NO: 255729 - DNA, 25 bp, Homo sapien
atgataatatgtttgcttacaacga

SEQ ID NO: 255730 - DNA, 25 bp, Homo sapien
gataatatgtttgcttacaacgaag

SEQ ID NO: 255731 - DNA, 25 bp, Homo sapien
taatatgtttgcttacaacgaaggt

SEQ ID NO: 255732 - DNA, 25 bp, Homo sapien
atatgtttgcttacaacgaaggtgg

SEQ ID NO: 255733 - DNA, 25 bp, Homo sapien
atgtttgcttacaacgaaggtggac

SEQ ID NO: 255734 - DNA, 25 bp, Homo sapien
tgtttgcttacaacgaaggtggacg

SEQ ID NO: 255735 - DNA, 25 bp, Homo sapien
gtttgcttacaacgaaggtggacgt

SEQ ID NO: 255736 - DNA, 25 bp, Homo sapien
tttgcttacaacgaaggtggacgtg

SEQ ID NO: 255737 - DNA, 25 bp, Homo sapien
ttgcttacaacgaaggtggacgtgg

SEQ ID NO: 255738 - DNA, 25 bp, Homo sapien
cttacaacgaaggtggacgtgggcg

SEQ ID NO: 255739 - DNA, 25 bp, Homo sapien
tggctcttcccaccagtacaggaag

SEQ ID NO: 255740 - DNA, 25 bp, Homo sapien
tcccaccagtacaggaagatcattc

SEQ ID NO: 255741 - DNA, 25 bp, Homo sapien
tatggcttataagtgttctttcctg

SEQ ID NO: 255742 - DNA, 25 bp, Homo sapien
gttctttcctgtatgaagcccaagc

SEQ ID NO: 255743 - DNA, 25 bp, Homo sapien
gaagcccaagctgtccacttggaga

SEQ ID NO: 255744 - DNA, 25 bp, Homo sapien
aagaagccatcctagatgcccagcc

SEQ ID NO: 255745 - DNA, 25 bp, Homo sapien
aaaatggatcctgtctttcttagcc

SEQ ID NO: 255746 - DNA, 25 bp, Homo sapien
ggatcctgtctttcttagccaagga

SEQ ID NO: 255747 - DNA, 25 bp, Homo sapien
tagccaaggactggtctcttttctc

SEQ ID NO: 255748 - DNA, 25 bp, Homo sapien
ttctccaatgtgtccctaacagagt

SEQ ID NO: 255749 - DNA, 25 bp, Homo sapien
cctaacagagtggtgaggctggctc

SEQ ID NO: 255750 - DNA, 25 bp, Homo sapien
tatgttatgtgtgtgactcccttgt

SEQ ID NO: 255751 - DNA, 25 bp, Homo sapien
tctcactgactcaccgatgtgatgt

SEQ ID NO: 255752 - DNA, 25 bp, Homo sapien
atgtgatgtgcaggcccacttctta

SEQ ID NO: 255753 - DNA, 25 bp, Homo sapien
acttcttaccccagatagcctcggg

SEQ ID NO: 255754 - DNA, 25 bp, Homo sapien
tagcctcgggcgctgcctgtagtca

SEQ ID NO: 255755 - DNA, 25 bp, Homo sapien
gcctgtagtcatgctgacagctgta

SEQ ID NO: 255756 - DNA, 25 bp, Homo sapien
gacagctgtacagtagccgccaaga

SEQ ID NO: 255757 - DNA, 25 bp, Homo sapien
gccgccaagactgctgacagctgga

SEQ ID NO: 255758 - DNA, 25 bp, Homo sapien
agctggagacggttctggtttcaac

SEQ ID NO: 255759 - DNA, 25 bp, Homo sapien
ggttctggtttcaactacggtatat

SEQ ID NO: 255760 - DNA, 25 bp, Homo sapien
attctagacagatcctcggttgggt

SEQ ID NO: 255761 - DNA, 25 bp, Homo sapien
tcagacttagcatcctttccaaatc

SEQ ID NO: 255762 - DNA, 25 bp, Homo sapien
tgacagctgtcacatcaatccagcc

SEQ ID NO: 255763 - DNA, 25 bp, Homo sapien
tgcccccatctcatttccaaaaaag

SEQ ID NO: 255764 - DNA, 25 bp, Homo sapien
aagaaaaatcatagaggcctcccca

SEQ ID NO: 255765 - DNA, 25 bp, Homo sapien
agctgtcacatcaatccagcccaga

SEQ ID NO: 255766 - DNA, 25 bp, Homo sapien
aggcctccccaatacaaatgcatag

SEQ ID NO: 255767 - DNA, 25 bp, Homo sapien
tgcataggacatgggaaacaaggtt

SEQ ID NO: 255768 - DNA, 25 bp, Homo sapien
acaaggtttgaaaggatatccagaa

SEQ ID NO: 255769 - DNA, 25 bp, Homo sapien
aagcttagggatagccctggccttt

SEQ ID NO: 255770 - DNA, 25 bp, Homo sapien
cctggccttttggaggtgacttggg

SEQ ID NO: 255771 - DNA, 25 bp, Homo sapien
ggccagagtcagcagtaacttctcc

SEQ ID NO: 255772 - DNA, 25 bp, Homo sapien
aatgttggtgtgttctcaagggtat

SEQ ID NO: 255773 - DNA, 25 bp, Homo sapien
gttctcaagggtatgcatgtgtcat

SEQ ID NO: 255774 - DNA, 25 bp, Homo sapien
tcattttgaagaccaaggccctaga

SEQ ID NO: 255775 - DNA, 25 bp, Homo sapien
caaggccctagaattgtcaaactta

SEQ ID NO: 255776 - DNA, 25 bp, Homo sapien
gtagatctgaagaggcctcatcaga

SEQ ID NO: 255777 - DNA, 25 bp, Homo sapien
tgagggttgcttgttaaaaatgtcc

SEQ ID NO: 255778 - DNA, 25 bp, Homo sapien
gtccaaacgtgcagagactgatctt

SEQ ID NO: 255779 - DNA, 25 bp, Homo sapien
gaggcctcatcagagcacatatttt

SEQ ID NO: 255780 - DNA, 25 bp, Homo sapien
agagcacatattttaggacaacaca

SEQ ID NO: 255781 - DNA, 25 bp, Homo sapien
acatctttaagttggtttccataga

SEQ ID NO: 255782 - DNA, 25 bp, Homo sapien
tagagctatgcatgtatccttaccc

SEQ ID NO: 255783 - DNA, 25 bp, Homo sapien
taatcaaactctggtctcactgcct

SEQ ID NO: 255784 - DNA, 25 bp, Homo sapien
tgccttatctcacaccaactctgtt

SEQ ID NO: 255785 - DNA, 25 bp, Homo sapien
tcacaccaactctgtttcctcattg

SEQ ID NO: 255786 - DNA, 25 bp, Homo sapien
attgccccctgagatggcctgtctt

SEQ ID NO: 255787 - DNA, 25 bp, Homo sapien
ggtatagcttggatgtcttcttgga

SEQ ID NO: 255788 - DNA, 25 bp, Homo sapien
gcttggatgtcttcttggatggttc

SEQ ID NO: 255789 - DNA, 25 bp, Homo sapien
atgtcttcttggatggttctgctta

SEQ ID NO: 255790 - DNA, 25 bp, Homo sapien
gtcttcttggatggttctgcttaga

SEQ ID NO: 255791 - DNA, 25 bp, Homo sapien
tctgcttagaatgagtgtcaaggag

SEQ ID NO: 255792 - DNA, 25 bp, Homo sapien
atggaggatgtgtttgtgcgcctgt

SEQ ID NO: 255793 - DNA, 25 bp, Homo sapien
gaagtattctgcttatacaaaatcc

SEQ ID NO: 255794 - DNA, 25 bp, Homo sapien
agttgcttatggcatacaaggctaa

SEQ ID NO: 255795 - DNA, 25 bp, Homo sapien
gcttatggcatacaaggctaaaatt

SEQ ID NO: 255796 - DNA, 25 bp, Homo sapien
aggctaaaattaattcagctattta

SEQ ID NO: 255797 - DNA, 25 bp, Homo sapien
agtgttttacatatacaaatagctg

SEQ ID NO: 255798 - DNA, 25 bp, Homo sapien
acaaatagctgaagtaacattccta

SEQ ID NO: 255799 - DNA, 25 bp, Homo sapien
agctgaagtaacattcctataattt

SEQ ID NO: 255800 - DNA, 25 bp, Homo sapien
ataattttaatctgacattggttag

SEQ ID NO: 255801 - DNA, 25 bp, Homo sapien
ctgacattggttagatcaagaaaac

SEQ ID NO: 255802 - DNA, 25 bp, Homo sapien
aacattgttaataagactgtagaat

SEQ ID NO: 255803 - DNA, 25 bp, Homo sapien
gaagttacatattgttctttaaata

SEQ ID NO: 255804 - DNA, 25 bp, Homo sapien
gaatcttatctaacagcatagcagt

SEQ ID NO: 255805 - DNA, 25 bp, Homo sapien
ggctgacatccatgaagatgccaaa

SEQ ID NO: 255806 - DNA, 25 bp, Homo sapien
ggtactatgttccagagtgctttct

SEQ ID NO: 255807 - DNA, 25 bp, Homo sapien
gagtgctttctgtcatttcagtcaa

SEQ ID NO: 255808 - DNA, 25 bp, Homo sapien
gacacagctgagtttaggaagacat

SEQ ID NO: 255809 - DNA, 25 bp, Homo sapien
ggaagacatccaattatttcaaatt

SEQ ID NO: 255810 - DNA, 25 bp, Homo sapien
ggtttgattacattccttcaacaag

SEQ ID NO: 255811 - DNA, 25 bp, Homo sapien
gtgaactattacatctttgcagact

SEQ ID NO: 255812 - DNA, 25 bp, Homo sapien
gactaaccatcaggaatcaactatt

SEQ ID NO: 255813 - DNA, 25 bp, Homo sapien
aacaatagtactctacccttcgaga

SEQ ID NO: 255814 - DNA, 25 bp, Homo sapien
tctacccttcgagagtaagagtaat

SEQ ID NO: 255815 - DNA, 25 bp, Homo sapien
gttgatcgtgaattggctgacatcc

SEQ ID NO: 255816 - DNA, 25 bp, Homo sapien
aggtcctgctgtcccacttgaccat

SEQ ID NO: 255817 - DNA, 25 bp, Homo sapien
tgttacaatattcccatctcttctg

SEQ ID NO: 255818 - DNA, 25 bp, Homo sapien
ttctgctgaagctcctgtaaccagt

SEQ ID NO: 255819 - DNA, 25 bp, Homo sapien
gaagctcctgtaaccagtaagtcat

SEQ ID NO: 255820 - DNA, 25 bp, Homo sapien
gctaggacatttctggctttttctg

SEQ ID NO: 255821 - DNA, 25 bp, Homo sapien
tcatgagttgacgattgggagcctt

SEQ ID NO: 255822 - DNA, 25 bp, Homo sapien
attgggagccttgagcaccgtgacg

SEQ ID NO: 255823 - DNA, 25 bp, Homo sapien
gctcccgcgctgtgcacctggaagt

SEQ ID NO: 255824 - DNA, 25 bp, Homo sapien
agaagcatttgggtgtgggtaaatt

SEQ ID NO: 255825 - DNA, 25 bp, Homo sapien
cagtgttatctctggctacaagacc

SEQ ID NO: 255826 - DNA, 25 bp, Homo sapien
atctctggctacaagacccttagga

SEQ ID NO: 255827 - DNA, 25 bp, Homo sapien
taaatcactttacctagcgttttag

SEQ ID NO: 255828 - DNA, 25 bp, Homo sapien
tcactttacctagcgttttagaaat

SEQ ID NO: 255829 - DNA, 25 bp, Homo sapien
gtaaagcatgtgtatccagcgttat

SEQ ID NO: 255830 - DNA, 25 bp, Homo sapien
gtgtatccagcgttatgtactttgc

SEQ ID NO: 255831 - DNA, 25 bp, Homo sapien
cgttatgtactttgcgccttgtgac

SEQ ID NO: 255832 - DNA, 25 bp, Homo sapien
gtactttgcgccttgtgacgtcttt

SEQ ID NO: 255833 - DNA, 25 bp, Homo sapien
tttgcgccttgtgacgtctttctgt

SEQ ID NO: 255834 - DNA, 25 bp, Homo sapien
gacgtctttctgtcatgtagctttt

SEQ ID NO: 255835 - DNA, 25 bp, Homo sapien
gtctttctgtcatgtagcttttagg

SEQ ID NO: 255836 - DNA, 25 bp, Homo sapien
agcttttagggtgtagctgtgaaaa

SEQ ID NO: 255837 - DNA, 25 bp, Homo sapien
aatcatcagaactcttcactgaagc

SEQ ID NO: 255838 - DNA, 25 bp, Homo sapien
catctcctgctggtgacaagtgtca

SEQ ID NO: 255839 - DNA, 25 bp, Homo sapien
gaagtgggctgctcctgcaggaccc

SEQ ID NO: 255840 - DNA, 25 bp, Homo sapien
gaaacctggcgattcacaacagaga

SEQ ID NO: 255841 - DNA, 25 bp, Homo sapien
gagagctgagaaatcctaagtctgg

SEQ ID NO: 255842 - DNA, 25 bp, Homo sapien
gtctggattccagctaaatgggagc

SEQ ID NO: 255843 - DNA, 25 bp, Homo sapien
aatagagcggcagtcggcgaactac

SEQ ID NO: 255844 - DNA, 25 bp, Homo sapien
gtcggcgaactacatgtagcccatg

SEQ ID NO: 255845 - DNA, 25 bp, Homo sapien
gtagcccatgaacaaaatccggtcc

SEQ ID NO: 255846 - DNA, 25 bp, Homo sapien
aaatccggtccagcacgtgtgtttt

SEQ ID NO: 255847 - DNA, 25 bp, Homo sapien
aagtctgaatgcaacagcccctggt

SEQ ID NO: 255848 - DNA, 25 bp, Homo sapien
aggaatggctagaccacatctcctg

SEQ ID NO: 255849 - DNA, 25 bp, Homo sapien
tcctgttccctcaactgagagtagg

SEQ ID NO: 255850 - DNA, 25 bp, Homo sapien
aggaggttgatatggccttcttcta

SEQ ID NO: 255851 - DNA, 25 bp, Homo sapien
gatatggccttcttctagcacaact

SEQ ID NO: 255852 - DNA, 25 bp, Homo sapien
tcttttttctcttatatgggtacag

SEQ ID NO: 255853 - DNA, 25 bp, Homo sapien
gtggtgtgctaaagccagctcctac

SEQ ID NO: 255854 - DNA, 25 bp, Homo sapien
gccagctcctaccaattcattagag

SEQ ID NO: 255855 - DNA, 25 bp, Homo sapien
taccaattcattagagctgcttgtt

SEQ ID NO: 255856 - DNA, 25 bp, Homo sapien
gagctgcttgttgaattttcagcaa

SEQ ID NO: 255857 - DNA, 25 bp, Homo sapien
cgtccctatacaagccagtctaatg

SEQ ID NO: 255858 - DNA, 25 bp, Homo sapien
aagccagtctaatgacacagggagc

SEQ ID NO: 255859 - DNA, 25 bp, Homo sapien
agcaatttgattactcctgttccct

SEQ ID NO: 255860 - DNA, 25 bp, Homo sapien
cgcggtcgcggcttctggcttctct

SEQ ID NO: 255861 - DNA, 25 bp, Homo sapien
ctctgtggagcttggttcttccgtg

SEQ ID NO: 255862 - DNA, 25 bp, Homo sapien
tggttcttccgtggtggtgcagcac

SEQ ID NO: 255863 - DNA, 25 bp, Homo sapien
gcaccccaggaacttcaggaaccag

SEQ ID NO: 255864 - DNA, 25 bp, Homo sapien
ttccttggagagctccccgggacag

SEQ ID NO: 255865 - DNA, 25 bp, Homo sapien
gggccaagtgaaactagcgcgtttt

SEQ ID NO: 255866 - DNA, 25 bp, Homo sapien
aactagcgcgttttcttggatccta

SEQ ID NO: 255867 - DNA, 25 bp, Homo sapien
gcgttttcttggatcctacacttta

SEQ ID NO: 255868 - DNA, 25 bp, Homo sapien
ggatcctacactttatagtgagtca

SEQ ID NO: 255869 - DNA, 25 bp, Homo sapien
aatacaaagccaacaacatttgctg

SEQ ID NO: 255870 - DNA, 25 bp, Homo sapien
gttttcctccgtaccatctgacgtt

SEQ ID NO: 255871 - DNA, 25 bp, Homo sapien
cataggaatactgggaacctgtagt

SEQ ID NO: 255872 - DNA, 25 bp, Homo sapien
ttgctaagcctatagttatctccct

SEQ ID NO: 255873 - DNA, 25 bp, Homo sapien
atagttatctccctaagaaccataa

SEQ ID NO: 255874 - DNA, 25 bp, Homo sapien
atttcattccagtttagcttcctca

SEQ ID NO: 255875 - DNA, 25 bp, Homo sapien
gcttcctcattttacatgttgggag

SEQ ID NO: 255876 - DNA, 25 bp, Homo sapien
acatgttgggagtcatgccctttaa

SEQ ID NO: 255877 - DNA, 25 bp, Homo sapien
gagtcatgccctttaatatgcctgg

SEQ ID NO: 255878 - DNA, 25 bp, Homo sapien
aatatgcctggcactgcacggtggc

SEQ ID NO: 255879 - DNA, 25 bp, Homo sapien
gcagtagcagacttgggcttaccca

SEQ ID NO: 255880 - DNA, 25 bp, Homo sapien
tgggcttacccagaaccctaagtct

SEQ ID NO: 255881 - DNA, 25 bp, Homo sapien
gaaccctaagtctctgacgctatag

SEQ ID NO: 255882 - DNA, 25 bp, Homo sapien
gaaaatttgtttattgctgcaaagt

SEQ ID NO: 255883 - DNA, 25 bp, Homo sapien
atgtctgtcatcttattggtatttg

SEQ ID NO: 255884 - DNA, 25 bp, Homo sapien
tggtatttgttctgtcgtttgggta

SEQ ID NO: 255885 - DNA, 25 bp, Homo sapien
acggatgtgtttgacactgccttac

SEQ ID NO: 255886 - DNA, 25 bp, Homo sapien
tgacactgccttactacatagattg

SEQ ID NO: 255887 - DNA, 25 bp, Homo sapien
atcttgaagttttgttgcatttttg

SEQ ID NO: 255888 - DNA, 25 bp, Homo sapien
gtttgccagaagaaaatttgtctac

SEQ ID NO: 255889 - DNA, 25 bp, Homo sapien
aatttgtctactaacaattccagcc

SEQ ID NO: 255890 - DNA, 25 bp, Homo sapien
taactcttggattttgagactaaca

SEQ ID NO: 255891 - DNA, 25 bp, Homo sapien
gagactaacatcctactttttaata

SEQ ID NO: 255892 - DNA, 25 bp, Homo sapien
catcctactttttaatactgtctaa

SEQ ID NO: 255893 - DNA, 25 bp, Homo sapien
aactcaaagcaaattatggtctcgt

SEQ ID NO: 255894 - DNA, 25 bp, Homo sapien
atggtctcgtagagcctataccttt

SEQ ID NO: 255895 - DNA, 25 bp, Homo sapien
agagcctatacctttcgaatttcct

SEQ ID NO: 255896 - DNA, 25 bp, Homo sapien
gaatttcctcctacaagtgttcagt

SEQ ID NO: 255897 - DNA, 25 bp, Homo sapien
gtgttcagtggacaccagaaacatt

SEQ ID NO: 255898 - DNA, 25 bp, Homo sapien
aaacattggctgcatttgatctcac

SEQ ID NO: 255899 - DNA, 25 bp, Homo sapien
tgatctcaccaaaagacccaaggat

SEQ ID NO: 255900 - DNA, 25 bp, Homo sapien
agacccaaggatgacagtactaaac

SEQ ID NO: 255901 - DNA, 25 bp, Homo sapien
gaaccagacatcaaacctcaaaagg

SEQ ID NO: 255902 - DNA, 25 bp, Homo sapien
aaaggacactgggtgctacatctcc

SEQ ID NO: 255903 - DNA, 25 bp, Homo sapien
ctgggtgctacatctcctaaaatac

SEQ ID NO: 255904 - DNA, 25 bp, Homo sapien
cttctatgtaactcccatactgtct

SEQ ID NO: 255905 - DNA, 25 bp, Homo sapien
atgtaactcccatactgtcttaatc

SEQ ID NO: 255906 - DNA, 25 bp, Homo sapien
atactgtcttaatctccttggaagt

SEQ ID NO: 255907 - DNA, 25 bp, Homo sapien
gtcttaatctccttggaagtcctct

SEQ ID NO: 255908 - DNA, 25 bp, Homo sapien
agtgcccagcttctgcagctaaggc

SEQ ID NO: 255909 - DNA, 25 bp, Homo sapien
cagctaaggcccttcccttcataag

SEQ ID NO: 255910 - DNA, 25 bp, Homo sapien
aaaagtgtcttcatgttgctgccca

SEQ ID NO: 255911 - DNA, 25 bp, Homo sapien
gttgctgcccaactttgcagaaagt

SEQ ID NO: 255912 - DNA, 25 bp, Homo sapien
aaggcagtgaggaactatcaaatca

SEQ ID NO: 255913 - DNA, 25 bp, Homo sapien
caaaagctcttgtcattaggttaaa

SEQ ID NO: 255914 - DNA, 25 bp, Homo sapien
gctcttgtcattaggttaaaacgtt

SEQ ID NO: 255915 - DNA, 25 bp, Homo sapien
tacatccggttgatgccttaagtct

SEQ ID NO: 255916 - DNA, 25 bp, Homo sapien
tgccttaagtctccctggcttctta

SEQ ID NO: 255917 - DNA, 25 bp, Homo sapien
ggcttcttacaagtatcttctgggc

SEQ ID NO: 255918 - DNA, 25 bp, Homo sapien
ggtcaattcccgaaagctactgtgc

SEQ ID NO: 255919 - DNA, 25 bp, Homo sapien
ggacatgtttgttgtaagctttctt

SEQ ID NO: 255920 - DNA, 25 bp, Homo sapien
catctccccttgcaaataatatcct

SEQ ID NO: 255921 - DNA, 25 bp, Homo sapien
ttgcaaataatatcctccatctggg

SEQ ID NO: 255922 - DNA, 25 bp, Homo sapien
gcttcctccaattccaggagaggtg

SEQ ID NO: 255923 - DNA, 25 bp, Homo sapien
ggctgaaggtacagacttgggcatc

SEQ ID NO: 255924 - DNA, 25 bp, Homo sapien
aatcagtgcacagcagctctctgat

SEQ ID NO: 255925 - DNA, 25 bp, Homo sapien
agctctctgatacatccggttgatg

SEQ ID NO: 255926 - DNA, 25 bp, Homo sapien
aatcccgacaagacagcagccaaca

SEQ ID NO: 255927 - DNA, 25 bp, Homo sapien
gcagccaacattcgaggagactttt

SEQ ID NO: 255928 - DNA, 25 bp, Homo sapien
ggagacttttggctccttggagacc

SEQ ID NO: 255929 - DNA, 25 bp, Homo sapien
gtatttccagtttatgggacgggca

SEQ ID NO: 255930 - DNA, 25 bp, Homo sapien
tatgggacgggcagatgatatcatt

SEQ ID NO: 255931 - DNA, 25 bp, Homo sapien
tgatatcattaactccagcgggtac

SEQ ID NO: 255932 - DNA, 25 bp, Homo sapien
taactccagcgggtaccggattgga

SEQ ID NO: 255933 - DNA, 25 bp, Homo sapien
cagcgggtaccggattggaccctcg

SEQ ID NO: 255934 - DNA, 25 bp, Homo sapien
gaccctcggaggtagagaatgcact

SEQ ID NO: 255935 - DNA, 25 bp, Homo sapien
agcaccctgctgtggttgagacggc

SEQ ID NO: 255936 - DNA, 25 bp, Homo sapien
tgagacggctgtgatcagcagccca

SEQ ID NO: 255937 - DNA, 25 bp, Homo sapien
agtacagatggaacttgtcttgtga

SEQ ID NO: 255938 - DNA, 25 bp, Homo sapien
gtgaattaacatcctgactactttt

SEQ ID NO: 255939 - DNA, 25 bp, Homo sapien
tgactacttttgttgatcatcacat

SEQ ID NO: 255940 - DNA, 25 bp, Homo sapien
gatcatcacattttttcctcatgag

SEQ ID NO: 255941 - DNA, 25 bp, Homo sapien
aatagtgttttataggctcctgaga

SEQ ID NO: 255942 - DNA, 25 bp, Homo sapien
actaaagtcatcgagatctgggttc

SEQ ID NO: 255943 - DNA, 25 bp, Homo sapien
gatctgggttcaaatgacactgctt

SEQ ID NO: 255944 - DNA, 25 bp, Homo sapien
acactgcttagggaggcattcactg

SEQ ID NO: 255945 - DNA, 25 bp, Homo sapien
ggcattcactgatcaagttacctaa

SEQ ID NO: 255946 - DNA, 25 bp, Homo sapien
atcagctttacacagcaggcaagtt

SEQ ID NO: 255947 - DNA, 25 bp, Homo sapien
aagtttcctgctctctacaagtaca

SEQ ID NO: 255948 - DNA, 25 bp, Homo sapien
cacctctcagtgctgacggtgcctt

SEQ ID NO: 255949 - DNA, 25 bp, Homo sapien
ctctcagtgctgacggtgccttcat

SEQ ID NO: 255950 - DNA, 25 bp, Homo sapien
tctcagtgctgacggtgccttcatg

SEQ ID NO: 255951 - DNA, 25 bp, Homo sapien
tcagtgctgacggtgccttcatgtc

SEQ ID NO: 255952 - DNA, 25 bp, Homo sapien
agtgctgacggtgccttcatgtccc

SEQ ID NO: 255953 - DNA, 25 bp, Homo sapien
tatgggggggctaaattatctctat

SEQ ID NO: 255954 - DNA, 25 bp, Homo sapien
gggctaaattatctctattttgtag

SEQ ID NO: 255955 - DNA, 25 bp, Homo sapien
ggctaaattatctctattttgtaga

SEQ ID NO: 255956 - DNA, 25 bp, Homo sapien
gtagagaggatctatatttgtaggg

SEQ ID NO: 255957 - DNA, 25 bp, Homo sapien
ccaggccgggtccctatctctgtgt

SEQ ID NO: 255958 - DNA, 25 bp, Homo sapien
gggtccctatctctgtgtataaact

SEQ ID NO: 255959 - DNA, 25 bp, Homo sapien
aaatcatgaaaatcagctgttttat

SEQ ID NO: 255960 - DNA, 25 bp, Homo sapien
ctgttttatttgcataggacaacta

SEQ ID NO: 255961 - DNA, 25 bp, Homo sapien
gcataggacaactaacctgtctgtg

SEQ ID NO: 255962 - DNA, 25 bp, Homo sapien
aactaacctgtctgtgtaactttgt

SEQ ID NO: 255963 - DNA, 25 bp, Homo sapien
acatgtaaaatgtgacagcctgcaa

SEQ ID NO: 255964 - DNA, 25 bp, Homo sapien
gtgacagcctgcaattttgtagaca

SEQ ID NO: 255965 - DNA, 25 bp, Homo sapien
cagcctgcaattttgtagacagtga

SEQ ID NO: 255966 - DNA, 25 bp, Homo sapien
gtgaagtaatggctgctatttataa

SEQ ID NO: 255967 - DNA, 25 bp, Homo sapien
ggaaaaatcaccttggttgaatgtt

SEQ ID NO: 255968 - DNA, 25 bp, Homo sapien
gttgaatgtttctcactcattaaac

SEQ ID NO: 255969 - DNA, 25 bp, Homo sapien
tctcactcattaaactttgcagaag

SEQ ID NO: 255970 - DNA, 25 bp, Homo sapien
tttggaagtttttcaacagccctat

SEQ ID NO: 255971 - DNA, 25 bp, Homo sapien
ggaagtttttcaacagccctatgat

SEQ ID NO: 255972 - DNA, 25 bp, Homo sapien
agtttttcaacagccctatgattta

SEQ ID NO: 255973 - DNA, 25 bp, Homo sapien
cagccctatgatttataaactgtca

SEQ ID NO: 255974 - DNA, 25 bp, Homo sapien
taaactgtcaatcactatttttaca

SEQ ID NO: 255975 - DNA, 25 bp, Homo sapien
gtaaatgtgctaatattctcgatat

SEQ ID NO: 255976 - DNA, 25 bp, Homo sapien
gtgctaatattctcgatatatgtga

SEQ ID NO: 255977 - DNA, 25 bp, Homo sapien
ttcttggaagaagcacttaataatt

SEQ ID NO: 255978 - DNA, 25 bp, Homo sapien
aagtagattagtgtatttctcatac

SEQ ID NO: 255979 - DNA, 25 bp, Homo sapien
gatggcatagatttgcttttttagt

SEQ ID NO: 255980 - DNA, 25 bp, Homo sapien
gtaaattgtcagatatcagactcta

SEQ ID NO: 255981 - DNA, 25 bp, Homo sapien
aggccataatggctgggttccaact

SEQ ID NO: 255982 - DNA, 25 bp, Homo sapien
tgcctcatcttgcatgccaaagtca

SEQ ID NO: 255983 - DNA, 25 bp, Homo sapien
aaatatcttctactctgtgctctgg

SEQ ID NO: 255984 - DNA, 25 bp, Homo sapien
tgctctggcttgatccctacagtaa

SEQ ID NO: 255985 - DNA, 25 bp, Homo sapien
agtaactccgtgattgtcctgaaag

SEQ ID NO: 255986 - DNA, 25 bp, Homo sapien
aagtctggatttcccatgcattgtc

SEQ ID NO: 255987 - DNA, 25 bp, Homo sapien
ggaacaccgtctactgttgaaccat

SEQ ID NO: 255988 - DNA, 25 bp, Homo sapien
gcagaagttcatcgacctgagttat

SEQ ID NO: 255989 - DNA, 25 bp, Homo sapien
ttatagaaggtctcttctccttgcc

SEQ ID NO: 255990 - DNA, 25 bp, Homo sapien
tccttgccttttctggccagtgtgt

SEQ ID NO: 255991 - DNA, 25 bp, Homo sapien
gtgtgtccagcccttttaacgaaga

SEQ ID NO: 255992 - DNA, 25 bp, Homo sapien
tatctcctgaacaatattttctcac

SEQ ID NO: 255993 - DNA, 25 bp, Homo sapien
tcctgaacaatattttctcactcat

SEQ ID NO: 255994 - DNA, 25 bp, Homo sapien
attttctcactcatattcctctatc

SEQ ID NO: 255995 - DNA, 25 bp, Homo sapien
ttctcactcatattcctctatctta

SEQ ID NO: 255996 - DNA, 25 bp, Homo sapien
tcactcatattcctctatcttatca

SEQ ID NO: 255997 - DNA, 25 bp, Homo sapien
actcatattcctctatcttatcact

SEQ ID NO: 255998 - DNA, 25 bp, Homo sapien
tatcttatcacttagctaaagacag

SEQ ID NO: 255999 - DNA, 25 bp, Homo sapien
tttctattaatttgcaaactgatga

SEQ ID NO: 256000 - DNA, 25 bp, Homo sapien
ttaatttgcaaactgatgatttcac

SEQ ID NO: 256001 - DNA, 25 bp, Homo sapien
ttttcgattatcagagtacttagta

SEQ ID NO: 256002 - DNA, 25 bp, Homo sapien
tcgattatcagagtacttagtaaat

SEQ ID NO: 256003 - DNA, 25 bp, Homo sapien
ttcacacaacaggtgatacccctat

SEQ ID NO: 256004 - DNA, 25 bp, Homo sapien
ggtgatacccctataggttaattat

SEQ ID NO: 256005 - DNA, 25 bp, Homo sapien
ggttaattattctctagatattcta

SEQ ID NO: 256006 - DNA, 25 bp, Homo sapien
gaatacttagtcttatgtgagtcaa

SEQ ID NO: 256007 - DNA, 25 bp, Homo sapien
gtgagtcaagagctctattctgtct

SEQ ID NO: 256008 - DNA, 25 bp, Homo sapien
tctgtcttcactactgggtgtctac

SEQ ID NO: 256009 - DNA, 25 bp, Homo sapien
cactactgggtgtctactgttataa

SEQ ID NO: 256010 - DNA, 25 bp, Homo sapien
gggtgtctactgttataaactggag

SEQ ID NO: 256011 - DNA, 25 bp, Homo sapien
atatgtgtggttaaatgccatgttt

SEQ ID NO: 256012 - DNA, 25 bp, Homo sapien
gtaggaaagtgaattctgcatttaa

SEQ ID NO: 256013 - DNA, 25 bp, Homo sapien
ttaaatttcagggaaccagtcagaa

SEQ ID NO: 256014 - DNA, 25 bp, Homo sapien
aattagatgatctgcacactctgta

SEQ ID NO: 256015 - DNA, 25 bp, Homo sapien
gatgatctgcacactctgtatcata

SEQ ID NO: 256016 - DNA, 25 bp, Homo sapien
gatctgcacactctgtatcataaaa

SEQ ID NO: 256017 - DNA, 25 bp, Homo sapien
tgcacactctgtatcataaaaaatc

SEQ ID NO: 256018 - DNA, 25 bp, Homo sapien
tattaaattgaccatatctccagac

SEQ ID NO: 256019 - DNA, 25 bp, Homo sapien
aaattgaccatatctccagacaaga

SEQ ID NO: 256020 - DNA, 25 bp, Homo sapien
gaccatatctccagacaagattgtt

SEQ ID NO: 256021 - DNA, 25 bp, Homo sapien
gaggctgtgtgttgcctataatgaa

SEQ ID NO: 256022 - DNA, 25 bp, Homo sapien
tgattttcttgaactggtaagcgcc

SEQ ID NO: 256023 - DNA, 25 bp, Homo sapien
ttcttgaactggtaagcgccaaagc

SEQ ID NO: 256024 - DNA, 25 bp, Homo sapien
ctggtaagcgccaaagcatgtgttt

SEQ ID NO: 256025 - DNA, 25 bp, Homo sapien
tccccaagaccgttatgtgccattt

SEQ ID NO: 256026 - DNA, 25 bp, Homo sapien
tatgtgccatttcattcagccagga

SEQ ID NO: 256027 - DNA, 25 bp, Homo sapien
gacacacagggccagtttatgcaga

SEQ ID NO: 256028 - DNA, 25 bp, Homo sapien
gaaatgatcaacaacctcctgggcc

SEQ ID NO: 256029 - DNA, 25 bp, Homo sapien
tgggccctctggttgaagccaagga

SEQ ID NO: 256030 - DNA, 25 bp, Homo sapien
ggttgaagccaaggactgcacttta

SEQ ID NO: 256031 - DNA, 25 bp, Homo sapien
gactgcactttaatccgacacaacg

SEQ ID NO: 256032 - DNA, 25 bp, Homo sapien
ttaatccgacacaacgtgttccacg

SEQ ID NO: 256033 - DNA, 25 bp, Homo sapien
tcacatcgctgtgctggattcagaa

SEQ ID NO: 256034 - DNA, 25 bp, Homo sapien
ttcagaactcttcctggagaagttt

SEQ ID NO: 256035 - DNA, 25 bp, Homo sapien
gtttttcttggtggcaggactcaac

SEQ ID NO: 256036 - DNA, 25 bp, Homo sapien
gggacagcgccctctggagctcgct

SEQ ID NO: 256037 - DNA, 25 bp, Homo sapien
tctggagctcgctgggagcatcacc

SEQ ID NO: 256038 - DNA, 25 bp, Homo sapien
gctgggagcatcaccgcctggacgc

SEQ ID NO: 256039 - DNA, 25 bp, Homo sapien
tgtggcccggcagggaagatcgcct

SEQ ID NO: 256040 - DNA, 25 bp, Homo sapien
acggctcgccggtccagagccatga

SEQ ID NO: 256041 - DNA, 25 bp, Homo sapien
ggtccagagccatgagccaagagcc

SEQ ID NO: 256042 - DNA, 25 bp, Homo sapien
aagatcgcctggacgtggagccagc

SEQ ID NO: 256043 - DNA, 25 bp, Homo sapien
ggacgtggagccagcatcgccccgt

SEQ ID NO: 256044 - DNA, 25 bp, Homo sapien
gtgccctcggcgtttgcatttgtaa

SEQ ID NO: 256045 - DNA, 25 bp, Homo sapien
gccctcggcgtttgcatttgtaaac

SEQ ID NO: 256046 - DNA, 25 bp, Homo sapien
aacttgtggtcttcctatgtgtcag

SEQ ID NO: 256047 - DNA, 25 bp, Homo sapien
gaacgcaagctaaagagcctcatgg

SEQ ID NO: 256048 - DNA, 25 bp, Homo sapien
tggagaaaagcaccgaacctaagat

SEQ ID NO: 256049 - DNA, 25 bp, Homo sapien
gaaaccatgaggatgttgaagccag

SEQ ID NO: 256050 - DNA, 25 bp, Homo sapien
gatcccatgttacaggagggtacct

SEQ ID NO: 256051 - DNA, 25 bp, Homo sapien
gaggtgctgagctgccgatacctga

SEQ ID NO: 256052 - DNA, 25 bp, Homo sapien
gatacctgaggttatccaaggagaa

SEQ ID NO: 256053 - DNA, 25 bp, Homo sapien
agaacattcggaccttgctcaagtt

SEQ ID NO: 256054 - DNA, 25 bp, Homo sapien
aggagggtacctttaacagccagag

SEQ ID NO: 256055 - DNA, 25 bp, Homo sapien
gagggcaaccttcataagagactgg

SEQ ID NO: 256056 - DNA, 25 bp, Homo sapien
gagactggtccaacaagatgcctga

SEQ ID NO: 256057 - DNA, 25 bp, Homo sapien
acaagatgcctgacatggcttacga

SEQ ID NO: 256058 - DNA, 25 bp, Homo sapien
acggagccgtcttgcccagccttga

SEQ ID NO: 256059 - DNA, 25 bp, Homo sapien
agcaagcttttttacatctcggatc

SEQ ID NO: 256060 - DNA, 25 bp, Homo sapien
ttttacatctcggatctgggcagtg

SEQ ID NO: 256061 - DNA, 25 bp, Homo sapien
acatctcggatctgggcagtgccct

SEQ ID NO: 256062 - DNA, 25 bp, Homo sapien
ggctgcctggttgcccagaggtggg

SEQ ID NO: 256063 - DNA, 25 bp, Homo sapien
aggaagccagcaggcgcccatggat

SEQ ID NO: 256064 - DNA, 25 bp, Homo sapien
agcaggcgcccatggatggtgtcat

SEQ ID NO: 256065 - DNA, 25 bp, Homo sapien
gcgcccatggatggtgtcatcggaa

SEQ ID NO: 256066 - DNA, 25 bp, Homo sapien
atggtgtcatcggaacagtcgccgg

SEQ ID NO: 256067 - DNA, 25 bp, Homo sapien
catcggaacagtcgccgggcactca

SEQ ID NO: 256068 - DNA, 25 bp, Homo sapien
cctttgggtccgaccaggccgctgg

SEQ ID NO: 256069 - DNA, 25 bp, Homo sapien
gcctcactttttggactggatcagg

SEQ ID NO: 256070 - DNA, 25 bp, Homo sapien
ttttggactggatcaggcagctgct

SEQ ID NO: 256071 - DNA, 25 bp, Homo sapien
gaaccacacaaccagagaggtgaga

SEQ ID NO: 256072 - DNA, 25 bp, Homo sapien
aaccacacaaccagagaggtgagag

SEQ ID NO: 256073 - DNA, 25 bp, Homo sapien
accacacaaccagagaggtgagagt

SEQ ID NO: 256074 - DNA, 25 bp, Homo sapien
agaggtgagagtgctcccacatctc

SEQ ID NO: 256075 - DNA, 25 bp, Homo sapien
gaggtgagagtgctcccacatctca

SEQ ID NO: 256076 - DNA, 25 bp, Homo sapien
gagagtgctcccacatctcatgtat

SEQ ID NO: 256077 - DNA, 25 bp, Homo sapien
agtgctcccacatctcatgtatatt

SEQ ID NO: 256078 - DNA, 25 bp, Homo sapien
gctcccacatctcatgtatattcag

SEQ ID NO: 256079 - DNA, 25 bp, Homo sapien
caggcagctgctggccatggaaatg

SEQ ID NO: 256080 - DNA, 25 bp, Homo sapien
gttgattctagggtcagggccctca

SEQ ID NO: 256081 - DNA, 25 bp, Homo sapien
gattctagggtcagggccctcactc

SEQ ID NO: 256082 - DNA, 25 bp, Homo sapien
gtgaagatcatggaggagccatctt

SEQ ID NO: 256083 - DNA, 25 bp, Homo sapien
gaagatcatggaggagccatcttaa

SEQ ID NO: 256084 - DNA, 25 bp, Homo sapien
cacactgctggaaggttaaagtcga

SEQ ID NO: 256085 - DNA, 25 bp, Homo sapien
actgctggaaggttaaagtcgactt

SEQ ID NO: 256086 - DNA, 25 bp, Homo sapien
aaggttaaagtcgacttcacgctag

SEQ ID NO: 256087 - DNA, 25 bp, Homo sapien
gttaaagtcgacttcacgctagttt

SEQ ID NO: 256088 - DNA, 25 bp, Homo sapien
aaagtcgacttcacgctagtttaag

SEQ ID NO: 256089 - DNA, 25 bp, Homo sapien
gtcgacttcacgctagtttaaggaa

SEQ ID NO: 256090 - DNA, 25 bp, Homo sapien
gacttcacgctagtttaaggaaata

SEQ ID NO: 256091 - DNA, 25 bp, Homo sapien
aatctgtatcacaagaatcacaaca

SEQ ID NO: 256092 - DNA, 25 bp, Homo sapien
cagccatcagagagaccgagtccat

SEQ ID NO: 256093 - DNA, 25 bp, Homo sapien
tctgggactcctgcttggaacataa

SEQ ID NO: 256094 - DNA, 25 bp, Homo sapien
aatcgcatctgatatcatgagttgc

SEQ ID NO: 256095 - DNA, 25 bp, Homo sapien
gatatcatgagttgcattttacaga

SEQ ID NO: 256096 - DNA, 25 bp, Homo sapien
cccattgcagtgaaattcctccaca

SEQ ID NO: 256097 - DNA, 25 bp, Homo sapien
tgcagtgaaattcctccacagaggc

SEQ ID NO: 256098 - DNA, 25 bp, Homo sapien
ctccacagaggcaacaaggaactgt

SEQ ID NO: 256099 - DNA, 25 bp, Homo sapien
ggaactgtgcaggaatatgtctaac

SEQ ID NO: 256100 - DNA, 25 bp, Homo sapien
aatatgtctaactacctgtctctgg

SEQ ID NO: 256101 - DNA, 25 bp, Homo sapien
tctaactacctgtctctggctgcaa

SEQ ID NO: 256102 - DNA, 25 bp, Homo sapien
ttagctggtcccttcatttcccgat

SEQ ID NO: 256103 - DNA, 25 bp, Homo sapien
atttcccgatcacagtgcactttat

SEQ ID NO: 256104 - DNA, 25 bp, Homo sapien
atcacagtgcactttatccgtcttt

SEQ ID NO: 256105 - DNA, 25 bp, Homo sapien
ttatccgtctttgccatttcatcaa

SEQ ID NO: 256106 - DNA, 25 bp, Homo sapien
tcaaatttagacttctctttcccgg

SEQ ID NO: 256107 - DNA, 25 bp, Homo sapien
tagacttctctttcccggacattgt

SEQ ID NO: 256108 - DNA, 25 bp, Homo sapien
ggacattgtcttccacctttcagag

SEQ ID NO: 256109 - DNA, 25 bp, Homo sapien
ccacctttcagagcacttcttggaa

SEQ ID NO: 256110 - DNA, 25 bp, Homo sapien
tcttggaaaattccggactcttgtc

SEQ ID NO: 256111 - DNA, 25 bp, Homo sapien
tctccaatagagatgccagggtttg

SEQ ID NO: 256112 - DNA, 25 bp, Homo sapien
ggcggatttccgaagagaacaggaa

SEQ ID NO: 256113 - DNA, 25 bp, Homo sapien
gcaaaaagttctcccacacatggta

SEQ ID NO: 256114 - DNA, 25 bp, Homo sapien
acatggtagaaagtcagcccctggc

SEQ ID NO: 256115 - DNA, 25 bp, Homo sapien
taggcaaatgcgatgcagagcccag

SEQ ID NO: 256116 - DNA, 25 bp, Homo sapien
tgatccttctctctgtgctgatggt

SEQ ID NO: 256117 - DNA, 25 bp, Homo sapien
tgatggtccaggtatgtcctctgat

SEQ ID NO: 256118 - DNA, 25 bp, Homo sapien
atgtcctctgatcggtgaaatcctc

SEQ ID NO: 256119 - DNA, 25 bp, Homo sapien
aaatcctcgggcagctggatgtgaa

SEQ ID NO: 256120 - DNA, 25 bp, Homo sapien
aacaggaggctgctcatgaaccaac

SEQ ID NO: 256121 - DNA, 25 bp, Homo sapien
atgaaccaacccaccatgaaaccag

SEQ ID NO: 256122 - DNA, 25 bp, Homo sapien
gcagagcccagcagtgtccatgtgg

SEQ ID NO: 256123 - DNA, 25 bp, Homo sapien
tgaggctatcccaccaaagatgaat

SEQ ID NO: 256124 - DNA, 25 bp, Homo sapien
tcaggaccctggaaacaatacacaa

SEQ ID NO: 256125 - DNA, 25 bp, Homo sapien
caacaaacttgtacatctgccataa

SEQ ID NO: 256126 - DNA, 25 bp, Homo sapien
gtacatctgccataagtctgacacc

SEQ ID NO: 256127 - DNA, 25 bp, Homo sapien
taagtctgacaccatcctagttatc

SEQ ID NO: 256128 - DNA, 25 bp, Homo sapien
tgacaccatcctagttatcagggat

SEQ ID NO: 256129 - DNA, 25 bp, Homo sapien
tgtaaacctaacctcatgcatctgt

SEQ ID NO: 256130 - DNA, 25 bp, Homo sapien
taacctcatgcatctgtgaatctcc

SEQ ID NO: 256131 - DNA, 25 bp, Homo sapien
gtgaatctccccatctaaaaagaca

SEQ ID NO: 256132 - DNA, 25 bp, Homo sapien
gacacagccttgtaaagaagcttgt

SEQ ID NO: 256133 - DNA, 25 bp, Homo sapien
agcttgtgtgaaagtgctaacgaca

SEQ ID NO: 256134 - DNA, 25 bp, Homo sapien
gtgctaacgacagacatgccaagtg

SEQ ID NO: 256135 - DNA, 25 bp, Homo sapien
gcttggcactgttctatatgtctta

SEQ ID NO: 256136 - DNA, 25 bp, Homo sapien
ttaaccatcaacactcttatgaggt

SEQ ID NO: 256137 - DNA, 25 bp, Homo sapien
tgaggtaaatatcccgcaattactt

SEQ ID NO: 256138 - DNA, 25 bp, Homo sapien
ttttgcgccaacctagtaccactac

SEQ ID NO: 256139 - DNA, 25 bp, Homo sapien
gagaggctaagttacaagggcacac

SEQ ID NO: 256140 - DNA, 25 bp, Homo sapien
ggcgcttaggaggataccatttggt

SEQ ID NO: 256141 - DNA, 25 bp, Homo sapien
gcacacagccataaactttggatct

SEQ ID NO: 256142 - DNA, 25 bp, Homo sapien
aaactttggatctgtggagtgactg

SEQ ID NO: 256143 - DNA, 25 bp, Homo sapien
gagtgactgggcttcagagtcctct

SEQ ID NO: 256144 - DNA, 25 bp, Homo sapien
agtgataatagctcaaactcttttg

SEQ ID NO: 256145 - DNA, 25 bp, Homo sapien
gcatttagtacatgcttggcactgt

SEQ ID NO: 256146 - DNA, 25 bp, Homo sapien
ctatggatcaacactggtcaggagg

SEQ ID NO: 256147 - DNA, 25 bp, Homo sapien
gacacgaaggccataccgggagctg

SEQ ID NO: 256148 - DNA, 25 bp, Homo sapien
ggagctgctctctgattaccaggac

SEQ ID NO: 256149 - DNA, 25 bp, Homo sapien
aggactcctgaaacacagagctcat

SEQ ID NO: 256150 - DNA, 25 bp, Homo sapien
cagagctcatggtgtccgtgggata

SEQ ID NO: 256151 - DNA, 25 bp, Homo sapien
gatatgaggcagaccacatccagtc

SEQ ID NO: 256152 - DNA, 25 bp, Homo sapien
accacatccagtccttgttagaaca

SEQ ID NO: 256153 - DNA, 25 bp, Homo sapien
taccatggcctggtactgaatcctg

SEQ ID NO: 256154 - DNA, 25 bp, Homo sapien
caggaaacctgatgcagggctccat

SEQ ID NO: 256155 - DNA, 25 bp, Homo sapien
agggctccatcatcacagcaaagtc

SEQ ID NO: 256156 - DNA, 25 bp, Homo sapien
agtctttgccttcagtggatcccac

SEQ ID NO: 256157 - DNA, 25 bp, Homo sapien
tacgctgtagcagaaccagatggct

SEQ ID NO: 256158 - DNA, 25 bp, Homo sapien
ttctggaactatggatcttgacccc

SEQ ID NO: 256159 - DNA, 25 bp, Homo sapien
ctatggatcttgaccccaaggatat

SEQ ID NO: 256160 - DNA, 25 bp, Homo sapien
gaccccaaggatatattattttatt

SEQ ID NO: 256161 - DNA, 25 bp, Homo sapien
caggtaggcgaaaagatgacaggat

SEQ ID NO: 256162 - DNA, 25 bp, Homo sapien
cagctacttcattcctgtaaatact

SEQ ID NO: 256163 - DNA, 25 bp, Homo sapien
attcctgtaaatactcttgctgtgt

SEQ ID NO: 256164 - DNA, 25 bp, Homo sapien
tactcttgctgtgttataaatatgg

SEQ ID NO: 256165 - DNA, 25 bp, Homo sapien
atgaccaatatcaatagacttcttg

SEQ ID NO: 256166 - DNA, 25 bp, Homo sapien
atagacttcttgaggctactataag

SEQ ID NO: 256167 - DNA, 25 bp, Homo sapien
cttgaggctactataagttttgaga

SEQ ID NO: 256168 - DNA, 25 bp, Homo sapien
gaccaagcggacatcacttatgagg

SEQ ID NO: 256169 - DNA, 25 bp, Homo sapien
agaagatgaccagcctgagctcctg

SEQ ID NO: 256170 - DNA, 25 bp, Homo sapien
acaaagcccagtctgtgtctcaaat

SEQ ID NO: 256171 - DNA, 25 bp, Homo sapien
gtgtctcaaatcaaccacaagctgg

SEQ ID NO: 256172 - DNA, 25 bp, Homo sapien
atcaaccacaagctggaggcacagt

SEQ ID NO: 256173 - DNA, 25 bp, Homo sapien
ggcacagttggtggatctgaaatct

SEQ ID NO: 256174 - DNA, 25 bp, Homo sapien
gaagtacatgatcagcttttacagc

SEQ ID NO: 256175 - DNA, 25 bp, Homo sapien
agcttttacagctgcactctattca

SEQ ID NO: 256176 - DNA, 25 bp, Homo sapien
tctattcagctgcagcttcatgcta

SEQ ID NO: 256177 - DNA, 25 bp, Homo sapien
gcttcatgctaaaactggtcaaagt

SEQ ID NO: 256178 - DNA, 25 bp, Homo sapien
aaagtgctgactctggtaccattaa

SEQ ID NO: 256179 - DNA, 25 bp, Homo sapien
acttccatggctggtttgggtgcag

SEQ ID NO: 256180 - DNA, 25 bp, Homo sapien
ttgggtgcagacatcatccaacttt

SEQ ID NO: 256181 - DNA, 25 bp, Homo sapien
caactttggacagaggatacaggct

SEQ ID NO: 256182 - DNA, 25 bp, Homo sapien
acaggctggcttgagctggcagctt

SEQ ID NO: 256183 - DNA, 25 bp, Homo sapien
tcctttcttcatgggtattattgct

SEQ ID NO: 256184 - DNA, 25 bp, Homo sapien
attgcttgtcttataatgttggtga

SEQ ID NO: 256185 - DNA, 25 bp, Homo sapien
agatttttcaccttccaagctgccc

SEQ ID NO: 256186 - DNA, 25 bp, Homo sapien
aagctgcccaaacccagtcaatttc

SEQ ID NO: 256187 - DNA, 25 bp, Homo sapien
aatttccacgtgactatactggttt

SEQ ID NO: 256188 - DNA, 25 bp, Homo sapien
gagggcagatagctgtgctctctac

SEQ ID NO: 256189 - DNA, 25 bp, Homo sapien
tacctttatctggagttattgagtc

SEQ ID NO: 256190 - DNA, 25 bp, Homo sapien
cttatgtagcgtcctgctcgaagac

SEQ ID NO: 256191 - DNA, 25 bp, Homo sapien
gtagcgtcctgctcgaagacgccag

SEQ ID NO: 256192 - DNA, 25 bp, Homo sapien
gctcgaagacgccaggccttacttc

SEQ ID NO: 256193 - DNA, 25 bp, Homo sapien
caggccttacttcaccacagtattt

SEQ ID NO: 256194 - DNA, 25 bp, Homo sapien
gccttacttcaccacagtatttcag

SEQ ID NO: 256195 - DNA, 25 bp, Homo sapien
agtatttcagaatagtgtgtacaga

SEQ ID NO: 256196 - DNA, 25 bp, Homo sapien
gtgtacagagtattaaaggttaact

SEQ ID NO: 256197 - DNA, 25 bp, Homo sapien
gttaactgagaaggatactacccat

SEQ ID NO: 256198 - DNA, 25 bp, Homo sapien
gagaaggatactacccattttacta

SEQ ID NO: 256199 - DNA, 25 bp, Homo sapien
ggatactacccattttactatggca

SEQ ID NO: 256200 - DNA, 25 bp, Homo sapien
tactacccattttactatggcacaa

SEQ ID NO: 256201 - DNA, 25 bp, Homo sapien
aagtcagctgcattgattgtgttct

SEQ ID NO: 256202 - DNA, 25 bp, Homo sapien
aagcccaagaaagctcatgtatttg

SEQ ID NO: 256203 - DNA, 25 bp, Homo sapien
atgtatttggtttctaatttcagtg

SEQ ID NO: 256204 - DNA, 25 bp, Homo sapien
ttgctcttagatgcttcccataatc

SEQ ID NO: 256205 - DNA, 25 bp, Homo sapien
ttcccataatcctggcacattaaaa

SEQ ID NO: 256206 - DNA, 25 bp, Homo sapien
caagactagtaggtttgggacacct

SEQ ID NO: 256207 - DNA, 25 bp, Homo sapien
tttgggacacctttaaatcctcact

SEQ ID NO: 256208 - DNA, 25 bp, Homo sapien
aatcctcacttcagagactaccaaa

SEQ ID NO: 256209 - DNA, 25 bp, Homo sapien
tttaggtggaagtcagctctctgtt

SEQ ID NO: 256210 - DNA, 25 bp, Homo sapien
gtcagctctctgttagtgactaaat

SEQ ID NO: 256211 - DNA, 25 bp, Homo sapien
aatatcatgcctgttgtggtgctgc

SEQ ID NO: 256212 - DNA, 25 bp, Homo sapien
gtacacgtcagcgagctctttagct

SEQ ID NO: 256213 - DNA, 25 bp, Homo sapien
ttagctgcccaacaaagagatcccc

SEQ ID NO: 256214 - DNA, 25 bp, Homo sapien
aagagatccccgatcctactgtctt

SEQ ID NO: 256215 - DNA, 25 bp, Homo sapien
tactgtcttcccgttctagatattt

SEQ ID NO: 256216 - DNA, 25 bp, Homo sapien
agatattttctccacatctgtcggc

SEQ ID NO: 256217 - DNA, 25 bp, Homo sapien
ggcctttctcgtcatcaggaagatg

SEQ ID NO: 256218 - DNA, 25 bp, Homo sapien
gttggacttaggtctcagtgtcact

SEQ ID NO: 256219 - DNA, 25 bp, Homo sapien
agtgtcactcggttcacctcgttat

SEQ ID NO: 256220 - DNA, 25 bp, Homo sapien
acctcgttatggagcccatccagaa

SEQ ID NO: 256221 - DNA, 25 bp, Homo sapien
gagcatcctgctgattatagccaac

SEQ ID NO: 256222 - DNA, 25 bp, Homo sapien
atctctggatctgggtcttgaactc

SEQ ID NO: 256223 - DNA, 25 bp, Homo sapien
cacctctcagtgctgacggtgcctt

SEQ ID NO: 256224 - DNA, 25 bp, Homo sapien
ctctcagtgctgacggtgccttcat

SEQ ID NO: 256225 - DNA, 25 bp, Homo sapien
tctcagtgctgacggtgccttcatg

SEQ ID NO: 256226 - DNA, 25 bp, Homo sapien
tcagtgctgacggtgccttcatgtc

SEQ ID NO: 256227 - DNA, 25 bp, Homo sapien
ccctgccctctgtaccccgtgaggg

SEQ ID NO: 256228 - DNA, 25 bp, Homo sapien
tatgggggggctaaattatctctat

SEQ ID NO: 256229 - DNA, 25 bp, Homo sapien
gggctaaattatctctattttgtag

SEQ ID NO: 256230 - DNA, 25 bp, Homo sapien
ggctaaattatctctattttgtaga

SEQ ID NO: 256231 - DNA, 25 bp, Homo sapien
aattatctctattttgtagagagga

SEQ ID NO: 256232 - DNA, 25 bp, Homo sapien
gtagagaggatctatatttgtaggg

SEQ ID NO: 256233 - DNA, 25 bp, Homo sapien
ccaggccgggtccctatctctgtgt

SEQ ID NO: 256234 - DNA, 25 bp, Homo sapien
aacttaggcaacagaatgcttgttt

SEQ ID NO: 256235 - DNA, 25 bp, Homo sapien
atgcttgtttggtcacacagaatca

SEQ ID NO: 256236 - DNA, 25 bp, Homo sapien
gtttggtcacacagaatcattcctt

SEQ ID NO: 256237 - DNA, 25 bp, Homo sapien
ggtcacacagaatcattccttaatg

SEQ ID NO: 256238 - DNA, 25 bp, Homo sapien
gaattaacacagtcaagagcaaaag

SEQ ID NO: 256239 - DNA, 25 bp, Homo sapien
aagtttctatgcttgagtctgctca

SEQ ID NO: 256240 - DNA, 25 bp, Homo sapien
tatgcttgagtctgctcaacagcag

SEQ ID NO: 256241 - DNA, 25 bp, Homo sapien
tctgctcaacagcaggcagccagtg

SEQ ID NO: 256242 - DNA, 25 bp, Homo sapien
agtgtcccaatcttagaagaacaga

SEQ ID NO: 256243 - DNA, 25 bp, Homo sapien
gaagcagaggtttcagctcaagata

SEQ ID NO: 256244 - DNA, 25 bp, Homo sapien
ggaacagagtttgcaggagtccaaa

SEQ ID NO: 256245 - DNA, 25 bp, Homo sapien
ttgggtttcgctcacgtttcccact

SEQ ID NO: 256246 - DNA, 25 bp, Homo sapien
gcacctcacgtcctgttacgtgttt

SEQ ID NO: 256247 - DNA, 25 bp, Homo sapien
tgttacgtgttttctaggacttagc

SEQ ID NO: 256248 - DNA, 25 bp, Homo sapien
gttttctaggacttagcagctgtca

SEQ ID NO: 256249 - DNA, 25 bp, Homo sapien
cttagcagctgtcacagggttgcca

SEQ ID NO: 256250 - DNA, 25 bp, Homo sapien
agggttgccacataaagcaggtcat

SEQ ID NO: 256251 - DNA, 25 bp, Homo sapien
aagcaggtcatgacccaaggtgcag

SEQ ID NO: 256252 - DNA, 25 bp, Homo sapien
cacgtttcccactgaagcgggattt

SEQ ID NO: 256253 - DNA, 25 bp, Homo sapien
gccacgagtgacaagatgcagagag

SEQ ID NO: 256254 - DNA, 25 bp, Homo sapien
tgataatccccgcaattcccgagtg

SEQ ID NO: 256255 - DNA, 25 bp, Homo sapien
gcaattcccgagtgcagaatgtctc

SEQ ID NO: 256256 - DNA, 25 bp, Homo sapien
gagcttattcaagatacatggagga

SEQ ID NO: 256257 - DNA, 25 bp, Homo sapien
cattatcatttttgtctttcatatt

SEQ ID NO: 256258 - DNA, 25 bp, Homo sapien
tttaagggtttgcatttctaggact

SEQ ID NO: 256259 - DNA, 25 bp, Homo sapien
tttctaggacttggaatagttgacc

SEQ ID NO: 256260 - DNA, 25 bp, Homo sapien
ggaatagttgaccatatacatagct

SEQ ID NO: 256261 - DNA, 25 bp, Homo sapien
gttgaccatatacatagctaaagga

SEQ ID NO: 256262 - DNA, 25 bp, Homo sapien
ggacatgtccctgaatgagaccatt

SEQ ID NO: 256263 - DNA, 25 bp, Homo sapien
gtccctgaatgagaccattatatat

SEQ ID NO: 256264 - DNA, 25 bp, Homo sapien
aagttcaccagacatctctttgtgg

SEQ ID NO: 256265 - DNA, 25 bp, Homo sapien
gttcaccagacatctctttgtggta

SEQ ID NO: 256266 - DNA, 25 bp, Homo sapien
tgggaccagatttcacagagcttat

SEQ ID NO: 256267 - DNA, 25 bp, Homo sapien
aatattcagatcaagccggcaacag

SEQ ID NO: 256268 - DNA, 25 bp, Homo sapien
attggtcaaattccatcacttcctc

SEQ ID NO: 256269 - DNA, 25 bp, Homo sapien
taaccctgctatcctagcagtgctg

SEQ ID NO: 256270 - DNA, 25 bp, Homo sapien
cacttcctcaccctttgtttcattt

SEQ ID NO: 256271 - DNA, 25 bp, Homo sapien
atttaaacctgtctttctggctttg

SEQ ID NO: 256272 - DNA, 25 bp, Homo sapien
tgtctttctggctttgaaccgttat

SEQ ID NO: 256273 - DNA, 25 bp, Homo sapien
gaaccgttatattggagtccgcatc

SEQ ID NO: 256274 - DNA, 25 bp, Homo sapien
ttggagtccgcatcttagaacaaga

SEQ ID NO: 256275 - DNA, 25 bp, Homo sapien
attcctctggcagaagttcctgcta

SEQ ID NO: 256276 - DNA, 25 bp, Homo sapien
gctatcatcccaatggaaatgtctg

SEQ ID NO: 256277 - DNA, 25 bp, Homo sapien
gtatacatcaatatcttgggaggtc

SEQ ID NO: 256278 - DNA, 25 bp, Homo sapien
agcttaaacgagctgcctcgtgtgt

SEQ ID NO: 256279 - DNA, 25 bp, Homo sapien
gagctgcctcgtgtgtgtacacata

SEQ ID NO: 256280 - DNA, 25 bp, Homo sapien
ttgtatgtgtgtgagtttcagcaga

SEQ ID NO: 256281 - DNA, 25 bp, Homo sapien
agaacatcaggtgagcagccttgat

SEQ ID NO: 256282 - DNA, 25 bp, Homo sapien
gagcagccttgatttataattctgg

SEQ ID NO: 256283 - DNA, 25 bp, Homo sapien
ataattctggctatacatcctactg

SEQ ID NO: 256284 - DNA, 25 bp, Homo sapien
ggctatacatcctactgtacctctg

SEQ ID NO: 256285 - DNA, 25 bp, Homo sapien
gtttaggaataatcacatgttgcat

SEQ ID NO: 256286 - DNA, 25 bp, Homo sapien
acatacttataagcagtggtggtag

SEQ ID NO: 256287 - DNA, 25 bp, Homo sapien
gtgtctgatttaaatcctcaggtgg

SEQ ID NO: 256288 - DNA, 25 bp, Homo sapien
taaatcctcaggtggcagcttaaac

SEQ ID NO: 256289 - DNA, 25 bp, Homo sapien
caatttcaccaacattctaacccat

SEQ ID NO: 256290 - DNA, 25 bp, Homo sapien
aacccatgaaacttttacactctgt

SEQ ID NO: 256291 - DNA, 25 bp, Homo sapien
tacactctgtgccaagaaactgttg

SEQ ID NO: 256292 - DNA, 25 bp, Homo sapien
aacatttgcagattcaggtctcaag

SEQ ID NO: 256293 - DNA, 25 bp, Homo sapien
gatgtctcataagcagcattttccc

SEQ ID NO: 256294 - DNA, 25 bp, Homo sapien
gcattttcccaacagtttagcatct

SEQ ID NO: 256295 - DNA, 25 bp, Homo sapien
gtttagcatctgtacacatctgcct

SEQ ID NO: 256296 - DNA, 25 bp, Homo sapien
gtacacatctgccttggtcatcagt

SEQ ID NO: 256297 - DNA, 25 bp, Homo sapien
tggtcatcagtccactcacagagta

SEQ ID NO: 256298 - DNA, 25 bp, Homo sapien
gaatggcatcccttgagaaggaaag

SEQ ID NO: 256299 - DNA, 25 bp, Homo sapien
ggttaatatacatactgagctccta

SEQ ID NO: 256300 - DNA, 25 bp, Homo sapien
gtgctcgcctggagcggtgccatgg

SEQ ID NO: 256301 - DNA, 25 bp, Homo sapien
tgccatggtgtgagtgttgccctgc

SEQ ID NO: 256302 - DNA, 25 bp, Homo sapien
gttgccctgcgtggtgactgcacca

SEQ ID NO: 256303 - DNA, 25 bp, Homo sapien
gtggtgactgcaccatcctccgtgg

SEQ ID NO: 256304 - DNA, 25 bp, Homo sapien
gtgctgcccgccacttggtggcact

SEQ ID NO: 256305 - DNA, 25 bp, Homo sapien
acttggtggcacttctggctggccc

SEQ ID NO: 256306 - DNA, 25 bp, Homo sapien
ggcacttctggctggcccctgggat

SEQ ID NO: 256307 - DNA, 25 bp, Homo sapien
ccctgggatcagagtttggcctttc

SEQ ID NO: 256308 - DNA, 25 bp, Homo sapien
ggatcagagtttggcctttcccttg

SEQ ID NO: 256309 - DNA, 25 bp, Homo sapien
agggctgccttggaggtccacgtcc

SEQ ID NO: 256310 - DNA, 25 bp, Homo sapien
tggaggtccacgtccaggaggagac

SEQ ID NO: 256311 - DNA, 25 bp, Homo sapien
gggtgcataccatattcttggttct

SEQ ID NO: 256312 - DNA, 25 bp, Homo sapien
tcttggttcttaaaatctatcactt

SEQ ID NO: 256313 - DNA, 25 bp, Homo sapien
tacaagcatagattttatcagggtg

SEQ ID NO: 256314 - DNA, 25 bp, Homo sapien
tttgtcaaagcaggttattcagtga

SEQ ID NO: 256315 - DNA, 25 bp, Homo sapien
caggttattcagtgattcctcccca

SEQ ID NO: 256316 - DNA, 25 bp, Homo sapien
gattcctccccaccattcttaagaa

SEQ ID NO: 256317 - DNA, 25 bp, Homo sapien
ataatgctgttgtgttagctctgag

SEQ ID NO: 256318 - DNA, 25 bp, Homo sapien
gctgttgtgttagctctgagtagaa

SEQ ID NO: 256319 - DNA, 25 bp, Homo sapien
ctctgtttggaggtaatattgggtt

SEQ ID NO: 256320 - DNA, 25 bp, Homo sapien
aatattgggttgaattctgactgcc

SEQ ID NO: 256321 - DNA, 25 bp, Homo sapien
ttgaattctgactgcccctttctag

SEQ ID NO: 256322 - DNA, 25 bp, Homo sapien
aaactggacaggaagaatctaaagc

SEQ ID NO: 256323 - DNA, 25 bp, Homo sapien
aactggacaggaagaatctaaagca

SEQ ID NO: 256324 - DNA, 25 bp, Homo sapien
actggacaggaagaatctaaagcaa

SEQ ID NO: 256325 - DNA, 25 bp, Homo sapien
ctggacaggaagaatctaaagcaaa

SEQ ID NO: 256326 - DNA, 25 bp, Homo sapien
tggacaggaagaatctaaagcaaac

SEQ ID NO: 256327 - DNA, 25 bp, Homo sapien
ggacaggaagaatctaaagcaaaca

SEQ ID NO: 256328 - DNA, 25 bp, Homo sapien
gacaggaagaatctaaagcaaacat

SEQ ID NO: 256329 - DNA, 25 bp, Homo sapien
ggaagaatctaaagcaaacattgaa

SEQ ID NO: 256330 - DNA, 25 bp, Homo sapien
gaagaatctaaagcaaacattgaaa

SEQ ID NO: 256331 - DNA, 25 bp, Homo sapien
gcaaacattgaaagtaaacgaccca

SEQ ID NO: 256332 - DNA, 25 bp, Homo sapien
aaacgacccaaagcaaagagtgtca

SEQ ID NO: 256333 - DNA, 25 bp, Homo sapien
gtctcaaccattcagcctgctgctg

SEQ ID NO: 256334 - DNA, 25 bp, Homo sapien
tgctgcaccatgttgggctgcggta

SEQ ID NO: 256335 - DNA, 25 bp, Homo sapien
ttgattgctaaatgttgcctaactt

SEQ ID NO: 256336 - DNA, 25 bp, Homo sapien
ctgtgtattactgtgattctctctg

SEQ ID NO: 256337 - DNA, 25 bp, Homo sapien
cctctcccacatttcatgcaaggga

SEQ ID NO: 256338 - DNA, 25 bp, Homo sapien
cttgcattctcttcctatgttcaga

SEQ ID NO: 256339 - DNA, 25 bp, Homo sapien
atgttcagaaactccagggcttgcc

SEQ ID NO: 256340 - DNA, 25 bp, Homo sapien
ggcttgcccacgtgtatgtatgagt

SEQ ID NO: 256341 - DNA, 25 bp, Homo sapien
tgattctctctgtaagctccccatg

SEQ ID NO: 256342 - DNA, 25 bp, Homo sapien
tgtaagctccccatgtggccaagga

SEQ ID NO: 256343 - DNA, 25 bp, Homo sapien
tcattgcactggtctcaaccattca

SEQ ID NO: 256344 - DNA, 25 bp, Homo sapien
caaatactgaagttaagtgcattgt

SEQ ID NO: 256345 - DNA, 25 bp, Homo sapien
tactgaagttaagtgcattgttttc

SEQ ID NO: 256346 - DNA, 25 bp, Homo sapien
aagttaagtgcattgttttcaggaa

SEQ ID NO: 256347 - DNA, 25 bp, Homo sapien
gttaagtgcattgttttcaggaatc

SEQ ID NO: 256348 - DNA, 25 bp, Homo sapien
ttaagtgcattgttttcaggaatca

SEQ ID NO: 256349 - DNA, 25 bp, Homo sapien
aagtgcattgttttcaggaatcaaa

SEQ ID NO: 256350 - DNA, 25 bp, Homo sapien
gtgcattgttttcaggaatcaaaag

SEQ ID NO: 256351 - DNA, 25 bp, Homo sapien
gcattgttttcaggaatcaaaagat

SEQ ID NO: 256352 - DNA, 25 bp, Homo sapien
ggtccggagttcgaggctggtttgg

SEQ ID NO: 256353 - DNA, 25 bp, Homo sapien
agttcgaggctggtttggccagcat

SEQ ID NO: 256354 - DNA, 25 bp, Homo sapien
tcgaggctggtttggccagcatggc

SEQ ID NO: 256355 - DNA, 25 bp, Homo sapien
agatattaattccttattggctaaa

SEQ ID NO: 256356 - DNA, 25 bp, Homo sapien
atacaaagtttgaggattctaagcc

SEQ ID NO: 256357 - DNA, 25 bp, Homo sapien
ggattctaagcctcaataatatatc

SEQ ID NO: 256358 - DNA, 25 bp, Homo sapien
agcattgtgcttccctcgtatcatc

SEQ ID NO: 256359 - DNA, 25 bp, Homo sapien
gcttccctcgtatcatcttggatgc

SEQ ID NO: 256360 - DNA, 25 bp, Homo sapien
cttggatgctgatattacaaacagt

SEQ ID NO: 256361 - DNA, 25 bp, Homo sapien
attacaaacagttggaacccagaag

SEQ ID NO: 256362 - DNA, 25 bp, Homo sapien
ggaacccagaagacttaaggaagca

SEQ ID NO: 256363 - DNA, 25 bp, Homo sapien
taaggaagcagtctactctggtcag

SEQ ID NO: 256364 - DNA, 25 bp, Homo sapien
agtctactctggtcagttttccttc

SEQ ID NO: 256365 - DNA, 25 bp, Homo sapien
aaaacacaggagaagcaggtaataa

SEQ ID NO: 256366 - DNA, 25 bp, Homo sapien
ttttatgacacaagtatctgagggt

SEQ ID NO: 256367 - DNA, 25 bp, Homo sapien
tctgagggtcagatatcccaggatt

SEQ ID NO: 256368 - DNA, 25 bp, Homo sapien
gatatcccaggatttatgagcccta

SEQ ID NO: 256369 - DNA, 25 bp, Homo sapien
atgagccctatgaggattagcaaat

SEQ ID NO: 256370 - DNA, 25 bp, Homo sapien
gcaaatgtacatacccatagagtga

SEQ ID NO: 256371 - DNA, 25 bp, Homo sapien
gaatctttgcttcataacatgctaa

SEQ ID NO: 256372 - DNA, 25 bp, Homo sapien
taatttcttcattatgtcttttctt

SEQ ID NO: 256373 - DNA, 25 bp, Homo sapien
cctcgtgtttcaactcatctatgag

SEQ ID NO: 256374 - DNA, 25 bp, Homo sapien
catctatgaggtcctgaggtcacta

SEQ ID NO: 256375 - DNA, 25 bp, Homo sapien
gaggtcctgaggtcactaaggataa

SEQ ID NO: 256376 - DNA, 25 bp, Homo sapien
tttagttcccattttatgacacaag

SEQ ID NO: 256377 - DNA, 25 bp, Homo sapien
ggttactgttaagcagacactgtgc

SEQ ID NO: 256378 - DNA, 25 bp, Homo sapien
cagacactgtgcttgaaaacagaga

SEQ ID NO: 256379 - DNA, 25 bp, Homo sapien
gacagtatagagtaagatccagaaa

SEQ ID NO: 256380 - DNA, 25 bp, Homo sapien
agtaagatccagaaatggactcccc

SEQ ID NO: 256381 - DNA, 25 bp, Homo sapien
cagaggaattcagtgtatcacaatg

SEQ ID NO: 256382 - DNA, 25 bp, Homo sapien
cagtgtatcacaatggaggtttttc

SEQ ID NO: 256383 - DNA, 25 bp, Homo sapien
atcacactgcctttgcatgagaaga

SEQ ID NO: 256384 - DNA, 25 bp, Homo sapien
gaaaattaaattggactgctctgtc

SEQ ID NO: 256385 - DNA, 25 bp, Homo sapien
aaattggactgctctgtcatgccat

SEQ ID NO: 256386 - DNA, 25 bp, Homo sapien
attggactgctctgtcatgccattt

SEQ ID NO: 256387 - DNA, 25 bp, Homo sapien
atctcatcatgtagaggagttgctt

SEQ ID NO: 256388 - DNA, 25 bp, Homo sapien
gaaaagcccagttagtggtgtgcaa

SEQ ID NO: 256389 - DNA, 25 bp, Homo sapien
gtggtgtgcaaacttacttccttta

SEQ ID NO: 256390 - DNA, 25 bp, Homo sapien
cttacttcctttaaatgtcccatgg

SEQ ID NO: 256391 - DNA, 25 bp, Homo sapien
gtcccatggatgtaggacagtgcca

SEQ ID NO: 256392 - DNA, 25 bp, Homo sapien
ggacagtgccatgtttcaagatgcc

SEQ ID NO: 256393 - DNA, 25 bp, Homo sapien
gcctgtgagctaggtcttcaagatt

SEQ ID NO: 256394 - DNA, 25 bp, Homo sapien
attcttgtactttagcaaatctgga

SEQ ID NO: 256395 - DNA, 25 bp, Homo sapien
caaatctggagttagttcatagtca

SEQ ID NO: 256396 - DNA, 25 bp, Homo sapien
gttagttcatagtcaaagtcagtta

SEQ ID NO: 256397 - DNA, 25 bp, Homo sapien
agtcagttaatatttcttagaggaa

SEQ ID NO: 256398 - DNA, 25 bp, Homo sapien
gaaagttttgctttttgtggcaaca

SEQ ID NO: 256399 - DNA, 25 bp, Homo sapien
aatacacattccctatagactgcct

SEQ ID NO: 256400 - DNA, 25 bp, Homo sapien
atagactgcctcctgtttagtccaa

SEQ ID NO: 256401 - DNA, 25 bp, Homo sapien
tttagtccaacttagatcactcaga

SEQ ID NO: 256402 - DNA, 25 bp, Homo sapien
tagatcactcagatccttcctggga

SEQ ID NO: 256403 - DNA, 25 bp, Homo sapien
cactcagatccttcctgggatcaaa

SEQ ID NO: 256404 - DNA, 25 bp, Homo sapien
ttaaacctaagacaaagcgaagcag

SEQ ID NO: 256405 - DNA, 25 bp, Homo sapien
aaagcgaagcaggtgtcacttgggt

SEQ ID NO: 256406 - DNA, 25 bp, Homo sapien
tttcctggttaatgtttagcttttg

SEQ ID NO: 256407 - DNA, 25 bp, Homo sapien
gtaatgctatttaaacacacctaag

SEQ ID NO: 256408 - DNA, 25 bp, Homo sapien
aatgatgagatcctgaacaaaagag

SEQ ID NO: 256409 - DNA, 25 bp, Homo sapien
gaaatgctcctacttgaaaaataca

SEQ ID NO: 256410 - DNA, 25 bp, Homo sapien
ctggttaaccttcatgggctgccta

SEQ ID NO: 256411 - DNA, 25 bp, Homo sapien
gggctgcctaaagaactgtgctgat

SEQ ID NO: 256412 - DNA, 25 bp, Homo sapien
gtggagtgtctatttggtgaacttc

SEQ ID NO: 256413 - DNA, 25 bp, Homo sapien
ttggtgaacttcaggtgctgcagga

SEQ ID NO: 256414 - DNA, 25 bp, Homo sapien
gttcccaggagaaaagtgctccaga

SEQ ID NO: 256415 - DNA, 25 bp, Homo sapien
aggagccatgacctgtgcaatgaag

SEQ ID NO: 256416 - DNA, 25 bp, Homo sapien
gacctgtgcaatgaagacctttaga

SEQ ID NO: 256417 - DNA, 25 bp, Homo sapien
ggttcttctgtgactccaatttctg

SEQ ID NO: 256418 - DNA, 25 bp, Homo sapien
caatttctgggtgaggttgttgcct

SEQ ID NO: 256419 - DNA, 25 bp, Homo sapien
tgttgcctcagcctcttcacaatga

SEQ ID NO: 256420 - DNA, 25 bp, Homo sapien
acagaagaggcctgcatggttggaa

SEQ ID NO: 256421 - DNA, 25 bp, Homo sapien
acggctgagggcaggcaggactcca

SEQ ID NO: 256422 - DNA, 25 bp, Homo sapien
ggactccaagagcacttctcccggg

SEQ ID NO: 256423 - DNA, 25 bp, Homo sapien
caagagcacttctcccgggaaatac

SEQ ID NO: 256424 - DNA, 25 bp, Homo sapien
cacaccccggcttggcagattttgc

SEQ ID NO: 256425 - DNA, 25 bp, Homo sapien
caaagagagtgacatcctgagcgat

SEQ ID NO: 256426 - DNA, 25 bp, Homo sapien
gaagatgatgaccaccgtcagactg

SEQ ID NO: 256427 - DNA, 25 bp, Homo sapien
atgaccaccgtcagactgtgaagca

SEQ ID NO: 256428 - DNA, 25 bp, Homo sapien
agggcagccctactaaagacatcga

SEQ ID NO: 256429 - DNA, 25 bp, Homo sapien
aagacatcgaaattcagttccagag

SEQ ID NO: 256430 - DNA, 25 bp, Homo sapien
gagactgaggatttccgaggaccca

SEQ ID NO: 256431 - DNA, 25 bp, Homo sapien
gatttccgaggacccagacgttcac

SEQ ID NO: 256432 - DNA, 25 bp, Homo sapien
tctcccagaggccaggatcagcagg

SEQ ID NO: 256433 - DNA, 25 bp, Homo sapien
caggatcagcaggtttgagtggata

SEQ ID NO: 256434 - DNA, 25 bp, Homo sapien
gagtggataattggcttgtggtcat

SEQ ID NO: 256435 - DNA, 25 bp, Homo sapien
ataattggcttgtggtcattttctc

SEQ ID NO: 256436 - DNA, 25 bp, Homo sapien
attggcttgtggtcattttctcata

SEQ ID NO: 256437 - DNA, 25 bp, Homo sapien
tggcttgtggtcattttctcatagg

SEQ ID NO: 256438 - DNA, 25 bp, Homo sapien
gcttgtggtcattttctcataggat

SEQ ID NO: 256439 - DNA, 25 bp, Homo sapien
tgtggtcattttctcataggatttt

SEQ ID NO: 256440 - DNA, 25 bp, Homo sapien
tggtcattttctcataggatttttc

SEQ ID NO: 256441 - DNA, 25 bp, Homo sapien
atcaaatttggatgccaactatgtg

SEQ ID NO: 256442 - DNA, 25 bp, Homo sapien
gtggctgctctggtggaagtggcaa

SEQ ID NO: 256443 - DNA, 25 bp, Homo sapien
aagactgcagtagggatatggttcc

SEQ ID NO: 256444 - DNA, 25 bp, Homo sapien
atatggttcctgtttgcctatttcc

SEQ ID NO: 256445 - DNA, 25 bp, Homo sapien
tgtttgcctatttccatccacaact

SEQ ID NO: 256446 - DNA, 25 bp, Homo sapien
tttccatccacaactctgccagaga

SEQ ID NO: 256447 - DNA, 25 bp, Homo sapien
gccagagacgaaagcagtgtttgaa

SEQ ID NO: 256448 - DNA, 25 bp, Homo sapien
agcagtgtttgaaacaattcaccaa

SEQ ID NO: 256449 - DNA, 25 bp, Homo sapien
attcaccaagatttccatctggaat

SEQ ID NO: 256450 - DNA, 25 bp, Homo sapien
tcatgattttgacagcctagtgcta

SEQ ID NO: 256451 - DNA, 25 bp, Homo sapien
agtgcttcaagattgacgcatcaga

SEQ ID NO: 256452 - DNA, 25 bp, Homo sapien
gacgcatcagatttgcacaatgtgc

SEQ ID NO: 256453 - DNA, 25 bp, Homo sapien
acaatgtgccactttaggagattat

SEQ ID NO: 256454 - DNA, 25 bp, Homo sapien
tgatgcttgcctacgttgctgagaa

SEQ ID NO: 256455 - DNA, 25 bp, Homo sapien
gatgcttgcctacgttgctgagaat

SEQ ID NO: 256456 - DNA, 25 bp, Homo sapien
tgcttgcctacgttgctgagaatgg

SEQ ID NO: 256457 - DNA, 25 bp, Homo sapien
gcttgcctacgttgctgagaatggc

SEQ ID NO: 256458 - DNA, 25 bp, Homo sapien
gcctacgttgctgagaatggcactg

SEQ ID NO: 256459 - DNA, 25 bp, Homo sapien
gcccagccaacaaaggttaacccag

SEQ ID NO: 256460 - DNA, 25 bp, Homo sapien
aggacactcctggacagtgatcctg

SEQ ID NO: 256461 - DNA, 25 bp, Homo sapien
gacactcctggacagtgatcctgat

SEQ ID NO: 256462 - DNA, 25 bp, Homo sapien
cactcctggacagtgatcctgatgt

SEQ ID NO: 256463 - DNA, 25 bp, Homo sapien
ctcctggacagtgatcctgatgtct

SEQ ID NO: 256464 - DNA, 25 bp, Homo sapien
cctggacagtgatcctgatgtctgt

SEQ ID NO: 256465 - DNA, 25 bp, Homo sapien
agtgaagcaagcaagaatttcccaa

SEQ ID NO: 256466 - DNA, 25 bp, Homo sapien
gaatttcccaagtgatgccaactca

SEQ ID NO: 256467 - DNA, 25 bp, Homo sapien
aaaagcagctttttcatctggaaag

SEQ ID NO: 256468 - DNA, 25 bp, Homo sapien
aaagaactggagaccttgaacctag

SEQ ID NO: 256469 - DNA, 25 bp, Homo sapien
gaacctaggcagcatgtgccttgaa

SEQ ID NO: 256470 - DNA, 25 bp, Homo sapien
gtgccttgaacctaggatcagtaaa

SEQ ID NO: 256471 - DNA, 25 bp, Homo sapien
agatcaccatatctttccgttgtgc

SEQ ID NO: 256472 - DNA, 25 bp, Homo sapien
atctttccgttgtgcctttagaaca

SEQ ID NO: 256473 - DNA, 25 bp, Homo sapien
gaaaatatctctttggctcacagag

SEQ ID NO: 256474 - DNA, 25 bp, Homo sapien
agaaatgaagtacaacccctcactg

SEQ ID NO: 256475 - DNA, 25 bp, Homo sapien
aagtacaacccctcactgtgctggg

SEQ ID NO: 256476 - DNA, 25 bp, Homo sapien
caccatcatgtttaattgcctcctc

SEQ ID NO: 256477 - DNA, 25 bp, Homo sapien
aattgcctcctcctgtcttgcattt

SEQ ID NO: 256478 - DNA, 25 bp, Homo sapien
taccccttagcagagggccaggtga

SEQ ID NO: 256479 - DNA, 25 bp, Homo sapien
ggctgggagtgtagacttcagttac

SEQ ID NO: 256480 - DNA, 25 bp, Homo sapien
ggagtgtagacttcagttacacccc

SEQ ID NO: 256481 - DNA, 25 bp, Homo sapien
gaaagcattagccttgaatcctcaa

SEQ ID NO: 256482 - DNA, 25 bp, Homo sapien
ttagccttgaatcctcaatcccagg

SEQ ID NO: 256483 - DNA, 25 bp, Homo sapien
tctactaaccactctcaacctatgg

SEQ ID NO: 256484 - DNA, 25 bp, Homo sapien
actctcaacctatggtatttatctt

SEQ ID NO: 256485 - DNA, 25 bp, Homo sapien
tcttttgattattctgtgcatctat

SEQ ID NO: 256486 - DNA, 25 bp, Homo sapien
gggattatattgtacagaatgcttt

SEQ ID NO: 256487 - DNA, 25 bp, Homo sapien
aatggtcctgacaggatccctttca

SEQ ID NO: 256488 - DNA, 25 bp, Homo sapien
tgacaggatccctttcagccacagg

SEQ ID NO: 256489 - DNA, 25 bp, Homo sapien
agccacaggcccttagcaaatgctg

SEQ ID NO: 256490 - DNA, 25 bp, Homo sapien
aatgctgctctcacggcccaagtca

SEQ ID NO: 256491 - DNA, 25 bp, Homo sapien
aagtcatcttccctggttcatgcct

SEQ ID NO: 256492 - DNA, 25 bp, Homo sapien
ggttcatgcctacttcggattaaag

SEQ ID NO: 256493 - DNA, 25 bp, Homo sapien
tgaccaagtccttattacacactct

SEQ ID NO: 256494 - DNA, 25 bp, Homo sapien
ttattacacactctcaaactccatg

SEQ ID NO: 256495 - DNA, 25 bp, Homo sapien
aaactccatgagatgtccttcatag

SEQ ID NO: 256496 - DNA, 25 bp, Homo sapien
ttcatagctctcatcccagttataa

SEQ ID NO: 256497 - DNA, 25 bp, Homo sapien
tatcctcattgctcctttcaatggt

SEQ ID NO: 256498 - DNA, 25 bp, Homo sapien
tgcgggtgcccctcacacaggagaa

SEQ ID NO: 256499 - DNA, 25 bp, Homo sapien
gggccaagtcaagaacacttcaaag

SEQ ID NO: 256500 - DNA, 25 bp, Homo sapien
gaacacttcaaagactggatgcaat

SEQ ID NO: 256501 - DNA, 25 bp, Homo sapien
tggatgcaatccagccaagaggttg

SEQ ID NO: 256502 - DNA, 25 bp, Homo sapien
agccagatctcccatgtgctaccat

SEQ ID NO: 256503 - DNA, 25 bp, Homo sapien
atgtgctaccataaggagagcctcg

SEQ ID NO: 256504 - DNA, 25 bp, Homo sapien
gggttttgtgtcgtttaactgctca

SEQ ID NO: 256505 - DNA, 25 bp, Homo sapien
gtttaactgctcatcagagctctcc

SEQ ID NO: 256506 - DNA, 25 bp, Homo sapien
atcagagctctccacacactgaaac

SEQ ID NO: 256507 - DNA, 25 bp, Homo sapien
cactgaaacctcaattctcttgttg

SEQ ID NO: 256508 - DNA, 25 bp, Homo sapien
gacactagaagtctgcgggtgcccc

SEQ ID NO: 256509 - DNA, 25 bp, Homo sapien
gcaatccatactcattcagtaacac

SEQ ID NO: 256510 - DNA, 25 bp, Homo sapien
atccatactcattcagtaacacagg

SEQ ID NO: 256511 - DNA, 25 bp, Homo sapien
ccatactcattcagtaacacaggct

SEQ ID NO: 256512 - DNA, 25 bp, Homo sapien
taacacaggctcatttatttaacca

SEQ ID NO: 256513 - DNA, 25 bp, Homo sapien
cacaggctcatttatttaaccagct

SEQ ID NO: 256514 - DNA, 25 bp, Homo sapien
ggctcatttatttaaccagctaatc

SEQ ID NO: 256515 - DNA, 25 bp, Homo sapien
catttatttaaccagctaatcattt

SEQ ID NO: 256516 - DNA, 25 bp, Homo sapien
atttaaccagctaatcatttatcca

SEQ ID NO: 256517 - DNA, 25 bp, Homo sapien
tttaaccagctaatcatttatccaa

SEQ ID NO: 256518 - DNA, 25 bp, Homo sapien
tcagcaaataaacagcattcttgtt

SEQ ID NO: 256519 - DNA, 25 bp, Homo sapien
aaacgacccaaagcaaagagtgtca

SEQ ID NO: 256520 - DNA, 25 bp, Homo sapien
gaacaaagcttcaatattggatact

SEQ ID NO: 256521 - DNA, 25 bp, Homo sapien
ctagctaatttggtcattctttgcc

SEQ ID NO: 256522 - DNA, 25 bp, Homo sapien
tataactcactttttgtcatgtaaa

SEQ ID NO: 256523 - DNA, 25 bp, Homo sapien
actcaagttgtactacccacataac

SEQ ID NO: 256524 - DNA, 25 bp, Homo sapien
gttgtactacccacataactgaaaa

SEQ ID NO: 256525 - DNA, 25 bp, Homo sapien
gccatttggccttatctgtgagatt

SEQ ID NO: 256526 - DNA, 25 bp, Homo sapien
tttggccttatctgtgagatttgac

SEQ ID NO: 256527 - DNA, 25 bp, Homo sapien
gtcattctttgccatagcttactct

SEQ ID NO: 256528 - DNA, 25 bp, Homo sapien
gccatagcttactctattcaaataa

SEQ ID NO: 256529 - DNA, 25 bp, Homo sapien
aaacatatattcttgcttgcatcct

SEQ ID NO: 256530 - DNA, 25 bp, Homo sapien
ttcttgcttgcatcctagattggaa

SEQ ID NO: 256531 - DNA, 25 bp, Homo sapien
ggtgggagtggccatggagtagatg

SEQ ID NO: 256532 - DNA, 25 bp, Homo sapien
ggagtggccatggagtagatggcag

SEQ ID NO: 256533 - DNA, 25 bp, Homo sapien
atggcaggggcttgttgaagggatt

SEQ ID NO: 256534 - DNA, 25 bp, Homo sapien
aagctgggccaaggagaatcccttg

SEQ ID NO: 256535 - DNA, 25 bp, Homo sapien
caagaggccaaggtttcaataaact

SEQ ID NO: 256536 - DNA, 25 bp, Homo sapien
agaggccaaggtttcaataaactag

SEQ ID NO: 256537 - DNA, 25 bp, Homo sapien
gaggccaaggtttcaataaactagg

SEQ ID NO: 256538 - DNA, 25 bp, Homo sapien
ggccaaggtttcaataaactaggat

SEQ ID NO: 256539 - DNA, 25 bp, Homo sapien
gccaaggtttcaataaactaggatc

SEQ ID NO: 256540 - DNA, 25 bp, Homo sapien
ccaaggtttcaataaactaggatca

SEQ ID NO: 256541 - DNA, 25 bp, Homo sapien
caaggtttcaataaactaggatcac

SEQ ID NO: 256542 - DNA, 25 bp, Homo sapien
agcagctgcgaagtctgcagcccag

SEQ ID NO: 256543 - DNA, 25 bp, Homo sapien
gaactctggaaagggtggctcagcc

SEQ ID NO: 256544 - DNA, 25 bp, Homo sapien
aaagggtggctcagccaggctctaa

SEQ ID NO: 256545 - DNA, 25 bp, Homo sapien
gggtggctcagccaggctctaaaaa

SEQ ID NO: 256546 - DNA, 25 bp, Homo sapien
agccaggctctaaaaaggtcccaag

SEQ ID NO: 256547 - DNA, 25 bp, Homo sapien
aaaaggtcccaagcgtgatctggtg

SEQ ID NO: 256548 - DNA, 25 bp, Homo sapien
caagcgtgatctggtgtgactcctg

SEQ ID NO: 256549 - DNA, 25 bp, Homo sapien
tgaaagcccctgtccctttggtggg

SEQ ID NO: 256550 - DNA, 25 bp, Homo sapien
cctttggtgggcatgcacacttgga

SEQ ID NO: 256551 - DNA, 25 bp, Homo sapien
gctcctctgccctacgtggttctgg

SEQ ID NO: 256552 - DNA, 25 bp, Homo sapien
atatgcctggaataatttctatcca

SEQ ID NO: 256553 - DNA, 25 bp, Homo sapien
aaacctgctttggtgtgatgcacac

SEQ ID NO: 256554 - DNA, 25 bp, Homo sapien
ggtgtgatgcacacttgatttcttt

SEQ ID NO: 256555 - DNA, 25 bp, Homo sapien
aggttcactggcttcacgtggatat

SEQ ID NO: 256556 - DNA, 25 bp, Homo sapien
acgaatgatctcttctagacctcta

SEQ ID NO: 256557 - DNA, 25 bp, Homo sapien
gaatgatctcttctagacctctagt

SEQ ID NO: 256558 - DNA, 25 bp, Homo sapien
tgatctcttctagacctctagtcta

SEQ ID NO: 256559 - DNA, 25 bp, Homo sapien
agacctctagtctagcttttgggta

SEQ ID NO: 256560 - DNA, 25 bp, Homo sapien
cctctagtctagcttttgggtatta

SEQ ID NO: 256561 - DNA, 25 bp, Homo sapien
agtctagcttttgggtattattaat

SEQ ID NO: 256562 - DNA, 25 bp, Homo sapien
taattatactttgagccatctgatt

SEQ ID NO: 256563 - DNA, 25 bp, Homo sapien
gtggaagtaagatacaaacctgctt

SEQ ID NO: 256564 - DNA, 25 bp, Homo sapien
acacgactcctgaatcatgttccat

SEQ ID NO: 256565 - DNA, 25 bp, Homo sapien
agattttactgcctcacctaggatg

SEQ ID NO: 256566 - DNA, 25 bp, Homo sapien
catgttccattactttaatcgctaa

SEQ ID NO: 256567 - DNA, 25 bp, Homo sapien
ttaatcgctaaacactgctccgttt

SEQ ID NO: 256568 - DNA, 25 bp, Homo sapien
acactgctccgtttaagctaaagag

SEQ ID NO: 256569 - DNA, 25 bp, Homo sapien
acatcaagatgagatagggccctga

SEQ ID NO: 256570 - DNA, 25 bp, Homo sapien
agggccctgaaagtcgcatgttgaa

SEQ ID NO: 256571 - DNA, 25 bp, Homo sapien
tgttgaacctttcttaccttctacg

SEQ ID NO: 256572 - DNA, 25 bp, Homo sapien
cttaccttctacgaggatgtcactc

SEQ ID NO: 256573 - DNA, 25 bp, Homo sapien
gaggatgtcactcaaaatcttttct

SEQ ID NO: 256574 - DNA, 25 bp, Homo sapien
gtgaacacgtcaagactacctactt

SEQ ID NO: 256575 - DNA, 25 bp, Homo sapien
ggtgggagtggccatggagtagatg

SEQ ID NO: 256576 - DNA, 25 bp, Homo sapien
ggattgaaagctctcctaggctagg

SEQ ID NO: 256577 - DNA, 25 bp, Homo sapien
ttgaaagctctcctaggctaggcat

SEQ ID NO: 256578 - DNA, 25 bp, Homo sapien
cagcttctcgggaagctgggccaag

SEQ ID NO: 256579 - DNA, 25 bp, Homo sapien
aagctgggccaaggagaatcccttg

SEQ ID NO: 256580 - DNA, 25 bp, Homo sapien
caagaggccaaggtttcaataaact

SEQ ID NO: 256581 - DNA, 25 bp, Homo sapien
agaggccaaggtttcaataaactag

SEQ ID NO: 256582 - DNA, 25 bp, Homo sapien
gaggccaaggtttcaataaactagg

SEQ ID NO: 256583 - DNA, 25 bp, Homo sapien
ggccaaggtttcaataaactaggat

SEQ ID NO: 256584 - DNA, 25 bp, Homo sapien
gccaaggtttcaataaactaggatc

SEQ ID NO: 256585 - DNA, 25 bp, Homo sapien
caaggtttcaataaactaggatcac

SEQ ID NO: 256586 - DNA, 25 bp, Homo sapien
ttttgccacaaggtggtgcttctgc

SEQ ID NO: 256587 - DNA, 25 bp, Homo sapien
gtgcttctgccattagacgcagtta

SEQ ID NO: 256588 - DNA, 25 bp, Homo sapien
tagacgcagttaggaggatgcaact

SEQ ID NO: 256589 - DNA, 25 bp, Homo sapien
atgcaactgcaaatctaaaattacg

SEQ ID NO: 256590 - DNA, 25 bp, Homo sapien
gaacatatgcattaatactaaacct

SEQ ID NO: 256591 - DNA, 25 bp, Homo sapien
gcagtaataccataattagccttct

SEQ ID NO: 256592 - DNA, 25 bp, Homo sapien
ttagccttctaatcatgtaatttgc

SEQ ID NO: 256593 - DNA, 25 bp, Homo sapien
aatttgctttacttaggtatttcat

SEQ ID NO: 256594 - DNA, 25 bp, Homo sapien
ggtatttcatttggttcagcctgtt

SEQ ID NO: 256595 - DNA, 25 bp, Homo sapien
cagcctgttatggaatttaccagct

SEQ ID NO: 256596 - DNA, 25 bp, Homo sapien
ttaccagcttgataaatttgcctat

SEQ ID NO: 256597 - DNA, 25 bp, Homo sapien
gtactgaagctaagatgtgaaacct

SEQ ID NO: 256598 - DNA, 25 bp, Homo sapien
gtgaaaccttccatatacactttaa

SEQ ID NO: 256599 - DNA, 25 bp, Homo sapien
aggacttctttgtccctggaaagtg

SEQ ID NO: 256600 - DNA, 25 bp, Homo sapien
ggctccttaggtagagaggtgtatt

SEQ ID NO: 256601 - DNA, 25 bp, Homo sapien
taatggtgccagtgttagaatcctt

SEQ ID NO: 256602 - DNA, 25 bp, Homo sapien
gtgttagaatccttggcagtctctt

SEQ ID NO: 256603 - DNA, 25 bp, Homo sapien
aatccttggcagtctcttcttgaac

SEQ ID NO: 256604 - DNA, 25 bp, Homo sapien
ttcttgaacctgcaactccagtggt

SEQ ID NO: 256605 - DNA, 25 bp, Homo sapien
actccagtggttaaatctcataggc

SEQ ID NO: 256606 - DNA, 25 bp, Homo sapien
aggccatataaccattttctagaga

SEQ ID NO: 256607 - DNA, 25 bp, Homo sapien
gagaattctgttcctactatctaat

SEQ ID NO: 256608 - DNA, 25 bp, Homo sapien
accaagtgccctatgccgtgaaggg

SEQ ID NO: 256609 - DNA, 25 bp, Homo sapien
gtgaagggctgtttccgcttcctgc

SEQ ID NO: 256610 - DNA, 25 bp, Homo sapien
ccaggttactgttgtgggcagctac

SEQ ID NO: 256611 - DNA, 25 bp, Homo sapien
gttgtgggcagctaccttctgggca

SEQ ID NO: 256612 - DNA, 25 bp, Homo sapien
gcagctaccttctgggcacctgcat

SEQ ID NO: 256613 - DNA, 25 bp, Homo sapien
tgggcacctgcatccgaccagacat

SEQ ID NO: 256614 - DNA, 25 bp, Homo sapien
gcatccgaccagacatcaatgtgga

SEQ ID NO: 256615 - DNA, 25 bp, Homo sapien
caatgtggatgtggcactgaccatg

SEQ ID NO: 256616 - DNA, 25 bp, Homo sapien
gatgtggcactgaccatgcccaggg

SEQ ID NO: 256617 - DNA, 25 bp, Homo sapien
aaatcctacaggacaaggacgggct

SEQ ID NO: 256618 - DNA, 25 bp, Homo sapien
gctgaaccagcgctacttccgcaag

SEQ ID NO: 256619 - DNA, 25 bp, Homo sapien
agacctccatacaggaagacttgtg

SEQ ID NO: 256620 - DNA, 25 bp, Homo sapien
cctccatacaggaagacttgtgtgt

SEQ ID NO: 256621 - DNA, 25 bp, Homo sapien
acctgtgtgtggcatctacagacct

SEQ ID NO: 256622 - DNA, 25 bp, Homo sapien
tgtgtgtggcatctacagaccttag

SEQ ID NO: 256623 - DNA, 25 bp, Homo sapien
gtgtggcatctacagaccttagatc

SEQ ID NO: 256624 - DNA, 25 bp, Homo sapien
ggcatctacagaccttagatcatag

SEQ ID NO: 256625 - DNA, 25 bp, Homo sapien
cagaccttagatcatagctgtgaga

SEQ ID NO: 256626 - DNA, 25 bp, Homo sapien
gtaagcactgccaaagttatcagct

SEQ ID NO: 256627 - DNA, 25 bp, Homo sapien
ctgccaaagttatcagctacccata

SEQ ID NO: 256628 - DNA, 25 bp, Homo sapien
tgttatctactcttcctagaatcaa

SEQ ID NO: 256629 - DNA, 25 bp, Homo sapien
atctactcttcctagaatcaaatat

SEQ ID NO: 256630 - DNA, 25 bp, Homo sapien
tgaagcttttcagcgcaggtgtagc

SEQ ID NO: 256631 - DNA, 25 bp, Homo sapien
tttcagcgcaggtgtagccggcttg

SEQ ID NO: 256632 - DNA, 25 bp, Homo sapien
ccgcagtgaggtttggagccgcttt

SEQ ID NO: 256633 - DNA, 25 bp, Homo sapien
tttggagccgctttggattgctgag

SEQ ID NO: 256634 - DNA, 25 bp, Homo sapien
ttcttcagccacttagggaaaccga

SEQ ID NO: 256635 - DNA, 25 bp, Homo sapien
ggcttgaaatagtgtgttctcttga

SEQ ID NO: 256636 - DNA, 25 bp, Homo sapien
ttctcttgagaaccaccgaggcagt

SEQ ID NO: 256637 - DNA, 25 bp, Homo sapien
ccgaggcagtgagatttgggattcc

SEQ ID NO: 256638 - DNA, 25 bp, Homo sapien
gggtctggagatcgtgctttttgtg

SEQ ID NO: 256639 - DNA, 25 bp, Homo sapien
gcctgcgtctcaggtgaccgtgact

SEQ ID NO: 256640 - DNA, 25 bp, Homo sapien
tgaccgtgactcctgaagcttttca

SEQ ID NO: 256641 - DNA, 25 bp, Homo sapien
ggccacgctcaagctgctgtccatc

SEQ ID NO: 256642 - DNA, 25 bp, Homo sapien
ttcctgagctacctgcccactgagg

SEQ ID NO: 256643 - DNA, 25 bp, Homo sapien
tcctgagctacctgcccactgaggt

SEQ ID NO: 256644 - DNA, 25 bp, Homo sapien
aggtgcagctcattaacgaagccta

SEQ ID NO: 256645 - DNA, 25 bp, Homo sapien
gtgcagctcattaacgaagcctatg

SEQ ID NO: 256646 - DNA, 25 bp, Homo sapien
gcagctcattaacgaagcctatggg

SEQ ID NO: 256647 - DNA, 25 bp, Homo sapien
agctcattaacgaagcctatgggct

SEQ ID NO: 256648 - DNA, 25 bp, Homo sapien
gctcattaacgaagcctatgggctg

SEQ ID NO: 256649 - DNA, 25 bp, Homo sapien
ttaacgaagcctatgggctggtggt

SEQ ID NO: 256650 - DNA, 25 bp, Homo sapien
ctggtggtggatgccgtactgggcc

SEQ ID NO: 256651 - DNA, 25 bp, Homo sapien
ggatgccgtactgggccccggcgtg

SEQ ID NO: 256652 - DNA, 25 bp, Homo sapien
cagtgggcagccatgcgagtcatga

SEQ ID NO: 256653 - DNA, 25 bp, Homo sapien
agtgggcagccatgcgagtcatgaa

SEQ ID NO: 256654 - DNA, 25 bp, Homo sapien
gtgggcagccatgcgagtcatgaag

SEQ ID NO: 256655 - DNA, 25 bp, Homo sapien
gggcagccatgcgagtcatgaaggt

SEQ ID NO: 256656 - DNA, 25 bp, Homo sapien
cagccatgcgagtcatgaaggtggc

SEQ ID NO: 256657 - DNA, 25 bp, Homo sapien
gccatgcgagtcatgaaggtggcat

SEQ ID NO: 256658 - DNA, 25 bp, Homo sapien
ccatgcgagtcatgaaggtggcatg

SEQ ID NO: 256659 - DNA, 25 bp, Homo sapien
atgcgagtcatgaaggtggcatgca

SEQ ID NO: 256660 - DNA, 25 bp, Homo sapien
gcgagtcatgaaggtggcatgcagg

SEQ ID NO: 256661 - DNA, 25 bp, Homo sapien
agtcatgaaggtggcatgcagggat

SEQ ID NO: 256662 - DNA, 25 bp, Homo sapien
tgaaggtggcatgcagggatgggaa

SEQ ID NO: 256663 - DNA, 25 bp, Homo sapien
tgtttccctttgtcacctaagcaag

SEQ ID NO: 256664 - DNA, 25 bp, Homo sapien
tgtcacctaagcaaggctttttctg

SEQ ID NO: 256665 - DNA, 25 bp, Homo sapien
cattgggtaactgttgtttagacca

SEQ ID NO: 256666 - DNA, 25 bp, Homo sapien
gtttagaccaacacttagaaatact

SEQ ID NO: 256667 - DNA, 25 bp, Homo sapien
gaaggtgccataatatggcttgcca

SEQ ID NO: 256668 - DNA, 25 bp, Homo sapien
tatggcttgccaatgttacctcctt

SEQ ID NO: 256669 - DNA, 25 bp, Homo sapien
gttacctccttgaatagtcatgtgt

SEQ ID NO: 256670 - DNA, 25 bp, Homo sapien
gaatagtcatgtgtcattgtcttga

SEQ ID NO: 256671 - DNA, 25 bp, Homo sapien
catgtgtcattgtcttgaattggta

SEQ ID NO: 256672 - DNA, 25 bp, Homo sapien
gtaattggagaaccttgcatgaaat

SEQ ID NO: 256673 - DNA, 25 bp, Homo sapien
atgaaatatgtgatcgtgtgtgtgt

SEQ ID NO: 256674 - DNA, 25 bp, Homo sapien
ataaagacagcactttccgcacaca

SEQ ID NO: 256675 - DNA, 25 bp, Homo sapien
gcactttccgcacacaaagtgtatt

SEQ ID NO: 256676 - DNA, 25 bp, Homo sapien
tatacaaattaatgagctctacttt

SEQ ID NO: 256677 - DNA, 25 bp, Homo sapien
tgagctctactttatttaagtgttc

SEQ ID NO: 256678 - DNA, 25 bp, Homo sapien
gatgtaaattttaggtccagttgaa

SEQ ID NO: 256679 - DNA, 25 bp, Homo sapien
ttaggtccagttgaacaaatattga

SEQ ID NO: 256680 - DNA, 25 bp, Homo sapien
ttgagtgcctatcatatgcaagact

SEQ ID NO: 256681 - DNA, 25 bp, Homo sapien
atgcaagactaactccttactagga

SEQ ID NO: 256682 - DNA, 25 bp, Homo sapien
tccttactaggaatgaaatcacaca

SEQ ID NO: 256683 - DNA, 25 bp, Homo sapien
aatcacacagtgtcttctgtttgca

SEQ ID NO: 256684 - DNA, 25 bp, Homo sapien
cttctgtttgcagtatgtgaacttt

SEQ ID NO: 256685 - DNA, 25 bp, Homo sapien
atcttgaggcttatcatcaccatgg

SEQ ID NO: 256686 - DNA, 25 bp, Homo sapien
catggagatatccttcttcagcttc

SEQ ID NO: 256687 - DNA, 25 bp, Homo sapien
tcttcaacgacctgattgcttgtgc

SEQ ID NO: 256688 - DNA, 25 bp, Homo sapien
attgcttgtgcgttccttgtgggag

SEQ ID NO: 256689 - DNA, 25 bp, Homo sapien
gccgtggtctttgctgtgagaagtc

SEQ ID NO: 256690 - DNA, 25 bp, Homo sapien
agaagtcggcgatccatgaatctcc

SEQ ID NO: 256691 - DNA, 25 bp, Homo sapien
cggcgatccatgaatctccactact

SEQ ID NO: 256692 - DNA, 25 bp, Homo sapien
tgctgtgatccttattggtgcggct

SEQ ID NO: 256693 - DNA, 25 bp, Homo sapien
gtgcggctggagtttttgcttttat

SEQ ID NO: 256694 - DNA, 25 bp, Homo sapien
tgcttttatcgatgtgtgtcttcaa

SEQ ID NO: 256695 - DNA, 25 bp, Homo sapien
gtgtgtcttcaaagaaaccacttca

SEQ ID NO: 256696 - DNA, 25 bp, Homo sapien
tttaacttcctcgttcgttatgcct

SEQ ID NO: 256697 - DNA, 25 bp, Homo sapien
ttaacttcctcgttcgttatgcctc

SEQ ID NO: 256698 - DNA, 25 bp, Homo sapien
taacttcctcgttcgttatgcctcc

SEQ ID NO: 256699 - DNA, 25 bp, Homo sapien
aacttcctcgttcgttatgcctcct

SEQ ID NO: 256700 - DNA, 25 bp, Homo sapien
acttcctcgttcgttatgcctcctt

SEQ ID NO: 256701 - DNA, 25 bp, Homo sapien
cttcctcgttcgttatgcctccttg

SEQ ID NO: 256702 - DNA, 25 bp, Homo sapien
ttcctcgttcgttatgcctccttgc

SEQ ID NO: 256703 - DNA, 25 bp, Homo sapien
tcctcgttcgttatgcctccttgcc

SEQ ID NO: 256704 - DNA, 25 bp, Homo sapien
cctcgttcgttatgcctccttgccc

SEQ ID NO: 256705 - DNA, 25 bp, Homo sapien
ctcgttcgttatgcctccttgcccc

SEQ ID NO: 256706 - DNA, 25 bp, Homo sapien
tcattaaacaacccccttctagcct

SEQ ID NO: 256707 - DNA, 25 bp, Homo sapien
agaggaacaaagctttcctgtgatt

SEQ ID NO: 256708 - DNA, 25 bp, Homo sapien
gatttctttcttcaacagatggcta

SEQ ID NO: 256709 - DNA, 25 bp, Homo sapien
aatggcacagcattgcagttagaat

SEQ ID NO: 256710 - DNA, 25 bp, Homo sapien
gatactaggagcacgtcctggacta

SEQ ID NO: 256711 - DNA, 25 bp, Homo sapien
cgtcctggactaaaaatttctacat

SEQ ID NO: 256712 - DNA, 25 bp, Homo sapien
gcaacaaccttatagcttcctttga

SEQ ID NO: 256713 - DNA, 25 bp, Homo sapien
gtagttgctgctggagtcagaagtt

SEQ ID NO: 256714 - DNA, 25 bp, Homo sapien
gagcttacagaatgtatggctgcct

SEQ ID NO: 256715 - DNA, 25 bp, Homo sapien
atggctgcctaagtaatagtctctg

SEQ ID NO: 256716 - DNA, 25 bp, Homo sapien
aaatctaatggcctttgtaatgtcc

SEQ ID NO: 256717 - DNA, 25 bp, Homo sapien
taatgtcctctgtcatttcacggag

SEQ ID NO: 256718 - DNA, 25 bp, Homo sapien
cttagaggcagcagaccagtccagc

SEQ ID NO: 256719 - DNA, 25 bp, Homo sapien
caggtcaaggtgtggaccgcacaac

SEQ ID NO: 256720 - DNA, 25 bp, Homo sapien
taagcaaagcaggaacccagctgga

SEQ ID NO: 256721 - DNA, 25 bp, Homo sapien
aaacgagccctggatctgcaaagca

SEQ ID NO: 256722 - DNA, 25 bp, Homo sapien
tgcaaagcaggtcccttcgcgagac

SEQ ID NO: 256723 - DNA, 25 bp, Homo sapien
tcgcgagaccaaagccgtgatccca

SEQ ID NO: 256724 - DNA, 25 bp, Homo sapien
gtgatcccaaccttagcaacataat

SEQ ID NO: 256725 - DNA, 25 bp, Homo sapien
ggcaggagcgattcccattcgagga

SEQ ID NO: 256726 - DNA, 25 bp, Homo sapien
gattcccattcgaggagtttgacct

SEQ ID NO: 256727 - DNA, 25 bp, Homo sapien
ggagtttgacctctcattttaatac

SEQ ID NO: 256728 - DNA, 25 bp, Homo sapien
ttttaatacaacacccgcctcttag

SEQ ID NO: 256729 - DNA, 25 bp, Homo sapien
cagtgccccacccagtcttggagag

SEQ ID NO: 256730 - DNA, 25 bp, Homo sapien
gttaaatcagaggttcaaatgctag

SEQ ID NO: 256731 - DNA, 25 bp, Homo sapien
aaatgctagagaactgagaagccct

SEQ ID NO: 256732 - DNA, 25 bp, Homo sapien
ctgggcagatgctgtttctgggccc

SEQ ID NO: 256733 - DNA, 25 bp, Homo sapien
acgtgagcatcgtgcatgtggcccc

SEQ ID NO: 256734 - DNA, 25 bp, Homo sapien
cctctgcagtgcaggagtcactgat

SEQ ID NO: 256735 - DNA, 25 bp, Homo sapien
tcactgattgatgggtgtgccgacc

SEQ ID NO: 256736 - DNA, 25 bp, Homo sapien
tgtgccgaccagcagcttcacaaat

SEQ ID NO: 256737 - DNA, 25 bp, Homo sapien
gcttcacaaatgtctgctgcaaggg

SEQ ID NO: 256738 - DNA, 25 bp, Homo sapien
gaatcgtcagagtccaatgtgtgcc

SEQ ID NO: 256739 - DNA, 25 bp, Homo sapien
agtccaatgtgtgcctctacagtaa

SEQ ID NO: 256740 - DNA, 25 bp, Homo sapien
ggagacaagagctggctcacctgaa

SEQ ID NO: 256741 - DNA, 25 bp, Homo sapien
gagacaagagctggctcacctgaaa

SEQ ID NO: 256742 - DNA, 25 bp, Homo sapien
gacaagagctggctcacctgaaagg

SEQ ID NO: 256743 - DNA, 25 bp, Homo sapien
caagagctggctcacctgaaaggag

SEQ ID NO: 256744 - DNA, 25 bp, Homo sapien
aagagctggctcacctgaaaggagg

SEQ ID NO: 256745 - DNA, 25 bp, Homo sapien
agctggctcacctgaaaggagggat

SEQ ID NO: 256746 - DNA, 25 bp, Homo sapien
gctggctcacctgaaaggagggatt

SEQ ID NO: 256747 - DNA, 25 bp, Homo sapien
ctggctcacctgaaaggagggatta

SEQ ID NO: 256748 - DNA, 25 bp, Homo sapien
ttggtgcaaaagtctttgatattac

SEQ ID NO: 256749 - DNA, 25 bp, Homo sapien
gtctttgatattactcttaatggct

SEQ ID NO: 256750 - DNA, 25 bp, Homo sapien
tctttgatattactcttaatggctt

SEQ ID NO: 256751 - DNA, 25 bp, Homo sapien
ggtgtctctcgcggcgcccaagcgc

SEQ ID NO: 256752 - DNA, 25 bp, Homo sapien
gtgtctctcgcggcgcccaagcgct

SEQ ID NO: 256753 - DNA, 25 bp, Homo sapien
gcgcccaagcgctgcgctggccgct

SEQ ID NO: 256754 - DNA, 25 bp, Homo sapien
cgcccaagcgctgcgctggccgctt

SEQ ID NO: 256755 - DNA, 25 bp, Homo sapien
ggccgcttctccgggcgccaccact

SEQ ID NO: 256756 - DNA, 25 bp, Homo sapien
gccgcttctccgggcgccaccactt

SEQ ID NO: 256757 - DNA, 25 bp, Homo sapien
ttctccgggcgccaccacttcgtgg

SEQ ID NO: 256758 - DNA, 25 bp, Homo sapien
tctccgggcgccaccacttcgtggc

SEQ ID NO: 256759 - DNA, 25 bp, Homo sapien
ctccgggcgccaccacttcgtggcc

SEQ ID NO: 256760 - DNA, 25 bp, Homo sapien
tccgggcgccaccacttcgtggccg

SEQ ID NO: 256761 - DNA, 25 bp, Homo sapien
ccgggcgccaccacttcgtggccgg

SEQ ID NO: 256762 - DNA, 25 bp, Homo sapien
aaatgttcttggctgttgtccagct

SEQ ID NO: 256763 - DNA, 25 bp, Homo sapien
gttgtccagctctaatgatgtccta

SEQ ID NO: 256764 - DNA, 25 bp, Homo sapien
atgatgtcctagagcagaagtgttt

SEQ ID NO: 256765 - DNA, 25 bp, Homo sapien
gaagtgtttcttctgatgtctcatt

SEQ ID NO: 256766 - DNA, 25 bp, Homo sapien
aaatggctttgctgccgaatgcatt

SEQ ID NO: 256767 - DNA, 25 bp, Homo sapien
caagaggatgatgtctgtgtatgtc

SEQ ID NO: 256768 - DNA, 25 bp, Homo sapien
tctgtgttttagagaggctggcaaa

SEQ ID NO: 256769 - DNA, 25 bp, Homo sapien
gagaggctggcaaatgctgctaaga

SEQ ID NO: 256770 - DNA, 25 bp, Homo sapien
gctgctaagaggatctgaggttcac

SEQ ID NO: 256771 - DNA, 25 bp, Homo sapien
gccgaatgcattatcttgccatttt

SEQ ID NO: 256772 - DNA, 25 bp, Homo sapien
tttgccctggataaaaatgttcttg

SEQ ID NO: 256773 - DNA, 25 bp, Homo sapien
ctacacatcacacgaattcctactt

SEQ ID NO: 256774 - DNA, 25 bp, Homo sapien
tacttcttggccttggtagtctact

SEQ ID NO: 256775 - DNA, 25 bp, Homo sapien
ggtagtctactgtactccactttaa

SEQ ID NO: 256776 - DNA, 25 bp, Homo sapien
taattccttccctatatttcttctg

SEQ ID NO: 256777 - DNA, 25 bp, Homo sapien
tccctatatttcttctgccatttta

SEQ ID NO: 256778 - DNA, 25 bp, Homo sapien
ctgccattttatcacagcctgattc

SEQ ID NO: 256779 - DNA, 25 bp, Homo sapien
gttgctgggtcctctgtgaagtctt

SEQ ID NO: 256780 - DNA, 25 bp, Homo sapien
taattacacctacatcaacctttct

SEQ ID NO: 256781 - DNA, 25 bp, Homo sapien
ggaatttgtctcttgggagttttca

SEQ ID NO: 256782 - DNA, 25 bp, Homo sapien
gtaaacttctattgtctgttcctta

SEQ ID NO: 256783 - DNA, 25 bp, Homo sapien
ggcattctttgctcaatgttctttc

SEQ ID NO: 256784 - DNA, 25 bp, Homo sapien
tgagggaccaacacattggccggga

SEQ ID NO: 256785 - DNA, 25 bp, Homo sapien
attggccgggaacaactcagacacc

SEQ ID NO: 256786 - DNA, 25 bp, Homo sapien
gacacccagcagtctggagcaggtt

SEQ ID NO: 256787 - DNA, 25 bp, Homo sapien
aggttggactggtccggccattcta

SEQ ID NO: 256788 - DNA, 25 bp, Homo sapien
tatgcagtactgagctaccccaaag

SEQ ID NO: 256789 - DNA, 25 bp, Homo sapien
aagcgggtgcatccacgaagacaca

SEQ ID NO: 256790 - DNA, 25 bp, Homo sapien
gaagacacaccggattcagttgtta

SEQ ID NO: 256791 - DNA, 25 bp, Homo sapien
gttaaatgagatgcacgtgtccgga

SEQ ID NO: 256792 - DNA, 25 bp, Homo sapien
gcacgtgtccggaaggaacccagga

SEQ ID NO: 256793 - DNA, 25 bp, Homo sapien
ggaacccaggaaactcttggtcatt

SEQ ID NO: 256794 - DNA, 25 bp, Homo sapien
ttggtcattccctctggagtaccag

SEQ ID NO: 256795 - DNA, 25 bp, Homo sapien
tccggcctgcagagagccgcaagaa

SEQ ID NO: 256796 - DNA, 25 bp, Homo sapien
gaagagcgccaagggcatgtactcc

SEQ ID NO: 256797 - DNA, 25 bp, Homo sapien
tgctattactatcccaaccgggcag

SEQ ID NO: 256798 - DNA, 25 bp, Homo sapien
aaccgggcaggcagctcagaccgag

SEQ ID NO: 256799 - DNA, 25 bp, Homo sapien
agaccgagcctcctttgtcatcggc

SEQ ID NO: 256800 - DNA, 25 bp, Homo sapien
gggccatgacacctgatcattggat

SEQ ID NO: 256801 - DNA, 25 bp, Homo sapien
gcactgctctactcatgagcctgga

SEQ ID NO: 256802 - DNA, 25 bp, Homo sapien
actcatgagcctggacagctgagac

SEQ ID NO: 256803 - DNA, 25 bp, Homo sapien
tggctgggaccggaagaactcctgc

SEQ ID NO: 256804 - DNA, 25 bp, Homo sapien
gaccggaagaactcctgcttggtgg

SEQ ID NO: 256805 - DNA, 25 bp, Homo sapien
gagcccatgcagcttgtctgcctca

SEQ ID NO: 256806 - DNA, 25 bp, Homo sapien
gcgactgcagtagtgcgggaaccta

SEQ ID NO: 256807 - DNA, 25 bp, Homo sapien
agtgcgggaacctattatttgacag

SEQ ID NO: 256808 - DNA, 25 bp, Homo sapien
atgacaggaagtgtagggaccccat

SEQ ID NO: 256809 - DNA, 25 bp, Homo sapien
gtagggaccccatgcttgatggatg

SEQ ID NO: 256810 - DNA, 25 bp, Homo sapien
cttatagtgtggtagtctcagtgtt

SEQ ID NO: 256811 - DNA, 25 bp, Homo sapien
tctcagtgttgatgggcatgaccga

SEQ ID NO: 256812 - DNA, 25 bp, Homo sapien
tgaccgagacagcaggagtacccct

SEQ ID NO: 256813 - DNA, 25 bp, Homo sapien
acagcaggagtacccctaagttctg

SEQ ID NO: 256814 - DNA, 25 bp, Homo sapien
gaaggacaccttactcaagctgtct

SEQ ID NO: 256815 - DNA, 25 bp, Homo sapien
tccggcatcctaagacgtgtggttt

SEQ ID NO: 256816 - DNA, 25 bp, Homo sapien
ttttaggaccttgggcctgataagt

SEQ ID NO: 256817 - DNA, 25 bp, Homo sapien
gtgagtgcactgaaattactccgca

SEQ ID NO: 256818 - DNA, 25 bp, Homo sapien
attactccgcaaacgttcacaagtc

SEQ ID NO: 256819 - DNA, 25 bp, Homo sapien
acgttcacaagtctggaaaccaaag

SEQ ID NO: 256820 - DNA, 25 bp, Homo sapien
caaaggtaattcgtatttctgcccg

SEQ ID NO: 256821 - DNA, 25 bp, Homo sapien
attcgtatttctgcccgaagtggag

SEQ ID NO: 256822 - DNA, 25 bp, Homo sapien
gggcataatcgagatggcagatctg

SEQ ID NO: 256823 - DNA, 25 bp, Homo sapien
ccaggacctaatgcttgccagtggg

SEQ ID NO: 256824 - DNA, 25 bp, Homo sapien
gagctgactgccaaacgacggaagc

SEQ ID NO: 256825 - DNA, 25 bp, Homo sapien
aagtttggatgtggaatctcattca

SEQ ID NO: 256826 - DNA, 25 bp, Homo sapien
tgtggaatctcattcaggaaagtgt

SEQ ID NO: 256827 - DNA, 25 bp, Homo sapien
tacaagcggaatatgtgagtgcact

SEQ ID NO: 256828 - DNA, 25 bp, Homo sapien
gcaatccatactcattcagtaacac

SEQ ID NO: 256829 - DNA, 25 bp, Homo sapien
aatccatactcattcagtaacacag

SEQ ID NO: 256830 - DNA, 25 bp, Homo sapien
atccatactcattcagtaacacagg

SEQ ID NO: 256831 - DNA, 25 bp, Homo sapien
tccatactcattcagtaacacaggc

SEQ ID NO: 256832 - DNA, 25 bp, Homo sapien
ccatactcattcagtaacacaggct

SEQ ID NO: 256833 - DNA, 25 bp, Homo sapien
taacacaggctcatttatttaacca

SEQ ID NO: 256834 - DNA, 25 bp, Homo sapien
catttatttaaccagctaatcattt

SEQ ID NO: 256835 - DNA, 25 bp, Homo sapien
ttatttaaccagctaatcatttatc

SEQ ID NO: 256836 - DNA, 25 bp, Homo sapien
tatttaaccagctaatcatttatcc

SEQ ID NO: 256837 - DNA, 25 bp, Homo sapien
atttaaccagctaatcatttatcca

SEQ ID NO: 256838 - DNA, 25 bp, Homo sapien
tttaaccagctaatcatttatccaa

SEQ ID NO: 256839 - DNA, 25 bp, Homo sapien
aggtctctaaaaattgccattcatg

SEQ ID NO: 256840 - DNA, 25 bp, Homo sapien
tcgggcctagggttttgagatgaat

SEQ ID NO: 256841 - DNA, 25 bp, Homo sapien
tttgagatgaatgtgcagtgtgtgt

SEQ ID NO: 256842 - DNA, 25 bp, Homo sapien
gcttccaccagcttggcattaagca

SEQ ID NO: 256843 - DNA, 25 bp, Homo sapien
gcttggcattaagcacccggagcat

SEQ ID NO: 256844 - DNA, 25 bp, Homo sapien
gggctcagggtcaaggcagattcct

SEQ ID NO: 256845 - DNA, 25 bp, Homo sapien
gggtcaaggcagattccttgcttgg

SEQ ID NO: 256846 - DNA, 25 bp, Homo sapien
tcatgaagatgccaattcgtattta

SEQ ID NO: 256847 - DNA, 25 bp, Homo sapien
gatgccaattcgtatttaaacattt

SEQ ID NO: 256848 - DNA, 25 bp, Homo sapien
acatttgttatcaatggtggtgttt

SEQ ID NO: 256849 - DNA, 25 bp, Homo sapien
ggtgtttgtgtgctgatttctatag

SEQ ID NO: 256850 - DNA, 25 bp, Homo sapien
agaacttaccatttttcctgtgagg

SEQ ID NO: 256851 - DNA, 25 bp, Homo sapien
tcctgtgaggtttcggtgctgatac

SEQ ID NO: 256852 - DNA, 25 bp, Homo sapien
cggtgctgatacttctattctgtga

SEQ ID NO: 256853 - DNA, 25 bp, Homo sapien
cttctattctgtgagttctggcaat

SEQ ID NO: 256854 - DNA, 25 bp, Homo sapien
agttctggcaattgtgtccgttcac

SEQ ID NO: 256855 - DNA, 25 bp, Homo sapien
ccagcctggtgatgcagcaggtgtc

SEQ ID NO: 256856 - DNA, 25 bp, Homo sapien
aggtgtcacagaaggaccctgtccc

SEQ ID NO: 256857 - DNA, 25 bp, Homo sapien
tccactgctaggatggtgtggcctc

SEQ ID NO: 256858 - DNA, 25 bp, Homo sapien
atggtgtggcctctgatctgtgacc

SEQ ID NO: 256859 - DNA, 25 bp, Homo sapien
cgcctggcacatcaccctaaaaagt

SEQ ID NO: 256860 - DNA, 25 bp, Homo sapien
tctgatctgtgaccgtgtcttgagg

SEQ ID NO: 256861 - DNA, 25 bp, Homo sapien
gtagcctgtactatcctgcttcaag

SEQ ID NO: 256862 - DNA, 25 bp, Homo sapien
tgcttcaagcctccgtgtcccttgt

SEQ ID NO: 256863 - DNA, 25 bp, Homo sapien
ccctaccttgagttgccagttcttt

SEQ ID NO: 256864 - DNA, 25 bp, Homo sapien
cttgagttgccagttctttactccc

SEQ ID NO: 256865 - DNA, 25 bp, Homo sapien
caaatgttcccatgccacctctggg

SEQ ID NO: 256866 - DNA, 25 bp, Homo sapien
ggtttctgttatctgacatccctgg

SEQ ID NO: 256867 - DNA, 25 bp, Homo sapien
ggctgctttcctggtagatgccatt

SEQ ID NO: 256868 - DNA, 25 bp, Homo sapien
ggtagatgccattcccagagaggcc

SEQ ID NO: 256869 - DNA, 25 bp, Homo sapien
cagagaggccaacagcgttcccagg

SEQ ID NO: 256870 - DNA, 25 bp, Homo sapien
tggctggtccgcatctctcagactc

SEQ ID NO: 256871 - DNA, 25 bp, Homo sapien
actctgccaggctacagttttgaga

SEQ ID NO: 256872 - DNA, 25 bp, Homo sapien
ggccactcttggcaatatgatggat

SEQ ID NO: 256873 - DNA, 25 bp, Homo sapien
tgatggataaactggctaacaccca

SEQ ID NO: 256874 - DNA, 25 bp, Homo sapien
gggagctgctgtctatagcaaaaca

SEQ ID NO: 256875 - DNA, 25 bp, Homo sapien
aaacaactgggaatcatgacaaatt

SEQ ID NO: 256876 - DNA, 25 bp, Homo sapien
ggaaaccaggatggcatttcaaaaa

SEQ ID NO: 256877 - DNA, 25 bp, Homo sapien
ttatacctttcctaagctttcacca

SEQ ID NO: 256878 - DNA, 25 bp, Homo sapien
gctttcaccaggacatgcagatttt

SEQ ID NO: 256879 - DNA, 25 bp, Homo sapien
tgcagattttattctgccagaaaga

SEQ ID NO: 256880 - DNA, 25 bp, Homo sapien
acaactcttgattagaagtcttcag

SEQ ID NO: 256881 - DNA, 25 bp, Homo sapien
gtcttcagttgaaattccactacaa

SEQ ID NO: 256882 - DNA, 25 bp, Homo sapien
gaaattccactacaaaagacatcat

SEQ ID NO: 256883 - DNA, 25 bp, Homo sapien
gggtcagggcacctgatggccctgg

SEQ ID NO: 256884 - DNA, 25 bp, Homo sapien
gtgggcccgccaccgcaggagaggg

SEQ ID NO: 256885 - DNA, 25 bp, Homo sapien
gcaggagagggcacctgagccaatc

SEQ ID NO: 256886 - DNA, 25 bp, Homo sapien
gagagggcacctgagccaatcggaa

SEQ ID NO: 256887 - DNA, 25 bp, Homo sapien
agagggcacctgagccaatcggaag

SEQ ID NO: 256888 - DNA, 25 bp, Homo sapien
ggccttggctgcacggaccccatgg

SEQ ID NO: 256889 - DNA, 25 bp, Homo sapien
ttggctgcacggaccccatgggagc

SEQ ID NO: 256890 - DNA, 25 bp, Homo sapien
gagtgggtcagactccctggttcag

SEQ ID NO: 256891 - DNA, 25 bp, Homo sapien
ccctggttcaggagacagacagcgg

SEQ ID NO: 256892 - DNA, 25 bp, Homo sapien
ctggttcaggagacagacagcggac

SEQ ID NO: 256893 - DNA, 25 bp, Homo sapien
ttcaggagacagacagcggacggat

SEQ ID NO: 256894 - DNA, 25 bp, Homo sapien
aggagtgcctggtgcttccctgtct

SEQ ID NO: 256895 - DNA, 25 bp, Homo sapien
gtgcctggtgcttccctgtctcttg

SEQ ID NO: 256896 - DNA, 25 bp, Homo sapien
atggagctgggccttttcttccatt

SEQ ID NO: 256897 - DNA, 25 bp, Homo sapien
ttttcttccattgctttctatctct

SEQ ID NO: 256898 - DNA, 25 bp, Homo sapien
attgctttctatctctctcgggcat

SEQ ID NO: 256899 - DNA, 25 bp, Homo sapien
tttctatctctctcgggcatatttg

SEQ ID NO: 256900 - DNA, 25 bp, Homo sapien
tctctctcgggcatatttggttagg

SEQ ID NO: 256901 - DNA, 25 bp, Homo sapien
agtgtcttcctcatgacccaggagg

SEQ ID NO: 256902 - DNA, 25 bp, Homo sapien
ttcctcatgacccaggaggcttagg

SEQ ID NO: 256903 - DNA, 25 bp, Homo sapien
tagggcctgtgggatggttgagtct

SEQ ID NO: 256904 - DNA, 25 bp, Homo sapien
gggacagggccagcgccactctctt

SEQ ID NO: 256905 - DNA, 25 bp, Homo sapien
tgctcgcggtgaggatcgatgacct

SEQ ID NO: 256906 - DNA, 25 bp, Homo sapien
tgaggatcgatgacctggaccacct

SEQ ID NO: 256907 - DNA, 25 bp, Homo sapien
gttcagctcacacacgacaaggtgg

SEQ ID NO: 256908 - DNA, 25 bp, Homo sapien
attggcatcgtccagcctgagctga

SEQ ID NO: 256909 - DNA, 25 bp, Homo sapien
atcgtccagcctgagctgactctgg

SEQ ID NO: 256910 - DNA, 25 bp, Homo sapien
acacacgacaaggtggaggcgcaga

SEQ ID NO: 256911 - DNA, 25 bp, Homo sapien
gaagcacgggaaagctgccaagcga

SEQ ID NO: 256912 - DNA, 25 bp, Homo sapien
agctgccaagcgaagtcacaagaga

SEQ ID NO: 256913 - DNA, 25 bp, Homo sapien
cagctgtgcgggaccaaggtgtcca

SEQ ID NO: 256914 - DNA, 25 bp, Homo sapien
agggcctccatgagccgacacatgc

SEQ ID NO: 256915 - DNA, 25 bp, Homo sapien
tgagccgacacatgcggcgcaagca

SEQ ID NO: 256916 - DNA, 25 bp, Homo sapien
gaatcttaaaccagtagttatctgt

SEQ ID NO: 256917 - DNA, 25 bp, Homo sapien
atctgtataaattaagccttgacct

SEQ ID NO: 256918 - DNA, 25 bp, Homo sapien
aattaagccttgaccttcttcatcc

SEQ ID NO: 256919 - DNA, 25 bp, Homo sapien
ttgaccttcttcatcccactgttta

SEQ ID NO: 256920 - DNA, 25 bp, Homo sapien
gtaaaacttgtcctttatttgcttg

SEQ ID NO: 256921 - DNA, 25 bp, Homo sapien
gtcctttatttgcttgaatttcaga

SEQ ID NO: 256922 - DNA, 25 bp, Homo sapien
tttcagaacagctacttgataccgt

SEQ ID NO: 256923 - DNA, 25 bp, Homo sapien
acagctacttgataccgttttaaga

SEQ ID NO: 256924 - DNA, 25 bp, Homo sapien
aacccaatacttaccagtgaagtca

SEQ ID NO: 256925 - DNA, 25 bp, Homo sapien
tgaaagtaattttgaaccttatccg

SEQ ID NO: 256926 - DNA, 25 bp, Homo sapien
gaaaagccagccttaagaatcttaa

SEQ ID NO: 256927 - DNA, 25 bp, Homo sapien
tggactccttcttactctgcagcaa

SEQ ID NO: 256928 - DNA, 25 bp, Homo sapien
ttcttactctgcagcaacatggagg

SEQ ID NO: 256929 - DNA, 25 bp, Homo sapien
cctctgactatgcaccagtgaacac

SEQ ID NO: 256930 - DNA, 25 bp, Homo sapien
agtgaacacatctgagtacatacca

SEQ ID NO: 256931 - DNA, 25 bp, Homo sapien
agtacataccagctctcctcatctt

SEQ ID NO: 256932 - DNA, 25 bp, Homo sapien
atggaggacgaaatcttagagcaac

SEQ ID NO: 256933 - DNA, 25 bp, Homo sapien
gaaatcttagagcaacatcatcaaa

SEQ ID NO: 256934 - DNA, 25 bp, Homo sapien
acatcatcaaacagtctttggtcct

SEQ ID NO: 256935 - DNA, 25 bp, Homo sapien
gtctttggtccttgagaatcttctt

SEQ ID NO: 256936 - DNA, 25 bp, Homo sapien
ccttgagaatcttctttgtgtttta

SEQ ID NO: 256937 - DNA, 25 bp, Homo sapien
tgtagcttttcagttgcagatgttg

SEQ ID NO: 256938 - DNA, 25 bp, Homo sapien
ggcctctagggtgatggaccagccc

SEQ ID NO: 256939 - DNA, 25 bp, Homo sapien
acttgactcaactacaggggcctgg

SEQ ID NO: 256940 - DNA, 25 bp, Homo sapien
tgggaagatgcctgggtcccctagg

SEQ ID NO: 256941 - DNA, 25 bp, Homo sapien
cactgggctcgcacaacgccaaggc

SEQ ID NO: 256942 - DNA, 25 bp, Homo sapien
gccaaggccgccaggagtgttttac

SEQ ID NO: 256943 - DNA, 25 bp, Homo sapien
caaggccgccaggagtgttttacat

SEQ ID NO: 256944 - DNA, 25 bp, Homo sapien
aggccgccaggagtgttttacatca

SEQ ID NO: 256945 - DNA, 25 bp, Homo sapien
ggccgccaggagtgttttacatcat

SEQ ID NO: 256946 - DNA, 25 bp, Homo sapien
ccgccaggagtgttttacatcatgt

SEQ ID NO: 256947 - DNA, 25 bp, Homo sapien
gccaggagtgttttacatcatgtcc

SEQ ID NO: 256948 - DNA, 25 bp, Homo sapien
tacatcatgtcctgagcctaccttt

SEQ ID NO: 256949 - DNA, 25 bp, Homo sapien
aaatagtggtgtccgtatacctgac

SEQ ID NO: 256950 - DNA, 25 bp, Homo sapien
gtggtgtccgtatacctgacaagga

SEQ ID NO: 256951 - DNA, 25 bp, Homo sapien
tacctgacaaggatgagacactagt

SEQ ID NO: 256952 - DNA, 25 bp, Homo sapien
gacactagtgtgctgagaatgccaa

SEQ ID NO: 256953 - DNA, 25 bp, Homo sapien
agaatgccaaggatgaacaaacagc

SEQ ID NO: 256954 - DNA, 25 bp, Homo sapien
ggatgaacaaacagcatgaaaccac

SEQ ID NO: 256955 - DNA, 25 bp, Homo sapien
ctacgctgcgctgctgcattcgggt

SEQ ID NO: 256956 - DNA, 25 bp, Homo sapien
tgctgcattcgggtggcgggatcaa

SEQ ID NO: 256957 - DNA, 25 bp, Homo sapien
gaacagcctctggaggagacttcac

SEQ ID NO: 256958 - DNA, 25 bp, Homo sapien
tggaggagacttcacaggacacatc

SEQ ID NO: 256959 - DNA, 25 bp, Homo sapien
gaggagacttcacaggacacatcct

SEQ ID NO: 256960 - DNA, 25 bp, Homo sapien
gtgatgcagataaaacgcttccaac

SEQ ID NO: 256961 - DNA, 25 bp, Homo sapien
aacgcttccaacacttttatataca

SEQ ID NO: 256962 - DNA, 25 bp, Homo sapien
tatatacagctgtccttggtttggg

SEQ ID NO: 256963 - DNA, 25 bp, Homo sapien
gggtgctttaatgggttcctgcagc

SEQ ID NO: 256964 - DNA, 25 bp, Homo sapien
agcttcttcactgtactctggagta

SEQ ID NO: 256965 - DNA, 25 bp, Homo sapien
gtactctggagtattctcagagcta

SEQ ID NO: 256966 - DNA, 25 bp, Homo sapien
ctcagagctatttttgttggcaagt

SEQ ID NO: 256967 - DNA, 25 bp, Homo sapien
gttggcaagtagctgttaaattctt

SEQ ID NO: 256968 - DNA, 25 bp, Homo sapien
gacaagagctgggatctcctagtgt

SEQ ID NO: 256969 - DNA, 25 bp, Homo sapien
gatctcctagtgtatcatcttgttg

SEQ ID NO: 256970 - DNA, 25 bp, Homo sapien
tgttgatattacttgcctgctttta

SEQ ID NO: 256971 - DNA, 25 bp, Homo sapien
gcactaatgggtcagccacactggt

SEQ ID NO: 256972 - DNA, 25 bp, Homo sapien
atgggtcagccacactggtctctgg

SEQ ID NO: 256973 - DNA, 25 bp, Homo sapien
gggatcacaaaataggccagttcct

SEQ ID NO: 256974 - DNA, 25 bp, Homo sapien
tgccaggccccaaatgctttgtatc

SEQ ID NO: 256975 - DNA, 25 bp, Homo sapien
tgctttgtatccaccaacatgggct

SEQ ID NO: 256976 - DNA, 25 bp, Homo sapien
aacatgggctcatgcgcttccctgt

SEQ ID NO: 256977 - DNA, 25 bp, Homo sapien
catgcgcttccctgtcaaccaaagg

SEQ ID NO: 256978 - DNA, 25 bp, Homo sapien
tgtgatgaaacagaaatgccccgaa

SEQ ID NO: 256979 - DNA, 25 bp, Homo sapien
agaaatgccccgaaggacttcctgc

SEQ ID NO: 256980 - DNA, 25 bp, Homo sapien
tgtccccatcagagcaggccatttg

SEQ ID NO: 256981 - DNA, 25 bp, Homo sapien
ctgcgtgggctccttttaacacaag

SEQ ID NO: 256982 - DNA, 25 bp, Homo sapien
aaacgggcccgttccatggacatag

SEQ ID NO: 256983 - DNA, 25 bp, Homo sapien
gttccatggacatagatgacttcat

SEQ ID NO: 256984 - DNA, 25 bp, Homo sapien
tgacttcatcagattgctacatgga

SEQ ID NO: 256985 - DNA, 25 bp, Homo sapien
gattgctacatggattcaacgcaga

SEQ ID NO: 256986 - DNA, 25 bp, Homo sapien
ggattcaacgcagaaggtattcatt

SEQ ID NO: 256987 - DNA, 25 bp, Homo sapien
tattcatttttcctaggtatttgga

SEQ ID NO: 256988 - DNA, 25 bp, Homo sapien
gataatgcttttgctttactgagac

SEQ ID NO: 256989 - DNA, 25 bp, Homo sapien
gagacattatttacttgactatttt

SEQ ID NO: 256990 - DNA, 25 bp, Homo sapien
gactatttttggttcaatactacta

SEQ ID NO: 256991 - DNA, 25 bp, Homo sapien
aatactactactgttgtcaccattt

SEQ ID NO: 256992 - DNA, 25 bp, Homo sapien
gttgtcaccatttatgattctgaat

SEQ ID NO: 256993 - DNA, 25 bp, Homo sapien
gagaatttgcttagcgccttccttg

SEQ ID NO: 256994 - DNA, 25 bp, Homo sapien
agaatttgcttagcgccttccttgt

SEQ ID NO: 256995 - DNA, 25 bp, Homo sapien
tttgcttagcgccttccttgttcct

SEQ ID NO: 256996 - DNA, 25 bp, Homo sapien
ttagcgccttccttgttcctgcata

SEQ ID NO: 256997 - DNA, 25 bp, Homo sapien
gccttccttgttcctgcatattttt

SEQ ID NO: 256998 - DNA, 25 bp, Homo sapien
tgcctccctgtgctggaattgactt

SEQ ID NO: 256999 - DNA, 25 bp, Homo sapien
tccctgtgctggaattgactttcct

SEQ ID NO: 257000 - DNA, 25 bp, Homo sapien
cctgtgctggaattgactttcctga

SEQ ID NO: 257001 - DNA, 25 bp, Homo sapien
agaggtgtaaataaggcgactggcc

SEQ ID NO: 257002 - DNA, 25 bp, Homo sapien
aataaggcgactggccttggcactg

SEQ ID NO: 257003 - DNA, 25 bp, Homo sapien
gcgactggccttggcactgtgggat

SEQ ID NO: 257004 - DNA, 25 bp, Homo sapien
tacctgagtgttctctcttctgcaa

SEQ ID NO: 257005 - DNA, 25 bp, Homo sapien
tctcttctgcaacacccgttttaac

SEQ ID NO: 257006 - DNA, 25 bp, Homo sapien
gacttctccccaacttggctaatgg

SEQ ID NO: 257007 - DNA, 25 bp, Homo sapien
gcggcgaaacgcactgaagagagtt

SEQ ID NO: 257008 - DNA, 25 bp, Homo sapien
aacgcactgaagagagttggataca

SEQ ID NO: 257009 - DNA, 25 bp, Homo sapien
agagttggatacagaatttcttgca

SEQ ID NO: 257010 - DNA, 25 bp, Homo sapien
gaatttcttgcaaacgaggtcgagt

SEQ ID NO: 257011 - DNA, 25 bp, Homo sapien
ttgcaaacgaggtcgagttgcgtct

SEQ ID NO: 257012 - DNA, 25 bp, Homo sapien
tcgagttgcgtctgggatacggtgt

SEQ ID NO: 257013 - DNA, 25 bp, Homo sapien
tactttgtctttttacacccgtgag

SEQ ID NO: 257014 - DNA, 25 bp, Homo sapien
tttttacacccgtgagaatgttcgg

SEQ ID NO: 257015 - DNA, 25 bp, Homo sapien
gagaagatgtcatggccctgtaagt

SEQ ID NO: 257016 - DNA, 25 bp, Homo sapien
gtcatggccctgtaagtcaagagaa

SEQ ID NO: 257017 - DNA, 25 bp, Homo sapien
aagagaacaggatggccaaaggcaa

SEQ ID NO: 257018 - DNA, 25 bp, Homo sapien
tcagagagcctcgttcttacacaag

SEQ ID NO: 257019 - DNA, 25 bp, Homo sapien
gcctcgttcttacacaagggccaag

SEQ ID NO: 257020 - DNA, 25 bp, Homo sapien
gaaacaggacatctaaggacttgga

SEQ ID NO: 257021 - DNA, 25 bp, Homo sapien
taaggacttggaagccccaggcacg

SEQ ID NO: 257022 - DNA, 25 bp, Homo sapien
gcctctctgttctccagctaaggaa

SEQ ID NO: 257023 - DNA, 25 bp, Homo sapien
gttctccagctaaggaacgctttat

SEQ ID NO: 257024 - DNA, 25 bp, Homo sapien
aactctgaaattttgattccaggca

SEQ ID NO: 257025 - DNA, 25 bp, Homo sapien
attttgattccaggcaatccatggg

SEQ ID NO: 257026 - DNA, 25 bp, Homo sapien
gaaaatttgttgataaaccatggca

SEQ ID NO: 257027 - DNA, 25 bp, Homo sapien
ttgataaaccatggcaactgcaaga

SEQ ID NO: 257028 - DNA, 25 bp, Homo sapien
aaaatgctgggacttttcatgaact

SEQ ID NO: 257029 - DNA, 25 bp, Homo sapien
gggacttttcatgaactttgtctta

SEQ ID NO: 257030 - DNA, 25 bp, Homo sapien
gaactttgtcttaagtgttgacatg

SEQ ID NO: 257031 - DNA, 25 bp, Homo sapien
tggtttaaaaacaactgcattagaa

SEQ ID NO: 257032 - DNA, 25 bp, Homo sapien
ttttaatttacaaagcgtgatcgct

SEQ ID NO: 257033 - DNA, 25 bp, Homo sapien
aagcgtgatcgctagcaaaagcatt

SEQ ID NO: 257034 - DNA, 25 bp, Homo sapien
agcattagtgctttttatctgcagt

SEQ ID NO: 257035 - DNA, 25 bp, Homo sapien
ttatctgcagtcttttttatgagct

SEQ ID NO: 257036 - DNA, 25 bp, Homo sapien
tgcagtcttttttatgagctttaca

SEQ ID NO: 257037 - DNA, 25 bp, Homo sapien
ttctgtaaggctgtcttcaatctca

SEQ ID NO: 257038 - DNA, 25 bp, Homo sapien
ggctgtcttcaatctcagagtcatc

SEQ ID NO: 257039 - DNA, 25 bp, Homo sapien
taaggagaagaggtccccagctcgt

SEQ ID NO: 257040 - DNA, 25 bp, Homo sapien
gtccccagctcgtgaaagatctttt

SEQ ID NO: 257041 - DNA, 25 bp, Homo sapien
gtctgaacagttgatgcatggtgag

SEQ ID NO: 257042 - DNA, 25 bp, Homo sapien
gatcagttgactttctacagaccca

SEQ ID NO: 257043 - DNA, 25 bp, Homo sapien
tacagacccagagtcatgtgttcca

SEQ ID NO: 257044 - DNA, 25 bp, Homo sapien
ggaggtatacttcttattccatgaa

SEQ ID NO: 257045 - DNA, 25 bp, Homo sapien
gactttgaggtcttcattgacactc

SEQ ID NO: 257046 - DNA, 25 bp, Homo sapien
tcttcattgacactctctctttgca

SEQ ID NO: 257047 - DNA, 25 bp, Homo sapien
tctttgcacaggaatctctggtcat

SEQ ID NO: 257048 - DNA, 25 bp, Homo sapien
atgatctctatttataattgttaag

SEQ ID NO: 257049 - DNA, 25 bp, Homo sapien
aagaacttacagcttatttcacaaa

SEQ ID NO: 257050 - DNA, 25 bp, Homo sapien
gcttatttcacaaaatcattgctct

SEQ ID NO: 257051 - DNA, 25 bp, Homo sapien
aaatcattgctcttttccactgtta

SEQ ID NO: 257052 - DNA, 25 bp, Homo sapien
atcattgctcttttccactgttatt

SEQ ID NO: 257053 - DNA, 25 bp, Homo sapien
tttccactgttatttgtaccatacg

SEQ ID NO: 257054 - DNA, 25 bp, Homo sapien
cactgttatttgtaccatacgtatg

SEQ ID NO: 257055 - DNA, 25 bp, Homo sapien
accatacgtatgtaccatagtgtgc

SEQ ID NO: 257056 - DNA, 25 bp, Homo sapien
gaaacacttaagagagagtggcaat

SEQ ID NO: 257057 - DNA, 25 bp, Homo sapien
gagagtggcaataacataatcattt

SEQ ID NO: 257058 - DNA, 25 bp, Homo sapien
ttttttacaaactgccaaattatag

SEQ ID NO: 257059 - DNA, 25 bp, Homo sapien
aaacagatgaattacctcacaggat

SEQ ID NO: 257060 - DNA, 25 bp, Homo sapien
tacctcacaggattgctggtcaaag

SEQ ID NO: 257061 - DNA, 25 bp, Homo sapien
tgctggtcaaagacactcggagaga

SEQ ID NO: 257062 - DNA, 25 bp, Homo sapien
agacactcggagagactccaggcat

SEQ ID NO: 257063 - DNA, 25 bp, Homo sapien
ctggccctaacctatcatgtatgaa

SEQ ID NO: 257064 - DNA, 25 bp, Homo sapien
actccaggcatgtgacaagtctctc

SEQ ID NO: 257065 - DNA, 25 bp, Homo sapien
atgtgacaagtctctcatctgcaga

SEQ ID NO: 257066 - DNA, 25 bp, Homo sapien
gcagaccccattttcagctcatgaa

SEQ ID NO: 257067 - DNA, 25 bp, Homo sapien
aaataggagcatactctgatttcac

SEQ ID NO: 257068 - DNA, 25 bp, Homo sapien
agttttaaccatcatcctgtgaccc

SEQ ID NO: 257069 - DNA, 25 bp, Homo sapien
atcctgtgaccccaaaagtccatca

SEQ ID NO: 257070 - DNA, 25 bp, Homo sapien
gggtatgccgcttcacctctactgg

SEQ ID NO: 257071 - DNA, 25 bp, Homo sapien
ggaacgtgttccctgctgatcgtgt

SEQ ID NO: 257072 - DNA, 25 bp, Homo sapien
acgtgttccctgctgatcgtgtgaa

SEQ ID NO: 257073 - DNA, 25 bp, Homo sapien
gtgttccctgctgatcgtgtgaaaa

SEQ ID NO: 257074 - DNA, 25 bp, Homo sapien
gttccctgctgatcgtgtgaaaaga

SEQ ID NO: 257075 - DNA, 25 bp, Homo sapien
tccctgctgatcgtgtgaaaagagt

SEQ ID NO: 257076 - DNA, 25 bp, Homo sapien
gctgatcgtgtgaaaagagtgagac

SEQ ID NO: 257077 - DNA, 25 bp, Homo sapien
gccttggacttggaggcaagcgatc

SEQ ID NO: 257078 - DNA, 25 bp, Homo sapien
acttggaggcaagcgatctgagtga

SEQ ID NO: 257079 - DNA, 25 bp, Homo sapien
ggcaagcgatctgagtgatgacctg

SEQ ID NO: 257080 - DNA, 25 bp, Homo sapien
caagcgatctgagtgatgacctggg

SEQ ID NO: 257081 - DNA, 25 bp, Homo sapien
aggtcttgggccaccatgagtaggc

SEQ ID NO: 257082 - DNA, 25 bp, Homo sapien
gggccaccatgagtaggcagtcaaa

SEQ ID NO: 257083 - DNA, 25 bp, Homo sapien
gcagtcaaaagtcattggctagcat

SEQ ID NO: 257084 - DNA, 25 bp, Homo sapien
gtcattggctagcatgcaaaaacat

SEQ ID NO: 257085 - DNA, 25 bp, Homo sapien
gtaagttcagtttatggagagctct

SEQ ID NO: 257086 - DNA, 25 bp, Homo sapien
cagtttatggagagctctgcgataa

SEQ ID NO: 257087 - DNA, 25 bp, Homo sapien
agctctgcgataagttatggcacca

SEQ ID NO: 257088 - DNA, 25 bp, Homo sapien
gttatggcaccaacagcaaccagtc

SEQ ID NO: 257089 - DNA, 25 bp, Homo sapien
ctagcttctctccaacactattaag

SEQ ID NO: 257090 - DNA, 25 bp, Homo sapien
acactattaagtacctgccaacctc

SEQ ID NO: 257091 - DNA, 25 bp, Homo sapien
ttaacaaagatcaggtcttgggcca

SEQ ID NO: 257092 - DNA, 25 bp, Homo sapien
agtctctgcacgtttggacattttt

SEQ ID NO: 257093 - DNA, 25 bp, Homo sapien
ggacatttttaacaagcaaccctca

SEQ ID NO: 257094 - DNA, 25 bp, Homo sapien
gcaaccctcatgatttttatgatcc

SEQ ID NO: 257095 - DNA, 25 bp, Homo sapien
gtttgacaattctagggccttggtc

SEQ ID NO: 257096 - DNA, 25 bp, Homo sapien
ttctagggccttggtcttcaaaatg

SEQ ID NO: 257097 - DNA, 25 bp, Homo sapien
gacacatgcatacccttgagaacac

SEQ ID NO: 257098 - DNA, 25 bp, Homo sapien
ggtaaggatacatgcatagctctat

SEQ ID NO: 257099 - DNA, 25 bp, Homo sapien
gtccaatttccatatgtgttgtcct

SEQ ID NO: 257100 - DNA, 25 bp, Homo sapien
gtgttgtcctaaaatatgtgctctg

SEQ ID NO: 257101 - DNA, 25 bp, Homo sapien
tgatgaggcctcttcagatctacca

SEQ ID NO: 257102 - DNA, 25 bp, Homo sapien
tcagatctaccatttctctttacct

SEQ ID NO: 257103 - DNA, 25 bp, Homo sapien
gtgtctaagccacttgatgaaccag

SEQ ID NO: 257104 - DNA, 25 bp, Homo sapien
gccacttgatgaaccagtcaatcca

SEQ ID NO: 257105 - DNA, 25 bp, Homo sapien
cctattttctctataaagttgcttt

SEQ ID NO: 257106 - DNA, 25 bp, Homo sapien
atgaggcttgatgggcagccctatc

SEQ ID NO: 257107 - DNA, 25 bp, Homo sapien
atgggcagccctatcagcagacaat

SEQ ID NO: 257108 - DNA, 25 bp, Homo sapien
cagcagacaatcattcattcaccca

SEQ ID NO: 257109 - DNA, 25 bp, Homo sapien
atttgagtatctgcttcaagccagg

SEQ ID NO: 257110 - DNA, 25 bp, Homo sapien
agtgctaagccctggaagtggtatc

SEQ ID NO: 257111 - DNA, 25 bp, Homo sapien
ggaagtggtatcttctccttatccg

SEQ ID NO: 257112 - DNA, 25 bp, Homo sapien
tatcttctccttatccgggagtggg

SEQ ID NO: 257113 - DNA, 25 bp, Homo sapien
tggggctacagtgttcattccagaa

SEQ ID NO: 257114 - DNA, 25 bp, Homo sapien
caccagtcttctcagcacaggaacg

SEQ ID NO: 257115 - DNA, 25 bp, Homo sapien
agcacaggaacggtgccttcacatt

SEQ ID NO: 257116 - DNA, 25 bp, Homo sapien
aggaacggtgccttcacattggtct

SEQ ID NO: 257117 - DNA, 25 bp, Homo sapien
tcctgattctgcagctggttctctc

SEQ ID NO: 257118 - DNA, 25 bp, Homo sapien
agctggttctctctccaagcactag

SEQ ID NO: 257119 - DNA, 25 bp, Homo sapien
tcggagtgggcctcattccagagtt

SEQ ID NO: 257120 - DNA, 25 bp, Homo sapien
agtgggcctcattccagagttgtgg

SEQ ID NO: 257121 - DNA, 25 bp, Homo sapien
ggcctcattccagagttgtggtggc

SEQ ID NO: 257122 - DNA, 25 bp, Homo sapien
tcattccagagttgtggtggccgct

SEQ ID NO: 257123 - DNA, 25 bp, Homo sapien
ttccagagttgtggtggccgctcca

SEQ ID NO: 257124 - DNA, 25 bp, Homo sapien
ggtggccgctccacctggcgagctt

SEQ ID NO: 257125 - DNA, 25 bp, Homo sapien
tttagattgtgggatcagtgattaa

SEQ ID NO: 257126 - DNA, 25 bp, Homo sapien
tactttcatctgtcacttggccagg

SEQ ID NO: 257127 - DNA, 25 bp, Homo sapien
tcatctgtcacttggccagggtcta

SEQ ID NO: 257128 - DNA, 25 bp, Homo sapien
gtaagtggcccctgtcagctgccac

SEQ ID NO: 257129 - DNA, 25 bp, Homo sapien
gcaggtggcctgaattcttagggat

SEQ ID NO: 257130 - DNA, 25 bp, Homo sapien
acttggccagggtctatggttcaga

SEQ ID NO: 257131 - DNA, 25 bp, Homo sapien
tgaattcttagggatgttggcatca

SEQ ID NO: 257132 - DNA, 25 bp, Homo sapien
ggatgttggcatcagctccatactc

SEQ ID NO: 257133 - DNA, 25 bp, Homo sapien
ggcatcagctccatactccagcaag

SEQ ID NO: 257134 - DNA, 25 bp, Homo sapien
tctatggttcagacccagcacctgg

SEQ ID NO: 257135 - DNA, 25 bp, Homo sapien
agacccagcacctggcgacagaggg

SEQ ID NO: 257136 - DNA, 25 bp, Homo sapien
tgctcccatcttccagatgttcagt

SEQ ID NO: 257137 - DNA, 25 bp, Homo sapien
aggacctgctctatgagggagagtc

SEQ ID NO: 257138 - DNA, 25 bp, Homo sapien
tatgagggagagtccacggtgtacc

SEQ ID NO: 257139 - DNA, 25 bp, Homo sapien
gagagtccacggtgtaccccgtgtt

SEQ ID NO: 257140 - DNA, 25 bp, Homo sapien
taccccgtgttcattaacgaggctg

SEQ ID NO: 257141 - DNA, 25 bp, Homo sapien
gtgttcattaacgaggctgcctact

SEQ ID NO: 257142 - DNA, 25 bp, Homo sapien
ggctgcctactatgagaagggcgtt

SEQ ID NO: 257143 - DNA, 25 bp, Homo sapien
gagaagggcgttgcctttgtccaga

SEQ ID NO: 257144 - DNA, 25 bp, Homo sapien
tgcctttgtccagactgagaagttc

SEQ ID NO: 257145 - DNA, 25 bp, Homo sapien
tgagaagttcacattcaccgtgcct

SEQ ID NO: 257146 - DNA, 25 bp, Homo sapien
tgcaggaccgagacttccagccact

SEQ ID NO: 257147 - DNA, 25 bp, Homo sapien
aatttagcaatgttaaccatcagat

SEQ ID NO: 257148 - DNA, 25 bp, Homo sapien
aaccatcagattaattttaggcttg

SEQ ID NO: 257149 - DNA, 25 bp, Homo sapien
gggagaacaagagatggacttttga

SEQ ID NO: 257150 - DNA, 25 bp, Homo sapien
ggacttttgagttttaggtatctgt

SEQ ID NO: 257151 - DNA, 25 bp, Homo sapien
tttaggtatctgtatgtatgtactt

SEQ ID NO: 257152 - DNA, 25 bp, Homo sapien
gtatgtactttcttgacctctgtta

SEQ ID NO: 257153 - DNA, 25 bp, Homo sapien
tatgtactttcttgacctctgttat

SEQ ID NO: 257154 - DNA, 25 bp, Homo sapien
tcttgacctctgttatatttctcca

SEQ ID NO: 257155 - DNA, 25 bp, Homo sapien
tatttctccagataagtactgttta

SEQ ID NO: 257156 - DNA, 25 bp, Homo sapien
gatgtcagatgagcaatagatagat

SEQ ID NO: 257157 - DNA, 25 bp, Homo sapien
aagacttgaataactttattggcta

SEQ ID NO: 257158 - DNA, 25 bp, Homo sapien
cctacatcgctgctgtcgtccacgc

SEQ ID NO: 257159 - DNA, 25 bp, Homo sapien
acgccctgctggaccggccttaggg

SEQ ID NO: 257160 - DNA, 25 bp, Homo sapien
gaccccgggagcagaagacgcgcct

SEQ ID NO: 257161 - DNA, 25 bp, Homo sapien
agaagacgcgcctgggctccgcgct

SEQ ID NO: 257162 - DNA, 25 bp, Homo sapien
ggctccgcgctctcagagaagcacg

SEQ ID NO: 257163 - DNA, 25 bp, Homo sapien
gcgctctcagagaagcacgtggtga

SEQ ID NO: 257164 - DNA, 25 bp, Homo sapien
gagaagcacgtggtgagggtggcct

SEQ ID NO: 257165 - DNA, 25 bp, Homo sapien
aaggaccgcgggtgtcgcaggtgtc

SEQ ID NO: 257166 - DNA, 25 bp, Homo sapien
gtcgcaggtgtcgtgtcagccgcaa

SEQ ID NO: 257167 - DNA, 25 bp, Homo sapien
gcaggtgtcgtgtcagccgcaataa

SEQ ID NO: 257168 - DNA, 25 bp, Homo sapien
aggtgtcgtgtcagccgcaataaac

SEQ ID NO: 257169 - DNA, 25 bp, Homo sapien
gtcagggcacctgatggccctggca

SEQ ID NO: 257170 - DNA, 25 bp, Homo sapien
gtgggcccgccaccgcaggagaggg

SEQ ID NO: 257171 - DNA, 25 bp, Homo sapien
gcaggagagggcacctgagccaatc

SEQ ID NO: 257172 - DNA, 25 bp, Homo sapien
gagagggcacctgagccaatcggaa

SEQ ID NO: 257173 - DNA, 25 bp, Homo sapien
agagggcacctgagccaatcggaag

SEQ ID NO: 257174 - DNA, 25 bp, Homo sapien
gcacctgagccaatcggaagagcct

SEQ ID NO: 257175 - DNA, 25 bp, Homo sapien
ttggctgcacggaccccatgggagc

SEQ ID NO: 257176 - DNA, 25 bp, Homo sapien
gagtgggtcagactccctggttcag

SEQ ID NO: 257177 - DNA, 25 bp, Homo sapien
ccctggttcaggagacagacagcgg

SEQ ID NO: 257178 - DNA, 25 bp, Homo sapien
ttcaggagacagacagcggacggat

SEQ ID NO: 257179 - DNA, 25 bp, Homo sapien
acagacagcggacggatcccaggct

SEQ ID NO: 257180 - DNA, 25 bp, Homo sapien
caggtccacatgctcgatgctgtac

SEQ ID NO: 257181 - DNA, 25 bp, Homo sapien
acatgctcgatgctgtactgccggg

SEQ ID NO: 257182 - DNA, 25 bp, Homo sapien
tgctccttgggaacttccaacaccg

SEQ ID NO: 257183 - DNA, 25 bp, Homo sapien
gggaacttccaacaccgagatgctg

SEQ ID NO: 257184 - DNA, 25 bp, Homo sapien
caacaccgagatgctggcgttggtg

SEQ ID NO: 257185 - DNA, 25 bp, Homo sapien
cggaagcccgggagaagctcacgtt

SEQ ID NO: 257186 - DNA, 25 bp, Homo sapien
gggagaagctcacgttgcgctcaca

SEQ ID NO: 257187 - DNA, 25 bp, Homo sapien
tcatccacgccgaagtaattggcat

SEQ ID NO: 257188 - DNA, 25 bp, Homo sapien
acgccgaagtaattggcatgttctt

SEQ ID NO: 257189 - DNA, 25 bp, Homo sapien
gttctttgcccacgaagtaatcctg

SEQ ID NO: 257190 - DNA, 25 bp, Homo sapien
aagtaatcctggtagtagcgggcgc

SEQ ID NO: 257191 - DNA, 25 bp, Homo sapien
aatgaagcactttccattctagccc

SEQ ID NO: 257192 - DNA, 25 bp, Homo sapien
ctttccattctagcccatgatgatg

SEQ ID NO: 257193 - DNA, 25 bp, Homo sapien
agctgtataggaaagcactttgtaa

SEQ ID NO: 257194 - DNA, 25 bp, Homo sapien
ggaaatggtgagtgcctctccccta

SEQ ID NO: 257195 - DNA, 25 bp, Homo sapien
gtgagtgcctctcccctaacataca

SEQ ID NO: 257196 - DNA, 25 bp, Homo sapien
aaatgttacctcacaattgttgaac

SEQ ID NO: 257197 - DNA, 25 bp, Homo sapien
aattgttgaacagtatctcggcttc

SEQ ID NO: 257198 - DNA, 25 bp, Homo sapien
gttgaacagtatctcggcttcatta

SEQ ID NO: 257199 - DNA, 25 bp, Homo sapien
cagtatctcggcttcattaagtcgt

SEQ ID NO: 257200 - DNA, 25 bp, Homo sapien
atctcggcttcattaagtcgtatgc

SEQ ID NO: 257201 - DNA, 25 bp, Homo sapien
ggcttcattaagtcgtatgcaagaa

SEQ ID NO: 257202 - DNA, 25 bp, Homo sapien
atggctgtctcagtggctgctataa

SEQ ID NO: 257203 - DNA, 25 bp, Homo sapien
tgctataatcgtaccagcctttcct

SEQ ID NO: 257204 - DNA, 25 bp, Homo sapien
agcctttcctgtcaagcctgaaatt

SEQ ID NO: 257205 - DNA, 25 bp, Homo sapien
aagaacttccaaagccatcaggaga

SEQ ID NO: 257206 - DNA, 25 bp, Homo sapien
tgctgggctctgcttactctcagga

SEQ ID NO: 257207 - DNA, 25 bp, Homo sapien
tactctcaggagcttgcagccactg

SEQ ID NO: 257208 - DNA, 25 bp, Homo sapien
cctgcgttgctaggtttccaagtta

SEQ ID NO: 257209 - DNA, 25 bp, Homo sapien
gtttccaagttaatcagaggtgcca

SEQ ID NO: 257210 - DNA, 25 bp, Homo sapien
agaggtgccagagtcagcaagagca

SEQ ID NO: 257211 - DNA, 25 bp, Homo sapien
agagcaggaggcctgttctctgtat

SEQ ID NO: 257212 - DNA, 25 bp, Homo sapien
tgttctctgtatcccatggatccgc

SEQ ID NO: 257213 - DNA, 25 bp, Homo sapien
caccaaatactattccatgccatgg

SEQ ID NO: 257214 - DNA, 25 bp, Homo sapien
ccatgccatggaagtgctatgcaat

SEQ ID NO: 257215 - DNA, 25 bp, Homo sapien
aataactctcccaggtagcacctta

SEQ ID NO: 257216 - DNA, 25 bp, Homo sapien
ggtagcaccttataccgcttaaaag

SEQ ID NO: 257217 - DNA, 25 bp, Homo sapien
agcctttaaaatctccaatctgaag

SEQ ID NO: 257218 - DNA, 25 bp, Homo sapien
ctccaatctgaaggtgtcacagtaa

SEQ ID NO: 257219 - DNA, 25 bp, Homo sapien
gaagtcatctatgtccatggaacgg

SEQ ID NO: 257220 - DNA, 25 bp, Homo sapien
tatgtccatggaacgggcccgtttg

SEQ ID NO: 257221 - DNA, 25 bp, Homo sapien
ggcccgtttgtcactaaaacctgtg

SEQ ID NO: 257222 - DNA, 25 bp, Homo sapien
acctgtgctggttaggatttgctgt

SEQ ID NO: 257223 - DNA, 25 bp, Homo sapien
tgctatgctgaaatcttctggtatt

SEQ ID NO: 257224 - DNA, 25 bp, Homo sapien
gtactacccacatttcaggtatcca

SEQ ID NO: 257225 - DNA, 25 bp, Homo sapien
gtcttggaaccaattctgcatggat

SEQ ID NO: 257226 - DNA, 25 bp, Homo sapien
aaccaattctgcatggataagcggg

SEQ ID NO: 257227 - DNA, 25 bp, Homo sapien
gggactaccatactggcaacaaaaa

SEQ ID NO: 257228 - DNA, 25 bp, Homo sapien
aaaatcacgaagtcctcggcttcta

SEQ ID NO: 257229 - DNA, 25 bp, Homo sapien
aagtcctcggcttctaaatccaatt

SEQ ID NO: 257230 - DNA, 25 bp, Homo sapien
tcggcttctaaatccaatttcccca

SEQ ID NO: 257231 - DNA, 25 bp, Homo sapien
atccaatttccccattagcttactg

SEQ ID NO: 257232 - DNA, 25 bp, Homo sapien
ttggacaagtcactcattctccctg

SEQ ID NO: 257233 - DNA, 25 bp, Homo sapien
gttgttaatctctgactatggctaa

SEQ ID NO: 257234 - DNA, 25 bp, Homo sapien
gactatggctaatttatgagttaaa

SEQ ID NO: 257235 - DNA, 25 bp, Homo sapien
aaacctgctttggtgtgatgcacac

SEQ ID NO: 257236 - DNA, 25 bp, Homo sapien
tcattacaactctggtataaataaa

SEQ ID NO: 257237 - DNA, 25 bp, Homo sapien
acgaatgatctcttctagacctcta

SEQ ID NO: 257238 - DNA, 25 bp, Homo sapien
gaatgatctcttctagacctctagt

SEQ ID NO: 257239 - DNA, 25 bp, Homo sapien
tgatctcttctagacctctagtcta

SEQ ID NO: 257240 - DNA, 25 bp, Homo sapien
agacctctagtctagcttttgggta

SEQ ID NO: 257241 - DNA, 25 bp, Homo sapien
cctctagtctagcttttgggtatta

SEQ ID NO: 257242 - DNA, 25 bp, Homo sapien
agtctagcttttgggtattattaat

SEQ ID NO: 257243 - DNA, 25 bp, Homo sapien
taattatactttgagccatctgatt

SEQ ID NO: 257244 - DNA, 25 bp, Homo sapien
gtggaagtaagatacaaacctgctt

SEQ ID NO: 257245 - DNA, 25 bp, Homo sapien
aagatacaaacctgctttggtgtga

SEQ ID NO: 257246 - DNA, 25 bp, Homo sapien
tcttgcagttgccatggtttatcaa

SEQ ID NO: 257247 - DNA, 25 bp, Homo sapien
atggtttatcaacaaattttcttca

SEQ ID NO: 257248 - DNA, 25 bp, Homo sapien
ttttcttcaccctaaaaactcatag

SEQ ID NO: 257249 - DNA, 25 bp, Homo sapien
atagtcttaaacttctgtgccagtg

SEQ ID NO: 257250 - DNA, 25 bp, Homo sapien
ttctgtgccagtgaaagccggcaca

SEQ ID NO: 257251 - DNA, 25 bp, Homo sapien
agccggcacagtatttcaattcttt

SEQ ID NO: 257252 - DNA, 25 bp, Homo sapien
aagacgttgacagcttgcctcgaga

SEQ ID NO: 257253 - DNA, 25 bp, Homo sapien
agcttgcctcgagagcctttgacgt

SEQ ID NO: 257254 - DNA, 25 bp, Homo sapien
gaatgattcatgtcaacacttaaga

SEQ ID NO: 257255 - DNA, 25 bp, Homo sapien
caaagttcatgaaaagtcccagcat

SEQ ID NO: 257256 - DNA, 25 bp, Homo sapien
gtcccagcatttttccaattcttgc

SEQ ID NO: 257257 - DNA, 25 bp, Homo sapien
agtatttttgaagatcctcgtgtac

SEQ ID NO: 257258 - DNA, 25 bp, Homo sapien
ggaaaacattcttcaggcatctggt

SEQ ID NO: 257259 - DNA, 25 bp, Homo sapien
ttcaggcatctggtaacttttatat

SEQ ID NO: 257260 - DNA, 25 bp, Homo sapien
gagacctttacgaattccactcaag

SEQ ID NO: 257261 - DNA, 25 bp, Homo sapien
tacgaattccactcaagtgccctaa

SEQ ID NO: 257262 - DNA, 25 bp, Homo sapien
agtgccctaattgcagaagtattac

SEQ ID NO: 257263 - DNA, 25 bp, Homo sapien
gaagtattactgaaattgctccaac

SEQ ID NO: 257264 - DNA, 25 bp, Homo sapien
attgctccaactggcattgaatctt

SEQ ID NO: 257265 - DNA, 25 bp, Homo sapien
ctggcattgaatctttacctgttaa

SEQ ID NO: 257266 - DNA, 25 bp, Homo sapien
cctgttaattttgcactaagggcta

SEQ ID NO: 257267 - DNA, 25 bp, Homo sapien
aagaccatccagatattgtcacctg

SEQ ID NO: 257268 - DNA, 25 bp, Homo sapien
aaaataattacagtttctctccttg

SEQ ID NO: 257269 - DNA, 25 bp, Homo sapien
aaataattacagtttctctccttga

SEQ ID NO: 257270 - DNA, 25 bp, Homo sapien
aataattacagtttctctccttgaa

SEQ ID NO: 257271 - DNA, 25 bp, Homo sapien
ttctctccttgaatgcaatgcttcc

SEQ ID NO: 257272 - DNA, 25 bp, Homo sapien
tctctccttgaatgcaatgcttcct

SEQ ID NO: 257273 - DNA, 25 bp, Homo sapien
ctctccttgaatgcaatgcttcctg

SEQ ID NO: 257274 - DNA, 25 bp, Homo sapien
tctccttgaatgcaatgcttcctgt

SEQ ID NO: 257275 - DNA, 25 bp, Homo sapien
ctccttgaatgcaatgcttcctgta

SEQ ID NO: 257276 - DNA, 25 bp, Homo sapien
tccttgaatgcaatgcttcctgtat

SEQ ID NO: 257277 - DNA, 25 bp, Homo sapien
ctaagtaaaaaacctgaacattctg

SEQ ID NO: 257278 - DNA, 25 bp, Homo sapien
agtaaaaaacctgaacattctgcac

SEQ ID NO: 257279 - DNA, 25 bp, Homo sapien
aatactactaaagtcatgccgtgtg

SEQ ID NO: 257280 - DNA, 25 bp, Homo sapien
aaagtcatgccgtgtgacttctgaa

SEQ ID NO: 257281 - DNA, 25 bp, Homo sapien
gtgacttctgaagctagctcctaag

SEQ ID NO: 257282 - DNA, 25 bp, Homo sapien
ctgaagctagctcctaagaagtcct

SEQ ID NO: 257283 - DNA, 25 bp, Homo sapien
aagaagtccttgcagcttctgcctg

SEQ ID NO: 257284 - DNA, 25 bp, Homo sapien
ttctgcctgcgactcttagaacact

SEQ ID NO: 257285 - DNA, 25 bp, Homo sapien
agaacacttgctttgaaggatgcca

SEQ ID NO: 257286 - DNA, 25 bp, Homo sapien
gctgtcttaaaagtctgagcactct

SEQ ID NO: 257287 - DNA, 25 bp, Homo sapien
aaagtctgagcactctgaaaccatc

SEQ ID NO: 257288 - DNA, 25 bp, Homo sapien
aaacgaaatctttgttctggatgca

SEQ ID NO: 257289 - DNA, 25 bp, Homo sapien
gatgcagttataatttggaaagcga

SEQ ID NO: 257290 - DNA, 25 bp, Homo sapien
gacccctcggctatgttatttgtat

SEQ ID NO: 257291 - DNA, 25 bp, Homo sapien
atattcggagtcctctgagacggga

SEQ ID NO: 257292 - DNA, 25 bp, Homo sapien
gtgaggacacgcagaggctcgaata

SEQ ID NO: 257293 - DNA, 25 bp, Homo sapien
ctgagacgggacaaggacactggac

SEQ ID NO: 257294 - DNA, 25 bp, Homo sapien
gacactggacggtctattgtgccat

SEQ ID NO: 257295 - DNA, 25 bp, Homo sapien
acggtctattgtgccatgcttatat

SEQ ID NO: 257296 - DNA, 25 bp, Homo sapien
agaggctcgaatatgctctcaaccc

SEQ ID NO: 257297 - DNA, 25 bp, Homo sapien
gatcacttaactttatgtatcacgt

SEQ ID NO: 257298 - DNA, 25 bp, Homo sapien
gaatatgctctcaaccctatcagtt

SEQ ID NO: 257299 - DNA, 25 bp, Homo sapien
agttgcctgctttaattcatcccat

SEQ ID NO: 257300 - DNA, 25 bp, Homo sapien
catcccatggaattgttttgtcttt

SEQ ID NO: 257301 - DNA, 25 bp, Homo sapien
tagttcgaccctcacagcctcgtaa

SEQ ID NO: 257302 - DNA, 25 bp, Homo sapien
gaccctcacagcctcgtaaaaggcg

SEQ ID NO: 257303 - DNA, 25 bp, Homo sapien
ctcacagcctcgtaaaaggcggtgt

SEQ ID NO: 257304 - DNA, 25 bp, Homo sapien
taaaaggcggtgtgacagttttgtc

SEQ ID NO: 257305 - DNA, 25 bp, Homo sapien
gacagttttgtcacgggcagaagga

SEQ ID NO: 257306 - DNA, 25 bp, Homo sapien
gcagaaggaagaaacgacgtcgtag

SEQ ID NO: 257307 - DNA, 25 bp, Homo sapien
aaacgacgtcgtagccagtagggag

SEQ ID NO: 257308 - DNA, 25 bp, Homo sapien
tagccagtagggagcagcgggacca

SEQ ID NO: 257309 - DNA, 25 bp, Homo sapien
ccccacttgccagtccctaaaggtg

SEQ ID NO: 257310 - DNA, 25 bp, Homo sapien
ggtgggtgccccagagtagattcca

SEQ ID NO: 257311 - DNA, 25 bp, Homo sapien
tgggtgccccagagtagattccacc

SEQ ID NO: 257312 - DNA, 25 bp, Homo sapien
gaaagaacacctgacgaataggata

SEQ ID NO: 257313 - DNA, 25 bp, Homo sapien
gaacacctgacgaataggatacagt

SEQ ID NO: 257314 - DNA, 25 bp, Homo sapien
taggatacagtgaattcctcttcaa

SEQ ID NO: 257315 - DNA, 25 bp, Homo sapien
tacagtgaattcctcttcaaagatt

SEQ ID NO: 257316 - DNA, 25 bp, Homo sapien
gaattcctcttcaaagattttagcc

SEQ ID NO: 257317 - DNA, 25 bp, Homo sapien
gattttagcctgtaaacatccttta

SEQ ID NO: 257318 - DNA, 25 bp, Homo sapien
tagcctgtaaacatcctttaaaatt

SEQ ID NO: 257319 - DNA, 25 bp, Homo sapien
agtacaatgagttctgagttcctca

SEQ ID NO: 257320 - DNA, 25 bp, Homo sapien
caatgagttctgagttcctcatcaa

SEQ ID NO: 257321 - DNA, 25 bp, Homo sapien
tgagttctgagttcctcatcaaaga

SEQ ID NO: 257322 - DNA, 25 bp, Homo sapien
agttctgagttcctcatcaaagaac

SEQ ID NO: 257323 - DNA, 25 bp, Homo sapien
taatgtgctcagtacaagttttggc

SEQ ID NO: 257324 - DNA, 25 bp, Homo sapien
agttttggcatattacaagcattca

SEQ ID NO: 257325 - DNA, 25 bp, Homo sapien
caagcattcaataaaccctacatct

SEQ ID NO: 257326 - DNA, 25 bp, Homo sapien
aaaccctacatcttattatcattaa

SEQ ID NO: 257327 - DNA, 25 bp, Homo sapien
tacgatcaggccacttgattccagt

SEQ ID NO: 257328 - DNA, 25 bp, Homo sapien
gattccagtcttggcaacagggtaa

SEQ ID NO: 257329 - DNA, 25 bp, Homo sapien
gaaaaagcctgactgaggtccaaat

SEQ ID NO: 257330 - DNA, 25 bp, Homo sapien
gactgaggtccaaatgcatgcggaa

SEQ ID NO: 257331 - DNA, 25 bp, Homo sapien
aatgcatgcggaagactgtttcagc

SEQ ID NO: 257332 - DNA, 25 bp, Homo sapien
gcaaaggtaacatccctctatgcca

SEQ ID NO: 257333 - DNA, 25 bp, Homo sapien
ccctctatgccacagcttgattgaa

SEQ ID NO: 257334 - DNA, 25 bp, Homo sapien
ataaagttggacatagaatctctaa

SEQ ID NO: 257335 - DNA, 25 bp, Homo sapien
ggacatagaatctctaaggactgac

SEQ ID NO: 257336 - DNA, 25 bp, Homo sapien
ggactgactcctttaactgtttttg

SEQ ID NO: 257337 - DNA, 25 bp, Homo sapien
actgtttttgagtgactacattacc

SEQ ID NO: 257338 - DNA, 25 bp, Homo sapien
ttgagtgactacattaccagataat

SEQ ID NO: 257339 - DNA, 25 bp, Homo sapien
accagataatgaatgagtccccaga

SEQ ID NO: 257340 - DNA, 25 bp, Homo sapien
gaatgagtccccagaaatattatga

SEQ ID NO: 257341 - DNA, 25 bp, Homo sapien
gtccccagaaatattatgactttca

SEQ ID NO: 257342 - DNA, 25 bp, Homo sapien
acttagtgtctgtgataaataattt

SEQ ID NO: 257343 - DNA, 25 bp, Homo sapien
tgtggttttctcagttgagatattt

SEQ ID NO: 257344 - DNA, 25 bp, Homo sapien
accattatgaatgccttaaaacttt

SEQ ID NO: 257345 - DNA, 25 bp, Homo sapien
gtgattaaacattctagaccaggct

SEQ ID NO: 257346 - DNA, 25 bp, Homo sapien
ccaggcttgttgatatgtatgccaa

SEQ ID NO: 257347 - DNA, 25 bp, Homo sapien
aaatgtcttttctattgtggtctga

SEQ ID NO: 257348 - DNA, 25 bp, Homo sapien
tattgtggtctgatatccgtttctg

SEQ ID NO: 257349 - DNA, 25 bp, Homo sapien
ggtctgatatccgtttctgtaataa

SEQ ID NO: 257350 - DNA, 25 bp, Homo sapien
aagatcagtttgttgtcctctgtgc

SEQ ID NO: 257351 - DNA, 25 bp, Homo sapien
agtttgttgtcctctgtgcaccagt

SEQ ID NO: 257352 - DNA, 25 bp, Homo sapien
ctgtgcaccagtggttttgccctta

SEQ ID NO: 257353 - DNA, 25 bp, Homo sapien
ggctagcatcaccaagatctgtcat

SEQ ID NO: 257354 - DNA, 25 bp, Homo sapien
accaagatctgtcatccagagctgc

SEQ ID NO: 257355 - DNA, 25 bp, Homo sapien
ggcaggcaggaaaccaatatttagt

SEQ ID NO: 257356 - DNA, 25 bp, Homo sapien
gggccgaatgcgatcaaacctaatc

SEQ ID NO: 257357 - DNA, 25 bp, Homo sapien
aacctaatccgcgagacttgctaag

SEQ ID NO: 257358 - DNA, 25 bp, Homo sapien
gacttgctaaggttctgtgctacaa

SEQ ID NO: 257359 - DNA, 25 bp, Homo sapien
gaattggtgcataaggctgcctcct

SEQ ID NO: 257360 - DNA, 25 bp, Homo sapien
ggctgcctcctgttatatggacaga

SEQ ID NO: 257361 - DNA, 25 bp, Homo sapien
tgaatgcaacaaccagcttccagtt

SEQ ID NO: 257362 - DNA, 25 bp, Homo sapien
gcttccagtttactacacctacaag

SEQ ID NO: 257363 - DNA, 25 bp, Homo sapien
gactgtggttaatgctgcttctgaa

SEQ ID NO: 257364 - DNA, 25 bp, Homo sapien
aattttctgctgttacactgtgact

SEQ ID NO: 257365 - DNA, 25 bp, Homo sapien
aattcgggaaattggtctctactgc

SEQ ID NO: 257366 - DNA, 25 bp, Homo sapien
cgagctatccgggaaagggccgaat

SEQ ID NO: 257367 - DNA, 25 bp, Homo sapien
agcgccggcagctcgtgttcgcagt

SEQ ID NO: 257368 - DNA, 25 bp, Homo sapien
agctcgtgttcgcagtcaccctgaa

SEQ ID NO: 257369 - DNA, 25 bp, Homo sapien
gtgtctccattctcctaagctcagg

SEQ ID NO: 257370 - DNA, 25 bp, Homo sapien
attctcctaagctcaggtcgtcaaa

SEQ ID NO: 257371 - DNA, 25 bp, Homo sapien
taagctcaggtcgtcaaaggcaaac

SEQ ID NO: 257372 - DNA, 25 bp, Homo sapien
gtcaaaggcaaacggagaagcccct

SEQ ID NO: 257373 - DNA, 25 bp, Homo sapien
ctaaagatttggacccagaccgtgc

SEQ ID NO: 257374 - DNA, 25 bp, Homo sapien
gagaagcccctttaggtcggagagt

SEQ ID NO: 257375 - DNA, 25 bp, Homo sapien
ccctttaggtcggagagtggtcagt

SEQ ID NO: 257376 - DNA, 25 bp, Homo sapien
gagtggtcagtattgcccacccaga

SEQ ID NO: 257377 - DNA, 25 bp, Homo sapien
aagagaacctcttcccaccaaagcg

SEQ ID NO: 257378 - DNA, 25 bp, Homo sapien
cactctcagcatgtgagtgtactct

SEQ ID NO: 257379 - DNA, 25 bp, Homo sapien
gagtgtactctatcagttccagcaa

SEQ ID NO: 257380 - DNA, 25 bp, Homo sapien
atcagttccagcaagtttttcctca

SEQ ID NO: 257381 - DNA, 25 bp, Homo sapien
cagcaagtttttcctcagtttctcc

SEQ ID NO: 257382 - DNA, 25 bp, Homo sapien
cagtttctccttgttcttagtgact

SEQ ID NO: 257383 - DNA, 25 bp, Homo sapien
ttagtgacttctctcagttcaacct

SEQ ID NO: 257384 - DNA, 25 bp, Homo sapien
agttcaacctcgagcttctgcaact

SEQ ID NO: 257385 - DNA, 25 bp, Homo sapien
tgcaactgctcctgcatttctagaa

SEQ ID NO: 257386 - DNA, 25 bp, Homo sapien
gctcctgcatttctagaacctgttt

SEQ ID NO: 257387 - DNA, 25 bp, Homo sapien
agctctattaatttcctgtaccaaa

SEQ ID NO: 257388 - DNA, 25 bp, Homo sapien
aatacaccaatattcgctctagctc

SEQ ID NO: 257389 - DNA, 25 bp, Homo sapien
agaggctgttaggtggtccgtggct

SEQ ID NO: 257390 - DNA, 25 bp, Homo sapien
tccgtggctcggcagctcctggctt

SEQ ID NO: 257391 - DNA, 25 bp, Homo sapien
tggcttcccaacaggcatctgtccg

SEQ ID NO: 257392 - DNA, 25 bp, Homo sapien
aacaggcatctgtccggtgcccggg

SEQ ID NO: 257393 - DNA, 25 bp, Homo sapien
gtgtgtgccttgctgcgtttctgtc

SEQ ID NO: 257394 - DNA, 25 bp, Homo sapien
tctgtctgtcctcccggacaaaggc

SEQ ID NO: 257395 - DNA, 25 bp, Homo sapien
gggctgtcttgacacattcctcaag

SEQ ID NO: 257396 - DNA, 25 bp, Homo sapien
gaaaaacttggtgtctgaagtgaaa

SEQ ID NO: 257397 - DNA, 25 bp, Homo sapien
tgtctgaagtgaaatcggacacccc

SEQ ID NO: 257398 - DNA, 25 bp, Homo sapien
gttaatgccaacactctctatgtca

SEQ ID NO: 257399 - DNA, 25 bp, Homo sapien
ctctatgtcacgttccgggcggaga

SEQ ID NO: 257400 - DNA, 25 bp, Homo sapien
ctacgttaaagaccagaggtggcta

SEQ ID NO: 257401 - DNA, 25 bp, Homo sapien
gaggtggctacagtgggtttcaaac

SEQ ID NO: 257402 - DNA, 25 bp, Homo sapien
ggaattttaagctgctcctcagacg

SEQ ID NO: 257403 - DNA, 25 bp, Homo sapien
gctcctcagacgtttaatgaccttt

SEQ ID NO: 257404 - DNA, 25 bp, Homo sapien
aaaccagaaccttgctctatcaggg

SEQ ID NO: 257405 - DNA, 25 bp, Homo sapien
aactggatgttcctcatgcattcct

SEQ ID NO: 257406 - DNA, 25 bp, Homo sapien
atgcattcctgatgagctgagctct

SEQ ID NO: 257407 - DNA, 25 bp, Homo sapien
agctgagctctccttcaatatttag

SEQ ID NO: 257408 - DNA, 25 bp, Homo sapien
ctccttcaatatttagccagtgggt

SEQ ID NO: 257409 - DNA, 25 bp, Homo sapien
ggcacaccgctcctgaatggaaatg

SEQ ID NO: 257410 - DNA, 25 bp, Homo sapien
ggaaatggagtctgcctacgttaaa

SEQ ID NO: 257411 - DNA, 25 bp, Homo sapien
acatgtcattataaggcttcttcat

SEQ ID NO: 257412 - DNA, 25 bp, Homo sapien
ataaggcttcttcatcagccctaac

SEQ ID NO: 257413 - DNA, 25 bp, Homo sapien
actcctgcctcactgaatgtgccaa

SEQ ID NO: 257414 - DNA, 25 bp, Homo sapien
aatgtgccaacggattgctcagctc

SEQ ID NO: 257415 - DNA, 25 bp, Homo sapien
gattgctcagctccaaccaaggaaa

SEQ ID NO: 257416 - DNA, 25 bp, Homo sapien
gttggatactttataccctctacat

SEQ ID NO: 257417 - DNA, 25 bp, Homo sapien
taccctctacattgtccattagcaa

SEQ ID NO: 257418 - DNA, 25 bp, Homo sapien
tgtccattagcaacacaacctagag

SEQ ID NO: 257419 - DNA, 25 bp, Homo sapien
tagcaacacaacctagagctaggat

SEQ ID NO: 257420 - DNA, 25 bp, Homo sapien
ttgcctgatttatgctatgcatgct

SEQ ID NO: 257421 - DNA, 25 bp, Homo sapien
ttatgctatgcatgctattttccat

SEQ ID NO: 257422 - DNA, 25 bp, Homo sapien
accatgagtgagttaggaggccgaa

SEQ ID NO: 257423 - DNA, 25 bp, Homo sapien
ggcttcgtgaccgaaaggccctgaa

SEQ ID NO: 257424 - DNA, 25 bp, Homo sapien
agttaggaggccgaactgcccacct

SEQ ID NO: 257425 - DNA, 25 bp, Homo sapien
gaactgcccacctctacaatgggtt

SEQ ID NO: 257426 - DNA, 25 bp, Homo sapien
aatgggttcccaggagagcgaacac

SEQ ID NO: 257427 - DNA, 25 bp, Homo sapien
aggagagcgaacacgggacccgctc

SEQ ID NO: 257428 - DNA, 25 bp, Homo sapien
aatgagttcaacagcaaggtacggt

SEQ ID NO: 257429 - DNA, 25 bp, Homo sapien
tacggtgagagctggcggcttcatt

SEQ ID NO: 257430 - DNA, 25 bp, Homo sapien
tttctccagctcagacactttctgg

SEQ ID NO: 257431 - DNA, 25 bp, Homo sapien
ggctcagtcttgctgcggcccttgt

SEQ ID NO: 257432 - DNA, 25 bp, Homo sapien
tgctgcggcccttgtggcatttggc

SEQ ID NO: 257433 - DNA, 25 bp, Homo sapien
accagatacgtttattctaagatat

SEQ ID NO: 257434 - DNA, 25 bp, Homo sapien
agatatgatttatgctgaaagcctg

SEQ ID NO: 257435 - DNA, 25 bp, Homo sapien
gaaagcctgcttttgttctagaggg

SEQ ID NO: 257436 - DNA, 25 bp, Homo sapien
gcttttgttctagagggatcatgga

SEQ ID NO: 257437 - DNA, 25 bp, Homo sapien
tttgtatatctgaggccttgggttt

SEQ ID NO: 257438 - DNA, 25 bp, Homo sapien
aggccttgggtttatggtgaatgac

SEQ ID NO: 257439 - DNA, 25 bp, Homo sapien
ggtgaatgactgactttatatgcct

SEQ ID NO: 257440 - DNA, 25 bp, Homo sapien
gactgactttatatgcctgaggccc

SEQ ID NO: 257441 - DNA, 25 bp, Homo sapien
ggccctgagtcatgctgtatttatc

SEQ ID NO: 257442 - DNA, 25 bp, Homo sapien
gctgtatttatctgaaccatgtggt

SEQ ID NO: 257443 - DNA, 25 bp, Homo sapien
gaaccatgtggtatcaatttaacca

SEQ ID NO: 257444 - DNA, 25 bp, Homo sapien
gttgactgtactgtaatgttgtatc

SEQ ID NO: 257445 - DNA, 25 bp, Homo sapien
gactgtactgtaatgttgtatcaac

SEQ ID NO: 257446 - DNA, 25 bp, Homo sapien
tgttgtatcaactgaattgaatgtt

SEQ ID NO: 257447 - DNA, 25 bp, Homo sapien
gttgtaatagttaaagaggcttaga

SEQ ID NO: 257448 - DNA, 25 bp, Homo sapien
gaggcttagaacaagctaacaggca

SEQ ID NO: 257449 - DNA, 25 bp, Homo sapien
tagaacaagctaacaggcaatagaa

SEQ ID NO: 257450 - DNA, 25 bp, Homo sapien
acatgttaattgttatcttattctt

SEQ ID NO: 257451 - DNA, 25 bp, Homo sapien
gttgtgtttaactcaccaacacgtg

SEQ ID NO: 257452 - DNA, 25 bp, Homo sapien
tgtgtttaactcaccaacacgtggt

SEQ ID NO: 257453 - DNA, 25 bp, Homo sapien
gtttaactcaccaacacgtggtgta

SEQ ID NO: 257454 - DNA, 25 bp, Homo sapien
actcaccaacacgtggtgtataatg

SEQ ID NO: 257455 - DNA, 25 bp, Homo sapien
agcttttgtaatccttttctgtgaa

SEQ ID NO: 257456 - DNA, 25 bp, Homo sapien
gtgaaatccagtactgtgtcagctt

SEQ ID NO: 257457 - DNA, 25 bp, Homo sapien
ctgtgtcagcttcgttagggtctaa

SEQ ID NO: 257458 - DNA, 25 bp, Homo sapien
tagggtctaaagtgtacctttcata

SEQ ID NO: 257459 - DNA, 25 bp, Homo sapien
attttcctgagctttaaatgagtga

SEQ ID NO: 257460 - DNA, 25 bp, Homo sapien
atgtgttttgttgaaacttcccaag

SEQ ID NO: 257461 - DNA, 25 bp, Homo sapien
gaatcttccattgtttatgggcctg

SEQ ID NO: 257462 - DNA, 25 bp, Homo sapien
ggcctgatgaaagcatttggcactt

SEQ ID NO: 257463 - DNA, 25 bp, Homo sapien
gagatgcatgtcaactcttccaaca

SEQ ID NO: 257464 - DNA, 25 bp, Homo sapien
aacctccagaatttactgagcctgt

SEQ ID NO: 257465 - DNA, 25 bp, Homo sapien
ctgagcctgtaacacagcttttgta

SEQ ID NO: 257466 - DNA, 25 bp, Homo sapien
atgctgagcaaggtcttggctggat

SEQ ID NO: 257467 - DNA, 25 bp, Homo sapien
ggtcttggctggatagagctgaaaa

SEQ ID NO: 257468 - DNA, 25 bp, Homo sapien
gtgtgctgagagaaggcaattcatc

SEQ ID NO: 257469 - DNA, 25 bp, Homo sapien
gagagaaggcaattcatcaactata

SEQ ID NO: 257470 - DNA, 25 bp, Homo sapien
ggcaattcatcaactataattttgc

SEQ ID NO: 257471 - DNA, 25 bp, Homo sapien
gcttaagataacacattacctttga

SEQ ID NO: 257472 - DNA, 25 bp, Homo sapien
cagaacaattccatacctctcaata

SEQ ID NO: 257473 - DNA, 25 bp, Homo sapien
attccatacctctcaataaatctta

SEQ ID NO: 257474 - DNA, 25 bp, Homo sapien
gtggctatcactggatatttaagat

SEQ ID NO: 257475 - DNA, 25 bp, Homo sapien
cactggatatttaagattgtctgag

SEQ ID NO: 257476 - DNA, 25 bp, Homo sapien
agattgtctgaggaagtgatgtgat

SEQ ID NO: 257477 - DNA, 25 bp, Homo sapien
gagttaatcaaagagatcccctggg

SEQ ID NO: 257478 - DNA, 25 bp, Homo sapien
aaagagatcccctgggtgggcctga

SEQ ID NO: 257479 - DNA, 25 bp, Homo sapien
aaaagagagtgaaccagtcagagac

SEQ ID NO: 257480 - DNA, 25 bp, Homo sapien
tagccttaaataagcaagctgccat

SEQ ID NO: 257481 - DNA, 25 bp, Homo sapien
aagctgccatgagctctacggctgc

SEQ ID NO: 257482 - DNA, 25 bp, Homo sapien
gccatgagctctacggctgcaagga

SEQ ID NO: 257483 - DNA, 25 bp, Homo sapien
gtgaacaaccatgtgatcttggaag

SEQ ID NO: 257484 - DNA, 25 bp, Homo sapien
atcttggaagaagcatctgaacctc

SEQ ID NO: 257485 - DNA, 25 bp, Homo sapien
aacgccttgcttgcagctttgtgaa

SEQ ID NO: 257486 - DNA, 25 bp, Homo sapien
agaggacccagctaaatcacgtttg

SEQ ID NO: 257487 - DNA, 25 bp, Homo sapien
taaatcacgtttggactcctgaccc

SEQ ID NO: 257488 - DNA, 25 bp, Homo sapien
aggaagaccaggatgggtctccctc

SEQ ID NO: 257489 - DNA, 25 bp, Homo sapien
cccgcgtttgggactgctgaagctg

SEQ ID NO: 257490 - DNA, 25 bp, Homo sapien
tctagaaagagaaccgctgtgctat

SEQ ID NO: 257491 - DNA, 25 bp, Homo sapien
ggtttcagcaaccaaggagcacaca

SEQ ID NO: 257492 - DNA, 25 bp, Homo sapien
acacaccctgatccttgattggtga

SEQ ID NO: 257493 - DNA, 25 bp, Homo sapien
ggatacacaaaatcaggctgcttca

SEQ ID NO: 257494 - DNA, 25 bp, Homo sapien
gaaccgctgtgctatcaggagggaa

SEQ ID NO: 257495 - DNA, 25 bp, Homo sapien
gctgcttcagaggaagtcatctgct

SEQ ID NO: 257496 - DNA, 25 bp, Homo sapien
gtcatctgctcacaggaatcagggt

SEQ ID NO: 257497 - DNA, 25 bp, Homo sapien
gaggccatctctgaagggtattttt

SEQ ID NO: 257498 - DNA, 25 bp, Homo sapien
ccttgagcctcagccaggaacggga

SEQ ID NO: 257499 - DNA, 25 bp, Homo sapien
aagactaaataataagatgccacta

SEQ ID NO: 257500 - DNA, 25 bp, Homo sapien
gatgccactattgtatttgaaccgg

SEQ ID NO: 257501 - DNA, 25 bp, Homo sapien
attgtatttgaaccgggctgcttgc

SEQ ID NO: 257502 - DNA, 25 bp, Homo sapien
ggctgcttgccacctaaaactaaaa

SEQ ID NO: 257503 - DNA, 25 bp, Homo sapien
aaaaacttacacaaggctattgaag

SEQ ID NO: 257504 - DNA, 25 bp, Homo sapien
ctacaggattatgaagcggcactta

SEQ ID NO: 257505 - DNA, 25 bp, Homo sapien
gaagcggcacttaagattgatccat

SEQ ID NO: 257506 - DNA, 25 bp, Homo sapien
ggcacttaagattgatccatccaac

SEQ ID NO: 257507 - DNA, 25 bp, Homo sapien
gatgctgagaagattcggaatgtaa

SEQ ID NO: 257508 - DNA, 25 bp, Homo sapien
ggaatgtaattcaaggaacagaact

SEQ ID NO: 257509 - DNA, 25 bp, Homo sapien
aaaacaactggaggcatctttgtac

SEQ ID NO: 257510 - DNA, 25 bp, Homo sapien
atgtctccgacatcattggcccaga

SEQ ID NO: 257511 - DNA, 25 bp, Homo sapien
tctccgacatcattggcccagacgg

SEQ ID NO: 257512 - DNA, 25 bp, Homo sapien
acggcctggtctacgccgtcgagtt

SEQ ID NO: 257513 - DNA, 25 bp, Homo sapien
tggtctacgccgtcgagttctccca

SEQ ID NO: 257514 - DNA, 25 bp, Homo sapien
cgccggccgcgatctggtcaacgtg

SEQ ID NO: 257515 - DNA, 25 bp, Homo sapien
aacatcattccggtcctggaggacg

SEQ ID NO: 257516 - DNA, 25 bp, Homo sapien
aggacgcgcggcacccgctcaagta

SEQ ID NO: 257517 - DNA, 25 bp, Homo sapien
ctcatcgggatggtggacgtgatct

SEQ ID NO: 257518 - DNA, 25 bp, Homo sapien
gatggtggacgtgatcttcgccgac

SEQ ID NO: 257519 - DNA, 25 bp, Homo sapien
tggacgtgatcttcgccgacgtggc

SEQ ID NO: 257520 - DNA, 25 bp, Homo sapien
gcaatgggggccactttctcatctc

SEQ ID NO: 257521 - DNA, 25 bp, Homo sapien
gtctcataaactgaagtcatccgtg

SEQ ID NO: 257522 - DNA, 25 bp, Homo sapien
aagtcatccgtggtttgccgtgagg

SEQ ID NO: 257523 - DNA, 25 bp, Homo sapien
tttgccgtgaggtctcctgagttta

SEQ ID NO: 257524 - DNA, 25 bp, Homo sapien
gtctcctgagtttattggagccttt

SEQ ID NO: 257525 - DNA, 25 bp, Homo sapien
ggagcctttattgcgtctatgacag

SEQ ID NO: 257526 - DNA, 25 bp, Homo sapien
gagaaagtgctcacatttcacctgc

SEQ ID NO: 257527 - DNA, 25 bp, Homo sapien
gctcacatttcacctgcatgggaat

SEQ ID NO: 257528 - DNA, 25 bp, Homo sapien
ggctctgaacttaggtaaatgaatt

SEQ ID NO: 257529 - DNA, 25 bp, Homo sapien
acagcttatatgtcctgaaccggag

SEQ ID NO: 257530 - DNA, 25 bp, Homo sapien
gagaatggtagctcccttgcaatta

SEQ ID NO: 257531 - DNA, 25 bp, Homo sapien
ggtagctcccttgcaattaaagaag

SEQ ID NO: 257532 - DNA, 25 bp, Homo sapien
tccctgccttgcacaagtgcaggat

SEQ ID NO: 257533 - DNA, 25 bp, Homo sapien
tggaatcctggacagcgccaaggca

SEQ ID NO: 257534 - DNA, 25 bp, Homo sapien
aggtggatgctgtctaaggagacaa

SEQ ID NO: 257535 - DNA, 25 bp, Homo sapien
gttgctgggactctgccggctcaca

SEQ ID NO: 257536 - DNA, 25 bp, Homo sapien
ggctcacacgctattcccatgtcat

SEQ ID NO: 257537 - DNA, 25 bp, Homo sapien
acagcgccaaggcagcaactgggat

SEQ ID NO: 257538 - DNA, 25 bp, Homo sapien
gggccaagtcagtgcttccaaagga

SEQ ID NO: 257539 - DNA, 25 bp, Homo sapien
gcttccaaaggagggtgcatcctga

SEQ ID NO: 257540 - DNA, 25 bp, Homo sapien
gccctctcctggcaatgtgaggaat

SEQ ID NO: 257541 - DNA, 25 bp, Homo sapien
gtgaggaattgtcctaagcacagac

SEQ ID NO: 257542 - DNA, 25 bp, Homo sapien
ttgtcctaagcacagacaactccct

SEQ ID NO: 257543 - DNA, 25 bp, Homo sapien
tttatatccacatttacttcactga

SEQ ID NO: 257544 - DNA, 25 bp, Homo sapien
gactgaggacataatggtggcttca

SEQ ID NO: 257545 - DNA, 25 bp, Homo sapien
ggtggcttcattactaagctgagtt

SEQ ID NO: 257546 - DNA, 25 bp, Homo sapien
agtggcacgatgagacacacacaca

SEQ ID NO: 257547 - DNA, 25 bp, Homo sapien
agaagatgtacttctctactggctt

SEQ ID NO: 257548 - DNA, 25 bp, Homo sapien
ggcttttcctctatcaattgtgaca

SEQ ID NO: 257549 - DNA, 25 bp, Homo sapien
atgttattttcttcacagtgactgc

SEQ ID NO: 257550 - DNA, 25 bp, Homo sapien
gctgcacagtccttcacagtagtaa

SEQ ID NO: 257551 - DNA, 25 bp, Homo sapien
cacagtagtaaaaccagactcatgg

SEQ ID NO: 257552 - DNA, 25 bp, Homo sapien
gaaatgtaagagatactgctccaaa

SEQ ID NO: 257553 - DNA, 25 bp, Homo sapien
actgctccaaattaatgctcattag

SEQ ID NO: 257554 - DNA, 25 bp, Homo sapien
ggacagccccggacgtcaatgcaaa

SEQ ID NO: 257555 - DNA, 25 bp, Homo sapien
gccccggacgtcaatgcaaatctgt

SEQ ID NO: 257556 - DNA, 25 bp, Homo sapien
aatgcaaatctgttgtccccaggga

SEQ ID NO: 257557 - DNA, 25 bp, Homo sapien
gcaaatctgttgtccccagggagta

SEQ ID NO: 257558 - DNA, 25 bp, Homo sapien
ttgtccccagggagtagcccagagt

SEQ ID NO: 257559 - DNA, 25 bp, Homo sapien
ctaccttgcccatgcgtttccaggg

SEQ ID NO: 257560 - DNA, 25 bp, Homo sapien
gggagccaagaattattttgccgca

SEQ ID NO: 257561 - DNA, 25 bp, Homo sapien
tattttgccgcaacactgaggtgtg

SEQ ID NO: 257562 - DNA, 25 bp, Homo sapien
gccgcaacactgaggtgtggctgat

SEQ ID NO: 257563 - DNA, 25 bp, Homo sapien
taaatattttcttccaatttggtca

SEQ ID NO: 257564 - DNA, 25 bp, Homo sapien
tccaatttggtcaaccctctgcata

SEQ ID NO: 257565 - DNA, 25 bp, Homo sapien
gttttagttcaacatttgggcttct

SEQ ID NO: 257566 - DNA, 25 bp, Homo sapien
ggcttcttggcctgattttcataca

SEQ ID NO: 257567 - DNA, 25 bp, Homo sapien
catacaatctcaatttacgaagctg

SEQ ID NO: 257568 - DNA, 25 bp, Homo sapien
tatttgttctaatctcactcttcta

SEQ ID NO: 257569 - DNA, 25 bp, Homo sapien
atctcactcttctaataggaatcag

SEQ ID NO: 257570 - DNA, 25 bp, Homo sapien
gaatcaggcaaatgaaagtctacca

SEQ ID NO: 257571 - DNA, 25 bp, Homo sapien
ctaccagacttttaaaatgggctgt

SEQ ID NO: 257572 - DNA, 25 bp, Homo sapien
ttatactctctaggtgttttgtgtt

SEQ ID NO: 257573 - DNA, 25 bp, Homo sapien
ggtcaggtaaattggtctgcttgct

SEQ ID NO: 257574 - DNA, 25 bp, Homo sapien
aaattggtctgcttgctgttgaaat

SEQ ID NO: 257575 - DNA, 25 bp, Homo sapien
gctgttgaaatttgccttctagcaa

SEQ ID NO: 257576 - DNA, 25 bp, Homo sapien
gagaggacaagggtgacccgggagg

SEQ ID NO: 257577 - DNA, 25 bp, Homo sapien
taaagatgggaccggggccagacgc

SEQ ID NO: 257578 - DNA, 25 bp, Homo sapien
aaagatgggaccggggccagacgca

SEQ ID NO: 257579 - DNA, 25 bp, Homo sapien
aagatgggaccggggccagacgcag

SEQ ID NO: 257580 - DNA, 25 bp, Homo sapien
agatgggaccggggccagacgcagt

SEQ ID NO: 257581 - DNA, 25 bp, Homo sapien
gatgggaccggggccagacgcagtg

SEQ ID NO: 257582 - DNA, 25 bp, Homo sapien
atgggaccggggccagacgcagtgg

SEQ ID NO: 257583 - DNA, 25 bp, Homo sapien
tgggaccggggccagacgcagtggc

SEQ ID NO: 257584 - DNA, 25 bp, Homo sapien
gggaccggggccagacgcagtggct

SEQ ID NO: 257585 - DNA, 25 bp, Homo sapien
ggaccggggccagacgcagtggctc

SEQ ID NO: 257586 - DNA, 25 bp, Homo sapien
gaccggggccagacgcagtggctca

SEQ ID NO: 257587 - DNA, 25 bp, Homo sapien
ctcagaagcacaggtggcgcaggca

SEQ ID NO: 257588 - DNA, 25 bp, Homo sapien
ggcgcaggcagacctctactgagaa

SEQ ID NO: 257589 - DNA, 25 bp, Homo sapien
ggcagatgaaactcacattttggag

SEQ ID NO: 257590 - DNA, 25 bp, Homo sapien
cagttacgtctacccctggtcggtg

SEQ ID NO: 257591 - DNA, 25 bp, Homo sapien
tacccctggtcggtgaccagagaat

SEQ ID NO: 257592 - DNA, 25 bp, Homo sapien
gaccagagaatcctttagcagcaac

SEQ ID NO: 257593 - DNA, 25 bp, Homo sapien
aaacaagctgtatgcccaacaactt

SEQ ID NO: 257594 - DNA, 25 bp, Homo sapien
gtatgcccaacaacttggaactggt

SEQ ID NO: 257595 - DNA, 25 bp, Homo sapien
aatgatttttggttcagccgcacag

SEQ ID NO: 257596 - DNA, 25 bp, Homo sapien
ttggttcagccgcacagtggaatat

SEQ ID NO: 257597 - DNA, 25 bp, Homo sapien
cagtggaatatcatgcggccattaa

SEQ ID NO: 257598 - DNA, 25 bp, Homo sapien
gccctgtagagtgtaagctccttga

SEQ ID NO: 257599 - DNA, 25 bp, Homo sapien
ttgagggccaagaatgcttctgcct

SEQ ID NO: 257600 - DNA, 25 bp, Homo sapien
ttgcttccccagtaccttctgtata

SEQ ID NO: 257601 - DNA, 25 bp, Homo sapien
gtaccttctgtatatttcataacca

SEQ ID NO: 257602 - DNA, 25 bp, Homo sapien
cattccatttaaagggcattgactt

SEQ ID NO: 257603 - DNA, 25 bp, Homo sapien
ctgcctgagaggttagcttcctaca

SEQ ID NO: 257604 - DNA, 25 bp, Homo sapien
gatacactttgacatctcacacaca

SEQ ID NO: 257605 - DNA, 25 bp, Homo sapien
tagcttcctacatataagctccttt

SEQ ID NO: 257606 - DNA, 25 bp, Homo sapien
aagctccttttgtattggacttgta

SEQ ID NO: 257607 - DNA, 25 bp, Homo sapien
gtaattgctcattcagtgttagtat

SEQ ID NO: 257608 - DNA, 25 bp, Homo sapien
agtgttagtattgccctgtagagtg

SEQ ID NO: 257609 - DNA, 25 bp, Homo sapien
ttgtccccagtcactaagcctcgaa

SEQ ID NO: 257610 - DNA, 25 bp, Homo sapien
gtcactaagcctcgaagccagactt

SEQ ID NO: 257611 - DNA, 25 bp, Homo sapien
tcgaagccagacttacccagatgtg

SEQ ID NO: 257612 - DNA, 25 bp, Homo sapien
gaagccagacttacccagatgtggg

SEQ ID NO: 257613 - DNA, 25 bp, Homo sapien
gttatgaagactgggaccggtccac

SEQ ID NO: 257614 - DNA, 25 bp, Homo sapien
gactgggaccggtccacagccagtg

SEQ ID NO: 257615 - DNA, 25 bp, Homo sapien
ttctggtctcaagcgctggaggatt

SEQ ID NO: 257616 - DNA, 25 bp, Homo sapien
ggatttggaaacctgcggacagtca

SEQ ID NO: 257617 - DNA, 25 bp, Homo sapien
aaacctgcggacagtcaggaattct

SEQ ID NO: 257618 - DNA, 25 bp, Homo sapien
ttctgagagaactggaggcaacaat

SEQ ID NO: 257619 - DNA, 25 bp, Homo sapien
aactggaggcaacaatcatgtcggg

SEQ ID NO: 257620 - DNA, 25 bp, Homo sapien
tgctggccggactttttccattgat

SEQ ID NO: 257621 - DNA, 25 bp, Homo sapien
tggccggactttttccattgattaa

SEQ ID NO: 257622 - DNA, 25 bp, Homo sapien
agtggtttgggttcacaaagcttgt

SEQ ID NO: 257623 - DNA, 25 bp, Homo sapien
caaagcttgtggtaagtccatgact

SEQ ID NO: 257624 - DNA, 25 bp, Homo sapien
gtggtaagtccatgacttcccttag

SEQ ID NO: 257625 - DNA, 25 bp, Homo sapien
taagtccatgacttcccttagagag

SEQ ID NO: 257626 - DNA, 25 bp, Homo sapien
agtccatgacttcccttagagagaa

SEQ ID NO: 257627 - DNA, 25 bp, Homo sapien
atgacttcccttagagagaaaagag

SEQ ID NO: 257628 - DNA, 25 bp, Homo sapien
gaatagattctactgtacttgcctt

SEQ ID NO: 257629 - DNA, 25 bp, Homo sapien
agattctactgtacttgccttttcc

SEQ ID NO: 257630 - DNA, 25 bp, Homo sapien
attctactgtacttgccttttcctc

SEQ ID NO: 257631 - DNA, 25 bp, Homo sapien
atgtcccaagcactgctctaagttc

SEQ ID NO: 257632 - DNA, 25 bp, Homo sapien
aagcactgctctaagttcccaatgt

SEQ ID NO: 257633 - DNA, 25 bp, Homo sapien
gctctaagttcccaatgtgtccgga

SEQ ID NO: 257634 - DNA, 25 bp, Homo sapien
ctaagttcccaatgtgtccggaatt

SEQ ID NO: 257635 - DNA, 25 bp, Homo sapien
tcaggaccttcagcactgatcaaca

SEQ ID NO: 257636 - DNA, 25 bp, Homo sapien
agcactgatcaacaatcctgggcat

SEQ ID NO: 257637 - DNA, 25 bp, Homo sapien
atcaacaatcctgggcatgggctga

SEQ ID NO: 257638 - DNA, 25 bp, Homo sapien
aatcctgggcatgggctgaccgaca

SEQ ID NO: 257639 - DNA, 25 bp, Homo sapien
ggcatgggctgaccgacagttttca

SEQ ID NO: 257640 - DNA, 25 bp, Homo sapien
gggctgaccgacagttttcacccag

SEQ ID NO: 257641 - DNA, 25 bp, Homo sapien
tgataaccatgtcccaagcactgct

SEQ ID NO: 257642 - DNA, 25 bp, Homo sapien
ttgcctcttccttgggagcatgctt

SEQ ID NO: 257643 - DNA, 25 bp, Homo sapien
gggagcatgctttctattcctatgt

SEQ ID NO: 257644 - DNA, 25 bp, Homo sapien
gatgtgggttcatatcttggcacca

SEQ ID NO: 257645 - DNA, 25 bp, Homo sapien
gcaccactcctgatagctgtgtgat

SEQ ID NO: 257646 - DNA, 25 bp, Homo sapien
tgtgatcatggcaaacctcgttttc

SEQ ID NO: 257647 - DNA, 25 bp, Homo sapien
tcgttttcatcgtctgtcaggtgga

SEQ ID NO: 257648 - DNA, 25 bp, Homo sapien
ggtgcatgtaaagtgctcagcatct

SEQ ID NO: 257649 - DNA, 25 bp, Homo sapien
tcagcatctgtgcttagcaggccat

SEQ ID NO: 257650 - DNA, 25 bp, Homo sapien
tgcctcctttttcttgagtaagcct

SEQ ID NO: 257651 - DNA, 25 bp, Homo sapien
tgagtaagcctttagaactttctga

SEQ ID NO: 257652 - DNA, 25 bp, Homo sapien
gaactttctgactcctctagagaag

SEQ ID NO: 257653 - DNA, 25 bp, Homo sapien
cgccgggtcggttcctggctggtgt

SEQ ID NO: 257654 - DNA, 25 bp, Homo sapien
ccccgccaaaccacagtgggagctg

SEQ ID NO: 257655 - DNA, 25 bp, Homo sapien
gggtgctcgcctacagtctgcatct

SEQ ID NO: 257656 - DNA, 25 bp, Homo sapien
tgctcgcctacagtctgcatctgta

SEQ ID NO: 257657 - DNA, 25 bp, Homo sapien
tcgcctacagtctgcatctgtagtg

SEQ ID NO: 257658 - DNA, 25 bp, Homo sapien
agtctgcatctgtagtgccttgtgg

SEQ ID NO: 257659 - DNA, 25 bp, Homo sapien
gtctgcatctgtagtgccttgtggg

SEQ ID NO: 257660 - DNA, 25 bp, Homo sapien
gtgccttgtggggtatccaggaaca

SEQ ID NO: 257661 - DNA, 25 bp, Homo sapien
gtatccaggaacaccctcccagcag

SEQ ID NO: 257662 - DNA, 25 bp, Homo sapien
ggatgggaaccctgtcccatgaagc

SEQ ID NO: 257663 - DNA, 25 bp, Homo sapien
catgaagccctctcctcagctttac

SEQ ID NO: 257664 - DNA, 25 bp, Homo sapien
gctatgtaacctctatgctctgtaa

SEQ ID NO: 257665 - DNA, 25 bp, Homo sapien
ctctatgctctgtaaggtgattatt

SEQ ID NO: 257666 - DNA, 25 bp, Homo sapien
tttgtatatagcaacatggcccagt

SEQ ID NO: 257667 - DNA, 25 bp, Homo sapien
catggcccagtgatattatatagtt

SEQ ID NO: 257668 - DNA, 25 bp, Homo sapien
tatagtttcccaatggagaggttat

SEQ ID NO: 257669 - DNA, 25 bp, Homo sapien
gttattgagtaacctttgcattagt

SEQ ID NO: 257670 - DNA, 25 bp, Homo sapien
gtttaaacactaccagaagaatgct

SEQ ID NO: 257671 - DNA, 25 bp, Homo sapien
gaatgctgagccaactataaacact

SEQ ID NO: 257672 - DNA, 25 bp, Homo sapien
gtacttattactgcttttgatactg

SEQ ID NO: 257673 - DNA, 25 bp, Homo sapien
gtattacgtgccaatagtttcccaa

SEQ ID NO: 257674 - DNA, 25 bp, Homo sapien
aatagtttcccaatcacatagcagg

SEQ ID NO: 257675 - DNA, 25 bp, Homo sapien
gcacagtctcctgtcaggctcggag

SEQ ID NO: 257676 - DNA, 25 bp, Homo sapien
acagtctcctgtcaggctcggagag

SEQ ID NO: 257677 - DNA, 25 bp, Homo sapien
aaaggaatcctatatctagtcctat

SEQ ID NO: 257678 - DNA, 25 bp, Homo sapien
gaagtggcttggtgggtgcagcccc

SEQ ID NO: 257679 - DNA, 25 bp, Homo sapien
cggttccgttgacgctggcaccttc

SEQ ID NO: 257680 - DNA, 25 bp, Homo sapien
ttaagccacatgctatgatgaataa

SEQ ID NO: 257681 - DNA, 25 bp, Homo sapien
gccacatgctatgatgaataaactg

SEQ ID NO: 257682 - DNA, 25 bp, Homo sapien
catgctatgatgaataaactgattt

SEQ ID NO: 257683 - DNA, 25 bp, Homo sapien
tttctaccattactgaacattagga

SEQ ID NO: 257684 - DNA, 25 bp, Homo sapien
taccattactgaacattaggacaaa

SEQ ID NO: 257685 - DNA, 25 bp, Homo sapien
ttactgaacattaggacaaacacaa

SEQ ID NO: 257686 - DNA, 25 bp, Homo sapien
ttttttattaattcgcgcttggcca

SEQ ID NO: 257687 - DNA, 25 bp, Homo sapien
ctttgggccttagggcgcctagaag

SEQ ID NO: 257688 - DNA, 25 bp, Homo sapien
cgcgcttggccacctcatctgtaaa

SEQ ID NO: 257689 - DNA, 25 bp, Homo sapien
gcaagatctggaaaagtgcttcgta

SEQ ID NO: 257690 - DNA, 25 bp, Homo sapien
aaaagtgcttcgtagactccttgac

SEQ ID NO: 257691 - DNA, 25 bp, Homo sapien
gtagactccttgacggagtttgcct

SEQ ID NO: 257692 - DNA, 25 bp, Homo sapien
gagtttgcctcctttgtacgctgcg

SEQ ID NO: 257693 - DNA, 25 bp, Homo sapien
ttgtacgctgcgtgaacatgcctca

SEQ ID NO: 257694 - DNA, 25 bp, Homo sapien
gcgtgaacatgcctcacctttaaga

SEQ ID NO: 257695 - DNA, 25 bp, Homo sapien
atgcctcacctttaagagagtctta

SEQ ID NO: 257696 - DNA, 25 bp, Homo sapien
aagacacgaaaacacttcctccagg

SEQ ID NO: 257697 - DNA, 25 bp, Homo sapien
aaacatcatgccgagtgatgaaaag

SEQ ID NO: 257698 - DNA, 25 bp, Homo sapien
caagaggaccttttagagtaatagt

SEQ ID NO: 257699 - DNA, 25 bp, Homo sapien
gagtaatagtcatcaaacttgaaat

SEQ ID NO: 257700 - DNA, 25 bp, Homo sapien
gatgcattgtaccataggcaactca

SEQ ID NO: 257701 - DNA, 25 bp, Homo sapien
ataggcaactcacaccttaacttgg

SEQ ID NO: 257702 - DNA, 25 bp, Homo sapien
gcaactcacaccttaacttggttgt

SEQ ID NO: 257703 - DNA, 25 bp, Homo sapien
ggaataagaaaaccactccaaatct

SEQ ID NO: 257704 - DNA, 25 bp, Homo sapien
tgtgtggcgccatcaaggtgaattt

SEQ ID NO: 257705 - DNA, 25 bp, Homo sapien
ggcgccatcaaggtgaatttctaga

SEQ ID NO: 257706 - DNA, 25 bp, Homo sapien
caaggtgaatttctagaacaggtaa

SEQ ID NO: 257707 - DNA, 25 bp, Homo sapien
aaaactaacctgtatagtgacagaa

SEQ ID NO: 257708 - DNA, 25 bp, Homo sapien
aaagtaaaggatggtctggcactat

SEQ ID NO: 257709 - DNA, 25 bp, Homo sapien
aagtaaaggatggtctggcactatt

SEQ ID NO: 257710 - DNA, 25 bp, Homo sapien
agtaaaggatggtctggcactattt

SEQ ID NO: 257711 - DNA, 25 bp, Homo sapien
gtaaaggatggtctggcactatttt

SEQ ID NO: 257712 - DNA, 25 bp, Homo sapien
taaaggatggtctggcactatttta

SEQ ID NO: 257713 - DNA, 25 bp, Homo sapien
aaaggatggtctggcactattttat

SEQ ID NO: 257714 - DNA, 25 bp, Homo sapien
aaggatggtctggcactattttatt

SEQ ID NO: 257715 - DNA, 25 bp, Homo sapien
aggatggtctggcactattttattt

SEQ ID NO: 257716 - DNA, 25 bp, Homo sapien
acaggaggcctcaggcggacacctc

SEQ ID NO: 257717 - DNA, 25 bp, Homo sapien
tccatggcaatctggcaggagcgcc

SEQ ID NO: 257718 - DNA, 25 bp, Homo sapien
tggcaatctggcaggagcgcccctt

SEQ ID NO: 257719 - DNA, 25 bp, Homo sapien
tgctggccggtgcttccacccattt

SEQ ID NO: 257720 - DNA, 25 bp, Homo sapien
aggttaataaaggtttgctcctcag

SEQ ID NO: 257721 - DNA, 25 bp, Homo sapien
aataaaggtttgctcctcagcaccc

SEQ ID NO: 257722 - DNA, 25 bp, Homo sapien
aagcagactcctgggcgcgtccgga

SEQ ID NO: 257723 - DNA, 25 bp, Homo sapien
gtttccatacggtttgttcacaggc

SEQ ID NO: 257724 - DNA, 25 bp, Homo sapien
tcctgggcgcgtccggaaatcccgt

SEQ ID NO: 257725 - DNA, 25 bp, Homo sapien
ccgtcggaaaaggcgcggttgccat

SEQ ID NO: 257726 - DNA, 25 bp, Homo sapien
atggcgccggagatgctccccaagc

SEQ ID NO: 257727 - DNA, 25 bp, Homo sapien
tctttttcccttctggacatcagat

SEQ ID NO: 257728 - DNA, 25 bp, Homo sapien
tttcccttctggacatcagatgcag

SEQ ID NO: 257729 - DNA, 25 bp, Homo sapien
ggacatcagatgcagataattgagt

SEQ ID NO: 257730 - DNA, 25 bp, Homo sapien
gagttcgtgattcaattcgtgggtc

SEQ ID NO: 257731 - DNA, 25 bp, Homo sapien
gattcaattcgtgggtcattatcat

SEQ ID NO: 257732 - DNA, 25 bp, Homo sapien
tgggtcattatcatcactggccgca

SEQ ID NO: 257733 - DNA, 25 bp, Homo sapien
actggccgcagcaaggctttatttg

SEQ ID NO: 257734 - DNA, 25 bp, Homo sapien
tccccacaggtagctcttctaatat

SEQ ID NO: 257735 - DNA, 25 bp, Homo sapien
aaatgtgtacctttctgtttgcatg

SEQ ID NO: 257736 - DNA, 25 bp, Homo sapien
tgtacctttctgtttgcatgtgttc

SEQ ID NO: 257737 - DNA, 25 bp, Homo sapien
atgtgttcttgcaaaatgcatattt

SEQ ID NO: 257738 - DNA, 25 bp, Homo sapien
caaacacaaacgaaaaccagcaaag

SEQ ID NO: 257739 - DNA, 25 bp, Homo sapien
aaccagcaaagaaagctcttcgaga

SEQ ID NO: 257740 - DNA, 25 bp, Homo sapien
gctcttcgagaagagtaaggctact

SEQ ID NO: 257741 - DNA, 25 bp, Homo sapien
gtaaggctactgatctttaggaatc

SEQ ID NO: 257742 - DNA, 25 bp, Homo sapien
ggctactgatctttaggaatcaaat

SEQ ID NO: 257743 - DNA, 25 bp, Homo sapien
gatctttaggaatcaaatcattatt

SEQ ID NO: 257744 - DNA, 25 bp, Homo sapien
tatttccacacatgtcatgaagaac

SEQ ID NO: 257745 - DNA, 25 bp, Homo sapien
cacacatgtcatgaagaacacagac

SEQ ID NO: 257746 - DNA, 25 bp, Homo sapien
gagggagaagtcaaagctcaagtaa

SEQ ID NO: 257747 - DNA, 25 bp, Homo sapien
aagagatttttaacctagagaggct

SEQ ID NO: 257748 - DNA, 25 bp, Homo sapien
aacctagagaggctgagttatcaag

SEQ ID NO: 257749 - DNA, 25 bp, Homo sapien
gaattggtagcatagtgtggagata

SEQ ID NO: 257750 - DNA, 25 bp, Homo sapien
ataagtgggcagtgcttggtcctgt

SEQ ID NO: 257751 - DNA, 25 bp, Homo sapien
ttggtcctgtttctgcctcctagag

SEQ ID NO: 257752 - DNA, 25 bp, Homo sapien
tttctgcctcctagagagtacctct

SEQ ID NO: 257753 - DNA, 25 bp, Homo sapien
gagagtacctctcagcatccaggga

SEQ ID NO: 257754 - DNA, 25 bp, Homo sapien
agcatccagggatgctttagtaact

SEQ ID NO: 257755 - DNA, 25 bp, Homo sapien
tgggcatgggttggatcctgatatc

SEQ ID NO: 257756 - DNA, 25 bp, Homo sapien
gggttggatcctgatatctgtgtca

SEQ ID NO: 257757 - DNA, 25 bp, Homo sapien
tatctgtgtcagttagtgagagttg

SEQ ID NO: 257758 - DNA, 25 bp, Homo sapien
gagttggttctatgaccctagagct

SEQ ID NO: 257759 - DNA, 25 bp, Homo sapien
tagagctctttgtgtccttcaaacg

SEQ ID NO: 257760 - DNA, 25 bp, Homo sapien
agggcctgccagtgtgacatgtgtc

SEQ ID NO: 257761 - DNA, 25 bp, Homo sapien
agtgtgacatgtgtcgcctctctcg

SEQ ID NO: 257762 - DNA, 25 bp, Homo sapien
tcctcccctgggtcacagggcttga

SEQ ID NO: 257763 - DNA, 25 bp, Homo sapien
gggaaacctgtgttcaagattcaaa

SEQ ID NO: 257764 - DNA, 25 bp, Homo sapien
ggagctccagccctgatggttactt

SEQ ID NO: 257765 - DNA, 25 bp, Homo sapien
gccctgatggttacttgctatggaa

SEQ ID NO: 257766 - DNA, 25 bp, Homo sapien
gatggttacttgctatggaattttt

SEQ ID NO: 257767 - DNA, 25 bp, Homo sapien
gtctctcagtgctgcaccatcagtg

SEQ ID NO: 257768 - DNA, 25 bp, Homo sapien
accatcagtggcctgaagaaggtca

SEQ ID NO: 257769 - DNA, 25 bp, Homo sapien
aggtcaaagtacagctgcagtgtgt

SEQ ID NO: 257770 - DNA, 25 bp, Homo sapien
gccggagggaggagctcgagatctt

SEQ ID NO: 257771 - DNA, 25 bp, Homo sapien
agttcgagaccaaactcaggcctgg

SEQ ID NO: 257772 - DNA, 25 bp, Homo sapien
cccgggaggctgacattgtagtgag

SEQ ID NO: 257773 - DNA, 25 bp, Homo sapien
ccgggaggctgacattgtagtgagc

SEQ ID NO: 257774 - DNA, 25 bp, Homo sapien
gggaggctgacattgtagtgagctg

SEQ ID NO: 257775 - DNA, 25 bp, Homo sapien
ggaggctgacattgtagtgagctga

SEQ ID NO: 257776 - DNA, 25 bp, Homo sapien
gaggctgacattgtagtgagctgag

SEQ ID NO: 257777 - DNA, 25 bp, Homo sapien
gcactctggcctaggcaacgagtga

SEQ ID NO: 257778 - DNA, 25 bp, Homo sapien
cactctggcctaggcaacgagtgaa

SEQ ID NO: 257779 - DNA, 25 bp, Homo sapien
ctctggcctaggcaacgagtgaaac

SEQ ID NO: 257780 - DNA, 25 bp, Homo sapien
tctggcctaggcaacgagtgaaact

SEQ ID NO: 257781 - DNA, 25 bp, Homo sapien
ctggcctaggcaacgagtgaaactc

SEQ ID NO: 257782 - DNA, 25 bp, Homo sapien
agtaaaatgctgttgaaggcccacg

SEQ ID NO: 257783 - DNA, 25 bp, Homo sapien
taaaatgctgttgaaggcccacggg

SEQ ID NO: 257784 - DNA, 25 bp, Homo sapien
aaaatgctgttgaaggcccacgggc

SEQ ID NO: 257785 - DNA, 25 bp, Homo sapien
aaatgctgttgaaggcccacgggca

SEQ ID NO: 257786 - DNA, 25 bp, Homo sapien
aatgctgttgaaggcccacgggcat

SEQ ID NO: 257787 - DNA, 25 bp, Homo sapien
ctgttgaaggcccacgggcatgact

SEQ ID NO: 257788 - DNA, 25 bp, Homo sapien
tgttgaaggcccacgggcatgactg

SEQ ID NO: 257789 - DNA, 25 bp, Homo sapien
tgaaggcccacgggcatgactgcac

SEQ ID NO: 257790 - DNA, 25 bp, Homo sapien
atgactgcacccctcactaattggt

SEQ ID NO: 257791 - DNA, 25 bp, Homo sapien
actgcacccctcactaattggtcat

SEQ ID NO: 257792 - DNA, 25 bp, Homo sapien
ctctccggacctgtgccaaactgtg

SEQ ID NO: 257793 - DNA, 25 bp, Homo sapien
ggaaggcccatcctgttcattatga

SEQ ID NO: 257794 - DNA, 25 bp, Homo sapien
aggcccatcctgttcattatgaatc

SEQ ID NO: 257795 - DNA, 25 bp, Homo sapien
tccaatacttgggtctttatagata

SEQ ID NO: 257796 - DNA, 25 bp, Homo sapien
tagatagaggctacaattgacatta

SEQ ID NO: 257797 - DNA, 25 bp, Homo sapien
agtgttgaaggttttctccatggta

SEQ ID NO: 257798 - DNA, 25 bp, Homo sapien
gaaggttttctccatggtatgaaac

SEQ ID NO: 257799 - DNA, 25 bp, Homo sapien
tggtatgaaaccattctgttgtctg

SEQ ID NO: 257800 - DNA, 25 bp, Homo sapien
aagacttctacaaaccgtggatagg

SEQ ID NO: 257801 - DNA, 25 bp, Homo sapien
cttttctcttgtgttgtccgtctta

SEQ ID NO: 257802 - DNA, 25 bp, Homo sapien
tgtgttgtccgtcttattaccataa

SEQ ID NO: 257803 - DNA, 25 bp, Homo sapien
aaaatgcctctgttgctaagccgct

SEQ ID NO: 257804 - DNA, 25 bp, Homo sapien
ggagattagaacaattatatgacca

SEQ ID NO: 257805 - DNA, 25 bp, Homo sapien
gaacaattatatgaccagaagcatc

SEQ ID NO: 257806 - DNA, 25 bp, Homo sapien
accagaagcatctaaccattatgta

SEQ ID NO: 257807 - DNA, 25 bp, Homo sapien
gaagcatctaaccattatgtaaaaa

SEQ ID NO: 257808 - DNA, 25 bp, Homo sapien
acaaattttgtgcagtactaaagaa

SEQ ID NO: 257809 - DNA, 25 bp, Homo sapien
aaagaaaaagcagtctaccattgtg

SEQ ID NO: 257810 - DNA, 25 bp, Homo sapien
taccattgtggtccttgaaaataac

SEQ ID NO: 257811 - DNA, 25 bp, Homo sapien
gtggtccttgaaaataactatagat

SEQ ID NO: 257812 - DNA, 25 bp, Homo sapien
attaaagcacttgaagacaatggtt

SEQ ID NO: 257813 - DNA, 25 bp, Homo sapien
aagcacttgaagacaatggttatag

SEQ ID NO: 257814 - DNA, 25 bp, Homo sapien
aagacaatggttatagtagatttga

SEQ ID NO: 257815 - DNA, 25 bp, Homo sapien
gaactggttagaggactccctcact

SEQ ID NO: 257816 - DNA, 25 bp, Homo sapien
ggttagaggactccctcacttttgt

SEQ ID NO: 257817 - DNA, 25 bp, Homo sapien
tcacttttgttgtccatgtggttcc

SEQ ID NO: 257818 - DNA, 25 bp, Homo sapien
tgtccatgtggttcccttccgtgga

SEQ ID NO: 257819 - DNA, 25 bp, Homo sapien
ttccgtggaccagccgtaataaaga

SEQ ID NO: 257820 - DNA, 25 bp, Homo sapien
agccgtaataaagagccaaggtagt

SEQ ID NO: 257821 - DNA, 25 bp, Homo sapien
cacgtgcctcgttgctatttttaaa

SEQ ID NO: 257822 - DNA, 25 bp, Homo sapien
tttagattatgtattccttttgaaa

SEQ ID NO: 257823 - DNA, 25 bp, Homo sapien
tttaaacctatgctgaaaatacgat

SEQ ID NO: 257824 - DNA, 25 bp, Homo sapien
aaaacaactccaatatgctaaaagt

SEQ ID NO: 257825 - DNA, 25 bp, Homo sapien
catgtatgcaattgagaaagtctat

SEQ ID NO: 257826 - DNA, 25 bp, Homo sapien
tcattattgaaacagcactttacat

SEQ ID NO: 257827 - DNA, 25 bp, Homo sapien
gtgccaaacataacttggtgagcaa

SEQ ID NO: 257828 - DNA, 25 bp, Homo sapien
ggtgagcaaattaaacttacatacg

SEQ ID NO: 257829 - DNA, 25 bp, Homo sapien
agtattatatgtctaatctccccaa

SEQ ID NO: 257830 - DNA, 25 bp, Homo sapien
atatgtctaatctccccaaaacttc

SEQ ID NO: 257831 - DNA, 25 bp, Homo sapien
gtctaatctccccaaaacttcaaag

SEQ ID NO: 257832 - DNA, 25 bp, Homo sapien
tctccccaaaacttcaaagctaatt

SEQ ID NO: 257833 - DNA, 25 bp, Homo sapien
ttaaaactccttattcttctctctc

SEQ ID NO: 257834 - DNA, 25 bp, Homo sapien
ttattcttctctctcttgttcttcc

SEQ ID NO: 257835 - DNA, 25 bp, Homo sapien
ttgtcctgtgtagactggaacccaa

SEQ ID NO: 257836 - DNA, 25 bp, Homo sapien
tggaacccaagcctcttaagaccaa

SEQ ID NO: 257837 - DNA, 25 bp, Homo sapien
gaggtctggatctgtggtgagatgg

SEQ ID NO: 257838 - DNA, 25 bp, Homo sapien
gctcaggaggtctggatctgtgatg

SEQ ID NO: 257839 - DNA, 25 bp, Homo sapien
gaggtctggatctgtgatgagatgg

SEQ ID NO: 257840 - DNA, 25 bp, Homo sapien
gtgggctcaggaggtctggatctgg

SEQ ID NO: 257841 - DNA, 25 bp, Homo sapien
ttcatttgttcattgtctatccttt

SEQ ID NO: 257842 - DNA, 25 bp, Homo sapien
attgtctatccttttgtattgattg

SEQ ID NO: 257843 - DNA, 25 bp, Homo sapien
ttgtctatccttttgtattgattga

SEQ ID NO: 257844 - DNA, 25 bp, Homo sapien
tgtctatccttttgtattgattgaa

SEQ ID NO: 257845 - DNA, 25 bp, Homo sapien
gtctatccttttgtattgattgaat

SEQ ID NO: 257846 - DNA, 25 bp, Homo sapien
tctatccttttgtattgattgaatt

SEQ ID NO: 257847 - DNA, 25 bp, Homo sapien
cttttgtattgattgaattttttat

SEQ ID NO: 257848 - DNA, 25 bp, Homo sapien
tttgtcccggcaacatttgctgtaa

SEQ ID NO: 257849 - DNA, 25 bp, Homo sapien
cagcagaatcacaccatataagagt

SEQ ID NO: 257850 - DNA, 25 bp, Homo sapien
gctttgataaggtaattctgtattc

SEQ ID NO: 257851 - DNA, 25 bp, Homo sapien
gagagggtccctgaataactccttc

SEQ ID NO: 257852 - DNA, 25 bp, Homo sapien
tgaataactccttcttgaggcagag

SEQ ID NO: 257853 - DNA, 25 bp, Homo sapien
ttcttgaggcagagatggcattatt

SEQ ID NO: 257854 - DNA, 25 bp, Homo sapien
ggcattattgcctgtgctgattagc

SEQ ID NO: 257855 - DNA, 25 bp, Homo sapien
tgctgattagcaagcagtgtgtgct

SEQ ID NO: 257856 - DNA, 25 bp, Homo sapien
gtgtgtgctgctgtaccaagctctc

SEQ ID NO: 257857 - DNA, 25 bp, Homo sapien
gtgctgctgtaccaagctctcagga

SEQ ID NO: 257858 - DNA, 25 bp, Homo sapien
agagtacttgtttcatcctcatctg

SEQ ID NO: 257859 - DNA, 25 bp, Homo sapien
caaaaggttcctattaatctgtgga

SEQ ID NO: 257860 - DNA, 25 bp, Homo sapien
aatctgtggaaggtagtaacttcaa

SEQ ID NO: 257861 - DNA, 25 bp, Homo sapien
ggaatcagtataatgcccactggat

SEQ ID NO: 257862 - DNA, 25 bp, Homo sapien
cactggatcagttctcattgagaga

SEQ ID NO: 257863 - DNA, 25 bp, Homo sapien
gagacaattctccagcaagtattta

SEQ ID NO: 257864 - DNA, 25 bp, Homo sapien
cagcaagtatttactttctacccct

SEQ ID NO: 257865 - DNA, 25 bp, Homo sapien
cccttcttcaaataattactcacca

SEQ ID NO: 257866 - DNA, 25 bp, Homo sapien
attactcaccaaagcaatatcaatg

SEQ ID NO: 257867 - DNA, 25 bp, Homo sapien
agcaatatcaatgggaaactcaaca

SEQ ID NO: 257868 - DNA, 25 bp, Homo sapien
agcagcaaagagctttcaaaaaccc

SEQ ID NO: 257869 - DNA, 25 bp, Homo sapien
gttatttattttctcctataataga

SEQ ID NO: 257870 - DNA, 25 bp, Homo sapien
tgtgtagtttgacagcattgtggtt

SEQ ID NO: 257871 - DNA, 25 bp, Homo sapien
cagcattgtggttgtagcagcaaag

SEQ ID NO: 257872 - DNA, 25 bp, Homo sapien
gtagcagcaaaggacttaaagtgat

SEQ ID NO: 257873 - DNA, 25 bp, Homo sapien
aaccatattctgtccctaagtaata

SEQ ID NO: 257874 - DNA, 25 bp, Homo sapien
ataccagatttgttctgctctgcct

SEQ ID NO: 257875 - DNA, 25 bp, Homo sapien
ctgcctcatctagaatcaacgtcta

SEQ ID NO: 257876 - DNA, 25 bp, Homo sapien
gaatcaacgtctaactaacttaaat

SEQ ID NO: 257877 - DNA, 25 bp, Homo sapien
aaatgagttcatatgaaaaggcttc

SEQ ID NO: 257878 - DNA, 25 bp, Homo sapien
gaaaaggcttcctctatggacactt

SEQ ID NO: 257879 - DNA, 25 bp, Homo sapien
ggcttcctctatggacacttagata

SEQ ID NO: 257880 - DNA, 25 bp, Homo sapien
gtaactattgaagttacctgggatg

SEQ ID NO: 257881 - DNA, 25 bp, Homo sapien
atccgtcaagaaggcccactgttgg

SEQ ID NO: 257882 - DNA, 25 bp, Homo sapien
tcaagaaggcccactgttggtgctt

SEQ ID NO: 257883 - DNA, 25 bp, Homo sapien
aaggcccactgttggtgcttggttc

SEQ ID NO: 257884 - DNA, 25 bp, Homo sapien
actgttggtgcttggttcccatctg

SEQ ID NO: 257885 - DNA, 25 bp, Homo sapien
gtgcttggttcccatctgtcaccta

SEQ ID NO: 257886 - DNA, 25 bp, Homo sapien
gtgcagagcccagcataacctagag

SEQ ID NO: 257887 - DNA, 25 bp, Homo sapien
agagcccagcataacctagagcccg

SEQ ID NO: 257888 - DNA, 25 bp, Homo sapien
agcataacctagagcccgctgtcaa

SEQ ID NO: 257889 - DNA, 25 bp, Homo sapien
cgaccttctctcttggagcgcggag

SEQ ID NO: 257890 - DNA, 25 bp, Homo sapien
tcttggagcgcggagccctcttcga

SEQ ID NO: 257891 - DNA, 25 bp, Homo sapien
agcgcggagccctcttcgacgcatt

SEQ ID NO: 257892 - DNA, 25 bp, Homo sapien
ccagggcagggcatcccttgacccc

SEQ ID NO: 257893 - DNA, 25 bp, Homo sapien
tctgccctcagggaactcaaggact

SEQ ID NO: 257894 - DNA, 25 bp, Homo sapien
tgccctcagggaactcaaggactct

SEQ ID NO: 257895 - DNA, 25 bp, Homo sapien
cagggaactcaaggactctcagaga

SEQ ID NO: 257896 - DNA, 25 bp, Homo sapien
gggaactcaaggactctcagagaca

SEQ ID NO: 257897 - DNA, 25 bp, Homo sapien
gaactcaaggactctcagagacacc

SEQ ID NO: 257898 - DNA, 25 bp, Homo sapien
aaggactctcagagacaccagggca

SEQ ID NO: 257899 - DNA, 25 bp, Homo sapien
ggactctcagagacaccagggcagc

SEQ ID NO: 257900 - DNA, 25 bp, Homo sapien
ctctcagagacaccagggcagcctg

SEQ ID NO: 257901 - DNA, 25 bp, Homo sapien
ccccaggaggacagccatggagaga

SEQ ID NO: 257902 - DNA, 25 bp, Homo sapien
aggacagccatggagagaactgaga

SEQ ID NO: 257903 - DNA, 25 bp, Homo sapien
ccgcaagaaacaaagctcgagtgaa

SEQ ID NO: 257904 - DNA, 25 bp, Homo sapien
ctcgagtgaaagcttgttacataat

SEQ ID NO: 257905 - DNA, 25 bp, Homo sapien
attggactcacaattatcgcctgct

SEQ ID NO: 257906 - DNA, 25 bp, Homo sapien
attatcgcctgctttgctgtgatag

SEQ ID NO: 257907 - DNA, 25 bp, Homo sapien
tgtgatagtgtcagccaaaagggct

SEQ ID NO: 257908 - DNA, 25 bp, Homo sapien
ctaagtggcgtgaagaagctgcatt

SEQ ID NO: 257909 - DNA, 25 bp, Homo sapien
aagctgcattggctgcacaggctaa

SEQ ID NO: 257910 - DNA, 25 bp, Homo sapien
attggctgcacaggctaaagctaaa

SEQ ID NO: 257911 - DNA, 25 bp, Homo sapien
gtgttcacctgaataccatccctgt

SEQ ID NO: 257912 - DNA, 25 bp, Homo sapien
tgaataccatccctgtcatcagcaa

SEQ ID NO: 257913 - DNA, 25 bp, Homo sapien
taccaaaatatctgccatggtttta

SEQ ID NO: 257914 - DNA, 25 bp, Homo sapien
gcctgagcagctccaaagcactggc

SEQ ID NO: 257915 - DNA, 25 bp, Homo sapien
tgagcagctccaaagcactggcttg

SEQ ID NO: 257916 - DNA, 25 bp, Homo sapien
agcagctccaaagcactggcttggg

SEQ ID NO: 257917 - DNA, 25 bp, Homo sapien
ggtccgagaccttcaaagtaaagca

SEQ ID NO: 257918 - DNA, 25 bp, Homo sapien
gaccttcaaagtaaagcaggcggaa

SEQ ID NO: 257919 - DNA, 25 bp, Homo sapien
gaatggggggacaggacaatttctc

SEQ ID NO: 257920 - DNA, 25 bp, Homo sapien
gggaggagccccttgtacctgctcc

SEQ ID NO: 257921 - DNA, 25 bp, Homo sapien
aggagccccttgtacctgctccgtg

SEQ ID NO: 257922 - DNA, 25 bp, Homo sapien
gtacctgctccgtgcccaacacatg

SEQ ID NO: 257923 - DNA, 25 bp, Homo sapien
aacacatgccctctctgtacatctt

SEQ ID NO: 257924 - DNA, 25 bp, Homo sapien
atgccctctctgtacatcttttgta

SEQ ID NO: 257925 - DNA, 25 bp, Homo sapien
aaaacccaactacatatgcactttc

SEQ ID NO: 257926 - DNA, 25 bp, Homo sapien
acccaactacatatgcactttcttg

SEQ ID NO: 257927 - DNA, 25 bp, Homo sapien
aactacatatgcactttcttggttg

SEQ ID NO: 257928 - DNA, 25 bp, Homo sapien
gggagagaaactgagatggccctct

SEQ ID NO: 257929 - DNA, 25 bp, Homo sapien
tgagatggccctctgtgactcgact

SEQ ID NO: 257930 - DNA, 25 bp, Homo sapien
gagatggccctctgtgactcgactg

SEQ ID NO: 257931 - DNA, 25 bp, Homo sapien
gatggccctctgtgactcgactgct

SEQ ID NO: 257932 - DNA, 25 bp, Homo sapien
tggccctctgtgactcgactgctgg

SEQ ID NO: 257933 - DNA, 25 bp, Homo sapien
gccctctgtgactcgactgctggga

SEQ ID NO: 257934 - DNA, 25 bp, Homo sapien
gcaatttgtcttattgtttgggtct

SEQ ID NO: 257935 - DNA, 25 bp, Homo sapien
caatttgtcttattgtttgggtcta

SEQ ID NO: 257936 - DNA, 25 bp, Homo sapien
acgcagtcagggtggaccgtgcaca

SEQ ID NO: 257937 - DNA, 25 bp, Homo sapien
tcagggtggaccgtgcacagggttt

SEQ ID NO: 257938 - DNA, 25 bp, Homo sapien
gtggaccgtgcacagggtttgtggg

SEQ ID NO: 257939 - DNA, 25 bp, Homo sapien
ataaatggctctgtgaacttcccct

SEQ ID NO: 257940 - DNA, 25 bp, Homo sapien
tgagctgcttccctgattcacaggg

SEQ ID NO: 257941 - DNA, 25 bp, Homo sapien
gattcacagggctgtggcacaccct

SEQ ID NO: 257942 - DNA, 25 bp, Homo sapien
ttcacagggctgtggcacaccctgg

SEQ ID NO: 257943 - DNA, 25 bp, Homo sapien
cagggctgtggcacaccctgggaca

SEQ ID NO: 257944 - DNA, 25 bp, Homo sapien
actctcctcaggacaacaagccaat

SEQ ID NO: 257945 - DNA, 25 bp, Homo sapien
acaacaagccaatccctccactggg

SEQ ID NO: 257946 - DNA, 25 bp, Homo sapien
agccccacgcagtcagggtggaccg

SEQ ID NO: 257947 - DNA, 25 bp, Homo sapien
gggactcgagcctgcagcttgctcg

SEQ ID NO: 257948 - DNA, 25 bp, Homo sapien
agcttgctcggctgggtttctgccc

SEQ ID NO: 257949 - DNA, 25 bp, Homo sapien
gaagccgtgagcgaccgggcctttt

SEQ ID NO: 257950 - DNA, 25 bp, Homo sapien
gggccttttccagaggccactattt

SEQ ID NO: 257951 - DNA, 25 bp, Homo sapien
gccactatttaccttgaagtttcct

SEQ ID NO: 257952 - DNA, 25 bp, Homo sapien
taccttgaagtttcctgttgaccct

SEQ ID NO: 257953 - DNA, 25 bp, Homo sapien
aagtttcctgttgaccctctgctga

SEQ ID NO: 257954 - DNA, 25 bp, Homo sapien
ctgacccacccgcttaaatagatta

SEQ ID NO: 257955 - DNA, 25 bp, Homo sapien
gacccacccgcttaaatagattaga

SEQ ID NO: 257956 - DNA, 25 bp, Homo sapien
tgctcagtgcggtgagtcccctcct

SEQ ID NO: 257957 - DNA, 25 bp, Homo sapien
gccccggaggttcaagcccgagctt

SEQ ID NO: 257958 - DNA, 25 bp, Homo sapien
ttcactgttttgcattctagtttga

SEQ ID NO: 257959 - DNA, 25 bp, Homo sapien
actgttttgcattctagtttgaata

SEQ ID NO: 257960 - DNA, 25 bp, Homo sapien
ttgtattgaaattggattcctatct

SEQ ID NO: 257961 - DNA, 25 bp, Homo sapien
gattcctatcttgtgtatgtttttg

SEQ ID NO: 257962 - DNA, 25 bp, Homo sapien
tcttgtgtatgtttttggtgcgtaa

SEQ ID NO: 257963 - DNA, 25 bp, Homo sapien
ggtgtcattacttttgaaatttgca

SEQ ID NO: 257964 - DNA, 25 bp, Homo sapien
atttgcaggacgaagggcatgcttt

SEQ ID NO: 257965 - DNA, 25 bp, Homo sapien
aggacgaagggcatgcttttggttt

SEQ ID NO: 257966 - DNA, 25 bp, Homo sapien
catgcttttggtttgctgtaagatt

SEQ ID NO: 257967 - DNA, 25 bp, Homo sapien
gtttgctgtaagattgtattctgta

SEQ ID NO: 257968 - DNA, 25 bp, Homo sapien
attgtaagccacattgttaataaag

SEQ ID NO: 257969 - DNA, 25 bp, Homo sapien
gaagaatccttagagagcatcagtt

SEQ ID NO: 257970 - DNA, 25 bp, Homo sapien
gagagcatcagttcgagtctcttac

SEQ ID NO: 257971 - DNA, 25 bp, Homo sapien
tcagttcgagtctcttacccggaaa

SEQ ID NO: 257972 - DNA, 25 bp, Homo sapien
gttcagagagggttccattctggga

SEQ ID NO: 257973 - DNA, 25 bp, Homo sapien
gagaggctaagggtctggagctcaa

SEQ ID NO: 257974 - DNA, 25 bp, Homo sapien
tgcctggactgtgcaggacggctct

SEQ ID NO: 257975 - DNA, 25 bp, Homo sapien
gtgcaggacggctctgtctcttcag

SEQ ID NO: 257976 - DNA, 25 bp, Homo sapien
ccgtcaggcccactgtatttggaga

SEQ ID NO: 257977 - DNA, 25 bp, Homo sapien
tccccagaggtttcagattcgagtc

SEQ ID NO: 257978 - DNA, 25 bp, Homo sapien
agattcgagtcaaccttgctgctgg

SEQ ID NO: 257979 - DNA, 25 bp, Homo sapien
atgtcagcagagaatttcagagctt

SEQ ID NO: 257980 - DNA, 25 bp, Homo sapien
acgtgcactcaatctgccagcagaa

SEQ ID NO: 257981 - DNA, 25 bp, Homo sapien
atctgccagcagaattcgggcccct

SEQ ID NO: 257982 - DNA, 25 bp, Homo sapien
gaattcgggcccctggcagacaagt

SEQ ID NO: 257983 - DNA, 25 bp, Homo sapien
cccctggcagacaagttggcatatg

SEQ ID NO: 257984 - DNA, 25 bp, Homo sapien
cacagaaatgaaatgcccgagcttg

SEQ ID NO: 257985 - DNA, 25 bp, Homo sapien
tgcccgagcttgttgccaggtcctc

SEQ ID NO: 257986 - DNA, 25 bp, Homo sapien
ttggctagcacagcctcttgctcag

SEQ ID NO: 257987 - DNA, 25 bp, Homo sapien
agcctcttgctcaggtgtctaaggg

SEQ ID NO: 257988 - DNA, 25 bp, Homo sapien
aggcaggtgatgtggctttgtccat

SEQ ID NO: 257989 - DNA, 25 bp, Homo sapien
gtccatggccgcagagcaggttcat

SEQ ID NO: 257990 - DNA, 25 bp, Homo sapien
tcatgggcaggcaggacttgagccc

SEQ ID NO: 257991 - DNA, 25 bp, Homo sapien
gaaggagcactaaaattgcattttt

SEQ ID NO: 257992 - DNA, 25 bp, Homo sapien
catttttatcatagtttgtgcacca

SEQ ID NO: 257993 - DNA, 25 bp, Homo sapien
gtttgtgcaccatgtttattcagta

SEQ ID NO: 257994 - DNA, 25 bp, Homo sapien
aaagcccaaatatcagtctcatagt

SEQ ID NO: 257995 - DNA, 25 bp, Homo sapien
cagtctcatagtttcagttatccag

SEQ ID NO: 257996 - DNA, 25 bp, Homo sapien
agttatccagttccttcagtaagtc

SEQ ID NO: 257997 - DNA, 25 bp, Homo sapien
gtaagtcacactattaaaagtctgt

SEQ ID NO: 257998 - DNA, 25 bp, Homo sapien
catttggtgtttgaatacgtgcaca

SEQ ID NO: 257999 - DNA, 25 bp, Homo sapien
gaatacgtgcacaggaatttccatc

SEQ ID NO: 258000 - DNA, 25 bp, Homo sapien
acaggaatttccatcccaaggtggg

SEQ ID NO: 258001 - DNA, 25 bp, Homo sapien
gggatgattacccttgctaaatact

SEQ ID NO: 258002 - DNA, 25 bp, Homo sapien
ttccccagtgttcacgctgagaagt

SEQ ID NO: 258003 - DNA, 25 bp, Homo sapien
gtgttcacgctgagaagtcttcata

SEQ ID NO: 258004 - DNA, 25 bp, Homo sapien
aagtcttcatattggaccagtgtga

SEQ ID NO: 258005 - DNA, 25 bp, Homo sapien
aaaacctgacttcattttgtcctga

SEQ ID NO: 258006 - DNA, 25 bp, Homo sapien
gacttcattttgtcctgaatgtaga

SEQ ID NO: 258007 - DNA, 25 bp, Homo sapien
attttgtcctgaatgtagaagtgaa

SEQ ID NO: 258008 - DNA, 25 bp, Homo sapien
gaaggacactagtttcaggcacctg

SEQ ID NO: 258009 - DNA, 25 bp, Homo sapien
acactagtttcaggcacctgggatg

SEQ ID NO: 258010 - DNA, 25 bp, Homo sapien
ttattcaactgaggctttccatgca

SEQ ID NO: 258011 - DNA, 25 bp, Homo sapien
attcaactgaggctttccatgcatt

SEQ ID NO: 258012 - DNA, 25 bp, Homo sapien
tccatgcattgggttgaatagctga

SEQ ID NO: 258013 - DNA, 25 bp, Homo sapien
agcggctctgatcagtaaaatgctg

SEQ ID NO: 258014 - DNA, 25 bp, Homo sapien
taaaatgctgttgaaggcccacggg

SEQ ID NO: 258015 - DNA, 25 bp, Homo sapien
aaaatgctgttgaaggcccacgggc

SEQ ID NO: 258016 - DNA, 25 bp, Homo sapien
aatgctgttgaaggcccacgggcat

SEQ ID NO: 258017 - DNA, 25 bp, Homo sapien
tgttgaaggcccacgggcatgactg

SEQ ID NO: 258018 - DNA, 25 bp, Homo sapien
atgactgcacccctcactaattggt

SEQ ID NO: 258019 - DNA, 25 bp, Homo sapien
actgcacccctcactaattggtcat

SEQ ID NO: 258020 - DNA, 25 bp, Homo sapien
ccctcactaattggtcattggtttg

SEQ ID NO: 258021 - DNA, 25 bp, Homo sapien
ggaggacaccactgtcccagtggaa

SEQ ID NO: 258022 - DNA, 25 bp, Homo sapien
tggaaccttgagcacaccttggagc

SEQ ID NO: 258023 - DNA, 25 bp, Homo sapien
ctctccggacctgtgccaaactgtg

SEQ ID NO: 258024 - DNA, 25 bp, Homo sapien
aaatcaaagtcatagcagatttggg

SEQ ID NO: 258025 - DNA, 25 bp, Homo sapien
gggcaaatatgtcaaagtcaaactt

SEQ ID NO: 258026 - DNA, 25 bp, Homo sapien
gaagacaaagatgaatgtgtgacag

SEQ ID NO: 258027 - DNA, 25 bp, Homo sapien
ccccaagaatctttaagcattgtga

SEQ ID NO: 258028 - DNA, 25 bp, Homo sapien
gaatctttaagcattgtgaaggaag

SEQ ID NO: 258029 - DNA, 25 bp, Homo sapien
gaaggaagattaatatagccaaata

SEQ ID NO: 258030 - DNA, 25 bp, Homo sapien
tagccaaataactagagtgatcagt

SEQ ID NO: 258031 - DNA, 25 bp, Homo sapien
aactagagtgatcagttctaccaga

SEQ ID NO: 258032 - DNA, 25 bp, Homo sapien
agagtgatcagttctaccagagagg

SEQ ID NO: 258033 - DNA, 25 bp, Homo sapien
ttctaccagagaggaccagttttgg

SEQ ID NO: 258034 - DNA, 25 bp, Homo sapien
cagagaggaccagttttggaagcca

SEQ ID NO: 258035 - DNA, 25 bp, Homo sapien
gaagaatgggaacctatagcctggt

SEQ ID NO: 258036 - DNA, 25 bp, Homo sapien
gaacctatagcctggttcctaagaa

SEQ ID NO: 258037 - DNA, 25 bp, Homo sapien
tatagcctggttcctaagaaaaaga

SEQ ID NO: 258038 - DNA, 25 bp, Homo sapien
gtattaaaacagaggacggtgattg

SEQ ID NO: 258039 - DNA, 25 bp, Homo sapien
gacggtgattgagatgtttaagagc

SEQ ID NO: 258040 - DNA, 25 bp, Homo sapien
gagcataactcattccactgtgggt

SEQ ID NO: 258041 - DNA, 25 bp, Homo sapien
ctcattccactgtgggttccaaggg

SEQ ID NO: 258042 - DNA, 25 bp, Homo sapien
aggacgactcagaggagctcgagga

SEQ ID NO: 258043 - DNA, 25 bp, Homo sapien
tgctacatggccaccacaaaatcac

SEQ ID NO: 258044 - DNA, 25 bp, Homo sapien
atggccaccacaaaatcacagacag

SEQ ID NO: 258045 - DNA, 25 bp, Homo sapien
agcagctgcagtatctcggaagaaa

SEQ ID NO: 258046 - DNA, 25 bp, Homo sapien
gaattcttaattcatggtgaacaga

SEQ ID NO: 258047 - DNA, 25 bp, Homo sapien
catggtgaacagatgttgggttctt

SEQ ID NO: 258048 - DNA, 25 bp, Homo sapien
gagggttttctctttaatcacaact

SEQ ID NO: 258049 - DNA, 25 bp, Homo sapien
gaaacctttaatacctctgcataag

SEQ ID NO: 258050 - DNA, 25 bp, Homo sapien
atacctctgcataagttctctgaaa

SEQ ID NO: 258051 - DNA, 25 bp, Homo sapien
gtctgtgtaacaaagcctgttgggt

SEQ ID NO: 258052 - DNA, 25 bp, Homo sapien
aagcctgttgggtacaggtctacaa

SEQ ID NO: 258053 - DNA, 25 bp, Homo sapien
gtacaggtctacaaggagatacttt

SEQ ID NO: 258054 - DNA, 25 bp, Homo sapien
ctacaaggagatactttgtttctaa

SEQ ID NO: 258055 - DNA, 25 bp, Homo sapien
aaggagttaaatcgtgtcacctgaa

SEQ ID NO: 258056 - DNA, 25 bp, Homo sapien
agttaaatcgtgtcacctgaatttt

SEQ ID NO: 258057 - DNA, 25 bp, Homo sapien
caagtcttcagggaataagcagcaa

SEQ ID NO: 258058 - DNA, 25 bp, Homo sapien
agcaaggacttggaattcctgagca

SEQ ID NO: 258059 - DNA, 25 bp, Homo sapien
ggaattcctgagcaagccttgggtt

SEQ ID NO: 258060 - DNA, 25 bp, Homo sapien
acgccctaggaagtccctctggaag

SEQ ID NO: 258061 - DNA, 25 bp, Homo sapien
aggacctctcccaccagatgacgga

SEQ ID NO: 258062 - DNA, 25 bp, Homo sapien
agatgacggagtttgctttctcgcc

SEQ ID NO: 258063 - DNA, 25 bp, Homo sapien
ccaggcgtgagctggcagtccagaa

SEQ ID NO: 258064 - DNA, 25 bp, Homo sapien
agaagcggccccagatgtggctatc

SEQ ID NO: 258065 - DNA, 25 bp, Homo sapien
agatgtggctatccaccgcccagtc

SEQ ID NO: 258066 - DNA, 25 bp, Homo sapien
atgcatatcattgccttatgccaag

SEQ ID NO: 258067 - DNA, 25 bp, Homo sapien
attgccttatgccaagatgattcaa

SEQ ID NO: 258068 - DNA, 25 bp, Homo sapien
ctgcctggtgttacaacctagctaa

SEQ ID NO: 258069 - DNA, 25 bp, Homo sapien
acaacctagctaacatatttgatgc

SEQ ID NO: 258070 - DNA, 25 bp, Homo sapien
atatttgatgctactcctgttgtct

SEQ ID NO: 258071 - DNA, 25 bp, Homo sapien
tcctgttgtctgtactgcttattca

SEQ ID NO: 258072 - DNA, 25 bp, Homo sapien
atggtgggtaaagcacaatcctacc

SEQ ID NO: 258073 - DNA, 25 bp, Homo sapien
atcattgtcctccaaaataattgta

SEQ ID NO: 258074 - DNA, 25 bp, Homo sapien
attgtatgacatacacggcccagcc

SEQ ID NO: 258075 - DNA, 25 bp, Homo sapien
tgctgctttgccatttccccttcta

SEQ ID NO: 258076 - DNA, 25 bp, Homo sapien
accttggtggatatttcagtactta

SEQ ID NO: 258077 - DNA, 25 bp, Homo sapien
accagactgtaatcataacctccct

SEQ ID NO: 258078 - DNA, 25 bp, Homo sapien
aacctccctctgtgtggcatcaata

SEQ ID NO: 258079 - DNA, 25 bp, Homo sapien
gttttccttttaccaagaaatgcag

SEQ ID NO: 258080 - DNA, 25 bp, Homo sapien
agagcaaaccccacgtaccagatca

SEQ ID NO: 258081 - DNA, 25 bp, Homo sapien
gtaccagatcactgattcctactga

SEQ ID NO: 258082 - DNA, 25 bp, Homo sapien
attcctactgaagcagctagcccga

SEQ ID NO: 258083 - DNA, 25 bp, Homo sapien
gctagcccgagaaaggactctctca

SEQ ID NO: 258084 - DNA, 25 bp, Homo sapien
ctctcatactggtcttgggaaatga

SEQ ID NO: 258085 - DNA, 25 bp, Homo sapien
agtggacaaggatggttaattctta

SEQ ID NO: 258086 - DNA, 25 bp, Homo sapien
tcttattctgtagacgtccacagga

SEQ ID NO: 258087 - DNA, 25 bp, Homo sapien
gacgtccacaggaacagactaggat

SEQ ID NO: 258088 - DNA, 25 bp, Homo sapien
gagggaatgccgcttggcttcacta

SEQ ID NO: 258089 - DNA, 25 bp, Homo sapien
gcttggcttcactaccaaaggtttt

SEQ ID NO: 258090 - DNA, 25 bp, Homo sapien
tttattctggcccacggattctatg

SEQ ID NO: 258091 - DNA, 25 bp, Homo sapien
aaaccagaaggtcagtgtctcttga

SEQ ID NO: 258092 - DNA, 25 bp, Homo sapien
ggcccacggattctatgtggtctgt

SEQ ID NO: 258093 - DNA, 25 bp, Homo sapien
acggattctatgtggtctgttaggg

SEQ ID NO: 258094 - DNA, 25 bp, Homo sapien
aggtcagtgtctcttgatatcctcc

SEQ ID NO: 258095 - DNA, 25 bp, Homo sapien
ggagcatttcccttgtgtcaggagt

SEQ ID NO: 258096 - DNA, 25 bp, Homo sapien
atttcccttgtgtcaggagtaacaa

SEQ ID NO: 258097 - DNA, 25 bp, Homo sapien
aggagagaatctacatgaccatatc

SEQ ID NO: 258098 - DNA, 25 bp, Homo sapien
gatatcctcctcagctagcaaatga

SEQ ID NO: 258099 - DNA, 25 bp, Homo sapien
atgagaaaactgtcagagccatttg

SEQ ID NO: 258100 - DNA, 25 bp, Homo sapien
gagtggaaggtcacatcctccgagg

SEQ ID NO: 258101 - DNA, 25 bp, Homo sapien
ggaaataaaatgtgcccctcccagt

SEQ ID NO: 258102 - DNA, 25 bp, Homo sapien
aggatgttgcagagccctctcccat

SEQ ID NO: 258103 - DNA, 25 bp, Homo sapien
agccctctcccatagtttattatgt

SEQ ID NO: 258104 - DNA, 25 bp, Homo sapien
gtttattatgttgcatcgtttatta

SEQ ID NO: 258105 - DNA, 25 bp, Homo sapien
ttgtgtcatgtgagtcctctctcct

SEQ ID NO: 258106 - DNA, 25 bp, Homo sapien
ggctgcttgagtctagaacccttcg

SEQ ID NO: 258107 - DNA, 25 bp, Homo sapien
gagtctagaacccttcgtatgtgtg

SEQ ID NO: 258108 - DNA, 25 bp, Homo sapien
gaacccttcgtatgtgtgaatatct

SEQ ID NO: 258109 - DNA, 25 bp, Homo sapien
atgtgtgaatatctgtgtgctgtac

SEQ ID NO: 258110 - DNA, 25 bp, Homo sapien
ctgtgtgctgtacagagtgacaata

SEQ ID NO: 258111 - DNA, 25 bp, Homo sapien
gtttggtttcttgtgaccagcaaaa

SEQ ID NO: 258112 - DNA, 25 bp, Homo sapien
tttgcattatactgaatcttgatgt

SEQ ID NO: 258113 - DNA, 25 bp, Homo sapien
gaatcttgatgtttaagagctatgt

SEQ ID NO: 258114 - DNA, 25 bp, Homo sapien
gtatattgaggacattatttctttg

SEQ ID NO: 258115 - DNA, 25 bp, Homo sapien
tgtgttgcaaattttttaccatgtt

SEQ ID NO: 258116 - DNA, 25 bp, Homo sapien
ttaccatgttattattagtctttta

SEQ ID NO: 258117 - DNA, 25 bp, Homo sapien
tatgatgtaaacttaatctctttga

SEQ ID NO: 258118 - DNA, 25 bp, Homo sapien
tataattcctggttttcccgacgtg

SEQ ID NO: 258119 - DNA, 25 bp, Homo sapien
ggttttcccgacgtgcgtagaatga

SEQ ID NO: 258120 - DNA, 25 bp, Homo sapien
gacgtgcgtagaatgaccttcccca

SEQ ID NO: 258121 - DNA, 25 bp, Homo sapien
tagaatgaccttccccacaaggtaa

SEQ ID NO: 258122 - DNA, 25 bp, Homo sapien
gattttgcttaaaacttttatgctt

SEQ ID NO: 258123 - DNA, 25 bp, Homo sapien
tggttctgacattcattgtaaatca

SEQ ID NO: 258124 - DNA, 25 bp, Homo sapien
ggaaattcatgtaagactttttaag

SEQ ID NO: 258125 - DNA, 25 bp, Homo sapien
gtgaactgtaagatactgtctaaaa

SEQ ID NO: 258126 - DNA, 25 bp, Homo sapien
atattatacctgttctttagaagtc

SEQ ID NO: 258127 - DNA, 25 bp, Homo sapien
gttctttagaagtcatgttagcagc

SEQ ID NO: 258128 - DNA, 25 bp, Homo sapien
gttagcagctaattatttcagtgat

SEQ ID NO: 258129 - DNA, 25 bp, Homo sapien
ttaggttttcactcaatctttcctg

SEQ ID NO: 258130 - DNA, 25 bp, Homo sapien
gttttcactcaatctttcctgtcac

SEQ ID NO: 258131 - DNA, 25 bp, Homo sapien
tttcctgtcacagtaacgtgaaaac

SEQ ID NO: 258132 - DNA, 25 bp, Homo sapien
aactgattattctttactccaagag

SEQ ID NO: 258133 - DNA, 25 bp, Homo sapien
ctgattattctttactccaagagaa

SEQ ID NO: 258134 - DNA, 25 bp, Homo sapien
gaaccggtattctccaaagtaatat

SEQ ID NO: 258135 - DNA, 25 bp, Homo sapien
agtaaaaccattgcttaagtgggca

SEQ ID NO: 258136 - DNA, 25 bp, Homo sapien
taagtgggcaaaactctagaggata

SEQ ID NO: 258137 - DNA, 25 bp, Homo sapien
tcttgaaaacaggtggtgatgccct

SEQ ID NO: 258138 - DNA, 25 bp, Homo sapien
ggtggtgatgccctgaaattcagca

SEQ ID NO: 258139 - DNA, 25 bp, Homo sapien
gggcacgtgttgttctacccaaggt

SEQ ID NO: 258140 - DNA, 25 bp, Homo sapien
gttgttctacccaaggtcagagtgt

SEQ ID NO: 258141 - DNA, 25 bp, Homo sapien
gtcagagtgtgtcactcaccacttg

SEQ ID NO: 258142 - DNA, 25 bp, Homo sapien
cctttttaccttctcatccttggag

SEQ ID NO: 258143 - DNA, 25 bp, Homo sapien
cactggcattagttatgggcctgat

SEQ ID NO: 258144 - DNA, 25 bp, Homo sapien
tatgggcctgatagtttaagaaaac

SEQ ID NO: 258145 - DNA, 25 bp, Homo sapien
acaactcttggcctgtagtctcact

SEQ ID NO: 258146 - DNA, 25 bp, Homo sapien
acacactccttccagcagagaaatt

SEQ ID NO: 258147 - DNA, 25 bp, Homo sapien
gggtagaacaactctatcaaaggac

SEQ ID NO: 258148 - DNA, 25 bp, Homo sapien
tcaaaggactgtaaacttcccattt

SEQ ID NO: 258149 - DNA, 25 bp, Homo sapien
tttcctccctagagacagctccaaa

SEQ ID NO: 258150 - DNA, 25 bp, Homo sapien
aaaaagaattgagcactgttgggag

SEQ ID NO: 258151 - DNA, 25 bp, Homo sapien
ctccaaactttcctttgggtgcaga

SEQ ID NO: 258152 - DNA, 25 bp, Homo sapien
gaggctttggatgtgtatttggata

SEQ ID NO: 258153 - DNA, 25 bp, Homo sapien
ccctggtctcatgtttttgtgttga

SEQ ID NO: 258154 - DNA, 25 bp, Homo sapien
gtttttgtgttgaaggacctccatt

SEQ ID NO: 258155 - DNA, 25 bp, Homo sapien
ggacctccattgaaatacaactctt

SEQ ID NO: 258156 - DNA, 25 bp, Homo sapien
ggaaacagccatctgcacaggtcaa

SEQ ID NO: 258157 - DNA, 25 bp, Homo sapien
tgcacaggtcaacatcttcttagct

SEQ ID NO: 258158 - DNA, 25 bp, Homo sapien
caacatcttcttagctgacagggag

SEQ ID NO: 258159 - DNA, 25 bp, Homo sapien
gaaacttcttggagtctgctcttgt

SEQ ID NO: 258160 - DNA, 25 bp, Homo sapien
gtctgctcttgtgcaaatgagccta

SEQ ID NO: 258161 - DNA, 25 bp, Homo sapien
aatgagcctagaaagcccgttaact

SEQ ID NO: 258162 - DNA, 25 bp, Homo sapien
tggaggcttccactgtttggctatc

SEQ ID NO: 258163 - DNA, 25 bp, Homo sapien
tttggctatcccaagtgggcccaaa

SEQ ID NO: 258164 - DNA, 25 bp, Homo sapien
ttcctctatttgtttgccccaggaa

SEQ ID NO: 258165 - DNA, 25 bp, Homo sapien
tttgccccaggaaatcagaggtgat

SEQ ID NO: 258166 - DNA, 25 bp, Homo sapien
atgatttggcttgggcacgacagga

SEQ ID NO: 258167 - DNA, 25 bp, Homo sapien
gtatttggttatcatcctccccata

SEQ ID NO: 258168 - DNA, 25 bp, Homo sapien
ggttatcatcctccccatacatcat

SEQ ID NO: 258169 - DNA, 25 bp, Homo sapien
acaatgtaatgctgtgtagtcatac

SEQ ID NO: 258170 - DNA, 25 bp, Homo sapien
tgctgtgtagtcatactgtattttt

SEQ ID NO: 258171 - DNA, 25 bp, Homo sapien
gaggatagttgaatccacaggatac

SEQ ID NO: 258172 - DNA, 25 bp, Homo sapien
acaggatactgagggccagctgtat

SEQ ID NO: 258173 - DNA, 25 bp, Homo sapien
tactgagggccagctgtattcacaa

SEQ ID NO: 258174 - DNA, 25 bp, Homo sapien
gctgtattcacaacccaaatcacat

SEQ ID NO: 258175 - DNA, 25 bp, Homo sapien
tggttgtgggacttccgtggatatc

SEQ ID NO: 258176 - DNA, 25 bp, Homo sapien
gggacttccgtggatatccaaatca

SEQ ID NO: 258177 - DNA, 25 bp, Homo sapien
tccaaatcagtggatgctaaagtcc

SEQ ID NO: 258178 - DNA, 25 bp, Homo sapien
cctggcaatctttgagatgctgtaa

SEQ ID NO: 258179 - DNA, 25 bp, Homo sapien
gatgctgtaatggaatggctgccct

SEQ ID NO: 258180 - DNA, 25 bp, Homo sapien
tggctgccctgagtgttaacagtaa

SEQ ID NO: 258181 - DNA, 25 bp, Homo sapien
gaaataatatctcaagggtcaagtt

SEQ ID NO: 258182 - DNA, 25 bp, Homo sapien
ggtcaagttgaccttttcagtggga

SEQ ID NO: 258183 - DNA, 25 bp, Homo sapien
ttttcagtgggaacgttgtccttca

SEQ ID NO: 258184 - DNA, 25 bp, Homo sapien
agtgggaacgttgtccttcaggcta

SEQ ID NO: 258185 - DNA, 25 bp, Homo sapien
aacgttgtccttcaggctacttagg

SEQ ID NO: 258186 - DNA, 25 bp, Homo sapien
cttcaggctacttaggattctttgt

SEQ ID NO: 258187 - DNA, 25 bp, Homo sapien
gattctttgtatctgcttcctggca

SEQ ID NO: 258188 - DNA, 25 bp, Homo sapien
tatctgcttcctggcaatctttgag

SEQ ID NO: 258189 - DNA, 25 bp, Homo sapien
atgcatgcagacaactgaaactcaa

SEQ ID NO: 258190 - DNA, 25 bp, Homo sapien
caagtggagaatttgtttgtgaaca

SEQ ID NO: 258191 - DNA, 25 bp, Homo sapien
ttgtgaacaagtcatactacttctg

SEQ ID NO: 258192 - DNA, 25 bp, Homo sapien
tgaatggaatctgcaatatcttttt

SEQ ID NO: 258193 - DNA, 25 bp, Homo sapien
tctgcaatatctttttccatgggag

SEQ ID NO: 258194 - DNA, 25 bp, Homo sapien
tatctttttccatgggagaccctaa

SEQ ID NO: 258195 - DNA, 25 bp, Homo sapien
aagaaaaccctggatcagaatgatc

SEQ ID NO: 258196 - DNA, 25 bp, Homo sapien
gatcagaatgatctgcagtttcaga

SEQ ID NO: 258197 - DNA, 25 bp, Homo sapien
ttgtaactgttaactttctcactga

SEQ ID NO: 258198 - DNA, 25 bp, Homo sapien
aactgttaactttctcactgacaaa

SEQ ID NO: 258199 - DNA, 25 bp, Homo sapien
taactttctcactgacaaagcaagt

SEQ ID NO: 258200 - DNA, 25 bp, Homo sapien
aatatatagcctactgaacataaag

SEQ ID NO: 258201 - DNA, 25 bp, Homo sapien
agcctactgaacataaaggaagttt

SEQ ID NO: 258202 - DNA, 25 bp, Homo sapien
aaggaagttttgtgaccagtcttat

SEQ ID NO: 258203 - DNA, 25 bp, Homo sapien
gttttgtgaccagtcttatgtgcag

SEQ ID NO: 258204 - DNA, 25 bp, Homo sapien
tgtgaccagtcttatgtgcagtggg

SEQ ID NO: 258205 - DNA, 25 bp, Homo sapien
gggagacaatgagtgagcttgcttt

SEQ ID NO: 258206 - DNA, 25 bp, Homo sapien
gagtgagcttgctttaggcttgtcc

SEQ ID NO: 258207 - DNA, 25 bp, Homo sapien
gagcttgctttaggcttgtcctcat

SEQ ID NO: 258208 - DNA, 25 bp, Homo sapien
gctttaggcttgtcctcatgtttaa

SEQ ID NO: 258209 - DNA, 25 bp, Homo sapien
aggcttgtcctcatgtttaaaaaga

SEQ ID NO: 258210 - DNA, 25 bp, Homo sapien
gaaattgaagcttggtatgaaaata

SEQ ID NO: 258211 - DNA, 25 bp, Homo sapien
ctgccccgtgtgcaaacagtcggtg

SEQ ID NO: 258212 - DNA, 25 bp, Homo sapien
gtgtgcaaacagtcggtggccgcca

SEQ ID NO: 258213 - DNA, 25 bp, Homo sapien
ggtggccgccacagaagacagcttt

SEQ ID NO: 258214 - DNA, 25 bp, Homo sapien
tggccgccacagaagacagctttga

SEQ ID NO: 258215 - DNA, 25 bp, Homo sapien
tgggccattcaagtccagctacgct

SEQ ID NO: 258216 - DNA, 25 bp, Homo sapien
tcaagtccagctacgctcccggagg

SEQ ID NO: 258217 - DNA, 25 bp, Homo sapien
agcaccacgtccctggaggcagagt

SEQ ID NO: 258218 - DNA, 25 bp, Homo sapien
gtccctggaggcagagtataccact

SEQ ID NO: 258219 - DNA, 25 bp, Homo sapien
gaggcagagtataccactgtctcct

SEQ ID NO: 258220 - DNA, 25 bp, Homo sapien
gcagagtataccactgtctcctcag

SEQ ID NO: 258221 - DNA, 25 bp, Homo sapien
cctgaggcccctggtcagtaaagat

SEQ ID NO: 258222 - DNA, 25 bp, Homo sapien
aaatctctctccagaggatcgtggc

SEQ ID NO: 258223 - DNA, 25 bp, Homo sapien
gatcgtggctgaggcaccatggaat

SEQ ID NO: 258224 - DNA, 25 bp, Homo sapien
ctgaggcaccatggaatgctgctgt

SEQ ID NO: 258225 - DNA, 25 bp, Homo sapien
tccaaaagtctttctagtctccagg

SEQ ID NO: 258226 - DNA, 25 bp, Homo sapien
agtctttctagtctccaggcattta

SEQ ID NO: 258227 - DNA, 25 bp, Homo sapien
gtctccaggcatttagaaaagcttt

SEQ ID NO: 258228 - DNA, 25 bp, Homo sapien
atttgagtggaaatcaccctgccca

SEQ ID NO: 258229 - DNA, 25 bp, Homo sapien
ggaaatcaccctgcccagctgtgag

SEQ ID NO: 258230 - DNA, 25 bp, Homo sapien
ggcgggtgagccacacacttggatc

SEQ ID NO: 258231 - DNA, 25 bp, Homo sapien
acacacttggatctcactgcagttg

SEQ ID NO: 258232 - DNA, 25 bp, Homo sapien
tctcactgcagttgtggcctctggg

SEQ ID NO: 258233 - DNA, 25 bp, Homo sapien
tcaggctggctgcatgcctcagctg

SEQ ID NO: 258234 - DNA, 25 bp, Homo sapien
ggctgcatgcctcagctgaagatcc

SEQ ID NO: 258235 - DNA, 25 bp, Homo sapien
cccaagctggtaggacagaaggaca

SEQ ID NO: 258236 - DNA, 25 bp, Homo sapien
atgccacctctctgcttgactgtct

SEQ ID NO: 258237 - DNA, 25 bp, Homo sapien
cttgactgtctccttccagattcga

SEQ ID NO: 258238 - DNA, 25 bp, Homo sapien
cttccagattcgagcaggtatgagc

SEQ ID NO: 258239 - DNA, 25 bp, Homo sapien
agggcatgcccgtgtgccagctctg

SEQ ID NO: 258240 - DNA, 25 bp, Homo sapien
agctctgcacagctggatagctgag

SEQ ID NO: 258241 - DNA, 25 bp, Homo sapien
ggacagacagattcctctagcctag

SEQ ID NO: 258242 - DNA, 25 bp, Homo sapien
agacagattcctctagcctagcgct

SEQ ID NO: 258243 - DNA, 25 bp, Homo sapien
cccgcgtcgggagaactgggatcgc

SEQ ID NO: 258244 - DNA, 25 bp, Homo sapien
atgtttttgaaccactctacttaga

SEQ ID NO: 258245 - DNA, 25 bp, Homo sapien
gatgtgagccgagtttggaaactgt

SEQ ID NO: 258246 - DNA, 25 bp, Homo sapien
tagtgagcagatagttcaacagatt

SEQ ID NO: 258247 - DNA, 25 bp, Homo sapien
taacactggtaaacccacttactcg

SEQ ID NO: 258248 - DNA, 25 bp, Homo sapien
acccaaaaatcagtgtgactccttc

SEQ ID NO: 258249 - DNA, 25 bp, Homo sapien
gtgtgactccttcccaagaatttat

SEQ ID NO: 258250 - DNA, 25 bp, Homo sapien
agcacttaatgttcaattcatcaga

SEQ ID NO: 258251 - DNA, 25 bp, Homo sapien
gaacactattaatgcttgatctttg

SEQ ID NO: 258252 - DNA, 25 bp, Homo sapien
gcttgatctttgttcagtgacctgg

SEQ ID NO: 258253 - DNA, 25 bp, Homo sapien
cctgggaaatattaattggtagcct

SEQ ID NO: 258254 - DNA, 25 bp, Homo sapien
ttggtagcctacatattagcagatg

SEQ ID NO: 258255 - DNA, 25 bp, Homo sapien
caatctggatcaactttcttacaaa

SEQ ID NO: 258256 - DNA, 25 bp, Homo sapien
gatcaactttcttacaaaaacggtg

SEQ ID NO: 258257 - DNA, 25 bp, Homo sapien
ttcttacaaaaacggtgtgctttga

SEQ ID NO: 258258 - DNA, 25 bp, Homo sapien
gtgctttgaaatgccaggatggctg

SEQ ID NO: 258259 - DNA, 25 bp, Homo sapien
ccaggatggctgattttacttattt

SEQ ID NO: 258260 - DNA, 25 bp, Homo sapien
tctttgttgctttcagtgaagcaaa

SEQ ID NO: 258261 - DNA, 25 bp, Homo sapien
gaagcaaagaactgccttgtagata

SEQ ID NO: 258262 - DNA, 25 bp, Homo sapien
gagttaaactgattacagggaacgt

SEQ ID NO: 258263 - DNA, 25 bp, Homo sapien
gattccagaattcgtcaattgtttt

SEQ ID NO: 258264 - DNA, 25 bp, Homo sapien
ggcccacttgtttataaagcaatat

SEQ ID NO: 258265 - DNA, 25 bp, Homo sapien
aatggtatgtgtaacaatctggatc

SEQ ID NO: 258266 - DNA, 25 bp, Homo sapien
tggaatatgtgccaaaacacgtgaa

SEQ ID NO: 258267 - DNA, 25 bp, Homo sapien
gccaaaacacgtgaaaagcttacat

SEQ ID NO: 258268 - DNA, 25 bp, Homo sapien
agaaaggcatcagttgtcgtttgga

SEQ ID NO: 258269 - DNA, 25 bp, Homo sapien
aggcatcagttgtcgtttggagaaa

SEQ ID NO: 258270 - DNA, 25 bp, Homo sapien
gtcgtttggagaaaggtacacattt

SEQ ID NO: 258271 - DNA, 25 bp, Homo sapien
gtacacatttttttgatggtcctaa

SEQ ID NO: 258272 - DNA, 25 bp, Homo sapien
atggtcctaagtgatatggtattac

SEQ ID NO: 258273 - DNA, 25 bp, Homo sapien
ggtattactactagaatcacagatt

SEQ ID NO: 258274 - DNA, 25 bp, Homo sapien
tcacattttccaacaaatatatagg

SEQ ID NO: 258275 - DNA, 25 bp, Homo sapien
gatttcttcaactgacttattttgg

SEQ ID NO: 258276 - DNA, 25 bp, Homo sapien
attttggtatattcaactacagctt

SEQ ID NO: 258277 - DNA, 25 bp, Homo sapien
gggccatccactgaacttcggaaag

SEQ ID NO: 258278 - DNA, 25 bp, Homo sapien
gacttggattgctgcatccagagcc

SEQ ID NO: 258279 - DNA, 25 bp, Homo sapien
tcaatctagccacactcagttgcta

SEQ ID NO: 258280 - DNA, 25 bp, Homo sapien
tagtccggtgttccggccgacgcaa

SEQ ID NO: 258281 - DNA, 25 bp, Homo sapien
aacggagctcaggatgacgccacat

SEQ ID NO: 258282 - DNA, 25 bp, Homo sapien
gacgccacatgtgtgtttgagtcaa

SEQ ID NO: 258283 - DNA, 25 bp, Homo sapien
aagcgcttttaactgtggctccaag

SEQ ID NO: 258284 - DNA, 25 bp, Homo sapien
taactgtggctccaagaacagcctg

SEQ ID NO: 258285 - DNA, 25 bp, Homo sapien
aacagcctgtacagccacttgagtt

SEQ ID NO: 258286 - DNA, 25 bp, Homo sapien
tacagccacttgagtttccccgtaa

SEQ ID NO: 258287 - DNA, 25 bp, Homo sapien
tgagtttccccgtaacaaggaatgt

SEQ ID NO: 258288 - DNA, 25 bp, Homo sapien
cattcatgtttcaattgacaaggga

SEQ ID NO: 258289 - DNA, 25 bp, Homo sapien
gagatgcttgctgaaggcacaagtt

SEQ ID NO: 258290 - DNA, 25 bp, Homo sapien
gaaggcacaagtttgaatacagaaa

SEQ ID NO: 258291 - DNA, 25 bp, Homo sapien
gacttccaatagttttcatttatca

SEQ ID NO: 258292 - DNA, 25 bp, Homo sapien
atttatcagattactacactattgt

SEQ ID NO: 258293 - DNA, 25 bp, Homo sapien
tttgtattggttaaagatgtcctga

SEQ ID NO: 258294 - DNA, 25 bp, Homo sapien
cctccttggctttcactgaagtttt

SEQ ID NO: 258295 - DNA, 25 bp, Homo sapien
ccttggctttcactgaagttttggg

SEQ ID NO: 258296 - DNA, 25 bp, Homo sapien
gggcagttcttcattaatttgggtt

SEQ ID NO: 258297 - DNA, 25 bp, Homo sapien
acactttacatcatgagttagccaa

SEQ ID NO: 258298 - DNA, 25 bp, Homo sapien
tgagttagccaaacattcatgtttc

SEQ ID NO: 258299 - DNA, 25 bp, Homo sapien
acattggatggcagtggagcaacac

SEQ ID NO: 258300 - DNA, 25 bp, Homo sapien
ggagcaacacagattgttttctgac

SEQ ID NO: 258301 - DNA, 25 bp, Homo sapien
gttttctgacaaaaatcagccaagt

SEQ ID NO: 258302 - DNA, 25 bp, Homo sapien
gccaagtactaggagaggcaggact

SEQ ID NO: 258303 - DNA, 25 bp, Homo sapien
ctcttcacggctgaggaactttggc

SEQ ID NO: 258304 - DNA, 25 bp, Homo sapien
gcttaggttactatggagtgtgcaa

SEQ ID NO: 258305 - DNA, 25 bp, Homo sapien
cacggctgaggaactttggccccga

SEQ ID NO: 258306 - DNA, 25 bp, Homo sapien
aaaggtcctgtggatttagatacca

SEQ ID NO: 258307 - DNA, 25 bp, Homo sapien
tgctgttgttggaaggtacctgccc

SEQ ID NO: 258308 - DNA, 25 bp, Homo sapien
tggaaggtacctgcccagataagga

SEQ ID NO: 258309 - DNA, 25 bp, Homo sapien
atcttctactatgtgcatctacatt

SEQ ID NO: 258310 - DNA, 25 bp, Homo sapien
caaacacggataatgcactcagagt

SEQ ID NO: 258311 - DNA, 25 bp, Homo sapien
acacggataatgcactcagagtaca

SEQ ID NO: 258312 - DNA, 25 bp, Homo sapien
atgcactcagagtacattttttgta

SEQ ID NO: 258313 - DNA, 25 bp, Homo sapien
ggatgtggattttattgcttactac

SEQ ID NO: 258314 - DNA, 25 bp, Homo sapien
tggattttattgcttactactttat

SEQ ID NO: 258315 - DNA, 25 bp, Homo sapien
aatatcaacttacagtctttaccag

SEQ ID NO: 258316 - DNA, 25 bp, Homo sapien
tacagtctttaccagtttactaagg

SEQ ID NO: 258317 - DNA, 25 bp, Homo sapien
tttttgccaaccttgatactgataa

SEQ ID NO: 258318 - DNA, 25 bp, Homo sapien
ttgccaaccttgatactgataactg

SEQ ID NO: 258319 - DNA, 25 bp, Homo sapien
ccaaccttgatactgataactgttt

SEQ ID NO: 258320 - DNA, 25 bp, Homo sapien
tttgcttggattttcttgatgaatt

SEQ ID NO: 258321 - DNA, 25 bp, Homo sapien
gaaattgagcattcatccccaccct

SEQ ID NO: 258322 - DNA, 25 bp, Homo sapien
ctcacattcccctaagacctaaatt

SEQ ID NO: 258323 - DNA, 25 bp, Homo sapien
ttcccctaagacctaaattatgcag

SEQ ID NO: 258324 - DNA, 25 bp, Homo sapien
gggagaaccctacatggaatcatat

SEQ ID NO: 258325 - DNA, 25 bp, Homo sapien
tggaatcatattctagccgcgtatt

SEQ ID NO: 258326 - DNA, 25 bp, Homo sapien
tctagccgcgtattcattagttttt

SEQ ID NO: 258327 - DNA, 25 bp, Homo sapien
gggcaagttaacagaggcaacctct

SEQ ID NO: 258328 - DNA, 25 bp, Homo sapien
gatgtgctcccaccacatgcgcagg

SEQ ID NO: 258329 - DNA, 25 bp, Homo sapien
accacatgcgcagggtctgtgattt

SEQ ID NO: 258330 - DNA, 25 bp, Homo sapien
gggtctgtgattttacatgtatgta

SEQ ID NO: 258331 - DNA, 25 bp, Homo sapien
gtaaaacacataggaagctgactta

SEQ ID NO: 258332 - DNA, 25 bp, Homo sapien
gtggcttttcacctgcttcgttaaa

SEQ ID NO: 258333 - DNA, 25 bp, Homo sapien
gcttttcacctgcttcgttaaattt

SEQ ID NO: 258334 - DNA, 25 bp, Homo sapien
ggtaaacagcacagatgctgggaga

SEQ ID NO: 258335 - DNA, 25 bp, Homo sapien
taaatttaactcacaccggctcaga

SEQ ID NO: 258336 - DNA, 25 bp, Homo sapien
atttaactcacaccggctcagagga

SEQ ID NO: 258337 - DNA, 25 bp, Homo sapien
agagggctggcatctgaccgtgacc

SEQ ID NO: 258338 - DNA, 25 bp, Homo sapien
ggctggcatctgaccgtgaccatca

SEQ ID NO: 258339 - DNA, 25 bp, Homo sapien
gaccatcacgcccatgtgacaaagg

SEQ ID NO: 258340 - DNA, 25 bp, Homo sapien
tcacgcccatgtgacaaaggatgtc

SEQ ID NO: 258341 - DNA, 25 bp, Homo sapien
gatgtcaccacagtgaacagttctg

SEQ ID NO: 258342 - DNA, 25 bp, Homo sapien
gtgaacagttctgaccacagtggct

SEQ ID NO: 258343 - DNA, 25 bp, Homo sapien
tactgttatgatgaagttaattgaa

SEQ ID NO: 258344 - DNA, 25 bp, Homo sapien
ttttggctttaacatagcttgctga

SEQ ID NO: 258345 - DNA, 25 bp, Homo sapien
ttggctttaacatagcttgctgatt

SEQ ID NO: 258346 - DNA, 25 bp, Homo sapien
ggctttaacatagcttgctgatttt

SEQ ID NO: 258347 - DNA, 25 bp, Homo sapien
gctttaacatagcttgctgattttt

SEQ ID NO: 258348 - DNA, 25 bp, Homo sapien
taacatagcttgctgatttttttgc

SEQ ID NO: 258349 - DNA, 25 bp, Homo sapien
ttttgctgtgtaatgctttcacctc

SEQ ID NO: 258350 - DNA, 25 bp, Homo sapien
tttgctgtgtaatgctttcacctct

SEQ ID NO: 258351 - DNA, 25 bp, Homo sapien
ttgctgtgtaatgctttcacctctc

SEQ ID NO: 258352 - DNA, 25 bp, Homo sapien
tgctgtgtaatgctttcacctctcc

SEQ ID NO: 258353 - DNA, 25 bp, Homo sapien
gctttcacctctccactgtgaatcc

SEQ ID NO: 258354 - DNA, 25 bp, Homo sapien
gttacacctggacatatatacacat

SEQ ID NO: 258355 - DNA, 25 bp, Homo sapien
ggattgtattccttctagtctaaga

SEQ ID NO: 258356 - DNA, 25 bp, Homo sapien
gtctaagacaagagattctatggta

SEQ ID NO: 258357 - DNA, 25 bp, Homo sapien
ttttctagcattgtattgtcaccag

SEQ ID NO: 258358 - DNA, 25 bp, Homo sapien
gaaagaagagtgctgaattctctgt

SEQ ID NO: 258359 - DNA, 25 bp, Homo sapien
gtttctgcatttcccaataataaat

SEQ ID NO: 258360 - DNA, 25 bp, Homo sapien
atttcccaataataaatctcctagg

SEQ ID NO: 258361 - DNA, 25 bp, Homo sapien
tctcctaggagagataactttttgc

SEQ ID NO: 258362 - DNA, 25 bp, Homo sapien
gatcctgtttgaagctcaactcatt

SEQ ID NO: 258363 - DNA, 25 bp, Homo sapien
gaagctcaactcattttgattgaaa

SEQ ID NO: 258364 - DNA, 25 bp, Homo sapien
gaaaaatgtgtgttacacctggaca

SEQ ID NO: 258365 - DNA, 25 bp, Homo sapien
tctccattctcatgccctattttat

SEQ ID NO: 258366 - DNA, 25 bp, Homo sapien
tgtttcccaatttttaggtcatttg

SEQ ID NO: 258367 - DNA, 25 bp, Homo sapien
aggtcatttgtgtcacttgcaattc

SEQ ID NO: 258368 - DNA, 25 bp, Homo sapien
gtgtcacttgcaattctcacaggag

SEQ ID NO: 258369 - DNA, 25 bp, Homo sapien
gcaattctcacaggagtggtgatgt

SEQ ID NO: 258370 - DNA, 25 bp, Homo sapien
gagtggtgatgtcaaagaaacccaa

SEQ ID NO: 258371 - DNA, 25 bp, Homo sapien
cagtcactttgttgtatggcccaga

SEQ ID NO: 258372 - DNA, 25 bp, Homo sapien
actttgttgtatggcccagagtgac

SEQ ID NO: 258373 - DNA, 25 bp, Homo sapien
ccaagtctcggctcaaaaagtagcg

SEQ ID NO: 258374 - DNA, 25 bp, Homo sapien
aaaagtagcgatctccattcacctt

SEQ ID NO: 258375 - DNA, 25 bp, Homo sapien
tagcgatctccattcacctttacct

SEQ ID NO: 258376 - DNA, 25 bp, Homo sapien
agttcccctggcattaccttgacaa

SEQ ID NO: 258377 - DNA, 25 bp, Homo sapien
tggcattaccttgacaacgtattca

SEQ ID NO: 258378 - DNA, 25 bp, Homo sapien
aacgtattcaaggtctgagtgccac

SEQ ID NO: 258379 - DNA, 25 bp, Homo sapien
tgccacgtggacttcttcaggactc

SEQ ID NO: 258380 - DNA, 25 bp, Homo sapien
gtggacttcttcaggactccagagg

SEQ ID NO: 258381 - DNA, 25 bp, Homo sapien
gctcctaccagcagactatcagtga

SEQ ID NO: 258382 - DNA, 25 bp, Homo sapien
agtgaaacagctggtcatccgccgt

SEQ ID NO: 258383 - DNA, 25 bp, Homo sapien
gggctcacggtcaggatcctagcca

SEQ ID NO: 258384 - DNA, 25 bp, Homo sapien
tagccaccaggcactagcaaagaag

SEQ ID NO: 258385 - DNA, 25 bp, Homo sapien
tggctgtccccagtatgcaaacaca

SEQ ID NO: 258386 - DNA, 25 bp, Homo sapien
agtatgcaaacacaccacggtctgc

SEQ ID NO: 258387 - DNA, 25 bp, Homo sapien
gaggaagacacctctgccccagtgg

SEQ ID NO: 258388 - DNA, 25 bp, Homo sapien
tctgccccagtggattagcaagtgt

SEQ ID NO: 258389 - DNA, 25 bp, Homo sapien
attagcaagtgtggcaggcttaaca

SEQ ID NO: 258390 - DNA, 25 bp, Homo sapien
ggcaggcttaacatgtccaggttct

SEQ ID NO: 258391 - DNA, 25 bp, Homo sapien
aggcttaacatgtccaggttctccc

SEQ ID NO: 258392 - DNA, 25 bp, Homo sapien
aggttctccccaataacattgtcca

SEQ ID NO: 258393 - DNA, 25 bp, Homo sapien
ttctccccaataacattgtccaggt

SEQ ID NO: 258394 - DNA, 25 bp, Homo sapien
caataacattgtccaggttggtttt

SEQ ID NO: 258395 - DNA, 25 bp, Homo sapien
gactaggtagaggtgaatgtactaa

SEQ ID NO: 258396 - DNA, 25 bp, Homo sapien
aatgccactgaatttgtatacttca

SEQ ID NO: 258397 - DNA, 25 bp, Homo sapien
gtatacttcagaatgtttgttatgt

SEQ ID NO: 258398 - DNA, 25 bp, Homo sapien
tattctggtcagcagaggtccttga

SEQ ID NO: 258399 - DNA, 25 bp, Homo sapien
gaggtccttgagtcacagtgttact

SEQ ID NO: 258400 - DNA, 25 bp, Homo sapien
gttactgaaatggttctgagcctga

SEQ ID NO: 258401 - DNA, 25 bp, Homo sapien
gcctgagaatctctttggcctctga

SEQ ID NO: 258402 - DNA, 25 bp, Homo sapien
tgccagtcctttcaggtttcctgtt

SEQ ID NO: 258403 - DNA, 25 bp, Homo sapien
caggtttcctgttcaaagccagtcc

SEQ ID NO: 258404 - DNA, 25 bp, Homo sapien
gggatcaccgagagtgtctgtatca

SEQ ID NO: 258405 - DNA, 25 bp, Homo sapien
gagtgtctgtatcattttgtagccc

SEQ ID NO: 258406 - DNA, 25 bp, Homo sapien
tttgtagcccttttctctgacgttt

SEQ ID NO: 258407 - DNA, 25 bp, Homo sapien
tccctcccttgtaagcagagtcata

SEQ ID NO: 258408 - DNA, 25 bp, Homo sapien
tagtctaaggctgggtattctggtc

SEQ ID NO: 258409 - DNA, 25 bp, Homo sapien
gggaaatagctcaagctgtctttgc

SEQ ID NO: 258410 - DNA, 25 bp, Homo sapien
aagctgtctttgcagcccctgaaga

SEQ ID NO: 258411 - DNA, 25 bp, Homo sapien
cctgaagacatcactgtaccctatt

SEQ ID NO: 258412 - DNA, 25 bp, Homo sapien
actgtaccctattgaaccatctcag

SEQ ID NO: 258413 - DNA, 25 bp, Homo sapien
tgaaccatctcagggtgatgctatt

SEQ ID NO: 258414 - DNA, 25 bp, Homo sapien
tgatgctattgttacgctgatccct

SEQ ID NO: 258415 - DNA, 25 bp, Homo sapien
tattgttacgctgatccctgcaacg

SEQ ID NO: 258416 - DNA, 25 bp, Homo sapien
tgatccctgcaacgcttgcctgtgc

SEQ ID NO: 258417 - DNA, 25 bp, Homo sapien
gcccaggatcctggcagctgcagag

SEQ ID NO: 258418 - DNA, 25 bp, Homo sapien
gaaaatggcagtaacactacctcaa

SEQ ID NO: 258419 - DNA, 25 bp, Homo sapien
ggcagtaacactacctcaaaccagg

SEQ ID NO: 258420 - DNA, 25 bp, Homo sapien
cactccagagagtggcttgtgtgac

SEQ ID NO: 258421 - DNA, 25 bp, Homo sapien
tctctttaagtttaagcgggcacat

SEQ ID NO: 258422 - DNA, 25 bp, Homo sapien
gcgggcacatatggctagtaactca

SEQ ID NO: 258423 - DNA, 25 bp, Homo sapien
gatagtgcaattctagttctagtgg

SEQ ID NO: 258424 - DNA, 25 bp, Homo sapien
gttctagtggcaaatagacctatgt

SEQ ID NO: 258425 - DNA, 25 bp, Homo sapien
gacctatgtttattgttaggcatga

SEQ ID NO: 258426 - DNA, 25 bp, Homo sapien
gttaggcatgaaaatttacacgtat

SEQ ID NO: 258427 - DNA, 25 bp, Homo sapien
aatgttccatatcggtgctgttcag

SEQ ID NO: 258428 - DNA, 25 bp, Homo sapien
atagtagctaccagctttctgtggc

SEQ ID NO: 258429 - DNA, 25 bp, Homo sapien
accagctttctgtggctattgagca

SEQ ID NO: 258430 - DNA, 25 bp, Homo sapien
tggctattgagcactccagagagtg

SEQ ID NO: 258431 - DNA, 25 bp, Homo sapien
tattcagagtatcctaaaaattccc

SEQ ID NO: 258432 - DNA, 25 bp, Homo sapien
accatcgtttgggtttggagagatt

SEQ ID NO: 258433 - DNA, 25 bp, Homo sapien
tgtggaattatgtcctctttctaat

SEQ ID NO: 258434 - DNA, 25 bp, Homo sapien
gtcctctttctaattttgcaacatt

SEQ ID NO: 258435 - DNA, 25 bp, Homo sapien
gcatgttaaaacattcttccctgaa

SEQ ID NO: 258436 - DNA, 25 bp, Homo sapien
attcttccctgaacccacaatgagt

SEQ ID NO: 258437 - DNA, 25 bp, Homo sapien
gattaatgacaacagtggctaagca

SEQ ID NO: 258438 - DNA, 25 bp, Homo sapien
ggctaagcatgggaagggtttctat

SEQ ID NO: 258439 - DNA, 25 bp, Homo sapien
agggtttctatggtgggactgcatt

SEQ ID NO: 258440 - DNA, 25 bp, Homo sapien
gactgcattggaccacctctgaatg

SEQ ID NO: 258441 - DNA, 25 bp, Homo sapien
ttggaccacctctgaatgtgtgtat

SEQ ID NO: 258442 - DNA, 25 bp, Homo sapien
tattatctgagttatttaccttcat

SEQ ID NO: 258443 - DNA, 25 bp, Homo sapien
ttatctgagttatttaccttcatag

SEQ ID NO: 258444 - DNA, 25 bp, Homo sapien
atctgagttatttaccttcatagtt

SEQ ID NO: 258445 - DNA, 25 bp, Homo sapien
ctgagttatttaccttcatagttat

SEQ ID NO: 258446 - DNA, 25 bp, Homo sapien
gagttatttaccttcatagttattt

SEQ ID NO: 258447 - DNA, 25 bp, Homo sapien
gttatttaccttcatagttatttca

SEQ ID NO: 258448 - DNA, 25 bp, Homo sapien
atttaccttcatagttatttcactt

SEQ ID NO: 258449 - DNA, 25 bp, Homo sapien
gttatttcactttatcttattggag

SEQ ID NO: 258450 - DNA, 25 bp, Homo sapien
atttcactttatcttattggagttt

SEQ ID NO: 258451 - DNA, 25 bp, Homo sapien
cactttatcttattggagtttttga

SEQ ID NO: 258452 - DNA, 25 bp, Homo sapien
atcttattggagtttttgagttatt

SEQ ID NO: 258453 - DNA, 25 bp, Homo sapien
gctgcccacacctatgtctcagaag

SEQ ID NO: 258454 - DNA, 25 bp, Homo sapien
tctcagaagagcttagggcattggg

SEQ ID NO: 258455 - DNA, 25 bp, Homo sapien
cttcatctgggttgacttgagaaag

SEQ ID NO: 258456 - DNA, 25 bp, Homo sapien
aggaaatgctgctctggcgccgctt

SEQ ID NO: 258457 - DNA, 25 bp, Homo sapien
tctggcgccgctttttggacaacaa

SEQ ID NO: 258458 - DNA, 25 bp, Homo sapien
gtgctgctgtcctttggcaaggcct

SEQ ID NO: 258459 - DNA, 25 bp, Homo sapien
tttggcaaggccttcgagtgtaaag

SEQ ID NO: 258460 - DNA, 25 bp, Homo sapien
gccttcgagtgtaaagagcctggtt

SEQ ID NO: 258461 - DNA, 25 bp, Homo sapien
taaagagcctggttggtttcgcttt

SEQ ID NO: 258462 - DNA, 25 bp, Homo sapien
gttggtttcgctttgtcttctcaga

SEQ ID NO: 258463 - DNA, 25 bp, Homo sapien
ggtttcgctttgtcttctcagacca

SEQ ID NO: 258464 - DNA, 25 bp, Homo sapien
cattgtctaatgaagatgaattctc

SEQ ID NO: 258465 - DNA, 25 bp, Homo sapien
gtttattcttcactgtatttctatt

SEQ ID NO: 258466 - DNA, 25 bp, Homo sapien
tgtatttctattggagcctcaggac

SEQ ID NO: 258467 - DNA, 25 bp, Homo sapien
ttctattggagcctcaggacaaaga

SEQ ID NO: 258468 - DNA, 25 bp, Homo sapien
tcaggacaaagagcagatggtgaga

SEQ ID NO: 258469 - DNA, 25 bp, Homo sapien
ggtgagaatctgtgttcagtgttaa

SEQ ID NO: 258470 - DNA, 25 bp, Homo sapien
tgttaagttttccttctgtaagaca

SEQ ID NO: 258471 - DNA, 25 bp, Homo sapien
gttttccttctgtaagacatgtgca

SEQ ID NO: 258472 - DNA, 25 bp, Homo sapien
ttctgtaagacatgtgcaacttgtg

SEQ ID NO: 258473 - DNA, 25 bp, Homo sapien
tgctgtgggacagattagcctcctt

SEQ ID NO: 258474 - DNA, 25 bp, Homo sapien
tgggacagattagcctccttgttct

SEQ ID NO: 258475 - DNA, 25 bp, Homo sapien
tcctgggctacatcaacgagcaata

SEQ ID NO: 258476 - DNA, 25 bp, Homo sapien
acgagcaatacgagcagaacctgag

SEQ ID NO: 258477 - DNA, 25 bp, Homo sapien
tgaggacccactgcatcgacgtcta

SEQ ID NO: 258478 - DNA, 25 bp, Homo sapien
ccccagatgtgctttgacgaggaca

SEQ ID NO: 258479 - DNA, 25 bp, Homo sapien
tcaacagcaagttacgggaccgaat

SEQ ID NO: 258480 - DNA, 25 bp, Homo sapien
gaccgaatcccttttgccgtggtag

SEQ ID NO: 258481 - DNA, 25 bp, Homo sapien
gggctgaccaagagcacctggtgaa

SEQ ID NO: 258482 - DNA, 25 bp, Homo sapien
gaacatggcgcactgtgaatttcct

SEQ ID NO: 258483 - DNA, 25 bp, Homo sapien
tgaatttcctctcctgagagacctg

SEQ ID NO: 258484 - DNA, 25 bp, Homo sapien
tgagagacctgcttatccgctccca

SEQ ID NO: 258485 - DNA, 25 bp, Homo sapien
ccacctccaagacctgaaggacata

SEQ ID NO: 258486 - DNA, 25 bp, Homo sapien
cagccctggctacccggatgaagag

SEQ ID NO: 258487 - DNA, 25 bp, Homo sapien
ggtgggcagccagggtagccagtga

SEQ ID NO: 258488 - DNA, 25 bp, Homo sapien
tagccagtgaggtcaggaagtctgt

SEQ ID NO: 258489 - DNA, 25 bp, Homo sapien
gaggtcaggaagtctgttgccttaa

SEQ ID NO: 258490 - DNA, 25 bp, Homo sapien
caggaagtctgttgccttaacgtcc

SEQ ID NO: 258491 - DNA, 25 bp, Homo sapien
gaagtctgttgccttaacgtcccct

SEQ ID NO: 258492 - DNA, 25 bp, Homo sapien
ttctccgctcccaggtctggttggt

SEQ ID NO: 258493 - DNA, 25 bp, Homo sapien
ctcccaggtctggttggtgagactt

SEQ ID NO: 258494 - DNA, 25 bp, Homo sapien
ccccattatgtcatgacctcactta

SEQ ID NO: 258495 - DNA, 25 bp, Homo sapien
tatgtcatgacctcacttaagtgga

SEQ ID NO: 258496 - DNA, 25 bp, Homo sapien
catgacctcacttaagtggaacact

SEQ ID NO: 258497 - DNA, 25 bp, Homo sapien
gccatcaccagagctttgcacaggg

SEQ ID NO: 258498 - DNA, 25 bp, Homo sapien
tttgcacagggagacaccacataga

SEQ ID NO: 258499 - DNA, 25 bp, Homo sapien
gcagatgaggcaacacacacaccat

SEQ ID NO: 258500 - DNA, 25 bp, Homo sapien
cttgctttttcctgtgtggctcatt

SEQ ID NO: 258501 - DNA, 25 bp, Homo sapien
aaggctagcctttactgactcatga

SEQ ID NO: 258502 - DNA, 25 bp, Homo sapien
gtggctcattggtaggagatctcaa

SEQ ID NO: 258503 - DNA, 25 bp, Homo sapien
ggagatctcaaattctaacccttgt

SEQ ID NO: 258504 - DNA, 25 bp, Homo sapien
tttactgactcatgaagctgtgtct

SEQ ID NO: 258505 - DNA, 25 bp, Homo sapien
tcagtggtggagacattgcgttaac

SEQ ID NO: 258506 - DNA, 25 bp, Homo sapien
tggagacattgcgttaaccccagca

SEQ ID NO: 258507 - DNA, 25 bp, Homo sapien
gttaaccccagcaagcgagccatca

SEQ ID NO: 258508 - DNA, 25 bp, Homo sapien
tttgtgcagtgcttctgaggttcat

SEQ ID NO: 258509 - DNA, 25 bp, Homo sapien
gaggttcatataatagtcttgtact

SEQ ID NO: 258510 - DNA, 25 bp, Homo sapien
agtcttgtactataatgtgctttac

SEQ ID NO: 258511 - DNA, 25 bp, Homo sapien
aatgtgctttactacacgataaatg

SEQ ID NO: 258512 - DNA, 25 bp, Homo sapien
ccctgtttcatgtttcatttagtgc

SEQ ID NO: 258513 - DNA, 25 bp, Homo sapien
caaaaagtcagatttccccagtgtt

SEQ ID NO: 258514 - DNA, 25 bp, Homo sapien
tcagatttccccagtgttttgttgt

SEQ ID NO: 258515 - DNA, 25 bp, Homo sapien
ttttgttgtctgttgtacctgctga

SEQ ID NO: 258516 - DNA, 25 bp, Homo sapien
ctgttgtacctgctgaaactacagt

SEQ ID NO: 258517 - DNA, 25 bp, Homo sapien
acagtagttgaatattgcggtagca

SEQ ID NO: 258518 - DNA, 25 bp, Homo sapien
ttgcggtagcatttcagttctcttt

SEQ ID NO: 258519 - DNA, 25 bp, Homo sapien
gaacagaacagggagtcattatctt

SEQ ID NO: 258520 - DNA, 25 bp, Homo sapien
gagtcattatctttttcttctttac

SEQ ID NO: 258521 - DNA, 25 bp, Homo sapien
gtaaaacgtcaataaagcagtatca

SEQ ID NO: 258522 - DNA, 25 bp, Homo sapien
taacgtttattctgtaccacgcggc

SEQ ID NO: 258523 - DNA, 25 bp, Homo sapien
tttattctgtaccacgcggctgtca

SEQ ID NO: 258524 - DNA, 25 bp, Homo sapien
taccacgcggctgtcagtgtccgga

SEQ ID NO: 258525 - DNA, 25 bp, Homo sapien
cggctgtcagtgtccggagtctcca

SEQ ID NO: 258526 - DNA, 25 bp, Homo sapien
aacaatgcagatgggtgtacttcct

SEQ ID NO: 258527 - DNA, 25 bp, Homo sapien
agatgggtgtacttcctttctctcc

SEQ ID NO: 258528 - DNA, 25 bp, Homo sapien
agccaacccatttttccttggaatg

SEQ ID NO: 258529 - DNA, 25 bp, Homo sapien
caacccatttttccttggaatgcaa

SEQ ID NO: 258530 - DNA, 25 bp, Homo sapien
tttcactccagctgtggccatgcag

SEQ ID NO: 258531 - DNA, 25 bp, Homo sapien
tgtggccatgcagaaatgtggtcta

SEQ ID NO: 258532 - DNA, 25 bp, Homo sapien
gaaatgtggtctagcgttaccagac

SEQ ID NO: 258533 - DNA, 25 bp, Homo sapien
gcgttaccagacctgatttttcaag

SEQ ID NO: 258534 - DNA, 25 bp, Homo sapien
gaggctaaaaatctggactagtatg

SEQ ID NO: 258535 - DNA, 25 bp, Homo sapien
agtatgtgagatttcctaacttgaa

SEQ ID NO: 258536 - DNA, 25 bp, Homo sapien
caaacccctttcatgaaccagatgt

SEQ ID NO: 258537 - DNA, 25 bp, Homo sapien
accagatgtgttgtgcctgtttaac

SEQ ID NO: 258538 - DNA, 25 bp, Homo sapien
aatatccgaagtatctcaagtacca

SEQ ID NO: 258539 - DNA, 25 bp, Homo sapien
atatcttcctgtgcacaatgcttat

SEQ ID NO: 258540 - DNA, 25 bp, Homo sapien
tgtgcacaatgcttatctagaccct

SEQ ID NO: 258541 - DNA, 25 bp, Homo sapien
actgagtaggatgtcgtatgatact

SEQ ID NO: 258542 - DNA, 25 bp, Homo sapien
gtaggatgtcgtatgatactttcaa

SEQ ID NO: 258543 - DNA, 25 bp, Homo sapien
ggatgtcgtatgatactttcaacaa

SEQ ID NO: 258544 - DNA, 25 bp, Homo sapien
atgtcgtatgatactttcaacaaat

SEQ ID NO: 258545 - DNA, 25 bp, Homo sapien
ccctaatgctgcctaagcatatgga

SEQ ID NO: 258546 - DNA, 25 bp, Homo sapien
atgctgcctaagcatatggatgttt

SEQ ID NO: 258547 - DNA, 25 bp, Homo sapien
atgttttaattctttgctgttataa

SEQ ID NO: 258548 - DNA, 25 bp, Homo sapien
agatatctaatacgccagaattact

SEQ ID NO: 258549 - DNA, 25 bp, Homo sapien
ctaatacgccagaattactgatggt

SEQ ID NO: 258550 - DNA, 25 bp, Homo sapien
tacgccagaattactgatggtaaaa

SEQ ID NO: 258551 - DNA, 25 bp, Homo sapien
gatggtaaaattgaagttgtgtaac

SEQ ID NO: 258552 - DNA, 25 bp, Homo sapien
gggctgagatgctgcaacaggtcac

SEQ ID NO: 258553 - DNA, 25 bp, Homo sapien
gctgcaacaggtcacgggctgctat

SEQ ID NO: 258554 - DNA, 25 bp, Homo sapien
aggtcacgggctgctattgtaaaca

SEQ ID NO: 258555 - DNA, 25 bp, Homo sapien
gggctgctattgtaaacactttttt

SEQ ID NO: 258556 - DNA, 25 bp, Homo sapien
ggataggttcaaataagagcttctt

SEQ ID NO: 258557 - DNA, 25 bp, Homo sapien
ataagagcttcttggcttggagaac

SEQ ID NO: 258558 - DNA, 25 bp, Homo sapien
gagcttcttggcttggagaactgag

SEQ ID NO: 258559 - DNA, 25 bp, Homo sapien
actaacctaatattctgaggacaag

SEQ ID NO: 258560 - DNA, 25 bp, Homo sapien
gacatttaataccacatgacttttt

SEQ ID NO: 258561 - DNA, 25 bp, Homo sapien
gtaagaggtctcattttctaaataa

SEQ ID NO: 258562 - DNA, 25 bp, Homo sapien
ctgaggttcagagttgagaggaaac

SEQ ID NO: 258563 - DNA, 25 bp, Homo sapien
taatgaaattgaactacagactatt

SEQ ID NO: 258564 - DNA, 25 bp, Homo sapien
taacgtacaatttcaaaacatgcaa

SEQ ID NO: 258565 - DNA, 25 bp, Homo sapien
catgcaaattagtgttatgtatttt

SEQ ID NO: 258566 - DNA, 25 bp, Homo sapien
ttttgtcatggctaaatactatata

SEQ ID NO: 258567 - DNA, 25 bp, Homo sapien
agattcagaacagtggtgacctgca

SEQ ID NO: 258568 - DNA, 25 bp, Homo sapien
attcagaacagtggtgacctgcagg

SEQ ID NO: 258569 - DNA, 25 bp, Homo sapien
gtgacctgcagggagaaagacaact

SEQ ID NO: 258570 - DNA, 25 bp, Homo sapien
gaataactagagatatttctgtcaa

SEQ ID NO: 258571 - DNA, 25 bp, Homo sapien
tagagatatttctgtcaacatgggt

SEQ ID NO: 258572 - DNA, 25 bp, Homo sapien
gtcaacatgggtaaacctcaaaaat

SEQ ID NO: 258573 - DNA, 25 bp, Homo sapien
catgggtaaacctcaaaaatagtat

SEQ ID NO: 258574 - DNA, 25 bp, Homo sapien
actccaggccaaaaatggcggccac

SEQ ID NO: 258575 - DNA, 25 bp, Homo sapien
tccaggccaaaaatggcggccacca

SEQ ID NO: 258576 - DNA, 25 bp, Homo sapien
aaggcgcccacgctgcgtaccaggc

SEQ ID NO: 258577 - DNA, 25 bp, Homo sapien
ggcccaggtctctgaagcagatcgg

SEQ ID NO: 258578 - DNA, 25 bp, Homo sapien
caggtctctgaagcagatcggcaca

SEQ ID NO: 258579 - DNA, 25 bp, Homo sapien
tctctgaagcagatcggcacactct

SEQ ID NO: 258580 - DNA, 25 bp, Homo sapien
gaagcagatcggcacactctggttg

SEQ ID NO: 258581 - DNA, 25 bp, Homo sapien
agcagatcggcacactctggttggt

SEQ ID NO: 258582 - DNA, 25 bp, Homo sapien
agatcggcacactctggttggtggt

SEQ ID NO: 258583 - DNA, 25 bp, Homo sapien
ttggtggtggtgcagaagtgccaga

SEQ ID NO: 258584 - DNA, 25 bp, Homo sapien
ggagaggacgaaagacaccaggagg

SEQ ID NO: 258585 - DNA, 25 bp, Homo sapien
tcaaagtccagttgctctccaagtt

SEQ ID NO: 258586 - DNA, 25 bp, Homo sapien
cttgcctcagacctttaagaccaaa

SEQ ID NO: 258587 - DNA, 25 bp, Homo sapien
agactgcaaaaccacagtgctgtac

SEQ ID NO: 258588 - DNA, 25 bp, Homo sapien
aaaaccacagtgctgtacctgccac

SEQ ID NO: 258589 - DNA, 25 bp, Homo sapien
caaggactggcgtcgaggcccaacc

SEQ ID NO: 258590 - DNA, 25 bp, Homo sapien
actacttttggttttgcaatgacag

SEQ ID NO: 258591 - DNA, 25 bp, Homo sapien
gtcgaggcccaacccaggaatgttg

SEQ ID NO: 258592 - DNA, 25 bp, Homo sapien
gggaagcagtttaggcctcatcaga

SEQ ID NO: 258593 - DNA, 25 bp, Homo sapien
gcagtttaggcctcatcagagctgg

SEQ ID NO: 258594 - DNA, 25 bp, Homo sapien
ttggttttgcaatgacagggtcgaa

SEQ ID NO: 258595 - DNA, 25 bp, Homo sapien
gacagggtcgaaaaaagccccagat

SEQ ID NO: 258596 - DNA, 25 bp, Homo sapien
cagttccaagtgttcctttgtgcta

SEQ ID NO: 258597 - DNA, 25 bp, Homo sapien
tgttcctttgtgctaaaatttacca

SEQ ID NO: 258598 - DNA, 25 bp, Homo sapien
tgtggcattcagttagtcttagaat

SEQ ID NO: 258599 - DNA, 25 bp, Homo sapien
atttaccaaagcttctgtggattga

SEQ ID NO: 258600 - DNA, 25 bp, Homo sapien
aagcttctgtggattgaggcagtta

SEQ ID NO: 258601 - DNA, 25 bp, Homo sapien
gggaaattctatcaacctaggagta

SEQ ID NO: 258602 - DNA, 25 bp, Homo sapien
gtctttcctttatctactcactttt

SEQ ID NO: 258603 - DNA, 25 bp, Homo sapien
tttcctttatctactcacttttctt

SEQ ID NO: 258604 - DNA, 25 bp, Homo sapien
tttctttctgcctgtgtgattctat

SEQ ID NO: 258605 - DNA, 25 bp, Homo sapien
gtcttagaatgtgggcctctttctt

SEQ ID NO: 258606 - DNA, 25 bp, Homo sapien
gcctccaaagcagctgatcaacaga

SEQ ID NO: 258607 - DNA, 25 bp, Homo sapien
agcacctcagaagatcaaggcttcc

SEQ ID NO: 258608 - DNA, 25 bp, Homo sapien
acctcagaagatcaaggcttccaaa

SEQ ID NO: 258609 - DNA, 25 bp, Homo sapien
aagatcaaggcttccaaattctcct

SEQ ID NO: 258610 - DNA, 25 bp, Homo sapien
gggaacagacgtcagccattcagca

SEQ ID NO: 258611 - DNA, 25 bp, Homo sapien
ggaacagacgtcagccattcagcac

SEQ ID NO: 258612 - DNA, 25 bp, Homo sapien
gaacagacgtcagccattcagcaca

SEQ ID NO: 258613 - DNA, 25 bp, Homo sapien
acagacgtcagccattcagcacaaa

SEQ ID NO: 258614 - DNA, 25 bp, Homo sapien
cagacgtcagccattcagcacaaag

SEQ ID NO: 258615 - DNA, 25 bp, Homo sapien
agacgtcagccattcagcacaaagg

SEQ ID NO: 258616 - DNA, 25 bp, Homo sapien
gacgtcagccattcagcacaaagga

SEQ ID NO: 258617 - DNA, 25 bp, Homo sapien
tcagcacaaaggaaacttccttctc

SEQ ID NO: 258618 - DNA, 25 bp, Homo sapien
cgcctgcggaattcccgggagagtt

SEQ ID NO: 258619 - DNA, 25 bp, Homo sapien
gaattcccgggagagttccaaagcg

SEQ ID NO: 258620 - DNA, 25 bp, Homo sapien
gagagttccaaagcggtgcgtccaa

SEQ ID NO: 258621 - DNA, 25 bp, Homo sapien
ttccaaagcggtgcgtccaagtttt

SEQ ID NO: 258622 - DNA, 25 bp, Homo sapien
agcggtgcgtccaagttttccggca

SEQ ID NO: 258623 - DNA, 25 bp, Homo sapien
gtcacgatgacgtccatccaaatgc

SEQ ID NO: 258624 - DNA, 25 bp, Homo sapien
gatgacgtccatccaaatgcgcatg

SEQ ID NO: 258625 - DNA, 25 bp, Homo sapien
gtccatccaaatgcgcatggcttcg

SEQ ID NO: 258626 - DNA, 25 bp, Homo sapien
tgcaacccagaacgcagcagctcag

SEQ ID NO: 258627 - DNA, 25 bp, Homo sapien
gaacgcagcagctcaggccagctga

SEQ ID NO: 258628 - DNA, 25 bp, Homo sapien
agctcaggccagctgaactgccgcg

SEQ ID NO: 258629 - DNA, 25 bp, Homo sapien
gaggctcctagccacaagaacggtg

SEQ ID NO: 258630 - DNA, 25 bp, Homo sapien
ttccagcctaccgtagaggaaaggc

SEQ ID NO: 258631 - DNA, 25 bp, Homo sapien
agaggcggctcagtaccagcctgtc

SEQ ID NO: 258632 - DNA, 25 bp, Homo sapien
agtcatccctgaattttcccggcac

SEQ ID NO: 258633 - DNA, 25 bp, Homo sapien
gctcctcaggccgaatagtgtatga

SEQ ID NO: 258634 - DNA, 25 bp, Homo sapien
aggccgaatagtgtatgatgcccgg

SEQ ID NO: 258635 - DNA, 25 bp, Homo sapien
tatgatgcccgggacatgagacggc

SEQ ID NO: 258636 - DNA, 25 bp, Homo sapien
ggaaaggcccctcaaaacaggcata

SEQ ID NO: 258637 - DNA, 25 bp, Homo sapien
aacaggcatatggtccgagctgggc

SEQ ID NO: 258638 - DNA, 25 bp, Homo sapien
catatggtccgagctgggcctaagg

SEQ ID NO: 258639 - DNA, 25 bp, Homo sapien
gcctaagggcctatgtgtatcctgt

SEQ ID NO: 258640 - DNA, 25 bp, Homo sapien
caatctggatcaactttcttacaaa

SEQ ID NO: 258641 - DNA, 25 bp, Homo sapien
atctggatcaactttcttacaaaaa

SEQ ID NO: 258642 - DNA, 25 bp, Homo sapien
gatcaactttcttacaaaaacggtg

SEQ ID NO: 258643 - DNA, 25 bp, Homo sapien
tttcttacaaaaacggtgtgctttg

SEQ ID NO: 258644 - DNA, 25 bp, Homo sapien
ttacaaaaacggtgtgctttgaaat

SEQ ID NO: 258645 - DNA, 25 bp, Homo sapien
gtgctttgaaatgccaggatggctg

SEQ ID NO: 258646 - DNA, 25 bp, Homo sapien
ccaggatggctgattttacttattt

SEQ ID NO: 258647 - DNA, 25 bp, Homo sapien
tctttgttgctttcagtgaagcaaa

SEQ ID NO: 258648 - DNA, 25 bp, Homo sapien
gagttaaactgattacagggaacgt

SEQ ID NO: 258649 - DNA, 25 bp, Homo sapien
ggcccacttgtttataaagcaatat

SEQ ID NO: 258650 - DNA, 25 bp, Homo sapien
aatggtatgtgtaacaatctggatc

SEQ ID NO: 258651 - DNA, 25 bp, Homo sapien
tccagctttctgtattcaaacttgt

SEQ ID NO: 258652 - DNA, 25 bp, Homo sapien
ttctgtattcaaacttgtgccttca

SEQ ID NO: 258653 - DNA, 25 bp, Homo sapien
tgtgccttcagcaagcatctcttca

SEQ ID NO: 258654 - DNA, 25 bp, Homo sapien
tttctttcccttgtcaattgaaaca

SEQ ID NO: 258655 - DNA, 25 bp, Homo sapien
tcccttgtcaattgaaacatgaatg

SEQ ID NO: 258656 - DNA, 25 bp, Homo sapien
gaatgtttggctaactcatgatgta

SEQ ID NO: 258657 - DNA, 25 bp, Homo sapien
ctcatgatgtaaagtgtctgttaag

SEQ ID NO: 258658 - DNA, 25 bp, Homo sapien
tcaggacatctttaaccaatacaaa

SEQ ID NO: 258659 - DNA, 25 bp, Homo sapien
aatttaaagcacttagtctccacaa

SEQ ID NO: 258660 - DNA, 25 bp, Homo sapien
aagcacttagtctccacaaagcaat

SEQ ID NO: 258661 - DNA, 25 bp, Homo sapien
cttagtctccacaaagcaatttaga

SEQ ID NO: 258662 - DNA, 25 bp, Homo sapien
ggtaggtagcaaactccccagaagt

SEQ ID NO: 258663 - DNA, 25 bp, Homo sapien
caaactccccagaagtatgaactct

SEQ ID NO: 258664 - DNA, 25 bp, Homo sapien
gtatgaactctggattagacatctc

SEQ ID NO: 258665 - DNA, 25 bp, Homo sapien
gacatctcagaatacatgagcactc

SEQ ID NO: 258666 - DNA, 25 bp, Homo sapien
tgagcactcatgttggcttgctttg

SEQ ID NO: 258667 - DNA, 25 bp, Homo sapien
gctttgtagctatgaacttaccctg

SEQ ID NO: 258668 - DNA, 25 bp, Homo sapien
ttcccatttcattataaaacctctt

SEQ ID NO: 258669 - DNA, 25 bp, Homo sapien
gaacttaccctgtattattgaaatg

SEQ ID NO: 258670 - DNA, 25 bp, Homo sapien
aattggtccattttagagcattact

SEQ ID NO: 258671 - DNA, 25 bp, Homo sapien
actattatgctatctgtccatttaa

SEQ ID NO: 258672 - DNA, 25 bp, Homo sapien
gaaatggcctatagattaaaaagct

SEQ ID NO: 258673 - DNA, 25 bp, Homo sapien
gtgatcccgccaagtatattcatcg

SEQ ID NO: 258674 - DNA, 25 bp, Homo sapien
aagtatattcatcgctcaccaagga

SEQ ID NO: 258675 - DNA, 25 bp, Homo sapien
gacgttcaaggctattaccctgggc

SEQ ID NO: 258676 - DNA, 25 bp, Homo sapien
ggcagctggcaagactccattttga

SEQ ID NO: 258677 - DNA, 25 bp, Homo sapien
gagagctcccagattggaaccagaa

SEQ ID NO: 258678 - DNA, 25 bp, Homo sapien
attagccacagtttcgctgaatcct

SEQ ID NO: 258679 - DNA, 25 bp, Homo sapien
tcgaccgcttaattcactgccagag

SEQ ID NO: 258680 - DNA, 25 bp, Homo sapien
actgccagagctctactgttgtgaa

SEQ ID NO: 258681 - DNA, 25 bp, Homo sapien
aagcagattcccatccatcatgact

SEQ ID NO: 258682 - DNA, 25 bp, Homo sapien
gactgccatccgactacgagaattt

SEQ ID NO: 258683 - DNA, 25 bp, Homo sapien
gagaatttattgagcgtcgcccagt

SEQ ID NO: 258684 - DNA, 25 bp, Homo sapien
tgtcaacccggctgcattaaatcct

SEQ ID NO: 258685 - DNA, 25 bp, Homo sapien
ggctgcattaaatcctgcctcattg

SEQ ID NO: 258686 - DNA, 25 bp, Homo sapien
gcctcattgcagtgtaagttggacg

SEQ ID NO: 258687 - DNA, 25 bp, Homo sapien
aggatataccaaccagacttcttct

SEQ ID NO: 258688 - DNA, 25 bp, Homo sapien
accagacttcttctttcttatgatt

SEQ ID NO: 258689 - DNA, 25 bp, Homo sapien
gattatcattcaccttacaccatgg

SEQ ID NO: 258690 - DNA, 25 bp, Homo sapien
atcattcaccttacaccatggactg

SEQ ID NO: 258691 - DNA, 25 bp, Homo sapien
tggactgccatagagccaaagccag

SEQ ID NO: 258692 - DNA, 25 bp, Homo sapien
actctgtctctgatgctggtttcta

SEQ ID NO: 258693 - DNA, 25 bp, Homo sapien
ttctactgtgttggagttctgccta

SEQ ID NO: 258694 - DNA, 25 bp, Homo sapien
ttcattctcctgtctgtcaacccgg

SEQ ID NO: 258695 - DNA, 25 bp, Homo sapien
taaatgtaacaatctaaggcactag

SEQ ID NO: 258696 - DNA, 25 bp, Homo sapien
ggcactagaacaatgctgaacacat

SEQ ID NO: 258697 - DNA, 25 bp, Homo sapien
aatagtgagtccaaagtctcaggac

SEQ ID NO: 258698 - DNA, 25 bp, Homo sapien
gtctcaggactcttcactgatgctg

SEQ ID NO: 258699 - DNA, 25 bp, Homo sapien
actgatgctgcttctactattggac

SEQ ID NO: 258700 - DNA, 25 bp, Homo sapien
tactattggaccctggaactcaaca

SEQ ID NO: 258701 - DNA, 25 bp, Homo sapien
ccctgatcttttacttcctgaaaca

SEQ ID NO: 258702 - DNA, 25 bp, Homo sapien
caggctgttctgataaatgtctatt

SEQ ID NO: 258703 - DNA, 25 bp, Homo sapien
aatgtctattaatttggtgcaggga

SEQ ID NO: 258704 - DNA, 25 bp, Homo sapien
aagtgggtcactttgaagctaatat

SEQ ID NO: 258705 - DNA, 25 bp, Homo sapien
gctaatatagtctaattacccacat

SEQ ID NO: 258706 - DNA, 25 bp, Homo sapien
gaaactaatacttctcttctttgtt

SEQ ID NO: 258707 - DNA, 25 bp, Homo sapien
aagcataaactgagtttccctcaaa

SEQ ID NO: 258708 - DNA, 25 bp, Homo sapien
actgagtttccctcaaatagggcaa

SEQ ID NO: 258709 - DNA, 25 bp, Homo sapien
atagggcaaaaatggccatgggtgt

SEQ ID NO: 258710 - DNA, 25 bp, Homo sapien
gtcccaggggagtagctagaattgc

SEQ ID NO: 258711 - DNA, 25 bp, Homo sapien
agaattgctaaggatcccctcagct

SEQ ID NO: 258712 - DNA, 25 bp, Homo sapien
tggatatggataaaaggactagcta

SEQ ID NO: 258713 - DNA, 25 bp, Homo sapien
ggactagctatttctactatctccc

SEQ ID NO: 258714 - DNA, 25 bp, Homo sapien
agctatttctactatctcccatttg

SEQ ID NO: 258715 - DNA, 25 bp, Homo sapien
atttctactatctcccatttgcaaa

SEQ ID NO: 258716 - DNA, 25 bp, Homo sapien
tactatctcccatttgcaaaatgag

SEQ ID NO: 258717 - DNA, 25 bp, Homo sapien
attctagtcattttgacctccctga

SEQ ID NO: 258718 - DNA, 25 bp, Homo sapien
attttgacctccctgaattccaatc

SEQ ID NO: 258719 - DNA, 25 bp, Homo sapien
tgaattccaatctcttctcacctca

SEQ ID NO: 258720 - DNA, 25 bp, Homo sapien
gagaacgtataatccccttcttgag

SEQ ID NO: 258721 - DNA, 25 bp, Homo sapien
atccccttcttgagctgtgtaaaac

SEQ ID NO: 258722 - DNA, 25 bp, Homo sapien
gaactattcctagactcattctggg

SEQ ID NO: 258723 - DNA, 25 bp, Homo sapien
ttcctgcttctcaagtgtcacaaga

SEQ ID NO: 258724 - DNA, 25 bp, Homo sapien
gtgtcacaagactatgttgcctatt

SEQ ID NO: 258725 - DNA, 25 bp, Homo sapien
ttctgggaatagttcggccaacttt

SEQ ID NO: 258726 - DNA, 25 bp, Homo sapien
gtttcaccatctctggaattctgct

SEQ ID NO: 258727 - DNA, 25 bp, Homo sapien
attctgctgcataaattctagtcat

SEQ ID NO: 258728 - DNA, 25 bp, Homo sapien
gaaaggccaagttgcacactactga

SEQ ID NO: 258729 - DNA, 25 bp, Homo sapien
acactactgagagactgccatgcac

SEQ ID NO: 258730 - DNA, 25 bp, Homo sapien
tggaggcctcagaacattcgacatg

SEQ ID NO: 258731 - DNA, 25 bp, Homo sapien
gaacattcgacatgctccagtcatg

SEQ ID NO: 258732 - DNA, 25 bp, Homo sapien
tcatggccacggcagtgactgctga

SEQ ID NO: 258733 - DNA, 25 bp, Homo sapien
agtgactgctgattgcctaacccca

SEQ ID NO: 258734 - DNA, 25 bp, Homo sapien
aatcaagcccctgattttcagctgg

SEQ ID NO: 258735 - DNA, 25 bp, Homo sapien
ccctgtcgccgatgtgttctttgaa

SEQ ID NO: 258736 - DNA, 25 bp, Homo sapien
attcttcctagaacaactccacgtg

SEQ ID NO: 258737 - DNA, 25 bp, Homo sapien
gtgcctgatacctgctggagagtcc

SEQ ID NO: 258738 - DNA, 25 bp, Homo sapien
cgccttgagcttctgggtcgagaaa

SEQ ID NO: 258739 - DNA, 25 bp, Homo sapien
tataccatgtccttgctgccaaata

SEQ ID NO: 258740 - DNA, 25 bp, Homo sapien
gactggaaagatggctgtcctccca

SEQ ID NO: 258741 - DNA, 25 bp, Homo sapien
ctcccaggactgtcgagtccaaggg

SEQ ID NO: 258742 - DNA, 25 bp, Homo sapien
gaacgagccggatggctgtgcttca

SEQ ID NO: 258743 - DNA, 25 bp, Homo sapien
tcagggagttgcagagagcgtctat

SEQ ID NO: 258744 - DNA, 25 bp, Homo sapien
gagagcgtctataccatcaacagtg

SEQ ID NO: 258745 - DNA, 25 bp, Homo sapien
atcaacagtgggtctacctctagcg

SEQ ID NO: 258746 - DNA, 25 bp, Homo sapien
gtgggtctacctctagcgaaagtga

SEQ ID NO: 258747 - DNA, 25 bp, Homo sapien
aagtgagcctgaactgggagagatc

SEQ ID NO: 258748 - DNA, 25 bp, Homo sapien
agagatccgggattcctcagcaagc

SEQ ID NO: 258749 - DNA, 25 bp, Homo sapien
cccgaacctggctacaacattaaca

SEQ ID NO: 258750 - DNA, 25 bp, Homo sapien
gcacggagggcacagtctcctgtca

SEQ ID NO: 258751 - DNA, 25 bp, Homo sapien
acagtctcctgtcaggctcggagag

SEQ ID NO: 258752 - DNA, 25 bp, Homo sapien
aaaggaatcctatatctagtcctat

SEQ ID NO: 258753 - DNA, 25 bp, Homo sapien
tctaactgacgtttcttttcgagga

SEQ ID NO: 258754 - DNA, 25 bp, Homo sapien
gaagtggcttggtgggtgcagcccc

SEQ ID NO: 258755 - DNA, 25 bp, Homo sapien
ccggttccgttgacgctggcacctt

SEQ ID NO: 258756 - DNA, 25 bp, Homo sapien
acgctggcaccttctgttgattttt

SEQ ID NO: 258757 - DNA, 25 bp, Homo sapien
aagccacatgctatgatgaataaac

SEQ ID NO: 258758 - DNA, 25 bp, Homo sapien
catgctatgatgaataaactgattt

SEQ ID NO: 258759 - DNA, 25 bp, Homo sapien
tttctaccattactgaacattagga

SEQ ID NO: 258760 - DNA, 25 bp, Homo sapien
attactgaacattaggacaaacaca

SEQ ID NO: 258761 - DNA, 25 bp, Homo sapien
ccatgacccacttgcactgtgagtg

SEQ ID NO: 258762 - DNA, 25 bp, Homo sapien
ccgatgagtgtgacttggttcctga

SEQ ID NO: 258763 - DNA, 25 bp, Homo sapien
tgaggaactccaggccaaaaatggc

SEQ ID NO: 258764 - DNA, 25 bp, Homo sapien
tccaggccaaaaatggcggccacca

SEQ ID NO: 258765 - DNA, 25 bp, Homo sapien
aaggcgcccacgctgcgtaccaggc

SEQ ID NO: 258766 - DNA, 25 bp, Homo sapien
ggcccaggtctctgaagcagatcgg

SEQ ID NO: 258767 - DNA, 25 bp, Homo sapien
tctctgaagcagatcggcacactct

SEQ ID NO: 258768 - DNA, 25 bp, Homo sapien
gaagcagatcggcacactctggttg

SEQ ID NO: 258769 - DNA, 25 bp, Homo sapien
agatcggcacactctggttggtggt

SEQ ID NO: 258770 - DNA, 25 bp, Homo sapien
ttggtggtggtgcagaagtgccaga

SEQ ID NO: 258771 - DNA, 25 bp, Homo sapien
ttcctgaggaggatcacaaaaccca

SEQ ID NO: 258772 - DNA, 25 bp, Homo sapien
gaccctgtcccgacaaaatggagtt

SEQ ID NO: 258773 - DNA, 25 bp, Homo sapien
ccgacaaaatggagttccccgtgtg

SEQ ID NO: 258774 - DNA, 25 bp, Homo sapien
tgtggcttcagctcgcggcgcgttc

SEQ ID NO: 258775 - DNA, 25 bp, Homo sapien
cagagctcctcagtgatccggcttt

SEQ ID NO: 258776 - DNA, 25 bp, Homo sapien
agtgatccggctttcggattgttcg

SEQ ID NO: 258777 - DNA, 25 bp, Homo sapien
ggattgttcgcctttcatctcattt

SEQ ID NO: 258778 - DNA, 25 bp, Homo sapien
catttgccgttgtccaaattctaat

SEQ ID NO: 258779 - DNA, 25 bp, Homo sapien
aaaactcatgtgttacttgctgtaa

SEQ ID NO: 258780 - DNA, 25 bp, Homo sapien
gttaacaaacgtacaccgcaaactg

SEQ ID NO: 258781 - DNA, 25 bp, Homo sapien
aacgtacaccgcaaactggataaag

SEQ ID NO: 258782 - DNA, 25 bp, Homo sapien
gaaactacccgactccctggaggcg

SEQ ID NO: 258783 - DNA, 25 bp, Homo sapien
gcttcccgaggatgaatgctgtgtt

SEQ ID NO: 258784 - DNA, 25 bp, Homo sapien
gtaaatttgtcactctagcattttg

SEQ ID NO: 258785 - DNA, 25 bp, Homo sapien
ataatgacatcccagttcatggagg

SEQ ID NO: 258786 - DNA, 25 bp, Homo sapien
gttatcctgaaactttctatgctca

SEQ ID NO: 258787 - DNA, 25 bp, Homo sapien
tgaaactttctatgctcagtggaaa

SEQ ID NO: 258788 - DNA, 25 bp, Homo sapien
ctcagtggaaagtatctgccagcca

SEQ ID NO: 258789 - DNA, 25 bp, Homo sapien
aagtatctgccagccacagcatgag

SEQ ID NO: 258790 - DNA, 25 bp, Homo sapien
ccagccacagcatgaggcctgtgaa

SEQ ID NO: 258791 - DNA, 25 bp, Homo sapien
gaaggctgactgagaaatcctctgc

SEQ ID NO: 258792 - DNA, 25 bp, Homo sapien
tgctgaagacccctggttctgttct

SEQ ID NO: 258793 - DNA, 25 bp, Homo sapien
ttctgcctccaacatgtataatttt

SEQ ID NO: 258794 - DNA, 25 bp, Homo sapien
gaattagagacaatgcagaatgaat

SEQ ID NO: 258795 - DNA, 25 bp, Homo sapien
gagacaatgcagaatgaatatcaat

SEQ ID NO: 258796 - DNA, 25 bp, Homo sapien
gcagaatgaatatcaatcaggattt

SEQ ID NO: 258797 - DNA, 25 bp, Homo sapien
gatttaaatcaattcatgactctct

SEQ ID NO: 258798 - DNA, 25 bp, Homo sapien
aatcaattcatgactctctcagctc

SEQ ID NO: 258799 - DNA, 25 bp, Homo sapien
atcaattcatgactctctcagctcc

SEQ ID NO: 258800 - DNA, 25 bp, Homo sapien
tcagctccctccaacaaatacagaa

SEQ ID NO: 258801 - DNA, 25 bp, Homo sapien
cagctccctccaacaaatacagaaa

SEQ ID NO: 258802 - DNA, 25 bp, Homo sapien
gctccctccaacaaatacagaaaac

SEQ ID NO: 258803 - DNA, 25 bp, Homo sapien
aaagaaattacagcgcaagatagtg

SEQ ID NO: 258804 - DNA, 25 bp, Homo sapien
agcgcaagatagtggaactccagga

SEQ ID NO: 258805 - DNA, 25 bp, Homo sapien
aaagccgcagggaccatccctggag

SEQ ID NO: 258806 - DNA, 25 bp, Homo sapien
gtccaggtgctggtatttttcatta

SEQ ID NO: 258807 - DNA, 25 bp, Homo sapien
tggtatttttcattagcctccaggg

SEQ ID NO: 258808 - DNA, 25 bp, Homo sapien
tgatgtagccagcagcgtccttgga

SEQ ID NO: 258809 - DNA, 25 bp, Homo sapien
ggacaacagtttgagatctgctgct

SEQ ID NO: 258810 - DNA, 25 bp, Homo sapien
gagatctgctgcttttcaaactgga

SEQ ID NO: 258811 - DNA, 25 bp, Homo sapien
aaactggattccttggagcgctgga

SEQ ID NO: 258812 - DNA, 25 bp, Homo sapien
aaatctcagcgatgtcacagggcag

SEQ ID NO: 258813 - DNA, 25 bp, Homo sapien
ggaaaattcagacttcccgcccagc

SEQ ID NO: 258814 - DNA, 25 bp, Homo sapien
accatttcaccaggcagctctaaat

SEQ ID NO: 258815 - DNA, 25 bp, Homo sapien
ataagccaaggttcacacaaaaaag

SEQ ID NO: 258816 - DNA, 25 bp, Homo sapien
tgatctggccctcaggactcagttc

SEQ ID NO: 258817 - DNA, 25 bp, Homo sapien
ggactcagttccaatagcactatct

SEQ ID NO: 258818 - DNA, 25 bp, Homo sapien
tagcactatctctgcagaggcttcc

SEQ ID NO: 258819 - DNA, 25 bp, Homo sapien
tgcagaggcttccttggtacttatt

SEQ ID NO: 258820 - DNA, 25 bp, Homo sapien
taagtgcctgtggttgtctcaacta

SEQ ID NO: 258821 - DNA, 25 bp, Homo sapien
tcaactaggctgagactggaactat

SEQ ID NO: 258822 - DNA, 25 bp, Homo sapien
tgactgcggaaggaggaacatccat

SEQ ID NO: 258823 - DNA, 25 bp, Homo sapien
ctccgtccccaagtgatgaatggtg

SEQ ID NO: 258824 - DNA, 25 bp, Homo sapien
gtgtcttaaacagtggtcaccacat

SEQ ID NO: 258825 - DNA, 25 bp, Homo sapien
acagtggtcaccacatacagtctct

SEQ ID NO: 258826 - DNA, 25 bp, Homo sapien
acatacagtctctgagggcccagcc

SEQ ID NO: 258827 - DNA, 25 bp, Homo sapien
gattcattcccataggctcaactta

SEQ ID NO: 258828 - DNA, 25 bp, Homo sapien
caacttagattcctaaaccctgctc

SEQ ID NO: 258829 - DNA, 25 bp, Homo sapien
tgaaaggttgtagtggctggcctct

SEQ ID NO: 258830 - DNA, 25 bp, Homo sapien
actttataagcaccaaattccattt

SEQ ID NO: 258831 - DNA, 25 bp, Homo sapien
ttccatttaaaaagtgccttcctgt

SEQ ID NO: 258832 - DNA, 25 bp, Homo sapien
aatatctataatggcttctgtttcc

SEQ ID NO: 258833 - DNA, 25 bp, Homo sapien
tcctgcattgaaagctgactgatct

SEQ ID NO: 258834 - DNA, 25 bp, Homo sapien
tgaaagctgactgatctggagggca

SEQ ID NO: 258835 - DNA, 25 bp, Homo sapien
gggcaattgggcaacagcaatcaaa

SEQ ID NO: 258836 - DNA, 25 bp, Homo sapien
tggtgaccagaggttgtagttcccc

SEQ ID NO: 258837 - DNA, 25 bp, Homo sapien
tttgtgtcactgtgggattcattcc

SEQ ID NO: 258838 - DNA, 25 bp, Homo sapien
acctcccgtccaaagcgaaatatat

SEQ ID NO: 258839 - DNA, 25 bp, Homo sapien
tgccctctatttatacttttacagc

SEQ ID NO: 258840 - DNA, 25 bp, Homo sapien
tttatacttttacagcatttggcac

SEQ ID NO: 258841 - DNA, 25 bp, Homo sapien
agagtagtagctttttatcacattc

SEQ ID NO: 258842 - DNA, 25 bp, Homo sapien
gatatggtatttcttagctctctct

SEQ ID NO: 258843 - DNA, 25 bp, Homo sapien
agctctctctccaactggctaataa

SEQ ID NO: 258844 - DNA, 25 bp, Homo sapien
ggctaataagttgctttttgtctga

SEQ ID NO: 258845 - DNA, 25 bp, Homo sapien
ttgtctgagtgcctaattttgtgtt

SEQ ID NO: 258846 - DNA, 25 bp, Homo sapien
gcatcagactgaatatccctcttgt

SEQ ID NO: 258847 - DNA, 25 bp, Homo sapien
tgaatatccctcttgtgcggccttc

SEQ ID NO: 258848 - DNA, 25 bp, Homo sapien
tgtgcggccttctaaaacctcccgt

SEQ ID NO: 258849 - DNA, 25 bp, Homo sapien
aggatataccaaccagacttcttct

SEQ ID NO: 258850 - DNA, 25 bp, Homo sapien
accagacttcttctttcttatgatt

SEQ ID NO: 258851 - DNA, 25 bp, Homo sapien
cagacttcttctttcttatgattat

SEQ ID NO: 258852 - DNA, 25 bp, Homo sapien
gattatcattcaccttacaccatgg

SEQ ID NO: 258853 - DNA, 25 bp, Homo sapien
ttatcattcaccttacaccatggac

SEQ ID NO: 258854 - DNA, 25 bp, Homo sapien
tcattcaccttacaccatggactgc

SEQ ID NO: 258855 - DNA, 25 bp, Homo sapien
tggactgccatagagccaaagccag

SEQ ID NO: 258856 - DNA, 25 bp, Homo sapien
aaagttattggggtgcatagcagcc

SEQ ID NO: 258857 - DNA, 25 bp, Homo sapien
tgtgttggagttctgcctagctgtg

SEQ ID NO: 258858 - DNA, 25 bp, Homo sapien
ttcattctcctgtctgtcaacccgg

SEQ ID NO: 258859 - DNA, 25 bp, Homo sapien
tcctgtctgtcaacccggctgcatt

SEQ ID NO: 258860 - DNA, 25 bp, Homo sapien
taagtgttccttctgattcacgtat

SEQ ID NO: 258861 - DNA, 25 bp, Homo sapien
aagtgttccttctgattcacgtatg

SEQ ID NO: 258862 - DNA, 25 bp, Homo sapien
agtgttccttctgattcacgtatgt

SEQ ID NO: 258863 - DNA, 25 bp, Homo sapien
gtgttccttctgattcacgtatgtg

SEQ ID NO: 258864 - DNA, 25 bp, Homo sapien
gttccttctgattcacgtatgtgca

SEQ ID NO: 258865 - DNA, 25 bp, Homo sapien
tccttctgattcacgtatgtgcatg

SEQ ID NO: 258866 - DNA, 25 bp, Homo sapien
cttctgattcacgtatgtgcatgta

SEQ ID NO: 258867 - DNA, 25 bp, Homo sapien
tctgattcacgtatgtgcatgtatt

SEQ ID NO: 258868 - DNA, 25 bp, Homo sapien
gattcacgtatgtgcatgtatttgt

SEQ ID NO: 258869 - DNA, 25 bp, Homo sapien
ttcacgtatgtgcatgtatttgtaa

SEQ ID NO: 258870 - DNA, 25 bp, Homo sapien
gcatgtatttgtaaaagtgtgtttg

SEQ ID NO: 258871 - DNA, 25 bp, Homo sapien
taatgttgcctcctttttagtaaga

SEQ ID NO: 258872 - DNA, 25 bp, Homo sapien
gcctcctttttagtaagattctacg

SEQ ID NO: 258873 - DNA, 25 bp, Homo sapien
gggtagctcttatacttcctctgct

SEQ ID NO: 258874 - DNA, 25 bp, Homo sapien
ttcctctgctctctttttcagtttc

SEQ ID NO: 258875 - DNA, 25 bp, Homo sapien
gctgttttcttagctattactccaa

SEQ ID NO: 258876 - DNA, 25 bp, Homo sapien
ttctctccgctaacctgagtgtcca

SEQ ID NO: 258877 - DNA, 25 bp, Homo sapien
tgagtgtccacagtagatatcgaga

SEQ ID NO: 258878 - DNA, 25 bp, Homo sapien
tccacagtagatatcgagacagctt

SEQ ID NO: 258879 - DNA, 25 bp, Homo sapien
gtagatatcgagacagctttaggaa

SEQ ID NO: 258880 - DNA, 25 bp, Homo sapien
acagctttaggaaggtgacggtcat

SEQ ID NO: 258881 - DNA, 25 bp, Homo sapien
gtgcctgtcatcttcagattcttca

SEQ ID NO: 258882 - DNA, 25 bp, Homo sapien
gaggcagagcaagagctagagaatt

SEQ ID NO: 258883 - DNA, 25 bp, Homo sapien
ctagagaattggtttccttgcttcc

SEQ ID NO: 258884 - DNA, 25 bp, Homo sapien
cttgcttccctgtatgctcagaaaa

SEQ ID NO: 258885 - DNA, 25 bp, Homo sapien
tgcttccctgtatgctcagaaaaca

SEQ ID NO: 258886 - DNA, 25 bp, Homo sapien
aaacattgatttgagcatagacgca

SEQ ID NO: 258887 - DNA, 25 bp, Homo sapien
attgatttgagcatagacgcagaga

SEQ ID NO: 258888 - DNA, 25 bp, Homo sapien
tatattttgcttactaccttttttg

SEQ ID NO: 258889 - DNA, 25 bp, Homo sapien
tccttttgtggagagggcgatgaat

SEQ ID NO: 258890 - DNA, 25 bp, Homo sapien
gttgataacaatatagtcggtgctt

SEQ ID NO: 258891 - DNA, 25 bp, Homo sapien
caatatagtcggtgcttctagttat

SEQ ID NO: 258892 - DNA, 25 bp, Homo sapien
ttatatgcaagtactcagtgataaa

SEQ ID NO: 258893 - DNA, 25 bp, Homo sapien
actgtaattagtacattcattattg

SEQ ID NO: 258894 - DNA, 25 bp, Homo sapien
gtgccaaacataacttggtgagcaa

SEQ ID NO: 258895 - DNA, 25 bp, Homo sapien
ggtgagcaaattaaacttacatacg

SEQ ID NO: 258896 - DNA, 25 bp, Homo sapien
agtattatatgtctaatctccccaa

SEQ ID NO: 258897 - DNA, 25 bp, Homo sapien
atatgtctaatctccccaaaacttc

SEQ ID NO: 258898 - DNA, 25 bp, Homo sapien
gtctaatctccccaaaacttcaaag

SEQ ID NO: 258899 - DNA, 25 bp, Homo sapien
tctccccaaaacttcaaagctaatt

SEQ ID NO: 258900 - DNA, 25 bp, Homo sapien
aactccttattcttctctctcttgt

SEQ ID NO: 258901 - DNA, 25 bp, Homo sapien
ttattcttctctctcttgttcttcc

SEQ ID NO: 258902 - DNA, 25 bp, Homo sapien
gactggaacccaagcctcttaagac

SEQ ID NO: 258903 - DNA, 25 bp, Homo sapien
tggaacccaagcctcttaagaccaa

SEQ ID NO: 258904 - DNA, 25 bp, Homo sapien
gttctgtgactttaaagtcttgcaa

SEQ ID NO: 258905 - DNA, 25 bp, Homo sapien
taatgggtgctttaataagaactct

SEQ ID NO: 258906 - DNA, 25 bp, Homo sapien
agaactcttgatacttttgttattg

SEQ ID NO: 258907 - DNA, 25 bp, Homo sapien
ggatgatattgttttggatttggaa

SEQ ID NO: 258908 - DNA, 25 bp, Homo sapien
aaatgtattctttcttatgcaatct

SEQ ID NO: 258909 - DNA, 25 bp, Homo sapien
atgcaatcttatgcagtcatactgc

SEQ ID NO: 258910 - DNA, 25 bp, Homo sapien
gcagtcatactgcttgaatatcatt

SEQ ID NO: 258911 - DNA, 25 bp, Homo sapien
tactgcttgaatatcattacctgaa

SEQ ID NO: 258912 - DNA, 25 bp, Homo sapien
tatcattacctgaatttatctttct

SEQ ID NO: 258913 - DNA, 25 bp, Homo sapien
gttgttgttttacactctacttatt

SEQ ID NO: 258914 - DNA, 25 bp, Homo sapien
ttacactctacttatttggtgcctg

SEQ ID NO: 258915 - DNA, 25 bp, Homo sapien
gatgacattccaattaaagcacgtg

SEQ ID NO: 258916 - DNA, 25 bp, Homo sapien
aaagcacgtgttagactgctgacgc

SEQ ID NO: 258917 - DNA, 25 bp, Homo sapien
cacgtgttagactgctgacgcgggt

SEQ ID NO: 258918 - DNA, 25 bp, Homo sapien
gtgatgcgaactggagtctgagcct

SEQ ID NO: 258919 - DNA, 25 bp, Homo sapien
gaactggagtctgagcctgcccgag

SEQ ID NO: 258920 - DNA, 25 bp, Homo sapien
aggttgtattcctggcgggtcgtct

SEQ ID NO: 258921 - DNA, 25 bp, Homo sapien
tgatctatcactctcgttcttgtag

SEQ ID NO: 258922 - DNA, 25 bp, Homo sapien
gttcttgtagctcccagccgaggac

SEQ ID NO: 258923 - DNA, 25 bp, Homo sapien
cagccgaggacgtcggatgtcatcg

SEQ ID NO: 258924 - DNA, 25 bp, Homo sapien
gatgtcatcgtccttgctgctttgc

SEQ ID NO: 258925 - DNA, 25 bp, Homo sapien
ggcctgctgtgatgacattccaatt

SEQ ID NO: 258926 - DNA, 25 bp, Homo sapien
ctatcctaccaacccgtgtgatgga

SEQ ID NO: 258927 - DNA, 25 bp, Homo sapien
ccgtgtgatggaccctggaccacaa

SEQ ID NO: 258928 - DNA, 25 bp, Homo sapien
gggttgactgcactcatcatccaca

SEQ ID NO: 258929 - DNA, 25 bp, Homo sapien
actgcactcatcatccacaggatgt

SEQ ID NO: 258930 - DNA, 25 bp, Homo sapien
cacaggatgtgcacacttacttcac

SEQ ID NO: 258931 - DNA, 25 bp, Homo sapien
ttacttcacagacactcttctgcag

SEQ ID NO: 258932 - DNA, 25 bp, Homo sapien
gacactcttctgcagtctcaaaatc

SEQ ID NO: 258933 - DNA, 25 bp, Homo sapien
tctgcagtctcaaaatctcacccat

SEQ ID NO: 258934 - DNA, 25 bp, Homo sapien
aaaatctcacccatcaactatgacc

SEQ ID NO: 258935 - DNA, 25 bp, Homo sapien
ctgctgccccaacaacatatttaat

SEQ ID NO: 258936 - DNA, 25 bp, Homo sapien
acaacatatttaatcagcagctaac

SEQ ID NO: 258937 - DNA, 25 bp, Homo sapien
gacaagttacttaagctctcagagc

SEQ ID NO: 258938 - DNA, 25 bp, Homo sapien
agagcatcaattgccgctcctgcaa

SEQ ID NO: 258939 - DNA, 25 bp, Homo sapien
aattgccgctcctgcaaattgagat

SEQ ID NO: 258940 - DNA, 25 bp, Homo sapien
gccgctcctgcaaattgagataata

SEQ ID NO: 258941 - DNA, 25 bp, Homo sapien
gataataatgcctgcctttcaaggt

SEQ ID NO: 258942 - DNA, 25 bp, Homo sapien
tcaaggtcattgtaaggattagaga

SEQ ID NO: 258943 - DNA, 25 bp, Homo sapien
tgttctgtggtcttaagtaataaat

SEQ ID NO: 258944 - DNA, 25 bp, Homo sapien
agtagctctgctgatgatgacgttg

SEQ ID NO: 258945 - DNA, 25 bp, Homo sapien
tctgctgatgatgacgttgataacc

SEQ ID NO: 258946 - DNA, 25 bp, Homo sapien
gtagctctgttgatgatgacgttga

SEQ ID NO: 258947 - DNA, 25 bp, Homo sapien
gacgttgataaccaaactgttctgt

SEQ ID NO: 258948 - DNA, 25 bp, Homo sapien
ctaatgttgcctcctttttagtaag

SEQ ID NO: 258949 - DNA, 25 bp, Homo sapien
taatgttgcctcctttttagtaaga

SEQ ID NO: 258950 - DNA, 25 bp, Homo sapien
aatgttgcctcctttttagtaagat

SEQ ID NO: 258951 - DNA, 25 bp, Homo sapien
atgttgcctcctttttagtaagatt

SEQ ID NO: 258952 - DNA, 25 bp, Homo sapien
gttgcctcctttttagtaagattct

SEQ ID NO: 258953 - DNA, 25 bp, Homo sapien
gcctcctttttagtaagattctacg

SEQ ID NO: 258954 - DNA, 25 bp, Homo sapien
gggtagctcttatacttcctctgct

SEQ ID NO: 258955 - DNA, 25 bp, Homo sapien
ggtagctcttatacttcctctgctc

SEQ ID NO: 258956 - DNA, 25 bp, Homo sapien
ttcctctgctctctttttcagtttc

SEQ ID NO: 258957 - DNA, 25 bp, Homo sapien
agctgttttcttagctattactcca

SEQ ID NO: 258958 - DNA, 25 bp, Homo sapien
gctgttttcttagctattactccaa

SEQ ID NO: 258959 - DNA, 25 bp, Homo sapien
gaccctgacctttgtttcaggatgc

SEQ ID NO: 258960 - DNA, 25 bp, Homo sapien
tgcaggaagggtctgaagtttattc

SEQ ID NO: 258961 - DNA, 25 bp, Homo sapien
aacctggttgatgctcaccttaaga

SEQ ID NO: 258962 - DNA, 25 bp, Homo sapien
aagtttattctaatccatgcctgga

SEQ ID NO: 258963 - DNA, 25 bp, Homo sapien
aggcattgtttatgcttccctgaac

SEQ ID NO: 258964 - DNA, 25 bp, Homo sapien
tttatgcttccctgaaccattctgt

SEQ ID NO: 258965 - DNA, 25 bp, Homo sapien
gaaccattctgtcattggactgaac

SEQ ID NO: 258966 - DNA, 25 bp, Homo sapien
ggactgaactcaagactggcaagaa

SEQ ID NO: 258967 - DNA, 25 bp, Homo sapien
gcaccaacagaatatgcatccatat

SEQ ID NO: 258968 - DNA, 25 bp, Homo sapien
tgtgtgaggagttaagtctgtttct

SEQ ID NO: 258969 - DNA, 25 bp, Homo sapien
aaattcccaagtactgctatcagaa

SEQ ID NO: 258970 - DNA, 25 bp, Homo sapien
gagagaagccatttaaagactgaga

SEQ ID NO: 258971 - DNA, 25 bp, Homo sapien
agctagacctttcaggcttcctatt

SEQ ID NO: 258972 - DNA, 25 bp, Homo sapien
aacattcctgactgtggttctgaca

SEQ ID NO: 258973 - DNA, 25 bp, Homo sapien
gacctttcaggcttcctatttatac

SEQ ID NO: 258974 - DNA, 25 bp, Homo sapien
gactgtggttctgacattcacaatg

SEQ ID NO: 258975 - DNA, 25 bp, Homo sapien
gacattcacaatgtttccatctgtt

SEQ ID NO: 258976 - DNA, 25 bp, Homo sapien
catctgtttgtttcactgaaatgat

SEQ ID NO: 258977 - DNA, 25 bp, Homo sapien
actgaaatgatgttctcccgttcct

SEQ ID NO: 258978 - DNA, 25 bp, Homo sapien
atgttctcccgttcctgtttggctt

SEQ ID NO: 258979 - DNA, 25 bp, Homo sapien
tttatacatttatctcgagtacacc

SEQ ID NO: 258980 - DNA, 25 bp, Homo sapien
atgcgaatcggccagcacattttca

SEQ ID NO: 258981 - DNA, 25 bp, Homo sapien
gtgccgccggctcggcccgccagga

SEQ ID NO: 258982 - DNA, 25 bp, Homo sapien
tgggcgaccggccgcgctggcagcg

SEQ ID NO: 258983 - DNA, 25 bp, Homo sapien
agctgctgctgcgccagttgggccg

SEQ ID NO: 258984 - DNA, 25 bp, Homo sapien
tgggtgaggacaagttccagtggct

SEQ ID NO: 258985 - DNA, 25 bp, Homo sapien
ttcgcgcgcgccatgcaggtgctgg

SEQ ID NO: 258986 - DNA, 25 bp, Homo sapien
tcgcgcgcgccatgcaggtgctggt

SEQ ID NO: 258987 - DNA, 25 bp, Homo sapien
atgcaggtgctggtcaccgccatct

SEQ ID NO: 258988 - DNA, 25 bp, Homo sapien
tgcaggtgctggtcaccgccatctc

SEQ ID NO: 258989 - DNA, 25 bp, Homo sapien
gcaggtgctggtcaccgccatctct

SEQ ID NO: 258990 - DNA, 25 bp, Homo sapien
aggtgctggtcaccgccatctctcc

SEQ ID NO: 258991 - DNA, 25 bp, Homo sapien
tggtcaccgccatctctccaggccg

SEQ ID NO: 258992 - DNA, 25 bp, Homo sapien
ccccttcttatcctgagagtgtagg

SEQ ID NO: 258993 - DNA, 25 bp, Homo sapien
gtgtagggtttctctgaattattat

SEQ ID NO: 258994 - DNA, 25 bp, Homo sapien
ttgcaaggatccctggatcctcatt

SEQ ID NO: 258995 - DNA, 25 bp, Homo sapien
ggatcctcattcctgatataagact

SEQ ID NO: 258996 - DNA, 25 bp, Homo sapien
gttctaggtaagtgcacattcatgt

SEQ ID NO: 258997 - DNA, 25 bp, Homo sapien
gatatattggttccatactaggcaa

SEQ ID NO: 258998 - DNA, 25 bp, Homo sapien
ggaagtgccacattatctgtaagga

SEQ ID NO: 258999 - DNA, 25 bp, Homo sapien
aggagaagagccattagccccagtc

SEQ ID NO: 259000 - DNA, 25 bp, Homo sapien
atggcgcactgtgagtgatggttta

SEQ ID NO: 259001 - DNA, 25 bp, Homo sapien
gatggtttagattctgcctggactc

SEQ ID NO: 259002 - DNA, 25 bp, Homo sapien
ctgcctggactcaaaccatttggtt

SEQ ID NO: 259003 - DNA, 25 bp, Homo sapien
agcctcttcctgatctggagccaca

SEQ ID NO: 259004 - DNA, 25 bp, Homo sapien
ttccagttcatctcagtcctcgaga

SEQ ID NO: 259005 - DNA, 25 bp, Homo sapien
ctcagtcctcgagaaaggcccttta

SEQ ID NO: 259006 - DNA, 25 bp, Homo sapien
agaaaggccctttaaatatgtcact

SEQ ID NO: 259007 - DNA, 25 bp, Homo sapien
aatatgtcactttcccattttcctt

SEQ ID NO: 259008 - DNA, 25 bp, Homo sapien
cattttcctttaaccatgggttgtg

SEQ ID NO: 259009 - DNA, 25 bp, Homo sapien
agaaagatggctgcttccaccaggg

SEQ ID NO: 259010 - DNA, 25 bp, Homo sapien
tccaccagggtggaggcttctaggt

SEQ ID NO: 259011 - DNA, 25 bp, Homo sapien
gaggcttctaggtctgcatgatgat

SEQ ID NO: 259012 - DNA, 25 bp, Homo sapien
gggagaactctaactgttgcagaaa

SEQ ID NO: 259013 - DNA, 25 bp, Homo sapien
aacagagcttcatggcttgcttaaa

SEQ ID NO: 259014 - DNA, 25 bp, Homo sapien
tgatgcttctatcaggtcccatcaa

SEQ ID NO: 259015 - DNA, 25 bp, Homo sapien
atcaggtcccatcaattcttagaat

SEQ ID NO: 259016 - DNA, 25 bp, Homo sapien
ctttgttagatattaggtcccatca

SEQ ID NO: 259017 - DNA, 25 bp, Homo sapien
gatattaggtcccatcaattcttag

SEQ ID NO: 259018 - DNA, 25 bp, Homo sapien
taggtcccatcaattcttagaatat

SEQ ID NO: 259019 - DNA, 25 bp, Homo sapien
acaactctacagtgcattggctaat

SEQ ID NO: 259020 - DNA, 25 bp, Homo sapien
gctaataaatgttgccatgttggtt

SEQ ID NO: 259021 - DNA, 25 bp, Homo sapien
tgttgccatgttggttgtaccaaaa

SEQ ID NO: 259022 - DNA, 25 bp, Homo sapien
taattgtgcacatctcgtataatat

SEQ ID NO: 259023 - DNA, 25 bp, Homo sapien
gcacatctcgtataatattcacaca

SEQ ID NO: 259024 - DNA, 25 bp, Homo sapien
atattcacacatattcttaatgaca

SEQ ID NO: 259025 - DNA, 25 bp, Homo sapien
aagattgtcctactaactccccttg

SEQ ID NO: 259026 - DNA, 25 bp, Homo sapien
ctggatatcattctctgggatgtgc

SEQ ID NO: 259027 - DNA, 25 bp, Homo sapien
gcgatcttatgatttgggccttcca

SEQ ID NO: 259028 - DNA, 25 bp, Homo sapien
ggccttccatgtagatatgtatact

SEQ ID NO: 259029 - DNA, 25 bp, Homo sapien
gatatgcctatcttgagtactttat

SEQ ID NO: 259030 - DNA, 25 bp, Homo sapien
tcccctctgtgttgttaatgcttta

SEQ ID NO: 259031 - DNA, 25 bp, Homo sapien
tctctgggatgtgcagtaggtcttt

SEQ ID NO: 259032 - DNA, 25 bp, Homo sapien
tgctttattagttcccttctggttt

SEQ ID NO: 259033 - DNA, 25 bp, Homo sapien
ttcccttctggttttagactaaatg

SEQ ID NO: 259034 - DNA, 25 bp, Homo sapien
aatgtgaaccctttagcagtataac

SEQ ID NO: 259035 - DNA, 25 bp, Homo sapien
gaagttatcaagattgtcctactaa

SEQ ID NO: 259036 - DNA, 25 bp, Homo sapien
ctctgtggatcaacataagtgggta

SEQ ID NO: 259037 - DNA, 25 bp, Homo sapien
tggatcaacataagtgggtacacaa

SEQ ID NO: 259038 - DNA, 25 bp, Homo sapien
ttttttcttggtgtatgtaagcaca

SEQ ID NO: 259039 - DNA, 25 bp, Homo sapien
atgtaagcacatttgttcctttata

SEQ ID NO: 259040 - DNA, 25 bp, Homo sapien
tcctttatatctgtttacaaaactg

SEQ ID NO: 259041 - DNA, 25 bp, Homo sapien
ttttttgaactagcatgactgtagg

SEQ ID NO: 259042 - DNA, 25 bp, Homo sapien
aactagcatgactgtagggttgagc

SEQ ID NO: 259043 - DNA, 25 bp, Homo sapien
gtagggttgagctacagtcaacaaa

SEQ ID NO: 259044 - DNA, 25 bp, Homo sapien
gtcacttttccccaggaaagaatat

SEQ ID NO: 259045 - DNA, 25 bp, Homo sapien
tcctgcatcaagtctgcgtggccat

SEQ ID NO: 259046 - DNA, 25 bp, Homo sapien
tgcatcaagtctgcgtggccatcct

SEQ ID NO: 259047 - DNA, 25 bp, Homo sapien
tggaatgttcttgcgctttgtgcac

SEQ ID NO: 259048 - DNA, 25 bp, Homo sapien
aaaacccaactacatatgcactttc

SEQ ID NO: 259049 - DNA, 25 bp, Homo sapien
acccaactacatatgcactttcttg

SEQ ID NO: 259050 - DNA, 25 bp, Homo sapien
aactacatatgcactttcttggttg

SEQ ID NO: 259051 - DNA, 25 bp, Homo sapien
gggagagaaactgagatggccctct

SEQ ID NO: 259052 - DNA, 25 bp, Homo sapien
tgagatggccctctgtgactcgact

SEQ ID NO: 259053 - DNA, 25 bp, Homo sapien
agatggccctctgtgactcgactgc

SEQ ID NO: 259054 - DNA, 25 bp, Homo sapien
gccctctgtgactcgactgctggga

SEQ ID NO: 259055 - DNA, 25 bp, Homo sapien
ctgggatgtatctgcttttgggagc

SEQ ID NO: 259056 - DNA, 25 bp, Homo sapien
gggagcagactgagtttcttttgca

SEQ ID NO: 259057 - DNA, 25 bp, Homo sapien
caatttgtcttattgtttgggtcta

SEQ ID NO: 259058 - DNA, 25 bp, Homo sapien
tcgggcaaaagggtgcaactttatt

SEQ ID NO: 259059 - DNA, 25 bp, Homo sapien
ggcaaaagggtgcaactttatttct

SEQ ID NO: 259060 - DNA, 25 bp, Homo sapien
gttattgagtagtttatacaaggca

SEQ ID NO: 259061 - DNA, 25 bp, Homo sapien
tattgagtagtttatacaaggcatg

SEQ ID NO: 259062 - DNA, 25 bp, Homo sapien
ttgagtagtttatacaaggcatggg

SEQ ID NO: 259063 - DNA, 25 bp, Homo sapien
gtggattaatgaatcactttttgcc

SEQ ID NO: 259064 - DNA, 25 bp, Homo sapien
tatcagtggataccacagatgttca

SEQ ID NO: 259065 - DNA, 25 bp, Homo sapien
atcagtggataccacagatgttcaa

SEQ ID NO: 259066 - DNA, 25 bp, Homo sapien
cagtggataccacagatgttcaaat

SEQ ID NO: 259067 - DNA, 25 bp, Homo sapien
agtggataccacagatgttcaaatt

SEQ ID NO: 259068 - DNA, 25 bp, Homo sapien
cagatgttcaaattccttatgtaaa

SEQ ID NO: 259069 - DNA, 25 bp, Homo sapien
tctcgagctgctgctgcgccagttg

SEQ ID NO: 259070 - DNA, 25 bp, Homo sapien
tgggcgaccggccgcgctggcagcg

SEQ ID NO: 259071 - DNA, 25 bp, Homo sapien
agctgctgctgcgccagttgggccg

SEQ ID NO: 259072 - DNA, 25 bp, Homo sapien
ctggcagcggctgctgggtgaggac

SEQ ID NO: 259073 - DNA, 25 bp, Homo sapien
tgggtgaggacaagttccagtggct

SEQ ID NO: 259074 - DNA, 25 bp, Homo sapien
acaagttccagtggctggcgggcct

SEQ ID NO: 259075 - DNA, 25 bp, Homo sapien
ttcgcgcgcgccatgcaggtgctgg

SEQ ID NO: 259076 - DNA, 25 bp, Homo sapien
atgcaggtgctggtcaccgccatct

SEQ ID NO: 259077 - DNA, 25 bp, Homo sapien
tgcaggtgctggtcaccgccatctc

SEQ ID NO: 259078 - DNA, 25 bp, Homo sapien
gcaggtgctggtcaccgccatctct

SEQ ID NO: 259079 - DNA, 25 bp, Homo sapien
tggtcaccgccatctctccaggccg

SEQ ID NO: 259080 - DNA, 25 bp, Homo sapien
actgagtaggatgtcgtatgatact

SEQ ID NO: 259081 - DNA, 25 bp, Homo sapien
ggatgtcgtatgatactttcaacaa

SEQ ID NO: 259082 - DNA, 25 bp, Homo sapien
aacaaattccctaatgctgcctaag

SEQ ID NO: 259083 - DNA, 25 bp, Homo sapien
ccctaatgctgcctaagcatatgga

SEQ ID NO: 259084 - DNA, 25 bp, Homo sapien
atgctgcctaagcatatggatgttt

SEQ ID NO: 259085 - DNA, 25 bp, Homo sapien
atgttttaattctttgctgttataa

SEQ ID NO: 259086 - DNA, 25 bp, Homo sapien
agatatctaatacgccagaattact

SEQ ID NO: 259087 - DNA, 25 bp, Homo sapien
ctaatacgccagaattactgatggt

SEQ ID NO: 259088 - DNA, 25 bp, Homo sapien
tacgccagaattactgatggtaaaa

SEQ ID NO: 259089 - DNA, 25 bp, Homo sapien
gatggtaaaattgaagttgtgtaac

SEQ ID NO: 259090 - DNA, 25 bp, Homo sapien
tcatttaaagacttatgttgccact

SEQ ID NO: 259091 - DNA, 25 bp, Homo sapien
catgtatactttactgggcatcaga

SEQ ID NO: 259092 - DNA, 25 bp, Homo sapien
aagacaccttgtatatatgctgatt

SEQ ID NO: 259093 - DNA, 25 bp, Homo sapien
aaggcctattcccagaagtcagtcc

SEQ ID NO: 259094 - DNA, 25 bp, Homo sapien
aagtcagtcctcattgtctatggga

SEQ ID NO: 259095 - DNA, 25 bp, Homo sapien
atagtgacaacttctcaactgtaga

SEQ ID NO: 259096 - DNA, 25 bp, Homo sapien
agactaatatgttcctcagtataca

SEQ ID NO: 259097 - DNA, 25 bp, Homo sapien
gtatacatgattacccttccacaga

SEQ ID NO: 259098 - DNA, 25 bp, Homo sapien
acagaatgatctgcttaggccctca

SEQ ID NO: 259099 - DNA, 25 bp, Homo sapien
gcttaggccctcagaatattttcaa

SEQ ID NO: 259100 - DNA, 25 bp, Homo sapien
atggaatcaatttgctcaccctcaa

SEQ ID NO: 259101 - DNA, 25 bp, Homo sapien
tctcagccctcttcacagaataaat

SEQ ID NO: 259102 - DNA, 25 bp, Homo sapien
acaagatggcagcaccctcggctcg

SEQ ID NO: 259103 - DNA, 25 bp, Homo sapien
tcggctcgtcttcacgacagaagga

SEQ ID NO: 259104 - DNA, 25 bp, Homo sapien
ttttggcagggcttcctgcacggaa

SEQ ID NO: 259105 - DNA, 25 bp, Homo sapien
agaaggtgacttacccgaggtgccg

SEQ ID NO: 259106 - DNA, 25 bp, Homo sapien
tgacttacccgaggtgccggaggat

SEQ ID NO: 259107 - DNA, 25 bp, Homo sapien
ccggaggatggaggcgtcttctcca

SEQ ID NO: 259108 - DNA, 25 bp, Homo sapien
ggaagtgaaaatgacgtccctgggc

SEQ ID NO: 259109 - DNA, 25 bp, Homo sapien
tcctgcacggaagatggagggctct

SEQ ID NO: 259110 - DNA, 25 bp, Homo sapien
agggctctgaaatagaattctgagt

SEQ ID NO: 259111 - DNA, 25 bp, Homo sapien
aattctgagtttggagaaccaatta

SEQ ID NO: 259112 - DNA, 25 bp, Homo sapien
tagagggaggacacgtaacaggcac

SEQ ID NO: 259113 - DNA, 25 bp, Homo sapien
tgttttcatgctggattctgagcca

SEQ ID NO: 259114 - DNA, 25 bp, Homo sapien
gctgcaactctgaggccgggcagac

SEQ ID NO: 259115 - DNA, 25 bp, Homo sapien
ggccgggcagactttccgctggaaa

SEQ ID NO: 259116 - DNA, 25 bp, Homo sapien
aatactggtgagaggtggatttgaa

SEQ ID NO: 259117 - DNA, 25 bp, Homo sapien
aggttttggctctgcaggtttgcac

SEQ ID NO: 259118 - DNA, 25 bp, Homo sapien
tgcaggtttgcacccagctctgtgg

SEQ ID NO: 259119 - DNA, 25 bp, Homo sapien
agctctgtggtgtatgccctcacag

SEQ ID NO: 259120 - DNA, 25 bp, Homo sapien
gtggtgtatgccctcacaggtcacc

SEQ ID NO: 259121 - DNA, 25 bp, Homo sapien
gggctcttgtgctggttaaatggac

SEQ ID NO: 259122 - DNA, 25 bp, Homo sapien
ggttaaatggaccttgatgtcttcc

SEQ ID NO: 259123 - DNA, 25 bp, Homo sapien
ggaccttgatgtcttccaaatgttt

SEQ ID NO: 259124 - DNA, 25 bp, Homo sapien
gttcgggttattgttctcaccaccg

SEQ ID NO: 259125 - DNA, 25 bp, Homo sapien
gttattgttctcaccaccgataggg

SEQ ID NO: 259126 - DNA, 25 bp, Homo sapien
gaaacccatgttcttagagagtcgt

SEQ ID NO: 259127 - DNA, 25 bp, Homo sapien
ggatgtgcgcgcagactgccctgct

SEQ ID NO: 259128 - DNA, 25 bp, Homo sapien
cgggaatccgactacactgaacgtt

SEQ ID NO: 259129 - DNA, 25 bp, Homo sapien
aatccgactacactgaacgtttggg

SEQ ID NO: 259130 - DNA, 25 bp, Homo sapien
taagtccaccgcagcagctgccggg

SEQ ID NO: 259131 - DNA, 25 bp, Homo sapien
agctgccgggacttgggcctcccag

SEQ ID NO: 259132 - DNA, 25 bp, Homo sapien
tagagagtcgtctggctactgcgta

SEQ ID NO: 259133 - DNA, 25 bp, Homo sapien
ggctactgcgtagtcctggaatatt

SEQ ID NO: 259134 - DNA, 25 bp, Homo sapien
tttcaaaaggcctcttccagttgat

SEQ ID NO: 259135 - DNA, 25 bp, Homo sapien
gttaattttacatcagcaaccagaa

SEQ ID NO: 259136 - DNA, 25 bp, Homo sapien
atcagcaaccagaatgaatctctcc

SEQ ID NO: 259137 - DNA, 25 bp, Homo sapien
agcagcttccctgcagcttcgaggt

SEQ ID NO: 259138 - DNA, 25 bp, Homo sapien
agcttcgaggtctttctattcttat

SEQ ID NO: 259139 - DNA, 25 bp, Homo sapien
atagttatggtgcatgctcctgtct

SEQ ID NO: 259140 - DNA, 25 bp, Homo sapien
ctctccctctagtatgaattcattc

SEQ ID NO: 259141 - DNA, 25 bp, Homo sapien
gctgtgtcctgttcggcttcttatt

SEQ ID NO: 259142 - DNA, 25 bp, Homo sapien
gcttcttattcttgacaggccttat

SEQ ID NO: 259143 - DNA, 25 bp, Homo sapien
tgacaggccttatcttgccgccttg

SEQ ID NO: 259144 - DNA, 25 bp, Homo sapien
gccttgcccttgtaagcacttcata

SEQ ID NO: 259145 - DNA, 25 bp, Homo sapien
gcacttcataaatgcttgttggctt

SEQ ID NO: 259146 - DNA, 25 bp, Homo sapien
gctgcaaaacatcagtttaggaatt

SEQ ID NO: 259147 - DNA, 25 bp, Homo sapien
ggtttaataaaactagcgccattgg

SEQ ID NO: 259148 - DNA, 25 bp, Homo sapien
gaataaattcccgagtagcccctgc

SEQ ID NO: 259149 - DNA, 25 bp, Homo sapien
gcccctgcagtagcgtatctgagct

SEQ ID NO: 259150 - DNA, 25 bp, Homo sapien
cagtagcgtatctgagctctcaaca

SEQ ID NO: 259151 - DNA, 25 bp, Homo sapien
caaataggattgtgttatggcagaa

SEQ ID NO: 259152 - DNA, 25 bp, Homo sapien
gatttttcagttctggtgatggatt

SEQ ID NO: 259153 - DNA, 25 bp, Homo sapien
ttacagatatctctggagccaccat

SEQ ID NO: 259154 - DNA, 25 bp, Homo sapien
tctggagccaccataatagactctt

SEQ ID NO: 259155 - DNA, 25 bp, Homo sapien
tagactcttaagattctgtgcttcc

SEQ ID NO: 259156 - DNA, 25 bp, Homo sapien
ttagttggtaaatccagatggagtc

SEQ ID NO: 259157 - DNA, 25 bp, Homo sapien
tgcacatgaccacggcccgcaggga

SEQ ID NO: 259158 - DNA, 25 bp, Homo sapien
gatgagatcaaggaactgtactccg

SEQ ID NO: 259159 - DNA, 25 bp, Homo sapien
aaggaactgtactccgaatcggacg

SEQ ID NO: 259160 - DNA, 25 bp, Homo sapien
aatcggacgagactttcgatcagat

SEQ ID NO: 259161 - DNA, 25 bp, Homo sapien
acgagactttcgatcagattagcaa

SEQ ID NO: 259162 - DNA, 25 bp, Homo sapien
atcagattagcaaggtggagcggca

SEQ ID NO: 259163 - DNA, 25 bp, Homo sapien
gctgcaggtgaaccacacggcgctc

SEQ ID NO: 259164 - DNA, 25 bp, Homo sapien
gctccgtgagctgcgcgtgatcctg

SEQ ID NO: 259165 - DNA, 25 bp, Homo sapien
agctgcgcgtgatcctgatggagaa

SEQ ID NO: 259166 - DNA, 25 bp, Homo sapien
gtgatcctgatggagaagtctctga

SEQ ID NO: 259167 - DNA, 25 bp, Homo sapien
agaagtctctgatcatggaggagaa

SEQ ID NO: 259168 - DNA, 25 bp, Homo sapien
agcctgtgggtcctttcccatcggg

SEQ ID NO: 259169 - DNA, 25 bp, Homo sapien
agcttgagtcctgctggtagccctt

SEQ ID NO: 259170 - DNA, 25 bp, Homo sapien
gtagcccttggcacaaggcctggta

SEQ ID NO: 259171 - DNA, 25 bp, Homo sapien
cagcctggtgctgccatgtaccaaa

SEQ ID NO: 259172 - DNA, 25 bp, Homo sapien
ctgccatgtaccaaactctgctggg

SEQ ID NO: 259173 - DNA, 25 bp, Homo sapien
agcagatgcaaacccattaggtata

SEQ ID NO: 259174 - DNA, 25 bp, Homo sapien
ggtatagcatggttcaagatatttt

SEQ ID NO: 259175 - DNA, 25 bp, Homo sapien
tttttgcttgtttcaataacacttt

SEQ ID NO: 259176 - DNA, 25 bp, Homo sapien
ataaaacatactcctgttccactgt

SEQ ID NO: 259177 - DNA, 25 bp, Homo sapien
taaaacacctgtttgaccagcctgt

SEQ ID NO: 259178 - DNA, 25 bp, Homo sapien
acacctgtttgaccagcctgtgggt

SEQ ID NO: 259179 - DNA, 25 bp, Homo sapien
ccacgtgtctgaagaacatatgctt

SEQ ID NO: 259180 - DNA, 25 bp, Homo sapien
gaacatatgcttacagaatggcgta

SEQ ID NO: 259181 - DNA, 25 bp, Homo sapien
agaatggcgtatatgatctcaatgc

SEQ ID NO: 259182 - DNA, 25 bp, Homo sapien
gatctcaatgccatcttgctgcaag

SEQ ID NO: 259183 - DNA, 25 bp, Homo sapien
ccagctaggatgttccctgtagttg

SEQ ID NO: 259184 - DNA, 25 bp, Homo sapien
cgcggcacagttcccaggatgactg

SEQ ID NO: 259185 - DNA, 25 bp, Homo sapien
ggatgactgctgtgccactcacaaa

SEQ ID NO: 259186 - DNA, 25 bp, Homo sapien
aatgagccttttgactgactccagc

SEQ ID NO: 259187 - DNA, 25 bp, Homo sapien
gcagcaggacgggactgtcgtttca

SEQ ID NO: 259188 - DNA, 25 bp, Homo sapien
ttgtttcagcaatcaaaacctggca

SEQ ID NO: 259189 - DNA, 25 bp, Homo sapien
aaacctggcaattggccatgtcaac

SEQ ID NO: 259190 - DNA, 25 bp, Homo sapien
gtctaaggtcacatggatgttcgca

SEQ ID NO: 259191 - DNA, 25 bp, Homo sapien
ggatgttcgcaacaattgggatgca

SEQ ID NO: 259192 - DNA, 25 bp, Homo sapien
gatgcagaacttgatctgactccca

SEQ ID NO: 259193 - DNA, 25 bp, Homo sapien
gactcccaggccaggtttgattttg

SEQ ID NO: 259194 - DNA, 25 bp, Homo sapien
ggccaggtttgattttgatttgcag

SEQ ID NO: 259195 - DNA, 25 bp, Homo sapien
ggcagagaggactaattttttacta

SEQ ID NO: 259196 - DNA, 25 bp, Homo sapien
ttttactaggttctgagccctgtac

SEQ ID NO: 259197 - DNA, 25 bp, Homo sapien
agccctgtactgaactctggattgc

SEQ ID NO: 259198 - DNA, 25 bp, Homo sapien
tactgaactctggattgccctgtac

SEQ ID NO: 259199 - DNA, 25 bp, Homo sapien
ctggattgccctgtacttggtggtg

SEQ ID NO: 259200 - DNA, 25 bp, Homo sapien
tccctgctcaattatacccatgtta

SEQ ID NO: 259201 - DNA, 25 bp, Homo sapien
tcgggcaaaagggtgcaactttatt

SEQ ID NO: 259202 - DNA, 25 bp, Homo sapien
ggcaaaagggtgcaactttatttct

SEQ ID NO: 259203 - DNA, 25 bp, Homo sapien
gttattgagtagtttatacaaggca

SEQ ID NO: 259204 - DNA, 25 bp, Homo sapien
ttgagtagtttatacaaggcatggg

SEQ ID NO: 259205 - DNA, 25 bp, Homo sapien
gtggattaatgaatcactttttgcc

SEQ ID NO: 259206 - DNA, 25 bp, Homo sapien
ttttgcctttttcttgctgtgtaca

SEQ ID NO: 259207 - DNA, 25 bp, Homo sapien
tttttcttgctgtgtacagtcatcc

SEQ ID NO: 259208 - DNA, 25 bp, Homo sapien
catccctttgtatcagtggatacca

SEQ ID NO: 259209 - DNA, 25 bp, Homo sapien
tatcagtggataccacagatgttca

SEQ ID NO: 259210 - DNA, 25 bp, Homo sapien
agtggataccacagatgttcaaatt

SEQ ID NO: 259211 - DNA, 25 bp, Homo sapien
cagatgttcaaattccttatgtaaa

SEQ ID NO: 259212 - DNA, 25 bp, Homo sapien
ctcagagcatcaattgccgctcctg

SEQ ID NO: 259213 - DNA, 25 bp, Homo sapien
agagcatcaattgccgctcctgcaa

SEQ ID NO: 259214 - DNA, 25 bp, Homo sapien
atcaattgccgctcctgcaaattga

SEQ ID NO: 259215 - DNA, 25 bp, Homo sapien
caattgccgctcctgcaaattgaga

SEQ ID NO: 259216 - DNA, 25 bp, Homo sapien
aattgccgctcctgcaaattgagat

SEQ ID NO: 259217 - DNA, 25 bp, Homo sapien
attgccgctcctgcaaattgagata

SEQ ID NO: 259218 - DNA, 25 bp, Homo sapien
tgccgctcctgcaaattgagataat

SEQ ID NO: 259219 - DNA, 25 bp, Homo sapien
gccgctcctgcaaattgagataata

SEQ ID NO: 259220 - DNA, 25 bp, Homo sapien
cgctcctgcaaattgagataataat

SEQ ID NO: 259221 - DNA, 25 bp, Homo sapien
tcaaggtcattgtaaggattagaga

SEQ ID NO: 259222 - DNA, 25 bp, Homo sapien
gattagagacaatgtgtgtaaagca

SEQ ID NO: 259223 - DNA, 25 bp, Homo sapien
atgtcctgtctcttatccatgaaaa

SEQ ID NO: 259224 - DNA, 25 bp, Homo sapien
atccatgaaaacactcccacaaaat

SEQ ID NO: 259225 - DNA, 25 bp, Homo sapien
tcacacccagtatctgttaacggag

SEQ ID NO: 259226 - DNA, 25 bp, Homo sapien
agctgtcttcagcacaccaagcatc

SEQ ID NO: 259227 - DNA, 25 bp, Homo sapien
gtgggtgaagaagactcattcccta

SEQ ID NO: 259228 - DNA, 25 bp, Homo sapien
gactcattccctaatgcaattcagg

SEQ ID NO: 259229 - DNA, 25 bp, Homo sapien
aaatgcctttcaggaagcacaagcc

SEQ ID NO: 259230 - DNA, 25 bp, Homo sapien
acaacatgggaaataccgtgcttta

SEQ ID NO: 259231 - DNA, 25 bp, Homo sapien
aaataccgtgctttaaatgttgctt

SEQ ID NO: 259232 - DNA, 25 bp, Homo sapien
atgttgctttaatcacagtgctcat

SEQ ID NO: 259233 - DNA, 25 bp, Homo sapien
tgagtaagggcatgtcctgtctctt

SEQ ID NO: 259234 - DNA, 25 bp, Homo sapien
atcatcaactgtccagtggactgga

SEQ ID NO: 259235 - DNA, 25 bp, Homo sapien
ccagtggactggaccttgctcgggt

SEQ ID NO: 259236 - DNA, 25 bp, Homo sapien
tggactggaccttgctcgggttcaa

SEQ ID NO: 259237 - DNA, 25 bp, Homo sapien
actggaccttgctcgggttcaagta

SEQ ID NO: 259238 - DNA, 25 bp, Homo sapien
gaccttgctcgggttcaagtagagg

SEQ ID NO: 259239 - DNA, 25 bp, Homo sapien
ttgctcgggttcaagtagagggcat

SEQ ID NO: 259240 - DNA, 25 bp, Homo sapien
ggttcaagtagagggcataggttaa

SEQ ID NO: 259241 - DNA, 25 bp, Homo sapien
aaaagtgcacttattgactcagaca

SEQ ID NO: 259242 - DNA, 25 bp, Homo sapien
gtgcacttattgactcagacaggac

SEQ ID NO: 259243 - DNA, 25 bp, Homo sapien
ttattgactcagacaggacactcag

SEQ ID NO: 259244 - DNA, 25 bp, Homo sapien
tgcaaaggactagcaaacttaaatg

SEQ ID NO: 259245 - DNA, 25 bp, Homo sapien
accacagcattatgatcctttccgg

SEQ ID NO: 259246 - DNA, 25 bp, Homo sapien
agcattatgatcctttccggctgct

SEQ ID NO: 259247 - DNA, 25 bp, Homo sapien
attatgatcctttccggctgctgac

SEQ ID NO: 259248 - DNA, 25 bp, Homo sapien
atcctttccggctgctgaccaatct

SEQ ID NO: 259249 - DNA, 25 bp, Homo sapien
gaccaatctgtattttgtgaacttc

SEQ ID NO: 259250 - DNA, 25 bp, Homo sapien
ctggctgctgtgttacaactgggtg

SEQ ID NO: 259251 - DNA, 25 bp, Homo sapien
gatgctctggtgatattacagctga

SEQ ID NO: 259252 - DNA, 25 bp, Homo sapien
ttacagctgaaagagacgtctaatc

SEQ ID NO: 259253 - DNA, 25 bp, Homo sapien
gctgggtatccagccttagcgcgca

SEQ ID NO: 259254 - DNA, 25 bp, Homo sapien
tagcgcgcaccgactacaacttcaa

SEQ ID NO: 259255 - DNA, 25 bp, Homo sapien
gcgcaccgactacaacttcaacttt

SEQ ID NO: 259256 - DNA, 25 bp, Homo sapien
agaacctacatgtattgttcaacat

SEQ ID NO: 259257 - DNA, 25 bp, Homo sapien
gttcaacatggatcacgagtgcaca

SEQ ID NO: 259258 - DNA, 25 bp, Homo sapien
atggcacagcagtagcgcacaggca

SEQ ID NO: 259259 - DNA, 25 bp, Homo sapien
agcgcacaggcacacagctatctgg

SEQ ID NO: 259260 - DNA, 25 bp, Homo sapien
tgtcacgtggactctacacaccgag

SEQ ID NO: 259261 - DNA, 25 bp, Homo sapien
ggactctacacaccgagaactgctt

SEQ ID NO: 259262 - DNA, 25 bp, Homo sapien
gaactgcttcaaggtcgcctgtgtc

SEQ ID NO: 259263 - DNA, 25 bp, Homo sapien
tcgcctgtgtctgagtgcgggtaaa

SEQ ID NO: 259264 - DNA, 25 bp, Homo sapien
gtgaatatcaacacccaggctatca

SEQ ID NO: 259265 - DNA, 25 bp, Homo sapien
caggctatcagggtgagacaactga

SEQ ID NO: 259266 - DNA, 25 bp, Homo sapien
ggtaaatgctttccaacgtacagta

SEQ ID NO: 259267 - DNA, 25 bp, Homo sapien
atcatccacggtccttcaatctgaa

SEQ ID NO: 259268 - DNA, 25 bp, Homo sapien
gaacacaaattctctccacagtgct

SEQ ID NO: 259269 - DNA, 25 bp, Homo sapien
gggtccaagatcttctgttgttgcc

SEQ ID NO: 259270 - DNA, 25 bp, Homo sapien
tgtaccaaaaagacatccacgcctc

SEQ ID NO: 259271 - DNA, 25 bp, Homo sapien
tcccctatgacaaccgcatgatgct

SEQ ID NO: 259272 - DNA, 25 bp, Homo sapien
aaccgcatgatgctcaaggcgtgca

SEQ ID NO: 259273 - DNA, 25 bp, Homo sapien
aaggcgtgcatccttaggaggccat

SEQ ID NO: 259274 - DNA, 25 bp, Homo sapien
ttaggaggccatgagcattctagcc

SEQ ID NO: 259275 - DNA, 25 bp, Homo sapien
tgttgttgccgcaagaccagcgagg

SEQ ID NO: 259276 - DNA, 25 bp, Homo sapien
actgttggcttccacaatccaagaa

SEQ ID NO: 259277 - DNA, 25 bp, Homo sapien
aagaatgttcgaacagcatcatcca

SEQ ID NO: 259278 - DNA, 25 bp, Homo sapien
taataacctagcatcaggctacact

SEQ ID NO: 259279 - DNA, 25 bp, Homo sapien
aggctacactacttgaatgctgaaa

SEQ ID NO: 259280 - DNA, 25 bp, Homo sapien
gagctaaagttctcttcagcacagt

SEQ ID NO: 259281 - DNA, 25 bp, Homo sapien
gttctcttcagcacagtttgcaata

SEQ ID NO: 259282 - DNA, 25 bp, Homo sapien
tgcaatattgtgtgttcgaggagtc

SEQ ID NO: 259283 - DNA, 25 bp, Homo sapien
gagtcagttgaagttgtgtggtaca

SEQ ID NO: 259284 - DNA, 25 bp, Homo sapien
agttgtgtggtacatggcattaaac

SEQ ID NO: 259285 - DNA, 25 bp, Homo sapien
agggaacgtgtcaatatcatctaac

SEQ ID NO: 259286 - DNA, 25 bp, Homo sapien
gtcaatatcatctaacatggttgtg

SEQ ID NO: 259287 - DNA, 25 bp, Homo sapien
attcagtctttgctttcacacctct

SEQ ID NO: 259288 - DNA, 25 bp, Homo sapien
tcacacctctcttagataatgaaca

SEQ ID NO: 259289 - DNA, 25 bp, Homo sapien
gggaatgcaacccatgtctggccaa

SEQ ID NO: 259290 - DNA, 25 bp, Homo sapien
ctactcatgctttctatccacagag

SEQ ID NO: 259291 - DNA, 25 bp, Homo sapien
cccatttcccagtctagagttgttg

SEQ ID NO: 259292 - DNA, 25 bp, Homo sapien
tgttggtccaagaggaggctctctc

SEQ ID NO: 259293 - DNA, 25 bp, Homo sapien
gaggctctctcttactctgaaatca

SEQ ID NO: 259294 - DNA, 25 bp, Homo sapien
aaatcatgagctgagggtttactgt

SEQ ID NO: 259295 - DNA, 25 bp, Homo sapien
ggtttactgtgtatgcctgaagcta

SEQ ID NO: 259296 - DNA, 25 bp, Homo sapien
atccacagagtctcactgatagttt

SEQ ID NO: 259297 - DNA, 25 bp, Homo sapien
tgatagtttgtcagccttgcatccc

SEQ ID NO: 259298 - DNA, 25 bp, Homo sapien
ccatgtgggtcctgtgaagctgctg

SEQ ID NO: 259299 - DNA, 25 bp, Homo sapien
gaagctgctggtcaacctatcccct

SEQ ID NO: 259300 - DNA, 25 bp, Homo sapien
ttgataaagtgtttacaaatccagc

SEQ ID NO: 259301 - DNA, 25 bp, Homo sapien
taatagcaatggtcatctcactgtt

SEQ ID NO: 259302 - DNA, 25 bp, Homo sapien
aaattatcatactcattcttgcaat

SEQ ID NO: 259303 - DNA, 25 bp, Homo sapien
actcattcttgcaatagatgcccaa

SEQ ID NO: 259304 - DNA, 25 bp, Homo sapien
caatagatgcccaaagaatctttgc

SEQ ID NO: 259305 - DNA, 25 bp, Homo sapien
aacagttacaacagggagtgaatta

SEQ ID NO: 259306 - DNA, 25 bp, Homo sapien
atttgactgcattattatttcagat

SEQ ID NO: 259307 - DNA, 25 bp, Homo sapien
atttcagattcaaattcggtcttca

SEQ ID NO: 259308 - DNA, 25 bp, Homo sapien
gattcaaattcggtcttcatagatt

SEQ ID NO: 259309 - DNA, 25 bp, Homo sapien
tcatagattgggttttagaagctgc

SEQ ID NO: 259310 - DNA, 25 bp, Homo sapien
ggttttagaagctgccagttttcat

SEQ ID NO: 259311 - DNA, 25 bp, Homo sapien
tccttgtggactaactgcaacctag

SEQ ID NO: 259312 - DNA, 25 bp, Homo sapien
ttgtggactaactgcaacctagctt

SEQ ID NO: 259313 - DNA, 25 bp, Homo sapien
taacagagtaagaccatttaaaggg

SEQ ID NO: 259314 - DNA, 25 bp, Homo sapien
aatggatgaacatacttggcactat

SEQ ID NO: 259315 - DNA, 25 bp, Homo sapien
gaacatacttggcactatgaactaa

SEQ ID NO: 259316 - DNA, 25 bp, Homo sapien
tgaactaaaagatctttggctaaag

SEQ ID NO: 259317 - DNA, 25 bp, Homo sapien
gaagactcattcaactcctacaagt

SEQ ID NO: 259318 - DNA, 25 bp, Homo sapien
ctacaagtgaattaaggagctctga

SEQ ID NO: 259319 - DNA, 25 bp, Homo sapien
gtaacgacagaattttcccactgtt

SEQ ID NO: 259320 - DNA, 25 bp, Homo sapien
gaattttcccactgttaaagcaaat

SEQ ID NO: 259321 - DNA, 25 bp, Homo sapien
atggcctgagaaggatttctatatt

SEQ ID NO: 259322 - DNA, 25 bp, Homo sapien
aagtagcattttcctcgtactccgg

SEQ ID NO: 259323 - DNA, 25 bp, Homo sapien
agtagcattttcctcgtactccggg

SEQ ID NO: 259324 - DNA, 25 bp, Homo sapien
ccagggacgtcattttcacttcctg

SEQ ID NO: 259325 - DNA, 25 bp, Homo sapien
agggacgtcattttcacttcctggc

SEQ ID NO: 259326 - DNA, 25 bp, Homo sapien
ggacgtcattttcacttcctggctt

SEQ ID NO: 259327 - DNA, 25 bp, Homo sapien
acgtcattttcacttcctggctttg

SEQ ID NO: 259328 - DNA, 25 bp, Homo sapien
gtcattttcacttcctggctttgga

SEQ ID NO: 259329 - DNA, 25 bp, Homo sapien
cattttcacttcctggctttggaga

SEQ ID NO: 259330 - DNA, 25 bp, Homo sapien
ttttcacttcctggctttggagaag

SEQ ID NO: 259331 - DNA, 25 bp, Homo sapien
tggagaagacgcctccatcctccgg

SEQ ID NO: 259332 - DNA, 25 bp, Homo sapien
agcaccacatggctcctggcagccc

SEQ ID NO: 259333 - DNA, 25 bp, Homo sapien
actgtgaggatctcaatggcctggt

SEQ ID NO: 259334 - DNA, 25 bp, Homo sapien
cggaagcattagaggcaccagcaaa

SEQ ID NO: 259335 - DNA, 25 bp, Homo sapien
tggtgggccacaagatcacttctgc

SEQ ID NO: 259336 - DNA, 25 bp, Homo sapien
atcacttctgcttccggctggaatg

SEQ ID NO: 259337 - DNA, 25 bp, Homo sapien
ttctccacagagtccggaaactgac

SEQ ID NO: 259338 - DNA, 25 bp, Homo sapien
ggaaactgacatatgcagccaccca

SEQ ID NO: 259339 - DNA, 25 bp, Homo sapien
atgatggcccagatgttctgtagct

SEQ ID NO: 259340 - DNA, 25 bp, Homo sapien
gttctgtagcttgcagtgactgcca

SEQ ID NO: 259341 - DNA, 25 bp, Homo sapien
gagaaaggaatctgctcccctgtgg

SEQ ID NO: 259342 - DNA, 25 bp, Homo sapien
aaatcacactccttaggcaccacat

SEQ ID NO: 259343 - DNA, 25 bp, Homo sapien
caccacatctacagggaagacccag

SEQ ID NO: 259344 - DNA, 25 bp, Homo sapien
tactgttatgatgaagttaattgaa

SEQ ID NO: 259345 - DNA, 25 bp, Homo sapien
ttttggctttaacatagcttgctga

SEQ ID NO: 259346 - DNA, 25 bp, Homo sapien
ttggctttaacatagcttgctgatt

SEQ ID NO: 259347 - DNA, 25 bp, Homo sapien
ggctttaacatagcttgctgatttt

SEQ ID NO: 259348 - DNA, 25 bp, Homo sapien
taacatagcttgctgatttttttgc

SEQ ID NO: 259349 - DNA, 25 bp, Homo sapien
ttttgctgtgtaatgctttcacctc

SEQ ID NO: 259350 - DNA, 25 bp, Homo sapien
tttgctgtgtaatgctttcacctct

SEQ ID NO: 259351 - DNA, 25 bp, Homo sapien
ttgctgtgtaatgctttcacctctc

SEQ ID NO: 259352 - DNA, 25 bp, Homo sapien
tgctgtgtaatgctttcacctctcc

SEQ ID NO: 259353 - DNA, 25 bp, Homo sapien
taatgctttcacctctccactgtga

SEQ ID NO: 259354 - DNA, 25 bp, Homo sapien
ctccactgtgaatcctttctgtgaa

SEQ ID NO: 259355 - DNA, 25 bp, Homo sapien
ggagagggtccttcctagcctcggc

SEQ ID NO: 259356 - DNA, 25 bp, Homo sapien
cgccgggtcggttcctggctggtgt

SEQ ID NO: 259357 - DNA, 25 bp, Homo sapien
ccccgccaaaccacagtgggagctg

SEQ ID NO: 259358 - DNA, 25 bp, Homo sapien
gggtgctcgcctacagtctgcatct

SEQ ID NO: 259359 - DNA, 25 bp, Homo sapien
tgctcgcctacagtctgcatctgta

SEQ ID NO: 259360 - DNA, 25 bp, Homo sapien
agtctgcatctgtagtgccttgtgg

SEQ ID NO: 259361 - DNA, 25 bp, Homo sapien
gtctgcatctgtagtgccttgtggg

SEQ ID NO: 259362 - DNA, 25 bp, Homo sapien
gtgccttgtggggtatccaggaaca

SEQ ID NO: 259363 - DNA, 25 bp, Homo sapien
gtatccaggaacaccctcccagcag

SEQ ID NO: 259364 - DNA, 25 bp, Homo sapien
ggatgggaaccctgtcccatgaagc

SEQ ID NO: 259365 - DNA, 25 bp, Homo sapien
atgaagccctctcctcagctttact

SEQ ID NO: 259366 - DNA, 25 bp, Homo sapien
ctgtgtcaatgtgggcttctccaag

SEQ ID NO: 259367 - DNA, 25 bp, Homo sapien
cagttttacttatccatgaagtggg

SEQ ID NO: 259368 - DNA, 25 bp, Homo sapien
gtggctataacaaagagactcatga

SEQ ID NO: 259369 - DNA, 25 bp, Homo sapien
atcatgtctctctcttgtaacagtc

SEQ ID NO: 259370 - DNA, 25 bp, Homo sapien
gtctctctcttgtaacagtccatag

SEQ ID NO: 259371 - DNA, 25 bp, Homo sapien
aacagtccatagtgcacatcctggg

SEQ ID NO: 259372 - DNA, 25 bp, Homo sapien
acatcctgggctactgttccacatg

SEQ ID NO: 259373 - DNA, 25 bp, Homo sapien
gttccacatggaatccagggacctg

SEQ ID NO: 259374 - DNA, 25 bp, Homo sapien
atggaatccagggacctggttccct

SEQ ID NO: 259375 - DNA, 25 bp, Homo sapien
attccttaggacattgtcctcctcg

SEQ ID NO: 259376 - DNA, 25 bp, Homo sapien
ttgtcctcctcgtcatagacagaca

SEQ ID NO: 259377 - DNA, 25 bp, Homo sapien
ggcctgtctaggtaatacagcccta

SEQ ID NO: 259378 - DNA, 25 bp, Homo sapien
ggtaatacagccctaatcttagagt

SEQ ID NO: 259379 - DNA, 25 bp, Homo sapien
actccttggtagactaaaatcaaat

SEQ ID NO: 259380 - DNA, 25 bp, Homo sapien
tgaaaaactaaaatactggactgat

SEQ ID NO: 259381 - DNA, 25 bp, Homo sapien
ggactgattccagagttttaccatc

SEQ ID NO: 259382 - DNA, 25 bp, Homo sapien
gagttttaccatcacttacaagaat

SEQ ID NO: 259383 - DNA, 25 bp, Homo sapien
ggtggctcatgccttatactaccat

SEQ ID NO: 259384 - DNA, 25 bp, Homo sapien
atgccttatactaccatatgtggaa

SEQ ID NO: 259385 - DNA, 25 bp, Homo sapien
gaatgaatccagtagccataccaag

SEQ ID NO: 259386 - DNA, 25 bp, Homo sapien
gtagccataccaagttattgaccag

SEQ ID NO: 259387 - DNA, 25 bp, Homo sapien
taccaagttattgaccagttatctt

SEQ ID NO: 259388 - DNA, 25 bp, Homo sapien
gctgacctttgaactattatgttat

SEQ ID NO: 259389 - DNA, 25 bp, Homo sapien
gaactattatgttatttccagggaa

SEQ ID NO: 259390 - DNA, 25 bp, Homo sapien
tgtggtctctgatctaatccttaga

SEQ ID NO: 259391 - DNA, 25 bp, Homo sapien
ctaatccttagagaatgtgaccatg

SEQ ID NO: 259392 - DNA, 25 bp, Homo sapien
tgaagacacttttcctacctggtaa

SEQ ID NO: 259393 - DNA, 25 bp, Homo sapien
gttggtttactgagccaggagctat

SEQ ID NO: 259394 - DNA, 25 bp, Homo sapien
aggagctataacaggtgctggagca

SEQ ID NO: 259395 - DNA, 25 bp, Homo sapien
agccacctgaggacccagagctcaa

SEQ ID NO: 259396 - DNA, 25 bp, Homo sapien
cccagagctcaaagccacatgttga

SEQ ID NO: 259397 - DNA, 25 bp, Homo sapien
gagataactgtatccactctggact

SEQ ID NO: 259398 - DNA, 25 bp, Homo sapien
tatccactctggactgctgaccttt

SEQ ID NO: 259399 - DNA, 25 bp, Homo sapien
gaaagcactctgtggatcaacataa

SEQ ID NO: 259400 - DNA, 25 bp, Homo sapien
tggatcaacataagtgggtacacaa

SEQ ID NO: 259401 - DNA, 25 bp, Homo sapien
ttttttcttggtgtatgtaagcaca

SEQ ID NO: 259402 - DNA, 25 bp, Homo sapien
atgtaagcacatttgttcctttata

SEQ ID NO: 259403 - DNA, 25 bp, Homo sapien
tcctttatatctgtttacaaaactg

SEQ ID NO: 259404 - DNA, 25 bp, Homo sapien
aactagcatgactgtagggttgagc

SEQ ID NO: 259405 - DNA, 25 bp, Homo sapien
gtagggttgagctacagtcaacaaa

SEQ ID NO: 259406 - DNA, 25 bp, Homo sapien
gtcacttttccccaggaaagaatat

SEQ ID NO: 259407 - DNA, 25 bp, Homo sapien
gaaagaatatttccctctcctgcat

SEQ ID NO: 259408 - DNA, 25 bp, Homo sapien
tcctgcatcaagtctgcgtggccat

SEQ ID NO: 259409 - DNA, 25 bp, Homo sapien
tgcatcaagtctgcgtggccatcct

SEQ ID NO: 259410 - DNA, 25 bp, Homo sapien
gctgttggctttgctgagtgcatgc

SEQ ID NO: 259411 - DNA, 25 bp, Homo sapien
gttggctttgctgagtgcatgctga

SEQ ID NO: 259412 - DNA, 25 bp, Homo sapien
gctttgctgagtgcatgctgaggct

SEQ ID NO: 259413 - DNA, 25 bp, Homo sapien
tgagtgcatgctgaggctggtagac

SEQ ID NO: 259414 - DNA, 25 bp, Homo sapien
ggactgcccaagactttgccggcca

SEQ ID NO: 259415 - DNA, 25 bp, Homo sapien
gactttgccggccacgacaacgcag

SEQ ID NO: 259416 - DNA, 25 bp, Homo sapien
ttgccggccacgacaacgcagtgca

SEQ ID NO: 259417 - DNA, 25 bp, Homo sapien
acgacaacgcagtgcacctgtgcag

SEQ ID NO: 259418 - DNA, 25 bp, Homo sapien
acaacgcagtgcacctgtgcaggtt

SEQ ID NO: 259419 - DNA, 25 bp, Homo sapien
cgcagtgcacctgtgcaggtttaca

SEQ ID NO: 259420 - DNA, 25 bp, Homo sapien
cctgatgtacgtgggccccggtgtt

SEQ ID NO: 259421 - DNA, 25 bp, Homo sapien
cacattacttcttttggcataattt

SEQ ID NO: 259422 - DNA, 25 bp, Homo sapien
agacatcattcacatttatcaatgt

SEQ ID NO: 259423 - DNA, 25 bp, Homo sapien
atataagaactcacccaccatattc

SEQ ID NO: 259424 - DNA, 25 bp, Homo sapien
taatcgtctaacaattttataatgg

SEQ ID NO: 259425 - DNA, 25 bp, Homo sapien
agtcatggcttctccagtcatttct

SEQ ID NO: 259426 - DNA, 25 bp, Homo sapien
catggcttctccagtcatttcttgc

SEQ ID NO: 259427 - DNA, 25 bp, Homo sapien
ttcttgcttatcgaaattatttcat

SEQ ID NO: 259428 - DNA, 25 bp, Homo sapien
tatttcatgagatgggtctctcctt

SEQ ID NO: 259429 - DNA, 25 bp, Homo sapien
catgagatgggtctctccttgtata

SEQ ID NO: 259430 - DNA, 25 bp, Homo sapien
atgggtctctccttgtatatttgaa

SEQ ID NO: 259431 - DNA, 25 bp, Homo sapien
tgaaaatgaggtttgcttccttcta

SEQ ID NO: 259432 - DNA, 25 bp, Homo sapien
gagtcacatatacacctcttgtttt

SEQ ID NO: 259433 - DNA, 25 bp, Homo sapien
ttattttcttgctttcacgggtatt

SEQ ID NO: 259434 - DNA, 25 bp, Homo sapien
gctttcacgggtattattgccaaga

SEQ ID NO: 259435 - DNA, 25 bp, Homo sapien
tgatccctttgacatcacctctcat

SEQ ID NO: 259436 - DNA, 25 bp, Homo sapien
aacacacccctaaaatttgcactct

SEQ ID NO: 259437 - DNA, 25 bp, Homo sapien
tttgcactctcttccgttttgaaaa

SEQ ID NO: 259438 - DNA, 25 bp, Homo sapien
caaatgcacactattaccgtctttc

SEQ ID NO: 259439 - DNA, 25 bp, Homo sapien
tcaccctgcgctatatttccaaagt

SEQ ID NO: 259440 - DNA, 25 bp, Homo sapien
tataatccagatattgccccatctc

SEQ ID NO: 259441 - DNA, 25 bp, Homo sapien
attgccccatctcaaacatgttaag

SEQ ID NO: 259442 - DNA, 25 bp, Homo sapien
acatgttaagtcagactgtgctgaa

SEQ ID NO: 259443 - DNA, 25 bp, Homo sapien
gctggagctcttctgggcaccaacc

SEQ ID NO: 259444 - DNA, 25 bp, Homo sapien
tgggcaccaaccctggcataaaacc

SEQ ID NO: 259445 - DNA, 25 bp, Homo sapien
actcaacagtgcctctgatggagca

SEQ ID NO: 259446 - DNA, 25 bp, Homo sapien
agcaggttcagcttggttgtgacct

SEQ ID NO: 259447 - DNA, 25 bp, Homo sapien
ttggttgtgacctctgctagaagcc

SEQ ID NO: 259448 - DNA, 25 bp, Homo sapien
tccctgtgcactgagctggtggttc

SEQ ID NO: 259449 - DNA, 25 bp, Homo sapien
tgagctggtggttcctcctttgcgc

SEQ ID NO: 259450 - DNA, 25 bp, Homo sapien
ttgcgccccaggtacatgctcagat

SEQ ID NO: 259451 - DNA, 25 bp, Homo sapien
atgctcagatctgtgtaccctacac

SEQ ID NO: 259452 - DNA, 25 bp, Homo sapien
aatgcagcctagaaggcctggaccc

SEQ ID NO: 259453 - DNA, 25 bp, Homo sapien
aggagatgctgctcccatccagtaa

SEQ ID NO: 259454 - DNA, 25 bp, Homo sapien
cgattctgaggatttgtttaactaa

SEQ ID NO: 259455 - DNA, 25 bp, Homo sapien
ggagtgccaggcatcccatgggacc

SEQ ID NO: 259456 - DNA, 25 bp, Homo sapien
cagtgtctgtgcctcccagaggtca

SEQ ID NO: 259457 - DNA, 25 bp, Homo sapien
ctgtgacagggcagagcatttctgg

SEQ ID NO: 259458 - DNA, 25 bp, Homo sapien
cagagcatttctggtcagtttctcc

SEQ ID NO: 259459 - DNA, 25 bp, Homo sapien
atttctggtcagtttctccatggtg

SEQ ID NO: 259460 - DNA, 25 bp, Homo sapien
tggtcagtttctccatggtgcctcc

SEQ ID NO: 259461 - DNA, 25 bp, Homo sapien
ctcccacccctttgtaaagtggatg

SEQ ID NO: 259462 - DNA, 25 bp, Homo sapien
gatggaattcagttgtctcaccctg

SEQ ID NO: 259463 - DNA, 25 bp, Homo sapien
ccctgatagcctgggtgttgatatt

SEQ ID NO: 259464 - DNA, 25 bp, Homo sapien
agcctgggtgttgatattcacttta

SEQ ID NO: 259465 - DNA, 25 bp, Homo sapien
acttgcgatgcatcttactctgttt

SEQ ID NO: 259466 - DNA, 25 bp, Homo sapien
agggcaattcccttttctgatattg

SEQ ID NO: 259467 - DNA, 25 bp, Homo sapien
ccttttctgatattgctagctgtgt

SEQ ID NO: 259468 - DNA, 25 bp, Homo sapien
agctgtgtttcttgggttgccacta

SEQ ID NO: 259469 - DNA, 25 bp, Homo sapien
gttgccactattgccactgaatgaa

SEQ ID NO: 259470 - DNA, 25 bp, Homo sapien
tcacctaaccaggtaatctgcagtt

SEQ ID NO: 259471 - DNA, 25 bp, Homo sapien
atctgcagttctcataatcgctttg

SEQ ID NO: 259472 - DNA, 25 bp, Homo sapien
taatcgctttgtgctattgatgagc

SEQ ID NO: 259473 - DNA, 25 bp, Homo sapien
gcagtcatatgtttttcaatgctat

SEQ ID NO: 259474 - DNA, 25 bp, Homo sapien
gcatgtctgttttttgacggcatct

SEQ ID NO: 259475 - DNA, 25 bp, Homo sapien
atcttgccatttgtgcattttacac

SEQ ID NO: 259476 - DNA, 25 bp, Homo sapien
tggccattggtaaacagaaaagctc

SEQ ID NO: 259477 - DNA, 25 bp, Homo sapien
agaaaagctcgcacacttgatgatt

SEQ ID NO: 259478 - DNA, 25 bp, Homo sapien
gctcgcacacttgatgattatgata

SEQ ID NO: 259479 - DNA, 25 bp, Homo sapien
gattatgatacatttgtcctaagca

SEQ ID NO: 259480 - DNA, 25 bp, Homo sapien
ttgtcctaagcaagaaaggccatta

SEQ ID NO: 259481 - DNA, 25 bp, Homo sapien
aattattttcccaccatactatcag

SEQ ID NO: 259482 - DNA, 25 bp, Homo sapien
ttcccaccatactatcagaaattag

SEQ ID NO: 259483 - DNA, 25 bp, Homo sapien
tcaacttctggataaatacacatgc

SEQ ID NO: 259484 - DNA, 25 bp, Homo sapien
tacacatgcctatgtatcctgacct

SEQ ID NO: 259485 - DNA, 25 bp, Homo sapien
tgcctatgtatcctgacctttcaaa

SEQ ID NO: 259486 - DNA, 25 bp, Homo sapien
gacctttcaaagagttcactggtat

SEQ ID NO: 259487 - DNA, 25 bp, Homo sapien
gagtcaaatatgtagcaggcagcca

SEQ ID NO: 259488 - DNA, 25 bp, Homo sapien
tcaaatatgtagcaggcagccaggg

SEQ ID NO: 259489 - DNA, 25 bp, Homo sapien
ccagggtcagtttgtggccactgct

SEQ ID NO: 259490 - DNA, 25 bp, Homo sapien
gggtcagtttgtggccactgctgcc

SEQ ID NO: 259491 - DNA, 25 bp, Homo sapien
ttccctgttgggttcaacacatctg

SEQ ID NO: 259492 - DNA, 25 bp, Homo sapien
tgttgggttcaacacatctgtgctc

SEQ ID NO: 259493 - DNA, 25 bp, Homo sapien
gttcaacacatctgtgctcctgtaa

SEQ ID NO: 259494 - DNA, 25 bp, Homo sapien
catctgtgctcctgtaagccctcag

SEQ ID NO: 259495 - DNA, 25 bp, Homo sapien
agcaagagaggctgaactaggagca

SEQ ID NO: 259496 - DNA, 25 bp, Homo sapien
caggacccagggactgaaaccagca

SEQ ID NO: 259497 - DNA, 25 bp, Homo sapien
ccagggactgaaaccagcacagcat

SEQ ID NO: 259498 - DNA, 25 bp, Homo sapien
gaaaaactttgttccttcagccatc

SEQ ID NO: 259499 - DNA, 25 bp, Homo sapien
tttgttccttcagccatcttcacag

SEQ ID NO: 259500 - DNA, 25 bp, Homo sapien
gccatcttcacaggccagggactgg

SEQ ID NO: 259501 - DNA, 25 bp, Homo sapien
tggactcaaatgcatctggaatgga

SEQ ID NO: 259502 - DNA, 25 bp, Homo sapien
gtgcatcctacagttcctaaagagt

SEQ ID NO: 259503 - DNA, 25 bp, Homo sapien
atttgtataaactcgtgtgagatca

SEQ ID NO: 259504 - DNA, 25 bp, Homo sapien
actagcttctcagtgggtgcatcat

SEQ ID NO: 259505 - DNA, 25 bp, Homo sapien
gcttctcagtgggtgcatcatagtg

SEQ ID NO: 259506 - DNA, 25 bp, Homo sapien
cagtgggtgcatcatagtgcaagtt

SEQ ID NO: 259507 - DNA, 25 bp, Homo sapien
attttctatcatctacccacctggt

SEQ ID NO: 259508 - DNA, 25 bp, Homo sapien
catctacccacctggttttcggagg

SEQ ID NO: 259509 - DNA, 25 bp, Homo sapien
aaaggccgtgctattctatttatgc

SEQ ID NO: 259510 - DNA, 25 bp, Homo sapien
taaaccaggactgttccagacccag

SEQ ID NO: 259511 - DNA, 25 bp, Homo sapien
aggaagtataggcagccttcctccg

SEQ ID NO: 259512 - DNA, 25 bp, Homo sapien
ttcctccggtcaaagagttcgcagg

SEQ ID NO: 259513 - DNA, 25 bp, Homo sapien
ttcgcaggtggtgctgaacgactcc

SEQ ID NO: 259514 - DNA, 25 bp, Homo sapien
gtgctgaacgactccagaacgtgaa

SEQ ID NO: 259515 - DNA, 25 bp, Homo sapien
agaacgtgaactgccctacagcagg

SEQ ID NO: 259516 - DNA, 25 bp, Homo sapien
tacagcaggcatcttctacagtcaa

SEQ ID NO: 259517 - DNA, 25 bp, Homo sapien
tacagtcaagctgaggtctcctgga

SEQ ID NO: 259518 - DNA, 25 bp, Homo sapien
gtctcctggaggttacaagcacctg

SEQ ID NO: 259519 - DNA, 25 bp, Homo sapien
tttgccaacatcttgtccaaataat

SEQ ID NO: 259520 - DNA, 25 bp, Homo sapien
ttatccttaaagttatagctacaac

SEQ ID NO: 259521 - DNA, 25 bp, Homo sapien
aaaacacactttatcttagacacca

SEQ ID NO: 259522 - DNA, 25 bp, Homo sapien
actttatcttagacaccaaagccaa

SEQ ID NO: 259523 - DNA, 25 bp, Homo sapien
ccaaattattccaagtgtatgctat

SEQ ID NO: 259524 - DNA, 25 bp, Homo sapien
tgtatgctatacaccgcagtgcagc

SEQ ID NO: 259525 - DNA, 25 bp, Homo sapien
tgctatacaccgcagtgcagctctg

SEQ ID NO: 259526 - DNA, 25 bp, Homo sapien
tatacaccgcagtgcagctctgctt

SEQ ID NO: 259527 - DNA, 25 bp, Homo sapien
gttatagctacaacaaattgaaccc

SEQ ID NO: 259528 - DNA, 25 bp, Homo sapien
ggccatttttggcacaatagttgtt

SEQ ID NO: 259529 - DNA, 25 bp, Homo sapien
gcacaatagttgttcaaatgtagat

SEQ ID NO: 259530 - DNA, 25 bp, Homo sapien
aattgaaccctgtagttattactga

SEQ ID NO: 259531 - DNA, 25 bp, Homo sapien
agaaagtatccccttctaccatctt

SEQ ID NO: 259532 - DNA, 25 bp, Homo sapien
cttccatttgtgtctgggttgtgct

SEQ ID NO: 259533 - DNA, 25 bp, Homo sapien
gttgtgctgggtaaagttctagact

SEQ ID NO: 259534 - DNA, 25 bp, Homo sapien
gttctagacttactaacgcagactt

SEQ ID NO: 259535 - DNA, 25 bp, Homo sapien
aacgcagacttcattttggtccggt

SEQ ID NO: 259536 - DNA, 25 bp, Homo sapien
attttggtccggtttccacagcatg

SEQ ID NO: 259537 - DNA, 25 bp, Homo sapien
tcgggcatcagtgtccaggagtagc

SEQ ID NO: 259538 - DNA, 25 bp, Homo sapien
agtagctgtatttgaggtttccttc

SEQ ID NO: 259539 - DNA, 25 bp, Homo sapien
gaggtttccttcactctggtaggtt

SEQ ID NO: 259540 - DNA, 25 bp, Homo sapien
ggtaggttcctgattcctgatgaaa

SEQ ID NO: 259541 - DNA, 25 bp, Homo sapien
attatactactgatcctcttttggg

SEQ ID NO: 259542 - DNA, 25 bp, Homo sapien
gagcctgaagaacaattccctctat

SEQ ID NO: 259543 - DNA, 25 bp, Homo sapien
aattccctctatgagacctggctgg

SEQ ID NO: 259544 - DNA, 25 bp, Homo sapien
gcagcaggagtgaccaatccctgat

SEQ ID NO: 259545 - DNA, 25 bp, Homo sapien
gtgaccaatccctgatgtaaaacat

SEQ ID NO: 259546 - DNA, 25 bp, Homo sapien
gagtctctgcatttgaaggtgtctt

SEQ ID NO: 259547 - DNA, 25 bp, Homo sapien
ttgaaggtgtctttactccaggccc

SEQ ID NO: 259548 - DNA, 25 bp, Homo sapien
cagaatggacgagtacagaagatgt

SEQ ID NO: 259549 - DNA, 25 bp, Homo sapien
gaagatgtggatgttcccttccctt

SEQ ID NO: 259550 - DNA, 25 bp, Homo sapien
cttcctcagccaggagaaacgggat

SEQ ID NO: 259551 - DNA, 25 bp, Homo sapien
aacgggatggtatcttgagttctgc

SEQ ID NO: 259552 - DNA, 25 bp, Homo sapien
atcttgagttctgcagtccctgagc

SEQ ID NO: 259553 - DNA, 25 bp, Homo sapien
ctactttgaagggaggttcatctaa

SEQ ID NO: 259554 - DNA, 25 bp, Homo sapien
ggaggttcatctaagtattactgat

SEQ ID NO: 259555 - DNA, 25 bp, Homo sapien
attactgataacagggatccaactt

SEQ ID NO: 259556 - DNA, 25 bp, Homo sapien
gataacagggatccaacttaaagta

SEQ ID NO: 259557 - DNA, 25 bp, Homo sapien
ggcaagagtcttttaagcggaactt

SEQ ID NO: 259558 - DNA, 25 bp, Homo sapien
agcggaacttcaattctgttgtcat

SEQ ID NO: 259559 - DNA, 25 bp, Homo sapien
aattctgttgtcatggttacttata

SEQ ID NO: 259560 - DNA, 25 bp, Homo sapien
aaatgtggtatattctaagtcaaga

SEQ ID NO: 259561 - DNA, 25 bp, Homo sapien
gtcaagatgctatgaagttgttata

SEQ ID NO: 259562 - DNA, 25 bp, Homo sapien
gttgttatagtttaagggacattct

SEQ ID NO: 259563 - DNA, 25 bp, Homo sapien
ttacttaagtacattactcttctca

SEQ ID NO: 259564 - DNA, 25 bp, Homo sapien
ccctcaggtggcagtgaccccgtca

SEQ ID NO: 259565 - DNA, 25 bp, Homo sapien
gcagtggccttggtcttggaaactg

SEQ ID NO: 259566 - DNA, 25 bp, Homo sapien
agtggccttggtcttggaaactgaa

SEQ ID NO: 259567 - DNA, 25 bp, Homo sapien
gtggccttggtcttggaaactgaag

SEQ ID NO: 259568 - DNA, 25 bp, Homo sapien
gccttggtcttggaaactgaaggga

SEQ ID NO: 259569 - DNA, 25 bp, Homo sapien
ctgaagggagaaggtctggccccca

SEQ ID NO: 259570 - DNA, 25 bp, Homo sapien
gcactggccctctgtgaggttcgat

SEQ ID NO: 259571 - DNA, 25 bp, Homo sapien
actggccctctgtgaggttcgatac

SEQ ID NO: 259572 - DNA, 25 bp, Homo sapien
gccctctgtgaggttcgatacttga

SEQ ID NO: 259573 - DNA, 25 bp, Homo sapien
ccctctgtgaggttcgatacttgaa

SEQ ID NO: 259574 - DNA, 25 bp, Homo sapien
gtgaggttcgatacttgaacgcccc

SEQ ID NO: 259575 - DNA, 25 bp, Homo sapien
tgcaactcctgcacatgctcaggac

SEQ ID NO: 259576 - DNA, 25 bp, Homo sapien
aaggagactatggatggacagcaca

SEQ ID NO: 259577 - DNA, 25 bp, Homo sapien
ggacagcacagaattacagccaatt

SEQ ID NO: 259578 - DNA, 25 bp, Homo sapien
tggttttaaatttcgccttggcact

SEQ ID NO: 259579 - DNA, 25 bp, Homo sapien
tgaaatgacagtaagtgttccttct

SEQ ID NO: 259580 - DNA, 25 bp, Homo sapien
aagtgttccttctgattcacgtatg

SEQ ID NO: 259581 - DNA, 25 bp, Homo sapien
gttccttctgattcacgtatgtgca

SEQ ID NO: 259582 - DNA, 25 bp, Homo sapien
cttctgattcacgtatgtgcatgta

SEQ ID NO: 259583 - DNA, 25 bp, Homo sapien
ttcacgtatgtgcatgtatttgtaa

SEQ ID NO: 259584 - DNA, 25 bp, Homo sapien
gcatgtatttgtaaaagtgtgtttg

SEQ ID NO: 259585 - DNA, 25 bp, Homo sapien
gtttgtgtgtgcattaaaagcaatt

SEQ ID NO: 259586 - DNA, 25 bp, Homo sapien
aagcactgacccacgcggactctgg

SEQ ID NO: 259587 - DNA, 25 bp, Homo sapien
tgggctgctggcctcacatttccac

SEQ ID NO: 259588 - DNA, 25 bp, Homo sapien
tggcctcacatttccactggcagtg

SEQ ID NO: 259589 - DNA, 25 bp, Homo sapien
actggcagtggagcctttccctgct

SEQ ID NO: 259590 - DNA, 25 bp, Homo sapien
tttccctgctccacaaatggccagg

SEQ ID NO: 259591 - DNA, 25 bp, Homo sapien
aaggcttccggctgttatcggctgc

SEQ ID NO: 259592 - DNA, 25 bp, Homo sapien
tccggctgttatcggctgcctcagg

SEQ ID NO: 259593 - DNA, 25 bp, Homo sapien
gggcgagtaccttggagggcctgct

SEQ ID NO: 259594 - DNA, 25 bp, Homo sapien
tggagggcacacaccagcctagtgc

SEQ ID NO: 259595 - DNA, 25 bp, Homo sapien
acacaccagcctagtgcttaccttg

SEQ ID NO: 259596 - DNA, 25 bp, Homo sapien
agcctagtgcttaccttggctcctg

SEQ ID NO: 259597 - DNA, 25 bp, Homo sapien
ttttttgtatgtctgcagtcgtcat

SEQ ID NO: 259598 - DNA, 25 bp, Homo sapien
cagtcgtcattaattgcagtggtta

SEQ ID NO: 259599 - DNA, 25 bp, Homo sapien
aagtgtggtctgcagacctcaggtc

SEQ ID NO: 259600 - DNA, 25 bp, Homo sapien
gcagacctcaggtcattcctaagac

SEQ ID NO: 259601 - DNA, 25 bp, Homo sapien
aagaccctttcacagagttgcaagg

SEQ ID NO: 259602 - DNA, 25 bp, Homo sapien
gatggctattctcatgatttatctg

SEQ ID NO: 259603 - DNA, 25 bp, Homo sapien
tttatctgcccttaaataggaacag

SEQ ID NO: 259604 - DNA, 25 bp, Homo sapien
ggaacagtagcatacccagtgccct

SEQ ID NO: 259605 - DNA, 25 bp, Homo sapien
tacccagtgccctagcatagtaatt

SEQ ID NO: 259606 - DNA, 25 bp, Homo sapien
aatagttgtaggtctttgcttgaat

SEQ ID NO: 259607 - DNA, 25 bp, Homo sapien
tctttgcttgaatagaaggtaaccc

SEQ ID NO: 259608 - DNA, 25 bp, Homo sapien
agggctcaccaaccagtcagctcag

SEQ ID NO: 259609 - DNA, 25 bp, Homo sapien
ggacatggtagaaaattaccccaca

SEQ ID NO: 259610 - DNA, 25 bp, Homo sapien
agaaaattaccccacagctttgcgg

SEQ ID NO: 259611 - DNA, 25 bp, Homo sapien
cacagctttgcggagcctggtgttg

SEQ ID NO: 259612 - DNA, 25 bp, Homo sapien
gttggctgagaacagcattagccca

SEQ ID NO: 259613 - DNA, 25 bp, Homo sapien
agaacagcattagcccagagctgca

SEQ ID NO: 259614 - DNA, 25 bp, Homo sapien
tgcagcaacagatctgtgacctcct

SEQ ID NO: 259615 - DNA, 25 bp, Homo sapien
gcaacagatctgtgacctcctctct

SEQ ID NO: 259616 - DNA, 25 bp, Homo sapien
agcagctcctggatgtgccccagcg

SEQ ID NO: 259617 - DNA, 25 bp, Homo sapien
ccagctctcagatggtgctaatgac

SEQ ID NO: 259618 - DNA, 25 bp, Homo sapien
tggtgctaatgacgtcaggactagg

SEQ ID NO: 259619 - DNA, 25 bp, Homo sapien
tggtggagaagataccactgccctt

SEQ ID NO: 259620 - DNA, 25 bp, Homo sapien
gctgttggctttgctgagtgcatgc

SEQ ID NO: 259621 - DNA, 25 bp, Homo sapien
gttggctttgctgagtgcatgctga

SEQ ID NO: 259622 - DNA, 25 bp, Homo sapien
gctttgctgagtgcatgctgaggct

SEQ ID NO: 259623 - DNA, 25 bp, Homo sapien
tgagtgcatgctgaggctggtagac

SEQ ID NO: 259624 - DNA, 25 bp, Homo sapien
ggactgcccaagactttgccggcca

SEQ ID NO: 259625 - DNA, 25 bp, Homo sapien
gactttgccggccacgacaacgcag

SEQ ID NO: 259626 - DNA, 25 bp, Homo sapien
acgacaacgcagtgcacctgtgcag

SEQ ID NO: 259627 - DNA, 25 bp, Homo sapien
cgcagtgcacctgtgcaggtttaca

SEQ ID NO: 259628 - DNA, 25 bp, Homo sapien
cctgatgtacgtgggccccggtgtt

SEQ ID NO: 259629 - DNA, 25 bp, Homo sapien
catctacaacctctgccagaagcag

SEQ ID NO: 259630 - DNA, 25 bp, Homo sapien
ctcaatgtgactgttgatttgctga

SEQ ID NO: 259631 - DNA, 25 bp, Homo sapien
gatttgctgaactttacatatcaca

SEQ ID NO: 259632 - DNA, 25 bp, Homo sapien
ttctcagttattgaacaagcaagca

SEQ ID NO: 259633 - DNA, 25 bp, Homo sapien
aagcaagcattatccagttgatctg

SEQ ID NO: 259634 - DNA, 25 bp, Homo sapien
atccagttgatctggcaatgacttt

SEQ ID NO: 259635 - DNA, 25 bp, Homo sapien
gtgtgggccacaatattgattttcc

SEQ ID NO: 259636 - DNA, 25 bp, Homo sapien
ggccacaatattgattttcccatta

SEQ ID NO: 259637 - DNA, 25 bp, Homo sapien
taatatgtttcacactatagtttgt

SEQ ID NO: 259638 - DNA, 25 bp, Homo sapien
gtttgtgtaacaacacgtgttcgca

SEQ ID NO: 259639 - DNA, 25 bp, Homo sapien
acacgtgttcgcattatctatgttg

SEQ ID NO: 259640 - DNA, 25 bp, Homo sapien
attatctatgttgctgttacttttg

SEQ ID NO: 259641 - DNA, 25 bp, Homo sapien
gaagaaactaattatcccagagagt

SEQ ID NO: 259642 - DNA, 25 bp, Homo sapien
atcccagagagtttttgagcatatg

SEQ ID NO: 259643 - DNA, 25 bp, Homo sapien
gtgaatttaagtttgttccccacat

SEQ ID NO: 259644 - DNA, 25 bp, Homo sapien
tttaagtttgttccccacattgtca

SEQ ID NO: 259645 - DNA, 25 bp, Homo sapien
tccccacattgtcagtttattctaa

SEQ ID NO: 259646 - DNA, 25 bp, Homo sapien
gcaaacagacttgcttaggtcctgt

SEQ ID NO: 259647 - DNA, 25 bp, Homo sapien
gacttgcttaggtcctgtagcaaat

SEQ ID NO: 259648 - DNA, 25 bp, Homo sapien
gtagcaaattaattcagaccttgaa

SEQ ID NO: 259649 - DNA, 25 bp, Homo sapien
agaccttgaacaacatttcattgtg

SEQ ID NO: 259650 - DNA, 25 bp, Homo sapien
acatttcattgtgctgtttaggaag

SEQ ID NO: 259651 - DNA, 25 bp, Homo sapien
ttccatattactgtgttactatcat

SEQ ID NO: 259652 - DNA, 25 bp, Homo sapien
atagctggaaggatattgcacattc

SEQ ID NO: 259653 - DNA, 25 bp, Homo sapien
gctggaaggatattgcacattctca

SEQ ID NO: 259654 - DNA, 25 bp, Homo sapien
tggaaggatattgcacattctcaac

SEQ ID NO: 259655 - DNA, 25 bp, Homo sapien
gatattgcacattctcaacataaag

SEQ ID NO: 259656 - DNA, 25 bp, Homo sapien
taaacatatgagatggtggatgtgc

SEQ ID NO: 259657 - DNA, 25 bp, Homo sapien
tataattatgtgctctcaagaatat

SEQ ID NO: 259658 - DNA, 25 bp, Homo sapien
attatgtgctctcaagaatatgtac

SEQ ID NO: 259659 - DNA, 25 bp, Homo sapien
ttctagtgttcgacagcactgtaga

SEQ ID NO: 259660 - DNA, 25 bp, Homo sapien
ctagtgttcgacagcactgtagaat

SEQ ID NO: 259661 - DNA, 25 bp, Homo sapien
gtgttcgacagcactgtagaatgac

SEQ ID NO: 259662 - DNA, 25 bp, Homo sapien
tcgacagcactgtagaatgactaca

SEQ ID NO: 259663 - DNA, 25 bp, Homo sapien
aagttatccctttatccagtttgcg

SEQ ID NO: 259664 - DNA, 25 bp, Homo sapien
atccctttatccagtttgcggtgta

SEQ ID NO: 259665 - DNA, 25 bp, Homo sapien
ctttatccagtttgcggtgtacgtt

SEQ ID NO: 259666 - DNA, 25 bp, Homo sapien
tccagtttgcggtgtacgtttgtta

SEQ ID NO: 259667 - DNA, 25 bp, Homo sapien
gtacgtttgttaaccttacagcaag

SEQ ID NO: 259668 - DNA, 25 bp, Homo sapien
ttacagcaagtaacacatgagtttt

SEQ ID NO: 259669 - DNA, 25 bp, Homo sapien
ttggacaacggcaaatgagatgaaa

SEQ ID NO: 259670 - DNA, 25 bp, Homo sapien
gatgaaaggcgaacaatccgaaagc

SEQ ID NO: 259671 - DNA, 25 bp, Homo sapien
aaggcgaacaatccgaaagccggat

SEQ ID NO: 259672 - DNA, 25 bp, Homo sapien
gaaagccggatcactgaggagctct

SEQ ID NO: 259673 - DNA, 25 bp, Homo sapien
tcactgaggagctctgggaacgcgc

SEQ ID NO: 259674 - DNA, 25 bp, Homo sapien
ctccccgctgcgtccagggatggag

SEQ ID NO: 259675 - DNA, 25 bp, Homo sapien
gtccagggatggagggccccaccac

SEQ ID NO: 259676 - DNA, 25 bp, Homo sapien
accacccatggaattgctggcccct

SEQ ID NO: 259677 - DNA, 25 bp, Homo sapien
tggcccgggacttcagccgtggctt

SEQ ID NO: 259678 - DNA, 25 bp, Homo sapien
cgtggcttcgcgtcaagagggtatt

SEQ ID NO: 259679 - DNA, 25 bp, Homo sapien
ggcttcgcgtcaagagggtattttt

SEQ ID NO: 259680 - DNA, 25 bp, Homo sapien
ttcgcgtcaagagggtatttttcct

SEQ ID NO: 259681 - DNA, 25 bp, Homo sapien
agccggagccgaaacctgagccaga

SEQ ID NO: 259682 - DNA, 25 bp, Homo sapien
ggagccgaaacctgagccagagtcc

SEQ ID NO: 259683 - DNA, 25 bp, Homo sapien
ctgagccagagtccgcggcgggcga

SEQ ID NO: 259684 - DNA, 25 bp, Homo sapien
cggagcccacgagccgcagacgcag

SEQ ID NO: 259685 - DNA, 25 bp, Homo sapien
gtgaccacagcagctgcatgcagac

SEQ ID NO: 259686 - DNA, 25 bp, Homo sapien
atgcagacaggactgcccgtgcttt

SEQ ID NO: 259687 - DNA, 25 bp, Homo sapien
aaacttgtttctcagacttccgcag

SEQ ID NO: 259688 - DNA, 25 bp, Homo sapien
ttccgcagatctcatcactttgatt

SEQ ID NO: 259689 - DNA, 25 bp, Homo sapien
ggtgattttgtttatcgttcctgta

SEQ ID NO: 259690 - DNA, 25 bp, Homo sapien
ttatcgttcctgtaacttgttctac

SEQ ID NO: 259691 - DNA, 25 bp, Homo sapien
acttgttctacattccacagtcttt

SEQ ID NO: 259692 - DNA, 25 bp, Homo sapien
cattccacagtctttaccgttttat

SEQ ID NO: 259693 - DNA, 25 bp, Homo sapien
tacaacaatccctgtccattgattc

SEQ ID NO: 259694 - DNA, 25 bp, Homo sapien
gtccattgattccactctggaactc

SEQ ID NO: 259695 - DNA, 25 bp, Homo sapien
gaactctttgttcatgccaattttg

SEQ ID NO: 259696 - DNA, 25 bp, Homo sapien
acgcagtcagggtggaccgtgcaca

SEQ ID NO: 259697 - DNA, 25 bp, Homo sapien
tcagggtggaccgtgcacagggttt

SEQ ID NO: 259698 - DNA, 25 bp, Homo sapien
gtggaccgtgcacagggtttgtggg

SEQ ID NO: 259699 - DNA, 25 bp, Homo sapien
tgagctgcttccctgattcacaggg

SEQ ID NO: 259700 - DNA, 25 bp, Homo sapien
gattcacagggctgtggcacaccct

SEQ ID NO: 259701 - DNA, 25 bp, Homo sapien
ttcacagggctgtggcacaccctgg

SEQ ID NO: 259702 - DNA, 25 bp, Homo sapien
cagggctgtggcacaccctgggaca

SEQ ID NO: 259703 - DNA, 25 bp, Homo sapien
actctcctcaggacaacaagccaat

SEQ ID NO: 259704 - DNA, 25 bp, Homo sapien
tcaggacaacaagccaatccctcca

SEQ ID NO: 259705 - DNA, 25 bp, Homo sapien
acaacaagccaatccctccactggg

SEQ ID NO: 259706 - DNA, 25 bp, Homo sapien
agccccacgcagtcagggtggaccg

SEQ ID NO: 259707 - DNA, 25 bp, Homo sapien
gctcaaaggaactcggagccttttt

SEQ ID NO: 259708 - DNA, 25 bp, Homo sapien
tatcttgttttttaccgctgggcaa

SEQ ID NO: 259709 - DNA, 25 bp, Homo sapien
ggagcctttttagaagaaatcgtgc

SEQ ID NO: 259710 - DNA, 25 bp, Homo sapien
atcgtgctgaattataatgtggctt

SEQ ID NO: 259711 - DNA, 25 bp, Homo sapien
atgtggcttactgcaataatgtttc

SEQ ID NO: 259712 - DNA, 25 bp, Homo sapien
ataatgtttctttgatcaggatgga

SEQ ID NO: 259713 - DNA, 25 bp, Homo sapien
taccgctgggcaaaccttgctggaa

SEQ ID NO: 259714 - DNA, 25 bp, Homo sapien
ttgctggaacaacaactgacttcat

SEQ ID NO: 259715 - DNA, 25 bp, Homo sapien
acaactgacttcatgatttgcacat

SEQ ID NO: 259716 - DNA, 25 bp, Homo sapien
gatttgcacatttggagggcttaac

SEQ ID NO: 259717 - DNA, 25 bp, Homo sapien
ggagggcttaacgtctttgcaaatg

SEQ ID NO: 259718 - DNA, 25 bp, Homo sapien
attcttctgagtagacctgtgttct

SEQ ID NO: 259719 - DNA, 25 bp, Homo sapien
ctgtgttctctgtttcaagtatgga

SEQ ID NO: 259720 - DNA, 25 bp, Homo sapien
gtatggaactgcataatggttcagt

SEQ ID NO: 259721 - DNA, 25 bp, Homo sapien
gggaaagtcttgctatatccttgag

SEQ ID NO: 259722 - DNA, 25 bp, Homo sapien
agtcttgctatatccttgagccagg

SEQ ID NO: 259723 - DNA, 25 bp, Homo sapien
gccaggaatcaaggtctccattgtt

SEQ ID NO: 259724 - DNA, 25 bp, Homo sapien
aaggtctccattgttatcctagccc

SEQ ID NO: 259725 - DNA, 25 bp, Homo sapien
cattgttatcctagccccatagatg

SEQ ID NO: 259726 - DNA, 25 bp, Homo sapien
cctagccccatagatgtttttactt

SEQ ID NO: 259727 - DNA, 25 bp, Homo sapien
atagatgtttttacttagccctaag

SEQ ID NO: 259728 - DNA, 25 bp, Homo sapien
aaagactagcacacaaggacaaata

SEQ ID NO: 259729 - DNA, 25 bp, Homo sapien
caagaattgcattgacccctggatt

SEQ ID NO: 259730 - DNA, 25 bp, Homo sapien
ttgcattgacccctggattttaccc

SEQ ID NO: 259731 - DNA, 25 bp, Homo sapien
gggacatgccccatttgcaaatgtg

SEQ ID NO: 259732 - DNA, 25 bp, Homo sapien
gaacctttgcaagttctaatgtcaa

SEQ ID NO: 259733 - DNA, 25 bp, Homo sapien
tgtcaaatgaactgcctgaaacctt

SEQ ID NO: 259734 - DNA, 25 bp, Homo sapien
gcctgaaaccttatcacctagtgaa

SEQ ID NO: 259735 - DNA, 25 bp, Homo sapien
aataatgaagtttctcctgcaggaa

SEQ ID NO: 259736 - DNA, 25 bp, Homo sapien
gatagctgcgtaatttgctttgaac

SEQ ID NO: 259737 - DNA, 25 bp, Homo sapien
tgctttgaacgctataagcctaatg

SEQ ID NO: 259738 - DNA, 25 bp, Homo sapien
gcctaatgacatagttcgtattctg

SEQ ID NO: 259739 - DNA, 25 bp, Homo sapien
gttcgtattctgacttgtaaacatt

SEQ ID NO: 259740 - DNA, 25 bp, Homo sapien
tttagaccggtcatggattctgcct

SEQ ID NO: 259741 - DNA, 25 bp, Homo sapien
taccactttctagctatctggctac

SEQ ID NO: 259742 - DNA, 25 bp, Homo sapien
ctggctactagcaagttaccttaac

SEQ ID NO: 259743 - DNA, 25 bp, Homo sapien
acaatctaagtttcaacctccccat

SEQ ID NO: 259744 - DNA, 25 bp, Homo sapien
tcaacctccccattcgtgaaatgga

SEQ ID NO: 259745 - DNA, 25 bp, Homo sapien
gtagcaagtctactgcatatcaaca

SEQ ID NO: 259746 - DNA, 25 bp, Homo sapien
acagtgtagcactgagcctggctct

SEQ ID NO: 259747 - DNA, 25 bp, Homo sapien
aaacaggccgagagacgcaagtcaa

SEQ ID NO: 259748 - DNA, 25 bp, Homo sapien
aaaggatggtctgctgtctgtctga

SEQ ID NO: 259749 - DNA, 25 bp, Homo sapien
tctgtctgactccaatgccaatggt

SEQ ID NO: 259750 - DNA, 25 bp, Homo sapien
atgccaatggtctttcctctataac

SEQ ID NO: 259751 - DNA, 25 bp, Homo sapien
agcatggtcaagttagacttatctt

SEQ ID NO: 259752 - DNA, 25 bp, Homo sapien
cacccaacaaagtcctggcatcttg

SEQ ID NO: 259753 - DNA, 25 bp, Homo sapien
agacttatcttgcaaatgtcaatat

SEQ ID NO: 259754 - DNA, 25 bp, Homo sapien
ttaagaagcttgctataggcaggat

SEQ ID NO: 259755 - DNA, 25 bp, Homo sapien
gcttgctataggcaggatacttaat

SEQ ID NO: 259756 - DNA, 25 bp, Homo sapien
ggcaggatacttaatggaaggacaa

SEQ ID NO: 259757 - DNA, 25 bp, Homo sapien
tggcatcttggctccctgatgttga

SEQ ID NO: 259758 - DNA, 25 bp, Homo sapien
ttggctccctgatgttgatgactga

SEQ ID NO: 259759 - DNA, 25 bp, Homo sapien
gctccctgatgttgatgactgaaga

SEQ ID NO: 259760 - DNA, 25 bp, Homo sapien
tgactgaagacacaggttgttacct

SEQ ID NO: 259761 - DNA, 25 bp, Homo sapien
gaagacacaggttgttacctgtttc

SEQ ID NO: 259762 - DNA, 25 bp, Homo sapien
accatggcaccatgccctgtgatgg

SEQ ID NO: 259763 - DNA, 25 bp, Homo sapien
gagtcaaatatgtagcaggcagcca

SEQ ID NO: 259764 - DNA, 25 bp, Homo sapien
agggtcagtttgtggccactgctgc

SEQ ID NO: 259765 - DNA, 25 bp, Homo sapien
ttccctgttgggttcaacacatctg

SEQ ID NO: 259766 - DNA, 25 bp, Homo sapien
gttcaacacatctgtgctcctgtaa

SEQ ID NO: 259767 - DNA, 25 bp, Homo sapien
catctgtgctcctgtaagccctcag

SEQ ID NO: 259768 - DNA, 25 bp, Homo sapien
aacttctaccaccagacacatctga

SEQ ID NO: 259769 - DNA, 25 bp, Homo sapien
gacacatctgagaagcaagcaagag

SEQ ID NO: 259770 - DNA, 25 bp, Homo sapien
gaggctgaactaggagcaggaccca

SEQ ID NO: 259771 - DNA, 25 bp, Homo sapien
caggacccagggactgaaaccagca

SEQ ID NO: 259772 - DNA, 25 bp, Homo sapien
ccagggactgaaaccagcacagcat

SEQ ID NO: 259773 - DNA, 25 bp, Homo sapien
tagcagtgggccgaagaagatactt

SEQ ID NO: 259774 - DNA, 25 bp, Homo sapien
gactcagactgatttgacatgcact

SEQ ID NO: 259775 - DNA, 25 bp, Homo sapien
actgatttgacatgcactgacctct

SEQ ID NO: 259776 - DNA, 25 bp, Homo sapien
ttgacatgcactgacctctcctata

SEQ ID NO: 259777 - DNA, 25 bp, Homo sapien
tctcctatacccctcactggagaag

SEQ ID NO: 259778 - DNA, 25 bp, Homo sapien
agaagggcacagatcacagacctca

SEQ ID NO: 259779 - DNA, 25 bp, Homo sapien
cagacctcagaggataagattccca

SEQ ID NO: 259780 - DNA, 25 bp, Homo sapien
gataagattcccacattcctgatgt

SEQ ID NO: 259781 - DNA, 25 bp, Homo sapien
atgtggaaatgttctcccaaacagg

SEQ ID NO: 259782 - DNA, 25 bp, Homo sapien
gtgattccatgccaccttcatgatt

SEQ ID NO: 259783 - DNA, 25 bp, Homo sapien
ccatgccaccttcatgatttttact

SEQ ID NO: 259784 - DNA, 25 bp, Homo sapien
atgatgaccctcaggtggcagtgac

SEQ ID NO: 259785 - DNA, 25 bp, Homo sapien
gcagtgaccccgtcactgtataaga

SEQ ID NO: 259786 - DNA, 25 bp, Homo sapien
agtgaccccgtcactgtataagaca

SEQ ID NO: 259787 - DNA, 25 bp, Homo sapien
gtgaccccgtcactgtataagacat

SEQ ID NO: 259788 - DNA, 25 bp, Homo sapien
cactgtataagacattttctcctgc

SEQ ID NO: 259789 - DNA, 25 bp, Homo sapien
actgtataagacattttctcctgct

SEQ ID NO: 259790 - DNA, 25 bp, Homo sapien
tgagcagaaggcatcatcccctgca

SEQ ID NO: 259791 - DNA, 25 bp, Homo sapien
agaaggcatcatcccctgcaactac

SEQ ID NO: 259792 - DNA, 25 bp, Homo sapien
agtggccttggtcttggaaactgaa

SEQ ID NO: 259793 - DNA, 25 bp, Homo sapien
gcactggccctctgtgaggttcgat

SEQ ID NO: 259794 - DNA, 25 bp, Homo sapien
gtgaggttcgatacttgaacgcccc

SEQ ID NO: 259795 - DNA, 25 bp, Homo sapien
gggcaatgtcttcccgagcaataat

SEQ ID NO: 259796 - DNA, 25 bp, Homo sapien
aatagctgagtggtggtcttaggac

SEQ ID NO: 259797 - DNA, 25 bp, Homo sapien
tggtggcccatgatgctagcactgt

SEQ ID NO: 259798 - DNA, 25 bp, Homo sapien
tagcactgtgtctttggccattctt

SEQ ID NO: 259799 - DNA, 25 bp, Homo sapien
cattcttgcctgtcatggagcatac

SEQ ID NO: 259800 - DNA, 25 bp, Homo sapien
ggagcatactccacagaagggcatg

SEQ ID NO: 259801 - DNA, 25 bp, Homo sapien
aagggcatggtcttcttggatcccg

SEQ ID NO: 259802 - DNA, 25 bp, Homo sapien
tggatcccggcatgggcccaacaaa

SEQ ID NO: 259803 - DNA, 25 bp, Homo sapien
gtagtcaatagttccactcagacct

SEQ ID NO: 259804 - DNA, 25 bp, Homo sapien
tgattgccttaactggcagctcttt

SEQ ID NO: 259805 - DNA, 25 bp, Homo sapien
tgccagcttccctcaattacatgag

SEQ ID NO: 259806 - DNA, 25 bp, Homo sapien
attaaaggcgatgcccaagtcccgg

SEQ ID NO: 259807 - DNA, 25 bp, Homo sapien
aaggcgatgcccaagtcccggcctt

SEQ ID NO: 259808 - DNA, 25 bp, Homo sapien
tcccgctggaggacggaagggacca

SEQ ID NO: 259809 - DNA, 25 bp, Homo sapien
gaccagggaccgagggtgcgcgggc

SEQ ID NO: 259810 - DNA, 25 bp, Homo sapien
tgcaggagtgcgcagggcagcaaga

SEQ ID NO: 259811 - DNA, 25 bp, Homo sapien
gcaagagtagcaggctgggcgcgcc

SEQ ID NO: 259812 - DNA, 25 bp, Homo sapien
tgggaggccaggaagtctttcgggt

SEQ ID NO: 259813 - DNA, 25 bp, Homo sapien
aaatattcacccagtgcttcagctt

SEQ ID NO: 259814 - DNA, 25 bp, Homo sapien
acccagtgcttcagcttacggtaaa

SEQ ID NO: 259815 - DNA, 25 bp, Homo sapien
cagtgcttcagcttacggtaaacta

SEQ ID NO: 259816 - DNA, 25 bp, Homo sapien
gtgcttcagcttacggtaaactaaa

SEQ ID NO: 259817 - DNA, 25 bp, Homo sapien
ctgcccagaccctagtgggtttaga

SEQ ID NO: 259818 - DNA, 25 bp, Homo sapien
gaccctagtgggtttagaccaggag

SEQ ID NO: 259819 - DNA, 25 bp, Homo sapien
cctagtgggtttagaccaggagtca

SEQ ID NO: 259820 - DNA, 25 bp, Homo sapien
gggtttagaccaggagtcagaacaa

SEQ ID NO: 259821 - DNA, 25 bp, Homo sapien
ggcacagggtccctctagaatgatg

SEQ ID NO: 259822 - DNA, 25 bp, Homo sapien
cacagggtccctctagaatgatgcc

SEQ ID NO: 259823 - DNA, 25 bp, Homo sapien
cagggtccctctagaatgatgcccc

SEQ ID NO: 259824 - DNA, 25 bp, Homo sapien
ggagaggtcatatggaccctgctct

SEQ ID NO: 259825 - DNA, 25 bp, Homo sapien
agaggtcatatggaccctgctctct

SEQ ID NO: 259826 - DNA, 25 bp, Homo sapien
aggtcatatggaccctgctctctgc

SEQ ID NO: 259827 - DNA, 25 bp, Homo sapien
tgctctctgcccagaccctagtggg

SEQ ID NO: 259828 - DNA, 25 bp, Homo sapien
aagacactcctctcacaggactatg

SEQ ID NO: 259829 - DNA, 25 bp, Homo sapien
caggactatgaaaccatcttttaag

SEQ ID NO: 259830 - DNA, 25 bp, Homo sapien
gaagttccaaggacaaaagtcactt

SEQ ID NO: 259831 - DNA, 25 bp, Homo sapien
atagtcctggcaacttgatctttag

SEQ ID NO: 259832 - DNA, 25 bp, Homo sapien
gatctatttttgcttcatctggctc

SEQ ID NO: 259833 - DNA, 25 bp, Homo sapien
tttgcttcatctggctctggcattc

SEQ ID NO: 259834 - DNA, 25 bp, Homo sapien
aaaaatgttcctgttcatactagag

SEQ ID NO: 259835 - DNA, 25 bp, Homo sapien
ttcatactagagaattcccttggcc

SEQ ID NO: 259836 - DNA, 25 bp, Homo sapien
aattgaaacctccttgaagtttctg

SEQ ID NO: 259837 - DNA, 25 bp, Homo sapien
ggagcacgtgaaccataactggctt

SEQ ID NO: 259838 - DNA, 25 bp, Homo sapien
gaaggactgatttcatgccaacttg

SEQ ID NO: 259839 - DNA, 25 bp, Homo sapien
acaggaggcctcaggcggacacctc

SEQ ID NO: 259840 - DNA, 25 bp, Homo sapien
aggcggacacctccctccatggcaa

SEQ ID NO: 259841 - DNA, 25 bp, Homo sapien
tccatggcaatctggcaggagcgcc

SEQ ID NO: 259842 - DNA, 25 bp, Homo sapien
atggcaatctggcaggagcgcccct

SEQ ID NO: 259843 - DNA, 25 bp, Homo sapien
tggcaatctggcaggagcgcccctt

SEQ ID NO: 259844 - DNA, 25 bp, Homo sapien
tgctggccggtgcttccacccattt

SEQ ID NO: 259845 - DNA, 25 bp, Homo sapien
aggttaataaaggtttgctcctcag

SEQ ID NO: 259846 - DNA, 25 bp, Homo sapien
tcctgggcgcgtccggaaatcccgt

SEQ ID NO: 259847 - DNA, 25 bp, Homo sapien
ccgtcggaaaaggcgcggttgccat

SEQ ID NO: 259848 - DNA, 25 bp, Homo sapien
gaaaaggcgcggttgccatggcgcc

SEQ ID NO: 259849 - DNA, 25 bp, Homo sapien
atggcgccggagatgctccccaagc

SEQ ID NO: 259850 - DNA, 25 bp, Homo sapien
gtcgtcggtttcacattttcagaga

SEQ ID NO: 259851 - DNA, 25 bp, Homo sapien
ttcagagagactttaccagatgcag

SEQ ID NO: 259852 - DNA, 25 bp, Homo sapien
aggatgaaggcaactctggaaggat

SEQ ID NO: 259853 - DNA, 25 bp, Homo sapien
ggagagcaagcactgtacctactgt

SEQ ID NO: 259854 - DNA, 25 bp, Homo sapien
gtacctactgtctgctgtctaagag

SEQ ID NO: 259855 - DNA, 25 bp, Homo sapien
tgctgtctaagagggctggtctcat

SEQ ID NO: 259856 - DNA, 25 bp, Homo sapien
ggctggtctcataactaaaaggtcc

SEQ ID NO: 259857 - DNA, 25 bp, Homo sapien
aggtccagtccctgagatcttgtgt

SEQ ID NO: 259858 - DNA, 25 bp, Homo sapien
gagatcttgtgtgcaaccgtcagaa

SEQ ID NO: 259859 - DNA, 25 bp, Homo sapien
acagtggcacgagttgtcttgcaag

SEQ ID NO: 259860 - DNA, 25 bp, Homo sapien
tgcaaggtgatgtctgtcccgtgga

SEQ ID NO: 259861 - DNA, 25 bp, Homo sapien
gtgcgtggggacagaggcctggaaa

SEQ ID NO: 259862 - DNA, 25 bp, Homo sapien
tgcgtggggacagaggcctggaaat

SEQ ID NO: 259863 - DNA, 25 bp, Homo sapien
aggcctggaaatgcggaggactata

SEQ ID NO: 259864 - DNA, 25 bp, Homo sapien
gcctggaaatgcggaggactataca

SEQ ID NO: 259865 - DNA, 25 bp, Homo sapien
gaggtcagaaacagaagagctgcag

SEQ ID NO: 259866 - DNA, 25 bp, Homo sapien
aggtcagaaacagaagagctgcagt

SEQ ID NO: 259867 - DNA, 25 bp, Homo sapien
ggtcagaaacagaagagctgcagtt

SEQ ID NO: 259868 - DNA, 25 bp, Homo sapien
gtcagaaacagaagagctgcagttg

SEQ ID NO: 259869 - DNA, 25 bp, Homo sapien
tcagaaacagaagagctgcagttgc

SEQ ID NO: 259870 - DNA, 25 bp, Homo sapien
cagaaacagaagagctgcagttgct

SEQ ID NO: 259871 - DNA, 25 bp, Homo sapien
ttctccccttggtgcccccctctgc

SEQ ID NO: 259872 - DNA, 25 bp, Homo sapien
gcacatgatgtgttaaatatgtaca

SEQ ID NO: 259873 - DNA, 25 bp, Homo sapien
gcacaagattgtcttacaagtcgtg

SEQ ID NO: 259874 - DNA, 25 bp, Homo sapien
gattgtcttacaagtcgtgctggct

SEQ ID NO: 259875 - DNA, 25 bp, Homo sapien
ttgtcttacaagtcgtgctggctaa

SEQ ID NO: 259876 - DNA, 25 bp, Homo sapien
gtcttacaagtcgtgctggctaatt

SEQ ID NO: 259877 - DNA, 25 bp, Homo sapien
cttacaagtcgtgctggctaatttt

SEQ ID NO: 259878 - DNA, 25 bp, Homo sapien
acaagtcgtgctggctaatttttag

SEQ ID NO: 259879 - DNA, 25 bp, Homo sapien
tagtttgtattcataagtggttttt

SEQ ID NO: 259880 - DNA, 25 bp, Homo sapien
aatttgcatgttctactttgattgt

SEQ ID NO: 259881 - DNA, 25 bp, Homo sapien
gcatgttctactttgattgtatgta

SEQ ID NO: 259882 - DNA, 25 bp, Homo sapien
gttctactttgattgtatgtaaaca

SEQ ID NO: 259883 - DNA, 25 bp, Homo sapien
aagtgtaggtgatgtgccattccat

SEQ ID NO: 259884 - DNA, 25 bp, Homo sapien
gtgccattccataatggcttccaga

SEQ ID NO: 259885 - DNA, 25 bp, Homo sapien
aatggcttccagactagggtgaatt

SEQ ID NO: 259886 - DNA, 25 bp, Homo sapien
gcttccagactagggtgaattttat

SEQ ID NO: 259887 - DNA, 25 bp, Homo sapien
aattttatgttctgtactgtactgt

SEQ ID NO: 259888 - DNA, 25 bp, Homo sapien
tgccttagcaaagggtggtgtttga

SEQ ID NO: 259889 - DNA, 25 bp, Homo sapien
ttgatgcaaatctttattcactttc

SEQ ID NO: 259890 - DNA, 25 bp, Homo sapien
attcactttcactggtgcacactga

SEQ ID NO: 259891 - DNA, 25 bp, Homo sapien
ggtgcacactgaaattttacttgaa

SEQ ID NO: 259892 - DNA, 25 bp, Homo sapien
gaacagttctcataataaagcactt

SEQ ID NO: 259893 - DNA, 25 bp, Homo sapien
ataataaagcacttgtcttttgctc

SEQ ID NO: 259894 - DNA, 25 bp, Homo sapien
tagagcactcgaacttttgtatttg

SEQ ID NO: 259895 - DNA, 25 bp, Homo sapien
gtatttgctgcttaacctcaatatt

SEQ ID NO: 259896 - DNA, 25 bp, Homo sapien
agcagaaaatgttaaccctccaggt

SEQ ID NO: 259897 - DNA, 25 bp, Homo sapien
ccaggtttctttcttaagcacaata

SEQ ID NO: 259898 - DNA, 25 bp, Homo sapien
gggagcgaacaacacaaggatattt

SEQ ID NO: 259899 - DNA, 25 bp, Homo sapien
ggatatttttacatttgacccgtct

SEQ ID NO: 259900 - DNA, 25 bp, Homo sapien
ttgacccgtctcaaaagtagcacac

SEQ ID NO: 259901 - DNA, 25 bp, Homo sapien
aaaagtagcacaccctatccttgtg

SEQ ID NO: 259902 - DNA, 25 bp, Homo sapien
ccctatccttgtgccattatttgta

SEQ ID NO: 259903 - DNA, 25 bp, Homo sapien
ccccagttgtcatcagcttttttag

SEQ ID NO: 259904 - DNA, 25 bp, Homo sapien
agcttttttagacaccacaggttgt

SEQ ID NO: 259905 - DNA, 25 bp, Homo sapien
gaggcctttgtccatgtcatcattt

SEQ ID NO: 259906 - DNA, 25 bp, Homo sapien
tcatcatttcccctttggctgtaac

SEQ ID NO: 259907 - DNA, 25 bp, Homo sapien
gctgcagttctctcataattttagg

SEQ ID NO: 259908 - DNA, 25 bp, Homo sapien
aggtttcatcttaaatgtcacttct

SEQ ID NO: 259909 - DNA, 25 bp, Homo sapien
atgtcacttcttcagaggcttcttg

SEQ ID NO: 259910 - DNA, 25 bp, Homo sapien
tcttgacagcacaagtcagggccct

SEQ ID NO: 259911 - DNA, 25 bp, Homo sapien
atcacatccattacctttccttgat

SEQ ID NO: 259912 - DNA, 25 bp, Homo sapien
attacctttccttgatcacttgtac

SEQ ID NO: 259913 - DNA, 25 bp, Homo sapien
gatcacttgtaccatcatctgtaat

SEQ ID NO: 259914 - DNA, 25 bp, Homo sapien
tttttgctagactggaagctctcag

SEQ ID NO: 259915 - DNA, 25 bp, Homo sapien
gaagctctcagagggcaggaaccat

SEQ ID NO: 259916 - DNA, 25 bp, Homo sapien
aatttcaggaactattgatctgtta

SEQ ID NO: 259917 - DNA, 25 bp, Homo sapien
ataaaacaggaccactcagacattt

SEQ ID NO: 259918 - DNA, 25 bp, Homo sapien
ggaccactcagacatttagctctaa

SEQ ID NO: 259919 - DNA, 25 bp, Homo sapien
gctctaagactttcacatatccgtt

SEQ ID NO: 259920 - DNA, 25 bp, Homo sapien
acatatccgttgttagaggcgtata

SEQ ID NO: 259921 - DNA, 25 bp, Homo sapien
gggcatgactcagcttctgcttaag

SEQ ID NO: 259922 - DNA, 25 bp, Homo sapien
tgactcagcttctgcttaagtacaa

SEQ ID NO: 259923 - DNA, 25 bp, Homo sapien
gttgtctgcagcgaaggaagaattt

SEQ ID NO: 259924 - DNA, 25 bp, Homo sapien
tgattgtagtatcaacagaaccaga

SEQ ID NO: 259925 - DNA, 25 bp, Homo sapien
aattatatatcttggaaactgactc

SEQ ID NO: 259926 - DNA, 25 bp, Homo sapien
gaaactgactcatcaaagctattag

SEQ ID NO: 259927 - DNA, 25 bp, Homo sapien
agtgctggaggtttacaggctgatc

SEQ ID NO: 259928 - DNA, 25 bp, Homo sapien
gatcatggcctgtcaccaggtgatg

SEQ ID NO: 259929 - DNA, 25 bp, Homo sapien
aagccaaccacatcgaggccctgtg

SEQ ID NO: 259930 - DNA, 25 bp, Homo sapien
ggccctgtggcatgacgaaagcctc

SEQ ID NO: 259931 - DNA, 25 bp, Homo sapien
gaaagcctcttaaacaagtacctgc

SEQ ID NO: 259932 - DNA, 25 bp, Homo sapien
taaacaagtacctgcttaaccacaa

SEQ ID NO: 259933 - DNA, 25 bp, Homo sapien
atgaatgccagcctcagtcccaagc

SEQ ID NO: 259934 - DNA, 25 bp, Homo sapien
cactctcccttgagtacatgtggga

SEQ ID NO: 259935 - DNA, 25 bp, Homo sapien
tatacgttggatgaatacctggtgg

SEQ ID NO: 259936 - DNA, 25 bp, Homo sapien
atacctggtgggtttgtgcaccatg

SEQ ID NO: 259937 - DNA, 25 bp, Homo sapien
caagcccattttcctgagggtgaag

SEQ ID NO: 259938 - DNA, 25 bp, Homo sapien
tgccttttccttgatgctgtttgta

SEQ ID NO: 259939 - DNA, 25 bp, Homo sapien
tacaatctgccaaatgccttttatg

SEQ ID NO: 259940 - DNA, 25 bp, Homo sapien
aaatgccttttatgtcaaacgcatt

SEQ ID NO: 259941 - DNA, 25 bp, Homo sapien
aaacgcatttttttctgatctgaga

SEQ ID NO: 259942 - DNA, 25 bp, Homo sapien
ttaatatttgccaatgactcacctt

SEQ ID NO: 259943 - DNA, 25 bp, Homo sapien
tttgccaatgactcacctttactga

SEQ ID NO: 259944 - DNA, 25 bp, Homo sapien
gaaaactccctatgagtggctatca

SEQ ID NO: 259945 - DNA, 25 bp, Homo sapien
actccctatgagtggctatcaaaat

SEQ ID NO: 259946 - DNA, 25 bp, Homo sapien
ggctatcaaaatattctatgggtta

SEQ ID NO: 259947 - DNA, 25 bp, Homo sapien
ctatgggttatcaaagaaggcaata

SEQ ID NO: 259948 - DNA, 25 bp, Homo sapien
aaagaaggcaatatcaacaatagtg

SEQ ID NO: 259949 - DNA, 25 bp, Homo sapien
gtgtctagtcaaggagtcggctttc

SEQ ID NO: 259950 - DNA, 25 bp, Homo sapien
aggagtcggctttcaggttcctgac

SEQ ID NO: 259951 - DNA, 25 bp, Homo sapien
ttcaggttcctgacggccaggcagg

SEQ ID NO: 259952 - DNA, 25 bp, Homo sapien
taaggtgtggctcagccgtcactgt

SEQ ID NO: 259953 - DNA, 25 bp, Homo sapien
tggtgcggtcctcaggcttttctgc

SEQ ID NO: 259954 - DNA, 25 bp, Homo sapien
ttctcacctgacagcgagggagagg

SEQ ID NO: 259955 - DNA, 25 bp, Homo sapien
ggaagcctcttagggctggaagcca

SEQ ID NO: 259956 - DNA, 25 bp, Homo sapien
ttttccctgggctcagtgcgttttg

SEQ ID NO: 259957 - DNA, 25 bp, Homo sapien
gttttgtcccaacttcatctgtttc

SEQ ID NO: 259958 - DNA, 25 bp, Homo sapien
gtttctgaaatgttctcacttggca

SEQ ID NO: 259959 - DNA, 25 bp, Homo sapien
gttctcacttggcagtgtctagtca

SEQ ID NO: 259960 - DNA, 25 bp, Homo sapien
tgctggcctcgtacacgtggtcgga

SEQ ID NO: 259961 - DNA, 25 bp, Homo sapien
tacacgtggtcggacgcggcggcag

SEQ ID NO: 259962 - DNA, 25 bp, Homo sapien
ggaagaggcgttgcgcttggcgctc

SEQ ID NO: 259963 - DNA, 25 bp, Homo sapien
gctcgacgacgtggcggcattgcac

SEQ ID NO: 259964 - DNA, 25 bp, Homo sapien
acgggcctgtcgtgcgccagctctg

SEQ ID NO: 259965 - DNA, 25 bp, Homo sapien
acggcaccggcgtcgtcaagcgttg

SEQ ID NO: 259966 - DNA, 25 bp, Homo sapien
aagcgttgggcggaggaccagcaca

SEQ ID NO: 259967 - DNA, 25 bp, Homo sapien
agccagggtggctttgtggtacagc

SEQ ID NO: 259968 - DNA, 25 bp, Homo sapien
gctttgtggtacagccgccggcgct

SEQ ID NO: 259969 - DNA, 25 bp, Homo sapien
gaaaaggatgactggacggtccctt

SEQ ID NO: 259970 - DNA, 25 bp, Homo sapien
atgactggacggtcccttatggccg

SEQ ID NO: 259971 - DNA, 25 bp, Homo sapien
acagtgacccctctggcaggttgtg

SEQ ID NO: 259972 - DNA, 25 bp, Homo sapien
aggttgtgcccccagagttcatggt

SEQ ID NO: 259973 - DNA, 25 bp, Homo sapien
tggttagaatccaaactctcagtac

SEQ ID NO: 259974 - DNA, 25 bp, Homo sapien
agaatccaaactctcagtaccaaca

SEQ ID NO: 259975 - DNA, 25 bp, Homo sapien
tcagtaccaacaacgcgagcgtgtg

SEQ ID NO: 259976 - DNA, 25 bp, Homo sapien
ccaacaacgcgagcgtgtgtggaga

SEQ ID NO: 259977 - DNA, 25 bp, Homo sapien
gaagcagccgtgaggatgagccctg

SEQ ID NO: 259978 - DNA, 25 bp, Homo sapien
gggtcccactggtgtcctagttgca

SEQ ID NO: 259979 - DNA, 25 bp, Homo sapien
cactggtgtcctagttgcaggagga

SEQ ID NO: 259980 - DNA, 25 bp, Homo sapien
ggacacgggacggacctgcgcagag

SEQ ID NO: 259981 - DNA, 25 bp, Homo sapien
gagacattgcaaggtcccccgggct

SEQ ID NO: 259982 - DNA, 25 bp, Homo sapien
accagcctgggtggtctcaagattg

SEQ ID NO: 259983 - DNA, 25 bp, Homo sapien
gcctgggtggtctcaagattggatt

SEQ ID NO: 259984 - DNA, 25 bp, Homo sapien
tggtctcaagattggattagcagcc

SEQ ID NO: 259985 - DNA, 25 bp, Homo sapien
aaagtccagctatccagccatagtc

SEQ ID NO: 259986 - DNA, 25 bp, Homo sapien
atcactgtgcccgaccaacccaagg

SEQ ID NO: 259987 - DNA, 25 bp, Homo sapien
cgcccatcgcgacagatgctcagag

SEQ ID NO: 259988 - DNA, 25 bp, Homo sapien
atcgcgacagatgctcagagctcat

SEQ ID NO: 259989 - DNA, 25 bp, Homo sapien
gcgacagatgctcagagctcatccc

SEQ ID NO: 259990 - DNA, 25 bp, Homo sapien
tcatccctggtgtcacaccacataa

SEQ ID NO: 259991 - DNA, 25 bp, Homo sapien
tccctggtgtcacaccacataaagg

SEQ ID NO: 259992 - DNA, 25 bp, Homo sapien
agtatcaccttcaccagcctgggtg

SEQ ID NO: 259993 - DNA, 25 bp, Homo sapien
gaatcaggctgggtctagaagagtt

SEQ ID NO: 259994 - DNA, 25 bp, Homo sapien
gagttatcagactgtaggcctgtat

SEQ ID NO: 259995 - DNA, 25 bp, Homo sapien
aggcctgtattaattttgcaagcta

SEQ ID NO: 259996 - DNA, 25 bp, Homo sapien
aatgttaatgtttactgccagcctt

SEQ ID NO: 259997 - DNA, 25 bp, Homo sapien
ttactgccagccttgcatagcaatg

SEQ ID NO: 259998 - DNA, 25 bp, Homo sapien
cagccttgcatagcaatgccagttt

SEQ ID NO: 259999 - DNA, 25 bp, Homo sapien
aatgccagtttgcagttgtgactat

SEQ ID NO: 260000 - DNA, 25 bp, Homo sapien
gcagttgtgactatgatgtgacttt

SEQ ID NO: 260001 - DNA, 25 bp, Homo sapien
gaagtggctcttgattgtttggaca

SEQ ID NO: 260002 - DNA, 25 bp, Homo sapien
ggacaagcagggtaggtaaatttca

SEQ ID NO: 260003 - DNA, 25 bp, Homo sapien
aaatcctagaatagagcactctcca

SEQ ID NO: 260004 - DNA, 25 bp, Homo sapien
tttaaagtaggaaacctcctcatct

SEQ ID NO: 260005 - DNA, 25 bp, Homo sapien
atctgccacctctcctgcagtgaga

SEQ ID NO: 260006 - DNA, 25 bp, Homo sapien
tagagactagacgtggatactccca

SEQ ID NO: 260007 - DNA, 25 bp, Homo sapien
tggatactcccacataggatactgg

SEQ ID NO: 260008 - DNA, 25 bp, Homo sapien
taatggatgactgtgggcctccacc

SEQ ID NO: 260009 - DNA, 25 bp, Homo sapien
tgactgtgggcctccaccaggcgca

SEQ ID NO: 260010 - DNA, 25 bp, Homo sapien
caggcgcaggtgaccctgcagatat

SEQ ID NO: 260011 - DNA, 25 bp, Homo sapien
caggtgaccctgcagatatgattca

SEQ ID NO: 260012 - DNA, 25 bp, Homo sapien
tgcagatatgattcagaggcagcct

SEQ ID NO: 260013 - DNA, 25 bp, Homo sapien
tccatgtggactatactgttgcttt

SEQ ID NO: 260014 - DNA, 25 bp, Homo sapien
tggactatactgttgctttcagaaa

SEQ ID NO: 260015 - DNA, 25 bp, Homo sapien
tggagttggagagccgccacagcct

SEQ ID NO: 260016 - DNA, 25 bp, Homo sapien
cctgcagcagatccgagaggatgaa

SEQ ID NO: 260017 - DNA, 25 bp, Homo sapien
agagagagggctccgagctcacact

SEQ ID NO: 260018 - DNA, 25 bp, Homo sapien
gagctcacactcaattcgcgggagg

SEQ ID NO: 260019 - DNA, 25 bp, Homo sapien
tgccctccggcagctacgaggaaga

SEQ ID NO: 260020 - DNA, 25 bp, Homo sapien
gctacgaggaagacccgcagacgat

SEQ ID NO: 260021 - DNA, 25 bp, Homo sapien
agacccgcagacgatactggacgat

SEQ ID NO: 260022 - DNA, 25 bp, Homo sapien
agacgatactggacgatcacctgtc

SEQ ID NO: 260023 - DNA, 25 bp, Homo sapien
gatcacctgtccagggtcctcaaga

SEQ ID NO: 260024 - DNA, 25 bp, Homo sapien
tgtccagggtcctcaagacccctgg

SEQ ID NO: 260025 - DNA, 25 bp, Homo sapien
agtctccgggcgtaggccgctatag

SEQ ID NO: 260026 - DNA, 25 bp, Homo sapien
agcgcttgcggcagtacaatgcccc

SEQ ID NO: 260027 - DNA, 25 bp, Homo sapien
cactcacggcaaagagagccaccta

SEQ ID NO: 260028 - DNA, 25 bp, Homo sapien
gagagccacctagtgagggattatt

SEQ ID NO: 260029 - DNA, 25 bp, Homo sapien
gagggattattctcatttccgcggt

SEQ ID NO: 260030 - DNA, 25 bp, Homo sapien
ttttctttctaccatgagcgcccaa

SEQ ID NO: 260031 - DNA, 25 bp, Homo sapien
gagcgcccaaggatagacactccta

SEQ ID NO: 260032 - DNA, 25 bp, Homo sapien
ggatagacactcctactacctatta

SEQ ID NO: 260033 - DNA, 25 bp, Homo sapien
ctcctactacctattacctcaaata

SEQ ID NO: 260034 - DNA, 25 bp, Homo sapien
cctcaaatagcctacatttctttcc

SEQ ID NO: 260035 - DNA, 25 bp, Homo sapien
atagcctacatttctttccgaaaat

SEQ ID NO: 260036 - DNA, 25 bp, Homo sapien
aaagaccagtgtgatcgtgtattgg

SEQ ID NO: 260037 - DNA, 25 bp, Homo sapien
gggttctctttggaatccgtacctg

SEQ ID NO: 260038 - DNA, 25 bp, Homo sapien
gccagccaggatccctgtctactgg

SEQ ID NO: 260039 - DNA, 25 bp, Homo sapien
tgtggagctttgctcctgcactctg

SEQ ID NO: 260040 - DNA, 25 bp, Homo sapien
tgcactctgccaagctctgaggctg

SEQ ID NO: 260041 - DNA, 25 bp, Homo sapien
tggcctctgtttaggctgctgatag

SEQ ID NO: 260042 - DNA, 25 bp, Homo sapien
tagacacctgtcttcatgctaaggc

SEQ ID NO: 260043 - DNA, 25 bp, Homo sapien
catgctaaggcctagctgactggct

SEQ ID NO: 260044 - DNA, 25 bp, Homo sapien
tgccaacatctgttagtttctgttt

SEQ ID NO: 260045 - DNA, 25 bp, Homo sapien
gttttcttcctggtagccatcatta

SEQ ID NO: 260046 - DNA, 25 bp, Homo sapien
cattatgggtgtggagtggtctctt

SEQ ID NO: 260047 - DNA, 25 bp, Homo sapien
gtctcttggctccttcttgacaggg

SEQ ID NO: 260048 - DNA, 25 bp, Homo sapien
atttttcctcagtcttcaatgacga

SEQ ID NO: 260049 - DNA, 25 bp, Homo sapien
gtcttcaatgacgagagcaatatta

SEQ ID NO: 260050 - DNA, 25 bp, Homo sapien
aagacattgctatctaatttttaat

SEQ ID NO: 260051 - DNA, 25 bp, Homo sapien
aattcctatgttcagtagcgtggtt

SEQ ID NO: 260052 - DNA, 25 bp, Homo sapien
agcgtggttgatgctattgtttagc

SEQ ID NO: 260053 - DNA, 25 bp, Homo sapien
gccttcccctccaaattgtatacat

SEQ ID NO: 260054 - DNA, 25 bp, Homo sapien
caaattgtatacattggcttggaat

SEQ ID NO: 260055 - DNA, 25 bp, Homo sapien
ggcttggaatgttcacaacttgcgt

SEQ ID NO: 260056 - DNA, 25 bp, Homo sapien
aatgttcacaacttgcgtgcgtggc

SEQ ID NO: 260057 - DNA, 25 bp, Homo sapien
cacaacttgcgtgcgtggcagcgga

SEQ ID NO: 260058 - DNA, 25 bp, Homo sapien
cgtggcagcggaagacgattcccat

SEQ ID NO: 260059 - DNA, 25 bp, Homo sapien
aagcagattactgtaagggcactgg

SEQ ID NO: 260060 - DNA, 25 bp, Homo sapien
agagcaaagcctgcccgggttactc

SEQ ID NO: 260061 - DNA, 25 bp, Homo sapien
cgggttactcgctgccacttcagga

SEQ ID NO: 260062 - DNA, 25 bp, Homo sapien
cttcaggagagggattgtatcagct

SEQ ID NO: 260063 - DNA, 25 bp, Homo sapien
ggattgtatcagctctcattacctt

SEQ ID NO: 260064 - DNA, 25 bp, Homo sapien
gtcatgaggcagttcataaattaaa

SEQ ID NO: 260065 - DNA, 25 bp, Homo sapien
gatatcatgcattatctcaaaatat

SEQ ID NO: 260066 - DNA, 25 bp, Homo sapien
attagataattcacgatgtaaaacg

SEQ ID NO: 260067 - DNA, 25 bp, Homo sapien
atgtaaaacgtgttcatgcagaagc

SEQ ID NO: 260068 - DNA, 25 bp, Homo sapien
aaacgtgttcatgcagaagcaaagg

SEQ ID NO: 260069 - DNA, 25 bp, Homo sapien
atgtaatagtcaagtatcagggaaa

SEQ ID NO: 260070 - DNA, 25 bp, Homo sapien
ggaggccctaagaagaatcccgaag

SEQ ID NO: 260071 - DNA, 25 bp, Homo sapien
gctggaggctgagggttcattactt

SEQ ID NO: 260072 - DNA, 25 bp, Homo sapien
ggctgagggttcattactttgttga

SEQ ID NO: 260073 - DNA, 25 bp, Homo sapien
ctttgttgagggtgtttcttatgac

SEQ ID NO: 260074 - DNA, 25 bp, Homo sapien
aaataagacccatggtgcctgagat

SEQ ID NO: 260075 - DNA, 25 bp, Homo sapien
gacccatggtgcctgagatactaat

SEQ ID NO: 260076 - DNA, 25 bp, Homo sapien
gatactaatgagaggcaattgccgt

SEQ ID NO: 260077 - DNA, 25 bp, Homo sapien
aggcaattgccgtcctagtgtgagg

SEQ ID NO: 260078 - DNA, 25 bp, Homo sapien
tggcccacttttcttgacaatctaa

SEQ ID NO: 260079 - DNA, 25 bp, Homo sapien
ttcttgacaatctaaacatccattc

SEQ ID NO: 260080 - DNA, 25 bp, Homo sapien
taaagtgaatgtgtccttcttgttt

SEQ ID NO: 260081 - DNA, 25 bp, Homo sapien
tatgcccattctcccggaggcacag

SEQ ID NO: 260082 - DNA, 25 bp, Homo sapien
acttcatgcacgccgatgctcagaa

SEQ ID NO: 260083 - DNA, 25 bp, Homo sapien
gggctgtggcttcttcaggctcttt

SEQ ID NO: 260084 - DNA, 25 bp, Homo sapien
tgtggcttcttcaggctctttccaa

SEQ ID NO: 260085 - DNA, 25 bp, Homo sapien
ttcttcaggctctttccaactactg

SEQ ID NO: 260086 - DNA, 25 bp, Homo sapien
ctgccagtcctttgcaagtgctgga

SEQ ID NO: 260087 - DNA, 25 bp, Homo sapien
tcctttgcaagtgctggatgtgggc

SEQ ID NO: 260088 - DNA, 25 bp, Homo sapien
ctggatgtgggctgtgggacttcca

SEQ ID NO: 260089 - DNA, 25 bp, Homo sapien
gtgggacttccagcctatgtacagg

SEQ ID NO: 260090 - DNA, 25 bp, Homo sapien
ttccagcctatgtacaggcctttac

SEQ ID NO: 260091 - DNA, 25 bp, Homo sapien
atgtacaggcctttacaccaaatct

SEQ ID NO: 260092 - DNA, 25 bp, Homo sapien
ggaggtaaactgtttcctgtccagc

SEQ ID NO: 260093 - DNA, 25 bp, Homo sapien
aactgtttcctgtccagccagaagt

SEQ ID NO: 260094 - DNA, 25 bp, Homo sapien
gaagtttgcggagggccttccccag

SEQ ID NO: 260095 - DNA, 25 bp, Homo sapien
aggcaatgctgcctgcgactctgtc

SEQ ID NO: 260096 - DNA, 25 bp, Homo sapien
tctgtccctgacagcgttggatgca

SEQ ID NO: 260097 - DNA, 25 bp, Homo sapien
gatgcaccgtatctcttctgatatt

SEQ ID NO: 260098 - DNA, 25 bp, Homo sapien
aagtgatttactatccgagtcctcc

SEQ ID NO: 260099 - DNA, 25 bp, Homo sapien
gttcgagccttttgatgtactttgt

SEQ ID NO: 260100 - DNA, 25 bp, Homo sapien
gtgtgcatgtgtttctgtcacatac

SEQ ID NO: 260101 - DNA, 25 bp, Homo sapien
tgtcacatacgtgccacagtggaac

SEQ ID NO: 260102 - DNA, 25 bp, Homo sapien
gttttgacactattttggttcatga

SEQ ID NO: 260103 - DNA, 25 bp, Homo sapien
ttccagtcacacccccgcctccaac

SEQ ID NO: 260104 - DNA, 25 bp, Homo sapien
tcacacccccgcctccaacccaaag

SEQ ID NO: 260105 - DNA, 25 bp, Homo sapien
aagtggggcctgtagctgagtcacc

SEQ ID NO: 260106 - DNA, 25 bp, Homo sapien
agtggggcctgtagctgagtcacca

SEQ ID NO: 260107 - DNA, 25 bp, Homo sapien
ggcctgtagctgagtcaccagggta

SEQ ID NO: 260108 - DNA, 25 bp, Homo sapien
gcctgtagctgagtcaccagggtag

SEQ ID NO: 260109 - DNA, 25 bp, Homo sapien
cctgtagctgagtcaccagggtagc

SEQ ID NO: 260110 - DNA, 25 bp, Homo sapien
ctgtagctgagtcaccagggtagcc

SEQ ID NO: 260111 - DNA, 25 bp, Homo sapien
tgtagctgagtcaccagggtagcct

SEQ ID NO: 260112 - DNA, 25 bp, Homo sapien
gtagctgagtcaccagggtagcctt

SEQ ID NO: 260113 - DNA, 25 bp, Homo sapien
tagctgagtcaccagggtagccttg

SEQ ID NO: 260114 - DNA, 25 bp, Homo sapien
tgcaggttttccagccggccgtcta

SEQ ID NO: 260115 - DNA, 25 bp, Homo sapien
cacagttaagggtggattacgtcat

SEQ ID NO: 260116 - DNA, 25 bp, Homo sapien
ggccgtctacaagtgcttcgtgcag

SEQ ID NO: 260117 - DNA, 25 bp, Homo sapien
caagtgcttcgtgcagcaggagctc

SEQ ID NO: 260118 - DNA, 25 bp, Homo sapien
cttcgtgcagcaggagctcgtggcc

SEQ ID NO: 260119 - DNA, 25 bp, Homo sapien
gagctcgtggcccagttcaaacccg

SEQ ID NO: 260120 - DNA, 25 bp, Homo sapien
ggattacgtcatttttgacaacttc

SEQ ID NO: 260121 - DNA, 25 bp, Homo sapien
gacaacttcaggctcgatgagaaga

SEQ ID NO: 260122 - DNA, 25 bp, Homo sapien
aagacagaatttgtgtggctcgact

SEQ ID NO: 260123 - DNA, 25 bp, Homo sapien
gaatttgtgtggctcgactgtccct

SEQ ID NO: 260124 - DNA, 25 bp, Homo sapien
gactgtcccttaggatccatgtaca

SEQ ID NO: 260125 - DNA, 25 bp, Homo sapien
ttcgcagaactgtttcctcaagggc

SEQ ID NO: 260126 - DNA, 25 bp, Homo sapien
aagggccccatagtgataccgtctt

SEQ ID NO: 260127 - DNA, 25 bp, Homo sapien
aggcccctcataagatcatcacaag

SEQ ID NO: 260128 - DNA, 25 bp, Homo sapien
tgataccgtcttttattccttttag

SEQ ID NO: 260129 - DNA, 25 bp, Homo sapien
gccctgaatgcagtgacttgtgtca

SEQ ID NO: 260130 - DNA, 25 bp, Homo sapien
ttgtgtcaggacagcgttctccatg

SEQ ID NO: 260131 - DNA, 25 bp, Homo sapien
tgagccccggtacagtattcctgct

SEQ ID NO: 260132 - DNA, 25 bp, Homo sapien
gatcatcacaagcaacacagagaaa

SEQ ID NO: 260133 - DNA, 25 bp, Homo sapien
gaaatgttggcctgctgaaaataga

SEQ ID NO: 260134 - DNA, 25 bp, Homo sapien
tagaagtgcagagactctctcccgt

SEQ ID NO: 260135 - DNA, 25 bp, Homo sapien
gactctctcccgtgacagaatgagg

SEQ ID NO: 260136 - DNA, 25 bp, Homo sapien
cagttgtatttgttccaaaacttgt

SEQ ID NO: 260137 - DNA, 25 bp, Homo sapien
ttgttccaaaacttgtttttgcaag

SEQ ID NO: 260138 - DNA, 25 bp, Homo sapien
cttgtttttgcaagttgtacttaat

SEQ ID NO: 260139 - DNA, 25 bp, Homo sapien
gcaagttgtacttaataacgatgta

SEQ ID NO: 260140 - DNA, 25 bp, Homo sapien
gttgtacttaataacgatgtaattt

SEQ ID NO: 260141 - DNA, 25 bp, Homo sapien
ccaaaatcaaacaattatgagtgtg

SEQ ID NO: 260142 - DNA, 25 bp, Homo sapien
gagtgtgaagagagtaatctctatg

SEQ ID NO: 260143 - DNA, 25 bp, Homo sapien
tgaaaacttgggaaagacctgataa

SEQ ID NO: 260144 - DNA, 25 bp, Homo sapien
ttgggaaagacctgataaaagacgt

SEQ ID NO: 260145 - DNA, 25 bp, Homo sapien
gaaagacctgataaaagacgtgtta

SEQ ID NO: 260146 - DNA, 25 bp, Homo sapien
gacctgataaaagacgtgttattaa

SEQ ID NO: 260147 - DNA, 25 bp, Homo sapien
caagcttgcagatcctactgaggca

SEQ ID NO: 260148 - DNA, 25 bp, Homo sapien
gcagatcctactgaggcaagcagaa

SEQ ID NO: 260149 - DNA, 25 bp, Homo sapien
ggcaagcagaaacttgtctggacaa

SEQ ID NO: 260150 - DNA, 25 bp, Homo sapien
cttgtctggacaaaaacatgtttaa

SEQ ID NO: 260151 - DNA, 25 bp, Homo sapien
tgtttaaaacggtctatcattttga

SEQ ID NO: 260152 - DNA, 25 bp, Homo sapien
cattttgaactctggaaaagtataa

SEQ ID NO: 260153 - DNA, 25 bp, Homo sapien
gtttacatgtggtgaacatgtttct

SEQ ID NO: 260154 - DNA, 25 bp, Homo sapien
cacacagagcaaggagtggattgaa

SEQ ID NO: 260155 - DNA, 25 bp, Homo sapien
gtggattgaaaattagtgtactctc

SEQ ID NO: 260156 - DNA, 25 bp, Homo sapien
attagtgtactctcgtgcaagcttg

SEQ ID NO: 260157 - DNA, 25 bp, Homo sapien
gtgtactctcgtgcaagcttgcaga

SEQ ID NO: 260158 - DNA, 25 bp, Homo sapien
gagaaacaaaagtcactttatgttc

SEQ ID NO: 260159 - DNA, 25 bp, Homo sapien
gaaacaaaagtcactttatgttctt

SEQ ID NO: 260160 - DNA, 25 bp, Homo sapien
aacaaaagtcactttatgttcttag

SEQ ID NO: 260161 - DNA, 25 bp, Homo sapien
acaaaagtcactttatgttcttagt

SEQ ID NO: 260162 - DNA, 25 bp, Homo sapien
gtcactttatgttcttagtaaatat

SEQ ID NO: 260163 - DNA, 25 bp, Homo sapien
tcactttatgttcttagtaaatatt

SEQ ID NO: 260164 - DNA, 25 bp, Homo sapien
ctttatgttcttagtaaatatttct

SEQ ID NO: 260165 - DNA, 25 bp, Homo sapien
gggttataggagatctaagtacaaa

SEQ ID NO: 260166 - DNA, 25 bp, Homo sapien
ggttataggagatctaagtacaaaa

SEQ ID NO: 260167 - DNA, 25 bp, Homo sapien
gttataggagatctaagtacaaaaa

SEQ ID NO: 260168 - DNA, 25 bp, Homo sapien
taagaacaacttaagttgagtacag

SEQ ID NO: 260169 - DNA, 25 bp, Homo sapien
taccacacaggctttagctagcaga

SEQ ID NO: 260170 - DNA, 25 bp, Homo sapien
agaggtggcctctggtcgtagctct

SEQ ID NO: 260171 - DNA, 25 bp, Homo sapien
gtcgtagctctttgtggtttgccaa

SEQ ID NO: 260172 - DNA, 25 bp, Homo sapien
gctctttgtggtttgccaaggcttt

SEQ ID NO: 260173 - DNA, 25 bp, Homo sapien
aaggctttctggttcactgactcaa

SEQ ID NO: 260174 - DNA, 25 bp, Homo sapien
ggttcactgactcaaaagggtttgg

SEQ ID NO: 260175 - DNA, 25 bp, Homo sapien
tttacagactggtaagatctcccaa

SEQ ID NO: 260176 - DNA, 25 bp, Homo sapien
gatctcccaaactgggtagttgtac

SEQ ID NO: 260177 - DNA, 25 bp, Homo sapien
gatatttaaaccctaacagtctggt

SEQ ID NO: 260178 - DNA, 25 bp, Homo sapien
aaccctaacagtctggttccagaat

SEQ ID NO: 260179 - DNA, 25 bp, Homo sapien
gatgaaaagcatgtctgggccttga

SEQ ID NO: 260180 - DNA, 25 bp, Homo sapien
aatagttttggttttgtggcatatg

SEQ ID NO: 260181 - DNA, 25 bp, Homo sapien
gtggcatatgaatagctgtttaaca

SEQ ID NO: 260182 - DNA, 25 bp, Homo sapien
aaatcaaagttagctttttgcttct

SEQ ID NO: 260183 - DNA, 25 bp, Homo sapien
tttgcttctcagcttttttgggcaa

SEQ ID NO: 260184 - DNA, 25 bp, Homo sapien
cttctcagcttttttgggcaataca

SEQ ID NO: 260185 - DNA, 25 bp, Homo sapien
gggcaatacaagttaagttcttaat

SEQ ID NO: 260186 - DNA, 25 bp, Homo sapien
ggcatgacttaagggaacattggtt

SEQ ID NO: 260187 - DNA, 25 bp, Homo sapien
aacagattatctaaagccatctcta

SEQ ID NO: 260188 - DNA, 25 bp, Homo sapien
agccatctctatgtttctgttcaga

SEQ ID NO: 260189 - DNA, 25 bp, Homo sapien
ctttgtatatttcatcttagccatt

SEQ ID NO: 260190 - DNA, 25 bp, Homo sapien
tcatcttagccattctatcctagaa

SEQ ID NO: 260191 - DNA, 25 bp, Homo sapien
gccctacatgggtatttgtggcaat

SEQ ID NO: 260192 - DNA, 25 bp, Homo sapien
attcaggagtaattgctttatcatc

SEQ ID NO: 260193 - DNA, 25 bp, Homo sapien
tgctttatcatcattctgttcagaa

SEQ ID NO: 260194 - DNA, 25 bp, Homo sapien
tctgttcagaagtaattgcattgct

SEQ ID NO: 260195 - DNA, 25 bp, Homo sapien
gcattgcttttggtgactgtagctt

SEQ ID NO: 260196 - DNA, 25 bp, Homo sapien
tttctagggtactttatgtttcttg

SEQ ID NO: 260197 - DNA, 25 bp, Homo sapien
tggtgactgtagcttacatttagaa

SEQ ID NO: 260198 - DNA, 25 bp, Homo sapien
tttagaattcagtcagttgggtcat

SEQ ID NO: 260199 - DNA, 25 bp, Homo sapien
gtcagttgggtcatatgccattttt

SEQ ID NO: 260200 - DNA, 25 bp, Homo sapien
aagatatatggattctgattttgct

SEQ ID NO: 260201 - DNA, 25 bp, Homo sapien
tgtataatataagccctacatgggt

SEQ ID NO: 260202 - DNA, 25 bp, Homo sapien
aacgataccttctacgacctgggct

SEQ ID NO: 260203 - DNA, 25 bp, Homo sapien
ataccttctacgacctgggcttgat

SEQ ID NO: 260204 - DNA, 25 bp, Homo sapien
accttctacgacctgggcttgatgg

SEQ ID NO: 260205 - DNA, 25 bp, Homo sapien
tacgacctgggcttgatgggctatg

SEQ ID NO: 260206 - DNA, 25 bp, Homo sapien
gacctgggcttgatgggctatgtca

SEQ ID NO: 260207 - DNA, 25 bp, Homo sapien
gcttgatgggctatgtcagtggctt

SEQ ID NO: 260208 - DNA, 25 bp, Homo sapien
ttgatgggctatgtcagtggcttcg

SEQ ID NO: 260209 - DNA, 25 bp, Homo sapien
ggaggagaagattgctcatgacctc

SEQ ID NO: 260210 - DNA, 25 bp, Homo sapien
acctcaggtttgtccgtctgcccgt

SEQ ID NO: 260211 - DNA, 25 bp, Homo sapien
tccacaggcctgtgagaactggctc

SEQ ID NO: 260212 - DNA, 25 bp, Homo sapien
acaggcctgtgagaactggctccgg

SEQ ID NO: 260213 - DNA, 25 bp, Homo sapien
gtctaggaagaggtgcttcctctct

SEQ ID NO: 260214 - DNA, 25 bp, Homo sapien
aggaagaggtgcttcctctctggaa

SEQ ID NO: 260215 - DNA, 25 bp, Homo sapien
gaagaggtgcttcctctctggaagc

SEQ ID NO: 260216 - DNA, 25 bp, Homo sapien
agaggtgcttcctctctggaagcag

SEQ ID NO: 260217 - DNA, 25 bp, Homo sapien
agtgctctcaccatctgagcaccag

SEQ ID NO: 260218 - DNA, 25 bp, Homo sapien
gaaagaatgggtgatgctgatcccc

SEQ ID NO: 260219 - DNA, 25 bp, Homo sapien
gaatgggtgatgctgatcccccaag

SEQ ID NO: 260220 - DNA, 25 bp, Homo sapien
gctgatcccccaagcagaatggtaa

SEQ ID NO: 260221 - DNA, 25 bp, Homo sapien
gctgctgtccacaggcggacggact

SEQ ID NO: 260222 - DNA, 25 bp, Homo sapien
acaggcggacggactctccaggagc

SEQ ID NO: 260223 - DNA, 25 bp, Homo sapien
aggcggacggactctccaggagccc

SEQ ID NO: 260224 - DNA, 25 bp, Homo sapien
caaagttcctgtaggaatacctcaa

SEQ ID NO: 260225 - DNA, 25 bp, Homo sapien
aatacctcaaagatcccttgtcaac

SEQ ID NO: 260226 - DNA, 25 bp, Homo sapien
tcaaagatcccttgtcaacagccag

SEQ ID NO: 260227 - DNA, 25 bp, Homo sapien
aagatcccttgtcaacagccagcta

SEQ ID NO: 260228 - DNA, 25 bp, Homo sapien
ttgtcaacagccagctacccatcaa

SEQ ID NO: 260229 - DNA, 25 bp, Homo sapien
ccagctacccatcaaggctacttga

SEQ ID NO: 260230 - DNA, 25 bp, Homo sapien
ggctacttgatgatcaaatcagcct

SEQ ID NO: 260231 - DNA, 25 bp, Homo sapien
ttctgactgggctggttcccctaga

SEQ ID NO: 260232 - DNA, 25 bp, Homo sapien
cactctttggcttaataaatgcctt

SEQ ID NO: 260233 - DNA, 25 bp, Homo sapien
ccagaaggcttcagcgcggctggaa

SEQ ID NO: 260234 - DNA, 25 bp, Homo sapien
ttcagcgcggctggaagtatacttg

SEQ ID NO: 260235 - DNA, 25 bp, Homo sapien
atgccaagtaagtgctgatttgttc

SEQ ID NO: 260236 - DNA, 25 bp, Homo sapien
gtaagtgctgatttgttctcattca

SEQ ID NO: 260237 - DNA, 25 bp, Homo sapien
agtgctgatttgttctcattcaact

SEQ ID NO: 260238 - DNA, 25 bp, Homo sapien
ctcattcaacttgtccagagggttt

SEQ ID NO: 260239 - DNA, 25 bp, Homo sapien
attcaacttgtccagagggtttcaa

SEQ ID NO: 260240 - DNA, 25 bp, Homo sapien
aacttgtccagagggtttcaatgtc

SEQ ID NO: 260241 - DNA, 25 bp, Homo sapien
gtccagagggtttcaatgtctttgt

SEQ ID NO: 260242 - DNA, 25 bp, Homo sapien
gagggtttcaatgtctttgtgtaaa

SEQ ID NO: 260243 - DNA, 25 bp, Homo sapien
gtaaatggtttacatagtctcactc

SEQ ID NO: 260244 - DNA, 25 bp, Homo sapien
atggtttacatagtctcactctctg

SEQ ID NO: 260245 - DNA, 25 bp, Homo sapien
gtttacatagtctcactctctgaat

SEQ ID NO: 260246 - DNA, 25 bp, Homo sapien
atttgccagaaccaagctacagatg

SEQ ID NO: 260247 - DNA, 25 bp, Homo sapien
gtcttattctgatgtaggtgaccaa

SEQ ID NO: 260248 - DNA, 25 bp, Homo sapien
actgaggcctggagtaaccagtcat

SEQ ID NO: 260249 - DNA, 25 bp, Homo sapien
gagtaaccagtcatattgcttccat

SEQ ID NO: 260250 - DNA, 25 bp, Homo sapien
atattgcttccatgctgggaactct

SEQ ID NO: 260251 - DNA, 25 bp, Homo sapien
gggaactctccaatgacatatcgca

SEQ ID NO: 260252 - DNA, 25 bp, Homo sapien
atatcgcacaatacagagccaacct

SEQ ID NO: 260253 - DNA, 25 bp, Homo sapien
tgcaagttctaaccttgcccaatct

SEQ ID NO: 260254 - DNA, 25 bp, Homo sapien
ttatacgccctcagtccatgtgcct

SEQ ID NO: 260255 - DNA, 25 bp, Homo sapien
cagtccatgtgcctctgtgatgatg

SEQ ID NO: 260256 - DNA, 25 bp, Homo sapien
gccacttgctccacatctgcagtta

SEQ ID NO: 260257 - DNA, 25 bp, Homo sapien
ttatgccagcttatattgtgagaac

SEQ ID NO: 260258 - DNA, 25 bp, Homo sapien
agtcagtttgggttttatcaatcct

SEQ ID NO: 260259 - DNA, 25 bp, Homo sapien
caatcctgttaatgcttgtccttgg

SEQ ID NO: 260260 - DNA, 25 bp, Homo sapien
ttgtccttggaacatctttcgcgta

SEQ ID NO: 260261 - DNA, 25 bp, Homo sapien
tggaacatctttcgcgtattcacgg

SEQ ID NO: 260262 - DNA, 25 bp, Homo sapien
atctttcgcgtattcacggtttgta

SEQ ID NO: 260263 - DNA, 25 bp, Homo sapien
gcgtattcacggtttgtagttgaaa

SEQ ID NO: 260264 - DNA, 25 bp, Homo sapien
ctgggagtaagatttgaggttgtaa

SEQ ID NO: 260265 - DNA, 25 bp, Homo sapien
ctaagttagtgtaatttggcttcat

SEQ ID NO: 260266 - DNA, 25 bp, Homo sapien
ttggcttcatatatgtaacgtgagg

SEQ ID NO: 260267 - DNA, 25 bp, Homo sapien
gtaacgtgaggtattaatgtaattc

SEQ ID NO: 260268 - DNA, 25 bp, Homo sapien
gtaatttcacagtccaccagactag

SEQ ID NO: 260269 - DNA, 25 bp, Homo sapien
ctgcagcagcatccgtagaattttt

SEQ ID NO: 260270 - DNA, 25 bp, Homo sapien
gtagaatttttgtactacacccaat

SEQ ID NO: 260271 - DNA, 25 bp, Homo sapien
ataccagactgggaaggcctatctt

SEQ ID NO: 260272 - DNA, 25 bp, Homo sapien
tgggaaggcctatctttcagtgacc

SEQ ID NO: 260273 - DNA, 25 bp, Homo sapien
tatctttcagtgaccctgctaactg

SEQ ID NO: 260274 - DNA, 25 bp, Homo sapien
gtgaccctgctaactgctaggatga

SEQ ID NO: 260275 - DNA, 25 bp, Homo sapien
gtatagtaacatgtacaggctacat

SEQ ID NO: 260276 - DNA, 25 bp, Homo sapien
gtccaccagactagttttgcataga

SEQ ID NO: 260277 - DNA, 25 bp, Homo sapien
acaggctacattgtaaacagcacaa

SEQ ID NO: 260278 - DNA, 25 bp, Homo sapien
gctgacatgtgtggttattcttttt

SEQ ID NO: 260279 - DNA, 25 bp, Homo sapien
aatattctgatgatttgccttttat

SEQ ID NO: 260280 - DNA, 25 bp, Homo sapien
tgatgatttgccttttatattgagt

SEQ ID NO: 260281 - DNA, 25 bp, Homo sapien
ttatttgcaaaagttactcctccag

SEQ ID NO: 260282 - DNA, 25 bp, Homo sapien
ttgcaaaagttactcctccagtctg

SEQ ID NO: 260283 - DNA, 25 bp, Homo sapien
gcaaaagttactcctccagtctgca

SEQ ID NO: 260284 - DNA, 25 bp, Homo sapien
gaattttttaatatgcacaggccat

SEQ ID NO: 260285 - DNA, 25 bp, Homo sapien
atgcacaggccatattctcttttga

SEQ ID NO: 260286 - DNA, 25 bp, Homo sapien
gcacaggccatattctcttttgaat

SEQ ID NO: 260287 - DNA, 25 bp, Homo sapien
aggccatattctcttttgaatagtt

SEQ ID NO: 260288 - DNA, 25 bp, Homo sapien
tttcatttcatgctcactactgttg

SEQ ID NO: 260289 - DNA, 25 bp, Homo sapien
atttcatgctcactactgttggcac

SEQ ID NO: 260290 - DNA, 25 bp, Homo sapien
gagttcacactgatgaagcaaacct

SEQ ID NO: 260291 - DNA, 25 bp, Homo sapien
caaacctttgaatttttgcacagct

SEQ ID NO: 260292 - DNA, 25 bp, Homo sapien
tttttgcacagctcttgtcagaaag

SEQ ID NO: 260293 - DNA, 25 bp, Homo sapien
tcttgtcagaaagccctgagttccc

SEQ ID NO: 260294 - DNA, 25 bp, Homo sapien
ctgagttccccctggataaagagtt

SEQ ID NO: 260295 - DNA, 25 bp, Homo sapien
ttgacatctgctattatgccttctt

SEQ ID NO: 260296 - DNA, 25 bp, Homo sapien
atgccttctttagatctttcttctg

SEQ ID NO: 260297 - DNA, 25 bp, Homo sapien
ggtgcagacatttctagtaagtgtt

SEQ ID NO: 260298 - DNA, 25 bp, Homo sapien
gtgtttgactacttgtatggcatta

SEQ ID NO: 260299 - DNA, 25 bp, Homo sapien
tatggcattagctttcacagaaaat

SEQ ID NO: 260300 - DNA, 25 bp, Homo sapien
aaaactgtggattggcctaggctaa

SEQ ID NO: 260301 - DNA, 25 bp, Homo sapien
acttctgtgttgtttaagcaagatg

SEQ ID NO: 260302 - DNA, 25 bp, Homo sapien
gatgtatctgtactgatgtctcagt

SEQ ID NO: 260303 - DNA, 25 bp, Homo sapien
gatgtctcagtgaatcagtctgttt

SEQ ID NO: 260304 - DNA, 25 bp, Homo sapien
taagcacttatcagggcttccacac

SEQ ID NO: 260305 - DNA, 25 bp, Homo sapien
agggcttccacacacttatttattt

SEQ ID NO: 260306 - DNA, 25 bp, Homo sapien
attttgccctagttaatcctgttgt

SEQ ID NO: 260307 - DNA, 25 bp, Homo sapien
ggctgttacagttctttcattcaat

SEQ ID NO: 260308 - DNA, 25 bp, Homo sapien
ataacttgtaaaccagtgactccta

SEQ ID NO: 260309 - DNA, 25 bp, Homo sapien
gtgactcctaatctttttcaagtta

SEQ ID NO: 260310 - DNA, 25 bp, Homo sapien
aagacaccttaccattgcttatttg

SEQ ID NO: 260311 - DNA, 25 bp, Homo sapien
ttggttttatgagacttgttccttt

SEQ ID NO: 260312 - DNA, 25 bp, Homo sapien
ccttttttcttgtgtgtcagatgtt

SEQ ID NO: 260313 - DNA, 25 bp, Homo sapien
gtgtgtcagatgttccttctaggta

SEQ ID NO: 260314 - DNA, 25 bp, Homo sapien
gtcagatgttccttctaggtagaat

SEQ ID NO: 260315 - DNA, 25 bp, Homo sapien
ggtagaattctttataccttctgaa

SEQ ID NO: 260316 - DNA, 25 bp, Homo sapien
gaaattatgtccttagagctgtaga

SEQ ID NO: 260317 - DNA, 25 bp, Homo sapien
gagctgtagatttagaactgacatc

SEQ ID NO: 260318 - DNA, 25 bp, Homo sapien
aactgacatctcttgagctgttcta

SEQ ID NO: 260319 - DNA, 25 bp, Homo sapien
gacatctcttgagctgttctaagat

SEQ ID NO: 260320 - DNA, 25 bp, Homo sapien
cttttactttggagatacgcagttt

SEQ ID NO: 260321 - DNA, 25 bp, Homo sapien
acgcagtttttattatatgtctagc

SEQ ID NO: 260322 - DNA, 25 bp, Homo sapien
tctaattaaattccacaagttcttt

SEQ ID NO: 260323 - DNA, 25 bp, Homo sapien
acatgagttttagagtgagacactt

SEQ ID NO: 260324 - DNA, 25 bp, Homo sapien
gacacttgagtttgaaatccagccc

SEQ ID NO: 260325 - DNA, 25 bp, Homo sapien
aatccagcccaaccatttactagtt

SEQ ID NO: 260326 - DNA, 25 bp, Homo sapien
gttgtgtgacctctatcaagttatg

SEQ ID NO: 260327 - DNA, 25 bp, Homo sapien
tctatcaagttatgcaacctctctg

SEQ ID NO: 260328 - DNA, 25 bp, Homo sapien
ttttggcaaattggtgctaacacct

SEQ ID NO: 260329 - DNA, 25 bp, Homo sapien
gctaacacctcacaggactattgta

SEQ ID NO: 260330 - DNA, 25 bp, Homo sapien
acttaacacagcatccgacacatct

SEQ ID NO: 260331 - DNA, 25 bp, Homo sapien
cgacacatctcatcactcaataaat

SEQ ID NO: 260332 - DNA, 25 bp, Homo sapien
taaattatcactgccctttgttact

SEQ ID NO: 260333 - DNA, 25 bp, Homo sapien
cactgccctttgttactgtggttaa

SEQ ID NO: 260334 - DNA, 25 bp, Homo sapien
ggaagaatatacaccaggctgttaa

SEQ ID NO: 260335 - DNA, 25 bp, Homo sapien
acaccaggctgttaatattgattac

SEQ ID NO: 260336 - DNA, 25 bp, Homo sapien
acagaaaaatgtaaatgctgccttt

SEQ ID NO: 260337 - DNA, 25 bp, Homo sapien
gtaaatgctgcctttatggtataaa

SEQ ID NO: 260338 - DNA, 25 bp, Homo sapien
atgctgcctttatggtataaaactg

SEQ ID NO: 260339 - DNA, 25 bp, Homo sapien
gtaattatgtgaacttttgagagag

SEQ ID NO: 260340 - DNA, 25 bp, Homo sapien
attaatgatggttatttctgtttta

SEQ ID NO: 260341 - DNA, 25 bp, Homo sapien
gttatttctgttttagtggttcatc

SEQ ID NO: 260342 - DNA, 25 bp, Homo sapien
atttctgttttagtggttcatcaat

SEQ ID NO: 260343 - DNA, 25 bp, Homo sapien
ctgttttagtggttcatcaattttt

SEQ ID NO: 260344 - DNA, 25 bp, Homo sapien
tagtggttcatcaattttttgtttt

SEQ ID NO: 260345 - DNA, 25 bp, Homo sapien
cttcagttaaactatcttccccaca

SEQ ID NO: 260346 - DNA, 25 bp, Homo sapien
cagaaattattatactacgaacaag

SEQ ID NO: 260347 - DNA, 25 bp, Homo sapien
ctacgaacaagttatgagtgagact

SEQ ID NO: 260348 - DNA, 25 bp, Homo sapien
gagtgagactgagaagcttgaagaa

SEQ ID NO: 260349 - DNA, 25 bp, Homo sapien
cttgaagaagctggtttttaagcag

SEQ ID NO: 260350 - DNA, 25 bp, Homo sapien
taagcagctcatataatattttgtg

SEQ ID NO: 260351 - DNA, 25 bp, Homo sapien
ttaaagaaagtgtcattgtttcctg

SEQ ID NO: 260352 - DNA, 25 bp, Homo sapien
cattgtttcctgttgggaggcaaat

SEQ ID NO: 260353 - DNA, 25 bp, Homo sapien
aattgtcatgattctttctgagcca

SEQ ID NO: 260354 - DNA, 25 bp, Homo sapien
tgtcatgattctttctgagccaaac

SEQ ID NO: 260355 - DNA, 25 bp, Homo sapien
tttcagttaaactatcttccccaca

SEQ ID NO: 260356 - DNA, 25 bp, Homo sapien
gctctggatctgtataactgcattt

SEQ ID NO: 260357 - DNA, 25 bp, Homo sapien
gggagacaagtgtgggtccctctca

SEQ ID NO: 260358 - DNA, 25 bp, Homo sapien
tgggtccctctcactgggcttcatt

SEQ ID NO: 260359 - DNA, 25 bp, Homo sapien
tgggcttcattctgtggaccaggat

SEQ ID NO: 260360 - DNA, 25 bp, Homo sapien
ctgtggaccaggatcattatttcat

SEQ ID NO: 260361 - DNA, 25 bp, Homo sapien
attatttcatgctcatgatcatgag

SEQ ID NO: 260362 - DNA, 25 bp, Homo sapien
tcatgatcatgagagttaggactga

SEQ ID NO: 260363 - DNA, 25 bp, Homo sapien
ttaggactgagtggctcctgtgact

SEQ ID NO: 260364 - DNA, 25 bp, Homo sapien
gactgagtggctcctgtgactccca

SEQ ID NO: 260365 - DNA, 25 bp, Homo sapien
gactcccaccatcttagatgatact

SEQ ID NO: 260366 - DNA, 25 bp, Homo sapien
tgatttgtgtgaattgtggtgaaac

SEQ ID NO: 260367 - DNA, 25 bp, Homo sapien
aacacaacgttgaaatccaggctta

SEQ ID NO: 260368 - DNA, 25 bp, Homo sapien
aatccaggcttatacgcagactccg

SEQ ID NO: 260369 - DNA, 25 bp, Homo sapien
gcagactccgattcctagagaacta

SEQ ID NO: 260370 - DNA, 25 bp, Homo sapien
aaatttggctttagtgtgacgggat

SEQ ID NO: 260371 - DNA, 25 bp, Homo sapien
tagtcttttgaacacggaaatcctg

SEQ ID NO: 260372 - DNA, 25 bp, Homo sapien
ggaaatcctgttgtacttaaagcta

SEQ ID NO: 260373 - DNA, 25 bp, Homo sapien
tgtacttaaagctagcggacccgtg

SEQ ID NO: 260374 - DNA, 25 bp, Homo sapien
acaactttgtcaggttcacgtccta

SEQ ID NO: 260375 - DNA, 25 bp, Homo sapien
gtcaggttcacgtcctataacggtt

SEQ ID NO: 260376 - DNA, 25 bp, Homo sapien
tacacaaaccgtttctatgagagat

SEQ ID NO: 260377 - DNA, 25 bp, Homo sapien
gaacacgttctgtaaacgagtcgct

SEQ ID NO: 260378 - DNA, 25 bp, Homo sapien
ttcactcaggccctgtctctcatta

SEQ ID NO: 260379 - DNA, 25 bp, Homo sapien
gtctctcattaacagccagtagctt

SEQ ID NO: 260380 - DNA, 25 bp, Homo sapien
agccagtagcttattggtgatccta

SEQ ID NO: 260381 - DNA, 25 bp, Homo sapien
tggtgatcctagatgcagcctgcaa

SEQ ID NO: 260382 - DNA, 25 bp, Homo sapien
tgcaaccttttgtacaactcacaga

SEQ ID NO: 260383 - DNA, 25 bp, Homo sapien
gtacaactcacagaagcactgattt

SEQ ID NO: 260384 - DNA, 25 bp, Homo sapien
agcactgatttgctgtcaaatggtg

SEQ ID NO: 260385 - DNA, 25 bp, Homo sapien
gtggaaaagttcaagctgccaaact

SEQ ID NO: 260386 - DNA, 25 bp, Homo sapien
gtgaatactgtaggccttaactgtt

SEQ ID NO: 260387 - DNA, 25 bp, Homo sapien
cctgactgattaaagcttggccaag

SEQ ID NO: 260388 - DNA, 25 bp, Homo sapien
ttggccaagcacagaatctttccca

SEQ ID NO: 260389 - DNA, 25 bp, Homo sapien
gcttcattgcaagagccagcatttg

SEQ ID NO: 260390 - DNA, 25 bp, Homo sapien
ttgagtttcttctgggcacctgcca

SEQ ID NO: 260391 - DNA, 25 bp, Homo sapien
tgccactgtgcatgtgtgacctcaa

SEQ ID NO: 260392 - DNA, 25 bp, Homo sapien
atgtgtgacctcaactgctttgtgc

SEQ ID NO: 260393 - DNA, 25 bp, Homo sapien
aactgctttgtgcaccctgactggg

SEQ ID NO: 260394 - DNA, 25 bp, Homo sapien
gtaggtgctagcgttccaacattac

SEQ ID NO: 260395 - DNA, 25 bp, Homo sapien
agaagaggtaacctgcccaaggtca

SEQ ID NO: 260396 - DNA, 25 bp, Homo sapien
attgtcagtctgacttcaggtgcat

SEQ ID NO: 260397 - DNA, 25 bp, Homo sapien
tgcataaaacctgaggctgagcctc

SEQ ID NO: 260398 - DNA, 25 bp, Homo sapien
gctgagcctccccatgagaggaaaa

SEQ ID NO: 260399 - DNA, 25 bp, Homo sapien
tttgtggtgtgacctcagttgccag

SEQ ID NO: 260400 - DNA, 25 bp, Homo sapien
gaaatcacctttgacgtgttgtaac

SEQ ID NO: 260401 - DNA, 25 bp, Homo sapien
tattacaggtaattggccttttaat

SEQ ID NO: 260402 - DNA, 25 bp, Homo sapien
gctgctgcttctcagatatttttca

SEQ ID NO: 260403 - DNA, 25 bp, Homo sapien
atttttcagtgccacgaaagctttt

SEQ ID NO: 260404 - DNA, 25 bp, Homo sapien
gtgccacgaaagcttttattatcag

SEQ ID NO: 260405 - DNA, 25 bp, Homo sapien
tttattatcagttcagtccctgccc

SEQ ID NO: 260406 - DNA, 25 bp, Homo sapien
tatcagttcagtccctgcccttaag

SEQ ID NO: 260407 - DNA, 25 bp, Homo sapien
tgcccttaaggttcatctgacctcc

SEQ ID NO: 260408 - DNA, 25 bp, Homo sapien
ttccccttccacagatttgtattaa

SEQ ID NO: 260409 - DNA, 25 bp, Homo sapien
attggccttttaattgctattatat

SEQ ID NO: 260410 - DNA, 25 bp, Homo sapien
agactgacattttcttattagttcc

SEQ ID NO: 260411 - DNA, 25 bp, Homo sapien
atatgaaaccccaaccaagaggagt

SEQ ID NO: 260412 - DNA, 25 bp, Homo sapien
atagtaatggacacttctcacacct

SEQ ID NO: 260413 - DNA, 25 bp, Homo sapien
gctttggtatagagtggccactttc

SEQ ID NO: 260414 - DNA, 25 bp, Homo sapien
ggccactttctctaggacctggaag

SEQ ID NO: 260415 - DNA, 25 bp, Homo sapien
gaacgattgtgatcctaggtcttct

SEQ ID NO: 260416 - DNA, 25 bp, Homo sapien
atcctaggtcttctttgtacgcatc

SEQ ID NO: 260417 - DNA, 25 bp, Homo sapien
gtacgcatctccgtatttaggccag

SEQ ID NO: 260418 - DNA, 25 bp, Homo sapien
cgtatttaggccagatctgcctcct

SEQ ID NO: 260419 - DNA, 25 bp, Homo sapien
gtcagcctccaggtgatttctttaa

SEQ ID NO: 260420 - DNA, 25 bp, Homo sapien
ccaaggctgttggtacccacgaaat

SEQ ID NO: 260421 - DNA, 25 bp, Homo sapien
ggtacccacgaaatgacagcaaaga

SEQ ID NO: 260422 - DNA, 25 bp, Homo sapien
ggttgaagtttttgcaaaggcattt

SEQ ID NO: 260423 - DNA, 25 bp, Homo sapien
gaaggaactctagtttctgtttgaa

SEQ ID NO: 260424 - DNA, 25 bp, Homo sapien
gaactctagtttctgtttgaagtga

SEQ ID NO: 260425 - DNA, 25 bp, Homo sapien
gaagtgaggattttctgaattatct

SEQ ID NO: 260426 - DNA, 25 bp, Homo sapien
ctaatatcatctaggttttctttaa

SEQ ID NO: 260427 - DNA, 25 bp, Homo sapien
gttcttcagttcaagcatcttctca

SEQ ID NO: 260428 - DNA, 25 bp, Homo sapien
tcttcagttcaagcatcttctcact

SEQ ID NO: 260429 - DNA, 25 bp, Homo sapien
agcatcttctcactaatgtttttca

SEQ ID NO: 260430 - DNA, 25 bp, Homo sapien
tcttctcactaatgtttttcactat

SEQ ID NO: 260431 - DNA, 25 bp, Homo sapien
gtttttcactataacagagaattca

SEQ ID NO: 260432 - DNA, 25 bp, Homo sapien
cagagaattcatttcaatttgagtt

SEQ ID NO: 260433 - DNA, 25 bp, Homo sapien
ttaccttataggctagagctctctg

SEQ ID NO: 260434 - DNA, 25 bp, Homo sapien
ataggctagagctctctgtgggaga

SEQ ID NO: 260435 - DNA, 25 bp, Homo sapien
gaggagctcactatttcatacccat

SEQ ID NO: 260436 - DNA, 25 bp, Homo sapien
cactatttcatacccatggctgttt

SEQ ID NO: 260437 - DNA, 25 bp, Homo sapien
acccatggctgtttagaatgcttaa

SEQ ID NO: 260438 - DNA, 25 bp, Homo sapien
gaagctccctgaggtgcggcccttt

SEQ ID NO: 260439 - DNA, 25 bp, Homo sapien
gcccttttttatgctggatctccaa

SEQ ID NO: 260440 - DNA, 25 bp, Homo sapien
ggaagcaaaaggaagtcccaaacag

SEQ ID NO: 260441 - DNA, 25 bp, Homo sapien
agtgctgaatctacagtggctctga

SEQ ID NO: 260442 - DNA, 25 bp, Homo sapien
gtggctctgagaacttttaactaat

SEQ ID NO: 260443 - DNA, 25 bp, Homo sapien
gatcattcatttatggagggaacca

SEQ ID NO: 260444 - DNA, 25 bp, Homo sapien
agatatgacataaatcccttgaggg

SEQ ID NO: 260445 - DNA, 25 bp, Homo sapien
atcccttgagggtctacatcttcag

SEQ ID NO: 260446 - DNA, 25 bp, Homo sapien
gtctacatcttcagggcgattccaa

SEQ ID NO: 260447 - DNA, 25 bp, Homo sapien
gggcgattccaatctacggacgagc

SEQ ID NO: 260448 - DNA, 25 bp, Homo sapien
aatctacggacgagctcggaccatc

SEQ ID NO: 260449 - DNA, 25 bp, Homo sapien
ggacgagctcggaccatccccggaa

SEQ ID NO: 260450 - DNA, 25 bp, Homo sapien
gaaccctcctgcgtccttaggttgt

SEQ ID NO: 260451 - DNA, 25 bp, Homo sapien
gcgtccttaggttgttgagtgcatc

SEQ ID NO: 260452 - DNA, 25 bp, Homo sapien
cttaggttgttgagtgcatccggga

SEQ ID NO: 260453 - DNA, 25 bp, Homo sapien
caagcgagacccagcatcctgggag

SEQ ID NO: 260454 - DNA, 25 bp, Homo sapien
cctcccgagcgtagatggaaggagc

SEQ ID NO: 260455 - DNA, 25 bp, Homo sapien
ggaagtcccaagtatcattgcctgg

SEQ ID NO: 260456 - DNA, 25 bp, Homo sapien
gtcccaagtatcattgcctggtttc

SEQ ID NO: 260457 - DNA, 25 bp, Homo sapien
cattgcctggtttcaggttttagta

SEQ ID NO: 260458 - DNA, 25 bp, Homo sapien
taggcagatagtgatgccatttttt

SEQ ID NO: 260459 - DNA, 25 bp, Homo sapien
tgatgccattttttgaggtaaagaa

SEQ ID NO: 260460 - DNA, 25 bp, Homo sapien
gggcaagctcagataggaagtttag

SEQ ID NO: 260461 - DNA, 25 bp, Homo sapien
acttgaggaagaggcacctatgtag

SEQ ID NO: 260462 - DNA, 25 bp, Homo sapien
gaggcacctatgtagggataatcat

SEQ ID NO: 260463 - DNA, 25 bp, Homo sapien
agtttaggagatgggtttgcaatac

SEQ ID NO: 260464 - DNA, 25 bp, Homo sapien
gatgggtttgcaatacattttggaa

SEQ ID NO: 260465 - DNA, 25 bp, Homo sapien
aattgttgggattcagagatggatt

SEQ ID NO: 260466 - DNA, 25 bp, Homo sapien
gaccgtattcgtcaggagctaatgc

SEQ ID NO: 260467 - DNA, 25 bp, Homo sapien
aggagctaatgctcactcattttag

SEQ ID NO: 260468 - DNA, 25 bp, Homo sapien
atgggatggatgtttggtcctctcc

SEQ ID NO: 260469 - DNA, 25 bp, Homo sapien
cttcccaggagttgtgacagacttt

SEQ ID NO: 260470 - DNA, 25 bp, Homo sapien
agttgtgacagactttcctcctcat

SEQ ID NO: 260471 - DNA, 25 bp, Homo sapien
atcaccttttacacagttccatcat

SEQ ID NO: 260472 - DNA, 25 bp, Homo sapien
gttccatcatctagcatgactgagt

SEQ ID NO: 260473 - DNA, 25 bp, Homo sapien
tgtttggtcctctccaatgacagga

SEQ ID NO: 260474 - DNA, 25 bp, Homo sapien
aatgacaggacccatggaacagccc

SEQ ID NO: 260475 - DNA, 25 bp, Homo sapien
agtatgagcacatggagtccctgga

SEQ ID NO: 260476 - DNA, 25 bp, Homo sapien
gagtccctggacttagaggctgacc

SEQ ID NO: 260477 - DNA, 25 bp, Homo sapien
ttctcgttccctcggaagtagtcga

SEQ ID NO: 260478 - DNA, 25 bp, Homo sapien
ggaagtagtcgagggccggcccgag

SEQ ID NO: 260479 - DNA, 25 bp, Homo sapien
aacttgaccgccctggaggctctac

SEQ ID NO: 260480 - DNA, 25 bp, Homo sapien
gccctggaggctctacgaccggtct

SEQ ID NO: 260481 - DNA, 25 bp, Homo sapien
ctggaggctctacgaccggtctcca

SEQ ID NO: 260482 - DNA, 25 bp, Homo sapien
caagcccctagctcctacttcttgg

SEQ ID NO: 260483 - DNA, 25 bp, Homo sapien
tacttcttggccttgacgtgcagcg

SEQ ID NO: 260484 - DNA, 25 bp, Homo sapien
tcttggccttgacgtgcagcgcccg

SEQ ID NO: 260485 - DNA, 25 bp, Homo sapien
gctgcaccgggtgtaactcgggcct

SEQ ID NO: 260486 - DNA, 25 bp, Homo sapien
caccgggtgtaactcgggcctacag

SEQ ID NO: 260487 - DNA, 25 bp, Homo sapien
ggatggccgccgagcttttgccttc

SEQ ID NO: 260488 - DNA, 25 bp, Homo sapien
aaatcactgggcatttccgtgagcc

SEQ ID NO: 260489 - DNA, 25 bp, Homo sapien
tgggcatttccgtgagccctttctg

SEQ ID NO: 260490 - DNA, 25 bp, Homo sapien
gtctttgcagtttccttatccccga

SEQ ID NO: 260491 - DNA, 25 bp, Homo sapien
acaagatttctagacccagtataaa

SEQ ID NO: 260492 - DNA, 25 bp, Homo sapien
gacagtttcttgttatctggccgat

SEQ ID NO: 260493 - DNA, 25 bp, Homo sapien
ttcttgttatctggccgatccactg

SEQ ID NO: 260494 - DNA, 25 bp, Homo sapien
gggaccgggctgcagcctttaaaat

SEQ ID NO: 260495 - DNA, 25 bp, Homo sapien
ggctgcagcctttaaaatttttgat

SEQ ID NO: 260496 - DNA, 25 bp, Homo sapien
aatttttgatcctggaggccgccga

SEQ ID NO: 260497 - DNA, 25 bp, Homo sapien
ggaggccgccgagctgaactttccg

SEQ ID NO: 260498 - DNA, 25 bp, Homo sapien
tttagtcttctgtaaatcactgggc

SEQ ID NO: 260499 - DNA, 25 bp, Homo sapien
cagggaagctgtgtgcgcttctcaa

SEQ ID NO: 260500 - DNA, 25 bp, Homo sapien
agctgtgtgcgcttctcaatgtctt

SEQ ID NO: 260501 - DNA, 25 bp, Homo sapien
ttctcaatgtcttctaccctcgttt

SEQ ID NO: 260502 - DNA, 25 bp, Homo sapien
tctaccctcgttttcccaatagtga

SEQ ID NO: 260503 - DNA, 25 bp, Homo sapien
cctcgttttcccaatagtgagcagc

SEQ ID NO: 260504 - DNA, 25 bp, Homo sapien
gcactgtggtgaggtcccttccact

SEQ ID NO: 260505 - DNA, 25 bp, Homo sapien
tggtgaggtcccttccactgtgtac

SEQ ID NO: 260506 - DNA, 25 bp, Homo sapien
cttccactgtgtactctgcatacag

SEQ ID NO: 260507 - DNA, 25 bp, Homo sapien
cactgtgtactctgcatacagggta

SEQ ID NO: 260508 - DNA, 25 bp, Homo sapien
gtactctgcatacagggtattccct

SEQ ID NO: 260509 - DNA, 25 bp, Homo sapien
atacagggtattccctgttccactc

SEQ ID NO: 260510 - DNA, 25 bp, Homo sapien
cgtgattctgatcccctggccaaat

SEQ ID NO: 260511 - DNA, 25 bp, Homo sapien
ggcaggaaccgcaagcgtgcaacta

SEQ ID NO: 260512 - DNA, 25 bp, Homo sapien
aagcgtgcaactagcctggagctac

SEQ ID NO: 260513 - DNA, 25 bp, Homo sapien
tggagctacccgtctggactcgcag

SEQ ID NO: 260514 - DNA, 25 bp, Homo sapien
tgatcccctggccaaatctttcttc

SEQ ID NO: 260515 - DNA, 25 bp, Homo sapien
tggctgtttcccacagctgctacgg

SEQ ID NO: 260516 - DNA, 25 bp, Homo sapien
ctctcttgctccttgacaccgagga

SEQ ID NO: 260517 - DNA, 25 bp, Homo sapien
ttgacaccgaggaggaccccactag

SEQ ID NO: 260518 - DNA, 25 bp, Homo sapien
gaggaggaccccactaggatccgag

SEQ ID NO: 260519 - DNA, 25 bp, Homo sapien
aatctttcttcctctggacagaggg

SEQ ID NO: 260520 - DNA, 25 bp, Homo sapien
gacagagggtccagtcgggaaacct

SEQ ID NO: 260521 - DNA, 25 bp, Homo sapien
atgacaccacagttcatggttggca

SEQ ID NO: 260522 - DNA, 25 bp, Homo sapien
tcatggttggcaaaacaggactttt

SEQ ID NO: 260523 - DNA, 25 bp, Homo sapien
gaatcaacctgtattgtgtgtgtga

SEQ ID NO: 260524 - DNA, 25 bp, Homo sapien
gaaggccagggcactaaagatacat

SEQ ID NO: 260525 - DNA, 25 bp, Homo sapien
gcaggatttcctatgattttatgtt

SEQ ID NO: 260526 - DNA, 25 bp, Homo sapien
gcatattggcagcaaatgctaacat

SEQ ID NO: 260527 - DNA, 25 bp, Homo sapien
aaatgttttctattacaactctgaa

SEQ ID NO: 260528 - DNA, 25 bp, Homo sapien
tattacaactctgaattccatgcct

SEQ ID NO: 260529 - DNA, 25 bp, Homo sapien
tgaattccatgcctggtcggaaccc

SEQ ID NO: 260530 - DNA, 25 bp, Homo sapien
tggtcggaacccgtgcttttctgct

SEQ ID NO: 260531 - DNA, 25 bp, Homo sapien
tgcttttctgctcatggcttacaaa

SEQ ID NO: 260532 - DNA, 25 bp, Homo sapien
gctgttatggtattctttcttgggt

SEQ ID NO: 260533 - DNA, 25 bp, Homo sapien
tcttgggttaagactttgtgctatt

SEQ ID NO: 260534 - DNA, 25 bp, Homo sapien
aggtttacattatttctagtcattt

SEQ ID NO: 260535 - DNA, 25 bp, Homo sapien
catttatattttactgtgaacgtct

SEQ ID NO: 260536 - DNA, 25 bp, Homo sapien
gtgaacgtctaatagctttagggta

SEQ ID NO: 260537 - DNA, 25 bp, Homo sapien
tagctttagggtatagggtcctgta

SEQ ID NO: 260538 - DNA, 25 bp, Homo sapien
gggaccttgagcttgacaattacat

SEQ ID NO: 260539 - DNA, 25 bp, Homo sapien
tgagcttgacaattacatctcccct

SEQ ID NO: 260540 - DNA, 25 bp, Homo sapien
aaagacagccctctggcatagtggt

SEQ ID NO: 260541 - DNA, 25 bp, Homo sapien
ggcatagtggtcattctcttgtggg

SEQ ID NO: 260542 - DNA, 25 bp, Homo sapien
gatgtttttatcttagggacttgct

SEQ ID NO: 260543 - DNA, 25 bp, Homo sapien
aaaactgaggctatgatgtacccta

SEQ ID NO: 260544 - DNA, 25 bp, Homo sapien
ggctatgatgtaccctataagttat

SEQ ID NO: 260545 - DNA, 25 bp, Homo sapien
aaacaccactggtaagaccccagcg

SEQ ID NO: 260546 - DNA, 25 bp, Homo sapien
aagaccccagcgtcactggcaagga

SEQ ID NO: 260547 - DNA, 25 bp, Homo sapien
cccagcgtcactggcaaggagcgag

SEQ ID NO: 260548 - DNA, 25 bp, Homo sapien
gggactgccgctgatgtcattgctt

SEQ ID NO: 260549 - DNA, 25 bp, Homo sapien
gactgccgctgatgtcattgcttcc

SEQ ID NO: 260550 - DNA, 25 bp, Homo sapien
ttctccaggacaggccgtgaacttg

SEQ ID NO: 260551 - DNA, 25 bp, Homo sapien
aggccgtgaacttgcctgggtcctg

SEQ ID NO: 260552 - DNA, 25 bp, Homo sapien
acattgatgggcaaaccttgaccaa

SEQ ID NO: 260553 - DNA, 25 bp, Homo sapien
ttgatgggcaaaccttgaccaaatg

SEQ ID NO: 260554 - DNA, 25 bp, Homo sapien
accactgcctccattagtcagaaga

SEQ ID NO: 260555 - DNA, 25 bp, Homo sapien
taactgtagaaagcccgtcatcctt

SEQ ID NO: 260556 - DNA, 25 bp, Homo sapien
ccgtcatccttgtgtatgcacttgc

SEQ ID NO: 260557 - DNA, 25 bp, Homo sapien
gtcaggatctttgattttggagcac

SEQ ID NO: 260558 - DNA, 25 bp, Homo sapien
gagcaaccttcatgaacattaccag

SEQ ID NO: 260559 - DNA, 25 bp, Homo sapien
accgcgatggactatctgtgatcac

SEQ ID NO: 260560 - DNA, 25 bp, Homo sapien
attttggagcacaagccttctgcgt

SEQ ID NO: 260561 - DNA, 25 bp, Homo sapien
aagccttctgcgtgctactgactgg

SEQ ID NO: 260562 - DNA, 25 bp, Homo sapien
tgcgtgctactgactgggtcctggc

SEQ ID NO: 260563 - DNA, 25 bp, Homo sapien
tccttccatggcatcgtcgtgaatg

SEQ ID NO: 260564 - DNA, 25 bp, Homo sapien
tgaatgggaatttccaccactgcct

SEQ ID NO: 260565 - DNA, 25 bp, Homo sapien
gctcagcctcaatcatgtcttaaca

SEQ ID NO: 260566 - DNA, 25 bp, Homo sapien
aatagctcaaaagtgacaagtcctt

SEQ ID NO: 260567 - DNA, 25 bp, Homo sapien
gacaagtccttttcacagcaccgtt

SEQ ID NO: 260568 - DNA, 25 bp, Homo sapien
agcaccgttctcagaacacctctga

SEQ ID NO: 260569 - DNA, 25 bp, Homo sapien
acacctctgagtaacgtgtttgcca

SEQ ID NO: 260570 - DNA, 25 bp, Homo sapien
acgtgtttgccagtagctattctca

SEQ ID NO: 260571 - DNA, 25 bp, Homo sapien
gtagctattctcactgatgcactga

SEQ ID NO: 260572 - DNA, 25 bp, Homo sapien
tcactgatgcactgatggccctgaa

SEQ ID NO: 260573 - DNA, 25 bp, Homo sapien
ggccctgaagaagcggatccagtca

SEQ ID NO: 260574 - DNA, 25 bp, Homo sapien
gaagcggatccagtcacataggaaa

SEQ ID NO: 260575 - DNA, 25 bp, Homo sapien
gcacatggaaggtgttgctttagaa

SEQ ID NO: 260576 - DNA, 25 bp, Homo sapien
ggtatgctgcaaataactagccatt

SEQ ID NO: 260577 - DNA, 25 bp, Homo sapien
tatttactagttctgttaaaagcag

SEQ ID NO: 260578 - DNA, 25 bp, Homo sapien
agttagacactaaggatctctttgt

SEQ ID NO: 260579 - DNA, 25 bp, Homo sapien
aggatctctttgtgaactctgtgtt

SEQ ID NO: 260580 - DNA, 25 bp, Homo sapien
gaactctgtgttctctatattagat

SEQ ID NO: 260581 - DNA, 25 bp, Homo sapien
gaattttattgcttatgtggcatac

SEQ ID NO: 260582 - DNA, 25 bp, Homo sapien
gaagtacagtattaaagtcagtggt

SEQ ID NO: 260583 - DNA, 25 bp, Homo sapien
agtcagtggtacacagacattctgt

SEQ ID NO: 260584 - DNA, 25 bp, Homo sapien
agacattctgtacatatcctgtgaa

SEQ ID NO: 260585 - DNA, 25 bp, Homo sapien
atatcctgtgaaacgtgctgtcata

SEQ ID NO: 260586 - DNA, 25 bp, Homo sapien
gtgaaacgtgctgtcatatgaaata

SEQ ID NO: 260587 - DNA, 25 bp, Homo sapien
gcaaggcaacaagttttcttttgtt

SEQ ID NO: 260588 - DNA, 25 bp, Homo sapien
ttgttttctcaccagccacaagcat

SEQ ID NO: 260589 - DNA, 25 bp, Homo sapien
agccacaagcatcttatgagtttct

SEQ ID NO: 260590 - DNA, 25 bp, Homo sapien
gcatcttatgagtttctgtgcaagg

SEQ ID NO: 260591 - DNA, 25 bp, Homo sapien
agcgtagagcactgctgtgctgtca

SEQ ID NO: 260592 - DNA, 25 bp, Homo sapien
tggcctttctctacccagaggccaa

SEQ ID NO: 260593 - DNA, 25 bp, Homo sapien
cctgcactgtgtccttggttggtgt

SEQ ID NO: 260594 - DNA, 25 bp, Homo sapien
gagaaggtgcttgctagcttttcct

SEQ ID NO: 260595 - DNA, 25 bp, Homo sapien
tgcttgctagcttttccttggtaca

SEQ ID NO: 260596 - DNA, 25 bp, Homo sapien
ttgctagcttttccttggtacattt

SEQ ID NO: 260597 - DNA, 25 bp, Homo sapien
tagcttttccttggtacattttcgg

SEQ ID NO: 260598 - DNA, 25 bp, Homo sapien
acatcctggtggaggcgagccgcgg

SEQ ID NO: 260599 - DNA, 25 bp, Homo sapien
gaggtggtactcacctcgcggccac

SEQ ID NO: 260600 - DNA, 25 bp, Homo sapien
aggtggtactcacctcgcggccacg

SEQ ID NO: 260601 - DNA, 25 bp, Homo sapien
caggagtctgaccccggacacgctg

SEQ ID NO: 260602 - DNA, 25 bp, Homo sapien
caagcagaggtactccacccggtgg

SEQ ID NO: 260603 - DNA, 25 bp, Homo sapien
aagcagaggtactccacccggtggt

SEQ ID NO: 260604 - DNA, 25 bp, Homo sapien
agaggtactccacccggtggtgcca

SEQ ID NO: 260605 - DNA, 25 bp, Homo sapien
gtggtgccacttcctaccgaccttc

SEQ ID NO: 260606 - DNA, 25 bp, Homo sapien
taccgaccttccgtaaatgcccgcg

SEQ ID NO: 260607 - DNA, 25 bp, Homo sapien
cagcctctccgacatgccgctaggg

SEQ ID NO: 260608 - DNA, 25 bp, Homo sapien
cagaacatcctggtggaggcgagcc

SEQ ID NO: 260609 - DNA, 25 bp, Homo sapien
cagacaagtattttggcacctccaa

SEQ ID NO: 260610 - DNA, 25 bp, Homo sapien
tccaaggactcgcagaacacagaga

SEQ ID NO: 260611 - DNA, 25 bp, Homo sapien
aagagagaccctgttatctttccgc

SEQ ID NO: 260612 - DNA, 25 bp, Homo sapien
gagaccctgttatctttccgcaggg

SEQ ID NO: 260613 - DNA, 25 bp, Homo sapien
gtggccgttcaaactctcagagatg

SEQ ID NO: 260614 - DNA, 25 bp, Homo sapien
ctttggtataagtggcagtttgact

SEQ ID NO: 260615 - DNA, 25 bp, Homo sapien
gtttgactggctgcaaggagagcct

SEQ ID NO: 260616 - DNA, 25 bp, Homo sapien
aagacaacatctaatcatccccaga

SEQ ID NO: 260617 - DNA, 25 bp, Homo sapien
taatcatccccagagaaatttcagc

SEQ ID NO: 260618 - DNA, 25 bp, Homo sapien
gaaatttcagctgagaagacaggat

SEQ ID NO: 260619 - DNA, 25 bp, Homo sapien
gggccagagtccagacaagtatttt

SEQ ID NO: 260620 - DNA, 25 bp, Homo sapien
tgctgcctcgcacaatgcatcaaag

SEQ ID NO: 260621 - DNA, 25 bp, Homo sapien
atgcatcaaaggaggttgtgtccgt

SEQ ID NO: 260622 - DNA, 25 bp, Homo sapien
gttgtgtccgtggtcgtaacctctt

SEQ ID NO: 260623 - DNA, 25 bp, Homo sapien
tggtcgtaacctcttcgcgtgaaag

SEQ ID NO: 260624 - DNA, 25 bp, Homo sapien
tcttcgcgtgaaaggcaccgcctgg

SEQ ID NO: 260625 - DNA, 25 bp, Homo sapien
cgcctggtccagtctttgtgaagga

SEQ ID NO: 260626 - DNA, 25 bp, Homo sapien
aatgacaaggctggagcgcagctcc

SEQ ID NO: 260627 - DNA, 25 bp, Homo sapien
tcccaccgcacagttatttgcaaag

SEQ ID NO: 260628 - DNA, 25 bp, Homo sapien
atttccatttcatcacagcaataag

SEQ ID NO: 260629 - DNA, 25 bp, Homo sapien
tttgcaaagtcccaggtgaactcgt

SEQ ID NO: 260630 - DNA, 25 bp, Homo sapien
agtcccaggtgaactcgtggcgaga

SEQ ID NO: 260631 - DNA, 25 bp, Homo sapien
gaaattcagcagatgtcttagtgtg

SEQ ID NO: 260632 - DNA, 25 bp, Homo sapien
agctccgatcagtacttgggtgaca

SEQ ID NO: 260633 - DNA, 25 bp, Homo sapien
gcagatgtcttagtgtgtacccttt

SEQ ID NO: 260634 - DNA, 25 bp, Homo sapien
gatgtcttagtgtgtacccttttca

SEQ ID NO: 260635 - DNA, 25 bp, Homo sapien
gtcttagtgtgtacccttttcaact

SEQ ID NO: 260636 - DNA, 25 bp, Homo sapien
tccgatcagtacttgggtgacagag

SEQ ID NO: 260637 - DNA, 25 bp, Homo sapien
tcttttaggatttgtacacacagat

SEQ ID NO: 260638 - DNA, 25 bp, Homo sapien
ggatttgtacacacagatatgacga

SEQ ID NO: 260639 - DNA, 25 bp, Homo sapien
cacacagatatgacgaaagacttga

SEQ ID NO: 260640 - DNA, 25 bp, Homo sapien
gagaaactattgaggtggcacatgc

SEQ ID NO: 260641 - DNA, 25 bp, Homo sapien
gtggcacatgcggttgtgtttcttt

SEQ ID NO: 260642 - DNA, 25 bp, Homo sapien
gtagaaaagccttttctgagcctgt

SEQ ID NO: 260643 - DNA, 25 bp, Homo sapien
tctgagcctgtgctttcggagccta

SEQ ID NO: 260644 - DNA, 25 bp, Homo sapien
gctttcggagcctatgtttgctgaa

SEQ ID NO: 260645 - DNA, 25 bp, Homo sapien
aaaccttataggtcattgccggaga

SEQ ID NO: 260646 - DNA, 25 bp, Homo sapien
tcattgccggagaagccagacattt

SEQ ID NO: 260647 - DNA, 25 bp, Homo sapien
agccagacatttcagattaccccaa

SEQ ID NO: 260648 - DNA, 25 bp, Homo sapien
catttcagattaccccaagcttctt

SEQ ID NO: 260649 - DNA, 25 bp, Homo sapien
caagcttcttgctaataagcagagt

SEQ ID NO: 260650 - DNA, 25 bp, Homo sapien
agcagagtaataacatccaagtttt

SEQ ID NO: 260651 - DNA, 25 bp, Homo sapien
agttttacattctgtgtttgaccaa

SEQ ID NO: 260652 - DNA, 25 bp, Homo sapien
ctgtgtttgaccaatcagctgaaat

SEQ ID NO: 260653 - DNA, 25 bp, Homo sapien
cagttgtatttgttccaaaacttgt

SEQ ID NO: 260654 - DNA, 25 bp, Homo sapien
cttgtttttgcaagttgtacttaat

SEQ ID NO: 260655 - DNA, 25 bp, Homo sapien
gcaagttgtacttaataacgatgta

SEQ ID NO: 260656 - DNA, 25 bp, Homo sapien
gttgtacttaataacgatgtaattt

SEQ ID NO: 260657 - DNA, 25 bp, Homo sapien
ccaaaatcaaacaattatgagtgtg

SEQ ID NO: 260658 - DNA, 25 bp, Homo sapien
gagtgtgaagagagtaatctctatg

SEQ ID NO: 260659 - DNA, 25 bp, Homo sapien
tgaaaacttgggaaagacctgataa

SEQ ID NO: 260660 - DNA, 25 bp, Homo sapien
ttgggaaagacctgataaaagacgt

SEQ ID NO: 260661 - DNA, 25 bp, Homo sapien
gaaagacctgataaaagacgtgtta

SEQ ID NO: 260662 - DNA, 25 bp, Homo sapien
aagacctgataaaagacgtgttatt

SEQ ID NO: 260663 - DNA, 25 bp, Homo sapien
gacctgataaaagacgtgttattaa

SEQ ID NO: 260664 - DNA, 25 bp, Homo sapien
taagacactaatatgcccactcaca

SEQ ID NO: 260665 - DNA, 25 bp, Homo sapien
taatatgcccactcacacagcaagt

SEQ ID NO: 260666 - DNA, 25 bp, Homo sapien
gagaaaattgagtgcccgtgatcca

SEQ ID NO: 260667 - DNA, 25 bp, Homo sapien
gtgatccaacgttctgcaactgttt

SEQ ID NO: 260668 - DNA, 25 bp, Homo sapien
acgttctgcaactgtttggaaacca

SEQ ID NO: 260669 - DNA, 25 bp, Homo sapien
gtggtagtacttctgaaccctaact

SEQ ID NO: 260670 - DNA, 25 bp, Homo sapien
aaaggtgtgtcgtttgcgtcctgga

SEQ ID NO: 260671 - DNA, 25 bp, Homo sapien
aaatatatcagcctgcaccatcagc

SEQ ID NO: 260672 - DNA, 25 bp, Homo sapien
tgcaccatcagcacagcttgcagat

SEQ ID NO: 260673 - DNA, 25 bp, Homo sapien
tggatctcccttaatttaaccccat

SEQ ID NO: 260674 - DNA, 25 bp, Homo sapien
ggagactgatgctcactaagacact

SEQ ID NO: 260675 - DNA, 25 bp, Homo sapien
ccgcgaagtccgaggcctggctctg

SEQ ID NO: 260676 - DNA, 25 bp, Homo sapien
cgcgaagtccgaggcctggctctgg

SEQ ID NO: 260677 - DNA, 25 bp, Homo sapien
ggagaggaccccattctgggactgc

SEQ ID NO: 260678 - DNA, 25 bp, Homo sapien
gaggaccccattctgggactgctca

SEQ ID NO: 260679 - DNA, 25 bp, Homo sapien
ggctccccaagacttgacgcagccc

SEQ ID NO: 260680 - DNA, 25 bp, Homo sapien
agccccccacgcttctggaggtggg

SEQ ID NO: 260681 - DNA, 25 bp, Homo sapien
ctctggacagatgggtgtcccctgg

SEQ ID NO: 260682 - DNA, 25 bp, Homo sapien
gacagatgggtgtcccctggtgccc

SEQ ID NO: 260683 - DNA, 25 bp, Homo sapien
acagatgggtgtcccctggtgcccc

SEQ ID NO: 260684 - DNA, 25 bp, Homo sapien
agatgggtgtcccctggtgcccctc

SEQ ID NO: 260685 - DNA, 25 bp, Homo sapien
atgggtgtcccctggtgcccctcca

SEQ ID NO: 260686 - DNA, 25 bp, Homo sapien
ggaccatgtctgtgctcatgtggat

SEQ ID NO: 260687 - DNA, 25 bp, Homo sapien
tgctcatgtggatcccagctgctgg

SEQ ID NO: 260688 - DNA, 25 bp, Homo sapien
tgatatcagcatctgatccaccctg

SEQ ID NO: 260689 - DNA, 25 bp, Homo sapien
tgctgggcagagcacaccacacatc

SEQ ID NO: 260690 - DNA, 25 bp, Homo sapien
aaatacatggagtcaaaggtcaggt

SEQ ID NO: 260691 - DNA, 25 bp, Homo sapien
gtcaggtgactgaatcaatgagtat

SEQ ID NO: 260692 - DNA, 25 bp, Homo sapien
tgttacacaccaagaaagacccctc

SEQ ID NO: 260693 - DNA, 25 bp, Homo sapien
aggcctggtctcctccaggatgaaa

SEQ ID NO: 260694 - DNA, 25 bp, Homo sapien
agaacctcccagaatcgaggctcac

SEQ ID NO: 260695 - DNA, 25 bp, Homo sapien
aatcgaggctcacggcagaggttct

SEQ ID NO: 260696 - DNA, 25 bp, Homo sapien
ggcagaggttctgcactcaccaagg

SEQ ID NO: 260697 - DNA, 25 bp, Homo sapien
ccgcgaagtccgaggcctggctctg

SEQ ID NO: 260698 - DNA, 25 bp, Homo sapien
cgcgaagtccgaggcctggctctgg

SEQ ID NO: 260699 - DNA, 25 bp, Homo sapien
ggctccccaagacttgacgcagccc

SEQ ID NO: 260700 - DNA, 25 bp, Homo sapien
agccccccacgcttctggaggtggg

SEQ ID NO: 260701 - DNA, 25 bp, Homo sapien
ctctggacagatgggtgtcccctgg

SEQ ID NO: 260702 - DNA, 25 bp, Homo sapien
gacagatgggtgtcccctggtgccc

SEQ ID NO: 260703 - DNA, 25 bp, Homo sapien
acagatgggtgtcccctggtgcccc

SEQ ID NO: 260704 - DNA, 25 bp, Homo sapien
cagatgggtgtcccctggtgcccct

SEQ ID NO: 260705 - DNA, 25 bp, Homo sapien
agatgggtgtcccctggtgcccctc

SEQ ID NO: 260706 - DNA, 25 bp, Homo sapien
atgggtgtcccctggtgcccctcca

SEQ ID NO: 260707 - DNA, 25 bp, Homo sapien
tggtgcccctccactcttctcttcc

SEQ ID NO: 260708 - DNA, 25 bp, Homo sapien
atcttttgcagaaatccaatttagt

SEQ ID NO: 260709 - DNA, 25 bp, Homo sapien
aaagtcatgttgtagcaagcatcac

SEQ ID NO: 260710 - DNA, 25 bp, Homo sapien
gttgtagcaagcatcactttaatat

SEQ ID NO: 260711 - DNA, 25 bp, Homo sapien
aagtgtacagcttatattattagca

SEQ ID NO: 260712 - DNA, 25 bp, Homo sapien
tatattagttatggtcttgaaggac

SEQ ID NO: 260713 - DNA, 25 bp, Homo sapien
aaggacattgaaaatctgttcagaa

SEQ ID NO: 260714 - DNA, 25 bp, Homo sapien
gtttttcaaccagagatgacatcac

SEQ ID NO: 260715 - DNA, 25 bp, Homo sapien
gatgacatcactctaactttccttt

SEQ ID NO: 260716 - DNA, 25 bp, Homo sapien
catcactctaactttcctttggttt

SEQ ID NO: 260717 - DNA, 25 bp, Homo sapien
catgagcaaccatgcctggtgtttt

SEQ ID NO: 260718 - DNA, 25 bp, Homo sapien
gcctggtgttttatcttttgcagaa

SEQ ID NO: 260719 - DNA, 25 bp, Homo sapien
tccagttaaacttcgtgattgaaca

SEQ ID NO: 260720 - DNA, 25 bp, Homo sapien
tgggaaagccgaatacatgtgactg

SEQ ID NO: 260721 - DNA, 25 bp, Homo sapien
agccgaatacatgtgactggagagt

SEQ ID NO: 260722 - DNA, 25 bp, Homo sapien
actggagagtgttgtgtcaatgaga

SEQ ID NO: 260723 - DNA, 25 bp, Homo sapien
aaacaagacagttcatactccagaa

SEQ ID NO: 260724 - DNA, 25 bp, Homo sapien
gttcatactccagaacctgtttaag

SEQ ID NO: 260725 - DNA, 25 bp, Homo sapien
cgtgattgaacacatgtttttccat

SEQ ID NO: 260726 - DNA, 25 bp, Homo sapien
agaattagaggcagtatgtcctgta

SEQ ID NO: 260727 - DNA, 25 bp, Homo sapien
gaggcagtatgtcctgtagaaaaca

SEQ ID NO: 260728 - DNA, 25 bp, Homo sapien
tgtttttccatgttccttcctagta

SEQ ID NO: 260729 - DNA, 25 bp, Homo sapien
aatatataaatccacaggcataagg

SEQ ID NO: 260730 - DNA, 25 bp, Homo sapien
gttcagataagggccagtgtgtgtc

SEQ ID NO: 260731 - DNA, 25 bp, Homo sapien
catgctgcgaaaattcagcctgcaa

SEQ ID NO: 260732 - DNA, 25 bp, Homo sapien
aaattcagcctgcaaaggctcctct

SEQ ID NO: 260733 - DNA, 25 bp, Homo sapien
acttgatcaggcccagaccaggtgg

SEQ ID NO: 260734 - DNA, 25 bp, Homo sapien
gttggcgctggcctgtgttgcaggg

SEQ ID NO: 260735 - DNA, 25 bp, Homo sapien
ccaggccttggaacataagctctgc

SEQ ID NO: 260736 - DNA, 25 bp, Homo sapien
ttggaacataagctctgcccctgca

SEQ ID NO: 260737 - DNA, 25 bp, Homo sapien
tcatgtcaccacacctgggatggag

SEQ ID NO: 260738 - DNA, 25 bp, Homo sapien
atgtcaccacacctgggatggagac

SEQ ID NO: 260739 - DNA, 25 bp, Homo sapien
atggagacatcaggtggcccagcga

SEQ ID NO: 260740 - DNA, 25 bp, Homo sapien
cagcgagagatggaggactgatcct

SEQ ID NO: 260741 - DNA, 25 bp, Homo sapien
taccacctactagggaaggctgcat

SEQ ID NO: 260742 - DNA, 25 bp, Homo sapien
aaggctgcattctacattacggtct

SEQ ID NO: 260743 - DNA, 25 bp, Homo sapien
ctacattacggtcttcagggatcct

SEQ ID NO: 260744 - DNA, 25 bp, Homo sapien
acatgcttccctttttgtttacctg

SEQ ID NO: 260745 - DNA, 25 bp, Homo sapien
gcaggttaggctacactatacactt

SEQ ID NO: 260746 - DNA, 25 bp, Homo sapien
actatacacttacagattttgccag

SEQ ID NO: 260747 - DNA, 25 bp, Homo sapien
attttgccagtagaagctttgagac

SEQ ID NO: 260748 - DNA, 25 bp, Homo sapien
tagaagctttgagacttcacatctt

SEQ ID NO: 260749 - DNA, 25 bp, Homo sapien
ttgctgtttcaatagggcttcatca

SEQ ID NO: 260750 - DNA, 25 bp, Homo sapien
ttctttattagaattgacctgcatc

SEQ ID NO: 260751 - DNA, 25 bp, Homo sapien
aattgacctgcatcaatccagtgcc

SEQ ID NO: 260752 - DNA, 25 bp, Homo sapien
aagagcttggcacagaagacagccg

SEQ ID NO: 260753 - DNA, 25 bp, Homo sapien
ggcacagaagacagccgggacaccc

SEQ ID NO: 260754 - DNA, 25 bp, Homo sapien
ggaggccgccacaagcctgtacgac

SEQ ID NO: 260755 - DNA, 25 bp, Homo sapien
caagcctgtacgaccgagtggatga

SEQ ID NO: 260756 - DNA, 25 bp, Homo sapien
gctggtcctcacctcgaacaatcgt

SEQ ID NO: 260757 - DNA, 25 bp, Homo sapien
ctcgaacaatcgtctccagcagctg

SEQ ID NO: 260758 - DNA, 25 bp, Homo sapien
agctggcgtcactcctggaagggaa

SEQ ID NO: 260759 - DNA, 25 bp, Homo sapien
tcctggaagacccactgcttgtgtc

SEQ ID NO: 260760 - DNA, 25 bp, Homo sapien
aagacccactgcttgtgtctctcag

SEQ ID NO: 260761 - DNA, 25 bp, Homo sapien
ccactgcttgtgtctctcaggctgg

SEQ ID NO: 260762 - DNA, 25 bp, Homo sapien
gggcaccgtcctggcgcggctgagg

SEQ ID NO: 260763 - DNA, 25 bp, Homo sapien
gagttgtctaagatcaggactgttt

SEQ ID NO: 260764 - DNA, 25 bp, Homo sapien
ggactgttttgatatctgaccttgt

SEQ ID NO: 260765 - DNA, 25 bp, Homo sapien
ctgaccttgttatatgcggagagta

SEQ ID NO: 260766 - DNA, 25 bp, Homo sapien
gctaagagtaatgcatcatgtattg

SEQ ID NO: 260767 - DNA, 25 bp, Homo sapien
actgaagcaatgtttgtgttgacta

SEQ ID NO: 260768 - DNA, 25 bp, Homo sapien
agatgacttgtgtagcacctcttta

SEQ ID NO: 260769 - DNA, 25 bp, Homo sapien
gtagcacctctttataagcacacag

SEQ ID NO: 260770 - DNA, 25 bp, Homo sapien
agcacacagctcatcttaatatttt

SEQ ID NO: 260771 - DNA, 25 bp, Homo sapien
actttgctccctgtgcatagtttag

SEQ ID NO: 260772 - DNA, 25 bp, Homo sapien
gctccctgtgcatagtttaggaact

SEQ ID NO: 260773 - DNA, 25 bp, Homo sapien
ggaactgtagtcctaggaggaaaca

SEQ ID NO: 260774 - DNA, 25 bp, Homo sapien
gaactgtatccatttagtcatagcc

SEQ ID NO: 260775 - DNA, 25 bp, Homo sapien
gtatccatttagtcatagcctttgt

SEQ ID NO: 260776 - DNA, 25 bp, Homo sapien
catagcctttgttactgtctttctg

SEQ ID NO: 260777 - DNA, 25 bp, Homo sapien
tttctgagccacttctctgctgaaa

SEQ ID NO: 260778 - DNA, 25 bp, Homo sapien
ctctgctgaaacaatctcccaaatc

SEQ ID NO: 260779 - DNA, 25 bp, Homo sapien
gaaacaatctcccaaatccataggg

SEQ ID NO: 260780 - DNA, 25 bp, Homo sapien
tccatagggatttggtcttttaaat

SEQ ID NO: 260781 - DNA, 25 bp, Homo sapien
agtaaatgcttcaatcatctttttt

SEQ ID NO: 260782 - DNA, 25 bp, Homo sapien
ttttttccaatatattcaacagtgc

SEQ ID NO: 260783 - DNA, 25 bp, Homo sapien
atcttgttttgttgtgagctattaa

SEQ ID NO: 260784 - DNA, 25 bp, Homo sapien
gagctattaaaacacctgaacaagt

SEQ ID NO: 260785 - DNA, 25 bp, Homo sapien
gactttccttttctcagagttatag

SEQ ID NO: 260786 - DNA, 25 bp, Homo sapien
agttctccagagatgtcaccagatg

SEQ ID NO: 260787 - DNA, 25 bp, Homo sapien
gtacatttccagttgacttttttat

SEQ ID NO: 260788 - DNA, 25 bp, Homo sapien
atggttggaaatactctgatgctca

SEQ ID NO: 260789 - DNA, 25 bp, Homo sapien
tgatgctcaactccctaatctatag

SEQ ID NO: 260790 - DNA, 25 bp, Homo sapien
aaggtctatactcttttgcaagcat

SEQ ID NO: 260791 - DNA, 25 bp, Homo sapien
gcaagcattgttctagtggcagtga

SEQ ID NO: 260792 - DNA, 25 bp, Homo sapien
gttctagtggcagtgaccctgttca

SEQ ID NO: 260793 - DNA, 25 bp, Homo sapien
gcttcagcccattttttctgattct

SEQ ID NO: 260794 - DNA, 25 bp, Homo sapien
ttctgattctcttgcttgcaaatta

SEQ ID NO: 260795 - DNA, 25 bp, Homo sapien
taagagtattctccaaatcacttga

SEQ ID NO: 260796 - DNA, 25 bp, Homo sapien
tgcacatcatcatcaacggcgagga

SEQ ID NO: 260797 - DNA, 25 bp, Homo sapien
atcaacggcgaggacatgggcccga

SEQ ID NO: 260798 - DNA, 25 bp, Homo sapien
ccctctacgcggtggtggacgtgtt

SEQ ID NO: 260799 - DNA, 25 bp, Homo sapien
ttgcttccacaaagagcgtgcgcct

SEQ ID NO: 260800 - DNA, 25 bp, Homo sapien
tgcgccttgtccagctcgagtatgg

SEQ ID NO: 260801 - DNA, 25 bp, Homo sapien
tatgagctgaacgtgctgcctccga

SEQ ID NO: 260802 - DNA, 25 bp, Homo sapien
tgcagactctgtgccgcctagtgat

SEQ ID NO: 260803 - DNA, 25 bp, Homo sapien
ctctgtgccgcctagtgatacaaag

SEQ ID NO: 260804 - DNA, 25 bp, Homo sapien
atacaaaggagcatggtgcaccggc

SEQ ID NO: 260805 - DNA, 25 bp, Homo sapien
gccgtagccgcctgggtgtcctctt

SEQ ID NO: 260806 - DNA, 25 bp, Homo sapien
atggcacggccgacatgcacatcat

SEQ ID NO: 260807 - DNA, 25 bp, Homo sapien
gcagtggcaggcatttctcttgctt

SEQ ID NO: 260808 - DNA, 25 bp, Homo sapien
tatgattgacctgggctggccatgt

SEQ ID NO: 260809 - DNA, 25 bp, Homo sapien
catgtccccgtcaatgcagctggtt

SEQ ID NO: 260810 - DNA, 25 bp, Homo sapien
aatgcagctggttctcaaaggcccc

SEQ ID NO: 260811 - DNA, 25 bp, Homo sapien
gcgcttgtcccgtggcacttagagg

SEQ ID NO: 260812 - DNA, 25 bp, Homo sapien
ccgtggcacttagagggagacctgc

SEQ ID NO: 260813 - DNA, 25 bp, Homo sapien
ctgctcctcctgagaatccaggaag

SEQ ID NO: 260814 - DNA, 25 bp, Homo sapien
agagacgacgttgctttctgatctt

SEQ ID NO: 260815 - DNA, 25 bp, Homo sapien
taacatttcagcttgagggtgacca

SEQ ID NO: 260816 - DNA, 25 bp, Homo sapien
tggccctagacctgggaatggactc

SEQ ID NO: 260817 - DNA, 25 bp, Homo sapien
aatggactcccaggcgcagtggcag

SEQ ID NO: 260818 - DNA, 25 bp, Homo sapien
tgacttaaacctgtgttccaagccc

SEQ ID NO: 260819 - DNA, 25 bp, Homo sapien
ttaaacctgtgttccaagccctgat

SEQ ID NO: 260820 - DNA, 25 bp, Homo sapien
aagccctgatccttgaccttggagt

SEQ ID NO: 260821 - DNA, 25 bp, Homo sapien
cctgatccttgaccttggagtggag

SEQ ID NO: 260822 - DNA, 25 bp, Homo sapien
ccttgaccttggagtggaggcagca

SEQ ID NO: 260823 - DNA, 25 bp, Homo sapien
aagaatctcaggagccagcttcctc

SEQ ID NO: 260824 - DNA, 25 bp, Homo sapien
ttcctttccatctcatgctgtgtaa

SEQ ID NO: 260825 - DNA, 25 bp, Homo sapien
tctcatgctgtgtaaagctgctgtg

SEQ ID NO: 260826 - DNA, 25 bp, Homo sapien
agctgctgtgtaatttaacttgtaa

SEQ ID NO: 260827 - DNA, 25 bp, Homo sapien
actcacctccaacgcctgtgaagaa

SEQ ID NO: 260828 - DNA, 25 bp, Homo sapien
aacgcctgtgaagaagctgctagtg

SEQ ID NO: 260829 - DNA, 25 bp, Homo sapien
tgcgttgcagcaagaaggagagtta

SEQ ID NO: 260830 - DNA, 25 bp, Homo sapien
ggagagttagacgtagagaaacacc

SEQ ID NO: 260831 - DNA, 25 bp, Homo sapien
ggattggccactgggccaggatcca

SEQ ID NO: 260832 - DNA, 25 bp, Homo sapien
ggccaggatccaggaatcctctctc

SEQ ID NO: 260833 - DNA, 25 bp, Homo sapien
tctctcctggtctgacccagttcag

SEQ ID NO: 260834 - DNA, 25 bp, Homo sapien
tggtctgacccagttcaggaatgca

SEQ ID NO: 260835 - DNA, 25 bp, Homo sapien
gacccagttcaggaatgcagaggcc

SEQ ID NO: 260836 - DNA, 25 bp, Homo sapien
cagttcaggaatgcagaggccgccc

SEQ ID NO: 260837 - DNA, 25 bp, Homo sapien
gttcaggaatgcagaggccgcccgc

SEQ ID NO: 260838 - DNA, 25 bp, Homo sapien
gccccggcaaatgcgttgcagcaag

SEQ ID NO: 260839 - DNA, 25 bp, Homo sapien
cccggcaaatgcgttgcagcaagaa

SEQ ID NO: 260840 - DNA, 25 bp, Homo sapien
tagccaatcttttttatggtctctc

SEQ ID NO: 260841 - DNA, 25 bp, Homo sapien
tttttatggtctctcaaatccctgg

SEQ ID NO: 260842 - DNA, 25 bp, Homo sapien
tgaaaagcagtccaatctggcaaca

SEQ ID NO: 260843 - DNA, 25 bp, Homo sapien
gcaacatcccagtgaaagagcccct

SEQ ID NO: 260844 - DNA, 25 bp, Homo sapien
gaaagagcccctccacaataagaag

SEQ ID NO: 260845 - DNA, 25 bp, Homo sapien
gaaggccatgcagatgacatgaaac

SEQ ID NO: 260846 - DNA, 25 bp, Homo sapien
acagaggctagattaccaggaaaat

SEQ ID NO: 260847 - DNA, 25 bp, Homo sapien
tgcctgtttctcatcctgcaggaat

SEQ ID NO: 260848 - DNA, 25 bp, Homo sapien
tcacgcaggcctctgatagaagtgg

SEQ ID NO: 260849 - DNA, 25 bp, Homo sapien
taaaactatcaaagcgtcccactca

SEQ ID NO: 260850 - DNA, 25 bp, Homo sapien
aaagcgtcccactcattaaaacatg

SEQ ID NO: 260851 - DNA, 25 bp, Homo sapien
gagaaacaaaagtcactttatgttc

SEQ ID NO: 260852 - DNA, 25 bp, Homo sapien
gaaacaaaagtcactttatgttctt

SEQ ID NO: 260853 - DNA, 25 bp, Homo sapien
aacaaaagtcactttatgttcttag

SEQ ID NO: 260854 - DNA, 25 bp, Homo sapien
acaaaagtcactttatgttcttagt

SEQ ID NO: 260855 - DNA, 25 bp, Homo sapien
gtcactttatgttcttagtaaatat

SEQ ID NO: 260856 - DNA, 25 bp, Homo sapien
ctttatgttcttagtaaatatttct

SEQ ID NO: 260857 - DNA, 25 bp, Homo sapien
gggttataggagatctaagtacaaa

SEQ ID NO: 260858 - DNA, 25 bp, Homo sapien
ggttataggagatctaagtacaaaa

SEQ ID NO: 260859 - DNA, 25 bp, Homo sapien
gttataggagatctaagtacaaaaa

SEQ ID NO: 260860 - DNA, 25 bp, Homo sapien
tgttattaatctcccctccttaagg

SEQ ID NO: 260861 - DNA, 25 bp, Homo sapien
agaacaacttaagttgagtacagtg

SEQ ID NO: 260862 - DNA, 25 bp, Homo sapien
ctgaatgcattcttactcttagggt

SEQ ID NO: 260863 - DNA, 25 bp, Homo sapien
tactcttagggttcatacctctaat

SEQ ID NO: 260864 - DNA, 25 bp, Homo sapien
tacctctaattcatgtggttaagac

SEQ ID NO: 260865 - DNA, 25 bp, Homo sapien
ttgtggtgaagtaatagggcccctt

SEQ ID NO: 260866 - DNA, 25 bp, Homo sapien
agggccccttgaaagaatctacaga

SEQ ID NO: 260867 - DNA, 25 bp, Homo sapien
tatactgagttgtgctgtactggtt

SEQ ID NO: 260868 - DNA, 25 bp, Homo sapien
gctgtactggtttgtgagaacatca

SEQ ID NO: 260869 - DNA, 25 bp, Homo sapien
atggttctagtactagggccattat

SEQ ID NO: 260870 - DNA, 25 bp, Homo sapien
agggccattattaactagtaacata

SEQ ID NO: 260871 - DNA, 25 bp, Homo sapien
attagtgacttcaactgggtgtcct

SEQ ID NO: 260872 - DNA, 25 bp, Homo sapien
tcaactgggtgtccttattatctga

SEQ ID NO: 260873 - DNA, 25 bp, Homo sapien
gggcctggcaggttccggaagagac

SEQ ID NO: 260874 - DNA, 25 bp, Homo sapien
gagacagggccagcgggagtcattt

SEQ ID NO: 260875 - DNA, 25 bp, Homo sapien
gggagtcatttcctgcagccactag

SEQ ID NO: 260876 - DNA, 25 bp, Homo sapien
gagtcatttcctgcagccactaggg

SEQ ID NO: 260877 - DNA, 25 bp, Homo sapien
ggcacgggcaggtgcgccttgggag

SEQ ID NO: 260878 - DNA, 25 bp, Homo sapien
gcaggtgcgccttgggagggctgag

SEQ ID NO: 260879 - DNA, 25 bp, Homo sapien
cccttccgagggtccgcaggtgaga

SEQ ID NO: 260880 - DNA, 25 bp, Homo sapien
tgcagagtcagggctgcacccaaga

SEQ ID NO: 260881 - DNA, 25 bp, Homo sapien
ggctgcacccaagaggagccacgga

SEQ ID NO: 260882 - DNA, 25 bp, Homo sapien
gcacccaagaggagccacggagccg

SEQ ID NO: 260883 - DNA, 25 bp, Homo sapien
agaggagccacggagccggagccgg

SEQ ID NO: 260884 - DNA, 25 bp, Homo sapien
atcggccatgccatcctgagatgaa

SEQ ID NO: 260885 - DNA, 25 bp, Homo sapien
cggccatgccatcctgagatgaatg

SEQ ID NO: 260886 - DNA, 25 bp, Homo sapien
ttggccatgctgtcttgagatgaat

SEQ ID NO: 260887 - DNA, 25 bp, Homo sapien
tgagacgaatgaacacctgggccat

SEQ ID NO: 260888 - DNA, 25 bp, Homo sapien
tcagccatgctctcctgagagggat

SEQ ID NO: 260889 - DNA, 25 bp, Homo sapien
gccatgctctcctgagagggatgaa

SEQ ID NO: 260890 - DNA, 25 bp, Homo sapien
agagggatgaacacctgggccttgc

SEQ ID NO: 260891 - DNA, 25 bp, Homo sapien
gggatgaacacctgggccttgccgt

SEQ ID NO: 260892 - DNA, 25 bp, Homo sapien
tgggccttgccgtcctgagatgaat

SEQ ID NO: 260893 - DNA, 25 bp, Homo sapien
tgaccatgctgtcctgagatgattg

SEQ ID NO: 260894 - DNA, 25 bp, Homo sapien
catgctgtcctgagatgattgtcct

SEQ ID NO: 260895 - DNA, 25 bp, Homo sapien
gaatattctactgaattgcaattta

SEQ ID NO: 260896 - DNA, 25 bp, Homo sapien
taaatattcttatcctcttaaataa

SEQ ID NO: 260897 - DNA, 25 bp, Homo sapien
aatcatcttgcagctatgcaattta

SEQ ID NO: 260898 - DNA, 25 bp, Homo sapien
gattaccaatttcaagtgctgccag

SEQ ID NO: 260899 - DNA, 25 bp, Homo sapien
accaatttcaagtgctgccagctaa

SEQ ID NO: 260900 - DNA, 25 bp, Homo sapien
gtgctgccagctaaaataactgttt

SEQ ID NO: 260901 - DNA, 25 bp, Homo sapien
ttattgtgctttgcatctccaggca

SEQ ID NO: 260902 - DNA, 25 bp, Homo sapien
attgtgctttgcatctccaggcagt

SEQ ID NO: 260903 - DNA, 25 bp, Homo sapien
gtgctttgcatctccaggcagttct

SEQ ID NO: 260904 - DNA, 25 bp, Homo sapien
gggtaaaatgtttagcaggctgtaa

SEQ ID NO: 260905 - DNA, 25 bp, Homo sapien
tttagcaggctgtaaacttaagaaa

SEQ ID NO: 260906 - DNA, 25 bp, Homo sapien
aattgacaaatgctgtaagcctttt

SEQ ID NO: 260907 - DNA, 25 bp, Homo sapien
gctgtaagccttttacagttatctg

SEQ ID NO: 260908 - DNA, 25 bp, Homo sapien
ttacagttatctgaacacacagaat

SEQ ID NO: 260909 - DNA, 25 bp, Homo sapien
gtctcttatgtgttcagaaccattt

SEQ ID NO: 260910 - DNA, 25 bp, Homo sapien
gttcagaaccatttcttccaatcac

SEQ ID NO: 260911 - DNA, 25 bp, Homo sapien
gaaccatttcttccaatcacctttt

SEQ ID NO: 260912 - DNA, 25 bp, Homo sapien
ttttttgtcttctggctataattta

SEQ ID NO: 260913 - DNA, 25 bp, Homo sapien
gtcttctggctataatttatcatta

SEQ ID NO: 260914 - DNA, 25 bp, Homo sapien
ggagcatgcatatttcatagttgag

SEQ ID NO: 260915 - DNA, 25 bp, Homo sapien
gagattcaataattcaggacaacag

SEQ ID NO: 260916 - DNA, 25 bp, Homo sapien
tacccaacaaaatattaagcctcat

SEQ ID NO: 260917 - DNA, 25 bp, Homo sapien
ttcctgctcatcgaggacctgactg

SEQ ID NO: 260918 - DNA, 25 bp, Homo sapien
tgctcatcgaggacctgactggctc

SEQ ID NO: 260919 - DNA, 25 bp, Homo sapien
tcatcgaggacctgactggctcctg

SEQ ID NO: 260920 - DNA, 25 bp, Homo sapien
gactggctcctgcttcgagccactg

SEQ ID NO: 260921 - DNA, 25 bp, Homo sapien
cccagggtctgctgctccacgagct

SEQ ID NO: 260922 - DNA, 25 bp, Homo sapien
cagccggccaccagtggcgaggcta

SEQ ID NO: 260923 - DNA, 25 bp, Homo sapien
cagtggcgaggctacaccgtctcct

SEQ ID NO: 260924 - DNA, 25 bp, Homo sapien
gctcaccttttgctgcctgctcatg

SEQ ID NO: 260925 - DNA, 25 bp, Homo sapien
aggaagcagctgtgttcgccaagta

SEQ ID NO: 260926 - DNA, 25 bp, Homo sapien
aagcagctgtgttcgccaagtacct

SEQ ID NO: 260927 - DNA, 25 bp, Homo sapien
agctgtgttcgccaagtacctggcc

SEQ ID NO: 260928 - DNA, 25 bp, Homo sapien
acatcctggtggaggcgagccgcgg

SEQ ID NO: 260929 - DNA, 25 bp, Homo sapien
gaggtggtactcacctcgcggccac

SEQ ID NO: 260930 - DNA, 25 bp, Homo sapien
gccgttctgcgtgcccaggagtctg

SEQ ID NO: 260931 - DNA, 25 bp, Homo sapien
caggagtctgaccccggacacgctg

SEQ ID NO: 260932 - DNA, 25 bp, Homo sapien
aagcagaggtactccacccggtggt

SEQ ID NO: 260933 - DNA, 25 bp, Homo sapien
agaggtactccacccggtggtgcca

SEQ ID NO: 260934 - DNA, 25 bp, Homo sapien
ggtggtgccacttcctaccgacctt

SEQ ID NO: 260935 - DNA, 25 bp, Homo sapien
taccgaccttccgtaaatgcccgcg

SEQ ID NO: 260936 - DNA, 25 bp, Homo sapien
cagcctctccgacatgccgctaggg

SEQ ID NO: 260937 - DNA, 25 bp, Homo sapien
ggcgctgctggagaacatgatccag

SEQ ID NO: 260938 - DNA, 25 bp, Homo sapien
cagaacatcctggtggaggcgagcc

SEQ ID NO: 260939 - DNA, 25 bp, Homo sapien
aagcaagtgtgaggtcgtcgcctct

SEQ ID NO: 260940 - DNA, 25 bp, Homo sapien
ggtcgtcgcctctggaagtgctagc

SEQ ID NO: 260941 - DNA, 25 bp, Homo sapien
aagtgctagcggagggtgatctccc

SEQ ID NO: 260942 - DNA, 25 bp, Homo sapien
gttctactagaaggccgatgactcc

SEQ ID NO: 260943 - DNA, 25 bp, Homo sapien
gatgactcctgggtaaagtgccaat

SEQ ID NO: 260944 - DNA, 25 bp, Homo sapien
gtaaagtgccaatgctcacctccat

SEQ ID NO: 260945 - DNA, 25 bp, Homo sapien
tcagtccctcgtggaatttccagga

SEQ ID NO: 260946 - DNA, 25 bp, Homo sapien
atttccaggagcacaagggcaatct

SEQ ID NO: 260947 - DNA, 25 bp, Homo sapien
aagggcaatctcgacagctccacgt

SEQ ID NO: 260948 - DNA, 25 bp, Homo sapien
caagcctggcccatgatcagataaa

SEQ ID NO: 260949 - DNA, 25 bp, Homo sapien
ggtggcatggacatttgcacacgtc

SEQ ID NO: 260950 - DNA, 25 bp, Homo sapien
aattattcatagtgcgttttttgta

SEQ ID NO: 260951 - DNA, 25 bp, Homo sapien
attcatagtgcgttttttgtaattt

SEQ ID NO: 260952 - DNA, 25 bp, Homo sapien
ttatgattgttaagtaagcttgact

SEQ ID NO: 260953 - DNA, 25 bp, Homo sapien
gtaagcttgacttataaattgacat

SEQ ID NO: 260954 - DNA, 25 bp, Homo sapien
gacattgtaattgtgtacataattg

SEQ ID NO: 260955 - DNA, 25 bp, Homo sapien
aaaacttacacatggaaagaactgt

SEQ ID NO: 260956 - DNA, 25 bp, Homo sapien
acacatggaaagaactgtatgcagt

SEQ ID NO: 260957 - DNA, 25 bp, Homo sapien
actgtatgcagttgactttactatg

SEQ ID NO: 260958 - DNA, 25 bp, Homo sapien
gtatgcagttgactttactatgtaa

SEQ ID NO: 260959 - DNA, 25 bp, Homo sapien
atgcagttgactttactatgtaaat

SEQ ID NO: 260960 - DNA, 25 bp, Homo sapien
atattcataccatttattaaatcag

SEQ ID NO: 260961 - DNA, 25 bp, Homo sapien
gaagtcttaatatcctgctcaggtc

SEQ ID NO: 260962 - DNA, 25 bp, Homo sapien
taatatcctgctcaggtcatgccca

SEQ ID NO: 260963 - DNA, 25 bp, Homo sapien
caggtcatgcccaaggtctgatttt

SEQ ID NO: 260964 - DNA, 25 bp, Homo sapien
gtcatgcccaaggtctgattttcac

SEQ ID NO: 260965 - DNA, 25 bp, Homo sapien
ggtctgattttcacaatcaacaaat

SEQ ID NO: 260966 - DNA, 25 bp, Homo sapien
taagaaacctgcacatcgtacacat

SEQ ID NO: 260967 - DNA, 25 bp, Homo sapien
agtaaagcatgtgggctaaccattt

SEQ ID NO: 260968 - DNA, 25 bp, Homo sapien
ggctaaccatttatgctagtgtcca

SEQ ID NO: 260969 - DNA, 25 bp, Homo sapien
atttatgctagtgtccatttttgga

SEQ ID NO: 260970 - DNA, 25 bp, Homo sapien
gtgtccatttttggaatgttagcat

SEQ ID NO: 260971 - DNA, 25 bp, Homo sapien
ggaatgttagcatgtgaagtcttaa

SEQ ID NO: 260972 - DNA, 25 bp, Homo sapien
aaaatgaagcaccatctcgtgggcc

SEQ ID NO: 260973 - DNA, 25 bp, Homo sapien
gcaccatctcgtgggccacatgaaa

SEQ ID NO: 260974 - DNA, 25 bp, Homo sapien
cacaggcataaagccgtatgagtgt

SEQ ID NO: 260975 - DNA, 25 bp, Homo sapien
agggacagtttccaccggcatgtga

SEQ ID NO: 260976 - DNA, 25 bp, Homo sapien
accggcatgtgacttcttgtactaa

SEQ ID NO: 260977 - DNA, 25 bp, Homo sapien
gtactaagtcctacgaagctgcaaa

SEQ ID NO: 260978 - DNA, 25 bp, Homo sapien
ggctgagcagaatacaactgaggct

SEQ ID NO: 260979 - DNA, 25 bp, Homo sapien
aaaaataggatctggcccttgagtg

SEQ ID NO: 260980 - DNA, 25 bp, Homo sapien
tggcccttgagtggcatgcacaaaa

SEQ ID NO: 260981 - DNA, 25 bp, Homo sapien
atctgggcacagatgatgcgtgcta

SEQ ID NO: 260982 - DNA, 25 bp, Homo sapien
atgcgtgctacttgctattatgaga

SEQ ID NO: 260983 - DNA, 25 bp, Homo sapien
aattcatttattagttctggaccaa

SEQ ID NO: 260984 - DNA, 25 bp, Homo sapien
gttctggaccaatgttatttataag

SEQ ID NO: 260985 - DNA, 25 bp, Homo sapien
gaatatgtttgtttctaatttccaa

SEQ ID NO: 260986 - DNA, 25 bp, Homo sapien
ttgtttctaatttccaaagcttgac

SEQ ID NO: 260987 - DNA, 25 bp, Homo sapien
ttccaaagcttgacagtttcttatg

SEQ ID NO: 260988 - DNA, 25 bp, Homo sapien
gcttgacagtttcttatgtttcatt

SEQ ID NO: 260989 - DNA, 25 bp, Homo sapien
ttctcttccttacatccaggaaatt

SEQ ID NO: 260990 - DNA, 25 bp, Homo sapien
ccttacatccaggaaatttgctgtt

SEQ ID NO: 260991 - DNA, 25 bp, Homo sapien
tacatccaggaaatttgctgtttat

SEQ ID NO: 260992 - DNA, 25 bp, Homo sapien
cctatttaagggagagagagctctt

SEQ ID NO: 260993 - DNA, 25 bp, Homo sapien
gagagagctcttgtaaaaattcatt

SEQ ID NO: 260994 - DNA, 25 bp, Homo sapien
gagaaagtatcaacaaactgagtaa

SEQ ID NO: 260995 - DNA, 25 bp, Homo sapien
aactattcttgaggggcactgaaaa

SEQ ID NO: 260996 - DNA, 25 bp, Homo sapien
gaggggcactgaaaagatgttcttt

SEQ ID NO: 260997 - DNA, 25 bp, Homo sapien
tacttgcaaaagaatatactgtgtt

SEQ ID NO: 260998 - DNA, 25 bp, Homo sapien
gaatatactgtgttttgagtatgaa

SEQ ID NO: 260999 - DNA, 25 bp, Homo sapien
agtatgaaagtgtgattgggtctgt

SEQ ID NO: 261000 - DNA, 25 bp, Homo sapien
gattgggtctgttgtgggaaccact

SEQ ID NO: 261001 - DNA, 25 bp, Homo sapien
gtctgttgtgggaaccactgactga

SEQ ID NO: 261002 - DNA, 25 bp, Homo sapien
gccatattcctagtttcacagaaat

SEQ ID NO: 261003 - DNA, 25 bp, Homo sapien
caggatttgcctgtaagcattcaaa

SEQ ID NO: 261004 - DNA, 25 bp, Homo sapien
gcctgtaagcattcaaattgttttg

SEQ ID NO: 261005 - DNA, 25 bp, Homo sapien
ccagcggcaagaggccagtacaggc

SEQ ID NO: 261006 - DNA, 25 bp, Homo sapien
ccagtacaggccagtccccagagga

SEQ ID NO: 261007 - DNA, 25 bp, Homo sapien
agaggaccatgcctccttggcacca

SEQ ID NO: 261008 - DNA, 25 bp, Homo sapien
agccctgaccactccagtttagagg

SEQ ID NO: 261009 - DNA, 25 bp, Homo sapien
gaccactccagtttagaggctaagg

SEQ ID NO: 261010 - DNA, 25 bp, Homo sapien
gtttagaggctaaggatggagaatc

SEQ ID NO: 261011 - DNA, 25 bp, Homo sapien
gaatccggtgggtctagagtgttca

SEQ ID NO: 261012 - DNA, 25 bp, Homo sapien
ccggtgggtctagagtgttcagcat

SEQ ID NO: 261013 - DNA, 25 bp, Homo sapien
gtctagagtgttcagcatatgccga

SEQ ID NO: 261014 - DNA, 25 bp, Homo sapien
ctagagtgttcagcatatgccgagg

SEQ ID NO: 261015 - DNA, 25 bp, Homo sapien
ggaggaaacaggctccagagcccct

SEQ ID NO: 261016 - DNA, 25 bp, Homo sapien
ttttggtctctagtttgaaggtact

SEQ ID NO: 261017 - DNA, 25 bp, Homo sapien
gaaggtactacatactgccgataaa

SEQ ID NO: 261018 - DNA, 25 bp, Homo sapien
actttgctgaattttgtgggtaatt

SEQ ID NO: 261019 - DNA, 25 bp, Homo sapien
aacagtattggtttcatagtaggac

SEQ ID NO: 261020 - DNA, 25 bp, Homo sapien
gtttcatagtaggactcaaccagaa

SEQ ID NO: 261021 - DNA, 25 bp, Homo sapien
gactcaaccagaattggtcctacat

SEQ ID NO: 261022 - DNA, 25 bp, Homo sapien
gaattggtcctacatatatgtgagt

SEQ ID NO: 261023 - DNA, 25 bp, Homo sapien
gagtgttcagtttttgcaaataagg

SEQ ID NO: 261024 - DNA, 25 bp, Homo sapien
ggtggatatatcctgccttatttag

SEQ ID NO: 261025 - DNA, 25 bp, Homo sapien
gccttatttaggattatagctggat

SEQ ID NO: 261026 - DNA, 25 bp, Homo sapien
agaaaattgccttttcattgtaagt

SEQ ID NO: 261027 - DNA, 25 bp, Homo sapien
gagaatgaggcaaatgttcccaatg

SEQ ID NO: 261028 - DNA, 25 bp, Homo sapien
aatgttcccaatgccagttaattcc

SEQ ID NO: 261029 - DNA, 25 bp, Homo sapien
ccagttaattcctgaggtggcatta

SEQ ID NO: 261030 - DNA, 25 bp, Homo sapien
gaggtggcattatttcttaactgat

SEQ ID NO: 261031 - DNA, 25 bp, Homo sapien
aactgatgcattgatcaacactgta

SEQ ID NO: 261032 - DNA, 25 bp, Homo sapien
ttgtgctgtgaaacagtcccaatat

SEQ ID NO: 261033 - DNA, 25 bp, Homo sapien
gtcccaatattattatattcccgca

SEQ ID NO: 261034 - DNA, 25 bp, Homo sapien
aaattgcggtattctgaaggcagca

SEQ ID NO: 261035 - DNA, 25 bp, Homo sapien
caaactgaacaaccacataagcata

SEQ ID NO: 261036 - DNA, 25 bp, Homo sapien
gtatgttttgctcacaagtctctta

SEQ ID NO: 261037 - DNA, 25 bp, Homo sapien
tttgctcacaagtctcttaagtact

SEQ ID NO: 261038 - DNA, 25 bp, Homo sapien
aaatgaggattgctccgaggcctgc

SEQ ID NO: 261039 - DNA, 25 bp, Homo sapien
ttgctccgaggcctgctccagtact

SEQ ID NO: 261040 - DNA, 25 bp, Homo sapien
cagtacttcccagaggctggcctgg

SEQ ID NO: 261041 - DNA, 25 bp, Homo sapien
ggcactcaggtagcttgaatcacca

SEQ ID NO: 261042 - DNA, 25 bp, Homo sapien
gtagcttgaatcaccaggacccttc

SEQ ID NO: 261043 - DNA, 25 bp, Homo sapien
caagccccacaggttctgagggagt

SEQ ID NO: 261044 - DNA, 25 bp, Homo sapien
ctgagggagtactagggccagctct

SEQ ID NO: 261045 - DNA, 25 bp, Homo sapien
cagctctgggagaggtctcttccta

SEQ ID NO: 261046 - DNA, 25 bp, Homo sapien
agaggtctcttcctatgctgtgaac

SEQ ID NO: 261047 - DNA, 25 bp, Homo sapien
tgcctttcttgcagcctacaacgaa

SEQ ID NO: 261048 - DNA, 25 bp, Homo sapien
tgcagcctacaacgaataaattttc

SEQ ID NO: 261049 - DNA, 25 bp, Homo sapien
tacttaccaaaatgacggctgtagt

SEQ ID NO: 261050 - DNA, 25 bp, Homo sapien
tggcatataaaaccttctcaataaa

SEQ ID NO: 261051 - DNA, 25 bp, Homo sapien
agctcttacatttactcctctatta

SEQ ID NO: 261052 - DNA, 25 bp, Homo sapien
ctcctctattagaccataagctgag

SEQ ID NO: 261053 - DNA, 25 bp, Homo sapien
taagctgagtaagaggaaggcccca

SEQ ID NO: 261054 - DNA, 25 bp, Homo sapien
agaggaaggccccagtcgtgtcatt

SEQ ID NO: 261055 - DNA, 25 bp, Homo sapien
gccccagtcgtgtcatttgtgataa

SEQ ID NO: 261056 - DNA, 25 bp, Homo sapien
gataactcatgcatagtaggtactc

SEQ ID NO: 261057 - DNA, 25 bp, Homo sapien
tagtaggtactcacacccacagacg

SEQ ID NO: 261058 - DNA, 25 bp, Homo sapien
ttttttaccatctcggacggctaca

SEQ ID NO: 261059 - DNA, 25 bp, Homo sapien
catctcggacggctacaaaagggta

SEQ ID NO: 261060 - DNA, 25 bp, Homo sapien
tgatcagattcagaggtacttccgc

SEQ ID NO: 261061 - DNA, 25 bp, Homo sapien
gattcagaggtacttccgccagaag

SEQ ID NO: 261062 - DNA, 25 bp, Homo sapien
agactcaaacggccatctcacagca

SEQ ID NO: 261063 - DNA, 25 bp, Homo sapien
tctcacagcaccaggagagctgtag

SEQ ID NO: 261064 - DNA, 25 bp, Homo sapien
ccaggagagctgtagggaccatctt

SEQ ID NO: 261065 - DNA, 25 bp, Homo sapien
cagcagcctagaccctgggagccag

SEQ ID NO: 261066 - DNA, 25 bp, Homo sapien
ctggagaaatccagtaacctggtgt

SEQ ID NO: 261067 - DNA, 25 bp, Homo sapien
gtaacctggtgttgcaagtcagctc

SEQ ID NO: 261068 - DNA, 25 bp, Homo sapien
aaacctccattctgacttctctcag

SEQ ID NO: 261069 - DNA, 25 bp, Homo sapien
ttctgacttctctcaggaagaatct

SEQ ID NO: 261070 - DNA, 25 bp, Homo sapien
ggaagaatctgagtgagcttgatca

SEQ ID NO: 261071 - DNA, 25 bp, Homo sapien
atttgttggtcactttaaagataat

SEQ ID NO: 261072 - DNA, 25 bp, Homo sapien
atataaacagctgaacatggtgcac

SEQ ID NO: 261073 - DNA, 25 bp, Homo sapien
aaacagctgaacatggtgcacaccc

SEQ ID NO: 261074 - DNA, 25 bp, Homo sapien
aacagctgaacatggtgcacacccc

SEQ ID NO: 261075 - DNA, 25 bp, Homo sapien
agctgaacatggtgcacaccccgac

SEQ ID NO: 261076 - DNA, 25 bp, Homo sapien
tgggatggcaagatggatcacttga

SEQ ID NO: 261077 - DNA, 25 bp, Homo sapien
gaggctgtgatgaactatgattgca

SEQ ID NO: 261078 - DNA, 25 bp, Homo sapien
ttcatttcctgttctctagttttcc

SEQ ID NO: 261079 - DNA, 25 bp, Homo sapien
catttcctgttctctagttttccgt

SEQ ID NO: 261080 - DNA, 25 bp, Homo sapien
ttcctgttctctagttttccgtatt

SEQ ID NO: 261081 - DNA, 25 bp, Homo sapien
gttctctagttttccgtattacctg

SEQ ID NO: 261082 - DNA, 25 bp, Homo sapien
tgcatgacctcaagcgggccaagat

SEQ ID NO: 261083 - DNA, 25 bp, Homo sapien
ctcaagcgggccaagatgggtctcg

SEQ ID NO: 261084 - DNA, 25 bp, Homo sapien
gggcatgcctgacaggaaccacctg

SEQ ID NO: 261085 - DNA, 25 bp, Homo sapien
tgacaggaaccacctggcctgtgcc

SEQ ID NO: 261086 - DNA, 25 bp, Homo sapien
gtgtgcccaggcttcaaggcgtacc

SEQ ID NO: 261087 - DNA, 25 bp, Homo sapien
aggcttcaaggcgtacctggacatc

SEQ ID NO: 261088 - DNA, 25 bp, Homo sapien
aaggcgtacctggacatcggccagg

SEQ ID NO: 261089 - DNA, 25 bp, Homo sapien
acatcggccaggtctactactatat

SEQ ID NO: 261090 - DNA, 25 bp, Homo sapien
gccaggtctactactatatgggcgt

SEQ ID NO: 261091 - DNA, 25 bp, Homo sapien
tgttcctggccaaggcgggcgagtc

SEQ ID NO: 261092 - DNA, 25 bp, Homo sapien
tgggtgccacgctgcccgagctgca

SEQ ID NO: 261093 - DNA, 25 bp, Homo sapien
atttgttggtcactttaaagataat

SEQ ID NO: 261094 - DNA, 25 bp, Homo sapien
gttggtcactttaaagataatataa

SEQ ID NO: 261095 - DNA, 25 bp, Homo sapien
atataaacagctgaacatggtgcac

SEQ ID NO: 261096 - DNA, 25 bp, Homo sapien
ataaacagctgaacatggtgcacac

SEQ ID NO: 261097 - DNA, 25 bp, Homo sapien
taaacagctgaacatggtgcacacc

SEQ ID NO: 261098 - DNA, 25 bp, Homo sapien
aaacagctgaacatggtgcacaccc

SEQ ID NO: 261099 - DNA, 25 bp, Homo sapien
aacagctgaacatggtgcacacccc

SEQ ID NO: 261100 - DNA, 25 bp, Homo sapien
agctgaacatggtgcacaccccgac

SEQ ID NO: 261101 - DNA, 25 bp, Homo sapien
tgaacatggtgcacaccccgactcc

SEQ ID NO: 261102 - DNA, 25 bp, Homo sapien
tgggatggcaagatggatcacttga

SEQ ID NO: 261103 - DNA, 25 bp, Homo sapien
gaggctgtgatgaactatgattgca

SEQ ID NO: 261104 - DNA, 25 bp, Homo sapien
tataaggtgtgagacacacctttcc

SEQ ID NO: 261105 - DNA, 25 bp, Homo sapien
gcactgtgcactactcataacggtg

SEQ ID NO: 261106 - DNA, 25 bp, Homo sapien
actgtgcactactcataacggtgat

SEQ ID NO: 261107 - DNA, 25 bp, Homo sapien
gtgcactactcataacggtgataac

SEQ ID NO: 261108 - DNA, 25 bp, Homo sapien
taacggtgataacctcaagaccatc

SEQ ID NO: 261109 - DNA, 25 bp, Homo sapien
gtgataacctcaagaccatcaggag

SEQ ID NO: 261110 - DNA, 25 bp, Homo sapien
acatgctttgtctcaggcgttgacg

SEQ ID NO: 261111 - DNA, 25 bp, Homo sapien
tgctttgtctcaggcgttgacgtat

SEQ ID NO: 261112 - DNA, 25 bp, Homo sapien
tttgtctcaggcgttgacgtatgta

SEQ ID NO: 261113 - DNA, 25 bp, Homo sapien
gtctcaggcgttgacgtatgtatgc

SEQ ID NO: 261114 - DNA, 25 bp, Homo sapien
caggcgttgacgtatgtatgcattt

SEQ ID NO: 261115 - DNA, 25 bp, Homo sapien
tcagataagggccagtgtgtgtccc

SEQ ID NO: 261116 - DNA, 25 bp, Homo sapien
ggccagtgtgtgtccctgaaggtca

SEQ ID NO: 261117 - DNA, 25 bp, Homo sapien
catgctgcgaaaattcagcctgcaa

SEQ ID NO: 261118 - DNA, 25 bp, Homo sapien
aaattcagcctgcaaaggctcctct

SEQ ID NO: 261119 - DNA, 25 bp, Homo sapien
acttgatcaggcccagaccaggtgg

SEQ ID NO: 261120 - DNA, 25 bp, Homo sapien
ccaggccttggaacataagctctgc

SEQ ID NO: 261121 - DNA, 25 bp, Homo sapien
ttggaacataagctctgcccctgca

SEQ ID NO: 261122 - DNA, 25 bp, Homo sapien
tcatgtcaccacacctgggatggag

SEQ ID NO: 261123 - DNA, 25 bp, Homo sapien
atggagacatcaggtggcccagcga

SEQ ID NO: 261124 - DNA, 25 bp, Homo sapien
cagcgagagatggaggactgatcct

SEQ ID NO: 261125 - DNA, 25 bp, Homo sapien
ctgatcctggaacgtgaagcagctt

SEQ ID NO: 261126 - DNA, 25 bp, Homo sapien
acatgaaatgaaacccagcatagga

SEQ ID NO: 261127 - DNA, 25 bp, Homo sapien
tgaaatgaaacccagcataggagct

SEQ ID NO: 261128 - DNA, 25 bp, Homo sapien
gagctggccaagagcttttaatttt

SEQ ID NO: 261129 - DNA, 25 bp, Homo sapien
ttattgatactcaaaaccaagtttg

SEQ ID NO: 261130 - DNA, 25 bp, Homo sapien
taaagtgttatggtagggttcttca

SEQ ID NO: 261131 - DNA, 25 bp, Homo sapien
aacagggtaagatgtgaggctgagt

SEQ ID NO: 261132 - DNA, 25 bp, Homo sapien
agtgttatggtagggttcttcagat

SEQ ID NO: 261133 - DNA, 25 bp, Homo sapien
gttatggtagggttcttcagatgta

SEQ ID NO: 261134 - DNA, 25 bp, Homo sapien
atggtagggttcttcagatgtaata

SEQ ID NO: 261135 - DNA, 25 bp, Homo sapien
gtagggttcttcagatgtaatattt

SEQ ID NO: 261136 - DNA, 25 bp, Homo sapien
gtaatattttactggtactatttat

SEQ ID NO: 261137 - DNA, 25 bp, Homo sapien
aataccacctagagactctgctact

SEQ ID NO: 261138 - DNA, 25 bp, Homo sapien
gagactctgctacttttcaaagaca

SEQ ID NO: 261139 - DNA, 25 bp, Homo sapien
aaagacatccacaaatagcagcatt

SEQ ID NO: 261140 - DNA, 25 bp, Homo sapien
gcagcattagtcaaacattaggcaa

SEQ ID NO: 261141 - DNA, 25 bp, Homo sapien
tgcaatctagcaatatggccaaaga

SEQ ID NO: 261142 - DNA, 25 bp, Homo sapien
aaagacaacctaccaaaccaagcag

SEQ ID NO: 261143 - DNA, 25 bp, Homo sapien
gggattaccccagaaacgcaaggct

SEQ ID NO: 261144 - DNA, 25 bp, Homo sapien
gaaacgcaaggctggttaaacacaa

SEQ ID NO: 261145 - DNA, 25 bp, Homo sapien
caagaaatacaaggctccagattag

SEQ ID NO: 261146 - DNA, 25 bp, Homo sapien
gtaactgtccacagaccacgtgatt

SEQ ID NO: 261147 - DNA, 25 bp, Homo sapien
acagaccacgtgattgtgacatata

SEQ ID NO: 261148 - DNA, 25 bp, Homo sapien
tttaccttctctcttgagcaacgtc

SEQ ID NO: 261149 - DNA, 25 bp, Homo sapien
ttctctcttgagcaacgtcagtaat

SEQ ID NO: 261150 - DNA, 25 bp, Homo sapien
gtcagtaattgatcttgcatctcag

SEQ ID NO: 261151 - DNA, 25 bp, Homo sapien
attgatcttgcatctcagagagaga

SEQ ID NO: 261152 - DNA, 25 bp, Homo sapien
catgtgtgagagagaaactggtttc

SEQ ID NO: 261153 - DNA, 25 bp, Homo sapien
agcactcctgaaaccccttactgta

SEQ ID NO: 261154 - DNA, 25 bp, Homo sapien
tcctgaaaccccttactgtaaggat

SEQ ID NO: 261155 - DNA, 25 bp, Homo sapien
tttctcttaccccttgggatccagg

SEQ ID NO: 261156 - DNA, 25 bp, Homo sapien
aggctctgagtctcttctctttggg

SEQ ID NO: 261157 - DNA, 25 bp, Homo sapien
gagtctcttctctttgggagtatcc

SEQ ID NO: 261158 - DNA, 25 bp, Homo sapien
tcttctctttgggagtatccatcaa

SEQ ID NO: 261159 - DNA, 25 bp, Homo sapien
gggaagtactactcctcaaatgttg

SEQ ID NO: 261160 - DNA, 25 bp, Homo sapien
ctcaaatgttgagggaagcttccat

SEQ ID NO: 261161 - DNA, 25 bp, Homo sapien
gaagcttccataacattgatgactg

SEQ ID NO: 261162 - DNA, 25 bp, Homo sapien
ttcatggcagtaattctcggctgta

SEQ ID NO: 261163 - DNA, 25 bp, Homo sapien
gtaattctcggctgtagttgcataa

SEQ ID NO: 261164 - DNA, 25 bp, Homo sapien
tgtagttgcataagcattgctcaag

SEQ ID NO: 261165 - DNA, 25 bp, Homo sapien
gaggaaaatccaaaagtgcagcagg

SEQ ID NO: 261166 - DNA, 25 bp, Homo sapien
gcagcaggagaactcttttccctga

SEQ ID NO: 261167 - DNA, 25 bp, Homo sapien
atgatagcacctaaacttacattta

SEQ ID NO: 261168 - DNA, 25 bp, Homo sapien
agacagacattccttctacatgtaa

SEQ ID NO: 261169 - DNA, 25 bp, Homo sapien
ctacatgtaatgacacttcttgtgt

SEQ ID NO: 261170 - DNA, 25 bp, Homo sapien
gccaacatcacctcttgccatttag

SEQ ID NO: 261171 - DNA, 25 bp, Homo sapien
gccatttagcccctagtgagaaatt

SEQ ID NO: 261172 - DNA, 25 bp, Homo sapien
aaattgggagctaccaggcaggtgc

SEQ ID NO: 261173 - DNA, 25 bp, Homo sapien
gcaggtgcccagtgcattcagggaa

SEQ ID NO: 261174 - DNA, 25 bp, Homo sapien
cattcagggaagatgggcacaacat

SEQ ID NO: 261175 - DNA, 25 bp, Homo sapien
gatgggtgtgtctggaagctcctct

SEQ ID NO: 261176 - DNA, 25 bp, Homo sapien
aagctcctcttcactgaccagggct

SEQ ID NO: 261177 - DNA, 25 bp, Homo sapien
tgcagggcttctcactatgtagcac

SEQ ID NO: 261178 - DNA, 25 bp, Homo sapien
tcactatgtagcaccagtcaccagc

SEQ ID NO: 261179 - DNA, 25 bp, Homo sapien
aggtcacagaagaagcccctcccag

SEQ ID NO: 261180 - DNA, 25 bp, Homo sapien
tgaagcccagggagacgggctccat

SEQ ID NO: 261181 - DNA, 25 bp, Homo sapien
agacacatccacgtgtctgctggat

SEQ ID NO: 261182 - DNA, 25 bp, Homo sapien
tgtctgctggattcctcgacagcca

SEQ ID NO: 261183 - DNA, 25 bp, Homo sapien
tggattcctcgacagccagggcctt

SEQ ID NO: 261184 - DNA, 25 bp, Homo sapien
ctgggacccctgtcagatgtctctg

SEQ ID NO: 261185 - DNA, 25 bp, Homo sapien
gatgtctctgcaggacctaaaattc

SEQ ID NO: 261186 - DNA, 25 bp, Homo sapien
ggacctaaaattcaacctgatcaat

SEQ ID NO: 261187 - DNA, 25 bp, Homo sapien
tcaacctgatcaatagcaaacgcca

SEQ ID NO: 261188 - DNA, 25 bp, Homo sapien
gcaggtcctcggtgagcagccgcca

SEQ ID NO: 261189 - DNA, 25 bp, Homo sapien
gccgccaggagctctggttttgaaa

SEQ ID NO: 261190 - DNA, 25 bp, Homo sapien
ccaggagctctggttttgaaaatgt

SEQ ID NO: 261191 - DNA, 25 bp, Homo sapien
gtgaaggtgcgcaacgcgcgcccct

SEQ ID NO: 261192 - DNA, 25 bp, Homo sapien
ttaagaagcattatgaaggccagac

SEQ ID NO: 261193 - DNA, 25 bp, Homo sapien
tgaaggccagacttactcatttttc

SEQ ID NO: 261194 - DNA, 25 bp, Homo sapien
tactcatttttctcccccaagtgag

SEQ ID NO: 261195 - DNA, 25 bp, Homo sapien
aagtgagctgcaagaggcccctgtt

SEQ ID NO: 261196 - DNA, 25 bp, Homo sapien
tgagctgcaagaggcccctgttagg

SEQ ID NO: 261197 - DNA, 25 bp, Homo sapien
gcaagaggcccctgttaggcccctg

SEQ ID NO: 261198 - DNA, 25 bp, Homo sapien
tcctgagcagtgatgtgctgctctt

SEQ ID NO: 261199 - DNA, 25 bp, Homo sapien
agtgatgtgctgctcttcttggtgg

SEQ ID NO: 261200 - DNA, 25 bp, Homo sapien
cgtcatctcgttggactctttaagg

SEQ ID NO: 261201 - DNA, 25 bp, Homo sapien
tcatctcgttggactctttaaggga

SEQ ID NO: 261202 - DNA, 25 bp, Homo sapien
ctctttaagggagtcaggaatagat

SEQ ID NO: 261203 - DNA, 25 bp, Homo sapien
atccaaaagcgcaaccgaatggtct

SEQ ID NO: 261204 - DNA, 25 bp, Homo sapien
cgacttgaatcccttcgactcagag

SEQ ID NO: 261205 - DNA, 25 bp, Homo sapien
aaccgaatggtctaaactgcctcat

SEQ ID NO: 261206 - DNA, 25 bp, Homo sapien
taaactgcctcattggttgcctgcc

SEQ ID NO: 261207 - DNA, 25 bp, Homo sapien
ctgccgccatattgcttgagagtga

SEQ ID NO: 261208 - DNA, 25 bp, Homo sapien
agagtgaactcaaccgtcgacatgc

SEQ ID NO: 261209 - DNA, 25 bp, Homo sapien
tcaaccgtcgacatgcttgtctaaa

SEQ ID NO: 261210 - DNA, 25 bp, Homo sapien
catgcttgtctaaaggttactggag

SEQ ID NO: 261211 - DNA, 25 bp, Homo sapien
ttactggagaccatttttcttccct

SEQ ID NO: 261212 - DNA, 25 bp, Homo sapien
gatttctaacaattttgccataaag

SEQ ID NO: 261213 - DNA, 25 bp, Homo sapien
acctcggcccaatgcagtgatggca

SEQ ID NO: 261214 - DNA, 25 bp, Homo sapien
tgaaggaataatgcctgggaaatta

SEQ ID NO: 261215 - DNA, 25 bp, Homo sapien
tatagattcagcttggtttgtggta

SEQ ID NO: 261216 - DNA, 25 bp, Homo sapien
gattcagcttggtttgtggtatttt

SEQ ID NO: 261217 - DNA, 25 bp, Homo sapien
aagaggcaagcccatgtcgttactg

SEQ ID NO: 261218 - DNA, 25 bp, Homo sapien
aagcccatgtcgttactgggttggg

SEQ ID NO: 261219 - DNA, 25 bp, Homo sapien
gggcatatggcctgcactcgaaatg

SEQ ID NO: 261220 - DNA, 25 bp, Homo sapien
atatggcctgcactcgaaatgggca

SEQ ID NO: 261221 - DNA, 25 bp, Homo sapien
ggcctgcactcgaaatgggcagaaa

SEQ ID NO: 261222 - DNA, 25 bp, Homo sapien
tgggcagaaaaattccttagttaag

SEQ ID NO: 261223 - DNA, 25 bp, Homo sapien
cctttaaccccaagtgagggatgat

SEQ ID NO: 261224 - DNA, 25 bp, Homo sapien
agggatgatatcatctctcaggctt

SEQ ID NO: 261225 - DNA, 25 bp, Homo sapien
agttcatcaccgactcagtttcccc

SEQ ID NO: 261226 - DNA, 25 bp, Homo sapien
agtttccccatgtgtatgctgtggt

SEQ ID NO: 261227 - DNA, 25 bp, Homo sapien
ggtattggatcagcaacgagataag

SEQ ID NO: 261228 - DNA, 25 bp, Homo sapien
tggatcagcaacgagataagaagat

SEQ ID NO: 261229 - DNA, 25 bp, Homo sapien
taagaagatctctcccatttccaag

SEQ ID NO: 261230 - DNA, 25 bp, Homo sapien
tccaagcgtctatgatgattctgag

SEQ ID NO: 261231 - DNA, 25 bp, Homo sapien
gattctgaggcacaaggtcacattt

SEQ ID NO: 261232 - DNA, 25 bp, Homo sapien
attctgaggcacaaggtcacatttg

SEQ ID NO: 261233 - DNA, 25 bp, Homo sapien
tctgaggcacaaggtcacatttgac

SEQ ID NO: 261234 - DNA, 25 bp, Homo sapien
actacaggtagatgatgggctccac

SEQ ID NO: 261235 - DNA, 25 bp, Homo sapien
tagatgatgggctccacgggaacag

SEQ ID NO: 261236 - DNA, 25 bp, Homo sapien
gtgcccggatccgaggagcaagtta

SEQ ID NO: 261237 - DNA, 25 bp, Homo sapien
gaggagcaagttaatctgtcccttc

SEQ ID NO: 261238 - DNA, 25 bp, Homo sapien
tgtcccttcattcgtgtcgcaatat

SEQ ID NO: 261239 - DNA, 25 bp, Homo sapien
attcgtgtcgcaatatttcccttcc

SEQ ID NO: 261240 - DNA, 25 bp, Homo sapien
ctaccttgttcggttgatacttagt

SEQ ID NO: 261241 - DNA, 25 bp, Homo sapien
gatacttagtaactccgtggccagt

SEQ ID NO: 261242 - DNA, 25 bp, Homo sapien
aactccgtggccagttgaagcgctg

SEQ ID NO: 261243 - DNA, 25 bp, Homo sapien
gaagcgctggatgtttcctagaaca

SEQ ID NO: 261244 - DNA, 25 bp, Homo sapien
caccaaagcctgttcgcacagaagg

SEQ ID NO: 261245 - DNA, 25 bp, Homo sapien
cacagaagggcgaccttgcagggac

SEQ ID NO: 261246 - DNA, 25 bp, Homo sapien
tcagtgtggcttttacaggactccc

SEQ ID NO: 261247 - DNA, 25 bp, Homo sapien
aatttgacccaaactcacgtccctg

SEQ ID NO: 261248 - DNA, 25 bp, Homo sapien
gttctcgtgattttgccttgtgcag

SEQ ID NO: 261249 - DNA, 25 bp, Homo sapien
acctgttcaaggcaaatcccttctg

SEQ ID NO: 261250 - DNA, 25 bp, Homo sapien
atcccttctgactggctggtggtga

SEQ ID NO: 261251 - DNA, 25 bp, Homo sapien
gaactcccctggtccttaattactg

SEQ ID NO: 261252 - DNA, 25 bp, Homo sapien
aattcctgactttgctggtttctga

SEQ ID NO: 261253 - DNA, 25 bp, Homo sapien
ttaattactgtgctcttccaggaag

SEQ ID NO: 261254 - DNA, 25 bp, Homo sapien
ggaagagtcccataatgcatgtgtt

SEQ ID NO: 261255 - DNA, 25 bp, Homo sapien
ctgatatgctaagctgcctgtgcca

SEQ ID NO: 261256 - DNA, 25 bp, Homo sapien
tcctaatgctgtgcttggttcccaa

SEQ ID NO: 261257 - DNA, 25 bp, Homo sapien
ttggttcccaatctcccaatttgac

SEQ ID NO: 261258 - DNA, 25 bp, Homo sapien
gacaccaactgtcaaatcaaatcaa

SEQ ID NO: 261259 - DNA, 25 bp, Homo sapien
attcaaatctagttccttcttaggc

SEQ ID NO: 261260 - DNA, 25 bp, Homo sapien
aatctagttccttcttaggcctaat

SEQ ID NO: 261261 - DNA, 25 bp, Homo sapien
ttaggcctaattttgtccttatgtt

SEQ ID NO: 261262 - DNA, 25 bp, Homo sapien
tattgtggtttaaatagcccatttt

SEQ ID NO: 261263 - DNA, 25 bp, Homo sapien
tagcccattttacatgacaactttc

SEQ ID NO: 261264 - DNA, 25 bp, Homo sapien
gacaactttcaaacaagagcataaa

SEQ ID NO: 261265 - DNA, 25 bp, Homo sapien
aacaggctaaggaattcataatgat

SEQ ID NO: 261266 - DNA, 25 bp, Homo sapien
tcttggccgccacctaaaggtttat

SEQ ID NO: 261267 - DNA, 25 bp, Homo sapien
ttattttacatgagacctactatgc

SEQ ID NO: 261268 - DNA, 25 bp, Homo sapien
catgagacctactatgcattccttt

SEQ ID NO: 261269 - DNA, 25 bp, Homo sapien
tcttggtttttcaagcatcttgtca

SEQ ID NO: 261270 - DNA, 25 bp, Homo sapien
tgacgcttaatctgaagggtgctca

SEQ ID NO: 261271 - DNA, 25 bp, Homo sapien
gtgctcagggcaagatctatttact

SEQ ID NO: 261272 - DNA, 25 bp, Homo sapien
caaaccattcatctatgcagccttt

SEQ ID NO: 261273 - DNA, 25 bp, Homo sapien
aggcagtcgtgctatagtatctccc

SEQ ID NO: 261274 - DNA, 25 bp, Homo sapien
tatagtatctccctgctgcaattct

SEQ ID NO: 261275 - DNA, 25 bp, Homo sapien
cctgctgcaattcttcaaggcatat

SEQ ID NO: 261276 - DNA, 25 bp, Homo sapien
aggcatattgcacattccccagcat

SEQ ID NO: 261277 - DNA, 25 bp, Homo sapien
agcatctttactcagtacatcctca

SEQ ID NO: 261278 - DNA, 25 bp, Homo sapien
cctcattataggttattcgtggctt

SEQ ID NO: 261279 - DNA, 25 bp, Homo sapien
gttattcgtggctttgttaaacaca

SEQ ID NO: 261280 - DNA, 25 bp, Homo sapien
ttaaagtgatccttaaatagcaata

SEQ ID NO: 261281 - DNA, 25 bp, Homo sapien
tccttttataaaaattctggctaat

SEQ ID NO: 261282 - DNA, 25 bp, Homo sapien
ttctggctaataaatctaagtaaat

SEQ ID NO: 261283 - DNA, 25 bp, Homo sapien
acaattgtgaacatttatgaaagca

SEQ ID NO: 261284 - DNA, 25 bp, Homo sapien
aagcaatgtttgctttatctcaggg

SEQ ID NO: 261285 - DNA, 25 bp, Homo sapien
gtttgctttatctcaggggttggaa

SEQ ID NO: 261286 - DNA, 25 bp, Homo sapien
tggaggccaaatccacctgtttttg

SEQ ID NO: 261287 - DNA, 25 bp, Homo sapien
ggaggccaaatccacctgtttttgc

SEQ ID NO: 261288 - DNA, 25 bp, Homo sapien
atagcaatacaattactgttgattt

SEQ ID NO: 261289 - DNA, 25 bp, Homo sapien
taaggtaaaatctatagagtcacat

SEQ ID NO: 261290 - DNA, 25 bp, Homo sapien
ctatagagtcacataattgcagcat

SEQ ID NO: 261291 - DNA, 25 bp, Homo sapien
actatctctagtgcttgactttaaa

SEQ ID NO: 261292 - DNA, 25 bp, Homo sapien
tctctagtgcttgactttaaatcag

SEQ ID NO: 261293 - DNA, 25 bp, Homo sapien
agtgcttgactttaaatcagtacag

SEQ ID NO: 261294 - DNA, 25 bp, Homo sapien
agtacagtacctgtacctgcacggt

SEQ ID NO: 261295 - DNA, 25 bp, Homo sapien
acagtacctgtacctgcacggtcac

SEQ ID NO: 261296 - DNA, 25 bp, Homo sapien
cgctccgtgtgtcgccctatattga

SEQ ID NO: 261297 - DNA, 25 bp, Homo sapien
gtgtgtcgccctatattgagggctc

SEQ ID NO: 261298 - DNA, 25 bp, Homo sapien
gtgtcgccctatattgagggctcaa

SEQ ID NO: 261299 - DNA, 25 bp, Homo sapien
gccctatattgagggctcaagcttt

SEQ ID NO: 261300 - DNA, 25 bp, Homo sapien
attacaagtcttgtactcaatgact

SEQ ID NO: 261301 - DNA, 25 bp, Homo sapien
gtcttgtactcaatgacttttgtca

SEQ ID NO: 261302 - DNA, 25 bp, Homo sapien
accgctctgtgctcacagggagctt

SEQ ID NO: 261303 - DNA, 25 bp, Homo sapien
agggagcttctgttcctaaggcttc

SEQ ID NO: 261304 - DNA, 25 bp, Homo sapien
gcttctgttcctaaggcttcccaag

SEQ ID NO: 261305 - DNA, 25 bp, Homo sapien
gggtttggaaataccgcatcctgtg

SEQ ID NO: 261306 - DNA, 25 bp, Homo sapien
ggaaataccgcatcctgtgctacac

SEQ ID NO: 261307 - DNA, 25 bp, Homo sapien
aagaaaatgctcactttgggatggg

SEQ ID NO: 261308 - DNA, 25 bp, Homo sapien
cactagcagtgtcggcgggtgccaa

SEQ ID NO: 261309 - DNA, 25 bp, Homo sapien
gcaacgactagaactgggagtgcat

SEQ ID NO: 261310 - DNA, 25 bp, Homo sapien
gagtgcattctccacagggtgacag

SEQ ID NO: 261311 - DNA, 25 bp, Homo sapien
agcgccacaagcagcgggttcctgg

SEQ ID NO: 261312 - DNA, 25 bp, Homo sapien
acaagcagcgggttcctggctgatc

SEQ ID NO: 261313 - DNA, 25 bp, Homo sapien
cacctgtcggccaggaaggtagaga

SEQ ID NO: 261314 - DNA, 25 bp, Homo sapien
agaacacggtgccagcgtcacactc

SEQ ID NO: 261315 - DNA, 25 bp, Homo sapien
gccagcgtcacactcttattaacag

SEQ ID NO: 261316 - DNA, 25 bp, Homo sapien
gtcacactcttattaacagatgcaa

SEQ ID NO: 261317 - DNA, 25 bp, Homo sapien
gatgcaataaccaccttcggagacc

SEQ ID NO: 261318 - DNA, 25 bp, Homo sapien
aaagagcactcagcccacaatgtga

SEQ ID NO: 261319 - DNA, 25 bp, Homo sapien
actcagcccacaatgtgacgcagag

SEQ ID NO: 261320 - DNA, 25 bp, Homo sapien
gtgacgcagagaaaccagagaccca

SEQ ID NO: 261321 - DNA, 25 bp, Homo sapien
atctggatgtgaaatggaccatgca

SEQ ID NO: 261322 - DNA, 25 bp, Homo sapien
acccaggcagggagtgcacccacgg

SEQ ID NO: 261323 - DNA, 25 bp, Homo sapien
atggaccatgcagacaggacccaag

SEQ ID NO: 261324 - DNA, 25 bp, Homo sapien
ttttggcccaaactgagagggccat

SEQ ID NO: 261325 - DNA, 25 bp, Homo sapien
ttcatctccacctacaaggtccatt

SEQ ID NO: 261326 - DNA, 25 bp, Homo sapien
atctccacctacaaggtccattcta

SEQ ID NO: 261327 - DNA, 25 bp, Homo sapien
cattctaccccatccgggcggtggg

SEQ ID NO: 261328 - DNA, 25 bp, Homo sapien
gagatgttttgtttgagctaattac

SEQ ID NO: 261329 - DNA, 25 bp, Homo sapien
taattactgaatgatgccctgcctg

SEQ ID NO: 261330 - DNA, 25 bp, Homo sapien
ttactgaatgatgccctgcctgaga

SEQ ID NO: 261331 - DNA, 25 bp, Homo sapien
tgaatgatgccctgcctgagacaga

SEQ ID NO: 261332 - DNA, 25 bp, Homo sapien
atgatgccctgcctgagacagagac

SEQ ID NO: 261333 - DNA, 25 bp, Homo sapien
gatgccctgcctgagacagagacag

SEQ ID NO: 261334 - DNA, 25 bp, Homo sapien
gaacatatgagaacacagttataaa

SEQ ID NO: 261335 - DNA, 25 bp, Homo sapien
ggctgttctgaattgttctctgtgc

SEQ ID NO: 261336 - DNA, 25 bp, Homo sapien
ttctctgtgctaggccttatctaaa

SEQ ID NO: 261337 - DNA, 25 bp, Homo sapien
atctaaaccgcttgccttaaatctt

SEQ ID NO: 261338 - DNA, 25 bp, Homo sapien
gcttgccttaaatctttgaccttca

SEQ ID NO: 261339 - DNA, 25 bp, Homo sapien
tttaaattgctgacactttccccat

SEQ ID NO: 261340 - DNA, 25 bp, Homo sapien
gacactttccccatgtgaaactgta

SEQ ID NO: 261341 - DNA, 25 bp, Homo sapien
ctgtatcataatttcttctgtcttc

SEQ ID NO: 261342 - DNA, 25 bp, Homo sapien
tctttaggctagcagcatttccctt

SEQ ID NO: 261343 - DNA, 25 bp, Homo sapien
ttccctttcttattcccagaagagc

SEQ ID NO: 261344 - DNA, 25 bp, Homo sapien
gtggctgcacaattctaattatttc

SEQ ID NO: 261345 - DNA, 25 bp, Homo sapien
atccatttagggactggctgttctg

SEQ ID NO: 261346 - DNA, 25 bp, Homo sapien
ggcatcagcgtcacctcggtgtggt

SEQ ID NO: 261347 - DNA, 25 bp, Homo sapien
gtcacctcggtgtggtcgtcgcctc

SEQ ID NO: 261348 - DNA, 25 bp, Homo sapien
ttgtgttccccgatgtctgggctgt

SEQ ID NO: 261349 - DNA, 25 bp, Homo sapien
gggtcagccgtcgagccacttgctt

SEQ ID NO: 261350 - DNA, 25 bp, Homo sapien
agccacttgctttgctcagttctgt

SEQ ID NO: 261351 - DNA, 25 bp, Homo sapien
tgtgtttcagccacatttccacggt

SEQ ID NO: 261352 - DNA, 25 bp, Homo sapien
acatttccacggtggaccctgtttg

SEQ ID NO: 261353 - DNA, 25 bp, Homo sapien
taaatattctgttcccatgtcaatc

SEQ ID NO: 261354 - DNA, 25 bp, Homo sapien
attctgttcccatgtcaatcagtga

SEQ ID NO: 261355 - DNA, 25 bp, Homo sapien
gttcccatgtcaatcagtgacgata

SEQ ID NO: 261356 - DNA, 25 bp, Homo sapien
agtgacgataaatacagccttgatt

SEQ ID NO: 261357 - DNA, 25 bp, Homo sapien
ttgaggcaggagtgtaattatctta

SEQ ID NO: 261358 - DNA, 25 bp, Homo sapien
aaggcccatgggaagagttacggat

SEQ ID NO: 261359 - DNA, 25 bp, Homo sapien
ccataaggagtattgccttgctcaa

SEQ ID NO: 261360 - DNA, 25 bp, Homo sapien
gccttgctcaagaatttaatccgct

SEQ ID NO: 261361 - DNA, 25 bp, Homo sapien
taatccgctgacagtatgcttcttc

SEQ ID NO: 261362 - DNA, 25 bp, Homo sapien
agtatgcttcttccagtttgcctta

SEQ ID NO: 261363 - DNA, 25 bp, Homo sapien
agtttgccttacttcctctgcaagt

SEQ ID NO: 261364 - DNA, 25 bp, Homo sapien
ttacttcctctgcaagtttctttgc

SEQ ID NO: 261365 - DNA, 25 bp, Homo sapien
aagtttctttgctccttagggcaga

SEQ ID NO: 261366 - DNA, 25 bp, Homo sapien
aaaaatagtcattccttgtgggtgt

SEQ ID NO: 261367 - DNA, 25 bp, Homo sapien
tccttgtgggtgttggacacagctt

SEQ ID NO: 261368 - DNA, 25 bp, Homo sapien
cagacctggtatttccctgggttct

SEQ ID NO: 261369 - DNA, 25 bp, Homo sapien
tcagtagggatgaccatgctgggcc

SEQ ID NO: 261370 - DNA, 25 bp, Homo sapien
tgggccccagacatctgtgaggttt

SEQ ID NO: 261371 - DNA, 25 bp, Homo sapien
ctgtgaggtttcctttgcagatcca

SEQ ID NO: 261372 - DNA, 25 bp, Homo sapien
gatccaatgagacatctgtggacag

SEQ ID NO: 261373 - DNA, 25 bp, Homo sapien
aagaatgctctggtgagacaggcct

SEQ ID NO: 261374 - DNA, 25 bp, Homo sapien
ccgaacctaaggattctggaagctt

SEQ ID NO: 261375 - DNA, 25 bp, Homo sapien
tggaagcttccagcctttggctcca

SEQ ID NO: 261376 - DNA, 25 bp, Homo sapien
ttggctccacgtttcctcaggagag

SEQ ID NO: 261377 - DNA, 25 bp, Homo sapien
aggagaggttcagtctgcctaggac

SEQ ID NO: 261378 - DNA, 25 bp, Homo sapien
ctcccttcccctgaataaagagtga

SEQ ID NO: 261379 - DNA, 25 bp, Homo sapien
gtatgtatgtgtaggtacgtatgtt

SEQ ID NO: 261380 - DNA, 25 bp, Homo sapien
tacgtatgttgtactatccacagtt

SEQ ID NO: 261381 - DNA, 25 bp, Homo sapien
ctatccacagtttgagatatgcagt

SEQ ID NO: 261382 - DNA, 25 bp, Homo sapien
ggttcttggagagtataccccatgg

SEQ ID NO: 261383 - DNA, 25 bp, Homo sapien
gagagtataccccatggatagagtg

SEQ ID NO: 261384 - DNA, 25 bp, Homo sapien
atagagtgggtgatactgtagtcaa

SEQ ID NO: 261385 - DNA, 25 bp, Homo sapien
gaactacctaaggtcttgagactgg

SEQ ID NO: 261386 - DNA, 25 bp, Homo sapien
gtatgtttcttcagcataagtcaca

SEQ ID NO: 261387 - DNA, 25 bp, Homo sapien
ctgttttaccagtgttgttcctaat

SEQ ID NO: 261388 - DNA, 25 bp, Homo sapien
accagtgttgttcctaatctcttac

SEQ ID NO: 261389 - DNA, 25 bp, Homo sapien
gtgttgttcctaatctcttactgtg

SEQ ID NO: 261390 - DNA, 25 bp, Homo sapien
atcaacatgggccagcgggagacac

SEQ ID NO: 261391 - DNA, 25 bp, Homo sapien
caggagctgctctttgatcacgagg

SEQ ID NO: 261392 - DNA, 25 bp, Homo sapien
tttgatcacgaggttcacgctgcat

SEQ ID NO: 261393 - DNA, 25 bp, Homo sapien
cacgctgcatcttttcgggaaggtt

SEQ ID NO: 261394 - DNA, 25 bp, Homo sapien
taaatgaccaccaggatcacagaag

SEQ ID NO: 261395 - DNA, 25 bp, Homo sapien
gaaagagctcgtgatgtccatggaa

SEQ ID NO: 261396 - DNA, 25 bp, Homo sapien
gtccatggaattcacgcagatcaca

SEQ ID NO: 261397 - DNA, 25 bp, Homo sapien
gcagatcacatccaggaatctttgg

SEQ ID NO: 261398 - DNA, 25 bp, Homo sapien
aaggactcatcaacacattgctgcc

SEQ ID NO: 261399 - DNA, 25 bp, Homo sapien
aaaaattcacaacaccatggcctca

SEQ ID NO: 261400 - DNA, 25 bp, Homo sapien
gaccaccttacaccacattatatgg

SEQ ID NO: 261401 - DNA, 25 bp, Homo sapien
tttctccaccttaaaaatgcgggca

SEQ ID NO: 261402 - DNA, 25 bp, Homo sapien
aatgcgggcatttaagtctgtccat

SEQ ID NO: 261403 - DNA, 25 bp, Homo sapien
gtctgtccattatctatatagtcct

SEQ ID NO: 261404 - DNA, 25 bp, Homo sapien
tatatagtcctgtcttgtctattgt

SEQ ID NO: 261405 - DNA, 25 bp, Homo sapien
atgcataatcagacaagcttgaata

SEQ ID NO: 261406 - DNA, 25 bp, Homo sapien
gcttgaatattgtttttgcaccaga

SEQ ID NO: 261407 - DNA, 25 bp, Homo sapien
gtttttgcaccagacgaacagtgag

SEQ ID NO: 261408 - DNA, 25 bp, Homo sapien
gaacagtgaggaaattcggagctat

SEQ ID NO: 261409 - DNA, 25 bp, Homo sapien
aattcggagctatacatatgtgcag

SEQ ID NO: 261410 - DNA, 25 bp, Homo sapien
tactacctagggtttatgcttaatt

SEQ ID NO: 261411 - DNA, 25 bp, Homo sapien
gaatgctgattgtaacggagttaat

SEQ ID NO: 261412 - DNA, 25 bp, Homo sapien
ccccaggtatcaattctatattttg

SEQ ID NO: 261413 - DNA, 25 bp, Homo sapien
tatattttgggactcattagcacaa

SEQ ID NO: 261414 - DNA, 25 bp, Homo sapien
cctgatatgtatctgctacttggta

SEQ ID NO: 261415 - DNA, 25 bp, Homo sapien
ctatacccacaccaaatgggcaatg

SEQ ID NO: 261416 - DNA, 25 bp, Homo sapien
aatgggcaatgatctcaactactat

SEQ ID NO: 261417 - DNA, 25 bp, Homo sapien
gcaatgatctcaactactatttaag

SEQ ID NO: 261418 - DNA, 25 bp, Homo sapien
gctacttggtagcagtaatgaaaaa

SEQ ID NO: 261419 - DNA, 25 bp, Homo sapien
gaataatctgacaccaaaggtctga

SEQ ID NO: 261420 - DNA, 25 bp, Homo sapien
atctgacaccaaaggtctgaagtta

SEQ ID NO: 261421 - DNA, 25 bp, Homo sapien
agttaacttctagctggtcttctct

SEQ ID NO: 261422 - DNA, 25 bp, Homo sapien
taacttctagctggtcttctctacc

SEQ ID NO: 261423 - DNA, 25 bp, Homo sapien
ttggatttcattttgccttctctaa

SEQ ID NO: 261424 - DNA, 25 bp, Homo sapien
gagaaagtatcaacaaactgagtaa

SEQ ID NO: 261425 - DNA, 25 bp, Homo sapien
gaggggcactgaaaagatgttcttt

SEQ ID NO: 261426 - DNA, 25 bp, Homo sapien
gatgttctttgaaacttgatttata

SEQ ID NO: 261427 - DNA, 25 bp, Homo sapien
tacttgcaaaagaatatactgtgtt

SEQ ID NO: 261428 - DNA, 25 bp, Homo sapien
agtatgaaagtgtgattgggtctgt

SEQ ID NO: 261429 - DNA, 25 bp, Homo sapien
gattgggtctgttgtgggaaccact

SEQ ID NO: 261430 - DNA, 25 bp, Homo sapien
gtctgttgtgggaaccactgactga

SEQ ID NO: 261431 - DNA, 25 bp, Homo sapien
gccatattcctagtttcacagaaat

SEQ ID NO: 261432 - DNA, 25 bp, Homo sapien
caggatttgcctgtaagcattcaaa

SEQ ID NO: 261433 - DNA, 25 bp, Homo sapien
gcctgtaagcattcaaattgttttg

SEQ ID NO: 261434 - DNA, 25 bp, Homo sapien
ccacaggctgctcaggaccgaggct

SEQ ID NO: 261435 - DNA, 25 bp, Homo sapien
accaggacgggattgtatggctgca

SEQ ID NO: 261436 - DNA, 25 bp, Homo sapien
gcaggaggctacacagtcccaggag

SEQ ID NO: 261437 - DNA, 25 bp, Homo sapien
caggaggctacacagtcccaggagg

SEQ ID NO: 261438 - DNA, 25 bp, Homo sapien
ccaggaggctgcttctaagaggccc

SEQ ID NO: 261439 - DNA, 25 bp, Homo sapien
taagaggcccacgtggcctgcatgg

SEQ ID NO: 261440 - DNA, 25 bp, Homo sapien
cacctggttaggacccagtccctgg

SEQ ID NO: 261441 - DNA, 25 bp, Homo sapien
gatgcgcctggctgtccagcatgtg

SEQ ID NO: 261442 - DNA, 25 bp, Homo sapien
cctggttaggacccagtccctggtg

SEQ ID NO: 261443 - DNA, 25 bp, Homo sapien
gtccagcatgtggtcatttgaattg

SEQ ID NO: 261444 - DNA, 25 bp, Homo sapien
acatgtttcactgggatgcctacag

SEQ ID NO: 261445 - DNA, 25 bp, Homo sapien
gccacaaaactagcaaggccaattt

SEQ ID NO: 261446 - DNA, 25 bp, Homo sapien
gcaaggccaatttaatagtatgtgt

SEQ ID NO: 261447 - DNA, 25 bp, Homo sapien
gagttccacttctcaccatttatta

SEQ ID NO: 261448 - DNA, 25 bp, Homo sapien
gtcaatgagatgtcctagagtttta

SEQ ID NO: 261449 - DNA, 25 bp, Homo sapien
gagaaacagtcaccatacttatgca

SEQ ID NO: 261450 - DNA, 25 bp, Homo sapien
cagtcaccatacttatgcatagggt

SEQ ID NO: 261451 - DNA, 25 bp, Homo sapien
tagggtgacattacagagctattca

SEQ ID NO: 261452 - DNA, 25 bp, Homo sapien
gagctattcattacaacactgtttg

SEQ ID NO: 261453 - DNA, 25 bp, Homo sapien
gaaacaccctaaatctccaacagta

SEQ ID NO: 261454 - DNA, 25 bp, Homo sapien
cactaatatgtgaaactgatggtca

SEQ ID NO: 261455 - DNA, 25 bp, Homo sapien
ctgatggtcacatatattactgtta

SEQ ID NO: 261456 - DNA, 25 bp, Homo sapien
agctagggttctacaaggcgtttct

SEQ ID NO: 261457 - DNA, 25 bp, Homo sapien
aggcgtttcttgttcaccgccggag

SEQ ID NO: 261458 - DNA, 25 bp, Homo sapien
aagcaggctccggagtgactgcctt

SEQ ID NO: 261459 - DNA, 25 bp, Homo sapien
ctgccttctgaaagtcggtcttgta

SEQ ID NO: 261460 - DNA, 25 bp, Homo sapien
cccctgtccctattctatgcttgaa

SEQ ID NO: 261461 - DNA, 25 bp, Homo sapien
cagcgtgcagtcctaatgttcaaga

SEQ ID NO: 261462 - DNA, 25 bp, Homo sapien
gttcaagaaccacgaccacataaaa

SEQ ID NO: 261463 - DNA, 25 bp, Homo sapien
acataaaaacattgctccccttctg

SEQ ID NO: 261464 - DNA, 25 bp, Homo sapien
aaattagtcttacccttgaagtcag

SEQ ID NO: 261465 - DNA, 25 bp, Homo sapien
gtcctcgcaatacacatcttgttag

SEQ ID NO: 261466 - DNA, 25 bp, Homo sapien
aaagtgttcggctccagctagggtt

SEQ ID NO: 261467 - DNA, 25 bp, Homo sapien
tctagggatgcggtttaatattttc

SEQ ID NO: 261468 - DNA, 25 bp, Homo sapien
gaacttccttacctgggtcgtagat

SEQ ID NO: 261469 - DNA, 25 bp, Homo sapien
attcctaaaagaatctgaggctcaa

SEQ ID NO: 261470 - DNA, 25 bp, Homo sapien
agagggcatcttaatatcctgcact

SEQ ID NO: 261471 - DNA, 25 bp, Homo sapien
tatcctgcactttcagtcattgagg

SEQ ID NO: 261472 - DNA, 25 bp, Homo sapien
ttcagtcattgagggcatgatcaca

SEQ ID NO: 261473 - DNA, 25 bp, Homo sapien
tacctgggtcgtagatggactctag

SEQ ID NO: 261474 - DNA, 25 bp, Homo sapien
ggtaagattttctatttgtgaggca

SEQ ID NO: 261475 - DNA, 25 bp, Homo sapien
gcaggaacaagggattggaccattg

SEQ ID NO: 261476 - DNA, 25 bp, Homo sapien
tggactctaggagatctccaaacct

SEQ ID NO: 261477 - DNA, 25 bp, Homo sapien
gtctgtatatgcattttctagggat

SEQ ID NO: 261478 - DNA, 25 bp, Homo sapien
ttttcaaatcacagttgcccatggg

SEQ ID NO: 261479 - DNA, 25 bp, Homo sapien
acagttgcccatgggtgtgtctgat

SEQ ID NO: 261480 - DNA, 25 bp, Homo sapien
ggaaaggtcacatacctgtacccta

SEQ ID NO: 261481 - DNA, 25 bp, Homo sapien
atacctgtaccctagctgcaaaaga

SEQ ID NO: 261482 - DNA, 25 bp, Homo sapien
gctggagatttcaggctcgttgtta

SEQ ID NO: 261483 - DNA, 25 bp, Homo sapien
gctcgttgttaagggtctgcggatt

SEQ ID NO: 261484 - DNA, 25 bp, Homo sapien
aagggtctgcggattcataaggtca

SEQ ID NO: 261485 - DNA, 25 bp, Homo sapien
aaggtcagaaattccatgaacacag

SEQ ID NO: 261486 - DNA, 25 bp, Homo sapien
ggtactcagcagctagtgaattcaa

SEQ ID NO: 261487 - DNA, 25 bp, Homo sapien
tggaaactagaatctcttctgagat

SEQ ID NO: 261488 - DNA, 25 bp, Homo sapien
tttgccacatgcttcttcactttat

SEQ ID NO: 261489 - DNA, 25 bp, Homo sapien
cttgtctgtggcatcttgctgtgga

SEQ ID NO: 261490 - DNA, 25 bp, Homo sapien
tggcatcttgctgtggagtctgttc

SEQ ID NO: 261491 - DNA, 25 bp, Homo sapien
gtggagtctgttcctgatgtttcac

SEQ ID NO: 261492 - DNA, 25 bp, Homo sapien
tctgttcctgatgtttcactcggat

SEQ ID NO: 261493 - DNA, 25 bp, Homo sapien
cctgatgtttcactcggatatgtag

SEQ ID NO: 261494 - DNA, 25 bp, Homo sapien
gtttcactcggatatgtagttttct

SEQ ID NO: 261495 - DNA, 25 bp, Homo sapien
gttttctttgatcatgctctcaggg

SEQ ID NO: 261496 - DNA, 25 bp, Homo sapien
atcatgctctcagggttaggctttg

SEQ ID NO: 261497 - DNA, 25 bp, Homo sapien
taggctttggtaatagaatgctggc

SEQ ID NO: 261498 - DNA, 25 bp, Homo sapien
tagaatgctggcttcatggagaatt

SEQ ID NO: 261499 - DNA, 25 bp, Homo sapien
tcatggagaatttggaagctttcct

SEQ ID NO: 261500 - DNA, 25 bp, Homo sapien
ttggcctgtccgtggcgggagcatc

SEQ ID NO: 261501 - DNA, 25 bp, Homo sapien
ggagcatctgcaaggaggagcccca

SEQ ID NO: 261502 - DNA, 25 bp, Homo sapien
gggagctccttagagctgaactcac

SEQ ID NO: 261503 - DNA, 25 bp, Homo sapien
ttagagctgaactcacccggcgtca

SEQ ID NO: 261504 - DNA, 25 bp, Homo sapien
gagctgaactcacccggcgtcaact

SEQ ID NO: 261505 - DNA, 25 bp, Homo sapien
atcaaccctccacccatggacaggg

SEQ ID NO: 261506 - DNA, 25 bp, Homo sapien
agcacaggagaggactcagccctct

SEQ ID NO: 261507 - DNA, 25 bp, Homo sapien
ctgccctgggactcatggatttgga

SEQ ID NO: 261508 - DNA, 25 bp, Homo sapien
catggatttggagttgtggccacac

SEQ ID NO: 261509 - DNA, 25 bp, Homo sapien
atttggagttgtggccacacggttg

SEQ ID NO: 261510 - DNA, 25 bp, Homo sapien
tgtggccacacggttgagggctgca

SEQ ID NO: 261511 - DNA, 25 bp, Homo sapien
gaatgtgccatttgattccatcatg

SEQ ID NO: 261512 - DNA, 25 bp, Homo sapien
attccatcatggagcggctgactct

SEQ ID NO: 261513 - DNA, 25 bp, Homo sapien
atcatggagcggctgactctgagaa

SEQ ID NO: 261514 - DNA, 25 bp, Homo sapien
ggagcggctgactctgagaagaatt

SEQ ID NO: 261515 - DNA, 25 bp, Homo sapien
gagaagaattgatccagtcactggg

SEQ ID NO: 261516 - DNA, 25 bp, Homo sapien
gtcactggggaaaggtaccacctca

SEQ ID NO: 261517 - DNA, 25 bp, Homo sapien
tggagatccaggctcgcctcctgca

SEQ ID NO: 261518 - DNA, 25 bp, Homo sapien
cgcctcctgcagaacccaaaggatg

SEQ ID NO: 261519 - DNA, 25 bp, Homo sapien
gctgaagagcaggtcaagctgaaaa

SEQ ID NO: 261520 - DNA, 25 bp, Homo sapien
tgggcccgagggttttttaagcatg

SEQ ID NO: 261521 - DNA, 25 bp, Homo sapien
tttttaagcatgacccagcattggg

SEQ ID NO: 261522 - DNA, 25 bp, Homo sapien
ggacatcacagcaacgaaagaacta

SEQ ID NO: 261523 - DNA, 25 bp, Homo sapien
taactgtggaccaggtgagagccac

SEQ ID NO: 261524 - DNA, 25 bp, Homo sapien
caggtgagagccacactgtagaaca

SEQ ID NO: 261525 - DNA, 25 bp, Homo sapien
cctctcttctttggcgaatgttatg

SEQ ID NO: 261526 - DNA, 25 bp, Homo sapien
gaagacattctgatgcacttaggat

SEQ ID NO: 261527 - DNA, 25 bp, Homo sapien
gatgcacttaggatcatgattcatg

SEQ ID NO: 261528 - DNA, 25 bp, Homo sapien
acatcttgctccaaaatgtggtgac

SEQ ID NO: 261529 - DNA, 25 bp, Homo sapien
gtgacaatttagaagctgtccacat

SEQ ID NO: 261530 - DNA, 25 bp, Homo sapien
tgtccacatagccagaccactctgt

SEQ ID NO: 261531 - DNA, 25 bp, Homo sapien
agccagaccactctgtaaatcacag

SEQ ID NO: 261532 - DNA, 25 bp, Homo sapien
aaatgtgccataattaggacagcag

SEQ ID NO: 261533 - DNA, 25 bp, Homo sapien
ttgcttggagcagactaccatgaca

SEQ ID NO: 261534 - DNA, 25 bp, Homo sapien
ggagcagactaccatgacaagccag

SEQ ID NO: 261535 - DNA, 25 bp, Homo sapien
actaccatgacaagccagtctcagg

SEQ ID NO: 261536 - DNA, 25 bp, Homo sapien
aaaacgggccaaggacaagctagag

SEQ ID NO: 261537 - DNA, 25 bp, Homo sapien
gattctgcatctacttttcctaaaa

SEQ ID NO: 261538 - DNA, 25 bp, Homo sapien
gcatctacttttcctaaaacgaaga

SEQ ID NO: 261539 - DNA, 25 bp, Homo sapien
gaaagcgattgaagcaagccaagga

SEQ ID NO: 261540 - DNA, 25 bp, Homo sapien
gaaattgaccagtacagaatgcaga

SEQ ID NO: 261541 - DNA, 25 bp, Homo sapien
cagagagataaagagtttcgactaa

SEQ ID NO: 261542 - DNA, 25 bp, Homo sapien
acaatctaagataatgggctctcag

SEQ ID NO: 261543 - DNA, 25 bp, Homo sapien
tgggctctcagaataatctctcaga

SEQ ID NO: 261544 - DNA, 25 bp, Homo sapien
tttatgctctttagacgtttaaaag

SEQ ID NO: 261545 - DNA, 25 bp, Homo sapien
ttgcttcttcgttttcggttgggat

SEQ ID NO: 261546 - DNA, 25 bp, Homo sapien
cttcgttttcggttgggatttgcag

SEQ ID NO: 261547 - DNA, 25 bp, Homo sapien
ggatttgcagtttaatggcctcaga

SEQ ID NO: 261548 - DNA, 25 bp, Homo sapien
agtttaatggcctcagatccttctc

SEQ ID NO: 261549 - DNA, 25 bp, Homo sapien
aatggcctcagatccttctccagat

SEQ ID NO: 261550 - DNA, 25 bp, Homo sapien
tccagatccccagggtttctttgtc

SEQ ID NO: 261551 - DNA, 25 bp, Homo sapien
ttatggagaaaaaccggtcactttg

SEQ ID NO: 261552 - DNA, 25 bp, Homo sapien
gaaaaaccggtcactttgtccagcg

SEQ ID NO: 261553 - DNA, 25 bp, Homo sapien
tttgtccagcgcactgtgaggcccc

SEQ ID NO: 261554 - DNA, 25 bp, Homo sapien
ggaaccgaagttacagattatatta

SEQ ID NO: 261555 - DNA, 25 bp, Homo sapien
gggtccagtggtgacagagctcagt

SEQ ID NO: 261556 - DNA, 25 bp, Homo sapien
acagagctcagtgtgggtccagaga

SEQ ID NO: 261557 - DNA, 25 bp, Homo sapien
cagagctcagtgtgggtccagagat

SEQ ID NO: 261558 - DNA, 25 bp, Homo sapien
tcagtgtgggtccagagatggtgtc

SEQ ID NO: 261559 - DNA, 25 bp, Homo sapien
gcaagtgccccttgagatgggctga

SEQ ID NO: 261560 - DNA, 25 bp, Homo sapien
aagtgccccttgagatgggctgaac

SEQ ID NO: 261561 - DNA, 25 bp, Homo sapien
gtgccccttgagatgggctgaacgt

SEQ ID NO: 261562 - DNA, 25 bp, Homo sapien
cttgagatgggctgaacgtgatgat

SEQ ID NO: 261563 - DNA, 25 bp, Homo sapien
agaagtcttgaggttgggaatataa

SEQ ID NO: 261564 - DNA, 25 bp, Homo sapien
gggaatataagaattaggtctcttt

SEQ ID NO: 261565 - DNA, 25 bp, Homo sapien
tacagtagggaagagcatgtggcaa

SEQ ID NO: 261566 - DNA, 25 bp, Homo sapien
gagtaaagtttactggctaccaggc

SEQ ID NO: 261567 - DNA, 25 bp, Homo sapien
aagtttactggctaccaggcaattc

SEQ ID NO: 261568 - DNA, 25 bp, Homo sapien
tactggctaccaggcaattcagcaa

SEQ ID NO: 261569 - DNA, 25 bp, Homo sapien
ggctaccaggcaattcagcaacaga

SEQ ID NO: 261570 - DNA, 25 bp, Homo sapien
caggcaattcagcaacagagctctt

SEQ ID NO: 261571 - DNA, 25 bp, Homo sapien
ggcaattcagcaacagagctcttca

SEQ ID NO: 261572 - DNA, 25 bp, Homo sapien
aattcagcaacagagctcttcagaa

SEQ ID NO: 261573 - DNA, 25 bp, Homo sapien
tgaaaaagcaggctcaaaacggaaa

SEQ ID NO: 261574 - DNA, 25 bp, Homo sapien
gcaggctcaaaacggaaaaagtcat

SEQ ID NO: 261575 - DNA, 25 bp, Homo sapien
caaagaaatcctctaaacagtcccg

SEQ ID NO: 261576 - DNA, 25 bp, Homo sapien
tcctctaaacagtcccggaaatctc

SEQ ID NO: 261577 - DNA, 25 bp, Homo sapien
ggcccttggcctgtccgtggcggga

SEQ ID NO: 261578 - DNA, 25 bp, Homo sapien
tgtccgtggcgggagcatctgcaag

SEQ ID NO: 261579 - DNA, 25 bp, Homo sapien
gggagcatctgcaaggaggagcccc

SEQ ID NO: 261580 - DNA, 25 bp, Homo sapien
gggagctccttagagctgaactcac

SEQ ID NO: 261581 - DNA, 25 bp, Homo sapien
ttagagctgaactcacccggcgtca

SEQ ID NO: 261582 - DNA, 25 bp, Homo sapien
gagctgaactcacccggcgtcaact

SEQ ID NO: 261583 - DNA, 25 bp, Homo sapien
atcaaccctccacccatggacaggg

SEQ ID NO: 261584 - DNA, 25 bp, Homo sapien
ctgccctgggactcatggatttgga

SEQ ID NO: 261585 - DNA, 25 bp, Homo sapien
catggatttggagttgtggccacac

SEQ ID NO: 261586 - DNA, 25 bp, Homo sapien
atttggagttgtggccacacggttg

SEQ ID NO: 261587 - DNA, 25 bp, Homo sapien
tgtggccacacggttgagggctgca

SEQ ID NO: 261588 - DNA, 25 bp, Homo sapien
ctgggcacagcagagacagactggt

SEQ ID NO: 261589 - DNA, 25 bp, Homo sapien
gaggtgccaaaaaagccagctgcgg

SEQ ID NO: 261590 - DNA, 25 bp, Homo sapien
aggacagctgccgtgagactcccga

SEQ ID NO: 261591 - DNA, 25 bp, Homo sapien
tgagactcccgatgtcacaggcagt

SEQ ID NO: 261592 - DNA, 25 bp, Homo sapien
ggcagtctgtgtggttacagcgccc

SEQ ID NO: 261593 - DNA, 25 bp, Homo sapien
ggtactgcggctcccagtgccagca

SEQ ID NO: 261594 - DNA, 25 bp, Homo sapien
agaaggactggcctgcccacaagaa

SEQ ID NO: 261595 - DNA, 25 bp, Homo sapien
tgcccacaagaagcactgtcgggag

SEQ ID NO: 261596 - DNA, 25 bp, Homo sapien
ctgtcgggagaggaagcgtcccttc

SEQ ID NO: 261597 - DNA, 25 bp, Homo sapien
agcgtcccttccagcatgagcttga

SEQ ID NO: 261598 - DNA, 25 bp, Homo sapien
gcatgagcttgagccagagcgatga

SEQ ID NO: 261599 - DNA, 25 bp, Homo sapien
agatccagtctgtggtatcatgcta

SEQ ID NO: 261600 - DNA, 25 bp, Homo sapien
cagtctgtggtatcatgctagtgct

SEQ ID NO: 261601 - DNA, 25 bp, Homo sapien
ctgtggtatcatgctagtgctgaca

SEQ ID NO: 261602 - DNA, 25 bp, Homo sapien
tatcatgctagtgctgacagggcct

SEQ ID NO: 261603 - DNA, 25 bp, Homo sapien
atgctagtgctgacagggccttgat

SEQ ID NO: 261604 - DNA, 25 bp, Homo sapien
ctagtgctgacagggccttgataga

SEQ ID NO: 261605 - DNA, 25 bp, Homo sapien
gacagggccttgatagaatagagtt

SEQ ID NO: 261606 - DNA, 25 bp, Homo sapien
ggccttgatagaatagagttggaaa

SEQ ID NO: 261607 - DNA, 25 bp, Homo sapien
gatggtaagcttttgtcagggtttt

SEQ ID NO: 261608 - DNA, 25 bp, Homo sapien
acaaaatctcttcccaaatctaaat

SEQ ID NO: 261609 - DNA, 25 bp, Homo sapien
agagatagaacttagcaggcagact

SEQ ID NO: 261610 - DNA, 25 bp, Homo sapien
ctgattcctgacaatgccaacgtct

SEQ ID NO: 261611 - DNA, 25 bp, Homo sapien
tcctgacaatgccaacgtcttctat

SEQ ID NO: 261612 - DNA, 25 bp, Homo sapien
tcttctatgccatgagtccagtcgc

SEQ ID NO: 261613 - DNA, 25 bp, Homo sapien
ttctatgccatgagtccagtcgccc

SEQ ID NO: 261614 - DNA, 25 bp, Homo sapien
cagagacttcatgctgcggcggaaa

SEQ ID NO: 261615 - DNA, 25 bp, Homo sapien
agacttcatgctgcggcggaaagag

SEQ ID NO: 261616 - DNA, 25 bp, Homo sapien
gggacccggaacactctgtctgtct

SEQ ID NO: 261617 - DNA, 25 bp, Homo sapien
tgtctgtctccccaagctgaggcag

SEQ ID NO: 261618 - DNA, 25 bp, Homo sapien
acaagacacaagtcccacaggcaag

SEQ ID NO: 261619 - DNA, 25 bp, Homo sapien
aagtcccacaggcaagcttgcgact

SEQ ID NO: 261620 - DNA, 25 bp, Homo sapien
ccacaggcaagcttgcgactcttct

SEQ ID NO: 261621 - DNA, 25 bp, Homo sapien
aaggtaagccagtgccgctgcttca

SEQ ID NO: 261622 - DNA, 25 bp, Homo sapien
gccgctgcttcatgttctgctttat

SEQ ID NO: 261623 - DNA, 25 bp, Homo sapien
tttatcccatcacgcccagaggagg

SEQ ID NO: 261624 - DNA, 25 bp, Homo sapien
agttctggctcaagagacgggccac

SEQ ID NO: 261625 - DNA, 25 bp, Homo sapien
agggcccaatgtcgctgcaaacaca

SEQ ID NO: 261626 - DNA, 25 bp, Homo sapien
acagccacgaagaacatgcagccac

SEQ ID NO: 261627 - DNA, 25 bp, Homo sapien
aggcatcatggctgttgctgcggct

SEQ ID NO: 261628 - DNA, 25 bp, Homo sapien
ccagatgcttttgtggacacttgtt

SEQ ID NO: 261629 - DNA, 25 bp, Homo sapien
gacacttgttgagagagcaccggat

SEQ ID NO: 261630 - DNA, 25 bp, Homo sapien
gatcatctcagacatatcggtgccc

SEQ ID NO: 261631 - DNA, 25 bp, Homo sapien
ggtgccctgcaaggtaagccagtgc

SEQ ID NO: 261632 - DNA, 25 bp, Homo sapien
ggagtccggaggagcagtctcttct

SEQ ID NO: 261633 - DNA, 25 bp, Homo sapien
agcagtctcttctgtcccgctggaa

SEQ ID NO: 261634 - DNA, 25 bp, Homo sapien
gctggaacccatggtccactgaagt

SEQ ID NO: 261635 - DNA, 25 bp, Homo sapien
ttgcaagttgtctgggttcatgtct

SEQ ID NO: 261636 - DNA, 25 bp, Homo sapien
gggttcatgtctaagcttgttccag

SEQ ID NO: 261637 - DNA, 25 bp, Homo sapien
gaatgcccacaagaattcaactgga

SEQ ID NO: 261638 - DNA, 25 bp, Homo sapien
aagaattcaactggatctggaagag

SEQ ID NO: 261639 - DNA, 25 bp, Homo sapien
gatggtgttaactgaacccattttg

SEQ ID NO: 261640 - DNA, 25 bp, Homo sapien
gaacccattttgattgagacctaca

SEQ ID NO: 261641 - DNA, 25 bp, Homo sapien
gagacctacacagggctgatgtcat

SEQ ID NO: 261642 - DNA, 25 bp, Homo sapien
gatgtcattcattggaaaccgcaac

SEQ ID NO: 261643 - DNA, 25 bp, Homo sapien
agcgagcactggtgttcgagccctg

SEQ ID NO: 261644 - DNA, 25 bp, Homo sapien
ctgccttattacaggataccccatt

SEQ ID NO: 261645 - DNA, 25 bp, Homo sapien
tattacaggataccccattctgagg

SEQ ID NO: 261646 - DNA, 25 bp, Homo sapien
ggataccccattctgaggaacaaaa

SEQ ID NO: 261647 - DNA, 25 bp, Homo sapien
ggctgctaacaaggacaactggaat

SEQ ID NO: 261648 - DNA, 25 bp, Homo sapien
gaataaattccttatggccatcaag

SEQ ID NO: 261649 - DNA, 25 bp, Homo sapien
ttatggccatcaagacctcccacag

SEQ ID NO: 261650 - DNA, 25 bp, Homo sapien
aattcatcagtcagtggtgtggagg

SEQ ID NO: 261651 - DNA, 25 bp, Homo sapien
tggagggctccccagcaccagcttt

SEQ ID NO: 261652 - DNA, 25 bp, Homo sapien
gaggaagagttagggcctctccctc

SEQ ID NO: 261653 - DNA, 25 bp, Homo sapien
ggcctctccctcattaaagttttat

SEQ ID NO: 261654 - DNA, 25 bp, Homo sapien
tgtaagacgggacattttctgaaat

SEQ ID NO: 261655 - DNA, 25 bp, Homo sapien
aacatgaagtaagaagctttgtccc

SEQ ID NO: 261656 - DNA, 25 bp, Homo sapien
aatatggacatctgggtggtgtcat

SEQ ID NO: 261657 - DNA, 25 bp, Homo sapien
gccaggaggaaggatttgccaaaat

SEQ ID NO: 261658 - DNA, 25 bp, Homo sapien
ggatttgccaaaatgggtaaactgg

SEQ ID NO: 261659 - DNA, 25 bp, Homo sapien
gtaaactgggcagtgcatgaaaact

SEQ ID NO: 261660 - DNA, 25 bp, Homo sapien
gcatgaaaactggtgcctttgctcc

SEQ ID NO: 261661 - DNA, 25 bp, Homo sapien
aaaactggtgcctttgctcctatgg

SEQ ID NO: 261662 - DNA, 25 bp, Homo sapien
tggtgcctttgctcctatgggccat

SEQ ID NO: 261663 - DNA, 25 bp, Homo sapien
tatgggccatcatcctgttgatagt

SEQ ID NO: 261664 - DNA, 25 bp, Homo sapien
atcctgttgatagtgaggtaccaag

SEQ ID NO: 261665 - DNA, 25 bp, Homo sapien
gaaaactatgcgaaggacagcttgc

SEQ ID NO: 261666 - DNA, 25 bp, Homo sapien
aaggacagcttgcagtggatcaccg

SEQ ID NO: 261667 - DNA, 25 bp, Homo sapien
ggatcaccgaccagtataacaagga

SEQ ID NO: 261668 - DNA, 25 bp, Homo sapien
gtgatgacaagtaccacttcaggat

SEQ ID NO: 261669 - DNA, 25 bp, Homo sapien
aagtaccacttcaggatcttccgag

SEQ ID NO: 261670 - DNA, 25 bp, Homo sapien
gatcttccgagtccttaaagtccag

SEQ ID NO: 261671 - DNA, 25 bp, Homo sapien
aactgcttcttctcagtgtttgctg

SEQ ID NO: 261672 - DNA, 25 bp, Homo sapien
gtgtttgctgtaccctggtttgaac

SEQ ID NO: 261673 - DNA, 25 bp, Homo sapien
aactgcggccactgcatgtgagaga

SEQ ID NO: 261674 - DNA, 25 bp, Homo sapien
gaatcctgcaatgggcaataatcct

SEQ ID NO: 261675 - DNA, 25 bp, Homo sapien
aaaacctttctaagcgtccatgaag

SEQ ID NO: 261676 - DNA, 25 bp, Homo sapien
ccttgagagtttgactagtgcaaca

SEQ ID NO: 261677 - DNA, 25 bp, Homo sapien
tctcctactattgattcctttacaa

SEQ ID NO: 261678 - DNA, 25 bp, Homo sapien
aaaatggttttattcctgtgctcga

SEQ ID NO: 261679 - DNA, 25 bp, Homo sapien
gttttattcctgtgctcgagcaaaa

SEQ ID NO: 261680 - DNA, 25 bp, Homo sapien
gctcgagcaaaacctactcttttta

SEQ ID NO: 261681 - DNA, 25 bp, Homo sapien
aacctactctttttatgtattctca

SEQ ID NO: 261682 - DNA, 25 bp, Homo sapien
atgtattctcaattttcagccctag

SEQ ID NO: 261683 - DNA, 25 bp, Homo sapien
ctattgattcctttacaactatttc

SEQ ID NO: 261684 - DNA, 25 bp, Homo sapien
aattttcagccctagaatgtgttat

SEQ ID NO: 261685 - DNA, 25 bp, Homo sapien
ctctcccaaagatctaaaagttatg

SEQ ID NO: 261686 - DNA, 25 bp, Homo sapien
gaaatatttccttgagagtttgact

SEQ ID NO: 261687 - DNA, 25 bp, Homo sapien
tcttatactgtaaacatgtggttcc

SEQ ID NO: 261688 - DNA, 25 bp, Homo sapien
catgtggttccaattctgaggtatt

SEQ ID NO: 261689 - DNA, 25 bp, Homo sapien
tccaattctgaggtattttcccggc

SEQ ID NO: 261690 - DNA, 25 bp, Homo sapien
gacccaaaaagaagttaggcttgag

SEQ ID NO: 261691 - DNA, 25 bp, Homo sapien
agagaacaattctagttcagagtga

SEQ ID NO: 261692 - DNA, 25 bp, Homo sapien
aaaagctgacatttgactgaaaatt

SEQ ID NO: 261693 - DNA, 25 bp, Homo sapien
gaaacaataccttttacggcatgta

SEQ ID NO: 261694 - DNA, 25 bp, Homo sapien
tacggcatgtaataggaagaagacc

SEQ ID NO: 261695 - DNA, 25 bp, Homo sapien
gaagacctggattttagttgctgct

SEQ ID NO: 261696 - DNA, 25 bp, Homo sapien
ctgctctgatgtcccaacttgggta

SEQ ID NO: 261697 - DNA, 25 bp, Homo sapien
tcccaacttgggtaaggcaacataa

SEQ ID NO: 261698 - DNA, 25 bp, Homo sapien
agttcatcaccgactcagtttcccc

SEQ ID NO: 261699 - DNA, 25 bp, Homo sapien
agtttccccatgtgtatgctgtggt

SEQ ID NO: 261700 - DNA, 25 bp, Homo sapien
ggtattggatcagcaacgagataag

SEQ ID NO: 261701 - DNA, 25 bp, Homo sapien
gtattggatcagcaacgagataaga

SEQ ID NO: 261702 - DNA, 25 bp, Homo sapien
ttggatcagcaacgagataagaaga

SEQ ID NO: 261703 - DNA, 25 bp, Homo sapien
tggatcagcaacgagataagaagat

SEQ ID NO: 261704 - DNA, 25 bp, Homo sapien
tcagcaacgagataagaagatctct

SEQ ID NO: 261705 - DNA, 25 bp, Homo sapien
gattctgaggcacaaggtcacattt

SEQ ID NO: 261706 - DNA, 25 bp, Homo sapien
attctgaggcacaaggtcacatttg

SEQ ID NO: 261707 - DNA, 25 bp, Homo sapien
ttctgaggcacaaggtcacatttga

SEQ ID NO: 261708 - DNA, 25 bp, Homo sapien
tctgaggcacaaggtcacatttgac

SEQ ID NO: 261709 - DNA, 25 bp, Homo sapien
tattatattaatctcccagaatcag

SEQ ID NO: 261710 - DNA, 25 bp, Homo sapien
atctctgacatgtttcgttgattcc

SEQ ID NO: 261711 - DNA, 25 bp, Homo sapien
tctctgacatgtttcgttgattcct

SEQ ID NO: 261712 - DNA, 25 bp, Homo sapien
ctctgacatgtttcgttgattcctg

SEQ ID NO: 261713 - DNA, 25 bp, Homo sapien
ttttccctaaatgctttattagact

SEQ ID NO: 261714 - DNA, 25 bp, Homo sapien
aatgctttattagacttttctcata

SEQ ID NO: 261715 - DNA, 25 bp, Homo sapien
gctttattagacttttctcataagt

SEQ ID NO: 261716 - DNA, 25 bp, Homo sapien
ctcataagttttgactggtactgtt

SEQ ID NO: 261717 - DNA, 25 bp, Homo sapien
taagttttgactggtactgttttca

SEQ ID NO: 261718 - DNA, 25 bp, Homo sapien
gttttgactggtactgttttcattg

SEQ ID NO: 261719 - DNA, 25 bp, Homo sapien
ttgactggtactgttttcattgtta

SEQ ID NO: 261720 - DNA, 25 bp, Homo sapien
gagccatctgcctgaagttgaacct

SEQ ID NO: 261721 - DNA, 25 bp, Homo sapien
aagttgaacctcattcttccttgtt

SEQ ID NO: 261722 - DNA, 25 bp, Homo sapien
cactggtcactcctatgtgctaaga

SEQ ID NO: 261723 - DNA, 25 bp, Homo sapien
gtgctaagacaaggcagacatctgt

SEQ ID NO: 261724 - DNA, 25 bp, Homo sapien
tcaagatctatcatcatttagctcc

SEQ ID NO: 261725 - DNA, 25 bp, Homo sapien
ctgtgtgttctcttaagtctttgga

SEQ ID NO: 261726 - DNA, 25 bp, Homo sapien
ggaaatcttgagcagtctaagcctt

SEQ ID NO: 261727 - DNA, 25 bp, Homo sapien
atttagctcctgaaagtccacactt

SEQ ID NO: 261728 - DNA, 25 bp, Homo sapien
aaagtccacacttaagtagagcctt

SEQ ID NO: 261729 - DNA, 25 bp, Homo sapien
gtagagccttagacctacagggaaa

SEQ ID NO: 261730 - DNA, 25 bp, Homo sapien
gggaaagtgctgtctctgtagtatt

SEQ ID NO: 261731 - DNA, 25 bp, Homo sapien
agcaccacactgtcaaaatgttgga

SEQ ID NO: 261732 - DNA, 25 bp, Homo sapien
tattggtattgcatagacacttgat

SEQ ID NO: 261733 - DNA, 25 bp, Homo sapien
gacacttgatgcctaaacctaataa

SEQ ID NO: 261734 - DNA, 25 bp, Homo sapien
aacttttatgtgcaagcttgggttc

SEQ ID NO: 261735 - DNA, 25 bp, Homo sapien
gcttgggttcttgactaattggtaa

SEQ ID NO: 261736 - DNA, 25 bp, Homo sapien
gaactagattagatccaattattag

SEQ ID NO: 261737 - DNA, 25 bp, Homo sapien
aaggcacagtgaacttcattcaaat

SEQ ID NO: 261738 - DNA, 25 bp, Homo sapien
gtgaacttcattcaaatgcagtgtg

SEQ ID NO: 261739 - DNA, 25 bp, Homo sapien
caaatgcagtgtggaactctcaggt

SEQ ID NO: 261740 - DNA, 25 bp, Homo sapien
gaactctcaggtttccttggtctgc

SEQ ID NO: 261741 - DNA, 25 bp, Homo sapien
tactcatcagcaccacactgtcaaa

SEQ ID NO: 261742 - DNA, 25 bp, Homo sapien
gagtgctaaggtgacactccaccaa

SEQ ID NO: 261743 - DNA, 25 bp, Homo sapien
gtgacactccaccaaccagagtgag

SEQ ID NO: 261744 - DNA, 25 bp, Homo sapien
ggcaggattctatgagtggttatac

SEQ ID NO: 261745 - DNA, 25 bp, Homo sapien
gacaaaactgcccaagaagaatctt

SEQ ID NO: 261746 - DNA, 25 bp, Homo sapien
tgagaatacactctttcaaggtggg

SEQ ID NO: 261747 - DNA, 25 bp, Homo sapien
atactctttagagggtacactgagc

SEQ ID NO: 261748 - DNA, 25 bp, Homo sapien
ctgagctaatactaccagttcttta

SEQ ID NO: 261749 - DNA, 25 bp, Homo sapien
agttctttatgagcactggaatgtg

SEQ ID NO: 261750 - DNA, 25 bp, Homo sapien
gtcctaagtttagcaaggtagtcta

SEQ ID NO: 261751 - DNA, 25 bp, Homo sapien
aggtagtctacagaaccatgctccc

SEQ ID NO: 261752 - DNA, 25 bp, Homo sapien
gaaccatgctcccacattatagata

SEQ ID NO: 261753 - DNA, 25 bp, Homo sapien
tattttgaatggtactttgtggaaa

SEQ ID NO: 261754 - DNA, 25 bp, Homo sapien
agttatgctgtgtacatcacttgca

SEQ ID NO: 261755 - DNA, 25 bp, Homo sapien
atgctgtgtacatcacttgcagatc

SEQ ID NO: 261756 - DNA, 25 bp, Homo sapien
gtgtacatcacttgcagatcaccaa

SEQ ID NO: 261757 - DNA, 25 bp, Homo sapien
gtacatcacttgcagatcaccaaaa

SEQ ID NO: 261758 - DNA, 25 bp, Homo sapien
agatcaccaaaaacactccgctgcc

SEQ ID NO: 261759 - DNA, 25 bp, Homo sapien
gtgaccgccggtgggtgtgtccccg

SEQ ID NO: 261760 - DNA, 25 bp, Homo sapien
gcaggtgtgcctcccagcggattat

SEQ ID NO: 261761 - DNA, 25 bp, Homo sapien
gtgtgcctcccagcggattatttat

SEQ ID NO: 261762 - DNA, 25 bp, Homo sapien
ctcccagcggattatttattgtaga

SEQ ID NO: 261763 - DNA, 25 bp, Homo sapien
gcaaaggtatattgatatgcatttt

SEQ ID NO: 261764 - DNA, 25 bp, Homo sapien
gatatgctttttgagttggatactt

SEQ ID NO: 261765 - DNA, 25 bp, Homo sapien
ggatacttaaatgcaccaaccaaag

SEQ ID NO: 261766 - DNA, 25 bp, Homo sapien
atgcaccaaccaaagcaatgttttg

SEQ ID NO: 261767 - DNA, 25 bp, Homo sapien
atttacaacaaacattctcaagaag

SEQ ID NO: 261768 - DNA, 25 bp, Homo sapien
tactatatacaatcagtctgcagag

SEQ ID NO: 261769 - DNA, 25 bp, Homo sapien
gtctgcagagactgttatgtgtctg

SEQ ID NO: 261770 - DNA, 25 bp, Homo sapien
gttatgtgtctgtttgcctttgtac

SEQ ID NO: 261771 - DNA, 25 bp, Homo sapien
gtctgtttgcctttgtacatatata

SEQ ID NO: 261772 - DNA, 25 bp, Homo sapien
tgaataatcattgtgcatctccatt

SEQ ID NO: 261773 - DNA, 25 bp, Homo sapien
tgtgcatctccattaatgttgttct

SEQ ID NO: 261774 - DNA, 25 bp, Homo sapien
gttgttctttgctttgtatataaat

SEQ ID NO: 261775 - DNA, 25 bp, Homo sapien
gcagtacaatcacacagggacacag

SEQ ID NO: 261776 - DNA, 25 bp, Homo sapien
cagtacaatcacacagggacacagt

SEQ ID NO: 261777 - DNA, 25 bp, Homo sapien
agtacaatcacacagggacacagtt

SEQ ID NO: 261778 - DNA, 25 bp, Homo sapien
gtacaatcacacagggacacagttc

SEQ ID NO: 261779 - DNA, 25 bp, Homo sapien
aattaagaagagcagacctctgaca

SEQ ID NO: 261780 - DNA, 25 bp, Homo sapien
cagagagctgcagtacaatcacaca

SEQ ID NO: 261781 - DNA, 25 bp, Homo sapien
agagagctgcagtacaatcacacag

SEQ ID NO: 261782 - DNA, 25 bp, Homo sapien
gagagctgcagtacaatcacacagg

SEQ ID NO: 261783 - DNA, 25 bp, Homo sapien
agagctgcagtacaatcacacaggg

SEQ ID NO: 261784 - DNA, 25 bp, Homo sapien
gagctgcagtacaatcacacaggga

SEQ ID NO: 261785 - DNA, 25 bp, Homo sapien
agctgcagtacaatcacacagggac

SEQ ID NO: 261786 - DNA, 25 bp, Homo sapien
aggtcagtttacaaacatctacact

SEQ ID NO: 261787 - DNA, 25 bp, Homo sapien
tacaaacatctacactgcaaaccca

SEQ ID NO: 261788 - DNA, 25 bp, Homo sapien
aaacatctacactgcaaacccaagg

SEQ ID NO: 261789 - DNA, 25 bp, Homo sapien
acatctacactgcaaacccaaggga

SEQ ID NO: 261790 - DNA, 25 bp, Homo sapien
atctacactgcaaacccaagggaaa

SEQ ID NO: 261791 - DNA, 25 bp, Homo sapien
acactgcaaacccaagggaaagtga

SEQ ID NO: 261792 - DNA, 25 bp, Homo sapien
gttattttatggaattctctataga

SEQ ID NO: 261793 - DNA, 25 bp, Homo sapien
ggatgtaagcagtatgtaaggaaac

SEQ ID NO: 261794 - DNA, 25 bp, Homo sapien
aacttagcttcatcatatactctgc

SEQ ID NO: 261795 - DNA, 25 bp, Homo sapien
tatactctgcaatatttaacatagt

SEQ ID NO: 261796 - DNA, 25 bp, Homo sapien
actatcacagataagaccaaaggtc

SEQ ID NO: 261797 - DNA, 25 bp, Homo sapien
gtgaacagcccggtgaatgccgatg

SEQ ID NO: 261798 - DNA, 25 bp, Homo sapien
agcccggtgaatgccgatgcctaga

SEQ ID NO: 261799 - DNA, 25 bp, Homo sapien
atgccgatgcctagagggctggact

SEQ ID NO: 261800 - DNA, 25 bp, Homo sapien
tgacgggaacccgtgtgccaatgga

SEQ ID NO: 261801 - DNA, 25 bp, Homo sapien
ggaggcagctgtagtgagacaccca

SEQ ID NO: 261802 - DNA, 25 bp, Homo sapien
tagtgagacacccaggtcctttgaa

SEQ ID NO: 261803 - DNA, 25 bp, Homo sapien
agacacccaggtcctttgaatgcac

SEQ ID NO: 261804 - DNA, 25 bp, Homo sapien
tttgaatgcacctgcccgcgtgggt

SEQ ID NO: 261805 - DNA, 25 bp, Homo sapien
cacctgcccgcgtgggttctacggg

SEQ ID NO: 261806 - DNA, 25 bp, Homo sapien
ggttctacgggctgcggtgtgaggt

SEQ ID NO: 261807 - DNA, 25 bp, Homo sapien
ggtgacatgtgcagatggaccctgc

SEQ ID NO: 261808 - DNA, 25 bp, Homo sapien
gagacctttaggttttcatctactt

SEQ ID NO: 261809 - DNA, 25 bp, Homo sapien
atctactttaagattgctctcttgg

SEQ ID NO: 261810 - DNA, 25 bp, Homo sapien
aagattgctctcttggcaattaggg

SEQ ID NO: 261811 - DNA, 25 bp, Homo sapien
aaagatgccatgtgttgctagtaca

SEQ ID NO: 261812 - DNA, 25 bp, Homo sapien
tacacagttataggatatggtttct

SEQ ID NO: 261813 - DNA, 25 bp, Homo sapien
gttgaattttgaggaactctcccta

SEQ ID NO: 261814 - DNA, 25 bp, Homo sapien
gaggaactctccctaaagaatgagt

SEQ ID NO: 261815 - DNA, 25 bp, Homo sapien
gaatgagttttatatctcctcaagg

SEQ ID NO: 261816 - DNA, 25 bp, Homo sapien
atctgtttattcttcagtgagtcct

SEQ ID NO: 261817 - DNA, 25 bp, Homo sapien
attcttcagtgagtccttttgaatt

SEQ ID NO: 261818 - DNA, 25 bp, Homo sapien
ctaagtctgtgtaagtgcttatgta

SEQ ID NO: 261819 - DNA, 25 bp, Homo sapien
gcagtgtccttgctggccttgcaaa

SEQ ID NO: 261820 - DNA, 25 bp, Homo sapien
gtccttgctggccttgcaaaatgag

SEQ ID NO: 261821 - DNA, 25 bp, Homo sapien
ctggccttgcaaaatgagttgggaa

SEQ ID NO: 261822 - DNA, 25 bp, Homo sapien
gagttgggaagggttgattccatcc

SEQ ID NO: 261823 - DNA, 25 bp, Homo sapien
ccatcctcttcaagttgtggaaaga

SEQ ID NO: 261824 - DNA, 25 bp, Homo sapien
gaagggtggtgttaattcttctctt

SEQ ID NO: 261825 - DNA, 25 bp, Homo sapien
agtcctcgcagtccgcctgagagag

SEQ ID NO: 261826 - DNA, 25 bp, Homo sapien
gcagtccgcctgagagagtagagaa

SEQ ID NO: 261827 - DNA, 25 bp, Homo sapien
cgcctgagagagtagagaagacccc

SEQ ID NO: 261828 - DNA, 25 bp, Homo sapien
gagtagagaagaccccctcccagaa

SEQ ID NO: 261829 - DNA, 25 bp, Homo sapien
tcccagaaccttcctgtaaggtctc

SEQ ID NO: 261830 - DNA, 25 bp, Homo sapien
ttgtacccagggttcatgattactg

SEQ ID NO: 261831 - DNA, 25 bp, Homo sapien
gttcatgattactgtgacccactaa

SEQ ID NO: 261832 - DNA, 25 bp, Homo sapien
tgtgacccactaagggacgatcttt

SEQ ID NO: 261833 - DNA, 25 bp, Homo sapien
gacgatctttgaggaaacagacctg

SEQ ID NO: 261834 - DNA, 25 bp, Homo sapien
gtgagtgggttttacagactgcttt

SEQ ID NO: 261835 - DNA, 25 bp, Homo sapien
agactgctttgtggcgacattcagg

SEQ ID NO: 261836 - DNA, 25 bp, Homo sapien
ggcgacattcaggaacagaccattc

SEQ ID NO: 261837 - DNA, 25 bp, Homo sapien
gaccattcaatggatgacttttcag

SEQ ID NO: 261838 - DNA, 25 bp, Homo sapien
caatggatgacttttcagtacataa

SEQ ID NO: 261839 - DNA, 25 bp, Homo sapien
aaagcaagcagtaatggccaggaga

SEQ ID NO: 261840 - DNA, 25 bp, Homo sapien
aatggccaggagagagcaaagatgc

SEQ ID NO: 261841 - DNA, 25 bp, Homo sapien
tttctctggagatgacctagaatgc

SEQ ID NO: 261842 - DNA, 25 bp, Homo sapien
tctctggagatgacctagaatgcag

SEQ ID NO: 261843 - DNA, 25 bp, Homo sapien
tctggagatgacctagaatgcagag

SEQ ID NO: 261844 - DNA, 25 bp, Homo sapien
cagcaagatgtatgagacgagactt

SEQ ID NO: 261845 - DNA, 25 bp, Homo sapien
agatgtatgagacgagactttgtta

SEQ ID NO: 261846 - DNA, 25 bp, Homo sapien
gagacgagactttgttaagcacctt

SEQ ID NO: 261847 - DNA, 25 bp, Homo sapien
gacgagactttgttaagcaccttaa

SEQ ID NO: 261848 - DNA, 25 bp, Homo sapien
acgagactttgttaagcaccttaag

SEQ ID NO: 261849 - DNA, 25 bp, Homo sapien
gagactttgttaagcaccttaagaa

SEQ ID NO: 261850 - DNA, 25 bp, Homo sapien
gttaagcaccttaagaagaaactga

SEQ ID NO: 261851 - DNA, 25 bp, Homo sapien
aactgaaacgtatgatttgagaata

SEQ ID NO: 261852 - DNA, 25 bp, Homo sapien
atttgcgagaagacagctgccccag

SEQ ID NO: 261853 - DNA, 25 bp, Homo sapien
aggatttggattagtatgcttcttc

SEQ ID NO: 261854 - DNA, 25 bp, Homo sapien
gtaagagacttgtgagtaagctcat

SEQ ID NO: 261855 - DNA, 25 bp, Homo sapien
agaacttgaccagatcaatggatcc

SEQ ID NO: 261856 - DNA, 25 bp, Homo sapien
gaggaaactacggtaccagagccaa

SEQ ID NO: 261857 - DNA, 25 bp, Homo sapien
ggtaccagagccaaaccagctttta

SEQ ID NO: 261858 - DNA, 25 bp, Homo sapien
gactgtgtatttacattatcagaca

SEQ ID NO: 261859 - DNA, 25 bp, Homo sapien
tgaacttgtttaacagaacattctc

SEQ ID NO: 261860 - DNA, 25 bp, Homo sapien
ggatccaaaggatgtgcttattttc

SEQ ID NO: 261861 - DNA, 25 bp, Homo sapien
tatttatatttctcgctgtagtgct

SEQ ID NO: 261862 - DNA, 25 bp, Homo sapien
cgctgtagtgctgaaattttttgga

SEQ ID NO: 261863 - DNA, 25 bp, Homo sapien
ctgaggctcggcacgttgaaatggc

SEQ ID NO: 261864 - DNA, 25 bp, Homo sapien
cggcacgttgaaatggcttgaccaa

SEQ ID NO: 261865 - DNA, 25 bp, Homo sapien
tgaccaaggtcccacaggcaaaaaa

SEQ ID NO: 261866 - DNA, 25 bp, Homo sapien
attgtaacccaatatctggctgcaa

SEQ ID NO: 261867 - DNA, 25 bp, Homo sapien
atatctggctgcaaaacccagtctc

SEQ ID NO: 261868 - DNA, 25 bp, Homo sapien
ccacctatcgtcaccgagattgtaa

SEQ ID NO: 261869 - DNA, 25 bp, Homo sapien
ggaagaatcaaatacatgcacaacg

SEQ ID NO: 261870 - DNA, 25 bp, Homo sapien
ttctccactgatcactcagaacatg

SEQ ID NO: 261871 - DNA, 25 bp, Homo sapien
atcactcagaacatggtaggcccta

SEQ ID NO: 261872 - DNA, 25 bp, Homo sapien
gccctagagagacagcagcccgaat

SEQ ID NO: 261873 - DNA, 25 bp, Homo sapien
acagcagcccgaatcttcccagaaa

SEQ ID NO: 261874 - DNA, 25 bp, Homo sapien
agaggttgctccgtggtccttgcac

SEQ ID NO: 261875 - DNA, 25 bp, Homo sapien
aagcttgccagggtgcatcaaatta

SEQ ID NO: 261876 - DNA, 25 bp, Homo sapien
tatactttgactctacttctaccag

SEQ ID NO: 261877 - DNA, 25 bp, Homo sapien
ttctaccagccagagaaaactgctt

SEQ ID NO: 261878 - DNA, 25 bp, Homo sapien
taaagggctcttgtgactagtttaa

SEQ ID NO: 261879 - DNA, 25 bp, Homo sapien
gactagtttaagcacacccagattg

SEQ ID NO: 261880 - DNA, 25 bp, Homo sapien
gaattcgcttccagcctgagtaaag

SEQ ID NO: 261881 - DNA, 25 bp, Homo sapien
tttaattacatctgccaagtccctc

SEQ ID NO: 261882 - DNA, 25 bp, Homo sapien
agaggatggaggtccctgtctccta

SEQ ID NO: 261883 - DNA, 25 bp, Homo sapien
ctgtctcctagctgactgtcaaatc

SEQ ID NO: 261884 - DNA, 25 bp, Homo sapien
atctgatcctttagaggttgctccg

SEQ ID NO: 261885 - DNA, 25 bp, Homo sapien
tcatgggtctcaggtctcctggaaa

SEQ ID NO: 261886 - DNA, 25 bp, Homo sapien
ggaacagcaattagcccactgctat

SEQ ID NO: 261887 - DNA, 25 bp, Homo sapien
cactgctatttagggcctttgtaaa

SEQ ID NO: 261888 - DNA, 25 bp, Homo sapien
agaactttgtcttttccaggtgagt

SEQ ID NO: 261889 - DNA, 25 bp, Homo sapien
gatgattcggagcttaggctttctc

SEQ ID NO: 261890 - DNA, 25 bp, Homo sapien
tttctctcccgtgtcaggaatcagt

SEQ ID NO: 261891 - DNA, 25 bp, Homo sapien
gtcagatgaagcctgctgcacgcgt

SEQ ID NO: 261892 - DNA, 25 bp, Homo sapien
cgtccctgtctagatcttgattcaa

SEQ ID NO: 261893 - DNA, 25 bp, Homo sapien
atatgcatttggatctccgtggatg

SEQ ID NO: 261894 - DNA, 25 bp, Homo sapien
ttccgctccagtaggttccagatta

SEQ ID NO: 261895 - DNA, 25 bp, Homo sapien
ttttttatccccaagctctttcctg

SEQ ID NO: 261896 - DNA, 25 bp, Homo sapien
tccagtggtgacagagctcagtgtg

SEQ ID NO: 261897 - DNA, 25 bp, Homo sapien
acagagctcagtgtgggtccagaga

SEQ ID NO: 261898 - DNA, 25 bp, Homo sapien
cagagctcagtgtgggtccagagat

SEQ ID NO: 261899 - DNA, 25 bp, Homo sapien
tcagtgtgggtccagagatggtgtc

SEQ ID NO: 261900 - DNA, 25 bp, Homo sapien
gcaagtgccccttgagatgggctga

SEQ ID NO: 261901 - DNA, 25 bp, Homo sapien
gtgccccttgagatgggctgaacgt

SEQ ID NO: 261902 - DNA, 25 bp, Homo sapien
cttgagatgggctgaacgtgatgat

SEQ ID NO: 261903 - DNA, 25 bp, Homo sapien
aacgtgatgatgatctgtggccagt

SEQ ID NO: 261904 - DNA, 25 bp, Homo sapien
agaagtcttgaggttgggaatataa

SEQ ID NO: 261905 - DNA, 25 bp, Homo sapien
gggaatataagaattaggtctcttt

SEQ ID NO: 261906 - DNA, 25 bp, Homo sapien
tacagtagggaagagcatgtggcaa

SEQ ID NO: 261907 - DNA, 25 bp, Homo sapien
tcccaggcctgtccctagggacaag

SEQ ID NO: 261908 - DNA, 25 bp, Homo sapien
tccctagggacaaggcccagggaag

SEQ ID NO: 261909 - DNA, 25 bp, Homo sapien
agctgaactggagtcaatcaccctt

SEQ ID NO: 261910 - DNA, 25 bp, Homo sapien
atcaccaaactgctggaactctcca

SEQ ID NO: 261911 - DNA, 25 bp, Homo sapien
tggaactctccagccaaatgctggg

SEQ ID NO: 261912 - DNA, 25 bp, Homo sapien
acctggagggtgagtctttgctgac

SEQ ID NO: 261913 - DNA, 25 bp, Homo sapien
gtgagtctttgctgacctctctcta

SEQ ID NO: 261914 - DNA, 25 bp, Homo sapien
tctactctcaggcatgtcttttgtc

SEQ ID NO: 261915 - DNA, 25 bp, Homo sapien
tcttttgtccttttcgtccatctat

SEQ ID NO: 261916 - DNA, 25 bp, Homo sapien
ttttcgtccatctatttctgtctgt

SEQ ID NO: 261917 - DNA, 25 bp, Homo sapien
atctatttctgtctgtcgctcactc

SEQ ID NO: 261918 - DNA, 25 bp, Homo sapien
ggccaatgacctgaaattatcactg

SEQ ID NO: 261919 - DNA, 25 bp, Homo sapien
aaattatcactgtatttgcagcaga

SEQ ID NO: 261920 - DNA, 25 bp, Homo sapien
gaattttgagccaatgcaagcattt

SEQ ID NO: 261921 - DNA, 25 bp, Homo sapien
tttaaatcttcctgggtcccaagca

SEQ ID NO: 261922 - DNA, 25 bp, Homo sapien
gctcttctgagaaaaacctgaacgt

SEQ ID NO: 261923 - DNA, 25 bp, Homo sapien
ctgaacgttggatgtactatgggca

SEQ ID NO: 261924 - DNA, 25 bp, Homo sapien
actatgggcattacaactatggaca

SEQ ID NO: 261925 - DNA, 25 bp, Homo sapien
gactactggcagaaatgaacaccat

SEQ ID NO: 261926 - DNA, 25 bp, Homo sapien
acatccttcagaatgattttcatgg

SEQ ID NO: 261927 - DNA, 25 bp, Homo sapien
gaattgaagccttgaagaactacca

SEQ ID NO: 261928 - DNA, 25 bp, Homo sapien
gaagaactaccagaaggccaatgac

SEQ ID NO: 261929 - DNA, 25 bp, Homo sapien
gtttatagtttaaagcaaactgttg

SEQ ID NO: 261930 - DNA, 25 bp, Homo sapien
tttatagtttaaagcaaactgttgt

SEQ ID NO: 261931 - DNA, 25 bp, Homo sapien
ttatagtttaaagcaaactgttgtt

SEQ ID NO: 261932 - DNA, 25 bp, Homo sapien
tatagtttaaagcaaactgttgttt

SEQ ID NO: 261933 - DNA, 25 bp, Homo sapien
aaagtatctaacagggccgggcgcg

SEQ ID NO: 261934 - DNA, 25 bp, Homo sapien
aagtatctaacagggccgggcgcgg

SEQ ID NO: 261935 - DNA, 25 bp, Homo sapien
agtatctaacagggccgggcgcggt

SEQ ID NO: 261936 - DNA, 25 bp, Homo sapien
gtatctaacagggccgggcgcggtg

SEQ ID NO: 261937 - DNA, 25 bp, Homo sapien
tatctaacagggccgggcgcggtgg

SEQ ID NO: 261938 - DNA, 25 bp, Homo sapien
atagctgggtgtggcggcgtgcgcc

SEQ ID NO: 261939 - DNA, 25 bp, Homo sapien
tgggtgtggcggcgtgcgcctgtag

SEQ ID NO: 261940 - DNA, 25 bp, Homo sapien
gaactgtatccatttagtcatagcc

SEQ ID NO: 261941 - DNA, 25 bp, Homo sapien
gtatccatttagtcatagcctttgt

SEQ ID NO: 261942 - DNA, 25 bp, Homo sapien
ctctgctgaaacaatctcccaaatc

SEQ ID NO: 261943 - DNA, 25 bp, Homo sapien
gctgaaacaatctcccaaatccata

SEQ ID NO: 261944 - DNA, 25 bp, Homo sapien
gaaacaatctcccaaatccataggg

SEQ ID NO: 261945 - DNA, 25 bp, Homo sapien
acaatctcccaaatccatagggatt

SEQ ID NO: 261946 - DNA, 25 bp, Homo sapien
tccatagggatttggtcttttaaat

SEQ ID NO: 261947 - DNA, 25 bp, Homo sapien
agtaaatgcttcaatcatctttttt

SEQ ID NO: 261948 - DNA, 25 bp, Homo sapien
tacaaactagttatatgtagaggct

SEQ ID NO: 261949 - DNA, 25 bp, Homo sapien
atcttgttttgttgtgagctattaa

SEQ ID NO: 261950 - DNA, 25 bp, Homo sapien
gagctattaaaacacctgaacaagt

SEQ ID NO: 261951 - DNA, 25 bp, Homo sapien
tgggagcaaatccataggctgcaaa

SEQ ID NO: 261952 - DNA, 25 bp, Homo sapien
aatccataggctgcaaagttccccg

SEQ ID NO: 261953 - DNA, 25 bp, Homo sapien
ataggctgcaaagttccccgtctct

SEQ ID NO: 261954 - DNA, 25 bp, Homo sapien
ccaccacagcacactcttgaagtat

SEQ ID NO: 261955 - DNA, 25 bp, Homo sapien
gcacactcttgaagtatggccttgg

SEQ ID NO: 261956 - DNA, 25 bp, Homo sapien
ttgaagtatggccttgggtgctctt

SEQ ID NO: 261957 - DNA, 25 bp, Homo sapien
cttgggtgctcttgttgtgccagct

SEQ ID NO: 261958 - DNA, 25 bp, Homo sapien
gttgtgccagctgaaggtgagaata

SEQ ID NO: 261959 - DNA, 25 bp, Homo sapien
aatactgatcaccaagtttcctaaa

SEQ ID NO: 261960 - DNA, 25 bp, Homo sapien
gatcaccaagtttcctaaaatagcc

SEQ ID NO: 261961 - DNA, 25 bp, Homo sapien
caagtttcctaaaatagccagcaaa

SEQ ID NO: 261962 - DNA, 25 bp, Homo sapien
tacaatctgccaaatgccttttatg

SEQ ID NO: 261963 - DNA, 25 bp, Homo sapien
aaatgccttttatgtcaaacgcatt

SEQ ID NO: 261964 - DNA, 25 bp, Homo sapien
caaacgcatttttttctgatctgag

SEQ ID NO: 261965 - DNA, 25 bp, Homo sapien
ttttttctgatctgagaagttttga

SEQ ID NO: 261966 - DNA, 25 bp, Homo sapien
ttaatatttgccaatgactcacctt

SEQ ID NO: 261967 - DNA, 25 bp, Homo sapien
ttattttagaaaactccctatgagt

SEQ ID NO: 261968 - DNA, 25 bp, Homo sapien
gaaaactccctatgagtggctatca

SEQ ID NO: 261969 - DNA, 25 bp, Homo sapien
actccctatgagtggctatcaaaat

SEQ ID NO: 261970 - DNA, 25 bp, Homo sapien
ggctatcaaaatattctatgggtta

SEQ ID NO: 261971 - DNA, 25 bp, Homo sapien
ctatgggttatcaaagaaggcaata

SEQ ID NO: 261972 - DNA, 25 bp, Homo sapien
aaagaaggcaatatcaacaatagtg

SEQ ID NO: 261973 - DNA, 25 bp, Homo sapien
tcctttctgtttctcgtatccctgc

SEQ ID NO: 261974 - DNA, 25 bp, Homo sapien
tgtttctcgtatccctgctcccttt

SEQ ID NO: 261975 - DNA, 25 bp, Homo sapien
tcattctttgcctctatccttagct

SEQ ID NO: 261976 - DNA, 25 bp, Homo sapien
ttctttgcctctatccttagctgaa

SEQ ID NO: 261977 - DNA, 25 bp, Homo sapien
ctttgcctctatccttagctgaaga

SEQ ID NO: 261978 - DNA, 25 bp, Homo sapien
tttgcctctatccttagctgaagac

SEQ ID NO: 261979 - DNA, 25 bp, Homo sapien
ttgcctctatccttagctgaagaca

SEQ ID NO: 261980 - DNA, 25 bp, Homo sapien
gcctctatccttagctgaagacaaa

SEQ ID NO: 261981 - DNA, 25 bp, Homo sapien
ctctatccttagctgaagacaaact

SEQ ID NO: 261982 - DNA, 25 bp, Homo sapien
atccttagctgaagacaaactagag

SEQ ID NO: 261983 - DNA, 25 bp, Homo sapien
gaagacaaactagaggagcagcatc

SEQ ID NO: 261984 - DNA, 25 bp, Homo sapien
tccgggactgtttagaggatttctt

SEQ ID NO: 261985 - DNA, 25 bp, Homo sapien
atgactttttccgttttgagcctgc

SEQ ID NO: 261986 - DNA, 25 bp, Homo sapien
tttgagcctgctttttcattctttc

SEQ ID NO: 261987 - DNA, 25 bp, Homo sapien
ttttgccttttccatcttcttctac

SEQ ID NO: 261988 - DNA, 25 bp, Homo sapien
atcttcttctactctatcaccttct

SEQ ID NO: 261989 - DNA, 25 bp, Homo sapien
gtttctgaagagctctgttgctgaa

SEQ ID NO: 261990 - DNA, 25 bp, Homo sapien
agctctgttgctgaattgcctggta

SEQ ID NO: 261991 - DNA, 25 bp, Homo sapien
ttgctgaattgcctggtagccagta

SEQ ID NO: 261992 - DNA, 25 bp, Homo sapien
gtagccagtaaactttactcctggg

SEQ ID NO: 261993 - DNA, 25 bp, Homo sapien
ttgtcatcttcatctcctggagatt

SEQ ID NO: 261994 - DNA, 25 bp, Homo sapien
atctcctggagatttccgggactgt

SEQ ID NO: 261995 - DNA, 25 bp, Homo sapien
ccccgcgcgcagaggtacctggaga

SEQ ID NO: 261996 - DNA, 25 bp, Homo sapien
gtacctggagacgatttcaactgaa

SEQ ID NO: 261997 - DNA, 25 bp, Homo sapien
aatgaaggcagtgtcgtgctgtcga

SEQ ID NO: 261998 - DNA, 25 bp, Homo sapien
gagaaagacacgaggctcctgagca

SEQ ID NO: 261999 - DNA, 25 bp, Homo sapien
tgctgtcgagagaaaggtggatccc

SEQ ID NO: 262000 - DNA, 25 bp, Homo sapien
ggtggatcccaacaacaggaaacta

SEQ ID NO: 262001 - DNA, 25 bp, Homo sapien
ggaaactacctaaatcaccgaccag

SEQ ID NO: 262002 - DNA, 25 bp, Homo sapien
aaatcaccgaccagttctggtgctg

SEQ ID NO: 262003 - DNA, 25 bp, Homo sapien
accagttctggtgctgcccgcgaag

SEQ ID NO: 262004 - DNA, 25 bp, Homo sapien
ctcctgagcagggaaagccgaggtt

SEQ ID NO: 262005 - DNA, 25 bp, Homo sapien
gaaagccgaggttgccaccgcaggc

SEQ ID NO: 262006 - DNA, 25 bp, Homo sapien
aaacaatctgctccaaactttataa

SEQ ID NO: 262007 - DNA, 25 bp, Homo sapien
aagctagatcacttccagacacagt

SEQ ID NO: 262008 - DNA, 25 bp, Homo sapien
acttccagacacagtgggtcacact

SEQ ID NO: 262009 - DNA, 25 bp, Homo sapien
agtgggtcacactttgtgctagcac

SEQ ID NO: 262010 - DNA, 25 bp, Homo sapien
tttgtgctagcacttctgaagacca

SEQ ID NO: 262011 - DNA, 25 bp, Homo sapien
gaagaccaaagcaggaggaccgcat

SEQ ID NO: 262012 - DNA, 25 bp, Homo sapien
caaagcaggaggaccgcatgaggcc

SEQ ID NO: 262013 - DNA, 25 bp, Homo sapien
gagacgccatctctggaaaaagtta

SEQ ID NO: 262014 - DNA, 25 bp, Homo sapien
aggagtttgggctctacattagact

SEQ ID NO: 262015 - DNA, 25 bp, Homo sapien
ggctctacattagacttccttactt

SEQ ID NO: 262016 - DNA, 25 bp, Homo sapien
gacttccttacttgagtttacaaca

SEQ ID NO: 262017 - DNA, 25 bp, Homo sapien
gttcactcaagtgccaagccaaagg

SEQ ID NO: 262018 - DNA, 25 bp, Homo sapien
caagccaaaggaacaaccctggttg

SEQ ID NO: 262019 - DNA, 25 bp, Homo sapien
tttccgagctcagcaatgctcagct

SEQ ID NO: 262020 - DNA, 25 bp, Homo sapien
accctggttgttgaactagcaccta

SEQ ID NO: 262021 - DNA, 25 bp, Homo sapien
aaggtcttagatggtacgcgttgct

SEQ ID NO: 262022 - DNA, 25 bp, Homo sapien
tacgcgttgctatacagaatctttg

SEQ ID NO: 262023 - DNA, 25 bp, Homo sapien
gaatctttggatatgtgcatcagtg

SEQ ID NO: 262024 - DNA, 25 bp, Homo sapien
gcaatgctcagctcataatgatgtc

SEQ ID NO: 262025 - DNA, 25 bp, Homo sapien
atgtcaagcaccatggccagtttta

SEQ ID NO: 262026 - DNA, 25 bp, Homo sapien
gaatggcttcctgtgtctaatgacc

SEQ ID NO: 262027 - DNA, 25 bp, Homo sapien
tctaatgaccctgacaacccatgtt

SEQ ID NO: 262028 - DNA, 25 bp, Homo sapien
tcttctaattaattgtcgaccctga

SEQ ID NO: 262029 - DNA, 25 bp, Homo sapien
ttgtcgaccctgaataaggtggtac

SEQ ID NO: 262030 - DNA, 25 bp, Homo sapien
aggtggtacaactaaggcatattat

SEQ ID NO: 262031 - DNA, 25 bp, Homo sapien
acatgagggattggaatttctttaa

SEQ ID NO: 262032 - DNA, 25 bp, Homo sapien
acttttagaaattatcgtcacacaa

SEQ ID NO: 262033 - DNA, 25 bp, Homo sapien
attatcgtcacacaaggaagccttt

SEQ ID NO: 262034 - DNA, 25 bp, Homo sapien
cacaaggaagcctttataggaccga

SEQ ID NO: 262035 - DNA, 25 bp, Homo sapien
gtaaatatgttgagacagccaaaga

SEQ ID NO: 262036 - DNA, 25 bp, Homo sapien
acagccaaagaaatttgttttgcta

SEQ ID NO: 262037 - DNA, 25 bp, Homo sapien
ttttgctacttaataaacacgcgaa

SEQ ID NO: 262038 - DNA, 25 bp, Homo sapien
cacgcgaatttatactttttgtctt

SEQ ID NO: 262039 - DNA, 25 bp, Homo sapien
accggcgtgtgaaccccgagagtgc

SEQ ID NO: 262040 - DNA, 25 bp, Homo sapien
gtgtgaaccccgagagtgcccgcgc

SEQ ID NO: 262041 - DNA, 25 bp, Homo sapien
gctgcgaaccggtcggtgcgcccct

SEQ ID NO: 262042 - DNA, 25 bp, Homo sapien
cgctttcctcgtccttgtaaatgtt

SEQ ID NO: 262043 - DNA, 25 bp, Homo sapien
tttaactcttcccagtgcgaactct

SEQ ID NO: 262044 - DNA, 25 bp, Homo sapien
ttaactcttcccagtgcgaactctg

SEQ ID NO: 262045 - DNA, 25 bp, Homo sapien
ttcccagtgcgaactctgctgtgag

SEQ ID NO: 262046 - DNA, 25 bp, Homo sapien
ccagtgcgaactctgctgtgagtgt

SEQ ID NO: 262047 - DNA, 25 bp, Homo sapien
tgcgaactctgctgtgagtgtgtgc

SEQ ID NO: 262048 - DNA, 25 bp, Homo sapien
agtcggcggcgggtagccactccat

SEQ ID NO: 262049 - DNA, 25 bp, Homo sapien
tcggcggcgggtagccactccatgc

SEQ ID NO: 262050 - DNA, 25 bp, Homo sapien
tacagcgaccctgaccgccgtccga

SEQ ID NO: 262051 - DNA, 25 bp, Homo sapien
gagccgccagacacccagagagacg

SEQ ID NO: 262052 - DNA, 25 bp, Homo sapien
ccagacacccagagagacgccagag

SEQ ID NO: 262053 - DNA, 25 bp, Homo sapien
cagacacccagagagacgccagagg

SEQ ID NO: 262054 - DNA, 25 bp, Homo sapien
agacacccagagagacgccagaggc

SEQ ID NO: 262055 - DNA, 25 bp, Homo sapien
acacccagagagacgccagaggccg

SEQ ID NO: 262056 - DNA, 25 bp, Homo sapien
agagagacgccagaggccgcggagg

SEQ ID NO: 262057 - DNA, 25 bp, Homo sapien
ggatcgccagccctcgagagctctg

SEQ ID NO: 262058 - DNA, 25 bp, Homo sapien
atcgccagccctcgagagctctgtg

SEQ ID NO: 262059 - DNA, 25 bp, Homo sapien
agccctcgagagctctgtgctccac

SEQ ID NO: 262060 - DNA, 25 bp, Homo sapien
tgtgctccacgccgaggatgcaccg

SEQ ID NO: 262061 - DNA, 25 bp, Homo sapien
agcctgggaagctcggatagagctc

SEQ ID NO: 262062 - DNA, 25 bp, Homo sapien
gctcggatagagctctttgaagaag

SEQ ID NO: 262063 - DNA, 25 bp, Homo sapien
aagaagatgcgctgagagtcctcac

SEQ ID NO: 262064 - DNA, 25 bp, Homo sapien
atgcgctgagagtcctcacaactgc

SEQ ID NO: 262065 - DNA, 25 bp, Homo sapien
tcacaactgcgtctccggaggcaga

SEQ ID NO: 262066 - DNA, 25 bp, Homo sapien
tgcgtctccggaggcagaacgaagt

SEQ ID NO: 262067 - DNA, 25 bp, Homo sapien
gggtgcgcgcactccttcagcgtgt

SEQ ID NO: 262068 - DNA, 25 bp, Homo sapien
tccttcagcgtgtcctggttttaaa

SEQ ID NO: 262069 - DNA, 25 bp, Homo sapien
tttaaaagactaacccatccggatg

SEQ ID NO: 262070 - DNA, 25 bp, Homo sapien
atccggatgggcctgaactcaagaa

SEQ ID NO: 262071 - DNA, 25 bp, Homo sapien
ggatgggcctgaactcaagaagcaa

SEQ ID NO: 262072 - DNA, 25 bp, Homo sapien
ccctagcaaggtccaggcaaagctg

SEQ ID NO: 262073 - DNA, 25 bp, Homo sapien
gatccagagtttcctagaacgcaac

SEQ ID NO: 262074 - DNA, 25 bp, Homo sapien
gaacgcaacttaggatggctaggaa

SEQ ID NO: 262075 - DNA, 25 bp, Homo sapien
aaagggaagcctgactgctcggtca

SEQ ID NO: 262076 - DNA, 25 bp, Homo sapien
tcaggagggtgcagtatctcttgct

SEQ ID NO: 262077 - DNA, 25 bp, Homo sapien
atctcttgctgggaacacagccagt

SEQ ID NO: 262078 - DNA, 25 bp, Homo sapien
cacaatgcctagactgtgtatgtct

SEQ ID NO: 262079 - DNA, 25 bp, Homo sapien
gactgtgtatgtctatttgcacaag

SEQ ID NO: 262080 - DNA, 25 bp, Homo sapien
tcctattttggagtggtcagacatt

SEQ ID NO: 262081 - DNA, 25 bp, Homo sapien
gattatctggcgttttagacaaatt

SEQ ID NO: 262082 - DNA, 25 bp, Homo sapien
gacaaatttgcaaaactgtgctttt

SEQ ID NO: 262083 - DNA, 25 bp, Homo sapien
gactttgctgatctcagcatctcct

SEQ ID NO: 262084 - DNA, 25 bp, Homo sapien
agtaaatgatcatctctaggttggg

SEQ ID NO: 262085 - DNA, 25 bp, Homo sapien
ataatcatctcaactgccaattcca

SEQ ID NO: 262086 - DNA, 25 bp, Homo sapien
ctcaactgccaattccaagtgtctt

SEQ ID NO: 262087 - DNA, 25 bp, Homo sapien
tgaatacactaaggcacaatgctgt

SEQ ID NO: 262088 - DNA, 25 bp, Homo sapien
caatgctgtagatcagttggccaca

SEQ ID NO: 262089 - DNA, 25 bp, Homo sapien
gctgtagatcagttggccacaaatg

SEQ ID NO: 262090 - DNA, 25 bp, Homo sapien
ggccacaaatgcaaagggcatgtaa

SEQ ID NO: 262091 - DNA, 25 bp, Homo sapien
taggtaatggtggtgctagtagcaa

SEQ ID NO: 262092 - DNA, 25 bp, Homo sapien
ttggtagatagtacatacttgccat

SEQ ID NO: 262093 - DNA, 25 bp, Homo sapien
catacttgccatttctatactagga

SEQ ID NO: 262094 - DNA, 25 bp, Homo sapien
cagtagctgggcgacattcagagct

SEQ ID NO: 262095 - DNA, 25 bp, Homo sapien
tagctgggcgacattcagagctctc

SEQ ID NO: 262096 - DNA, 25 bp, Homo sapien
tgggcgacattcagagctctctctc

SEQ ID NO: 262097 - DNA, 25 bp, Homo sapien
tttattgggcaattttatgtgagtt

SEQ ID NO: 262098 - DNA, 25 bp, Homo sapien
gagctctctctctgaggtatataag

SEQ ID NO: 262099 - DNA, 25 bp, Homo sapien
gtatataagaagagccctgggagct

SEQ ID NO: 262100 - DNA, 25 bp, Homo sapien
actgaagcagcctcaccaaagcaaa

SEQ ID NO: 262101 - DNA, 25 bp, Homo sapien
gcagcctcaccaaagcaaagattcc

SEQ ID NO: 262102 - DNA, 25 bp, Homo sapien
ttgggtcaaaaatgggtaatctctt

SEQ ID NO: 262103 - DNA, 25 bp, Homo sapien
gcataatttattgttgccattttat

SEQ ID NO: 262104 - DNA, 25 bp, Homo sapien
gttgccattttatcaaatgagtagg

SEQ ID NO: 262105 - DNA, 25 bp, Homo sapien
aacactatgtgttcagttttcttgt

SEQ ID NO: 262106 - DNA, 25 bp, Homo sapien
atgtgttcagttttcttgtgggctt

SEQ ID NO: 262107 - DNA, 25 bp, Homo sapien
tcagttttcttgtgggcttctgaaa

SEQ ID NO: 262108 - DNA, 25 bp, Homo sapien
gtgggcttctgaaagttgccatctt

SEQ ID NO: 262109 - DNA, 25 bp, Homo sapien
gcttctgaaagttgccatcttccct

SEQ ID NO: 262110 - DNA, 25 bp, Homo sapien
tctgaaagttgccatcttccctccg

SEQ ID NO: 262111 - DNA, 25 bp, Homo sapien
atttgctattttcattatacactat

SEQ ID NO: 262112 - DNA, 25 bp, Homo sapien
agagagagaagtaccactgtggcta

SEQ ID NO: 262113 - DNA, 25 bp, Homo sapien
gtaccactgtggctagatatataca

SEQ ID NO: 262114 - DNA, 25 bp, Homo sapien
tataggatacacactcatgtatgta

SEQ ID NO: 262115 - DNA, 25 bp, Homo sapien
atacacacacacgagagacagaagg

SEQ ID NO: 262116 - DNA, 25 bp, Homo sapien
accacccacctgatttaccaagagt

SEQ ID NO: 262117 - DNA, 25 bp, Homo sapien
gatttaccaagagtgatcccagatt

SEQ ID NO: 262118 - DNA, 25 bp, Homo sapien
gtgatcccagattatgcagttgttt

SEQ ID NO: 262119 - DNA, 25 bp, Homo sapien
gttgttttgtgagctaactgtccat

SEQ ID NO: 262120 - DNA, 25 bp, Homo sapien
gacttgtgtactctgccacagtgcc

SEQ ID NO: 262121 - DNA, 25 bp, Homo sapien
ctgccacagtgccaaaaggccaggg

SEQ ID NO: 262122 - DNA, 25 bp, Homo sapien
aagttcccagcaccctcgtgagaaa

SEQ ID NO: 262123 - DNA, 25 bp, Homo sapien
accctcgtgagaaatgaagaccgca

SEQ ID NO: 262124 - DNA, 25 bp, Homo sapien
agcagccctggcaacaaaaaccgga

SEQ ID NO: 262125 - DNA, 25 bp, Homo sapien
gtcatcctgggttgtatatacacat

SEQ ID NO: 262126 - DNA, 25 bp, Homo sapien
acatataactgtcatccccgaagga

SEQ ID NO: 262127 - DNA, 25 bp, Homo sapien
tcacttgaattggagccccagaagc

SEQ ID NO: 262128 - DNA, 25 bp, Homo sapien
ccagaagcaaggttaaagtgagtta

SEQ ID NO: 262129 - DNA, 25 bp, Homo sapien
gagttactactgagtttctggtgtt

SEQ ID NO: 262130 - DNA, 25 bp, Homo sapien
actactgagtttctggtgttcctaa

SEQ ID NO: 262131 - DNA, 25 bp, Homo sapien
gagtttctggtgttcctaacttatc

SEQ ID NO: 262132 - DNA, 25 bp, Homo sapien
tttctggtgttcctaacttatccct

SEQ ID NO: 262133 - DNA, 25 bp, Homo sapien
tggtgttcctaacttatccctttgg

SEQ ID NO: 262134 - DNA, 25 bp, Homo sapien
tgttcctaacttatccctttggtat

SEQ ID NO: 262135 - DNA, 25 bp, Homo sapien
cttatccctttggtatatatgtaga

SEQ ID NO: 262136 - DNA, 25 bp, Homo sapien
gagagactgcagttagccactgcac

SEQ ID NO: 262137 - DNA, 25 bp, Homo sapien
tgggcaagagtggctcctctctctc

SEQ ID NO: 262138 - DNA, 25 bp, Homo sapien
tagctcacctccagaatcaagacga

SEQ ID NO: 262139 - DNA, 25 bp, Homo sapien
agacgaaagcacgactgtgtgattt

SEQ ID NO: 262140 - DNA, 25 bp, Homo sapien
aatgaggttattgctgccctagttc

SEQ ID NO: 262141 - DNA, 25 bp, Homo sapien
ttattgctgccctagttccatgtgg

SEQ ID NO: 262142 - DNA, 25 bp, Homo sapien
cctcttctgcatggaatgtgccaac

SEQ ID NO: 262143 - DNA, 25 bp, Homo sapien
gaatgtgccaacaagatctgtgaaa

SEQ ID NO: 262144 - DNA, 25 bp, Homo sapien
aagagaacgccatcatgtccagttt

SEQ ID NO: 262145 - DNA, 25 bp, Homo sapien
gccatcatgtccagtttgccagaca

SEQ ID NO: 262146 - DNA, 25 bp, Homo sapien
gccagacagctgttactcaggcaat

SEQ ID NO: 262147 - DNA, 25 bp, Homo sapien
actcaggcaatccaaattcactctt

SEQ ID NO: 262148 - DNA, 25 bp, Homo sapien
tatctctatatggactcgtaaaggc

SEQ ID NO: 262149 - DNA, 25 bp, Homo sapien
gaggtccacactgactccatggaga

SEQ ID NO: 262150 - DNA, 25 bp, Homo sapien
tagcaaacataggtctctctccttt

SEQ ID NO: 262151 - DNA, 25 bp, Homo sapien
catcaaatccccagaattactttcc

SEQ ID NO: 262152 - DNA, 25 bp, Homo sapien
attactttcctacacatcagatgcc

SEQ ID NO: 262153 - DNA, 25 bp, Homo sapien
gccagtggtggcatagagacagatc

SEQ ID NO: 262154 - DNA, 25 bp, Homo sapien
gagacagatcagatgctccagcact

SEQ ID NO: 262155 - DNA, 25 bp, Homo sapien
gctccagcactcaaggttcatgaga

SEQ ID NO: 262156 - DNA, 25 bp, Homo sapien
gattcaaaaccgattttcttccact

SEQ ID NO: 262157 - DNA, 25 bp, Homo sapien
gattttcttccactccaaacataca

SEQ ID NO: 262158 - DNA, 25 bp, Homo sapien
aaacatacactcttttctcttgggc

SEQ ID NO: 262159 - DNA, 25 bp, Homo sapien
tctcttgggcagctataaatagggt

SEQ ID NO: 262160 - DNA, 25 bp, Homo sapien
aatctaggctataatggtgttcaaa

SEQ ID NO: 262161 - DNA, 25 bp, Homo sapien
ggctataatggtgttcaaatttttt

SEQ ID NO: 262162 - DNA, 25 bp, Homo sapien
gacattcaattcaaatgtatcttct

SEQ ID NO: 262163 - DNA, 25 bp, Homo sapien
tctctggttaaagtatggtgaagtc

SEQ ID NO: 262164 - DNA, 25 bp, Homo sapien
ttaaagtatggtgaagtctgtcctg

SEQ ID NO: 262165 - DNA, 25 bp, Homo sapien
tgtcctgtgggcactccccattgac

SEQ ID NO: 262166 - DNA, 25 bp, Homo sapien
gtgggcactccccattgactcctag

SEQ ID NO: 262167 - DNA, 25 bp, Homo sapien
attgactcctagcagctcttgagcc

SEQ ID NO: 262168 - DNA, 25 bp, Homo sapien
tagcagctcttgagccccatcttca

SEQ ID NO: 262169 - DNA, 25 bp, Homo sapien
ccatcttcaggatccgtactttgat

SEQ ID NO: 262170 - DNA, 25 bp, Homo sapien
aggatccgtactttgatagtcactg

SEQ ID NO: 262171 - DNA, 25 bp, Homo sapien
ttcattctcagtcatgcccggagat

SEQ ID NO: 262172 - DNA, 25 bp, Homo sapien
tcatgcccggagatcacccaggaga

SEQ ID NO: 262173 - DNA, 25 bp, Homo sapien
aataatacaaacaccaccactgtcc

SEQ ID NO: 262174 - DNA, 25 bp, Homo sapien
aaacaccaccactgtccagagagag

SEQ ID NO: 262175 - DNA, 25 bp, Homo sapien
acctcagtgctctaagctcacagaa

SEQ ID NO: 262176 - DNA, 25 bp, Homo sapien
agtgctctaagctcacagaagtgaa

SEQ ID NO: 262177 - DNA, 25 bp, Homo sapien
agtgaaataatgtctgtgggttggc

SEQ ID NO: 262178 - DNA, 25 bp, Homo sapien
atgtctgtgggttggcaatggcttt

SEQ ID NO: 262179 - DNA, 25 bp, Homo sapien
caatggctttgtgggatcatatgtc

SEQ ID NO: 262180 - DNA, 25 bp, Homo sapien
gtgggatcatatgtcttggccaaag

SEQ ID NO: 262181 - DNA, 25 bp, Homo sapien
atatgtcttggccaaagatgggaaa

SEQ ID NO: 262182 - DNA, 25 bp, Homo sapien
gtctctccaaagtcctatgggtctc

SEQ ID NO: 262183 - DNA, 25 bp, Homo sapien
aagtcctatgggtctcactatcttt

SEQ ID NO: 262184 - DNA, 25 bp, Homo sapien
gtctcactatctttgctcatggaac

SEQ ID NO: 262185 - DNA, 25 bp, Homo sapien
ctgcctggaagactctacacagata

SEQ ID NO: 262186 - DNA, 25 bp, Homo sapien
atatggagaatccttgactcaggct

SEQ ID NO: 262187 - DNA, 25 bp, Homo sapien
gggcagtctagtaccaggctcttaa

SEQ ID NO: 262188 - DNA, 25 bp, Homo sapien
gtaccaggctcttaatcttcagaga

SEQ ID NO: 262189 - DNA, 25 bp, Homo sapien
gaatgtcttccttccctactctcta

SEQ ID NO: 262190 - DNA, 25 bp, Homo sapien
cctactctctagactttcctttctt

SEQ ID NO: 262191 - DNA, 25 bp, Homo sapien
tcctttcttaactcaatccaagtcc

SEQ ID NO: 262192 - DNA, 25 bp, Homo sapien
taactcaatccaagtcctacctgct

SEQ ID NO: 262193 - DNA, 25 bp, Homo sapien
gaatgcgaggtgtgattgtcccagt

SEQ ID NO: 262194 - DNA, 25 bp, Homo sapien
gtgtgattgtcccagtggctctcaa

SEQ ID NO: 262195 - DNA, 25 bp, Homo sapien
gtctgcccaggaatactacgttgat

SEQ ID NO: 262196 - DNA, 25 bp, Homo sapien
atgcgctaccaaatacgcctgggca

SEQ ID NO: 262197 - DNA, 25 bp, Homo sapien
gggatctctcccagagacttgacat

SEQ ID NO: 262198 - DNA, 25 bp, Homo sapien
tctcccagagacttgacattttagc

SEQ ID NO: 262199 - DNA, 25 bp, Homo sapien
tacgttgattacaaaccgaaccaca

SEQ ID NO: 262200 - DNA, 25 bp, Homo sapien
accgaaccacattgagggagccctg

SEQ ID NO: 262201 - DNA, 25 bp, Homo sapien
ttgagggagccctggtgatcatcaa

SEQ ID NO: 262202 - DNA, 25 bp, Homo sapien
tggtgatcatcaacgagtatggctc

SEQ ID NO: 262203 - DNA, 25 bp, Homo sapien
agtatggctcgtgtacctgccacca

SEQ ID NO: 262204 - DNA, 25 bp, Homo sapien
attgtggtatattcagactatggac

SEQ ID NO: 262205 - DNA, 25 bp, Homo sapien
ttcagactatggactattacacagc

SEQ ID NO: 262206 - DNA, 25 bp, Homo sapien
gactatggactattacacagcaatt

SEQ ID NO: 262207 - DNA, 25 bp, Homo sapien
tatggactattacacagcaattaaa

SEQ ID NO: 262208 - DNA, 25 bp, Homo sapien
aaagcataaactactgataatacaa

SEQ ID NO: 262209 - DNA, 25 bp, Homo sapien
aaatctcaatgacactatattaagt

SEQ ID NO: 262210 - DNA, 25 bp, Homo sapien
acacaagagggctgtttatggttcc

SEQ ID NO: 262211 - DNA, 25 bp, Homo sapien
caagagggctgtttatggttccatt

SEQ ID NO: 262212 - DNA, 25 bp, Homo sapien
atactattcagccttgatgaggaag

SEQ ID NO: 262213 - DNA, 25 bp, Homo sapien
gatgaggaaggaaattctgtcattt

SEQ ID NO: 262214 - DNA, 25 bp, Homo sapien
ggaggacagaactcaaatgtttgta

SEQ ID NO: 262215 - DNA, 25 bp, Homo sapien
tggtcctcaacgagactcagttttc

SEQ ID NO: 262216 - DNA, 25 bp, Homo sapien
tcaacgagactcagttttccgcctt

SEQ ID NO: 262217 - DNA, 25 bp, Homo sapien
gagactcagttttccgcctttcggg

SEQ ID NO: 262218 - DNA, 25 bp, Homo sapien
gggccaggaatgcatcttttccaaa

SEQ ID NO: 262219 - DNA, 25 bp, Homo sapien
caggaatgcatcttttccaaagtga

SEQ ID NO: 262220 - DNA, 25 bp, Homo sapien
gaatgcatcttttccaaagtgagcg

SEQ ID NO: 262221 - DNA, 25 bp, Homo sapien
atgcatcttttccaaagtgagcggt

SEQ ID NO: 262222 - DNA, 25 bp, Homo sapien
gcatcttttccaaagtgagcggtgg

SEQ ID NO: 262223 - DNA, 25 bp, Homo sapien
tcttttccaaagtgagcggtggccc

SEQ ID NO: 262224 - DNA, 25 bp, Homo sapien
tgccagcgctctgcgaacccggcga

SEQ ID NO: 262225 - DNA, 25 bp, Homo sapien
cgcactgggccgtctacgtgggcgg

SEQ ID NO: 262226 - DNA, 25 bp, Homo sapien
aaaccaatttgacacctgcactagc

SEQ ID NO: 262227 - DNA, 25 bp, Homo sapien
actagcgtcatctgcgagccgaggg

SEQ ID NO: 262228 - DNA, 25 bp, Homo sapien
cagcattgccttgaacatacttgtt

SEQ ID NO: 262229 - DNA, 25 bp, Homo sapien
gagccgagggccaagagtatcttct

SEQ ID NO: 262230 - DNA, 25 bp, Homo sapien
aagagtatcttctcggtcttggtgg

SEQ ID NO: 262231 - DNA, 25 bp, Homo sapien
gtacgggttgtcacggtgcttgtaa

SEQ ID NO: 262232 - DNA, 25 bp, Homo sapien
ggtgcttgtaaagccactgcttgag

SEQ ID NO: 262233 - DNA, 25 bp, Homo sapien
aactttattctcaaagcccagctta

SEQ ID NO: 262234 - DNA, 25 bp, Homo sapien
gcttaaatctggctgtcgaacggta

SEQ ID NO: 262235 - DNA, 25 bp, Homo sapien
gaacggtattcttaagccgacgtct

SEQ ID NO: 262236 - DNA, 25 bp, Homo sapien
taagccgacgtcttgcattagcaaa

SEQ ID NO: 262237 - DNA, 25 bp, Homo sapien
taacagtatctaactttatcatagt

SEQ ID NO: 262238 - DNA, 25 bp, Homo sapien
gtatctaactttatcatagttgatg

SEQ ID NO: 262239 - DNA, 25 bp, Homo sapien
aatctttgtaaaatgcgcaagtgca

SEQ ID NO: 262240 - DNA, 25 bp, Homo sapien
gtaaaatgcgcaagtgcaataattt

SEQ ID NO: 262241 - DNA, 25 bp, Homo sapien
tgcgcaagtgcaataatttaaagag

SEQ ID NO: 262242 - DNA, 25 bp, Homo sapien
agtgcaataatttaaagaggtctta

SEQ ID NO: 262243 - DNA, 25 bp, Homo sapien
agaggtcttaactttgcatttataa

SEQ ID NO: 262244 - DNA, 25 bp, Homo sapien
gaggtcttaactttgcatttataaa

SEQ ID NO: 262245 - DNA, 25 bp, Homo sapien
tcatttgcagtctttgtatttaaaa

SEQ ID NO: 262246 - DNA, 25 bp, Homo sapien
gtaatcatttattataatctaggca

SEQ ID NO: 262247 - DNA, 25 bp, Homo sapien
tattataatctaggcaagttgtaaa

SEQ ID NO: 262248 - DNA, 25 bp, Homo sapien
gtgtattccttaagaatgagaccat

SEQ ID NO: 262249 - DNA, 25 bp, Homo sapien
gaatgagaccataaatatccctgac

SEQ ID NO: 262250 - DNA, 25 bp, Homo sapien
tgagaccataaatatccctgacccc

SEQ ID NO: 262251 - DNA, 25 bp, Homo sapien
agaagatagaatttgtggtgttttc

SEQ ID NO: 262252 - DNA, 25 bp, Homo sapien
agaaaactagagctgtgtccgcgtg

SEQ ID NO: 262253 - DNA, 25 bp, Homo sapien
aaaactagagctgtgtccgcgtgga

SEQ ID NO: 262254 - DNA, 25 bp, Homo sapien
aaactagagctgtgtccgcgtggac

SEQ ID NO: 262255 - DNA, 25 bp, Homo sapien
actagagctgtgtccgcgtggactt

SEQ ID NO: 262256 - DNA, 25 bp, Homo sapien
ccttcccttctcccaaatgatgtgt

SEQ ID NO: 262257 - DNA, 25 bp, Homo sapien
caaatgatgtgtggatgcccagggc

SEQ ID NO: 262258 - DNA, 25 bp, Homo sapien
atacctatttttggttatactcaga

SEQ ID NO: 262259 - DNA, 25 bp, Homo sapien
gcccactccatcacttattcaaata

SEQ ID NO: 262260 - DNA, 25 bp, Homo sapien
agcattgcaatgactcctgctgagt

SEQ ID NO: 262261 - DNA, 25 bp, Homo sapien
tgctgagtcttttcctgcaccagct

SEQ ID NO: 262262 - DNA, 25 bp, Homo sapien
accagctctctattgccttaaggag

SEQ ID NO: 262263 - DNA, 25 bp, Homo sapien
tagtgttttgtccttgaagcctgtc

SEQ ID NO: 262264 - DNA, 25 bp, Homo sapien
gtcctgggccagttgaactttcctg

SEQ ID NO: 262265 - DNA, 25 bp, Homo sapien
gaactttcctgcctttccatggtga

SEQ ID NO: 262266 - DNA, 25 bp, Homo sapien
tctcaactccctcttgtggcaattt

SEQ ID NO: 262267 - DNA, 25 bp, Homo sapien
aatttccctttattttacatgcagg

SEQ ID NO: 262268 - DNA, 25 bp, Homo sapien
tttacatgcaggtctctcttgccag

SEQ ID NO: 262269 - DNA, 25 bp, Homo sapien
agcctgttagctggagcccacaggg

SEQ ID NO: 262270 - DNA, 25 bp, Homo sapien
aaataccaagattaattacatgcta

SEQ ID NO: 262271 - DNA, 25 bp, Homo sapien
ctaagaggattgatctcatgtgctt

SEQ ID NO: 262272 - DNA, 25 bp, Homo sapien
aaaacatgcaatgttacagatacat

SEQ ID NO: 262273 - DNA, 25 bp, Homo sapien
aacctgcagttttcctccctagagg

SEQ ID NO: 262274 - DNA, 25 bp, Homo sapien
cagttttcctccctagaggtagccg

SEQ ID NO: 262275 - DNA, 25 bp, Homo sapien
gattgatctcatgtgctttttgcca

SEQ ID NO: 262276 - DNA, 25 bp, Homo sapien
agaggtagccgccatcctaaagtca

SEQ ID NO: 262277 - DNA, 25 bp, Homo sapien
agccgccatcctaaagtcagtgtga

SEQ ID NO: 262278 - DNA, 25 bp, Homo sapien
ccgccatcctaaagtcagtgtgaat

SEQ ID NO: 262279 - DNA, 25 bp, Homo sapien
ttttatgatgtatgtagcatccata

SEQ ID NO: 262280 - DNA, 25 bp, Homo sapien
actggagagtttactaaatttgtgt

SEQ ID NO: 262281 - DNA, 25 bp, Homo sapien
gacagaattagcattttaggctcag

SEQ ID NO: 262282 - DNA, 25 bp, Homo sapien
gacagatgatgagaaatgcagtttt

SEQ ID NO: 262283 - DNA, 25 bp, Homo sapien
gcattttaggctcagatgatagtta

SEQ ID NO: 262284 - DNA, 25 bp, Homo sapien
aaagtttgagatgggccaaagtgca

SEQ ID NO: 262285 - DNA, 25 bp, Homo sapien
aaagtgcagggcaacagacggcaag

SEQ ID NO: 262286 - DNA, 25 bp, Homo sapien
gaggagcatagctggtgcatttgat

SEQ ID NO: 262287 - DNA, 25 bp, Homo sapien
agcatagctggtgcatttgatgctg

SEQ ID NO: 262288 - DNA, 25 bp, Homo sapien
gaggtcagagttatgaaggcggcca

SEQ ID NO: 262289 - DNA, 25 bp, Homo sapien
ggaaggcttcctcggaacctgaaga

SEQ ID NO: 262290 - DNA, 25 bp, Homo sapien
tctgagtgactgtaatgggccttcc

SEQ ID NO: 262291 - DNA, 25 bp, Homo sapien
agtgactgtaatgggccttccattt

SEQ ID NO: 262292 - DNA, 25 bp, Homo sapien
gaagaaactagtggaatacgtgtgt

SEQ ID NO: 262293 - DNA, 25 bp, Homo sapien
gtggaatacgtgtgtttgtacattc

SEQ ID NO: 262294 - DNA, 25 bp, Homo sapien
tgctgacatccctgagctggtaaga

SEQ ID NO: 262295 - DNA, 25 bp, Homo sapien
gctggtaagaatggtctccggtaaa

SEQ ID NO: 262296 - DNA, 25 bp, Homo sapien
gaatggtctccggtaaaagagaatt

SEQ ID NO: 262297 - DNA, 25 bp, Homo sapien
gagagctcttcctccattggctgct

SEQ ID NO: 262298 - DNA, 25 bp, Homo sapien
tcctccattggctgcttcttaattg

SEQ ID NO: 262299 - DNA, 25 bp, Homo sapien
ttcttaattgcctttacttcaaaat

SEQ ID NO: 262300 - DNA, 25 bp, Homo sapien
aagcaattttaggtgtccgaaggca

SEQ ID NO: 262301 - DNA, 25 bp, Homo sapien
taggtgtccgaaggcaagaaaccgt

SEQ ID NO: 262302 - DNA, 25 bp, Homo sapien
gaaaccgtgggaagataaatatatg

SEQ ID NO: 262303 - DNA, 25 bp, Homo sapien
gcccagcagaggctggtgcaaccaa

SEQ ID NO: 262304 - DNA, 25 bp, Homo sapien
cagcagaggctggtgcaaccaatca

SEQ ID NO: 262305 - DNA, 25 bp, Homo sapien
gcagaggctggtgcaaccaatcacc

SEQ ID NO: 262306 - DNA, 25 bp, Homo sapien
gcaaccaatcacctcctttagtaag

SEQ ID NO: 262307 - DNA, 25 bp, Homo sapien
caaccaatcacctcctttagtaagt

SEQ ID NO: 262308 - DNA, 25 bp, Homo sapien
caatcacctcctttagtaagtttct

SEQ ID NO: 262309 - DNA, 25 bp, Homo sapien
ttagtaagtttctccctgggcttca

SEQ ID NO: 262310 - DNA, 25 bp, Homo sapien
taagtttctccctgggcttcacctc

SEQ ID NO: 262311 - DNA, 25 bp, Homo sapien
gggcttcacctcttcacctgtgggc

SEQ ID NO: 262312 - DNA, 25 bp, Homo sapien
acctgtgggctttccacctgtctct

SEQ ID NO: 262313 - DNA, 25 bp, Homo sapien
tttaagacagtctcctctgttgcca

SEQ ID NO: 262314 - DNA, 25 bp, Homo sapien
ccaattgcacatttctcattaccca

SEQ ID NO: 262315 - DNA, 25 bp, Homo sapien
gggctgtggtgaacaaatgatgctt

SEQ ID NO: 262316 - DNA, 25 bp, Homo sapien
aatgatgcttttatagatggtccct

SEQ ID NO: 262317 - DNA, 25 bp, Homo sapien
gatggtccctagcttacaatgattc

SEQ ID NO: 262318 - DNA, 25 bp, Homo sapien
atgattcaatttacaatgcttcaat

SEQ ID NO: 262319 - DNA, 25 bp, Homo sapien
caatttgttgacttacaatgggttt

SEQ ID NO: 262320 - DNA, 25 bp, Homo sapien
gtttatcaggatgtaacccaatgca

SEQ ID NO: 262321 - DNA, 25 bp, Homo sapien
aacccaatgcatttcaacttacgat

SEQ ID NO: 262322 - DNA, 25 bp, Homo sapien
tttcagtttcgaatgggtttatcca

SEQ ID NO: 262323 - DNA, 25 bp, Homo sapien
ggagagaggttatttcgacttttga

SEQ ID NO: 262324 - DNA, 25 bp, Homo sapien
tcgacttttgaaccaattgcacatt

SEQ ID NO: 262325 - DNA, 25 bp, Homo sapien
aaggctttgccctctgaaaatattc

SEQ ID NO: 262326 - DNA, 25 bp, Homo sapien
aaaatattctagcacttcggagtct

SEQ ID NO: 262327 - DNA, 25 bp, Homo sapien
agcacttcggagtcttctaggagaa

SEQ ID NO: 262328 - DNA, 25 bp, Homo sapien
aggtaacccacttattcttcttgat

SEQ ID NO: 262329 - DNA, 25 bp, Homo sapien
gaaaatatcacatgcttagagctat

SEQ ID NO: 262330 - DNA, 25 bp, Homo sapien
aaaatggtcagaaggctaacagagc

SEQ ID NO: 262331 - DNA, 25 bp, Homo sapien
agagcctagcacagctgtgtgttta

SEQ ID NO: 262332 - DNA, 25 bp, Homo sapien
gcatttgtttcaatagcaggtctga

SEQ ID NO: 262333 - DNA, 25 bp, Homo sapien
atagcaggtctgaacatgtataatt

SEQ ID NO: 262334 - DNA, 25 bp, Homo sapien
gaatttctcagaagcaatgttttct

SEQ ID NO: 262335 - DNA, 25 bp, Homo sapien
ttttgtttagtttgcttccagtaag

SEQ ID NO: 262336 - DNA, 25 bp, Homo sapien
ccccttgtggttagagtcctgattt

SEQ ID NO: 262337 - DNA, 25 bp, Homo sapien
gttagagtcctgattttactgcaaa

SEQ ID NO: 262338 - DNA, 25 bp, Homo sapien
actgcaaaggtgttcatgttccttg

SEQ ID NO: 262339 - DNA, 25 bp, Homo sapien
gttccttgtgaagtgtgggctctta

SEQ ID NO: 262340 - DNA, 25 bp, Homo sapien
gcagttggcctttgtagctgcaaca

SEQ ID NO: 262341 - DNA, 25 bp, Homo sapien
ttggcctttgtagctgcaacagcag

SEQ ID NO: 262342 - DNA, 25 bp, Homo sapien
aacagcagccacctgcaggttgggt

SEQ ID NO: 262343 - DNA, 25 bp, Homo sapien
aggttgggtgaagtgccctgacact

SEQ ID NO: 262344 - DNA, 25 bp, Homo sapien
tgaagtgccctgacactgctgtagc

SEQ ID NO: 262345 - DNA, 25 bp, Homo sapien
aaccgaagacaagacagacacccat

SEQ ID NO: 262346 - DNA, 25 bp, Homo sapien
agacagacacccatgttcttaaata

SEQ ID NO: 262347 - DNA, 25 bp, Homo sapien
gagatatcaaaggagacaacgccat

SEQ ID NO: 262348 - DNA, 25 bp, Homo sapien
gagacaacgccattattgacgagat

SEQ ID NO: 262349 - DNA, 25 bp, Homo sapien
ttgacgagatcactcccaagcggat

SEQ ID NO: 262350 - DNA, 25 bp, Homo sapien
ccaagcggattggagattgtcccaa

SEQ ID NO: 262351 - DNA, 25 bp, Homo sapien
gagattgtcccaatacttagaccta

SEQ ID NO: 262352 - DNA, 25 bp, Homo sapien
ttagacctatagcaaggccttggga

SEQ ID NO: 262353 - DNA, 25 bp, Homo sapien
aggagagcaggaacctaaccattgc

SEQ ID NO: 262354 - DNA, 25 bp, Homo sapien
ctccattgtgcggagcaacgtcgca

SEQ ID NO: 262355 - DNA, 25 bp, Homo sapien
gcggagcaacgtcgcaccagctttt

SEQ ID NO: 262356 - DNA, 25 bp, Homo sapien
tcctgggttgggttgataatctaaa

SEQ ID NO: 262357 - DNA, 25 bp, Homo sapien
ctcattattgcggtatgtataggga

SEQ ID NO: 262358 - DNA, 25 bp, Homo sapien
caaaacctggcaggagcttttggta

SEQ ID NO: 262359 - DNA, 25 bp, Homo sapien
gcaggagcttttggtaaaatgtcca

SEQ ID NO: 262360 - DNA, 25 bp, Homo sapien
aatgtccaaggcacataattgaaag

SEQ ID NO: 262361 - DNA, 25 bp, Homo sapien
agaatcagtatctgttccccattgt

SEQ ID NO: 262362 - DNA, 25 bp, Homo sapien
gtatctgttccccattgtttggaac

SEQ ID NO: 262363 - DNA, 25 bp, Homo sapien
aatgaatctgtggagtgatgagcta

SEQ ID NO: 262364 - DNA, 25 bp, Homo sapien
tgatgagctaggatatctggattga

SEQ ID NO: 262365 - DNA, 25 bp, Homo sapien
tctggattgagatggcctaggaaaa

SEQ ID NO: 262366 - DNA, 25 bp, Homo sapien
aaagtggtcctggttatgggttatg

SEQ ID NO: 262367 - DNA, 25 bp, Homo sapien
atgttcattctccttaattccttaa

SEQ ID NO: 262368 - DNA, 25 bp, Homo sapien
ccttaattccttaacaatcaggcag

SEQ ID NO: 262369 - DNA, 25 bp, Homo sapien
tccatgccggccagagtgtagaaag

SEQ ID NO: 262370 - DNA, 25 bp, Homo sapien
gtgtagaaagccataacgcagccat

SEQ ID NO: 262371 - DNA, 25 bp, Homo sapien
taacgcagccatcagcacaataatg

SEQ ID NO: 262372 - DNA, 25 bp, Homo sapien
cacaataatgtgactctacgctgat

SEQ ID NO: 262373 - DNA, 25 bp, Homo sapien
gtgactctacgctgatatgctccct

SEQ ID NO: 262374 - DNA, 25 bp, Homo sapien
tgacttccccttcccggatttgtga

SEQ ID NO: 262375 - DNA, 25 bp, Homo sapien
gtgtcaagactaggaatctggcctt

SEQ ID NO: 262376 - DNA, 25 bp, Homo sapien
cctcagatcaggcatagccatagtc

SEQ ID NO: 262377 - DNA, 25 bp, Homo sapien
tagccatagtcaagcccagcaggtt

SEQ ID NO: 262378 - DNA, 25 bp, Homo sapien
cagcaggtttcctcaggagctgtct

SEQ ID NO: 262379 - DNA, 25 bp, Homo sapien
tgatggtggatgacgctgctgaaca

SEQ ID NO: 262380 - DNA, 25 bp, Homo sapien
ctggctgagtaatggctttgaatca

SEQ ID NO: 262381 - DNA, 25 bp, Homo sapien
accctgtgttgtcataatgcgagcc

SEQ ID NO: 262382 - DNA, 25 bp, Homo sapien
gatggtgcaatcctgtgaacacaat

SEQ ID NO: 262383 - DNA, 25 bp, Homo sapien
cgaagagttgggtctttggcagaaa

SEQ ID NO: 262384 - DNA, 25 bp, Homo sapien
aacaagcagcaaagagggccatcat

SEQ ID NO: 262385 - DNA, 25 bp, Homo sapien
gggccatcatcctttgtttaactga

SEQ ID NO: 262386 - DNA, 25 bp, Homo sapien
gatcaataatcctcacctgacttat

SEQ ID NO: 262387 - DNA, 25 bp, Homo sapien
taatgcgagccatcagtccagttgt

SEQ ID NO: 262388 - DNA, 25 bp, Homo sapien
gccatcagtccagttgtcagtgaaa

SEQ ID NO: 262389 - DNA, 25 bp, Homo sapien
aaagtatcactcatgggcagccggt

SEQ ID NO: 262390 - DNA, 25 bp, Homo sapien
gtcaggacgctgtggtatattgcct

SEQ ID NO: 262391 - DNA, 25 bp, Homo sapien
caggaatgcatcttttccaaagtga

SEQ ID NO: 262392 - DNA, 25 bp, Homo sapien
ggaatgcatcttttccaaagtgagc

SEQ ID NO: 262393 - DNA, 25 bp, Homo sapien
gaatgcatcttttccaaagtgagcg

SEQ ID NO: 262394 - DNA, 25 bp, Homo sapien
aatgcatcttttccaaagtgagcgg

SEQ ID NO: 262395 - DNA, 25 bp, Homo sapien
atgcatcttttccaaagtgagcggt

SEQ ID NO: 262396 - DNA, 25 bp, Homo sapien
tgcatcttttccaaagtgagcggtg

SEQ ID NO: 262397 - DNA, 25 bp, Homo sapien
gcatcttttccaaagtgagcggtgg

SEQ ID NO: 262398 - DNA, 25 bp, Homo sapien
atcttttccaaagtgagcggtggcc

SEQ ID NO: 262399 - DNA, 25 bp, Homo sapien
tcttttccaaagtgagcggtggccc

SEQ ID NO: 262400 - DNA, 25 bp, Homo sapien
tgccagcgctctgcgaacccggcga

SEQ ID NO: 262401 - DNA, 25 bp, Homo sapien
cgcactgggccgtctacgtgggcgg

SEQ ID NO: 262402 - DNA, 25 bp, Homo sapien
aactcctgggcttaatcacttaaga

SEQ ID NO: 262403 - DNA, 25 bp, Homo sapien
aatcacttaagacctcctgtcttgg

SEQ ID NO: 262404 - DNA, 25 bp, Homo sapien
taagacctcctgtcttggtctccca

SEQ ID NO: 262405 - DNA, 25 bp, Homo sapien
accatgcctcacttttagcgcagtg

SEQ ID NO: 262406 - DNA, 25 bp, Homo sapien
acttttagcgcagtgtgatcctaca

SEQ ID NO: 262407 - DNA, 25 bp, Homo sapien
gtgatcctacacaaattgccctgtg

SEQ ID NO: 262408 - DNA, 25 bp, Homo sapien
aaattgccctgtgtatattccaagg

SEQ ID NO: 262409 - DNA, 25 bp, Homo sapien
attccaagggacgatctgggtttgt

SEQ ID NO: 262410 - DNA, 25 bp, Homo sapien
gtagggccagaaacacgtgcagttc

SEQ ID NO: 262411 - DNA, 25 bp, Homo sapien
tgtgtttgtagaggcagcatcttgc

SEQ ID NO: 262412 - DNA, 25 bp, Homo sapien
gctatgttgtctaagctgatctcga

SEQ ID NO: 262413 - DNA, 25 bp, Homo sapien
agggccacccatgaggcaagcgaat

SEQ ID NO: 262414 - DNA, 25 bp, Homo sapien
atgaaatattcacctggactcacca

SEQ ID NO: 262415 - DNA, 25 bp, Homo sapien
gactcaccatcatcaacacttcaag

SEQ ID NO: 262416 - DNA, 25 bp, Homo sapien
ttcttttaaagagtcctgagggcca

SEQ ID NO: 262417 - DNA, 25 bp, Homo sapien
gaaaactgtggtttggatgatcaaa

SEQ ID NO: 262418 - DNA, 25 bp, Homo sapien
gatcaaaaccatttaccatcccagc

SEQ ID NO: 262419 - DNA, 25 bp, Homo sapien
aaagagtcctgagggccaagatggc

SEQ ID NO: 262420 - DNA, 25 bp, Homo sapien
aagagcatgtttcagcaccaactcc

SEQ ID NO: 262421 - DNA, 25 bp, Homo sapien
tgctttaaaacagggacggtcagat

SEQ ID NO: 262422 - DNA, 25 bp, Homo sapien
aaaccatcgctacccaggatggaag

SEQ ID NO: 262423 - DNA, 25 bp, Homo sapien
aggatggaagcctcatttcgccagg

SEQ ID NO: 262424 - DNA, 25 bp, Homo sapien
ataagataactgcatgtgactctat

SEQ ID NO: 262425 - DNA, 25 bp, Homo sapien
gataactgcatgtgactctatatgt

SEQ ID NO: 262426 - DNA, 25 bp, Homo sapien
gcatgtgactctatatgtatctcaa

SEQ ID NO: 262427 - DNA, 25 bp, Homo sapien
taaggcagccttataaatactgtta

SEQ ID NO: 262428 - DNA, 25 bp, Homo sapien
gccttataaatactgttaatctcta

SEQ ID NO: 262429 - DNA, 25 bp, Homo sapien
ataacagactatgctgaccttcttt

SEQ ID NO: 262430 - DNA, 25 bp, Homo sapien
tgaaatgacctatatattcccttat

SEQ ID NO: 262431 - DNA, 25 bp, Homo sapien
atgacctatatattcccttatagag

SEQ ID NO: 262432 - DNA, 25 bp, Homo sapien
atattcccttatagagactcattaa

SEQ ID NO: 262433 - DNA, 25 bp, Homo sapien
aaattatggttatctctacaatgga

SEQ ID NO: 262434 - DNA, 25 bp, Homo sapien
ggttatctctacaatggagtattat

SEQ ID NO: 262435 - DNA, 25 bp, Homo sapien
gggtatggacagcagaggatggcac

SEQ ID NO: 262436 - DNA, 25 bp, Homo sapien
ggtatggacagcagaggatggcact

SEQ ID NO: 262437 - DNA, 25 bp, Homo sapien
gtatggacagcagaggatggcactg

SEQ ID NO: 262438 - DNA, 25 bp, Homo sapien
ggcactgctcaccgcttccccaact

SEQ ID NO: 262439 - DNA, 25 bp, Homo sapien
gcactgctcaccgcttccccaactc

SEQ ID NO: 262440 - DNA, 25 bp, Homo sapien
cactgctcaccgcttccccaactcc

SEQ ID NO: 262441 - DNA, 25 bp, Homo sapien
ttccccaactcctgcaggatcagcg

SEQ ID NO: 262442 - DNA, 25 bp, Homo sapien
tccccaactcctgcaggatcagcga

SEQ ID NO: 262443 - DNA, 25 bp, Homo sapien
ccccaactcctgcaggatcagcgac

SEQ ID NO: 262444 - DNA, 25 bp, Homo sapien
cccaactcctgcaggatcagcgaca

SEQ ID NO: 262445 - DNA, 25 bp, Homo sapien
ccaactcctgcaggatcagcgacat

SEQ ID NO: 262446 - DNA, 25 bp, Homo sapien
tcaggcacagcatcatggagttctg

SEQ ID NO: 262447 - DNA, 25 bp, Homo sapien
agcatcatggagttctgcttcagct

SEQ ID NO: 262448 - DNA, 25 bp, Homo sapien
gttctgcttcagcttgtactgaaac

SEQ ID NO: 262449 - DNA, 25 bp, Homo sapien
tcagcttgtactgaaacgcacttca

SEQ ID NO: 262450 - DNA, 25 bp, Homo sapien
gctcgtccatccaggcaaatgaaga

SEQ ID NO: 262451 - DNA, 25 bp, Homo sapien
gaaacgcacttcagaacatgccttg

SEQ ID NO: 262452 - DNA, 25 bp, Homo sapien
cgcacttcagaacatgccttgttcc

SEQ ID NO: 262453 - DNA, 25 bp, Homo sapien
aatgaagaccataagctgggctacg

SEQ ID NO: 262454 - DNA, 25 bp, Homo sapien
taagctgggctacggtccctcagga

SEQ ID NO: 262455 - DNA, 25 bp, Homo sapien
gctgggctacggtccctcaggacga

SEQ ID NO: 262456 - DNA, 25 bp, Homo sapien
ctgcttgcatttcagctcaggcaca

SEQ ID NO: 262457 - DNA, 25 bp, Homo sapien
atatctccccacaaacctaaacaat

SEQ ID NO: 262458 - DNA, 25 bp, Homo sapien
cctaaacaatttcgagagggacttg

SEQ ID NO: 262459 - DNA, 25 bp, Homo sapien
atttcgagagggacttgtgttctgc

SEQ ID NO: 262460 - DNA, 25 bp, Homo sapien
gagagggacttgtgttctgcaacca

SEQ ID NO: 262461 - DNA, 25 bp, Homo sapien
gagggacttgtgttctgcaaccagt

SEQ ID NO: 262462 - DNA, 25 bp, Homo sapien
gggacttgtgttctgcaaccagtca

SEQ ID NO: 262463 - DNA, 25 bp, Homo sapien
gacttgtgttctgcaaccagtcaca

SEQ ID NO: 262464 - DNA, 25 bp, Homo sapien
cttgtgttctgcaaccagtcacaga

SEQ ID NO: 262465 - DNA, 25 bp, Homo sapien
gtgttctgcaaccagtcacagaata

SEQ ID NO: 262466 - DNA, 25 bp, Homo sapien
tgcaaccagtcacagaatatcaggt

SEQ ID NO: 262467 - DNA, 25 bp, Homo sapien
ccagtcacagaatatcaggtgagct

SEQ ID NO: 262468 - DNA, 25 bp, Homo sapien
caggtcttatcgtatcccttgccat

SEQ ID NO: 262469 - DNA, 25 bp, Homo sapien
ttatcgtatcccttgccatctgaac

SEQ ID NO: 262470 - DNA, 25 bp, Homo sapien
gccatctgaacttgtttgcactgct

SEQ ID NO: 262471 - DNA, 25 bp, Homo sapien
tctgaacttgtttgcactgcttctg

SEQ ID NO: 262472 - DNA, 25 bp, Homo sapien
tcttgaaaaacttccccggtatgat

SEQ ID NO: 262473 - DNA, 25 bp, Homo sapien
aacttccccggtatgatgattgttg

SEQ ID NO: 262474 - DNA, 25 bp, Homo sapien
caactttttctatagtcattgatgg

SEQ ID NO: 262475 - DNA, 25 bp, Homo sapien
gggaaatcactggagatcaaatatg

SEQ ID NO: 262476 - DNA, 25 bp, Homo sapien
ccagtttactcatggattttagcta

SEQ ID NO: 262477 - DNA, 25 bp, Homo sapien
ttagctattttttcactgggtaaat

SEQ ID NO: 262478 - DNA, 25 bp, Homo sapien
gcattttcatggctcttaataaaca

SEQ ID NO: 262479 - DNA, 25 bp, Homo sapien
gagacggcaacgttctggctgccat

SEQ ID NO: 262480 - DNA, 25 bp, Homo sapien
tctggctgccattagacttacgtct

SEQ ID NO: 262481 - DNA, 25 bp, Homo sapien
gctgccattagacttacgtctccct

SEQ ID NO: 262482 - DNA, 25 bp, Homo sapien
agaaatgtgcaaaaggcccctccgg

SEQ ID NO: 262483 - DNA, 25 bp, Homo sapien
aaatgtgcaaaaggcccctccggag

SEQ ID NO: 262484 - DNA, 25 bp, Homo sapien
gagaaaactattttgccgttcagct

SEQ ID NO: 262485 - DNA, 25 bp, Homo sapien
aactattttgccgttcagctgttct

SEQ ID NO: 262486 - DNA, 25 bp, Homo sapien
tcagctgttctttacagaggatgtt

SEQ ID NO: 262487 - DNA, 25 bp, Homo sapien
gttattttagtgagacccaggtcct

SEQ ID NO: 262488 - DNA, 25 bp, Homo sapien
agacccaggtcctagaccttctgat

SEQ ID NO: 262489 - DNA, 25 bp, Homo sapien
gtcctagaccttctgattcctattt

SEQ ID NO: 262490 - DNA, 25 bp, Homo sapien
gttaaagtttcaccatgcagctcat

SEQ ID NO: 262491 - DNA, 25 bp, Homo sapien
tttcaccatgcagctcatgctggac

SEQ ID NO: 262492 - DNA, 25 bp, Homo sapien
gctcatgctggactagagcaaatag

SEQ ID NO: 262493 - DNA, 25 bp, Homo sapien
ggcttccttcaagcggagtggttga

SEQ ID NO: 262494 - DNA, 25 bp, Homo sapien
gatagggcggctcggctccaggaaa

SEQ ID NO: 262495 - DNA, 25 bp, Homo sapien
aggaaagccggctgtgtcactgcag

SEQ ID NO: 262496 - DNA, 25 bp, Homo sapien
aagccggctgtgtcactgcagggct

SEQ ID NO: 262497 - DNA, 25 bp, Homo sapien
acagcgcctccttttggataaggca

SEQ ID NO: 262498 - DNA, 25 bp, Homo sapien
gataaggcacaaaacaccctttctt

SEQ ID NO: 262499 - DNA, 25 bp, Homo sapien
ctttcttaaagttgccggtgttctg

SEQ ID NO: 262500 - DNA, 25 bp, Homo sapien
gatgaaacatcctggagaagcgtac

SEQ ID NO: 262501 - DNA, 25 bp, Homo sapien
atcagtacctgaatatgtctttttg

SEQ ID NO: 262502 - DNA, 25 bp, Homo sapien
agcctcccgagtacaatacctgaat

SEQ ID NO: 262503 - DNA, 25 bp, Homo sapien
tcccgagtacaatacctgaatttta

SEQ ID NO: 262504 - DNA, 25 bp, Homo sapien
tcatttaggatgagaactttgtgta

SEQ ID NO: 262505 - DNA, 25 bp, Homo sapien
atgaaatgagattttgctgcactct

SEQ ID NO: 262506 - DNA, 25 bp, Homo sapien
tgctgcactctgacataagataata

SEQ ID NO: 262507 - DNA, 25 bp, Homo sapien
agaactttgtgtatagttgagtcaa

SEQ ID NO: 262508 - DNA, 25 bp, Homo sapien
tgtgtatagttgagtcaagtttcac

SEQ ID NO: 262509 - DNA, 25 bp, Homo sapien
taaaatttctgatcattggtatgtc

SEQ ID NO: 262510 - DNA, 25 bp, Homo sapien
gatcattggtatgtcaatctcttga

SEQ ID NO: 262511 - DNA, 25 bp, Homo sapien
ggtatgtcaatctcttgatgaaaaa

SEQ ID NO: 262512 - DNA, 25 bp, Homo sapien
caattccacggccaaacaggtttat

SEQ ID NO: 262513 - DNA, 25 bp, Homo sapien
aaaagcctgcgaagagttccagtta

SEQ ID NO: 262514 - DNA, 25 bp, Homo sapien
gaatctggctgagatcctgatcgct

SEQ ID NO: 262515 - DNA, 25 bp, Homo sapien
tgagatcctgatcgcttacaagctg

SEQ ID NO: 262516 - DNA, 25 bp, Homo sapien
gatcgcttacaagctgaggctttta

SEQ ID NO: 262517 - DNA, 25 bp, Homo sapien
gaagtgctggctagttggaactgtt

SEQ ID NO: 262518 - DNA, 25 bp, Homo sapien
ggaactgtttggacactttccaact

SEQ ID NO: 262519 - DNA, 25 bp, Homo sapien
gccgttaggctctgttgcggttaga

SEQ ID NO: 262520 - DNA, 25 bp, Homo sapien
gagctgttatgctctgttgaagcta

SEQ ID NO: 262521 - DNA, 25 bp, Homo sapien
gctttgtttcttgagaacacagtca

SEQ ID NO: 262522 - DNA, 25 bp, Homo sapien
gagaacacagtcatcaaggttgtaa

SEQ ID NO: 262523 - DNA, 25 bp, Homo sapien
ttaatcatcacctcagtcctctgaa

SEQ ID NO: 262524 - DNA, 25 bp, Homo sapien
caggcaagtgtgtccattttacaga

SEQ ID NO: 262525 - DNA, 25 bp, Homo sapien
gcaagtccttgcctgagactaaaca

SEQ ID NO: 262526 - DNA, 25 bp, Homo sapien
taggacgaggctggaattcccacac

SEQ ID NO: 262527 - DNA, 25 bp, Homo sapien
gaattcccacacctggactaatgca

SEQ ID NO: 262528 - DNA, 25 bp, Homo sapien
atgcacagccagtgtttcaacgtcg

SEQ ID NO: 262529 - DNA, 25 bp, Homo sapien
ttcaacgtcgccaacccagaaatgt

SEQ ID NO: 262530 - DNA, 25 bp, Homo sapien
ccagaaatgttttctctccctgtca

SEQ ID NO: 262531 - DNA, 25 bp, Homo sapien
cgatcctaatcaagtgtgagcccac

SEQ ID NO: 262532 - DNA, 25 bp, Homo sapien
gagcccactgtctaatgcggtgcat

SEQ ID NO: 262533 - DNA, 25 bp, Homo sapien
gcaggtgcacgggtcttaatcatca

SEQ ID NO: 262534 - DNA, 25 bp, Homo sapien
tatggatgatcttccccaacccctt

SEQ ID NO: 262535 - DNA, 25 bp, Homo sapien
ggctctctgtgtaaacagttctcat

SEQ ID NO: 262536 - DNA, 25 bp, Homo sapien
cagttctcatcagtggaatgtggtt

SEQ ID NO: 262537 - DNA, 25 bp, Homo sapien
tcatcttcttggtggtcatgttatt

SEQ ID NO: 262538 - DNA, 25 bp, Homo sapien
gttaaaaactcacctgcatgcagca

SEQ ID NO: 262539 - DNA, 25 bp, Homo sapien
ctgcatgcagcacatgacaggctaa

SEQ ID NO: 262540 - DNA, 25 bp, Homo sapien
gacaggctaaaatctcttgtggaca

SEQ ID NO: 262541 - DNA, 25 bp, Homo sapien
gtaacaaaggcacccaccagggttg

SEQ ID NO: 262542 - DNA, 25 bp, Homo sapien
aaaggcacccaccagggttgagcat

SEQ ID NO: 262543 - DNA, 25 bp, Homo sapien
ggttgagcatccgtgttgctgacaa

SEQ ID NO: 262544 - DNA, 25 bp, Homo sapien
tccgtgttgctgacaacgaccacca

SEQ ID NO: 262545 - DNA, 25 bp, Homo sapien
aaagctcacttgtttccgtattcta

SEQ ID NO: 262546 - DNA, 25 bp, Homo sapien
gtttccgtattctaagcggacgcga

SEQ ID NO: 262547 - DNA, 25 bp, Homo sapien
ctaagcggacgcgaacattgttctt

SEQ ID NO: 262548 - DNA, 25 bp, Homo sapien
aacattgttcttttctcgtgctttc

SEQ ID NO: 262549 - DNA, 25 bp, Homo sapien
ttctcgtgctttcccactttcaaga

SEQ ID NO: 262550 - DNA, 25 bp, Homo sapien
gcctgcccacatttcgagttatctt

SEQ ID NO: 262551 - DNA, 25 bp, Homo sapien
gagttatcttcgtcggctcctgcaa

SEQ ID NO: 262552 - DNA, 25 bp, Homo sapien
ggtggctactctccgctcatccaga

SEQ ID NO: 262553 - DNA, 25 bp, Homo sapien
tgcgccttcttcctgcgatgaccga

SEQ ID NO: 262554 - DNA, 25 bp, Homo sapien
aagcagcagatcagcactcttcttc

SEQ ID NO: 262555 - DNA, 25 bp, Homo sapien
gagtattttcctttaaagctcactt

SEQ ID NO: 262556 - DNA, 25 bp, Homo sapien
tgaaattccttctatttgatcatat

SEQ ID NO: 262557 - DNA, 25 bp, Homo sapien
tatagtccaacttaatacctagcct

SEQ ID NO: 262558 - DNA, 25 bp, Homo sapien
gtccaacttaatacctagccttatg

SEQ ID NO: 262559 - DNA, 25 bp, Homo sapien
acttaatacctagccttatgagttg

SEQ ID NO: 262560 - DNA, 25 bp, Homo sapien
atacctagccttatgagttgtataa

SEQ ID NO: 262561 - DNA, 25 bp, Homo sapien
tataaggtaaggttacctacctgag

SEQ ID NO: 262562 - DNA, 25 bp, Homo sapien
caatcttattcattagagaacatgg

SEQ ID NO: 262563 - DNA, 25 bp, Homo sapien
gaacatggtgcttagggtctgagac

SEQ ID NO: 262564 - DNA, 25 bp, Homo sapien
gtgcttagggtctgagaccttttga

SEQ ID NO: 262565 - DNA, 25 bp, Homo sapien
ccttttgaaaggtctgagaactctt

SEQ ID NO: 262566 - DNA, 25 bp, Homo sapien
tgaaaggtctgagaactctttaaaa

SEQ ID NO: 262567 - DNA, 25 bp, Homo sapien
gttagcgtgtactattggttttctt

SEQ ID NO: 262568 - DNA, 25 bp, Homo sapien
ttacttcctctagttgtgaaggcag

SEQ ID NO: 262569 - DNA, 25 bp, Homo sapien
aacattgcataagttaccttttttg

SEQ ID NO: 262570 - DNA, 25 bp, Homo sapien
gtattaggtgatgtgcagtactgaa

SEQ ID NO: 262571 - DNA, 25 bp, Homo sapien
tgatgtgcagtactgaaagtgcagt

SEQ ID NO: 262572 - DNA, 25 bp, Homo sapien
gaaagtgcagtatctaaccaactag

SEQ ID NO: 262573 - DNA, 25 bp, Homo sapien
gtatctaaccaactagaacgtttgt

SEQ ID NO: 262574 - DNA, 25 bp, Homo sapien
gaacaagtgcacctttgttatatat

SEQ ID NO: 262575 - DNA, 25 bp, Homo sapien
ttggaaagtgactattctggctttt

SEQ ID NO: 262576 - DNA, 25 bp, Homo sapien
ctttcttctttttctacaatcgagt

SEQ ID NO: 262577 - DNA, 25 bp, Homo sapien
tttttctacaatcgagttagcgtgt

SEQ ID NO: 262578 - DNA, 25 bp, Homo sapien
tttgttgttcctttaacctttgctg

SEQ ID NO: 262579 - DNA, 25 bp, Homo sapien
gttcctttaacctttgctgtagtgt

SEQ ID NO: 262580 - DNA, 25 bp, Homo sapien
taacctttgctgtagtgtttctttt

SEQ ID NO: 262581 - DNA, 25 bp, Homo sapien
tagttccttctatacatgtttgcag

SEQ ID NO: 262582 - DNA, 25 bp, Homo sapien
ccttctatacatgtttgcagtgtta

SEQ ID NO: 262583 - DNA, 25 bp, Homo sapien
gtttgcagtgttaagataattgtac

SEQ ID NO: 262584 - DNA, 25 bp, Homo sapien
gtactttgaaaacaccagctgtata

SEQ ID NO: 262585 - DNA, 25 bp, Homo sapien
aaacaccagctgtatatatttttct

SEQ ID NO: 262586 - DNA, 25 bp, Homo sapien
atttttgatctttgagtgtattcta

SEQ ID NO: 262587 - DNA, 25 bp, Homo sapien
attctatttgtgtaaggactttggc

SEQ ID NO: 262588 - DNA, 25 bp, Homo sapien
aggactttggcttacatttgaataa

SEQ ID NO: 262589 - DNA, 25 bp, Homo sapien
gggtaactcatagtaaaagtggctt

SEQ ID NO: 262590 - DNA, 25 bp, Homo sapien
ctctttgtagagaattactcacaag

SEQ ID NO: 262591 - DNA, 25 bp, Homo sapien
gaattactcacaagaaatactttct

SEQ ID NO: 262592 - DNA, 25 bp, Homo sapien
gaaggttgagctgaactgtggacta

SEQ ID NO: 262593 - DNA, 25 bp, Homo sapien
ttgagctgaactgtggactatgaac

SEQ ID NO: 262594 - DNA, 25 bp, Homo sapien
gactatgaacattgtcctgccaaaa

SEQ ID NO: 262595 - DNA, 25 bp, Homo sapien
atgaacattgtcctgccaaaaagct

SEQ ID NO: 262596 - DNA, 25 bp, Homo sapien
cattttgaatttctctgtccaccac

SEQ ID NO: 262597 - DNA, 25 bp, Homo sapien
ctgtccaccaccatttcaaatatct

SEQ ID NO: 262598 - DNA, 25 bp, Homo sapien
tagctaaattcctaaaccacctaca

SEQ ID NO: 262599 - DNA, 25 bp, Homo sapien
accacctacaaaaactgaaccacat

SEQ ID NO: 262600 - DNA, 25 bp, Homo sapien
aagaatttggattcagccgcgaaga

SEQ ID NO: 262601 - DNA, 25 bp, Homo sapien
gattcagccgcgaagagatttatca

SEQ ID NO: 262602 - DNA, 25 bp, Homo sapien
gagatttatcagcttaactcagata

SEQ ID NO: 262603 - DNA, 25 bp, Homo sapien
aaagctagtctctaacttccaggcc

SEQ ID NO: 262604 - DNA, 25 bp, Homo sapien
aggcccacggctcaagtgaatttga

SEQ ID NO: 262605 - DNA, 25 bp, Homo sapien
gaatactgcatttacagtgtagagt

SEQ ID NO: 262606 - DNA, 25 bp, Homo sapien
gtaacacataacattgtatgcatgg

SEQ ID NO: 262607 - DNA, 25 bp, Homo sapien
gtgtcctaccactctaatcaagaaa

SEQ ID NO: 262608 - DNA, 25 bp, Homo sapien
attacagactctgattctacagtga

SEQ ID NO: 262609 - DNA, 25 bp, Homo sapien
tctacagtgatgattgaattctaaa

SEQ ID NO: 262610 - DNA, 25 bp, Homo sapien
aatggttatcattagggcttttgat

SEQ ID NO: 262611 - DNA, 25 bp, Homo sapien
ggcaagagatacatactctcttcaa

SEQ ID NO: 262612 - DNA, 25 bp, Homo sapien
gagcatgagatgcagccattctttc

SEQ ID NO: 262613 - DNA, 25 bp, Homo sapien
gcagccattctttcagcaaagcttc

SEQ ID NO: 262614 - DNA, 25 bp, Homo sapien
ttcagcaaagcttcattgacacctg

SEQ ID NO: 262615 - DNA, 25 bp, Homo sapien
attgacacctgcacctgttaactgt

SEQ ID NO: 262616 - DNA, 25 bp, Homo sapien
gcacctgttaactgtgttcgacatt

SEQ ID NO: 262617 - DNA, 25 bp, Homo sapien
aactgtgttcgacattgaagggaga

SEQ ID NO: 262618 - DNA, 25 bp, Homo sapien
aagatgtgcactctggactcaagaa

SEQ ID NO: 262619 - DNA, 25 bp, Homo sapien
tctggactcaagaaactcttagttc

SEQ ID NO: 262620 - DNA, 25 bp, Homo sapien
gaaactcttagttcagtggaggaaa

SEQ ID NO: 262621 - DNA, 25 bp, Homo sapien
aaggcttcaggcctttaagctcagc

SEQ ID NO: 262622 - DNA, 25 bp, Homo sapien
acgtagttccagtttctgtatctaa

SEQ ID NO: 262623 - DNA, 25 bp, Homo sapien
ttctgtatctaaagactcagcttgg

SEQ ID NO: 262624 - DNA, 25 bp, Homo sapien
tcagcttggagtcacttgtctggac

SEQ ID NO: 262625 - DNA, 25 bp, Homo sapien
cttggagtcacttgtctggactaaa

SEQ ID NO: 262626 - DNA, 25 bp, Homo sapien
taacccctccttgtctggtttgtga

SEQ ID NO: 262627 - DNA, 25 bp, Homo sapien
tttgtgactttctgtactctgatgc

SEQ ID NO: 262628 - DNA, 25 bp, Homo sapien
gtgactttctgtactctgatgcccc

SEQ ID NO: 262629 - DNA, 25 bp, Homo sapien
tcttgggccttccttcttgctctat

SEQ ID NO: 262630 - DNA, 25 bp, Homo sapien
cttcttgctctatatatggttttgg

SEQ ID NO: 262631 - DNA, 25 bp, Homo sapien
ctatatatggttttggattcattcc

SEQ ID NO: 262632 - DNA, 25 bp, Homo sapien
aaatatttactgtcatttcagtaga

SEQ ID NO: 262633 - DNA, 25 bp, Homo sapien
gttctcgaccagagctttgctccca

SEQ ID NO: 262634 - DNA, 25 bp, Homo sapien
agtccaggcgcctcattcggaggcc

SEQ ID NO: 262635 - DNA, 25 bp, Homo sapien
cattcggaggcctcttgactgggac

SEQ ID NO: 262636 - DNA, 25 bp, Homo sapien
agagatgttttctccgctctgactt

SEQ ID NO: 262637 - DNA, 25 bp, Homo sapien
tgacttgtggctcaggactactttc

SEQ ID NO: 262638 - DNA, 25 bp, Homo sapien
aggactactttctgggtcgtgctcc

SEQ ID NO: 262639 - DNA, 25 bp, Homo sapien
tgtgcctgggcccataaacaacagg

SEQ ID NO: 262640 - DNA, 25 bp, Homo sapien
gcccataaacaacaggagccttttg

SEQ ID NO: 262641 - DNA, 25 bp, Homo sapien
tgccttccatggagggaaatgggac

SEQ ID NO: 262642 - DNA, 25 bp, Homo sapien
tgctttgctgttgccgagcacgagt

SEQ ID NO: 262643 - DNA, 25 bp, Homo sapien
gccgagcacgagtaaagcttttgtt

SEQ ID NO: 262644 - DNA, 25 bp, Homo sapien
tcaggcacagcatcatggagttctg

SEQ ID NO: 262645 - DNA, 25 bp, Homo sapien
gttctgcttcagcttgtactgaaac

SEQ ID NO: 262646 - DNA, 25 bp, Homo sapien
gcttcagcttgtactgaaacgcact

SEQ ID NO: 262647 - DNA, 25 bp, Homo sapien
gctcgtccatccaggcaaatgaaga

SEQ ID NO: 262648 - DNA, 25 bp, Homo sapien
agcttgtactgaaacgcacttcaga

SEQ ID NO: 262649 - DNA, 25 bp, Homo sapien
gaaacgcacttcagaacatgccttg

SEQ ID NO: 262650 - DNA, 25 bp, Homo sapien
aacgcacttcagaacatgccttgtt

SEQ ID NO: 262651 - DNA, 25 bp, Homo sapien
cgcacttcagaacatgccttgttcc

SEQ ID NO: 262652 - DNA, 25 bp, Homo sapien
aatgaagaccataagctgggctacg

SEQ ID NO: 262653 - DNA, 25 bp, Homo sapien
taagctgggctacggtccctcagga

SEQ ID NO: 262654 - DNA, 25 bp, Homo sapien
gctgggctacggtccctcaggacga

SEQ ID NO: 262655 - DNA, 25 bp, Homo sapien
atttcacaagccttcacaggcacgg

SEQ ID NO: 262656 - DNA, 25 bp, Homo sapien
agcatgctttgcttgcgatcacctc

SEQ ID NO: 262657 - DNA, 25 bp, Homo sapien
gaatctgcccaaatcaagccgttta

SEQ ID NO: 262658 - DNA, 25 bp, Homo sapien
atcgcccttcggaggaaagcggcag

SEQ ID NO: 262659 - DNA, 25 bp, Homo sapien
gaaagcggcagctggtcaggctcct

SEQ ID NO: 262660 - DNA, 25 bp, Homo sapien
gagacctttcaggagagccctgaga

SEQ ID NO: 262661 - DNA, 25 bp, Homo sapien
ggaactgaggccaccgtgagcaaga

SEQ ID NO: 262662 - DNA, 25 bp, Homo sapien
caagccgtttatagcttcgaggtat

SEQ ID NO: 262663 - DNA, 25 bp, Homo sapien
ttcgaggtattaaacagccactagg

SEQ ID NO: 262664 - DNA, 25 bp, Homo sapien
aacagccactaggacagttgatgaa

SEQ ID NO: 262665 - DNA, 25 bp, Homo sapien
gagtcagtggcatttcacaagcctt

SEQ ID NO: 262666 - DNA, 25 bp, Homo sapien
agagaacttgaatagctatgcatat

SEQ ID NO: 262667 - DNA, 25 bp, Homo sapien
aatagctatgcatatttgtgttttc

SEQ ID NO: 262668 - DNA, 25 bp, Homo sapien
cttccttgctttgttatgtacatat

SEQ ID NO: 262669 - DNA, 25 bp, Homo sapien
tatttgtatatatcagccactaact

SEQ ID NO: 262670 - DNA, 25 bp, Homo sapien
atatcagccactaacttcttatctt

SEQ ID NO: 262671 - DNA, 25 bp, Homo sapien
ctttccttcattcttcacttactaa

SEQ ID NO: 262672 - DNA, 25 bp, Homo sapien
atttacataaggtactggtagttca

SEQ ID NO: 262673 - DNA, 25 bp, Homo sapien
gtactggtagttcatataaattcat

SEQ ID NO: 262674 - DNA, 25 bp, Homo sapien
gcagaattgcaactgaacttaagca

SEQ ID NO: 262675 - DNA, 25 bp, Homo sapien
aagcaagaatcattatcacccaggg

SEQ ID NO: 262676 - DNA, 25 bp, Homo sapien
tttgtgccccatttaaggaaagaga

SEQ ID NO: 262677 - DNA, 25 bp, Homo sapien
cttgaagccacttcccaggtgatgt

SEQ ID NO: 262678 - DNA, 25 bp, Homo sapien
gtgttgctgccagaagccctgaagc

SEQ ID NO: 262679 - DNA, 25 bp, Homo sapien
tgtgagcatgtggaaccggagcacc

SEQ ID NO: 262680 - DNA, 25 bp, Homo sapien
agcacccaggtgttgctcagctctg

SEQ ID NO: 262681 - DNA, 25 bp, Homo sapien
gctcagctctggtgtgcctgaacaa

SEQ ID NO: 262682 - DNA, 25 bp, Homo sapien
tctggtgtgcctgaacaagaggaca

SEQ ID NO: 262683 - DNA, 25 bp, Homo sapien
gacaaagaaggtagcacctttcctc

SEQ ID NO: 262684 - DNA, 25 bp, Homo sapien
tagcacctttcctcccgttgagcaa

SEQ ID NO: 262685 - DNA, 25 bp, Homo sapien
tgagcaacatcccatccagacaggt

SEQ ID NO: 262686 - DNA, 25 bp, Homo sapien
tccacagggtctggagctggcagac

SEQ ID NO: 262687 - DNA, 25 bp, Homo sapien
caggatcctggcagatggcctcgaa

SEQ ID NO: 262688 - DNA, 25 bp, Homo sapien
tgacaggtccatcctaactctgagg

SEQ ID NO: 262689 - DNA, 25 bp, Homo sapien
ccatcctaactctgaggtccttttg

SEQ ID NO: 262690 - DNA, 25 bp, Homo sapien
tttgtagtcaactttgtgctctcct

SEQ ID NO: 262691 - DNA, 25 bp, Homo sapien
ttgtgctctcctccattagtgatgt

SEQ ID NO: 262692 - DNA, 25 bp, Homo sapien
tcctccattagtgatgttttctcaa

SEQ ID NO: 262693 - DNA, 25 bp, Homo sapien
gtatctgaacacttacttcccaagt

SEQ ID NO: 262694 - DNA, 25 bp, Homo sapien
acttcccaagtataaatgacattca

SEQ ID NO: 262695 - DNA, 25 bp, Homo sapien
tccactggaataggcaaggaagtac

SEQ ID NO: 262696 - DNA, 25 bp, Homo sapien
tactgcctatataatctacttctgt

SEQ ID NO: 262697 - DNA, 25 bp, Homo sapien
tctacttctgtagacttctagaatg

SEQ ID NO: 262698 - DNA, 25 bp, Homo sapien
aaacaacatgggataatcttcagtc

SEQ ID NO: 262699 - DNA, 25 bp, Homo sapien
cagttgtcaccttcggcatcaaaca

SEQ ID NO: 262700 - DNA, 25 bp, Homo sapien
accttcggcatcaaacactctgatt

SEQ ID NO: 262701 - DNA, 25 bp, Homo sapien
aaacactctgattacatgactcccc

SEQ ID NO: 262702 - DNA, 25 bp, Homo sapien
gactcccctgctggttgatgtggaa

SEQ ID NO: 262703 - DNA, 25 bp, Homo sapien
tgatgtggaataacgccagccctgc

SEQ ID NO: 262704 - DNA, 25 bp, Homo sapien
ggcatctacacaagatccgccgggc

SEQ ID NO: 262705 - DNA, 25 bp, Homo sapien
gggccacagagctcgaggctgtctt

SEQ ID NO: 262706 - DNA, 25 bp, Homo sapien
cctgcagggcagagcacgcttgttt

SEQ ID NO: 262707 - DNA, 25 bp, Homo sapien
gcagagcacgcttgtttgggcaatt

SEQ ID NO: 262708 - DNA, 25 bp, Homo sapien
gtttgggcaattgtaatcagttact

SEQ ID NO: 262709 - DNA, 25 bp, Homo sapien
ttttttctatgctattttaccattt

SEQ ID NO: 262710 - DNA, 25 bp, Homo sapien
tcacctcctcttcatgtgatgtgga

SEQ ID NO: 262711 - DNA, 25 bp, Homo sapien
gatgtggacccctgggagcatcagt

SEQ ID NO: 262712 - DNA, 25 bp, Homo sapien
agtgtcctcatctgtccaatgacag

SEQ ID NO: 262713 - DNA, 25 bp, Homo sapien
acagcccttttctcacagagttatt

SEQ ID NO: 262714 - DNA, 25 bp, Homo sapien
tcaacaatttcttggcatagtgcct

SEQ ID NO: 262715 - DNA, 25 bp, Homo sapien
gtgtgcttagcgcaaatggcagctc

SEQ ID NO: 262716 - DNA, 25 bp, Homo sapien
atggcagctctcatcatgaatgata

SEQ ID NO: 262717 - DNA, 25 bp, Homo sapien
gaatgatagactctttcaccctgct

SEQ ID NO: 262718 - DNA, 25 bp, Homo sapien
gctggtcccaggtcggcacacacat

SEQ ID NO: 262719 - DNA, 25 bp, Homo sapien
atttctcctttctgtgcacagcact

SEQ ID NO: 262720 - DNA, 25 bp, Homo sapien
gtgcacagcactttattgttacaaa

SEQ ID NO: 262721 - DNA, 25 bp, Homo sapien
catttggttctaatgaagatgtcat

SEQ ID NO: 262722 - DNA, 25 bp, Homo sapien
tttggttctaatgaagatgtcatag

SEQ ID NO: 262723 - DNA, 25 bp, Homo sapien
gatgtcatagttctttctatggtta

SEQ ID NO: 262724 - DNA, 25 bp, Homo sapien
gtcatagttctttctatggttataa

SEQ ID NO: 262725 - DNA, 25 bp, Homo sapien
tagttctttctatggttataataag

SEQ ID NO: 262726 - DNA, 25 bp, Homo sapien
tggttataataagttttgtggttcg

SEQ ID NO: 262727 - DNA, 25 bp, Homo sapien
ttcttttttttgctctgtgtagcag

SEQ ID NO: 262728 - DNA, 25 bp, Homo sapien
ttttttgctctgtgtagcagaaaga

SEQ ID NO: 262729 - DNA, 25 bp, Homo sapien
ttttgctctgtgtagcagaaagaac

SEQ ID NO: 262730 - DNA, 25 bp, Homo sapien
ttgctctgtgtagcagaaagaactt

SEQ ID NO: 262731 - DNA, 25 bp, Homo sapien
tctgtgtagcagaaagaacttataa

SEQ ID NO: 262732 - DNA, 25 bp, Homo sapien
agatggacggactgttggaacacct

SEQ ID NO: 262733 - DNA, 25 bp, Homo sapien
acggactgttggaacacctgagggt

SEQ ID NO: 262734 - DNA, 25 bp, Homo sapien
aagctgcgcgaactcctcaaagagg

SEQ ID NO: 262735 - DNA, 25 bp, Homo sapien
gaaaattagcagaaatcaaaggcag

SEQ ID NO: 262736 - DNA, 25 bp, Homo sapien
aagcagtacaaaaccgttcacacaa

SEQ ID NO: 262737 - DNA, 25 bp, Homo sapien
gttcacacaacgatagagacggaat

SEQ ID NO: 262738 - DNA, 25 bp, Homo sapien
aggccctgctgacaaatctcagacg

SEQ ID NO: 262739 - DNA, 25 bp, Homo sapien
gacaaatctcagacgccaggaacag

SEQ ID NO: 262740 - DNA, 25 bp, Homo sapien
atctcagacgccaggaacagaagaa

SEQ ID NO: 262741 - DNA, 25 bp, Homo sapien
gaaaaatgcctgacagcttgagcca

SEQ ID NO: 262742 - DNA, 25 bp, Homo sapien
acagcttgagccagatggacggact

SEQ ID NO: 262743 - DNA, 25 bp, Homo sapien
gtgtatacatattatagtccactat

SEQ ID NO: 262744 - DNA, 25 bp, Homo sapien
atagtccactatatggatgcaccag

SEQ ID NO: 262745 - DNA, 25 bp, Homo sapien
gatgcaccagaattttttcccgaga

SEQ ID NO: 262746 - DNA, 25 bp, Homo sapien
tgcaccagaattttttcccgagatg

SEQ ID NO: 262747 - DNA, 25 bp, Homo sapien
ttatttagcgtggtatcacgagcat

SEQ ID NO: 262748 - DNA, 25 bp, Homo sapien
cgtggtatcacgagcatttccctgt

SEQ ID NO: 262749 - DNA, 25 bp, Homo sapien
gtatcacgagcatttccctgtgctg

SEQ ID NO: 262750 - DNA, 25 bp, Homo sapien
acgagcatttccctgtgctgttgta

SEQ ID NO: 262751 - DNA, 25 bp, Homo sapien
agcatttccctgtgctgttgtatac

SEQ ID NO: 262752 - DNA, 25 bp, Homo sapien
tttccctgtgctgttgtatacctga

SEQ ID NO: 262753 - DNA, 25 bp, Homo sapien
gtgctgttgtatacctgaaaacata

SEQ ID NO: 262754 - DNA, 25 bp, Homo sapien
aatgtcggctcctctgtctggaagt

SEQ ID NO: 262755 - DNA, 25 bp, Homo sapien
tcctctgtctggaagtcgagtctga

SEQ ID NO: 262756 - DNA, 25 bp, Homo sapien
gaaggccattggtttagttcagctt

SEQ ID NO: 262757 - DNA, 25 bp, Homo sapien
tggtttagttcagctttggccaaag

SEQ ID NO: 262758 - DNA, 25 bp, Homo sapien
ttggccaaaggaagggaccagctca

SEQ ID NO: 262759 - DNA, 25 bp, Homo sapien
gagtgaaagtgctggcctgattttt

SEQ ID NO: 262760 - DNA, 25 bp, Homo sapien
acatgtcaaaatgctagctcccact

SEQ ID NO: 262761 - DNA, 25 bp, Homo sapien
aaaagttatcttgccattacccaag

SEQ ID NO: 262762 - DNA, 25 bp, Homo sapien
gttcaagttcccaaagttaacatca

SEQ ID NO: 262763 - DNA, 25 bp, Homo sapien
taacatcacaggaaattacaccacc

SEQ ID NO: 262764 - DNA, 25 bp, Homo sapien
accaccaactgatttgccccaatgt

SEQ ID NO: 262765 - DNA, 25 bp, Homo sapien
tcaactcctgctcgcattattgaca

SEQ ID NO: 262766 - DNA, 25 bp, Homo sapien
tcctgctcgcattattgacaaatat

SEQ ID NO: 262767 - DNA, 25 bp, Homo sapien
cccctaatgagtttgtgttaagcgt

SEQ ID NO: 262768 - DNA, 25 bp, Homo sapien
gcgaatgagcgccttttaaaaaagt

SEQ ID NO: 262769 - DNA, 25 bp, Homo sapien
aaaagtgctacacccaggtttcacg

SEQ ID NO: 262770 - DNA, 25 bp, Homo sapien
tacacccaggtttcacggcgtggct

SEQ ID NO: 262771 - DNA, 25 bp, Homo sapien
tcacggcgtggctttattaccttaa

SEQ ID NO: 262772 - DNA, 25 bp, Homo sapien
gcgtggctttattaccttaagtatc

SEQ ID NO: 262773 - DNA, 25 bp, Homo sapien
ccctctgcactcaggcgaaatattc

SEQ ID NO: 262774 - DNA, 25 bp, Homo sapien
caggcgaaatattcctagctttgat

SEQ ID NO: 262775 - DNA, 25 bp, Homo sapien
aatattcctagctttgatgtttgca

SEQ ID NO: 262776 - DNA, 25 bp, Homo sapien
gatagaataatatcactcagtgtga

SEQ ID NO: 262777 - DNA, 25 bp, Homo sapien
gaaaaactcggtggtctcatatctt

SEQ ID NO: 262778 - DNA, 25 bp, Homo sapien
gtggtctcatatcttttgacagttg

SEQ ID NO: 262779 - DNA, 25 bp, Homo sapien
catatcttttgacagttgtttgtga

SEQ ID NO: 262780 - DNA, 25 bp, Homo sapien
ttgtttgtgaataataccctcccca

SEQ ID NO: 262781 - DNA, 25 bp, Homo sapien
ttgtgaataataccctccccaacaa

SEQ ID NO: 262782 - DNA, 25 bp, Homo sapien
gctttcttatgtggtaaatgtctca

SEQ ID NO: 262783 - DNA, 25 bp, Homo sapien
attttgctgcctggtatttgttcag

SEQ ID NO: 262784 - DNA, 25 bp, Homo sapien
gcctggtatttgttcagtttccttg

SEQ ID NO: 262785 - DNA, 25 bp, Homo sapien
gaatcaggctttctcccaactctga

SEQ ID NO: 262786 - DNA, 25 bp, Homo sapien
ctgaaacattcagacttactttctt

SEQ ID NO: 262787 - DNA, 25 bp, Homo sapien
ttgcctcatgatgtcctggtggagt

SEQ ID NO: 262788 - DNA, 25 bp, Homo sapien
ctcatgatgtcctggtggagtacca

SEQ ID NO: 262789 - DNA, 25 bp, Homo sapien
tggtggagtaccagcaacggcctca

SEQ ID NO: 262790 - DNA, 25 bp, Homo sapien
tggagtaccagcaacggcctcagct

SEQ ID NO: 262791 - DNA, 25 bp, Homo sapien
tggacatacaatgtgtacctatgat

SEQ ID NO: 262792 - DNA, 25 bp, Homo sapien
caatgtgtacctatgatttttatga

SEQ ID NO: 262793 - DNA, 25 bp, Homo sapien
agcactgtgctccttttccagagaa

SEQ ID NO: 262794 - DNA, 25 bp, Homo sapien
gcactgtgctccttttccagagaaa

SEQ ID NO: 262795 - DNA, 25 bp, Homo sapien
aagttagactacttgaagagagcat

SEQ ID NO: 262796 - DNA, 25 bp, Homo sapien
gagcatttaaagctggtgtcaggaa

SEQ ID NO: 262797 - DNA, 25 bp, Homo sapien
gtgtggactctgtggtctaaaagct

SEQ ID NO: 262798 - DNA, 25 bp, Homo sapien
actatagtgaccttcctaggctctc

SEQ ID NO: 262799 - DNA, 25 bp, Homo sapien
tccccatcctatgagaaactagtgg

SEQ ID NO: 262800 - DNA, 25 bp, Homo sapien
ctatgagaaactagtgggttgctgc

SEQ ID NO: 262801 - DNA, 25 bp, Homo sapien
ggccctgttcttaggatcagtggca

SEQ ID NO: 262802 - DNA, 25 bp, Homo sapien
ctgttcttaggatcagtggcaggga

SEQ ID NO: 262803 - DNA, 25 bp, Homo sapien
gaaacgggtatctcttttctctctt

SEQ ID NO: 262804 - DNA, 25 bp, Homo sapien
aaccaaaaattatcccagcatgagc

SEQ ID NO: 262805 - DNA, 25 bp, Homo sapien
aaaaattatcccagcatgagcacgg

SEQ ID NO: 262806 - DNA, 25 bp, Homo sapien
attatcccagcatgagcacgggcac

SEQ ID NO: 262807 - DNA, 25 bp, Homo sapien
atcccagcatgagcacgggcacgtg

SEQ ID NO: 262808 - DNA, 25 bp, Homo sapien
atgagcacgggcacgtgcccttcac

SEQ ID NO: 262809 - DNA, 25 bp, Homo sapien
agaacaggctcaagtctacttctca

SEQ ID NO: 262810 - DNA, 25 bp, Homo sapien
aagtctacttctcacgctggctctg

SEQ ID NO: 262811 - DNA, 25 bp, Homo sapien
gaaagttttgtttcagactggcagt

SEQ ID NO: 262812 - DNA, 25 bp, Homo sapien
gactggcagtgctgtctgatataaa

SEQ ID NO: 262813 - DNA, 25 bp, Homo sapien
gtcaagtactgcacgctgtagctac

SEQ ID NO: 262814 - DNA, 25 bp, Homo sapien
gcacgctgtagctacctgaggttta

SEQ ID NO: 262815 - DNA, 25 bp, Homo sapien
gctacctgaggtttaggccggaaga

SEQ ID NO: 262816 - DNA, 25 bp, Homo sapien
gaagaggcacggctgatttaaaagt

SEQ ID NO: 262817 - DNA, 25 bp, Homo sapien
gcttggtgaaaaatctgccttatca

SEQ ID NO: 262818 - DNA, 25 bp, Homo sapien
tctgccttatcactagcaacactac

SEQ ID NO: 262819 - DNA, 25 bp, Homo sapien
aacactacgacttgtctctgttctt

SEQ ID NO: 262820 - DNA, 25 bp, Homo sapien
cttcccagccttcggaactatggag

SEQ ID NO: 262821 - DNA, 25 bp, Homo sapien
agccttcggaactatggagcccgca

SEQ ID NO: 262822 - DNA, 25 bp, Homo sapien
ttcggaactatggagcccgcactct

SEQ ID NO: 262823 - DNA, 25 bp, Homo sapien
atccctactcttgcatctaacagtt

SEQ ID NO: 262824 - DNA, 25 bp, Homo sapien
tactcttgcatctaacagtttccgc

SEQ ID NO: 262825 - DNA, 25 bp, Homo sapien
tcttgcatctaacagtttccgctat

SEQ ID NO: 262826 - DNA, 25 bp, Homo sapien
gcatctaacagtttccgctattttg

SEQ ID NO: 262827 - DNA, 25 bp, Homo sapien
taacagtttccgctattttgcacca

SEQ ID NO: 262828 - DNA, 25 bp, Homo sapien
agtttccgctattttgcaccacctg

SEQ ID NO: 262829 - DNA, 25 bp, Homo sapien
aagtgttctttctgactactgctgt

SEQ ID NO: 262830 - DNA, 25 bp, Homo sapien
tgggccctcaccaggcaacaaacct

SEQ ID NO: 262831 - DNA, 25 bp, Homo sapien
acacaaggatttcaattctccaaaa

SEQ ID NO: 262832 - DNA, 25 bp, Homo sapien
aatgggacaagatgtgagtgtcaca

SEQ ID NO: 262833 - DNA, 25 bp, Homo sapien
gggattgtcacctgctaacagaaga

SEQ ID NO: 262834 - DNA, 25 bp, Homo sapien
attattgagtgtgtgactagtgcag

SEQ ID NO: 262835 - DNA, 25 bp, Homo sapien
gggacatttcaagccagattgttcc

SEQ ID NO: 262836 - DNA, 25 bp, Homo sapien
ttcaagccagattgttcctcagact

SEQ ID NO: 262837 - DNA, 25 bp, Homo sapien
gccagattgttcctcagactgcaat

SEQ ID NO: 262838 - DNA, 25 bp, Homo sapien
attgttcctcagactgcaatctaat

SEQ ID NO: 262839 - DNA, 25 bp, Homo sapien
gcaatctaattttactatctgtcac

SEQ ID NO: 262840 - DNA, 25 bp, Homo sapien
attttactatctgtcactagccacc

SEQ ID NO: 262841 - DNA, 25 bp, Homo sapien
tagccacctcagtcaaagatttcaa

SEQ ID NO: 262842 - DNA, 25 bp, Homo sapien
gggcagagcggataaccccttcctt

SEQ ID NO: 262843 - DNA, 25 bp, Homo sapien
cttccttgtctgtttcctttgagaa

SEQ ID NO: 262844 - DNA, 25 bp, Homo sapien
gaaaggacactccaccttttcaaag

SEQ ID NO: 262845 - DNA, 25 bp, Homo sapien
tttcaaaggtacttaaagccatctt

SEQ ID NO: 262846 - DNA, 25 bp, Homo sapien
aagccatctttacagattgcttgta

SEQ ID NO: 262847 - DNA, 25 bp, Homo sapien
gaaagagtcatgtcctttggattga

SEQ ID NO: 262848 - DNA, 25 bp, Homo sapien
ggttaaatcatcaaccactagcccc

SEQ ID NO: 262849 - DNA, 25 bp, Homo sapien
cccctttcaaaatcagcgagatatt

SEQ ID NO: 262850 - DNA, 25 bp, Homo sapien
gaaattgtcctttggttgccttagt

SEQ ID NO: 262851 - DNA, 25 bp, Homo sapien
gttgccttagttaccagagttgaat

SEQ ID NO: 262852 - DNA, 25 bp, Homo sapien
tgaatgtacacatttcggtagtggg

SEQ ID NO: 262853 - DNA, 25 bp, Homo sapien
gcttctgtggccaacctcctagaga

SEQ ID NO: 262854 - DNA, 25 bp, Homo sapien
acctcctagagaacccgggagaatg

SEQ ID NO: 262855 - DNA, 25 bp, Homo sapien
gagaacccgggagaatgttccagaa

SEQ ID NO: 262856 - DNA, 25 bp, Homo sapien
agaatgttccagaagtctgtcccct

SEQ ID NO: 262857 - DNA, 25 bp, Homo sapien
tccagacccaggctggtgacacctt

SEQ ID NO: 262858 - DNA, 25 bp, Homo sapien
gctggtgacaccttggcttgggctc

SEQ ID NO: 262859 - DNA, 25 bp, Homo sapien
gacaccttggcttgggctctgctca

SEQ ID NO: 262860 - DNA, 25 bp, Homo sapien
ctacgcaccctgatagaggcgtgga

SEQ ID NO: 262861 - DNA, 25 bp, Homo sapien
aaatggcgctgaaagttcccacccg

SEQ ID NO: 262862 - DNA, 25 bp, Homo sapien
gcaccctgatagaggcgtggagtaa

SEQ ID NO: 262863 - DNA, 25 bp, Homo sapien
agcctctagaaatcccgcttctgtg

SEQ ID NO: 262864 - DNA, 25 bp, Homo sapien
tcccaaacaagcctgccatgaggta

SEQ ID NO: 262865 - DNA, 25 bp, Homo sapien
aagcctgccatgaggtaggatccta

SEQ ID NO: 262866 - DNA, 25 bp, Homo sapien
ttagatagtgtttcagctgctgtcc

SEQ ID NO: 262867 - DNA, 25 bp, Homo sapien
ttcagctgctgtcccaaagtaacaa

SEQ ID NO: 262868 - DNA, 25 bp, Homo sapien
aagtaggaagtcaatctgtgtgctg

SEQ ID NO: 262869 - DNA, 25 bp, Homo sapien
ggaagtcaatctgtgtgctggtttt

SEQ ID NO: 262870 - DNA, 25 bp, Homo sapien
gtcaatctgtgtgctggttttgttg

SEQ ID NO: 262871 - DNA, 25 bp, Homo sapien
tgctggttttgttggttatgtggaa

SEQ ID NO: 262872 - DNA, 25 bp, Homo sapien
atgtggaaatcacaaactccagagg

SEQ ID NO: 262873 - DNA, 25 bp, Homo sapien
atcacaaactccagaggagcaaagg

SEQ ID NO: 262874 - DNA, 25 bp, Homo sapien
ggtttttcaatgtcttttgctttca

SEQ ID NO: 262875 - DNA, 25 bp, Homo sapien
tttagagcatctgccggatgattat

SEQ ID NO: 262876 - DNA, 25 bp, Homo sapien
tctgccggatgattatgttgttttt

SEQ ID NO: 262877 - DNA, 25 bp, Homo sapien
gaagctgtatgttggtctttcccat

SEQ ID NO: 262878 - DNA, 25 bp, Homo sapien
tttctttgacctattactgatggac

SEQ ID NO: 262879 - DNA, 25 bp, Homo sapien
atgttggtctttcccatggtggaca

SEQ ID NO: 262880 - DNA, 25 bp, Homo sapien
aaatctgcacaatatagtctaaaca

SEQ ID NO: 262881 - DNA, 25 bp, Homo sapien
ttatcttgtaatatactactgtatg

SEQ ID NO: 262882 - DNA, 25 bp, Homo sapien
tggtctttcccatggtggacactgg

SEQ ID NO: 262883 - DNA, 25 bp, Homo sapien
gtatgattttcattggtttagtaaa

SEQ ID NO: 262884 - DNA, 25 bp, Homo sapien
ggaactaaagctgcaaccaaaaaca

SEQ ID NO: 262885 - DNA, 25 bp, Homo sapien
aacatggggtgatttcagacttttc

SEQ ID NO: 262886 - DNA, 25 bp, Homo sapien
aatcatcgggcagttgttttccatc

SEQ ID NO: 262887 - DNA, 25 bp, Homo sapien
gttttccatcatatccttgtttgga

SEQ ID NO: 262888 - DNA, 25 bp, Homo sapien
cttgtttggatctatcactgattgg

SEQ ID NO: 262889 - DNA, 25 bp, Homo sapien
gattggattatttctatcactggta

SEQ ID NO: 262890 - DNA, 25 bp, Homo sapien
atcactgatctatcactggtcactg

SEQ ID NO: 262891 - DNA, 25 bp, Homo sapien
tctgtcagtggtattggatctatca

SEQ ID NO: 262892 - DNA, 25 bp, Homo sapien
atcactgatatttttctccgtggtt

SEQ ID NO: 262893 - DNA, 25 bp, Homo sapien
atgtcagcaggagccttattccttc

SEQ ID NO: 262894 - DNA, 25 bp, Homo sapien
ttattccttcttgtttccaccagtg

SEQ ID NO: 262895 - DNA, 25 bp, Homo sapien
agtgcttgacactcggtaggttccc

SEQ ID NO: 262896 - DNA, 25 bp, Homo sapien
cggtaggttccctatatgcatggaa

SEQ ID NO: 262897 - DNA, 25 bp, Homo sapien
gattatcaaggtgactttggaaacc

SEQ ID NO: 262898 - DNA, 25 bp, Homo sapien
gataaaaagtgactctcagattggt

SEQ ID NO: 262899 - DNA, 25 bp, Homo sapien
gtgactctcagattggtaatgccag

SEQ ID NO: 262900 - DNA, 25 bp, Homo sapien
actctcagattggtaatgccagaaa

SEQ ID NO: 262901 - DNA, 25 bp, Homo sapien
gaggactcaccaaaagtactagatc

SEQ ID NO: 262902 - DNA, 25 bp, Homo sapien
agtactagatctatgtaagttgtag

SEQ ID NO: 262903 - DNA, 25 bp, Homo sapien
atttgtggtagcctccatcttttaa

SEQ ID NO: 262904 - DNA, 25 bp, Homo sapien
ttgtggtagcctccatcttttaaac

SEQ ID NO: 262905 - DNA, 25 bp, Homo sapien
gacatgcagtatttgtatcatttta

SEQ ID NO: 262906 - DNA, 25 bp, Homo sapien
ttttaaattctgtaacactgggaat

SEQ ID NO: 262907 - DNA, 25 bp, Homo sapien
ctgggaattaaatatactcaacttt

SEQ ID NO: 262908 - DNA, 25 bp, Homo sapien
gcttctgtggccaacctcctagaga

SEQ ID NO: 262909 - DNA, 25 bp, Homo sapien
acctcctagagaacccgggagaatg

SEQ ID NO: 262910 - DNA, 25 bp, Homo sapien
agaacccgggagaatgttccagaag

SEQ ID NO: 262911 - DNA, 25 bp, Homo sapien
gcacactggtgagggaggctggaac

SEQ ID NO: 262912 - DNA, 25 bp, Homo sapien
tccagacccaggctggtgacacctt

SEQ ID NO: 262913 - DNA, 25 bp, Homo sapien
gctggtgacaccttggcttgggctc

SEQ ID NO: 262914 - DNA, 25 bp, Homo sapien
gacaccttggcttgggctctgctca

SEQ ID NO: 262915 - DNA, 25 bp, Homo sapien
ctacgcaccctgatagaggcgtgga

SEQ ID NO: 262916 - DNA, 25 bp, Homo sapien
gcaccctgatagaggcgtggagtaa

SEQ ID NO: 262917 - DNA, 25 bp, Homo sapien
ggcgtggagtaaaagataacttgtt

SEQ ID NO: 262918 - DNA, 25 bp, Homo sapien
agcctctagaaatcccgcttctgtg

SEQ ID NO: 262919 - DNA, 25 bp, Homo sapien
acagtggttctacctggataacgtc

SEQ ID NO: 262920 - DNA, 25 bp, Homo sapien
ctggataacgtcattggccatagtt

SEQ ID NO: 262921 - DNA, 25 bp, Homo sapien
gccatagttatggaactgcatttga

SEQ ID NO: 262922 - DNA, 25 bp, Homo sapien
gcatttgaagtgaccagtggaggaa

SEQ ID NO: 262923 - DNA, 25 bp, Homo sapien
ggaggaagtctacagcccaagaaga

SEQ ID NO: 262924 - DNA, 25 bp, Homo sapien
gggaagagcctactgcagagactaa

SEQ ID NO: 262925 - DNA, 25 bp, Homo sapien
gaagcgggcactgataatcgaaata

SEQ ID NO: 262926 - DNA, 25 bp, Homo sapien
gggaaatctcagaaacttactcaag

SEQ ID NO: 262927 - DNA, 25 bp, Homo sapien
aaagctttgaaggacaagggcatta

SEQ ID NO: 262928 - DNA, 25 bp, Homo sapien
atagtacaacattccgagacaagac

SEQ ID NO: 262929 - DNA, 25 bp, Homo sapien
cgagacaagacagaatttgcccaag

SEQ ID NO: 262930 - DNA, 25 bp, Homo sapien
gaggtgtaacctggagcaagaaaga

SEQ ID NO: 262931 - DNA, 25 bp, Homo sapien
aacccaagtacatgcagtgcacaga

SEQ ID NO: 262932 - DNA, 25 bp, Homo sapien
agtacatgcagtgcacagaagagca

SEQ ID NO: 262933 - DNA, 25 bp, Homo sapien
aagtcacttgacttgctggcggcca

SEQ ID NO: 262934 - DNA, 25 bp, Homo sapien
gagcctggacttcagtctgcatctg

SEQ ID NO: 262935 - DNA, 25 bp, Homo sapien
ctggacttcagtctgcatctgtgaa

SEQ ID NO: 262936 - DNA, 25 bp, Homo sapien
tctgcatctgtgaaacccagcgcat

SEQ ID NO: 262937 - DNA, 25 bp, Homo sapien
gcatctgtgaaacccagcgcatggg

SEQ ID NO: 262938 - DNA, 25 bp, Homo sapien
aaacccagcgcatgggtgcgttggt

SEQ ID NO: 262939 - DNA, 25 bp, Homo sapien
cagcgcatgggtgcgttggtcacca

SEQ ID NO: 262940 - DNA, 25 bp, Homo sapien
cagacacccacgtttcgccaaaaat

SEQ ID NO: 262941 - DNA, 25 bp, Homo sapien
gttcaactgggtctgagacttcaag

SEQ ID NO: 262942 - DNA, 25 bp, Homo sapien
ttcaactgggtctgagacttcaagg

SEQ ID NO: 262943 - DNA, 25 bp, Homo sapien
catagctgtcatggcctcacctgga

SEQ ID NO: 262944 - DNA, 25 bp, Homo sapien
tcaactgggtctgagacttcaaggg

SEQ ID NO: 262945 - DNA, 25 bp, Homo sapien
ctaaagggggtactgagcctcctgt

SEQ ID NO: 262946 - DNA, 25 bp, Homo sapien
gggtactgagcctcctgtggcccgc

SEQ ID NO: 262947 - DNA, 25 bp, Homo sapien
gtactgagcctcctgtggcccgcag

SEQ ID NO: 262948 - DNA, 25 bp, Homo sapien
agcagtgagggcacagctgtgggtt

SEQ ID NO: 262949 - DNA, 25 bp, Homo sapien
agtgagggcacagctgtgggttgca

SEQ ID NO: 262950 - DNA, 25 bp, Homo sapien
gagggcacagctgtgggttgcaggg

SEQ ID NO: 262951 - DNA, 25 bp, Homo sapien
cctttgagggggattctgtgccaca

SEQ ID NO: 262952 - DNA, 25 bp, Homo sapien
ggtgaacccgtgagcaactgtggta

SEQ ID NO: 262953 - DNA, 25 bp, Homo sapien
gaacccgtgagcaactgtggtacct

SEQ ID NO: 262954 - DNA, 25 bp, Homo sapien
gagcaactgtggtacctccacctgt

SEQ ID NO: 262955 - DNA, 25 bp, Homo sapien
acaacctacaactcagcagtaccaa

SEQ ID NO: 262956 - DNA, 25 bp, Homo sapien
tcagcagtaccaagggctggacgct

SEQ ID NO: 262957 - DNA, 25 bp, Homo sapien
gggtcccgcgaagcctgctgcgaag

SEQ ID NO: 262958 - DNA, 25 bp, Homo sapien
ctgctgcgaagtgaaggaagccaga

SEQ ID NO: 262959 - DNA, 25 bp, Homo sapien
gacacaaaagtctccatcctgcggg

SEQ ID NO: 262960 - DNA, 25 bp, Homo sapien
ctgcgggagtcactcacaggacaat

SEQ ID NO: 262961 - DNA, 25 bp, Homo sapien
gagtcactcacaggacaattctgga

SEQ ID NO: 262962 - DNA, 25 bp, Homo sapien
caattctggaggacgcaaagctgta

SEQ ID NO: 262963 - DNA, 25 bp, Homo sapien
tgcaaaacaagcattccgtcacctc

SEQ ID NO: 262964 - DNA, 25 bp, Homo sapien
agcattccgtcacctctttaataat

SEQ ID NO: 262965 - DNA, 25 bp, Homo sapien
gtcacctctttaataatgtcacaga

SEQ ID NO: 262966 - DNA, 25 bp, Homo sapien
caagttgtaatataatctgtcatgt

SEQ ID NO: 262967 - DNA, 25 bp, Homo sapien
gaaggtaaatttgtgcttgcacggg

SEQ ID NO: 262968 - DNA, 25 bp, Homo sapien
atatttcagaccgtgagtaccttga

SEQ ID NO: 262969 - DNA, 25 bp, Homo sapien
tgctaatacccagttgaagctaaaa

SEQ ID NO: 262970 - DNA, 25 bp, Homo sapien
gcaactatttgaatcctgtgaatta

SEQ ID NO: 262971 - DNA, 25 bp, Homo sapien
gagtaccttgagatctgagcaactg

SEQ ID NO: 262972 - DNA, 25 bp, Homo sapien
gagatctgagcaactgtgttaatga

SEQ ID NO: 262973 - DNA, 25 bp, Homo sapien
gaagtaatagcaatggtccacagtg

SEQ ID NO: 262974 - DNA, 25 bp, Homo sapien
gattactaaacattctacttatcca

SEQ ID NO: 262975 - DNA, 25 bp, Homo sapien
tacttatccacatgtgccaagatgt

SEQ ID NO: 262976 - DNA, 25 bp, Homo sapien
gccaagatgtgccatttaggtctct

SEQ ID NO: 262977 - DNA, 25 bp, Homo sapien
gtgccatttaggtctctgcagaaat

SEQ ID NO: 262978 - DNA, 25 bp, Homo sapien
aggtctctgcagaaattagctgttt

SEQ ID NO: 262979 - DNA, 25 bp, Homo sapien
gctgtttggtatcatcacctgccat

SEQ ID NO: 262980 - DNA, 25 bp, Homo sapien
gtatcatcacctgccatacatgttg

SEQ ID NO: 262981 - DNA, 25 bp, Homo sapien
gccatacatgttgtgtgcagcagtg

SEQ ID NO: 262982 - DNA, 25 bp, Homo sapien
gtgtgcagcagtgagaagtatattc

SEQ ID NO: 262983 - DNA, 25 bp, Homo sapien
gaagtatattctctaccactgctct

SEQ ID NO: 262984 - DNA, 25 bp, Homo sapien
tatattctctaccactgctctttct

SEQ ID NO: 262985 - DNA, 25 bp, Homo sapien
agatacttagtatagctcctcagcc

SEQ ID NO: 262986 - DNA, 25 bp, Homo sapien
tagtatagctcctcagccataacct

SEQ ID NO: 262987 - DNA, 25 bp, Homo sapien
gatgaaatttaaaccagatacgatt

SEQ ID NO: 262988 - DNA, 25 bp, Homo sapien
aaatggcttatttttcaggcactaa

SEQ ID NO: 262989 - DNA, 25 bp, Homo sapien
ttttcaggcactaaggattgttaag

SEQ ID NO: 262990 - DNA, 25 bp, Homo sapien
cttttcaacgaaggattgcctttct

SEQ ID NO: 262991 - DNA, 25 bp, Homo sapien
acgaaggattgcctttcttctccca

SEQ ID NO: 262992 - DNA, 25 bp, Homo sapien
tttcaggcctcaacaggcactgtat

SEQ ID NO: 262993 - DNA, 25 bp, Homo sapien
ggcctcaacaggcactgtattcatt

SEQ ID NO: 262994 - DNA, 25 bp, Homo sapien
ggcactgtattcattgccaatgttc

SEQ ID NO: 262995 - DNA, 25 bp, Homo sapien
attgccaatgttccaaattatcaaa

SEQ ID NO: 262996 - DNA, 25 bp, Homo sapien
aagacccagaaatgagggatggtgt

SEQ ID NO: 262997 - DNA, 25 bp, Homo sapien
ggtgggattcctgagcgttctgcta

SEQ ID NO: 262998 - DNA, 25 bp, Homo sapien
attcctgagcgttctgctaggcctg

SEQ ID NO: 262999 - DNA, 25 bp, Homo sapien
cctgctgagcacttcttggcctttt

SEQ ID NO: 263000 - DNA, 25 bp, Homo sapien
tgagcacttcttggccttttccata

SEQ ID NO: 263001 - DNA, 25 bp, Homo sapien
gcacttcttggccttttccataagg

SEQ ID NO: 263002 - DNA, 25 bp, Homo sapien
tttccataaggctttctcactctgt

SEQ ID NO: 263003 - DNA, 25 bp, Homo sapien
tttctcactctgtcttacagatatc

SEQ ID NO: 263004 - DNA, 25 bp, Homo sapien
actctgtcttacagatatctcccca

SEQ ID NO: 263005 - DNA, 25 bp, Homo sapien
gctcctggatgcaggtctgaggcct

SEQ ID NO: 263006 - DNA, 25 bp, Homo sapien
gtctgaggcctgagatgtccaggaa

SEQ ID NO: 263007 - DNA, 25 bp, Homo sapien
tcccaaacaagcctgccatgaggta

SEQ ID NO: 263008 - DNA, 25 bp, Homo sapien
aagcctgccatgaggtaggatccta

SEQ ID NO: 263009 - DNA, 25 bp, Homo sapien
aagtaggaagtcaatctgtgtgctg

SEQ ID NO: 263010 - DNA, 25 bp, Homo sapien
ggaagtcaatctgtgtgctggtttt

SEQ ID NO: 263011 - DNA, 25 bp, Homo sapien
gtcaatctgtgtgctggttttgttg

SEQ ID NO: 263012 - DNA, 25 bp, Homo sapien
tgctggttttgttggttatgtggaa

SEQ ID NO: 263013 - DNA, 25 bp, Homo sapien
gttttgttggttatgtggaaatcac

SEQ ID NO: 263014 - DNA, 25 bp, Homo sapien
atgtggaaatcacaaactccagagg

SEQ ID NO: 263015 - DNA, 25 bp, Homo sapien
atcacaaactccagaggagcaaagg

SEQ ID NO: 263016 - DNA, 25 bp, Homo sapien
ggtttttcaatgtcttttgctttca

SEQ ID NO: 263017 - DNA, 25 bp, Homo sapien
tttttcaatgtcttttgctttcaga

SEQ ID NO: 263018 - DNA, 25 bp, Homo sapien
aagctaatcccaaaatgccattaag

SEQ ID NO: 263019 - DNA, 25 bp, Homo sapien
agtgcttatcactttaattttccaa

SEQ ID NO: 263020 - DNA, 25 bp, Homo sapien
gaatccatcagtgggtgatcctttt

SEQ ID NO: 263021 - DNA, 25 bp, Homo sapien
gaactcacagtgaatccaacatgaa

SEQ ID NO: 263022 - DNA, 25 bp, Homo sapien
acaattttattaccaccactgcaca

SEQ ID NO: 263023 - DNA, 25 bp, Homo sapien
taccaccactgcacaaagtaagggt

SEQ ID NO: 263024 - DNA, 25 bp, Homo sapien
gttatacttcatgtcacacacacgt

SEQ ID NO: 263025 - DNA, 25 bp, Homo sapien
cacacgtgtgtgttcgatgaataac

SEQ ID NO: 263026 - DNA, 25 bp, Homo sapien
ataacaactcaagtggtccaggtga

SEQ ID NO: 263027 - DNA, 25 bp, Homo sapien
gaacaccaaagacttgacaatcaca

SEQ ID NO: 263028 - DNA, 25 bp, Homo sapien
atcacaagagaaaccaacgtctaag

SEQ ID NO: 263029 - DNA, 25 bp, Homo sapien
gctgcaggactgtctcagaagggaa

SEQ ID NO: 263030 - DNA, 25 bp, Homo sapien
tatttaccttccaaactgagatcta

SEQ ID NO: 263031 - DNA, 25 bp, Homo sapien
gatctaaaacccgaacaaagcctca

SEQ ID NO: 263032 - DNA, 25 bp, Homo sapien
aagcctcaggaaacatactccacca

SEQ ID NO: 263033 - DNA, 25 bp, Homo sapien
gaatctaatgtaggaggcctcccgc

SEQ ID NO: 263034 - DNA, 25 bp, Homo sapien
tcccgctgtgcgtctagcaggaaag

SEQ ID NO: 263035 - DNA, 25 bp, Homo sapien
tctagcaggaaagaccatacggtgc

SEQ ID NO: 263036 - DNA, 25 bp, Homo sapien
catacggtgcaagtctccaggatca

SEQ ID NO: 263037 - DNA, 25 bp, Homo sapien
gcaagtctccaggatcactagaggg

SEQ ID NO: 263038 - DNA, 25 bp, Homo sapien
gattgttcatttcagtccaggtagc

SEQ ID NO: 263039 - DNA, 25 bp, Homo sapien
gtagcaacaggaagcccgtgcaaat

SEQ ID NO: 263040 - DNA, 25 bp, Homo sapien
cctcctaggccctcattggaggatc

SEQ ID NO: 263041 - DNA, 25 bp, Homo sapien
ggaaactgggaaggccgggctctgg

SEQ ID NO: 263042 - DNA, 25 bp, Homo sapien
ggcccggatgttccctaacaatgaa

SEQ ID NO: 263043 - DNA, 25 bp, Homo sapien
aacaatgaaatcatcgccgacctat

SEQ ID NO: 263044 - DNA, 25 bp, Homo sapien
gaaatcatcgccgacctatcagagc

SEQ ID NO: 263045 - DNA, 25 bp, Homo sapien
atcagagccgccgagctgggatacc

SEQ ID NO: 263046 - DNA, 25 bp, Homo sapien
agctgggatacctgcctgacctgta

SEQ ID NO: 263047 - DNA, 25 bp, Homo sapien
tgcctgacctgtaccccggagggag

SEQ ID NO: 263048 - DNA, 25 bp, Homo sapien
ttggaggatctaaacgcctctcttc

SEQ ID NO: 263049 - DNA, 25 bp, Homo sapien
taaacgcctctcttcggcgtggaga

SEQ ID NO: 263050 - DNA, 25 bp, Homo sapien
aagggacgactcagacgaggacaag

SEQ ID NO: 263051 - DNA, 25 bp, Homo sapien
ctgggcatggccaatggccagcagt

SEQ ID NO: 263052 - DNA, 25 bp, Homo sapien
gccagcagtggctgcaaagcaccag

SEQ ID NO: 263053 - DNA, 25 bp, Homo sapien
tgcaaagcaccagcgggagccagcg

SEQ ID NO: 263054 - DNA, 25 bp, Homo sapien
aagacagcgtcatcctgagcgtcaa

SEQ ID NO: 263055 - DNA, 25 bp, Homo sapien
agcgtcatcctgagcgtcaagttct

SEQ ID NO: 263056 - DNA, 25 bp, Homo sapien
caagcgttggaatggacgacttcct

SEQ ID NO: 263057 - DNA, 25 bp, Homo sapien
aatggacgacttccttggcgtctac

SEQ ID NO: 263058 - DNA, 25 bp, Homo sapien
cttggcgtctacagcatgccggcgg

SEQ ID NO: 263059 - DNA, 25 bp, Homo sapien
ggacaaaagtgttcgaggtgcctga

SEQ ID NO: 263060 - DNA, 25 bp, Homo sapien
gaggtgcctgagatgtctccagtca

SEQ ID NO: 263061 - DNA, 25 bp, Homo sapien
agatgtctccagtcacgtgctgtga

SEQ ID NO: 263062 - DNA, 25 bp, Homo sapien
agcggcccctgtctgccgcggaaat

SEQ ID NO: 263063 - DNA, 25 bp, Homo sapien
ctgtctgccgcggaaatggctgttg

SEQ ID NO: 263064 - DNA, 25 bp, Homo sapien
tgccgcggaaatggctgttggactt

SEQ ID NO: 263065 - DNA, 25 bp, Homo sapien
gacgcgatatgcctctcctgcgtgg

SEQ ID NO: 263066 - DNA, 25 bp, Homo sapien
cttaacaccagctgcatatgtgcta

SEQ ID NO: 263067 - DNA, 25 bp, Homo sapien
acaccagctgcatatgtgctaggca

SEQ ID NO: 263068 - DNA, 25 bp, Homo sapien
gctgcatatgtgctaggcaacctga

SEQ ID NO: 263069 - DNA, 25 bp, Homo sapien
gtgctaggcaacctgaagcagttca

SEQ ID NO: 263070 - DNA, 25 bp, Homo sapien
atatgcctctcctgcgtgggcgctg

SEQ ID NO: 263071 - DNA, 25 bp, Homo sapien
gatgttgaacagctgttaacgtcca

SEQ ID NO: 263072 - DNA, 25 bp, Homo sapien
tgaacagctgttaacgtccaaaaaa

SEQ ID NO: 263073 - DNA, 25 bp, Homo sapien
atgtttattatctcttgctcctgga

SEQ ID NO: 263074 - DNA, 25 bp, Homo sapien
ttgctcctggatcctatttcagtga

SEQ ID NO: 263075 - DNA, 25 bp, Homo sapien
gatcctatttcagtgagctcccaca

SEQ ID NO: 263076 - DNA, 25 bp, Homo sapien
ttgctggtttccttatccttgatga

SEQ ID NO: 263077 - DNA, 25 bp, Homo sapien
gctggtttccttatccttgatgact

SEQ ID NO: 263078 - DNA, 25 bp, Homo sapien
cttttgccacttatgcaagaggctt

SEQ ID NO: 263079 - DNA, 25 bp, Homo sapien
ccacttatgcaagaggcttggtgca

SEQ ID NO: 263080 - DNA, 25 bp, Homo sapien
ggcagtgtgtgcaaacactcccatt

SEQ ID NO: 263081 - DNA, 25 bp, Homo sapien
tgtgtgcaaacactcccattccaca

SEQ ID NO: 263082 - DNA, 25 bp, Homo sapien
cacatcaggtggtgcctttggagca

SEQ ID NO: 263083 - DNA, 25 bp, Homo sapien
atcaggtggtgcctttggagcactt

SEQ ID NO: 263084 - DNA, 25 bp, Homo sapien
aagaagcagggatttcttcaaatgc

SEQ ID NO: 263085 - DNA, 25 bp, Homo sapien
gaagcagggatttcttcaaatgcta

SEQ ID NO: 263086 - DNA, 25 bp, Homo sapien
gcagggatttcttcaaatgctagta

SEQ ID NO: 263087 - DNA, 25 bp, Homo sapien
cagggatttcttcaaatgctagtaa

SEQ ID NO: 263088 - DNA, 25 bp, Homo sapien
agggatttcttcaaatgctagtaag

SEQ ID NO: 263089 - DNA, 25 bp, Homo sapien
gatttcttcaaatgctagtaagcac

SEQ ID NO: 263090 - DNA, 25 bp, Homo sapien
ttcttcaaatgctagtaagcacaaa

SEQ ID NO: 263091 - DNA, 25 bp, Homo sapien
gctagtaagcacaaagagagggaga

SEQ ID NO: 263092 - DNA, 25 bp, Homo sapien
tgtaagtaacgaacagggccgggca

SEQ ID NO: 263093 - DNA, 25 bp, Homo sapien
taagtaacgaacagggccgggcatg

SEQ ID NO: 263094 - DNA, 25 bp, Homo sapien
gcatggtggcgtgagaggccgaggt

SEQ ID NO: 263095 - DNA, 25 bp, Homo sapien
gagcagcttccctcaaagcggcacg

SEQ ID NO: 263096 - DNA, 25 bp, Homo sapien
agcttccctcaaagcggcacggaat

SEQ ID NO: 263097 - DNA, 25 bp, Homo sapien
cctcaaagcggcacggaatcgggaa

SEQ ID NO: 263098 - DNA, 25 bp, Homo sapien
ctcaaagcggcacggaatcgggaac

SEQ ID NO: 263099 - DNA, 25 bp, Homo sapien
gcggcacggaatcgggaaccccact

SEQ ID NO: 263100 - DNA, 25 bp, Homo sapien
gcaattcatgatgggcgttcttgtc

SEQ ID NO: 263101 - DNA, 25 bp, Homo sapien
ttcatgatgggcgttcttgtctggt

SEQ ID NO: 263102 - DNA, 25 bp, Homo sapien
atgatgggcgttcttgtctggtttc

SEQ ID NO: 263103 - DNA, 25 bp, Homo sapien
ttgtcctccctcctgaaataagaaa

SEQ ID NO: 263104 - DNA, 25 bp, Homo sapien
gtcctccctcctgaaataagaaatt

SEQ ID NO: 263105 - DNA, 25 bp, Homo sapien
ttctcacattcacagagcagcttcc

SEQ ID NO: 263106 - DNA, 25 bp, Homo sapien
aatcagttgcttcatgcccagggaa

SEQ ID NO: 263107 - DNA, 25 bp, Homo sapien
ataggctttgtgtgcagcctgttag

SEQ ID NO: 263108 - DNA, 25 bp, Homo sapien
agcctgttaggccagcgtttaattg

SEQ ID NO: 263109 - DNA, 25 bp, Homo sapien
aattgacatagactgttgtttctca

SEQ ID NO: 263110 - DNA, 25 bp, Homo sapien
acaacagttctattacgtacgtatg

SEQ ID NO: 263111 - DNA, 25 bp, Homo sapien
atttctgtgcttcaaggagcttcag

SEQ ID NO: 263112 - DNA, 25 bp, Homo sapien
ggagcttcagagagattgccttgtt

SEQ ID NO: 263113 - DNA, 25 bp, Homo sapien
attgccttgttcaaagccctatggt

SEQ ID NO: 263114 - DNA, 25 bp, Homo sapien
gctcacaccttcatatagcagtgcc

SEQ ID NO: 263115 - DNA, 25 bp, Homo sapien
atatagcagtgcctcttacagaata

SEQ ID NO: 263116 - DNA, 25 bp, Homo sapien
ataggaacccatcttgtcaatcagt

SEQ ID NO: 263117 - DNA, 25 bp, Homo sapien
agttctcaaacatgttatccccttg

SEQ ID NO: 263118 - DNA, 25 bp, Homo sapien
tatccccttgtcctgactatagagg

SEQ ID NO: 263119 - DNA, 25 bp, Homo sapien
tctgtacctgattatgcaacccttt

SEQ ID NO: 263120 - DNA, 25 bp, Homo sapien
tgcaaccctttgacgtttaacccat

SEQ ID NO: 263121 - DNA, 25 bp, Homo sapien
gccacgtttatttactgcatagctg

SEQ ID NO: 263122 - DNA, 25 bp, Homo sapien
tttaacccatctcccatggttgaat

SEQ ID NO: 263123 - DNA, 25 bp, Homo sapien
gttgaatgtccccttggaatccaga

SEQ ID NO: 263124 - DNA, 25 bp, Homo sapien
gaaggcctggatatcctggcacttg

SEQ ID NO: 263125 - DNA, 25 bp, Homo sapien
agctgtagctttcatcttattgtag

SEQ ID NO: 263126 - DNA, 25 bp, Homo sapien
tattgtagtcctcttttctctgaag

SEQ ID NO: 263127 - DNA, 25 bp, Homo sapien
ttctctgaagcatcaatcccctaat

SEQ ID NO: 263128 - DNA, 25 bp, Homo sapien
gtggcttcactatggcgctggtatg

SEQ ID NO: 263129 - DNA, 25 bp, Homo sapien
cgctggtatgcgtctgtttattgct

SEQ ID NO: 263130 - DNA, 25 bp, Homo sapien
ggaagacttcacacggcatggtaaa

SEQ ID NO: 263131 - DNA, 25 bp, Homo sapien
gtatagaagccactagctgcctcta

SEQ ID NO: 263132 - DNA, 25 bp, Homo sapien
ctggtctggtttctgtatcgagcaa

SEQ ID NO: 263133 - DNA, 25 bp, Homo sapien
actagctgcctctaggaacagagaa

SEQ ID NO: 263134 - DNA, 25 bp, Homo sapien
gaaaggtttgcctgaacttcactcc

SEQ ID NO: 263135 - DNA, 25 bp, Homo sapien
actccgattcggatttgctcgattc

SEQ ID NO: 263136 - DNA, 25 bp, Homo sapien
atttgctcgattctttgcctggcct

SEQ ID NO: 263137 - DNA, 25 bp, Homo sapien
atcgagcaatgtctccaaggtggac

SEQ ID NO: 263138 - DNA, 25 bp, Homo sapien
gaacaggagctagactgtggcttca

SEQ ID NO: 263139 - DNA, 25 bp, Homo sapien
tagaaacagcattggatggcagaaa

SEQ ID NO: 263140 - DNA, 25 bp, Homo sapien
gaatctgaagcccttgtaaagctaa

SEQ ID NO: 263141 - DNA, 25 bp, Homo sapien
tttgggactcaatgtagttatttgc

SEQ ID NO: 263142 - DNA, 25 bp, Homo sapien
actatgatctggtatttgttgaagc

SEQ ID NO: 263143 - DNA, 25 bp, Homo sapien
tgaagcatttgatttctgttctttc

SEQ ID NO: 263144 - DNA, 25 bp, Homo sapien
tctgttctttcctgattgctgagaa

SEQ ID NO: 263145 - DNA, 25 bp, Homo sapien
tcctgattgctgagaagcttgtgaa

SEQ ID NO: 263146 - DNA, 25 bp, Homo sapien
gtgaaaccatttgtggccattcttc

SEQ ID NO: 263147 - DNA, 25 bp, Homo sapien
ttgtggccattcttcccaccacatt

SEQ ID NO: 263148 - DNA, 25 bp, Homo sapien
caccacattcggctctttggatttt

SEQ ID NO: 263149 - DNA, 25 bp, Homo sapien
aagcattttgatagctacatagaaa

SEQ ID NO: 263150 - DNA, 25 bp, Homo sapien
aagaggtcgaagaggctgaatatgt

SEQ ID NO: 263151 - DNA, 25 bp, Homo sapien
gggaagaatttcacttgcctctgga

SEQ ID NO: 263152 - DNA, 25 bp, Homo sapien
gaagaatttcacttgcctctggaaa

SEQ ID NO: 263153 - DNA, 25 bp, Homo sapien
acttgcctctggaaatgcctttatc

SEQ ID NO: 263154 - DNA, 25 bp, Homo sapien
tgcctctggaaatgcctttatcaat

SEQ ID NO: 263155 - DNA, 25 bp, Homo sapien
tggaaatgcctttatcaatcttcgt

SEQ ID NO: 263156 - DNA, 25 bp, Homo sapien
tttatcaatcttcgtagaggctgaa

SEQ ID NO: 263157 - DNA, 25 bp, Homo sapien
gagagagaactttataagctgcact

SEQ ID NO: 263158 - DNA, 25 bp, Homo sapien
aagctgcacttttttaaacccagag

SEQ ID NO: 263159 - DNA, 25 bp, Homo sapien
gcacttttttaaacccagagcagat

SEQ ID NO: 263160 - DNA, 25 bp, Homo sapien
tttttaaacccagagcagataattc

SEQ ID NO: 263161 - DNA, 25 bp, Homo sapien
ccatccacgaccttcctaaagggat

SEQ ID NO: 263162 - DNA, 25 bp, Homo sapien
tccacgaccttcctaaagggatccg

SEQ ID NO: 263163 - DNA, 25 bp, Homo sapien
cactcgggcagtgagatgtcggaaa

SEQ ID NO: 263164 - DNA, 25 bp, Homo sapien
atggcagaggagtccggagaggctc

SEQ ID NO: 263165 - DNA, 25 bp, Homo sapien
aggctcctgaggagtgtacttcgcc

SEQ ID NO: 263166 - DNA, 25 bp, Homo sapien
ctgaggagtgtacttcgccttggaa

SEQ ID NO: 263167 - DNA, 25 bp, Homo sapien
tacttcgccttggaagttctccagg

SEQ ID NO: 263168 - DNA, 25 bp, Homo sapien
cctccgaggtggacgcgtgcagcac

SEQ ID NO: 263169 - DNA, 25 bp, Homo sapien
tgcagcacgggcactgaaccctgag

SEQ ID NO: 263170 - DNA, 25 bp, Homo sapien
caggagtccgtcgtgcatgccgaag

SEQ ID NO: 263171 - DNA, 25 bp, Homo sapien
gtcgtgcatgccgaaggctcctcgt

SEQ ID NO: 263172 - DNA, 25 bp, Homo sapien
gcccagcagaggctggtgcaaccaa

SEQ ID NO: 263173 - DNA, 25 bp, Homo sapien
ccagcagaggctggtgcaaccaatc

SEQ ID NO: 263174 - DNA, 25 bp, Homo sapien
cagcagaggctggtgcaaccaatca

SEQ ID NO: 263175 - DNA, 25 bp, Homo sapien
agcagaggctggtgcaaccaatcac

SEQ ID NO: 263176 - DNA, 25 bp, Homo sapien
gcagaggctggtgcaaccaatcacc

SEQ ID NO: 263177 - DNA, 25 bp, Homo sapien
gcaaccaatcacctcctttagtaag

SEQ ID NO: 263178 - DNA, 25 bp, Homo sapien
caaccaatcacctcctttagtaagt

SEQ ID NO: 263179 - DNA, 25 bp, Homo sapien
caatcacctcctttagtaagtttct

SEQ ID NO: 263180 - DNA, 25 bp, Homo sapien
taagtttctccctgggcttcacctc

SEQ ID NO: 263181 - DNA, 25 bp, Homo sapien
gggcttcacctcttcacctgtgggc

SEQ ID NO: 263182 - DNA, 25 bp, Homo sapien
tttaagacagtctcctctgttgcca

SEQ ID NO: 263183 - DNA, 25 bp, Homo sapien
aagtctgaaggatttgaacgcgttc

SEQ ID NO: 263184 - DNA, 25 bp, Homo sapien
aacctttggttcagcaaaacaccag

SEQ ID NO: 263185 - DNA, 25 bp, Homo sapien
aagataaaatacactccggagaagc

SEQ ID NO: 263186 - DNA, 25 bp, Homo sapien
ggagaagcccattctctcaacgcat

SEQ ID NO: 263187 - DNA, 25 bp, Homo sapien
ttctctcaacgcatctgacagttca

SEQ ID NO: 263188 - DNA, 25 bp, Homo sapien
gttcacaaagagcaactgcagtcca

SEQ ID NO: 263189 - DNA, 25 bp, Homo sapien
gagcaactgcagtccaacttaaaaa

SEQ ID NO: 263190 - DNA, 25 bp, Homo sapien
aatgggcaacatgcactgaggcaat

SEQ ID NO: 263191 - DNA, 25 bp, Homo sapien
gaaggaatgcgcaattaatcaacaa

SEQ ID NO: 263192 - DNA, 25 bp, Homo sapien
acaaaagcctgctctttcctaacga

SEQ ID NO: 263193 - DNA, 25 bp, Homo sapien
gcctgctctttcctaacgagtgaag

SEQ ID NO: 263194 - DNA, 25 bp, Homo sapien
ctcagattggccttgaagctgtagg

SEQ ID NO: 263195 - DNA, 25 bp, Homo sapien
tgaagctgtagggaacctgtccacc

SEQ ID NO: 263196 - DNA, 25 bp, Homo sapien
gtccaccctctgcacagggcaagag

SEQ ID NO: 263197 - DNA, 25 bp, Homo sapien
agagccacgccaacaggaggaagtt

SEQ ID NO: 263198 - DNA, 25 bp, Homo sapien
gaagttggagtgcatcctggcacct

SEQ ID NO: 263199 - DNA, 25 bp, Homo sapien
gcacctgccaatcggaagactgaca

SEQ ID NO: 263200 - DNA, 25 bp, Homo sapien
ttcctacttatcagacacaatcact

SEQ ID NO: 263201 - DNA, 25 bp, Homo sapien
aacattttgtgtcatactgctttac

SEQ ID NO: 263202 - DNA, 25 bp, Homo sapien
actgctttacatcatctattctacc

SEQ ID NO: 263203 - DNA, 25 bp, Homo sapien
cattcactggtcaaagaagcgcaga

SEQ ID NO: 263204 - DNA, 25 bp, Homo sapien
gaagcgcagagttaagttggccagt

SEQ ID NO: 263205 - DNA, 25 bp, Homo sapien
aactgattggcctctgtcacccaag

SEQ ID NO: 263206 - DNA, 25 bp, Homo sapien
caggtgccactggaagaggcgttca

SEQ ID NO: 263207 - DNA, 25 bp, Homo sapien
cagtgccgctagctgcaaattgctt

SEQ ID NO: 263208 - DNA, 25 bp, Homo sapien
aggcgttcagaagcactgcggtgct

SEQ ID NO: 263209 - DNA, 25 bp, Homo sapien
gtgctccagctcctggatgcagata

SEQ ID NO: 263210 - DNA, 25 bp, Homo sapien
tatctccccacaaacctaaacaatt

SEQ ID NO: 263211 - DNA, 25 bp, Homo sapien
gagagggacttgtgttctgcaacca

SEQ ID NO: 263212 - DNA, 25 bp, Homo sapien
tgtgttctgcaaccagtcacagaat

SEQ ID NO: 263213 - DNA, 25 bp, Homo sapien
agggccccaccactctgattggaag

SEQ ID NO: 263214 - DNA, 25 bp, Homo sapien
ccaccactctgattggaagtcataa

SEQ ID NO: 263215 - DNA, 25 bp, Homo sapien
ggaagtcataagcttgacaactgat

SEQ ID NO: 263216 - DNA, 25 bp, Homo sapien
agttcaaactgaacacttctctcca

SEQ ID NO: 263217 - DNA, 25 bp, Homo sapien
agctctattcctatcttcctaatct

SEQ ID NO: 263218 - DNA, 25 bp, Homo sapien
atcttcctaatctaatggctctaca

SEQ ID NO: 263219 - DNA, 25 bp, Homo sapien
ggctctacaagatagtcatttccag

SEQ ID NO: 263220 - DNA, 25 bp, Homo sapien
taggtatgggctttctctggcagca

SEQ ID NO: 263221 - DNA, 25 bp, Homo sapien
agtgctacagatgcaccagggcacc

SEQ ID NO: 263222 - DNA, 25 bp, Homo sapien
ctaggtagaccttgttctgtagctg

SEQ ID NO: 263223 - DNA, 25 bp, Homo sapien
ctgctgtgaagaagctgcagccctg

SEQ ID NO: 263224 - DNA, 25 bp, Homo sapien
tgcagccctgaactcaggtcatact

SEQ ID NO: 263225 - DNA, 25 bp, Homo sapien
caggtcatactcaggaacagcagca

SEQ ID NO: 263226 - DNA, 25 bp, Homo sapien
gagacccatgggtctcccttcaggg

SEQ ID NO: 263227 - DNA, 25 bp, Homo sapien
agaaggccggagagaagctgctcga

SEQ ID NO: 263228 - DNA, 25 bp, Homo sapien
aagctgctcgaggagatgaggaacc

SEQ ID NO: 263229 - DNA, 25 bp, Homo sapien
ctgctcgaggagatgaggaacctgc

SEQ ID NO: 263230 - DNA, 25 bp, Homo sapien
gggcaaagcactcaacacatacctg

SEQ ID NO: 263231 - DNA, 25 bp, Homo sapien
gcaaagcactcaacacatacctgat

SEQ ID NO: 263232 - DNA, 25 bp, Homo sapien
gcactcaacacatacctgattctag

SEQ ID NO: 263233 - DNA, 25 bp, Homo sapien
actcaacacatacctgattctagaa

SEQ ID NO: 263234 - DNA, 25 bp, Homo sapien
gattctagaatgaaagtcaccagta

SEQ ID NO: 263235 - DNA, 25 bp, Homo sapien
gaaagtcaccagtaggtcagtccct

SEQ ID NO: 263236 - DNA, 25 bp, Homo sapien
aagtcaccagtaggtcagtcccttc

SEQ ID NO: 263237 - DNA, 25 bp, Homo sapien
tcaccagtaggtcagtcccttccat

SEQ ID NO: 263238 - DNA, 25 bp, Homo sapien
caaatgctagtcttccaccatgaaa

SEQ ID NO: 263239 - DNA, 25 bp, Homo sapien
gtagcaatttccataaggatgtgcc

SEQ ID NO: 263240 - DNA, 25 bp, Homo sapien
ataaggatgtgccttcactcacacg

SEQ ID NO: 263241 - DNA, 25 bp, Homo sapien
cactcacacgggacaggcggtggtt

SEQ ID NO: 263242 - DNA, 25 bp, Homo sapien
atagagtcgggcaaaaccagcagta

SEQ ID NO: 263243 - DNA, 25 bp, Homo sapien
accagcagtagagtatgaccagcca

SEQ ID NO: 263244 - DNA, 25 bp, Homo sapien
gtagagtatgaccagccaagccaat

SEQ ID NO: 263245 - DNA, 25 bp, Homo sapien
atgaccagccaagccaatctgctta

SEQ ID NO: 263246 - DNA, 25 bp, Homo sapien
gtagccactaagagtctgagtctga

SEQ ID NO: 263247 - DNA, 25 bp, Homo sapien
ggacagaatgtcattacatgcctat

SEQ ID NO: 263248 - DNA, 25 bp, Homo sapien
acatgcctatgggaataccaatcat

SEQ ID NO: 263249 - DNA, 25 bp, Homo sapien
tataaagtggttaattacggtggcg

SEQ ID NO: 263250 - DNA, 25 bp, Homo sapien
atgatggcttttaactcctctcaag

SEQ ID NO: 263251 - DNA, 25 bp, Homo sapien
tttaactcctctcaaggacaccgaa

SEQ ID NO: 263252 - DNA, 25 bp, Homo sapien
tttaataaacactggaaggctggga

SEQ ID NO: 263253 - DNA, 25 bp, Homo sapien
aattcacaccattcttactttcttg

SEQ ID NO: 263254 - DNA, 25 bp, Homo sapien
cacaccattcttactttcttggttt

SEQ ID NO: 263255 - DNA, 25 bp, Homo sapien
gatagcttatctacatccttaaatt

SEQ ID NO: 263256 - DNA, 25 bp, Homo sapien
gaaccagtagaacctggtgagtgaa

SEQ ID NO: 263257 - DNA, 25 bp, Homo sapien
aattaatggctgtagctaccctctg

SEQ ID NO: 263258 - DNA, 25 bp, Homo sapien
gtagctaccctctgcatggctccaa

SEQ ID NO: 263259 - DNA, 25 bp, Homo sapien
gctgaggagcgattgcattttgtta

SEQ ID NO: 263260 - DNA, 25 bp, Homo sapien
cttgtcagtgcgtgtgcggtcaaaa

SEQ ID NO: 263261 - DNA, 25 bp, Homo sapien
gagccattataatgcccagtgcaca

SEQ ID NO: 263262 - DNA, 25 bp, Homo sapien
ataaggccaccaccagcaaagtcag

SEQ ID NO: 263263 - DNA, 25 bp, Homo sapien
aaagtcagccaggagattcagcggg

SEQ ID NO: 263264 - DNA, 25 bp, Homo sapien
gagagaacacctgacaaagccaaat

SEQ ID NO: 263265 - DNA, 25 bp, Homo sapien
agttgatatcgtggccagctaaccg

SEQ ID NO: 263266 - DNA, 25 bp, Homo sapien
ctaaccggcagaagcttcctgactg

SEQ ID NO: 263267 - DNA, 25 bp, Homo sapien
caaatccactcagcctggcataaat

SEQ ID NO: 263268 - DNA, 25 bp, Homo sapien
aaataagccttggattttcccgctg

SEQ ID NO: 263269 - DNA, 25 bp, Homo sapien
attttcccgctgcagaatctctggg

SEQ ID NO: 263270 - DNA, 25 bp, Homo sapien
tggagtttctccatgacaccgcggc

SEQ ID NO: 263271 - DNA, 25 bp, Homo sapien
tggcccagccggcaggcttgttctt

SEQ ID NO: 263272 - DNA, 25 bp, Homo sapien
agccggcaggcttgttcttcagcat

SEQ ID NO: 263273 - DNA, 25 bp, Homo sapien
ttgttcttcagcatccgacgggaac

SEQ ID NO: 263274 - DNA, 25 bp, Homo sapien
atccgacgggaacatctccaacaga

SEQ ID NO: 263275 - DNA, 25 bp, Homo sapien
ccgacgggaacatctccaacagaag

SEQ ID NO: 263276 - DNA, 25 bp, Homo sapien
acaccccgcctcatctggaaatagt

SEQ ID NO: 263277 - DNA, 25 bp, Homo sapien
gcctcatctggaaatagttccgttt

SEQ ID NO: 263278 - DNA, 25 bp, Homo sapien
tctggaaatagttccgtttgtttct

SEQ ID NO: 263279 - DNA, 25 bp, Homo sapien
gtttctctaaaaagacttgtaggtg

SEQ ID NO: 263280 - DNA, 25 bp, Homo sapien
aaaatcttttgttctcatggaattg

SEQ ID NO: 263281 - DNA, 25 bp, Homo sapien
ctattggcaagatcgcatgtttttt

SEQ ID NO: 263282 - DNA, 25 bp, Homo sapien
tttttagcctcctacgaacattaag

SEQ ID NO: 263283 - DNA, 25 bp, Homo sapien
ttttagcctcctacgaacattaaga

SEQ ID NO: 263284 - DNA, 25 bp, Homo sapien
tttagcctcctacgaacattaagaa

SEQ ID NO: 263285 - DNA, 25 bp, Homo sapien
ttagcctcctacgaacattaagaag

SEQ ID NO: 263286 - DNA, 25 bp, Homo sapien
tagcctcctacgaacattaagaaga

SEQ ID NO: 263287 - DNA, 25 bp, Homo sapien
agcctcctacgaacattaagaagaa

SEQ ID NO: 263288 - DNA, 25 bp, Homo sapien
gcctcctacgaacattaagaagaaa

SEQ ID NO: 263289 - DNA, 25 bp, Homo sapien
gaaaaatgttgcgaggcacagtggc

SEQ ID NO: 263290 - DNA, 25 bp, Homo sapien
tgaggtgtccaagaggatcacctga

SEQ ID NO: 263291 - DNA, 25 bp, Homo sapien
tacaaaatttgcctagcgtggtggt

SEQ ID NO: 263292 - DNA, 25 bp, Homo sapien
aatttgcctagcgtggtggtgggca

SEQ ID NO: 263293 - DNA, 25 bp, Homo sapien
ataggccctgagatgtgaggtctgc

SEQ ID NO: 263294 - DNA, 25 bp, Homo sapien
ctgagatgtgaggtctgctgcttca

SEQ ID NO: 263295 - DNA, 25 bp, Homo sapien
gatgtgaggtctgctgcttcactgg

SEQ ID NO: 263296 - DNA, 25 bp, Homo sapien
tcactggggcccgatgactttggct

SEQ ID NO: 263297 - DNA, 25 bp, Homo sapien
ggcctagggcctcttctcattgaaa

SEQ ID NO: 263298 - DNA, 25 bp, Homo sapien
agggcctcttctcattgaaagctct

SEQ ID NO: 263299 - DNA, 25 bp, Homo sapien
gaaagctctgctttatacagaccca

SEQ ID NO: 263300 - DNA, 25 bp, Homo sapien
agctctgctttatacagacccaagc

SEQ ID NO: 263301 - DNA, 25 bp, Homo sapien
ttatacagacccaagcatacacacc

SEQ ID NO: 263302 - DNA, 25 bp, Homo sapien
agcatacacaccaggccgtcacttt

SEQ ID NO: 263303 - DNA, 25 bp, Homo sapien
acacaccaggccgtcactttgggtt

SEQ ID NO: 263304 - DNA, 25 bp, Homo sapien
ttattctggtgtgctgttgtgttct

SEQ ID NO: 263305 - DNA, 25 bp, Homo sapien
gctgttgtgttctcatatggttgtc

SEQ ID NO: 263306 - DNA, 25 bp, Homo sapien
atatggttgtctttttggtcttgat

SEQ ID NO: 263307 - DNA, 25 bp, Homo sapien
gtctttttggtcttgatagtgtatc

SEQ ID NO: 263308 - DNA, 25 bp, Homo sapien
tagtgtatcagtaacagagtacgag

SEQ ID NO: 263309 - DNA, 25 bp, Homo sapien
gagtacgagtaacaaacagggatct

SEQ ID NO: 263310 - DNA, 25 bp, Homo sapien
acagggatctcttctgaacggcgtg

SEQ ID NO: 263311 - DNA, 25 bp, Homo sapien
atctcttctgaacggcgtgacatta

SEQ ID NO: 263312 - DNA, 25 bp, Homo sapien
gaaaagctgtttacggcctcaactt

SEQ ID NO: 263313 - DNA, 25 bp, Homo sapien
ttacggcctcaactttgctgtggtt

SEQ ID NO: 263314 - DNA, 25 bp, Homo sapien
gcagtaactggagagtggcacttat

SEQ ID NO: 263315 - DNA, 25 bp, Homo sapien
ggtggcttcccacaatgaggaatct

SEQ ID NO: 263316 - DNA, 25 bp, Homo sapien
tgaggaatctgttcgccaggcaacc

SEQ ID NO: 263317 - DNA, 25 bp, Homo sapien
gctgggcattcctctggatgggact

SEQ ID NO: 263318 - DNA, 25 bp, Homo sapien
gatgggactgtctgtttcggacaac

SEQ ID NO: 263319 - DNA, 25 bp, Homo sapien
tttcggacaacttctgggcatgtgt

SEQ ID NO: 263320 - DNA, 25 bp, Homo sapien
gggcatgtgtgaccacgtctctcta

SEQ ID NO: 263321 - DNA, 25 bp, Homo sapien
ggcaggccggctatgtagtgtataa

SEQ ID NO: 263322 - DNA, 25 bp, Homo sapien
gtagtgtataagtccattccctatg

SEQ ID NO: 263323 - DNA, 25 bp, Homo sapien
tggaggaggtaatcccctacctgat

SEQ ID NO: 263324 - DNA, 25 bp, Homo sapien
tacctgatccggagggcccaggaga

SEQ ID NO: 263325 - DNA, 25 bp, Homo sapien
ccaggagaaccggagcgtgcttcag

SEQ ID NO: 263326 - DNA, 25 bp, Homo sapien
tgggaggcaggttgtctagaacaca

SEQ ID NO: 263327 - DNA, 25 bp, Homo sapien
ggcaggttgtctagaacacagcctt

SEQ ID NO: 263328 - DNA, 25 bp, Homo sapien
caggttgtctagaacacagccttgc

SEQ ID NO: 263329 - DNA, 25 bp, Homo sapien
gaaagcaggcatcaacttccaggga

SEQ ID NO: 263330 - DNA, 25 bp, Homo sapien
gcaggcatcaacttccagggatcta

SEQ ID NO: 263331 - DNA, 25 bp, Homo sapien
ggcatcaacttccagggatctaata

SEQ ID NO: 263332 - DNA, 25 bp, Homo sapien
acttccagggatctaataacttcct

SEQ ID NO: 263333 - DNA, 25 bp, Homo sapien
gatctaataacttcctaacttaaag

SEQ ID NO: 263334 - DNA, 25 bp, Homo sapien
gccctggctagggtagtgatgacat

SEQ ID NO: 263335 - DNA, 25 bp, Homo sapien
ggtagtgatgacatgcacccaaaca

SEQ ID NO: 263336 - DNA, 25 bp, Homo sapien
agtgatgacatgcacccaaacaccc

SEQ ID NO: 263337 - DNA, 25 bp, Homo sapien
ggtggtctcaagcttcagacgcttt

SEQ ID NO: 263338 - DNA, 25 bp, Homo sapien
cagacgctttccacgatgctataaa

SEQ ID NO: 263339 - DNA, 25 bp, Homo sapien
gatatggaacgcttttacatttctt

SEQ ID NO: 263340 - DNA, 25 bp, Homo sapien
gaaattttaatctctgggcatgtga

SEQ ID NO: 263341 - DNA, 25 bp, Homo sapien
gaagcccaaagtaaggttcactgtt

SEQ ID NO: 263342 - DNA, 25 bp, Homo sapien
caaaaaggttgtttcttcactggag

SEQ ID NO: 263343 - DNA, 25 bp, Homo sapien
ttcactggagtcctaatcctcccag

SEQ ID NO: 263344 - DNA, 25 bp, Homo sapien
atcctcccagaagatttttgatgaa

SEQ ID NO: 263345 - DNA, 25 bp, Homo sapien
gggcatgtgactatgttccatcttg

SEQ ID NO: 263346 - DNA, 25 bp, Homo sapien
catcttgtcttgatggcttttcaaa

SEQ ID NO: 263347 - DNA, 25 bp, Homo sapien
aaagaagccatggtggtctcaagct

SEQ ID NO: 263348 - DNA, 25 bp, Homo sapien
gaacttataaacaggtgggtataat

SEQ ID NO: 263349 - DNA, 25 bp, Homo sapien
caggtgggtataatgtagacttccg

SEQ ID NO: 263350 - DNA, 25 bp, Homo sapien
ggtgggtataatgtagacttccgaa

SEQ ID NO: 263351 - DNA, 25 bp, Homo sapien
gtgggtataatgtagacttccgaat

SEQ ID NO: 263352 - DNA, 25 bp, Homo sapien
tgggtataatgtagacttccgaata

SEQ ID NO: 263353 - DNA, 25 bp, Homo sapien
gggtataatgtagacttccgaataa

SEQ ID NO: 263354 - DNA, 25 bp, Homo sapien
ggtataatgtagacttccgaataag

SEQ ID NO: 263355 - DNA, 25 bp, Homo sapien
ataatgtagacttccgaataagaat

SEQ ID NO: 263356 - DNA, 25 bp, Homo sapien
gtagacttccgaataagaatatttt

SEQ ID NO: 263357 - DNA, 25 bp, Homo sapien
gacttccgaataagaatattttatc

SEQ ID NO: 263358 - DNA, 25 bp, Homo sapien
tatagtacctaaccaaataaaatct

SEQ ID NO: 263359 - DNA, 25 bp, Homo sapien
cctggcagtgatgcttagggctgat

SEQ ID NO: 263360 - DNA, 25 bp, Homo sapien
ttagggctgataagaatgctgactc

SEQ ID NO: 263361 - DNA, 25 bp, Homo sapien
tcaccatccgcggtgttggttggga

SEQ ID NO: 263362 - DNA, 25 bp, Homo sapien
ttgccacatattctggctccaggct

SEQ ID NO: 263363 - DNA, 25 bp, Homo sapien
caggctctctccaggagagatggat

SEQ ID NO: 263364 - DNA, 25 bp, Homo sapien
aaggtgaggttcgaggccacatcta

SEQ ID NO: 263365 - DNA, 25 bp, Homo sapien
gttcgaggccacatctatgggtgaa

SEQ ID NO: 263366 - DNA, 25 bp, Homo sapien
gccagactttggcaagtggtcagaa

SEQ ID NO: 263367 - DNA, 25 bp, Homo sapien
agggctttacttcaaatcaagaaat

SEQ ID NO: 263368 - DNA, 25 bp, Homo sapien
cccttggcttgttgtcctgaagagt

SEQ ID NO: 263369 - DNA, 25 bp, Homo sapien
ggcttgttgtcctgaagagtcttta

SEQ ID NO: 263370 - DNA, 25 bp, Homo sapien
gatcccagttattatttactcacta

SEQ ID NO: 263371 - DNA, 25 bp, Homo sapien
ttactcactatcatttagtgggtga

SEQ ID NO: 263372 - DNA, 25 bp, Homo sapien
gtgggtgaatcacagtaatttccct

SEQ ID NO: 263373 - DNA, 25 bp, Homo sapien
atttccctgtaaaatgtggtacctg

SEQ ID NO: 263374 - DNA, 25 bp, Homo sapien
gtggtacctgaagtcatatttgaga

SEQ ID NO: 263375 - DNA, 25 bp, Homo sapien
cgataagttactgtttgcattgaaa

SEQ ID NO: 263376 - DNA, 25 bp, Homo sapien
caaagccttttgaaatctgtaaaca

SEQ ID NO: 263377 - DNA, 25 bp, Homo sapien
atctgtaaacataaaattcctctca

SEQ ID NO: 263378 - DNA, 25 bp, Homo sapien
atctaaagccagttttatgttccta

SEQ ID NO: 263379 - DNA, 25 bp, Homo sapien
tttatgttcctaaaatctcattttc

SEQ ID NO: 263380 - DNA, 25 bp, Homo sapien
cattttcttctttctagtactacta

SEQ ID NO: 263381 - DNA, 25 bp, Homo sapien
tgctgagcattggacattgtccaat

SEQ ID NO: 263382 - DNA, 25 bp, Homo sapien
gattcattctgagtttctgactgag

SEQ ID NO: 263383 - DNA, 25 bp, Homo sapien
gtttctgactgagatcattctttca

SEQ ID NO: 263384 - DNA, 25 bp, Homo sapien
gactatgtctatttgtcctgggacc

SEQ ID NO: 263385 - DNA, 25 bp, Homo sapien
gtctatttgtcctgggacccataaa

SEQ ID NO: 263386 - DNA, 25 bp, Homo sapien
gggacccataaaatatgcagcccta

SEQ ID NO: 263387 - DNA, 25 bp, Homo sapien
tgcagccctaacatgatttcatttt

SEQ ID NO: 263388 - DNA, 25 bp, Homo sapien
tcagatcagctttcatattgcctta

SEQ ID NO: 263389 - DNA, 25 bp, Homo sapien
tattgccttatagacgatgacttca

SEQ ID NO: 263390 - DNA, 25 bp, Homo sapien
aaatatctgtatttggtggcataat

SEQ ID NO: 263391 - DNA, 25 bp, Homo sapien
gtggcataatatgttcttagtataa

SEQ ID NO: 263392 - DNA, 25 bp, Homo sapien
gtgagcgcgaagacgccgccgtggc

SEQ ID NO: 263393 - DNA, 25 bp, Homo sapien
cggccgccgcagtagaagcgattgc

SEQ ID NO: 263394 - DNA, 25 bp, Homo sapien
gccgccgcagtagaagcgattgcga

SEQ ID NO: 263395 - DNA, 25 bp, Homo sapien
gccgcagtagaagcgattgcgaccc

SEQ ID NO: 263396 - DNA, 25 bp, Homo sapien
cagtagaagcgattgcgacccggga

SEQ ID NO: 263397 - DNA, 25 bp, Homo sapien
agtagaagcgattgcgacccgggaa

SEQ ID NO: 263398 - DNA, 25 bp, Homo sapien
gtagaagcgattgcgacccgggaac

SEQ ID NO: 263399 - DNA, 25 bp, Homo sapien
agaagcgattgcgacccgggaacac

SEQ ID NO: 263400 - DNA, 25 bp, Homo sapien
gaagcgattgcgacccgggaacacc

SEQ ID NO: 263401 - DNA, 25 bp, Homo sapien
aagcgattgcgacccgggaacacct

SEQ ID NO: 263402 - DNA, 25 bp, Homo sapien
gaacacctcccacttgcgccgtggg

SEQ ID NO: 263403 - DNA, 25 bp, Homo sapien
atgcaaccttgttctcaaccacttg

SEQ ID NO: 263404 - DNA, 25 bp, Homo sapien
aaccacttgctatctcgtgattcag

SEQ ID NO: 263405 - DNA, 25 bp, Homo sapien
gattcagggattggatgagtctcta

SEQ ID NO: 263406 - DNA, 25 bp, Homo sapien
gagtctctatggtttgttttgccct

SEQ ID NO: 263407 - DNA, 25 bp, Homo sapien
ttgccctgaagagcagaaggcttct

SEQ ID NO: 263408 - DNA, 25 bp, Homo sapien
atctgattgggcatgtcacctcgga

SEQ ID NO: 263409 - DNA, 25 bp, Homo sapien
atgtcacctcggatggcaagggagt

SEQ ID NO: 263410 - DNA, 25 bp, Homo sapien
aaatcatggagtcccagctttcgga

SEQ ID NO: 263411 - DNA, 25 bp, Homo sapien
agctttcggagacgccttgcagctg

SEQ ID NO: 263412 - DNA, 25 bp, Homo sapien
tgcagctgcccggtgaagaaaatgc

SEQ ID NO: 263413 - DNA, 25 bp, Homo sapien
gaaaccacccagatgtccagtgata

SEQ ID NO: 263414 - DNA, 25 bp, Homo sapien
aaaaatttatgttacactcaggctg

SEQ ID NO: 263415 - DNA, 25 bp, Homo sapien
ctaaatagtgggaatccggaccaat

SEQ ID NO: 263416 - DNA, 25 bp, Homo sapien
tgggaatccggaccaataaagaaag

SEQ ID NO: 263417 - DNA, 25 bp, Homo sapien
aattagtcgctaatgctggtgacag

SEQ ID NO: 263418 - DNA, 25 bp, Homo sapien
tagtcgctaatgctggtgacagctc

SEQ ID NO: 263419 - DNA, 25 bp, Homo sapien
tagggtatgacaaaacagcagaatt

SEQ ID NO: 263420 - DNA, 25 bp, Homo sapien
gacaaaacagcagaattgctaagac

SEQ ID NO: 263421 - DNA, 25 bp, Homo sapien
ttgctaagacaacaccccaaaatgg

SEQ ID NO: 263422 - DNA, 25 bp, Homo sapien
gacaacaccccaaaatggatcaacc

SEQ ID NO: 263423 - DNA, 25 bp, Homo sapien
gaaactgccgttgaacttggctctc

SEQ ID NO: 263424 - DNA, 25 bp, Homo sapien
gttgaacttggctctctcacagcag

SEQ ID NO: 263425 - DNA, 25 bp, Homo sapien
actctggttcccatccttgtgccag

SEQ ID NO: 263426 - DNA, 25 bp, Homo sapien
tttcctgtcatcttgactctgtgca

SEQ ID NO: 263427 - DNA, 25 bp, Homo sapien
tgtcatcttgactctgtgcagttgg

SEQ ID NO: 263428 - DNA, 25 bp, Homo sapien
atagatgacctcaatctaccagcct

SEQ ID NO: 263429 - DNA, 25 bp, Homo sapien
tcttgactctgtgcagttggctcca

SEQ ID NO: 263430 - DNA, 25 bp, Homo sapien
gcagttggctccacactacgctcgt

SEQ ID NO: 263431 - DNA, 25 bp, Homo sapien
ggctccacactacgctcgttcaggt

SEQ ID NO: 263432 - DNA, 25 bp, Homo sapien
tgacctcaatctaccagcctgagag

SEQ ID NO: 263433 - DNA, 25 bp, Homo sapien
tgagagctccaccttgatcgccact

SEQ ID NO: 263434 - DNA, 25 bp, Homo sapien
tctctttctgctcattgtttctctt

SEQ ID NO: 263435 - DNA, 25 bp, Homo sapien
ctttctgctcattgtttctcttttt

SEQ ID NO: 263436 - DNA, 25 bp, Homo sapien
aatttcctttgtagcttcaattcct

SEQ ID NO: 263437 - DNA, 25 bp, Homo sapien
gcttcaattccttatatgacttcag

SEQ ID NO: 263438 - DNA, 25 bp, Homo sapien
gacttcagactggagaagcctgtta

SEQ ID NO: 263439 - DNA, 25 bp, Homo sapien
gaagcctgttaaaccactgttagtt

SEQ ID NO: 263440 - DNA, 25 bp, Homo sapien
aattctcaatttggctgctgtacac

SEQ ID NO: 263441 - DNA, 25 bp, Homo sapien
tgctgtacacgtgccagagttttac

SEQ ID NO: 263442 - DNA, 25 bp, Homo sapien
gccagagttttactactgtagtgac

SEQ ID NO: 263443 - DNA, 25 bp, Homo sapien
agtgaccgttgagaagacccttgtt

SEQ ID NO: 263444 - DNA, 25 bp, Homo sapien
aacctttcattgttaagtgcctgta

SEQ ID NO: 263445 - DNA, 25 bp, Homo sapien
agtgcctgtattcctttcatttact

SEQ ID NO: 263446 - DNA, 25 bp, Homo sapien
tatttacctagaaccattgtctact

SEQ ID NO: 263447 - DNA, 25 bp, Homo sapien
gtttagatactcatcaggacctcac

SEQ ID NO: 263448 - DNA, 25 bp, Homo sapien
ggacctcacaggagctgagacttat

SEQ ID NO: 263449 - DNA, 25 bp, Homo sapien
tgagacttatcagccagaatgtgtt

SEQ ID NO: 263450 - DNA, 25 bp, Homo sapien
gaatgtgttcttcggacagtcgtac

SEQ ID NO: 263451 - DNA, 25 bp, Homo sapien
ggacagtcgtacacatcttacagaa

SEQ ID NO: 263452 - DNA, 25 bp, Homo sapien
cacatcttacagaaaaccctccttg

SEQ ID NO: 263453 - DNA, 25 bp, Homo sapien
accctccttgtagagttggttgtgg

SEQ ID NO: 263454 - DNA, 25 bp, Homo sapien
ggttgtggtatgtgtttgatgctat

SEQ ID NO: 263455 - DNA, 25 bp, Homo sapien
ttttaatgtgtacacctgctctagg

SEQ ID NO: 263456 - DNA, 25 bp, Homo sapien
acctgctctagggacgattcgtttg

SEQ ID NO: 263457 - DNA, 25 bp, Homo sapien
taatagagtggcctctttcgctctt

SEQ ID NO: 263458 - DNA, 25 bp, Homo sapien
cagagctcgagcctccagttgtctg

SEQ ID NO: 263459 - DNA, 25 bp, Homo sapien
acagtctccatgtgagtctgcctga

SEQ ID NO: 263460 - DNA, 25 bp, Homo sapien
gtctccatgtgagtctgcctgacca

SEQ ID NO: 263461 - DNA, 25 bp, Homo sapien
ccatgtgagtctgcctgaccaggtg

SEQ ID NO: 263462 - DNA, 25 bp, Homo sapien
tgcctgaccaggtgtatcaagtgca

SEQ ID NO: 263463 - DNA, 25 bp, Homo sapien
ctgaccaggtgtatcaagtgcacaa

SEQ ID NO: 263464 - DNA, 25 bp, Homo sapien
gaccaggtgtatcaagtgcacaaag

SEQ ID NO: 263465 - DNA, 25 bp, Homo sapien
tcaaaaccctcaaggccaactttgt

SEQ ID NO: 263466 - DNA, 25 bp, Homo sapien
aaccctcaaggccaactttgtcact

SEQ ID NO: 263467 - DNA, 25 bp, Homo sapien
ctcaaggccaactttgtcactctgt

SEQ ID NO: 263468 - DNA, 25 bp, Homo sapien
caaggccaactttgtcactctgtcc

SEQ ID NO: 263469 - DNA, 25 bp, Homo sapien
ttgggtctccaggttctacctagga

SEQ ID NO: 263470 - DNA, 25 bp, Homo sapien
gctgttccattgcagcatagggaaa

SEQ ID NO: 263471 - DNA, 25 bp, Homo sapien
tagggaaactgttcaagcacacaat

SEQ ID NO: 263472 - DNA, 25 bp, Homo sapien
gagaggccagtaccaaaacttcagt

SEQ ID NO: 263473 - DNA, 25 bp, Homo sapien
aaacttcagtatctggcccaatggc

SEQ ID NO: 263474 - DNA, 25 bp, Homo sapien
ggcccaatggcaagaggctactgtt

SEQ ID NO: 263475 - DNA, 25 bp, Homo sapien
gctactgttaggtttgcatttgggc

SEQ ID NO: 263476 - DNA, 25 bp, Homo sapien
gcatttgggcagttagaacctcaca

SEQ ID NO: 263477 - DNA, 25 bp, Homo sapien
gttagaacctcacagataccagctc

SEQ ID NO: 263478 - DNA, 25 bp, Homo sapien
gataccagctcccaagttgctagtc

SEQ ID NO: 263479 - DNA, 25 bp, Homo sapien
ccaagttgctagtccatcagtgtaa

SEQ ID NO: 263480 - DNA, 25 bp, Homo sapien
aagagcttttctgacttggtagtag

SEQ ID NO: 263481 - DNA, 25 bp, Homo sapien
cttggtagtagtaggtcaggataaa

SEQ ID NO: 263482 - DNA, 25 bp, Homo sapien
tgtgctatcccctacttgtgagttg

SEQ ID NO: 263483 - DNA, 25 bp, Homo sapien
atcccctacttgtgagttgtatata

SEQ ID NO: 263484 - DNA, 25 bp, Homo sapien
atttgttaggattcttttgtgtcca

SEQ ID NO: 263485 - DNA, 25 bp, Homo sapien
tagatggctggctctgactgctata

SEQ ID NO: 263486 - DNA, 25 bp, Homo sapien
ggctctgactgctataacaaggtat

SEQ ID NO: 263487 - DNA, 25 bp, Homo sapien
acaaggtatgtatcacagctatgta

SEQ ID NO: 263488 - DNA, 25 bp, Homo sapien
gaatgcaaaatctactatagttgta

SEQ ID NO: 263489 - DNA, 25 bp, Homo sapien
atagttgtactataaattcagcacc

SEQ ID NO: 263490 - DNA, 25 bp, Homo sapien
aattcagcacctgttactgtataat

SEQ ID NO: 263491 - DNA, 25 bp, Homo sapien
agggctggtgcaggatacagtcttt

SEQ ID NO: 263492 - DNA, 25 bp, Homo sapien
ggatacagtctttggctgctttggc

SEQ ID NO: 263493 - DNA, 25 bp, Homo sapien
gctgctttggccctgggagcctaaa

SEQ ID NO: 263494 - DNA, 25 bp, Homo sapien
ttggccctgggagcctaaaggacag

SEQ ID NO: 263495 - DNA, 25 bp, Homo sapien
ggcttcacaagaggcctagagcagg

SEQ ID NO: 263496 - DNA, 25 bp, Homo sapien
atggctggagagtctgctcggttcc

SEQ ID NO: 263497 - DNA, 25 bp, Homo sapien
tggagagtctgctcggttccgcagc

SEQ ID NO: 263498 - DNA, 25 bp, Homo sapien
tggaagctccagtgacagtctgaaa

SEQ ID NO: 263499 - DNA, 25 bp, Homo sapien
agatacaacaggagtgtcggcccac

SEQ ID NO: 263500 - DNA, 25 bp, Homo sapien
acaacaggagtgtcggcccacaggg

SEQ ID NO: 263501 - DNA, 25 bp, Homo sapien
gcccacagggctggtgcaggataca

SEQ ID NO: 263502 - DNA, 25 bp, Homo sapien
aacctgctcaatgctgtcatcgtgc

SEQ ID NO: 263503 - DNA, 25 bp, Homo sapien
ctgtcatcgtgcagcggttaacata

SEQ ID NO: 263504 - DNA, 25 bp, Homo sapien
gcggttaacataaccgcccagccag

SEQ ID NO: 263505 - DNA, 25 bp, Homo sapien
aggatcagcgacatccgactcttca

SEQ ID NO: 263506 - DNA, 25 bp, Homo sapien
gacatccgactcttcatcgtggatg

SEQ ID NO: 263507 - DNA, 25 bp, Homo sapien
gactcttcatcgtggatgcccggcc

SEQ ID NO: 263508 - DNA, 25 bp, Homo sapien
accagctttatcctcatgactactt

SEQ ID NO: 263509 - DNA, 25 bp, Homo sapien
ttatcctcatgactactttcccgaa

SEQ ID NO: 263510 - DNA, 25 bp, Homo sapien
tttcccgaacaaagagctggctgat

SEQ ID NO: 263511 - DNA, 25 bp, Homo sapien
tggctgatgagagccagaccctgaa

SEQ ID NO: 263512 - DNA, 25 bp, Homo sapien
gaaggaagccaacctgctcaatgct

SEQ ID NO: 263513 - DNA, 25 bp, Homo sapien
gttcaactgggtctgagacttcaag

SEQ ID NO: 263514 - DNA, 25 bp, Homo sapien
ttcaactgggtctgagacttcaagg

SEQ ID NO: 263515 - DNA, 25 bp, Homo sapien
tcaactgggtctgagacttcaaggg

SEQ ID NO: 263516 - DNA, 25 bp, Homo sapien
aactgggtctgagacttcaaggggt

SEQ ID NO: 263517 - DNA, 25 bp, Homo sapien
tgggtctgagacttcaaggggtggt

SEQ ID NO: 263518 - DNA, 25 bp, Homo sapien
gcctaaagggggtactgagcctcct

SEQ ID NO: 263519 - DNA, 25 bp, Homo sapien
ctaaagggggtactgagcctcctgt

SEQ ID NO: 263520 - DNA, 25 bp, Homo sapien
taaagggggtactgagcctcctgtg

SEQ ID NO: 263521 - DNA, 25 bp, Homo sapien
aaagggggtactgagcctcctgtgg

SEQ ID NO: 263522 - DNA, 25 bp, Homo sapien
aagggggtactgagcctcctgtggc

SEQ ID NO: 263523 - DNA, 25 bp, Homo sapien
agggggtactgagcctcctgtggcc

SEQ ID NO: 263524 - DNA, 25 bp, Homo sapien
caatgatttagcctgttgattagac

SEQ ID NO: 263525 - DNA, 25 bp, Homo sapien
gcctgttgattagacttacgcacta

SEQ ID NO: 263526 - DNA, 25 bp, Homo sapien
ttacgcactaataaatgccagggct

SEQ ID NO: 263527 - DNA, 25 bp, Homo sapien
aatgccagggctgtgtacagaatag

SEQ ID NO: 263528 - DNA, 25 bp, Homo sapien
agaataggagtgtattttagcttca

SEQ ID NO: 263529 - DNA, 25 bp, Homo sapien
ttcagctgtttcacatgcatctctc

SEQ ID NO: 263530 - DNA, 25 bp, Homo sapien
acatgcatctctcactggtatgtgt

SEQ ID NO: 263531 - DNA, 25 bp, Homo sapien
catctctcactggtatgtgtgatga

SEQ ID NO: 263532 - DNA, 25 bp, Homo sapien
gtaatgtaagccttaactcttaagc

SEQ ID NO: 263533 - DNA, 25 bp, Homo sapien
gtaagccttaactcttaagcagagt

SEQ ID NO: 263534 - DNA, 25 bp, Homo sapien
atagacttgaaagatgactgcctga

SEQ ID NO: 263535 - DNA, 25 bp, Homo sapien
gctccttatagcttcttataagcag

SEQ ID NO: 263536 - DNA, 25 bp, Homo sapien
agcagagatgttcctaaaggacagg

SEQ ID NO: 263537 - DNA, 25 bp, Homo sapien
atgagcagactcaagttgaaggatt

SEQ ID NO: 263538 - DNA, 25 bp, Homo sapien
ttcctcctcctgctttctgggcatg

SEQ ID NO: 263539 - DNA, 25 bp, Homo sapien
aaatttgcttctttgtctgtgctcc

SEQ ID NO: 263540 - DNA, 25 bp, Homo sapien
tctgtgctccaattctttcctgtgt

SEQ ID NO: 263541 - DNA, 25 bp, Homo sapien
ggtctagattgggatccccttttct

SEQ ID NO: 263542 - DNA, 25 bp, Homo sapien
cccttttctggcaacatcttgagta

SEQ ID NO: 263543 - DNA, 25 bp, Homo sapien
aatggtcactagagcaccaacagcc

SEQ ID NO: 263544 - DNA, 25 bp, Homo sapien
ctgcacattccaagtttaatcatag

SEQ ID NO: 263545 - DNA, 25 bp, Homo sapien
caagtttaatcatagctccttatag

SEQ ID NO: 263546 - DNA, 25 bp, Homo sapien
ccatgcctggcctttaatatcttta

SEQ ID NO: 263547 - DNA, 25 bp, Homo sapien
gcctggcctttaatatctttaatat

SEQ ID NO: 263548 - DNA, 25 bp, Homo sapien
ttatcttatgatctgatatccagtt

SEQ ID NO: 263549 - DNA, 25 bp, Homo sapien
tattttctgtcttgtaaatgtcttt

SEQ ID NO: 263550 - DNA, 25 bp, Homo sapien
cacattagaatccagaaaggttcac

SEQ ID NO: 263551 - DNA, 25 bp, Homo sapien
aaggttcacaaattgcagttggctg

SEQ ID NO: 263552 - DNA, 25 bp, Homo sapien
gcagttggctgaaatgccttatctc

SEQ ID NO: 263553 - DNA, 25 bp, Homo sapien
gaaatgccttatctcttacgctaat

SEQ ID NO: 263554 - DNA, 25 bp, Homo sapien
atctcttacgctaatagttcctcca

SEQ ID NO: 263555 - DNA, 25 bp, Homo sapien
cttacgctaatagttcctccactaa

SEQ ID NO: 263556 - DNA, 25 bp, Homo sapien
gctaatagttcctccactaattaaa

SEQ ID NO: 263557 - DNA, 25 bp, Homo sapien
atcttgtgccaggtgcggtagtaga

SEQ ID NO: 263558 - DNA, 25 bp, Homo sapien
agctcgccataacagatcaggccat

SEQ ID NO: 263559 - DNA, 25 bp, Homo sapien
ctttcttcttgtacttcagcgcaat

SEQ ID NO: 263560 - DNA, 25 bp, Homo sapien
gcaatgttgttctgaatcgcttcaa

SEQ ID NO: 263561 - DNA, 25 bp, Homo sapien
gaatcgcttcaaagtctttcccatg

SEQ ID NO: 263562 - DNA, 25 bp, Homo sapien
aaagtctttcccatgctcgtacagc

SEQ ID NO: 263563 - DNA, 25 bp, Homo sapien
tacagcccctcgaagaaggtgttct

SEQ ID NO: 263564 - DNA, 25 bp, Homo sapien
aggtgttcttgtcctctgtgctcca

SEQ ID NO: 263565 - DNA, 25 bp, Homo sapien
acagttcctgggatgacttcttcag

SEQ ID NO: 263566 - DNA, 25 bp, Homo sapien
aggcctcgagagaacacatgatcaa

SEQ ID NO: 263567 - DNA, 25 bp, Homo sapien
tcgatgtacttggtgatcttgtgcc

SEQ ID NO: 263568 - DNA, 25 bp, Homo sapien
gagtctggatgatggacagtgacaa

SEQ ID NO: 263569 - DNA, 25 bp, Homo sapien
cagtgacaagcagttattcatgtgt

SEQ ID NO: 263570 - DNA, 25 bp, Homo sapien
attcatgtgtgaatctggtcaacat

SEQ ID NO: 263571 - DNA, 25 bp, Homo sapien
gaatctggtcaacatgaacatttag

SEQ ID NO: 263572 - DNA, 25 bp, Homo sapien
aacatttagatgctgaacacaaaag

SEQ ID NO: 263573 - DNA, 25 bp, Homo sapien
tttattagctatatttgttgcccat

SEQ ID NO: 263574 - DNA, 25 bp, Homo sapien
gttgcccatatattggaacagatct

SEQ ID NO: 263575 - DNA, 25 bp, Homo sapien
gagtgtattttcctaatctttccaa

SEQ ID NO: 263576 - DNA, 25 bp, Homo sapien
tattttcctaatctttccaacacca

SEQ ID NO: 263577 - DNA, 25 bp, Homo sapien
ttccaacaccaacctaaaaactcat

SEQ ID NO: 263578 - DNA, 25 bp, Homo sapien
gtaataagattaacaacctcgcatt

SEQ ID NO: 263579 - DNA, 25 bp, Homo sapien
ttccagaacattatacaaaccagtg

SEQ ID NO: 263580 - DNA, 25 bp, Homo sapien
accagtggaatattgtgttgaatca

SEQ ID NO: 263581 - DNA, 25 bp, Homo sapien
tcattcgtacttttcaaattgccac

SEQ ID NO: 263582 - DNA, 25 bp, Homo sapien
atatatttctagtagcagtcctgtg

SEQ ID NO: 263583 - DNA, 25 bp, Homo sapien
agtcctgtgtttcctaagcatcttg

SEQ ID NO: 263584 - DNA, 25 bp, Homo sapien
tgtgtttcctaagcatcttgaattt

SEQ ID NO: 263585 - DNA, 25 bp, Homo sapien
gaattttataaaccaacctctgatc

SEQ ID NO: 263586 - DNA, 25 bp, Homo sapien
taaaccaacctctgatcaatcttcc

SEQ ID NO: 263587 - DNA, 25 bp, Homo sapien
gatcaatcttcccatatcttgttag

SEQ ID NO: 263588 - DNA, 25 bp, Homo sapien
gttagcattaatcaaatacctgtat

SEQ ID NO: 263589 - DNA, 25 bp, Homo sapien
tttattctgaggtacatattttttc

SEQ ID NO: 263590 - DNA, 25 bp, Homo sapien
agccttcgcttctggagtactcctg

SEQ ID NO: 263591 - DNA, 25 bp, Homo sapien
gtactcctgggctggcaggcgaacc

SEQ ID NO: 263592 - DNA, 25 bp, Homo sapien
gaaccgactgcggaggcgctacttg

SEQ ID NO: 263593 - DNA, 25 bp, Homo sapien
tgaagagcttacagtcggaccgcgc

SEQ ID NO: 263594 - DNA, 25 bp, Homo sapien
aggcgctacttggactggaggaaaa

SEQ ID NO: 263595 - DNA, 25 bp, Homo sapien
gcaggacaagctggcggcgacgcag

SEQ ID NO: 263596 - DNA, 25 bp, Homo sapien
ctggacctggcctgagactctgcgc

SEQ ID NO: 263597 - DNA, 25 bp, Homo sapien
gatgtgtcagagaggacactgcagt

SEQ ID NO: 263598 - DNA, 25 bp, Homo sapien
acactgcagttgtccgtgctagtag

SEQ ID NO: 263599 - DNA, 25 bp, Homo sapien
agttgtccgtgctagtagccttcgc

SEQ ID NO: 263600 - DNA, 25 bp, Homo sapien
gctagtagccttcgcttctggagta

SEQ ID NO: 263601 - DNA, 25 bp, Homo sapien
agtgagtgtcactacttggctttgc

SEQ ID NO: 263602 - DNA, 25 bp, Homo sapien
tggctttgcttagcaggttctgctt

SEQ ID NO: 263603 - DNA, 25 bp, Homo sapien
tcacacttgttctttgacctgctga

SEQ ID NO: 263604 - DNA, 25 bp, Homo sapien
tgctgacttgtgacttgcagaaaca

SEQ ID NO: 263605 - DNA, 25 bp, Homo sapien
gtagtcctagcctggtaaagaccct

SEQ ID NO: 263606 - DNA, 25 bp, Homo sapien
tccaccacccctataagtttgattg

SEQ ID NO: 263607 - DNA, 25 bp, Homo sapien
ggcctattgggctcttggatggaac

SEQ ID NO: 263608 - DNA, 25 bp, Homo sapien
tcttggatggaaccctttcccgtat

SEQ ID NO: 263609 - DNA, 25 bp, Homo sapien
atcagtgctgactcaggatctcctg

SEQ ID NO: 263610 - DNA, 25 bp, Homo sapien
ggatctcctggtttggaatcgtaat

SEQ ID NO: 263611 - DNA, 25 bp, Homo sapien
gaatcgtaatgtgcctcaatcctct

SEQ ID NO: 263612 - DNA, 25 bp, Homo sapien
ttccaccctagtgggtctggagaca

SEQ ID NO: 263613 - DNA, 25 bp, Homo sapien
accctagtgggtctggagacagcat

SEQ ID NO: 263614 - DNA, 25 bp, Homo sapien
gggtctggagacagcatggcttgtc

SEQ ID NO: 263615 - DNA, 25 bp, Homo sapien
gaacaatggttttcaaactactcca

SEQ ID NO: 263616 - DNA, 25 bp, Homo sapien
tggttttcaaactactccacagaat

SEQ ID NO: 263617 - DNA, 25 bp, Homo sapien
tccacagaatcctcagggtctctta

SEQ ID NO: 263618 - DNA, 25 bp, Homo sapien
taggactgttcaagggctcatttgc

SEQ ID NO: 263619 - DNA, 25 bp, Homo sapien
ctcatttgctgaggagcctttgaac

SEQ ID NO: 263620 - DNA, 25 bp, Homo sapien
tgaggagcctttgaacagtcagtcc

SEQ ID NO: 263621 - DNA, 25 bp, Homo sapien
gagcctttgaacagtcagtcctaag

SEQ ID NO: 263622 - DNA, 25 bp, Homo sapien
ttgaacagtcagtcctaagagacgc

SEQ ID NO: 263623 - DNA, 25 bp, Homo sapien
gaatccaaaaaggtgagctcaacat

SEQ ID NO: 263624 - DNA, 25 bp, Homo sapien
tcaacatttggactccttctacctt

SEQ ID NO: 263625 - DNA, 25 bp, Homo sapien
gactccttctaccttgggagcattt

SEQ ID NO: 263626 - DNA, 25 bp, Homo sapien
gggagcatttattaattctggagga

SEQ ID NO: 263627 - DNA, 25 bp, Homo sapien
agttagtggagagcctgatcagtgt

SEQ ID NO: 263628 - DNA, 25 bp, Homo sapien
ggagagcctgatcagtgttttagac

SEQ ID NO: 263629 - DNA, 25 bp, Homo sapien
tcagaatctaggactcatcaaggga

SEQ ID NO: 263630 - DNA, 25 bp, Homo sapien
tcatcaagggaaatagcctagcgtt

SEQ ID NO: 263631 - DNA, 25 bp, Homo sapien
tagcctagcgttgggatgagaacct

SEQ ID NO: 263632 - DNA, 25 bp, Homo sapien
gaacctaaataattgcagcacagta

SEQ ID NO: 263633 - DNA, 25 bp, Homo sapien
gaactagtgggcctgtagcttcaaa

SEQ ID NO: 263634 - DNA, 25 bp, Homo sapien
aaactgatgcagctgaggccagaag

SEQ ID NO: 263635 - DNA, 25 bp, Homo sapien
aggccagaagccaggtttgaatcat

SEQ ID NO: 263636 - DNA, 25 bp, Homo sapien
gaagccaggtttgaatcattcataa

SEQ ID NO: 263637 - DNA, 25 bp, Homo sapien
attcataagctgagtgttttcactg

SEQ ID NO: 263638 - DNA, 25 bp, Homo sapien
atttcaccttcgctacaatgctggg

SEQ ID NO: 263639 - DNA, 25 bp, Homo sapien
caccttcgctacaatgctgggagat

SEQ ID NO: 263640 - DNA, 25 bp, Homo sapien
gatgggaattacaccattcgcacat

SEQ ID NO: 263641 - DNA, 25 bp, Homo sapien
ggaattacaccattcgcacatcagg

SEQ ID NO: 263642 - DNA, 25 bp, Homo sapien
accattcgcacatcaggaaacaggg

SEQ ID NO: 263643 - DNA, 25 bp, Homo sapien
ggctgtggattcttgggtaacttgc

SEQ ID NO: 263644 - DNA, 25 bp, Homo sapien
gggtaacttgcccatgctcagaaac

SEQ ID NO: 263645 - DNA, 25 bp, Homo sapien
ttttttgatttaccagcgttcgaca

SEQ ID NO: 263646 - DNA, 25 bp, Homo sapien
tttgatttaccagcgttcgacatcg

SEQ ID NO: 263647 - DNA, 25 bp, Homo sapien
tcttcctctagattaattgcttcgc

SEQ ID NO: 263648 - DNA, 25 bp, Homo sapien
agattaattgcttcgctcttttgag

SEQ ID NO: 263649 - DNA, 25 bp, Homo sapien
attgcttcgctcttttgagcaagaa

SEQ ID NO: 263650 - DNA, 25 bp, Homo sapien
gagcaagaatactctgtgtggcatc

SEQ ID NO: 263651 - DNA, 25 bp, Homo sapien
ctctgtgtggcatctttggtactat

SEQ ID NO: 263652 - DNA, 25 bp, Homo sapien
ggaacgagaatccagcattatcttt

SEQ ID NO: 263653 - DNA, 25 bp, Homo sapien
gagaatccagcattatctttaataa

SEQ ID NO: 263654 - DNA, 25 bp, Homo sapien
tgcccaagaaccctttcctggagag

SEQ ID NO: 263655 - DNA, 25 bp, Homo sapien
agagctgctccgagaccgcacagcg

SEQ ID NO: 263656 - DNA, 25 bp, Homo sapien
cgtggacctgggacctcgaacctgg

SEQ ID NO: 263657 - DNA, 25 bp, Homo sapien
gcttatttcacattcttgtcttttc

SEQ ID NO: 263658 - DNA, 25 bp, Homo sapien
ttttcttgcttgctcgagctgttcg

SEQ ID NO: 263659 - DNA, 25 bp, Homo sapien
tcgagctgttcgtgggttactttct

SEQ ID NO: 263660 - DNA, 25 bp, Homo sapien
tcgtgggttactttctgccttagtt

SEQ ID NO: 263661 - DNA, 25 bp, Homo sapien
aatgatttagtggttgcccagcctc

SEQ ID NO: 263662 - DNA, 25 bp, Homo sapien
gttgcccagcctcctttccaaggag

SEQ ID NO: 263663 - DNA, 25 bp, Homo sapien
ttccaaggagaggtgttcgctgagc

SEQ ID NO: 263664 - DNA, 25 bp, Homo sapien
agaggtgttcgctgagcggctctcc

SEQ ID NO: 263665 - DNA, 25 bp, Homo sapien
ggcccctttaagaagccaagtcagt

SEQ ID NO: 263666 - DNA, 25 bp, Homo sapien
agaagccaagtcagtcctgatgctg

SEQ ID NO: 263667 - DNA, 25 bp, Homo sapien
atgaggcccagaagctgagcctggt

SEQ ID NO: 263668 - DNA, 25 bp, Homo sapien
atgtgagccaggtctctgtggttca

SEQ ID NO: 263669 - DNA, 25 bp, Homo sapien
gtggttcacacgctacagacagatt

SEQ ID NO: 263670 - DNA, 25 bp, Homo sapien
agctgctgacccattcagggcttga

SEQ ID NO: 263671 - DNA, 25 bp, Homo sapien
gagggcctctagtatgtccattact

SEQ ID NO: 263672 - DNA, 25 bp, Homo sapien
ttactggagtccctaatcacgcctt

SEQ ID NO: 263673 - DNA, 25 bp, Homo sapien
ttggccagcctccttttgaaagtgt

SEQ ID NO: 263674 - DNA, 25 bp, Homo sapien
tgaaagtgtccgaagcctttttact

SEQ ID NO: 263675 - DNA, 25 bp, Homo sapien
tctagctcccacaattcagtgttgg

SEQ ID NO: 263676 - DNA, 25 bp, Homo sapien
tcagtgttgggtcctctgtgcaata

SEQ ID NO: 263677 - DNA, 25 bp, Homo sapien
gggtcctctgtgcaatatcatgatc

SEQ ID NO: 263678 - DNA, 25 bp, Homo sapien
ctggccgttcatacaacctagagga

SEQ ID NO: 263679 - DNA, 25 bp, Homo sapien
taagttccaggacttgacctcttgc

SEQ ID NO: 263680 - DNA, 25 bp, Homo sapien
cttgcccaccagataactcttgtta

SEQ ID NO: 263681 - DNA, 25 bp, Homo sapien
gatttcaagtcataatctctcctga

SEQ ID NO: 263682 - DNA, 25 bp, Homo sapien
tcaagtcataatctctcctgaagac

SEQ ID NO: 263683 - DNA, 25 bp, Homo sapien
acaacctagaggaaacgtaacacag

SEQ ID NO: 263684 - DNA, 25 bp, Homo sapien
tctcctgaagactcttggttcattg

SEQ ID NO: 263685 - DNA, 25 bp, Homo sapien
aagactcttggttcattgtcatgca

SEQ ID NO: 263686 - DNA, 25 bp, Homo sapien
ttggttcattgtcatgcatcccctg

SEQ ID NO: 263687 - DNA, 25 bp, Homo sapien
atgcatcccctggtactattataca

SEQ ID NO: 263688 - DNA, 25 bp, Homo sapien
cctggtactattatacacatccatt

SEQ ID NO: 263689 - DNA, 25 bp, Homo sapien
gacatcacttgtcagattttctggt

SEQ ID NO: 263690 - DNA, 25 bp, Homo sapien
gtcagattttctggtgtatggaaag

SEQ ID NO: 263691 - DNA, 25 bp, Homo sapien
ctcttttgaagcctgaaacttacaa

SEQ ID NO: 263692 - DNA, 25 bp, Homo sapien
tttaaagcctgaaatctaccataag

SEQ ID NO: 263693 - DNA, 25 bp, Homo sapien
taaggaacttggtaaattgtgtcag

SEQ ID NO: 263694 - DNA, 25 bp, Homo sapien
gtaaattgtgtcagataccatgaaa

SEQ ID NO: 263695 - DNA, 25 bp, Homo sapien
gtcagataccatgaaaatgcatctt

SEQ ID NO: 263696 - DNA, 25 bp, Homo sapien
gcatcttttcatagttaaccacaga

SEQ ID NO: 263697 - DNA, 25 bp, Homo sapien
caaattggtggtcaggttcaaggta

SEQ ID NO: 263698 - DNA, 25 bp, Homo sapien
atggattattgggttgattagtagc

SEQ ID NO: 263699 - DNA, 25 bp, Homo sapien
actaaatgcatgttcaggtcaaaat

SEQ ID NO: 263700 - DNA, 25 bp, Homo sapien
aagaatcttcctgccaacaggtagg

SEQ ID NO: 263701 - DNA, 25 bp, Homo sapien
gccaacaggtaggtcctgctggaca

SEQ ID NO: 263702 - DNA, 25 bp, Homo sapien
attacctcaagaattttcagtcgat

SEQ ID NO: 263703 - DNA, 25 bp, Homo sapien
gatatgtcaatgtactgttccttct

SEQ ID NO: 263704 - DNA, 25 bp, Homo sapien
gttccttctcagtaagtacagtgtc

SEQ ID NO: 263705 - DNA, 25 bp, Homo sapien
agtgtcacatgctgctggcggtaaa

SEQ ID NO: 263706 - DNA, 25 bp, Homo sapien
gctgctggcggtaaaagcaacccaa

SEQ ID NO: 263707 - DNA, 25 bp, Homo sapien
gcaacccaagtgtcagatcacacaa

SEQ ID NO: 263708 - DNA, 25 bp, Homo sapien
gatcacacaaattttagggacaagt

SEQ ID NO: 263709 - DNA, 25 bp, Homo sapien
gtctttcaaaagacggacaccttgt

SEQ ID NO: 263710 - DNA, 25 bp, Homo sapien
acaccttgtgatattttggagtcta

SEQ ID NO: 263711 - DNA, 25 bp, Homo sapien
ggattcgagatttacatatgcctgt

SEQ ID NO: 263712 - DNA, 25 bp, Homo sapien
atatgcctgtttgtgattttatctc

SEQ ID NO: 263713 - DNA, 25 bp, Homo sapien
aacaactctggattacattttcctc

SEQ ID NO: 263714 - DNA, 25 bp, Homo sapien
tttcctctcaactgaaaaccctcag

SEQ ID NO: 263715 - DNA, 25 bp, Homo sapien
agtaatgcaaagaaaggccttcctt

SEQ ID NO: 263716 - DNA, 25 bp, Homo sapien
aagtgactaaattgccttctagcca

SEQ ID NO: 263717 - DNA, 25 bp, Homo sapien
aattgccttctagccattttttctt

SEQ ID NO: 263718 - DNA, 25 bp, Homo sapien
gaggctgtattttttattccatttc

SEQ ID NO: 263719 - DNA, 25 bp, Homo sapien
atatggccatactgcttttttaccc

SEQ ID NO: 263720 - DNA, 25 bp, Homo sapien
actgcttttttacccctgcactatt

SEQ ID NO: 263721 - DNA, 25 bp, Homo sapien
cagtgcaccacagaataggattcga

SEQ ID NO: 263722 - DNA, 25 bp, Homo sapien
tcagcccgaggagcagtctggcatg

SEQ ID NO: 263723 - DNA, 25 bp, Homo sapien
gcatgggagtgaggccccgtccttc

SEQ ID NO: 263724 - DNA, 25 bp, Homo sapien
cttctcactgcctggtcacatggtg

SEQ ID NO: 263725 - DNA, 25 bp, Homo sapien
actgcctggtcacatggtgcctagg

SEQ ID NO: 263726 - DNA, 25 bp, Homo sapien
gcctggtcacatggtgcctagggat

SEQ ID NO: 263727 - DNA, 25 bp, Homo sapien
tggtcacatggtgcctagggatgca

SEQ ID NO: 263728 - DNA, 25 bp, Homo sapien
tggtgcctagggatgcagggctgga

SEQ ID NO: 263729 - DNA, 25 bp, Homo sapien
tcagccgagtcctgcctgagtgttg

SEQ ID NO: 263730 - DNA, 25 bp, Homo sapien
agtcctgcctgagtgttgcaagctc

SEQ ID NO: 263731 - DNA, 25 bp, Homo sapien
tgagtgttgcaagctcaggccttta

SEQ ID NO: 263732 - DNA, 25 bp, Homo sapien
aggcctttaaggactgctgatgccc

SEQ ID NO: 263733 - DNA, 25 bp, Homo sapien
tgcaccctgggaactgcagtaactt

SEQ ID NO: 263734 - DNA, 25 bp, Homo sapien
gcagtaacttattctcaaaggcttt

SEQ ID NO: 263735 - DNA, 25 bp, Homo sapien
ggctttaaacacagagatcctctca

SEQ ID NO: 263736 - DNA, 25 bp, Homo sapien
agagatcctctcagcggccgtgggc

SEQ ID NO: 263737 - DNA, 25 bp, Homo sapien
cttgtcctagccctgccacgtgagg

SEQ ID NO: 263738 - DNA, 25 bp, Homo sapien
acgtgagggtccagcctccagggac

SEQ ID NO: 263739 - DNA, 25 bp, Homo sapien
caacggcaaatccaaagttctttca

SEQ ID NO: 263740 - DNA, 25 bp, Homo sapien
agagcgagagagagtacgtgcacac

SEQ ID NO: 263741 - DNA, 25 bp, Homo sapien
gagagtacgtgcacacgcgcacaaa

SEQ ID NO: 263742 - DNA, 25 bp, Homo sapien
gcacacgcgcacaaaagagagaaac

SEQ ID NO: 263743 - DNA, 25 bp, Homo sapien
gaaacggacaccagaggaatgaact

SEQ ID NO: 263744 - DNA, 25 bp, Homo sapien
gggcaacctgggacaagacacccag

SEQ ID NO: 263745 - DNA, 25 bp, Homo sapien
cacccagagggtaaggattccagga

SEQ ID NO: 263746 - DNA, 25 bp, Homo sapien
atgaagctgccatttctggttggga

SEQ ID NO: 263747 - DNA, 25 bp, Homo sapien
gagaaagggctccattatgagcatg

SEQ ID NO: 263748 - DNA, 25 bp, Homo sapien
tatgagcatgggttcagggccctgc

SEQ ID NO: 263749 - DNA, 25 bp, Homo sapien
agggccctgcattacccaatcagaa

SEQ ID NO: 263750 - DNA, 25 bp, Homo sapien
tacccaatcagaacagccgggatga

SEQ ID NO: 263751 - DNA, 25 bp, Homo sapien
gggaaccccttcataaagttcagag

SEQ ID NO: 263752 - DNA, 25 bp, Homo sapien
ccttcataaagttcagagtggctgg

SEQ ID NO: 263753 - DNA, 25 bp, Homo sapien
gtcagcatggccaggctattcacac

SEQ ID NO: 263754 - DNA, 25 bp, Homo sapien
ggctattcacacaggccacagcaga

SEQ ID NO: 263755 - DNA, 25 bp, Homo sapien
gggatgcatgcgacagcccatgacc

SEQ ID NO: 263756 - DNA, 25 bp, Homo sapien
catgacccgaggcattctcagggta

SEQ ID NO: 263757 - DNA, 25 bp, Homo sapien
ttctcagggtatctgtgctgtgtgc

SEQ ID NO: 263758 - DNA, 25 bp, Homo sapien
tgctgtgtgcccgtgagaacatctt

SEQ ID NO: 263759 - DNA, 25 bp, Homo sapien
tctgctcccaggcaactgtgtgaat

SEQ ID NO: 263760 - DNA, 25 bp, Homo sapien
tttacattatttggagcctcatctg

SEQ ID NO: 263761 - DNA, 25 bp, Homo sapien
ggagcctcatctgtgtcaggctata

SEQ ID NO: 263762 - DNA, 25 bp, Homo sapien
ggctataacattctatcctcatctg

SEQ ID NO: 263763 - DNA, 25 bp, Homo sapien
tctgtaaaacttccccgtccattat

SEQ ID NO: 263764 - DNA, 25 bp, Homo sapien
tgccgtggtgaatgagagactagac

SEQ ID NO: 263765 - DNA, 25 bp, Homo sapien
atgagagactagacgtgatgcctct

SEQ ID NO: 263766 - DNA, 25 bp, Homo sapien
gatccagacaaaaaagagcacttcc

SEQ ID NO: 263767 - DNA, 25 bp, Homo sapien
ccagcagcagtgagtttgaggatct

SEQ ID NO: 263768 - DNA, 25 bp, Homo sapien
gaggatctgaatgcatatgcttccc

SEQ ID NO: 263769 - DNA, 25 bp, Homo sapien
gaatgcatatgcttcccaaagaaat

SEQ ID NO: 263770 - DNA, 25 bp, Homo sapien
gccatcgacccaaaatttgcagctt

SEQ ID NO: 263771 - DNA, 25 bp, Homo sapien
gagaaacttaaaccgctactgccag

SEQ ID NO: 263772 - DNA, 25 bp, Homo sapien
cagaaggatgagcttgacagacaaa

SEQ ID NO: 263773 - DNA, 25 bp, Homo sapien
gacagacaaaatcccaagcgcatta

SEQ ID NO: 263774 - DNA, 25 bp, Homo sapien
aatcccaagcgcattaacgcagtct

SEQ ID NO: 263775 - DNA, 25 bp, Homo sapien
attaacgcagtctcccatttgcctt

SEQ ID NO: 263776 - DNA, 25 bp, Homo sapien
atttgccttcgagaacacccctgat

SEQ ID NO: 263777 - DNA, 25 bp, Homo sapien
taggaactttcccataaggttatgt

SEQ ID NO: 263778 - DNA, 25 bp, Homo sapien
ccataaggttatgttttccagccca

SEQ ID NO: 263779 - DNA, 25 bp, Homo sapien
ataaggttatgttttccagcccagg

SEQ ID NO: 263780 - DNA, 25 bp, Homo sapien
taaggttatgttttccagcccaggc

SEQ ID NO: 263781 - DNA, 25 bp, Homo sapien
aaggttatgttttccagcccaggca

SEQ ID NO: 263782 - DNA, 25 bp, Homo sapien
aggttatgttttccagcccaggcat

SEQ ID NO: 263783 - DNA, 25 bp, Homo sapien
ggttatgttttccagcccaggcatg

SEQ ID NO: 263784 - DNA, 25 bp, Homo sapien
ttatgttttccagcccaggcatgga

SEQ ID NO: 263785 - DNA, 25 bp, Homo sapien
ttggctggacctccgtttctacgaa

SEQ ID NO: 263786 - DNA, 25 bp, Homo sapien
ggctggacctccgtttctacgaaat

SEQ ID NO: 263787 - DNA, 25 bp, Homo sapien
gctggacctccgtttctacgaaata

SEQ ID NO: 263788 - DNA, 25 bp, Homo sapien
tgggcttatgacatcatggctggct

SEQ ID NO: 263789 - DNA, 25 bp, Homo sapien
atcatggctggctgctgagcgatga

SEQ ID NO: 263790 - DNA, 25 bp, Homo sapien
ctgagcgatgaagtggatgccacaa

SEQ ID NO: 263791 - DNA, 25 bp, Homo sapien
gatgccacaaagaaatccgacatat

SEQ ID NO: 263792 - DNA, 25 bp, Homo sapien
agattctgaaatcggtttccctcca

SEQ ID NO: 263793 - DNA, 25 bp, Homo sapien
gtttccctccagctgtagtaacagg

SEQ ID NO: 263794 - DNA, 25 bp, Homo sapien
gtaacaggcgtgaagtcaggagaat

SEQ ID NO: 263795 - DNA, 25 bp, Homo sapien
aaaccataacaaagtcttgccctgt

SEQ ID NO: 263796 - DNA, 25 bp, Homo sapien
aaagtcttgccctgtattaaatgca

SEQ ID NO: 263797 - DNA, 25 bp, Homo sapien
gcaaaccttttggacatcattttat

SEQ ID NO: 263798 - DNA, 25 bp, Homo sapien
aaagtggctaataaatcagacctga

SEQ ID NO: 263799 - DNA, 25 bp, Homo sapien
tcatttacagcctggacaccctatt

SEQ ID NO: 263800 - DNA, 25 bp, Homo sapien
ggacaccctatttcttgaggtgaac

SEQ ID NO: 263801 - DNA, 25 bp, Homo sapien
tgaaggcttttgtacgacgtgtgtc

SEQ ID NO: 263802 - DNA, 25 bp, Homo sapien
gtgtcaggcaagactctggccagac

SEQ ID NO: 263803 - DNA, 25 bp, Homo sapien
accctttgccatagtccatttgtaa

SEQ ID NO: 263804 - DNA, 25 bp, Homo sapien
tgtaatgtatttccacatggcacag

SEQ ID NO: 263805 - DNA, 25 bp, Homo sapien
atggcacaggtatctccacttttgc

SEQ ID NO: 263806 - DNA, 25 bp, Homo sapien
ccatgctctcatgtggctcagaatt

SEQ ID NO: 263807 - DNA, 25 bp, Homo sapien
ggctcagaattattctccctactgc

SEQ ID NO: 263808 - DNA, 25 bp, Homo sapien
gttcgatgcacaccagacttctgag

SEQ ID NO: 263809 - DNA, 25 bp, Homo sapien
ggtgtggatctgtctgcccagtgcc

SEQ ID NO: 263810 - DNA, 25 bp, Homo sapien
gcacccagtccactggcagtggaat

SEQ ID NO: 263811 - DNA, 25 bp, Homo sapien
ttgctttcctgagaatcattctgag

SEQ ID NO: 263812 - DNA, 25 bp, Homo sapien
gaatcattctgaggctgggctattg

SEQ ID NO: 263813 - DNA, 25 bp, Homo sapien
cattctgaggctgggctattgcttc

SEQ ID NO: 263814 - DNA, 25 bp, Homo sapien
tattgcttctcccttgcttcaaaga

SEQ ID NO: 263815 - DNA, 25 bp, Homo sapien
gcttctcccttgcttcaaagaatct

SEQ ID NO: 263816 - DNA, 25 bp, Homo sapien
ttgcttcaaagaatctagcagcggg

SEQ ID NO: 263817 - DNA, 25 bp, Homo sapien
attttgcaacaaaaagctgacccag

SEQ ID NO: 263818 - DNA, 25 bp, Homo sapien
aaagctgacccagaggccatacaga

SEQ ID NO: 263819 - DNA, 25 bp, Homo sapien
gacccagaggccatacagagcagga

SEQ ID NO: 263820 - DNA, 25 bp, Homo sapien
cagagcaggaatatcccattgcccc

SEQ ID NO: 263821 - DNA, 25 bp, Homo sapien
gggtaccgaaaggagggcaattcat

SEQ ID NO: 263822 - DNA, 25 bp, Homo sapien
aagaaatttcctctgttcattccgt

SEQ ID NO: 263823 - DNA, 25 bp, Homo sapien
aaatttcctctgttcattccgttct

SEQ ID NO: 263824 - DNA, 25 bp, Homo sapien
attccgttctcttcaacctaagcaa

SEQ ID NO: 263825 - DNA, 25 bp, Homo sapien
caacctaagcaatatggatgtgtga

SEQ ID NO: 263826 - DNA, 25 bp, Homo sapien
attatggtaccaaaaatgtccacct

SEQ ID NO: 263827 - DNA, 25 bp, Homo sapien
atagttgacaacctgggaaagttct

SEQ ID NO: 263828 - DNA, 25 bp, Homo sapien
caacctgggaaagttctgagtattt

SEQ ID NO: 263829 - DNA, 25 bp, Homo sapien
tactgctcttttttgtgcatagaaa

SEQ ID NO: 263830 - DNA, 25 bp, Homo sapien
tttgcattaatttgccaatactctt

SEQ ID NO: 263831 - DNA, 25 bp, Homo sapien
ttgccaatactcttattctttgttc

SEQ ID NO: 263832 - DNA, 25 bp, Homo sapien
gtgctttgagaatatgaggctagat

SEQ ID NO: 263833 - DNA, 25 bp, Homo sapien
gtgaagctaagttgtctaagtggac

SEQ ID NO: 263834 - DNA, 25 bp, Homo sapien
gtaaaaatgtcccaccagcaagctg

SEQ ID NO: 263835 - DNA, 25 bp, Homo sapien
gataaagcttagtgctaatctcaga

SEQ ID NO: 263836 - DNA, 25 bp, Homo sapien
gagggagtctcatgatgcctgagat

SEQ ID NO: 263837 - DNA, 25 bp, Homo sapien
tgcctgagataatttctggccatta

SEQ ID NO: 263838 - DNA, 25 bp, Homo sapien
ctggccattagtggtgttcacgtta

SEQ ID NO: 263839 - DNA, 25 bp, Homo sapien
gggcagtaatcatccgacctgaaaa

SEQ ID NO: 263840 - DNA, 25 bp, Homo sapien
catccgacctgaaaaatagccttag

SEQ ID NO: 263841 - DNA, 25 bp, Homo sapien
gaaaaatagccttagatccctcata

SEQ ID NO: 263842 - DNA, 25 bp, Homo sapien
gccttagatccctcataaaatagtg

SEQ ID NO: 263843 - DNA, 25 bp, Homo sapien
agaaactttctcttgtagtgcctct

SEQ ID NO: 263844 - DNA, 25 bp, Homo sapien
aactttctcttgtagtgcctcttga

SEQ ID NO: 263845 - DNA, 25 bp, Homo sapien
tttctcttgtagtgcctcttgacaa

SEQ ID NO: 263846 - DNA, 25 bp, Homo sapien
ctcttgtagtgcctcttgacaaagc

SEQ ID NO: 263847 - DNA, 25 bp, Homo sapien
ttgacaaagcacaatttcccgcctt

SEQ ID NO: 263848 - DNA, 25 bp, Homo sapien
gacaaagcacaatttcccgcctttt

SEQ ID NO: 263849 - DNA, 25 bp, Homo sapien
aattgtgttttattgcggtatcaac

SEQ ID NO: 263850 - DNA, 25 bp, Homo sapien
ttgcggtatcaacaatgtgaataag

SEQ ID NO: 263851 - DNA, 25 bp, Homo sapien
gttcttttttccatgtaaatcaact

SEQ ID NO: 263852 - DNA, 25 bp, Homo sapien
atcaactatctttgttatcactaag

SEQ ID NO: 263853 - DNA, 25 bp, Homo sapien
taacttatgtgcattgttaggctgt

SEQ ID NO: 263854 - DNA, 25 bp, Homo sapien
gtagtctccttattaagtctgaaga

SEQ ID NO: 263855 - DNA, 25 bp, Homo sapien
gtgcaaagcagtcaagtcttttctc

SEQ ID NO: 263856 - DNA, 25 bp, Homo sapien
aagtcttttctcaacatgaccccaa

SEQ ID NO: 263857 - DNA, 25 bp, Homo sapien
tcaacatgaccccaatcaagctttt

SEQ ID NO: 263858 - DNA, 25 bp, Homo sapien
aacgtttggaatagagctcagttca

SEQ ID NO: 263859 - DNA, 25 bp, Homo sapien
gttcaaactcttcctattgcaaacg

SEQ ID NO: 263860 - DNA, 25 bp, Homo sapien
attgcaaacgaggaaatggctacag

SEQ ID NO: 263861 - DNA, 25 bp, Homo sapien
tggctacagaagcagagtgcccaaa

SEQ ID NO: 263862 - DNA, 25 bp, Homo sapien
gagtgcccaaagaatgcgaatgcaa

SEQ ID NO: 263863 - DNA, 25 bp, Homo sapien
caagtgatgagatcctttctggcat

SEQ ID NO: 263864 - DNA, 25 bp, Homo sapien
gaacaacagatgtagtctccttatt

SEQ ID NO: 263865 - DNA, 25 bp, Homo sapien
agcaaaatactccaagggctcagag

SEQ ID NO: 263866 - DNA, 25 bp, Homo sapien
gggctcagagatgaactcctagtct

SEQ ID NO: 263867 - DNA, 25 bp, Homo sapien
gagatgaactcctagtctaaggtct

SEQ ID NO: 263868 - DNA, 25 bp, Homo sapien
ctagtctaaggtctagtcctgcaga

SEQ ID NO: 263869 - DNA, 25 bp, Homo sapien
cagagggacccctctttggaatgta

SEQ ID NO: 263870 - DNA, 25 bp, Homo sapien
gtatttgagcaattcaggccagtca

SEQ ID NO: 263871 - DNA, 25 bp, Homo sapien
ttcaggccagtcaagttaaaccttt

SEQ ID NO: 263872 - DNA, 25 bp, Homo sapien
taaaccttttcacccatgcctaaat

SEQ ID NO: 263873 - DNA, 25 bp, Homo sapien
ttcacccatgcctaaatgctattta

SEQ ID NO: 263874 - DNA, 25 bp, Homo sapien
attcccttaaattaccatctgctct

SEQ ID NO: 263875 - DNA, 25 bp, Homo sapien
attaccatctgctctatctgcaagt

SEQ ID NO: 263876 - DNA, 25 bp, Homo sapien
atggatgcttgtcagatttgttttc

SEQ ID NO: 263877 - DNA, 25 bp, Homo sapien
aaagtttaccattacattctaagag

SEQ ID NO: 263878 - DNA, 25 bp, Homo sapien
cattctaagagaccccgattgagct

SEQ ID NO: 263879 - DNA, 25 bp, Homo sapien
agagaccccgattgagctggagttg

SEQ ID NO: 263880 - DNA, 25 bp, Homo sapien
ccaggtttatctgaaaagatcgaca

SEQ ID NO: 263881 - DNA, 25 bp, Homo sapien
gaaaagatcgacatacacagaaagc

SEQ ID NO: 263882 - DNA, 25 bp, Homo sapien
acagaaagctccagtgttctcctga

SEQ ID NO: 263883 - DNA, 25 bp, Homo sapien
aaagctccagtgttctcctgatcta

SEQ ID NO: 263884 - DNA, 25 bp, Homo sapien
ctccagtgttctcctgatctacagg

SEQ ID NO: 263885 - DNA, 25 bp, Homo sapien
gtgttctcctgatctacaggcccca

SEQ ID NO: 263886 - DNA, 25 bp, Homo sapien
gaatgttctgatatgacaggctaca

SEQ ID NO: 263887 - DNA, 25 bp, Homo sapien
tttttatatctggtctgtttttctt

SEQ ID NO: 263888 - DNA, 25 bp, Homo sapien
gcaattttcagatatctcaccttac

SEQ ID NO: 263889 - DNA, 25 bp, Homo sapien
gatatctcaccttaccatatctttc

SEQ ID NO: 263890 - DNA, 25 bp, Homo sapien
tcaccttaccatatctttccttatt

SEQ ID NO: 263891 - DNA, 25 bp, Homo sapien
ccttattttcactgcatgcatttaa

SEQ ID NO: 263892 - DNA, 25 bp, Homo sapien
tttcactgcatgcatttaatcactg

SEQ ID NO: 263893 - DNA, 25 bp, Homo sapien
tcactgtattacttaatgtttgatt

SEQ ID NO: 263894 - DNA, 25 bp, Homo sapien
tgatttgttattatgggcatttcaa

SEQ ID NO: 263895 - DNA, 25 bp, Homo sapien
tgggcatttcaaataggcaagcatt

SEQ ID NO: 263896 - DNA, 25 bp, Homo sapien
caaataggcaagcattgaattgtaa

SEQ ID NO: 263897 - DNA, 25 bp, Homo sapien
cacaccagagatgatattaaacact

SEQ ID NO: 263898 - DNA, 25 bp, Homo sapien
ttccacctctggatcgtgacccaat

SEQ ID NO: 263899 - DNA, 25 bp, Homo sapien
acctctggatcgtgacccaatatca

SEQ ID NO: 263900 - DNA, 25 bp, Homo sapien
ggatcgtgacccaatatcacctaag

SEQ ID NO: 263901 - DNA, 25 bp, Homo sapien
atatcacctaagaaggagcttggga

SEQ ID NO: 263902 - DNA, 25 bp, Homo sapien
gttaagaggtgtggattctcatcct

SEQ ID NO: 263903 - DNA, 25 bp, Homo sapien
gaggtgtggattctcatcctgactc

SEQ ID NO: 263904 - DNA, 25 bp, Homo sapien
gtggattctcatcctgactcttcca

SEQ ID NO: 263905 - DNA, 25 bp, Homo sapien
acctcttggctttgacttcaggcag

SEQ ID NO: 263906 - DNA, 25 bp, Homo sapien
tcttggctttgacttcaggcagacc

SEQ ID NO: 263907 - DNA, 25 bp, Homo sapien
caggcagaccctggaatttttctga

SEQ ID NO: 263908 - DNA, 25 bp, Homo sapien
ttctgaaattttgcttactctgtta

SEQ ID NO: 263909 - DNA, 25 bp, Homo sapien
gattattaaagctacagagtgtcag

SEQ ID NO: 263910 - DNA, 25 bp, Homo sapien
gagtgtcaggacaaggatttgtatt

SEQ ID NO: 263911 - DNA, 25 bp, Homo sapien
ccaaccctaacaaatgaccatcggg

SEQ ID NO: 263912 - DNA, 25 bp, Homo sapien
aatgaccatcgggtcagctcgcaca

SEQ ID NO: 263913 - DNA, 25 bp, Homo sapien
ccagcctaagctgaactgcttctat

SEQ ID NO: 263914 - DNA, 25 bp, Homo sapien
tgaactgcttctatggcctctatag

SEQ ID NO: 263915 - DNA, 25 bp, Homo sapien
gcttctatggcctctataggttaga

SEQ ID NO: 263916 - DNA, 25 bp, Homo sapien
gcctctataggttagatatggctga

SEQ ID NO: 263917 - DNA, 25 bp, Homo sapien
atgatgttcattatgttactaaaac

SEQ ID NO: 263918 - DNA, 25 bp, Homo sapien
accagtagcatcaacaatgtgtcag

SEQ ID NO: 263919 - DNA, 25 bp, Homo sapien
gtgtcagaattcacatttattacca

SEQ ID NO: 263920 - DNA, 25 bp, Homo sapien
ttaagtccacataaaaactgtacgt

SEQ ID NO: 263921 - DNA, 25 bp, Homo sapien
aaatgtttactgatgccttattcat

SEQ ID NO: 263922 - DNA, 25 bp, Homo sapien
atgccttattcataatcatcaaaag

SEQ ID NO: 263923 - DNA, 25 bp, Homo sapien
attcaaatgcctttcattgggtgaa

SEQ ID NO: 263924 - DNA, 25 bp, Homo sapien
atgcctttcattgggtgaactggta

SEQ ID NO: 263925 - DNA, 25 bp, Homo sapien
gggtgaactggtaaactgtggtata

SEQ ID NO: 263926 - DNA, 25 bp, Homo sapien
aactgtggtatatctatgcagtgaa

SEQ ID NO: 263927 - DNA, 25 bp, Homo sapien
agtgaaatactcctctgcagtgaca

SEQ ID NO: 263928 - DNA, 25 bp, Homo sapien
aatactcctctgcagtgacaatggg

SEQ ID NO: 263929 - DNA, 25 bp, Homo sapien
ggtttcctataaagttcaatgtaca

SEQ ID NO: 263930 - DNA, 25 bp, Homo sapien
gagagactgacacattgggcaccat

SEQ ID NO: 263931 - DNA, 25 bp, Homo sapien
gttgttgcagtgaactagtggctaa

SEQ ID NO: 263932 - DNA, 25 bp, Homo sapien
tgccaaatacaaacccttctgatat

SEQ ID NO: 263933 - DNA, 25 bp, Homo sapien
attcaaattgatatccaggaaacaa

SEQ ID NO: 263934 - DNA, 25 bp, Homo sapien
ggaaacaatccttgaccttcgtact

SEQ ID NO: 263935 - DNA, 25 bp, Homo sapien
ttgaccttcgtactcctcagaagaa

SEQ ID NO: 263936 - DNA, 25 bp, Homo sapien
gtactcctcagaagaagctgttgat

SEQ ID NO: 263937 - DNA, 25 bp, Homo sapien
aagctgttgataactcttcctgagc

SEQ ID NO: 263938 - DNA, 25 bp, Homo sapien
aactcttcctgagctggtggaatgt

SEQ ID NO: 263939 - DNA, 25 bp, Homo sapien
gtggaatgtaccagtgccaaagcat

SEQ ID NO: 263940 - DNA, 25 bp, Homo sapien
gtgccaaagcattctatatcccaga

SEQ ID NO: 263941 - DNA, 25 bp, Homo sapien
agagttagatattgctaatttcttc

SEQ ID NO: 263942 - DNA, 25 bp, Homo sapien
tctccaggaacctctacgtggtcct

SEQ ID NO: 263943 - DNA, 25 bp, Homo sapien
tacgtggtcctgtcgctctgcataa

SEQ ID NO: 263944 - DNA, 25 bp, Homo sapien
tgtcgctctgcataacctacgggat

SEQ ID NO: 263945 - DNA, 25 bp, Homo sapien
gctctgcataacctacgggatttta

SEQ ID NO: 263946 - DNA, 25 bp, Homo sapien
ggattttattttccaccctgtgcac

SEQ ID NO: 263947 - DNA, 25 bp, Homo sapien
tgtgcaccttgccttactcgctgct

SEQ ID NO: 263948 - DNA, 25 bp, Homo sapien
ttactcgctgctctgcgattactat

SEQ ID NO: 263949 - DNA, 25 bp, Homo sapien
ctgctctgcgattactatcagagta

SEQ ID NO: 263950 - DNA, 25 bp, Homo sapien
tgctgagctgccagtacttcctggc

SEQ ID NO: 263951 - DNA, 25 bp, Homo sapien
agctgccagtacttcctggctcaga

SEQ ID NO: 263952 - DNA, 25 bp, Homo sapien
tggctcagattctggtctccctggt

SEQ ID NO: 263953 - DNA, 25 bp, Homo sapien
ggaaggaggaacgtggctcctcctc

SEQ ID NO: 263954 - DNA, 25 bp, Homo sapien
aggcctgttcctgagacagagcctg

SEQ ID NO: 263955 - DNA, 25 bp, Homo sapien
gacagagcctggtctcacaagaggg

SEQ ID NO: 263956 - DNA, 25 bp, Homo sapien
tatttttgcctgtattgaccatttc

SEQ ID NO: 263957 - DNA, 25 bp, Homo sapien
tgcctgtattgaccatttctgccta

SEQ ID NO: 263958 - DNA, 25 bp, Homo sapien
gtattgaccatttctgcctaggtcg

SEQ ID NO: 263959 - DNA, 25 bp, Homo sapien
atttctgcctaggtcgtctcagaca

SEQ ID NO: 263960 - DNA, 25 bp, Homo sapien
taggtcgtctcagacagcctcatct

SEQ ID NO: 263961 - DNA, 25 bp, Homo sapien
tcttggtagctttactgattgccag

SEQ ID NO: 263962 - DNA, 25 bp, Homo sapien
gtagctttactgattgccagggaaa

SEQ ID NO: 263963 - DNA, 25 bp, Homo sapien
ttactgattgccagggaaaatgaaa

SEQ ID NO: 263964 - DNA, 25 bp, Homo sapien
ggaattatgttgtcatgtgccttta

SEQ ID NO: 263965 - DNA, 25 bp, Homo sapien
atgttgtcatgtgcctttaaccagc

SEQ ID NO: 263966 - DNA, 25 bp, Homo sapien
gtcatgtgcctttaaccagctttag

SEQ ID NO: 263967 - DNA, 25 bp, Homo sapien
gtgcctttaaccagctttagtaatt

SEQ ID NO: 263968 - DNA, 25 bp, Homo sapien
gatagttttgttaggtgacaggacc

SEQ ID NO: 263969 - DNA, 25 bp, Homo sapien
ttatcattatgtacattactgggtt

SEQ ID NO: 263970 - DNA, 25 bp, Homo sapien
tacattactgggtttttagcatttc

SEQ ID NO: 263971 - DNA, 25 bp, Homo sapien
gcatttcctaatgtgaagttttaat

SEQ ID NO: 263972 - DNA, 25 bp, Homo sapien
ttaaacaagtagttcactcttccat

SEQ ID NO: 263973 - DNA, 25 bp, Homo sapien
tccatttaagggatagcagttcctt

SEQ ID NO: 263974 - DNA, 25 bp, Homo sapien
gggatagcagttccttgtataaaat

SEQ ID NO: 263975 - DNA, 25 bp, Homo sapien
atggcgctcagcctgaatcagtcag

SEQ ID NO: 263976 - DNA, 25 bp, Homo sapien
gaatcagtcagctaggtctcttgtg

SEQ ID NO: 263977 - DNA, 25 bp, Homo sapien
tcagctaggtctcttgtggccctgg

SEQ ID NO: 263978 - DNA, 25 bp, Homo sapien
atgtgattcctgtaggtgtggcccc

SEQ ID NO: 263979 - DNA, 25 bp, Homo sapien
gccccagggtggacagctacagagt

SEQ ID NO: 263980 - DNA, 25 bp, Homo sapien
atgtagggcacctggaaggctccat

SEQ ID NO: 263981 - DNA, 25 bp, Homo sapien
acctggaaggctccatgtgtcctgg

SEQ ID NO: 263982 - DNA, 25 bp, Homo sapien
acaggtctctgtcaattgggtgcat

SEQ ID NO: 263983 - DNA, 25 bp, Homo sapien
aattgggtgcatcacactgtggcct

SEQ ID NO: 263984 - DNA, 25 bp, Homo sapien
tgtggcctttttgtcgtggatttaa

SEQ ID NO: 263985 - DNA, 25 bp, Homo sapien
gattgtacaaatcaaactggtggat

SEQ ID NO: 263986 - DNA, 25 bp, Homo sapien
aaaaattctgcttctgaattgtatt

SEQ ID NO: 263987 - DNA, 25 bp, Homo sapien
gtatttgaatagtatgggcttacaa

SEQ ID NO: 263988 - DNA, 25 bp, Homo sapien
gggcttacaacaaaaaccagataat

SEQ ID NO: 263989 - DNA, 25 bp, Homo sapien
cagataattcttgcttctattcttt

SEQ ID NO: 263990 - DNA, 25 bp, Homo sapien
ttcttgcttctattctttttgaata

SEQ ID NO: 263991 - DNA, 25 bp, Homo sapien
tgttatactagtgttcttgtgggaa

SEQ ID NO: 263992 - DNA, 25 bp, Homo sapien
tcttgtgggaattttatcagttata

SEQ ID NO: 263993 - DNA, 25 bp, Homo sapien
gaaagcacatccagttttccgtttg

SEQ ID NO: 263994 - DNA, 25 bp, Homo sapien
gcacatccagttttccgtttggaca

SEQ ID NO: 263995 - DNA, 25 bp, Homo sapien
tccagttttccgtttggacattgtt

SEQ ID NO: 263996 - DNA, 25 bp, Homo sapien
tggacattgttaataaatctgaggt

SEQ ID NO: 263997 - DNA, 25 bp, Homo sapien
gtaatagctgctttgattcaaatca

SEQ ID NO: 263998 - DNA, 25 bp, Homo sapien
taaaaatgtcctacagactgtgagg

SEQ ID NO: 263999 - DNA, 25 bp, Homo sapien
tatactgatatcaaagagcaacttt

SEQ ID NO: 264000 - DNA, 25 bp, Homo sapien
gagcaactttcagaattatgattgt

SEQ ID NO: 264001 - DNA, 25 bp, Homo sapien
gattgttaacacctatgcagtcagt

SEQ ID NO: 264002 - DNA, 25 bp, Homo sapien
ttaacacctatgcagtcagtccttt

SEQ ID NO: 264003 - DNA, 25 bp, Homo sapien
acctatgcagtcagtcctttgatga

SEQ ID NO: 264004 - DNA, 25 bp, Homo sapien
ttgaaaagttggctttcttctataa

SEQ ID NO: 264005 - DNA, 25 bp, Homo sapien
gctttcttctataagccttgctgtt

SEQ ID NO: 264006 - DNA, 25 bp, Homo sapien
tataagccttgctgttccttctcaa

SEQ ID NO: 264007 - DNA, 25 bp, Homo sapien
ccttgctgttccttctcaaccaaga

SEQ ID NO: 264008 - DNA, 25 bp, Homo sapien
taggaactttcccataaggttatgt

SEQ ID NO: 264009 - DNA, 25 bp, Homo sapien
cataaggttatgttttccagcccag

SEQ ID NO: 264010 - DNA, 25 bp, Homo sapien
taaggttatgttttccagcccaggc

SEQ ID NO: 264011 - DNA, 25 bp, Homo sapien
aaggttatgttttccagcccaggca

SEQ ID NO: 264012 - DNA, 25 bp, Homo sapien
aggttatgttttccagcccaggcat

SEQ ID NO: 264013 - DNA, 25 bp, Homo sapien
ggttatgttttccagcccaggcatg

SEQ ID NO: 264014 - DNA, 25 bp, Homo sapien
ttatgttttccagcccaggcatgga

SEQ ID NO: 264015 - DNA, 25 bp, Homo sapien
ttggctggacctccgtttctacgaa

SEQ ID NO: 264016 - DNA, 25 bp, Homo sapien
gctggacctccgtttctacgaaata

SEQ ID NO: 264017 - DNA, 25 bp, Homo sapien
gtagtcctatctactcaagggtggg

SEQ ID NO: 264018 - DNA, 25 bp, Homo sapien
gccacagtgaattaggattgcacca

SEQ ID NO: 264019 - DNA, 25 bp, Homo sapien
ttcacttgtgtatctgctaaaatcc

SEQ ID NO: 264020 - DNA, 25 bp, Homo sapien
cacttgtgtatctgctaaaatcctg

SEQ ID NO: 264021 - DNA, 25 bp, Homo sapien
cttgtgtatctgctaaaatcctggg

SEQ ID NO: 264022 - DNA, 25 bp, Homo sapien
atctgctaaaatcctggggtgtcac

SEQ ID NO: 264023 - DNA, 25 bp, Homo sapien
tgtcacatagacacgctaaacctcg

SEQ ID NO: 264024 - DNA, 25 bp, Homo sapien
acatagacacgctaaacctcgtctc

SEQ ID NO: 264025 - DNA, 25 bp, Homo sapien
attttattcccaagtacgtacagat

SEQ ID NO: 264026 - DNA, 25 bp, Homo sapien
ttattcccaagtacgtacagatttt

SEQ ID NO: 264027 - DNA, 25 bp, Homo sapien
agtacgtacagattttatttccaag

SEQ ID NO: 264028 - DNA, 25 bp, Homo sapien
tactttttagcaacatggtttttca

SEQ ID NO: 264029 - DNA, 25 bp, Homo sapien
ttttagcaacatggtttttcacttg

SEQ ID NO: 264030 - DNA, 25 bp, Homo sapien
aaggaggaactgacactagtgaata

SEQ ID NO: 264031 - DNA, 25 bp, Homo sapien
aaactggctactaaactgctaaagg

SEQ ID NO: 264032 - DNA, 25 bp, Homo sapien
gttggacagtccttttagattatat

SEQ ID NO: 264033 - DNA, 25 bp, Homo sapien
gtccttttagattatatgggcttac

SEQ ID NO: 264034 - DNA, 25 bp, Homo sapien
tgggcttacaatgaatccgctgctt

SEQ ID NO: 264035 - DNA, 25 bp, Homo sapien
gaatccgctgctttataacatcacc

SEQ ID NO: 264036 - DNA, 25 bp, Homo sapien
tgctttataacatcacccaggttgt

SEQ ID NO: 264037 - DNA, 25 bp, Homo sapien
atcacccaggttgttatcctgtcag

SEQ ID NO: 264038 - DNA, 25 bp, Homo sapien
aggttgttatcctgtcagctgtttc

SEQ ID NO: 264039 - DNA, 25 bp, Homo sapien
ctgtcagctgtttctggtgttatca

SEQ ID NO: 264040 - DNA, 25 bp, Homo sapien
ggtgttatcagtgacttgcttggat

SEQ ID NO: 264041 - DNA, 25 bp, Homo sapien
caaaaacgattgtcatttgcagttt

SEQ ID NO: 264042 - DNA, 25 bp, Homo sapien
gttttgatacacctctagttgtcag

SEQ ID NO: 264043 - DNA, 25 bp, Homo sapien
gatacacctctagttgtcagttcaa

SEQ ID NO: 264044 - DNA, 25 bp, Homo sapien
agaagtgcactcttaacatcccatt

SEQ ID NO: 264045 - DNA, 25 bp, Homo sapien
agtgcactcttaacatcccatttat

SEQ ID NO: 264046 - DNA, 25 bp, Homo sapien
ctcttaacatcccatttatccagtg

SEQ ID NO: 264047 - DNA, 25 bp, Homo sapien
atcccatttatccagtgtcaaagct

SEQ ID NO: 264048 - DNA, 25 bp, Homo sapien
gggaatcaacgcttatggttagacc

SEQ ID NO: 264049 - DNA, 25 bp, Homo sapien
tccagtgtcaaagctatgatacatt

SEQ ID NO: 264050 - DNA, 25 bp, Homo sapien
caacgcttatggttagacctctgat

SEQ ID NO: 264051 - DNA, 25 bp, Homo sapien
atggttagacctctgattcaggaag

SEQ ID NO: 264052 - DNA, 25 bp, Homo sapien
ttattcctgagtaaacaagtatgac

SEQ ID NO: 264053 - DNA, 25 bp, Homo sapien
gtaaacaagtatgacatcgacccat

SEQ ID NO: 264054 - DNA, 25 bp, Homo sapien
tgacatcgacccatagcaatgcttt

SEQ ID NO: 264055 - DNA, 25 bp, Homo sapien
gggaacaacagctgtcatcaatcca

SEQ ID NO: 264056 - DNA, 25 bp, Homo sapien
agctgtcatcaatccagtgtctggg

SEQ ID NO: 264057 - DNA, 25 bp, Homo sapien
tgacccatctgaagagggacgcaga

SEQ ID NO: 264058 - DNA, 25 bp, Homo sapien
gtaggtaggaggaggcatttacaaa

SEQ ID NO: 264059 - DNA, 25 bp, Homo sapien
acaaaatgctacctgttgaggtgcc

SEQ ID NO: 264060 - DNA, 25 bp, Homo sapien
tgaggtgcccgcatttgatggaaac

SEQ ID NO: 264061 - DNA, 25 bp, Homo sapien
ttgatggaaacttcaccccgatcat

SEQ ID NO: 264062 - DNA, 25 bp, Homo sapien
ttcaccccgatcatgcaacatcaga

SEQ ID NO: 264063 - DNA, 25 bp, Homo sapien
ggacatatgtgtgattcaatatata

SEQ ID NO: 264064 - DNA, 25 bp, Homo sapien
tttaatactttcctactgataatga

SEQ ID NO: 264065 - DNA, 25 bp, Homo sapien
gagtgtttttcttgtccaatagagc

SEQ ID NO: 264066 - DNA, 25 bp, Homo sapien
gtttttcttgtccaatagagcctaa

SEQ ID NO: 264067 - DNA, 25 bp, Homo sapien
gtccaatagagcctaattgtttcct

SEQ ID NO: 264068 - DNA, 25 bp, Homo sapien
gagggctgcacctttaaattcccag

SEQ ID NO: 264069 - DNA, 25 bp, Homo sapien
ggctgcacctttaaattcccagatt

SEQ ID NO: 264070 - DNA, 25 bp, Homo sapien
gcacctttaaattcccagattgtca

SEQ ID NO: 264071 - DNA, 25 bp, Homo sapien
ttgtcaatagacatgtacagtatat

SEQ ID NO: 264072 - DNA, 25 bp, Homo sapien
ggataaggtggacacaagtgcacat

SEQ ID NO: 264073 - DNA, 25 bp, Homo sapien
ggtggacacaagtgcacatataaat

SEQ ID NO: 264074 - DNA, 25 bp, Homo sapien
catttcaggccagaaaagttaagag

SEQ ID NO: 264075 - DNA, 25 bp, Homo sapien
gcccgagtccgtttctttaatggag

SEQ ID NO: 264076 - DNA, 25 bp, Homo sapien
gagtccgtttctttaatggaggtat

SEQ ID NO: 264077 - DNA, 25 bp, Homo sapien
ggaggtattagctagagaagacatt

SEQ ID NO: 264078 - DNA, 25 bp, Homo sapien
gacattgatgaagcagtatgtgcaa

SEQ ID NO: 264079 - DNA, 25 bp, Homo sapien
agcagtatgtgcaatattatttaaa

SEQ ID NO: 264080 - DNA, 25 bp, Homo sapien
tccattgtgaaggttacagtcccac

SEQ ID NO: 264081 - DNA, 25 bp, Homo sapien
tgaaggttacagtcccaccatttgt

SEQ ID NO: 264082 - DNA, 25 bp, Homo sapien
ggttacagtcccaccatttgttgat

SEQ ID NO: 264083 - DNA, 25 bp, Homo sapien
tacagtcccaccatttgttgatcct

SEQ ID NO: 264084 - DNA, 25 bp, Homo sapien
ttgttgatcctctgtttcaaagaca

SEQ ID NO: 264085 - DNA, 25 bp, Homo sapien
ctttattgtttctagtggcccacta

SEQ ID NO: 264086 - DNA, 25 bp, Homo sapien
tagtggcccactaaagtaagtcagg

SEQ ID NO: 264087 - DNA, 25 bp, Homo sapien
cagaggttaacaactgaatttgctc

SEQ ID NO: 264088 - DNA, 25 bp, Homo sapien
gaatttgctcttcagtaatattata

SEQ ID NO: 264089 - DNA, 25 bp, Homo sapien
attatataacaacctgagagcccta

SEQ ID NO: 264090 - DNA, 25 bp, Homo sapien
aacctgagagccctaaatgaattct

SEQ ID NO: 264091 - DNA, 25 bp, Homo sapien
gaattcttatgattctcctaagtac

SEQ ID NO: 264092 - DNA, 25 bp, Homo sapien
tctcctaagtacctgctacttaata

SEQ ID NO: 264093 - DNA, 25 bp, Homo sapien
gataacttcacccaggacacttgga

SEQ ID NO: 264094 - DNA, 25 bp, Homo sapien
gacacttggatttatatttctccct

SEQ ID NO: 264095 - DNA, 25 bp, Homo sapien
atatttatgcatcctttttatttga

SEQ ID NO: 264096 - DNA, 25 bp, Homo sapien
aaacactgagctttcccggtggaag

SEQ ID NO: 264097 - DNA, 25 bp, Homo sapien
tgagctttcccggtggaagagttcc

SEQ ID NO: 264098 - DNA, 25 bp, Homo sapien
gtgttctcttcgctgtttagttagc

SEQ ID NO: 264099 - DNA, 25 bp, Homo sapien
tttattccgacctacggaagcccag

SEQ ID NO: 264100 - DNA, 25 bp, Homo sapien
gaggaccaggattaccgctgccgct

SEQ ID NO: 264101 - DNA, 25 bp, Homo sapien
aggattaccgctgccgctggatgcg

SEQ ID NO: 264102 - DNA, 25 bp, Homo sapien
atgcgcgaccgtgagacgctgcgct

SEQ ID NO: 264103 - DNA, 25 bp, Homo sapien
aggagacataccctctgtccagcct

SEQ ID NO: 264104 - DNA, 25 bp, Homo sapien
gtggagtcggcctcaaaggttccgc

SEQ ID NO: 264105 - DNA, 25 bp, Homo sapien
aaaggttccgctctcatgtcggcaa

SEQ ID NO: 264106 - DNA, 25 bp, Homo sapien
ctctcatgtcggcaagtgtgatttg

SEQ ID NO: 264107 - DNA, 25 bp, Homo sapien
aaaactgtctttgggtgattgtgga

SEQ ID NO: 264108 - DNA, 25 bp, Homo sapien
agaggtgatcatatgtccgctgtgt

SEQ ID NO: 264109 - DNA, 25 bp, Homo sapien
atatgtccgctgtgttgctcccatc

SEQ ID NO: 264110 - DNA, 25 bp, Homo sapien
cctggtgactggtagctctcatgag

SEQ ID NO: 264111 - DNA, 25 bp, Homo sapien
tagctctcatgagggtgtgatggtc

SEQ ID NO: 264112 - DNA, 25 bp, Homo sapien
ggtgtgatggtcaggccttgcccct

SEQ ID NO: 264113 - DNA, 25 bp, Homo sapien
ttgcccctggtgtaaattctgtctg

SEQ ID NO: 264114 - DNA, 25 bp, Homo sapien
aaattctgtctgtaataggctgtga

SEQ ID NO: 264115 - DNA, 25 bp, Homo sapien
taggctgtgactttctaactcaaca

SEQ ID NO: 264116 - DNA, 25 bp, Homo sapien
taactcaacatcaccactggcttag

SEQ ID NO: 264117 - DNA, 25 bp, Homo sapien
actggcttaggagttccatttgcac

SEQ ID NO: 264118 - DNA, 25 bp, Homo sapien
gaaactggaactacgttggcagtat

SEQ ID NO: 264119 - DNA, 25 bp, Homo sapien
acgttggcagtattcagtttgacat

SEQ ID NO: 264120 - DNA, 25 bp, Homo sapien
ggcatcagagtacagaaagtcacaa

SEQ ID NO: 264121 - DNA, 25 bp, Homo sapien
tgaacagctggactagtcggccctt

SEQ ID NO: 264122 - DNA, 25 bp, Homo sapien
ataccctcagtaaccatcagcaatg

SEQ ID NO: 264123 - DNA, 25 bp, Homo sapien
agcagtatctgcaccaacgttaaca

SEQ ID NO: 264124 - DNA, 25 bp, Homo sapien
gttaacagacagacaggtgctttta

SEQ ID NO: 264125 - DNA, 25 bp, Homo sapien
gaatttgacaatattacgtgcctga

SEQ ID NO: 264126 - DNA, 25 bp, Homo sapien
gggttacttttagtccagacaagtg

SEQ ID NO: 264127 - DNA, 25 bp, Homo sapien
gtccagacaagtgactccaagctga

SEQ ID NO: 264128 - DNA, 25 bp, Homo sapien
ctccaagctgagtctttagatacag

SEQ ID NO: 264129 - DNA, 25 bp, Homo sapien
atgggagaatatcacttttactttg

SEQ ID NO: 264130 - DNA, 25 bp, Homo sapien
ataagggtagatcaaaagtttcaga

SEQ ID NO: 264131 - DNA, 25 bp, Homo sapien
tttttaaatgctatatgtactctac

SEQ ID NO: 264132 - DNA, 25 bp, Homo sapien
atgtactctacatctctttcataat

SEQ ID NO: 264133 - DNA, 25 bp, Homo sapien
gatgtcctgaaaaaactggcaacag

SEQ ID NO: 264134 - DNA, 25 bp, Homo sapien
ggcaacagtggatagcctcagagtt

SEQ ID NO: 264135 - DNA, 25 bp, Homo sapien
gtggatagcctcagagttctaaatt

SEQ ID NO: 264136 - DNA, 25 bp, Homo sapien
aatcaaaatatctcaggtttctttc

SEQ ID NO: 264137 - DNA, 25 bp, Homo sapien
tttcattcacataatctttcttctg

SEQ ID NO: 264138 - DNA, 25 bp, Homo sapien
tctttcttctgtgcttatgatctca

SEQ ID NO: 264139 - DNA, 25 bp, Homo sapien
cttctgtgcttatgatctcagtggg

SEQ ID NO: 264140 - DNA, 25 bp, Homo sapien
ctaaatagtgggaatccggaccaat

SEQ ID NO: 264141 - DNA, 25 bp, Homo sapien
tgggaatccggaccaataaagaaag

SEQ ID NO: 264142 - DNA, 25 bp, Homo sapien
agctaatgaattagtcgctaatgct

SEQ ID NO: 264143 - DNA, 25 bp, Homo sapien
aattagtcgctaatgctggtgacag

SEQ ID NO: 264144 - DNA, 25 bp, Homo sapien
ttagtcgctaatgctggtgacagct

SEQ ID NO: 264145 - DNA, 25 bp, Homo sapien
tagtcgctaatgctggtgacagctc

SEQ ID NO: 264146 - DNA, 25 bp, Homo sapien
tagggtatgacaaaacagcagaatt

SEQ ID NO: 264147 - DNA, 25 bp, Homo sapien
gacaaaacagcagaattgctaagac

SEQ ID NO: 264148 - DNA, 25 bp, Homo sapien
ttgctaagacaacaccccaaaatgg

SEQ ID NO: 264149 - DNA, 25 bp, Homo sapien
gctaagacaacaccccaaaatggat

SEQ ID NO: 264150 - DNA, 25 bp, Homo sapien
acaacaccccaaaatggatcaacct

SEQ ID NO: 264151 - DNA, 25 bp, Homo sapien
ttacaaacatgagcctccgtacctg

SEQ ID NO: 264152 - DNA, 25 bp, Homo sapien
tccgtacctggccaatccatatatt

SEQ ID NO: 264153 - DNA, 25 bp, Homo sapien
aggcagaatcttgccgtattgccca

SEQ ID NO: 264154 - DNA, 25 bp, Homo sapien
taatatctcactttgactgttaatg

SEQ ID NO: 264155 - DNA, 25 bp, Homo sapien
atagctgataacattcttgaaggta

SEQ ID NO: 264156 - DNA, 25 bp, Homo sapien
gaaggtagacatttgctccctgata

SEQ ID NO: 264157 - DNA, 25 bp, Homo sapien
gacatttgctccctgataatgaaga

SEQ ID NO: 264158 - DNA, 25 bp, Homo sapien
ctgagtagaggtgatgtttttgtat

SEQ ID NO: 264159 - DNA, 25 bp, Homo sapien
ttgtatttagttttctccacatata

SEQ ID NO: 264160 - DNA, 25 bp, Homo sapien
acatatatctgtcccacttgcaatg

SEQ ID NO: 264161 - DNA, 25 bp, Homo sapien
gtcccacttgcaatggatagtattt

SEQ ID NO: 264162 - DNA, 25 bp, Homo sapien
tacctgcgcccgagcactgctgaga

SEQ ID NO: 264163 - DNA, 25 bp, Homo sapien
gagcactgctgagacgacatccctt

SEQ ID NO: 264164 - DNA, 25 bp, Homo sapien
tgctgagacgacatcccttccagcg

SEQ ID NO: 264165 - DNA, 25 bp, Homo sapien
atatctccccacaaacctaaacaat

SEQ ID NO: 264166 - DNA, 25 bp, Homo sapien
cctaaacaatttcgagagggacttg

SEQ ID NO: 264167 - DNA, 25 bp, Homo sapien
gagagggacttgtgttctgcaacca

SEQ ID NO: 264168 - DNA, 25 bp, Homo sapien
gggacttgtgttctgcaaccagtca

SEQ ID NO: 264169 - DNA, 25 bp, Homo sapien
tgtgttctgcaaccagtcacagaat

SEQ ID NO: 264170 - DNA, 25 bp, Homo sapien
gcaaccagtcacagaatatcaggtg

SEQ ID NO: 264171 - DNA, 25 bp, Homo sapien
atcaggtgagctgggcgtgtcttca

SEQ ID NO: 264172 - DNA, 25 bp, Homo sapien
tgagctgggcgtgtcttcactgacc

SEQ ID NO: 264173 - DNA, 25 bp, Homo sapien
aatctaggctataatggtgttcaaa

SEQ ID NO: 264174 - DNA, 25 bp, Homo sapien
ggctataatggtgttcaaatttttt

SEQ ID NO: 264175 - DNA, 25 bp, Homo sapien
tttttccatttcagggacaccctct

SEQ ID NO: 264176 - DNA, 25 bp, Homo sapien
gacattcaattcaaatgtatcttct

SEQ ID NO: 264177 - DNA, 25 bp, Homo sapien
tctctggttaaagtatggtgaagtc

SEQ ID NO: 264178 - DNA, 25 bp, Homo sapien
tatggtgaagtctgtcctgtgggca

SEQ ID NO: 264179 - DNA, 25 bp, Homo sapien
tgtcctgtgggcactccccattgac

SEQ ID NO: 264180 - DNA, 25 bp, Homo sapien
cattgactcctagcagctcttgagc

SEQ ID NO: 264181 - DNA, 25 bp, Homo sapien
tagcagctcttgagccccatcttca

SEQ ID NO: 264182 - DNA, 25 bp, Homo sapien
ccatcttcaggatccgtactttgat

SEQ ID NO: 264183 - DNA, 25 bp, Homo sapien
aggatccgtactttgatagtcactg

SEQ ID NO: 264184 - DNA, 25 bp, Homo sapien
cccagcgttcggtggaagtccagga

SEQ ID NO: 264185 - DNA, 25 bp, Homo sapien
tcgggacacagggttctccggtgga

SEQ ID NO: 264186 - DNA, 25 bp, Homo sapien
agtctctccaggctgccaacaagtc

SEQ ID NO: 264187 - DNA, 25 bp, Homo sapien
actcagaaggccgagacccagcggt

SEQ ID NO: 264188 - DNA, 25 bp, Homo sapien
cagcaaggcagtgacccagcggttt

SEQ ID NO: 264189 - DNA, 25 bp, Homo sapien
agtgacccagcggtttcgcgaggat

SEQ ID NO: 264190 - DNA, 25 bp, Homo sapien
gcccgggacccagttactagattat

SEQ ID NO: 264191 - DNA, 25 bp, Homo sapien
gacccagttactagattatgaaggc

SEQ ID NO: 264192 - DNA, 25 bp, Homo sapien
tatgaaggcatctcaggccctggag

SEQ ID NO: 264193 - DNA, 25 bp, Homo sapien
agacccagcggtcttcaatagaagt

SEQ ID NO: 264194 - DNA, 25 bp, Homo sapien
tcttcaatagaagtccgggaggccg

SEQ ID NO: 264195 - DNA, 25 bp, Homo sapien
aaataccaagattaattacatgcta

SEQ ID NO: 264196 - DNA, 25 bp, Homo sapien
gcttttttcagttttctcactttgt

SEQ ID NO: 264197 - DNA, 25 bp, Homo sapien
ctaagaggattgatctcatgtgctt

SEQ ID NO: 264198 - DNA, 25 bp, Homo sapien
taagtcctcaacctgcagttttcct

SEQ ID NO: 264199 - DNA, 25 bp, Homo sapien
tgcagttttcctccctagaggtagc

SEQ ID NO: 264200 - DNA, 25 bp, Homo sapien
gattgatctcatgtgctttttgcca

SEQ ID NO: 264201 - DNA, 25 bp, Homo sapien
agaggtagccgccatcctaaagtca

SEQ ID NO: 264202 - DNA, 25 bp, Homo sapien
agccgccatcctaaagtcagtgtga

SEQ ID NO: 264203 - DNA, 25 bp, Homo sapien
ccgccatcctaaagtcagtgtgaat

SEQ ID NO: 264204 - DNA, 25 bp, Homo sapien
ttttatgatgtatgtagcatccata

SEQ ID NO: 264205 - DNA, 25 bp, Homo sapien
actggagagtttactaaatttgtgt

SEQ ID NO: 264206 - DNA, 25 bp, Homo sapien
agaacccggatctccgcaagcgcag

SEQ ID NO: 264207 - DNA, 25 bp, Homo sapien
agcctcgcgccacatggagtgcagt

SEQ ID NO: 264208 - DNA, 25 bp, Homo sapien
tcgcgccacatggagtgcagtttgc

SEQ ID NO: 264209 - DNA, 25 bp, Homo sapien
gcgccacatggagtgcagtttgccg

SEQ ID NO: 264210 - DNA, 25 bp, Homo sapien
gccacatggagtgcagtttgccgcc

SEQ ID NO: 264211 - DNA, 25 bp, Homo sapien
acatggagtgcagtttgccgccctc

SEQ ID NO: 264212 - DNA, 25 bp, Homo sapien
atggagtgcagtttgccgccctcca

SEQ ID NO: 264213 - DNA, 25 bp, Homo sapien
ctggaccggcgagtcttcttgtaaa

SEQ ID NO: 264214 - DNA, 25 bp, Homo sapien
aattaacaagtgacaagggagtgca

SEQ ID NO: 264215 - DNA, 25 bp, Homo sapien
caagtgacaagggagtgcagtgcct

SEQ ID NO: 264216 - DNA, 25 bp, Homo sapien
tgacaagggagtgcagtgccttgca

SEQ ID NO: 264217 - DNA, 25 bp, Homo sapien
ttatagagtcagggtttccctgtgt

SEQ ID NO: 264218 - DNA, 25 bp, Homo sapien
gggcatgattcaaaattatcctccg

SEQ ID NO: 264219 - DNA, 25 bp, Homo sapien
tgattcaaaattatcctccgagctg

SEQ ID NO: 264220 - DNA, 25 bp, Homo sapien
attcaaaattatcctccgagctgcc

SEQ ID NO: 264221 - DNA, 25 bp, Homo sapien
ttcaaaattatcctccgagctgcct

SEQ ID NO: 264222 - DNA, 25 bp, Homo sapien
caaaattatcctccgagctgcctct

SEQ ID NO: 264223 - DNA, 25 bp, Homo sapien
aattatcctccgagctgcctctctg

SEQ ID NO: 264224 - DNA, 25 bp, Homo sapien
tccgagctgcctctctggttctttc

SEQ ID NO: 264225 - DNA, 25 bp, Homo sapien
ctgggaaaaacacttaggcaagttg

SEQ ID NO: 264226 - DNA, 25 bp, Homo sapien
gagaggactgcttaatgtcaggagc

SEQ ID NO: 264227 - DNA, 25 bp, Homo sapien
aggactgcttaatgtcaggagctca

SEQ ID NO: 264228 - DNA, 25 bp, Homo sapien
taagtcaaagccatgtgcaccctga

SEQ ID NO: 264229 - DNA, 25 bp, Homo sapien
aaagccatgtgcaccctgaattttt

SEQ ID NO: 264230 - DNA, 25 bp, Homo sapien
gccatgtgcaccctgaatttttata

SEQ ID NO: 264231 - DNA, 25 bp, Homo sapien
gaatttttataggtgcagccaaggc

SEQ ID NO: 264232 - DNA, 25 bp, Homo sapien
catcctccgcagctgtggtggttga

SEQ ID NO: 264233 - DNA, 25 bp, Homo sapien
ccgcagctgtggtggttgacttttc

SEQ ID NO: 264234 - DNA, 25 bp, Homo sapien
tgtggtggttgacttttcctcatac

SEQ ID NO: 264235 - DNA, 25 bp, Homo sapien
actatgtcagtttggttttcgctta

SEQ ID NO: 264236 - DNA, 25 bp, Homo sapien
gtcagtttggttttcgcttactatg

SEQ ID NO: 264237 - DNA, 25 bp, Homo sapien
gaacattactgaccacattctgtgt

SEQ ID NO: 264238 - DNA, 25 bp, Homo sapien
ggtgtttctctagcatggaacccag

SEQ ID NO: 264239 - DNA, 25 bp, Homo sapien
aactttctggtggcctcggcgtgga

SEQ ID NO: 264240 - DNA, 25 bp, Homo sapien
agactttccatgtacactatgaatg

SEQ ID NO: 264241 - DNA, 25 bp, Homo sapien
ttccatgtacactatgaatgccaag

SEQ ID NO: 264242 - DNA, 25 bp, Homo sapien
gctccccatgtgattgtaatatgca

SEQ ID NO: 264243 - DNA, 25 bp, Homo sapien
gtgattgtaatatgcagccaagaat

SEQ ID NO: 264244 - DNA, 25 bp, Homo sapien
gaatgccaagtgctgtgaataccaa

SEQ ID NO: 264245 - DNA, 25 bp, Homo sapien
agtgctgtgaataccaacccatgct

SEQ ID NO: 264246 - DNA, 25 bp, Homo sapien
aataccaacccatgctttcaaagag

SEQ ID NO: 264247 - DNA, 25 bp, Homo sapien
acccatgctttcaaagagcctgctg

SEQ ID NO: 264248 - DNA, 25 bp, Homo sapien
atgctttcaaagagcctgctgcctc

SEQ ID NO: 264249 - DNA, 25 bp, Homo sapien
tgctgcctcagagcatgtgatgtgg

SEQ ID NO: 264250 - DNA, 25 bp, Homo sapien
agtgggttgaattgccatggctgct

SEQ ID NO: 264251 - DNA, 25 bp, Homo sapien
aagctcccgactagacatacatgga

SEQ ID NO: 264252 - DNA, 25 bp, Homo sapien
ccgactagacatacatggagcagta

SEQ ID NO: 264253 - DNA, 25 bp, Homo sapien
aaagatgcagatgttctctgaggct

SEQ ID NO: 264254 - DNA, 25 bp, Homo sapien
gatgcagatgttctctgaggctgaa

SEQ ID NO: 264255 - DNA, 25 bp, Homo sapien
gatgttctctgaggctgaataagac

SEQ ID NO: 264256 - DNA, 25 bp, Homo sapien
ggctgaataagaccatgctctgcct

SEQ ID NO: 264257 - DNA, 25 bp, Homo sapien
ttgtttcaactgttacacagagatg

SEQ ID NO: 264258 - DNA, 25 bp, Homo sapien
tgttacacagagatgaccagaggat

SEQ ID NO: 264259 - DNA, 25 bp, Homo sapien
gcagtgcagttcaagaggctctggt

SEQ ID NO: 264260 - DNA, 25 bp, Homo sapien
tgcagttcaagaggctctggttcgg

SEQ ID NO: 264261 - DNA, 25 bp, Homo sapien
ttttgtcatacatttctctatttga

SEQ ID NO: 264262 - DNA, 25 bp, Homo sapien
caaattcgttttttgtccaagacat

SEQ ID NO: 264263 - DNA, 25 bp, Homo sapien
tttgtccaagacattctatcagaat

SEQ ID NO: 264264 - DNA, 25 bp, Homo sapien
ctatcagaattttacttgcctctat

SEQ ID NO: 264265 - DNA, 25 bp, Homo sapien
tttacttgcctctataatctgaaaa

SEQ ID NO: 264266 - DNA, 25 bp, Homo sapien
ggttctagaatgtcccacttgctgt

SEQ ID NO: 264267 - DNA, 25 bp, Homo sapien
aatgtcccacttgctgtctcttaga

SEQ ID NO: 264268 - DNA, 25 bp, Homo sapien
ctgtctcttagaggctgagcttcat

SEQ ID NO: 264269 - DNA, 25 bp, Homo sapien
ggctgagcttcatttctatgagcaa

SEQ ID NO: 264270 - DNA, 25 bp, Homo sapien
aagagctcatttagcaatgtagtta

SEQ ID NO: 264271 - DNA, 25 bp, Homo sapien
ttatttctattatggaatccctggg

SEQ ID NO: 264272 - DNA, 25 bp, Homo sapien
gaatgcaggaaagtcaccaaaactg

SEQ ID NO: 264273 - DNA, 25 bp, Homo sapien
ggaaagtcaccaaaactgtcacctc

SEQ ID NO: 264274 - DNA, 25 bp, Homo sapien
aagtcaccaaaactgtcacctcatt

SEQ ID NO: 264275 - DNA, 25 bp, Homo sapien
accaaaactgtcacctcattcagca

SEQ ID NO: 264276 - DNA, 25 bp, Homo sapien
accaaaaggttcacatcggaccaag

SEQ ID NO: 264277 - DNA, 25 bp, Homo sapien
gttcacatcggaccaagaacctatt

SEQ ID NO: 264278 - DNA, 25 bp, Homo sapien
acatcggaccaagaacctattaata

SEQ ID NO: 264279 - DNA, 25 bp, Homo sapien
ggaccaagaacctattaatatatgt

SEQ ID NO: 264280 - DNA, 25 bp, Homo sapien
gttgaaagagttcagatggaaatct

SEQ ID NO: 264281 - DNA, 25 bp, Homo sapien
ggaaatctgcgaggatttcctgctg

SEQ ID NO: 264282 - DNA, 25 bp, Homo sapien
ggatttcctgctgggaactacatta

SEQ ID NO: 264283 - DNA, 25 bp, Homo sapien
gttctttaatatctctaactctcag

SEQ ID NO: 264284 - DNA, 25 bp, Homo sapien
gagaatggctgttttcatgttcctt

SEQ ID NO: 264285 - DNA, 25 bp, Homo sapien
aatatctctaactctcagttctaat

SEQ ID NO: 264286 - DNA, 25 bp, Homo sapien
ggctgttttcatgttccttgagaac

SEQ ID NO: 264287 - DNA, 25 bp, Homo sapien
gcacatttatgtacttggcattctt

SEQ ID NO: 264288 - DNA, 25 bp, Homo sapien
tggcattcttctttgcgcttaagca

SEQ ID NO: 264289 - DNA, 25 bp, Homo sapien
ttctttgcgcttaagcattcagaaa

SEQ ID NO: 264290 - DNA, 25 bp, Homo sapien
atgttccttgagaaccgtcgtcttt

SEQ ID NO: 264291 - DNA, 25 bp, Homo sapien
tgagaaccgtcgtcttttaataaga

SEQ ID NO: 264292 - DNA, 25 bp, Homo sapien
taagacagcatcgattctggagtca

SEQ ID NO: 264293 - DNA, 25 bp, Homo sapien
agattgggtctcaactctgacaccg

SEQ ID NO: 264294 - DNA, 25 bp, Homo sapien
attaagactcctttgccttgctata

SEQ ID NO: 264295 - DNA, 25 bp, Homo sapien
agactcctttgccttgctatagcag

SEQ ID NO: 264296 - DNA, 25 bp, Homo sapien
acattctgtgctgctgaggcaattt

SEQ ID NO: 264297 - DNA, 25 bp, Homo sapien
gtgctgctgaggcaatttctgctat

SEQ ID NO: 264298 - DNA, 25 bp, Homo sapien
tgaggcaatttctgctattcgttcc

SEQ ID NO: 264299 - DNA, 25 bp, Homo sapien
ttctgctattcgttcctctgaactt

SEQ ID NO: 264300 - DNA, 25 bp, Homo sapien
tctgaacttccttgggtttgtttag

SEQ ID NO: 264301 - DNA, 25 bp, Homo sapien
gagagtaaaagtgctactgcttcta

SEQ ID NO: 264302 - DNA, 25 bp, Homo sapien
agtgctactgcttctataatttgga

SEQ ID NO: 264303 - DNA, 25 bp, Homo sapien
tgcttctataatttggacttcccta

SEQ ID NO: 264304 - DNA, 25 bp, Homo sapien
aaactactcaaaactatattctgct

SEQ ID NO: 264305 - DNA, 25 bp, Homo sapien
accatgctagccttgtattcagtca

SEQ ID NO: 264306 - DNA, 25 bp, Homo sapien
tgctagccttgtattcagtcattag

SEQ ID NO: 264307 - DNA, 25 bp, Homo sapien
cttgtattcagtcattagggttcga

SEQ ID NO: 264308 - DNA, 25 bp, Homo sapien
attcagtcattagggttcgaggtgg

SEQ ID NO: 264309 - DNA, 25 bp, Homo sapien
tttgtggagcccattttctcctttg

SEQ ID NO: 264310 - DNA, 25 bp, Homo sapien
gcccattttctcctttgatggttac

SEQ ID NO: 264311 - DNA, 25 bp, Homo sapien
tttctcctttgatggttaccaggcc

SEQ ID NO: 264312 - DNA, 25 bp, Homo sapien
tcctaccctttgtgctgtgcctgca

SEQ ID NO: 264313 - DNA, 25 bp, Homo sapien
ccgtgcccaagaataccaagcaact

SEQ ID NO: 264314 - DNA, 25 bp, Homo sapien
gaataccaagcaactggctctggcc

SEQ ID NO: 264315 - DNA, 25 bp, Homo sapien
gactttagatgcggctttgggagaa

SEQ ID NO: 264316 - DNA, 25 bp, Homo sapien
atattccttagatttaggacagtgg

SEQ ID NO: 264317 - DNA, 25 bp, Homo sapien
tattccttagatttaggacagtggc

SEQ ID NO: 264318 - DNA, 25 bp, Homo sapien
attccttagatttaggacagtggcc

SEQ ID NO: 264319 - DNA, 25 bp, Homo sapien
ttccttagatttaggacagtggcct

SEQ ID NO: 264320 - DNA, 25 bp, Homo sapien
tccttagatttaggacagtggcctt

SEQ ID NO: 264321 - DNA, 25 bp, Homo sapien
ccttagatttaggacagtggcctta

SEQ ID NO: 264322 - DNA, 25 bp, Homo sapien
cttagatttaggacagtggccttaa

SEQ ID NO: 264323 - DNA, 25 bp, Homo sapien
ttagatttaggacagtggccttaaa

SEQ ID NO: 264324 - DNA, 25 bp, Homo sapien
tagatttaggacagtggccttaaaa

SEQ ID NO: 264325 - DNA, 25 bp, Homo sapien
atagtgacacttgggaacctccacg

SEQ ID NO: 264326 - DNA, 25 bp, Homo sapien
gggaacctccacgacatgtgaaacg

SEQ ID NO: 264327 - DNA, 25 bp, Homo sapien
tgtgaaacggaagctgtctaaatca

SEQ ID NO: 264328 - DNA, 25 bp, Homo sapien
gaagctgtctaaatcagatgactga

SEQ ID NO: 264329 - DNA, 25 bp, Homo sapien
gatgactgaaatctgcctaaaacgt

SEQ ID NO: 264330 - DNA, 25 bp, Homo sapien
aattcttcaactcaagatgtctgat

SEQ ID NO: 264331 - DNA, 25 bp, Homo sapien
gtctgatttactgtgaatttgccca

SEQ ID NO: 264332 - DNA, 25 bp, Homo sapien
ggcatacacactcaaaaagcaggat

SEQ ID NO: 264333 - DNA, 25 bp, Homo sapien
aagcaggatccaatacccaaaagaa

SEQ ID NO: 264334 - DNA, 25 bp, Homo sapien
atgttgtgccaaagttaaactactg

SEQ ID NO: 264335 - DNA, 25 bp, Homo sapien
taaactactgcagttggtggaagtt

SEQ ID NO: 264336 - DNA, 25 bp, Homo sapien
atatcaagcattgtatacagcatat

SEQ ID NO: 264337 - DNA, 25 bp, Homo sapien
gtacaagtcgtattagtatacccac

SEQ ID NO: 264338 - DNA, 25 bp, Homo sapien
gtcgtattagtatacccactagtag

SEQ ID NO: 264339 - DNA, 25 bp, Homo sapien
cccactagtagtatataatctcttg

SEQ ID NO: 264340 - DNA, 25 bp, Homo sapien
ataatctcttggagctagaatagct

SEQ ID NO: 264341 - DNA, 25 bp, Homo sapien
gctagaatagctctaaaatgtcatt

SEQ ID NO: 264342 - DNA, 25 bp, Homo sapien
aaatgtcattttgcccaaaacgcac

SEQ ID NO: 264343 - DNA, 25 bp, Homo sapien
cattttgcccaaaacgcacatcaac

SEQ ID NO: 264344 - DNA, 25 bp, Homo sapien
aacgcacatcaacaaattccttcta

SEQ ID NO: 264345 - DNA, 25 bp, Homo sapien
attccttctatagattttaagcagg

SEQ ID NO: 264346 - DNA, 25 bp, Homo sapien
caacaattaggtatccacatgggtg

SEQ ID NO: 264347 - DNA, 25 bp, Homo sapien
ttattttaggagaactgactggtaa

SEQ ID NO: 264348 - DNA, 25 bp, Homo sapien
gaccaaattttgtgtaaacgattag

SEQ ID NO: 264349 - DNA, 25 bp, Homo sapien
gaaagatgaacaaagtattgccctt

SEQ ID NO: 264350 - DNA, 25 bp, Homo sapien
tattgccctttgactggttttcttc

SEQ ID NO: 264351 - DNA, 25 bp, Homo sapien
agatacattctcttgcagctcttca

SEQ ID NO: 264352 - DNA, 25 bp, Homo sapien
tcttcattcattggtgacaagcccc

SEQ ID NO: 264353 - DNA, 25 bp, Homo sapien
caccccgggactttactaatgagct

SEQ ID NO: 264354 - DNA, 25 bp, Homo sapien
caatgagaaatcgacctgaggagca

SEQ ID NO: 264355 - DNA, 25 bp, Homo sapien
aacaaaggcatcagctcttacacca

SEQ ID NO: 264356 - DNA, 25 bp, Homo sapien
aaggcatcagctcttacaccaaaag

SEQ ID NO: 264357 - DNA, 25 bp, Homo sapien
ttaacgctgtaaccaaaggtatagt

SEQ ID NO: 264358 - DNA, 25 bp, Homo sapien
ttcccttctcagtctttgggtaact

SEQ ID NO: 264359 - DNA, 25 bp, Homo sapien
tcccttctcagtctttgggtaacta

SEQ ID NO: 264360 - DNA, 25 bp, Homo sapien
ccttctcagtctttgggtaactaag

SEQ ID NO: 264361 - DNA, 25 bp, Homo sapien
cttctcagtctttgggtaactaagt

SEQ ID NO: 264362 - DNA, 25 bp, Homo sapien
ttctcagtctttgggtaactaagtg

SEQ ID NO: 264363 - DNA, 25 bp, Homo sapien
ctcagtctttgggtaactaagtgtg

SEQ ID NO: 264364 - DNA, 25 bp, Homo sapien
tcagtctttgggtaactaagtgtgg

SEQ ID NO: 264365 - DNA, 25 bp, Homo sapien
cagtctttgggtaactaagtgtggt

SEQ ID NO: 264366 - DNA, 25 bp, Homo sapien
tgggtaactaagtgtggttttattg

SEQ ID NO: 264367 - DNA, 25 bp, Homo sapien
tgtggttttattgacgatgaaatac

SEQ ID NO: 264368 - DNA, 25 bp, Homo sapien
ggttttattgacgatgaaatacaag

SEQ ID NO: 264369 - DNA, 25 bp, Homo sapien
tattccccgccaccatggatgacgt

SEQ ID NO: 264370 - DNA, 25 bp, Homo sapien
cagggtcccgtttcactgcagtgaa

SEQ ID NO: 264371 - DNA, 25 bp, Homo sapien
agggtcccgtttcactgcagtgaat

SEQ ID NO: 264372 - DNA, 25 bp, Homo sapien
gggtcccgtttcactgcagtgaatg

SEQ ID NO: 264373 - DNA, 25 bp, Homo sapien
ggtcccgtttcactgcagtgaatgt

SEQ ID NO: 264374 - DNA, 25 bp, Homo sapien
gtcccgtttcactgcagtgaatgtg

SEQ ID NO: 264375 - DNA, 25 bp, Homo sapien
tgtggcaagagcttccgctaccgct

SEQ ID NO: 264376 - DNA, 25 bp, Homo sapien
agagcttccgctaccgctcagacct

SEQ ID NO: 264377 - DNA, 25 bp, Homo sapien
ggcacacagcgctcaagccccacgc

SEQ ID NO: 264378 - DNA, 25 bp, Homo sapien
aagcacagcttcaacctagccaacc

SEQ ID NO: 264379 - DNA, 25 bp, Homo sapien
ttcaacctagccaaccacctgcgct

SEQ ID NO: 264380 - DNA, 25 bp, Homo sapien
ccaggacgatgccacacaagagagt

SEQ ID NO: 264381 - DNA, 25 bp, Homo sapien
acgatgccacacaagagagtcttca

SEQ ID NO: 264382 - DNA, 25 bp, Homo sapien
gccacacaagagagtcttcagagac

SEQ ID NO: 264383 - DNA, 25 bp, Homo sapien
actggaaatgcttgccagggaggaa

SEQ ID NO: 264384 - DNA, 25 bp, Homo sapien
cctccatcctcaggagcacagaagg

SEQ ID NO: 264385 - DNA, 25 bp, Homo sapien
agaagggtgaagctgagcccacata

SEQ ID NO: 264386 - DNA, 25 bp, Homo sapien
gggtgaagctgagcccacatagaga

SEQ ID NO: 264387 - DNA, 25 bp, Homo sapien
tagagaagcatctcatgctgtctgc

SEQ ID NO: 264388 - DNA, 25 bp, Homo sapien
ggcaggagatgctcaaaggtcaaca

SEQ ID NO: 264389 - DNA, 25 bp, Homo sapien
ggagatgctcaaaggtcaacatgac

SEQ ID NO: 264390 - DNA, 25 bp, Homo sapien
aaggagcgccccaggacgatgccac

SEQ ID NO: 264391 - DNA, 25 bp, Homo sapien
tgcaatatattgtttcgttcatgga

SEQ ID NO: 264392 - DNA, 25 bp, Homo sapien
atattgtttcgttcatggaacaaat

SEQ ID NO: 264393 - DNA, 25 bp, Homo sapien
ataggctgaattcaaacatgcaatt

SEQ ID NO: 264394 - DNA, 25 bp, Homo sapien
atgggaagagcttctaagggcatct

SEQ ID NO: 264395 - DNA, 25 bp, Homo sapien
gcttctaagggcatcttaacaggat

SEQ ID NO: 264396 - DNA, 25 bp, Homo sapien
atcttaacaggatgctacatgaaaa

SEQ ID NO: 264397 - DNA, 25 bp, Homo sapien
aatacatatcacttttagtttagat

SEQ ID NO: 264398 - DNA, 25 bp, Homo sapien
agtatgtccagtgtgttcggtttgt

SEQ ID NO: 264399 - DNA, 25 bp, Homo sapien
gtccagtgtgttcggtttgttacat

SEQ ID NO: 264400 - DNA, 25 bp, Homo sapien
gtgttcggtttgttacatattccat

SEQ ID NO: 264401 - DNA, 25 bp, Homo sapien
catattccatgaaatatctgagtgt

SEQ ID NO: 264402 - DNA, 25 bp, Homo sapien
tagccaaacggctgtgctcagatgg

SEQ ID NO: 264403 - DNA, 25 bp, Homo sapien
tgagctgaggttggtctcttgccaa

SEQ ID NO: 264404 - DNA, 25 bp, Homo sapien
tcttgccaaaccgtggctgttgtgt

SEQ ID NO: 264405 - DNA, 25 bp, Homo sapien
tgttgttcttcatgtcttcgagttc

SEQ ID NO: 264406 - DNA, 25 bp, Homo sapien
ttcattctgcctattctggcatcag

SEQ ID NO: 264407 - DNA, 25 bp, Homo sapien
atcagctcacttgaggagtccctca

SEQ ID NO: 264408 - DNA, 25 bp, Homo sapien
agtccctcagccttcttgtatttaa

SEQ ID NO: 264409 - DNA, 25 bp, Homo sapien
catcgtcttagactttgtggctcta

SEQ ID NO: 264410 - DNA, 25 bp, Homo sapien
tgtggctctaaagtacctgtctgtt

SEQ ID NO: 264411 - DNA, 25 bp, Homo sapien
gagatttcaagtctcttgtcaccat

SEQ ID NO: 264412 - DNA, 25 bp, Homo sapien
gcataagtggcctttttgaaccaag

SEQ ID NO: 264413 - DNA, 25 bp, Homo sapien
cccgccaccatggatgacgtccccg

SEQ ID NO: 264414 - DNA, 25 bp, Homo sapien
ccagggtcccgtttcactgcagtga

SEQ ID NO: 264415 - DNA, 25 bp, Homo sapien
cagggtcccgtttcactgcagtgaa

SEQ ID NO: 264416 - DNA, 25 bp, Homo sapien
agggtcccgtttcactgcagtgaat

SEQ ID NO: 264417 - DNA, 25 bp, Homo sapien
gggtcccgtttcactgcagtgaatg

SEQ ID NO: 264418 - DNA, 25 bp, Homo sapien
ggtcccgtttcactgcagtgaatgt

SEQ ID NO: 264419 - DNA, 25 bp, Homo sapien
gtcccgtttcactgcagtgaatgtg

SEQ ID NO: 264420 - DNA, 25 bp, Homo sapien
aagagcttccgctaccgctcagacc

SEQ ID NO: 264421 - DNA, 25 bp, Homo sapien
ggcacacagcgctcaagccccacgc

SEQ ID NO: 264422 - DNA, 25 bp, Homo sapien
aagcacagcttcaacctagccaacc

SEQ ID NO: 264423 - DNA, 25 bp, Homo sapien
ttcaacctagccaaccacctgcgct

SEQ ID NO: 264424 - DNA, 25 bp, Homo sapien
aactgacagagacgcagtgccagat

SEQ ID NO: 264425 - DNA, 25 bp, Homo sapien
agtcaggaagtatccacgccactcc

SEQ ID NO: 264426 - DNA, 25 bp, Homo sapien
agtgccagatacaccccgagaaagt

SEQ ID NO: 264427 - DNA, 25 bp, Homo sapien
gaaagtgccagagactcagctccag

SEQ ID NO: 264428 - DNA, 25 bp, Homo sapien
ctcagctccagacagtgcagacata

SEQ ID NO: 264429 - DNA, 25 bp, Homo sapien
gacaaatgtgggtatcagcctgaag

SEQ ID NO: 264430 - DNA, 25 bp, Homo sapien
ttcctgtgggagagggctcctgcct

SEQ ID NO: 264431 - DNA, 25 bp, Homo sapien
tccaaacactgccagagacactgtc

SEQ ID NO: 264432 - DNA, 25 bp, Homo sapien
acacagtcagacacactgccagaga

SEQ ID NO: 264433 - DNA, 25 bp, Homo sapien
cacactgccagagacaccgttataa

SEQ ID NO: 264434 - DNA, 25 bp, Homo sapien
gacaccgttataaagactgccagag

SEQ ID NO: 264435 - DNA, 25 bp, Homo sapien
agtctggcagttgggagggcagtgt

SEQ ID NO: 264436 - DNA, 25 bp, Homo sapien
ggcagtgtgaagacgggcacggtgc

SEQ ID NO: 264437 - DNA, 25 bp, Homo sapien
gtgaagacgggcacggtgcggaaaa

SEQ ID NO: 264438 - DNA, 25 bp, Homo sapien
tacggcgtccgggtggagcagcctg

SEQ ID NO: 264439 - DNA, 25 bp, Homo sapien
gccctgcaagaagtcgggcagcacg

SEQ ID NO: 264440 - DNA, 25 bp, Homo sapien
aagaagtcgggcagcacgcagctga

SEQ ID NO: 264441 - DNA, 25 bp, Homo sapien
ggcagcacgcagctgagcgaggcgc

SEQ ID NO: 264442 - DNA, 25 bp, Homo sapien
agcgaggcgcggaaggcgtcgtgcg

SEQ ID NO: 264443 - DNA, 25 bp, Homo sapien
ggaaggcgtcgtgcgggccgtgcgc

SEQ ID NO: 264444 - DNA, 25 bp, Homo sapien
ctctctcttggagccgcccggaacg

SEQ ID NO: 264445 - DNA, 25 bp, Homo sapien
agggcccccaggaagtctggcagtt

SEQ ID NO: 264446 - DNA, 25 bp, Homo sapien
aaagctggtgtgtccaaggaagaaa

SEQ ID NO: 264447 - DNA, 25 bp, Homo sapien
aaaacaggctgtgactacaaaccta

SEQ ID NO: 264448 - DNA, 25 bp, Homo sapien
ggctgtgactacaaacctaaaagta

SEQ ID NO: 264449 - DNA, 25 bp, Homo sapien
gtaaaggcaaacaactgccagacag

SEQ ID NO: 264450 - DNA, 25 bp, Homo sapien
ggaatacaggccttgattagtgaat

SEQ ID NO: 264451 - DNA, 25 bp, Homo sapien
tggtaaatattgcatgcctcctggg

SEQ ID NO: 264452 - DNA, 25 bp, Homo sapien
gaagtcactgagacagacaaaagct

SEQ ID NO: 264453 - DNA, 25 bp, Homo sapien
gtgaatttcaagctcagttctcggg

SEQ ID NO: 264454 - DNA, 25 bp, Homo sapien
gaaggacaaggttaattctactgta

SEQ ID NO: 264455 - DNA, 25 bp, Homo sapien
actgtaaataatcctaccattcaga

SEQ ID NO: 264456 - DNA, 25 bp, Homo sapien
ccattcagaaaagctggtgtgtcca

SEQ ID NO: 264457 - DNA, 25 bp, Homo sapien
aatgggcttttctactaaaagcata

SEQ ID NO: 264458 - DNA, 25 bp, Homo sapien
actgaggctgatttagtcagggcaa

SEQ ID NO: 264459 - DNA, 25 bp, Homo sapien
tagtcagggcaaaaccatttacttt

SEQ ID NO: 264460 - DNA, 25 bp, Homo sapien
catttactttacatattcgttttca

SEQ ID NO: 264461 - DNA, 25 bp, Homo sapien
tattcgttttcaatacttgctgttc

SEQ ID NO: 264462 - DNA, 25 bp, Homo sapien
aatacttgctgttcatgttacacaa

SEQ ID NO: 264463 - DNA, 25 bp, Homo sapien
gttcatgttacacaagcttcttacg

SEQ ID NO: 264464 - DNA, 25 bp, Homo sapien
tacacaagcttcttacggttttctt

SEQ ID NO: 264465 - DNA, 25 bp, Homo sapien
atgggtacattttaacaaactcagt

SEQ ID NO: 264466 - DNA, 25 bp, Homo sapien
aactcagtagtacaacctaaacttg

SEQ ID NO: 264467 - DNA, 25 bp, Homo sapien
gtatagccatttatatcctatgtat

SEQ ID NO: 264468 - DNA, 25 bp, Homo sapien
tttgtgaagtgtacctgttcttgtc

SEQ ID NO: 264469 - DNA, 25 bp, Homo sapien
tgttcttgtctcttttttcagtcat

SEQ ID NO: 264470 - DNA, 25 bp, Homo sapien
tttcagtcattttctgcacgcatcc

SEQ ID NO: 264471 - DNA, 25 bp, Homo sapien
agatgactgtagcttttcgtgctcc

SEQ ID NO: 264472 - DNA, 25 bp, Homo sapien
ttcgtgctccactgcgaggtttgtg

SEQ ID NO: 264473 - DNA, 25 bp, Homo sapien
aggtttgtgctcagagccgctgcac

SEQ ID NO: 264474 - DNA, 25 bp, Homo sapien
ggagtgcaggacgagctactgcttt

SEQ ID NO: 264475 - DNA, 25 bp, Homo sapien
tactgctttggagcgagggtttcct

SEQ ID NO: 264476 - DNA, 25 bp, Homo sapien
gtttcctgcttttgagttgacctga

SEQ ID NO: 264477 - DNA, 25 bp, Homo sapien
tttgagttgacctgacttccttctt

SEQ ID NO: 264478 - DNA, 25 bp, Homo sapien
gacttccttcttgaaatgactgtta

SEQ ID NO: 264479 - DNA, 25 bp, Homo sapien
ttttgcctggctgcagggttcggct

SEQ ID NO: 264480 - DNA, 25 bp, Homo sapien
gtgtgtccacaccgcagtgcctctg

SEQ ID NO: 264481 - DNA, 25 bp, Homo sapien
gcccctcgggggactggacacacat

SEQ ID NO: 264482 - DNA, 25 bp, Homo sapien
tgccagaggcgctacgaagctttgc

SEQ ID NO: 264483 - DNA, 25 bp, Homo sapien
agaggcgctacgaagctttgcccag

SEQ ID NO: 264484 - DNA, 25 bp, Homo sapien
gcgctacgaagctttgcccagatga

SEQ ID NO: 264485 - DNA, 25 bp, Homo sapien
gctacgaagctttgcccagatgaag

SEQ ID NO: 264486 - DNA, 25 bp, Homo sapien
cgaagctttgcccagatgaagccag

SEQ ID NO: 264487 - DNA, 25 bp, Homo sapien
gtttgccttcttacggatttagacg

SEQ ID NO: 264488 - DNA, 25 bp, Homo sapien
gccttcttacggatttagacgaggt

SEQ ID NO: 264489 - DNA, 25 bp, Homo sapien
cttacggatttagacgaggttcgag

SEQ ID NO: 264490 - DNA, 25 bp, Homo sapien
ggaggatctacttagcaaacttttt

SEQ ID NO: 264491 - DNA, 25 bp, Homo sapien
ctctctttctatggtcggagtctag

SEQ ID NO: 264492 - DNA, 25 bp, Homo sapien
atggtcggagtctagttaacaaatt

SEQ ID NO: 264493 - DNA, 25 bp, Homo sapien
gatctgatataacttgcatgctttc

SEQ ID NO: 264494 - DNA, 25 bp, Homo sapien
acttgcatgctttctgaacaggcca

SEQ ID NO: 264495 - DNA, 25 bp, Homo sapien
ttctgaacaggccattgtatccatt

SEQ ID NO: 264496 - DNA, 25 bp, Homo sapien
gttgccctaaaatgtgttgctgcac

SEQ ID NO: 264497 - DNA, 25 bp, Homo sapien
gttgctgcactggaaagaaagaact

SEQ ID NO: 264498 - DNA, 25 bp, Homo sapien
aactagcttgagttggcttgatgga

SEQ ID NO: 264499 - DNA, 25 bp, Homo sapien
gaacaattatcctcttactttcatt

SEQ ID NO: 264500 - DNA, 25 bp, Homo sapien
ttacaatcctcttactttattccag

SEQ ID NO: 264501 - DNA, 25 bp, Homo sapien
ccctgaagtttgataatagctctct

SEQ ID NO: 264502 - DNA, 25 bp, Homo sapien
agctctcttggatttttgtggttac

SEQ ID NO: 264503 - DNA, 25 bp, Homo sapien
tttgtggttacctcatggcaatctc

SEQ ID NO: 264504 - DNA, 25 bp, Homo sapien
gttacctcatggcaatctcactaag

SEQ ID NO: 264505 - DNA, 25 bp, Homo sapien
gagcaagctcttggcacatgaagga

SEQ ID NO: 264506 - DNA, 25 bp, Homo sapien
aagattcatttcttttcccgcttgg

SEQ ID NO: 264507 - DNA, 25 bp, Homo sapien
gcttggccttttggttctctaataa

SEQ ID NO: 264508 - DNA, 25 bp, Homo sapien
ggttctctaataagctgtgagctga

SEQ ID NO: 264509 - DNA, 25 bp, Homo sapien
gagctgaggtccatgcagggaaaac

SEQ ID NO: 264510 - DNA, 25 bp, Homo sapien
ggagctctaatgagaaatacgcaat

SEQ ID NO: 264511 - DNA, 25 bp, Homo sapien
aacagctatttaggcggcttagacc

SEQ ID NO: 264512 - DNA, 25 bp, Homo sapien
gtagtagaggtcctgccggtcctgg

SEQ ID NO: 264513 - DNA, 25 bp, Homo sapien
ggcacttgcggctccgggccatctg

SEQ ID NO: 264514 - DNA, 25 bp, Homo sapien
gcgccacgacctggcacttgtggga

SEQ ID NO: 264515 - DNA, 25 bp, Homo sapien
acttgtgggagatggtctgcacgtc

SEQ ID NO: 264516 - DNA, 25 bp, Homo sapien
gagatggtctgcacgtcgttctcat

SEQ ID NO: 264517 - DNA, 25 bp, Homo sapien
gtcgttctcatcctcgtggcaggac

SEQ ID NO: 264518 - DNA, 25 bp, Homo sapien
atcctcgtggcaggactggtacagc

SEQ ID NO: 264519 - DNA, 25 bp, Homo sapien
ggcaggactggtacagcgcattctt

SEQ ID NO: 264520 - DNA, 25 bp, Homo sapien
ggtacagcgcattcttgccgtcgca

SEQ ID NO: 264521 - DNA, 25 bp, Homo sapien
gctcagcataggatgggcacgccat

SEQ ID NO: 264522 - DNA, 25 bp, Homo sapien
ataggatgggcacgccatcagccgt

SEQ ID NO: 264523 - DNA, 25 bp, Homo sapien
atagctgtgtagacattttaattca

SEQ ID NO: 264524 - DNA, 25 bp, Homo sapien
gtagacattttaattcagtttccaa

SEQ ID NO: 264525 - DNA, 25 bp, Homo sapien
gacattttaattcagtttccaaagc

SEQ ID NO: 264526 - DNA, 25 bp, Homo sapien
tttaattcagtttccaaagctctca

SEQ ID NO: 264527 - DNA, 25 bp, Homo sapien
taattcagtttccaaagctctcaaa

SEQ ID NO: 264528 - DNA, 25 bp, Homo sapien
aattcagtttccaaagctctcaaaa

SEQ ID NO: 264529 - DNA, 25 bp, Homo sapien
ttcagtttccaaagctctcaaaaaa

SEQ ID NO: 264530 - DNA, 25 bp, Homo sapien
gtatttttgaagtacggagtgatgc

SEQ ID NO: 264531 - DNA, 25 bp, Homo sapien
agctttgaaagaagaccatttttca

SEQ ID NO: 264532 - DNA, 25 bp, Homo sapien
tttgaagtacggagtgatgcggttt

SEQ ID NO: 264533 - DNA, 25 bp, Homo sapien
cgtggcttacagttccaacgactca

SEQ ID NO: 264534 - DNA, 25 bp, Homo sapien
gagaaatcatctcttacttgcctga

SEQ ID NO: 264535 - DNA, 25 bp, Homo sapien
tctcttacttgcctgagggagttct

SEQ ID NO: 264536 - DNA, 25 bp, Homo sapien
gagttctggcagacgttttgaatgt

SEQ ID NO: 264537 - DNA, 25 bp, Homo sapien
ggatgtggaagttctttcctcgtct

SEQ ID NO: 264538 - DNA, 25 bp, Homo sapien
gtctccatcctgtcaagagccgtgg

SEQ ID NO: 264539 - DNA, 25 bp, Homo sapien
tcaagagccgtggagcaaacagcag

SEQ ID NO: 264540 - DNA, 25 bp, Homo sapien
aaactgataacgcacgtcacctcgc

SEQ ID NO: 264541 - DNA, 25 bp, Homo sapien
gtaacttcaattcagcctctttggg

SEQ ID NO: 264542 - DNA, 25 bp, Homo sapien
agcaagttcaatccaatctcttcct

SEQ ID NO: 264543 - DNA, 25 bp, Homo sapien
ttcaatccaatctcttcctgactca

SEQ ID NO: 264544 - DNA, 25 bp, Homo sapien
atcaacatgcaaagctctcgaagag

SEQ ID NO: 264545 - DNA, 25 bp, Homo sapien
aatttgggagtcatcctggatccgt

SEQ ID NO: 264546 - DNA, 25 bp, Homo sapien
cggatatttattgggcgtcctcaac

SEQ ID NO: 264547 - DNA, 25 bp, Homo sapien
tttattgggcgtcctcaacagccag

SEQ ID NO: 264548 - DNA, 25 bp, Homo sapien
ttctggattcatctttccctgcaat

SEQ ID NO: 264549 - DNA, 25 bp, Homo sapien
agggcgatcaccagtgacctgtggt

SEQ ID NO: 264550 - DNA, 25 bp, Homo sapien
acctgtggtgtggagtctcctttta

SEQ ID NO: 264551 - DNA, 25 bp, Homo sapien
gtggagtctccttttacctatgtct

SEQ ID NO: 264552 - DNA, 25 bp, Homo sapien
ttcatctttccctgcaatccagctt

SEQ ID NO: 264553 - DNA, 25 bp, Homo sapien
catactggagactgggatcatcatc

SEQ ID NO: 264554 - DNA, 25 bp, Homo sapien
gggatcatcatccaggcttttgcac

SEQ ID NO: 264555 - DNA, 25 bp, Homo sapien
catccaggcttttgcactgggccag

SEQ ID NO: 264556 - DNA, 25 bp, Homo sapien
catttcttcattacagttgtcattg

SEQ ID NO: 264557 - DNA, 25 bp, Homo sapien
actgtggaatgatgccagcctggct

SEQ ID NO: 264558 - DNA, 25 bp, Homo sapien
tggctttcttcttgtttacccatca

SEQ ID NO: 264559 - DNA, 25 bp, Homo sapien
ataagattttccagcaccagtctgc

SEQ ID NO: 264560 - DNA, 25 bp, Homo sapien
caccagtctgcccataggcaaaaat

SEQ ID NO: 264561 - DNA, 25 bp, Homo sapien
acattatatccctcaaaggcgtgta

SEQ ID NO: 264562 - DNA, 25 bp, Homo sapien
gtaagagcatttccttgccaatgtc

SEQ ID NO: 264563 - DNA, 25 bp, Homo sapien
gccaatgtcattgtacacacggttt

SEQ ID NO: 264564 - DNA, 25 bp, Homo sapien
tgtacacacggttttgagatgcaaa

SEQ ID NO: 264565 - DNA, 25 bp, Homo sapien
aaacagggatcttcgggtgaggtat

SEQ ID NO: 264566 - DNA, 25 bp, Homo sapien
tggagcttcctttggattctttggg

SEQ ID NO: 264567 - DNA, 25 bp, Homo sapien
atttaacaggtgcaaggagatttcc

SEQ ID NO: 264568 - DNA, 25 bp, Homo sapien
gttttttcttcctataaggaagctg

SEQ ID NO: 264569 - DNA, 25 bp, Homo sapien
agttaatcaaagtctcttggcctag

SEQ ID NO: 264570 - DNA, 25 bp, Homo sapien
aagtctcttggcctagggtgacaca

SEQ ID NO: 264571 - DNA, 25 bp, Homo sapien
tcttggcctagggtgacacagctaa

SEQ ID NO: 264572 - DNA, 25 bp, Homo sapien
gacacagctaagatttgtacctaga

SEQ ID NO: 264573 - DNA, 25 bp, Homo sapien
gatttgtacctagagatttctgagt

SEQ ID NO: 264574 - DNA, 25 bp, Homo sapien
agatttctgagtgttgacttctctc

SEQ ID NO: 264575 - DNA, 25 bp, Homo sapien
actgtgtgcagcatattgcaggctt

SEQ ID NO: 264576 - DNA, 25 bp, Homo sapien
gcagcatattgcaggctttcactca

SEQ ID NO: 264577 - DNA, 25 bp, Homo sapien
tattgcaggctttcactcatttaat

SEQ ID NO: 264578 - DNA, 25 bp, Homo sapien
aaaagcaaaagatcccttggtactg

SEQ ID NO: 264579 - DNA, 25 bp, Homo sapien
gatcccttggtactgcaaaactcaa

SEQ ID NO: 264580 - DNA, 25 bp, Homo sapien
ggtactgcaaaactcaatcgctttc

SEQ ID NO: 264581 - DNA, 25 bp, Homo sapien
gcaaaactcaatcgctttcacaata

SEQ ID NO: 264582 - DNA, 25 bp, Homo sapien
actcaatcgctttcacaataaatag

SEQ ID NO: 264583 - DNA, 25 bp, Homo sapien
aatagataaactgctttgtgggaag

SEQ ID NO: 264584 - DNA, 25 bp, Homo sapien
atttactaatacatggaagaacttc

SEQ ID NO: 264585 - DNA, 25 bp, Homo sapien
gtatttaggcataatgtgtgttcta

SEQ ID NO: 264586 - DNA, 25 bp, Homo sapien
attgttgacaactttgtggctacac

SEQ ID NO: 264587 - DNA, 25 bp, Homo sapien
aactttgtggctacacttttgtctt

SEQ ID NO: 264588 - DNA, 25 bp, Homo sapien
tggctacacttttgtcttttcttct

SEQ ID NO: 264589 - DNA, 25 bp, Homo sapien
aagctcccgactagacatacatgga

SEQ ID NO: 264590 - DNA, 25 bp, Homo sapien
ccgactagacatacatggagcagta

SEQ ID NO: 264591 - DNA, 25 bp, Homo sapien
aaagatgcagatgttctctgaggct

SEQ ID NO: 264592 - DNA, 25 bp, Homo sapien
gatgcagatgttctctgaggctgaa

SEQ ID NO: 264593 - DNA, 25 bp, Homo sapien
gcagatgttctctgaggctgaataa

SEQ ID NO: 264594 - DNA, 25 bp, Homo sapien
gatgttctctgaggctgaataagac

SEQ ID NO: 264595 - DNA, 25 bp, Homo sapien
ttgtttcaactgttacacagagatg

SEQ ID NO: 264596 - DNA, 25 bp, Homo sapien
tgttacacagagatgaccagaggat

SEQ ID NO: 264597 - DNA, 25 bp, Homo sapien
ttacacagagatgaccagaggatgg

SEQ ID NO: 264598 - DNA, 25 bp, Homo sapien
gcagtgcagttcaagaggctctggt

SEQ ID NO: 264599 - DNA, 25 bp, Homo sapien
tgcagttcaagaggctctggttcgg

SEQ ID NO: 264600 - DNA, 25 bp, Homo sapien
cggaccttctggctgtagcggaaca

SEQ ID NO: 264601 - DNA, 25 bp, Homo sapien
gaccttctggctgtagcggaacatc

SEQ ID NO: 264602 - DNA, 25 bp, Homo sapien
ccttctggctgtagcggaacatcag

SEQ ID NO: 264603 - DNA, 25 bp, Homo sapien
tggctgtagcggaacatcaggccct

SEQ ID NO: 264604 - DNA, 25 bp, Homo sapien
gctgtagcggaacatcaggccctag

SEQ ID NO: 264605 - DNA, 25 bp, Homo sapien
tgtagcggaacatcaggccctagtc

SEQ ID NO: 264606 - DNA, 25 bp, Homo sapien
gtagcggaacatcaggccctagtct

SEQ ID NO: 264607 - DNA, 25 bp, Homo sapien
agcggaacatcaggccctagtcttt

SEQ ID NO: 264608 - DNA, 25 bp, Homo sapien
gaacatcaggccctagtctttggcg

SEQ ID NO: 264609 - DNA, 25 bp, Homo sapien
aacatcaggccctagtctttggcgg

SEQ ID NO: 264610 - DNA, 25 bp, Homo sapien
atcaggccctagtctttggcggcgg

SEQ ID NO: 264611 - DNA, 25 bp, Homo sapien
tttttgagatgttacctaccagtaa

SEQ ID NO: 264612 - DNA, 25 bp, Homo sapien
gagatgttacctaccagtaatgttg

SEQ ID NO: 264613 - DNA, 25 bp, Homo sapien
gatgttacctaccagtaatgttggt

SEQ ID NO: 264614 - DNA, 25 bp, Homo sapien
acctaccagtaatgttggtactatt

SEQ ID NO: 264615 - DNA, 25 bp, Homo sapien
tggtactattataaggcaatcgtct

SEQ ID NO: 264616 - DNA, 25 bp, Homo sapien
ggcaatcgtcttataaactttttca

SEQ ID NO: 264617 - DNA, 25 bp, Homo sapien
caatcgtcttataaactttttcact

SEQ ID NO: 264618 - DNA, 25 bp, Homo sapien
tttcaacacagtttttacgtaacag

SEQ ID NO: 264619 - DNA, 25 bp, Homo sapien
ttacgtaacagaactgttttcctca

SEQ ID NO: 264620 - DNA, 25 bp, Homo sapien
gaaatcagttgttaatgtgcatgct

SEQ ID NO: 264621 - DNA, 25 bp, Homo sapien
cagttgttaatgtgcatgctagtgt

SEQ ID NO: 264622 - DNA, 25 bp, Homo sapien
tagtacctgaccacctgtttcaaaa

SEQ ID NO: 264623 - DNA, 25 bp, Homo sapien
ttcaaaacgcaggtgtttctggttt

SEQ ID NO: 264624 - DNA, 25 bp, Homo sapien
gcggaatgtgttttcgtgtcttcta

SEQ ID NO: 264625 - DNA, 25 bp, Homo sapien
cttctaggaagggtctgctgaggac

SEQ ID NO: 264626 - DNA, 25 bp, Homo sapien
tgaggaccagaccacgtaagcctga

SEQ ID NO: 264627 - DNA, 25 bp, Homo sapien
acgtaagcctgagtggatcctgact

SEQ ID NO: 264628 - DNA, 25 bp, Homo sapien
acctgcctcgtgctgatgatctatg

SEQ ID NO: 264629 - DNA, 25 bp, Homo sapien
ctatgcatggcgttatgtagatcac

SEQ ID NO: 264630 - DNA, 25 bp, Homo sapien
gatcacgtgcggcagagacagccac

SEQ ID NO: 264631 - DNA, 25 bp, Homo sapien
taatttggagcacagtcttcccggt

SEQ ID NO: 264632 - DNA, 25 bp, Homo sapien
ttcccggtgcctagacatgccaagg

SEQ ID NO: 264633 - DNA, 25 bp, Homo sapien
gggccttggcaatcatgtcctcgaa

SEQ ID NO: 264634 - DNA, 25 bp, Homo sapien
tgtcctcgaagtcagcaaagcccag

SEQ ID NO: 264635 - DNA, 25 bp, Homo sapien
agcttgccgtcaccgtccaagtcag

SEQ ID NO: 264636 - DNA, 25 bp, Homo sapien
tcctcaatgaccttgtcgcacacaa

SEQ ID NO: 264637 - DNA, 25 bp, Homo sapien
tcctcatccagctctgacttagtga

SEQ ID NO: 264638 - DNA, 25 bp, Homo sapien
tctgacttagtgagccgggccagcg

SEQ ID NO: 264639 - DNA, 25 bp, Homo sapien
caggtcctccttgcagatgaagttg

SEQ ID NO: 264640 - DNA, 25 bp, Homo sapien
gcatagtttgccttgagctctcggg

SEQ ID NO: 264641 - DNA, 25 bp, Homo sapien
gagccgactcgcagagcacggaaaa

SEQ ID NO: 264642 - DNA, 25 bp, Homo sapien
aaacatgtccacaaagtcgttgaaa

SEQ ID NO: 264643 - DNA, 25 bp, Homo sapien
gtcgttgaaagtgaggttcccctca

SEQ ID NO: 264644 - DNA, 25 bp, Homo sapien
tcaaggtaaggtagctttggcagca

SEQ ID NO: 264645 - DNA, 25 bp, Homo sapien
agggctgatactatgaggctgaaac

SEQ ID NO: 264646 - DNA, 25 bp, Homo sapien
gaggctgaaacaatccttgtgatga

SEQ ID NO: 264647 - DNA, 25 bp, Homo sapien
cagtgacatacaaagaccaaggatt

SEQ ID NO: 264648 - DNA, 25 bp, Homo sapien
tagaattttggccttctgcactact

SEQ ID NO: 264649 - DNA, 25 bp, Homo sapien
ctactcttttgctcttacgaacata

SEQ ID NO: 264650 - DNA, 25 bp, Homo sapien
gacatttacctatgtgtgctgcctc

SEQ ID NO: 264651 - DNA, 25 bp, Homo sapien
gtgtgctgcctcattcctggtgaag

SEQ ID NO: 264652 - DNA, 25 bp, Homo sapien
agcaactgctacttgttctctatgc

SEQ ID NO: 264653 - DNA, 25 bp, Homo sapien
ctacttgttctctatgcctctaaaa

SEQ ID NO: 264654 - DNA, 25 bp, Homo sapien
ctatgcctctaaaatgatgctgttt

SEQ ID NO: 264655 - DNA, 25 bp, Homo sapien
tgacctaaaccagcaggaagtcgtc

SEQ ID NO: 264656 - DNA, 25 bp, Homo sapien
ggaagtcgtcctgggctgtaagcac

SEQ ID NO: 264657 - DNA, 25 bp, Homo sapien
tgggctgtaagcaccatcacttgct

SEQ ID NO: 264658 - DNA, 25 bp, Homo sapien
tgtaagcaccatcacttgctttttt

SEQ ID NO: 264659 - DNA, 25 bp, Homo sapien
aagcacttcacaatagaccctcgag

SEQ ID NO: 264660 - DNA, 25 bp, Homo sapien
acttcacaatagaccctcgagggct

SEQ ID NO: 264661 - DNA, 25 bp, Homo sapien
accctcgagggcttgtgtccatttg

SEQ ID NO: 264662 - DNA, 25 bp, Homo sapien
gcttgtgtccatttggccttttaca

SEQ ID NO: 264663 - DNA, 25 bp, Homo sapien
tgtccatttggccttttacaagtgt

SEQ ID NO: 264664 - DNA, 25 bp, Homo sapien
ggccttttacaagtgtaatgccaat

SEQ ID NO: 264665 - DNA, 25 bp, Homo sapien
gtgtaatgccaatttcattgatttt

SEQ ID NO: 264666 - DNA, 25 bp, Homo sapien
gttggacgcataactgtgctgaata

SEQ ID NO: 264667 - DNA, 25 bp, Homo sapien
aagcaattagcttcctgagggtcag

SEQ ID NO: 264668 - DNA, 25 bp, Homo sapien
gcttcctgagggtcagtagctgaca

SEQ ID NO: 264669 - DNA, 25 bp, Homo sapien
agggtcagtagctgacattccattt

SEQ ID NO: 264670 - DNA, 25 bp, Homo sapien
aatttgacaggaggtggtttgcttt

SEQ ID NO: 264671 - DNA, 25 bp, Homo sapien
ggtttgctttgaatctgggagtact

SEQ ID NO: 264672 - DNA, 25 bp, Homo sapien
actggcccacattgattctggcaat

SEQ ID NO: 264673 - DNA, 25 bp, Homo sapien
attctggcaataaagctcactgtag

SEQ ID NO: 264674 - DNA, 25 bp, Homo sapien
aaagctcactgtagtgcaccactac

SEQ ID NO: 264675 - DNA, 25 bp, Homo sapien
agtgcaccactaccatcgtcagcga

SEQ ID NO: 264676 - DNA, 25 bp, Homo sapien
cagcgaatggtttagttggacgcat

SEQ ID NO: 264677 - DNA, 25 bp, Homo sapien
ggcggtgggtgctgcagaacgacag

SEQ ID NO: 264678 - DNA, 25 bp, Homo sapien
gaggaagctctgtgtatgctgaaaa

SEQ ID NO: 264679 - DNA, 25 bp, Homo sapien
atgctgaaaattctcacctgccatt

SEQ ID NO: 264680 - DNA, 25 bp, Homo sapien
gaaacgtgaacagctggcacagcag

SEQ ID NO: 264681 - DNA, 25 bp, Homo sapien
ctgccatttcatttccttcaaagga

SEQ ID NO: 264682 - DNA, 25 bp, Homo sapien
ggaacacagcattataactgccaga

SEQ ID NO: 264683 - DNA, 25 bp, Homo sapien
gccagattgaaaacgaagtgcactt

SEQ ID NO: 264684 - DNA, 25 bp, Homo sapien
ggagtaatactcattgccacaaagc

SEQ ID NO: 264685 - DNA, 25 bp, Homo sapien
attgccacaaagctgggcctgcagg

SEQ ID NO: 264686 - DNA, 25 bp, Homo sapien
gggcctgcaggatcaaatcacagtt

SEQ ID NO: 264687 - DNA, 25 bp, Homo sapien
caaatcacagttggccagctctggc

SEQ ID NO: 264688 - DNA, 25 bp, Homo sapien
gacctccaccacaggattctctggg

SEQ ID NO: 264689 - DNA, 25 bp, Homo sapien
actagtaccgtgagcgtggcaatct

SEQ ID NO: 264690 - DNA, 25 bp, Homo sapien
agtaccgtgagcgtggcaatctggt

SEQ ID NO: 264691 - DNA, 25 bp, Homo sapien
ctttcagctccttgcggtcccggta

SEQ ID NO: 264692 - DNA, 25 bp, Homo sapien
gtgtcttctgtgtagagctggcaga

SEQ ID NO: 264693 - DNA, 25 bp, Homo sapien
gtgtagagctggcagaaatagcccc

SEQ ID NO: 264694 - DNA, 25 bp, Homo sapien
gggcatctgagagccggatccgcac

SEQ ID NO: 264695 - DNA, 25 bp, Homo sapien
gggagaactcctcaagctggaaacg

SEQ ID NO: 264696 - DNA, 25 bp, Homo sapien
agctggaaacgctcatccttcaagg

SEQ ID NO: 264697 - DNA, 25 bp, Homo sapien
taccagcgcagggtggcagccggac

SEQ ID NO: 264698 - DNA, 25 bp, Homo sapien
accgcggaacgaggcagctgagctc

SEQ ID NO: 264699 - DNA, 25 bp, Homo sapien
acaacgacagatatgatgagatcca

SEQ ID NO: 264700 - DNA, 25 bp, Homo sapien
caacgacagatatgatgagatccat

SEQ ID NO: 264701 - DNA, 25 bp, Homo sapien
aacgacagatatgatgagatccatt

SEQ ID NO: 264702 - DNA, 25 bp, Homo sapien
acgacagatatgatgagatccattg

SEQ ID NO: 264703 - DNA, 25 bp, Homo sapien
cgacagatatgatgagatccattgt

SEQ ID NO: 264704 - DNA, 25 bp, Homo sapien
tgggtcccaaatctgtggctcactt

SEQ ID NO: 264705 - DNA, 25 bp, Homo sapien
gggtcccaaatctgtggctcacttt

SEQ ID NO: 264706 - DNA, 25 bp, Homo sapien
ggtcccaaatctgtggctcactttg

SEQ ID NO: 264707 - DNA, 25 bp, Homo sapien
gtcccaaatctgtggctcactttgc

SEQ ID NO: 264708 - DNA, 25 bp, Homo sapien
caaatctgtggctcactttgccaag

SEQ ID NO: 264709 - DNA, 25 bp, Homo sapien
tgtggctcactttgccaagctggaa

SEQ ID NO: 264710 - DNA, 25 bp, Homo sapien
ttgatgctcatgtccacggcttcac

SEQ ID NO: 264711 - DNA, 25 bp, Homo sapien
atgtccacggcttcacctaaggagt

SEQ ID NO: 264712 - DNA, 25 bp, Homo sapien
gaggcgcgccgctcagacggatctt

SEQ ID NO: 264713 - DNA, 25 bp, Homo sapien
tcagacggatcttgagttgcaggtt

SEQ ID NO: 264714 - DNA, 25 bp, Homo sapien
atcttgagttgcaggttgttggcga

SEQ ID NO: 264715 - DNA, 25 bp, Homo sapien
acggcttcacctaaggagtccacag

SEQ ID NO: 264716 - DNA, 25 bp, Homo sapien
taaggagtccacagcatcgcggtag

SEQ ID NO: 264717 - DNA, 25 bp, Homo sapien
gagtccacagcatcgcggtaggtct

SEQ ID NO: 264718 - DNA, 25 bp, Homo sapien
atcgcggtaggtctggatgcaaccc

SEQ ID NO: 264719 - DNA, 25 bp, Homo sapien
ggtaggtctggatgcaacccacgct

SEQ ID NO: 264720 - DNA, 25 bp, Homo sapien
gtctggatgcaacccacgctcagcg

SEQ ID NO: 264721 - DNA, 25 bp, Homo sapien
cgacctacacaattagccctaaaag

SEQ ID NO: 264722 - DNA, 25 bp, Homo sapien
ttagccctaaaagagatcactgctg

SEQ ID NO: 264723 - DNA, 25 bp, Homo sapien
taaaagagatcactgctgacccctc

SEQ ID NO: 264724 - DNA, 25 bp, Homo sapien
gaggccagcctgtgacaagttctca

SEQ ID NO: 264725 - DNA, 25 bp, Homo sapien
tgtgacaagttctcacctgtccaag

SEQ ID NO: 264726 - DNA, 25 bp, Homo sapien
agttctcacctgtccaaggcaaaag

SEQ ID NO: 264727 - DNA, 25 bp, Homo sapien
tcacctgtccaaggcaaaaggagat

SEQ ID NO: 264728 - DNA, 25 bp, Homo sapien
gacaacgcaaagaggttgttttgta

SEQ ID NO: 264729 - DNA, 25 bp, Homo sapien
tgttttgtaaagctgaaggtgttca

SEQ ID NO: 264730 - DNA, 25 bp, Homo sapien
aaggtgttcaaaggactggtcttca

SEQ ID NO: 264731 - DNA, 25 bp, Homo sapien
tgttcaaaggactggtcttcattct

SEQ ID NO: 264732 - DNA, 25 bp, Homo sapien
gccaggcgctcgaatttgttgaaga

SEQ ID NO: 264733 - DNA, 25 bp, Homo sapien
aagaggtgggtgttcagtatcgaaa

SEQ ID NO: 264734 - DNA, 25 bp, Homo sapien
gttcagtatcgaaagagccgcggat

SEQ ID NO: 264735 - DNA, 25 bp, Homo sapien
aagagccgcggattgtacattagaa

SEQ ID NO: 264736 - DNA, 25 bp, Homo sapien
attgtacattagaaagcctggcttt

SEQ ID NO: 264737 - DNA, 25 bp, Homo sapien
agaaagcctggctttgcgccgcgtc

SEQ ID NO: 264738 - DNA, 25 bp, Homo sapien
gcgtccttgccacttgctgaccagg

SEQ ID NO: 264739 - DNA, 25 bp, Homo sapien
cctgggatgtgaggccgtctcgctc

SEQ ID NO: 264740 - DNA, 25 bp, Homo sapien
gctccttgagagtaaaaacccgcct

SEQ ID NO: 264741 - DNA, 25 bp, Homo sapien
taaaaacccgcctgggtcgccatca

SEQ ID NO: 264742 - DNA, 25 bp, Homo sapien
atcaccctaggcttggtgcagggcc

SEQ ID NO: 264743 - DNA, 25 bp, Homo sapien
tctcacccctggagccctgcgggtg

SEQ ID NO: 264744 - DNA, 25 bp, Homo sapien
agggcatgagttccccagtccccaa

SEQ ID NO: 264745 - DNA, 25 bp, Homo sapien
gggcatgagttccccagtccccaag

SEQ ID NO: 264746 - DNA, 25 bp, Homo sapien
gcatgagttccccagtccccaagga

SEQ ID NO: 264747 - DNA, 25 bp, Homo sapien
catgagttccccagtccccaaggaa

SEQ ID NO: 264748 - DNA, 25 bp, Homo sapien
tgagttccccagtccccaaggaaag

SEQ ID NO: 264749 - DNA, 25 bp, Homo sapien
ttccccagtccccaaggaaaggcag

SEQ ID NO: 264750 - DNA, 25 bp, Homo sapien
caaggaaaggcagccccctcagtct

SEQ ID NO: 264751 - DNA, 25 bp, Homo sapien
aaggaaaggcagccccctcagtctc

SEQ ID NO: 264752 - DNA, 25 bp, Homo sapien
catctccctcccctctgccttttaa

SEQ ID NO: 264753 - DNA, 25 bp, Homo sapien
acaggaagtcggcacatctccaggt

SEQ ID NO: 264754 - DNA, 25 bp, Homo sapien
agtctgctggcattttcgttagtgg

SEQ ID NO: 264755 - DNA, 25 bp, Homo sapien
gcattttcgttagtgggcttcctca

SEQ ID NO: 264756 - DNA, 25 bp, Homo sapien
tagtgggcttcctcatacttatttt

SEQ ID NO: 264757 - DNA, 25 bp, Homo sapien
gggcttcctcatacttatttttgaa

SEQ ID NO: 264758 - DNA, 25 bp, Homo sapien
gtatattttccagtgcctttgagta

SEQ ID NO: 264759 - DNA, 25 bp, Homo sapien
tccagtgcctttgagtagttatttg

SEQ ID NO: 264760 - DNA, 25 bp, Homo sapien
agtgagttgtatgtggtttgtcccc

SEQ ID NO: 264761 - DNA, 25 bp, Homo sapien
tgtatgtggtttgtccccaccacaa

SEQ ID NO: 264762 - DNA, 25 bp, Homo sapien
taattgccagtttaacggtattgaa

SEQ ID NO: 264763 - DNA, 25 bp, Homo sapien
cagggttcttgtgaccatttcagtc

SEQ ID NO: 264764 - DNA, 25 bp, Homo sapien
tgaccatttcagtctgctggcattt

SEQ ID NO: 264765 - DNA, 25 bp, Homo sapien
aacggagtcggctcaatgaggcctt

SEQ ID NO: 264766 - DNA, 25 bp, Homo sapien
gagtcggctcaatgaggccttacaa

SEQ ID NO: 264767 - DNA, 25 bp, Homo sapien
atgaggccttacaagcagagagaca

SEQ ID NO: 264768 - DNA, 25 bp, Homo sapien
cagagagacagctctatagcagtct

SEQ ID NO: 264769 - DNA, 25 bp, Homo sapien
gacagctctatagcagtctggtgaa

SEQ ID NO: 264770 - DNA, 25 bp, Homo sapien
gtctggtgaagttccatgcccatcc

SEQ ID NO: 264771 - DNA, 25 bp, Homo sapien
aagttccatgcccatccagagagct

SEQ ID NO: 264772 - DNA, 25 bp, Homo sapien
ggctcaggtgttacgcagtcggcta

SEQ ID NO: 264773 - DNA, 25 bp, Homo sapien
tacgcagtcggctagaagaagttct

SEQ ID NO: 264774 - DNA, 25 bp, Homo sapien
ggaagaagcttggagcgcttaaaca

SEQ ID NO: 264775 - DNA, 25 bp, Homo sapien
tggagcgcttaaacaggctggagac

SEQ ID NO: 264776 - DNA, 25 bp, Homo sapien
aagatgctggagtaaacaatttaac

SEQ ID NO: 264777 - DNA, 25 bp, Homo sapien
ggaaaaggaggcatactttcaacat

SEQ ID NO: 264778 - DNA, 25 bp, Homo sapien
actttcaacatatgtctggcctaag

SEQ ID NO: 264779 - DNA, 25 bp, Homo sapien
gtctggcctaagtactggatttcat

SEQ ID NO: 264780 - DNA, 25 bp, Homo sapien
actggatttcatgatgttctggcta

SEQ ID NO: 264781 - DNA, 25 bp, Homo sapien
gatgttctggctatgacaaaacaaa

SEQ ID NO: 264782 - DNA, 25 bp, Homo sapien
tactgcaaagatggtacttacatca

SEQ ID NO: 264783 - DNA, 25 bp, Homo sapien
gataactcaagaattacccctggag

SEQ ID NO: 264784 - DNA, 25 bp, Homo sapien
gaattacccctggagaataaacaat

SEQ ID NO: 264785 - DNA, 25 bp, Homo sapien
gtatttgtaatattgccagaaggat

SEQ ID NO: 264786 - DNA, 25 bp, Homo sapien
tactactggatcaaggaatctttct

SEQ ID NO: 264787 - DNA, 25 bp, Homo sapien
agggcatgagttccccagtccccaa

SEQ ID NO: 264788 - DNA, 25 bp, Homo sapien
gggcatgagttccccagtccccaag

SEQ ID NO: 264789 - DNA, 25 bp, Homo sapien
ggcatgagttccccagtccccaagg

SEQ ID NO: 264790 - DNA, 25 bp, Homo sapien
gcatgagttccccagtccccaagga

SEQ ID NO: 264791 - DNA, 25 bp, Homo sapien
catgagttccccagtccccaaggaa

SEQ ID NO: 264792 - DNA, 25 bp, Homo sapien
tgagttccccagtccccaaggaaag

SEQ ID NO: 264793 - DNA, 25 bp, Homo sapien
ccctcagtctccctcctcctcattc

SEQ ID NO: 264794 - DNA, 25 bp, Homo sapien
cctcagtctccctcctcctcattcc

SEQ ID NO: 264795 - DNA, 25 bp, Homo sapien
ctcagtctccctcctcctcattccc

SEQ ID NO: 264796 - DNA, 25 bp, Homo sapien
ttcgagcttgttccccagcggcgca

SEQ ID NO: 264797 - DNA, 25 bp, Homo sapien
aaagctggcgctgggagtgggaaaa

SEQ ID NO: 264798 - DNA, 25 bp, Homo sapien
ggcccgcgaaatggcctcaagatcg

SEQ ID NO: 264799 - DNA, 25 bp, Homo sapien
gcctcaagatcgtgcctttgttaga

SEQ ID NO: 264800 - DNA, 25 bp, Homo sapien
agatcgtgcctttgttagaagaaac

SEQ ID NO: 264801 - DNA, 25 bp, Homo sapien
gaagaaacatgggtacgctccgatg

SEQ ID NO: 264802 - DNA, 25 bp, Homo sapien
aacatgggtacgctccgatgcgacg

SEQ ID NO: 264803 - DNA, 25 bp, Homo sapien
gctccgatgcgacgcaggcttccaa

SEQ ID NO: 264804 - DNA, 25 bp, Homo sapien
accccagcggttcggtggtggtgca

SEQ ID NO: 264805 - DNA, 25 bp, Homo sapien
cctaataattcagcctggcagggtt

SEQ ID NO: 264806 - DNA, 25 bp, Homo sapien
ttcagcctggcagggttcgcgttta

SEQ ID NO: 264807 - DNA, 25 bp, Homo sapien
aaaagtttgagcttctcaccttcag

SEQ ID NO: 264808 - DNA, 25 bp, Homo sapien
tcaccttcagtcttagctcttgaac

SEQ ID NO: 264809 - DNA, 25 bp, Homo sapien
gtcttagctcttgaacctgttgaga

SEQ ID NO: 264810 - DNA, 25 bp, Homo sapien
tctgtgtcagcccactggaaggaaa

SEQ ID NO: 264811 - DNA, 25 bp, Homo sapien
gaagcaacgttttcatctgattgga

SEQ ID NO: 264812 - DNA, 25 bp, Homo sapien
ggaaggaaaagcgaatcaaccgatt

SEQ ID NO: 264813 - DNA, 25 bp, Homo sapien
caaccgattcagtgatgttagtgca

SEQ ID NO: 264814 - DNA, 25 bp, Homo sapien
tgttagtgcatccagaaacaggctt

SEQ ID NO: 264815 - DNA, 25 bp, Homo sapien
cttttgggaaaagcttgacctgagc

SEQ ID NO: 264816 - DNA, 25 bp, Homo sapien
cttgacctgagctgattaaatcctg

SEQ ID NO: 264817 - DNA, 25 bp, Homo sapien
atctgattggaaataccgtattgct

SEQ ID NO: 264818 - DNA, 25 bp, Homo sapien
atatgcatgcatttgaccctagata

SEQ ID NO: 264819 - DNA, 25 bp, Homo sapien
tgcatttgaccctagatatttatta

SEQ ID NO: 264820 - DNA, 25 bp, Homo sapien
gatatttattaggagttttctgtct

SEQ ID NO: 264821 - DNA, 25 bp, Homo sapien
gagcatattttagctggtaagttca

SEQ ID NO: 264822 - DNA, 25 bp, Homo sapien
gttcaggaatcatcaggtcttttat

SEQ ID NO: 264823 - DNA, 25 bp, Homo sapien
aggaatcatcaggtcttttatttct

SEQ ID NO: 264824 - DNA, 25 bp, Homo sapien
tagatttctgcactggaagctccct

SEQ ID NO: 264825 - DNA, 25 bp, Homo sapien
tggaagctccctctgtttgctgtac

SEQ ID NO: 264826 - DNA, 25 bp, Homo sapien
tccctctgtttgctgtactgtttcc

SEQ ID NO: 264827 - DNA, 25 bp, Homo sapien
tttcccctaacttctatgttaaatg

SEQ ID NO: 264828 - DNA, 25 bp, Homo sapien
acttctatgttaaatgccaccattt

SEQ ID NO: 264829 - DNA, 25 bp, Homo sapien
gtcacaggtcaaagccgagaacaga

SEQ ID NO: 264830 - DNA, 25 bp, Homo sapien
gcatcgggcggccaccagcagggtc

SEQ ID NO: 264831 - DNA, 25 bp, Homo sapien
gccacaaggacgctcccgttccagt

SEQ ID NO: 264832 - DNA, 25 bp, Homo sapien
ttccagtccccggaagagggtggct

SEQ ID NO: 264833 - DNA, 25 bp, Homo sapien
gaccagcagaggtcctcacggcctg

SEQ ID NO: 264834 - DNA, 25 bp, Homo sapien
cagcagaggtcctcacggcctgcgg

SEQ ID NO: 264835 - DNA, 25 bp, Homo sapien
gggagacctgagactcctaagctga

SEQ ID NO: 264836 - DNA, 25 bp, Homo sapien
gagactcctaagctgagcacgtcag

SEQ ID NO: 264837 - DNA, 25 bp, Homo sapien
tcctaagctgagcacgtcagcgtct

SEQ ID NO: 264838 - DNA, 25 bp, Homo sapien
ctctgaaggtcggaggtcacaggtc

SEQ ID NO: 264839 - DNA, 25 bp, Homo sapien
tgaaggtcggaggtcacaggtcaaa

SEQ ID NO: 264840 - DNA, 25 bp, Homo sapien
agaagagctctcttgttgttagcac

SEQ ID NO: 264841 - DNA, 25 bp, Homo sapien
gagctctcttgttgttagcacttat

SEQ ID NO: 264842 - DNA, 25 bp, Homo sapien
ctctcttgttgttagcacttattgt

SEQ ID NO: 264843 - DNA, 25 bp, Homo sapien
gttagcacttattgtttgcaagaac

SEQ ID NO: 264844 - DNA, 25 bp, Homo sapien
gtttgcaagaacagaatacatcctt

SEQ ID NO: 264845 - DNA, 25 bp, Homo sapien
atgagtgttctgatgtggtggcttt

SEQ ID NO: 264846 - DNA, 25 bp, Homo sapien
gttctgatgtggtggcttttgcaaa

SEQ ID NO: 264847 - DNA, 25 bp, Homo sapien
gatgtggtggcttttgcaaaaatct

SEQ ID NO: 264848 - DNA, 25 bp, Homo sapien
catccagaattcatattgtcttgac

SEQ ID NO: 264849 - DNA, 25 bp, Homo sapien
ttgtcttgacaagaactatggttct

SEQ ID NO: 264850 - DNA, 25 bp, Homo sapien
tgacaagaactatggttctctgttt

SEQ ID NO: 264851 - DNA, 25 bp, Homo sapien
ttatgagggatccatccttatgatc

SEQ ID NO: 264852 - DNA, 25 bp, Homo sapien
cactaaacccgacttccaacactgg

SEQ ID NO: 264853 - DNA, 25 bp, Homo sapien
gatttgaagcggacaaatatctaaa

SEQ ID NO: 264854 - DNA, 25 bp, Homo sapien
aactacagcaaagagtacagatcgg

SEQ ID NO: 264855 - DNA, 25 bp, Homo sapien
tacagatcgggaggcatggcaagct

SEQ ID NO: 264856 - DNA, 25 bp, Homo sapien
atcgggaggcatggcaagctctgct

SEQ ID NO: 264857 - DNA, 25 bp, Homo sapien
tggcaagctctgctggtcactccaa

SEQ ID NO: 264858 - DNA, 25 bp, Homo sapien
aagctctgctggtcactccaatgga

SEQ ID NO: 264859 - DNA, 25 bp, Homo sapien
tctgctggtcactccaatggagtca

SEQ ID NO: 264860 - DNA, 25 bp, Homo sapien
actccaatggagtcaacatttcaag

SEQ ID NO: 264861 - DNA, 25 bp, Homo sapien
caagaatgttacaagcagctgggtt

SEQ ID NO: 264862 - DNA, 25 bp, Homo sapien
gtgtagcatattaatgcctgccaca

SEQ ID NO: 264863 - DNA, 25 bp, Homo sapien
atgcctgccacaagggtgctatcaa

SEQ ID NO: 264864 - DNA, 25 bp, Homo sapien
agggtgctatcaaccagaatcttca

SEQ ID NO: 264865 - DNA, 25 bp, Homo sapien
gaatcttcagtgaatcttcttgtct

SEQ ID NO: 264866 - DNA, 25 bp, Homo sapien
gaatcttcttgtctgaattgcacat

SEQ ID NO: 264867 - DNA, 25 bp, Homo sapien
atgtgtaaggacaccgtggcccatg

SEQ ID NO: 264868 - DNA, 25 bp, Homo sapien
tggcccatgcattgacactgtcata

SEQ ID NO: 264869 - DNA, 25 bp, Homo sapien
ctcctttagcaagccttctcgaagg

SEQ ID NO: 264870 - DNA, 25 bp, Homo sapien
gaaggactccatgcctcactgatct

SEQ ID NO: 264871 - DNA, 25 bp, Homo sapien
ctcactgaacgccacagaccaagaa

SEQ ID NO: 264872 - DNA, 25 bp, Homo sapien
aagaacccataatgtcctcctcagg

SEQ ID NO: 264873 - DNA, 25 bp, Homo sapien
gggaggagactctcgccaaagctta

SEQ ID NO: 264874 - DNA, 25 bp, Homo sapien
tctcgccaaagcttagcaccaacag

SEQ ID NO: 264875 - DNA, 25 bp, Homo sapien
cttagcaccaacagaagtggtcccc

SEQ ID NO: 264876 - DNA, 25 bp, Homo sapien
tcttccctccaaccgaggagaaagt

SEQ ID NO: 264877 - DNA, 25 bp, Homo sapien
aaagtggcgcgcctttgaggagtcc

SEQ ID NO: 264878 - DNA, 25 bp, Homo sapien
ttgaggagtccgaggtcccggccca

SEQ ID NO: 264879 - DNA, 25 bp, Homo sapien
atcaagcgtttgtagtgtcctggga

SEQ ID NO: 264880 - DNA, 25 bp, Homo sapien
gtcctgggatctggcacttcgatga

SEQ ID NO: 264881 - DNA, 25 bp, Homo sapien
gatctggcacttcgatgagaaagct

SEQ ID NO: 264882 - DNA, 25 bp, Homo sapien
tgagaaagctgtgacggccccaact

SEQ ID NO: 264883 - DNA, 25 bp, Homo sapien
gccccaacttctaacagcgagtggt

SEQ ID NO: 264884 - DNA, 25 bp, Homo sapien
tcttttcctcttggcgtatggctga

SEQ ID NO: 264885 - DNA, 25 bp, Homo sapien
cgtatggctgagctttggacccaga

SEQ ID NO: 264886 - DNA, 25 bp, Homo sapien
gacccagaaaggatggttgcccctt

SEQ ID NO: 264887 - DNA, 25 bp, Homo sapien
ttgccccttcctagaatagacacat

SEQ ID NO: 264888 - DNA, 25 bp, Homo sapien
agacacatccagttgagtgttcaag

SEQ ID NO: 264889 - DNA, 25 bp, Homo sapien
gcatggaccccagatgtccaaaagg

SEQ ID NO: 264890 - DNA, 25 bp, Homo sapien
gggaggaacatgagccacttccctg

SEQ ID NO: 264891 - DNA, 25 bp, Homo sapien
tgcgcagctcctaggtgtacctgaa

SEQ ID NO: 264892 - DNA, 25 bp, Homo sapien
gtacctgaatgtcatcgatgtcact

SEQ ID NO: 264893 - DNA, 25 bp, Homo sapien
tccaggaatgctatgtatatcagat

SEQ ID NO: 264894 - DNA, 25 bp, Homo sapien
atacgggagtgtctgtcatcttctt

SEQ ID NO: 264895 - DNA, 25 bp, Homo sapien
gggtgaaaagctaggctcctgtgac

SEQ ID NO: 264896 - DNA, 25 bp, Homo sapien
tgaaaagctaggctcctgtgacctc

SEQ ID NO: 264897 - DNA, 25 bp, Homo sapien
aaagctaggctcctgtgacctcctt

SEQ ID NO: 264898 - DNA, 25 bp, Homo sapien
gctaggctcctgtgacctccttctg

SEQ ID NO: 264899 - DNA, 25 bp, Homo sapien
taaagaccacttagtcccactccct

SEQ ID NO: 264900 - DNA, 25 bp, Homo sapien
ctgcctcattccatttctggggata

SEQ ID NO: 264901 - DNA, 25 bp, Homo sapien
gaccagtctgaggtcacaacccaaa

SEQ ID NO: 264902 - DNA, 25 bp, Homo sapien
gtctgaggtcacaacccaaagctgg

SEQ ID NO: 264903 - DNA, 25 bp, Homo sapien
ctgaggtcacaacccaaagctggca

SEQ ID NO: 264904 - DNA, 25 bp, Homo sapien
gaggtcacaacccaaagctggcagg

SEQ ID NO: 264905 - DNA, 25 bp, Homo sapien
tcacaacccaaagctggcagggctg

SEQ ID NO: 264906 - DNA, 25 bp, Homo sapien
gggccaggatctagaaagactgcct

SEQ ID NO: 264907 - DNA, 25 bp, Homo sapien
cgcgggcctgctgtcatggactcgt

SEQ ID NO: 264908 - DNA, 25 bp, Homo sapien
gcctgctgtcatggactcgtggaga

SEQ ID NO: 264909 - DNA, 25 bp, Homo sapien
tcatggactcgtggagagctcgctt

SEQ ID NO: 264910 - DNA, 25 bp, Homo sapien
ggactcgtggagagctcgcttcccg

SEQ ID NO: 264911 - DNA, 25 bp, Homo sapien
tggagagctcgcttcccgcgcggac

SEQ ID NO: 264912 - DNA, 25 bp, Homo sapien
acccgggcggtagctcgttaagatg

SEQ ID NO: 264913 - DNA, 25 bp, Homo sapien
tagctcgttaagatggcgaagtgtc

SEQ ID NO: 264914 - DNA, 25 bp, Homo sapien
ctaggatccccgaaaaggagcacgg

SEQ ID NO: 264915 - DNA, 25 bp, Homo sapien
agcacgggcgcgaaagcggccaggc

SEQ ID NO: 264916 - DNA, 25 bp, Homo sapien
aggctgggccaggatctagaaagac

SEQ ID NO: 264917 - DNA, 25 bp, Homo sapien
gtgctggctctctgtcacaatgcct

SEQ ID NO: 264918 - DNA, 25 bp, Homo sapien
gctctctgtcacaatgcctcaaaag

SEQ ID NO: 264919 - DNA, 25 bp, Homo sapien
atgcctcaaaagacatggaacccag

SEQ ID NO: 264920 - DNA, 25 bp, Homo sapien
gacatggaacccaggcctacaaccg

SEQ ID NO: 264921 - DNA, 25 bp, Homo sapien
caaccgtcccaactgctaattcttt

SEQ ID NO: 264922 - DNA, 25 bp, Homo sapien
gaaagcagtttgttatactattcat

SEQ ID NO: 264923 - DNA, 25 bp, Homo sapien
atttcatgtcattttggatcttata

SEQ ID NO: 264924 - DNA, 25 bp, Homo sapien
gaatgactccattttaggtagccac

SEQ ID NO: 264925 - DNA, 25 bp, Homo sapien
aggtagccacttttgatgttaatat

SEQ ID NO: 264926 - DNA, 25 bp, Homo sapien
tatatagtgagtccaatgtatgctt

SEQ ID NO: 264927 - DNA, 25 bp, Homo sapien
gagtccaatgtatgctttagaagta

SEQ ID NO: 264928 - DNA, 25 bp, Homo sapien
ggagtgtgattgcaaaaacatcccc

SEQ ID NO: 264929 - DNA, 25 bp, Homo sapien
gtgtgattgcaaaaacatcccccaa

SEQ ID NO: 264930 - DNA, 25 bp, Homo sapien
ccttgaatacacttgtctggtatca

SEQ ID NO: 264931 - DNA, 25 bp, Homo sapien
ttgaatacacttgtctggtatcaca

SEQ ID NO: 264932 - DNA, 25 bp, Homo sapien
gaatacacttgtctggtatcacatg

SEQ ID NO: 264933 - DNA, 25 bp, Homo sapien
aatacacttgtctggtatcacatga

SEQ ID NO: 264934 - DNA, 25 bp, Homo sapien
atacacttgtctggtatcacatgag

SEQ ID NO: 264935 - DNA, 25 bp, Homo sapien
tacacttgtctggtatcacatgagt

SEQ ID NO: 264936 - DNA, 25 bp, Homo sapien
acacttgtctggtatcacatgagta

SEQ ID NO: 264937 - DNA, 25 bp, Homo sapien
cacttgtctggtatcacatgagtag

SEQ ID NO: 264938 - DNA, 25 bp, Homo sapien
acttgtctggtatcacatgagtaga

SEQ ID NO: 264939 - DNA, 25 bp, Homo sapien
cggctctctgcttacgtatgccatg

SEQ ID NO: 264940 - DNA, 25 bp, Homo sapien
tctctgcttacgtatgccatgcata

SEQ ID NO: 264941 - DNA, 25 bp, Homo sapien
ttacgtatgccatgcatacctcctg

SEQ ID NO: 264942 - DNA, 25 bp, Homo sapien
tttccggacccccatccaagaggag

SEQ ID NO: 264943 - DNA, 25 bp, Homo sapien
tccaagaggagcaggccgacgccca

SEQ ID NO: 264944 - DNA, 25 bp, Homo sapien
tgacctgggcccaccaaggtggacg

SEQ ID NO: 264945 - DNA, 25 bp, Homo sapien
ggtctgctgggcgagcagggcaggt

SEQ ID NO: 264946 - DNA, 25 bp, Homo sapien
tgggccaactctgcaccgttctagg

SEQ ID NO: 264947 - DNA, 25 bp, Homo sapien
aactctgcaccgttctaggtgccga

SEQ ID NO: 264948 - DNA, 25 bp, Homo sapien
accgttctaggtgccgatggctgcc

SEQ ID NO: 264949 - DNA, 25 bp, Homo sapien
ttctaggtgccgatggctgcctccg

SEQ ID NO: 264950 - DNA, 25 bp, Homo sapien
ttctctgcaacctatatgaaaatgt

SEQ ID NO: 264951 - DNA, 25 bp, Homo sapien
aaatgcagaaaccagcttctaacag

SEQ ID NO: 264952 - DNA, 25 bp, Homo sapien
agaaatttacaaaagccaatcctga

SEQ ID NO: 264953 - DNA, 25 bp, Homo sapien
aatcctgaaggagcattatctacaa

SEQ ID NO: 264954 - DNA, 25 bp, Homo sapien
attgcaaatgaacctacagtactag

SEQ ID NO: 264955 - DNA, 25 bp, Homo sapien
atgaacctacagtactagcaagatg

SEQ ID NO: 264956 - DNA, 25 bp, Homo sapien
cagtactagcaagatgaagcagctt

SEQ ID NO: 264957 - DNA, 25 bp, Homo sapien
gaagcagcttgagaattaggtcagt

SEQ ID NO: 264958 - DNA, 25 bp, Homo sapien
attaggtcagtttggatgggtacga

SEQ ID NO: 264959 - DNA, 25 bp, Homo sapien
ggatgggtacgagagaactcctctt

SEQ ID NO: 264960 - DNA, 25 bp, Homo sapien
tactttccaatgattaaattctttc

SEQ ID NO: 264961 - DNA, 25 bp, Homo sapien
tttccggacccccatccaagaggag

SEQ ID NO: 264962 - DNA, 25 bp, Homo sapien
tccggacccccatccaagaggagca

SEQ ID NO: 264963 - DNA, 25 bp, Homo sapien
ccggacccccatccaagaggagcag

SEQ ID NO: 264964 - DNA, 25 bp, Homo sapien
gaggagcaggccgacgcccactcca

SEQ ID NO: 264965 - DNA, 25 bp, Homo sapien
aggagcaggccgacgcccactccac

SEQ ID NO: 264966 - DNA, 25 bp, Homo sapien
ggagcaggccgacgcccactccacc

SEQ ID NO: 264967 - DNA, 25 bp, Homo sapien
caggccgacgcccactccaccctgg

SEQ ID NO: 264968 - DNA, 25 bp, Homo sapien
tgacctgggcccaccaaggtggacg

SEQ ID NO: 264969 - DNA, 25 bp, Homo sapien
acctgggcccaccaaggtggacgct

SEQ ID NO: 264970 - DNA, 25 bp, Homo sapien
cctgggcccaccaaggtggacgctg

SEQ ID NO: 264971 - DNA, 25 bp, Homo sapien
ctgggcccaccaaggtggacgctgg

SEQ ID NO: 264972 - DNA, 25 bp, Homo sapien
gagagctctttattttctgtggaag

SEQ ID NO: 264973 - DNA, 25 bp, Homo sapien
agagctctttattttctgtggaagc

SEQ ID NO: 264974 - DNA, 25 bp, Homo sapien
ttatacgaaccaggcttctgcttca

SEQ ID NO: 264975 - DNA, 25 bp, Homo sapien
caacctcagcaaacatcgtttgctt

SEQ ID NO: 264976 - DNA, 25 bp, Homo sapien
caaacatcgtttgctttggagagga

SEQ ID NO: 264977 - DNA, 25 bp, Homo sapien
cgtttgctttggagaggaacttaag

SEQ ID NO: 264978 - DNA, 25 bp, Homo sapien
aggaacttaaggactcagcaggaaa

SEQ ID NO: 264979 - DNA, 25 bp, Homo sapien
gaacttaaggactcagcaggaaatt

SEQ ID NO: 264980 - DNA, 25 bp, Homo sapien
aggactcagcaggaaattgaagata

SEQ ID NO: 264981 - DNA, 25 bp, Homo sapien
gaaagggttcagcttcaaagaagac

SEQ ID NO: 264982 - DNA, 25 bp, Homo sapien
ggttcagcttcaaagaagacacttt

SEQ ID NO: 264983 - DNA, 25 bp, Homo sapien
ataggattagatacgcaggaagaca

SEQ ID NO: 264984 - DNA, 25 bp, Homo sapien
gaaaactacagtacattgtgatcag

SEQ ID NO: 264985 - DNA, 25 bp, Homo sapien
gatcagtagttctttaatagggaca

SEQ ID NO: 264986 - DNA, 25 bp, Homo sapien
tacaggatgcatgaaagcccggaga

SEQ ID NO: 264987 - DNA, 25 bp, Homo sapien
agcccggagatggaacccctaatga

SEQ ID NO: 264988 - DNA, 25 bp, Homo sapien
gagacacccaagctgaggcctgaaa

SEQ ID NO: 264989 - DNA, 25 bp, Homo sapien
gacactaagtgtctactctgtggta

SEQ ID NO: 264990 - DNA, 25 bp, Homo sapien
aagtgtctactctgtggtaagcaca

SEQ ID NO: 264991 - DNA, 25 bp, Homo sapien
gtaagcacagtcttaggttccagat

SEQ ID NO: 264992 - DNA, 25 bp, Homo sapien
taggttccagatcacgctagaaagt

SEQ ID NO: 264993 - DNA, 25 bp, Homo sapien
gtaggagaaacactccctgtcttta

SEQ ID NO: 264994 - DNA, 25 bp, Homo sapien
ttactgggtcaccatccttttgatc

SEQ ID NO: 264995 - DNA, 25 bp, Homo sapien
aagggtgtcatcagtacagaactta

SEQ ID NO: 264996 - DNA, 25 bp, Homo sapien
gtcatttaatttacagtgctttggc

SEQ ID NO: 264997 - DNA, 25 bp, Homo sapien
tttaacatcttgaattaggttggtt

SEQ ID NO: 264998 - DNA, 25 bp, Homo sapien
taggttggttacattttgactgttt

SEQ ID NO: 264999 - DNA, 25 bp, Homo sapien
aaacttgtagaaacacagcaaagct

SEQ ID NO: 265000 - DNA, 25 bp, Homo sapien
agcaaagctagtgaccttcacactt

SEQ ID NO: 265001 - DNA, 25 bp, Homo sapien
agctagtgaccttcacactttcacg

SEQ ID NO: 265002 - DNA, 25 bp, Homo sapien
ctacattttattatgcctaaagagt

SEQ ID NO: 265003 - DNA, 25 bp, Homo sapien
tatgcctaaagagtcagtgatgata

SEQ ID NO: 265004 - DNA, 25 bp, Homo sapien
cagaagcaccttactgggtcaccat

SEQ ID NO: 265005 - DNA, 25 bp, Homo sapien
gctctcaaacccaaaacacagatcg

SEQ ID NO: 265006 - DNA, 25 bp, Homo sapien
aacccaaaacacagatcgatataag

SEQ ID NO: 265007 - DNA, 25 bp, Homo sapien
ggtgaggcacaattatgaagtgcat

SEQ ID NO: 265008 - DNA, 25 bp, Homo sapien
aagtgcatattattcagatgtatag

SEQ ID NO: 265009 - DNA, 25 bp, Homo sapien
atagtaaatactttgcattgctttt

SEQ ID NO: 265010 - DNA, 25 bp, Homo sapien
gatttttacacttccaaagtacatt

SEQ ID NO: 265011 - DNA, 25 bp, Homo sapien
gtacatttactttttgtcttgataa

SEQ ID NO: 265012 - DNA, 25 bp, Homo sapien
gtcttgataatgaatcacttttgcc

SEQ ID NO: 265013 - DNA, 25 bp, Homo sapien
ttgccagtaattggcctcttccaaa

SEQ ID NO: 265014 - DNA, 25 bp, Homo sapien
atccttctgacttacagatgtttaa

SEQ ID NO: 265015 - DNA, 25 bp, Homo sapien
tgagtttaactacatcttgatacaa

SEQ ID NO: 265016 - DNA, 25 bp, Homo sapien
aagtgtcaagactcatcgaactgta

SEQ ID NO: 265017 - DNA, 25 bp, Homo sapien
acacttttgttctaggtacattaga

SEQ ID NO: 265018 - DNA, 25 bp, Homo sapien
aataagccaggtaacagctttgcct

SEQ ID NO: 265019 - DNA, 25 bp, Homo sapien
aggtaacagctttgcctgggtggct

SEQ ID NO: 265020 - DNA, 25 bp, Homo sapien
gaggcttgggacactttacattgat

SEQ ID NO: 265021 - DNA, 25 bp, Homo sapien
tttacattgatctccctcttaggca

SEQ ID NO: 265022 - DNA, 25 bp, Homo sapien
ccctcttaggcatgttcgttttggt

SEQ ID NO: 265023 - DNA, 25 bp, Homo sapien
taggcatgttcgttttggtttggtt

SEQ ID NO: 265024 - DNA, 25 bp, Homo sapien
gaagcatttttgaggtgacgtaaat

SEQ ID NO: 265025 - DNA, 25 bp, Homo sapien
gacgtaaatgtttttgtatcttgat

SEQ ID NO: 265026 - DNA, 25 bp, Homo sapien
gggtgcacatccaagtgtcaagact

SEQ ID NO: 265027 - DNA, 25 bp, Homo sapien
ccacaacccgccaggatttaatctt

SEQ ID NO: 265028 - DNA, 25 bp, Homo sapien
cacaacccgccaggatttaatcttt

SEQ ID NO: 265029 - DNA, 25 bp, Homo sapien
acccgccaggatttaatcttttatg

SEQ ID NO: 265030 - DNA, 25 bp, Homo sapien
ttcagtttatagtttccaggaggaa

SEQ ID NO: 265031 - DNA, 25 bp, Homo sapien
ttccaggaggaaagtcttgtaacgc

SEQ ID NO: 265032 - DNA, 25 bp, Homo sapien
tccaggaggaaagtcttgtaacgct

SEQ ID NO: 265033 - DNA, 25 bp, Homo sapien
ccaggaggaaagtcttgtaacgctt

SEQ ID NO: 265034 - DNA, 25 bp, Homo sapien
caggaggaaagtcttgtaacgcttt

SEQ ID NO: 265035 - DNA, 25 bp, Homo sapien
gaggaaagtcttgtaacgctttact

SEQ ID NO: 265036 - DNA, 25 bp, Homo sapien
tcttgtaacgctttactttttctct

SEQ ID NO: 265037 - DNA, 25 bp, Homo sapien
tgtaacgctttactttttctcttct

SEQ ID NO: 265038 - DNA, 25 bp, Homo sapien
ccgcccaaggtgtctcctagctggg

SEQ ID NO: 265039 - DNA, 25 bp, Homo sapien
gtgcactgtccagctctggagagat

SEQ ID NO: 265040 - DNA, 25 bp, Homo sapien
agagctggtgccttccagtggacta

SEQ ID NO: 265041 - DNA, 25 bp, Homo sapien
gtggactacttcatcctagaagccc

SEQ ID NO: 265042 - DNA, 25 bp, Homo sapien
agaagccctcgggatgcacgtttca

SEQ ID NO: 265043 - DNA, 25 bp, Homo sapien
tcgggatgcacgtttcactggaaga

SEQ ID NO: 265044 - DNA, 25 bp, Homo sapien
ttcactggaagaaaggcctagcttg

SEQ ID NO: 265045 - DNA, 25 bp, Homo sapien
gcctagcttgggtaggtccctagaa

SEQ ID NO: 265046 - DNA, 25 bp, Homo sapien
agcgcgggtgctgttggcacaaaca

SEQ ID NO: 265047 - DNA, 25 bp, Homo sapien
tgctgttggcacaaacacaggcaga

SEQ ID NO: 265048 - DNA, 25 bp, Homo sapien
ctctgcgtgcttccggcgagcaaag

SEQ ID NO: 265049 - DNA, 25 bp, Homo sapien
gctgcatgaaacctctccctagaag

SEQ ID NO: 265050 - DNA, 25 bp, Homo sapien
tggtgataccccaccattcctggga

SEQ ID NO: 265051 - DNA, 25 bp, Homo sapien
aggatgcccttcttggcatttccct

SEQ ID NO: 265052 - DNA, 25 bp, Homo sapien
ttccatgaccagattagtccctctc

SEQ ID NO: 265053 - DNA, 25 bp, Homo sapien
tctccttccagaatgtctccttggg

SEQ ID NO: 265054 - DNA, 25 bp, Homo sapien
gtctccttgggtttattcaccatgt

SEQ ID NO: 265055 - DNA, 25 bp, Homo sapien
acctgatcgtcactgcattagcata

SEQ ID NO: 265056 - DNA, 25 bp, Homo sapien
catcttgttatgtacttgggtccca

SEQ ID NO: 265057 - DNA, 25 bp, Homo sapien
cttgggtcccagtcactaatatgtg

SEQ ID NO: 265058 - DNA, 25 bp, Homo sapien
atgtgggtgtcctatgtctttaaac

SEQ ID NO: 265059 - DNA, 25 bp, Homo sapien
cctcagacacctcccaaaagatgag

SEQ ID NO: 265060 - DNA, 25 bp, Homo sapien
ctgtaattaatcatgccgtgggccc

SEQ ID NO: 265061 - DNA, 25 bp, Homo sapien
attaatcatgccgtgggccctaatt

SEQ ID NO: 265062 - DNA, 25 bp, Homo sapien
tgccgtgggccctaattcagactca

SEQ ID NO: 265063 - DNA, 25 bp, Homo sapien
ttcagactcaccacattcaaatttc

SEQ ID NO: 265064 - DNA, 25 bp, Homo sapien
gtgtctacttaagaaatgctccgct

SEQ ID NO: 265065 - DNA, 25 bp, Homo sapien
gaaatgctccgcttatgaaatgctc

SEQ ID NO: 265066 - DNA, 25 bp, Homo sapien
gctccgcttatgaaatgctctttgt

SEQ ID NO: 265067 - DNA, 25 bp, Homo sapien
aatgctctttgttgccgaagcagcc

SEQ ID NO: 265068 - DNA, 25 bp, Homo sapien
tagcattcctaactatccttagctg

SEQ ID NO: 265069 - DNA, 25 bp, Homo sapien
ctatccttagctgtatttctcttca

SEQ ID NO: 265070 - DNA, 25 bp, Homo sapien
ccccgggcaggttaagatggttgct

SEQ ID NO: 265071 - DNA, 25 bp, Homo sapien
gtctagtaattcttgatgttcatct

SEQ ID NO: 265072 - DNA, 25 bp, Homo sapien
ccagtggaaacacatgaacttcgat

SEQ ID NO: 265073 - DNA, 25 bp, Homo sapien
tgaacttcgatgcaggtccagagac

SEQ ID NO: 265074 - DNA, 25 bp, Homo sapien
agagaccatggacactcccacgagg

SEQ ID NO: 265075 - DNA, 25 bp, Homo sapien
cctacacttcagttgagggaaaagc

SEQ ID NO: 265076 - DNA, 25 bp, Homo sapien
gaaaagctcaagtgccttaggcccg

SEQ ID NO: 265077 - DNA, 25 bp, Homo sapien
cgtggaccacagtcttggctgagat

SEQ ID NO: 265078 - DNA, 25 bp, Homo sapien
aagggatgagcaacagggacttctg

SEQ ID NO: 265079 - DNA, 25 bp, Homo sapien
tctgccacagtgacaatggaattgt

SEQ ID NO: 265080 - DNA, 25 bp, Homo sapien
gaattgtgttgtgccttacttcaga

SEQ ID NO: 265081 - DNA, 25 bp, Homo sapien
tacttcagaggtggtctcttctttc

SEQ ID NO: 265082 - DNA, 25 bp, Homo sapien
atatattttttacaagccccagctc

SEQ ID NO: 265083 - DNA, 25 bp, Homo sapien
atattttttacaagccccagctcct

SEQ ID NO: 265084 - DNA, 25 bp, Homo sapien
tccaccatgggctgcagtatagaca

SEQ ID NO: 265085 - DNA, 25 bp, Homo sapien
tgggctgcagtatagacagacagat

SEQ ID NO: 265086 - DNA, 25 bp, Homo sapien
acagacagatggaccctggctgtac

SEQ ID NO: 265087 - DNA, 25 bp, Homo sapien
acagatggaccctggctgtacgaag

SEQ ID NO: 265088 - DNA, 25 bp, Homo sapien
tggaccctggctgtacgaagggcca

SEQ ID NO: 265089 - DNA, 25 bp, Homo sapien
tggggttcaggcattgtcttttttc

SEQ ID NO: 265090 - DNA, 25 bp, Homo sapien
tttttcctccttgtatataagaatg

SEQ ID NO: 265091 - DNA, 25 bp, Homo sapien
gaatgtatatttgatgcctcataaa

SEQ ID NO: 265092 - DNA, 25 bp, Homo sapien
tgatgcctcataaaagaccttgtgc

SEQ ID NO: 265093 - DNA, 25 bp, Homo sapien
ggtggtaagcttcaaatatcaaatt

SEQ ID NO: 265094 - DNA, 25 bp, Homo sapien
tatcaaattttgttctgccgtgtag

SEQ ID NO: 265095 - DNA, 25 bp, Homo sapien
caaattttgttctgccgtgtagaaa

SEQ ID NO: 265096 - DNA, 25 bp, Homo sapien
ttagaaggactgcaaccctatgtga

SEQ ID NO: 265097 - DNA, 25 bp, Homo sapien
gaaggactgcaaccctatgtgacat

SEQ ID NO: 265098 - DNA, 25 bp, Homo sapien
ggactgcaaccctatgtgacattat

SEQ ID NO: 265099 - DNA, 25 bp, Homo sapien
gcaaccctatgtgacattataactt

SEQ ID NO: 265100 - DNA, 25 bp, Homo sapien
ctatgtgacattataacttacttaa

SEQ ID NO: 265101 - DNA, 25 bp, Homo sapien
aagaataagacttgccttatggaaa

SEQ ID NO: 265102 - DNA, 25 bp, Homo sapien
gataccacttgttaaatcaggcatg

SEQ ID NO: 265103 - DNA, 25 bp, Homo sapien
acttgttaaatcaggcatgggagga

SEQ ID NO: 265104 - DNA, 25 bp, Homo sapien
gccagtcacccagagatcatgttaa

SEQ ID NO: 265105 - DNA, 25 bp, Homo sapien
aatgcacatctggttcagcaggcct

SEQ ID NO: 265106 - DNA, 25 bp, Homo sapien
gttcagcaggcctaggtttctgtat

SEQ ID NO: 265107 - DNA, 25 bp, Homo sapien
ggcctaggtttctgtatgttataga

SEQ ID NO: 265108 - DNA, 25 bp, Homo sapien
gttcaaagaagacaaactctagcca

SEQ ID NO: 265109 - DNA, 25 bp, Homo sapien
ttctggcttcctggcagcaattccg

SEQ ID NO: 265110 - DNA, 25 bp, Homo sapien
agcaattccggcctgagattccttc

SEQ ID NO: 265111 - DNA, 25 bp, Homo sapien
tgagattccttctctgtgcatactt

SEQ ID NO: 265112 - DNA, 25 bp, Homo sapien
agcagactcccttgggcaatacttc

SEQ ID NO: 265113 - DNA, 25 bp, Homo sapien
cttgggcaatacttcacagacatga

SEQ ID NO: 265114 - DNA, 25 bp, Homo sapien
acagacatgactgtgcacgccagtc

SEQ ID NO: 265115 - DNA, 25 bp, Homo sapien
caaatgcagcgtgagaatccataca

SEQ ID NO: 265116 - DNA, 25 bp, Homo sapien
tacacgtaatccatattcaccttcc

SEQ ID NO: 265117 - DNA, 25 bp, Homo sapien
ccatccatcccgcagaagaggcatg

SEQ ID NO: 265118 - DNA, 25 bp, Homo sapien
agaggcatggtgacacccaggctac

SEQ ID NO: 265119 - DNA, 25 bp, Homo sapien
ccaggctactgtccatgcttgagag

SEQ ID NO: 265120 - DNA, 25 bp, Homo sapien
ccatgcttgagaggacgtatttgaa

SEQ ID NO: 265121 - DNA, 25 bp, Homo sapien
gaaggttctgttactacaagttggg

SEQ ID NO: 265122 - DNA, 25 bp, Homo sapien
ttgggaatattcacggacatgcctg

SEQ ID NO: 265123 - DNA, 25 bp, Homo sapien
tgaataccccggctgtaactcacac

SEQ ID NO: 265124 - DNA, 25 bp, Homo sapien
gtaactcacacgtggtctgtgtaag

SEQ ID NO: 265125 - DNA, 25 bp, Homo sapien
tctgtgtaagtggattaacctcggg

SEQ ID NO: 265126 - DNA, 25 bp, Homo sapien
attgtggtaagaccctcggtgacac

SEQ ID NO: 265127 - DNA, 25 bp, Homo sapien
aagtccttgggcctcctgtactcac

SEQ ID NO: 265128 - DNA, 25 bp, Homo sapien
gaagcacaggttagcgtgtcacctt

SEQ ID NO: 265129 - DNA, 25 bp, Homo sapien
gtcaccttgggcaaagctctcagca

SEQ ID NO: 265130 - DNA, 25 bp, Homo sapien
aaaggaggcatgaatatctacatca

SEQ ID NO: 265131 - DNA, 25 bp, Homo sapien
atctacatcatcagtttgccatgag

SEQ ID NO: 265132 - DNA, 25 bp, Homo sapien
cctcctgtactcacattacctggaa

SEQ ID NO: 265133 - DNA, 25 bp, Homo sapien
gcagagcctggcatgtagtttgtgc

SEQ ID NO: 265134 - DNA, 25 bp, Homo sapien
cctggcatgtagtttgtgctcagtg

SEQ ID NO: 265135 - DNA, 25 bp, Homo sapien
ccaacccagacggactgaatcaaaa

SEQ ID NO: 265136 - DNA, 25 bp, Homo sapien
gaatcaaaatcttcattgtggtaag

SEQ ID NO: 265137 - DNA, 25 bp, Homo sapien
gcaacccagctctataccaaagatt

SEQ ID NO: 265138 - DNA, 25 bp, Homo sapien
gagcctccatgcagacagctgtctc

SEQ ID NO: 265139 - DNA, 25 bp, Homo sapien
tgcccacaaattccagtcacttcaa

SEQ ID NO: 265140 - DNA, 25 bp, Homo sapien
ggtaatcttttgttcacccaactca

SEQ ID NO: 265141 - DNA, 25 bp, Homo sapien
aactgtgttgaactctgctctgtct

SEQ ID NO: 265142 - DNA, 25 bp, Homo sapien
ttctagcttgggaagaccaccattt

SEQ ID NO: 265143 - DNA, 25 bp, Homo sapien
ggaagaccaccattttctactggag

SEQ ID NO: 265144 - DNA, 25 bp, Homo sapien
accattttctactggagctctacct

SEQ ID NO: 265145 - DNA, 25 bp, Homo sapien
tacctcccagggtcaaagtctgaaa

SEQ ID NO: 265146 - DNA, 25 bp, Homo sapien
aactcacttcctacagtagccactt

SEQ ID NO: 265147 - DNA, 25 bp, Homo sapien
agttctcgtggcgatttgttctaca

SEQ ID NO: 265148 - DNA, 25 bp, Homo sapien
gataacagcacctgcctcattgcgt

SEQ ID NO: 265149 - DNA, 25 bp, Homo sapien
aacagcacctgcctcattgcgttgt

SEQ ID NO: 265150 - DNA, 25 bp, Homo sapien
agcacctgcctcattgcgttgtgaa

SEQ ID NO: 265151 - DNA, 25 bp, Homo sapien
acctgcctcattgcgttgtgaagaa

SEQ ID NO: 265152 - DNA, 25 bp, Homo sapien
tgcctcattgcgttgtgaagaagat

SEQ ID NO: 265153 - DNA, 25 bp, Homo sapien
cattgcgttgtgaagaagatgaaat

SEQ ID NO: 265154 - DNA, 25 bp, Homo sapien
gatgaaatgtttagcccggtgccca

SEQ ID NO: 265155 - DNA, 25 bp, Homo sapien
atgaaatgtttagcccggtgcccaa

SEQ ID NO: 265156 - DNA, 25 bp, Homo sapien
tgacctccaggacaagtgatctccc

SEQ ID NO: 265157 - DNA, 25 bp, Homo sapien
gacctccaggacaagtgatctccca

SEQ ID NO: 265158 - DNA, 25 bp, Homo sapien
tgggactacagctcaacaacgcccc

SEQ ID NO: 265159 - DNA, 25 bp, Homo sapien
gggcacttgtcttagctggaaaagg

SEQ ID NO: 265160 - DNA, 25 bp, Homo sapien
gggctgatgcctttcagtacgagtt

SEQ ID NO: 265161 - DNA, 25 bp, Homo sapien
gatgcctttcagtacgagtttcact

SEQ ID NO: 265162 - DNA, 25 bp, Homo sapien
gtattatttttcttgttgatgctaa

SEQ ID NO: 265163 - DNA, 25 bp, Homo sapien
ttcttgttgatgctaagtactcaaa

SEQ ID NO: 265164 - DNA, 25 bp, Homo sapien
aaaagcaattgcactttttctcatt

SEQ ID NO: 265165 - DNA, 25 bp, Homo sapien
tctgccctctcttggtctttacatt

SEQ ID NO: 265166 - DNA, 25 bp, Homo sapien
tctcttggtctttacattctgtcta

SEQ ID NO: 265167 - DNA, 25 bp, Homo sapien
ggtctttacattctgtctagcattt

SEQ ID NO: 265168 - DNA, 25 bp, Homo sapien
gtctagcatttaacgcaaaaagtca

SEQ ID NO: 265169 - DNA, 25 bp, Homo sapien
gtcagtttacattcagttaacacat

SEQ ID NO: 265170 - DNA, 25 bp, Homo sapien
agaagcttgtcacttactggggacc

SEQ ID NO: 265171 - DNA, 25 bp, Homo sapien
tggggaccctgatgagtttctctct

SEQ ID NO: 265172 - DNA, 25 bp, Homo sapien
tgttgtcctgccttatccctaatct

SEQ ID NO: 265173 - DNA, 25 bp, Homo sapien
tttaaaaacagtatccctctcctct

SEQ ID NO: 265174 - DNA, 25 bp, Homo sapien
tatccctaatctagctccctgatca

SEQ ID NO: 265175 - DNA, 25 bp, Homo sapien
catttgaatgtaaccctaattggac

SEQ ID NO: 265176 - DNA, 25 bp, Homo sapien
gaattttctccctttcagtatggac

SEQ ID NO: 265177 - DNA, 25 bp, Homo sapien
tctccctttcagtatggacaaaatc

SEQ ID NO: 265178 - DNA, 25 bp, Homo sapien
ggacaaaatcaacaaccatgaatca

SEQ ID NO: 265179 - DNA, 25 bp, Homo sapien
aaccatgaatcagagacttttagag

SEQ ID NO: 265180 - DNA, 25 bp, Homo sapien
tcagagacttttagaggatgggtag

SEQ ID NO: 265181 - DNA, 25 bp, Homo sapien
tcctctgatctgttctttcttggaa

SEQ ID NO: 265182 - DNA, 25 bp, Homo sapien
cttggaacaccacccaagaacgtca

SEQ ID NO: 265183 - DNA, 25 bp, Homo sapien
aagaacgtcacctcctccatcagat

SEQ ID NO: 265184 - DNA, 25 bp, Homo sapien
tccatcagattgtgagctcctggag

SEQ ID NO: 265185 - DNA, 25 bp, Homo sapien
aggagctgtgtccttctattcatct

SEQ ID NO: 265186 - DNA, 25 bp, Homo sapien
tctattcatcttcctatccccagaa

SEQ ID NO: 265187 - DNA, 25 bp, Homo sapien
agaaccttgcacagatcctggaatg

SEQ ID NO: 265188 - DNA, 25 bp, Homo sapien
gatcctggaatgtggtaggtgctca

SEQ ID NO: 265189 - DNA, 25 bp, Homo sapien
aagaaccatgaaactgtattttgag

SEQ ID NO: 265190 - DNA, 25 bp, Homo sapien
gagtttctatgttatagcagtcagc

SEQ ID NO: 265191 - DNA, 25 bp, Homo sapien
agcagtcagcaaatcctattaaata

SEQ ID NO: 265192 - DNA, 25 bp, Homo sapien
ctgctggccaccttgagttctgtgc

SEQ ID NO: 265193 - DNA, 25 bp, Homo sapien
gctggccaccttgagttctgtgcct

SEQ ID NO: 265194 - DNA, 25 bp, Homo sapien
cctcccttgtgcatttcaacaggtg

SEQ ID NO: 265195 - DNA, 25 bp, Homo sapien
gtgcatttcaacaggtgccactgtc

SEQ ID NO: 265196 - DNA, 25 bp, Homo sapien
tgcatttcaacaggtgccactgtcc

SEQ ID NO: 265197 - DNA, 25 bp, Homo sapien
aacaggtgccactgtcccctacttt

SEQ ID NO: 265198 - DNA, 25 bp, Homo sapien
tcccctactttgcagagggctccgg

SEQ ID NO: 265199 - DNA, 25 bp, Homo sapien
agtgcccactaccagcaccttgatt

SEQ ID NO: 265200 - DNA, 25 bp, Homo sapien
actaccagcaccttgattcttcctc

SEQ ID NO: 265201 - DNA, 25 bp, Homo sapien
tcttcctccagagtacagttcttgg

SEQ ID NO: 265202 - DNA, 25 bp, Homo sapien
gagtacagttcttggggctacccct

SEQ ID NO: 265203 - DNA, 25 bp, Homo sapien
atatattttttacaagccccagctc

SEQ ID NO: 265204 - DNA, 25 bp, Homo sapien
atattttttacaagccccagctcct

SEQ ID NO: 265205 - DNA, 25 bp, Homo sapien
tccaccatgggctgcagtatagaca

SEQ ID NO: 265206 - DNA, 25 bp, Homo sapien
tgggctgcagtatagacagacagat

SEQ ID NO: 265207 - DNA, 25 bp, Homo sapien
acagacagatggaccctggctgtac

SEQ ID NO: 265208 - DNA, 25 bp, Homo sapien
tggaccctggctgtacgaagggcca

SEQ ID NO: 265209 - DNA, 25 bp, Homo sapien
gggttcaggcattgtcttttttcct

SEQ ID NO: 265210 - DNA, 25 bp, Homo sapien
tgtcttttttcctccttgtatataa

SEQ ID NO: 265211 - DNA, 25 bp, Homo sapien
ttttcctccttgtatataagaatgt

SEQ ID NO: 265212 - DNA, 25 bp, Homo sapien
gaatgtatatttgatgcctcataaa

SEQ ID NO: 265213 - DNA, 25 bp, Homo sapien
tgatgcctcataaaagaccttgtgc

SEQ ID NO: 265214 - DNA, 25 bp, Homo sapien
ggaaaatggcattcatcagactact

SEQ ID NO: 265215 - DNA, 25 bp, Homo sapien
tctcttatttcatgtgtaactcctt

SEQ ID NO: 265216 - DNA, 25 bp, Homo sapien
tgctgcacacggagggccttatcag

SEQ ID NO: 265217 - DNA, 25 bp, Homo sapien
gagggccttatcagacacaggacag

SEQ ID NO: 265218 - DNA, 25 bp, Homo sapien
agcactcaagtgctcatagcctttc

SEQ ID NO: 265219 - DNA, 25 bp, Homo sapien
aagcccatccattctgtgcactgtt

SEQ ID NO: 265220 - DNA, 25 bp, Homo sapien
attctgtgcactgttggccccaggg

SEQ ID NO: 265221 - DNA, 25 bp, Homo sapien
gcatgtccatcgcaggcttcaatgt

SEQ ID NO: 265222 - DNA, 25 bp, Homo sapien
atcgcaggcttcaatgtgtctggca

SEQ ID NO: 265223 - DNA, 25 bp, Homo sapien
gaagtgcgaatttgagtgaccgtct

SEQ ID NO: 265224 - DNA, 25 bp, Homo sapien
gagtgaccgtctgtacgtccaaaat

SEQ ID NO: 265225 - DNA, 25 bp, Homo sapien
ctgcttactgctgcaggtggaggcc

SEQ ID NO: 265226 - DNA, 25 bp, Homo sapien
aggtggaggccccatgccggaggga

SEQ ID NO: 265227 - DNA, 25 bp, Homo sapien
aagcccaagcttgtgccggtcatta

SEQ ID NO: 265228 - DNA, 25 bp, Homo sapien
aagcttgtgccggtcattacggcct

SEQ ID NO: 265229 - DNA, 25 bp, Homo sapien
ggtcattacggccttgcctagctgg

SEQ ID NO: 265230 - DNA, 25 bp, Homo sapien
tacggccttgcctagctggcaggga

SEQ ID NO: 265231 - DNA, 25 bp, Homo sapien
gctggcagggacagctgcgtgtgat

SEQ ID NO: 265232 - DNA, 25 bp, Homo sapien
gtggagatgccagatgccgcctgcc

SEQ ID NO: 265233 - DNA, 25 bp, Homo sapien
tgccgcctgccctgtgaggacggct

SEQ ID NO: 265234 - DNA, 25 bp, Homo sapien
gggacattttcattgggtcctcgtg

SEQ ID NO: 265235 - DNA, 25 bp, Homo sapien
ttttcattgggtcctcgtggtccgt

SEQ ID NO: 265236 - DNA, 25 bp, Homo sapien
gggtatgcaattcttgtagaagagc

SEQ ID NO: 265237 - DNA, 25 bp, Homo sapien
aataatccaagagtggtgttccctt

SEQ ID NO: 265238 - DNA, 25 bp, Homo sapien
aagagtggtgttcccttgagagcct

SEQ ID NO: 265239 - DNA, 25 bp, Homo sapien
agtggtgttcccttgagagccttgg

SEQ ID NO: 265240 - DNA, 25 bp, Homo sapien
gtcccaatttagttcaggtgtgtgt

SEQ ID NO: 265241 - DNA, 25 bp, Homo sapien
ataattctacttacctttcaggatg

SEQ ID NO: 265242 - DNA, 25 bp, Homo sapien
acctttcaggatgttattagagtca

SEQ ID NO: 265243 - DNA, 25 bp, Homo sapien
ggtgtgtgtacctgatctaaacatt

SEQ ID NO: 265244 - DNA, 25 bp, Homo sapien
gtgtacctgatctaaacatttttgg

SEQ ID NO: 265245 - DNA, 25 bp, Homo sapien
aacatttttggtgaaaggatcagat

SEQ ID NO: 265246 - DNA, 25 bp, Homo sapien
ggatcagattatagggcagaaacat

SEQ ID NO: 265247 - DNA, 25 bp, Homo sapien
cattttcacatggattgggatcaca

SEQ ID NO: 265248 - DNA, 25 bp, Homo sapien
gattgggatcacaaatatcaccttt

SEQ ID NO: 265249 - DNA, 25 bp, Homo sapien
acctccacaacactagaacagttgg

SEQ ID NO: 265250 - DNA, 25 bp, Homo sapien
caaatatcacctttgccgaactggg

SEQ ID NO: 265251 - DNA, 25 bp, Homo sapien
ggacaccgaggctgagcccgaccaa

SEQ ID NO: 265252 - DNA, 25 bp, Homo sapien
gaccaagagccagacggctaccgag

SEQ ID NO: 265253 - DNA, 25 bp, Homo sapien
agacggctaccgagcgcttcatgat

SEQ ID NO: 265254 - DNA, 25 bp, Homo sapien
tcatgatcccgtctcccggacgtga

SEQ ID NO: 265255 - DNA, 25 bp, Homo sapien
agccatctggacactcacaggaaaa

SEQ ID NO: 265256 - DNA, 25 bp, Homo sapien
aaaggaaccatcagccaatcctggc

SEQ ID NO: 265257 - DNA, 25 bp, Homo sapien
ggcaaacagatacctccattttcac

SEQ ID NO: 265258 - DNA, 25 bp, Homo sapien
agggcacagattgaccactgctcac

SEQ ID NO: 265259 - DNA, 25 bp, Homo sapien
cactgctcaccatgctgagtaggag

SEQ ID NO: 265260 - DNA, 25 bp, Homo sapien
ggaactgaagcattggtgcacttct

SEQ ID NO: 265261 - DNA, 25 bp, Homo sapien
ggtgcacttctactagattccgttc

SEQ ID NO: 265262 - DNA, 25 bp, Homo sapien
gattccgttctgtcttagtggccaa

SEQ ID NO: 265263 - DNA, 25 bp, Homo sapien
cttagtggccaacaatcaactgatt

SEQ ID NO: 265264 - DNA, 25 bp, Homo sapien
gtatctttctattttgaccacttgt

SEQ ID NO: 265265 - DNA, 25 bp, Homo sapien
ttgtcttaacactcccctgtgcttt

SEQ ID NO: 265266 - DNA, 25 bp, Homo sapien
gaaattccaattcatgtatgtaaac

SEQ ID NO: 265267 - DNA, 25 bp, Homo sapien
ccagatttccattgtgggttctatg

SEQ ID NO: 265268 - DNA, 25 bp, Homo sapien
gttctatggtgcaaaatgggagcca

SEQ ID NO: 265269 - DNA, 25 bp, Homo sapien
ttttctttcaaggagagtagaccaa

SEQ ID NO: 265270 - DNA, 25 bp, Homo sapien
agtagaccaacgtgtgcactgccag

SEQ ID NO: 265271 - DNA, 25 bp, Homo sapien
cctccctggcatggagggttggact

SEQ ID NO: 265272 - DNA, 25 bp, Homo sapien
ttggactggcatggacaagagaagc

SEQ ID NO: 265273 - DNA, 25 bp, Homo sapien
aagcaagccaactggacttgttccc

SEQ ID NO: 265274 - DNA, 25 bp, Homo sapien
gctgggacccagcaaatccacaatt

SEQ ID NO: 265275 - DNA, 25 bp, Homo sapien
cagcaaatccacaattccagtcttc

SEQ ID NO: 265276 - DNA, 25 bp, Homo sapien
acaattccagtcttccctgctgtat

SEQ ID NO: 265277 - DNA, 25 bp, Homo sapien
ttccctgctgtatggcggatatgga

SEQ ID NO: 265278 - DNA, 25 bp, Homo sapien
gatggaaagcagcaaggccttgcct

SEQ ID NO: 265279 - DNA, 25 bp, Homo sapien
aaggccttgcctgccaagtgggaga

SEQ ID NO: 265280 - DNA, 25 bp, Homo sapien
tttagtatctgtgcaatgaccttga

SEQ ID NO: 265281 - DNA, 25 bp, Homo sapien
gaccttgatatccaggtgcaatcac

SEQ ID NO: 265282 - DNA, 25 bp, Homo sapien
ggtgcaatcacaatcttttctgata

SEQ ID NO: 265283 - DNA, 25 bp, Homo sapien
ttctgatagacttgaaatcctcact

SEQ ID NO: 265284 - DNA, 25 bp, Homo sapien
gaaatcctcacttaactttgtcaag

SEQ ID NO: 265285 - DNA, 25 bp, Homo sapien
cagcaggtcctgaaataagttcatt

SEQ ID NO: 265286 - DNA, 25 bp, Homo sapien
gtttcgtatgtgaatattgcttgct

SEQ ID NO: 265287 - DNA, 25 bp, Homo sapien
tgaatattgcttgctttgttttgtc

SEQ ID NO: 265288 - DNA, 25 bp, Homo sapien
gcaatgggtgagtattctggtatcc

SEQ ID NO: 265289 - DNA, 25 bp, Homo sapien
attctggtatcctttgttcatcata

SEQ ID NO: 265290 - DNA, 25 bp, Homo sapien
tcctttgttcatcatacacatcatg

SEQ ID NO: 265291 - DNA, 25 bp, Homo sapien
ttctctactgaatggcaatagctgt

SEQ ID NO: 265292 - DNA, 25 bp, Homo sapien
ggcaatagctgttttatagcagaga

SEQ ID NO: 265293 - DNA, 25 bp, Homo sapien
gtaacagttattagagtggagagct

SEQ ID NO: 265294 - DNA, 25 bp, Homo sapien
gagtggagagcttggtcagaaaaac

SEQ ID NO: 265295 - DNA, 25 bp, Homo sapien
gtagaattcacactaattgctggaa

SEQ ID NO: 265296 - DNA, 25 bp, Homo sapien
attgctggaattacattttgctaca

SEQ ID NO: 265297 - DNA, 25 bp, Homo sapien
ggaattacattttgctacagtttta

SEQ ID NO: 265298 - DNA, 25 bp, Homo sapien
acattttgctacagttttattaaga

SEQ ID NO: 265299 - DNA, 25 bp, Homo sapien
tagtgactgattatgtgatgggaat

SEQ ID NO: 265300 - DNA, 25 bp, Homo sapien
ggaaatggttgccactttctctact

SEQ ID NO: 265301 - DNA, 25 bp, Homo sapien
ggttgccactttctctactgaatgg

SEQ ID NO: 265302 - DNA, 25 bp, Homo sapien
cttagtggctattttcataatcccc

SEQ ID NO: 265303 - DNA, 25 bp, Homo sapien
gtggaaaaacattataaccttgcaa

SEQ ID NO: 265304 - DNA, 25 bp, Homo sapien
aagatgagggctactggttcagggt

SEQ ID NO: 265305 - DNA, 25 bp, Homo sapien
agggttctcatcctgattttgacag

SEQ ID NO: 265306 - DNA, 25 bp, Homo sapien
tcctgattttgacagcacttctcac

SEQ ID NO: 265307 - DNA, 25 bp, Homo sapien
acttctcactgtccgatcaggtgat

SEQ ID NO: 265308 - DNA, 25 bp, Homo sapien
tgtccgatcaggtgatcaacttgtc

SEQ ID NO: 265309 - DNA, 25 bp, Homo sapien
atcaacttgtcctttgtcttagctc

SEQ ID NO: 265310 - DNA, 25 bp, Homo sapien
acttgtcctttgtcttagctctggg

SEQ ID NO: 265311 - DNA, 25 bp, Homo sapien
ctttgtcttagctctgggtgtgtgt

SEQ ID NO: 265312 - DNA, 25 bp, Homo sapien
gtgtggcctatgcatagcaataata

SEQ ID NO: 265313 - DNA, 25 bp, Homo sapien
taaacagttgtgaaccaagatctat

SEQ ID NO: 265314 - DNA, 25 bp, Homo sapien
ttgtgaaccaagatctataaagcga

SEQ ID NO: 265315 - DNA, 25 bp, Homo sapien
gagatatatatacttgtggttttca

SEQ ID NO: 265316 - DNA, 25 bp, Homo sapien
tgtggttttcaaattggactttcaa

SEQ ID NO: 265317 - DNA, 25 bp, Homo sapien
taaatctgtccctgagagtgtctct

SEQ ID NO: 265318 - DNA, 25 bp, Homo sapien
ctgtccctgagagtgtctctgataa

SEQ ID NO: 265319 - DNA, 25 bp, Homo sapien
gagtgtctctgataaaagggcaaat

SEQ ID NO: 265320 - DNA, 25 bp, Homo sapien
aagggcaaatctgcacctatgtagc

SEQ ID NO: 265321 - DNA, 25 bp, Homo sapien
aatctgcacctatgtagctctgcat

SEQ ID NO: 265322 - DNA, 25 bp, Homo sapien
atgtagctctgcatctcctgtcttt

SEQ ID NO: 265323 - DNA, 25 bp, Homo sapien
ctgtcttttcaggtttgtcatcaga

SEQ ID NO: 265324 - DNA, 25 bp, Homo sapien
gcctctcaaagacgatgtgctactg

SEQ ID NO: 265325 - DNA, 25 bp, Homo sapien
gatgtgctactgttggagacacgag

SEQ ID NO: 265326 - DNA, 25 bp, Homo sapien
aacagatccctctgtgccttggaac

SEQ ID NO: 265327 - DNA, 25 bp, Homo sapien
ttggaacccagtggctgtacttcac

SEQ ID NO: 265328 - DNA, 25 bp, Homo sapien
tgtacttcactacccagcaaagcct

SEQ ID NO: 265329 - DNA, 25 bp, Homo sapien
gctcgccttggagagtacttactac

SEQ ID NO: 265330 - DNA, 25 bp, Homo sapien
gtacttactacaagacctgcagtca

SEQ ID NO: 265331 - DNA, 25 bp, Homo sapien
gccagtgtctgcagctatgggacga

SEQ ID NO: 265332 - DNA, 25 bp, Homo sapien
ctgcagctatgggacgatgacttgg

SEQ ID NO: 265333 - DNA, 25 bp, Homo sapien
acttgggagcgctatgggcctgccc

SEQ ID NO: 265334 - DNA, 25 bp, Homo sapien
gacaaatacatccacaagcgctggg

SEQ ID NO: 265335 - DNA, 25 bp, Homo sapien
gaccttgctactcaagtatgatttg

SEQ ID NO: 265336 - DNA, 25 bp, Homo sapien
atgatttgtgaaccaacagcatcaa

SEQ ID NO: 265337 - DNA, 25 bp, Homo sapien
aacagcatcaacatcgtattgaagt

SEQ ID NO: 265338 - DNA, 25 bp, Homo sapien
agaagtttgggctctgctccaaacc

SEQ ID NO: 265339 - DNA, 25 bp, Homo sapien
gctctgctccaaacctattaaatct

SEQ ID NO: 265340 - DNA, 25 bp, Homo sapien
atctacattgcaacaaagtccccag

SEQ ID NO: 265341 - DNA, 25 bp, Homo sapien
tcacaggcactttgtagtttgagaa

SEQ ID NO: 265342 - DNA, 25 bp, Homo sapien
aagattactgtgttgtcttcacatg

SEQ ID NO: 265343 - DNA, 25 bp, Homo sapien
gttgtcttcacatgaatgaggctat

SEQ ID NO: 265344 - DNA, 25 bp, Homo sapien
atgttttctgacaagggacctctgc

SEQ ID NO: 265345 - DNA, 25 bp, Homo sapien
gacaagggacctctgcttacaaggt

SEQ ID NO: 265346 - DNA, 25 bp, Homo sapien
ggaccactgtacaacttctgaagga

SEQ ID NO: 265347 - DNA, 25 bp, Homo sapien
aggagaaaggttactctcatcagct

SEQ ID NO: 265348 - DNA, 25 bp, Homo sapien
gaacttgttgacatgcagcacgtga

SEQ ID NO: 265349 - DNA, 25 bp, Homo sapien
gcagcacgtgaatggcacatttgat

SEQ ID NO: 265350 - DNA, 25 bp, Homo sapien
gatgtagttggctggtgacttttaa

SEQ ID NO: 265351 - DNA, 25 bp, Homo sapien
aatcgttcacagttaggtattgcag

SEQ ID NO: 265352 - DNA, 25 bp, Homo sapien
cccagtgaagcgtggctccaggata

SEQ ID NO: 265353 - DNA, 25 bp, Homo sapien
ggctccaggataatgaggcctccat

SEQ ID NO: 265354 - DNA, 25 bp, Homo sapien
gactccactccctcgaagattgggt

SEQ ID NO: 265355 - DNA, 25 bp, Homo sapien
agattgggtgcatactctgccaggt

SEQ ID NO: 265356 - DNA, 25 bp, Homo sapien
tgccaggtccacagatcgtaaccac

SEQ ID NO: 265357 - DNA, 25 bp, Homo sapien
acgtgtaacaaatacatgtacccat

SEQ ID NO: 265358 - DNA, 25 bp, Homo sapien
agcagtcagtgcacataagagtaat

SEQ ID NO: 265359 - DNA, 25 bp, Homo sapien
taatatgcttgttatactgtgtggc

SEQ ID NO: 265360 - DNA, 25 bp, Homo sapien
tgcttgttatactgtgtggctacac

SEQ ID NO: 265361 - DNA, 25 bp, Homo sapien
tatactgtgtggctacactggttaa

SEQ ID NO: 265362 - DNA, 25 bp, Homo sapien
gtgtggctacactggttaaggaaat

SEQ ID NO: 265363 - DNA, 25 bp, Homo sapien
gctacactggttaaggaaattcctg

SEQ ID NO: 265364 - DNA, 25 bp, Homo sapien
ggacaggaaatgttaccaacccata

SEQ ID NO: 265365 - DNA, 25 bp, Homo sapien
tgttaccaacccatagaaatgatga

SEQ ID NO: 265366 - DNA, 25 bp, Homo sapien
gataccccaaatactctgacattat

SEQ ID NO: 265367 - DNA, 25 bp, Homo sapien
atactctgacattattatacatttt

SEQ ID NO: 265368 - DNA, 25 bp, Homo sapien
agtttgcctctgttgctactgctat

SEQ ID NO: 265369 - DNA, 25 bp, Homo sapien
ctgttgctactgctattcttttcaa

SEQ ID NO: 265370 - DNA, 25 bp, Homo sapien
ttgtaaatcttgttctttccaccct

SEQ ID NO: 265371 - DNA, 25 bp, Homo sapien
tgttatacactcacacatgccattc

SEQ ID NO: 265372 - DNA, 25 bp, Homo sapien
tacactcacacatgccattctgcag

SEQ ID NO: 265373 - DNA, 25 bp, Homo sapien
ccattctgcagattattcattgatt

SEQ ID NO: 265374 - DNA, 25 bp, Homo sapien
atctaagacttaggagtatcaagaa

SEQ ID NO: 265375 - DNA, 25 bp, Homo sapien
tttccaccctactggcaaagacatt

SEQ ID NO: 265376 - DNA, 25 bp, Homo sapien
aagacattgggtggtaaatttctgt

SEQ ID NO: 265377 - DNA, 25 bp, Homo sapien
ctagaacatcagtcataggccagtt

SEQ ID NO: 265378 - DNA, 25 bp, Homo sapien
ataggccagtttgcctctgttgcta

SEQ ID NO: 265379 - DNA, 25 bp, Homo sapien
ttcaggcccttggtgtgagagccca

SEQ ID NO: 265380 - DNA, 25 bp, Homo sapien
gaggacagcttgtctgctgctccaa

SEQ ID NO: 265381 - DNA, 25 bp, Homo sapien
gtctgctgctccaaatcacttagat

SEQ ID NO: 265382 - DNA, 25 bp, Homo sapien
tcacttagatctgattcctgttttg

SEQ ID NO: 265383 - DNA, 25 bp, Homo sapien
attcctgttttgaaagtcctgccct

SEQ ID NO: 265384 - DNA, 25 bp, Homo sapien
gtagcccagcccatctaaatggaag

SEQ ID NO: 265385 - DNA, 25 bp, Homo sapien
atggaagctgggaattgcccctcac

SEQ ID NO: 265386 - DNA, 25 bp, Homo sapien
cctgtgtcctgtccagctgaagctt

SEQ ID NO: 265387 - DNA, 25 bp, Homo sapien
tgaagcttttgcagcactttacctc

SEQ ID NO: 265388 - DNA, 25 bp, Homo sapien
ttttgcagcactttacctctctgaa

SEQ ID NO: 265389 - DNA, 25 bp, Homo sapien
cagtggtggtcagtttttactgcaa

SEQ ID NO: 265390 - DNA, 25 bp, Homo sapien
attttctggttctggattttgctag

SEQ ID NO: 265391 - DNA, 25 bp, Homo sapien
tgcggttttccacctggacagatac

SEQ ID NO: 265392 - DNA, 25 bp, Homo sapien
atgaagcacaacttcgttgccacgt

SEQ ID NO: 265393 - DNA, 25 bp, Homo sapien
gttgccacgtctcccgtgaggtttt

SEQ ID NO: 265394 - DNA, 25 bp, Homo sapien
tcccgtgaggttttccccgtgatat

SEQ ID NO: 265395 - DNA, 25 bp, Homo sapien
gttttccccgtgatattagactctg

SEQ ID NO: 265396 - DNA, 25 bp, Homo sapien
cccgtgatattagactctggagcca

SEQ ID NO: 265397 - DNA, 25 bp, Homo sapien
agcctgggttcaactgccttttcta

SEQ ID NO: 265398 - DNA, 25 bp, Homo sapien
gacgttgagcgggtcacttgactgt

SEQ ID NO: 265399 - DNA, 25 bp, Homo sapien
gtcacttgactgtcgtgtgcattgt

SEQ ID NO: 265400 - DNA, 25 bp, Homo sapien
actgtcgtgtgcattgttttcccca

SEQ ID NO: 265401 - DNA, 25 bp, Homo sapien
atagccaggcaattttccagccttc

SEQ ID NO: 265402 - DNA, 25 bp, Homo sapien
tttccagccttctttgagttgggta

SEQ ID NO: 265403 - DNA, 25 bp, Homo sapien
aattctggccattacttccaatgtg

SEQ ID NO: 265404 - DNA, 25 bp, Homo sapien
tgtgcaatttctatacctggctcat

SEQ ID NO: 265405 - DNA, 25 bp, Homo sapien
tggctcataaaaccctcccatgtgc

SEQ ID NO: 265406 - DNA, 25 bp, Homo sapien
gtgcagcctttcatgttgacattaa

SEQ ID NO: 265407 - DNA, 25 bp, Homo sapien
cttgggaagctatgtgttacacaga

SEQ ID NO: 265408 - DNA, 25 bp, Homo sapien
tacacagagtaaatcaccagaagcc

SEQ ID NO: 265409 - DNA, 25 bp, Homo sapien
tgtcatttgcaactcccacttgtat

SEQ ID NO: 265410 - DNA, 25 bp, Homo sapien
gcaactcccacttgtatttgtacga

SEQ ID NO: 265411 - DNA, 25 bp, Homo sapien
gtatttgtacgaggcagttggataa

SEQ ID NO: 265412 - DNA, 25 bp, Homo sapien
caagtaggcattgtgtgttcaagat

SEQ ID NO: 265413 - DNA, 25 bp, Homo sapien
gcattgtgtgttcaagattcagact

SEQ ID NO: 265414 - DNA, 25 bp, Homo sapien
aaagacgttgatgctagttatgaca

SEQ ID NO: 265415 - DNA, 25 bp, Homo sapien
aactcttggaaagcttcttgcaaac

SEQ ID NO: 265416 - DNA, 25 bp, Homo sapien
ggaaagcttcttgcaaacacacatt

SEQ ID NO: 265417 - DNA, 25 bp, Homo sapien
agagtatttacctcaacctggctta

SEQ ID NO: 265418 - DNA, 25 bp, Homo sapien
gtatttacctcaacctggcttatgt

SEQ ID NO: 265419 - DNA, 25 bp, Homo sapien
acctcaacctggcttatgttactta

SEQ ID NO: 265420 - DNA, 25 bp, Homo sapien
caacctggcttatgttacttatttt

SEQ ID NO: 265421 - DNA, 25 bp, Homo sapien
tagcgtctttaaggtatcgtttata

SEQ ID NO: 265422 - DNA, 25 bp, Homo sapien
caaatatcagtcaatgtagtcagtt

SEQ ID NO: 265423 - DNA, 25 bp, Homo sapien
gcgccaggatccaggcttgcaaacg

SEQ ID NO: 265424 - DNA, 25 bp, Homo sapien
aggatccaggcttgcaaacgtcccc

SEQ ID NO: 265425 - DNA, 25 bp, Homo sapien
ggcttgcaaacgtccccatgccatg

SEQ ID NO: 265426 - DNA, 25 bp, Homo sapien
atgccatgcgcaggcacatctcggg

SEQ ID NO: 265427 - DNA, 25 bp, Homo sapien
tgcgcaggcacatctcgggcggcca

SEQ ID NO: 265428 - DNA, 25 bp, Homo sapien
ccgccggtttccaaggatgcaacta

SEQ ID NO: 265429 - DNA, 25 bp, Homo sapien
attagctgcagtgccgcctaaacgc

SEQ ID NO: 265430 - DNA, 25 bp, Homo sapien
ggtttccaaggatgcaactatgaag

SEQ ID NO: 265431 - DNA, 25 bp, Homo sapien
aaacgcggcggcccgtgcagaacca

SEQ ID NO: 265432 - DNA, 25 bp, Homo sapien
tgcaactatgaagagacacagtggg

SEQ ID NO: 265433 - DNA, 25 bp, Homo sapien
tacgattgggtcgtgactgtggccc

SEQ ID NO: 265434 - DNA, 25 bp, Homo sapien
aactatattgatgggcttggatgaa

SEQ ID NO: 265435 - DNA, 25 bp, Homo sapien
agggcagctcatatttcgggagcca

SEQ ID NO: 265436 - DNA, 25 bp, Homo sapien
gccaggagaacgagtgagtgctaaa

SEQ ID NO: 265437 - DNA, 25 bp, Homo sapien
gtgctaaaacctcctgttttctgtg

SEQ ID NO: 265438 - DNA, 25 bp, Homo sapien
gtgttaaacattccgtccctgtttg

SEQ ID NO: 265439 - DNA, 25 bp, Homo sapien
tccctgtttgagacatcagtatgta

SEQ ID NO: 265440 - DNA, 25 bp, Homo sapien
taacttttgttgagtgtttagcagg

SEQ ID NO: 265441 - DNA, 25 bp, Homo sapien
gtttagcaggtactagggacatact

SEQ ID NO: 265442 - DNA, 25 bp, Homo sapien
gggacatactagtgttttccttaat

SEQ ID NO: 265443 - DNA, 25 bp, Homo sapien
gaaatgggtgctattattagcccca

SEQ ID NO: 265444 - DNA, 25 bp, Homo sapien
attagccccatcttatagatgaggc

SEQ ID NO: 265445 - DNA, 25 bp, Homo sapien
tgactaccgtcatgagcaggcggct

SEQ ID NO: 265446 - DNA, 25 bp, Homo sapien
tccaaggagatctaccagctgcgtg

SEQ ID NO: 265447 - DNA, 25 bp, Homo sapien
agctgcgtgggcagagccacaaaga

SEQ ID NO: 265448 - DNA, 25 bp, Homo sapien
aaagagcccatccaagtgcagacct

SEQ ID NO: 265449 - DNA, 25 bp, Homo sapien
atccaagtgcagacctttagggaga

SEQ ID NO: 265450 - DNA, 25 bp, Homo sapien
gatagcattcttcacaaggccaagg

SEQ ID NO: 265451 - DNA, 25 bp, Homo sapien
aggccaaggatcaacatacctcctc

SEQ ID NO: 265452 - DNA, 25 bp, Homo sapien
gccgacgacgtctgatggagtgcat

SEQ ID NO: 265453 - DNA, 25 bp, Homo sapien
tgcacatgaagtatttatccacctg

SEQ ID NO: 265454 - DNA, 25 bp, Homo sapien
atccacctgttttattttcatgaag

SEQ ID NO: 265455 - DNA, 25 bp, Homo sapien
catgaagttcttagactagctgaat

SEQ ID NO: 265456 - DNA, 25 bp, Homo sapien
ttagaataagtactggcgaaccatc

SEQ ID NO: 265457 - DNA, 25 bp, Homo sapien
tggcgaaccatctctgtggtcttgt

SEQ ID NO: 265458 - DNA, 25 bp, Homo sapien
ccatctctgtggtcttgtttaaaaa

SEQ ID NO: 265459 - DNA, 25 bp, Homo sapien
tggccatgcaggttgacaccgttgg

SEQ ID NO: 265460 - DNA, 25 bp, Homo sapien
gacaccgttggtaatttataatagc

SEQ ID NO: 265461 - DNA, 25 bp, Homo sapien
ataatagcttttgttcgatcccaac

SEQ ID NO: 265462 - DNA, 25 bp, Homo sapien
gcttttgttcgatcccaactttcca

SEQ ID NO: 265463 - DNA, 25 bp, Homo sapien
ccaatatttttcaaggagaggcttc

SEQ ID NO: 265464 - DNA, 25 bp, Homo sapien
gagaggcttcttgctgaattttgat

SEQ ID NO: 265465 - DNA, 25 bp, Homo sapien
ctgaattttgattctgcagctgaaa

SEQ ID NO: 265466 - DNA, 25 bp, Homo sapien
tctgcagctgaaatttaggacagtt

SEQ ID NO: 265467 - DNA, 25 bp, Homo sapien
ggggtcaagcatcctcctgtcttgg

SEQ ID NO: 265468 - DNA, 25 bp, Homo sapien
tgttgggattagaagcatgagccgc

SEQ ID NO: 265469 - DNA, 25 bp, Homo sapien
gccttttagtgggaggagttgccat

SEQ ID NO: 265470 - DNA, 25 bp, Homo sapien
ccttttagtgggaggagttgccatt

SEQ ID NO: 265471 - DNA, 25 bp, Homo sapien
cttttagtgggaggagttgccatta

SEQ ID NO: 265472 - DNA, 25 bp, Homo sapien
ttttagtgggaggagttgccattac

SEQ ID NO: 265473 - DNA, 25 bp, Homo sapien
ggagttgccattacactacgtccag

SEQ ID NO: 265474 - DNA, 25 bp, Homo sapien
gagttgccattacactacgtccagt

SEQ ID NO: 265475 - DNA, 25 bp, Homo sapien
agttgccattacactacgtccagta

SEQ ID NO: 265476 - DNA, 25 bp, Homo sapien
gttgccattacactacgtccagtaa

SEQ ID NO: 265477 - DNA, 25 bp, Homo sapien
ttgccattacactacgtccagtaag

SEQ ID NO: 265478 - DNA, 25 bp, Homo sapien
aaaatgcaaatgtccttcaccagta

SEQ ID NO: 265479 - DNA, 25 bp, Homo sapien
gcaaatgtccttcaccagtaaagca

SEQ ID NO: 265480 - DNA, 25 bp, Homo sapien
gtccttcaccagtaaagcaagcaaa

SEQ ID NO: 265481 - DNA, 25 bp, Homo sapien
tgtttttgaaatctactcgtcaaag

SEQ ID NO: 265482 - DNA, 25 bp, Homo sapien
gaaatctactcgtcaaagagttttc

SEQ ID NO: 265483 - DNA, 25 bp, Homo sapien
ttaggagatatcaacatgcattttt

SEQ ID NO: 265484 - DNA, 25 bp, Homo sapien
tttccttagatgaaagagatggctt

SEQ ID NO: 265485 - DNA, 25 bp, Homo sapien
gatggcttttggcagtgtgttctaa

SEQ ID NO: 265486 - DNA, 25 bp, Homo sapien
ttgtattactctccaaatctactgt

SEQ ID NO: 265487 - DNA, 25 bp, Homo sapien
aatctactgtactgtcagcttcact

SEQ ID NO: 265488 - DNA, 25 bp, Homo sapien
tactgtcagcttcactccacctgag

SEQ ID NO: 265489 - DNA, 25 bp, Homo sapien
cctcagaagcttgtcacttactggg

SEQ ID NO: 265490 - DNA, 25 bp, Homo sapien
tggggaccctgatgagtttctctct

SEQ ID NO: 265491 - DNA, 25 bp, Homo sapien
tgttgtcctgccttatccctaatct

SEQ ID NO: 265492 - DNA, 25 bp, Homo sapien
tttaaaaacagtatccctctcctct

SEQ ID NO: 265493 - DNA, 25 bp, Homo sapien
tatccctaatctagctccctgatca

SEQ ID NO: 265494 - DNA, 25 bp, Homo sapien
catttgaatgtaaccctaattggac

SEQ ID NO: 265495 - DNA, 25 bp, Homo sapien
gaattttctccctttcagtatggac

SEQ ID NO: 265496 - DNA, 25 bp, Homo sapien
tctccctttcagtatggacaaaatc

SEQ ID NO: 265497 - DNA, 25 bp, Homo sapien
atcaacaaccatgaatcagagactt

SEQ ID NO: 265498 - DNA, 25 bp, Homo sapien
tcagagacttttagaggatgggtag

SEQ ID NO: 265499 - DNA, 25 bp, Homo sapien
aagcttagcctgctcaactgaacag

SEQ ID NO: 265500 - DNA, 25 bp, Homo sapien
tgcccaattctttattctccacccc

SEQ ID NO: 265501 - DNA, 25 bp, Homo sapien
agggcatgagttccccagtccccaa

SEQ ID NO: 265502 - DNA, 25 bp, Homo sapien
tgagttccccagtccccaaggaaag

SEQ ID NO: 265503 - DNA, 25 bp, Homo sapien
aaggaaaggcagccccctcagtctc

SEQ ID NO: 265504 - DNA, 25 bp, Homo sapien
ctggtgtcacctggattcctgcagt

SEQ ID NO: 265505 - DNA, 25 bp, Homo sapien
attcctgcagtaattctgagccctt

SEQ ID NO: 265506 - DNA, 25 bp, Homo sapien
taattctgagcccttgaaatcctca

SEQ ID NO: 265507 - DNA, 25 bp, Homo sapien
gagcccttgaaatcctcagtcgcct

SEQ ID NO: 265508 - DNA, 25 bp, Homo sapien
tgaaatcctcagtcgccttggcggg

SEQ ID NO: 265509 - DNA, 25 bp, Homo sapien
acaggaggtcggcacatctccaggt

SEQ ID NO: 265510 - DNA, 25 bp, Homo sapien
ggtcggcacatctccaggtcttcat

SEQ ID NO: 265511 - DNA, 25 bp, Homo sapien
attgcactcttggaagatcccgcat

SEQ ID NO: 265512 - DNA, 25 bp, Homo sapien
aagatcccgcatgggttcgaggtga

SEQ ID NO: 265513 - DNA, 25 bp, Homo sapien
aggtgaggccgcttcagaacctcaa

SEQ ID NO: 265514 - DNA, 25 bp, Homo sapien
aggccgcttcagaacctcaaatgaa

SEQ ID NO: 265515 - DNA, 25 bp, Homo sapien
agaacctcaaatgaaagactgtctc

SEQ ID NO: 265516 - DNA, 25 bp, Homo sapien
ctgtctcctcgtgggagagcacctg

SEQ ID NO: 265517 - DNA, 25 bp, Homo sapien
agacgaatgatagggcctggtttac

SEQ ID NO: 265518 - DNA, 25 bp, Homo sapien
gatagggcctggtttacattcattt

SEQ ID NO: 265519 - DNA, 25 bp, Homo sapien
taactctttatgaccttcactcagc

SEQ ID NO: 265520 - DNA, 25 bp, Homo sapien
gaccttcactcagctgtggatttgg

SEQ ID NO: 265521 - DNA, 25 bp, Homo sapien
ctaaattagcgaatgtttttcacaa

SEQ ID NO: 265522 - DNA, 25 bp, Homo sapien
acacaaaaagcatttccccctcatt

SEQ ID NO: 265523 - DNA, 25 bp, Homo sapien
aagcatttccccctcattacttctg

SEQ ID NO: 265524 - DNA, 25 bp, Homo sapien
ttctgcctccacaaagatggttttg

SEQ ID NO: 265525 - DNA, 25 bp, Homo sapien
gcctccacaaagatggttttgtttt

SEQ ID NO: 265526 - DNA, 25 bp, Homo sapien
gttctactacaggagaggtttttct

SEQ ID NO: 265527 - DNA, 25 bp, Homo sapien
ctactacaggagaggtttttctatt

SEQ ID NO: 265528 - DNA, 25 bp, Homo sapien
caggagaggtttttctatttatcta

SEQ ID NO: 265529 - DNA, 25 bp, Homo sapien
ggaagtatagacatggacccaaaaa

SEQ ID NO: 265530 - DNA, 25 bp, Homo sapien
agtatagacatggacccaaaaaatc

SEQ ID NO: 265531 - DNA, 25 bp, Homo sapien
gagaaaaccacaggatatacacaca

SEQ ID NO: 265532 - DNA, 25 bp, Homo sapien
aaccacaggatatacacacaaaaag

SEQ ID NO: 265533 - DNA, 25 bp, Homo sapien
ttcagatcattcgaatcattttggg

SEQ ID NO: 265534 - DNA, 25 bp, Homo sapien
tttggggacttaatcatgtacatgg

SEQ ID NO: 265535 - DNA, 25 bp, Homo sapien
atttgaggttgatgttctatccaat

SEQ ID NO: 265536 - DNA, 25 bp, Homo sapien
gaggttgatgttctatccaatggcc

SEQ ID NO: 265537 - DNA, 25 bp, Homo sapien
gttgatgttctatccaatggccgaa

SEQ ID NO: 265538 - DNA, 25 bp, Homo sapien
gatgttctatccaatggccgaagat

SEQ ID NO: 265539 - DNA, 25 bp, Homo sapien
atccaatggccgaagatagcagcag

SEQ ID NO: 265540 - DNA, 25 bp, Homo sapien
aatggccgaagatagcagcaggttt

SEQ ID NO: 265541 - DNA, 25 bp, Homo sapien
ggccgaagatagcagcaggtttttt

SEQ ID NO: 265542 - DNA, 25 bp, Homo sapien
catatgttgatttgtttcatttgga

SEQ ID NO: 265543 - DNA, 25 bp, Homo sapien
gttgatttgtttcatttggattttt

SEQ ID NO: 265544 - DNA, 25 bp, Homo sapien
ggagatagaggaggcttccctccaa

SEQ ID NO: 265545 - DNA, 25 bp, Homo sapien
gaggaggcttccctccaagaggacc

SEQ ID NO: 265546 - DNA, 25 bp, Homo sapien
aggaggaaacgtccagcaccgagct

SEQ ID NO: 265547 - DNA, 25 bp, Homo sapien
caccgagctggagactggcagtgtc

SEQ ID NO: 265548 - DNA, 25 bp, Homo sapien
gctggagactggcagtgtcccaatc

SEQ ID NO: 265549 - DNA, 25 bp, Homo sapien
gtcccaatccttcaattggtgattt

SEQ ID NO: 265550 - DNA, 25 bp, Homo sapien
tggtgatttctgctgtgatgtaatt

SEQ ID NO: 265551 - DNA, 25 bp, Homo sapien
tttctgctgtgatgtaattgtatgc

SEQ ID NO: 265552 - DNA, 25 bp, Homo sapien
ggttgtggaaaccagaacttcgcct

SEQ ID NO: 265553 - DNA, 25 bp, Homo sapien
cagaacttcgcctggagaacagagt

SEQ ID NO: 265554 - DNA, 25 bp, Homo sapien
tgcaaccagtgtggtgatcgtggca

SEQ ID NO: 265555 - DNA, 25 bp, Homo sapien
ttcaaaacagtaagctgtctttcag

SEQ ID NO: 265556 - DNA, 25 bp, Homo sapien
ctgtgaattcactgtttaatctatt

SEQ ID NO: 265557 - DNA, 25 bp, Homo sapien
aatagtcctggtgacaaacaatctg

SEQ ID NO: 265558 - DNA, 25 bp, Homo sapien
catcatgggcttcatgggaagaaca

SEQ ID NO: 265559 - DNA, 25 bp, Homo sapien
atgggaagaacatgttgcatttatt

SEQ ID NO: 265560 - DNA, 25 bp, Homo sapien
gactactagccacaagttactctga

SEQ ID NO: 265561 - DNA, 25 bp, Homo sapien
actagccacaagttactctgattat

SEQ ID NO: 265562 - DNA, 25 bp, Homo sapien
gccacaagttactctgattatagta

SEQ ID NO: 265563 - DNA, 25 bp, Homo sapien
tagtaactgttttatcaacccactt

SEQ ID NO: 265564 - DNA, 25 bp, Homo sapien
gttttatcaacccacttcatcttta

SEQ ID NO: 265565 - DNA, 25 bp, Homo sapien
atttacattcacaattcaaaacagt

SEQ ID NO: 265566 - DNA, 25 bp, Homo sapien
agggcatgagttccccagtccccaa

SEQ ID NO: 265567 - DNA, 25 bp, Homo sapien
gggcatgagttccccagtccccaag

SEQ ID NO: 265568 - DNA, 25 bp, Homo sapien
ggcatgagttccccagtccccaagg

SEQ ID NO: 265569 - DNA, 25 bp, Homo sapien
gcatgagttccccagtccccaagga

SEQ ID NO: 265570 - DNA, 25 bp, Homo sapien
catgagttccccagtccccaaggaa

SEQ ID NO: 265571 - DNA, 25 bp, Homo sapien
tgagttccccagtccccaaggaaag

SEQ ID NO: 265572 - DNA, 25 bp, Homo sapien
ccctcagtctccctcctcctcattc

SEQ ID NO: 265573 - DNA, 25 bp, Homo sapien
cctcagtctccctcctcctcattcc

SEQ ID NO: 265574 - DNA, 25 bp, Homo sapien
ctcagtctccctcctcctcattccc

SEQ ID NO: 265575 - DNA, 25 bp, Homo sapien
agtcaaaacttcttgtcctcagcac

SEQ ID NO: 265576 - DNA, 25 bp, Homo sapien
tgactttcctctatgtgtccttttg

SEQ ID NO: 265577 - DNA, 25 bp, Homo sapien
ttgaatagtgtgtcctgcacaggaa

SEQ ID NO: 265578 - DNA, 25 bp, Homo sapien
gtcctgcacaggaaatggttatatt

SEQ ID NO: 265579 - DNA, 25 bp, Homo sapien
gttatatttgttagcttctttccta

SEQ ID NO: 265580 - DNA, 25 bp, Homo sapien
aaatcattcagacttccaggctttc

SEQ ID NO: 265581 - DNA, 25 bp, Homo sapien
tctttcctaggtcttattggagtac

SEQ ID NO: 265582 - DNA, 25 bp, Homo sapien
gacataatctctgtccactaggacc

SEQ ID NO: 265583 - DNA, 25 bp, Homo sapien
gacttccaggctttcagtagagaga

SEQ ID NO: 265584 - DNA, 25 bp, Homo sapien
gtttctgggtatatggacaggagtt

SEQ ID NO: 265585 - DNA, 25 bp, Homo sapien
gttaaggctgagttgacaagtcaaa

SEQ ID NO: 265586 - DNA, 25 bp, Homo sapien
gctatcgtgggcgtggtccttgcac

SEQ ID NO: 265587 - DNA, 25 bp, Homo sapien
tgggcgtggtccttgcaccgtccca

SEQ ID NO: 265588 - DNA, 25 bp, Homo sapien
cgtggcacggtttcctggtctttgg

SEQ ID NO: 265589 - DNA, 25 bp, Homo sapien
ctagtcacatttactcttaagaaat

SEQ ID NO: 265590 - DNA, 25 bp, Homo sapien
tttctcaacttccactgcagtgtgt

SEQ ID NO: 265591 - DNA, 25 bp, Homo sapien
tcaacttccactgcagtgtgtgtgc

SEQ ID NO: 265592 - DNA, 25 bp, Homo sapien
atgaaaggttttccaggagagaact

SEQ ID NO: 265593 - DNA, 25 bp, Homo sapien
tccaggagagaactgtgtacaaata

SEQ ID NO: 265594 - DNA, 25 bp, Homo sapien
actgtgtacaaataaggtgactgga

SEQ ID NO: 265595 - DNA, 25 bp, Homo sapien
tgactggagatgtgacctgatgtgt

SEQ ID NO: 265596 - DNA, 25 bp, Homo sapien
agatgtgacctgatgtgtcacgagg

SEQ ID NO: 265597 - DNA, 25 bp, Homo sapien
agtgagacaggagccacttccactc

SEQ ID NO: 265598 - DNA, 25 bp, Homo sapien
agccatccctgctttatctgagacc

SEQ ID NO: 265599 - DNA, 25 bp, Homo sapien
gagaccacccctactgtggtaggag

SEQ ID NO: 265600 - DNA, 25 bp, Homo sapien
gtaggagctgtatctgcaccggcag

SEQ ID NO: 265601 - DNA, 25 bp, Homo sapien
ggcagaagctaacacacctcaggat

SEQ ID NO: 265602 - DNA, 25 bp, Homo sapien
gctaacacacctcaggatgccacat

SEQ ID NO: 265603 - DNA, 25 bp, Homo sapien
gtagccaaactgtagtccttctaaa

SEQ ID NO: 265604 - DNA, 25 bp, Homo sapien
ggacatggcagtcaaaaagtctgag

SEQ ID NO: 265605 - DNA, 25 bp, Homo sapien
aaagtctgagtaaagctgttttttg

SEQ ID NO: 265606 - DNA, 25 bp, Homo sapien
tgtattttatatttgcttctgccat

SEQ ID NO: 265607 - DNA, 25 bp, Homo sapien
tctgccattttactgtcactaatta

SEQ ID NO: 265608 - DNA, 25 bp, Homo sapien
atgccaccaccactccgtggaggtc

SEQ ID NO: 265609 - DNA, 25 bp, Homo sapien
catgggtcgcatgggaggccgtgga

SEQ ID NO: 265610 - DNA, 25 bp, Homo sapien
gaggcttccctccaagaggaccccg

SEQ ID NO: 265611 - DNA, 25 bp, Homo sapien
aggaggaaacgtccagcaccgagct

SEQ ID NO: 265612 - DNA, 25 bp, Homo sapien
gaaacgtccagcaccgagctggaga

SEQ ID NO: 265613 - DNA, 25 bp, Homo sapien
caccgagctggagactggcagtgtc

SEQ ID NO: 265614 - DNA, 25 bp, Homo sapien
gagctggagactggcagtgtcccaa

SEQ ID NO: 265615 - DNA, 25 bp, Homo sapien
ctggagactggcagtgtcccaatcc

SEQ ID NO: 265616 - DNA, 25 bp, Homo sapien
gtggaaaccagaacttcgcctggag

SEQ ID NO: 265617 - DNA, 25 bp, Homo sapien
gaaaccagaacttcgcctggagaac

SEQ ID NO: 265618 - DNA, 25 bp, Homo sapien
cagaacttcgcctggagaacagagt

SEQ ID NO: 265619 - DNA, 25 bp, Homo sapien
gggccaaactatctgcatttgaatc

SEQ ID NO: 265620 - DNA, 25 bp, Homo sapien
tctgacatttattagctttgtgact

SEQ ID NO: 265621 - DNA, 25 bp, Homo sapien
attagctttgtgacttgggcaagta

SEQ ID NO: 265622 - DNA, 25 bp, Homo sapien
tgggcaagtaattatcacatctgtg

SEQ ID NO: 265623 - DNA, 25 bp, Homo sapien
gtacagatgacttaaacagtcttgg

SEQ ID NO: 265624 - DNA, 25 bp, Homo sapien
aaaatgggcactctgcagggtcatt

SEQ ID NO: 265625 - DNA, 25 bp, Homo sapien
cactctgcagggtcattgtgaggaa

SEQ ID NO: 265626 - DNA, 25 bp, Homo sapien
gaggaatgatatatgcatagcactt

SEQ ID NO: 265627 - DNA, 25 bp, Homo sapien
ggaaacaaattcacctgattcttca

SEQ ID NO: 265628 - DNA, 25 bp, Homo sapien
cacctgattcttcaaggtgttctgt

SEQ ID NO: 265629 - DNA, 25 bp, Homo sapien
tggttagcagaagtggcattatgaa

SEQ ID NO: 265630 - DNA, 25 bp, Homo sapien
gggtttgccgacagggatttactgt

SEQ ID NO: 265631 - DNA, 25 bp, Homo sapien
cgacagggatttactgtcccacagc

SEQ ID NO: 265632 - DNA, 25 bp, Homo sapien
ccaagatcaagatgtgcgcaaggtt

SEQ ID NO: 265633 - DNA, 25 bp, Homo sapien
caagatgtgcgcaaggttgtttcct

SEQ ID NO: 265634 - DNA, 25 bp, Homo sapien
cagtgtgggcactgggctattatca

SEQ ID NO: 265635 - DNA, 25 bp, Homo sapien
gggcactgggctattatcagtgagt

SEQ ID NO: 265636 - DNA, 25 bp, Homo sapien
attatcagtgagtgtattcatttgc

SEQ ID NO: 265637 - DNA, 25 bp, Homo sapien
gtattcatttgcttgggctactgta

SEQ ID NO: 265638 - DNA, 25 bp, Homo sapien
atttgcttgggctactgtaacacag

SEQ ID NO: 265639 - DNA, 25 bp, Homo sapien
ttgggctactgtaacacagcacctc

SEQ ID NO: 265640 - DNA, 25 bp, Homo sapien
ggctactgtaacacagcacctcaga

SEQ ID NO: 265641 - DNA, 25 bp, Homo sapien
ggatttctgcaaaaacagatctatt

SEQ ID NO: 265642 - DNA, 25 bp, Homo sapien
ctgcaaaaacagatctatttaattt

SEQ ID NO: 265643 - DNA, 25 bp, Homo sapien
ttttttccccatccctgtcttgaga

SEQ ID NO: 265644 - DNA, 25 bp, Homo sapien
ttttccccatccctgtcttgagatt

SEQ ID NO: 265645 - DNA, 25 bp, Homo sapien
ttccccatccctgtcttgagatttt

SEQ ID NO: 265646 - DNA, 25 bp, Homo sapien
cccatccctgtcttgagattttctg

SEQ ID NO: 265647 - DNA, 25 bp, Homo sapien
cttgagattttctggcatgtttctg

SEQ ID NO: 265648 - DNA, 25 bp, Homo sapien
gagattttctggcatgtttctggag

SEQ ID NO: 265649 - DNA, 25 bp, Homo sapien
gattttctggcatgtttctggaggt

SEQ ID NO: 265650 - DNA, 25 bp, Homo sapien
attttctggcatgtttctggaggtt

SEQ ID NO: 265651 - DNA, 25 bp, Homo sapien
ttttctggcatgtttctggaggttt

SEQ ID NO: 265652 - DNA, 25 bp, Homo sapien
agaaggatgaggaacaggcagcctt

SEQ ID NO: 265653 - DNA, 25 bp, Homo sapien
gcggaagagccccagagaacacaat

SEQ ID NO: 265654 - DNA, 25 bp, Homo sapien
tccaggtccatggagagcagcccta

SEQ ID NO: 265655 - DNA, 25 bp, Homo sapien
gtccatggagagcagccctaggaaa

SEQ ID NO: 265656 - DNA, 25 bp, Homo sapien
gccagtcaaagttgaggctccggaa

SEQ ID NO: 265657 - DNA, 25 bp, Homo sapien
gaggctccggaatacatccccataa

SEQ ID NO: 265658 - DNA, 25 bp, Homo sapien
atccccataagtgatgaccctaagg

SEQ ID NO: 265659 - DNA, 25 bp, Homo sapien
taagtgatgaccctaaggcctccgc

SEQ ID NO: 265660 - DNA, 25 bp, Homo sapien
ctaaggcctccgcaaagaaaaagat

SEQ ID NO: 265661 - DNA, 25 bp, Homo sapien
agaaggtagagcagccagtcatcga

SEQ ID NO: 265662 - DNA, 25 bp, Homo sapien
gagcagccagtcatcgaggagccag

SEQ ID NO: 265663 - DNA, 25 bp, Homo sapien
ctccttccctaaggagtcctgtggg

SEQ ID NO: 265664 - DNA, 25 bp, Homo sapien
tactgtggtgagaaacctcactgtc

SEQ ID NO: 265665 - DNA, 25 bp, Homo sapien
gtgagaaacctcactgtccatggtt

SEQ ID NO: 265666 - DNA, 25 bp, Homo sapien
acctcactgtccatggttaactgaa

SEQ ID NO: 265667 - DNA, 25 bp, Homo sapien
agaaatccctccttcagaaagaact

SEQ ID NO: 265668 - DNA, 25 bp, Homo sapien
acttgagtagtagatgaggtggtta

SEQ ID NO: 265669 - DNA, 25 bp, Homo sapien
ggttagacaggatctttttccctca

SEQ ID NO: 265670 - DNA, 25 bp, Homo sapien
acaggatctttttccctcaagctgt

SEQ ID NO: 265671 - DNA, 25 bp, Homo sapien
ccctcaagctgtttggacgccacag

SEQ ID NO: 265672 - DNA, 25 bp, Homo sapien
gtttggacgccacagccaggaccaa

SEQ ID NO: 265673 - DNA, 25 bp, Homo sapien
ccaggaccaactctgacagctgcga

SEQ ID NO: 265674 - DNA, 25 bp, Homo sapien
gttaattattcctcgatacacctcg

SEQ ID NO: 265675 - DNA, 25 bp, Homo sapien
atacacctcgccatcacttgtgtat

SEQ ID NO: 265676 - DNA, 25 bp, Homo sapien
gtgtatcccttttctacatgtgacc

SEQ ID NO: 265677 - DNA, 25 bp, Homo sapien
atcccttttctacatgtgacctttc

SEQ ID NO: 265678 - DNA, 25 bp, Homo sapien
acatgtgacctttccctggccacat

SEQ ID NO: 265679 - DNA, 25 bp, Homo sapien
tggccacatctgctactctctttga

SEQ ID NO: 265680 - DNA, 25 bp, Homo sapien
gctactctctttgagcatgatgcct

SEQ ID NO: 265681 - DNA, 25 bp, Homo sapien
agcatgatgcctctactgtattcta

SEQ ID NO: 265682 - DNA, 25 bp, Homo sapien
gatgcctctactgtattctattcca

SEQ ID NO: 265683 - DNA, 25 bp, Homo sapien
actgtattctattccagagctcatt

SEQ ID NO: 265684 - DNA, 25 bp, Homo sapien
gagctcattgttttgtcagtttttt

SEQ ID NO: 265685 - DNA, 25 bp, Homo sapien
ggtctcatcccattaacaggtcaat

SEQ ID NO: 265686 - DNA, 25 bp, Homo sapien
aggtcaatgctaaaagtgtctgcag

SEQ ID NO: 265687 - DNA, 25 bp, Homo sapien
gcagaacccatgatgtgaatttact

SEQ ID NO: 265688 - DNA, 25 bp, Homo sapien
gaagagaaagactctccaccaggtg

SEQ ID NO: 265689 - DNA, 25 bp, Homo sapien
atgagtgcggccatgttccttgggt

SEQ ID NO: 265690 - DNA, 25 bp, Homo sapien
ggagcttctgccttggagggattca

SEQ ID NO: 265691 - DNA, 25 bp, Homo sapien
ctgccttggagggattcaactgacc

SEQ ID NO: 265692 - DNA, 25 bp, Homo sapien
atgttccttgggtacgagctgtcgc

SEQ ID NO: 265693 - DNA, 25 bp, Homo sapien
acgagctgtcgctgcaggctatccg

SEQ ID NO: 265694 - DNA, 25 bp, Homo sapien
gaccacgcagtgacgagcccataag

SEQ ID NO: 265695 - DNA, 25 bp, Homo sapien
gtgacgagcccataagcgccagggt

SEQ ID NO: 265696 - DNA, 25 bp, Homo sapien
tggtcactggactggccccttatca

SEQ ID NO: 265697 - DNA, 25 bp, Homo sapien
tggccccttatcacacagcggaagc

SEQ ID NO: 265698 - DNA, 25 bp, Homo sapien
acagcggaagccagcatggcacatt

SEQ ID NO: 265699 - DNA, 25 bp, Homo sapien
gccagcatggcacattctcagccgt

SEQ ID NO: 265700 - DNA, 25 bp, Homo sapien
tcccagcacatatggtcagtgagga

SEQ ID NO: 265701 - DNA, 25 bp, Homo sapien
gggcagagttgctgcaccaccatgc

SEQ ID NO: 265702 - DNA, 25 bp, Homo sapien
gagttgctgcaccaccatgcaccgg

SEQ ID NO: 265703 - DNA, 25 bp, Homo sapien
acccgtccttattctcactaggtca

SEQ ID NO: 265704 - DNA, 25 bp, Homo sapien
ttattctcactaggtcacttccgat

SEQ ID NO: 265705 - DNA, 25 bp, Homo sapien
gtcacttccgatgccttcttagaga

SEQ ID NO: 265706 - DNA, 25 bp, Homo sapien
tccgatgccttcttagagagcatgg

SEQ ID NO: 265707 - DNA, 25 bp, Homo sapien
acattttttgagtactagctcttac

SEQ ID NO: 265708 - DNA, 25 bp, Homo sapien
agctcttactctagtttcttggtac

SEQ ID NO: 265709 - DNA, 25 bp, Homo sapien
cttggtaccatatctttcagctttc

SEQ ID NO: 265710 - DNA, 25 bp, Homo sapien
ccatatctttcagctttctctcaaa

SEQ ID NO: 265711 - DNA, 25 bp, Homo sapien
ttcattcttatcaatgcttttccta

SEQ ID NO: 265712 - DNA, 25 bp, Homo sapien
aatgcttttcctatcattctggata

SEQ ID NO: 265713 - DNA, 25 bp, Homo sapien
ggatacttcgttaagtttatcttca

SEQ ID NO: 265714 - DNA, 25 bp, Homo sapien
gaaatgaaaactgcttgccttctct

SEQ ID NO: 265715 - DNA, 25 bp, Homo sapien
ccttctctttttgccattccattat

SEQ ID NO: 265716 - DNA, 25 bp, Homo sapien
ttgccattccattattttaaccatc

SEQ ID NO: 265717 - DNA, 25 bp, Homo sapien
ccatctgtgggtcaaggagttattc

SEQ ID NO: 265718 - DNA, 25 bp, Homo sapien
caccggattctccattcaccccttt

SEQ ID NO: 265719 - DNA, 25 bp, Homo sapien
cctggtgtcaactcgattcctgcgg

SEQ ID NO: 265720 - DNA, 25 bp, Homo sapien
tggtgtcaactcgattcctgcggta

SEQ ID NO: 265721 - DNA, 25 bp, Homo sapien
ggtgtcaactcgattcctgcggtaa

SEQ ID NO: 265722 - DNA, 25 bp, Homo sapien
gtgtcaactcgattcctgcggtaac

SEQ ID NO: 265723 - DNA, 25 bp, Homo sapien
tgtcaactcgattcctgcggtaact

SEQ ID NO: 265724 - DNA, 25 bp, Homo sapien
gtcaactcgattcctgcggtaactc

SEQ ID NO: 265725 - DNA, 25 bp, Homo sapien
tcaactcgattcctgcggtaactct

SEQ ID NO: 265726 - DNA, 25 bp, Homo sapien
aactcgattcctgcggtaactctga

SEQ ID NO: 265727 - DNA, 25 bp, Homo sapien
tcgattcctgcggtaactctgagcc

SEQ ID NO: 265728 - DNA, 25 bp, Homo sapien
attcctgcggtaactctgagccctg

SEQ ID NO: 265729 - DNA, 25 bp, Homo sapien
atcgttggccggagacaggatatgt

SEQ ID NO: 265730 - DNA, 25 bp, Homo sapien
gggacaatacgttctattactacaa

SEQ ID NO: 265731 - DNA, 25 bp, Homo sapien
gtgatgacaaagaagtccacaaagt

SEQ ID NO: 265732 - DNA, 25 bp, Homo sapien
atttatgcttactagcctgtcttct

SEQ ID NO: 265733 - DNA, 25 bp, Homo sapien
tagcctgtcttctttgtattacttg

SEQ ID NO: 265734 - DNA, 25 bp, Homo sapien
gtcttctttgtattacttgtcaatt

SEQ ID NO: 265735 - DNA, 25 bp, Homo sapien
aagtattcatcatttccttctacat

SEQ ID NO: 265736 - DNA, 25 bp, Homo sapien
atcatttccttctacatcatgtgtt

SEQ ID NO: 265737 - DNA, 25 bp, Homo sapien
ccttctacatcatgtgtttgtcatt

SEQ ID NO: 265738 - DNA, 25 bp, Homo sapien
tcggcggaacgaggataacccagta

SEQ ID NO: 265739 - DNA, 25 bp, Homo sapien
ataacccagtagagccggacccagg

SEQ ID NO: 265740 - DNA, 25 bp, Homo sapien
gcaggcgatgagtctagtagcaccc

SEQ ID NO: 265741 - DNA, 25 bp, Homo sapien
tagtagcacccaggacggcttgtag

SEQ ID NO: 265742 - DNA, 25 bp, Homo sapien
ggacggcttgtagctatgcatcatt

SEQ ID NO: 265743 - DNA, 25 bp, Homo sapien
atgcatcattttcctacggcgttag

SEQ ID NO: 265744 - DNA, 25 bp, Homo sapien
tacggcgttagcactttaagcacat

SEQ ID NO: 265745 - DNA, 25 bp, Homo sapien
ccacgtttggccttctgggattcac

SEQ ID NO: 265746 - DNA, 25 bp, Homo sapien
attcactgtgagtgtcctgagctct

SEQ ID NO: 265747 - DNA, 25 bp, Homo sapien
tggtttttctctcagcatgtctcct

SEQ ID NO: 265748 - DNA, 25 bp, Homo sapien
acttcactgggcactagacttttct

SEQ ID NO: 265749 - DNA, 25 bp, Homo sapien
tagacttttctattggcctgtgcca

SEQ ID NO: 265750 - DNA, 25 bp, Homo sapien
gccatcgcccagtattagcacaagt

SEQ ID NO: 265751 - DNA, 25 bp, Homo sapien
tgctcgacggcctagaagagtacct

SEQ ID NO: 265752 - DNA, 25 bp, Homo sapien
gagtacctagcggaagacccagagc

SEQ ID NO: 265753 - DNA, 25 bp, Homo sapien
ggaagccgcctacctcattgcctta

SEQ ID NO: 265754 - DNA, 25 bp, Homo sapien
attgccttacttctagacacagctg

SEQ ID NO: 265755 - DNA, 25 bp, Homo sapien
tacttctagacacagctgcccactt

SEQ ID NO: 265756 - DNA, 25 bp, Homo sapien
ttgtgggctcatggtggccctccag

SEQ ID NO: 265757 - DNA, 25 bp, Homo sapien
tggcactgctccagcggtattttcc

SEQ ID NO: 265758 - DNA, 25 bp, Homo sapien
tccagcggtattttcctgcccagtg

SEQ ID NO: 265759 - DNA, 25 bp, Homo sapien
tggctgcagccagatgcaccaggtc

SEQ ID NO: 265760 - DNA, 25 bp, Homo sapien
agatgcaccaggtccaggagagcac

SEQ ID NO: 265761 - DNA, 25 bp, Homo sapien
aggtccaggagagcacggcctccga

SEQ ID NO: 265762 - DNA, 25 bp, Homo sapien
gggctcagtgagcactactcacaga

SEQ ID NO: 265763 - DNA, 25 bp, Homo sapien
acctgaccctgttgggtcgagtcag

SEQ ID NO: 265764 - DNA, 25 bp, Homo sapien
gtagcacctgtgttctttgagttca

SEQ ID NO: 265765 - DNA, 25 bp, Homo sapien
gtgttctttgagttcacatcatgaa

SEQ ID NO: 265766 - DNA, 25 bp, Homo sapien
ttcccagataccatctcaggcttaa

SEQ ID NO: 265767 - DNA, 25 bp, Homo sapien
tcaggcttaacctagcacatcctat

SEQ ID NO: 265768 - DNA, 25 bp, Homo sapien
ctagcacatcctatttcttttcttc

SEQ ID NO: 265769 - DNA, 25 bp, Homo sapien
atccaaattggactgacctcacttc

SEQ ID NO: 265770 - DNA, 25 bp, Homo sapien
tcacttcaaagttgctgtcccattt

SEQ ID NO: 265771 - DNA, 25 bp, Homo sapien
attttgtcaccctatcttatctcgg

SEQ ID NO: 265772 - DNA, 25 bp, Homo sapien
ttgcagactgatggccagaccaact

SEQ ID NO: 265773 - DNA, 25 bp, Homo sapien
gaaaagcaaaaactaggtgtgtcat

SEQ ID NO: 265774 - DNA, 25 bp, Homo sapien
aaaactaggtgtgtcattgaaataa

SEQ ID NO: 265775 - DNA, 25 bp, Homo sapien
gtgtgtcattgaaataataggcata

SEQ ID NO: 265776 - DNA, 25 bp, Homo sapien
gaatttgtactaaatcagatttgcc

SEQ ID NO: 265777 - DNA, 25 bp, Homo sapien
tgtactaaatcagatttgccatgtc

SEQ ID NO: 265778 - DNA, 25 bp, Homo sapien
catgtccagtacagaataatttgta

SEQ ID NO: 265779 - DNA, 25 bp, Homo sapien
ttgtacttagtatttgcagcagggt

SEQ ID NO: 265780 - DNA, 25 bp, Homo sapien
gtatttgcagcagggtttgtctttg

SEQ ID NO: 265781 - DNA, 25 bp, Homo sapien
ttgcagcagggtttgtctttgtgaa

SEQ ID NO: 265782 - DNA, 25 bp, Homo sapien
ttgtctttgtgaattcagatgaaac

SEQ ID NO: 265783 - DNA, 25 bp, Homo sapien
taggaatattttgtcagtcattaaa

SEQ ID NO: 265784 - DNA, 25 bp, Homo sapien
aagacaaacccacagcgaacggctc

SEQ ID NO: 265785 - DNA, 25 bp, Homo sapien
actccctgctttctatcacacgggt

SEQ ID NO: 265786 - DNA, 25 bp, Homo sapien
tgctttctatcacacgggtcacaag

SEQ ID NO: 265787 - DNA, 25 bp, Homo sapien
tatcacacgggtcacaaggcagctc

SEQ ID NO: 265788 - DNA, 25 bp, Homo sapien
gggtcacaaggcagctctcagagca

SEQ ID NO: 265789 - DNA, 25 bp, Homo sapien
agctctcagagcagaaggcacacac

SEQ ID NO: 265790 - DNA, 25 bp, Homo sapien
cagaaggcacacacactgcagtgga

SEQ ID NO: 265791 - DNA, 25 bp, Homo sapien
gaaaggaagtcactccaaggtacac

SEQ ID NO: 265792 - DNA, 25 bp, Homo sapien
ggagagtaggaactttcagttacct

SEQ ID NO: 265793 - DNA, 25 bp, Homo sapien
tttcagttacctaagactacagcca

SEQ ID NO: 265794 - DNA, 25 bp, Homo sapien
acaagacaccttaatgtttgttcaa

SEQ ID NO: 265795 - DNA, 25 bp, Homo sapien
acaccctgaacatggctgctggtat

SEQ ID NO: 265796 - DNA, 25 bp, Homo sapien
tttttccaaacctcagtttgcccat

SEQ ID NO: 265797 - DNA, 25 bp, Homo sapien
gaaggaatgtctacatctgtttgct

SEQ ID NO: 265798 - DNA, 25 bp, Homo sapien
atctgtttgctaatcgaggtcccat

SEQ ID NO: 265799 - DNA, 25 bp, Homo sapien
aatcgaggtcccatggtgacacggc

SEQ ID NO: 265800 - DNA, 25 bp, Homo sapien
gtgacacggctgactttaagattct

SEQ ID NO: 265801 - DNA, 25 bp, Homo sapien
gattcttttaacaccgggattctgc

SEQ ID NO: 265802 - DNA, 25 bp, Homo sapien
gggattctgccatcctattaaggat

SEQ ID NO: 265803 - DNA, 25 bp, Homo sapien
cagtttgcccatctgttaaacaggg

SEQ ID NO: 265804 - DNA, 25 bp, Homo sapien
gggattatagtacttgtctcacaaa

SEQ ID NO: 265805 - DNA, 25 bp, Homo sapien
ggatgtatcccaagcgctcagcatg

SEQ ID NO: 265806 - DNA, 25 bp, Homo sapien
actcattggctacctgtgagcacca

SEQ ID NO: 265807 - DNA, 25 bp, Homo sapien
accaggtcagccctaacagctctga

SEQ ID NO: 265808 - DNA, 25 bp, Homo sapien
gtcaggccagttcccagattacagg

SEQ ID NO: 265809 - DNA, 25 bp, Homo sapien
gattacaggagctactttcctctct

SEQ ID NO: 265810 - DNA, 25 bp, Homo sapien
ctcacctgctaagtcatcacagata

SEQ ID NO: 265811 - DNA, 25 bp, Homo sapien
cgggtcagttaatcgtagcattttt

SEQ ID NO: 265812 - DNA, 25 bp, Homo sapien
ttttccatgcaaatggctctggtta

SEQ ID NO: 265813 - DNA, 25 bp, Homo sapien
gaatcaaactgaacacttgtactta

SEQ ID NO: 265814 - DNA, 25 bp, Homo sapien
gtcactgagtgaccttgtctgatgc

SEQ ID NO: 265815 - DNA, 25 bp, Homo sapien
tgaccttgtctgatgctggtgtttt

SEQ ID NO: 265816 - DNA, 25 bp, Homo sapien
gattgtttgtgtccaagagaactca

SEQ ID NO: 265817 - DNA, 25 bp, Homo sapien
gttcaacttacattattctctccat

SEQ ID NO: 265818 - DNA, 25 bp, Homo sapien
ttattctctccataatctaagcccc

SEQ ID NO: 265819 - DNA, 25 bp, Homo sapien
tctccataatctaagcccctttctt

SEQ ID NO: 265820 - DNA, 25 bp, Homo sapien
cctttcttctggttttgataccaag

SEQ ID NO: 265821 - DNA, 25 bp, Homo sapien
tggttggttagcctttttgtaatag

SEQ ID NO: 265822 - DNA, 25 bp, Homo sapien
agcctttttgtaatagtcctgtata

SEQ ID NO: 265823 - DNA, 25 bp, Homo sapien
gtatagtattatatctgcgtagtat

SEQ ID NO: 265824 - DNA, 25 bp, Homo sapien
atattttgacagttcttttcataga

SEQ ID NO: 265825 - DNA, 25 bp, Homo sapien
taagttaagaacagtcatacatcct

SEQ ID NO: 265826 - DNA, 25 bp, Homo sapien
catacatccttaactcctgtacttt

SEQ ID NO: 265827 - DNA, 25 bp, Homo sapien
tcctgtactttacttctaaacgttg

SEQ ID NO: 265828 - DNA, 25 bp, Homo sapien
gaggcctggacgttgtcagccttcc

SEQ ID NO: 265829 - DNA, 25 bp, Homo sapien
ctgcggtgcaggtatccgcaggcac

SEQ ID NO: 265830 - DNA, 25 bp, Homo sapien
gtatccgcaggcacgagcgcagaga

SEQ ID NO: 265831 - DNA, 25 bp, Homo sapien
gcacgagcgcagagacggcgaccct

SEQ ID NO: 265832 - DNA, 25 bp, Homo sapien
ggccatcttgagcaccgccttttac

SEQ ID NO: 265833 - DNA, 25 bp, Homo sapien
ttgggcgccaccatccatgacagga

SEQ ID NO: 265834 - DNA, 25 bp, Homo sapien
accatccatgacaggaggccaagga

SEQ ID NO: 265835 - DNA, 25 bp, Homo sapien
ttgagcaccgccttttacttcggcc

SEQ ID NO: 265836 - DNA, 25 bp, Homo sapien
actccgccaccgtaggtaagactgg

SEQ ID NO: 265837 - DNA, 25 bp, Homo sapien
gccaccgtaggtaagactgggttcg

SEQ ID NO: 265838 - DNA, 25 bp, Homo sapien
gtagaggcctggacgttgtcagcct

SEQ ID NO: 265839 - DNA, 25 bp, Homo sapien
ttgcccggcctattcccttgggctt

SEQ ID NO: 265840 - DNA, 25 bp, Homo sapien
ttaaaaagcgtcttggatggaggtg

SEQ ID NO: 265841 - DNA, 25 bp, Homo sapien
gtaacccaagttgcatgtatcccca

SEQ ID NO: 265842 - DNA, 25 bp, Homo sapien
gggcacttttgtgattcccctgctt

SEQ ID NO: 265843 - DNA, 25 bp, Homo sapien
tgtgattcccctgcttgtgactgca

SEQ ID NO: 265844 - DNA, 25 bp, Homo sapien
tgcttgtgactgcacaccgggaccc

SEQ ID NO: 265845 - DNA, 25 bp, Homo sapien
ccactcaattcaaagacccagactg

SEQ ID NO: 265846 - DNA, 25 bp, Homo sapien
aaagacccagactgcttcaacccta

SEQ ID NO: 265847 - DNA, 25 bp, Homo sapien
gacaagggcaagttccaggacaatg

SEQ ID NO: 265848 - DNA, 25 bp, Homo sapien
ggacaatgatgctttcatgcccttt

SEQ ID NO: 265849 - DNA, 25 bp, Homo sapien
atgccctttgcctcaggtgcaggca

SEQ ID NO: 265850 - DNA, 25 bp, Homo sapien
agtggctgcagacaataggatctca

SEQ ID NO: 265851 - DNA, 25 bp, Homo sapien
gaattgcttatctgttctcgtagag

SEQ ID NO: 265852 - DNA, 25 bp, Homo sapien
aaatgagacactgccactctgtggt

SEQ ID NO: 265853 - DNA, 25 bp, Homo sapien
gtggtgcacaatggctaagactgac

SEQ ID NO: 265854 - DNA, 25 bp, Homo sapien
ggctaagactgacctatatacattt

SEQ ID NO: 265855 - DNA, 25 bp, Homo sapien
cattttctaatcttgtccttgtgta

SEQ ID NO: 265856 - DNA, 25 bp, Homo sapien
gtgtatttcgtgatctgctggttca

SEQ ID NO: 265857 - DNA, 25 bp, Homo sapien
gctggttcaacatctgtttgtacgt

SEQ ID NO: 265858 - DNA, 25 bp, Homo sapien
gtacgttaaacacctcaatcttaat

SEQ ID NO: 265859 - DNA, 25 bp, Homo sapien
aagaacgatgatccttcccattgag

SEQ ID NO: 265860 - DNA, 25 bp, Homo sapien
atccttcccattgagcctactaaga

SEQ ID NO: 265861 - DNA, 25 bp, Homo sapien
gaagtaaatgtatctgcaagctgat

SEQ ID NO: 265862 - DNA, 25 bp, Homo sapien
aatgtatctgcaagctgatttaaat

SEQ ID NO: 265863 - DNA, 25 bp, Homo sapien
aattgtagattttctcttcattgca

SEQ ID NO: 265864 - DNA, 25 bp, Homo sapien
ttctcttcattgcatattttctgat

SEQ ID NO: 265865 - DNA, 25 bp, Homo sapien
gtaagaattgtcctcaaaatctcta

SEQ ID NO: 265866 - DNA, 25 bp, Homo sapien
attgtcctcaaaatctctattcttg

SEQ ID NO: 265867 - DNA, 25 bp, Homo sapien
aaatctctattcttgagcacagtag

SEQ ID NO: 265868 - DNA, 25 bp, Homo sapien
ctctattcttgagcacagtagtaaa

SEQ ID NO: 265869 - DNA, 25 bp, Homo sapien
tatttcaagggttctgcataagcaa

SEQ ID NO: 265870 - DNA, 25 bp, Homo sapien
gggttctgcataagcaaccttgttt

SEQ ID NO: 265871 - DNA, 25 bp, Homo sapien
ataagcaaccttgttttattgtgac

SEQ ID NO: 265872 - DNA, 25 bp, Homo sapien
tgggcctcatcgttcttgtcaacat

SEQ ID NO: 265873 - DNA, 25 bp, Homo sapien
atcgttcttgtcaacattggcatca

SEQ ID NO: 265874 - DNA, 25 bp, Homo sapien
aacattggcatcaacgtggcaacta

SEQ ID NO: 265875 - DNA, 25 bp, Homo sapien
caacgtggcaactatgatgtggcat

SEQ ID NO: 265876 - DNA, 25 bp, Homo sapien
tatgatgtggcatggactccagaac

SEQ ID NO: 265877 - DNA, 25 bp, Homo sapien
tggactccagaacgccttagacaag

SEQ ID NO: 265878 - DNA, 25 bp, Homo sapien
gaacgccttagacaagatgattgat

SEQ ID NO: 265879 - DNA, 25 bp, Homo sapien
agatgattgattgggctactcagaa

SEQ ID NO: 265880 - DNA, 25 bp, Homo sapien
aggccagtgaaagtcccccaagtgg

SEQ ID NO: 265881 - DNA, 25 bp, Homo sapien
gtgagatgttgcaatcaataccaag

SEQ ID NO: 265882 - DNA, 25 bp, Homo sapien
gatgccgaggacatcttactcctgc

SEQ ID NO: 265883 - DNA, 25 bp, Homo sapien
catggaaggctatggctggcactct

SEQ ID NO: 265884 - DNA, 25 bp, Homo sapien
tatggctggcactcttcctcttttt

SEQ ID NO: 265885 - DNA, 25 bp, Homo sapien
ttcctctttttccagttcactgagg

SEQ ID NO: 265886 - DNA, 25 bp, Homo sapien
tgaaggaaggcatttcagcccgagt

SEQ ID NO: 265887 - DNA, 25 bp, Homo sapien
tttcagcccgagtaaactccccagg

SEQ ID NO: 265888 - DNA, 25 bp, Homo sapien
gtggtgagctccattgtgtacactt

SEQ ID NO: 265889 - DNA, 25 bp, Homo sapien
cagtaaacactccagcggctgttga

SEQ ID NO: 265890 - DNA, 25 bp, Homo sapien
actccagcggctgttgaccaatgaa

SEQ ID NO: 265891 - DNA, 25 bp, Homo sapien
tgtgtacacttggaagcagcccaga

SEQ ID NO: 265892 - DNA, 25 bp, Homo sapien
aggtgaagacctgttcgtgaactcc

SEQ ID NO: 265893 - DNA, 25 bp, Homo sapien
gttcgtgaactccagaggccattgg

SEQ ID NO: 265894 - DNA, 25 bp, Homo sapien
ggaactctatggttacctttactct

SEQ ID NO: 265895 - DNA, 25 bp, Homo sapien
actctatggttacctttactctaag

SEQ ID NO: 265896 - DNA, 25 bp, Homo sapien
ttagatgggtgttactgattcttac

SEQ ID NO: 265897 - DNA, 25 bp, Homo sapien
gatgggtgttactgattcttacctc

SEQ ID NO: 265898 - DNA, 25 bp, Homo sapien
atgggtgttactgattcttacctca

SEQ ID NO: 265899 - DNA, 25 bp, Homo sapien
caaaatgacctgcttagagttctgc

SEQ ID NO: 265900 - DNA, 25 bp, Homo sapien
aatgacctgcttagagttctgcacc

SEQ ID NO: 265901 - DNA, 25 bp, Homo sapien
tgacctgcttagagttctgcacccc

SEQ ID NO: 265902 - DNA, 25 bp, Homo sapien
tttattgaagagtcttgatgtcttt

SEQ ID NO: 265903 - DNA, 25 bp, Homo sapien
tcttttgggaaaggaactctatggt

SEQ ID NO: 265904 - DNA, 25 bp, Homo sapien
tgggaaaggaactctatggttacct

SEQ ID NO: 265905 - DNA, 25 bp, Homo sapien
ttgcttgtatcaaataaaccatgga

SEQ ID NO: 265906 - DNA, 25 bp, Homo sapien
gtatcaaataaaccatggattcatg

SEQ ID NO: 265907 - DNA, 25 bp, Homo sapien
catggattcatggtttattttattc

SEQ ID NO: 265908 - DNA, 25 bp, Homo sapien
atgttatattttgacaacttcagac

SEQ ID NO: 265909 - DNA, 25 bp, Homo sapien
tatattttgacaacttcagacttac

SEQ ID NO: 265910 - DNA, 25 bp, Homo sapien
cagaaagattataagaggtagtaca

SEQ ID NO: 265911 - DNA, 25 bp, Homo sapien
tttggatattattccccaaatgtta

SEQ ID NO: 265912 - DNA, 25 bp, Homo sapien
gttaacattttactgcatttacttt

SEQ ID NO: 265913 - DNA, 25 bp, Homo sapien
cctcctgtctttctagatgaatatg

SEQ ID NO: 265914 - DNA, 25 bp, Homo sapien
cctgtctttctagatgaatatgaat

SEQ ID NO: 265915 - DNA, 25 bp, Homo sapien
gaatataggtacttaatacagattt

SEQ ID NO: 265916 - DNA, 25 bp, Homo sapien
gcgacagaatacatgaagtgagcat

SEQ ID NO: 265917 - DNA, 25 bp, Homo sapien
aatggagttgatacacttgctaggt

SEQ ID NO: 265918 - DNA, 25 bp, Homo sapien
acttgctaggtgtgggattgctaca

SEQ ID NO: 265919 - DNA, 25 bp, Homo sapien
gtgtgggattgctacaaaccttcga

SEQ ID NO: 265920 - DNA, 25 bp, Homo sapien
ggattgctacaaaccttcgatttgt

SEQ ID NO: 265921 - DNA, 25 bp, Homo sapien
caaagatcactgattgagatcgcta

SEQ ID NO: 265922 - DNA, 25 bp, Homo sapien
gtgtatgcctgtagtattatctgac

SEQ ID NO: 265923 - DNA, 25 bp, Homo sapien
attatctgactggatgtttactatc

SEQ ID NO: 265924 - DNA, 25 bp, Homo sapien
gaaacatctgaattataccatttga

SEQ ID NO: 265925 - DNA, 25 bp, Homo sapien
gattgagatcgctataacacaaata

SEQ ID NO: 265926 - DNA, 25 bp, Homo sapien
gggagaattaccagaatgcgacaga

SEQ ID NO: 265927 - DNA, 25 bp, Homo sapien
tcttgacatcgctgtatcccaaata

SEQ ID NO: 265928 - DNA, 25 bp, Homo sapien
tctcctgatacagcaaggcagttgt

SEQ ID NO: 265929 - DNA, 25 bp, Homo sapien
ggcagttgtgagcaagttattcata

SEQ ID NO: 265930 - DNA, 25 bp, Homo sapien
tcataactctacacctcaatttctt

SEQ ID NO: 265931 - DNA, 25 bp, Homo sapien
gaggatatagatgccgagcccagta

SEQ ID NO: 265932 - DNA, 25 bp, Homo sapien
atgccgagcccagtagcacagggtg

SEQ ID NO: 265933 - DNA, 25 bp, Homo sapien
tagcacagggtgcagccgttcaaac

SEQ ID NO: 265934 - DNA, 25 bp, Homo sapien
cagccgttcaaaccaactgacattt

SEQ ID NO: 265935 - DNA, 25 bp, Homo sapien
tgacatttactgagggctgctttgt

SEQ ID NO: 265936 - DNA, 25 bp, Homo sapien
tgctttgtcaggtccctctctacag

SEQ ID NO: 265937 - DNA, 25 bp, Homo sapien
ctacagtatactccaacacacacat

SEQ ID NO: 265938 - DNA, 25 bp, Homo sapien
ctgggagtactgtgtgaggtggtct

SEQ ID NO: 265939 - DNA, 25 bp, Homo sapien
ggtctcactggtggtgattgaagaa

SEQ ID NO: 265940 - DNA, 25 bp, Homo sapien
aagtgaagctgggagtatcatgtga

SEQ ID NO: 265941 - DNA, 25 bp, Homo sapien
tatcatgtgaggtggtctcagtggt

SEQ ID NO: 265942 - DNA, 25 bp, Homo sapien
tctcagtggtggtgatcgaagaagt

SEQ ID NO: 265943 - DNA, 25 bp, Homo sapien
tgtgggatgtagtctcagtggtggt

SEQ ID NO: 265944 - DNA, 25 bp, Homo sapien
tctcagtggtggtgattgaagaagt

SEQ ID NO: 265945 - DNA, 25 bp, Homo sapien
attgaagaagtgaagccgggagtac

SEQ ID NO: 265946 - DNA, 25 bp, Homo sapien
gtctcagtggtggtgatcgaagaac

SEQ ID NO: 265947 - DNA, 25 bp, Homo sapien
tggtggtgatcgaagaactgaagct

SEQ ID NO: 265948 - DNA, 25 bp, Homo sapien
aactgaagctgggagtactgcttga

SEQ ID NO: 265949 - DNA, 25 bp, Homo sapien
gggctgagaattgttgcttcaggat

SEQ ID NO: 265950 - DNA, 25 bp, Homo sapien
gaattgttgcttcaggatagctaga

SEQ ID NO: 265951 - DNA, 25 bp, Homo sapien
aaggtggtgtggtgggacgctggca

SEQ ID NO: 265952 - DNA, 25 bp, Homo sapien
agttggtgtgttctggtttcgtggg

SEQ ID NO: 265953 - DNA, 25 bp, Homo sapien
gtttcgtgggatagtggaagtcact

SEQ ID NO: 265954 - DNA, 25 bp, Homo sapien
gggattcttggtgattaggagaaca

SEQ ID NO: 265955 - DNA, 25 bp, Homo sapien
taggagaacagggtacttcctgtgg

SEQ ID NO: 265956 - DNA, 25 bp, Homo sapien
gggcagtttttcatgaccacaggac

SEQ ID NO: 265957 - DNA, 25 bp, Homo sapien
agtttttcatgaccacaggactgca

SEQ ID NO: 265958 - DNA, 25 bp, Homo sapien
tagggtcaacaaatcaggccccttg

SEQ ID NO: 265959 - DNA, 25 bp, Homo sapien
gtcaacaaatcaggccccttgtggg

SEQ ID NO: 265960 - DNA, 25 bp, Homo sapien
agggcatgagttccccagtccccaa

SEQ ID NO: 265961 - DNA, 25 bp, Homo sapien
tgagttccccagtccccaaggaaag

SEQ ID NO: 265962 - DNA, 25 bp, Homo sapien
tggtgtcaactcgattcctgcggta

SEQ ID NO: 265963 - DNA, 25 bp, Homo sapien
gtgtcaactcgattcctgcggtaac

SEQ ID NO: 265964 - DNA, 25 bp, Homo sapien
gtcaactcgattcctgcggtaactc

SEQ ID NO: 265965 - DNA, 25 bp, Homo sapien
aactcgattcctgcggtaactctga

SEQ ID NO: 265966 - DNA, 25 bp, Homo sapien
tcgattcctgcggtaactctgagcc

SEQ ID NO: 265967 - DNA, 25 bp, Homo sapien
attcctgcggtaactctgagccctg

SEQ ID NO: 265968 - DNA, 25 bp, Homo sapien
cggtaactctgagccctgaaatcct

SEQ ID NO: 265969 - DNA, 25 bp, Homo sapien
tgaaatcctcagtctccttggcggg

SEQ ID NO: 265970 - DNA, 25 bp, Homo sapien
aggaagtcggcacatctccaggtct

SEQ ID NO: 265971 - DNA, 25 bp, Homo sapien
agatatatgtccttgctttcccatg

SEQ ID NO: 265972 - DNA, 25 bp, Homo sapien
tttcccatggttcttaagtgagtct

SEQ ID NO: 265973 - DNA, 25 bp, Homo sapien
gagtcttaagcttggatttgctcca

SEQ ID NO: 265974 - DNA, 25 bp, Homo sapien
ggtggtttgtgtttctcaaggctga

SEQ ID NO: 265975 - DNA, 25 bp, Homo sapien
agctactatttggtgcatgtcggaa

SEQ ID NO: 265976 - DNA, 25 bp, Homo sapien
gtgcatgtcggaaatctcacactaa

SEQ ID NO: 265977 - DNA, 25 bp, Homo sapien
actgtggatactctgtcatcactga

SEQ ID NO: 265978 - DNA, 25 bp, Homo sapien
tgcaaacaatcccactgcttgtaac

SEQ ID NO: 265979 - DNA, 25 bp, Homo sapien
tgcttgtaactcctggcagtgtgta

SEQ ID NO: 265980 - DNA, 25 bp, Homo sapien
ggcagtgtgtacttaccaaaatctt

SEQ ID NO: 265981 - DNA, 25 bp, Homo sapien
tcttgatcacacttaggtctcttgc

SEQ ID NO: 265982 - DNA, 25 bp, Homo sapien
acagcaccatgtaagatatccaact

SEQ ID NO: 265983 - DNA, 25 bp, Homo sapien
tatccaactactctgaaactaccac

SEQ ID NO: 265984 - DNA, 25 bp, Homo sapien
tactctgaaactaccacactgtgaa

SEQ ID NO: 265985 - DNA, 25 bp, Homo sapien
taccacactgtgaagagtctaacca

SEQ ID NO: 265986 - DNA, 25 bp, Homo sapien
gagtctaaccaagccacctggagag

SEQ ID NO: 265987 - DNA, 25 bp, Homo sapien
aacagccctagctgtgctcctactg

SEQ ID NO: 265988 - DNA, 25 bp, Homo sapien
agcctgccaggcatgtgactgagac

SEQ ID NO: 265989 - DNA, 25 bp, Homo sapien
gaagtggattttccagccctactca

SEQ ID NO: 265990 - DNA, 25 bp, Homo sapien
agggtcccagggactctcctgagat

SEQ ID NO: 265991 - DNA, 25 bp, Homo sapien
ggctctcctgccaaggaatttacat

SEQ ID NO: 265992 - DNA, 25 bp, Homo sapien
atttacatttccttgtcacagcacc

SEQ ID NO: 265993 - DNA, 25 bp, Homo sapien
taattttcagctcctctgttggaca

SEQ ID NO: 265994 - DNA, 25 bp, Homo sapien
tcagctcctctgttggacatataag

SEQ ID NO: 265995 - DNA, 25 bp, Homo sapien
ctgttggacatataagtgcatctct

SEQ ID NO: 265996 - DNA, 25 bp, Homo sapien
ataagtgcatctcttgttggacata

SEQ ID NO: 265997 - DNA, 25 bp, Homo sapien
gcatctcttgttggacataggcaaa

SEQ ID NO: 265998 - DNA, 25 bp, Homo sapien
ggcaaaataacttggcaaacttagt

SEQ ID NO: 265999 - DNA, 25 bp, Homo sapien
gcaaacttagttctggtgatttctt

SEQ ID NO: 266000 - DNA, 25 bp, Homo sapien
gtgatttcttgatggtttggaagtc

SEQ ID NO: 266001 - DNA, 25 bp, Homo sapien
atggtttggaagtctattgctggga

SEQ ID NO: 266002 - DNA, 25 bp, Homo sapien
ggaagaaattccatcatacatattc

SEQ ID NO: 266003 - DNA, 25 bp, Homo sapien
ggagcagtactacaagttgagtaat

SEQ ID NO: 266004 - DNA, 25 bp, Homo sapien
tctctagcaaaaaagcatgctcttg

SEQ ID NO: 266005 - DNA, 25 bp, Homo sapien
cttgatctttttaaattctttggct

SEQ ID NO: 266006 - DNA, 25 bp, Homo sapien
ttgatctttttaaattctttggctt

SEQ ID NO: 266007 - DNA, 25 bp, Homo sapien
acctttgacttgcagcctctgagac

SEQ ID NO: 266008 - DNA, 25 bp, Homo sapien
ttgacttgcagcctctgagacccat

SEQ ID NO: 266009 - DNA, 25 bp, Homo sapien
tgacttgcagcctctgagacccatg

SEQ ID NO: 266010 - DNA, 25 bp, Homo sapien
gacttgcagcctctgagacccatgt

SEQ ID NO: 266011 - DNA, 25 bp, Homo sapien
acttgcagcctctgagacccatgta

SEQ ID NO: 266012 - DNA, 25 bp, Homo sapien
taagttttatttcatggctttaaca

SEQ ID NO: 266013 - DNA, 25 bp, Homo sapien
tcatggctttaacagcacctaagtt

SEQ ID NO: 266014 - DNA, 25 bp, Homo sapien
catggctttaacagcacctaagttc

SEQ ID NO: 266015 - DNA, 25 bp, Homo sapien
aaagcttcgagaaatgctgcaccaa

SEQ ID NO: 266016 - DNA, 25 bp, Homo sapien
aaagccagcttggacaacttcacag

SEQ ID NO: 266017 - DNA, 25 bp, Homo sapien
gacaacttcacagctcagagggtac

SEQ ID NO: 266018 - DNA, 25 bp, Homo sapien
agagggtacttctccagctcagcaa

SEQ ID NO: 266019 - DNA, 25 bp, Homo sapien
agctcagcaacaggtagctctgctt

SEQ ID NO: 266020 - DNA, 25 bp, Homo sapien
acaggtagctctgcttgatcttcag

SEQ ID NO: 266021 - DNA, 25 bp, Homo sapien
gagtgctttattctgcagccaactt

SEQ ID NO: 266022 - DNA, 25 bp, Homo sapien
ttgaaatacagaagctccagagggt

SEQ ID NO: 266023 - DNA, 25 bp, Homo sapien
ggtggtacgacagaaagagcgccaa

SEQ ID NO: 266024 - DNA, 25 bp, Homo sapien
aagagcgccaactggctgatgccaa

SEQ ID NO: 266025 - DNA, 25 bp, Homo sapien
ctgatgccaaacaatgtgtgcaatt

SEQ ID NO: 266026 - DNA, 25 bp, Homo sapien
gaagaagtctgggagaccacagaaa

SEQ ID NO: 266027 - DNA, 25 bp, Homo sapien
cttggatcagtgtgtgctggtgatt

SEQ ID NO: 266028 - DNA, 25 bp, Homo sapien
aacaccaatgacactgagctattag

SEQ ID NO: 266029 - DNA, 25 bp, Homo sapien
ttagagatcaaaactgggtcaggaa

SEQ ID NO: 266030 - DNA, 25 bp, Homo sapien
gaagagttcatgttaagctttcaca

SEQ ID NO: 266031 - DNA, 25 bp, Homo sapien
ctttcacatgtgctaagaacgctga

SEQ ID NO: 266032 - DNA, 25 bp, Homo sapien
gaacgctgaaagatacacactgatt

SEQ ID NO: 266033 - DNA, 25 bp, Homo sapien
agatacacactgatttccatcttaa

SEQ ID NO: 266034 - DNA, 25 bp, Homo sapien
atttccatcttaatagtgccggata

SEQ ID NO: 266035 - DNA, 25 bp, Homo sapien
tagtgccggataattgacaaatttg

SEQ ID NO: 266036 - DNA, 25 bp, Homo sapien
tttcccttcctcaagtcttgttcac

SEQ ID NO: 266037 - DNA, 25 bp, Homo sapien
agggcatgagttccccagtccccaa

SEQ ID NO: 266038 - DNA, 25 bp, Homo sapien
gggcatgagttccccagtccccaag

SEQ ID NO: 266039 - DNA, 25 bp, Homo sapien
ggcatgagttccccagtccccaagg

SEQ ID NO: 266040 - DNA, 25 bp, Homo sapien
gcatgagttccccagtccccaagga

SEQ ID NO: 266041 - DNA, 25 bp, Homo sapien
catgagttccccagtccccaaggaa

SEQ ID NO: 266042 - DNA, 25 bp, Homo sapien
tgagttccccagtccccaaggaaag

SEQ ID NO: 266043 - DNA, 25 bp, Homo sapien
ccctcagtctccctcctcctcattc

SEQ ID NO: 266044 - DNA, 25 bp, Homo sapien
cctcagtctccctcctcctcattcc

SEQ ID NO: 266045 - DNA, 25 bp, Homo sapien
ctcagtctccctcctcctcattccc

SEQ ID NO: 266046 - DNA, 25 bp, Homo sapien
catggctcatgtatttctgcttaag

SEQ ID NO: 266047 - DNA, 25 bp, Homo sapien
ttaatgcatcccttttcaactactc

SEQ ID NO: 266048 - DNA, 25 bp, Homo sapien
tttcaactactccagcgctgttgct

SEQ ID NO: 266049 - DNA, 25 bp, Homo sapien
ctgttgctgctgcaatgttagcaaa

SEQ ID NO: 266050 - DNA, 25 bp, Homo sapien
gttagcaaatgcaagccagagagaa

SEQ ID NO: 266051 - DNA, 25 bp, Homo sapien
gaagcacttgaaaatcctttgatgt

SEQ ID NO: 266052 - DNA, 25 bp, Homo sapien
atgttcaaatagtgtggatgtttac

SEQ ID NO: 266053 - DNA, 25 bp, Homo sapien
ggatgtttacatatctgaagttttc

SEQ ID NO: 266054 - DNA, 25 bp, Homo sapien
aaatactagcatatccggtttccct

SEQ ID NO: 266055 - DNA, 25 bp, Homo sapien
agcatatccggtttcccttaatagc

SEQ ID NO: 266056 - DNA, 25 bp, Homo sapien
caaagaccctgaagccatccatggc

SEQ ID NO: 266057 - DNA, 25 bp, Homo sapien
tgaaaagctaggctcctgtgacctc

SEQ ID NO: 266058 - DNA, 25 bp, Homo sapien
aaagctaggctcctgtgacctcctt

SEQ ID NO: 266059 - DNA, 25 bp, Homo sapien
taaagaccacttagtcccactccct

SEQ ID NO: 266060 - DNA, 25 bp, Homo sapien
ctgcctcattccatttctggggata

SEQ ID NO: 266061 - DNA, 25 bp, Homo sapien
tcccactccctctttttacagaaga

SEQ ID NO: 266062 - DNA, 25 bp, Homo sapien
agcgagtctgtctcaaacgtctcaa

SEQ ID NO: 266063 - DNA, 25 bp, Homo sapien
gaaactcaggcccaagaaggacagt

SEQ ID NO: 266064 - DNA, 25 bp, Homo sapien
gaccagtctgaggtcacaacccaaa

SEQ ID NO: 266065 - DNA, 25 bp, Homo sapien
gtctgaggtcacaacccaaagctgg

SEQ ID NO: 266066 - DNA, 25 bp, Homo sapien
gaggtcacaacccaaagctggcagg

SEQ ID NO: 266067 - DNA, 25 bp, Homo sapien
tcacaacccaaagctggcagggctg

SEQ ID NO: 266068 - DNA, 25 bp, Homo sapien
tgccaaatgttcctagattgctctt

SEQ ID NO: 266069 - DNA, 25 bp, Homo sapien
gttcctagattgctcttaacctgtt

SEQ ID NO: 266070 - DNA, 25 bp, Homo sapien
gattgctcttaacctgttaatacaa

SEQ ID NO: 266071 - DNA, 25 bp, Homo sapien
atggagtctggcctaagtacagaat

SEQ ID NO: 266072 - DNA, 25 bp, Homo sapien
tcttttgttctgtatcaaactgcag

SEQ ID NO: 266073 - DNA, 25 bp, Homo sapien
actgcagaacagctatatacttggt

SEQ ID NO: 266074 - DNA, 25 bp, Homo sapien
atacttggtattttgtacgtgaata

SEQ ID NO: 266075 - DNA, 25 bp, Homo sapien
tgaataacgttttagcttttgtgcc

SEQ ID NO: 266076 - DNA, 25 bp, Homo sapien
cttttgtgcccttttgagcttgaag

SEQ ID NO: 266077 - DNA, 25 bp, Homo sapien
gagcttgaagggttatcctcaaagg

SEQ ID NO: 266078 - DNA, 25 bp, Homo sapien
gaagacaaacctaagataccataaa

SEQ ID NO: 266079 - DNA, 25 bp, Homo sapien
cacctaccaacgccctgtggaaagg

SEQ ID NO: 266080 - DNA, 25 bp, Homo sapien
gaaaggaagcctatgttttatatat

SEQ ID NO: 266081 - DNA, 25 bp, Homo sapien
acacccagaagtctttggacccatt

SEQ ID NO: 266082 - DNA, 25 bp, Homo sapien
cagaagtctttggacccatttggtt

SEQ ID NO: 266083 - DNA, 25 bp, Homo sapien
tataaatacaggacagctccaaggc

SEQ ID NO: 266084 - DNA, 25 bp, Homo sapien
cagctccaaggcccagtccagatga

SEQ ID NO: 266085 - DNA, 25 bp, Homo sapien
ccacccaggacttcatgcagggctg

SEQ ID NO: 266086 - DNA, 25 bp, Homo sapien
ggcagttgttggagccccaccctgg

SEQ ID NO: 266087 - DNA, 25 bp, Homo sapien
actttcttctctcccagggatggcg

SEQ ID NO: 266088 - DNA, 25 bp, Homo sapien
tctctcccagggatggcgtcaacag

SEQ ID NO: 266089 - DNA, 25 bp, Homo sapien
gggatggcgtcaacagtcccaccta

SEQ ID NO: 266090 - DNA, 25 bp, Homo sapien
aaacagtatctcagtcaccaaacgc

SEQ ID NO: 266091 - DNA, 25 bp, Homo sapien
gaagagtgcttatccactggctgca

SEQ ID NO: 266092 - DNA, 25 bp, Homo sapien
tatccactggctgcagagactccga

SEQ ID NO: 266093 - DNA, 25 bp, Homo sapien
gagactccgagcatgaaggccacaa

SEQ ID NO: 266094 - DNA, 25 bp, Homo sapien
catgaaggccacaaggtctgcactt

SEQ ID NO: 266095 - DNA, 25 bp, Homo sapien
gccactgccccgaaatgaaactgat

SEQ ID NO: 266096 - DNA, 25 bp, Homo sapien
gaaactgatgccacatttgccacga

SEQ ID NO: 266097 - DNA, 25 bp, Homo sapien
gccacgacgtcacctataaatcaga

SEQ ID NO: 266098 - DNA, 25 bp, Homo sapien
cagtgatagtgtcctgcttgtggtt

SEQ ID NO: 266099 - DNA, 25 bp, Homo sapien
agggctcatgttatagtggctcagt

SEQ ID NO: 266100 - DNA, 25 bp, Homo sapien
ggctcagtggctccatgtgttaata

SEQ ID NO: 266101 - DNA, 25 bp, Homo sapien
ttcctttgtgaatcactgtgtgcca

SEQ ID NO: 266102 - DNA, 25 bp, Homo sapien
aagagaacatcatagattcttctaa

SEQ ID NO: 266103 - DNA, 25 bp, Homo sapien
actgtgtgccaactgactattcatt

SEQ ID NO: 266104 - DNA, 25 bp, Homo sapien
gtgccaactgactattcattgtgtt

SEQ ID NO: 266105 - DNA, 25 bp, Homo sapien
attcattgtgttgtagtcacagtca

SEQ ID NO: 266106 - DNA, 25 bp, Homo sapien
tgctgctcacttgatttcagatatg

SEQ ID NO: 266107 - DNA, 25 bp, Homo sapien
ttcagatatggccagtggaaactcc

SEQ ID NO: 266108 - DNA, 25 bp, Homo sapien
aaaagcagggtcaatgtttcattct

SEQ ID NO: 266109 - DNA, 25 bp, Homo sapien
gggtcaatgtttcattctgtccttt

SEQ ID NO: 266110 - DNA, 25 bp, Homo sapien
cattctgtcctttatccatttgaaa

SEQ ID NO: 266111 - DNA, 25 bp, Homo sapien
gaagatagtcacctatagttgtgga

SEQ ID NO: 266112 - DNA, 25 bp, Homo sapien
gccaccccacaacccgccaggattt

SEQ ID NO: 266113 - DNA, 25 bp, Homo sapien
cccacaacccgccaggatttaatct

SEQ ID NO: 266114 - DNA, 25 bp, Homo sapien
ccacaacccgccaggatttaatctt

SEQ ID NO: 266115 - DNA, 25 bp, Homo sapien
cacaacccgccaggatttaatcttt

SEQ ID NO: 266116 - DNA, 25 bp, Homo sapien
ttcagtttatagtttccaggaggaa

SEQ ID NO: 266117 - DNA, 25 bp, Homo sapien
ttccaggaggaaagtcttgtaacgc

SEQ ID NO: 266118 - DNA, 25 bp, Homo sapien
tccaggaggaaagtcttgtaacgct

SEQ ID NO: 266119 - DNA, 25 bp, Homo sapien
ccaggaggaaagtcttgtaacgctt

SEQ ID NO: 266120 - DNA, 25 bp, Homo sapien
caggaggaaagtcttgtaacgcttt

SEQ ID NO: 266121 - DNA, 25 bp, Homo sapien
gaggaaagtcttgtaacgctttact

SEQ ID NO: 266122 - DNA, 25 bp, Homo sapien
tcttgtaacgctttactttttctct

SEQ ID NO: 266123 - DNA, 25 bp, Homo sapien
tgacggggccttttagtgggaggag

SEQ ID NO: 266124 - DNA, 25 bp, Homo sapien
ggccttttagtgggaggagttgcca

SEQ ID NO: 266125 - DNA, 25 bp, Homo sapien
gccttttagtgggaggagttgccat

SEQ ID NO: 266126 - DNA, 25 bp, Homo sapien
ccttttagtgggaggagttgccatt

SEQ ID NO: 266127 - DNA, 25 bp, Homo sapien
cttttagtgggaggagttgccatta

SEQ ID NO: 266128 - DNA, 25 bp, Homo sapien
ttttagtgggaggagttgccattac

SEQ ID NO: 266129 - DNA, 25 bp, Homo sapien
ggagttgccattacactacgtccag

SEQ ID NO: 266130 - DNA, 25 bp, Homo sapien
gagttgccattacactacgtccagt

SEQ ID NO: 266131 - DNA, 25 bp, Homo sapien
agttgccattacactacgtccagta

SEQ ID NO: 266132 - DNA, 25 bp, Homo sapien
gttgccattacactacgtccagtaa

SEQ ID NO: 266133 - DNA, 25 bp, Homo sapien
ttgccattacactacgtccagtaag

SEQ ID NO: 266134 - DNA, 25 bp, Homo sapien
ctcatttcctgtaacctagatgcct

SEQ ID NO: 266135 - DNA, 25 bp, Homo sapien
atttcaccatagagattctttgctg

SEQ ID NO: 266136 - DNA, 25 bp, Homo sapien
caccatagagattctttgctgaaga

SEQ ID NO: 266137 - DNA, 25 bp, Homo sapien
tcctgtaacctagatgcctttttaa

SEQ ID NO: 266138 - DNA, 25 bp, Homo sapien
aaaaccaagctacagctccttataa

SEQ ID NO: 266139 - DNA, 25 bp, Homo sapien
gctacagctccttataattcaacaa

SEQ ID NO: 266140 - DNA, 25 bp, Homo sapien
gctccttataattcaacaagcattt

SEQ ID NO: 266141 - DNA, 25 bp, Homo sapien
tctatgcagtctccatgtgaaacca

SEQ ID NO: 266142 - DNA, 25 bp, Homo sapien
gtctccatgtgaaaccaggtgctgt

SEQ ID NO: 266143 - DNA, 25 bp, Homo sapien
ccatgtgaaaccaggtgctgttccc

SEQ ID NO: 266144 - DNA, 25 bp, Homo sapien
tcccaaaggagaaaacactgccctc

SEQ ID NO: 266145 - DNA, 25 bp, Homo sapien
tgtcaaaaggccaaagcattgcccc

SEQ ID NO: 266146 - DNA, 25 bp, Homo sapien
aacacactcctttaatgtagtccct

SEQ ID NO: 266147 - DNA, 25 bp, Homo sapien
ctttaatgtagtcccttctttccag

SEQ ID NO: 266148 - DNA, 25 bp, Homo sapien
tctttccaggtgtcttcctgaagag

SEQ ID NO: 266149 - DNA, 25 bp, Homo sapien
gagagatgcaattgggagctccgta

SEQ ID NO: 266150 - DNA, 25 bp, Homo sapien
gggagctccgtagtgaatctagtta

SEQ ID NO: 266151 - DNA, 25 bp, Homo sapien
gaaagacccgtctctcaatattatg

SEQ ID NO: 266152 - DNA, 25 bp, Homo sapien
ctcaatattatggttgcttcccaaa

SEQ ID NO: 266153 - DNA, 25 bp, Homo sapien
ttgcttcccaaaacaaaaccagttg

SEQ ID NO: 266154 - DNA, 25 bp, Homo sapien
gatatggacatgctgccttacattt

SEQ ID NO: 266155 - DNA, 25 bp, Homo sapien
ccttacatttcatatcacctcttta

SEQ ID NO: 266156 - DNA, 25 bp, Homo sapien
aaagggaggcaccattccagtctgg

SEQ ID NO: 266157 - DNA, 25 bp, Homo sapien
tgaagcgacctggttcatctcggca

SEQ ID NO: 266158 - DNA, 25 bp, Homo sapien
agtaatctccgcattctgcagaatc

SEQ ID NO: 266159 - DNA, 25 bp, Homo sapien
tgcagaatcctatctcatctggttt

SEQ ID NO: 266160 - DNA, 25 bp, Homo sapien
catctggttttaatcctgaaggcat

SEQ ID NO: 266161 - DNA, 25 bp, Homo sapien
ggaggagacccaacagaggtaccaa

SEQ ID NO: 266162 - DNA, 25 bp, Homo sapien
aacttcctttttgatttgtgccaat

SEQ ID NO: 266163 - DNA, 25 bp, Homo sapien
gaggatctattccacaagacgctgt

SEQ ID NO: 266164 - DNA, 25 bp, Homo sapien
cacaagacgctgtatgttttttctc

SEQ ID NO: 266165 - DNA, 25 bp, Homo sapien
tctctcctaaattgcataccacttg

SEQ ID NO: 266166 - DNA, 25 bp, Homo sapien
ataccacttggagccataccctgtg

SEQ ID NO: 266167 - DNA, 25 bp, Homo sapien
aggacgtccccgaagacgtcaagct

SEQ ID NO: 266168 - DNA, 25 bp, Homo sapien
agacgtcaagctgcggcgtcgtcca

SEQ ID NO: 266169 - DNA, 25 bp, Homo sapien
tccaccggccggaacgggaggctct

SEQ ID NO: 266170 - DNA, 25 bp, Homo sapien
aggctctggagaacgagcccggccc

SEQ ID NO: 266171 - DNA, 25 bp, Homo sapien
ggcccgagacggaccttctggctgt

SEQ ID NO: 266172 - DNA, 25 bp, Homo sapien
ggaccttctggctgtagcggaacat

SEQ ID NO: 266173 - DNA, 25 bp, Homo sapien
accttctggctgtagcggaacatca

SEQ ID NO: 266174 - DNA, 25 bp, Homo sapien
ggctgtagcggaacatcaggcccta

SEQ ID NO: 266175 - DNA, 25 bp, Homo sapien
gtagcggaacatcaggccctagtct

SEQ ID NO: 266176 - DNA, 25 bp, Homo sapien
gaacatcaggccctagtctttggcg

SEQ ID NO: 266177 - DNA, 25 bp, Homo sapien
atcaggccctagtctttggcggcgg

SEQ ID NO: 266178 - DNA, 25 bp, Homo sapien
agtgtggatcgggtttctggcactt

SEQ ID NO: 266179 - DNA, 25 bp, Homo sapien
gtttctggcacttgcagtgtctgca

SEQ ID NO: 266180 - DNA, 25 bp, Homo sapien
tggcacttgcagtgtctgcacggtc

SEQ ID NO: 266181 - DNA, 25 bp, Homo sapien
agaccgggcccagatgagtttgcgc

SEQ ID NO: 266182 - DNA, 25 bp, Homo sapien
ggcccagatgagtttgcgctgaatc

SEQ ID NO: 266183 - DNA, 25 bp, Homo sapien
ctgaactaccgggacacatgctgtt

SEQ ID NO: 266184 - DNA, 25 bp, Homo sapien
taccgggacacatgctgttcctgcc

SEQ ID NO: 266185 - DNA, 25 bp, Homo sapien
tgttcctgcctccaggcgtgcactt

SEQ ID NO: 266186 - DNA, 25 bp, Homo sapien
tccaggcgtgcacttcttcctgcag

SEQ ID NO: 266187 - DNA, 25 bp, Homo sapien
cctactaactccttcttgaacttga

SEQ ID NO: 266188 - DNA, 25 bp, Homo sapien
ttcttgaacttgatagctccattgt

SEQ ID NO: 266189 - DNA, 25 bp, Homo sapien
cagcttgggcacatcagtgaaaccc

SEQ ID NO: 266190 - DNA, 25 bp, Homo sapien
agcttgggcacatcagtgaaaccct

SEQ ID NO: 266191 - DNA, 25 bp, Homo sapien
tgcacttcatcctgggtaagagtgg

SEQ ID NO: 266192 - DNA, 25 bp, Homo sapien
acttcatcctgggtaagagtgggac

SEQ ID NO: 266193 - DNA, 25 bp, Homo sapien
ttcatcctgggtaagagtgggacac

SEQ ID NO: 266194 - DNA, 25 bp, Homo sapien
catcctgggtaagagtgggacacct

SEQ ID NO: 266195 - DNA, 25 bp, Homo sapien
tcctgggtaagagtgggacacctgt

SEQ ID NO: 266196 - DNA, 25 bp, Homo sapien
ggtaagagtgggacacctgtgtctt

SEQ ID NO: 266197 - DNA, 25 bp, Homo sapien
gtaagagtgggacacctgtgtctta

SEQ ID NO: 266198 - DNA, 25 bp, Homo sapien
aagagtgggacacctgtgtcttaaa

SEQ ID NO: 266199 - DNA, 25 bp, Homo sapien
gagtgggacacctgtgtcttaaaaa

SEQ ID NO: 266200 - DNA, 25 bp, Homo sapien
gtgaggtggtactcgcctgtaagtc

SEQ ID NO: 266201 - DNA, 25 bp, Homo sapien
tggtactcgcctgtaagtcctgagg

SEQ ID NO: 266202 - DNA, 25 bp, Homo sapien
cgcctgtaagtcctgaggctgagtt

SEQ ID NO: 266203 - DNA, 25 bp, Homo sapien
aacccataaatagcagtcgtcacat

SEQ ID NO: 266204 - DNA, 25 bp, Homo sapien
atagcagtcgtcacatgcactcaga

SEQ ID NO: 266205 - DNA, 25 bp, Homo sapien
tcacatgcactcagatttccacaaa

SEQ ID NO: 266206 - DNA, 25 bp, Homo sapien
atgcactcagatttccacaaatata

SEQ ID NO: 266207 - DNA, 25 bp, Homo sapien
gggacctgggagtaatacagcctgt

SEQ ID NO: 266208 - DNA, 25 bp, Homo sapien
ggcctctagcggttatatcacgtaa

SEQ ID NO: 266209 - DNA, 25 bp, Homo sapien
gttatatcacgtaaaatctcgggag

SEQ ID NO: 266210 - DNA, 25 bp, Homo sapien
tcacgtaaaatctcgggagttgtgc

SEQ ID NO: 266211 - DNA, 25 bp, Homo sapien
gaacgtcctctgagccgcccgcagg

SEQ ID NO: 266212 - DNA, 25 bp, Homo sapien
gggaggaagagaccgagaacgttgg

SEQ ID NO: 266213 - DNA, 25 bp, Homo sapien
aggacgtccccgaagacgtcaagct

SEQ ID NO: 266214 - DNA, 25 bp, Homo sapien
acgtccccgaagacgtcaagctgcg

SEQ ID NO: 266215 - DNA, 25 bp, Homo sapien
tccccgaagacgtcaagctgcggcg

SEQ ID NO: 266216 - DNA, 25 bp, Homo sapien
cgaagacgtcaagctgcggcgtcgt

SEQ ID NO: 266217 - DNA, 25 bp, Homo sapien
agacgtcaagctgcggcgtcgtcca

SEQ ID NO: 266218 - DNA, 25 bp, Homo sapien
tccaccggccggaacgggaggctct

SEQ ID NO: 266219 - DNA, 25 bp, Homo sapien
gccggaacgggaggctctggagaac

SEQ ID NO: 266220 - DNA, 25 bp, Homo sapien
gagaacgagcccggccctcaaggga

SEQ ID NO: 266221 - DNA, 25 bp, Homo sapien
cggccctcaagggacgctgtctggg

SEQ ID NO: 266222 - DNA, 25 bp, Homo sapien
actctataaagatgtcaggagccca

SEQ ID NO: 266223 - DNA, 25 bp, Homo sapien
cagaaagccacatcacatataagat

SEQ ID NO: 266224 - DNA, 25 bp, Homo sapien
gatgaagtcttttctctaagacgga

SEQ ID NO: 266225 - DNA, 25 bp, Homo sapien
tctctaagacggaaagctgcaaagg

SEQ ID NO: 266226 - DNA, 25 bp, Homo sapien
ccagctgttatttctaaaggtcata

SEQ ID NO: 266227 - DNA, 25 bp, Homo sapien
aaatcaaaggtattcagctattcat

SEQ ID NO: 266228 - DNA, 25 bp, Homo sapien
tcagctattcatttacttgcatggt

SEQ ID NO: 266229 - DNA, 25 bp, Homo sapien
ttacttgcatggtatgagtgaccaa

SEQ ID NO: 266230 - DNA, 25 bp, Homo sapien
gagtgaccaaaacggaagcacgctt

SEQ ID NO: 266231 - DNA, 25 bp, Homo sapien
ggaagcacgctttgtatttctacac

SEQ ID NO: 266232 - DNA, 25 bp, Homo sapien
gcacgctttgtatttctacactgaa

SEQ ID NO: 266233 - DNA, 25 bp, Homo sapien
acagtgtccgcccacctatttatga

SEQ ID NO: 266234 - DNA, 25 bp, Homo sapien
tgtccgcccacctatttatgacata

SEQ ID NO: 266235 - DNA, 25 bp, Homo sapien
ccgcccacctatttatgacatattt

SEQ ID NO: 266236 - DNA, 25 bp, Homo sapien
tggaacccgaggcctcactcctgtg

SEQ ID NO: 266237 - DNA, 25 bp, Homo sapien
ctgaggccgggccagtcttcctggg

SEQ ID NO: 266238 - DNA, 25 bp, Homo sapien
tctcaggcccgtggcatcgctggga

SEQ ID NO: 266239 - DNA, 25 bp, Homo sapien
ccagtggaccccagtggtctagagg

SEQ ID NO: 266240 - DNA, 25 bp, Homo sapien
gtggaccccagtggtctagaggaat

SEQ ID NO: 266241 - DNA, 25 bp, Homo sapien
accccagtggtctagaggaatgtga

SEQ ID NO: 266242 - DNA, 25 bp, Homo sapien
tggtctagaggaatgtgagccccgc

SEQ ID NO: 266243 - DNA, 25 bp, Homo sapien
ctagaggaatgtgagccccgcctgt

SEQ ID NO: 266244 - DNA, 25 bp, Homo sapien
agtctaatgtcattcacttcatttg

SEQ ID NO: 266245 - DNA, 25 bp, Homo sapien
aatgtcattcacttcatttgatggg

SEQ ID NO: 266246 - DNA, 25 bp, Homo sapien
gggtcacttgttagctgtcactaat

SEQ ID NO: 266247 - DNA, 25 bp, Homo sapien
acttgataaatgaaactgtaccgtt

SEQ ID NO: 266248 - DNA, 25 bp, Homo sapien
gtaccgttaaatacaatagctgagt

SEQ ID NO: 266249 - DNA, 25 bp, Homo sapien
tttccccagtgtattgtaaaattga

SEQ ID NO: 266250 - DNA, 25 bp, Homo sapien
gacacacactaatacaagatggatt

SEQ ID NO: 266251 - DNA, 25 bp, Homo sapien
gatggattatcaggatgtatctaaa

SEQ ID NO: 266252 - DNA, 25 bp, Homo sapien
tgtatctaaatgtcccgagagggtt

SEQ ID NO: 266253 - DNA, 25 bp, Homo sapien
tcccgagagggttaaaagctaactg

SEQ ID NO: 266254 - DNA, 25 bp, Homo sapien
aatctgacaaatcttgtttatatgg

SEQ ID NO: 266255 - DNA, 25 bp, Homo sapien
agacagacggacaggcggaccgcta

SEQ ID NO: 266256 - DNA, 25 bp, Homo sapien
cggaccgctagggagctcaagtacc

SEQ ID NO: 266257 - DNA, 25 bp, Homo sapien
gaccgctagggagctcaagtacccg

SEQ ID NO: 266258 - DNA, 25 bp, Homo sapien
cgctagggagctcaagtacccggac

SEQ ID NO: 266259 - DNA, 25 bp, Homo sapien
aagtacccggacacacgcacgagcg

SEQ ID NO: 266260 - DNA, 25 bp, Homo sapien
ggacacacgcacgagcgcagaacaa

SEQ ID NO: 266261 - DNA, 25 bp, Homo sapien
acacacgcacgagcgcagaacaaag

SEQ ID NO: 266262 - DNA, 25 bp, Homo sapien
acgcacgagcgcagaacaaagggcc

SEQ ID NO: 266263 - DNA, 25 bp, Homo sapien
gagcgcagaacaaagggccggacat

SEQ ID NO: 266264 - DNA, 25 bp, Homo sapien
aacaaagggccggacatgctccagc

SEQ ID NO: 266265 - DNA, 25 bp, Homo sapien
aaagggccggacatgctccagcccg

SEQ ID NO: 266266 - DNA, 25 bp, Homo sapien
gggcataatcattaagactaggcta

SEQ ID NO: 266267 - DNA, 25 bp, Homo sapien
gactaggctaaaaattcgagacttt

SEQ ID NO: 266268 - DNA, 25 bp, Homo sapien
cttcccaagtgactatcttccttga

SEQ ID NO: 266269 - DNA, 25 bp, Homo sapien
caagtgactatcttccttgaaactt

SEQ ID NO: 266270 - DNA, 25 bp, Homo sapien
ttcaatgacatcacacgatactggt

SEQ ID NO: 266271 - DNA, 25 bp, Homo sapien
cacacgatactggttttattctgga

SEQ ID NO: 266272 - DNA, 25 bp, Homo sapien
ggttttattctggactatctatcct

SEQ ID NO: 266273 - DNA, 25 bp, Homo sapien
tatctatcctactcatgggtccaag

SEQ ID NO: 266274 - DNA, 25 bp, Homo sapien
ctactcatgggtccaagggaaactt

SEQ ID NO: 266275 - DNA, 25 bp, Homo sapien
gagcaagtagtctagtttcaagtgt

SEQ ID NO: 266276 - DNA, 25 bp, Homo sapien
gaaatgggagtagctaagcctggaa

SEQ ID NO: 266277 - DNA, 25 bp, Homo sapien
aacctcgtcccaatggactacagga

SEQ ID NO: 266278 - DNA, 25 bp, Homo sapien
caggaagagccccatcgtccacgtg

SEQ ID NO: 266279 - DNA, 25 bp, Homo sapien
ttcaaagaaaggatcgtggcggcgt

SEQ ID NO: 266280 - DNA, 25 bp, Homo sapien
ggaacctcactttcaacgactttgt

SEQ ID NO: 266281 - DNA, 25 bp, Homo sapien
aacgactttgtggacatgttttccg

SEQ ID NO: 266282 - DNA, 25 bp, Homo sapien
acatgttttccgtgctctgcgagtc

SEQ ID NO: 266283 - DNA, 25 bp, Homo sapien
gtcggctccccgagagctcaaggca

SEQ ID NO: 266284 - DNA, 25 bp, Homo sapien
gctcaaggcaaactatgccttcaag

SEQ ID NO: 266285 - DNA, 25 bp, Homo sapien
tgccttcaagatctatgacttcaac

SEQ ID NO: 266286 - DNA, 25 bp, Homo sapien
gatctatgacttcaacactgacaac

SEQ ID NO: 266287 - DNA, 25 bp, Homo sapien
caacactgacaacttcatctgcaag

SEQ ID NO: 266288 - DNA, 25 bp, Homo sapien
gatctgctgatgaaacccttttctt

SEQ ID NO: 266289 - DNA, 25 bp, Homo sapien
ctgctgatgaaacccttttcttcct

SEQ ID NO: 266290 - DNA, 25 bp, Homo sapien
ttccttgattgactggatctcgggc

SEQ ID NO: 266291 - DNA, 25 bp, Homo sapien
tgattgactggatctcgggcaggac

SEQ ID NO: 266292 - DNA, 25 bp, Homo sapien
agagcccggtgcacagtcaggtgaa

SEQ ID NO: 266293 - DNA, 25 bp, Homo sapien
gcccggtgcacagtcaggtgaaagt

SEQ ID NO: 266294 - DNA, 25 bp, Homo sapien
aagctgagggccagagccacgcagc

SEQ ID NO: 266295 - DNA, 25 bp, Homo sapien
gggcagttgttttcatcctgggaag

SEQ ID NO: 266296 - DNA, 25 bp, Homo sapien
gttgttttcatcctgggaagccagt

SEQ ID NO: 266297 - DNA, 25 bp, Homo sapien
tgggaagccagtcgcagtcattctg

SEQ ID NO: 266298 - DNA, 25 bp, Homo sapien
agtcattctgcctacctgaggcagg

SEQ ID NO: 266299 - DNA, 25 bp, Homo sapien
ggttcagcagagagccaccacgcag

SEQ ID NO: 266300 - DNA, 25 bp, Homo sapien
ggatgcactgggacctgagaaccgt

SEQ ID NO: 266301 - DNA, 25 bp, Homo sapien
acctgagaaccgtcgggcagtccca

SEQ ID NO: 266302 - DNA, 25 bp, Homo sapien
ggcagtcccacgagctctttcatga

SEQ ID NO: 266303 - DNA, 25 bp, Homo sapien
tgaccagctccaaccgacaagtaca

SEQ ID NO: 266304 - DNA, 25 bp, Homo sapien
ttcgcactccactagctagtaagct

SEQ ID NO: 266305 - DNA, 25 bp, Homo sapien
ctgagctacaaggtgtgccaggcac

SEQ ID NO: 266306 - DNA, 25 bp, Homo sapien
gtgccaggcacccaggacgccgatt

SEQ ID NO: 266307 - DNA, 25 bp, Homo sapien
gattcaccgcttcagtgaaggccca

SEQ ID NO: 266308 - DNA, 25 bp, Homo sapien
cttccatgaagacttccgtgatcca

SEQ ID NO: 266309 - DNA, 25 bp, Homo sapien
ttgtgcagtcttttcccggcgtgag

SEQ ID NO: 266310 - DNA, 25 bp, Homo sapien
aatgcctgatttgctatttttgaca

SEQ ID NO: 266311 - DNA, 25 bp, Homo sapien
tttgctatttttgacatttcctcgt

SEQ ID NO: 266312 - DNA, 25 bp, Homo sapien
atttttgacatttcctcgtctctta

SEQ ID NO: 266313 - DNA, 25 bp, Homo sapien
tgacatttcctcgtctcttaagaag

SEQ ID NO: 266314 - DNA, 25 bp, Homo sapien
atttcctcgtctcttaagaagtcag

SEQ ID NO: 266315 - DNA, 25 bp, Homo sapien
tcctcgtctcttaagaagtcagtta

SEQ ID NO: 266316 - DNA, 25 bp, Homo sapien
tcctgtttcatagattactgtgaaa

SEQ ID NO: 266317 - DNA, 25 bp, Homo sapien
ctgtgaaacatgtatttaaacctat

SEQ ID NO: 266318 - DNA, 25 bp, Homo sapien
gtatttagattctagcgtgagttaa

SEQ ID NO: 266319 - DNA, 25 bp, Homo sapien
gttagttactaaacatatggcatgg

SEQ ID NO: 266320 - DNA, 25 bp, Homo sapien
ttttttccaaatgctatcagtgttt

SEQ ID NO: 266321 - DNA, 25 bp, Homo sapien
agatgtttcttttcataatgaaggc

SEQ ID NO: 266322 - DNA, 25 bp, Homo sapien
gaaggcaccatttcactagggattc

SEQ ID NO: 266323 - DNA, 25 bp, Homo sapien
gcaccatttcactagggattcaaga

SEQ ID NO: 266324 - DNA, 25 bp, Homo sapien
tcaagatccatacagaagtgtgcta

SEQ ID NO: 266325 - DNA, 25 bp, Homo sapien
acagaagtgtgctatatctttagaa

SEQ ID NO: 266326 - DNA, 25 bp, Homo sapien
aatttttccaagtttgtgcctgtcg

SEQ ID NO: 266327 - DNA, 25 bp, Homo sapien
tgtgcctgtcgtcatcatggtgatg

SEQ ID NO: 266328 - DNA, 25 bp, Homo sapien
ggctggtgaaacactgcccactgca

SEQ ID NO: 266329 - DNA, 25 bp, Homo sapien
ctgcccactgcatcaattccagagt

SEQ ID NO: 266330 - DNA, 25 bp, Homo sapien
aaattaatgttgacctttactgagt

SEQ ID NO: 266331 - DNA, 25 bp, Homo sapien
aactccttcagcttagaaacccaat

SEQ ID NO: 266332 - DNA, 25 bp, Homo sapien
aagttcaaattagagtcagcgtgct

SEQ ID NO: 266333 - DNA, 25 bp, Homo sapien
gagtcagcgtgctcatcagaaagaa

SEQ ID NO: 266334 - DNA, 25 bp, Homo sapien
gccaacacgtttaggaacagaaacg

SEQ ID NO: 266335 - DNA, 25 bp, Homo sapien
gttgaagacaaacaatccattgcgt

SEQ ID NO: 266336 - DNA, 25 bp, Homo sapien
aatccattgcgtttgtgttcagtaa

SEQ ID NO: 266337 - DNA, 25 bp, Homo sapien
gcgtttgtgttcagtaacccaagca

SEQ ID NO: 266338 - DNA, 25 bp, Homo sapien
gaaggcttgactatttgaaatctca

SEQ ID NO: 266339 - DNA, 25 bp, Homo sapien
gggccgtattggcttttcttatact

SEQ ID NO: 266340 - DNA, 25 bp, Homo sapien
cgtattggcttttcttatactctag

SEQ ID NO: 266341 - DNA, 25 bp, Homo sapien
tatactctagaacatacgacgacaa

SEQ ID NO: 266342 - DNA, 25 bp, Homo sapien
aacatacgacgacaaagaagatttt

SEQ ID NO: 266343 - DNA, 25 bp, Homo sapien
cagagaacgtgactgtcattcctaa

SEQ ID NO: 266344 - DNA, 25 bp, Homo sapien
cttgtccttgtaatttaacagctgg

SEQ ID NO: 266345 - DNA, 25 bp, Homo sapien
agctggagcctgtgatgttcgctgc

SEQ ID NO: 266346 - DNA, 25 bp, Homo sapien
ttcgctgctgctgtgaccaggaatg

SEQ ID NO: 266347 - DNA, 25 bp, Homo sapien
gctgctgtgaccaggaatgctcatc

SEQ ID NO: 266348 - DNA, 25 bp, Homo sapien
taacaacgctgttcagacggtcctg

SEQ ID NO: 266349 - DNA, 25 bp, Homo sapien
tgttcagacggtcctgcttcaccgg

SEQ ID NO: 266350 - DNA, 25 bp, Homo sapien
cttcaccggcgtgtttggaggagac

SEQ ID NO: 266351 - DNA, 25 bp, Homo sapien
tcaatcctccttttgatcagctctg

SEQ ID NO: 266352 - DNA, 25 bp, Homo sapien
tgctctgctgggacgacgacacgtg

SEQ ID NO: 266353 - DNA, 25 bp, Homo sapien
gacacgtggtgtccccgattggttt

SEQ ID NO: 266354 - DNA, 25 bp, Homo sapien
atattccttagatttaggacagtgg

SEQ ID NO: 266355 - DNA, 25 bp, Homo sapien
tattccttagatttaggacagtggc

SEQ ID NO: 266356 - DNA, 25 bp, Homo sapien
attccttagatttaggacagtggcc

SEQ ID NO: 266357 - DNA, 25 bp, Homo sapien
ttccttagatttaggacagtggcct

SEQ ID NO: 266358 - DNA, 25 bp, Homo sapien
tccttagatttaggacagtggcctt

SEQ ID NO: 266359 - DNA, 25 bp, Homo sapien
ccttagatttaggacagtggcctta

SEQ ID NO: 266360 - DNA, 25 bp, Homo sapien
cttagatttaggacagtggccttaa

SEQ ID NO: 266361 - DNA, 25 bp, Homo sapien
ttagatttaggacagtggccttaaa

SEQ ID NO: 266362 - DNA, 25 bp, Homo sapien
tagatttaggacagtggccttaaaa

SEQ ID NO: 266363 - DNA, 25 bp, Homo sapien
aaaatgcccattaatgggccgggcg

SEQ ID NO: 266364 - DNA, 25 bp, Homo sapien
aaatgcccattaatgggccgggcgc

SEQ ID NO: 266365 - DNA, 25 bp, Homo sapien
gccagaccctggtgcggtggtagag

SEQ ID NO: 266366 - DNA, 25 bp, Homo sapien
tggtagaggctcagacgtcggttcc

SEQ ID NO: 266367 - DNA, 25 bp, Homo sapien
agaggctcagacgtcggttccctat

SEQ ID NO: 266368 - DNA, 25 bp, Homo sapien
acgtcggttccctatgccattgtgg

SEQ ID NO: 266369 - DNA, 25 bp, Homo sapien
gttccctatgccattgtgggcggca

SEQ ID NO: 266370 - DNA, 25 bp, Homo sapien
ggtgtttctgatcatatgtgtgcta

SEQ ID NO: 266371 - DNA, 25 bp, Homo sapien
atatgtgtgctagtgggcatggtct

SEQ ID NO: 266372 - DNA, 25 bp, Homo sapien
gctcggtacggcagaagggttccta

SEQ ID NO: 266373 - DNA, 25 bp, Homo sapien
acggcagaagggttcctatctgacc

SEQ ID NO: 266374 - DNA, 25 bp, Homo sapien
aagagaagccttcctcaatggcagc

SEQ ID NO: 266375 - DNA, 25 bp, Homo sapien
agccttcctcaatggcagcgacgga

SEQ ID NO: 266376 - DNA, 25 bp, Homo sapien
gaacaggttttcaatgctaatgaaa

SEQ ID NO: 266377 - DNA, 25 bp, Homo sapien
atgcaaggaagttggcaaatgaacc

SEQ ID NO: 266378 - DNA, 25 bp, Homo sapien
atgaacctgtacaagtggcatttca

SEQ ID NO: 266379 - DNA, 25 bp, Homo sapien
acctgtacaagtggcatttcagttt

SEQ ID NO: 266380 - DNA, 25 bp, Homo sapien
tcataggaacttaaccctgtatttc

SEQ ID NO: 266381 - DNA, 25 bp, Homo sapien
gaacttaaccctgtatttccactag

SEQ ID NO: 266382 - DNA, 25 bp, Homo sapien
taaccctgtatttccactaggaaca

SEQ ID NO: 266383 - DNA, 25 bp, Homo sapien
gtattaacagattcagtgtttgcaa

SEQ ID NO: 266384 - DNA, 25 bp, Homo sapien
agattcagtgtttgcaatgacttta

SEQ ID NO: 266385 - DNA, 25 bp, Homo sapien
ttatagaacataactgtggtgaata

SEQ ID NO: 266386 - DNA, 25 bp, Homo sapien
gtggtgaataatgagaatcagctat

SEQ ID NO: 266387 - DNA, 25 bp, Homo sapien
gagcttcaacttcacttataatgac

SEQ ID NO: 266388 - DNA, 25 bp, Homo sapien
aataatgtgccatattacttagaaa

SEQ ID NO: 266389 - DNA, 25 bp, Homo sapien
aacacctagctgttaagtgtcacag

SEQ ID NO: 266390 - DNA, 25 bp, Homo sapien
gttaagtgtcacagcagcttctgca

SEQ ID NO: 266391 - DNA, 25 bp, Homo sapien
gcagcttctgcagtgatgtgacgtt

SEQ ID NO: 266392 - DNA, 25 bp, Homo sapien
gagcattttctataagaggacattg

SEQ ID NO: 266393 - DNA, 25 bp, Homo sapien
ggaaactgatgttgcatactcattc

SEQ ID NO: 266394 - DNA, 25 bp, Homo sapien
tgttgcatactcattcagaatattg

SEQ ID NO: 266395 - DNA, 25 bp, Homo sapien
agtgaaaacacttgtacctgtaatt

SEQ ID NO: 266396 - DNA, 25 bp, Homo sapien
cacttgtacctgtaattttagtcaa

SEQ ID NO: 266397 - DNA, 25 bp, Homo sapien
atgttggtctgttaaaattttctga

SEQ ID NO: 266398 - DNA, 25 bp, Homo sapien
tgtatactccacacattttatgcca

SEQ ID NO: 266399 - DNA, 25 bp, Homo sapien
actccacacattttatgccatataa

SEQ ID NO: 266400 - DNA, 25 bp, Homo sapien
gccatataatggtgtgttttcttaa

SEQ ID NO: 266401 - DNA, 25 bp, Homo sapien
gtggctttcaaattaaaatgacctt

SEQ ID NO: 266402 - DNA, 25 bp, Homo sapien
aagattcataattctgagagaggtt

SEQ ID NO: 266403 - DNA, 25 bp, Homo sapien
gaggtttgcaaccaggagatacaaa

SEQ ID NO: 266404 - DNA, 25 bp, Homo sapien
gaagtctcagtagtaatcttgttca

SEQ ID NO: 266405 - DNA, 25 bp, Homo sapien
gtagtaatcttgttcatgtgctttt

SEQ ID NO: 266406 - DNA, 25 bp, Homo sapien
gttcatgtgcttttacagccagcta

SEQ ID NO: 266407 - DNA, 25 bp, Homo sapien
tgtgcttttacagccagctacattt

SEQ ID NO: 266408 - DNA, 25 bp, Homo sapien
ttacagccagctacatttaagaatg

SEQ ID NO: 266409 - DNA, 25 bp, Homo sapien
gaaaatatgagttcttagctttaat

SEQ ID NO: 266410 - DNA, 25 bp, Homo sapien
actgtttatagtcatctgaaatatc

SEQ ID NO: 266411 - DNA, 25 bp, Homo sapien
tcttagctttaatcatgaagtctga

SEQ ID NO: 266412 - DNA, 25 bp, Homo sapien
atcatgaagtctgaagtttgctttc

SEQ ID NO: 266413 - DNA, 25 bp, Homo sapien
agttgttttggttcattgctttata

SEQ ID NO: 266414 - DNA, 25 bp, Homo sapien
ttgaatgccaaacctgttctttttt

SEQ ID NO: 266415 - DNA, 25 bp, Homo sapien
tactgtgtccaatattctttcaagc

SEQ ID NO: 266416 - DNA, 25 bp, Homo sapien
ttctttcaagcaaatgcaatggctg

SEQ ID NO: 266417 - DNA, 25 bp, Homo sapien
aatgcaatggctggaatataattca

SEQ ID NO: 266418 - DNA, 25 bp, Homo sapien
atttactctgattctactcacttgt

SEQ ID NO: 266419 - DNA, 25 bp, Homo sapien
tgattctactcacttgttttttaaa

SEQ ID NO: 266420 - DNA, 25 bp, Homo sapien
gaaacagtgttgatagagactcagc

SEQ ID NO: 266421 - DNA, 25 bp, Homo sapien
aacagtgttgatagagactcagctg

SEQ ID NO: 266422 - DNA, 25 bp, Homo sapien
cagtgttgatagagactcagctgaa

SEQ ID NO: 266423 - DNA, 25 bp, Homo sapien
tgttgatagagactcagctgaaagc

SEQ ID NO: 266424 - DNA, 25 bp, Homo sapien
aagacactttgctgttgatagctga

SEQ ID NO: 266425 - DNA, 25 bp, Homo sapien
agacactttgctgttgatagctgag

SEQ ID NO: 266426 - DNA, 25 bp, Homo sapien
gacactttgctgttgatagctgagg

SEQ ID NO: 266427 - DNA, 25 bp, Homo sapien
acactttgctgttgatagctgaggt

SEQ ID NO: 266428 - DNA, 25 bp, Homo sapien
cactttgctgttgatagctgaggtt

SEQ ID NO: 266429 - DNA, 25 bp, Homo sapien
ctttgctgttgatagctgaggttat

SEQ ID NO: 266430 - DNA, 25 bp, Homo sapien
ttgctgttgatagctgaggttatgg

SEQ ID NO: 266431 - DNA, 25 bp, Homo sapien
tccggctctctgcttacgtatgcca

SEQ ID NO: 266432 - DNA, 25 bp, Homo sapien
gctctctgcttacgtatgccatgca

SEQ ID NO: 266433 - DNA, 25 bp, Homo sapien
tctctgcttacgtatgccatgcata

SEQ ID NO: 266434 - DNA, 25 bp, Homo sapien
ctctgcttacgtatgccatgcatac

SEQ ID NO: 266435 - DNA, 25 bp, Homo sapien
ttacgtatgccatgcatacctcctg

SEQ ID NO: 266436 - DNA, 25 bp, Homo sapien
ggtctgctgggcgagcagggcaggt

SEQ ID NO: 266437 - DNA, 25 bp, Homo sapien
tgggccaactctgcaccgttctagg

SEQ ID NO: 266438 - DNA, 25 bp, Homo sapien
ggccaactctgcaccgttctaggtg

SEQ ID NO: 266439 - DNA, 25 bp, Homo sapien
aactctgcaccgttctaggtgccga

SEQ ID NO: 266440 - DNA, 25 bp, Homo sapien
accgttctaggtgccgatggctgcc

SEQ ID NO: 266441 - DNA, 25 bp, Homo sapien
ttctaggtgccgatggctgcctccg

SEQ ID NO: 266442 - DNA, 25 bp, Homo sapien
aaaggatgccagtcattggatcaga

SEQ ID NO: 266443 - DNA, 25 bp, Homo sapien
gatcagagaccaccttaatccagga

SEQ ID NO: 266444 - DNA, 25 bp, Homo sapien
ggatgacttcatcttaactaaatta

SEQ ID NO: 266445 - DNA, 25 bp, Homo sapien
tttctaaataaacccacattctgag

SEQ ID NO: 266446 - DNA, 25 bp, Homo sapien
ttctgggtgggcatgctatttggca

SEQ ID NO: 266447 - DNA, 25 bp, Homo sapien
gctatttggcaggacaaagtcaaca

SEQ ID NO: 266448 - DNA, 25 bp, Homo sapien
aacacaggacactcattttcaggat

SEQ ID NO: 266449 - DNA, 25 bp, Homo sapien
actcattttcaggattgatcgcatg

SEQ ID NO: 266450 - DNA, 25 bp, Homo sapien
ttgatcgcatggtttgaggaagctg

SEQ ID NO: 266451 - DNA, 25 bp, Homo sapien
ttcctttacgtcatcttccttctga

SEQ ID NO: 266452 - DNA, 25 bp, Homo sapien
cttctgagatgctctgtgtccaaat

SEQ ID NO: 266453 - DNA, 25 bp, Homo sapien
gtatttttaccatctcagtcacctc

SEQ ID NO: 266454 - DNA, 25 bp, Homo sapien
tttttaccatctcagtcacctccag

SEQ ID NO: 266455 - DNA, 25 bp, Homo sapien
gtgccggatgatgaggtgatattag

SEQ ID NO: 266456 - DNA, 25 bp, Homo sapien
agccagggaagccacgctccgctgg

SEQ ID NO: 266457 - DNA, 25 bp, Homo sapien
gagagttgtggaacaggctcaggca

SEQ ID NO: 266458 - DNA, 25 bp, Homo sapien
tttagggaattgagttttggagtgt

SEQ ID NO: 266459 - DNA, 25 bp, Homo sapien
gtgtgttccctacctagctatatat

SEQ ID NO: 266460 - DNA, 25 bp, Homo sapien
tccctacctagctatatatatccca

SEQ ID NO: 266461 - DNA, 25 bp, Homo sapien
tatatatcccaaaaatatcctggtg

SEQ ID NO: 266462 - DNA, 25 bp, Homo sapien
aactcgtgtgggaggatttccatat

SEQ ID NO: 266463 - DNA, 25 bp, Homo sapien
gtgtgggaggatttccatatttcag

SEQ ID NO: 266464 - DNA, 25 bp, Homo sapien
caaagacctgcagccaccagtgctt

SEQ ID NO: 266465 - DNA, 25 bp, Homo sapien
ctccctgtcagtcaggcgaattcaa

SEQ ID NO: 266466 - DNA, 25 bp, Homo sapien
cagtcaggcgaattcaaccggaaaa

SEQ ID NO: 266467 - DNA, 25 bp, Homo sapien
agagggctgtgcacacagtagcaca

SEQ ID NO: 266468 - DNA, 25 bp, Homo sapien
gcacacagtagcacacaggatctca

SEQ ID NO: 266469 - DNA, 25 bp, Homo sapien
gtagcacacaggatctcacagtaac

SEQ ID NO: 266470 - DNA, 25 bp, Homo sapien
acaggatctcacagtaacgcggcat

SEQ ID NO: 266471 - DNA, 25 bp, Homo sapien
gatctcacagtaacgcggcatggga

SEQ ID NO: 266472 - DNA, 25 bp, Homo sapien
cgcagttacaaaggcagggcccggc

SEQ ID NO: 266473 - DNA, 25 bp, Homo sapien
aggcttgccacgttctgcagccgtg

SEQ ID NO: 266474 - DNA, 25 bp, Homo sapien
tcagcccgactcagagtgcctgaac

SEQ ID NO: 266475 - DNA, 25 bp, Homo sapien
atttggtttctaaatttctatgtct

SEQ ID NO: 266476 - DNA, 25 bp, Homo sapien
ttctatgtcttattctaatcactga

SEQ ID NO: 266477 - DNA, 25 bp, Homo sapien
tcctacttaggtgaaatctattctt

SEQ ID NO: 266478 - DNA, 25 bp, Homo sapien
aagtaaagaggagctgtcccgaaca

SEQ ID NO: 266479 - DNA, 25 bp, Homo sapien
ctgtcccgaacagtgaagtgtcgta

SEQ ID NO: 266480 - DNA, 25 bp, Homo sapien
gaagtgtcgtaatgcggccctgaaa

SEQ ID NO: 266481 - DNA, 25 bp, Homo sapien
gtaatgcggccctgaaagagagtca

SEQ ID NO: 266482 - DNA, 25 bp, Homo sapien
gaagttgaaagaagacctcgaggct

SEQ ID NO: 266483 - DNA, 25 bp, Homo sapien
tgaaagaagacctcgaggctgtgga

SEQ ID NO: 266484 - DNA, 25 bp, Homo sapien
tcctttaaaggaataagcagctaat

SEQ ID NO: 266485 - DNA, 25 bp, Homo sapien
cagctaataaagatgggttctattt

SEQ ID NO: 266486 - DNA, 25 bp, Homo sapien
atagcagtctatatgacatcaccca

SEQ ID NO: 266487 - DNA, 25 bp, Homo sapien
agcagtctatatgacatcacccata

SEQ ID NO: 266488 - DNA, 25 bp, Homo sapien
gtctatatgacatcacccatatcat

SEQ ID NO: 266489 - DNA, 25 bp, Homo sapien
atgacatcacccatatcattcacga

SEQ ID NO: 266490 - DNA, 25 bp, Homo sapien
gacatcacccatatcattcacgaaa

SEQ ID NO: 266491 - DNA, 25 bp, Homo sapien
atcacccatatcattcacgaaatta

SEQ ID NO: 266492 - DNA, 25 bp, Homo sapien
cacccatatcattcacgaaattaaa

SEQ ID NO: 266493 - DNA, 25 bp, Homo sapien
agcatgtgagatttgctttctgtag

SEQ ID NO: 266494 - DNA, 25 bp, Homo sapien
tttaactacaagaactttttgatat

SEQ ID NO: 266495 - DNA, 25 bp, Homo sapien
ttcatttggatcatcactttacctt

SEQ ID NO: 266496 - DNA, 25 bp, Homo sapien
tcatttggatcatcactttaccttg

SEQ ID NO: 266497 - DNA, 25 bp, Homo sapien
gcaagggagtaattctagcctgttt

SEQ ID NO: 266498 - DNA, 25 bp, Homo sapien
ggagtaattctagcctgtttttaca

SEQ ID NO: 266499 - DNA, 25 bp, Homo sapien
tagcctgtttttacaagaacacagt

SEQ ID NO: 266500 - DNA, 25 bp, Homo sapien
gaacacagtggctatagacagtgcc

SEQ ID NO: 266501 - DNA, 25 bp, Homo sapien
gctatagacagtgccagtgtgaaga

SEQ ID NO: 266502 - DNA, 25 bp, Homo sapien
agtgccagtgtgaagatgactcagc

SEQ ID NO: 266503 - DNA, 25 bp, Homo sapien
atgactcagcaaacgtggagaacca

SEQ ID NO: 266504 - DNA, 25 bp, Homo sapien
gaaccaaagattctagggcagcacc

SEQ ID NO: 266505 - DNA, 25 bp, Homo sapien
tctagggcagcaccaaaactgggaa

SEQ ID NO: 266506 - DNA, 25 bp, Homo sapien
tgggaaagcaattacagcagaagtt

SEQ ID NO: 266507 - DNA, 25 bp, Homo sapien
agttgccttccccatggtagcttag

SEQ ID NO: 266508 - DNA, 25 bp, Homo sapien
tgagtcccgagaccaaacgtcgttt

SEQ ID NO: 266509 - DNA, 25 bp, Homo sapien
gagaccaaacgtcgtttccctctcg

SEQ ID NO: 266510 - DNA, 25 bp, Homo sapien
gggagcgcaaggtcaagttcgcctt

SEQ ID NO: 266511 - DNA, 25 bp, Homo sapien
gagactcgccgagcgccgttgctga

SEQ ID NO: 266512 - DNA, 25 bp, Homo sapien
gagcgccgttgctgagccctgcaaa

SEQ ID NO: 266513 - DNA, 25 bp, Homo sapien
gagccctgcaaatagcagctacctg

SEQ ID NO: 266514 - DNA, 25 bp, Homo sapien
gcttcagcctagatcctgccatgaa

SEQ ID NO: 266515 - DNA, 25 bp, Homo sapien
ggtcaagttcgccttggccgtgctc

SEQ ID NO: 266516 - DNA, 25 bp, Homo sapien
ccgtgctccagctcaggtactaggg

SEQ ID NO: 266517 - DNA, 25 bp, Homo sapien
gccggacgagccttgagtcccgaga

SEQ ID NO: 266518 - DNA, 25 bp, Homo sapien
acgagccttgagtcccgagaccaaa

SEQ ID NO: 266519 - DNA, 25 bp, Homo sapien
agctaccatagacttcaggaaagac

SEQ ID NO: 266520 - DNA, 25 bp, Homo sapien
acttcaggaaagacacatcgagcca

SEQ ID NO: 266521 - DNA, 25 bp, Homo sapien
gacacatcgagccaatgacaaaaat

SEQ ID NO: 266522 - DNA, 25 bp, Homo sapien
gtttcctaccttcagggagtctaag

SEQ ID NO: 266523 - DNA, 25 bp, Homo sapien
cttcagggagtctaagaatgcagta

SEQ ID NO: 266524 - DNA, 25 bp, Homo sapien
gtggagcaaacatctttcaaatgga

SEQ ID NO: 266525 - DNA, 25 bp, Homo sapien
gaaaggaagactgttagaggctctt

SEQ ID NO: 266526 - DNA, 25 bp, Homo sapien
gaggctcttttgaatgttagaggca

SEQ ID NO: 266527 - DNA, 25 bp, Homo sapien
gcaaatgtcaagaaggatgtcagct

SEQ ID NO: 266528 - DNA, 25 bp, Homo sapien
atgtcagctgtgagtgggactcaga

SEQ ID NO: 266529 - DNA, 25 bp, Homo sapien
gaaagagaaacgttttggactacag

SEQ ID NO: 266530 - DNA, 25 bp, Homo sapien
aatgctctgcatggattggagacac

SEQ ID NO: 266531 - DNA, 25 bp, Homo sapien
tctgcatggattggagacacagcaa

SEQ ID NO: 266532 - DNA, 25 bp, Homo sapien
acagcaataactactgttgccatgg

SEQ ID NO: 266533 - DNA, 25 bp, Homo sapien
ataactactgttgccatggaagggt

SEQ ID NO: 266534 - DNA, 25 bp, Homo sapien
ctactgttgccatggaagggttaac

SEQ ID NO: 266535 - DNA, 25 bp, Homo sapien
ttaacagtgtaggagctggtttatc

SEQ ID NO: 266536 - DNA, 25 bp, Homo sapien
taggagctggtttatcagtccgctt

SEQ ID NO: 266537 - DNA, 25 bp, Homo sapien
agctggtttatcagtccgctttgac

SEQ ID NO: 266538 - DNA, 25 bp, Homo sapien
tggtttatcagtccgctttgacata

SEQ ID NO: 266539 - DNA, 25 bp, Homo sapien
atcagtccgctttgacatacagcta

SEQ ID NO: 266540 - DNA, 25 bp, Homo sapien
aattcagtgtggacttatgccaaag

SEQ ID NO: 266541 - DNA, 25 bp, Homo sapien
ttctctccagcccatttattggagc

SEQ ID NO: 266542 - DNA, 25 bp, Homo sapien
catttattggagcagggctttgcaa

SEQ ID NO: 266543 - DNA, 25 bp, Homo sapien
tttgcaaagccggtctcctagcagc

SEQ ID NO: 266544 - DNA, 25 bp, Homo sapien
gcagaaggcccattcatattacaat

SEQ ID NO: 266545 - DNA, 25 bp, Homo sapien
gtttgtttaaactgcctctgtcttc

SEQ ID NO: 266546 - DNA, 25 bp, Homo sapien
tctgtcttcattcacagcctgatgt

SEQ ID NO: 266547 - DNA, 25 bp, Homo sapien
agcctgatgtccatgtgcattgtga

SEQ ID NO: 266548 - DNA, 25 bp, Homo sapien
ttgtgagtccacaatggcactaaag

SEQ ID NO: 266549 - DNA, 25 bp, Homo sapien
actaaaggactcattgtggccgaaa

SEQ ID NO: 266550 - DNA, 25 bp, Homo sapien
ttttttcccctctgatacttggata

SEQ ID NO: 266551 - DNA, 25 bp, Homo sapien
gatacttggatacttgggctgttta

SEQ ID NO: 266552 - DNA, 25 bp, Homo sapien
ttagccaagcatgatggtgccaacc

SEQ ID NO: 266553 - DNA, 25 bp, Homo sapien
tagccaagcatgatggtgccaacct

SEQ ID NO: 266554 - DNA, 25 bp, Homo sapien
agccaagcatgatggtgccaacctg

SEQ ID NO: 266555 - DNA, 25 bp, Homo sapien
gccaagcatgatggtgccaacctgt

SEQ ID NO: 266556 - DNA, 25 bp, Homo sapien
ccaagcatgatggtgccaacctgta

SEQ ID NO: 266557 - DNA, 25 bp, Homo sapien
tgatggtgccaacctgtaattccag

SEQ ID NO: 266558 - DNA, 25 bp, Homo sapien
ttccagcctgggtaatgaagtcgga

SEQ ID NO: 266559 - DNA, 25 bp, Homo sapien
ccagcctgggtaatgaagtcggagt

SEQ ID NO: 266560 - DNA, 25 bp, Homo sapien
cctgggtaatgaagtcggagtgaaa

SEQ ID NO: 266561 - DNA, 25 bp, Homo sapien
gtaatgaagtcggagtgaaactctg

SEQ ID NO: 266562 - DNA, 25 bp, Homo sapien
aaaaggccagttgggcttggtggct

SEQ ID NO: 266563 - DNA, 25 bp, Homo sapien
aggacccgggcttgccaagagcaga

SEQ ID NO: 266564 - DNA, 25 bp, Homo sapien
gggcttgccaagagcagaggccctc

SEQ ID NO: 266565 - DNA, 25 bp, Homo sapien
agcaaccaggataccaccactttgg

SEQ ID NO: 266566 - DNA, 25 bp, Homo sapien
tttgtgtacagaggtccgggtctga

SEQ ID NO: 266567 - DNA, 25 bp, Homo sapien
cgggtctgagacctcataggctgca

SEQ ID NO: 266568 - DNA, 25 bp, Homo sapien
tgagacctcataggctgcagaaatc

SEQ ID NO: 266569 - DNA, 25 bp, Homo sapien
gaactcctttgccagcgtggatttc

SEQ ID NO: 266570 - DNA, 25 bp, Homo sapien
cgtggatttctcaagtcgggactgc

SEQ ID NO: 266571 - DNA, 25 bp, Homo sapien
caagtcgggactgcataattaaagc

SEQ ID NO: 266572 - DNA, 25 bp, Homo sapien
gtagttgtgtgtgcagcacttcgcc

SEQ ID NO: 266573 - DNA, 25 bp, Homo sapien
agcacttcgccctgatatgtgtgct

SEQ ID NO: 266574 - DNA, 25 bp, Homo sapien
gaatatatctatcatgcatctgaaa

SEQ ID NO: 266575 - DNA, 25 bp, Homo sapien
tcatgcatctgaaattgcctaggat

SEQ ID NO: 266576 - DNA, 25 bp, Homo sapien
attgcctaggatggttctgattgct

SEQ ID NO: 266577 - DNA, 25 bp, Homo sapien
ggatggttctgattgctggtattca

SEQ ID NO: 266578 - DNA, 25 bp, Homo sapien
gctggtattcagatccaatgtaact

SEQ ID NO: 266579 - DNA, 25 bp, Homo sapien
gatccaatgtaactccaaatattta

SEQ ID NO: 266580 - DNA, 25 bp, Homo sapien
aaatatttacccatacacttcaaga

SEQ ID NO: 266581 - DNA, 25 bp, Homo sapien
tacccatacacttcaagaatgtttg

SEQ ID NO: 266582 - DNA, 25 bp, Homo sapien
gataaggtctctgtgtgctttacaa

SEQ ID NO: 266583 - DNA, 25 bp, Homo sapien
gtctctgtgtgctttacaataggat

SEQ ID NO: 266584 - DNA, 25 bp, Homo sapien
ggatagatttgataccactgaataa

SEQ ID NO: 266585 - DNA, 25 bp, Homo sapien
ggcttggatcctgaaaccctgggtt

SEQ ID NO: 266586 - DNA, 25 bp, Homo sapien
gaaaccctgggttctgattctagcc

SEQ ID NO: 266587 - DNA, 25 bp, Homo sapien
ctgggttctgattctagccttgtgc

SEQ ID NO: 266588 - DNA, 25 bp, Homo sapien
attctagccttgtgctgcttttcaa

SEQ ID NO: 266589 - DNA, 25 bp, Homo sapien
agccttgtgctgcttttcaattagc

SEQ ID NO: 266590 - DNA, 25 bp, Homo sapien
aagtgacgacacagaatgcattaaa

SEQ ID NO: 266591 - DNA, 25 bp, Homo sapien
aaactgtttcctaagctccgacact

SEQ ID NO: 266592 - DNA, 25 bp, Homo sapien
taagctccgacacttgctccagaaa

SEQ ID NO: 266593 - DNA, 25 bp, Homo sapien
gacacttgctccagaaatagcttca

SEQ ID NO: 266594 - DNA, 25 bp, Homo sapien
atagcttcaaaaccatccattacaa

SEQ ID NO: 266595 - DNA, 25 bp, Homo sapien
ttacaaaatcgaatcaactgcaggg

SEQ ID NO: 266596 - DNA, 25 bp, Homo sapien
ggatggtgtattgatggccccaaca

SEQ ID NO: 266597 - DNA, 25 bp, Homo sapien
tggtgtattgatggccccaacagaa

SEQ ID NO: 266598 - DNA, 25 bp, Homo sapien
tattgatggccccaacagaactttc

SEQ ID NO: 266599 - DNA, 25 bp, Homo sapien
actttctaaaatcatgcgataaaca

SEQ ID NO: 266600 - DNA, 25 bp, Homo sapien
atgatagtagttgtaaaatgcttct

SEQ ID NO: 266601 - DNA, 25 bp, Homo sapien
gaaaatgttgagtaattatcgatag

SEQ ID NO: 266602 - DNA, 25 bp, Homo sapien
tagaaattttgctgtccattcatac

SEQ ID NO: 266603 - DNA, 25 bp, Homo sapien
attttgctgtccattcatacattcc

SEQ ID NO: 266604 - DNA, 25 bp, Homo sapien
attccttcaattaactttcattgtt

SEQ ID NO: 266605 - DNA, 25 bp, Homo sapien
ttacaaagtttggagcatggaaaca

SEQ ID NO: 266606 - DNA, 25 bp, Homo sapien
ctgcttattttttaggatggtgtat

SEQ ID NO: 266607 - DNA, 25 bp, Homo sapien
agctgtatcgctaaacggatgtctc

SEQ ID NO: 266608 - DNA, 25 bp, Homo sapien
taaacggatgtctcaggagtctggc

SEQ ID NO: 266609 - DNA, 25 bp, Homo sapien
ttgagcccagatggcatagcctgca

SEQ ID NO: 266610 - DNA, 25 bp, Homo sapien
gatggcatagcctgcacaaatacag

SEQ ID NO: 266611 - DNA, 25 bp, Homo sapien
gggctggccgcattctccgtcttaa

SEQ ID NO: 266612 - DNA, 25 bp, Homo sapien
taaccagctcgctcctaggtgcttt

SEQ ID NO: 266613 - DNA, 25 bp, Homo sapien
gcttctgcactctaccagcttggag

SEQ ID NO: 266614 - DNA, 25 bp, Homo sapien
tctctcttgcagtaaaatgaggctg

SEQ ID NO: 266615 - DNA, 25 bp, Homo sapien
agttgctgggcatctggtctgctga

SEQ ID NO: 266616 - DNA, 25 bp, Homo sapien
gggcatctggtctgctgattaccac

SEQ ID NO: 266617 - DNA, 25 bp, Homo sapien
tgattaccaccttggtgcccaatgt

SEQ ID NO: 266618 - DNA, 25 bp, Homo sapien
ttttttgacagtttttcatcaactg

SEQ ID NO: 266619 - DNA, 25 bp, Homo sapien
atcaactgtcaaaaacttcaaccct

SEQ ID NO: 266620 - DNA, 25 bp, Homo sapien
tcaactgtcaaaaacttcaaccctt

SEQ ID NO: 266621 - DNA, 25 bp, Homo sapien
aagctaagcagtgggtacctgggat

SEQ ID NO: 266622 - DNA, 25 bp, Homo sapien
gctaagcagtgggtacctgggatct

SEQ ID NO: 266623 - DNA, 25 bp, Homo sapien
ctaagcagtgggtacctgggatctc

SEQ ID NO: 266624 - DNA, 25 bp, Homo sapien
taagcagtgggtacctgggatctct

SEQ ID NO: 266625 - DNA, 25 bp, Homo sapien
aagcagtgggtacctgggatctctc

SEQ ID NO: 266626 - DNA, 25 bp, Homo sapien
agcagtgggtacctgggatctctct

SEQ ID NO: 266627 - DNA, 25 bp, Homo sapien
gtacctgggatctctctgaactatt

SEQ ID NO: 266628 - DNA, 25 bp, Homo sapien
ataacttcttgtgagtcttaagtat

SEQ ID NO: 266629 - DNA, 25 bp, Homo sapien
tcttcattggaaagtcattcgtatt

SEQ ID NO: 266630 - DNA, 25 bp, Homo sapien
tggaaagtcattcgtatttacttaa

SEQ ID NO: 266631 - DNA, 25 bp, Homo sapien
tacttaagttttcaaatatcacagt

SEQ ID NO: 266632 - DNA, 25 bp, Homo sapien
cagtgcagattagaacaaagtagtt

SEQ ID NO: 266633 - DNA, 25 bp, Homo sapien
aagtgtatggagaagctcgcattct

SEQ ID NO: 266634 - DNA, 25 bp, Homo sapien
gtatggagaagctcgcattcttctt

SEQ ID NO: 266635 - DNA, 25 bp, Homo sapien
ggagaagctcgcattcttcttgttt

SEQ ID NO: 266636 - DNA, 25 bp, Homo sapien
agaagctcgcattcttcttgttttg

SEQ ID NO: 266637 - DNA, 25 bp, Homo sapien
tcttgttttgtgctgtcattatttt

SEQ ID NO: 266638 - DNA, 25 bp, Homo sapien
gtcattattttagtttgttatcttc

SEQ ID NO: 266639 - DNA, 25 bp, Homo sapien
gtttgttatcttcgtctactttagt

SEQ ID NO: 266640 - DNA, 25 bp, Homo sapien
ctatgagcagcccaactactcgggc

SEQ ID NO: 266641 - DNA, 25 bp, Homo sapien
tcaccctctacgaggaccggggctt

SEQ ID NO: 266642 - DNA, 25 bp, Homo sapien
atgagcagcccaactactcgggcct

SEQ ID NO: 266643 - DNA, 25 bp, Homo sapien
gactatgccgaccaccagcagtgga

SEQ ID NO: 266644 - DNA, 25 bp, Homo sapien
tatgccgaccaccagcagtggatgg

SEQ ID NO: 266645 - DNA, 25 bp, Homo sapien
tgccgaccaccagcagtggatgggc

SEQ ID NO: 266646 - DNA, 25 bp, Homo sapien
tccagggccgccactacgaatgcag

SEQ ID NO: 266647 - DNA, 25 bp, Homo sapien
agggccgccactacgaatgcagcag

SEQ ID NO: 266648 - DNA, 25 bp, Homo sapien
gccgccactacgaatgcagcagcga

SEQ ID NO: 266649 - DNA, 25 bp, Homo sapien
actacgaatgcagcagcgaccaccc

SEQ ID NO: 266650 - DNA, 25 bp, Homo sapien
tgcagccctacttgagccgctgcaa

SEQ ID NO: 266651 - DNA, 25 bp, Homo sapien
acgccagctcccacaggctcaggat

SEQ ID NO: 266652 - DNA, 25 bp, Homo sapien
acaggctcaggatctatgagcgaga

SEQ ID NO: 266653 - DNA, 25 bp, Homo sapien
caggctcaggatctatgagcgagag

SEQ ID NO: 266654 - DNA, 25 bp, Homo sapien
gctcaggatctatgagcgagaggac

SEQ ID NO: 266655 - DNA, 25 bp, Homo sapien
ctcaggatctatgagcgagaggact

SEQ ID NO: 266656 - DNA, 25 bp, Homo sapien
tcaggatctatgagcgagaggacta

SEQ ID NO: 266657 - DNA, 25 bp, Homo sapien
caggatctatgagcgagaggactac

SEQ ID NO: 266658 - DNA, 25 bp, Homo sapien
ggatctatgagcgagaggactacag

SEQ ID NO: 266659 - DNA, 25 bp, Homo sapien
gatctatgagcgagaggactacagg

SEQ ID NO: 266660 - DNA, 25 bp, Homo sapien
atctatgagcgagaggactacaggg

SEQ ID NO: 266661 - DNA, 25 bp, Homo sapien
agcgagaggactacaggggccagat

SEQ ID NO: 266662 - DNA, 25 bp, Homo sapien
catccccagtaaagtgtctctaggc

SEQ ID NO: 266663 - DNA, 25 bp, Homo sapien
gtctctaggccctgagtatgctttt

SEQ ID NO: 266664 - DNA, 25 bp, Homo sapien
ggccctgagtatgcttttcatgtca

SEQ ID NO: 266665 - DNA, 25 bp, Homo sapien
gagtatgcttttcatgtcacttggg

SEQ ID NO: 266666 - DNA, 25 bp, Homo sapien
aagaaaccagtgaaagctccaggaa

SEQ ID NO: 266667 - DNA, 25 bp, Homo sapien
aaccagtgaaagctccaggaaacaa

SEQ ID NO: 266668 - DNA, 25 bp, Homo sapien
agcacaaccaaaactacggccaaga

SEQ ID NO: 266669 - DNA, 25 bp, Homo sapien
aatgattctctgtcaacctttctct

SEQ ID NO: 266670 - DNA, 25 bp, Homo sapien
tgtcaacctttctctactagtggag

SEQ ID NO: 266671 - DNA, 25 bp, Homo sapien
tcttctcagacctctgacctgtgac

SEQ ID NO: 266672 - DNA, 25 bp, Homo sapien
gtgacagaagcccatccccagtaaa

SEQ ID NO: 266673 - DNA, 25 bp, Homo sapien
atcgtcatgtccatgctggagaaga

SEQ ID NO: 266674 - DNA, 25 bp, Homo sapien
tgctggagaagacggctctcctgca

SEQ ID NO: 266675 - DNA, 25 bp, Homo sapien
gagaagacggctctcctgcaggcac

SEQ ID NO: 266676 - DNA, 25 bp, Homo sapien
gaagacggctctcctgcaggcacgc

SEQ ID NO: 266677 - DNA, 25 bp, Homo sapien
ctgtgcaaagcctcgtgtgcctggc

SEQ ID NO: 266678 - DNA, 25 bp, Homo sapien
gtgcaaagcctcgtgtgcctggcag

SEQ ID NO: 266679 - DNA, 25 bp, Homo sapien
aaagcctcgtgtgcctggcagcctt

SEQ ID NO: 266680 - DNA, 25 bp, Homo sapien
cgtgtgcctggcagccttcggcctg

SEQ ID NO: 266681 - DNA, 25 bp, Homo sapien
agcctcttcccgcaaatgtcagaga

SEQ ID NO: 266682 - DNA, 25 bp, Homo sapien
gcctcttcccgcaaatgtcagagat

SEQ ID NO: 266683 - DNA, 25 bp, Homo sapien
aagggattgatgtcctggacagcga

SEQ ID NO: 266684 - DNA, 25 bp, Homo sapien
agcacaaccaaaactacggccaaga

SEQ ID NO: 266685 - DNA, 25 bp, Homo sapien
caaccaaaactacggccaagagaag

SEQ ID NO: 266686 - DNA, 25 bp, Homo sapien
gaaatgattctctgtcaacctttct

SEQ ID NO: 266687 - DNA, 25 bp, Homo sapien
atgattctctgtcaacctttctcta

SEQ ID NO: 266688 - DNA, 25 bp, Homo sapien
ttctctgtcaacctttctctactag

SEQ ID NO: 266689 - DNA, 25 bp, Homo sapien
ctgtcaacctttctctactagtgga

SEQ ID NO: 266690 - DNA, 25 bp, Homo sapien
gtcaacctttctctactagtggaga

SEQ ID NO: 266691 - DNA, 25 bp, Homo sapien
aacctttctctactagtggagagga

SEQ ID NO: 266692 - DNA, 25 bp, Homo sapien
ctttctctactagtggagaggagtg

SEQ ID NO: 266693 - DNA, 25 bp, Homo sapien
gtgacagaagcccatccccagtaaa

SEQ ID NO: 266694 - DNA, 25 bp, Homo sapien
acagaagcccatccccagtaaagtg

SEQ ID NO: 266695 - DNA, 25 bp, Homo sapien
atgtatttctacttcttcattggaa

SEQ ID NO: 266696 - DNA, 25 bp, Homo sapien
tcttcattggaaagtcattcgtatt

SEQ ID NO: 266697 - DNA, 25 bp, Homo sapien
tggaaagtcattcgtatttacttaa

SEQ ID NO: 266698 - DNA, 25 bp, Homo sapien
cagtgcagattagaacaaagtagtt

SEQ ID NO: 266699 - DNA, 25 bp, Homo sapien
aagtgtatggagaagctcgcattct

SEQ ID NO: 266700 - DNA, 25 bp, Homo sapien
ggagaagctcgcattcttcttgttt

SEQ ID NO: 266701 - DNA, 25 bp, Homo sapien
agaagctcgcattcttcttgttttg

SEQ ID NO: 266702 - DNA, 25 bp, Homo sapien
tcttgttttgtgctgtcattatttt

SEQ ID NO: 266703 - DNA, 25 bp, Homo sapien
gtcattattttagtttgttatcttc

SEQ ID NO: 266704 - DNA, 25 bp, Homo sapien
gtttgttatcttcgtctactttagt

SEQ ID NO: 266705 - DNA, 25 bp, Homo sapien
cactgtacccggctgggaaatgaat

SEQ ID NO: 266706 - DNA, 25 bp, Homo sapien
gcccatcaccatagctcttgttgag

SEQ ID NO: 266707 - DNA, 25 bp, Homo sapien
accatagctcttgttgagtctaaca

SEQ ID NO: 266708 - DNA, 25 bp, Homo sapien
gagtctaacagtattaatcacaatg

SEQ ID NO: 266709 - DNA, 25 bp, Homo sapien
atcacaatggaggtgagtatacccc

SEQ ID NO: 266710 - DNA, 25 bp, Homo sapien
gcgagttacctcgaggccacagggc

SEQ ID NO: 266711 - DNA, 25 bp, Homo sapien
tccatggctccccactgtctttttt

SEQ ID NO: 266712 - DNA, 25 bp, Homo sapien
agatgcaaacctgggtagggcagaa

SEQ ID NO: 266713 - DNA, 25 bp, Homo sapien
aggccacagggctcaagagaacttc

SEQ ID NO: 266714 - DNA, 25 bp, Homo sapien
ggctcaagagaacttcagcgaggat

SEQ ID NO: 266715 - DNA, 25 bp, Homo sapien
gggacgccatcctctgggagacaga

SEQ ID NO: 266716 - DNA, 25 bp, Homo sapien
agaaggaggacgacccactgcgccg

SEQ ID NO: 266717 - DNA, 25 bp, Homo sapien
gcaccccgtgtataatccagtgtta

SEQ ID NO: 266718 - DNA, 25 bp, Homo sapien
aatccagtgttaacctctgaggaac

SEQ ID NO: 266719 - DNA, 25 bp, Homo sapien
ttaacctctgaggaacacctcggct

SEQ ID NO: 266720 - DNA, 25 bp, Homo sapien
ctcggctctcccaactgaggagaga

SEQ ID NO: 266721 - DNA, 25 bp, Homo sapien
gagggattctttttacacccaggct

SEQ ID NO: 266722 - DNA, 25 bp, Homo sapien
caggctggcgcattttcaagtgaca

SEQ ID NO: 266723 - DNA, 25 bp, Homo sapien
tcaagtgacaatctcgggctctagt

SEQ ID NO: 266724 - DNA, 25 bp, Homo sapien
cgggctctagttgcctttgagatat

SEQ ID NO: 266725 - DNA, 25 bp, Homo sapien
tttgagatatccactctgctctttc

SEQ ID NO: 266726 - DNA, 25 bp, Homo sapien
aacatgctctcaagattagcccata

SEQ ID NO: 266727 - DNA, 25 bp, Homo sapien
tagcccataggcagttcttgtgacc

SEQ ID NO: 266728 - DNA, 25 bp, Homo sapien
aatgttgcttatgtttccttggtca

SEQ ID NO: 266729 - DNA, 25 bp, Homo sapien
atgtttccttggtcattctgtccat

SEQ ID NO: 266730 - DNA, 25 bp, Homo sapien
tcctcctgtctgtccaaagccaagg

SEQ ID NO: 266731 - DNA, 25 bp, Homo sapien
gacactgctctactctaaatttttt

SEQ ID NO: 266732 - DNA, 25 bp, Homo sapien
gcagaggacaccaggactttcattt

SEQ ID NO: 266733 - DNA, 25 bp, Homo sapien
aggactttcattttccctcagtatg

SEQ ID NO: 266734 - DNA, 25 bp, Homo sapien
ttcattttccctcagtatggcccat

SEQ ID NO: 266735 - DNA, 25 bp, Homo sapien
tcagtatggcccatcctttgggtat

SEQ ID NO: 266736 - DNA, 25 bp, Homo sapien
atggcccatcctttgggtatgccaa

SEQ ID NO: 266737 - DNA, 25 bp, Homo sapien
ttgggtatgccaactccatgtccac

SEQ ID NO: 266738 - DNA, 25 bp, Homo sapien
ctgcatgtaggacagggcacagttt

SEQ ID NO: 266739 - DNA, 25 bp, Homo sapien
gtctgcattagctcttcacaattaa

SEQ ID NO: 266740 - DNA, 25 bp, Homo sapien
gctcttcacaattaactcttcatag

SEQ ID NO: 266741 - DNA, 25 bp, Homo sapien
caagagttaatgtcttgtcttccat

SEQ ID NO: 266742 - DNA, 25 bp, Homo sapien
gtcttccatttttgtactaaaatat

SEQ ID NO: 266743 - DNA, 25 bp, Homo sapien
agttcagcatgatttggtatatagc

SEQ ID NO: 266744 - DNA, 25 bp, Homo sapien
tatagcttatggtaaatgagaacgc

SEQ ID NO: 266745 - DNA, 25 bp, Homo sapien
aaatgagaacgcattatgacttatt

SEQ ID NO: 266746 - DNA, 25 bp, Homo sapien
ttctaagagtagacatacagacaaa

SEQ ID NO: 266747 - DNA, 25 bp, Homo sapien
aagtaacatcacacatacgcacaga

SEQ ID NO: 266748 - DNA, 25 bp, Homo sapien
tcacacatacgcacagattttcaac

SEQ ID NO: 266749 - DNA, 25 bp, Homo sapien
gcacagattttcaactctactaata

SEQ ID NO: 266750 - DNA, 25 bp, Homo sapien
taacgaacaatgctagcttgactat

SEQ ID NO: 266751 - DNA, 25 bp, Homo sapien
atgctagcttgactattgcttgtac

SEQ ID NO: 266752 - DNA, 25 bp, Homo sapien
tattgcttgtacaaaccgttttttg

SEQ ID NO: 266753 - DNA, 25 bp, Homo sapien
gatacaggtgggattcctccggaaa

SEQ ID NO: 266754 - DNA, 25 bp, Homo sapien
tgcagaagtgcgagggctgtattta

SEQ ID NO: 266755 - DNA, 25 bp, Homo sapien
gagggctgtatttaggcccctaaag

SEQ ID NO: 266756 - DNA, 25 bp, Homo sapien
gctggattttgcagacctggtaggc

SEQ ID NO: 266757 - DNA, 25 bp, Homo sapien
ggaaacggagttttatagcaccaga

SEQ ID NO: 266758 - DNA, 25 bp, Homo sapien
tatagcaccagactttatccccttt

SEQ ID NO: 266759 - DNA, 25 bp, Homo sapien
tagaaatttagggtttttgctgtct

SEQ ID NO: 266760 - DNA, 25 bp, Homo sapien
ttttgctgtcttttataacgaacaa

SEQ ID NO: 266761 - DNA, 25 bp, Homo sapien
agagatctttctacagagtctagct

SEQ ID NO: 266762 - DNA, 25 bp, Homo sapien
gagtctagctgtgctgattatcaaa

SEQ ID NO: 266763 - DNA, 25 bp, Homo sapien
atggctaataacacaggtgccggtc

SEQ ID NO: 266764 - DNA, 25 bp, Homo sapien
cacaggtgccggtcaactttataaa

SEQ ID NO: 266765 - DNA, 25 bp, Homo sapien
gtgaaaattatcctaaccattgtgg

SEQ ID NO: 266766 - DNA, 25 bp, Homo sapien
gtctactttgacacattcagggcta

SEQ ID NO: 266767 - DNA, 25 bp, Homo sapien
tggaaaaatgcccatcccacttcaa

SEQ ID NO: 266768 - DNA, 25 bp, Homo sapien
ccatcccacttcaattcatagctga

SEQ ID NO: 266769 - DNA, 25 bp, Homo sapien
tttgacacattcagggctagccctc

SEQ ID NO: 266770 - DNA, 25 bp, Homo sapien
tctcctgctggtgcagttcaatgtg

SEQ ID NO: 266771 - DNA, 25 bp, Homo sapien
gtcatttgtggtcacttaacagcaa

SEQ ID NO: 266772 - DNA, 25 bp, Homo sapien
tccccacgaggctttgttctcctgg

SEQ ID NO: 266773 - DNA, 25 bp, Homo sapien
agtgcctggcaggttgactctacca

SEQ ID NO: 266774 - DNA, 25 bp, Homo sapien
gtgcctggcaggttgactctaccat

SEQ ID NO: 266775 - DNA, 25 bp, Homo sapien
tgcctggcaggttgactctaccatc

SEQ ID NO: 266776 - DNA, 25 bp, Homo sapien
tggcaggttgactctaccatccccg

SEQ ID NO: 266777 - DNA, 25 bp, Homo sapien
gcaggttgactctaccatccccggg

SEQ ID NO: 266778 - DNA, 25 bp, Homo sapien
ccatgacccaggataaccctatgtc

SEQ ID NO: 266779 - DNA, 25 bp, Homo sapien
catgacccaggataaccctatgtct

SEQ ID NO: 266780 - DNA, 25 bp, Homo sapien
atgacccaggataaccctatgtctc

SEQ ID NO: 266781 - DNA, 25 bp, Homo sapien
tgacccaggataaccctatgtctcc

SEQ ID NO: 266782 - DNA, 25 bp, Homo sapien
gacccaggataaccctatgtctcct

SEQ ID NO: 266783 - DNA, 25 bp, Homo sapien
ggaggaaagtagagccccaccctga

SEQ ID NO: 266784 - DNA, 25 bp, Homo sapien
accctgactgctaagccgtttgctt

SEQ ID NO: 266785 - DNA, 25 bp, Homo sapien
agccgtttgctttggtgtcatgaaa

SEQ ID NO: 266786 - DNA, 25 bp, Homo sapien
gggtcccctatttctattatgtaag

SEQ ID NO: 266787 - DNA, 25 bp, Homo sapien
ttaaatgacaaagtggacctctggg

SEQ ID NO: 266788 - DNA, 25 bp, Homo sapien
tgatggtggttttgtgggattctcc

SEQ ID NO: 266789 - DNA, 25 bp, Homo sapien
ttgtgggattctccccatagcccca

SEQ ID NO: 266790 - DNA, 25 bp, Homo sapien
agaaggcccattctgattcaccaat

SEQ ID NO: 266791 - DNA, 25 bp, Homo sapien
tgattcaccaatcgcatggacgcac

SEQ ID NO: 266792 - DNA, 25 bp, Homo sapien
atggacgcactttcctaccaggcta

SEQ ID NO: 266793 - DNA, 25 bp, Homo sapien
cactttcctaccaggctaggaggga

SEQ ID NO: 266794 - DNA, 25 bp, Homo sapien
gacgtccgatgatgatgtcccgtgt

SEQ ID NO: 266795 - DNA, 25 bp, Homo sapien
gtccgatgatgatgtcccgtgtccg

SEQ ID NO: 266796 - DNA, 25 bp, Homo sapien
tgatgatgtcccgtgtccgggctac

SEQ ID NO: 266797 - DNA, 25 bp, Homo sapien
gatgtcccgtgtccgggctacctgt

SEQ ID NO: 266798 - DNA, 25 bp, Homo sapien
aaatctcccacgagtctccgggcag

SEQ ID NO: 266799 - DNA, 25 bp, Homo sapien
aagctcaaggtgctgaagatcctgc

SEQ ID NO: 266800 - DNA, 25 bp, Homo sapien
aaggtgctgaagatcctgctctatc

SEQ ID NO: 266801 - DNA, 25 bp, Homo sapien
gtgctgaagatcctgctctatctgt

SEQ ID NO: 266802 - DNA, 25 bp, Homo sapien
ctgaagatcctgctctatctgtgca

SEQ ID NO: 266803 - DNA, 25 bp, Homo sapien
aagatcctgctctatctgtgcagcc

SEQ ID NO: 266804 - DNA, 25 bp, Homo sapien
ttcctgctcatcctcaaacgcaact

SEQ ID NO: 266805 - DNA, 25 bp, Homo sapien
aagtcaagggatctctacttccatc

SEQ ID NO: 266806 - DNA, 25 bp, Homo sapien
tacttccatccttattttcctcaaa

SEQ ID NO: 266807 - DNA, 25 bp, Homo sapien
ccttattttcctcaaaagctggtgc

SEQ ID NO: 266808 - DNA, 25 bp, Homo sapien
tcctgggcacaccatgatggagtgc

SEQ ID NO: 266809 - DNA, 25 bp, Homo sapien
gtgccagcagtaatcaaccagactt

SEQ ID NO: 266810 - DNA, 25 bp, Homo sapien
aagaggagataatctgctctcaagg

SEQ ID NO: 266811 - DNA, 25 bp, Homo sapien
tgtgggctccagtgttgtaatctac

SEQ ID NO: 266812 - DNA, 25 bp, Homo sapien
gttgtaatctactacttgaatctag

SEQ ID NO: 266813 - DNA, 25 bp, Homo sapien
atgatggagtgcagccccactgatt

SEQ ID NO: 266814 - DNA, 25 bp, Homo sapien
tgattgggacccatgcagccagcct

SEQ ID NO: 266815 - DNA, 25 bp, Homo sapien
aatgtgcacaagtcaagggatctct

SEQ ID NO: 266816 - DNA, 25 bp, Homo sapien
tttctgtctctctgaagataacgtt

SEQ ID NO: 266817 - DNA, 25 bp, Homo sapien
gaagataacgttaagctgcagctcc

SEQ ID NO: 266818 - DNA, 25 bp, Homo sapien
taagctgcagctccgtatctgtgaa

SEQ ID NO: 266819 - DNA, 25 bp, Homo sapien
gctgcagctccgtatctgtgaaaac

SEQ ID NO: 266820 - DNA, 25 bp, Homo sapien
gctccgtatctgtgaaaacccattt

SEQ ID NO: 266821 - DNA, 25 bp, Homo sapien
aaaacccatttcacagcatctgcat

SEQ ID NO: 266822 - DNA, 25 bp, Homo sapien
atttcacagcatctgcatccctgga

SEQ ID NO: 266823 - DNA, 25 bp, Homo sapien
gcatctgcatccctggattgctaaa

SEQ ID NO: 266824 - DNA, 25 bp, Homo sapien
ctgcatccctggattgctaaatacc

SEQ ID NO: 266825 - DNA, 25 bp, Homo sapien
gagatatggaactgaacttcccttt

SEQ ID NO: 266826 - DNA, 25 bp, Homo sapien
tggaactgaacttccctttggcaaa

SEQ ID NO: 266827 - DNA, 25 bp, Homo sapien
aatgattaccgaactccagacctat

SEQ ID NO: 266828 - DNA, 25 bp, Homo sapien
gaactccagacctatttgctataac

SEQ ID NO: 266829 - DNA, 25 bp, Homo sapien
agtctgggtaaacacatacttcggt

SEQ ID NO: 266830 - DNA, 25 bp, Homo sapien
gaaagacttgtttggtagcccaagg

SEQ ID NO: 266831 - DNA, 25 bp, Homo sapien
gaatgttcactctgcagaggaactt

SEQ ID NO: 266832 - DNA, 25 bp, Homo sapien
agaggaacttccctccagttacatc

SEQ ID NO: 266833 - DNA, 25 bp, Homo sapien
gttacatcttcctcatacattagcc

SEQ ID NO: 266834 - DNA, 25 bp, Homo sapien
gccacctccacacttgacatagatg

SEQ ID NO: 266835 - DNA, 25 bp, Homo sapien
agatgccaacatgtttcaaaaccaa

SEQ ID NO: 266836 - DNA, 25 bp, Homo sapien
aaaccaatcttgaaggagcctaaag

SEQ ID NO: 266837 - DNA, 25 bp, Homo sapien
gagcctaaagagttgatggtcctct

SEQ ID NO: 266838 - DNA, 25 bp, Homo sapien
gaatgaactacatccctattccagc

SEQ ID NO: 266839 - DNA, 25 bp, Homo sapien
atccctattccagccgctgatgaat

SEQ ID NO: 266840 - DNA, 25 bp, Homo sapien
cagccgctgatgaatatgttctcca

SEQ ID NO: 266841 - DNA, 25 bp, Homo sapien
tatgttctccagcacaaggcagcat

SEQ ID NO: 266842 - DNA, 25 bp, Homo sapien
aactcatccaagtgacgagacggaa

SEQ ID NO: 266843 - DNA, 25 bp, Homo sapien
cagaataattttccaaacagtcctt

SEQ ID NO: 266844 - DNA, 25 bp, Homo sapien
caaacagtcctttattcgtaattat

SEQ ID NO: 266845 - DNA, 25 bp, Homo sapien
aaagatttaccctccagcacattca

SEQ ID NO: 266846 - DNA, 25 bp, Homo sapien
cctccagcacattcactgggtaaag

SEQ ID NO: 266847 - DNA, 25 bp, Homo sapien
gagacggaatagactgagatcacct

SEQ ID NO: 266848 - DNA, 25 bp, Homo sapien
atttatgtaatctctgaatgaacta

SEQ ID NO: 266849 - DNA, 25 bp, Homo sapien
gcactgagccgaggtatttccattt

SEQ ID NO: 266850 - DNA, 25 bp, Homo sapien
gttaactaaacgctagctaccagga

SEQ ID NO: 266851 - DNA, 25 bp, Homo sapien
tagctaccaggaaatgacgcagaag

SEQ ID NO: 266852 - DNA, 25 bp, Homo sapien
gacgcagaagtcacgttcttcttcc

SEQ ID NO: 266853 - DNA, 25 bp, Homo sapien
ttctcagttctacgtgccctttgaa

SEQ ID NO: 266854 - DNA, 25 bp, Homo sapien
acatttcacactttggatggtttgc

SEQ ID NO: 266855 - DNA, 25 bp, Homo sapien
gatggtttgcttgtctctagttttt

SEQ ID NO: 266856 - DNA, 25 bp, Homo sapien
ttagaaagctcttatcactccttcc

SEQ ID NO: 266857 - DNA, 25 bp, Homo sapien
gctcttatcactccttcctaagaaa

SEQ ID NO: 266858 - DNA, 25 bp, Homo sapien
aaatcacacatttcataaaaccctg

SEQ ID NO: 266859 - DNA, 25 bp, Homo sapien
aaccctgatgaattttggatatgtg

SEQ ID NO: 266860 - DNA, 25 bp, Homo sapien
tatccttccttgatgtccccgtgta

SEQ ID NO: 266861 - DNA, 25 bp, Homo sapien
gatgtccccgtgtagtggaaagagc

SEQ ID NO: 266862 - DNA, 25 bp, Homo sapien
agagcggatggcagggtcccagagt

SEQ ID NO: 266863 - DNA, 25 bp, Homo sapien
tcccagagtggtgcaaagggttcct

SEQ ID NO: 266864 - DNA, 25 bp, Homo sapien
gatgcacggctcctttattattgta

SEQ ID NO: 266865 - DNA, 25 bp, Homo sapien
acggctcctttattattgtaaccag

SEQ ID NO: 266866 - DNA, 25 bp, Homo sapien
attattgtaaccaggcatgggtggg

SEQ ID NO: 266867 - DNA, 25 bp, Homo sapien
gggtctgaaggctgcaatactgatg

SEQ ID NO: 266868 - DNA, 25 bp, Homo sapien
tgaaggctgcaatactgatgacaca

SEQ ID NO: 266869 - DNA, 25 bp, Homo sapien
aggctgcaatactgatgacacaggg

SEQ ID NO: 266870 - DNA, 25 bp, Homo sapien
accctagaagcccaggtgctcctga

SEQ ID NO: 266871 - DNA, 25 bp, Homo sapien
atcaactgtcaaaaacttcaaccct

SEQ ID NO: 266872 - DNA, 25 bp, Homo sapien
tcaactgtcaaaaacttcaaccctt

SEQ ID NO: 266873 - DNA, 25 bp, Homo sapien
aagctaagcagtgggtacctgggat

SEQ ID NO: 266874 - DNA, 25 bp, Homo sapien
agctaagcagtgggtacctgggatc

SEQ ID NO: 266875 - DNA, 25 bp, Homo sapien
gctaagcagtgggtacctgggatct

SEQ ID NO: 266876 - DNA, 25 bp, Homo sapien
ctaagcagtgggtacctgggatctc

SEQ ID NO: 266877 - DNA, 25 bp, Homo sapien
taagcagtgggtacctgggatctct

SEQ ID NO: 266878 - DNA, 25 bp, Homo sapien
aagcagtgggtacctgggatctctc

SEQ ID NO: 266879 - DNA, 25 bp, Homo sapien
agcagtgggtacctgggatctctct

SEQ ID NO: 266880 - DNA, 25 bp, Homo sapien
attatctatatataaaccatgattt

SEQ ID NO: 266881 - DNA, 25 bp, Homo sapien
ttatctatatataaaccatgattta

SEQ ID NO: 266882 - DNA, 25 bp, Homo sapien
agcagcagcgactagaactgatctg

SEQ ID NO: 266883 - DNA, 25 bp, Homo sapien
atctgggtgagatctaggcctcagc

SEQ ID NO: 266884 - DNA, 25 bp, Homo sapien
taggcctcagcaacaactgacgcaa

SEQ ID NO: 266885 - DNA, 25 bp, Homo sapien
ttttgttctaggattggctacagct

SEQ ID NO: 266886 - DNA, 25 bp, Homo sapien
ttggctacagctgaaactaccgcgc

SEQ ID NO: 266887 - DNA, 25 bp, Homo sapien
acagctgaaactaccgcgcttgatt

SEQ ID NO: 266888 - DNA, 25 bp, Homo sapien
tccttccggcctggatactgaggaa

SEQ ID NO: 266889 - DNA, 25 bp, Homo sapien
taccgcgcttgattcaaagctcggg

SEQ ID NO: 266890 - DNA, 25 bp, Homo sapien
tttggctggcccaatccgctgatcc

SEQ ID NO: 266891 - DNA, 25 bp, Homo sapien
tactgaggaaggtgacttagacttt

SEQ ID NO: 266892 - DNA, 25 bp, Homo sapien
tcctctgagtcgtaacggacggaca

SEQ ID NO: 266893 - DNA, 25 bp, Homo sapien
tgtgtgaccctgagccctcgctgtg

SEQ ID NO: 266894 - DNA, 25 bp, Homo sapien
tcgctgtgcatcatcgcttcccaga

SEQ ID NO: 266895 - DNA, 25 bp, Homo sapien
agaagatcagcagtcttgtttgcct

SEQ ID NO: 266896 - DNA, 25 bp, Homo sapien
ttcccagactctgttactagtccag

SEQ ID NO: 266897 - DNA, 25 bp, Homo sapien
tgttactagtccagatggcgagggc

SEQ ID NO: 266898 - DNA, 25 bp, Homo sapien
cctaagcagagagtgaactggttgc

SEQ ID NO: 266899 - DNA, 25 bp, Homo sapien
aactggttgcagaagctcatgggca

SEQ ID NO: 266900 - DNA, 25 bp, Homo sapien
aggtcctctgcctagaaacacaagg

SEQ ID NO: 266901 - DNA, 25 bp, Homo sapien
gtttgccttttatcgaagtacatgg

SEQ ID NO: 266902 - DNA, 25 bp, Homo sapien
gtacatggatcacaatgagctcagg

SEQ ID NO: 266903 - DNA, 25 bp, Homo sapien
caatgagctcaggaggatgggtact

SEQ ID NO: 266904 - DNA, 25 bp, Homo sapien
aatccagagggcctgttggtcaatg

SEQ ID NO: 266905 - DNA, 25 bp, Homo sapien
ggcctgttggtcaatgtgttggaaa

SEQ ID NO: 266906 - DNA, 25 bp, Homo sapien
aaaggacatttcaggccggcagagt

SEQ ID NO: 266907 - DNA, 25 bp, Homo sapien
atttcaggccggcagagtaattgga

SEQ ID NO: 266908 - DNA, 25 bp, Homo sapien
acaggcatagaggtgacttttggaa

SEQ ID NO: 266909 - DNA, 25 bp, Homo sapien
tgaaccaggcttccacgactgggtt

SEQ ID NO: 266910 - DNA, 25 bp, Homo sapien
tgggttctacccaggccagtgggaa

SEQ ID NO: 266911 - DNA, 25 bp, Homo sapien
tgggaaacttcaggccagccttgat

SEQ ID NO: 266912 - DNA, 25 bp, Homo sapien
gccagccttgattggaagaacttcc

SEQ ID NO: 266913 - DNA, 25 bp, Homo sapien
gagggaggtctttaagatcgctttt

SEQ ID NO: 266914 - DNA, 25 bp, Homo sapien
tagtttccaggacttgtctaaaaat

SEQ ID NO: 266915 - DNA, 25 bp, Homo sapien
ctaattcatgaatctccaccaaaat

SEQ ID NO: 266916 - DNA, 25 bp, Homo sapien
acttatagagagtattgcatgattt

SEQ ID NO: 266917 - DNA, 25 bp, Homo sapien
aaatgtgttttccaaagatgaatag

SEQ ID NO: 266918 - DNA, 25 bp, Homo sapien
aaagatgaatagagtcctgccacca

SEQ ID NO: 266919 - DNA, 25 bp, Homo sapien
gatgaatagagtcctgccaccatca

SEQ ID NO: 266920 - DNA, 25 bp, Homo sapien
ccctacaaattgaggatatcctaaa

SEQ ID NO: 266921 - DNA, 25 bp, Homo sapien
aatatagcatatggacattgtacat

SEQ ID NO: 266922 - DNA, 25 bp, Homo sapien
ttgtacatttaaggtcagggaaggc

SEQ ID NO: 266923 - DNA, 25 bp, Homo sapien
cagggaaggcacttttcttcctaat

SEQ ID NO: 266924 - DNA, 25 bp, Homo sapien
tctgaattttttgaacttctgatat

SEQ ID NO: 266925 - DNA, 25 bp, Homo sapien
acttctgatatttgtaacactaatt

SEQ ID NO: 266926 - DNA, 25 bp, Homo sapien
gaaagcaaccatgctaagcttcaaa

SEQ ID NO: 266927 - DNA, 25 bp, Homo sapien
gcatgtgagcacacctgatgacgct

SEQ ID NO: 266928 - DNA, 25 bp, Homo sapien
tgatgacgctagacccactggaatc

SEQ ID NO: 266929 - DNA, 25 bp, Homo sapien
tggaatctcgcataactcatcctga

SEQ ID NO: 266930 - DNA, 25 bp, Homo sapien
aacgtgttgggaatcaagtctctca

SEQ ID NO: 266931 - DNA, 25 bp, Homo sapien
aagtctctcaggattagccctggta

SEQ ID NO: 266932 - DNA, 25 bp, Homo sapien
ttagccctggtaatctgaaagtcac

SEQ ID NO: 266933 - DNA, 25 bp, Homo sapien
tgaaagtcaccagtcatcaagaagt

SEQ ID NO: 266934 - DNA, 25 bp, Homo sapien
aagtggcatctctaccatgtggtgc

SEQ ID NO: 266935 - DNA, 25 bp, Homo sapien
gcaatcatagccctgaactcaaatt

SEQ ID NO: 266936 - DNA, 25 bp, Homo sapien
aaaatgcattatctcttcccaaaat

SEQ ID NO: 266937 - DNA, 25 bp, Homo sapien
tgcccatgcccatcctggtgctacc

SEQ ID NO: 266938 - DNA, 25 bp, Homo sapien
tgctggagaagacggctctcctgca

SEQ ID NO: 266939 - DNA, 25 bp, Homo sapien
ggagaagacggctctcctgcaggca

SEQ ID NO: 266940 - DNA, 25 bp, Homo sapien
agaagacggctctcctgcaggcacg

SEQ ID NO: 266941 - DNA, 25 bp, Homo sapien
gaagacggctctcctgcaggcacgc

SEQ ID NO: 266942 - DNA, 25 bp, Homo sapien
ctgtgcaaagcctcgtgtgcctggc

SEQ ID NO: 266943 - DNA, 25 bp, Homo sapien
gtgcaaagcctcgtgtgcctggcag

SEQ ID NO: 266944 - DNA, 25 bp, Homo sapien
aaagcctcgtgtgcctggcagcctt

SEQ ID NO: 266945 - DNA, 25 bp, Homo sapien
agcctcttcccgcaaatgtcagaga

SEQ ID NO: 266946 - DNA, 25 bp, Homo sapien
gcctcttcccgcaaatgtcagagat

SEQ ID NO: 266947 - DNA, 25 bp, Homo sapien
gaagggattgatgtcctggacagcg

SEQ ID NO: 266948 - DNA, 25 bp, Homo sapien
taggctcagcacatagccaatccta

SEQ ID NO: 266949 - DNA, 25 bp, Homo sapien
aatcctaccatttctcgagggcagc

SEQ ID NO: 266950 - DNA, 25 bp, Homo sapien
gagggcagctgaaagtgtttactca

SEQ ID NO: 266951 - DNA, 25 bp, Homo sapien
tatgttgttatctaccttgaggagt

SEQ ID NO: 266952 - DNA, 25 bp, Homo sapien
ttgaggagttagttggtagcaccag

SEQ ID NO: 266953 - DNA, 25 bp, Homo sapien
gtagcaccagcatctttgggtagaa

SEQ ID NO: 266954 - DNA, 25 bp, Homo sapien
tgggtagaattgcttctgacccttg

SEQ ID NO: 266955 - DNA, 25 bp, Homo sapien
gccccaagaggttcagctgcaagtg

SEQ ID NO: 266956 - DNA, 25 bp, Homo sapien
caagtgtgccactgaactgaggaca

SEQ ID NO: 266957 - DNA, 25 bp, Homo sapien
gaactgaggacacagcaccagacct

SEQ ID NO: 266958 - DNA, 25 bp, Homo sapien
accagacctgaatccagttcacatg

SEQ ID NO: 266959 - DNA, 25 bp, Homo sapien
actgctggctcaggccccaacctct

SEQ ID NO: 266960 - DNA, 25 bp, Homo sapien
ctgctggctcaggccccaacctctg

SEQ ID NO: 266961 - DNA, 25 bp, Homo sapien
tgctggctcaggccccaacctctgg

SEQ ID NO: 266962 - DNA, 25 bp, Homo sapien
gctggctcaggccccaacctctggc

SEQ ID NO: 266963 - DNA, 25 bp, Homo sapien
ctggctcaggccccaacctctggcc

SEQ ID NO: 266964 - DNA, 25 bp, Homo sapien
tggctcaggccccaacctctggcct

SEQ ID NO: 266965 - DNA, 25 bp, Homo sapien
ggctcaggccccaacctctggcctt

SEQ ID NO: 266966 - DNA, 25 bp, Homo sapien
gctcaggccccaacctctggccttt

SEQ ID NO: 266967 - DNA, 25 bp, Homo sapien
agagaccactcacaagcgcctgctc

SEQ ID NO: 266968 - DNA, 25 bp, Homo sapien
tcactcttgcctgaaattgggcaga

SEQ ID NO: 266969 - DNA, 25 bp, Homo sapien
caacatggaggactgagcacgtgca

SEQ ID NO: 266970 - DNA, 25 bp, Homo sapien
gactgagcacgtgcagaatcttctc

SEQ ID NO: 266971 - DNA, 25 bp, Homo sapien
gagcacgtgcagaatcttctcccat

SEQ ID NO: 266972 - DNA, 25 bp, Homo sapien
tgcagaatcttctcccattacacat

SEQ ID NO: 266973 - DNA, 25 bp, Homo sapien
aagatttgtaggtacctgaaacata

SEQ ID NO: 266974 - DNA, 25 bp, Homo sapien
gcttacgacacatagccaaaggaac

SEQ ID NO: 266975 - DNA, 25 bp, Homo sapien
atagccaaaggaacttacacttgag

SEQ ID NO: 266976 - DNA, 25 bp, Homo sapien
gaacttacacttgagcaaagtcctc

SEQ ID NO: 266977 - DNA, 25 bp, Homo sapien
acttgagcaaagtcctcaagggaag

SEQ ID NO: 266978 - DNA, 25 bp, Homo sapien
taaggcagcccaggaaataggaact

SEQ ID NO: 266979 - DNA, 25 bp, Homo sapien
aataggaactgagactctggtaccc

SEQ ID NO: 266980 - DNA, 25 bp, Homo sapien
gactctggtacccacaggagcctgg

SEQ ID NO: 266981 - DNA, 25 bp, Homo sapien
actctggtacccacaggagcctggg

SEQ ID NO: 266982 - DNA, 25 bp, Homo sapien
ggtgggcaaagagcgctcaatccag

SEQ ID NO: 266983 - DNA, 25 bp, Homo sapien
gggcaaagagcgctcaatccagctc

SEQ ID NO: 266984 - DNA, 25 bp, Homo sapien
aaagagcgctcaatccagctccttg

SEQ ID NO: 266985 - DNA, 25 bp, Homo sapien
agagcgctcaatccagctccttgaa

SEQ ID NO: 266986 - DNA, 25 bp, Homo sapien
gagcgctcaatccagctccttgaac

SEQ ID NO: 266987 - DNA, 25 bp, Homo sapien
tgggcatcactgcaggccccgtgct

SEQ ID NO: 266988 - DNA, 25 bp, Homo sapien
agtggggccttggtcctgagaatca

SEQ ID NO: 266989 - DNA, 25 bp, Homo sapien
tgcacacctgggaagatggagagag

SEQ ID NO: 266990 - DNA, 25 bp, Homo sapien
acacctgggaagatggagagagaac

SEQ ID NO: 266991 - DNA, 25 bp, Homo sapien
cacctgggaagatggagagagaact

SEQ ID NO: 266992 - DNA, 25 bp, Homo sapien
aagatggagagagaactatgaaata

SEQ ID NO: 266993 - DNA, 25 bp, Homo sapien
agatggagagagaactatgaaataa

SEQ ID NO: 266994 - DNA, 25 bp, Homo sapien
gatggagagagaactatgaaataag

SEQ ID NO: 266995 - DNA, 25 bp, Homo sapien
atggagagagaactatgaaataaga

SEQ ID NO: 266996 - DNA, 25 bp, Homo sapien
tgaaataagaatgcacagggccggg

SEQ ID NO: 266997 - DNA, 25 bp, Homo sapien
aataagaatgcacagggccgggcgc

SEQ ID NO: 266998 - DNA, 25 bp, Homo sapien
ataagaatgcacagggccgggcgcg

SEQ ID NO: 266999 - DNA, 25 bp, Homo sapien
taagaatgcacagggccgggcgcgg

SEQ ID NO: 267000 - DNA, 25 bp, Homo sapien
aagggtattcagacacatggacaca

SEQ ID NO: 267001 - DNA, 25 bp, Homo sapien
gacacatggacacacattcctagaa

SEQ ID NO: 267002 - DNA, 25 bp, Homo sapien
ctagaatgtcatcatatggtcctaa

SEQ ID NO: 267003 - DNA, 25 bp, Homo sapien
atggtcctaattccatgtcaccaac

SEQ ID NO: 267004 - DNA, 25 bp, Homo sapien
aattccatgtcaccaacaacacaga

SEQ ID NO: 267005 - DNA, 25 bp, Homo sapien
cagacaagaccctgtttacaacttt

SEQ ID NO: 267006 - DNA, 25 bp, Homo sapien
gggaacttgtatactgggcctgttt

SEQ ID NO: 267007 - DNA, 25 bp, Homo sapien
gtgtatggccatagatgtatttctg

SEQ ID NO: 267008 - DNA, 25 bp, Homo sapien
ggcctgtttttcagcctgtttgcta

SEQ ID NO: 267009 - DNA, 25 bp, Homo sapien
agcctgtttgctaccttttttgcat

SEQ ID NO: 267010 - DNA, 25 bp, Homo sapien
tgaattttacagacactgggctaaa

SEQ ID NO: 267011 - DNA, 25 bp, Homo sapien
agctcataaatttacagatacaaca

SEQ ID NO: 267012 - DNA, 25 bp, Homo sapien
ttacagatacaacaaacagatgtct

SEQ ID NO: 267013 - DNA, 25 bp, Homo sapien
aacagatgtctaaatccagaccaca

SEQ ID NO: 267014 - DNA, 25 bp, Homo sapien
aaatccagaccacatcttgtgccac

SEQ ID NO: 267015 - DNA, 25 bp, Homo sapien
agaccacatcttgtgccactgtaaa

SEQ ID NO: 267016 - DNA, 25 bp, Homo sapien
cacatcttgtgccactgtaaaagag

SEQ ID NO: 267017 - DNA, 25 bp, Homo sapien
gtgccactgtaaaagagaaggatcc

SEQ ID NO: 267018 - DNA, 25 bp, Homo sapien
gagaaggatccacacagcactgtca

SEQ ID NO: 267019 - DNA, 25 bp, Homo sapien
aaggatccacacagcactgtcagcc

SEQ ID NO: 267020 - DNA, 25 bp, Homo sapien
gtcagcccacagactctaacaattg

SEQ ID NO: 267021 - DNA, 25 bp, Homo sapien
gactctaacaattggaacagactat

SEQ ID NO: 267022 - DNA, 25 bp, Homo sapien
gatcctactaactgtgcagctcatg

SEQ ID NO: 267023 - DNA, 25 bp, Homo sapien
ctactaactgtgcagctcatgggcc

SEQ ID NO: 267024 - DNA, 25 bp, Homo sapien
agccaaggctccagaaggctctgcc

SEQ ID NO: 267025 - DNA, 25 bp, Homo sapien
cctatgggctgggatctttgtgcag

SEQ ID NO: 267026 - DNA, 25 bp, Homo sapien
gggatctttgtgcagacccacgttc

SEQ ID NO: 267027 - DNA, 25 bp, Homo sapien
agacccacgttccaggacagagaat

SEQ ID NO: 267028 - DNA, 25 bp, Homo sapien
ggcagtgttgcatggtgtgattaac

SEQ ID NO: 267029 - DNA, 25 bp, Homo sapien
ggtgtgattaacctactaacccagg

SEQ ID NO: 267030 - DNA, 25 bp, Homo sapien
attaacctactaacccagggctcag

SEQ ID NO: 267031 - DNA, 25 bp, Homo sapien
taacccagggctcagccgggacgct

SEQ ID NO: 267032 - DNA, 25 bp, Homo sapien
gacgctgtggcgtgtgacgaggtgc

SEQ ID NO: 267033 - DNA, 25 bp, Homo sapien
tttgcccagcccatttgtatatctc

SEQ ID NO: 267034 - DNA, 25 bp, Homo sapien
cctttggagaatatctaggttcttt

SEQ ID NO: 267035 - DNA, 25 bp, Homo sapien
cttttgaaggtagctgcatataaac

SEQ ID NO: 267036 - DNA, 25 bp, Homo sapien
ggtagctgcatataaactagccaaa

SEQ ID NO: 267037 - DNA, 25 bp, Homo sapien
aaactagccaaattaacagactgtg

SEQ ID NO: 267038 - DNA, 25 bp, Homo sapien
cagactgtggtttttagatggcttt

SEQ ID NO: 267039 - DNA, 25 bp, Homo sapien
gatggctttccatatctacaagaac

SEQ ID NO: 267040 - DNA, 25 bp, Homo sapien
ggctttccatatctacaagaactat

SEQ ID NO: 267041 - DNA, 25 bp, Homo sapien
gaactatttagttctcaaaactggg

SEQ ID NO: 267042 - DNA, 25 bp, Homo sapien
ttagttctcaaaactgggaagaaat

SEQ ID NO: 267043 - DNA, 25 bp, Homo sapien
ggaagaaatgtttcagaggcatcat

SEQ ID NO: 267044 - DNA, 25 bp, Homo sapien
actatgtccatattttacagcttag

SEQ ID NO: 267045 - DNA, 25 bp, Homo sapien
ggaaactattatacatctgctattg

SEQ ID NO: 267046 - DNA, 25 bp, Homo sapien
ttatacatctgctattgtgcaatga

SEQ ID NO: 267047 - DNA, 25 bp, Homo sapien
gaagtagctctagaaagacacatgt

SEQ ID NO: 267048 - DNA, 25 bp, Homo sapien
aagacacatgtatacaaggcactat

SEQ ID NO: 267049 - DNA, 25 bp, Homo sapien
ggcactattgtacacactttgctga

SEQ ID NO: 267050 - DNA, 25 bp, Homo sapien
tgtacacactttgctgaatattttg

SEQ ID NO: 267051 - DNA, 25 bp, Homo sapien
gaatattttgtcagttgtatttaca

SEQ ID NO: 267052 - DNA, 25 bp, Homo sapien
ggtactttcttaagagcatatatgt

SEQ ID NO: 267053 - DNA, 25 bp, Homo sapien
gaatagtacagattgctgagtatta

SEQ ID NO: 267054 - DNA, 25 bp, Homo sapien
ggtaaataaacatcctatgcctttt

SEQ ID NO: 267055 - DNA, 25 bp, Homo sapien
acccgtgttcctcagtggccaggaa

SEQ ID NO: 267056 - DNA, 25 bp, Homo sapien
gtggccaggaacgttatgaagcatc

SEQ ID NO: 267057 - DNA, 25 bp, Homo sapien
tatgaagcatcagacctaacctggg

SEQ ID NO: 267058 - DNA, 25 bp, Homo sapien
gcatcagacctaacctgggaggagg

SEQ ID NO: 267059 - DNA, 25 bp, Homo sapien
gatgcagatatatctctggaggagc

SEQ ID NO: 267060 - DNA, 25 bp, Homo sapien
ggagcaaagccctgtcaaacaagtc

SEQ ID NO: 267061 - DNA, 25 bp, Homo sapien
caagtcaaaaggctggtgccccaga

SEQ ID NO: 267062 - DNA, 25 bp, Homo sapien
gcaggcgagcgtggctaagaaaaaa

SEQ ID NO: 267063 - DNA, 25 bp, Homo sapien
atggtaggagtgcagctttctcccc

SEQ ID NO: 267064 - DNA, 25 bp, Homo sapien
cagttactttccagctccgggctgg

SEQ ID NO: 267065 - DNA, 25 bp, Homo sapien
gggctggctcaggacccgtgttcct

SEQ ID NO: 267066 - DNA, 25 bp, Homo sapien
gtttctttctatccagggtttctct

SEQ ID NO: 267067 - DNA, 25 bp, Homo sapien
cagggtttctcttgggatactcata

SEQ ID NO: 267068 - DNA, 25 bp, Homo sapien
gtttctcttgggatactcatatggt

SEQ ID NO: 267069 - DNA, 25 bp, Homo sapien
actcatatggtatattactggctta

SEQ ID NO: 267070 - DNA, 25 bp, Homo sapien
aattttcctcagttctgtaatccag

SEQ ID NO: 267071 - DNA, 25 bp, Homo sapien
tgtaatccagattttccccattgag

SEQ ID NO: 267072 - DNA, 25 bp, Homo sapien
aatccagattttccccattgagtaa

SEQ ID NO: 267073 - DNA, 25 bp, Homo sapien
gattttccccattgagtaaataata

SEQ ID NO: 267074 - DNA, 25 bp, Homo sapien
ggtaaaaccagcatgctcaaacact

SEQ ID NO: 267075 - DNA, 25 bp, Homo sapien
agcatgctcaaacactgagctcaaa

SEQ ID NO: 267076 - DNA, 25 bp, Homo sapien
actgagctcaaacattaacattact

SEQ ID NO: 267077 - DNA, 25 bp, Homo sapien
atacagggagactgatatggcatgt

SEQ ID NO: 267078 - DNA, 25 bp, Homo sapien
tatggcatgtagtttcaaggcaaaa

SEQ ID NO: 267079 - DNA, 25 bp, Homo sapien
gggagggattcttatctcataaagc

SEQ ID NO: 267080 - DNA, 25 bp, Homo sapien
attcatgcagctaaacagtttgggc

SEQ ID NO: 267081 - DNA, 25 bp, Homo sapien
atctgtcttttagagattcccaaga

SEQ ID NO: 267082 - DNA, 25 bp, Homo sapien
gattcccaagaataacggctcaata

SEQ ID NO: 267083 - DNA, 25 bp, Homo sapien
taataattgtatggcagtgcatctc

SEQ ID NO: 267084 - DNA, 25 bp, Homo sapien
ggcagtgcatctccaagttatatct

SEQ ID NO: 267085 - DNA, 25 bp, Homo sapien
gcatctccaagttatatctgattct

SEQ ID NO: 267086 - DNA, 25 bp, Homo sapien
ctgattcttaaatttcctgtttcct

SEQ ID NO: 267087 - DNA, 25 bp, Homo sapien
tgtttcctttgtgtcctgcctatct

SEQ ID NO: 267088 - DNA, 25 bp, Homo sapien
gatggtaaatggcagctgacacttg

SEQ ID NO: 267089 - DNA, 25 bp, Homo sapien
gcagctgacacttgcgacagtatca

SEQ ID NO: 267090 - DNA, 25 bp, Homo sapien
tgcgacagtatcaagaaggcactaa

SEQ ID NO: 267091 - DNA, 25 bp, Homo sapien
gtgagaaggatgacttgccctttct

SEQ ID NO: 267092 - DNA, 25 bp, Homo sapien
gaatgccttgcaaatccagctcagt

SEQ ID NO: 267093 - DNA, 25 bp, Homo sapien
gcaaatccagctcagtactgctaga

SEQ ID NO: 267094 - DNA, 25 bp, Homo sapien
gctcagtactgctagataatccata

SEQ ID NO: 267095 - DNA, 25 bp, Homo sapien
tctatgtgaagtttcctggttttaa

SEQ ID NO: 267096 - DNA, 25 bp, Homo sapien
tacagaacactgtacaggccagaaa

SEQ ID NO: 267097 - DNA, 25 bp, Homo sapien
caatctgtgtgctaccagtttacaa

SEQ ID NO: 267098 - DNA, 25 bp, Homo sapien
ccagtttacaattagctatgcttct

SEQ ID NO: 267099 - DNA, 25 bp, Homo sapien
cagataggtgtataacattcgtcta

SEQ ID NO: 267100 - DNA, 25 bp, Homo sapien
gtcaagatcgacaaacactgcctgt

SEQ ID NO: 267101 - DNA, 25 bp, Homo sapien
gatcgacaaacactgcctgttaaaa

SEQ ID NO: 267102 - DNA, 25 bp, Homo sapien
aaacactgcctgttaaaataagaca

SEQ ID NO: 267103 - DNA, 25 bp, Homo sapien
agacagaagctggaaacggaagata

SEQ ID NO: 267104 - DNA, 25 bp, Homo sapien
aaacggaagataaacctgagagaga

SEQ ID NO: 267105 - DNA, 25 bp, Homo sapien
gaaagcatgactctggaatccacct

SEQ ID NO: 267106 - DNA, 25 bp, Homo sapien
ctggaatccacctgccatcagagct

SEQ ID NO: 267107 - DNA, 25 bp, Homo sapien
catcagagctctctccagaccagtg

SEQ ID NO: 267108 - DNA, 25 bp, Homo sapien
gactctgcccagtgtagatatcttt

SEQ ID NO: 267109 - DNA, 25 bp, Homo sapien
gcccagtgtagatatctttcacaaa

SEQ ID NO: 267110 - DNA, 25 bp, Homo sapien
aaatacttcctagggaaacacacat

SEQ ID NO: 267111 - DNA, 25 bp, Homo sapien
ttcctagggaaacacacattttgcc

SEQ ID NO: 267112 - DNA, 25 bp, Homo sapien
attttgcccaatgccttctgtttgg

SEQ ID NO: 267113 - DNA, 25 bp, Homo sapien
acacattttgccctatttggaactt

SEQ ID NO: 267114 - DNA, 25 bp, Homo sapien
cattttgccctatttggaactttga

SEQ ID NO: 267115 - DNA, 25 bp, Homo sapien
aactttgaaaagtgagccctcctct

SEQ ID NO: 267116 - DNA, 25 bp, Homo sapien
aaaagtgagccctcctctgcccatg

SEQ ID NO: 267117 - DNA, 25 bp, Homo sapien
gctttgaaaagtgagccctgactgg

SEQ ID NO: 267118 - DNA, 25 bp, Homo sapien
aagtgagccctgactgggtgtggtg

SEQ ID NO: 267119 - DNA, 25 bp, Homo sapien
gtggtggttgacacctgttatcaca

SEQ ID NO: 267120 - DNA, 25 bp, Homo sapien
gtggttgacacctgttatcacagca

SEQ ID NO: 267121 - DNA, 25 bp, Homo sapien
gacagagttagtggaactactgaaa

SEQ ID NO: 267122 - DNA, 25 bp, Homo sapien
actactgaaacaacctgtccaatta

SEQ ID NO: 267123 - DNA, 25 bp, Homo sapien
aactagactgaatccctgaggtctt

SEQ ID NO: 267124 - DNA, 25 bp, Homo sapien
gactgaatccctgaggtcttgtctc

SEQ ID NO: 267125 - DNA, 25 bp, Homo sapien
tttctctgctcttcttccttggaga

SEQ ID NO: 267126 - DNA, 25 bp, Homo sapien
aggtcttgtctcctcatgttatctg

SEQ ID NO: 267127 - DNA, 25 bp, Homo sapien
cctcatgttatctgctcctgaaggg

SEQ ID NO: 267128 - DNA, 25 bp, Homo sapien
tttggaaatctccagggtttttcag

SEQ ID NO: 267129 - DNA, 25 bp, Homo sapien
gctcttcttccttggagatggcaga

SEQ ID NO: 267130 - DNA, 25 bp, Homo sapien
cttggagatggcagaatccagcccc

SEQ ID NO: 267131 - DNA, 25 bp, Homo sapien
gaatccagccccttagggaaatgaa

SEQ ID NO: 267132 - DNA, 25 bp, Homo sapien
atcagtgtttccgtctgctcacctg

SEQ ID NO: 267133 - DNA, 25 bp, Homo sapien
acccatgcccaccagtgttggtctt

SEQ ID NO: 267134 - DNA, 25 bp, Homo sapien
accagtgttggtctttgcctcaaag

SEQ ID NO: 267135 - DNA, 25 bp, Homo sapien
gttggtctttgcctcaaagcctgag

SEQ ID NO: 267136 - DNA, 25 bp, Homo sapien
aaagcctgagacctgcttcacggcc

SEQ ID NO: 267137 - DNA, 25 bp, Homo sapien
acggccttcaccagccctgatggag

SEQ ID NO: 267138 - DNA, 25 bp, Homo sapien
agcagctgccacgtggaggaagctc

SEQ ID NO: 267139 - DNA, 25 bp, Homo sapien
tgccacgtggaggaagctcaatatc

SEQ ID NO: 267140 - DNA, 25 bp, Homo sapien
gctcaatatcagctgggaaggaact

SEQ ID NO: 267141 - DNA, 25 bp, Homo sapien
ggaaggaactgtgcctctgtctgac

SEQ ID NO: 267142 - DNA, 25 bp, Homo sapien
aggaactgtgcctctgtctgactgg

SEQ ID NO: 267143 - DNA, 25 bp, Homo sapien
cgggaagtcggtgtactctgctctc

SEQ ID NO: 267144 - DNA, 25 bp, Homo sapien
gctctcctctgcctctatttgttct

SEQ ID NO: 267145 - DNA, 25 bp, Homo sapien
ccccggagactatcatcttatttaa

SEQ ID NO: 267146 - DNA, 25 bp, Homo sapien
atcttatttaaccaccatctatcgg

SEQ ID NO: 267147 - DNA, 25 bp, Homo sapien
ggtggacaacttaaaactctgcctt

SEQ ID NO: 267148 - DNA, 25 bp, Homo sapien
aaaactctgccttcagccaagagct

SEQ ID NO: 267149 - DNA, 25 bp, Homo sapien
ctcgcctggctccatcaggttcaag

SEQ ID NO: 267150 - DNA, 25 bp, Homo sapien
gttcaagttcaggtttgacccagcc

SEQ ID NO: 267151 - DNA, 25 bp, Homo sapien
aagcctctgcccttcgtggactgag

SEQ ID NO: 267152 - DNA, 25 bp, Homo sapien
ttcgtggactgaggatgcacccagt

SEQ ID NO: 267153 - DNA, 25 bp, Homo sapien
tgaggatgcacccagtctccaccat

SEQ ID NO: 267154 - DNA, 25 bp, Homo sapien
tgccttatcatcatccctgtcacat

SEQ ID NO: 267155 - DNA, 25 bp, Homo sapien
tgtcacatctctccataattccttc

SEQ ID NO: 267156 - DNA, 25 bp, Homo sapien
aggcccagcaccttagcacctgagg

SEQ ID NO: 267157 - DNA, 25 bp, Homo sapien
agcacctgaggctgctacctgagaa

SEQ ID NO: 267158 - DNA, 25 bp, Homo sapien
tgagaagtacgcactgttctggctt

SEQ ID NO: 267159 - DNA, 25 bp, Homo sapien
agaccatgctccatttctgctgttg

SEQ ID NO: 267160 - DNA, 25 bp, Homo sapien
tctgctgttgaagtctttgagagac

SEQ ID NO: 267161 - DNA, 25 bp, Homo sapien
gatcatgggctgagtgcaacctcct

SEQ ID NO: 267162 - DNA, 25 bp, Homo sapien
aatacaagttgaggccatctcttcc

SEQ ID NO: 267163 - DNA, 25 bp, Homo sapien
tagggcctaacctctaagcctagca

SEQ ID NO: 267164 - DNA, 25 bp, Homo sapien
aagcctagcagcacaaactcaggag

SEQ ID NO: 267165 - DNA, 25 bp, Homo sapien
tccccacgaggctttgttctcctgg

SEQ ID NO: 267166 - DNA, 25 bp, Homo sapien
acaagttgtgctctcattggccggg

SEQ ID NO: 267167 - DNA, 25 bp, Homo sapien
agttgtgctctcattggccgggcct

SEQ ID NO: 267168 - DNA, 25 bp, Homo sapien
agtgcctggcaggttgactctacca

SEQ ID NO: 267169 - DNA, 25 bp, Homo sapien
tgcctggcaggttgactctaccatc

SEQ ID NO: 267170 - DNA, 25 bp, Homo sapien
gcaggttgactctaccatccccggg

SEQ ID NO: 267171 - DNA, 25 bp, Homo sapien
atgacccaggataaccctatgtctc

SEQ ID NO: 267172 - DNA, 25 bp, Homo sapien
gacccaggataaccctatgtctcct

SEQ ID NO: 267173 - DNA, 25 bp, Homo sapien
cccagaatccttcagtggctctcat

SEQ ID NO: 267174 - DNA, 25 bp, Homo sapien
tggctctcatcaccttcaggaaaag

SEQ ID NO: 267175 - DNA, 25 bp, Homo sapien
tcatcaccttcaggaaaagcccaaa

SEQ ID NO: 267176 - DNA, 25 bp, Homo sapien
acatgtttggaatcatgatgcttct

SEQ ID NO: 267177 - DNA, 25 bp, Homo sapien
tgatgcttctactcattgcagtatt

SEQ ID NO: 267178 - DNA, 25 bp, Homo sapien
aggattcgtttggtactgctgcgcc

SEQ ID NO: 267179 - DNA, 25 bp, Homo sapien
gtttggtactgctgcgcctatcact

SEQ ID NO: 267180 - DNA, 25 bp, Homo sapien
gcctatcacttttacctgcaggatt

SEQ ID NO: 267181 - DNA, 25 bp, Homo sapien
agaaatcgtgtctatttttatggaa

SEQ ID NO: 267182 - DNA, 25 bp, Homo sapien
gagaaacagttcctattcacgaccg

SEQ ID NO: 267183 - DNA, 25 bp, Homo sapien
tattcacgaccgcagtgctactgta

SEQ ID NO: 267184 - DNA, 25 bp, Homo sapien
gaccgcagtgctactgtatatgatg

SEQ ID NO: 267185 - DNA, 25 bp, Homo sapien
tgttttccctatttcggttgtcgat

SEQ ID NO: 267186 - DNA, 25 bp, Homo sapien
ttcggttgtcgattcagttctatat

SEQ ID NO: 267187 - DNA, 25 bp, Homo sapien
agccagaacacatggctgggccttt

SEQ ID NO: 267188 - DNA, 25 bp, Homo sapien
taagttctcccaggtagtatatggg

SEQ ID NO: 267189 - DNA, 25 bp, Homo sapien
cagcagggtagagaggacaaagaat

SEQ ID NO: 267190 - DNA, 25 bp, Homo sapien
ctggtttctgccctttaagagcacc

SEQ ID NO: 267191 - DNA, 25 bp, Homo sapien
tttctgccctttaagagcacccggt

SEQ ID NO: 267192 - DNA, 25 bp, Homo sapien
agagcacccggtcagtcagagaaca

SEQ ID NO: 267193 - DNA, 25 bp, Homo sapien
gcacccggtcagtcagagaacagag

SEQ ID NO: 267194 - DNA, 25 bp, Homo sapien
gggagccaacacttgaattcaacct

SEQ ID NO: 267195 - DNA, 25 bp, Homo sapien
gccaacacttgaattcaaccttttt

SEQ ID NO: 267196 - DNA, 25 bp, Homo sapien
tttttccactgagacaaatcctagg

SEQ ID NO: 267197 - DNA, 25 bp, Homo sapien
ccactgagacaaatcctaggctcct

SEQ ID NO: 267198 - DNA, 25 bp, Homo sapien
ttctttttgacttcacccttggata

SEQ ID NO: 267199 - DNA, 25 bp, Homo sapien
tgacttcacccttggataccatcaa

SEQ ID NO: 267200 - DNA, 25 bp, Homo sapien
gtgctcctttgtgataatgggctat

SEQ ID NO: 267201 - DNA, 25 bp, Homo sapien
gggctatttgtatctctgagggctt

SEQ ID NO: 267202 - DNA, 25 bp, Homo sapien
tctgagggcttccacacaggatggc

SEQ ID NO: 267203 - DNA, 25 bp, Homo sapien
gatggccattcaagaagcttctgct

SEQ ID NO: 267204 - DNA, 25 bp, Homo sapien
tgctctgcctttcattacagtctat

SEQ ID NO: 267205 - DNA, 25 bp, Homo sapien
tacagtctatctttagtcctcctaa

SEQ ID NO: 267206 - DNA, 25 bp, Homo sapien
gtcctcctaaaccttcagctataat

SEQ ID NO: 267207 - DNA, 25 bp, Homo sapien
gctataatctctatgcaatcaactt

SEQ ID NO: 267208 - DNA, 25 bp, Homo sapien
atgtttgtagtattgtccctttctc

SEQ ID NO: 267209 - DNA, 25 bp, Homo sapien
gaaatacatgaagatgacagccaca

SEQ ID NO: 267210 - DNA, 25 bp, Homo sapien
gaagatgacagccacatgtttaccc

SEQ ID NO: 267211 - DNA, 25 bp, Homo sapien
gggatgatcccagcctttttgtcat

SEQ ID NO: 267212 - DNA, 25 bp, Homo sapien
gaatgaacaggtgcaagtgcccaca

SEQ ID NO: 267213 - DNA, 25 bp, Homo sapien
aagtgcccacacctgtgttggaagt

SEQ ID NO: 267214 - DNA, 25 bp, Homo sapien
gaggctcacaaaggtggacgactgt

SEQ ID NO: 267215 - DNA, 25 bp, Homo sapien
gcgctagtagctgcctttcatgtat

SEQ ID NO: 267216 - DNA, 25 bp, Homo sapien
ctgcctttcatgtatttaggattga

SEQ ID NO: 267217 - DNA, 25 bp, Homo sapien
catgtatttaggattgagtgtccaa

SEQ ID NO: 267218 - DNA, 25 bp, Homo sapien
gagtgtccaagaagactgtcccaaa

SEQ ID NO: 267219 - DNA, 25 bp, Homo sapien
ccaagaagactgtcccaaactttca

SEQ ID NO: 267220 - DNA, 25 bp, Homo sapien
tgtctattatgtgtctagcatagta

SEQ ID NO: 267221 - DNA, 25 bp, Homo sapien
gtctagcatagtaaaaatggctcta

SEQ ID NO: 267222 - DNA, 25 bp, Homo sapien
gtaaaaatggctctaaattgcatat

SEQ ID NO: 267223 - DNA, 25 bp, Homo sapien
atggctctaaattgcatataaatgc

SEQ ID NO: 267224 - DNA, 25 bp, Homo sapien
attgcatataaatgcccagatttta

SEQ ID NO: 267225 - DNA, 25 bp, Homo sapien
ttccttccctaggtaaaggagtgat

SEQ ID NO: 267226 - DNA, 25 bp, Homo sapien
aaaggagtgatagaacttgtgccaa

SEQ ID NO: 267227 - DNA, 25 bp, Homo sapien
aggagtgatagaacttgtgccaaaa

SEQ ID NO: 267228 - DNA, 25 bp, Homo sapien
gagtgatagaacttgtgccaaaaag

SEQ ID NO: 267229 - DNA, 25 bp, Homo sapien
gaacttgtgccaaaaagagggaatc

SEQ ID NO: 267230 - DNA, 25 bp, Homo sapien
cttgtgccaaaaagagggaatctat

SEQ ID NO: 267231 - DNA, 25 bp, Homo sapien
ttgaaaggacacagactgggaaaca

SEQ ID NO: 267232 - DNA, 25 bp, Homo sapien
gaagtagacagacatttggctagta

SEQ ID NO: 267233 - DNA, 25 bp, Homo sapien
ttggctagtatgtgcctggaccact

SEQ ID NO: 267234 - DNA, 25 bp, Homo sapien
tgtttggaggaaggtcatttcagaa

SEQ ID NO: 267235 - DNA, 25 bp, Homo sapien
gaggctgaggtctaaaacttctaat

SEQ ID NO: 267236 - DNA, 25 bp, Homo sapien
ttctaatctggacttctattgaagt

SEQ ID NO: 267237 - DNA, 25 bp, Homo sapien
aacaggaagttgaaggctaccatat

SEQ ID NO: 267238 - DNA, 25 bp, Homo sapien
gaaggctaccatatgtaaatccagt

SEQ ID NO: 267239 - DNA, 25 bp, Homo sapien
atgtaaatccagttgttgcctgaaa

SEQ ID NO: 267240 - DNA, 25 bp, Homo sapien
cagttgttgcctgaaatcagtcatt

SEQ ID NO: 267241 - DNA, 25 bp, Homo sapien
atcagtcatttcaagggagtatctt

SEQ ID NO: 267242 - DNA, 25 bp, Homo sapien
ctgccgtcgggttcctgcgctgaca

SEQ ID NO: 267243 - DNA, 25 bp, Homo sapien
ttcctgcgctgacacctggtctgtg

SEQ ID NO: 267244 - DNA, 25 bp, Homo sapien
acctggtctgtgcacctgtgttgct

SEQ ID NO: 267245 - DNA, 25 bp, Homo sapien
gaaaactggacacttttgtatgtat

SEQ ID NO: 267246 - DNA, 25 bp, Homo sapien
gtatattatagagacactgtttcca

SEQ ID NO: 267247 - DNA, 25 bp, Homo sapien
gacactgtttccattctaatttatc

SEQ ID NO: 267248 - DNA, 25 bp, Homo sapien
gattgacttactacttggaagataa

SEQ ID NO: 267249 - DNA, 25 bp, Homo sapien
gggtggcgcgtccttgataaatctc

SEQ ID NO: 267250 - DNA, 25 bp, Homo sapien
tggcgcgtccttgataaatctctag

SEQ ID NO: 267251 - DNA, 25 bp, Homo sapien
ttgataaatctctaggtggcctccc

SEQ ID NO: 267252 - DNA, 25 bp, Homo sapien
taaatctctaggtggcctcccgcca

SEQ ID NO: 267253 - DNA, 25 bp, Homo sapien
aaaagggagggaaggctagcacaat

SEQ ID NO: 267254 - DNA, 25 bp, Homo sapien
ggaggctagtattagtacctacagc

SEQ ID NO: 267255 - DNA, 25 bp, Homo sapien
gtattagtacctacagcacattttc

SEQ ID NO: 267256 - DNA, 25 bp, Homo sapien
caatctcttgtatctgtgttcttta

SEQ ID NO: 267257 - DNA, 25 bp, Homo sapien
aatcctcaaaacagtatcaattctt

SEQ ID NO: 267258 - DNA, 25 bp, Homo sapien
gtatcaattcttatagttgggtttt

SEQ ID NO: 267259 - DNA, 25 bp, Homo sapien
atagtatcataccattcagcacatg

SEQ ID NO: 267260 - DNA, 25 bp, Homo sapien
gaaatcactacgtctgaaggttaaa

SEQ ID NO: 267261 - DNA, 25 bp, Homo sapien
tttagtctaacattgtctcttattt

SEQ ID NO: 267262 - DNA, 25 bp, Homo sapien
tctcttatttagttcatctccaaca

SEQ ID NO: 267263 - DNA, 25 bp, Homo sapien
atctccaacaaactatgtgccaagc

SEQ ID NO: 267264 - DNA, 25 bp, Homo sapien
attcccttgtctccagtctgtacat

SEQ ID NO: 267265 - DNA, 25 bp, Homo sapien
agtctgtacataccctgtgtgcctt

SEQ ID NO: 267266 - DNA, 25 bp, Homo sapien
tcttaacgtctctacctggattttt

SEQ ID NO: 267267 - DNA, 25 bp, Homo sapien
ggatttttaacgcatctgaaacact

SEQ ID NO: 267268 - DNA, 25 bp, Homo sapien
tgaaacactcttcagtctgctgctc

SEQ ID NO: 267269 - DNA, 25 bp, Homo sapien
gttataatatacagagccgctttgc

SEQ ID NO: 267270 - DNA, 25 bp, Homo sapien
tgctgctccccaaggctaagctgga

SEQ ID NO: 267271 - DNA, 25 bp, Homo sapien
tacagagccgctttgcattgggcac

SEQ ID NO: 267272 - DNA, 25 bp, Homo sapien
gggccatcacagttaatcctctaag

SEQ ID NO: 267273 - DNA, 25 bp, Homo sapien
aatcctctaaggtcggagtgcccta

SEQ ID NO: 267274 - DNA, 25 bp, Homo sapien
ggagtgccctattagaagaccctgg

SEQ ID NO: 267275 - DNA, 25 bp, Homo sapien
ccacatcatggaagatggcgtatcc

SEQ ID NO: 267276 - DNA, 25 bp, Homo sapien
cttattcattcatttaactattttt

SEQ ID NO: 267277 - DNA, 25 bp, Homo sapien
tttttgtacctatttatcatcccca

SEQ ID NO: 267278 - DNA, 25 bp, Homo sapien
tactctctagctccatgagctccat

SEQ ID NO: 267279 - DNA, 25 bp, Homo sapien
actctctagctccatgagctccatt

SEQ ID NO: 267280 - DNA, 25 bp, Homo sapien
tctctagctccatgagctccattgt

SEQ ID NO: 267281 - DNA, 25 bp, Homo sapien
tctagctccatgagctccattgttt

SEQ ID NO: 267282 - DNA, 25 bp, Homo sapien
ctagctccatgagctccattgtttt

SEQ ID NO: 267283 - DNA, 25 bp, Homo sapien
tagctccatgagctccattgttttg

SEQ ID NO: 267284 - DNA, 25 bp, Homo sapien
agctccatgagctccattgttttga

SEQ ID NO: 267285 - DNA, 25 bp, Homo sapien
gctccatgagctccattgttttgat

SEQ ID NO: 267286 - DNA, 25 bp, Homo sapien
aaacagggtcttgtctgtgttgttg

SEQ ID NO: 267287 - DNA, 25 bp, Homo sapien
tctgtgttgttggtgacatggaatt

SEQ ID NO: 267288 - DNA, 25 bp, Homo sapien
ggaccatatgatgacattctaggaa

SEQ ID NO: 267289 - DNA, 25 bp, Homo sapien
gtacatatgcaggaatacatgacta

SEQ ID NO: 267290 - DNA, 25 bp, Homo sapien
ttctaggaatgtgtgtccatgtgtc

SEQ ID NO: 267291 - DNA, 25 bp, Homo sapien
gtgtccatgtgtctgaatacccttt

SEQ ID NO: 267292 - DNA, 25 bp, Homo sapien
gtctgaataccctttttagcccagt

SEQ ID NO: 267293 - DNA, 25 bp, Homo sapien
tttagcccagtgtctgtaaaattca

SEQ ID NO: 267294 - DNA, 25 bp, Homo sapien
gaaatacatctatggccatacacat

SEQ ID NO: 267295 - DNA, 25 bp, Homo sapien
tggccatacacatagctatagatat

SEQ ID NO: 267296 - DNA, 25 bp, Homo sapien
gtcatatataataatcttctcagaa

SEQ ID NO: 267297 - DNA, 25 bp, Homo sapien
tgttctttataaacacacgtgtaca

SEQ ID NO: 267298 - DNA, 25 bp, Homo sapien
gtgtacacacacgtccctgggataa

SEQ ID NO: 267299 - DNA, 25 bp, Homo sapien
acacacgtccctgggataaactgat

SEQ ID NO: 267300 - DNA, 25 bp, Homo sapien
gataaactgatctccatgaaagaat

SEQ ID NO: 267301 - DNA, 25 bp, Homo sapien
gagaattttaaaatggtagagccat

SEQ ID NO: 267302 - DNA, 25 bp, Homo sapien
gaaatgctagctaaaagccaatgag

SEQ ID NO: 267303 - DNA, 25 bp, Homo sapien
aaagccaatgagtagttacaatctt

SEQ ID NO: 267304 - DNA, 25 bp, Homo sapien
gtagttacaatctttactgctgaaa

SEQ ID NO: 267305 - DNA, 25 bp, Homo sapien
gttacaatctttactgctgaaagaa

SEQ ID NO: 267306 - DNA, 25 bp, Homo sapien
gaaatcagatggactctgaaactct

SEQ ID NO: 267307 - DNA, 25 bp, Homo sapien
cagatggactctgaaactctgatga

SEQ ID NO: 267308 - DNA, 25 bp, Homo sapien
aaaatgagcaatgctgagctggcat

SEQ ID NO: 267309 - DNA, 25 bp, Homo sapien
gctgagctggcattactcttgttca

SEQ ID NO: 267310 - DNA, 25 bp, Homo sapien
agctggcattactcttgttcattat

SEQ ID NO: 267311 - DNA, 25 bp, Homo sapien
ggcattactcttgttcattattctc

SEQ ID NO: 267312 - DNA, 25 bp, Homo sapien
actcttgttcattattctcacagtg

SEQ ID NO: 267313 - DNA, 25 bp, Homo sapien
tgttcattattctcacagtgggtca

SEQ ID NO: 267314 - DNA, 25 bp, Homo sapien
ttctcacagtgggtcattatgctgt

SEQ ID NO: 267315 - DNA, 25 bp, Homo sapien
tatgctgtggtttggtcaatctacc

SEQ ID NO: 267316 - DNA, 25 bp, Homo sapien
gtggtttggtcaatctacctggaaa

SEQ ID NO: 267317 - DNA, 25 bp, Homo sapien
gtcaatctacctggaaaaacaactg

SEQ ID NO: 267318 - DNA, 25 bp, Homo sapien
aaacaactggatgaactactaagta

SEQ ID NO: 267319 - DNA, 25 bp, Homo sapien
agacctcaaagacctcagggaaaga

SEQ ID NO: 267320 - DNA, 25 bp, Homo sapien
acctcagggaaagactgacgggcct

SEQ ID NO: 267321 - DNA, 25 bp, Homo sapien
gactgacgggcctggcttgaatcca

SEQ ID NO: 267322 - DNA, 25 bp, Homo sapien
gggcctggcttgaatccagggccca

SEQ ID NO: 267323 - DNA, 25 bp, Homo sapien
ctggctcagtcagccaaggccagga

SEQ ID NO: 267324 - DNA, 25 bp, Homo sapien
tcagtcagccaaggccaggagagtg

SEQ ID NO: 267325 - DNA, 25 bp, Homo sapien
gaaagaattcctgaaggcggcttca

SEQ ID NO: 267326 - DNA, 25 bp, Homo sapien
gaaggcggcttcatggatcaggaac

SEQ ID NO: 267327 - DNA, 25 bp, Homo sapien
cttcatggatcaggaacatctcagg

SEQ ID NO: 267328 - DNA, 25 bp, Homo sapien
acatctcaggagtatactgagccca

SEQ ID NO: 267329 - DNA, 25 bp, Homo sapien
ggagtatactgagcccaagaacact

SEQ ID NO: 267330 - DNA, 25 bp, Homo sapien
ataaggctacttcatctggacattc

SEQ ID NO: 267331 - DNA, 25 bp, Homo sapien
aggctacttcatctggacattcatc

SEQ ID NO: 267332 - DNA, 25 bp, Homo sapien
ggacattcatcagtctcaaggtatg

SEQ ID NO: 267333 - DNA, 25 bp, Homo sapien
atcagtctcaaggtatggttcatct

SEQ ID NO: 267334 - DNA, 25 bp, Homo sapien
caaggtatggttcatctggagacag

SEQ ID NO: 267335 - DNA, 25 bp, Homo sapien
agacagaatcattcctgcacttggt

SEQ ID NO: 267336 - DNA, 25 bp, Homo sapien
gaatcattcctgcacttggtacttt

SEQ ID NO: 267337 - DNA, 25 bp, Homo sapien
cctgcacttggtacttttggagtct

SEQ ID NO: 267338 - DNA, 25 bp, Homo sapien
acttttggagtctgtttattcacct

SEQ ID NO: 267339 - DNA, 25 bp, Homo sapien
gtttattcacctcacaattttaagt

SEQ ID NO: 267340 - DNA, 25 bp, Homo sapien
aaaaactgggtgctttcataaatgt

SEQ ID NO: 267341 - DNA, 25 bp, Homo sapien
ctgtggtcggctttccatgggtgaa

SEQ ID NO: 267342 - DNA, 25 bp, Homo sapien
gtcggctttccatgggtgaaacaga

SEQ ID NO: 267343 - DNA, 25 bp, Homo sapien
ttcaaatatcctcaccaactgcttt

SEQ ID NO: 267344 - DNA, 25 bp, Homo sapien
caccaactgctttcctagatttttc

SEQ ID NO: 267345 - DNA, 25 bp, Homo sapien
ctttcctagatttttcagccagtta

SEQ ID NO: 267346 - DNA, 25 bp, Homo sapien
gatttttcagccagttacttgacca

SEQ ID NO: 267347 - DNA, 25 bp, Homo sapien
agccagttacttgaccatattagga

SEQ ID NO: 267348 - DNA, 25 bp, Homo sapien
tatcactgagattaatggccctggg

SEQ ID NO: 267349 - DNA, 25 bp, Homo sapien
tgagcttgggcttcaggacatagaa

SEQ ID NO: 267350 - DNA, 25 bp, Homo sapien
gaaaacaacattagttatgctggaa

SEQ ID NO: 267351 - DNA, 25 bp, Homo sapien
aatggccctgggttgcagccacaag

SEQ ID NO: 267352 - DNA, 25 bp, Homo sapien
cttttctgcagggaagtatgtgaac

SEQ ID NO: 267353 - DNA, 25 bp, Homo sapien
gtgaacgttcacaccaagcgtgtca

SEQ ID NO: 267354 - DNA, 25 bp, Homo sapien
acaccaagcgtgtcagtcatgtctg

SEQ ID NO: 267355 - DNA, 25 bp, Homo sapien
agtcatgtctgtaagtcatctccca

SEQ ID NO: 267356 - DNA, 25 bp, Homo sapien
aggtcaggttttcctgcccaatgag

SEQ ID NO: 267357 - DNA, 25 bp, Homo sapien
ggatggcttgactttggagctcttt

SEQ ID NO: 267358 - DNA, 25 bp, Homo sapien
tttggagctctttggatctgtggat

SEQ ID NO: 267359 - DNA, 25 bp, Homo sapien
tttggatttctgatacccgtttgat

SEQ ID NO: 267360 - DNA, 25 bp, Homo sapien
gatcaaagaggcaaccgaggtctaa

SEQ ID NO: 267361 - DNA, 25 bp, Homo sapien
gaggtctaacgggtcaagtgacttt

SEQ ID NO: 267362 - DNA, 25 bp, Homo sapien
aagtgactttcccatatccgtgaag

SEQ ID NO: 267363 - DNA, 25 bp, Homo sapien
gatgagcgccactttatctcaaatg

SEQ ID NO: 267364 - DNA, 25 bp, Homo sapien
gtttacacatactagggaaaagcat

SEQ ID NO: 267365 - DNA, 25 bp, Homo sapien
ggaaaagcatctgcagtttctgaac

SEQ ID NO: 267366 - DNA, 25 bp, Homo sapien
gaactctttgtgaatcagtatcact

SEQ ID NO: 267367 - DNA, 25 bp, Homo sapien
tgtgaatcagtatcactttttcatg

SEQ ID NO: 267368 - DNA, 25 bp, Homo sapien
ttttcatgttacttcagagatcaat

SEQ ID NO: 267369 - DNA, 25 bp, Homo sapien
ttcagagatcaatattcagtgcatt

SEQ ID NO: 267370 - DNA, 25 bp, Homo sapien
gtgcattggttttatttaccatctt

SEQ ID NO: 267371 - DNA, 25 bp, Homo sapien
aaaatctccttcacaaagccctttg

SEQ ID NO: 267372 - DNA, 25 bp, Homo sapien
aagccctttgcgacaaacttatgta

SEQ ID NO: 267373 - DNA, 25 bp, Homo sapien
ccaaaattgatatctgcctcacctg

SEQ ID NO: 267374 - DNA, 25 bp, Homo sapien
agagaaacggagcatcagcccagct

SEQ ID NO: 267375 - DNA, 25 bp, Homo sapien
tcagcccagctgtcgcacagggtct

SEQ ID NO: 267376 - DNA, 25 bp, Homo sapien
agctcctggcagacgggactcactt

SEQ ID NO: 267377 - DNA, 25 bp, Homo sapien
tgcggccactccaagctaatgaaga

SEQ ID NO: 267378 - DNA, 25 bp, Homo sapien
gaagagccgtttactccggaggtga

SEQ ID NO: 267379 - DNA, 25 bp, Homo sapien
ttactccggaggtgagtccccgagg

SEQ ID NO: 267380 - DNA, 25 bp, Homo sapien
gggactcacttcacggacacacaga

SEQ ID NO: 267381 - DNA, 25 bp, Homo sapien
gacacacagacccacgatcttcatg

SEQ ID NO: 267382 - DNA, 25 bp, Homo sapien
cacgatcttcatgctattagggtaa

SEQ ID NO: 267383 - DNA, 25 bp, Homo sapien
tagggtaatttcatcttcacagtaa

SEQ ID NO: 267384 - DNA, 25 bp, Homo sapien
gtaaaaaatcaccaattcccagaga

SEQ ID NO: 267385 - DNA, 25 bp, Homo sapien
tttgaagtcgccaaaatccctgcct

SEQ ID NO: 267386 - DNA, 25 bp, Homo sapien
aatccctgccttggatatgttgaag

SEQ ID NO: 267387 - DNA, 25 bp, Homo sapien
gctggaggagattttgaactgtgat

SEQ ID NO: 267388 - DNA, 25 bp, Homo sapien
actgtgattgtgaggctcagggcct

SEQ ID NO: 267389 - DNA, 25 bp, Homo sapien
tcagggcctggtactctagcagcag

SEQ ID NO: 267390 - DNA, 25 bp, Homo sapien
gcctggtactctagcagcagccaca

SEQ ID NO: 267391 - DNA, 25 bp, Homo sapien
acagggctaagcatgcatgttaaca

SEQ ID NO: 267392 - DNA, 25 bp, Homo sapien
aagcatgcatgttaacagggtatat

SEQ ID NO: 267393 - DNA, 25 bp, Homo sapien
cagggtatatttattctatgttcga

SEQ ID NO: 267394 - DNA, 25 bp, Homo sapien
ctatgttcgaatttgtcttttgatc

SEQ ID NO: 267395 - DNA, 25 bp, Homo sapien
gaatttgtcttttgatcgcttttat

SEQ ID NO: 267396 - DNA, 25 bp, Homo sapien
attcaattatcactagacttacaag

SEQ ID NO: 267397 - DNA, 25 bp, Homo sapien
caattatcactagacttacaagact

SEQ ID NO: 267398 - DNA, 25 bp, Homo sapien
tatcactagacttacaagactacag

SEQ ID NO: 267399 - DNA, 25 bp, Homo sapien
cactagacttacaagactacagaaa

SEQ ID NO: 267400 - DNA, 25 bp, Homo sapien
caagactacagaaaatttctcaaga

SEQ ID NO: 267401 - DNA, 25 bp, Homo sapien
tttctcaagaaccagtaaggatcag

SEQ ID NO: 267402 - DNA, 25 bp, Homo sapien
caagaaccagtaaggatcagacaga

SEQ ID NO: 267403 - DNA, 25 bp, Homo sapien
tcagacagagccaatgacaatactg

SEQ ID NO: 267404 - DNA, 25 bp, Homo sapien
gacagagccaatgacaatactgaag

SEQ ID NO: 267405 - DNA, 25 bp, Homo sapien
gagccaatgacaatactgaagaagc

SEQ ID NO: 267406 - DNA, 25 bp, Homo sapien
aatgacaatactgaagaagcttgcc

SEQ ID NO: 267407 - DNA, 25 bp, Homo sapien
ttatcacctcccaggacagtggtca

SEQ ID NO: 267408 - DNA, 25 bp, Homo sapien
acagtggtcaggtcttacaaaaggc

SEQ ID NO: 267409 - DNA, 25 bp, Homo sapien
agaagacattggtagctcccctcat

SEQ ID NO: 267410 - DNA, 25 bp, Homo sapien
ctcccctcatttcctacaatttgga

SEQ ID NO: 267411 - DNA, 25 bp, Homo sapien
aaaaataattcttggcatcatgctt

SEQ ID NO: 267412 - DNA, 25 bp, Homo sapien
ttggcatcatgcttggttgggagtt

SEQ ID NO: 267413 - DNA, 25 bp, Homo sapien
gggattgtgatggatcatatactca

SEQ ID NO: 267414 - DNA, 25 bp, Homo sapien
aaatgtatccctgcattgtttccta

SEQ ID NO: 267415 - DNA, 25 bp, Homo sapien
attgtttcctagtttcactctgtac

SEQ ID NO: 267416 - DNA, 25 bp, Homo sapien
cctagtttcactctgtaccttatgc

SEQ ID NO: 267417 - DNA, 25 bp, Homo sapien
atctttaccctattcacccttatca

SEQ ID NO: 267418 - DNA, 25 bp, Homo sapien
gtcgagtctacatatctgttccaat

SEQ ID NO: 267419 - DNA, 25 bp, Homo sapien
tatctgttccaatgttcctacaaag

SEQ ID NO: 267420 - DNA, 25 bp, Homo sapien
acgatggtacgtttctgtttattct

SEQ ID NO: 267421 - DNA, 25 bp, Homo sapien
tctgtttattctacacttgtttctg

SEQ ID NO: 267422 - DNA, 25 bp, Homo sapien
attttcagtaattgctcattggttg

SEQ ID NO: 267423 - DNA, 25 bp, Homo sapien
caaccatacatgcagaaccaactaa

SEQ ID NO: 267424 - DNA, 25 bp, Homo sapien
caactaattcttctggtaactacat

SEQ ID NO: 267425 - DNA, 25 bp, Homo sapien
aaattctatggtatggctccatcac

SEQ ID NO: 267426 - DNA, 25 bp, Homo sapien
tggctccatcacaatttaatcatag

SEQ ID NO: 267427 - DNA, 25 bp, Homo sapien
tcaaagtgatttttggcctcaagca

SEQ ID NO: 267428 - DNA, 25 bp, Homo sapien
atttttcctccaacatgtcgagtct

SEQ ID NO: 267429 - DNA, 25 bp, Homo sapien
atttgagactgttagaactcggtgt

SEQ ID NO: 267430 - DNA, 25 bp, Homo sapien
gagactgttagaactcggtgttgtt

SEQ ID NO: 267431 - DNA, 25 bp, Homo sapien
gactgttagaactcggtgttgttat

SEQ ID NO: 267432 - DNA, 25 bp, Homo sapien
tgttagaactcggtgttgttatcca

SEQ ID NO: 267433 - DNA, 25 bp, Homo sapien
actcggtgttgttatccacacaaat

SEQ ID NO: 267434 - DNA, 25 bp, Homo sapien
tcggtgttgttatccacacaaatgg

SEQ ID NO: 267435 - DNA, 25 bp, Homo sapien
ggtgttgttatccacacaaatggaa

SEQ ID NO: 267436 - DNA, 25 bp, Homo sapien
aacatgtttgtttgtaaatatcaga

SEQ ID NO: 267437 - DNA, 25 bp, Homo sapien
atgggaaagtatatccttttgtaat

SEQ ID NO: 267438 - DNA, 25 bp, Homo sapien
gggaaagtatatccttttgtaatat

SEQ ID NO: 267439 - DNA, 25 bp, Homo sapien
gtatatccttttgtaatataagatg

SEQ ID NO: 267440 - DNA, 25 bp, Homo sapien
atgtgtcccacatgtgtagtcctaa

SEQ ID NO: 267441 - DNA, 25 bp, Homo sapien
tgtagtcctaaatgccactgtctca

SEQ ID NO: 267442 - DNA, 25 bp, Homo sapien
tgtctcacagttggcctcttatcag

SEQ ID NO: 267443 - DNA, 25 bp, Homo sapien
gttggcctcttatcaggacctaagc

SEQ ID NO: 267444 - DNA, 25 bp, Homo sapien
gacagcaacttgcagagccccattc

SEQ ID NO: 267445 - DNA, 25 bp, Homo sapien
tgggcaagatggaatcactcagctt

SEQ ID NO: 267446 - DNA, 25 bp, Homo sapien
tcactcagcttaaggaaggtcttcc

SEQ ID NO: 267447 - DNA, 25 bp, Homo sapien
gtcttccccatctatgcttttgaag

SEQ ID NO: 267448 - DNA, 25 bp, Homo sapien
aagggtatattcttgctgaacgaga

SEQ ID NO: 267449 - DNA, 25 bp, Homo sapien
aggaagctgaagatatctctgtcaa

SEQ ID NO: 267450 - DNA, 25 bp, Homo sapien
atctctgtcaagtcatcctctgtgt

SEQ ID NO: 267451 - DNA, 25 bp, Homo sapien
gcaaagctttgcaatgatactctca

SEQ ID NO: 267452 - DNA, 25 bp, Homo sapien
aacagaatgctgtcttcccataatg

SEQ ID NO: 267453 - DNA, 25 bp, Homo sapien
gctgtcttcccataatgatggcatt

SEQ ID NO: 267454 - DNA, 25 bp, Homo sapien
attcaattatcactagacttacaag

SEQ ID NO: 267455 - DNA, 25 bp, Homo sapien
tatcactagacttacaagactacag

SEQ ID NO: 267456 - DNA, 25 bp, Homo sapien
caagactacagaaaatttctcaaga

SEQ ID NO: 267457 - DNA, 25 bp, Homo sapien
tttctcaagaaccagtaaggatcag

SEQ ID NO: 267458 - DNA, 25 bp, Homo sapien
caagaaccagtaaggatcagacaga

SEQ ID NO: 267459 - DNA, 25 bp, Homo sapien
tcagacagagccaatgacaatactg

SEQ ID NO: 267460 - DNA, 25 bp, Homo sapien
gagccaatgacaatactgaagaagc

SEQ ID NO: 267461 - DNA, 25 bp, Homo sapien
aatgacaatactgaagaagcttgcc

SEQ ID NO: 267462 - DNA, 25 bp, Homo sapien
ggcactcatgaatgttgcagtttac

SEQ ID NO: 267463 - DNA, 25 bp, Homo sapien
aggtgacagagatagacagcccaaa

SEQ ID NO: 267464 - DNA, 25 bp, Homo sapien
gcccaaaagaatggctcaatgttgt

SEQ ID NO: 267465 - DNA, 25 bp, Homo sapien
gacttgaattgcttcctgatttctg

SEQ ID NO: 267466 - DNA, 25 bp, Homo sapien
tggtcagggttcagggcaatagaaa

SEQ ID NO: 267467 - DNA, 25 bp, Homo sapien
atagaaatgccatagagccaagaag

SEQ ID NO: 267468 - DNA, 25 bp, Homo sapien
agcaggttttactgagagttctacc

SEQ ID NO: 267469 - DNA, 25 bp, Homo sapien
gagagttctacctgttgggcaaaca

SEQ ID NO: 267470 - DNA, 25 bp, Homo sapien
gtctctgtctgttgcctttgcataa

SEQ ID NO: 267471 - DNA, 25 bp, Homo sapien
taattatcaagtgacccggtggcta

SEQ ID NO: 267472 - DNA, 25 bp, Homo sapien
ccggtggctacaaggcactcatgaa

SEQ ID NO: 267473 - DNA, 25 bp, Homo sapien
aactctttcttctcaaatcaatcag

SEQ ID NO: 267474 - DNA, 25 bp, Homo sapien
caaacttaccatgtgaaggacagca

SEQ ID NO: 267475 - DNA, 25 bp, Homo sapien
agcaagcagttgacctctggaggtc

SEQ ID NO: 267476 - DNA, 25 bp, Homo sapien
gacctctggaggtccttagacttaa

SEQ ID NO: 267477 - DNA, 25 bp, Homo sapien
ggaagaaaattcctccccagcatta

SEQ ID NO: 267478 - DNA, 25 bp, Homo sapien
aattcctccccagcattaacttgga

SEQ ID NO: 267479 - DNA, 25 bp, Homo sapien
cccagcattaacttggaccagtaat

SEQ ID NO: 267480 - DNA, 25 bp, Homo sapien
ggaccagtaatgtttttctatttat

SEQ ID NO: 267481 - DNA, 25 bp, Homo sapien
agcacatgggcattctttctgagac

SEQ ID NO: 267482 - DNA, 25 bp, Homo sapien
gggcattctttctgagacctgcaaa

SEQ ID NO: 267483 - DNA, 25 bp, Homo sapien
aaacaaagggagaggctaagcagac

SEQ ID NO: 267484 - DNA, 25 bp, Homo sapien
ttgccctttgccatagtctttcttt

SEQ ID NO: 267485 - DNA, 25 bp, Homo sapien
gccatagtctttctttgagccagga

SEQ ID NO: 267486 - DNA, 25 bp, Homo sapien
gcttgagtgccagtagccatcttgc

SEQ ID NO: 267487 - DNA, 25 bp, Homo sapien
tagccatcttgcacacatgacacaa

SEQ ID NO: 267488 - DNA, 25 bp, Homo sapien
tgacacaaaagctcacaccctgtgg

SEQ ID NO: 267489 - DNA, 25 bp, Homo sapien
caccctgtggactatggatggctac

SEQ ID NO: 267490 - DNA, 25 bp, Homo sapien
gatggctacaaaatccctagaaagg

SEQ ID NO: 267491 - DNA, 25 bp, Homo sapien
gatttagaatgaactagagtcccta

SEQ ID NO: 267492 - DNA, 25 bp, Homo sapien
gagtccctaataacatctattgctt

SEQ ID NO: 267493 - DNA, 25 bp, Homo sapien
gaacatgtatcttctatgaacaact

SEQ ID NO: 267494 - DNA, 25 bp, Homo sapien
tacagccaaacgcaatttccacatg

SEQ ID NO: 267495 - DNA, 25 bp, Homo sapien
ctttttcattctggctgaaagaaaa

SEQ ID NO: 267496 - DNA, 25 bp, Homo sapien
aaaggattagttgagtgtgaaattc

SEQ ID NO: 267497 - DNA, 25 bp, Homo sapien
caacagtattttgctcatacatact

SEQ ID NO: 267498 - DNA, 25 bp, Homo sapien
gctcatacatactaaaaaggtgcgt

SEQ ID NO: 267499 - DNA, 25 bp, Homo sapien
catactaaaaaggtgcgtagggact

SEQ ID NO: 267500 - DNA, 25 bp, Homo sapien
gcgtagggacttggcgcatttaaac

SEQ ID NO: 267501 - DNA, 25 bp, Homo sapien
gacttggcgcatttaaacaagtttc

SEQ ID NO: 267502 - DNA, 25 bp, Homo sapien
gaaaggtttcaatttgactcaagaa

SEQ ID NO: 267503 - DNA, 25 bp, Homo sapien
gaatttatcacttgctgcatggatc

SEQ ID NO: 267504 - DNA, 25 bp, Homo sapien
ttatcacttgctgcatggatcagat

SEQ ID NO: 267505 - DNA, 25 bp, Homo sapien
attaatactagcctttttcattctg

SEQ ID NO: 267506 - DNA, 25 bp, Homo sapien
ttgcagaacaccagaacatcacaca

SEQ ID NO: 267507 - DNA, 25 bp, Homo sapien
agaacatcacacaaagccccttgct

SEQ ID NO: 267508 - DNA, 25 bp, Homo sapien
aaagccccttgctcagtggcttggg

SEQ ID NO: 267509 - DNA, 25 bp, Homo sapien
gactggtactaatttctgtattact

SEQ ID NO: 267510 - DNA, 25 bp, Homo sapien
gtttaatactctgtagccaccagct

SEQ ID NO: 267511 - DNA, 25 bp, Homo sapien
taatttgtgttgcaagagaagtccc

SEQ ID NO: 267512 - DNA, 25 bp, Homo sapien
catgtgtcaagggatcaggtgccac

SEQ ID NO: 267513 - DNA, 25 bp, Homo sapien
tcaggtgccacggacttggagctgt

SEQ ID NO: 267514 - DNA, 25 bp, Homo sapien
tgtggctcacaggtattgaatgaat

SEQ ID NO: 267515 - DNA, 25 bp, Homo sapien
gagcaatgtgcgaatgctgagtgtt

SEQ ID NO: 267516 - DNA, 25 bp, Homo sapien
tagaaagacttattgcagaacacca

SEQ ID NO: 267517 - DNA, 25 bp, Homo sapien
agtggtagaagcaactgaacggatg

SEQ ID NO: 267518 - DNA, 25 bp, Homo sapien
aactgaacggatgcgtgcgagctga

SEQ ID NO: 267519 - DNA, 25 bp, Homo sapien
gaggagaactcttgaaatctccatt

SEQ ID NO: 267520 - DNA, 25 bp, Homo sapien
ttttcaatcccttcgaaatcacgta

SEQ ID NO: 267521 - DNA, 25 bp, Homo sapien
atcccttcgaaatcacgtatggttt

SEQ ID NO: 267522 - DNA, 25 bp, Homo sapien
aatcacgtatggtttccacaaagcc

SEQ ID NO: 267523 - DNA, 25 bp, Homo sapien
tctctgctcctccattcgcaagtgt

SEQ ID NO: 267524 - DNA, 25 bp, Homo sapien
attcgcaagtgtcttcctgggccag

SEQ ID NO: 267525 - DNA, 25 bp, Homo sapien
gcaagtgtcttcctgggccagactc

SEQ ID NO: 267526 - DNA, 25 bp, Homo sapien
gatgaagttttctatggtgggacac

SEQ ID NO: 267527 - DNA, 25 bp, Homo sapien
gaagttttctatggtgggacactaa

SEQ ID NO: 267528 - DNA, 25 bp, Homo sapien
atcgcaccattgcaaccccacctgg

SEQ ID NO: 267529 - DNA, 25 bp, Homo sapien
ggatttattatgtgctcactgctgg

SEQ ID NO: 267530 - DNA, 25 bp, Homo sapien
gatttattatgtgctcactgctggc

SEQ ID NO: 267531 - DNA, 25 bp, Homo sapien
atttattatgtgctcactgctggct

SEQ ID NO: 267532 - DNA, 25 bp, Homo sapien
tttattatgtgctcactgctggctc

SEQ ID NO: 267533 - DNA, 25 bp, Homo sapien
attatgtgctcactgctggctcagg

SEQ ID NO: 267534 - DNA, 25 bp, Homo sapien
actgctggctcaggccccaacctct

SEQ ID NO: 267535 - DNA, 25 bp, Homo sapien
tggctcaggccccaacctctggcct

SEQ ID NO: 267536 - DNA, 25 bp, Homo sapien
ggctcaggccccaacctctggcctt

SEQ ID NO: 267537 - DNA, 25 bp, Homo sapien
gctcaggccccaacctctggccttt

SEQ ID NO: 267538 - DNA, 25 bp, Homo sapien
tcaggccccaacctctggcctttta

SEQ ID NO: 267539 - DNA, 25 bp, Homo sapien
atcaatttgcagtctccaggatgca

SEQ ID NO: 267540 - DNA, 25 bp, Homo sapien
tctccaggatgcaacttcaccctat

SEQ ID NO: 267541 - DNA, 25 bp, Homo sapien
ttcaccctatgctgcgttcataaat

SEQ ID NO: 267542 - DNA, 25 bp, Homo sapien
gcgttcataaattaatctcctggga

SEQ ID NO: 267543 - DNA, 25 bp, Homo sapien
tctcctgggattagattctgtgttt

SEQ ID NO: 267544 - DNA, 25 bp, Homo sapien
tgttttagtaacactcctgaggcat

SEQ ID NO: 267545 - DNA, 25 bp, Homo sapien
gtgagacaagttctgacaactttca

SEQ ID NO: 267546 - DNA, 25 bp, Homo sapien
tgcgaggcacggaagtgtccaaagt

SEQ ID NO: 267547 - DNA, 25 bp, Homo sapien
tcggccttctggatccccgtgggtt

SEQ ID NO: 267548 - DNA, 25 bp, Homo sapien
agaggccgatgcttgtggctcttac

SEQ ID NO: 267549 - DNA, 25 bp, Homo sapien
gtggctcttaccaacatcaatttgc

SEQ ID NO: 267550 - DNA, 25 bp, Homo sapien
aaaagactgttgttatggtttgcat

SEQ ID NO: 267551 - DNA, 25 bp, Homo sapien
attgtaaccgatacgcagagtctga

SEQ ID NO: 267552 - DNA, 25 bp, Homo sapien
cagagtctgaccgttgggcaacaag

SEQ ID NO: 267553 - DNA, 25 bp, Homo sapien
gggcaacaagtttttctatcctgat

SEQ ID NO: 267554 - DNA, 25 bp, Homo sapien
ttctatcctgatgcgcaacacagtc

SEQ ID NO: 267555 - DNA, 25 bp, Homo sapien
tttagcctcctttccatattctcac

SEQ ID NO: 267556 - DNA, 25 bp, Homo sapien
ctaatttctctcttacagagtacaa

SEQ ID NO: 267557 - DNA, 25 bp, Homo sapien
agatttacagaagcccacgaagaat

SEQ ID NO: 267558 - DNA, 25 bp, Homo sapien
agcccacgaagaatttacagcctgc

SEQ ID NO: 267559 - DNA, 25 bp, Homo sapien
aggtgtatacaaactccgaacatat

SEQ ID NO: 267560 - DNA, 25 bp, Homo sapien
atatccagtattccaattcctttgt

SEQ ID NO: 267561 - DNA, 25 bp, Homo sapien
attctgctgccacaagtaattccta

SEQ ID NO: 267562 - DNA, 25 bp, Homo sapien
ttctgctgccacaagtaattcctag

SEQ ID NO: 267563 - DNA, 25 bp, Homo sapien
ctgccacaagtaattcctagtaaga

SEQ ID NO: 267564 - DNA, 25 bp, Homo sapien
tgccacaagtaattcctagtaagat

SEQ ID NO: 267565 - DNA, 25 bp, Homo sapien
gccacaagtaattcctagtaagatt

SEQ ID NO: 267566 - DNA, 25 bp, Homo sapien
ccacaagtaattcctagtaagattg

SEQ ID NO: 267567 - DNA, 25 bp, Homo sapien
acaagtaattcctagtaagattggc

SEQ ID NO: 267568 - DNA, 25 bp, Homo sapien
ttctacagtaacagattctgaatga

SEQ ID NO: 267569 - DNA, 25 bp, Homo sapien
ctacagtaacagattctgaatgaat

SEQ ID NO: 267570 - DNA, 25 bp, Homo sapien
tattagaagactcagtttctttcac

SEQ ID NO: 267571 - DNA, 25 bp, Homo sapien
attagaagactcagtttctttcacc

SEQ ID NO: 267572 - DNA, 25 bp, Homo sapien
gggctgaggcttccagtaaactgta

SEQ ID NO: 267573 - DNA, 25 bp, Homo sapien
ccagtaaactgtagcttccttgctc

SEQ ID NO: 267574 - DNA, 25 bp, Homo sapien
ttccttccatttaagccaggcaaca

SEQ ID NO: 267575 - DNA, 25 bp, Homo sapien
tccttgctcctctagcatggtgtaa

SEQ ID NO: 267576 - DNA, 25 bp, Homo sapien
tggtgtaagtatatgatgcctggaa

SEQ ID NO: 267577 - DNA, 25 bp, Homo sapien
gaaatgtggcaaccgttttcctcct

SEQ ID NO: 267578 - DNA, 25 bp, Homo sapien
ttaagccaggcaacataaccattcc

SEQ ID NO: 267579 - DNA, 25 bp, Homo sapien
gggttgaagtcagtactgtcaaatg

SEQ ID NO: 267580 - DNA, 25 bp, Homo sapien
taaccattccctctagcagcagaga

SEQ ID NO: 267581 - DNA, 25 bp, Homo sapien
gcagagatggtcacaagcccagtca

SEQ ID NO: 267582 - DNA, 25 bp, Homo sapien
ggtcacaagcccagtcagaaacaat

SEQ ID NO: 267583 - DNA, 25 bp, Homo sapien
tttgaagtcagtcgcccaatctgaa

SEQ ID NO: 267584 - DNA, 25 bp, Homo sapien
aatctgaaagccgtggatgcgcctg

SEQ ID NO: 267585 - DNA, 25 bp, Homo sapien
ctccatctcgtcaggtgtggctgtg

SEQ ID NO: 267586 - DNA, 25 bp, Homo sapien
gtgagcgccgcgcattttccgatac

SEQ ID NO: 267587 - DNA, 25 bp, Homo sapien
cattttccgataccgcgagacttct

SEQ ID NO: 267588 - DNA, 25 bp, Homo sapien
gagacttctctgtttccgagcgctg

SEQ ID NO: 267589 - DNA, 25 bp, Homo sapien
tttccgagcgctgtgaaggaactga

SEQ ID NO: 267590 - DNA, 25 bp, Homo sapien
aattgaggctttgagttttcgttag

SEQ ID NO: 267591 - DNA, 25 bp, Homo sapien
gagttttcgttagccaagacgttgt

SEQ ID NO: 267592 - DNA, 25 bp, Homo sapien
ccaagacgttgtgttgctctgtgtt

SEQ ID NO: 267593 - DNA, 25 bp, Homo sapien
gagctctcgaggagcctccagccag

SEQ ID NO: 267594 - DNA, 25 bp, Homo sapien
aagcctccttcaaggttaggttcag

SEQ ID NO: 267595 - DNA, 25 bp, Homo sapien
gttaggttcaggttctgttttccat

SEQ ID NO: 267596 - DNA, 25 bp, Homo sapien
gttttccatttaacctcatgtgcca

SEQ ID NO: 267597 - DNA, 25 bp, Homo sapien
ctcatgtgccataaagctgcccagg

SEQ ID NO: 267598 - DNA, 25 bp, Homo sapien
ataaagctgcccaggcacaccagag

SEQ ID NO: 267599 - DNA, 25 bp, Homo sapien
gacagtgctgctctgccagtagcaa

SEQ ID NO: 267600 - DNA, 25 bp, Homo sapien
tagcaagccccagatggaggaagct

SEQ ID NO: 267601 - DNA, 25 bp, Homo sapien
agctgggcccatttctggccacttc

SEQ ID NO: 267602 - DNA, 25 bp, Homo sapien
tctggccacttccacccatttggag

SEQ ID NO: 267603 - DNA, 25 bp, Homo sapien
atagctgtaaatgcccaagtagaat

SEQ ID NO: 267604 - DNA, 25 bp, Homo sapien
atgcccaagtagaatctgacagaat

SEQ ID NO: 267605 - DNA, 25 bp, Homo sapien
attcctcgaacatgcagtacataaa

SEQ ID NO: 267606 - DNA, 25 bp, Homo sapien
acttgccatttattgtaaggaaact

SEQ ID NO: 267607 - DNA, 25 bp, Homo sapien
ggaaatactcaaaagcaaggttgga

SEQ ID NO: 267608 - DNA, 25 bp, Homo sapien
aaagttgggtacagtatgtaactgc

SEQ ID NO: 267609 - DNA, 25 bp, Homo sapien
acagtatgtaactgcgggaaaccca

SEQ ID NO: 267610 - DNA, 25 bp, Homo sapien
tgcgggaaacccactgcccctttgt

SEQ ID NO: 267611 - DNA, 25 bp, Homo sapien
actgcccctttgtaagctgtggaac

SEQ ID NO: 267612 - DNA, 25 bp, Homo sapien
gcccctttgtaagctgtggaaccca

SEQ ID NO: 267613 - DNA, 25 bp, Homo sapien
ctttgtaagctgtggaacccaaact

SEQ ID NO: 267614 - DNA, 25 bp, Homo sapien
gtaagctgtggaacccaaactgtat

SEQ ID NO: 267615 - DNA, 25 bp, Homo sapien
agctgtggaacccaaactgtatggg

SEQ ID NO: 267616 - DNA, 25 bp, Homo sapien
gcaccctctagagaagcagggactt

SEQ ID NO: 267617 - DNA, 25 bp, Homo sapien
ctctagagaagcagggacttcagct

SEQ ID NO: 267618 - DNA, 25 bp, Homo sapien
aagggctgtcagagttatccatgtt

SEQ ID NO: 267619 - DNA, 25 bp, Homo sapien
ggctgtcagagttatccatgttatt

SEQ ID NO: 267620 - DNA, 25 bp, Homo sapien
tgtcagagttatccatgttattttt

SEQ ID NO: 267621 - DNA, 25 bp, Homo sapien
atttttgtgagtacggtgcctccta

SEQ ID NO: 267622 - DNA, 25 bp, Homo sapien
ttgtgagtacggtgcctcctaaaca

SEQ ID NO: 267623 - DNA, 25 bp, Homo sapien
gagtacggtgcctcctaaacaatca

SEQ ID NO: 267624 - DNA, 25 bp, Homo sapien
tacggtgcctcctaaacaatcacat

SEQ ID NO: 267625 - DNA, 25 bp, Homo sapien
ggtgcctcctaaacaatcacatgag

SEQ ID NO: 267626 - DNA, 25 bp, Homo sapien
gcctcctaaacaatcacatgaggat

SEQ ID NO: 267627 - DNA, 25 bp, Homo sapien
agctgggcgccgtaagtgtagcctt

SEQ ID NO: 267628 - DNA, 25 bp, Homo sapien
cgtaagtgtagccttcgccgaagaa

SEQ ID NO: 267629 - DNA, 25 bp, Homo sapien
gccgaagaagtacttgttgcgcagt

SEQ ID NO: 267630 - DNA, 25 bp, Homo sapien
ggtccaccgtgtgctcgttgtacag

SEQ ID NO: 267631 - DNA, 25 bp, Homo sapien
gtgtgctcgttgtacaggcccttct

SEQ ID NO: 267632 - DNA, 25 bp, Homo sapien
tgtacaggcccttctcagcgcggga

SEQ ID NO: 267633 - DNA, 25 bp, Homo sapien
gggacaccacctcgtcaatgcgggc

SEQ ID NO: 267634 - DNA, 25 bp, Homo sapien
aatgcgggcctcgatcttggcgcac

SEQ ID NO: 267635 - DNA, 25 bp, Homo sapien
ttggcgcactcgtcctggctgaaga

SEQ ID NO: 267636 - DNA, 25 bp, Homo sapien
tcgtcctggctgaagaggcgcatct

SEQ ID NO: 267637 - DNA, 25 bp, Homo sapien
gcatctggcggatgccgctcttcac

SEQ ID NO: 267638 - DNA, 25 bp, Homo sapien
tgtgcccagctgacatattctcact

SEQ ID NO: 267639 - DNA, 25 bp, Homo sapien
tgcccagctgacatattctcactta

SEQ ID NO: 267640 - DNA, 25 bp, Homo sapien
ctcccactttttcatattcctcttt

SEQ ID NO: 267641 - DNA, 25 bp, Homo sapien
catttttgcctttccgtttctgtct

SEQ ID NO: 267642 - DNA, 25 bp, Homo sapien
ttttgcctttccgtttctgtctatg

SEQ ID NO: 267643 - DNA, 25 bp, Homo sapien
tttgcctttccgtttctgtctatga

SEQ ID NO: 267644 - DNA, 25 bp, Homo sapien
ttgcctttccgtttctgtctatgat

SEQ ID NO: 267645 - DNA, 25 bp, Homo sapien
tgcctttccgtttctgtctatgatg

SEQ ID NO: 267646 - DNA, 25 bp, Homo sapien
gcctttccgtttctgtctatgatgt

SEQ ID NO: 267647 - DNA, 25 bp, Homo sapien
cctttccgtttctgtctatgatgta

SEQ ID NO: 267648 - DNA, 25 bp, Homo sapien
ctttccgtttctgtctatgatgtag

SEQ ID NO: 267649 - DNA, 25 bp, Homo sapien
ttcctcaaacctgttaagcttacat

SEQ ID NO: 267650 - DNA, 25 bp, Homo sapien
aatgccaccagcagccgactatgcg

SEQ ID NO: 267651 - DNA, 25 bp, Homo sapien
gcagccgactatgcgtgggagccaa

SEQ ID NO: 267652 - DNA, 25 bp, Homo sapien
gtgggagccaaccttgaggacacct

SEQ ID NO: 267653 - DNA, 25 bp, Homo sapien
ttgaggacacctgatctctcacttc

SEQ ID NO: 267654 - DNA, 25 bp, Homo sapien
gatctctcacttcttatgtcagatg

SEQ ID NO: 267655 - DNA, 25 bp, Homo sapien
ctaaatatccatcctctcttgttta

SEQ ID NO: 267656 - DNA, 25 bp, Homo sapien
atcctctcttgtttattagcattgt

SEQ ID NO: 267657 - DNA, 25 bp, Homo sapien
tagcattgttgttctggtccaggcc

SEQ ID NO: 267658 - DNA, 25 bp, Homo sapien
tggtccaggccttcatcaataaagc

SEQ ID NO: 267659 - DNA, 25 bp, Homo sapien
gaatgtccaaaatagccgggcaatt

SEQ ID NO: 267660 - DNA, 25 bp, Homo sapien
agaaaattcaacttcctaccagcct

SEQ ID NO: 267661 - DNA, 25 bp, Homo sapien
ctaccagccttagaaaggtctcttt

SEQ ID NO: 267662 - DNA, 25 bp, Homo sapien
tagggttacctagctggtccataca

SEQ ID NO: 267663 - DNA, 25 bp, Homo sapien
ctagctggtccatacaggttttatc

SEQ ID NO: 267664 - DNA, 25 bp, Homo sapien
acaggttttatcacctcactgcaag

SEQ ID NO: 267665 - DNA, 25 bp, Homo sapien
aagttgaatattctgttccccacgg

SEQ ID NO: 267666 - DNA, 25 bp, Homo sapien
ggatctggcttaatccctagttgct

SEQ ID NO: 267667 - DNA, 25 bp, Homo sapien
ggcttaatccctagttgctcatata

SEQ ID NO: 267668 - DNA, 25 bp, Homo sapien
gctcatatagttggtatcagcatag

SEQ ID NO: 267669 - DNA, 25 bp, Homo sapien
gatcttgatatttgcaacagcctag

SEQ ID NO: 267670 - DNA, 25 bp, Homo sapien
agttcagctgcttctattggtaaga

SEQ ID NO: 267671 - DNA, 25 bp, Homo sapien
ggaagttctgtttttattctccatt

SEQ ID NO: 267672 - DNA, 25 bp, Homo sapien
ccttctatgttcttgccatgtcaac

SEQ ID NO: 267673 - DNA, 25 bp, Homo sapien
tgttttttaaattcccagatcattc

SEQ ID NO: 267674 - DNA, 25 bp, Homo sapien
agatcattctggcattggtcctgga

SEQ ID NO: 267675 - DNA, 25 bp, Homo sapien
tcattctggcattggtcctggattc

SEQ ID NO: 267676 - DNA, 25 bp, Homo sapien
tagcaacatctattactcctgaaat

SEQ ID NO: 267677 - DNA, 25 bp, Homo sapien
ttactcctgaaatattttggctctt

SEQ ID NO: 267678 - DNA, 25 bp, Homo sapien
aaatattttggctcttcgtggcctg

SEQ ID NO: 267679 - DNA, 25 bp, Homo sapien
ctcttcgtggcctgtatgattcagt

SEQ ID NO: 267680 - DNA, 25 bp, Homo sapien
ggcctgtatgattcagtagactctg

SEQ ID NO: 267681 - DNA, 25 bp, Homo sapien
agcggtttaaggaactgagcttcag

SEQ ID NO: 267682 - DNA, 25 bp, Homo sapien
agcggagggcgggactgctggagca

SEQ ID NO: 267683 - DNA, 25 bp, Homo sapien
cggagggcgggactgctggagcagc

SEQ ID NO: 267684 - DNA, 25 bp, Homo sapien
gagggcgggactgctggagcagccg

SEQ ID NO: 267685 - DNA, 25 bp, Homo sapien
ggacccgacccggagctcgggctct

SEQ ID NO: 267686 - DNA, 25 bp, Homo sapien
ggagctcgggctctcgcacgctgct

SEQ ID NO: 267687 - DNA, 25 bp, Homo sapien
ctcgggctctcgcacgctgctcctg

SEQ ID NO: 267688 - DNA, 25 bp, Homo sapien
tgcaccgcgcgctgcgctggtccca

SEQ ID NO: 267689 - DNA, 25 bp, Homo sapien
agctctgcctccaccgggtggcgac

SEQ ID NO: 267690 - DNA, 25 bp, Homo sapien
cggcgcgctgggaggcccggaagcg

SEQ ID NO: 267691 - DNA, 25 bp, Homo sapien
ggaggcccggaagcgggcgtgcagt

SEQ ID NO: 267692 - DNA, 25 bp, Homo sapien
ggcgtgcagtgcagcgacgcctacc

SEQ ID NO: 267693 - DNA, 25 bp, Homo sapien
gccaaggcacgtggatcactttagg

SEQ ID NO: 267694 - DNA, 25 bp, Homo sapien
aaattagttggatgtggtggcctgt

SEQ ID NO: 267695 - DNA, 25 bp, Homo sapien
aattagttggatgtggtggcctgta

SEQ ID NO: 267696 - DNA, 25 bp, Homo sapien
attagttggatgtggtggcctgtaa

SEQ ID NO: 267697 - DNA, 25 bp, Homo sapien
ttagttggatgtggtggcctgtaat

SEQ ID NO: 267698 - DNA, 25 bp, Homo sapien
tagttggatgtggtggcctgtaatc

SEQ ID NO: 267699 - DNA, 25 bp, Homo sapien
agttggatgtggtggcctgtaatcc

SEQ ID NO: 267700 - DNA, 25 bp, Homo sapien
ggtggaggctgtagtgagccagata

SEQ ID NO: 267701 - DNA, 25 bp, Homo sapien
gtggaggctgtagtgagccagatag

SEQ ID NO: 267702 - DNA, 25 bp, Homo sapien
gaggctgtagtgagccagatagcac

SEQ ID NO: 267703 - DNA, 25 bp, Homo sapien
ttagccaagcatgatggtgccaacc

SEQ ID NO: 267704 - DNA, 25 bp, Homo sapien
tagccaagcatgatggtgccaacct

SEQ ID NO: 267705 - DNA, 25 bp, Homo sapien
agccaagcatgatggtgccaacctg

SEQ ID NO: 267706 - DNA, 25 bp, Homo sapien
gccaagcatgatggtgccaacctgt

SEQ ID NO: 267707 - DNA, 25 bp, Homo sapien
ccaagcatgatggtgccaacctgta

SEQ ID NO: 267708 - DNA, 25 bp, Homo sapien
ttccagcctgggtaatgaagtcgga

SEQ ID NO: 267709 - DNA, 25 bp, Homo sapien
tccagcctgggtaatgaagtcggag

SEQ ID NO: 267710 - DNA, 25 bp, Homo sapien
ccagcctgggtaatgaagtcggagt

SEQ ID NO: 267711 - DNA, 25 bp, Homo sapien
cctgggtaatgaagtcggagtgaaa

SEQ ID NO: 267712 - DNA, 25 bp, Homo sapien
ctgggtaatgaagtcggagtgaaac

SEQ ID NO: 267713 - DNA, 25 bp, Homo sapien
gtaatgaagtcggagtgaaactctg

SEQ ID NO: 267714 - DNA, 25 bp, Homo sapien
catattctcacttaatagaattata

SEQ ID NO: 267715 - DNA, 25 bp, Homo sapien
attctcacttaatagaattatagag

SEQ ID NO: 267716 - DNA, 25 bp, Homo sapien
ctcccactttttcatattcctcttt

SEQ ID NO: 267717 - DNA, 25 bp, Homo sapien
catttttgcctttccgtttctgtct

SEQ ID NO: 267718 - DNA, 25 bp, Homo sapien
ttttgcctttccgtttctgtctatg

SEQ ID NO: 267719 - DNA, 25 bp, Homo sapien
tttgcctttccgtttctgtctatga

SEQ ID NO: 267720 - DNA, 25 bp, Homo sapien
ttgcctttccgtttctgtctatgat

SEQ ID NO: 267721 - DNA, 25 bp, Homo sapien
tgcctttccgtttctgtctatgatg

SEQ ID NO: 267722 - DNA, 25 bp, Homo sapien
gcctttccgtttctgtctatgatgt

SEQ ID NO: 267723 - DNA, 25 bp, Homo sapien
cctttccgtttctgtctatgatgta

SEQ ID NO: 267724 - DNA, 25 bp, Homo sapien
ctttccgtttctgtctatgatgtag

SEQ ID NO: 267725 - DNA, 25 bp, Homo sapien
aaatcattcgtgaagaccatgtgga

SEQ ID NO: 267726 - DNA, 25 bp, Homo sapien
ccatgtggaggctttaagaactact

SEQ ID NO: 267727 - DNA, 25 bp, Homo sapien
ggctttaagaactactcagagaatc

SEQ ID NO: 267728 - DNA, 25 bp, Homo sapien
ttatgtccggactctggcctcgcct

SEQ ID NO: 267729 - DNA, 25 bp, Homo sapien
ttctgtgtaattgaggcattccata

SEQ ID NO: 267730 - DNA, 25 bp, Homo sapien
ggacatatttggctatttccagaga

SEQ ID NO: 267731 - DNA, 25 bp, Homo sapien
tcttatggaatgacacttggagcaa

SEQ ID NO: 267732 - DNA, 25 bp, Homo sapien
gaccagcttggattaggagcctctg

SEQ ID NO: 267733 - DNA, 25 bp, Homo sapien
atgtgagtttcacgtgctccttcag

SEQ ID NO: 267734 - DNA, 25 bp, Homo sapien
agtttcacgtgctccttcaggaaag

SEQ ID NO: 267735 - DNA, 25 bp, Homo sapien
ctccttcaggaaagcacttgggtat

SEQ ID NO: 267736 - DNA, 25 bp, Homo sapien
agtacaggccgaccatgaggccctc

SEQ ID NO: 267737 - DNA, 25 bp, Homo sapien
gaccatgaggccctcccgggaaagt

SEQ ID NO: 267738 - DNA, 25 bp, Homo sapien
ccctagggaggatggatgcactgcc

SEQ ID NO: 267739 - DNA, 25 bp, Homo sapien
atgcactgcctaggaggagacgcaa

SEQ ID NO: 267740 - DNA, 25 bp, Homo sapien
ggagacgcaaggttagacctcgccc

SEQ ID NO: 267741 - DNA, 25 bp, Homo sapien
gcaaggttagacctcgccccatttt

SEQ ID NO: 267742 - DNA, 25 bp, Homo sapien
gtgctgcagggtccgcaccaccaga

SEQ ID NO: 267743 - DNA, 25 bp, Homo sapien
agggtccgcaccaccagagaaagat

SEQ ID NO: 267744 - DNA, 25 bp, Homo sapien
taatagtagctcagttttattttct

SEQ ID NO: 267745 - DNA, 25 bp, Homo sapien
cagagaaaacaagggacccctgagc

SEQ ID NO: 267746 - DNA, 25 bp, Homo sapien
ggacccctgagcacacaaaggcagt

SEQ ID NO: 267747 - DNA, 25 bp, Homo sapien
aacatagcagagctatctgggtttg

SEQ ID NO: 267748 - DNA, 25 bp, Homo sapien
ggctatgacgttaggtatatgcact

SEQ ID NO: 267749 - DNA, 25 bp, Homo sapien
aggtatatgcactttacattgtatg

SEQ ID NO: 267750 - DNA, 25 bp, Homo sapien
gtatgtatctttttagttctagtga

SEQ ID NO: 267751 - DNA, 25 bp, Homo sapien
gttctagtgaactcatctggaatca

SEQ ID NO: 267752 - DNA, 25 bp, Homo sapien
gaactcatctggaatcatgttacag

SEQ ID NO: 267753 - DNA, 25 bp, Homo sapien
aaaatgattctccaggtccaaacac

SEQ ID NO: 267754 - DNA, 25 bp, Homo sapien
gattctccaggtccaaacacattta

SEQ ID NO: 267755 - DNA, 25 bp, Homo sapien
tctccaggtccaaacacatttaagt

SEQ ID NO: 267756 - DNA, 25 bp, Homo sapien
ctactctaacaattgcggctatctc

SEQ ID NO: 267757 - DNA, 25 bp, Homo sapien
aattgcggctatctcattttgtctc

SEQ ID NO: 267758 - DNA, 25 bp, Homo sapien
taccaagcttatcttgcaagggagt

SEQ ID NO: 267759 - DNA, 25 bp, Homo sapien
accaagcttatcttgcaagggagtt

SEQ ID NO: 267760 - DNA, 25 bp, Homo sapien
caagcttatcttgcaagggagttat

SEQ ID NO: 267761 - DNA, 25 bp, Homo sapien
agcttatcttgcaagggagttattt

SEQ ID NO: 267762 - DNA, 25 bp, Homo sapien
tatcttgcaagggagttattttcat

SEQ ID NO: 267763 - DNA, 25 bp, Homo sapien
tcatctaacatagaaagtgtgtttt

SEQ ID NO: 267764 - DNA, 25 bp, Homo sapien
gtgtgttttatcagacaaatgcttt

SEQ ID NO: 267765 - DNA, 25 bp, Homo sapien
gtgttttatcagacaaatgctttta

SEQ ID NO: 267766 - DNA, 25 bp, Homo sapien
ttttcattctaataatttgatacag

SEQ ID NO: 267767 - DNA, 25 bp, Homo sapien
gacaaagctgttcagatgatgctat

SEQ ID NO: 267768 - DNA, 25 bp, Homo sapien
caaagctgttcagatgatgctatta

SEQ ID NO: 267769 - DNA, 25 bp, Homo sapien
cctaataatttgatctttaccctga

SEQ ID NO: 267770 - DNA, 25 bp, Homo sapien
aaatgtttcctccattgttgctgac

SEQ ID NO: 267771 - DNA, 25 bp, Homo sapien
gaaacagaccaggattcatttatga

SEQ ID NO: 267772 - DNA, 25 bp, Homo sapien
cagtgttatttcaattcagctccat

SEQ ID NO: 267773 - DNA, 25 bp, Homo sapien
attcagctccattcacattttattc

SEQ ID NO: 267774 - DNA, 25 bp, Homo sapien
tcctccattgttgctgacgtagata

SEQ ID NO: 267775 - DNA, 25 bp, Homo sapien
tttattcttttgtgtctctgcacta

SEQ ID NO: 267776 - DNA, 25 bp, Homo sapien
ttttgtgtctctgcactaatgccct

SEQ ID NO: 267777 - DNA, 25 bp, Homo sapien
atattcccttcaatatgctaacccc

SEQ ID NO: 267778 - DNA, 25 bp, Homo sapien
atatgctaacccctaggtggctttt

SEQ ID NO: 267779 - DNA, 25 bp, Homo sapien
aggtggcttttcattcagaaggttc

SEQ ID NO: 267780 - DNA, 25 bp, Homo sapien
gtgattgtgtcccagtaaagtaaga

SEQ ID NO: 267781 - DNA, 25 bp, Homo sapien
tgattgtgtcccagtaaagtaagaa

SEQ ID NO: 267782 - DNA, 25 bp, Homo sapien
gattgtgtcccagtaaagtaagaaa

SEQ ID NO: 267783 - DNA, 25 bp, Homo sapien
attgtgtcccagtaaagtaagaaag

SEQ ID NO: 267784 - DNA, 25 bp, Homo sapien
ttgtgtcccagtaaagtaagaaagt

SEQ ID NO: 267785 - DNA, 25 bp, Homo sapien
tgtgtcccagtaaagtaagaaagta

SEQ ID NO: 267786 - DNA, 25 bp, Homo sapien
tgtcccagtaaagtaagaaagtaca

SEQ ID NO: 267787 - DNA, 25 bp, Homo sapien
tcccagtaaagtaagaaagtacaca

SEQ ID NO: 267788 - DNA, 25 bp, Homo sapien
cccagtaaagtaagaaagtacacat

SEQ ID NO: 267789 - DNA, 25 bp, Homo sapien
gtaagaaagtacacatatcaaaaaa

SEQ ID NO: 267790 - DNA, 25 bp, Homo sapien
aagaaagtacacatatcaaaaaata

SEQ ID NO: 267791 - DNA, 25 bp, Homo sapien
agtctccttctttttgtggtcttat

SEQ ID NO: 267792 - DNA, 25 bp, Homo sapien
ggtcttatgctatccaaccaatcag

SEQ ID NO: 267793 - DNA, 25 bp, Homo sapien
tcaaaataactctggaccctggatt

SEQ ID NO: 267794 - DNA, 25 bp, Homo sapien
ggaccctggatttcagtgattcata

SEQ ID NO: 267795 - DNA, 25 bp, Homo sapien
gattcatattgccaaatagcagctg

SEQ ID NO: 267796 - DNA, 25 bp, Homo sapien
aatagcagctgatccaaatgcacag

SEQ ID NO: 267797 - DNA, 25 bp, Homo sapien
ggttttatgagactccttataggat

SEQ ID NO: 267798 - DNA, 25 bp, Homo sapien
tataatacctgtcacagtccgctgg

SEQ ID NO: 267799 - DNA, 25 bp, Homo sapien
tccgctggccatcacttaggttatt

SEQ ID NO: 267800 - DNA, 25 bp, Homo sapien
ggttattccaccacttgttaatctc

SEQ ID NO: 267801 - DNA, 25 bp, Homo sapien
gttaatctcctttctgaagtctcct

SEQ ID NO: 267802 - DNA, 25 bp, Homo sapien
agagcacatataatgccaacacggg

SEQ ID NO: 267803 - DNA, 25 bp, Homo sapien
aatgaatgtggcctccatagtccat

SEQ ID NO: 267804 - DNA, 25 bp, Homo sapien
aatgtggcctccatagtccatagtg

SEQ ID NO: 267805 - DNA, 25 bp, Homo sapien
ggcctccatagtccatagtgtttct

SEQ ID NO: 267806 - DNA, 25 bp, Homo sapien
atagtgtttctctggagcctcaggg

SEQ ID NO: 267807 - DNA, 25 bp, Homo sapien
gagcctcagggcttggcatttattg

SEQ ID NO: 267808 - DNA, 25 bp, Homo sapien
gcttggcatttattgcagcatcatg

SEQ ID NO: 267809 - DNA, 25 bp, Homo sapien
cagcatcatgctaagaaccttcggc

SEQ ID NO: 267810 - DNA, 25 bp, Homo sapien
gctaagaaccttcggcataggtatc

SEQ ID NO: 267811 - DNA, 25 bp, Homo sapien
ggaaaagattacaagtctcagcaaa

SEQ ID NO: 267812 - DNA, 25 bp, Homo sapien
caagaggttttatgccccaacctga

SEQ ID NO: 267813 - DNA, 25 bp, Homo sapien
atccattcttcaccgattgtctaaa

SEQ ID NO: 267814 - DNA, 25 bp, Homo sapien
acagagagacggtggtcctctgccg

SEQ ID NO: 267815 - DNA, 25 bp, Homo sapien
ctctgccgcggtgggattctttggt

SEQ ID NO: 267816 - DNA, 25 bp, Homo sapien
taaaacagtgacctctgttgggcat

SEQ ID NO: 267817 - DNA, 25 bp, Homo sapien
ggtttcatttttagtgctctcctgt

SEQ ID NO: 267818 - DNA, 25 bp, Homo sapien
gtgctctcctgtcttaagcaacgta

SEQ ID NO: 267819 - DNA, 25 bp, Homo sapien
tcttaagcaacgtaggcactcctga

SEQ ID NO: 267820 - DNA, 25 bp, Homo sapien
gtaggcactcctgaaccaagttctc

SEQ ID NO: 267821 - DNA, 25 bp, Homo sapien
gttctctttcctgcatgaaacgaag

SEQ ID NO: 267822 - DNA, 25 bp, Homo sapien
ttcgtgcataacatttcaggacccg

SEQ ID NO: 267823 - DNA, 25 bp, Homo sapien
gggaaagtgaggtcatccattcttc

SEQ ID NO: 267824 - DNA, 25 bp, Homo sapien
ggcttccttctggttcaagcctgaa

SEQ ID NO: 267825 - DNA, 25 bp, Homo sapien
agcctggcctctaaatcggtgctga

SEQ ID NO: 267826 - DNA, 25 bp, Homo sapien
gcctctaaatcggtgctgagcgttt

SEQ ID NO: 267827 - DNA, 25 bp, Homo sapien
taaatcggtgctgagcgttttactc

SEQ ID NO: 267828 - DNA, 25 bp, Homo sapien
tcggtgctgagcgttttactcagta

SEQ ID NO: 267829 - DNA, 25 bp, Homo sapien
gagcgttttactcagtagacagctt

SEQ ID NO: 267830 - DNA, 25 bp, Homo sapien
tttactcagtagacagcttgggaat

SEQ ID NO: 267831 - DNA, 25 bp, Homo sapien
gatctgacagagtggctgtggacac

SEQ ID NO: 267832 - DNA, 25 bp, Homo sapien
gctgtggacactgaagcaagccata

SEQ ID NO: 267833 - DNA, 25 bp, Homo sapien
aagcaagccataccagggtggacct

SEQ ID NO: 267834 - DNA, 25 bp, Homo sapien
agccataccagggtggacctggcct

SEQ ID NO: 267835 - DNA, 25 bp, Homo sapien
tgtttagtcagcttgtctattttct

SEQ ID NO: 267836 - DNA, 25 bp, Homo sapien
tatctccctttttgtagttatgttc

SEQ ID NO: 267837 - DNA, 25 bp, Homo sapien
gtagttatgttccttaatttctgta

SEQ ID NO: 267838 - DNA, 25 bp, Homo sapien
gttttgaaattgtccaacgtgtgct

SEQ ID NO: 267839 - DNA, 25 bp, Homo sapien
gaaattgtccaacgtgtgctttgaa

SEQ ID NO: 267840 - DNA, 25 bp, Homo sapien
attgtccaacgtgtgctttgaaaaa

SEQ ID NO: 267841 - DNA, 25 bp, Homo sapien
gaagggatgttttctgtgtcaaatg

SEQ ID NO: 267842 - DNA, 25 bp, Homo sapien
aggtaatcatagatcaaatttgctt

SEQ ID NO: 267843 - DNA, 25 bp, Homo sapien
caaatttgcttattgtcttgttcaa

SEQ ID NO: 267844 - DNA, 25 bp, Homo sapien
gcttattgtcttgttcaaatcctag

SEQ ID NO: 267845 - DNA, 25 bp, Homo sapien
caaatcctagaaaaccattagcatt

SEQ ID NO: 267846 - DNA, 25 bp, Homo sapien
cagtcagtcctgagtcctgccgtca

SEQ ID NO: 267847 - DNA, 25 bp, Homo sapien
gagtcctgccgtcagactctggcag

SEQ ID NO: 267848 - DNA, 25 bp, Homo sapien
tcccagaggagcatcaactccagga

SEQ ID NO: 267849 - DNA, 25 bp, Homo sapien
caactccaggagaacagggatttct

SEQ ID NO: 267850 - DNA, 25 bp, Homo sapien
cagggatttctatcaatgtcattca

SEQ ID NO: 267851 - DNA, 25 bp, Homo sapien
atcaatgtcattcactgctgcatcc

SEQ ID NO: 267852 - DNA, 25 bp, Homo sapien
tggtaggcgcctgacagatgcttgt

SEQ ID NO: 267853 - DNA, 25 bp, Homo sapien
agatacgtcccctgcccggtgatga

SEQ ID NO: 267854 - DNA, 25 bp, Homo sapien
ggtgatgacccaccatcaactgcat

SEQ ID NO: 267855 - DNA, 25 bp, Homo sapien
atcaactgcatcctccaagctggat

SEQ ID NO: 267856 - DNA, 25 bp, Homo sapien
ctccaagctggattcctagacatct

SEQ ID NO: 267857 - DNA, 25 bp, Homo sapien
gtcttggctcttcaaattctatcag

SEQ ID NO: 267858 - DNA, 25 bp, Homo sapien
aattctatcaggctcgctctcaagt

SEQ ID NO: 267859 - DNA, 25 bp, Homo sapien
ggtttgtaccaaggctcctgaaatc

SEQ ID NO: 267860 - DNA, 25 bp, Homo sapien
gctctcaagttcttttgtgcggtga

SEQ ID NO: 267861 - DNA, 25 bp, Homo sapien
gaagtcaagaatccgtacctgctca

SEQ ID NO: 267862 - DNA, 25 bp, Homo sapien
ggagcagaatgcctgtctgactcac

SEQ ID NO: 267863 - DNA, 25 bp, Homo sapien
tgactcaccctgacagatcagctat

SEQ ID NO: 267864 - DNA, 25 bp, Homo sapien
gtagaaaattcttcaccccagaggc

SEQ ID NO: 267865 - DNA, 25 bp, Homo sapien
cagaggctttatctctcctgcaggg

SEQ ID NO: 267866 - DNA, 25 bp, Homo sapien
agcagaaatctactctttgacaaac

SEQ ID NO: 267867 - DNA, 25 bp, Homo sapien
aggatgtgagttcaagtcttggctc

SEQ ID NO: 267868 - DNA, 25 bp, Homo sapien
tcgccactagggaggccttcaccaa

SEQ ID NO: 267869 - DNA, 25 bp, Homo sapien
tagggaggccttcaccaaggtgaca

SEQ ID NO: 267870 - DNA, 25 bp, Homo sapien
ccaaggtgacagacctggaggctcg

SEQ ID NO: 267871 - DNA, 25 bp, Homo sapien
ggaggctcgggtgcacggcccggac

SEQ ID NO: 267872 - DNA, 25 bp, Homo sapien
tgcacggcccggacgcggagcacta

SEQ ID NO: 267873 - DNA, 25 bp, Homo sapien
gcccggacgcggagcactactggtc

SEQ ID NO: 267874 - DNA, 25 bp, Homo sapien
cggacgcggagcactactggtcgct

SEQ ID NO: 267875 - DNA, 25 bp, Homo sapien
acgcggagcactactggtcgctggc

SEQ ID NO: 267876 - DNA, 25 bp, Homo sapien
gagcactactggtcgctggcggcca

SEQ ID NO: 267877 - DNA, 25 bp, Homo sapien
actactggtcgctggcggccatggc

SEQ ID NO: 267878 - DNA, 25 bp, Homo sapien
cgctggcggccatggcggcgtggga

SEQ ID NO: 267879 - DNA, 25 bp, Homo sapien
ctctctgcccagtgtgctcaggtgg

SEQ ID NO: 267880 - DNA, 25 bp, Homo sapien
gggacatgaatcgagccacagagtg

SEQ ID NO: 267881 - DNA, 25 bp, Homo sapien
gaatcgagccacagagtgccctggg

SEQ ID NO: 267882 - DNA, 25 bp, Homo sapien
agctcctgcgagacgagcctttcga

SEQ ID NO: 267883 - DNA, 25 bp, Homo sapien
agacgagcctttcgagcgcagctca

SEQ ID NO: 267884 - DNA, 25 bp, Homo sapien
gagcgcagctcaggcatttggttca

SEQ ID NO: 267885 - DNA, 25 bp, Homo sapien
cagctcaggcatttggttcagggtc

SEQ ID NO: 267886 - DNA, 25 bp, Homo sapien
aggcatttggttcagggtcctactg

SEQ ID NO: 267887 - DNA, 25 bp, Homo sapien
tttggttcagggtcctactgccgga

SEQ ID NO: 267888 - DNA, 25 bp, Homo sapien
gtcctactgccggagtcgtctgagg

SEQ ID NO: 267889 - DNA, 25 bp, Homo sapien
tgccggagtcgtctgaggcctccat

SEQ ID NO: 267890 - DNA, 25 bp, Homo sapien
tgcttacaggctgcactcgccccga

SEQ ID NO: 267891 - DNA, 25 bp, Homo sapien
taccccacacgcattttccagaaat

SEQ ID NO: 267892 - DNA, 25 bp, Homo sapien
gccacccttttactaagaggagcct

SEQ ID NO: 267893 - DNA, 25 bp, Homo sapien
tttactaagaggagcctccgtcgtc

SEQ ID NO: 267894 - DNA, 25 bp, Homo sapien
taagaggagcctccgtcgtcccaac

SEQ ID NO: 267895 - DNA, 25 bp, Homo sapien
ccccttgctccgagcgggaagcttg

SEQ ID NO: 267896 - DNA, 25 bp, Homo sapien
cgggaagcttggtgcagcgcaccaa

SEQ ID NO: 267897 - DNA, 25 bp, Homo sapien
gtgcagcgcaccaaggtccggtaga

SEQ ID NO: 267898 - DNA, 25 bp, Homo sapien
tgcagcgcaccaaggtccggtagag

SEQ ID NO: 267899 - DNA, 25 bp, Homo sapien
ctccagacgtgggatcccatgttat

SEQ ID NO: 267900 - DNA, 25 bp, Homo sapien
gacgtgggatcccatgttatacttg

SEQ ID NO: 267901 - DNA, 25 bp, Homo sapien
tatattctttattgtgcctgtgtgt

SEQ ID NO: 267902 - DNA, 25 bp, Homo sapien
tctttattgtgcctgtgtgttacca

SEQ ID NO: 267903 - DNA, 25 bp, Homo sapien
ctttattgtgcctgtgtgttaccat

SEQ ID NO: 267904 - DNA, 25 bp, Homo sapien
ttattgtgcctgtgtgttaccatgc

SEQ ID NO: 267905 - DNA, 25 bp, Homo sapien
gtgtgttaccatgctaagaatgtct

SEQ ID NO: 267906 - DNA, 25 bp, Homo sapien
gtgttaccatgctaagaatgtcttt

SEQ ID NO: 267907 - DNA, 25 bp, Homo sapien
ttaccatgctaagaatgtctttgtt

SEQ ID NO: 267908 - DNA, 25 bp, Homo sapien
tgatgtattaatctgtgttttcaat

SEQ ID NO: 267909 - DNA, 25 bp, Homo sapien
tttccaagtacagttcaaataactt

SEQ ID NO: 267910 - DNA, 25 bp, Homo sapien
gtacagttcaaataacttgcatatt

SEQ ID NO: 267911 - DNA, 25 bp, Homo sapien
atggttgacaagtgttctttttgca

SEQ ID NO: 267912 - DNA, 25 bp, Homo sapien
ggcacgtttaattggctcccagcag

SEQ ID NO: 267913 - DNA, 25 bp, Homo sapien
ttgttgcctccctctagaagtgtta

SEQ ID NO: 267914 - DNA, 25 bp, Homo sapien
tctagaagtgttaccgttttcacgt

SEQ ID NO: 267915 - DNA, 25 bp, Homo sapien
tttcacgtcctattaatgtcctctg

SEQ ID NO: 267916 - DNA, 25 bp, Homo sapien
aatgtcctctggttgttaaattaca

SEQ ID NO: 267917 - DNA, 25 bp, Homo sapien
acattacagtgcactgggttccctc

SEQ ID NO: 267918 - DNA, 25 bp, Homo sapien
gggttccctcctggagtgaatacaa

SEQ ID NO: 267919 - DNA, 25 bp, Homo sapien
aaacggagggcatctacttgtattt

SEQ ID NO: 267920 - DNA, 25 bp, Homo sapien
ttgtggctttgatcaatcctgttga

SEQ ID NO: 267921 - DNA, 25 bp, Homo sapien
atcctgttgactggtgtatgtctgc

SEQ ID NO: 267922 - DNA, 25 bp, Homo sapien
gtatgtctgcgcaaacctgtttcaa

SEQ ID NO: 267923 - DNA, 25 bp, Homo sapien
atgtcagttcatgttattgtatcaa

SEQ ID NO: 267924 - DNA, 25 bp, Homo sapien
ggatacatgattatgctgtcgtgat

SEQ ID NO: 267925 - DNA, 25 bp, Homo sapien
atgctgtcgtgatatgatttctaac

SEQ ID NO: 267926 - DNA, 25 bp, Homo sapien
gatttctaacaattgtcttgtcatt

SEQ ID NO: 267927 - DNA, 25 bp, Homo sapien
gtcactatgtcataacagactttat

SEQ ID NO: 267928 - DNA, 25 bp, Homo sapien
aacagactttatattgtgccatgca

SEQ ID NO: 267929 - DNA, 25 bp, Homo sapien
tattgtgccatgcagtcctattgct

SEQ ID NO: 267930 - DNA, 25 bp, Homo sapien
atgcagtcctattgctcttttgttt

SEQ ID NO: 267931 - DNA, 25 bp, Homo sapien
gattctcattaaatacatgcatcaa

SEQ ID NO: 267932 - DNA, 25 bp, Homo sapien
catgcatcaaaatcaactgcagtta

SEQ ID NO: 267933 - DNA, 25 bp, Homo sapien
tattacatgctaactcaaacttaca

SEQ ID NO: 267934 - DNA, 25 bp, Homo sapien
ccaagtgtgttgagtactttgtact

SEQ ID NO: 267935 - DNA, 25 bp, Homo sapien
gtactttgtacttgtcttgaggaac

SEQ ID NO: 267936 - DNA, 25 bp, Homo sapien
acagtagggataagagagacctgct

SEQ ID NO: 267937 - DNA, 25 bp, Homo sapien
catagagtttacaggccaggagaat

SEQ ID NO: 267938 - DNA, 25 bp, Homo sapien
gaatgcagacatttatagatttttt

SEQ ID NO: 267939 - DNA, 25 bp, Homo sapien
aaattgtatagcattactcaaaggg

SEQ ID NO: 267940 - DNA, 25 bp, Homo sapien
aattgtaaggcatcaacctaaggtg

SEQ ID NO: 267941 - DNA, 25 bp, Homo sapien
gagtatataccaggagaacccaata

SEQ ID NO: 267942 - DNA, 25 bp, Homo sapien
ttagtggattgttaaagcctctttg

SEQ ID NO: 267943 - DNA, 25 bp, Homo sapien
aagcctctttgaaacctggaagcgg

SEQ ID NO: 267944 - DNA, 25 bp, Homo sapien
gagttagtagggagatgtcatcagt

SEQ ID NO: 267945 - DNA, 25 bp, Homo sapien
acatgtaaaatgttcaggcttttgt

SEQ ID NO: 267946 - DNA, 25 bp, Homo sapien
gttcaggcttttgtgaaatacctta

SEQ ID NO: 267947 - DNA, 25 bp, Homo sapien
gaaaaaggtttctatcatgtcctgt

SEQ ID NO: 267948 - DNA, 25 bp, Homo sapien
atcatgtcctgtttgcttttgtgca

SEQ ID NO: 267949 - DNA, 25 bp, Homo sapien
gtattttatatcttcgttgcattct

SEQ ID NO: 267950 - DNA, 25 bp, Homo sapien
tcttcgttgcattctaattttgccc

SEQ ID NO: 267951 - DNA, 25 bp, Homo sapien
ttctcactgcttgtacatttcatca

SEQ ID NO: 267952 - DNA, 25 bp, Homo sapien
acttgtataaaaactcttcagacta

SEQ ID NO: 267953 - DNA, 25 bp, Homo sapien
tcagactaaaagattgcccctaatg

SEQ ID NO: 267954 - DNA, 25 bp, Homo sapien
aagattgcccctaatgtaaataata

SEQ ID NO: 267955 - DNA, 25 bp, Homo sapien
ttatcgtgtttaattctggctttct

SEQ ID NO: 267956 - DNA, 25 bp, Homo sapien
tttctactgtctaattcattacatt

SEQ ID NO: 267957 - DNA, 25 bp, Homo sapien
cattttttcagcacattcctgtcta

SEQ ID NO: 267958 - DNA, 25 bp, Homo sapien
ttttttgtatgcaccccaatatatg

SEQ ID NO: 267959 - DNA, 25 bp, Homo sapien
gtatgcaccccaatatatgcacatt

SEQ ID NO: 267960 - DNA, 25 bp, Homo sapien
gcatatgcatgaacccacgaacaat

SEQ ID NO: 267961 - DNA, 25 bp, Homo sapien
attatgaagcatacgtaaggacaga

SEQ ID NO: 267962 - DNA, 25 bp, Homo sapien
gaaatttcaaaccaagcttgagggt

SEQ ID NO: 267963 - DNA, 25 bp, Homo sapien
aaacctgttgctaattgtgatgact

SEQ ID NO: 267964 - DNA, 25 bp, Homo sapien
ttagttactatctcaatgcataatg

SEQ ID NO: 267965 - DNA, 25 bp, Homo sapien
caatgcataatgtacagtgacgggt

SEQ ID NO: 267966 - DNA, 25 bp, Homo sapien
gtgacgggtgaagtttatcattaat

SEQ ID NO: 267967 - DNA, 25 bp, Homo sapien
attgacacacactaggcagctgact

SEQ ID NO: 267968 - DNA, 25 bp, Homo sapien
aggcagctgactccttgaatatcca

SEQ ID NO: 267969 - DNA, 25 bp, Homo sapien
gaatatccagtgtgacccataaaat

SEQ ID NO: 267970 - DNA, 25 bp, Homo sapien
aatagtctgttaataccggatctta

SEQ ID NO: 267971 - DNA, 25 bp, Homo sapien
atattcagtacgtaatttggagaca

SEQ ID NO: 267972 - DNA, 25 bp, Homo sapien
gcagtggttaatgtcttagaagtca

SEQ ID NO: 267973 - DNA, 25 bp, Homo sapien
cagaatagagcagttacctaccagt

SEQ ID NO: 267974 - DNA, 25 bp, Homo sapien
gaagtcagacttctttttcaaggtc

SEQ ID NO: 267975 - DNA, 25 bp, Homo sapien
aaggtcttcagaaccacacttgatt

SEQ ID NO: 267976 - DNA, 25 bp, Homo sapien
agaaccacacttgatttctgttttg

SEQ ID NO: 267977 - DNA, 25 bp, Homo sapien
tttgttgcagctgtaattgacacac

SEQ ID NO: 267978 - DNA, 25 bp, Homo sapien
gaggccattatagagtcctcttatt

SEQ ID NO: 267979 - DNA, 25 bp, Homo sapien
agtcctcttattggaatggattaga

SEQ ID NO: 267980 - DNA, 25 bp, Homo sapien
gaaacttaagtcattataccaggaa

SEQ ID NO: 267981 - DNA, 25 bp, Homo sapien
agtcattataccaggaaaatcattc

SEQ ID NO: 267982 - DNA, 25 bp, Homo sapien
caagagttaggtttcataatctgcc

SEQ ID NO: 267983 - DNA, 25 bp, Homo sapien
cacaggaaccagcttatgccttgat

SEQ ID NO: 267984 - DNA, 25 bp, Homo sapien
ggattacaaatacacctacatgata

SEQ ID NO: 267985 - DNA, 25 bp, Homo sapien
aaatacacctacatgataaattggg

SEQ ID NO: 267986 - DNA, 25 bp, Homo sapien
accagcttatgccttgattacgatt

SEQ ID NO: 267987 - DNA, 25 bp, Homo sapien
gcttatgccttgattacgattttaa

SEQ ID NO: 267988 - DNA, 25 bp, Homo sapien
cggcacgaggccattatagagtcct

SEQ ID NO: 267989 - DNA, 25 bp, Homo sapien
ggaagccaatgacccatttgccaat

SEQ ID NO: 267990 - DNA, 25 bp, Homo sapien
tttgccaataaagacgatcccttct

SEQ ID NO: 267991 - DNA, 25 bp, Homo sapien
gatcccttctactatgactggaaaa

SEQ ID NO: 267992 - DNA, 25 bp, Homo sapien
aaacctgcagctgagcggactgatc

SEQ ID NO: 267993 - DNA, 25 bp, Homo sapien
actgatctgcggagggctcctggcc

SEQ ID NO: 267994 - DNA, 25 bp, Homo sapien
cctggccattgctgggatcgcggca

SEQ ID NO: 267995 - DNA, 25 bp, Homo sapien
gatcgcggcagttctgagtggcaaa

SEQ ID NO: 267996 - DNA, 25 bp, Homo sapien
aagcagcacagtcctgtacctgaga

SEQ ID NO: 267997 - DNA, 25 bp, Homo sapien
agtcctgtacctgagaaggccatcc

SEQ ID NO: 267998 - DNA, 25 bp, Homo sapien
gaggaacctgcagagtcacacagtt

SEQ ID NO: 267999 - DNA, 25 bp, Homo sapien
acagttggcctgactgccttggaag

SEQ ID NO: 268000 - DNA, 25 bp, Homo sapien
gggatatcgtagtcagtaataagtg

SEQ ID NO: 268001 - DNA, 25 bp, Homo sapien
gatgagttcatttgtgagaggctct

SEQ ID NO: 268002 - DNA, 25 bp, Homo sapien
tcgacgatggcttcgctccctcaat

SEQ ID NO: 268003 - DNA, 25 bp, Homo sapien
gaatctgcagaacatgatgatcttt

SEQ ID NO: 268004 - DNA, 25 bp, Homo sapien
catgatgatcttttggaaacagggc

SEQ ID NO: 268005 - DNA, 25 bp, Homo sapien
tcttttggaaacagggcagggacgt

SEQ ID NO: 268006 - DNA, 25 bp, Homo sapien
gtgaatgagcacgtaatgtccccat

SEQ ID NO: 268007 - DNA, 25 bp, Homo sapien
gagcacgtaatgtccccatgggttt

SEQ ID NO: 268008 - DNA, 25 bp, Homo sapien
tccccatgggtttgtctttccgaag

SEQ ID NO: 268009 - DNA, 25 bp, Homo sapien
atccaaagacgtttaatgagcacct

SEQ ID NO: 268010 - DNA, 25 bp, Homo sapien
tgtgtcaggcattgtaccgggcaat

SEQ ID NO: 268011 - DNA, 25 bp, Homo sapien
tgctggtagagccacatcaccctta

SEQ ID NO: 268012 - DNA, 25 bp, Homo sapien
agccacatcacccttacatatacag

SEQ ID NO: 268013 - DNA, 25 bp, Homo sapien
ggcatcaccaggattctaaaccctc

SEQ ID NO: 268014 - DNA, 25 bp, Homo sapien
tggaggacctgcacctagccacttc

SEQ ID NO: 268015 - DNA, 25 bp, Homo sapien
acctagccacttctggtgaggagct

SEQ ID NO: 268016 - DNA, 25 bp, Homo sapien
ctagccacttctggtgaggagctgc

SEQ ID NO: 268017 - DNA, 25 bp, Homo sapien
aaggagctactgtcatctcttgaga

SEQ ID NO: 268018 - DNA, 25 bp, Homo sapien
gctactgtcatctcttgagactata

SEQ ID NO: 268019 - DNA, 25 bp, Homo sapien
gagactataaaatccctagcaatat

SEQ ID NO: 268020 - DNA, 25 bp, Homo sapien
aatccctagcaatattcattgactc

SEQ ID NO: 268021 - DNA, 25 bp, Homo sapien
gcaatattcattgactctcaaatat

SEQ ID NO: 268022 - DNA, 25 bp, Homo sapien
agacatcttgaccattcagctagaa

SEQ ID NO: 268023 - DNA, 25 bp, Homo sapien
tgaccattcagctagaaccctggca

SEQ ID NO: 268024 - DNA, 25 bp, Homo sapien
ggcagcaacagagctatttaattgt

SEQ ID NO: 268025 - DNA, 25 bp, Homo sapien
aaagctaccctgtcctcgttagtca

SEQ ID NO: 268026 - DNA, 25 bp, Homo sapien
ccctgtcctcgttagtcattgctat

SEQ ID NO: 268027 - DNA, 25 bp, Homo sapien
attgctattcaatcattccagtccc

SEQ ID NO: 268028 - DNA, 25 bp, Homo sapien
ttcaatcattccagtcccaagttat

SEQ ID NO: 268029 - DNA, 25 bp, Homo sapien
agtcccaagttatttttgtgccact

SEQ ID NO: 268030 - DNA, 25 bp, Homo sapien
ggtaactacaaactctatcctgtgt

SEQ ID NO: 268031 - DNA, 25 bp, Homo sapien
ctgtgtttgtaagaggagctgtgta

SEQ ID NO: 268032 - DNA, 25 bp, Homo sapien
taaagggacaatttacttcattatt

SEQ ID NO: 268033 - DNA, 25 bp, Homo sapien
aatgagcgcgtcatggttatgatgg

SEQ ID NO: 268034 - DNA, 25 bp, Homo sapien
tatgctgtctaaatttgccttggga

SEQ ID NO: 268035 - DNA, 25 bp, Homo sapien
atgtctgttgtgttgtttggtgtca

SEQ ID NO: 268036 - DNA, 25 bp, Homo sapien
ttggtgtcagtttctgtaacgcctt

SEQ ID NO: 268037 - DNA, 25 bp, Homo sapien
tttctgtaacgcctttctatttcaa

SEQ ID NO: 268038 - DNA, 25 bp, Homo sapien
aaatgggagtgtattgggcatctca

SEQ ID NO: 268039 - DNA, 25 bp, Homo sapien
gggcatctcagagttttcagctgaa

SEQ ID NO: 268040 - DNA, 25 bp, Homo sapien
tttgccttgggaaaccatcatggtg

SEQ ID NO: 268041 - DNA, 25 bp, Homo sapien
tgaactgaagggtctgatggtaact

SEQ ID NO: 268042 - DNA, 25 bp, Homo sapien
acttctacggcttgccttgacctag

SEQ ID NO: 268043 - DNA, 25 bp, Homo sapien
gcttgccttgacctagcaggaatga

SEQ ID NO: 268044 - DNA, 25 bp, Homo sapien
agaaatcacgtggatgcctcaagaa

SEQ ID NO: 268045 - DNA, 25 bp, Homo sapien
gatgcctcaagaaagcttatgactt

SEQ ID NO: 268046 - DNA, 25 bp, Homo sapien
cttatgacttgttctgcggtttgca

SEQ ID NO: 268047 - DNA, 25 bp, Homo sapien
gcggtttgcagaagggacccaagct

SEQ ID NO: 268048 - DNA, 25 bp, Homo sapien
gggacccaagctaaccaaggaggag

SEQ ID NO: 268049 - DNA, 25 bp, Homo sapien
acagacacgtctgagaggccctcgt

SEQ ID NO: 268050 - DNA, 25 bp, Homo sapien
gccctcgtggaggacaatagtgaac

SEQ ID NO: 268051 - DNA, 25 bp, Homo sapien
aatagtgaacatcaacgccatcctc

SEQ ID NO: 268052 - DNA, 25 bp, Homo sapien
ctgtggtggtctttattcacggcta

SEQ ID NO: 268053 - DNA, 25 bp, Homo sapien
ttattcacggctactatgcctgaac

SEQ ID NO: 268054 - DNA, 25 bp, Homo sapien
atgcctgaactctatctgagccatt

SEQ ID NO: 268055 - DNA, 25 bp, Homo sapien
aaggtctagcacctatcttcagagg

SEQ ID NO: 268056 - DNA, 25 bp, Homo sapien
acacttgtgaccataggaatatagc

SEQ ID NO: 268057 - DNA, 25 bp, Homo sapien
gtgctcagatggtgggatgaattcc

SEQ ID NO: 268058 - DNA, 25 bp, Homo sapien
attcctgaattattgttggctctag

SEQ ID NO: 268059 - DNA, 25 bp, Homo sapien
ggctctagtagtttcttcagatcaa

SEQ ID NO: 268060 - DNA, 25 bp, Homo sapien
aaattaggtctcagaatggcagttg

SEQ ID NO: 268061 - DNA, 25 bp, Homo sapien
tggcagttggccacccaatgtgtat

SEQ ID NO: 268062 - DNA, 25 bp, Homo sapien
atacaattactcaaccagctgcttg

SEQ ID NO: 268063 - DNA, 25 bp, Homo sapien
gtcttaacttgacttttcctgtcat

SEQ ID NO: 268064 - DNA, 25 bp, Homo sapien
gtcatttgctgccattgtttgccaa

SEQ ID NO: 268065 - DNA, 25 bp, Homo sapien
attgtttgccaaaggtctagcacct

SEQ ID NO: 268066 - DNA, 25 bp, Homo sapien
tcgccactagggaggccttcaccaa

SEQ ID NO: 268067 - DNA, 25 bp, Homo sapien
ggaggctcgggtgcacggcccggac

SEQ ID NO: 268068 - DNA, 25 bp, Homo sapien
gaggctcgggtgcacggcccggacg

SEQ ID NO: 268069 - DNA, 25 bp, Homo sapien
tgcacggcccggacgcggagcacta

SEQ ID NO: 268070 - DNA, 25 bp, Homo sapien
gcccggacgcggagcactactggtc

SEQ ID NO: 268071 - DNA, 25 bp, Homo sapien
cggacgcggagcactactggtcgct

SEQ ID NO: 268072 - DNA, 25 bp, Homo sapien
ggacgcggagcactactggtcgctg

SEQ ID NO: 268073 - DNA, 25 bp, Homo sapien
acgcggagcactactggtcgctggc

SEQ ID NO: 268074 - DNA, 25 bp, Homo sapien
cgcggagcactactggtcgctggcg

SEQ ID NO: 268075 - DNA, 25 bp, Homo sapien
gcggagcactactggtcgctggcgg

SEQ ID NO: 268076 - DNA, 25 bp, Homo sapien
cggagcactactggtcgctggcggc

SEQ ID NO: 268077 - DNA, 25 bp, Homo sapien
gctagtgcctgagattttggatttc

SEQ ID NO: 268078 - DNA, 25 bp, Homo sapien
atttctgagtcccaggaggtgctga

SEQ ID NO: 268079 - DNA, 25 bp, Homo sapien
ggaggtgctgatatcatttatctgc

SEQ ID NO: 268080 - DNA, 25 bp, Homo sapien
atatcatttatctgcggactcgtat

SEQ ID NO: 268081 - DNA, 25 bp, Homo sapien
atctgcggactcgtattatgaagcg

SEQ ID NO: 268082 - DNA, 25 bp, Homo sapien
tcgtattatgaagcgcaaggtccta

SEQ ID NO: 268083 - DNA, 25 bp, Homo sapien
gcaaggtcctagagcgtgtgatttt

SEQ ID NO: 268084 - DNA, 25 bp, Homo sapien
gagcgtgtgattttacaggcataag

SEQ ID NO: 268085 - DNA, 25 bp, Homo sapien
aataggatgggtggcctaattttct

SEQ ID NO: 268086 - DNA, 25 bp, Homo sapien
catacacatacaacctgacaactaa

SEQ ID NO: 268087 - DNA, 25 bp, Homo sapien
acaacttttggagctagtgcctgag

SEQ ID NO: 268088 - DNA, 25 bp, Homo sapien
acgtgtgtccgtgtatgcatttatg

SEQ ID NO: 268089 - DNA, 25 bp, Homo sapien
gcatttatgcatgagtacgtgttca

SEQ ID NO: 268090 - DNA, 25 bp, Homo sapien
gttcatgcatgtatgtcagtcgata

SEQ ID NO: 268091 - DNA, 25 bp, Homo sapien
gtcgatactgtcctgttaacacatg

SEQ ID NO: 268092 - DNA, 25 bp, Homo sapien
agaaaaccaggcctagacactacgt

SEQ ID NO: 268093 - DNA, 25 bp, Homo sapien
tagacactacgtctctggcctgtgg

SEQ ID NO: 268094 - DNA, 25 bp, Homo sapien
agccaaattagagctggccagtcca

SEQ ID NO: 268095 - DNA, 25 bp, Homo sapien
tggccagtccaggtttgagcccagt

SEQ ID NO: 268096 - DNA, 25 bp, Homo sapien
ttgcctgctggtgagaagctcaaaa

SEQ ID NO: 268097 - DNA, 25 bp, Homo sapien
gcacgatcggtgaagcaggctttga

SEQ ID NO: 268098 - DNA, 25 bp, Homo sapien
agcgtttgtgttggttttgcttcca

SEQ ID NO: 268099 - DNA, 25 bp, Homo sapien
tctctctttttctctaggtattccc

SEQ ID NO: 268100 - DNA, 25 bp, Homo sapien
taggtattccctagtgctttcatcg

SEQ ID NO: 268101 - DNA, 25 bp, Homo sapien
gtattccctagtgctttcatcgtaa

SEQ ID NO: 268102 - DNA, 25 bp, Homo sapien
ttccctagtgctttcatcgtaaaat

SEQ ID NO: 268103 - DNA, 25 bp, Homo sapien
gctttcatcgtaaaataggattcta

SEQ ID NO: 268104 - DNA, 25 bp, Homo sapien
aggattctaacaactattaatgtat

SEQ ID NO: 268105 - DNA, 25 bp, Homo sapien
gggagatttgggttggccagcagct

SEQ ID NO: 268106 - DNA, 25 bp, Homo sapien
agcagcttctgacccttgttgttag

SEQ ID NO: 268107 - DNA, 25 bp, Homo sapien
cttctgacccttgttgttagtgtgt

SEQ ID NO: 268108 - DNA, 25 bp, Homo sapien
tagtgtgtgggccttcctttgttct

SEQ ID NO: 268109 - DNA, 25 bp, Homo sapien
tcacctcccaaaggtacttttagca

SEQ ID NO: 268110 - DNA, 25 bp, Homo sapien
gcagcgggaacagcacgaagagtga

SEQ ID NO: 268111 - DNA, 25 bp, Homo sapien
aacagcacgaagagtgagctgtcgt

SEQ ID NO: 268112 - DNA, 25 bp, Homo sapien
acagcacgaagagtgagctgtcgtt

SEQ ID NO: 268113 - DNA, 25 bp, Homo sapien
cagcacgaagagtgagctgtcgttg

SEQ ID NO: 268114 - DNA, 25 bp, Homo sapien
aagagtgagctgtcgttggcgtcca

SEQ ID NO: 268115 - DNA, 25 bp, Homo sapien
tcagcgccgtggagccgcggtctga

SEQ ID NO: 268116 - DNA, 25 bp, Homo sapien
cagcgccgtggagccgcggtctgaa

SEQ ID NO: 268117 - DNA, 25 bp, Homo sapien
gtggagccgcggtctgaagcgccca

SEQ ID NO: 268118 - DNA, 25 bp, Homo sapien
ggagccgcggtctgaagcgcccacg

SEQ ID NO: 268119 - DNA, 25 bp, Homo sapien
cagcgacctgagggcgaacagaatc

SEQ ID NO: 268120 - DNA, 25 bp, Homo sapien
cgacctgagggcgaacagaatcgcg

SEQ ID NO: 268121 - DNA, 25 bp, Homo sapien
cagtgagaaatacggagatggatac

SEQ ID NO: 268122 - DNA, 25 bp, Homo sapien
agatggatacagaatggcatttaca

SEQ ID NO: 268123 - DNA, 25 bp, Homo sapien
gaatggcatttacatgttcattttg

SEQ ID NO: 268124 - DNA, 25 bp, Homo sapien
tcattttgtaaatttcgaacatttg

SEQ ID NO: 268125 - DNA, 25 bp, Homo sapien
aaagatattgaactgcatctggaaa

SEQ ID NO: 268126 - DNA, 25 bp, Homo sapien
actgcatctggaaagttcttcacat

SEQ ID NO: 268127 - DNA, 25 bp, Homo sapien
gcatctggaaagttcttcacatcag

SEQ ID NO: 268128 - DNA, 25 bp, Homo sapien
tctggaaagttcttcacatcaggaa

SEQ ID NO: 268129 - DNA, 25 bp, Homo sapien
ggaaagttcttcacatcaggaaaca

SEQ ID NO: 268130 - DNA, 25 bp, Homo sapien
gttcttcacatcaggaaacattaga

SEQ ID NO: 268131 - DNA, 25 bp, Homo sapien
ggaaacattagatcatatacagaaa

SEQ ID NO: 268132 - DNA, 25 bp, Homo sapien
aagtccaaccataattccaagctcc

SEQ ID NO: 268133 - DNA, 25 bp, Homo sapien
tgatttactcaaggcctccaatggg

SEQ ID NO: 268134 - DNA, 25 bp, Homo sapien
aattccccagatgaactccaaagct

SEQ ID NO: 268135 - DNA, 25 bp, Homo sapien
aggtcatactccaggtccccaaaga

SEQ ID NO: 268136 - DNA, 25 bp, Homo sapien
caaatcctaagagcccacctggaag

SEQ ID NO: 268137 - DNA, 25 bp, Homo sapien
cctggaagtccacgtatgctagaac

SEQ ID NO: 268138 - DNA, 25 bp, Homo sapien
gtatgctagaactctgggcagggcc

SEQ ID NO: 268139 - DNA, 25 bp, Homo sapien
gcagggcctaatctagctgaggtcc

SEQ ID NO: 268140 - DNA, 25 bp, Homo sapien
ctccaatgggctgtgtcctgaaatc

SEQ ID NO: 268141 - DNA, 25 bp, Homo sapien
tcctgaaatcttaggcaagccccat

SEQ ID NO: 268142 - DNA, 25 bp, Homo sapien
aagccccatgatccagacagtcaga

SEQ ID NO: 268143 - DNA, 25 bp, Homo sapien
tttctctctgcctgatgtctactga

SEQ ID NO: 268144 - DNA, 25 bp, Homo sapien
tgatgtctactgaacagaacttccc

SEQ ID NO: 268145 - DNA, 25 bp, Homo sapien
tgagagctgcttcccaatggcctgc

SEQ ID NO: 268146 - DNA, 25 bp, Homo sapien
aatggcctgcattaaagcattcgta

SEQ ID NO: 268147 - DNA, 25 bp, Homo sapien
atgcacccctcttcctgagcttggt

SEQ ID NO: 268148 - DNA, 25 bp, Homo sapien
tgagcttggtccctgcctggtgatt

SEQ ID NO: 268149 - DNA, 25 bp, Homo sapien
tgcctggtgattcttcttatactcg

SEQ ID NO: 268150 - DNA, 25 bp, Homo sapien
gtgattcttcttatactcggagagc

SEQ ID NO: 268151 - DNA, 25 bp, Homo sapien
ttatactcggagagcatccctggtt

SEQ ID NO: 268152 - DNA, 25 bp, Homo sapien
gagcatccctggttgaggagacacc

SEQ ID NO: 268153 - DNA, 25 bp, Homo sapien
tggttgaggagacacccgcaatcct

SEQ ID NO: 268154 - DNA, 25 bp, Homo sapien
taagggttacacacatgaggcaact

SEQ ID NO: 268155 - DNA, 25 bp, Homo sapien
atgaggcaactacaatccagaggaa

SEQ ID NO: 268156 - DNA, 25 bp, Homo sapien
gaatttgtgactatcctcagaggcc

SEQ ID NO: 268157 - DNA, 25 bp, Homo sapien
tcctcagaggccacagccattgatg

SEQ ID NO: 268158 - DNA, 25 bp, Homo sapien
agccattgatgcctctttcactctg

SEQ ID NO: 268159 - DNA, 25 bp, Homo sapien
ccattatgtcccactgaacagcttg

SEQ ID NO: 268160 - DNA, 25 bp, Homo sapien
acagcttgggtgtcagagccagcca

SEQ ID NO: 268161 - DNA, 25 bp, Homo sapien
attggacctggttgcattttctagt

SEQ ID NO: 268162 - DNA, 25 bp, Homo sapien
ttctagtctctgctttctccaaata

SEQ ID NO: 268163 - DNA, 25 bp, Homo sapien
ttctccaaatatcccagtacttagt

SEQ ID NO: 268164 - DNA, 25 bp, Homo sapien
agtacttagtttttgctctggttga

SEQ ID NO: 268165 - DNA, 25 bp, Homo sapien
ctgtggattcaacccagaggtctgt

SEQ ID NO: 268166 - DNA, 25 bp, Homo sapien
tgcaagcaggctagacaaggtgtgt

SEQ ID NO: 268167 - DNA, 25 bp, Homo sapien
aggtgtgtgcttgcaccccttcctt

SEQ ID NO: 268168 - DNA, 25 bp, Homo sapien
ttactacctaggcacagtgttggat

SEQ ID NO: 268169 - DNA, 25 bp, Homo sapien
agtgttggatggtcagtgcttcctg

SEQ ID NO: 268170 - DNA, 25 bp, Homo sapien
tcctgttttgtgatggccatgtgcc

SEQ ID NO: 268171 - DNA, 25 bp, Homo sapien
ttgcagtcccagtgaacccctgaaa

SEQ ID NO: 268172 - DNA, 25 bp, Homo sapien
agggtccccaggtcagtcctgagga

SEQ ID NO: 268173 - DNA, 25 bp, Homo sapien
gagaaggcagctcagtctttactgt

SEQ ID NO: 268174 - DNA, 25 bp, Homo sapien
gtctttactgtgatgcagcctctag

SEQ ID NO: 268175 - DNA, 25 bp, Homo sapien
tagtgatccccaggtcctgagtaga

SEQ ID NO: 268176 - DNA, 25 bp, Homo sapien
ccacatagctttcctagactctatt

SEQ ID NO: 268177 - DNA, 25 bp, Homo sapien
agactctattcataagtgccttact

SEQ ID NO: 268178 - DNA, 25 bp, Homo sapien
tcataagtgccttactgccttatct

SEQ ID NO: 268179 - DNA, 25 bp, Homo sapien
tgccttatcttcctctccgagtatg

SEQ ID NO: 268180 - DNA, 25 bp, Homo sapien
ctccgagtatgctgcaaaccccagt

SEQ ID NO: 268181 - DNA, 25 bp, Homo sapien
cccagtcctgtgtcagttcagctgt

SEQ ID NO: 268182 - DNA, 25 bp, Homo sapien
gtgaacacatctttgatcatataat

SEQ ID NO: 268183 - DNA, 25 bp, Homo sapien
caaatactacctcacattcagcaga

SEQ ID NO: 268184 - DNA, 25 bp, Homo sapien
tcagcagatgactttccttcctaat

SEQ ID NO: 268185 - DNA, 25 bp, Homo sapien
tttttatgtatctcatcagctcact

SEQ ID NO: 268186 - DNA, 25 bp, Homo sapien
ttttagtttctcttcccacatagct

SEQ ID NO: 268187 - DNA, 25 bp, Homo sapien
gttaatattagttctgacctttggg

SEQ ID NO: 268188 - DNA, 25 bp, Homo sapien
ccatttacactgaagatcgatctga

SEQ ID NO: 268189 - DNA, 25 bp, Homo sapien
gaacacatggttggactgaagagaa

SEQ ID NO: 268190 - DNA, 25 bp, Homo sapien
aaaggcttctggtggctcaggaacg

SEQ ID NO: 268191 - DNA, 25 bp, Homo sapien
ggctcaggaacgtctttggcaacta

SEQ ID NO: 268192 - DNA, 25 bp, Homo sapien
gtctttggcaactacaacagctgat

SEQ ID NO: 268193 - DNA, 25 bp, Homo sapien
gctgatatttcaacagagcacatac

SEQ ID NO: 268194 - DNA, 25 bp, Homo sapien
tgcctgtctccatggctggttttaa

SEQ ID NO: 268195 - DNA, 25 bp, Homo sapien
tctccatggctggttttaatttccc

SEQ ID NO: 268196 - DNA, 25 bp, Homo sapien
ttttaatttccccattctgcagtgg

SEQ ID NO: 268197 - DNA, 25 bp, Homo sapien
cccattctgcagtggcttgttaata

SEQ ID NO: 268198 - DNA, 25 bp, Homo sapien
attctgctgccacaagtaattccta

SEQ ID NO: 268199 - DNA, 25 bp, Homo sapien
ttctgctgccacaagtaattcctag

SEQ ID NO: 268200 - DNA, 25 bp, Homo sapien
ctgctgccacaagtaattcctagta

SEQ ID NO: 268201 - DNA, 25 bp, Homo sapien
ctgccacaagtaattcctagtaaga

SEQ ID NO: 268202 - DNA, 25 bp, Homo sapien
gccacaagtaattcctagtaagatt

SEQ ID NO: 268203 - DNA, 25 bp, Homo sapien
acaagtaattcctagtaagattggc

SEQ ID NO: 268204 - DNA, 25 bp, Homo sapien
ttttacaggagcactttggccttat

SEQ ID NO: 268205 - DNA, 25 bp, Homo sapien
gcactttggccttatttttatactg

SEQ ID NO: 268206 - DNA, 25 bp, Homo sapien
ttctacagtaacagattctgaatga

SEQ ID NO: 268207 - DNA, 25 bp, Homo sapien
attagaagactcagtttctttcacc

SEQ ID NO: 268208 - DNA, 25 bp, Homo sapien
gaagactcagtttctttcacctagt

SEQ ID NO: 268209 - DNA, 25 bp, Homo sapien
gtagcaaaacctatttatgccagtt

SEQ ID NO: 268210 - DNA, 25 bp, Homo sapien
atttatgccagtttacctgctataa

SEQ ID NO: 268211 - DNA, 25 bp, Homo sapien
gccagtttacctgctataattattt

SEQ ID NO: 268212 - DNA, 25 bp, Homo sapien
acctgctataattatttccaacgaa

SEQ ID NO: 268213 - DNA, 25 bp, Homo sapien
gaatactgtttctatgaaaccaaat

SEQ ID NO: 268214 - DNA, 25 bp, Homo sapien
ttgggagttcaacggttcttcttgg

SEQ ID NO: 268215 - DNA, 25 bp, Homo sapien
ttcttcttgggtacgtccgagtata

SEQ ID NO: 268216 - DNA, 25 bp, Homo sapien
gggtacgtccgagtatacttctagc

SEQ ID NO: 268217 - DNA, 25 bp, Homo sapien
acgtccgagtatacttctagcagtt

SEQ ID NO: 268218 - DNA, 25 bp, Homo sapien
gctgtatgtgtagtcactaagagtc

SEQ ID NO: 268219 - DNA, 25 bp, Homo sapien
gtgtagtcactaagagtcaggtatg

SEQ ID NO: 268220 - DNA, 25 bp, Homo sapien
tgaggtggccagacgtccagtatca

SEQ ID NO: 268221 - DNA, 25 bp, Homo sapien
cagtatcagatcttgggcggccgga

SEQ ID NO: 268222 - DNA, 25 bp, Homo sapien
aaaccagatcattttcggccacaat

SEQ ID NO: 268223 - DNA, 25 bp, Homo sapien
ggccacaatggcttttatgtcttct

SEQ ID NO: 268224 - DNA, 25 bp, Homo sapien
tgtcttctacatttcgatcgtggat

SEQ ID NO: 268225 - DNA, 25 bp, Homo sapien
gatcgtggatccgtactacagctac

SEQ ID NO: 268226 - DNA, 25 bp, Homo sapien
gctactgtcaactggagaccatctt

SEQ ID NO: 268227 - DNA, 25 bp, Homo sapien
catctacgtgtatggagcattcccc

SEQ ID NO: 268228 - DNA, 25 bp, Homo sapien
agctggtctctgctggagtcgtcat

SEQ ID NO: 268229 - DNA, 25 bp, Homo sapien
ggagtcgtcatcctactgatcatct

SEQ ID NO: 268230 - DNA, 25 bp, Homo sapien
agctccccgcttctaaactatgtga

SEQ ID NO: 268231 - DNA, 25 bp, Homo sapien
gcctggtttaaaactgcatttccca

SEQ ID NO: 268232 - DNA, 25 bp, Homo sapien
tttcccaatgatgattatgttctct

SEQ ID NO: 268233 - DNA, 25 bp, Homo sapien
gagccccatctgagcgcacacatgt

SEQ ID NO: 268234 - DNA, 25 bp, Homo sapien
tgagcgcacacatgtgtggtgctct

SEQ ID NO: 268235 - DNA, 25 bp, Homo sapien
gggcacagcctcaaatataatacaa

SEQ ID NO: 268236 - DNA, 25 bp, Homo sapien
caatatttccaacatcgtgtccttg

SEQ ID NO: 268237 - DNA, 25 bp, Homo sapien
aacatcgtgtccttggaatacagat

SEQ ID NO: 268238 - DNA, 25 bp, Homo sapien
tttctatgtttttctaagctttctc

SEQ ID NO: 268239 - DNA, 25 bp, Homo sapien
gtttttctaagctttctctaatgag

SEQ ID NO: 268240 - DNA, 25 bp, Homo sapien
ttctctaatgagcatgcactactgt

SEQ ID NO: 268241 - DNA, 25 bp, Homo sapien
tgagcatgcactactgtaataaaca

SEQ ID NO: 268242 - DNA, 25 bp, Homo sapien
tcaggacacctcagttctctgtgtt

SEQ ID NO: 268243 - DNA, 25 bp, Homo sapien
caggacacctcagttctctgtgttt

SEQ ID NO: 268244 - DNA, 25 bp, Homo sapien
aggacacctcagttctctgtgtttt

SEQ ID NO: 268245 - DNA, 25 bp, Homo sapien
ggacacctcagttctctgtgttttt

SEQ ID NO: 268246 - DNA, 25 bp, Homo sapien
gacacctcagttctctgtgttttta

SEQ ID NO: 268247 - DNA, 25 bp, Homo sapien
acacctcagttctctgtgtttttaa

SEQ ID NO: 268248 - DNA, 25 bp, Homo sapien
cctcagttctctgtgtttttaagaa

SEQ ID NO: 268249 - DNA, 25 bp, Homo sapien
tctctgtgtttttaagaagggtcgg

SEQ ID NO: 268250 - DNA, 25 bp, Homo sapien
tagctgggagtgttgccgtggcctg

SEQ ID NO: 268251 - DNA, 25 bp, Homo sapien
ggagtgttgccgtggcctgtagtcc

SEQ ID NO: 268252 - DNA, 25 bp, Homo sapien
caagagaattgcttgctcaaacccg

SEQ ID NO: 268253 - DNA, 25 bp, Homo sapien
aatcctgtgcaatacttagtcatat

SEQ ID NO: 268254 - DNA, 25 bp, Homo sapien
tagtcatataagcagttccttcatg

SEQ ID NO: 268255 - DNA, 25 bp, Homo sapien
ttccttcatgaagttattggttcac

SEQ ID NO: 268256 - DNA, 25 bp, Homo sapien
attggttcacaactatggaatggat

SEQ ID NO: 268257 - DNA, 25 bp, Homo sapien
tggatggaaccatttagggaaattc

SEQ ID NO: 268258 - DNA, 25 bp, Homo sapien
ggaaattcctgccatgactgttttt

SEQ ID NO: 268259 - DNA, 25 bp, Homo sapien
ggaaacatccaaacacaatcataat

SEQ ID NO: 268260 - DNA, 25 bp, Homo sapien
atatttctgagattcgttctgacac

SEQ ID NO: 268261 - DNA, 25 bp, Homo sapien
gttctgacactaaaactgcaccacc

SEQ ID NO: 268262 - DNA, 25 bp, Homo sapien
aactgcaccaccaatgtggtctaaa

SEQ ID NO: 268263 - DNA, 25 bp, Homo sapien
gtggtctaaatacagaacactagca

SEQ ID NO: 268264 - DNA, 25 bp, Homo sapien
gatttggaaccacttcagatcaact

SEQ ID NO: 268265 - DNA, 25 bp, Homo sapien
tttggaaccacttcagatcaactcg

SEQ ID NO: 268266 - DNA, 25 bp, Homo sapien
ttggaaccacttcagatcaactcgt

SEQ ID NO: 268267 - DNA, 25 bp, Homo sapien
tggaaccacttcagatcaactcgtt

SEQ ID NO: 268268 - DNA, 25 bp, Homo sapien
ggaaccacttcagatcaactcgttt

SEQ ID NO: 268269 - DNA, 25 bp, Homo sapien
gaaccacttcagatcaactcgtttt

SEQ ID NO: 268270 - DNA, 25 bp, Homo sapien
accacttcagatcaactcgttttta

SEQ ID NO: 268271 - DNA, 25 bp, Homo sapien
actcgtttttataatggtgttgttg

SEQ ID NO: 268272 - DNA, 25 bp, Homo sapien
tttttccttggtccacaggtaggtg

SEQ ID NO: 268273 - DNA, 25 bp, Homo sapien
ttttccttggtccacaggtaggtgt

SEQ ID NO: 268274 - DNA, 25 bp, Homo sapien
tttccttggtccacaggtaggtgtc

SEQ ID NO: 268275 - DNA, 25 bp, Homo sapien
tgggaaacagtcttttgccccacaa

SEQ ID NO: 268276 - DNA, 25 bp, Homo sapien
tttgccccacaacctttgtagacgg

SEQ ID NO: 268277 - DNA, 25 bp, Homo sapien
caacctttgtagacggcctagtgaa

SEQ ID NO: 268278 - DNA, 25 bp, Homo sapien
gcctagtgaataagcctttccagag

SEQ ID NO: 268279 - DNA, 25 bp, Homo sapien
aaaaatctgcctgggctctcaaccg

SEQ ID NO: 268280 - DNA, 25 bp, Homo sapien
tcaaccgctggtttaccacactgga

SEQ ID NO: 268281 - DNA, 25 bp, Homo sapien
tttaccacactggatccgtgcgtca

SEQ ID NO: 268282 - DNA, 25 bp, Homo sapien
gtgcgtcaccgagcatgcacaatgc

SEQ ID NO: 268283 - DNA, 25 bp, Homo sapien
aatgcctgtggtttaattcgccttc

SEQ ID NO: 268284 - DNA, 25 bp, Homo sapien
ttaattcgccttcttagtcaacagc

SEQ ID NO: 268285 - DNA, 25 bp, Homo sapien
gaatgtcgccaagctgaacctcaga

SEQ ID NO: 268286 - DNA, 25 bp, Homo sapien
acatggccatggttatgaaccagga

SEQ ID NO: 268287 - DNA, 25 bp, Homo sapien
tcagaaaaacggttgttggatctaa

SEQ ID NO: 268288 - DNA, 25 bp, Homo sapien
ggaatcagtacaagacctcatagaa

SEQ ID NO: 268289 - DNA, 25 bp, Homo sapien
taggatgactcatggttctgtgcct

SEQ ID NO: 268290 - DNA, 25 bp, Homo sapien
tctgtgcctcctagaacaatgttca

SEQ ID NO: 268291 - DNA, 25 bp, Homo sapien
ttcaatatgactaacctgccaccaa

SEQ ID NO: 268292 - DNA, 25 bp, Homo sapien
ctgccaccaaattaaatgtttgctc

SEQ ID NO: 268293 - DNA, 25 bp, Homo sapien
atgtttgctccaggatggtcagtaa

SEQ ID NO: 268294 - DNA, 25 bp, Homo sapien
gtaagacaggcttggattttctaat

SEQ ID NO: 268295 - DNA, 25 bp, Homo sapien
gagattcaggaatactgggccatca

SEQ ID NO: 268296 - DNA, 25 bp, Homo sapien
gaatactgggccatcagggattata

SEQ ID NO: 268297 - DNA, 25 bp, Homo sapien
aagctacctgaaagtcctaacgagt

SEQ ID NO: 268298 - DNA, 25 bp, Homo sapien
gaaagctgtaaagtgagtccccatt

SEQ ID NO: 268299 - DNA, 25 bp, Homo sapien
gagtccccattttcaaggtgcaagg

SEQ ID NO: 268300 - DNA, 25 bp, Homo sapien
aaggtgcaagggtcaggtactgtaa

SEQ ID NO: 268301 - DNA, 25 bp, Homo sapien
aatagtttttctggcctgaggaact

SEQ ID NO: 268302 - DNA, 25 bp, Homo sapien
tggcctgaggaactagaacactgaa

SEQ ID NO: 268303 - DNA, 25 bp, Homo sapien
gaaaaccacagcctttggccaaggg

SEQ ID NO: 268304 - DNA, 25 bp, Homo sapien
agacccaaattctgtctactcacat

SEQ ID NO: 268305 - DNA, 25 bp, Homo sapien
aaattctgtctactcacatctttgg

SEQ ID NO: 268306 - DNA, 25 bp, Homo sapien
tcacatctttggctaaccactgagt

SEQ ID NO: 268307 - DNA, 25 bp, Homo sapien
tttggctaaccactgagtcacacat

SEQ ID NO: 268308 - DNA, 25 bp, Homo sapien
agtcactaacctgcccaggcgagtt

SEQ ID NO: 268309 - DNA, 25 bp, Homo sapien
tgcccaattaccctagttctctgac

SEQ ID NO: 268310 - DNA, 25 bp, Homo sapien
ctagttctctgaccctccaggactg

SEQ ID NO: 268311 - DNA, 25 bp, Homo sapien
cagagcaagatcttcactgcgcctt

SEQ ID NO: 268312 - DNA, 25 bp, Homo sapien
ttcactcccagtgttctttgcatgg

SEQ ID NO: 268313 - DNA, 25 bp, Homo sapien
agtgttctttgcatggcctcagcat

SEQ ID NO: 268314 - DNA, 25 bp, Homo sapien
ggcctcagcatttattggagccgct

SEQ ID NO: 268315 - DNA, 25 bp, Homo sapien
tattggagccgctgtctgattcatt

SEQ ID NO: 268316 - DNA, 25 bp, Homo sapien
gccgctgtctgattcattttggatt

SEQ ID NO: 268317 - DNA, 25 bp, Homo sapien
tggattcatctcgtgcactgtgcaa

SEQ ID NO: 268318 - DNA, 25 bp, Homo sapien
aacacagattccaactgtgatgcat

SEQ ID NO: 268319 - DNA, 25 bp, Homo sapien
tcatccagcaaatcacctaaaaagt

SEQ ID NO: 268320 - DNA, 25 bp, Homo sapien
aaaagcctagctccagtttcagatc

SEQ ID NO: 268321 - DNA, 25 bp, Homo sapien
tcccctacctttctgaacactagtt

SEQ ID NO: 268322 - DNA, 25 bp, Homo sapien
ttctgaacactagtttcttcctctg

SEQ ID NO: 268323 - DNA, 25 bp, Homo sapien
gggcacaagaatcgcaagtcccttc

SEQ ID NO: 268324 - DNA, 25 bp, Homo sapien
tatgacgctgcaagactctaggtac

SEQ ID NO: 268325 - DNA, 25 bp, Homo sapien
gactctaggtacagtttaggactcc

SEQ ID NO: 268326 - DNA, 25 bp, Homo sapien
cagtttaggactccgggcattcaga

SEQ ID NO: 268327 - DNA, 25 bp, Homo sapien
agatccccgggacttgtcaagttct

SEQ ID NO: 268328 - DNA, 25 bp, Homo sapien
catttttgatatttcgtgacaacac

SEQ ID NO: 268329 - DNA, 25 bp, Homo sapien
catcacatttttgtgctgtgtgtta

SEQ ID NO: 268330 - DNA, 25 bp, Homo sapien
aattgtgcttcttttatttcctaat

SEQ ID NO: 268331 - DNA, 25 bp, Homo sapien
taattgtcttagttttgtttgtctt

SEQ ID NO: 268332 - DNA, 25 bp, Homo sapien
gtcttattatgtgtatttcagctgt

SEQ ID NO: 268333 - DNA, 25 bp, Homo sapien
gtgtatttcagctgtgtatgcatca

SEQ ID NO: 268334 - DNA, 25 bp, Homo sapien
tcagctgtgtatgcatcacagccct

SEQ ID NO: 268335 - DNA, 25 bp, Homo sapien
atcacagccctcctttttgctgtgc

SEQ ID NO: 268336 - DNA, 25 bp, Homo sapien
gttctcttcacaccatgtcatttca

SEQ ID NO: 268337 - DNA, 25 bp, Homo sapien
tcacatggtatattgtaggttttga

SEQ ID NO: 268338 - DNA, 25 bp, Homo sapien
aatgcactgcaagattggttttaac

SEQ ID NO: 268339 - DNA, 25 bp, Homo sapien
ctgcaagattggttttaactggaga

SEQ ID NO: 268340 - DNA, 25 bp, Homo sapien
ttttcaggtgcaaaagctcagtttt

SEQ ID NO: 268341 - DNA, 25 bp, Homo sapien
gaatttcccttatcaactttctcga

SEQ ID NO: 268342 - DNA, 25 bp, Homo sapien
ttatcaactttctcgaccatctttc

SEQ ID NO: 268343 - DNA, 25 bp, Homo sapien
ttctcgaccatctttctctggtggt

SEQ ID NO: 268344 - DNA, 25 bp, Homo sapien
atctttctctggtggtgcggaccct

SEQ ID NO: 268345 - DNA, 25 bp, Homo sapien
gggcgaggtctaaccttgcgtctcc

SEQ ID NO: 268346 - DNA, 25 bp, Homo sapien
ttgcgtctcctcctaggcagtgcat

SEQ ID NO: 268347 - DNA, 25 bp, Homo sapien
taggcagtgcatccatcctccctag

SEQ ID NO: 268348 - DNA, 25 bp, Homo sapien
agtgcatccatcctccctagggcag

SEQ ID NO: 268349 - DNA, 25 bp, Homo sapien
gagggcctcatggtcggcctgtact

SEQ ID NO: 268350 - DNA, 25 bp, Homo sapien
atggtcggcctgtactgcctttgtg

SEQ ID NO: 268351 - DNA, 25 bp, Homo sapien
ctgtactgcctttgtgtgctcaggg

SEQ ID NO: 268352 - DNA, 25 bp, Homo sapien
tctacacattttgccaggtcaggca

SEQ ID NO: 268353 - DNA, 25 bp, Homo sapien
tagtaagcaggatgcccccaactct

SEQ ID NO: 268354 - DNA, 25 bp, Homo sapien
gggaaggagcttgctctgacgtcac

SEQ ID NO: 268355 - DNA, 25 bp, Homo sapien
aaggagcttgctctgacgtcaccct

SEQ ID NO: 268356 - DNA, 25 bp, Homo sapien
tgactcctgtcctgagagctgtgga

SEQ ID NO: 268357 - DNA, 25 bp, Homo sapien
tgagagctgtggatgccgcctcctg

SEQ ID NO: 268358 - DNA, 25 bp, Homo sapien
gcatcaggacttttgagtccagctg

SEQ ID NO: 268359 - DNA, 25 bp, Homo sapien
gacttttgagtccagctgccagcaa

SEQ ID NO: 268360 - DNA, 25 bp, Homo sapien
ttgagtccagctgccagcaatggtt

SEQ ID NO: 268361 - DNA, 25 bp, Homo sapien
tgccagcaatggttccaactcggag

SEQ ID NO: 268362 - DNA, 25 bp, Homo sapien
aatggttccaactcggaggcagcgc

SEQ ID NO: 268363 - DNA, 25 bp, Homo sapien
gatggcaacaacatgggctgagact

SEQ ID NO: 268364 - DNA, 25 bp, Homo sapien
tgggctgagacttgaccttgtgact

SEQ ID NO: 268365 - DNA, 25 bp, Homo sapien
tgagacttgaccttgtgactccagc

SEQ ID NO: 268366 - DNA, 25 bp, Homo sapien
gtgactccagcctaggattatataa

SEQ ID NO: 268367 - DNA, 25 bp, Homo sapien
aggatgtgactgaccttagaggatt

SEQ ID NO: 268368 - DNA, 25 bp, Homo sapien
gaccttagaggatttcacgggaact

SEQ ID NO: 268369 - DNA, 25 bp, Homo sapien
atttcacgggaacttagctgtacac

SEQ ID NO: 268370 - DNA, 25 bp, Homo sapien
ttagctgtacacgtggaacccattt

SEQ ID NO: 268371 - DNA, 25 bp, Homo sapien
ggaacccatttatttgctgacactt

SEQ ID NO: 268372 - DNA, 25 bp, Homo sapien
atttgctgacacttctcatttcctt

SEQ ID NO: 268373 - DNA, 25 bp, Homo sapien
aacctacattcccagacctataatt

SEQ ID NO: 268374 - DNA, 25 bp, Homo sapien
ttccccatctgtaacttgagaaaat

SEQ ID NO: 268375 - DNA, 25 bp, Homo sapien
gaactagatctgtaacgtccttata

SEQ ID NO: 268376 - DNA, 25 bp, Homo sapien
gtaacgtccttataggtgtcactag

SEQ ID NO: 268377 - DNA, 25 bp, Homo sapien
aggtgtgtgacaggcagtctgattc

SEQ ID NO: 268378 - DNA, 25 bp, Homo sapien
tcctctcattctccatagtctgttt

SEQ ID NO: 268379 - DNA, 25 bp, Homo sapien
tgtttcctggaaagtcgatgtaatt

SEQ ID NO: 268380 - DNA, 25 bp, Homo sapien
gtcgatgtaattaactgatggccca

SEQ ID NO: 268381 - DNA, 25 bp, Homo sapien
gatggcccaaaaactacctcaagag

SEQ ID NO: 268382 - DNA, 25 bp, Homo sapien
gacctggccctgttaagacggctta

SEQ ID NO: 268383 - DNA, 25 bp, Homo sapien
ttaaccactgagatcccgttctatt

SEQ ID NO: 268384 - DNA, 25 bp, Homo sapien
gagatcccgttctattgatttaata

SEQ ID NO: 268385 - DNA, 25 bp, Homo sapien
tgctcacggagaaggcggcgcccgt

SEQ ID NO: 268386 - DNA, 25 bp, Homo sapien
aaggcggcgcccgtcatgaacgtca

SEQ ID NO: 268387 - DNA, 25 bp, Homo sapien
ggcggcgcccgtcatgaacgtcatc

SEQ ID NO: 268388 - DNA, 25 bp, Homo sapien
gtcatgaacgtcatccacagcatct

SEQ ID NO: 268389 - DNA, 25 bp, Homo sapien
tcatgaacgtcatccacagcatctt

SEQ ID NO: 268390 - DNA, 25 bp, Homo sapien
catcttcagcctcgtgctcaagttc

SEQ ID NO: 268391 - DNA, 25 bp, Homo sapien
tcttcagcctcgtgctcaagttccg

SEQ ID NO: 268392 - DNA, 25 bp, Homo sapien
aagttccgcagccagctcatctccc

SEQ ID NO: 268393 - DNA, 25 bp, Homo sapien
tcaagtactactcccactttctctt

SEQ ID NO: 268394 - DNA, 25 bp, Homo sapien
actttctcttcaaagtggtgaccaa

SEQ ID NO: 268395 - DNA, 25 bp, Homo sapien
tcttcaaagtggtgaccaagctggt

SEQ ID NO: 268396 - DNA, 25 bp, Homo sapien
ccactgccttcttattttgcccatt

SEQ ID NO: 268397 - DNA, 25 bp, Homo sapien
gcatcacccaacagagagcacagct

SEQ ID NO: 268398 - DNA, 25 bp, Homo sapien
tgttcattgtttcatccctcctcga

SEQ ID NO: 268399 - DNA, 25 bp, Homo sapien
aacagagagcacagctgatggcaaa

SEQ ID NO: 268400 - DNA, 25 bp, Homo sapien
gagcacagctgatggcaaaaaggaa

SEQ ID NO: 268401 - DNA, 25 bp, Homo sapien
gaggtgaaagttattcatttatgct

SEQ ID NO: 268402 - DNA, 25 bp, Homo sapien
tcgacctccgattttcaatcccttt

SEQ ID NO: 268403 - DNA, 25 bp, Homo sapien
gattttcaatccctttctcactatg

SEQ ID NO: 268404 - DNA, 25 bp, Homo sapien
tttcaatccctttctcactatgcct

SEQ ID NO: 268405 - DNA, 25 bp, Homo sapien
ttttgctcctcctccgatatttggt

SEQ ID NO: 268406 - DNA, 25 bp, Homo sapien
gatatttggtcctccactgccttct

SEQ ID NO: 268407 - DNA, 25 bp, Homo sapien
gcttggtgcacggaagaactgatga

SEQ ID NO: 268408 - DNA, 25 bp, Homo sapien
ggaagaactgatgagcagcttcact

SEQ ID NO: 268409 - DNA, 25 bp, Homo sapien
atgcagcaggacagatcaggacaaa

SEQ ID NO: 268410 - DNA, 25 bp, Homo sapien
tcaggacaaagccatgctggagttg

SEQ ID NO: 268411 - DNA, 25 bp, Homo sapien
ggctaaccagaaaggaacccaccat

SEQ ID NO: 268412 - DNA, 25 bp, Homo sapien
gaaaggaacccaccattggtctcct

SEQ ID NO: 268413 - DNA, 25 bp, Homo sapien
cattggtctccttagtaacgacttc

SEQ ID NO: 268414 - DNA, 25 bp, Homo sapien
actgcttctctgaatactctaaggg

SEQ ID NO: 268415 - DNA, 25 bp, Homo sapien
tactctaagggaggcagatctaggc

SEQ ID NO: 268416 - DNA, 25 bp, Homo sapien
gatctaggccaggtgaccagggttt

SEQ ID NO: 268417 - DNA, 25 bp, Homo sapien
gtgaccagggtttacaagtcccagg

SEQ ID NO: 268418 - DNA, 25 bp, Homo sapien
aatagacatgtcacataggtggcat

SEQ ID NO: 268419 - DNA, 25 bp, Homo sapien
cataggtggcatagaaatattttcg

SEQ ID NO: 268420 - DNA, 25 bp, Homo sapien
gaaatattttcgtagtacaatggag

SEQ ID NO: 268421 - DNA, 25 bp, Homo sapien
aatcacttcatgtggtttggctgca

SEQ ID NO: 268422 - DNA, 25 bp, Homo sapien
attctttaacttcttcagctcaacc

SEQ ID NO: 268423 - DNA, 25 bp, Homo sapien
taacttcttcagctcaaccatttct

SEQ ID NO: 268424 - DNA, 25 bp, Homo sapien
tttggctgcaggtaatctgtagacc

SEQ ID NO: 268425 - DNA, 25 bp, Homo sapien
gcaggtaatctgtagaccatgctga

SEQ ID NO: 268426 - DNA, 25 bp, Homo sapien
tctgtagaccatgctgaaggaaaac

SEQ ID NO: 268427 - DNA, 25 bp, Homo sapien
acattttgtccaggtgactagcttg

SEQ ID NO: 268428 - DNA, 25 bp, Homo sapien
gtccaggtgactagcttgaaaaatc

SEQ ID NO: 268429 - DNA, 25 bp, Homo sapien
agttcccaagggtgcctcttcccag

SEQ ID NO: 268430 - DNA, 25 bp, Homo sapien
aggaggtgccagagatccaagagaa

SEQ ID NO: 268431 - DNA, 25 bp, Homo sapien
gggcagcggcagtcaaagccacgca

SEQ ID NO: 268432 - DNA, 25 bp, Homo sapien
ggcagtcaaagccacgcagacacta

SEQ ID NO: 268433 - DNA, 25 bp, Homo sapien
gtcaaagccacgcagacactacagg

SEQ ID NO: 268434 - DNA, 25 bp, Homo sapien
cacgcagacactacaggccaatgag

SEQ ID NO: 268435 - DNA, 25 bp, Homo sapien
gcagacactacaggccaatgagtcg

SEQ ID NO: 268436 - DNA, 25 bp, Homo sapien
actacaggccaatgagtcggccagt

SEQ ID NO: 268437 - DNA, 25 bp, Homo sapien
aatgagtcggccagtgacatcctca

SEQ ID NO: 268438 - DNA, 25 bp, Homo sapien
tgagtcggccagtgacatcctcatc

SEQ ID NO: 268439 - DNA, 25 bp, Homo sapien
ggagccacgagtccaacgcccctgg

SEQ ID NO: 268440 - DNA, 25 bp, Homo sapien
ttgagtcccgagaccaaacgtcgtt

SEQ ID NO: 268441 - DNA, 25 bp, Homo sapien
tgagtcccgagaccaaacgtcgttt

SEQ ID NO: 268442 - DNA, 25 bp, Homo sapien
gagaccaaacgtcgtttccctctcg

SEQ ID NO: 268443 - DNA, 25 bp, Homo sapien
ctaagggagcgcaaggtcaagttcg

SEQ ID NO: 268444 - DNA, 25 bp, Homo sapien
gggagcgcaaggtcaagttcgcctt

SEQ ID NO: 268445 - DNA, 25 bp, Homo sapien
gcaaggtcaagttcgccttggccgt

SEQ ID NO: 268446 - DNA, 25 bp, Homo sapien
ggtcaagttcgccttggccgtgctc

SEQ ID NO: 268447 - DNA, 25 bp, Homo sapien
tggccgtgctccagctcaggtacta

SEQ ID NO: 268448 - DNA, 25 bp, Homo sapien
ccgtgctccagctcaggtactaggg

SEQ ID NO: 268449 - DNA, 25 bp, Homo sapien
gccggacgagccttgagtcccgaga

SEQ ID NO: 268450 - DNA, 25 bp, Homo sapien
acgagccttgagtcccgagaccaaa

SEQ ID NO: 268451 - DNA, 25 bp, Homo sapien
caatgtggctgatgctcataaaaag

SEQ ID NO: 268452 - DNA, 25 bp, Homo sapien
atcgatcaacaaaagcgaccagcct

SEQ ID NO: 268453 - DNA, 25 bp, Homo sapien
ctatccacggccttctcaacagatg

SEQ ID NO: 268454 - DNA, 25 bp, Homo sapien
agttgatttcgtgctttatttctta

SEQ ID NO: 268455 - DNA, 25 bp, Homo sapien
gaatagtgactaacctaagggatct

SEQ ID NO: 268456 - DNA, 25 bp, Homo sapien
cagtgccaccttccaaaattactta

SEQ ID NO: 268457 - DNA, 25 bp, Homo sapien
cttacctaagaggactgagcctgct

SEQ ID NO: 268458 - DNA, 25 bp, Homo sapien
aggactgagcctgctgtccctggag

SEQ ID NO: 268459 - DNA, 25 bp, Homo sapien
gttagctaaaacagtgcctcagtac

SEQ ID NO: 268460 - DNA, 25 bp, Homo sapien
aacagtgcctcagtacggagcgtac

SEQ ID NO: 268461 - DNA, 25 bp, Homo sapien
ggagcgtacctgtgttaacttctag

SEQ ID NO: 268462 - DNA, 25 bp, Homo sapien
taggaaaatgcacactcatgttgat

SEQ ID NO: 268463 - DNA, 25 bp, Homo sapien
tgcacactcatgttgattcctatgc

SEQ ID NO: 268464 - DNA, 25 bp, Homo sapien
cactcatgttgattcctatgctaaa

SEQ ID NO: 268465 - DNA, 25 bp, Homo sapien
atgttgattcctatgctaaaataca

SEQ ID NO: 268466 - DNA, 25 bp, Homo sapien
aatgttcatctagtgttaggcacta

SEQ ID NO: 268467 - DNA, 25 bp, Homo sapien
agtgttaggcactatagtatttata

SEQ ID NO: 268468 - DNA, 25 bp, Homo sapien
gcttgtatttttaactgttgcttgt

SEQ ID NO: 268469 - DNA, 25 bp, Homo sapien
ttttaactgttgcttgttctcttaa

SEQ ID NO: 268470 - DNA, 25 bp, Homo sapien
gcttgttctcttaaaaggtatcaat

SEQ ID NO: 268471 - DNA, 25 bp, Homo sapien
ggtatcaatgtaccttttttggtag

SEQ ID NO: 268472 - DNA, 25 bp, Homo sapien
atagtgcaaattatttgtatgcttc

SEQ ID NO: 268473 - DNA, 25 bp, Homo sapien
gacgtctcggcaagaggcagcactt

SEQ ID NO: 268474 - DNA, 25 bp, Homo sapien
tgcattctcccaagagagattcagt

SEQ ID NO: 268475 - DNA, 25 bp, Homo sapien
ctctgccaatgcactgggcgctggg

SEQ ID NO: 268476 - DNA, 25 bp, Homo sapien
tgctcccgccggaagggtgttttag

SEQ ID NO: 268477 - DNA, 25 bp, Homo sapien
ttggcagctccgtttaaggctccag

SEQ ID NO: 268478 - DNA, 25 bp, Homo sapien
gtttaaggctccagggactgcttgg

SEQ ID NO: 268479 - DNA, 25 bp, Homo sapien
tgcttggctgctccacagtgacggt

SEQ ID NO: 268480 - DNA, 25 bp, Homo sapien
acagtgacggtcactctgaggtgga

SEQ ID NO: 268481 - DNA, 25 bp, Homo sapien
aagtcaggacccaagttctcagtca

SEQ ID NO: 268482 - DNA, 25 bp, Homo sapien
ccaagttctcagtcaagggtaagat

SEQ ID NO: 268483 - DNA, 25 bp, Homo sapien
gatgctgtagccgagagttccccaa

SEQ ID NO: 268484 - DNA, 25 bp, Homo sapien
gtgggtatccgaaaactaagccagg

SEQ ID NO: 268485 - DNA, 25 bp, Homo sapien
ggaagcggttaacttatctttgcca

SEQ ID NO: 268486 - DNA, 25 bp, Homo sapien
atctttgccaacatttgagggagcc

SEQ ID NO: 268487 - DNA, 25 bp, Homo sapien
aacatttgagggagccttgggccgc

SEQ ID NO: 268488 - DNA, 25 bp, Homo sapien
ttgggccgctgcatgtcgttatgca

SEQ ID NO: 268489 - DNA, 25 bp, Homo sapien
gtcgttatgcagatcagactcatca

SEQ ID NO: 268490 - DNA, 25 bp, Homo sapien
cctcccgtggaaggcgagatggtcc

SEQ ID NO: 268491 - DNA, 25 bp, Homo sapien
gagatggtcctggaggcagtcctca

SEQ ID NO: 268492 - DNA, 25 bp, Homo sapien
ttccagcctctcagtgtgttggaga

SEQ ID NO: 268493 - DNA, 25 bp, Homo sapien
gggagctgaatcttcaatcggaata

SEQ ID NO: 268494 - DNA, 25 bp, Homo sapien
caatcggaataaaagcagccctccc

SEQ ID NO: 268495 - DNA, 25 bp, Homo sapien
aattgtgcttcttttatttcctaat

SEQ ID NO: 268496 - DNA, 25 bp, Homo sapien
taattgtcttagttttgtttgtctt

SEQ ID NO: 268497 - DNA, 25 bp, Homo sapien
gtcttattatgtgtatttcagctgt

SEQ ID NO: 268498 - DNA, 25 bp, Homo sapien
gtatttcagctgtgtatgcatcaca

SEQ ID NO: 268499 - DNA, 25 bp, Homo sapien
atcacagccctcctttttgctgtgc

SEQ ID NO: 268500 - DNA, 25 bp, Homo sapien
tgtgctgtggctacagttttctcac

SEQ ID NO: 268501 - DNA, 25 bp, Homo sapien
gttctcttcacaccatgtcatttca

SEQ ID NO: 268502 - DNA, 25 bp, Homo sapien
tcacatggtatattgtaggttttga

SEQ ID NO: 268503 - DNA, 25 bp, Homo sapien
aatcggtattttaaatgcactgcaa

SEQ ID NO: 268504 - DNA, 25 bp, Homo sapien
tgcactgcaagattggttttaactg

SEQ ID NO: 268505 - DNA, 25 bp, Homo sapien
ttttcaggtgcaaaagctcagtttt

SEQ ID NO: 268506 - DNA, 25 bp, Homo sapien
ttgcccacaaagctgtgggtggttt

SEQ ID NO: 268507 - DNA, 25 bp, Homo sapien
ggtggtttctggtacttaaagcact

SEQ ID NO: 268508 - DNA, 25 bp, Homo sapien
actaatattatgttgctgctctgcg

SEQ ID NO: 268509 - DNA, 25 bp, Homo sapien
tattatgttgctgctctgcgaacag

SEQ ID NO: 268510 - DNA, 25 bp, Homo sapien
tgcgaacagcccagtagtcccattt

SEQ ID NO: 268511 - DNA, 25 bp, Homo sapien
gcaaatggagtccttacaactggag

SEQ ID NO: 268512 - DNA, 25 bp, Homo sapien
actggagtttatgttgtcttgccct

SEQ ID NO: 268513 - DNA, 25 bp, Homo sapien
gagtttatgttgtcttgcccttttt

SEQ ID NO: 268514 - DNA, 25 bp, Homo sapien
tgtacttttttattgtcgaattgtt

SEQ ID NO: 268515 - DNA, 25 bp, Homo sapien
tcattctttacttgttcttacgaaa

SEQ ID NO: 268516 - DNA, 25 bp, Homo sapien
ttgctgtacgtgtatcatcattcca

SEQ ID NO: 268517 - DNA, 25 bp, Homo sapien
ggaacactcaaattaccaatatcaa

SEQ ID NO: 268518 - DNA, 25 bp, Homo sapien
accaatatcaaggtaagatcagaca

SEQ ID NO: 268519 - DNA, 25 bp, Homo sapien
ggtaagatcagacatcatttcaata

SEQ ID NO: 268520 - DNA, 25 bp, Homo sapien
tgagaatacatcactccaaatttta

SEQ ID NO: 268521 - DNA, 25 bp, Homo sapien
gaatacatcactccaaattttaagg

SEQ ID NO: 268522 - DNA, 25 bp, Homo sapien
taaaggatagtaggcaaacattatg

SEQ ID NO: 268523 - DNA, 25 bp, Homo sapien
gaagactttctgctgataaattcta

SEQ ID NO: 268524 - DNA, 25 bp, Homo sapien
agactttctgctgataaattctaca

SEQ ID NO: 268525 - DNA, 25 bp, Homo sapien
gataaattctacaacttcagtgaaa

SEQ ID NO: 268526 - DNA, 25 bp, Homo sapien
tctacaacttcagtgaaatgggcaa

SEQ ID NO: 268527 - DNA, 25 bp, Homo sapien
ggttgaatttttgggaagatcaata

SEQ ID NO: 268528 - DNA, 25 bp, Homo sapien
gagccgttctgcagcgggaacagca

SEQ ID NO: 268529 - DNA, 25 bp, Homo sapien
gcagcgggaacagcacgaagagtga

SEQ ID NO: 268530 - DNA, 25 bp, Homo sapien
aagagtgagctgtcgttggcgtcca

SEQ ID NO: 268531 - DNA, 25 bp, Homo sapien
tgagctgtcgttggcgtccagcacc

SEQ ID NO: 268532 - DNA, 25 bp, Homo sapien
tcagcgccgtggagccgcggtctga

SEQ ID NO: 268533 - DNA, 25 bp, Homo sapien
gtggagccgcggtctgaagcgccca

SEQ ID NO: 268534 - DNA, 25 bp, Homo sapien
ctgaagcgcccacgcggaactcgaa

SEQ ID NO: 268535 - DNA, 25 bp, Homo sapien
acgcggaactcgaactcctgcaggg

SEQ ID NO: 268536 - DNA, 25 bp, Homo sapien
tagtccagcgacctgagggcgaaca

SEQ ID NO: 268537 - DNA, 25 bp, Homo sapien
cgacctgagggcgaacagaatcgcg

SEQ ID NO: 268538 - DNA, 25 bp, Homo sapien
gaagaacgacgacaccaaggccaac

SEQ ID NO: 268539 - DNA, 25 bp, Homo sapien
tattcctccctcatgctagattcag

SEQ ID NO: 268540 - DNA, 25 bp, Homo sapien
atgctagattcagtccatcactcag

SEQ ID NO: 268541 - DNA, 25 bp, Homo sapien
gcctcctgtcaggaaaaccatagca

SEQ ID NO: 268542 - DNA, 25 bp, Homo sapien
ggaaaaccatagcaaatcctacttt

SEQ ID NO: 268543 - DNA, 25 bp, Homo sapien
aatgaagttacaagacacttttcca

SEQ ID NO: 268544 - DNA, 25 bp, Homo sapien
tcacactcaatgaagggacccaggg

SEQ ID NO: 268545 - DNA, 25 bp, Homo sapien
caactcagctccttctctaaagtgc

SEQ ID NO: 268546 - DNA, 25 bp, Homo sapien
cttctctaaagtgccctctaatggg

SEQ ID NO: 268547 - DNA, 25 bp, Homo sapien
gtgccctctaatgggcagtggcttt

SEQ ID NO: 268548 - DNA, 25 bp, Homo sapien
tggctttggtctctgtttggcaaat

SEQ ID NO: 268549 - DNA, 25 bp, Homo sapien
ggcaaattatgtccagagggttaac

SEQ ID NO: 268550 - DNA, 25 bp, Homo sapien
gaaagcatacatgataaacagttta

SEQ ID NO: 268551 - DNA, 25 bp, Homo sapien
aaacagtttatggtacttctcagaa

SEQ ID NO: 268552 - DNA, 25 bp, Homo sapien
ttatggtacttctcagaatcatttc

SEQ ID NO: 268553 - DNA, 25 bp, Homo sapien
atttagcttaagttccaacttactg

SEQ ID NO: 268554 - DNA, 25 bp, Homo sapien
tccaacttactgttcttattataaa

SEQ ID NO: 268555 - DNA, 25 bp, Homo sapien
attgcaaagcaacctgtcttacatt

SEQ ID NO: 268556 - DNA, 25 bp, Homo sapien
gtcttacattcttacattatcttaa

SEQ ID NO: 268557 - DNA, 25 bp, Homo sapien
caatttaaaatttgctagtggtttg

SEQ ID NO: 268558 - DNA, 25 bp, Homo sapien
gtactgactacatgtatgctgttat

SEQ ID NO: 268559 - DNA, 25 bp, Homo sapien
tgtcagtgtttccttctataaactg

SEQ ID NO: 268560 - DNA, 25 bp, Homo sapien
cagtgtttccttctataaactgttc

SEQ ID NO: 268561 - DNA, 25 bp, Homo sapien
gctgcttaggctgggcttgaaatag

SEQ ID NO: 268562 - DNA, 25 bp, Homo sapien
ctgggcttgaaataggctgagtgaa

SEQ ID NO: 268563 - DNA, 25 bp, Homo sapien
tgagtgaaaacctgcgagcccctgg

SEQ ID NO: 268564 - DNA, 25 bp, Homo sapien
ggctgcttccctgtgcatggaaagg

SEQ ID NO: 268565 - DNA, 25 bp, Homo sapien
tccctgtgcatggaaaggagctgtt

SEQ ID NO: 268566 - DNA, 25 bp, Homo sapien
ggtgagtatggagatctctgccctt

SEQ ID NO: 268567 - DNA, 25 bp, Homo sapien
gagatctctgcccttgtcagaggaa

SEQ ID NO: 268568 - DNA, 25 bp, Homo sapien
ctctgcccttgtcagaggaaggctt

SEQ ID NO: 268569 - DNA, 25 bp, Homo sapien
aagcagccagtggaggctttcgcct

SEQ ID NO: 268570 - DNA, 25 bp, Homo sapien
gaggctttcgcctgaactgtgcaat

SEQ ID NO: 268571 - DNA, 25 bp, Homo sapien
gcctgaactgtgcaatccttacctg

SEQ ID NO: 268572 - DNA, 25 bp, Homo sapien
ttcagggtttaatcactgtctagct

SEQ ID NO: 268573 - DNA, 25 bp, Homo sapien
tcactgtctagctgtcactttctag

SEQ ID NO: 268574 - DNA, 25 bp, Homo sapien
gtcactttctagctacaggacctca

SEQ ID NO: 268575 - DNA, 25 bp, Homo sapien
ggacctcacaagtcagtttgctgct

SEQ ID NO: 268576 - DNA, 25 bp, Homo sapien
acaagtcagtttgctgctctgtagt

SEQ ID NO: 268577 - DNA, 25 bp, Homo sapien
agtttgctgctctgtagttgcttat

SEQ ID NO: 268578 - DNA, 25 bp, Homo sapien
tgtagttgcttatccctaataaaat

SEQ ID NO: 268579 - DNA, 25 bp, Homo sapien
atggatgtaatatctcctcctgctc

SEQ ID NO: 268580 - DNA, 25 bp, Homo sapien
cctgctctgtgagaattaagatcta

SEQ ID NO: 268581 - DNA, 25 bp, Homo sapien
tacagaacaggtattgatcagtcct

SEQ ID NO: 268582 - DNA, 25 bp, Homo sapien
gatcagtcctgtaattgggtttagt

SEQ ID NO: 268583 - DNA, 25 bp, Homo sapien
tactcagttcagcagagaagtcact

SEQ ID NO: 268584 - DNA, 25 bp, Homo sapien
gaagtcactgacaaacgagatcaca

SEQ ID NO: 268585 - DNA, 25 bp, Homo sapien
acaaacgagatcacactgactgctt

SEQ ID NO: 268586 - DNA, 25 bp, Homo sapien
gaacattcactagcatctgtgtcgg

SEQ ID NO: 268587 - DNA, 25 bp, Homo sapien
ttcactagcatctgtgtcgggccta

SEQ ID NO: 268588 - DNA, 25 bp, Homo sapien
taccctccctggtcaaatacagcta

SEQ ID NO: 268589 - DNA, 25 bp, Homo sapien
ggtcaaatacagctacagtctccct

SEQ ID NO: 268590 - DNA, 25 bp, Homo sapien
agtctccctgcagatacgagttttc

SEQ ID NO: 268591 - DNA, 25 bp, Homo sapien
agttttccagaaatgagccgatgtt

SEQ ID NO: 268592 - DNA, 25 bp, Homo sapien
atgagccgatgttttctgcgagaat

SEQ ID NO: 268593 - DNA, 25 bp, Homo sapien
taaactgtacactgcagatgcttta

SEQ ID NO: 268594 - DNA, 25 bp, Homo sapien
aaacctgttaatggtagagcctttg

SEQ ID NO: 268595 - DNA, 25 bp, Homo sapien
attggttttgagcacccaactcact

SEQ ID NO: 268596 - DNA, 25 bp, Homo sapien
aactcactctttatgtggtgaccac

SEQ ID NO: 268597 - DNA, 25 bp, Homo sapien
gaccactggcgggattgtgatttaa

SEQ ID NO: 268598 - DNA, 25 bp, Homo sapien
agctaggtaggctgtgggctattca

SEQ ID NO: 268599 - DNA, 25 bp, Homo sapien
gtgggctattcacataaagagtatc

SEQ ID NO: 268600 - DNA, 25 bp, Homo sapien
aatggtagagcctttggataattca

SEQ ID NO: 268601 - DNA, 25 bp, Homo sapien
cagtgagactgtagttcttttcaaa

SEQ ID NO: 268602 - DNA, 25 bp, Homo sapien
ttcaaagatcttgttgatttctctg

SEQ ID NO: 268603 - DNA, 25 bp, Homo sapien
gatttctctgttcatgtattgcaaa

SEQ ID NO: 268604 - DNA, 25 bp, Homo sapien
attgcaaatgactgaagacttgttc

SEQ ID NO: 268605 - DNA, 25 bp, Homo sapien
caactcaatgtcaagtgtgaacctt

SEQ ID NO: 268606 - DNA, 25 bp, Homo sapien
gtgtgaaccttgtgttgaccctgat

SEQ ID NO: 268607 - DNA, 25 bp, Homo sapien
aaccttgtgttgaccctgatttgag

SEQ ID NO: 268608 - DNA, 25 bp, Homo sapien
gtgttgaccctgatttgagcaagca

SEQ ID NO: 268609 - DNA, 25 bp, Homo sapien
gaccctgatttgagcaagcaataaa

SEQ ID NO: 268610 - DNA, 25 bp, Homo sapien
gagacatttagattatgaatttcac

SEQ ID NO: 268611 - DNA, 25 bp, Homo sapien
tgaatttcacatttgatgatagtta

SEQ ID NO: 268612 - DNA, 25 bp, Homo sapien
aattttgtgaggtgtgatattggca

SEQ ID NO: 268613 - DNA, 25 bp, Homo sapien
ggcaatgtggttagatgacttcaga

SEQ ID NO: 268614 - DNA, 25 bp, Homo sapien
gttaagcaagtatggcaacatctaa

SEQ ID NO: 268615 - DNA, 25 bp, Homo sapien
cgcctggcccgcatgtattacattt

SEQ ID NO: 268616 - DNA, 25 bp, Homo sapien
actctggaaggagagagcctggcct

SEQ ID NO: 268617 - DNA, 25 bp, Homo sapien
gagcctggccttacagaagacatct

SEQ ID NO: 268618 - DNA, 25 bp, Homo sapien
gaagacatctgaactatcaatcaac

SEQ ID NO: 268619 - DNA, 25 bp, Homo sapien
aacagaaatctcacgtatagttgaa

SEQ ID NO: 268620 - DNA, 25 bp, Homo sapien
aacaggaccaggacagcactggcta

SEQ ID NO: 268621 - DNA, 25 bp, Homo sapien
aaaggaggatcatggttctctgcaa

SEQ ID NO: 268622 - DNA, 25 bp, Homo sapien
atcatggttctctgcaaagagctgg

SEQ ID NO: 268623 - DNA, 25 bp, Homo sapien
actggctacactggcttatcgatta

SEQ ID NO: 268624 - DNA, 25 bp, Homo sapien
ggcttatcgattacatcccacaata

SEQ ID NO: 268625 - DNA, 25 bp, Homo sapien
ggatgctcaggcatatggcctcaga

SEQ ID NO: 268626 - DNA, 25 bp, Homo sapien
tggcctcagaaacatgggctattga

SEQ ID NO: 268627 - DNA, 25 bp, Homo sapien
tagacaccctttcttcctaagttca

SEQ ID NO: 268628 - DNA, 25 bp, Homo sapien
aagggaagcccacacatgtactgct

SEQ ID NO: 268629 - DNA, 25 bp, Homo sapien
atctcagctcaaatattccttatgc

SEQ ID NO: 268630 - DNA, 25 bp, Homo sapien
attccttatgcagagatgccttccc

SEQ ID NO: 268631 - DNA, 25 bp, Homo sapien
tgattccctaaactagactcggacc

SEQ ID NO: 268632 - DNA, 25 bp, Homo sapien
aactagactcggacccctctgttct

SEQ ID NO: 268633 - DNA, 25 bp, Homo sapien
tgttctgcatctctgtggcatatca

SEQ ID NO: 268634 - DNA, 25 bp, Homo sapien
gcatctctgtggcatatcatctgcc

SEQ ID NO: 268635 - DNA, 25 bp, Homo sapien
atcatctgccccttttgtaaaactt

SEQ ID NO: 268636 - DNA, 25 bp, Homo sapien
acttgtggttacttgtttagcgtct

SEQ ID NO: 268637 - DNA, 25 bp, Homo sapien
gttacttgtttagcgtctctttcct

SEQ ID NO: 268638 - DNA, 25 bp, Homo sapien
gaactggaaaaatctgcaggtggtt

SEQ ID NO: 268639 - DNA, 25 bp, Homo sapien
gggaaacctaaatgagcctttggag

SEQ ID NO: 268640 - DNA, 25 bp, Homo sapien
ggagaaagggatactcttgcagact

SEQ ID NO: 268641 - DNA, 25 bp, Homo sapien
tcttgcagactgaagctgagctcct

SEQ ID NO: 268642 - DNA, 25 bp, Homo sapien
tgaagctgagctcctgaagctccct

SEQ ID NO: 268643 - DNA, 25 bp, Homo sapien
ttccccagccagactgcaacagata

SEQ ID NO: 268644 - DNA, 25 bp, Homo sapien
tgcaacagataccagagcggcccct

SEQ ID NO: 268645 - DNA, 25 bp, Homo sapien
acgcagggcgctttccttcctttgt

SEQ ID NO: 268646 - DNA, 25 bp, Homo sapien
gttctcagcttctccgcttgagtgg

SEQ ID NO: 268647 - DNA, 25 bp, Homo sapien
agcttctccgcttgagtggcttgag

SEQ ID NO: 268648 - DNA, 25 bp, Homo sapien
gagtggcttgagtgcacttctgctc

SEQ ID NO: 268649 - DNA, 25 bp, Homo sapien
tatctgggcgtgttaagtcgttctt

SEQ ID NO: 268650 - DNA, 25 bp, Homo sapien
agtcgttcttgatgaaatgtgtcct

SEQ ID NO: 268651 - DNA, 25 bp, Homo sapien
atgtgtcctctgtgaatgtagtctc

SEQ ID NO: 268652 - DNA, 25 bp, Homo sapien
gtgaatgtagtctcactgttagact

SEQ ID NO: 268653 - DNA, 25 bp, Homo sapien
gtgcccagttcctcttaaaagtaca

SEQ ID NO: 268654 - DNA, 25 bp, Homo sapien
tacagatgctccttgggttgcagcc

SEQ ID NO: 268655 - DNA, 25 bp, Homo sapien
gctccttgggttgcagccgtaataa

SEQ ID NO: 268656 - DNA, 25 bp, Homo sapien
cagccgtaataaacccatcctaaat

SEQ ID NO: 268657 - DNA, 25 bp, Homo sapien
gggaaccagtgatctcagtgctgaa

SEQ ID NO: 268658 - DNA, 25 bp, Homo sapien
gtgtcttcatacttgatttgcctta

SEQ ID NO: 268659 - DNA, 25 bp, Homo sapien
catacttgatttgccttaccgcagg

SEQ ID NO: 268660 - DNA, 25 bp, Homo sapien
gtgcttggcccaaaagaggacagag

SEQ ID NO: 268661 - DNA, 25 bp, Homo sapien
gaggacagaggccatcataagataa

SEQ ID NO: 268662 - DNA, 25 bp, Homo sapien
aagaaggatgcactgctacctataa

SEQ ID NO: 268663 - DNA, 25 bp, Homo sapien
gcactgctacctataaacaacctta

SEQ ID NO: 268664 - DNA, 25 bp, Homo sapien
aaccttaacgaaatactgattctgc

SEQ ID NO: 268665 - DNA, 25 bp, Homo sapien
tgattctgcttactaaactccccag

SEQ ID NO: 268666 - DNA, 25 bp, Homo sapien
actccccagatctgtaacaaacaat

SEQ ID NO: 268667 - DNA, 25 bp, Homo sapien
gatctgtaacaaacaatgcacatta

SEQ ID NO: 268668 - DNA, 25 bp, Homo sapien
ttaatgccactgaaccgtatacgta

SEQ ID NO: 268669 - DNA, 25 bp, Homo sapien
accgtatacgtaaatatgttcagac

SEQ ID NO: 268670 - DNA, 25 bp, Homo sapien
gttcagacagtaaatttaatgctat

SEQ ID NO: 268671 - DNA, 25 bp, Homo sapien
aaattagcaactaccagacctcacg

SEQ ID NO: 268672 - DNA, 25 bp, Homo sapien
actaccagacctcacgtgttgcagt

SEQ ID NO: 268673 - DNA, 25 bp, Homo sapien
caatgcattggattcagttttgtga

SEQ ID NO: 268674 - DNA, 25 bp, Homo sapien
gattctgtggccatccaagggatgt

SEQ ID NO: 268675 - DNA, 25 bp, Homo sapien
gagaggctccagaaggatttctaga

SEQ ID NO: 268676 - DNA, 25 bp, Homo sapien
ggatttctagatcgcttcaagccta

SEQ ID NO: 268677 - DNA, 25 bp, Homo sapien
tcaagcctatactgatggccttagc

SEQ ID NO: 268678 - DNA, 25 bp, Homo sapien
tggccttagctttgttcagtcattg

SEQ ID NO: 268679 - DNA, 25 bp, Homo sapien
gtcattgtaactgggattgttgtca

SEQ ID NO: 268680 - DNA, 25 bp, Homo sapien
attgttgtcattgctaccgtggtag

SEQ ID NO: 268681 - DNA, 25 bp, Homo sapien
attgctaccgtggtagtcaccttca

SEQ ID NO: 268682 - DNA, 25 bp, Homo sapien
aatacttgcattgttctggtactta

SEQ ID NO: 268683 - DNA, 25 bp, Homo sapien
tctggtacttattctgagaaatgaa

SEQ ID NO: 268684 - DNA, 25 bp, Homo sapien
atgttttttacatacttactactgt

SEQ ID NO: 268685 - DNA, 25 bp, Homo sapien
acatacttactactgttttgtctct

SEQ ID NO: 268686 - DNA, 25 bp, Homo sapien
actgttttgtctcttcacactgaaa

SEQ ID NO: 268687 - DNA, 25 bp, Homo sapien
ttgtctcttcacactgaaaaacagt

SEQ ID NO: 268688 - DNA, 25 bp, Homo sapien
ttattgccttctataaactttccaa

SEQ ID NO: 268689 - DNA, 25 bp, Homo sapien
ttgccttctataaactttccaataa

SEQ ID NO: 268690 - DNA, 25 bp, Homo sapien
atacaacctatagtcttaactcaga

SEQ ID NO: 268691 - DNA, 25 bp, Homo sapien
agtcttaactcagaatttatgtagc

SEQ ID NO: 268692 - DNA, 25 bp, Homo sapien
gctatttctttgtggttgggtaatt

SEQ ID NO: 268693 - DNA, 25 bp, Homo sapien
cagttaaatattgggacactaacca

SEQ ID NO: 268694 - DNA, 25 bp, Homo sapien
ccatccaggtcaagaaaagtcacat

SEQ ID NO: 268695 - DNA, 25 bp, Homo sapien
aaagtcacatgccatagccatggta

SEQ ID NO: 268696 - DNA, 25 bp, Homo sapien
gccatagccatggtattgcacatca

SEQ ID NO: 268697 - DNA, 25 bp, Homo sapien
atggtattgcacatcattcatcttg

SEQ ID NO: 268698 - DNA, 25 bp, Homo sapien
atcattcatcttgcattctttgaga

SEQ ID NO: 268699 - DNA, 25 bp, Homo sapien
gaagtgggaagctttgtccaggcct

SEQ ID NO: 268700 - DNA, 25 bp, Homo sapien
tgggaagctttgtccaggcctgtgt

SEQ ID NO: 268701 - DNA, 25 bp, Homo sapien
aggcctgtgtgtgaacccaatgttt

SEQ ID NO: 268702 - DNA, 25 bp, Homo sapien
gtgtgaacccaatgttttgtttaga

SEQ ID NO: 268703 - DNA, 25 bp, Homo sapien
acaagtaagttcattgctatagcat

SEQ ID NO: 268704 - DNA, 25 bp, Homo sapien
gatgttattttagaatcgattccca

SEQ ID NO: 268705 - DNA, 25 bp, Homo sapien
gaatcgattcccatctaaagaactc

SEQ ID NO: 268706 - DNA, 25 bp, Homo sapien
gagtctgacatttccaggaccagat

SEQ ID NO: 268707 - DNA, 25 bp, Homo sapien
ggaccagatattgtcttactcacat

SEQ ID NO: 268708 - DNA, 25 bp, Homo sapien
attgtcttactcacatttcctttgc

SEQ ID NO: 268709 - DNA, 25 bp, Homo sapien
tgaaatagggctttccttccaaatg

SEQ ID NO: 268710 - DNA, 25 bp, Homo sapien
tccaaatggctatttttaggctagg

SEQ ID NO: 268711 - DNA, 25 bp, Homo sapien
ttttaggctagggatgttaacatca

SEQ ID NO: 268712 - DNA, 25 bp, Homo sapien
gtgtgtggaataactggaatgtcat

SEQ ID NO: 268713 - DNA, 25 bp, Homo sapien
ttgcttttaagccatttctgatgat

SEQ ID NO: 268714 - DNA, 25 bp, Homo sapien
agccatttctgatgatatagccaaa

SEQ ID NO: 268715 - DNA, 25 bp, Homo sapien
ccccaccgagggtgaagaggcaagt

SEQ ID NO: 268716 - DNA, 25 bp, Homo sapien
gaagaggcaagtggccctaagcaaa

SEQ ID NO: 268717 - DNA, 25 bp, Homo sapien
gcaagtggccctaagcaaaagacgt

SEQ ID NO: 268718 - DNA, 25 bp, Homo sapien
ggccctaagcaaaagacgtgccagt

SEQ ID NO: 268719 - DNA, 25 bp, Homo sapien
aagacgtgccagtgttgtgcggtca

SEQ ID NO: 268720 - DNA, 25 bp, Homo sapien
acgtgccagtgttgtgcggtcatgt

SEQ ID NO: 268721 - DNA, 25 bp, Homo sapien
tgccagtgttgtgcggtcatgtgaa

SEQ ID NO: 268722 - DNA, 25 bp, Homo sapien
gtgttgtgcggtcatgtgaacccat

SEQ ID NO: 268723 - DNA, 25 bp, Homo sapien
tgtgcggtcatgtgaacccatgccc

SEQ ID NO: 268724 - DNA, 25 bp, Homo sapien
gatgccacacctcttctggcagaga

SEQ ID NO: 268725 - DNA, 25 bp, Homo sapien
ccgaatgccagccactgcttcaggg

SEQ ID NO: 268726 - DNA, 25 bp, Homo sapien
tcctcttggtttttgaattagtgtt

SEQ ID NO: 268727 - DNA, 25 bp, Homo sapien
attttcatttccatcatggttataa

SEQ ID NO: 268728 - DNA, 25 bp, Homo sapien
gttataacaaatttgctgcatgccc

SEQ ID NO: 268729 - DNA, 25 bp, Homo sapien
aatttgctgcatgcccaaactgaca

SEQ ID NO: 268730 - DNA, 25 bp, Homo sapien
gcatgcccaaactgacaacagcaat

SEQ ID NO: 268731 - DNA, 25 bp, Homo sapien
tgacaacagcaatcactgagggaac

SEQ ID NO: 268732 - DNA, 25 bp, Homo sapien
ctgagggaacaggttttgaatcttt

SEQ ID NO: 268733 - DNA, 25 bp, Homo sapien
tgttatgaagtttatcgtctctact

SEQ ID NO: 268734 - DNA, 25 bp, Homo sapien
agtttatcgtctctacttgcttgag

SEQ ID NO: 268735 - DNA, 25 bp, Homo sapien
aaagcagatgctgcagctttagtct

SEQ ID NO: 268736 - DNA, 25 bp, Homo sapien
gctttagtctgttatgctgatttag

SEQ ID NO: 268737 - DNA, 25 bp, Homo sapien
gatgcaaagacatccagagtgatat

SEQ ID NO: 268738 - DNA, 25 bp, Homo sapien
aagtaaaacaagatcacaccctgga

SEQ ID NO: 268739 - DNA, 25 bp, Homo sapien
gtaaaacaagatcacaccctggaac

SEQ ID NO: 268740 - DNA, 25 bp, Homo sapien
taaaacaagatcacaccctggaaca

SEQ ID NO: 268741 - DNA, 25 bp, Homo sapien
aaaacaagatcacaccctggaacaa

SEQ ID NO: 268742 - DNA, 25 bp, Homo sapien
aaacaagatcacaccctggaacaat

SEQ ID NO: 268743 - DNA, 25 bp, Homo sapien
aacaagatcacaccctggaacaatt

SEQ ID NO: 268744 - DNA, 25 bp, Homo sapien
caagatcacaccctggaacaattgg

SEQ ID NO: 268745 - DNA, 25 bp, Homo sapien
aagatcacaccctggaacaattgga

SEQ ID NO: 268746 - DNA, 25 bp, Homo sapien
agatcacaccctggaacaattggag

SEQ ID NO: 268747 - DNA, 25 bp, Homo sapien
atcacaccctggaacaattggagga

SEQ ID NO: 268748 - DNA, 25 bp, Homo sapien
acctcagctccaaggcgtgactcat

SEQ ID NO: 268749 - DNA, 25 bp, Homo sapien
atttctcagtctcaccatcctttgt

SEQ ID NO: 268750 - DNA, 25 bp, Homo sapien
atcctttgttggctcagacatcgca

SEQ ID NO: 268751 - DNA, 25 bp, Homo sapien
gggttgtgtgcctgcgtctctcact

SEQ ID NO: 268752 - DNA, 25 bp, Homo sapien
gaaaacccatagaccagcctaactt

SEQ ID NO: 268753 - DNA, 25 bp, Homo sapien
agcctaacttcctttcaaccaagtg

SEQ ID NO: 268754 - DNA, 25 bp, Homo sapien
tttcaaccaagtgacggcctcctgg

SEQ ID NO: 268755 - DNA, 25 bp, Homo sapien
ggttcctctcagttcatcatcaaaa

SEQ ID NO: 268756 - DNA, 25 bp, Homo sapien
gtgtgtacatgtcatacaagccaag

SEQ ID NO: 268757 - DNA, 25 bp, Homo sapien
aagccaagagtgttcatgtcctcgt

SEQ ID NO: 268758 - DNA, 25 bp, Homo sapien
catgtcctcgttcctttcaaatgaa

SEQ ID NO: 268759 - DNA, 25 bp, Homo sapien
gattcttagtcccactccagactac

SEQ ID NO: 268760 - DNA, 25 bp, Homo sapien
ggattctgtggtagccaggtgacaa

SEQ ID NO: 268761 - DNA, 25 bp, Homo sapien
aacctgatacagattgcttccaaat

SEQ ID NO: 268762 - DNA, 25 bp, Homo sapien
gattgcttccaaatttctctccagc

SEQ ID NO: 268763 - DNA, 25 bp, Homo sapien
cagcccttatctctctattaaacta

SEQ ID NO: 268764 - DNA, 25 bp, Homo sapien
tataatcttatctttctaactgaaa

SEQ ID NO: 268765 - DNA, 25 bp, Homo sapien
gtctctctctaatgatatttcgatg

SEQ ID NO: 268766 - DNA, 25 bp, Homo sapien
gaaattgtggattgtgttatcatac

SEQ ID NO: 268767 - DNA, 25 bp, Homo sapien
gtgttatcatactaagtggattcag

SEQ ID NO: 268768 - DNA, 25 bp, Homo sapien
gaactggttgagttaccatacccca

SEQ ID NO: 268769 - DNA, 25 bp, Homo sapien
accccaaaaatgcttgatccatgtc

SEQ ID NO: 268770 - DNA, 25 bp, Homo sapien
ggaaattcactatggcaggttgtac

SEQ ID NO: 268771 - DNA, 25 bp, Homo sapien
gttgtacagctgataagaacactca

SEQ ID NO: 268772 - DNA, 25 bp, Homo sapien
acactcattgtttgtggttcagcag

SEQ ID NO: 268773 - DNA, 25 bp, Homo sapien
ggttcagcaggtactctgacaggtt

SEQ ID NO: 268774 - DNA, 25 bp, Homo sapien
gtactctgacaggttttttcatatc

SEQ ID NO: 268775 - DNA, 25 bp, Homo sapien
ggaacacttttagcttcactttttg

SEQ ID NO: 268776 - DNA, 25 bp, Homo sapien
tcactttttggatcatcacatggtt

SEQ ID NO: 268777 - DNA, 25 bp, Homo sapien
tctgtgacactgacattttcctggg

SEQ ID NO: 268778 - DNA, 25 bp, Homo sapien
gggactatcttccaattctttggca

SEQ ID NO: 268779 - DNA, 25 bp, Homo sapien
tctttggcactgtcttgatttaagt

SEQ ID NO: 268780 - DNA, 25 bp, Homo sapien
gaaattgtcatccataattctgtgc

SEQ ID NO: 268781 - DNA, 25 bp, Homo sapien
gactgccagcagttgaggattgagt

SEQ ID NO: 268782 - DNA, 25 bp, Homo sapien
gcagttgaggattgagtccgaccat

SEQ ID NO: 268783 - DNA, 25 bp, Homo sapien
attgagtccgaccatgtttacatgc

SEQ ID NO: 268784 - DNA, 25 bp, Homo sapien
ccatgtttacatgcagggttcccaa

SEQ ID NO: 268785 - DNA, 25 bp, Homo sapien
agggttcccaacaccagtggtgaca

SEQ ID NO: 268786 - DNA, 25 bp, Homo sapien
agtggtgacactgggaagcagcccc

SEQ ID NO: 268787 - DNA, 25 bp, Homo sapien
aatccttaatgtcaaaccaggtcag

SEQ ID NO: 268788 - DNA, 25 bp, Homo sapien
accaggtcagtgtttcttactgtgt

SEQ ID NO: 268789 - DNA, 25 bp, Homo sapien
aagactgagagtagaggcactttat

SEQ ID NO: 268790 - DNA, 25 bp, Homo sapien
gagtagaggcactttatgctgctat

SEQ ID NO: 268791 - DNA, 25 bp, Homo sapien
ggcactttatgctgctataggtggg

SEQ ID NO: 268792 - DNA, 25 bp, Homo sapien
ttaggtcttctctgtccctttactg

SEQ ID NO: 268793 - DNA, 25 bp, Homo sapien
ttcctcttcttttccagattacagt

SEQ ID NO: 268794 - DNA, 25 bp, Homo sapien
gattacagtatgaagctttattttc

SEQ ID NO: 268795 - DNA, 25 bp, Homo sapien
ttctttgtacaagcttaaaatttca

SEQ ID NO: 268796 - DNA, 25 bp, Homo sapien
aaatttcaacatcatcatccgccaa

SEQ ID NO: 268797 - DNA, 25 bp, Homo sapien
atcatcatccgccaaagttgttcct

SEQ ID NO: 268798 - DNA, 25 bp, Homo sapien
gagacaaatcggtgtgccattgaca

SEQ ID NO: 268799 - DNA, 25 bp, Homo sapien
aaatcggtgtgccattgacaacatg

SEQ ID NO: 268800 - DNA, 25 bp, Homo sapien
ggtgtgccattgacaacatgagcca

SEQ ID NO: 268801 - DNA, 25 bp, Homo sapien
gccattgacaacatgagccagggta

SEQ ID NO: 268802 - DNA, 25 bp, Homo sapien
atgagccagggtaaaggcacccttt

SEQ ID NO: 268803 - DNA, 25 bp, Homo sapien
caatcaagtcctggtgttgcaaaag

SEQ ID NO: 268804 - DNA, 25 bp, Homo sapien
gtcctggtgttgcaaaaggctcaga

SEQ ID NO: 268805 - DNA, 25 bp, Homo sapien
cagaggagcctttgcaaagtaagga

SEQ ID NO: 268806 - DNA, 25 bp, Homo sapien
aaagtaaggagtcgcatcccctgcc

SEQ ID NO: 268807 - DNA, 25 bp, Homo sapien
cagccatgctttcggagactctaaa

SEQ ID NO: 268808 - DNA, 25 bp, Homo sapien
tcggagactctaaagtaactgtggt

SEQ ID NO: 268809 - DNA, 25 bp, Homo sapien
taactgtggtaaattctattaagcc

SEQ ID NO: 268810 - DNA, 25 bp, Homo sapien
tattaagccatcgtcacctacagaa

SEQ ID NO: 268811 - DNA, 25 bp, Homo sapien
ctgcttatgtgccttgcatcttatt

SEQ ID NO: 268812 - DNA, 25 bp, Homo sapien
atgtgccttgcatcttatttttgaa

SEQ ID NO: 268813 - DNA, 25 bp, Homo sapien
gtgtgtgttttagtacttaattgac

SEQ ID NO: 268814 - DNA, 25 bp, Homo sapien
tttattaagctttctaaattccagc

SEQ ID NO: 268815 - DNA, 25 bp, Homo sapien
taaattccagccacattgctgtaca

SEQ ID NO: 268816 - DNA, 25 bp, Homo sapien
agccacattgctgtacatcaacatt

SEQ ID NO: 268817 - DNA, 25 bp, Homo sapien
tgctgtacatcaacattggtttcat

SEQ ID NO: 268818 - DNA, 25 bp, Homo sapien
aacattggtttcattcaacagacat

SEQ ID NO: 268819 - DNA, 25 bp, Homo sapien
tcaacagacatttttttggcctgaa

SEQ ID NO: 268820 - DNA, 25 bp, Homo sapien
ttttggcctgaagatacaaggttca

SEQ ID NO: 268821 - DNA, 25 bp, Homo sapien
aagatacaaggttcagaaagaggcc

SEQ ID NO: 268822 - DNA, 25 bp, Homo sapien
tgccctcaaataactttcatactgg

SEQ ID NO: 268823 - DNA, 25 bp, Homo sapien
catactggtgtatgatgaactgacc

SEQ ID NO: 268824 - DNA, 25 bp, Homo sapien
tgatgttgtatagtttgtagcctgg

SEQ ID NO: 268825 - DNA, 25 bp, Homo sapien
gtattcatttagttgatgctgttgt

SEQ ID NO: 268826 - DNA, 25 bp, Homo sapien
gtttcagcccatggatattaacatt

SEQ ID NO: 268827 - DNA, 25 bp, Homo sapien
agttgatgctgttgtttgtagtaac

SEQ ID NO: 268828 - DNA, 25 bp, Homo sapien
caaattgtgccagttagccttcatt

SEQ ID NO: 268829 - DNA, 25 bp, Homo sapien
attgtgccagttagccttcattttc

SEQ ID NO: 268830 - DNA, 25 bp, Homo sapien
gccttcattttctggcattataatg

SEQ ID NO: 268831 - DNA, 25 bp, Homo sapien
cgtttgtgattctgtagtatgttaa

SEQ ID NO: 268832 - DNA, 25 bp, Homo sapien
tgttaacaaaacatactccgttaat

SEQ ID NO: 268833 - DNA, 25 bp, Homo sapien
actggtgttgatcttttctgtggtg

SEQ ID NO: 268834 - DNA, 25 bp, Homo sapien
gatcttttctgtggtgctattattt

SEQ ID NO: 268835 - DNA, 25 bp, Homo sapien
gatagcttgaagcattattgtgaat

SEQ ID NO: 268836 - DNA, 25 bp, Homo sapien
aaagtaaaacaagatcacaccctgg

SEQ ID NO: 268837 - DNA, 25 bp, Homo sapien
aagtaaaacaagatcacaccctgga

SEQ ID NO: 268838 - DNA, 25 bp, Homo sapien
agtaaaacaagatcacaccctggaa

SEQ ID NO: 268839 - DNA, 25 bp, Homo sapien
gtaaaacaagatcacaccctggaac

SEQ ID NO: 268840 - DNA, 25 bp, Homo sapien
taaaacaagatcacaccctggaaca

SEQ ID NO: 268841 - DNA, 25 bp, Homo sapien
aaaacaagatcacaccctggaacaa

SEQ ID NO: 268842 - DNA, 25 bp, Homo sapien
aaacaagatcacaccctggaacaat

SEQ ID NO: 268843 - DNA, 25 bp, Homo sapien
aacaagatcacaccctggaacaatt

SEQ ID NO: 268844 - DNA, 25 bp, Homo sapien
caagatcacaccctggaacaattgg

SEQ ID NO: 268845 - DNA, 25 bp, Homo sapien
aagatcacaccctggaacaattgga

SEQ ID NO: 268846 - DNA, 25 bp, Homo sapien
agatcacaccctggaacaattggag

SEQ ID NO: 268847 - DNA, 25 bp, Homo sapien
tgaaggctacattcttgtcccacag

SEQ ID NO: 268848 - DNA, 25 bp, Homo sapien
atggcaagtggcatgctgactcaga

SEQ ID NO: 268849 - DNA, 25 bp, Homo sapien
agtggcatgctgactcagacaccgg

SEQ ID NO: 268850 - DNA, 25 bp, Homo sapien
atgctgactcagacaccgggcactg

SEQ ID NO: 268851 - DNA, 25 bp, Homo sapien
cagacaccgggcactgagaaaagtg

SEQ ID NO: 268852 - DNA, 25 bp, Homo sapien
tctggacctattcagtcctcaaggg

SEQ ID NO: 268853 - DNA, 25 bp, Homo sapien
tattcagtcctcaagggtgccctgc

SEQ ID NO: 268854 - DNA, 25 bp, Homo sapien
tcaagggtgccctgctaaaggctgg

SEQ ID NO: 268855 - DNA, 25 bp, Homo sapien
cctgctaaaggctgggctgaaagct

SEQ ID NO: 268856 - DNA, 25 bp, Homo sapien
agctaagaggagaggtggcattcaa

SEQ ID NO: 268857 - DNA, 25 bp, Homo sapien
tggcattcaatgtgtcctgtgtcct

SEQ ID NO: 268858 - DNA, 25 bp, Homo sapien
tctaagttaatactttttctcacct

SEQ ID NO: 268859 - DNA, 25 bp, Homo sapien
ttttctcaccttagatgtaatctac

SEQ ID NO: 268860 - DNA, 25 bp, Homo sapien
gggtatttttaattgactcttggat

SEQ ID NO: 268861 - DNA, 25 bp, Homo sapien
gatggttcaccatttctcgagtagg

SEQ ID NO: 268862 - DNA, 25 bp, Homo sapien
ccatttctcgagtaggattccttct

SEQ ID NO: 268863 - DNA, 25 bp, Homo sapien
agtaggattccttctgcaggtctca

SEQ ID NO: 268864 - DNA, 25 bp, Homo sapien
ttctgcaggtctcatgattcattct

SEQ ID NO: 268865 - DNA, 25 bp, Homo sapien
cattctgttttggtgagtttagcaa

SEQ ID NO: 268866 - DNA, 25 bp, Homo sapien
caaatttaaatcctatatgcctccc

SEQ ID NO: 268867 - DNA, 25 bp, Homo sapien
gcctctgcacatacatatacttggt

SEQ ID NO: 268868 - DNA, 25 bp, Homo sapien
tctgtttctaagacactatgaagac

SEQ ID NO: 268869 - DNA, 25 bp, Homo sapien
ttcctcttcttttccagattacagt

SEQ ID NO: 268870 - DNA, 25 bp, Homo sapien
gattacagtatgaagctttattttc

SEQ ID NO: 268871 - DNA, 25 bp, Homo sapien
ttctttgtacaagcttaaaatttca

SEQ ID NO: 268872 - DNA, 25 bp, Homo sapien
tcaacatcatcatccgccaaagttg

SEQ ID NO: 268873 - DNA, 25 bp, Homo sapien
atcatcatccgccaaagttgttcct

SEQ ID NO: 268874 - DNA, 25 bp, Homo sapien
gagacaaatcggtgtgccattgaca

SEQ ID NO: 268875 - DNA, 25 bp, Homo sapien
aaatcggtgtgccattgacaacatg

SEQ ID NO: 268876 - DNA, 25 bp, Homo sapien
ggtgtgccattgacaacatgagcca

SEQ ID NO: 268877 - DNA, 25 bp, Homo sapien
gccattgacaacatgagccagggta

SEQ ID NO: 268878 - DNA, 25 bp, Homo sapien
atgagccagggtaaaggcacccttt

SEQ ID NO: 268879 - DNA, 25 bp, Homo sapien
gagccagggtaaaggcaccctttgg

SEQ ID NO: 268880 - DNA, 25 bp, Homo sapien
agaagacccctgtcaaatgcacacg

SEQ ID NO: 268881 - DNA, 25 bp, Homo sapien
aatgcacacgcgttaaccacgtgtt

SEQ ID NO: 268882 - DNA, 25 bp, Homo sapien
gtgttacccaaggacgactcagtca

SEQ ID NO: 268883 - DNA, 25 bp, Homo sapien
gactcagtcatcctttaggactcgg

SEQ ID NO: 268884 - DNA, 25 bp, Homo sapien
tagcacagatgaacctggcactgag

SEQ ID NO: 268885 - DNA, 25 bp, Homo sapien
gggagatcttttggccgcaggtcat

SEQ ID NO: 268886 - DNA, 25 bp, Homo sapien
ggccgcaggtcatttaggatattgt

SEQ ID NO: 268887 - DNA, 25 bp, Homo sapien
gaacagccatggtttagtcacttat

SEQ ID NO: 268888 - DNA, 25 bp, Homo sapien
caaagcacttctcccaatgctgctg

SEQ ID NO: 268889 - DNA, 25 bp, Homo sapien
gaatcccgcccacgcgtgagaatca

SEQ ID NO: 268890 - DNA, 25 bp, Homo sapien
gagaatcaccccattattacagaag

SEQ ID NO: 268891 - DNA, 25 bp, Homo sapien
gtatggtgctttaaatactaatttt

SEQ ID NO: 268892 - DNA, 25 bp, Homo sapien
atatttcaagctttttgcagggtag

SEQ ID NO: 268893 - DNA, 25 bp, Homo sapien
tcaagctttttgcagggtagaaata

SEQ ID NO: 268894 - DNA, 25 bp, Homo sapien
ttttgcagggtagaaataagtggct

SEQ ID NO: 268895 - DNA, 25 bp, Homo sapien
taagtggctgttaaagaaaatatct

SEQ ID NO: 268896 - DNA, 25 bp, Homo sapien
gtgtccctttttaaaactcgatgat

SEQ ID NO: 268897 - DNA, 25 bp, Homo sapien
tttttaaaactcgatgatggctttc

SEQ ID NO: 268898 - DNA, 25 bp, Homo sapien
gtttttcagctccagttaaaactga

SEQ ID NO: 268899 - DNA, 25 bp, Homo sapien
aaaactgacaataggcagctatcaa

SEQ ID NO: 268900 - DNA, 25 bp, Homo sapien
gacaataggcagctatcaaaaatgg

SEQ ID NO: 268901 - DNA, 25 bp, Homo sapien
gtgctctttctggaatattagagga

SEQ ID NO: 268902 - DNA, 25 bp, Homo sapien
tgatcctctgtccctcaagctgtta

SEQ ID NO: 268903 - DNA, 25 bp, Homo sapien
atggattcagcatgcgcccagatct

SEQ ID NO: 268904 - DNA, 25 bp, Homo sapien
gattacccctttccactaggtgagc

SEQ ID NO: 268905 - DNA, 25 bp, Homo sapien
tttccactaggtgagctggaacctg

SEQ ID NO: 268906 - DNA, 25 bp, Homo sapien
ctggaacctgggaaactaatagagt

SEQ ID NO: 268907 - DNA, 25 bp, Homo sapien
tcagcatgcgcccagatctgtgtgc

SEQ ID NO: 268908 - DNA, 25 bp, Homo sapien
aagaataaactcaaagccggcaatg

SEQ ID NO: 268909 - DNA, 25 bp, Homo sapien
aaagccggcaatgccctggcatttt

SEQ ID NO: 268910 - DNA, 25 bp, Homo sapien
cctggcatttttgggtcttgagaga

SEQ ID NO: 268911 - DNA, 25 bp, Homo sapien
catgaacccgaagaaataccttggt

SEQ ID NO: 268912 - DNA, 25 bp, Homo sapien
accttggttccttttacacagatgc

SEQ ID NO: 268913 - DNA, 25 bp, Homo sapien
aagccaactaatagactctcagcca

SEQ ID NO: 268914 - DNA, 25 bp, Homo sapien
tctcagccattcagcagcatatcag

SEQ ID NO: 268915 - DNA, 25 bp, Homo sapien
attcagcagcatatcagatgactta

SEQ ID NO: 268916 - DNA, 25 bp, Homo sapien
agatgacttatttggcccatccgag

SEQ ID NO: 268917 - DNA, 25 bp, Homo sapien
ggcccatccgagtctgtgtagcaga

SEQ ID NO: 268918 - DNA, 25 bp, Homo sapien
gcagacaggtctatttaaactttca

SEQ ID NO: 268919 - DNA, 25 bp, Homo sapien
taaagttgcatctaaagtaccacag

SEQ ID NO: 268920 - DNA, 25 bp, Homo sapien
aagtaccacagatacaaccatgttt

SEQ ID NO: 268921 - DNA, 25 bp, Homo sapien
gatacaaccatgtttaaatcctcgt

SEQ ID NO: 268922 - DNA, 25 bp, Homo sapien
tttaaatcctcgtatgcactctggc

SEQ ID NO: 268923 - DNA, 25 bp, Homo sapien
tttccagtaaaaacatgaccagctt

SEQ ID NO: 268924 - DNA, 25 bp, Homo sapien
caccaagtagagctgtgttcagttt

SEQ ID NO: 268925 - DNA, 25 bp, Homo sapien
cagttttatctgatagtcgagtcat

SEQ ID NO: 268926 - DNA, 25 bp, Homo sapien
agtcgagtcattttgcaatggcact

SEQ ID NO: 268927 - DNA, 25 bp, Homo sapien
ttgcaatggcactggaatgctgtat

SEQ ID NO: 268928 - DNA, 25 bp, Homo sapien
gcactggaatgctgtatggagatga

SEQ ID NO: 268929 - DNA, 25 bp, Homo sapien
actaaacggcttttacaccacattg

SEQ ID NO: 268930 - DNA, 25 bp, Homo sapien
acggcttttacaccacattgttttg

SEQ ID NO: 268931 - DNA, 25 bp, Homo sapien
acaccacattgttttgagatagaaa

SEQ ID NO: 268932 - DNA, 25 bp, Homo sapien
gacattgaaatgtttacggtacatc

SEQ ID NO: 268933 - DNA, 25 bp, Homo sapien
tcaagaaatttaggcgcggcagctc

SEQ ID NO: 268934 - DNA, 25 bp, Homo sapien
gctcgcgcctgcaatacagctgaaa

SEQ ID NO: 268935 - DNA, 25 bp, Homo sapien
tgctgtctccagtggtcatagaagt

SEQ ID NO: 268936 - DNA, 25 bp, Homo sapien
tctctgtctttctcatacacactta

SEQ ID NO: 268937 - DNA, 25 bp, Homo sapien
tctgtctttctcatacacacttaca

SEQ ID NO: 268938 - DNA, 25 bp, Homo sapien
tctttctcatacacacttacacaca

SEQ ID NO: 268939 - DNA, 25 bp, Homo sapien
aattttcagagagtctactttcaga

SEQ ID NO: 268940 - DNA, 25 bp, Homo sapien
gaaaagccttcaggaatacatcatg

SEQ ID NO: 268941 - DNA, 25 bp, Homo sapien
agccttcaggaatacatcatgtaca

SEQ ID NO: 268942 - DNA, 25 bp, Homo sapien
gaatacatcatgtacaaaactgaga

SEQ ID NO: 268943 - DNA, 25 bp, Homo sapien
gagaaattacctgaagtatctttaa

SEQ ID NO: 268944 - DNA, 25 bp, Homo sapien
gcattgttttttgaacatcacactt

SEQ ID NO: 268945 - DNA, 25 bp, Homo sapien
gaacatcacacttgaaaagtacatg

SEQ ID NO: 268946 - DNA, 25 bp, Homo sapien
gcaggcaaagctcgatgctcaactc

SEQ ID NO: 268947 - DNA, 25 bp, Homo sapien
tcgatgctcaactccgggacaaaga

SEQ ID NO: 268948 - DNA, 25 bp, Homo sapien
caaagagttttacaggcccatccct

SEQ ID NO: 268949 - DNA, 25 bp, Homo sapien
caagctaacagatgggtaccctgct

SEQ ID NO: 268950 - DNA, 25 bp, Homo sapien
cagatgggtaccctgctttcaaaag

SEQ ID NO: 268951 - DNA, 25 bp, Homo sapien
aaaagaccccacatgactgccaaag

SEQ ID NO: 268952 - DNA, 25 bp, Homo sapien
atgactgccaaagacctgggactcc

SEQ ID NO: 268953 - DNA, 25 bp, Homo sapien
ggcttcttcccatcacaggaacatg

SEQ ID NO: 268954 - DNA, 25 bp, Homo sapien
atcacaggaacatgaggccacgagg

SEQ ID NO: 268955 - DNA, 25 bp, Homo sapien
gaggacgagcgcaagttcaccagca

SEQ ID NO: 268956 - DNA, 25 bp, Homo sapien
tggtcgactatcagccctacaggaa

SEQ ID NO: 268957 - DNA, 25 bp, Homo sapien
gtccgcctggggtggccgaacgtat

SEQ ID NO: 268958 - DNA, 25 bp, Homo sapien
gccgaacgtatggagctgggctcca

SEQ ID NO: 268959 - DNA, 25 bp, Homo sapien
ctgggctccagggtgcacggggatg

SEQ ID NO: 268960 - DNA, 25 bp, Homo sapien
cgcgggtgcccgagatctgactcac

SEQ ID NO: 268961 - DNA, 25 bp, Homo sapien
cgggtgcccgagatctgactcaccg

SEQ ID NO: 268962 - DNA, 25 bp, Homo sapien
gggtgcccgagatctgactcaccgt

SEQ ID NO: 268963 - DNA, 25 bp, Homo sapien
ggtgcccgagatctgactcaccgtc

SEQ ID NO: 268964 - DNA, 25 bp, Homo sapien
gtgcccgagatctgactcaccgtcc

SEQ ID NO: 268965 - DNA, 25 bp, Homo sapien
tgcccgagatctgactcaccgtccc

SEQ ID NO: 268966 - DNA, 25 bp, Homo sapien
tccgggcttagccggcggaggtggg

SEQ ID NO: 268967 - DNA, 25 bp, Homo sapien
gggcgggtgccgccgaggtagccac

SEQ ID NO: 268968 - DNA, 25 bp, Homo sapien
gtccgcctggggtggccgaacgtat

SEQ ID NO: 268969 - DNA, 25 bp, Homo sapien
gccgaacgtatggagctgggctcca

SEQ ID NO: 268970 - DNA, 25 bp, Homo sapien
ccgaacgtatggagctgggctccag

SEQ ID NO: 268971 - DNA, 25 bp, Homo sapien
ctgggctccagggtgcacggggatg

SEQ ID NO: 268972 - DNA, 25 bp, Homo sapien
cgcgggtgcccgagatctgactcac

SEQ ID NO: 268973 - DNA, 25 bp, Homo sapien
aggagcggggcgttctccctcccag

SEQ ID NO: 268974 - DNA, 25 bp, Homo sapien
cgggtgcccgagatctgactcaccg

SEQ ID NO: 268975 - DNA, 25 bp, Homo sapien
gggtgcccgagatctgactcaccgt

SEQ ID NO: 268976 - DNA, 25 bp, Homo sapien
ggtgcccgagatctgactcaccgtc

SEQ ID NO: 268977 - DNA, 25 bp, Homo sapien
gtgcccgagatctgactcaccgtcc

SEQ ID NO: 268978 - DNA, 25 bp, Homo sapien
gggcgggtgccgccgaggtagccac

SEQ ID NO: 268979 - DNA, 25 bp, Homo sapien
taatccctaatatcaactaaccaat

SEQ ID NO: 268980 - DNA, 25 bp, Homo sapien
aatgaaatgctgtacctcttgttgt

SEQ ID NO: 268981 - DNA, 25 bp, Homo sapien
gctgtacctcttgttgtatgagaag

SEQ ID NO: 268982 - DNA, 25 bp, Homo sapien
gtctatgagaatggcttttaactaa

SEQ ID NO: 268983 - DNA, 25 bp, Homo sapien
ggcttttaactaatcaacaccttga

SEQ ID NO: 268984 - DNA, 25 bp, Homo sapien
tcaacaccttgattaaccagtagaa

SEQ ID NO: 268985 - DNA, 25 bp, Homo sapien
tgatgattcgcttatgactgcctgt

SEQ ID NO: 268986 - DNA, 25 bp, Homo sapien
tgcctgtacctcaccgggacaaaat

SEQ ID NO: 268987 - DNA, 25 bp, Homo sapien
tacctcaccgggacaaaattgtggt

SEQ ID NO: 268988 - DNA, 25 bp, Homo sapien
ttagagagtctttagccacaaacag

SEQ ID NO: 268989 - DNA, 25 bp, Homo sapien
ataacaaccactggcttatattgca

SEQ ID NO: 268990 - DNA, 25 bp, Homo sapien
gaagtgacaaatcaaactcgctcaa

SEQ ID NO: 268991 - DNA, 25 bp, Homo sapien
tcaaactcgctcaataggtggtaat

SEQ ID NO: 268992 - DNA, 25 bp, Homo sapien
ttaaacttctggctctaaagcccag

SEQ ID NO: 268993 - DNA, 25 bp, Homo sapien
taaagcccagaataggttgtcaatg

SEQ ID NO: 268994 - DNA, 25 bp, Homo sapien
taggttgtcaatgggatttcacagt

SEQ ID NO: 268995 - DNA, 25 bp, Homo sapien
gggatttcacagtggctccctgaca

SEQ ID NO: 268996 - DNA, 25 bp, Homo sapien
gtggctccctgacactaagcaagga

SEQ ID NO: 268997 - DNA, 25 bp, Homo sapien
gcaaggatgtatttctacatctagt

SEQ ID NO: 268998 - DNA, 25 bp, Homo sapien
taaactctaataggattctcagaaa

SEQ ID NO: 268999 - DNA, 25 bp, Homo sapien
gggaagacctggcaattctgaaatc

SEQ ID NO: 269000 - DNA, 25 bp, Homo sapien
gttactaagtggatcatgactgctt

SEQ ID NO: 269001 - DNA, 25 bp, Homo sapien
tgtacattgtcccagactgtttgta

SEQ ID NO: 269002 - DNA, 25 bp, Homo sapien
ttgtcccagactgtttgtaaacatg

SEQ ID NO: 269003 - DNA, 25 bp, Homo sapien
tcagacatgtgtaaggtagacgcct

SEQ ID NO: 269004 - DNA, 25 bp, Homo sapien
aaggtagacgcctatggccactggc

SEQ ID NO: 269005 - DNA, 25 bp, Homo sapien
tatggccactggcttgaccaccttg

SEQ ID NO: 269006 - DNA, 25 bp, Homo sapien
actggcttgaccaccttggaagtca

SEQ ID NO: 269007 - DNA, 25 bp, Homo sapien
gaccaccttggaagtcaatgactat

SEQ ID NO: 269008 - DNA, 25 bp, Homo sapien
ataggtgtagtaactcatttcaagg

SEQ ID NO: 269009 - DNA, 25 bp, Homo sapien
atttttcatgagaatttgggactaa

SEQ ID NO: 269010 - DNA, 25 bp, Homo sapien
aatttgggactaaattgctgaacca

SEQ ID NO: 269011 - DNA, 25 bp, Homo sapien
gctgaaccaataaagctgaagagtt

SEQ ID NO: 269012 - DNA, 25 bp, Homo sapien
gtccttcctttctgggctgcttcat

SEQ ID NO: 269013 - DNA, 25 bp, Homo sapien
ggagtaaacgcccacttatctgttg

SEQ ID NO: 269014 - DNA, 25 bp, Homo sapien
aacgcccacttatctgttgcattta

SEQ ID NO: 269015 - DNA, 25 bp, Homo sapien
agctctgatatcgtcagctgttgcc

SEQ ID NO: 269016 - DNA, 25 bp, Homo sapien
tctgttgcatttacacacgtgttgt

SEQ ID NO: 269017 - DNA, 25 bp, Homo sapien
acacacgtgttgtattttatcaata

SEQ ID NO: 269018 - DNA, 25 bp, Homo sapien
attttatcaataaagccgctatgtc

SEQ ID NO: 269019 - DNA, 25 bp, Homo sapien
gccgctatgtcaacatgcttgcatt

SEQ ID NO: 269020 - DNA, 25 bp, Homo sapien
gcaatttccacatgcatggtctcat

SEQ ID NO: 269021 - DNA, 25 bp, Homo sapien
taatcattacaacaagctggaaagg

SEQ ID NO: 269022 - DNA, 25 bp, Homo sapien
agctgttgccagatccagaggcgtc

SEQ ID NO: 269023 - DNA, 25 bp, Homo sapien
gttggattccaagacctcctttcca

SEQ ID NO: 269024 - DNA, 25 bp, Homo sapien
cctcctttccagcttgttgtaatga

SEQ ID NO: 269025 - DNA, 25 bp, Homo sapien
atgagaccatgcatgtggaaattgc

SEQ ID NO: 269026 - DNA, 25 bp, Homo sapien
gcatgtggaaattgcattaactaat

SEQ ID NO: 269027 - DNA, 25 bp, Homo sapien
gcatgttgacatagcggctttattg

SEQ ID NO: 269028 - DNA, 25 bp, Homo sapien
acaacacgtgtgtaaatgcaacaga

SEQ ID NO: 269029 - DNA, 25 bp, Homo sapien
caacagataagtgggcgtttactcc

SEQ ID NO: 269030 - DNA, 25 bp, Homo sapien
gcgtttactcccctccatgaagcag

SEQ ID NO: 269031 - DNA, 25 bp, Homo sapien
agcagcccagaaaggaaggacgcag

SEQ ID NO: 269032 - DNA, 25 bp, Homo sapien
gaaggacgcagctgtgcgccctcct

SEQ ID NO: 269033 - DNA, 25 bp, Homo sapien
tagcgcatggtgcagaccccaccat

SEQ ID NO: 269034 - DNA, 25 bp, Homo sapien
gattcaattaactagatcttagctg

SEQ ID NO: 269035 - DNA, 25 bp, Homo sapien
attaactagatcttagctgactgat

SEQ ID NO: 269036 - DNA, 25 bp, Homo sapien
gatcttagctgactgatctcagaag

SEQ ID NO: 269037 - DNA, 25 bp, Homo sapien
cttagctgactgatctcagaaggtt

SEQ ID NO: 269038 - DNA, 25 bp, Homo sapien
gatctcagaaggtttcatgaaagaa

SEQ ID NO: 269039 - DNA, 25 bp, Homo sapien
aatgctttaaacatcttgatctagc

SEQ ID NO: 269040 - DNA, 25 bp, Homo sapien
aagtgtctctaaattggtgagatgt

SEQ ID NO: 269041 - DNA, 25 bp, Homo sapien
attggtgagatgttatctgtggaga

SEQ ID NO: 269042 - DNA, 25 bp, Homo sapien
tctgtggagacaaatgtaggattta

SEQ ID NO: 269043 - DNA, 25 bp, Homo sapien
gtaagagggtttattcaagagagat

SEQ ID NO: 269044 - DNA, 25 bp, Homo sapien
aagagagattatgactgggtgcagt

SEQ ID NO: 269045 - DNA, 25 bp, Homo sapien
gcatgttgacatagcggctttattg

SEQ ID NO: 269046 - DNA, 25 bp, Homo sapien
gacatagcggctttattgataaaat

SEQ ID NO: 269047 - DNA, 25 bp, Homo sapien
acaacacgtgtgtaaatgcaacaga

SEQ ID NO: 269048 - DNA, 25 bp, Homo sapien
acacgtgtgtaaatgcaacagataa

SEQ ID NO: 269049 - DNA, 25 bp, Homo sapien
caacagataagtgggcgtttactcc

SEQ ID NO: 269050 - DNA, 25 bp, Homo sapien
taagtgggcgtttactcccctccat

SEQ ID NO: 269051 - DNA, 25 bp, Homo sapien
tgggcgtttactcccctccatgaag

SEQ ID NO: 269052 - DNA, 25 bp, Homo sapien
gcgtttactcccctccatgaagcag

SEQ ID NO: 269053 - DNA, 25 bp, Homo sapien
gcagcccagaaaggaaggacgcagc

SEQ ID NO: 269054 - DNA, 25 bp, Homo sapien
gccctcctcctagcgcatggtgcag

SEQ ID NO: 269055 - DNA, 25 bp, Homo sapien
ccaccatgaagaaccaggaaggcca

SEQ ID NO: 269056 - DNA, 25 bp, Homo sapien
gtgaatatgatctccaaacccttat

SEQ ID NO: 269057 - DNA, 25 bp, Homo sapien
tatgatctccaaacccttatttttt

SEQ ID NO: 269058 - DNA, 25 bp, Homo sapien
aaatttccactcatggacgatgcaa

SEQ ID NO: 269059 - DNA, 25 bp, Homo sapien
ttccactcatggacgatgcaaccaa

SEQ ID NO: 269060 - DNA, 25 bp, Homo sapien
ggacgatgcaaccaacagatgcaat

SEQ ID NO: 269061 - DNA, 25 bp, Homo sapien
caacagatgcaatctctgagaagat

SEQ ID NO: 269062 - DNA, 25 bp, Homo sapien
gaagatgaaaattgggacctcttat

SEQ ID NO: 269063 - DNA, 25 bp, Homo sapien
tgggacctcttattataaaattgac

SEQ ID NO: 269064 - DNA, 25 bp, Homo sapien
ataaaattgacctagctggactcag

SEQ ID NO: 269065 - DNA, 25 bp, Homo sapien
tgacctagctggactcaggaaacca

SEQ ID NO: 269066 - DNA, 25 bp, Homo sapien
ccagggaagaagtcaatgcaggcat

SEQ ID NO: 269067 - DNA, 25 bp, Homo sapien
acaaatattttctggcacacacatt

SEQ ID NO: 269068 - DNA, 25 bp, Homo sapien
ggcacacacattaattcacagaaag

SEQ ID NO: 269069 - DNA, 25 bp, Homo sapien
agaacagtagtcacgtgggcacaat

SEQ ID NO: 269070 - DNA, 25 bp, Homo sapien
ggcacaatatttaaccctttcagat

SEQ ID NO: 269071 - DNA, 25 bp, Homo sapien
gatactgaggtttatcaccgcttga

SEQ ID NO: 269072 - DNA, 25 bp, Homo sapien
gtttatcaccgcttgatttcttagt

SEQ ID NO: 269073 - DNA, 25 bp, Homo sapien
gttgcagtttggtttcaggcaggat

SEQ ID NO: 269074 - DNA, 25 bp, Homo sapien
gcaggatttccaggctatcacagcc

SEQ ID NO: 269075 - DNA, 25 bp, Homo sapien
acagcctgctccgatggcatgatta

SEQ ID NO: 269076 - DNA, 25 bp, Homo sapien
gaaaaatcagtcttaacgctcagag

SEQ ID NO: 269077 - DNA, 25 bp, Homo sapien
acgctcagagataaataaccacatt

SEQ ID NO: 269078 - DNA, 25 bp, Homo sapien
gaggcagcaggagctacaatgcaga

SEQ ID NO: 269079 - DNA, 25 bp, Homo sapien
caatgcagaaaagccatggattaat

SEQ ID NO: 269080 - DNA, 25 bp, Homo sapien
aaagccatggattaataggaactga

SEQ ID NO: 269081 - DNA, 25 bp, Homo sapien
ataggaactgaagcgccgggagcca

SEQ ID NO: 269082 - DNA, 25 bp, Homo sapien
ctgaagcgccgggagccatgaagct

SEQ ID NO: 269083 - DNA, 25 bp, Homo sapien
agaaaaagccatgggctagcatcga

SEQ ID NO: 269084 - DNA, 25 bp, Homo sapien
ggcagaaagaagttagtcagtagca

SEQ ID NO: 269085 - DNA, 25 bp, Homo sapien
taagatcatgagacagtagaagcga

SEQ ID NO: 269086 - DNA, 25 bp, Homo sapien
agccagaaaggagttgagtcaccaa

SEQ ID NO: 269087 - DNA, 25 bp, Homo sapien
gaaaggagttgagtcaccaatttgg

SEQ ID NO: 269088 - DNA, 25 bp, Homo sapien
ggcaacatggcaacaggaatggaag

SEQ ID NO: 269089 - DNA, 25 bp, Homo sapien
actacctaagactggtgcacgtttg

SEQ ID NO: 269090 - DNA, 25 bp, Homo sapien
actggtgcacgtttggctggatgaa

SEQ ID NO: 269091 - DNA, 25 bp, Homo sapien
gagcagttttttcttcgaaagcctg

SEQ ID NO: 269092 - DNA, 25 bp, Homo sapien
tttttcttcgaaagcctggtctgaa

SEQ ID NO: 269093 - DNA, 25 bp, Homo sapien
agcctggtctgaaatatgtcaccta

SEQ ID NO: 269094 - DNA, 25 bp, Homo sapien
tgtcacctacggaaatattcgcgag

SEQ ID NO: 269095 - DNA, 25 bp, Homo sapien
attcgcgagcgtgttgagttaagga

SEQ ID NO: 269096 - DNA, 25 bp, Homo sapien
ttaaggaaacgactgggttgcaagt

SEQ ID NO: 269097 - DNA, 25 bp, Homo sapien
ggttgcaagtcatttcagtggtatt

SEQ ID NO: 269098 - DNA, 25 bp, Homo sapien
aatgtcttcccagagttggaggcat

SEQ ID NO: 269099 - DNA, 25 bp, Homo sapien
taagtttggaacatcgtggaattac

SEQ ID NO: 269100 - DNA, 25 bp, Homo sapien
gtgccacactgtgccaagggtgtta

SEQ ID NO: 269101 - DNA, 25 bp, Homo sapien
aagggtgttacataacatttctctt

SEQ ID NO: 269102 - DNA, 25 bp, Homo sapien
tgaggcaaatactgttctcgtcccc

SEQ ID NO: 269103 - DNA, 25 bp, Homo sapien
tgttctcgtccccattttgcagaag

SEQ ID NO: 269104 - DNA, 25 bp, Homo sapien
tgagctcaaaggtcacttggctagt

SEQ ID NO: 269105 - DNA, 25 bp, Homo sapien
ggctagtgtatagtcattagtgctg

SEQ ID NO: 269106 - DNA, 25 bp, Homo sapien
tgtctccaaatatttccggctctct

SEQ ID NO: 269107 - DNA, 25 bp, Homo sapien
gctctctgccttctggcacaaggta

SEQ ID NO: 269108 - DNA, 25 bp, Homo sapien
ctggcacaaggtaggactgcatgtt

SEQ ID NO: 269109 - DNA, 25 bp, Homo sapien
tgctgggtcctcattgtacacaaat

SEQ ID NO: 269110 - DNA, 25 bp, Homo sapien
tgtacacaaataccccgggcctcaa

SEQ ID NO: 269111 - DNA, 25 bp, Homo sapien
gaacacgctgtaggaagtctgaata

SEQ ID NO: 269112 - DNA, 25 bp, Homo sapien
cctcttgcctcaaccagaaacgaaa

SEQ ID NO: 269113 - DNA, 25 bp, Homo sapien
gaaagacgatgaccaccctttataa

SEQ ID NO: 269114 - DNA, 25 bp, Homo sapien
ttataaaacatcctcagcccttgtc

SEQ ID NO: 269115 - DNA, 25 bp, Homo sapien
ttgtccagccttgcgtggcatgaga

SEQ ID NO: 269116 - DNA, 25 bp, Homo sapien
aagaccttcaagcagtgtcactcct

SEQ ID NO: 269117 - DNA, 25 bp, Homo sapien
gcagtgtcactccttcgaacaaaga

SEQ ID NO: 269118 - DNA, 25 bp, Homo sapien
gggtcccacttatctgacagcagca

SEQ ID NO: 269119 - DNA, 25 bp, Homo sapien
atcctaccaaaatcccagtgacaaa

SEQ ID NO: 269120 - DNA, 25 bp, Homo sapien
gacacaggcgtgaaaagcagcttcc

SEQ ID NO: 269121 - DNA, 25 bp, Homo sapien
gcagcttcctgtcctggaaaaacca

SEQ ID NO: 269122 - DNA, 25 bp, Homo sapien
atgtacacacggtggcatcacttct

SEQ ID NO: 269123 - DNA, 25 bp, Homo sapien
gtggcatcacttcttaagctgtacc

SEQ ID NO: 269124 - DNA, 25 bp, Homo sapien
taagctgtacctccgagaacttcca

SEQ ID NO: 269125 - DNA, 25 bp, Homo sapien
gaacttccagaaccagttattcctt

SEQ ID NO: 269126 - DNA, 25 bp, Homo sapien
gaaccagttattccttatgcgaagt

SEQ ID NO: 269127 - DNA, 25 bp, Homo sapien
tttgtcatgtgccaaactgctcagc

SEQ ID NO: 269128 - DNA, 25 bp, Homo sapien
ggtgaagagtttgccagtggtaaat

SEQ ID NO: 269129 - DNA, 25 bp, Homo sapien
aagagggtctctttcgactgccagg

SEQ ID NO: 269130 - DNA, 25 bp, Homo sapien
tttcgactgccaggccaggctaatc

SEQ ID NO: 269131 - DNA, 25 bp, Homo sapien
gttaaggagctccaagatgcctttg

SEQ ID NO: 269132 - DNA, 25 bp, Homo sapien
gggagaagccatcatttgacagcaa

SEQ ID NO: 269133 - DNA, 25 bp, Homo sapien
tgctgtaaagatgcaaaagccctga

SEQ ID NO: 269134 - DNA, 25 bp, Homo sapien
aaagccctgaagcattatctgccaa

SEQ ID NO: 269135 - DNA, 25 bp, Homo sapien
gaagcattatctgccaaacctcagc

SEQ ID NO: 269136 - DNA, 25 bp, Homo sapien
tgggtaccacaggaccagcacagat

SEQ ID NO: 269137 - DNA, 25 bp, Homo sapien
gccctgaccatggttaggctgacat

SEQ ID NO: 269138 - DNA, 25 bp, Homo sapien
aggaccagcacagattgctccagca

SEQ ID NO: 269139 - DNA, 25 bp, Homo sapien
agattgctccagcacattgtccagc

SEQ ID NO: 269140 - DNA, 25 bp, Homo sapien
tccagccacgagacagaatttccct

SEQ ID NO: 269141 - DNA, 25 bp, Homo sapien
ttccctcttacagatccattgaata

SEQ ID NO: 269142 - DNA, 25 bp, Homo sapien
agatccattgaatagccctggcctg

SEQ ID NO: 269143 - DNA, 25 bp, Homo sapien
cattgaatagccctggcctgtgggt

SEQ ID NO: 269144 - DNA, 25 bp, Homo sapien
atggaattcttcagtacacatgctt

SEQ ID NO: 269145 - DNA, 25 bp, Homo sapien
gtggaaacattccacgctccgccag

SEQ ID NO: 269146 - DNA, 25 bp, Homo sapien
tccgccagcacgctcattaaagtga

SEQ ID NO: 269147 - DNA, 25 bp, Homo sapien
taaagtgatgatttgggttgcaaca

SEQ ID NO: 269148 - DNA, 25 bp, Homo sapien
agtgccaagtacttcctgtgttcaa

SEQ ID NO: 269149 - DNA, 25 bp, Homo sapien
caagtacttcctgtgttcaactggg

SEQ ID NO: 269150 - DNA, 25 bp, Homo sapien
ccatgtggcaagacccaaagcttcc

SEQ ID NO: 269151 - DNA, 25 bp, Homo sapien
aagcttccccagagatcctatggga

SEQ ID NO: 269152 - DNA, 25 bp, Homo sapien
taagttttttgagccaccatattcc

SEQ ID NO: 269153 - DNA, 25 bp, Homo sapien
tttcagcctaaaataacaccatggg

SEQ ID NO: 269154 - DNA, 25 bp, Homo sapien
gacatgctggaaggaatctttcttt

SEQ ID NO: 269155 - DNA, 25 bp, Homo sapien
gtatggtgctttaaatactaatttt

SEQ ID NO: 269156 - DNA, 25 bp, Homo sapien
atatttcaagctttttgcagggtag

SEQ ID NO: 269157 - DNA, 25 bp, Homo sapien
tcaagctttttgcagggtagaaata

SEQ ID NO: 269158 - DNA, 25 bp, Homo sapien
taagtggctgttaaagaaaatatct

SEQ ID NO: 269159 - DNA, 25 bp, Homo sapien
gaaggattatttcagtgtccctttt

SEQ ID NO: 269160 - DNA, 25 bp, Homo sapien
gtgtccctttttaaaactcgatgat

SEQ ID NO: 269161 - DNA, 25 bp, Homo sapien
tttttaaaactcgatgatggctttc

SEQ ID NO: 269162 - DNA, 25 bp, Homo sapien
gtttttcagctccagttaaaactga

SEQ ID NO: 269163 - DNA, 25 bp, Homo sapien
aaaactgacaataggcagctatcaa

SEQ ID NO: 269164 - DNA, 25 bp, Homo sapien
gaaaaaatcttgtgctctttctgga

SEQ ID NO: 269165 - DNA, 25 bp, Homo sapien
gtgctctttctggaatattagagga

SEQ ID NO: 269166 - DNA, 25 bp, Homo sapien
gagtgaaaacacctgccatctacaa

SEQ ID NO: 269167 - DNA, 25 bp, Homo sapien
ccatctacaaattacaaggctggat

SEQ ID NO: 269168 - DNA, 25 bp, Homo sapien
aaggctggataacagctcactccat

SEQ ID NO: 269169 - DNA, 25 bp, Homo sapien
aacagctcactccatttgaaattca

SEQ ID NO: 269170 - DNA, 25 bp, Homo sapien
aacccaagagctaggttcttactga

SEQ ID NO: 269171 - DNA, 25 bp, Homo sapien
gctaggttcttactgaatttgcatc

SEQ ID NO: 269172 - DNA, 25 bp, Homo sapien
gggaaactgaacttagctttcaaag

SEQ ID NO: 269173 - DNA, 25 bp, Homo sapien
aaactagggattattctggcaatgg

SEQ ID NO: 269174 - DNA, 25 bp, Homo sapien
gtgtatgcgtatgcaagaattcttg

SEQ ID NO: 269175 - DNA, 25 bp, Homo sapien
ttcactccatgaatgatctcttctg

SEQ ID NO: 269176 - DNA, 25 bp, Homo sapien
atgatctcttctgtaagtcagtgtg

SEQ ID NO: 269177 - DNA, 25 bp, Homo sapien
attagaggtccttgagtagaaccaa

SEQ ID NO: 269178 - DNA, 25 bp, Homo sapien
tagaaccaaggatgttttgaaggga

SEQ ID NO: 269179 - DNA, 25 bp, Homo sapien
gggaagggaagtttaagttatgcat

SEQ ID NO: 269180 - DNA, 25 bp, Homo sapien
gaaaaggaaatctagcatgtgaggg

SEQ ID NO: 269181 - DNA, 25 bp, Homo sapien
gggactaagtgttctcagagtgatg

SEQ ID NO: 269182 - DNA, 25 bp, Homo sapien
cagagtgatgttttaatccagtcca

SEQ ID NO: 269183 - DNA, 25 bp, Homo sapien
gtgatgttttaatccagtccaataa

SEQ ID NO: 269184 - DNA, 25 bp, Homo sapien
tccctccctgcgttttattaaatga

SEQ ID NO: 269185 - DNA, 25 bp, Homo sapien
gcactgggaggtgtaatacatcaca

SEQ ID NO: 269186 - DNA, 25 bp, Homo sapien
agaaaacgcatactttctgtgtcta

SEQ ID NO: 269187 - DNA, 25 bp, Homo sapien
ttctgtgtctacaaaagatactatg

SEQ ID NO: 269188 - DNA, 25 bp, Homo sapien
tcaatgcagtctacccatccaattt

SEQ ID NO: 269189 - DNA, 25 bp, Homo sapien
atgcagtctacccatccaatttttt

SEQ ID NO: 269190 - DNA, 25 bp, Homo sapien
gagacattttttcgtatcatcaata

SEQ ID NO: 269191 - DNA, 25 bp, Homo sapien
gtgagattggtaatatcaaccacaa

SEQ ID NO: 269192 - DNA, 25 bp, Homo sapien
ttaacagccatttcaagttattctt

SEQ ID NO: 269193 - DNA, 25 bp, Homo sapien
taaaaacgattttagtgtttgcatt

SEQ ID NO: 269194 - DNA, 25 bp, Homo sapien
tcaatattgcatatgctttccacta

SEQ ID NO: 269195 - DNA, 25 bp, Homo sapien
atatgctttccactatgttcttgaa

SEQ ID NO: 269196 - DNA, 25 bp, Homo sapien
gctttccactatgttcttgaaagtg

SEQ ID NO: 269197 - DNA, 25 bp, Homo sapien
gtatattttaaaggttcgcgagctt

SEQ ID NO: 269198 - DNA, 25 bp, Homo sapien
gttcgcgagcttgaaatggtatctt

SEQ ID NO: 269199 - DNA, 25 bp, Homo sapien
taattttacactcctgcctcaatgc

SEQ ID NO: 269200 - DNA, 25 bp, Homo sapien
tcaatgcagtctacccatccaattt

SEQ ID NO: 269201 - DNA, 25 bp, Homo sapien
atgcagtctacccatccaatttttt

SEQ ID NO: 269202 - DNA, 25 bp, Homo sapien
gagacattttttcgtatcatcaata

SEQ ID NO: 269203 - DNA, 25 bp, Homo sapien
gtgagattggtaatatcaaccacaa

SEQ ID NO: 269204 - DNA, 25 bp, Homo sapien
ttaacagccatttcaagttattctt

SEQ ID NO: 269205 - DNA, 25 bp, Homo sapien
acgattttagtgtttgcattttgtt

SEQ ID NO: 269206 - DNA, 25 bp, Homo sapien
tcaatattgcatatgctttccacta

SEQ ID NO: 269207 - DNA, 25 bp, Homo sapien
atatgctttccactatgttcttgaa

SEQ ID NO: 269208 - DNA, 25 bp, Homo sapien
gtatattttaaaggttcgcgagctt

SEQ ID NO: 269209 - DNA, 25 bp, Homo sapien
gttcgcgagcttgaaatggtatctt

SEQ ID NO: 269210 - DNA, 25 bp, Homo sapien
caagctgctctacaaagatcctgtt

SEQ ID NO: 269211 - DNA, 25 bp, Homo sapien
aagatcctgttccagcaagtaagag

SEQ ID NO: 269212 - DNA, 25 bp, Homo sapien
agaaccacttcatctggcagtttct

SEQ ID NO: 269213 - DNA, 25 bp, Homo sapien
gtttctcctgaagatactgttcagc

SEQ ID NO: 269214 - DNA, 25 bp, Homo sapien
agacactcttgcacgttttgcacga

SEQ ID NO: 269215 - DNA, 25 bp, Homo sapien
tgcacgttttgcacgatgaccaaag

SEQ ID NO: 269216 - DNA, 25 bp, Homo sapien
tgtagttgaagttgaggcgccctcc

SEQ ID NO: 269217 - DNA, 25 bp, Homo sapien
cgccctccatactgttctttgtggg

SEQ ID NO: 269218 - DNA, 25 bp, Homo sapien
ggacacgctgttcttttcggcaaaa

SEQ ID NO: 269219 - DNA, 25 bp, Homo sapien
agagtttttctacgaagttggtatg

SEQ ID NO: 269220 - DNA, 25 bp, Homo sapien
tggactattttgtgcaccaggacct

SEQ ID NO: 269221 - DNA, 25 bp, Homo sapien
atgtagctcccacaccagccttgag

SEQ ID NO: 269222 - DNA, 25 bp, Homo sapien
gaggccagagaaggcatcgaagcca

SEQ ID NO: 269223 - DNA, 25 bp, Homo sapien
gagaaggcatcgaagccaagacctg

SEQ ID NO: 269224 - DNA, 25 bp, Homo sapien
aggcatcgaagccaagacctgggcc

SEQ ID NO: 269225 - DNA, 25 bp, Homo sapien
gcatcgaagccaagacctgggccca

SEQ ID NO: 269226 - DNA, 25 bp, Homo sapien
ggaccctctgggaaaatgtggattt

SEQ ID NO: 269227 - DNA, 25 bp, Homo sapien
ctctgggaaaatgtggatttgagct

SEQ ID NO: 269228 - DNA, 25 bp, Homo sapien
atttgagctggtgagagtgttgcta

SEQ ID NO: 269229 - DNA, 25 bp, Homo sapien
tgttgctaaggctgggctaaagcct

SEQ ID NO: 269230 - DNA, 25 bp, Homo sapien
ctgggctaaagcctggagagggtag

SEQ ID NO: 269231 - DNA, 25 bp, Homo sapien
aggcagggctgatcctggcctctga

SEQ ID NO: 269232 - DNA, 25 bp, Homo sapien
tatccaaggacctgaaagaaagctt

SEQ ID NO: 269233 - DNA, 25 bp, Homo sapien
agttaaccaagctcaactggctcta

SEQ ID NO: 269234 - DNA, 25 bp, Homo sapien
actggctctaagttttgcaaggctt

SEQ ID NO: 269235 - DNA, 25 bp, Homo sapien
agaacaaatttcaagctgcagtctt

SEQ ID NO: 269236 - DNA, 25 bp, Homo sapien
ggagttatccaatgaagccctgaga

SEQ ID NO: 269237 - DNA, 25 bp, Homo sapien
gaagccctgagaaaaattctacgaa

SEQ ID NO: 269238 - DNA, 25 bp, Homo sapien
tacgaagggatcttccagtgacccg

SEQ ID NO: 269239 - DNA, 25 bp, Homo sapien
tccagtgacccgcactcttattgac

SEQ ID NO: 269240 - DNA, 25 bp, Homo sapien
gaagaatatttgtgcaagctcactt

SEQ ID NO: 269241 - DNA, 25 bp, Homo sapien
aagctcacttcttcaggtgtgtcaa

SEQ ID NO: 269242 - DNA, 25 bp, Homo sapien
ggtgtgtcaaccttcatattgaaat

SEQ ID NO: 269243 - DNA, 25 bp, Homo sapien
acctgcagccagatatcgttagaaa

SEQ ID NO: 269244 - DNA, 25 bp, Homo sapien
atatattcctatcactcctgttttc

SEQ ID NO: 269245 - DNA, 25 bp, Homo sapien
atcactcctgttttcactttaatag

SEQ ID NO: 269246 - DNA, 25 bp, Homo sapien
atagaaggctgttgcagtactgcat

SEQ ID NO: 269247 - DNA, 25 bp, Homo sapien
gcagtactgcatgatgggctcttat

SEQ ID NO: 269248 - DNA, 25 bp, Homo sapien
gattccatacaacagattgcttgcc

SEQ ID NO: 269249 - DNA, 25 bp, Homo sapien
gctaattcttatctttgtgacagga

SEQ ID NO: 269250 - DNA, 25 bp, Homo sapien
gacaggattgtttgacactgagcaa

SEQ ID NO: 269251 - DNA, 25 bp, Homo sapien
ttgcttgcctgggttagtgcttatt

SEQ ID NO: 269252 - DNA, 25 bp, Homo sapien
ttttaagttcttggtgcttcttgtc

SEQ ID NO: 269253 - DNA, 25 bp, Homo sapien
ttcttgtctgacttctgtatttgca

SEQ ID NO: 269254 - DNA, 25 bp, Homo sapien
cgggcctcagagcagattttagttc

SEQ ID NO: 269255 - DNA, 25 bp, Homo sapien
gttcatctttcatttcaaagcactc

SEQ ID NO: 269256 - DNA, 25 bp, Homo sapien
aagcactccttagatatctgcaaat

SEQ ID NO: 269257 - DNA, 25 bp, Homo sapien
taatttggtgaggacgcccagcttc

SEQ ID NO: 269258 - DNA, 25 bp, Homo sapien
gcccagcttcccaaataacaaggct

SEQ ID NO: 269259 - DNA, 25 bp, Homo sapien
ggcttttcctttgattctaaccaag

SEQ ID NO: 269260 - DNA, 25 bp, Homo sapien
attctaaccaagtgagccggccctg

SEQ ID NO: 269261 - DNA, 25 bp, Homo sapien
gggacttgcgtttcagatcagatga

SEQ ID NO: 269262 - DNA, 25 bp, Homo sapien
ttttcatgtatgtccagcagcaaga

SEQ ID NO: 269263 - DNA, 25 bp, Homo sapien
gcaagagagtccttcactggtgaaa

SEQ ID NO: 269264 - DNA, 25 bp, Homo sapien
actggtgaaaaatcacgggcctcag

SEQ ID NO: 269265 - DNA, 25 bp, Homo sapien
tagcatgattttatagagttttgat

SEQ ID NO: 269266 - DNA, 25 bp, Homo sapien
gctttttgatagttacctagtttgc

SEQ ID NO: 269267 - DNA, 25 bp, Homo sapien
aagcagttctaaatagctatttcag

SEQ ID NO: 269268 - DNA, 25 bp, Homo sapien
gatagttacctagtttgcaaaagat

SEQ ID NO: 269269 - DNA, 25 bp, Homo sapien
gaagtgctgaaagaagggccaacta

SEQ ID NO: 269270 - DNA, 25 bp, Homo sapien
aagaagggccaactaaattaggatg

SEQ ID NO: 269271 - DNA, 25 bp, Homo sapien
gaattggcctgggtttaggacctat

SEQ ID NO: 269272 - DNA, 25 bp, Homo sapien
ttggcctgggtttaggacctatgta

SEQ ID NO: 269273 - DNA, 25 bp, Homo sapien
gtttaggacctatgtatgaaggcca

SEQ ID NO: 269274 - DNA, 25 bp, Homo sapien
aacatcacaacccaaaatacttagc

SEQ ID NO: 269275 - DNA, 25 bp, Homo sapien
acaacccaaaatacttagcatgatt

SEQ ID NO: 269276 - DNA, 25 bp, Homo sapien
gcctgtttattgtgctaattctggt

SEQ ID NO: 269277 - DNA, 25 bp, Homo sapien
agacgcaatcttctcctccaggcat

SEQ ID NO: 269278 - DNA, 25 bp, Homo sapien
agggcattcagactggactcctgta

SEQ ID NO: 269279 - DNA, 25 bp, Homo sapien
ctccaggcatggaagtgtgtctgca

SEQ ID NO: 269280 - DNA, 25 bp, Homo sapien
aagtgtgtctgcaactgggcatcca

SEQ ID NO: 269281 - DNA, 25 bp, Homo sapien
tgtgctgccccgaacgggctcttaa

SEQ ID NO: 269282 - DNA, 25 bp, Homo sapien
cgaacgggctcttaacaggtgggca

SEQ ID NO: 269283 - DNA, 25 bp, Homo sapien
ggactcctgtacctcgctggagaga

SEQ ID NO: 269284 - DNA, 25 bp, Homo sapien
ctcgctggagagaggcttctctcat

SEQ ID NO: 269285 - DNA, 25 bp, Homo sapien
gagaggcttctctcattcgccggaa

SEQ ID NO: 269286 - DNA, 25 bp, Homo sapien
ctgcagggcctgtttattgtgctaa

SEQ ID NO: 269287 - DNA, 25 bp, Homo sapien
ggaaaaaacatctgctctcttgtca

SEQ ID NO: 269288 - DNA, 25 bp, Homo sapien
aaacatctgctctcttgtcaggact

SEQ ID NO: 269289 - DNA, 25 bp, Homo sapien
tgtcaggacttttctgtctccagga

SEQ ID NO: 269290 - DNA, 25 bp, Homo sapien
aggacttttctgtctccaggagctt

SEQ ID NO: 269291 - DNA, 25 bp, Homo sapien
tgtctccaggagcttctcaactttg

SEQ ID NO: 269292 - DNA, 25 bp, Homo sapien
caggagcttctcaactttgcagata

SEQ ID NO: 269293 - DNA, 25 bp, Homo sapien
tctcaactttgcagatactctagaa

SEQ ID NO: 269294 - DNA, 25 bp, Homo sapien
tactctagaatggtattgcatgcaa

SEQ ID NO: 269295 - DNA, 25 bp, Homo sapien
attgcatgcaaaataatgaccgcca

SEQ ID NO: 269296 - DNA, 25 bp, Homo sapien
ataatgaccgccaagatgttcctgc

SEQ ID NO: 269297 - DNA, 25 bp, Homo sapien
gatgttcctgccctaatccccagaa

SEQ ID NO: 269298 - DNA, 25 bp, Homo sapien
ctgcaccttttaaagtggctccaaa

SEQ ID NO: 269299 - DNA, 25 bp, Homo sapien
ccaaatagatcagggtggtaggcgc

SEQ ID NO: 269300 - DNA, 25 bp, Homo sapien
tggtaggcgcgagtgcagggagctg

SEQ ID NO: 269301 - DNA, 25 bp, Homo sapien
ggagctgcgaagttggaagattact

SEQ ID NO: 269302 - DNA, 25 bp, Homo sapien
ccgctcgcggctttgcagaaaacaa

SEQ ID NO: 269303 - DNA, 25 bp, Homo sapien
ggaagattactgcttttcaaactgc

SEQ ID NO: 269304 - DNA, 25 bp, Homo sapien
gattactgcttttcaaactgccaaa

SEQ ID NO: 269305 - DNA, 25 bp, Homo sapien
tactgcttttcaaactgccaaagag

SEQ ID NO: 269306 - DNA, 25 bp, Homo sapien
gctcgcggctttgcagaaaacaaat

SEQ ID NO: 269307 - DNA, 25 bp, Homo sapien
gcttttcaaactgccaaagagcaaa

SEQ ID NO: 269308 - DNA, 25 bp, Homo sapien
aataatgacacacttctctggaagc

SEQ ID NO: 269309 - DNA, 25 bp, Homo sapien
ccccttggagaagctttacgatcag

SEQ ID NO: 269310 - DNA, 25 bp, Homo sapien
tttacgatcaggacaagcacgacga

SEQ ID NO: 269311 - DNA, 25 bp, Homo sapien
aggacaagcacgacgatcttcacca

SEQ ID NO: 269312 - DNA, 25 bp, Homo sapien
caccacctgggcactattatcaaaa

SEQ ID NO: 269313 - DNA, 25 bp, Homo sapien
ctcaagtgtgagtggtcaatcatct

SEQ ID NO: 269314 - DNA, 25 bp, Homo sapien
ggtcaatcatcttttgtgacatccc

SEQ ID NO: 269315 - DNA, 25 bp, Homo sapien
gacaacatagaaatgcttcctcatt

SEQ ID NO: 269316 - DNA, 25 bp, Homo sapien
attatgagccaattccattcagttc

SEQ ID NO: 269317 - DNA, 25 bp, Homo sapien
tatgaatgaatctgctcccactggt

SEQ ID NO: 269318 - DNA, 25 bp, Homo sapien
tgctcccactggtattactgatcat

SEQ ID NO: 269319 - DNA, 25 bp, Homo sapien
gtattactgatcatattgtccaagg

SEQ ID NO: 269320 - DNA, 25 bp, Homo sapien
tttctcagacttcctcagcgcagga

SEQ ID NO: 269321 - DNA, 25 bp, Homo sapien
cagacttcctcagcgcaggatgtaa

SEQ ID NO: 269322 - DNA, 25 bp, Homo sapien
tcagcgcaggatgtaaatagcacta

SEQ ID NO: 269323 - DNA, 25 bp, Homo sapien
atagcactaacgatcgactggaaca

SEQ ID NO: 269324 - DNA, 25 bp, Homo sapien
gactggaacaaagtgaccgctgtgt

SEQ ID NO: 269325 - DNA, 25 bp, Homo sapien
gaccgctgtgtaaaactactgcctt

SEQ ID NO: 269326 - DNA, 25 bp, Homo sapien
tgtaaaactactgccttgccactca

SEQ ID NO: 269327 - DNA, 25 bp, Homo sapien
ccttgccactcactgttgtatacat

SEQ ID NO: 269328 - DNA, 25 bp, Homo sapien
cactcactgttgtatacatttctta

SEQ ID NO: 269329 - DNA, 25 bp, Homo sapien
gtgtatttcacatttcttggacttt

SEQ ID NO: 269330 - DNA, 25 bp, Homo sapien
ctgttattcagtgatgcattttgta

SEQ ID NO: 269331 - DNA, 25 bp, Homo sapien
tgggtttaggtcatcattttaaaat

SEQ ID NO: 269332 - DNA, 25 bp, Homo sapien
ggagatgaatcaacttatagaccca

SEQ ID NO: 269333 - DNA, 25 bp, Homo sapien
tatagacccatattttccttctaaa

SEQ ID NO: 269334 - DNA, 25 bp, Homo sapien
tttgaataacatgccagtgacccag

SEQ ID NO: 269335 - DNA, 25 bp, Homo sapien
ataacatgccagtgacccagcaggt

SEQ ID NO: 269336 - DNA, 25 bp, Homo sapien
gacccagcaggtccaagatggctaa

SEQ ID NO: 269337 - DNA, 25 bp, Homo sapien
gcaggtccaagatggctaaccaaga

SEQ ID NO: 269338 - DNA, 25 bp, Homo sapien
aataacttacttttaccctcacatg

SEQ ID NO: 269339 - DNA, 25 bp, Homo sapien
cttttaccctcacatggaaagttgg

SEQ ID NO: 269340 - DNA, 25 bp, Homo sapien
ggaaagttggtatctattgctaaat

SEQ ID NO: 269341 - DNA, 25 bp, Homo sapien
gtcactctgacagtctttgacactg

SEQ ID NO: 269342 - DNA, 25 bp, Homo sapien
agccaggacgcagctacgcggtgct

SEQ ID NO: 269343 - DNA, 25 bp, Homo sapien
acgcggtgctgttgggcatcatctt

SEQ ID NO: 269344 - DNA, 25 bp, Homo sapien
cggcggttgcgctcgtctatgtgct

SEQ ID NO: 269345 - DNA, 25 bp, Homo sapien
tctatgtgctgctgcgccgcaggaa

SEQ ID NO: 269346 - DNA, 25 bp, Homo sapien
tgctgcgccgcaggaagggcaacac

SEQ ID NO: 269347 - DNA, 25 bp, Homo sapien
gggtgcacagccctgatgggagcag

SEQ ID NO: 269348 - DNA, 25 bp, Homo sapien
agcagcttggctgtgagcaccaggc

SEQ ID NO: 269349 - DNA, 25 bp, Homo sapien
tggctgtgagcaccaggccaagact

SEQ ID NO: 269350 - DNA, 25 bp, Homo sapien
gaacaggcagcccagtcctgcgact

SEQ ID NO: 269351 - DNA, 25 bp, Homo sapien
ccaggaccagacacctgggacctgg

SEQ ID NO: 269352 - DNA, 25 bp, Homo sapien
atacttgatacctgggcatttaacc

SEQ ID NO: 269353 - DNA, 25 bp, Homo sapien
tttcaagctactccgggtgacccca

SEQ ID NO: 269354 - DNA, 25 bp, Homo sapien
gggtgaccccagaactcatctgaac

SEQ ID NO: 269355 - DNA, 25 bp, Homo sapien
accccagaactcatctgaactcaga

SEQ ID NO: 269356 - DNA, 25 bp, Homo sapien
tcatctgaactcagaagcccaagag

SEQ ID NO: 269357 - DNA, 25 bp, Homo sapien
agcccaagagtttcattcctctcac

SEQ ID NO: 269358 - DNA, 25 bp, Homo sapien
caagagtttcattcctctcacttta

SEQ ID NO: 269359 - DNA, 25 bp, Homo sapien
gagtttcattcctctcactttaggg

SEQ ID NO: 269360 - DNA, 25 bp, Homo sapien
acttccaccttcagcttgtattaca

SEQ ID NO: 269361 - DNA, 25 bp, Homo sapien
ttccaccttcagcttgtattacaac

SEQ ID NO: 269362 - DNA, 25 bp, Homo sapien
acaaaaccagcctttcaagctactc

SEQ ID NO: 269363 - DNA, 25 bp, Homo sapien
agcctttcaagctactccgggtgac

SEQ ID NO: 269364 - DNA, 25 bp, Homo sapien
gctcagtgctgggtgcaggtaggca

SEQ ID NO: 269365 - DNA, 25 bp, Homo sapien
accgtttgccttcatggatggtcat

SEQ ID NO: 269366 - DNA, 25 bp, Homo sapien
gatggtcatgtccatccagccgaag

SEQ ID NO: 269367 - DNA, 25 bp, Homo sapien
tgctggaagccattcatgtcctcgg

SEQ ID NO: 269368 - DNA, 25 bp, Homo sapien
aagccattcatgtcctcggtgagcg

SEQ ID NO: 269369 - DNA, 25 bp, Homo sapien
tcatgtcctcggtgagcgggtagcc

SEQ ID NO: 269370 - DNA, 25 bp, Homo sapien
tggcctccaggaatgcgcagtgcag

SEQ ID NO: 269371 - DNA, 25 bp, Homo sapien
tgtggctctggccattcttgacata

SEQ ID NO: 269372 - DNA, 25 bp, Homo sapien
tggccattcttgacatactccacgc

SEQ ID NO: 269373 - DNA, 25 bp, Homo sapien
acgggtgccctcaaatagcaccctg

SEQ ID NO: 269374 - DNA, 25 bp, Homo sapien
aatagcaccctgctcacaagcgtct

SEQ ID NO: 269375 - DNA, 25 bp, Homo sapien
gcgtggaggcgttaagcgcatctca

SEQ ID NO: 269376 - DNA, 25 bp, Homo sapien
gcgttaagcgcatctcaggccttat

SEQ ID NO: 269377 - DNA, 25 bp, Homo sapien
ctcaggccttatatacgaggagaca

SEQ ID NO: 269378 - DNA, 25 bp, Homo sapien
atacgaggagacacgcggagttctt

SEQ ID NO: 269379 - DNA, 25 bp, Homo sapien
gacacgcggagttcttaaagtgttt

SEQ ID NO: 269380 - DNA, 25 bp, Homo sapien
gtttttggagaatgtaatccgcgat

SEQ ID NO: 269381 - DNA, 25 bp, Homo sapien
cgcgatgcagttacctacacggagc

SEQ ID NO: 269382 - DNA, 25 bp, Homo sapien
accctgtatggctttggcggctgag

SEQ ID NO: 269383 - DNA, 25 bp, Homo sapien
ctttggcggctgagtgttttactta

SEQ ID NO: 269384 - DNA, 25 bp, Homo sapien
ccgcaaagttctgcgcgacaacatt

SEQ ID NO: 269385 - DNA, 25 bp, Homo sapien
agttctgcgcgacaacattcagggc

SEQ ID NO: 269386 - DNA, 25 bp, Homo sapien
tccctcaaatgtaggaaatacctgt

SEQ ID NO: 269387 - DNA, 25 bp, Homo sapien
gtgagtggcttcttagcccatcagt

SEQ ID NO: 269388 - DNA, 25 bp, Homo sapien
ggcttcttagcccatcagtaaagtt

SEQ ID NO: 269389 - DNA, 25 bp, Homo sapien
agtaaagttatcacaccttggcctc

SEQ ID NO: 269390 - DNA, 25 bp, Homo sapien
gaaatagtcactgagcactggatgc

SEQ ID NO: 269391 - DNA, 25 bp, Homo sapien
actgagcactggatgctaggtggca

SEQ ID NO: 269392 - DNA, 25 bp, Homo sapien
tgctaggtggcaggttttttctttc

SEQ ID NO: 269393 - DNA, 25 bp, Homo sapien
gccatcatactttaatatctttcag

SEQ ID NO: 269394 - DNA, 25 bp, Homo sapien
aatatctttcagcactgtcaggtta

SEQ ID NO: 269395 - DNA, 25 bp, Homo sapien
agcactgtcaggttatcttctggct

SEQ ID NO: 269396 - DNA, 25 bp, Homo sapien
gtcaggttatcttctggcttctatt

SEQ ID NO: 269397 - DNA, 25 bp, Homo sapien
tggccagagggcaccatccaagtgg

SEQ ID NO: 269398 - DNA, 25 bp, Homo sapien
agggcaccatccaagtggccggcag

SEQ ID NO: 269399 - DNA, 25 bp, Homo sapien
cggcagttctaggagggcattcagt

SEQ ID NO: 269400 - DNA, 25 bp, Homo sapien
gagggcattcagttccccgtaccat

SEQ ID NO: 269401 - DNA, 25 bp, Homo sapien
ggatgcgggtcggttgcctctctct

SEQ ID NO: 269402 - DNA, 25 bp, Homo sapien
ctctcacttgctctgcatttgtgaa

SEQ ID NO: 269403 - DNA, 25 bp, Homo sapien
aaacaaaaggtatgccctccactct

SEQ ID NO: 269404 - DNA, 25 bp, Homo sapien
tgccctccactctgtgttatcagat

SEQ ID NO: 269405 - DNA, 25 bp, Homo sapien
actctgtgttatcagatgcccgccc

SEQ ID NO: 269406 - DNA, 25 bp, Homo sapien
actctgtgttatcagtcttggttga

SEQ ID NO: 269407 - DNA, 25 bp, Homo sapien
tcagtcttggttgagctgtttgggc

SEQ ID NO: 269408 - DNA, 25 bp, Homo sapien
aggactctggcttccggagagtctg

SEQ ID NO: 269409 - DNA, 25 bp, Homo sapien
tggcttccggagagtctggcccctg

SEQ ID NO: 269410 - DNA, 25 bp, Homo sapien
ccccagctcatgtgctagttcatag

SEQ ID NO: 269411 - DNA, 25 bp, Homo sapien
cagctcatgtgctagttcataggga

SEQ ID NO: 269412 - DNA, 25 bp, Homo sapien
ctagttcatagggagcaggaagcag

SEQ ID NO: 269413 - DNA, 25 bp, Homo sapien
gactgagaggaggtcctgatacagt

SEQ ID NO: 269414 - DNA, 25 bp, Homo sapien
gtcctgatacagtggaagagtccct

SEQ ID NO: 269415 - DNA, 25 bp, Homo sapien
acagtggaagagtcccttcttctgt

SEQ ID NO: 269416 - DNA, 25 bp, Homo sapien
aagagtcccttcttctgttgctgag

SEQ ID NO: 269417 - DNA, 25 bp, Homo sapien
ttctgttgctgagcgtggtagccta

SEQ ID NO: 269418 - DNA, 25 bp, Homo sapien
tgctgcttttcttgcttcaataaag

SEQ ID NO: 269419 - DNA, 25 bp, Homo sapien
cggaatgactaactcaggatcacat

SEQ ID NO: 269420 - DNA, 25 bp, Homo sapien
taactcaggatcacatactggcagt

SEQ ID NO: 269421 - DNA, 25 bp, Homo sapien
tcaggatcacatactggcagtggga

SEQ ID NO: 269422 - DNA, 25 bp, Homo sapien
ggagcagctgccatcaattgccagg

SEQ ID NO: 269423 - DNA, 25 bp, Homo sapien
ctgccatcaattgccagggccaagt

SEQ ID NO: 269424 - DNA, 25 bp, Homo sapien
ccaagtggatgataggatggatgct

SEQ ID NO: 269425 - DNA, 25 bp, Homo sapien
gatgctggtgcatgcggaggaggca

SEQ ID NO: 269426 - DNA, 25 bp, Homo sapien
aggaggcagacgcaacgctcatctc

SEQ ID NO: 269427 - DNA, 25 bp, Homo sapien
gacgcaacgctcatctctaataatg

SEQ ID NO: 269428 - DNA, 25 bp, Homo sapien
ctaataatgatgtctgttccctcag

SEQ ID NO: 269429 - DNA, 25 bp, Homo sapien
atgatgtctgttccctcagaggcgg

SEQ ID NO: 269430 - DNA, 25 bp, Homo sapien
aatcggaggtaattgaagcgtgcac

SEQ ID NO: 269431 - DNA, 25 bp, Homo sapien
gcgtgcacaaaccacagagacttat

SEQ ID NO: 269432 - DNA, 25 bp, Homo sapien
acaaggattgactgatacgaaacta

SEQ ID NO: 269433 - DNA, 25 bp, Homo sapien
aaagctggaaatcagattcctccaa

SEQ ID NO: 269434 - DNA, 25 bp, Homo sapien
gattcctccaagaaaccttgcacag

SEQ ID NO: 269435 - DNA, 25 bp, Homo sapien
gacgggttattgcaatcttttctga

SEQ ID NO: 269436 - DNA, 25 bp, Homo sapien
aatacagggtctttcataatggcac

SEQ ID NO: 269437 - DNA, 25 bp, Homo sapien
cataatggcactgagtttgacttta

SEQ ID NO: 269438 - DNA, 25 bp, Homo sapien
tgcttcaatagcatttcccagtaaa

SEQ ID NO: 269439 - DNA, 25 bp, Homo sapien
ttcccagtaaataggagtgactctg

SEQ ID NO: 269440 - DNA, 25 bp, Homo sapien
gactctggtatctcgtttgtgaatc

SEQ ID NO: 269441 - DNA, 25 bp, Homo sapien
gtctgaatcgcacagggcagtgttt

SEQ ID NO: 269442 - DNA, 25 bp, Homo sapien
acagggcagtgtttgaccagcctca

SEQ ID NO: 269443 - DNA, 25 bp, Homo sapien
tgatggtgcccgctttaatcgtgtc

SEQ ID NO: 269444 - DNA, 25 bp, Homo sapien
tgcccgctttaatcgtgtcccaaaa

SEQ ID NO: 269445 - DNA, 25 bp, Homo sapien
aaattattgccatcatccagcgagg

SEQ ID NO: 269446 - DNA, 25 bp, Homo sapien
gaggccaagagacatttctttccag

SEQ ID NO: 269447 - DNA, 25 bp, Homo sapien
atatggccaaccctcctttgaaaat

SEQ ID NO: 269448 - DNA, 25 bp, Homo sapien
ttctccaagaaacagggaggcccta

SEQ ID NO: 269449 - DNA, 25 bp, Homo sapien
tcagaagcccacaccgccaggtgga

SEQ ID NO: 269450 - DNA, 25 bp, Homo sapien
tggagggctcagtgcagacagcctt

SEQ ID NO: 269451 - DNA, 25 bp, Homo sapien
gggccagtgtgtgtctgaatcgcac

SEQ ID NO: 269452 - DNA, 25 bp, Homo sapien
agaaaggagaagtgctaagaaacca

SEQ ID NO: 269453 - DNA, 25 bp, Homo sapien
gaaaggagaagtgctaagaaaccaa

SEQ ID NO: 269454 - DNA, 25 bp, Homo sapien
aaaggagaagtgctaagaaaccaag

SEQ ID NO: 269455 - DNA, 25 bp, Homo sapien
aaggagaagtgctaagaaaccaagg

SEQ ID NO: 269456 - DNA, 25 bp, Homo sapien
aggagaagtgctaagaaaccaagga

SEQ ID NO: 269457 - DNA, 25 bp, Homo sapien
ggagaagtgctaagaaaccaaggaa

SEQ ID NO: 269458 - DNA, 25 bp, Homo sapien
gagaagtgctaagaaaccaaggaac

SEQ ID NO: 269459 - DNA, 25 bp, Homo sapien
agaagtgctaagaaaccaaggaaca

SEQ ID NO: 269460 - DNA, 25 bp, Homo sapien
gaagtgctaagaaaccaaggaacag

SEQ ID NO: 269461 - DNA, 25 bp, Homo sapien
agaaaccaaggaacaggccaggcgc

SEQ ID NO: 269462 - DNA, 25 bp, Homo sapien
tgaggcatgtaaatcacttgaggtc

SEQ ID NO: 269463 - DNA, 25 bp, Homo sapien
gggctcttcaatgaccaaaggccat

SEQ ID NO: 269464 - DNA, 25 bp, Homo sapien
gaccaaaggccataagagactggaa

SEQ ID NO: 269465 - DNA, 25 bp, Homo sapien
agactggaaggcaaaaggacccatt

SEQ ID NO: 269466 - DNA, 25 bp, Homo sapien
aggacccattaatgtaatccaaaca

SEQ ID NO: 269467 - DNA, 25 bp, Homo sapien
tgtaatccaaacatcagtctcctgc

SEQ ID NO: 269468 - DNA, 25 bp, Homo sapien
atcagtctcctgcagcaaagaggtg

SEQ ID NO: 269469 - DNA, 25 bp, Homo sapien
agagtagctgtggacgagtgaaaaa

SEQ ID NO: 269470 - DNA, 25 bp, Homo sapien
gagtgaaaaagacatcgcaccatgt

SEQ ID NO: 269471 - DNA, 25 bp, Homo sapien
gacatcgcaccatgtcttcaaatta

SEQ ID NO: 269472 - DNA, 25 bp, Homo sapien
gtcttcaaattacatccagcaactt

SEQ ID NO: 269473 - DNA, 25 bp, Homo sapien
ggtacagaaggaagaccatgtgaaa

SEQ ID NO: 269474 - DNA, 25 bp, Homo sapien
gctgttaatatgaagtggccagtta

SEQ ID NO: 269475 - DNA, 25 bp, Homo sapien
aagtggccagttacatagcccaggg

SEQ ID NO: 269476 - DNA, 25 bp, Homo sapien
gggtgcttctctccgtaaaatagct

SEQ ID NO: 269477 - DNA, 25 bp, Homo sapien
tctctccgtaaaatagctgctgctc

SEQ ID NO: 269478 - DNA, 25 bp, Homo sapien
ctagtaattgtatgtgatggtccac

SEQ ID NO: 269479 - DNA, 25 bp, Homo sapien
gctgctccagcccattacattaggc

SEQ ID NO: 269480 - DNA, 25 bp, Homo sapien
cattacattaggctgtggcttctgg

SEQ ID NO: 269481 - DNA, 25 bp, Homo sapien
ggacaaggtttgacaagcgatgctg

SEQ ID NO: 269482 - DNA, 25 bp, Homo sapien
aattcttttgctccttgtaacactc

SEQ ID NO: 269483 - DNA, 25 bp, Homo sapien
gaggaaaatgccttttacctgtggg

SEQ ID NO: 269484 - DNA, 25 bp, Homo sapien
gtgtatctataggtcacttagctgt

SEQ ID NO: 269485 - DNA, 25 bp, Homo sapien
aatacttgttttactgagaacagaa

SEQ ID NO: 269486 - DNA, 25 bp, Homo sapien
aggaccagccctctctagattgctg

SEQ ID NO: 269487 - DNA, 25 bp, Homo sapien
gccctctctagattgctggaattgt

SEQ ID NO: 269488 - DNA, 25 bp, Homo sapien
ttgctggaattgtatggatgtgttg

SEQ ID NO: 269489 - DNA, 25 bp, Homo sapien
gggttggtttagtgatctcttcctt

SEQ ID NO: 269490 - DNA, 25 bp, Homo sapien
tggtttagtgatctcttccttgaca

SEQ ID NO: 269491 - DNA, 25 bp, Homo sapien
tagtgatctcttccttgacacccta

SEQ ID NO: 269492 - DNA, 25 bp, Homo sapien
tcttccttgacaccctagcaaagat

SEQ ID NO: 269493 - DNA, 25 bp, Homo sapien
cttgacaccctagcaaagatgcttt

SEQ ID NO: 269494 - DNA, 25 bp, Homo sapien
gatgcttttgtggagtgcaaacctt

SEQ ID NO: 269495 - DNA, 25 bp, Homo sapien
gtggagtgcaaacctttcataaata

SEQ ID NO: 269496 - DNA, 25 bp, Homo sapien
gaacatatgttttttgggggcacac

SEQ ID NO: 269497 - DNA, 25 bp, Homo sapien
acttcaaccctccggagggcctgtg

SEQ ID NO: 269498 - DNA, 25 bp, Homo sapien
tgtgccccaaagagagcctccttct

SEQ ID NO: 269499 - DNA, 25 bp, Homo sapien
aaagagagcctccttctgtgtgcag

SEQ ID NO: 269500 - DNA, 25 bp, Homo sapien
agagagcctccttctgtgtgcagtg

SEQ ID NO: 269501 - DNA, 25 bp, Homo sapien
agagcctccttctgtgtgcagtgaa

SEQ ID NO: 269502 - DNA, 25 bp, Homo sapien
gagcctccttctgtgtgcagtgaag

SEQ ID NO: 269503 - DNA, 25 bp, Homo sapien
gaaggtgtgagttctaaacatgaga

SEQ ID NO: 269504 - DNA, 25 bp, Homo sapien
acaccccttgttcttggatagggtg

SEQ ID NO: 269505 - DNA, 25 bp, Homo sapien
cttgttcttggatagggtgactcga

SEQ ID NO: 269506 - DNA, 25 bp, Homo sapien
tgttcttggatagggtgactcgata

SEQ ID NO: 269507 - DNA, 25 bp, Homo sapien
aggtaatttagatgtatctgtacat

SEQ ID NO: 269508 - DNA, 25 bp, Homo sapien
atgtatacagatgaagagcgttgag

SEQ ID NO: 269509 - DNA, 25 bp, Homo sapien
ggatgctagaggaatgtgcccacac

SEQ ID NO: 269510 - DNA, 25 bp, Homo sapien
gaggaatgtgcccacacacatctca

SEQ ID NO: 269511 - DNA, 25 bp, Homo sapien
cagcagcatggccaaaatcagaaag

SEQ ID NO: 269512 - DNA, 25 bp, Homo sapien
ggccaaaatcagaaagatgtcactt

SEQ ID NO: 269513 - DNA, 25 bp, Homo sapien
gatgtcactttgatccagttcttgt

SEQ ID NO: 269514 - DNA, 25 bp, Homo sapien
atccagttcttgtttaccttatcct

SEQ ID NO: 269515 - DNA, 25 bp, Homo sapien
agttcttgtttaccttatcctgctg

SEQ ID NO: 269516 - DNA, 25 bp, Homo sapien
ttgtttaccttatcctgctgtggcg

SEQ ID NO: 269517 - DNA, 25 bp, Homo sapien
cctgctgtggcgctgattttgtcgt

SEQ ID NO: 269518 - DNA, 25 bp, Homo sapien
gtgtcacagagatcattaaaccatg

SEQ ID NO: 269519 - DNA, 25 bp, Homo sapien
aaaccatgtgatgatccaaaaagtg

SEQ ID NO: 269520 - DNA, 25 bp, Homo sapien
aaaacctgtcagagtacctgctgaa

SEQ ID NO: 269521 - DNA, 25 bp, Homo sapien
gagtacctgctgaaccacaaacaat

SEQ ID NO: 269522 - DNA, 25 bp, Homo sapien
acctgctgaaccacaaacaatgagt

SEQ ID NO: 269523 - DNA, 25 bp, Homo sapien
aatgagtgttcttatcagctgtaca

SEQ ID NO: 269524 - DNA, 25 bp, Homo sapien
agctgtacaacctgccatagtgaat

SEQ ID NO: 269525 - DNA, 25 bp, Homo sapien
gccatagtgaatttccatctcggaa

SEQ ID NO: 269526 - DNA, 25 bp, Homo sapien
tttttgaccatctaaaggccacagg

SEQ ID NO: 269527 - DNA, 25 bp, Homo sapien
ctaaaggccacaggtcatgcaagag

SEQ ID NO: 269528 - DNA, 25 bp, Homo sapien
gagcaccttcatcatcgtctttaaa

SEQ ID NO: 269529 - DNA, 25 bp, Homo sapien
catagagaagagtgattttgttttt

SEQ ID NO: 269530 - DNA, 25 bp, Homo sapien
gacttgattctgtagaaatatacta

SEQ ID NO: 269531 - DNA, 25 bp, Homo sapien
agtaatttagatagtggatagccac

SEQ ID NO: 269532 - DNA, 25 bp, Homo sapien
agtggatagccactttcctatcttt

SEQ ID NO: 269533 - DNA, 25 bp, Homo sapien
tagccactttcctatctttctctta

SEQ ID NO: 269534 - DNA, 25 bp, Homo sapien
tcctatctttctcttatccatatga

SEQ ID NO: 269535 - DNA, 25 bp, Homo sapien
atctttctcttatccatatgaatgt

SEQ ID NO: 269536 - DNA, 25 bp, Homo sapien
gttgttacaacttatgattttctaa

SEQ ID NO: 269537 - DNA, 25 bp, Homo sapien
gattttctaaactagctgtgattta

SEQ ID NO: 269538 - DNA, 25 bp, Homo sapien
agctgtgatttataatgacatcctg

SEQ ID NO: 269539 - DNA, 25 bp, Homo sapien
gtgatttataatgacatcctgagaa

SEQ ID NO: 269540 - DNA, 25 bp, Homo sapien
gagaagctcccatttaggaatgaat

SEQ ID NO: 269541 - DNA, 25 bp, Homo sapien
aactgtccttgggttacactaccat

SEQ ID NO: 269542 - DNA, 25 bp, Homo sapien
ggttacactaccatttattgggaca

SEQ ID NO: 269543 - DNA, 25 bp, Homo sapien
gggacaagccccagaggcagtattt

SEQ ID NO: 269544 - DNA, 25 bp, Homo sapien
gcagtatttgatttcctcaggcccc

SEQ ID NO: 269545 - DNA, 25 bp, Homo sapien
tcaggccccactctaggacaggagg

SEQ ID NO: 269546 - DNA, 25 bp, Homo sapien
ggacaggaggcaccatctatttcag

SEQ ID NO: 269547 - DNA, 25 bp, Homo sapien
atctatttcagccttctgctgcctt

SEQ ID NO: 269548 - DNA, 25 bp, Homo sapien
gggcaccacagacatcaagattcca

SEQ ID NO: 269549 - DNA, 25 bp, Homo sapien
agacatcaagattccagttcatcca

SEQ ID NO: 269550 - DNA, 25 bp, Homo sapien
agggtcgttgacagcaggttctgca

SEQ ID NO: 269551 - DNA, 25 bp, Homo sapien
agctgtacaacctgccatagtgaat

SEQ ID NO: 269552 - DNA, 25 bp, Homo sapien
gctgtacaacctgccatagtgaatt

SEQ ID NO: 269553 - DNA, 25 bp, Homo sapien
tacaacctgccatagtgaatttcca

SEQ ID NO: 269554 - DNA, 25 bp, Homo sapien
atagtgaatttccatctcggaataa

SEQ ID NO: 269555 - DNA, 25 bp, Homo sapien
gtgaatttccatctcggaataaact

SEQ ID NO: 269556 - DNA, 25 bp, Homo sapien
tttccatctcggaataaactttttg

SEQ ID NO: 269557 - DNA, 25 bp, Homo sapien
tttttgaccatctaaaggccacagg

SEQ ID NO: 269558 - DNA, 25 bp, Homo sapien
ttgaccatctaaaggccacaggtca

SEQ ID NO: 269559 - DNA, 25 bp, Homo sapien
agagcaccttcatcatcgtctttaa

SEQ ID NO: 269560 - DNA, 25 bp, Homo sapien
gcaccttcatcatcgtctttaaaca

SEQ ID NO: 269561 - DNA, 25 bp, Homo sapien
accttcatcatcgtctttaaacagc

SEQ ID NO: 269562 - DNA, 25 bp, Homo sapien
aggaaatgagcaacttactgaagaa

SEQ ID NO: 269563 - DNA, 25 bp, Homo sapien
gagagactgctaaagttcagcatag

SEQ ID NO: 269564 - DNA, 25 bp, Homo sapien
ggagcaaagtgcaatactgatactt

SEQ ID NO: 269565 - DNA, 25 bp, Homo sapien
caacaagagtcaattttacagagat

SEQ ID NO: 269566 - DNA, 25 bp, Homo sapien
gacaaccaattcaaagtaacttatg

SEQ ID NO: 269567 - DNA, 25 bp, Homo sapien
aggaggattaagtagccagctgaaa

SEQ ID NO: 269568 - DNA, 25 bp, Homo sapien
gtagccagctgaaagcaattagaga

SEQ ID NO: 269569 - DNA, 25 bp, Homo sapien
agagaaataattgaattgcccctca

SEQ ID NO: 269570 - DNA, 25 bp, Homo sapien
tgaattgcccctcaaacagcctgag

SEQ ID NO: 269571 - DNA, 25 bp, Homo sapien
acagcctgagcttttcaagagttat

SEQ ID NO: 269572 - DNA, 25 bp, Homo sapien
gatgtcttcagtttattgcacccaa

SEQ ID NO: 269573 - DNA, 25 bp, Homo sapien
ggtctctgagtgtaggattcttgaa

SEQ ID NO: 269574 - DNA, 25 bp, Homo sapien
ggattcttgaacctgctgatttgca

SEQ ID NO: 269575 - DNA, 25 bp, Homo sapien
gatttgcatttcacctgtagttcta

SEQ ID NO: 269576 - DNA, 25 bp, Homo sapien
tgcatttcacctgtagttctacagt

SEQ ID NO: 269577 - DNA, 25 bp, Homo sapien
atcaaagcttctaatacaacgttgc

SEQ ID NO: 269578 - DNA, 25 bp, Homo sapien
tacaacgttgctagagccatggctt

SEQ ID NO: 269579 - DNA, 25 bp, Homo sapien
gccatggcttggaaataaatcagga

SEQ ID NO: 269580 - DNA, 25 bp, Homo sapien
ggtctttcctgtttgtggacaagca

SEQ ID NO: 269581 - DNA, 25 bp, Homo sapien
caggcagagttcagggtcatgggct

SEQ ID NO: 269582 - DNA, 25 bp, Homo sapien
atgggctagggcagtcatgcctagt

SEQ ID NO: 269583 - DNA, 25 bp, Homo sapien
gcagtcatgcctagtggtctctgag

SEQ ID NO: 269584 - DNA, 25 bp, Homo sapien
attcttggggtttctgtggccggca

SEQ ID NO: 269585 - DNA, 25 bp, Homo sapien
cggcaccctgcgtcctgggtgtgaa

SEQ ID NO: 269586 - DNA, 25 bp, Homo sapien
gcagcctcttcacagaaaccagagc

SEQ ID NO: 269587 - DNA, 25 bp, Homo sapien
tcctctatctaccagagaccttctg

SEQ ID NO: 269588 - DNA, 25 bp, Homo sapien
agccccacctcaggtggctaatgag

SEQ ID NO: 269589 - DNA, 25 bp, Homo sapien
agaaaacctcagagaacaccctcca

SEQ ID NO: 269590 - DNA, 25 bp, Homo sapien
agaaaccagagccgcgctcttcctg

SEQ ID NO: 269591 - DNA, 25 bp, Homo sapien
tcttcctgctgtcaggcaacaacag

SEQ ID NO: 269592 - DNA, 25 bp, Homo sapien
gtcaggcaacaacagctcagcacag

SEQ ID NO: 269593 - DNA, 25 bp, Homo sapien
caggcaacaacagctcagcacaggg

SEQ ID NO: 269594 - DNA, 25 bp, Homo sapien
gacacacaatagatgtcctctgaat

SEQ ID NO: 269595 - DNA, 25 bp, Homo sapien
tgctcgattcttccctaggagatcc

SEQ ID NO: 269596 - DNA, 25 bp, Homo sapien
gaacatatgttttttgggggcacac

SEQ ID NO: 269597 - DNA, 25 bp, Homo sapien
acttcaaccctccggagggcctgtg

SEQ ID NO: 269598 - DNA, 25 bp, Homo sapien
tgtgccccaaagagagcctccttct

SEQ ID NO: 269599 - DNA, 25 bp, Homo sapien
aaagagagcctccttctgtgtgcag

SEQ ID NO: 269600 - DNA, 25 bp, Homo sapien
gagcctccttctgtgtgcagtgaag

SEQ ID NO: 269601 - DNA, 25 bp, Homo sapien
gaaggtgtgagttctaaacatgaga

SEQ ID NO: 269602 - DNA, 25 bp, Homo sapien
acaccccttgttcttggatagggtg

SEQ ID NO: 269603 - DNA, 25 bp, Homo sapien
cttgttcttggatagggtgactcga

SEQ ID NO: 269604 - DNA, 25 bp, Homo sapien
tgttcttggatagggtgactcgata

SEQ ID NO: 269605 - DNA, 25 bp, Homo sapien
aaagcgccacagactgagcggctta

SEQ ID NO: 269606 - DNA, 25 bp, Homo sapien
tgggatcacagggttgtggcatcac

SEQ ID NO: 269607 - DNA, 25 bp, Homo sapien
atcacagggttgtggcatcacagct

SEQ ID NO: 269608 - DNA, 25 bp, Homo sapien
ggcatcacagctggctatattctta

SEQ ID NO: 269609 - DNA, 25 bp, Homo sapien
tcacagctggctatattcttaacat

SEQ ID NO: 269610 - DNA, 25 bp, Homo sapien
agctggctatattcttaacattatt

SEQ ID NO: 269611 - DNA, 25 bp, Homo sapien
taacattattttgtaaccattccaa

SEQ ID NO: 269612 - DNA, 25 bp, Homo sapien
gaaatttctctctggctgacttgat

SEQ ID NO: 269613 - DNA, 25 bp, Homo sapien
tctctctggctgacttgatccacag

SEQ ID NO: 269614 - DNA, 25 bp, Homo sapien
tggctgacttgatccacagcgcctc

SEQ ID NO: 269615 - DNA, 25 bp, Homo sapien
gacgcacatgagacagcatctcgta

SEQ ID NO: 269616 - DNA, 25 bp, Homo sapien
acatgagacagcatctcgtatgttg

SEQ ID NO: 269617 - DNA, 25 bp, Homo sapien
tggagcccagcaatgtgtgtcctga

SEQ ID NO: 269618 - DNA, 25 bp, Homo sapien
atgtgtgtcctgacaagtccacgcg

SEQ ID NO: 269619 - DNA, 25 bp, Homo sapien
cggttctcaaagtatggtctcagga

SEQ ID NO: 269620 - DNA, 25 bp, Homo sapien
ccccagtgctggctagggttgcaaa

SEQ ID NO: 269621 - DNA, 25 bp, Homo sapien
ggttgcaaagccactgctctacgga

SEQ ID NO: 269622 - DNA, 25 bp, Homo sapien
tacggagcgagcgagatccatcata

SEQ ID NO: 269623 - DNA, 25 bp, Homo sapien
gcgagaggatgaggccatacagacc

SEQ ID NO: 269624 - DNA, 25 bp, Homo sapien
gtctcaggactagcagcgtcgaaaa

SEQ ID NO: 269625 - DNA, 25 bp, Homo sapien
aaatgctgggaactcgttagaaaag

SEQ ID NO: 269626 - DNA, 25 bp, Homo sapien
aagcaagttttcaatcctcgcccca

SEQ ID NO: 269627 - DNA, 25 bp, Homo sapien
aatcctcgccccagaatcagaaact

SEQ ID NO: 269628 - DNA, 25 bp, Homo sapien
tgaaggtgtttcctaatctccctga

SEQ ID NO: 269629 - DNA, 25 bp, Homo sapien
gacaccaggaataatctagggctca

SEQ ID NO: 269630 - DNA, 25 bp, Homo sapien
atctagggctcattagagatgtcaa

SEQ ID NO: 269631 - DNA, 25 bp, Homo sapien
gatctgttctagtttcttaacctaa

SEQ ID NO: 269632 - DNA, 25 bp, Homo sapien
caagagtgttttagttccattttat

SEQ ID NO: 269633 - DNA, 25 bp, Homo sapien
gggagtctgagccaaacatgttatg

SEQ ID NO: 269634 - DNA, 25 bp, Homo sapien
aacatgttatgtcactttccaagtc

SEQ ID NO: 269635 - DNA, 25 bp, Homo sapien
ctttccaagtctccatagcacagaa

SEQ ID NO: 269636 - DNA, 25 bp, Homo sapien
gtctccatagcacagaagtcttctg

SEQ ID NO: 269637 - DNA, 25 bp, Homo sapien
gtcagtttcatgaatagatcttact

SEQ ID NO: 269638 - DNA, 25 bp, Homo sapien
aagcattcattgaggtttttggcaa

SEQ ID NO: 269639 - DNA, 25 bp, Homo sapien
gtttttctaaatctggcaatcctac

SEQ ID NO: 269640 - DNA, 25 bp, Homo sapien
tggcaatcctacagctgtggtcatg

SEQ ID NO: 269641 - DNA, 25 bp, Homo sapien
ctacagctgtggtcatgggaaatca

SEQ ID NO: 269642 - DNA, 25 bp, Homo sapien
tgggaaatcacctacagcatgttaa

SEQ ID NO: 269643 - DNA, 25 bp, Homo sapien
ttaaagtcctctagtcatcatctcg

SEQ ID NO: 269644 - DNA, 25 bp, Homo sapien
tagtcatcatctcgtcacctgaaat

SEQ ID NO: 269645 - DNA, 25 bp, Homo sapien
tcgtcacctgaaatggaagtccttt

SEQ ID NO: 269646 - DNA, 25 bp, Homo sapien
ctgcctggtgggtttctatttaaga

SEQ ID NO: 269647 - DNA, 25 bp, Homo sapien
aacctgcaattgtgctttggcttaa

SEQ ID NO: 269648 - DNA, 25 bp, Homo sapien
gtgctttggcttaatgtctagctca

SEQ ID NO: 269649 - DNA, 25 bp, Homo sapien
gtctagctcactgtacttgtaaatg

SEQ ID NO: 269650 - DNA, 25 bp, Homo sapien
tgacccctgatctacggaggcctgc

SEQ ID NO: 269651 - DNA, 25 bp, Homo sapien
gaccgtgcgggcaccagtgcagtgc

SEQ ID NO: 269652 - DNA, 25 bp, Homo sapien
ccagtgcagtgctgccttggttcct

SEQ ID NO: 269653 - DNA, 25 bp, Homo sapien
gcagtgctgccttggttcctggacc

SEQ ID NO: 269654 - DNA, 25 bp, Homo sapien
aagcagacagcgagacccccagcgg

SEQ ID NO: 269655 - DNA, 25 bp, Homo sapien
cctcggcactccaggcttataattt

SEQ ID NO: 269656 - DNA, 25 bp, Homo sapien
ggcactccaggcttataatttcgaa

SEQ ID NO: 269657 - DNA, 25 bp, Homo sapien
aggcttataatttcgaactcttctg

SEQ ID NO: 269658 - DNA, 25 bp, Homo sapien
taatttcgaactcttctggaaggtc

SEQ ID NO: 269659 - DNA, 25 bp, Homo sapien
ttcgaactcttctggaaggtcactc

SEQ ID NO: 269660 - DNA, 25 bp, Homo sapien
tggaaggtcactcaggaacaccctc

SEQ ID NO: 269661 - DNA, 25 bp, Homo sapien
ttcatttttgtaagtgtgcctccca

SEQ ID NO: 269662 - DNA, 25 bp, Homo sapien
tttttgtaagtgtgcctcccacctg

SEQ ID NO: 269663 - DNA, 25 bp, Homo sapien
attgttcttgtttatgactctgcct

SEQ ID NO: 269664 - DNA, 25 bp, Homo sapien
tgtttatgactctgccttttatggt

SEQ ID NO: 269665 - DNA, 25 bp, Homo sapien
tgactctgccttttatggtgatgtt

SEQ ID NO: 269666 - DNA, 25 bp, Homo sapien
aatgttcagctactagagagaaaaa

SEQ ID NO: 269667 - DNA, 25 bp, Homo sapien
gatgttgatcattttagtccttcga

SEQ ID NO: 269668 - DNA, 25 bp, Homo sapien
tttagtccttcgatcatagcactgt

SEQ ID NO: 269669 - DNA, 25 bp, Homo sapien
gtccttcgatcatagcactgtatca

SEQ ID NO: 269670 - DNA, 25 bp, Homo sapien
gatcatagcactgtatcatcttaaa

SEQ ID NO: 269671 - DNA, 25 bp, Homo sapien
gtcagagacctatcagactgagaat

SEQ ID NO: 269672 - DNA, 25 bp, Homo sapien
ttttttgccttgattcgagcctcac

SEQ ID NO: 269673 - DNA, 25 bp, Homo sapien
ttgattcgagcctcaccctggcctt

SEQ ID NO: 269674 - DNA, 25 bp, Homo sapien
tctcctgtggctgagcaggcctctg

SEQ ID NO: 269675 - DNA, 25 bp, Homo sapien
tgagcaggcctctgtgtccatgaca

SEQ ID NO: 269676 - DNA, 25 bp, Homo sapien
gggctgtgggtgtatgtcctcccta

SEQ ID NO: 269677 - DNA, 25 bp, Homo sapien
tgtgggtgtatgtcctccctactgg

SEQ ID NO: 269678 - DNA, 25 bp, Homo sapien
ggtgtatgtcctccctactggcttc

SEQ ID NO: 269679 - DNA, 25 bp, Homo sapien
atgatgctcttggaactcttcccca

SEQ ID NO: 269680 - DNA, 25 bp, Homo sapien
ggaactcttccccaaggagtcagtc

SEQ ID NO: 269681 - DNA, 25 bp, Homo sapien
gagtcagtcccccaggcctatcagg

SEQ ID NO: 269682 - DNA, 25 bp, Homo sapien
atcaggggatccttttgtatctgca

SEQ ID NO: 269683 - DNA, 25 bp, Homo sapien
ccccaccaagatgaatgctggctgg

SEQ ID NO: 269684 - DNA, 25 bp, Homo sapien
gctgcctccaggtgaaagtgtcacc

SEQ ID NO: 269685 - DNA, 25 bp, Homo sapien
ggtgaaagtgtcaccagctctggtg

SEQ ID NO: 269686 - DNA, 25 bp, Homo sapien
tggactccaggagccacaattgtgt

SEQ ID NO: 269687 - DNA, 25 bp, Homo sapien
gagccacaattgtgtgtaggcacta

SEQ ID NO: 269688 - DNA, 25 bp, Homo sapien
taggcactaggcttctgttgggtgt

SEQ ID NO: 269689 - DNA, 25 bp, Homo sapien
ttgggtgtttggatggtgcatttat

SEQ ID NO: 269690 - DNA, 25 bp, Homo sapien
gtgcatttatatttacccacggtaa

SEQ ID NO: 269691 - DNA, 25 bp, Homo sapien
atttggtcaagcttcatgccttgca

SEQ ID NO: 269692 - DNA, 25 bp, Homo sapien
gtgagccattcaagtgccacttaag

SEQ ID NO: 269693 - DNA, 25 bp, Homo sapien
agtgccacttaagtgcagatgttta

SEQ ID NO: 269694 - DNA, 25 bp, Homo sapien
gggaaaattagctgattcatagaaa

SEQ ID NO: 269695 - DNA, 25 bp, Homo sapien
taaattcagtgtggcatcagttctt

SEQ ID NO: 269696 - DNA, 25 bp, Homo sapien
cagtgtggcatcagttcttaatact

SEQ ID NO: 269697 - DNA, 25 bp, Homo sapien
taatactgagaaagattagcctgca

SEQ ID NO: 269698 - DNA, 25 bp, Homo sapien
aagattagcctgcagattcagaaaa

SEQ ID NO: 269699 - DNA, 25 bp, Homo sapien
gaaacatttctccactcagaatttt

SEQ ID NO: 269700 - DNA, 25 bp, Homo sapien
gaattttgatcatcctagtccctta

SEQ ID NO: 269701 - DNA, 25 bp, Homo sapien
gatcatcctagtcccttacccaaaa

SEQ ID NO: 269702 - DNA, 25 bp, Homo sapien
ttactgcagtgattgatgtgtccat

SEQ ID NO: 269703 - DNA, 25 bp, Homo sapien
gatgtgtccatattaactttcatgt

SEQ ID NO: 269704 - DNA, 25 bp, Homo sapien
aacatttcgaaatatgggtcaagtc

SEQ ID NO: 269705 - DNA, 25 bp, Homo sapien
gtttccataacaagcagctctgact

SEQ ID NO: 269706 - DNA, 25 bp, Homo sapien
agctctgactagttctgtatcccca

SEQ ID NO: 269707 - DNA, 25 bp, Homo sapien
tgtatccccaggcactagcatggtc

SEQ ID NO: 269708 - DNA, 25 bp, Homo sapien
atacttgtttcctaagctttcctgc

SEQ ID NO: 269709 - DNA, 25 bp, Homo sapien
gtttctgggccagagtacctagaag

SEQ ID NO: 269710 - DNA, 25 bp, Homo sapien
gaaggcttgggccttaaccctgtag

SEQ ID NO: 269711 - DNA, 25 bp, Homo sapien
gtagcactcagttgcctttggtaga

SEQ ID NO: 269712 - DNA, 25 bp, Homo sapien
ggtagactactcattctggtcttca

SEQ ID NO: 269713 - DNA, 25 bp, Homo sapien
gcatttgccaccttaagcagagtca

SEQ ID NO: 269714 - DNA, 25 bp, Homo sapien
gagtcaagttcagttctcctggtgc

SEQ ID NO: 269715 - DNA, 25 bp, Homo sapien
aggtatcttaggctggattcccctc

SEQ ID NO: 269716 - DNA, 25 bp, Homo sapien
atgtagctcccacaccagccttgag

SEQ ID NO: 269717 - DNA, 25 bp, Homo sapien
gaggccagagaaggcatcgaagcca

SEQ ID NO: 269718 - DNA, 25 bp, Homo sapien
gagaaggcatcgaagccaagacctg

SEQ ID NO: 269719 - DNA, 25 bp, Homo sapien
aggcatcgaagccaagacctgggcc

SEQ ID NO: 269720 - DNA, 25 bp, Homo sapien
gcatcgaagccaagacctgggccca

SEQ ID NO: 269721 - DNA, 25 bp, Homo sapien
ggaccctctgggaaaatgtggattt

SEQ ID NO: 269722 - DNA, 25 bp, Homo sapien
gaccctctgggaaaatgtggatttg

SEQ ID NO: 269723 - DNA, 25 bp, Homo sapien
ctctgggaaaatgtggatttgagct

SEQ ID NO: 269724 - DNA, 25 bp, Homo sapien
gagctggtgagagtgttgctaaggc

SEQ ID NO: 269725 - DNA, 25 bp, Homo sapien
gttgctaaggctgggctaaagcctg

SEQ ID NO: 269726 - DNA, 25 bp, Homo sapien
ctgggctaaagcctggagagggtag

SEQ ID NO: 269727 - DNA, 25 bp, Homo sapien
taatatgtgaaaaactcggatcttt

SEQ ID NO: 269728 - DNA, 25 bp, Homo sapien
agcatcatagatcatttttccatat

SEQ ID NO: 269729 - DNA, 25 bp, Homo sapien
ttttccatatgacactggttccgat

SEQ ID NO: 269730 - DNA, 25 bp, Homo sapien
tatgacactggttccgattttaaaa

SEQ ID NO: 269731 - DNA, 25 bp, Homo sapien
ttgaattctacttttgccatctgaa

SEQ ID NO: 269732 - DNA, 25 bp, Homo sapien
acttttgccatctgaattgacttga

SEQ ID NO: 269733 - DNA, 25 bp, Homo sapien
gatgtttattggctcatgtggacag

SEQ ID NO: 269734 - DNA, 25 bp, Homo sapien
ttggctcatgtggacagaaatgtac

SEQ ID NO: 269735 - DNA, 25 bp, Homo sapien
ctttctgctttattttctgaatttc

SEQ ID NO: 269736 - DNA, 25 bp, Homo sapien
ctgaatttcacattacttttactta

SEQ ID NO: 269737 - DNA, 25 bp, Homo sapien
ttacttttacttaatgcttttgtgt

SEQ ID NO: 269738 - DNA, 25 bp, Homo sapien
gagcacgctcaggtgataggacgac

SEQ ID NO: 269739 - DNA, 25 bp, Homo sapien
tgataggacgactcctgagacccag

SEQ ID NO: 269740 - DNA, 25 bp, Homo sapien
tgagacccagcgaccgtggagacag

SEQ ID NO: 269741 - DNA, 25 bp, Homo sapien
agccctggcccgtggatggatccct

SEQ ID NO: 269742 - DNA, 25 bp, Homo sapien
gatggatcccttggctgtctgagga

SEQ ID NO: 269743 - DNA, 25 bp, Homo sapien
atcccttggctgtctgaggactgct

SEQ ID NO: 269744 - DNA, 25 bp, Homo sapien
actgctccagaagtgcgggaatcca

SEQ ID NO: 269745 - DNA, 25 bp, Homo sapien
agaagtgcgggaatccagggcccac

SEQ ID NO: 269746 - DNA, 25 bp, Homo sapien
cagggcccacccagaagaccgtgaa

SEQ ID NO: 269747 - DNA, 25 bp, Homo sapien
agaccgtgaacagttccttagcctc

SEQ ID NO: 269748 - DNA, 25 bp, Homo sapien
aactcagtttacaggcgtggtttgt

SEQ ID NO: 269749 - DNA, 25 bp, Homo sapien
tgaccctagcccaaactctgtagta

SEQ ID NO: 269750 - DNA, 25 bp, Homo sapien
tctgtagtacctatagccgtgttgt

SEQ ID NO: 269751 - DNA, 25 bp, Homo sapien
gccgtgttgtacattatggtagcca

SEQ ID NO: 269752 - DNA, 25 bp, Homo sapien
ttcctcagttgcacttgacacattt

SEQ ID NO: 269753 - DNA, 25 bp, Homo sapien
gacacatttcaagtacttcatagcc

SEQ ID NO: 269754 - DNA, 25 bp, Homo sapien
cacacaggtagaatattgccatctt

SEQ ID NO: 269755 - DNA, 25 bp, Homo sapien
attgccatcttcacagatatttcta

SEQ ID NO: 269756 - DNA, 25 bp, Homo sapien
acagatatttctattgggccgtgct

SEQ ID NO: 269757 - DNA, 25 bp, Homo sapien
tgggccgtgctgttctatagaatta

SEQ ID NO: 269758 - DNA, 25 bp, Homo sapien
gtgagtcaggtctaccacagtggag

SEQ ID NO: 269759 - DNA, 25 bp, Homo sapien
atttaggcagtacgtcatgtacctt

SEQ ID NO: 269760 - DNA, 25 bp, Homo sapien
aaaaatgggacatgggcaccagaga

SEQ ID NO: 269761 - DNA, 25 bp, Homo sapien
agagagactcctgagagctccctta

SEQ ID NO: 269762 - DNA, 25 bp, Homo sapien
gagctcccttagtgctcttagagga

SEQ ID NO: 269763 - DNA, 25 bp, Homo sapien
gaagtcaaacgcagctcagattctc

SEQ ID NO: 269764 - DNA, 25 bp, Homo sapien
taacccctcagacttccagaggcgg

SEQ ID NO: 269765 - DNA, 25 bp, Homo sapien
ggcgggaactgcagcgatgatacaa

SEQ ID NO: 269766 - DNA, 25 bp, Homo sapien
ggaaagaatgccgttttggagtcag

SEQ ID NO: 269767 - DNA, 25 bp, Homo sapien
tgggtttgaatccacttgcagccac

SEQ ID NO: 269768 - DNA, 25 bp, Homo sapien
gaatccacttgcagccacttgcagg

SEQ ID NO: 269769 - DNA, 25 bp, Homo sapien
agctgtgcgtgtaccctgacgagtc

SEQ ID NO: 269770 - DNA, 25 bp, Homo sapien
ggccttagtcccctctgaaaaatgg

SEQ ID NO: 269771 - DNA, 25 bp, Homo sapien
gagttaggagacatgtttttaccaa

SEQ ID NO: 269772 - DNA, 25 bp, Homo sapien
gacatgtttttaccaaaggaatcaa

SEQ ID NO: 269773 - DNA, 25 bp, Homo sapien
tgttgaaaacacaccaggagaaaac

SEQ ID NO: 269774 - DNA, 25 bp, Homo sapien
cataagcaagaaactgggaggccaa

SEQ ID NO: 269775 - DNA, 25 bp, Homo sapien
aaattccagatccagtcttccatgc

SEQ ID NO: 269776 - DNA, 25 bp, Homo sapien
ttccagatccagtcttccatgcttg

SEQ ID NO: 269777 - DNA, 25 bp, Homo sapien
ccatgcttgatgatggtgtccagaa

SEQ ID NO: 269778 - DNA, 25 bp, Homo sapien
ttggagttgcacttgtatttcagtt

SEQ ID NO: 269779 - DNA, 25 bp, Homo sapien
gttgcacttgtatttcagtttatgt

SEQ ID NO: 269780 - DNA, 25 bp, Homo sapien
tcagtttatgtaagtagccgaactt

SEQ ID NO: 269781 - DNA, 25 bp, Homo sapien
gtagccgaacttatggacagaatat

SEQ ID NO: 269782 - DNA, 25 bp, Homo sapien
tcaactctttttgaggacaactgga

SEQ ID NO: 269783 - DNA, 25 bp, Homo sapien
gaattggcaagttgatagctgctga

SEQ ID NO: 269784 - DNA, 25 bp, Homo sapien
tagctgctgaagatatggaaatcgg

SEQ ID NO: 269785 - DNA, 25 bp, Homo sapien
atcggtggttcaaaattgtggtaca

SEQ ID NO: 269786 - DNA, 25 bp, Homo sapien
gtggtacacaataattcttatgttt

SEQ ID NO: 269787 - DNA, 25 bp, Homo sapien
gtttctaaacatcttatgccctgga

SEQ ID NO: 269788 - DNA, 25 bp, Homo sapien
taaacatcttatgccctggaagcca

SEQ ID NO: 269789 - DNA, 25 bp, Homo sapien
ggatatccaacagaaaaggcactct

SEQ ID NO: 269790 - DNA, 25 bp, Homo sapien
aaaaggcactcttgttttaccacat

SEQ ID NO: 269791 - DNA, 25 bp, Homo sapien
ttaccacataacttgattgcctcct

SEQ ID NO: 269792 - DNA, 25 bp, Homo sapien
ttgattgcctcctcctaagtctagt

SEQ ID NO: 269793 - DNA, 25 bp, Homo sapien
aacaagcacctggtcccgaggctga

SEQ ID NO: 269794 - DNA, 25 bp, Homo sapien
cacctggtcccgaggctgagagaag

SEQ ID NO: 269795 - DNA, 25 bp, Homo sapien
agaaggctcgggtctaagcgcgtgt

SEQ ID NO: 269796 - DNA, 25 bp, Homo sapien
gtcgcgcttccggtctgggtagatt

SEQ ID NO: 269797 - DNA, 25 bp, Homo sapien
cttccggtctgggtagatttgctgg

SEQ ID NO: 269798 - DNA, 25 bp, Homo sapien
cccgggcaaaccgttgctgtttcag

SEQ ID NO: 269799 - DNA, 25 bp, Homo sapien
caaaccgttgctgtttcagcccggg

SEQ ID NO: 269800 - DNA, 25 bp, Homo sapien
tggcaccccgtgcacttgtggcctg

SEQ ID NO: 269801 - DNA, 25 bp, Homo sapien
gcacttgtggcctgcggcggtcctt

SEQ ID NO: 269802 - DNA, 25 bp, Homo sapien
tgcggcggtccttgcagagctgttc

SEQ ID NO: 269803 - DNA, 25 bp, Homo sapien
cttgcagagctgttcgccgaccggg

SEQ ID NO: 269804 - DNA, 25 bp, Homo sapien
gtgacttattctatcaggtaaatat

SEQ ID NO: 269805 - DNA, 25 bp, Homo sapien
atattcttattatcccagatagtgt

SEQ ID NO: 269806 - DNA, 25 bp, Homo sapien
tatcccagatagtgttggcaaagct

SEQ ID NO: 269807 - DNA, 25 bp, Homo sapien
agtgttggcaaagctaatactgcac

SEQ ID NO: 269808 - DNA, 25 bp, Homo sapien
aagctaatactgcacattctgtctg

SEQ ID NO: 269809 - DNA, 25 bp, Homo sapien
aatactgcacattctgtctgtacag

SEQ ID NO: 269810 - DNA, 25 bp, Homo sapien
gcacattctgtctgtacagtttcga

SEQ ID NO: 269811 - DNA, 25 bp, Homo sapien
ctgtctgtacagtttcgaaatttat

SEQ ID NO: 269812 - DNA, 25 bp, Homo sapien
ggctttcttccctgtgctaccagta

SEQ ID NO: 269813 - DNA, 25 bp, Homo sapien
ctgtgctaccagtacatcatacaat

SEQ ID NO: 269814 - DNA, 25 bp, Homo sapien
gtacatcatacaatactaggcgtat

SEQ ID NO: 269815 - DNA, 25 bp, Homo sapien
ggaatcattattcatgacccctctg

SEQ ID NO: 269816 - DNA, 25 bp, Homo sapien
cattattcatgacccctctgcaaat

SEQ ID NO: 269817 - DNA, 25 bp, Homo sapien
acccctctgcaaatgtgtcagtctc

SEQ ID NO: 269818 - DNA, 25 bp, Homo sapien
tgcaaatgtgtcagtctccaaagag

SEQ ID NO: 269819 - DNA, 25 bp, Homo sapien
cagtctccaaagagagtatctcccc

SEQ ID NO: 269820 - DNA, 25 bp, Homo sapien
gtatctccccccaaattttgtgtag

SEQ ID NO: 269821 - DNA, 25 bp, Homo sapien
ttttgtgtagcttcttttgttatgg

SEQ ID NO: 269822 - DNA, 25 bp, Homo sapien
gtgtagcttcttttgttatggaaaa

SEQ ID NO: 269823 - DNA, 25 bp, Homo sapien
ttttaaaataaactccagcacaggg

SEQ ID NO: 269824 - DNA, 25 bp, Homo sapien
aaaataaactccagcacagggatgc

SEQ ID NO: 269825 - DNA, 25 bp, Homo sapien
tgtgcatgcctgagttgattccgaa

SEQ ID NO: 269826 - DNA, 25 bp, Homo sapien
aatgaacatggagtccctgaagatg

SEQ ID NO: 269827 - DNA, 25 bp, Homo sapien
gcttccagggagaaattgtacatta

SEQ ID NO: 269828 - DNA, 25 bp, Homo sapien
aatgcagatgtgattcctatggatg

SEQ ID NO: 269829 - DNA, 25 bp, Homo sapien
attcctatggatgagggtaacctag

SEQ ID NO: 269830 - DNA, 25 bp, Homo sapien
gaagcctgggtacctgaacaacctt

SEQ ID NO: 269831 - DNA, 25 bp, Homo sapien
acaaccttgtggagcatagacacct

SEQ ID NO: 269832 - DNA, 25 bp, Homo sapien
atagacacctacgtggcctggactg

SEQ ID NO: 269833 - DNA, 25 bp, Homo sapien
gagacaggtggcacctcgtgcttcc

SEQ ID NO: 269834 - DNA, 25 bp, Homo sapien
acctcgtgcttcctccgaagggaga

SEQ ID NO: 269835 - DNA, 25 bp, Homo sapien
tccgaagggagagcccatttcctaa

SEQ ID NO: 269836 - DNA, 25 bp, Homo sapien
gcccatttcctaacagctggatcaa

SEQ ID NO: 269837 - DNA, 25 bp, Homo sapien
atattcccaatgactatgtttggta

SEQ ID NO: 269838 - DNA, 25 bp, Homo sapien
tgtttggtaataatcagctcttctg

SEQ ID NO: 269839 - DNA, 25 bp, Homo sapien
ggtaataatcagctcttctggccca

SEQ ID NO: 269840 - DNA, 25 bp, Homo sapien
gtggggtggcctttaaattgcctgc

SEQ ID NO: 269841 - DNA, 25 bp, Homo sapien
gctcttctggcccacaagtaggaat

SEQ ID NO: 269842 - DNA, 25 bp, Homo sapien
ggcccacaagtaggaatgatcaatg

SEQ ID NO: 269843 - DNA, 25 bp, Homo sapien
tgagaacttaacttagtcctttatt

SEQ ID NO: 269844 - DNA, 25 bp, Homo sapien
gagttcttatggctagaagacctca

SEQ ID NO: 269845 - DNA, 25 bp, Homo sapien
tatggctagaagacctcagatgccc

SEQ ID NO: 269846 - DNA, 25 bp, Homo sapien
agatgcccacagctgtcacgtttgt

SEQ ID NO: 269847 - DNA, 25 bp, Homo sapien
gcccacagctgtcacgtttgtgaaa

SEQ ID NO: 269848 - DNA, 25 bp, Homo sapien
gtgctgtttctctctgagggcttta

SEQ ID NO: 269849 - DNA, 25 bp, Homo sapien
ctctctgagggctttagtttactac

SEQ ID NO: 269850 - DNA, 25 bp, Homo sapien
ggctttagtttactactactcgtag

SEQ ID NO: 269851 - DNA, 25 bp, Homo sapien
actactcgtagctaacatatatagg

SEQ ID NO: 269852 - DNA, 25 bp, Homo sapien
gactgtgctctggatattgagtgcc

SEQ ID NO: 269853 - DNA, 25 bp, Homo sapien
gctctggatattgagtgcctctgtt

SEQ ID NO: 269854 - DNA, 25 bp, Homo sapien
gtgattgaaaggaaagtcacccttt

SEQ ID NO: 269855 - DNA, 25 bp, Homo sapien
cctttccagggaggtttcactgtat

SEQ ID NO: 269856 - DNA, 25 bp, Homo sapien
gggaggtttcactgtataaaattca

SEQ ID NO: 269857 - DNA, 25 bp, Homo sapien
gaaaggtaccagtgcagttattaat

SEQ ID NO: 269858 - DNA, 25 bp, Homo sapien
taatggaggtgctgtttctctctga

SEQ ID NO: 269859 - DNA, 25 bp, Homo sapien
cggactagtggagaagcgatcgctc

SEQ ID NO: 269860 - DNA, 25 bp, Homo sapien
gtggagaagcgatcgctccatccgg

SEQ ID NO: 269861 - DNA, 25 bp, Homo sapien
gcaggcgcgggtaccctattttaga

SEQ ID NO: 269862 - DNA, 25 bp, Homo sapien
gcgcgggtaccctattttagagtca

SEQ ID NO: 269863 - DNA, 25 bp, Homo sapien
gggtaccctattttagagtcacgca

SEQ ID NO: 269864 - DNA, 25 bp, Homo sapien
ccctattttagagtcacgcatgttg

SEQ ID NO: 269865 - DNA, 25 bp, Homo sapien
acgcatgttgaggttattgctccaa

SEQ ID NO: 269866 - DNA, 25 bp, Homo sapien
ggttattgctccaagactcaaaagg

SEQ ID NO: 269867 - DNA, 25 bp, Homo sapien
tcgggaggattcgagcctggacctt

SEQ ID NO: 269868 - DNA, 25 bp, Homo sapien
ggattcgagcctggaccttttgagc

SEQ ID NO: 269869 - DNA, 25 bp, Homo sapien
gaccttttgagctccccagtatggg

SEQ ID NO: 269870 - DNA, 25 bp, Homo sapien
tcagagtgggttgtagggaacattt

SEQ ID NO: 269871 - DNA, 25 bp, Homo sapien
gctgcacaagcagtatggtacctgt

SEQ ID NO: 269872 - DNA, 25 bp, Homo sapien
caagcagtatggtacctgtcatctt

SEQ ID NO: 269873 - DNA, 25 bp, Homo sapien
agcagtatggtacctgtcatcttag

SEQ ID NO: 269874 - DNA, 25 bp, Homo sapien
cagtatggtacctgtcatcttagtt

SEQ ID NO: 269875 - DNA, 25 bp, Homo sapien
gggagtgcagacatgcctgtgcaat

SEQ ID NO: 269876 - DNA, 25 bp, Homo sapien
gagtgcagacatgcctgtgcaatct

SEQ ID NO: 269877 - DNA, 25 bp, Homo sapien
gtgcagacatgcctgtgcaatctgg

SEQ ID NO: 269878 - DNA, 25 bp, Homo sapien
cccagttctttgtcctctggaactc

SEQ ID NO: 269879 - DNA, 25 bp, Homo sapien
ttgtcctctggaactccccaaatca

SEQ ID NO: 269880 - DNA, 25 bp, Homo sapien
tctggaactccccaaatcattattg

SEQ ID NO: 269881 - DNA, 25 bp, Homo sapien
accagggcaagttttgagcgtgcag

SEQ ID NO: 269882 - DNA, 25 bp, Homo sapien
ccagggcaagttttgagcgtgcaga

SEQ ID NO: 269883 - DNA, 25 bp, Homo sapien
cagggcaagttttgagcgtgcagat

SEQ ID NO: 269884 - DNA, 25 bp, Homo sapien
agggcaagttttgagcgtgcagatc

SEQ ID NO: 269885 - DNA, 25 bp, Homo sapien
gggcaagttttgagcgtgcagatcc

SEQ ID NO: 269886 - DNA, 25 bp, Homo sapien
ggcaagttttgagcgtgcagatcca

SEQ ID NO: 269887 - DNA, 25 bp, Homo sapien
caagttttgagcgtgcagatccacc

SEQ ID NO: 269888 - DNA, 25 bp, Homo sapien
aagttttgagcgtgcagatccacca

SEQ ID NO: 269889 - DNA, 25 bp, Homo sapien
agttttgagcgtgcagatccaccag

SEQ ID NO: 269890 - DNA, 25 bp, Homo sapien
gttttgagcgtgcagatccaccagc

SEQ ID NO: 269891 - DNA, 25 bp, Homo sapien
tgcttgaagccaggggcaccaggat

SEQ ID NO: 269892 - DNA, 25 bp, Homo sapien
acttctcactcagtactctatatgc

SEQ ID NO: 269893 - DNA, 25 bp, Homo sapien
agctgtacaaggaggcgctcacggt

SEQ ID NO: 269894 - DNA, 25 bp, Homo sapien
aaggaggcgctcacggtgaacccag

SEQ ID NO: 269895 - DNA, 25 bp, Homo sapien
acggtgaacccagatggcgtgcgca

SEQ ID NO: 269896 - DNA, 25 bp, Homo sapien
atggcgtgcgcatcatgcatagcct

SEQ ID NO: 269897 - DNA, 25 bp, Homo sapien
tgagtcggctgggccacaagagctt

SEQ ID NO: 269898 - DNA, 25 bp, Homo sapien
ccacaagagcttggcccagaaggtg

SEQ ID NO: 269899 - DNA, 25 bp, Homo sapien
ggcccagaaggtgcttcgtgatgcc

SEQ ID NO: 269900 - DNA, 25 bp, Homo sapien
aggcagagtacgtgccacgaggcgt

SEQ ID NO: 269901 - DNA, 25 bp, Homo sapien
cccagggccagaacgaggctgccgt

SEQ ID NO: 269902 - DNA, 25 bp, Homo sapien
aacgaggctgccgttgactgcttcc

SEQ ID NO: 269903 - DNA, 25 bp, Homo sapien
cagggtggctggcatgggactggca

SEQ ID NO: 269904 - DNA, 25 bp, Homo sapien
agggtggctggcatgggactggcac

SEQ ID NO: 269905 - DNA, 25 bp, Homo sapien
gggtggctggcatgggactggcact

SEQ ID NO: 269906 - DNA, 25 bp, Homo sapien
ggtggctggcatgggactggcactc

SEQ ID NO: 269907 - DNA, 25 bp, Homo sapien
tgggactggcactctgtacctccac

SEQ ID NO: 269908 - DNA, 25 bp, Homo sapien
gggactggcactctgtacctccact

SEQ ID NO: 269909 - DNA, 25 bp, Homo sapien
ggactggcactctgtacctccactc

SEQ ID NO: 269910 - DNA, 25 bp, Homo sapien
actggcactctgtacctccactccg

SEQ ID NO: 269911 - DNA, 25 bp, Homo sapien
tgtacctccactccgtcaccaggga

SEQ ID NO: 269912 - DNA, 25 bp, Homo sapien
acctccactccgtcaccagggacag

SEQ ID NO: 269913 - DNA, 25 bp, Homo sapien
cctccactccgtcaccagggacagc

SEQ ID NO: 269914 - DNA, 25 bp, Homo sapien
gcgtccttcaccatggcaactcggg

SEQ ID NO: 269915 - DNA, 25 bp, Homo sapien
caccatggcaactcgggcgtcggga

SEQ ID NO: 269916 - DNA, 25 bp, Homo sapien
tatccgccagcccacgagaagtgac

SEQ ID NO: 269917 - DNA, 25 bp, Homo sapien
cgagaagtgacgaaggagcaccatt

SEQ ID NO: 269918 - DNA, 25 bp, Homo sapien
gaaggagcaccattgaaggagaatt

SEQ ID NO: 269919 - DNA, 25 bp, Homo sapien
aaactggagtctactgagatgaggc

SEQ ID NO: 269920 - DNA, 25 bp, Homo sapien
gacgcctacgagaccggaagtgcct

SEQ ID NO: 269921 - DNA, 25 bp, Homo sapien
gctgttgggaatggccctggtacca

SEQ ID NO: 269922 - DNA, 25 bp, Homo sapien
ttgggaatggccctggtaccacatc

SEQ ID NO: 269923 - DNA, 25 bp, Homo sapien
acgagaccggaagtgcctgggccca

SEQ ID NO: 269924 - DNA, 25 bp, Homo sapien
gtggaggaaggacccgcgtggccgc

SEQ ID NO: 269925 - DNA, 25 bp, Homo sapien
gtggaatatgtacagccagacccaa

SEQ ID NO: 269926 - DNA, 25 bp, Homo sapien
gccagacccaagaaaccttaggctg

SEQ ID NO: 269927 - DNA, 25 bp, Homo sapien
gaaaccttaggctgatgaggtacat

SEQ ID NO: 269928 - DNA, 25 bp, Homo sapien
aggctgatgaggtacatggatgtca

SEQ ID NO: 269929 - DNA, 25 bp, Homo sapien
tatcctcagctttatctgaagttaa

SEQ ID NO: 269930 - DNA, 25 bp, Homo sapien
gtatctttcccataatgaaatccaa

SEQ ID NO: 269931 - DNA, 25 bp, Homo sapien
tgatggaagagtgccccctcacggt

SEQ ID NO: 269932 - DNA, 25 bp, Homo sapien
cctcacggtgtggaggtcctgcttg

SEQ ID NO: 269933 - DNA, 25 bp, Homo sapien
ggtcctgcttggctagcaactgaat

SEQ ID NO: 269934 - DNA, 25 bp, Homo sapien
taaattcaagggaccctgcggaccg

SEQ ID NO: 269935 - DNA, 25 bp, Homo sapien
agggaccctgcggaccggactgcta

SEQ ID NO: 269936 - DNA, 25 bp, Homo sapien
ctgcgtctcctgtccagcacaaggg

SEQ ID NO: 269937 - DNA, 25 bp, Homo sapien
tgcgtctcctgtccagcacaagggg

SEQ ID NO: 269938 - DNA, 25 bp, Homo sapien
gcgtctcctgtccagcacaaggggt

SEQ ID NO: 269939 - DNA, 25 bp, Homo sapien
cgtctcctgtccagcacaaggggtc

SEQ ID NO: 269940 - DNA, 25 bp, Homo sapien
cctgtccagcacaaggggtctccag

SEQ ID NO: 269941 - DNA, 25 bp, Homo sapien
ctgtccagcacaaggggtctccagt

SEQ ID NO: 269942 - DNA, 25 bp, Homo sapien
tgtccagcacaaggggtctccagtg

SEQ ID NO: 269943 - DNA, 25 bp, Homo sapien
gtccagcacaaggggtctccagtgt

SEQ ID NO: 269944 - DNA, 25 bp, Homo sapien
cagcacaaggggtctccagtgtgga

SEQ ID NO: 269945 - DNA, 25 bp, Homo sapien
gcacaaggggtctccagtgtggacg

SEQ ID NO: 269946 - DNA, 25 bp, Homo sapien
cacaaggggtctccagtgtggacgt

SEQ ID NO: 269947 - DNA, 25 bp, Homo sapien
ccagcccggcctttgtgggactgag

SEQ ID NO: 269948 - DNA, 25 bp, Homo sapien
ctttgtgggactgaggtggcgctga

SEQ ID NO: 269949 - DNA, 25 bp, Homo sapien
aaggcgggacttggagataaatact

SEQ ID NO: 269950 - DNA, 25 bp, Homo sapien
gagataaatactgagcacccacaac

SEQ ID NO: 269951 - DNA, 25 bp, Homo sapien
atactgagcacccacaacaggcagc

SEQ ID NO: 269952 - DNA, 25 bp, Homo sapien
agccagcaccactgcagattggata

SEQ ID NO: 269953 - DNA, 25 bp, Homo sapien
gcagattggatactgcaatgatgat

SEQ ID NO: 269954 - DNA, 25 bp, Homo sapien
actgcaatgatgataagcatggcct

SEQ ID NO: 269955 - DNA, 25 bp, Homo sapien
taagcatggcctgcctttatggagg

SEQ ID NO: 269956 - DNA, 25 bp, Homo sapien
atggcctgcctttatggaggttctg

SEQ ID NO: 269957 - DNA, 25 bp, Homo sapien
tatggaggttctggatgttcctgtg

SEQ ID NO: 269958 - DNA, 25 bp, Homo sapien
gaacaaccaagagcctgcccaggtg

SEQ ID NO: 269959 - DNA, 25 bp, Homo sapien
gagcctgcccaggtggtctgccatg

SEQ ID NO: 269960 - DNA, 25 bp, Homo sapien
agggagctcccaggaagctgatctg

SEQ ID NO: 269961 - DNA, 25 bp, Homo sapien
tgccatcattacatgcagtttgcag

SEQ ID NO: 269962 - DNA, 25 bp, Homo sapien
cagtttgcagcagcggcctatgggt

SEQ ID NO: 269963 - DNA, 25 bp, Homo sapien
gtgactgctgcagaagcagaaccac

SEQ ID NO: 269964 - DNA, 25 bp, Homo sapien
gaaccacagactatgacttggtcgg

SEQ ID NO: 269965 - DNA, 25 bp, Homo sapien
gacttggtcggaggcgatcagctca

SEQ ID NO: 269966 - DNA, 25 bp, Homo sapien
gatcagctcaactgtcacttcggct

SEQ ID NO: 269967 - DNA, 25 bp, Homo sapien
atcctgcacaccacagggctgcagt

SEQ ID NO: 269968 - DNA, 25 bp, Homo sapien
ggctgcagtacagggacttcatcca

SEQ ID NO: 269969 - DNA, 25 bp, Homo sapien
attattgggcacaccctcagagttt

SEQ ID NO: 269970 - DNA, 25 bp, Homo sapien
gggtcccaagatttgcatttccatc

SEQ ID NO: 269971 - DNA, 25 bp, Homo sapien
atttccatcgatttcccaggtgaag

SEQ ID NO: 269972 - DNA, 25 bp, Homo sapien
ggttgagaaaccctgccatacagca

SEQ ID NO: 269973 - DNA, 25 bp, Homo sapien
tttgagaaccactaccctagaaagt

SEQ ID NO: 269974 - DNA, 25 bp, Homo sapien
tccccatgctctcctgattaggaag

SEQ ID NO: 269975 - DNA, 25 bp, Homo sapien
aaccctgccatacagcagtggttct

SEQ ID NO: 269976 - DNA, 25 bp, Homo sapien
ggttctcaagccctagtttgtacca

SEQ ID NO: 269977 - DNA, 25 bp, Homo sapien
gccctagtttgtaccacaattacct

SEQ ID NO: 269978 - DNA, 25 bp, Homo sapien
taccttcagggttggtaaggccgat

SEQ ID NO: 269979 - DNA, 25 bp, Homo sapien
taaggccgattattgggcacaccct

SEQ ID NO: 269980 - DNA, 25 bp, Homo sapien
gctctggccttactcttggcccaag

SEQ ID NO: 269981 - DNA, 25 bp, Homo sapien
ttggcccaagcatctggctctagag

SEQ ID NO: 269982 - DNA, 25 bp, Homo sapien
gcatctggctctagagatcttctaa

SEQ ID NO: 269983 - DNA, 25 bp, Homo sapien
agatcttctaatatccaacaggcca

SEQ ID NO: 269984 - DNA, 25 bp, Homo sapien
ctggctgaccagctaagcttgacaa

SEQ ID NO: 269985 - DNA, 25 bp, Homo sapien
gagaaaaccaccagggagccagggc

SEQ ID NO: 269986 - DNA, 25 bp, Homo sapien
gggaccatcctaggattcaggactt

SEQ ID NO: 269987 - DNA, 25 bp, Homo sapien
gaggaagtggctacacctcgctcca

SEQ ID NO: 269988 - DNA, 25 bp, Homo sapien
gacttggagtcatttggagcctctc

SEQ ID NO: 269989 - DNA, 25 bp, Homo sapien
ttgccctgaactggacctacttgct

SEQ ID NO: 269990 - DNA, 25 bp, Homo sapien
tggacctacttgcttgaccagagcc

SEQ ID NO: 269991 - DNA, 25 bp, Homo sapien
atttgatttggccacagggtttgct

SEQ ID NO: 269992 - DNA, 25 bp, Homo sapien
cagggtttgctgttttcatttcatc

SEQ ID NO: 269993 - DNA, 25 bp, Homo sapien
tcatttcatcttgttactccactgt

SEQ ID NO: 269994 - DNA, 25 bp, Homo sapien
ttgctgggcagattatgttcttaac

SEQ ID NO: 269995 - DNA, 25 bp, Homo sapien
ttgttactccactgtgctggtgata

SEQ ID NO: 269996 - DNA, 25 bp, Homo sapien
ttaccatttttgctaatattgcctt

SEQ ID NO: 269997 - DNA, 25 bp, Homo sapien
ttgtacttgagtttccatgctggct

SEQ ID NO: 269998 - DNA, 25 bp, Homo sapien
atgctggcttttacttccagaggga

SEQ ID NO: 269999 - DNA, 25 bp, Homo sapien
tgttcttaactaaattctctcttcc

SEQ ID NO: 270000 - DNA, 25 bp, Homo sapien
taaaatttccttctagctcctgtga

SEQ ID NO: 270001 - DNA, 25 bp, Homo sapien
gtgatcgtcatccagacaactttag

SEQ ID NO: 270002 - DNA, 25 bp, Homo sapien
caggatcatccacctgcaggaggag

SEQ ID NO: 270003 - DNA, 25 bp, Homo sapien
tctgctgctcactatagcgccaagt

SEQ ID NO: 270004 - DNA, 25 bp, Homo sapien
gctgctcactatagcgccaagtggt

SEQ ID NO: 270005 - DNA, 25 bp, Homo sapien
actatagcgccaagtggtcacacga

SEQ ID NO: 270006 - DNA, 25 bp, Homo sapien
atagcgccaagtggtcacacgaagc

SEQ ID NO: 270007 - DNA, 25 bp, Homo sapien
ccaagtggtcacacgaagcggaatt

SEQ ID NO: 270008 - DNA, 25 bp, Homo sapien
agcaaaatactcataggtccgaaga

SEQ ID NO: 270009 - DNA, 25 bp, Homo sapien
atactcataggtccgaagatgctca

SEQ ID NO: 270010 - DNA, 25 bp, Homo sapien
cataggtccgaagatgctcaccgac

SEQ ID NO: 270011 - DNA, 25 bp, Homo sapien
tccgaagatgctcaccgaccacatg

SEQ ID NO: 270012 - DNA, 25 bp, Homo sapien
agacatcctgatgcgggccttggac

SEQ ID NO: 270013 - DNA, 25 bp, Homo sapien
aatcctgggcgcctttgaatctgtt

SEQ ID NO: 270014 - DNA, 25 bp, Homo sapien
ggcgcctttgaatctgttctgtgat

SEQ ID NO: 270015 - DNA, 25 bp, Homo sapien
gaatctgttctgtgatcacgctgaa

SEQ ID NO: 270016 - DNA, 25 bp, Homo sapien
aaaagatgggaaccctgtgaacagg

SEQ ID NO: 270017 - DNA, 25 bp, Homo sapien
gggacaccatcctgcttatttgggt

SEQ ID NO: 270018 - DNA, 25 bp, Homo sapien
ttatttgggtcttacactcttgtcc

SEQ ID NO: 270019 - DNA, 25 bp, Homo sapien
cttgtccaaagaggcactgtatatg

SEQ ID NO: 270020 - DNA, 25 bp, Homo sapien
gaggcactgtatatgtctgtttttc

SEQ ID NO: 270021 - DNA, 25 bp, Homo sapien
tatgtctgtttttccactaccgtat

SEQ ID NO: 270022 - DNA, 25 bp, Homo sapien
actaccgtatcattgctgttcacat

SEQ ID NO: 270023 - DNA, 25 bp, Homo sapien
atcattgctgttcacatgtaatgtg

SEQ ID NO: 270024 - DNA, 25 bp, Homo sapien
tgaacagactcccacgtgcactgct

SEQ ID NO: 270025 - DNA, 25 bp, Homo sapien
gtgcactgctgcaagggtgcctgca

SEQ ID NO: 270026 - DNA, 25 bp, Homo sapien
tgcagaaggcgacttgtcctccatc

SEQ ID NO: 270027 - DNA, 25 bp, Homo sapien
tgaacagacccagtgccctatgtgg

SEQ ID NO: 270028 - DNA, 25 bp, Homo sapien
ctgggcatggcccttgcacagaatg

SEQ ID NO: 270029 - DNA, 25 bp, Homo sapien
gcccacggtcatctgtgagtctgaa

SEQ ID NO: 270030 - DNA, 25 bp, Homo sapien
gtctgaatgttcacaacctaagaag

SEQ ID NO: 270031 - DNA, 25 bp, Homo sapien
taagaaggtgacttgttggcagacg

SEQ ID NO: 270032 - DNA, 25 bp, Homo sapien
gagctatgcccagagcgtgtttcaa

SEQ ID NO: 270033 - DNA, 25 bp, Homo sapien
gtgtttcaagagctttggctcctat

SEQ ID NO: 270034 - DNA, 25 bp, Homo sapien
gcgtgaggctcttctaccaggatag

SEQ ID NO: 270035 - DNA, 25 bp, Homo sapien
agacttactgaagctcttgtggctg

SEQ ID NO: 270036 - DNA, 25 bp, Homo sapien
aagctcttgtggctgaaaaggagaa

SEQ ID NO: 270037 - DNA, 25 bp, Homo sapien
tcaggactatgccagagaggtaatt

SEQ ID NO: 270038 - DNA, 25 bp, Homo sapien
gccagagaggtaattgaacttgaat

SEQ ID NO: 270039 - DNA, 25 bp, Homo sapien
gaacttgaatcggaaacaacaaata

SEQ ID NO: 270040 - DNA, 25 bp, Homo sapien
atatttaccctcttgtaaaagctgt

SEQ ID NO: 270041 - DNA, 25 bp, Homo sapien
taccctcttgtaaaagctgtacagg

SEQ ID NO: 270042 - DNA, 25 bp, Homo sapien
ccgtggaccagtgtttgtggacaga

SEQ ID NO: 270043 - DNA, 25 bp, Homo sapien
aagaggttcaagatgcccatattca

SEQ ID NO: 270044 - DNA, 25 bp, Homo sapien
gaggttcaagatgcccatattcagc

SEQ ID NO: 270045 - DNA, 25 bp, Homo sapien
gatgcccatattcagcaaatggcca

SEQ ID NO: 270046 - DNA, 25 bp, Homo sapien
gggctccactgggtcactctgagag

SEQ ID NO: 270047 - DNA, 25 bp, Homo sapien
tccactgggtcactctgagagggtt

SEQ ID NO: 270048 - DNA, 25 bp, Homo sapien
gtcactctgagagggttgtggctct

SEQ ID NO: 270049 - DNA, 25 bp, Homo sapien
agggttgtggctctggttcttatta

SEQ ID NO: 270050 - DNA, 25 bp, Homo sapien
gttgtggctctggttcttattaaac

SEQ ID NO: 270051 - DNA, 25 bp, Homo sapien
ttcttattaaaccagggccaggtgc

SEQ ID NO: 270052 - DNA, 25 bp, Homo sapien
accttgtctctggaaaacaattagc

SEQ ID NO: 270053 - DNA, 25 bp, Homo sapien
ttgtctctggaaaacaattagctgg

SEQ ID NO: 270054 - DNA, 25 bp, Homo sapien
ggaggttgaggctcctgtgaaccct

SEQ ID NO: 270055 - DNA, 25 bp, Homo sapien
aggttgaggctcctgtgaaccctga

SEQ ID NO: 270056 - DNA, 25 bp, Homo sapien
aggctcctgtgaaccctgatggcac

SEQ ID NO: 270057 - DNA, 25 bp, Homo sapien
gatcctacaggaggagcatctgcag

SEQ ID NO: 270058 - DNA, 25 bp, Homo sapien
acgtgccccaggtcaagatcgagca

SEQ ID NO: 270059 - DNA, 25 bp, Homo sapien
cgcgcgcccaggctgagatcaagaa

SEQ ID NO: 270060 - DNA, 25 bp, Homo sapien
aggacactggtatgccgctcacgac

SEQ ID NO: 270061 - DNA, 25 bp, Homo sapien
agcccacaggatcaaacaacagtct

SEQ ID NO: 270062 - DNA, 25 bp, Homo sapien
agtctgagcacacactgatggacaa

SEQ ID NO: 270063 - DNA, 25 bp, Homo sapien
gaggagctgctatttttctttactt

SEQ ID NO: 270064 - DNA, 25 bp, Homo sapien
tctttacttaatcttcgcagaccat

SEQ ID NO: 270065 - DNA, 25 bp, Homo sapien
gcagaccatagctgttctggctgaa

SEQ ID NO: 270066 - DNA, 25 bp, Homo sapien
aggagcggcgcatcagacttcgaga

SEQ ID NO: 270067 - DNA, 25 bp, Homo sapien
gaagctccagatgcaaaagatccta

SEQ ID NO: 270068 - DNA, 25 bp, Homo sapien
agggcctcctgcaccgcagagaggg

SEQ ID NO: 270069 - DNA, 25 bp, Homo sapien
tgcactctcctttcccttaaatggg

SEQ ID NO: 270070 - DNA, 25 bp, Homo sapien
gcactctcctttcccttaaatgggc

SEQ ID NO: 270071 - DNA, 25 bp, Homo sapien
ctctcctttcccttaaatgggcaca

SEQ ID NO: 270072 - DNA, 25 bp, Homo sapien
tttcccttaaatgggcacagccagg

SEQ ID NO: 270073 - DNA, 25 bp, Homo sapien
ctgggaagagagagctccccctcca

SEQ ID NO: 270074 - DNA, 25 bp, Homo sapien
gcctgagccttccagctgtcaagtt

SEQ ID NO: 270075 - DNA, 25 bp, Homo sapien
cctgagccttccagctgtcaagttt

SEQ ID NO: 270076 - DNA, 25 bp, Homo sapien
agtttgaaaagaagccaccgtgcct

SEQ ID NO: 270077 - DNA, 25 bp, Homo sapien
gtttgaaaagaagccaccgtgcctc

SEQ ID NO: 270078 - DNA, 25 bp, Homo sapien
tttgaaaagaagccaccgtgcctcc

SEQ ID NO: 270079 - DNA, 25 bp, Homo sapien
gttgaatcaccataaagctaacaag

SEQ ID NO: 270080 - DNA, 25 bp, Homo sapien
agcagaaacatgaaccttagctttt

SEQ ID NO: 270081 - DNA, 25 bp, Homo sapien
gaaccttagcttttcaagcgatcaa

SEQ ID NO: 270082 - DNA, 25 bp, Homo sapien
ccctgtcggcaaatggtaaggccaa

SEQ ID NO: 270083 - DNA, 25 bp, Homo sapien
ccctcatccttcaaaagtctcgaat

SEQ ID NO: 270084 - DNA, 25 bp, Homo sapien
aaagtctcgaatcagctgtttcctt

SEQ ID NO: 270085 - DNA, 25 bp, Homo sapien
cttctctaagaaggtttccaggtct

SEQ ID NO: 270086 - DNA, 25 bp, Homo sapien
ctctaagaaggtttccaggtctgcc

SEQ ID NO: 270087 - DNA, 25 bp, Homo sapien
taagaaggtttccaggtctgccttt

SEQ ID NO: 270088 - DNA, 25 bp, Homo sapien
aacaccatgctcagtgaagtcacca

SEQ ID NO: 270089 - DNA, 25 bp, Homo sapien
gtgaagtcaccagactgtttatgtt

SEQ ID NO: 270090 - DNA, 25 bp, Homo sapien
tagatttttaactgtcacgtgaggt

SEQ ID NO: 270091 - DNA, 25 bp, Homo sapien
actgtcacgtgaggtaggcattatc

SEQ ID NO: 270092 - DNA, 25 bp, Homo sapien
gtgaggtaggcattatcatcattat

SEQ ID NO: 270093 - DNA, 25 bp, Homo sapien
ctccaccagtgggttagtgctgctg

SEQ ID NO: 270094 - DNA, 25 bp, Homo sapien
tacaaacacagaatcagactcagag

SEQ ID NO: 270095 - DNA, 25 bp, Homo sapien
atctggacaaggttacacacttagt

SEQ ID NO: 270096 - DNA, 25 bp, Homo sapien
tacacacttagtaccagagaagctg

SEQ ID NO: 270097 - DNA, 25 bp, Homo sapien
aactcaggtttatttgacttcataa

SEQ ID NO: 270098 - DNA, 25 bp, Homo sapien
ttcataatctttgctcttatccctc

SEQ ID NO: 270099 - DNA, 25 bp, Homo sapien
gctcactaggtcctctctgtttaat

SEQ ID NO: 270100 - DNA, 25 bp, Homo sapien
tcctctctgtttaatctcaacaatc

SEQ ID NO: 270101 - DNA, 25 bp, Homo sapien
agaaattgatgatgctgcccagttt

SEQ ID NO: 270102 - DNA, 25 bp, Homo sapien
cagtttgctaccactgatcctgagc

SEQ ID NO: 270103 - DNA, 25 bp, Homo sapien
cactgatcctgagccacatttggaa

SEQ ID NO: 270104 - DNA, 25 bp, Homo sapien
attaggccatcacatctacagcagt

SEQ ID NO: 270105 - DNA, 25 bp, Homo sapien
ctacagcagtgattcatcttttgaa

SEQ ID NO: 270106 - DNA, 25 bp, Homo sapien
gttcgtggtgcaaatccatggatca

SEQ ID NO: 270107 - DNA, 25 bp, Homo sapien
taagtccgtcagttaaagggaggct

SEQ ID NO: 270108 - DNA, 25 bp, Homo sapien
aagggaggctacgtgtgaatttatc

SEQ ID NO: 270109 - DNA, 25 bp, Homo sapien
gtgaatttatcatcagtctctcaat

SEQ ID NO: 270110 - DNA, 25 bp, Homo sapien
gtctctcaatggaatgttcatggtc

SEQ ID NO: 270111 - DNA, 25 bp, Homo sapien
taaacagcaagctcgccactgtgga

SEQ ID NO: 270112 - DNA, 25 bp, Homo sapien
cccttcatcgtcaagcatgcataca

SEQ ID NO: 270113 - DNA, 25 bp, Homo sapien
agcatgcatacaacctttacaagga

SEQ ID NO: 270114 - DNA, 25 bp, Homo sapien
agactgtgggcaggaaacgccgcca

SEQ ID NO: 270115 - DNA, 25 bp, Homo sapien
aggaaacgccgccacaggctctgct

SEQ ID NO: 270116 - DNA, 25 bp, Homo sapien
gtgaacttatgactacctgtccgtc

SEQ ID NO: 270117 - DNA, 25 bp, Homo sapien
atgactacctgtccgtctgggaatg

SEQ ID NO: 270118 - DNA, 25 bp, Homo sapien
gtctgggaatgttgtaccggaagtt

SEQ ID NO: 270119 - DNA, 25 bp, Homo sapien
aaactgaaccatgccagatgccagg

SEQ ID NO: 270120 - DNA, 25 bp, Homo sapien
gggaatggtgttcctcaacaatgga

SEQ ID NO: 270121 - DNA, 25 bp, Homo sapien
aagacgctgagttatttgcactgga

SEQ ID NO: 270122 - DNA, 25 bp, Homo sapien
actttttctgtctgcccttcatcgt

SEQ ID NO: 270123 - DNA, 25 bp, Homo sapien
gactttgcatgtgtagttacttctc

SEQ ID NO: 270124 - DNA, 25 bp, Homo sapien
agttacttctcctgaaatggccttc

SEQ ID NO: 270125 - DNA, 25 bp, Homo sapien
attcctgccaatccaggtccttatc

SEQ ID NO: 270126 - DNA, 25 bp, Homo sapien
aggtccttatcatccttcaggttgt

SEQ ID NO: 270127 - DNA, 25 bp, Homo sapien
tgtcttaaatgtcatccaggtgtgt

SEQ ID NO: 270128 - DNA, 25 bp, Homo sapien
gtcatccaggtgtgtgtatttttat

SEQ ID NO: 270129 - DNA, 25 bp, Homo sapien
gcggagatgtggcatttgttcatta

SEQ ID NO: 270130 - DNA, 25 bp, Homo sapien
tataatgactatgtgccagcatttc

SEQ ID NO: 270131 - DNA, 25 bp, Homo sapien
gccagcatttccgtatgtgcaagaa

SEQ ID NO: 270132 - DNA, 25 bp, Homo sapien
tagactcaaagagctctgtcatcaa

SEQ ID NO: 270133 - DNA, 25 bp, Homo sapien
tctgtcatcaagctgttgttctgaa

SEQ ID NO: 270134 - DNA, 25 bp, Homo sapien
tttactatcccaggcaagagatcag

SEQ ID NO: 270135 - DNA, 25 bp, Homo sapien
attactatcctcaagggtttgtgac

SEQ ID NO: 270136 - DNA, 25 bp, Homo sapien
gaataaggcctaggaggagaccgaa

SEQ ID NO: 270137 - DNA, 25 bp, Homo sapien
gcggccactgagagatatggagact

SEQ ID NO: 270138 - DNA, 25 bp, Homo sapien
tggagactatagaacaggtcagact

SEQ ID NO: 270139 - DNA, 25 bp, Homo sapien
ggctctgaggtttctggaatggcta

SEQ ID NO: 270140 - DNA, 25 bp, Homo sapien
cagcctgaatactggtgtcattaag

SEQ ID NO: 270141 - DNA, 25 bp, Homo sapien
tgaatactggtgtcattaagcatgt

SEQ ID NO: 270142 - DNA, 25 bp, Homo sapien
attactattgtaaagcagtggataa

SEQ ID NO: 270143 - DNA, 25 bp, Homo sapien
atgagaagctcagtcctatagataa

SEQ ID NO: 270144 - DNA, 25 bp, Homo sapien
gctcagtcctatagataagttatca

SEQ ID NO: 270145 - DNA, 25 bp, Homo sapien
atttgtctcctgactgttactgtat

SEQ ID NO: 270146 - DNA, 25 bp, Homo sapien
actgtatcagttcttacctaaataa

SEQ ID NO: 270147 - DNA, 25 bp, Homo sapien
aacaactgatctccctactttttgc

SEQ ID NO: 270148 - DNA, 25 bp, Homo sapien
actttttgcctatgccctcaaatgt

SEQ ID NO: 270149 - DNA, 25 bp, Homo sapien
atgccctcaaatgtgctcattgttg

SEQ ID NO: 270150 - DNA, 25 bp, Homo sapien
tgtgctcattgttgatctatctccc

SEQ ID NO: 270151 - DNA, 25 bp, Homo sapien
attgttgatctatctccctgttagg

SEQ ID NO: 270152 - DNA, 25 bp, Homo sapien
ctatctccctgttaggtgttctttt

SEQ ID NO: 270153 - DNA, 25 bp, Homo sapien
ttttctcctctttagaaagcagcca

SEQ ID NO: 270154 - DNA, 25 bp, Homo sapien
gaaaccagggttctctcaaagtgga

SEQ ID NO: 270155 - DNA, 25 bp, Homo sapien
ttcacccttcccacttaggcagtgt

SEQ ID NO: 270156 - DNA, 25 bp, Homo sapien
taagagtcacaggaccgcctgttca

SEQ ID NO: 270157 - DNA, 25 bp, Homo sapien
cctgttcaggctcttcatctaagga

SEQ ID NO: 270158 - DNA, 25 bp, Homo sapien
acatacgtgcagacagagcgaccta

SEQ ID NO: 270159 - DNA, 25 bp, Homo sapien
gagcgacctacagtctgtgctacaa

SEQ ID NO: 270160 - DNA, 25 bp, Homo sapien
cagtctgtgctacaacgacatcttc

SEQ ID NO: 270161 - DNA, 25 bp, Homo sapien
aacgacatcttccacgcatcctgag

SEQ ID NO: 270162 - DNA, 25 bp, Homo sapien
gcatcctgagctcggtgttacttac

SEQ ID NO: 270163 - DNA, 25 bp, Homo sapien
tcggtgttacttaccctacagtgga

SEQ ID NO: 270164 - DNA, 25 bp, Homo sapien
aaatagtccaaatatcaaccagctg

SEQ ID NO: 270165 - DNA, 25 bp, Homo sapien
gtataacacagttcccattaccatc

SEQ ID NO: 270166 - DNA, 25 bp, Homo sapien
agttcccattaccatcaagcttatg

SEQ ID NO: 270167 - DNA, 25 bp, Homo sapien
agtaattcataagggatctgtgtaa

SEQ ID NO: 270168 - DNA, 25 bp, Homo sapien
aagggatctgtgtaatctgaatgta

SEQ ID NO: 270169 - DNA, 25 bp, Homo sapien
agctactctatgctagtatagacta

SEQ ID NO: 270170 - DNA, 25 bp, Homo sapien
atttgaataactttagctctactgt

SEQ ID NO: 270171 - DNA, 25 bp, Homo sapien
ataactttagctctactgtttgatt

SEQ ID NO: 270172 - DNA, 25 bp, Homo sapien
tattcccatgtgtcttagaagccca

SEQ ID NO: 270173 - DNA, 25 bp, Homo sapien
ttagaagcccaaagtcagtgagatg

SEQ ID NO: 270174 - DNA, 25 bp, Homo sapien
atgaaacccaacatcaagaaattga

SEQ ID NO: 270175 - DNA, 25 bp, Homo sapien
gtatagactatacaccaataatttt

SEQ ID NO: 270176 - DNA, 25 bp, Homo sapien
agcattaggtagttgggctatagca

SEQ ID NO: 270177 - DNA, 25 bp, Homo sapien
aattttgataatgagttctaggatg

SEQ ID NO: 270178 - DNA, 25 bp, Homo sapien
gagcttctctgactgtgacccggca

SEQ ID NO: 270179 - DNA, 25 bp, Homo sapien
actgtgacccggcagaggcttctgt

SEQ ID NO: 270180 - DNA, 25 bp, Homo sapien
ggccctacagtggagggttctcttt

SEQ ID NO: 270181 - DNA, 25 bp, Homo sapien
ttggaaacaaacagccctgcttggt

SEQ ID NO: 270182 - DNA, 25 bp, Homo sapien
acaaacagccctgcttggtttcagt

SEQ ID NO: 270183 - DNA, 25 bp, Homo sapien
gcttggtttcagtttgaggccactt

SEQ ID NO: 270184 - DNA, 25 bp, Homo sapien
gaggccacttatcttcaatgtgaca

SEQ ID NO: 270185 - DNA, 25 bp, Homo sapien
gccctgtgacactccccattgatga

SEQ ID NO: 270186 - DNA, 25 bp, Homo sapien
tccccattgatgactcccataggta

SEQ ID NO: 270187 - DNA, 25 bp, Homo sapien
gatgactcccataggtacagataaa

SEQ ID NO: 270188 - DNA, 25 bp, Homo sapien
aaacaaatcttttatgccactccag

SEQ ID NO: 270189 - DNA, 25 bp, Homo sapien
cacatctctgtagaggtccctctga

SEQ ID NO: 270190 - DNA, 25 bp, Homo sapien
ggtccctctgagcagaatccagcaa

SEQ ID NO: 270191 - DNA, 25 bp, Homo sapien
tctgagcagaatccagcaaagccca

SEQ ID NO: 270192 - DNA, 25 bp, Homo sapien
atcctcaaagaccactgagtcctaa

SEQ ID NO: 270193 - DNA, 25 bp, Homo sapien
gagtcctaagacaaaccacacaggt

SEQ ID NO: 270194 - DNA, 25 bp, Homo sapien
gggaactggactcaattcataaatt

SEQ ID NO: 270195 - DNA, 25 bp, Homo sapien
caaacaagattctgtggtgtcccaa

SEQ ID NO: 270196 - DNA, 25 bp, Homo sapien
ggaaggaatgatgccatcctcacct

SEQ ID NO: 270197 - DNA, 25 bp, Homo sapien
aatgatgccatcctcacctactgag

SEQ ID NO: 270198 - DNA, 25 bp, Homo sapien
acctactgaggccaggttccggaag

SEQ ID NO: 270199 - DNA, 25 bp, Homo sapien
caggttccggaaggtctccagcatc

SEQ ID NO: 270200 - DNA, 25 bp, Homo sapien
tttattaagctttctaaattccagc

SEQ ID NO: 270201 - DNA, 25 bp, Homo sapien
taaattccagccacattgctgtaca

SEQ ID NO: 270202 - DNA, 25 bp, Homo sapien
agccacattgctgtacatcaacatt

SEQ ID NO: 270203 - DNA, 25 bp, Homo sapien
tgctgtacatcaacattggtttcat

SEQ ID NO: 270204 - DNA, 25 bp, Homo sapien
aacattggtttcattcaacagacat

SEQ ID NO: 270205 - DNA, 25 bp, Homo sapien
ttttggcctgaagatacaaggttca

SEQ ID NO: 270206 - DNA, 25 bp, Homo sapien
aggttcagaaagaggccatccctgc

SEQ ID NO: 270207 - DNA, 25 bp, Homo sapien
tgccctcaaataactttcatactgg

SEQ ID NO: 270208 - DNA, 25 bp, Homo sapien
catactggtgtatgatgaactgacc

SEQ ID NO: 270209 - DNA, 25 bp, Homo sapien
gtgcttacaagctatgtttctgttc

SEQ ID NO: 270210 - DNA, 25 bp, Homo sapien
tgatgttgtatagtttgtagcctgg

SEQ ID NO: 270211 - DNA, 25 bp, Homo sapien
ctctatgtgtcacccggagagtccc

SEQ ID NO: 270212 - DNA, 25 bp, Homo sapien
ccaagctgaacttgacttcctgggc

SEQ ID NO: 270213 - DNA, 25 bp, Homo sapien
gtgtcacccggagagtcccagctaa

SEQ ID NO: 270214 - DNA, 25 bp, Homo sapien
tcacccggagagtcccagctaagag

SEQ ID NO: 270215 - DNA, 25 bp, Homo sapien
cggagagtcccagctaagaggccaa

SEQ ID NO: 270216 - DNA, 25 bp, Homo sapien
tggctggaaccagcttttgaggcat

SEQ ID NO: 270217 - DNA, 25 bp, Homo sapien
gagagtcccagctaagaggccaaat

SEQ ID NO: 270218 - DNA, 25 bp, Homo sapien
gagtcccagctaagaggccaaatga

SEQ ID NO: 270219 - DNA, 25 bp, Homo sapien
tcccagctaagaggccaaatgagta

SEQ ID NO: 270220 - DNA, 25 bp, Homo sapien
aatgcaagacatgaagctgggaggg

SEQ ID NO: 270221 - DNA, 25 bp, Homo sapien
atgctgatctgacctcaggctgctg

SEQ ID NO: 270222 - DNA, 25 bp, Homo sapien
ttaaaaatttacctgctcaccactg

SEQ ID NO: 270223 - DNA, 25 bp, Homo sapien
tcaccactggatttgggacgtctga

SEQ ID NO: 270224 - DNA, 25 bp, Homo sapien
gaatcatgctactacatccttttgc

SEQ ID NO: 270225 - DNA, 25 bp, Homo sapien
atccttttgcactcttggcttgggt

SEQ ID NO: 270226 - DNA, 25 bp, Homo sapien
cttggcttgggtgtgtgtcttttca

SEQ ID NO: 270227 - DNA, 25 bp, Homo sapien
gtgtcttttcatttcatcagctgtc

SEQ ID NO: 270228 - DNA, 25 bp, Homo sapien
ttcatcagctgtcctaaattctgga

SEQ ID NO: 270229 - DNA, 25 bp, Homo sapien
agccagcttatagacatgcaggaac

SEQ ID NO: 270230 - DNA, 25 bp, Homo sapien
gcaggaaccaattgttagttgacgt

SEQ ID NO: 270231 - DNA, 25 bp, Homo sapien
gttagttgacgtgttgatggcttca

SEQ ID NO: 270232 - DNA, 25 bp, Homo sapien
gatggcttcaaaccagtcagtgaaa

SEQ ID NO: 270233 - DNA, 25 bp, Homo sapien
acatcaagaagcctgacaagtcctt

SEQ ID NO: 270234 - DNA, 25 bp, Homo sapien
gcctgacaagtccttcaaatgcaag

SEQ ID NO: 270235 - DNA, 25 bp, Homo sapien
caggctttcttagttgagctgtctt

SEQ ID NO: 270236 - DNA, 25 bp, Homo sapien
agaagcgacatcaacctgtcaaggt

SEQ ID NO: 270237 - DNA, 25 bp, Homo sapien
gtcaaggtggatatggatgctgtca

SEQ ID NO: 270238 - DNA, 25 bp, Homo sapien
agttgagctgtcttcctgaggttgt

SEQ ID NO: 270239 - DNA, 25 bp, Homo sapien
caaagagtcatgtggcttatgtgct

SEQ ID NO: 270240 - DNA, 25 bp, Homo sapien
tggcttatgtgctgaggcctgccca

SEQ ID NO: 270241 - DNA, 25 bp, Homo sapien
ttcctgaggttgtttggagccgctg

SEQ ID NO: 270242 - DNA, 25 bp, Homo sapien
taaagccagtcccaacaagcttgca

SEQ ID NO: 270243 - DNA, 25 bp, Homo sapien
gtcccaacaagcttgcactgaacat

SEQ ID NO: 270244 - DNA, 25 bp, Homo sapien
gggctgattttcagcagacgctcaa

SEQ ID NO: 270245 - DNA, 25 bp, Homo sapien
gacgctcaatttggaaagcctttgg

SEQ ID NO: 270246 - DNA, 25 bp, Homo sapien
ggaaaggtaattgctcagaattgca

SEQ ID NO: 270247 - DNA, 25 bp, Homo sapien
cttttcttcatgtttagcgttaaag

SEQ ID NO: 270248 - DNA, 25 bp, Homo sapien
gcgttaaagaataacagcccacgtt

SEQ ID NO: 270249 - DNA, 25 bp, Homo sapien
agcccacgttttctctgaaagcttt

SEQ ID NO: 270250 - DNA, 25 bp, Homo sapien
tttctgaatcattagagtccagtca

SEQ ID NO: 270251 - DNA, 25 bp, Homo sapien
tagagtccagtcaatgtggttttaa

SEQ ID NO: 270252 - DNA, 25 bp, Homo sapien
gtggttttaatacatgtagcaacag

SEQ ID NO: 270253 - DNA, 25 bp, Homo sapien
ggaacatccatcctgggtttgatca

SEQ ID NO: 270254 - DNA, 25 bp, Homo sapien
ttacaacagccttaaattaccttag

SEQ ID NO: 270255 - DNA, 25 bp, Homo sapien
gcaatcaagcatgctaacccatact

SEQ ID NO: 270256 - DNA, 25 bp, Homo sapien
gcatgctaacccatactgaatgata

SEQ ID NO: 270257 - DNA, 25 bp, Homo sapien
tacttgtagatatttcttcctttcc

SEQ ID NO: 270258 - DNA, 25 bp, Homo sapien
tcctttccttgaaattctcctttct

SEQ ID NO: 270259 - DNA, 25 bp, Homo sapien
ccttgaaattctcctttctatggaa

SEQ ID NO: 270260 - DNA, 25 bp, Homo sapien
ggaatgctcatgcagatttagctct

SEQ ID NO: 270261 - DNA, 25 bp, Homo sapien
gatttagctctgaaggcatatttaa

SEQ ID NO: 270262 - DNA, 25 bp, Homo sapien
gtatgtcttgacaacagtctttaga

SEQ ID NO: 270263 - DNA, 25 bp, Homo sapien
aaagacactttgagttagtccaggc

SEQ ID NO: 270264 - DNA, 25 bp, Homo sapien
gttagtccaggcttaatgtgcaata

SEQ ID NO: 270265 - DNA, 25 bp, Homo sapien
gtgcaatactgactctatactgatc

SEQ ID NO: 270266 - DNA, 25 bp, Homo sapien
catagtagtctaaggcttcaccagc

SEQ ID NO: 270267 - DNA, 25 bp, Homo sapien
tggcccactgtatctagactttagg

SEQ ID NO: 270268 - DNA, 25 bp, Homo sapien
gtatctagactttaggttcatttta

SEQ ID NO: 270269 - DNA, 25 bp, Homo sapien
ttaataattatgctttccttctctg

SEQ ID NO: 270270 - DNA, 25 bp, Homo sapien
tcacttccttagataccttcattca

SEQ ID NO: 270271 - DNA, 25 bp, Homo sapien
tccttagataccttcattcagtgat

SEQ ID NO: 270272 - DNA, 25 bp, Homo sapien
agtgatatatctggcttttacaatt

SEQ ID NO: 270273 - DNA, 25 bp, Homo sapien
gaatatgtcagtaataatccagcac

SEQ ID NO: 270274 - DNA, 25 bp, Homo sapien
gtaagtttctctttggtgggttgag

SEQ ID NO: 270275 - DNA, 25 bp, Homo sapien
gcacacattgaaatattgacacaga

SEQ ID NO: 270276 - DNA, 25 bp, Homo sapien
acagattaccataatttgtgcaaca

SEQ ID NO: 270277 - DNA, 25 bp, Homo sapien
actagttggtaagttgggccttgct

SEQ ID NO: 270278 - DNA, 25 bp, Homo sapien
gtaagttgggccttgctgatagatt

SEQ ID NO: 270279 - DNA, 25 bp, Homo sapien
gggccttgctgatagatttatacac

SEQ ID NO: 270280 - DNA, 25 bp, Homo sapien
gctgatagatttatacactggtgtg

SEQ ID NO: 270281 - DNA, 25 bp, Homo sapien
cactggtgtgtaagccctatactgc

SEQ ID NO: 270282 - DNA, 25 bp, Homo sapien
tgtaagccctatactgctgctgtca

SEQ ID NO: 270283 - DNA, 25 bp, Homo sapien
gctgctgtcactaatgtttttgata

SEQ ID NO: 270284 - DNA, 25 bp, Homo sapien
gtgaatactctctctttccttagcc

SEQ ID NO: 270285 - DNA, 25 bp, Homo sapien
ttagccttggcaacattcttctctg

SEQ ID NO: 270286 - DNA, 25 bp, Homo sapien
cttggcaacattcttctctgtgcta

SEQ ID NO: 270287 - DNA, 25 bp, Homo sapien
gaaatcccatctctgtatccaaatc

SEQ ID NO: 270288 - DNA, 25 bp, Homo sapien
gtaggtttactatacagaactggat

SEQ ID NO: 270289 - DNA, 25 bp, Homo sapien
gttctaactgttcaatagacttcta

SEQ ID NO: 270290 - DNA, 25 bp, Homo sapien
taaatagttccccataccgtgctgc

SEQ ID NO: 270291 - DNA, 25 bp, Homo sapien
taccgtgctgcatcaggatttgatt

SEQ ID NO: 270292 - DNA, 25 bp, Homo sapien
aatggaatccattgtgtccacaatt

SEQ ID NO: 270293 - DNA, 25 bp, Homo sapien
ggatttgatttgtatgccatctgtt

SEQ ID NO: 270294 - DNA, 25 bp, Homo sapien
gtatgccatctgttgcaatgcactt

SEQ ID NO: 270295 - DNA, 25 bp, Homo sapien
cacttggttttacttgcttgtcaat

SEQ ID NO: 270296 - DNA, 25 bp, Homo sapien
ttccaaatgtcttcatggttttgtc

SEQ ID NO: 270297 - DNA, 25 bp, Homo sapien
ttgtgtccacaattgcaaagcaata

SEQ ID NO: 270298 - DNA, 25 bp, Homo sapien
gatagtttgggttgtcagctaggac

SEQ ID NO: 270299 - DNA, 25 bp, Homo sapien
tagtcaagggtacaatgaggtgttt

SEQ ID NO: 270300 - DNA, 25 bp, Homo sapien
tgaggtgttttaaccagaaaatcgt

SEQ ID NO: 270301 - DNA, 25 bp, Homo sapien
atcagaatattctagattgccattg

SEQ ID NO: 270302 - DNA, 25 bp, Homo sapien
gattgccattgtagtcgttcagtgt

SEQ ID NO: 270303 - DNA, 25 bp, Homo sapien
gtagtcgttcagtgtttcaacatct

SEQ ID NO: 270304 - DNA, 25 bp, Homo sapien
gtgtcattgtttagctgtcacagtg

SEQ ID NO: 270305 - DNA, 25 bp, Homo sapien
gtcacagtgtgaaaaacgttttgat

SEQ ID NO: 270306 - DNA, 25 bp, Homo sapien
ttaagctgcattaactccaatgtat

SEQ ID NO: 270307 - DNA, 25 bp, Homo sapien
aacagtttttgacagcttaccttgc

SEQ ID NO: 270308 - DNA, 25 bp, Homo sapien
gtttttgacagcttaccttgcacac

SEQ ID NO: 270309 - DNA, 25 bp, Homo sapien
acagcttaccttgcacactctgaat

SEQ ID NO: 270310 - DNA, 25 bp, Homo sapien
aagtacagcgagtagtccgagagcg

SEQ ID NO: 270311 - DNA, 25 bp, Homo sapien
cagtctggaaaaggcgcccgcggca

SEQ ID NO: 270312 - DNA, 25 bp, Homo sapien
tgccgcccggctatgatgaaacgaa

SEQ ID NO: 270313 - DNA, 25 bp, Homo sapien
cgcccggctatgatgaaacgaaagt

SEQ ID NO: 270314 - DNA, 25 bp, Homo sapien
ggcgaaacggctcttctggaaaacg

SEQ ID NO: 270315 - DNA, 25 bp, Homo sapien
gagtagtccgagagcgcccaccggc

SEQ ID NO: 270316 - DNA, 25 bp, Homo sapien
gctcttctggaaaacgtcgcgggtg

SEQ ID NO: 270317 - DNA, 25 bp, Homo sapien
cttctggaaaacgtcgcgggtgccg

SEQ ID NO: 270318 - DNA, 25 bp, Homo sapien
ctggtacggccgatcatgggcagtt

SEQ ID NO: 270319 - DNA, 25 bp, Homo sapien
acggccgatcatgggcagtttctgc

SEQ ID NO: 270320 - DNA, 25 bp, Homo sapien
agtttctgcacgtagcgcgaggccg

SEQ ID NO: 270321 - DNA, 25 bp, Homo sapien
tgaaggagtcacctacccgacgaga

SEQ ID NO: 270322 - DNA, 25 bp, Homo sapien
tacccgacgagactaacggctgcgg

SEQ ID NO: 270323 - DNA, 25 bp, Homo sapien
gagactaacggctgcggcgcggaag

SEQ ID NO: 270324 - DNA, 25 bp, Homo sapien
agcccgccgagaaccaggaatacga

SEQ ID NO: 270325 - DNA, 25 bp, Homo sapien
accaggaatacgagagccaggcggc

SEQ ID NO: 270326 - DNA, 25 bp, Homo sapien
cggcgggacctgtactgagcaagaa

SEQ ID NO: 270327 - DNA, 25 bp, Homo sapien
gggacctgtactgagcaagaaagaa

SEQ ID NO: 270328 - DNA, 25 bp, Homo sapien
atttattgttatgagatccgtgctt

SEQ ID NO: 270329 - DNA, 25 bp, Homo sapien
atgagatccgtgcttttatcttgtc

SEQ ID NO: 270330 - DNA, 25 bp, Homo sapien
atccgtgcttttatcttgtctcaga

SEQ ID NO: 270331 - DNA, 25 bp, Homo sapien
gtgcttttatcttgtctcagactcc

SEQ ID NO: 270332 - DNA, 25 bp, Homo sapien
cacgttcctgcgttaaagagcccgg

SEQ ID NO: 270333 - DNA, 25 bp, Homo sapien
taaagagcccgggaccagcgcagag

SEQ ID NO: 270334 - DNA, 25 bp, Homo sapien
gcgcagagggcctgatgcctgatct

SEQ ID NO: 270335 - DNA, 25 bp, Homo sapien
tgatgcctgatctgtcaagtctgtc

SEQ ID NO: 270336 - DNA, 25 bp, Homo sapien
tgatctgtcaagtctgtccgaccgt

SEQ ID NO: 270337 - DNA, 25 bp, Homo sapien
aagtctgtccgaccgtgcctgtctg

SEQ ID NO: 270338 - DNA, 25 bp, Homo sapien
cagctgttccagtggtggattggca

SEQ ID NO: 270339 - DNA, 25 bp, Homo sapien
gcccacctagcccaggacaaggagt

SEQ ID NO: 270340 - DNA, 25 bp, Homo sapien
ggccatggaggatagccttcgttat

SEQ ID NO: 270341 - DNA, 25 bp, Homo sapien
gaggatagccttcgttatcgtcagc

SEQ ID NO: 270342 - DNA, 25 bp, Homo sapien
tcgttatcgtcagcctctgtttcca

SEQ ID NO: 270343 - DNA, 25 bp, Homo sapien
cttcacaagtaccatgcagcgcaaa

SEQ ID NO: 270344 - DNA, 25 bp, Homo sapien
aactagtggctagcatcggcttgac

SEQ ID NO: 270345 - DNA, 25 bp, Homo sapien
tcattcccctcgaataactgaagat

SEQ ID NO: 270346 - DNA, 25 bp, Homo sapien
ctgtacaacaatggagactctcgga

SEQ ID NO: 270347 - DNA, 25 bp, Homo sapien
ggagactctcggaacatttatccac

SEQ ID NO: 270348 - DNA, 25 bp, Homo sapien
cggaacatttatccacagtgcaatt

SEQ ID NO: 270349 - DNA, 25 bp, Homo sapien
ttatccacagtgcaattacagaaag

SEQ ID NO: 270350 - DNA, 25 bp, Homo sapien
aaagcagttcgtgatttctctagaa

SEQ ID NO: 270351 - DNA, 25 bp, Homo sapien
gtaccatatgtacaatcccaacaat

SEQ ID NO: 270352 - DNA, 25 bp, Homo sapien
caatcccaacaatcctagacacagt

SEQ ID NO: 270353 - DNA, 25 bp, Homo sapien
atcctagacacagtagaacactcaa

SEQ ID NO: 270354 - DNA, 25 bp, Homo sapien
aataggtcttgcaggtttccttttg

SEQ ID NO: 270355 - DNA, 25 bp, Homo sapien
ggtcttgcaggtttccttttgaatt

SEQ ID NO: 270356 - DNA, 25 bp, Homo sapien
tgcaggtttccttttgaattttaag

SEQ ID NO: 270357 - DNA, 25 bp, Homo sapien
gggtgtcagtaatatctgcagaatg

SEQ ID NO: 270358 - DNA, 25 bp, Homo sapien
gaatgcagtctttcatgctaatgag

SEQ ID NO: 270359 - DNA, 25 bp, Homo sapien
gtctttcatgctaatgagttagtct

SEQ ID NO: 270360 - DNA, 25 bp, Homo sapien
gtgataacaaaggatctttcatgaa

SEQ ID NO: 270361 - DNA, 25 bp, Homo sapien
tttcatgaatgtccaagggtaagtc

SEQ ID NO: 270362 - DNA, 25 bp, Homo sapien
atgtccaagggtaagtcagtattaa

SEQ ID NO: 270363 - DNA, 25 bp, Homo sapien
tgctgtattacaaggcaatgctacc

SEQ ID NO: 270364 - DNA, 25 bp, Homo sapien
aggcaatgctaccttctttattccc

SEQ ID NO: 270365 - DNA, 25 bp, Homo sapien
taactatagcattattctgaaggat

SEQ ID NO: 270366 - DNA, 25 bp, Homo sapien
gaaggattttcaaagtctccatgtg

SEQ ID NO: 270367 - DNA, 25 bp, Homo sapien
aaagtctccatgtgttttgttgcat

SEQ ID NO: 270368 - DNA, 25 bp, Homo sapien
ccatgtgttttgttgcatttaggat

SEQ ID NO: 270369 - DNA, 25 bp, Homo sapien
caatggacaacacaaagcccagtct

SEQ ID NO: 270370 - DNA, 25 bp, Homo sapien
aaagcccagtcttactatttatatg

SEQ ID NO: 270371 - DNA, 25 bp, Homo sapien
gtacagtatttggtgatagagagca

SEQ ID NO: 270372 - DNA, 25 bp, Homo sapien
aaacacatcagaacagttgccttaa

SEQ ID NO: 270373 - DNA, 25 bp, Homo sapien
gaacagttgccttaacactgaaaaa

SEQ ID NO: 270374 - DNA, 25 bp, Homo sapien
gaaaaacataccctgcattttgaaa

SEQ ID NO: 270375 - DNA, 25 bp, Homo sapien
tgtttatggatgtctcagcagttct

SEQ ID NO: 270376 - DNA, 25 bp, Homo sapien
cggccgctctgctgccactatggag

SEQ ID NO: 270377 - DNA, 25 bp, Homo sapien
ctgctgccactatggagccgtggtg

SEQ ID NO: 270378 - DNA, 25 bp, Homo sapien
atgctcttggctggaaggcagtaga

SEQ ID NO: 270379 - DNA, 25 bp, Homo sapien
ggcagtagaacgagtcctgtaccca

SEQ ID NO: 270380 - DNA, 25 bp, Homo sapien
agtagaacgagtcctgtacccacac

SEQ ID NO: 270381 - DNA, 25 bp, Homo sapien
gaacgagtcctgtacccacacctgt

SEQ ID NO: 270382 - DNA, 25 bp, Homo sapien
acctgtccacctactggacaaactt

SEQ ID NO: 270383 - DNA, 25 bp, Homo sapien
actggacaaacttgcaggctgtgct

SEQ ID NO: 270384 - DNA, 25 bp, Homo sapien
ggagccattctggtggcggtagagc

SEQ ID NO: 270385 - DNA, 25 bp, Homo sapien
agatcctggcagatcctgtgcggcc

SEQ ID NO: 270386 - DNA, 25 bp, Homo sapien
tggcagatcctgtgcggccgctctg

SEQ ID NO: 270387 - DNA, 25 bp, Homo sapien
cctacttcagcatttgacccaaatt

SEQ ID NO: 270388 - DNA, 25 bp, Homo sapien
ttcttactaatctcaaagtgcctga

SEQ ID NO: 270389 - DNA, 25 bp, Homo sapien
aagtgcctgaactctttgatcttag

SEQ ID NO: 270390 - DNA, 25 bp, Homo sapien
aagatcattctttcacatcatgcaa

SEQ ID NO: 270391 - DNA, 25 bp, Homo sapien
catcatgcaaatgtcctagcatttt

SEQ ID NO: 270392 - DNA, 25 bp, Homo sapien
ctagcattttcaagcattccaacca

SEQ ID NO: 270393 - DNA, 25 bp, Homo sapien
aagcattccaaccactttgatatca

SEQ ID NO: 270394 - DNA, 25 bp, Homo sapien
tttgatatcattttcacaacatccc

SEQ ID NO: 270395 - DNA, 25 bp, Homo sapien
tggcaagtattattatgtccttctg

SEQ ID NO: 270396 - DNA, 25 bp, Homo sapien
tatgtccttctgagatgaggaagcc

SEQ ID NO: 270397 - DNA, 25 bp, Homo sapien
actgtagtggtagcagccctacttc

SEQ ID NO: 270398 - DNA, 25 bp, Homo sapien
gacatctgatactgcagaccagcct

SEQ ID NO: 270399 - DNA, 25 bp, Homo sapien
gcagaccagccttggctagatccta

SEQ ID NO: 270400 - DNA, 25 bp, Homo sapien
ggctagatcctaggcgtcagagtga

SEQ ID NO: 270401 - DNA, 25 bp, Homo sapien
atcctaggcgtcagagtgaaatcat

SEQ ID NO: 270402 - DNA, 25 bp, Homo sapien
aaatcatgaatttccttttgtagat

SEQ ID NO: 270403 - DNA, 25 bp, Homo sapien
gattagaattgatggtccaactctc

SEQ ID NO: 270404 - DNA, 25 bp, Homo sapien
gtaaaagccagatatatcactgaat

SEQ ID NO: 270405 - DNA, 25 bp, Homo sapien
aagtgatatttatcaacttcccaaa

SEQ ID NO: 270406 - DNA, 25 bp, Homo sapien
tcaacttcccaaatgatacagagaa

SEQ ID NO: 270407 - DNA, 25 bp, Homo sapien
aagtctagatacagtgggccaggct

SEQ ID NO: 270408 - DNA, 25 bp, Homo sapien
gctggtgaagccttagactactatg

SEQ ID NO: 270409 - DNA, 25 bp, Homo sapien
ggaatcacaacacatagggtttttt

SEQ ID NO: 270410 - DNA, 25 bp, Homo sapien
gaaatggtctttaatgaagcaagcc

SEQ ID NO: 270411 - DNA, 25 bp, Homo sapien
tttaatgaagcaagccatgtgtggc

SEQ ID NO: 270412 - DNA, 25 bp, Homo sapien
ccatgtgtggcttttcaggcgagca

SEQ ID NO: 270413 - DNA, 25 bp, Homo sapien
ggcttttcaggcgagcattttcatg

SEQ ID NO: 270414 - DNA, 25 bp, Homo sapien
tcaggcgagcattttcatgcttggt

SEQ ID NO: 270415 - DNA, 25 bp, Homo sapien
ttcatgcttggttaactgtaaggat

SEQ ID NO: 270416 - DNA, 25 bp, Homo sapien
aaggatgttcatgttcctttcccaa

SEQ ID NO: 270417 - DNA, 25 bp, Homo sapien
aaagcaacttattcactggagatgt

SEQ ID NO: 270418 - DNA, 25 bp, Homo sapien
gagatgtgaggagccatccgcacat

SEQ ID NO: 270419 - DNA, 25 bp, Homo sapien
ggagccatccgcacatcacaattct

SEQ ID NO: 270420 - DNA, 25 bp, Homo sapien
gcccagccgggttttattcacaaca

SEQ ID NO: 270421 - DNA, 25 bp, Homo sapien
agccgggttttattcacaacagtga

SEQ ID NO: 270422 - DNA, 25 bp, Homo sapien
caacagtgaactgcttttagtcagt

SEQ ID NO: 270423 - DNA, 25 bp, Homo sapien
ctgcttttagtcagtggtgaagtga

SEQ ID NO: 270424 - DNA, 25 bp, Homo sapien
gtgatgcatgattccagtttttctg

SEQ ID NO: 270425 - DNA, 25 bp, Homo sapien
gaggagcagcctcccatcctaaatg

SEQ ID NO: 270426 - DNA, 25 bp, Homo sapien
tcctaaatgccgatgcagccccggg

SEQ ID NO: 270427 - DNA, 25 bp, Homo sapien
tgcagccccgggtccagaaaaggtg

SEQ ID NO: 270428 - DNA, 25 bp, Homo sapien
ggtgacgagtgttgtgccttttaaa

SEQ ID NO: 270429 - DNA, 25 bp, Homo sapien
aacagagggacctattgtcaaggac

SEQ ID NO: 270430 - DNA, 25 bp, Homo sapien
tgtcaaggacgaggctcttcagatt

SEQ ID NO: 270431 - DNA, 25 bp, Homo sapien
gaggcgatggtaaactagacccact

SEQ ID NO: 270432 - DNA, 25 bp, Homo sapien
gatggtaaactagacccactgtgtg

SEQ ID NO: 270433 - DNA, 25 bp, Homo sapien
gtaaactagacccactgtgtgaaaa

SEQ ID NO: 270434 - DNA, 25 bp, Homo sapien
aaaggccaggatagccgtgctgaat

SEQ ID NO: 270435 - DNA, 25 bp, Homo sapien
gatagccgtgctgaatgcctactga

SEQ ID NO: 270436 - DNA, 25 bp, Homo sapien
agccgtgctgaatgcctactgatct

SEQ ID NO: 270437 - DNA, 25 bp, Homo sapien
aatgcctactgatctcctcatggaa

SEQ ID NO: 270438 - DNA, 25 bp, Homo sapien
actgatctcctcatggaacaggcat

SEQ ID NO: 270439 - DNA, 25 bp, Homo sapien
atctcctcatggaacaggcatctca

SEQ ID NO: 270440 - DNA, 25 bp, Homo sapien
gaacaggcatctcaagtcggcacaa

SEQ ID NO: 270441 - DNA, 25 bp, Homo sapien
gctgccccagccattctatgatgca

SEQ ID NO: 270442 - DNA, 25 bp, Homo sapien
agacatttatgctgcttgccttcaa

SEQ ID NO: 270443 - DNA, 25 bp, Homo sapien
cttgccttcaagtaaatatcagcta

SEQ ID NO: 270444 - DNA, 25 bp, Homo sapien
ggaatattagactgtctcccttttc

SEQ ID NO: 270445 - DNA, 25 bp, Homo sapien
gatttagtattattcctcctggcat

SEQ ID NO: 270446 - DNA, 25 bp, Homo sapien
ttccctgtaaagtgggcctttaatg

SEQ ID NO: 270447 - DNA, 25 bp, Homo sapien
atgggatggccacactttattgatg

SEQ ID NO: 270448 - DNA, 25 bp, Homo sapien
gatgggaatcctgtgttcaagttga

SEQ ID NO: 270449 - DNA, 25 bp, Homo sapien
atgaagcctaactagtaacctacaa

SEQ ID NO: 270450 - DNA, 25 bp, Homo sapien
ctggcattcctcattctaacttttg

SEQ ID NO: 270451 - DNA, 25 bp, Homo sapien
attctaacttttgccatcacctgag

SEQ ID NO: 270452 - DNA, 25 bp, Homo sapien
gcaccagggtgcacatctttaaaga

SEQ ID NO: 270453 - DNA, 25 bp, Homo sapien
taaacatttcttaggctgtgaaata

SEQ ID NO: 270454 - DNA, 25 bp, Homo sapien
gagtctttgattaaggtctctacat

SEQ ID NO: 270455 - DNA, 25 bp, Homo sapien
gattaaggtctctacatgaaggaaa

SEQ ID NO: 270456 - DNA, 25 bp, Homo sapien
gaactacaagttcatctgcagtatg

SEQ ID NO: 270457 - DNA, 25 bp, Homo sapien
catctgcagtatgaacttgggagaa

SEQ ID NO: 270458 - DNA, 25 bp, Homo sapien
cttgggagaaactggatctattgac

SEQ ID NO: 270459 - DNA, 25 bp, Homo sapien
ggatctattgactaggaggccttct

SEQ ID NO: 270460 - DNA, 25 bp, Homo sapien
gactaggaggccttctcagctgcca

SEQ ID NO: 270461 - DNA, 25 bp, Homo sapien
cataattttctcaacatgacttagt

SEQ ID NO: 270462 - DNA, 25 bp, Homo sapien
tgacttagtatttggtaatggaccc

SEQ ID NO: 270463 - DNA, 25 bp, Homo sapien
tagtatttggtaatggacccaacct

SEQ ID NO: 270464 - DNA, 25 bp, Homo sapien
agagctctgttgagtaatcttttaa

SEQ ID NO: 270465 - DNA, 25 bp, Homo sapien
gctgcagctacccttttgagattaa

SEQ ID NO: 270466 - DNA, 25 bp, Homo sapien
gattaagtaatagctccctgtttgt

SEQ ID NO: 270467 - DNA, 25 bp, Homo sapien
aatagctccctgtttgtgccttgtt

SEQ ID NO: 270468 - DNA, 25 bp, Homo sapien
tttgtgccttgttagggctagggat

SEQ ID NO: 270469 - DNA, 25 bp, Homo sapien
gatgtttaaggatccttgcccttgc

SEQ ID NO: 270470 - DNA, 25 bp, Homo sapien
tagtcctagcatgttttgttgtccc

SEQ ID NO: 270471 - DNA, 25 bp, Homo sapien
aaactttcctcaattacacaatttg

SEQ ID NO: 270472 - DNA, 25 bp, Homo sapien
atttgatcttgttcctaccagtacc

SEQ ID NO: 270473 - DNA, 25 bp, Homo sapien
cagtacctttgctggtacaacctaa

SEQ ID NO: 270474 - DNA, 25 bp, Homo sapien
cagtttcactcttaggcatttaccc

SEQ ID NO: 270475 - DNA, 25 bp, Homo sapien
cattgctgtcgctggttgatggtga

SEQ ID NO: 270476 - DNA, 25 bp, Homo sapien
gatggcacttaatgagaacctggtc

SEQ ID NO: 270477 - DNA, 25 bp, Homo sapien
gaacctggtcattgggaaagcccca

SEQ ID NO: 270478 - DNA, 25 bp, Homo sapien
tgggaaagccccaagcctgcgtctt

SEQ ID NO: 270479 - DNA, 25 bp, Homo sapien
aagcctgcgtcttgctgtgatgcct

SEQ ID NO: 270480 - DNA, 25 bp, Homo sapien
agtggacgagtgactgtccctggtt

SEQ ID NO: 270481 - DNA, 25 bp, Homo sapien
ttgctgtgatgccttccccattatg

SEQ ID NO: 270482 - DNA, 25 bp, Homo sapien
ttccccattatgaagggtccattgg

SEQ ID NO: 270483 - DNA, 25 bp, Homo sapien
ctggtttgggctggtgccatttaga

SEQ ID NO: 270484 - DNA, 25 bp, Homo sapien
catttagagggcaaccagagtgcag

SEQ ID NO: 270485 - DNA, 25 bp, Homo sapien
aagagggacattgctgtcgctggtt

SEQ ID NO: 270486 - DNA, 25 bp, Homo sapien
acaagcctacgtgttcctgaagcag

SEQ ID NO: 270487 - DNA, 25 bp, Homo sapien
gaagcagatccccaaggcgcgtatg

SEQ ID NO: 270488 - DNA, 25 bp, Homo sapien
gtatgcagttgaagcgcctggccaa

SEQ ID NO: 270489 - DNA, 25 bp, Homo sapien
gctggctcctgctggctgacattta

SEQ ID NO: 270490 - DNA, 25 bp, Homo sapien
gctgacatttactgccagggcagca

SEQ ID NO: 270491 - DNA, 25 bp, Homo sapien
agcaagttcgacctcgccttagaac

SEQ ID NO: 270492 - DNA, 25 bp, Homo sapien
ccttagaactgctgcggcgctgtgt

SEQ ID NO: 270493 - DNA, 25 bp, Homo sapien
tgcggcgctgtgtgcaatacaacaa

SEQ ID NO: 270494 - DNA, 25 bp, Homo sapien
aacaagtcctgctacaaggcctatg

SEQ ID NO: 270495 - DNA, 25 bp, Homo sapien
gaaggagcagtcctacaaggatgca

SEQ ID NO: 270496 - DNA, 25 bp, Homo sapien
aaggatgcagtcaccaactacaaac

SEQ ID NO: 270497 - DNA, 25 bp, Homo sapien
attcaaaacctgctgaacactcacc

SEQ ID NO: 270498 - DNA, 25 bp, Homo sapien
tgaacactcaccctcaatgtatatt

SEQ ID NO: 270499 - DNA, 25 bp, Homo sapien
ttctggcctgcttcaaggtcagtta

SEQ ID NO: 270500 - DNA, 25 bp, Homo sapien
aggtcagttacactacttcctggga

SEQ ID NO: 270501 - DNA, 25 bp, Homo sapien
agttacactacttcctgggatgggc

SEQ ID NO: 270502 - DNA, 25 bp, Homo sapien
gcctttctctggcttaagcttggtt

SEQ ID NO: 270503 - DNA, 25 bp, Homo sapien
tggcttaagcttggttgtccctggc

SEQ ID NO: 270504 - DNA, 25 bp, Homo sapien
ttggttgtccctggctttcccaagg

SEQ ID NO: 270505 - DNA, 25 bp, Homo sapien
tttcccaaggatcacagcccaaaag

SEQ ID NO: 270506 - DNA, 25 bp, Homo sapien
gagtgagcagcctaatcaagccaag

SEQ ID NO: 270507 - DNA, 25 bp, Homo sapien
agggagaaggatgttgcatcccttt

SEQ ID NO: 270508 - DNA, 25 bp, Homo sapien
aagtttacttgctgaatttcccata

SEQ ID NO: 270509 - DNA, 25 bp, Homo sapien
ttccactgggcttgccagaggattt

SEQ ID NO: 270510 - DNA, 25 bp, Homo sapien
aaacagtggtgagccctggaaggaa

SEQ ID NO: 270511 - DNA, 25 bp, Homo sapien
ggaatatttactggcccttggacat

SEQ ID NO: 270512 - DNA, 25 bp, Homo sapien
gacataaacccagcacagtaagact

SEQ ID NO: 270513 - DNA, 25 bp, Homo sapien
gtaagactcacatcaggctgaaggc

SEQ ID NO: 270514 - DNA, 25 bp, Homo sapien
gaaggcagtgcagtatgaaccgacc

SEQ ID NO: 270515 - DNA, 25 bp, Homo sapien
ttgaggaagtttgctctgggactcc

SEQ ID NO: 270516 - DNA, 25 bp, Homo sapien
tgggactcctctgagctactaaatg

SEQ ID NO: 270517 - DNA, 25 bp, Homo sapien
aggactaatgggaacacactgactc

SEQ ID NO: 270518 - DNA, 25 bp, Homo sapien
acacactgactccatcacattagaa

SEQ ID NO: 270519 - DNA, 25 bp, Homo sapien
aacagttccagttgtgtatgtacca

SEQ ID NO: 270520 - DNA, 25 bp, Homo sapien
tgtaccaactctaggaacaccacag

SEQ ID NO: 270521 - DNA, 25 bp, Homo sapien
acttcatgagtctacaacctccatt

SEQ ID NO: 270522 - DNA, 25 bp, Homo sapien
attggcccaaagtcggctgcaacat

SEQ ID NO: 270523 - DNA, 25 bp, Homo sapien
aagtcggctgcaacattggttatgg

SEQ ID NO: 270524 - DNA, 25 bp, Homo sapien
ataaggcactaacctctgcttggac

SEQ ID NO: 270525 - DNA, 25 bp, Homo sapien
atgaagatttctagtcctcgacaag

SEQ ID NO: 270526 - DNA, 25 bp, Homo sapien
gtcctcgacaagaagcctaacagca

SEQ ID NO: 270527 - DNA, 25 bp, Homo sapien
aagcctaacagcaacttctacatta

SEQ ID NO: 270528 - DNA, 25 bp, Homo sapien
aagtttccagataaggcttctgaga

SEQ ID NO: 270529 - DNA, 25 bp, Homo sapien
taaagcatcctaagctgtttcttaa

SEQ ID NO: 270530 - DNA, 25 bp, Homo sapien
gaagcaggagtggaagctctctaag

SEQ ID NO: 270531 - DNA, 25 bp, Homo sapien
gaagctctctaagggatacgaaatc

SEQ ID NO: 270532 - DNA, 25 bp, Homo sapien
acgaaatctgattttatccaaagaa

SEQ ID NO: 270533 - DNA, 25 bp, Homo sapien
aatcacagcagcctttgaaagacac

SEQ ID NO: 270534 - DNA, 25 bp, Homo sapien
agcagcctttgaaagacacattcag

SEQ ID NO: 270535 - DNA, 25 bp, Homo sapien
atttcaaaaccaggcgctctgctta

SEQ ID NO: 270536 - DNA, 25 bp, Homo sapien
aggcgctctgcttattcactgaaac

SEQ ID NO: 270537 - DNA, 25 bp, Homo sapien
cactgaaaccgtaagctgctgaaac

SEQ ID NO: 270538 - DNA, 25 bp, Homo sapien
taagaaactggtcttaaagcttcag

SEQ ID NO: 270539 - DNA, 25 bp, Homo sapien
gcttcaggccaaacaatgcttcaaa

SEQ ID NO: 270540 - DNA, 25 bp, Homo sapien
gaaaaatcagttatcaattacctaa

SEQ ID NO: 270541 - DNA, 25 bp, Homo sapien
caggctctggaagggagcaccccat

SEQ ID NO: 270542 - DNA, 25 bp, Homo sapien
aggcagagtgtgctctcacccctta

SEQ ID NO: 270543 - DNA, 25 bp, Homo sapien
accccttagctctgtagtgatttta

SEQ ID NO: 270544 - DNA, 25 bp, Homo sapien
atgattaaggctactgttcggtctg

SEQ ID NO: 270545 - DNA, 25 bp, Homo sapien
ttaaggctactgttcggtctgcatt

SEQ ID NO: 270546 - DNA, 25 bp, Homo sapien
ggctactgttcggtctgcatttgga

SEQ ID NO: 270547 - DNA, 25 bp, Homo sapien
ctgttcggtctgcatttggacctga

SEQ ID NO: 270548 - DNA, 25 bp, Homo sapien
tttggacctgagcaacagggacccc

SEQ ID NO: 270549 - DNA, 25 bp, Homo sapien
gagcaacagggacccctgcccagag

SEQ ID NO: 270550 - DNA, 25 bp, Homo sapien
cagaggtccatccttcagcagggtg

SEQ ID NO: 270551 - DNA, 25 bp, Homo sapien
gtccatccttcagcagggtgcactg

SEQ ID NO: 270552 - DNA, 25 bp, Homo sapien
tttacatcaccaataggatctgagg

SEQ ID NO: 270553 - DNA, 25 bp, Homo sapien
gagatggcgggtattatcactggca

SEQ ID NO: 270554 - DNA, 25 bp, Homo sapien
ggcgggtattatcactggcatttta

SEQ ID NO: 270555 - DNA, 25 bp, Homo sapien
attatcactggcattttacaggtga

SEQ ID NO: 270556 - DNA, 25 bp, Homo sapien
ttacaggtgagaaagcccaaagcca

SEQ ID NO: 270557 - DNA, 25 bp, Homo sapien
aagcccaaagccactgaggtaatta

SEQ ID NO: 270558 - DNA, 25 bp, Homo sapien
taattgattttgaacttgggtctgt

SEQ ID NO: 270559 - DNA, 25 bp, Homo sapien
tcatgtgcaagattatatacttagt

SEQ ID NO: 270560 - DNA, 25 bp, Homo sapien
taaaccagactattaactcttacct

SEQ ID NO: 270561 - DNA, 25 bp, Homo sapien
aactcttacctttataaccacagat

SEQ ID NO: 270562 - DNA, 25 bp, Homo sapien
acttagatttggtgatgctaggaat

SEQ ID NO: 270563 - DNA, 25 bp, Homo sapien
ggacatggcgaagtttacagactga

SEQ ID NO: 270564 - DNA, 25 bp, Homo sapien
atggttggtacagtaagtctttgac

SEQ ID NO: 270565 - DNA, 25 bp, Homo sapien
ttgaccacattttctgaaggtcatg

SEQ ID NO: 270566 - DNA, 25 bp, Homo sapien
agaaacgggcttttctctagctggt

SEQ ID NO: 270567 - DNA, 25 bp, Homo sapien
tctctagctggtttaggctggaagc

SEQ ID NO: 270568 - DNA, 25 bp, Homo sapien
ctggtttaggctggaagctgtgtcc

SEQ ID NO: 270569 - DNA, 25 bp, Homo sapien
ggtcgatgggatggcatattgttaa

SEQ ID NO: 270570 - DNA, 25 bp, Homo sapien
aaagaatctccattgtcgtcactgt

SEQ ID NO: 270571 - DNA, 25 bp, Homo sapien
tgtcgtcactgtcctgtggatgtta

SEQ ID NO: 270572 - DNA, 25 bp, Homo sapien
gaaccagtcatggagaccagccagt

SEQ ID NO: 270573 - DNA, 25 bp, Homo sapien
ggagaccagccagtttagatggtaa

SEQ ID NO: 270574 - DNA, 25 bp, Homo sapien
ctacaagcaatttcaggcattataa

SEQ ID NO: 270575 - DNA, 25 bp, Homo sapien
tatttcaggtaattttagccgtctt

SEQ ID NO: 270576 - DNA, 25 bp, Homo sapien
ttgaaagccgaggacgcacataaaa

SEQ ID NO: 270577 - DNA, 25 bp, Homo sapien
ccatgtgggagacttagcctatttg

SEQ ID NO: 270578 - DNA, 25 bp, Homo sapien
ggcttacagaaagagccatcagcca

SEQ ID NO: 270579 - DNA, 25 bp, Homo sapien
gccagagggctcctacagagtcatg

SEQ ID NO: 270580 - DNA, 25 bp, Homo sapien
cagagggctcctacagagtcatggg

SEQ ID NO: 270581 - DNA, 25 bp, Homo sapien
caagcgcctgctgcctcatgggtag

SEQ ID NO: 270582 - DNA, 25 bp, Homo sapien
gcctgctgcctcatgggtagacaag

SEQ ID NO: 270583 - DNA, 25 bp, Homo sapien
gctgcctcatgggtagacaaggtta

SEQ ID NO: 270584 - DNA, 25 bp, Homo sapien
catgggtagacaaggttagagaaca

SEQ ID NO: 270585 - DNA, 25 bp, Homo sapien
agataacatgctagcctggaattgt

SEQ ID NO: 270586 - DNA, 25 bp, Homo sapien
tattttacctgcctacctacctgaa

SEQ ID NO: 270587 - DNA, 25 bp, Homo sapien
acctgcctacctacctgaatgaatg

SEQ ID NO: 270588 - DNA, 25 bp, Homo sapien
atggttgactgaattaagctgacac

SEQ ID NO: 270589 - DNA, 25 bp, Homo sapien
cagtctccattgtgcctccttcaga

SEQ ID NO: 270590 - DNA, 25 bp, Homo sapien
tgtgtccatcattccagtgtgagca

SEQ ID NO: 270591 - DNA, 25 bp, Homo sapien
gtgtgagcacatgatctgagcccgg

SEQ ID NO: 270592 - DNA, 25 bp, Homo sapien
gatctgagcccggtcagtgaggttt

SEQ ID NO: 270593 - DNA, 25 bp, Homo sapien
gcccggtcagtgaggtttaatttca

SEQ ID NO: 270594 - DNA, 25 bp, Homo sapien
tttcaggactttggttggaactctt

SEQ ID NO: 270595 - DNA, 25 bp, Homo sapien
ctcttgggaaagacaagttctccct

SEQ ID NO: 270596 - DNA, 25 bp, Homo sapien
cttactctccaaaatcaccaaatct

SEQ ID NO: 270597 - DNA, 25 bp, Homo sapien
aacaggctgattgtatctgtctatg

SEQ ID NO: 270598 - DNA, 25 bp, Homo sapien
tctgtctatgagcaaaggaaacctg

SEQ ID NO: 270599 - DNA, 25 bp, Homo sapien
gacagagttgtcatgtgtctgcctg

SEQ ID NO: 270600 - DNA, 25 bp, Homo sapien
tcatgtgtctgcctgtctacacttg

SEQ ID NO: 270601 - DNA, 25 bp, Homo sapien
gtctacacttgctgtgcagaacatc

SEQ ID NO: 270602 - DNA, 25 bp, Homo sapien
acttgctgtgcagaacatccgctca

SEQ ID NO: 270603 - DNA, 25 bp, Homo sapien
gaatgacaaccagccattgaaagaa

SEQ ID NO: 270604 - DNA, 25 bp, Homo sapien
gaaagcagccctcacaccatagcat

SEQ ID NO: 270605 - DNA, 25 bp, Homo sapien
acaccatagcatctacaccaagagc

SEQ ID NO: 270606 - DNA, 25 bp, Homo sapien
tacaccaagagctacaaccaaaatg

SEQ ID NO: 270607 - DNA, 25 bp, Homo sapien
ggcagtgaagaagactccgaagaag

SEQ ID NO: 270608 - DNA, 25 bp, Homo sapien
gaaggcgaagaagcccgcggcggct

SEQ ID NO: 270609 - DNA, 25 bp, Homo sapien
aaaggtggcgaagagccctaagaag

SEQ ID NO: 270610 - DNA, 25 bp, Homo sapien
caaggccgctgccaaaccgaaaaag

SEQ ID NO: 270611 - DNA, 25 bp, Homo sapien
aaggcaaccaagagtcctgccaagc

SEQ ID NO: 270612 - DNA, 25 bp, Homo sapien
caagcccaaggcagttaagccgaag

SEQ ID NO: 270613 - DNA, 25 bp, Homo sapien
agccgaaggcggcaaagcccaaagc

SEQ ID NO: 270614 - DNA, 25 bp, Homo sapien
ggcggcaaagcccaaagccgctaag

SEQ ID NO: 270615 - DNA, 25 bp, Homo sapien
gcaaaacctaaagctgcaaaggcca

SEQ ID NO: 270616 - DNA, 25 bp, Homo sapien
ccaagaaggcggctgccaaaaagaa

SEQ ID NO: 270617 - DNA, 25 bp, Homo sapien
gaagctggcgtgtgaaaaccgcaac

SEQ ID NO: 270618 - DNA, 25 bp, Homo sapien
gcctcttgttctcttccataagatt

SEQ ID NO: 270619 - DNA, 25 bp, Homo sapien
taagatttttctgggtcaggccagg

SEQ ID NO: 270620 - DNA, 25 bp, Homo sapien
tgaggtgctgtctcttcattgtcca

SEQ ID NO: 270621 - DNA, 25 bp, Homo sapien
gtccaggcctctctgactcaaaatg

SEQ ID NO: 270622 - DNA, 25 bp, Homo sapien
ctctgactcaaaatgcctacacctg

SEQ ID NO: 270623 - DNA, 25 bp, Homo sapien
gaaggataactcatgtgccacagcg

SEQ ID NO: 270624 - DNA, 25 bp, Homo sapien
ctcatgtgccacagcgaggtcgagg

SEQ ID NO: 270625 - DNA, 25 bp, Homo sapien
gaggtcgaggctggccttctctttt

SEQ ID NO: 270626 - DNA, 25 bp, Homo sapien
ccaaagaggatgttaagcttctaca

SEQ ID NO: 270627 - DNA, 25 bp, Homo sapien
agcttctacatctagaatgcctgtg

SEQ ID NO: 270628 - DNA, 25 bp, Homo sapien
gaatgcctgtgactctgaccataag

SEQ ID NO: 270629 - DNA, 25 bp, Homo sapien
ggtgaactctactttcctgaggatc

SEQ ID NO: 270630 - DNA, 25 bp, Homo sapien
tggctaccaacatccccaaaggctg

SEQ ID NO: 270631 - DNA, 25 bp, Homo sapien
agctgtcagagttcatgtctcctac

SEQ ID NO: 270632 - DNA, 25 bp, Homo sapien
tcatgtctcctacctggatggcaaa

SEQ ID NO: 270633 - DNA, 25 bp, Homo sapien
gatggcaaagggaacctggcacctc

SEQ ID NO: 270634 - DNA, 25 bp, Homo sapien
gtcttcactgacagatgaccttctc

SEQ ID NO: 270635 - DNA, 25 bp, Homo sapien
tgaccttctcaagtactatcaccag

SEQ ID NO: 270636 - DNA, 25 bp, Homo sapien
tatcaccaggtgactcgtgctgtgc

SEQ ID NO: 270637 - DNA, 25 bp, Homo sapien
gggatgatccgcaactgatgaaggt

SEQ ID NO: 270638 - DNA, 25 bp, Homo sapien
tgatgaaggttgcactccaggactt

SEQ ID NO: 270639 - DNA, 25 bp, Homo sapien
ggacttgcagacgaactccaagatt

SEQ ID NO: 270640 - DNA, 25 bp, Homo sapien
tcatgtctcctgctagaatagtatt

SEQ ID NO: 270641 - DNA, 25 bp, Homo sapien
gtctcctgctagaatagtattggat

SEQ ID NO: 270642 - DNA, 25 bp, Homo sapien
agtattggatacctgactaaattac

SEQ ID NO: 270643 - DNA, 25 bp, Homo sapien
ggatacctgactaaattacacaaaa

SEQ ID NO: 270644 - DNA, 25 bp, Homo sapien
tagaccataataggatagcgctgtg

SEQ ID NO: 270645 - DNA, 25 bp, Homo sapien
gatagcgctgtgaatacatccttcc

SEQ ID NO: 270646 - DNA, 25 bp, Homo sapien
agcgctgtgaatacatccttcccga

SEQ ID NO: 270647 - DNA, 25 bp, Homo sapien
tgtgaatacatccttcccgatcact

SEQ ID NO: 270648 - DNA, 25 bp, Homo sapien
atccttcccgatcactgagtcacag

SEQ ID NO: 270649 - DNA, 25 bp, Homo sapien
gatcactgagtcacagtgacccttg

SEQ ID NO: 270650 - DNA, 25 bp, Homo sapien
gagtcacagtgacccttggctgctg

SEQ ID NO: 270651 - DNA, 25 bp, Homo sapien
gtcattagggactatgggccacctt

SEQ ID NO: 270652 - DNA, 25 bp, Homo sapien
ggactatgggccaccttttaggaag

SEQ ID NO: 270653 - DNA, 25 bp, Homo sapien
tgggccaccttttaggaagatttat

SEQ ID NO: 270654 - DNA, 25 bp, Homo sapien
atagtgttttggcaattcaagtttc

SEQ ID NO: 270655 - DNA, 25 bp, Homo sapien
aaatgtaattgatgggaacctcagt

SEQ ID NO: 270656 - DNA, 25 bp, Homo sapien
gggaacctcagtgactctggatgaa

SEQ ID NO: 270657 - DNA, 25 bp, Homo sapien
gactctggatgaataagatgctgtt

SEQ ID NO: 270658 - DNA, 25 bp, Homo sapien
agatgctgttgagtggctctgactt

SEQ ID NO: 270659 - DNA, 25 bp, Homo sapien
ggaaggttgtaattaaacagcacat

SEQ ID NO: 270660 - DNA, 25 bp, Homo sapien
tcacattattgtcccattccatagg

SEQ ID NO: 270661 - DNA, 25 bp, Homo sapien
attccatagggataatgatgaccac

SEQ ID NO: 270662 - DNA, 25 bp, Homo sapien
accagttgtcatggtttggccagct

SEQ ID NO: 270663 - DNA, 25 bp, Homo sapien
aaaatacactctcattcgtttccag

SEQ ID NO: 270664 - DNA, 25 bp, Homo sapien
tcgtttccagaacgttacgtgtcca

SEQ ID NO: 270665 - DNA, 25 bp, Homo sapien
agtcatgggctttgtctagcaccgc

SEQ ID NO: 270666 - DNA, 25 bp, Homo sapien
gaacgttacgtgtccagaacatagt

SEQ ID NO: 270667 - DNA, 25 bp, Homo sapien
gatgtttgtttctaataccgattga

SEQ ID NO: 270668 - DNA, 25 bp, Homo sapien
tgaaagtgctttcctaccaattccc

SEQ ID NO: 270669 - DNA, 25 bp, Homo sapien
gctttgtctagcaccgcttttgaag

SEQ ID NO: 270670 - DNA, 25 bp, Homo sapien
aatttggttgtctaggacgctttca

SEQ ID NO: 270671 - DNA, 25 bp, Homo sapien
gacgctttcatccttttcacaagga

SEQ ID NO: 270672 - DNA, 25 bp, Homo sapien
tttcacaaggactgcgtacaaacca

SEQ ID NO: 270673 - DNA, 25 bp, Homo sapien
gcagcagcgacgacgagcacgatgt

SEQ ID NO: 270674 - DNA, 25 bp, Homo sapien
acggcagcgccaagagcccggcagt

SEQ ID NO: 270675 - DNA, 25 bp, Homo sapien
tccccggcggtcacgagatttcagc

SEQ ID NO: 270676 - DNA, 25 bp, Homo sapien
ggtcacgagatttcagcctgtgcag

SEQ ID NO: 270677 - DNA, 25 bp, Homo sapien
atttcagcctgtgcagggattgggc

SEQ ID NO: 270678 - DNA, 25 bp, Homo sapien
attgggcgagagttccgcatatgga

SEQ ID NO: 270679 - DNA, 25 bp, Homo sapien
agagttccgcatatggaggcgccct

SEQ ID NO: 270680 - DNA, 25 bp, Homo sapien
atggaggcgcccttgctggagcctc

SEQ ID NO: 270681 - DNA, 25 bp, Homo sapien
agcctctcggagtggagcgcgtttc

SEQ ID NO: 270682 - DNA, 25 bp, Homo sapien
ggagtggagcgcgtttccttctccc

SEQ ID NO: 270683 - DNA, 25 bp, Homo sapien
caacggcgggctgcactactcagag

SEQ ID NO: 270684 - DNA, 25 bp, Homo sapien
tatattctatgagcttctctcttgg

SEQ ID NO: 270685 - DNA, 25 bp, Homo sapien
cttaggcttcatctggtagaattaa

SEQ ID NO: 270686 - DNA, 25 bp, Homo sapien
taaaagttacattgggtcacacgtc

SEQ ID NO: 270687 - DNA, 25 bp, Homo sapien
attgggtcacacgtcccaggtgttg

SEQ ID NO: 270688 - DNA, 25 bp, Homo sapien
gtcccaggtgttgcatcacaggcca

SEQ ID NO: 270689 - DNA, 25 bp, Homo sapien
atcacaggccacagaattacctata

SEQ ID NO: 270690 - DNA, 25 bp, Homo sapien
gaattacctatataaaactgagtgc

SEQ ID NO: 270691 - DNA, 25 bp, Homo sapien
atgtagacactcttccactaaattg

SEQ ID NO: 270692 - DNA, 25 bp, Homo sapien
gacactcttccactaaattgttttt

SEQ ID NO: 270693 - DNA, 25 bp, Homo sapien
ttcttatcttgggaacctgctgtat

SEQ ID NO: 270694 - DNA, 25 bp, Homo sapien
tcttgggaacctgctgtattttatc

SEQ ID NO: 270695 - DNA, 25 bp, Homo sapien
ttcttgatttgagccttgggaacca

SEQ ID NO: 270696 - DNA, 25 bp, Homo sapien
tgggaaccaatcaactttgtttcca

SEQ ID NO: 270697 - DNA, 25 bp, Homo sapien
tgtgaacttccctcctttaccagta

SEQ ID NO: 270698 - DNA, 25 bp, Homo sapien
agacccgtggcttgccatagctgta

SEQ ID NO: 270699 - DNA, 25 bp, Homo sapien
ggcttgccatagctgtacatcttgg

SEQ ID NO: 270700 - DNA, 25 bp, Homo sapien
aactgcagcagttcagataagatac

SEQ ID NO: 270701 - DNA, 25 bp, Homo sapien
ttgttcactcccaaagaaactcagt

SEQ ID NO: 270702 - DNA, 25 bp, Homo sapien
cagtatctttggagaattctttctt

SEQ ID NO: 270703 - DNA, 25 bp, Homo sapien
gtcgaaaggacgtttggcccagcag

SEQ ID NO: 270704 - DNA, 25 bp, Homo sapien
tccaccaatgaacggactccaattc

SEQ ID NO: 270705 - DNA, 25 bp, Homo sapien
gaacggactccaattcttgatttga

SEQ ID NO: 270706 - DNA, 25 bp, Homo sapien
cttcttgcggaagcggcacaagccg

SEQ ID NO: 270707 - DNA, 25 bp, Homo sapien
gggagagaaggcgttttatctatta

SEQ ID NO: 270708 - DNA, 25 bp, Homo sapien
gataatctcgagaagccgtgggaca

SEQ ID NO: 270709 - DNA, 25 bp, Homo sapien
tcgagaagccgtgggacaaaggaca

SEQ ID NO: 270710 - DNA, 25 bp, Homo sapien
gaagcggcacaagccgcagtacagc

SEQ ID NO: 270711 - DNA, 25 bp, Homo sapien
gacaaaggacagtagggcgtaggtt

SEQ ID NO: 270712 - DNA, 25 bp, Homo sapien
gcgtaggttgcgtgtctcaggaatt

SEQ ID NO: 270713 - DNA, 25 bp, Homo sapien
ggttgcgtgtctcaggaattaacat

SEQ ID NO: 270714 - DNA, 25 bp, Homo sapien
gcgtgtctcaggaattaacattttg

SEQ ID NO: 270715 - DNA, 25 bp, Homo sapien
gtacagcgcggcctttttacgtcat

SEQ ID NO: 270716 - DNA, 25 bp, Homo sapien
acacctgcggactggcgcatgcgtt

SEQ ID NO: 270717 - DNA, 25 bp, Homo sapien
acttttgtcacgtgtacatttgctg

SEQ ID NO: 270718 - DNA, 25 bp, Homo sapien
tcacgtgtacatttgctgacagtaa

SEQ ID NO: 270719 - DNA, 25 bp, Homo sapien
agcttagtcattttgattgcgtgaa

SEQ ID NO: 270720 - DNA, 25 bp, Homo sapien
ggaattttattctcagtattgcttt

SEQ ID NO: 270721 - DNA, 25 bp, Homo sapien
aatggagaaatttactttggcaagt

SEQ ID NO: 270722 - DNA, 25 bp, Homo sapien
tactttggcaagttcaatggtcaac

SEQ ID NO: 270723 - DNA, 25 bp, Homo sapien
aatggtcaacagtcagttcatgcaa

SEQ ID NO: 270724 - DNA, 25 bp, Homo sapien
atgcaaaatgggatgaaaccgacct

SEQ ID NO: 270725 - DNA, 25 bp, Homo sapien
ggaatctgcttccttaatatttgtt

SEQ ID NO: 270726 - DNA, 25 bp, Homo sapien
gcttccttaatatttgtttcttgca

SEQ ID NO: 270727 - DNA, 25 bp, Homo sapien
gtttcttgcagtaaatgttactaca

SEQ ID NO: 270728 - DNA, 25 bp, Homo sapien
aaatgggaaatacaaacagcatgca

SEQ ID NO: 270729 - DNA, 25 bp, Homo sapien
accccactcccaagggaaattgctg

SEQ ID NO: 270730 - DNA, 25 bp, Homo sapien
gctgggttttggacgaattttcact

SEQ ID NO: 270731 - DNA, 25 bp, Homo sapien
attttcactttgtgtgcacctttta

SEQ ID NO: 270732 - DNA, 25 bp, Homo sapien
ttgtgtgcaccttttatgtatgtaa

SEQ ID NO: 270733 - DNA, 25 bp, Homo sapien
actactttgaaatctgattccgcta

SEQ ID NO: 270734 - DNA, 25 bp, Homo sapien
gattccgctatttcatgtttgtctt

SEQ ID NO: 270735 - DNA, 25 bp, Homo sapien
gtttgtcttaccatgttattatgta

SEQ ID NO: 270736 - DNA, 25 bp, Homo sapien
ttttcctacatccaaagctacctag

SEQ ID NO: 270737 - DNA, 25 bp, Homo sapien
agctacctagtatctcttttgtatg

SEQ ID NO: 270738 - DNA, 25 bp, Homo sapien
ttgtatgaaggtttcatcatgtatc

SEQ ID NO: 270739 - DNA, 25 bp, Homo sapien
tcataataacctactcagagataat

SEQ ID NO: 270740 - DNA, 25 bp, Homo sapien
cggctgtttgatgggtccggaaatc

SEQ ID NO: 270741 - DNA, 25 bp, Homo sapien
ttgatgggtccggaaatctcttgaa

SEQ ID NO: 270742 - DNA, 25 bp, Homo sapien
ggtccggaaatctcttgaaggtgaa

SEQ ID NO: 270743 - DNA, 25 bp, Homo sapien
atctcttgaaggtgaatccaagcaa

SEQ ID NO: 270744 - DNA, 25 bp, Homo sapien
atccaagcaagataaacggtgcgga

SEQ ID NO: 270745 - DNA, 25 bp, Homo sapien
cctgattgggtagaaagcgctgtcc

SEQ ID NO: 270746 - DNA, 25 bp, Homo sapien
tagaaagcgctgtcccaacaggcga

SEQ ID NO: 270747 - DNA, 25 bp, Homo sapien
ccaacaggcgagtcttcttcataat

SEQ ID NO: 270748 - DNA, 25 bp, Homo sapien
acaggcgagtcttcttcataataac

SEQ ID NO: 270749 - DNA, 25 bp, Homo sapien
gcgagtcttcttcataataacctac

SEQ ID NO: 270750 - DNA, 25 bp, Homo sapien
aacagctatcaatcttcaacagggc

SEQ ID NO: 270751 - DNA, 25 bp, Homo sapien
atcaatcttcaacagggctttttaa

SEQ ID NO: 270752 - DNA, 25 bp, Homo sapien
tctgcaccagcaaataaacctttca

SEQ ID NO: 270753 - DNA, 25 bp, Homo sapien
caggttaactaaacacacttgtgtc

SEQ ID NO: 270754 - DNA, 25 bp, Homo sapien
acacttgtgtctttgaaaatctagt

SEQ ID NO: 270755 - DNA, 25 bp, Homo sapien
gtttgagaaatcctaacagcagttt

SEQ ID NO: 270756 - DNA, 25 bp, Homo sapien
cctaacagcagtttgggacaagtga

SEQ ID NO: 270757 - DNA, 25 bp, Homo sapien
ggacaagtgatggagccaccgccct

SEQ ID NO: 270758 - DNA, 25 bp, Homo sapien
cctacaccaatttcactgtcagtac

SEQ ID NO: 270759 - DNA, 25 bp, Homo sapien
tgtcagtacatgcagtgctaacagt

SEQ ID NO: 270760 - DNA, 25 bp, Homo sapien
gatcagctgtgtcttttattaggaa

SEQ ID NO: 270761 - DNA, 25 bp, Homo sapien
aatattcttccaccaacgctatgaa

SEQ ID NO: 270762 - DNA, 25 bp, Homo sapien
ttcttccaccaacgctatgaaacag

SEQ ID NO: 270763 - DNA, 25 bp, Homo sapien
gagtaacatttaaatcctcctcttt

SEQ ID NO: 270764 - DNA, 25 bp, Homo sapien
tttaaatcctcctctttattgctgg

SEQ ID NO: 270765 - DNA, 25 bp, Homo sapien
ctcctctttattgctggccgtaaaa

SEQ ID NO: 270766 - DNA, 25 bp, Homo sapien
aaatatgtcttttggagagcagaac

SEQ ID NO: 270767 - DNA, 25 bp, Homo sapien
catgccagaatgtataaggtgcaac

SEQ ID NO: 270768 - DNA, 25 bp, Homo sapien
ggtgcaactgtttgatatgaaaacc

SEQ ID NO: 270769 - DNA, 25 bp, Homo sapien
gacagcttttgtcaaccttcttatc

SEQ ID NO: 270770 - DNA, 25 bp, Homo sapien
gcttttgtcaaccttcttatccaat

SEQ ID NO: 270771 - DNA, 25 bp, Homo sapien
tcttatccaatattcttccaccaac

SEQ ID NO: 270772 - DNA, 25 bp, Homo sapien
gatccttggaggaagcttctaaacc

SEQ ID NO: 270773 - DNA, 25 bp, Homo sapien
ggtttctcagaagtgtggagcgtct

SEQ ID NO: 270774 - DNA, 25 bp, Homo sapien
tggagcgtctgcattagtcctggcg

SEQ ID NO: 270775 - DNA, 25 bp, Homo sapien
aggtgactcagggtgggttcctact

SEQ ID NO: 270776 - DNA, 25 bp, Homo sapien
cagggtgggttcctactgaatttca

SEQ ID NO: 270777 - DNA, 25 bp, Homo sapien
ctgtctgctgaaagacccgttatta

SEQ ID NO: 270778 - DNA, 25 bp, Homo sapien
gggaggtaacgctgtatatttctgt

SEQ ID NO: 270779 - DNA, 25 bp, Homo sapien
ctgtatatttctgtttgcaagcaat

SEQ ID NO: 270780 - DNA, 25 bp, Homo sapien
aatctttggagggtgttgcataaca

SEQ ID NO: 270781 - DNA, 25 bp, Homo sapien
agatgtatcaggtctttgtcctgga

SEQ ID NO: 270782 - DNA, 25 bp, Homo sapien
ctttgtcctggatccttggaggaag

SEQ ID NO: 270783 - DNA, 25 bp, Homo sapien
ggagccaggttctgcgactctggat

SEQ ID NO: 270784 - DNA, 25 bp, Homo sapien
ccaggttctgcgactctggatgggt

SEQ ID NO: 270785 - DNA, 25 bp, Homo sapien
gggtttctgtttccgctccgcccat

SEQ ID NO: 270786 - DNA, 25 bp, Homo sapien
agcctccttgcctatgaaattgaat

SEQ ID NO: 270787 - DNA, 25 bp, Homo sapien
aattgaattaatggcacctcctccc

SEQ ID NO: 270788 - DNA, 25 bp, Homo sapien
tccccttcgggcttgctgcgagaga

SEQ ID NO: 270789 - DNA, 25 bp, Homo sapien
gcatgagtgggtttacaagcgcctg

SEQ ID NO: 270790 - DNA, 25 bp, Homo sapien
agtgggtttacaagcgcctggagca

SEQ ID NO: 270791 - DNA, 25 bp, Homo sapien
tggagcagctttgtccatcgtccgg

SEQ ID NO: 270792 - DNA, 25 bp, Homo sapien
tttgtccatcgtccgggcggcaagc

SEQ ID NO: 270793 - DNA, 25 bp, Homo sapien
tgaagaaggcgctctgtgttcgcag

SEQ ID NO: 270794 - DNA, 25 bp, Homo sapien
agaacctcttgtccatagggcctct

SEQ ID NO: 270795 - DNA, 25 bp, Homo sapien
taccatttattgagccgctcatggg

SEQ ID NO: 270796 - DNA, 25 bp, Homo sapien
ttggacagcctgctttgcagccatt

SEQ ID NO: 270797 - DNA, 25 bp, Homo sapien
gaggttctgattcaatttgcctgaa

SEQ ID NO: 270798 - DNA, 25 bp, Homo sapien
cagccattctgcttggagtttgctt

SEQ ID NO: 270799 - DNA, 25 bp, Homo sapien
ctttgtcagcttaagccatggcaga

SEQ ID NO: 270800 - DNA, 25 bp, Homo sapien
aacttacaccatctaaggctaaaat

SEQ ID NO: 270801 - DNA, 25 bp, Homo sapien
aatttgcctgaaaggttgcctggga

SEQ ID NO: 270802 - DNA, 25 bp, Homo sapien
ggttgcctgggaatcaaggctttta

SEQ ID NO: 270803 - DNA, 25 bp, Homo sapien
aaagctgcccaggtaatcctaatga

SEQ ID NO: 270804 - DNA, 25 bp, Homo sapien
aaggttgagaacctcttgtccatag

SEQ ID NO: 270805 - DNA, 25 bp, Homo sapien
tgcttggctagcaactgaatatgaa

SEQ ID NO: 270806 - DNA, 25 bp, Homo sapien
taaattcaagggaccctgcggaccg

SEQ ID NO: 270807 - DNA, 25 bp, Homo sapien
gagaggacagtccaccactgatgca

SEQ ID NO: 270808 - DNA, 25 bp, Homo sapien
ttctccgccaaacctcacggaattg

SEQ ID NO: 270809 - DNA, 25 bp, Homo sapien
aacctcacggaattgtgacattcat

SEQ ID NO: 270810 - DNA, 25 bp, Homo sapien
ggcgaatgtgcgggaccccatccat

SEQ ID NO: 270811 - DNA, 25 bp, Homo sapien
tgaagttaaaagtatctttcccata

SEQ ID NO: 270812 - DNA, 25 bp, Homo sapien
gtatctttcccataatgaaatccaa

SEQ ID NO: 270813 - DNA, 25 bp, Homo sapien
tgatggaagagtgccccctcacggt

SEQ ID NO: 270814 - DNA, 25 bp, Homo sapien
cccctcacggtgtggaggtcctgct

SEQ ID NO: 270815 - DNA, 25 bp, Homo sapien
gaggtcctgcttggctagcaactga

SEQ ID NO: 270816 - DNA, 25 bp, Homo sapien
tagaggccatcaccacttgtttatt

SEQ ID NO: 270817 - DNA, 25 bp, Homo sapien
tgtcctatcctcattctaagctgat

SEQ ID NO: 270818 - DNA, 25 bp, Homo sapien
tcaagggcacagctccaggtagttt

SEQ ID NO: 270819 - DNA, 25 bp, Homo sapien
acagctccaggtagttttccttctc

SEQ ID NO: 270820 - DNA, 25 bp, Homo sapien
gtttccttctgtctaccaggtcatt

SEQ ID NO: 270821 - DNA, 25 bp, Homo sapien
taccaggtcattcccattagcatgt

SEQ ID NO: 270822 - DNA, 25 bp, Homo sapien
attagcatgtttttgccgcttttct

SEQ ID NO: 270823 - DNA, 25 bp, Homo sapien
gtttttgccgcttttcttaagagat

SEQ ID NO: 270824 - DNA, 25 bp, Homo sapien
ataatatctcaaccctaattcctcc

SEQ ID NO: 270825 - DNA, 25 bp, Homo sapien
tgtgcttttcttctgtggatacatt

SEQ ID NO: 270826 - DNA, 25 bp, Homo sapien
ggatacattatttaggccactattc

SEQ ID NO: 270827 - DNA, 25 bp, Homo sapien
atggcccagtctcttctacaaaaca

SEQ ID NO: 270828 - DNA, 25 bp, Homo sapien
aacacacctgtctcaagtgggttgg

SEQ ID NO: 270829 - DNA, 25 bp, Homo sapien
ggcactcttgccgagaagtcgctgt

SEQ ID NO: 270830 - DNA, 25 bp, Homo sapien
gaagtcgctgtcacagtcgtgagct

SEQ ID NO: 270831 - DNA, 25 bp, Homo sapien
gtcacagtcgtgagctgaggacatc

SEQ ID NO: 270832 - DNA, 25 bp, Homo sapien
accagagccgtaagagccttctagc

SEQ ID NO: 270833 - DNA, 25 bp, Homo sapien
gccttctagctgcagagtggttgtt

SEQ ID NO: 270834 - DNA, 25 bp, Homo sapien
agtggttgtttccacatggccacaa

SEQ ID NO: 270835 - DNA, 25 bp, Homo sapien
agagtgggtgttccactgcaagccc

SEQ ID NO: 270836 - DNA, 25 bp, Homo sapien
actcatttgcttttggctggaagac

SEQ ID NO: 270837 - DNA, 25 bp, Homo sapien
tttgcttttggctggaagaccgggt

SEQ ID NO: 270838 - DNA, 25 bp, Homo sapien
ttgcctatagtcaaaaagcttttcc

SEQ ID NO: 270839 - DNA, 25 bp, Homo sapien
aaagcttttccattgatggagactt

SEQ ID NO: 270840 - DNA, 25 bp, Homo sapien
tggagacttactttcaaatgagctt

SEQ ID NO: 270841 - DNA, 25 bp, Homo sapien
gagcttgtgttgaattcagcactct

SEQ ID NO: 270842 - DNA, 25 bp, Homo sapien
aattcagcactctagattctctctg

SEQ ID NO: 270843 - DNA, 25 bp, Homo sapien
agcactctagattctctctgacatt

SEQ ID NO: 270844 - DNA, 25 bp, Homo sapien
ctttttcatctataggattgagcca

SEQ ID NO: 270845 - DNA, 25 bp, Homo sapien
gattgagccaaaaaacatacatact

SEQ ID NO: 270846 - DNA, 25 bp, Homo sapien
gaaaggtaccatctaattcttttat

SEQ ID NO: 270847 - DNA, 25 bp, Homo sapien
aaagatagctacttctgaaatgtct

SEQ ID NO: 270848 - DNA, 25 bp, Homo sapien
taacagagtttcaagattgcaaagt

SEQ ID NO: 270849 - DNA, 25 bp, Homo sapien
tccactagtgtaggcctagctatcg

SEQ ID NO: 270850 - DNA, 25 bp, Homo sapien
tctttttcgggaattaaggtgtcat

SEQ ID NO: 270851 - DNA, 25 bp, Homo sapien
aggtgtcatatattgctctagctgg

SEQ ID NO: 270852 - DNA, 25 bp, Homo sapien
gtaggcctagctatcgaaacaagag

SEQ ID NO: 270853 - DNA, 25 bp, Homo sapien
attgctctagctggcttgggacaga

SEQ ID NO: 270854 - DNA, 25 bp, Homo sapien
gaggagtgcatgtaaatcttctagt

SEQ ID NO: 270855 - DNA, 25 bp, Homo sapien
taaatcttctagtctctctgcttct

SEQ ID NO: 270856 - DNA, 25 bp, Homo sapien
gcttctcttgaaatgtggcagtctg

SEQ ID NO: 270857 - DNA, 25 bp, Homo sapien
tttgtgtgatattatagccagtgac

SEQ ID NO: 270858 - DNA, 25 bp, Homo sapien
tattatagccagtgacaagagagct

SEQ ID NO: 270859 - DNA, 25 bp, Homo sapien
acaagagagctaagggtgagcccct

SEQ ID NO: 270860 - DNA, 25 bp, Homo sapien
cgagctgctaatccggaagctacct

SEQ ID NO: 270861 - DNA, 25 bp, Homo sapien
gctaatccggaagctaccttttcag

SEQ ID NO: 270862 - DNA, 25 bp, Homo sapien
atccggaagctaccttttcagcgct

SEQ ID NO: 270863 - DNA, 25 bp, Homo sapien
gaagctaccttttcagcgcttggta

SEQ ID NO: 270864 - DNA, 25 bp, Homo sapien
accttttcagcgcttggtacgggag

SEQ ID NO: 270865 - DNA, 25 bp, Homo sapien
tttcagcgcttggtacgggagatcg

SEQ ID NO: 270866 - DNA, 25 bp, Homo sapien
ttggtacgggagatcgcacaggact

SEQ ID NO: 270867 - DNA, 25 bp, Homo sapien
tacgggagatcgcacaggactttaa

SEQ ID NO: 270868 - DNA, 25 bp, Homo sapien
cattcacgccaaacgcgtcactatt

SEQ ID NO: 270869 - DNA, 25 bp, Homo sapien
gggagagggcataaatattcctatc

SEQ ID NO: 270870 - DNA, 25 bp, Homo sapien
atattcctatcagcccaagaagtct

SEQ ID NO: 270871 - DNA, 25 bp, Homo sapien
ggcttctacctttacgtcagcgttt

SEQ ID NO: 270872 - DNA, 25 bp, Homo sapien
gtcagcgttttctccatctctcatt

SEQ ID NO: 270873 - DNA, 25 bp, Homo sapien
acactgtgctacaatcatgtggcag

SEQ ID NO: 270874 - DNA, 25 bp, Homo sapien
tcatgtggcagcttgatcatctcca

SEQ ID NO: 270875 - DNA, 25 bp, Homo sapien
tcatctccactacactatgctttat

SEQ ID NO: 270876 - DNA, 25 bp, Homo sapien
ttatttctcgacaaagctcagcaca

SEQ ID NO: 270877 - DNA, 25 bp, Homo sapien
gctcagcacaaatggcttctgattt

SEQ ID NO: 270878 - DNA, 25 bp, Homo sapien
ttaacggatggacgcaggttctgca

SEQ ID NO: 270879 - DNA, 25 bp, Homo sapien
tctgcactgacttctgtttcggaac

SEQ ID NO: 270880 - DNA, 25 bp, Homo sapien
tgtttcggaaccacagtaaggctgt

SEQ ID NO: 270881 - DNA, 25 bp, Homo sapien
ggcacactagtgcatactttatagg

SEQ ID NO: 270882 - DNA, 25 bp, Homo sapien
ttcttacactccaaactcagccggg

SEQ ID NO: 270883 - DNA, 25 bp, Homo sapien
aactcagccgggacagacctctgct

SEQ ID NO: 270884 - DNA, 25 bp, Homo sapien
ccacgaacgtgtgacgacggctgga

SEQ ID NO: 270885 - DNA, 25 bp, Homo sapien
tggaggccaacagagtccctacagg

SEQ ID NO: 270886 - DNA, 25 bp, Homo sapien
aacagagtccctacaggtggtgctc

SEQ ID NO: 270887 - DNA, 25 bp, Homo sapien
tacaggtggtgctcacggtaatgca

SEQ ID NO: 270888 - DNA, 25 bp, Homo sapien
gtgctcacggtaatgcaccgacaat

SEQ ID NO: 270889 - DNA, 25 bp, Homo sapien
gcaccgacaatgagtggctgttttc

SEQ ID NO: 270890 - DNA, 25 bp, Homo sapien
aatgagtggctgttttccagtttct

SEQ ID NO: 270891 - DNA, 25 bp, Homo sapien
agtttctggcctccgctgcctatct

SEQ ID NO: 270892 - DNA, 25 bp, Homo sapien
gctgcctatctagggacggcaggat

SEQ ID NO: 270893 - DNA, 25 bp, Homo sapien
gggcctccaagcaggtgccaaggca

SEQ ID NO: 270894 - DNA, 25 bp, Homo sapien
gtgccaaggcagaatcggatgtgac

SEQ ID NO: 270895 - DNA, 25 bp, Homo sapien
cagaatcggatgtgaccaggagaac

SEQ ID NO: 270896 - DNA, 25 bp, Homo sapien
gaccaggagaacacccttgaaggat

SEQ ID NO: 270897 - DNA, 25 bp, Homo sapien
ggataaagcgaatgtgcgaccacca

SEQ ID NO: 270898 - DNA, 25 bp, Homo sapien
aagcgaatgtgcgaccaccatgcag

SEQ ID NO: 270899 - DNA, 25 bp, Homo sapien
atgtgcgaccaccatgcaggtctgg

SEQ ID NO: 270900 - DNA, 25 bp, Homo sapien
caccatgcaggtctggcccatggaa

SEQ ID NO: 270901 - DNA, 25 bp, Homo sapien
cctctgctgggagccgggacactga

SEQ ID NO: 270902 - DNA, 25 bp, Homo sapien
gctcctgccacatgagcaggttgac

SEQ ID NO: 270903 - DNA, 25 bp, Homo sapien
ctgccacatgagcaggttgacctgc

SEQ ID NO: 270904 - DNA, 25 bp, Homo sapien
ccatgattttgacatagagtataat

SEQ ID NO: 270905 - DNA, 25 bp, Homo sapien
ataattctgatgttacttatttcaa

SEQ ID NO: 270906 - DNA, 25 bp, Homo sapien
tacttatttcaatatgccttgtata

SEQ ID NO: 270907 - DNA, 25 bp, Homo sapien
atgccttgtatatattagctgttta

SEQ ID NO: 270908 - DNA, 25 bp, Homo sapien
taagagagtcgctttttggttgaaa

SEQ ID NO: 270909 - DNA, 25 bp, Homo sapien
gaaaagtatttctaggctgagcaag

SEQ ID NO: 270910 - DNA, 25 bp, Homo sapien
ttctaggctgagcaaggtagctcat

SEQ ID NO: 270911 - DNA, 25 bp, Homo sapien
ttaaagtctatccagaccaccatgt

SEQ ID NO: 270912 - DNA, 25 bp, Homo sapien
gtctatccagaccaccatgttttta

SEQ ID NO: 270913 - DNA, 25 bp, Homo sapien
tccagaccaccatgtttttatttac

SEQ ID NO: 270914 - DNA, 25 bp, Homo sapien
tgtttttatttacagtgactatata

SEQ ID NO: 270915 - DNA, 25 bp, Homo sapien
gcagctctgatctggaactgggaag

SEQ ID NO: 270916 - DNA, 25 bp, Homo sapien
aggacaacacacagtcaagctcttt

SEQ ID NO: 270917 - DNA, 25 bp, Homo sapien
tcaagctctttctcgtctcagagaa

SEQ ID NO: 270918 - DNA, 25 bp, Homo sapien
ctcgtctcagagaatccagcagaat

SEQ ID NO: 270919 - DNA, 25 bp, Homo sapien
agaatcttcagggatccttccagac

SEQ ID NO: 270920 - DNA, 25 bp, Homo sapien
ggaagactctcacactctgcagaga

SEQ ID NO: 270921 - DNA, 25 bp, Homo sapien
gcttgtttagcatttgacctacatt

SEQ ID NO: 270922 - DNA, 25 bp, Homo sapien
tgacctacattcagaaacgaccagc

SEQ ID NO: 270923 - DNA, 25 bp, Homo sapien
aactttcagctctaaggattactta

SEQ ID NO: 270924 - DNA, 25 bp, Homo sapien
aatggtgttcattctcagatatctt

SEQ ID NO: 270925 - DNA, 25 bp, Homo sapien
tctcagatatcttgcctttctcagg

SEQ ID NO: 270926 - DNA, 25 bp, Homo sapien
gccgcatggcccctccaggaacatt

SEQ ID NO: 270927 - DNA, 25 bp, Homo sapien
attcccacataatacattccatcac

SEQ ID NO: 270928 - DNA, 25 bp, Homo sapien
tcccacataatacattccatcacag

SEQ ID NO: 270929 - DNA, 25 bp, Homo sapien
acataatacattccatcacagccag

SEQ ID NO: 270930 - DNA, 25 bp, Homo sapien
cataatacattccatcacagccagc

SEQ ID NO: 270931 - DNA, 25 bp, Homo sapien
ataatacattccatcacagccagcc

SEQ ID NO: 270932 - DNA, 25 bp, Homo sapien
agcccagctccactcagggctggcc

SEQ ID NO: 270933 - DNA, 25 bp, Homo sapien
ggagtccccgtgtgccccaagaggc

SEQ ID NO: 270934 - DNA, 25 bp, Homo sapien
tgccccaagaggctagccccagggt

SEQ ID NO: 270935 - DNA, 25 bp, Homo sapien
agggccctcagaggaaaggcagtat

SEQ ID NO: 270936 - DNA, 25 bp, Homo sapien
gctttccctggctcagggatcttct

SEQ ID NO: 270937 - DNA, 25 bp, Homo sapien
tttcttgagaatagtccattttttg

SEQ ID NO: 270938 - DNA, 25 bp, Homo sapien
taccgtatgttctggtcattggaaa

SEQ ID NO: 270939 - DNA, 25 bp, Homo sapien
acagaacagctcatagttgggtgat

SEQ ID NO: 270940 - DNA, 25 bp, Homo sapien
attacacttgtagggctttttgtct

SEQ ID NO: 270941 - DNA, 25 bp, Homo sapien
tagggctttttgtcttactcagtga

SEQ ID NO: 270942 - DNA, 25 bp, Homo sapien
agtgaccatcactacgaatgtctta

SEQ ID NO: 270943 - DNA, 25 bp, Homo sapien
gaatgtcttacattgaagcacagac

SEQ ID NO: 270944 - DNA, 25 bp, Homo sapien
gaagcacagactgcagagcacttgt

SEQ ID NO: 270945 - DNA, 25 bp, Homo sapien
gagcacttgttaacttagtcctcct

SEQ ID NO: 270946 - DNA, 25 bp, Homo sapien
ttaacttagtcctcctgcataatgc

SEQ ID NO: 270947 - DNA, 25 bp, Homo sapien
gtcctcctgcataatgcactcgtga

SEQ ID NO: 270948 - DNA, 25 bp, Homo sapien
agggcataagttcctctaatgttta

SEQ ID NO: 270949 - DNA, 25 bp, Homo sapien
gttcctctaatgtttattgcaatgt

SEQ ID NO: 270950 - DNA, 25 bp, Homo sapien
aggttttcattgtatgatggacacg

SEQ ID NO: 270951 - DNA, 25 bp, Homo sapien
agagagagtagctaactcagctgga

SEQ ID NO: 270952 - DNA, 25 bp, Homo sapien
aactcagctggaattggcctggaga

SEQ ID NO: 270953 - DNA, 25 bp, Homo sapien
gaaaacgatggtgagaactcccgga

SEQ ID NO: 270954 - DNA, 25 bp, Homo sapien
gaactcccggagaacgttagaactg

SEQ ID NO: 270955 - DNA, 25 bp, Homo sapien
ctgagctgaagcttgcagaatgcat

SEQ ID NO: 270956 - DNA, 25 bp, Homo sapien
gatggacacgatgtaacccctaaag

SEQ ID NO: 270957 - DNA, 25 bp, Homo sapien
gtgaaaaatagtcctcattctcatg

SEQ ID NO: 270958 - DNA, 25 bp, Homo sapien
gtcctcattctcatggatttatagc

SEQ ID NO: 270959 - DNA, 25 bp, Homo sapien
tggaaggttaggtttgtcaacacaa

SEQ ID NO: 270960 - DNA, 25 bp, Homo sapien
ggtttgtcaacacaaagacatggaa

SEQ ID NO: 270961 - DNA, 25 bp, Homo sapien
acatggaagattagaggtttgtcaa

SEQ ID NO: 270962 - DNA, 25 bp, Homo sapien
gaggtttgtcaacacaaagacacag

SEQ ID NO: 270963 - DNA, 25 bp, Homo sapien
gacacaggaagaatgggctgcagaa

SEQ ID NO: 270964 - DNA, 25 bp, Homo sapien
tgggctgcagaagatttagatgttt

SEQ ID NO: 270965 - DNA, 25 bp, Homo sapien
tgttttccatttgggcacattttac

SEQ ID NO: 270966 - DNA, 25 bp, Homo sapien
gggcacattttacttagctggagaa

SEQ ID NO: 270967 - DNA, 25 bp, Homo sapien
tttacttagctggagaactaggttt

SEQ ID NO: 270968 - DNA, 25 bp, Homo sapien
ggagaactaggtttaaaacagcctg

SEQ ID NO: 270969 - DNA, 25 bp, Homo sapien
gcctgggtaggaaaattagaagcaa

SEQ ID NO: 270970 - DNA, 25 bp, Homo sapien
aaaaggcgacgaatcaggacacagt

SEQ ID NO: 270971 - DNA, 25 bp, Homo sapien
cgacgaatcaggacacagtgaactt

SEQ ID NO: 270972 - DNA, 25 bp, Homo sapien
caggacacagtgaacttgggaatga

SEQ ID NO: 270973 - DNA, 25 bp, Homo sapien
ggagggtggagtgtcggctgcaaag

SEQ ID NO: 270974 - DNA, 25 bp, Homo sapien
ggaggacctgcccaggtatgccttc

SEQ ID NO: 270975 - DNA, 25 bp, Homo sapien
acctgcccaggtatgccttccagtg

SEQ ID NO: 270976 - DNA, 25 bp, Homo sapien
tatgccttccagtgatgcccaccag

SEQ ID NO: 270977 - DNA, 25 bp, Homo sapien
tccagtgatgcccaccagagaatac

SEQ ID NO: 270978 - DNA, 25 bp, Homo sapien
tgatgcccaccagagaatacattct

SEQ ID NO: 270979 - DNA, 25 bp, Homo sapien
gtacaagtaggatatgaattagcag

SEQ ID NO: 270980 - DNA, 25 bp, Homo sapien
gaattagcagtttacaagtttacat

SEQ ID NO: 270981 - DNA, 25 bp, Homo sapien
gaccaaaaagactcaacagccgctt

SEQ ID NO: 270982 - DNA, 25 bp, Homo sapien
aaagactcaacagccgcttgaagcc

SEQ ID NO: 270983 - DNA, 25 bp, Homo sapien
cagccgcttgaagccaagaactctt

SEQ ID NO: 270984 - DNA, 25 bp, Homo sapien
aagaactcttcaatgccagctactg

SEQ ID NO: 270985 - DNA, 25 bp, Homo sapien
tcaatgccagctactgccacctaaa

SEQ ID NO: 270986 - DNA, 25 bp, Homo sapien
ccacctaaaaatcatctggctttat

SEQ ID NO: 270987 - DNA, 25 bp, Homo sapien
gttccacaggtagcagacacttcac

SEQ ID NO: 270988 - DNA, 25 bp, Homo sapien
acaggtagcagacacttcacttcca

SEQ ID NO: 270989 - DNA, 25 bp, Homo sapien
tcaattattcccacaggattttagg

SEQ ID NO: 270990 - DNA, 25 bp, Homo sapien
cacaggattttaggtcagggagcaa

SEQ ID NO: 270991 - DNA, 25 bp, Homo sapien
gaagatacacaacagactcgcaaaa

SEQ ID NO: 270992 - DNA, 25 bp, Homo sapien
ggatgtagatagaaagcacctgaat

SEQ ID NO: 270993 - DNA, 25 bp, Homo sapien
cacctgaattgtgcttctgaattaa

SEQ ID NO: 270994 - DNA, 25 bp, Homo sapien
ctgaattgtgcttctgaattaacca

SEQ ID NO: 270995 - DNA, 25 bp, Homo sapien
gaattaaccaatccaggaactgctt

SEQ ID NO: 270996 - DNA, 25 bp, Homo sapien
ccaggaactgctttacctttggact

SEQ ID NO: 270997 - DNA, 25 bp, Homo sapien
acctttggactttttgttatgtgag

SEQ ID NO: 270998 - DNA, 25 bp, Homo sapien
ggactttttgttatgtgagatattc

SEQ ID NO: 270999 - DNA, 25 bp, Homo sapien
tccatttgctttgggtatatgtata

SEQ ID NO: 271000 - DNA, 25 bp, Homo sapien
atgtatattgttacttgtagccaaa

SEQ ID NO: 271001 - DNA, 25 bp, Homo sapien
aatatgcctttttctgcgggagtag

SEQ ID NO: 271002 - DNA, 25 bp, Homo sapien
atgcctttttctgcgggagtaggtg

SEQ ID NO: 271003 - DNA, 25 bp, Homo sapien
caactagagacactgcctgctgcgc

SEQ ID NO: 271004 - DNA, 25 bp, Homo sapien
aactagagacactgcctgctgcgcc

SEQ ID NO: 271005 - DNA, 25 bp, Homo sapien
gtgtgcagggacacagaccccagca

SEQ ID NO: 271006 - DNA, 25 bp, Homo sapien
gtgcagggacacagaccccagcagc

SEQ ID NO: 271007 - DNA, 25 bp, Homo sapien
ggctggtgaagcctcctggttccaa

SEQ ID NO: 271008 - DNA, 25 bp, Homo sapien
ctggtgaagcctcctggttccaaag

SEQ ID NO: 271009 - DNA, 25 bp, Homo sapien
ggtgaagcctcctggttccaaaggg

SEQ ID NO: 271010 - DNA, 25 bp, Homo sapien
ctcctggttccaaaggggctctagg

SEQ ID NO: 271011 - DNA, 25 bp, Homo sapien
gggatcacagacactgatgcaggcg

SEQ ID NO: 271012 - DNA, 25 bp, Homo sapien
ctggaacccccttccattcaattag

SEQ ID NO: 271013 - DNA, 25 bp, Homo sapien
attcaattagtccggccccagcctt

SEQ ID NO: 271014 - DNA, 25 bp, Homo sapien
gagctgctcagcaaaaggtgcttat

SEQ ID NO: 271015 - DNA, 25 bp, Homo sapien
gtgcttattgaattacacctcataa

SEQ ID NO: 271016 - DNA, 25 bp, Homo sapien
acacctcataacaggcagaatttga

SEQ ID NO: 271017 - DNA, 25 bp, Homo sapien
gcagaatttgaatgctgttcatcac

SEQ ID NO: 271018 - DNA, 25 bp, Homo sapien
ctgttcatcacaggagctatggagt

SEQ ID NO: 271019 - DNA, 25 bp, Homo sapien
catcacaggagctatggagtgcata

SEQ ID NO: 271020 - DNA, 25 bp, Homo sapien
tatggagtgcatagttttatagaga

SEQ ID NO: 271021 - DNA, 25 bp, Homo sapien
tttatagagagtatctccccgcagg

SEQ ID NO: 271022 - DNA, 25 bp, Homo sapien
tagagagtatctccccgcaggcaag

SEQ ID NO: 271023 - DNA, 25 bp, Homo sapien
tctccccgcaggcaagatacataga

SEQ ID NO: 271024 - DNA, 25 bp, Homo sapien
tacatagaacaggtgcagaattaca

SEQ ID NO: 271025 - DNA, 25 bp, Homo sapien
atgattgccggttctccgcagcacg

SEQ ID NO: 271026 - DNA, 25 bp, Homo sapien
tccgcagcacgagtcagggaggcca

SEQ ID NO: 271027 - DNA, 25 bp, Homo sapien
tgagatggaagagccaccccacaat

SEQ ID NO: 271028 - DNA, 25 bp, Homo sapien
accccacaatgggaagaacctggag

SEQ ID NO: 271029 - DNA, 25 bp, Homo sapien
aggttctccttgtctatgcccaaga

SEQ ID NO: 271030 - DNA, 25 bp, Homo sapien
gagaagccacccttcaggagagagt

SEQ ID NO: 271031 - DNA, 25 bp, Homo sapien
atgcttactcacagagaggtctcac

SEQ ID NO: 271032 - DNA, 25 bp, Homo sapien
aggtctcacaagtaggcacgtcgtc

SEQ ID NO: 271033 - DNA, 25 bp, Homo sapien
gtaggcacgtcgtccataaatgaga

SEQ ID NO: 271034 - DNA, 25 bp, Homo sapien
gtcgtccataaatgagactcgcatg

SEQ ID NO: 271035 - DNA, 25 bp, Homo sapien
gactcgcatgttgaatatttacaca

SEQ ID NO: 271036 - DNA, 25 bp, Homo sapien
agacgttgaagacgttgtgactcga

SEQ ID NO: 271037 - DNA, 25 bp, Homo sapien
tgtgactcgagggattctgcgaccc

SEQ ID NO: 271038 - DNA, 25 bp, Homo sapien
gggattctgcgaccccacgtgtgta

SEQ ID NO: 271039 - DNA, 25 bp, Homo sapien
tagcagtcaccttggccaggcagtt

SEQ ID NO: 271040 - DNA, 25 bp, Homo sapien
ggctggagaggcacatcttgacaga

SEQ ID NO: 271041 - DNA, 25 bp, Homo sapien
gaggcacatcttgacagaaaccaaa

SEQ ID NO: 271042 - DNA, 25 bp, Homo sapien
gaggaggccgcctgtacacagaggt

SEQ ID NO: 271043 - DNA, 25 bp, Homo sapien
agaggtgaccctcttaaaggagtag

SEQ ID NO: 271044 - DNA, 25 bp, Homo sapien
gggctttaaatacgtttagtgcgat

SEQ ID NO: 271045 - DNA, 25 bp, Homo sapien
gtttagtgcgatcacgggactgaca

SEQ ID NO: 271046 - DNA, 25 bp, Homo sapien
atcacgggactgacaagacgttgaa

SEQ ID NO: 271047 - DNA, 25 bp, Homo sapien
agaactttcgttcacagcaggcacg

SEQ ID NO: 271048 - DNA, 25 bp, Homo sapien
gaactttcgttcacagcaggcacgg

SEQ ID NO: 271049 - DNA, 25 bp, Homo sapien
aactttcgttcacagcaggcacggt

SEQ ID NO: 271050 - DNA, 25 bp, Homo sapien
actttcgttcacagcaggcacggtc

SEQ ID NO: 271051 - DNA, 25 bp, Homo sapien
tttcgttcacagcaggcacggtctt

SEQ ID NO: 271052 - DNA, 25 bp, Homo sapien
ggactctgaacggaaagactggcct

SEQ ID NO: 271053 - DNA, 25 bp, Homo sapien
gactctgaacggaaagactggcctc

SEQ ID NO: 271054 - DNA, 25 bp, Homo sapien
ctctgaacggaaagactggcctcat

SEQ ID NO: 271055 - DNA, 25 bp, Homo sapien
tctgaacggaaagactggcctcatc

SEQ ID NO: 271056 - DNA, 25 bp, Homo sapien
tgaacggaaagactggcctcatccc

SEQ ID NO: 271057 - DNA, 25 bp, Homo sapien
aacggaaagactggcctcatccctg

SEQ ID NO: 271058 - DNA, 25 bp, Homo sapien
aattttgtgcatatgaatactgtta

SEQ ID NO: 271059 - DNA, 25 bp, Homo sapien
atatttgactacattttgaaaggaa

SEQ ID NO: 271060 - DNA, 25 bp, Homo sapien
gacaacatactactagaaacctagg

SEQ ID NO: 271061 - DNA, 25 bp, Homo sapien
gaaacctaggctgtgagtgtaaaac

SEQ ID NO: 271062 - DNA, 25 bp, Homo sapien
atagctcacattctgttaagagtca

SEQ ID NO: 271063 - DNA, 25 bp, Homo sapien
tattcctttggcacagcagtaagtg

SEQ ID NO: 271064 - DNA, 25 bp, Homo sapien
gtaagtgtgctcaagatctttgcct

SEQ ID NO: 271065 - DNA, 25 bp, Homo sapien
gtgtgctcaagatctttgcctgtaa

SEQ ID NO: 271066 - DNA, 25 bp, Homo sapien
gctcaagatctttgcctgtaagctt

SEQ ID NO: 271067 - DNA, 25 bp, Homo sapien
agatctttgcctgtaagcttgaata

SEQ ID NO: 271068 - DNA, 25 bp, Homo sapien
gcctgtaagcttgaatatttggctt

SEQ ID NO: 271069 - DNA, 25 bp, Homo sapien
atcttctttttcatgacttctatgt

SEQ ID NO: 271070 - DNA, 25 bp, Homo sapien
gacttctatgtgatattccatatct

SEQ ID NO: 271071 - DNA, 25 bp, Homo sapien
tctgaacaattctgatccagatcca

SEQ ID NO: 271072 - DNA, 25 bp, Homo sapien
caggacttatggttgttcttattag

SEQ ID NO: 271073 - DNA, 25 bp, Homo sapien
agaactggcactaaaatctcatcaa

SEQ ID NO: 271074 - DNA, 25 bp, Homo sapien
gaaagcagatacatgtccaagagac

SEQ ID NO: 271075 - DNA, 25 bp, Homo sapien
gagacaacgcaggtaactctccaaa

SEQ ID NO: 271076 - DNA, 25 bp, Homo sapien
aagtcatttactccaatgctttcag

SEQ ID NO: 271077 - DNA, 25 bp, Homo sapien
ctccaatgctttcagtaatcttctt

SEQ ID NO: 271078 - DNA, 25 bp, Homo sapien
agatccatctttcctgcaacagtgg

SEQ ID NO: 271079 - DNA, 25 bp, Homo sapien
ttctagacattttgcccctaaaaat

SEQ ID NO: 271080 - DNA, 25 bp, Homo sapien
gacagcgactactcaagaacaataa

SEQ ID NO: 271081 - DNA, 25 bp, Homo sapien
gctgaagaattcaacattgaccatt

SEQ ID NO: 271082 - DNA, 25 bp, Homo sapien
cattctatggtctttctacatttga

SEQ ID NO: 271083 - DNA, 25 bp, Homo sapien
aaactcaataagtaggtgcctcatg

SEQ ID NO: 271084 - DNA, 25 bp, Homo sapien
gtaggtgcctcatgagccaagcaaa

SEQ ID NO: 271085 - DNA, 25 bp, Homo sapien
aattgttgtttggaagcatcttctc

SEQ ID NO: 271086 - DNA, 25 bp, Homo sapien
tctcttattctgtgcaacaacaatg

SEQ ID NO: 271087 - DNA, 25 bp, Homo sapien
tctcagtcggattgtgacgtgggac

SEQ ID NO: 271088 - DNA, 25 bp, Homo sapien
ttatatgacaaccactgacaaccag

SEQ ID NO: 271089 - DNA, 25 bp, Homo sapien
aaccactgacaaccagctcagctgt

SEQ ID NO: 271090 - DNA, 25 bp, Homo sapien
aaccagctcagctgttggactgaga

SEQ ID NO: 271091 - DNA, 25 bp, Homo sapien
gctgaactcagccagcacgttctcg

SEQ ID NO: 271092 - DNA, 25 bp, Homo sapien
gacagtagcttaacggtgagctcgt

SEQ ID NO: 271093 - DNA, 25 bp, Homo sapien
agtccttcaccacgatggccggctg

SEQ ID NO: 271094 - DNA, 25 bp, Homo sapien
acgatggccggctgagtcgtgtcca

SEQ ID NO: 271095 - DNA, 25 bp, Homo sapien
ggctgagtcgtgtccagcagctcct

SEQ ID NO: 271096 - DNA, 25 bp, Homo sapien
tagccctcagcctgcaggtcaatga

SEQ ID NO: 271097 - DNA, 25 bp, Homo sapien
aggtcaatgacctgtgctttgcgac

SEQ ID NO: 271098 - DNA, 25 bp, Homo sapien
gtgctttgcgacaccactcaaagga

SEQ ID NO: 271099 - DNA, 25 bp, Homo sapien
gaggcgaagtacttcttgacgctct

SEQ ID NO: 271100 - DNA, 25 bp, Homo sapien
ttgacgctctcatcgtgggtgaact

SEQ ID NO: 271101 - DNA, 25 bp, Homo sapien
gtgggtgaactccaccccactgtct

SEQ ID NO: 271102 - DNA, 25 bp, Homo sapien
taattacccatgtttacctttctgt

SEQ ID NO: 271103 - DNA, 25 bp, Homo sapien
tacccatgtttacctttctgtttgt

SEQ ID NO: 271104 - DNA, 25 bp, Homo sapien
tgtttgtctattcaactttcctcct

SEQ ID NO: 271105 - DNA, 25 bp, Homo sapien
tgtctattcaactttcctcctgtaa

SEQ ID NO: 271106 - DNA, 25 bp, Homo sapien
tcaactttcctcctgtaactcagat

SEQ ID NO: 271107 - DNA, 25 bp, Homo sapien
tttcctcctgtaactcagatgtttc

SEQ ID NO: 271108 - DNA, 25 bp, Homo sapien
gatgtttcttctggaaccatttccc

SEQ ID NO: 271109 - DNA, 25 bp, Homo sapien
ccatttcccttcttcctaaaatatg

SEQ ID NO: 271110 - DNA, 25 bp, Homo sapien
cttcttcctaaaatatgtcctttgg

SEQ ID NO: 271111 - DNA, 25 bp, Homo sapien
gtttttcttttaacacctgcaatat

SEQ ID NO: 271112 - DNA, 25 bp, Homo sapien
aacacctgcaatataatcataaatg

SEQ ID NO: 271113 - DNA, 25 bp, Homo sapien
atatgtccaagcctaggctttaaga

SEQ ID NO: 271114 - DNA, 25 bp, Homo sapien
gagattatcttggatgttccagcct

SEQ ID NO: 271115 - DNA, 25 bp, Homo sapien
ggatgttccagccttaagctcccag

SEQ ID NO: 271116 - DNA, 25 bp, Homo sapien
gccttaagctcccagctgaatgtgg

SEQ ID NO: 271117 - DNA, 25 bp, Homo sapien
tgaatgtgggtgtatcctcagctac

SEQ ID NO: 271118 - DNA, 25 bp, Homo sapien
gtatcctcagctacaccacagaaaa

SEQ ID NO: 271119 - DNA, 25 bp, Homo sapien
gaggaactactcagtcgatcccaat

SEQ ID NO: 271120 - DNA, 25 bp, Homo sapien
tcaacccacagactcactagaaata

SEQ ID NO: 271121 - DNA, 25 bp, Homo sapien
agagactggcagctttccttttatc

SEQ ID NO: 271122 - DNA, 25 bp, Homo sapien
caccatgctgcaaagaagctcagct

SEQ ID NO: 271123 - DNA, 25 bp, Homo sapien
gaagctcagctggattactgaaaga

SEQ ID NO: 271124 - DNA, 25 bp, Homo sapien
acattcacctacagcccattgttgt

SEQ ID NO: 271125 - DNA, 25 bp, Homo sapien
tacagcccattgttgtactggatta

SEQ ID NO: 271126 - DNA, 25 bp, Homo sapien
tactggattaacaagcgacggcgct

SEQ ID NO: 271127 - DNA, 25 bp, Homo sapien
aagcgacggcgctacggcatgaatg

SEQ ID NO: 271128 - DNA, 25 bp, Homo sapien
ggcatgaatgcagccatcaacacgg

SEQ ID NO: 271129 - DNA, 25 bp, Homo sapien
gactgaggtccagaatccagatgtt

SEQ ID NO: 271130 - DNA, 25 bp, Homo sapien
tgggatttggacatccccgaaggca

SEQ ID NO: 271131 - DNA, 25 bp, Homo sapien
aggcaggagccatgctgaccaagac

SEQ ID NO: 271132 - DNA, 25 bp, Homo sapien
tgaccaagacagcaaccccaaggcg

SEQ ID NO: 271133 - DNA, 25 bp, Homo sapien
agacagcaaccccaaggcggaagcc

SEQ ID NO: 271134 - DNA, 25 bp, Homo sapien
ttcccatctttcaggaggtgccctt

SEQ ID NO: 271135 - DNA, 25 bp, Homo sapien
gaaagcctgattgtatttgttgacc

SEQ ID NO: 271136 - DNA, 25 bp, Homo sapien
gattttatggtacagcctctctgga

SEQ ID NO: 271137 - DNA, 25 bp, Homo sapien
gggtgtgttcgctcacagaatgcaa

SEQ ID NO: 271138 - DNA, 25 bp, Homo sapien
tttgaccccctaatctttcttctag

SEQ ID NO: 271139 - DNA, 25 bp, Homo sapien
ggagtttctcctacagataaactta

SEQ ID NO: 271140 - DNA, 25 bp, Homo sapien
gataaacttagaagggtgctcaaat

SEQ ID NO: 271141 - DNA, 25 bp, Homo sapien
atcaggactggcagctgcaaggaca

SEQ ID NO: 271142 - DNA, 25 bp, Homo sapien
tgcaaggacacaccagagccacaga

SEQ ID NO: 271143 - DNA, 25 bp, Homo sapien
gagccacagaaactaaagagaattt

SEQ ID NO: 271144 - DNA, 25 bp, Homo sapien
gagaatttccaaaaggagtctatgg

SEQ ID NO: 271145 - DNA, 25 bp, Homo sapien
agtctatggtgaagtctctgaggat

SEQ ID NO: 271146 - DNA, 25 bp, Homo sapien
attccttttgtgttagtccatgtgt

SEQ ID NO: 271147 - DNA, 25 bp, Homo sapien
ttagtccatgtgtctcccgactgtt

SEQ ID NO: 271148 - DNA, 25 bp, Homo sapien
cttggagtcaggaacagactttgct

SEQ ID NO: 271149 - DNA, 25 bp, Homo sapien
gactttgctattttctggctgtgtg

SEQ ID NO: 271150 - DNA, 25 bp, Homo sapien
ggctgtgtgatcctgatgagtccct

SEQ ID NO: 271151 - DNA, 25 bp, Homo sapien
tgatgagtcccttgaacctcctgga

SEQ ID NO: 271152 - DNA, 25 bp, Homo sapien
ataaatcaagtctatctcacagcct

SEQ ID NO: 271153 - DNA, 25 bp, Homo sapien
agtctatctcacagccttacgtggg

SEQ ID NO: 271154 - DNA, 25 bp, Homo sapien
tgaacacacattgtacatcacgaag

SEQ ID NO: 271155 - DNA, 25 bp, Homo sapien
gtacatcacgaagctgtgtgcaaat

SEQ ID NO: 271156 - DNA, 25 bp, Homo sapien
taaatatcgtgtaactccagccctt

SEQ ID NO: 271157 - DNA, 25 bp, Homo sapien
catcttagccatgtagtggccttgg

SEQ ID NO: 271158 - DNA, 25 bp, Homo sapien
ttcaggccatcttgcctcaaagggt

SEQ ID NO: 271159 - DNA, 25 bp, Homo sapien
ttcctttgaggagcatggtagagtc

SEQ ID NO: 271160 - DNA, 25 bp, Homo sapien
ggagcatggtagagtccacagccat

SEQ ID NO: 271161 - DNA, 25 bp, Homo sapien
cacagccatggctgaagtcagtgga

SEQ ID NO: 271162 - DNA, 25 bp, Homo sapien
atcttgcctcaaagggtacacatgt

SEQ ID NO: 271163 - DNA, 25 bp, Homo sapien
ggtacacatgtttggcggttaagat

SEQ ID NO: 271164 - DNA, 25 bp, Homo sapien
aactaacccttatgtttcatcctgg

SEQ ID NO: 271165 - DNA, 25 bp, Homo sapien
ttatgtttcatcctggccccatgat

SEQ ID NO: 271166 - DNA, 25 bp, Homo sapien
tcatcctggccccatgatgtacaca

SEQ ID NO: 271167 - DNA, 25 bp, Homo sapien
gatgtacacatcttagccatgtagt

SEQ ID NO: 271168 - DNA, 25 bp, Homo sapien
gatcctgtatggcatggtgaccaag

SEQ ID NO: 271169 - DNA, 25 bp, Homo sapien
gagaaactatctccactacatccgc

SEQ ID NO: 271170 - DNA, 25 bp, Homo sapien
acaagaacttgtccatgcacctgtt

SEQ ID NO: 271171 - DNA, 25 bp, Homo sapien
gcttcaggatgtccagatcagcgac

SEQ ID NO: 271172 - DNA, 25 bp, Homo sapien
gatcagcgacattgtcacgttggat

SEQ ID NO: 271173 - DNA, 25 bp, Homo sapien
acgttggataagtgccagtccctga

SEQ ID NO: 271174 - DNA, 25 bp, Homo sapien
gccagtccctgaacaagacggtgta

SEQ ID NO: 271175 - DNA, 25 bp, Homo sapien
agacggtgtacttcaatgtgctcaa

SEQ ID NO: 271176 - DNA, 25 bp, Homo sapien
aggtcaccaaggtcgcagacatcaa

SEQ ID NO: 271177 - DNA, 25 bp, Homo sapien
ttctgaggctgaatgtctgcctgct

SEQ ID NO: 271178 - DNA, 25 bp, Homo sapien
gaatgtctgcctgctccccaaaatg

SEQ ID NO: 271179 - DNA, 25 bp, Homo sapien
taatcagcacggaaggaaggtaatt

SEQ ID NO: 271180 - DNA, 25 bp, Homo sapien
tagcgcaggtctgatgcccttcact

SEQ ID NO: 271181 - DNA, 25 bp, Homo sapien
gtctgatgcccttcactcagcctga

SEQ ID NO: 271182 - DNA, 25 bp, Homo sapien
ctgacgcccttcacagaagtgttga

SEQ ID NO: 271183 - DNA, 25 bp, Homo sapien
acctgcatcgtagctggttccattt

SEQ ID NO: 271184 - DNA, 25 bp, Homo sapien
aataaacgatggtggtcctgatgct

SEQ ID NO: 271185 - DNA, 25 bp, Homo sapien
tggtcctgatgctggagtgctaagt

SEQ ID NO: 271186 - DNA, 25 bp, Homo sapien
agctggttccattttcaccacaaat

SEQ ID NO: 271187 - DNA, 25 bp, Homo sapien
tcaccacaaatcttatccacaggaa

SEQ ID NO: 271188 - DNA, 25 bp, Homo sapien
caggaaatgggctttcttaggagaa

SEQ ID NO: 271189 - DNA, 25 bp, Homo sapien
agggaggaaatgcatttaatcagca

SEQ ID NO: 271190 - DNA, 25 bp, Homo sapien
acagattgaaccgatagagtccttt

SEQ ID NO: 271191 - DNA, 25 bp, Homo sapien
gaaccgatagagtcctttgagagtc

SEQ ID NO: 271192 - DNA, 25 bp, Homo sapien
gatagagtcctttgagagtcaccag

SEQ ID NO: 271193 - DNA, 25 bp, Homo sapien
gagtcctttgagagtcaccagttac

SEQ ID NO: 271194 - DNA, 25 bp, Homo sapien
gtcctttgagagtcaccagttactg

SEQ ID NO: 271195 - DNA, 25 bp, Homo sapien
gagagtcaccagttactggtccact

SEQ ID NO: 271196 - DNA, 25 bp, Homo sapien
accagttactggtccactctctgta

SEQ ID NO: 271197 - DNA, 25 bp, Homo sapien
gcatttggcaagtataaacccgacc

SEQ ID NO: 271198 - DNA, 25 bp, Homo sapien
ggcaagtataaacccgaccaggata

SEQ ID NO: 271199 - DNA, 25 bp, Homo sapien
gagcccaggagtatgcgtttagcct

SEQ ID NO: 271200 - DNA, 25 bp, Homo sapien
aggagtatgcgtttagcctgggcaa

SEQ ID NO: 271201 - DNA, 25 bp, Homo sapien
tgatcagccaacaagggtcagtcct

SEQ ID NO: 271202 - DNA, 25 bp, Homo sapien
gaaaagacagccacacccaaatctc

SEQ ID NO: 271203 - DNA, 25 bp, Homo sapien
aaatctcatgaagcagtccccttta

SEQ ID NO: 271204 - DNA, 25 bp, Homo sapien
gaagctggaagagaaccgacccaaa

SEQ ID NO: 271205 - DNA, 25 bp, Homo sapien
gagaaccgacccaaagaatccaaga

SEQ ID NO: 271206 - DNA, 25 bp, Homo sapien
caagagactaagactgtgcagggtt

SEQ ID NO: 271207 - DNA, 25 bp, Homo sapien
ggtcagtcctatgcttatcccttga

SEQ ID NO: 271208 - DNA, 25 bp, Homo sapien
ttgaccaatctctgtgcccagaggg

SEQ ID NO: 271209 - DNA, 25 bp, Homo sapien
ggcagggtactctgattggcaatac

SEQ ID NO: 271210 - DNA, 25 bp, Homo sapien
gattggcaataccttcatcgtgggc

SEQ ID NO: 271211 - DNA, 25 bp, Homo sapien
ttcatcgtgggccaaccactgtggg

SEQ ID NO: 271212 - DNA, 25 bp, Homo sapien
cagtgaaaggcatccgaggtaagat

SEQ ID NO: 271213 - DNA, 25 bp, Homo sapien
agtgatgtcaaagacctcacccaag

SEQ ID NO: 271214 - DNA, 25 bp, Homo sapien
gaggtaagatcaggaaaagctccct

SEQ ID NO: 271215 - DNA, 25 bp, Homo sapien
gctccctagggcaggtggcaaatgc

SEQ ID NO: 271216 - DNA, 25 bp, Homo sapien
tgaggctgtgtgtttcaggtcagta

SEQ ID NO: 271217 - DNA, 25 bp, Homo sapien
aaagacctcacccaagactagggag

SEQ ID NO: 271218 - DNA, 25 bp, Homo sapien
gcggtttgacgtttgaagaacagga

SEQ ID NO: 271219 - DNA, 25 bp, Homo sapien
ttaatgactggttgtggcatgtgca

SEQ ID NO: 271220 - DNA, 25 bp, Homo sapien
gactagggagacaccatgtttgcat

SEQ ID NO: 271221 - DNA, 25 bp, Homo sapien
gtttgcataaataccttggtctgcc

SEQ ID NO: 271222 - DNA, 25 bp, Homo sapien
aataccttggtctgcctttgagaaa

SEQ ID NO: 271223 - DNA, 25 bp, Homo sapien
ttacttcttgcatcgtattctatga

SEQ ID NO: 271224 - DNA, 25 bp, Homo sapien
gtattctatgaactcactttcaaga

SEQ ID NO: 271225 - DNA, 25 bp, Homo sapien
agagacgttgtctatccacaggttt

SEQ ID NO: 271226 - DNA, 25 bp, Homo sapien
gttgtctatccacaggttttctgca

SEQ ID NO: 271227 - DNA, 25 bp, Homo sapien
gttttctgcagtcctaattaaaaag

SEQ ID NO: 271228 - DNA, 25 bp, Homo sapien
ttttcatttcaacttccaacccaag

SEQ ID NO: 271229 - DNA, 25 bp, Homo sapien
gcttgagggcatagcagtaactgca

SEQ ID NO: 271230 - DNA, 25 bp, Homo sapien
gagtatattgtgttcattttgctgt

SEQ ID NO: 271231 - DNA, 25 bp, Homo sapien
ggagttgcctttcaaacaccaaaca

SEQ ID NO: 271232 - DNA, 25 bp, Homo sapien
actaatatgattccctgcggacact

SEQ ID NO: 271233 - DNA, 25 bp, Homo sapien
tgcggacactgctatcacatcaaga

SEQ ID NO: 271234 - DNA, 25 bp, Homo sapien
attagtgcttgttaagatgtttcaa

SEQ ID NO: 271235 - DNA, 25 bp, Homo sapien
ttcaagtgctttggccacttctctc

SEQ ID NO: 271236 - DNA, 25 bp, Homo sapien
ctgtttcttcatggtcagcatattt

SEQ ID NO: 271237 - DNA, 25 bp, Homo sapien
gttttcgggaaagggcatcagatgc

SEQ ID NO: 271238 - DNA, 25 bp, Homo sapien
ggcatcagatgcgtctgtgtctgga

SEQ ID NO: 271239 - DNA, 25 bp, Homo sapien
tgcgtctgtgtctggagaattgctc

SEQ ID NO: 271240 - DNA, 25 bp, Homo sapien
gtgtatccatgtgaagcaagtctct

SEQ ID NO: 271241 - DNA, 25 bp, Homo sapien
aagcaagtctctgagagcaactgga

SEQ ID NO: 271242 - DNA, 25 bp, Homo sapien
cgtgttcacagcagctactttgaaa

SEQ ID NO: 271243 - DNA, 25 bp, Homo sapien
ttgaaaggcctccagttttgacgtt

SEQ ID NO: 271244 - DNA, 25 bp, Homo sapien
ccagttttgacgttctcatggaaaa

SEQ ID NO: 271245 - DNA, 25 bp, Homo sapien
ttggaagggctactctgcctccatc

SEQ ID NO: 271246 - DNA, 25 bp, Homo sapien
aggtgcaggcctcgctgcttcttaa

SEQ ID NO: 271247 - DNA, 25 bp, Homo sapien
gaaacggaaactgtatgattgtctt

SEQ ID NO: 271248 - DNA, 25 bp, Homo sapien
gtctacaatgtctgagagtggcgtt

SEQ ID NO: 271249 - DNA, 25 bp, Homo sapien
agagtggcgtttgcggcatgacttt

SEQ ID NO: 271250 - DNA, 25 bp, Homo sapien
gcgtttgcggcatgacttttaaaaa

SEQ ID NO: 271251 - DNA, 25 bp, Homo sapien
gctggtattggaccctttctgtgtt

SEQ ID NO: 271252 - DNA, 25 bp, Homo sapien
gcctccatcagcattttcaaatttc

SEQ ID NO: 271253 - DNA, 25 bp, Homo sapien
tcaaatttcaggctctggcctttca

SEQ ID NO: 271254 - DNA, 25 bp, Homo sapien
accagtcctgtttacactgccaggt

SEQ ID NO: 271255 - DNA, 25 bp, Homo sapien
ttacactgccaggttccgctaggag

SEQ ID NO: 271256 - DNA, 25 bp, Homo sapien
aatgggagcccttcatcacagcttt

SEQ ID NO: 271257 - DNA, 25 bp, Homo sapien
atcacagctttgtagttacctcaac

SEQ ID NO: 271258 - DNA, 25 bp, Homo sapien
gtagttacctcaactctggctgttg

SEQ ID NO: 271259 - DNA, 25 bp, Homo sapien
ctggctgttgagtaatttgctcagt

SEQ ID NO: 271260 - DNA, 25 bp, Homo sapien
gtagtgaattacaacctcctctggt

SEQ ID NO: 271261 - DNA, 25 bp, Homo sapien
tggttccctcgagatcaagtctaac

SEQ ID NO: 271262 - DNA, 25 bp, Homo sapien
gtctaacctggtgattgcgtcatct

SEQ ID NO: 271263 - DNA, 25 bp, Homo sapien
attgcgtcatctggtgggagagcac

SEQ ID NO: 271264 - DNA, 25 bp, Homo sapien
ggagagcacggctacaacagcaggt

SEQ ID NO: 271265 - DNA, 25 bp, Homo sapien
aggtggaaaccatgctcgggtcctg

SEQ ID NO: 271266 - DNA, 25 bp, Homo sapien
tcctggccactttgcctaggatgaa

SEQ ID NO: 271267 - DNA, 25 bp, Homo sapien
aaactgaggcccgagaacatacagc

SEQ ID NO: 271268 - DNA, 25 bp, Homo sapien
gaacatacagccagcatgtgccatt

SEQ ID NO: 271269 - DNA, 25 bp, Homo sapien
gccattgctgggttccagcctcagt

SEQ ID NO: 271270 - DNA, 25 bp, Homo sapien
agcctcagtctgctgattccagggc

SEQ ID NO: 271271 - DNA, 25 bp, Homo sapien
gggccccagatgaaccgccaagtgg

SEQ ID NO: 271272 - DNA, 25 bp, Homo sapien
ggttgtcattttgacgccgaggctc

SEQ ID NO: 271273 - DNA, 25 bp, Homo sapien
gaggctccgaagcatgccatggcct

SEQ ID NO: 271274 - DNA, 25 bp, Homo sapien
accaggagcctctatgagacactcg

SEQ ID NO: 271275 - DNA, 25 bp, Homo sapien
aggttcatctcctaatttaatgtcc

SEQ ID NO: 271276 - DNA, 25 bp, Homo sapien
gagacactcggctctccgggatgcg

SEQ ID NO: 271277 - DNA, 25 bp, Homo sapien
tctatccccatgtcactgatgttga

SEQ ID NO: 271278 - DNA, 25 bp, Homo sapien
gaagtattctatttctttgacattc

SEQ ID NO: 271279 - DNA, 25 bp, Homo sapien
ttctttgacattcagtgggacacat

SEQ ID NO: 271280 - DNA, 25 bp, Homo sapien
gtgggacacataatgaggccatcat

SEQ ID NO: 271281 - DNA, 25 bp, Homo sapien
gatggtgacctaaatagccactacc

SEQ ID NO: 271282 - DNA, 25 bp, Homo sapien
aatagccactacctctggccttggg

SEQ ID NO: 271283 - DNA, 25 bp, Homo sapien
tggccttgggttacttggcttcctg

SEQ ID NO: 271284 - DNA, 25 bp, Homo sapien
ttcctggcccggcaacaacagattc

SEQ ID NO: 271285 - DNA, 25 bp, Homo sapien
gattctgttacagacacctaactat

SEQ ID NO: 271286 - DNA, 25 bp, Homo sapien
cacctaactatctgtaatgctaccg

SEQ ID NO: 271287 - DNA, 25 bp, Homo sapien
aatgctaccgatactaggtgagaac

SEQ ID NO: 271288 - DNA, 25 bp, Homo sapien
gtcaaaccaggaatcttagtctaga

SEQ ID NO: 271289 - DNA, 25 bp, Homo sapien
gtatttcttagacccatgtctctgt

SEQ ID NO: 271290 - DNA, 25 bp, Homo sapien
tagacccatgtctctgtccaaatag

SEQ ID NO: 271291 - DNA, 25 bp, Homo sapien
atgtctctgtccaaataggcctttc

SEQ ID NO: 271292 - DNA, 25 bp, Homo sapien
tctctgtccaaataggcctttccat

SEQ ID NO: 271293 - DNA, 25 bp, Homo sapien
tggcatttcccgctcatttatatga

SEQ ID NO: 271294 - DNA, 25 bp, Homo sapien
cccgctcatttatatgacttgctga

SEQ ID NO: 271295 - DNA, 25 bp, Homo sapien
gacttgctgagttcctatggtcatt

SEQ ID NO: 271296 - DNA, 25 bp, Homo sapien
tgagttcctatggtcatttgagttt

SEQ ID NO: 271297 - DNA, 25 bp, Homo sapien
ttgagtttgcaaacagtggtctgta

SEQ ID NO: 271298 - DNA, 25 bp, Homo sapien
agtggtctgtagcactcaggttttc

SEQ ID NO: 271299 - DNA, 25 bp, Homo sapien
gtagcactcaggttttctggagttg

SEQ ID NO: 271300 - DNA, 25 bp, Homo sapien
gattcatcaggtcgagttttagctc

SEQ ID NO: 271301 - DNA, 25 bp, Homo sapien
gagttttagctcaggcaagtggcaa

SEQ ID NO: 271302 - DNA, 25 bp, Homo sapien
ggtgttatccatttgctagatctta

SEQ ID NO: 271303 - DNA, 25 bp, Homo sapien
gattcacaaattgatgggccacgaa

SEQ ID NO: 271304 - DNA, 25 bp, Homo sapien
acgaaaacgaggcacacacggttgt

SEQ ID NO: 271305 - DNA, 25 bp, Homo sapien
acacggttgtgttttctcacgacgg

SEQ ID NO: 271306 - DNA, 25 bp, Homo sapien
ggctctgacggcacagttcgaacgt

SEQ ID NO: 271307 - DNA, 25 bp, Homo sapien
gaacgtggtcttgaccgtcagcaca

SEQ ID NO: 271308 - DNA, 25 bp, Homo sapien
ctgtgggactttcggaagctgttac

SEQ ID NO: 271309 - DNA, 25 bp, Homo sapien
aagctgttaccaattgtgtccatcg

SEQ ID NO: 271310 - DNA, 25 bp, Homo sapien
gtgtccatcgatataggtccaagtc

SEQ ID NO: 271311 - DNA, 25 bp, Homo sapien
gcacctagaaacactaaggttgtta

SEQ ID NO: 271312 - DNA, 25 bp, Homo sapien
ggttgttaagtactgttcctctgtc

SEQ ID NO: 271313 - DNA, 25 bp, Homo sapien
gtcatctccactaccagatagtaaa

SEQ ID NO: 271314 - DNA, 25 bp, Homo sapien
tcttaaggctagacagactctgttt

SEQ ID NO: 271315 - DNA, 25 bp, Homo sapien
gatgttgtatcacacaagttggcca

SEQ ID NO: 271316 - DNA, 25 bp, Homo sapien
gtatcacacaagttggccataccat

SEQ ID NO: 271317 - DNA, 25 bp, Homo sapien
gttggccataccatgaacattcagc

SEQ ID NO: 271318 - DNA, 25 bp, Homo sapien
tcctcctttctgtggacacttgtaa

SEQ ID NO: 271319 - DNA, 25 bp, Homo sapien
cagatgatgatcttcagtagaattt

SEQ ID NO: 271320 - DNA, 25 bp, Homo sapien
cacatttaacctgtcttgagatgga

SEQ ID NO: 271321 - DNA, 25 bp, Homo sapien
gatggaattatgtaagcacctagaa

SEQ ID NO: 271322 - DNA, 25 bp, Homo sapien
gggcctcagtgctgtgtggaccctt

SEQ ID NO: 271323 - DNA, 25 bp, Homo sapien
ctcagtgctgtgtggaccctttctt

SEQ ID NO: 271324 - DNA, 25 bp, Homo sapien
cagtgctgtgtggaccctttcttgt

SEQ ID NO: 271325 - DNA, 25 bp, Homo sapien
ggaccctttcttgtctccctgatga

SEQ ID NO: 271326 - DNA, 25 bp, Homo sapien
tttcttgtctccctgatgactggat

SEQ ID NO: 271327 - DNA, 25 bp, Homo sapien
cttgtctccctgatgactggatgga

SEQ ID NO: 271328 - DNA, 25 bp, Homo sapien
tccctgatgactggatggagggcct

SEQ ID NO: 271329 - DNA, 25 bp, Homo sapien
gggtcttagaggattcactcatgtc

SEQ ID NO: 271330 - DNA, 25 bp, Homo sapien
gtcttagaggattcactcatgtccc

SEQ ID NO: 271331 - DNA, 25 bp, Homo sapien
tcgtccattttggagttataaccta

SEQ ID NO: 271332 - DNA, 25 bp, Homo sapien
agatagttgggcctcagtgctgtgt

SEQ ID NO: 271333 - DNA, 25 bp, Homo sapien
gaatccaagcccaacttcacccctc

SEQ ID NO: 271334 - DNA, 25 bp, Homo sapien
aatccaagcccaacttcacccctct

SEQ ID NO: 271335 - DNA, 25 bp, Homo sapien
atccaagcccaacttcacccctctc

SEQ ID NO: 271336 - DNA, 25 bp, Homo sapien
tccaagcccaacttcacccctctcg

SEQ ID NO: 271337 - DNA, 25 bp, Homo sapien
aacttcacccctctcgccatcttgg

SEQ ID NO: 271338 - DNA, 25 bp, Homo sapien
acttcacccctctcgccatcttggc

SEQ ID NO: 271339 - DNA, 25 bp, Homo sapien
acccctctcgccatcttggcccatg

SEQ ID NO: 271340 - DNA, 25 bp, Homo sapien
ccctctcgccatcttggcccatgtt

SEQ ID NO: 271341 - DNA, 25 bp, Homo sapien
cctctcgccatcttggcccatgttc

SEQ ID NO: 271342 - DNA, 25 bp, Homo sapien
ctctcgccatcttggcccatgttct

SEQ ID NO: 271343 - DNA, 25 bp, Homo sapien
tctcgccatcttggcccatgttctc

SEQ ID NO: 271344 - DNA, 25 bp, Homo sapien
agttagacttgctcacgttcagttt

SEQ ID NO: 271345 - DNA, 25 bp, Homo sapien
ttagacttgctcacgttcagtttgt

SEQ ID NO: 271346 - DNA, 25 bp, Homo sapien
cagttgtgtgttgacttactatgtt

SEQ ID NO: 271347 - DNA, 25 bp, Homo sapien
gtgtgttgacttactatgttttgaa

SEQ ID NO: 271348 - DNA, 25 bp, Homo sapien
gttttgaaagtggtgacttctaccg

SEQ ID NO: 271349 - DNA, 25 bp, Homo sapien
gaaagtggtgacttctaccgaatga

SEQ ID NO: 271350 - DNA, 25 bp, Homo sapien
tggtgacttctaccgaatgagtgga

SEQ ID NO: 271351 - DNA, 25 bp, Homo sapien
tctaccgaatgagtggaagttccca

SEQ ID NO: 271352 - DNA, 25 bp, Homo sapien
tgagtggaagttcccattgtcaaaa

SEQ ID NO: 271353 - DNA, 25 bp, Homo sapien
atgcttgcactgctggttgtgtatc

SEQ ID NO: 271354 - DNA, 25 bp, Homo sapien
tgcttgcactgctggttgtgtatca

SEQ ID NO: 271355 - DNA, 25 bp, Homo sapien
ctctagaaagcaactgaggccaggt

SEQ ID NO: 271356 - DNA, 25 bp, Homo sapien
tctagaaagcaactgaggccaggtg

SEQ ID NO: 271357 - DNA, 25 bp, Homo sapien
ctagaaagcaactgaggccaggtgc

SEQ ID NO: 271358 - DNA, 25 bp, Homo sapien
tagaaagcaactgaggccaggtgcg

SEQ ID NO: 271359 - DNA, 25 bp, Homo sapien
agaaagcaactgaggccaggtgcgg

SEQ ID NO: 271360 - DNA, 25 bp, Homo sapien
gaaagcaactgaggccaggtgcggt

SEQ ID NO: 271361 - DNA, 25 bp, Homo sapien
aaagcaactgaggccaggtgcggtg

SEQ ID NO: 271362 - DNA, 25 bp, Homo sapien
aagcaactgaggccaggtgcggtgg

SEQ ID NO: 271363 - DNA, 25 bp, Homo sapien
gcctgggtgactagcaaaactccat

SEQ ID NO: 271364 - DNA, 25 bp, Homo sapien
cctgggtgactagcaaaactccatc

SEQ ID NO: 271365 - DNA, 25 bp, Homo sapien
ctgggtgactagcaaaactccatct

SEQ ID NO: 271366 - DNA, 25 bp, Homo sapien
gtttccaatcaattatgtaccccaa

SEQ ID NO: 271367 - DNA, 25 bp, Homo sapien
cccaacaatgtgaggtcaactactt

SEQ ID NO: 271368 - DNA, 25 bp, Homo sapien
gtcaactacttagactacctcttag

SEQ ID NO: 271369 - DNA, 25 bp, Homo sapien
gactacctcttagcttctacattta

SEQ ID NO: 271370 - DNA, 25 bp, Homo sapien
gtttcaaagtctgttctgatcctta

SEQ ID NO: 271371 - DNA, 25 bp, Homo sapien
gaacatagatacctacttagctgta

SEQ ID NO: 271372 - DNA, 25 bp, Homo sapien
gatccttaaatttgacacttctctt

SEQ ID NO: 271373 - DNA, 25 bp, Homo sapien
gtattctttgggattagcttaccac

SEQ ID NO: 271374 - DNA, 25 bp, Homo sapien
tagcttaccacttaataaattcctt

SEQ ID NO: 271375 - DNA, 25 bp, Homo sapien
taaattccttccaacactatcttct

SEQ ID NO: 271376 - DNA, 25 bp, Homo sapien
gatacagagctgaatccataagata

SEQ ID NO: 271377 - DNA, 25 bp, Homo sapien
gactaactctgaatgtccttccttt

SEQ ID NO: 271378 - DNA, 25 bp, Homo sapien
tttttaatcaatacctaaggactca

SEQ ID NO: 271379 - DNA, 25 bp, Homo sapien
caatacctaaggactcactgctcct

SEQ ID NO: 271380 - DNA, 25 bp, Homo sapien
tgctaactcaggtgaaaattccctt

SEQ ID NO: 271381 - DNA, 25 bp, Homo sapien
tcaggtgaaaattcccttacccctg

SEQ ID NO: 271382 - DNA, 25 bp, Homo sapien
cacttcccgggttttctcaggctcg

SEQ ID NO: 271383 - DNA, 25 bp, Homo sapien
cctgccaccaaataagacagtattc

SEQ ID NO: 271384 - DNA, 25 bp, Homo sapien
agtattctattatgtctccctttga

SEQ ID NO: 271385 - DNA, 25 bp, Homo sapien
tattatgtctccctttgactcctaa

SEQ ID NO: 271386 - DNA, 25 bp, Homo sapien
tgactcctaacacccaactaagaag

SEQ ID NO: 271387 - DNA, 25 bp, Homo sapien
acccaactaagaaggactaactctg

SEQ ID NO: 271388 - DNA, 25 bp, Homo sapien
gtgcaggcttggaaaatatgtgtct

SEQ ID NO: 271389 - DNA, 25 bp, Homo sapien
gaaaatatgtgtctgaatggtacca

SEQ ID NO: 271390 - DNA, 25 bp, Homo sapien
gaatggtaccaggaacttgctattt

SEQ ID NO: 271391 - DNA, 25 bp, Homo sapien
ggaacttgctatttttgactcaaac

SEQ ID NO: 271392 - DNA, 25 bp, Homo sapien
gtttatgatgctaattactcatttt

SEQ ID NO: 271393 - DNA, 25 bp, Homo sapien
cagaaaggtgactgctctatgtaac

SEQ ID NO: 271394 - DNA, 25 bp, Homo sapien
ggtgactgctctatgtaacagaaat

SEQ ID NO: 271395 - DNA, 25 bp, Homo sapien
gagttaagcataaagtcagtctact

SEQ ID NO: 271396 - DNA, 25 bp, Homo sapien
gtcagtctactttatttgcagtctt

SEQ ID NO: 271397 - DNA, 25 bp, Homo sapien
aactgtcataattctttgcattggt

SEQ ID NO: 271398 - DNA, 25 bp, Homo sapien
aattctttgcattggtacattttta

SEQ ID NO: 271399 - DNA, 25 bp, Homo sapien
taaaagtgttgaaaatctgttctta

SEQ ID NO: 271400 - DNA, 25 bp, Homo sapien
aaatgtttgaagcagcacaatttga

SEQ ID NO: 271401 - DNA, 25 bp, Homo sapien
gtttgaagcagcacaatttgatggt

SEQ ID NO: 271402 - DNA, 25 bp, Homo sapien
gaagcagcacaatttgatggtttca

SEQ ID NO: 271403 - DNA, 25 bp, Homo sapien
gcagcacaatttgatggtttcacat

SEQ ID NO: 271404 - DNA, 25 bp, Homo sapien
gcacaatttgatggtttcacattaa

SEQ ID NO: 271405 - DNA, 25 bp, Homo sapien
tgatggtttcacattaattcactgt

SEQ ID NO: 271406 - DNA, 25 bp, Homo sapien
ggtttcacattaattcactgtgtaa

SEQ ID NO: 271407 - DNA, 25 bp, Homo sapien
ttcactgtgtaaacaaacctaaact

SEQ ID NO: 271408 - DNA, 25 bp, Homo sapien
aaagcagtgttacatattattaagg

SEQ ID NO: 271409 - DNA, 25 bp, Homo sapien
gaaatttgtactatatgtttacatg

SEQ ID NO: 271410 - DNA, 25 bp, Homo sapien
tgtctcggatactttgggttcacat

SEQ ID NO: 271411 - DNA, 25 bp, Homo sapien
gtctcggatactttgggttcacata

SEQ ID NO: 271412 - DNA, 25 bp, Homo sapien
tctcggatactttgggttcacataa

SEQ ID NO: 271413 - DNA, 25 bp, Homo sapien
ctcggatactttgggttcacataag

SEQ ID NO: 271414 - DNA, 25 bp, Homo sapien
cggatactttgggttcacataagga

SEQ ID NO: 271415 - DNA, 25 bp, Homo sapien
ggatactttgggttcacataaggaa

SEQ ID NO: 271416 - DNA, 25 bp, Homo sapien
gatactttgggttcacataaggaaa

SEQ ID NO: 271417 - DNA, 25 bp, Homo sapien
acctcgagttgtctcgccttcctgg

SEQ ID NO: 271418 - DNA, 25 bp, Homo sapien
ttctttttccaagcacaatgtaagc

SEQ ID NO: 271419 - DNA, 25 bp, Homo sapien
tttttccaagcacaatgtaagcaca

SEQ ID NO: 271420 - DNA, 25 bp, Homo sapien
ctcgagttgtctcgccttcctggac

SEQ ID NO: 271421 - DNA, 25 bp, Homo sapien
ctgtacttattagaactgggtaaat

SEQ ID NO: 271422 - DNA, 25 bp, Homo sapien
aaatctattattccatcaattcagt

SEQ ID NO: 271423 - DNA, 25 bp, Homo sapien
tctaggtgattatgcagaatcttct

SEQ ID NO: 271424 - DNA, 25 bp, Homo sapien
agaatcttctgccagggcacgatgc

SEQ ID NO: 271425 - DNA, 25 bp, Homo sapien
gggcacgatgctgtcgtaagagatt

SEQ ID NO: 271426 - DNA, 25 bp, Homo sapien
tgctgtcgtaagagatttctgttct

SEQ ID NO: 271427 - DNA, 25 bp, Homo sapien
cttgccctgttccttgagtgaagtg

SEQ ID NO: 271428 - DNA, 25 bp, Homo sapien
gtgaatcccttccttgtacatggtg

SEQ ID NO: 271429 - DNA, 25 bp, Homo sapien
ccttgtacatggtggtcagtggcac

SEQ ID NO: 271430 - DNA, 25 bp, Homo sapien
tggtcagtggcacggaatccccaat

SEQ ID NO: 271431 - DNA, 25 bp, Homo sapien
gcacggaatccccaatagattgtat

SEQ ID NO: 271432 - DNA, 25 bp, Homo sapien
gcccaggttcatactataatttcag

SEQ ID NO: 271433 - DNA, 25 bp, Homo sapien
taatttcagtggttactgccctacc

SEQ ID NO: 271434 - DNA, 25 bp, Homo sapien
gtgtatctaagacttctcgagttta

SEQ ID NO: 271435 - DNA, 25 bp, Homo sapien
ataatgagtcagttatgcccatgta

SEQ ID NO: 271436 - DNA, 25 bp, Homo sapien
gttatgcccatgtaatagctaggtt

SEQ ID NO: 271437 - DNA, 25 bp, Homo sapien
gtttgagaggctgcgtagaccacct

SEQ ID NO: 271438 - DNA, 25 bp, Homo sapien
ttgtatacatcaacacgggagtgga

SEQ ID NO: 271439 - DNA, 25 bp, Homo sapien
gagtggaacatgtatgcaccagaat

SEQ ID NO: 271440 - DNA, 25 bp, Homo sapien
gtagaccacctctattcagcctagt

SEQ ID NO: 271441 - DNA, 25 bp, Homo sapien
agtctcccccagtctatgttaaaag

SEQ ID NO: 271442 - DNA, 25 bp, Homo sapien
ctaatttagttcagcccaggttcat

SEQ ID NO: 271443 - DNA, 25 bp, Homo sapien
gaccttggacgcaggagagacacct

SEQ ID NO: 271444 - DNA, 25 bp, Homo sapien
acacctgggttctagttcaagtcgg

SEQ ID NO: 271445 - DNA, 25 bp, Homo sapien
caagtcggccaaggactgtgtgacc

SEQ ID NO: 271446 - DNA, 25 bp, Homo sapien
gacaagtctaactggtctgtgaaca

SEQ ID NO: 271447 - DNA, 25 bp, Homo sapien
atttgcccttccagctgtaaacact

SEQ ID NO: 271448 - DNA, 25 bp, Homo sapien
aatacatgtgggatcttgccaaggt

SEQ ID NO: 271449 - DNA, 25 bp, Homo sapien
tgggatcttgccaaggtgctgcctt

SEQ ID NO: 271450 - DNA, 25 bp, Homo sapien
tttaggatgctgacccctgcactac

SEQ ID NO: 271451 - DNA, 25 bp, Homo sapien
cctgcactaccttagaacatgttga

SEQ ID NO: 271452 - DNA, 25 bp, Homo sapien
aacatgttgatctgtgagtgcccaa

SEQ ID NO: 271453 - DNA, 25 bp, Homo sapien
tctgtgagtgcccaagcccctgagg

SEQ ID NO: 271454 - DNA, 25 bp, Homo sapien
agaaggtatcggcaccatacagaga

SEQ ID NO: 271455 - DNA, 25 bp, Homo sapien
gaaggtatcggcaccatacagagag

SEQ ID NO: 271456 - DNA, 25 bp, Homo sapien
aaggtatcggcaccatacagagaga

SEQ ID NO: 271457 - DNA, 25 bp, Homo sapien
ggtatcggcaccatacagagagaca

SEQ ID NO: 271458 - DNA, 25 bp, Homo sapien
gtatcggcaccatacagagagacag

SEQ ID NO: 271459 - DNA, 25 bp, Homo sapien
gagacagaaagatgccataatggct

SEQ ID NO: 271460 - DNA, 25 bp, Homo sapien
gaaagatgccataatggctttgcct

SEQ ID NO: 271461 - DNA, 25 bp, Homo sapien
agatgccataatggctttgccttgc

SEQ ID NO: 271462 - DNA, 25 bp, Homo sapien
cataatggctttgccttgctttgtg

SEQ ID NO: 271463 - DNA, 25 bp, Homo sapien
taatggctttgccttgctttgtgag

SEQ ID NO: 271464 - DNA, 25 bp, Homo sapien
tgctttgtgaggccaccaaacagag

SEQ ID NO: 271465 - DNA, 25 bp, Homo sapien
gacatcactcactgcagcgattcat

SEQ ID NO: 271466 - DNA, 25 bp, Homo sapien
tgctcccacatctgaattcctttaa

SEQ ID NO: 271467 - DNA, 25 bp, Homo sapien
atacttgtccatttagactgccggc

SEQ ID NO: 271468 - DNA, 25 bp, Homo sapien
ttagactgccggcaaaccctgagag

SEQ ID NO: 271469 - DNA, 25 bp, Homo sapien
cttttgtatctccagtgcctagaac

SEQ ID NO: 271470 - DNA, 25 bp, Homo sapien
tgaattcctttaactcactccatgt

SEQ ID NO: 271471 - DNA, 25 bp, Homo sapien
gcactcattcattgaacgttgctga

SEQ ID NO: 271472 - DNA, 25 bp, Homo sapien
actcactccatgtttttctcaaagg

SEQ ID NO: 271473 - DNA, 25 bp, Homo sapien
ttctcaaaggcagaccaaggtattt

SEQ ID NO: 271474 - DNA, 25 bp, Homo sapien
tatgcaaacatggtgtctccctagt

SEQ ID NO: 271475 - DNA, 25 bp, Homo sapien
gtctccctagtcttgggtgaggtct

SEQ ID NO: 271476 - DNA, 25 bp, Homo sapien
ggacataggtatgtatatgcacatg

SEQ ID NO: 271477 - DNA, 25 bp, Homo sapien
tatatgtatatatccatcttcaata

SEQ ID NO: 271478 - DNA, 25 bp, Homo sapien
gagagttgtaaatactccttggtca

SEQ ID NO: 271479 - DNA, 25 bp, Homo sapien
taaatactccttggtcatatgtctg

SEQ ID NO: 271480 - DNA, 25 bp, Homo sapien
atgtctgtctttctcatagtatcat

SEQ ID NO: 271481 - DNA, 25 bp, Homo sapien
gtctttctcatagtatcatatcttc

SEQ ID NO: 271482 - DNA, 25 bp, Homo sapien
gttatgttaacaactccatttattg

SEQ ID NO: 271483 - DNA, 25 bp, Homo sapien
aaatcgtgtgtagacctgtatcctc

SEQ ID NO: 271484 - DNA, 25 bp, Homo sapien
cctgtatcctcctgacatagtttat

SEQ ID NO: 271485 - DNA, 25 bp, Homo sapien
catagtttatgtagggtctcttctc

SEQ ID NO: 271486 - DNA, 25 bp, Homo sapien
gtagggtctcttctcaaataaagta

SEQ ID NO: 271487 - DNA, 25 bp, Homo sapien
gaacctagctggtagagatgctcaa

SEQ ID NO: 271488 - DNA, 25 bp, Homo sapien
gagatgctcaaatgatgtttactga

SEQ ID NO: 271489 - DNA, 25 bp, Homo sapien
tttactgaatggtggctccagggcc

SEQ ID NO: 271490 - DNA, 25 bp, Homo sapien
acctgctgatcttcctgcctggagg

SEQ ID NO: 271491 - DNA, 25 bp, Homo sapien
agctcttcctgagatacctgcatgg

SEQ ID NO: 271492 - DNA, 25 bp, Homo sapien
gagatacctgcatggttccttccca

SEQ ID NO: 271493 - DNA, 25 bp, Homo sapien
ctccaggttccctttagaaaggatg

SEQ ID NO: 271494 - DNA, 25 bp, Homo sapien
agaaaggatgttcccaaccatccaa

SEQ ID NO: 271495 - DNA, 25 bp, Homo sapien
caacctggaaatagagccccactgc

SEQ ID NO: 271496 - DNA, 25 bp, Homo sapien
tcaaccaccctagtgtgagaagtat

SEQ ID NO: 271497 - DNA, 25 bp, Homo sapien
attcccataatggaacctagctggt

SEQ ID NO: 271498 - DNA, 25 bp, Homo sapien
gatacaggcaccaggtcgcagcgct

SEQ ID NO: 271499 - DNA, 25 bp, Homo sapien
caccaggtcgcagcgctgcagaggt

SEQ ID NO: 271500 - DNA, 25 bp, Homo sapien
cagaggtgcgcaagggccgcccaaa

SEQ ID NO: 271501 - DNA, 25 bp, Homo sapien
gaggcagacacagggcgttccatcc

SEQ ID NO: 271502 - DNA, 25 bp, Homo sapien
aggcagtgacagtcgtcgcggaatc

SEQ ID NO: 271503 - DNA, 25 bp, Homo sapien
gtcgcggaatcctgcgtgtgacacc

SEQ ID NO: 271504 - DNA, 25 bp, Homo sapien
ccctgcccagcggattagggagttg

SEQ ID NO: 271505 - DNA, 25 bp, Homo sapien
cggattagggagttgtcctctggta

SEQ ID NO: 271506 - DNA, 25 bp, Homo sapien
gttgtcctctggtaaaaggatttct

SEQ ID NO: 271507 - DNA, 25 bp, Homo sapien
taaaaggatttctgggctgcttcca

SEQ ID NO: 271508 - DNA, 25 bp, Homo sapien
atttctgggctgcttccagcttggg

SEQ ID NO: 271509 - DNA, 25 bp, Homo sapien
cttctccccacaggctgtaaataga

SEQ ID NO: 271510 - DNA, 25 bp, Homo sapien
ccacaggctgtaaatagacttccaa

SEQ ID NO: 271511 - DNA, 25 bp, Homo sapien
agcccaggtaggtggtgaacccgct

SEQ ID NO: 271512 - DNA, 25 bp, Homo sapien
aggtaggtggtgaacccgctgccac

SEQ ID NO: 271513 - DNA, 25 bp, Homo sapien
acgtctatcagtcctcttgttttat

SEQ ID NO: 271514 - DNA, 25 bp, Homo sapien
atcagtcctcttgttttatgcaaag

SEQ ID NO: 271515 - DNA, 25 bp, Homo sapien
aggagggatagtcaacacccctgct

SEQ ID NO: 271516 - DNA, 25 bp, Homo sapien
gggatagtcaacacccctgctgtct

SEQ ID NO: 271517 - DNA, 25 bp, Homo sapien
ctctgtcactcacacactgatttat

SEQ ID NO: 271518 - DNA, 25 bp, Homo sapien
ctgagctgggctgttcctgcaggat

SEQ ID NO: 271519 - DNA, 25 bp, Homo sapien
ctgggctgttcctgcaggatggaca

SEQ ID NO: 271520 - DNA, 25 bp, Homo sapien
gaacagctcgtttgactgatgggaa

SEQ ID NO: 271521 - DNA, 25 bp, Homo sapien
ggaatcatgctcacatggtcccctc

SEQ ID NO: 271522 - DNA, 25 bp, Homo sapien
agagacgatttctgggcctagcctg

SEQ ID NO: 271523 - DNA, 25 bp, Homo sapien
tgggcctagcctgctttctctagaa

SEQ ID NO: 271524 - DNA, 25 bp, Homo sapien
agaaagtattttcaagtctgctgct

SEQ ID NO: 271525 - DNA, 25 bp, Homo sapien
ctgctgagcacctgtggactggcat

SEQ ID NO: 271526 - DNA, 25 bp, Homo sapien
tggactggcatctttgaccgttcat

SEQ ID NO: 271527 - DNA, 25 bp, Homo sapien
ttcatcctacacactgcaacagaga

SEQ ID NO: 271528 - DNA, 25 bp, Homo sapien
agagatcataccttgcctgtgtagt

SEQ ID NO: 271529 - DNA, 25 bp, Homo sapien
ataccttgcctgtgtagtcttttct

SEQ ID NO: 271530 - DNA, 25 bp, Homo sapien
agatccttttctccatccttggaag

SEQ ID NO: 271531 - DNA, 25 bp, Homo sapien
gggtgccccagaggcgccagtcttg

SEQ ID NO: 271532 - DNA, 25 bp, Homo sapien
cccagaggcgccagtcttggctggt

SEQ ID NO: 271533 - DNA, 25 bp, Homo sapien
cagaggcgccagtcttggctggtca

SEQ ID NO: 271534 - DNA, 25 bp, Homo sapien
aggcgccagtcttggctggtcagcg

SEQ ID NO: 271535 - DNA, 25 bp, Homo sapien
gcccagtaaagagaacgccacaagt

SEQ ID NO: 271536 - DNA, 25 bp, Homo sapien
cccagtaaagagaacgccacaagta

SEQ ID NO: 271537 - DNA, 25 bp, Homo sapien
ccagtaaagagaacgccacaagtaa

SEQ ID NO: 271538 - DNA, 25 bp, Homo sapien
cagtaaagagaacgccacaagtaac

SEQ ID NO: 271539 - DNA, 25 bp, Homo sapien
taaagagaacgccacaagtaactcc

SEQ ID NO: 271540 - DNA, 25 bp, Homo sapien
aaagagaacgccacaagtaactcct

SEQ ID NO: 271541 - DNA, 25 bp, Homo sapien
aagagaacgccacaagtaactcctg

SEQ ID NO: 271542 - DNA, 25 bp, Homo sapien
caagtctatatttgatgatgatatg

SEQ ID NO: 271543 - DNA, 25 bp, Homo sapien
aagtctatatttgatgatgatatgg

SEQ ID NO: 271544 - DNA, 25 bp, Homo sapien
agtctatatttgatgatgatatgga

SEQ ID NO: 271545 - DNA, 25 bp, Homo sapien
tgatgatatggatgacatcttctcc

SEQ ID NO: 271546 - DNA, 25 bp, Homo sapien
ctggtatccaggctaagacaaccaa

SEQ ID NO: 271547 - DNA, 25 bp, Homo sapien
tggtatccaggctaagacaaccaaa

SEQ ID NO: 271548 - DNA, 25 bp, Homo sapien
ggtatccaggctaagacaaccaaac

SEQ ID NO: 271549 - DNA, 25 bp, Homo sapien
gtatccaggctaagacaaccaaacc

SEQ ID NO: 271550 - DNA, 25 bp, Homo sapien
tatccaggctaagacaaccaaacca

SEQ ID NO: 271551 - DNA, 25 bp, Homo sapien
atccaggctaagacaaccaaaccaa

SEQ ID NO: 271552 - DNA, 25 bp, Homo sapien
tccaggctaagacaaccaaaccaaa

SEQ ID NO: 271553 - DNA, 25 bp, Homo sapien
ctggagacctcaccaatgggtcatt

SEQ ID NO: 271554 - DNA, 25 bp, Homo sapien
atgggtcattgtctctctagaacgt

SEQ ID NO: 271555 - DNA, 25 bp, Homo sapien
tctagaacgtgccaggctgtgtttt

SEQ ID NO: 271556 - DNA, 25 bp, Homo sapien
ttgttttgcagcttccttagtatcc

SEQ ID NO: 271557 - DNA, 25 bp, Homo sapien
cagttctttgtcttgtctgcaactc

SEQ ID NO: 271558 - DNA, 25 bp, Homo sapien
cagcttccttagtatcctttgtgag

SEQ ID NO: 271559 - DNA, 25 bp, Homo sapien
gtctgcaactcttttatgttctgaa

SEQ ID NO: 271560 - DNA, 25 bp, Homo sapien
tatgttctgaagcttttgtcttggc

SEQ ID NO: 271561 - DNA, 25 bp, Homo sapien
gaagcttttgtcttggcaattgctg

SEQ ID NO: 271562 - DNA, 25 bp, Homo sapien
ggcaattgctgtacaacattcataa

SEQ ID NO: 271563 - DNA, 25 bp, Homo sapien
aaggacactattaccctggagacct

SEQ ID NO: 271564 - DNA, 25 bp, Homo sapien
catcctctgtctggtggagttggaa

SEQ ID NO: 271565 - DNA, 25 bp, Homo sapien
ttggaaagtcgggaacatacacatg

SEQ ID NO: 271566 - DNA, 25 bp, Homo sapien
gggaacatacacatggagaccaaaa

SEQ ID NO: 271567 - DNA, 25 bp, Homo sapien
atactgcagagaacctgctcactgt

SEQ ID NO: 271568 - DNA, 25 bp, Homo sapien
ctgctcactgttcagaaagtagata

SEQ ID NO: 271569 - DNA, 25 bp, Homo sapien
tagaaatctctccttactggtcact

SEQ ID NO: 271570 - DNA, 25 bp, Homo sapien
atctctccttactggtcactcacta

SEQ ID NO: 271571 - DNA, 25 bp, Homo sapien
gggagcaaggactagacgcttcaca

SEQ ID NO: 271572 - DNA, 25 bp, Homo sapien
aaggactagacgcttcacagcctgg

SEQ ID NO: 271573 - DNA, 25 bp, Homo sapien
tagacgcttcacagcctggagcttc

SEQ ID NO: 271574 - DNA, 25 bp, Homo sapien
ttcctctttattcatcctctgtctg

SEQ ID NO: 271575 - DNA, 25 bp, Homo sapien
ctcttcgcgtgcctgaatatttata

SEQ ID NO: 271576 - DNA, 25 bp, Homo sapien
aagatacaggcgtcatcacagccgc

SEQ ID NO: 271577 - DNA, 25 bp, Homo sapien
gagcagctggcttcgttcataaata

SEQ ID NO: 271578 - DNA, 25 bp, Homo sapien
gctggcttcgttcataaatattata

SEQ ID NO: 271579 - DNA, 25 bp, Homo sapien
tattataaccactcagaattcatca

SEQ ID NO: 271580 - DNA, 25 bp, Homo sapien
cagaattcatcatcatcacagttaa

SEQ ID NO: 271581 - DNA, 25 bp, Homo sapien
gataaaattccacagtgccagaact

SEQ ID NO: 271582 - DNA, 25 bp, Homo sapien
aagagctcgtcctgctggtcgggcc

SEQ ID NO: 271583 - DNA, 25 bp, Homo sapien
gaactaaaagtcatccgggttcacg

SEQ ID NO: 271584 - DNA, 25 bp, Homo sapien
agcggactgggcagcaccatgctca

SEQ ID NO: 271585 - DNA, 25 bp, Homo sapien
atgctcaagcctagggttcgatccc

SEQ ID NO: 271586 - DNA, 25 bp, Homo sapien
gactgaattacactcatcctttgga

SEQ ID NO: 271587 - DNA, 25 bp, Homo sapien
gaattacactcatcctttggaagag

SEQ ID NO: 271588 - DNA, 25 bp, Homo sapien
gcaagcagtggcagtttttcacagc

SEQ ID NO: 271589 - DNA, 25 bp, Homo sapien
gctcatcttgctgtgttcaattatt

SEQ ID NO: 271590 - DNA, 25 bp, Homo sapien
tgctgtgttcaattattaccatcac

SEQ ID NO: 271591 - DNA, 25 bp, Homo sapien
atcttaaaatgctacccttcagcct

SEQ ID NO: 271592 - DNA, 25 bp, Homo sapien
tacccttcagccttaccctttaatg

SEQ ID NO: 271593 - DNA, 25 bp, Homo sapien
gtgacaatacgggaggtccaaactt

SEQ ID NO: 271594 - DNA, 25 bp, Homo sapien
gaggtccaaactttgtccctgttct

SEQ ID NO: 271595 - DNA, 25 bp, Homo sapien
cctgttctctgtgttccttaccttt

SEQ ID NO: 271596 - DNA, 25 bp, Homo sapien
cttacctttctgtccctgtgtatag

SEQ ID NO: 271597 - DNA, 25 bp, Homo sapien
gaggccgcacagtcactctggtgac

SEQ ID NO: 271598 - DNA, 25 bp, Homo sapien
aagatgaacccgcatgcagtccagt

SEQ ID NO: 271599 - DNA, 25 bp, Homo sapien
tgccagttcagtatctaccctgtga

SEQ ID NO: 271600 - DNA, 25 bp, Homo sapien
agttcagtatctaccctgtgacgca

SEQ ID NO: 271601 - DNA, 25 bp, Homo sapien
agtatctaccctgtgacgcaggtcg

SEQ ID NO: 271602 - DNA, 25 bp, Homo sapien
tgacgcaggtcgctcacaattactg

SEQ ID NO: 271603 - DNA, 25 bp, Homo sapien
aggtcgctcacaattactgtaccca

SEQ ID NO: 271604 - DNA, 25 bp, Homo sapien
acaattactgtacccacctgaggaa

SEQ ID NO: 271605 - DNA, 25 bp, Homo sapien
attactgtacccacctgaggaagca

SEQ ID NO: 271606 - DNA, 25 bp, Homo sapien
tgtacccacctgaggaagcagtgtg

SEQ ID NO: 271607 - DNA, 25 bp, Homo sapien
agtgtggacaggctgacacgtacca

SEQ ID NO: 271608 - DNA, 25 bp, Homo sapien
gagggtccaatctccggtgtgagcc

SEQ ID NO: 271609 - DNA, 25 bp, Homo sapien
agggtccaatctccggtgtgagccc

SEQ ID NO: 271610 - DNA, 25 bp, Homo sapien
aatctccggtgtgagcccacctcgt

SEQ ID NO: 271611 - DNA, 25 bp, Homo sapien
tccattctgctttcttgccacacag

SEQ ID NO: 271612 - DNA, 25 bp, Homo sapien
cattctgctttcttgccacacagtg

SEQ ID NO: 271613 - DNA, 25 bp, Homo sapien
attctgctttcttgccacacagtgg

SEQ ID NO: 271614 - DNA, 25 bp, Homo sapien
ttctgctttcttgccacacagtggg

SEQ ID NO: 271615 - DNA, 25 bp, Homo sapien
tgctttcttgccacacagtgggccg

SEQ ID NO: 271616 - DNA, 25 bp, Homo sapien
gctttcttgccacacagtgggccgg

SEQ ID NO: 271617 - DNA, 25 bp, Homo sapien
tttcttgccacacagtgggccggcc

SEQ ID NO: 271618 - DNA, 25 bp, Homo sapien
actgacctggaagagctgggtacca

SEQ ID NO: 271619 - DNA, 25 bp, Homo sapien
ttactgcccactatagaaattgttt

SEQ ID NO: 271620 - DNA, 25 bp, Homo sapien
tactgcccactatagaaattgtttg

SEQ ID NO: 271621 - DNA, 25 bp, Homo sapien
actgcccactatagaaattgtttga

SEQ ID NO: 271622 - DNA, 25 bp, Homo sapien
tgcccactatagaaattgtttgact

SEQ ID NO: 271623 - DNA, 25 bp, Homo sapien
gcccactatagaaattgtttgacta

SEQ ID NO: 271624 - DNA, 25 bp, Homo sapien
aattgtttgactatgtagtggacca

SEQ ID NO: 271625 - DNA, 25 bp, Homo sapien
tgtttgactatgtagtggaccatgt

SEQ ID NO: 271626 - DNA, 25 bp, Homo sapien
tttgactatgtagtggaccatgtat

SEQ ID NO: 271627 - DNA, 25 bp, Homo sapien
gactatgtagtggaccatgtatata

SEQ ID NO: 271628 - DNA, 25 bp, Homo sapien
gtagtggaccatgtatatatgataa

SEQ ID NO: 271629 - DNA, 25 bp, Homo sapien
gtggaccatgtatatatgataaatt

SEQ ID NO: 271630 - DNA, 25 bp, Homo sapien
ctctctgggccggtgcaagtcgctg

SEQ ID NO: 271631 - DNA, 25 bp, Homo sapien
ctggcttcagacagggtcgggtgga

SEQ ID NO: 271632 - DNA, 25 bp, Homo sapien
gggtttgcgccatcagatcatctta

SEQ ID NO: 271633 - DNA, 25 bp, Homo sapien
gatcatcttaggtgtcttacccatt

SEQ ID NO: 271634 - DNA, 25 bp, Homo sapien
cttaggtgtcttacccattacaaag

SEQ ID NO: 271635 - DNA, 25 bp, Homo sapien
gtgtcttacccattacaaagaagtg

SEQ ID NO: 271636 - DNA, 25 bp, Homo sapien
acctgtcgatgatagagctgcctgc

SEQ ID NO: 271637 - DNA, 25 bp, Homo sapien
gtcgatgatagagctgcctgcagcc

SEQ ID NO: 271638 - DNA, 25 bp, Homo sapien
gatagagctgcctgcagccctcaga

SEQ ID NO: 271639 - DNA, 25 bp, Homo sapien
tgcttggaccccagaattcacccgg

SEQ ID NO: 271640 - DNA, 25 bp, Homo sapien
tctgctgcaggaaggatccctcgcc

SEQ ID NO: 271641 - DNA, 25 bp, Homo sapien
tctgcctcaagaatgatttcgagtg

SEQ ID NO: 271642 - DNA, 25 bp, Homo sapien
gaatgatttcgagtgggaccagtct

SEQ ID NO: 271643 - DNA, 25 bp, Homo sapien
atttcgagtgggaccagtctccaga

SEQ ID NO: 271644 - DNA, 25 bp, Homo sapien
ttcgagtgggaccagtctccagaga

SEQ ID NO: 271645 - DNA, 25 bp, Homo sapien
cgagtgggaccagtctccagagaca

SEQ ID NO: 271646 - DNA, 25 bp, Homo sapien
gatttcgggtgggacagtctccaga

SEQ ID NO: 271647 - DNA, 25 bp, Homo sapien
tcgggtgggacagtctccagagaca

SEQ ID NO: 271648 - DNA, 25 bp, Homo sapien
ggagatcctctttcaaggaataagc

SEQ ID NO: 271649 - DNA, 25 bp, Homo sapien
cctctttcaaggaataagccaatgg

SEQ ID NO: 271650 - DNA, 25 bp, Homo sapien
tttaaaaaattagtcgctggccaga

SEQ ID NO: 271651 - DNA, 25 bp, Homo sapien
aaattagtcgctggccagacatggt

SEQ ID NO: 271652 - DNA, 25 bp, Homo sapien
aaatccttcttaggtgtccttctgg

SEQ ID NO: 271653 - DNA, 25 bp, Homo sapien
ttctgggagagggtctcctgccatt

SEQ ID NO: 271654 - DNA, 25 bp, Homo sapien
tgccattcccgtggtgttcagggat

SEQ ID NO: 271655 - DNA, 25 bp, Homo sapien
atgaaccgagagcaggaccaccagg

SEQ ID NO: 271656 - DNA, 25 bp, Homo sapien
ttcaagtccccgctttttactgcct

SEQ ID NO: 271657 - DNA, 25 bp, Homo sapien
tttactgccttgtcatcttggccaa

SEQ ID NO: 271658 - DNA, 25 bp, Homo sapien
ttggccaagccattcagtccttcta

SEQ ID NO: 271659 - DNA, 25 bp, Homo sapien
cagtccttctaagcctcagacaata

SEQ ID NO: 271660 - DNA, 25 bp, Homo sapien
aaatgaagctaagtctgccaatctt

SEQ ID NO: 271661 - DNA, 25 bp, Homo sapien
tgccaatcttcacccacagggatgt

SEQ ID NO: 271662 - DNA, 25 bp, Homo sapien
aagcaaccgtgtgatactgtgggaa

SEQ ID NO: 271663 - DNA, 25 bp, Homo sapien
acaaacacctgtgctaggtcagtct

SEQ ID NO: 271664 - DNA, 25 bp, Homo sapien
aaacacctgtgctaggtcagtctgg

SEQ ID NO: 271665 - DNA, 25 bp, Homo sapien
acacctgtgctaggtcagtctggca

SEQ ID NO: 271666 - DNA, 25 bp, Homo sapien
ctgtgctaggtcagtctggcacgta

SEQ ID NO: 271667 - DNA, 25 bp, Homo sapien
gctaggtcagtctggcacgtaagat

SEQ ID NO: 271668 - DNA, 25 bp, Homo sapien
aggtcagtctggcacgtaagatgaa

SEQ ID NO: 271669 - DNA, 25 bp, Homo sapien
gtcagtctggcacgtaagatgaaca

SEQ ID NO: 271670 - DNA, 25 bp, Homo sapien
tctggcacgtaagatgaacatccct

SEQ ID NO: 271671 - DNA, 25 bp, Homo sapien
ggcacgtaagatgaacatccctacc

SEQ ID NO: 271672 - DNA, 25 bp, Homo sapien
taagatgaacatccctaccaacaca

SEQ ID NO: 271673 - DNA, 25 bp, Homo sapien
agatgaacatccctaccaacacaga

SEQ ID NO: 271674 - DNA, 25 bp, Homo sapien
aaaaaataaagacctgcttgcagta

SEQ ID NO: 271675 - DNA, 25 bp, Homo sapien
aaaataaagacctgcttgcagtatt

SEQ ID NO: 271676 - DNA, 25 bp, Homo sapien
atattttaaatggtgctatagccaa

SEQ ID NO: 271677 - DNA, 25 bp, Homo sapien
aaatggtgctatagccaatgtattt

SEQ ID NO: 271678 - DNA, 25 bp, Homo sapien
ggtgctatagccaatgtatttgaat

SEQ ID NO: 271679 - DNA, 25 bp, Homo sapien
tgctatagccaatgtatttgaatgc

SEQ ID NO: 271680 - DNA, 25 bp, Homo sapien
atagccaatgtatttgaatgcttgc

SEQ ID NO: 271681 - DNA, 25 bp, Homo sapien
agccaatgtatttgaatgcttgcac

SEQ ID NO: 271682 - DNA, 25 bp, Homo sapien
gccaatgtatttgaatgcttgcact

SEQ ID NO: 271683 - DNA, 25 bp, Homo sapien
caatgtatttgaatgcttgcactgc

SEQ ID NO: 271684 - DNA, 25 bp, Homo sapien
atgtatttgaatgcttgcactgctg

SEQ ID NO: 271685 - DNA, 25 bp, Homo sapien
acaagggaatcggagccagcccaag

SEQ ID NO: 271686 - DNA, 25 bp, Homo sapien
ggacttctgggacgtaaccacttca

SEQ ID NO: 271687 - DNA, 25 bp, Homo sapien
gccagcccaagccaactgacaataa

SEQ ID NO: 271688 - DNA, 25 bp, Homo sapien
gccaactgacaataactttctttta

SEQ ID NO: 271689 - DNA, 25 bp, Homo sapien
aactttcttttagtgactgcattag

SEQ ID NO: 271690 - DNA, 25 bp, Homo sapien
ggacgtaaccacttcagtttccaat

SEQ ID NO: 271691 - DNA, 25 bp, Homo sapien
aaataactcacctgggtctccaatc

SEQ ID NO: 271692 - DNA, 25 bp, Homo sapien
tccaatcagacctaacagagccaga

SEQ ID NO: 271693 - DNA, 25 bp, Homo sapien
gtttccaatcactgacttccctgaa

SEQ ID NO: 271694 - DNA, 25 bp, Homo sapien
gaacctggtatcttcagatctgggt

SEQ ID NO: 271695 - DNA, 25 bp, Homo sapien
atcttcagatctgggttgaagctga

SEQ ID NO: 271696 - DNA, 25 bp, Homo sapien
tctgcctcaagaatgatttcgagtg

SEQ ID NO: 271697 - DNA, 25 bp, Homo sapien
atttcgagtgggaccagtctccaga

SEQ ID NO: 271698 - DNA, 25 bp, Homo sapien
cgagtgggaccagtctccagagaca

SEQ ID NO: 271699 - DNA, 25 bp, Homo sapien
gatttcgggtgggacagtctccaga

SEQ ID NO: 271700 - DNA, 25 bp, Homo sapien
cagcccctcgagtctctttggactt

SEQ ID NO: 271701 - DNA, 25 bp, Homo sapien
ctttggacttggagatcctctttca

SEQ ID NO: 271702 - DNA, 25 bp, Homo sapien
tcgggtgggacagtctccagagaca

SEQ ID NO: 271703 - DNA, 25 bp, Homo sapien
gatcctctttcaaggaataagccaa

SEQ ID NO: 271704 - DNA, 25 bp, Homo sapien
aatggtctcattttgtcctctggtc

SEQ ID NO: 271705 - DNA, 25 bp, Homo sapien
aaattagtcgctggccagacatggt

SEQ ID NO: 271706 - DNA, 25 bp, Homo sapien
aatggtctcattttgtcttctggtc

SEQ ID NO: 271707 - DNA, 25 bp, Homo sapien
cctgaccaagcaccacgtgccattc

SEQ ID NO: 271708 - DNA, 25 bp, Homo sapien
ctgaccaagcaccacgtgccattca

SEQ ID NO: 271709 - DNA, 25 bp, Homo sapien
tgaccaagcaccacgtgccattcat

SEQ ID NO: 271710 - DNA, 25 bp, Homo sapien
gaccaagcaccacgtgccattcatc

SEQ ID NO: 271711 - DNA, 25 bp, Homo sapien
accaagcaccacgtgccattcatca

SEQ ID NO: 271712 - DNA, 25 bp, Homo sapien
ccaagcaccacgtgccattcatcat

SEQ ID NO: 271713 - DNA, 25 bp, Homo sapien
caagcaccacgtgccattcatcatg

SEQ ID NO: 271714 - DNA, 25 bp, Homo sapien
aagcaccacgtgccattcatcatgg

SEQ ID NO: 271715 - DNA, 25 bp, Homo sapien
tcactgactgttttggttgcttctt

SEQ ID NO: 271716 - DNA, 25 bp, Homo sapien
ttgcttcttggttggaggatgttgt

SEQ ID NO: 271717 - DNA, 25 bp, Homo sapien
aggatgttgtgcctcaccgatgaga

SEQ ID NO: 271718 - DNA, 25 bp, Homo sapien
tgtgcctcaccgatgagagccggaa

SEQ ID NO: 271719 - DNA, 25 bp, Homo sapien
gccggaagcaaaggtaccagttctt

SEQ ID NO: 271720 - DNA, 25 bp, Homo sapien
agcataggaatgtgtcccttcctgc

SEQ ID NO: 271721 - DNA, 25 bp, Homo sapien
gctcgggtctctcaactgaactcaa

SEQ ID NO: 271722 - DNA, 25 bp, Homo sapien
gaactcaacccttccttgattgatt

SEQ ID NO: 271723 - DNA, 25 bp, Homo sapien
gcatgttatctctcataatccctgc

SEQ ID NO: 271724 - DNA, 25 bp, Homo sapien
atccagtgctcttttcatagattac

SEQ ID NO: 271725 - DNA, 25 bp, Homo sapien
gattacattgcttcagcatccacct

SEQ ID NO: 271726 - DNA, 25 bp, Homo sapien
cacaggaaccagagagcgatatgac

SEQ ID NO: 271727 - DNA, 25 bp, Homo sapien
agcgatatgacatctctgctgacgt

SEQ ID NO: 271728 - DNA, 25 bp, Homo sapien
atctctgctgacgtgaacacaacag

SEQ ID NO: 271729 - DNA, 25 bp, Homo sapien
attcatttctagcatccagctcaaa

SEQ ID NO: 271730 - DNA, 25 bp, Homo sapien
gtgaacacaacaggaggctctcctc

SEQ ID NO: 271731 - DNA, 25 bp, Homo sapien
aggcagtgaccttgcaagctcatca

SEQ ID NO: 271732 - DNA, 25 bp, Homo sapien
atcagcacagactggtccagcgtat

SEQ ID NO: 271733 - DNA, 25 bp, Homo sapien
gactggtccagcgtatgggagaact

SEQ ID NO: 271734 - DNA, 25 bp, Homo sapien
tagcatccagctcaaaatgcatatc

SEQ ID NO: 271735 - DNA, 25 bp, Homo sapien
aatgcatatctatctgctgaagtcc

SEQ ID NO: 271736 - DNA, 25 bp, Homo sapien
gaggatctcacagtaaaaccacagg

SEQ ID NO: 271737 - DNA, 25 bp, Homo sapien
tgtcccgccacactggctttaggac

SEQ ID NO: 271738 - DNA, 25 bp, Homo sapien
actggctttaggacctgttgacacg

SEQ ID NO: 271739 - DNA, 25 bp, Homo sapien
tggctttaggacctgttgacacgga

SEQ ID NO: 271740 - DNA, 25 bp, Homo sapien
ggctttaggacctgttgacacggag

SEQ ID NO: 271741 - DNA, 25 bp, Homo sapien
ctttaggacctgttgacacggaggg

SEQ ID NO: 271742 - DNA, 25 bp, Homo sapien
atttaatttttgcagctcaactttt

SEQ ID NO: 271743 - DNA, 25 bp, Homo sapien
ttaatttttgcagctcaacttttaa

SEQ ID NO: 271744 - DNA, 25 bp, Homo sapien
tttttgcagctcaacttttaaacaa

SEQ ID NO: 271745 - DNA, 25 bp, Homo sapien
ttgcagctcaacttttaaacaaact

SEQ ID NO: 271746 - DNA, 25 bp, Homo sapien
agctcaacttttaaacaaactgcag

SEQ ID NO: 271747 - DNA, 25 bp, Homo sapien
gctgaggcctggtcagcagtgaccc

SEQ ID NO: 271748 - DNA, 25 bp, Homo sapien
gtcgtggaagactgacctggccatg

SEQ ID NO: 271749 - DNA, 25 bp, Homo sapien
tgacctggccatggcttctcatgtc

SEQ ID NO: 271750 - DNA, 25 bp, Homo sapien
ttctcatgtcccagctcaggacctg

SEQ ID NO: 271751 - DNA, 25 bp, Homo sapien
tttcctctggccgtcacgtgtggag

SEQ ID NO: 271752 - DNA, 25 bp, Homo sapien
cgtcacgtgtggagtgaaattctca

SEQ ID NO: 271753 - DNA, 25 bp, Homo sapien
gaaattctcagaagcggctgtccct

SEQ ID NO: 271754 - DNA, 25 bp, Homo sapien
acctctctggctgtgtccagaaaat

SEQ ID NO: 271755 - DNA, 25 bp, Homo sapien
atctgtttacagcttcaattttcta

SEQ ID NO: 271756 - DNA, 25 bp, Homo sapien
aaacccagaggaaagctgttgatgc

SEQ ID NO: 271757 - DNA, 25 bp, Homo sapien
aatgtttccttcctctacatattcc

SEQ ID NO: 271758 - DNA, 25 bp, Homo sapien
acatattccatgatgcgtcctgtgg

SEQ ID NO: 271759 - DNA, 25 bp, Homo sapien
tgacaatgactaaatgagagcaatc

SEQ ID NO: 271760 - DNA, 25 bp, Homo sapien
gagcaatcatctaagttgtcccctt

SEQ ID NO: 271761 - DNA, 25 bp, Homo sapien
aatcatctaagttgtccccttacaa

SEQ ID NO: 271762 - DNA, 25 bp, Homo sapien
gttgtccccttacaactatacaaga

SEQ ID NO: 271763 - DNA, 25 bp, Homo sapien
gtccccttacaactatacaagaagt

SEQ ID NO: 271764 - DNA, 25 bp, Homo sapien
gccaaggaactcaacgttgaccact

SEQ ID NO: 271765 - DNA, 25 bp, Homo sapien
gaactcaacgttgaccactctatgg

SEQ ID NO: 271766 - DNA, 25 bp, Homo sapien
aacgttgaccactctatggtccttt

SEQ ID NO: 271767 - DNA, 25 bp, Homo sapien
cactctatggtcctttggcatttga

SEQ ID NO: 271768 - DNA, 25 bp, Homo sapien
tctatggtcctttggcatttgaagc

SEQ ID NO: 271769 - DNA, 25 bp, Homo sapien
gtcttattctatgcaacaacaacaa

SEQ ID NO: 271770 - DNA, 25 bp, Homo sapien
gtagcaagatagtaacatggtcatt

SEQ ID NO: 271771 - DNA, 25 bp, Homo sapien
ggaacattgcctaggataatatggt

SEQ ID NO: 271772 - DNA, 25 bp, Homo sapien
gtgattacaactattattacttatg

SEQ ID NO: 271773 - DNA, 25 bp, Homo sapien
acttatgattttacttacaaaggag

SEQ ID NO: 271774 - DNA, 25 bp, Homo sapien
ggagtaattagagaacatagccatg

SEQ ID NO: 271775 - DNA, 25 bp, Homo sapien
catagccatgttagggtgaggatca

SEQ ID NO: 271776 - DNA, 25 bp, Homo sapien
gggtgaggatcataagttatatcat

SEQ ID NO: 271777 - DNA, 25 bp, Homo sapien
aatatggtatagctgtggtttgtga

SEQ ID NO: 271778 - DNA, 25 bp, Homo sapien
agctgtggtttgtgatttatggtat

SEQ ID NO: 271779 - DNA, 25 bp, Homo sapien
ggtatatccatatgatcaggtacaa

SEQ ID NO: 271780 - DNA, 25 bp, Homo sapien
aggtacaatgtacaattttcaaatg

SEQ ID NO: 271781 - DNA, 25 bp, Homo sapien
catctataccccattgcttggtggg

SEQ ID NO: 271782 - DNA, 25 bp, Homo sapien
gggtgatcactctgattctctgcat

SEQ ID NO: 271783 - DNA, 25 bp, Homo sapien
atcactctgattctctgcatgcatt

SEQ ID NO: 271784 - DNA, 25 bp, Homo sapien
ctgattctctgcatgcatttttata

SEQ ID NO: 271785 - DNA, 25 bp, Homo sapien
atttgtttgccatttatcctattaa

SEQ ID NO: 271786 - DNA, 25 bp, Homo sapien
gccatttatcctattaatctgcatt

SEQ ID NO: 271787 - DNA, 25 bp, Homo sapien
attctgtcaattgtggcaagttatc

SEQ ID NO: 271788 - DNA, 25 bp, Homo sapien
gtggcaagttatcagcatatttttt

SEQ ID NO: 271789 - DNA, 25 bp, Homo sapien
gaaagacacttctgtatacactgga

SEQ ID NO: 271790 - DNA, 25 bp, Homo sapien
atacactggaaatctcaggaaattt

SEQ ID NO: 271791 - DNA, 25 bp, Homo sapien
ctctcccctaaggacaagggtatat

SEQ ID NO: 271792 - DNA, 25 bp, Homo sapien
taccaaaaaggtggtcagagatccg

SEQ ID NO: 271793 - DNA, 25 bp, Homo sapien
tgggcctgattccaaagaagggtca

SEQ ID NO: 271794 - DNA, 25 bp, Homo sapien
gattccaaagaagggtcaaggccaa

SEQ ID NO: 271795 - DNA, 25 bp, Homo sapien
aaggccaaggcctcgagcttacgtg

SEQ ID NO: 271796 - DNA, 25 bp, Homo sapien
aaggcctcgagcttacgtgtggcca

SEQ ID NO: 271797 - DNA, 25 bp, Homo sapien
tcgagcttacgtgtggccaccaggg

SEQ ID NO: 271798 - DNA, 25 bp, Homo sapien
ggtcagaagtccagctcgggcatca

SEQ ID NO: 271799 - DNA, 25 bp, Homo sapien
cagaagtccagctcgggcatcaggg

SEQ ID NO: 271800 - DNA, 25 bp, Homo sapien
ccagctcgggcatcagggtgtgctt

SEQ ID NO: 271801 - DNA, 25 bp, Homo sapien
atcagggtgtgcttgaccgggcagc

SEQ ID NO: 271802 - DNA, 25 bp, Homo sapien
gggagagtccaataccaaaaaggtg

SEQ ID NO: 271803 - DNA, 25 bp, Homo sapien
agacttctctctaaatgtggagata

SEQ ID NO: 271804 - DNA, 25 bp, Homo sapien
atatttatagcctgtggtagtgcac

SEQ ID NO: 271805 - DNA, 25 bp, Homo sapien
gtggtagtgcacatggttaacataa

SEQ ID NO: 271806 - DNA, 25 bp, Homo sapien
atacatgtaacaattctgatctttt

SEQ ID NO: 271807 - DNA, 25 bp, Homo sapien
gatctttttaaggttcactggtgta

SEQ ID NO: 271808 - DNA, 25 bp, Homo sapien
gtcacaaattacaaatcaatgctgt

SEQ ID NO: 271809 - DNA, 25 bp, Homo sapien
gctgtaatataatttgcacctggaa

SEQ ID NO: 271810 - DNA, 25 bp, Homo sapien
ttgcacctggaatggctaacgtgaa

SEQ ID NO: 271811 - DNA, 25 bp, Homo sapien
atggctaacgtgaagcctgaattaa

SEQ ID NO: 271812 - DNA, 25 bp, Homo sapien
ttagtttttaccatcaccaatttct

SEQ ID NO: 271813 - DNA, 25 bp, Homo sapien
caccaatttctatgactgttgcaaa

SEQ ID NO: 271814 - DNA, 25 bp, Homo sapien
tgacaataccaagtgactacagaag

SEQ ID NO: 271815 - DNA, 25 bp, Homo sapien
taccaagtgactacagaagggatat

SEQ ID NO: 271816 - DNA, 25 bp, Homo sapien
aggcaattcacaaaagggcaaatat

SEQ ID NO: 271817 - DNA, 25 bp, Homo sapien
tcttataatgcatactatacagcag

SEQ ID NO: 271818 - DNA, 25 bp, Homo sapien
gaatgaatgtgcattaggtgccaac

SEQ ID NO: 271819 - DNA, 25 bp, Homo sapien
gcattaggtgccaacatctatgact

SEQ ID NO: 271820 - DNA, 25 bp, Homo sapien
tatgactccaaatcacaatgaggga

SEQ ID NO: 271821 - DNA, 25 bp, Homo sapien
gaaaaaagttacattgtaggccagg

SEQ ID NO: 271822 - DNA, 25 bp, Homo sapien
aaaatgtgcaactgactaataaact

SEQ ID NO: 271823 - DNA, 25 bp, Homo sapien
taaagagatactatctcacagctgc

SEQ ID NO: 271824 - DNA, 25 bp, Homo sapien
gctgctggattagcaaaagtttaaa

SEQ ID NO: 271825 - DNA, 25 bp, Homo sapien
agatcgccgccgttgttgggctgtg

SEQ ID NO: 271826 - DNA, 25 bp, Homo sapien
gttgggctgtggagacgtctcaacc

SEQ ID NO: 271827 - DNA, 25 bp, Homo sapien
gggctgtggagacgtctcaaccaaa

SEQ ID NO: 271828 - DNA, 25 bp, Homo sapien
tggagacgtctcaaccaaagtggag

SEQ ID NO: 271829 - DNA, 25 bp, Homo sapien
caaagtggagccgacagaggccccg

SEQ ID NO: 271830 - DNA, 25 bp, Homo sapien
gacagagcggccacaaccactaggg

SEQ ID NO: 271831 - DNA, 25 bp, Homo sapien
gggcgggaagcgcacgcgcaaacgc

SEQ ID NO: 271832 - DNA, 25 bp, Homo sapien
ttcgcggccgctgtaaacaccaaag

SEQ ID NO: 271833 - DNA, 25 bp, Homo sapien
gcggccgctgtaaacaccaaagagc

SEQ ID NO: 271834 - DNA, 25 bp, Homo sapien
caaagagcgcctgcgcaagccgaga

SEQ ID NO: 271835 - DNA, 25 bp, Homo sapien
gagcgcctgcgcaagccgagagtct

SEQ ID NO: 271836 - DNA, 25 bp, Homo sapien
aacaattgaaagtccgaatctgcaa

SEQ ID NO: 271837 - DNA, 25 bp, Homo sapien
gaaagtccgaatctgcaagttcatc

SEQ ID NO: 271838 - DNA, 25 bp, Homo sapien
aagtccgaatctgcaagttcatctc

SEQ ID NO: 271839 - DNA, 25 bp, Homo sapien
gtccgaatctgcaagttcatctctg

SEQ ID NO: 271840 - DNA, 25 bp, Homo sapien
ccgaatctgcaagttcatctctgag

SEQ ID NO: 271841 - DNA, 25 bp, Homo sapien
gaatctgcaagttcatctctgagaa

SEQ ID NO: 271842 - DNA, 25 bp, Homo sapien
atctgcaagttcatctctgagaacc

SEQ ID NO: 271843 - DNA, 25 bp, Homo sapien
catctctgagaaccgaattttacag

SEQ ID NO: 271844 - DNA, 25 bp, Homo sapien
ctgagaaccgaattttacagccact

SEQ ID NO: 271845 - DNA, 25 bp, Homo sapien
actgcgcccggtaacaactaatgtt

SEQ ID NO: 271846 - DNA, 25 bp, Homo sapien
gcgcccggtaacaactaatgttgga

SEQ ID NO: 271847 - DNA, 25 bp, Homo sapien
gctgaagctgactggctgagtcttc

SEQ ID NO: 271848 - DNA, 25 bp, Homo sapien
ctgaagctgactggctgagtcttct

SEQ ID NO: 271849 - DNA, 25 bp, Homo sapien
gaagctgactggctgagtcttctgg

SEQ ID NO: 271850 - DNA, 25 bp, Homo sapien
ggactcttggacctacactggtgtt

SEQ ID NO: 271851 - DNA, 25 bp, Homo sapien
actcttggacctacactggtgtttt

SEQ ID NO: 271852 - DNA, 25 bp, Homo sapien
cttggacctacactggtgttttgcc

SEQ ID NO: 271853 - DNA, 25 bp, Homo sapien
tcggcttccctcctttagaggtttg

SEQ ID NO: 271854 - DNA, 25 bp, Homo sapien
gggactcagactgagctactactgg

SEQ ID NO: 271855 - DNA, 25 bp, Homo sapien
ctgagctactactggcttccttgcc

SEQ ID NO: 271856 - DNA, 25 bp, Homo sapien
gcccctcagtttgcagacagcctat

SEQ ID NO: 271857 - DNA, 25 bp, Homo sapien
gggacttcaccctgtgatcctgtgc

SEQ ID NO: 271858 - DNA, 25 bp, Homo sapien
agggagcaagcactgactcctcagg

SEQ ID NO: 271859 - DNA, 25 bp, Homo sapien
aggagacctgccaactaggaccctg

SEQ ID NO: 271860 - DNA, 25 bp, Homo sapien
gacctgccaactaggaccctgggag

SEQ ID NO: 271861 - DNA, 25 bp, Homo sapien
ctccatatttacgtgcttgtaactc

SEQ ID NO: 271862 - DNA, 25 bp, Homo sapien
tgggtcatctcaggctcatcagcaa

SEQ ID NO: 271863 - DNA, 25 bp, Homo sapien
catctcaggctcatcagcaaatcct

SEQ ID NO: 271864 - DNA, 25 bp, Homo sapien
aagaagcccaggagagttcctggct

SEQ ID NO: 271865 - DNA, 25 bp, Homo sapien
tttacgtgcttgtaactctggcatg

SEQ ID NO: 271866 - DNA, 25 bp, Homo sapien
tggctcagaacccctctctgaggct

SEQ ID NO: 271867 - DNA, 25 bp, Homo sapien
gcttgtaactctggcatgacctttg

SEQ ID NO: 271868 - DNA, 25 bp, Homo sapien
gacctttgctccagtctctaccaga

SEQ ID NO: 271869 - DNA, 25 bp, Homo sapien
caaactggcagatgcttctctggga

SEQ ID NO: 271870 - DNA, 25 bp, Homo sapien
gcttctctgggagcaaggccacatg

SEQ ID NO: 271871 - DNA, 25 bp, Homo sapien
ggccacatgggctgatgcagctttg

SEQ ID NO: 271872 - DNA, 25 bp, Homo sapien
atgcagctttgagtgctcaggttct

SEQ ID NO: 271873 - DNA, 25 bp, Homo sapien
gagtgctcaggttctgttttctgga

SEQ ID NO: 271874 - DNA, 25 bp, Homo sapien
agggctgtcagggtgcttctatgaa

SEQ ID NO: 271875 - DNA, 25 bp, Homo sapien
gggtgcttctatgaatatgggcttc

SEQ ID NO: 271876 - DNA, 25 bp, Homo sapien
tatgggcttcagctgtagcacttgg

SEQ ID NO: 271877 - DNA, 25 bp, Homo sapien
acttggcagaaacgtgatgtgtccc

SEQ ID NO: 271878 - DNA, 25 bp, Homo sapien
tgatgtgtcccacaaactgctggtg

SEQ ID NO: 271879 - DNA, 25 bp, Homo sapien
agatgttcgtcagccaattcaacct

SEQ ID NO: 271880 - DNA, 25 bp, Homo sapien
gactccctgaacactttccgaagct

SEQ ID NO: 271881 - DNA, 25 bp, Homo sapien
gaagcttcggctccagctacagtcg

SEQ ID NO: 271882 - DNA, 25 bp, Homo sapien
agctacagtcgtgtcaactacctga

SEQ ID NO: 271883 - DNA, 25 bp, Homo sapien
cccctggcattaatctctggaaagg

SEQ ID NO: 271884 - DNA, 25 bp, Homo sapien
aatctctggaaaggaggctgactcc

SEQ ID NO: 271885 - DNA, 25 bp, Homo sapien
cctggccagaccgaggacttatggt

SEQ ID NO: 271886 - DNA, 25 bp, Homo sapien
aggacttatggtggcaccagccatc

SEQ ID NO: 271887 - DNA, 25 bp, Homo sapien
tccccaggagttcagcctaactaga

SEQ ID NO: 271888 - DNA, 25 bp, Homo sapien
tggcggtactgcctcaaccagaacc

SEQ ID NO: 271889 - DNA, 25 bp, Homo sapien
agcctggaccgctacggacagaagc

SEQ ID NO: 271890 - DNA, 25 bp, Homo sapien
ggacagaagcccctgcctttcgact

SEQ ID NO: 271891 - DNA, 25 bp, Homo sapien
agaaagtgcagttttccacccacag

SEQ ID NO: 271892 - DNA, 25 bp, Homo sapien
gggtgcttccaatagcatccttgag

SEQ ID NO: 271893 - DNA, 25 bp, Homo sapien
cttgagacagactccgctctagtac

SEQ ID NO: 271894 - DNA, 25 bp, Homo sapien
gctctagtacctccagcgaggagtt

SEQ ID NO: 271895 - DNA, 25 bp, Homo sapien
gaggagttcactactgcaacaagca

SEQ ID NO: 271896 - DNA, 25 bp, Homo sapien
aagcagcccattcttggatttttat

SEQ ID NO: 271897 - DNA, 25 bp, Homo sapien
tacatcaagttctcactcctttata

SEQ ID NO: 271898 - DNA, 25 bp, Homo sapien
gatgacatgcacgttcagaactgct

SEQ ID NO: 271899 - DNA, 25 bp, Homo sapien
gaactgctgaatatttcccctttta

SEQ ID NO: 271900 - DNA, 25 bp, Homo sapien
ttcactgctcaatcacctttataca

SEQ ID NO: 271901 - DNA, 25 bp, Homo sapien
cctttatacagtttctttacggcag

SEQ ID NO: 271902 - DNA, 25 bp, Homo sapien
catggccccagtctttctcaggcta

SEQ ID NO: 271903 - DNA, 25 bp, Homo sapien
cctctcaagctcttgaaggttataa

SEQ ID NO: 271904 - DNA, 25 bp, Homo sapien
gattgatagtccatgattcaggtct

SEQ ID NO: 271905 - DNA, 25 bp, Homo sapien
gtccatgattcaggtcttgagataa

SEQ ID NO: 271906 - DNA, 25 bp, Homo sapien
gagataaaaggcacgaacgtccctc

SEQ ID NO: 271907 - DNA, 25 bp, Homo sapien
ggaaaccatgttgtgagagacccat

SEQ ID NO: 271908 - DNA, 25 bp, Homo sapien
gtgagtgaagcagagcctcaagctc

SEQ ID NO: 271909 - DNA, 25 bp, Homo sapien
gagcctcaagctccagatggatctt

SEQ ID NO: 271910 - DNA, 25 bp, Homo sapien
tttccagaaaaatgcacgtgaacat

SEQ ID NO: 271911 - DNA, 25 bp, Homo sapien
gtttccaagatacgatgggccctgt

SEQ ID NO: 271912 - DNA, 25 bp, Homo sapien
gtgaaaccactgaggattccatggc

SEQ ID NO: 271913 - DNA, 25 bp, Homo sapien
cccagacaggaggtatgcgaggaaa

SEQ ID NO: 271914 - DNA, 25 bp, Homo sapien
gagatggaagtttcgcccaggacta

SEQ ID NO: 271915 - DNA, 25 bp, Homo sapien
ggaagtttcgcccaggactagactt

SEQ ID NO: 271916 - DNA, 25 bp, Homo sapien
tttcgcccaggactagacttgtgct

SEQ ID NO: 271917 - DNA, 25 bp, Homo sapien
actagacttgtgctgggaatcgccc

SEQ ID NO: 271918 - DNA, 25 bp, Homo sapien
ttgtgctgggaatcgccctctcttg

SEQ ID NO: 271919 - DNA, 25 bp, Homo sapien
gccctctcttgcctatgtatacaga

SEQ ID NO: 271920 - DNA, 25 bp, Homo sapien
aaggcagtatgtttaaaggagattt

SEQ ID NO: 271921 - DNA, 25 bp, Homo sapien
aaatgaccctttgctatatctcctc

SEQ ID NO: 271922 - DNA, 25 bp, Homo sapien
ctttgctatatctcctcatcaaaaa

SEQ ID NO: 271923 - DNA, 25 bp, Homo sapien
agaatctacatttcctgtgggggcc

SEQ ID NO: 271924 - DNA, 25 bp, Homo sapien
aaatttcggtagtctctgtttgcat

SEQ ID NO: 271925 - DNA, 25 bp, Homo sapien
gtagtctctgtttgcatggcagaaa

SEQ ID NO: 271926 - DNA, 25 bp, Homo sapien
gaaattctgcacatgttttatctga

SEQ ID NO: 271927 - DNA, 25 bp, Homo sapien
gagaggtgaatcttctttgacagac

SEQ ID NO: 271928 - DNA, 25 bp, Homo sapien
tttgacagactttgtattttccact

SEQ ID NO: 271929 - DNA, 25 bp, Homo sapien
gtattttccacttctaactgggcct

SEQ ID NO: 271930 - DNA, 25 bp, Homo sapien
taactgggcctctcttttctcagga

SEQ ID NO: 271931 - DNA, 25 bp, Homo sapien
ctctcttttctcaggatctatccta

SEQ ID NO: 271932 - DNA, 25 bp, Homo sapien
ggatctatcctagccaaatatctca

SEQ ID NO: 271933 - DNA, 25 bp, Homo sapien
tatctcagttacatttaccatacag

SEQ ID NO: 271934 - DNA, 25 bp, Homo sapien
taccatacagtttcctttgtgaaag

SEQ ID NO: 271935 - DNA, 25 bp, Homo sapien
cttggttcaacagcgcatgcttttc

SEQ ID NO: 271936 - DNA, 25 bp, Homo sapien
atgcttttcctccaccagatttagg

SEQ ID NO: 271937 - DNA, 25 bp, Homo sapien
ccaccagatttaggacacaacatta

SEQ ID NO: 271938 - DNA, 25 bp, Homo sapien
tttagaatggccagagaggtcactc

SEQ ID NO: 271939 - DNA, 25 bp, Homo sapien
gaggtcactctttgctgaattccaa

SEQ ID NO: 271940 - DNA, 25 bp, Homo sapien
ctctttgctgaattccaatatctga

SEQ ID NO: 271941 - DNA, 25 bp, Homo sapien
aattgcttgagcagattgtaagcac

SEQ ID NO: 271942 - DNA, 25 bp, Homo sapien
gtaagcacttgtccttattcttaaa

SEQ ID NO: 271943 - DNA, 25 bp, Homo sapien
agtgcctgacaaataatctcctggg

SEQ ID NO: 271944 - DNA, 25 bp, Homo sapien
acaaatatgtgtccagtgagcagct

SEQ ID NO: 271945 - DNA, 25 bp, Homo sapien
tgtgtccagtgagcagcttggttca

SEQ ID NO: 271946 - DNA, 25 bp, Homo sapien
acaaggaatgtgttagcttaaactg

SEQ ID NO: 271947 - DNA, 25 bp, Homo sapien
agcttaaactggatcattttacttt

SEQ ID NO: 271948 - DNA, 25 bp, Homo sapien
ttactttttggcatcatgcatctgt

SEQ ID NO: 271949 - DNA, 25 bp, Homo sapien
ggcatcatgcatctgtactgtacca

SEQ ID NO: 271950 - DNA, 25 bp, Homo sapien
atctgtactgtaccaaaagtgttta

SEQ ID NO: 271951 - DNA, 25 bp, Homo sapien
ttctttctcacttttagcattttat

SEQ ID NO: 271952 - DNA, 25 bp, Homo sapien
gaacatgggcttgttatttcactga

SEQ ID NO: 271953 - DNA, 25 bp, Homo sapien
gttatttcactgaagtgcctgtcat

SEQ ID NO: 271954 - DNA, 25 bp, Homo sapien
tgaagtgcctgtcatttgtttgttt

SEQ ID NO: 271955 - DNA, 25 bp, Homo sapien
atgtgggtaacctgtagtattctgc

SEQ ID NO: 271956 - DNA, 25 bp, Homo sapien
gggtaacctgtagtattctgctata

SEQ ID NO: 271957 - DNA, 25 bp, Homo sapien
cagctacattgttgagttagtgatg

SEQ ID NO: 271958 - DNA, 25 bp, Homo sapien
atggtcttaactggattacaaaaag

SEQ ID NO: 271959 - DNA, 25 bp, Homo sapien
ggtcttaactggattacaaaaagca

SEQ ID NO: 271960 - DNA, 25 bp, Homo sapien
gtcttaactggattacaaaaagcaa

SEQ ID NO: 271961 - DNA, 25 bp, Homo sapien
ctggattacaaaaagcaaatactag

SEQ ID NO: 271962 - DNA, 25 bp, Homo sapien
cactggtttaatcatgcttaatact

SEQ ID NO: 271963 - DNA, 25 bp, Homo sapien
ctggtttaatcatgcttaatactac

SEQ ID NO: 271964 - DNA, 25 bp, Homo sapien
ggtttaatcatgcttaatactacaa

SEQ ID NO: 271965 - DNA, 25 bp, Homo sapien
gtttaatcatgcttaatactacaaa

SEQ ID NO: 271966 - DNA, 25 bp, Homo sapien
taatcatgcttaatactacaaaaca

SEQ ID NO: 271967 - DNA, 25 bp, Homo sapien
atcatgcttaatactacaaaacaaa

SEQ ID NO: 271968 - DNA, 25 bp, Homo sapien
atccctctcgatctggcatcttgga

SEQ ID NO: 271969 - DNA, 25 bp, Homo sapien
aaaggcaagctcaccacaatgtaag

SEQ ID NO: 271970 - DNA, 25 bp, Homo sapien
gtaagcctatggtctggccaacctt

SEQ ID NO: 271971 - DNA, 25 bp, Homo sapien
ggccaaccttgcttttgggaactgt

SEQ ID NO: 271972 - DNA, 25 bp, Homo sapien
ggagccagatagaatgacatgcctt

SEQ ID NO: 271973 - DNA, 25 bp, Homo sapien
catgcctttttcctaattgtccaca

SEQ ID NO: 271974 - DNA, 25 bp, Homo sapien
tgggccaagccatccatcttgcaat

SEQ ID NO: 271975 - DNA, 25 bp, Homo sapien
tgcaatcttcatctaaaacagctct

SEQ ID NO: 271976 - DNA, 25 bp, Homo sapien
aaacagctctcatttcatgccagtt

SEQ ID NO: 271977 - DNA, 25 bp, Homo sapien
atgccagttttgctcaaacctgcac

SEQ ID NO: 271978 - DNA, 25 bp, Homo sapien
aaacctgcaccgtcacaagatattc

SEQ ID NO: 271979 - DNA, 25 bp, Homo sapien
gggtgagaacccatatgctctgaat

SEQ ID NO: 271980 - DNA, 25 bp, Homo sapien
ggaggtgaaagtgcgtcccattcca

SEQ ID NO: 271981 - DNA, 25 bp, Homo sapien
gcgtcccattccaaagggtctgtaa

SEQ ID NO: 271982 - DNA, 25 bp, Homo sapien
gccccacccagggaaggatgtgtgc

SEQ ID NO: 271983 - DNA, 25 bp, Homo sapien
ggtctgtaaggtgatgattcatcca

SEQ ID NO: 271984 - DNA, 25 bp, Homo sapien
atgagcatcatctgtatgccagaca

SEQ ID NO: 271985 - DNA, 25 bp, Homo sapien
gccaggtgctgggactacaaataag

SEQ ID NO: 271986 - DNA, 25 bp, Homo sapien
agactagtttcttgacccactcaga

SEQ ID NO: 271987 - DNA, 25 bp, Homo sapien
aaggatgtgtgcttctcagacgaca

SEQ ID NO: 271988 - DNA, 25 bp, Homo sapien
ttctcagacgacagcagggcacttt

SEQ ID NO: 271989 - DNA, 25 bp, Homo sapien
ttgctggaatgctcccctgggtgga

SEQ ID NO: 271990 - DNA, 25 bp, Homo sapien
atcttagcttatgctcagctgtgaa

SEQ ID NO: 271991 - DNA, 25 bp, Homo sapien
agtaaatgtccaggcaggcactctc

SEQ ID NO: 271992 - DNA, 25 bp, Homo sapien
aggcaggcactctctgcaacataga

SEQ ID NO: 271993 - DNA, 25 bp, Homo sapien
ggcactctctgcaacatagaattaa

SEQ ID NO: 271994 - DNA, 25 bp, Homo sapien
gacagagagcagaaatacaggttta

SEQ ID NO: 271995 - DNA, 25 bp, Homo sapien
tagtgttttgactcagaaccatccg

SEQ ID NO: 271996 - DNA, 25 bp, Homo sapien
gttttgactcagaaccatccgttaa

SEQ ID NO: 271997 - DNA, 25 bp, Homo sapien
gactcagaaccatccgttaatacga

SEQ ID NO: 271998 - DNA, 25 bp, Homo sapien
tccgttaatacgatttgagagacag

SEQ ID NO: 271999 - DNA, 25 bp, Homo sapien
agtagagtgctcgtgtgtgtgtgca

SEQ ID NO: 272000 - DNA, 25 bp, Homo sapien
tggtgcttctataatcttagcttat

SEQ ID NO: 272001 - DNA, 25 bp, Homo sapien
gggcctagtattcaaggactgattt

SEQ ID NO: 272002 - DNA, 25 bp, Homo sapien
tgaggtttattttctaggttgcctt

SEQ ID NO: 272003 - DNA, 25 bp, Homo sapien
ctaggttgccttaatatttgaacat

SEQ ID NO: 272004 - DNA, 25 bp, Homo sapien
tagctattctgttgactatccatca

SEQ ID NO: 272005 - DNA, 25 bp, Homo sapien
attctgttgactatccatcaggata

SEQ ID NO: 272006 - DNA, 25 bp, Homo sapien
ggataataattagttgctgcagtac

SEQ ID NO: 272007 - DNA, 25 bp, Homo sapien
tagttgctgcagtactcataatgag

SEQ ID NO: 272008 - DNA, 25 bp, Homo sapien
gtactcataatgagccctttcaagg

SEQ ID NO: 272009 - DNA, 25 bp, Homo sapien
aatgagccctttcaaggaatagatg

SEQ ID NO: 272010 - DNA, 25 bp, Homo sapien
gaatagatgtaaattacccttaggg

SEQ ID NO: 272011 - DNA, 25 bp, Homo sapien
gggtagccactatattttttatact

SEQ ID NO: 272012 - DNA, 25 bp, Homo sapien
gacaggtgacctaaaagaagacaaa

SEQ ID NO: 272013 - DNA, 25 bp, Homo sapien
agacaaaattgctgggagatccccg

SEQ ID NO: 272014 - DNA, 25 bp, Homo sapien
aattgctgggagatccccggagatc

SEQ ID NO: 272015 - DNA, 25 bp, Homo sapien
ggagatcccaggcaccactgatggt

SEQ ID NO: 272016 - DNA, 25 bp, Homo sapien
accactgatggtgccttcaaaagct

SEQ ID NO: 272017 - DNA, 25 bp, Homo sapien
tggtgccttcaaaagcttggctcag

SEQ ID NO: 272018 - DNA, 25 bp, Homo sapien
aaagcttggctcagagatctcttgg

SEQ ID NO: 272019 - DNA, 25 bp, Homo sapien
gtcaggggcctagcttaaattccag

SEQ ID NO: 272020 - DNA, 25 bp, Homo sapien
taaattccagttcagccacttgcta

SEQ ID NO: 272021 - DNA, 25 bp, Homo sapien
agccacagaatgttcctgggtctct

SEQ ID NO: 272022 - DNA, 25 bp, Homo sapien
acagaatgttcctgggtctctttct

SEQ ID NO: 272023 - DNA, 25 bp, Homo sapien
gctgaagctgactggctgagtcttc

SEQ ID NO: 272024 - DNA, 25 bp, Homo sapien
ctgaagctgactggctgagtcttct

SEQ ID NO: 272025 - DNA, 25 bp, Homo sapien
tgaagctgactggctgagtcttctg

SEQ ID NO: 272026 - DNA, 25 bp, Homo sapien
gaagctgactggctgagtcttctgg

SEQ ID NO: 272027 - DNA, 25 bp, Homo sapien
ggactcttggacctacactggtgtt

SEQ ID NO: 272028 - DNA, 25 bp, Homo sapien
gactcttggacctacactggtgttt

SEQ ID NO: 272029 - DNA, 25 bp, Homo sapien
actcttggacctacactggtgtttt

SEQ ID NO: 272030 - DNA, 25 bp, Homo sapien
ctcttggacctacactggtgttttg

SEQ ID NO: 272031 - DNA, 25 bp, Homo sapien
tcttggacctacactggtgttttgc

SEQ ID NO: 272032 - DNA, 25 bp, Homo sapien
cttggacctacactggtgttttgcc

SEQ ID NO: 272033 - DNA, 25 bp, Homo sapien
gcccctcagtttgcagacagcctat

SEQ ID NO: 272034 - DNA, 25 bp, Homo sapien
ggtaacgtagaaatcatctctgcgg

SEQ ID NO: 272035 - DNA, 25 bp, Homo sapien
agaaatcatctctgcgggcgtgaaa

SEQ ID NO: 272036 - DNA, 25 bp, Homo sapien
gctgtgcccgatgctttcggatgtt

SEQ ID NO: 272037 - DNA, 25 bp, Homo sapien
atgctttcggatgttgcttttagga

SEQ ID NO: 272038 - DNA, 25 bp, Homo sapien
gaaaagtccaggtctcctgtgcttc

SEQ ID NO: 272039 - DNA, 25 bp, Homo sapien
tgtgcttcccgaacgcacgcggcag

SEQ ID NO: 272040 - DNA, 25 bp, Homo sapien
ccgagttcacctttgcgtgggctgt

SEQ ID NO: 272041 - DNA, 25 bp, Homo sapien
tcacctttgcgtgggctgtggctta

SEQ ID NO: 272042 - DNA, 25 bp, Homo sapien
gctgtggcttactttttggtttgtt

SEQ ID NO: 272043 - DNA, 25 bp, Homo sapien
tatttccggaggtaaggtgattatc

SEQ ID NO: 272044 - DNA, 25 bp, Homo sapien
gaggtaaggtgattatccgttcccg

SEQ ID NO: 272045 - DNA, 25 bp, Homo sapien
tagtgacaaagtgcacgttactgtg

SEQ ID NO: 272046 - DNA, 25 bp, Homo sapien
gttactgtgatcaatttcagctgtc

SEQ ID NO: 272047 - DNA, 25 bp, Homo sapien
gctgtctactagtgactgtattgtg

SEQ ID NO: 272048 - DNA, 25 bp, Homo sapien
gtattgtgatatgcatcttgtttca

SEQ ID NO: 272049 - DNA, 25 bp, Homo sapien
aaaaagcctgctttgcctctcttga

SEQ ID NO: 272050 - DNA, 25 bp, Homo sapien
ttgcctctcttgactagtttgtgtt

SEQ ID NO: 272051 - DNA, 25 bp, Homo sapien
agtttgtgttttagatgtcatcata

SEQ ID NO: 272052 - DNA, 25 bp, Homo sapien
gatctagcatgattccttatctgag

SEQ ID NO: 272053 - DNA, 25 bp, Homo sapien
tgcacattttgtaccgcatgctttg

SEQ ID NO: 272054 - DNA, 25 bp, Homo sapien
cgcatgctttgggatcgacttttat

SEQ ID NO: 272055 - DNA, 25 bp, Homo sapien
cgacttttatcccacttgtatctag

SEQ ID NO: 272056 - DNA, 25 bp, Homo sapien
gggtatgagttgtgccctctatata

SEQ ID NO: 272057 - DNA, 25 bp, Homo sapien
tgagttgtgccctctatatagctgt

SEQ ID NO: 272058 - DNA, 25 bp, Homo sapien
gttgtgccctctatatagctgtgtg

SEQ ID NO: 272059 - DNA, 25 bp, Homo sapien
catgtttgtgtaaagacgacttaac

SEQ ID NO: 272060 - DNA, 25 bp, Homo sapien
gtaaagacgacttaacttcccatag

SEQ ID NO: 272061 - DNA, 25 bp, Homo sapien
agacgacttaacttcccatagaatt

SEQ ID NO: 272062 - DNA, 25 bp, Homo sapien
ttaacttcccatagaattcttgagg

SEQ ID NO: 272063 - DNA, 25 bp, Homo sapien
gggataatgaatcttgccagttcta

SEQ ID NO: 272064 - DNA, 25 bp, Homo sapien
gtaaattgctacacaaatgctctgt

SEQ ID NO: 272065 - DNA, 25 bp, Homo sapien
cacaaatgctctgtgttgacattca

SEQ ID NO: 272066 - DNA, 25 bp, Homo sapien
tgctctgtgttgacattcatgctaa

SEQ ID NO: 272067 - DNA, 25 bp, Homo sapien
gggtgccccagaggcgccagtcttg

SEQ ID NO: 272068 - DNA, 25 bp, Homo sapien
cccagaggcgccagtcttggctggt

SEQ ID NO: 272069 - DNA, 25 bp, Homo sapien
cagaggcgccagtcttggctggtca

SEQ ID NO: 272070 - DNA, 25 bp, Homo sapien
aggcgccagtcttggctggtcagcg

SEQ ID NO: 272071 - DNA, 25 bp, Homo sapien
tgttccagggcaggatcctggaccg

SEQ ID NO: 272072 - DNA, 25 bp, Homo sapien
gcccagtaaagagaacgccacaagt

SEQ ID NO: 272073 - DNA, 25 bp, Homo sapien
cccagtaaagagaacgccacaagta

SEQ ID NO: 272074 - DNA, 25 bp, Homo sapien
ccagtaaagagaacgccacaagtaa

SEQ ID NO: 272075 - DNA, 25 bp, Homo sapien
cagtaaagagaacgccacaagtaac

SEQ ID NO: 272076 - DNA, 25 bp, Homo sapien
aaagagaacgccacaagtaactcct

SEQ ID NO: 272077 - DNA, 25 bp, Homo sapien
aagagaacgccacaagtaactcctg

SEQ ID NO: 272078 - DNA, 25 bp, Homo sapien
agcattcccacctgtaataattttg

SEQ ID NO: 272079 - DNA, 25 bp, Homo sapien
cattcccacctgtaataattttgtt

SEQ ID NO: 272080 - DNA, 25 bp, Homo sapien
aattttgttaacactagactatcag

SEQ ID NO: 272081 - DNA, 25 bp, Homo sapien
gttaacactagactatcagtaaatt

SEQ ID NO: 272082 - DNA, 25 bp, Homo sapien
tagactatcagtaaattatcaagaa

SEQ ID NO: 272083 - DNA, 25 bp, Homo sapien
gtatttacacaagaacaagtgaaat

SEQ ID NO: 272084 - DNA, 25 bp, Homo sapien
ggagaaatttctcatctggtgataa

SEQ ID NO: 272085 - DNA, 25 bp, Homo sapien
gaaatttctcatctggtgataaagg

SEQ ID NO: 272086 - DNA, 25 bp, Homo sapien
atttctcatctggtgataaagggaa

SEQ ID NO: 272087 - DNA, 25 bp, Homo sapien
tctcatctggtgataaagggaaaaa

SEQ ID NO: 272088 - DNA, 25 bp, Homo sapien
aagataatgtaaaagcagattgctg

SEQ ID NO: 272089 - DNA, 25 bp, Homo sapien
tgccagggctttgcttggaggctac

SEQ ID NO: 272090 - DNA, 25 bp, Homo sapien
cagggctttgcttggaggctactcc

SEQ ID NO: 272091 - DNA, 25 bp, Homo sapien
ggctttgcttggaggctactcccaa

SEQ ID NO: 272092 - DNA, 25 bp, Homo sapien
ggaggctactcccaagcctacggga

SEQ ID NO: 272093 - DNA, 25 bp, Homo sapien
caagcctacgggactgtctgccact

SEQ ID NO: 272094 - DNA, 25 bp, Homo sapien
ctacgggactgtctgccactcggca

SEQ ID NO: 272095 - DNA, 25 bp, Homo sapien
gggcaccatgtgtgagccgccctac

SEQ ID NO: 272096 - DNA, 25 bp, Homo sapien
agggtggccagcgtacaacaggtcc

SEQ ID NO: 272097 - DNA, 25 bp, Homo sapien
gtggccagcgtacaacaggtccctc

SEQ ID NO: 272098 - DNA, 25 bp, Homo sapien
ggccggaggatgttcagcacctctg

SEQ ID NO: 272099 - DNA, 25 bp, Homo sapien
ccggaggatgttcagcacctctgcc

SEQ ID NO: 272100 - DNA, 25 bp, Homo sapien
gaccaataggctcaatagattcagt

SEQ ID NO: 272101 - DNA, 25 bp, Homo sapien
tagattcagtcttgttggccaggcc

SEQ ID NO: 272102 - DNA, 25 bp, Homo sapien
gtcttgttggccaggcccacttgaa

SEQ ID NO: 272103 - DNA, 25 bp, Homo sapien
aaagtcaagaacagcttctaggtaa

SEQ ID NO: 272104 - DNA, 25 bp, Homo sapien
attatgtacccaaaaggagttgaag

SEQ ID NO: 272105 - DNA, 25 bp, Homo sapien
ggtttacattaaacatccttcaagt

SEQ ID NO: 272106 - DNA, 25 bp, Homo sapien
acatccttcaagttcttatctttaa

SEQ ID NO: 272107 - DNA, 25 bp, Homo sapien
ttaaatggagtttcagtgtctccca

SEQ ID NO: 272108 - DNA, 25 bp, Homo sapien
gtgtctcccaaaggctggatgagtt

SEQ ID NO: 272109 - DNA, 25 bp, Homo sapien
aaggctgggcaagggctaacttgac

SEQ ID NO: 272110 - DNA, 25 bp, Homo sapien
agggctaacttgaccaataggctca

SEQ ID NO: 272111 - DNA, 25 bp, Homo sapien
accagtgtggctcccgtggccagaa

SEQ ID NO: 272112 - DNA, 25 bp, Homo sapien
gaagtttgggttgccctgtggtctt

SEQ ID NO: 272113 - DNA, 25 bp, Homo sapien
tgtggtcttcgccttcaaagcaggc

SEQ ID NO: 272114 - DNA, 25 bp, Homo sapien
aaagcaggccgccacttgaatcctt

SEQ ID NO: 272115 - DNA, 25 bp, Homo sapien
gaatccttctggaacggacagtgtt

SEQ ID NO: 272116 - DNA, 25 bp, Homo sapien
agtgttgctgtaaacgccgcggaat

SEQ ID NO: 272117 - DNA, 25 bp, Homo sapien
agtattcgtagcttctttcttgagg

SEQ ID NO: 272118 - DNA, 25 bp, Homo sapien
gataaggaagacttgttctggcccc

SEQ ID NO: 272119 - DNA, 25 bp, Homo sapien
ttcttgagggatctcgggaacgttc

SEQ ID NO: 272120 - DNA, 25 bp, Homo sapien
tctgacctcatctaccagaggagag

SEQ ID NO: 272121 - DNA, 25 bp, Homo sapien
agtgggatcctctaacactcgagcc

SEQ ID NO: 272122 - DNA, 25 bp, Homo sapien
atgcccagctaatccacctttttgg

SEQ ID NO: 272123 - DNA, 25 bp, Homo sapien
atccacctttttgggtcttcagaca

SEQ ID NO: 272124 - DNA, 25 bp, Homo sapien
ttttgggtcttcagacatatcgctg

SEQ ID NO: 272125 - DNA, 25 bp, Homo sapien
gacatatcgctgcttcattgatcct

SEQ ID NO: 272126 - DNA, 25 bp, Homo sapien
ttcattgatcctctctcctgtatag

SEQ ID NO: 272127 - DNA, 25 bp, Homo sapien
tgatcctctctcctgtatagcagct

SEQ ID NO: 272128 - DNA, 25 bp, Homo sapien
tttggtctctccctcctcgctgtta

SEQ ID NO: 272129 - DNA, 25 bp, Homo sapien
ctcttcattccagaacagttgatgt

SEQ ID NO: 272130 - DNA, 25 bp, Homo sapien
aacagttgatgtaagcctgcttccc

SEQ ID NO: 272131 - DNA, 25 bp, Homo sapien
gttgatgtaagcctgcttcccctgt

SEQ ID NO: 272132 - DNA, 25 bp, Homo sapien
tgtttcttcactgcctttcctcttt

SEQ ID NO: 272133 - DNA, 25 bp, Homo sapien
gacgtgacgtaagccggaagcgact

SEQ ID NO: 272134 - DNA, 25 bp, Homo sapien
ggaagcgactttccgccgagaaata

SEQ ID NO: 272135 - DNA, 25 bp, Homo sapien
ggcgcgtgtttggaaattgatagaa

SEQ ID NO: 272136 - DNA, 25 bp, Homo sapien
agaaaagataaagggaccgagctgc

SEQ ID NO: 272137 - DNA, 25 bp, Homo sapien
tgtcagcctggcttactgatctgcg

SEQ ID NO: 272138 - DNA, 25 bp, Homo sapien
ttactgatctgcgtccgtttcacca

SEQ ID NO: 272139 - DNA, 25 bp, Homo sapien
cgtttcaccacggattcagttacta

SEQ ID NO: 272140 - DNA, 25 bp, Homo sapien
cacggattcagttactaagcatttt

SEQ ID NO: 272141 - DNA, 25 bp, Homo sapien
ttttttggttctttgcaacgtgagt

SEQ ID NO: 272142 - DNA, 25 bp, Homo sapien
ggttctttgcaacgtgagtggcatt

SEQ ID NO: 272143 - DNA, 25 bp, Homo sapien
acgtgagtggcattggctcagtgat

SEQ ID NO: 272144 - DNA, 25 bp, Homo sapien
attgtgaaaacactgccctgcctag

SEQ ID NO: 272145 - DNA, 25 bp, Homo sapien
aattctatagtttttcactgatgta

SEQ ID NO: 272146 - DNA, 25 bp, Homo sapien
actgatgtaactttctagactggac

SEQ ID NO: 272147 - DNA, 25 bp, Homo sapien
gatgactaatagtaatcactccaag

SEQ ID NO: 272148 - DNA, 25 bp, Homo sapien
aatcactccaagttgatgttgactg

SEQ ID NO: 272149 - DNA, 25 bp, Homo sapien
ggttgtggtgaaatcattttgcatt

SEQ ID NO: 272150 - DNA, 25 bp, Homo sapien
taaattgcatattccttgaccagag

SEQ ID NO: 272151 - DNA, 25 bp, Homo sapien
attccttgaccagagcacagattac

SEQ ID NO: 272152 - DNA, 25 bp, Homo sapien
gcacagattacttatgcttcttaat

SEQ ID NO: 272153 - DNA, 25 bp, Homo sapien
aaatcttaaatcctctgtccaactg

SEQ ID NO: 272154 - DNA, 25 bp, Homo sapien
caactggagtatctggctatgggcc

SEQ ID NO: 272155 - DNA, 25 bp, Homo sapien
aaacacaatattttactgtgagata

SEQ ID NO: 272156 - DNA, 25 bp, Homo sapien
gtgagataatatgttttaccagcaa

SEQ ID NO: 272157 - DNA, 25 bp, Homo sapien
ccagcaaagtgtggcatagtaatta

SEQ ID NO: 272158 - DNA, 25 bp, Homo sapien
aaacaatggtcattttacccctctg

SEQ ID NO: 272159 - DNA, 25 bp, Homo sapien
aatggtcattttacccctctgcttc

SEQ ID NO: 272160 - DNA, 25 bp, Homo sapien
gtcattttacccctctgcttctcaa

SEQ ID NO: 272161 - DNA, 25 bp, Homo sapien
acagctgctctgctgtactctttga

SEQ ID NO: 272162 - DNA, 25 bp, Homo sapien
tgctctgctgtactctttgagggct

SEQ ID NO: 272163 - DNA, 25 bp, Homo sapien
tgctgtactctttgagggctcttga

SEQ ID NO: 272164 - DNA, 25 bp, Homo sapien
tgtactctttgagggctcttgagcg

SEQ ID NO: 272165 - DNA, 25 bp, Homo sapien
gggtgtttgtgtagatagttgtaaa

SEQ ID NO: 272166 - DNA, 25 bp, Homo sapien
agggcctcctgcaccgcagagaggg

SEQ ID NO: 272167 - DNA, 25 bp, Homo sapien
gctctctgctctgggaggctgctca

SEQ ID NO: 272168 - DNA, 25 bp, Homo sapien
tgcactctcctttcccttaaatggg

SEQ ID NO: 272169 - DNA, 25 bp, Homo sapien
ctctcctttcccttaaatgggcaca

SEQ ID NO: 272170 - DNA, 25 bp, Homo sapien
tttcccttaaatgggcacagccagg

SEQ ID NO: 272171 - DNA, 25 bp, Homo sapien
ctggcatgggactggcactctgtac

SEQ ID NO: 272172 - DNA, 25 bp, Homo sapien
ctgggaagagagagctccccctcca

SEQ ID NO: 272173 - DNA, 25 bp, Homo sapien
tgggactggcactctgtacctccac

SEQ ID NO: 272174 - DNA, 25 bp, Homo sapien
gcctgagccttccagctgtcaagtt

SEQ ID NO: 272175 - DNA, 25 bp, Homo sapien
cctgagccttccagctgtcaagttt

SEQ ID NO: 272176 - DNA, 25 bp, Homo sapien
gtttgaaaagaagccaccgtgcctc

SEQ ID NO: 272177 - DNA, 25 bp, Homo sapien
gatgcgtttggtagagtttggcctc

SEQ ID NO: 272178 - DNA, 25 bp, Homo sapien
aaattgggcaagataactgtatgga

SEQ ID NO: 272179 - DNA, 25 bp, Homo sapien
tttggtagagtttggcctcccagag

SEQ ID NO: 272180 - DNA, 25 bp, Homo sapien
tatatatggctacttgaaaaggaat

SEQ ID NO: 272181 - DNA, 25 bp, Homo sapien
aaggaattatgcttctctttaatac

SEQ ID NO: 272182 - DNA, 25 bp, Homo sapien
tctctttaatacagcaggattctct

SEQ ID NO: 272183 - DNA, 25 bp, Homo sapien
acagcaggattctctggttataaaa

SEQ ID NO: 272184 - DNA, 25 bp, Homo sapien
ggattctctggttataaaagtgttt

SEQ ID NO: 272185 - DNA, 25 bp, Homo sapien
gagcacagagcaggactaagatgaa

SEQ ID NO: 272186 - DNA, 25 bp, Homo sapien
gagcaggactaagatgaacagagaa

SEQ ID NO: 272187 - DNA, 25 bp, Homo sapien
gagggaaatggtggataatcagttt

SEQ ID NO: 272188 - DNA, 25 bp, Homo sapien
atttaccaaaagctcatgtgcagtc

SEQ ID NO: 272189 - DNA, 25 bp, Homo sapien
tgcagtcactgtgtggcactagatt

SEQ ID NO: 272190 - DNA, 25 bp, Homo sapien
tgtgtggcactagatttcattttca

SEQ ID NO: 272191 - DNA, 25 bp, Homo sapien
tcaacaaagagcagattcccaaact

SEQ ID NO: 272192 - DNA, 25 bp, Homo sapien
tgaaaaacttatgtccccagtgttg

SEQ ID NO: 272193 - DNA, 25 bp, Homo sapien
tgtccccagtgttgaaacagcactt

SEQ ID NO: 272194 - DNA, 25 bp, Homo sapien
aacagcacttgaatcaacaggcttc

SEQ ID NO: 272195 - DNA, 25 bp, Homo sapien
ggcttcagagactgagccattttca

SEQ ID NO: 272196 - DNA, 25 bp, Homo sapien
agccattttcaaactcacacctttt

SEQ ID NO: 272197 - DNA, 25 bp, Homo sapien
cacaccttttgcaacataagcctca

SEQ ID NO: 272198 - DNA, 25 bp, Homo sapien
ggaaatactccagacttttcctcac

SEQ ID NO: 272199 - DNA, 25 bp, Homo sapien
actgggccggacgagtaaccagctt

SEQ ID NO: 272200 - DNA, 25 bp, Homo sapien
ggacgagtaaccagcttcgctcctt

SEQ ID NO: 272201 - DNA, 25 bp, Homo sapien
ttcgctcctttcaagagacctttga

SEQ ID NO: 272202 - DNA, 25 bp, Homo sapien
tttgagaaagtgcagccacctccca

SEQ ID NO: 272203 - DNA, 25 bp, Homo sapien
tccttccagggtctgaacgccaggt

SEQ ID NO: 272204 - DNA, 25 bp, Homo sapien
ggtctgaacgccaggtgcaggctct

SEQ ID NO: 272205 - DNA, 25 bp, Homo sapien
tgcaggctctcctgagcaggtatgg

SEQ ID NO: 272206 - DNA, 25 bp, Homo sapien
tcctgagcaggtatggccctgggaa

SEQ ID NO: 272207 - DNA, 25 bp, Homo sapien
gtatggccctgggaagctgtaccag

SEQ ID NO: 272208 - DNA, 25 bp, Homo sapien
tgcacattcgtgaccctccagaggg

SEQ ID NO: 272209 - DNA, 25 bp, Homo sapien
cagagggaagcatggcccagctgcc

SEQ ID NO: 272210 - DNA, 25 bp, Homo sapien
taaaccacagtttgatttagttagc

SEQ ID NO: 272211 - DNA, 25 bp, Homo sapien
aaccacagtttgatttagttagcct

SEQ ID NO: 272212 - DNA, 25 bp, Homo sapien
accacagtttgatttagttagcctt

SEQ ID NO: 272213 - DNA, 25 bp, Homo sapien
ccacagtttgatttagttagccttg

SEQ ID NO: 272214 - DNA, 25 bp, Homo sapien
cacagtttgatttagttagccttgc

SEQ ID NO: 272215 - DNA, 25 bp, Homo sapien
acagtttgatttagttagccttgct

SEQ ID NO: 272216 - DNA, 25 bp, Homo sapien
agtttgatttagttagccttgctgg

SEQ ID NO: 272217 - DNA, 25 bp, Homo sapien
gtttgatttagttagccttgctggg

SEQ ID NO: 272218 - DNA, 25 bp, Homo sapien
ttagttagccttgctggggccataa

SEQ ID NO: 272219 - DNA, 25 bp, Homo sapien
cttgctggggccataatatgcttca

SEQ ID NO: 272220 - DNA, 25 bp, Homo sapien
tggggccataatatgcttcagggtg

SEQ ID NO: 272221 - DNA, 25 bp, Homo sapien
cagagacgaggctccgggatttacc

SEQ ID NO: 272222 - DNA, 25 bp, Homo sapien
atgagagccggcagtttggctgtat

SEQ ID NO: 272223 - DNA, 25 bp, Homo sapien
ttggctgtatcgtaagctggcgctt

SEQ ID NO: 272224 - DNA, 25 bp, Homo sapien
gtatcgtaagctggcgctttagctg

SEQ ID NO: 272225 - DNA, 25 bp, Homo sapien
agcgggagggcctcagtcgtcccat

SEQ ID NO: 272226 - DNA, 25 bp, Homo sapien
tcagtcgtcccatccgggctgtagg

SEQ ID NO: 272227 - DNA, 25 bp, Homo sapien
tgtaggctccgcaaagctcttgatg

SEQ ID NO: 272228 - DNA, 25 bp, Homo sapien
agctcttgatgcactgtcaggctgg

SEQ ID NO: 272229 - DNA, 25 bp, Homo sapien
gtgagcctgctgattcaagtgtccc

SEQ ID NO: 272230 - DNA, 25 bp, Homo sapien
gctgattcaagtgtccctgtgggtc

SEQ ID NO: 272231 - DNA, 25 bp, Homo sapien
tgtgggtcccgcaccttctgagaca

SEQ ID NO: 272232 - DNA, 25 bp, Homo sapien
gtcggccggtcctctaccaggtggt

SEQ ID NO: 272233 - DNA, 25 bp, Homo sapien
ccagaggacctgggcttccgacagg

SEQ ID NO: 272234 - DNA, 25 bp, Homo sapien
tggagggccactgtgacggccgcat

SEQ ID NO: 272235 - DNA, 25 bp, Homo sapien
cactgtgacggccgcatcggcatct

SEQ ID NO: 272236 - DNA, 25 bp, Homo sapien
ccaagtgcttcgtggtccccgccgg

SEQ ID NO: 272237 - DNA, 25 bp, Homo sapien
gccggccctcggatgtcaggagccc

SEQ ID NO: 272238 - DNA, 25 bp, Homo sapien
gccccgatcccagcagggagatcag

SEQ ID NO: 272239 - DNA, 25 bp, Homo sapien
agcagggagatcagccctaatgatg

SEQ ID NO: 272240 - DNA, 25 bp, Homo sapien
gggagatcagccctaatgatgctgt

SEQ ID NO: 272241 - DNA, 25 bp, Homo sapien
gatcagccctaatgatgctgtgtcc

SEQ ID NO: 272242 - DNA, 25 bp, Homo sapien
cagccctaatgatgctgtgtccatg

SEQ ID NO: 272243 - DNA, 25 bp, Homo sapien
tgccggcagcacagcctcaaaatac

SEQ ID NO: 272244 - DNA, 25 bp, Homo sapien
aatgttcgcagataccagtgacacc

SEQ ID NO: 272245 - DNA, 25 bp, Homo sapien
agataccagtgacaccaggtggctg

SEQ ID NO: 272246 - DNA, 25 bp, Homo sapien
ggctggactgatggagacgtcttca

SEQ ID NO: 272247 - DNA, 25 bp, Homo sapien
gtcttcagacaggagccgctcagtc

SEQ ID NO: 272248 - DNA, 25 bp, Homo sapien
agacaggagccgctcagtcttcttt

SEQ ID NO: 272249 - DNA, 25 bp, Homo sapien
tcgcctcctgtgtggtgccggaaga

SEQ ID NO: 272250 - DNA, 25 bp, Homo sapien
ggaagagcgccaggttcagtgttac

SEQ ID NO: 272251 - DNA, 25 bp, Homo sapien
ttcagtgttaccctgagggctgatt

SEQ ID NO: 272252 - DNA, 25 bp, Homo sapien
gttgttttccttagacaggtccacg

SEQ ID NO: 272253 - DNA, 25 bp, Homo sapien
gtggaagatttcagccgtattaaaa

SEQ ID NO: 272254 - DNA, 25 bp, Homo sapien
caatctgacatgctgcatggaacat

SEQ ID NO: 272255 - DNA, 25 bp, Homo sapien
ggatgtgatttatacctggaaggcc

SEQ ID NO: 272256 - DNA, 25 bp, Homo sapien
caagcagccaatgagtcccataatg

SEQ ID NO: 272257 - DNA, 25 bp, Homo sapien
tgagtcccataatgggtccatcctc

SEQ ID NO: 272258 - DNA, 25 bp, Homo sapien
agtgatatgaccttcatctgcgttg

SEQ ID NO: 272259 - DNA, 25 bp, Homo sapien
ttcatctgcgttgccaggaaccctg

SEQ ID NO: 272260 - DNA, 25 bp, Homo sapien
ggaaccctgtcagcagaaacttctc

SEQ ID NO: 272261 - DNA, 25 bp, Homo sapien
catccttgccaggaagctctgtgaa

SEQ ID NO: 272262 - DNA, 25 bp, Homo sapien
gaaggtgctgctgatgacccagatt

SEQ ID NO: 272263 - DNA, 25 bp, Homo sapien
tgatgacccagattcctccatggtc

SEQ ID NO: 272264 - DNA, 25 bp, Homo sapien
agattcctccatggtcctcctgtgt

SEQ ID NO: 272265 - DNA, 25 bp, Homo sapien
tcctgacgacacagcatccctgtcc

SEQ ID NO: 272266 - DNA, 25 bp, Homo sapien
tcccagatgaaggattccccggcgg

SEQ ID NO: 272267 - DNA, 25 bp, Homo sapien
ccagatgaaggattccccggcggga

SEQ ID NO: 272268 - DNA, 25 bp, Homo sapien
ttccccggcgggagacagggccctg

SEQ ID NO: 272269 - DNA, 25 bp, Homo sapien
ctgtgtgttatctccccatgaaaag

SEQ ID NO: 272270 - DNA, 25 bp, Homo sapien
tgtgtgttatctccccatgaaaagt

SEQ ID NO: 272271 - DNA, 25 bp, Homo sapien
ccccatgaaaagtcacctaggccga

SEQ ID NO: 272272 - DNA, 25 bp, Homo sapien
atgaaaagtcacctaggccgagcat

SEQ ID NO: 272273 - DNA, 25 bp, Homo sapien
gaaaagtcacctaggccgagcatgg

SEQ ID NO: 272274 - DNA, 25 bp, Homo sapien
aaaagtcacctaggccgagcatggt

SEQ ID NO: 272275 - DNA, 25 bp, Homo sapien
aggtggaggcgtgcggatcatctga

SEQ ID NO: 272276 - DNA, 25 bp, Homo sapien
atggtgcccacctatgagaccctga

SEQ ID NO: 272277 - DNA, 25 bp, Homo sapien
gaacaccattctagagggcttccag

SEQ ID NO: 272278 - DNA, 25 bp, Homo sapien
tactcacccttttccaaaggagcac

SEQ ID NO: 272279 - DNA, 25 bp, Homo sapien
aaaggagcacaggtgttggccatca

SEQ ID NO: 272280 - DNA, 25 bp, Homo sapien
agcacaggtgttggccatcagaaga

SEQ ID NO: 272281 - DNA, 25 bp, Homo sapien
tggccatcagaagacacactggagc

SEQ ID NO: 272282 - DNA, 25 bp, Homo sapien
agaagacacactggagcgcatgggc

SEQ ID NO: 272283 - DNA, 25 bp, Homo sapien
tgtgtgccaagctcagtcacctctg

SEQ ID NO: 272284 - DNA, 25 bp, Homo sapien
caagctcagtcacctctgattcagc

SEQ ID NO: 272285 - DNA, 25 bp, Homo sapien
agcccctgagggtgtctgctgccag

SEQ ID NO: 272286 - DNA, 25 bp, Homo sapien
tgggaagtacactccaagctggaaa

SEQ ID NO: 272287 - DNA, 25 bp, Homo sapien
ggaagtctttacacacatgctggag

SEQ ID NO: 272288 - DNA, 25 bp, Homo sapien
ggagagttcattagcatcaaaccac

SEQ ID NO: 272289 - DNA, 25 bp, Homo sapien
gcatctagaagtgtggcccaagttc

SEQ ID NO: 272290 - DNA, 25 bp, Homo sapien
tggcccaagttctgttcttcaatca

SEQ ID NO: 272291 - DNA, 25 bp, Homo sapien
tgttcttcaatcagcccacccatta

SEQ ID NO: 272292 - DNA, 25 bp, Homo sapien
acccattatccctatgtatctcgat

SEQ ID NO: 272293 - DNA, 25 bp, Homo sapien
gatgtaagcaagtaacacagccaag

SEQ ID NO: 272294 - DNA, 25 bp, Homo sapien
acagccaagacccagtttacagtgt

SEQ ID NO: 272295 - DNA, 25 bp, Homo sapien
gtttacagtgtctagtacctaacag

SEQ ID NO: 272296 - DNA, 25 bp, Homo sapien
gtacctaacagactcttgacacgtt

SEQ ID NO: 272297 - DNA, 25 bp, Homo sapien
ttgacacgtttcacttgcccttgag

SEQ ID NO: 272298 - DNA, 25 bp, Homo sapien
gtcacaaacagttccccagttgata

SEQ ID NO: 272299 - DNA, 25 bp, Homo sapien
aacaattgaaagtccgaatctgcaa

SEQ ID NO: 272300 - DNA, 25 bp, Homo sapien
gaaagtccgaatctgcaagttcatc

SEQ ID NO: 272301 - DNA, 25 bp, Homo sapien
gtccgaatctgcaagttcatctctg

SEQ ID NO: 272302 - DNA, 25 bp, Homo sapien
gaatctgcaagttcatctctgagaa

SEQ ID NO: 272303 - DNA, 25 bp, Homo sapien
atctgcaagttcatctctgagaacc

SEQ ID NO: 272304 - DNA, 25 bp, Homo sapien
ctgagaaccgaattttacagccact

SEQ ID NO: 272305 - DNA, 25 bp, Homo sapien
gtagaaatcacatcccttcagtctg

SEQ ID NO: 272306 - DNA, 25 bp, Homo sapien
ctgccaatgtgataactgcccaaga

SEQ ID NO: 272307 - DNA, 25 bp, Homo sapien
actgcgcccggtaacaactaatgtt

SEQ ID NO: 272308 - DNA, 25 bp, Homo sapien
gcgcccggtaacaactaatgttgga

SEQ ID NO: 272309 - DNA, 25 bp, Homo sapien
gaatatacatttctggtttacacaa

SEQ ID NO: 272310 - DNA, 25 bp, Homo sapien
acacaatgagaagccttgggttccc

SEQ ID NO: 272311 - DNA, 25 bp, Homo sapien
tgtcagattctatcacagtgcactt

SEQ ID NO: 272312 - DNA, 25 bp, Homo sapien
atcacagtgcacttttactactatt

SEQ ID NO: 272313 - DNA, 25 bp, Homo sapien
aaatctgcattttgtgagtgtgtat

SEQ ID NO: 272314 - DNA, 25 bp, Homo sapien
gtgtattgagtaattgagtgcttct

SEQ ID NO: 272315 - DNA, 25 bp, Homo sapien
gagtgcttctttgttcaatttgcat

SEQ ID NO: 272316 - DNA, 25 bp, Homo sapien
ggaatagaccaaaccaatgtcaaag

SEQ ID NO: 272317 - DNA, 25 bp, Homo sapien
tgtcaaaggtggtctctatgagagc

SEQ ID NO: 272318 - DNA, 25 bp, Homo sapien
ggtctctatgagagctgcatgcctc

SEQ ID NO: 272319 - DNA, 25 bp, Homo sapien
gctgcatgcctccaaagtaatcgat

SEQ ID NO: 272320 - DNA, 25 bp, Homo sapien
caggcaccagacacagggcacggtg

SEQ ID NO: 272321 - DNA, 25 bp, Homo sapien
ggtggagagacttctcccccgtggc

SEQ ID NO: 272322 - DNA, 25 bp, Homo sapien
cgttttgcccgaggctgctcttctg

SEQ ID NO: 272323 - DNA, 25 bp, Homo sapien
cgaggctgctcttctgtcagacttc

SEQ ID NO: 272324 - DNA, 25 bp, Homo sapien
cttctgtcagacttcctctttgtac

SEQ ID NO: 272325 - DNA, 25 bp, Homo sapien
gtcagacttcctctttgtaccacag

SEQ ID NO: 272326 - DNA, 25 bp, Homo sapien
agcagtttctctgaagatctgtcaa

SEQ ID NO: 272327 - DNA, 25 bp, Homo sapien
tttctctgaagatctgtcaacaggt

SEQ ID NO: 272328 - DNA, 25 bp, Homo sapien
atctgtcaacaggttaagtcaatct

SEQ ID NO: 272329 - DNA, 25 bp, Homo sapien
ggttaagtcaatctggggcttccac

SEQ ID NO: 272330 - DNA, 25 bp, Homo sapien
ccagagcttggtggtcccgaaacgg

SEQ ID NO: 272331 - DNA, 25 bp, Homo sapien
aggcctgatgggagacactgtgtat

SEQ ID NO: 272332 - DNA, 25 bp, Homo sapien
gagacactgtgtatacccacttcct

SEQ ID NO: 272333 - DNA, 25 bp, Homo sapien
aagggtgtgtcccttactgcgcaga

SEQ ID NO: 272334 - DNA, 25 bp, Homo sapien
cctggcctcaaaccctgttgatgtt

SEQ ID NO: 272335 - DNA, 25 bp, Homo sapien
agtgcttcgagatggcagatgttct

SEQ ID NO: 272336 - DNA, 25 bp, Homo sapien
gatgttctggctacacaggaaccct

SEQ ID NO: 272337 - DNA, 25 bp, Homo sapien
ccttactgcgcagagggctgctatt

SEQ ID NO: 272338 - DNA, 25 bp, Homo sapien
caggaaccctggattgcttgttaca

SEQ ID NO: 272339 - DNA, 25 bp, Homo sapien
gattgcttgttacaggtgttgcctt

SEQ ID NO: 272340 - DNA, 25 bp, Homo sapien
tggagctgccggtctatgacatcac

SEQ ID NO: 272341 - DNA, 25 bp, Homo sapien
agaagcatcttattctctcaggcct

SEQ ID NO: 272342 - DNA, 25 bp, Homo sapien
gttaatttacttgtacgtgtcctct

SEQ ID NO: 272343 - DNA, 25 bp, Homo sapien
ctacaccatgtatttccttccttta

SEQ ID NO: 272344 - DNA, 25 bp, Homo sapien
ttttttcaccggctgccagccatct

SEQ ID NO: 272345 - DNA, 25 bp, Homo sapien
tcctccttggaattgtgctgtgttt

SEQ ID NO: 272346 - DNA, 25 bp, Homo sapien
gctgtgtttcgttgtcctggaggac

SEQ ID NO: 272347 - DNA, 25 bp, Homo sapien
gaagagcaggttaaggcatgagcat

SEQ ID NO: 272348 - DNA, 25 bp, Homo sapien
agcatgtgtgtatcactttgaagaa

SEQ ID NO: 272349 - DNA, 25 bp, Homo sapien
gagaaaccaggtattctgctacagt

SEQ ID NO: 272350 - DNA, 25 bp, Homo sapien
caggtattctgctacagtttggaga

SEQ ID NO: 272351 - DNA, 25 bp, Homo sapien
cttctgctctttatcttttcagcta

SEQ ID NO: 272352 - DNA, 25 bp, Homo sapien
atcttttcagctatgactgactata

SEQ ID NO: 272353 - DNA, 25 bp, Homo sapien
ggtcctgcctcatgaatgaggcctt

SEQ ID NO: 272354 - DNA, 25 bp, Homo sapien
taacgttttctcagggaaccacaat

SEQ ID NO: 272355 - DNA, 25 bp, Homo sapien
ttctcagggaaccacaatgcacgaa

SEQ ID NO: 272356 - DNA, 25 bp, Homo sapien
accacaatgcacgaaagaggaactg

SEQ ID NO: 272357 - DNA, 25 bp, Homo sapien
ggttgctaaccaggatgctgggaac

SEQ ID NO: 272358 - DNA, 25 bp, Homo sapien
gatgctgggaacaaaggcctcttga

SEQ ID NO: 272359 - DNA, 25 bp, Homo sapien
cagccacagcccagctgagcatgag

SEQ ID NO: 272360 - DNA, 25 bp, Homo sapien
cctgggcattccctgctttgcattg

SEQ ID NO: 272361 - DNA, 25 bp, Homo sapien
gctttgcattgctgcttctcttcac

SEQ ID NO: 272362 - DNA, 25 bp, Homo sapien
tggaggctatgtcaccctaactatc

SEQ ID NO: 272363 - DNA, 25 bp, Homo sapien
gaggctatgtcaccctaactatcct

SEQ ID NO: 272364 - DNA, 25 bp, Homo sapien
gagctgaaaatatagcctgactctt

SEQ ID NO: 272365 - DNA, 25 bp, Homo sapien
ggacaaaagacaaggcatgggtaga

SEQ ID NO: 272366 - DNA, 25 bp, Homo sapien
gattagaatgtatcacaatgcccac

SEQ ID NO: 272367 - DNA, 25 bp, Homo sapien
gaaatttaatccttactgtgtagaa

SEQ ID NO: 272368 - DNA, 25 bp, Homo sapien
aatccttactgtgtagaatatttag

SEQ ID NO: 272369 - DNA, 25 bp, Homo sapien
gactgcttgacaccagtccagttga

SEQ ID NO: 272370 - DNA, 25 bp, Homo sapien
gtccagttgaccctcaaatccatga

SEQ ID NO: 272371 - DNA, 25 bp, Homo sapien
agttgaccctcaaatccatgatttc

SEQ ID NO: 272372 - DNA, 25 bp, Homo sapien
aaatccatgatttctgccaccatat

SEQ ID NO: 272373 - DNA, 25 bp, Homo sapien
atgatttctgccaccatattcacag

SEQ ID NO: 272374 - DNA, 25 bp, Homo sapien
tgccaccatattcacagaaacaaga

SEQ ID NO: 272375 - DNA, 25 bp, Homo sapien
atttatcttatttgctaatgggagc

SEQ ID NO: 272376 - DNA, 25 bp, Homo sapien
gagcacttcttcctttgttaggctg

SEQ ID NO: 272377 - DNA, 25 bp, Homo sapien
gcacttcttcctttgttaggctgtg

SEQ ID NO: 272378 - DNA, 25 bp, Homo sapien
ttcttcctttgttaggctgtgcttt

SEQ ID NO: 272379 - DNA, 25 bp, Homo sapien
cctttgttaggctgtgctttactga

SEQ ID NO: 272380 - DNA, 25 bp, Homo sapien
gttaggctgtgctttactgataaaa

SEQ ID NO: 272381 - DNA, 25 bp, Homo sapien
ggctgtgctttactgataaaaccaa

SEQ ID NO: 272382 - DNA, 25 bp, Homo sapien
aaatgttatgcaatgttttccaaac

SEQ ID NO: 272383 - DNA, 25 bp, Homo sapien
cagataaaagctattgtgtgagtat

SEQ ID NO: 272384 - DNA, 25 bp, Homo sapien
tattgtgtgagtatattgtgctaaa

SEQ ID NO: 272385 - DNA, 25 bp, Homo sapien
gtgagtatattgtgctaaaatcata

SEQ ID NO: 272386 - DNA, 25 bp, Homo sapien
tagagagcacctcctttgctggtca

SEQ ID NO: 272387 - DNA, 25 bp, Homo sapien
tttgctggtcagacatggagcctgc

SEQ ID NO: 272388 - DNA, 25 bp, Homo sapien
gacatggagcctgcagttggtcaca

SEQ ID NO: 272389 - DNA, 25 bp, Homo sapien
gttggtcacagatgatactgcttta

SEQ ID NO: 272390 - DNA, 25 bp, Homo sapien
aagattcccgtcttataaatggagt

SEQ ID NO: 272391 - DNA, 25 bp, Homo sapien
tacagggaacctcaagtagtgaagt

SEQ ID NO: 272392 - DNA, 25 bp, Homo sapien
catgtgtaaggctttgtggcttcag

SEQ ID NO: 272393 - DNA, 25 bp, Homo sapien
gcttcaggtaccagtggctaaggta

SEQ ID NO: 272394 - DNA, 25 bp, Homo sapien
gaaaaagtccatcttccatccccta

SEQ ID NO: 272395 - DNA, 25 bp, Homo sapien
ttccatcccctacatggcagttaat

SEQ ID NO: 272396 - DNA, 25 bp, Homo sapien
tggcagttaatacccttctatatgg

SEQ ID NO: 272397 - DNA, 25 bp, Homo sapien
atatattacccttacaatgtccaca

SEQ ID NO: 272398 - DNA, 25 bp, Homo sapien
tattacccttacaatgtccacacaa

SEQ ID NO: 272399 - DNA, 25 bp, Homo sapien
gaattgctaccatagtggaatggca

SEQ ID NO: 272400 - DNA, 25 bp, Homo sapien
agaagaactaactccagatggtcca

SEQ ID NO: 272401 - DNA, 25 bp, Homo sapien
tccagatggtccaaatataacccaa

SEQ ID NO: 272402 - DNA, 25 bp, Homo sapien
aatataacccaaagcccagaggtag

SEQ ID NO: 272403 - DNA, 25 bp, Homo sapien
agcccagaggtagagaagtcccagg

SEQ ID NO: 272404 - DNA, 25 bp, Homo sapien
aagtcccagggaaggttgattcagt

SEQ ID NO: 272405 - DNA, 25 bp, Homo sapien
ccagggaaggttgattcagtggtcc

SEQ ID NO: 272406 - DNA, 25 bp, Homo sapien
ggtttccattgcttaaagcttccta

SEQ ID NO: 272407 - DNA, 25 bp, Homo sapien
aaagcttcctaattcataggcatat

SEQ ID NO: 272408 - DNA, 25 bp, Homo sapien
acagaatcctgaaagtccgtgacta

SEQ ID NO: 272409 - DNA, 25 bp, Homo sapien
ggcaaaggctctcctttttgtgaac

SEQ ID NO: 272410 - DNA, 25 bp, Homo sapien
tccggagaatccaaaccttcaaatt

SEQ ID NO: 272411 - DNA, 25 bp, Homo sapien
aattcttccactgactccatcttta

SEQ ID NO: 272412 - DNA, 25 bp, Homo sapien
actccatctttacaaagcccacttt

SEQ ID NO: 272413 - DNA, 25 bp, Homo sapien
gcccactttaatgtcctttaaggct

SEQ ID NO: 272414 - DNA, 25 bp, Homo sapien
ataagttcttcttgttttccagctt

SEQ ID NO: 272415 - DNA, 25 bp, Homo sapien
gaaccaatatcactcttgtttcaat

SEQ ID NO: 272416 - DNA, 25 bp, Homo sapien
tcaatctgaggcatctcttcttcta

SEQ ID NO: 272417 - DNA, 25 bp, Homo sapien
ggtggtccaataactctacaatcag

SEQ ID NO: 272418 - DNA, 25 bp, Homo sapien
atcagccttgtagaggtcattaaag

SEQ ID NO: 272419 - DNA, 25 bp, Homo sapien
tgtattggttcctagttcctactaa

SEQ ID NO: 272420 - DNA, 25 bp, Homo sapien
gttcctactaatttctcacacttag

SEQ ID NO: 272421 - DNA, 25 bp, Homo sapien
ttagttaactagtcagtcttactga

SEQ ID NO: 272422 - DNA, 25 bp, Homo sapien
ggttacaaaccaaagtgagatgcct

SEQ ID NO: 272423 - DNA, 25 bp, Homo sapien
tgagatgcctatctggtttctgcac

SEQ ID NO: 272424 - DNA, 25 bp, Homo sapien
tgcctatctggtttctgcacagttg

SEQ ID NO: 272425 - DNA, 25 bp, Homo sapien
gcagaaactgctgattgttcctttt

SEQ ID NO: 272426 - DNA, 25 bp, Homo sapien
cacagttgtcctgaattatgttggc

SEQ ID NO: 272427 - DNA, 25 bp, Homo sapien
gactgattatacaatgtgtcctttt

SEQ ID NO: 272428 - DNA, 25 bp, Homo sapien
aaaatggttctctgttctctttgca

SEQ ID NO: 272429 - DNA, 25 bp, Homo sapien
gttctctttgcagttcttgtattgg

SEQ ID NO: 272430 - DNA, 25 bp, Homo sapien
tggacgacgtgcctacttgtgagac

SEQ ID NO: 272431 - DNA, 25 bp, Homo sapien
ctacttgtgagacctctctgtgagt

SEQ ID NO: 272432 - DNA, 25 bp, Homo sapien
gagacctctctgtgagtaagcatat

SEQ ID NO: 272433 - DNA, 25 bp, Homo sapien
gaatgttccccaagttcatgaaact

SEQ ID NO: 272434 - DNA, 25 bp, Homo sapien
gaaactcagaaactctctcctgaag

SEQ ID NO: 272435 - DNA, 25 bp, Homo sapien
tctcctgaagggtggcttctcttgg

SEQ ID NO: 272436 - DNA, 25 bp, Homo sapien
cttctcttgggcatagacaaggaga

SEQ ID NO: 272437 - DNA, 25 bp, Homo sapien
gggtggctcttccatctcatggcct

SEQ ID NO: 272438 - DNA, 25 bp, Homo sapien
tggcctccctgactcgtgctgcgga

SEQ ID NO: 272439 - DNA, 25 bp, Homo sapien
gtaaatattcaacatgcgagtctca

SEQ ID NO: 272440 - DNA, 25 bp, Homo sapien
tgcgagtctcatttatggacgacgt

SEQ ID NO: 272441 - DNA, 25 bp, Homo sapien
atgacttgccttttctggctatttc

SEQ ID NO: 272442 - DNA, 25 bp, Homo sapien
atgggatcatatgacatgtggtttc

SEQ ID NO: 272443 - DNA, 25 bp, Homo sapien
atgtggtttcctatatctgactttt

SEQ ID NO: 272444 - DNA, 25 bp, Homo sapien
gcataacgtttttgaggctcatcca

SEQ ID NO: 272445 - DNA, 25 bp, Homo sapien
gctcatccatgttgtagtactccat

SEQ ID NO: 272446 - DNA, 25 bp, Homo sapien
agtactccatgccatgttgtgggct

SEQ ID NO: 272447 - DNA, 25 bp, Homo sapien
gttgtgggctacataatattccatt

SEQ ID NO: 272448 - DNA, 25 bp, Homo sapien
gacatttaggtttggtctacttttg

SEQ ID NO: 272449 - DNA, 25 bp, Homo sapien
tttgtggcattaatagtgctgctgt

SEQ ID NO: 272450 - DNA, 25 bp, Homo sapien
gtgctgctgtgaacaatcatgtaca

SEQ ID NO: 272451 - DNA, 25 bp, Homo sapien
gtacaagtcttgtatcagagccact

SEQ ID NO: 272452 - DNA, 25 bp, Homo sapien
cagtttctggatctgtatggtacta

SEQ ID NO: 272453 - DNA, 25 bp, Homo sapien
tttataattctgtaaccgtatggca

SEQ ID NO: 272454 - DNA, 25 bp, Homo sapien
attctgtaaccgtatggcagtgtta

SEQ ID NO: 272455 - DNA, 25 bp, Homo sapien
aaccgtatggcagtgttatgccaaa

SEQ ID NO: 272456 - DNA, 25 bp, Homo sapien
atagtttttgttgcttactgctgta

SEQ ID NO: 272457 - DNA, 25 bp, Homo sapien
tagagttagagttccttttgagtaa

SEQ ID NO: 272458 - DNA, 25 bp, Homo sapien
ctattgccaaatatacatcctgtaa

SEQ ID NO: 272459 - DNA, 25 bp, Homo sapien
aataaaagccactccatcttagata

SEQ ID NO: 272460 - DNA, 25 bp, Homo sapien
gccactccatcttagataacatttt

SEQ ID NO: 272461 - DNA, 25 bp, Homo sapien
tagcattgtgctagagtacattatg

SEQ ID NO: 272462 - DNA, 25 bp, Homo sapien
gtacattatggtgattttgcacgat

SEQ ID NO: 272463 - DNA, 25 bp, Homo sapien
aagtgcccaagtgggcgcggccgtc

SEQ ID NO: 272464 - DNA, 25 bp, Homo sapien
gccgtcggcgaggtcagtttagcct

SEQ ID NO: 272465 - DNA, 25 bp, Homo sapien
gtcggcgaggtcagtttagcctgta

SEQ ID NO: 272466 - DNA, 25 bp, Homo sapien
agtttagcctgtactggaccgtgga

SEQ ID NO: 272467 - DNA, 25 bp, Homo sapien
ttagcctgtactggaccgtggaacc

SEQ ID NO: 272468 - DNA, 25 bp, Homo sapien
gcctgtactggaccgtggaaccctg

SEQ ID NO: 272469 - DNA, 25 bp, Homo sapien
ccacagtctgctgcggtctgtggaa

SEQ ID NO: 272470 - DNA, 25 bp, Homo sapien
gctccaagcggctggtagctgctag

SEQ ID NO: 272471 - DNA, 25 bp, Homo sapien
ccaagcggctggtagctgctagtaa

SEQ ID NO: 272472 - DNA, 25 bp, Homo sapien
gcggctggtagctgctagtaattca

SEQ ID NO: 272473 - DNA, 25 bp, Homo sapien
gctgctagtaattcagacttctggc

SEQ ID NO: 272474 - DNA, 25 bp, Homo sapien
gcaaaatcctcttattttctataag

SEQ ID NO: 272475 - DNA, 25 bp, Homo sapien
acacagaaggtctatgaacaagctt

SEQ ID NO: 272476 - DNA, 25 bp, Homo sapien
gaacaagcttagatcaggtcctgtg

SEQ ID NO: 272477 - DNA, 25 bp, Homo sapien
gtcctgtggatgagcatgtggtccc

SEQ ID NO: 272478 - DNA, 25 bp, Homo sapien
tggatgagcatgtggtccccacgac

SEQ ID NO: 272479 - DNA, 25 bp, Homo sapien
cccacgttttggctgtatcctttat

SEQ ID NO: 272480 - DNA, 25 bp, Homo sapien
gttttggctgtatcctttatcccag

SEQ ID NO: 272481 - DNA, 25 bp, Homo sapien
tgtatcctttatcccagccagtcat

SEQ ID NO: 272482 - DNA, 25 bp, Homo sapien
tggatttgtgaccaatgacatttat

SEQ ID NO: 272483 - DNA, 25 bp, Homo sapien
atgacatttatgagttctccccaga

SEQ ID NO: 272484 - DNA, 25 bp, Homo sapien
tttatgagttctccccagaccaaat

SEQ ID NO: 272485 - DNA, 25 bp, Homo sapien
tatttcctttttctagtttggcaca

SEQ ID NO: 272486 - DNA, 25 bp, Homo sapien
cctttttctagtttggcacatgcag

SEQ ID NO: 272487 - DNA, 25 bp, Homo sapien
ttctagtttggcacatgcaggtagt

SEQ ID NO: 272488 - DNA, 25 bp, Homo sapien
ggcacatgcaggtagttggtgaaca

SEQ ID NO: 272489 - DNA, 25 bp, Homo sapien
gaagaggagggacctactgaaccca

SEQ ID NO: 272490 - DNA, 25 bp, Homo sapien
gagggacctactgaacccagagtca

SEQ ID NO: 272491 - DNA, 25 bp, Homo sapien
ggacctactgaacccagagtcagga

SEQ ID NO: 272492 - DNA, 25 bp, Homo sapien
ctactgaacccagagtcaggaagag

SEQ ID NO: 272493 - DNA, 25 bp, Homo sapien
acactaaaattccactcatgccggg

SEQ ID NO: 272494 - DNA, 25 bp, Homo sapien
taaaattccactcatgccgggcgtg

SEQ ID NO: 272495 - DNA, 25 bp, Homo sapien
aattccactcatgccgggcgtggtg

SEQ ID NO: 272496 - DNA, 25 bp, Homo sapien
ctacattgtccttaggtcaatatct

SEQ ID NO: 272497 - DNA, 25 bp, Homo sapien
cattgtccttaggtcaatatctttc

SEQ ID NO: 272498 - DNA, 25 bp, Homo sapien
tgtccttaggtcaatatctttctgt

SEQ ID NO: 272499 - DNA, 25 bp, Homo sapien
gtccttaggtcaatatctttctgtt

SEQ ID NO: 272500 - DNA, 25 bp, Homo sapien
tccttaggtcaatatctttctgttt

SEQ ID NO: 272501 - DNA, 25 bp, Homo sapien
cttaggtcaatatctttctgtttgt

SEQ ID NO: 272502 - DNA, 25 bp, Homo sapien
ttactcatttcttgttctatctctt

SEQ ID NO: 272503 - DNA, 25 bp, Homo sapien
caatcacaaaagacaggaatggatg

SEQ ID NO: 272504 - DNA, 25 bp, Homo sapien
gatgcaaatcctacttcatctgtaa

SEQ ID NO: 272505 - DNA, 25 bp, Homo sapien
atgcaaatcctacttcatctgtaaa

SEQ ID NO: 272506 - DNA, 25 bp, Homo sapien
gcaaatcctacttcatctgtaaata

SEQ ID NO: 272507 - DNA, 25 bp, Homo sapien
ccaccatactttccctcactgtctt

SEQ ID NO: 272508 - DNA, 25 bp, Homo sapien
cactgtcttcgccatctggaacagc

SEQ ID NO: 272509 - DNA, 25 bp, Homo sapien
tgtcttcgccatctggaacagcctg

SEQ ID NO: 272510 - DNA, 25 bp, Homo sapien
gtcttcgccatctggaacagcctgg

SEQ ID NO: 272511 - DNA, 25 bp, Homo sapien
tcccccaacagcgtttgacttgtta

SEQ ID NO: 272512 - DNA, 25 bp, Homo sapien
gcaacaagggacaaaggagttcacc

SEQ ID NO: 272513 - DNA, 25 bp, Homo sapien
ggacaaaggagttcaccttccccat

SEQ ID NO: 272514 - DNA, 25 bp, Homo sapien
acaaaggagttcaccttccccatgc

SEQ ID NO: 272515 - DNA, 25 bp, Homo sapien
ctgttgccccgaacctctgtcctgg

SEQ ID NO: 272516 - DNA, 25 bp, Homo sapien
agcatgcccactgcgcacaggggga

SEQ ID NO: 272517 - DNA, 25 bp, Homo sapien
acagggggagtctggcaccgccaag

SEQ ID NO: 272518 - DNA, 25 bp, Homo sapien
gttactgctgccctacctagcctgg

SEQ ID NO: 272519 - DNA, 25 bp, Homo sapien
tacctagcctggctcaccgtgactt

SEQ ID NO: 272520 - DNA, 25 bp, Homo sapien
tagcctggctcaccgtgacttcagc

SEQ ID NO: 272521 - DNA, 25 bp, Homo sapien
acagcctttgtccagtgcaccagcc

SEQ ID NO: 272522 - DNA, 25 bp, Homo sapien
agcctcagcccacggagaagagtga

SEQ ID NO: 272523 - DNA, 25 bp, Homo sapien
ctcagcccacggagaagagtgactg

SEQ ID NO: 272524 - DNA, 25 bp, Homo sapien
aagagtgactgaggccctagggcat

SEQ ID NO: 272525 - DNA, 25 bp, Homo sapien
aagagtctgcaagcagggctgtgga

SEQ ID NO: 272526 - DNA, 25 bp, Homo sapien
ggctgtggagttagggttcacccca

SEQ ID NO: 272527 - DNA, 25 bp, Homo sapien
tggagttagggttcaccccaatggg

SEQ ID NO: 272528 - DNA, 25 bp, Homo sapien
ggtgccgtttttccttagaaatcag

SEQ ID NO: 272529 - DNA, 25 bp, Homo sapien
gtgaaccatatgtacactgtgtttg

SEQ ID NO: 272530 - DNA, 25 bp, Homo sapien
aggcaactctcctctgtagagtgaa

SEQ ID NO: 272531 - DNA, 25 bp, Homo sapien
tttgagagacattagttccccacgg

SEQ ID NO: 272532 - DNA, 25 bp, Homo sapien
gagacattagttccccacggagaag

SEQ ID NO: 272533 - DNA, 25 bp, Homo sapien
attagttccccacggagaagggatg

SEQ ID NO: 272534 - DNA, 25 bp, Homo sapien
agaagggatggatagtctgtgcttc

SEQ ID NO: 272535 - DNA, 25 bp, Homo sapien
tgcaggtgctggtacctccttaggt

SEQ ID NO: 272536 - DNA, 25 bp, Homo sapien
ggtgctggtacctccttaggtctgg

SEQ ID NO: 272537 - DNA, 25 bp, Homo sapien
ctcctctgtagagtgaaagactata

SEQ ID NO: 272538 - DNA, 25 bp, Homo sapien
ctcttatgacctctgtgcaaagact

SEQ ID NO: 272539 - DNA, 25 bp, Homo sapien
tatgacctctgtgcaaagactggga

SEQ ID NO: 272540 - DNA, 25 bp, Homo sapien
cccacaccagatcctgagagtgaga

SEQ ID NO: 272541 - DNA, 25 bp, Homo sapien
acaccagatcctgagagtgagaagc

SEQ ID NO: 272542 - DNA, 25 bp, Homo sapien
agagtgagaagcctgactgaccccg

SEQ ID NO: 272543 - DNA, 25 bp, Homo sapien
gagtgagaagcctgactgaccccgc

SEQ ID NO: 272544 - DNA, 25 bp, Homo sapien
gtgagaagcctgactgaccccgcct

SEQ ID NO: 272545 - DNA, 25 bp, Homo sapien
gagaagcctgactgaccccgcctag

SEQ ID NO: 272546 - DNA, 25 bp, Homo sapien
gactgaccccgcctagacgccaggc

SEQ ID NO: 272547 - DNA, 25 bp, Homo sapien
agacgccaggcccacttcacgccgt

SEQ ID NO: 272548 - DNA, 25 bp, Homo sapien
taagtggagaagtgacggaccctca

SEQ ID NO: 272549 - DNA, 25 bp, Homo sapien
aagtggagaagtgacggaccctcag

SEQ ID NO: 272550 - DNA, 25 bp, Homo sapien
gtggagaagtgacggaccctcaggg

SEQ ID NO: 272551 - DNA, 25 bp, Homo sapien
gttggagttttggatactgatcata

SEQ ID NO: 272552 - DNA, 25 bp, Homo sapien
ggacaagtgcttacaatctgctcaa

SEQ ID NO: 272553 - DNA, 25 bp, Homo sapien
gtgcttacaatctgctcaagcaatt

SEQ ID NO: 272554 - DNA, 25 bp, Homo sapien
gctcaagcaattgtttttcagatat

SEQ ID NO: 272555 - DNA, 25 bp, Homo sapien
ggaattcagcaaagagtgacctctc

SEQ ID NO: 272556 - DNA, 25 bp, Homo sapien
agcaaagagtgacctctctggccat

SEQ ID NO: 272557 - DNA, 25 bp, Homo sapien
agtgacctctctggccattctaaaa

SEQ ID NO: 272558 - DNA, 25 bp, Homo sapien
tctctggccattctaaaactttaat

SEQ ID NO: 272559 - DNA, 25 bp, Homo sapien
aatgttgtgtcctaaatctggtgga

SEQ ID NO: 272560 - DNA, 25 bp, Homo sapien
gaaaagcatgcgctgttgaaccaag

SEQ ID NO: 272561 - DNA, 25 bp, Homo sapien
gttgaaccaagctgctcactgtaca

SEQ ID NO: 272562 - DNA, 25 bp, Homo sapien
tgaacattttccagagtcaaagatt

SEQ ID NO: 272563 - DNA, 25 bp, Homo sapien
ttttctttttatatcacctacagta

SEQ ID NO: 272564 - DNA, 25 bp, Homo sapien
tcacctacagtactacctaacctta

SEQ ID NO: 272565 - DNA, 25 bp, Homo sapien
acacattttagggtatcaaggcaga

SEQ ID NO: 272566 - DNA, 25 bp, Homo sapien
gaaaaagctatccaccagcatttag

SEQ ID NO: 272567 - DNA, 25 bp, Homo sapien
accagcatttagtttctcccagaag

SEQ ID NO: 272568 - DNA, 25 bp, Homo sapien
tttagtttctcccagaagtctgcta

SEQ ID NO: 272569 - DNA, 25 bp, Homo sapien
gtttctcccagaagtctgctaagga

SEQ ID NO: 272570 - DNA, 25 bp, Homo sapien
ccagaagtctgctaaggaacatcaa

SEQ ID NO: 272571 - DNA, 25 bp, Homo sapien
ggaacatcaaaacaacctctcttgt

SEQ ID NO: 272572 - DNA, 25 bp, Homo sapien
aaacaacctctcttgtcctcatttt

SEQ ID NO: 272573 - DNA, 25 bp, Homo sapien
tcttttcccaggctctaacactctt

SEQ ID NO: 272574 - DNA, 25 bp, Homo sapien
taacactcttcttgggtcctcagtg

SEQ ID NO: 272575 - DNA, 25 bp, Homo sapien
gtcctcagtgtagcaccgtgggaga

SEQ ID NO: 272576 - DNA, 25 bp, Homo sapien
gtgggagaagttcttgccctttcag

SEQ ID NO: 272577 - DNA, 25 bp, Homo sapien
gccctttcagctcagaagactcatt

SEQ ID NO: 272578 - DNA, 25 bp, Homo sapien
gatagatgcaccactggcatttgct

SEQ ID NO: 272579 - DNA, 25 bp, Homo sapien
agaaaactcatgtctgcctggtatg

SEQ ID NO: 272580 - DNA, 25 bp, Homo sapien
ctgcctggtatggtggcttgtatct

SEQ ID NO: 272581 - DNA, 25 bp, Homo sapien
ctttatgatagctctccttggtgct

SEQ ID NO: 272582 - DNA, 25 bp, Homo sapien
gcttgtatctgcagttccagctatt

SEQ ID NO: 272583 - DNA, 25 bp, Homo sapien
ggaagcaaatatccctctcttttcc

SEQ ID NO: 272584 - DNA, 25 bp, Homo sapien
tactctgggctgctgaacactggtg

SEQ ID NO: 272585 - DNA, 25 bp, Homo sapien
acactggtgctgtggtggttttcaa

SEQ ID NO: 272586 - DNA, 25 bp, Homo sapien
ttaattcctaggctaaccgtatggc

SEQ ID NO: 272587 - DNA, 25 bp, Homo sapien
taggctaaccgtatggcctatagtt

SEQ ID NO: 272588 - DNA, 25 bp, Homo sapien
aaagcacatctatgttcactgccac

SEQ ID NO: 272589 - DNA, 25 bp, Homo sapien
gttcactgccactctgaaaaaggga

SEQ ID NO: 272590 - DNA, 25 bp, Homo sapien
tatttctcagtctttcaaggcttga

SEQ ID NO: 272591 - DNA, 25 bp, Homo sapien
ttcaaggcttgagactaatataggc

SEQ ID NO: 272592 - DNA, 25 bp, Homo sapien
ctaatataggccattgtgattcagg

SEQ ID NO: 272593 - DNA, 25 bp, Homo sapien
gtgggatgagtaccctctgaaaaag

SEQ ID NO: 272594 - DNA, 25 bp, Homo sapien
ggctggatcttgtggaagactgtct

SEQ ID NO: 272595 - DNA, 25 bp, Homo sapien
gcctcatattgtggcaaggatcaaa

SEQ ID NO: 272596 - DNA, 25 bp, Homo sapien
caacacctagtgcaattctttttac

SEQ ID NO: 272597 - DNA, 25 bp, Homo sapien
gtgcaattctttttacacattaggt

SEQ ID NO: 272598 - DNA, 25 bp, Homo sapien
attgtgttgaactaacctggcggta

SEQ ID NO: 272599 - DNA, 25 bp, Homo sapien
ctaacctggcggtataggcaaaatt

SEQ ID NO: 272600 - DNA, 25 bp, Homo sapien
gaaagtcttgacttcctcttatctc

SEQ ID NO: 272601 - DNA, 25 bp, Homo sapien
cttgacttcctcttatctctaagta

SEQ ID NO: 272602 - DNA, 25 bp, Homo sapien
atctctaagtaattggcatgtcctc

SEQ ID NO: 272603 - DNA, 25 bp, Homo sapien
aactcattactttatgttacttatg

SEQ ID NO: 272604 - DNA, 25 bp, Homo sapien
gttacttatgggaacctcatctaaa

SEQ ID NO: 272605 - DNA, 25 bp, Homo sapien
aaagcaaggatcctgatacctgcct

SEQ ID NO: 272606 - DNA, 25 bp, Homo sapien
ccaccatactttccctcactgtctt

SEQ ID NO: 272607 - DNA, 25 bp, Homo sapien
cactgtcttcgccatctggaacagc

SEQ ID NO: 272608 - DNA, 25 bp, Homo sapien
tgtcttcgccatctggaacagcctg

SEQ ID NO: 272609 - DNA, 25 bp, Homo sapien
gtcttcgccatctggaacagcctgg

SEQ ID NO: 272610 - DNA, 25 bp, Homo sapien
tcccccaacagcgtttgacttgtta

SEQ ID NO: 272611 - DNA, 25 bp, Homo sapien
gcaacaagggacaaaggagttcacc

SEQ ID NO: 272612 - DNA, 25 bp, Homo sapien
ggacaaaggagttcaccttccccat

SEQ ID NO: 272613 - DNA, 25 bp, Homo sapien
acaaaggagttcaccttccccatgc

SEQ ID NO: 272614 - DNA, 25 bp, Homo sapien
ccgaacctctgtcctggactggagc

SEQ ID NO: 272615 - DNA, 25 bp, Homo sapien
agcatgcccactgcgcacaggggga

SEQ ID NO: 272616 - DNA, 25 bp, Homo sapien
gtctggcaccgccaagaggtccctg

SEQ ID NO: 272617 - DNA, 25 bp, Homo sapien
gccgcatggcccctccaggaacatt

SEQ ID NO: 272618 - DNA, 25 bp, Homo sapien
attcccacataatacattccatcac

SEQ ID NO: 272619 - DNA, 25 bp, Homo sapien
ttcccacataatacattccatcaca

SEQ ID NO: 272620 - DNA, 25 bp, Homo sapien
tcccacataatacattccatcacag

SEQ ID NO: 272621 - DNA, 25 bp, Homo sapien
cccacataatacattccatcacagc

SEQ ID NO: 272622 - DNA, 25 bp, Homo sapien
ccacataatacattccatcacagcc

SEQ ID NO: 272623 - DNA, 25 bp, Homo sapien
cacataatacattccatcacagcca

SEQ ID NO: 272624 - DNA, 25 bp, Homo sapien
acataatacattccatcacagccag

SEQ ID NO: 272625 - DNA, 25 bp, Homo sapien
cataatacattccatcacagccagc

SEQ ID NO: 272626 - DNA, 25 bp, Homo sapien
ataatacattccatcacagccagcc

SEQ ID NO: 272627 - DNA, 25 bp, Homo sapien
agcccagctccactcagggctggcc

SEQ ID NO: 272628 - DNA, 25 bp, Homo sapien
taatctgtgcagaaagagtaatctt

SEQ ID NO: 272629 - DNA, 25 bp, Homo sapien
gagtaatcttgctcttcaccatcat

SEQ ID NO: 272630 - DNA, 25 bp, Homo sapien
atcttgctcttcaccatcataatgt

SEQ ID NO: 272631 - DNA, 25 bp, Homo sapien
gtgtattttataccatctgccatag

SEQ ID NO: 272632 - DNA, 25 bp, Homo sapien
tctgccatagatattgaacatacca

SEQ ID NO: 272633 - DNA, 25 bp, Homo sapien
acataccatcagcacaattctactc

SEQ ID NO: 272634 - DNA, 25 bp, Homo sapien
ttccaaaatcaaccgaaggcctgaa

SEQ ID NO: 272635 - DNA, 25 bp, Homo sapien
ggcctgaaacctggtaagcacagtc

SEQ ID NO: 272636 - DNA, 25 bp, Homo sapien
ttcaaaaccaactggactccaaagg

SEQ ID NO: 272637 - DNA, 25 bp, Homo sapien
ggactccaaaggtcacactaaccta

SEQ ID NO: 272638 - DNA, 25 bp, Homo sapien
acactaacctagtgcatttacctag

SEQ ID NO: 272639 - DNA, 25 bp, Homo sapien
ggagagcccggcgtggaccagcgtg

SEQ ID NO: 272640 - DNA, 25 bp, Homo sapien
tggaccagcgtgacgaccccagcgt

SEQ ID NO: 272641 - DNA, 25 bp, Homo sapien
gcgtgacgaccccagcgtgctgcgg

SEQ ID NO: 272642 - DNA, 25 bp, Homo sapien
ctccacaagggtccctgcgcgggcc

SEQ ID NO: 272643 - DNA, 25 bp, Homo sapien
ggccgttgccactcgggacagccat

SEQ ID NO: 272644 - DNA, 25 bp, Homo sapien
tcgggacagccatcccctcgagttc

SEQ ID NO: 272645 - DNA, 25 bp, Homo sapien
tcccgggttgggaggcgggcgactg

SEQ ID NO: 272646 - DNA, 25 bp, Homo sapien
gactgcgcgcgaggtaaaggaactt

SEQ ID NO: 272647 - DNA, 25 bp, Homo sapien
ctgcgcgcgaggtaaaggaacttgc

SEQ ID NO: 272648 - DNA, 25 bp, Homo sapien
gcgcgaggtaaaggaacttgcgttc

SEQ ID NO: 272649 - DNA, 25 bp, Homo sapien
gggtccgaatcgcacgcggccgggt

SEQ ID NO: 272650 - DNA, 25 bp, Homo sapien
gcagtcatctatgttacatctatcc

SEQ ID NO: 272651 - DNA, 25 bp, Homo sapien
tacatctatcctgcctaagaaaaag

SEQ ID NO: 272652 - DNA, 25 bp, Homo sapien
agaaaaagctgcacatcctaccttc

SEQ ID NO: 272653 - DNA, 25 bp, Homo sapien
gcacatcctaccttcagagtacaaa

SEQ ID NO: 272654 - DNA, 25 bp, Homo sapien
aaaaggtacatctgagactcaagac

SEQ ID NO: 272655 - DNA, 25 bp, Homo sapien
agactcaagactctcactgattgga

SEQ ID NO: 272656 - DNA, 25 bp, Homo sapien
aacagcattatggtgaggcagagac

SEQ ID NO: 272657 - DNA, 25 bp, Homo sapien
ctgattggagagcttgtggaaaaca

SEQ ID NO: 272658 - DNA, 25 bp, Homo sapien
aaaacacaccatgccaataaatgag

SEQ ID NO: 272659 - DNA, 25 bp, Homo sapien
tttctgcctcttttttatgcagtca

SEQ ID NO: 272660 - DNA, 25 bp, Homo sapien
gcctcttttttatgcagtcatctat

SEQ ID NO: 272661 - DNA, 25 bp, Homo sapien
ccacagccttaattatttcagtgtc

SEQ ID NO: 272662 - DNA, 25 bp, Homo sapien
ttatttcagtgtcttgctggtctgc

SEQ ID NO: 272663 - DNA, 25 bp, Homo sapien
gtcttgctggtctgccttaagtgta

SEQ ID NO: 272664 - DNA, 25 bp, Homo sapien
caaagggccttattcataagtggac

SEQ ID NO: 272665 - DNA, 25 bp, Homo sapien
gccttaagtgtatcttctgggtttt

SEQ ID NO: 272666 - DNA, 25 bp, Homo sapien
gtatgcacacaatgtcgttttgtaa

SEQ ID NO: 272667 - DNA, 25 bp, Homo sapien
ataagtggacaggtttccccatagg

SEQ ID NO: 272668 - DNA, 25 bp, Homo sapien
gacaggtttccccatagggaccatc

SEQ ID NO: 272669 - DNA, 25 bp, Homo sapien
tagggaccatcgcacatatacatat

SEQ ID NO: 272670 - DNA, 25 bp, Homo sapien
aagtacatacttccatcaggcttgt

SEQ ID NO: 272671 - DNA, 25 bp, Homo sapien
acttccatcaggcttgtaacaattg

SEQ ID NO: 272672 - DNA, 25 bp, Homo sapien
tttaagacatattggggctgggcgc

SEQ ID NO: 272673 - DNA, 25 bp, Homo sapien
ttaagacatattggggctgggcgca

SEQ ID NO: 272674 - DNA, 25 bp, Homo sapien
taagacatattggggctgggcgcag

SEQ ID NO: 272675 - DNA, 25 bp, Homo sapien
aagacatattggggctgggcgcagt

SEQ ID NO: 272676 - DNA, 25 bp, Homo sapien
agacatattggggctgggcgcagtg

SEQ ID NO: 272677 - DNA, 25 bp, Homo sapien
gacatattggggctgggcgcagtgg

SEQ ID NO: 272678 - DNA, 25 bp, Homo sapien
tgactaacatgctgaaaccccatgt

SEQ ID NO: 272679 - DNA, 25 bp, Homo sapien
gactaacatgctgaaaccccatgtc

SEQ ID NO: 272680 - DNA, 25 bp, Homo sapien
actaacatgctgaaaccccatgtct

SEQ ID NO: 272681 - DNA, 25 bp, Homo sapien
gctgaaaccccatgtctactaaaga

SEQ ID NO: 272682 - DNA, 25 bp, Homo sapien
gccgagatcacgccattgcattcta

SEQ ID NO: 272683 - DNA, 25 bp, Homo sapien
tattgccacagcctattgtataaac

SEQ ID NO: 272684 - DNA, 25 bp, Homo sapien
gccacagcctattgtataaactatg

SEQ ID NO: 272685 - DNA, 25 bp, Homo sapien
tgtaaaatattagccaatgttgtca

SEQ ID NO: 272686 - DNA, 25 bp, Homo sapien
tgatgtatttccttggttatgacca

SEQ ID NO: 272687 - DNA, 25 bp, Homo sapien
gatactgaaactaatgtctgtgtgt

SEQ ID NO: 272688 - DNA, 25 bp, Homo sapien
actaatgtctgtgtgtttaaatgtt

SEQ ID NO: 272689 - DNA, 25 bp, Homo sapien
aaatgtttaccagcaaattgtctta

SEQ ID NO: 272690 - DNA, 25 bp, Homo sapien
gcaaattgtcttatcatgttaatga

SEQ ID NO: 272691 - DNA, 25 bp, Homo sapien
gagaatgttcaatgcctgtgtggta

SEQ ID NO: 272692 - DNA, 25 bp, Homo sapien
caatgcctgtgtggtaaatagtaaa

SEQ ID NO: 272693 - DNA, 25 bp, Homo sapien
ggcataaaagtaactttctctgaag

SEQ ID NO: 272694 - DNA, 25 bp, Homo sapien
ggagctcatcagattagcactgtgg

SEQ ID NO: 272695 - DNA, 25 bp, Homo sapien
gggcatctggctttagcacatttcc

SEQ ID NO: 272696 - DNA, 25 bp, Homo sapien
agcacatttccctaatggagtagaa

SEQ ID NO: 272697 - DNA, 25 bp, Homo sapien
gaaaatggacagacttgactaggaa

SEQ ID NO: 272698 - DNA, 25 bp, Homo sapien
gactaggaagctccactgagcagga

SEQ ID NO: 272699 - DNA, 25 bp, Homo sapien
gagccaaaaactctccatacctgga

SEQ ID NO: 272700 - DNA, 25 bp, Homo sapien
aaaggtatgctctagcttgggaaat

SEQ ID NO: 272701 - DNA, 25 bp, Homo sapien
aactctccatacctggatggtaagg

SEQ ID NO: 272702 - DNA, 25 bp, Homo sapien
tttctcatggtgattgcttatagca

SEQ ID NO: 272703 - DNA, 25 bp, Homo sapien
attgcttatagcaagtccactcccc

SEQ ID NO: 272704 - DNA, 25 bp, Homo sapien
agcagacatgcatcttggagctcat

SEQ ID NO: 272705 - DNA, 25 bp, Homo sapien
caacaagttcccgtgattgcagtaa

SEQ ID NO: 272706 - DNA, 25 bp, Homo sapien
agttcccgtgattgcagtaaaaata

SEQ ID NO: 272707 - DNA, 25 bp, Homo sapien
gaattgaagacttagccagtcagat

SEQ ID NO: 272708 - DNA, 25 bp, Homo sapien
cttagccagtcagataagttttttc

SEQ ID NO: 272709 - DNA, 25 bp, Homo sapien
ctgagccaaagtgattatgcattct

SEQ ID NO: 272710 - DNA, 25 bp, Homo sapien
ttatgcattcttcatctattttagt

SEQ ID NO: 272711 - DNA, 25 bp, Homo sapien
tttagttagcactttgtatcgttat

SEQ ID NO: 272712 - DNA, 25 bp, Homo sapien
caatacatgtataacttgtagctat

SEQ ID NO: 272713 - DNA, 25 bp, Homo sapien
gtagctataaacattttgtgccatt

SEQ ID NO: 272714 - DNA, 25 bp, Homo sapien
acattttgtgccattaaagctctca

SEQ ID NO: 272715 - DNA, 25 bp, Homo sapien
ttgtgccattaaagctctcacaaaa

SEQ ID NO: 272716 - DNA, 25 bp, Homo sapien
actggcttcgggactgcaaaccctt

SEQ ID NO: 272717 - DNA, 25 bp, Homo sapien
tcgggactgcaaaccctttgctgat

SEQ ID NO: 272718 - DNA, 25 bp, Homo sapien
gcaaaccctttgctgatgccttctg

SEQ ID NO: 272719 - DNA, 25 bp, Homo sapien
gctgatgccttctgcgtggatgtgc

SEQ ID NO: 272720 - DNA, 25 bp, Homo sapien
gcgtcacctctctgctactctggtg

SEQ ID NO: 272721 - DNA, 25 bp, Homo sapien
tgctactctggtgctgcgctggttc

SEQ ID NO: 272722 - DNA, 25 bp, Homo sapien
ggtgctgcgctggttccagtcgcat

SEQ ID NO: 272723 - DNA, 25 bp, Homo sapien
tggttccagtcgcatctgcagcgct

SEQ ID NO: 272724 - DNA, 25 bp, Homo sapien
agtcgcatctgcagcgctccttggc

SEQ ID NO: 272725 - DNA, 25 bp, Homo sapien
gctccttggccactgtgcgttacag

SEQ ID NO: 272726 - DNA, 25 bp, Homo sapien
gccactgtgcgttacagcctggagg

SEQ ID NO: 272727 - DNA, 25 bp, Homo sapien
tctccgcagggcatggcatttccac

SEQ ID NO: 272728 - DNA, 25 bp, Homo sapien
agggcatggcatttccacgcctcca

SEQ ID NO: 272729 - DNA, 25 bp, Homo sapien
acaatctgctccaccgggatgagtg

SEQ ID NO: 272730 - DNA, 25 bp, Homo sapien
gctccaccgggatgagtggttcctg

SEQ ID NO: 272731 - DNA, 25 bp, Homo sapien
atgagtggttcctgccggttctgct

SEQ ID NO: 272732 - DNA, 25 bp, Homo sapien
gagtcccggcgttggatcatttgaa

SEQ ID NO: 272733 - DNA, 25 bp, Homo sapien
gggccagcaaggctagtctcagctc

SEQ ID NO: 272734 - DNA, 25 bp, Homo sapien
tagtctcagctctttcaccaccggg

SEQ ID NO: 272735 - DNA, 25 bp, Homo sapien
ggatcatttgaaggacaggtccaga

SEQ ID NO: 272736 - DNA, 25 bp, Homo sapien
gacaggtccagaaagcggtgatgct

SEQ ID NO: 272737 - DNA, 25 bp, Homo sapien
tccagaaagcggtgatgctcccggg

SEQ ID NO: 272738 - DNA, 25 bp, Homo sapien
tgaccatatggtcacagatccagaa

SEQ ID NO: 272739 - DNA, 25 bp, Homo sapien
gatccagaagccagacgtctgtggg

SEQ ID NO: 272740 - DNA, 25 bp, Homo sapien
ttgctcctgagactgtgacctttga

SEQ ID NO: 272741 - DNA, 25 bp, Homo sapien
gagactgtgacctttgattcctgca

SEQ ID NO: 272742 - DNA, 25 bp, Homo sapien
ggtctgcgcctgtgactgagtgaaa

SEQ ID NO: 272743 - DNA, 25 bp, Homo sapien
gaaaatcgtcataactgtactcgga

SEQ ID NO: 272744 - DNA, 25 bp, Homo sapien
tgtactcggaggttaactctggcat

SEQ ID NO: 272745 - DNA, 25 bp, Homo sapien
aactctggcatgactgggatggaat

SEQ ID NO: 272746 - DNA, 25 bp, Homo sapien
ggatggaatcccaggcaacatgctg

SEQ ID NO: 272747 - DNA, 25 bp, Homo sapien
tcaacctgactgctctggaggttat

SEQ ID NO: 272748 - DNA, 25 bp, Homo sapien
tgtgcagagcaatctttgaccatat

SEQ ID NO: 272749 - DNA, 25 bp, Homo sapien
acttgcctgaggaagtagagctagc

SEQ ID NO: 272750 - DNA, 25 bp, Homo sapien
gtagagctagcaaaggacagtcaaa

SEQ ID NO: 272751 - DNA, 25 bp, Homo sapien
gacagtcaaaatctcccagtcctgt

SEQ ID NO: 272752 - DNA, 25 bp, Homo sapien
agtcctgtcctgttctgaagctcac

SEQ ID NO: 272753 - DNA, 25 bp, Homo sapien
gtcctgttctgaagctcacattcaa

SEQ ID NO: 272754 - DNA, 25 bp, Homo sapien
ttcaaaacaagactgcaccacggct

SEQ ID NO: 272755 - DNA, 25 bp, Homo sapien
tcctccccaggttaaagctacgact

SEQ ID NO: 272756 - DNA, 25 bp, Homo sapien
ggagagctcaccataggccaaacat

SEQ ID NO: 272757 - DNA, 25 bp, Homo sapien
ggccaaacattgagataagcacttt

SEQ ID NO: 272758 - DNA, 25 bp, Homo sapien
taagcactttatggagtcagctcct

SEQ ID NO: 272759 - DNA, 25 bp, Homo sapien
ttatggagtcagctccttcagcact

SEQ ID NO: 272760 - DNA, 25 bp, Homo sapien
cattgtgctgtgaccgctttgatca

SEQ ID NO: 272761 - DNA, 25 bp, Homo sapien
tgtgaccgctttgatcacctggcat

SEQ ID NO: 272762 - DNA, 25 bp, Homo sapien
tttggccttcctttaaaggacgctg

SEQ ID NO: 272763 - DNA, 25 bp, Homo sapien
ttaaaggacgctgcgctgtgttctg

SEQ ID NO: 272764 - DNA, 25 bp, Homo sapien
tgtgttctgcgtggagttcagctcc

SEQ ID NO: 272765 - DNA, 25 bp, Homo sapien
ttgctcttcactttggtcttcgtgt

SEQ ID NO: 272766 - DNA, 25 bp, Homo sapien
actttggtcttcgtgtggctggttc

SEQ ID NO: 272767 - DNA, 25 bp, Homo sapien
tttcctgcaggaagagtccagcccc

SEQ ID NO: 272768 - DNA, 25 bp, Homo sapien
gggtggctgccaacagcccaggatc

SEQ ID NO: 272769 - DNA, 25 bp, Homo sapien
tggcggttggaactcctgtctccca

SEQ ID NO: 272770 - DNA, 25 bp, Homo sapien
gaactcctgtctcccacctgtgggt

SEQ ID NO: 272771 - DNA, 25 bp, Homo sapien
tttaccctctttgcaagcccgaaag

SEQ ID NO: 272772 - DNA, 25 bp, Homo sapien
ttgcaagcccgaaagaatgactgat

SEQ ID NO: 272773 - DNA, 25 bp, Homo sapien
gaatgactgatcattgttcagacga

SEQ ID NO: 272774 - DNA, 25 bp, Homo sapien
ttgttcagacgattcgtttcccact

SEQ ID NO: 272775 - DNA, 25 bp, Homo sapien
attagccggtccttacaaggctctg

SEQ ID NO: 272776 - DNA, 25 bp, Homo sapien
tgaggtccggattatccccatttta

SEQ ID NO: 272777 - DNA, 25 bp, Homo sapien
cggtccgttggctgctgcttagcac

SEQ ID NO: 272778 - DNA, 25 bp, Homo sapien
ttggctgctgcttagcacctctaca

SEQ ID NO: 272779 - DNA, 25 bp, Homo sapien
ttagcacctctacagcacttttcgt

SEQ ID NO: 272780 - DNA, 25 bp, Homo sapien
tacagcacttttcgtcttcaaagcc

SEQ ID NO: 272781 - DNA, 25 bp, Homo sapien
tttcgtcttcaaagccttctacgga

SEQ ID NO: 272782 - DNA, 25 bp, Homo sapien
gcctgttgcgtgacaagggtgccct

SEQ ID NO: 272783 - DNA, 25 bp, Homo sapien
ccctggacaggctggcagaaagtca

SEQ ID NO: 272784 - DNA, 25 bp, Homo sapien
gcagaaagtcaagccagagacctaa

SEQ ID NO: 272785 - DNA, 25 bp, Homo sapien
aagttaccttgattgcctttgacaa

SEQ ID NO: 272786 - DNA, 25 bp, Homo sapien
gcctttgacaacactcaagtacttc

SEQ ID NO: 272787 - DNA, 25 bp, Homo sapien
aagtacttcattggcccttctgctg

SEQ ID NO: 272788 - DNA, 25 bp, Homo sapien
tgctgcagaacttgaacacgtggtt

SEQ ID NO: 272789 - DNA, 25 bp, Homo sapien
gaacacgtggttcttcaaatacagt

SEQ ID NO: 272790 - DNA, 25 bp, Homo sapien
gaagtaaagcctggcctttggctct

SEQ ID NO: 272791 - DNA, 25 bp, Homo sapien
tcaaatacagtactttcctcccaac

SEQ ID NO: 272792 - DNA, 25 bp, Homo sapien
gagctacaggcctgttgcgtgacaa

SEQ ID NO: 272793 - DNA, 25 bp, Homo sapien
ggtgccgtgatctctattgcattaa

SEQ ID NO: 272794 - DNA, 25 bp, Homo sapien
gaaacatcatgtggcttcccagggc

SEQ ID NO: 272795 - DNA, 25 bp, Homo sapien
gatttgagtccaggctcctactcca

SEQ ID NO: 272796 - DNA, 25 bp, Homo sapien
agtgctgacctttcccgtcactttc

SEQ ID NO: 272797 - DNA, 25 bp, Homo sapien
cagtgtgagctctatcctgtccaga

SEQ ID NO: 272798 - DNA, 25 bp, Homo sapien
tatcctgtccagagtcatgaagtat

SEQ ID NO: 272799 - DNA, 25 bp, Homo sapien
gcacatggatgtcttatagatgatc

SEQ ID NO: 272800 - DNA, 25 bp, Homo sapien
gatgatcttgtccaagtcattcatt

SEQ ID NO: 272801 - DNA, 25 bp, Homo sapien
gattataacaaaagtccctcacagg

SEQ ID NO: 272802 - DNA, 25 bp, Homo sapien
aagtccctcacaggagacaaagctg

SEQ ID NO: 272803 - DNA, 25 bp, Homo sapien
gacaaagctggtgccgtgatctcta

SEQ ID NO: 272804 - DNA, 25 bp, Homo sapien
taagaagaccttgagccacactgac

SEQ ID NO: 272805 - DNA, 25 bp, Homo sapien
cactgacccaatggtcttggatgat

SEQ ID NO: 272806 - DNA, 25 bp, Homo sapien
gatgattttggcactagcttaccct

SEQ ID NO: 272807 - DNA, 25 bp, Homo sapien
tagcttacccttcatcgatatctac

SEQ ID NO: 272808 - DNA, 25 bp, Homo sapien
ccttcatcgatatctacttttccac

SEQ ID NO: 272809 - DNA, 25 bp, Homo sapien
gacacaactgtccacaagcttcaag

SEQ ID NO: 272810 - DNA, 25 bp, Homo sapien
gagatcgtgcatgtgctgagcctaa

SEQ ID NO: 272811 - DNA, 25 bp, Homo sapien
tgctgagcctaatgctggaagactt

SEQ ID NO: 272812 - DNA, 25 bp, Homo sapien
gaagacttgccccaggagaagcccc

SEQ ID NO: 272813 - DNA, 25 bp, Homo sapien
cagcaggctgatgcacatacagata

SEQ ID NO: 272814 - DNA, 25 bp, Homo sapien
aatgctgactgcacaagtttcagtg

SEQ ID NO: 272815 - DNA, 25 bp, Homo sapien
gtttaagctacagagcattgttgta

SEQ ID NO: 272816 - DNA, 25 bp, Homo sapien
attgttgtagtggtgagggccctct

SEQ ID NO: 272817 - DNA, 25 bp, Homo sapien
gggctggaggagtatacatgattct

SEQ ID NO: 272818 - DNA, 25 bp, Homo sapien
ggagtatacatgattcttgtgttca

SEQ ID NO: 272819 - DNA, 25 bp, Homo sapien
gtgttcatgttgtcatttgaaactc

SEQ ID NO: 272820 - DNA, 25 bp, Homo sapien
atttggaaaacctctccactggaga

SEQ ID NO: 272821 - DNA, 25 bp, Homo sapien
cactggagaggtttcatctctgaga

SEQ ID NO: 272822 - DNA, 25 bp, Homo sapien
atctctgagaggttttgtaataata

SEQ ID NO: 272823 - DNA, 25 bp, Homo sapien
gtaagttcagtaaatccagtccaaa

SEQ ID NO: 272824 - DNA, 25 bp, Homo sapien
aatccagtccaaattctcatcacat

SEQ ID NO: 272825 - DNA, 25 bp, Homo sapien
gtccaaattctcatcacatgtatta

SEQ ID NO: 272826 - DNA, 25 bp, Homo sapien
aagctgggtctctttgttgctatgt

SEQ ID NO: 272827 - DNA, 25 bp, Homo sapien
agctgggtctctttgttgctatgtt

SEQ ID NO: 272828 - DNA, 25 bp, Homo sapien
tccggtgatgtgtttagggatcttc

SEQ ID NO: 272829 - DNA, 25 bp, Homo sapien
atgtgtttagggatcttctctgtgg

SEQ ID NO: 272830 - DNA, 25 bp, Homo sapien
gaagaggagggtcttgttctcccat

SEQ ID NO: 272831 - DNA, 25 bp, Homo sapien
agaggagggtcttgttctcccatct

SEQ ID NO: 272832 - DNA, 25 bp, Homo sapien
agggtcttgttctcccatctgttta

SEQ ID NO: 272833 - DNA, 25 bp, Homo sapien
gtcttgttctcccatctgtttattc

SEQ ID NO: 272834 - DNA, 25 bp, Homo sapien
tgttctcccatctgtttattctttg

SEQ ID NO: 272835 - DNA, 25 bp, Homo sapien
catctgtttattctttgggctctgg

SEQ ID NO: 272836 - DNA, 25 bp, Homo sapien
actactttggggctttctccagact

SEQ ID NO: 272837 - DNA, 25 bp, Homo sapien
gaaagcctgattgtatttgttgacc

SEQ ID NO: 272838 - DNA, 25 bp, Homo sapien
gtatttgttgaccttaaggaaagtg

SEQ ID NO: 272839 - DNA, 25 bp, Homo sapien
agggtgtgttcgctcacagaatgca

SEQ ID NO: 272840 - DNA, 25 bp, Homo sapien
gtgtgttcgctcacagaatgcaaat

SEQ ID NO: 272841 - DNA, 25 bp, Homo sapien
tttgaccccctaatctttcttctag

SEQ ID NO: 272842 - DNA, 25 bp, Homo sapien
ggagtttctcctacagataaactta

SEQ ID NO: 272843 - DNA, 25 bp, Homo sapien
gataaacttagaagggtgctcaaat

SEQ ID NO: 272844 - DNA, 25 bp, Homo sapien
agctgcaaggacacaccagagccac

SEQ ID NO: 272845 - DNA, 25 bp, Homo sapien
gcaaggacacaccagagccacagaa

SEQ ID NO: 272846 - DNA, 25 bp, Homo sapien
gagccacagaaactaaagagaattt

SEQ ID NO: 272847 - DNA, 25 bp, Homo sapien
gaatttccaaaaggagtctatggtg

SEQ ID NO: 272848 - DNA, 25 bp, Homo sapien
aagggtgagaccttgctcagcacga

SEQ ID NO: 272849 - DNA, 25 bp, Homo sapien
gagaccttgctcagcacgatagctg

SEQ ID NO: 272850 - DNA, 25 bp, Homo sapien
gagaacagcttcctccttcaatgct

SEQ ID NO: 272851 - DNA, 25 bp, Homo sapien
ctccttcaatgctggtctctctata

SEQ ID NO: 272852 - DNA, 25 bp, Homo sapien
gctggtctctctatactgacagttg

SEQ ID NO: 272853 - DNA, 25 bp, Homo sapien
agttgacagctgatgatcccacatt

SEQ ID NO: 272854 - DNA, 25 bp, Homo sapien
gatcccacattctcagtcatgcgaa

SEQ ID NO: 272855 - DNA, 25 bp, Homo sapien
tcatgcgaatgacctcacctgagca

SEQ ID NO: 272856 - DNA, 25 bp, Homo sapien
cctgagcaccagtttgtaacggatg

SEQ ID NO: 272857 - DNA, 25 bp, Homo sapien
aaatgctgcacaggaatttggcact

SEQ ID NO: 272858 - DNA, 25 bp, Homo sapien
ggaatttggcacttctgtatagaaa

SEQ ID NO: 272859 - DNA, 25 bp, Homo sapien
tactctgaagaccttatctaattct

SEQ ID NO: 272860 - DNA, 25 bp, Homo sapien
aagaccttatctaattctaattgga

SEQ ID NO: 272861 - DNA, 25 bp, Homo sapien
gtcataacatgctagcaggcatcac

SEQ ID NO: 272862 - DNA, 25 bp, Homo sapien
aatagggtcttgaagccctcatcac

SEQ ID NO: 272863 - DNA, 25 bp, Homo sapien
agccctcatcactagaggtaacctt

SEQ ID NO: 272864 - DNA, 25 bp, Homo sapien
gtaacctttaacaggaagagagaat

SEQ ID NO: 272865 - DNA, 25 bp, Homo sapien
ttataatgcagcaccaaatccctcc

SEQ ID NO: 272866 - DNA, 25 bp, Homo sapien
ccctacttgtgaatagtcaaggtca

SEQ ID NO: 272867 - DNA, 25 bp, Homo sapien
aggtcatttcatttacagacttgtt

SEQ ID NO: 272868 - DNA, 25 bp, Homo sapien
aggcatcacagagcaaatgcactac

SEQ ID NO: 272869 - DNA, 25 bp, Homo sapien
agcaaatgcactacctcagatctct

SEQ ID NO: 272870 - DNA, 25 bp, Homo sapien
ttagctgaatgattccttagcgata

SEQ ID NO: 272871 - DNA, 25 bp, Homo sapien
tagcgatataggtaggagtccacaa

SEQ ID NO: 272872 - DNA, 25 bp, Homo sapien
ggagtccacaaaaatctatgaaaat

SEQ ID NO: 272873 - DNA, 25 bp, Homo sapien
ataaactcccttaatagtgataaag

SEQ ID NO: 272874 - DNA, 25 bp, Homo sapien
aagagctcctcttgactaaataagt

SEQ ID NO: 272875 - DNA, 25 bp, Homo sapien
taagtcatcctaacatggagttcaa

SEQ ID NO: 272876 - DNA, 25 bp, Homo sapien
tggagttcaagttttcacaatcgct

SEQ ID NO: 272877 - DNA, 25 bp, Homo sapien
aagttttcacaatcgcttttaacag

SEQ ID NO: 272878 - DNA, 25 bp, Homo sapien
agccagtgtggtccttgtaggccga

SEQ ID NO: 272879 - DNA, 25 bp, Homo sapien
gatgacagtatagctgacttgcaat

SEQ ID NO: 272880 - DNA, 25 bp, Homo sapien
gaaggcatttgcttatgttattagc

SEQ ID NO: 272881 - DNA, 25 bp, Homo sapien
gtcggccggtcctctaccaggtggt

SEQ ID NO: 272882 - DNA, 25 bp, Homo sapien
cggtcctctaccaggtggtggccca

SEQ ID NO: 272883 - DNA, 25 bp, Homo sapien
ggccagaggacctgggcttccgaca

SEQ ID NO: 272884 - DNA, 25 bp, Homo sapien
tggagggccactgtgacggccgcat

SEQ ID NO: 272885 - DNA, 25 bp, Homo sapien
tgtgacggccgcatcggcatcttcc

SEQ ID NO: 272886 - DNA, 25 bp, Homo sapien
atcttccccaagtgcttcgtggtcc

SEQ ID NO: 272887 - DNA, 25 bp, Homo sapien
gccggccctcggatgtcaggagccc

SEQ ID NO: 272888 - DNA, 25 bp, Homo sapien
gatcccagcagggagatcagcccta

SEQ ID NO: 272889 - DNA, 25 bp, Homo sapien
gggagatcagccctaatgatgctgt

SEQ ID NO: 272890 - DNA, 25 bp, Homo sapien
gatcagccctaatgatgctgtgtcc

SEQ ID NO: 272891 - DNA, 25 bp, Homo sapien
cagccctaatgatgctgtgtccatg

SEQ ID NO: 272892 - DNA, 25 bp, Homo sapien
tgtctttatacttttcatttctcaa

SEQ ID NO: 272893 - DNA, 25 bp, Homo sapien
cagtctaccaaatgagttaaatcgt

SEQ ID NO: 272894 - DNA, 25 bp, Homo sapien
gagttaaatcgttacagtcgtgtct

SEQ ID NO: 272895 - DNA, 25 bp, Homo sapien
aaatcgttacagtcgtgtctacctc

SEQ ID NO: 272896 - DNA, 25 bp, Homo sapien
gttacagtcgtgtctacctcttatt

SEQ ID NO: 272897 - DNA, 25 bp, Homo sapien
tacagtcgtgtctacctcttatttt

SEQ ID NO: 272898 - DNA, 25 bp, Homo sapien
agtcgtgtctacctcttatttttct

SEQ ID NO: 272899 - DNA, 25 bp, Homo sapien
tctgtatttaggctgctgttttggt

SEQ ID NO: 272900 - DNA, 25 bp, Homo sapien
taggctgctgttttggtgagattct

SEQ ID NO: 272901 - DNA, 25 bp, Homo sapien
gctgctgttttggtgagattctaat

SEQ ID NO: 272902 - DNA, 25 bp, Homo sapien
gttttggtgagattctaatttcttt

SEQ ID NO: 272903 - DNA, 25 bp, Homo sapien
cagagccttgtaaggaccggctaat

SEQ ID NO: 272904 - DNA, 25 bp, Homo sapien
gaccggctaatgagggcaggcgagt

SEQ ID NO: 272905 - DNA, 25 bp, Homo sapien
caggcgagtgggaaacgaatcgtct

SEQ ID NO: 272906 - DNA, 25 bp, Homo sapien
gaatcgtctgaacaatgatcagtca

SEQ ID NO: 272907 - DNA, 25 bp, Homo sapien
ttctttcgggcttgcaaagagggta

SEQ ID NO: 272908 - DNA, 25 bp, Homo sapien
tagaccgaaggcagctttggtgact

SEQ ID NO: 272909 - DNA, 25 bp, Homo sapien
gaaggcagctttggtgactccactt

SEQ ID NO: 272910 - DNA, 25 bp, Homo sapien
gctttggtgactccacttcttttta

SEQ ID NO: 272911 - DNA, 25 bp, Homo sapien
tcctctgccctctgactttaagtga

SEQ ID NO: 272912 - DNA, 25 bp, Homo sapien
gccctctgactttaagtgacaggca

SEQ ID NO: 272913 - DNA, 25 bp, Homo sapien
taagtgacaggcagttccctcccct

SEQ ID NO: 272914 - DNA, 25 bp, Homo sapien
attctgtttgtctgaaataagcctc

SEQ ID NO: 272915 - DNA, 25 bp, Homo sapien
ataagcctcagacatgataagtaca

SEQ ID NO: 272916 - DNA, 25 bp, Homo sapien
gataagtacaattacagaggttcaa

SEQ ID NO: 272917 - DNA, 25 bp, Homo sapien
tcaaagtcttaaacccgtgtgtcca

SEQ ID NO: 272918 - DNA, 25 bp, Homo sapien
agtcttaaacccgtgtgtccagagc

SEQ ID NO: 272919 - DNA, 25 bp, Homo sapien
tgtgtccagagccacttgtaccctt

SEQ ID NO: 272920 - DNA, 25 bp, Homo sapien
agagccacttgtacccttggtaatc

SEQ ID NO: 272921 - DNA, 25 bp, Homo sapien
acttgtacccttggtaatctgccta

SEQ ID NO: 272922 - DNA, 25 bp, Homo sapien
gtaatctgcctacctcctcatgagg

SEQ ID NO: 272923 - DNA, 25 bp, Homo sapien
ctcctcatgaggcattccaggttat

SEQ ID NO: 272924 - DNA, 25 bp, Homo sapien
catgaggcattccaggttattcctg

SEQ ID NO: 272925 - DNA, 25 bp, Homo sapien
tcctgtattgcctatttcaagtacc

SEQ ID NO: 272926 - DNA, 25 bp, Homo sapien
tgcctatttcaagtaccatccaaga

SEQ ID NO: 272927 - DNA, 25 bp, Homo sapien
tatttcaagtaccatccaagagcca

SEQ ID NO: 272928 - DNA, 25 bp, Homo sapien
atccaagagccatcctgagttcctc

SEQ ID NO: 272929 - DNA, 25 bp, Homo sapien
cttctcttgtctagttagtcagcaa

SEQ ID NO: 272930 - DNA, 25 bp, Homo sapien
gtctagttagtcagcaagtcttgca

SEQ ID NO: 272931 - DNA, 25 bp, Homo sapien
ctgcctcctcacctgaagttttcaa

SEQ ID NO: 272932 - DNA, 25 bp, Homo sapien
caaacagtacccctttacattcttg

SEQ ID NO: 272933 - DNA, 25 bp, Homo sapien
gaacttctgttatatgggttatagc

SEQ ID NO: 272934 - DNA, 25 bp, Homo sapien
gggttatagctgttaatatttgtca

SEQ ID NO: 272935 - DNA, 25 bp, Homo sapien
aaaaccattgtattttgacatgaat

SEQ ID NO: 272936 - DNA, 25 bp, Homo sapien
gtccctgttccagcattgactttac

SEQ ID NO: 272937 - DNA, 25 bp, Homo sapien
cctgttccagcattgactttactat

SEQ ID NO: 272938 - DNA, 25 bp, Homo sapien
gactttactatgtgacctcgagcaa

SEQ ID NO: 272939 - DNA, 25 bp, Homo sapien
tcagtttctccatatacaaaatggg

SEQ ID NO: 272940 - DNA, 25 bp, Homo sapien
taatgatactaaccattgcctacct

SEQ ID NO: 272941 - DNA, 25 bp, Homo sapien
ttgcctacctcatagagatgttatg

SEQ ID NO: 272942 - DNA, 25 bp, Homo sapien
aagcacgaatgctttcaactcttcg

SEQ ID NO: 272943 - DNA, 25 bp, Homo sapien
gaatgctttcaactcttcggaagaa

SEQ ID NO: 272944 - DNA, 25 bp, Homo sapien
gctttcaactcttcggaagaaaggt

SEQ ID NO: 272945 - DNA, 25 bp, Homo sapien
gaagttgtgtttttaatgatccaat

SEQ ID NO: 272946 - DNA, 25 bp, Homo sapien
acaatactgttagtcatgttaagaa

SEQ ID NO: 272947 - DNA, 25 bp, Homo sapien
gagtttaacattacttcctaagagc

SEQ ID NO: 272948 - DNA, 25 bp, Homo sapien
ttacttcctaagagctaagggcaaa

SEQ ID NO: 272949 - DNA, 25 bp, Homo sapien
aattctttactacataccgtgctag

SEQ ID NO: 272950 - DNA, 25 bp, Homo sapien
ctacataccgtgctagttgaagtgt

SEQ ID NO: 272951 - DNA, 25 bp, Homo sapien
tgctagttgaagtgttaggcctaac

SEQ ID NO: 272952 - DNA, 25 bp, Homo sapien
gtatgtaacctaaagtccctaccat

SEQ ID NO: 272953 - DNA, 25 bp, Homo sapien
aaagtccctaccataaatcatattg

SEQ ID NO: 272954 - DNA, 25 bp, Homo sapien
ttggtagacttatctgtcatggctt

SEQ ID NO: 272955 - DNA, 25 bp, Homo sapien
tgtcatggcttaagtcccctagtaa

SEQ ID NO: 272956 - DNA, 25 bp, Homo sapien
ggcttaagtcccctagtaaatcatt

SEQ ID NO: 272957 - DNA, 25 bp, Homo sapien
agtcccctagtaaatcattatcaag

SEQ ID NO: 272958 - DNA, 25 bp, Homo sapien
gctttccagaacgtgactcttgcaa

SEQ ID NO: 272959 - DNA, 25 bp, Homo sapien
gaacgtgactcttgcaaattatcaa

SEQ ID NO: 272960 - DNA, 25 bp, Homo sapien
gggaactaatctaagggatccagat

SEQ ID NO: 272961 - DNA, 25 bp, Homo sapien
ctaagggatccagatcaaacagcct

SEQ ID NO: 272962 - DNA, 25 bp, Homo sapien
acagcctcatgaagacttattttat

SEQ ID NO: 272963 - DNA, 25 bp, Homo sapien
agaaaagccctgctacacagaggat

SEQ ID NO: 272964 - DNA, 25 bp, Homo sapien
agccctgctacacagaggatcagag

SEQ ID NO: 272965 - DNA, 25 bp, Homo sapien
tttcccggaggcacggaaagtgagt

SEQ ID NO: 272966 - DNA, 25 bp, Homo sapien
gagtaaacaagtatctctacctgaa

SEQ ID NO: 272967 - DNA, 25 bp, Homo sapien
aagtatctctacctgaaatgattaa

SEQ ID NO: 272968 - DNA, 25 bp, Homo sapien
ttcctcatagctgctttccagaacg

SEQ ID NO: 272969 - DNA, 25 bp, Homo sapien
ggaaaggcagtatggcggaggccat

SEQ ID NO: 272970 - DNA, 25 bp, Homo sapien
gaaaggcagtatggcggaggccatg

SEQ ID NO: 272971 - DNA, 25 bp, Homo sapien
aaaggcagtatggcggaggccatgg

SEQ ID NO: 272972 - DNA, 25 bp, Homo sapien
ctggcctcccctgcggagctgcatg

SEQ ID NO: 272973 - DNA, 25 bp, Homo sapien
gcctcccctgcggagctgcatggac

SEQ ID NO: 272974 - DNA, 25 bp, Homo sapien
cctcccctgcggagctgcatggacg

SEQ ID NO: 272975 - DNA, 25 bp, Homo sapien
ctcccctgcggagctgcatggacgc

SEQ ID NO: 272976 - DNA, 25 bp, Homo sapien
tcccctgcggagctgcatggacgcc

SEQ ID NO: 272977 - DNA, 25 bp, Homo sapien
ctgcatggacgcctggctccaggct

SEQ ID NO: 272978 - DNA, 25 bp, Homo sapien
tgcatggacgcctggctccaggctc

SEQ ID NO: 272979 - DNA, 25 bp, Homo sapien
atggacgcctggctccaggctccag

SEQ ID NO: 272980 - DNA, 25 bp, Homo sapien
aaggcgtcacagtgagggcagaaaa

SEQ ID NO: 272981 - DNA, 25 bp, Homo sapien
gggcagaaaagacactcctcagatc

SEQ ID NO: 272982 - DNA, 25 bp, Homo sapien
aaagacactcctcagatcctggaag

SEQ ID NO: 272983 - DNA, 25 bp, Homo sapien
ctcagatcctggaagcagcaacctg

SEQ ID NO: 272984 - DNA, 25 bp, Homo sapien
gaagacaggatttgcagggacacac

SEQ ID NO: 272985 - DNA, 25 bp, Homo sapien
agaccaaatcatggccatctcagca

SEQ ID NO: 272986 - DNA, 25 bp, Homo sapien
gcagcagcgtgtgtgacagttactg

SEQ ID NO: 272987 - DNA, 25 bp, Homo sapien
ggatttgcagggacacacctatgag

SEQ ID NO: 272988 - DNA, 25 bp, Homo sapien
cgagaacctaatgccactctgagaa

SEQ ID NO: 272989 - DNA, 25 bp, Homo sapien
ctgagaaagctcagtacgggtgcaa

SEQ ID NO: 272990 - DNA, 25 bp, Homo sapien
gacacacctatgaggagggattccc

SEQ ID NO: 272991 - DNA, 25 bp, Homo sapien
atgggtctaattttgcctctcaacc

SEQ ID NO: 272992 - DNA, 25 bp, Homo sapien
ctctcaacctgtctttattgccaat

SEQ ID NO: 272993 - DNA, 25 bp, Homo sapien
tcaacctgtctttattgccaataaa

SEQ ID NO: 272994 - DNA, 25 bp, Homo sapien
gaaccttagaatatcatcttcatta

SEQ ID NO: 272995 - DNA, 25 bp, Homo sapien
tttatgttctatcatgattctccat

SEQ ID NO: 272996 - DNA, 25 bp, Homo sapien
gctgatgaaatccaacttcctcatt

SEQ ID NO: 272997 - DNA, 25 bp, Homo sapien
atccaacttcctcattttaccaatg

SEQ ID NO: 272998 - DNA, 25 bp, Homo sapien
aagacctagaggagtactgggaata

SEQ ID NO: 272999 - DNA, 25 bp, Homo sapien
gtactgggaatagccataggtgata

SEQ ID NO: 273000 - DNA, 25 bp, Homo sapien
gccataggtgatagaataggtaatt

SEQ ID NO: 273001 - DNA, 25 bp, Homo sapien
gatgatgatttactacttattacaa

SEQ ID NO: 273002 - DNA, 25 bp, Homo sapien
tttctctccccaagcacttttactg

SEQ ID NO: 273003 - DNA, 25 bp, Homo sapien
tctctccccaagcacttttactggt

SEQ ID NO: 273004 - DNA, 25 bp, Homo sapien
tctccccaagcacttttactggtga

SEQ ID NO: 273005 - DNA, 25 bp, Homo sapien
ctccccaagcacttttactggtgaa

SEQ ID NO: 273006 - DNA, 25 bp, Homo sapien
tccccaagcacttttactggtgaaa

SEQ ID NO: 273007 - DNA, 25 bp, Homo sapien
ccccaagcacttttactggtgaaat

SEQ ID NO: 273008 - DNA, 25 bp, Homo sapien
cccaagcacttttactggtgaaata

SEQ ID NO: 273009 - DNA, 25 bp, Homo sapien
atcaatatgtaaaaacggcccactt

SEQ ID NO: 273010 - DNA, 25 bp, Homo sapien
tcaatatgtaaaaacggcccacttc

SEQ ID NO: 273011 - DNA, 25 bp, Homo sapien
ttggcctgtggtttcccacccacta

SEQ ID NO: 273012 - DNA, 25 bp, Homo sapien
tgtggtttcccacccactatacaaa

SEQ ID NO: 273013 - DNA, 25 bp, Homo sapien
gaaaaaacactgcatttgggcacca

SEQ ID NO: 273014 - DNA, 25 bp, Homo sapien
aaaacactgcatttgggcaccatct

SEQ ID NO: 273015 - DNA, 25 bp, Homo sapien
aacactgcatttgggcaccatctca

SEQ ID NO: 273016 - DNA, 25 bp, Homo sapien
tcagctcccttgcatccaggtgcag

SEQ ID NO: 273017 - DNA, 25 bp, Homo sapien
ccaggtgcagcatggactgagttct

SEQ ID NO: 273018 - DNA, 25 bp, Homo sapien
cagcatggactgagttcttgacaac

SEQ ID NO: 273019 - DNA, 25 bp, Homo sapien
tggactgagttcttgacaacagaat

SEQ ID NO: 273020 - DNA, 25 bp, Homo sapien
acaacagaatgtggtcagaagtgac

SEQ ID NO: 273021 - DNA, 25 bp, Homo sapien
cagaagtgacatatgccaacacggg

SEQ ID NO: 273022 - DNA, 25 bp, Homo sapien
tttccttgcctatgagctggaacat

SEQ ID NO: 273023 - DNA, 25 bp, Homo sapien
gcctatgagctggaacataacacat

SEQ ID NO: 273024 - DNA, 25 bp, Homo sapien
catggattgttgatcatctgatgct

SEQ ID NO: 273025 - DNA, 25 bp, Homo sapien
tgatgctatgattctttcccaggca

SEQ ID NO: 273026 - DNA, 25 bp, Homo sapien
tttcccaggcaccacacctgttggt

SEQ ID NO: 273027 - DNA, 25 bp, Homo sapien
cacctgttggtgttcagatggagcg

SEQ ID NO: 273028 - DNA, 25 bp, Homo sapien
tggagcggcacactagtcatcctaa

SEQ ID NO: 273029 - DNA, 25 bp, Homo sapien
gtcatcctaacagaaaagttccagc

SEQ ID NO: 273030 - DNA, 25 bp, Homo sapien
aggaagctaatgctgtgcctctctg

SEQ ID NO: 273031 - DNA, 25 bp, Homo sapien
gtgcctctctgtagagcaaaaccct

SEQ ID NO: 273032 - DNA, 25 bp, Homo sapien
cccagctatattaatcttcaagcaa

SEQ ID NO: 273033 - DNA, 25 bp, Homo sapien
aacaggctgagatctgctggagaca

SEQ ID NO: 273034 - DNA, 25 bp, Homo sapien
tctgctggagacaacttaggaaatt

SEQ ID NO: 273035 - DNA, 25 bp, Homo sapien
gggtaagatgtccagtttctccagt

SEQ ID NO: 273036 - DNA, 25 bp, Homo sapien
taagatgtccagtttctccagtgta

SEQ ID NO: 273037 - DNA, 25 bp, Homo sapien
gtccagtttctccagtgtatcgtta

SEQ ID NO: 273038 - DNA, 25 bp, Homo sapien
agtttctccagtgtatcgttattgt

SEQ ID NO: 273039 - DNA, 25 bp, Homo sapien
ccagtgtatcgttattgtttttcct

SEQ ID NO: 273040 - DNA, 25 bp, Homo sapien
ttccttttgcaattagtgggtaatt

SEQ ID NO: 273041 - DNA, 25 bp, Homo sapien
aggagaaactttgagaccttgttga

SEQ ID NO: 273042 - DNA, 25 bp, Homo sapien
tgttgacaattctgttcctcatcaa

SEQ ID NO: 273043 - DNA, 25 bp, Homo sapien
aattctgttcctcatcaaatctacc

SEQ ID NO: 273044 - DNA, 25 bp, Homo sapien
aatctacccctcctaggtttagcat

SEQ ID NO: 273045 - DNA, 25 bp, Homo sapien
ggtttagcatcctttgacgattctt

SEQ ID NO: 273046 - DNA, 25 bp, Homo sapien
ggcaggaatgagagctggtgcggct

SEQ ID NO: 273047 - DNA, 25 bp, Homo sapien
accccttgaaccctgacatgggcgc

SEQ ID NO: 273048 - DNA, 25 bp, Homo sapien
gacatgggcgcccaaggattctccc

SEQ ID NO: 273049 - DNA, 25 bp, Homo sapien
aaggattctccccgcaggctcgcag

SEQ ID NO: 273050 - DNA, 25 bp, Homo sapien
agactcacctgatcaccgggcaagc

SEQ ID NO: 273051 - DNA, 25 bp, Homo sapien
ctggagctgtggaccctgtggtaac

SEQ ID NO: 273052 - DNA, 25 bp, Homo sapien
tgtggtaacctcagtgcccgtggct

SEQ ID NO: 273053 - DNA, 25 bp, Homo sapien
tggtaacctcagtgcccgtggctca

SEQ ID NO: 273054 - DNA, 25 bp, Homo sapien
gctcacgtcgtgtgccaggcagcag

SEQ ID NO: 273055 - DNA, 25 bp, Homo sapien
caggcagcagatggcggagggtgtc

SEQ ID NO: 273056 - DNA, 25 bp, Homo sapien
atggcggagggtgtcgggctcccct

SEQ ID NO: 273057 - DNA, 25 bp, Homo sapien
agaggaagcccggtcactgagcatc

SEQ ID NO: 273058 - DNA, 25 bp, Homo sapien
gtcactgagcatctacagagggcta

SEQ ID NO: 273059 - DNA, 25 bp, Homo sapien
ttgttattcccaatattctctgtat

SEQ ID NO: 273060 - DNA, 25 bp, Homo sapien
tgagggctagaaacatgcagtactt

SEQ ID NO: 273061 - DNA, 25 bp, Homo sapien
agctgaggtatgaatctgggtctgc

SEQ ID NO: 273062 - DNA, 25 bp, Homo sapien
gaatctgggtctgcctgactcaaag

SEQ ID NO: 273063 - DNA, 25 bp, Homo sapien
aaagcccaaacgctttcctttgcat

SEQ ID NO: 273064 - DNA, 25 bp, Homo sapien
gctttcctttgcatcgtgtcacaaa

SEQ ID NO: 273065 - DNA, 25 bp, Homo sapien
tcgtgtcacaaagtcatagaccatg

SEQ ID NO: 273066 - DNA, 25 bp, Homo sapien
atagaccatgacattgtttgtatct

SEQ ID NO: 273067 - DNA, 25 bp, Homo sapien
tgttatgggtctttcaactctggaa

SEQ ID NO: 273068 - DNA, 25 bp, Homo sapien
tttttctgaatatcgaaatccgttc

SEQ ID NO: 273069 - DNA, 25 bp, Homo sapien
cacatctgtccacggcaagcttttc

SEQ ID NO: 273070 - DNA, 25 bp, Homo sapien
ttcccggacacactcgggcctttga

SEQ ID NO: 273071 - DNA, 25 bp, Homo sapien
acacactcgggcctttgaaaatgcc

SEQ ID NO: 273072 - DNA, 25 bp, Homo sapien
gcctttgaaaatgcccacacttgtt

SEQ ID NO: 273073 - DNA, 25 bp, Homo sapien
cacttgttttcataaacccactcct

SEQ ID NO: 273074 - DNA, 25 bp, Homo sapien
tgttttcataaacccactccttcct

SEQ ID NO: 273075 - DNA, 25 bp, Homo sapien
acttgcaatccgcatgcttctctgg

SEQ ID NO: 273076 - DNA, 25 bp, Homo sapien
tctttccgaaccctagggccgacag

SEQ ID NO: 273077 - DNA, 25 bp, Homo sapien
tagggccgacagctcggtctctaac

SEQ ID NO: 273078 - DNA, 25 bp, Homo sapien
tccagcgcgccgaatcggagggaga

SEQ ID NO: 273079 - DNA, 25 bp, Homo sapien
gagagctgagcaacagtcatatcct

SEQ ID NO: 273080 - DNA, 25 bp, Homo sapien
gagctgagcaacagtcatatccttt

SEQ ID NO: 273081 - DNA, 25 bp, Homo sapien
ctgagcaacagtcatatcctttgat

SEQ ID NO: 273082 - DNA, 25 bp, Homo sapien
atcctttgatctaatgattccactg

SEQ ID NO: 273083 - DNA, 25 bp, Homo sapien
tgatctaatgattccactgatgaga

SEQ ID NO: 273084 - DNA, 25 bp, Homo sapien
gggaagaaagtcagcaacctgtagt

SEQ ID NO: 273085 - DNA, 25 bp, Homo sapien
aagtcagcaacctgtagttcatcac

SEQ ID NO: 273086 - DNA, 25 bp, Homo sapien
ggttacagaataaagtggacaatgc

SEQ ID NO: 273087 - DNA, 25 bp, Homo sapien
aataaagtggacaatgcttgtggaa

SEQ ID NO: 273088 - DNA, 25 bp, Homo sapien
ggaaatcaccttaagataacaacta

SEQ ID NO: 273089 - DNA, 25 bp, Homo sapien
agcctattaatttacatacacacag

SEQ ID NO: 273090 - DNA, 25 bp, Homo sapien
aggcaggactgcagatctatggaaa

SEQ ID NO: 273091 - DNA, 25 bp, Homo sapien
gcagatctatggaaattgcctggaa

SEQ ID NO: 273092 - DNA, 25 bp, Homo sapien
aattgcctggaagagtcagctgtaa

SEQ ID NO: 273093 - DNA, 25 bp, Homo sapien
agtcagctgtaagggatgagaatcc

SEQ ID NO: 273094 - DNA, 25 bp, Homo sapien
taacaagatcttaaacatgagtgag

SEQ ID NO: 273095 - DNA, 25 bp, Homo sapien
catgagtgagaatctgttgccccaa

SEQ ID NO: 273096 - DNA, 25 bp, Homo sapien
gagtgagaatctgttgccccaacct

SEQ ID NO: 273097 - DNA, 25 bp, Homo sapien
aatctgttgccccaacctaaggtga

SEQ ID NO: 273098 - DNA, 25 bp, Homo sapien
aatccaaggtaaaaaacacggcatg

SEQ ID NO: 273099 - DNA, 25 bp, Homo sapien
gcaacagtacaggaagttgggtaga

SEQ ID NO: 273100 - DNA, 25 bp, Homo sapien
caacagagagactgtggcagaggca

SEQ ID NO: 273101 - DNA, 25 bp, Homo sapien
caatgatcttcaagtatttgccact

SEQ ID NO: 273102 - DNA, 25 bp, Homo sapien
gtatttgccactttcgagtacagct

SEQ ID NO: 273103 - DNA, 25 bp, Homo sapien
cactttcgagtacagctaattggat

SEQ ID NO: 273104 - DNA, 25 bp, Homo sapien
ttggataatctcaaaccctttagtg

SEQ ID NO: 273105 - DNA, 25 bp, Homo sapien
attttctaattacctgtgtatgcta

SEQ ID NO: 273106 - DNA, 25 bp, Homo sapien
acctgtgtatgctacagtacagaca

SEQ ID NO: 273107 - DNA, 25 bp, Homo sapien
ataaacatgttcataggtcttcccc

SEQ ID NO: 273108 - DNA, 25 bp, Homo sapien
cccgtcttctaagggcattttctgt

SEQ ID NO: 273109 - DNA, 25 bp, Homo sapien
gaatgtttaacggttctggcgcaaa

SEQ ID NO: 273110 - DNA, 25 bp, Homo sapien
acggttctggcgcaaagctttcttg

SEQ ID NO: 273111 - DNA, 25 bp, Homo sapien
ggcgcaaagctttcttgcattctga

SEQ ID NO: 273112 - DNA, 25 bp, Homo sapien
caactgtgagaatcaatggcctaaa

SEQ ID NO: 273113 - DNA, 25 bp, Homo sapien
gaatcaatggcctaaatgcttttta

SEQ ID NO: 273114 - DNA, 25 bp, Homo sapien
taagtgtcaagataatggcacattg

SEQ ID NO: 273115 - DNA, 25 bp, Homo sapien
atgcctgccaagtataaatgactct

SEQ ID NO: 273116 - DNA, 25 bp, Homo sapien
aaatgactctcatcttaaaacaagg

SEQ ID NO: 273117 - DNA, 25 bp, Homo sapien
taaaacaaggttcttcaggtttctg

SEQ ID NO: 273118 - DNA, 25 bp, Homo sapien
caggtttctgcttgattgacttggt

SEQ ID NO: 273119 - DNA, 25 bp, Homo sapien
gattgacttggtacaaacttgaagc

SEQ ID NO: 273120 - DNA, 25 bp, Homo sapien
gttgccttctaatttttactccaag

SEQ ID NO: 273121 - DNA, 25 bp, Homo sapien
ttttactccaagattgtttcatatc

SEQ ID NO: 273122 - DNA, 25 bp, Homo sapien
gtttcatatctattccttaagtgta

SEQ ID NO: 273123 - DNA, 25 bp, Homo sapien
gatacgaggtgctccgacggcaaaa

SEQ ID NO: 273124 - DNA, 25 bp, Homo sapien
gtgctccgacggcaaaaatcccata

SEQ ID NO: 273125 - DNA, 25 bp, Homo sapien
tccgacggcaaaaatcccatacatt

SEQ ID NO: 273126 - DNA, 25 bp, Homo sapien
gacggcaaaaatcccatacattttt

SEQ ID NO: 273127 - DNA, 25 bp, Homo sapien
gattactaaattaatagcaggcact

SEQ ID NO: 273128 - DNA, 25 bp, Homo sapien
tagcaggcactaagacagatgtcaa

SEQ ID NO: 273129 - DNA, 25 bp, Homo sapien
gacagatgtcaaaacgtcttgaaaa

SEQ ID NO: 273130 - DNA, 25 bp, Homo sapien
aacgtcttgaaaatgtttatctgtg

SEQ ID NO: 273131 - DNA, 25 bp, Homo sapien
gtggtgggacgcattatctgattgt

SEQ ID NO: 273132 - DNA, 25 bp, Homo sapien
gtgggacgcattatctgattgtgta

SEQ ID NO: 273133 - DNA, 25 bp, Homo sapien
gaacagctgtttgcaacagtcccct

SEQ ID NO: 273134 - DNA, 25 bp, Homo sapien
gagtttagtatccaagtccgcgggt

SEQ ID NO: 273135 - DNA, 25 bp, Homo sapien
ttagtatccaagtccgcgggtgtga

SEQ ID NO: 273136 - DNA, 25 bp, Homo sapien
tgccggaagatggtcaacgaccggt

SEQ ID NO: 273137 - DNA, 25 bp, Homo sapien
gtcaacgaccggtggaagaccatgg

SEQ ID NO: 273138 - DNA, 25 bp, Homo sapien
gcgacaagccgcagacaaatcagcc

SEQ ID NO: 273139 - DNA, 25 bp, Homo sapien
aagccgcagacaaatcagccccgtt

SEQ ID NO: 273140 - DNA, 25 bp, Homo sapien
cgcagacaaatcagccccgttgctg

SEQ ID NO: 273141 - DNA, 25 bp, Homo sapien
aaatcagccccgttgctgagtctcc

SEQ ID NO: 273142 - DNA, 25 bp, Homo sapien
tccgtttcctcacctctacaatggg

SEQ ID NO: 273143 - DNA, 25 bp, Homo sapien
tccctaggtcttttcggaggcggag

SEQ ID NO: 273144 - DNA, 25 bp, Homo sapien
tttcggaggcggagtttagtatcca

SEQ ID NO: 273145 - DNA, 25 bp, Homo sapien
gcctactactactatacggctgcga

SEQ ID NO: 273146 - DNA, 25 bp, Homo sapien
gattaaatgtatgtgaatgttttgc

SEQ ID NO: 273147 - DNA, 25 bp, Homo sapien
cctactactactatacggctgcgag

SEQ ID NO: 273148 - DNA, 25 bp, Homo sapien
ctactactactatacggctgcgaga

SEQ ID NO: 273149 - DNA, 25 bp, Homo sapien
tactactactatacggctgcgagaa

SEQ ID NO: 273150 - DNA, 25 bp, Homo sapien
actactactatacggctgcgagaag

SEQ ID NO: 273151 - DNA, 25 bp, Homo sapien
ctactactatacggctgcgagaaga

SEQ ID NO: 273152 - DNA, 25 bp, Homo sapien
tactactatacggctgcgagaagac

SEQ ID NO: 273153 - DNA, 25 bp, Homo sapien
actactatacggctgcgagaagacg

SEQ ID NO: 273154 - DNA, 25 bp, Homo sapien
ctactatacggctgcgagaagacga

SEQ ID NO: 273155 - DNA, 25 bp, Homo sapien
tactatacggctgcgagaagacgac

SEQ ID NO: 273156 - DNA, 25 bp, Homo sapien
aatacatcaaatctctaaactgtga

SEQ ID NO: 273157 - DNA, 25 bp, Homo sapien
tggatacattttggacttatagtct

SEQ ID NO: 273158 - DNA, 25 bp, Homo sapien
ttatagtcttgctggactactgcat

SEQ ID NO: 273159 - DNA, 25 bp, Homo sapien
gcatgtgcaagaactgtaaggccca

SEQ ID NO: 273160 - DNA, 25 bp, Homo sapien
aactgtaaggcccaactttgatttg

SEQ ID NO: 273161 - DNA, 25 bp, Homo sapien
actttgatttgtcttgcttgccaat

SEQ ID NO: 273162 - DNA, 25 bp, Homo sapien
gtcttgcttgccaatttataatgtt

SEQ ID NO: 273163 - DNA, 25 bp, Homo sapien
aatggctttcttgtcatttgaccaa

SEQ ID NO: 273164 - DNA, 25 bp, Homo sapien
gatatcttagatttgcaacagggaa

SEQ ID NO: 273165 - DNA, 25 bp, Homo sapien
tttgcaacagggaagagctaaactc

SEQ ID NO: 273166 - DNA, 25 bp, Homo sapien
gagctaaactcgctttggaacttac

SEQ ID NO: 273167 - DNA, 25 bp, Homo sapien
ataaatacacagattttgttttgga

SEQ ID NO: 273168 - DNA, 25 bp, Homo sapien
tttggatccaagaaattactgaaat

SEQ ID NO: 273169 - DNA, 25 bp, Homo sapien
atgtcattagttaaaagccatgtta

SEQ ID NO: 273170 - DNA, 25 bp, Homo sapien
gaagagtatgcctctcagcattgtg

SEQ ID NO: 273171 - DNA, 25 bp, Homo sapien
aagagtatgcctctcagcattgtga

SEQ ID NO: 273172 - DNA, 25 bp, Homo sapien
cagactaatttgatgttctttaatg

SEQ ID NO: 273173 - DNA, 25 bp, Homo sapien
tttgatgttctttaatgttccctta

SEQ ID NO: 273174 - DNA, 25 bp, Homo sapien
gatgttctttaatgttcccttattt

SEQ ID NO: 273175 - DNA, 25 bp, Homo sapien
aatgtgaaattaatgtccttcacaa

SEQ ID NO: 273176 - DNA, 25 bp, Homo sapien
tcttttgaaagcactgttacagttg

SEQ ID NO: 273177 - DNA, 25 bp, Homo sapien
tgaaagcactgttacagttgtataa

SEQ ID NO: 273178 - DNA, 25 bp, Homo sapien
tcaggcatgcattctccagattggt

SEQ ID NO: 273179 - DNA, 25 bp, Homo sapien
gcattctccagattggtctgtgtaa

SEQ ID NO: 273180 - DNA, 25 bp, Homo sapien
gtctgtgtaagctcggaaaactgga

SEQ ID NO: 273181 - DNA, 25 bp, Homo sapien
tgacttttaagagaccgtggtctac

SEQ ID NO: 273182 - DNA, 25 bp, Homo sapien
gtggtctacagaaacctcaggacaa

SEQ ID NO: 273183 - DNA, 25 bp, Homo sapien
gaaatatggctctgtaatcactgac

SEQ ID NO: 273184 - DNA, 25 bp, Homo sapien
aaaactgtggatgcctgggactgtg

SEQ ID NO: 273185 - DNA, 25 bp, Homo sapien
gactgtgtaggttgtgcccttacta

SEQ ID NO: 273186 - DNA, 25 bp, Homo sapien
taggttgtgcccttactaggtaagt

SEQ ID NO: 273187 - DNA, 25 bp, Homo sapien
gtttgtactaagtgctcagtccatg

SEQ ID NO: 273188 - DNA, 25 bp, Homo sapien
gtgctcagtccatggtagataacaa

SEQ ID NO: 273189 - DNA, 25 bp, Homo sapien
aaactctaccattcattatgtggta

SEQ ID NO: 273190 - DNA, 25 bp, Homo sapien
aactctaccattcattatgtggtaa

SEQ ID NO: 273191 - DNA, 25 bp, Homo sapien
actctaccattcattatgtggtaac

SEQ ID NO: 273192 - DNA, 25 bp, Homo sapien
ctctaccattcattatgtggtaact

SEQ ID NO: 273193 - DNA, 25 bp, Homo sapien
tctaccattcattatgtggtaactg

SEQ ID NO: 273194 - DNA, 25 bp, Homo sapien
ctaccattcattatgtggtaactgt

SEQ ID NO: 273195 - DNA, 25 bp, Homo sapien
accattcattatgtggtaactgtat

SEQ ID NO: 273196 - DNA, 25 bp, Homo sapien
gtggtaactgtattgaacttacttt

SEQ ID NO: 273197 - DNA, 25 bp, Homo sapien
tggtaactgtattgaacttacttta

SEQ ID NO: 273198 - DNA, 25 bp, Homo sapien
gtgactagatgtcaccacttcaaaa

SEQ ID NO: 273199 - DNA, 25 bp, Homo sapien
tgactagatgtcaccacttcaaaaa

SEQ ID NO: 273200 - DNA, 25 bp, Homo sapien
aagtaaggactagattgccaaggaa

SEQ ID NO: 273201 - DNA, 25 bp, Homo sapien
gaaaagactgtcttgcccttggatc

SEQ ID NO: 273202 - DNA, 25 bp, Homo sapien
tgtcttgcccttggatccaaaagtt

SEQ ID NO: 273203 - DNA, 25 bp, Homo sapien
attagtgcatacatcatgtcatttc

SEQ ID NO: 273204 - DNA, 25 bp, Homo sapien
tcatttcacctcctgttcctaggaa

SEQ ID NO: 273205 - DNA, 25 bp, Homo sapien
taggaactctccattcccaagcatt

SEQ ID NO: 273206 - DNA, 25 bp, Homo sapien
ccaagcattgccagtgttttccaga

SEQ ID NO: 273207 - DNA, 25 bp, Homo sapien
ttgccagtgttttccagataatctt

SEQ ID NO: 273208 - DNA, 25 bp, Homo sapien
ccagataatcttagctgttgtcttg

SEQ ID NO: 273209 - DNA, 25 bp, Homo sapien
cttcacagactgtaggagaattcaa

SEQ ID NO: 273210 - DNA, 25 bp, Homo sapien
gctccgctctactgaactaaatgat

SEQ ID NO: 273211 - DNA, 25 bp, Homo sapien
gtgaattgtctataacttagagtac

SEQ ID NO: 273212 - DNA, 25 bp, Homo sapien
gtactagagaaggaagcaccaattc

SEQ ID NO: 273213 - DNA, 25 bp, Homo sapien
aggaagcaccaattcaatggaagag

SEQ ID NO: 273214 - DNA, 25 bp, Homo sapien
agtctcaagagaccgaactacatct

SEQ ID NO: 273215 - DNA, 25 bp, Homo sapien
gagaccgaactacatctgagaattt

SEQ ID NO: 273216 - DNA, 25 bp, Homo sapien
ggttggatttcagatcaatagggat

SEQ ID NO: 273217 - DNA, 25 bp, Homo sapien
actggcatttcccaataaatgatgt

SEQ ID NO: 273218 - DNA, 25 bp, Homo sapien
gatgttgagataatcagcagctgtt

SEQ ID NO: 273219 - DNA, 25 bp, Homo sapien
aaactgaggctcttcctcactgttt

SEQ ID NO: 273220 - DNA, 25 bp, Homo sapien
gtttctaccaaaatcaatgtatatg

SEQ ID NO: 273221 - DNA, 25 bp, Homo sapien
gtatatatacagacttctttctagt

SEQ ID NO: 273222 - DNA, 25 bp, Homo sapien
agctttagtctctgtaactcttatg

SEQ ID NO: 273223 - DNA, 25 bp, Homo sapien
aactcttatgtttgtgccccattat

SEQ ID NO: 273224 - DNA, 25 bp, Homo sapien
gtgctttagagcaacaccttgtttt

SEQ ID NO: 273225 - DNA, 25 bp, Homo sapien
gcaacaccttgtttttcctctattt

SEQ ID NO: 273226 - DNA, 25 bp, Homo sapien
tactagttcttgctccagaggcatg

SEQ ID NO: 273227 - DNA, 25 bp, Homo sapien
cagaggcatggctttgaggctagaa

SEQ ID NO: 273228 - DNA, 25 bp, Homo sapien
gaggctagaatcatgagcaatctct

SEQ ID NO: 273229 - DNA, 25 bp, Homo sapien
gagcaatctctcataaacaagtctg

SEQ ID NO: 273230 - DNA, 25 bp, Homo sapien
aacaagtctgttatgcacctggaga

SEQ ID NO: 273231 - DNA, 25 bp, Homo sapien
agtctgttatgcacctggagatact

SEQ ID NO: 273232 - DNA, 25 bp, Homo sapien
ggagcctgcagtgaaaggatcagtt

SEQ ID NO: 273233 - DNA, 25 bp, Homo sapien
atcaaagcccctcacagaagtggag

SEQ ID NO: 273234 - DNA, 25 bp, Homo sapien
ctcacagaagtggaggacggtgccc

SEQ ID NO: 273235 - DNA, 25 bp, Homo sapien
gtgcccaagagtagcggtttggact

SEQ ID NO: 273236 - DNA, 25 bp, Homo sapien
agtagcggtttggactgctgctgcc

SEQ ID NO: 273237 - DNA, 25 bp, Homo sapien
tctcaatttccccatcccttggatg

SEQ ID NO: 273238 - DNA, 25 bp, Homo sapien
gggagaaattggtataatgcttgca

SEQ ID NO: 273239 - DNA, 25 bp, Homo sapien
aaaggcaatgtcttctggttgtggt

SEQ ID NO: 273240 - DNA, 25 bp, Homo sapien
tgtcttctggttgtggttatttcct

SEQ ID NO: 273241 - DNA, 25 bp, Homo sapien
tggttatttcctttcctgcttgcct

SEQ ID NO: 273242 - DNA, 25 bp, Homo sapien
ttggatgggagcaagagtctctgct

SEQ ID NO: 273243 - DNA, 25 bp, Homo sapien
tgtgagtgtcatcatcaaagcccct

SEQ ID NO: 273244 - DNA, 25 bp, Homo sapien
gaaactcattgatgctctgatagag

SEQ ID NO: 273245 - DNA, 25 bp, Homo sapien
tagagaattttcttcagcctagtaa

SEQ ID NO: 273246 - DNA, 25 bp, Homo sapien
aatggactgatctggcgttctgttt

SEQ ID NO: 273247 - DNA, 25 bp, Homo sapien
tgtgggcatatggaacagagcaacc

SEQ ID NO: 273248 - DNA, 25 bp, Homo sapien
gagcaaccgagaactgcatacattg

SEQ ID NO: 273249 - DNA, 25 bp, Homo sapien
acattgaaccttgtgttagcattct

SEQ ID NO: 273250 - DNA, 25 bp, Homo sapien
gtgttagcattctctctctatctca

SEQ ID NO: 273251 - DNA, 25 bp, Homo sapien
tctctctatctcatctggccgagta

SEQ ID NO: 273252 - DNA, 25 bp, Homo sapien
tcatctggccgagtatctttttcct

SEQ ID NO: 273253 - DNA, 25 bp, Homo sapien
agagatgtgtgcgtcacctgaccag

SEQ ID NO: 273254 - DNA, 25 bp, Homo sapien
acctgaccagagtgacactgcttta

SEQ ID NO: 273255 - DNA, 25 bp, Homo sapien
agtcctgcagctgatgttgccctca

SEQ ID NO: 273256 - DNA, 25 bp, Homo sapien
gttgccctcaccgtgatagcaggag

SEQ ID NO: 273257 - DNA, 25 bp, Homo sapien
tggaggagaagttaccctcggcccg

SEQ ID NO: 273258 - DNA, 25 bp, Homo sapien
ttcctttcatcacagggcctttaac

SEQ ID NO: 273259 - DNA, 25 bp, Homo sapien
ttaactcctcctagggagtagcaga

SEQ ID NO: 273260 - DNA, 25 bp, Homo sapien
cctttactttcagggattggtcagg

SEQ ID NO: 273261 - DNA, 25 bp, Homo sapien
aagtggccatcctgaaacctagtgt

SEQ ID NO: 273262 - DNA, 25 bp, Homo sapien
ctagtgttgctgtgacctggtgaca

SEQ ID NO: 273263 - DNA, 25 bp, Homo sapien
aaaacatgtgggttctttgtgtaga

SEQ ID NO: 273264 - DNA, 25 bp, Homo sapien
ctttgtgtagatgtggctagttcca

SEQ ID NO: 273265 - DNA, 25 bp, Homo sapien
gttccaattagagaagtcctgcagc

SEQ ID NO: 273266 - DNA, 25 bp, Homo sapien
aatggaacgtctttattgtgcttga

SEQ ID NO: 273267 - DNA, 25 bp, Homo sapien
tattgtgcttgaagtatttcttctc

SEQ ID NO: 273268 - DNA, 25 bp, Homo sapien
atttcttctctggttgtaattctaa

SEQ ID NO: 273269 - DNA, 25 bp, Homo sapien
acagagtcatttgagctttctcccc

SEQ ID NO: 273270 - DNA, 25 bp, Homo sapien
tcccgctagtatctttacaggagca

SEQ ID NO: 273271 - DNA, 25 bp, Homo sapien
gaggatgtataattttgggcgaagt

SEQ ID NO: 273272 - DNA, 25 bp, Homo sapien
tacaatttatttgaggttattccta

SEQ ID NO: 273273 - DNA, 25 bp, Homo sapien
atttggtgttttggaggagatcaca

SEQ ID NO: 273274 - DNA, 25 bp, Homo sapien
ggagatcacacactaagagaacgtt

SEQ ID NO: 273275 - DNA, 25 bp, Homo sapien
agagaacgttgattgcctcggctat

SEQ ID NO: 273276 - DNA, 25 bp, Homo sapien
acgttgattgcctcggctattgtgc

SEQ ID NO: 273277 - DNA, 25 bp, Homo sapien
taaggttctaaactgtgctacagat

SEQ ID NO: 273278 - DNA, 25 bp, Homo sapien
aactgtgctacagatacttgtaaga

SEQ ID NO: 273279 - DNA, 25 bp, Homo sapien
gctacagatacttgtaagactttta

SEQ ID NO: 273280 - DNA, 25 bp, Homo sapien
gtatgttcttacataaggcctttct

SEQ ID NO: 273281 - DNA, 25 bp, Homo sapien
gttcttacataaggcctttcttagg

SEQ ID NO: 273282 - DNA, 25 bp, Homo sapien
ttttaggttccaactgtgttagaca

SEQ ID NO: 273283 - DNA, 25 bp, Homo sapien
ggttccaactgtgttagacatgagt

SEQ ID NO: 273284 - DNA, 25 bp, Homo sapien
gctagatccatggtctctagatggt

SEQ ID NO: 273285 - DNA, 25 bp, Homo sapien
gatccatggtctctagatggtttac

SEQ ID NO: 273286 - DNA, 25 bp, Homo sapien
atggtctctagatggtttacttaaa

SEQ ID NO: 273287 - DNA, 25 bp, Homo sapien
agatggtttacttaaataggccagg

SEQ ID NO: 273288 - DNA, 25 bp, Homo sapien
gggtggaaactatgaccatatcctt

SEQ ID NO: 273289 - DNA, 25 bp, Homo sapien
aactatgaccatatccttaaaaaga

SEQ ID NO: 273290 - DNA, 25 bp, Homo sapien
gctttgccaccaactagctgtgatc

SEQ ID NO: 273291 - DNA, 25 bp, Homo sapien
agctgtgatcccaacctgttagatg

SEQ ID NO: 273292 - DNA, 25 bp, Homo sapien
gatcccaacctgttagatgggaaaa

SEQ ID NO: 273293 - DNA, 25 bp, Homo sapien
aaaaggaggtgccttcttggccaag

SEQ ID NO: 273294 - DNA, 25 bp, Homo sapien
gaggtgccttcttggccaagtgaaa

SEQ ID NO: 273295 - DNA, 25 bp, Homo sapien
tgccttcttggccaagtgaaagaaa

SEQ ID NO: 273296 - DNA, 25 bp, Homo sapien
aggcttgctgtctgctctaagccca

SEQ ID NO: 273297 - DNA, 25 bp, Homo sapien
gagtggacccacaagcacggtcagt

SEQ ID NO: 273298 - DNA, 25 bp, Homo sapien
aagcacggtcagttctccggcggct

SEQ ID NO: 273299 - DNA, 25 bp, Homo sapien
acacctaccgtgtccggtttgctct

SEQ ID NO: 273300 - DNA, 25 bp, Homo sapien
tccggtttgctctacccgggaacag

SEQ ID NO: 273301 - DNA, 25 bp, Homo sapien
tgctgcgtgggccagagtcacagag

SEQ ID NO: 273302 - DNA, 25 bp, Homo sapien
tctacccgggaacagccagcttggc

SEQ ID NO: 273303 - DNA, 25 bp, Homo sapien
ggaacagccagcttggcctgcggcc

SEQ ID NO: 273304 - DNA, 25 bp, Homo sapien
aagctgaacccagagaccttcgtgg

SEQ ID NO: 273305 - DNA, 25 bp, Homo sapien
agagaccttcgtggccttctgcatc

SEQ ID NO: 273306 - DNA, 25 bp, Homo sapien
cttctgcatcattgccatggacagg

SEQ ID NO: 273307 - DNA, 25 bp, Homo sapien
atcattgccatggacaggctcacta

SEQ ID NO: 273308 - DNA, 25 bp, Homo sapien
tggacaggctcactaaggacaccta

SEQ ID NO: 273309 - DNA, 25 bp, Homo sapien
ggctcactaaggacacctaccgtgt

SEQ ID NO: 273310 - DNA, 25 bp, Homo sapien
agacagtaatgggtagagactttag

SEQ ID NO: 273311 - DNA, 25 bp, Homo sapien
gtggtggaatactctatatattgac

SEQ ID NO: 273312 - DNA, 25 bp, Homo sapien
gacgtaagcgtttcactatgtataa

SEQ ID NO: 273313 - DNA, 25 bp, Homo sapien
aggcctaagccctccctgatgggca

SEQ ID NO: 273314 - DNA, 25 bp, Homo sapien
gatgggcagtcagtccagagatgct

SEQ ID NO: 273315 - DNA, 25 bp, Homo sapien
cagtctatgctgtgagtgtccttat

SEQ ID NO: 273316 - DNA, 25 bp, Homo sapien
atgctgtgagtgtccttatgggtgc

SEQ ID NO: 273317 - DNA, 25 bp, Homo sapien
gagtgtccttatgggtgcaagagat

SEQ ID NO: 273318 - DNA, 25 bp, Homo sapien
gcaagagatagggctgtgcctctct

SEQ ID NO: 273319 - DNA, 25 bp, Homo sapien
gtgcctctctgcgtttccaggtgga

SEQ ID NO: 273320 - DNA, 25 bp, Homo sapien
ctctctgcgtttccaggtggagtag

SEQ ID NO: 273321 - DNA, 25 bp, Homo sapien
ccactacccttcacagtctgtgata

SEQ ID NO: 273322 - DNA, 25 bp, Homo sapien
cacagtctgtgatagccattcttct

SEQ ID NO: 273323 - DNA, 25 bp, Homo sapien
gtctgtgatagccattcttctattc

SEQ ID NO: 273324 - DNA, 25 bp, Homo sapien
gacactgtttttaatgagccagagg

SEQ ID NO: 273325 - DNA, 25 bp, Homo sapien
gtgaactttctcaagtgtgtaacag

SEQ ID NO: 273326 - DNA, 25 bp, Homo sapien
agtgtgtaacaggaggctttcttag

SEQ ID NO: 273327 - DNA, 25 bp, Homo sapien
aacaggaggctttcttagggacagt

SEQ ID NO: 273328 - DNA, 25 bp, Homo sapien
ggctttcttagggacagttgctggt

SEQ ID NO: 273329 - DNA, 25 bp, Homo sapien
ggacagttgctggtgcagttaaact

SEQ ID NO: 273330 - DNA, 25 bp, Homo sapien
gctggtgcagttaaactgcctagtt

SEQ ID NO: 273331 - DNA, 25 bp, Homo sapien
aactgcctagttgaggtgtgccttg

SEQ ID NO: 273332 - DNA, 25 bp, Homo sapien
tggtttgatgcctaatacagcttca

SEQ ID NO: 273333 - DNA, 25 bp, Homo sapien
tgatgcctaatacagcttcaaagaa

SEQ ID NO: 273334 - DNA, 25 bp, Homo sapien
ttatcttttcttcatggactacccc

SEQ ID NO: 273335 - DNA, 25 bp, Homo sapien
ttttcttcatggactaccccttaga

SEQ ID NO: 273336 - DNA, 25 bp, Homo sapien
catggactaccccttagaaccaaat

SEQ ID NO: 273337 - DNA, 25 bp, Homo sapien
aaagaagcttctttgtagagcaaga

SEQ ID NO: 273338 - DNA, 25 bp, Homo sapien
aaatgagacgttatctttttctatg

SEQ ID NO: 273339 - DNA, 25 bp, Homo sapien
gagacgttatctttttctatgatca

SEQ ID NO: 273340 - DNA, 25 bp, Homo sapien
tttttctatgatcaaaactccaaga

SEQ ID NO: 273341 - DNA, 25 bp, Homo sapien
gaaatagtagatatccaagaattca

SEQ ID NO: 273342 - DNA, 25 bp, Homo sapien
tttgcagtgcagtgaatgctgaaat

SEQ ID NO: 273343 - DNA, 25 bp, Homo sapien
agtggattgaggaccatgatcattc

SEQ ID NO: 273344 - DNA, 25 bp, Homo sapien
gaggaccatgatcattcattgacag

SEQ ID NO: 273345 - DNA, 25 bp, Homo sapien
taggtttgccttcagctctcagtcc

SEQ ID NO: 273346 - DNA, 25 bp, Homo sapien
tgtgagctgcatgaaaaccttttgt

SEQ ID NO: 273347 - DNA, 25 bp, Homo sapien
ggacacataaataggtcatccaagt

SEQ ID NO: 273348 - DNA, 25 bp, Homo sapien
taggtcatccaagtttagtgagaat

SEQ ID NO: 273349 - DNA, 25 bp, Homo sapien
tgaaaaccttttgtgcgctgctgaa

SEQ ID NO: 273350 - DNA, 25 bp, Homo sapien
ttacatagactttacccaaatattg

SEQ ID NO: 273351 - DNA, 25 bp, Homo sapien
caaatattgggctttttgtaaacat

SEQ ID NO: 273352 - DNA, 25 bp, Homo sapien
ttgtgcgctgctgaagctctagtgc

SEQ ID NO: 273353 - DNA, 25 bp, Homo sapien
atgtcgggtacatagtagccactta

SEQ ID NO: 273354 - DNA, 25 bp, Homo sapien
ttgcccctcagtggagcagggcctg

SEQ ID NO: 273355 - DNA, 25 bp, Homo sapien
tgctgctgtttgttcccgaaactgt

SEQ ID NO: 273356 - DNA, 25 bp, Homo sapien
ctgctgtttgttcccgaaactgtac

SEQ ID NO: 273357 - DNA, 25 bp, Homo sapien
ctgtttgttcccgaaactgtactgt

SEQ ID NO: 273358 - DNA, 25 bp, Homo sapien
gtttgttcccgaaactgtactgtga

SEQ ID NO: 273359 - DNA, 25 bp, Homo sapien
tgttcccgaaactgtactgtgagcc

SEQ ID NO: 273360 - DNA, 25 bp, Homo sapien
ggcagattgttctgaggccccagat

SEQ ID NO: 273361 - DNA, 25 bp, Homo sapien
agattgttctgaggccccagatgtg

SEQ ID NO: 273362 - DNA, 25 bp, Homo sapien
agatgtgccaaaacagcccccaggg

SEQ ID NO: 273363 - DNA, 25 bp, Homo sapien
tgaatggcccccaatgctgctgttt

SEQ ID NO: 273364 - DNA, 25 bp, Homo sapien
cccaatgctgctgtttttcaataaa

SEQ ID NO: 273365 - DNA, 25 bp, Homo sapien
aaggatcaaactcatgcttgtccaa

SEQ ID NO: 273366 - DNA, 25 bp, Homo sapien
aactcatgcttgtccaaatgttagg

SEQ ID NO: 273367 - DNA, 25 bp, Homo sapien
tccaaatgttaggaaagccaggcct

SEQ ID NO: 273368 - DNA, 25 bp, Homo sapien
ggcctgtgtcctatgatagaacaga

SEQ ID NO: 273369 - DNA, 25 bp, Homo sapien
tattaggctacgagaaaagcttggt

SEQ ID NO: 273370 - DNA, 25 bp, Homo sapien
gttggcaaactatattaccgcagca

SEQ ID NO: 273371 - DNA, 25 bp, Homo sapien
atattaccgcagcacagtttgaaat

SEQ ID NO: 273372 - DNA, 25 bp, Homo sapien
cagtttgaaatacggaagctccaaa

SEQ ID NO: 273373 - DNA, 25 bp, Homo sapien
aaatacggaagctccaaaattgcaa

SEQ ID NO: 273374 - DNA, 25 bp, Homo sapien
ttgtttattgccttcctcggaaaag

SEQ ID NO: 273375 - DNA, 25 bp, Homo sapien
tgccttcctcggaaaagtcctaaat

SEQ ID NO: 273376 - DNA, 25 bp, Homo sapien
aattctgaggcaatcacattcacag

SEQ ID NO: 273377 - DNA, 25 bp, Homo sapien
gatgacttttcctatgggatgcaca

SEQ ID NO: 273378 - DNA, 25 bp, Homo sapien
acagggtggaaacaagctgctctca

SEQ ID NO: 273379 - DNA, 25 bp, Homo sapien
agtgtggtgctcaccttgggcacat

SEQ ID NO: 273380 - DNA, 25 bp, Homo sapien
acatttttgatgatgggcctcgtcc

SEQ ID NO: 273381 - DNA, 25 bp, Homo sapien
gggcctcgtccaactgggaaaagat

SEQ ID NO: 273382 - DNA, 25 bp, Homo sapien
actgcataaattcggctgccttgtc

SEQ ID NO: 273383 - DNA, 25 bp, Homo sapien
tgccttgtcttttacacctgcggat

SEQ ID NO: 273384 - DNA, 25 bp, Homo sapien
acacctgcggatagcagtggcaccg

SEQ ID NO: 273385 - DNA, 25 bp, Homo sapien
gcccaggcagacaaagcggagctct

SEQ ID NO: 273386 - DNA, 25 bp, Homo sapien
agtgtacttaatgcacagcttatta

SEQ ID NO: 273387 - DNA, 25 bp, Homo sapien
cccagtgaggcagcacgcagcacct

SEQ ID NO: 273388 - DNA, 25 bp, Homo sapien
ccagtgaggcagcacgcagcacctc

SEQ ID NO: 273389 - DNA, 25 bp, Homo sapien
gtcactccaagtgtgagggcaggcc

SEQ ID NO: 273390 - DNA, 25 bp, Homo sapien
tcactccaagtgtgagggcaggccc

SEQ ID NO: 273391 - DNA, 25 bp, Homo sapien
cactccaagtgtgagggcaggccct

SEQ ID NO: 273392 - DNA, 25 bp, Homo sapien
actccaagtgtgagggcaggccctg

SEQ ID NO: 273393 - DNA, 25 bp, Homo sapien
ctccaagtgtgagggcaggccctgg

SEQ ID NO: 273394 - DNA, 25 bp, Homo sapien
tccaagtgtgagggcaggccctggc

SEQ ID NO: 273395 - DNA, 25 bp, Homo sapien
aggacgagggtgagtccacgcacct

SEQ ID NO: 273396 - DNA, 25 bp, Homo sapien
gcacctacttccagagaacgaaaat

SEQ ID NO: 273397 - DNA, 25 bp, Homo sapien
tatgatatatcgactggcacaggct

SEQ ID NO: 273398 - DNA, 25 bp, Homo sapien
ggaaaagttcatccactcagttatt

SEQ ID NO: 273399 - DNA, 25 bp, Homo sapien
gttcatccactcagttattatatca

SEQ ID NO: 273400 - DNA, 25 bp, Homo sapien
tatcgactggcacaggctgaggaaa

SEQ ID NO: 273401 - DNA, 25 bp, Homo sapien
acaaagaatgcgtcacataatggaa

SEQ ID NO: 273402 - DNA, 25 bp, Homo sapien
tggaagacttgtgaacgcagacgac

SEQ ID NO: 273403 - DNA, 25 bp, Homo sapien
gaaagacaacagctcgagtcacttt

SEQ ID NO: 273404 - DNA, 25 bp, Homo sapien
acagctcgagtcactttataagaac

SEQ ID NO: 273405 - DNA, 25 bp, Homo sapien
aagaacctcaggataccgttattag

SEQ ID NO: 273406 - DNA, 25 bp, Homo sapien
agactgtgtgggatagatttctgct

SEQ ID NO: 273407 - DNA, 25 bp, Homo sapien
ttctgcttctcagataagccctggg

SEQ ID NO: 273408 - DNA, 25 bp, Homo sapien
agccctgggctagagacacttgaga

SEQ ID NO: 273409 - DNA, 25 bp, Homo sapien
ggaaggcttcaggtctcttttagac

SEQ ID NO: 273410 - DNA, 25 bp, Homo sapien
atactctgagggtctggaaatcctt

SEQ ID NO: 273411 - DNA, 25 bp, Homo sapien
ggaaatcctttaggcgaggtgctct

SEQ ID NO: 273412 - DNA, 25 bp, Homo sapien
ggcgaggtgctcttccatcaaaaag

SEQ ID NO: 273413 - DNA, 25 bp, Homo sapien
aaagccagatgctaaggcagcaggt

SEQ ID NO: 273414 - DNA, 25 bp, Homo sapien
agcaggtggagttacagccctatca

SEQ ID NO: 273415 - DNA, 25 bp, Homo sapien
aatgggtcaggtaaactcacctact

SEQ ID NO: 273416 - DNA, 25 bp, Homo sapien
taaactcacctactccaactaaaag

SEQ ID NO: 273417 - DNA, 25 bp, Homo sapien
ggtgacggccgcacaacagcatgaa

SEQ ID NO: 273418 - DNA, 25 bp, Homo sapien
tgacggccgcacaacagcatgaatg

SEQ ID NO: 273419 - DNA, 25 bp, Homo sapien
gacggccgcacaacagcatgaatgg

SEQ ID NO: 273420 - DNA, 25 bp, Homo sapien
cagcatgaatggactgaacgccact

SEQ ID NO: 273421 - DNA, 25 bp, Homo sapien
atgaatggactgaacgccactgaaa

SEQ ID NO: 273422 - DNA, 25 bp, Homo sapien
ggactgaacgccactgaaaactgaa

SEQ ID NO: 273423 - DNA, 25 bp, Homo sapien
tgaacgccactgaaaactgaactct

SEQ ID NO: 273424 - DNA, 25 bp, Homo sapien
aacgccactgaaaactgaactcttg

SEQ ID NO: 273425 - DNA, 25 bp, Homo sapien
gggtgtacttacactaaatatgtag

SEQ ID NO: 273426 - DNA, 25 bp, Homo sapien
tatgtagggcatatttactctcaac

SEQ ID NO: 273427 - DNA, 25 bp, Homo sapien
tgtagggcatatttactctcaacat

SEQ ID NO: 273428 - DNA, 25 bp, Homo sapien
gaattaactctcagggaaccctctt

SEQ ID NO: 273429 - DNA, 25 bp, Homo sapien
tccagttctttaccttgcacagtga

SEQ ID NO: 273430 - DNA, 25 bp, Homo sapien
gagacctgcccaagttgaatttcca

SEQ ID NO: 273431 - DNA, 25 bp, Homo sapien
tggcacctagaaagttaaatccctt

SEQ ID NO: 273432 - DNA, 25 bp, Homo sapien
ttaaatccctttaggcccatacact

SEQ ID NO: 273433 - DNA, 25 bp, Homo sapien
ggcccatacactagagacatgtttt

SEQ ID NO: 273434 - DNA, 25 bp, Homo sapien
gaatgtcacactatataactgaggt

SEQ ID NO: 273435 - DNA, 25 bp, Homo sapien
aagttgaatttccatggccttcctc

SEQ ID NO: 273436 - DNA, 25 bp, Homo sapien
aaaatgtttcttctagcccttacag

SEQ ID NO: 273437 - DNA, 25 bp, Homo sapien
ctagcccttacagggtgtgattctt

SEQ ID NO: 273438 - DNA, 25 bp, Homo sapien
gtaaaccactacttgagctacctaa

SEQ ID NO: 273439 - DNA, 25 bp, Homo sapien
aggtattagcaatgcttgcatcatt

SEQ ID NO: 273440 - DNA, 25 bp, Homo sapien
gcaatgcttgcatcattaataatca

SEQ ID NO: 273441 - DNA, 25 bp, Homo sapien
atcattcagttgaaggtcaagccca

SEQ ID NO: 273442 - DNA, 25 bp, Homo sapien
aaggtcaagcccatagacacacact

SEQ ID NO: 273443 - DNA, 25 bp, Homo sapien
gacacacactctctgctggtaagaa

SEQ ID NO: 273444 - DNA, 25 bp, Homo sapien
actctctgctggtaagaaaccatag

SEQ ID NO: 273445 - DNA, 25 bp, Homo sapien
gaaaccatagcccagaactgagcca

SEQ ID NO: 273446 - DNA, 25 bp, Homo sapien
agcccagaactgagccaataaggtt

SEQ ID NO: 273447 - DNA, 25 bp, Homo sapien
actgagccaataaggttgtttgaac

SEQ ID NO: 273448 - DNA, 25 bp, Homo sapien
tgaggggcagcttatcacagtgcaa

SEQ ID NO: 273449 - DNA, 25 bp, Homo sapien
gtttaagccgcaaaggtattagcaa

SEQ ID NO: 273450 - DNA, 25 bp, Homo sapien
agattatattcactcctgccaagga

SEQ ID NO: 273451 - DNA, 25 bp, Homo sapien
ccaggactctctttagagcaaggaa

SEQ ID NO: 273452 - DNA, 25 bp, Homo sapien
gagcaaggaagcctcgttctctttc

SEQ ID NO: 273453 - DNA, 25 bp, Homo sapien
tctttcttctcaagaggctctcttg

SEQ ID NO: 273454 - DNA, 25 bp, Homo sapien
ggctctcttgttctccatcaggaga

SEQ ID NO: 273455 - DNA, 25 bp, Homo sapien
tctccatcaggagagccttgattta

SEQ ID NO: 273456 - DNA, 25 bp, Homo sapien
ttgatttaggctacggcctcactct

SEQ ID NO: 273457 - DNA, 25 bp, Homo sapien
ctctctatggccaccctaagaggaa

SEQ ID NO: 273458 - DNA, 25 bp, Homo sapien
acctcattacctccagagggctggg

SEQ ID NO: 273459 - DNA, 25 bp, Homo sapien
ctgggcagggccaagtgcctcatag

SEQ ID NO: 273460 - DNA, 25 bp, Homo sapien
tcataggactcatgttctctccaac

SEQ ID NO: 273461 - DNA, 25 bp, Homo sapien
aagtttgcgagctctgcaccttgtg

SEQ ID NO: 273462 - DNA, 25 bp, Homo sapien
tgcgagctctgcaccttgtggaaga

SEQ ID NO: 273463 - DNA, 25 bp, Homo sapien
accttgtggaagacctgcgtggatt

SEQ ID NO: 273464 - DNA, 25 bp, Homo sapien
ttgtggaagacctgcgtggattgtt

SEQ ID NO: 273465 - DNA, 25 bp, Homo sapien
gaagacctgcgtggattgttagaga

SEQ ID NO: 273466 - DNA, 25 bp, Homo sapien
acctgcgtggattgttagagatgat

SEQ ID NO: 273467 - DNA, 25 bp, Homo sapien
agaaggcttgagatgccagatccca

SEQ ID NO: 273468 - DNA, 25 bp, Homo sapien
gcttgagatgccagatcccagattc

SEQ ID NO: 273469 - DNA, 25 bp, Homo sapien
gagatgccagatcccagattcaaca

SEQ ID NO: 273470 - DNA, 25 bp, Homo sapien
gccagatcccagattcaacagcaga

SEQ ID NO: 273471 - DNA, 25 bp, Homo sapien
agatcccagattcaacagcagaaac

SEQ ID NO: 273472 - DNA, 25 bp, Homo sapien
gggactggacccatacaatgtactg

SEQ ID NO: 273473 - DNA, 25 bp, Homo sapien
atacaatgtactggccccaaaggga

SEQ ID NO: 273474 - DNA, 25 bp, Homo sapien
tcaggcaccagggaagaccctaatt

SEQ ID NO: 273475 - DNA, 25 bp, Homo sapien
gaatagtaggctgcatctgtgaaga

SEQ ID NO: 273476 - DNA, 25 bp, Homo sapien
gaagaggacaataccagcgtcgtct

SEQ ID NO: 273477 - DNA, 25 bp, Homo sapien
agcgtcgtctggttttggctgcaca

SEQ ID NO: 273478 - DNA, 25 bp, Homo sapien
gtcgtctggttttggctgcacaaag

SEQ ID NO: 273479 - DNA, 25 bp, Homo sapien
gctgtggagcccattacaagctggt

SEQ ID NO: 273480 - DNA, 25 bp, Homo sapien
gagcccattacaagctggtgcccca

SEQ ID NO: 273481 - DNA, 25 bp, Homo sapien
agcagctggcacactgagcacctgc

SEQ ID NO: 273482 - DNA, 25 bp, Homo sapien
gtgctgtaaagtttcttctttccag

SEQ ID NO: 273483 - DNA, 25 bp, Homo sapien
accccaggatcaggatatctgtcct

SEQ ID NO: 273484 - DNA, 25 bp, Homo sapien
gatatctgtccttgtttcatgttga

SEQ ID NO: 273485 - DNA, 25 bp, Homo sapien
aattggatctcacttaggctttgaa

SEQ ID NO: 273486 - DNA, 25 bp, Homo sapien
gctttgaaggtgacagccatctctg

SEQ ID NO: 273487 - DNA, 25 bp, Homo sapien
agccatctctgatagctgagcataa

SEQ ID NO: 273488 - DNA, 25 bp, Homo sapien
ttcctctcttagatcgcactttgaa

SEQ ID NO: 273489 - DNA, 25 bp, Homo sapien
cttagatcgcactttgaagatggcc

SEQ ID NO: 273490 - DNA, 25 bp, Homo sapien
gatggccttttggagacaatctgac

SEQ ID NO: 273491 - DNA, 25 bp, Homo sapien
gaattattctagctgtaactaccta

SEQ ID NO: 273492 - DNA, 25 bp, Homo sapien
ctacctattggctatgtgttgattg

SEQ ID NO: 273493 - DNA, 25 bp, Homo sapien
ggctatgtgttgattgatcctagaa

SEQ ID NO: 273494 - DNA, 25 bp, Homo sapien
ggagaatattatttagactaatcca

SEQ ID NO: 273495 - DNA, 25 bp, Homo sapien
gactaatccagatttgctttctatg

SEQ ID NO: 273496 - DNA, 25 bp, Homo sapien
atccagatttgctttctatgaaaat

SEQ ID NO: 273497 - DNA, 25 bp, Homo sapien
atctaatgtctggattatcttcctt

SEQ ID NO: 273498 - DNA, 25 bp, Homo sapien
tgtctggattatcttccttttctca

SEQ ID NO: 273499 - DNA, 25 bp, Homo sapien
ttccttttctcatggcctaagaaat

SEQ ID NO: 273500 - DNA, 25 bp, Homo sapien
aagcagggatttagccttaataaag

SEQ ID NO: 273501 - DNA, 25 bp, Homo sapien
aaggtaaccttctgacatctgttgt

SEQ ID NO: 273502 - DNA, 25 bp, Homo sapien
catctgttgttaatccccctttgta

SEQ ID NO: 273503 - DNA, 25 bp, Homo sapien
gtatctgcactgttattttgagatg

SEQ ID NO: 273504 - DNA, 25 bp, Homo sapien
ttgagatgtcatactgtacactgta

SEQ ID NO: 273505 - DNA, 25 bp, Homo sapien
gattgaaaacatttgtctcttgcaa

SEQ ID NO: 273506 - DNA, 25 bp, Homo sapien
gaaaacatttgtctcttgcaagatc

SEQ ID NO: 273507 - DNA, 25 bp, Homo sapien
atttgtctcttgcaagatcacccta

SEQ ID NO: 273508 - DNA, 25 bp, Homo sapien
tctcttgcaagatcaccctactttg

SEQ ID NO: 273509 - DNA, 25 bp, Homo sapien
caagatcaccctactttgcaagttg

SEQ ID NO: 273510 - DNA, 25 bp, Homo sapien
gatcaccctactttgcaagttggtg

SEQ ID NO: 273511 - DNA, 25 bp, Homo sapien
gggtgctatcagaatatcaggtgaa

SEQ ID NO: 273512 - DNA, 25 bp, Homo sapien
atcaggtgaagagagaatcagctta

SEQ ID NO: 273513 - DNA, 25 bp, Homo sapien
aatcagcttaaatagaaagggcttg

SEQ ID NO: 273514 - DNA, 25 bp, Homo sapien
gaaagggcttgtcaagactggccaa

SEQ ID NO: 273515 - DNA, 25 bp, Homo sapien
aagggcttgtcaagactggccaatg

SEQ ID NO: 273516 - DNA, 25 bp, Homo sapien
ggagaatccagccataaaacgcatt

SEQ ID NO: 273517 - DNA, 25 bp, Homo sapien
taaaacgcattacgcggtccaggac

SEQ ID NO: 273518 - DNA, 25 bp, Homo sapien
acagaggaggatatcggcggacttc

SEQ ID NO: 273519 - DNA, 25 bp, Homo sapien
ttcacgccaccatcgagtgtgagca

SEQ ID NO: 273520 - DNA, 25 bp, Homo sapien
acctctacaagttcgtgggtcgcat

SEQ ID NO: 273521 - DNA, 25 bp, Homo sapien
tgggtcgcatcaacgtttacagtga

SEQ ID NO: 273522 - DNA, 25 bp, Homo sapien
agtgacctgaatgacccgtggtgag

SEQ ID NO: 273523 - DNA, 25 bp, Homo sapien
gacccgtggtgaggaccttaggatc

SEQ ID NO: 273524 - DNA, 25 bp, Homo sapien
ccttaggatcggaaaactgctgctt

SEQ ID NO: 273525 - DNA, 25 bp, Homo sapien
aactgctgcttagaggagctacact

SEQ ID NO: 273526 - DNA, 25 bp, Homo sapien
ggagctacactgaagaacactgaga

SEQ ID NO: 273527 - DNA, 25 bp, Homo sapien
acacttccagctgttgatcacagat

SEQ ID NO: 273528 - DNA, 25 bp, Homo sapien
tcttcatcatctacagatgcagcca

SEQ ID NO: 273529 - DNA, 25 bp, Homo sapien
agatgcagccagcacggttcatcat

SEQ ID NO: 273530 - DNA, 25 bp, Homo sapien
gccagcacggttcatcatctgagga

SEQ ID NO: 273531 - DNA, 25 bp, Homo sapien
gttcatcatctgaggaatccaccaa

SEQ ID NO: 273532 - DNA, 25 bp, Homo sapien
ggaatccaccaagagaaccagccat

SEQ ID NO: 273533 - DNA, 25 bp, Homo sapien
aagagaaccagccattccaaacttc

SEQ ID NO: 273534 - DNA, 25 bp, Homo sapien
gctgccgaggcagatttatccaata

SEQ ID NO: 273535 - DNA, 25 bp, Homo sapien
atatggaaagggtatctctctcgac

SEQ ID NO: 273536 - DNA, 25 bp, Homo sapien
aagggtatctctctcgacggcagac

SEQ ID NO: 273537 - DNA, 25 bp, Homo sapien
aagctccctcaatgaaaacagacac

SEQ ID NO: 273538 - DNA, 25 bp, Homo sapien
aaactctaccattcattatgtggta

SEQ ID NO: 273539 - DNA, 25 bp, Homo sapien
aactctaccattcattatgtggtaa

SEQ ID NO: 273540 - DNA, 25 bp, Homo sapien
actctaccattcattatgtggtaac

SEQ ID NO: 273541 - DNA, 25 bp, Homo sapien
tctaccattcattatgtggtaactg

SEQ ID NO: 273542 - DNA, 25 bp, Homo sapien
accattcattatgtggtaactgtat

SEQ ID NO: 273543 - DNA, 25 bp, Homo sapien
gtggtaactgtattgaacttacttt

SEQ ID NO: 273544 - DNA, 25 bp, Homo sapien
tggtaactgtattgaacttacttta

SEQ ID NO: 273545 - DNA, 25 bp, Homo sapien
ggattttattttaatgtgactagat

SEQ ID NO: 273546 - DNA, 25 bp, Homo sapien
tgactagatgtcaccacttcaaaaa

SEQ ID NO: 273547 - DNA, 25 bp, Homo sapien
gactagatgtcaccacttcaaaaaa

SEQ ID NO: 273548 - DNA, 25 bp, Homo sapien
actagatgtcaccacttcaaaaaat

SEQ ID NO: 273549 - DNA, 25 bp, Homo sapien
tagaccattagctgttgccgtcaca

SEQ ID NO: 273550 - DNA, 25 bp, Homo sapien
tgccgtcacatgcttagacaccagt

SEQ ID NO: 273551 - DNA, 25 bp, Homo sapien
tacttagcgtgttatgaccttcctc

SEQ ID NO: 273552 - DNA, 25 bp, Homo sapien
tcctcacccatactaccaaatttaa

SEQ ID NO: 273553 - DNA, 25 bp, Homo sapien
cccgacttcaccctctggaaggaag

SEQ ID NO: 273554 - DNA, 25 bp, Homo sapien
tccccatggtttcagagcagttttt

SEQ ID NO: 273555 - DNA, 25 bp, Homo sapien
agtttttacctgcaagcaccatctc

SEQ ID NO: 273556 - DNA, 25 bp, Homo sapien
accatctctgtatgtgctcttacta

SEQ ID NO: 273557 - DNA, 25 bp, Homo sapien
acagttcttgagagggattgcatct

SEQ ID NO: 273558 - DNA, 25 bp, Homo sapien
ggattgcatcttggtgtttttgtat

SEQ ID NO: 273559 - DNA, 25 bp, Homo sapien
atagcccagtctcttgcacaaatta

SEQ ID NO: 273560 - DNA, 25 bp, Homo sapien
cgcacctctacctggtggccagcaa

SEQ ID NO: 273561 - DNA, 25 bp, Homo sapien
ctggcccacttcttctgtggatggc

SEQ ID NO: 273562 - DNA, 25 bp, Homo sapien
tggcccacttcttctgtggatggcc

SEQ ID NO: 273563 - DNA, 25 bp, Homo sapien
gcccacttcttctgtggatggccct

SEQ ID NO: 273564 - DNA, 25 bp, Homo sapien
cacttcttctgtggatggccctcag

SEQ ID NO: 273565 - DNA, 25 bp, Homo sapien
acttcttctgtggatggccctcagg

SEQ ID NO: 273566 - DNA, 25 bp, Homo sapien
ttcttctgtggatggccctcagggt

SEQ ID NO: 273567 - DNA, 25 bp, Homo sapien
tcttctgtggatggccctcagggtc

SEQ ID NO: 273568 - DNA, 25 bp, Homo sapien
gagaccctctgggctgaggaggagg

SEQ ID NO: 273569 - DNA, 25 bp, Homo sapien
agctgtttagggttgctggaggccg

SEQ ID NO: 273570 - DNA, 25 bp, Homo sapien
ctgtttagggttgctggaggccggg

SEQ ID NO: 273571 - DNA, 25 bp, Homo sapien
tgacatctgaagcaatcgggatcct

SEQ ID NO: 273572 - DNA, 25 bp, Homo sapien
gaagcaatcgggatcctgtttggtt

SEQ ID NO: 273573 - DNA, 25 bp, Homo sapien
ggatcctgtttggttttgccacatc

SEQ ID NO: 273574 - DNA, 25 bp, Homo sapien
gtttggttttgccacatccgacctg

SEQ ID NO: 273575 - DNA, 25 bp, Homo sapien
ggccctgaactctttctcgagtagt

SEQ ID NO: 273576 - DNA, 25 bp, Homo sapien
aactctttctcgagtagtccccaga

SEQ ID NO: 273577 - DNA, 25 bp, Homo sapien
tcgagtagtccccagagatttcagg

SEQ ID NO: 273578 - DNA, 25 bp, Homo sapien
gaccagaaacaaagtcttctgcaag

SEQ ID NO: 273579 - DNA, 25 bp, Homo sapien
gtcttctgcaagcaaagaactgcaa

SEQ ID NO: 273580 - DNA, 25 bp, Homo sapien
acaggccccagctgttaggtttgag

SEQ ID NO: 273581 - DNA, 25 bp, Homo sapien
agaggtaccattgctgacccctgag

SEQ ID NO: 273582 - DNA, 25 bp, Homo sapien
tcagtcatcatttactgatccctcc

SEQ ID NO: 273583 - DNA, 25 bp, Homo sapien
agtcatcatttactgatccctcctc

SEQ ID NO: 273584 - DNA, 25 bp, Homo sapien
gtcatcatttactgatccctcctca

SEQ ID NO: 273585 - DNA, 25 bp, Homo sapien
tcatttactgatccctcctcactaa

SEQ ID NO: 273586 - DNA, 25 bp, Homo sapien
tcactaaccttttcctgcctcttgt

SEQ ID NO: 273587 - DNA, 25 bp, Homo sapien
ttttcctgcctcttgtttacaaaca

SEQ ID NO: 273588 - DNA, 25 bp, Homo sapien
tagtttattgctgggaaaaggtctg

SEQ ID NO: 273589 - DNA, 25 bp, Homo sapien
tttattgctgggaaaaggtctgggt

SEQ ID NO: 273590 - DNA, 25 bp, Homo sapien
agtttagaacacactaaggcttggg

SEQ ID NO: 273591 - DNA, 25 bp, Homo sapien
taaggcttggggcatcagtcatcat

SEQ ID NO: 273592 - DNA, 25 bp, Homo sapien
gggcatcagtcatcatttactgatc

SEQ ID NO: 273593 - DNA, 25 bp, Homo sapien
tggagaaacgccacatcgcggcgat

SEQ ID NO: 273594 - DNA, 25 bp, Homo sapien
agaaacgccacatcgcggcgatcca

SEQ ID NO: 273595 - DNA, 25 bp, Homo sapien
gcgatccacggcgaacccacagcgt

SEQ ID NO: 273596 - DNA, 25 bp, Homo sapien
aggccgcggctttggctgagtccct

SEQ ID NO: 273597 - DNA, 25 bp, Homo sapien
cctccgaccctcaggataggaacgg

SEQ ID NO: 273598 - DNA, 25 bp, Homo sapien
gaccctcaggataggaacggccccg

SEQ ID NO: 273599 - DNA, 25 bp, Homo sapien
cctcaggataggaacggccccggcg

SEQ ID NO: 273600 - DNA, 25 bp, Homo sapien
gattcgcgacccgacatggagcgtc

SEQ ID NO: 273601 - DNA, 25 bp, Homo sapien
ggcggagcctggcttggttgaggca

SEQ ID NO: 273602 - DNA, 25 bp, Homo sapien
tctgcctcagcttcggttaccctgg

SEQ ID NO: 273603 - DNA, 25 bp, Homo sapien
tcagcttcggttaccctggcgcagc

SEQ ID NO: 273604 - DNA, 25 bp, Homo sapien
aggccatgtggtatttcggatcagc

SEQ ID NO: 273605 - DNA, 25 bp, Homo sapien
gtggtatttcggatcagcccagggt

SEQ ID NO: 273606 - DNA, 25 bp, Homo sapien
gtatttcggatcagcccagggttcc

SEQ ID NO: 273607 - DNA, 25 bp, Homo sapien
ccagggttcccagtttgtcgagtgg

SEQ ID NO: 273608 - DNA, 25 bp, Homo sapien
gtgggcctcggcaggaaacctcaaa

SEQ ID NO: 273609 - DNA, 25 bp, Homo sapien
gagtggcgcggaccaaggccctgtg

SEQ ID NO: 273610 - DNA, 25 bp, Homo sapien
accaaggccctgtggctgcctatgg

SEQ ID NO: 273611 - DNA, 25 bp, Homo sapien
gggactgatgcctgagcgccaccta

SEQ ID NO: 273612 - DNA, 25 bp, Homo sapien
agcgccacctactgcattttggaca

SEQ ID NO: 273613 - DNA, 25 bp, Homo sapien
cacctactgcattttggacacctca

SEQ ID NO: 273614 - DNA, 25 bp, Homo sapien
agacacctgggactttccccttctg

SEQ ID NO: 273615 - DNA, 25 bp, Homo sapien
aagaaccatgaagagatcatctcca

SEQ ID NO: 273616 - DNA, 25 bp, Homo sapien
gatcatctccacctacaggaatcat

SEQ ID NO: 273617 - DNA, 25 bp, Homo sapien
aatcatctactgaatgctgctcggg

SEQ ID NO: 273618 - DNA, 25 bp, Homo sapien
gaagtgtacaatatcctgctgcaaa

SEQ ID NO: 273619 - DNA, 25 bp, Homo sapien
atcctgctgcaaatccttagcatgg

SEQ ID NO: 273620 - DNA, 25 bp, Homo sapien
cctcagggatacgagattctctgtt

SEQ ID NO: 273621 - DNA, 25 bp, Homo sapien
tctctgttggaataagaaaccctgg

SEQ ID NO: 273622 - DNA, 25 bp, Homo sapien
gaaaccctggttgacagaggcttca

SEQ ID NO: 273623 - DNA, 25 bp, Homo sapien
gacagaggcttcatcaggctgtggt

SEQ ID NO: 273624 - DNA, 25 bp, Homo sapien
agctttcagaagaggttctagcaat

SEQ ID NO: 273625 - DNA, 25 bp, Homo sapien
ggagaaaatgctcgccttgccctgc

SEQ ID NO: 273626 - DNA, 25 bp, Homo sapien
gaggcggagtttagtatccaagtcc

SEQ ID NO: 273627 - DNA, 25 bp, Homo sapien
gagtttagtatccaagtccgcgggt

SEQ ID NO: 273628 - DNA, 25 bp, Homo sapien
ttagtatccaagtccgcgggtgtga

SEQ ID NO: 273629 - DNA, 25 bp, Homo sapien
aagtccgcgggtgtgagcgcgcgcg

SEQ ID NO: 273630 - DNA, 25 bp, Homo sapien
tgccggaagatggtcaacgaccggt

SEQ ID NO: 273631 - DNA, 25 bp, Homo sapien
gcgacaagccgcagacaaatcagcc

SEQ ID NO: 273632 - DNA, 25 bp, Homo sapien
aagccgcagacaaatcagccccgtt

SEQ ID NO: 273633 - DNA, 25 bp, Homo sapien
cgcagacaaatcagccccgttgctg

SEQ ID NO: 273634 - DNA, 25 bp, Homo sapien
acaaatcagccccgttgctgagtct

SEQ ID NO: 273635 - DNA, 25 bp, Homo sapien
tccctaggtcttttcggaggcggag

SEQ ID NO: 273636 - DNA, 25 bp, Homo sapien
tttcggaggcggagtttagtatcca

SEQ ID NO: 273637 - DNA, 25 bp, Homo sapien
gataaagtatatgagcatgtacagg

SEQ ID NO: 273638 - DNA, 25 bp, Homo sapien
atgagcatgtacaggggtgtccaat

SEQ ID NO: 273639 - DNA, 25 bp, Homo sapien
acagaagggatttgcaagtgctcac

SEQ ID NO: 273640 - DNA, 25 bp, Homo sapien
gaagggatttgcaagtgctcacaat

SEQ ID NO: 273641 - DNA, 25 bp, Homo sapien
agggatttgcaagtgctcacaattt

SEQ ID NO: 273642 - DNA, 25 bp, Homo sapien
gggatttgcaagtgctcacaatttg

SEQ ID NO: 273643 - DNA, 25 bp, Homo sapien
gatttgcaagtgctcacaatttggg

SEQ ID NO: 273644 - DNA, 25 bp, Homo sapien
gcaagtgctcacaatttggggacaa

SEQ ID NO: 273645 - DNA, 25 bp, Homo sapien
aaagatcttttaaagcaaatgcaag

SEQ ID NO: 273646 - DNA, 25 bp, Homo sapien
gcaaatgcaagaacacttacagata

SEQ ID NO: 273647 - DNA, 25 bp, Homo sapien
gcaagaacacttacagataagggct

SEQ ID NO: 273648 - DNA, 25 bp, Homo sapien
gagatgtgccagatttagattttct

SEQ ID NO: 273649 - DNA, 25 bp, Homo sapien
tagattttcttaccctaatctgttt

SEQ ID NO: 273650 - DNA, 25 bp, Homo sapien
attccatttgaaagtgtcaagccca

SEQ ID NO: 273651 - DNA, 25 bp, Homo sapien
gtgtcaagcccattcagataagcta

SEQ ID NO: 273652 - DNA, 25 bp, Homo sapien
gataagctataatctggtctttaag

SEQ ID NO: 273653 - DNA, 25 bp, Homo sapien
tctggtctttaaggaacacaacttt

SEQ ID NO: 273654 - DNA, 25 bp, Homo sapien
taaaactgcagctttcttttatata

SEQ ID NO: 273655 - DNA, 25 bp, Homo sapien
ttttatataaatcaagcctctgtta

SEQ ID NO: 273656 - DNA, 25 bp, Homo sapien
gcctctgttaacttgaattccttat

SEQ ID NO: 273657 - DNA, 25 bp, Homo sapien
cttatagtacatattttcccatctg

SEQ ID NO: 273658 - DNA, 25 bp, Homo sapien
ttcccatctgtaatgacgaaatttt

SEQ ID NO: 273659 - DNA, 25 bp, Homo sapien
aactaaacatcatatgttctcatat

SEQ ID NO: 273660 - DNA, 25 bp, Homo sapien
atatgttctcatatgtccctaagct

SEQ ID NO: 273661 - DNA, 25 bp, Homo sapien
tatgttctcatatgtccctaagcta

SEQ ID NO: 273662 - DNA, 25 bp, Homo sapien
atgttctcatatgtccctaagctat

SEQ ID NO: 273663 - DNA, 25 bp, Homo sapien
tgttctcatatgtccctaagctatg

SEQ ID NO: 273664 - DNA, 25 bp, Homo sapien
gttctcatatgtccctaagctatga

SEQ ID NO: 273665 - DNA, 25 bp, Homo sapien
ctcaagagtactatggtaatataat

SEQ ID NO: 273666 - DNA, 25 bp, Homo sapien
tcatatgtccctaagctatgaggat

SEQ ID NO: 273667 - DNA, 25 bp, Homo sapien
ttaaaaatcgccaaagaacttatgt

SEQ ID NO: 273668 - DNA, 25 bp, Homo sapien
aatcgccaaagaacttatgtaacta

SEQ ID NO: 273669 - DNA, 25 bp, Homo sapien
tcaactgaggaatggaaaactaaac

SEQ ID NO: 273670 - DNA, 25 bp, Homo sapien
gcaagtgcaagaacagagaggagca

SEQ ID NO: 273671 - DNA, 25 bp, Homo sapien
caagtgcaagaacagagaggagcaa

SEQ ID NO: 273672 - DNA, 25 bp, Homo sapien
cagagaggagcaaagcgcggctgga

SEQ ID NO: 273673 - DNA, 25 bp, Homo sapien
gagaggagcaaagcgcggctggagt

SEQ ID NO: 273674 - DNA, 25 bp, Homo sapien
aagtcagcagtctaggaggtggcac

SEQ ID NO: 273675 - DNA, 25 bp, Homo sapien
agtcagcagtctaggaggtggcaca

SEQ ID NO: 273676 - DNA, 25 bp, Homo sapien
tcagcagtctaggaggtggcacaga

SEQ ID NO: 273677 - DNA, 25 bp, Homo sapien
agcagtctaggaggtggcacagaga

SEQ ID NO: 273678 - DNA, 25 bp, Homo sapien
ggtggcacagagatgacatgtgaat

SEQ ID NO: 273679 - DNA, 25 bp, Homo sapien
gtggcacagagatgacatgtgaata

SEQ ID NO: 273680 - DNA, 25 bp, Homo sapien
tggcacagagatgacatgtgaataa

SEQ ID NO: 273681 - DNA, 25 bp, Homo sapien
ggaatagtgaggtggctgagtcaga

SEQ ID NO: 273682 - DNA, 25 bp, Homo sapien
ggctgagtcagaggcagagtgatgc

SEQ ID NO: 273683 - DNA, 25 bp, Homo sapien
aggcagagtgatgcaatgactgaaa

SEQ ID NO: 273684 - DNA, 25 bp, Homo sapien
gagtgatgcaatgactgaaagactt

SEQ ID NO: 273685 - DNA, 25 bp, Homo sapien
gatgcaatgactgaaagacttaacc

SEQ ID NO: 273686 - DNA, 25 bp, Homo sapien
tgactgaaagacttaaccagccatc

SEQ ID NO: 273687 - DNA, 25 bp, Homo sapien
ctgaaagacttaaccagccatcacc

SEQ ID NO: 273688 - DNA, 25 bp, Homo sapien
gaaagacttaaccagccatcaccgg

SEQ ID NO: 273689 - DNA, 25 bp, Homo sapien
aaagacttaaccagccatcaccggc

SEQ ID NO: 273690 - DNA, 25 bp, Homo sapien
aagacggtcatgagccagggaatgc

SEQ ID NO: 273691 - DNA, 25 bp, Homo sapien
agacggtcatgagccagggaatgca

SEQ ID NO: 273692 - DNA, 25 bp, Homo sapien
ggaaacaaagagtcaaactgtggac

SEQ ID NO: 273693 - DNA, 25 bp, Homo sapien
aactgtggacttgattttgttagct

SEQ ID NO: 273694 - DNA, 25 bp, Homo sapien
atttatctttcattcagttcccttc

SEQ ID NO: 273695 - DNA, 25 bp, Homo sapien
tttcattcagttcccttccattatc

SEQ ID NO: 273696 - DNA, 25 bp, Homo sapien
ccattatcatttacttttacttaga

SEQ ID NO: 273697 - DNA, 25 bp, Homo sapien
tacttagaagtatccaaggaagtct

SEQ ID NO: 273698 - DNA, 25 bp, Homo sapien
tccatttcttcctaaagggagagtg

SEQ ID NO: 273699 - DNA, 25 bp, Homo sapien
gagtgagtgatatgtacagtgtttt

SEQ ID NO: 273700 - DNA, 25 bp, Homo sapien
ttgtatacatatattccagaacttg

SEQ ID NO: 273701 - DNA, 25 bp, Homo sapien
tccagaacttggaggaaatcttatt

SEQ ID NO: 273702 - DNA, 25 bp, Homo sapien
tatgaatataaccatctgttactgt

SEQ ID NO: 273703 - DNA, 25 bp, Homo sapien
gggtctgatttatctgtgtttgcct

SEQ ID NO: 273704 - DNA, 25 bp, Homo sapien
atctgtgtttgcctagagctttaac

SEQ ID NO: 273705 - DNA, 25 bp, Homo sapien
gagctttaacagagcctgacacttg

SEQ ID NO: 273706 - DNA, 25 bp, Homo sapien
ttaacagagcctgacacttgtaact

SEQ ID NO: 273707 - DNA, 25 bp, Homo sapien
aaatctaaactcaggcatggtggct

SEQ ID NO: 273708 - DNA, 25 bp, Homo sapien
taagttatttgggagctatcagaat

SEQ ID NO: 273709 - DNA, 25 bp, Homo sapien
gaggaaggcctgagcctaggaactc

SEQ ID NO: 273710 - DNA, 25 bp, Homo sapien
gcctgagcctaggaactcaaggtga

SEQ ID NO: 273711 - DNA, 25 bp, Homo sapien
attatctatctattagctgtcagaa

SEQ ID NO: 273712 - DNA, 25 bp, Homo sapien
taaaagcttactgagggtcctgaac

SEQ ID NO: 273713 - DNA, 25 bp, Homo sapien
gcttactgagggtcctgaactgtga

SEQ ID NO: 273714 - DNA, 25 bp, Homo sapien
gaagttttctaattgctcccatttt

SEQ ID NO: 273715 - DNA, 25 bp, Homo sapien
attgctcccattttcccagcaaaat

SEQ ID NO: 273716 - DNA, 25 bp, Homo sapien
gggtcacataggacaatctctagtg

SEQ ID NO: 273717 - DNA, 25 bp, Homo sapien
ggacaatctctagtgcttgtaaatc

SEQ ID NO: 273718 - DNA, 25 bp, Homo sapien
ctctagtgcttgtaaatctaaggaa

SEQ ID NO: 273719 - DNA, 25 bp, Homo sapien
ctgaagagggagagttgctgaaaca

SEQ ID NO: 273720 - DNA, 25 bp, Homo sapien
gaaacaacacttgataggccgtaag

SEQ ID NO: 273721 - DNA, 25 bp, Homo sapien
taggccgtaagaagggatctgatga

SEQ ID NO: 273722 - DNA, 25 bp, Homo sapien
gagaggctggctttaagtaggaata

SEQ ID NO: 273723 - DNA, 25 bp, Homo sapien
tagaaacagtccaattccagtacta

SEQ ID NO: 273724 - DNA, 25 bp, Homo sapien
ctaggaaggcagagtaatgggcaat

SEQ ID NO: 273725 - DNA, 25 bp, Homo sapien
ctggagcaccctgctgggccgtgga

SEQ ID NO: 273726 - DNA, 25 bp, Homo sapien
taggcttccaaaggtactctggccc

SEQ ID NO: 273727 - DNA, 25 bp, Homo sapien
ttccaaaggtactctggcccctggc

SEQ ID NO: 273728 - DNA, 25 bp, Homo sapien
tctggcccctggctgcgttgctgca

SEQ ID NO: 273729 - DNA, 25 bp, Homo sapien
ctctgcacagagcacgggatcagct

SEQ ID NO: 273730 - DNA, 25 bp, Homo sapien
acgggatcagctccacgttgttaac

SEQ ID NO: 273731 - DNA, 25 bp, Homo sapien
tcagctccacgttgttaacctcaaa

SEQ ID NO: 273732 - DNA, 25 bp, Homo sapien
gctccacgttgttaacctcaaatcg

SEQ ID NO: 273733 - DNA, 25 bp, Homo sapien
cctcaaatcgtaattgctgcctcat

SEQ ID NO: 273734 - DNA, 25 bp, Homo sapien
atcgtaattgctgcctcataaaggg

SEQ ID NO: 273735 - DNA, 25 bp, Homo sapien
acagcacaggactctccaggacgct

SEQ ID NO: 273736 - DNA, 25 bp, Homo sapien
ttcctgcaaggcgaggtcgagagtc

SEQ ID NO: 273737 - DNA, 25 bp, Homo sapien
gcgaggtcgagagtcaccttgtgtt

SEQ ID NO: 273738 - DNA, 25 bp, Homo sapien
gtcgagagtcaccttgtgttgaaaa

SEQ ID NO: 273739 - DNA, 25 bp, Homo sapien
aatatattccccaaatgcccgtaag

SEQ ID NO: 273740 - DNA, 25 bp, Homo sapien
caaatgcccgtaagaattcctactt

SEQ ID NO: 273741 - DNA, 25 bp, Homo sapien
aattcctacttcaagcctcagactt

SEQ ID NO: 273742 - DNA, 25 bp, Homo sapien
aactacttgactgaggttagttata

SEQ ID NO: 273743 - DNA, 25 bp, Homo sapien
gttagttatatgaccgtttctcttt

SEQ ID NO: 273744 - DNA, 25 bp, Homo sapien
tgaccgtttctctttagggtttcat

SEQ ID NO: 273745 - DNA, 25 bp, Homo sapien
agggtttcatttctctagcgtaatt

SEQ ID NO: 273746 - DNA, 25 bp, Homo sapien
atttctctagcgtaattcttgttta

SEQ ID NO: 273747 - DNA, 25 bp, Homo sapien
ggacacctaccagggaacggagatg

SEQ ID NO: 273748 - DNA, 25 bp, Homo sapien
acctaccagggaacggagatgtgta

SEQ ID NO: 273749 - DNA, 25 bp, Homo sapien
accagggaacggagatgtgtatcaa

SEQ ID NO: 273750 - DNA, 25 bp, Homo sapien
agatgtgtatcaagaaaggctggca

SEQ ID NO: 273751 - DNA, 25 bp, Homo sapien
gataaagaatccctcgttcttcagg

SEQ ID NO: 273752 - DNA, 25 bp, Homo sapien
taaagaatccctcgttcttcaggta

SEQ ID NO: 273753 - DNA, 25 bp, Homo sapien
aagaatccctcgttcttcaggtaag

SEQ ID NO: 273754 - DNA, 25 bp, Homo sapien
gaatccctcgttcttcaggtaagtg

SEQ ID NO: 273755 - DNA, 25 bp, Homo sapien
gtaagtgtgttaacagaccaggtgg

SEQ ID NO: 273756 - DNA, 25 bp, Homo sapien
tgttaacagaccaggtggaggctca

SEQ ID NO: 273757 - DNA, 25 bp, Homo sapien
ttaacagaccaggtggaggctcagg

SEQ ID NO: 273758 - DNA, 25 bp, Homo sapien
ggtgacggccgcacaacagcatgaa

SEQ ID NO: 273759 - DNA, 25 bp, Homo sapien
gacggccgcacaacagcatgaatgg

SEQ ID NO: 273760 - DNA, 25 bp, Homo sapien
gcatgaatggactgaacgccactga

SEQ ID NO: 273761 - DNA, 25 bp, Homo sapien
ggactgaacgccactgaaaactgaa

SEQ ID NO: 273762 - DNA, 25 bp, Homo sapien
tgaacgccactgaaaactgaactct

SEQ ID NO: 273763 - DNA, 25 bp, Homo sapien
aacgccactgaaaactgaactcttg

SEQ ID NO: 273764 - DNA, 25 bp, Homo sapien
gcaaacaactcttctccccaaaaat

SEQ ID NO: 273765 - DNA, 25 bp, Homo sapien
gggtgtacttacactaaatatgtag

SEQ ID NO: 273766 - DNA, 25 bp, Homo sapien
tatgtagggcatatttactctcaac

SEQ ID NO: 273767 - DNA, 25 bp, Homo sapien
tgtagggcatatttactctcaacat

SEQ ID NO: 273768 - DNA, 25 bp, Homo sapien
tactctcaacatttatttccttatt

SEQ ID NO: 273769 - DNA, 25 bp, Homo sapien
ttgtaaatgactttttgcagtgtaa

SEQ ID NO: 273770 - DNA, 25 bp, Homo sapien
aaaaatctgtgtaccgtgaagtgtt

SEQ ID NO: 273771 - DNA, 25 bp, Homo sapien
gaagtgttttctttctagcttccct

SEQ ID NO: 273772 - DNA, 25 bp, Homo sapien
gagctagagctgcttctcagaattt

SEQ ID NO: 273773 - DNA, 25 bp, Homo sapien
ttctagcttccctttaggtagttca

SEQ ID NO: 273774 - DNA, 25 bp, Homo sapien
aggtagttcaactgggcatctgtta

SEQ ID NO: 273775 - DNA, 25 bp, Homo sapien
gggcatctgttaaatctcagtgaaa

SEQ ID NO: 273776 - DNA, 25 bp, Homo sapien
aattatttcaaaagcagatcctggg

SEQ ID NO: 273777 - DNA, 25 bp, Homo sapien
agatagaaaatctcccgactgggca

SEQ ID NO: 273778 - DNA, 25 bp, Homo sapien
aaatctcccgactgggcacggttgt

SEQ ID NO: 273779 - DNA, 25 bp, Homo sapien
gaattttaaggccagagacttctct

SEQ ID NO: 273780 - DNA, 25 bp, Homo sapien
ctgactgtcaggataaactccgtgg

SEQ ID NO: 273781 - DNA, 25 bp, Homo sapien
gtacaggagcccagacaaagcccag

SEQ ID NO: 273782 - DNA, 25 bp, Homo sapien
gcctgtcaagagacgcagagggccc

SEQ ID NO: 273783 - DNA, 25 bp, Homo sapien
ctactccctgggagccacgtgctgg

SEQ ID NO: 273784 - DNA, 25 bp, Homo sapien
gagccacgtgctggccatgtggcca

SEQ ID NO: 273785 - DNA, 25 bp, Homo sapien
catgtggccagggacggcatgagca

SEQ ID NO: 273786 - DNA, 25 bp, Homo sapien
gggccttctggtttggtgtcaacag

SEQ ID NO: 273787 - DNA, 25 bp, Homo sapien
tttggtgtcaacagctcacaggagc

SEQ ID NO: 273788 - DNA, 25 bp, Homo sapien
tcaacagctcacaggagcgtgaacc

SEQ ID NO: 273789 - DNA, 25 bp, Homo sapien
ggtaaaacccaagacattaaatctg

SEQ ID NO: 273790 - DNA, 25 bp, Homo sapien
ccaagacattaaatctgccatctca

SEQ ID NO: 273791 - DNA, 25 bp, Homo sapien
cgctacgctgcaggccttgaagctg

SEQ ID NO: 273792 - DNA, 25 bp, Homo sapien
gctgccgctgcttccgaggttgccg

SEQ ID NO: 273793 - DNA, 25 bp, Homo sapien
gctgcttccgaggttgccggcggga

SEQ ID NO: 273794 - DNA, 25 bp, Homo sapien
ttcacgatctcctaccgcggcgggc

SEQ ID NO: 273795 - DNA, 25 bp, Homo sapien
gaggcgagacgacggcgcgcgtcag

SEQ ID NO: 273796 - DNA, 25 bp, Homo sapien
gcgcgtcaggtcgtccagggactgc

SEQ ID NO: 273797 - DNA, 25 bp, Homo sapien
gggccgcgtacctcctggatggcct

SEQ ID NO: 273798 - DNA, 25 bp, Homo sapien
cgtacctcctggatggcctcttaga

SEQ ID NO: 273799 - DNA, 25 bp, Homo sapien
ctcctggatggcctcttagacgttc

SEQ ID NO: 273800 - DNA, 25 bp, Homo sapien
ttagacgttctctgagtcgctgcgc

SEQ ID NO: 273801 - DNA, 25 bp, Homo sapien
acaggggcagcaggcacacccagga

SEQ ID NO: 273802 - DNA, 25 bp, Homo sapien
gcactagtagtttctggcgcaggca

SEQ ID NO: 273803 - DNA, 25 bp, Homo sapien
agggagaatggctgtgcatcttgta

SEQ ID NO: 273804 - DNA, 25 bp, Homo sapien
gtcgtagtagtgtctgtcctgggct

SEQ ID NO: 273805 - DNA, 25 bp, Homo sapien
ggttgggagtgtactctctgagaat

SEQ ID NO: 273806 - DNA, 25 bp, Homo sapien
tactctctgagaataccttggaagg

SEQ ID NO: 273807 - DNA, 25 bp, Homo sapien
gatgtgtatgagtggtgcacaccca

SEQ ID NO: 273808 - DNA, 25 bp, Homo sapien
atgagtggtgcacacccatgtgctt

SEQ ID NO: 273809 - DNA, 25 bp, Homo sapien
acacccatgtgctttatggctcaac

SEQ ID NO: 273810 - DNA, 25 bp, Homo sapien
ggctcaacaatcattccattctttc

SEQ ID NO: 273811 - DNA, 25 bp, Homo sapien
aacaatcattccattctttcccatt

SEQ ID NO: 273812 - DNA, 25 bp, Homo sapien
gtagttcaaatttgggaggtactgt

SEQ ID NO: 273813 - DNA, 25 bp, Homo sapien
ttctgtcgtcttctcgcagccgtat

SEQ ID NO: 273814 - DNA, 25 bp, Homo sapien
tctgtcgtcttctcgcagccgtata

SEQ ID NO: 273815 - DNA, 25 bp, Homo sapien
ctgtcgtcttctcgcagccgtatag

SEQ ID NO: 273816 - DNA, 25 bp, Homo sapien
tgtcgtcttctcgcagccgtatagt

SEQ ID NO: 273817 - DNA, 25 bp, Homo sapien
tttttgcaaaacattcacatacatt

SEQ ID NO: 273818 - DNA, 25 bp, Homo sapien
ttcacatacatttaatctctttctc

SEQ ID NO: 273819 - DNA, 25 bp, Homo sapien
tcacatacatttaatctctttctcc

SEQ ID NO: 273820 - DNA, 25 bp, Homo sapien
cacatacatttaatctctttctcct

SEQ ID NO: 273821 - DNA, 25 bp, Homo sapien
acatacatttaatctctttctcctc

SEQ ID NO: 273822 - DNA, 25 bp, Homo sapien
catacatttaatctctttctcctcc

SEQ ID NO: 273823 - DNA, 25 bp, Homo sapien
atacatttaatctctttctcctcct

SEQ ID NO: 273824 - DNA, 25 bp, Homo sapien
acttgtcgttgtaatcctcctggat

SEQ ID NO: 273825 - DNA, 25 bp, Homo sapien
taaactcactgtatgggtcgtggat

SEQ ID NO: 273826 - DNA, 25 bp, Homo sapien
ttttcctgtgctgaggatcttgtcc

SEQ ID NO: 273827 - DNA, 25 bp, Homo sapien
ggtcgtggatgatgcccctgtagat

SEQ ID NO: 273828 - DNA, 25 bp, Homo sapien
ctcgaagtagggagcactggccgcc

SEQ ID NO: 273829 - DNA, 25 bp, Homo sapien
actggccgccttggttaggtacagg

SEQ ID NO: 273830 - DNA, 25 bp, Homo sapien
ttaggtacaggcatagctcctgcgc

SEQ ID NO: 273831 - DNA, 25 bp, Homo sapien
tgtagctgaagctcctgtcgtggag

SEQ ID NO: 273832 - DNA, 25 bp, Homo sapien
tcttgtccgccattttctgcaggaa

SEQ ID NO: 273833 - DNA, 25 bp, Homo sapien
atctgctgctggacgatggtgtacc

SEQ ID NO: 273834 - DNA, 25 bp, Homo sapien
ctggtcccagtacttgtcgttgtaa

SEQ ID NO: 273835 - DNA, 25 bp, Homo sapien
gaccaagtgggagtgttttctccac

SEQ ID NO: 273836 - DNA, 25 bp, Homo sapien
gagtgttttctccactattacacaa

SEQ ID NO: 273837 - DNA, 25 bp, Homo sapien
acacaagatttctcacttacagaat

SEQ ID NO: 273838 - DNA, 25 bp, Homo sapien
ttcttcctctatcaagctctactac

SEQ ID NO: 273839 - DNA, 25 bp, Homo sapien
agctctactacctttggttccaacg

SEQ ID NO: 273840 - DNA, 25 bp, Homo sapien
ggttccaacggaaacatgcctgtac

SEQ ID NO: 273841 - DNA, 25 bp, Homo sapien
agcaccctcgaacagtgactgacag

SEQ ID NO: 273842 - DNA, 25 bp, Homo sapien
gacaggagctggtatttatatattc

SEQ ID NO: 273843 - DNA, 25 bp, Homo sapien
ttctttggctggagacaaccctgag

SEQ ID NO: 273844 - DNA, 25 bp, Homo sapien
ggtgctgatttttccaaagcttgaa

SEQ ID NO: 273845 - DNA, 25 bp, Homo sapien
aagcttgaatatatgggtccaggaa

SEQ ID NO: 273846 - DNA, 25 bp, Homo sapien
aagatagtgacttcccagcttttct

SEQ ID NO: 273847 - DNA, 25 bp, Homo sapien
aaagcacccctaatagctgagaaga

SEQ ID NO: 273848 - DNA, 25 bp, Homo sapien
gaatctggaggcatagctaccatca

SEQ ID NO: 273849 - DNA, 25 bp, Homo sapien
tagctaccatcacagctacactaac

SEQ ID NO: 273850 - DNA, 25 bp, Homo sapien
acactaaccaccatactttactgta

SEQ ID NO: 273851 - DNA, 25 bp, Homo sapien
ttactgtatccttcaggtgtctgtc

SEQ ID NO: 273852 - DNA, 25 bp, Homo sapien
aggtgtctgtcctagctagttttgt

SEQ ID NO: 273853 - DNA, 25 bp, Homo sapien
ctagttttgtggtctggctccttca

SEQ ID NO: 273854 - DNA, 25 bp, Homo sapien
atcagaagaaaggtggccaggctca

SEQ ID NO: 273855 - DNA, 25 bp, Homo sapien
gcaacaagcctgtttattttcatta

SEQ ID NO: 273856 - DNA, 25 bp, Homo sapien
ctggcaggcttgctccattgtagag

SEQ ID NO: 273857 - DNA, 25 bp, Homo sapien
tattgcaagcatccagttccctgtt

SEQ ID NO: 273858 - DNA, 25 bp, Homo sapien
tccttttaaatgtggctagctacag

SEQ ID NO: 273859 - DNA, 25 bp, Homo sapien
gctacagtagtttgtgtttcctgca

SEQ ID NO: 273860 - DNA, 25 bp, Homo sapien
gtttcctgcaactaatcactcatac

SEQ ID NO: 273861 - DNA, 25 bp, Homo sapien
atctgtatctaaagcactccacctg

SEQ ID NO: 273862 - DNA, 25 bp, Homo sapien
tccacctgggtcatgtactatactt

SEQ ID NO: 273863 - DNA, 25 bp, Homo sapien
taattcacaaaactacctactcgtt

SEQ ID NO: 273864 - DNA, 25 bp, Homo sapien
taccaggcttgctctagagcgtggg

SEQ ID NO: 273865 - DNA, 25 bp, Homo sapien
ggcagagtgcacctattgaattcca

SEQ ID NO: 273866 - DNA, 25 bp, Homo sapien
gcacctattgaattccatcatcagt

SEQ ID NO: 273867 - DNA, 25 bp, Homo sapien
tcatcagtttttctataccatggag

SEQ ID NO: 273868 - DNA, 25 bp, Homo sapien
gcaatggcaagttcaaagtcccctg

SEQ ID NO: 273869 - DNA, 25 bp, Homo sapien
gacatccttgaatccgaagtagtga

SEQ ID NO: 273870 - DNA, 25 bp, Homo sapien
aagtcccctgaaaagtctcctgaga

SEQ ID NO: 273871 - DNA, 25 bp, Homo sapien
aatcttgtgtgttcacagaattctg

SEQ ID NO: 273872 - DNA, 25 bp, Homo sapien
gaattctgaggctggatacataaat

SEQ ID NO: 273873 - DNA, 25 bp, Homo sapien
aatgtggcttctctgaaggagacac

SEQ ID NO: 273874 - DNA, 25 bp, Homo sapien
ggagacacatggtatacaagaacaa

SEQ ID NO: 273875 - DNA, 25 bp, Homo sapien
agaactataaaatcactggtgccta

SEQ ID NO: 273876 - DNA, 25 bp, Homo sapien
ctggtgcctaaagctatactgaaca

SEQ ID NO: 273877 - DNA, 25 bp, Homo sapien
attgcctttatcaaactccagtttt

SEQ ID NO: 273878 - DNA, 25 bp, Homo sapien
ggtagagtcatttgcaagtcttcaa

SEQ ID NO: 273879 - DNA, 25 bp, Homo sapien
gagtcactcttggacactgtgtcta

SEQ ID NO: 273880 - DNA, 25 bp, Homo sapien
gatatcaacctggtaaacacttatc

SEQ ID NO: 273881 - DNA, 25 bp, Homo sapien
cttatcagaagtgtaccgttgtgta

SEQ ID NO: 273882 - DNA, 25 bp, Homo sapien
gtaccgttgtgtatacaaagttcga

SEQ ID NO: 273883 - DNA, 25 bp, Homo sapien
gttcgaagtcgtttacttgcttgca

SEQ ID NO: 273884 - DNA, 25 bp, Homo sapien
acttgcttgcaagaaccttgaactt

SEQ ID NO: 273885 - DNA, 25 bp, Homo sapien
gaacttattcaaacaaggtcatcat

SEQ ID NO: 273886 - DNA, 25 bp, Homo sapien
acaaggtcatcatcacgggacagat

SEQ ID NO: 273887 - DNA, 25 bp, Homo sapien
cactgtgtctagatttgttcttgca

SEQ ID NO: 273888 - DNA, 25 bp, Homo sapien
gttcttgcagctcttctgaaacaca

SEQ ID NO: 273889 - DNA, 25 bp, Homo sapien
atttacttagtcaagcatgtggaga

SEQ ID NO: 273890 - DNA, 25 bp, Homo sapien
ggactgtgggtctgactcctgcgtt

SEQ ID NO: 273891 - DNA, 25 bp, Homo sapien
tgtgggtctgactcctgcgttccag

SEQ ID NO: 273892 - DNA, 25 bp, Homo sapien
tgactcctgcgttccagccgtgggt

SEQ ID NO: 273893 - DNA, 25 bp, Homo sapien
actcctgcgttccagccgtgggtgc

SEQ ID NO: 273894 - DNA, 25 bp, Homo sapien
gggtgccacctcttgcgggaagcag

SEQ ID NO: 273895 - DNA, 25 bp, Homo sapien
gggaagcagggcaaaaccactttgg

SEQ ID NO: 273896 - DNA, 25 bp, Homo sapien
aaaaccactttggtcaggcgctcct

SEQ ID NO: 273897 - DNA, 25 bp, Homo sapien
ttggtcaggcgctcctcgtgccttt

SEQ ID NO: 273898 - DNA, 25 bp, Homo sapien
gtgcctttctcccttcgtaggtgac

SEQ ID NO: 273899 - DNA, 25 bp, Homo sapien
ttctcccttcgtaggtgaccagcat

SEQ ID NO: 273900 - DNA, 25 bp, Homo sapien
ccttcgtaggtgaccagcatctcgt

SEQ ID NO: 273901 - DNA, 25 bp, Homo sapien
ggcagctcagcctggtccattgaga

SEQ ID NO: 273902 - DNA, 25 bp, Homo sapien
tggtccattgagacccactctaaac

SEQ ID NO: 273903 - DNA, 25 bp, Homo sapien
gagacccactctaaacagacatcat

SEQ ID NO: 273904 - DNA, 25 bp, Homo sapien
aacagacatcatatttggaacaaga

SEQ ID NO: 273905 - DNA, 25 bp, Homo sapien
atgcttcgagacaggaatgggcccc

SEQ ID NO: 273906 - DNA, 25 bp, Homo sapien
aatgggccccactgtcatgcagaaa

SEQ ID NO: 273907 - DNA, 25 bp, Homo sapien
tttatgttttctcttgtgccaccac

SEQ ID NO: 273908 - DNA, 25 bp, Homo sapien
tttctcttgtgccaccaccaaactg

SEQ ID NO: 273909 - DNA, 25 bp, Homo sapien
ggacctgctgtgacctaaagggcat

SEQ ID NO: 273910 - DNA, 25 bp, Homo sapien
taaagggcattcctttagcagataa

SEQ ID NO: 273911 - DNA, 25 bp, Homo sapien
agataagaccttgaaaactgcaaaa

SEQ ID NO: 273912 - DNA, 25 bp, Homo sapien
aatgatactaatagtacttatccca

SEQ ID NO: 273913 - DNA, 25 bp, Homo sapien
ataaatagccaaaagccaatacata

SEQ ID NO: 273914 - DNA, 25 bp, Homo sapien
aaatagccaaaagccaatacataat

SEQ ID NO: 273915 - DNA, 25 bp, Homo sapien
atagccaaaagccaatacataataa

SEQ ID NO: 273916 - DNA, 25 bp, Homo sapien
ccaggaatacattgttagatgactg

SEQ ID NO: 273917 - DNA, 25 bp, Homo sapien
aggaatacattgttagatgactgaa

SEQ ID NO: 273918 - DNA, 25 bp, Homo sapien
ggaatacattgttagatgactgaaa

SEQ ID NO: 273919 - DNA, 25 bp, Homo sapien
gaatacattgttagatgactgaaaa

SEQ ID NO: 273920 - DNA, 25 bp, Homo sapien
aatacattgttagatgactgaaaaa

SEQ ID NO: 273921 - DNA, 25 bp, Homo sapien
ggagctctatttctgttaacccaaa

SEQ ID NO: 273922 - DNA, 25 bp, Homo sapien
gagctctatttctgttaacccaaat

SEQ ID NO: 273923 - DNA, 25 bp, Homo sapien
tctaccaactggatatatttactta

SEQ ID NO: 273924 - DNA, 25 bp, Homo sapien
tacttaagtctgttttctgttctaa

SEQ ID NO: 273925 - DNA, 25 bp, Homo sapien
aaggttggattcagtagcctctaac

SEQ ID NO: 273926 - DNA, 25 bp, Homo sapien
gattcagtagcctctaaccattttc

SEQ ID NO: 273927 - DNA, 25 bp, Homo sapien
tttttgaaaacttactctttggatg

SEQ ID NO: 273928 - DNA, 25 bp, Homo sapien
aggaatgtgtttcagcatttccaca

SEQ ID NO: 273929 - DNA, 25 bp, Homo sapien
tttccacatttagaagaggcaatct

SEQ ID NO: 273930 - DNA, 25 bp, Homo sapien
gctttttcatgactcaatctttcac

SEQ ID NO: 273931 - DNA, 25 bp, Homo sapien
aatctttcactgaataggtttggca

SEQ ID NO: 273932 - DNA, 25 bp, Homo sapien
aggtttggcagtaaatttcactaag

SEQ ID NO: 273933 - DNA, 25 bp, Homo sapien
gaattataatttcagttctaccaac

SEQ ID NO: 273934 - DNA, 25 bp, Homo sapien
agcttggaggaagcccgagcgacct

SEQ ID NO: 273935 - DNA, 25 bp, Homo sapien
ggctgaccttcctcattcttttcaa

SEQ ID NO: 273936 - DNA, 25 bp, Homo sapien
gtgtgaataataaccaagcccagtt

SEQ ID NO: 273937 - DNA, 25 bp, Homo sapien
agcccagtttggcaactccttgagg

SEQ ID NO: 273938 - DNA, 25 bp, Homo sapien
gccccattctcctttttggaacttg

SEQ ID NO: 273939 - DNA, 25 bp, Homo sapien
tcaggaagcaggttctctccagtcg

SEQ ID NO: 273940 - DNA, 25 bp, Homo sapien
tctccagtcggtggctttcctttct

SEQ ID NO: 273941 - DNA, 25 bp, Homo sapien
ttcctttctgttgcgggtctcttga

SEQ ID NO: 273942 - DNA, 25 bp, Homo sapien
ttctgttgcgggtctcttgagggcc

SEQ ID NO: 273943 - DNA, 25 bp, Homo sapien
tgccctgtcagttacggaacagagg

SEQ ID NO: 273944 - DNA, 25 bp, Homo sapien
ggaggacacagcaaatttgaaccaa

SEQ ID NO: 273945 - DNA, 25 bp, Homo sapien
gaattgtatctcatttggctgagca

SEQ ID NO: 273946 - DNA, 25 bp, Homo sapien
atttggctgagcattacttttgtca

SEQ ID NO: 273947 - DNA, 25 bp, Homo sapien
attacttttgtcagaatgtgttatc

SEQ ID NO: 273948 - DNA, 25 bp, Homo sapien
gttatctgtaaaccatgtgtagtga

SEQ ID NO: 273949 - DNA, 25 bp, Homo sapien
aaccatgtgtagtgaaattcttctg

SEQ ID NO: 273950 - DNA, 25 bp, Homo sapien
gaaattcttctgtaactttggatta

SEQ ID NO: 273951 - DNA, 25 bp, Homo sapien
atttcttttgtagacctgctgatgg

SEQ ID NO: 273952 - DNA, 25 bp, Homo sapien
ttgtagacctgctgatggtatggtt

SEQ ID NO: 273953 - DNA, 25 bp, Homo sapien
gatcacagggtagtgatgtctactg

SEQ ID NO: 273954 - DNA, 25 bp, Homo sapien
gatgtctactgggattatactcata

SEQ ID NO: 273955 - DNA, 25 bp, Homo sapien
gggattatactcataacatctacac

SEQ ID NO: 273956 - DNA, 25 bp, Homo sapien
aaaggagtctactgctaagatttca

SEQ ID NO: 273957 - DNA, 25 bp, Homo sapien
gtaccgggcacaccatcgcaatgct

SEQ ID NO: 273958 - DNA, 25 bp, Homo sapien
ttctttccttcatatcaagtcaact

SEQ ID NO: 273959 - DNA, 25 bp, Homo sapien
aagtcaactcaagcttgctctactt

SEQ ID NO: 273960 - DNA, 25 bp, Homo sapien
aagcttgctctacttacctggtgta

SEQ ID NO: 273961 - DNA, 25 bp, Homo sapien
acctggtgtacacagtctaagaact

SEQ ID NO: 273962 - DNA, 25 bp, Homo sapien
agaactgtaagaagactggagcaaa

SEQ ID NO: 273963 - DNA, 25 bp, Homo sapien
aaaaccactcccctgacagttgagg

SEQ ID NO: 273964 - DNA, 25 bp, Homo sapien
gacagttgagggtcaagctgctcct

SEQ ID NO: 273965 - DNA, 25 bp, Homo sapien
aagctgctcctctgactgaatttgt

SEQ ID NO: 273966 - DNA, 25 bp, Homo sapien
gctcctctgactgaatttgtgacca

SEQ ID NO: 273967 - DNA, 25 bp, Homo sapien
aaagcatttgttgtgattttaaagt

SEQ ID NO: 273968 - DNA, 25 bp, Homo sapien
tttgttgtgattttaaagtgttgca

SEQ ID NO: 273969 - DNA, 25 bp, Homo sapien
gattttgtggccgtgggtagacttt

SEQ ID NO: 273970 - DNA, 25 bp, Homo sapien
agtttgtttaagtcaccaagcagca

SEQ ID NO: 273971 - DNA, 25 bp, Homo sapien
ccaaaatcttaatgtgtttcatttg

SEQ ID NO: 273972 - DNA, 25 bp, Homo sapien
cttttggttttgctcccctataatg

SEQ ID NO: 273973 - DNA, 25 bp, Homo sapien
gctcccctataatgtgtccttcaaa

SEQ ID NO: 273974 - DNA, 25 bp, Homo sapien
ctcccctataatgtgtccttcaaat

SEQ ID NO: 273975 - DNA, 25 bp, Homo sapien
ccctataatgtgtccttcaaatgaa

SEQ ID NO: 273976 - DNA, 25 bp, Homo sapien
taatgtgtccttcaaatgaaacccc

SEQ ID NO: 273977 - DNA, 25 bp, Homo sapien
tccttcaaatgaaacccccatactt

SEQ ID NO: 273978 - DNA, 25 bp, Homo sapien
actgcaacctataaataacctttag

SEQ ID NO: 273979 - DNA, 25 bp, Homo sapien
gcaacctataaataacctttagcat

SEQ ID NO: 273980 - DNA, 25 bp, Homo sapien
taaataacctttagcattcctattg

SEQ ID NO: 273981 - DNA, 25 bp, Homo sapien
aataacctttagcattcctattgta

SEQ ID NO: 273982 - DNA, 25 bp, Homo sapien
ataacctttagcattcctattgtaa

SEQ ID NO: 273983 - DNA, 25 bp, Homo sapien
taacctttagcattcctattgtaac

SEQ ID NO: 273984 - DNA, 25 bp, Homo sapien
aacctttagcattcctattgtaaca

SEQ ID NO: 273985 - DNA, 25 bp, Homo sapien
acctttagcattcctattgtaacaa

SEQ ID NO: 273986 - DNA, 25 bp, Homo sapien
cctttagcattcctattgtaacaaa

SEQ ID NO: 273987 - DNA, 25 bp, Homo sapien
tttagcattcctattgtaacaaaat

SEQ ID NO: 273988 - DNA, 25 bp, Homo sapien
ttagcattcctattgtaacaaaatt

SEQ ID NO: 273989 - DNA, 25 bp, Homo sapien
cattaacaggtaaggagtttctaat

SEQ ID NO: 273990 - DNA, 25 bp, Homo sapien
gataaacttgttgcactcaaggtac

SEQ ID NO: 273991 - DNA, 25 bp, Homo sapien
gttgcactcaaggtacatttctact

SEQ ID NO: 273992 - DNA, 25 bp, Homo sapien
gcactcaaggtacatttctactttg

SEQ ID NO: 273993 - DNA, 25 bp, Homo sapien
ggtacatttctactttgtaaagcaa

SEQ ID NO: 273994 - DNA, 25 bp, Homo sapien
tttgtaaagcaagaagccaatacac

SEQ ID NO: 273995 - DNA, 25 bp, Homo sapien
agaagccaatacactcagttggata

SEQ ID NO: 273996 - DNA, 25 bp, Homo sapien
gccaatacactcagttggataaaaa

SEQ ID NO: 273997 - DNA, 25 bp, Homo sapien
atatagagagttacagcttatagag

SEQ ID NO: 273998 - DNA, 25 bp, Homo sapien
agcttatagagctgaagaggaataa

SEQ ID NO: 273999 - DNA, 25 bp, Homo sapien
aaaagtgtctctgaataactttatg

SEQ ID NO: 274000 - DNA, 25 bp, Homo sapien
aagtttttgtctctttgtctcatca

SEQ ID NO: 274001 - DNA, 25 bp, Homo sapien
tggtgtgcttcatagacctagccgc

SEQ ID NO: 274002 - DNA, 25 bp, Homo sapien
gcccctctagcctaactgtagacaa

SEQ ID NO: 274003 - DNA, 25 bp, Homo sapien
actgtagacaaggttggtgacggca

SEQ ID NO: 274004 - DNA, 25 bp, Homo sapien
tgacggcagcggagatgacaatgat

SEQ ID NO: 274005 - DNA, 25 bp, Homo sapien
attccgctgcacattattctcttcc

SEQ ID NO: 274006 - DNA, 25 bp, Homo sapien
atcgcatttctgactatgagcccta

SEQ ID NO: 274007 - DNA, 25 bp, Homo sapien
tatgagccctagagtcaggctgctt

SEQ ID NO: 274008 - DNA, 25 bp, Homo sapien
ggaccagcttccttggtgacttctt

SEQ ID NO: 274009 - DNA, 25 bp, Homo sapien
gtgacttcttcccttgaagccctta

SEQ ID NO: 274010 - DNA, 25 bp, Homo sapien
ctgtcagtcttacttagtcaagttt

SEQ ID NO: 274011 - DNA, 25 bp, Homo sapien
gctgctctgttttaggtctcaattt

SEQ ID NO: 274012 - DNA, 25 bp, Homo sapien
gctctgttttaggtctcaatttcat

SEQ ID NO: 274013 - DNA, 25 bp, Homo sapien
ctgttttaggtctcaatttcatctg

SEQ ID NO: 274014 - DNA, 25 bp, Homo sapien
gttttaggtctcaatttcatctgta

SEQ ID NO: 274015 - DNA, 25 bp, Homo sapien
aatgatactaatagtacttatccca

SEQ ID NO: 274016 - DNA, 25 bp, Homo sapien
aaatagccaaaagccaatacataat

SEQ ID NO: 274017 - DNA, 25 bp, Homo sapien
gatctggttccaggaatacattgtt

SEQ ID NO: 274018 - DNA, 25 bp, Homo sapien
tggttccaggaatacattgttagat

SEQ ID NO: 274019 - DNA, 25 bp, Homo sapien
ggaatacattgttagatgactgaaa

SEQ ID NO: 274020 - DNA, 25 bp, Homo sapien
ggagctctatttctgttaacccaaa

SEQ ID NO: 274021 - DNA, 25 bp, Homo sapien
gagctctatttctgttaacccaaat

SEQ ID NO: 274022 - DNA, 25 bp, Homo sapien
caagggcatggtacagctcctcaac

SEQ ID NO: 274023 - DNA, 25 bp, Homo sapien
ggagcataaggagttcccgctgccc

SEQ ID NO: 274024 - DNA, 25 bp, Homo sapien
agtcccaaaggactgcaattttgac

SEQ ID NO: 274025 - DNA, 25 bp, Homo sapien
gcatgagttatgaggccaagcacgt

SEQ ID NO: 274026 - DNA, 25 bp, Homo sapien
aggccaagcacgtctgggagtgcct

SEQ ID NO: 274027 - DNA, 25 bp, Homo sapien
tctgggagtgcctacgcaagggtat

SEQ ID NO: 274028 - DNA, 25 bp, Homo sapien
aaggaaagtcctgtgattcccctgt

SEQ ID NO: 274029 - DNA, 25 bp, Homo sapien
gtgattcccctgtcggaaagtgagc

SEQ ID NO: 274030 - DNA, 25 bp, Homo sapien
tcggaaagtgagctcctggctgaca

SEQ ID NO: 274031 - DNA, 25 bp, Homo sapien
tcctggctgacatccttgaagaggt

SEQ ID NO: 274032 - DNA, 25 bp, Homo sapien
tgaggaaggccattggagtcacctt

SEQ ID NO: 274033 - DNA, 25 bp, Homo sapien
gtgggacccggcgagcgtgagtggc

SEQ ID NO: 274034 - DNA, 25 bp, Homo sapien
gcgagcgtgagtggcccggagcggc

SEQ ID NO: 274035 - DNA, 25 bp, Homo sapien
agcggccttcgatgcggcgcagtat

SEQ ID NO: 274036 - DNA, 25 bp, Homo sapien
tcgatgcggcgcagtatgaagaggc

SEQ ID NO: 274037 - DNA, 25 bp, Homo sapien
gggcggcgactttagggcagaagac

SEQ ID NO: 274038 - DNA, 25 bp, Homo sapien
aaggtggtgtactcgcggtcgcaac

SEQ ID NO: 274039 - DNA, 25 bp, Homo sapien
ggtgtactcgcggtcgcaactgtcg

SEQ ID NO: 274040 - DNA, 25 bp, Homo sapien
tactcgcggtcgcaactgtcgctgg

SEQ ID NO: 274041 - DNA, 25 bp, Homo sapien
aactgtcgctggctgacagcaccaa

SEQ ID NO: 274042 - DNA, 25 bp, Homo sapien
gagccaacgcggactgggacggcgg

SEQ ID NO: 274043 - DNA, 25 bp, Homo sapien
gacggcggcggcagtagtgggaccc

SEQ ID NO: 274044 - DNA, 25 bp, Homo sapien
aggaaaatttttcgcagcataattt

SEQ ID NO: 274045 - DNA, 25 bp, Homo sapien
tttttcgcagcataattttaagtga

SEQ ID NO: 274046 - DNA, 25 bp, Homo sapien
gtatgatcagatttctaaatatgtg

SEQ ID NO: 274047 - DNA, 25 bp, Homo sapien
gcacacatatgtaagtttaaagaaa

SEQ ID NO: 274048 - DNA, 25 bp, Homo sapien
gttaatatatgtgaagccctttacc

SEQ ID NO: 274049 - DNA, 25 bp, Homo sapien
taggaggaaggtgtttgccctgttt

SEQ ID NO: 274050 - DNA, 25 bp, Homo sapien
cccaaagtgggaactatatctgttt

SEQ ID NO: 274051 - DNA, 25 bp, Homo sapien
atgtgaagccctttaccagtgctga

SEQ ID NO: 274052 - DNA, 25 bp, Homo sapien
gaagccctttaccagtgctgagagc

SEQ ID NO: 274053 - DNA, 25 bp, Homo sapien
gccctttaccagtgctgagagcatt

SEQ ID NO: 274054 - DNA, 25 bp, Homo sapien
ctgagagcattgtaagcattatata

SEQ ID NO: 274055 - DNA, 25 bp, Homo sapien
aggtaagtcactgcagaccgacctc

SEQ ID NO: 274056 - DNA, 25 bp, Homo sapien
ttgtggagaatcagagcatcttgac

SEQ ID NO: 274057 - DNA, 25 bp, Homo sapien
catcttgacatgactgctgacctaa

SEQ ID NO: 274058 - DNA, 25 bp, Homo sapien
tgactgctgacctaaagatccctgg

SEQ ID NO: 274059 - DNA, 25 bp, Homo sapien
atcctgtggaacctcttctagttca

SEQ ID NO: 274060 - DNA, 25 bp, Homo sapien
gtgtgagcattagactgccagttgt

SEQ ID NO: 274061 - DNA, 25 bp, Homo sapien
gactgccagttgtctagtgacatct

SEQ ID NO: 274062 - DNA, 25 bp, Homo sapien
gacatctgatgcttgctgtgaactt

SEQ ID NO: 274063 - DNA, 25 bp, Homo sapien
gaacttttaagatccccgaatcctg

SEQ ID NO: 274064 - DNA, 25 bp, Homo sapien
gaatcctgagcacctcaatctttaa

SEQ ID NO: 274065 - DNA, 25 bp, Homo sapien
tctttaattgccctgtattccgaag

SEQ ID NO: 274066 - DNA, 25 bp, Homo sapien
tctgacatctatggacaaagccttt

SEQ ID NO: 274067 - DNA, 25 bp, Homo sapien
aaagcctttatcacagtcctggaga

SEQ ID NO: 274068 - DNA, 25 bp, Homo sapien
agtcctggagatgactccggtgctt

SEQ ID NO: 274069 - DNA, 25 bp, Homo sapien
ccggtgcttgggacagaaatcatca

SEQ ID NO: 274070 - DNA, 25 bp, Homo sapien
ttaccgaggtactattatatttgac

SEQ ID NO: 274071 - DNA, 25 bp, Homo sapien
ctattatatttgaccattgcccttt

SEQ ID NO: 274072 - DNA, 25 bp, Homo sapien
gtaacattaatgcacagttttcctg

SEQ ID NO: 274073 - DNA, 25 bp, Homo sapien
cattattacagttatcatcattctt

SEQ ID NO: 274074 - DNA, 25 bp, Homo sapien
agggttcagccttaacagtatacag

SEQ ID NO: 274075 - DNA, 25 bp, Homo sapien
cagccttaacagtatacagggtaaa

SEQ ID NO: 274076 - DNA, 25 bp, Homo sapien
gggtaaaatccatgaaactgccttt

SEQ ID NO: 274077 - DNA, 25 bp, Homo sapien
gcatcttgttttgaagtgatccgaa

SEQ ID NO: 274078 - DNA, 25 bp, Homo sapien
aaagagcgtgattttcccaaactgt

SEQ ID NO: 274079 - DNA, 25 bp, Homo sapien
cagagccttgagatggaagcgagat

SEQ ID NO: 274080 - DNA, 25 bp, Homo sapien
aggccgccgggaagctgcacgtcat

SEQ ID NO: 274081 - DNA, 25 bp, Homo sapien
tgctcactgtgggatgctgtgcgat

SEQ ID NO: 274082 - DNA, 25 bp, Homo sapien
gggaagctgcacgtcatcctctgga

SEQ ID NO: 274083 - DNA, 25 bp, Homo sapien
tggacctctttgctgactgtgtgct

SEQ ID NO: 274084 - DNA, 25 bp, Homo sapien
ctttgctgactgtgtgctgtcacca

SEQ ID NO: 274085 - DNA, 25 bp, Homo sapien
agacagttactatctttccctggtt

SEQ ID NO: 274086 - DNA, 25 bp, Homo sapien
ctatctttccctggttgacggatta

SEQ ID NO: 274087 - DNA, 25 bp, Homo sapien
tggttgacggattagagtttccctt

SEQ ID NO: 274088 - DNA, 25 bp, Homo sapien
gtgccctgggttgatctctggtgat

SEQ ID NO: 274089 - DNA, 25 bp, Homo sapien
gttgatctctggtgatggccattca

SEQ ID NO: 274090 - DNA, 25 bp, Homo sapien
tggtgatggccattcacccggctgg

SEQ ID NO: 274091 - DNA, 25 bp, Homo sapien
gagggtctcccattgacacagtgaa

SEQ ID NO: 274092 - DNA, 25 bp, Homo sapien
cattgacacagtgaatttgccatgt

SEQ ID NO: 274093 - DNA, 25 bp, Homo sapien
atttgccatgtgacttgcacaggga

SEQ ID NO: 274094 - DNA, 25 bp, Homo sapien
tgcacagggaaatttggacagaatt

SEQ ID NO: 274095 - DNA, 25 bp, Homo sapien
aaaggactggagcagtttacactca

SEQ ID NO: 274096 - DNA, 25 bp, Homo sapien
ggagcagtttacactcagattaaaa

SEQ ID NO: 274097 - DNA, 25 bp, Homo sapien
acacagaacacaatcctttaatccg

SEQ ID NO: 274098 - DNA, 25 bp, Homo sapien
ctttaatccggtaacaatcacttga

SEQ ID NO: 274099 - DNA, 25 bp, Homo sapien
ggaagaaggcgtctgctccacagtt

SEQ ID NO: 274100 - DNA, 25 bp, Homo sapien
cacagttcagctggccctgtagtta

SEQ ID NO: 274101 - DNA, 25 bp, Homo sapien
agctggccctgtagttaatgctccc

SEQ ID NO: 274102 - DNA, 25 bp, Homo sapien
tcaccttctcttggacctgtggtct

SEQ ID NO: 274103 - DNA, 25 bp, Homo sapien
ggacctgtggtctgactggagtata

SEQ ID NO: 274104 - DNA, 25 bp, Homo sapien
gtgaggaaatcttgacatcgaatat

SEQ ID NO: 274105 - DNA, 25 bp, Homo sapien
gaatattttgttccatctccttcac

SEQ ID NO: 274106 - DNA, 25 bp, Homo sapien
accctctaccatcaataatccagta

SEQ ID NO: 274107 - DNA, 25 bp, Homo sapien
gggatgtaaagacccagcattctga

SEQ ID NO: 274108 - DNA, 25 bp, Homo sapien
attctgaaatgggatgctctgtact

SEQ ID NO: 274109 - DNA, 25 bp, Homo sapien
atgggatgctctgtactatatggga

SEQ ID NO: 274110 - DNA, 25 bp, Homo sapien
tacagtgagcatgtcctttataaga

SEQ ID NO: 274111 - DNA, 25 bp, Homo sapien
aatgctaatgatttattgtgtatga

SEQ ID NO: 274112 - DNA, 25 bp, Homo sapien
gaattctatgtataatcctgtgaaa

SEQ ID NO: 274113 - DNA, 25 bp, Homo sapien
aatcctgtgaaaatttgtagtgttg

SEQ ID NO: 274114 - DNA, 25 bp, Homo sapien
gtagggactggaaagatcagagatt

SEQ ID NO: 274115 - DNA, 25 bp, Homo sapien
gatcagagattatgttatggccatg

SEQ ID NO: 274116 - DNA, 25 bp, Homo sapien
gagattatgttatggccatgaatga

SEQ ID NO: 274117 - DNA, 25 bp, Homo sapien
atgaggcctgacctgcattgtcaat

SEQ ID NO: 274118 - DNA, 25 bp, Homo sapien
ggcctgacctgcattgtcaataact

SEQ ID NO: 274119 - DNA, 25 bp, Homo sapien
gacctgcattgtcaataactaaatt

SEQ ID NO: 274120 - DNA, 25 bp, Homo sapien
aactaaattgattattgtggaaaca

SEQ ID NO: 274121 - DNA, 25 bp, Homo sapien
gcttgtagtaaaatgtagttggtat

SEQ ID NO: 274122 - DNA, 25 bp, Homo sapien
gtagttggtatcagattatatgctg

SEQ ID NO: 274123 - DNA, 25 bp, Homo sapien
ctgattaaattggaagcagtctttt

SEQ ID NO: 274124 - DNA, 25 bp, Homo sapien
ggaagcagtctttttgtaattgcaa

SEQ ID NO: 274125 - DNA, 25 bp, Homo sapien
gcaataaaaatgcaatatccactta

SEQ ID NO: 274126 - DNA, 25 bp, Homo sapien
gcaatatccacttatgattgttatc

SEQ ID NO: 274127 - DNA, 25 bp, Homo sapien
cttcagaaggactataatcagttta

SEQ ID NO: 274128 - DNA, 25 bp, Homo sapien
atcagtttaaagactagcaaagata

SEQ ID NO: 274129 - DNA, 25 bp, Homo sapien
gagctatgtatctatatggtaccat

SEQ ID NO: 274130 - DNA, 25 bp, Homo sapien
gtatctatatggtaccattttggtt

SEQ ID NO: 274131 - DNA, 25 bp, Homo sapien
agacatgatttgatgcatgttcagt

SEQ ID NO: 274132 - DNA, 25 bp, Homo sapien
tctgacatctatggacaaagccttt

SEQ ID NO: 274133 - DNA, 25 bp, Homo sapien
gacatctatggacaaagcctttatc

SEQ ID NO: 274134 - DNA, 25 bp, Homo sapien
acaaagcctttatcacagtcctgga

SEQ ID NO: 274135 - DNA, 25 bp, Homo sapien
aaagcctttatcacagtcctggaga

SEQ ID NO: 274136 - DNA, 25 bp, Homo sapien
gcctttatcacagtcctggagatga

SEQ ID NO: 274137 - DNA, 25 bp, Homo sapien
tatcacagtcctggagatgactccg

SEQ ID NO: 274138 - DNA, 25 bp, Homo sapien
agtcctggagatgactccggtgctt

SEQ ID NO: 274139 - DNA, 25 bp, Homo sapien
agatgactccggtgcttgggacaga

SEQ ID NO: 274140 - DNA, 25 bp, Homo sapien
atgactccggtgcttgggacagaaa

SEQ ID NO: 274141 - DNA, 25 bp, Homo sapien
gactccggtgcttgggacagaaatc

SEQ ID NO: 274142 - DNA, 25 bp, Homo sapien
ccggtgcttgggacagaaatcatca

SEQ ID NO: 274143 - DNA, 25 bp, Homo sapien
ttggagtggcattccgaagatcacc

SEQ ID NO: 274144 - DNA, 25 bp, Homo sapien
gaagatcaccacacataccttggtt

SEQ ID NO: 274145 - DNA, 25 bp, Homo sapien
ttctgatggctgctgaactccgact

SEQ ID NO: 274146 - DNA, 25 bp, Homo sapien
gacttcttcgctgagacatgactgt

SEQ ID NO: 274147 - DNA, 25 bp, Homo sapien
gactgtgggaacagcctccagctat

SEQ ID NO: 274148 - DNA, 25 bp, Homo sapien
tccagctatctgctcatcagaggtg

SEQ ID NO: 274149 - DNA, 25 bp, Homo sapien
tcatcagaggtgctttcctcaacct

SEQ ID NO: 274150 - DNA, 25 bp, Homo sapien
gaaaccccagctgtttacttatatt

SEQ ID NO: 274151 - DNA, 25 bp, Homo sapien
atattggtctgtaaatccctggaag

SEQ ID NO: 274152 - DNA, 25 bp, Homo sapien
ggaagtaaaccccatgcatttttat

SEQ ID NO: 274153 - DNA, 25 bp, Homo sapien
gcatttttatctactgtctgaggac

SEQ ID NO: 274154 - DNA, 25 bp, Homo sapien
agtctgcaggacaaattccattcag

SEQ ID NO: 274155 - DNA, 25 bp, Homo sapien
attccattcagttctgagacttgaa

SEQ ID NO: 274156 - DNA, 25 bp, Homo sapien
gaaaatagttctctgtggcttgata

SEQ ID NO: 274157 - DNA, 25 bp, Homo sapien
tgtggcttgatattccgttctctag

SEQ ID NO: 274158 - DNA, 25 bp, Homo sapien
attccgttctctaggtgcattgaca

SEQ ID NO: 274159 - DNA, 25 bp, Homo sapien
taggtgcattgacacggccttaccc

SEQ ID NO: 274160 - DNA, 25 bp, Homo sapien
ctgtttctgagatgcaatggtggga

SEQ ID NO: 274161 - DNA, 25 bp, Homo sapien
ttaccccttggtcctggattggcag

SEQ ID NO: 274162 - DNA, 25 bp, Homo sapien
tggattggcagcctgcccatttttt

SEQ ID NO: 274163 - DNA, 25 bp, Homo sapien
ttttcttatgactgcttagttccta

SEQ ID NO: 274164 - DNA, 25 bp, Homo sapien
tgactgcttagttcctattttttgt

SEQ ID NO: 274165 - DNA, 25 bp, Homo sapien
tgtccgagtagagcccacacagtat

SEQ ID NO: 274166 - DNA, 25 bp, Homo sapien
gtagagcccacacagtattggaaag

SEQ ID NO: 274167 - DNA, 25 bp, Homo sapien
gaaatatagccactgctttcactcc

SEQ ID NO: 274168 - DNA, 25 bp, Homo sapien
ccactgctttcactcctgggagtag

SEQ ID NO: 274169 - DNA, 25 bp, Homo sapien
gggtgccctggttgctttcaccagc

SEQ ID NO: 274170 - DNA, 25 bp, Homo sapien
gctttcaccagcctgcaagagtata

SEQ ID NO: 274171 - DNA, 25 bp, Homo sapien
ggagaacatcaacaacgatctgggt

SEQ ID NO: 274172 - DNA, 25 bp, Homo sapien
catcaacaacgatctgggttcaaat

SEQ ID NO: 274173 - DNA, 25 bp, Homo sapien
cttattagccatgttgctgtgtcaa

SEQ ID NO: 274174 - DNA, 25 bp, Homo sapien
ttgctgtgtcaacttctctgagctt

SEQ ID NO: 274175 - DNA, 25 bp, Homo sapien
acagcacccttggagtgagtgtcag

SEQ ID NO: 274176 - DNA, 25 bp, Homo sapien
tgcggtagaagttggcagtgccact

SEQ ID NO: 274177 - DNA, 25 bp, Homo sapien
tgtccacaggatagactgaaactct

SEQ ID NO: 274178 - DNA, 25 bp, Homo sapien
gtgccactgtggacttttaaaggga

SEQ ID NO: 274179 - DNA, 25 bp, Homo sapien
taaagggacaactctgggtacaagc

SEQ ID NO: 274180 - DNA, 25 bp, Homo sapien
aactctgggtacaagcctgaagtgt

SEQ ID NO: 274181 - DNA, 25 bp, Homo sapien
aatacaattgagcttgtctccttga

SEQ ID NO: 274182 - DNA, 25 bp, Homo sapien
ttgtctccttgaaaactggttctct

SEQ ID NO: 274183 - DNA, 25 bp, Homo sapien
actggttctctctttttactacatt

SEQ ID NO: 274184 - DNA, 25 bp, Homo sapien
tgtgataaacgtgagcaggcagcag

SEQ ID NO: 274185 - DNA, 25 bp, Homo sapien
gcaggcagcaggatgctacctgata

SEQ ID NO: 274186 - DNA, 25 bp, Homo sapien
gatgctacctgataactgagtataa

SEQ ID NO: 274187 - DNA, 25 bp, Homo sapien
gataagggtgcctagcaggagcaaa

SEQ ID NO: 274188 - DNA, 25 bp, Homo sapien
gagcaaagggagttccctccagatt

SEQ ID NO: 274189 - DNA, 25 bp, Homo sapien
agattgcccctactttcttggtgaa

SEQ ID NO: 274190 - DNA, 25 bp, Homo sapien
attgcccctactttcttggtgaagt

SEQ ID NO: 274191 - DNA, 25 bp, Homo sapien
agccatcttgtaaaagctaacagga

SEQ ID NO: 274192 - DNA, 25 bp, Homo sapien
taagaagcactggaggctgggtgtg

SEQ ID NO: 274193 - DNA, 25 bp, Homo sapien
tatctgtaatcccatgcaatcccag

SEQ ID NO: 274194 - DNA, 25 bp, Homo sapien
tgtaatcccatgcaatcccagcatt

SEQ ID NO: 274195 - DNA, 25 bp, Homo sapien
gatgaaagcgaagctttaacaggag

SEQ ID NO: 274196 - DNA, 25 bp, Homo sapien
acatttctaaatattgaggagcgat

SEQ ID NO: 274197 - DNA, 25 bp, Homo sapien
tattgaggagcgataagggtgccta

SEQ ID NO: 274198 - DNA, 25 bp, Homo sapien
aagtgattctccaacaaggacttct

SEQ ID NO: 274199 - DNA, 25 bp, Homo sapien
taatcagtcaccatggagtttttta

SEQ ID NO: 274200 - DNA, 25 bp, Homo sapien
aattacaaggttgtatccacctcaa

SEQ ID NO: 274201 - DNA, 25 bp, Homo sapien
ggttgtatccacctcaaataggaag

SEQ ID NO: 274202 - DNA, 25 bp, Homo sapien
gaagaactgataagttttgcacaat

SEQ ID NO: 274203 - DNA, 25 bp, Homo sapien
tttgcacaattatttaactcctctg

SEQ ID NO: 274204 - DNA, 25 bp, Homo sapien
taactcctctgttaggccttcctta

SEQ ID NO: 274205 - DNA, 25 bp, Homo sapien
gttttttaataggacagcttctgct

SEQ ID NO: 274206 - DNA, 25 bp, Homo sapien
ataggacagcttctgctcttacaga

SEQ ID NO: 274207 - DNA, 25 bp, Homo sapien
gagtttttatgccagtaggttagaa

SEQ ID NO: 274208 - DNA, 25 bp, Homo sapien
gaagcataacatgtttctatattga

SEQ ID NO: 274209 - DNA, 25 bp, Homo sapien
ttgccttaaatattatccccaattg

SEQ ID NO: 274210 - DNA, 25 bp, Homo sapien
aatattatccccaattgcttcagtc

SEQ ID NO: 274211 - DNA, 25 bp, Homo sapien
tattatccccaattgcttcagtcat

SEQ ID NO: 274212 - DNA, 25 bp, Homo sapien
ttatccccaattgcttcagtcattc

SEQ ID NO: 274213 - DNA, 25 bp, Homo sapien
attctagttttcataatctattaga

SEQ ID NO: 274214 - DNA, 25 bp, Homo sapien
ttagcaactgctatgtgcctttcgt

SEQ ID NO: 274215 - DNA, 25 bp, Homo sapien
gcaactgctatgtgcctttcgttgt

SEQ ID NO: 274216 - DNA, 25 bp, Homo sapien
tgctatgtgcctttcgttgttccag

SEQ ID NO: 274217 - DNA, 25 bp, Homo sapien
tatgtgcctttcgttgttccagata

SEQ ID NO: 274218 - DNA, 25 bp, Homo sapien
gtgcctttcgttgttccagatatgc

SEQ ID NO: 274219 - DNA, 25 bp, Homo sapien
cctttcgttgttccagatatgcaga

SEQ ID NO: 274220 - DNA, 25 bp, Homo sapien
gaaggtatttgtgaaccgtcctata

SEQ ID NO: 274221 - DNA, 25 bp, Homo sapien
ctctctggtatttggtagaggctca

SEQ ID NO: 274222 - DNA, 25 bp, Homo sapien
aataaatgtcatggtccccaccctt

SEQ ID NO: 274223 - DNA, 25 bp, Homo sapien
gcctttccacctatataaatgcagg

SEQ ID NO: 274224 - DNA, 25 bp, Homo sapien
gatctcatttaatcctggttcttaa

SEQ ID NO: 274225 - DNA, 25 bp, Homo sapien
atcctggttcttaaagtgtcctgtg

SEQ ID NO: 274226 - DNA, 25 bp, Homo sapien
gtgtcctgtgaagcttagtgtgcca

SEQ ID NO: 274227 - DNA, 25 bp, Homo sapien
gtgaagcttagtgtgccagccggct

SEQ ID NO: 274228 - DNA, 25 bp, Homo sapien
atagcgacagtcctctttcgtctat

SEQ ID NO: 274229 - DNA, 25 bp, Homo sapien
tttcgtctatacttcctttctacag

SEQ ID NO: 274230 - DNA, 25 bp, Homo sapien
gcactgatagctgcctttaagggtt

SEQ ID NO: 274231 - DNA, 25 bp, Homo sapien
tacgagttttaccactacgtcaaag

SEQ ID NO: 274232 - DNA, 25 bp, Homo sapien
taccactacgtcaaagagcagttcc

SEQ ID NO: 274233 - DNA, 25 bp, Homo sapien
agttccacctgctgaagcgcaagtt

SEQ ID NO: 274234 - DNA, 25 bp, Homo sapien
ctgctgaagcgcaagtttggactta

SEQ ID NO: 274235 - DNA, 25 bp, Homo sapien
gtttggacttaagtctcacgtcagc

SEQ ID NO: 274236 - DNA, 25 bp, Homo sapien
gacttaagtctcacgtcagcaagcc

SEQ ID NO: 274237 - DNA, 25 bp, Homo sapien
ttctttatcccaactccactggaaa

SEQ ID NO: 274238 - DNA, 25 bp, Homo sapien
ggaaaccgaggagccaatcgacgat

SEQ ID NO: 274239 - DNA, 25 bp, Homo sapien
gccaatcgacgatgaagaacaggat

SEQ ID NO: 274240 - DNA, 25 bp, Homo sapien
aagaggtgatgtgactgtgttgcct

SEQ ID NO: 274241 - DNA, 25 bp, Homo sapien
tatggctttatctcccttttccaga

SEQ ID NO: 274242 - DNA, 25 bp, Homo sapien
atccattatatctaaagggcaagtg

SEQ ID NO: 274243 - DNA, 25 bp, Homo sapien
gtgaactgggtataactccttggtt

SEQ ID NO: 274244 - DNA, 25 bp, Homo sapien
actccttggttcttaactagtacat

SEQ ID NO: 274245 - DNA, 25 bp, Homo sapien
acattcttaatctgtgagacccaaa

SEQ ID NO: 274246 - DNA, 25 bp, Homo sapien
gattgtacagtactctaaacgtctg

SEQ ID NO: 274247 - DNA, 25 bp, Homo sapien
gtactctaaacgtctgcaaaggtct

SEQ ID NO: 274248 - DNA, 25 bp, Homo sapien
ggtctagatgttatcagtatcacta

SEQ ID NO: 274249 - DNA, 25 bp, Homo sapien
gtatcactagtttttatttctgcca

SEQ ID NO: 274250 - DNA, 25 bp, Homo sapien
ccagtagctcccttttaggttacat

SEQ ID NO: 274251 - DNA, 25 bp, Homo sapien
aggttacattgttgtcctctttcca

SEQ ID NO: 274252 - DNA, 25 bp, Homo sapien
tacattgttgtcctctttccagtgt

SEQ ID NO: 274253 - DNA, 25 bp, Homo sapien
agaacctcaaaccttaacatatata

SEQ ID NO: 274254 - DNA, 25 bp, Homo sapien
atatatgatcatgtgggaccttgtt

SEQ ID NO: 274255 - DNA, 25 bp, Homo sapien
atcagattgcaatttctagtggtag

SEQ ID NO: 274256 - DNA, 25 bp, Homo sapien
gagattttccagttccagcgagctc

SEQ ID NO: 274257 - DNA, 25 bp, Homo sapien
agcgagctccatgtgatgtccgtgc

SEQ ID NO: 274258 - DNA, 25 bp, Homo sapien
atgtccgtgctgatggtgtgtgatc

SEQ ID NO: 274259 - DNA, 25 bp, Homo sapien
tgatggtgtgtgatccacactttga

SEQ ID NO: 274260 - DNA, 25 bp, Homo sapien
tagtggtagtgtccaagctcctata

SEQ ID NO: 274261 - DNA, 25 bp, Homo sapien
gtgtccaagctcctatatattttgt

SEQ ID NO: 274262 - DNA, 25 bp, Homo sapien
ttgtaccaactacctgggtaatttg

SEQ ID NO: 274263 - DNA, 25 bp, Homo sapien
atttgatgggttttcagaactactc

SEQ ID NO: 274264 - DNA, 25 bp, Homo sapien
gacaccatgtttgtaagtgcattgt

SEQ ID NO: 274265 - DNA, 25 bp, Homo sapien
aagtgcattgtcctggcttttggtg

SEQ ID NO: 274266 - DNA, 25 bp, Homo sapien
ggagttcctgcctgaattatagtct

SEQ ID NO: 274267 - DNA, 25 bp, Homo sapien
ctttccatctcatatcttcatgtgg

SEQ ID NO: 274268 - DNA, 25 bp, Homo sapien
tgtggagccctcaagctttagacaa

SEQ ID NO: 274269 - DNA, 25 bp, Homo sapien
acaagtcttttatctccgttttcag

SEQ ID NO: 274270 - DNA, 25 bp, Homo sapien
tccgttttcaggtggctcccattat

SEQ ID NO: 274271 - DNA, 25 bp, Homo sapien
ctcccattatcttgagacctcataa

SEQ ID NO: 274272 - DNA, 25 bp, Homo sapien
acctcataatgctgctttccttaaa

SEQ ID NO: 274273 - DNA, 25 bp, Homo sapien
aatttgttttacactgacgctagtc

SEQ ID NO: 274274 - DNA, 25 bp, Homo sapien
gtcagcacagagctactcacatttc

SEQ ID NO: 274275 - DNA, 25 bp, Homo sapien
tcgcgggcatctaacctgcttcaag

SEQ ID NO: 274276 - DNA, 25 bp, Homo sapien
ctgcttcaaggctcagggctaaaag

SEQ ID NO: 274277 - DNA, 25 bp, Homo sapien
cgctcctcgatctgctgagtgacga

SEQ ID NO: 274278 - DNA, 25 bp, Homo sapien
tgctgagtgacgaccctgtacaagt

SEQ ID NO: 274279 - DNA, 25 bp, Homo sapien
cgaccctgtacaagtcatttctctt

SEQ ID NO: 274280 - DNA, 25 bp, Homo sapien
atttctcttccgagagcttcagttt

SEQ ID NO: 274281 - DNA, 25 bp, Homo sapien
agtttcctcacgtgccaagcggacg

SEQ ID NO: 274282 - DNA, 25 bp, Homo sapien
attcagggctcgctgtcaaccagga

SEQ ID NO: 274283 - DNA, 25 bp, Homo sapien
tgtcaaccaggaccttccaggaact

SEQ ID NO: 274284 - DNA, 25 bp, Homo sapien
tgggccaagagcagtagaaatcact

SEQ ID NO: 274285 - DNA, 25 bp, Homo sapien
agaaatcactgggtggtccgcacag

SEQ ID NO: 274286 - DNA, 25 bp, Homo sapien
gcaaagaatggagttcaaccttaca

SEQ ID NO: 274287 - DNA, 25 bp, Homo sapien
gaatggagttcaaccttacactata

SEQ ID NO: 274288 - DNA, 25 bp, Homo sapien
gagttcaaccttacactataaacat

SEQ ID NO: 274289 - DNA, 25 bp, Homo sapien
tgtttttacaactaacttggaatat

SEQ ID NO: 274290 - DNA, 25 bp, Homo sapien
ttggaatatactgcaaatcactagt

SEQ ID NO: 274291 - DNA, 25 bp, Homo sapien
gcaaatcactagtaagtagagacac

SEQ ID NO: 274292 - DNA, 25 bp, Homo sapien
ggtaattctgaataaggatctgaat

SEQ ID NO: 274293 - DNA, 25 bp, Homo sapien
gaataaatccagatcacagactgtt

SEQ ID NO: 274294 - DNA, 25 bp, Homo sapien
atcacagactgttcctttaccaata

SEQ ID NO: 274295 - DNA, 25 bp, Homo sapien
cagactgttcctttaccaatatgta

SEQ ID NO: 274296 - DNA, 25 bp, Homo sapien
gactgttcctttaccaatatgtaaa

SEQ ID NO: 274297 - DNA, 25 bp, Homo sapien
gtgaagctcttcacatatattcaaa

SEQ ID NO: 274298 - DNA, 25 bp, Homo sapien
gtaatctgaagaacttttgcccttt

SEQ ID NO: 274299 - DNA, 25 bp, Homo sapien
gtaactcttgtttctaggtaatcgt

SEQ ID NO: 274300 - DNA, 25 bp, Homo sapien
gtttctaggtaatcgttctctctca

SEQ ID NO: 274301 - DNA, 25 bp, Homo sapien
aggtaatcgttctctctcaacaaac

SEQ ID NO: 274302 - DNA, 25 bp, Homo sapien
gttctctctcaacaaacttctcaag

SEQ ID NO: 274303 - DNA, 25 bp, Homo sapien
aacttctcaagcgtctgtgtaacaa

SEQ ID NO: 274304 - DNA, 25 bp, Homo sapien
gtgtaacaagccacatgttctaaca

SEQ ID NO: 274305 - DNA, 25 bp, Homo sapien
ctaacaaattgtctccatcgcactt

SEQ ID NO: 274306 - DNA, 25 bp, Homo sapien
aattgtctccatcgcacttcaacag

SEQ ID NO: 274307 - DNA, 25 bp, Homo sapien
caacagccaggtccctattttttat

SEQ ID NO: 274308 - DNA, 25 bp, Homo sapien
cccagtgaggcagcacgcagcacct

SEQ ID NO: 274309 - DNA, 25 bp, Homo sapien
ccagtgaggcagcacgcagcacctc

SEQ ID NO: 274310 - DNA, 25 bp, Homo sapien
gtcactccaagtgtgagggcaggcc

SEQ ID NO: 274311 - DNA, 25 bp, Homo sapien
tcactccaagtgtgagggcaggccc

SEQ ID NO: 274312 - DNA, 25 bp, Homo sapien
cactccaagtgtgagggcaggccct

SEQ ID NO: 274313 - DNA, 25 bp, Homo sapien
actccaagtgtgagggcaggccctg

SEQ ID NO: 274314 - DNA, 25 bp, Homo sapien
ctccaagtgtgagggcaggccctgg

SEQ ID NO: 274315 - DNA, 25 bp, Homo sapien
tccaagtgtgagggcaggccctggc

SEQ ID NO: 274316 - DNA, 25 bp, Homo sapien
gatgctgcatcatttgtactgttta

SEQ ID NO: 274317 - DNA, 25 bp, Homo sapien
atttgtactgtttaggtcgacgtga

SEQ ID NO: 274318 - DNA, 25 bp, Homo sapien
ggtcgacgtgaggacatcatcttat

SEQ ID NO: 274319 - DNA, 25 bp, Homo sapien
acgtgaggacatcatcttatttaga

SEQ ID NO: 274320 - DNA, 25 bp, Homo sapien
caaggctgagatttttatgatgttt

SEQ ID NO: 274321 - DNA, 25 bp, Homo sapien
attgggcacaatgattttgacctta

SEQ ID NO: 274322 - DNA, 25 bp, Homo sapien
cttttctactgtttaacatacacag

SEQ ID NO: 274323 - DNA, 25 bp, Homo sapien
tacacaggctatttatacacgtccc

SEQ ID NO: 274324 - DNA, 25 bp, Homo sapien
aggctatttatacacgtccccagct

SEQ ID NO: 274325 - DNA, 25 bp, Homo sapien
cctgtgactcaggtttatgaatggt

SEQ ID NO: 274326 - DNA, 25 bp, Homo sapien
gaatggtgtttgtgtagcaacacat

SEQ ID NO: 274327 - DNA, 25 bp, Homo sapien
attagaaatgtaagtgcctcagtgt

SEQ ID NO: 274328 - DNA, 25 bp, Homo sapien
aatgtaagtgcctcagtgtttactg

SEQ ID NO: 274329 - DNA, 25 bp, Homo sapien
gagaacagggtttgataagggataa

SEQ ID NO: 274330 - DNA, 25 bp, Homo sapien
gggataagtggaattctggcagatt

SEQ ID NO: 274331 - DNA, 25 bp, Homo sapien
attctggcagatttacttgtaggtt

SEQ ID NO: 274332 - DNA, 25 bp, Homo sapien
cttgtaggttattgtgagtttatca

SEQ ID NO: 274333 - DNA, 25 bp, Homo sapien
gtgagtttatcataattttgacaac

SEQ ID NO: 274334 - DNA, 25 bp, Homo sapien
aaaactccacagtatgttgaaatgc

SEQ ID NO: 274335 - DNA, 25 bp, Homo sapien
actccacagtatgttgaaatgcatt

SEQ ID NO: 274336 - DNA, 25 bp, Homo sapien
ggcatatatatatactagttttcaa

SEQ ID NO: 274337 - DNA, 25 bp, Homo sapien
tcaaaacttgtactccttttctgta

SEQ ID NO: 274338 - DNA, 25 bp, Homo sapien
ttcctctgatcttttatgtatgtta

SEQ ID NO: 274339 - DNA, 25 bp, Homo sapien
gttaagaaataactactaagtgctt

SEQ ID NO: 274340 - DNA, 25 bp, Homo sapien
ttaaattgctatgctacatttctag

SEQ ID NO: 274341 - DNA, 25 bp, Homo sapien
taatatttttaaggctaaggattca

SEQ ID NO: 274342 - DNA, 25 bp, Homo sapien
agtatttcagtagaactaggactga

SEQ ID NO: 274343 - DNA, 25 bp, Homo sapien
aattatctttatgtctttaacaaca

SEQ ID NO: 274344 - DNA, 25 bp, Homo sapien
gttttagcatactgcaagcttggct

SEQ ID NO: 274345 - DNA, 25 bp, Homo sapien
agcatactgcaagcttggctacttt

SEQ ID NO: 274346 - DNA, 25 bp, Homo sapien
tactgcaagcttggctacttttcct

SEQ ID NO: 274347 - DNA, 25 bp, Homo sapien
aagcttggctacttttcctctgatc

SEQ ID NO: 274348 - DNA, 25 bp, Homo sapien
ggctacttttcctctgatcttttat

SEQ ID NO: 274349 - DNA, 25 bp, Homo sapien
gctgccgctgcttccgaggttgccg

SEQ ID NO: 274350 - DNA, 25 bp, Homo sapien
gctgcttccgaggttgccggcggga

SEQ ID NO: 274351 - DNA, 25 bp, Homo sapien
gcttccgaggttgccggcgggaggc

SEQ ID NO: 274352 - DNA, 25 bp, Homo sapien
ttcacgatctcctaccgcggcgggc

SEQ ID NO: 274353 - DNA, 25 bp, Homo sapien
ggaggcgagacgacggcgcgcgtca

SEQ ID NO: 274354 - DNA, 25 bp, Homo sapien
cggcgcgcgtcaggtcgtccaggga

SEQ ID NO: 274355 - DNA, 25 bp, Homo sapien
gcgcgtcaggtcgtccagggactgc

SEQ ID NO: 274356 - DNA, 25 bp, Homo sapien
gggccgcgtacctcctggatggcct

SEQ ID NO: 274357 - DNA, 25 bp, Homo sapien
gcgtacctcctggatggcctcttag

SEQ ID NO: 274358 - DNA, 25 bp, Homo sapien
cgtacctcctggatggcctcttaga

SEQ ID NO: 274359 - DNA, 25 bp, Homo sapien
acaggggcagcaggcacacccagga

SEQ ID NO: 274360 - DNA, 25 bp, Homo sapien
agcactcggagtcgctgcccgcgca

SEQ ID NO: 274361 - DNA, 25 bp, Homo sapien
ccgcgcagccgtaaagcagacgacg

SEQ ID NO: 274362 - DNA, 25 bp, Homo sapien
gcgcagccgtaaagcagacgacgct

SEQ ID NO: 274363 - DNA, 25 bp, Homo sapien
cagccgtaaagcagacgacgctggg

SEQ ID NO: 274364 - DNA, 25 bp, Homo sapien
atcggcagcgtcgatctccgcagtg

SEQ ID NO: 274365 - DNA, 25 bp, Homo sapien
gcagcgtcgatctccgcagtggagc

SEQ ID NO: 274366 - DNA, 25 bp, Homo sapien
gtcgatctccgcagtggagcgccag

SEQ ID NO: 274367 - DNA, 25 bp, Homo sapien
gatctccgcagtggagcgccagcga

SEQ ID NO: 274368 - DNA, 25 bp, Homo sapien
cagtggagcgccagcgacggcagga

SEQ ID NO: 274369 - DNA, 25 bp, Homo sapien
gagcgccagcgacggcaggaccctg

SEQ ID NO: 274370 - DNA, 25 bp, Homo sapien
aggcgcccagccgagcactcggagt

SEQ ID NO: 274371 - DNA, 25 bp, Homo sapien
tgggcctcgcctttgtgcagccaaa

SEQ ID NO: 274372 - DNA, 25 bp, Homo sapien
tgtgcagccaaaaccagacgacgct

SEQ ID NO: 274373 - DNA, 25 bp, Homo sapien
agacgacgctggtattgtcctcttc

SEQ ID NO: 274374 - DNA, 25 bp, Homo sapien
acgctggtattgtcctcttcacaga

SEQ ID NO: 274375 - DNA, 25 bp, Homo sapien
tcttcacagatgcagcctactattc

SEQ ID NO: 274376 - DNA, 25 bp, Homo sapien
gcagcctactattctcttgttggag

SEQ ID NO: 274377 - DNA, 25 bp, Homo sapien
gactaaattagggtcttccctggtg

SEQ ID NO: 274378 - DNA, 25 bp, Homo sapien
tagggtcttccctggtgcctgaagc

SEQ ID NO: 274379 - DNA, 25 bp, Homo sapien
ccaatgcaatggctagtctttactg

SEQ ID NO: 274380 - DNA, 25 bp, Homo sapien
aactttacagcacattttgagtaat

SEQ ID NO: 274381 - DNA, 25 bp, Homo sapien
tagtgcaggtgctcagtgtgccagc

SEQ ID NO: 274382 - DNA, 25 bp, Homo sapien
ggccccgaactgtgtttctgctaat

SEQ ID NO: 274383 - DNA, 25 bp, Homo sapien
aatcaaactttgagccttgagcgat

SEQ ID NO: 274384 - DNA, 25 bp, Homo sapien
gagccttgagcgatgggcactacag

SEQ ID NO: 274385 - DNA, 25 bp, Homo sapien
gtattttcctttatgaccaaaccag

SEQ ID NO: 274386 - DNA, 25 bp, Homo sapien
gaccaaaccaggaggttatacagct

SEQ ID NO: 274387 - DNA, 25 bp, Homo sapien
ggttatacagctggcattgcataca

SEQ ID NO: 274388 - DNA, 25 bp, Homo sapien
gctggcattgcatacatgacagatg

SEQ ID NO: 274389 - DNA, 25 bp, Homo sapien
ggtaactgtgtatattatctagcaa

SEQ ID NO: 274390 - DNA, 25 bp, Homo sapien
agagacagcagcagacactcgccaa

SEQ ID NO: 274391 - DNA, 25 bp, Homo sapien
gcagacactcgccaaaaaagacaga

SEQ ID NO: 274392 - DNA, 25 bp, Homo sapien
aagggacaagagagacacatagaca

SEQ ID NO: 274393 - DNA, 25 bp, Homo sapien
atttcatcaggccagattcacaaac

SEQ ID NO: 274394 - DNA, 25 bp, Homo sapien
ttcacaaacagaatgggagtgcttt

SEQ ID NO: 274395 - DNA, 25 bp, Homo sapien
gggagtgctttatctatacctttga

SEQ ID NO: 274396 - DNA, 25 bp, Homo sapien
gttatcacagcttaatttcatccag

SEQ ID NO: 274397 - DNA, 25 bp, Homo sapien
tttcatccaggcttggtgtctttac

SEQ ID NO: 274398 - DNA, 25 bp, Homo sapien
ttcatcttgttcaggcagtgatttg

SEQ ID NO: 274399 - DNA, 25 bp, Homo sapien
gcagtgatttgctcagaattttaca

SEQ ID NO: 274400 - DNA, 25 bp, Homo sapien
gacataccctatacagacctatttg

SEQ ID NO: 274401 - DNA, 25 bp, Homo sapien
gaattctactgtgggtttattgaac

SEQ ID NO: 274402 - DNA, 25 bp, Homo sapien
cttcgcaaaacagaccaggccagtt

SEQ ID NO: 274403 - DNA, 25 bp, Homo sapien
gaccaggccagttaggtacagcctc

SEQ ID NO: 274404 - DNA, 25 bp, Homo sapien
ggcccttctcccatatttataagtg

SEQ ID NO: 274405 - DNA, 25 bp, Homo sapien
catatttataagtgtccggccggga

SEQ ID NO: 274406 - DNA, 25 bp, Homo sapien
gtccccggcgcgtatcgtaggcagt

SEQ ID NO: 274407 - DNA, 25 bp, Homo sapien
gcgcgtatcgtaggcagtgtaccgt

SEQ ID NO: 274408 - DNA, 25 bp, Homo sapien
atcgtaggcagtgtaccgtggccgt

SEQ ID NO: 274409 - DNA, 25 bp, Homo sapien
taccgtggccgtgccgtcagagtgt

SEQ ID NO: 274410 - DNA, 25 bp, Homo sapien
cgtgtgcgtgtgtgccgtgtcgagg

SEQ ID NO: 274411 - DNA, 25 bp, Homo sapien
tcgaggctgtgtagagtgcattgta

SEQ ID NO: 274412 - DNA, 25 bp, Homo sapien
ctgtgtagagtgcattgtacagcat

SEQ ID NO: 274413 - DNA, 25 bp, Homo sapien
attgtacagcatattttcatgaata

SEQ ID NO: 274414 - DNA, 25 bp, Homo sapien
actggtctcagcttctccagcgggc

SEQ ID NO: 274415 - DNA, 25 bp, Homo sapien
agtcgagtttggtcagggtcccaca

SEQ ID NO: 274416 - DNA, 25 bp, Homo sapien
caggctgctctcatgtggagagctt

SEQ ID NO: 274417 - DNA, 25 bp, Homo sapien
gaacctgaggttgatctaccagcgt

SEQ ID NO: 274418 - DNA, 25 bp, Homo sapien
gatctaccagcgtttcgtttggagt

SEQ ID NO: 274419 - DNA, 25 bp, Homo sapien
cccagagactaggaaacgtaaagca

SEQ ID NO: 274420 - DNA, 25 bp, Homo sapien
gcaaagtcatgcatctgtcacgtat

SEQ ID NO: 274421 - DNA, 25 bp, Homo sapien
gcatctgtcacgtatgtagtaccca

SEQ ID NO: 274422 - DNA, 25 bp, Homo sapien
gtacccatatgaacagactccactc

SEQ ID NO: 274423 - DNA, 25 bp, Homo sapien
ggtccaggcctcagacacggagaag

SEQ ID NO: 274424 - DNA, 25 bp, Homo sapien
acggagaagctgctctggtgaccta

SEQ ID NO: 274425 - DNA, 25 bp, Homo sapien
aagctgctctggtgacctagacggg

SEQ ID NO: 274426 - DNA, 25 bp, Homo sapien
gatgtttcctcatggttagattggg

SEQ ID NO: 274427 - DNA, 25 bp, Homo sapien
tgagggttgaaatgctgtaagtgat

SEQ ID NO: 274428 - DNA, 25 bp, Homo sapien
aaatgctgtaagtgatatgtattgc

SEQ ID NO: 274429 - DNA, 25 bp, Homo sapien
gtattgcaggtatacatccagatgc

SEQ ID NO: 274430 - DNA, 25 bp, Homo sapien
tgcaggtatacatccagatgcacag

SEQ ID NO: 274431 - DNA, 25 bp, Homo sapien
atccagatgcacagaatgtccattt

SEQ ID NO: 274432 - DNA, 25 bp, Homo sapien
gcacagaatgtccatttgtccctta

SEQ ID NO: 274433 - DNA, 25 bp, Homo sapien
cagaatgtccatttgtcccttattg

SEQ ID NO: 274434 - DNA, 25 bp, Homo sapien
atgtccatttgtcccttattggtga

SEQ ID NO: 274435 - DNA, 25 bp, Homo sapien
ttgtcccttattggtgatgctaatt

SEQ ID NO: 274436 - DNA, 25 bp, Homo sapien
gtcccttattggtgatgctaatttt

SEQ ID NO: 274437 - DNA, 25 bp, Homo sapien
gtgtacctgttgtcaaagctcacgg

SEQ ID NO: 274438 - DNA, 25 bp, Homo sapien
acctgttgtcaaagctcacggaaga

SEQ ID NO: 274439 - DNA, 25 bp, Homo sapien
agctcacggaagacaaagagactct

SEQ ID NO: 274440 - DNA, 25 bp, Homo sapien
aagagactctgcagtacttacaaca

SEQ ID NO: 274441 - DNA, 25 bp, Homo sapien
gactctgcagtacttacaacagaat

SEQ ID NO: 274442 - DNA, 25 bp, Homo sapien
aaagagctgagcttgcagccgctgc

SEQ ID NO: 274443 - DNA, 25 bp, Homo sapien
agctgagcttgcagccgctgctgtg

SEQ ID NO: 274444 - DNA, 25 bp, Homo sapien
aagcagcttggcagcgtggccacag

SEQ ID NO: 274445 - DNA, 25 bp, Homo sapien
agcttggcagcgtggccacaggctc

SEQ ID NO: 274446 - DNA, 25 bp, Homo sapien
cagcagtctctggaacttaaaagaa

SEQ ID NO: 274447 - DNA, 25 bp, Homo sapien
acttaaaagaaagatgcttcgagac

SEQ ID NO: 274448 - DNA, 25 bp, Homo sapien
atgtctcaaatctgggtacctgggt

SEQ ID NO: 274449 - DNA, 25 bp, Homo sapien
ggcagtattggcaggtcttaatttg

SEQ ID NO: 274450 - DNA, 25 bp, Homo sapien
aacttactgtccagggtgttttcag

SEQ ID NO: 274451 - DNA, 25 bp, Homo sapien
ttcagtgtttgccaacttgtggtaa

SEQ ID NO: 274452 - DNA, 25 bp, Homo sapien
tgcttagagaactacccttaggttt

SEQ ID NO: 274453 - DNA, 25 bp, Homo sapien
ggtttgtttctgataagcatgtgga

SEQ ID NO: 274454 - DNA, 25 bp, Homo sapien
cttaccttagttcaaatagctgttt

SEQ ID NO: 274455 - DNA, 25 bp, Homo sapien
aatagctgtttaagtggcaatgcca

SEQ ID NO: 274456 - DNA, 25 bp, Homo sapien
aatgccacgatctgaattgaaccta

SEQ ID NO: 274457 - DNA, 25 bp, Homo sapien
gaacctaggtgatcttagtccacag

SEQ ID NO: 274458 - DNA, 25 bp, Homo sapien
agtccacagttctcttgatcatgat

SEQ ID NO: 274459 - DNA, 25 bp, Homo sapien
acttattgtccctataatgggccat

SEQ ID NO: 274460 - DNA, 25 bp, Homo sapien
tttgcctctggaaaacacctactta

SEQ ID NO: 274461 - DNA, 25 bp, Homo sapien
aaaacacctacttatccttcaatgc

SEQ ID NO: 274462 - DNA, 25 bp, Homo sapien
agatcctctcaagacagtatccggc

SEQ ID NO: 274463 - DNA, 25 bp, Homo sapien
ctgctcctttcatctgaaatgactc

SEQ ID NO: 274464 - DNA, 25 bp, Homo sapien
aatgactcacatagttttcgcccgt

SEQ ID NO: 274465 - DNA, 25 bp, Homo sapien
gttttcgcccgtgaaatccataaag

SEQ ID NO: 274466 - DNA, 25 bp, Homo sapien
atgccaggtaattaacggttcgaag

SEQ ID NO: 274467 - DNA, 25 bp, Homo sapien
cggttcgaagcatgacacctgtggt

SEQ ID NO: 274468 - DNA, 25 bp, Homo sapien
cacctgtggtttcagtttataacct

SEQ ID NO: 274469 - DNA, 25 bp, Homo sapien
aacctagcattgatctgaaattcca

SEQ ID NO: 274470 - DNA, 25 bp, Homo sapien
aaattttgatttgacactcaggaga

SEQ ID NO: 274471 - DNA, 25 bp, Homo sapien
gattacagatcaatttacctccata

SEQ ID NO: 274472 - DNA, 25 bp, Homo sapien
ttacctccataaatctttgaattgt

SEQ ID NO: 274473 - DNA, 25 bp, Homo sapien
aatctttgaattgtcactgtgacca

SEQ ID NO: 274474 - DNA, 25 bp, Homo sapien
aattgtcactgtgaccacaggatga

SEQ ID NO: 274475 - DNA, 25 bp, Homo sapien
tcctttattagccattttataggtt

SEQ ID NO: 274476 - DNA, 25 bp, Homo sapien
ttcccattccatggccttgtcttgg

SEQ ID NO: 274477 - DNA, 25 bp, Homo sapien
catggccttgtcttggcagggagta

SEQ ID NO: 274478 - DNA, 25 bp, Homo sapien
gcagggagtaaaaaatcccacttct

SEQ ID NO: 274479 - DNA, 25 bp, Homo sapien
tactttagtgggtctcaactgcagc

SEQ ID NO: 274480 - DNA, 25 bp, Homo sapien
gtgggtctcaactgcagcatttcag

SEQ ID NO: 274481 - DNA, 25 bp, Homo sapien
tgacatcatagaggacatagtgcaa

SEQ ID NO: 274482 - DNA, 25 bp, Homo sapien
agtttgatactgagcttggagcctc

SEQ ID NO: 274483 - DNA, 25 bp, Homo sapien
gcttggagcctcagtagttctggat

SEQ ID NO: 274484 - DNA, 25 bp, Homo sapien
gagctgtacgggaggttgtaaccat

SEQ ID NO: 274485 - DNA, 25 bp, Homo sapien
gagctaccctggttggcagttgaca

SEQ ID NO: 274486 - DNA, 25 bp, Homo sapien
agttgacatccgaggaccagcactg

SEQ ID NO: 274487 - DNA, 25 bp, Homo sapien
accagcactggtcatcgcacagaaa

SEQ ID NO: 274488 - DNA, 25 bp, Homo sapien
gaaaactttacaccttgagatccct

SEQ ID NO: 274489 - DNA, 25 bp, Homo sapien
aacttccaagtgtatgtttgatggg

SEQ ID NO: 274490 - DNA, 25 bp, Homo sapien
gggatcaacatttaaaggctctgga

SEQ ID NO: 274491 - DNA, 25 bp, Homo sapien
gagtcagataactgtttttggcttc

SEQ ID NO: 274492 - DNA, 25 bp, Homo sapien
gcagaatctctgctcagtgagcttg

SEQ ID NO: 274493 - DNA, 25 bp, Homo sapien
tctgctcagtgagcttggatgagtg

SEQ ID NO: 274494 - DNA, 25 bp, Homo sapien
gcaactattttatatgactgttctg

SEQ ID NO: 274495 - DNA, 25 bp, Homo sapien
tgggcctttgttcctatctgtaaat

SEQ ID NO: 274496 - DNA, 25 bp, Homo sapien
gcctttgttcctatctgtaaatgag

SEQ ID NO: 274497 - DNA, 25 bp, Homo sapien
gtagatattgccaagatttcccagg

SEQ ID NO: 274498 - DNA, 25 bp, Homo sapien
attgccaagatttcccaggctcaat

SEQ ID NO: 274499 - DNA, 25 bp, Homo sapien
gatttcccaggctcaatacagtgta

SEQ ID NO: 274500 - DNA, 25 bp, Homo sapien
ttcccaggctcaatacagtgtaatt

SEQ ID NO: 274501 - DNA, 25 bp, Homo sapien
atgactgttctgtacaaacaaaaag

SEQ ID NO: 274502 - DNA, 25 bp, Homo sapien
gtcatattgtgataatgctctgctt

SEQ ID NO: 274503 - DNA, 25 bp, Homo sapien
ttcctgcaaggcgaggtcgagagtc

SEQ ID NO: 274504 - DNA, 25 bp, Homo sapien
aaggcgaggtcgagagtcaccttgt

SEQ ID NO: 274505 - DNA, 25 bp, Homo sapien
gcgaggtcgagagtcaccttgtgtt

SEQ ID NO: 274506 - DNA, 25 bp, Homo sapien
gtcgagagtcaccttgtgttgaaaa

SEQ ID NO: 274507 - DNA, 25 bp, Homo sapien
aactacttgactgaggttagttata

SEQ ID NO: 274508 - DNA, 25 bp, Homo sapien
gttagttatatgaccgtttctcttt

SEQ ID NO: 274509 - DNA, 25 bp, Homo sapien
gttatatgaccgtttctctttaggg

SEQ ID NO: 274510 - DNA, 25 bp, Homo sapien
tgaccgtttctctttagggtttcat

SEQ ID NO: 274511 - DNA, 25 bp, Homo sapien
tttagggtttcatttctctagcgta

SEQ ID NO: 274512 - DNA, 25 bp, Homo sapien
gggtttcatttctctagcgtaattc

SEQ ID NO: 274513 - DNA, 25 bp, Homo sapien
atttctctagcgtaattcttgttta

SEQ ID NO: 274514 - DNA, 25 bp, Homo sapien
attggacacccctgtacatgctcat

SEQ ID NO: 274515 - DNA, 25 bp, Homo sapien
tggacacccctgtacatgctcatat

SEQ ID NO: 274516 - DNA, 25 bp, Homo sapien
gacacccctgtacatgctcatatac

SEQ ID NO: 274517 - DNA, 25 bp, Homo sapien
acccctgtacatgctcatatacttt

SEQ ID NO: 274518 - DNA, 25 bp, Homo sapien
ccctgtacatgctcatatactttat

SEQ ID NO: 274519 - DNA, 25 bp, Homo sapien
gtacatgctcatatactttatcttt

SEQ ID NO: 274520 - DNA, 25 bp, Homo sapien
acatgctcatatactttatctttaa

SEQ ID NO: 274521 - DNA, 25 bp, Homo sapien
gctcatatactttatctttaatctt

SEQ ID NO: 274522 - DNA, 25 bp, Homo sapien
agcccttatctgtaagtgttcttgc

SEQ ID NO: 274523 - DNA, 25 bp, Homo sapien
cccttatctgtaagtgttcttgcat

SEQ ID NO: 274524 - DNA, 25 bp, Homo sapien
gcatttgctttaaaagatctttata

SEQ ID NO: 274525 - DNA, 25 bp, Homo sapien
gggcgcggccgtaccagtgcgcggc

SEQ ID NO: 274526 - DNA, 25 bp, Homo sapien
gtaccagtgcgcggcctgcggcaag

SEQ ID NO: 274527 - DNA, 25 bp, Homo sapien
gctggcgctccacgctgctgaaaca

SEQ ID NO: 274528 - DNA, 25 bp, Homo sapien
ggcgctccacgctgctgaaacatcg

SEQ ID NO: 274529 - DNA, 25 bp, Homo sapien
gctccacgctgctgaaacatcgcag

SEQ ID NO: 274530 - DNA, 25 bp, Homo sapien
tccacgctgctgaaacatcgcagca

SEQ ID NO: 274531 - DNA, 25 bp, Homo sapien
ggcacggctcgctcctggcacagca

SEQ ID NO: 274532 - DNA, 25 bp, Homo sapien
tggcacagcacctgcgcacgcacgg

SEQ ID NO: 274533 - DNA, 25 bp, Homo sapien
acaagtgcccggtgtgcgccaaggg

SEQ ID NO: 274534 - DNA, 25 bp, Homo sapien
ggtgtgcgccaagggcttcggccag

SEQ ID NO: 274535 - DNA, 25 bp, Homo sapien
agggctctgcgctgctcaaacacct

SEQ ID NO: 274536 - DNA, 25 bp, Homo sapien
aagcattgtccactttattctgtaa

SEQ ID NO: 274537 - DNA, 25 bp, Homo sapien
tattctgtaaccttttcaactacca

SEQ ID NO: 274538 - DNA, 25 bp, Homo sapien
tgtaaccttttcaactaccattttg

SEQ ID NO: 274539 - DNA, 25 bp, Homo sapien
aatttgcttttatccatgtggttgt

SEQ ID NO: 274540 - DNA, 25 bp, Homo sapien
cttttatccatgtggttgtttgtga

SEQ ID NO: 274541 - DNA, 25 bp, Homo sapien
gtttgtgatgaactacaggttgctg

SEQ ID NO: 274542 - DNA, 25 bp, Homo sapien
tacaggttgctgactttcttcccct

SEQ ID NO: 274543 - DNA, 25 bp, Homo sapien
gaggatctcatcagtggaatcatta

SEQ ID NO: 274544 - DNA, 25 bp, Homo sapien
tcaaaggatatgactgttgctcagc

SEQ ID NO: 274545 - DNA, 25 bp, Homo sapien
gatatgactgttgctcagctctctg

SEQ ID NO: 274546 - DNA, 25 bp, Homo sapien
gttgttatcttaaggtgatttccaa

SEQ ID NO: 274547 - DNA, 25 bp, Homo sapien
cttttatttcgatgtgtaatggttc

SEQ ID NO: 274548 - DNA, 25 bp, Homo sapien
gtaatggttcacatgatttggatga

SEQ ID NO: 274549 - DNA, 25 bp, Homo sapien
ggagggatcaaactttatagacaaa

SEQ ID NO: 274550 - DNA, 25 bp, Homo sapien
atagacaaaacccagctgtgtgaaa

SEQ ID NO: 274551 - DNA, 25 bp, Homo sapien
aacaggattaatgccagtgattggg

SEQ ID NO: 274552 - DNA, 25 bp, Homo sapien
gggatgatcaaagagaaaccttact

SEQ ID NO: 274553 - DNA, 25 bp, Homo sapien
agtactcattccactaaagggcgaa

SEQ ID NO: 274554 - DNA, 25 bp, Homo sapien
gaattggcagagttcggcatccctg

SEQ ID NO: 274555 - DNA, 25 bp, Homo sapien
tgcagcacatgtcagcctggcgttg

SEQ ID NO: 274556 - DNA, 25 bp, Homo sapien
tcagcctggcgttgggcaagtctgc

SEQ ID NO: 274557 - DNA, 25 bp, Homo sapien
gcaagtctgccacctttcttttatt

SEQ ID NO: 274558 - DNA, 25 bp, Homo sapien
gacagcgggtgaagctcagcacaca

SEQ ID NO: 274559 - DNA, 25 bp, Homo sapien
ggaagccaggccttggccacacggc

SEQ ID NO: 274560 - DNA, 25 bp, Homo sapien
agaggcccagtttgcccaggacagt

SEQ ID NO: 274561 - DNA, 25 bp, Homo sapien
cagtttgcccaggacagtcttgatt

SEQ ID NO: 274562 - DNA, 25 bp, Homo sapien
gacagtcttgatttataccaggtga

SEQ ID NO: 274563 - DNA, 25 bp, Homo sapien
taccaggtgagggtcctcgtgcaga

SEQ ID NO: 274564 - DNA, 25 bp, Homo sapien
gtcctcgtgcagatggtgcattctc

SEQ ID NO: 274565 - DNA, 25 bp, Homo sapien
ggtgcattctctagtttccaaactg

SEQ ID NO: 274566 - DNA, 25 bp, Homo sapien
ctggcagagagcttggatgttttcc

SEQ ID NO: 274567 - DNA, 25 bp, Homo sapien
tccttgatgcagtgggaagccgttg

SEQ ID NO: 274568 - DNA, 25 bp, Homo sapien
gaaaaattttaagcctcaagtgaca

SEQ ID NO: 274569 - DNA, 25 bp, Homo sapien
atggttaatcactgtttgaatcaga

SEQ ID NO: 274570 - DNA, 25 bp, Homo sapien
aatcagagactatttactagctggt

SEQ ID NO: 274571 - DNA, 25 bp, Homo sapien
tactagctggtcctcataaatcagg

SEQ ID NO: 274572 - DNA, 25 bp, Homo sapien
ctggtcctcataaatcagggctggg

SEQ ID NO: 274573 - DNA, 25 bp, Homo sapien
ggagaaatatttatcatcggctaat

SEQ ID NO: 274574 - DNA, 25 bp, Homo sapien
atcatcggctaatgtcatgtgactt

SEQ ID NO: 274575 - DNA, 25 bp, Homo sapien
ggcactgagagaagaaccttaggat

SEQ ID NO: 274576 - DNA, 25 bp, Homo sapien
agaaccttaggatttttgaagtcag

SEQ ID NO: 274577 - DNA, 25 bp, Homo sapien
ttatgacatgacatggcaggctcat

SEQ ID NO: 274578 - DNA, 25 bp, Homo sapien
ggcaggctcattttgcttcatgaat

SEQ ID NO: 274579 - DNA, 25 bp, Homo sapien
ggctcattttgcttcatgaataatg

SEQ ID NO: 274580 - DNA, 25 bp, Homo sapien
agatgtgttgcattcattgggtttc

SEQ ID NO: 274581 - DNA, 25 bp, Homo sapien
gtgttgcattcattgggtttctatg

SEQ ID NO: 274582 - DNA, 25 bp, Homo sapien
cattgggtttctatgagatgtggtt

SEQ ID NO: 274583 - DNA, 25 bp, Homo sapien
atgagatgtggttttatcagacaat

SEQ ID NO: 274584 - DNA, 25 bp, Homo sapien
tcccagtcccaaaagttaaatacag

SEQ ID NO: 274585 - DNA, 25 bp, Homo sapien
ttaaatacaggccacttacttcttt

SEQ ID NO: 274586 - DNA, 25 bp, Homo sapien
tacaggccacttacttctttaacca

SEQ ID NO: 274587 - DNA, 25 bp, Homo sapien
ggccacttacttctttaaccaaatg

SEQ ID NO: 274588 - DNA, 25 bp, Homo sapien
cacttacttctttaaccaaatgata

SEQ ID NO: 274589 - DNA, 25 bp, Homo sapien
cgtgacctcttgaagcccaattatt

SEQ ID NO: 274590 - DNA, 25 bp, Homo sapien
tgacctcttgaagcccaattattgc

SEQ ID NO: 274591 - DNA, 25 bp, Homo sapien
gcaagtgcaagaacagagaggagca

SEQ ID NO: 274592 - DNA, 25 bp, Homo sapien
caagtgcaagaacagagaggagcaa

SEQ ID NO: 274593 - DNA, 25 bp, Homo sapien
cagagaggagcaaagcgcggctgga

SEQ ID NO: 274594 - DNA, 25 bp, Homo sapien
gagaggagcaaagcgcggctggagt

SEQ ID NO: 274595 - DNA, 25 bp, Homo sapien
aagtcagcagtctaggaggtggcac

SEQ ID NO: 274596 - DNA, 25 bp, Homo sapien
agtcagcagtctaggaggtggcaca

SEQ ID NO: 274597 - DNA, 25 bp, Homo sapien
tcagcagtctaggaggtggcacaga

SEQ ID NO: 274598 - DNA, 25 bp, Homo sapien
agcagtctaggaggtggcacagaga

SEQ ID NO: 274599 - DNA, 25 bp, Homo sapien
ggtggcacagagatgacatgtgaat

SEQ ID NO: 274600 - DNA, 25 bp, Homo sapien
gtggcacagagatgacatgtgaata

SEQ ID NO: 274601 - DNA, 25 bp, Homo sapien
tggcacagagatgacatgtgaataa

SEQ ID NO: 274602 - DNA, 25 bp, Homo sapien
agataagctctgtcctgagtccaaa

SEQ ID NO: 274603 - DNA, 25 bp, Homo sapien
caaaccaagcccttccaagagagaa

SEQ ID NO: 274604 - DNA, 25 bp, Homo sapien
gtcagagatgttgaagattccagca

SEQ ID NO: 274605 - DNA, 25 bp, Homo sapien
gaagattccagcaaatttctcctct

SEQ ID NO: 274606 - DNA, 25 bp, Homo sapien
tcctcttatttctaccaagcctttg

SEQ ID NO: 274607 - DNA, 25 bp, Homo sapien
aagcctttgtgaacattgctcttca

SEQ ID NO: 274608 - DNA, 25 bp, Homo sapien
gaacattgctcttcattttggcctg

SEQ ID NO: 274609 - DNA, 25 bp, Homo sapien
gctcttcattttggcctgtacttct

SEQ ID NO: 274610 - DNA, 25 bp, Homo sapien
tgtacttctccctcagggacgtaga

SEQ ID NO: 274611 - DNA, 25 bp, Homo sapien
caattaaggtacttctccctcaggg

SEQ ID NO: 274612 - DNA, 25 bp, Homo sapien
ggtacttctccctcagggacgtaga

SEQ ID NO: 274613 - DNA, 25 bp, Homo sapien
gaggacgacgacactgaggaagcct

SEQ ID NO: 274614 - DNA, 25 bp, Homo sapien
aggaagcctggatgcagctacggcc

SEQ ID NO: 274615 - DNA, 25 bp, Homo sapien
tggatgcagctacggcccacagaac

SEQ ID NO: 274616 - DNA, 25 bp, Homo sapien
agtgctgcggcagtggctgctcacc

SEQ ID NO: 274617 - DNA, 25 bp, Homo sapien
gtgtttgacctctatcaccgagatc

SEQ ID NO: 274618 - DNA, 25 bp, Homo sapien
ctctatcaccgagatctggcaaggt

SEQ ID NO: 274619 - DNA, 25 bp, Homo sapien
gacaggagcctgctgcgtgggccag

SEQ ID NO: 274620 - DNA, 25 bp, Homo sapien
aagctgaacccagagaccttcgtgg

SEQ ID NO: 274621 - DNA, 25 bp, Homo sapien
tggccttctgcatcattgccatgga

SEQ ID NO: 274622 - DNA, 25 bp, Homo sapien
atcattgccatggacaggctcacta

SEQ ID NO: 274623 - DNA, 25 bp, Homo sapien
aggctcactaaggacacctaccgtg

SEQ ID NO: 274624 - DNA, 25 bp, Homo sapien
gagcacaaattgaaccaagcccctg

SEQ ID NO: 274625 - DNA, 25 bp, Homo sapien
caaattgaaccaagcccctgagaag

SEQ ID NO: 274626 - DNA, 25 bp, Homo sapien
gaaccaagcccctgagaagtggcag

SEQ ID NO: 274627 - DNA, 25 bp, Homo sapien
gcccctgagaagtggcagcagctgt

SEQ ID NO: 274628 - DNA, 25 bp, Homo sapien
gaagaaccaagaacagatcgctccc

SEQ ID NO: 274629 - DNA, 25 bp, Homo sapien
tgggtgtaccaacctacctttctat

SEQ ID NO: 274630 - DNA, 25 bp, Homo sapien
tgtaccaacctacctttctatcaga

SEQ ID NO: 274631 - DNA, 25 bp, Homo sapien
accaacctacctttctatcagaaga

SEQ ID NO: 274632 - DNA, 25 bp, Homo sapien
acctacctttctatcagaagagggc

SEQ ID NO: 274633 - DNA, 25 bp, Homo sapien
aaattcagcattttcccatccaatg

SEQ ID NO: 274634 - DNA, 25 bp, Homo sapien
tcagcattttcccatccaatggagt

SEQ ID NO: 274635 - DNA, 25 bp, Homo sapien
tgctgcgtgggccagagtcacagag

SEQ ID NO: 274636 - DNA, 25 bp, Homo sapien
caagctgaacccagagaccttcgtg

SEQ ID NO: 274637 - DNA, 25 bp, Homo sapien
agctgaacccagagaccttcgtggc

SEQ ID NO: 274638 - DNA, 25 bp, Homo sapien
agagaccttcgtggccttctgcatc

SEQ ID NO: 274639 - DNA, 25 bp, Homo sapien
tggccttctgcatcattgccatgga

SEQ ID NO: 274640 - DNA, 25 bp, Homo sapien
cttctgcatcattgccatggacagg

SEQ ID NO: 274641 - DNA, 25 bp, Homo sapien
atcattgccatggacaggctcacta

SEQ ID NO: 274642 - DNA, 25 bp, Homo sapien
ccatggacaggctcactaaggacac

SEQ ID NO: 274643 - DNA, 25 bp, Homo sapien
ggacaggctcactaaggacacctac

SEQ ID NO: 274644 - DNA, 25 bp, Homo sapien
ggctcactaaggacacctaccgtgt

SEQ ID NO: 274645 - DNA, 25 bp, Homo sapien
cactaaggacacctaccgtgtccgg

SEQ ID NO: 274646 - DNA, 25 bp, Homo sapien
gaaaaacttacagaatggcctgact

SEQ ID NO: 274647 - DNA, 25 bp, Homo sapien
ggcactgggccaggttccatatgac

SEQ ID NO: 274648 - DNA, 25 bp, Homo sapien
tggcctgactacacagagctcactg

SEQ ID NO: 274649 - DNA, 25 bp, Homo sapien
gctcactgttgaaaaacgctgggtt

SEQ ID NO: 274650 - DNA, 25 bp, Homo sapien
aacgctgggttgtaactctaagata

SEQ ID NO: 274651 - DNA, 25 bp, Homo sapien
gatagcatctgctacattgctaaag

SEQ ID NO: 274652 - DNA, 25 bp, Homo sapien
gatctgttaggaatcttagctgcta

SEQ ID NO: 274653 - DNA, 25 bp, Homo sapien
tagctgctactgttgcaacaccaat

SEQ ID NO: 274654 - DNA, 25 bp, Homo sapien
gttccatatgacctgggtgccagca

SEQ ID NO: 274655 - DNA, 25 bp, Homo sapien
ggttttgcttatgcttgtatttgtt

SEQ ID NO: 274656 - DNA, 25 bp, Homo sapien
caacctatatagcaagtatcacagt

SEQ ID NO: 274657 - DNA, 25 bp, Homo sapien
ctgtgcctggtgatttaggttggtc

SEQ ID NO: 274658 - DNA, 25 bp, Homo sapien
ggtgatttaggttggtcatcccgtc

SEQ ID NO: 274659 - DNA, 25 bp, Homo sapien
ttaggttggtcatcccgtctaatcc

SEQ ID NO: 274660 - DNA, 25 bp, Homo sapien
tctaatccccttattacactctgaa

SEQ ID NO: 274661 - DNA, 25 bp, Homo sapien
acactctgaagttgatcttcccact

SEQ ID NO: 274662 - DNA, 25 bp, Homo sapien
tgtttctggtcactagtagaaatga

SEQ ID NO: 274663 - DNA, 25 bp, Homo sapien
gaaatgagaattgaactgtctgcct

SEQ ID NO: 274664 - DNA, 25 bp, Homo sapien
acacatactctgttcaagatggcaa

SEQ ID NO: 274665 - DNA, 25 bp, Homo sapien
caagatggcaaatgcttgggttaga

SEQ ID NO: 274666 - DNA, 25 bp, Homo sapien
ggtaatgatgttcttttggctaatg

SEQ ID NO: 274667 - DNA, 25 bp, Homo sapien
gttcttttggctaatggtaacttca

SEQ ID NO: 274668 - DNA, 25 bp, Homo sapien
ggcagaaacatgttcattttcccat

SEQ ID NO: 274669 - DNA, 25 bp, Homo sapien
gaacaagtcccaagggtttatcatc

SEQ ID NO: 274670 - DNA, 25 bp, Homo sapien
gtactttagaacaaggcctgtttct

SEQ ID NO: 274671 - DNA, 25 bp, Homo sapien
tttatcatctgcctgaaggcactgc

SEQ ID NO: 274672 - DNA, 25 bp, Homo sapien
aaggcactgctaacgaatttgtcaa

SEQ ID NO: 274673 - DNA, 25 bp, Homo sapien
tgtcaaatcctttatccagcacagc

SEQ ID NO: 274674 - DNA, 25 bp, Homo sapien
ttatccagcacagctttaccaagca

SEQ ID NO: 274675 - DNA, 25 bp, Homo sapien
acagtcaggcctttgcacttctcat

SEQ ID NO: 274676 - DNA, 25 bp, Homo sapien
cctttgcacttctcattctcatagg

SEQ ID NO: 274677 - DNA, 25 bp, Homo sapien
ttttctgccatccaatgagagcaga

SEQ ID NO: 274678 - DNA, 25 bp, Homo sapien
gaatctccaatgaaactgactagat

SEQ ID NO: 274679 - DNA, 25 bp, Homo sapien
taatggtactttaataactactaag

SEQ ID NO: 274680 - DNA, 25 bp, Homo sapien
ttggctatttcaatgtaagttataa

SEQ ID NO: 274681 - DNA, 25 bp, Homo sapien
gtaagttataaggtggtacattcct

SEQ ID NO: 274682 - DNA, 25 bp, Homo sapien
taaggtggtacattcctaagggtat

SEQ ID NO: 274683 - DNA, 25 bp, Homo sapien
cattcctaagggtatttatagttga

SEQ ID NO: 274684 - DNA, 25 bp, Homo sapien
aatacaacgtgctaaatcttttatg

SEQ ID NO: 274685 - DNA, 25 bp, Homo sapien
acaacgtgctaaatcttttatgtat

SEQ ID NO: 274686 - DNA, 25 bp, Homo sapien
caacaaagttagactgacttctata

SEQ ID NO: 274687 - DNA, 25 bp, Homo sapien
gactgacttctatatgtgctctttt

SEQ ID NO: 274688 - DNA, 25 bp, Homo sapien
gacttctatatgtgctcttttactc

SEQ ID NO: 274689 - DNA, 25 bp, Homo sapien
atatgtgctcttttactctgataat

SEQ ID NO: 274690 - DNA, 25 bp, Homo sapien
gcagcaagtggagtttcttttttct

SEQ ID NO: 274691 - DNA, 25 bp, Homo sapien
aaaacaaactgcacgaagtggagtt

SEQ ID NO: 274692 - DNA, 25 bp, Homo sapien
tgttctgaaactagtgcttctcaac

SEQ ID NO: 274693 - DNA, 25 bp, Homo sapien
gaaactagtgcttctcaaccagtaa

SEQ ID NO: 274694 - DNA, 25 bp, Homo sapien
ttctcaaccagtaaagcaggcacga

SEQ ID NO: 274695 - DNA, 25 bp, Homo sapien
ggcaagggctttttgttctagtgaa

SEQ ID NO: 274696 - DNA, 25 bp, Homo sapien
gaaacaggtggcctcctttcgatgt

SEQ ID NO: 274697 - DNA, 25 bp, Homo sapien
gcctcctttcgatgtgggtttgtaa

SEQ ID NO: 274698 - DNA, 25 bp, Homo sapien
aaagcactagtggtctaatagcatg

SEQ ID NO: 274699 - DNA, 25 bp, Homo sapien
gtggtctaatagcatgggctccttg

SEQ ID NO: 274700 - DNA, 25 bp, Homo sapien
atagcatgggctccttgagatagac

SEQ ID NO: 274701 - DNA, 25 bp, Homo sapien
agtcgcagggaaaggtctcgtcctc

SEQ ID NO: 274702 - DNA, 25 bp, Homo sapien
tctcgtcctccttaaccatgacaat

SEQ ID NO: 274703 - DNA, 25 bp, Homo sapien
aactcgcagctttcgactttgtttc

SEQ ID NO: 274704 - DNA, 25 bp, Homo sapien
tcgactttgtttccgaacgagcttg

SEQ ID NO: 274705 - DNA, 25 bp, Homo sapien
aacgagcttgccgtgctgaatgaaa

SEQ ID NO: 274706 - DNA, 25 bp, Homo sapien
gtctgctttatgtcgaagccagtct

SEQ ID NO: 274707 - DNA, 25 bp, Homo sapien
gaagccagtcttcataaccctgttt

SEQ ID NO: 274708 - DNA, 25 bp, Homo sapien
ataaccctgtttgatagccgtcaca

SEQ ID NO: 274709 - DNA, 25 bp, Homo sapien
gaagagtggaagtccgcttgtcact

SEQ ID NO: 274710 - DNA, 25 bp, Homo sapien
gcttgtcactggacttgtgggtgta

SEQ ID NO: 274711 - DNA, 25 bp, Homo sapien
gtgggtgtatcaataatcaactgca

SEQ ID NO: 274712 - DNA, 25 bp, Homo sapien
ttgagaagacaacctgagtggtgtt

SEQ ID NO: 274713 - DNA, 25 bp, Homo sapien
caacctgagtggtgttgggtgaaca

SEQ ID NO: 274714 - DNA, 25 bp, Homo sapien
gttgggtgaacagtcattctacctg

SEQ ID NO: 274715 - DNA, 25 bp, Homo sapien
ggtgaacagtcattctacctggctg

SEQ ID NO: 274716 - DNA, 25 bp, Homo sapien
gaacagtcattctacctggctgtag

SEQ ID NO: 274717 - DNA, 25 bp, Homo sapien
gtcattctacctggctgtagtgtag

SEQ ID NO: 274718 - DNA, 25 bp, Homo sapien
gagctggcggccatggatcattgaa

SEQ ID NO: 274719 - DNA, 25 bp, Homo sapien
ctggcggccatggatcattgaaagc

SEQ ID NO: 274720 - DNA, 25 bp, Homo sapien
gccatggatcattgaaagccttgaa

SEQ ID NO: 274721 - DNA, 25 bp, Homo sapien
gccaccagtggttttagttgagcag

SEQ ID NO: 274722 - DNA, 25 bp, Homo sapien
caccagtggttttagttgagcagca

SEQ ID NO: 274723 - DNA, 25 bp, Homo sapien
acggccctgggcaactctcagtctg

SEQ ID NO: 274724 - DNA, 25 bp, Homo sapien
agtctggccacccattcgatgctgc

SEQ ID NO: 274725 - DNA, 25 bp, Homo sapien
ggtctcagagtgtcccagggtactg

SEQ ID NO: 274726 - DNA, 25 bp, Homo sapien
agtgtcccagggtactggccacaca

SEQ ID NO: 274727 - DNA, 25 bp, Homo sapien
gggtactggccacacatgcccgaca

SEQ ID NO: 274728 - DNA, 25 bp, Homo sapien
atgcccgacaccagggtcataaggt

SEQ ID NO: 274729 - DNA, 25 bp, Homo sapien
gggtcataaggtcctctcagcagag

SEQ ID NO: 274730 - DNA, 25 bp, Homo sapien
agccactgcagcaccaaaggcattt

SEQ ID NO: 274731 - DNA, 25 bp, Homo sapien
gaaggaggcaaggacgcgtcatcta

SEQ ID NO: 274732 - DNA, 25 bp, Homo sapien
gcgtcatctagatgtcaagccccag

SEQ ID NO: 274733 - DNA, 25 bp, Homo sapien
tgcgattctgtcacagttcacccca

SEQ ID NO: 274734 - DNA, 25 bp, Homo sapien
gtttaccagtaaaagtatgcatttt

SEQ ID NO: 274735 - DNA, 25 bp, Homo sapien
gactttcagatttatgctttttacg

SEQ ID NO: 274736 - DNA, 25 bp, Homo sapien
gctttttacgtgaagctgctaaact

SEQ ID NO: 274737 - DNA, 25 bp, Homo sapien
cgtgaagctgctaaactaaaagtaa

SEQ ID NO: 274738 - DNA, 25 bp, Homo sapien
tggaagaaaccaagtctagtaggtt

SEQ ID NO: 274739 - DNA, 25 bp, Homo sapien
tacacttaaaatatcttctccagag

SEQ ID NO: 274740 - DNA, 25 bp, Homo sapien
ttctccagagactgtatgctcctat

SEQ ID NO: 274741 - DNA, 25 bp, Homo sapien
gagactgtatgctcctatactagac

SEQ ID NO: 274742 - DNA, 25 bp, Homo sapien
gtatgctcctatactagactgtaag

SEQ ID NO: 274743 - DNA, 25 bp, Homo sapien
gcagtctgtcagatttatctttgta

SEQ ID NO: 274744 - DNA, 25 bp, Homo sapien
ccagcgcctagtgtagtgccttgca

SEQ ID NO: 274745 - DNA, 25 bp, Homo sapien
gaagggcagggtagttctttccatt

SEQ ID NO: 274746 - DNA, 25 bp, Homo sapien
tagttctttccatttccccttgcag

SEQ ID NO: 274747 - DNA, 25 bp, Homo sapien
ttgcagctacacttactttctccct

SEQ ID NO: 274748 - DNA, 25 bp, Homo sapien
gactaccaaatggagtgacggttga

SEQ ID NO: 274749 - DNA, 25 bp, Homo sapien
atatgatacacccagacagacccag

SEQ ID NO: 274750 - DNA, 25 bp, Homo sapien
aaatcttttgatttccccagcgaga

SEQ ID NO: 274751 - DNA, 25 bp, Homo sapien
ttgatttccccagcgagatacttac

SEQ ID NO: 274752 - DNA, 25 bp, Homo sapien
agcgagatacttaccactctctctt

SEQ ID NO: 274753 - DNA, 25 bp, Homo sapien
tcttctctttcccatggttaaaaca

SEQ ID NO: 274754 - DNA, 25 bp, Homo sapien
aacaggagttgtgttctctgtcgct

SEQ ID NO: 274755 - DNA, 25 bp, Homo sapien
tgtgttctctgtcgctgctaaatta

SEQ ID NO: 274756 - DNA, 25 bp, Homo sapien
tcattgttttggtgttctacaatca

SEQ ID NO: 274757 - DNA, 25 bp, Homo sapien
ttggtgttctacaatcatgatttgg

SEQ ID NO: 274758 - DNA, 25 bp, Homo sapien
aacctcattgtcctggagtgaaaat

SEQ ID NO: 274759 - DNA, 25 bp, Homo sapien
ttcattccacttctttgagtatttg

SEQ ID NO: 274760 - DNA, 25 bp, Homo sapien
aatgcccatgaattaagtaagaacc

SEQ ID NO: 274761 - DNA, 25 bp, Homo sapien
agaaccaatgagagccttagagtca

SEQ ID NO: 274762 - DNA, 25 bp, Homo sapien
gagccttagagtcatgatttcttta

SEQ ID NO: 274763 - DNA, 25 bp, Homo sapien
ggttcttagaaatccaaggccttga

SEQ ID NO: 274764 - DNA, 25 bp, Homo sapien
gccttgacttttaaaacttgtctct

SEQ ID NO: 274765 - DNA, 25 bp, Homo sapien
gacttttaaaacttgtctctgagtt

SEQ ID NO: 274766 - DNA, 25 bp, Homo sapien
taagggctcattttggaatgtaaaa

SEQ ID NO: 274767 - DNA, 25 bp, Homo sapien
gggaaacacattccataagagggag

SEQ ID NO: 274768 - DNA, 25 bp, Homo sapien
gcggcaggtctgatcccacagggcc

SEQ ID NO: 274769 - DNA, 25 bp, Homo sapien
aacacattccataagagggaggagt

SEQ ID NO: 274770 - DNA, 25 bp, Homo sapien
aggaacttcagtgccatcccaactg

SEQ ID NO: 274771 - DNA, 25 bp, Homo sapien
tcagtgccatcccaactgcaatggg

SEQ ID NO: 274772 - DNA, 25 bp, Homo sapien
agtgccatcccaactgcaatgggaa

SEQ ID NO: 274773 - DNA, 25 bp, Homo sapien
taaaaagttcctcttagctgggctt

SEQ ID NO: 274774 - DNA, 25 bp, Homo sapien
aaaagttcctcttagctgggcttgg

SEQ ID NO: 274775 - DNA, 25 bp, Homo sapien
tgccaaggtcctgagtcaagctgag

SEQ ID NO: 274776 - DNA, 25 bp, Homo sapien
aaggtcctgagtcaagctgagcttg

SEQ ID NO: 274777 - DNA, 25 bp, Homo sapien
caagctgagcttggcaagttcaaaa

SEQ ID NO: 274778 - DNA, 25 bp, Homo sapien
tccagggcactctggtccctattcc

SEQ ID NO: 274779 - DNA, 25 bp, Homo sapien
agctcctaggcagctgagccgggtc

SEQ ID NO: 274780 - DNA, 25 bp, Homo sapien
cctaggcagctgagccgggtccctt

SEQ ID NO: 274781 - DNA, 25 bp, Homo sapien
gtgaccaggagctttggtgcaggga

SEQ ID NO: 274782 - DNA, 25 bp, Homo sapien
agctttggtgcagggagctcttggt

SEQ ID NO: 274783 - DNA, 25 bp, Homo sapien
tttggtgcagggagctcttggtggg

SEQ ID NO: 274784 - DNA, 25 bp, Homo sapien
acccctgccaggtctgtggacatgg

SEQ ID NO: 274785 - DNA, 25 bp, Homo sapien
cctgccaggtctgtggacatggtta

SEQ ID NO: 274786 - DNA, 25 bp, Homo sapien
tggacatggttatatgcccgggaga

SEQ ID NO: 274787 - DNA, 25 bp, Homo sapien
acatggttatatgcccgggagaggg

SEQ ID NO: 274788 - DNA, 25 bp, Homo sapien
cccaatcccacctctgtttattctg

SEQ ID NO: 274789 - DNA, 25 bp, Homo sapien
aattacatccggcaatacctctttt

SEQ ID NO: 274790 - DNA, 25 bp, Homo sapien
tacctcttttgctaatggaactcag

SEQ ID NO: 274791 - DNA, 25 bp, Homo sapien
gagtctggaatctaggcaggtagct

SEQ ID NO: 274792 - DNA, 25 bp, Homo sapien
gtagctggcctgacagtaaccttga

SEQ ID NO: 274793 - DNA, 25 bp, Homo sapien
tggcctgacagtaaccttgatccag

SEQ ID NO: 274794 - DNA, 25 bp, Homo sapien
ccttgatccaggtaaaccaaagtgg

SEQ ID NO: 274795 - DNA, 25 bp, Homo sapien
caaagtggaattctcgagcctggaa

SEQ ID NO: 274796 - DNA, 25 bp, Homo sapien
tcgagcctggaattgatgactcata

SEQ ID NO: 274797 - DNA, 25 bp, Homo sapien
tcaaatccgcccatgcattgagatc

SEQ ID NO: 274798 - DNA, 25 bp, Homo sapien
aggtgggattagtagcttagtctca

SEQ ID NO: 274799 - DNA, 25 bp, Homo sapien
agcttagtctcagtttcaagtggat

SEQ ID NO: 274800 - DNA, 25 bp, Homo sapien
gatgacaatcatcagagccctgtgc

SEQ ID NO: 274801 - DNA, 25 bp, Homo sapien
tgacaatcatcagagccctgtgcat

SEQ ID NO: 274802 - DNA, 25 bp, Homo sapien
tgtgcatcactcataggggaaaccg

SEQ ID NO: 274803 - DNA, 25 bp, Homo sapien
attacaaggctttctatgggcacag

SEQ ID NO: 274804 - DNA, 25 bp, Homo sapien
atgggcacagccttgactttgtaaa

SEQ ID NO: 274805 - DNA, 25 bp, Homo sapien
ggcacagccttgactttgtaaagca

SEQ ID NO: 274806 - DNA, 25 bp, Homo sapien
gccttgactttgtaaagcaggacat

SEQ ID NO: 274807 - DNA, 25 bp, Homo sapien
gcaggacattgtcccttgacacagg

SEQ ID NO: 274808 - DNA, 25 bp, Homo sapien
ttgacacaggacaagccagggcagg

SEQ ID NO: 274809 - DNA, 25 bp, Homo sapien
cgggtcggtgtcaggtgctcctttc

SEQ ID NO: 274810 - DNA, 25 bp, Homo sapien
gtgtcaggtgctcctttccaccttt

SEQ ID NO: 274811 - DNA, 25 bp, Homo sapien
ccctgtatgtaaggaagcacgtttt

SEQ ID NO: 274812 - DNA, 25 bp, Homo sapien
gttagaaacatcactgtttgatcta

SEQ ID NO: 274813 - DNA, 25 bp, Homo sapien
attgcaacattcttaggtggtttta

SEQ ID NO: 274814 - DNA, 25 bp, Homo sapien
gtttgatctaaaagaggcttcctga

SEQ ID NO: 274815 - DNA, 25 bp, Homo sapien
taaaagaggcttcctgatttaacag

SEQ ID NO: 274816 - DNA, 25 bp, Homo sapien
aagaggcttcctgatttaacaggat

SEQ ID NO: 274817 - DNA, 25 bp, Homo sapien
ggcttcctgatttaacaggatgtga

SEQ ID NO: 274818 - DNA, 25 bp, Homo sapien
gaaatttatgtaagaagtctccatt

SEQ ID NO: 274819 - DNA, 25 bp, Homo sapien
gtaagaagtctccattgataatggt

SEQ ID NO: 274820 - DNA, 25 bp, Homo sapien
ccattgataatggtaaaacctatta

SEQ ID NO: 274821 - DNA, 25 bp, Homo sapien
ctattaaatgatacctctttttctt

SEQ ID NO: 274822 - DNA, 25 bp, Homo sapien
ctctaccagtcagtggttctgatgt

SEQ ID NO: 274823 - DNA, 25 bp, Homo sapien
gtcagtggttctgatgtcatcgggt

SEQ ID NO: 274824 - DNA, 25 bp, Homo sapien
gtggaggtggtgttctatacctaaa

SEQ ID NO: 274825 - DNA, 25 bp, Homo sapien
aaaggatgacctgctccagaaacag

SEQ ID NO: 274826 - DNA, 25 bp, Homo sapien
gcaccagcacagcatgtattttctt

SEQ ID NO: 274827 - DNA, 25 bp, Homo sapien
tcttctcttctgaaagttctggctt

SEQ ID NO: 274828 - DNA, 25 bp, Homo sapien
gaaagttctggcttgtagacccctc

SEQ ID NO: 274829 - DNA, 25 bp, Homo sapien
gcagatctctactgtaaaatgggct

SEQ ID NO: 274830 - DNA, 25 bp, Homo sapien
gtaaaatgggctccctggtatctcc

SEQ ID NO: 274831 - DNA, 25 bp, Homo sapien
tggtatctcctgtcttccctactgc

SEQ ID NO: 274832 - DNA, 25 bp, Homo sapien
ctactgctccaaaccctaaattttg

SEQ ID NO: 274833 - DNA, 25 bp, Homo sapien
cctcacctgtcactttttaattgca

SEQ ID NO: 274834 - DNA, 25 bp, Homo sapien
acctgtcactttttaattgcaagaa

SEQ ID NO: 274835 - DNA, 25 bp, Homo sapien
ttgcaagaaagctgaaaggtttttt

SEQ ID NO: 274836 - DNA, 25 bp, Homo sapien
tactatattgcctaacttgtattat

SEQ ID NO: 274837 - DNA, 25 bp, Homo sapien
acttgtattattaagcaattctgct

SEQ ID NO: 274838 - DNA, 25 bp, Homo sapien
aacctgtgaccttacattttcatct

SEQ ID NO: 274839 - DNA, 25 bp, Homo sapien
gtgaccttacattttcatctgaaaa

SEQ ID NO: 274840 - DNA, 25 bp, Homo sapien
gctggacaccaattgccctatgaag

SEQ ID NO: 274841 - DNA, 25 bp, Homo sapien
acaccaattgccctatgaagctatt

SEQ ID NO: 274842 - DNA, 25 bp, Homo sapien
ccaattgccctatgaagctattgct

SEQ ID NO: 274843 - DNA, 25 bp, Homo sapien
tgcaacctcacctgtcactttttaa

SEQ ID NO: 274844 - DNA, 25 bp, Homo sapien
tagaatttctgtattaaaagccttg

SEQ ID NO: 274845 - DNA, 25 bp, Homo sapien
gattatatattagcgtgcatacaca

SEQ ID NO: 274846 - DNA, 25 bp, Homo sapien
agcgtgcatacacatctgtaacaaa

SEQ ID NO: 274847 - DNA, 25 bp, Homo sapien
gtgcatacacatctgtaacaaatgt

SEQ ID NO: 274848 - DNA, 25 bp, Homo sapien
aagcaagacgtatttgtctatatag

SEQ ID NO: 274849 - DNA, 25 bp, Homo sapien
gtctatatagacaattgtgtatgtg

SEQ ID NO: 274850 - DNA, 25 bp, Homo sapien
gtgtgtgtcgtaatgtatgtagata

SEQ ID NO: 274851 - DNA, 25 bp, Homo sapien
taacaaagactggtggttacttcta

SEQ ID NO: 274852 - DNA, 25 bp, Homo sapien
tgaacattttacaatttaggtagaa

SEQ ID NO: 274853 - DNA, 25 bp, Homo sapien
aatttttcatagaaatatccttgag

SEQ ID NO: 274854 - DNA, 25 bp, Homo sapien
gaaatatccttgagaaactagaatt

SEQ ID NO: 274855 - DNA, 25 bp, Homo sapien
ccagaagttgatttgctcagcataa

SEQ ID NO: 274856 - DNA, 25 bp, Homo sapien
gggtatcattttctgagccctaata

SEQ ID NO: 274857 - DNA, 25 bp, Homo sapien
atcattttctgagccctaatactgt

SEQ ID NO: 274858 - DNA, 25 bp, Homo sapien
gggcaggacagaaacgtctaattag

SEQ ID NO: 274859 - DNA, 25 bp, Homo sapien
agtaattttgtgtgactccaaggaa

SEQ ID NO: 274860 - DNA, 25 bp, Homo sapien
ggaaaagctctcttctaactccttt

SEQ ID NO: 274861 - DNA, 25 bp, Homo sapien
ttctaactcctttcaaaattctcag

SEQ ID NO: 274862 - DNA, 25 bp, Homo sapien
tctcagaaaaattacctgttcactg

SEQ ID NO: 274863 - DNA, 25 bp, Homo sapien
aagtatttatccagcaagtaccatc

SEQ ID NO: 274864 - DNA, 25 bp, Homo sapien
aagtaccatctgtcaaccttgttct

SEQ ID NO: 274865 - DNA, 25 bp, Homo sapien
tgcctgccagaagttgatttgctca

SEQ ID NO: 274866 - DNA, 25 bp, Homo sapien
tatcccccccaaacattatcaaaat

SEQ ID NO: 274867 - DNA, 25 bp, Homo sapien
ctaactagggctgagagactattaa

SEQ ID NO: 274868 - DNA, 25 bp, Homo sapien
actagggctgagagactattaaatt

SEQ ID NO: 274869 - DNA, 25 bp, Homo sapien
atgttctgcagaaaatcttatggac

SEQ ID NO: 274870 - DNA, 25 bp, Homo sapien
gcagaaaatcttatggacttcctta

SEQ ID NO: 274871 - DNA, 25 bp, Homo sapien
gaaaatcttatggacttccttaagt

SEQ ID NO: 274872 - DNA, 25 bp, Homo sapien
atcttatggacttccttaagtgtaa

SEQ ID NO: 274873 - DNA, 25 bp, Homo sapien
tatggacttccttaagtgtaatagt

SEQ ID NO: 274874 - DNA, 25 bp, Homo sapien
gacttccttaagtgtaatagttatg

SEQ ID NO: 274875 - DNA, 25 bp, Homo sapien
tagttatgataacccgatttaaata

SEQ ID NO: 274876 - DNA, 25 bp, Homo sapien
ataagaaacatactgaataaccaca

SEQ ID NO: 274877 - DNA, 25 bp, Homo sapien
tgcactcaagacctataaggccttt

SEQ ID NO: 274878 - DNA, 25 bp, Homo sapien
cacagcctgatcctaagtggaaagg

SEQ ID NO: 274879 - DNA, 25 bp, Homo sapien
caggagaagcgtggcagagaactat

SEQ ID NO: 274880 - DNA, 25 bp, Homo sapien
gagaactatggatcaggcagcccct

SEQ ID NO: 274881 - DNA, 25 bp, Homo sapien
ccctctcatctttaccataagctag

SEQ ID NO: 274882 - DNA, 25 bp, Homo sapien
ccataagctaggtgcactgcaaagt

SEQ ID NO: 274883 - DNA, 25 bp, Homo sapien
aataagcaggatctgaaacaggcca

SEQ ID NO: 274884 - DNA, 25 bp, Homo sapien
caggccagctgaaactttcaagagg

SEQ ID NO: 274885 - DNA, 25 bp, Homo sapien
tttcaagaggaaccagttcaggcat

SEQ ID NO: 274886 - DNA, 25 bp, Homo sapien
cagttcaggcatttccaggtagcaa

SEQ ID NO: 274887 - DNA, 25 bp, Homo sapien
catttccaggtagcaagggaccacc

SEQ ID NO: 274888 - DNA, 25 bp, Homo sapien
attggtgttccaaggcaagaagtta

SEQ ID NO: 274889 - DNA, 25 bp, Homo sapien
gaagttattttcaccagggaagcct

SEQ ID NO: 274890 - DNA, 25 bp, Homo sapien
gcctgtgaacagaaagagctcctga

SEQ ID NO: 274891 - DNA, 25 bp, Homo sapien
aaagagctcctgagactacacctgc

SEQ ID NO: 274892 - DNA, 25 bp, Homo sapien
gagcgagggtgattgtccacttaca

SEQ ID NO: 274893 - DNA, 25 bp, Homo sapien
gcttttaatttggtgtcagtaggaa

SEQ ID NO: 274894 - DNA, 25 bp, Homo sapien
gaccagcacggatttgggaatcacc

SEQ ID NO: 274895 - DNA, 25 bp, Homo sapien
ggaatcaccaatagagtcaacccct

SEQ ID NO: 274896 - DNA, 25 bp, Homo sapien
agtcaacccctcactctaagatgag

SEQ ID NO: 274897 - DNA, 25 bp, Homo sapien
gattgtccacttacaacaaagtttg

SEQ ID NO: 274898 - DNA, 25 bp, Homo sapien
aagtttgcaactccctggatagtcc

SEQ ID NO: 274899 - DNA, 25 bp, Homo sapien
tgcttttttcctaccctatatctat

SEQ ID NO: 274900 - DNA, 25 bp, Homo sapien
cctaccctatatctattttctcttt

SEQ ID NO: 274901 - DNA, 25 bp, Homo sapien
ttagtaacaaatttctgggctgaaa

SEQ ID NO: 274902 - DNA, 25 bp, Homo sapien
tgggctgaaaatctcagccttcctt

SEQ ID NO: 274903 - DNA, 25 bp, Homo sapien
agccttccttgcaggtcaacaagat

SEQ ID NO: 274904 - DNA, 25 bp, Homo sapien
gatttacgaaatccatttttcctgt

SEQ ID NO: 274905 - DNA, 25 bp, Homo sapien
ttttttccgtgcctacaatgtggac

SEQ ID NO: 274906 - DNA, 25 bp, Homo sapien
ttccgtgcctacaatgtggacatct

SEQ ID NO: 274907 - DNA, 25 bp, Homo sapien
ctacaatgtggacatctaagctgga

SEQ ID NO: 274908 - DNA, 25 bp, Homo sapien
gatattacagactattttgcaatga

SEQ ID NO: 274909 - DNA, 25 bp, Homo sapien
gagagtttgtgatacagactgcttt

SEQ ID NO: 274910 - DNA, 25 bp, Homo sapien
gcaagtaacttaaaactatcctcag

SEQ ID NO: 274911 - DNA, 25 bp, Homo sapien
gtaacttaaaactatcctcagacaa

SEQ ID NO: 274912 - DNA, 25 bp, Homo sapien
atttgctctcatgatgtcagaaatt

SEQ ID NO: 274913 - DNA, 25 bp, Homo sapien
ttgctctcatgatgtcagaaattag

SEQ ID NO: 274914 - DNA, 25 bp, Homo sapien
gctctcatgatgtcagaaattaggt

SEQ ID NO: 274915 - DNA, 25 bp, Homo sapien
ctcatgatgtcagaaattaggtaac

SEQ ID NO: 274916 - DNA, 25 bp, Homo sapien
catgatgtcagaaattaggtaactt

SEQ ID NO: 274917 - DNA, 25 bp, Homo sapien
gatgtcagaaattaggtaacttttc

SEQ ID NO: 274918 - DNA, 25 bp, Homo sapien
taacttttctattttggttcttcat

SEQ ID NO: 274919 - DNA, 25 bp, Homo sapien
tcttcatttagatatcaacctggta

SEQ ID NO: 274920 - DNA, 25 bp, Homo sapien
tgtggagaaagccggcaagtaactt

SEQ ID NO: 274921 - DNA, 25 bp, Homo sapien
ggacttttcaaagaacaccttgcca

SEQ ID NO: 274922 - DNA, 25 bp, Homo sapien
agaacaccttgccaaatttggtaat

SEQ ID NO: 274923 - DNA, 25 bp, Homo sapien
atttggtaattcctagcaattgtca

SEQ ID NO: 274924 - DNA, 25 bp, Homo sapien
aattcctagcaattgtcatttcctg

SEQ ID NO: 274925 - DNA, 25 bp, Homo sapien
tgtcatttcctgttggaatttctta

SEQ ID NO: 274926 - DNA, 25 bp, Homo sapien
aaagtaattcttgaccttgtgtatt

SEQ ID NO: 274927 - DNA, 25 bp, Homo sapien
cttgaccttgtgtatttagtaaaat

SEQ ID NO: 274928 - DNA, 25 bp, Homo sapien
aagactttttagactttcaatgcta

SEQ ID NO: 274929 - DNA, 25 bp, Homo sapien
tagactttcaatgctaattgatcct

SEQ ID NO: 274930 - DNA, 25 bp, Homo sapien
atcaaactttgtaacatggtgcttt

SEQ ID NO: 274931 - DNA, 25 bp, Homo sapien
atggtgctttattgtggacttttca

SEQ ID NO: 274932 - DNA, 25 bp, Homo sapien
aaatgatgactgatgccccaagcct

SEQ ID NO: 274933 - DNA, 25 bp, Homo sapien
aatgatgactgatgccccaagcctt

SEQ ID NO: 274934 - DNA, 25 bp, Homo sapien
tgactgatgccccaagccttagtgt

SEQ ID NO: 274935 - DNA, 25 bp, Homo sapien
actgatgccccaagccttagtgtgt

SEQ ID NO: 274936 - DNA, 25 bp, Homo sapien
gatgccccaagccttagtgtgttct

SEQ ID NO: 274937 - DNA, 25 bp, Homo sapien
cagaccttttcccagcaataaacta

SEQ ID NO: 274938 - DNA, 25 bp, Homo sapien
gggaaaagctgctccctaaaccctg

SEQ ID NO: 274939 - DNA, 25 bp, Homo sapien
aaaagctgctccctaaaccctgaag

SEQ ID NO: 274940 - DNA, 25 bp, Homo sapien
aaagctgctccctaaaccctgaagc

SEQ ID NO: 274941 - DNA, 25 bp, Homo sapien
tagtgaggagggatcagtaaatgat

SEQ ID NO: 274942 - DNA, 25 bp, Homo sapien
gtaaatgatgactgatgccccaagc

SEQ ID NO: 274943 - DNA, 25 bp, Homo sapien
gggcaacagattctcactcatgttt

SEQ ID NO: 274944 - DNA, 25 bp, Homo sapien
ctcactcatgtttaagatcttgtta

SEQ ID NO: 274945 - DNA, 25 bp, Homo sapien
gttatttcagcttcataagatcaaa

SEQ ID NO: 274946 - DNA, 25 bp, Homo sapien
ttttctcttttaccctcaggattct

SEQ ID NO: 274947 - DNA, 25 bp, Homo sapien
caggattctcatcccttacagctga

SEQ ID NO: 274948 - DNA, 25 bp, Homo sapien
ttacagctgactcttccaggcaatt

SEQ ID NO: 274949 - DNA, 25 bp, Homo sapien
gactcttccaggcaatttccataga

SEQ ID NO: 274950 - DNA, 25 bp, Homo sapien
aatttccatagatctgcagtcctgc

SEQ ID NO: 274951 - DNA, 25 bp, Homo sapien
aagagagttctcattttccctattc

SEQ ID NO: 274952 - DNA, 25 bp, Homo sapien
attcaaactaatacccatgccgtgt

SEQ ID NO: 274953 - DNA, 25 bp, Homo sapien
caaactaatacccatgccgtgtttt

SEQ ID NO: 274954 - DNA, 25 bp, Homo sapien
tctctgttcttgcacttgcctcagt

SEQ ID NO: 274955 - DNA, 25 bp, Homo sapien
cagtggcctctgcagcagagcctca

SEQ ID NO: 274956 - DNA, 25 bp, Homo sapien
ctcttcttgggatgcccctgttatt

SEQ ID NO: 274957 - DNA, 25 bp, Homo sapien
tggagggccggctccttggtcatta

SEQ ID NO: 274958 - DNA, 25 bp, Homo sapien
ggctccttggtcattattcacatgt

SEQ ID NO: 274959 - DNA, 25 bp, Homo sapien
tattcacatgtcatctctgtgccac

SEQ ID NO: 274960 - DNA, 25 bp, Homo sapien
gtgccacctcctagactgctgactt

SEQ ID NO: 274961 - DNA, 25 bp, Homo sapien
gaaaagcagtgtgccagggcctgcc

SEQ ID NO: 274962 - DNA, 25 bp, Homo sapien
gggcctgccctcacacttggagtga

SEQ ID NO: 274963 - DNA, 25 bp, Homo sapien
acacttggagtgacccaggaggtgc

SEQ ID NO: 274964 - DNA, 25 bp, Homo sapien
aggaggtgctgcgtgctgcctcact

SEQ ID NO: 274965 - DNA, 25 bp, Homo sapien
aggccatgtggtatttcggatcagc

SEQ ID NO: 274966 - DNA, 25 bp, Homo sapien
catgtggtatttcggatcagcccag

SEQ ID NO: 274967 - DNA, 25 bp, Homo sapien
ggtatttcggatcagcccagggttc

SEQ ID NO: 274968 - DNA, 25 bp, Homo sapien
tatttcggatcagcccagggttccc

SEQ ID NO: 274969 - DNA, 25 bp, Homo sapien
ccagggttcccagtttgtcgagtgg

SEQ ID NO: 274970 - DNA, 25 bp, Homo sapien
gagtggcgcggaccaaggccctgtg

SEQ ID NO: 274971 - DNA, 25 bp, Homo sapien
gggactgatgcctgagcgccaccta

SEQ ID NO: 274972 - DNA, 25 bp, Homo sapien
agcgccacctactgcattttggaca

SEQ ID NO: 274973 - DNA, 25 bp, Homo sapien
cacctactgcattttggacacctca

SEQ ID NO: 274974 - DNA, 25 bp, Homo sapien
tggacacctcacaccaaggggagat

SEQ ID NO: 274975 - DNA, 25 bp, Homo sapien
agacacctgggactttccccttctg

SEQ ID NO: 274976 - DNA, 25 bp, Homo sapien
tttgattggcagttttctccttcag

SEQ ID NO: 274977 - DNA, 25 bp, Homo sapien
gcagttttctccttcaggttttact

SEQ ID NO: 274978 - DNA, 25 bp, Homo sapien
tttctccttcaggttttactatatt

SEQ ID NO: 274979 - DNA, 25 bp, Homo sapien
tattggttgttgaaatcccttgaac

SEQ ID NO: 274980 - DNA, 25 bp, Homo sapien
aatcccttgaactaattgcttccct

SEQ ID NO: 274981 - DNA, 25 bp, Homo sapien
tgaactaattgcttcccttttccca

SEQ ID NO: 274982 - DNA, 25 bp, Homo sapien
taattgcttcccttttcccaggcaa

SEQ ID NO: 274983 - DNA, 25 bp, Homo sapien
atcctcacctttgttgtgtagtcaa

SEQ ID NO: 274984 - DNA, 25 bp, Homo sapien
ttgtgtagtcaaagatctgtaggaa

SEQ ID NO: 274985 - DNA, 25 bp, Homo sapien
aaaagactgttagagtatttagctt

SEQ ID NO: 274986 - DNA, 25 bp, Homo sapien
gggtgtaaaggtaagcatctttgat

SEQ ID NO: 274987 - DNA, 25 bp, Homo sapien
aataatattttgtctccttgcctaa

SEQ ID NO: 274988 - DNA, 25 bp, Homo sapien
acttccttgggcttgtgtcatcagc

SEQ ID NO: 274989 - DNA, 25 bp, Homo sapien
ttatttgtctatgcacatgtgtgcg

SEQ ID NO: 274990 - DNA, 25 bp, Homo sapien
tgtgtgctcgaatgcatgcgtgtat

SEQ ID NO: 274991 - DNA, 25 bp, Homo sapien
tatgtgtttagggtctcttcccagt

SEQ ID NO: 274992 - DNA, 25 bp, Homo sapien
agggtctcttcccagtgatccgtaa

SEQ ID NO: 274993 - DNA, 25 bp, Homo sapien
gtgatccgtaactcaccaaaaatca

SEQ ID NO: 274994 - DNA, 25 bp, Homo sapien
tttcccaaaattccctggagcagta

SEQ ID NO: 274995 - DNA, 25 bp, Homo sapien
cagcagttgtgaagtccccattggg

SEQ ID NO: 274996 - DNA, 25 bp, Homo sapien
gacttggtagcatggaaagccacac

SEQ ID NO: 274997 - DNA, 25 bp, Homo sapien
aagccacacaaagatgtgctgcatc

SEQ ID NO: 274998 - DNA, 25 bp, Homo sapien
gttaaagtcaacatccagcgtcttg

SEQ ID NO: 274999 - DNA, 25 bp, Homo sapien
cagcgtcttgttttgcctttcagat

SEQ ID NO: 275000 - DNA, 25 bp, Homo sapien
tgcctttcagatgctatgtggtcgt

SEQ ID NO: 275001 - DNA, 25 bp, Homo sapien
ctatgtggtcgtggcacgttttgtt

SEQ ID NO: 275002 - DNA, 25 bp, Homo sapien
gtttctgtagtcgtcttgtttggat

SEQ ID NO: 275003 - DNA, 25 bp, Homo sapien
agtcgtcttgtttggatcaactcct

SEQ ID NO: 275004 - DNA, 25 bp, Homo sapien
gatcaactcctagaggctggtttag

SEQ ID NO: 275005 - DNA, 25 bp, Homo sapien
gaggctggtttagaacaggcccatg

SEQ ID NO: 275006 - DNA, 25 bp, Homo sapien
aacaggcccatgagggagctgcacc

SEQ ID NO: 275007 - DNA, 25 bp, Homo sapien
gcacctgccctggaagtattgtttt

SEQ ID NO: 275008 - DNA, 25 bp, Homo sapien
tccatgtgaacatgacattgagtca

SEQ ID NO: 275009 - DNA, 25 bp, Homo sapien
aatgctgggattgcatgggattaca

SEQ ID NO: 275010 - DNA, 25 bp, Homo sapien
tactattttcctgttagcttttaca

SEQ ID NO: 275011 - DNA, 25 bp, Homo sapien
ttcctgttagcttttacaagatggc

SEQ ID NO: 275012 - DNA, 25 bp, Homo sapien
gcttacctcttacttcaccaagaaa

SEQ ID NO: 275013 - DNA, 25 bp, Homo sapien
gggcaatctggagggaactcccttt

SEQ ID NO: 275014 - DNA, 25 bp, Homo sapien
ctggagggaactccctttgctcctg

SEQ ID NO: 275015 - DNA, 25 bp, Homo sapien
tttgctcctgctaggcacccttatc

SEQ ID NO: 275016 - DNA, 25 bp, Homo sapien
cccttatcgctcctcaatatttaga

SEQ ID NO: 275017 - DNA, 25 bp, Homo sapien
gaaatgttacccataactatccttc

SEQ ID NO: 275018 - DNA, 25 bp, Homo sapien
ataactatccttcttttcctgtctc

SEQ ID NO: 275019 - DNA, 25 bp, Homo sapien
tccttcttttcctgtctcctgttaa

SEQ ID NO: 275020 - DNA, 25 bp, Homo sapien
gccaaattttgcttcgaggtccctg

SEQ ID NO: 275021 - DNA, 25 bp, Homo sapien
caaattttgcttcgaggtccctggg

SEQ ID NO: 275022 - DNA, 25 bp, Homo sapien
ggatggactgcagtggaccaggcat

SEQ ID NO: 275023 - DNA, 25 bp, Homo sapien
agtggaccaggcattctcatatcct

SEQ ID NO: 275024 - DNA, 25 bp, Homo sapien
accaggcattctcatatcctgcggg

SEQ ID NO: 275025 - DNA, 25 bp, Homo sapien
tgtcaaaaagttctggtcgttaaat

SEQ ID NO: 275026 - DNA, 25 bp, Homo sapien
gaactggctccagggcttcagggtc

SEQ ID NO: 275027 - DNA, 25 bp, Homo sapien
ggctccagggcttcagggtcactgt

SEQ ID NO: 275028 - DNA, 25 bp, Homo sapien
tcagggtcactgtttacattagaat

SEQ ID NO: 275029 - DNA, 25 bp, Homo sapien
ggtcactgtttacattagaatcccc

SEQ ID NO: 275030 - DNA, 25 bp, Homo sapien
ccctccagccaaattttgcttcgag

SEQ ID NO: 275031 - DNA, 25 bp, Homo sapien
acgggctgaccagcgccaagttcga

SEQ ID NO: 275032 - DNA, 25 bp, Homo sapien
tgaccagcgccaagttcgagggttt

SEQ ID NO: 275033 - DNA, 25 bp, Homo sapien
ccaagttcgagggtttgtgcttctt

SEQ ID NO: 275034 - DNA, 25 bp, Homo sapien
gagggtttgtgcttcttgagcagcc

SEQ ID NO: 275035 - DNA, 25 bp, Homo sapien
ttgtgcttcttgagcagccgcgtga

SEQ ID NO: 275036 - DNA, 25 bp, Homo sapien
ttgagcagccgcgtgatcttctcgt

SEQ ID NO: 275037 - DNA, 25 bp, Homo sapien
tgatcttctcgtcgtccgagttggg

SEQ ID NO: 275038 - DNA, 25 bp, Homo sapien
ggccggttgtattcgtcgtcgtcct

SEQ ID NO: 275039 - DNA, 25 bp, Homo sapien
accttcagcttctcggcgtccgagt

SEQ ID NO: 275040 - DNA, 25 bp, Homo sapien
gcgtccgagtcctgcttcttcttgg

SEQ ID NO: 275041 - DNA, 25 bp, Homo sapien
gagtcctgcttcttcttggccgacg

SEQ ID NO: 275042 - DNA, 25 bp, Homo sapien
ttacttttcatctttgggacctctc

SEQ ID NO: 275043 - DNA, 25 bp, Homo sapien
tttgggacctctcgagatcatcttc

SEQ ID NO: 275044 - DNA, 25 bp, Homo sapien
gagatcatcttctcctgaatgtcct

SEQ ID NO: 275045 - DNA, 25 bp, Homo sapien
ttttttctctcctacattcagtctg

SEQ ID NO: 275046 - DNA, 25 bp, Homo sapien
acattcagtctgtcgcgaacgcatt

SEQ ID NO: 275047 - DNA, 25 bp, Homo sapien
gtcgcgaacgcattgtggattgtca

SEQ ID NO: 275048 - DNA, 25 bp, Homo sapien
actcaagtcagtcttttggataagg

SEQ ID NO: 275049 - DNA, 25 bp, Homo sapien
tgctctcctgttaatagttgtttct

SEQ ID NO: 275050 - DNA, 25 bp, Homo sapien
tagttgtttcttcccagaggttaat

SEQ ID NO: 275051 - DNA, 25 bp, Homo sapien
tggactttgaacaccgtcttttttg

SEQ ID NO: 275052 - DNA, 25 bp, Homo sapien
gaacaccgtcttttttgactgtgac

SEQ ID NO: 275053 - DNA, 25 bp, Homo sapien
gagaagtgtaagtctgctctgggca

SEQ ID NO: 275054 - DNA, 25 bp, Homo sapien
tctgggcagtcttagaagccaccat

SEQ ID NO: 275055 - DNA, 25 bp, Homo sapien
gaagccaccattgatttctatttga

SEQ ID NO: 275056 - DNA, 25 bp, Homo sapien
ttctatttgagtttacccaggtgtc

SEQ ID NO: 275057 - DNA, 25 bp, Homo sapien
gtcattagtacacacagctcctaag

SEQ ID NO: 275058 - DNA, 25 bp, Homo sapien
cctaagacccctgtgatctctggaa

SEQ ID NO: 275059 - DNA, 25 bp, Homo sapien
gaatatggaattttcagtccccact

SEQ ID NO: 275060 - DNA, 25 bp, Homo sapien
aggtccgtggctgggtcttagaatt

SEQ ID NO: 275061 - DNA, 25 bp, Homo sapien
gagaggcttgagacttggctaatca

SEQ ID NO: 275062 - DNA, 25 bp, Homo sapien
acttggctaatcactaacggcggat

SEQ ID NO: 275063 - DNA, 25 bp, Homo sapien
ctactgctgatgctggaccaaggac

SEQ ID NO: 275064 - DNA, 25 bp, Homo sapien
gttctgaccagaggtccctcttcag

SEQ ID NO: 275065 - DNA, 25 bp, Homo sapien
agaggtccctcttcaggtcacacag

SEQ ID NO: 275066 - DNA, 25 bp, Homo sapien
ttcaggtcacacagcactcttagtg

SEQ ID NO: 275067 - DNA, 25 bp, Homo sapien
ccttttagcattctctaggcaaaag

SEQ ID NO: 275068 - DNA, 25 bp, Homo sapien
tctaggcaaaagagggcttagttct

SEQ ID NO: 275069 - DNA, 25 bp, Homo sapien
ttgcagctggcaaaaccaaggcagg

SEQ ID NO: 275070 - DNA, 25 bp, Homo sapien
caaggcaggcagtcactgacatgta

SEQ ID NO: 275071 - DNA, 25 bp, Homo sapien
atcatggtcagatctcagggtccca

SEQ ID NO: 275072 - DNA, 25 bp, Homo sapien
gtcccaggccaacagttctcctatt

SEQ ID NO: 275073 - DNA, 25 bp, Homo sapien
taccaactgggcataattattcagt

SEQ ID NO: 275074 - DNA, 25 bp, Homo sapien
attattcagttgctggtgacagaaa

SEQ ID NO: 275075 - DNA, 25 bp, Homo sapien
ggcaggaatgagagctggtgcggct

SEQ ID NO: 275076 - DNA, 25 bp, Homo sapien
accccttgaaccctgacatgggcgc

SEQ ID NO: 275077 - DNA, 25 bp, Homo sapien
acatgggcgcccaaggattctcccc

SEQ ID NO: 275078 - DNA, 25 bp, Homo sapien
aaggattctccccgcaggctcgcag

SEQ ID NO: 275079 - DNA, 25 bp, Homo sapien
cagactcacctgatcaccgggcaag

SEQ ID NO: 275080 - DNA, 25 bp, Homo sapien
gactcacctgatcaccgggcaagcg

SEQ ID NO: 275081 - DNA, 25 bp, Homo sapien
tgtggtaacctcagtgcccgtggct

SEQ ID NO: 275082 - DNA, 25 bp, Homo sapien
tggtaacctcagtgcccgtggctca

SEQ ID NO: 275083 - DNA, 25 bp, Homo sapien
gctcacgtcgtgtgccaggcagcag

SEQ ID NO: 275084 - DNA, 25 bp, Homo sapien
caggcagcagatggcggagggtgtc

SEQ ID NO: 275085 - DNA, 25 bp, Homo sapien
atggcggagggtgtcgggctcccct

SEQ ID NO: 275086 - DNA, 25 bp, Homo sapien
tgataatcattgatttttgcattta

SEQ ID NO: 275087 - DNA, 25 bp, Homo sapien
gcatttaacttttaccttatctcat

SEQ ID NO: 275088 - DNA, 25 bp, Homo sapien
tttaacttttaccttatctcatcag

SEQ ID NO: 275089 - DNA, 25 bp, Homo sapien
ccccataaaatattcattgtcggat

SEQ ID NO: 275090 - DNA, 25 bp, Homo sapien
gcataagctaaacatacgcagagaa

SEQ ID NO: 275091 - DNA, 25 bp, Homo sapien
aagctaaacatacgcagagaaaaac

SEQ ID NO: 275092 - DNA, 25 bp, Homo sapien
aatattcattgtcggatttatacac

SEQ ID NO: 275093 - DNA, 25 bp, Homo sapien
attcattgtcggatttatacacttt

SEQ ID NO: 275094 - DNA, 25 bp, Homo sapien
cattgtcggatttatacacttttga

SEQ ID NO: 275095 - DNA, 25 bp, Homo sapien
gtcggatttatacacttttgaactt

SEQ ID NO: 275096 - DNA, 25 bp, Homo sapien
ggatttatacacttttgaactttga

SEQ ID NO: 275097 - DNA, 25 bp, Homo sapien
ccgtggtgtaggtggcagtgctgat

SEQ ID NO: 275098 - DNA, 25 bp, Homo sapien
ggagggcccggcttgcctggctcac

SEQ ID NO: 275099 - DNA, 25 bp, Homo sapien
gttgcctaggttggtgaccacgtcg

SEQ ID NO: 275100 - DNA, 25 bp, Homo sapien
ctaggttggtgaccacgtcgtcaaa

SEQ ID NO: 275101 - DNA, 25 bp, Homo sapien
gttggtgaccacgtcgtcaaacttg

SEQ ID NO: 275102 - DNA, 25 bp, Homo sapien
ggtgaccacgtcgtcaaacttgagt

SEQ ID NO: 275103 - DNA, 25 bp, Homo sapien
gaccacgtcgtcaaacttgagtacc

SEQ ID NO: 275104 - DNA, 25 bp, Homo sapien
gtcgtcaaacttgagtacctcgtaa

SEQ ID NO: 275105 - DNA, 25 bp, Homo sapien
tcaaacttgagtacctcgtaaccct

SEQ ID NO: 275106 - DNA, 25 bp, Homo sapien
ttgagtacctcgtaaccctcgtggg

SEQ ID NO: 275107 - DNA, 25 bp, Homo sapien
ttgaggccggcgtagaaggccacgc

SEQ ID NO: 275108 - DNA, 25 bp, Homo sapien
taagagaggaaagcattaggcagat

SEQ ID NO: 275109 - DNA, 25 bp, Homo sapien
gcagatggaatgtacatgtgaggat

SEQ ID NO: 275110 - DNA, 25 bp, Homo sapien
ggagacagaaaacaagtagcccttt

SEQ ID NO: 275111 - DNA, 25 bp, Homo sapien
acaagtagccctttccatcaagata

SEQ ID NO: 275112 - DNA, 25 bp, Homo sapien
acaaaaacattttcctgcacctact

SEQ ID NO: 275113 - DNA, 25 bp, Homo sapien
tgctggctattgaatgtcactcctg

SEQ ID NO: 275114 - DNA, 25 bp, Homo sapien
gctattgaatgtcactcctgatttc

SEQ ID NO: 275115 - DNA, 25 bp, Homo sapien
acattttcctgcacctactacacag

SEQ ID NO: 275116 - DNA, 25 bp, Homo sapien
tactacacagcctgagtgcggcata

SEQ ID NO: 275117 - DNA, 25 bp, Homo sapien
gtgcggcataagttgaccttgcttg

SEQ ID NO: 275118 - DNA, 25 bp, Homo sapien
ttgaccttgcttgctaagaaatggg

SEQ ID NO: 275119 - DNA, 25 bp, Homo sapien
attggacacccctgtacatgctcat

SEQ ID NO: 275120 - DNA, 25 bp, Homo sapien
ggacacccctgtacatgctcatata

SEQ ID NO: 275121 - DNA, 25 bp, Homo sapien
acccctgtacatgctcatatacttt

SEQ ID NO: 275122 - DNA, 25 bp, Homo sapien
ccctgtacatgctcatatactttat

SEQ ID NO: 275123 - DNA, 25 bp, Homo sapien
gtacatgctcatatactttatcttt

SEQ ID NO: 275124 - DNA, 25 bp, Homo sapien
gctcatatactttatctttaatctt

SEQ ID NO: 275125 - DNA, 25 bp, Homo sapien
agcccttatctgtaagtgttcttgc

SEQ ID NO: 275126 - DNA, 25 bp, Homo sapien
cccttatctgtaagtgttcttgcat

SEQ ID NO: 275127 - DNA, 25 bp, Homo sapien
gcatttgctttaaaagatctttata

SEQ ID NO: 275128 - DNA, 25 bp, Homo sapien
atgtgtggcccaagataattcttaa

SEQ ID NO: 275129 - DNA, 25 bp, Homo sapien
taattcttaattcttccaatgtggc

SEQ ID NO: 275130 - DNA, 25 bp, Homo sapien
gaatatattgatatgcctctttcag

SEQ ID NO: 275131 - DNA, 25 bp, Homo sapien
tatgcctctttcagtcaactttaaa

SEQ ID NO: 275132 - DNA, 25 bp, Homo sapien
atgcctctttcagtcaactttaaat

SEQ ID NO: 275133 - DNA, 25 bp, Homo sapien
tgcctctttcagtcaactttaaatg

SEQ ID NO: 275134 - DNA, 25 bp, Homo sapien
gagaagtcgtcatttatataataaa

SEQ ID NO: 275135 - DNA, 25 bp, Homo sapien
atatatatgggtgtgtataaatgtc

SEQ ID NO: 275136 - DNA, 25 bp, Homo sapien
ataaatgtcatatctgtttagccat

SEQ ID NO: 275137 - DNA, 25 bp, Homo sapien
aaatgtcatatctgtttagccataa

SEQ ID NO: 275138 - DNA, 25 bp, Homo sapien
atgtcatatctgtttagccataata

SEQ ID NO: 275139 - DNA, 25 bp, Homo sapien
gtcatatctgtttagccataatatt

SEQ ID NO: 275140 - DNA, 25 bp, Homo sapien
taatattttaattaatggccgttat

SEQ ID NO: 275141 - DNA, 25 bp, Homo sapien
agcggccaggctcaaaatatcttaa

SEQ ID NO: 275142 - DNA, 25 bp, Homo sapien
tggaactcggagtcagtcatctgtt

SEQ ID NO: 275143 - DNA, 25 bp, Homo sapien
tcatctgttctcaacgtggtcatct

SEQ ID NO: 275144 - DNA, 25 bp, Homo sapien
gttctcaacgtggtcatctcaaaaa

SEQ ID NO: 275145 - DNA, 25 bp, Homo sapien
aaatatgagcacacggaagttttct

SEQ ID NO: 275146 - DNA, 25 bp, Homo sapien
cgaacaccagtgcagtagccaggat

SEQ ID NO: 275147 - DNA, 25 bp, Homo sapien
gcacacggaagttttcttccttctt

SEQ ID NO: 275148 - DNA, 25 bp, Homo sapien
tcttgtcagttttgagtccaatatc

SEQ ID NO: 275149 - DNA, 25 bp, Homo sapien
tccaatatcaatactgttgtcctgt

SEQ ID NO: 275150 - DNA, 25 bp, Homo sapien
actgttgtcctgtgaaagattttaa

SEQ ID NO: 275151 - DNA, 25 bp, Homo sapien
gtaatttcctgatgtcttgattgtt

SEQ ID NO: 275152 - DNA, 25 bp, Homo sapien
ccttgcaagggtgcctctgttctgt

SEQ ID NO: 275153 - DNA, 25 bp, Homo sapien
ttctctactcctccagtaagttggc

SEQ ID NO: 275154 - DNA, 25 bp, Homo sapien
tactcctccagtaagttggcagttt

SEQ ID NO: 275155 - DNA, 25 bp, Homo sapien
ttggcagttttggtgccaaacccca

SEQ ID NO: 275156 - DNA, 25 bp, Homo sapien
atctccaaagagacatgccaggcaa

SEQ ID NO: 275157 - DNA, 25 bp, Homo sapien
agacatgccaggcaagacaaacccc

SEQ ID NO: 275158 - DNA, 25 bp, Homo sapien
ctttccggtggccttggaaacagat

SEQ ID NO: 275159 - DNA, 25 bp, Homo sapien
tggaaacagattgctccgagctgga

SEQ ID NO: 275160 - DNA, 25 bp, Homo sapien
attgctccgagctggagaatgtcgg

SEQ ID NO: 275161 - DNA, 25 bp, Homo sapien
agagttagaacttgtgcctttggga

SEQ ID NO: 275162 - DNA, 25 bp, Homo sapien
tagaacttgtgcctttgggagtaag

SEQ ID NO: 275163 - DNA, 25 bp, Homo sapien
tgctgctgtccctcttctcgttggt

SEQ ID NO: 275164 - DNA, 25 bp, Homo sapien
tgtccctcttctcgttggtggccag

SEQ ID NO: 275165 - DNA, 25 bp, Homo sapien
cgcacctctacctggtggccagcaa

SEQ ID NO: 275166 - DNA, 25 bp, Homo sapien
ctggcccacttcttctgtggatggc

SEQ ID NO: 275167 - DNA, 25 bp, Homo sapien
acttcttctgtggatggccctcagg

SEQ ID NO: 275168 - DNA, 25 bp, Homo sapien
ttcttctgtggatggccctcagggt

SEQ ID NO: 275169 - DNA, 25 bp, Homo sapien
tcttctgtggatggccctcagggtc

SEQ ID NO: 275170 - DNA, 25 bp, Homo sapien
atggccctcagggtcctgggagacc

SEQ ID NO: 275171 - DNA, 25 bp, Homo sapien
aagagggcagcagcccagctgttta

SEQ ID NO: 275172 - DNA, 25 bp, Homo sapien
agcagcccagctgtttagggttgct

SEQ ID NO: 275173 - DNA, 25 bp, Homo sapien
ctgtttagggttgctggaggccggg

SEQ ID NO: 275174 - DNA, 25 bp, Homo sapien
gacacacaaaaccaaaagccggagt

SEQ ID NO: 275175 - DNA, 25 bp, Homo sapien
gaaaattctttctctgaccatgcca

SEQ ID NO: 275176 - DNA, 25 bp, Homo sapien
tgaccatgccagacgcggccggtca

SEQ ID NO: 275177 - DNA, 25 bp, Homo sapien
aggctcgcagctccgcgctaggatc

SEQ ID NO: 275178 - DNA, 25 bp, Homo sapien
ggatcgggcggctgtacaaccaaga

SEQ ID NO: 275179 - DNA, 25 bp, Homo sapien
ggcggctgtacaaccaagatcgact

SEQ ID NO: 275180 - DNA, 25 bp, Homo sapien
acaaccaagatcgactttgccctgt

SEQ ID NO: 275181 - DNA, 25 bp, Homo sapien
gggccctctgggagtgaagatcctt

SEQ ID NO: 275182 - DNA, 25 bp, Homo sapien
cctctgggagtgaagatcctttgga

SEQ ID NO: 275183 - DNA, 25 bp, Homo sapien
tgagacggcctctctagcgcgttga

SEQ ID NO: 275184 - DNA, 25 bp, Homo sapien
accggccacctgttgagaatccatg

SEQ ID NO: 275185 - DNA, 25 bp, Homo sapien
gcatcttagaatctatgatatatag

SEQ ID NO: 275186 - DNA, 25 bp, Homo sapien
cgggagattagcttgagccccagag

SEQ ID NO: 275187 - DNA, 25 bp, Homo sapien
gggagattagcttgagccccagagt

SEQ ID NO: 275188 - DNA, 25 bp, Homo sapien
ggagattagcttgagccccagagtt

SEQ ID NO: 275189 - DNA, 25 bp, Homo sapien
gagattagcttgagccccagagttt

SEQ ID NO: 275190 - DNA, 25 bp, Homo sapien
agattagcttgagccccagagtttg

SEQ ID NO: 275191 - DNA, 25 bp, Homo sapien
gattagcttgagccccagagtttga

SEQ ID NO: 275192 - DNA, 25 bp, Homo sapien
catcttagaatctatgatatatagt

SEQ ID NO: 275193 - DNA, 25 bp, Homo sapien
ttagcttgagccccagagtttgagg

SEQ ID NO: 275194 - DNA, 25 bp, Homo sapien
aatcatagctgagtgtagtgctgtg

SEQ ID NO: 275195 - DNA, 25 bp, Homo sapien
atcatagctgagtgtagtgctgtgc

SEQ ID NO: 275196 - DNA, 25 bp, Homo sapien
gtgcaaaggtgtggacgcatgaaat

SEQ ID NO: 275197 - DNA, 25 bp, Homo sapien
gaaatgccatgatgggttccgctga

SEQ ID NO: 275198 - DNA, 25 bp, Homo sapien
atgggttccgctgagcaacgtggca

SEQ ID NO: 275199 - DNA, 25 bp, Homo sapien
gagcaacgtggcattgccagagcat

SEQ ID NO: 275200 - DNA, 25 bp, Homo sapien
attgccagagcatgatgtggaagct

SEQ ID NO: 275201 - DNA, 25 bp, Homo sapien
cccttcataggtaggcagggctgaa

SEQ ID NO: 275202 - DNA, 25 bp, Homo sapien
tggaggagctagacttgtcatggaa

SEQ ID NO: 275203 - DNA, 25 bp, Homo sapien
ggtttggagccactggagcctttaa

SEQ ID NO: 275204 - DNA, 25 bp, Homo sapien
gccactggagcctttaaatcaggat

SEQ ID NO: 275205 - DNA, 25 bp, Homo sapien
gatagagtcatgatcagaattgcat

SEQ ID NO: 275206 - DNA, 25 bp, Homo sapien
aggaaaatccctttggtggctgaat

SEQ ID NO: 275207 - DNA, 25 bp, Homo sapien
tcttcattccacgagaattttgatt

SEQ ID NO: 275208 - DNA, 25 bp, Homo sapien
tttgatttttaacagcagtctctct

SEQ ID NO: 275209 - DNA, 25 bp, Homo sapien
tttttaacagcagtctctctttttc

SEQ ID NO: 275210 - DNA, 25 bp, Homo sapien
ctttttctcagcattgcaaatatat

SEQ ID NO: 275211 - DNA, 25 bp, Homo sapien
acattcatgaccaaagtatcgctta

SEQ ID NO: 275212 - DNA, 25 bp, Homo sapien
atgaccaaagtatcgcttactgacc

SEQ ID NO: 275213 - DNA, 25 bp, Homo sapien
aagtatcgcttactgaccatgcagc

SEQ ID NO: 275214 - DNA, 25 bp, Homo sapien
tcgcttactgaccatgcagctgtaa

SEQ ID NO: 275215 - DNA, 25 bp, Homo sapien
tactgaccatgcagctgtaaacctt

SEQ ID NO: 275216 - DNA, 25 bp, Homo sapien
tgcagctgtaaaccttctgtgccta

SEQ ID NO: 275217 - DNA, 25 bp, Homo sapien
aaacctaagagtgagtgaatggaga

SEQ ID NO: 275218 - DNA, 25 bp, Homo sapien
gatgccctgaaagtatgatcataca

SEQ ID NO: 275219 - DNA, 25 bp, Homo sapien
aatggtccttgggtccagctggcaa

SEQ ID NO: 275220 - DNA, 25 bp, Homo sapien
ggattctgccttccttgaagtgagc

SEQ ID NO: 275221 - DNA, 25 bp, Homo sapien
aagaaacaagtgctcatgctccctg

SEQ ID NO: 275222 - DNA, 25 bp, Homo sapien
atgctccctgacattattagctgcc

SEQ ID NO: 275223 - DNA, 25 bp, Homo sapien
attagctgccacgatgaagcctcag

SEQ ID NO: 275224 - DNA, 25 bp, Homo sapien
acgatgaagcctcagtcccaaacac

SEQ ID NO: 275225 - DNA, 25 bp, Homo sapien
gcttcctgtctaactcaagagctaa

SEQ ID NO: 275226 - DNA, 25 bp, Homo sapien
gtttagatcttaggccatgccatga

SEQ ID NO: 275227 - DNA, 25 bp, Homo sapien
atgccatgaattcccctggttgact

SEQ ID NO: 275228 - DNA, 25 bp, Homo sapien
cccctggttgactgcatttgtgaaa

SEQ ID NO: 275229 - DNA, 25 bp, Homo sapien
gtgactttacattaaggttggagac

SEQ ID NO: 275230 - DNA, 25 bp, Homo sapien
cattttgaattgcaccgactgggat

SEQ ID NO: 275231 - DNA, 25 bp, Homo sapien
gcaccgactgggatcctgtgaaggc

SEQ ID NO: 275232 - DNA, 25 bp, Homo sapien
gtgaaggccatgaccacactctgta

SEQ ID NO: 275233 - DNA, 25 bp, Homo sapien
atgaccacactctgtactcactgct

SEQ ID NO: 275234 - DNA, 25 bp, Homo sapien
gtactcactgctttataaaagtcat

SEQ ID NO: 275235 - DNA, 25 bp, Homo sapien
gtcatctcagtgactggtttctgta

SEQ ID NO: 275236 - DNA, 25 bp, Homo sapien
gatgctgaaagctggcccgaggtcc

SEQ ID NO: 275237 - DNA, 25 bp, Homo sapien
cgaggtccacaaccagcaagcggag

SEQ ID NO: 275238 - DNA, 25 bp, Homo sapien
cagcaagcggaggagataataacat

SEQ ID NO: 275239 - DNA, 25 bp, Homo sapien
ataacattgggacttttggcttctg

SEQ ID NO: 275240 - DNA, 25 bp, Homo sapien
atgatcttctttggccacggctatg

SEQ ID NO: 275241 - DNA, 25 bp, Homo sapien
agcacacggtgtggagcatggaaca

SEQ ID NO: 275242 - DNA, 25 bp, Homo sapien
atcttctttggccacggctatgctc

SEQ ID NO: 275243 - DNA, 25 bp, Homo sapien
tcaaccgctacatcagtgacacgtt

SEQ ID NO: 275244 - DNA, 25 bp, Homo sapien
aaccgctacatcagtgacacgttct

SEQ ID NO: 275245 - DNA, 25 bp, Homo sapien
gctacatcagtgacacgttctggaa

SEQ ID NO: 275246 - DNA, 25 bp, Homo sapien
tcagtgacacgttctggaaggcccg

SEQ ID NO: 275247 - DNA, 25 bp, Homo sapien
gggcctcgccaaggactgggtcttc

SEQ ID NO: 275248 - DNA, 25 bp, Homo sapien
ctcgccaaggactgggtcttcacca

SEQ ID NO: 275249 - DNA, 25 bp, Homo sapien
aggactgggtcttcaccaccctcaa

SEQ ID NO: 275250 - DNA, 25 bp, Homo sapien
tttggccacggctatgctcgcctca

SEQ ID NO: 275251 - DNA, 25 bp, Homo sapien
ttttctttttcatggacaaggttat

SEQ ID NO: 275252 - DNA, 25 bp, Homo sapien
gacaaggttatggtacttatctact

SEQ ID NO: 275253 - DNA, 25 bp, Homo sapien
ggttatggtacttatctactaaaag

SEQ ID NO: 275254 - DNA, 25 bp, Homo sapien
aaaacatctggttcaattacgctga

SEQ ID NO: 275255 - DNA, 25 bp, Homo sapien
attacgctgaactctgactacatgt

SEQ ID NO: 275256 - DNA, 25 bp, Homo sapien
gctgaactctgactacatgtgggcc

SEQ ID NO: 275257 - DNA, 25 bp, Homo sapien
ctctgactacatgtgggccagtaat

SEQ ID NO: 275258 - DNA, 25 bp, Homo sapien
acatgtgggccagtaataatatgaa

SEQ ID NO: 275259 - DNA, 25 bp, Homo sapien
tggacttaagaataaaccttgtgtt

SEQ ID NO: 275260 - DNA, 25 bp, Homo sapien
gaataaaccttgtgtttaatctctt

SEQ ID NO: 275261 - DNA, 25 bp, Homo sapien
taatgtgagttttctgttacgcaaa

SEQ ID NO: 275262 - DNA, 25 bp, Homo sapien
cagataccatttgctcaatggaatc

SEQ ID NO: 275263 - DNA, 25 bp, Homo sapien
tgctcaatggaatcagttccccctc

SEQ ID NO: 275264 - DNA, 25 bp, Homo sapien
acccatccccttctgtacatagccg

SEQ ID NO: 275265 - DNA, 25 bp, Homo sapien
cttctgtacatagccgccccttcct

SEQ ID NO: 275266 - DNA, 25 bp, Homo sapien
tttgctttgagtctgatatgacagt

SEQ ID NO: 275267 - DNA, 25 bp, Homo sapien
gctttgagtctgatatgacagtgat

SEQ ID NO: 275268 - DNA, 25 bp, Homo sapien
ttgagtctgatatgacagtgatgtg

SEQ ID NO: 275269 - DNA, 25 bp, Homo sapien
ggctgccccagctgacttggaggcc

SEQ ID NO: 275270 - DNA, 25 bp, Homo sapien
ctggctcaggagctcatagatggag

SEQ ID NO: 275271 - DNA, 25 bp, Homo sapien
agggcctctgccctgaacatctggg

SEQ ID NO: 275272 - DNA, 25 bp, Homo sapien
gcctctgccctgaacatctgggctt

SEQ ID NO: 275273 - DNA, 25 bp, Homo sapien
ggcacacagaagttgtcccatcaat

SEQ ID NO: 275274 - DNA, 25 bp, Homo sapien
aaggtatcccactgagctgcaaagt

SEQ ID NO: 275275 - DNA, 25 bp, Homo sapien
ggaaatggcatcgttctcgacagca

SEQ ID NO: 275276 - DNA, 25 bp, Homo sapien
gctgcaaagtagtgtcttccttcta

SEQ ID NO: 275277 - DNA, 25 bp, Homo sapien
aatcagaaccactcctttataacaa

SEQ ID NO: 275278 - DNA, 25 bp, Homo sapien
ttagaatggactgcggctgaggctc

SEQ ID NO: 275279 - DNA, 25 bp, Homo sapien
gaggctccacgactctagcagacga

SEQ ID NO: 275280 - DNA, 25 bp, Homo sapien
tagcagacgattccctttactttag

SEQ ID NO: 275281 - DNA, 25 bp, Homo sapien
gttctcgacagcactgggactgaat

SEQ ID NO: 275282 - DNA, 25 bp, Homo sapien
gggtttcgtctgtttcactaacact

SEQ ID NO: 275283 - DNA, 25 bp, Homo sapien
gtttcactaacacttgtccccaagt

SEQ ID NO: 275284 - DNA, 25 bp, Homo sapien
tgtttactggacagttggaaaacca

SEQ ID NO: 275285 - DNA, 25 bp, Homo sapien
cagataccatttgctcaatggaatc

SEQ ID NO: 275286 - DNA, 25 bp, Homo sapien
atttgctcaatggaatcagttcccc

SEQ ID NO: 275287 - DNA, 25 bp, Homo sapien
accctttagctccttttgctttgag

SEQ ID NO: 275288 - DNA, 25 bp, Homo sapien
tttgctttgagtctgatatgacagt

SEQ ID NO: 275289 - DNA, 25 bp, Homo sapien
gctttgagtctgatatgacagtgat

SEQ ID NO: 275290 - DNA, 25 bp, Homo sapien
ggctgccccagctgacttggaggcc

SEQ ID NO: 275291 - DNA, 25 bp, Homo sapien
aggccctggctcaggagctcataga

SEQ ID NO: 275292 - DNA, 25 bp, Homo sapien
aggtgtgggctgactacctcccaga

SEQ ID NO: 275293 - DNA, 25 bp, Homo sapien
agggcctctgccctgaacatctggg

SEQ ID NO: 275294 - DNA, 25 bp, Homo sapien
gcctctgccctgaacatctgggctt

SEQ ID NO: 275295 - DNA, 25 bp, Homo sapien
gtttgcaccacttccattggttata

SEQ ID NO: 275296 - DNA, 25 bp, Homo sapien
ataactgctcgagggcttggttggc

SEQ ID NO: 275297 - DNA, 25 bp, Homo sapien
ggttggcctttacttgagactgatt

SEQ ID NO: 275298 - DNA, 25 bp, Homo sapien
gagactgattttttcactgaggcca

SEQ ID NO: 275299 - DNA, 25 bp, Homo sapien
agacgcctcaaaacatcagccaaag

SEQ ID NO: 275300 - DNA, 25 bp, Homo sapien
aaagccgcctttagcacagtgattt

SEQ ID NO: 275301 - DNA, 25 bp, Homo sapien
agcacagtgatttcatcttcttgtt

SEQ ID NO: 275302 - DNA, 25 bp, Homo sapien
atcttcttgttgctgaactcgtgac

SEQ ID NO: 275303 - DNA, 25 bp, Homo sapien
ttttctgtaccacttttagcagcag

SEQ ID NO: 275304 - DNA, 25 bp, Homo sapien
aagagtttcttttcctgcaattgag

SEQ ID NO: 275305 - DNA, 25 bp, Homo sapien
gacagcactggtatgacttggtttt

SEQ ID NO: 275306 - DNA, 25 bp, Homo sapien
gagagtggtgatgacccaaatgttg

SEQ ID NO: 275307 - DNA, 25 bp, Homo sapien
agagtggtgatgacccaaatgttga

SEQ ID NO: 275308 - DNA, 25 bp, Homo sapien
gagtggtgatgacccaaatgttgaa

SEQ ID NO: 275309 - DNA, 25 bp, Homo sapien
agtggtgatgacccaaatgttgaac

SEQ ID NO: 275310 - DNA, 25 bp, Homo sapien
gtggtgatgacccaaatgttgaacc

SEQ ID NO: 275311 - DNA, 25 bp, Homo sapien
tggtgatgacccaaatgttgaacca

SEQ ID NO: 275312 - DNA, 25 bp, Homo sapien
ggtgatgacccaaatgttgaaccaa

SEQ ID NO: 275313 - DNA, 25 bp, Homo sapien
gtgatgacccaaatgttgaaccaat

SEQ ID NO: 275314 - DNA, 25 bp, Homo sapien
aatgcagatttcctttactcagttt

SEQ ID NO: 275315 - DNA, 25 bp, Homo sapien
tgagctgatctttcttagtttgcac

SEQ ID NO: 275316 - DNA, 25 bp, Homo sapien
tagtttgcactataataccctccac

SEQ ID NO: 275317 - DNA, 25 bp, Homo sapien
tataataccctccactgaagtctca

SEQ ID NO: 275318 - DNA, 25 bp, Homo sapien
gaagtctcactgcaactgcttttaa

SEQ ID NO: 275319 - DNA, 25 bp, Homo sapien
gtgaagagaaactagccctttgcta

SEQ ID NO: 275320 - DNA, 25 bp, Homo sapien
cacgggccagtgagtcatttagtca

SEQ ID NO: 275321 - DNA, 25 bp, Homo sapien
atgcttgtcacaaagagtagccttg

SEQ ID NO: 275322 - DNA, 25 bp, Homo sapien
gagtagccttgttgattacacttat

SEQ ID NO: 275323 - DNA, 25 bp, Homo sapien
aatcttcgggagacttcttcaatga

SEQ ID NO: 275324 - DNA, 25 bp, Homo sapien
cagtgttagagctttcagtttccat

SEQ ID NO: 275325 - DNA, 25 bp, Homo sapien
ggcaggccaggctttatgtgaatag

SEQ ID NO: 275326 - DNA, 25 bp, Homo sapien
gtgctgttgtgagccaagtacttga

SEQ ID NO: 275327 - DNA, 25 bp, Homo sapien
gtacttgagtacttcgaggtcccct

SEQ ID NO: 275328 - DNA, 25 bp, Homo sapien
aggtccccttctactgcagacatct

SEQ ID NO: 275329 - DNA, 25 bp, Homo sapien
ttccctatggttcctgtgacccagg

SEQ ID NO: 275330 - DNA, 25 bp, Homo sapien
gtgacccaggtttgtctcagagtgg

SEQ ID NO: 275331 - DNA, 25 bp, Homo sapien
ggttagcacacggtaccatctccat

SEQ ID NO: 275332 - DNA, 25 bp, Homo sapien
taccatctccatcccctttaaaagt

SEQ ID NO: 275333 - DNA, 25 bp, Homo sapien
ctccccaactagcttgcagggattt

SEQ ID NO: 275334 - DNA, 25 bp, Homo sapien
gcttgcagggatttctgatcaccta

SEQ ID NO: 275335 - DNA, 25 bp, Homo sapien
atttctgatcacctagtagagtcta

SEQ ID NO: 275336 - DNA, 25 bp, Homo sapien
atgtactatagttgcctctgttaga

SEQ ID NO: 275337 - DNA, 25 bp, Homo sapien
tttttctcccatgcaattccagatc

SEQ ID NO: 275338 - DNA, 25 bp, Homo sapien
tggcctgtctgcaagttccttcagg

SEQ ID NO: 275339 - DNA, 25 bp, Homo sapien
ttccagatctacaagcagacctgct

SEQ ID NO: 275340 - DNA, 25 bp, Homo sapien
gcagacctgcttattgagtttattg

SEQ ID NO: 275341 - DNA, 25 bp, Homo sapien
atatctcagggtccataaatctgtg

SEQ ID NO: 275342 - DNA, 25 bp, Homo sapien
aatctgtgagaaactcgtgggaagc

SEQ ID NO: 275343 - DNA, 25 bp, Homo sapien
gaagcagagcagcacataacagcaa

SEQ ID NO: 275344 - DNA, 25 bp, Homo sapien
agttccttcaggcatgctgccatca

SEQ ID NO: 275345 - DNA, 25 bp, Homo sapien
aacagcaagatgattttccccttcc

SEQ ID NO: 275346 - DNA, 25 bp, Homo sapien
tctcatttatcactgtatctcctgt

SEQ ID NO: 275347 - DNA, 25 bp, Homo sapien
gtggccccttcggttaagtgtctgg

SEQ ID NO: 275348 - DNA, 25 bp, Homo sapien
tggccccttcggttaagtgtctggg

SEQ ID NO: 275349 - DNA, 25 bp, Homo sapien
ggcacgtgctcgcaggtgatgaggt

SEQ ID NO: 275350 - DNA, 25 bp, Homo sapien
acgtgctcgcaggtgatgaggtggg

SEQ ID NO: 275351 - DNA, 25 bp, Homo sapien
gcagcgcctgggtgtcgtggaagat

SEQ ID NO: 275352 - DNA, 25 bp, Homo sapien
agcgcctgggtgtcgtggaagatga

SEQ ID NO: 275353 - DNA, 25 bp, Homo sapien
cgcctgggtgtcgtggaagatgacg

SEQ ID NO: 275354 - DNA, 25 bp, Homo sapien
accgccttctggagcccgcagaggg

SEQ ID NO: 275355 - DNA, 25 bp, Homo sapien
tgacgaagatgctgggctggcagat

SEQ ID NO: 275356 - DNA, 25 bp, Homo sapien
gggacagctcaggcggccacagttg

SEQ ID NO: 275357 - DNA, 25 bp, Homo sapien
gggagcatcagcctgtgcggagctg

SEQ ID NO: 275358 - DNA, 25 bp, Homo sapien
ttcagtggacaactaacctgggatg

SEQ ID NO: 275359 - DNA, 25 bp, Homo sapien
agtcccaccatgtattttgctttgt

SEQ ID NO: 275360 - DNA, 25 bp, Homo sapien
gaggaatcgtatgggttcttctgcc

SEQ ID NO: 275361 - DNA, 25 bp, Homo sapien
ttctgcccaccgttgtgactaagaa

SEQ ID NO: 275362 - DNA, 25 bp, Homo sapien
gcccaccgttgtgactaagaatgca

SEQ ID NO: 275363 - DNA, 25 bp, Homo sapien
aatgcacagggacttggttctcgtt

SEQ ID NO: 275364 - DNA, 25 bp, Homo sapien
gacttggttctcgttgcaccttttt

SEQ ID NO: 275365 - DNA, 25 bp, Homo sapien
gggacccactgtacagcccttcatt

SEQ ID NO: 275366 - DNA, 25 bp, Homo sapien
cagcccttcattctgctgtgtcagt

SEQ ID NO: 275367 - DNA, 25 bp, Homo sapien
gtcagtttggcctggcctgacactg

SEQ ID NO: 275368 - DNA, 25 bp, Homo sapien
gaccacggaagcagagtgagagcct

SEQ ID NO: 275369 - DNA, 25 bp, Homo sapien
tgaaagattatatggcttacccggg

SEQ ID NO: 275370 - DNA, 25 bp, Homo sapien
gggccacttagctaataaaggaaca

SEQ ID NO: 275371 - DNA, 25 bp, Homo sapien
gggccgctgtttgatccacagcctt

SEQ ID NO: 275372 - DNA, 25 bp, Homo sapien
cacagccttgttcctaaccactatg

SEQ ID NO: 275373 - DNA, 25 bp, Homo sapien
tgttcctaaccactatgccctgtgg

SEQ ID NO: 275374 - DNA, 25 bp, Homo sapien
gtggcctctcacaccaaaaggaagt

SEQ ID NO: 275375 - DNA, 25 bp, Homo sapien
gaagtaccaaactgcttccttactc

SEQ ID NO: 275376 - DNA, 25 bp, Homo sapien
ctgcttccttactcaaataaatgtg

SEQ ID NO: 275377 - DNA, 25 bp, Homo sapien
ctgaaatgcagttgcagttttctcc

SEQ ID NO: 275378 - DNA, 25 bp, Homo sapien
atacttggtgtgagccaggcacttt

SEQ ID NO: 275379 - DNA, 25 bp, Homo sapien
attgtactaatcttaatcccattgt

SEQ ID NO: 275380 - DNA, 25 bp, Homo sapien
ctctgtcttctcaactacatgaaac

SEQ ID NO: 275381 - DNA, 25 bp, Homo sapien
aaaccaccatgctttgtttgggatc

SEQ ID NO: 275382 - DNA, 25 bp, Homo sapien
accatgctttgtttgggatccccta

SEQ ID NO: 275383 - DNA, 25 bp, Homo sapien
taccctgctctgaggtctgtgcctg

SEQ ID NO: 275384 - DNA, 25 bp, Homo sapien
ggtctgtgcctgcaggtagaaatct

SEQ ID NO: 275385 - DNA, 25 bp, Homo sapien
ggtcatagtcttaaggtgcatgtca

SEQ ID NO: 275386 - DNA, 25 bp, Homo sapien
gcatgtcaatatctgcagttgtttc

SEQ ID NO: 275387 - DNA, 25 bp, Homo sapien
ttctgtttcttcacagtaagaagct

SEQ ID NO: 275388 - DNA, 25 bp, Homo sapien
gtaagaagctaaatctttcccctgt

SEQ ID NO: 275389 - DNA, 25 bp, Homo sapien
aatctttcccctgttactctcaaag

SEQ ID NO: 275390 - DNA, 25 bp, Homo sapien
cctgttactctcaaagccagaagta

SEQ ID NO: 275391 - DNA, 25 bp, Homo sapien
aggcaagtaatactttcattatgtg

SEQ ID NO: 275392 - DNA, 25 bp, Homo sapien
ggcaagtaatactttcattatgtgt

SEQ ID NO: 275393 - DNA, 25 bp, Homo sapien
gcaagtaatactttcattatgtgtc

SEQ ID NO: 275394 - DNA, 25 bp, Homo sapien
caagtaatactttcattatgtgtct

SEQ ID NO: 275395 - DNA, 25 bp, Homo sapien
aagtaatactttcattatgtgtctg

SEQ ID NO: 275396 - DNA, 25 bp, Homo sapien
agtaatactttcattatgtgtctgt

SEQ ID NO: 275397 - DNA, 25 bp, Homo sapien
gtaatactttcattatgtgtctgtt

SEQ ID NO: 275398 - DNA, 25 bp, Homo sapien
taatactttcattatgtgtctgttt

SEQ ID NO: 275399 - DNA, 25 bp, Homo sapien
aatactttcattatgtgtctgtttt

SEQ ID NO: 275400 - DNA, 25 bp, Homo sapien
atactttcattatgtgtctgttttt

SEQ ID NO: 275401 - DNA, 25 bp, Homo sapien
gtttgagtgagtgttcttaattcct

SEQ ID NO: 275402 - DNA, 25 bp, Homo sapien
ttgagtgagtgttcttaattccttt

SEQ ID NO: 275403 - DNA, 25 bp, Homo sapien
ttttcttgttcatagcttaaggtgc

SEQ ID NO: 275404 - DNA, 25 bp, Homo sapien
tcttgttcatagcttaaggtgctta

SEQ ID NO: 275405 - DNA, 25 bp, Homo sapien
gttcatagcttaaggtgcttatttt

SEQ ID NO: 275406 - DNA, 25 bp, Homo sapien
agacatagtatggtacatgcaaacg

SEQ ID NO: 275407 - DNA, 25 bp, Homo sapien
tagtatggtacatgcaaacggtgtc

SEQ ID NO: 275408 - DNA, 25 bp, Homo sapien
tttcctgcttttttctagcactaga

SEQ ID NO: 275409 - DNA, 25 bp, Homo sapien
tcctgcttttttctagcactagatt

SEQ ID NO: 275410 - DNA, 25 bp, Homo sapien
ttctagcactagatttatagttgag

SEQ ID NO: 275411 - DNA, 25 bp, Homo sapien
ctttcttgagtagaagggcagaata

SEQ ID NO: 275412 - DNA, 25 bp, Homo sapien
ggctgaagtagtctcattacggaaa

SEQ ID NO: 275413 - DNA, 25 bp, Homo sapien
gcttgttgaaactgaatttgtgatt

SEQ ID NO: 275414 - DNA, 25 bp, Homo sapien
gagagtgtgagcagccttttagtaa

SEQ ID NO: 275415 - DNA, 25 bp, Homo sapien
agccttttagtaattgattgcctca

SEQ ID NO: 275416 - DNA, 25 bp, Homo sapien
ttgcctcaagatgtggtattcagcc

SEQ ID NO: 275417 - DNA, 25 bp, Homo sapien
gaggtttacagaagcctttacccat

SEQ ID NO: 275418 - DNA, 25 bp, Homo sapien
acagaagcctttacccatcctgaga

SEQ ID NO: 275419 - DNA, 25 bp, Homo sapien
atcctgagactcagttctgctgttg

SEQ ID NO: 275420 - DNA, 25 bp, Homo sapien
cagttctgctgttggtcttcagaga

SEQ ID NO: 275421 - DNA, 25 bp, Homo sapien
ttcagagaagtgtctgcacctgctg

SEQ ID NO: 275422 - DNA, 25 bp, Homo sapien
caagaagtcattgagggctgttgta

SEQ ID NO: 275423 - DNA, 25 bp, Homo sapien
gggtccttgcctacagtcagcttta

SEQ ID NO: 275424 - DNA, 25 bp, Homo sapien
tttgttctgtgtggaacaaaggcaa

SEQ ID NO: 275425 - DNA, 25 bp, Homo sapien
ttgttctgtgtggaacaaaggcaaa

SEQ ID NO: 275426 - DNA, 25 bp, Homo sapien
tgttctgtgtggaacaaaggcaaag

SEQ ID NO: 275427 - DNA, 25 bp, Homo sapien
gttctgtgtggaacaaaggcaaagg

SEQ ID NO: 275428 - DNA, 25 bp, Homo sapien
ttctgtgtggaacaaaggcaaaggc

SEQ ID NO: 275429 - DNA, 25 bp, Homo sapien
tctgtgtggaacaaaggcaaaggca

SEQ ID NO: 275430 - DNA, 25 bp, Homo sapien
ctgtgtggaacaaaggcaaaggcag

SEQ ID NO: 275431 - DNA, 25 bp, Homo sapien
cagggagttcaccatacccttgaac

SEQ ID NO: 275432 - DNA, 25 bp, Homo sapien
aacaggccgggaaggaagcagacaa

SEQ ID NO: 275433 - DNA, 25 bp, Homo sapien
gacaaagcggtccaagggttccaca

SEQ ID NO: 275434 - DNA, 25 bp, Homo sapien
caaagcggtccaagggttccacact

SEQ ID NO: 275435 - DNA, 25 bp, Homo sapien
gggtcaaccatgctgctgaccaggc

SEQ ID NO: 275436 - DNA, 25 bp, Homo sapien
accatgctgctgaccaggctggaaa

SEQ ID NO: 275437 - DNA, 25 bp, Homo sapien
tgctgctgaccaggctggaaaggaa

SEQ ID NO: 275438 - DNA, 25 bp, Homo sapien
aaaggaagtggagaagcttggccaa

SEQ ID NO: 275439 - DNA, 25 bp, Homo sapien
agaagcttggccaaggtgcccacca

SEQ ID NO: 275440 - DNA, 25 bp, Homo sapien
aaggagctgcagaatgctcataatg

SEQ ID NO: 275441 - DNA, 25 bp, Homo sapien
ataatggggtcaaccaagccagcaa

SEQ ID NO: 275442 - DNA, 25 bp, Homo sapien
tccatttcttcctttgattctgtca

SEQ ID NO: 275443 - DNA, 25 bp, Homo sapien
tcttcctttgattctgtcaatgttt

SEQ ID NO: 275444 - DNA, 25 bp, Homo sapien
tttgattctgtcaatgtttgtttca

SEQ ID NO: 275445 - DNA, 25 bp, Homo sapien
tgggctctgatgtttggtgcatata

SEQ ID NO: 275446 - DNA, 25 bp, Homo sapien
atatattacatcttggtgaattttc

SEQ ID NO: 275447 - DNA, 25 bp, Homo sapien
aaattataggatgtctgggatttcc

SEQ ID NO: 275448 - DNA, 25 bp, Homo sapien
ggatgtctgggatttcctttgaatc

SEQ ID NO: 275449 - DNA, 25 bp, Homo sapien
ctgggatttcctttgaatccgtggg

SEQ ID NO: 275450 - DNA, 25 bp, Homo sapien
gggctgggagtaactataaatgaaa

SEQ ID NO: 275451 - DNA, 25 bp, Homo sapien
aggctgcaaggataggtacacacag

SEQ ID NO: 275452 - DNA, 25 bp, Homo sapien
gtaaagattgttggcttttccagcc

SEQ ID NO: 275453 - DNA, 25 bp, Homo sapien
tccttcctgaccttaggtctgggca

SEQ ID NO: 275454 - DNA, 25 bp, Homo sapien
ttcctgaccttaggtctgggcacag

SEQ ID NO: 275455 - DNA, 25 bp, Homo sapien
tcctgaccttaggtctgggcacagg

SEQ ID NO: 275456 - DNA, 25 bp, Homo sapien
cctgaccttaggtctgggcacagga

SEQ ID NO: 275457 - DNA, 25 bp, Homo sapien
gaccttaggtctgggcacaggagga

SEQ ID NO: 275458 - DNA, 25 bp, Homo sapien
ctcacacttagcctcttccttggtt

SEQ ID NO: 275459 - DNA, 25 bp, Homo sapien
acacttagcctcttccttggttggg

SEQ ID NO: 275460 - DNA, 25 bp, Homo sapien
attctcctcccgaagcatccctggg

SEQ ID NO: 275461 - DNA, 25 bp, Homo sapien
gggacactttgaggcctcattcctg

SEQ ID NO: 275462 - DNA, 25 bp, Homo sapien
gacactttgaggcctcattcctgcc

SEQ ID NO: 275463 - DNA, 25 bp, Homo sapien
tccccttcctttcacatggaggaaa

SEQ ID NO: 275464 - DNA, 25 bp, Homo sapien
ccccacagtgtaattggtgctgaaa

SEQ ID NO: 275465 - DNA, 25 bp, Homo sapien
gaaaatagtttcgtgcctgaggtct

SEQ ID NO: 275466 - DNA, 25 bp, Homo sapien
gtgcctgaggtctgttgtcactcac

SEQ ID NO: 275467 - DNA, 25 bp, Homo sapien
actcactcactttctgacaattagg

SEQ ID NO: 275468 - DNA, 25 bp, Homo sapien
ctttctgacaattaggtgagccact

SEQ ID NO: 275469 - DNA, 25 bp, Homo sapien
aggtgagccacttgaggattttctg

SEQ ID NO: 275470 - DNA, 25 bp, Homo sapien
ggattttctggcctgaagttataaa

SEQ ID NO: 275471 - DNA, 25 bp, Homo sapien
gttataaaaacttggcatctgtcct

SEQ ID NO: 275472 - DNA, 25 bp, Homo sapien
gcatctgtcctaaggtaattgtaaa

SEQ ID NO: 275473 - DNA, 25 bp, Homo sapien
aggttatatggcatttatctggtaa

SEQ ID NO: 275474 - DNA, 25 bp, Homo sapien
aggttgattcataattcttggtata

SEQ ID NO: 275475 - DNA, 25 bp, Homo sapien
gatgaaaacacttggcaggaattac

SEQ ID NO: 275476 - DNA, 25 bp, Homo sapien
tggcaggaattacaaggcaatgaag

SEQ ID NO: 275477 - DNA, 25 bp, Homo sapien
gaagaattcttaaggttatcttaga

SEQ ID NO: 275478 - DNA, 25 bp, Homo sapien
aatgtgagctatatcctttactggt

SEQ ID NO: 275479 - DNA, 25 bp, Homo sapien
gagctatatcctttactggtaagaa

SEQ ID NO: 275480 - DNA, 25 bp, Homo sapien
ggaatattagaatttaggtactgtt

SEQ ID NO: 275481 - DNA, 25 bp, Homo sapien
atgttattaacgatgattgacctta

SEQ ID NO: 275482 - DNA, 25 bp, Homo sapien
gattgaccttaaatagggactctat

SEQ ID NO: 275483 - DNA, 25 bp, Homo sapien
agggactctattgctaaccattctg

SEQ ID NO: 275484 - DNA, 25 bp, Homo sapien
ggactctattgctaaccattctgtg

SEQ ID NO: 275485 - DNA, 25 bp, Homo sapien
actctattgctaaccattctgtgcc

SEQ ID NO: 275486 - DNA, 25 bp, Homo sapien
ggcacattccagagagtggtgatga

SEQ ID NO: 275487 - DNA, 25 bp, Homo sapien
gagtggtgatgacccaaatgttgaa

SEQ ID NO: 275488 - DNA, 25 bp, Homo sapien
gtgatgacccaaatgttgaaccaat

SEQ ID NO: 275489 - DNA, 25 bp, Homo sapien
gttgaaccaattatgttcgggcggg

SEQ ID NO: 275490 - DNA, 25 bp, Homo sapien
caattatgttcgggcggggtcttag

SEQ ID NO: 275491 - DNA, 25 bp, Homo sapien
cggggtcttagctgtgaatcctgaa

SEQ ID NO: 275492 - DNA, 25 bp, Homo sapien
gggtcttagctgtgaatcctgaatg

SEQ ID NO: 275493 - DNA, 25 bp, Homo sapien
gtcttagctgtgaatcctgaatggt

SEQ ID NO: 275494 - DNA, 25 bp, Homo sapien
cttagctgtgaatcctgaatggttc

SEQ ID NO: 275495 - DNA, 25 bp, Homo sapien
agctgtgaatcctgaatggttcata

SEQ ID NO: 275496 - DNA, 25 bp, Homo sapien
gtgaatcctgaatggttcataaagt

SEQ ID NO: 275497 - DNA, 25 bp, Homo sapien
ttggtccctccaagatgaccatcct

SEQ ID NO: 275498 - DNA, 25 bp, Homo sapien
aagatgaccatcctgagtttctagc

SEQ ID NO: 275499 - DNA, 25 bp, Homo sapien
atgaccatcctgagtttctagctct

SEQ ID NO: 275500 - DNA, 25 bp, Homo sapien
agtttctagctcttgtttcatgaga

SEQ ID NO: 275501 - DNA, 25 bp, Homo sapien
ctagctcttgtttcatgagagagca

SEQ ID NO: 275502 - DNA, 25 bp, Homo sapien
tggccggtctcactcctggactggc

SEQ ID NO: 275503 - DNA, 25 bp, Homo sapien
gacaagcagaaagtccttcaggttc

SEQ ID NO: 275504 - DNA, 25 bp, Homo sapien
cttcaggttctctttgaaactttca

SEQ ID NO: 275505 - DNA, 25 bp, Homo sapien
caaaggtgataatctgggttgcaca

SEQ ID NO: 275506 - DNA, 25 bp, Homo sapien
tctgggttgcacaggaagtttccgg

SEQ ID NO: 275507 - DNA, 25 bp, Homo sapien
agtgctgcttgtagtggctggccat

SEQ ID NO: 275508 - DNA, 25 bp, Homo sapien
gctgtccaagctgaaagggcagcta

SEQ ID NO: 275509 - DNA, 25 bp, Homo sapien
aaatccagggtgcaattcctcagct

SEQ ID NO: 275510 - DNA, 25 bp, Homo sapien
gcaattcctcagcttggtcaagaag

SEQ ID NO: 275511 - DNA, 25 bp, Homo sapien
gaagtatctgcaggcaagtgggctc

SEQ ID NO: 275512 - DNA, 25 bp, Homo sapien
gccccgtgaggcagtagcttcagac

SEQ ID NO: 275513 - DNA, 25 bp, Homo sapien
aggcagtagcttcagacgggcctcc

SEQ ID NO: 275514 - DNA, 25 bp, Homo sapien
gcctcccactgttggatgctgtaaa

SEQ ID NO: 275515 - DNA, 25 bp, Homo sapien
gatgctgtaaatctgtccgtgtgaa

SEQ ID NO: 275516 - DNA, 25 bp, Homo sapien
tgatttgagggtccaatgccaggaa

SEQ ID NO: 275517 - DNA, 25 bp, Homo sapien
ggcagagtgaccaagcgcccgtgtc

SEQ ID NO: 275518 - DNA, 25 bp, Homo sapien
cggcaggtcatgtacgcggaacgct

SEQ ID NO: 275519 - DNA, 25 bp, Homo sapien
tggtgattggatttgtagaaactgt

SEQ ID NO: 275520 - DNA, 25 bp, Homo sapien
tctactggtcaaaccgcatcataag

SEQ ID NO: 275521 - DNA, 25 bp, Homo sapien
ctgtggttaaatagttgacggatta

SEQ ID NO: 275522 - DNA, 25 bp, Homo sapien
tgtcccttccatggtagttccataa

SEQ ID NO: 275523 - DNA, 25 bp, Homo sapien
atgttttctgcctggagcaactagt

SEQ ID NO: 275524 - DNA, 25 bp, Homo sapien
gcctggagcaactagtcttgaccgt

SEQ ID NO: 275525 - DNA, 25 bp, Homo sapien
gtcttgaccgtatctgctatgcata

SEQ ID NO: 275526 - DNA, 25 bp, Homo sapien
aaccgcatcataaggctaaattcaa

SEQ ID NO: 275527 - DNA, 25 bp, Homo sapien
ctgctatgcatagcacagtacctgg

SEQ ID NO: 275528 - DNA, 25 bp, Homo sapien
cctggtacacaaaaagatttcagta

SEQ ID NO: 275529 - DNA, 25 bp, Homo sapien
gggaactagggatgctatttttgat

SEQ ID NO: 275530 - DNA, 25 bp, Homo sapien
gaagtaattagtacagctgcagatc

SEQ ID NO: 275531 - DNA, 25 bp, Homo sapien
attagtacagctgcagatctctctg

SEQ ID NO: 275532 - DNA, 25 bp, Homo sapien
gtacagctgcagatctctctgtgta

SEQ ID NO: 275533 - DNA, 25 bp, Homo sapien
gctgcagatctctctgtgtatatct

SEQ ID NO: 275534 - DNA, 25 bp, Homo sapien
agatctctctgtgtatatctatcta

SEQ ID NO: 275535 - DNA, 25 bp, Homo sapien
gctttatggtttcttttggaagaga

SEQ ID NO: 275536 - DNA, 25 bp, Homo sapien
aatcatgaatggaatctaaacagaa

SEQ ID NO: 275537 - DNA, 25 bp, Homo sapien
aaatgtcagatgaacgtatttcctg

SEQ ID NO: 275538 - DNA, 25 bp, Homo sapien
cagatgaacgtatttcctgttttca

SEQ ID NO: 275539 - DNA, 25 bp, Homo sapien
tttcctgttttcatagactattcaa

SEQ ID NO: 275540 - DNA, 25 bp, Homo sapien
tgttttgaccatgaagttgtattat

SEQ ID NO: 275541 - DNA, 25 bp, Homo sapien
taaataagtgcatcttttttgagac

SEQ ID NO: 275542 - DNA, 25 bp, Homo sapien
atgcagtaggcaaatgttgacattc

SEQ ID NO: 275543 - DNA, 25 bp, Homo sapien
atgttgacattcaccagggcacagt

SEQ ID NO: 275544 - DNA, 25 bp, Homo sapien
gggcacagtcaatccctgacaattt

SEQ ID NO: 275545 - DNA, 25 bp, Homo sapien
gtcaatccctgacaatttcagaagt

SEQ ID NO: 275546 - DNA, 25 bp, Homo sapien
cagaagttttgttgccaatactgat

SEQ ID NO: 275547 - DNA, 25 bp, Homo sapien
gttgccaatactgatttatgtgggc

SEQ ID NO: 275548 - DNA, 25 bp, Homo sapien
agattctgtagtctgctgctccttc

SEQ ID NO: 275549 - DNA, 25 bp, Homo sapien
tgctccttctctcatggattacctt

SEQ ID NO: 275550 - DNA, 25 bp, Homo sapien
tggattaccttcttgttcctacagt

SEQ ID NO: 275551 - DNA, 25 bp, Homo sapien
tcttgttcctacagttgcacctatt

SEQ ID NO: 275552 - DNA, 25 bp, Homo sapien
gggatgatctccatgcgctgctggc

SEQ ID NO: 275553 - DNA, 25 bp, Homo sapien
tgcgctgctggccatacaggtaata

SEQ ID NO: 275554 - DNA, 25 bp, Homo sapien
gctgctggccatacaggtaatagtc

SEQ ID NO: 275555 - DNA, 25 bp, Homo sapien
tacaggtaatagtccagctcctctg

SEQ ID NO: 275556 - DNA, 25 bp, Homo sapien
agctcctctgcgctgcagcggaagc

SEQ ID NO: 275557 - DNA, 25 bp, Homo sapien
aggtggcgccgaggcacagttcctt

SEQ ID NO: 275558 - DNA, 25 bp, Homo sapien
ctagaggcgcgaacaccggcagctg

SEQ ID NO: 275559 - DNA, 25 bp, Homo sapien
tgcgacaccggcagggccgagagac

SEQ ID NO: 275560 - DNA, 25 bp, Homo sapien
agagaccagccagcgcgggtgtctc

SEQ ID NO: 275561 - DNA, 25 bp, Homo sapien
ggtgtctcggtgagcgtgcgggtgc

SEQ ID NO: 275562 - DNA, 25 bp, Homo sapien
gtgcgcgagagtgtgcgccctgcgt

SEQ ID NO: 275563 - DNA, 25 bp, Homo sapien
taccaaaccaccataacagacagtc

SEQ ID NO: 275564 - DNA, 25 bp, Homo sapien
acagacagtctgctagaagagaact

SEQ ID NO: 275565 - DNA, 25 bp, Homo sapien
gactacccatgggataaatccagct

SEQ ID NO: 275566 - DNA, 25 bp, Homo sapien
gagaactgatcaggccattatgtca

SEQ ID NO: 275567 - DNA, 25 bp, Homo sapien
atcaggccattatgtcaccggacaa

SEQ ID NO: 275568 - DNA, 25 bp, Homo sapien
tcaccggacaacaggacaatcatct

SEQ ID NO: 275569 - DNA, 25 bp, Homo sapien
acaggacaatcatctgagttgggat

SEQ ID NO: 275570 - DNA, 25 bp, Homo sapien
atctgagttgggatgctgaatcacg

SEQ ID NO: 275571 - DNA, 25 bp, Homo sapien
gatgctgaatcacggcaactccaag

SEQ ID NO: 275572 - DNA, 25 bp, Homo sapien
ggcaactccaagacatctgggattt

SEQ ID NO: 275573 - DNA, 25 bp, Homo sapien
ttttaccctcacattggatacaatc

SEQ ID NO: 275574 - DNA, 25 bp, Homo sapien
aagtgtttcaatatgtttcacagta

SEQ ID NO: 275575 - DNA, 25 bp, Homo sapien
cttttcacgacatcctaaaatgaga

SEQ ID NO: 275576 - DNA, 25 bp, Homo sapien
aatacaggccagattatacaatact

SEQ ID NO: 275577 - DNA, 25 bp, Homo sapien
tatacaatacttctgtgcacaccag

SEQ ID NO: 275578 - DNA, 25 bp, Homo sapien
aagatcagcgagaaaggctttggaa

SEQ ID NO: 275579 - DNA, 25 bp, Homo sapien
tttcccccgcatttagtaaatcaca

SEQ ID NO: 275580 - DNA, 25 bp, Homo sapien
ctacctgactggcatccaattatca

SEQ ID NO: 275581 - DNA, 25 bp, Homo sapien
gactggcatccaattatcagagata

SEQ ID NO: 275582 - DNA, 25 bp, Homo sapien
cagagatattcagtgtttaagctac

SEQ ID NO: 275583 - DNA, 25 bp, Homo sapien
catgaatttctgtacacacacctaa

SEQ ID NO: 275584 - DNA, 25 bp, Homo sapien
tctgtacacacacctaaacataaag

SEQ ID NO: 275585 - DNA, 25 bp, Homo sapien
gtaacttttgaaactagctcagatg

SEQ ID NO: 275586 - DNA, 25 bp, Homo sapien
gaaactagctcagatgctgaccgag

SEQ ID NO: 275587 - DNA, 25 bp, Homo sapien
cagatgctgaccgagcccgggagaa

SEQ ID NO: 275588 - DNA, 25 bp, Homo sapien
agaagctgaatgggacgatcgtaga

SEQ ID NO: 275589 - DNA, 25 bp, Homo sapien
aaaattgaggtcaataatgccacgg

SEQ ID NO: 275590 - DNA, 25 bp, Homo sapien
gaacccctacaccaacggctggaag

SEQ ID NO: 275591 - DNA, 25 bp, Homo sapien
tacaccaacggctggaagctaaatc

SEQ ID NO: 275592 - DNA, 25 bp, Homo sapien
taaatccagtggtcggcgcagtcta

SEQ ID NO: 275593 - DNA, 25 bp, Homo sapien
gtcggcgcagtctacgggcctgaat

SEQ ID NO: 275594 - DNA, 25 bp, Homo sapien
agtctacgggcctgaattctatgca

SEQ ID NO: 275595 - DNA, 25 bp, Homo sapien
gggcctgaattctatgcagtgacgg

SEQ ID NO: 275596 - DNA, 25 bp, Homo sapien
acatggaggacttctccaatgacct

SEQ ID NO: 275597 - DNA, 25 bp, Homo sapien
tgttcagcagcttctttgatgaccc

SEQ ID NO: 275598 - DNA, 25 bp, Homo sapien
atgaccctgtgctggatgagaagag

SEQ ID NO: 275599 - DNA, 25 bp, Homo sapien
agaagagccctctattggacatgga

SEQ ID NO: 275600 - DNA, 25 bp, Homo sapien
agccctctattggacatggaactgg

SEQ ID NO: 275601 - DNA, 25 bp, Homo sapien
atggaactggactcccctacgccag

SEQ ID NO: 275602 - DNA, 25 bp, Homo sapien
catcaagatggaggacaccacccaa

SEQ ID NO: 275603 - DNA, 25 bp, Homo sapien
gacaccacccaagatgcagagcatg

SEQ ID NO: 275604 - DNA, 25 bp, Homo sapien
agcatgggcgctgggacacaaactg

SEQ ID NO: 275605 - DNA, 25 bp, Homo sapien
gacacaaactgtgctccatcatggt

SEQ ID NO: 275606 - DNA, 25 bp, Homo sapien
aactgtgctccatcatggtgaagca

SEQ ID NO: 275607 - DNA, 25 bp, Homo sapien
ggcagcccaagaacccgggtccttg

SEQ ID NO: 275608 - DNA, 25 bp, Homo sapien
cgggtccttgcctacagtcagcttt

SEQ ID NO: 275609 - DNA, 25 bp, Homo sapien
gcatttaaatagcaatactagacag

SEQ ID NO: 275610 - DNA, 25 bp, Homo sapien
cagaaaataagtagggattccaaag

SEQ ID NO: 275611 - DNA, 25 bp, Homo sapien
gggattccaaaggaagcctttattg

SEQ ID NO: 275612 - DNA, 25 bp, Homo sapien
gaagcctttattggttgggctaggc

SEQ ID NO: 275613 - DNA, 25 bp, Homo sapien
agcctttattggttgggctaggctg

SEQ ID NO: 275614 - DNA, 25 bp, Homo sapien
ctgggctagctgtggaagatagact

SEQ ID NO: 275615 - DNA, 25 bp, Homo sapien
gtggaagatagacttctatgtccct

SEQ ID NO: 275616 - DNA, 25 bp, Homo sapien
gagacatgtggatctgacatcgtgt

SEQ ID NO: 275617 - DNA, 25 bp, Homo sapien
gttttattcttgactgagcctcgca

SEQ ID NO: 275618 - DNA, 25 bp, Homo sapien
agcactgcatgatctcagcctagaa

SEQ ID NO: 275619 - DNA, 25 bp, Homo sapien
gatctcagcctagaaatgagccaaa

SEQ ID NO: 275620 - DNA, 25 bp, Homo sapien
aagctgtcttccaaccagagtagca

SEQ ID NO: 275621 - DNA, 25 bp, Homo sapien
atacatgtgtctgacttttccccta

SEQ ID NO: 275622 - DNA, 25 bp, Homo sapien
tagactgtagcgcaaatggaactgt

SEQ ID NO: 275623 - DNA, 25 bp, Homo sapien
ttcccctagcctgttgaacattcaa

SEQ ID NO: 275624 - DNA, 25 bp, Homo sapien
taaacagccattgaaatgctttcat

SEQ ID NO: 275625 - DNA, 25 bp, Homo sapien
atgctttcatagtgcttcatttgta

SEQ ID NO: 275626 - DNA, 25 bp, Homo sapien
cagtgctgtggcattggagactacg

SEQ ID NO: 275627 - DNA, 25 bp, Homo sapien
gagactacggagagagtcttctcta

SEQ ID NO: 275628 - DNA, 25 bp, Homo sapien
agagtcttctctaccagcactgcat

SEQ ID NO: 275629 - DNA, 25 bp, Homo sapien
tgctcctaatagtcacatctgtgtt

SEQ ID NO: 275630 - DNA, 25 bp, Homo sapien
tagtcacatctgtgtttagaagggc

SEQ ID NO: 275631 - DNA, 25 bp, Homo sapien
tcctgcgtcagagcctgtcaagcat

SEQ ID NO: 275632 - DNA, 25 bp, Homo sapien
tgtcaagcatgtcaggcctagagtg

SEQ ID NO: 275633 - DNA, 25 bp, Homo sapien
ggcctagagtggctttctgatccct

SEQ ID NO: 275634 - DNA, 25 bp, Homo sapien
ttctgatccctgttatacacctatt

SEQ ID NO: 275635 - DNA, 25 bp, Homo sapien
ataagttatctaagctaattctgag

SEQ ID NO: 275636 - DNA, 25 bp, Homo sapien
ttctgagctcagagtaattttcctg

SEQ ID NO: 275637 - DNA, 25 bp, Homo sapien
agagtaattttcctgaaggagcttc

SEQ ID NO: 275638 - DNA, 25 bp, Homo sapien
ctcgccagtgggaaatagggccctt

SEQ ID NO: 275639 - DNA, 25 bp, Homo sapien
cttggtaccttttgctcctaatagt

SEQ ID NO: 275640 - DNA, 25 bp, Homo sapien
tgcctcccggcaattatacatgtgt

SEQ ID NO: 275641 - DNA, 25 bp, Homo sapien
ctcccggcaattatacatgtgtcag

SEQ ID NO: 275642 - DNA, 25 bp, Homo sapien
ccggcaattatacatgtgtcaggat

SEQ ID NO: 275643 - DNA, 25 bp, Homo sapien
gtgtcaggatgtcaaaaagcaattc

SEQ ID NO: 275644 - DNA, 25 bp, Homo sapien
aggatgtcaaaaagcaattctcctg

SEQ ID NO: 275645 - DNA, 25 bp, Homo sapien
ggtttcaccgtatcggcgaggatga

SEQ ID NO: 275646 - DNA, 25 bp, Homo sapien
caccgtatcggcgaggatgatctct

SEQ ID NO: 275647 - DNA, 25 bp, Homo sapien
cgtatcggcgaggatgatctctatc

SEQ ID NO: 275648 - DNA, 25 bp, Homo sapien
gtgtgtgaaacgtagtctgcaactc

SEQ ID NO: 275649 - DNA, 25 bp, Homo sapien
gtgtgaaacgtagtctgcaactctg

SEQ ID NO: 275650 - DNA, 25 bp, Homo sapien
tgaaacgtagtctgcaactctgcct

SEQ ID NO: 275651 - DNA, 25 bp, Homo sapien
gaaaaggtgcttccaaagcatattt

SEQ ID NO: 275652 - DNA, 25 bp, Homo sapien
gatgctattattgtaaatccctctt

SEQ ID NO: 275653 - DNA, 25 bp, Homo sapien
gtaaatccctctttaagcttcatgc

SEQ ID NO: 275654 - DNA, 25 bp, Homo sapien
tccctctttaagcttcatgcattta

SEQ ID NO: 275655 - DNA, 25 bp, Homo sapien
tcctcttcctttctggaaagctttt

SEQ ID NO: 275656 - DNA, 25 bp, Homo sapien
gcttttatgacttaactccaaattc

SEQ ID NO: 275657 - DNA, 25 bp, Homo sapien
gacttaactccaaattctatgtgtt

SEQ ID NO: 275658 - DNA, 25 bp, Homo sapien
aactaaagtatcatgtcctccttaa

SEQ ID NO: 275659 - DNA, 25 bp, Homo sapien
atgtcctccttaaagaataccatta

SEQ ID NO: 275660 - DNA, 25 bp, Homo sapien
attcataacctctgaaaccagcgag

SEQ ID NO: 275661 - DNA, 25 bp, Homo sapien
aaccagcgagggtcataaagctact

SEQ ID NO: 275662 - DNA, 25 bp, Homo sapien
gaagcatttaaatagcaatactaga

SEQ ID NO: 275663 - DNA, 25 bp, Homo sapien
aatagcaatactagacagtaaatgg

SEQ ID NO: 275664 - DNA, 25 bp, Homo sapien
cagaaaataagtagggattccaaag

SEQ ID NO: 275665 - DNA, 25 bp, Homo sapien
tccaaaggaagcctttattggttgg

SEQ ID NO: 275666 - DNA, 25 bp, Homo sapien
aggaagcctttattggttgggctag

SEQ ID NO: 275667 - DNA, 25 bp, Homo sapien
gaagcctttattggttgggctaggc

SEQ ID NO: 275668 - DNA, 25 bp, Homo sapien
aagcctttattggttgggctaggct

SEQ ID NO: 275669 - DNA, 25 bp, Homo sapien
agcctttattggttgggctaggctg

SEQ ID NO: 275670 - DNA, 25 bp, Homo sapien
cctttattggttgggctaggctggg

SEQ ID NO: 275671 - DNA, 25 bp, Homo sapien
gctagctgtggaagatagacttcta

SEQ ID NO: 275672 - DNA, 25 bp, Homo sapien
gtggaagatagacttctatgtccct

SEQ ID NO: 275673 - DNA, 25 bp, Homo sapien
ggaatttggagacactatgttctaa

SEQ ID NO: 275674 - DNA, 25 bp, Homo sapien
tcctttgcctacctcagtaacagag

SEQ ID NO: 275675 - DNA, 25 bp, Homo sapien
acagaggctgggtctgagccttgct

SEQ ID NO: 275676 - DNA, 25 bp, Homo sapien
agccttgctcgagattagctcttca

SEQ ID NO: 275677 - DNA, 25 bp, Homo sapien
agattagctcttcaccaggtctgtg

SEQ ID NO: 275678 - DNA, 25 bp, Homo sapien
caggtctgtgtggtaatcatatcgt

SEQ ID NO: 275679 - DNA, 25 bp, Homo sapien
gtagttaccgtaggtcacgctgcaa

SEQ ID NO: 275680 - DNA, 25 bp, Homo sapien
ggtcacgctgcaagtgtaatttaca

SEQ ID NO: 275681 - DNA, 25 bp, Homo sapien
tacagtgaggcatagtcttttccag

SEQ ID NO: 275682 - DNA, 25 bp, Homo sapien
aatacttgtgtcaccgatccagggt

SEQ ID NO: 275683 - DNA, 25 bp, Homo sapien
tctttcctgagtctgaaatacctgg

SEQ ID NO: 275684 - DNA, 25 bp, Homo sapien
agggctggagggtctcgtctgagga

SEQ ID NO: 275685 - DNA, 25 bp, Homo sapien
gaggctctcgctggacgtctggcct

SEQ ID NO: 275686 - DNA, 25 bp, Homo sapien
tcgctggacgtctggcctgtgcgct

SEQ ID NO: 275687 - DNA, 25 bp, Homo sapien
tgtgcgctggtggacggatgcctac

SEQ ID NO: 275688 - DNA, 25 bp, Homo sapien
tttggaggacccgatgaccaggcgt

SEQ ID NO: 275689 - DNA, 25 bp, Homo sapien
gatgaccaggcgtcctgcgagtccg

SEQ ID NO: 275690 - DNA, 25 bp, Homo sapien
cacctcggacttggctgtggacggt

SEQ ID NO: 275691 - DNA, 25 bp, Homo sapien
gtgcaagtgcatcctgcagggctgg

SEQ ID NO: 275692 - DNA, 25 bp, Homo sapien
tgtgcgcagctgtgggctgaccttt

SEQ ID NO: 275693 - DNA, 25 bp, Homo sapien
tgggctgacctttgcagagttttgt

SEQ ID NO: 275694 - DNA, 25 bp, Homo sapien
gacctttgcagagttttgtggaata

SEQ ID NO: 275695 - DNA, 25 bp, Homo sapien
ggagcaggagtttatttgacatcta

SEQ ID NO: 275696 - DNA, 25 bp, Homo sapien
tgacatctagttatctgtctgtctg

SEQ ID NO: 275697 - DNA, 25 bp, Homo sapien
tatctatctgtctgctgtatgagag

SEQ ID NO: 275698 - DNA, 25 bp, Homo sapien
gtaggactggattaaatgaccactg

SEQ ID NO: 275699 - DNA, 25 bp, Homo sapien
atgaccactgaactcactgaatcca

SEQ ID NO: 275700 - DNA, 25 bp, Homo sapien
gaatccagatcattcatatcatcaa

SEQ ID NO: 275701 - DNA, 25 bp, Homo sapien
tcatatcatcaacaaaagctctagg

SEQ ID NO: 275702 - DNA, 25 bp, Homo sapien
ggtcacgttgtgaatgcttaaaaca

SEQ ID NO: 275703 - DNA, 25 bp, Homo sapien
attttcttcaacaaccatatcgcta

SEQ ID NO: 275704 - DNA, 25 bp, Homo sapien
tatcgctaaactaatatatccagag

SEQ ID NO: 275705 - DNA, 25 bp, Homo sapien
gcacaattcgtgttgaaccttccaa

SEQ ID NO: 275706 - DNA, 25 bp, Homo sapien
ggaaatggttttaacccactctgca

SEQ ID NO: 275707 - DNA, 25 bp, Homo sapien
ggttttaacccactctgcaagggat

SEQ ID NO: 275708 - DNA, 25 bp, Homo sapien
gtattctcacttacttacaaactat

SEQ ID NO: 275709 - DNA, 25 bp, Homo sapien
gctgctgtttggaagaaggcacctt

SEQ ID NO: 275710 - DNA, 25 bp, Homo sapien
gaaggcaccttataactagccatta

SEQ ID NO: 275711 - DNA, 25 bp, Homo sapien
actagccattagcaccaaagcatca

SEQ ID NO: 275712 - DNA, 25 bp, Homo sapien
caaagcatcacgttggtatcaggat

SEQ ID NO: 275713 - DNA, 25 bp, Homo sapien
ggagagaatgtcatcatttgcaaat

SEQ ID NO: 275714 - DNA, 25 bp, Homo sapien
aaactattaccaacagcatgcattt

SEQ ID NO: 275715 - DNA, 25 bp, Homo sapien
acagcatgcattttagtatggcaga

SEQ ID NO: 275716 - DNA, 25 bp, Homo sapien
gtgtgatgttcccttagaaaccaaa

SEQ ID NO: 275717 - DNA, 25 bp, Homo sapien
taagaagccacttggacaccttctc

SEQ ID NO: 275718 - DNA, 25 bp, Homo sapien
accttctccaggagacctcttgttc

SEQ ID NO: 275719 - DNA, 25 bp, Homo sapien
ctcttgttcctccaagtaacttttg

SEQ ID NO: 275720 - DNA, 25 bp, Homo sapien
acttttgttctgtctttgctatctc

SEQ ID NO: 275721 - DNA, 25 bp, Homo sapien
tttgctatctctccatttatgtctc

SEQ ID NO: 275722 - DNA, 25 bp, Homo sapien
acaacatctggcatatggcaatggc

SEQ ID NO: 275723 - DNA, 25 bp, Homo sapien
tacatccactggacttcagctcttt

SEQ ID NO: 275724 - DNA, 25 bp, Homo sapien
tcttttcccctccaatataggcaga

SEQ ID NO: 275725 - DNA, 25 bp, Homo sapien
ggcagagttttcagtatcagttaag

SEQ ID NO: 275726 - DNA, 25 bp, Homo sapien
gtagctattagtatccaaaaggccc

SEQ ID NO: 275727 - DNA, 25 bp, Homo sapien
gaagacccataagtggagtgtccta

SEQ ID NO: 275728 - DNA, 25 bp, Homo sapien
tggttggaccccaggactgaggacc

SEQ ID NO: 275729 - DNA, 25 bp, Homo sapien
ttggaccccaggactgaggaccaga

SEQ ID NO: 275730 - DNA, 25 bp, Homo sapien
ccctggagatgacaagggccaccca

SEQ ID NO: 275731 - DNA, 25 bp, Homo sapien
aagacacactcacccacggtgctgt

SEQ ID NO: 275732 - DNA, 25 bp, Homo sapien
ccacggtgctgtaagggcctgagct

SEQ ID NO: 275733 - DNA, 25 bp, Homo sapien
gctgtaagggcctgagctgtgctca

SEQ ID NO: 275734 - DNA, 25 bp, Homo sapien
ggccatgctacctccaagggacagg

SEQ ID NO: 275735 - DNA, 25 bp, Homo sapien
cctccaagggacaggtaacagtctt

SEQ ID NO: 275736 - DNA, 25 bp, Homo sapien
gtaacagtcttagatcctctggctc

SEQ ID NO: 275737 - DNA, 25 bp, Homo sapien
cagtcttagatcctctggctctcag

SEQ ID NO: 275738 - DNA, 25 bp, Homo sapien
cctctggctctcaggaagtggcagg

SEQ ID NO: 275739 - DNA, 25 bp, Homo sapien
cccactgtacagagaccaagaacag

SEQ ID NO: 275740 - DNA, 25 bp, Homo sapien
tattattgccaatcccctaagatat

SEQ ID NO: 275741 - DNA, 25 bp, Homo sapien
gccaatcccctaagatattgtattt

SEQ ID NO: 275742 - DNA, 25 bp, Homo sapien
ttgtattttacaaatctccctcttc

SEQ ID NO: 275743 - DNA, 25 bp, Homo sapien
tatattttatgaagttagtgcgggc

SEQ ID NO: 275744 - DNA, 25 bp, Homo sapien
tatgaagttagtgcgggctttgctg

SEQ ID NO: 275745 - DNA, 25 bp, Homo sapien
tagtgcgggctttgctgctccctgg

SEQ ID NO: 275746 - DNA, 25 bp, Homo sapien
tgcccaagccgctgggcctttttaa

SEQ ID NO: 275747 - DNA, 25 bp, Homo sapien
gccgctgggcctttttaattgccaa

SEQ ID NO: 275748 - DNA, 25 bp, Homo sapien
tgccaaactgctctcttcatcagct

SEQ ID NO: 275749 - DNA, 25 bp, Homo sapien
cttcatcagctcagcacatgcttta

SEQ ID NO: 275750 - DNA, 25 bp, Homo sapien
acaccatctcttatctctcattatt

SEQ ID NO: 275751 - DNA, 25 bp, Homo sapien
ttatctctcattattctgcctctta

SEQ ID NO: 275752 - DNA, 25 bp, Homo sapien
cctattatggctcccaagaaagttc

SEQ ID NO: 275753 - DNA, 25 bp, Homo sapien
gaaagttcctgctttagtgttttgt

SEQ ID NO: 275754 - DNA, 25 bp, Homo sapien
tgctttagtgttttgttccctctgc

SEQ ID NO: 275755 - DNA, 25 bp, Homo sapien
cagagagctccccttagtgatctca

SEQ ID NO: 275756 - DNA, 25 bp, Homo sapien
tatcagtaagacaaacccttctccc

SEQ ID NO: 275757 - DNA, 25 bp, Homo sapien
tatcccctgtacctgacaatctatg

SEQ ID NO: 275758 - DNA, 25 bp, Homo sapien
gacaatctatgagtttgcttcttta

SEQ ID NO: 275759 - DNA, 25 bp, Homo sapien
atgcccatcacatgccctagaaggt

SEQ ID NO: 275760 - DNA, 25 bp, Homo sapien
tgccctagaaggtaagtcccatgaa

SEQ ID NO: 275761 - DNA, 25 bp, Homo sapien
agaaataccctcagcagcgaagctt

SEQ ID NO: 275762 - DNA, 25 bp, Homo sapien
tcaggagcccggtgcccaagactga

SEQ ID NO: 275763 - DNA, 25 bp, Homo sapien
gaagcttcctgacgcctgtctgcag

SEQ ID NO: 275764 - DNA, 25 bp, Homo sapien
tgccgccgtcgcttctggctgaaga

SEQ ID NO: 275765 - DNA, 25 bp, Homo sapien
cttctggctgaagacgtttgaggac

SEQ ID NO: 275766 - DNA, 25 bp, Homo sapien
cgtttgaggacgatttgcggaattc

SEQ ID NO: 275767 - DNA, 25 bp, Homo sapien
ttgcggaattccaagtccactactg

SEQ ID NO: 275768 - DNA, 25 bp, Homo sapien
aagtccactactgggttccagctgc

SEQ ID NO: 275769 - DNA, 25 bp, Homo sapien
cggtgcccaagactgactgactagg

SEQ ID NO: 275770 - DNA, 25 bp, Homo sapien
agactgactgactagggagcttgaa

SEQ ID NO: 275771 - DNA, 25 bp, Homo sapien
ttgaagggccggtgttcaggccctc

SEQ ID NO: 275772 - DNA, 25 bp, Homo sapien
aagtgagtaagacaggttgctcttt

SEQ ID NO: 275773 - DNA, 25 bp, Homo sapien
agacaggttgctctttggaaaacaa

SEQ ID NO: 275774 - DNA, 25 bp, Homo sapien
aatccctttattagaacaaggcatg

SEQ ID NO: 275775 - DNA, 25 bp, Homo sapien
gacagcttgatggatgaagagcaga

SEQ ID NO: 275776 - DNA, 25 bp, Homo sapien
gcatgaaattctgccactaggtggc

SEQ ID NO: 275777 - DNA, 25 bp, Homo sapien
actaggtggcgatgccctataactt

SEQ ID NO: 275778 - DNA, 25 bp, Homo sapien
gtacatcacacgagcactatggaag

SEQ ID NO: 275779 - DNA, 25 bp, Homo sapien
atcacacgagcactatggaagattt

SEQ ID NO: 275780 - DNA, 25 bp, Homo sapien
tttttcaggatgacaacaccttaga

SEQ ID NO: 275781 - DNA, 25 bp, Homo sapien
caggatgacaacaccttagaggttt

SEQ ID NO: 275782 - DNA, 25 bp, Homo sapien
gcatggattttaggagggacagtat

SEQ ID NO: 275783 - DNA, 25 bp, Homo sapien
gaagcactaggaataaacctgtatt

SEQ ID NO: 275784 - DNA, 25 bp, Homo sapien
cctgtatttttgctcttgggtttat

SEQ ID NO: 275785 - DNA, 25 bp, Homo sapien
gctcttgggtttattcctcttcttc

SEQ ID NO: 275786 - DNA, 25 bp, Homo sapien
tgggtttattcctcttcttccaata

SEQ ID NO: 275787 - DNA, 25 bp, Homo sapien
tcaattatactgaaccctgaagaat

SEQ ID NO: 275788 - DNA, 25 bp, Homo sapien
ctgaaccctgaagaattaaaagtga

SEQ ID NO: 275789 - DNA, 25 bp, Homo sapien
aatgcctaaccatttatgattaaaa

SEQ ID NO: 275790 - DNA, 25 bp, Homo sapien
tttttctcattaaacagagcatggg

SEQ ID NO: 275791 - DNA, 25 bp, Homo sapien
tggatatttaggttggtttcatgtc

SEQ ID NO: 275792 - DNA, 25 bp, Homo sapien
ttgctattgtgaatgactattactt

SEQ ID NO: 275793 - DNA, 25 bp, Homo sapien
gactattactttaagaagcactagg

SEQ ID NO: 275794 - DNA, 25 bp, Homo sapien
catgtttttaaacttgggtcaatat

SEQ ID NO: 275795 - DNA, 25 bp, Homo sapien
aagaccagaagttgttaaacatcat

SEQ ID NO: 275796 - DNA, 25 bp, Homo sapien
ttaaatccccttatccaggaattag

SEQ ID NO: 275797 - DNA, 25 bp, Homo sapien
ccttatccaggaattagcattgtta

SEQ ID NO: 275798 - DNA, 25 bp, Homo sapien
ttcttggccgcagcagaatattatt

SEQ ID NO: 275799 - DNA, 25 bp, Homo sapien
tattccctcaagctttccatggctt

SEQ ID NO: 275800 - DNA, 25 bp, Homo sapien
tcaagctttccatggcttgggtctg

SEQ ID NO: 275801 - DNA, 25 bp, Homo sapien
atggcttgggtctgccctggttttg

SEQ ID NO: 275802 - DNA, 25 bp, Homo sapien
tgccctggttttgaacattaggtta

SEQ ID NO: 275803 - DNA, 25 bp, Homo sapien
gttttgaacattaggttaggctaca

SEQ ID NO: 275804 - DNA, 25 bp, Homo sapien
taggttaggctacagaaagcattct

SEQ ID NO: 275805 - DNA, 25 bp, Homo sapien
gtgagcctgccagcgtttgcgacgt

SEQ ID NO: 275806 - DNA, 25 bp, Homo sapien
cgcacgacaggctcatactttctga

SEQ ID NO: 275807 - DNA, 25 bp, Homo sapien
gacaggctcatactttctgaggatc

SEQ ID NO: 275808 - DNA, 25 bp, Homo sapien
atactttctgaggatcgtgcatagc

SEQ ID NO: 275809 - DNA, 25 bp, Homo sapien
ctttctgaggatcgtgcatagcata

SEQ ID NO: 275810 - DNA, 25 bp, Homo sapien
ggatcgtgcatagcataggacgtct

SEQ ID NO: 275811 - DNA, 25 bp, Homo sapien
gcatagcataggacgtctgaacctt

SEQ ID NO: 275812 - DNA, 25 bp, Homo sapien
taggacgtctgaacctttgtacaaa

SEQ ID NO: 275813 - DNA, 25 bp, Homo sapien
tagatgacatcttgctacagctttt

SEQ ID NO: 275814 - DNA, 25 bp, Homo sapien
gacatcttgctacagcttttatttg

SEQ ID NO: 275815 - DNA, 25 bp, Homo sapien
cttgctacagcttttatttgtgaat

SEQ ID NO: 275816 - DNA, 25 bp, Homo sapien
ggaagtcgatagtctcaaaggcact

SEQ ID NO: 275817 - DNA, 25 bp, Homo sapien
tgtttctcccaagtaggccaccagg

SEQ ID NO: 275818 - DNA, 25 bp, Homo sapien
aggcagcctctagagttgctttacc

SEQ ID NO: 275819 - DNA, 25 bp, Homo sapien
agagttgctttacccaaatccttct

SEQ ID NO: 275820 - DNA, 25 bp, Homo sapien
tccttctccagccatgacttggtga

SEQ ID NO: 275821 - DNA, 25 bp, Homo sapien
ctccacttccctcagatgatgagga

SEQ ID NO: 275822 - DNA, 25 bp, Homo sapien
ttctctcttcccagtgatgcacatc

SEQ ID NO: 275823 - DNA, 25 bp, Homo sapien
acacgtggtgaacaactgcctttag

SEQ ID NO: 275824 - DNA, 25 bp, Homo sapien
aactgcctttagctggtccagatta

SEQ ID NO: 275825 - DNA, 25 bp, Homo sapien
gctggtccagattaatcatttcaaa

SEQ ID NO: 275826 - DNA, 25 bp, Homo sapien
gacatccattttagatcacaagcag

SEQ ID NO: 275827 - DNA, 25 bp, Homo sapien
aatattgtattatgtaccaccaaaa

SEQ ID NO: 275828 - DNA, 25 bp, Homo sapien
accaaaaccttagtgatgcaatagt

SEQ ID NO: 275829 - DNA, 25 bp, Homo sapien
gtgatgcaatagttcttaaatgaca

SEQ ID NO: 275830 - DNA, 25 bp, Homo sapien
ggtctattagggaaactgtgatgtc

SEQ ID NO: 275831 - DNA, 25 bp, Homo sapien
atttttcccgttaatccatcgtcat

SEQ ID NO: 275832 - DNA, 25 bp, Homo sapien
ccgttaatccatcgtcatcagtttg

SEQ ID NO: 275833 - DNA, 25 bp, Homo sapien
catcgtcatcagtttggcaagtttt

SEQ ID NO: 275834 - DNA, 25 bp, Homo sapien
ggcaagttttgatacaggtgctttt

SEQ ID NO: 275835 - DNA, 25 bp, Homo sapien
taatgtttgcatgtaagcaggcagt

SEQ ID NO: 275836 - DNA, 25 bp, Homo sapien
agcaggcagtaactattatgtcaca

SEQ ID NO: 275837 - DNA, 25 bp, Homo sapien
actgtgatgtctttcattttctgaa

SEQ ID NO: 275838 - DNA, 25 bp, Homo sapien
atagtagtgttctttgaggatgcat

SEQ ID NO: 275839 - DNA, 25 bp, Homo sapien
aggatgcatttacttttccccaaat

SEQ ID NO: 275840 - DNA, 25 bp, Homo sapien
ttacttttccccaaatttgatagat

SEQ ID NO: 275841 - DNA, 25 bp, Homo sapien
atatattttttctggccacttggct

SEQ ID NO: 275842 - DNA, 25 bp, Homo sapien
ggccacttggcttctaactgattaa

SEQ ID NO: 275843 - DNA, 25 bp, Homo sapien
gaaaaacgcacgtgtgcctgtttca

SEQ ID NO: 275844 - DNA, 25 bp, Homo sapien
gtgtgcctgtttcactcaaatcata

SEQ ID NO: 275845 - DNA, 25 bp, Homo sapien
aagctgctacagttatagtttgtga

SEQ ID NO: 275846 - DNA, 25 bp, Homo sapien
agagggaaattactgttactgtgtc

SEQ ID NO: 275847 - DNA, 25 bp, Homo sapien
tgatgcttttggtcagataatctgc

SEQ ID NO: 275848 - DNA, 25 bp, Homo sapien
ataatctgctgcctgtcaatatttg

SEQ ID NO: 275849 - DNA, 25 bp, Homo sapien
caagggtgacccgttcgccttcgag

SEQ ID NO: 275850 - DNA, 25 bp, Homo sapien
ttcgccttcgagtcttccaaagatg

SEQ ID NO: 275851 - DNA, 25 bp, Homo sapien
gagtcttccaaagatgtgggcagca

SEQ ID NO: 275852 - DNA, 25 bp, Homo sapien
atgtgggcagcagggtctcaagtcc

SEQ ID NO: 275853 - DNA, 25 bp, Homo sapien
accactgtgttctctcatcctaact

SEQ ID NO: 275854 - DNA, 25 bp, Homo sapien
taactcctcctagggccgacagaaa

SEQ ID NO: 275855 - DNA, 25 bp, Homo sapien
gggccgacagaaaatcccttggctt

SEQ ID NO: 275856 - DNA, 25 bp, Homo sapien
aggctgcacggtgatgacaggtcac

SEQ ID NO: 275857 - DNA, 25 bp, Homo sapien
tctcctcaattcacagcaactttat

SEQ ID NO: 275858 - DNA, 25 bp, Homo sapien
agcaactttatgaactccttgtccc

SEQ ID NO: 275859 - DNA, 25 bp, Homo sapien
aggtcaccaggcagactcgtgtgtg

SEQ ID NO: 275860 - DNA, 25 bp, Homo sapien
ttcctcctctcgacttcactatgaa

SEQ ID NO: 275861 - DNA, 25 bp, Homo sapien
gacttcactatgaatgccgcatctg

SEQ ID NO: 275862 - DNA, 25 bp, Homo sapien
gcacgtacatgttgactgccgaggg

SEQ ID NO: 275863 - DNA, 25 bp, Homo sapien
tatgaatgccgcatctgttgaatga

SEQ ID NO: 275864 - DNA, 25 bp, Homo sapien
ctcttgcttttggatagaagtgatt

SEQ ID NO: 275865 - DNA, 25 bp, Homo sapien
gaagtgattgcaaatcttatcaaaa

SEQ ID NO: 275866 - DNA, 25 bp, Homo sapien
gggcagctgtacattaaatgaaacc

SEQ ID NO: 275867 - DNA, 25 bp, Homo sapien
gaagtcgatcggcagagcggacagg

SEQ ID NO: 275868 - DNA, 25 bp, Homo sapien
tgcagaggaccttccgacaggttgg

SEQ ID NO: 275869 - DNA, 25 bp, Homo sapien
cttccgacaggttggtcagaccatg

SEQ ID NO: 275870 - DNA, 25 bp, Homo sapien
ggttggtcagaccatgcccatggtt

SEQ ID NO: 275871 - DNA, 25 bp, Homo sapien
accatacagtatccaatcgtctcaa

SEQ ID NO: 275872 - DNA, 25 bp, Homo sapien
gctgtctttcctctgaatgcaagga

SEQ ID NO: 275873 - DNA, 25 bp, Homo sapien
ccggttacacaaacgctgacaaaag

SEQ ID NO: 275874 - DNA, 25 bp, Homo sapien
ggaaattcggagcagtacccatctg

SEQ ID NO: 275875 - DNA, 25 bp, Homo sapien
gtacccatctggtccatacagcgaa

SEQ ID NO: 275876 - DNA, 25 bp, Homo sapien
gtccatacagcgaactcccagtgag

SEQ ID NO: 275877 - DNA, 25 bp, Homo sapien
gagcaccacggcaatgtaactaatt

SEQ ID NO: 275878 - DNA, 25 bp, Homo sapien
aactaattcatgtttccctcttggc

SEQ ID NO: 275879 - DNA, 25 bp, Homo sapien
gggcaagcttaagtgactcagaatc

SEQ ID NO: 275880 - DNA, 25 bp, Homo sapien
gcaagtctcataggagagctgcgat

SEQ ID NO: 275881 - DNA, 25 bp, Homo sapien
gagctgcgatcgaggttaccataca

SEQ ID NO: 275882 - DNA, 25 bp, Homo sapien
ggtggatgttctcgcgtgtttattc

SEQ ID NO: 275883 - DNA, 25 bp, Homo sapien
gtgtgtcccgggtaaatatttgaat

SEQ ID NO: 275884 - DNA, 25 bp, Homo sapien
gtgtttattcctgcaggtggcttaa

SEQ ID NO: 275885 - DNA, 25 bp, Homo sapien
aggtggcttaactgtgcttgcgcgc

SEQ ID NO: 275886 - DNA, 25 bp, Homo sapien
ttaactgtgcttgcgcgcgcgtgga

SEQ ID NO: 275887 - DNA, 25 bp, Homo sapien
ctttccgagtcaattatgcgaggtc

SEQ ID NO: 275888 - DNA, 25 bp, Homo sapien
ttatgcgaggtcatgtgcctggaga

SEQ ID NO: 275889 - DNA, 25 bp, Homo sapien
tggtggcgctccctgaaggactcat

SEQ ID NO: 275890 - DNA, 25 bp, Homo sapien
gctccctgaaggactcattgcagat

SEQ ID NO: 275891 - DNA, 25 bp, Homo sapien
gcggtgaatgtatgtgtctttgtgc

SEQ ID NO: 275892 - DNA, 25 bp, Homo sapien
gtatgtgtctttgtgcagggtttcg

SEQ ID NO: 275893 - DNA, 25 bp, Homo sapien
ggaatcaagaaacggcagagagact

SEQ ID NO: 275894 - DNA, 25 bp, Homo sapien
gagagactgagggttgcagacacat

SEQ ID NO: 275895 - DNA, 25 bp, Homo sapien
gagggttgcagacacatatattttt

SEQ ID NO: 275896 - DNA, 25 bp, Homo sapien
gacacatatatttttgaggctgggt

SEQ ID NO: 275897 - DNA, 25 bp, Homo sapien
ttgaggctgggtgacgagaaaatct

SEQ ID NO: 275898 - DNA, 25 bp, Homo sapien
aaaatctagagacatgagggacata

SEQ ID NO: 275899 - DNA, 25 bp, Homo sapien
agggacataaatgggcctggcagcc

SEQ ID NO: 275900 - DNA, 25 bp, Homo sapien
ataaatgggcctggcagcctcggct

SEQ ID NO: 275901 - DNA, 25 bp, Homo sapien
gctctttgcggctgctggcaggact

SEQ ID NO: 275902 - DNA, 25 bp, Homo sapien
gcaggactgagctgtccgggttctc

SEQ ID NO: 275903 - DNA, 25 bp, Homo sapien
tgcctcggcgctctcgcaaatgaag

SEQ ID NO: 275904 - DNA, 25 bp, Homo sapien
ttcctctaccatccctggttagaat

SEQ ID NO: 275905 - DNA, 25 bp, Homo sapien
atccctggttagaatggcgttctca

SEQ ID NO: 275906 - DNA, 25 bp, Homo sapien
ggttagaatggcgttctcactcacc

SEQ ID NO: 275907 - DNA, 25 bp, Homo sapien
aatggcgttctcactcacctatcca

SEQ ID NO: 275908 - DNA, 25 bp, Homo sapien
acctatccacgctgcagatgagggt

SEQ ID NO: 275909 - DNA, 25 bp, Homo sapien
atccacgctgcagatgagggtgaag

SEQ ID NO: 275910 - DNA, 25 bp, Homo sapien
aaaccatttaaaacatgcatcgcag

SEQ ID NO: 275911 - DNA, 25 bp, Homo sapien
aacatgcatcgcagcaaaccaacat

SEQ ID NO: 275912 - DNA, 25 bp, Homo sapien
tacacaaccaaacggcactggtctc

SEQ ID NO: 275913 - DNA, 25 bp, Homo sapien
aaacggcactggtctctttcagagc

SEQ ID NO: 275914 - DNA, 25 bp, Homo sapien
cggcactggtctctttcagagcctt

SEQ ID NO: 275915 - DNA, 25 bp, Homo sapien
agcattagtatgcaagcccactgag

SEQ ID NO: 275916 - DNA, 25 bp, Homo sapien
tcccactccaccaaagcagaagtta

SEQ ID NO: 275917 - DNA, 25 bp, Homo sapien
tacaacctacacgtatcaaccagct

SEQ ID NO: 275918 - DNA, 25 bp, Homo sapien
gtatgcaagcccactgagcctatta

SEQ ID NO: 275919 - DNA, 25 bp, Homo sapien
tccgctgctcaaccatttttcaggg

SEQ ID NO: 275920 - DNA, 25 bp, Homo sapien
cccactgagcctattaccttgaaag

SEQ ID NO: 275921 - DNA, 25 bp, Homo sapien
tgagcctattaccttgaaagcagag

SEQ ID NO: 275922 - DNA, 25 bp, Homo sapien
gaaagcagagtccaagcactgaatt

SEQ ID NO: 275923 - DNA, 25 bp, Homo sapien
gcactgaatttttctagactcccat

SEQ ID NO: 275924 - DNA, 25 bp, Homo sapien
gactcccattataggtggacaccca

SEQ ID NO: 275925 - DNA, 25 bp, Homo sapien
tggacacccagaaagccagtggaga

SEQ ID NO: 275926 - DNA, 25 bp, Homo sapien
ggctgcagagacctgctcttgaata

SEQ ID NO: 275927 - DNA, 25 bp, Homo sapien
gaatgaacctggatcaccaaattag

SEQ ID NO: 275928 - DNA, 25 bp, Homo sapien
gacctgctcttgaatagggctgcct

SEQ ID NO: 275929 - DNA, 25 bp, Homo sapien
ttgaatagggctgcctttgggatca

SEQ ID NO: 275930 - DNA, 25 bp, Homo sapien
ttgggatcagggagccgagcatact

SEQ ID NO: 275931 - DNA, 25 bp, Homo sapien
agcatactgggcaaggctcatcatg

SEQ ID NO: 275932 - DNA, 25 bp, Homo sapien
aggctcatcatgttcctttgtggaa

SEQ ID NO: 275933 - DNA, 25 bp, Homo sapien
gaagccgaagctgagtgcgcactag

SEQ ID NO: 275934 - DNA, 25 bp, Homo sapien
tgcgcactagagctgctagcaggca

SEQ ID NO: 275935 - DNA, 25 bp, Homo sapien
ttgtctcttttgtcccattgtgggc

SEQ ID NO: 275936 - DNA, 25 bp, Homo sapien
attgtgggcatatggtgggctcctt

SEQ ID NO: 275937 - DNA, 25 bp, Homo sapien
gcccagtgatgctgatattgctagt

SEQ ID NO: 275938 - DNA, 25 bp, Homo sapien
gagatcacattttaagagccattgc

SEQ ID NO: 275939 - DNA, 25 bp, Homo sapien
gtgcacacatgattactgggtccca

SEQ ID NO: 275940 - DNA, 25 bp, Homo sapien
gagccattgctctaggaagcctgga

SEQ ID NO: 275941 - DNA, 25 bp, Homo sapien
gaagcctggagaaatacactcagaa

SEQ ID NO: 275942 - DNA, 25 bp, Homo sapien
taatcaggatcacaacctaagccct

SEQ ID NO: 275943 - DNA, 25 bp, Homo sapien
ctgccactggcctattttatcgaac

SEQ ID NO: 275944 - DNA, 25 bp, Homo sapien
attttatcgaacctgcagtcactgc

SEQ ID NO: 275945 - DNA, 25 bp, Homo sapien
gcagtcactgctaacattgaacact

SEQ ID NO: 275946 - DNA, 25 bp, Homo sapien
gaacactgaatgctacagctcctgt

SEQ ID NO: 275947 - DNA, 25 bp, Homo sapien
ctttcttacaagttgcccagtgatg

SEQ ID NO: 275948 - DNA, 25 bp, Homo sapien
aagatcatggtcctgccgtagacct

SEQ ID NO: 275949 - DNA, 25 bp, Homo sapien
cgtagacctggctccaaggacgtgg

SEQ ID NO: 275950 - DNA, 25 bp, Homo sapien
ggccctgctgcctcttgagtgctgg

SEQ ID NO: 275951 - DNA, 25 bp, Homo sapien
gtgctggcagcatggctgaccctcg

SEQ ID NO: 275952 - DNA, 25 bp, Homo sapien
ggtggttttatggtgcaggtcactt

SEQ ID NO: 275953 - DNA, 25 bp, Homo sapien
tgcaggtcacttgggtcttcagggt

SEQ ID NO: 275954 - DNA, 25 bp, Homo sapien
tgggtcttcagggtcccttccgagg

SEQ ID NO: 275955 - DNA, 25 bp, Homo sapien
cttccgagggcatgtgttcagcact

SEQ ID NO: 275956 - DNA, 25 bp, Homo sapien
gagggcatgtgttcagcactcccgc

SEQ ID NO: 275957 - DNA, 25 bp, Homo sapien
agcactcccgcgttcagcctgaggg

SEQ ID NO: 275958 - DNA, 25 bp, Homo sapien
gaagacagttacagatctcattaat

SEQ ID NO: 275959 - DNA, 25 bp, Homo sapien
ttggtccctccaagatgaccatcct

SEQ ID NO: 275960 - DNA, 25 bp, Homo sapien
aagatgaccatcctgagtttctagc

SEQ ID NO: 275961 - DNA, 25 bp, Homo sapien
atgaccatcctgagtttctagctct

SEQ ID NO: 275962 - DNA, 25 bp, Homo sapien
agtttctagctcttgtttcatgaga

SEQ ID NO: 275963 - DNA, 25 bp, Homo sapien
ctagctcttgtttcatgagagagca

SEQ ID NO: 275964 - DNA, 25 bp, Homo sapien
agagagcagctccccggcttggcca

SEQ ID NO: 275965 - DNA, 25 bp, Homo sapien
atctggccggtctcactcctggact

SEQ ID NO: 275966 - DNA, 25 bp, Homo sapien
ggccggtctcactcctggactggct

SEQ ID NO: 275967 - DNA, 25 bp, Homo sapien
gaaactttcaaaggtgataatctgg

SEQ ID NO: 275968 - DNA, 25 bp, Homo sapien
aggtgataatctgggttgcacagga

SEQ ID NO: 275969 - DNA, 25 bp, Homo sapien
agtgctgcttgtagtggctggccat

SEQ ID NO: 275970 - DNA, 25 bp, Homo sapien
acagagtagattttggtcccgtttg

SEQ ID NO: 275971 - DNA, 25 bp, Homo sapien
tgcagggcacaagcctacatggtgg

SEQ ID NO: 275972 - DNA, 25 bp, Homo sapien
aagcctacatggtggctctggtcat

SEQ ID NO: 275973 - DNA, 25 bp, Homo sapien
gtggctctggtcatatcattagaaa

SEQ ID NO: 275974 - DNA, 25 bp, Homo sapien
gtcaattcatttagactggtagaac

SEQ ID NO: 275975 - DNA, 25 bp, Homo sapien
agactggtagaaccagaaccactgt

SEQ ID NO: 275976 - DNA, 25 bp, Homo sapien
aaccactgtgtagtacatccaaacg

SEQ ID NO: 275977 - DNA, 25 bp, Homo sapien
ctgtgtagtacatccaaacggttaa

SEQ ID NO: 275978 - DNA, 25 bp, Homo sapien
ttaaaattccctggaagatgttaca

SEQ ID NO: 275979 - DNA, 25 bp, Homo sapien
gatgttacataatcctatcatggtg

SEQ ID NO: 275980 - DNA, 25 bp, Homo sapien
tacataatcctatcatggtgtttat

SEQ ID NO: 275981 - DNA, 25 bp, Homo sapien
ggatcatgccgcctttgaaaagtcc

SEQ ID NO: 275982 - DNA, 25 bp, Homo sapien
gcctttgaaaagtccagccgcattt

SEQ ID NO: 275983 - DNA, 25 bp, Homo sapien
tccagccgcatttcatgagcagaga

SEQ ID NO: 275984 - DNA, 25 bp, Homo sapien
gccgcatttcatgagcagagaagga

SEQ ID NO: 275985 - DNA, 25 bp, Homo sapien
cggagagatcggagctggtcaggat

SEQ ID NO: 275986 - DNA, 25 bp, Homo sapien
ggatgcacattttggaagagacctc

SEQ ID NO: 275987 - DNA, 25 bp, Homo sapien
aagagacctcggctgagccatccct

SEQ ID NO: 275988 - DNA, 25 bp, Homo sapien
agagagccagactagccgatgacct

SEQ ID NO: 275989 - DNA, 25 bp, Homo sapien
gactagccgatgacctcaatgagaa

SEQ ID NO: 275990 - DNA, 25 bp, Homo sapien
aagattgcacagaggcctggcccca

SEQ ID NO: 275991 - DNA, 25 bp, Homo sapien
tgcacagaggcctggccccatggag

SEQ ID NO: 275992 - DNA, 25 bp, Homo sapien
gcagttaccaaaatgcatccaaaat

SEQ ID NO: 275993 - DNA, 25 bp, Homo sapien
aagatggcttaatggctaggcagag

SEQ ID NO: 275994 - DNA, 25 bp, Homo sapien
gagatgtgatgaagtcagtacagca

SEQ ID NO: 275995 - DNA, 25 bp, Homo sapien
aagtcagtacagcagaatggtaaca

SEQ ID NO: 275996 - DNA, 25 bp, Homo sapien
aatggtaacaagtgagcatctccct

SEQ ID NO: 275997 - DNA, 25 bp, Homo sapien
caagtgagcatctccctaatgggaa

SEQ ID NO: 275998 - DNA, 25 bp, Homo sapien
ctccctaatgggaatgggacattcc

SEQ ID NO: 275999 - DNA, 25 bp, Homo sapien
gacattcctggtagagctgggagaa

SEQ ID NO: 276000 - DNA, 25 bp, Homo sapien
gaccaaagctactgggaaattctgc

SEQ ID NO: 276001 - DNA, 25 bp, Homo sapien
attctgcagagataattgtcccatt

SEQ ID NO: 276002 - DNA, 25 bp, Homo sapien
agagataattgtcccattacttttt

SEQ ID NO: 276003 - DNA, 25 bp, Homo sapien
tggctgcgactctttcaacctgtga

SEQ ID NO: 276004 - DNA, 25 bp, Homo sapien
actctttcaacctgtgagtcctggg

SEQ ID NO: 276005 - DNA, 25 bp, Homo sapien
gtgcatggcttagtacagttgctaa

SEQ ID NO: 276006 - DNA, 25 bp, Homo sapien
gcgatcagggaagccttcaactggc

SEQ ID NO: 276007 - DNA, 25 bp, Homo sapien
agggaagccttcaactggcagagag

SEQ ID NO: 276008 - DNA, 25 bp, Homo sapien
gtaggtgaggccattctgtatttgg

SEQ ID NO: 276009 - DNA, 25 bp, Homo sapien
gggacagtgaggtcaccttcccact

SEQ ID NO: 276010 - DNA, 25 bp, Homo sapien
aggtcaccttcccactcgtgtgtgt

SEQ ID NO: 276011 - DNA, 25 bp, Homo sapien
tgggattggctcatggtcaggttcc

SEQ ID NO: 276012 - DNA, 25 bp, Homo sapien
attggctcatggtcaggttccctaa

SEQ ID NO: 276013 - DNA, 25 bp, Homo sapien
aggttccctaactcttggctgcgac

SEQ ID NO: 276014 - DNA, 25 bp, Homo sapien
tcggcccactgcgtccgcagagtgg

SEQ ID NO: 276015 - DNA, 25 bp, Homo sapien
gggctggcccctcggctcagcagaa

SEQ ID NO: 276016 - DNA, 25 bp, Homo sapien
agcagaagccccacggtaggcccat

SEQ ID NO: 276017 - DNA, 25 bp, Homo sapien
gcagaagccccacggtaggcccatg

SEQ ID NO: 276018 - DNA, 25 bp, Homo sapien
gtctttcggagccagccggtagcat

SEQ ID NO: 276019 - DNA, 25 bp, Homo sapien
gagccagccggtagcatccacctgg

SEQ ID NO: 276020 - DNA, 25 bp, Homo sapien
tgtccagcaggcagccggcaacctc

SEQ ID NO: 276021 - DNA, 25 bp, Homo sapien
gagcctgctgtctggctcagcccgt

SEQ ID NO: 276022 - DNA, 25 bp, Homo sapien
tgctgtctggctcagcccgtggact

SEQ ID NO: 276023 - DNA, 25 bp, Homo sapien
tggctcagcccgtggactctatgcc

SEQ ID NO: 276024 - DNA, 25 bp, Homo sapien
ccctccaagttcaggcagcgcctgg

SEQ ID NO: 276025 - DNA, 25 bp, Homo sapien
tgtaacttctctttctaatgttttt

SEQ ID NO: 276026 - DNA, 25 bp, Homo sapien
gaaggcacatcttgacacagtacct

SEQ ID NO: 276027 - DNA, 25 bp, Homo sapien
tggaaacatgtgtcccagaggagaa

SEQ ID NO: 276028 - DNA, 25 bp, Homo sapien
aagaggtttgacttgcgtgtagaaa

SEQ ID NO: 276029 - DNA, 25 bp, Homo sapien
gcgtgtagaaaacccggcccctgag

SEQ ID NO: 276030 - DNA, 25 bp, Homo sapien
ctgaggaaaagaccccactggttct

SEQ ID NO: 276031 - DNA, 25 bp, Homo sapien
ttctctgatgacctgggatgcctaa

SEQ ID NO: 276032 - DNA, 25 bp, Homo sapien
gggatgcctaactgtctactccctg

SEQ ID NO: 276033 - DNA, 25 bp, Homo sapien
ctcagagcagccaagtcattggtgt

SEQ ID NO: 276034 - DNA, 25 bp, Homo sapien
aagtcattggtgttcattttcccca

SEQ ID NO: 276035 - DNA, 25 bp, Homo sapien
gttcattttccccacagtgattttt

SEQ ID NO: 276036 - DNA, 25 bp, Homo sapien
tactgaagggctagtggcactgcca

SEQ ID NO: 276037 - DNA, 25 bp, Homo sapien
agtgcgtaggcttccagtgatggtt

SEQ ID NO: 276038 - DNA, 25 bp, Homo sapien
ggcagtggatggaataactccttgt

SEQ ID NO: 276039 - DNA, 25 bp, Homo sapien
aactccttgtggcattctgaagtgt

SEQ ID NO: 276040 - DNA, 25 bp, Homo sapien
tgccaggctctggactaggtgctag

SEQ ID NO: 276041 - DNA, 25 bp, Homo sapien
gctaggtttccagggaggagccaaa

SEQ ID NO: 276042 - DNA, 25 bp, Homo sapien
ccaaacacgggccttgctcttgtgg

SEQ ID NO: 276043 - DNA, 25 bp, Homo sapien
cggccatcttgcagcaggagggatt

SEQ ID NO: 276044 - DNA, 25 bp, Homo sapien
ggagggattctggtcagctataaag

SEQ ID NO: 276045 - DNA, 25 bp, Homo sapien
gtcagctataaaggaggactttcca

SEQ ID NO: 276046 - DNA, 25 bp, Homo sapien
ggactttccatctgggagaggcaga

SEQ ID NO: 276047 - DNA, 25 bp, Homo sapien
gcaaatggcgctgggaggtgtacac

SEQ ID NO: 276048 - DNA, 25 bp, Homo sapien
aggtgtacacggaggtctctgtaaa

SEQ ID NO: 276049 - DNA, 25 bp, Homo sapien
gggaagcccgtcttgggtcctcgct

SEQ ID NO: 276050 - DNA, 25 bp, Homo sapien
agttagaggctgtacaaggccccca

SEQ ID NO: 276051 - DNA, 25 bp, Homo sapien
gtggatcctggaattttctcacgca

SEQ ID NO: 276052 - DNA, 25 bp, Homo sapien
aattttctcacgcaggagccattgc

SEQ ID NO: 276053 - DNA, 25 bp, Homo sapien
ggtctcagaaactgcgaggccagtt

SEQ ID NO: 276054 - DNA, 25 bp, Homo sapien
aaactgcgaggccagttccttggag

SEQ ID NO: 276055 - DNA, 25 bp, Homo sapien
cactgcctgtcggttgcttggattc

SEQ ID NO: 276056 - DNA, 25 bp, Homo sapien
ggttgcttggattccctgacgtaag

SEQ ID NO: 276057 - DNA, 25 bp, Homo sapien
aatcaggacaggtggtgcaaatggc

SEQ ID NO: 276058 - DNA, 25 bp, Homo sapien
ggtgcaacccacagcttcaaacttc

SEQ ID NO: 276059 - DNA, 25 bp, Homo sapien
ttcaaacttctgctctacacttctg

SEQ ID NO: 276060 - DNA, 25 bp, Homo sapien
tacacttctgtcactacagccatcg

SEQ ID NO: 276061 - DNA, 25 bp, Homo sapien
caggcccctcatgacatggatatga

SEQ ID NO: 276062 - DNA, 25 bp, Homo sapien
agtcacaggcttcttgctctaagtg

SEQ ID NO: 276063 - DNA, 25 bp, Homo sapien
caggcttcttgctctaagtgtttga

SEQ ID NO: 276064 - DNA, 25 bp, Homo sapien
tggtggagatggactttgtacaagc

SEQ ID NO: 276065 - DNA, 25 bp, Homo sapien
gagcatcataacttcgggtttccag

SEQ ID NO: 276066 - DNA, 25 bp, Homo sapien
gatatgacactgacgcttcctttgc

SEQ ID NO: 276067 - DNA, 25 bp, Homo sapien
tcctttgctggagaacccatgacag

SEQ ID NO: 276068 - DNA, 25 bp, Homo sapien
aggtcatgcaggctctggtaccaag

SEQ ID NO: 276069 - DNA, 25 bp, Homo sapien
gggacgattttcaatcacagttttt

SEQ ID NO: 276070 - DNA, 25 bp, Homo sapien
ttcaatcacagttttttgttacgag

SEQ ID NO: 276071 - DNA, 25 bp, Homo sapien
tcacagttttttgttacgagtggaa

SEQ ID NO: 276072 - DNA, 25 bp, Homo sapien
acgagtggaaaatgcgtatttataa

SEQ ID NO: 276073 - DNA, 25 bp, Homo sapien
tgaagtagtacagacatgaatgtgt

SEQ ID NO: 276074 - DNA, 25 bp, Homo sapien
atccaaggatggcacctgttaatgt

SEQ ID NO: 276075 - DNA, 25 bp, Homo sapien
caaggatggcacctgttaatgtgta

SEQ ID NO: 276076 - DNA, 25 bp, Homo sapien
ggatggcacctgttaatgtgtatat

SEQ ID NO: 276077 - DNA, 25 bp, Homo sapien
tggcacctgttaatgtgtatatcag

SEQ ID NO: 276078 - DNA, 25 bp, Homo sapien
taatgtgtatatcagggatgtccaa

SEQ ID NO: 276079 - DNA, 25 bp, Homo sapien
cccgggacgattttcaatcacagtt

SEQ ID NO: 276080 - DNA, 25 bp, Homo sapien
gcccagagagctcctggttcctgaa

SEQ ID NO: 276081 - DNA, 25 bp, Homo sapien
cagagagctcctggttcctgaactg

SEQ ID NO: 276082 - DNA, 25 bp, Homo sapien
agagagctcctggttcctgaactga

SEQ ID NO: 276083 - DNA, 25 bp, Homo sapien
gagagctcctggttcctgaactgag

SEQ ID NO: 276084 - DNA, 25 bp, Homo sapien
agagctcctggttcctgaactgagc

SEQ ID NO: 276085 - DNA, 25 bp, Homo sapien
gagctcctggttcctgaactgagct

SEQ ID NO: 276086 - DNA, 25 bp, Homo sapien
agctcctggttcctgaactgagctg

SEQ ID NO: 276087 - DNA, 25 bp, Homo sapien
gctcctggttcctgaactgagctgc

SEQ ID NO: 276088 - DNA, 25 bp, Homo sapien
tcctggttcctgaactgagctgcct

SEQ ID NO: 276089 - DNA, 25 bp, Homo sapien
cctggttcctgaactgagctgcctc

SEQ ID NO: 276090 - DNA, 25 bp, Homo sapien
agagggcaccaacccacctactctg

SEQ ID NO: 276091 - DNA, 25 bp, Homo sapien
atcttgttttcaaacaggtcccaag

SEQ ID NO: 276092 - DNA, 25 bp, Homo sapien
aaatgccaataacagaacccataga

SEQ ID NO: 276093 - DNA, 25 bp, Homo sapien
aaatagagttgtcaggaatccaggt

SEQ ID NO: 276094 - DNA, 25 bp, Homo sapien
ccaggtgtacctgagttactaggat

SEQ ID NO: 276095 - DNA, 25 bp, Homo sapien
ttcacaatttgtggtcatgtcaaca

SEQ ID NO: 276096 - DNA, 25 bp, Homo sapien
ggtcatgtcaacaaatcctagtgta

SEQ ID NO: 276097 - DNA, 25 bp, Homo sapien
aggtcccaagacacttctgacttag

SEQ ID NO: 276098 - DNA, 25 bp, Homo sapien
gacacttctgacttagcactttgtt

SEQ ID NO: 276099 - DNA, 25 bp, Homo sapien
gcactttgttagcaatgcattttcc

SEQ ID NO: 276100 - DNA, 25 bp, Homo sapien
tcctgcatttgtgaagaatccttca

SEQ ID NO: 276101 - DNA, 25 bp, Homo sapien
gaatccttcatgactttcaccataa

SEQ ID NO: 276102 - DNA, 25 bp, Homo sapien
gatttctgtttcttatggattatta

SEQ ID NO: 276103 - DNA, 25 bp, Homo sapien
aatcagaggaaatctgcttctctca

SEQ ID NO: 276104 - DNA, 25 bp, Homo sapien
tctgcttctctcaacataaaaccaa

SEQ ID NO: 276105 - DNA, 25 bp, Homo sapien
ccagacattgttggagtttgcctgt

SEQ ID NO: 276106 - DNA, 25 bp, Homo sapien
ggagtttgcctgttgacaatggtta

SEQ ID NO: 276107 - DNA, 25 bp, Homo sapien
atggttatgatgctgctcgttgtct

SEQ ID NO: 276108 - DNA, 25 bp, Homo sapien
tgctcgttgtcttgagttgcatgta

SEQ ID NO: 276109 - DNA, 25 bp, Homo sapien
gttgcatgtaacgacagtagctctg

SEQ ID NO: 276110 - DNA, 25 bp, Homo sapien
cagtagctctgaagggtgtcatgat

SEQ ID NO: 276111 - DNA, 25 bp, Homo sapien
aacttgtagtgtggtctgattgtgc

SEQ ID NO: 276112 - DNA, 25 bp, Homo sapien
gtctgattgtgccagggaataaata

SEQ ID NO: 276113 - DNA, 25 bp, Homo sapien
tactctttatctaaatgtttgcaca

SEQ ID NO: 276114 - DNA, 25 bp, Homo sapien
gcacatactctttgaacatctatca

SEQ ID NO: 276115 - DNA, 25 bp, Homo sapien
acatctatcatttttccagcagtta

SEQ ID NO: 276116 - DNA, 25 bp, Homo sapien
agcagttatgagtttttcttcccag

SEQ ID NO: 276117 - DNA, 25 bp, Homo sapien
tatgagtttttcttcccaggaatat

SEQ ID NO: 276118 - DNA, 25 bp, Homo sapien
tgaaattgacaacttttcccccacg

SEQ ID NO: 276119 - DNA, 25 bp, Homo sapien
attgtatcctcttttaatgccaccc

SEQ ID NO: 276120 - DNA, 25 bp, Homo sapien
cccctgtgtttaacagcctttgaca

SEQ ID NO: 276121 - DNA, 25 bp, Homo sapien
agcctttgacacaatgtaggagcaa

SEQ ID NO: 276122 - DNA, 25 bp, Homo sapien
gtaggagcaatccatgggactcaaa

SEQ ID NO: 276123 - DNA, 25 bp, Homo sapien
caatccatgggactcaaagaatatt

SEQ ID NO: 276124 - DNA, 25 bp, Homo sapien
ttccccgggaaagttgactgaggtg

SEQ ID NO: 276125 - DNA, 25 bp, Homo sapien
tgaggtgaccagtaatagaattgaa

SEQ ID NO: 276126 - DNA, 25 bp, Homo sapien
aaagggagagtgtcttcagtgcaat

SEQ ID NO: 276127 - DNA, 25 bp, Homo sapien
ttcagtgcaatgtggcatcctggat

SEQ ID NO: 276128 - DNA, 25 bp, Homo sapien
gcatcctggattgggtcttggaaca

SEQ ID NO: 276129 - DNA, 25 bp, Homo sapien
tcttggaacaaaaacaggacattag

SEQ ID NO: 276130 - DNA, 25 bp, Homo sapien
gttaatataccaatttcagtctctt

SEQ ID NO: 276131 - DNA, 25 bp, Homo sapien
ttcagtctcttggttttgacagatg

SEQ ID NO: 276132 - DNA, 25 bp, Homo sapien
ttgacagatgtaccatggtgatgta

SEQ ID NO: 276133 - DNA, 25 bp, Homo sapien
aggaactctttgtactatctctgca

SEQ ID NO: 276134 - DNA, 25 bp, Homo sapien
ctctgtaaatctagtatcattccaa

SEQ ID NO: 276135 - DNA, 25 bp, Homo sapien
tccgatgtagtctatggaaatgtgt

SEQ ID NO: 276136 - DNA, 25 bp, Homo sapien
gtttcagttgaactgtatcaagaaa

SEQ ID NO: 276137 - DNA, 25 bp, Homo sapien
gttgaactgtatcaagaaaatctgg

SEQ ID NO: 276138 - DNA, 25 bp, Homo sapien
atgaagataagcatcttccaaaatg

SEQ ID NO: 276139 - DNA, 25 bp, Homo sapien
taatttactgagagagtagcattgt

SEQ ID NO: 276140 - DNA, 25 bp, Homo sapien
gtacattttcacaaatcctgtcagt

SEQ ID NO: 276141 - DNA, 25 bp, Homo sapien
acattttcacaaatcctgtcagtgt

SEQ ID NO: 276142 - DNA, 25 bp, Homo sapien
attttcacaaatcctgtcagtgtct

SEQ ID NO: 276143 - DNA, 25 bp, Homo sapien
tttcacaaatcctgtcagtgtctgg

SEQ ID NO: 276144 - DNA, 25 bp, Homo sapien
tcacaaatcctgtcagtgtctggct

SEQ ID NO: 276145 - DNA, 25 bp, Homo sapien
acaaatcctgtcagtgtctggctta

SEQ ID NO: 276146 - DNA, 25 bp, Homo sapien
gggaagttcctggacatcaatactg

SEQ ID NO: 276147 - DNA, 25 bp, Homo sapien
atcaatactgtcaacctttctaaca

SEQ ID NO: 276148 - DNA, 25 bp, Homo sapien
tttctaacaaatgtttctgatgcag

SEQ ID NO: 276149 - DNA, 25 bp, Homo sapien
tcttgtggcgcttacattaaaatcc

SEQ ID NO: 276150 - DNA, 25 bp, Homo sapien
gaaacagttttcatttaggtgtgga

SEQ ID NO: 276151 - DNA, 25 bp, Homo sapien
acagataatattgtccctgctcacc

SEQ ID NO: 276152 - DNA, 25 bp, Homo sapien
acctctcagacctcatatcaagaca

SEQ ID NO: 276153 - DNA, 25 bp, Homo sapien
agacctcatatcaagacacaactcc

SEQ ID NO: 276154 - DNA, 25 bp, Homo sapien
taatctttgaagagcctgttaaaaa

SEQ ID NO: 276155 - DNA, 25 bp, Homo sapien
atggatgttcaagcagcatcccgcc

SEQ ID NO: 276156 - DNA, 25 bp, Homo sapien
ccgcccctctgaatcagacataggg

SEQ ID NO: 276157 - DNA, 25 bp, Homo sapien
taagggcaagtaagggctgaacttt

SEQ ID NO: 276158 - DNA, 25 bp, Homo sapien
gtaaacttacaagacaaaaggctct

SEQ ID NO: 276159 - DNA, 25 bp, Homo sapien
gccacccaccatttctacggaagaa

SEQ ID NO: 276160 - DNA, 25 bp, Homo sapien
ccatttctacggaagaactgagcac

SEQ ID NO: 276161 - DNA, 25 bp, Homo sapien
tgagcactctgttctccaaacctat

SEQ ID NO: 276162 - DNA, 25 bp, Homo sapien
aaacctatcagaaatttgtggccga

SEQ ID NO: 276163 - DNA, 25 bp, Homo sapien
atcagaaatttgtggccgagttcaa

SEQ ID NO: 276164 - DNA, 25 bp, Homo sapien
ccgagttcaagcactgaggccatta

SEQ ID NO: 276165 - DNA, 25 bp, Homo sapien
aagcactgaggccattactttccta

SEQ ID NO: 276166 - DNA, 25 bp, Homo sapien
gaggccattactttcctattgggta

SEQ ID NO: 276167 - DNA, 25 bp, Homo sapien
ccttataacatgaaggaacctcctt

SEQ ID NO: 276168 - DNA, 25 bp, Homo sapien
ctggctccttacagctcttaggaag

SEQ ID NO: 276169 - DNA, 25 bp, Homo sapien
gctccttacagctcttaggaaggga

SEQ ID NO: 276170 - DNA, 25 bp, Homo sapien
agtagtctttccctgcacattgttc

SEQ ID NO: 276171 - DNA, 25 bp, Homo sapien
cacattgttctgtgcagttagtagc

SEQ ID NO: 276172 - DNA, 25 bp, Homo sapien
tgtgcagttagtagcgacatacact

SEQ ID NO: 276173 - DNA, 25 bp, Homo sapien
aggccaaagttcctactgtgtccta

SEQ ID NO: 276174 - DNA, 25 bp, Homo sapien
gttcctactgtgtcctacttgaagg

SEQ ID NO: 276175 - DNA, 25 bp, Homo sapien
acttgaaggatgattttgttttctt

SEQ ID NO: 276176 - DNA, 25 bp, Homo sapien
tatcagttgggcatgccagtcgtgt

SEQ ID NO: 276177 - DNA, 25 bp, Homo sapien
gcatgccagtcgtgtgacagccaaa

SEQ ID NO: 276178 - DNA, 25 bp, Homo sapien
agtcgtgtgacagccaaaaatgaag

SEQ ID NO: 276179 - DNA, 25 bp, Homo sapien
cagcaggcagcatcttccaagctct

SEQ ID NO: 276180 - DNA, 25 bp, Homo sapien
ttcctaacctgaagacccttgcaat

SEQ ID NO: 276181 - DNA, 25 bp, Homo sapien
acctgaagacccttgcaatggtgtt

SEQ ID NO: 276182 - DNA, 25 bp, Homo sapien
gacccttgcaatggtgttgggcaca

SEQ ID NO: 276183 - DNA, 25 bp, Homo sapien
gttgggcacacccagaaatccaggg

SEQ ID NO: 276184 - DNA, 25 bp, Homo sapien
ggcacacccagaaatccagggtcat

SEQ ID NO: 276185 - DNA, 25 bp, Homo sapien
gaaatccagggtcatcccctatctc

SEQ ID NO: 276186 - DNA, 25 bp, Homo sapien
tccagatcctcaatggcatctgcaa

SEQ ID NO: 276187 - DNA, 25 bp, Homo sapien
gcttagcttcttccagctagtagaa

SEQ ID NO: 276188 - DNA, 25 bp, Homo sapien
agctagtagaagctgcccgcagtcc

SEQ ID NO: 276189 - DNA, 25 bp, Homo sapien
ctgcgtcccccatggtggaagccag

SEQ ID NO: 276190 - DNA, 25 bp, Homo sapien
ttggagcggccagagactcgctgga

SEQ ID NO: 276191 - DNA, 25 bp, Homo sapien
agctctggagggtgcctggttctgg

SEQ ID NO: 276192 - DNA, 25 bp, Homo sapien
gtgaaggttaaatcagcgagtgaca

SEQ ID NO: 276193 - DNA, 25 bp, Homo sapien
gcgagtgacaggtgaaattccattt

SEQ ID NO: 276194 - DNA, 25 bp, Homo sapien
catttctgacaaagattatgggttt

SEQ ID NO: 276195 - DNA, 25 bp, Homo sapien
tttgtctgtgtctcactcgaatctc

SEQ ID NO: 276196 - DNA, 25 bp, Homo sapien
gtctcactcgaatctctgggtattg

SEQ ID NO: 276197 - DNA, 25 bp, Homo sapien
cgaatctctgggtattgcttttata

SEQ ID NO: 276198 - DNA, 25 bp, Homo sapien
ctgggtattgcttttatatttcttg

SEQ ID NO: 276199 - DNA, 25 bp, Homo sapien
ttaggtacctatgtattttggaaca

SEQ ID NO: 276200 - DNA, 25 bp, Homo sapien
ttttctgattgaacttgtcaaaatg

SEQ ID NO: 276201 - DNA, 25 bp, Homo sapien
agctgaagctgagttttcgtttacc

SEQ ID NO: 276202 - DNA, 25 bp, Homo sapien
gctgaagctgagttttcgtttacct

SEQ ID NO: 276203 - DNA, 25 bp, Homo sapien
ctgaagctgagttttcgtttacctt

SEQ ID NO: 276204 - DNA, 25 bp, Homo sapien
tgaagctgagttttcgtttaccttg

SEQ ID NO: 276205 - DNA, 25 bp, Homo sapien
gaagctgagttttcgtttaccttgg

SEQ ID NO: 276206 - DNA, 25 bp, Homo sapien
agctgagttttcgtttaccttggag

SEQ ID NO: 276207 - DNA, 25 bp, Homo sapien
gctgagttttcgtttaccttggagc

SEQ ID NO: 276208 - DNA, 25 bp, Homo sapien
ctgagttttcgtttaccttggagct

SEQ ID NO: 276209 - DNA, 25 bp, Homo sapien
tgagttttcgtttaccttggagctt

SEQ ID NO: 276210 - DNA, 25 bp, Homo sapien
aagtgtccggccagcagtctagagt

SEQ ID NO: 276211 - DNA, 25 bp, Homo sapien
gcagtctagagtcccacactcttca

SEQ ID NO: 276212 - DNA, 25 bp, Homo sapien
cttcatgctgtattacaacagtaag

SEQ ID NO: 276213 - DNA, 25 bp, Homo sapien
agtaagagcagatatccttcctgga

SEQ ID NO: 276214 - DNA, 25 bp, Homo sapien
ggttttaatgccatagatcccactg

SEQ ID NO: 276215 - DNA, 25 bp, Homo sapien
aatgccatagatcccactggaaaat

SEQ ID NO: 276216 - DNA, 25 bp, Homo sapien
gatcccactggaaaattcagaattc

SEQ ID NO: 276217 - DNA, 25 bp, Homo sapien
cagaattccaactaacaaagacatg

SEQ ID NO: 276218 - DNA, 25 bp, Homo sapien
tggtggttgaaaagtcctcagtgac

SEQ ID NO: 276219 - DNA, 25 bp, Homo sapien
gtcctcagtgacaataatgatggca

SEQ ID NO: 276220 - DNA, 25 bp, Homo sapien
gagaacagagagaagtgtccggcca

SEQ ID NO: 276221 - DNA, 25 bp, Homo sapien
aaacagtttatccttcagaagctcc

SEQ ID NO: 276222 - DNA, 25 bp, Homo sapien
agaagctcccttcaaaatcctcttt

SEQ ID NO: 276223 - DNA, 25 bp, Homo sapien
ccttggcccttaacaatcagcaaag

SEQ ID NO: 276224 - DNA, 25 bp, Homo sapien
tcatcatgccattaaactgccctct

SEQ ID NO: 276225 - DNA, 25 bp, Homo sapien
agggctctcggtgattgtctcaagt

SEQ ID NO: 276226 - DNA, 25 bp, Homo sapien
aaaaggagaccagcggtagccaaag

SEQ ID NO: 276227 - DNA, 25 bp, Homo sapien
aagctatatccttaactaccgctgc

SEQ ID NO: 276228 - DNA, 25 bp, Homo sapien
aaagggcttagatacttgtcctctt

SEQ ID NO: 276229 - DNA, 25 bp, Homo sapien
acttgtcctcttgattactctgaac

SEQ ID NO: 276230 - DNA, 25 bp, Homo sapien
gattactctgaactacatcttgtaa

SEQ ID NO: 276231 - DNA, 25 bp, Homo sapien
gtaattaccaacttcagtcaagaaa

SEQ ID NO: 276232 - DNA, 25 bp, Homo sapien
tggttggaccccaggactgaggacc

SEQ ID NO: 276233 - DNA, 25 bp, Homo sapien
ttggaccccaggactgaggaccaga

SEQ ID NO: 276234 - DNA, 25 bp, Homo sapien
aagacacactcacccacggtgctgt

SEQ ID NO: 276235 - DNA, 25 bp, Homo sapien
tcacccacggtgctgtaagggcctg

SEQ ID NO: 276236 - DNA, 25 bp, Homo sapien
ccacggtgctgtaagggcctgagct

SEQ ID NO: 276237 - DNA, 25 bp, Homo sapien
tgtgctcagctgccggccatgctac

SEQ ID NO: 276238 - DNA, 25 bp, Homo sapien
ggccatgctacctccaagggacagg

SEQ ID NO: 276239 - DNA, 25 bp, Homo sapien
atgctacctccaagggacaggtaac

SEQ ID NO: 276240 - DNA, 25 bp, Homo sapien
cctccaagggacaggtaacagtctt

SEQ ID NO: 276241 - DNA, 25 bp, Homo sapien
gtaacagtcttagatcctctggctc

SEQ ID NO: 276242 - DNA, 25 bp, Homo sapien
cagtcttagatcctctggctctcag

SEQ ID NO: 276243 - DNA, 25 bp, Homo sapien
atgaatcttaaggacatgatgctaa

SEQ ID NO: 276244 - DNA, 25 bp, Homo sapien
taaggacatgatgctaagtgaagta

SEQ ID NO: 276245 - DNA, 25 bp, Homo sapien
gaagtaagccagtcactggaagaca

SEQ ID NO: 276246 - DNA, 25 bp, Homo sapien
actggaagacaaatactctatgctt

SEQ ID NO: 276247 - DNA, 25 bp, Homo sapien
agacaaatactctatgcttccattt

SEQ ID NO: 276248 - DNA, 25 bp, Homo sapien
aatactctatgcttccatttatgtg

SEQ ID NO: 276249 - DNA, 25 bp, Homo sapien
tactctatgcttccatttatgtgaa

SEQ ID NO: 276250 - DNA, 25 bp, Homo sapien
tttatgtgaagtatctagagcagtc

SEQ ID NO: 276251 - DNA, 25 bp, Homo sapien
gtatctagagcagtcaaatgcatag

SEQ ID NO: 276252 - DNA, 25 bp, Homo sapien
gcagtcaaatgcatagaaacaagta

SEQ ID NO: 276253 - DNA, 25 bp, Homo sapien
gaaatgaggagttgtttaatgggta

SEQ ID NO: 276254 - DNA, 25 bp, Homo sapien
tcctctacccacaagaacatactgt

SEQ ID NO: 276255 - DNA, 25 bp, Homo sapien
atactgtaactctactgcttttccc

SEQ ID NO: 276256 - DNA, 25 bp, Homo sapien
actttttccatgagatctttccacc

SEQ ID NO: 276257 - DNA, 25 bp, Homo sapien
ttaactttccctggtacctgcctat

SEQ ID NO: 276258 - DNA, 25 bp, Homo sapien
gtacctgcctatacaggtctagggt

SEQ ID NO: 276259 - DNA, 25 bp, Homo sapien
gggatcctaacttagtcaagtggat

SEQ ID NO: 276260 - DNA, 25 bp, Homo sapien
caagtggatcactgaccttgcagtt

SEQ ID NO: 276261 - DNA, 25 bp, Homo sapien
gatctttccacctgatttaagggag

SEQ ID NO: 276262 - DNA, 25 bp, Homo sapien
agatcactgggcagtttgagactga

SEQ ID NO: 276263 - DNA, 25 bp, Homo sapien
gtttgagactgaacccacgtcttag

SEQ ID NO: 276264 - DNA, 25 bp, Homo sapien
gaaggaaggtcactcttctgtcctc

SEQ ID NO: 276265 - DNA, 25 bp, Homo sapien
gagtactcagtgcataattatgatc

SEQ ID NO: 276266 - DNA, 25 bp, Homo sapien
gaagttctctttcctaatggcacaa

SEQ ID NO: 276267 - DNA, 25 bp, Homo sapien
ggcaagtgccttgggttctttaaat

SEQ ID NO: 276268 - DNA, 25 bp, Homo sapien
aatggcacaagtggtaacccctaat

SEQ ID NO: 276269 - DNA, 25 bp, Homo sapien
gtggtaacccctaattctctagcct

SEQ ID NO: 276270 - DNA, 25 bp, Homo sapien
aacccctaattctctagcctgcagg

SEQ ID NO: 276271 - DNA, 25 bp, Homo sapien
gaaggctcaccctctacttggttta

SEQ ID NO: 276272 - DNA, 25 bp, Homo sapien
ctacttggtttaatattgatctgga

SEQ ID NO: 276273 - DNA, 25 bp, Homo sapien
gaggcagtttcagatagaatctgta

SEQ ID NO: 276274 - DNA, 25 bp, Homo sapien
gaatctgtatgtggattttgctgta

SEQ ID NO: 276275 - DNA, 25 bp, Homo sapien
ataatagtacctacaagatgggttt

SEQ ID NO: 276276 - DNA, 25 bp, Homo sapien
aacccctgcctcatgtctgtaacat

SEQ ID NO: 276277 - DNA, 25 bp, Homo sapien
acatgtgacagtaattccagctcgg

SEQ ID NO: 276278 - DNA, 25 bp, Homo sapien
tgacagtaattccagctcggtccct

SEQ ID NO: 276279 - DNA, 25 bp, Homo sapien
ctcggtccctccaggcaaaggagaa

SEQ ID NO: 276280 - DNA, 25 bp, Homo sapien
aggagaaacgggacttacttcacag

SEQ ID NO: 276281 - DNA, 25 bp, Homo sapien
aacgggacttacttcacaggacaga

SEQ ID NO: 276282 - DNA, 25 bp, Homo sapien
tacttcacaggacagaggattgaca

SEQ ID NO: 276283 - DNA, 25 bp, Homo sapien
acatctcattcatttcttagatttg

SEQ ID NO: 276284 - DNA, 25 bp, Homo sapien
ttcacaattgtgttctctaaaatgt

SEQ ID NO: 276285 - DNA, 25 bp, Homo sapien
gtgttctctaaaatgtgtctaaatt

SEQ ID NO: 276286 - DNA, 25 bp, Homo sapien
gtccacaaaaagtgtttgaggttct

SEQ ID NO: 276287 - DNA, 25 bp, Homo sapien
ccactaactgagaatggctgccttg

SEQ ID NO: 276288 - DNA, 25 bp, Homo sapien
tttgactgttactgtagaactgaag

SEQ ID NO: 276289 - DNA, 25 bp, Homo sapien
gataaagcgaattttggagttgttt

SEQ ID NO: 276290 - DNA, 25 bp, Homo sapien
ttttggagttgtttgtgtgatctac

SEQ ID NO: 276291 - DNA, 25 bp, Homo sapien
gttgtttgtgtgatctactagttac

SEQ ID NO: 276292 - DNA, 25 bp, Homo sapien
gtttgtgtgatctactagttactag

SEQ ID NO: 276293 - DNA, 25 bp, Homo sapien
aaatcacaggtttataatgcagcta

SEQ ID NO: 276294 - DNA, 25 bp, Homo sapien
caggtttataatgcagctaatggga

SEQ ID NO: 276295 - DNA, 25 bp, Homo sapien
gaaacagacttaggtggcatgatga

SEQ ID NO: 276296 - DNA, 25 bp, Homo sapien
ggcatgatgaggtcattcaagtcgt

SEQ ID NO: 276297 - DNA, 25 bp, Homo sapien
gaggtcattcaagtcgtaaaaattt

SEQ ID NO: 276298 - DNA, 25 bp, Homo sapien
gctgtccccaagaccaaaggagcta

SEQ ID NO: 276299 - DNA, 25 bp, Homo sapien
ggagctagagcttggttcaaatgat

SEQ ID NO: 276300 - DNA, 25 bp, Homo sapien
gaacacggaaatgcctccagtaagt

SEQ ID NO: 276301 - DNA, 25 bp, Homo sapien
ggttcaaatgatctccaagggccct

SEQ ID NO: 276302 - DNA, 25 bp, Homo sapien
caaatgatctccaagggcccttata

SEQ ID NO: 276303 - DNA, 25 bp, Homo sapien
tccaagggcccttataccccaggag

SEQ ID NO: 276304 - DNA, 25 bp, Homo sapien
tccaaacctaagaaccaggtgcatt

SEQ ID NO: 276305 - DNA, 25 bp, Homo sapien
agaatcagttattgccgggtgtggt

SEQ ID NO: 276306 - DNA, 25 bp, Homo sapien
cctccagtaagtacaggctgcaaaa

SEQ ID NO: 276307 - DNA, 25 bp, Homo sapien
aaatccccaggcaaaggactgtgtg

SEQ ID NO: 276308 - DNA, 25 bp, Homo sapien
gttctagtaattggagctgtcccca

SEQ ID NO: 276309 - DNA, 25 bp, Homo sapien
gggcctcatgctattgtgagtctcc

SEQ ID NO: 276310 - DNA, 25 bp, Homo sapien
tattgtgagtctccctgcagcccaa

SEQ ID NO: 276311 - DNA, 25 bp, Homo sapien
agcccaagtggaagcttggctccta

SEQ ID NO: 276312 - DNA, 25 bp, Homo sapien
ttggctcctaacaagcacaagctgc

SEQ ID NO: 276313 - DNA, 25 bp, Homo sapien
gcacaagctgccaattgttaccttc

SEQ ID NO: 276314 - DNA, 25 bp, Homo sapien
gccaattgttaccttcttctgagag

SEQ ID NO: 276315 - DNA, 25 bp, Homo sapien
accttcttctgagagccttgctaaa

SEQ ID NO: 276316 - DNA, 25 bp, Homo sapien
gtaactctgggaaaactcttatagg

SEQ ID NO: 276317 - DNA, 25 bp, Homo sapien
aaactcttataggttcctgaccatg

SEQ ID NO: 276318 - DNA, 25 bp, Homo sapien
gttcctgaccatgaatccatctttt

SEQ ID NO: 276319 - DNA, 25 bp, Homo sapien
gaagaaacatcctctaagcagattg

SEQ ID NO: 276320 - DNA, 25 bp, Homo sapien
gggggggcacattccagagagtggt

SEQ ID NO: 276321 - DNA, 25 bp, Homo sapien
gggggcacattccagagagtggtga

SEQ ID NO: 276322 - DNA, 25 bp, Homo sapien
tgaaccaattatgttcgggcggggt

SEQ ID NO: 276323 - DNA, 25 bp, Homo sapien
caattatgttcgggcggggtcttag

SEQ ID NO: 276324 - DNA, 25 bp, Homo sapien
tgttcgggcggggtcttagctgtga

SEQ ID NO: 276325 - DNA, 25 bp, Homo sapien
gttcgggcggggtcttagctgtgaa

SEQ ID NO: 276326 - DNA, 25 bp, Homo sapien
tcgggcggggtcttagctgtgaatc

SEQ ID NO: 276327 - DNA, 25 bp, Homo sapien
cgggcggggtcttagctgtgaatcc

SEQ ID NO: 276328 - DNA, 25 bp, Homo sapien
gggcggggtcttagctgtgaatcct

SEQ ID NO: 276329 - DNA, 25 bp, Homo sapien
ggcggggtcttagctgtgaatcctg

SEQ ID NO: 276330 - DNA, 25 bp, Homo sapien
cggggtcttagctgtgaatcctgaa

SEQ ID NO: 276331 - DNA, 25 bp, Homo sapien
gtttctatgagactttagttatgtt

SEQ ID NO: 276332 - DNA, 25 bp, Homo sapien
gtggaggaagaatgcactattcgat

SEQ ID NO: 276333 - DNA, 25 bp, Homo sapien
gcactattcgataaatgaccttggg

SEQ ID NO: 276334 - DNA, 25 bp, Homo sapien
gggataattgcttaccaattagaaa

SEQ ID NO: 276335 - DNA, 25 bp, Homo sapien
aaaattccatctccatgacaaccta

SEQ ID NO: 276336 - DNA, 25 bp, Homo sapien
attccatctccatgacaacctaaat

SEQ ID NO: 276337 - DNA, 25 bp, Homo sapien
atctccatgacaacctaaatgtaag

SEQ ID NO: 276338 - DNA, 25 bp, Homo sapien
taagaggcctctaacaatatagtca

SEQ ID NO: 276339 - DNA, 25 bp, Homo sapien
gaggcctctaacaatatagtcattt

SEQ ID NO: 276340 - DNA, 25 bp, Homo sapien
atagtcatttgaggcatgagccacc

SEQ ID NO: 276341 - DNA, 25 bp, Homo sapien
ccagccacaaattcatgtttctatg

SEQ ID NO: 276342 - DNA, 25 bp, Homo sapien
agctgaagctgagttttcgtttacc

SEQ ID NO: 276343 - DNA, 25 bp, Homo sapien
gctgaagctgagttttcgtttacct

SEQ ID NO: 276344 - DNA, 25 bp, Homo sapien
ctgaagctgagttttcgtttacctt

SEQ ID NO: 276345 - DNA, 25 bp, Homo sapien
tgaagctgagttttcgtttaccttg

SEQ ID NO: 276346 - DNA, 25 bp, Homo sapien
gaagctgagttttcgtttaccttgg

SEQ ID NO: 276347 - DNA, 25 bp, Homo sapien
agctgagttttcgtttaccttggag

SEQ ID NO: 276348 - DNA, 25 bp, Homo sapien
gctgagttttcgtttaccttggagc

SEQ ID NO: 276349 - DNA, 25 bp, Homo sapien
ctgagttttcgtttaccttggagct

SEQ ID NO: 276350 - DNA, 25 bp, Homo sapien
tgagttttcgtttaccttggagctt

SEQ ID NO: 276351 - DNA, 25 bp, Homo sapien
taccttggagcttttttatcctttg

SEQ ID NO: 276352 - DNA, 25 bp, Homo sapien
gcggccgcgaattcttttgcttttt

SEQ ID NO: 276353 - DNA, 25 bp, Homo sapien
ggaaaacacagatcctggtgccgaa

SEQ ID NO: 276354 - DNA, 25 bp, Homo sapien
aaacacagatcctggtgccgaacat

SEQ ID NO: 276355 - DNA, 25 bp, Homo sapien
acagatcctggtgccgaacatgagg

SEQ ID NO: 276356 - DNA, 25 bp, Homo sapien
atcctggtgccgaacatgaggacag

SEQ ID NO: 276357 - DNA, 25 bp, Homo sapien
gaacatgaggacagggcaggccgaa

SEQ ID NO: 276358 - DNA, 25 bp, Homo sapien
ctgggcctggatgctggagagtcat

SEQ ID NO: 276359 - DNA, 25 bp, Homo sapien
ggtgcttcagagtactctgggtgag

SEQ ID NO: 276360 - DNA, 25 bp, Homo sapien
ggagggaaagatggtgcccaccaca

SEQ ID NO: 276361 - DNA, 25 bp, Homo sapien
atggtgcccaccacatggaggccag

SEQ ID NO: 276362 - DNA, 25 bp, Homo sapien
aggccagcctaggtcttgtatgaaa

SEQ ID NO: 276363 - DNA, 25 bp, Homo sapien
agcctaggtcttgtatgaaacctgt

SEQ ID NO: 276364 - DNA, 25 bp, Homo sapien
ggcgacgcgcacacaccttgagtga

SEQ ID NO: 276365 - DNA, 25 bp, Homo sapien
gacgcgcacacaccttgagtgacag

SEQ ID NO: 276366 - DNA, 25 bp, Homo sapien
gcgcacacaccttgagtgacagcga

SEQ ID NO: 276367 - DNA, 25 bp, Homo sapien
acaccttgagtgacagcgacctctt

SEQ ID NO: 276368 - DNA, 25 bp, Homo sapien
accttgagtgacagcgacctcttct

SEQ ID NO: 276369 - DNA, 25 bp, Homo sapien
gcgacctcttctctacaggttttcc

SEQ ID NO: 276370 - DNA, 25 bp, Homo sapien
agcgtggccctagcgggcgttcggt

SEQ ID NO: 276371 - DNA, 25 bp, Homo sapien
tcggttttctttggaaatcgcggag

SEQ ID NO: 276372 - DNA, 25 bp, Homo sapien
aggaggcgcgagcaggctgtgagcc

SEQ ID NO: 276373 - DNA, 25 bp, Homo sapien
cctctccgtcgggagcagggcaaag

SEQ ID NO: 276374 - DNA, 25 bp, Homo sapien
gagcagggcaaaggcgccaggaaca

SEQ ID NO: 276375 - DNA, 25 bp, Homo sapien
gaagttaaggatctttcgccaggaa

SEQ ID NO: 276376 - DNA, 25 bp, Homo sapien
ttcgccaggaagattatcccagctt

SEQ ID NO: 276377 - DNA, 25 bp, Homo sapien
agattatcccagcttgttcaggagg

SEQ ID NO: 276378 - DNA, 25 bp, Homo sapien
ttcaggagggcttgatgtcctcacc

SEQ ID NO: 276379 - DNA, 25 bp, Homo sapien
tcctcacccgggtctgtataacaga

SEQ ID NO: 276380 - DNA, 25 bp, Homo sapien
agctcaagccacagagtccaggcca

SEQ ID NO: 276381 - DNA, 25 bp, Homo sapien
aggccacctcagagccaggaaatgc

SEQ ID NO: 276382 - DNA, 25 bp, Homo sapien
tcagagccaggaaatgcatcctccc

SEQ ID NO: 276383 - DNA, 25 bp, Homo sapien
cacctggactggctcagtgaggcta

SEQ ID NO: 276384 - DNA, 25 bp, Homo sapien
ggctcagtgaggctaattttataat

SEQ ID NO: 276385 - DNA, 25 bp, Homo sapien
ggctaattttataattctggctgat

SEQ ID NO: 276386 - DNA, 25 bp, Homo sapien
ggcccaggttcaactctagggaaag

SEQ ID NO: 276387 - DNA, 25 bp, Homo sapien
caggttcaactctagggaaaggcct

SEQ ID NO: 276388 - DNA, 25 bp, Homo sapien
caactctagggaaaggcctgttggc

SEQ ID NO: 276389 - DNA, 25 bp, Homo sapien
tctgagggacccgacgaggctggag

SEQ ID NO: 276390 - DNA, 25 bp, Homo sapien
ccgacgaggctggaggagggacttg

SEQ ID NO: 276391 - DNA, 25 bp, Homo sapien
cttgggggagcctagaaacagccta

SEQ ID NO: 276392 - DNA, 25 bp, Homo sapien
ttgagggacccactcgcatcgttgc

SEQ ID NO: 276393 - DNA, 25 bp, Homo sapien
ggaaattcttctcataaacaagcgt

SEQ ID NO: 276394 - DNA, 25 bp, Homo sapien
attcttctcataaacaagcgtccgg

SEQ ID NO: 276395 - DNA, 25 bp, Homo sapien
ttctcataaacaagcgtccggacct

SEQ ID NO: 276396 - DNA, 25 bp, Homo sapien
ataaacaagcgtccggacctgagcg

SEQ ID NO: 276397 - DNA, 25 bp, Homo sapien
atcttagatctcttgttgacagtgc

SEQ ID NO: 276398 - DNA, 25 bp, Homo sapien
agatctcttgttgacagtgcataaa

SEQ ID NO: 276399 - DNA, 25 bp, Homo sapien
gacagtgcataaaagttaccagtag

SEQ ID NO: 276400 - DNA, 25 bp, Homo sapien
gttaccagtagaggtcatacttgat

SEQ ID NO: 276401 - DNA, 25 bp, Homo sapien
gaggtcatacttgattaatattttc

SEQ ID NO: 276402 - DNA, 25 bp, Homo sapien
taatattttcatatcctcttttctg

SEQ ID NO: 276403 - DNA, 25 bp, Homo sapien
tcagtaaaactgtatcttggattgt

SEQ ID NO: 276404 - DNA, 25 bp, Homo sapien
gattgttacaagtggtctgtttgct

SEQ ID NO: 276405 - DNA, 25 bp, Homo sapien
aagtggtctgtttgctaccttctgt

SEQ ID NO: 276406 - DNA, 25 bp, Homo sapien
gaggctactgatggttgaattgaaa

SEQ ID NO: 276407 - DNA, 25 bp, Homo sapien
gtgtctttatggtaggagctcaata

SEQ ID NO: 276408 - DNA, 25 bp, Homo sapien
ttactgacagcccaatttcttccct

SEQ ID NO: 276409 - DNA, 25 bp, Homo sapien
aacatggctgagaactatccctcaa

SEQ ID NO: 276410 - DNA, 25 bp, Homo sapien
gaactatccctcaagataaggctaa

SEQ ID NO: 276411 - DNA, 25 bp, Homo sapien
aaggctaaccccaggatgtactgtt

SEQ ID NO: 276412 - DNA, 25 bp, Homo sapien
aggatgtactgttccacctcaactt

SEQ ID NO: 276413 - DNA, 25 bp, Homo sapien
tgttccacctcaactttctgttgac

SEQ ID NO: 276414 - DNA, 25 bp, Homo sapien
actttctgttgacttcatttacata

SEQ ID NO: 276415 - DNA, 25 bp, Homo sapien
ttgccacagcaaatgagagtgatgt

SEQ ID NO: 276416 - DNA, 25 bp, Homo sapien
aagattgttaactcaccttgtcagt

SEQ ID NO: 276417 - DNA, 25 bp, Homo sapien
gttaactcaccttgtcagtttccca

SEQ ID NO: 276418 - DNA, 25 bp, Homo sapien
agtttcccactatcttcttggattc

SEQ ID NO: 276419 - DNA, 25 bp, Homo sapien
agtagctatggcatgcactgggtcc

SEQ ID NO: 276420 - DNA, 25 bp, Homo sapien
gtagctatggcatgcactgggtccg

SEQ ID NO: 276421 - DNA, 25 bp, Homo sapien
tagctatggcatgcactgggtccgc

SEQ ID NO: 276422 - DNA, 25 bp, Homo sapien
ttcaccttcagtagctatggcatgc

SEQ ID NO: 276423 - DNA, 25 bp, Homo sapien
tcaccttcagtagctatggcatgca

SEQ ID NO: 276424 - DNA, 25 bp, Homo sapien
caccttcagtagctatggcatgcac

SEQ ID NO: 276425 - DNA, 25 bp, Homo sapien
accttcagtagctatggcatgcact

SEQ ID NO: 276426 - DNA, 25 bp, Homo sapien
ccttcagtagctatggcatgcactg

SEQ ID NO: 276427 - DNA, 25 bp, Homo sapien
cttcagtagctatggcatgcactgg

SEQ ID NO: 276428 - DNA, 25 bp, Homo sapien
ttcagtagctatggcatgcactggg

SEQ ID NO: 276429 - DNA, 25 bp, Homo sapien
cagtagctatggcatgcactgggtc

SEQ ID NO: 276430 - DNA, 25 bp, Homo sapien
atggagtcttgattgtacgtgcccc

SEQ ID NO: 276431 - DNA, 25 bp, Homo sapien
cttgattgtacgtgccccacttgca

SEQ ID NO: 276432 - DNA, 25 bp, Homo sapien
acagcctgccttgggttatatacca

SEQ ID NO: 276433 - DNA, 25 bp, Homo sapien
ctcattgggcaaagctttaaagtac

SEQ ID NO: 276434 - DNA, 25 bp, Homo sapien
aagaggaacacaacctcgctgtctc

SEQ ID NO: 276435 - DNA, 25 bp, Homo sapien
tcgctgtctcaaacagttccctaaa

SEQ ID NO: 276436 - DNA, 25 bp, Homo sapien
gtctcaaacagttccctaaatcaag

SEQ ID NO: 276437 - DNA, 25 bp, Homo sapien
aagatgttacattccctaggaggga

SEQ ID NO: 276438 - DNA, 25 bp, Homo sapien
aggccaacctgtttcaggcagttcc

SEQ ID NO: 276439 - DNA, 25 bp, Homo sapien
aggcagttcctccatatcaggatat

SEQ ID NO: 276440 - DNA, 25 bp, Homo sapien
ggatattgcattcccagtgcattct

SEQ ID NO: 276441 - DNA, 25 bp, Homo sapien
gtggactgcatctgccagcccagca

SEQ ID NO: 276442 - DNA, 25 bp, Homo sapien
gctccccagacacttaaccgaaggg

SEQ ID NO: 276443 - DNA, 25 bp, Homo sapien
tggactgcatctgccagcccagcat

SEQ ID NO: 276444 - DNA, 25 bp, Homo sapien
gactgcatctgccagcccagcatct

SEQ ID NO: 276445 - DNA, 25 bp, Homo sapien
tgtggccgcctgagctgtccccggg

SEQ ID NO: 276446 - DNA, 25 bp, Homo sapien
tgcgggctccagaaggcggtgtggg

SEQ ID NO: 276447 - DNA, 25 bp, Homo sapien
agcatcttcgtcatcttccacgaca

SEQ ID NO: 276448 - DNA, 25 bp, Homo sapien
tcgtcatcttccacgacacccaggc

SEQ ID NO: 276449 - DNA, 25 bp, Homo sapien
atcttccacgacacccaggcgctgc

SEQ ID NO: 276450 - DNA, 25 bp, Homo sapien
tcatcacctgcgagcacgtgccccg

SEQ ID NO: 276451 - DNA, 25 bp, Homo sapien
acctgcgagcacgtgccccgcgctt

SEQ ID NO: 276452 - DNA, 25 bp, Homo sapien
tctgaattacaatggacttgactcc

SEQ ID NO: 276453 - DNA, 25 bp, Homo sapien
acgctttcctaggagtcagggtctt

SEQ ID NO: 276454 - DNA, 25 bp, Homo sapien
cagggtctttggactcttctcgtca

SEQ ID NO: 276455 - DNA, 25 bp, Homo sapien
gactcttctcgtcattggagctcaa

SEQ ID NO: 276456 - DNA, 25 bp, Homo sapien
attggagctcaagtcaccagccaca

SEQ ID NO: 276457 - DNA, 25 bp, Homo sapien
accagccacacaaccagatgagagg

SEQ ID NO: 276458 - DNA, 25 bp, Homo sapien
gaggtcatctaagtagcagtgagca

SEQ ID NO: 276459 - DNA, 25 bp, Homo sapien
gcagtgagcattgcacggaacagat

SEQ ID NO: 276460 - DNA, 25 bp, Homo sapien
cagattcagatgagcattttcctta

SEQ ID NO: 276461 - DNA, 25 bp, Homo sapien
gagcattttccttatacaataccaa

SEQ ID NO: 276462 - DNA, 25 bp, Homo sapien
gcatcttattgtgcctttagaccag

SEQ ID NO: 276463 - DNA, 25 bp, Homo sapien
ggcttgtgatctgtgaaattccagg

SEQ ID NO: 276464 - DNA, 25 bp, Homo sapien
gatctgtgaaattccaggtgatgga

SEQ ID NO: 276465 - DNA, 25 bp, Homo sapien
ggtgatggatgcatccagtgtgcat

SEQ ID NO: 276466 - DNA, 25 bp, Homo sapien
agtgtgcatcactaagaggcccttt

SEQ ID NO: 276467 - DNA, 25 bp, Homo sapien
aagaggccctttcccagtggcctct

SEQ ID NO: 276468 - DNA, 25 bp, Homo sapien
ctggctgcaggctggttccagtgtg

SEQ ID NO: 276469 - DNA, 25 bp, Homo sapien
tccagtgtgaaagattatactgcct

SEQ ID NO: 276470 - DNA, 25 bp, Homo sapien
tgaaaataacttccccagtgagcag

SEQ ID NO: 276471 - DNA, 25 bp, Homo sapien
tgaaaaatgacgtttgtagttcttt

SEQ ID NO: 276472 - DNA, 25 bp, Homo sapien
gccagaaggagatgtcttgtgtgaa

SEQ ID NO: 276473 - DNA, 25 bp, Homo sapien
ggagatgtcttgtgtgaaggctaaa

SEQ ID NO: 276474 - DNA, 25 bp, Homo sapien
gaagaagcttcaagccctcctaaat

SEQ ID NO: 276475 - DNA, 25 bp, Homo sapien
gggctcagcaaaattgactcttcct

SEQ ID NO: 276476 - DNA, 25 bp, Homo sapien
agcaaaattgactcttccttatttg

SEQ ID NO: 276477 - DNA, 25 bp, Homo sapien
attgactcttccttatttgtttcca

SEQ ID NO: 276478 - DNA, 25 bp, Homo sapien
tgactcttccttatttgtttccatc

SEQ ID NO: 276479 - DNA, 25 bp, Homo sapien
tcttccttatttgtttccatccata

SEQ ID NO: 276480 - DNA, 25 bp, Homo sapien
gaacgtaacacatctcagcaccgag

SEQ ID NO: 276481 - DNA, 25 bp, Homo sapien
tcaagccctcctaaattacccaagg

SEQ ID NO: 276482 - DNA, 25 bp, Homo sapien
acacatctcagcaccgagctcttgt

SEQ ID NO: 276483 - DNA, 25 bp, Homo sapien
caaggaaggaggctactgtatcagt

SEQ ID NO: 276484 - DNA, 25 bp, Homo sapien
gaaggaggctactgtatcagtttct

SEQ ID NO: 276485 - DNA, 25 bp, Homo sapien
gtctcttcttcagactgggtaggga

SEQ ID NO: 276486 - DNA, 25 bp, Homo sapien
gaatatgatattttagggacaaagc

SEQ ID NO: 276487 - DNA, 25 bp, Homo sapien
acaaagctgaggactggttttaaat

SEQ ID NO: 276488 - DNA, 25 bp, Homo sapien
aatgctatcattctgctaaacggcc

SEQ ID NO: 276489 - DNA, 25 bp, Homo sapien
atcattctgctaaacggccccaaaa

SEQ ID NO: 276490 - DNA, 25 bp, Homo sapien
cggccccaaaacagtagaatttctg

SEQ ID NO: 276491 - DNA, 25 bp, Homo sapien
agtagaatttctgctcatgtcctag

SEQ ID NO: 276492 - DNA, 25 bp, Homo sapien
gctcatgtcctagcaggttcagaag

SEQ ID NO: 276493 - DNA, 25 bp, Homo sapien
ggttcagaagactgcagccaagttc

SEQ ID NO: 276494 - DNA, 25 bp, Homo sapien
gactgcagccaagttcagatgtaaa

SEQ ID NO: 276495 - DNA, 25 bp, Homo sapien
caagaagtagcacttttccaaagga

SEQ ID NO: 276496 - DNA, 25 bp, Homo sapien
gagttgcaccaacctggagtacagg

SEQ ID NO: 276497 - DNA, 25 bp, Homo sapien
gagtacaggcagatcccagcgagca

SEQ ID NO: 276498 - DNA, 25 bp, Homo sapien
agatcccagcgagcacttccaagta

SEQ ID NO: 276499 - DNA, 25 bp, Homo sapien
gagcacttccaagtactttaggacg

SEQ ID NO: 276500 - DNA, 25 bp, Homo sapien
ttcttcaggattgtcccacttgcca

SEQ ID NO: 276501 - DNA, 25 bp, Homo sapien
ttgccaccctttccagctgagctga

SEQ ID NO: 276502 - DNA, 25 bp, Homo sapien
agctgagctgataggaaccaatgaa

SEQ ID NO: 276503 - DNA, 25 bp, Homo sapien
gaaccaatgaaagtctaggcgatga

SEQ ID NO: 276504 - DNA, 25 bp, Homo sapien
gattttccgttacctcagggatcaa

SEQ ID NO: 276505 - DNA, 25 bp, Homo sapien
gaagccacagactccgaaggcatag

SEQ ID NO: 276506 - DNA, 25 bp, Homo sapien
taaacttgatcgcttctgggacttc

SEQ ID NO: 276507 - DNA, 25 bp, Homo sapien
aggagccggaacctcagggtcacca

SEQ ID NO: 276508 - DNA, 25 bp, Homo sapien
gccggaacctcagggtcaccaggtg

SEQ ID NO: 276509 - DNA, 25 bp, Homo sapien
actgaggggacctccgctctccaga

SEQ ID NO: 276510 - DNA, 25 bp, Homo sapien
acagccgctcggacgcccaaagtcg

SEQ ID NO: 276511 - DNA, 25 bp, Homo sapien
tgctgtgacaatgccctcttaccag

SEQ ID NO: 276512 - DNA, 25 bp, Homo sapien
tcttaccagcaccagcagcggaaag

SEQ ID NO: 276513 - DNA, 25 bp, Homo sapien
taccagcaccagcagcggaaagcaa

SEQ ID NO: 276514 - DNA, 25 bp, Homo sapien
gcaccagcagcggaaagcaatttca

SEQ ID NO: 276515 - DNA, 25 bp, Homo sapien
agcagcggaaagcaatttcaaccaa

SEQ ID NO: 276516 - DNA, 25 bp, Homo sapien
aagcaatttcaaccaacttcctccg

SEQ ID NO: 276517 - DNA, 25 bp, Homo sapien
tcaaccaacttcctccgcggtgggt

SEQ ID NO: 276518 - DNA, 25 bp, Homo sapien
tttccttcaaggtctgtcatatgag

SEQ ID NO: 276519 - DNA, 25 bp, Homo sapien
tcatatgagtcctccccttttacaa

SEQ ID NO: 276520 - DNA, 25 bp, Homo sapien
tccccttttacaacacttattatgg

SEQ ID NO: 276521 - DNA, 25 bp, Homo sapien
tatttttcaagttattcttcttaga

SEQ ID NO: 276522 - DNA, 25 bp, Homo sapien
tcttcttagatttgcagtacctact

SEQ ID NO: 276523 - DNA, 25 bp, Homo sapien
cagtacctactgaaatttgtgtttt

SEQ ID NO: 276524 - DNA, 25 bp, Homo sapien
gatatttaagtcacttgtccaatga

SEQ ID NO: 276525 - DNA, 25 bp, Homo sapien
gtccaatgatgtgtatgtctaagcc

SEQ ID NO: 276526 - DNA, 25 bp, Homo sapien
tgtctaagcctcatgtaccgatttg

SEQ ID NO: 276527 - DNA, 25 bp, Homo sapien
tgtaccgatttgaagtcagacttaa

SEQ ID NO: 276528 - DNA, 25 bp, Homo sapien
tgagactttttaatcggttcttcaa

SEQ ID NO: 276529 - DNA, 25 bp, Homo sapien
gtttttatttggttgtctccacctg

SEQ ID NO: 276530 - DNA, 25 bp, Homo sapien
ttatttggttgtctccacctgcttg

SEQ ID NO: 276531 - DNA, 25 bp, Homo sapien
cttggttagcaggtaggttctcctc

SEQ ID NO: 276532 - DNA, 25 bp, Homo sapien
agcaggtaggttctcctctctgtat

SEQ ID NO: 276533 - DNA, 25 bp, Homo sapien
ctctctgtattctacatctgaggct

SEQ ID NO: 276534 - DNA, 25 bp, Homo sapien
gtattctacatctgaggcttctctt

SEQ ID NO: 276535 - DNA, 25 bp, Homo sapien
tgaggcttctcttaatatatgctta

SEQ ID NO: 276536 - DNA, 25 bp, Homo sapien
aatatatgcttaatgctgccaaaga

SEQ ID NO: 276537 - DNA, 25 bp, Homo sapien
atgctgccaaagaggtgagctcacc

SEQ ID NO: 276538 - DNA, 25 bp, Homo sapien
tgagctcacctgagcagcctaagct

SEQ ID NO: 276539 - DNA, 25 bp, Homo sapien
acctgagcagcctaagctctgctgt

SEQ ID NO: 276540 - DNA, 25 bp, Homo sapien
taaccatcacctttgattatgcata

SEQ ID NO: 276541 - DNA, 25 bp, Homo sapien
gggtaagtgctcattgaagttcatg

SEQ ID NO: 276542 - DNA, 25 bp, Homo sapien
gaagttcatggctataaccattgca

SEQ ID NO: 276543 - DNA, 25 bp, Homo sapien
ataaccattgcaggataatctcact

SEQ ID NO: 276544 - DNA, 25 bp, Homo sapien
aatctcactgacatttggaatcctg

SEQ ID NO: 276545 - DNA, 25 bp, Homo sapien
ctgttagtaacagagcatagctctt

SEQ ID NO: 276546 - DNA, 25 bp, Homo sapien
gagctctgtattaacgagctactca

SEQ ID NO: 276547 - DNA, 25 bp, Homo sapien
gagctactcattgaggctgttccag

SEQ ID NO: 276548 - DNA, 25 bp, Homo sapien
gctgttccaggataagctggtcact

SEQ ID NO: 276549 - DNA, 25 bp, Homo sapien
agaagggaactcagcaatgccaagt

SEQ ID NO: 276550 - DNA, 25 bp, Homo sapien
agcaatgccaagtcttcctcacctg

SEQ ID NO: 276551 - DNA, 25 bp, Homo sapien
gaatgtattgctaatgttaagtaaa

SEQ ID NO: 276552 - DNA, 25 bp, Homo sapien
atacgcatgctgaaaaaacattcct

SEQ ID NO: 276553 - DNA, 25 bp, Homo sapien
cgcatgctgaaaaaacattcctcca

SEQ ID NO: 276554 - DNA, 25 bp, Homo sapien
ggttgaacagacatttatttatcct

SEQ ID NO: 276555 - DNA, 25 bp, Homo sapien
cttcagttcttcaattggcacttaa

SEQ ID NO: 276556 - DNA, 25 bp, Homo sapien
cagttcttcaattggcacttaaatt

SEQ ID NO: 276557 - DNA, 25 bp, Homo sapien
aattggcacttaaattgcagggtct

SEQ ID NO: 276558 - DNA, 25 bp, Homo sapien
cacttaaattgcagggtcttgagag

SEQ ID NO: 276559 - DNA, 25 bp, Homo sapien
gacatttatttatcctgcaaagcag

SEQ ID NO: 276560 - DNA, 25 bp, Homo sapien
ttatttatcctgcaaagcaggccaa

SEQ ID NO: 276561 - DNA, 25 bp, Homo sapien
caaagcaggccaataaacaatttta

SEQ ID NO: 276562 - DNA, 25 bp, Homo sapien
tgtattctggatatgaatcttttgt

SEQ ID NO: 276563 - DNA, 25 bp, Homo sapien
atacttttttacttattgatatctt

SEQ ID NO: 276564 - DNA, 25 bp, Homo sapien
atgctgaaaatcaaacgttatctgc

SEQ ID NO: 276565 - DNA, 25 bp, Homo sapien
caaacgttatctgcagtggtaacag

SEQ ID NO: 276566 - DNA, 25 bp, Homo sapien
atctgcagtggtaacagtctgactt

SEQ ID NO: 276567 - DNA, 25 bp, Homo sapien
gtggtaacagtctgacttctaaact

SEQ ID NO: 276568 - DNA, 25 bp, Homo sapien
gtaacagtctgacttctaaactgct

SEQ ID NO: 276569 - DNA, 25 bp, Homo sapien
gtctgacttctaaactgctatatgt

SEQ ID NO: 276570 - DNA, 25 bp, Homo sapien
gacttctaaactgctatatgtaata

SEQ ID NO: 276571 - DNA, 25 bp, Homo sapien
gtaatgattgttgatctcttttaat

SEQ ID NO: 276572 - DNA, 25 bp, Homo sapien
gttgatctcttttaatgaacagaat

SEQ ID NO: 276573 - DNA, 25 bp, Homo sapien
cctccttcctgaccttaggtctggg

SEQ ID NO: 276574 - DNA, 25 bp, Homo sapien
tccttcctgaccttaggtctgggca

SEQ ID NO: 276575 - DNA, 25 bp, Homo sapien
cttcctgaccttaggtctgggcaca

SEQ ID NO: 276576 - DNA, 25 bp, Homo sapien
ttcctgaccttaggtctgggcacag

SEQ ID NO: 276577 - DNA, 25 bp, Homo sapien
tcctgaccttaggtctgggcacagg

SEQ ID NO: 276578 - DNA, 25 bp, Homo sapien
cctgaccttaggtctgggcacagga

SEQ ID NO: 276579 - DNA, 25 bp, Homo sapien
gaccttaggtctgggcacaggagga

SEQ ID NO: 276580 - DNA, 25 bp, Homo sapien
attctcctcccgaagcatccctggg

SEQ ID NO: 276581 - DNA, 25 bp, Homo sapien
gggacactttgaggcctcattcctg

SEQ ID NO: 276582 - DNA, 25 bp, Homo sapien
gacactttgaggcctcattcctgcc

SEQ ID NO: 276583 - DNA, 25 bp, Homo sapien
actttgaggcctcattcctgcccct

SEQ ID NO: 276584 - DNA, 25 bp, Homo sapien
gagtactcagtgcataattatgatc

SEQ ID NO: 276585 - DNA, 25 bp, Homo sapien
atgaagttctctttcctaatggcac

SEQ ID NO: 276586 - DNA, 25 bp, Homo sapien
gttctctttcctaatggcacaagtg

SEQ ID NO: 276587 - DNA, 25 bp, Homo sapien
atggcacaagtggtaacccctaatt

SEQ ID NO: 276588 - DNA, 25 bp, Homo sapien
gtggtaacccctaattctctagcct

SEQ ID NO: 276589 - DNA, 25 bp, Homo sapien
aacccctaattctctagcctgcagg

SEQ ID NO: 276590 - DNA, 25 bp, Homo sapien
tcaccctctacttggtttaatattg

SEQ ID NO: 276591 - DNA, 25 bp, Homo sapien
ctacttggtttaatattgatctgga

SEQ ID NO: 276592 - DNA, 25 bp, Homo sapien
gaggcagtttcagatagaatctgta

SEQ ID NO: 276593 - DNA, 25 bp, Homo sapien
gaatctgtatgtggattttgctgta

SEQ ID NO: 276594 - DNA, 25 bp, Homo sapien
ataatagtacctacaagatgggttt

SEQ ID NO: 276595 - DNA, 25 bp, Homo sapien
ggcctctggaatgtgacacagaact

SEQ ID NO: 276596 - DNA, 25 bp, Homo sapien
tgacggtgttgatgtgtggagtccg

SEQ ID NO: 276597 - DNA, 25 bp, Homo sapien
ggtgttgatgtgtggagtccggtgc

SEQ ID NO: 276598 - DNA, 25 bp, Homo sapien
gtgttgatgtgtggagtccggtgcc

SEQ ID NO: 276599 - DNA, 25 bp, Homo sapien
tgttgatgtgtggagtccggtgcct

SEQ ID NO: 276600 - DNA, 25 bp, Homo sapien
gttgatgtgtggagtccggtgcctg

SEQ ID NO: 276601 - DNA, 25 bp, Homo sapien
ttgatgtgtggagtccggtgcctgg

SEQ ID NO: 276602 - DNA, 25 bp, Homo sapien
tgatgtgtggagtccggtgcctggt

SEQ ID NO: 276603 - DNA, 25 bp, Homo sapien
gatgtgtggagtccggtgcctggtt

SEQ ID NO: 276604 - DNA, 25 bp, Homo sapien
gtgtggagtccggtgcctggtttgg

SEQ ID NO: 276605 - DNA, 25 bp, Homo sapien
tgtggagtccggtgcctggtttggg

SEQ ID NO: 276606 - DNA, 25 bp, Homo sapien
gttatatttgaagtagccctggccc

SEQ ID NO: 276607 - DNA, 25 bp, Homo sapien
ttatatttgaagtagccctggccct

SEQ ID NO: 276608 - DNA, 25 bp, Homo sapien
tatatttgaagtagccctggcccta

SEQ ID NO: 276609 - DNA, 25 bp, Homo sapien
atatttgaagtagccctggccctag

SEQ ID NO: 276610 - DNA, 25 bp, Homo sapien
tttgaagtagccctggccctagttc

SEQ ID NO: 276611 - DNA, 25 bp, Homo sapien
tgaagtagccctggccctagttcta

SEQ ID NO: 276612 - DNA, 25 bp, Homo sapien
gtagccctggccctagttctatagg

SEQ ID NO: 276613 - DNA, 25 bp, Homo sapien
tagccctggccctagttctataggg

SEQ ID NO: 276614 - DNA, 25 bp, Homo sapien
ccctggccctagttctatagggctg

SEQ ID NO: 276615 - DNA, 25 bp, Homo sapien
cctagttctatagggctggctattt

SEQ ID NO: 276616 - DNA, 25 bp, Homo sapien
gttctatagggctggctatttaata

SEQ ID NO: 276617 - DNA, 25 bp, Homo sapien
aacacacctgctacattttacacat

SEQ ID NO: 276618 - DNA, 25 bp, Homo sapien
ctgctacattttacacatgtgttgg

SEQ ID NO: 276619 - DNA, 25 bp, Homo sapien
aagaatatctgagacgacgtttggg

SEQ ID NO: 276620 - DNA, 25 bp, Homo sapien
acgacgtttgggagcaatgctcttt

SEQ ID NO: 276621 - DNA, 25 bp, Homo sapien
ggagcaatgctctttaccacgttca

SEQ ID NO: 276622 - DNA, 25 bp, Homo sapien
agcagttgctggtgccttgtgggaa

SEQ ID NO: 276623 - DNA, 25 bp, Homo sapien
agtcacttcctgcttgacctgactc

SEQ ID NO: 276624 - DNA, 25 bp, Homo sapien
ttgacctgactcttcacatgtggct

SEQ ID NO: 276625 - DNA, 25 bp, Homo sapien
gactcttcacatgtggctgcttaat

SEQ ID NO: 276626 - DNA, 25 bp, Homo sapien
ttcacatgtggctgcttaattcctg

SEQ ID NO: 276627 - DNA, 25 bp, Homo sapien
tgcttctcctttactaacacacctg

SEQ ID NO: 276628 - DNA, 25 bp, Homo sapien
tatcaatgatgtatcctggaatgtg

SEQ ID NO: 276629 - DNA, 25 bp, Homo sapien
gtgaagatgtccctttatagttaaa

SEQ ID NO: 276630 - DNA, 25 bp, Homo sapien
tattgtaccattgttagaccttgaa

SEQ ID NO: 276631 - DNA, 25 bp, Homo sapien
gttagaccttgaatgagtccatgtt

SEQ ID NO: 276632 - DNA, 25 bp, Homo sapien
atgagtccatgttaccgtgtgtgtc

SEQ ID NO: 276633 - DNA, 25 bp, Homo sapien
ccatgttaccgtgtgtgtctgtata

SEQ ID NO: 276634 - DNA, 25 bp, Homo sapien
tctgtatatctatctgtagagaaag

SEQ ID NO: 276635 - DNA, 25 bp, Homo sapien
aaattgggcactgtctgtgttgcac

SEQ ID NO: 276636 - DNA, 25 bp, Homo sapien
tgtctgtgttgcaccactactgtat

SEQ ID NO: 276637 - DNA, 25 bp, Homo sapien
ttgcaccactactgtatcttttcga

SEQ ID NO: 276638 - DNA, 25 bp, Homo sapien
accactactgtatcttttcgaaaga

SEQ ID NO: 276639 - DNA, 25 bp, Homo sapien
tttgactttgagctctattcagaag

SEQ ID NO: 276640 - DNA, 25 bp, Homo sapien
tgattaacgaaagcaagggctggct

SEQ ID NO: 276641 - DNA, 25 bp, Homo sapien
gtaattctgcaacatgaagccttcc

SEQ ID NO: 276642 - DNA, 25 bp, Homo sapien
atgaagccttccagtattctccctt

SEQ ID NO: 276643 - DNA, 25 bp, Homo sapien
gtattctcccttcaccttgaacatt

SEQ ID NO: 276644 - DNA, 25 bp, Homo sapien
tgctcttcatttgctgcctggtagt

SEQ ID NO: 276645 - DNA, 25 bp, Homo sapien
tttgctgcctggtagtcagtctgga

SEQ ID NO: 276646 - DNA, 25 bp, Homo sapien
tagtcagtctggagctgctttcatc

SEQ ID NO: 276647 - DNA, 25 bp, Homo sapien
tgctttcatctctgttgctgccggt

SEQ ID NO: 276648 - DNA, 25 bp, Homo sapien
gtaataaataaacgctcacagaatg

SEQ ID NO: 276649 - DNA, 25 bp, Homo sapien
aatttgaatattcctagcctcccag

SEQ ID NO: 276650 - DNA, 25 bp, Homo sapien
gttcaaataagccttactcattagg

SEQ ID NO: 276651 - DNA, 25 bp, Homo sapien
tactcattaggccttaaattaaaag

SEQ ID NO: 276652 - DNA, 25 bp, Homo sapien
gaaacacaacacagacactacagat

SEQ ID NO: 276653 - DNA, 25 bp, Homo sapien
gagcattcagcttcttaagagtagc

SEQ ID NO: 276654 - DNA, 25 bp, Homo sapien
gcattcagcttcttaagagtagcat

SEQ ID NO: 276655 - DNA, 25 bp, Homo sapien
cttcttaagagtagcatgacatttt

SEQ ID NO: 276656 - DNA, 25 bp, Homo sapien
ttatctcaatagaatagccctcttt

SEQ ID NO: 276657 - DNA, 25 bp, Homo sapien
tttgtatcacagaagtatagcacct

SEQ ID NO: 276658 - DNA, 25 bp, Homo sapien
aagtatagcaccttcttacagagtt

SEQ ID NO: 276659 - DNA, 25 bp, Homo sapien
gtatagcaccttcttacagagtttt

SEQ ID NO: 276660 - DNA, 25 bp, Homo sapien
agcaccttcttacagagttttatat

SEQ ID NO: 276661 - DNA, 25 bp, Homo sapien
ttgatcggaatatgtactgtgaaga

SEQ ID NO: 276662 - DNA, 25 bp, Homo sapien
tgatcggaatatgtactgtgaagag

SEQ ID NO: 276663 - DNA, 25 bp, Homo sapien
gatcggaatatgtactgtgaagagt

SEQ ID NO: 276664 - DNA, 25 bp, Homo sapien
atcggaatatgtactgtgaagagta

SEQ ID NO: 276665 - DNA, 25 bp, Homo sapien
tcggaatatgtactgtgaagagtag

SEQ ID NO: 276666 - DNA, 25 bp, Homo sapien
gggaggtggtctgccggtgccctgc

SEQ ID NO: 276667 - DNA, 25 bp, Homo sapien
cctccactccgagctgggggggaat

SEQ ID NO: 276668 - DNA, 25 bp, Homo sapien
ggggggtagcaccacctccctgaca

SEQ ID NO: 276669 - DNA, 25 bp, Homo sapien
tgacaccctcccctgacctgactag

SEQ ID NO: 276670 - DNA, 25 bp, Homo sapien
acaccctcccctgacctgactaggg

SEQ ID NO: 276671 - DNA, 25 bp, Homo sapien
ttcaccccagcaccctttgaaccca

SEQ ID NO: 276672 - DNA, 25 bp, Homo sapien
aggcggcgcactaccagctcgtcta

SEQ ID NO: 276673 - DNA, 25 bp, Homo sapien
acacctgcaaggtctgcgggactag

SEQ ID NO: 276674 - DNA, 25 bp, Homo sapien
aggtctgcgggactaggtcctccaa

SEQ ID NO: 276675 - DNA, 25 bp, Homo sapien
gggactaggtcctccaagcgcatct

SEQ ID NO: 276676 - DNA, 25 bp, Homo sapien
aagctggcctatcaccaaggcgtgg

SEQ ID NO: 276677 - DNA, 25 bp, Homo sapien
aaggcgtggtcattgtgacctgccc

SEQ ID NO: 276678 - DNA, 25 bp, Homo sapien
tggtcattgtgacctgccccggctg

SEQ ID NO: 276679 - DNA, 25 bp, Homo sapien
agaaccaccatatcatcgctgacaa

SEQ ID NO: 276680 - DNA, 25 bp, Homo sapien
atatcatcgctgacaacctgggctg

SEQ ID NO: 276681 - DNA, 25 bp, Homo sapien
atcgctgacaacctgggctggttct

SEQ ID NO: 276682 - DNA, 25 bp, Homo sapien
ctgggctggttctcggacctgaatg

SEQ ID NO: 276683 - DNA, 25 bp, Homo sapien
cacgaggtcaatttatggttatcaa

SEQ ID NO: 276684 - DNA, 25 bp, Homo sapien
cgaggtcaatttatggttatcaaat

SEQ ID NO: 276685 - DNA, 25 bp, Homo sapien
gtgatctgccttagcctcactgctt

SEQ ID NO: 276686 - DNA, 25 bp, Homo sapien
tgatctgccttagcctcactgcttg

SEQ ID NO: 276687 - DNA, 25 bp, Homo sapien
ttgagactgagtgtcgctctatagc

SEQ ID NO: 276688 - DNA, 25 bp, Homo sapien
gagactgagtgtcgctctatagccc

SEQ ID NO: 276689 - DNA, 25 bp, Homo sapien
gactgagtgtcgctctatagcccag

SEQ ID NO: 276690 - DNA, 25 bp, Homo sapien
actgagtgtcgctctatagcccagg

SEQ ID NO: 276691 - DNA, 25 bp, Homo sapien
gagtgtagtgctcactgcgacttcc

SEQ ID NO: 276692 - DNA, 25 bp, Homo sapien
agtgtagtgctcactgcgacttccg

SEQ ID NO: 276693 - DNA, 25 bp, Homo sapien
tgtagtgctcactgcgacttccgcc

SEQ ID NO: 276694 - DNA, 25 bp, Homo sapien
cttttcttcctgtgatgccaccaca

SEQ ID NO: 276695 - DNA, 25 bp, Homo sapien
gatgccaccacacatgtaatcaatt

SEQ ID NO: 276696 - DNA, 25 bp, Homo sapien
tcccaaaatcatttactctgcctga

SEQ ID NO: 276697 - DNA, 25 bp, Homo sapien
atcaatttatataccttttctctta

SEQ ID NO: 276698 - DNA, 25 bp, Homo sapien
atttgcctgttgttagtatgtttca

SEQ ID NO: 276699 - DNA, 25 bp, Homo sapien
atttactctgcctgaaattggctac

SEQ ID NO: 276700 - DNA, 25 bp, Homo sapien
gagggaaagtcttcacttttctaca

SEQ ID NO: 276701 - DNA, 25 bp, Homo sapien
cttctaaggataagtctgtctgttt

SEQ ID NO: 276702 - DNA, 25 bp, Homo sapien
tgaaattggctacatccctggcttc

SEQ ID NO: 276703 - DNA, 25 bp, Homo sapien
ttccttctcgcctatgtagagggta

SEQ ID NO: 276704 - DNA, 25 bp, Homo sapien
atataagctcctaaatctcccggtt

SEQ ID NO: 276705 - DNA, 25 bp, Homo sapien
cagagccacatcctttatcgaggaa

SEQ ID NO: 276706 - DNA, 25 bp, Homo sapien
cacatcctttatcgaggaagctggg

SEQ ID NO: 276707 - DNA, 25 bp, Homo sapien
agaccctcagtctggagcctagatc

SEQ ID NO: 276708 - DNA, 25 bp, Homo sapien
ggagcctagatccactacgcactaa

SEQ ID NO: 276709 - DNA, 25 bp, Homo sapien
tacgcactaaccatgccctgtgaag

SEQ ID NO: 276710 - DNA, 25 bp, Homo sapien
ccatgccctgtgaagatggtcttcg

SEQ ID NO: 276711 - DNA, 25 bp, Homo sapien
ctggctccgcccttgggaacaggca

SEQ ID NO: 276712 - DNA, 25 bp, Homo sapien
gggcagcaaacatctaacagcttct

SEQ ID NO: 276713 - DNA, 25 bp, Homo sapien
caaacatctaacagcttctggttcc

SEQ ID NO: 276714 - DNA, 25 bp, Homo sapien
tgtggccctcactctttagctaaat

SEQ ID NO: 276715 - DNA, 25 bp, Homo sapien
ggccctcactctttagctaaatttc

SEQ ID NO: 276716 - DNA, 25 bp, Homo sapien
gtctgggaaaagagagtccttctag

SEQ ID NO: 276717 - DNA, 25 bp, Homo sapien
ttctagggacacaagcctcagggtc

SEQ ID NO: 276718 - DNA, 25 bp, Homo sapien
gtctccacataggaccagaagtttt

SEQ ID NO: 276719 - DNA, 25 bp, Homo sapien
atctacttaagtcagtaaggccagg

SEQ ID NO: 276720 - DNA, 25 bp, Homo sapien
caatagtcaaacctcagttcctcct

SEQ ID NO: 276721 - DNA, 25 bp, Homo sapien
gagttgatggcagttgccgctcagt

SEQ ID NO: 276722 - DNA, 25 bp, Homo sapien
cagctcacggctgatgtagggaaaa

SEQ ID NO: 276723 - DNA, 25 bp, Homo sapien
aacaactcaggtgtctagtctaatg

SEQ ID NO: 276724 - DNA, 25 bp, Homo sapien
gttgccgctcagttgatggcagtta

SEQ ID NO: 276725 - DNA, 25 bp, Homo sapien
ttgatggcagttaatgtccctccta

SEQ ID NO: 276726 - DNA, 25 bp, Homo sapien
agtggccagttcctgaagccttcaa

SEQ ID NO: 276727 - DNA, 25 bp, Homo sapien
aatatttgttgtgcctgtctttacc

SEQ ID NO: 276728 - DNA, 25 bp, Homo sapien
tgttgtgcctgtctttaccatgtaa

SEQ ID NO: 276729 - DNA, 25 bp, Homo sapien
gtgcctgtctttaccatgtaactta

SEQ ID NO: 276730 - DNA, 25 bp, Homo sapien
gtaacttaatgtttgcaaggccaga

SEQ ID NO: 276731 - DNA, 25 bp, Homo sapien
caaggccagagtgtttgaaagtttt

SEQ ID NO: 276732 - DNA, 25 bp, Homo sapien
ctttataattaccttgtcctttctg

SEQ ID NO: 276733 - DNA, 25 bp, Homo sapien
ccttgtcctttctggttgactatac

SEQ ID NO: 276734 - DNA, 25 bp, Homo sapien
ggttgactatactaggctaagccct

SEQ ID NO: 276735 - DNA, 25 bp, Homo sapien
gctaagccctcttaatagccatgag

SEQ ID NO: 276736 - DNA, 25 bp, Homo sapien
gccctcttaatagccatgagtgtaa

SEQ ID NO: 276737 - DNA, 25 bp, Homo sapien
atagccatgagtgtaaaatttagtt

SEQ ID NO: 276738 - DNA, 25 bp, Homo sapien
aacagtcccctttatcagcttttcg

SEQ ID NO: 276739 - DNA, 25 bp, Homo sapien
tttatcagcttttcggtcctcttcc

SEQ ID NO: 276740 - DNA, 25 bp, Homo sapien
ttccaccctggcgatcttctgataa

SEQ ID NO: 276741 - DNA, 25 bp, Homo sapien
ggcgatcttctgataagcacccaac

SEQ ID NO: 276742 - DNA, 25 bp, Homo sapien
agcacccaacagatatcattcgttt

SEQ ID NO: 276743 - DNA, 25 bp, Homo sapien
tcattcgttttaattacctagacaa

SEQ ID NO: 276744 - DNA, 25 bp, Homo sapien
tagacaaccgtgaccccatggagac

SEQ ID NO: 276745 - DNA, 25 bp, Homo sapien
gaccccatggagactgtccagcaag

SEQ ID NO: 276746 - DNA, 25 bp, Homo sapien
agacttcagccgacagtcacatgat

SEQ ID NO: 276747 - DNA, 25 bp, Homo sapien
attgcaggacagaactaggctaaga

SEQ ID NO: 276748 - DNA, 25 bp, Homo sapien
tcaatgatgtccctaagtgccagct

SEQ ID NO: 276749 - DNA, 25 bp, Homo sapien
aaagcaaaatcacctggatttcctt

SEQ ID NO: 276750 - DNA, 25 bp, Homo sapien
tcacctggatttccttgccatttgg

SEQ ID NO: 276751 - DNA, 25 bp, Homo sapien
gatttccttgccatttggctttcaa

SEQ ID NO: 276752 - DNA, 25 bp, Homo sapien
tggctttcaaatgtgctcagccaat

SEQ ID NO: 276753 - DNA, 25 bp, Homo sapien
gtgctcagccaatgacaggctggaa

SEQ ID NO: 276754 - DNA, 25 bp, Homo sapien
gatttgtgtacaagatcccttccac

SEQ ID NO: 276755 - DNA, 25 bp, Homo sapien
tcattacctgccatggtcctagcag

SEQ ID NO: 276756 - DNA, 25 bp, Homo sapien
atggtcctagcagtggctgttctta

SEQ ID NO: 276757 - DNA, 25 bp, Homo sapien
gtggctgttcttattatggccacaa

SEQ ID NO: 276758 - DNA, 25 bp, Homo sapien
agtgtggatcttggcataacagaca

SEQ ID NO: 276759 - DNA, 25 bp, Homo sapien
atccatccttccttttcctatactt

SEQ ID NO: 276760 - DNA, 25 bp, Homo sapien
gcgggctgtgttgccctgggcttta

SEQ ID NO: 276761 - DNA, 25 bp, Homo sapien
cagggttggcaggccggatcttgat

SEQ ID NO: 276762 - DNA, 25 bp, Homo sapien
ggaccatagggaaatgtcttctcaa

SEQ ID NO: 276763 - DNA, 25 bp, Homo sapien
gaccatagggaaatgtcttctcaat

SEQ ID NO: 276764 - DNA, 25 bp, Homo sapien
accatagggaaatgtcttctcaatt

SEQ ID NO: 276765 - DNA, 25 bp, Homo sapien
catagggaaatgtcttctcaattct

SEQ ID NO: 276766 - DNA, 25 bp, Homo sapien
tagggaaatgtcttctcaattcttt

SEQ ID NO: 276767 - DNA, 25 bp, Homo sapien
gggaaatgtcttctcaattctttta

SEQ ID NO: 276768 - DNA, 25 bp, Homo sapien
atgtcttctcaattcttttaatttc

SEQ ID NO: 276769 - DNA, 25 bp, Homo sapien
gtcttctcaattcttttaatttcat

SEQ ID NO: 276770 - DNA, 25 bp, Homo sapien
ctggtgactcacatgacggtgttga

SEQ ID NO: 276771 - DNA, 25 bp, Homo sapien
tcactacggctcacttatgccatag

SEQ ID NO: 276772 - DNA, 25 bp, Homo sapien
ttacttgtaatagaagcggctcttg

SEQ ID NO: 276773 - DNA, 25 bp, Homo sapien
tatgccatagggaacaatcaccaga

SEQ ID NO: 276774 - DNA, 25 bp, Homo sapien
aacatttacctggttggctgaccat

SEQ ID NO: 276775 - DNA, 25 bp, Homo sapien
ttggctgaccattcattggcctaac

SEQ ID NO: 276776 - DNA, 25 bp, Homo sapien
ggcctaaccagagccaacttaacaa

SEQ ID NO: 276777 - DNA, 25 bp, Homo sapien
gcggctcttgatcttattatagtga

SEQ ID NO: 276778 - DNA, 25 bp, Homo sapien
ttatagtgagatttccagacttctt

SEQ ID NO: 276779 - DNA, 25 bp, Homo sapien
agatagatcctgtttgtgttgtcct

SEQ ID NO: 276780 - DNA, 25 bp, Homo sapien
gtgttgtcctgccacgtagatgcat

SEQ ID NO: 276781 - DNA, 25 bp, Homo sapien
cacgtagatgcatttcacactcact

SEQ ID NO: 276782 - DNA, 25 bp, Homo sapien
ttatctttgcattttgctcaggtaa

SEQ ID NO: 276783 - DNA, 25 bp, Homo sapien
ttgctcaggtaaattatcttcccag

SEQ ID NO: 276784 - DNA, 25 bp, Homo sapien
gtaaattatcttcccagagtctaga

SEQ ID NO: 276785 - DNA, 25 bp, Homo sapien
gaaataaagatatccctgatcctgt

SEQ ID NO: 276786 - DNA, 25 bp, Homo sapien
atccctgatcctgtttaagagcata

SEQ ID NO: 276787 - DNA, 25 bp, Homo sapien
gacaattaatattcaggtgcttact

SEQ ID NO: 276788 - DNA, 25 bp, Homo sapien
attcaggtgcttacttttgagccaa

SEQ ID NO: 276789 - DNA, 25 bp, Homo sapien
acttttgagccaatatgtagcagag

SEQ ID NO: 276790 - DNA, 25 bp, Homo sapien
tatgtagactctttgtttgttaaat

SEQ ID NO: 276791 - DNA, 25 bp, Homo sapien
tgaagccaggtgatgcattgttagc

SEQ ID NO: 276792 - DNA, 25 bp, Homo sapien
gcattgttagctttgacaactgact

SEQ ID NO: 276793 - DNA, 25 bp, Homo sapien
ttctttcttgttccacaatgaattg

SEQ ID NO: 276794 - DNA, 25 bp, Homo sapien
gttccacaatgaattgcacatccat

SEQ ID NO: 276795 - DNA, 25 bp, Homo sapien
ccatcagagctgatagcctgttaat

SEQ ID NO: 276796 - DNA, 25 bp, Homo sapien
gatagcctgttaataagcactggtc

SEQ ID NO: 276797 - DNA, 25 bp, Homo sapien
taagcactggtctaacacagccaac

SEQ ID NO: 276798 - DNA, 25 bp, Homo sapien
tccacagcgccatattaatggagga

SEQ ID NO: 276799 - DNA, 25 bp, Homo sapien
gggaggaaggtgaaatctactgcat

SEQ ID NO: 276800 - DNA, 25 bp, Homo sapien
aatctactgcatgggattcaggaaa

SEQ ID NO: 276801 - DNA, 25 bp, Homo sapien
ttcaggaaacagttgtggttggtca

SEQ ID NO: 276802 - DNA, 25 bp, Homo sapien
ggttcttgaatgatctactataagg

SEQ ID NO: 276803 - DNA, 25 bp, Homo sapien
tactataaggcagggaaggttcatt

SEQ ID NO: 276804 - DNA, 25 bp, Homo sapien
gtttctacacggtctgaattgggtt

SEQ ID NO: 276805 - DNA, 25 bp, Homo sapien
gaattgggttcatttccgtttagca

SEQ ID NO: 276806 - DNA, 25 bp, Homo sapien
catttattgagctcccagcgtgggt

SEQ ID NO: 276807 - DNA, 25 bp, Homo sapien
agcgtgggtcacagaattcagtaaa

SEQ ID NO: 276808 - DNA, 25 bp, Homo sapien
tcagtaaacctgatcccgtgttcaa

SEQ ID NO: 276809 - DNA, 25 bp, Homo sapien
tgttcaaggtgctatattccgatgc

SEQ ID NO: 276810 - DNA, 25 bp, Homo sapien
gctatattccgatgcagggcagggc

SEQ ID NO: 276811 - DNA, 25 bp, Homo sapien
aatggtgaccacagcagtagcatgc

SEQ ID NO: 276812 - DNA, 25 bp, Homo sapien
tagcatgctaatagcctggtgggca

SEQ ID NO: 276813 - DNA, 25 bp, Homo sapien
taactcgaatttagccatcacgcat

SEQ ID NO: 276814 - DNA, 25 bp, Homo sapien
ttagccatcacgcattttcaaaaat

SEQ ID NO: 276815 - DNA, 25 bp, Homo sapien
tttgtttcaatcctgctcttttcta

SEQ ID NO: 276816 - DNA, 25 bp, Homo sapien
ttctaccatatcacccagtttccaa

SEQ ID NO: 276817 - DNA, 25 bp, Homo sapien
cccagtttccaaatcgttcagcaaa

SEQ ID NO: 276818 - DNA, 25 bp, Homo sapien
tggtcaatgggattaacctttccct

SEQ ID NO: 276819 - DNA, 25 bp, Homo sapien
ttttattctcaggaaatctcccttg

SEQ ID NO: 276820 - DNA, 25 bp, Homo sapien
aatctcccttgtccattttgcaaga

SEQ ID NO: 276821 - DNA, 25 bp, Homo sapien
gactgtgtgattctttctactgtta

SEQ ID NO: 276822 - DNA, 25 bp, Homo sapien
gtgattctttctactgttacaagga

SEQ ID NO: 276823 - DNA, 25 bp, Homo sapien
attattttacggatcatttctgagg

SEQ ID NO: 276824 - DNA, 25 bp, Homo sapien
aacttcattatgtaccaccccttgg

SEQ ID NO: 276825 - DNA, 25 bp, Homo sapien
gacagagccatttatccagacagga

SEQ ID NO: 276826 - DNA, 25 bp, Homo sapien
tccctcatgcgtttcttattgtcta

SEQ ID NO: 276827 - DNA, 25 bp, Homo sapien
aatttcctggcagctcatgattctg

SEQ ID NO: 276828 - DNA, 25 bp, Homo sapien
gaatagtgccactttggcattatga

SEQ ID NO: 276829 - DNA, 25 bp, Homo sapien
gaagcatggatacataactagggtt

SEQ ID NO: 276830 - DNA, 25 bp, Homo sapien
aactagggttttgtgtatgactaca

SEQ ID NO: 276831 - DNA, 25 bp, Homo sapien
gtatgactacaacgaaatgcagaat

SEQ ID NO: 276832 - DNA, 25 bp, Homo sapien
cagaatggtgtctccaaaaggtttc

SEQ ID NO: 276833 - DNA, 25 bp, Homo sapien
atgattctgctacactacaccatgc

SEQ ID NO: 276834 - DNA, 25 bp, Homo sapien
tacaccatgccatctcttgtgtgaa

SEQ ID NO: 276835 - DNA, 25 bp, Homo sapien
gccatctcttgtgtgaaaggacaga

SEQ ID NO: 276836 - DNA, 25 bp, Homo sapien
tggaggactatgtcatccctcatgc

SEQ ID NO: 276837 - DNA, 25 bp, Homo sapien
agaagaggccatgatatagtaatat

SEQ ID NO: 276838 - DNA, 25 bp, Homo sapien
tggtttaatgtggtatggttgtagt

SEQ ID NO: 276839 - DNA, 25 bp, Homo sapien
atggttgtagtgtgtggcggaaatt

SEQ ID NO: 276840 - DNA, 25 bp, Homo sapien
ggaagaattgtcaacttgcagggca

SEQ ID NO: 276841 - DNA, 25 bp, Homo sapien
agaattgtcaacttgcagggcagca

SEQ ID NO: 276842 - DNA, 25 bp, Homo sapien
aattgtcaacttgcagggcagcagg

SEQ ID NO: 276843 - DNA, 25 bp, Homo sapien
gccatttgtatttagctagaagaac

SEQ ID NO: 276844 - DNA, 25 bp, Homo sapien
gtatttagctagaagaacatggatt

SEQ ID NO: 276845 - DNA, 25 bp, Homo sapien
gaacatggattgaagcaatggatga

SEQ ID NO: 276846 - DNA, 25 bp, Homo sapien
tgatggatttcagagcaatttgtga

SEQ ID NO: 276847 - DNA, 25 bp, Homo sapien
cagagcaatttgtgaagtagaacca

SEQ ID NO: 276848 - DNA, 25 bp, Homo sapien
aacaacagttggtatgcctcctcca

SEQ ID NO: 276849 - DNA, 25 bp, Homo sapien
acttcccacaactgtggaagccagt

SEQ ID NO: 276850 - DNA, 25 bp, Homo sapien
gaagccagtgatccagatagcatag

SEQ ID NO: 276851 - DNA, 25 bp, Homo sapien
gatgggtgaaagctgctcaaccgca

SEQ ID NO: 276852 - DNA, 25 bp, Homo sapien
aaagctgctcaaccgcatcagacag

SEQ ID NO: 276853 - DNA, 25 bp, Homo sapien
gaggcaaagctatgtgcataccata

SEQ ID NO: 276854 - DNA, 25 bp, Homo sapien
gactgcattagttgtgttttgttat

SEQ ID NO: 276855 - DNA, 25 bp, Homo sapien
tgtgcataccatagctttttctccc

SEQ ID NO: 276856 - DNA, 25 bp, Homo sapien
caactaaactacattgttttcctgg

SEQ ID NO: 276857 - DNA, 25 bp, Homo sapien
gttttcctggcctctcatgcattta

SEQ ID NO: 276858 - DNA, 25 bp, Homo sapien
tggcctctcatgcatttaggttggg

SEQ ID NO: 276859 - DNA, 25 bp, Homo sapien
agaaggagcttggagcgggccagga

SEQ ID NO: 276860 - DNA, 25 bp, Homo sapien
gaaggagcttggagcgggccaggac

SEQ ID NO: 276861 - DNA, 25 bp, Homo sapien
aaggagcttggagcgggccaggaca

SEQ ID NO: 276862 - DNA, 25 bp, Homo sapien
aggagcttggagcgggccaggacag

SEQ ID NO: 276863 - DNA, 25 bp, Homo sapien
ggagcttggagcgggccaggacaga

SEQ ID NO: 276864 - DNA, 25 bp, Homo sapien
gagcttggagcgggccaggacagag

SEQ ID NO: 276865 - DNA, 25 bp, Homo sapien
agcttggagcgggccaggacagagg

SEQ ID NO: 276866 - DNA, 25 bp, Homo sapien
ccaggacagaggactatctcaaacg

SEQ ID NO: 276867 - DNA, 25 bp, Homo sapien
caggacagaggactatctcaaacgg

SEQ ID NO: 276868 - DNA, 25 bp, Homo sapien
aggacagaggactatctcaaacgga

SEQ ID NO: 276869 - DNA, 25 bp, Homo sapien
tagtacagcatggtgatctattgat

SEQ ID NO: 276870 - DNA, 25 bp, Homo sapien
tatattctttatttgctgacatagg

SEQ ID NO: 276871 - DNA, 25 bp, Homo sapien
gctgacataggaggtcaccgggtat

SEQ ID NO: 276872 - DNA, 25 bp, Homo sapien
ggtcaccgggtatataaagatgata

SEQ ID NO: 276873 - DNA, 25 bp, Homo sapien
aagcatatgtcctagttggcctaag

SEQ ID NO: 276874 - DNA, 25 bp, Homo sapien
agttggcctaagacagttctggttt

SEQ ID NO: 276875 - DNA, 25 bp, Homo sapien
cagttctggtttcatgcctgtagtc

SEQ ID NO: 276876 - DNA, 25 bp, Homo sapien
tttaatagtgcttcctttcactctc

SEQ ID NO: 276877 - DNA, 25 bp, Homo sapien
ttcactctcaggtatgtcccatttt

SEQ ID NO: 276878 - DNA, 25 bp, Homo sapien
caggtatgtcccattttgtataata

SEQ ID NO: 276879 - DNA, 25 bp, Homo sapien
taaattgtacgatcaccctatatat

SEQ ID NO: 276880 - DNA, 25 bp, Homo sapien
aaaactggttctatcattgcctcac

SEQ ID NO: 276881 - DNA, 25 bp, Homo sapien
ggttctatcattgcctcactttata

SEQ ID NO: 276882 - DNA, 25 bp, Homo sapien
tatcattgcctcactttatatatta

SEQ ID NO: 276883 - DNA, 25 bp, Homo sapien
tacagagttatacatactactttgt

SEQ ID NO: 276884 - DNA, 25 bp, Homo sapien
gggtgtgatgatactcaaaagtttt

SEQ ID NO: 276885 - DNA, 25 bp, Homo sapien
tttcttttcaaaactgaagtcaatg

SEQ ID NO: 276886 - DNA, 25 bp, Homo sapien
gtcaatgtgatagaatggtgagcat

SEQ ID NO: 276887 - DNA, 25 bp, Homo sapien
ggtgagcattattttggaaggccag

SEQ ID NO: 276888 - DNA, 25 bp, Homo sapien
aggaagaagtcagactcagcctgtg

SEQ ID NO: 276889 - DNA, 25 bp, Homo sapien
gggcgtgcagtaaacatgtaaaaag

SEQ ID NO: 276890 - DNA, 25 bp, Homo sapien
gattcttactaataagcaggtggat

SEQ ID NO: 276891 - DNA, 25 bp, Homo sapien
gaagcttcaagccctcctaaattac

SEQ ID NO: 276892 - DNA, 25 bp, Homo sapien
gggctcagcaaaattgactcttcct

SEQ ID NO: 276893 - DNA, 25 bp, Homo sapien
agcaaaattgactcttccttatttg

SEQ ID NO: 276894 - DNA, 25 bp, Homo sapien
attgactcttccttatttgtttcca

SEQ ID NO: 276895 - DNA, 25 bp, Homo sapien
tgactcttccttatttgtttccatc

SEQ ID NO: 276896 - DNA, 25 bp, Homo sapien
tcttccttatttgtttccatccata

SEQ ID NO: 276897 - DNA, 25 bp, Homo sapien
agaacgtaacacatctcagcaccga

SEQ ID NO: 276898 - DNA, 25 bp, Homo sapien
acgtaacacatctcagcaccgagct

SEQ ID NO: 276899 - DNA, 25 bp, Homo sapien
acacatctcagcaccgagctcttgt

SEQ ID NO: 276900 - DNA, 25 bp, Homo sapien
caaggaaggaggctactgtatcagt

SEQ ID NO: 276901 - DNA, 25 bp, Homo sapien
gaaggaggctactgtatcagtttct

SEQ ID NO: 276902 - DNA, 25 bp, Homo sapien
aggccagagaagtcagaaaggctcc

SEQ ID NO: 276903 - DNA, 25 bp, Homo sapien
agaagtcagaaaggctccatatttg

SEQ ID NO: 276904 - DNA, 25 bp, Homo sapien
gatatggtcaaataatggcgccctt

SEQ ID NO: 276905 - DNA, 25 bp, Homo sapien
atggtcaaataatggcgcccttaag

SEQ ID NO: 276906 - DNA, 25 bp, Homo sapien
taatggcgcccttaagagcagcctg

SEQ ID NO: 276907 - DNA, 25 bp, Homo sapien
gcgcccttaagagcagcctgtgaca

SEQ ID NO: 276908 - DNA, 25 bp, Homo sapien
gcccttaagagcagcctgtgacaat

SEQ ID NO: 276909 - DNA, 25 bp, Homo sapien
aagagcagcctgtgacaattgaagg

SEQ ID NO: 276910 - DNA, 25 bp, Homo sapien
gacaattgaagggtggtcgccatat

SEQ ID NO: 276911 - DNA, 25 bp, Homo sapien
aagggtggtcgccatattttcagaa

SEQ ID NO: 276912 - DNA, 25 bp, Homo sapien
ccatattttcagaaggcaccttccg

SEQ ID NO: 276913 - DNA, 25 bp, Homo sapien
ggagtgttctggctccttttattac

SEQ ID NO: 276914 - DNA, 25 bp, Homo sapien
gctgtcacttacatggtattcaggg

SEQ ID NO: 276915 - DNA, 25 bp, Homo sapien
aaattgaaactctctcacttaccct

SEQ ID NO: 276916 - DNA, 25 bp, Homo sapien
actctctcacttaccctgaaaaaga

SEQ ID NO: 276917 - DNA, 25 bp, Homo sapien
tgactgtgagcataacattgttact

SEQ ID NO: 276918 - DNA, 25 bp, Homo sapien
ttgttacttcattcaagacatggaa

SEQ ID NO: 276919 - DNA, 25 bp, Homo sapien
acatggtattcagggaggacacaga

SEQ ID NO: 276920 - DNA, 25 bp, Homo sapien
aaagggttaattagtgctgctcaca

SEQ ID NO: 276921 - DNA, 25 bp, Homo sapien
gtgctgctcacaaaatagttctact

SEQ ID NO: 276922 - DNA, 25 bp, Homo sapien
agaggatctgtgagcagcctgcagc

SEQ ID NO: 276923 - DNA, 25 bp, Homo sapien
gagcagcctgcagccaagctttgag

SEQ ID NO: 276924 - DNA, 25 bp, Homo sapien
tcttcctttgattctgtcaatgttt

SEQ ID NO: 276925 - DNA, 25 bp, Homo sapien
tttgattctgtcaatgtttgtttca

SEQ ID NO: 276926 - DNA, 25 bp, Homo sapien
ctgatgtttggtgcatatatattac

SEQ ID NO: 276927 - DNA, 25 bp, Homo sapien
atatattacatcttggtgaattttc

SEQ ID NO: 276928 - DNA, 25 bp, Homo sapien
aaattataggatgtctgggatttcc

SEQ ID NO: 276929 - DNA, 25 bp, Homo sapien
ggatgtctgggatttcctttgaatc

SEQ ID NO: 276930 - DNA, 25 bp, Homo sapien
ctgggatttcctttgaatccgtggg

SEQ ID NO: 276931 - DNA, 25 bp, Homo sapien
gggctgggagtaactataaatgaaa

SEQ ID NO: 276932 - DNA, 25 bp, Homo sapien
aggctgcaaggataggtacacacag

SEQ ID NO: 276933 - DNA, 25 bp, Homo sapien
aagcagggcttggagcagatggtaa

SEQ ID NO: 276934 - DNA, 25 bp, Homo sapien
gtaaagattgttggcttttccagcc

SEQ ID NO: 276935 - DNA, 25 bp, Homo sapien
tgggacctaggagtttgcttctgat

SEQ ID NO: 276936 - DNA, 25 bp, Homo sapien
taggagtttgcttctgatagggtca

SEQ ID NO: 276937 - DNA, 25 bp, Homo sapien
tgatagggtcagctttcccatttcc

SEQ ID NO: 276938 - DNA, 25 bp, Homo sapien
tttcccatttcccttcaatgcttgg

SEQ ID NO: 276939 - DNA, 25 bp, Homo sapien
tttcccttcaatgcttgggaacctt

SEQ ID NO: 276940 - DNA, 25 bp, Homo sapien
gaccttgtggcttggctggaatcca

SEQ ID NO: 276941 - DNA, 25 bp, Homo sapien
ggctggaatccaggactgtattttc

SEQ ID NO: 276942 - DNA, 25 bp, Homo sapien
gaagaacctgcagattcttccatcc

SEQ ID NO: 276943 - DNA, 25 bp, Homo sapien
gaaggacgtggcatccaagctgagc

SEQ ID NO: 276944 - DNA, 25 bp, Homo sapien
gctgtcctcccttcatttctgtgga

SEQ ID NO: 276945 - DNA, 25 bp, Homo sapien
cttcatttctgtggaccttggaggc

SEQ ID NO: 276946 - DNA, 25 bp, Homo sapien
ggcagagcacactcagcaggataga

SEQ ID NO: 276947 - DNA, 25 bp, Homo sapien
gatagaggcagtgcagccacagctc

SEQ ID NO: 276948 - DNA, 25 bp, Homo sapien
tcggcctcagcgtcaccctgagatt

SEQ ID NO: 276949 - DNA, 25 bp, Homo sapien
agacacagtgcgctagtacggctgt

SEQ ID NO: 276950 - DNA, 25 bp, Homo sapien
cgctagtacggctgtccggaggtca

SEQ ID NO: 276951 - DNA, 25 bp, Homo sapien
tgtccggaggtcagcctgatttcaa

SEQ ID NO: 276952 - DNA, 25 bp, Homo sapien
ggtcagcctgatttcaacccaggtg

SEQ ID NO: 276953 - DNA, 25 bp, Homo sapien
ctggccagcagtgaatgtaggagat

SEQ ID NO: 276954 - DNA, 25 bp, Homo sapien
attgtgcaagtgactttctctcgac

SEQ ID NO: 276955 - DNA, 25 bp, Homo sapien
aagtgactttctctcgactctgatt

SEQ ID NO: 276956 - DNA, 25 bp, Homo sapien
ctttctctcgactctgattttatta

SEQ ID NO: 276957 - DNA, 25 bp, Homo sapien
tgtgaccaatggcttcattttgaag

SEQ ID NO: 276958 - DNA, 25 bp, Homo sapien
aagccacagaagatacacttccgca

SEQ ID NO: 276959 - DNA, 25 bp, Homo sapien
gatacacttccgcaagatatcttca

SEQ ID NO: 276960 - DNA, 25 bp, Homo sapien
acacttccgcaagatatcttcattt

SEQ ID NO: 276961 - DNA, 25 bp, Homo sapien
gaaagttacaactgtgttagactaa

SEQ ID NO: 276962 - DNA, 25 bp, Homo sapien
gaaatttttccttctaaggtcagtg

SEQ ID NO: 276963 - DNA, 25 bp, Homo sapien
ttccttctaaggtcagtgagtgttg

SEQ ID NO: 276964 - DNA, 25 bp, Homo sapien
taaggtcagtgagtgttgttgctac

SEQ ID NO: 276965 - DNA, 25 bp, Homo sapien
gtgagtgttgttgctactgaaatga

SEQ ID NO: 276966 - DNA, 25 bp, Homo sapien
tgcaaaggtgaagccacctcaagat

SEQ ID NO: 276967 - DNA, 25 bp, Homo sapien
aaaggtgaagccacctcaagatgaa

SEQ ID NO: 276968 - DNA, 25 bp, Homo sapien
ggccgggtcgcaagaagaccctgac

SEQ ID NO: 276969 - DNA, 25 bp, Homo sapien
cgggtcgcaagaagaccctgaccgt

SEQ ID NO: 276970 - DNA, 25 bp, Homo sapien
gtttcagctgtattttcgaacccct

SEQ ID NO: 276971 - DNA, 25 bp, Homo sapien
tcagctgtattttcgaacccctgtg

SEQ ID NO: 276972 - DNA, 25 bp, Homo sapien
tgtattttcgaacccctgtgcttgg

SEQ ID NO: 276973 - DNA, 25 bp, Homo sapien
ttttcgaacccctgtgcttggccga

SEQ ID NO: 276974 - DNA, 25 bp, Homo sapien
tcgaacccctgtgcttggccgaggg

SEQ ID NO: 276975 - DNA, 25 bp, Homo sapien
tggccgaggggttcccaaggctcca

SEQ ID NO: 276976 - DNA, 25 bp, Homo sapien
caaggctccactccgccttggaggg

SEQ ID NO: 276977 - DNA, 25 bp, Homo sapien
tgcggaagcccggaggtgacctggg

SEQ ID NO: 276978 - DNA, 25 bp, Homo sapien
gcctttgaagacagcgcgggactcg

SEQ ID NO: 276979 - DNA, 25 bp, Homo sapien
gttaagacaggccttccctggagtc

SEQ ID NO: 276980 - DNA, 25 bp, Homo sapien
ctggagtcctgttactatctcttaa

SEQ ID NO: 276981 - DNA, 25 bp, Homo sapien
atctcttaatagttatgtgccacag

SEQ ID NO: 276982 - DNA, 25 bp, Homo sapien
tatgtgccacagagtgatacacttt

SEQ ID NO: 276983 - DNA, 25 bp, Homo sapien
gggcccagtgttctcatgtatgtag

SEQ ID NO: 276984 - DNA, 25 bp, Homo sapien
gtatgtagtcatacctacctttcta

SEQ ID NO: 276985 - DNA, 25 bp, Homo sapien
cctgtttgtcagtctccattgaata

SEQ ID NO: 276986 - DNA, 25 bp, Homo sapien
gaagtgctcagtattacctattacc

SEQ ID NO: 276987 - DNA, 25 bp, Homo sapien
gtattacctattacctggcatcaaa

SEQ ID NO: 276988 - DNA, 25 bp, Homo sapien
gaatacatatgctcttgcttcctgc

SEQ ID NO: 276989 - DNA, 25 bp, Homo sapien
accgtggaaggtcttgcagtacaaa

SEQ ID NO: 276990 - DNA, 25 bp, Homo sapien
tcgcatcttcccaaacggtgtctcg

SEQ ID NO: 276991 - DNA, 25 bp, Homo sapien
gcatcttcccaaacggtgtctcgtc

SEQ ID NO: 276992 - DNA, 25 bp, Homo sapien
caaacggtgtctcgtccagcctggc

SEQ ID NO: 276993 - DNA, 25 bp, Homo sapien
ggtgtctcgtccagcctggcccagg

SEQ ID NO: 276994 - DNA, 25 bp, Homo sapien
gagcagtcgatgacggcgaccccag

SEQ ID NO: 276995 - DNA, 25 bp, Homo sapien
tcgatgacggcgaccccagactgcg

SEQ ID NO: 276996 - DNA, 25 bp, Homo sapien
agactgcgccaccagctgtctgtct

SEQ ID NO: 276997 - DNA, 25 bp, Homo sapien
gggacgcgtactgcttgcccacggg

SEQ ID NO: 276998 - DNA, 25 bp, Homo sapien
cagaccgccgaatctgtggcccagg

SEQ ID NO: 276999 - DNA, 25 bp, Homo sapien
gaccgccgaatctgtggcccaggcg

SEQ ID NO: 277000 - DNA, 25 bp, Homo sapien
agtggcccaactcccacatggccag

SEQ ID NO: 277001 - DNA, 25 bp, Homo sapien
agatttgctcattcagttgttatta

SEQ ID NO: 277002 - DNA, 25 bp, Homo sapien
aagatccttcagagcaacgattgca

SEQ ID NO: 277003 - DNA, 25 bp, Homo sapien
gaagcagccttctgatctgaggacc

SEQ ID NO: 277004 - DNA, 25 bp, Homo sapien
tgcagatcagatattggccctcctg

SEQ ID NO: 277005 - DNA, 25 bp, Homo sapien
gcctggctctgttcatcactacaga

SEQ ID NO: 277006 - DNA, 25 bp, Homo sapien
gagaccccaatgaacacctgcagct

SEQ ID NO: 277007 - DNA, 25 bp, Homo sapien
aaccccagtcccctgacagaggagt

SEQ ID NO: 277008 - DNA, 25 bp, Homo sapien
agaggagtccttcctcaatgtccag

SEQ ID NO: 277009 - DNA, 25 bp, Homo sapien
ttcctcaatgtccagcaatgctttg

SEQ ID NO: 277010 - DNA, 25 bp, Homo sapien
caatgctttgccaatgtctccgtga

SEQ ID NO: 277011 - DNA, 25 bp, Homo sapien
gtctccgtgacagaaagatttgctc

SEQ ID NO: 277012 - DNA, 25 bp, Homo sapien
aaggaaaagtacttatcagccaatt

SEQ ID NO: 277013 - DNA, 25 bp, Homo sapien
ttaagtgcctattaaagctaagcaa

SEQ ID NO: 277014 - DNA, 25 bp, Homo sapien
aagcaaaatgccaaatactccctaa

SEQ ID NO: 277015 - DNA, 25 bp, Homo sapien
atactccctaacctcatacagaata

SEQ ID NO: 277016 - DNA, 25 bp, Homo sapien
tatttcccattttccaggtactgtg

SEQ ID NO: 277017 - DNA, 25 bp, Homo sapien
aacctcatacagaatacaggcaatg

SEQ ID NO: 277018 - DNA, 25 bp, Homo sapien
gaaggtagatattaacccaataatc

SEQ ID NO: 277019 - DNA, 25 bp, Homo sapien
cccattttccaggtactgtggttag

SEQ ID NO: 277020 - DNA, 25 bp, Homo sapien
gaacagacaggattcctgacctcct

SEQ ID NO: 277021 - DNA, 25 bp, Homo sapien
gattcctgacctcctggagtttaga

SEQ ID NO: 277022 - DNA, 25 bp, Homo sapien
gacctcctggagtttagagtgaaga

SEQ ID NO: 277023 - DNA, 25 bp, Homo sapien
gctgaacttgaaacgttttagcaga

SEQ ID NO: 277024 - DNA, 25 bp, Homo sapien
atatgtgaaagttcattgtggtcat

SEQ ID NO: 277025 - DNA, 25 bp, Homo sapien
aagttcattgtggtcatggtgagaa

SEQ ID NO: 277026 - DNA, 25 bp, Homo sapien
cattgtggtcatggtgagaaaacta

SEQ ID NO: 277027 - DNA, 25 bp, Homo sapien
aacaatcttcagatggcttgaacac

SEQ ID NO: 277028 - DNA, 25 bp, Homo sapien
tcttcagatggcttgaacacgtgcc

SEQ ID NO: 277029 - DNA, 25 bp, Homo sapien
gcttgaacacgtgccattatagtat

SEQ ID NO: 277030 - DNA, 25 bp, Homo sapien
acacgtgccattatagtatctaaca

SEQ ID NO: 277031 - DNA, 25 bp, Homo sapien
atagtatctaacaaaaagtggcata

SEQ ID NO: 277032 - DNA, 25 bp, Homo sapien
aatattacaaaacatccaacactag

SEQ ID NO: 277033 - DNA, 25 bp, Homo sapien
aacactagaaagcaatgactaacat

SEQ ID NO: 277034 - DNA, 25 bp, Homo sapien
aggtacctggacactgacaacttga

SEQ ID NO: 277035 - DNA, 25 bp, Homo sapien
tggacactgacaacttgagccctac

SEQ ID NO: 277036 - DNA, 25 bp, Homo sapien
acttgagccctaccaaggaaacaag

SEQ ID NO: 277037 - DNA, 25 bp, Homo sapien
aacaagggctggtataggtgcaaac

SEQ ID NO: 277038 - DNA, 25 bp, Homo sapien
ataggtgcaaacctctcatctgcca

SEQ ID NO: 277039 - DNA, 25 bp, Homo sapien
gtttcaaagactgggtcaactgcct

SEQ ID NO: 277040 - DNA, 25 bp, Homo sapien
aaagactgggtcaactgcctgggct

SEQ ID NO: 277041 - DNA, 25 bp, Homo sapien
tgggtcaactgcctgggcttcttcg

SEQ ID NO: 277042 - DNA, 25 bp, Homo sapien
tcgcctacctgcactttttaacaaa

SEQ ID NO: 277043 - DNA, 25 bp, Homo sapien
gtcgacggccaatgccatgacacag

SEQ ID NO: 277044 - DNA, 25 bp, Homo sapien
aatgccatgacacaggccatcagcc

SEQ ID NO: 277045 - DNA, 25 bp, Homo sapien
accagaatgacaaatgttcacacat

SEQ ID NO: 277046 - DNA, 25 bp, Homo sapien
gttcacacatagttggtagcgttcg

SEQ ID NO: 277047 - DNA, 25 bp, Homo sapien
tagttggtagcgttcgaagagtcaa

SEQ ID NO: 277048 - DNA, 25 bp, Homo sapien
gagtcaagaggagcggacgtattct

SEQ ID NO: 277049 - DNA, 25 bp, Homo sapien
ggacgtattctctaaggagccagga

SEQ ID NO: 277050 - DNA, 25 bp, Homo sapien
gaaagtctgtttgcagtgtgttcat

SEQ ID NO: 277051 - DNA, 25 bp, Homo sapien
agtgtgttcattttctccctagtag

SEQ ID NO: 277052 - DNA, 25 bp, Homo sapien
tccctagtaggtcttgtcattgcca

SEQ ID NO: 277053 - DNA, 25 bp, Homo sapien
ttgtcattgccaaccaatctggtga

SEQ ID NO: 277054 - DNA, 25 bp, Homo sapien
caatctggtgaactatctcctcctt

SEQ ID NO: 277055 - DNA, 25 bp, Homo sapien
aagctggattctttccggtatacct

SEQ ID NO: 277056 - DNA, 25 bp, Homo sapien
tgcccttgggtgtccttggcacaag

SEQ ID NO: 277057 - DNA, 25 bp, Homo sapien
aggcaggctaggctgcaccagcttc

SEQ ID NO: 277058 - DNA, 25 bp, Homo sapien
aggtgccattcccacaccatctgaa

SEQ ID NO: 277059 - DNA, 25 bp, Homo sapien
ctgaatcactgatttcctcgcaatc

SEQ ID NO: 277060 - DNA, 25 bp, Homo sapien
atttcctcgcaatcagacgctatct

SEQ ID NO: 277061 - DNA, 25 bp, Homo sapien
gacgctatcttccagttaatcactt

SEQ ID NO: 277062 - DNA, 25 bp, Homo sapien
taatcacttcgcttgtatttaacat

SEQ ID NO: 277063 - DNA, 25 bp, Homo sapien
accctttcattatcacatacagctg

SEQ ID NO: 277064 - DNA, 25 bp, Homo sapien
ggacctgtaaactgtgaggctggac

SEQ ID NO: 277065 - DNA, 25 bp, Homo sapien
gaggctggaccagttatgtcaaatc

SEQ ID NO: 277066 - DNA, 25 bp, Homo sapien
ccagttatgtcaaatctgtcctccc

SEQ ID NO: 277067 - DNA, 25 bp, Homo sapien
aaacccataggcaccaaaatcctgg

SEQ ID NO: 277068 - DNA, 25 bp, Homo sapien
gcaccaaaatcctggctgtttacat

SEQ ID NO: 277069 - DNA, 25 bp, Homo sapien
gtttacatttctgcagatttgggaa

SEQ ID NO: 277070 - DNA, 25 bp, Homo sapien
tgcagatttgggaattacccatctg

SEQ ID NO: 277071 - DNA, 25 bp, Homo sapien
gtatttcctcctagtaaacacaata

SEQ ID NO: 277072 - DNA, 25 bp, Homo sapien
gagatataaaatcctggcaaacata

SEQ ID NO: 277073 - DNA, 25 bp, Homo sapien
aaatcctggcaaacataatcgtggt

SEQ ID NO: 277074 - DNA, 25 bp, Homo sapien
cctggcaaacataatcgtggttaaa

SEQ ID NO: 277075 - DNA, 25 bp, Homo sapien
ttaatctgggccctttgggatctgt

SEQ ID NO: 277076 - DNA, 25 bp, Homo sapien
tgggatctgtcccttcaaaggcagg

SEQ ID NO: 277077 - DNA, 25 bp, Homo sapien
ctgtcccttcaaaggcaggtgagtt

SEQ ID NO: 277078 - DNA, 25 bp, Homo sapien
ttgatcggaatatgtactgtgaaga

SEQ ID NO: 277079 - DNA, 25 bp, Homo sapien
tgatcggaatatgtactgtgaagag

SEQ ID NO: 277080 - DNA, 25 bp, Homo sapien
gatcggaatatgtactgtgaagagt

SEQ ID NO: 277081 - DNA, 25 bp, Homo sapien
atcggaatatgtactgtgaagagta

SEQ ID NO: 277082 - DNA, 25 bp, Homo sapien
tcggaatatgtactgtgaagagtag

SEQ ID NO: 277083 - DNA, 25 bp, Homo sapien
tggggaggtggtctgccggtgccct

SEQ ID NO: 277084 - DNA, 25 bp, Homo sapien
tacccctccactccgagctgggggg

SEQ ID NO: 277085 - DNA, 25 bp, Homo sapien
gtagcaccacctccctgacaccctc

SEQ ID NO: 277086 - DNA, 25 bp, Homo sapien
tgacaccctcccctgacctgactag

SEQ ID NO: 277087 - DNA, 25 bp, Homo sapien
acaccctcccctgacctgactaggg

SEQ ID NO: 277088 - DNA, 25 bp, Homo sapien
ttcaccccagcaccctttgaaccca

SEQ ID NO: 277089 - DNA, 25 bp, Homo sapien
gcaacccatctttcttcagtatgta

SEQ ID NO: 277090 - DNA, 25 bp, Homo sapien
ttcttcagtatgtatgttctgtaca

SEQ ID NO: 277091 - DNA, 25 bp, Homo sapien
tgtacatacttatcggagcgcgcca

SEQ ID NO: 277092 - DNA, 25 bp, Homo sapien
atcggagcgcgccagtaagtatcag

SEQ ID NO: 277093 - DNA, 25 bp, Homo sapien
ttacatcatcagatcagcatgtgct

SEQ ID NO: 277094 - DNA, 25 bp, Homo sapien
agcatgtgctatactccctgcaaga

SEQ ID NO: 277095 - DNA, 25 bp, Homo sapien
ctccctgcaagaaatatactgacat

SEQ ID NO: 277096 - DNA, 25 bp, Homo sapien
tactgacatgaacaggcagttcttg

SEQ ID NO: 277097 - DNA, 25 bp, Homo sapien
aaagagcatttctttaagtacctgg

SEQ ID NO: 277098 - DNA, 25 bp, Homo sapien
tacagctctcagtgatcagcaggga

SEQ ID NO: 277099 - DNA, 25 bp, Homo sapien
tcagtgatcagcagggagtttattt

SEQ ID NO: 277100 - DNA, 25 bp, Homo sapien
gcgggctgtgttgccctgggcttta

SEQ ID NO: 277101 - DNA, 25 bp, Homo sapien
cagggttggcaggccggatcttgat

SEQ ID NO: 277102 - DNA, 25 bp, Homo sapien
ggaccatagggaaatgtcttctcaa

SEQ ID NO: 277103 - DNA, 25 bp, Homo sapien
gaccatagggaaatgtcttctcaat

SEQ ID NO: 277104 - DNA, 25 bp, Homo sapien
accatagggaaatgtcttctcaatt

SEQ ID NO: 277105 - DNA, 25 bp, Homo sapien
ccatagggaaatgtcttctcaattc

SEQ ID NO: 277106 - DNA, 25 bp, Homo sapien
catagggaaatgtcttctcaattct

SEQ ID NO: 277107 - DNA, 25 bp, Homo sapien
atagggaaatgtcttctcaattctt

SEQ ID NO: 277108 - DNA, 25 bp, Homo sapien
tagggaaatgtcttctcaattcttt

SEQ ID NO: 277109 - DNA, 25 bp, Homo sapien
atgtcttctcaattcttttaatttc

SEQ ID NO: 277110 - DNA, 25 bp, Homo sapien
gtcttctcaattcttttaatttcat

SEQ ID NO: 277111 - DNA, 25 bp, Homo sapien
gtggactgcatctgccagcccagca

SEQ ID NO: 277112 - DNA, 25 bp, Homo sapien
gctccccagacacttaaccgaaggg

SEQ ID NO: 277113 - DNA, 25 bp, Homo sapien
tggactgcatctgccagcccagcat

SEQ ID NO: 277114 - DNA, 25 bp, Homo sapien
gactgcatctgccagcccagcatct

SEQ ID NO: 277115 - DNA, 25 bp, Homo sapien
tgcgggctccagaaggcggtgtggg

SEQ ID NO: 277116 - DNA, 25 bp, Homo sapien
tcgtcatcttccacgacacccaggc

SEQ ID NO: 277117 - DNA, 25 bp, Homo sapien
atcttccacgacacccaggcgctgc

SEQ ID NO: 277118 - DNA, 25 bp, Homo sapien
aggcgctgcccacccacctcatcac

SEQ ID NO: 277119 - DNA, 25 bp, Homo sapien
tcatcacctgcgagcacgtgccccg

SEQ ID NO: 277120 - DNA, 25 bp, Homo sapien
atcacctgcgagcacgtgccccgcg

SEQ ID NO: 277121 - DNA, 25 bp, Homo sapien
acctgcgagcacgtgccccgcgctt

SEQ ID NO: 277122 - DNA, 25 bp, Homo sapien
atttagtttagtgatcagtatgaga

SEQ ID NO: 277123 - DNA, 25 bp, Homo sapien
atacctaatcctatgttgctattgt

SEQ ID NO: 277124 - DNA, 25 bp, Homo sapien
aatggagtaacaagttccctatctc

SEQ ID NO: 277125 - DNA, 25 bp, Homo sapien
tggagtaacaagttccctatctccc

SEQ ID NO: 277126 - DNA, 25 bp, Homo sapien
atttgtccatagtaaaatggccaca

SEQ ID NO: 277127 - DNA, 25 bp, Homo sapien
agtaaaatggccacattgatgataa

SEQ ID NO: 277128 - DNA, 25 bp, Homo sapien
gataatttctagaactagtttctga

SEQ ID NO: 277129 - DNA, 25 bp, Homo sapien
aactagtttctgagattgtcagccc

SEQ ID NO: 277130 - DNA, 25 bp, Homo sapien
agattgtcagccctttgtctaaaat

SEQ ID NO: 277131 - DNA, 25 bp, Homo sapien
gtcagccctttgtctaaaataatgg

SEQ ID NO: 277132 - DNA, 25 bp, Homo sapien
ccctttgtctaaaataatggcagta

SEQ ID NO: 277133 - DNA, 25 bp, Homo sapien
atattcctcaaatcagtgccataag

SEQ ID NO: 277134 - DNA, 25 bp, Homo sapien
gtgccataagactaatttatttggt

SEQ ID NO: 277135 - DNA, 25 bp, Homo sapien
gtactgaaaacttaggtatcaacat

SEQ ID NO: 277136 - DNA, 25 bp, Homo sapien
gttactcaaacagatactatgtccg

SEQ ID NO: 277137 - DNA, 25 bp, Homo sapien
gatactatgtccgtattcttctaat

SEQ ID NO: 277138 - DNA, 25 bp, Homo sapien
tactcaaagtatgttccaaggtctg

SEQ ID NO: 277139 - DNA, 25 bp, Homo sapien
gttccaaggtctggcagcctttgta

SEQ ID NO: 277140 - DNA, 25 bp, Homo sapien
ggcagcctttgtatcacctggaagc

SEQ ID NO: 277141 - DNA, 25 bp, Homo sapien
tcacctggaagcctattaggaatgc

SEQ ID NO: 277142 - DNA, 25 bp, Homo sapien
gaatgcagaatctcagacgccacct

SEQ ID NO: 277143 - DNA, 25 bp, Homo sapien
cttagtatattctcttgggaatcga

SEQ ID NO: 277144 - DNA, 25 bp, Homo sapien
aactagaggtcattatgttcaatga

SEQ ID NO: 277145 - DNA, 25 bp, Homo sapien
gaggtcattatgttcaatgaaatat

SEQ ID NO: 277146 - DNA, 25 bp, Homo sapien
gtcaggacagaaagacagactttgc

SEQ ID NO: 277147 - DNA, 25 bp, Homo sapien
aaagacagactttgcatgttctcat

SEQ ID NO: 277148 - DNA, 25 bp, Homo sapien
agacagactttgcatgttctcattt

SEQ ID NO: 277149 - DNA, 25 bp, Homo sapien
aaattaaaacagtggactcatggag

SEQ ID NO: 277150 - DNA, 25 bp, Homo sapien
aacagtggactcatggagatatgga

SEQ ID NO: 277151 - DNA, 25 bp, Homo sapien
gtaaaatgatggatatcagaggctg

SEQ ID NO: 277152 - DNA, 25 bp, Homo sapien
gctgggaagggtagtttcaagagga

SEQ ID NO: 277153 - DNA, 25 bp, Homo sapien
gaatgaataagatctgggtcgggca

SEQ ID NO: 277154 - DNA, 25 bp, Homo sapien
atgaataagatctgggtcgggcatg

SEQ ID NO: 277155 - DNA, 25 bp, Homo sapien
agtcactgttgtctttcacattata

SEQ ID NO: 277156 - DNA, 25 bp, Homo sapien
cactgttgtctttcacattataatt

SEQ ID NO: 277157 - DNA, 25 bp, Homo sapien
tcttgtgatagaagggatgatgcaa

SEQ ID NO: 277158 - DNA, 25 bp, Homo sapien
gtgtcaccagatttctgttaaaacc

SEQ ID NO: 277159 - DNA, 25 bp, Homo sapien
cagatttctgttaaaaccaaggttg

SEQ ID NO: 277160 - DNA, 25 bp, Homo sapien
aaagcctaacattggtaagctacat

SEQ ID NO: 277161 - DNA, 25 bp, Homo sapien
aacattggtaagctacattgttttc

SEQ ID NO: 277162 - DNA, 25 bp, Homo sapien
tagaatgattcagagatttcagata

SEQ ID NO: 277163 - DNA, 25 bp, Homo sapien
ttttaaactttaatgcttagctaga

SEQ ID NO: 277164 - DNA, 25 bp, Homo sapien
aatgcttagctagaatctacattct

SEQ ID NO: 277165 - DNA, 25 bp, Homo sapien
ttagctagaatctacattctgagga

SEQ ID NO: 277166 - DNA, 25 bp, Homo sapien
aatggtaactggtgcttaaagctga

SEQ ID NO: 277167 - DNA, 25 bp, Homo sapien
agaaaccacacgattgttccactgt

SEQ ID NO: 277168 - DNA, 25 bp, Homo sapien
ttgttccactgtctggaagcaccat

SEQ ID NO: 277169 - DNA, 25 bp, Homo sapien
tggaagcaccatcccctatcgcagg

SEQ ID NO: 277170 - DNA, 25 bp, Homo sapien
gactcctgggccacaagcagtcggt

SEQ ID NO: 277171 - DNA, 25 bp, Homo sapien
agcagtcggtcagtgcagacttcaa

SEQ ID NO: 277172 - DNA, 25 bp, Homo sapien
gtcagtgcagacttcaagtgtgtct

SEQ ID NO: 277173 - DNA, 25 bp, Homo sapien
ctgtttgatgtggtgtgattgtgct

SEQ ID NO: 277174 - DNA, 25 bp, Homo sapien
gattgtgctggccttgtcgaaaaag

SEQ ID NO: 277175 - DNA, 25 bp, Homo sapien
aaagatgtgatgcttctcagaacct

SEQ ID NO: 277176 - DNA, 25 bp, Homo sapien
aaatccaaagtctgaccagtttgta

SEQ ID NO: 277177 - DNA, 25 bp, Homo sapien
cttacttgccctcgatgtttcaaga

SEQ ID NO: 277178 - DNA, 25 bp, Homo sapien
atgcctggtgaaaccgagaggccac

SEQ ID NO: 277179 - DNA, 25 bp, Homo sapien
cgagaggccacatggcatgtccaag

SEQ ID NO: 277180 - DNA, 25 bp, Homo sapien
aggagacatgctttctgggttctat

SEQ ID NO: 277181 - DNA, 25 bp, Homo sapien
agagatggttttagcctgcaattga

SEQ ID NO: 277182 - DNA, 25 bp, Homo sapien
gataaatagccacaactggagttat

SEQ ID NO: 277183 - DNA, 25 bp, Homo sapien
ttttgatctcataaaccccaggaat

SEQ ID NO: 277184 - DNA, 25 bp, Homo sapien
ccaggaattacacacagaatggatt

SEQ ID NO: 277185 - DNA, 25 bp, Homo sapien
agcatcttgtgctattgcagagact

SEQ ID NO: 277186 - DNA, 25 bp, Homo sapien
attgcagagacttttctacccagga

SEQ ID NO: 277187 - DNA, 25 bp, Homo sapien
ggtatgaatgaacaactctcttact

SEQ ID NO: 277188 - DNA, 25 bp, Homo sapien
taagcatttcctctcgagtaaaacg

SEQ ID NO: 277189 - DNA, 25 bp, Homo sapien
gagtaaaacgttctggcacctttct

SEQ ID NO: 277190 - DNA, 25 bp, Homo sapien
gacattgacctgatgcttgattctt

SEQ ID NO: 277191 - DNA, 25 bp, Homo sapien
gattctttccttgttccagcttaaa

SEQ ID NO: 277192 - DNA, 25 bp, Homo sapien
tagtagcatgtgaatcccgttgatc

SEQ ID NO: 277193 - DNA, 25 bp, Homo sapien
aatcccgttgatctctggtggcaga

SEQ ID NO: 277194 - DNA, 25 bp, Homo sapien
gtggttttttggctgtcttaattct

SEQ ID NO: 277195 - DNA, 25 bp, Homo sapien
ttccagctctctcgtgttctctttg

SEQ ID NO: 277196 - DNA, 25 bp, Homo sapien
tctttgcctcctccaggtgttggtt

SEQ ID NO: 277197 - DNA, 25 bp, Homo sapien
tccaggtgttggttctctcttaaga

SEQ ID NO: 277198 - DNA, 25 bp, Homo sapien
gttctctcttaagaatccccaggat

SEQ ID NO: 277199 - DNA, 25 bp, Homo sapien
tcatgcccattctctttactgtcta

SEQ ID NO: 277200 - DNA, 25 bp, Homo sapien
atgcccattctctttactgtctagc

SEQ ID NO: 277201 - DNA, 25 bp, Homo sapien
aaggaagtgatctaaatgccagcgt

SEQ ID NO: 277202 - DNA, 25 bp, Homo sapien
gatctaaatgccagcgtgttcagtg

SEQ ID NO: 277203 - DNA, 25 bp, Homo sapien
aatgccagcgtgttcagtggtaaat

SEQ ID NO: 277204 - DNA, 25 bp, Homo sapien
cagtggtaaatattagttggtgcaa

SEQ ID NO: 277205 - DNA, 25 bp, Homo sapien
gcactaacctaatagctttgcaaat

SEQ ID NO: 277206 - DNA, 25 bp, Homo sapien
agatattcggatatggattctcccc

SEQ ID NO: 277207 - DNA, 25 bp, Homo sapien
tattcggatatggattctccccacc

SEQ ID NO: 277208 - DNA, 25 bp, Homo sapien
acctaactccattatcttcactctt

SEQ ID NO: 277209 - DNA, 25 bp, Homo sapien
aactccattatcttcactctttcct

SEQ ID NO: 277210 - DNA, 25 bp, Homo sapien
ggactatatgtcaagtaatgtgcaa

SEQ ID NO: 277211 - DNA, 25 bp, Homo sapien
aaaacaaagacagttcctgccctga

SEQ ID NO: 277212 - DNA, 25 bp, Homo sapien
ccctgatggagcttgtagatcagaa

SEQ ID NO: 277213 - DNA, 25 bp, Homo sapien
aatgtacaactgtgatgagtgcaac

SEQ ID NO: 277214 - DNA, 25 bp, Homo sapien
caaaagagaggttcatggcactatc

SEQ ID NO: 277215 - DNA, 25 bp, Homo sapien
agaggttcatggcactatcaaacat

SEQ ID NO: 277216 - DNA, 25 bp, Homo sapien
actatcaaacatgcaatggacggat

SEQ ID NO: 277217 - DNA, 25 bp, Homo sapien
gcaatggacggattttgtttttgcc

SEQ ID NO: 277218 - DNA, 25 bp, Homo sapien
ttttgtttttgcctataaactcttg

SEQ ID NO: 277219 - DNA, 25 bp, Homo sapien
gggacagcattaatcaccatgttct

SEQ ID NO: 277220 - DNA, 25 bp, Homo sapien
ttaatcaccatgttctttccttatc

SEQ ID NO: 277221 - DNA, 25 bp, Homo sapien
atttcattgaatgtgccatagtaga

SEQ ID NO: 277222 - DNA, 25 bp, Homo sapien
aatagctagttgttgtgttccgaca

SEQ ID NO: 277223 - DNA, 25 bp, Homo sapien
gttgtgttccgacattccaaaatgc

SEQ ID NO: 277224 - DNA, 25 bp, Homo sapien
acaacctagtagtatctttcatgaa

SEQ ID NO: 277225 - DNA, 25 bp, Homo sapien
gtttaagtagtatgtaagcttctct

SEQ ID NO: 277226 - DNA, 25 bp, Homo sapien
agcttctctcattgttgcttttttg

SEQ ID NO: 277227 - DNA, 25 bp, Homo sapien
attgttgcttttttgcacatgttct

SEQ ID NO: 277228 - DNA, 25 bp, Homo sapien
atgttcttcattcctctctagtgca

SEQ ID NO: 277229 - DNA, 25 bp, Homo sapien
cttcattcctctctagtgcaatatg

SEQ ID NO: 277230 - DNA, 25 bp, Homo sapien
atggaatttgtctatctgtctttgg

SEQ ID NO: 277231 - DNA, 25 bp, Homo sapien
gtctatctgtctttggaaaactttt

SEQ ID NO: 277232 - DNA, 25 bp, Homo sapien
ctccctgtggagttggccgatactg

SEQ ID NO: 277233 - DNA, 25 bp, Homo sapien
gccgatactgcctgtgacctgcaat

SEQ ID NO: 277234 - DNA, 25 bp, Homo sapien
acctgcaatgtggtctaagctgtca

SEQ ID NO: 277235 - DNA, 25 bp, Homo sapien
taagctgtcagacctccacagtggc

SEQ ID NO: 277236 - DNA, 25 bp, Homo sapien
aggttttccatacctgagcctgctt

SEQ ID NO: 277237 - DNA, 25 bp, Homo sapien
agcctgcttctacccacttttattt

SEQ ID NO: 277238 - DNA, 25 bp, Homo sapien
tatttttcccaggagtcacgcttag

SEQ ID NO: 277239 - DNA, 25 bp, Homo sapien
gagtcacgcttagtcatctcttgct

SEQ ID NO: 277240 - DNA, 25 bp, Homo sapien
atctcttgctctttgaactccatgt

SEQ ID NO: 277241 - DNA, 25 bp, Homo sapien
atgtctgtatcagctacccagagga

SEQ ID NO: 277242 - DNA, 25 bp, Homo sapien
ccagaggacccatcagacagaaagt

SEQ ID NO: 277243 - DNA, 25 bp, Homo sapien
ctcattcactggtgccctatggcta

SEQ ID NO: 277244 - DNA, 25 bp, Homo sapien
cctatggctacacactgcagttttg

SEQ ID NO: 277245 - DNA, 25 bp, Homo sapien
acactgcagttttggcatgtcctag

SEQ ID NO: 277246 - DNA, 25 bp, Homo sapien
tggcatgtcctagctgctcgattag

SEQ ID NO: 277247 - DNA, 25 bp, Homo sapien
gtatttcgaatttctgactttgaga

SEQ ID NO: 277248 - DNA, 25 bp, Homo sapien
gctcgattagcttttatcattgtct

SEQ ID NO: 277249 - DNA, 25 bp, Homo sapien
atcattgtctttgagcacctcgtgt

SEQ ID NO: 277250 - DNA, 25 bp, Homo sapien
gagcacctcgtgttttgtataaagc

SEQ ID NO: 277251 - DNA, 25 bp, Homo sapien
gagaaccgatctgagcctgaatctg

SEQ ID NO: 277252 - DNA, 25 bp, Homo sapien
gggactcctcttaagtactgcagat

SEQ ID NO: 277253 - DNA, 25 bp, Homo sapien
gtactgcagataccgggactaccgt

SEQ ID NO: 277254 - DNA, 25 bp, Homo sapien
gggacctctgagacgtttctccagg

SEQ ID NO: 277255 - DNA, 25 bp, Homo sapien
ctctgagacgtttctccaggacaag

SEQ ID NO: 277256 - DNA, 25 bp, Homo sapien
aggaacagcacgaacatgtcagcct

SEQ ID NO: 277257 - DNA, 25 bp, Homo sapien
gaacatgtcagcctgcgtggatgaa

SEQ ID NO: 277258 - DNA, 25 bp, Homo sapien
cagcctgcgtggatgaaaccgggaa

SEQ ID NO: 277259 - DNA, 25 bp, Homo sapien
aagatggccgcgagccgtgtgccca

SEQ ID NO: 277260 - DNA, 25 bp, Homo sapien
ccatggctgtcggtgtgaggctgta

SEQ ID NO: 277261 - DNA, 25 bp, Homo sapien
aggctgtagctctgtggaaaacgca

SEQ ID NO: 277262 - DNA, 25 bp, Homo sapien
agaccacacagtacagaggcgaggc

SEQ ID NO: 277263 - DNA, 25 bp, Homo sapien
gtacagaggcgaggccgtctccaga

SEQ ID NO: 277264 - DNA, 25 bp, Homo sapien
acaacatggtgattacagctattaa

SEQ ID NO: 277265 - DNA, 25 bp, Homo sapien
atttagtttagtgatcagtatgaga

SEQ ID NO: 277266 - DNA, 25 bp, Homo sapien
atacctaatcctatgttgctattgt

SEQ ID NO: 277267 - DNA, 25 bp, Homo sapien
cctagttggtgtgcctgctcagaaa

SEQ ID NO: 277268 - DNA, 25 bp, Homo sapien
aatggagtaacaagttccctatctc

SEQ ID NO: 277269 - DNA, 25 bp, Homo sapien
tccctatctcccatatttatttgtc

SEQ ID NO: 277270 - DNA, 25 bp, Homo sapien
atttgtccatagtaaaatggccaca

SEQ ID NO: 277271 - DNA, 25 bp, Homo sapien
agtaaaatggccacattgatgataa

SEQ ID NO: 277272 - DNA, 25 bp, Homo sapien
aactagtttctgagattgtcagccc

SEQ ID NO: 277273 - DNA, 25 bp, Homo sapien
agattgtcagccctttgtctaaaat

SEQ ID NO: 277274 - DNA, 25 bp, Homo sapien
gtcagccctttgtctaaaataatgg

SEQ ID NO: 277275 - DNA, 25 bp, Homo sapien
ccctttgtctaaaataatggcagta

SEQ ID NO: 277276 - DNA, 25 bp, Homo sapien
gattctctccttgccatggggatga

SEQ ID NO: 277277 - DNA, 25 bp, Homo sapien
aaattctcccttcatccttgagatt

SEQ ID NO: 277278 - DNA, 25 bp, Homo sapien
ttcatccttgagattggactcccgc

SEQ ID NO: 277279 - DNA, 25 bp, Homo sapien
ttgagattggactcccgccacacat

SEQ ID NO: 277280 - DNA, 25 bp, Homo sapien
cctgttctttctgagacaaatcatc

SEQ ID NO: 277281 - DNA, 25 bp, Homo sapien
tccctcacctggatggtgccagcgg

SEQ ID NO: 277282 - DNA, 25 bp, Homo sapien
cagcgggtggcctggaccacccaga

SEQ ID NO: 277283 - DNA, 25 bp, Homo sapien
agacaaatcatctaccaggtttccg

SEQ ID NO: 277284 - DNA, 25 bp, Homo sapien
tctaccaggtttccgcctcgggaca

SEQ ID NO: 277285 - DNA, 25 bp, Homo sapien
gcacagacagcctagcagcctgggt

SEQ ID NO: 277286 - DNA, 25 bp, Homo sapien
cagacagcctagcagcctgggtgac

SEQ ID NO: 277287 - DNA, 25 bp, Homo sapien
accctgtgtagctttcccaaagaca

SEQ ID NO: 277288 - DNA, 25 bp, Homo sapien
gtagctttcccaaagacagagtcaa

SEQ ID NO: 277289 - DNA, 25 bp, Homo sapien
gacagagtcaaacgtctcctggaga

SEQ ID NO: 277290 - DNA, 25 bp, Homo sapien
ctggagaacagaggcttcccttcgt

SEQ ID NO: 277291 - DNA, 25 bp, Homo sapien
gaggcttcccttcgtctttggtcat

SEQ ID NO: 277292 - DNA, 25 bp, Homo sapien
ttgctccccaggtggcaacgcaggc

SEQ ID NO: 277293 - DNA, 25 bp, Homo sapien
cacagctctcctgggtgttggctca

SEQ ID NO: 277294 - DNA, 25 bp, Homo sapien
gtgttggctcaggacagccctgttt

SEQ ID NO: 277295 - DNA, 25 bp, Homo sapien
agccctgtttccaactggttaggcg

SEQ ID NO: 277296 - DNA, 25 bp, Homo sapien
gccctttggttccaggttgaaactg

SEQ ID NO: 277297 - DNA, 25 bp, Homo sapien
tccaggttgaaactgcccatgtggt

SEQ ID NO: 277298 - DNA, 25 bp, Homo sapien
aagctttttctgtgagggttggcca

SEQ ID NO: 277299 - DNA, 25 bp, Homo sapien
gagggttggccactgtaaaagtaca

SEQ ID NO: 277300 - DNA, 25 bp, Homo sapien
gtacagatcaaagagacgttccatt

SEQ ID NO: 277301 - DNA, 25 bp, Homo sapien
tcaaagagacgttccattttccagt

SEQ ID NO: 277302 - DNA, 25 bp, Homo sapien
ttttccagtctgataagagctgcct

SEQ ID NO: 277303 - DNA, 25 bp, Homo sapien
gataagagctgcctgtttgtgcaaa

SEQ ID NO: 277304 - DNA, 25 bp, Homo sapien
aaaaggatgctgtaatttccattga

SEQ ID NO: 277305 - DNA, 25 bp, Homo sapien
atttccattgatgttgcacagccaa

SEQ ID NO: 277306 - DNA, 25 bp, Homo sapien
tgatgttgcacagccaaataggtaa

SEQ ID NO: 277307 - DNA, 25 bp, Homo sapien
gggagtcttcagcatgctgcccacc

SEQ ID NO: 277308 - DNA, 25 bp, Homo sapien
tcttcagcatgctgcccacctggaa

SEQ ID NO: 277309 - DNA, 25 bp, Homo sapien
actcaagtacttggctcacaacagc

SEQ ID NO: 277310 - DNA, 25 bp, Homo sapien
gtacttggctcacaacagcactatt

SEQ ID NO: 277311 - DNA, 25 bp, Homo sapien
cttggctcacaacagcactattcac

SEQ ID NO: 277312 - DNA, 25 bp, Homo sapien
ttacgcctctagactctactaggtg

SEQ ID NO: 277313 - DNA, 25 bp, Homo sapien
gcctctagactctactaggtgatca

SEQ ID NO: 277314 - DNA, 25 bp, Homo sapien
gactctactaggtgatcagaaatcc

SEQ ID NO: 277315 - DNA, 25 bp, Homo sapien
tcagaaatccctgcaagctagttgg

SEQ ID NO: 277316 - DNA, 25 bp, Homo sapien
tggagaggaaacactgctacccgcc

SEQ ID NO: 277317 - DNA, 25 bp, Homo sapien
aggaaacactgctacccgcccaatg

SEQ ID NO: 277318 - DNA, 25 bp, Homo sapien
gaaagtttagactcctacatgggat

SEQ ID NO: 277319 - DNA, 25 bp, Homo sapien
gggacctcgaagtactcaagtactt

SEQ ID NO: 277320 - DNA, 25 bp, Homo sapien
atagaagtgctgtatgcggaccctg

SEQ ID NO: 277321 - DNA, 25 bp, Homo sapien
gaagagaatccaactgctacccaac

SEQ ID NO: 277322 - DNA, 25 bp, Homo sapien
gtgtctgcactcagctcaaattcta

SEQ ID NO: 277323 - DNA, 25 bp, Homo sapien
agcccctatcatccggtagctgagg

SEQ ID NO: 277324 - DNA, 25 bp, Homo sapien
gacgcgatgttctcaaaaactcctt

SEQ ID NO: 277325 - DNA, 25 bp, Homo sapien
tagtcacaggtctctgcattacagc

SEQ ID NO: 277326 - DNA, 25 bp, Homo sapien
gcattacagcctggtttgccatatc

SEQ ID NO: 277327 - DNA, 25 bp, Homo sapien
ttgccatatctaaagcatcccttag

SEQ ID NO: 277328 - DNA, 25 bp, Homo sapien
tcaaaaactccttcttcatctctgg

SEQ ID NO: 277329 - DNA, 25 bp, Homo sapien
atctctggcagggtttctctgaatc

SEQ ID NO: 277330 - DNA, 25 bp, Homo sapien
ttgcccactggcctacattatagaa

SEQ ID NO: 277331 - DNA, 25 bp, Homo sapien
aactctgatgtttaaagccctttgc

SEQ ID NO: 277332 - DNA, 25 bp, Homo sapien
caaggtttacatgaacagggaactt

SEQ ID NO: 277333 - DNA, 25 bp, Homo sapien
tgtttaaagccctttgctttatata

SEQ ID NO: 277334 - DNA, 25 bp, Homo sapien
gagttcagtagtaagataggtttca

SEQ ID NO: 277335 - DNA, 25 bp, Homo sapien
gaacagggaacttgtctgttttgtt

SEQ ID NO: 277336 - DNA, 25 bp, Homo sapien
attacaggtcctggcagagccttga

SEQ ID NO: 277337 - DNA, 25 bp, Homo sapien
gtttattactgtatcccctatgctg

SEQ ID NO: 277338 - DNA, 25 bp, Homo sapien
tactgtatcccctatgctggcacat

SEQ ID NO: 277339 - DNA, 25 bp, Homo sapien
tatcccctatgctggcacatactat

SEQ ID NO: 277340 - DNA, 25 bp, Homo sapien
cctatgctggcacatactatgtaat

SEQ ID NO: 277341 - DNA, 25 bp, Homo sapien
gagtgcatgagtgaataaccattct

SEQ ID NO: 277342 - DNA, 25 bp, Homo sapien
ccagcacccctgctgtgtggttcat

SEQ ID NO: 277343 - DNA, 25 bp, Homo sapien
cagcacccctgctgtgtggttcatc

SEQ ID NO: 277344 - DNA, 25 bp, Homo sapien
agcacccctgctgtgtggttcatct

SEQ ID NO: 277345 - DNA, 25 bp, Homo sapien
gcacccctgctgtgtggttcatctt

SEQ ID NO: 277346 - DNA, 25 bp, Homo sapien
cctgcccacccctgaaagactggcc

SEQ ID NO: 277347 - DNA, 25 bp, Homo sapien
gtctccacgtggtgtatggatctgt

SEQ ID NO: 277348 - DNA, 25 bp, Homo sapien
tctccacgtggtgtatggatctgtg

SEQ ID NO: 277349 - DNA, 25 bp, Homo sapien
ctccacgtggtgtatggatctgtgg

SEQ ID NO: 277350 - DNA, 25 bp, Homo sapien
tccacgtggtgtatggatctgtggt

SEQ ID NO: 277351 - DNA, 25 bp, Homo sapien
cacgtggtgtatggatctgtggtca

SEQ ID NO: 277352 - DNA, 25 bp, Homo sapien
acgtggtgtatggatctgtggtcat

SEQ ID NO: 277353 - DNA, 25 bp, Homo sapien
gatctcctccctctgttgaaagctg

SEQ ID NO: 277354 - DNA, 25 bp, Homo sapien
atctcctccctctgttgaaagctgc

SEQ ID NO: 277355 - DNA, 25 bp, Homo sapien
gctcaggtgtctggtgtcgggcgcc

SEQ ID NO: 277356 - DNA, 25 bp, Homo sapien
agctctggcagcgtctgggtgctga

SEQ ID NO: 277357 - DNA, 25 bp, Homo sapien
gcagaggcggagagaaccctgtcct

SEQ ID NO: 277358 - DNA, 25 bp, Homo sapien
agaggcggagagaaccctgtcctga

SEQ ID NO: 277359 - DNA, 25 bp, Homo sapien
aggcggagagaaccctgtcctgatc

SEQ ID NO: 277360 - DNA, 25 bp, Homo sapien
cggagagaaccctgtcctgatcttc

SEQ ID NO: 277361 - DNA, 25 bp, Homo sapien
tgtcctgatcttcctaggtgggata

SEQ ID NO: 277362 - DNA, 25 bp, Homo sapien
tcctgatcttcctaggtgggataaa

SEQ ID NO: 277363 - DNA, 25 bp, Homo sapien
gatcttcctaggtgggataaatatc

SEQ ID NO: 277364 - DNA, 25 bp, Homo sapien
tacccctactccaggtcacataatg

SEQ ID NO: 277365 - DNA, 25 bp, Homo sapien
gagtatgactcctgaacagcttcag

SEQ ID NO: 277366 - DNA, 25 bp, Homo sapien
attgatgagagaaatcgcccacttt

SEQ ID NO: 277367 - DNA, 25 bp, Homo sapien
aatcgcccactttctgatgaggaat

SEQ ID NO: 277368 - DNA, 25 bp, Homo sapien
attagatgctatgttcccagaagga

SEQ ID NO: 277369 - DNA, 25 bp, Homo sapien
ggatataaggtacttcctcctccag

SEQ ID NO: 277370 - DNA, 25 bp, Homo sapien
gggatgaaacaccagctagtcagat

SEQ ID NO: 277371 - DNA, 25 bp, Homo sapien
tcctccagctggttatgttcctatt

SEQ ID NO: 277372 - DNA, 25 bp, Homo sapien
tatgttcctattcgaactccagctc

SEQ ID NO: 277373 - DNA, 25 bp, Homo sapien
tgggtggaagcactccagttctgac

SEQ ID NO: 277374 - DNA, 25 bp, Homo sapien
gttctgacccctggaaagacaccaa

SEQ ID NO: 277375 - DNA, 25 bp, Homo sapien
actttgaaatgttggttgtgctttt

SEQ ID NO: 277376 - DNA, 25 bp, Homo sapien
gattgaatccaaacaaccagaaggg

SEQ ID NO: 277377 - DNA, 25 bp, Homo sapien
cacaggtgttgagacaaagcggctt

SEQ ID NO: 277378 - DNA, 25 bp, Homo sapien
aagatggatgtttggtgcccttgtc

SEQ ID NO: 277379 - DNA, 25 bp, Homo sapien
tttggtgcccttgtcaatctctgtg

SEQ ID NO: 277380 - DNA, 25 bp, Homo sapien
aatctctgtgcttcatagctggtct

SEQ ID NO: 277381 - DNA, 25 bp, Homo sapien
atagctggtctaatgtgggccctta

SEQ ID NO: 277382 - DNA, 25 bp, Homo sapien
gtgggcccttagttctcaccatgta

SEQ ID NO: 277383 - DNA, 25 bp, Homo sapien
caccatgtacactctttagagatgt

SEQ ID NO: 277384 - DNA, 25 bp, Homo sapien
aagcggcttgcggtgtttcaaaaat

SEQ ID NO: 277385 - DNA, 25 bp, Homo sapien
ggtgattttgtctctgtacactaaa

SEQ ID NO: 277386 - DNA, 25 bp, Homo sapien
tgactttcccaatgagcccttgtgt

SEQ ID NO: 277387 - DNA, 25 bp, Homo sapien
agcccttgtgttggctcctttggcc

SEQ ID NO: 277388 - DNA, 25 bp, Homo sapien
tcctttggccctctttttgaaagag

SEQ ID NO: 277389 - DNA, 25 bp, Homo sapien
tggtgtttaaggtccatagcattaa

SEQ ID NO: 277390 - DNA, 25 bp, Homo sapien
aaggtccatagcattaagtttgaag

SEQ ID NO: 277391 - DNA, 25 bp, Homo sapien
gagctgagactctatacttttccca

SEQ ID NO: 277392 - DNA, 25 bp, Homo sapien
tgagactctatacttttcccaaggt

SEQ ID NO: 277393 - DNA, 25 bp, Homo sapien
cacctcctgactttatacatggcta

SEQ ID NO: 277394 - DNA, 25 bp, Homo sapien
tatacatggctactcccaggacaag

SEQ ID NO: 277395 - DNA, 25 bp, Homo sapien
gacaagcttcttccagatggtccag

SEQ ID NO: 277396 - DNA, 25 bp, Homo sapien
agatggtccagctcgtttcctgcct

SEQ ID NO: 277397 - DNA, 25 bp, Homo sapien
ccacggaggagatcgatctgcgcag

SEQ ID NO: 277398 - DNA, 25 bp, Homo sapien
agctgcccttcaagcacgtgcgtga

SEQ ID NO: 277399 - DNA, 25 bp, Homo sapien
agcacgtgcgtgactaccgcctgcg

SEQ ID NO: 277400 - DNA, 25 bp, Homo sapien
acctcgtgcctttctttatctacag

SEQ ID NO: 277401 - DNA, 25 bp, Homo sapien
tttctttatctacagcggcttcgag

SEQ ID NO: 277402 - DNA, 25 bp, Homo sapien
tacagcggcttcgaggtgctctttg

SEQ ID NO: 277403 - DNA, 25 bp, Homo sapien
gaggtgctctttgcctgcactggta

SEQ ID NO: 277404 - DNA, 25 bp, Homo sapien
ctgcactggtatcgccttgggctat

SEQ ID NO: 277405 - DNA, 25 bp, Homo sapien
ggctggagcggctggcttacctcct

SEQ ID NO: 277406 - DNA, 25 bp, Homo sapien
aacctcattgtggtggagagcgtgc

SEQ ID NO: 277407 - DNA, 25 bp, Homo sapien
agagcgtgctcatggcagtggcctt

SEQ ID NO: 277408 - DNA, 25 bp, Homo sapien
ttcagttgcctgattgctagcatag

SEQ ID NO: 277409 - DNA, 25 bp, Homo sapien
gattgctagcatagatagtacctct

SEQ ID NO: 277410 - DNA, 25 bp, Homo sapien
agtacctctatgtatgtgccatttc

SEQ ID NO: 277411 - DNA, 25 bp, Homo sapien
aaaagctgaacactgtgctggaagc

SEQ ID NO: 277412 - DNA, 25 bp, Homo sapien
aggcttcactggtgtagggatgcca

SEQ ID NO: 277413 - DNA, 25 bp, Homo sapien
attgtgcctcagttgtcccatcact

SEQ ID NO: 277414 - DNA, 25 bp, Homo sapien
tggtgtagggatgccatttctgccc

SEQ ID NO: 277415 - DNA, 25 bp, Homo sapien
atttctgccccctaagaatcacaag

SEQ ID NO: 277416 - DNA, 25 bp, Homo sapien
aatcacaagggctagagcattgcag

SEQ ID NO: 277417 - DNA, 25 bp, Homo sapien
agttgtcccatcactcccacttggg

SEQ ID NO: 277418 - DNA, 25 bp, Homo sapien
tgaaggtggaattcagttgcctgat

SEQ ID NO: 277419 - DNA, 25 bp, Homo sapien
gacctggttccagccgtttgcaggg

SEQ ID NO: 277420 - DNA, 25 bp, Homo sapien
gctccgagaggcgtgtgctttccgt

SEQ ID NO: 277421 - DNA, 25 bp, Homo sapien
ctccgagaggcgtgtgctttccgtg

SEQ ID NO: 277422 - DNA, 25 bp, Homo sapien
tgcctggcctcatccttgtatttaa

SEQ ID NO: 277423 - DNA, 25 bp, Homo sapien
gcctggcctcatccttgtatttaat

SEQ ID NO: 277424 - DNA, 25 bp, Homo sapien
cctggcctcatccttgtatttaatt

SEQ ID NO: 277425 - DNA, 25 bp, Homo sapien
ctggcctcatccttgtatttaatta

SEQ ID NO: 277426 - DNA, 25 bp, Homo sapien
tggcctcatccttgtatttaattaa

SEQ ID NO: 277427 - DNA, 25 bp, Homo sapien
ggcctcatccttgtatttaattaat

SEQ ID NO: 277428 - DNA, 25 bp, Homo sapien
gcctcatccttgtatttaattaatt

SEQ ID NO: 277429 - DNA, 25 bp, Homo sapien
ctcatccttgtatttaattaattaa

SEQ ID NO: 277430 - DNA, 25 bp, Homo sapien
cttaccctgacatttgtgatataaa

SEQ ID NO: 277431 - DNA, 25 bp, Homo sapien
agatatgtttttacttaatgcaaat

SEQ ID NO: 277432 - DNA, 25 bp, Homo sapien
acactgaaaagcctctttgtgaatt

SEQ ID NO: 277433 - DNA, 25 bp, Homo sapien
gaaaagcctctttgtgaattaatac

SEQ ID NO: 277434 - DNA, 25 bp, Homo sapien
ttgtgaattaatacagttctgcttg

SEQ ID NO: 277435 - DNA, 25 bp, Homo sapien
acagttctgcttgatgcacttgatt

SEQ ID NO: 277436 - DNA, 25 bp, Homo sapien
ctgcttgatgcacttgatttgaaaa

SEQ ID NO: 277437 - DNA, 25 bp, Homo sapien
aagacatttctctgtatgtggcgca

SEQ ID NO: 277438 - DNA, 25 bp, Homo sapien
atttctctgtatgtggcgcatgtcg

SEQ ID NO: 277439 - DNA, 25 bp, Homo sapien
gcgcatgtcggctttgctttgaaaa

SEQ ID NO: 277440 - DNA, 25 bp, Homo sapien
gattcattaaggatttgccttaccc

SEQ ID NO: 277441 - DNA, 25 bp, Homo sapien
ccatggtcatcctcaacagcatgag

SEQ ID NO: 277442 - DNA, 25 bp, Homo sapien
gctgttttcttctaaggatcaaaaa

SEQ ID NO: 277443 - DNA, 25 bp, Homo sapien
aaaacctctagctttccatcaggga

SEQ ID NO: 277444 - DNA, 25 bp, Homo sapien
tctagctttccatcagggacaaatg

SEQ ID NO: 277445 - DNA, 25 bp, Homo sapien
gggacaaatgtacttttgactcagt

SEQ ID NO: 277446 - DNA, 25 bp, Homo sapien
tgctccatgaggtcactcaggtgga

SEQ ID NO: 277447 - DNA, 25 bp, Homo sapien
gtacttttgactcagtcacagattt

SEQ ID NO: 277448 - DNA, 25 bp, Homo sapien
gaaattttccattgagcgggtctgc

SEQ ID NO: 277449 - DNA, 25 bp, Homo sapien
cattgagcgggtctgctggtaaacc

SEQ ID NO: 277450 - DNA, 25 bp, Homo sapien
gtctgctggtaaacccacgttcatt

SEQ ID NO: 277451 - DNA, 25 bp, Homo sapien
tggacaggaggcacgaccaccctga

SEQ ID NO: 277452 - DNA, 25 bp, Homo sapien
gggaaccattccaacatcccattca

SEQ ID NO: 277453 - DNA, 25 bp, Homo sapien
attccaacatcccattcagcagggt

SEQ ID NO: 277454 - DNA, 25 bp, Homo sapien
atcccattcagcagggtgaaccaca

SEQ ID NO: 277455 - DNA, 25 bp, Homo sapien
acagcaagttcatggtcacggagaa

SEQ ID NO: 277456 - DNA, 25 bp, Homo sapien
gagaaggcagcctacataggcacct

SEQ ID NO: 277457 - DNA, 25 bp, Homo sapien
acataggcacctccaactggtcgga

SEQ ID NO: 277458 - DNA, 25 bp, Homo sapien
ccaactggtcggaggattacttcag

SEQ ID NO: 277459 - DNA, 25 bp, Homo sapien
tgggcttggtggtcacccagagccc

SEQ ID NO: 277460 - DNA, 25 bp, Homo sapien
ctctttgagcgggactggagttcgc

SEQ ID NO: 277461 - DNA, 25 bp, Homo sapien
tggagttcgcgctacgccgtcggcc

SEQ ID NO: 277462 - DNA, 25 bp, Homo sapien
ctccgggccaggactgcgtttggca

SEQ ID NO: 277463 - DNA, 25 bp, Homo sapien
aagtattttagccaaggccactcag

SEQ ID NO: 277464 - DNA, 25 bp, Homo sapien
caaggccactcagcgcttaagtgat

SEQ ID NO: 277465 - DNA, 25 bp, Homo sapien
atagaagcagattccaactcaagtc

SEQ ID NO: 277466 - DNA, 25 bp, Homo sapien
gattccaactcaagtctgcatggct

SEQ ID NO: 277467 - DNA, 25 bp, Homo sapien
agtctgcatggctttaaaccctgtg

SEQ ID NO: 277468 - DNA, 25 bp, Homo sapien
aatgaaactttctcactttgtctca

SEQ ID NO: 277469 - DNA, 25 bp, Homo sapien
tttgtctcactgacagagctatcat

SEQ ID NO: 277470 - DNA, 25 bp, Homo sapien
acctgcctcagcactggcttgagga

SEQ ID NO: 277471 - DNA, 25 bp, Homo sapien
gcttgaggactcaagtccgggaact

SEQ ID NO: 277472 - DNA, 25 bp, Homo sapien
tcaagtccgggaactgttggtggaa

SEQ ID NO: 277473 - DNA, 25 bp, Homo sapien
ggcatttcagtggatgcctcagccc

SEQ ID NO: 277474 - DNA, 25 bp, Homo sapien
gaaggaaccttagataattctcata

SEQ ID NO: 277475 - DNA, 25 bp, Homo sapien
gataattctcatatgcatttaacag

SEQ ID NO: 277476 - DNA, 25 bp, Homo sapien
atatgcatttaacagacgaggaaac

SEQ ID NO: 277477 - DNA, 25 bp, Homo sapien
agagccgtcacatcaatacctcatt

SEQ ID NO: 277478 - DNA, 25 bp, Homo sapien
cagccggtaggaagtttcccctgag

SEQ ID NO: 277479 - DNA, 25 bp, Homo sapien
caatacctcatttgatcttcataag

SEQ ID NO: 277480 - DNA, 25 bp, Homo sapien
atcttcataagagcacctggaggag

SEQ ID NO: 277481 - DNA, 25 bp, Homo sapien
gataggcattttgtagacaatctgg

SEQ ID NO: 277482 - DNA, 25 bp, Homo sapien
attttgtagacaatctggaagttct

SEQ ID NO: 277483 - DNA, 25 bp, Homo sapien
gggttgtatgcaaggttctcctcct

SEQ ID NO: 277484 - DNA, 25 bp, Homo sapien
ttgtatgcaaggttctcctcctggc

SEQ ID NO: 277485 - DNA, 25 bp, Homo sapien
tatcagatgcagttctccaaggcca

SEQ ID NO: 277486 - DNA, 25 bp, Homo sapien
gagcaccgagatgggaaagttttca

SEQ ID NO: 277487 - DNA, 25 bp, Homo sapien
caaggccaagagtgcatccaagggt

SEQ ID NO: 277488 - DNA, 25 bp, Homo sapien
aagagtgcatccaagggtccagtgg

SEQ ID NO: 277489 - DNA, 25 bp, Homo sapien
gtggctgtccctggctaaaaattgc

SEQ ID NO: 277490 - DNA, 25 bp, Homo sapien
taaaaattgcttcgccccacaatgt

SEQ ID NO: 277491 - DNA, 25 bp, Homo sapien
acaatgtcctgcgtacgccataatc

SEQ ID NO: 277492 - DNA, 25 bp, Homo sapien
gcgtacgccataatccaggagctga

SEQ ID NO: 277493 - DNA, 25 bp, Homo sapien
atgttgccaagggatcccatcaagg

SEQ ID NO: 277494 - DNA, 25 bp, Homo sapien
aagggatcccatcaaggccaaactc

SEQ ID NO: 277495 - DNA, 25 bp, Homo sapien
catcaaggccaaactcagggaggat

SEQ ID NO: 277496 - DNA, 25 bp, Homo sapien
aagaccatggaggactactgaccaa

SEQ ID NO: 277497 - DNA, 25 bp, Homo sapien
tactgaccaacaacctctgaccttc

SEQ ID NO: 277498 - DNA, 25 bp, Homo sapien
atgggggacgaatcactaggcaaag

SEQ ID NO: 277499 - DNA, 25 bp, Homo sapien
gaaggagacaaaatggctgccttta

SEQ ID NO: 277500 - DNA, 25 bp, Homo sapien
aaaatggctgcctttacagctgcag

SEQ ID NO: 277501 - DNA, 25 bp, Homo sapien
tgcctttacagctgcagcaagatgt

SEQ ID NO: 277502 - DNA, 25 bp, Homo sapien
ggaaacactggttccctaggcacct

SEQ ID NO: 277503 - DNA, 25 bp, Homo sapien
gttccctaggcacctccattgtctt

SEQ ID NO: 277504 - DNA, 25 bp, Homo sapien
cccgccttgggagcatgaaataaat

SEQ ID NO: 277505 - DNA, 25 bp, Homo sapien
caggtgggcccggtgacagtaacct

SEQ ID NO: 277506 - DNA, 25 bp, Homo sapien
gtgggcccggtgacagtaaccttca

SEQ ID NO: 277507 - DNA, 25 bp, Homo sapien
aatctgcatttaagggagactctgg

SEQ ID NO: 277508 - DNA, 25 bp, Homo sapien
agggcatcgtatcctatggacggtc

SEQ ID NO: 277509 - DNA, 25 bp, Homo sapien
tatggacggtcggatgcaaagcccc

SEQ ID NO: 277510 - DNA, 25 bp, Homo sapien
attaccggccctggatcaaccagat

SEQ ID NO: 277511 - DNA, 25 bp, Homo sapien
gatcaaccagatcctgcaggcaaat

SEQ ID NO: 277512 - DNA, 25 bp, Homo sapien
gcaggcaaattaatcctggatcctg

SEQ ID NO: 277513 - DNA, 25 bp, Homo sapien
atcctggatcctgagccagcctgaa

SEQ ID NO: 277514 - DNA, 25 bp, Homo sapien
aagctggaactggacctgagcagca

SEQ ID NO: 277515 - DNA, 25 bp, Homo sapien
gagcagcaaattgtgtgccactcat

SEQ ID NO: 277516 - DNA, 25 bp, Homo sapien
attgtgtgccactcattctggtcta

SEQ ID NO: 277517 - DNA, 25 bp, Homo sapien
ttctggtctacccttggtccctcag

SEQ ID NO: 277518 - DNA, 25 bp, Homo sapien
gggactgagaagctactccggttta

SEQ ID NO: 277519 - DNA, 25 bp, Homo sapien
tgagaagctactccggtttagaaac

SEQ ID NO: 277520 - DNA, 25 bp, Homo sapien
agtgacatgaactctcaggaggact

SEQ ID NO: 277521 - DNA, 25 bp, Homo sapien
accccagagacacccgtgtagatgg

SEQ ID NO: 277522 - DNA, 25 bp, Homo sapien
gagacacccgtgtagatgggtacat

SEQ ID NO: 277523 - DNA, 25 bp, Homo sapien
agatgggtacatcacggcttctctc

SEQ ID NO: 277524 - DNA, 25 bp, Homo sapien
cttctctcccacgttaagacttaat

SEQ ID NO: 277525 - DNA, 25 bp, Homo sapien
gaactctcaggaggactgagccaga

SEQ ID NO: 277526 - DNA, 25 bp, Homo sapien
actgagccagaagcggacagggcaa

SEQ ID NO: 277527 - DNA, 25 bp, Homo sapien
acagggcaagacgagctgtgcttga

SEQ ID NO: 277528 - DNA, 25 bp, Homo sapien
ggtcagggactgagaagctactccg

SEQ ID NO: 277529 - DNA, 25 bp, Homo sapien
cgtgtctcaccgtctttatttaaca

SEQ ID NO: 277530 - DNA, 25 bp, Homo sapien
gagactataaatgaccctgagcaga

SEQ ID NO: 277531 - DNA, 25 bp, Homo sapien
accctgagcagagtggctgcgagca

SEQ ID NO: 277532 - DNA, 25 bp, Homo sapien
cacgggcgtcatcctagccgcgtga

SEQ ID NO: 277533 - DNA, 25 bp, Homo sapien
atcctagccgcgtgagcgccgagct

SEQ ID NO: 277534 - DNA, 25 bp, Homo sapien
cttgtacacttgctccgttttctct

SEQ ID NO: 277535 - DNA, 25 bp, Homo sapien
gttttctctaaactgccgcgatgaa

SEQ ID NO: 277536 - DNA, 25 bp, Homo sapien
aactgccgcgatgaatgtcagtccc

SEQ ID NO: 277537 - DNA, 25 bp, Homo sapien
gcgatgaatgtcagtccccagagcc

SEQ ID NO: 277538 - DNA, 25 bp, Homo sapien
cccggttttctctacttggatctga

SEQ ID NO: 277539 - DNA, 25 bp, Homo sapien
ttggatctgagaactctgtccctcc

SEQ ID NO: 277540 - DNA, 25 bp, Homo sapien
ttagtggccagagcatgtcttggca

SEQ ID NO: 277541 - DNA, 25 bp, Homo sapien
cagagcatgtcttggcagagaaact

SEQ ID NO: 277542 - DNA, 25 bp, Homo sapien
gaaggaggctggaatggctgcacca

SEQ ID NO: 277543 - DNA, 25 bp, Homo sapien
ggatgacgggtaacctgggtcacat

SEQ ID NO: 277544 - DNA, 25 bp, Homo sapien
gtaacctgggtcacatgtgcgagat

SEQ ID NO: 277545 - DNA, 25 bp, Homo sapien
ggtcacatgtgcgagatcttcttgt

SEQ ID NO: 277546 - DNA, 25 bp, Homo sapien
tgtgcgagatcttcttgtagcctgg

SEQ ID NO: 277547 - DNA, 25 bp, Homo sapien
ggaggagcttacactgtcctgagag

SEQ ID NO: 277548 - DNA, 25 bp, Homo sapien
gagcttacactgtcctgagagcagt

SEQ ID NO: 277549 - DNA, 25 bp, Homo sapien
ctccagagtatctaggcattagtta

SEQ ID NO: 277550 - DNA, 25 bp, Homo sapien
gcattagttacatgccatgttacag

SEQ ID NO: 277551 - DNA, 25 bp, Homo sapien
gcctatttcccacgattgttttgag

SEQ ID NO: 277552 - DNA, 25 bp, Homo sapien
ggaaggtctaaatcactgcgcaact

SEQ ID NO: 277553 - DNA, 25 bp, Homo sapien
tcactgcgcaactgcaaggcattat

SEQ ID NO: 277554 - DNA, 25 bp, Homo sapien
ttccttttaattcctgcttccacaa

SEQ ID NO: 277555 - DNA, 25 bp, Homo sapien
aaacatctcatcacatatccttggg

SEQ ID NO: 277556 - DNA, 25 bp, Homo sapien
atatccttgggttcctgggttacat

SEQ ID NO: 277557 - DNA, 25 bp, Homo sapien
ggagagattcgtggtgtagctcaat

SEQ ID NO: 277558 - DNA, 25 bp, Homo sapien
ggtgtagctcaatctatgtgtcata

SEQ ID NO: 277559 - DNA, 25 bp, Homo sapien
tgtgtcatagctatcccacaatctc

SEQ ID NO: 277560 - DNA, 25 bp, Homo sapien
tatcccacaatctcttcttcaactt

SEQ ID NO: 277561 - DNA, 25 bp, Homo sapien
tcaacttctccaacacatcaagaca

SEQ ID NO: 277562 - DNA, 25 bp, Homo sapien
acaccttaaggctgcagaaccctat

SEQ ID NO: 277563 - DNA, 25 bp, Homo sapien
ttaaggctgcagaaccctatgcctt

SEQ ID NO: 277564 - DNA, 25 bp, Homo sapien
gaaccctatgcctttaccatcctga

SEQ ID NO: 277565 - DNA, 25 bp, Homo sapien
gcgggcctacaagctggctgcagaa

SEQ ID NO: 277566 - DNA, 25 bp, Homo sapien
agctggctgcagaaacccaggaaga

SEQ ID NO: 277567 - DNA, 25 bp, Homo sapien
ggctgtgggcactggctggcgcgag

SEQ ID NO: 277568 - DNA, 25 bp, Homo sapien
aaaacccaatactgggagctgtgcc

SEQ ID NO: 277569 - DNA, 25 bp, Homo sapien
ggagctgtgccaggcaactggccaa

SEQ ID NO: 277570 - DNA, 25 bp, Homo sapien
aggcaactggccaagaacccatctc

SEQ ID NO: 277571 - DNA, 25 bp, Homo sapien
aagaacccatctcatccccagagga

SEQ ID NO: 277572 - DNA, 25 bp, Homo sapien
ggctttctagccactgtgagtaccc

SEQ ID NO: 277573 - DNA, 25 bp, Homo sapien
gagcatggaataattgtttcacaga

SEQ ID NO: 277574 - DNA, 25 bp, Homo sapien
gaagagggaccttcttcagtcaggt

SEQ ID NO: 277575 - DNA, 25 bp, Homo sapien
caggtttactcctgatgggaagtac

SEQ ID NO: 277576 - DNA, 25 bp, Homo sapien
ggaagtacttgattgtggcccagct

SEQ ID NO: 277577 - DNA, 25 bp, Homo sapien
ttgattgtggcccagctgaatctta

SEQ ID NO: 277578 - DNA, 25 bp, Homo sapien
tgaatcttagcaggctctcagtcgt

SEQ ID NO: 277579 - DNA, 25 bp, Homo sapien
tagcaggctctcagtcgtagcagca

SEQ ID NO: 277580 - DNA, 25 bp, Homo sapien
gtgatcagcacaatccaactagcag

SEQ ID NO: 277581 - DNA, 25 bp, Homo sapien
gcagatcaagttttgccacatctcc

SEQ ID NO: 277582 - DNA, 25 bp, Homo sapien
gccacatctcctagaagtcgacaga

SEQ ID NO: 277583 - DNA, 25 bp, Homo sapien
gactggagcagtctatgtagcagaa

SEQ ID NO: 277584 - DNA, 25 bp, Homo sapien
catatatgacattaaggctacagaa

SEQ ID NO: 277585 - DNA, 25 bp, Homo sapien
aggctacagaagttttgtgcattaa

SEQ ID NO: 277586 - DNA, 25 bp, Homo sapien
aagttttgtgcattaatcttaattc

SEQ ID NO: 277587 - DNA, 25 bp, Homo sapien
atgtttcaagaagggcagactcacg

SEQ ID NO: 277588 - DNA, 25 bp, Homo sapien
gaagggcagactcacgaatttttta

SEQ ID NO: 277589 - DNA, 25 bp, Homo sapien
ggcagactcacgaattttttagaaa

SEQ ID NO: 277590 - DNA, 25 bp, Homo sapien
gaaaacagtgcttcttaatgatatg

SEQ ID NO: 277591 - DNA, 25 bp, Homo sapien
cagtgcttcttaatgatatgctatt

SEQ ID NO: 277592 - DNA, 25 bp, Homo sapien
atacttattagttatgtgcaagctt

SEQ ID NO: 277593 - DNA, 25 bp, Homo sapien
gtgcaagctttgtatattcttatat

SEQ ID NO: 277594 - DNA, 25 bp, Homo sapien
ggcacgtatagttaagagagtttta

SEQ ID NO: 277595 - DNA, 25 bp, Homo sapien
ttgtatttttaggtgttcttgaact

SEQ ID NO: 277596 - DNA, 25 bp, Homo sapien
tgtatttttaggtgttcttgaactc

SEQ ID NO: 277597 - DNA, 25 bp, Homo sapien
tatttttaggtgttcttgaactcct

SEQ ID NO: 277598 - DNA, 25 bp, Homo sapien
actcctgatgtcaggtgattctcct

SEQ ID NO: 277599 - DNA, 25 bp, Homo sapien
cctgatgtcaggtgattctcctagc

SEQ ID NO: 277600 - DNA, 25 bp, Homo sapien
tgatgtcaggtgattctcctagctc

SEQ ID NO: 277601 - DNA, 25 bp, Homo sapien
gatgtcaggtgattctcctagctcc

SEQ ID NO: 277602 - DNA, 25 bp, Homo sapien
atgtcaggtgattctcctagctcca

SEQ ID NO: 277603 - DNA, 25 bp, Homo sapien
caggtgattctcctagctccaaatg

SEQ ID NO: 277604 - DNA, 25 bp, Homo sapien
aggtgattctcctagctccaaatgt

SEQ ID NO: 277605 - DNA, 25 bp, Homo sapien
ggtgattctcctagctccaaatgtt

SEQ ID NO: 277606 - DNA, 25 bp, Homo sapien
tcatttctcttcttggatttgagaa

SEQ ID NO: 277607 - DNA, 25 bp, Homo sapien
ctctgggatccctgctcattagctt

SEQ ID NO: 277608 - DNA, 25 bp, Homo sapien
tgctcattagcttcctatgcgtggc

SEQ ID NO: 277609 - DNA, 25 bp, Homo sapien
gcacaatttctgacaacttgaaaat

SEQ ID NO: 277610 - DNA, 25 bp, Homo sapien
attagcttcctatgcgtggctttct

SEQ ID NO: 277611 - DNA, 25 bp, Homo sapien
tatgcgtggctttcttccctgctgg

SEQ ID NO: 277612 - DNA, 25 bp, Homo sapien
ctggctctgggctataacctctcct

SEQ ID NO: 277613 - DNA, 25 bp, Homo sapien
cctctcatcctcttcagggaatgga

SEQ ID NO: 277614 - DNA, 25 bp, Homo sapien
aagttccagagaattggctccgtgt

SEQ ID NO: 277615 - DNA, 25 bp, Homo sapien
agagaattggctccgtgtcccattt

SEQ ID NO: 277616 - DNA, 25 bp, Homo sapien
ttggctccgtgtcccattttttctt

SEQ ID NO: 277617 - DNA, 25 bp, Homo sapien
cactctgtcgccgagttttggagtg

SEQ ID NO: 277618 - DNA, 25 bp, Homo sapien
actctgtcgccgagttttggagtgt

SEQ ID NO: 277619 - DNA, 25 bp, Homo sapien
ctctgtcgccgagttttggagtgta

SEQ ID NO: 277620 - DNA, 25 bp, Homo sapien
tctgtcgccgagttttggagtgtat

SEQ ID NO: 277621 - DNA, 25 bp, Homo sapien
ctgtcgccgagttttggagtgtatt

SEQ ID NO: 277622 - DNA, 25 bp, Homo sapien
tgtcgccgagttttggagtgtattg

SEQ ID NO: 277623 - DNA, 25 bp, Homo sapien
tcgccgagttttggagtgtattggc

SEQ ID NO: 277624 - DNA, 25 bp, Homo sapien
agttttggagtgtattggcgcgatc

SEQ ID NO: 277625 - DNA, 25 bp, Homo sapien
gttttggagtgtattggcgcgatct

SEQ ID NO: 277626 - DNA, 25 bp, Homo sapien
atgatccacccacgtccacctacca

SEQ ID NO: 277627 - DNA, 25 bp, Homo sapien
acccacgtccacctaccaaagtgct

SEQ ID NO: 277628 - DNA, 25 bp, Homo sapien
gcattgtgtgccattattgtctctg

SEQ ID NO: 277629 - DNA, 25 bp, Homo sapien
gtgccattattgtctctgttgtgat

SEQ ID NO: 277630 - DNA, 25 bp, Homo sapien
tattgtctctgttgtgattaatcac

SEQ ID NO: 277631 - DNA, 25 bp, Homo sapien
aagcagatgtcaatacattggcaaa

SEQ ID NO: 277632 - DNA, 25 bp, Homo sapien
attggcaaatggctgtgactatgtt

SEQ ID NO: 277633 - DNA, 25 bp, Homo sapien
atggctgtgactatgtttcaataaa

SEQ ID NO: 277634 - DNA, 25 bp, Homo sapien
gggtctttctctcaccatgcatggc

SEQ ID NO: 277635 - DNA, 25 bp, Homo sapien
atgcatggcctgtggctctgtcagc

SEQ ID NO: 277636 - DNA, 25 bp, Homo sapien
ctgtggctctgtcagcaaacgtttt

SEQ ID NO: 277637 - DNA, 25 bp, Homo sapien
cgttttctgcaaaaggccacctagt

SEQ ID NO: 277638 - DNA, 25 bp, Homo sapien
ggccacctagtaagtgttttaggca

SEQ ID NO: 277639 - DNA, 25 bp, Homo sapien
tggtatgagtaccttcaagctgaga

SEQ ID NO: 277640 - DNA, 25 bp, Homo sapien
gagtaccttcaagctgagaaattaa

SEQ ID NO: 277641 - DNA, 25 bp, Homo sapien
aaattggcagtatttttgtgaggcc

SEQ ID NO: 277642 - DNA, 25 bp, Homo sapien
gaattcacctaaaacccagactaca

SEQ ID NO: 277643 - DNA, 25 bp, Homo sapien
aacccagactacacaagatttctat

SEQ ID NO: 277644 - DNA, 25 bp, Homo sapien
gatttctataggtaaaacacttctt

SEQ ID NO: 277645 - DNA, 25 bp, Homo sapien
cttcttaaaatgaacttgtcttcca

SEQ ID NO: 277646 - DNA, 25 bp, Homo sapien
atgaacttgtcttccaaaatacaaa

SEQ ID NO: 277647 - DNA, 25 bp, Homo sapien
gaaggaacaatcttccacgcacaaa

SEQ ID NO: 277648 - DNA, 25 bp, Homo sapien
atcttccacgcacaaatgttagcag

SEQ ID NO: 277649 - DNA, 25 bp, Homo sapien
gatagaattatcagctcaaatttcc

SEQ ID NO: 277650 - DNA, 25 bp, Homo sapien
tcctgagtacagctttagctggata

SEQ ID NO: 277651 - DNA, 25 bp, Homo sapien
gctttagctggatactataggtttt

SEQ ID NO: 277652 - DNA, 25 bp, Homo sapien
aaggagtctacatttatcattttta

SEQ ID NO: 277653 - DNA, 25 bp, Homo sapien
ttttattcctctttggttgtttgag

SEQ ID NO: 277654 - DNA, 25 bp, Homo sapien
ataatgggtttcttaatttctagca

SEQ ID NO: 277655 - DNA, 25 bp, Homo sapien
gggtttcttaatttctagcatttag

SEQ ID NO: 277656 - DNA, 25 bp, Homo sapien
ctagcatttaggaatcttgattttt

SEQ ID NO: 277657 - DNA, 25 bp, Homo sapien
ctagttttattggattatgagcaga

SEQ ID NO: 277658 - DNA, 25 bp, Homo sapien
gagcagaaaacatggcctgtaaaaa

SEQ ID NO: 277659 - DNA, 25 bp, Homo sapien
gtgtgaatttttcttcattgtcaag

SEQ ID NO: 277660 - DNA, 25 bp, Homo sapien
aagtacctgattgattttggacata

SEQ ID NO: 277661 - DNA, 25 bp, Homo sapien
aagaattccaaatagacaaactcgg

SEQ ID NO: 277662 - DNA, 25 bp, Homo sapien
gacaaactcggtatgcttgggattt

SEQ ID NO: 277663 - DNA, 25 bp, Homo sapien
tatgcttgggatttgctttacattc

SEQ ID NO: 277664 - DNA, 25 bp, Homo sapien
gctttacattctaagtggatttgga

SEQ ID NO: 277665 - DNA, 25 bp, Homo sapien
gcaaggcaaatgtggatatatgttt

SEQ ID NO: 277666 - DNA, 25 bp, Homo sapien
ggatatatgtttataactgcacaaa

SEQ ID NO: 277667 - DNA, 25 bp, Homo sapien
gaattctgaagggacgcataagaca

SEQ ID NO: 277668 - DNA, 25 bp, Homo sapien
gggaacaaaacttactctgcaaaag

SEQ ID NO: 277669 - DNA, 25 bp, Homo sapien
aatatatgatttacctgctgttgtc

SEQ ID NO: 277670 - DNA, 25 bp, Homo sapien
gatttacctgctgttgtcataagaa

SEQ ID NO: 277671 - DNA, 25 bp, Homo sapien
acctgctgttgtcataagaattcca

SEQ ID NO: 277672 - DNA, 25 bp, Homo sapien
caccactcttctccatgaaaactat

SEQ ID NO: 277673 - DNA, 25 bp, Homo sapien
gcaaatgcataaatattcaaagctc

SEQ ID NO: 277674 - DNA, 25 bp, Homo sapien
aaagctcattttctgcagaaacact

SEQ ID NO: 277675 - DNA, 25 bp, Homo sapien
gaaacacttctggtatatgaaatta

SEQ ID NO: 277676 - DNA, 25 bp, Homo sapien
agatcagaagaagctacagtttttc

SEQ ID NO: 277677 - DNA, 25 bp, Homo sapien
ggaaatgtcatctattcataccttt

SEQ ID NO: 277678 - DNA, 25 bp, Homo sapien
tgtcatctattcatacctttctctc

SEQ ID NO: 277679 - DNA, 25 bp, Homo sapien
acctttctctccaaattcagtgttc

SEQ ID NO: 277680 - DNA, 25 bp, Homo sapien
cagtgttctttccatatgctccatt

SEQ ID NO: 277681 - DNA, 25 bp, Homo sapien
gttctttccatatgctccattgtac

SEQ ID NO: 277682 - DNA, 25 bp, Homo sapien
tttccatatgctccattgtactcca

SEQ ID NO: 277683 - DNA, 25 bp, Homo sapien
gtctgtttgctagtggaggctgtta

SEQ ID NO: 277684 - DNA, 25 bp, Homo sapien
gctgttaacagcacgggaagtggtc

SEQ ID NO: 277685 - DNA, 25 bp, Homo sapien
gggttcaacaagagatgagccatct

SEQ ID NO: 277686 - DNA, 25 bp, Homo sapien
agccatctggtcctccagaggtgga

SEQ ID NO: 277687 - DNA, 25 bp, Homo sapien
gaggaggcacgtgacccacatggtc

SEQ ID NO: 277688 - DNA, 25 bp, Homo sapien
acccacatggtctggccactgatga

SEQ ID NO: 277689 - DNA, 25 bp, Homo sapien
tggccactgatgactgaacaagcta

SEQ ID NO: 277690 - DNA, 25 bp, Homo sapien
tgaacaagctatggacaccggaccc

SEQ ID NO: 277691 - DNA, 25 bp, Homo sapien
gagttcagatacatgccccaaaagg

SEQ ID NO: 277692 - DNA, 25 bp, Homo sapien
tgagtcaaccctctggaatgcccac

SEQ ID NO: 277693 - DNA, 25 bp, Homo sapien
aggccagccggctttgggactcccg

SEQ ID NO: 277694 - DNA, 25 bp, Homo sapien
tggttacacactctgctggccacat

SEQ ID NO: 277695 - DNA, 25 bp, Homo sapien
actctgctggccacattaaaaatta

SEQ ID NO: 277696 - DNA, 25 bp, Homo sapien
gactcatgttaaattatctcctcca

SEQ ID NO: 277697 - DNA, 25 bp, Homo sapien
ttatctcctccaaaggactttttat

SEQ ID NO: 277698 - DNA, 25 bp, Homo sapien
tggactctacctgcttggttcagtg

SEQ ID NO: 277699 - DNA, 25 bp, Homo sapien
tctacctgcttggttcagtgtcctg

SEQ ID NO: 277700 - DNA, 25 bp, Homo sapien
gaaccactacttagtaattagttct

SEQ ID NO: 277701 - DNA, 25 bp, Homo sapien
gtatctacttctaaaattacctagt

SEQ ID NO: 277702 - DNA, 25 bp, Homo sapien
gaaggatatgcttagttttagaaat

SEQ ID NO: 277703 - DNA, 25 bp, Homo sapien
gaagcaaggatctagtcagtgttac

SEQ ID NO: 277704 - DNA, 25 bp, Homo sapien
gatctagtcagtgttacagggtaaa

SEQ ID NO: 277705 - DNA, 25 bp, Homo sapien
gatctgcaagtggtccttttttggt

SEQ ID NO: 277706 - DNA, 25 bp, Homo sapien
tttggtagctattgactgaccaggg

SEQ ID NO: 277707 - DNA, 25 bp, Homo sapien
acaggtgactgctgtagccttgagt

SEQ ID NO: 277708 - DNA, 25 bp, Homo sapien
agccttgagtgaggacctcggccaa

SEQ ID NO: 277709 - DNA, 25 bp, Homo sapien
aaaaagaaggctcctaccgtggctg

SEQ ID NO: 277710 - DNA, 25 bp, Homo sapien
tcctaccgtggctgtttgctgatgg

SEQ ID NO: 277711 - DNA, 25 bp, Homo sapien
gctgatggtcttcgcagagcctgct

SEQ ID NO: 277712 - DNA, 25 bp, Homo sapien
tgctgtctttgagcttcctgagaga

SEQ ID NO: 277713 - DNA, 25 bp, Homo sapien
gcttaggtgagtgctccaggtccat

SEQ ID NO: 277714 - DNA, 25 bp, Homo sapien
aagcctgaggaatctaaacccttgg

SEQ ID NO: 277715 - DNA, 25 bp, Homo sapien
aaacccttgggacttctggatctgc

SEQ ID NO: 277716 - DNA, 25 bp, Homo sapien
ttcctaggtctccagtggcccctca

SEQ ID NO: 277717 - DNA, 25 bp, Homo sapien
ggccttgcagtctctctaccctggg

SEQ ID NO: 277718 - DNA, 25 bp, Homo sapien
cagaagaaggcaggagttgattttt

SEQ ID NO: 277719 - DNA, 25 bp, Homo sapien
gggtttctttgtcctcaaggtactg

SEQ ID NO: 277720 - DNA, 25 bp, Homo sapien
gtttctttgtcctcaaggtactgtt

SEQ ID NO: 277721 - DNA, 25 bp, Homo sapien
ttgtcctcaaggtactgttctgttt

SEQ ID NO: 277722 - DNA, 25 bp, Homo sapien
tgtcctcaaggtactgttctgtttc

SEQ ID NO: 277723 - DNA, 25 bp, Homo sapien
ttctgtttctctttacccctctgct

SEQ ID NO: 277724 - DNA, 25 bp, Homo sapien
ttatttattgtaagcattcccacgt

SEQ ID NO: 277725 - DNA, 25 bp, Homo sapien
tttattgtaagcattcccacgttaa

SEQ ID NO: 277726 - DNA, 25 bp, Homo sapien
attgtaagcattcccacgttaaata

SEQ ID NO: 277727 - DNA, 25 bp, Homo sapien
tcctttgtgagtcttggttggcccc

SEQ ID NO: 277728 - DNA, 25 bp, Homo sapien
cctttgtgagtcttggttggcccca

SEQ ID NO: 277729 - DNA, 25 bp, Homo sapien
tttgtgagtcttggttggccccagc

SEQ ID NO: 277730 - DNA, 25 bp, Homo sapien
ttgtgagtcttggttggccccagcc

SEQ ID NO: 277731 - DNA, 25 bp, Homo sapien
gtagggctgtgggttccagaactct

SEQ ID NO: 277732 - DNA, 25 bp, Homo sapien
tagggctgtgggttccagaactcta

SEQ ID NO: 277733 - DNA, 25 bp, Homo sapien
agggctgtgggttccagaactctat

SEQ ID NO: 277734 - DNA, 25 bp, Homo sapien
gggctgtgggttccagaactctata

SEQ ID NO: 277735 - DNA, 25 bp, Homo sapien
ggctgtgggttccagaactctataa

SEQ ID NO: 277736 - DNA, 25 bp, Homo sapien
ctgtgggttccagaactctataact

SEQ ID NO: 277737 - DNA, 25 bp, Homo sapien
gtgggttccagaactctataactgg

SEQ ID NO: 277738 - DNA, 25 bp, Homo sapien
gccgcctcttctctgcgtcgcaggc

SEQ ID NO: 277739 - DNA, 25 bp, Homo sapien
ccggcggccgtgacaatgtcgcggg

SEQ ID NO: 277740 - DNA, 25 bp, Homo sapien
gggctggtagcagggcgccggccgc

SEQ ID NO: 277741 - DNA, 25 bp, Homo sapien
cgccgagccgtctcaagtttaaact

SEQ ID NO: 277742 - DNA, 25 bp, Homo sapien
gccgagccgtctcaagtttaaactt

SEQ ID NO: 277743 - DNA, 25 bp, Homo sapien
gagccgtctcaagtttaaacttaca

SEQ ID NO: 277744 - DNA, 25 bp, Homo sapien
gccgtctcaagtttaaacttacacg

SEQ ID NO: 277745 - DNA, 25 bp, Homo sapien
caagtttaaacttacacgaatcgct

SEQ ID NO: 277746 - DNA, 25 bp, Homo sapien
ttaaacttacacgaatcgctttctg

SEQ ID NO: 277747 - DNA, 25 bp, Homo sapien
taaacttacacgaatcgctttctgg

SEQ ID NO: 277748 - DNA, 25 bp, Homo sapien
aaacttacacgaatcgctttctgga

SEQ ID NO: 277749 - DNA, 25 bp, Homo sapien
ctttccagctgaagggacgaaccca

SEQ ID NO: 277750 - DNA, 25 bp, Homo sapien
agtaacaaggcccaagaccccacat

SEQ ID NO: 277751 - DNA, 25 bp, Homo sapien
ccaagaccccacatgggtcagataa

SEQ ID NO: 277752 - DNA, 25 bp, Homo sapien
ggtcagataagcagcccctactaga

SEQ ID NO: 277753 - DNA, 25 bp, Homo sapien
agcagcccctactagaagcttgcta

SEQ ID NO: 277754 - DNA, 25 bp, Homo sapien
gaagcttgctactcgttaactgaaa

SEQ ID NO: 277755 - DNA, 25 bp, Homo sapien
aaaagtggaggccacgcactacttt

SEQ ID NO: 277756 - DNA, 25 bp, Homo sapien
tactttcactctctctagcaggtga

SEQ ID NO: 277757 - DNA, 25 bp, Homo sapien
tgatggcaacagtcactccgtgtaa

SEQ ID NO: 277758 - DNA, 25 bp, Homo sapien
cagtcactccgtgtaaggtttaact

SEQ ID NO: 277759 - DNA, 25 bp, Homo sapien
gaattacaccatttgatatctccat

SEQ ID NO: 277760 - DNA, 25 bp, Homo sapien
attttcagttaattaggttgtcact

SEQ ID NO: 277761 - DNA, 25 bp, Homo sapien
tttcagttaattaggttgtcacttt

SEQ ID NO: 277762 - DNA, 25 bp, Homo sapien
cagttaattaggttgtcactttttg

SEQ ID NO: 277763 - DNA, 25 bp, Homo sapien
acagttagaactgatgcacacatcc

SEQ ID NO: 277764 - DNA, 25 bp, Homo sapien
ttagaactgatgcacacatccgttt

SEQ ID NO: 277765 - DNA, 25 bp, Homo sapien
taaacagctatctgaaataggaagt

SEQ ID NO: 277766 - DNA, 25 bp, Homo sapien
cagctatctgaaataggaagtgtaa

SEQ ID NO: 277767 - DNA, 25 bp, Homo sapien
atatgttagcatattgtatacattg

SEQ ID NO: 277768 - DNA, 25 bp, Homo sapien
attaacataagctagaatcattgac

SEQ ID NO: 277769 - DNA, 25 bp, Homo sapien
acataagctagaatcattgacataa

SEQ ID NO: 277770 - DNA, 25 bp, Homo sapien
taagctagaatcattgacataaatt

SEQ ID NO: 277771 - DNA, 25 bp, Homo sapien
caagcctttttgggcttttctatca

SEQ ID NO: 277772 - DNA, 25 bp, Homo sapien
ctatcaccagtatctgactgtggca

SEQ ID NO: 277773 - DNA, 25 bp, Homo sapien
agtatctgactgtggcatgaatctc

SEQ ID NO: 277774 - DNA, 25 bp, Homo sapien
gtatctgactgtggcatgaatctca

SEQ ID NO: 277775 - DNA, 25 bp, Homo sapien
tctgactgtggcatgaatctcagtt

SEQ ID NO: 277776 - DNA, 25 bp, Homo sapien
ctgtggcatgaatctcagttaacaa

SEQ ID NO: 277777 - DNA, 25 bp, Homo sapien
aagcatatccaaatcaccctttaaa

SEQ ID NO: 277778 - DNA, 25 bp, Homo sapien
gcatatccaaatcaccctttaaatt

SEQ ID NO: 277779 - DNA, 25 bp, Homo sapien
ttaaaatatctgtgcccttaaaggg

SEQ ID NO: 277780 - DNA, 25 bp, Homo sapien
atatctgtgcccttaaagggctgat

SEQ ID NO: 277781 - DNA, 25 bp, Homo sapien
aaagggctgatgaaaaccagaagaa

SEQ ID NO: 277782 - DNA, 25 bp, Homo sapien
actgtgagactggttttttggtatg

SEQ ID NO: 277783 - DNA, 25 bp, Homo sapien
gtttttgaactcctctaagcctctg

SEQ ID NO: 277784 - DNA, 25 bp, Homo sapien
ttgggagtagaaataccacttccta

SEQ ID NO: 277785 - DNA, 25 bp, Homo sapien
taccacttcctaaagtctgttttat

SEQ ID NO: 277786 - DNA, 25 bp, Homo sapien
ttgaactcctctaagcctctgtttt

SEQ ID NO: 277787 - DNA, 25 bp, Homo sapien
aaattctctatccaggcatagtgta

SEQ ID NO: 277788 - DNA, 25 bp, Homo sapien
aatatacagataatggccagacgcc

SEQ ID NO: 277789 - DNA, 25 bp, Homo sapien
agacgccatggctaaaacctgtgac

SEQ ID NO: 277790 - DNA, 25 bp, Homo sapien
aaacctgtgacgctagcacttcgga

SEQ ID NO: 277791 - DNA, 25 bp, Homo sapien
tgacgctagcacttcggaaggctga

SEQ ID NO: 277792 - DNA, 25 bp, Homo sapien
atcgggttgagtgaatatttagtaa

SEQ ID NO: 277793 - DNA, 25 bp, Homo sapien
gtaaaatgccaaagttcaactagat

SEQ ID NO: 277794 - DNA, 25 bp, Homo sapien
actagatgatgtatcaggctcttcc

SEQ ID NO: 277795 - DNA, 25 bp, Homo sapien
aaagctccatgattctatgatcaat

SEQ ID NO: 277796 - DNA, 25 bp, Homo sapien
gatcccataccaatactaagtccta

SEQ ID NO: 277797 - DNA, 25 bp, Homo sapien
aatactaagtcctaggtctccacag

SEQ ID NO: 277798 - DNA, 25 bp, Homo sapien
aagtcctaggtctccacagaatgtc

SEQ ID NO: 277799 - DNA, 25 bp, Homo sapien
cagaatgtccctatagtctttcaaa

SEQ ID NO: 277800 - DNA, 25 bp, Homo sapien
gtctttcaaaaaataccatcgctca

SEQ ID NO: 277801 - DNA, 25 bp, Homo sapien
aaataccatcgctcatttagaagag

SEQ ID NO: 277802 - DNA, 25 bp, Homo sapien
atattatagcttgttttgccttaaa

SEQ ID NO: 277803 - DNA, 25 bp, Homo sapien
agaatttccaaaccaggcaaggcac

SEQ ID NO: 277804 - DNA, 25 bp, Homo sapien
atatttggtactgagattggttctg

SEQ ID NO: 277805 - DNA, 25 bp, Homo sapien
catgtggctgctgtggttataggta

SEQ ID NO: 277806 - DNA, 25 bp, Homo sapien
aaatctgatattcttttaccgaaat

SEQ ID NO: 277807 - DNA, 25 bp, Homo sapien
ccgaaataaccccagtatcatctac

SEQ ID NO: 277808 - DNA, 25 bp, Homo sapien
gtatcatctactacttaccatctgt

SEQ ID NO: 277809 - DNA, 25 bp, Homo sapien
aatagactttactctgtcttttttg

SEQ ID NO: 277810 - DNA, 25 bp, Homo sapien
tgtcttttttgtcttcggtttattg

SEQ ID NO: 277811 - DNA, 25 bp, Homo sapien
ggtttattgtactgagtgccgccaa

SEQ ID NO: 277812 - DNA, 25 bp, Homo sapien
gagtgccgccaaaacaacttttgtt

SEQ ID NO: 277813 - DNA, 25 bp, Homo sapien
gcagctggttctataggaatgtagg

SEQ ID NO: 277814 - DNA, 25 bp, Homo sapien
gagccagaggccagtattgatttca

SEQ ID NO: 277815 - DNA, 25 bp, Homo sapien
actcattttctaatgcaactcctag

SEQ ID NO: 277816 - DNA, 25 bp, Homo sapien
taatgcaactcctagaaactctatg

SEQ ID NO: 277817 - DNA, 25 bp, Homo sapien
gcaactcctagaaactctatgatat

SEQ ID NO: 277818 - DNA, 25 bp, Homo sapien
gtaagtattgttaccacacatgggc

SEQ ID NO: 277819 - DNA, 25 bp, Homo sapien
acatgggctaagatccccagaggca

SEQ ID NO: 277820 - DNA, 25 bp, Homo sapien
taagatccccagaggcagactgcct

SEQ ID NO: 277821 - DNA, 25 bp, Homo sapien
actgcctgagttcaattcttggctc

SEQ ID NO: 277822 - DNA, 25 bp, Homo sapien
gagttcaattcttggctccaccatt

SEQ ID NO: 277823 - DNA, 25 bp, Homo sapien
aaagcttacaacttgagattcagca

SEQ ID NO: 277824 - DNA, 25 bp, Homo sapien
gagattcagcatcttgctcagtatt

SEQ ID NO: 277825 - DNA, 25 bp, Homo sapien
ttgctcagtatttccaagactaata

SEQ ID NO: 277826 - DNA, 25 bp, Homo sapien
tccccacaaaagatgccacgagaac

SEQ ID NO: 277827 - DNA, 25 bp, Homo sapien
tcgtgaactgtgataagcaatgaac

SEQ ID NO: 277828 - DNA, 25 bp, Homo sapien
gttgaagaagcacctcatgaacctc

SEQ ID NO: 277829 - DNA, 25 bp, Homo sapien
atgaacctccccagagaaacgggat

SEQ ID NO: 277830 - DNA, 25 bp, Homo sapien
ggagattccccgttttgtggaatgc

SEQ ID NO: 277831 - DNA, 25 bp, Homo sapien
ccgttttgtggaatgctttctgtgt

SEQ ID NO: 277832 - DNA, 25 bp, Homo sapien
tgtttcctacttctggatgcctaag

SEQ ID NO: 277833 - DNA, 25 bp, Homo sapien
gatgcctaaggagtggccagtcata

SEQ ID NO: 277834 - DNA, 25 bp, Homo sapien
agtggccagtcatactcctggctga

SEQ ID NO: 277835 - DNA, 25 bp, Homo sapien
aggcaccgtggttttcctcactgaa

SEQ ID NO: 277836 - DNA, 25 bp, Homo sapien
gtggttttcctcactgaactcaagg

SEQ ID NO: 277837 - DNA, 25 bp, Homo sapien
agaggagcagtgtgtagtcccctgt

SEQ ID NO: 277838 - DNA, 25 bp, Homo sapien
gcagtgtgtagtcccctgtttgaca

SEQ ID NO: 277839 - DNA, 25 bp, Homo sapien
agtcccctgtttgacagggctggga

SEQ ID NO: 277840 - DNA, 25 bp, Homo sapien
atttctttgagcctagtggttactt

SEQ ID NO: 277841 - DNA, 25 bp, Homo sapien
tacttgggaagttaactaagcttgg

SEQ ID NO: 277842 - DNA, 25 bp, Homo sapien
aggaagattgctccaaaggaaagaa

SEQ ID NO: 277843 - DNA, 25 bp, Homo sapien
ggtcaagccagaacctctagagaat

SEQ ID NO: 277844 - DNA, 25 bp, Homo sapien
aggtgaaaaatgttgagtccagttt

SEQ ID NO: 277845 - DNA, 25 bp, Homo sapien
gtccagtttgtttcccaaatcagcg

SEQ ID NO: 277846 - DNA, 25 bp, Homo sapien
ttgtttcccaaatcagcggactgag

SEQ ID NO: 277847 - DNA, 25 bp, Homo sapien
cggactgagaagttggaggcactaa

SEQ ID NO: 277848 - DNA, 25 bp, Homo sapien
gcaaaaacatccttgactcatgtat

SEQ ID NO: 277849 - DNA, 25 bp, Homo sapien
actcatgtattgaagggtctttttt

SEQ ID NO: 277850 - DNA, 25 bp, Homo sapien
gagaacatctgtcatctgtatcaca

SEQ ID NO: 277851 - DNA, 25 bp, Homo sapien
ttaacagtgactgatgaccaccagt

SEQ ID NO: 277852 - DNA, 25 bp, Homo sapien
tgaccaccagttacttcatatgaag

SEQ ID NO: 277853 - DNA, 25 bp, Homo sapien
tcagttatttgtccactaagttggt

SEQ ID NO: 277854 - DNA, 25 bp, Homo sapien
ctaagttggtgggtgctttttgaca

SEQ ID NO: 277855 - DNA, 25 bp, Homo sapien
acaaaagcccgggaaatatgatctg

SEQ ID NO: 277856 - DNA, 25 bp, Homo sapien
gatctgcaatttctatcgagtgatg

SEQ ID NO: 277857 - DNA, 25 bp, Homo sapien
cttgaaataatcctacggctgggaa

SEQ ID NO: 277858 - DNA, 25 bp, Homo sapien
ggctgggaaattattctcctccttt

SEQ ID NO: 277859 - DNA, 25 bp, Homo sapien
cgccagctctctcctttataaacag

SEQ ID NO: 277860 - DNA, 25 bp, Homo sapien
ttagactggtttgtatcatgcccct

SEQ ID NO: 277861 - DNA, 25 bp, Homo sapien
actggtttgtatcatgccccttgat

SEQ ID NO: 277862 - DNA, 25 bp, Homo sapien
gtatcatgccccttgatgtaccaga

SEQ ID NO: 277863 - DNA, 25 bp, Homo sapien
atgccccttgatgtaccagagatat

SEQ ID NO: 277864 - DNA, 25 bp, Homo sapien
gatgtaccagagatatgtttaacca

SEQ ID NO: 277865 - DNA, 25 bp, Homo sapien
acctagttttgttgattctgacaat

SEQ ID NO: 277866 - DNA, 25 bp, Homo sapien
gattctgacaatctcacacacattt

SEQ ID NO: 277867 - DNA, 25 bp, Homo sapien
gacaatctcacacacatttaagaat

SEQ ID NO: 277868 - DNA, 25 bp, Homo sapien
gaatttaccatttttcaggcacttt

SEQ ID NO: 277869 - DNA, 25 bp, Homo sapien
aataaaaataagtcgccagctctct

SEQ ID NO: 277870 - DNA, 25 bp, Homo sapien
gtactgcaaccagatgatgcgtcgt

SEQ ID NO: 277871 - DNA, 25 bp, Homo sapien
gatgcgtcgtcgtaacatgacccaa

SEQ ID NO: 277872 - DNA, 25 bp, Homo sapien
ggtcgttgcaaaccggtgaacactt

SEQ ID NO: 277873 - DNA, 25 bp, Homo sapien
gaacactttcgttcatgaaccgctt

SEQ ID NO: 277874 - DNA, 25 bp, Homo sapien
gaaccgcttgtagacgttcagaacg

SEQ ID NO: 277875 - DNA, 25 bp, Homo sapien
gttcagaacgtttgcttccaagaga

SEQ ID NO: 277876 - DNA, 25 bp, Homo sapien
aaatggccagggtaactgctacaaa

SEQ ID NO: 277877 - DNA, 25 bp, Homo sapien
gctacaaatctaactcttctatgca

SEQ ID NO: 277878 - DNA, 25 bp, Homo sapien
atatcactgactgccgtcttactaa

SEQ ID NO: 277879 - DNA, 25 bp, Homo sapien
gaacgtcatatcatcgttgcatgcg

SEQ ID NO: 277880 - DNA, 25 bp, Homo sapien
gttgcatgcgaaggctctccgtacg

SEQ ID NO: 277881 - DNA, 25 bp, Homo sapien
agagcccatatccccatagagtcta

SEQ ID NO: 277882 - DNA, 25 bp, Homo sapien
ggtcgccaaatgttttcttaaagag

SEQ ID NO: 277883 - DNA, 25 bp, Homo sapien
gttttcttaaagagcctgatagtgt

SEQ ID NO: 277884 - DNA, 25 bp, Homo sapien
aagagcctgatagtgtatatgttag

SEQ ID NO: 277885 - DNA, 25 bp, Homo sapien
agtgtatatgttaggctttgtgagc

SEQ ID NO: 277886 - DNA, 25 bp, Homo sapien
agccaggtatttacagcaactcaat

SEQ ID NO: 277887 - DNA, 25 bp, Homo sapien
ggtatttacagcaactcaattctac

SEQ ID NO: 277888 - DNA, 25 bp, Homo sapien
agcaactcaattctaccactgtggt

SEQ ID NO: 277889 - DNA, 25 bp, Homo sapien
aactcaattctaccactgtggtatg

SEQ ID NO: 277890 - DNA, 25 bp, Homo sapien
ctaccactgtggtatgaaaacagct

SEQ ID NO: 277891 - DNA, 25 bp, Homo sapien
gtgatatgaaaacagctatagacaa

SEQ ID NO: 277892 - DNA, 25 bp, Homo sapien
taatggcaaaccagattctgtggga

SEQ ID NO: 277893 - DNA, 25 bp, Homo sapien
aacacagattatgcgaactggacag

SEQ ID NO: 277894 - DNA, 25 bp, Homo sapien
ttatgcgaactggacagaacacttg

SEQ ID NO: 277895 - DNA, 25 bp, Homo sapien
cgaactggacagaacacttgggaaa

SEQ ID NO: 277896 - DNA, 25 bp, Homo sapien
actggacagaacacttgggaaagta

SEQ ID NO: 277897 - DNA, 25 bp, Homo sapien
ttgggaaagtaaaaatatccttgct

SEQ ID NO: 277898 - DNA, 25 bp, Homo sapien
ttgctgtttcatttgctccacttgt

SEQ ID NO: 277899 - DNA, 25 bp, Homo sapien
tttgctccacttgtgcaaccaagta

SEQ ID NO: 277900 - DNA, 25 bp, Homo sapien
gctccacttgtgcaaccaagtaaga

SEQ ID NO: 277901 - DNA, 25 bp, Homo sapien
tgtgcaaccaagtaagaatgataat

SEQ ID NO: 277902 - DNA, 25 bp, Homo sapien
gtaagaatgataatggcaaaccaga

SEQ ID NO: 277903 - DNA, 25 bp, Homo sapien
acatcctggaccctgcgcagggcgt

SEQ ID NO: 277904 - DNA, 25 bp, Homo sapien
agggcgtccttgatgtcctgcagca

SEQ ID NO: 277905 - DNA, 25 bp, Homo sapien
cagcggccctcgagctcggcgatga

SEQ ID NO: 277906 - DNA, 25 bp, Homo sapien
tcgagctcggcgatgagctcagcta

SEQ ID NO: 277907 - DNA, 25 bp, Homo sapien
agctcggcgatgagctcagctaggt

SEQ ID NO: 277908 - DNA, 25 bp, Homo sapien
atgagctcagctaggtgggcgctct

SEQ ID NO: 277909 - DNA, 25 bp, Homo sapien
agctcagctaggtgggcgctctgct

SEQ ID NO: 277910 - DNA, 25 bp, Homo sapien
aaacctccgcagtgtctctaccagt

SEQ ID NO: 277911 - DNA, 25 bp, Homo sapien
gcagtgtctctaccagtcccgggac

SEQ ID NO: 277912 - DNA, 25 bp, Homo sapien
tgcacacggtcctcagctccatagg

SEQ ID NO: 277913 - DNA, 25 bp, Homo sapien
gtcctcagctccataggcacaactt

SEQ ID NO: 277914 - DNA, 25 bp, Homo sapien
gaagtacgtagccttgaaccggagt

SEQ ID NO: 277915 - DNA, 25 bp, Homo sapien
cgtagccttgaaccggagtaaccag

SEQ ID NO: 277916 - DNA, 25 bp, Homo sapien
tgaaccggagtaaccagggacagaa

SEQ ID NO: 277917 - DNA, 25 bp, Homo sapien
cacttcgtccgcctgaggaggaaaa

SEQ ID NO: 277918 - DNA, 25 bp, Homo sapien
ctgtgaaaaagaacgtggagccctt

SEQ ID NO: 277919 - DNA, 25 bp, Homo sapien
aaagaacgtggagccctttctgccg

SEQ ID NO: 277920 - DNA, 25 bp, Homo sapien
tggagccctttctgccgaatggaaa

SEQ ID NO: 277921 - DNA, 25 bp, Homo sapien
ttctgccgaatggaaacccgctaaa

SEQ ID NO: 277922 - DNA, 25 bp, Homo sapien
gctaaaccccgttatggagtctgct

SEQ ID NO: 277923 - DNA, 25 bp, Homo sapien
aaaccccgttatggagtctgctaca

SEQ ID NO: 277924 - DNA, 25 bp, Homo sapien
atgtgacgttcctaggaacttagct

SEQ ID NO: 277925 - DNA, 25 bp, Homo sapien
ttgagcgttttttcactagtgcaac

SEQ ID NO: 277926 - DNA, 25 bp, Homo sapien
gagcgttttttcactagtgcaactt

SEQ ID NO: 277927 - DNA, 25 bp, Homo sapien
gttttttcactagtgcaactttgga

SEQ ID NO: 277928 - DNA, 25 bp, Homo sapien
tcactagtgcaactttggatttttt

SEQ ID NO: 277929 - DNA, 25 bp, Homo sapien
gagaattttggtaccttaatgaaca

SEQ ID NO: 277930 - DNA, 25 bp, Homo sapien
caaggctgaggatgtgtaaccctta

SEQ ID NO: 277931 - DNA, 25 bp, Homo sapien
agccatcttggaatgtcacaggaac

SEQ ID NO: 277932 - DNA, 25 bp, Homo sapien
catcttggaatgtcacaggaactgg

SEQ ID NO: 277933 - DNA, 25 bp, Homo sapien
gtcacaggaactggttgaacacctg

SEQ ID NO: 277934 - DNA, 25 bp, Homo sapien
ggaactggttgaacacctgaagcaa

SEQ ID NO: 277935 - DNA, 25 bp, Homo sapien
aactggttgaacacctgaagcaaac

SEQ ID NO: 277936 - DNA, 25 bp, Homo sapien
ttcagactctgaaatctgtcattac

SEQ ID NO: 277937 - DNA, 25 bp, Homo sapien
atctgtcattacaatcaagtgcttg

SEQ ID NO: 277938 - DNA, 25 bp, Homo sapien
acaatcaagtgcttgtcacagctga

SEQ ID NO: 277939 - DNA, 25 bp, Homo sapien
gctgaaagatttctggtggcttaaa

SEQ ID NO: 277940 - DNA, 25 bp, Homo sapien
ggtggcttaaagtttactagcagta

SEQ ID NO: 277941 - DNA, 25 bp, Homo sapien
gatatggtacagttctttgtacaga

SEQ ID NO: 277942 - DNA, 25 bp, Homo sapien
gtacagaaaggcaccattatgttag

SEQ ID NO: 277943 - DNA, 25 bp, Homo sapien
gaagaatcaggttttaaccttgtgt

SEQ ID NO: 277944 - DNA, 25 bp, Homo sapien
accttgtgtgtctgttacttctgag

SEQ ID NO: 277945 - DNA, 25 bp, Homo sapien
gttacttctgagtgcatttctataa

SEQ ID NO: 277946 - DNA, 25 bp, Homo sapien
gcgtcaacattataaaagagcactt

SEQ ID NO: 277947 - DNA, 25 bp, Homo sapien
aactcccagagaacacccatgtagc

SEQ ID NO: 277948 - DNA, 25 bp, Homo sapien
cagagaacacccatgtagcaagagt

SEQ ID NO: 277949 - DNA, 25 bp, Homo sapien
aggattcaaagcgaagggactgcaa

SEQ ID NO: 277950 - DNA, 25 bp, Homo sapien
agggactgcaagaaccatggaacca

SEQ ID NO: 277951 - DNA, 25 bp, Homo sapien
atggaaccagcctcccacgattttg

SEQ ID NO: 277952 - DNA, 25 bp, Homo sapien
agcctcccacgattttgcggatgac

SEQ ID NO: 277953 - DNA, 25 bp, Homo sapien
tgcggatgacgaacccgagccttgg

SEQ ID NO: 277954 - DNA, 25 bp, Homo sapien
gagccaagaatcagacatgcacaga

SEQ ID NO: 277955 - DNA, 25 bp, Homo sapien
acatgcacagaactgctgattggaa

SEQ ID NO: 277956 - DNA, 25 bp, Homo sapien
aaatctgatctcatagccctggtgt

SEQ ID NO: 277957 - DNA, 25 bp, Homo sapien
gatctcatagccctggtgtgggcaa

SEQ ID NO: 277958 - DNA, 25 bp, Homo sapien
taattgcctacttaaaattttcagt

SEQ ID NO: 277959 - DNA, 25 bp, Homo sapien
attttcagttaattaggttgtcact

SEQ ID NO: 277960 - DNA, 25 bp, Homo sapien
cagttaattaggttgtcactttttg

SEQ ID NO: 277961 - DNA, 25 bp, Homo sapien
taattaggttgtcactttttgttct

SEQ ID NO: 277962 - DNA, 25 bp, Homo sapien
acagttagaactgatgcacacatcc

SEQ ID NO: 277963 - DNA, 25 bp, Homo sapien
ttagaactgatgcacacatccgttt

SEQ ID NO: 277964 - DNA, 25 bp, Homo sapien
actcattttaaacagctatctgaaa

SEQ ID NO: 277965 - DNA, 25 bp, Homo sapien
aacagctatctgaaataggaagtgt

SEQ ID NO: 277966 - DNA, 25 bp, Homo sapien
atatgttagcatattgtatacattg

SEQ ID NO: 277967 - DNA, 25 bp, Homo sapien
attaacataagctagaatcattgac

SEQ ID NO: 277968 - DNA, 25 bp, Homo sapien
acataagctagaatcattgacataa

SEQ ID NO: 277969 - DNA, 25 bp, Homo sapien
atgatgcaactatcccgggattgtg

SEQ ID NO: 277970 - DNA, 25 bp, Homo sapien
gagatttgcgtctttcagtatttca

SEQ ID NO: 277971 - DNA, 25 bp, Homo sapien
gcgtctttcagtatttcaatgttgg

SEQ ID NO: 277972 - DNA, 25 bp, Homo sapien
agtgtttgggattatgtcttttaga

SEQ ID NO: 277973 - DNA, 25 bp, Homo sapien
tccaaacttgtgtgaggactgtgag

SEQ ID NO: 277974 - DNA, 25 bp, Homo sapien
cttaaaccattttcagtctccaaat

SEQ ID NO: 277975 - DNA, 25 bp, Homo sapien
ttttcagtctccaaataaagcccca

SEQ ID NO: 277976 - DNA, 25 bp, Homo sapien
taaagccccaagcaaggcagtagct

SEQ ID NO: 277977 - DNA, 25 bp, Homo sapien
caagcaaggcagtagctccacctaa

SEQ ID NO: 277978 - DNA, 25 bp, Homo sapien
aaggcagtagctccacctaacatga

SEQ ID NO: 277979 - DNA, 25 bp, Homo sapien
gcagtagctccacctaacatgatgc

SEQ ID NO: 277980 - DNA, 25 bp, Homo sapien
gtgtgaacattccacgacagaactt

SEQ ID NO: 277981 - DNA, 25 bp, Homo sapien
gaacattccacgacagaacttcact

SEQ ID NO: 277982 - DNA, 25 bp, Homo sapien
cacgacagaacttcactaaatgtgt

SEQ ID NO: 277983 - DNA, 25 bp, Homo sapien
ccctgtaaggccatgggacacacag

SEQ ID NO: 277984 - DNA, 25 bp, Homo sapien
taaggccatgggacacacagcccat

SEQ ID NO: 277985 - DNA, 25 bp, Homo sapien
tcctgggctggaagtctgtgtatga

SEQ ID NO: 277986 - DNA, 25 bp, Homo sapien
atgggacacacagcccatcagttct

SEQ ID NO: 277987 - DNA, 25 bp, Homo sapien
tcttcatgtggtcatcccctgttag

SEQ ID NO: 277988 - DNA, 25 bp, Homo sapien
ttcatgtggtcatcccctgttagat

SEQ ID NO: 277989 - DNA, 25 bp, Homo sapien
tcatgtggtcatcccctgttagatg

SEQ ID NO: 277990 - DNA, 25 bp, Homo sapien
cctcatttttgtaccttctgtgtga

SEQ ID NO: 277991 - DNA, 25 bp, Homo sapien
atgagactgagccatatctgcagta

SEQ ID NO: 277992 - DNA, 25 bp, Homo sapien
gagccatatctgcagtaagagaaat

SEQ ID NO: 277993 - DNA, 25 bp, Homo sapien
aaagtgattctctaacagacctctt

SEQ ID NO: 277994 - DNA, 25 bp, Homo sapien
gtgattctctaacagacctcttaaa

SEQ ID NO: 277995 - DNA, 25 bp, Homo sapien
cagacctcttaaattgtgacatgaa

SEQ ID NO: 277996 - DNA, 25 bp, Homo sapien
gggcgtgttcttcagaatatatagt

SEQ ID NO: 277997 - DNA, 25 bp, Homo sapien
gttattttcaacaaatgccaggcta

SEQ ID NO: 277998 - DNA, 25 bp, Homo sapien
aaatgccaggctagattcctcacat

SEQ ID NO: 277999 - DNA, 25 bp, Homo sapien
aggctagattcctcacatgtggcta

SEQ ID NO: 278000 - DNA, 25 bp, Homo sapien
ctagattcctcacatgtggctattt

SEQ ID NO: 278001 - DNA, 25 bp, Homo sapien
acatgtggctatttcttatgtaaga

SEQ ID NO: 278002 - DNA, 25 bp, Homo sapien
gcttgagggagcttataacttgcac

SEQ ID NO: 278003 - DNA, 25 bp, Homo sapien
ggagcttataacttgcacctagagg

SEQ ID NO: 278004 - DNA, 25 bp, Homo sapien
tgcacctagagggtttacccacttt

SEQ ID NO: 278005 - DNA, 25 bp, Homo sapien
ggtttacccactttgtggatttgat

SEQ ID NO: 278006 - DNA, 25 bp, Homo sapien
atttgatttatccaccaaccacagc

SEQ ID NO: 278007 - DNA, 25 bp, Homo sapien
ataatgtcaagattctaggagttta

SEQ ID NO: 278008 - DNA, 25 bp, Homo sapien
gttttcattttgagtcagacattct

SEQ ID NO: 278009 - DNA, 25 bp, Homo sapien
gtcagacattcttttctcattctca

SEQ ID NO: 278010 - DNA, 25 bp, Homo sapien
ctcaaatctgttttaaatgctccaa

SEQ ID NO: 278011 - DNA, 25 bp, Homo sapien
taatgcttctgtagtaaccatatgc

SEQ ID NO: 278012 - DNA, 25 bp, Homo sapien
gtaaccatatgcagtttactttgaa

SEQ ID NO: 278013 - DNA, 25 bp, Homo sapien
caagaccatctccaacagccggaag

SEQ ID NO: 278014 - DNA, 25 bp, Homo sapien
gaccatctccaacagccggaagctg

SEQ ID NO: 278015 - DNA, 25 bp, Homo sapien
caacagccggaagctgatgaacatc

SEQ ID NO: 278016 - DNA, 25 bp, Homo sapien
atgaacatcgccttcaatgacatga

SEQ ID NO: 278017 - DNA, 25 bp, Homo sapien
tcaatgacatgaaccccttccgcat

SEQ ID NO: 278018 - DNA, 25 bp, Homo sapien
tgcgcatggtccaccgggagcggct

SEQ ID NO: 278019 - DNA, 25 bp, Homo sapien
tcccggcgcagagctgtgtccgagg

SEQ ID NO: 278020 - DNA, 25 bp, Homo sapien
agagctgtgtccgagggctgtgcca

SEQ ID NO: 278021 - DNA, 25 bp, Homo sapien
gctgtgccagcgaggacgaggtgga

SEQ ID NO: 278022 - DNA, 25 bp, Homo sapien
acccttggctggcagacccactgga

SEQ ID NO: 278023 - DNA, 25 bp, Homo sapien
cttggctggcagacccactggaggt

SEQ ID NO: 278024 - DNA, 25 bp, Homo sapien
cttgccacagacagaacctttggaa

SEQ ID NO: 278025 - DNA, 25 bp, Homo sapien
gccacagacagaacctttggaagat

SEQ ID NO: 278026 - DNA, 25 bp, Homo sapien
aagatgatattgttggtgtctagcc

SEQ ID NO: 278027 - DNA, 25 bp, Homo sapien
gatgatattgttggtgtctagcctt

SEQ ID NO: 278028 - DNA, 25 bp, Homo sapien
gatattgttggtgtctagcctttgg

SEQ ID NO: 278029 - DNA, 25 bp, Homo sapien
attgttggtgtctagcctttggtta

SEQ ID NO: 278030 - DNA, 25 bp, Homo sapien
tgttggtgtctagcctttggttaag

SEQ ID NO: 278031 - DNA, 25 bp, Homo sapien
gcctttggttaagatcaacacttga

SEQ ID NO: 278032 - DNA, 25 bp, Homo sapien
gatcaacacttgatgggtgattttt

SEQ ID NO: 278033 - DNA, 25 bp, Homo sapien
aacacttgatgggtgatttttaata

SEQ ID NO: 278034 - DNA, 25 bp, Homo sapien
taataaaaacagctagcttaatgtt

SEQ ID NO: 278035 - DNA, 25 bp, Homo sapien
gggcctgtttgcatcggccaaagca

SEQ ID NO: 278036 - DNA, 25 bp, Homo sapien
gcctgtttgcatcggccaaagcagt

SEQ ID NO: 278037 - DNA, 25 bp, Homo sapien
gtttgcatcggccaaagcagtttct

SEQ ID NO: 278038 - DNA, 25 bp, Homo sapien
agcagtttctaagacacggcgggac

SEQ ID NO: 278039 - DNA, 25 bp, Homo sapien
agtttctaagacacggcgggactgt

SEQ ID NO: 278040 - DNA, 25 bp, Homo sapien
aagacacggcgggactgtgatccga

SEQ ID NO: 278041 - DNA, 25 bp, Homo sapien
acacggcgggactgtgatccgaaag

SEQ ID NO: 278042 - DNA, 25 bp, Homo sapien
gactgtgatccgaaagggcgctggg

SEQ ID NO: 278043 - DNA, 25 bp, Homo sapien
gaacagaaggtcttctcggcctcgg

SEQ ID NO: 278044 - DNA, 25 bp, Homo sapien
cagaaggtcttctcggcctcggaaa

SEQ ID NO: 278045 - DNA, 25 bp, Homo sapien
tcttctcggcctcggaaaagggacg

SEQ ID NO: 278046 - DNA, 25 bp, Homo sapien
caagtgatcagttgctttaaaacct

SEQ ID NO: 278047 - DNA, 25 bp, Homo sapien
gatcagttgctttaaaacctaatca

SEQ ID NO: 278048 - DNA, 25 bp, Homo sapien
gctttaaaacctaatcaatatttgg

SEQ ID NO: 278049 - DNA, 25 bp, Homo sapien
gcaaaacacttgcttcacatttctc

SEQ ID NO: 278050 - DNA, 25 bp, Homo sapien
aaaacacttgcttcacatttctctg

SEQ ID NO: 278051 - DNA, 25 bp, Homo sapien
aacacttgcttcacatttctctgca

SEQ ID NO: 278052 - DNA, 25 bp, Homo sapien
tctgcagatctttggccctcttcgt

SEQ ID NO: 278053 - DNA, 25 bp, Homo sapien
gccctcttcgtgcagtagtgaattg

SEQ ID NO: 278054 - DNA, 25 bp, Homo sapien
cctcttcgtgcagtagtgaattgtt

SEQ ID NO: 278055 - DNA, 25 bp, Homo sapien
tttccaatgagtgttctcgagaaac

SEQ ID NO: 278056 - DNA, 25 bp, Homo sapien
tgagtgttctcgagaaacaaccctg

SEQ ID NO: 278057 - DNA, 25 bp, Homo sapien
aatgccagtacttgtttgctgtgga

SEQ ID NO: 278058 - DNA, 25 bp, Homo sapien
ctaggaatggattgcttagtctaaa

SEQ ID NO: 278059 - DNA, 25 bp, Homo sapien
tctaaagtaagcactaccaccatcc

SEQ ID NO: 278060 - DNA, 25 bp, Homo sapien
atccacgttttcactcaacacagtg

SEQ ID NO: 278061 - DNA, 25 bp, Homo sapien
actcaacacagtgccttttaattgg

SEQ ID NO: 278062 - DNA, 25 bp, Homo sapien
ggtgactaacatcaaaacaccttga

SEQ ID NO: 278063 - DNA, 25 bp, Homo sapien
agaaaccatgtgtacatccctgtgc

SEQ ID NO: 278064 - DNA, 25 bp, Homo sapien
atccctgtgcctcttagattgctaa

SEQ ID NO: 278065 - DNA, 25 bp, Homo sapien
gattgctaagttctgctctcattct

SEQ ID NO: 278066 - DNA, 25 bp, Homo sapien
tctgctctcattcttacttcaaagg

SEQ ID NO: 278067 - DNA, 25 bp, Homo sapien
aatacaagtcatagccctgttggca

SEQ ID NO: 278068 - DNA, 25 bp, Homo sapien
tttaaggccctggtggtgcacagga

SEQ ID NO: 278069 - DNA, 25 bp, Homo sapien
ggccataaggagcttcttatctact

SEQ ID NO: 278070 - DNA, 25 bp, Homo sapien
atctactttaagctcttggctggct

SEQ ID NO: 278071 - DNA, 25 bp, Homo sapien
ctcttggctggcttttccaggaagt

SEQ ID NO: 278072 - DNA, 25 bp, Homo sapien
aatcatgactcattttctgcagggt

SEQ ID NO: 278073 - DNA, 25 bp, Homo sapien
gactcattttctgcagggtcagtgg

SEQ ID NO: 278074 - DNA, 25 bp, Homo sapien
aaactggagaggtggctgtccctgt

SEQ ID NO: 278075 - DNA, 25 bp, Homo sapien
tgttcctgccggtgcctgaagcttt

SEQ ID NO: 278076 - DNA, 25 bp, Homo sapien
acaggaagccgtgactaaaatgata

SEQ ID NO: 278077 - DNA, 25 bp, Homo sapien
aggtacactgttcctaatacgggat

SEQ ID NO: 278078 - DNA, 25 bp, Homo sapien
ataaaagactcaacaccacacctga

SEQ ID NO: 278079 - DNA, 25 bp, Homo sapien
gattctgcattatgcatttgccatc

SEQ ID NO: 278080 - DNA, 25 bp, Homo sapien
atttgccatctatcaatcgctgcct

SEQ ID NO: 278081 - DNA, 25 bp, Homo sapien
atcgctgccttattttgaatcattt

SEQ ID NO: 278082 - DNA, 25 bp, Homo sapien
tttggcacttattccaccaagctgc

SEQ ID NO: 278083 - DNA, 25 bp, Homo sapien
tgccctttgacttatccatctattt

SEQ ID NO: 278084 - DNA, 25 bp, Homo sapien
ccatctatttcccatatgtgctgaa

SEQ ID NO: 278085 - DNA, 25 bp, Homo sapien
atatctcatgatgctctttataggt

SEQ ID NO: 278086 - DNA, 25 bp, Homo sapien
tttacctacagtcatctatactcag

SEQ ID NO: 278087 - DNA, 25 bp, Homo sapien
aagagacatcctcggaatctttccc

SEQ ID NO: 278088 - DNA, 25 bp, Homo sapien
gtacagcattccagtgtgacacgag

SEQ ID NO: 278089 - DNA, 25 bp, Homo sapien
aagacaggctgtggattcagtgcag

SEQ ID NO: 278090 - DNA, 25 bp, Homo sapien
atgtgcctggccgagagagattcaa

SEQ ID NO: 278091 - DNA, 25 bp, Homo sapien
gtgcctggccgagagagattcaagt

SEQ ID NO: 278092 - DNA, 25 bp, Homo sapien
gcctggccgagagagattcaagtta

SEQ ID NO: 278093 - DNA, 25 bp, Homo sapien
cctggccgagagagattcaagttag

SEQ ID NO: 278094 - DNA, 25 bp, Homo sapien
gtcctatatggccaagctatgggct

SEQ ID NO: 278095 - DNA, 25 bp, Homo sapien
atatggccaagctatgggctagcag

SEQ ID NO: 278096 - DNA, 25 bp, Homo sapien
tggccaagctatgggctagcaggat

SEQ ID NO: 278097 - DNA, 25 bp, Homo sapien
caagctatgggctagcaggatgccc

SEQ ID NO: 278098 - DNA, 25 bp, Homo sapien
caggatgccctgtgtatgccagtcc

SEQ ID NO: 278099 - DNA, 25 bp, Homo sapien
gatgccctgtgtatgccagtcccag

SEQ ID NO: 278100 - DNA, 25 bp, Homo sapien
gtgtatgccagtcccagggcttgtt

SEQ ID NO: 278101 - DNA, 25 bp, Homo sapien
gggacgccgcagcacagcccagcac

SEQ ID NO: 278102 - DNA, 25 bp, Homo sapien
ggcagaggtgaccacggcccctctt

SEQ ID NO: 278103 - DNA, 25 bp, Homo sapien
tctttgctccgtcatcggctggtca

SEQ ID NO: 278104 - DNA, 25 bp, Homo sapien
ctttgctccgtcatcggctggtcag

SEQ ID NO: 278105 - DNA, 25 bp, Homo sapien
ctggtcagctgtggtcacggtgcct

SEQ ID NO: 278106 - DNA, 25 bp, Homo sapien
tcagctgtggtcacggtgcctcaga

SEQ ID NO: 278107 - DNA, 25 bp, Homo sapien
tgtggtcacggtgcctcagaggaca

SEQ ID NO: 278108 - DNA, 25 bp, Homo sapien
ggtcacggtgcctcagaggacagat

SEQ ID NO: 278109 - DNA, 25 bp, Homo sapien
cacggtgcctcagaggacagatctc

SEQ ID NO: 278110 - DNA, 25 bp, Homo sapien
gggcaagtgccagatcctgagagcg

SEQ ID NO: 278111 - DNA, 25 bp, Homo sapien
gactcggagctgcagcctgcacgac

SEQ ID NO: 278112 - DNA, 25 bp, Homo sapien
agagctctatcccagcctgagggct

SEQ ID NO: 278113 - DNA, 25 bp, Homo sapien
cctgagggctggactgttgttatct

SEQ ID NO: 278114 - DNA, 25 bp, Homo sapien
gagggctggactgttgttatctcca

SEQ ID NO: 278115 - DNA, 25 bp, Homo sapien
tggactgttgttatctccagcacct

SEQ ID NO: 278116 - DNA, 25 bp, Homo sapien
gactgttgttatctccagcacctgt

SEQ ID NO: 278117 - DNA, 25 bp, Homo sapien
gttatctccagcacctgtctgtgat

SEQ ID NO: 278118 - DNA, 25 bp, Homo sapien
ctccagcacctgtctgtgatcaagg

SEQ ID NO: 278119 - DNA, 25 bp, Homo sapien
gtctcatttggctcattccaaggca

SEQ ID NO: 278120 - DNA, 25 bp, Homo sapien
atttggctcattccaaggcagtctg

SEQ ID NO: 278121 - DNA, 25 bp, Homo sapien
taaaatgtatgcatgctcccactcc

SEQ ID NO: 278122 - DNA, 25 bp, Homo sapien
ggctcgcacatccaggaggtgctca

SEQ ID NO: 278123 - DNA, 25 bp, Homo sapien
ggcttatgtagcaaaatggcaccta

SEQ ID NO: 278124 - DNA, 25 bp, Homo sapien
tggcacctacctgcaaagaacttag

SEQ ID NO: 278125 - DNA, 25 bp, Homo sapien
agaacttagtccctaatggagatga

SEQ ID NO: 278126 - DNA, 25 bp, Homo sapien
aaatgtgctaagtggatttactagt

SEQ ID NO: 278127 - DNA, 25 bp, Homo sapien
agtaatatgtgagccaaggacgata

SEQ ID NO: 278128 - DNA, 25 bp, Homo sapien
gacgataaagctcctgattctgatg

SEQ ID NO: 278129 - DNA, 25 bp, Homo sapien
aagctcctgattctgatgggtatca

SEQ ID NO: 278130 - DNA, 25 bp, Homo sapien
gcttttcaggaagtgttacttgtta

SEQ ID NO: 278131 - DNA, 25 bp, Homo sapien
gttacttgttataggtcagaggtca

SEQ ID NO: 278132 - DNA, 25 bp, Homo sapien
gcaaactacaggttacaaccccact

SEQ ID NO: 278133 - DNA, 25 bp, Homo sapien
attggaatacagttatgcccacttg

SEQ ID NO: 278134 - DNA, 25 bp, Homo sapien
tttatttgatttgtggtctttagtc

SEQ ID NO: 278135 - DNA, 25 bp, Homo sapien
gatttgtggtctttagtcataggta

SEQ ID NO: 278136 - DNA, 25 bp, Homo sapien
gtggtctttagtcataggtaatcaa

SEQ ID NO: 278137 - DNA, 25 bp, Homo sapien
ggtctttagtcataggtaatcaaaa

SEQ ID NO: 278138 - DNA, 25 bp, Homo sapien
tgcaaaactttatacattaatgtac

SEQ ID NO: 278139 - DNA, 25 bp, Homo sapien
aatgatggtacaaattgccacttta

SEQ ID NO: 278140 - DNA, 25 bp, Homo sapien
gggaataataatcaaagcacgtgtt

SEQ ID NO: 278141 - DNA, 25 bp, Homo sapien
taatcaaagcacgtgttccttcagt

SEQ ID NO: 278142 - DNA, 25 bp, Homo sapien
tcaaagcacgtgttccttcagtact

SEQ ID NO: 278143 - DNA, 25 bp, Homo sapien
gtatctaggaatctatacttccaat

SEQ ID NO: 278144 - DNA, 25 bp, Homo sapien
aggaatctatacttccaatacagat

SEQ ID NO: 278145 - DNA, 25 bp, Homo sapien
ggtgaagaagactcggcctacctac

SEQ ID NO: 278146 - DNA, 25 bp, Homo sapien
tacctactactcagtaatcctgctg

SEQ ID NO: 278147 - DNA, 25 bp, Homo sapien
actactcagtaatcctgctgtccag

SEQ ID NO: 278148 - DNA, 25 bp, Homo sapien
tcctgctgtccagtcgactggagaa

SEQ ID NO: 278149 - DNA, 25 bp, Homo sapien
ccagtcgactggagaagagagattt

SEQ ID NO: 278150 - DNA, 25 bp, Homo sapien
gttcacctctactagttttatttgt

SEQ ID NO: 278151 - DNA, 25 bp, Homo sapien
atagacccaagcacttttctcattt

SEQ ID NO: 278152 - DNA, 25 bp, Homo sapien
catttcttctgacagttcgagtcac

SEQ ID NO: 278153 - DNA, 25 bp, Homo sapien
agttcgagtcacttctcacagttga

SEQ ID NO: 278154 - DNA, 25 bp, Homo sapien
tcacagttgacttcctcaccaaata

SEQ ID NO: 278155 - DNA, 25 bp, Homo sapien
gttgacttcctcaccaaataataag

SEQ ID NO: 278156 - DNA, 25 bp, Homo sapien
tgcacaaacccttaatgaacactgt

SEQ ID NO: 278157 - DNA, 25 bp, Homo sapien
gaacactgtcttttcatggattcaa

SEQ ID NO: 278158 - DNA, 25 bp, Homo sapien
agccaaggtctaacatagggcctct

SEQ ID NO: 278159 - DNA, 25 bp, Homo sapien
taacatagggcctctcctcaaggag

SEQ ID NO: 278160 - DNA, 25 bp, Homo sapien
ggagggatacaattcttggttcagt

SEQ ID NO: 278161 - DNA, 25 bp, Homo sapien
gaaacagaaccctaaaacatccatt

SEQ ID NO: 278162 - DNA, 25 bp, Homo sapien
catttgattcaaggtgctggtccaa

SEQ ID NO: 278163 - DNA, 25 bp, Homo sapien
aggtgctggtccaacagagttttta

SEQ ID NO: 278164 - DNA, 25 bp, Homo sapien
aactactcacttctttatttcatcc

SEQ ID NO: 278165 - DNA, 25 bp, Homo sapien
cttctttatttcatcctttcgactg

SEQ ID NO: 278166 - DNA, 25 bp, Homo sapien
gatgggtcaggttacgacttacaac

SEQ ID NO: 278167 - DNA, 25 bp, Homo sapien
tgggttgtgtgttaccatgttttta

SEQ ID NO: 278168 - DNA, 25 bp, Homo sapien
catttccctcagttgtcaagtaggg

SEQ ID NO: 278169 - DNA, 25 bp, Homo sapien
tctgatgcttcactgatgacaccgg

SEQ ID NO: 278170 - DNA, 25 bp, Homo sapien
gcttcactgatgacaccggaaatga

SEQ ID NO: 278171 - DNA, 25 bp, Homo sapien
catgaattttcctgtactaaaacaa

SEQ ID NO: 278172 - DNA, 25 bp, Homo sapien
aaagttggttaaagcctgcatgtaa

SEQ ID NO: 278173 - DNA, 25 bp, Homo sapien
gatttagaggtgtatgtgctcctac

SEQ ID NO: 278174 - DNA, 25 bp, Homo sapien
gaggtgtatgtgctcctactgtgtt

SEQ ID NO: 278175 - DNA, 25 bp, Homo sapien
tactgtgttctctgctccaaggaat

SEQ ID NO: 278176 - DNA, 25 bp, Homo sapien
tccaaggaatcatggcgcagtgctc

SEQ ID NO: 278177 - DNA, 25 bp, Homo sapien
cccagaggtgggttgtgtgttacca

SEQ ID NO: 278178 - DNA, 25 bp, Homo sapien
acaccttaaggctgcagaaccctat

SEQ ID NO: 278179 - DNA, 25 bp, Homo sapien
ttaaggctgcagaaccctatgcctt

SEQ ID NO: 278180 - DNA, 25 bp, Homo sapien
gaaccctatgcctttaccatcctga

SEQ ID NO: 278181 - DNA, 25 bp, Homo sapien
agctggctgcagaaacccaggaaga

SEQ ID NO: 278182 - DNA, 25 bp, Homo sapien
aggaagagctggagacttggctgtg

SEQ ID NO: 278183 - DNA, 25 bp, Homo sapien
ggctgtgggcactggctggcgcgag

SEQ ID NO: 278184 - DNA, 25 bp, Homo sapien
aaaacccaatactgggagctgtgcc

SEQ ID NO: 278185 - DNA, 25 bp, Homo sapien
ggagctgtgccaggcaactggccaa

SEQ ID NO: 278186 - DNA, 25 bp, Homo sapien
aggcaactggccaagaacccatctc

SEQ ID NO: 278187 - DNA, 25 bp, Homo sapien
aacccatctcatccccagaggacag

SEQ ID NO: 278188 - DNA, 25 bp, Homo sapien
ggctttctagccactgtgagtaccc

SEQ ID NO: 278189 - DNA, 25 bp, Homo sapien
aataacagcacaaatcctccgacag

SEQ ID NO: 278190 - DNA, 25 bp, Homo sapien
aaatcctccgacagggcggattgtc

SEQ ID NO: 278191 - DNA, 25 bp, Homo sapien
cagggcggattgtctacccaacaaa

SEQ ID NO: 278192 - DNA, 25 bp, Homo sapien
gattgtctacccaacaaagagggag

SEQ ID NO: 278193 - DNA, 25 bp, Homo sapien
aaataagcagtttttgcaacaagaa

SEQ ID NO: 278194 - DNA, 25 bp, Homo sapien
aaaatacctcttgcttaggactgga

SEQ ID NO: 278195 - DNA, 25 bp, Homo sapien
tcttgcttaggactggaagccctat

SEQ ID NO: 278196 - DNA, 25 bp, Homo sapien
ggactggaagccctatcaaaatcct

SEQ ID NO: 278197 - DNA, 25 bp, Homo sapien
aaatccttggattcccacagttctc

SEQ ID NO: 278198 - DNA, 25 bp, Homo sapien
ttccccgatggaatgttgtgaacac

SEQ ID NO: 278199 - DNA, 25 bp, Homo sapien
gttgtgaacacatttgcttatagga

SEQ ID NO: 278200 - DNA, 25 bp, Homo sapien
ttctgtgggactccaccttggttga

SEQ ID NO: 278201 - DNA, 25 bp, Homo sapien
gtgggactccaccttggttgaccat

SEQ ID NO: 278202 - DNA, 25 bp, Homo sapien
ggactccaccttggttgaccataga

SEQ ID NO: 278203 - DNA, 25 bp, Homo sapien
actccaccttggttgaccatagaaa

SEQ ID NO: 278204 - DNA, 25 bp, Homo sapien
tggaaagtgaaactgtgcataaagg

SEQ ID NO: 278205 - DNA, 25 bp, Homo sapien
gtgcataaagggagactactgtact

SEQ ID NO: 278206 - DNA, 25 bp, Homo sapien
gggagactactgtacttgaaattct

SEQ ID NO: 278207 - DNA, 25 bp, Homo sapien
tacttgaaattctacaataaggaga

SEQ ID NO: 278208 - DNA, 25 bp, Homo sapien
aagtcatcagtaaccaacagtaact

SEQ ID NO: 278209 - DNA, 25 bp, Homo sapien
atcagtaaccaacagtaacttataa

SEQ ID NO: 278210 - DNA, 25 bp, Homo sapien
aagtcaggaattatgtgaatttcta

SEQ ID NO: 278211 - DNA, 25 bp, Homo sapien
aacgttcagtgtcgacctactcagg

SEQ ID NO: 278212 - DNA, 25 bp, Homo sapien
tactcaggttcaactgcgtcctgtc

SEQ ID NO: 278213 - DNA, 25 bp, Homo sapien
tgcgtcctgtccaagttcgtaagat

SEQ ID NO: 278214 - DNA, 25 bp, Homo sapien
tgtaactctagaagaccacctggca

SEQ ID NO: 278215 - DNA, 25 bp, Homo sapien
aagtgtgaaactgttgcagctgctc

SEQ ID NO: 278216 - DNA, 25 bp, Homo sapien
ctgttactagatctccgggtggttc

SEQ ID NO: 278217 - DNA, 25 bp, Homo sapien
tggttcccaggaacaacgcgctaaa

SEQ ID NO: 278218 - DNA, 25 bp, Homo sapien
caaacccgggttaccatcagaactg

SEQ ID NO: 278219 - DNA, 25 bp, Homo sapien
atcagaactgttcgcgtccgtagac

SEQ ID NO: 278220 - DNA, 25 bp, Homo sapien
gggtaaacaccgcaaattcaagcac

SEQ ID NO: 278221 - DNA, 25 bp, Homo sapien
aaattcaagcacacccacgacaaaa

SEQ ID NO: 278222 - DNA, 25 bp, Homo sapien
atagttttgcccttttatgaatgtg

SEQ ID NO: 278223 - DNA, 25 bp, Homo sapien
tagttttgcccttttatgaatgtga

SEQ ID NO: 278224 - DNA, 25 bp, Homo sapien
agttttgcccttttatgaatgtgat

SEQ ID NO: 278225 - DNA, 25 bp, Homo sapien
gttttgcccttttatgaatgtgatt

SEQ ID NO: 278226 - DNA, 25 bp, Homo sapien
tttgcccttttatgaatgtgattat

SEQ ID NO: 278227 - DNA, 25 bp, Homo sapien
gcccttttatgaatgtgattatctc

SEQ ID NO: 278228 - DNA, 25 bp, Homo sapien
gattatctcaattttattatgttaa

SEQ ID NO: 278229 - DNA, 25 bp, Homo sapien
tgttaaggaaggacacagtggccca

SEQ ID NO: 278230 - DNA, 25 bp, Homo sapien
gttaaggaaggacacagtggcccac

SEQ ID NO: 278231 - DNA, 25 bp, Homo sapien
aaggaaggacacagtggcccacacc

SEQ ID NO: 278232 - DNA, 25 bp, Homo sapien
tgaaccatgttaccactgctgcatt

SEQ ID NO: 278233 - DNA, 25 bp, Homo sapien
ggattctgtgcccaataccatgaaa

SEQ ID NO: 278234 - DNA, 25 bp, Homo sapien
tctgtgcccaataccatgaaatcaa

SEQ ID NO: 278235 - DNA, 25 bp, Homo sapien
gtgcccaataccatgaaatcaatgc

SEQ ID NO: 278236 - DNA, 25 bp, Homo sapien
ataccatgaaatcaatgcacagaag

SEQ ID NO: 278237 - DNA, 25 bp, Homo sapien
tcattccacaagcatttttgctggg

SEQ ID NO: 278238 - DNA, 25 bp, Homo sapien
cagatagggtgggtttgtataatga

SEQ ID NO: 278239 - DNA, 25 bp, Homo sapien
gagtataaaaaacttctagcagaag

SEQ ID NO: 278240 - DNA, 25 bp, Homo sapien
gtatatcaagaaagggctctcttcg

SEQ ID NO: 278241 - DNA, 25 bp, Homo sapien
gaaagggctctcttcgaaatcacac

SEQ ID NO: 278242 - DNA, 25 bp, Homo sapien
aagggctctcttcgaaatcacacca

SEQ ID NO: 278243 - DNA, 25 bp, Homo sapien
ggctctcttcgaaatcacaccactg

SEQ ID NO: 278244 - DNA, 25 bp, Homo sapien
tggcgtttgtctacggctttggcag

SEQ ID NO: 278245 - DNA, 25 bp, Homo sapien
cggtgggttacaagtgaagctgaat

SEQ ID NO: 278246 - DNA, 25 bp, Homo sapien
gaagctgaatcttgaaggtacccaa

SEQ ID NO: 278247 - DNA, 25 bp, Homo sapien
gaaggaatcaataactctctaggta

SEQ ID NO: 278248 - DNA, 25 bp, Homo sapien
aactctctaggtaactcgaaatcac

SEQ ID NO: 278249 - DNA, 25 bp, Homo sapien
acggctttggcagcttcgcgaattc

SEQ ID NO: 278250 - DNA, 25 bp, Homo sapien
taactacatttgcaacttcagaaat

SEQ ID NO: 278251 - DNA, 25 bp, Homo sapien
tcgcgaattccacgtgctaggtcat

SEQ ID NO: 278252 - DNA, 25 bp, Homo sapien
tcatggtggatgagagcggtcttca

SEQ ID NO: 278253 - DNA, 25 bp, Homo sapien
tggatgagagcggtcttcagcacct

SEQ ID NO: 278254 - DNA, 25 bp, Homo sapien
ggtcttcagcacctcttgtgaagca

SEQ ID NO: 278255 - DNA, 25 bp, Homo sapien
gggcgcgggacactccatctctgtt

SEQ ID NO: 278256 - DNA, 25 bp, Homo sapien
tgttcctgccggtcgggtccgcaaa

SEQ ID NO: 278257 - DNA, 25 bp, Homo sapien
gctgcggcgcccaaagggttaacgc

SEQ ID NO: 278258 - DNA, 25 bp, Homo sapien
aacgcaggcgttcggccagtgcaaa

SEQ ID NO: 278259 - DNA, 25 bp, Homo sapien
gtgcaaaccggcctcgcaggatccg

SEQ ID NO: 278260 - DNA, 25 bp, Homo sapien
ggatccgcgcttaaaatccgggtgt

SEQ ID NO: 278261 - DNA, 25 bp, Homo sapien
gggtttgtttcttctactatgccaa

SEQ ID NO: 278262 - DNA, 25 bp, Homo sapien
ttcttctactatgccaagctggtgg

SEQ ID NO: 278263 - DNA, 25 bp, Homo sapien
cgtgacgcacgcaccggaggaaaaa

SEQ ID NO: 278264 - DNA, 25 bp, Homo sapien
aggaaaaagtgcttctcggctcgct

SEQ ID NO: 278265 - DNA, 25 bp, Homo sapien
ggaagagagctcactccccatgcgg

SEQ ID NO: 278266 - DNA, 25 bp, Homo sapien
gttctcaaagacacatgcatttatt

SEQ ID NO: 278267 - DNA, 25 bp, Homo sapien
aatcctaagtgaataatgtctcatg

SEQ ID NO: 278268 - DNA, 25 bp, Homo sapien
atgtctcatgggagaacacatgata

SEQ ID NO: 278269 - DNA, 25 bp, Homo sapien
gtatttgtgtaatctgatcatgcac

SEQ ID NO: 278270 - DNA, 25 bp, Homo sapien
atctgatcatgcactcaatggttgg

SEQ ID NO: 278271 - DNA, 25 bp, Homo sapien
cactcaatggttggaaaaggcactc

SEQ ID NO: 278272 - DNA, 25 bp, Homo sapien
actccagtgctaagaaaataaccag

SEQ ID NO: 278273 - DNA, 25 bp, Homo sapien
ccagaagccaatatatcgattctta

SEQ ID NO: 278274 - DNA, 25 bp, Homo sapien
atatcgattcttatatctcggttta

SEQ ID NO: 278275 - DNA, 25 bp, Homo sapien
atctcggtttatgttaccaactgaa

SEQ ID NO: 278276 - DNA, 25 bp, Homo sapien
ggtgtaatgcataactttttccagt

SEQ ID NO: 278277 - DNA, 25 bp, Homo sapien
ttccaacaatgttttctaatcattt

SEQ ID NO: 278278 - DNA, 25 bp, Homo sapien
cattttattctgttagttattgtga

SEQ ID NO: 278279 - DNA, 25 bp, Homo sapien
gtgagattctgtaatctgtttctga

SEQ ID NO: 278280 - DNA, 25 bp, Homo sapien
attctgtaatctgtttctgaaagcc

SEQ ID NO: 278281 - DNA, 25 bp, Homo sapien
ttttagaatagattgcatgcacact

SEQ ID NO: 278282 - DNA, 25 bp, Homo sapien
agattgcatgcacacttttcctcat

SEQ ID NO: 278283 - DNA, 25 bp, Homo sapien
gcatgcacacttttcctcatagagt

SEQ ID NO: 278284 - DNA, 25 bp, Homo sapien
gcacacttttcctcatagagtctta

SEQ ID NO: 278285 - DNA, 25 bp, Homo sapien
cctcatagagtcttatatttctgaa

SEQ ID NO: 278286 - DNA, 25 bp, Homo sapien
ctgaagtattttggtgctttcaaat

SEQ ID NO: 278287 - DNA, 25 bp, Homo sapien
ggtgctttcaaataaccttatagta

SEQ ID NO: 278288 - DNA, 25 bp, Homo sapien
gattcagatgaatacttgtacattt

SEQ ID NO: 278289 - DNA, 25 bp, Homo sapien
gataaatatgtgctttaagtacctt

SEQ ID NO: 278290 - DNA, 25 bp, Homo sapien
gttgtggtgatgtttacagttgatc

SEQ ID NO: 278291 - DNA, 25 bp, Homo sapien
acagttgatctaacaccaaagctaa

SEQ ID NO: 278292 - DNA, 25 bp, Homo sapien
aaagtatctaactgtaagtcttaca

SEQ ID NO: 278293 - DNA, 25 bp, Homo sapien
gtaagtcttacaggagaaatcatgg

SEQ ID NO: 278294 - DNA, 25 bp, Homo sapien
gaacaaagagcttttcaccctagcc

SEQ ID NO: 278295 - DNA, 25 bp, Homo sapien
accctagccagtctaacatgcagtt

SEQ ID NO: 278296 - DNA, 25 bp, Homo sapien
gccagtctaacatgcagttttggta

SEQ ID NO: 278297 - DNA, 25 bp, Homo sapien
tgcagttttggtatctagattcccc

SEQ ID NO: 278298 - DNA, 25 bp, Homo sapien
ccccagttagagatgatgagcataa

SEQ ID NO: 278299 - DNA, 25 bp, Homo sapien
ctccgtggatgtgattgggaaccca

SEQ ID NO: 278300 - DNA, 25 bp, Homo sapien
taaatagattctggcccacagttta

SEQ ID NO: 278301 - DNA, 25 bp, Homo sapien
tctggcccacagtttacctcgaaag

SEQ ID NO: 278302 - DNA, 25 bp, Homo sapien
aaaggctgttgatgttgttctgttt

SEQ ID NO: 278303 - DNA, 25 bp, Homo sapien
ctgtttctcctctttcacttagaga

SEQ ID NO: 278304 - DNA, 25 bp, Homo sapien
gatcaatgttgattttgcgtacacc

SEQ ID NO: 278305 - DNA, 25 bp, Homo sapien
ttgcgtacaccatgacatcagcgtt

SEQ ID NO: 278306 - DNA, 25 bp, Homo sapien
atcagcgttaggcaattaggagaaa

SEQ ID NO: 278307 - DNA, 25 bp, Homo sapien
ccctcgaggaggctgtttctaacag

SEQ ID NO: 278308 - DNA, 25 bp, Homo sapien
atttccccactcaaagatcagatca

SEQ ID NO: 278309 - DNA, 25 bp, Homo sapien
aagatcagatcaccagcagaggagc

SEQ ID NO: 278310 - DNA, 25 bp, Homo sapien
ctgggacccttccagtagattggat

SEQ ID NO: 278311 - DNA, 25 bp, Homo sapien
tgggacccttccagtagattggatt

SEQ ID NO: 278312 - DNA, 25 bp, Homo sapien
gggacccttccagtagattggattt

SEQ ID NO: 278313 - DNA, 25 bp, Homo sapien
ggacccttccagtagattggatttc

SEQ ID NO: 278314 - DNA, 25 bp, Homo sapien
gacccttccagtagattggatttca

SEQ ID NO: 278315 - DNA, 25 bp, Homo sapien
ccttccagtagattggatttcactc

SEQ ID NO: 278316 - DNA, 25 bp, Homo sapien
gggagccggcagagccaaacaaaga

SEQ ID NO: 278317 - DNA, 25 bp, Homo sapien
ggagccggcagagccaaacaaagaa

SEQ ID NO: 278318 - DNA, 25 bp, Homo sapien
gccggcagagccaaacaaagaaagg

SEQ ID NO: 278319 - DNA, 25 bp, Homo sapien
gaagaagctgtaggactaaggactg

SEQ ID NO: 278320 - DNA, 25 bp, Homo sapien
gaggaatgtcatttgcttttcttgg

SEQ ID NO: 278321 - DNA, 25 bp, Homo sapien
acatcattactagtatattttgctt

SEQ ID NO: 278322 - DNA, 25 bp, Homo sapien
tactagtatattttgcttagatttg

SEQ ID NO: 278323 - DNA, 25 bp, Homo sapien
atcaaatgatgctgtcttatttaca

SEQ ID NO: 278324 - DNA, 25 bp, Homo sapien
gatgctgtcttatttacagtcagta

SEQ ID NO: 278325 - DNA, 25 bp, Homo sapien
gctgtcttatttacagtcagtaatt

SEQ ID NO: 278326 - DNA, 25 bp, Homo sapien
cagtcagtaattaagttcaattcaa

SEQ ID NO: 278327 - DNA, 25 bp, Homo sapien
ttcaaactattttaccttgaatata

SEQ ID NO: 278328 - DNA, 25 bp, Homo sapien
atttactttaattcatgtcaaaaca

SEQ ID NO: 278329 - DNA, 25 bp, Homo sapien
tctttttatacacacacatgaaata

SEQ ID NO: 278330 - DNA, 25 bp, Homo sapien
tgaaattaaattttgccagttgtaa

SEQ ID NO: 278331 - DNA, 25 bp, Homo sapien
gtaagacaaagacaacagataactt

SEQ ID NO: 278332 - DNA, 25 bp, Homo sapien
tgtgatgtgatcttgtctgctcgaa

SEQ ID NO: 278333 - DNA, 25 bp, Homo sapien
tcttgtctgctcgaagatggagagt

SEQ ID NO: 278334 - DNA, 25 bp, Homo sapien
gctttcatccagcactgttgtcatt

SEQ ID NO: 278335 - DNA, 25 bp, Homo sapien
aaagtgtctggaagactcctccgtg

SEQ ID NO: 278336 - DNA, 25 bp, Homo sapien
gagaaaacacgtgcgtggtttctgc

SEQ ID NO: 278337 - DNA, 25 bp, Homo sapien
cggtcagtaccggttagtgagcttt

SEQ ID NO: 278338 - DNA, 25 bp, Homo sapien
agtgagcttttgtctgcacctggtt

SEQ ID NO: 278339 - DNA, 25 bp, Homo sapien
tctgcacctggtttagacaataaag

SEQ ID NO: 278340 - DNA, 25 bp, Homo sapien
agaaacatgactaagcccggccatt

SEQ ID NO: 278341 - DNA, 25 bp, Homo sapien
attgtcttggctccaggcacctgat

SEQ ID NO: 278342 - DNA, 25 bp, Homo sapien
gctccaggcacctgatggtccttga

SEQ ID NO: 278343 - DNA, 25 bp, Homo sapien
atataggcttgtctctttggtcttt

SEQ ID NO: 278344 - DNA, 25 bp, Homo sapien
ctctttggtcttttattttggctct

SEQ ID NO: 278345 - DNA, 25 bp, Homo sapien
attttggctctattgttgggaatct

SEQ ID NO: 278346 - DNA, 25 bp, Homo sapien
tctatttcctattccataagtaagt

SEQ ID NO: 278347 - DNA, 25 bp, Homo sapien
gtaagtatacctaacatgctgtgga

SEQ ID NO: 278348 - DNA, 25 bp, Homo sapien
acctaacatgctgtggaatcttgag

SEQ ID NO: 278349 - DNA, 25 bp, Homo sapien
gaatcttgagtttccaacaccgtgc

SEQ ID NO: 278350 - DNA, 25 bp, Homo sapien
tccaacaccgtgctgcttgatagaa

SEQ ID NO: 278351 - DNA, 25 bp, Homo sapien
caccgtgctgcttgatagaatgact

SEQ ID NO: 278352 - DNA, 25 bp, Homo sapien
tgcttgatagaatgactttgaggtc

SEQ ID NO: 278353 - DNA, 25 bp, Homo sapien
gaggtccttggataaaatgtgatat

SEQ ID NO: 278354 - DNA, 25 bp, Homo sapien
caggctcctggtactttgtcagcaa

SEQ ID NO: 278355 - DNA, 25 bp, Homo sapien
cctggtactttgtcagcaacatact

SEQ ID NO: 278356 - DNA, 25 bp, Homo sapien
gcaacatactgctttcattcttaaa

SEQ ID NO: 278357 - DNA, 25 bp, Homo sapien
cattcttaaaggtttcattggctgt

SEQ ID NO: 278358 - DNA, 25 bp, Homo sapien
tttgcatactcactggagagaggaa

SEQ ID NO: 278359 - DNA, 25 bp, Homo sapien
gtcctaagataacatctgcacacag

SEQ ID NO: 278360 - DNA, 25 bp, Homo sapien
atctgcacacagagagtttatctga

SEQ ID NO: 278361 - DNA, 25 bp, Homo sapien
gtttatctgattccttatcaaccat

SEQ ID NO: 278362 - DNA, 25 bp, Homo sapien
tatcaaccatgatctctatctgagg

SEQ ID NO: 278363 - DNA, 25 bp, Homo sapien
tgatctctatctgaggtcctgtata

SEQ ID NO: 278364 - DNA, 25 bp, Homo sapien
gaggtcctgtatagtgggatcattt

SEQ ID NO: 278365 - DNA, 25 bp, Homo sapien
ggagtttactacctaagttgcttct

SEQ ID NO: 278366 - DNA, 25 bp, Homo sapien
gcttctagggcatatgtataccata

SEQ ID NO: 278367 - DNA, 25 bp, Homo sapien
gtagtctagatttctggatatactc

SEQ ID NO: 278368 - DNA, 25 bp, Homo sapien
tgattctctttcagtattccctcta

SEQ ID NO: 278369 - DNA, 25 bp, Homo sapien
tttcagtattccctctaaacatctc

SEQ ID NO: 278370 - DNA, 25 bp, Homo sapien
ccagcttagttaaaccctgcgtttg

SEQ ID NO: 278371 - DNA, 25 bp, Homo sapien
taaaccctgcgtttggaccttcctg

SEQ ID NO: 278372 - DNA, 25 bp, Homo sapien
tcctgcctgcagctattagtagaaa

SEQ ID NO: 278373 - DNA, 25 bp, Homo sapien
atatttccatatttcccttcaccta

SEQ ID NO: 278374 - DNA, 25 bp, Homo sapien
tatttcccttcacctaacattttat

SEQ ID NO: 278375 - DNA, 25 bp, Homo sapien
ttttggaagcgttatcagtcctatt

SEQ ID NO: 278376 - DNA, 25 bp, Homo sapien
caccactcttctccatgaaaactat

SEQ ID NO: 278377 - DNA, 25 bp, Homo sapien
ccactcttctccatgaaaactatga

SEQ ID NO: 278378 - DNA, 25 bp, Homo sapien
gcaaatgcataaatattcaaagctc

SEQ ID NO: 278379 - DNA, 25 bp, Homo sapien
gaaacacttctggtatatgaaatta

SEQ ID NO: 278380 - DNA, 25 bp, Homo sapien
gaaattattaaactgtagaatgcta

SEQ ID NO: 278381 - DNA, 25 bp, Homo sapien
agatcagaagaagctacagtttttc

SEQ ID NO: 278382 - DNA, 25 bp, Homo sapien
ggaaatgtcatctattcataccttt

SEQ ID NO: 278383 - DNA, 25 bp, Homo sapien
tgtcatctattcatacctttctctc

SEQ ID NO: 278384 - DNA, 25 bp, Homo sapien
cagtgttctttccatatgctccatt

SEQ ID NO: 278385 - DNA, 25 bp, Homo sapien
gttctttccatatgctccattgtac

SEQ ID NO: 278386 - DNA, 25 bp, Homo sapien
tttccatatgctccattgtactcca

SEQ ID NO: 278387 - DNA, 25 bp, Homo sapien
attgctgttgtgctgcattattgca

SEQ ID NO: 278388 - DNA, 25 bp, Homo sapien
gcattattgcaaaatagtcagcttc

SEQ ID NO: 278389 - DNA, 25 bp, Homo sapien
agtcagcttctaattatctattggc

SEQ ID NO: 278390 - DNA, 25 bp, Homo sapien
tatctattggctggttcaatcaagc

SEQ ID NO: 278391 - DNA, 25 bp, Homo sapien
tggttcaatcaagccttttccttct

SEQ ID NO: 278392 - DNA, 25 bp, Homo sapien
tgttctttcccttgctaagggaagg

SEQ ID NO: 278393 - DNA, 25 bp, Homo sapien
gaatgggagaactcaagccagctga

SEQ ID NO: 278394 - DNA, 25 bp, Homo sapien
ctcaagccagctgatgaccaattct

SEQ ID NO: 278395 - DNA, 25 bp, Homo sapien
ataagtgttgggatcctactgccac

SEQ ID NO: 278396 - DNA, 25 bp, Homo sapien
gtggtacaagtctttaatagctgat

SEQ ID NO: 278397 - DNA, 25 bp, Homo sapien
gattatagggaagtcattccccacc

SEQ ID NO: 278398 - DNA, 25 bp, Homo sapien
aacaccgtgacgaacctgcacgtgg

SEQ ID NO: 278399 - DNA, 25 bp, Homo sapien
ccgtgacgaacctgcacgtgggcgc

SEQ ID NO: 278400 - DNA, 25 bp, Homo sapien
gaggccgctgagtgcctggtgtgct

SEQ ID NO: 278401 - DNA, 25 bp, Homo sapien
ctggtgtgctccgagctggcgctgc

SEQ ID NO: 278402 - DNA, 25 bp, Homo sapien
tgctggtgctgttctcgccgtgcca

SEQ ID NO: 278403 - DNA, 25 bp, Homo sapien
cgcgcgcaggatgaagaagtgcatc

SEQ ID NO: 278404 - DNA, 25 bp, Homo sapien
atgaagaagtgcatcaggtgccagg

SEQ ID NO: 278405 - DNA, 25 bp, Homo sapien
gccaggtggtcgtcagcaagaaact

SEQ ID NO: 278406 - DNA, 25 bp, Homo sapien
ggtcgtcagcaagaaactgcgccca

SEQ ID NO: 278407 - DNA, 25 bp, Homo sapien
tcagcaagaaactgcgcccagacgg

SEQ ID NO: 278408 - DNA, 25 bp, Homo sapien
aactgcgcccagacggctctgaggt

SEQ ID NO: 278409 - DNA, 25 bp, Homo sapien
taggtaacttgcctttttagatcct

SEQ ID NO: 278410 - DNA, 25 bp, Homo sapien
gtaacttgcctttttagatcctatt

SEQ ID NO: 278411 - DNA, 25 bp, Homo sapien
acttgcctttttagatcctatttag

SEQ ID NO: 278412 - DNA, 25 bp, Homo sapien
atcctatttaggcttattagtctat

SEQ ID NO: 278413 - DNA, 25 bp, Homo sapien
gcttattagtctatattctacattc

SEQ ID NO: 278414 - DNA, 25 bp, Homo sapien
attctacattcttgcacgatggaaa

SEQ ID NO: 278415 - DNA, 25 bp, Homo sapien
ttgcacgatggaaattactagagaa

SEQ ID NO: 278416 - DNA, 25 bp, Homo sapien
accagagaaatagcacttgttaact

SEQ ID NO: 278417 - DNA, 25 bp, Homo sapien
gagaaatagcacttgttaactacaa

SEQ ID NO: 278418 - DNA, 25 bp, Homo sapien
ttaactacaattgtgactctaggta

SEQ ID NO: 278419 - DNA, 25 bp, Homo sapien
gtgactctaggtaaacttgggcctt

SEQ ID NO: 278420 - DNA, 25 bp, Homo sapien
caagaggatgtgatacagagatcca

SEQ ID NO: 278421 - DNA, 25 bp, Homo sapien
cattaggtgtctcctcatcagagat

SEQ ID NO: 278422 - DNA, 25 bp, Homo sapien
aggtgtctcctcatcagagattact

SEQ ID NO: 278423 - DNA, 25 bp, Homo sapien
gagattactaatcttatagtcctta

SEQ ID NO: 278424 - DNA, 25 bp, Homo sapien
gtccttaatcatctctcaaacttca

SEQ ID NO: 278425 - DNA, 25 bp, Homo sapien
aatcatctctcaaacttcagcttaa

SEQ ID NO: 278426 - DNA, 25 bp, Homo sapien
ttcagcttaaatctcagtttccaaa

SEQ ID NO: 278427 - DNA, 25 bp, Homo sapien
gtttccaaagaaggtgcatgatacc

SEQ ID NO: 278428 - DNA, 25 bp, Homo sapien
aggtgcatgataccactgtgaacac

SEQ ID NO: 278429 - DNA, 25 bp, Homo sapien
actgtgaacacaaaaccatgacttc

SEQ ID NO: 278430 - DNA, 25 bp, Homo sapien
accatgacttcaattgagaacagga

SEQ ID NO: 278431 - DNA, 25 bp, Homo sapien
cctggaaggtgctgactgggatata

SEQ ID NO: 278432 - DNA, 25 bp, Homo sapien
gtcttatcaagagcaaacccaaggt

SEQ ID NO: 278433 - DNA, 25 bp, Homo sapien
aacccaaggtgctggttgtggacct

SEQ ID NO: 278434 - DNA, 25 bp, Homo sapien
tggacctgccgatcctgaagatcat

SEQ ID NO: 278435 - DNA, 25 bp, Homo sapien
aagatcatccccattgaagcccatc

SEQ ID NO: 278436 - DNA, 25 bp, Homo sapien
aagcccatcgcctcaagctgcagaa

SEQ ID NO: 278437 - DNA, 25 bp, Homo sapien
aagctgcagaatactttccggaccc

SEQ ID NO: 278438 - DNA, 25 bp, Homo sapien
gtctacaccacctccatgagaagga

SEQ ID NO: 278439 - DNA, 25 bp, Homo sapien
aacgccatgggagtcggcttggttt

SEQ ID NO: 278440 - DNA, 25 bp, Homo sapien
gtcggcttggtttttgaagctgatc

SEQ ID NO: 278441 - DNA, 25 bp, Homo sapien
gatgctttgtctcaggactgtacct

SEQ ID NO: 278442 - DNA, 25 bp, Homo sapien
caacagggttagcatggccagcaca

SEQ ID NO: 278443 - DNA, 25 bp, Homo sapien
gcacagatcgctgcttttattgatg

SEQ ID NO: 278444 - DNA, 25 bp, Homo sapien
gatgcaaatcaagcctgctgcttct

SEQ ID NO: 278445 - DNA, 25 bp, Homo sapien
gcagacttagccaaggaactccaag

SEQ ID NO: 278446 - DNA, 25 bp, Homo sapien
tctacggtcaggcagcaggctctga

SEQ ID NO: 278447 - DNA, 25 bp, Homo sapien
gaactccaagatgcatgactgggac

SEQ ID NO: 278448 - DNA, 25 bp, Homo sapien
tccacatggaaatgccttgccctaa

SEQ ID NO: 278449 - DNA, 25 bp, Homo sapien
ccttgccctaaaccttgaatgactg

SEQ ID NO: 278450 - DNA, 25 bp, Homo sapien
tgcgatctgggagtgcatctgtcaa

SEQ ID NO: 278451 - DNA, 25 bp, Homo sapien
gtgcatctgtcaagtctttgtgttt

SEQ ID NO: 278452 - DNA, 25 bp, Homo sapien
aggctctgaaggctgatcctacacc

SEQ ID NO: 278453 - DNA, 25 bp, Homo sapien
atagttttgcccttttatgaatgtg

SEQ ID NO: 278454 - DNA, 25 bp, Homo sapien
tagttttgcccttttatgaatgtga

SEQ ID NO: 278455 - DNA, 25 bp, Homo sapien
agttttgcccttttatgaatgtgat

SEQ ID NO: 278456 - DNA, 25 bp, Homo sapien
gttttgcccttttatgaatgtgatt

SEQ ID NO: 278457 - DNA, 25 bp, Homo sapien
ttttgcccttttatgaatgtgatta

SEQ ID NO: 278458 - DNA, 25 bp, Homo sapien
tttgcccttttatgaatgtgattat

SEQ ID NO: 278459 - DNA, 25 bp, Homo sapien
tgcccttttatgaatgtgattatct

SEQ ID NO: 278460 - DNA, 25 bp, Homo sapien
gcccttttatgaatgtgattatctc

SEQ ID NO: 278461 - DNA, 25 bp, Homo sapien
cccttttatgaatgtgattatctca

SEQ ID NO: 278462 - DNA, 25 bp, Homo sapien
tgttaaggaaggacacagtggccca

SEQ ID NO: 278463 - DNA, 25 bp, Homo sapien
gttaaggaaggacacagtggcccac

SEQ ID NO: 278464 - DNA, 25 bp, Homo sapien
ttaaatgtgttatcctttgcctctt

SEQ ID NO: 278465 - DNA, 25 bp, Homo sapien
gtgttatcctttgcctctttgaaaa

SEQ ID NO: 278466 - DNA, 25 bp, Homo sapien
aatcatctagagacacagtgagaag

SEQ ID NO: 278467 - DNA, 25 bp, Homo sapien
gaggagaaaccacgacaataatatt

SEQ ID NO: 278468 - DNA, 25 bp, Homo sapien
caaaggacatgggaggagaattaac

SEQ ID NO: 278469 - DNA, 25 bp, Homo sapien
aacacagttatgctggttaagctgc

SEQ ID NO: 278470 - DNA, 25 bp, Homo sapien
gctggttaagctgcaggcctggttc

SEQ ID NO: 278471 - DNA, 25 bp, Homo sapien
gagcctgccagcactcagggaaggt

SEQ ID NO: 278472 - DNA, 25 bp, Homo sapien
tgccagcactcagggaaggttacct

SEQ ID NO: 278473 - DNA, 25 bp, Homo sapien
aggttacctgagtttcatggctgcc

SEQ ID NO: 278474 - DNA, 25 bp, Homo sapien
gagtttcatggctgccattgtgaga

SEQ ID NO: 278475 - DNA, 25 bp, Homo sapien
aagaaggtggctggcgccgctaccc

SEQ ID NO: 278476 - DNA, 25 bp, Homo sapien
gccgctaccccgaagaaaagcatca

SEQ ID NO: 278477 - DNA, 25 bp, Homo sapien
gcatcaaaaagactcctaagaaggt

SEQ ID NO: 278478 - DNA, 25 bp, Homo sapien
aagaagccagcaaccgctgctggga

SEQ ID NO: 278479 - DNA, 25 bp, Homo sapien
agcaaccgctgctgggaccaagaaa

SEQ ID NO: 278480 - DNA, 25 bp, Homo sapien
aaccgctgctgggaccaagaaagtg

SEQ ID NO: 278481 - DNA, 25 bp, Homo sapien
aagaaagtggccaagagtgcgaaaa

SEQ ID NO: 278482 - DNA, 25 bp, Homo sapien
ggccaagagtgcgaaaaaggtgaaa

SEQ ID NO: 278483 - DNA, 25 bp, Homo sapien
gtgaaaacacctcagccaaaaaaag

SEQ ID NO: 278484 - DNA, 25 bp, Homo sapien
agagtccagctaaggccaaagcccc

SEQ ID NO: 278485 - DNA, 25 bp, Homo sapien
tccagctaaggccaaagcccctaag

SEQ ID NO: 278486 - DNA, 25 bp, Homo sapien
attgcctctaggttcttgtgttcat

SEQ ID NO: 278487 - DNA, 25 bp, Homo sapien
gttcttgtgttcattctcgctggac

SEQ ID NO: 278488 - DNA, 25 bp, Homo sapien
attctcgctggacacatttccatca

SEQ ID NO: 278489 - DNA, 25 bp, Homo sapien
atttccatcagtgcaccctaaatta

SEQ ID NO: 278490 - DNA, 25 bp, Homo sapien
ggttctcccacgtttgggtgcttag

SEQ ID NO: 278491 - DNA, 25 bp, Homo sapien
ccacgtttgggtgcttagggactag

SEQ ID NO: 278492 - DNA, 25 bp, Homo sapien
ccatggttggtttagtagcaaactg

SEQ ID NO: 278493 - DNA, 25 bp, Homo sapien
aactgtgtggaatcatatagactac

SEQ ID NO: 278494 - DNA, 25 bp, Homo sapien
ttcacagccagaaaacagtcgccgg

SEQ ID NO: 278495 - DNA, 25 bp, Homo sapien
aacagtcgccggaaacgtagtgagt

SEQ ID NO: 278496 - DNA, 25 bp, Homo sapien
aacgtagtgagtactggctaacagt

SEQ ID NO: 278497 - DNA, 25 bp, Homo sapien
tgattcttcgtgtcacgctgagcag

SEQ ID NO: 278498 - DNA, 25 bp, Homo sapien
ggcatccaaagctgtgggatcacag

SEQ ID NO: 278499 - DNA, 25 bp, Homo sapien
gggatcacagaaagtgttgcttcag

SEQ ID NO: 278500 - DNA, 25 bp, Homo sapien
ttgcttcaggtgtggatgccagcca

SEQ ID NO: 278501 - DNA, 25 bp, Homo sapien
gtgtggatgccagccactcctcatg

SEQ ID NO: 278502 - DNA, 25 bp, Homo sapien
ctcatgctcgtcactcttaaaagat

SEQ ID NO: 278503 - DNA, 25 bp, Homo sapien
gattgagacacccaaccttaaaaat

SEQ ID NO: 278504 - DNA, 25 bp, Homo sapien
aaatgctccaataatccattcagaa

SEQ ID NO: 278505 - DNA, 25 bp, Homo sapien
aaccaaactcatatgcacaagatgt

SEQ ID NO: 278506 - DNA, 25 bp, Homo sapien
taaagtcaattcttgcttgtttttt

SEQ ID NO: 278507 - DNA, 25 bp, Homo sapien
gaaatttctaaaactggctatgcta

SEQ ID NO: 278508 - DNA, 25 bp, Homo sapien
ttgatataaatcatactgttccttg

SEQ ID NO: 278509 - DNA, 25 bp, Homo sapien
actgttccttgattgtcaactagca

SEQ ID NO: 278510 - DNA, 25 bp, Homo sapien
caactagcattttaaggaattccct

SEQ ID NO: 278511 - DNA, 25 bp, Homo sapien
gaattccctaaattccaccaataga

SEQ ID NO: 278512 - DNA, 25 bp, Homo sapien
gaattctcaatcttattggtcctac

SEQ ID NO: 278513 - DNA, 25 bp, Homo sapien
attggtcctacatgcctcaaagaat

SEQ ID NO: 278514 - DNA, 25 bp, Homo sapien
aagttctttcggcaacaccaatata

SEQ ID NO: 278515 - DNA, 25 bp, Homo sapien
gacaaagttttgcattgttctaaat

SEQ ID NO: 278516 - DNA, 25 bp, Homo sapien
tgttctaaatgcaagtattcctcct

SEQ ID NO: 278517 - DNA, 25 bp, Homo sapien
gtattcctccttggcttaaatgatt

SEQ ID NO: 278518 - DNA, 25 bp, Homo sapien
gattgatcaaacctaattcttttgg

SEQ ID NO: 278519 - DNA, 25 bp, Homo sapien
gagagcagtgccatgtttgaccacc

SEQ ID NO: 278520 - DNA, 25 bp, Homo sapien
agtgccatgtttgaccaccagaggg

SEQ ID NO: 278521 - DNA, 25 bp, Homo sapien
agtgctgctgtgtagcatttcttcc

SEQ ID NO: 278522 - DNA, 25 bp, Homo sapien
gtagcatttcttcctggtgtgagcc

SEQ ID NO: 278523 - DNA, 25 bp, Homo sapien
tgagcctctccacaagcctgttgag

SEQ ID NO: 278524 - DNA, 25 bp, Homo sapien
aagcctgttgagtggttgagctctc

SEQ ID NO: 278525 - DNA, 25 bp, Homo sapien
tggttgagctctccacaattctgct

SEQ ID NO: 278526 - DNA, 25 bp, Homo sapien
acaattctgctcatttggaggttgg

SEQ ID NO: 278527 - DNA, 25 bp, Homo sapien
catgttagggcccaggtgactagct

SEQ ID NO: 278528 - DNA, 25 bp, Homo sapien
tagggcccaggtgactagctgtctc

SEQ ID NO: 278529 - DNA, 25 bp, Homo sapien
gaagccctggcttctgcgctggagt

SEQ ID NO: 278530 - DNA, 25 bp, Homo sapien
gtagctatctgggtctgtttggcac

SEQ ID NO: 278531 - DNA, 25 bp, Homo sapien
gtctgtttggcactgtggattctca

SEQ ID NO: 278532 - DNA, 25 bp, Homo sapien
gtggattctcaagggcctagaaccc

SEQ ID NO: 278533 - DNA, 25 bp, Homo sapien
tagaacccttgcctctgaaactggt

SEQ ID NO: 278534 - DNA, 25 bp, Homo sapien
tctgaaactggtccgctggtgcagc

SEQ ID NO: 278535 - DNA, 25 bp, Homo sapien
ccccgatctctaaatgaggcctgag

SEQ ID NO: 278536 - DNA, 25 bp, Homo sapien
aaatgaggcctgagcgtcaccctag

SEQ ID NO: 278537 - DNA, 25 bp, Homo sapien
agttctgcccctttttagctgtgta

SEQ ID NO: 278538 - DNA, 25 bp, Homo sapien
gcccctttttagctgtgtagacttg

SEQ ID NO: 278539 - DNA, 25 bp, Homo sapien
ttagctgtgtagacttggacgagac

SEQ ID NO: 278540 - DNA, 25 bp, Homo sapien
agacttggacgagacatttgacttc

SEQ ID NO: 278541 - DNA, 25 bp, Homo sapien
tgccattgggttttgcccttgcaaa

SEQ ID NO: 278542 - DNA, 25 bp, Homo sapien
aaaggcttcctaggtctccagtggc

SEQ ID NO: 278543 - DNA, 25 bp, Homo sapien
ggccttgcagtctctctaccctggg

SEQ ID NO: 278544 - DNA, 25 bp, Homo sapien
cagaagaaggcaggagttgattttt

SEQ ID NO: 278545 - DNA, 25 bp, Homo sapien
gggtttctttgtcctcaaggtactg

SEQ ID NO: 278546 - DNA, 25 bp, Homo sapien
ttctttgtcctcaaggtactgttct

SEQ ID NO: 278547 - DNA, 25 bp, Homo sapien
tgtcctcaaggtactgttctgtttc

SEQ ID NO: 278548 - DNA, 25 bp, Homo sapien
gttctgtttctctttacccctctgc

SEQ ID NO: 278549 - DNA, 25 bp, Homo sapien
ctttacccctctgctttatttattg

SEQ ID NO: 278550 - DNA, 25 bp, Homo sapien
tatttattgtaagcattcccacgtt

SEQ ID NO: 278551 - DNA, 25 bp, Homo sapien
attgtaagcattcccacgttaaata

SEQ ID NO: 278552 - DNA, 25 bp, Homo sapien
tggtaccatggaagacctgtccctg

SEQ ID NO: 278553 - DNA, 25 bp, Homo sapien
tccctgcccatttctcaaaaatgca

SEQ ID NO: 278554 - DNA, 25 bp, Homo sapien
aaagatcacagcactagcggagact

SEQ ID NO: 278555 - DNA, 25 bp, Homo sapien
agacctttaggctctgttgaagttc

SEQ ID NO: 278556 - DNA, 25 bp, Homo sapien
tctggcattgcttatgagacccttc

SEQ ID NO: 278557 - DNA, 25 bp, Homo sapien
ggaaggtctaagtcaactcctccat

SEQ ID NO: 278558 - DNA, 25 bp, Homo sapien
aagtcaactcctccattggactgga

SEQ ID NO: 278559 - DNA, 25 bp, Homo sapien
gatgaggctcactggtgacatcctg

SEQ ID NO: 278560 - DNA, 25 bp, Homo sapien
gaaactgtctcatgctttctgacct

SEQ ID NO: 278561 - DNA, 25 bp, Homo sapien
gggaaagttgtacccacgacatcct

SEQ ID NO: 278562 - DNA, 25 bp, Homo sapien
atcctcaaccactggtaccatggaa

SEQ ID NO: 278563 - DNA, 25 bp, Homo sapien
gcctatcttctgaaccacatagaag

SEQ ID NO: 278564 - DNA, 25 bp, Homo sapien
tacagtatcagtgaagcagctagct

SEQ ID NO: 278565 - DNA, 25 bp, Homo sapien
gggctgagtagcataacacttttat

SEQ ID NO: 278566 - DNA, 25 bp, Homo sapien
gaaaaccttcaattcatagtatctg

SEQ ID NO: 278567 - DNA, 25 bp, Homo sapien
gaaagcattaatattctcagtcatt

SEQ ID NO: 278568 - DNA, 25 bp, Homo sapien
attctcagtcattaatttttccaac

SEQ ID NO: 278569 - DNA, 25 bp, Homo sapien
aatgaaggcactttgcaagcatcac

SEQ ID NO: 278570 - DNA, 25 bp, Homo sapien
gcaagcatcacagacttattgtaat

SEQ ID NO: 278571 - DNA, 25 bp, Homo sapien
aagtgttttggcatgttgggctctc

SEQ ID NO: 278572 - DNA, 25 bp, Homo sapien
atgttgggctctctaatcttttcgc

SEQ ID NO: 278573 - DNA, 25 bp, Homo sapien
ctttcagaatttgtgctttcaagtg

SEQ ID NO: 278574 - DNA, 25 bp, Homo sapien
ggacattttacccaaggtttagcag

SEQ ID NO: 278575 - DNA, 25 bp, Homo sapien
ggtttagcagcaacatccacaccta

SEQ ID NO: 278576 - DNA, 25 bp, Homo sapien
taccacgtcggaaagcagtgcttct

SEQ ID NO: 278577 - DNA, 25 bp, Homo sapien
ttaatggagtcttcctcggcaacaa

SEQ ID NO: 278578 - DNA, 25 bp, Homo sapien
tcggcaacaagaggtctctatcaga

SEQ ID NO: 278579 - DNA, 25 bp, Homo sapien
gaaatacgatattgatcccaggaat

SEQ ID NO: 278580 - DNA, 25 bp, Homo sapien
gaatcccaaagttaactccaggcga

SEQ ID NO: 278581 - DNA, 25 bp, Homo sapien
ggcgacaatccatatatgtacccag

SEQ ID NO: 278582 - DNA, 25 bp, Homo sapien
aaaggcttccacaaagcaggatcaa

SEQ ID NO: 278583 - DNA, 25 bp, Homo sapien
gatcaatgctcccaccagtgaattt

SEQ ID NO: 278584 - DNA, 25 bp, Homo sapien
gtgaatttttcaatagtgccttatg

SEQ ID NO: 278585 - DNA, 25 bp, Homo sapien
tgtgtgaacattccacgacagaact

SEQ ID NO: 278586 - DNA, 25 bp, Homo sapien
tgtgaacattccacgacagaacttc

SEQ ID NO: 278587 - DNA, 25 bp, Homo sapien
gaacattccacgacagaacttcact

SEQ ID NO: 278588 - DNA, 25 bp, Homo sapien
aacattccacgacagaacttcacta

SEQ ID NO: 278589 - DNA, 25 bp, Homo sapien
cacgacagaacttcactaaatgtgt

SEQ ID NO: 278590 - DNA, 25 bp, Homo sapien
cgacagaacttcactaaatgtgtga

SEQ ID NO: 278591 - DNA, 25 bp, Homo sapien
ccctgtaaggccatgggacacacag

SEQ ID NO: 278592 - DNA, 25 bp, Homo sapien
tcctgggctggaagtctgtgtatga

SEQ ID NO: 278593 - DNA, 25 bp, Homo sapien
tcttcatgtggtcatcccctgttag

SEQ ID NO: 278594 - DNA, 25 bp, Homo sapien
ttcatgtggtcatcccctgttagat

SEQ ID NO: 278595 - DNA, 25 bp, Homo sapien
tcatgtggtcatcccctgttagatg

SEQ ID NO: 278596 - DNA, 25 bp, Homo sapien
ttgtatcccacaactttactaaatt

SEQ ID NO: 278597 - DNA, 25 bp, Homo sapien
ttataataggattatgtcatccatg

SEQ ID NO: 278598 - DNA, 25 bp, Homo sapien
gtcatccatgaatagagagagtttt

SEQ ID NO: 278599 - DNA, 25 bp, Homo sapien
gagagagttttacttctgtcttttc

SEQ ID NO: 278600 - DNA, 25 bp, Homo sapien
ctgtcttttcaatctagatgccttt

SEQ ID NO: 278601 - DNA, 25 bp, Homo sapien
ttcaatctagatgcctttacttttt

SEQ ID NO: 278602 - DNA, 25 bp, Homo sapien
attaccctggctagaacctccagta

SEQ ID NO: 278603 - DNA, 25 bp, Homo sapien
taccctggctagaacctccagtaaa

SEQ ID NO: 278604 - DNA, 25 bp, Homo sapien
tggctagaacctccagtaaaaggtt

SEQ ID NO: 278605 - DNA, 25 bp, Homo sapien
ctccagtaaaaggttgaatagaagt

SEQ ID NO: 278606 - DNA, 25 bp, Homo sapien
tctgatcttaggagaaaagctttta

SEQ ID NO: 278607 - DNA, 25 bp, Homo sapien
aagagtactgagaaatgcctgtgca

SEQ ID NO: 278608 - DNA, 25 bp, Homo sapien
gtgcaggcaaaggtgtcttgattca

SEQ ID NO: 278609 - DNA, 25 bp, Homo sapien
gtcttgattcaggacaggcaatgtg

SEQ ID NO: 278610 - DNA, 25 bp, Homo sapien
aggtactgtagtgattagcaatgac

SEQ ID NO: 278611 - DNA, 25 bp, Homo sapien
tgacagtgcactaatcacagccctt

SEQ ID NO: 278612 - DNA, 25 bp, Homo sapien
acagcccttgttgagcaatcagtct

SEQ ID NO: 278613 - DNA, 25 bp, Homo sapien
aatcagtcttcattaggctccccaa

SEQ ID NO: 278614 - DNA, 25 bp, Homo sapien
ttgaggctttttaacgctgaatctg

SEQ ID NO: 278615 - DNA, 25 bp, Homo sapien
gaatctgtgtgtgaaaggcccttct

SEQ ID NO: 278616 - DNA, 25 bp, Homo sapien
tgaaaggcccttctgtttaatattt

SEQ ID NO: 278617 - DNA, 25 bp, Homo sapien
gttgcagtgcagttaataaatcctt

SEQ ID NO: 278618 - DNA, 25 bp, Homo sapien
gacctgatcatgaaactggcttaaa

SEQ ID NO: 278619 - DNA, 25 bp, Homo sapien
catgctgtgtagatgtttttgccca

SEQ ID NO: 278620 - DNA, 25 bp, Homo sapien
gtagatgtttttgcccacagaaggg

SEQ ID NO: 278621 - DNA, 25 bp, Homo sapien
cagctgcatcaggactggccgtagt

SEQ ID NO: 278622 - DNA, 25 bp, Homo sapien
ctggccgtagtcttctctgtgctca

SEQ ID NO: 278623 - DNA, 25 bp, Homo sapien
atattcatggaagttgcagctgctg

SEQ ID NO: 278624 - DNA, 25 bp, Homo sapien
actggacattccattggtcactgtt

SEQ ID NO: 278625 - DNA, 25 bp, Homo sapien
cactgttaggtggtgactgctcata

SEQ ID NO: 278626 - DNA, 25 bp, Homo sapien
gtgactgctcatagcttttctctgc

SEQ ID NO: 278627 - DNA, 25 bp, Homo sapien
gaagccagagtatacctagctctag

SEQ ID NO: 278628 - DNA, 25 bp, Homo sapien
ctagctctaggagtgcttatcagat

SEQ ID NO: 278629 - DNA, 25 bp, Homo sapien
actactttttaattgcaattctagg

SEQ ID NO: 278630 - DNA, 25 bp, Homo sapien
attctaggtaattgtgcatcgtgat

SEQ ID NO: 278631 - DNA, 25 bp, Homo sapien
catcgtgatgtgattgcttggctat

SEQ ID NO: 278632 - DNA, 25 bp, Homo sapien
gtgattgcttggctattgtctgaat

SEQ ID NO: 278633 - DNA, 25 bp, Homo sapien
ttggctattgtctgaatatttcctt

SEQ ID NO: 278634 - DNA, 25 bp, Homo sapien
ctaatgctttgattggatttgccag

SEQ ID NO: 278635 - DNA, 25 bp, Homo sapien
atttgccagttcaccggacagtgat

SEQ ID NO: 278636 - DNA, 25 bp, Homo sapien
gaatataatcggtttcagtgcaact

SEQ ID NO: 278637 - DNA, 25 bp, Homo sapien
ttcagtgcaactggatggtctgctt

SEQ ID NO: 278638 - DNA, 25 bp, Homo sapien
caactggatggtctgcttttaaatg

SEQ ID NO: 278639 - DNA, 25 bp, Homo sapien
ggtctgcttttaaatgtgacttaat

SEQ ID NO: 278640 - DNA, 25 bp, Homo sapien
gcacctgtcaagataacctgtcaat

SEQ ID NO: 278641 - DNA, 25 bp, Homo sapien
gtcaagataacctgtcaatgtagta

SEQ ID NO: 278642 - DNA, 25 bp, Homo sapien
aacctgtcaatgtagtaggaaaaca

SEQ ID NO: 278643 - DNA, 25 bp, Homo sapien
aagcacgggaaaagatggcaaggtt

SEQ ID NO: 278644 - DNA, 25 bp, Homo sapien
gaaaagtgctcagttcctcatacct

SEQ ID NO: 278645 - DNA, 25 bp, Homo sapien
gtgctcagttcctcatacctgtaat

SEQ ID NO: 278646 - DNA, 25 bp, Homo sapien
aagtatattgtgctagcttgtctaa

SEQ ID NO: 278647 - DNA, 25 bp, Homo sapien
atattgtgctagcttgtctaagaat

SEQ ID NO: 278648 - DNA, 25 bp, Homo sapien
gtgctagcttgtctaagaataaact

SEQ ID NO: 278649 - DNA, 25 bp, Homo sapien
ggagggctgcacctgtcaagataac

SEQ ID NO: 278650 - DNA, 25 bp, Homo sapien
ggctgcacctgtcaagataacctgt

SEQ ID NO: 278651 - DNA, 25 bp, Homo sapien
aaatcaatctagaatgactggctca

SEQ ID NO: 278652 - DNA, 25 bp, Homo sapien
actggctcatcaacagctattaatt

SEQ ID NO: 278653 - DNA, 25 bp, Homo sapien
gccctgacaggctagaattgacatt

SEQ ID NO: 278654 - DNA, 25 bp, Homo sapien
aagtccttgctttttgtgtgcttta

SEQ ID NO: 278655 - DNA, 25 bp, Homo sapien
agttcctattagatccttctgtttc

SEQ ID NO: 278656 - DNA, 25 bp, Homo sapien
atccttctgtttcctgcttaaaatg

SEQ ID NO: 278657 - DNA, 25 bp, Homo sapien
aaatgtatgacagttccccaaggcc

SEQ ID NO: 278658 - DNA, 25 bp, Homo sapien
aaggccatcagctatttcttagcag

SEQ ID NO: 278659 - DNA, 25 bp, Homo sapien
agcagggcatttgaggcctctgcac

SEQ ID NO: 278660 - DNA, 25 bp, Homo sapien
ccagcttcgttcatcctttaaggta

SEQ ID NO: 278661 - DNA, 25 bp, Homo sapien
ctttaaggtaggtctcacatggcat

SEQ ID NO: 278662 - DNA, 25 bp, Homo sapien
aaagctgattgcgactggtgccctt

SEQ ID NO: 278663 - DNA, 25 bp, Homo sapien
gtgcccttgtaggtcaataatgtct

SEQ ID NO: 278664 - DNA, 25 bp, Homo sapien
aataatgtctattttgatgtggcct

SEQ ID NO: 278665 - DNA, 25 bp, Homo sapien
ttttcttcactatagatgtctttgt

SEQ ID NO: 278666 - DNA, 25 bp, Homo sapien
gatgtggcctgaatatttcacttca

SEQ ID NO: 278667 - DNA, 25 bp, Homo sapien
ttcattttatatggtcggatgctcc

SEQ ID NO: 278668 - DNA, 25 bp, Homo sapien
ggtcggatgctccatgttaggatta

SEQ ID NO: 278669 - DNA, 25 bp, Homo sapien
catctgattctgtatttaatatcta

SEQ ID NO: 278670 - DNA, 25 bp, Homo sapien
atctaaatgggatcagtgacactgg

SEQ ID NO: 278671 - DNA, 25 bp, Homo sapien
tgtgagaaggtttggtacttttcaa

SEQ ID NO: 278672 - DNA, 25 bp, Homo sapien
tcaaaacctgttggtcttagaaaga

SEQ ID NO: 278673 - DNA, 25 bp, Homo sapien
gcataagaaaataccgtctgctgaa

SEQ ID NO: 278674 - DNA, 25 bp, Homo sapien
agaaaataccgtctgctgaaagagg

SEQ ID NO: 278675 - DNA, 25 bp, Homo sapien
aataccgtctgctgaaagagggaca

SEQ ID NO: 278676 - DNA, 25 bp, Homo sapien
taccgtctgctgaaagagggacaat

SEQ ID NO: 278677 - DNA, 25 bp, Homo sapien
ccgtctgctgaaagagggacaataa

SEQ ID NO: 278678 - DNA, 25 bp, Homo sapien
aagcttggaattcagacaacagatc

SEQ ID NO: 278679 - DNA, 25 bp, Homo sapien
ggaattcagacaacagatccaagtc

SEQ ID NO: 278680 - DNA, 25 bp, Homo sapien
acaacagatccaagtctgggcttga

SEQ ID NO: 278681 - DNA, 25 bp, Homo sapien
aacagatccaagtctgggcttgatc

SEQ ID NO: 278682 - DNA, 25 bp, Homo sapien
agatccaagtctgggcttgatctca

SEQ ID NO: 278683 - DNA, 25 bp, Homo sapien
ctcaagctagtgttttgatgttgaa

SEQ ID NO: 278684 - DNA, 25 bp, Homo sapien
tttacaaaaataggtgctggctcac

SEQ ID NO: 278685 - DNA, 25 bp, Homo sapien
aaaataggtgctggctcacgtgctg

SEQ ID NO: 278686 - DNA, 25 bp, Homo sapien
aataggtgctggctcacgtgctgta

SEQ ID NO: 278687 - DNA, 25 bp, Homo sapien
aggtgctggctcacgtgctgtagtt

SEQ ID NO: 278688 - DNA, 25 bp, Homo sapien
tgctggctcacgtgctgtagtttgc

SEQ ID NO: 278689 - DNA, 25 bp, Homo sapien
tggctcacgtgctgtagtttgctga

SEQ ID NO: 278690 - DNA, 25 bp, Homo sapien
tttgctgaccccttgcatcagtgaa

SEQ ID NO: 278691 - DNA, 25 bp, Homo sapien
tgctgaccccttgcatcagtgaaga

SEQ ID NO: 278692 - DNA, 25 bp, Homo sapien
tgaccccttgcatcagtgaagattt

SEQ ID NO: 278693 - DNA, 25 bp, Homo sapien
accccttgcatcagtgaagattttt

SEQ ID NO: 278694 - DNA, 25 bp, Homo sapien
cttgcatcagtgaagattttttcaa

SEQ ID NO: 278695 - DNA, 25 bp, Homo sapien
agaaatatccagaagtcaagccatg

SEQ ID NO: 278696 - DNA, 25 bp, Homo sapien
agaagtcaagccatggatccacctg

SEQ ID NO: 278697 - DNA, 25 bp, Homo sapien
catggatccacctgcacgtaaagaa

SEQ ID NO: 278698 - DNA, 25 bp, Homo sapien
ggatccacctgcacgtaaagaaaaa

SEQ ID NO: 278699 - DNA, 25 bp, Homo sapien
aaagttaaagaatctgtcagcagag

SEQ ID NO: 278700 - DNA, 25 bp, Homo sapien
tcagcagagttgagaaggccaaaca

SEQ ID NO: 278701 - DNA, 25 bp, Homo sapien
aagagcagagatctatgccctcaac

SEQ ID NO: 278702 - DNA, 25 bp, Homo sapien
gagatctatgccctcaacagagtca

SEQ ID NO: 278703 - DNA, 25 bp, Homo sapien
atgccctcaacagagtcatgacaga

SEQ ID NO: 278704 - DNA, 25 bp, Homo sapien
aacagagtcatgacagaactggagc

SEQ ID NO: 278705 - DNA, 25 bp, Homo sapien
gagcagcagcagtttgatgagttct

SEQ ID NO: 278706 - DNA, 25 bp, Homo sapien
gaaattggacaaccacaagtctgag

SEQ ID NO: 278707 - DNA, 25 bp, Homo sapien
gacaaccacaagtctgagagatttg

SEQ ID NO: 278708 - DNA, 25 bp, Homo sapien
aatttcaggctatgtggcaacgtct

SEQ ID NO: 278709 - DNA, 25 bp, Homo sapien
ggctatgtggcaacgtctttggtac

SEQ ID NO: 278710 - DNA, 25 bp, Homo sapien
gtggcaacgtctttggtacatttca

SEQ ID NO: 278711 - DNA, 25 bp, Homo sapien
ggtacatttcaaaggtctgactaaa

SEQ ID NO: 278712 - DNA, 25 bp, Homo sapien
ttcaaaggtctgactaaatcagtct

SEQ ID NO: 278713 - DNA, 25 bp, Homo sapien
gaggcaagatcacacactgtgtggt

SEQ ID NO: 278714 - DNA, 25 bp, Homo sapien
tttatcacccttttgtgtttcacag

SEQ ID NO: 278715 - DNA, 25 bp, Homo sapien
gaatgtatgtacgtggacttgccta

SEQ ID NO: 278716 - DNA, 25 bp, Homo sapien
atgtatgtacgtggacttgcctaaa

SEQ ID NO: 278717 - DNA, 25 bp, Homo sapien
gccttgaagttgttattctttccta

SEQ ID NO: 278718 - DNA, 25 bp, Homo sapien
tttcctattagaaccctgatgggag

SEQ ID NO: 278719 - DNA, 25 bp, Homo sapien
aggagcagcaccagatgatcttttc

SEQ ID NO: 278720 - DNA, 25 bp, Homo sapien
tgatcttttcatgggcacgtactct

SEQ ID NO: 278721 - DNA, 25 bp, Homo sapien
atgggcacgtactctttcaaggaat

SEQ ID NO: 278722 - DNA, 25 bp, Homo sapien
cgtactctttcaaggaatcccatgg

SEQ ID NO: 278723 - DNA, 25 bp, Homo sapien
gaatcccatggagctcagtgaaatt

SEQ ID NO: 278724 - DNA, 25 bp, Homo sapien
gaaattacactttggcttagagata

SEQ ID NO: 278725 - DNA, 25 bp, Homo sapien
tgttattaatccaaggtctcactaa

SEQ ID NO: 278726 - DNA, 25 bp, Homo sapien
ggtctcactaataatttggcaagtt

SEQ ID NO: 278727 - DNA, 25 bp, Homo sapien
gcaagttctttaatgagccaaatct

SEQ ID NO: 278728 - DNA, 25 bp, Homo sapien
aagcctgaaattgtcctgtgaagtg

SEQ ID NO: 278729 - DNA, 25 bp, Homo sapien
agtgaagtatgatcggacagcctct

SEQ ID NO: 278730 - DNA, 25 bp, Homo sapien
gacagcctcttttcagcttttatga

SEQ ID NO: 278731 - DNA, 25 bp, Homo sapien
cagcttttatgacaatggagacaga

SEQ ID NO: 278732 - DNA, 25 bp, Homo sapien
acagaggaattgtggctcttgccaa

SEQ ID NO: 278733 - DNA, 25 bp, Homo sapien
ggctcttgccaaggtcacaggattg

SEQ ID NO: 278734 - DNA, 25 bp, Homo sapien
ggtcacaggattggaatacagagcc

SEQ ID NO: 278735 - DNA, 25 bp, Homo sapien
ggaatacagagccaagccaccccag

SEQ ID NO: 278736 - DNA, 25 bp, Homo sapien
ggacatgcaagagcctcagaaggga

SEQ ID NO: 278737 - DNA, 25 bp, Homo sapien
gggagaacaagtagcctctgtcctg

SEQ ID NO: 278738 - DNA, 25 bp, Homo sapien
gtagcctctgtcctgaagttgtaac

SEQ ID NO: 278739 - DNA, 25 bp, Homo sapien
gtgggacctgagatccctgcccact

SEQ ID NO: 278740 - DNA, 25 bp, Homo sapien
ttcattggctgcccaggccactggc

SEQ ID NO: 278741 - DNA, 25 bp, Homo sapien
ggccactggccccagttctcagtgt

SEQ ID NO: 278742 - DNA, 25 bp, Homo sapien
ttgggccctaagcatcaccagaagg

SEQ ID NO: 278743 - DNA, 25 bp, Homo sapien
gggccctaagcatcaccagaaggga

SEQ ID NO: 278744 - DNA, 25 bp, Homo sapien
taagcatcaccagaagggagtaagc

SEQ ID NO: 278745 - DNA, 25 bp, Homo sapien
atcaccagaagggagtaagcaggga

SEQ ID NO: 278746 - DNA, 25 bp, Homo sapien
gagagaagcaatattactccctccc

SEQ ID NO: 278747 - DNA, 25 bp, Homo sapien
agaagcaatattactccctccccta

SEQ ID NO: 278748 - DNA, 25 bp, Homo sapien
tacctatgggtctttgcttccccag

SEQ ID NO: 278749 - DNA, 25 bp, Homo sapien
atgggcaggccctgccatggacaga

SEQ ID NO: 278750 - DNA, 25 bp, Homo sapien
atatcatgtgtaggccaatctctta

SEQ ID NO: 278751 - DNA, 25 bp, Homo sapien
ggccaatctcttaagctctgaattt

SEQ ID NO: 278752 - DNA, 25 bp, Homo sapien
gttcagctactcgatatattcactt

SEQ ID NO: 278753 - DNA, 25 bp, Homo sapien
gatatattcacttagctattccata

SEQ ID NO: 278754 - DNA, 25 bp, Homo sapien
aagctattccataagcacttcaaat

SEQ ID NO: 278755 - DNA, 25 bp, Homo sapien
tatttagttcattatctgctcccct

SEQ ID NO: 278756 - DNA, 25 bp, Homo sapien
cccctcttgctattgccaagtttaa

SEQ ID NO: 278757 - DNA, 25 bp, Homo sapien
ttgcttcccacatccaaatcattac

SEQ ID NO: 278758 - DNA, 25 bp, Homo sapien
tccaaatcattaccatgccccttta

SEQ ID NO: 278759 - DNA, 25 bp, Homo sapien
catgcccctttacctcaattttcta

SEQ ID NO: 278760 - DNA, 25 bp, Homo sapien
atgtaccacatgacacacctatctg

SEQ ID NO: 278761 - DNA, 25 bp, Homo sapien
ggaacctacctttgatcagcaagga

SEQ ID NO: 278762 - DNA, 25 bp, Homo sapien
aacctacctttgatcagcaaggaag

SEQ ID NO: 278763 - DNA, 25 bp, Homo sapien
ctttgatcagcaaggaaggactggg

SEQ ID NO: 278764 - DNA, 25 bp, Homo sapien
gggtggcaaaggctcatgcccccat

SEQ ID NO: 278765 - DNA, 25 bp, Homo sapien
ggcaaaggctcatgcccccatttta

SEQ ID NO: 278766 - DNA, 25 bp, Homo sapien
acagatgtcatcatttgtcccaaca

SEQ ID NO: 278767 - DNA, 25 bp, Homo sapien
gtcatcatttgtcccaacatcattg

SEQ ID NO: 278768 - DNA, 25 bp, Homo sapien
tcatttgtcccaacatcattgattg

SEQ ID NO: 278769 - DNA, 25 bp, Homo sapien
atttgtcccaacatcattgattgaa

SEQ ID NO: 278770 - DNA, 25 bp, Homo sapien
catcattgattgaataagccatctt

SEQ ID NO: 278771 - DNA, 25 bp, Homo sapien
tgattgaataagccatcttttcccc

SEQ ID NO: 278772 - DNA, 25 bp, Homo sapien
cactctgtcgccgagttttggagtg

SEQ ID NO: 278773 - DNA, 25 bp, Homo sapien
actctgtcgccgagttttggagtgt

SEQ ID NO: 278774 - DNA, 25 bp, Homo sapien
ctctgtcgccgagttttggagtgta

SEQ ID NO: 278775 - DNA, 25 bp, Homo sapien
tctgtcgccgagttttggagtgtat

SEQ ID NO: 278776 - DNA, 25 bp, Homo sapien
ctgtcgccgagttttggagtgtatt

SEQ ID NO: 278777 - DNA, 25 bp, Homo sapien
tgtcgccgagttttggagtgtattg

SEQ ID NO: 278778 - DNA, 25 bp, Homo sapien
gtcgccgagttttggagtgtattgg

SEQ ID NO: 278779 - DNA, 25 bp, Homo sapien
tcgccgagttttggagtgtattggc

SEQ ID NO: 278780 - DNA, 25 bp, Homo sapien
agttttggagtgtattggcgcgatc

SEQ ID NO: 278781 - DNA, 25 bp, Homo sapien
gttttggagtgtattggcgcgatct

SEQ ID NO: 278782 - DNA, 25 bp, Homo sapien
atgatccacccacgtccacctacca

SEQ ID NO: 278783 - DNA, 25 bp, Homo sapien
aactcaggctcagctgagggatgct

SEQ ID NO: 278784 - DNA, 25 bp, Homo sapien
tgagggatgctgtccagagcctgca

SEQ ID NO: 278785 - DNA, 25 bp, Homo sapien
tgcctcaatggagacaccacctgag

SEQ ID NO: 278786 - DNA, 25 bp, Homo sapien
tggagacaccacctgagctgcccat

SEQ ID NO: 278787 - DNA, 25 bp, Homo sapien
tcatcacacgtggtctgggagcaga

SEQ ID NO: 278788 - DNA, 25 bp, Homo sapien
ctgggagcagagagatagccatctt

SEQ ID NO: 278789 - DNA, 25 bp, Homo sapien
ggtgtctgactttgccttagcccta

SEQ ID NO: 278790 - DNA, 25 bp, Homo sapien
ttagccctacttggcctacagtggg

SEQ ID NO: 278791 - DNA, 25 bp, Homo sapien
gtcccaaccactctggcagtatgaa

SEQ ID NO: 278792 - DNA, 25 bp, Homo sapien
ctctggcagtatgaagttgcccagt

SEQ ID NO: 278793 - DNA, 25 bp, Homo sapien
agttgcccagtaaaatcttgatttc

SEQ ID NO: 278794 - DNA, 25 bp, Homo sapien
acataagacatcatgataacatttg

SEQ ID NO: 278795 - DNA, 25 bp, Homo sapien
gatatttggtggtttcatgtggtaa

SEQ ID NO: 278796 - DNA, 25 bp, Homo sapien
catgtggtaatgtaattttctgttt

SEQ ID NO: 278797 - DNA, 25 bp, Homo sapien
attacagtactttttacaggcacag

SEQ ID NO: 278798 - DNA, 25 bp, Homo sapien
tacagtactttttacaggcacagtg

SEQ ID NO: 278799 - DNA, 25 bp, Homo sapien
tttttacaggcacagtggtactgtc

SEQ ID NO: 278800 - DNA, 25 bp, Homo sapien
tttttgtaagatgctagttgtgaaa

SEQ ID NO: 278801 - DNA, 25 bp, Homo sapien
gtaagatgctagttgtgaaatacaa

SEQ ID NO: 278802 - DNA, 25 bp, Homo sapien
aattgcatacagtaaaagtctgtga

SEQ ID NO: 278803 - DNA, 25 bp, Homo sapien
aagatactttcaatggaataccagc

SEQ ID NO: 278804 - DNA, 25 bp, Homo sapien
tactttcaatggaataccagctaac

SEQ ID NO: 278805 - DNA, 25 bp, Homo sapien
ctttttctcttgcttgaaacagtgc

SEQ ID NO: 278806 - DNA, 25 bp, Homo sapien
tcttgcttgaaacagtgctcctcga

SEQ ID NO: 278807 - DNA, 25 bp, Homo sapien
ttgcttgaaacagtgctcctcgaac

SEQ ID NO: 278808 - DNA, 25 bp, Homo sapien
ttgaaacagtgctcctcgaactttg

SEQ ID NO: 278809 - DNA, 25 bp, Homo sapien
gaacaatcacacattctgcttatta

SEQ ID NO: 278810 - DNA, 25 bp, Homo sapien
caatcacacattctgcttattaaag

SEQ ID NO: 278811 - DNA, 25 bp, Homo sapien
tgtattagaaaatggccaactttaa

SEQ ID NO: 278812 - DNA, 25 bp, Homo sapien
tttaaatcgccttgacaatcatcag

SEQ ID NO: 278813 - DNA, 25 bp, Homo sapien
gacaatcatcagcttttgaaatgtg

SEQ ID NO: 278814 - DNA, 25 bp, Homo sapien
atgtgaattcctattgccagagtaa

SEQ ID NO: 278815 - DNA, 25 bp, Homo sapien
gccagagtaaaggtctcgtttttat

SEQ ID NO: 278816 - DNA, 25 bp, Homo sapien
agagccacaattctagacttctagg

SEQ ID NO: 278817 - DNA, 25 bp, Homo sapien
acttctaggatgtcaggagccatgc

SEQ ID NO: 278818 - DNA, 25 bp, Homo sapien
aggagccatgctcttaagcttctca

SEQ ID NO: 278819 - DNA, 25 bp, Homo sapien
gcttctcaccctgctgttttaatga

SEQ ID NO: 278820 - DNA, 25 bp, Homo sapien
gagattaatgattattttccactga

SEQ ID NO: 278821 - DNA, 25 bp, Homo sapien
gagcacctacctgtgatgttcataa

SEQ ID NO: 278822 - DNA, 25 bp, Homo sapien
ataaatgactcacatggagatttgg

SEQ ID NO: 278823 - DNA, 25 bp, Homo sapien
tttggaaggatatcactgtggaaag

SEQ ID NO: 278824 - DNA, 25 bp, Homo sapien
gaaagtagatgttaacagcctctag

SEQ ID NO: 278825 - DNA, 25 bp, Homo sapien
atcagctatttgagatgcagtcact

SEQ ID NO: 278826 - DNA, 25 bp, Homo sapien
gatgcagtcactgtaatgtgataac

SEQ ID NO: 278827 - DNA, 25 bp, Homo sapien
tcctaacagggctttggtgtatctt

SEQ ID NO: 278828 - DNA, 25 bp, Homo sapien
ggtgtatctttgttccaatttctac

SEQ ID NO: 278829 - DNA, 25 bp, Homo sapien
tacttttatctagtcacacttacat

SEQ ID NO: 278830 - DNA, 25 bp, Homo sapien
taaatagacacctcaaccattagtt

SEQ ID NO: 278831 - DNA, 25 bp, Homo sapien
gacacctcaaccattagttgctaat

SEQ ID NO: 278832 - DNA, 25 bp, Homo sapien
ttttctctacctttgccccaaaatg

SEQ ID NO: 278833 - DNA, 25 bp, Homo sapien
tacctttgccccaaaatgtgcctca

SEQ ID NO: 278834 - DNA, 25 bp, Homo sapien
cttacatagtgtaatgtctctctct

SEQ ID NO: 278835 - DNA, 25 bp, Homo sapien
atgtctctctcttacagcattgtac

SEQ ID NO: 278836 - DNA, 25 bp, Homo sapien
tcttacagcattgtacagtttggga

SEQ ID NO: 278837 - DNA, 25 bp, Homo sapien
taatcctgtggaaaatgtcctaaca

SEQ ID NO: 278838 - DNA, 25 bp, Homo sapien
gctgtggctttaccttgttgtggaa

SEQ ID NO: 278839 - DNA, 25 bp, Homo sapien
agttgggttcggacaccaggataat

SEQ ID NO: 278840 - DNA, 25 bp, Homo sapien
taatagaatcttcctctcatttccc

SEQ ID NO: 278841 - DNA, 25 bp, Homo sapien
ccccagatccttgacagtataactt

SEQ ID NO: 278842 - DNA, 25 bp, Homo sapien
gtataacttgatgacttctaatcct

SEQ ID NO: 278843 - DNA, 25 bp, Homo sapien
tgatgacttctaatcctaaggaatt

SEQ ID NO: 278844 - DNA, 25 bp, Homo sapien
aggaattgcataccttggttttcag

SEQ ID NO: 278845 - DNA, 25 bp, Homo sapien
tggttttcaggtacagccatttaaa

SEQ ID NO: 278846 - DNA, 25 bp, Homo sapien
gtacagccatttaaacagggtgcag

SEQ ID NO: 278847 - DNA, 25 bp, Homo sapien
acagggtgcagtgtattgacagttc

SEQ ID NO: 278848 - DNA, 25 bp, Homo sapien
gtaatacttctcttggtactgtaag

SEQ ID NO: 278849 - DNA, 25 bp, Homo sapien
atcattggtaatagtaatcagttcc

SEQ ID NO: 278850 - DNA, 25 bp, Homo sapien
tttaaagtatattgcctgtcatagc

SEQ ID NO: 278851 - DNA, 25 bp, Homo sapien
gcctgtcatagcaagcactctgtta

SEQ ID NO: 278852 - DNA, 25 bp, Homo sapien
tagcaagcactctgttactgttagc

SEQ ID NO: 278853 - DNA, 25 bp, Homo sapien
gcactctgttactgttagctattat

SEQ ID NO: 278854 - DNA, 25 bp, Homo sapien
ctctgttactgttagctattatcat

SEQ ID NO: 278855 - DNA, 25 bp, Homo sapien
ttatgactattgctctatgttgttt

SEQ ID NO: 278856 - DNA, 25 bp, Homo sapien
ctattgctctatgttgttttttgtt

SEQ ID NO: 278857 - DNA, 25 bp, Homo sapien
ttgtttgtttgaagaatgggctctt

SEQ ID NO: 278858 - DNA, 25 bp, Homo sapien
agaatgggctcttaaccttgtatga

SEQ ID NO: 278859 - DNA, 25 bp, Homo sapien
gggctcttaaccttgtatgagaaag

SEQ ID NO: 278860 - DNA, 25 bp, Homo sapien
atgcgctctcaggatctggcacttg

SEQ ID NO: 278861 - DNA, 25 bp, Homo sapien
ggcacttgcccccatagagatctgt

SEQ ID NO: 278862 - DNA, 25 bp, Homo sapien
atagagatctgtcctctgaggcacc

SEQ ID NO: 278863 - DNA, 25 bp, Homo sapien
agatctgtcctctgaggcaccgtga

SEQ ID NO: 278864 - DNA, 25 bp, Homo sapien
tctgaggcaccgtgaccacagctga

SEQ ID NO: 278865 - DNA, 25 bp, Homo sapien
agctgaccagccgatgacggagcaa

SEQ ID NO: 278866 - DNA, 25 bp, Homo sapien
tgaccagccgatgacggagcaaaga

SEQ ID NO: 278867 - DNA, 25 bp, Homo sapien
aaagaggggccgtggtcacctctgc

SEQ ID NO: 278868 - DNA, 25 bp, Homo sapien
gtggtgcggtcagcctgtctttggg

SEQ ID NO: 278869 - DNA, 25 bp, Homo sapien
tgggtgctccacctgaggactctcc

SEQ ID NO: 278870 - DNA, 25 bp, Homo sapien
aggactctccggagtctcctttggg

SEQ ID NO: 278871 - DNA, 25 bp, Homo sapien
gtttcttctttgattatgtagttac

SEQ ID NO: 278872 - DNA, 25 bp, Homo sapien
ctagatacattcttttagggaagtg

SEQ ID NO: 278873 - DNA, 25 bp, Homo sapien
tttactcagtatacagataaccaca

SEQ ID NO: 278874 - DNA, 25 bp, Homo sapien
catttcataatgttggcactggagt

SEQ ID NO: 278875 - DNA, 25 bp, Homo sapien
ggcactggagtattataagagatca

SEQ ID NO: 278876 - DNA, 25 bp, Homo sapien
tcatggcaagattacctcacgttca

SEQ ID NO: 278877 - DNA, 25 bp, Homo sapien
gattacctcacgttcagtatagttt

SEQ ID NO: 278878 - DNA, 25 bp, Homo sapien
agtttagttttgtgtgtatcttaca

SEQ ID NO: 278879 - DNA, 25 bp, Homo sapien
gtatcttacagtatgcatgttctga

SEQ ID NO: 278880 - DNA, 25 bp, Homo sapien
ctgaaattatttgtgatcctgatat

SEQ ID NO: 278881 - DNA, 25 bp, Homo sapien
acatataatagctttgttacctgga

SEQ ID NO: 278882 - DNA, 25 bp, Homo sapien
ctgggacccttccagtagattggat

SEQ ID NO: 278883 - DNA, 25 bp, Homo sapien
tgggacccttccagtagattggatt

SEQ ID NO: 278884 - DNA, 25 bp, Homo sapien
gggacccttccagtagattggattt

SEQ ID NO: 278885 - DNA, 25 bp, Homo sapien
ggacccttccagtagattggatttc

SEQ ID NO: 278886 - DNA, 25 bp, Homo sapien
gacccttccagtagattggatttca

SEQ ID NO: 278887 - DNA, 25 bp, Homo sapien
gggagccggcagagccaaacaaaga

SEQ ID NO: 278888 - DNA, 25 bp, Homo sapien
ggagccggcagagccaaacaaagaa

SEQ ID NO: 278889 - DNA, 25 bp, Homo sapien
gccggcagagccaaacaaagaaagg

SEQ ID NO: 278890 - DNA, 25 bp, Homo sapien
ccggcagagccaaacaaagaaaggg

SEQ ID NO: 278891 - DNA, 25 bp, Homo sapien
ggaagaagctgtaggactaaggact

SEQ ID NO: 278892 - DNA, 25 bp, Homo sapien
gaagaagctgtaggactaaggactg

SEQ ID NO: 278893 - DNA, 25 bp, Homo sapien
gggaacctaacactcacatagcata

SEQ ID NO: 278894 - DNA, 25 bp, Homo sapien
gcatatcctttctaatcacttcttc

SEQ ID NO: 278895 - DNA, 25 bp, Homo sapien
taatcacttcttcaattctttttgc

SEQ ID NO: 278896 - DNA, 25 bp, Homo sapien
tgctgcagttctgtgctaaaatggg

SEQ ID NO: 278897 - DNA, 25 bp, Homo sapien
gtgaacgagaactctgcctacctaa

SEQ ID NO: 278898 - DNA, 25 bp, Homo sapien
actctgcctacctaagaagttcatt

SEQ ID NO: 278899 - DNA, 25 bp, Homo sapien
ggtaatgaaatcagtccttgaatga

SEQ ID NO: 278900 - DNA, 25 bp, Homo sapien
gaagttcattgtgttctaagtggaa

SEQ ID NO: 278901 - DNA, 25 bp, Homo sapien
gtccttgaatgaaagcagtgccctt

SEQ ID NO: 278902 - DNA, 25 bp, Homo sapien
aatgaaagcagtgcccttgagaagg

SEQ ID NO: 278903 - DNA, 25 bp, Homo sapien
atatttcgtgggaacctaacactca

SEQ ID NO: 278904 - DNA, 25 bp, Homo sapien
gactgtttcgtaagtcagattaagt

SEQ ID NO: 278905 - DNA, 25 bp, Homo sapien
ctgtcagtcatggtttatgggaact

SEQ ID NO: 278906 - DNA, 25 bp, Homo sapien
tcttctgttggttcattcagctgaa

SEQ ID NO: 278907 - DNA, 25 bp, Homo sapien
gttggttcattcagctgaagtcttt

SEQ ID NO: 278908 - DNA, 25 bp, Homo sapien
ttcagctgaagtctttgatactact

SEQ ID NO: 278909 - DNA, 25 bp, Homo sapien
tgatactactagtcttcttctgcca

SEQ ID NO: 278910 - DNA, 25 bp, Homo sapien
ctactagtcttcttctgccaatggg

SEQ ID NO: 278911 - DNA, 25 bp, Homo sapien
aaggcctgacatttatgaactgcca

SEQ ID NO: 278912 - DNA, 25 bp, Homo sapien
agttcatttataaggatactgagcc

SEQ ID NO: 278913 - DNA, 25 bp, Homo sapien
ggatactgagcctacttatgtttaa

SEQ ID NO: 278914 - DNA, 25 bp, Homo sapien
ctgagcctacttatgtttaaaaatc

SEQ ID NO: 278915 - DNA, 25 bp, Homo sapien
gtctagatgttacagcaaagcccca

SEQ ID NO: 278916 - DNA, 25 bp, Homo sapien
gatgttacagcaaagccccaactaa

SEQ ID NO: 278917 - DNA, 25 bp, Homo sapien
agccccaactaatctttagaagcat

SEQ ID NO: 278918 - DNA, 25 bp, Homo sapien
agaagcatattggaactgataactc

SEQ ID NO: 278919 - DNA, 25 bp, Homo sapien
ggaactgataactccattttaaaat

SEQ ID NO: 278920 - DNA, 25 bp, Homo sapien
gaatttatttcttataccaacaggt

SEQ ID NO: 278921 - DNA, 25 bp, Homo sapien
ctcaatatcactaataactgggaaa

SEQ ID NO: 278922 - DNA, 25 bp, Homo sapien
aaaatattacctgttttcatggtgc

SEQ ID NO: 278923 - DNA, 25 bp, Homo sapien
attacctgttttcatggtgctaata

SEQ ID NO: 278924 - DNA, 25 bp, Homo sapien
tggtgctaatattacctgttctccc

SEQ ID NO: 278925 - DNA, 25 bp, Homo sapien
tgttctcccactgctaatgacatac

SEQ ID NO: 278926 - DNA, 25 bp, Homo sapien
tcgccatgacggctggtccccacag

SEQ ID NO: 278927 - DNA, 25 bp, Homo sapien
cgccatgacggctggtccccacagg

SEQ ID NO: 278928 - DNA, 25 bp, Homo sapien
gccatgacggctggtccccacagga

SEQ ID NO: 278929 - DNA, 25 bp, Homo sapien
ccatgacggctggtccccacaggac

SEQ ID NO: 278930 - DNA, 25 bp, Homo sapien
atgacggctggtccccacaggacca

SEQ ID NO: 278931 - DNA, 25 bp, Homo sapien
tgacggctggtccccacaggaccag

SEQ ID NO: 278932 - DNA, 25 bp, Homo sapien
gacggctggtccccacaggaccagc

SEQ ID NO: 278933 - DNA, 25 bp, Homo sapien
acggctggtccccacaggaccagct

SEQ ID NO: 278934 - DNA, 25 bp, Homo sapien
cggctggtccccacaggaccagctg

SEQ ID NO: 278935 - DNA, 25 bp, Homo sapien
ggctggtccccacaggaccagctgg

SEQ ID NO: 278936 - DNA, 25 bp, Homo sapien
gctggtccccacaggaccagctggg

SEQ ID NO: 278937 - DNA, 25 bp, Homo sapien
agctttgtgacaaatctagtgtatg

SEQ ID NO: 278938 - DNA, 25 bp, Homo sapien
ataaaacagacttgcaaagtgctcc

SEQ ID NO: 278939 - DNA, 25 bp, Homo sapien
aaagtgctccctaaaaatgccaata

SEQ ID NO: 278940 - DNA, 25 bp, Homo sapien
aaaagcagtgtgtcacagagagtca

SEQ ID NO: 278941 - DNA, 25 bp, Homo sapien
cacagagagtcagttgggagccaat

SEQ ID NO: 278942 - DNA, 25 bp, Homo sapien
agttgggagccaatcccttggttga

SEQ ID NO: 278943 - DNA, 25 bp, Homo sapien
ggaggcaatctaggattcccatcgc

SEQ ID NO: 278944 - DNA, 25 bp, Homo sapien
ttcccatcgccacttaaatctgtta

SEQ ID NO: 278945 - DNA, 25 bp, Homo sapien
gccacttaaatctgttagtgagcta

SEQ ID NO: 278946 - DNA, 25 bp, Homo sapien
gagctaagttacacacgggcaggga

SEQ ID NO: 278947 - DNA, 25 bp, Homo sapien
cacacgggcagggatttctgtgttt

SEQ ID NO: 278948 - DNA, 25 bp, Homo sapien
cagaaaagatttatcagccatgcta

SEQ ID NO: 278949 - DNA, 25 bp, Homo sapien
gaattttgatctttagagacactag

SEQ ID NO: 278950 - DNA, 25 bp, Homo sapien
gagacactagttttggccaacttaa

SEQ ID NO: 278951 - DNA, 25 bp, Homo sapien
ttacatagtatttgacactcatgca

SEQ ID NO: 278952 - DNA, 25 bp, Homo sapien
tagtagtttattctgcgccttttgt

SEQ ID NO: 278953 - DNA, 25 bp, Homo sapien
attctgcgccttttgttaaaactga

SEQ ID NO: 278954 - DNA, 25 bp, Homo sapien
gaaaatggttgtcactgctcttcca

SEQ ID NO: 278955 - DNA, 25 bp, Homo sapien
actgctcttccagcctatgaatatt

SEQ ID NO: 278956 - DNA, 25 bp, Homo sapien
gaaccatggatttatgtctggatca

SEQ ID NO: 278957 - DNA, 25 bp, Homo sapien
ggatttatgtctggatcatccatac

SEQ ID NO: 278958 - DNA, 25 bp, Homo sapien
ggatcatccatacagaaccaacaat

SEQ ID NO: 278959 - DNA, 25 bp, Homo sapien
gcataatgtactctatctgcgatat

SEQ ID NO: 278960 - DNA, 25 bp, Homo sapien
gtacccatcattgttctgttgtcat

SEQ ID NO: 278961 - DNA, 25 bp, Homo sapien
ttgtcatccctcctagccagtttgg

SEQ ID NO: 278962 - DNA, 25 bp, Homo sapien
gccagtttggtttcccttagagcct

SEQ ID NO: 278963 - DNA, 25 bp, Homo sapien
gcctaacaaaagcttcacgaattca

SEQ ID NO: 278964 - DNA, 25 bp, Homo sapien
taaaacatggaactgggtgcaaaat

SEQ ID NO: 278965 - DNA, 25 bp, Homo sapien
atctgcgatattagcttctcggtct

SEQ ID NO: 278966 - DNA, 25 bp, Homo sapien
tcccaagctccatattcatagaaaa

SEQ ID NO: 278967 - DNA, 25 bp, Homo sapien
ttagcttctcggtcttgcagtgttg

SEQ ID NO: 278968 - DNA, 25 bp, Homo sapien
tgcagtgttgcctaacacacacagt

SEQ ID NO: 278969 - DNA, 25 bp, Homo sapien
gatcagcacattttttgagactgca

SEQ ID NO: 278970 - DNA, 25 bp, Homo sapien
tagctagtcctccttgacatagtgt

SEQ ID NO: 278971 - DNA, 25 bp, Homo sapien
gacatagtgtggactcctggcatca

SEQ ID NO: 278972 - DNA, 25 bp, Homo sapien
atcaccttgtctactctctggatga

SEQ ID NO: 278973 - DNA, 25 bp, Homo sapien
tctctggatgagctcaaatgtgtca

SEQ ID NO: 278974 - DNA, 25 bp, Homo sapien
aaatgtgtcagtgtgcctgtctaac

SEQ ID NO: 278975 - DNA, 25 bp, Homo sapien
gcctgtctaactttggtccagatgt

SEQ ID NO: 278976 - DNA, 25 bp, Homo sapien
gaactaaaccattacctgcttgctt

SEQ ID NO: 278977 - DNA, 25 bp, Homo sapien
tgcttgcttgtagacctggaccgta

SEQ ID NO: 278978 - DNA, 25 bp, Homo sapien
tagacctggaccgtaggagagccca

SEQ ID NO: 278979 - DNA, 25 bp, Homo sapien
tctactatcttcaccctcataaaaa

SEQ ID NO: 278980 - DNA, 25 bp, Homo sapien
ggccaactcttttctacatctaata

SEQ ID NO: 278981 - DNA, 25 bp, Homo sapien
tttactttctctcgccatgtagtga

SEQ ID NO: 278982 - DNA, 25 bp, Homo sapien
aaacagtacggcatgtggcacctga

SEQ ID NO: 278983 - DNA, 25 bp, Homo sapien
gcatgtggcacctgaacagtcttca

SEQ ID NO: 278984 - DNA, 25 bp, Homo sapien
tttacagcctagtgaagaacagttt

SEQ ID NO: 278985 - DNA, 25 bp, Homo sapien
tgaacagtcttcatgcccaggaatc

SEQ ID NO: 278986 - DNA, 25 bp, Homo sapien
atgcccaggaatcccaaatgctgtt

SEQ ID NO: 278987 - DNA, 25 bp, Homo sapien
gaatcacttgattttccacttcaga

SEQ ID NO: 278988 - DNA, 25 bp, Homo sapien
aagccaaccgctcaacaacactggg

SEQ ID NO: 278989 - DNA, 25 bp, Homo sapien
cctgggtctccttgtagtcgatcaa

SEQ ID NO: 278990 - DNA, 25 bp, Homo sapien
acagtttgaaagataggctggctca

SEQ ID NO: 278991 - DNA, 25 bp, Homo sapien
aggaggcatcttgtgtcctttactt

SEQ ID NO: 278992 - DNA, 25 bp, Homo sapien
tacatctagtgatgacattttttca

SEQ ID NO: 278993 - DNA, 25 bp, Homo sapien
aaaaccgtgtacagtactacatgtg

SEQ ID NO: 278994 - DNA, 25 bp, Homo sapien
ccgtgtacagtactacatgtggtag

SEQ ID NO: 278995 - DNA, 25 bp, Homo sapien
ctacatgtggtagagcgttttctca

SEQ ID NO: 278996 - DNA, 25 bp, Homo sapien
acatgtggtagagcgttttctcaaa

SEQ ID NO: 278997 - DNA, 25 bp, Homo sapien
ggtagagcgttttctcaaattgtct

SEQ ID NO: 278998 - DNA, 25 bp, Homo sapien
gagcgttttctcaaattgtctattg

SEQ ID NO: 278999 - DNA, 25 bp, Homo sapien
tgtcgtaaacctgttttgtctcctt

SEQ ID NO: 279000 - DNA, 25 bp, Homo sapien
tttttgttctcttgccacttctctc

SEQ ID NO: 279001 - DNA, 25 bp, Homo sapien
cccacaaccagtaccaatgtacata

SEQ ID NO: 279002 - DNA, 25 bp, Homo sapien
taatgttttagactttacagaaact

SEQ ID NO: 279003 - DNA, 25 bp, Homo sapien
aggcccagcacatcgccgtggcggt

SEQ ID NO: 279004 - DNA, 25 bp, Homo sapien
cctgcaggtctacggagttgaggtg

SEQ ID NO: 279005 - DNA, 25 bp, Homo sapien
caggtctacggagttgaggtgcccg

SEQ ID NO: 279006 - DNA, 25 bp, Homo sapien
ccatggacacagagatcccctaagg

SEQ ID NO: 279007 - DNA, 25 bp, Homo sapien
catggacacagagatcccctaaggt

SEQ ID NO: 279008 - DNA, 25 bp, Homo sapien
atggacacagagatcccctaaggtc

SEQ ID NO: 279009 - DNA, 25 bp, Homo sapien
tggacacagagatcccctaaggtcc

SEQ ID NO: 279010 - DNA, 25 bp, Homo sapien
ggacacagagatcccctaaggtcct

SEQ ID NO: 279011 - DNA, 25 bp, Homo sapien
cacagagatcccctaaggtcctggc

SEQ ID NO: 279012 - DNA, 25 bp, Homo sapien
acagagatcccctaaggtcctggcc

SEQ ID NO: 279013 - DNA, 25 bp, Homo sapien
agagatcccctaaggtcctggccca

SEQ ID NO: 279014 - DNA, 25 bp, Homo sapien
acatcctggaccctgcgcagggcgt

SEQ ID NO: 279015 - DNA, 25 bp, Homo sapien
cagcggccctcgagctcggcgatga

SEQ ID NO: 279016 - DNA, 25 bp, Homo sapien
cggccctcgagctcggcgatgagct

SEQ ID NO: 279017 - DNA, 25 bp, Homo sapien
tcgagctcggcgatgagctcagcta

SEQ ID NO: 279018 - DNA, 25 bp, Homo sapien
cgagctcggcgatgagctcagctag

SEQ ID NO: 279019 - DNA, 25 bp, Homo sapien
agctcggcgatgagctcagctaggt

SEQ ID NO: 279020 - DNA, 25 bp, Homo sapien
gctcggcgatgagctcagctaggtg

SEQ ID NO: 279021 - DNA, 25 bp, Homo sapien
atgagctcagctaggtgggcgctct

SEQ ID NO: 279022 - DNA, 25 bp, Homo sapien
agctcagctaggtgggcgctctgct

SEQ ID NO: 279023 - DNA, 25 bp, Homo sapien
gctcagctaggtgggcgctctgctg

SEQ ID NO: 279024 - DNA, 25 bp, Homo sapien
gcagccggggcagcacctccagctc

SEQ ID NO: 279025 - DNA, 25 bp, Homo sapien
gtgcatgcacatgatcctaggtatg

SEQ ID NO: 279026 - DNA, 25 bp, Homo sapien
atgatcctaggtatgtatgttggac

SEQ ID NO: 279027 - DNA, 25 bp, Homo sapien
tatgttggacagtgcacacgtgtgt

SEQ ID NO: 279028 - DNA, 25 bp, Homo sapien
acgtgtgtgttcacagacaatacaa

SEQ ID NO: 279029 - DNA, 25 bp, Homo sapien
ttcacagacaatacaacatgccctc

SEQ ID NO: 279030 - DNA, 25 bp, Homo sapien
tggtgccccaggtcttggtatcccc

SEQ ID NO: 279031 - DNA, 25 bp, Homo sapien
tcttggtatccccagcttagtgacc

SEQ ID NO: 279032 - DNA, 25 bp, Homo sapien
agcttagtgaccagacttacttgca

SEQ ID NO: 279033 - DNA, 25 bp, Homo sapien
ttgaaattcaggcttggagtggcct

SEQ ID NO: 279034 - DNA, 25 bp, Homo sapien
ctatgtgctggaataaaaggtgtgt

SEQ ID NO: 279035 - DNA, 25 bp, Homo sapien
tgtgcgcatatgtgtgcgcctgcat

SEQ ID NO: 279036 - DNA, 25 bp, Homo sapien
actcagctagtcatagctcagccag

SEQ ID NO: 279037 - DNA, 25 bp, Homo sapien
tagtcatagctcagccagagggaag

SEQ ID NO: 279038 - DNA, 25 bp, Homo sapien
atgcactcggttttgcattaacaaa

SEQ ID NO: 279039 - DNA, 25 bp, Homo sapien
agaatatttgttgcatcttcaagca

SEQ ID NO: 279040 - DNA, 25 bp, Homo sapien
ttgttgcatcttcaagcaacctgct

SEQ ID NO: 279041 - DNA, 25 bp, Homo sapien
tgctgctctccagactgttacagtg

SEQ ID NO: 279042 - DNA, 25 bp, Homo sapien
gactgttacagtgcatgagtgataa

SEQ ID NO: 279043 - DNA, 25 bp, Homo sapien
gagtcagtcacttgtacattttaga

SEQ ID NO: 279044 - DNA, 25 bp, Homo sapien
gtatttctcaactatgttacttcaa

SEQ ID NO: 279045 - DNA, 25 bp, Homo sapien
agtgccaaacttaatgttaccttct

SEQ ID NO: 279046 - DNA, 25 bp, Homo sapien
acttaatgttaccttctctgctaaa

SEQ ID NO: 279047 - DNA, 25 bp, Homo sapien
tttgcaccggttgctcggtctgcac

SEQ ID NO: 279048 - DNA, 25 bp, Homo sapien
ggtctgcaccgatttggcctctcgt

SEQ ID NO: 279049 - DNA, 25 bp, Homo sapien
cctctcgtccactaacttaacagat

SEQ ID NO: 279050 - DNA, 25 bp, Homo sapien
tacagttggtacttctggagagtct

SEQ ID NO: 279051 - DNA, 25 bp, Homo sapien
tggagagtcttctctgacccgtgtc

SEQ ID NO: 279052 - DNA, 25 bp, Homo sapien
ccgtgtctgggaattggttgccttc

SEQ ID NO: 279053 - DNA, 25 bp, Homo sapien
ggttgccttctgttctgtacataac

SEQ ID NO: 279054 - DNA, 25 bp, Homo sapien
ataacctttgttacagcacttctca

SEQ ID NO: 279055 - DNA, 25 bp, Homo sapien
gcacttctcacctggcattgtgaaa

SEQ ID NO: 279056 - DNA, 25 bp, Homo sapien
tgtgaaaatccgtttacctgccttt

SEQ ID NO: 279057 - DNA, 25 bp, Homo sapien
agctgggatcatgtcttatttgtaa

SEQ ID NO: 279058 - DNA, 25 bp, Homo sapien
gaatataggctcagagttactacat

SEQ ID NO: 279059 - DNA, 25 bp, Homo sapien
gagttactacatcaactacattttc

SEQ ID NO: 279060 - DNA, 25 bp, Homo sapien
tcaactacattttcatcaagccaga

SEQ ID NO: 279061 - DNA, 25 bp, Homo sapien
gccagaaatttgtatgctatcaact

SEQ ID NO: 279062 - DNA, 25 bp, Homo sapien
gggatgaaaaacttacaacttctag

SEQ ID NO: 279063 - DNA, 25 bp, Homo sapien
caacttctagtacaggatttcttat

SEQ ID NO: 279064 - DNA, 25 bp, Homo sapien
gatttcttatcctcagtgctattaa

SEQ ID NO: 279065 - DNA, 25 bp, Homo sapien
tgctattaatattttgggccaccta

SEQ ID NO: 279066 - DNA, 25 bp, Homo sapien
tattttgggccacctaattctttgt

SEQ ID NO: 279067 - DNA, 25 bp, Homo sapien
ttgggccacctaattctttgttgag

SEQ ID NO: 279068 - DNA, 25 bp, Homo sapien
ccacctaattctttgttgagggttg

SEQ ID NO: 279069 - DNA, 25 bp, Homo sapien
gaacttcacttaggacattagcaca

SEQ ID NO: 279070 - DNA, 25 bp, Homo sapien
ggacattagcacacaaatagcacac

SEQ ID NO: 279071 - DNA, 25 bp, Homo sapien
atagcacacatatcacatacccatt

SEQ ID NO: 279072 - DNA, 25 bp, Homo sapien
gcacacatatcacatacccatttat

SEQ ID NO: 279073 - DNA, 25 bp, Homo sapien
atgttcctgatacatgtgtcatgtg

SEQ ID NO: 279074 - DNA, 25 bp, Homo sapien
gtcatgtgatttcttccaacaaatg

SEQ ID NO: 279075 - DNA, 25 bp, Homo sapien
aagtaaagactctgtcatgcatttt

SEQ ID NO: 279076 - DNA, 25 bp, Homo sapien
gcaagcaactagtctgtaggttgtc

SEQ ID NO: 279077 - DNA, 25 bp, Homo sapien
gtaggttgtcttttctctagagatc

SEQ ID NO: 279078 - DNA, 25 bp, Homo sapien
ttgtcttttctctagagatccttgt

SEQ ID NO: 279079 - DNA, 25 bp, Homo sapien
cctgtctccgtgacaaccagtggtt

SEQ ID NO: 279080 - DNA, 25 bp, Homo sapien
agctgatctgcaatgggatccctga

SEQ ID NO: 279081 - DNA, 25 bp, Homo sapien
tttgaactctgagcacttagccacc

SEQ ID NO: 279082 - DNA, 25 bp, Homo sapien
acttagccacccaagcagagcagca

SEQ ID NO: 279083 - DNA, 25 bp, Homo sapien
agcagcaagagtggctctgtagtgt

SEQ ID NO: 279084 - DNA, 25 bp, Homo sapien
ggctctgtagtgttgttgcgctcca

SEQ ID NO: 279085 - DNA, 25 bp, Homo sapien
gttgcgctccagtgcagcatattga

SEQ ID NO: 279086 - DNA, 25 bp, Homo sapien
ttgaaacatttatctgctaagcaga

SEQ ID NO: 279087 - DNA, 25 bp, Homo sapien
aagcagatgccttcgcattgggact

SEQ ID NO: 279088 - DNA, 25 bp, Homo sapien
tgccttcgcattgggactctgaaca

SEQ ID NO: 279089 - DNA, 25 bp, Homo sapien
tattaagcctgttattgtgactgac

SEQ ID NO: 279090 - DNA, 25 bp, Homo sapien
ctgttattgtgactgacagctcagt

SEQ ID NO: 279091 - DNA, 25 bp, Homo sapien
cggccgtggcggtgggttacaagtg

SEQ ID NO: 279092 - DNA, 25 bp, Homo sapien
gtgggttacaagtgaagctgaatct

SEQ ID NO: 279093 - DNA, 25 bp, Homo sapien
gaagctgaatcttgaaggtacccaa

SEQ ID NO: 279094 - DNA, 25 bp, Homo sapien
gcgcaactcggcagcggcagggaaa

SEQ ID NO: 279095 - DNA, 25 bp, Homo sapien
gaaggaatcaataactctctaggta

SEQ ID NO: 279096 - DNA, 25 bp, Homo sapien
tcaataactctctaggtaactcgaa

SEQ ID NO: 279097 - DNA, 25 bp, Homo sapien
ctctctaggtaactcgaaatcacag

SEQ ID NO: 279098 - DNA, 25 bp, Homo sapien
taactacatttgcaacttcagaaat

SEQ ID NO: 279099 - DNA, 25 bp, Homo sapien
tcatggtggatgagagcggtcttca

SEQ ID NO: 279100 - DNA, 25 bp, Homo sapien
tggatgagagcggtcttcagcacct

SEQ ID NO: 279101 - DNA, 25 bp, Homo sapien
ggtcttcagcacctcttgtgaagca

SEQ ID NO: 279102 - DNA, 25 bp, Homo sapien
aagtgtactcacttactcactcctt

SEQ ID NO: 279103 - DNA, 25 bp, Homo sapien
cttactcactccttttgaactacaa

SEQ ID NO: 279104 - DNA, 25 bp, Homo sapien
aaactcctattgaatctagctcagg

SEQ ID NO: 279105 - DNA, 25 bp, Homo sapien
attgaatctagctcaggatcacctg

SEQ ID NO: 279106 - DNA, 25 bp, Homo sapien
ctgagcccaggagtgtaagccatag

SEQ ID NO: 279107 - DNA, 25 bp, Homo sapien
tgtaagccatagagagaccctgact

SEQ ID NO: 279108 - DNA, 25 bp, Homo sapien
aactgatctggattgtctacgccaa

SEQ ID NO: 279109 - DNA, 25 bp, Homo sapien
tctacgccaacaggacttgatttct

SEQ ID NO: 279110 - DNA, 25 bp, Homo sapien
gatttctgattagcactactatgga

SEQ ID NO: 279111 - DNA, 25 bp, Homo sapien
gagattcgtgtctctaggctttcat

SEQ ID NO: 279112 - DNA, 25 bp, Homo sapien
gtctctaggctttcattgcattgtg

SEQ ID NO: 279113 - DNA, 25 bp, Homo sapien
taagctcctttttattaatctgtag

SEQ ID NO: 279114 - DNA, 25 bp, Homo sapien
tattaatctgtagggcagagcttag

SEQ ID NO: 279115 - DNA, 25 bp, Homo sapien
agacctctcttctgtaagcaactca

SEQ ID NO: 279116 - DNA, 25 bp, Homo sapien
acctctcttctgtaagcaactcaat

SEQ ID NO: 279117 - DNA, 25 bp, Homo sapien
attatttaagtaccatcctcaccca

SEQ ID NO: 279118 - DNA, 25 bp, Homo sapien
ttaagtaccatcctcacccagtgta

SEQ ID NO: 279119 - DNA, 25 bp, Homo sapien
atcctcacccagtgtactgttagct

SEQ ID NO: 279120 - DNA, 25 bp, Homo sapien
cccagtgtactgttagctgctgtta

SEQ ID NO: 279121 - DNA, 25 bp, Homo sapien
gctgctgttatgatattgattactg

SEQ ID NO: 279122 - DNA, 25 bp, Homo sapien
gtatatccttggtagactgttgatc

SEQ ID NO: 279123 - DNA, 25 bp, Homo sapien
tatccttggtagactgttgatcaaa

SEQ ID NO: 279124 - DNA, 25 bp, Homo sapien
ttgtatcccacaactttactaaatt

SEQ ID NO: 279125 - DNA, 25 bp, Homo sapien
ttataataggattatgtcatccatg

SEQ ID NO: 279126 - DNA, 25 bp, Homo sapien
tgtcatccatgaatagagagagttt

SEQ ID NO: 279127 - DNA, 25 bp, Homo sapien
atccatgaatagagagagttttact

SEQ ID NO: 279128 - DNA, 25 bp, Homo sapien
ctgtcttttcaatctagatgccttt

SEQ ID NO: 279129 - DNA, 25 bp, Homo sapien
gtcttttcaatctagatgcctttac

SEQ ID NO: 279130 - DNA, 25 bp, Homo sapien
ttcaatctagatgcctttacttttt

SEQ ID NO: 279131 - DNA, 25 bp, Homo sapien
attaccctggctagaacctccagta

SEQ ID NO: 279132 - DNA, 25 bp, Homo sapien
taccctggctagaacctccagtaaa

SEQ ID NO: 279133 - DNA, 25 bp, Homo sapien
tggctagaacctccagtaaaaggtt

SEQ ID NO: 279134 - DNA, 25 bp, Homo sapien
ctccagtaaaaggttgaatagaagt

SEQ ID NO: 279135 - DNA, 25 bp, Homo sapien
caagagttgtagagtcctcacattt

SEQ ID NO: 279136 - DNA, 25 bp, Homo sapien
gagttgtagagtcctcacattttaa

SEQ ID NO: 279137 - DNA, 25 bp, Homo sapien
gttgtagagtcctcacattttaaaa

SEQ ID NO: 279138 - DNA, 25 bp, Homo sapien
tgacgaaaataacatctgactggga

SEQ ID NO: 279139 - DNA, 25 bp, Homo sapien
taacatctgactgggatagaaactt

SEQ ID NO: 279140 - DNA, 25 bp, Homo sapien
gactgggatagaaactttgtaacat

SEQ ID NO: 279141 - DNA, 25 bp, Homo sapien
ataattttgccacttggaattaact

SEQ ID NO: 279142 - DNA, 25 bp, Homo sapien
tgccacttggaattaactactattg

SEQ ID NO: 279143 - DNA, 25 bp, Homo sapien
tgagttttagtcagcggtgcagcca

SEQ ID NO: 279144 - DNA, 25 bp, Homo sapien
gtgcagccagcaccacagtccagtg

SEQ ID NO: 279145 - DNA, 25 bp, Homo sapien
ccagcaccacagtccagtggtcttt

SEQ ID NO: 279146 - DNA, 25 bp, Homo sapien
attggagggatataggcacctggaa

SEQ ID NO: 279147 - DNA, 25 bp, Homo sapien
agggatataggcacctggaatgcag

SEQ ID NO: 279148 - DNA, 25 bp, Homo sapien
gagggagtgaattcctgccaacaca

SEQ ID NO: 279149 - DNA, 25 bp, Homo sapien
gggagtgaattcctgccaacacata

SEQ ID NO: 279150 - DNA, 25 bp, Homo sapien
gtgaattcctgccaacacataaatt

SEQ ID NO: 279151 - DNA, 25 bp, Homo sapien
tgggccccagattgtgaagaataaa

SEQ ID NO: 279152 - DNA, 25 bp, Homo sapien
gatgagatcatcctggactacaccc

SEQ ID NO: 279153 - DNA, 25 bp, Homo sapien
agatcatcctggactacacccaatg

SEQ ID NO: 279154 - DNA, 25 bp, Homo sapien
tcatcctggactacacccaatgata

SEQ ID NO: 279155 - DNA, 25 bp, Homo sapien
tcctggactacacccaatgataagt

SEQ ID NO: 279156 - DNA, 25 bp, Homo sapien
cacccaatgataagtgtccttaaag

SEQ ID NO: 279157 - DNA, 25 bp, Homo sapien
ttcttgtatgacttttgactcttca

SEQ ID NO: 279158 - DNA, 25 bp, Homo sapien
ttgactcttcatatgctttcttcat

SEQ ID NO: 279159 - DNA, 25 bp, Homo sapien
actcttcatatgctttcttcattgt

SEQ ID NO: 279160 - DNA, 25 bp, Homo sapien
ttttttgcacattcccttaagtttg

SEQ ID NO: 279161 - DNA, 25 bp, Homo sapien
ttgcacattcccttaagtttggcag

SEQ ID NO: 279162 - DNA, 25 bp, Homo sapien
gcacattcccttaagtttggcagtc

SEQ ID NO: 279163 - DNA, 25 bp, Homo sapien
cattcccttaagtttggcagtctaa

SEQ ID NO: 279164 - DNA, 25 bp, Homo sapien
tcccttaagtttggcagtctaatct

SEQ ID NO: 279165 - DNA, 25 bp, Homo sapien
gtttggcagtctaatctgtatcttt

SEQ ID NO: 279166 - DNA, 25 bp, Homo sapien
gtctaatctgtatctttggcataaa

SEQ ID NO: 279167 - DNA, 25 bp, Homo sapien
aacaaaaaatgctggccaagtgtgg

SEQ ID NO: 279168 - DNA, 25 bp, Homo sapien
gcagcgaccctcatttgccttttag

SEQ ID NO: 279169 - DNA, 25 bp, Homo sapien
agcgaccctcatttgccttttagtc

SEQ ID NO: 279170 - DNA, 25 bp, Homo sapien
cgaccctcatttgccttttagtcag

SEQ ID NO: 279171 - DNA, 25 bp, Homo sapien
accctcatttgccttttagtcagaa

SEQ ID NO: 279172 - DNA, 25 bp, Homo sapien
ccctcatttgccttttagtcagaat

SEQ ID NO: 279173 - DNA, 25 bp, Homo sapien
cctcatttgccttttagtcagaatt

SEQ ID NO: 279174 - DNA, 25 bp, Homo sapien
tcatttgccttttagtcagaattaa

SEQ ID NO: 279175 - DNA, 25 bp, Homo sapien
tagtcagaattaatctctgcacaga

SEQ ID NO: 279176 - DNA, 25 bp, Homo sapien
cagaattaatctctgcacagaaagg

SEQ ID NO: 279177 - DNA, 25 bp, Homo sapien
gcacagaaagggacacttacccggg

SEQ ID NO: 279178 - DNA, 25 bp, Homo sapien
aaagccccccgctggtgtgttggag

SEQ ID NO: 279179 - DNA, 25 bp, Homo sapien
cactgacagaatgtgcttagcactt

SEQ ID NO: 279180 - DNA, 25 bp, Homo sapien
gtgcttagcacttttggctattcac

SEQ ID NO: 279181 - DNA, 25 bp, Homo sapien
ggctattcacacagcttttgagcat

SEQ ID NO: 279182 - DNA, 25 bp, Homo sapien
gcttttgagcatgatttgcatccaa

SEQ ID NO: 279183 - DNA, 25 bp, Homo sapien
gcatccaatatttacattgctagca

SEQ ID NO: 279184 - DNA, 25 bp, Homo sapien
aagccatctgtgagttttgtcaaaa

SEQ ID NO: 279185 - DNA, 25 bp, Homo sapien
gtttctttgaactaactcttatgca

SEQ ID NO: 279186 - DNA, 25 bp, Homo sapien
gaactaactcttatgcagttgcaaa

SEQ ID NO: 279187 - DNA, 25 bp, Homo sapien
gtgtacaatatcaggtgttccagat

SEQ ID NO: 279188 - DNA, 25 bp, Homo sapien
tatcattgcttccttgttccctctg

SEQ ID NO: 279189 - DNA, 25 bp, Homo sapien
tccctctgaggtccagaagattcat

SEQ ID NO: 279190 - DNA, 25 bp, Homo sapien
tgcctgctatcgagcatgagcacct

SEQ ID NO: 279191 - DNA, 25 bp, Homo sapien
gagcatgagcacctaaatcactata

SEQ ID NO: 279192 - DNA, 25 bp, Homo sapien
ctataactcatacaaatctcccttc

SEQ ID NO: 279193 - DNA, 25 bp, Homo sapien
taactcatacaaatctcccttcaac

SEQ ID NO: 279194 - DNA, 25 bp, Homo sapien
ccttcaaccacacaacaacagttaa

SEQ ID NO: 279195 - DNA, 25 bp, Homo sapien
attcaatacacagttcagtgcatga

SEQ ID NO: 279196 - DNA, 25 bp, Homo sapien
agtgcatgaaccgttattgatccga

SEQ ID NO: 279197 - DNA, 25 bp, Homo sapien
atgaaccgttattgatccgaatgaa

SEQ ID NO: 279198 - DNA, 25 bp, Homo sapien
accgttattgatccgaatgaactct

SEQ ID NO: 279199 - DNA, 25 bp, Homo sapien
agacaatgtacaagagactcaaatc

SEQ ID NO: 279200 - DNA, 25 bp, Homo sapien
tgacacaaatgactgggctaaatct

SEQ ID NO: 279201 - DNA, 25 bp, Homo sapien
tatataattctcaaacagagtctaa

SEQ ID NO: 279202 - DNA, 25 bp, Homo sapien
cagagtctaaaaaattgcatgagga

SEQ ID NO: 279203 - DNA, 25 bp, Homo sapien
taacctcaatgtccatagacaagaa

SEQ ID NO: 279204 - DNA, 25 bp, Homo sapien
gaggatatgtatagtatgaggtcac

SEQ ID NO: 279205 - DNA, 25 bp, Homo sapien
gtatgaggtcactatataaagtaaa

SEQ ID NO: 279206 - DNA, 25 bp, Homo sapien
tagcatattatgctgtagctacata

SEQ ID NO: 279207 - DNA, 25 bp, Homo sapien
aacaacatgcatgggcataataagc

SEQ ID NO: 279208 - DNA, 25 bp, Homo sapien
gggcataataagcatcaaattcaga

SEQ ID NO: 279209 - DNA, 25 bp, Homo sapien
gagaaatgttcacttctgggaaaag

SEQ ID NO: 279210 - DNA, 25 bp, Homo sapien
tagaatacattactactgagtagct

SEQ ID NO: 279211 - DNA, 25 bp, Homo sapien
ataaacttaagctacctgaatcaaa

SEQ ID NO: 279212 - DNA, 25 bp, Homo sapien
gaatatgggcaacaacaattgtagt

SEQ ID NO: 279213 - DNA, 25 bp, Homo sapien
tgtagtagatttttaagtacctagt

SEQ ID NO: 279214 - DNA, 25 bp, Homo sapien
gttaaaaagtgttctgggccatcca

SEQ ID NO: 279215 - DNA, 25 bp, Homo sapien
gttctgggccatccagatatatgga

SEQ ID NO: 279216 - DNA, 25 bp, Homo sapien
agcaatattccttaatcttctctcc

SEQ ID NO: 279217 - DNA, 25 bp, Homo sapien
tattccttaatcttctctcctggag

SEQ ID NO: 279218 - DNA, 25 bp, Homo sapien
tcctggagctcatttgctcacgtaa

SEQ ID NO: 279219 - DNA, 25 bp, Homo sapien
gctcatttgctcacgtaaaagttaa

SEQ ID NO: 279220 - DNA, 25 bp, Homo sapien
attgctatatgacttctactggagg

SEQ ID NO: 279221 - DNA, 25 bp, Homo sapien
acttctactggaggagaattcacca

SEQ ID NO: 279222 - DNA, 25 bp, Homo sapien
gaattcaccatgctgggaatggcag

SEQ ID NO: 279223 - DNA, 25 bp, Homo sapien
aaatgctctggtttctgtattcaaa

SEQ ID NO: 279224 - DNA, 25 bp, Homo sapien
ctgtattcaaatactccatgttttg

SEQ ID NO: 279225 - DNA, 25 bp, Homo sapien
gttttgaagttagcaaagcccttag

SEQ ID NO: 279226 - DNA, 25 bp, Homo sapien
gcccttagagagtacagctgaccct

SEQ ID NO: 279227 - DNA, 25 bp, Homo sapien
gcaccggccctgcatgcagttgaaa

SEQ ID NO: 279228 - DNA, 25 bp, Homo sapien
gcagttgaaaatctcctataacctt

SEQ ID NO: 279229 - DNA, 25 bp, Homo sapien
tctcctataacctttgattttccca

SEQ ID NO: 279230 - DNA, 25 bp, Homo sapien
tataacctttgattttcccacaact

SEQ ID NO: 279231 - DNA, 25 bp, Homo sapien
ttcctttcctacatatggagaagag

SEQ ID NO: 279232 - DNA, 25 bp, Homo sapien
tttaatagctctgccttgagctgag

SEQ ID NO: 279233 - DNA, 25 bp, Homo sapien
tctgccttgagctgagtatgtaaat

SEQ ID NO: 279234 - DNA, 25 bp, Homo sapien
ggtcgaggctgagaagccgtggtgg

SEQ ID NO: 279235 - DNA, 25 bp, Homo sapien
taccatggacacagagatcccctaa

SEQ ID NO: 279236 - DNA, 25 bp, Homo sapien
agagatcccctaaggtcctggccca

SEQ ID NO: 279237 - DNA, 25 bp, Homo sapien
aaagagaagcccaggatggtcggct

SEQ ID NO: 279238 - DNA, 25 bp, Homo sapien
agaagcccaggatggtcggctgcct

SEQ ID NO: 279239 - DNA, 25 bp, Homo sapien
gggacattgtcaccacgtcgccatg

SEQ ID NO: 279240 - DNA, 25 bp, Homo sapien
tcaccacgtcgccatgacggctggt

SEQ ID NO: 279241 - DNA, 25 bp, Homo sapien
atgacggctggtccccacaggacca

SEQ ID NO: 279242 - DNA, 25 bp, Homo sapien
cccacaggaccagctgggaggactg

SEQ ID NO: 279243 - DNA, 25 bp, Homo sapien
ggaggactggttgtgctgctggaga

SEQ ID NO: 279244 - DNA, 25 bp, Homo sapien
gaaggcaatggcatgctgccgcttt

SEQ ID NO: 279245 - DNA, 25 bp, Homo sapien
ggacatgaaggcaatttctcggcat

SEQ ID NO: 279246 - DNA, 25 bp, Homo sapien
aatttctcggcatacgcaggagctc

SEQ ID NO: 279247 - DNA, 25 bp, Homo sapien
agccattattcaaacgctccatcag

SEQ ID NO: 279248 - DNA, 25 bp, Homo sapien
ttccctatagggatattatcggctt

SEQ ID NO: 279249 - DNA, 25 bp, Homo sapien
agagcaaaaaggtcatactgggata

SEQ ID NO: 279250 - DNA, 25 bp, Homo sapien
gaatttgtcaaagcagcaggattac

SEQ ID NO: 279251 - DNA, 25 bp, Homo sapien
caggattacaggattatgctccaga

SEQ ID NO: 279252 - DNA, 25 bp, Homo sapien
tatgctccagaaataactgcccctg

SEQ ID NO: 279253 - DNA, 25 bp, Homo sapien
aataactgcccctgaagagaatgag

SEQ ID NO: 279254 - DNA, 25 bp, Homo sapien
gaggaattaccttgcactgaaccat

SEQ ID NO: 279255 - DNA, 25 bp, Homo sapien
gggaaatccacttcacagagcttga

SEQ ID NO: 279256 - DNA, 25 bp, Homo sapien
ggcttttacacacattttctctgtt

SEQ ID NO: 279257 - DNA, 25 bp, Homo sapien
ttgtagtcgtgcaagattttttgtg

SEQ ID NO: 279258 - DNA, 25 bp, Homo sapien
aactgtatcaagttcatcaccttta

SEQ ID NO: 279259 - DNA, 25 bp, Homo sapien
gttcatcacctttatcaatttgacc

SEQ ID NO: 279260 - DNA, 25 bp, Homo sapien
atcaatttgacctgtgccgtgaact

SEQ ID NO: 279261 - DNA, 25 bp, Homo sapien
acctgtgccgtgaacttctttagat

SEQ ID NO: 279262 - DNA, 25 bp, Homo sapien
gtgccgtgaacttctttagattcat

SEQ ID NO: 279263 - DNA, 25 bp, Homo sapien
agaatactaatttaagcaaggcttg

SEQ ID NO: 279264 - DNA, 25 bp, Homo sapien
ttcttggtttctttgtgttgtggtc

SEQ ID NO: 279265 - DNA, 25 bp, Homo sapien
gtttctttgtgttgtggtcacatca

SEQ ID NO: 279266 - DNA, 25 bp, Homo sapien
gtggtcacatcatgtggcttttaca

SEQ ID NO: 279267 - DNA, 25 bp, Homo sapien
ggtcgaggctgagaagccgtggtgg

SEQ ID NO: 279268 - DNA, 25 bp, Homo sapien
aaagagaagcccaggatggtcggct

SEQ ID NO: 279269 - DNA, 25 bp, Homo sapien
agaagcccaggatggtcggctgcct

SEQ ID NO: 279270 - DNA, 25 bp, Homo sapien
gaagcccaggatggtcggctgcctg

SEQ ID NO: 279271 - DNA, 25 bp, Homo sapien
aagcccaggatggtcggctgcctgg

SEQ ID NO: 279272 - DNA, 25 bp, Homo sapien
ggatggtcggctgcctggggacatt

SEQ ID NO: 279273 - DNA, 25 bp, Homo sapien
agctgggaggactggttgtgctgct

SEQ ID NO: 279274 - DNA, 25 bp, Homo sapien
tgggaggactggttgtgctgctgga

SEQ ID NO: 279275 - DNA, 25 bp, Homo sapien
ggaggactggttgtgctgctggaga

SEQ ID NO: 279276 - DNA, 25 bp, Homo sapien
gaggactggttgtgctgctggagaa

SEQ ID NO: 279277 - DNA, 25 bp, Homo sapien
ggactggttgtgctgctggagaagg

SEQ ID NO: 279278 - DNA, 25 bp, Homo sapien
agaggacctcctctgacaaactggt

SEQ ID NO: 279279 - DNA, 25 bp, Homo sapien
tctgacaaactggtctggtacccac

SEQ ID NO: 279280 - DNA, 25 bp, Homo sapien
cttccaggcttctcttgtcatcttt

SEQ ID NO: 279281 - DNA, 25 bp, Homo sapien
cttgtcatctttctctgcctgaggg

SEQ ID NO: 279282 - DNA, 25 bp, Homo sapien
gaaatgcgatgtgatctgtaccagg

SEQ ID NO: 279283 - DNA, 25 bp, Homo sapien
aggtcacccagctatgctgcaaagt

SEQ ID NO: 279284 - DNA, 25 bp, Homo sapien
gcaaagtgggttggccaaggccctt

SEQ ID NO: 279285 - DNA, 25 bp, Homo sapien
ttggccaaggccctttgcactgcat

SEQ ID NO: 279286 - DNA, 25 bp, Homo sapien
gtgcccagcaacatcaggtaacctt

SEQ ID NO: 279287 - DNA, 25 bp, Homo sapien
aggtaaccttcactgagcaccaagc

SEQ ID NO: 279288 - DNA, 25 bp, Homo sapien
agcaccaagcttatgccaggtctgt

SEQ ID NO: 279289 - DNA, 25 bp, Homo sapien
ttcaattcaatagagcagttgcact

SEQ ID NO: 279290 - DNA, 25 bp, Homo sapien
gagcagttgcacttttctcatatag

SEQ ID NO: 279291 - DNA, 25 bp, Homo sapien
gttgcacttttctcatatagtaaaa

SEQ ID NO: 279292 - DNA, 25 bp, Homo sapien
agtaaacagtacagcacaaccccta

SEQ ID NO: 279293 - DNA, 25 bp, Homo sapien
agtacagcacaacccctaagtgcag

SEQ ID NO: 279294 - DNA, 25 bp, Homo sapien
gagggtcaaagcctcactgtaccac

SEQ ID NO: 279295 - DNA, 25 bp, Homo sapien
aaagcctcactgtaccactttccag

SEQ ID NO: 279296 - DNA, 25 bp, Homo sapien
actttccagctgtgtaatcttggga

SEQ ID NO: 279297 - DNA, 25 bp, Homo sapien
gatgcttaaaagctatacctgactt

SEQ ID NO: 279298 - DNA, 25 bp, Homo sapien
gctatacctgacttttaggattgtt

SEQ ID NO: 279299 - DNA, 25 bp, Homo sapien
aaccattgtttaaacctatatgaat

SEQ ID NO: 279300 - DNA, 25 bp, Homo sapien
ctgtgtcggccctttagtgagtgtc

SEQ ID NO: 279301 - DNA, 25 bp, Homo sapien
ggccctttagtgagtgtctgcgttt

SEQ ID NO: 279302 - DNA, 25 bp, Homo sapien
agtgtctgcgtttcgttcaagtcta

SEQ ID NO: 279303 - DNA, 25 bp, Homo sapien
gttcaagtctacgagcacagccgtg

SEQ ID NO: 279304 - DNA, 25 bp, Homo sapien
gtctacgagcacagccgtgttctaa

SEQ ID NO: 279305 - DNA, 25 bp, Homo sapien
gtgttctaacctctcagagcaatgt

SEQ ID NO: 279306 - DNA, 25 bp, Homo sapien
aagcactatttctccaacgcttgca

SEQ ID NO: 279307 - DNA, 25 bp, Homo sapien
aacgcttgcagttggtgaaaagaac

SEQ ID NO: 279308 - DNA, 25 bp, Homo sapien
aagaaccaatgcctcgctatttggg

SEQ ID NO: 279309 - DNA, 25 bp, Homo sapien
aatgcctcgctatttgggtgcacat

SEQ ID NO: 279310 - DNA, 25 bp, Homo sapien
gaaaatgccagagggtatcttcaag

SEQ ID NO: 279311 - DNA, 25 bp, Homo sapien
ttacgagacctaagaaactatgcca

SEQ ID NO: 279312 - DNA, 25 bp, Homo sapien
actatgccaaagaaaagcgagatga

SEQ ID NO: 279313 - DNA, 25 bp, Homo sapien
cgagatgaacaaaggagacgccacc

SEQ ID NO: 279314 - DNA, 25 bp, Homo sapien
ggagacgccaccaggatgaactgga

SEQ ID NO: 279315 - DNA, 25 bp, Homo sapien
accaggatgaactggactccatgga

SEQ ID NO: 279316 - DNA, 25 bp, Homo sapien
gactccatggagaactactataagg

SEQ ID NO: 279317 - DNA, 25 bp, Homo sapien
tactataaggaccagttttcattgc

SEQ ID NO: 279318 - DNA, 25 bp, Homo sapien
gttttcattgctggcagaagccata

SEQ ID NO: 279319 - DNA, 25 bp, Homo sapien
gaagccatatcacaggaacatcaag

SEQ ID NO: 279320 - DNA, 25 bp, Homo sapien
aaatctcaggcccagacattacata

SEQ ID NO: 279321 - DNA, 25 bp, Homo sapien
aggcccagacattacataaggtgaa

SEQ ID NO: 279322 - DNA, 25 bp, Homo sapien
tttctgggattctcatcatccatag

SEQ ID NO: 279323 - DNA, 25 bp, Homo sapien
gggattctcatcatccatagaaagg

SEQ ID NO: 279324 - DNA, 25 bp, Homo sapien
ttaaatgggtgatgagcgagtgctt

SEQ ID NO: 279325 - DNA, 25 bp, Homo sapien
agcgagtgcttttgtcctgggttaa

SEQ ID NO: 279326 - DNA, 25 bp, Homo sapien
ttttgtcctgggttaatcctagata

SEQ ID NO: 279327 - DNA, 25 bp, Homo sapien
atcctagatataactctacatgtgt

SEQ ID NO: 279328 - DNA, 25 bp, Homo sapien
gttatgagcatagacaactggacta

SEQ ID NO: 279329 - DNA, 25 bp, Homo sapien
ggagctcaaagtagcacagctgact

SEQ ID NO: 279330 - DNA, 25 bp, Homo sapien
ctgactgagtggctttctacattca

SEQ ID NO: 279331 - DNA, 25 bp, Homo sapien
ctgagtggctttctacattcactga

SEQ ID NO: 279332 - DNA, 25 bp, Homo sapien
ctcaacatgttcatttatctgataa

SEQ ID NO: 279333 - DNA, 25 bp, Homo sapien
taaagcttgaaacaggtggctgaca

SEQ ID NO: 279334 - DNA, 25 bp, Homo sapien
aatacctcagcaagaaattgcaagt

SEQ ID NO: 279335 - DNA, 25 bp, Homo sapien
agtaataattgcaccaagagtcagc

SEQ ID NO: 279336 - DNA, 25 bp, Homo sapien
gcaccaagagtcagcatctatttta

SEQ ID NO: 279337 - DNA, 25 bp, Homo sapien
gtcagcatctattttaactgtatgt

SEQ ID NO: 279338 - DNA, 25 bp, Homo sapien
gaaacaggtggctgacaatgcagaa

SEQ ID NO: 279339 - DNA, 25 bp, Homo sapien
gtcaaatttttgcttagatggctac

SEQ ID NO: 279340 - DNA, 25 bp, Homo sapien
ttttgcttagatggctacaaatact

SEQ ID NO: 279341 - DNA, 25 bp, Homo sapien
gtggctgacaatgcagaaatcaatc

SEQ ID NO: 279342 - DNA, 25 bp, Homo sapien
gaaatcaatcactgacctgaaaagg

SEQ ID NO: 279343 - DNA, 25 bp, Homo sapien
gaacattgttagaggaatttaggat

SEQ ID NO: 279344 - DNA, 25 bp, Homo sapien
gatattgatgggatgttaaggactg

SEQ ID NO: 279345 - DNA, 25 bp, Homo sapien
gcaacaaatcagatggccagagtaa

SEQ ID NO: 279346 - DNA, 25 bp, Homo sapien
tcagatggccagagtaaatgacaaa

SEQ ID NO: 279347 - DNA, 25 bp, Homo sapien
atggctgagatttcattctttggaa

SEQ ID NO: 279348 - DNA, 25 bp, Homo sapien
ctgagatttcattctttggaaagtc

SEQ ID NO: 279349 - DNA, 25 bp, Homo sapien
gtctcagatgaggaagctgtaagta

SEQ ID NO: 279350 - DNA, 25 bp, Homo sapien
ttaagaactcttgtcctggaaacct

SEQ ID NO: 279351 - DNA, 25 bp, Homo sapien
ggaaagcaccaataggatttggcaa

SEQ ID NO: 279352 - DNA, 25 bp, Homo sapien
aataggatttggcaaggacttgtca

SEQ ID NO: 279353 - DNA, 25 bp, Homo sapien
tggcaaggacttgtcatgattaact

SEQ ID NO: 279354 - DNA, 25 bp, Homo sapien
ggacttgtcatgattaactgaatag

SEQ ID NO: 279355 - DNA, 25 bp, Homo sapien
agtcataatgtgttgctaagtccga

SEQ ID NO: 279356 - DNA, 25 bp, Homo sapien
tgtgttgctaagtccgatcccagat

SEQ ID NO: 279357 - DNA, 25 bp, Homo sapien
aagtccgatcccagatcctaaaaat

SEQ ID NO: 279358 - DNA, 25 bp, Homo sapien
tgaggtagtggccattgaacagaaa

SEQ ID NO: 279359 - DNA, 25 bp, Homo sapien
acaagtgtacctttttctaccactg

SEQ ID NO: 279360 - DNA, 25 bp, Homo sapien
acctttttctaccactgttgttcag

SEQ ID NO: 279361 - DNA, 25 bp, Homo sapien
ttctaccactgttgttcagttttat

SEQ ID NO: 279362 - DNA, 25 bp, Homo sapien
attatattgacaagcacctctgccc

SEQ ID NO: 279363 - DNA, 25 bp, Homo sapien
acaaaatatgcatgatggcaccata

SEQ ID NO: 279364 - DNA, 25 bp, Homo sapien
gatggcaccatattgtgtataatag

SEQ ID NO: 279365 - DNA, 25 bp, Homo sapien
gtgacaaatacagtctatgtgggtg

SEQ ID NO: 279366 - DNA, 25 bp, Homo sapien
atcatctttgttactgacacttggg

SEQ ID NO: 279367 - DNA, 25 bp, Homo sapien
gggagtactttatagtggctgtcaa

SEQ ID NO: 279368 - DNA, 25 bp, Homo sapien
gtggctgtcaagaccaatacaaaac

SEQ ID NO: 279369 - DNA, 25 bp, Homo sapien
tacaaaacatggtttgtgcctgaaa

SEQ ID NO: 279370 - DNA, 25 bp, Homo sapien
gtgcctgaaaaagtcaagtgccatt

SEQ ID NO: 279371 - DNA, 25 bp, Homo sapien
gtatcagctttaaccagctgccctg

SEQ ID NO: 279372 - DNA, 25 bp, Homo sapien
caacatccaggatcttcattgagtt

SEQ ID NO: 279373 - DNA, 25 bp, Homo sapien
atcttcattgagtttagctgctata

SEQ ID NO: 279374 - DNA, 25 bp, Homo sapien
agctgccctgtgttccatgtttctg

SEQ ID NO: 279375 - DNA, 25 bp, Homo sapien
agctattagaacactggaagactgc

SEQ ID NO: 279376 - DNA, 25 bp, Homo sapien
ggaagactgcaagccacatacaaat

SEQ ID NO: 279377 - DNA, 25 bp, Homo sapien
aatatgtaaaggacttggaatgtta

SEQ ID NO: 279378 - DNA, 25 bp, Homo sapien
aataaccattcatcattttgcttta

SEQ ID NO: 279379 - DNA, 25 bp, Homo sapien
taaccattcatcattttgctttata

SEQ ID NO: 279380 - DNA, 25 bp, Homo sapien
aaccattcatcattttgctttatat

SEQ ID NO: 279381 - DNA, 25 bp, Homo sapien
ccattcatcattttgctttatatta

SEQ ID NO: 279382 - DNA, 25 bp, Homo sapien
ttacatctaatatttcctgaaacat

SEQ ID NO: 279383 - DNA, 25 bp, Homo sapien
ttttgtaatacccacatggaaagtg

SEQ ID NO: 279384 - DNA, 25 bp, Homo sapien
gtaatacccacatggaaagtggaga

SEQ ID NO: 279385 - DNA, 25 bp, Homo sapien
acattgccaaggagaataatggtta

SEQ ID NO: 279386 - DNA, 25 bp, Homo sapien
taatggttaaacaaatctgttcaaa

SEQ ID NO: 279387 - DNA, 25 bp, Homo sapien
aaacaaatctgttcaaatacatatt

SEQ ID NO: 279388 - DNA, 25 bp, Homo sapien
gcaaatgtggctttctgtctgctgc

SEQ ID NO: 279389 - DNA, 25 bp, Homo sapien
tctgctgcctggtgcttttatagta

SEQ ID NO: 279390 - DNA, 25 bp, Homo sapien
ggtgcttttatagtacttcatctgc

SEQ ID NO: 279391 - DNA, 25 bp, Homo sapien
gtacttcatctgctttttattgttg

SEQ ID NO: 279392 - DNA, 25 bp, Homo sapien
tggcatttgtttggctgtcattgtc

SEQ ID NO: 279393 - DNA, 25 bp, Homo sapien
ggctgtcattgtcgagtatatattt

SEQ ID NO: 279394 - DNA, 25 bp, Homo sapien
gaagtcaaggcatgtatactagata

SEQ ID NO: 279395 - DNA, 25 bp, Homo sapien
ttctctttcaggcacctggacgtat

SEQ ID NO: 279396 - DNA, 25 bp, Homo sapien
caggcacctggacgtatttagtatt

SEQ ID NO: 279397 - DNA, 25 bp, Homo sapien
acgtatttagtattctgccctgtgc

SEQ ID NO: 279398 - DNA, 25 bp, Homo sapien
tctagcaaatgtggctttctgtctg

SEQ ID NO: 279399 - DNA, 25 bp, Homo sapien
tgttgacagcatagccgaccttttg

SEQ ID NO: 279400 - DNA, 25 bp, Homo sapien
atcgggaagcccagccgcttcattt

SEQ ID NO: 279401 - DNA, 25 bp, Homo sapien
agccgcttcattttcgactgcgtgt

SEQ ID NO: 279402 - DNA, 25 bp, Homo sapien
gactgcgtgtcccaggaatacggca

SEQ ID NO: 279403 - DNA, 25 bp, Homo sapien
aggaatacggcatcaaccccgagcg

SEQ ID NO: 279404 - DNA, 25 bp, Homo sapien
caccgtcatggtgggagaccgcctg

SEQ ID NO: 279405 - DNA, 25 bp, Homo sapien
tgggagaccgcctggacacagacat

SEQ ID NO: 279406 - DNA, 25 bp, Homo sapien
tggacacagacatcctcctaggcgc

SEQ ID NO: 279407 - DNA, 25 bp, Homo sapien
atcaggaaagtgactgcgtgtctaa

SEQ ID NO: 279408 - DNA, 25 bp, Homo sapien
gaagaaaatggtccctgacttctat

SEQ ID NO: 279409 - DNA, 25 bp, Homo sapien
ggtccctgacttctatgttgacagc

SEQ ID NO: 279410 - DNA, 25 bp, Homo sapien
gtagaggaaattcctcaactttctc

SEQ ID NO: 279411 - DNA, 25 bp, Homo sapien
tcctcaactttctcaacgagtcatg

SEQ ID NO: 279412 - DNA, 25 bp, Homo sapien
ggcctccataaagcaccgattaaga

SEQ ID NO: 279413 - DNA, 25 bp, Homo sapien
tcctaaggcaggttttgtttgaatg

SEQ ID NO: 279414 - DNA, 25 bp, Homo sapien
caggttttgtttgaatgaggtgtct

SEQ ID NO: 279415 - DNA, 25 bp, Homo sapien
gaggtgtcttgattagataactaca

SEQ ID NO: 279416 - DNA, 25 bp, Homo sapien
tagataactacatgccactgaagga

SEQ ID NO: 279417 - DNA, 25 bp, Homo sapien
gccactgaaggagaacagtactttt

SEQ ID NO: 279418 - DNA, 25 bp, Homo sapien
ggagctatttttgtttcgcagtaga

SEQ ID NO: 279419 - DNA, 25 bp, Homo sapien
tttcgcagtagagttgaaaccagct

SEQ ID NO: 279420 - DNA, 25 bp, Homo sapien
gaaaccagctgattaatccaatgaa

SEQ ID NO: 279421 - DNA, 25 bp, Homo sapien
tgaactttttgcaccatgtacccat

SEQ ID NO: 279422 - DNA, 25 bp, Homo sapien
gtacccatggcttacactacttaga

SEQ ID NO: 279423 - DNA, 25 bp, Homo sapien
agagaacaccagcactctttgacaa

SEQ ID NO: 279424 - DNA, 25 bp, Homo sapien
tgagtgaccctttttaaacaatgct

SEQ ID NO: 279425 - DNA, 25 bp, Homo sapien
aaacaatgctgagcaggccctgagc

SEQ ID NO: 279426 - DNA, 25 bp, Homo sapien
ggccctgagctataatcaacggtga

SEQ ID NO: 279427 - DNA, 25 bp, Homo sapien
atcaacggtgagctttaatgtctat

SEQ ID NO: 279428 - DNA, 25 bp, Homo sapien
gacagttaggttttgctctcttttg

SEQ ID NO: 279429 - DNA, 25 bp, Homo sapien
ggttacgtagaccagcagtgtttaa

SEQ ID NO: 279430 - DNA, 25 bp, Homo sapien
gtgagtctgttatctgtcctatcgc

SEQ ID NO: 279431 - DNA, 25 bp, Homo sapien
tatctgtcctatcgcgttttttaaa

SEQ ID NO: 279432 - DNA, 25 bp, Homo sapien
ataatgaggttcttttgatgctgta

SEQ ID NO: 279433 - DNA, 25 bp, Homo sapien
gactaggaaggactctgaatttcaa

SEQ ID NO: 279434 - DNA, 25 bp, Homo sapien
agaggtgatttctcgcatgagcatc

SEQ ID NO: 279435 - DNA, 25 bp, Homo sapien
tttctcgcatgagcatctcttccat

SEQ ID NO: 279436 - DNA, 25 bp, Homo sapien
tccctccacaagctacagtgatgca

SEQ ID NO: 279437 - DNA, 25 bp, Homo sapien
gtgatgcatgtagcagacacggcac

SEQ ID NO: 279438 - DNA, 25 bp, Homo sapien
ggtccaagccaataaagctcaacaa

SEQ ID NO: 279439 - DNA, 25 bp, Homo sapien
aaagatggagcttatggcccttacc

SEQ ID NO: 279440 - DNA, 25 bp, Homo sapien
gagcttatggcccttaccctttgga

SEQ ID NO: 279441 - DNA, 25 bp, Homo sapien
ttaccctttggaaatatccccagat

SEQ ID NO: 279442 - DNA, 25 bp, Homo sapien
atccccagattggtttagattgaac

SEQ ID NO: 279443 - DNA, 25 bp, Homo sapien
gacagaaagcgctttggatgcctga

SEQ ID NO: 279444 - DNA, 25 bp, Homo sapien
gagaaacaacagcttgtccgggcta

SEQ ID NO: 279445 - DNA, 25 bp, Homo sapien
cttgtccgggctactgatgcgaaga

SEQ ID NO: 279446 - DNA, 25 bp, Homo sapien
gaagagaggccatggtttccttttt

SEQ ID NO: 279447 - DNA, 25 bp, Homo sapien
tcaggcgctaccacgagctacacat

SEQ ID NO: 279448 - DNA, 25 bp, Homo sapien
tgaatggcagccttgacgtcacaac

SEQ ID NO: 279449 - DNA, 25 bp, Homo sapien
gacgtcacaacagctaggaaccact

SEQ ID NO: 279450 - DNA, 25 bp, Homo sapien
ggcagggccattttcatccagttct

SEQ ID NO: 279451 - DNA, 25 bp, Homo sapien
tacacatccgtccattcgtttaatc

SEQ ID NO: 279452 - DNA, 25 bp, Homo sapien
cgtccattcgtttaatcttcacagc

SEQ ID NO: 279453 - DNA, 25 bp, Homo sapien
gcacagctctgccagacagaaagcg

SEQ ID NO: 279454 - DNA, 25 bp, Homo sapien
gactcctgttcatggcaagctaata

SEQ ID NO: 279455 - DNA, 25 bp, Homo sapien
caagctaatagtctgtctggtggaa

SEQ ID NO: 279456 - DNA, 25 bp, Homo sapien
gaacgtgagagaataactagcgagt

SEQ ID NO: 279457 - DNA, 25 bp, Homo sapien
gagtggatttactttaacagggtag

SEQ ID NO: 279458 - DNA, 25 bp, Homo sapien
ggctgtgtttgtctaacaaggattt

SEQ ID NO: 279459 - DNA, 25 bp, Homo sapien
ttaacagggtagtcagggaaggcct

SEQ ID NO: 279460 - DNA, 25 bp, Homo sapien
cctcttgtggtggtgacatactgat

SEQ ID NO: 279461 - DNA, 25 bp, Homo sapien
caaggatttgggtaactactggata

SEQ ID NO: 279462 - DNA, 25 bp, Homo sapien
actactggatacaagccactgtgct

SEQ ID NO: 279463 - DNA, 25 bp, Homo sapien
acaagccactgtgcttagtatggat

SEQ ID NO: 279464 - DNA, 25 bp, Homo sapien
gcttagtatggatagactgccatca

SEQ ID NO: 279465 - DNA, 25 bp, Homo sapien
gggttcctcctatccaggcaaggac

SEQ ID NO: 279466 - DNA, 25 bp, Homo sapien
caaggacgggcccatgagcaacgta

SEQ ID NO: 279467 - DNA, 25 bp, Homo sapien
gacacacaggttactaagggttact

SEQ ID NO: 279468 - DNA, 25 bp, Homo sapien
agcgctctgtgctcataaagacacg

SEQ ID NO: 279469 - DNA, 25 bp, Homo sapien
taaagacacgcgcaattccactatt

SEQ ID NO: 279470 - DNA, 25 bp, Homo sapien
actattcacctactaactcggcaaa

SEQ ID NO: 279471 - DNA, 25 bp, Homo sapien
ctaactcggcaaagcacacaaattt

SEQ ID NO: 279472 - DNA, 25 bp, Homo sapien
gctgcggtgaaacaggaatgctcct

SEQ ID NO: 279473 - DNA, 25 bp, Homo sapien
aaagcaactagaccaccaggctgtg

SEQ ID NO: 279474 - DNA, 25 bp, Homo sapien
accaggctgtggcaagaccaatcaa

SEQ ID NO: 279475 - DNA, 25 bp, Homo sapien
ggcaagaccaatcaagtcccgggtt

SEQ ID NO: 279476 - DNA, 25 bp, Homo sapien
ggtttgttgtgcagcatgtgtcact

SEQ ID NO: 279477 - DNA, 25 bp, Homo sapien
gtgcagcatgtgtcacttaaattta

SEQ ID NO: 279478 - DNA, 25 bp, Homo sapien
aataacttctatgtctaagaccagg

SEQ ID NO: 279479 - DNA, 25 bp, Homo sapien
ttttaacttgcaaaccctagtgtgc

SEQ ID NO: 279480 - DNA, 25 bp, Homo sapien
ctagtgtgcatccatgacagcctta

SEQ ID NO: 279481 - DNA, 25 bp, Homo sapien
gacagccttagtttgttaccttgtg

SEQ ID NO: 279482 - DNA, 25 bp, Homo sapien
tagtttgttaccttgtggacagcag

SEQ ID NO: 279483 - DNA, 25 bp, Homo sapien
acagcaggtccatgttacaaaaggt

SEQ ID NO: 279484 - DNA, 25 bp, Homo sapien
gatttgatctgctagcgtttggcac

SEQ ID NO: 279485 - DNA, 25 bp, Homo sapien
gctagcgtttggcacttttaaattt

SEQ ID NO: 279486 - DNA, 25 bp, Homo sapien
aattttgactgcatgtagttaactg

SEQ ID NO: 279487 - DNA, 25 bp, Homo sapien
tagtagagcgagacatctcagtgct

SEQ ID NO: 279488 - DNA, 25 bp, Homo sapien
gatcaaggaaccagaaagcttctag

SEQ ID NO: 279489 - DNA, 25 bp, Homo sapien
gcatcccactaaaccactttttata

SEQ ID NO: 279490 - DNA, 25 bp, Homo sapien
actttttatattccattcgaacctg

SEQ ID NO: 279491 - DNA, 25 bp, Homo sapien
gagaggtccgtgttacatccagagc

SEQ ID NO: 279492 - DNA, 25 bp, Homo sapien
gtgttacatccagagcttggtttgg

SEQ ID NO: 279493 - DNA, 25 bp, Homo sapien
gcttggtttgggagaaaggatccta

SEQ ID NO: 279494 - DNA, 25 bp, Homo sapien
gataaagacaccaagccctactctc

SEQ ID NO: 279495 - DNA, 25 bp, Homo sapien
acaccaagccctactctctagtttt

SEQ ID NO: 279496 - DNA, 25 bp, Homo sapien
aaagcttctagaggcatgagatgtc

SEQ ID NO: 279497 - DNA, 25 bp, Homo sapien
aggcatgagatgtcggattccaata

SEQ ID NO: 279498 - DNA, 25 bp, Homo sapien
agattgtcagttcatgacttgcaaa

SEQ ID NO: 279499 - DNA, 25 bp, Homo sapien
gttcatgacttgcaaactactagat

SEQ ID NO: 279500 - DNA, 25 bp, Homo sapien
gacttgcaaactactagatggatta

SEQ ID NO: 279501 - DNA, 25 bp, Homo sapien
tttttaaatgatccccagtactggt

SEQ ID NO: 279502 - DNA, 25 bp, Homo sapien
aatgatccccagtactggtcagagc

SEQ ID NO: 279503 - DNA, 25 bp, Homo sapien
tccccagtactggtcagagcatgag

SEQ ID NO: 279504 - DNA, 25 bp, Homo sapien
agtactggtcagagcatgaggcata

SEQ ID NO: 279505 - DNA, 25 bp, Homo sapien
ggtcagagcatgaggcatagtaaat

SEQ ID NO: 279506 - DNA, 25 bp, Homo sapien
atatttttacacactgcttgtggga

SEQ ID NO: 279507 - DNA, 25 bp, Homo sapien
cactgcttgtgggattagaaattgg

SEQ ID NO: 279508 - DNA, 25 bp, Homo sapien
gcacaacttgtgcagagggagtaat

SEQ ID NO: 279509 - DNA, 25 bp, Homo sapien
ggcaagaggctgaggggcttccgag

SEQ ID NO: 279510 - DNA, 25 bp, Homo sapien
ggctgaggggcttccgagcccctga

SEQ ID NO: 279511 - DNA, 25 bp, Homo sapien
tctcctcccgcaggcctttactccg

SEQ ID NO: 279512 - DNA, 25 bp, Homo sapien
ttcacacagaggcacaacctggacc

SEQ ID NO: 279513 - DNA, 25 bp, Homo sapien
tcacacagaggcacaacctggaccc

SEQ ID NO: 279514 - DNA, 25 bp, Homo sapien
cacacagaggcacaacctggaccca

SEQ ID NO: 279515 - DNA, 25 bp, Homo sapien
acagaggcacaacctggacccaggc

SEQ ID NO: 279516 - DNA, 25 bp, Homo sapien
cagaggcacaacctggacccaggca

SEQ ID NO: 279517 - DNA, 25 bp, Homo sapien
agaggcacaacctggacccaggcag

SEQ ID NO: 279518 - DNA, 25 bp, Homo sapien
acaacctggacccaggcagcctctt

SEQ ID NO: 279519 - DNA, 25 bp, Homo sapien
ctccctccccaatctcttccatttt

SEQ ID NO: 279520 - DNA, 25 bp, Homo sapien
caggtgcatcagtcacagttgctca

SEQ ID NO: 279521 - DNA, 25 bp, Homo sapien
atcagtcacagttgctcagaaccct

SEQ ID NO: 279522 - DNA, 25 bp, Homo sapien
gctcagaaccctgctcagtgataaa

SEQ ID NO: 279523 - DNA, 25 bp, Homo sapien
tactaaagctgggtcaatcagggtc

SEQ ID NO: 279524 - DNA, 25 bp, Homo sapien
catgaagcctgagacaagatctctc

SEQ ID NO: 279525 - DNA, 25 bp, Homo sapien
ggtccccaaaggcaatgctgtacac

SEQ ID NO: 279526 - DNA, 25 bp, Homo sapien
aatgctgtacacttggagctgcctg

SEQ ID NO: 279527 - DNA, 25 bp, Homo sapien
tgcaactactcccatttaccaatta

SEQ ID NO: 279528 - DNA, 25 bp, Homo sapien
actactcccatttaccaattatctg

SEQ ID NO: 279529 - DNA, 25 bp, Homo sapien
ctggaagaaccagtctacaatagaa

SEQ ID NO: 279530 - DNA, 25 bp, Homo sapien
agaagacaacgaggccaacacacaa

SEQ ID NO: 279531 - DNA, 25 bp, Homo sapien
tttggcttcaaaagctaacttcatc

SEQ ID NO: 279532 - DNA, 25 bp, Homo sapien
ttttatgttactcatgctctaataa

SEQ ID NO: 279533 - DNA, 25 bp, Homo sapien
tatgttactcatgctctaataaagc

SEQ ID NO: 279534 - DNA, 25 bp, Homo sapien
aataaagcaagcacataaatctgct

SEQ ID NO: 279535 - DNA, 25 bp, Homo sapien
aaatctgcttttcctactgatagtt

SEQ ID NO: 279536 - DNA, 25 bp, Homo sapien
atctgcttttcctactgatagtttt

SEQ ID NO: 279537 - DNA, 25 bp, Homo sapien
ctgcttttcctactgatagttttag

SEQ ID NO: 279538 - DNA, 25 bp, Homo sapien
tttcctactgatagttttagttcta

SEQ ID NO: 279539 - DNA, 25 bp, Homo sapien
agttttagttctatcttgtaagatt

SEQ ID NO: 279540 - DNA, 25 bp, Homo sapien
gatatgtaatcttctaatcattatt

SEQ ID NO: 279541 - DNA, 25 bp, Homo sapien
tcttttctttagtccaatagttatt

SEQ ID NO: 279542 - DNA, 25 bp, Homo sapien
aagcttcgtatccacctgctggctg

SEQ ID NO: 279543 - DNA, 25 bp, Homo sapien
cactcatcacctttttggtctatgc

SEQ ID NO: 279544 - DNA, 25 bp, Homo sapien
gtctatgcaggaggaagtctaacag

SEQ ID NO: 279545 - DNA, 25 bp, Homo sapien
tttaatccagctttggcactttcgc

SEQ ID NO: 279546 - DNA, 25 bp, Homo sapien
ggcactttcgctacatttcatgtgt

SEQ ID NO: 279547 - DNA, 25 bp, Homo sapien
tgatgaagcattccctcagtttttt

SEQ ID NO: 279548 - DNA, 25 bp, Homo sapien
ttatagtatactggctggctccttc

SEQ ID NO: 279549 - DNA, 25 bp, Homo sapien
ctggctccttctttaggtatattgt

SEQ ID NO: 279550 - DNA, 25 bp, Homo sapien
atgattttgatgttcagctttttcc

SEQ ID NO: 279551 - DNA, 25 bp, Homo sapien
tcagctttttccttccatggctgca

SEQ ID NO: 279552 - DNA, 25 bp, Homo sapien
aggaagtccgaaccaagcttcgtat

SEQ ID NO: 279553 - DNA, 25 bp, Homo sapien
ctttctggaatgtacctgttctgct

SEQ ID NO: 279554 - DNA, 25 bp, Homo sapien
gaatgtacctgttctgctacaacca

SEQ ID NO: 279555 - DNA, 25 bp, Homo sapien
tacctgttctgctacaaccatggat

SEQ ID NO: 279556 - DNA, 25 bp, Homo sapien
gttctgctacaaccatggatatcct

SEQ ID NO: 279557 - DNA, 25 bp, Homo sapien
ccatggatatcctgacctttctgtg

SEQ ID NO: 279558 - DNA, 25 bp, Homo sapien
ttctgtgcctttcagggacaagggt

SEQ ID NO: 279559 - DNA, 25 bp, Homo sapien
agaggagtttcagactccctctaaa

SEQ ID NO: 279560 - DNA, 25 bp, Homo sapien
ttgctttctcctgctaccaaaacaa

SEQ ID NO: 279561 - DNA, 25 bp, Homo sapien
ctttctcctgctaccaaaacaaaca

SEQ ID NO: 279562 - DNA, 25 bp, Homo sapien
gggtcaatgaaatatacagctcctt

SEQ ID NO: 279563 - DNA, 25 bp, Homo sapien
gaaatatacagctcctttctggaat

SEQ ID NO: 279564 - DNA, 25 bp, Homo sapien
atgcctatgctgctggcctaaaacc

SEQ ID NO: 279565 - DNA, 25 bp, Homo sapien
ggcctaaaaccacactcagaaacga

SEQ ID NO: 279566 - DNA, 25 bp, Homo sapien
gaaacgaggacctagaagatcccta

SEQ ID NO: 279567 - DNA, 25 bp, Homo sapien
gtgattgtatttctgattctccctc

SEQ ID NO: 279568 - DNA, 25 bp, Homo sapien
tccctctcttcgaattatctgactt

SEQ ID NO: 279569 - DNA, 25 bp, Homo sapien
gtgcacatagtaatcatatcaccgc

SEQ ID NO: 279570 - DNA, 25 bp, Homo sapien
atcatatcaccgctgcataacaaca

SEQ ID NO: 279571 - DNA, 25 bp, Homo sapien
gcataacaacacagtgcatcttttt

SEQ ID NO: 279572 - DNA, 25 bp, Homo sapien
aaaaacgatgcatcaagcttgtttg

SEQ ID NO: 279573 - DNA, 25 bp, Homo sapien
aagcttgtttgtcaaataccacagt

SEQ ID NO: 279574 - DNA, 25 bp, Homo sapien
tattcattgttatcttgccaatgga

SEQ ID NO: 279575 - DNA, 25 bp, Homo sapien
accaaaatgtggtacaaggacacaa

SEQ ID NO: 279576 - DNA, 25 bp, Homo sapien
gtggtacaaggacacaatgtgagca

SEQ ID NO: 279577 - DNA, 25 bp, Homo sapien
gtacaaggacacaatgtgagcacat

SEQ ID NO: 279578 - DNA, 25 bp, Homo sapien
ggacacaatgtgagcacatgctttt

SEQ ID NO: 279579 - DNA, 25 bp, Homo sapien
ccctcaaaattatgaagtaacatca

SEQ ID NO: 279580 - DNA, 25 bp, Homo sapien
caatgtgagcacatgcttttgggaa

SEQ ID NO: 279581 - DNA, 25 bp, Homo sapien
aatgtgagcacatgcttttgggaaa

SEQ ID NO: 279582 - DNA, 25 bp, Homo sapien
gctgaatgtagagttgccacaaacc

SEQ ID NO: 279583 - DNA, 25 bp, Homo sapien
tgaatgtagagttgccacaaacctt

SEQ ID NO: 279584 - DNA, 25 bp, Homo sapien
aaaatgcaatatctagctgggtgca

SEQ ID NO: 279585 - DNA, 25 bp, Homo sapien
aaatcaggaggatgactggagccta

SEQ ID NO: 279586 - DNA, 25 bp, Homo sapien
cttttcaggagtgtttgcatttttc

SEQ ID NO: 279587 - DNA, 25 bp, Homo sapien
atctaataactctttatatctgaag

SEQ ID NO: 279588 - DNA, 25 bp, Homo sapien
gaaggatatgaacgctttgtgatac

SEQ ID NO: 279589 - DNA, 25 bp, Homo sapien
aacgctttgtgatacaggttacaga

SEQ ID NO: 279590 - DNA, 25 bp, Homo sapien
ttttttctccgcttgctgtgagcct

SEQ ID NO: 279591 - DNA, 25 bp, Homo sapien
ttgctgtgagccttttgggtttgtt

SEQ ID NO: 279592 - DNA, 25 bp, Homo sapien
ttgggtttgtttcctagctccaaat

SEQ ID NO: 279593 - DNA, 25 bp, Homo sapien
gtttcctagctccaaatcttaactt

SEQ ID NO: 279594 - DNA, 25 bp, Homo sapien
agctccaaatcttaacttggtgtca

SEQ ID NO: 279595 - DNA, 25 bp, Homo sapien
taacttggtgtcaagtttcctggct

SEQ ID NO: 279596 - DNA, 25 bp, Homo sapien
atatgttgattagccatttacatgt

SEQ ID NO: 279597 - DNA, 25 bp, Homo sapien
gctggatctagtgtacggaaacctg

SEQ ID NO: 279598 - DNA, 25 bp, Homo sapien
tctagtgtacggaaacctgattctg

SEQ ID NO: 279599 - DNA, 25 bp, Homo sapien
tacggaaacctgattctgggttcct

SEQ ID NO: 279600 - DNA, 25 bp, Homo sapien
gaaacctgattctgggttcctttgg

SEQ ID NO: 279601 - DNA, 25 bp, Homo sapien
cctgattctgggttcctttgggaag

SEQ ID NO: 279602 - DNA, 25 bp, Homo sapien
ctttgggaaggagcattacgggcct

SEQ ID NO: 279603 - DNA, 25 bp, Homo sapien
ggaaggagcattacgggcctgctcc

SEQ ID NO: 279604 - DNA, 25 bp, Homo sapien
aggtggaaggactggcgcatctcat

SEQ ID NO: 279605 - DNA, 25 bp, Homo sapien
aaggactggcgcatctcatgagagc

SEQ ID NO: 279606 - DNA, 25 bp, Homo sapien
gactggcgcatctcatgagagctaa

SEQ ID NO: 279607 - DNA, 25 bp, Homo sapien
tggcgcatctcatgagagctaagca

SEQ ID NO: 279608 - DNA, 25 bp, Homo sapien
ggcaagaggctgaggggcttccgag

SEQ ID NO: 279609 - DNA, 25 bp, Homo sapien
tctcctcccgcaggcctttactccg

SEQ ID NO: 279610 - DNA, 25 bp, Homo sapien
ggtgtctcttcacacagaggcacaa

SEQ ID NO: 279611 - DNA, 25 bp, Homo sapien
gtgtctcttcacacagaggcacaac

SEQ ID NO: 279612 - DNA, 25 bp, Homo sapien
ttcacacagaggcacaacctggacc

SEQ ID NO: 279613 - DNA, 25 bp, Homo sapien
acagaggcacaacctggacccaggc

SEQ ID NO: 279614 - DNA, 25 bp, Homo sapien
cagaggcacaacctggacccaggca

SEQ ID NO: 279615 - DNA, 25 bp, Homo sapien
agaggcacaacctggacccaggcag

SEQ ID NO: 279616 - DNA, 25 bp, Homo sapien
acaacctggacccaggcagcctctt

SEQ ID NO: 279617 - DNA, 25 bp, Homo sapien
caatctcttccatttttctacagat

SEQ ID NO: 279618 - DNA, 25 bp, Homo sapien
tcttccatttttctacagatttttt

SEQ ID NO: 279619 - DNA, 25 bp, Homo sapien
aggaagggcctgagtccgagcagaa

SEQ ID NO: 279620 - DNA, 25 bp, Homo sapien
ggcctgagtccgagcagaagaagaa

SEQ ID NO: 279621 - DNA, 25 bp, Homo sapien
aagaagggctcccatcacatcaacc

SEQ ID NO: 279622 - DNA, 25 bp, Homo sapien
agggctcccatcacatcaaccggtg

SEQ ID NO: 279623 - DNA, 25 bp, Homo sapien
ccatcacatcaaccggtggcgcatt

SEQ ID NO: 279624 - DNA, 25 bp, Homo sapien
cacatcaaccggtggcgcattgcca

SEQ ID NO: 279625 - DNA, 25 bp, Homo sapien
accggtggcgcattgccacgaagca

SEQ ID NO: 279626 - DNA, 25 bp, Homo sapien
gggaggacatcgatgtcacctccaa

SEQ ID NO: 279627 - DNA, 25 bp, Homo sapien
aggacatcgatgtcacctccaatga

SEQ ID NO: 279628 - DNA, 25 bp, Homo sapien
atcgatgtcacctccaatgactagg

SEQ ID NO: 279629 - DNA, 25 bp, Homo sapien
gatgtcacctccaatgactagggtg

SEQ ID NO: 279630 - DNA, 25 bp, Homo sapien
tggacttgccagatgcccaagataa

SEQ ID NO: 279631 - DNA, 25 bp, Homo sapien
gatgcccaagataagttccatgaat

SEQ ID NO: 279632 - DNA, 25 bp, Homo sapien
tccatgaattgatgagccagctcca

SEQ ID NO: 279633 - DNA, 25 bp, Homo sapien
attccagagaggactgtagagttcc

SEQ ID NO: 279634 - DNA, 25 bp, Homo sapien
gtagagttccaacatatcatcccca

SEQ ID NO: 279635 - DNA, 25 bp, Homo sapien
tatcatccccatatctgcagttact

SEQ ID NO: 279636 - DNA, 25 bp, Homo sapien
agtcactggatgaacaggccaacca

SEQ ID NO: 279637 - DNA, 25 bp, Homo sapien
aacagttgcttaatttgtggatttc

SEQ ID NO: 279638 - DNA, 25 bp, Homo sapien
tgtggatttctgatacaatgtcttc

SEQ ID NO: 279639 - DNA, 25 bp, Homo sapien
atacaatgtcttctactgagccacc

SEQ ID NO: 279640 - DNA, 25 bp, Homo sapien
tactgagccaccatcaaagcatgct

SEQ ID NO: 279641 - DNA, 25 bp, Homo sapien
aatcaatccccatactatatgcctc

SEQ ID NO: 279642 - DNA, 25 bp, Homo sapien
tccccatactatatgcctctaatac

SEQ ID NO: 279643 - DNA, 25 bp, Homo sapien
agatagtcacaatgctattctatta

SEQ ID NO: 279644 - DNA, 25 bp, Homo sapien
ttgagggtagatttctgcagcaaat

SEQ ID NO: 279645 - DNA, 25 bp, Homo sapien
tgcagcaaattgaatataccagaat

SEQ ID NO: 279646 - DNA, 25 bp, Homo sapien
tataccagaatagttgttttccagt

SEQ ID NO: 279647 - DNA, 25 bp, Homo sapien
agttgttttccagttctaccacttg

SEQ ID NO: 279648 - DNA, 25 bp, Homo sapien
tttccagttctaccacttggttgga

SEQ ID NO: 279649 - DNA, 25 bp, Homo sapien
tctaccacttggttggaacagtaag

SEQ ID NO: 279650 - DNA, 25 bp, Homo sapien
agtaagacagtgatggcctccaggt

SEQ ID NO: 279651 - DNA, 25 bp, Homo sapien
gaaattaaggccagaaattcgagac

SEQ ID NO: 279652 - DNA, 25 bp, Homo sapien
cagagctgagctcaaaatatcctaa

SEQ ID NO: 279653 - DNA, 25 bp, Homo sapien
gagctgagctcaaaatatcctaact

SEQ ID NO: 279654 - DNA, 25 bp, Homo sapien
gagctcaaaatatcctaactctggc

SEQ ID NO: 279655 - DNA, 25 bp, Homo sapien
aaaatatcctaactctggccaggca

SEQ ID NO: 279656 - DNA, 25 bp, Homo sapien
aatatcctaactctggccaggcatg

SEQ ID NO: 279657 - DNA, 25 bp, Homo sapien
ggtctcctggaggttcacttaaggt

SEQ ID NO: 279658 - DNA, 25 bp, Homo sapien
ctcctggaggttcacttaaggtcag

SEQ ID NO: 279659 - DNA, 25 bp, Homo sapien
aggctgagatgggagtatcagaatc

SEQ ID NO: 279660 - DNA, 25 bp, Homo sapien
tgggagtatcagaatcatcagagat

SEQ ID NO: 279661 - DNA, 25 bp, Homo sapien
atcatcagagatgagcccagaagct

SEQ ID NO: 279662 - DNA, 25 bp, Homo sapien
catcagagatgagcccagaagctgg

SEQ ID NO: 279663 - DNA, 25 bp, Homo sapien
gttttctctatactgaggatttcct

SEQ ID NO: 279664 - DNA, 25 bp, Homo sapien
ctgaggatttcctcagctgggagaa

SEQ ID NO: 279665 - DNA, 25 bp, Homo sapien
atttcctcagctgggagaaagcaca

SEQ ID NO: 279666 - DNA, 25 bp, Homo sapien
agaaagcacaaagcgttttccacct

SEQ ID NO: 279667 - DNA, 25 bp, Homo sapien
gtcaccttgttctatggcacgggct

SEQ ID NO: 279668 - DNA, 25 bp, Homo sapien
tgcagccacaccatcttctaggaca

SEQ ID NO: 279669 - DNA, 25 bp, Homo sapien
gccacaccatcttctaggacaagtc

SEQ ID NO: 279670 - DNA, 25 bp, Homo sapien
aggacaagtctggtggcctcagtga

SEQ ID NO: 279671 - DNA, 25 bp, Homo sapien
aacacggacatgaagagggccctgg

SEQ ID NO: 279672 - DNA, 25 bp, Homo sapien
ggagactcctcagtagggcaacatt

SEQ ID NO: 279673 - DNA, 25 bp, Homo sapien
gactcctcagtagggcaacattttt

SEQ ID NO: 279674 - DNA, 25 bp, Homo sapien
caggaactctgtctaggttgttcat

SEQ ID NO: 279675 - DNA, 25 bp, Homo sapien
actctgtctaggttgttcatctggc

SEQ ID NO: 279676 - DNA, 25 bp, Homo sapien
tctaggttgttcatctggcagccag

SEQ ID NO: 279677 - DNA, 25 bp, Homo sapien
aggttgttcatctggcagccagcaa

SEQ ID NO: 279678 - DNA, 25 bp, Homo sapien
gcatatctgttttagctactgcttg

SEQ ID NO: 279679 - DNA, 25 bp, Homo sapien
tatctgttttagctactgcttgcct

SEQ ID NO: 279680 - DNA, 25 bp, Homo sapien
tactgcttgcctgttatcatcctgg

SEQ ID NO: 279681 - DNA, 25 bp, Homo sapien
gcttgcctgttatcatcctgggatg

SEQ ID NO: 279682 - DNA, 25 bp, Homo sapien
atcatcctgggatgctgcttgcttc

SEQ ID NO: 279683 - DNA, 25 bp, Homo sapien
gatgctgcttgcttctccgtgatct

SEQ ID NO: 279684 - DNA, 25 bp, Homo sapien
tccgtgatctcttcttgttcttaaa

SEQ ID NO: 279685 - DNA, 25 bp, Homo sapien
gaatgtttgaatcatatactcttct

SEQ ID NO: 279686 - DNA, 25 bp, Homo sapien
gtttgaatcatatactcttctttca

SEQ ID NO: 279687 - DNA, 25 bp, Homo sapien
tgaatcatatactcttctttcaccc

SEQ ID NO: 279688 - DNA, 25 bp, Homo sapien
aaagaagaaactctatctaatgtta

SEQ ID NO: 279689 - DNA, 25 bp, Homo sapien
tttttgcccctgacggaggtgatgg

SEQ ID NO: 279690 - DNA, 25 bp, Homo sapien
gcccctgacggaggtgatggtggaa

SEQ ID NO: 279691 - DNA, 25 bp, Homo sapien
tgtgtaacaacgactcccaaagaaa

SEQ ID NO: 279692 - DNA, 25 bp, Homo sapien
tgtaacaacgactcccaaagaaaat

SEQ ID NO: 279693 - DNA, 25 bp, Homo sapien
gtaacaacgactcccaaagaaaatg

SEQ ID NO: 279694 - DNA, 25 bp, Homo sapien
gaaaatgtacagatttacttcctag

SEQ ID NO: 279695 - DNA, 25 bp, Homo sapien
aaatgtacagatttacttcctagcc

SEQ ID NO: 279696 - DNA, 25 bp, Homo sapien
gaagacagacagtaccaacggaaat

SEQ ID NO: 279697 - DNA, 25 bp, Homo sapien
aagacagacagtaccaacggaaata

SEQ ID NO: 279698 - DNA, 25 bp, Homo sapien
agacagacagtaccaacggaaatac

SEQ ID NO: 279699 - DNA, 25 bp, Homo sapien
gacagacagtaccaacggaaatact

SEQ ID NO: 279700 - DNA, 25 bp, Homo sapien
cagacagtaccaacggaaatactgt

SEQ ID NO: 279701 - DNA, 25 bp, Homo sapien
cagtaccaacggaaatactgtagct

SEQ ID NO: 279702 - DNA, 25 bp, Homo sapien
acggaaatactgtagctcctcctgc

SEQ ID NO: 279703 - DNA, 25 bp, Homo sapien
tgccaggccatgttttccccctctt

SEQ ID NO: 279704 - DNA, 25 bp, Homo sapien
tccccctctttcaaaatctaacttg

SEQ ID NO: 279705 - DNA, 25 bp, Homo sapien
aaaatctaacttgagactcgcattt

SEQ ID NO: 279706 - DNA, 25 bp, Homo sapien
ggtcagtggccctgaagacagacag

SEQ ID NO: 279707 - DNA, 25 bp, Homo sapien
aactgtacaagatggcttatttgga

SEQ ID NO: 279708 - DNA, 25 bp, Homo sapien
aggaaatctcttcacgcctggcctt

SEQ ID NO: 279709 - DNA, 25 bp, Homo sapien
tggcctttgccttcaagttctcttc

SEQ ID NO: 279710 - DNA, 25 bp, Homo sapien
tttctttctcctggcatgggtcaac

SEQ ID NO: 279711 - DNA, 25 bp, Homo sapien
ttccccagaggcaatccactggtaa

SEQ ID NO: 279712 - DNA, 25 bp, Homo sapien
gcaatccactggtaacaattccttg

SEQ ID NO: 279713 - DNA, 25 bp, Homo sapien
cactggtaacaattccttgtatatt

SEQ ID NO: 279714 - DNA, 25 bp, Homo sapien
gcaaagatacgctagataaaaatac

SEQ ID NO: 279715 - DNA, 25 bp, Homo sapien
atgggtcaacaaccttcctgtgagc

SEQ ID NO: 279716 - DNA, 25 bp, Homo sapien
ttttcattatataatggccccttta

SEQ ID NO: 279717 - DNA, 25 bp, Homo sapien
tggcccctttatttacatatttact

SEQ ID NO: 279718 - DNA, 25 bp, Homo sapien
gactgagactgagccttgctaaggt

SEQ ID NO: 279719 - DNA, 25 bp, Homo sapien
gccttgctaaggtggctgcacagag

SEQ ID NO: 279720 - DNA, 25 bp, Homo sapien
ggtcagttgtgtgttgcgaagttac

SEQ ID NO: 279721 - DNA, 25 bp, Homo sapien
gtgtcatgagaaggtctggtctctt

SEQ ID NO: 279722 - DNA, 25 bp, Homo sapien
aggtctggtctcttggatcttagca

SEQ ID NO: 279723 - DNA, 25 bp, Homo sapien
ggatcttagcaaactcagaagtgtt

SEQ ID NO: 279724 - DNA, 25 bp, Homo sapien
agaagtgttttgtagcaaggctgct

SEQ ID NO: 279725 - DNA, 25 bp, Homo sapien
gcaaggctgcttggtataagtccaa

SEQ ID NO: 279726 - DNA, 25 bp, Homo sapien
aagtccaagaatggtggctacctgg

SEQ ID NO: 279727 - DNA, 25 bp, Homo sapien
gcgaagttacttgagaccagttcct

SEQ ID NO: 279728 - DNA, 25 bp, Homo sapien
acttgagaccagttcctttcctgag

SEQ ID NO: 279729 - DNA, 25 bp, Homo sapien
aatgactgagctgttgtgaaagggt

SEQ ID NO: 279730 - DNA, 25 bp, Homo sapien
actgagctgttgtgaaagggttagt

SEQ ID NO: 279731 - DNA, 25 bp, Homo sapien
ccagaactcttaactgtcaggccaa

SEQ ID NO: 279732 - DNA, 25 bp, Homo sapien
agaactcttaactgtcaggccaatg

SEQ ID NO: 279733 - DNA, 25 bp, Homo sapien
gaactcttaactgtcaggccaatgt

SEQ ID NO: 279734 - DNA, 25 bp, Homo sapien
actcttaactgtcaggccaatgtct

SEQ ID NO: 279735 - DNA, 25 bp, Homo sapien
tcttaactgtcaggccaatgtcttt

SEQ ID NO: 279736 - DNA, 25 bp, Homo sapien
acttcctcacactgatcccacataa

SEQ ID NO: 279737 - DNA, 25 bp, Homo sapien
tcccacataactctgggtatgatag

SEQ ID NO: 279738 - DNA, 25 bp, Homo sapien
acataactctgggtatgatagtgag

SEQ ID NO: 279739 - DNA, 25 bp, Homo sapien
ctctgggtatgatagtgagtgtcag

SEQ ID NO: 279740 - DNA, 25 bp, Homo sapien
tgggttggtttttgtcttcgacgct

SEQ ID NO: 279741 - DNA, 25 bp, Homo sapien
gttggtttttgtcttcgacgctcag

SEQ ID NO: 279742 - DNA, 25 bp, Homo sapien
gtttttgtcttcgacgctcagggtc

SEQ ID NO: 279743 - DNA, 25 bp, Homo sapien
ttttgtcttcgacgctcagggtctg

SEQ ID NO: 279744 - DNA, 25 bp, Homo sapien
tgtcttcgacgctcagggtctgggc

SEQ ID NO: 279745 - DNA, 25 bp, Homo sapien
acgctcagggtctgggcgcctcgca

SEQ ID NO: 279746 - DNA, 25 bp, Homo sapien
tgggcgcctcgcatttgcagtctgt

SEQ ID NO: 279747 - DNA, 25 bp, Homo sapien
gcctcgcatttgcagtctgttgtga

SEQ ID NO: 279748 - DNA, 25 bp, Homo sapien
ctcgcatttgcagtctgttgtgaca

SEQ ID NO: 279749 - DNA, 25 bp, Homo sapien
cgcatttgcagtctgttgtgacaga

SEQ ID NO: 279750 - DNA, 25 bp, Homo sapien
cggcgaggccccttcagtcttgttc

SEQ ID NO: 279751 - DNA, 25 bp, Homo sapien
gatccttggtgattgtagtcagtca

SEQ ID NO: 279752 - DNA, 25 bp, Homo sapien
ttgtagtcagtcaaagggtggcttt

SEQ ID NO: 279753 - DNA, 25 bp, Homo sapien
gtggctttgacatagcacctatctg

SEQ ID NO: 279754 - DNA, 25 bp, Homo sapien
gcacctatctgttagggcaaatact

SEQ ID NO: 279755 - DNA, 25 bp, Homo sapien
atactgccagggaaaaggtgacatt

SEQ ID NO: 279756 - DNA, 25 bp, Homo sapien
gaatcatctgggattggactcttga

SEQ ID NO: 279757 - DNA, 25 bp, Homo sapien
ttggactcttgatcaatagatgcga

SEQ ID NO: 279758 - DNA, 25 bp, Homo sapien
aatagatgcgaaatgtcaggtggac

SEQ ID NO: 279759 - DNA, 25 bp, Homo sapien
ggtggacatgagaactgttggtctt

SEQ ID NO: 279760 - DNA, 25 bp, Homo sapien
gagaactgttggtctttggtacata

SEQ ID NO: 279761 - DNA, 25 bp, Homo sapien
ggtctttggtacatatgtgttgcaa

SEQ ID NO: 279762 - DNA, 25 bp, Homo sapien
aaactgcttttgaaggagcctaaat

SEQ ID NO: 279763 - DNA, 25 bp, Homo sapien
ggagcctaaataattgacttagcag

SEQ ID NO: 279764 - DNA, 25 bp, Homo sapien
gacttagcagacaatgacatcacac

SEQ ID NO: 279765 - DNA, 25 bp, Homo sapien
gcagacaatgacatcacacatttta

SEQ ID NO: 279766 - DNA, 25 bp, Homo sapien
atgacatcacacattttaaataagt

SEQ ID NO: 279767 - DNA, 25 bp, Homo sapien
taatcaaatagaaaatgccagtaaa

SEQ ID NO: 279768 - DNA, 25 bp, Homo sapien
aacaatgactaaagggtctcgagag

SEQ ID NO: 279769 - DNA, 25 bp, Homo sapien
gtctcgagagacagtctgagctggt

SEQ ID NO: 279770 - DNA, 25 bp, Homo sapien
cgagagacagtctgagctggtagaa

SEQ ID NO: 279771 - DNA, 25 bp, Homo sapien
gaagaaagaaactgaccttgaagaa

SEQ ID NO: 279772 - DNA, 25 bp, Homo sapien
aaagaaactgaccttgaagaagatc

SEQ ID NO: 279773 - DNA, 25 bp, Homo sapien
tggcagacctgtatgtacatctatg

SEQ ID NO: 279774 - DNA, 25 bp, Homo sapien
gccacagccaaaacatcttccagta

SEQ ID NO: 279775 - DNA, 25 bp, Homo sapien
tcttccagtaactgagcatacccag

SEQ ID NO: 279776 - DNA, 25 bp, Homo sapien
gtaactgagcatacccagtgggcca

SEQ ID NO: 279777 - DNA, 25 bp, Homo sapien
tgagcatacccagtgggccaacaag

SEQ ID NO: 279778 - DNA, 25 bp, Homo sapien
agtgggccaacaagcacgctctaaa

SEQ ID NO: 279779 - DNA, 25 bp, Homo sapien
gggccaacaagcacgctctaaatac

SEQ ID NO: 279780 - DNA, 25 bp, Homo sapien
tgtgaagtacaaggcattctgcgct

SEQ ID NO: 279781 - DNA, 25 bp, Homo sapien
gtacaaggcattctgcgcttgtggt

SEQ ID NO: 279782 - DNA, 25 bp, Homo sapien
gcattctgcgcttgtggtgggaaca

SEQ ID NO: 279783 - DNA, 25 bp, Homo sapien
ttctgcgcttgtggtgggaacaagt

SEQ ID NO: 279784 - DNA, 25 bp, Homo sapien
tcccattagccccaatgagagaact

SEQ ID NO: 279785 - DNA, 25 bp, Homo sapien
agagaactcaacgtgccggagctga

SEQ ID NO: 279786 - DNA, 25 bp, Homo sapien
gctgagtgggccttgcacgagacac

SEQ ID NO: 279787 - DNA, 25 bp, Homo sapien
tggccccactttcaggcctggagga

SEQ ID NO: 279788 - DNA, 25 bp, Homo sapien
ggcctggaggaagcatgcacacatg

SEQ ID NO: 279789 - DNA, 25 bp, Homo sapien
atgcacacatggagacggcgcctgc

SEQ ID NO: 279790 - DNA, 25 bp, Homo sapien
cggcgcctgcctgtagatgtttgga

SEQ ID NO: 279791 - DNA, 25 bp, Homo sapien
gtttggatcttcgagatctccccag

SEQ ID NO: 279792 - DNA, 25 bp, Homo sapien
aggcatcttgtctcccacaggatcg

SEQ ID NO: 279793 - DNA, 25 bp, Homo sapien
gtctcccacaggatcgtgtgtgtag

SEQ ID NO: 279794 - DNA, 25 bp, Homo sapien
agagggaaactatttgtagcttgtt

SEQ ID NO: 279795 - DNA, 25 bp, Homo sapien
tgtattccaaataaggcctctgtga

SEQ ID NO: 279796 - DNA, 25 bp, Homo sapien
caaataaggcctctgtgaaatgtct

SEQ ID NO: 279797 - DNA, 25 bp, Homo sapien
ccgtctttgttatggtcagcttcat

SEQ ID NO: 279798 - DNA, 25 bp, Homo sapien
atggtcagcttcattatttggatgt

SEQ ID NO: 279799 - DNA, 25 bp, Homo sapien
attcaaagcagcagttccaaacata

SEQ ID NO: 279800 - DNA, 25 bp, Homo sapien
gcagttccaaacataacacacatct

SEQ ID NO: 279801 - DNA, 25 bp, Homo sapien
aacacacatctattttcttagagtt

SEQ ID NO: 279802 - DNA, 25 bp, Homo sapien
aattgtggatcctacatgttcctat

SEQ ID NO: 279803 - DNA, 25 bp, Homo sapien
catgttcctatgttcattctctaaa

SEQ ID NO: 279804 - DNA, 25 bp, Homo sapien
acctgagtaactttatgaaaacaca

SEQ ID NO: 279805 - DNA, 25 bp, Homo sapien
cacatttttgtcacatttttactga

SEQ ID NO: 279806 - DNA, 25 bp, Homo sapien
gtctgagccctggacaaagaaagca

SEQ ID NO: 279807 - DNA, 25 bp, Homo sapien
gaaagcagccaccttttaagcagtc

SEQ ID NO: 279808 - DNA, 25 bp, Homo sapien
gagctacgtgatgcaggaagcacat

SEQ ID NO: 279809 - DNA, 25 bp, Homo sapien
gaacaaaggcagttgatcagtcttt

SEQ ID NO: 279810 - DNA, 25 bp, Homo sapien
tatactacatgttccaaatccttgg

SEQ ID NO: 279811 - DNA, 25 bp, Homo sapien
caaatccttgggaaaccatgtttct

SEQ ID NO: 279812 - DNA, 25 bp, Homo sapien
ggaaaccatgtttctgtataaacct

SEQ ID NO: 279813 - DNA, 25 bp, Homo sapien
aaccttgtaactttgcagctgcacg

SEQ ID NO: 279814 - DNA, 25 bp, Homo sapien
gaagcagaaactcgctgagcctcaa

SEQ ID NO: 279815 - DNA, 25 bp, Homo sapien
ggaaaggtctttattgatgatcact

SEQ ID NO: 279816 - DNA, 25 bp, Homo sapien
tgatgatcacttggctcagtaggat

SEQ ID NO: 279817 - DNA, 25 bp, Homo sapien
gagggctttttgagtcccttccaag

SEQ ID NO: 279818 - DNA, 25 bp, Homo sapien
ctttttgagtcccttccaagtgaga

SEQ ID NO: 279819 - DNA, 25 bp, Homo sapien
ttgagtcccttccaagtgagattgt

SEQ ID NO: 279820 - DNA, 25 bp, Homo sapien
gtcccttccaagtgagattgtaaat

SEQ ID NO: 279821 - DNA, 25 bp, Homo sapien
tgtaaatgtagaattttccactgtt

SEQ ID NO: 279822 - DNA, 25 bp, Homo sapien
tttccactgttggatctagattttt

SEQ ID NO: 279823 - DNA, 25 bp, Homo sapien
acagagctgagaccttgtgcatgca

SEQ ID NO: 279824 - DNA, 25 bp, Homo sapien
tatataaaaagcttgtttctacagt

SEQ ID NO: 279825 - DNA, 25 bp, Homo sapien
gtttctacagtttgcagtggatcta

SEQ ID NO: 279826 - DNA, 25 bp, Homo sapien
gcagtggatctaaacattacggcaa

SEQ ID NO: 279827 - DNA, 25 bp, Homo sapien
taaacattacggcaattttaggatt

SEQ ID NO: 279828 - DNA, 25 bp, Homo sapien
ctagaagttccatgtttgctttaga

SEQ ID NO: 279829 - DNA, 25 bp, Homo sapien
tagaagttccatgtttgctttagaa

SEQ ID NO: 279830 - DNA, 25 bp, Homo sapien
gtttgctttagaagccttagtttag

SEQ ID NO: 279831 - DNA, 25 bp, Homo sapien
tgctttagaagccttagtttagacc

SEQ ID NO: 279832 - DNA, 25 bp, Homo sapien
gctttagaagccttagtttagacca

SEQ ID NO: 279833 - DNA, 25 bp, Homo sapien
ctttagaagccttagtttagaccag

SEQ ID NO: 279834 - DNA, 25 bp, Homo sapien
tttagaagccttagtttagaccagg

SEQ ID NO: 279835 - DNA, 25 bp, Homo sapien
ttagaagccttagtttagaccaggt

SEQ ID NO: 279836 - DNA, 25 bp, Homo sapien
tagaagccttagtttagaccaggtg

SEQ ID NO: 279837 - DNA, 25 bp, Homo sapien
agaagccttagtttagaccaggtgc

SEQ ID NO: 279838 - DNA, 25 bp, Homo sapien
gaagccttagtttagaccaggtgca

SEQ ID NO: 279839 - DNA, 25 bp, Homo sapien
gaaacaatttcgtttaatgggatct

SEQ ID NO: 279840 - DNA, 25 bp, Homo sapien
caatttcgtttaatgggatctgtac

SEQ ID NO: 279841 - DNA, 25 bp, Homo sapien
atttcgtttaatgggatctgtacaa

SEQ ID NO: 279842 - DNA, 25 bp, Homo sapien
ttcgtttaatgggatctgtacaact

SEQ ID NO: 279843 - DNA, 25 bp, Homo sapien
cgtttaatgggatctgtacaactga

SEQ ID NO: 279844 - DNA, 25 bp, Homo sapien
tttaatgggatctgtacaactgatt

SEQ ID NO: 279845 - DNA, 25 bp, Homo sapien
aaaagccccaaagcatataatctct

SEQ ID NO: 279846 - DNA, 25 bp, Homo sapien
agccccaaagcatataatctctact

SEQ ID NO: 279847 - DNA, 25 bp, Homo sapien
gccccaaagcatataatctctactc

SEQ ID NO: 279848 - DNA, 25 bp, Homo sapien
gcatataatctctactccttacagt

SEQ ID NO: 279849 - DNA, 25 bp, Homo sapien
catataatctctactccttacagtc

SEQ ID NO: 279850 - DNA, 25 bp, Homo sapien
agaggcctcctcttactttgttcta

SEQ ID NO: 279851 - DNA, 25 bp, Homo sapien
tactttgttctaatcgcctttggga

SEQ ID NO: 279852 - DNA, 25 bp, Homo sapien
aatcgcctttgggacatctatgggt

SEQ ID NO: 279853 - DNA, 25 bp, Homo sapien
acatctatgggtctctttgtcagaa

SEQ ID NO: 279854 - DNA, 25 bp, Homo sapien
gaagcctgggcttatagtatagaag

SEQ ID NO: 279855 - DNA, 25 bp, Homo sapien
gggagaatcccctaccactgtaagc

SEQ ID NO: 279856 - DNA, 25 bp, Homo sapien
accactgtaagcaacgagcattgtt

SEQ ID NO: 279857 - DNA, 25 bp, Homo sapien
gagtcacattgtgctgtcttgctgc

SEQ ID NO: 279858 - DNA, 25 bp, Homo sapien
tgtcttgctgcacggatagccaatt

SEQ ID NO: 279859 - DNA, 25 bp, Homo sapien
gcacggatagccaattctctacatc

SEQ ID NO: 279860 - DNA, 25 bp, Homo sapien
agccaattctctacatcttataaca

SEQ ID NO: 279861 - DNA, 25 bp, Homo sapien
tgctgctactcagactagctctaag

SEQ ID NO: 279862 - DNA, 25 bp, Homo sapien
gactagctctaagtaatgtgattct

SEQ ID NO: 279863 - DNA, 25 bp, Homo sapien
tctaaagcaaagtcattggatggga

SEQ ID NO: 279864 - DNA, 25 bp, Homo sapien
ggagatacattggaagatcccttca

SEQ ID NO: 279865 - DNA, 25 bp, Homo sapien
aaatgactcaccaacaaatgtacag

SEQ ID NO: 279866 - DNA, 25 bp, Homo sapien
atgtacagcaataacaccatccaga

SEQ ID NO: 279867 - DNA, 25 bp, Homo sapien
aagggaccctgcaggagtttcacac

SEQ ID NO: 279868 - DNA, 25 bp, Homo sapien
agtttcacacgagagtggtccttcc

SEQ ID NO: 279869 - DNA, 25 bp, Homo sapien
gtgcatcacacaggtattgcttttt

SEQ ID NO: 279870 - DNA, 25 bp, Homo sapien
ctttttaacaagaactgatgctcct

SEQ ID NO: 279871 - DNA, 25 bp, Homo sapien
atgctccttgggtgctgctgctact

SEQ ID NO: 279872 - DNA, 25 bp, Homo sapien
aatgtctcagtgtgctgatttggta

SEQ ID NO: 279873 - DNA, 25 bp, Homo sapien
gaattattcttctggaggtctgtta

SEQ ID NO: 279874 - DNA, 25 bp, Homo sapien
aggtctgttagactacatcctacac

SEQ ID NO: 279875 - DNA, 25 bp, Homo sapien
actacatcctacactgacttcagaa

SEQ ID NO: 279876 - DNA, 25 bp, Homo sapien
gtctgtcagacaaaaaggccttatg

SEQ ID NO: 279877 - DNA, 25 bp, Homo sapien
aaaggccttatgtcaccactggtac

SEQ ID NO: 279878 - DNA, 25 bp, Homo sapien
cctcatcccatttacagtttttcta

SEQ ID NO: 279879 - DNA, 25 bp, Homo sapien
tacagtttttctaactccagggtag

SEQ ID NO: 279880 - DNA, 25 bp, Homo sapien
ctccagggtagtgtttagtgttaat

SEQ ID NO: 279881 - DNA, 25 bp, Homo sapien
aacttgtaacctggttgggactgat

SEQ ID NO: 279882 - DNA, 25 bp, Homo sapien
gggactgatattgtcatagctatga

SEQ ID NO: 279883 - DNA, 25 bp, Homo sapien
tggtgggagatgagtctcaaagcta

SEQ ID NO: 279884 - DNA, 25 bp, Homo sapien
gtgggagatgagtctcaaagctaag

SEQ ID NO: 279885 - DNA, 25 bp, Homo sapien
gggagatgagtctcaaagctaagta

SEQ ID NO: 279886 - DNA, 25 bp, Homo sapien
gagatgagtctcaaagctaagtagt

SEQ ID NO: 279887 - DNA, 25 bp, Homo sapien
agatgagtctcaaagctaagtagtg

SEQ ID NO: 279888 - DNA, 25 bp, Homo sapien
gatgagtctcaaagctaagtagtgg

SEQ ID NO: 279889 - DNA, 25 bp, Homo sapien
atgagtctcaaagctaagtagtgga

SEQ ID NO: 279890 - DNA, 25 bp, Homo sapien
tgagtctcaaagctaagtagtggaa

SEQ ID NO: 279891 - DNA, 25 bp, Homo sapien
gagtctcaaagctaagtagtggaag

SEQ ID NO: 279892 - DNA, 25 bp, Homo sapien
agctaagtagtggaagctgggcaca

SEQ ID NO: 279893 - DNA, 25 bp, Homo sapien
ctaagtagtggaagctgggcacagt

SEQ ID NO: 279894 - DNA, 25 bp, Homo sapien
ttgagattagaatagaacaggctct

SEQ ID NO: 279895 - DNA, 25 bp, Homo sapien
agaacaggctctattcatgcaaact

SEQ ID NO: 279896 - DNA, 25 bp, Homo sapien
acaggctctattcatgcaaactata

SEQ ID NO: 279897 - DNA, 25 bp, Homo sapien
tcttcattaattggagcttctgggc

SEQ ID NO: 279898 - DNA, 25 bp, Homo sapien
ttaattggagcttctgggcaacatc

SEQ ID NO: 279899 - DNA, 25 bp, Homo sapien
taacttgttgattcagatgtcttgg

SEQ ID NO: 279900 - DNA, 25 bp, Homo sapien
cttggtccctgaatagtcctagatt

SEQ ID NO: 279901 - DNA, 25 bp, Homo sapien
ggtccctgaatagtcctagattact

SEQ ID NO: 279902 - DNA, 25 bp, Homo sapien
cacatgttgtgttcagctttctgtt

SEQ ID NO: 279903 - DNA, 25 bp, Homo sapien
atgttgtgttcagctttctgtttta

SEQ ID NO: 279904 - DNA, 25 bp, Homo sapien
atattatttgccattgagattagaa

SEQ ID NO: 279905 - DNA, 25 bp, Homo sapien
ttgtccttatctttgccccttgtgt

SEQ ID NO: 279906 - DNA, 25 bp, Homo sapien
ttgtgtctgtctcacacacatctgc

SEQ ID NO: 279907 - DNA, 25 bp, Homo sapien
atctgctcctcagcacgtcggtgtg

SEQ ID NO: 279908 - DNA, 25 bp, Homo sapien
atcaaggtgcttcagcaaggccact

SEQ ID NO: 279909 - DNA, 25 bp, Homo sapien
gtgcttcagcaaggccactttgagg

SEQ ID NO: 279910 - DNA, 25 bp, Homo sapien
tttgaggatgatgaccccgatggct

SEQ ID NO: 279911 - DNA, 25 bp, Homo sapien
atgatgaccccgatggcttcttagg

SEQ ID NO: 279912 - DNA, 25 bp, Homo sapien
gatggcttcttaggctgagcgccca

SEQ ID NO: 279913 - DNA, 25 bp, Homo sapien
aagatcccccagagtccaggagctg

SEQ ID NO: 279914 - DNA, 25 bp, Homo sapien
cagccctcataacagattccaagga

SEQ ID NO: 279915 - DNA, 25 bp, Homo sapien
ggagagggcaccctcttgtccttat

SEQ ID NO: 279916 - DNA, 25 bp, Homo sapien
ctgcggtctcaaactcaagcaatcc

SEQ ID NO: 279917 - DNA, 25 bp, Homo sapien
tgcggtctcaaactcaagcaatcct

SEQ ID NO: 279918 - DNA, 25 bp, Homo sapien
ctgtgaaataagtatcaagcatcat

SEQ ID NO: 279919 - DNA, 25 bp, Homo sapien
gggccacagtaatgcaccaccatac

SEQ ID NO: 279920 - DNA, 25 bp, Homo sapien
atactgtcatatccttaatttctta

SEQ ID NO: 279921 - DNA, 25 bp, Homo sapien
gtcatatccttaatttcttataaat

SEQ ID NO: 279922 - DNA, 25 bp, Homo sapien
aaaaattttctaggacaggtgcagt

SEQ ID NO: 279923 - DNA, 25 bp, Homo sapien
aaattttctaggacaggtgcagtgg

SEQ ID NO: 279924 - DNA, 25 bp, Homo sapien
gtatcaagcatcataatcatgacct

SEQ ID NO: 279925 - DNA, 25 bp, Homo sapien
gcatcataatcatgacctgtttcag

SEQ ID NO: 279926 - DNA, 25 bp, Homo sapien
tcataatcatgacctgtttcagtcc

SEQ ID NO: 279927 - DNA, 25 bp, Homo sapien
gctatttttgggtgcagtttttata

SEQ ID NO: 279928 - DNA, 25 bp, Homo sapien
caaagtatttaatcctactgcttta

SEQ ID NO: 279929 - DNA, 25 bp, Homo sapien
gtatcctttttgctatcagttattg

SEQ ID NO: 279930 - DNA, 25 bp, Homo sapien
atcctttttgctatcagttattgaa

SEQ ID NO: 279931 - DNA, 25 bp, Homo sapien
aaatgtgtgttaactgtgtgtgagt

SEQ ID NO: 279932 - DNA, 25 bp, Homo sapien
catacacaagtttgacaacttcctc

SEQ ID NO: 279933 - DNA, 25 bp, Homo sapien
gacaacttcctcaatagttgattct

SEQ ID NO: 279934 - DNA, 25 bp, Homo sapien
acttcctcaatagttgattctttta

SEQ ID NO: 279935 - DNA, 25 bp, Homo sapien
gatgggatacatcttcctttcaagt

SEQ ID NO: 279936 - DNA, 25 bp, Homo sapien
gggatacatcttcctttcaagtaat

SEQ ID NO: 279937 - DNA, 25 bp, Homo sapien
tcctttcaagtaataatttctgcct

SEQ ID NO: 279938 - DNA, 25 bp, Homo sapien
tttctgtgtaagaattgtttacctt

SEQ ID NO: 279939 - DNA, 25 bp, Homo sapien
gtagatccctttggttgttatggac

SEQ ID NO: 279940 - DNA, 25 bp, Homo sapien
atccctttggttgttatggacattt

SEQ ID NO: 279941 - DNA, 25 bp, Homo sapien
tgtaaatacaattgtgttcttgatt

SEQ ID NO: 279942 - DNA, 25 bp, Homo sapien
ttcagatactttgctatattgcatt

SEQ ID NO: 279943 - DNA, 25 bp, Homo sapien
caaagctatctttgagaatgttata

SEQ ID NO: 279944 - DNA, 25 bp, Homo sapien
ttaacaatattaacccctccaagct

SEQ ID NO: 279945 - DNA, 25 bp, Homo sapien
tattaacccctccaagctacaaaca

SEQ ID NO: 279946 - DNA, 25 bp, Homo sapien
acccctccaagctacaaacatggga

SEQ ID NO: 279947 - DNA, 25 bp, Homo sapien
cctccaagctacaaacatgggatat

SEQ ID NO: 279948 - DNA, 25 bp, Homo sapien
catgggatatctttcatttatttgt

SEQ ID NO: 279949 - DNA, 25 bp, Homo sapien
gaagacagacagtaccaacggaaat

SEQ ID NO: 279950 - DNA, 25 bp, Homo sapien
aagacagacagtaccaacggaaata

SEQ ID NO: 279951 - DNA, 25 bp, Homo sapien
agacagacagtaccaacggaaatac

SEQ ID NO: 279952 - DNA, 25 bp, Homo sapien
gacagacagtaccaacggaaatact

SEQ ID NO: 279953 - DNA, 25 bp, Homo sapien
acagacagtaccaacggaaatactg

SEQ ID NO: 279954 - DNA, 25 bp, Homo sapien
cagacagtaccaacggaaatactgt

SEQ ID NO: 279955 - DNA, 25 bp, Homo sapien
agacagtaccaacggaaatactgta

SEQ ID NO: 279956 - DNA, 25 bp, Homo sapien
cagtaccaacggaaatactgtagct

SEQ ID NO: 279957 - DNA, 25 bp, Homo sapien
tgccaggccatgttttccccctctt

SEQ ID NO: 279958 - DNA, 25 bp, Homo sapien
tccccctctttcaaaatctaacttg

SEQ ID NO: 279959 - DNA, 25 bp, Homo sapien
aaaatctaacttgagactcgcattt

SEQ ID NO: 279960 - DNA, 25 bp, Homo sapien
ttcctttgtgtttttgtaataccag

SEQ ID NO: 279961 - DNA, 25 bp, Homo sapien
gtgtttttgtaataccagtggagcc

SEQ ID NO: 279962 - DNA, 25 bp, Homo sapien
tgtttttgtaataccagtggagcct

SEQ ID NO: 279963 - DNA, 25 bp, Homo sapien
gtttttgtaataccagtggagcctt

SEQ ID NO: 279964 - DNA, 25 bp, Homo sapien
ttttgtaataccagtggagcctttt

SEQ ID NO: 279965 - DNA, 25 bp, Homo sapien
tttgtaataccagtggagccttttc

SEQ ID NO: 279966 - DNA, 25 bp, Homo sapien
ttgtaataccagtggagccttttct

SEQ ID NO: 279967 - DNA, 25 bp, Homo sapien
tgtaataccagtggagccttttctt

SEQ ID NO: 279968 - DNA, 25 bp, Homo sapien
gaaactaggcaaacctaagacaatt

SEQ ID NO: 279969 - DNA, 25 bp, Homo sapien
aacctaagacaattatgcttaagga

SEQ ID NO: 279970 - DNA, 25 bp, Homo sapien
gaaacggatcaaatggaatggctca

SEQ ID NO: 279971 - DNA, 25 bp, Homo sapien
ggacgtcagagccatgagtaacaat

SEQ ID NO: 279972 - DNA, 25 bp, Homo sapien
gtaacaataacgaaccagggctatg

SEQ ID NO: 279973 - DNA, 25 bp, Homo sapien
ttccccatcttaacagccagtgctg

SEQ ID NO: 279974 - DNA, 25 bp, Homo sapien
aacagccagtgctgcgtatggccat

SEQ ID NO: 279975 - DNA, 25 bp, Homo sapien
gtatggccatcagcagacagtccat

SEQ ID NO: 279976 - DNA, 25 bp, Homo sapien
taaacccaagtttggtgaccttgct

SEQ ID NO: 279977 - DNA, 25 bp, Homo sapien
agcagacagtccatttataccactg

SEQ ID NO: 279978 - DNA, 25 bp, Homo sapien
gacaaagattgggaggaaccagccc

SEQ ID NO: 279979 - DNA, 25 bp, Homo sapien
tgaccttgctttaggtacctgggct

SEQ ID NO: 279980 - DNA, 25 bp, Homo sapien
gtacctgggctgctcaaaaggagac

SEQ ID NO: 279981 - DNA, 25 bp, Homo sapien
aacattgcttgcaacattcaagagg

SEQ ID NO: 279982 - DNA, 25 bp, Homo sapien
gcccactgggagcatggctgtcctg

SEQ ID NO: 279983 - DNA, 25 bp, Homo sapien
atggctgtcctgctccccatggagc

SEQ ID NO: 279984 - DNA, 25 bp, Homo sapien
gctccccatggagcagaacaggtgg

SEQ ID NO: 279985 - DNA, 25 bp, Homo sapien
caggggctgcacaggctgccaacag

SEQ ID NO: 279986 - DNA, 25 bp, Homo sapien
gctgccaacaggtccaccgttgctg

SEQ ID NO: 279987 - DNA, 25 bp, Homo sapien
aggtccaccgttgctggcttctgtg

SEQ ID NO: 279988 - DNA, 25 bp, Homo sapien
ctggcttctgtgtggcgctaactca

SEQ ID NO: 279989 - DNA, 25 bp, Homo sapien
ttctgtgtggcgctaactcacgatc

SEQ ID NO: 279990 - DNA, 25 bp, Homo sapien
tgtgtggcgctaactcacgatctct

SEQ ID NO: 279991 - DNA, 25 bp, Homo sapien
ggcgctaactcacgatctctcacag

SEQ ID NO: 279992 - DNA, 25 bp, Homo sapien
ctattggggttgaccatcctgctcc

SEQ ID NO: 279993 - DNA, 25 bp, Homo sapien
gtttaaaccacccaatctgaagtat

SEQ ID NO: 279994 - DNA, 25 bp, Homo sapien
tgttatggcagtcctgggcagacta

SEQ ID NO: 279995 - DNA, 25 bp, Homo sapien
gtcctgggcagactaatacaatatg

SEQ ID NO: 279996 - DNA, 25 bp, Homo sapien
gggcctctacagaagtcattaaggt

SEQ ID NO: 279997 - DNA, 25 bp, Homo sapien
gaagtcattaaggttacatcggtcc

SEQ ID NO: 279998 - DNA, 25 bp, Homo sapien
ttaaggttacatcggtcctgagggt

SEQ ID NO: 279999 - DNA, 25 bp, Homo sapien
gggccctcatccaacaggattcgtc

SEQ ID NO: 280000 - DNA, 25 bp, Homo sapien
aacaggattcgtctttctgagagga

SEQ ID NO: 280001 - DNA, 25 bp, Homo sapien
aaggagagccctccccagaaatcac

SEQ ID NO: 280002 - DNA, 25 bp, Homo sapien
gaaatcacacggaccagcaccttga

SEQ ID NO: 280003 - DNA, 25 bp, Homo sapien
tgggacttccagaaaacagaactgt

SEQ ID NO: 280004 - DNA, 25 bp, Homo sapien
gtctgctccccgtcatatagacgag

SEQ ID NO: 280005 - DNA, 25 bp, Homo sapien
gctccccgtcatatagacgagtgtt

SEQ ID NO: 280006 - DNA, 25 bp, Homo sapien
agacgagtgttgtctgtgttcagat

SEQ ID NO: 280007 - DNA, 25 bp, Homo sapien
agtgttgtctgtgttcagatttcaa

SEQ ID NO: 280008 - DNA, 25 bp, Homo sapien
ggaattgcacaatatatgctcctat

SEQ ID NO: 280009 - DNA, 25 bp, Homo sapien
atatgctcctatgtctaaatttttt

SEQ ID NO: 280010 - DNA, 25 bp, Homo sapien
tgtatttatcagtagtttttagcat

SEQ ID NO: 280011 - DNA, 25 bp, Homo sapien
tttagcattgtatcgcactgtggta

SEQ ID NO: 280012 - DNA, 25 bp, Homo sapien
cgcactgtggtatttcattgtatat

SEQ ID NO: 280013 - DNA, 25 bp, Homo sapien
cattgaccagttgaacatttgggct

SEQ ID NO: 280014 - DNA, 25 bp, Homo sapien
agttgaacatttgggctatttccag

SEQ ID NO: 280015 - DNA, 25 bp, Homo sapien
gttattattctttgccatcatgctt

SEQ ID NO: 280016 - DNA, 25 bp, Homo sapien
gagccaaaaggctacatcatgttga

SEQ ID NO: 280017 - DNA, 25 bp, Homo sapien
gctacatcatgttgagggtgctgga

SEQ ID NO: 280018 - DNA, 25 bp, Homo sapien
ggtgctggagattttacattttgac

SEQ ID NO: 280019 - DNA, 25 bp, Homo sapien
atgttcggaatacagtgcagccctt

SEQ ID NO: 280020 - DNA, 25 bp, Homo sapien
gaatacagtgcagcccttacgacag

SEQ ID NO: 280021 - DNA, 25 bp, Homo sapien
agcccttacgacaggcttacgtaga

SEQ ID NO: 280022 - DNA, 25 bp, Homo sapien
cttacgtagagcttttgtgagattt

SEQ ID NO: 280023 - DNA, 25 bp, Homo sapien
tagaactctgtaaccctcagcaagt

SEQ ID NO: 280024 - DNA, 25 bp, Homo sapien
accctcagcaagtttcatttttgtc

SEQ ID NO: 280025 - DNA, 25 bp, Homo sapien
agcaagtttcatttttgtcatgaca

SEQ ID NO: 280026 - DNA, 25 bp, Homo sapien
ccactgacttgtaatctttacgacc

SEQ ID NO: 280027 - DNA, 25 bp, Homo sapien
actgacttgtaatctttacgacctc

SEQ ID NO: 280028 - DNA, 25 bp, Homo sapien
gacttgtaatctttacgacctcagt

SEQ ID NO: 280029 - DNA, 25 bp, Homo sapien
tgtaatctttacgacctcagtgagg

SEQ ID NO: 280030 - DNA, 25 bp, Homo sapien
gtaatctttacgacctcagtgaggg

SEQ ID NO: 280031 - DNA, 25 bp, Homo sapien
aatctttacgacctcagtgagggtc

SEQ ID NO: 280032 - DNA, 25 bp, Homo sapien
agggtcagaagtgtccgcgagccct

SEQ ID NO: 280033 - DNA, 25 bp, Homo sapien
tcagaagtgtccgcgagccctgtag

SEQ ID NO: 280034 - DNA, 25 bp, Homo sapien
tccgcgagccctgtaggcgaggaga

SEQ ID NO: 280035 - DNA, 25 bp, Homo sapien
tggctgagggcgcacagcctggaag

SEQ ID NO: 280036 - DNA, 25 bp, Homo sapien
ggagaaactagagctggactctgct

SEQ ID NO: 280037 - DNA, 25 bp, Homo sapien
atgagatgatcagggaggctgacat

SEQ ID NO: 280038 - DNA, 25 bp, Homo sapien
agatggccaggtcaattatgaagag

SEQ ID NO: 280039 - DNA, 25 bp, Homo sapien
gccaggtcaattatgaagagtttgt

SEQ ID NO: 280040 - DNA, 25 bp, Homo sapien
atgatgactgcaaagtgaaggcccc

SEQ ID NO: 280041 - DNA, 25 bp, Homo sapien
tgactgcaaagtgaaggccccccgg

SEQ ID NO: 280042 - DNA, 25 bp, Homo sapien
gggcagctggcgatgcccgttctct

SEQ ID NO: 280043 - DNA, 25 bp, Homo sapien
tggcgatgcccgttctcttgatctc

SEQ ID NO: 280044 - DNA, 25 bp, Homo sapien
ttctcttgatctctctcttctcgcg

SEQ ID NO: 280045 - DNA, 25 bp, Homo sapien
tgcgtaccccggttctagcaaacac

SEQ ID NO: 280046 - DNA, 25 bp, Homo sapien
gcaaacaccaattgattgactgaga

SEQ ID NO: 280047 - DNA, 25 bp, Homo sapien
gactgagaatctgataaagcaacaa

SEQ ID NO: 280048 - DNA, 25 bp, Homo sapien
gccctgggtccataagatgtcatcg

SEQ ID NO: 280049 - DNA, 25 bp, Homo sapien
gatgtcatcggcgagcgctggactt

SEQ ID NO: 280050 - DNA, 25 bp, Homo sapien
ggcgagcgctggacttgaccgtcaa

SEQ ID NO: 280051 - DNA, 25 bp, Homo sapien
gacttgaccgtcaacttgggattgt

SEQ ID NO: 280052 - DNA, 25 bp, Homo sapien
gaccgtcaacttgggattgttaagg

SEQ ID NO: 280053 - DNA, 25 bp, Homo sapien
tccttctgtcgccaaggcggtggca

SEQ ID NO: 280054 - DNA, 25 bp, Homo sapien
aactgcgggcaggtcggcggagtta

SEQ ID NO: 280055 - DNA, 25 bp, Homo sapien
gtcggcggagttagatggcagcaaa

SEQ ID NO: 280056 - DNA, 25 bp, Homo sapien
ggccggcttggtgtgataaagttcc

SEQ ID NO: 280057 - DNA, 25 bp, Homo sapien
agttccaactgggtccttccgcgag

SEQ ID NO: 280058 - DNA, 25 bp, Homo sapien
ttccgcgagccctgggtccataaga

SEQ ID NO: 280059 - DNA, 25 bp, Homo sapien
tctccctttgatttgctgactgatg

SEQ ID NO: 280060 - DNA, 25 bp, Homo sapien
gctgactgatggatgcagtccattt

SEQ ID NO: 280061 - DNA, 25 bp, Homo sapien
ggaaagagcactagacttagattct

SEQ ID NO: 280062 - DNA, 25 bp, Homo sapien
ttagattctagtcccagttctgtca

SEQ ID NO: 280063 - DNA, 25 bp, Homo sapien
gttctgtcacttaacagctatgtgt

SEQ ID NO: 280064 - DNA, 25 bp, Homo sapien
gaagagtacttggatctctggatct

SEQ ID NO: 280065 - DNA, 25 bp, Homo sapien
gatctctggatctcttttaacttta

SEQ ID NO: 280066 - DNA, 25 bp, Homo sapien
actttaatattctcctctataaggg

SEQ ID NO: 280067 - DNA, 25 bp, Homo sapien
ttctcagtggttgaagttgttcctg

SEQ ID NO: 280068 - DNA, 25 bp, Homo sapien
gttgttcctgattacagctctctta

SEQ ID NO: 280069 - DNA, 25 bp, Homo sapien
agctctcttatctgttctccctttg

SEQ ID NO: 280070 - DNA, 25 bp, Homo sapien
gaggcatcaggaagtcaggagtgct

SEQ ID NO: 280071 - DNA, 25 bp, Homo sapien
ggctggtaacagtcatggtattaaa

SEQ ID NO: 280072 - DNA, 25 bp, Homo sapien
gcaggccttactgtgaaggtggtat

SEQ ID NO: 280073 - DNA, 25 bp, Homo sapien
actgtgaaggtggtatttgagatga

SEQ ID NO: 280074 - DNA, 25 bp, Homo sapien
tgaagtagttggtcagagtccctgt

SEQ ID NO: 280075 - DNA, 25 bp, Homo sapien
agttggtcagagtccctgtttgaca

SEQ ID NO: 280076 - DNA, 25 bp, Homo sapien
ggtcagagtccctgtttgacacatg

SEQ ID NO: 280077 - DNA, 25 bp, Homo sapien
gagtccctgtttgacacatggagac

SEQ ID NO: 280078 - DNA, 25 bp, Homo sapien
gtttgacacatggagaccaccttga

SEQ ID NO: 280079 - DNA, 25 bp, Homo sapien
acatggagaccaccttgacagcaaa

SEQ ID NO: 280080 - DNA, 25 bp, Homo sapien
atggagaccaccttgacagcaaagg

SEQ ID NO: 280081 - DNA, 25 bp, Homo sapien
gtgtttacaacagcaaagcaccgtt

SEQ ID NO: 280082 - DNA, 25 bp, Homo sapien
aaagcaccgttagcctggacagttg

SEQ ID NO: 280083 - DNA, 25 bp, Homo sapien
accgttagcctggacagttgcttat

SEQ ID NO: 280084 - DNA, 25 bp, Homo sapien
ttagcctggacagttgcttatggca

SEQ ID NO: 280085 - DNA, 25 bp, Homo sapien
gcttatggcatcgatagggttggat

SEQ ID NO: 280086 - DNA, 25 bp, Homo sapien
agggttggataatattctgggattt

SEQ ID NO: 280087 - DNA, 25 bp, Homo sapien
gggatttgttgcagcagaattcctc

SEQ ID NO: 280088 - DNA, 25 bp, Homo sapien
agaattcctctatctgatgatcagc

SEQ ID NO: 280089 - DNA, 25 bp, Homo sapien
ttcctctatctgatgatcagcagtt

SEQ ID NO: 280090 - DNA, 25 bp, Homo sapien
gatcagcagttgaacataaacttca

SEQ ID NO: 280091 - DNA, 25 bp, Homo sapien
gtatctctcttgaatagcatttggg

SEQ ID NO: 280092 - DNA, 25 bp, Homo sapien
caggtgaaccacaaaagcacattaa

SEQ ID NO: 280093 - DNA, 25 bp, Homo sapien
gaaccacaaaagcacattaatctaa

SEQ ID NO: 280094 - DNA, 25 bp, Homo sapien
caaaaaaccacatgttgtatgactc

SEQ ID NO: 280095 - DNA, 25 bp, Homo sapien
aaccacatgttgtatgactctattt

SEQ ID NO: 280096 - DNA, 25 bp, Homo sapien
acatgttgtatgactctatttttat

SEQ ID NO: 280097 - DNA, 25 bp, Homo sapien
atgactctatttttatgatatccag

SEQ ID NO: 280098 - DNA, 25 bp, Homo sapien
acaaatctgtagtgtcagtaagtca

SEQ ID NO: 280099 - DNA, 25 bp, Homo sapien
ctgtagtgtcagtaagtcaattagg

SEQ ID NO: 280100 - DNA, 25 bp, Homo sapien
ttgatgagcatgagggatttcttag

SEQ ID NO: 280101 - DNA, 25 bp, Homo sapien
gagcatgagggatttcttaggaatt

SEQ ID NO: 280102 - DNA, 25 bp, Homo sapien
gtgatgatggtcaaacaagtctaaa

SEQ ID NO: 280103 - DNA, 25 bp, Homo sapien
ggctataagttgagatgccaccttc

SEQ ID NO: 280104 - DNA, 25 bp, Homo sapien
tgccaccttcaaccattaacttaaa

SEQ ID NO: 280105 - DNA, 25 bp, Homo sapien
gtttacttttgctttacgcatattt

SEQ ID NO: 280106 - DNA, 25 bp, Homo sapien
acttctagatattctgcctcacatt

SEQ ID NO: 280107 - DNA, 25 bp, Homo sapien
cacatttctagttaggatacctcct

SEQ ID NO: 280108 - DNA, 25 bp, Homo sapien
ggatacctccttcctatagaatttt

SEQ ID NO: 280109 - DNA, 25 bp, Homo sapien
cttcctatagaattttgcactgttg

SEQ ID NO: 280110 - DNA, 25 bp, Homo sapien
ttgcactgttggctctattgtttca

SEQ ID NO: 280111 - DNA, 25 bp, Homo sapien
aaaacaagcatattattccactacc

SEQ ID NO: 280112 - DNA, 25 bp, Homo sapien
ccccacatatttagaccagcagtct

SEQ ID NO: 280113 - DNA, 25 bp, Homo sapien
gtaaaggtcaggttctcatgagatc

SEQ ID NO: 280114 - DNA, 25 bp, Homo sapien
gagctggcacagagttagggaaatt

SEQ ID NO: 280115 - DNA, 25 bp, Homo sapien
ctggcacagagttagggaaattgac

SEQ ID NO: 280116 - DNA, 25 bp, Homo sapien
attgactgtgtctcatattggctag

SEQ ID NO: 280117 - DNA, 25 bp, Homo sapien
gactgtgtctcatattggctagtga

SEQ ID NO: 280118 - DNA, 25 bp, Homo sapien
ctgtgtctcatattggctagtgaga

SEQ ID NO: 280119 - DNA, 25 bp, Homo sapien
atattggctagtgagagtgatctgt

SEQ ID NO: 280120 - DNA, 25 bp, Homo sapien
gctagtgagagtgatctgttggaat

SEQ ID NO: 280121 - DNA, 25 bp, Homo sapien
gagagtgatctgttggaattgtata

SEQ ID NO: 280122 - DNA, 25 bp, Homo sapien
gatctgttggaattgtatatcaaaa

SEQ ID NO: 280123 - DNA, 25 bp, Homo sapien
gtacatacattttgtctagcaattc

SEQ ID NO: 280124 - DNA, 25 bp, Homo sapien
gcaattctactattgggtatttata

SEQ ID NO: 280125 - DNA, 25 bp, Homo sapien
gtgcagccaaacttaaggcaccggc

SEQ ID NO: 280126 - DNA, 25 bp, Homo sapien
aggcaccggcaagtgttgtcagcac

SEQ ID NO: 280127 - DNA, 25 bp, Homo sapien
tgaggccagccaagtccctgtgtta

SEQ ID NO: 280128 - DNA, 25 bp, Homo sapien
gccaagtccctgtgttacgaatggt

SEQ ID NO: 280129 - DNA, 25 bp, Homo sapien
cctgtgttacgaatggtgggccaag

SEQ ID NO: 280130 - DNA, 25 bp, Homo sapien
tgtctgctcggtcccagtaggacag

SEQ ID NO: 280131 - DNA, 25 bp, Homo sapien
agtaggacaggcagagctccaggct

SEQ ID NO: 280132 - DNA, 25 bp, Homo sapien
ctggcaccatggtaggcctccaggg

SEQ ID NO: 280133 - DNA, 25 bp, Homo sapien
ggcacactgggcaggcttgcccatt

SEQ ID NO: 280134 - DNA, 25 bp, Homo sapien
cctggccctgagaatggagctgtag

SEQ ID NO: 280135 - DNA, 25 bp, Homo sapien
ggagctgtagcctcatggacaataa

SEQ ID NO: 280136 - DNA, 25 bp, Homo sapien
ttcctcccaatctttgtccagtggt

SEQ ID NO: 280137 - DNA, 25 bp, Homo sapien
ggccatacgcagcactggctgttaa

SEQ ID NO: 280138 - DNA, 25 bp, Homo sapien
atagccctggttcgttattgttact

SEQ ID NO: 280139 - DNA, 25 bp, Homo sapien
tattgttactcatggctctgacgtc

SEQ ID NO: 280140 - DNA, 25 bp, Homo sapien
aagccctcttgaatgttgcaagcaa

SEQ ID NO: 280141 - DNA, 25 bp, Homo sapien
tgttaaatatcacacctcggtctcc

SEQ ID NO: 280142 - DNA, 25 bp, Homo sapien
ggtctccttttgagcagcccaggta

SEQ ID NO: 280143 - DNA, 25 bp, Homo sapien
agcagcccaggtacctaaagcaagg

SEQ ID NO: 280144 - DNA, 25 bp, Homo sapien
gggtttaaacttcagttgccatcac

SEQ ID NO: 280145 - DNA, 25 bp, Homo sapien
gttgccatcacagcagggttcaggt

SEQ ID NO: 280146 - DNA, 25 bp, Homo sapien
agggttcaggttatgcagtttttgc

SEQ ID NO: 280147 - DNA, 25 bp, Homo sapien
caggagttcataccagtctaggggc

SEQ ID NO: 280148 - DNA, 25 bp, Homo sapien
aggagttcataccagtctaggggca

SEQ ID NO: 280149 - DNA, 25 bp, Homo sapien
ggagttcataccagtctaggggcaa

SEQ ID NO: 280150 - DNA, 25 bp, Homo sapien
gagttcataccagtctaggggcaac

SEQ ID NO: 280151 - DNA, 25 bp, Homo sapien
agttcataccagtctaggggcaaca

SEQ ID NO: 280152 - DNA, 25 bp, Homo sapien
gttcataccagtctaggggcaacat

SEQ ID NO: 280153 - DNA, 25 bp, Homo sapien
ttcataccagtctaggggcaacatg

SEQ ID NO: 280154 - DNA, 25 bp, Homo sapien
tcataccagtctaggggcaacatgg

SEQ ID NO: 280155 - DNA, 25 bp, Homo sapien
acctgaggtcaggtcccagcgactt

SEQ ID NO: 280156 - DNA, 25 bp, Homo sapien
cctgaggtcaggtcccagcgacttg

SEQ ID NO: 280157 - DNA, 25 bp, Homo sapien
ctgaggtcaggtcccagcgacttgg

SEQ ID NO: 280158 - DNA, 25 bp, Homo sapien
caaggaaagctttctctcctgcaac

SEQ ID NO: 280159 - DNA, 25 bp, Homo sapien
tcctgcaaccattggagggaccctg

SEQ ID NO: 280160 - DNA, 25 bp, Homo sapien
gcccagctggcactttgatttcagc

SEQ ID NO: 280161 - DNA, 25 bp, Homo sapien
cagcccagtgaaagtgattttgagc

SEQ ID NO: 280162 - DNA, 25 bp, Homo sapien
gtgaaagtgattttgagcttctgac

SEQ ID NO: 280163 - DNA, 25 bp, Homo sapien
ttttgttgtttttatgctcccccag

SEQ ID NO: 280164 - DNA, 25 bp, Homo sapien
gcatctccaggaaactactgcactt

SEQ ID NO: 280165 - DNA, 25 bp, Homo sapien
gctgttgaactgtggaggcatagat

SEQ ID NO: 280166 - DNA, 25 bp, Homo sapien
ggcatagattagagtgacgtggtca

SEQ ID NO: 280167 - DNA, 25 bp, Homo sapien
tgacgtggtcacaagccaaggaaca

SEQ ID NO: 280168 - DNA, 25 bp, Homo sapien
acctgaagccaccaacagcttgaaa

SEQ ID NO: 280169 - DNA, 25 bp, Homo sapien
ggaatgcacatcttttgcgccacta

SEQ ID NO: 280170 - DNA, 25 bp, Homo sapien
tttgcgccactattaaggcacctgt

SEQ ID NO: 280171 - DNA, 25 bp, Homo sapien
aggcacctgtcaccttacatctcaa

SEQ ID NO: 280172 - DNA, 25 bp, Homo sapien
atctggaatcaaagtgccctgggtt

SEQ ID NO: 280173 - DNA, 25 bp, Homo sapien
gtgccctgggttgagaagcagacct

SEQ ID NO: 280174 - DNA, 25 bp, Homo sapien
tctggtcacactttggtcactcatt

SEQ ID NO: 280175 - DNA, 25 bp, Homo sapien
acactttggtcactcattagctcta

SEQ ID NO: 280176 - DNA, 25 bp, Homo sapien
gtcactcattagctctaggaccagt

SEQ ID NO: 280177 - DNA, 25 bp, Homo sapien
taggaccagtcactaatctctgaga

SEQ ID NO: 280178 - DNA, 25 bp, Homo sapien
gtcactaatctctgagactccattt

SEQ ID NO: 280179 - DNA, 25 bp, Homo sapien
tggcccccctgctgaaatcttgatt

SEQ ID NO: 280180 - DNA, 25 bp, Homo sapien
agtgatgtccataacagcctctgca

SEQ ID NO: 280181 - DNA, 25 bp, Homo sapien
agcctctgcagcgatggcacggagc

SEQ ID NO: 280182 - DNA, 25 bp, Homo sapien
actatccatcggtgcaaggtttctg

SEQ ID NO: 280183 - DNA, 25 bp, Homo sapien
aggtgtccatttacggctgaagcaa

SEQ ID NO: 280184 - DNA, 25 bp, Homo sapien
ggctgaagcaatgctcttccatcag

SEQ ID NO: 280185 - DNA, 25 bp, Homo sapien
gctgaagggatctgggctacctcgt

SEQ ID NO: 280186 - DNA, 25 bp, Homo sapien
ctacctcgtggcaccagattacaaa

SEQ ID NO: 280187 - DNA, 25 bp, Homo sapien
gcaggaataattctgtttgccacag

SEQ ID NO: 280188 - DNA, 25 bp, Homo sapien
cacaggaaactggtgcttctggtac

SEQ ID NO: 280189 - DNA, 25 bp, Homo sapien
tggtacaccctcctatattaaaagt

SEQ ID NO: 280190 - DNA, 25 bp, Homo sapien
agtctctattacatggccaggcaca

SEQ ID NO: 280191 - DNA, 25 bp, Homo sapien
agcaggttgtacatgatttcatgtt

SEQ ID NO: 280192 - DNA, 25 bp, Homo sapien
ttcatgtttatgtagcaaaatgcat

SEQ ID NO: 280193 - DNA, 25 bp, Homo sapien
cattgaaatgtattagtgttgaaac

SEQ ID NO: 280194 - DNA, 25 bp, Homo sapien
attgttatattttccttgtgtgtca

SEQ ID NO: 280195 - DNA, 25 bp, Homo sapien
tgttatattttccttgtgtgtcatt

SEQ ID NO: 280196 - DNA, 25 bp, Homo sapien
ttatattttccttgtgtgtcattta

SEQ ID NO: 280197 - DNA, 25 bp, Homo sapien
attcagcctaactgaataaggctaa

SEQ ID NO: 280198 - DNA, 25 bp, Homo sapien
aaggctaaatgaatactgtaattga

SEQ ID NO: 280199 - DNA, 25 bp, Homo sapien
tttaaatctttgtcatgagtttttt

SEQ ID NO: 280200 - DNA, 25 bp, Homo sapien
ctgattacacagaactttgtgggtg

SEQ ID NO: 280201 - DNA, 25 bp, Homo sapien
attacacagaactttgtgggtggtt

SEQ ID NO: 280202 - DNA, 25 bp, Homo sapien
taataaatcatgtgacttggccaat

SEQ ID NO: 280203 - DNA, 25 bp, Homo sapien
aatcatgtgacttggccaattacag

SEQ ID NO: 280204 - DNA, 25 bp, Homo sapien
tgacttggccaattacagaaattcc

SEQ ID NO: 280205 - DNA, 25 bp, Homo sapien
gaaattcctaagtgtagtattttga

SEQ ID NO: 280206 - DNA, 25 bp, Homo sapien
ggccagtgtcccagatttgtaaggt

SEQ ID NO: 280207 - DNA, 25 bp, Homo sapien
gtgtcccagatttgtaaggtacagt

SEQ ID NO: 280208 - DNA, 25 bp, Homo sapien
gtacagtgtgcatacagtgtgtctt

SEQ ID NO: 280209 - DNA, 25 bp, Homo sapien
ccaagtatttattttcagaagccca

SEQ ID NO: 280210 - DNA, 25 bp, Homo sapien
ttattttcagaagcccacttttggg

SEQ ID NO: 280211 - DNA, 25 bp, Homo sapien
gaaggttgcctatatttttgatagt

SEQ ID NO: 280212 - DNA, 25 bp, Homo sapien
aaacagttttaactattgctgaagt

SEQ ID NO: 280213 - DNA, 25 bp, Homo sapien
ccacttaatccctgattcactgtct

SEQ ID NO: 280214 - DNA, 25 bp, Homo sapien
ttcactgtctgatttgggctttctg

SEQ ID NO: 280215 - DNA, 25 bp, Homo sapien
tgatttgggctttctgctttacttc

SEQ ID NO: 280216 - DNA, 25 bp, Homo sapien
gatttacaaccctaatatcccaggc

SEQ ID NO: 280217 - DNA, 25 bp, Homo sapien
tatcccaggcacatacaaaacttat

SEQ ID NO: 280218 - DNA, 25 bp, Homo sapien
atgaattacccagcacaactgtgaa

SEQ ID NO: 280219 - DNA, 25 bp, Homo sapien
aactgtgaaactctgtattgcttct

SEQ ID NO: 280220 - DNA, 25 bp, Homo sapien
tctgtattgcttcttccggtccaca

SEQ ID NO: 280221 - DNA, 25 bp, Homo sapien
tccacaccctatactcatgacatta

SEQ ID NO: 280222 - DNA, 25 bp, Homo sapien
atattatcatcctgtttgactcatg

SEQ ID NO: 280223 - DNA, 25 bp, Homo sapien
taaggtggtgatcttctctttcaaa

SEQ ID NO: 280224 - DNA, 25 bp, Homo sapien
aagtcttcgatctttcttacaagtg

SEQ ID NO: 280225 - DNA, 25 bp, Homo sapien
gtcttcgatctttcttacaagtgca

SEQ ID NO: 280226 - DNA, 25 bp, Homo sapien
tcgatctttcttacaagtgcagaga

SEQ ID NO: 280227 - DNA, 25 bp, Homo sapien
aagggccgcctatcctgtaatcaca

SEQ ID NO: 280228 - DNA, 25 bp, Homo sapien
ggccgcctatcctgtaatcacatga

SEQ ID NO: 280229 - DNA, 25 bp, Homo sapien
gcctatcctgtaatcacatgacttg

SEQ ID NO: 280230 - DNA, 25 bp, Homo sapien
tatcctgtaatcacatgacttgctt

SEQ ID NO: 280231 - DNA, 25 bp, Homo sapien
cctgtaatcacatgacttgcttcac

SEQ ID NO: 280232 - DNA, 25 bp, Homo sapien
ataaatatcagtgaccccagccgtt

SEQ ID NO: 280233 - DNA, 25 bp, Homo sapien
tgatggtagtggtcaccccggccca

SEQ ID NO: 280234 - DNA, 25 bp, Homo sapien
taaagtcttcgatctttcttacaag

SEQ ID NO: 280235 - DNA, 25 bp, Homo sapien
gttgaaaactatggcccagggacca

SEQ ID NO: 280236 - DNA, 25 bp, Homo sapien
agggaccacttccagcctgactgtt

SEQ ID NO: 280237 - DNA, 25 bp, Homo sapien
acttccagcctgactgttgttttgt

SEQ ID NO: 280238 - DNA, 25 bp, Homo sapien
atgtttgcccatttgaactttatga

SEQ ID NO: 280239 - DNA, 25 bp, Homo sapien
gaactttatgactcagtggtcacaa

SEQ ID NO: 280240 - DNA, 25 bp, Homo sapien
gactcagtggtcacaaggtgtacga

SEQ ID NO: 280241 - DNA, 25 bp, Homo sapien
aggtgtacgacgaccatcaccatgg

SEQ ID NO: 280242 - DNA, 25 bp, Homo sapien
atctctttctcccttgagattagta

SEQ ID NO: 280243 - DNA, 25 bp, Homo sapien
gacattgcatgaacggtcttaggaa

SEQ ID NO: 280244 - DNA, 25 bp, Homo sapien
ggtcttaggaagaaagtgcctgcta

SEQ ID NO: 280245 - DNA, 25 bp, Homo sapien
gtgcctgctaaatcttaggtgttct

SEQ ID NO: 280246 - DNA, 25 bp, Homo sapien
gaaatctcaaaagccattcactaac

SEQ ID NO: 280247 - DNA, 25 bp, Homo sapien
ctaacttaaaacaactcaacagagc

SEQ ID NO: 280248 - DNA, 25 bp, Homo sapien
tcaacagagccatgaaacaaatgcc

SEQ ID NO: 280249 - DNA, 25 bp, Homo sapien
taagacaactgcatgttacatcatc

SEQ ID NO: 280250 - DNA, 25 bp, Homo sapien
gcatgttacatcatcggcactttat

SEQ ID NO: 280251 - DNA, 25 bp, Homo sapien
catcggcactttatacattactgtt

SEQ ID NO: 280252 - DNA, 25 bp, Homo sapien
tgaacagcagcacgtctgataccat

SEQ ID NO: 280253 - DNA, 25 bp, Homo sapien
gtctgataccatcagctgggcagat

SEQ ID NO: 280254 - DNA, 25 bp, Homo sapien
ctgggcagatgcattaaggttaaat

SEQ ID NO: 280255 - DNA, 25 bp, Homo sapien
atctaagtgtcaagaaaaccctatt

SEQ ID NO: 280256 - DNA, 25 bp, Homo sapien
atgcagctgttaagcgtaacatggt

SEQ ID NO: 280257 - DNA, 25 bp, Homo sapien
ttattgtttactgttgtttcccctg

SEQ ID NO: 280258 - DNA, 25 bp, Homo sapien
tgttgtttcccctggctataatgta

SEQ ID NO: 280259 - DNA, 25 bp, Homo sapien
gctataatgtaagctccatgtgggc

SEQ ID NO: 280260 - DNA, 25 bp, Homo sapien
tttaatactgcagctgtctaccttc

SEQ ID NO: 280261 - DNA, 25 bp, Homo sapien
ttcactgatatatcacaagtgccta

SEQ ID NO: 280262 - DNA, 25 bp, Homo sapien
gctgtctaccttccagatcgagaaa

SEQ ID NO: 280263 - DNA, 25 bp, Homo sapien
gaactgaattgaactatgtatccat

SEQ ID NO: 280264 - DNA, 25 bp, Homo sapien
gaactatgtatccatgatgcaagta

SEQ ID NO: 280265 - DNA, 25 bp, Homo sapien
agatcgagaaatcccataccccttt

SEQ ID NO: 280266 - DNA, 25 bp, Homo sapien
cctttcacctgctctatgtttttca

SEQ ID NO: 280267 - DNA, 25 bp, Homo sapien
acctatcaccctagatacttcacat

SEQ ID NO: 280268 - DNA, 25 bp, Homo sapien
ttagccctattgtaatctgcaaact

SEQ ID NO: 280269 - DNA, 25 bp, Homo sapien
ctgcaaactactgttttccttgttt

SEQ ID NO: 280270 - DNA, 25 bp, Homo sapien
gaacttcagtagcttaacattggta

SEQ ID NO: 280271 - DNA, 25 bp, Homo sapien
cttcaactagccattcaatactgcc

SEQ ID NO: 280272 - DNA, 25 bp, Homo sapien
ttcaatactgcctaccattcttgta

SEQ ID NO: 280273 - DNA, 25 bp, Homo sapien
tgtatgtttttctagcagatttgct

SEQ ID NO: 280274 - DNA, 25 bp, Homo sapien
tgactttctcagatgacagttgaaa

SEQ ID NO: 280275 - DNA, 25 bp, Homo sapien
ccttccctgcttaactgagaaaaca

SEQ ID NO: 280276 - DNA, 25 bp, Homo sapien
ctgttcttctaattcatttacctga

SEQ ID NO: 280277 - DNA, 25 bp, Homo sapien
tttacctgagtcttccattgctgca

SEQ ID NO: 280278 - DNA, 25 bp, Homo sapien
attgctgcagttctttagccctatt

SEQ ID NO: 280279 - DNA, 25 bp, Homo sapien
tgctttctttcctccattacatcaa

SEQ ID NO: 280280 - DNA, 25 bp, Homo sapien
gctttctttcctccattacatcaat

SEQ ID NO: 280281 - DNA, 25 bp, Homo sapien
ctttctttcctccattacatcaatt

SEQ ID NO: 280282 - DNA, 25 bp, Homo sapien
tttctttcctccattacatcaattt

SEQ ID NO: 280283 - DNA, 25 bp, Homo sapien
tctttcctccattacatcaattttg

SEQ ID NO: 280284 - DNA, 25 bp, Homo sapien
gtaatacgtggccttgctggagctc

SEQ ID NO: 280285 - DNA, 25 bp, Homo sapien
gaagctaacaatgaacatatggtag

SEQ ID NO: 280286 - DNA, 25 bp, Homo sapien
aacatatggtagaagtgaggacaca

SEQ ID NO: 280287 - DNA, 25 bp, Homo sapien
gatgaaaactgggatcccactggaa

SEQ ID NO: 280288 - DNA, 25 bp, Homo sapien
gaaaactgggatcccactggaacaa

SEQ ID NO: 280289 - DNA, 25 bp, Homo sapien
aactgggatcccactggaacaaaga

SEQ ID NO: 280290 - DNA, 25 bp, Homo sapien
agatctttcattgtagtacttctga

SEQ ID NO: 280291 - DNA, 25 bp, Homo sapien
aattaaccaaaatcacagtattctg

SEQ ID NO: 280292 - DNA, 25 bp, Homo sapien
gatgattctacaaagcctgctgttt

SEQ ID NO: 280293 - DNA, 25 bp, Homo sapien
caaaggctgctgatgatttctacaa

SEQ ID NO: 280294 - DNA, 25 bp, Homo sapien
tacaaagcctgctgtagtgttgctg

SEQ ID NO: 280295 - DNA, 25 bp, Homo sapien
ctgctgtagtgttgctgtggcctct

SEQ ID NO: 280296 - DNA, 25 bp, Homo sapien
gctgtggcctctgcttaaaaaagta

SEQ ID NO: 280297 - DNA, 25 bp, Homo sapien
attgatgcagcatgttcaccccaac

SEQ ID NO: 280298 - DNA, 25 bp, Homo sapien
aacctccctgcctaaaggctcaggg

SEQ ID NO: 280299 - DNA, 25 bp, Homo sapien
aaaggctcagggaccatcttggaag

SEQ ID NO: 280300 - DNA, 25 bp, Homo sapien
gcgcgtgagattgtaagagccgaat

SEQ ID NO: 280301 - DNA, 25 bp, Homo sapien
cattaataagtaacagattttagga

SEQ ID NO: 280302 - DNA, 25 bp, Homo sapien
aaatctataaattgatcatctgttt

SEQ ID NO: 280303 - DNA, 25 bp, Homo sapien
aatctataaattgatcatctgttta

SEQ ID NO: 280304 - DNA, 25 bp, Homo sapien
atctataaattgatcatctgtttat

SEQ ID NO: 280305 - DNA, 25 bp, Homo sapien
ataaattgatcatctgtttataaat

SEQ ID NO: 280306 - DNA, 25 bp, Homo sapien
tgtttataaattggcagatggttgt

SEQ ID NO: 280307 - DNA, 25 bp, Homo sapien
tttataaattggcagatggttgtgt

SEQ ID NO: 280308 - DNA, 25 bp, Homo sapien
tataaattggcagatggttgtgtac

SEQ ID NO: 280309 - DNA, 25 bp, Homo sapien
tggcagatggttgtgtaccatcttt

SEQ ID NO: 280310 - DNA, 25 bp, Homo sapien
ggcagatggttgtgtaccatctttt

SEQ ID NO: 280311 - DNA, 25 bp, Homo sapien
gcagatggttgtgtaccatctttta

SEQ ID NO: 280312 - DNA, 25 bp, Homo sapien
aagtcttcgatctttcttacaagtg

SEQ ID NO: 280313 - DNA, 25 bp, Homo sapien
gtcttcgatctttcttacaagtgca

SEQ ID NO: 280314 - DNA, 25 bp, Homo sapien
ttcgatctttcttacaagtgcagag

SEQ ID NO: 280315 - DNA, 25 bp, Homo sapien
cgatctttcttacaagtgcagagaa

SEQ ID NO: 280316 - DNA, 25 bp, Homo sapien
aagggccgcctatcctgtaatcaca

SEQ ID NO: 280317 - DNA, 25 bp, Homo sapien
ggccgcctatcctgtaatcacatga

SEQ ID NO: 280318 - DNA, 25 bp, Homo sapien
ccgcctatcctgtaatcacatgact

SEQ ID NO: 280319 - DNA, 25 bp, Homo sapien
gcctatcctgtaatcacatgacttg

SEQ ID NO: 280320 - DNA, 25 bp, Homo sapien
tatcctgtaatcacatgacttgctt

SEQ ID NO: 280321 - DNA, 25 bp, Homo sapien
cctgtaatcacatgacttgcttcac

SEQ ID NO: 280322 - DNA, 25 bp, Homo sapien
taaagtcttcgatctttcttacaag

SEQ ID NO: 280323 - DNA, 25 bp, Homo sapien
tcacgtgaggtctgtgaggaccaat

SEQ ID NO: 280324 - DNA, 25 bp, Homo sapien
ttgtgggtagttcatcttccctcga

SEQ ID NO: 280325 - DNA, 25 bp, Homo sapien
ttccctcgattggttaactccttag

SEQ ID NO: 280326 - DNA, 25 bp, Homo sapien
aactccttagtttcagaccacagac

SEQ ID NO: 280327 - DNA, 25 bp, Homo sapien
gtttcagaccacagactcaagattg

SEQ ID NO: 280328 - DNA, 25 bp, Homo sapien
agactcaagattggctcttcccaga

SEQ ID NO: 280329 - DNA, 25 bp, Homo sapien
agagggcagcagacagtcaccccaa

SEQ ID NO: 280330 - DNA, 25 bp, Homo sapien
gacagtcaccccaaggcaggtgtag

SEQ ID NO: 280331 - DNA, 25 bp, Homo sapien
ccctgaagactctggtcccagtcag

SEQ ID NO: 280332 - DNA, 25 bp, Homo sapien
ctgtgacctgtgaccttctgccaga

SEQ ID NO: 280333 - DNA, 25 bp, Homo sapien
tctgccagaattgtcatgcctctga

SEQ ID NO: 280334 - DNA, 25 bp, Homo sapien
aactggtatgagttcttctttaact

SEQ ID NO: 280335 - DNA, 25 bp, Homo sapien
gagttcttctttaactgttcagtag

SEQ ID NO: 280336 - DNA, 25 bp, Homo sapien
tttctttgatgggagactctatatt

SEQ ID NO: 280337 - DNA, 25 bp, Homo sapien
gggagactctatattactgatttaa

SEQ ID NO: 280338 - DNA, 25 bp, Homo sapien
taatctcattactcatagttggtct

SEQ ID NO: 280339 - DNA, 25 bp, Homo sapien
catagttggtcttttcaggttttct

SEQ ID NO: 280340 - DNA, 25 bp, Homo sapien
ggtccaattttggtaagttgtatct

SEQ ID NO: 280341 - DNA, 25 bp, Homo sapien
ttttggtaagttgtatctgttcagg

SEQ ID NO: 280342 - DNA, 25 bp, Homo sapien
ggcatatagttgttcataatagtct

SEQ ID NO: 280343 - DNA, 25 bp, Homo sapien
tctgtggtatcggtttaatgtcttc

SEQ ID NO: 280344 - DNA, 25 bp, Homo sapien
gtggtatcggtttaatgtcttctag

SEQ ID NO: 280345 - DNA, 25 bp, Homo sapien
aggataccatactgcaacagaccga

SEQ ID NO: 280346 - DNA, 25 bp, Homo sapien
gataccatactgcaacagaccgaag

SEQ ID NO: 280347 - DNA, 25 bp, Homo sapien
accatactgcaacagaccgaaggcg

SEQ ID NO: 280348 - DNA, 25 bp, Homo sapien
tactgcaacagaccgaaggcggaag

SEQ ID NO: 280349 - DNA, 25 bp, Homo sapien
aggctttaaggatctgcaaaaatgt

SEQ ID NO: 280350 - DNA, 25 bp, Homo sapien
aatgtaaaacgatgccactcctact

SEQ ID NO: 280351 - DNA, 25 bp, Homo sapien
taaaacgatgccactcctactgatg

SEQ ID NO: 280352 - DNA, 25 bp, Homo sapien
aacgatgccactcctactgatgaaa

SEQ ID NO: 280353 - DNA, 25 bp, Homo sapien
cgatgccactcctactgatgaaata

SEQ ID NO: 280354 - DNA, 25 bp, Homo sapien
gtaatggatgtatagtcttcaaatg

SEQ ID NO: 280355 - DNA, 25 bp, Homo sapien
ggatgtatagtcttcaaatggatga

SEQ ID NO: 280356 - DNA, 25 bp, Homo sapien
cctttgctggctccaaacaatgact

SEQ ID NO: 280357 - DNA, 25 bp, Homo sapien
tgctggctccaaacaatgactcttt

SEQ ID NO: 280358 - DNA, 25 bp, Homo sapien
tggctccaaacaatgactctttcct

SEQ ID NO: 280359 - DNA, 25 bp, Homo sapien
gctccaaacaatgactctttcctat

SEQ ID NO: 280360 - DNA, 25 bp, Homo sapien
aacaatgactctttcctatcttttt

SEQ ID NO: 280361 - DNA, 25 bp, Homo sapien
gcttttctagagttccagtaatgga

SEQ ID NO: 280362 - DNA, 25 bp, Homo sapien
agagttccagtaatggaatcataca

SEQ ID NO: 280363 - DNA, 25 bp, Homo sapien
cagttctggatgctgaaaagtttat

SEQ ID NO: 280364 - DNA, 25 bp, Homo sapien
ggcactagcaggtttggtgtctgag

SEQ ID NO: 280365 - DNA, 25 bp, Homo sapien
tgtctgagggcccagtttctaattt

SEQ ID NO: 280366 - DNA, 25 bp, Homo sapien
tttgaagatggtgctttaaacactg

SEQ ID NO: 280367 - DNA, 25 bp, Homo sapien
gcgcctggccccgtattcatttttt

SEQ ID NO: 280368 - DNA, 25 bp, Homo sapien
ttcattttttatactggaaaacatt

SEQ ID NO: 280369 - DNA, 25 bp, Homo sapien
agcataaaaatgaatactccaaaga

SEQ ID NO: 280370 - DNA, 25 bp, Homo sapien
tatggcaaattaaaagggacacggt

SEQ ID NO: 280371 - DNA, 25 bp, Homo sapien
ttaaaagggacacggtactatgatt

SEQ ID NO: 280372 - DNA, 25 bp, Homo sapien
aagggacacggtactatgatttaat

SEQ ID NO: 280373 - DNA, 25 bp, Homo sapien
gggacacggtactatgatttaatta

SEQ ID NO: 280374 - DNA, 25 bp, Homo sapien
gacacggtactatgatttaattact

SEQ ID NO: 280375 - DNA, 25 bp, Homo sapien
actatgatttaattactgtcttgtc

SEQ ID NO: 280376 - DNA, 25 bp, Homo sapien
tatgatttaattactgtcttgtctt

SEQ ID NO: 280377 - DNA, 25 bp, Homo sapien
gatttaattactgtcttgtcttttt

SEQ ID NO: 280378 - DNA, 25 bp, Homo sapien
gccccgatagaggatggattcacat

SEQ ID NO: 280379 - DNA, 25 bp, Homo sapien
atggattcacatcaggcgccgcgca

SEQ ID NO: 280380 - DNA, 25 bp, Homo sapien
tcctgctcaagttttgcgatcagat

SEQ ID NO: 280381 - DNA, 25 bp, Homo sapien
gtgcgaggttcgcaagccacgcctc

SEQ ID NO: 280382 - DNA, 25 bp, Homo sapien
caagttttgcgatcagattcattac

SEQ ID NO: 280383 - DNA, 25 bp, Homo sapien
aggtccggccgcttccgcaacgtat

SEQ ID NO: 280384 - DNA, 25 bp, Homo sapien
ttccgcaacgtattcctcagtgctt

SEQ ID NO: 280385 - DNA, 25 bp, Homo sapien
agattcattactgactccttttgcc

SEQ ID NO: 280386 - DNA, 25 bp, Homo sapien
attactgactccttttgccatcttg

SEQ ID NO: 280387 - DNA, 25 bp, Homo sapien
tttgccatcttgtcggcgttggcac

SEQ ID NO: 280388 - DNA, 25 bp, Homo sapien
gcctggccccgatagaggatggatt

SEQ ID NO: 280389 - DNA, 25 bp, Homo sapien
agcagagtactcatgatgcctttga

SEQ ID NO: 280390 - DNA, 25 bp, Homo sapien
gtatataatctacccttaacagagc

SEQ ID NO: 280391 - DNA, 25 bp, Homo sapien
caaaacatcatgtagggtgacctag

SEQ ID NO: 280392 - DNA, 25 bp, Homo sapien
catgtagggtgacctagtttccaaa

SEQ ID NO: 280393 - DNA, 25 bp, Homo sapien
tgacctagtttccaaaccaataaat

SEQ ID NO: 280394 - DNA, 25 bp, Homo sapien
atctacccttaacagagcttttctt

SEQ ID NO: 280395 - DNA, 25 bp, Homo sapien
tacttattaagtactgctttttaca

SEQ ID NO: 280396 - DNA, 25 bp, Homo sapien
gacaactgtttctttctatgcatat

SEQ ID NO: 280397 - DNA, 25 bp, Homo sapien
ttacagtgctaaaatgatttctgat

SEQ ID NO: 280398 - DNA, 25 bp, Homo sapien
gatttctgataaaatggtccctaac

SEQ ID NO: 280399 - DNA, 25 bp, Homo sapien
tggtccctaactcaactagaaggct

SEQ ID NO: 280400 - DNA, 25 bp, Homo sapien
gatccagttaaatgcgagtgcttcc

SEQ ID NO: 280401 - DNA, 25 bp, Homo sapien
aatgcgagtgcttcctagttataca

SEQ ID NO: 280402 - DNA, 25 bp, Homo sapien
gaaggcttcctcctgttgtaatcac

SEQ ID NO: 280403 - DNA, 25 bp, Homo sapien
gcttcctagttatacatggcgactg

SEQ ID NO: 280404 - DNA, 25 bp, Homo sapien
catggcgactgctgagaagggactc

SEQ ID NO: 280405 - DNA, 25 bp, Homo sapien
gttcactcctctagcctcatttaga

SEQ ID NO: 280406 - DNA, 25 bp, Homo sapien
tagcctcatttagagctcgcattaa

SEQ ID NO: 280407 - DNA, 25 bp, Homo sapien
ttaagagcacgggatctggatccac

SEQ ID NO: 280408 - DNA, 25 bp, Homo sapien
ctggatccacactgtttggattcaa

SEQ ID NO: 280409 - DNA, 25 bp, Homo sapien
ttgtaatcactaaccccaactctgt

SEQ ID NO: 280410 - DNA, 25 bp, Homo sapien
tcccttgcccgattcattcattcgt

SEQ ID NO: 280411 - DNA, 25 bp, Homo sapien
gaaagagctaaaacgtcatcctctc

SEQ ID NO: 280412 - DNA, 25 bp, Homo sapien
tcctctcttcagtgatgtggactgg

SEQ ID NO: 280413 - DNA, 25 bp, Homo sapien
gtggactgggaaaatctgcagcatc

SEQ ID NO: 280414 - DNA, 25 bp, Homo sapien
aaaatctgcagcatcagactatgcc

SEQ ID NO: 280415 - DNA, 25 bp, Homo sapien
gatgaaacagatacctcctattttg

SEQ ID NO: 280416 - DNA, 25 bp, Homo sapien
aaacagatacctcctattttgaagc

SEQ ID NO: 280417 - DNA, 25 bp, Homo sapien
gtatctggatttagtctgtagcaca

SEQ ID NO: 280418 - DNA, 25 bp, Homo sapien
tagtctgtagcacaaaaattttcct

SEQ ID NO: 280419 - DNA, 25 bp, Homo sapien
agttatctgataatgctcaaagtgc

SEQ ID NO: 280420 - DNA, 25 bp, Homo sapien
tgctcaaagtgcagtagaaatactt

SEQ ID NO: 280421 - DNA, 25 bp, Homo sapien
gaaatacttttaaccattgatgata

SEQ ID NO: 280422 - DNA, 25 bp, Homo sapien
gttgaaatggttggcatcctcccac

SEQ ID NO: 280423 - DNA, 25 bp, Homo sapien
tgtgtcccctcgctctgttgttcca

SEQ ID NO: 280424 - DNA, 25 bp, Homo sapien
tgttgttccagctatgtcccctctg

SEQ ID NO: 280425 - DNA, 25 bp, Homo sapien
tctgttgctccaactgcagctcatt

SEQ ID NO: 280426 - DNA, 25 bp, Homo sapien
gcagctcattctgttagagttcctc

SEQ ID NO: 280427 - DNA, 25 bp, Homo sapien
tcattctgttagagttcctcattca

SEQ ID NO: 280428 - DNA, 25 bp, Homo sapien
gctcccttcctcaagtattcttaaa

SEQ ID NO: 280429 - DNA, 25 bp, Homo sapien
tcctggctctcccttgagttatttt

SEQ ID NO: 280430 - DNA, 25 bp, Homo sapien
attttcctttcttcgctatcttggg

SEQ ID NO: 280431 - DNA, 25 bp, Homo sapien
cttcgctatcttgggactcttcttt

SEQ ID NO: 280432 - DNA, 25 bp, Homo sapien
catcggttgagagaaggacttcttc

SEQ ID NO: 280433 - DNA, 25 bp, Homo sapien
actctttcttgctttaggactctga

SEQ ID NO: 280434 - DNA, 25 bp, Homo sapien
ttcttgctttaggactctgaaaaca

SEQ ID NO: 280435 - DNA, 25 bp, Homo sapien
acaaaggtcaagctctaagaaaatt

SEQ ID NO: 280436 - DNA, 25 bp, Homo sapien
aattactgctcaaacttcactaccc

SEQ ID NO: 280437 - DNA, 25 bp, Homo sapien
ttcactaccctggaagccttactag

SEQ ID NO: 280438 - DNA, 25 bp, Homo sapien
accctggaagccttactagatattt

SEQ ID NO: 280439 - DNA, 25 bp, Homo sapien
gataggttacttacagtagcacaga

SEQ ID NO: 280440 - DNA, 25 bp, Homo sapien
gtagcacagaaatgttagcatattt

SEQ ID NO: 280441 - DNA, 25 bp, Homo sapien
tggcttctcccgctagagtaaatgg

SEQ ID NO: 280442 - DNA, 25 bp, Homo sapien
ttctcccgctagagtaaatggcttt

SEQ ID NO: 280443 - DNA, 25 bp, Homo sapien
gagcctgctgtcctgcaggcaagtc

SEQ ID NO: 280444 - DNA, 25 bp, Homo sapien
atacccatattaatcctatgttaag

SEQ ID NO: 280445 - DNA, 25 bp, Homo sapien
ttaatcctatgttaagatgctctgg

SEQ ID NO: 280446 - DNA, 25 bp, Homo sapien
gatgctctggaaataaaggccttat

SEQ ID NO: 280447 - DNA, 25 bp, Homo sapien
taaaggccttattcccttacacatg

SEQ ID NO: 280448 - DNA, 25 bp, Homo sapien
tattcccttacacatgcgatttttg

SEQ ID NO: 280449 - DNA, 25 bp, Homo sapien
tgtgggtggtctgtgtagttactcc

SEQ ID NO: 280450 - DNA, 25 bp, Homo sapien
gtctgtgtagttactccccatacaa

SEQ ID NO: 280451 - DNA, 25 bp, Homo sapien
agttactccccatacaacaaagctg

SEQ ID NO: 280452 - DNA, 25 bp, Homo sapien
acacaatgtattctgcattttcaaa

SEQ ID NO: 280453 - DNA, 25 bp, Homo sapien
tatcttactgatatgcgttgaccaa

SEQ ID NO: 280454 - DNA, 25 bp, Homo sapien
ctgatatgcgttgaccaaatcccat

SEQ ID NO: 280455 - DNA, 25 bp, Homo sapien
ggatatgacggtaggaaaacctggt

SEQ ID NO: 280456 - DNA, 25 bp, Homo sapien
ggaaaacctggttggatgtattaca

SEQ ID NO: 280457 - DNA, 25 bp, Homo sapien
gatgtattacagagacatacacata

SEQ ID NO: 280458 - DNA, 25 bp, Homo sapien
gattcacacagtaaagacagttgcc

SEQ ID NO: 280459 - DNA, 25 bp, Homo sapien
gatcttataaaaggaccatgtaatt

SEQ ID NO: 280460 - DNA, 25 bp, Homo sapien
atgactctaaagaattgtattccag

SEQ ID NO: 280461 - DNA, 25 bp, Homo sapien
aagacagttgccaaagtaatctgca

SEQ ID NO: 280462 - DNA, 25 bp, Homo sapien
gccaaagtaatctgcaatgaggaaa

SEQ ID NO: 280463 - DNA, 25 bp, Homo sapien
gggttgtacgtcatgtcttggttta

SEQ ID NO: 280464 - DNA, 25 bp, Homo sapien
gttgtacgtcatgtcttggtttaga

SEQ ID NO: 280465 - DNA, 25 bp, Homo sapien
cgtcatgtcttggtttagactacac

SEQ ID NO: 280466 - DNA, 25 bp, Homo sapien
tgtgtcaattgaaccactcactggt

SEQ ID NO: 280467 - DNA, 25 bp, Homo sapien
actcactggttctgtgacctcagtt

SEQ ID NO: 280468 - DNA, 25 bp, Homo sapien
acctcagttcttcgtagactctgga
